United States Patent 7,655,785 (BIOINFORMATICALLY DETECTABLE GROUP OF NOVEL REGULATORY OLIGONUCLEOTIDES AND USES THEREOF) - sequence listing, part 35

SEQ ID NO: 1437022 - RNA, 14 nt, Homo sapiens
cuacucagacuguu

SEQ ID NO: 1437023 - RNA, 23 nt, Homo sapiens
cuacucagacuguugcacucuaa

SEQ ID NO: 1437024 - RNA, 16 nt, Homo sapiens
cuacucucaccgacuu

SEQ ID NO: 1437025 - RNA, 12 nt, Homo sapiens
cuacuugccaca

SEQ ID NO: 1437026 - RNA, 22 nt, Homo sapiens
cuagaaccaagcuucagagccu

SEQ ID NO: 1437027 - RNA, 20 nt, Homo sapiens
cuagaacccccacauuuacc

SEQ ID NO: 1437028 - RNA, 19 nt, Homo sapiens
cuagaaccuagaagggcua

SEQ ID NO: 1437029 - RNA, 19 nt, Homo sapiens
cuagaaccuggagggcuag

SEQ ID NO: 1437030 - RNA, 12 nt, Homo sapiens
cuagaaggccac

SEQ ID NO: 1437031 - RNA, 13 nt, Homo sapiens
cuagaagggcuag

SEQ ID NO: 1437032 - RNA, 13 nt, Homo sapiens
cuagaaugcacac

SEQ ID NO: 1437033 - RNA, 18 nt, Homo sapiens
cuagaaugcacaccaaaa

SEQ ID NO: 1437034 - RNA, 23 nt, Homo sapiens
cuagagauauggcagcgaaagga

SEQ ID NO: 1437035 - RNA, 19 nt, Homo sapiens
cuagagccugugcuaaaga

SEQ ID NO: 1437036 - RNA, 18 nt, Homo sapiens
cuagagugcaguggugca

SEQ ID NO: 1437037 - RNA, 18 nt, Homo sapiens
cuagaucuuacaucugca

SEQ ID NO: 1437038 - RNA, 17 nt, Homo sapiens
cuagcaagaccuguugg

SEQ ID NO: 1437039 - RNA, 16 nt, Homo sapiens
cuagcaggaauauuuc

SEQ ID NO: 1437040 - RNA, 22 nt, Homo sapiens
cuagccaugauaacugcaauuu

SEQ ID NO: 1437041 - RNA, 15 nt, Homo sapiens
cuagcccacuuguca

SEQ ID NO: 1437042 - RNA, 19 nt, Homo sapiens
cuagcgugcccugccccuc

SEQ ID NO: 1437043 - RNA, 10 nt, Homo sapiens
caauagucaa

SEQ ID NO: 1437044 - RNA, 17 nt, Homo sapiens
caauaucugacaguuac

SEQ ID NO: 1437045 - RNA, 14 nt, Homo sapiens
caauaucuucauac

SEQ ID NO: 1437046 - RNA, 23 nt, Homo sapiens
caauauuucccccuuacuacuuc

SEQ ID NO: 1437047 - RNA, 13 nt, Homo sapiens
caaucagcacuga

SEQ ID NO: 1437048 - RNA, 14 nt, Homo sapiens
caaucagcacugaa

SEQ ID NO: 1437049 - RNA, 15 nt, Homo sapiens
caaucagcacugaaa

SEQ ID NO: 1437050 - RNA, 17 nt, Homo sapiens
caaucaugaguaccuca

SEQ ID NO: 1437051 - RNA, 12 nt, Homo sapiens
caaucccaaaag

SEQ ID NO: 1437052 - RNA, 21 nt, Homo sapiens
caauccugcccccagccaugg

SEQ ID NO: 1437053 - RNA, 12 nt, Homo sapiens
caauccuuaaca

SEQ ID NO: 1437054 - RNA, 22 nt, Homo sapiens
caauccuuaacauauuugcaca

SEQ ID NO: 1437055 - RNA, 19 nt, Homo sapiens
caaucucaucugauaugca

SEQ ID NO: 1437056 - RNA, 16 nt, Homo sapiens
caaucucgcaguacau

SEQ ID NO: 1437057 - RNA, 19 nt, Homo sapiens
caaucuucggggugugaug

SEQ ID NO: 1437058 - RNA, 18 nt, Homo sapiens
caaugaaaccaaagccag

SEQ ID NO: 1437059 - RNA, 13 nt, Homo sapiens
caaugaccuguau

SEQ ID NO: 1437060 - RNA, 19 nt, Homo sapiens
caaugcaaagauucacaua

SEQ ID NO: 1437061 - RNA, 19 nt, Homo sapiens
caaugcacauccauuccca

SEQ ID NO: 1437062 - RNA, 17 nt, Homo sapiens
caaugcacauuaguuuu

SEQ ID NO: 1437063 - RNA, 16 nt, Homo sapiens
caaugcacgcacacau

SEQ ID NO: 1437064 - RNA, 22 nt, Homo sapiens
caaugccuugacaacagacuga

SEQ ID NO: 1437065 - RNA, 23 nt, Homo sapiens
caaugccuuuuugauuacagugu

SEQ ID NO: 1437066 - RNA, 11 nt, Homo sapiens
caaugcuauaa

SEQ ID NO: 1437067 - RNA, 18 nt, Homo sapiens
caaugcuggcuuucuccc

SEQ ID NO: 1437068 - RNA, 16 nt, Homo sapiens
caauggagacugucuc

SEQ ID NO: 1437069 - RNA, 16 nt, Homo sapiens
caaugggcacugggau

SEQ ID NO: 1437070 - RNA, 16 nt, Homo sapiens
caaugguagcaaaaca

SEQ ID NO: 1437071 - RNA, 18 nt, Homo sapiens
caauguuuuuaaaaaucu

SEQ ID NO: 1437072 - RNA, 12 nt, Homo sapiens
caauuaaugaca

SEQ ID NO: 1437073 - RNA, 16 nt, Homo sapiens
caauuauuacauuuau

SEQ ID NO: 1437074 - RNA, 20 nt, Homo sapiens
caauuccaaaggaaucucca

SEQ ID NO: 1437075 - RNA, 16 nt, Homo sapiens
caauucuccugccuca

SEQ ID NO: 1437076 - RNA, 20 nt, Homo sapiens
ucuggaagccuggacucuaa

SEQ ID NO: 1437077 - RNA, 17 nt, Homo sapiens
ucuggaccagccuguug

SEQ ID NO: 1437078 - RNA, 17 nt, Homo sapiens
ucuggauggcaccagag

SEQ ID NO: 1437079 - RNA, 16 nt, Homo sapiens
ucuggccaggcauggc

SEQ ID NO: 1437080 - RNA, 20 nt, Homo sapiens
ucuggccugggcgacagagc

SEQ ID NO: 1437081 - RNA, 20 nt, Homo sapiens
ucuggcuaaauggacaucau

SEQ ID NO: 1437082 - RNA, 18 nt, Homo sapiens
ucuggcugaggauuucaa

SEQ ID NO: 1437083 - RNA, 22 nt, Homo sapiens
ucugggagggauguucuagccc

SEQ ID NO: 1437084 - RNA, 19 nt, Homo sapiens
ucuguagcuuguucccugu

SEQ ID NO: 1437085 - RNA, 21 nt, Homo sapiens
ucuguccagaggcugcaagga

SEQ ID NO: 1437086 - RNA, 17 nt, Homo sapiens
ucugucuuccuucauua

SEQ ID NO: 1437087 - RNA, 23 nt, Homo sapiens
ucugugcuuugacucaccuguua

SEQ ID NO: 1437088 - RNA, 13 nt, Homo sapiens
ucuguguggugcc

SEQ ID NO: 1437089 - RNA, 21 nt, Homo sapiens
ucuguucuguugaucccacuu

SEQ ID NO: 1437090 - RNA, 14 nt, Homo sapiens
ucuguuguccauca

SEQ ID NO: 1437091 - RNA, 16 nt, Homo sapiens
ucuguuucccaccuca

SEQ ID NO: 1437092 - RNA, 18 nt, Homo sapiens
ucuguuuuuuuaagaaag

SEQ ID NO: 1437093 - RNA, 18 nt, Homo sapiens
ucuuaaaacacuuuucaa

SEQ ID NO: 1437094 - RNA, 15 nt, Homo sapiens
ucuuaaaauguuaac

SEQ ID NO: 1437095 - RNA, 15 nt, Homo sapiens
ucuuaaaauucuugg

SEQ ID NO: 1437096 - RNA, 15 nt, Homo sapiens
ucuuaauaggcuuua

SEQ ID NO: 1437097 - RNA, 16 nt, Homo sapiens
ucuuaauaggcuuuau

SEQ ID NO: 1437098 - RNA, 19 nt, Homo sapiens
ucuuacaguggagugagau

SEQ ID NO: 1437099 - RNA, 14 nt, Homo sapiens
ucuuacuuaugugu

SEQ ID NO: 1437100 - RNA, 19 nt, Homo sapiens
ucuuagccucccaaagugc

SEQ ID NO: 1437101 - RNA, 11 nt, Homo sapiens
ucuuagcuguc

SEQ ID NO: 1437102 - RNA, 11 nt, Homo sapiens
ucuuauacuuc

SEQ ID NO: 1437103 - RNA, 18 nt, Homo sapiens
ucuuauuagaacaggcaa

SEQ ID NO: 1437104 - RNA, 18 nt, Homo sapiens
ucuuauucaugcuuucuc

SEQ ID NO: 1437105 - RNA, 19 nt, Homo sapiens
ucuuauucccaaacuacag

SEQ ID NO: 1437106 - RNA, 14 nt, Homo sapiens
ucuuauuuccucaa

SEQ ID NO: 1437107 - RNA, 18 nt, Homo sapiens
ucuucaccccccacucac

SEQ ID NO: 1437108 - RNA, 20 nt, Homo sapiens
ucuucacuucagacaauuca

SEQ ID NO: 1437109 - RNA, 21 nt, Homo sapiens
ucuucaggguguuaaggcagu

SEQ ID NO: 1437110 - RNA, 22 nt, Homo sapiens
ucuuccacccauucccccaugu

SEQ ID NO: 1437111 - RNA, 19 nt, Homo sapiens
ucuuccagaagaugcccuc

SEQ ID NO: 1437112 - RNA, 17 nt, Homo sapiens
ucuuccagcaugcaucc

SEQ ID NO: 1437113 - RNA, 14 nt, Homo sapiens
ucuucccaccucag

SEQ ID NO: 1437114 - RNA, 23 nt, Homo sapiens
ucuucccuguaugauuccuugau

SEQ ID NO: 1437115 - RNA, 14 nt, Homo sapiens
ucuuccugccucag

SEQ ID NO: 1437116 - RNA, 20 nt, Homo sapiens
ucuucgguguuuaaagucaa

SEQ ID NO: 1437117 - RNA, 15 nt, Homo sapiens
ucuucuaaccucagc

SEQ ID NO: 1437118 - RNA, 15 nt, Homo sapiens
ucuucuacaaccaga

SEQ ID NO: 1437119 - RNA, 19 nt, Homo sapiens
ucuucuccaacaccaccuc

SEQ ID NO: 1437120 - RNA, 14 nt, Homo sapiens
ucuucucccugugu

SEQ ID NO: 1437121 - RNA, 17 nt, Homo sapiens
ucuucuccuaugcauuu

SEQ ID NO: 1437122 - RNA, 13 nt, Homo sapiens
ucuucugucugca

SEQ ID NO: 1437123 - RNA, 19 nt, Homo sapiens
ucuucuuguguccugauga

SEQ ID NO: 1437124 - RNA, 19 nt, Homo sapiens
ucuucuuuuuuugugaugu

SEQ ID NO: 1437125 - RNA, 17 nt, Homo sapiens
ucuugaaaucugaaugc

SEQ ID NO: 1437126 - RNA, 17 nt, Homo sapiens
ucuugacauucaaggca

SEQ ID NO: 1437127 - RNA, 13 nt, Homo sapiens
ucuugcagaucaa

SEQ ID NO: 1437128 - RNA, 13 nt, Homo sapiens
ucuugcauugcaa

SEQ ID NO: 1437129 - RNA, 13 nt, Homo sapiens
ucuugcucaaaaa

SEQ ID NO: 1437130 - RNA, 19 nt, Homo sapiens
ucuuggaccucugcucuga

SEQ ID NO: 1437131 - RNA, 13 nt, Homo sapiens
ucuugugccucag

SEQ ID NO: 1437132 - RNA, 20 nt, Homo sapiens
ucuuuaauuuguuaucucaa

SEQ ID NO: 1437133 - RNA, 12 nt, Homo sapiens
ucuuuaccugag

SEQ ID NO: 1437134 - RNA, 13 nt, Homo sapiens
ucuuuacuagaua

SEQ ID NO: 1437135 - RNA, 16 nt, Homo sapiens
ucuuuaguucugucag

SEQ ID NO: 1437136 - RNA, 22 nt, Homo sapiens
ucuuucaaaguguaagcacuuc

SEQ ID NO: 1437137 - RNA, 22 nt, Homo sapiens
ucuuucagauggaggugccaua

SEQ ID NO: 1437138 - RNA, 14 nt, Homo sapiens
ucuuuccccaccuc

SEQ ID NO: 1437139 - RNA, 18 nt, Homo sapiens
ucuuucuaacuccaguga

SEQ ID NO: 1437140 - RNA, 19 nt, Homo sapiens
ucuuuguaaugucaccacc

SEQ ID NO: 1437141 - RNA, 21 nt, Homo sapiens
ucuuuguaaugucaccaccuu

SEQ ID NO: 1437142 - RNA, 16 nt, Homo sapiens
ugaccgaguaccugcu

SEQ ID NO: 1437143 - RNA, 15 nt, Homo sapiens
ugaccucacagugac

SEQ ID NO: 1437144 - RNA, 12 nt, Homo sapiens
ugaccucagcug

SEQ ID NO: 1437145 - RNA, 23 nt, Homo sapiens
ugaccuguuagaugugacacauu

SEQ ID NO: 1437146 - RNA, 23 nt, Homo sapiens
ugaccuguuauuaccauuagcau

SEQ ID NO: 1437147 - RNA, 18 nt, Homo sapiens
ugaccuuggagagacaca

SEQ ID NO: 1437148 - RNA, 21 nt, Homo sapiens
ugaccuuggagagacacagcg

SEQ ID NO: 1437149 - RNA, 21 nt, Homo sapiens
ugaccuuguugcaugauguau

SEQ ID NO: 1437150 - RNA, 22 nt, Homo sapiens
ugaccuuguugcaugauguauu

SEQ ID NO: 1437151 - RNA, 22 nt, Homo sapiens
ugacgucacuggaccacugggc

SEQ ID NO: 1437152 - RNA, 16 nt, Homo sapiens
ugacuaucacauacaa

SEQ ID NO: 1437153 - RNA, 16 nt, Homo sapiens
ugacucagcauaccug

SEQ ID NO: 1437154 - RNA, 19 nt, Homo sapiens
ugacuccucuaagccacuc

SEQ ID NO: 1437155 - RNA, 21 nt, Homo sapiens
ugacugaauuugggccucuug

SEQ ID NO: 1437156 - RNA, 18 nt, Homo sapiens
ugacugauguuacaucac

SEQ ID NO: 1437157 - RNA, 17 nt, Homo sapiens
ugacuuuuucagaguug

SEQ ID NO: 1437158 - RNA, 13 nt, Homo sapiens
ugagaaaaucagu

SEQ ID NO: 1437159 - RNA, 13 nt, Homo sapiens
uacaccacucugg

SEQ ID NO: 1437160 - RNA, 19 nt, Homo sapiens
uacaccuguugcaccucag

SEQ ID NO: 1437161 - RNA, 21 nt, Homo sapiens
uacacuuggagcccgugcagu

SEQ ID NO: 1437162 - RNA, 22 nt, Homo sapiens
uacacuuguauaaauguauaua

SEQ ID NO: 1437163 - RNA, 19 nt, Homo sapiens
uacagaauggaaccaaaau

SEQ ID NO: 1437164 - RNA, 15 nt, Homo sapiens
uacagacgucucaag

SEQ ID NO: 1437165 - RNA, 18 nt, Homo sapiens
uacagacuucuccagacc

SEQ ID NO: 1437166 - RNA, 17 nt, Homo sapiens
uacagagaagugaauaa

SEQ ID NO: 1437167 - RNA, 15 nt, Homo sapiens
uacagagaaucugaa

SEQ ID NO: 1437168 - RNA, 19 nt, Homo sapiens
uacagaguuuaugauuuaa

SEQ ID NO: 1437169 - RNA, 14 nt, Homo sapiens
uacagauagucaaa

SEQ ID NO: 1437170 - RNA, 23 nt, Homo sapiens
uacagcagaaaaucuuuuacuag

SEQ ID NO: 1437171 - RNA, 17 nt, Homo sapiens
uacagcagugucaucag

SEQ ID NO: 1437172 - RNA, 16 nt, Homo sapiens
uacagggcccagguga

SEQ ID NO: 1437173 - RNA, 18 nt, Homo sapiens
uacaggugcaagccacua

SEQ ID NO: 1437174 - RNA, 21 nt, Homo sapiens
uacaggugcaagccacuaugu

SEQ ID NO: 1437175 - RNA, 16 nt, Homo sapiens
uacauacauacauaca

SEQ ID NO: 1437176 - RNA, 17 nt, Homo sapiens
uacauacauacauauau

SEQ ID NO: 1437177 - RNA, 13 nt, Homo sapiens
uacauacauauau

SEQ ID NO: 1437178 - RNA, 22 nt, Homo sapiens
uacauagauggaccaguagaca

SEQ ID NO: 1437179 - RNA, 18 nt, Homo sapiens
uacauaguucuuacuacu

SEQ ID NO: 1437180 - RNA, 23 nt, Homo sapiens
uacauauauauauacacauacau

SEQ ID NO: 1437181 - RNA, 20 nt, Homo sapiens
uacaugacucagcauaccug

SEQ ID NO: 1437182 - RNA, 13 nt, Homo sapiens
uacauguaaucca

SEQ ID NO: 1437183 - RNA, 16 nt, Homo sapiens
uacauguaauccauca

SEQ ID NO: 1437184 - RNA, 19 nt, Homo sapiens
uacauguguggauguguaa

SEQ ID NO: 1437185 - RNA, 14 nt, Homo sapiens
uacauguguguaua

SEQ ID NO: 1437186 - RNA, 19 nt, Homo sapiens
uacauucuuuaucuugaca

SEQ ID NO: 1437187 - RNA, 16 nt, Homo sapiens
uaagaaaacaaucaca

SEQ ID NO: 1437188 - RNA, 14 nt, Homo sapiens
uaagaaaauuuacu

SEQ ID NO: 1437189 - RNA, 17 nt, Homo sapiens
uaagagaagaugugauu

SEQ ID NO: 1437190 - RNA, 20 nt, Homo sapiens
uaagagaagaugugauuuau

SEQ ID NO: 1437191 - RNA, 15 nt, Homo sapiens
uaagagaaugaauua

SEQ ID NO: 1437192 - RNA, 24 nt, Homo sapiens
uaagaguagcaaguucuagagaag

SEQ ID NO: 1437193 - RNA, 23 nt, Homo sapiens
uaagauuguccagugcaaccaca

SEQ ID NO: 1437194 - RNA, 14 nt, Homo sapiens
uaagcaaaaccacu

SEQ ID NO: 1437195 - RNA, 23 nt, Homo sapiens
uaagcccagcucugcuuuuucca

SEQ ID NO: 1437196 - RNA, 16 nt, Homo sapiens
uaagcuaggaaugaaa

SEQ ID NO: 1437197 - RNA, 19 nt, Homo sapiens
uaagcucccagggccuguc

SEQ ID NO: 1437198 - RNA, 12 nt, Homo sapiens
uaagcucuggcu

SEQ ID NO: 1437199 - RNA, 22 nt, Homo sapiens
uaagcugggaaaaaaguuuuga

SEQ ID NO: 1437200 - RNA, 13 nt, Homo sapiens
uaagcuguaaaaa

SEQ ID NO: 1437201 - RNA, 15 nt, Homo sapiens
uaaggauugugauau

SEQ ID NO: 1437202 - RNA, 14 nt, Homo sapiens
uaagggaaacugcc

SEQ ID NO: 1437203 - RNA, 17 nt, Homo sapiens
uaagguaauucauggca

SEQ ID NO: 1437204 - RNA, 13 nt, Homo sapiens
uaagguacuuaaa

SEQ ID NO: 1437205 - RNA, 20 nt, Homo sapiens
uaagguacuuaaagcuucua

SEQ ID NO: 1437206 - RNA, 20 nt, Homo sapiens
uaagguguugguguauuugc

SEQ ID NO: 1437207 - RNA, 23 nt, Homo sapiens
uaagguguugguguauuugccag

SEQ ID NO: 1437208 - RNA, 13 nt, Homo sapiens
uaaguaaaaccac

SEQ ID NO: 1437209 - RNA, 15 nt, Homo sapiens
uaaguaaaccaaaaa

SEQ ID NO: 1437210 - RNA, 13 nt, Homo sapiens
uaaguaauuauuc

SEQ ID NO: 1437211 - RNA, 12 nt, Homo sapiens
uaaguacaaaua

SEQ ID NO: 1437212 - RNA, 23 nt, Homo sapiens
uaaguaccccugauaagcaaauu

SEQ ID NO: 1437213 - RNA, 22 nt, Homo sapiens
uaaguggcuuuuuaacaugaaa

SEQ ID NO: 1437214 - RNA, 18 nt, Homo sapiens
uaagugguauauacauau

SEQ ID NO: 1437215 - RNA, 14 nt, Homo sapiens
uaaguuuaucuuuc

SEQ ID NO: 1437216 - RNA, 13 nt, Homo sapiens
gaggccuuggaaa

SEQ ID NO: 1437217 - RNA, 21 nt, Homo sapiens
gaggcgcagcccgaagcccag

SEQ ID NO: 1437218 - RNA, 12 nt, Homo sapiens
gaggcuccugug

SEQ ID NO: 1437219 - RNA, 15 nt, Homo sapiens
gaggcuuccagagag

SEQ ID NO: 1437220 - RNA, 14 nt, Homo sapiens
gagggagagcaccu

SEQ ID NO: 1437221 - RNA, 18 nt, Homo sapiens
gagggagguuccucgcag

SEQ ID NO: 1437222 - RNA, 21 nt, Homo sapiens
gagggauucuggucuucacug

SEQ ID NO: 1437223 - RNA, 20 nt, Homo sapiens
gagggggccuucacagugac

SEQ ID NO: 1437224 - RNA, 21 nt, Homo sapiens
gagguaaaagugugagcagug

SEQ ID NO: 1437225 - RNA, 22 nt, Homo sapiens
gagguaccagcaauauguaaau

SEQ ID NO: 1437226 - RNA, 16 nt, Homo sapiens
gagguccugagcacug

SEQ ID NO: 1437227 - RNA, 17 nt, Homo sapiens
gagguccugagcacugc

SEQ ID NO: 1437228 - RNA, 16 nt, Homo sapiens
gaggugagaccaccuc

SEQ ID NO: 1437229 - RNA, 15 nt, Homo sapiens
gagguggacaguccu

SEQ ID NO: 1437230 - RNA, 18 nt, Homo sapiens
gagguggagguugcagug

SEQ ID NO: 1437231 - RNA, 19 nt, Homo sapiens
gagguggagguugcaguga

SEQ ID NO: 1437232 - RNA, 17 nt, Homo sapiens
gagguggugccuucuca

SEQ ID NO: 1437233 - RNA, 20 nt, Homo sapiens
gagguuccucgcaggucuca

SEQ ID NO: 1437234 - RNA, 16 nt, Homo sapiens
gagguugaagaaugag

SEQ ID NO: 1437235 - RNA, 19 nt, Homo sapiens
gaguaacaugccagcuucc

SEQ ID NO: 1437236 - RNA, 23 nt, Homo sapiens
gaguacagauguaaaugccacaa

SEQ ID NO: 1437237 - RNA, 14 nt, Homo sapiens
gaguauaauauuca

SEQ ID NO: 1437238 - RNA, 13 nt, Homo sapiens
gaguauacuaaaa

SEQ ID NO: 1437239 - RNA, 21 nt, Homo sapiens
gagucaggacuugaacccagg

SEQ ID NO: 1437240 - RNA, 22 nt, Homo sapiens
gagucugggcaaugaaaccaaa

SEQ ID NO: 1437241 - RNA, 16 nt, Homo sapiens
gagugagaucuuacag

SEQ ID NO: 1437242 - RNA, 15 nt, Homo sapiens
gagugcuaggauuac

SEQ ID NO: 1437243 - RNA, 14 nt, Homo sapiens
gaguggcacguuua

SEQ ID NO: 1437244 - RNA, 13 nt, Homo sapiens
gagugggggaccg

SEQ ID NO: 1437245 - RNA, 15 nt, Homo sapiens
gagugugcagacuga

SEQ ID NO: 1437246 - RNA, 15 nt, Homo sapiens
gaguucaagccugug

SEQ ID NO: 1437247 - RNA, 22 nt, Homo sapiens
gaguuccucagggaguuugacg

SEQ ID NO: 1437248 - RNA, 16 nt, Homo sapiens
gaguucugaagcugac

SEQ ID NO: 1437249 - RNA, 16 nt, Homo sapiens
gaguuguacacugugu

SEQ ID NO: 1437250 - RNA, 22 nt, Homo sapiens
gaguuguuuuggugccugccuc

SEQ ID NO: 1437251 - RNA, 21 nt, Homo sapiens
gauaaaucaguuaugucaauu

SEQ ID NO: 1437252 - RNA, 16 nt, Homo sapiens
gauacccagagcauua

SEQ ID NO: 1437253 - RNA, 20 nt, Homo sapiens
gauagaacaaugcuauaaua

SEQ ID NO: 1437254 - RNA, 18 nt, Homo sapiens
gauagauccauuuggaca

SEQ ID NO: 1437255 - RNA, 19 nt, Homo sapiens
gauagcuauuuucuuacag

SEQ ID NO: 1437256 - RNA, 18 nt, Homo sapiens
gauagcuuggagggaugg

SEQ ID NO: 1437257 - RNA, 12 nt, Homo sapiens
gauagggacuga

SEQ ID NO: 1437258 - RNA, 17 nt, Homo sapiens
gauauauaccacuuucc

SEQ ID NO: 1437259 - RNA, 19 nt, Homo sapiens
gauaucaaaaagacugugg

SEQ ID NO: 1437260 - RNA, 11 nt, Homo sapiens
gauaugcacac

SEQ ID NO: 1437261 - RNA, 19 nt, Homo sapiens
gauaugcacacacacggau

SEQ ID NO: 1437262 - RNA, 14 nt, Homo sapiens
gauaugggacugag

SEQ ID NO: 1437263 - RNA, 16 nt, Homo sapiens
gauaugggacugagcc

SEQ ID NO: 1437264 - RNA, 21 nt, Homo sapiens
guuuuauucugacuuccucug

SEQ ID NO: 1437265 - RNA, 18 nt, Homo sapiens
guuuucaugagcugagug

SEQ ID NO: 1437266 - RNA, 14 nt, Homo sapiens
guuuucauuaucuc

SEQ ID NO: 1437267 - RNA, 13 nt, Homo sapiens
guuuugccuuaaa

SEQ ID NO: 1437268 - RNA, 20 nt, Homo sapiens
guuuugucucugcaucucau

SEQ ID NO: 1437269 - RNA, 14 nt, Homo sapiens
uaaaaacuuccauc

SEQ ID NO: 1437270 - RNA, 13 nt, Homo sapiens
uaaaaacuuguac

SEQ ID NO: 1437271 - RNA, 18 nt, Homo sapiens
uaaaaagacuaaccugcc

SEQ ID NO: 1437272 - RNA, 13 nt, Homo sapiens
uaaaaagaggcau

SEQ ID NO: 1437273 - RNA, 14 nt, Homo sapiens
uaaaaaguggcuaa

SEQ ID NO: 1437274 - RNA, 14 nt, Homo sapiens
uaaaaccacagcag

SEQ ID NO: 1437275 - RNA, 15 nt, Homo sapiens
uaaaacccagcaugu

SEQ ID NO: 1437276 - RNA, 12 nt, Homo sapiens
uaaaaccuuuca

SEQ ID NO: 1437277 - RNA, 15 nt, Homo sapiens
uaaaagugacucuca

SEQ ID NO: 1437278 - RNA, 13 nt, Homo sapiens
uaaaaguuacuua

SEQ ID NO: 1437279 - RNA, 17 nt, Homo sapiens
uaaaauaaguauuucca

SEQ ID NO: 1437280 - RNA, 16 nt, Homo sapiens
uaaaauacacacucaa

SEQ ID NO: 1437281 - RNA, 14 nt, Homo sapiens
uaaaauauggcuau

SEQ ID NO: 1437282 - RNA, 19 nt, Homo sapiens
uaaaaucauuucugcauca

SEQ ID NO: 1437283 - RNA, 14 nt, Homo sapiens
uaaaauucuuggga

SEQ ID NO: 1437284 - RNA, 22 nt, Homo sapiens
uaaaauuuaaccuacuagacaa

SEQ ID NO: 1437285 - RNA, 19 nt, Homo sapiens
uaaacaagggcagugagaa

SEQ ID NO: 1437286 - RNA, 15 nt, Homo sapiens
uaaacauagcuugua

SEQ ID NO: 1437287 - RNA, 20 nt, Homo sapiens
uaaacaugagcgcugaugau

SEQ ID NO: 1437288 - RNA, 22 nt, Homo sapiens
uaaacauugguaagaaugagcu

SEQ ID NO: 1437289 - RNA, 13 nt, Homo sapiens
uaaaccaaaaagg

SEQ ID NO: 1437290 - RNA, 22 nt, Homo sapiens
uaaacccaaauaaauguguaaa

SEQ ID NO: 1437291 - RNA, 22 nt, Homo sapiens
uaaacccagcucccuucuuccc

SEQ ID NO: 1437292 - RNA, 21 nt, Homo sapiens
uaaaccuagggagguugaaga

SEQ ID NO: 1437293 - RNA, 19 nt, Homo sapiens
uaaacuauaaacuacugua

SEQ ID NO: 1437294 - RNA, 19 nt, Homo sapiens
aaauggcuguagguggugu

SEQ ID NO: 1437295 - RNA, 16 nt, Homo sapiens
aaaugggcagugccuc

SEQ ID NO: 1437296 - RNA, 13 nt, Homo sapiens
aaauggugggaac

SEQ ID NO: 1437297 - RNA, 16 nt, Homo sapiens
aaauguacgaaacugu

SEQ ID NO: 1437298 - RNA, 22 nt, Homo sapiens
aaaugugacccagauccucaca

SEQ ID NO: 1437299 - RNA, 22 nt, Homo sapiens
aaauguuugaguuuucaaagau

SEQ ID NO: 1437300 - RNA, 23 nt, Homo sapiens
aaauuaaagcccauaaggccaga

SEQ ID NO: 1437301 - RNA, 20 nt, Homo sapiens
aaauuagaaagcaacuuauc

SEQ ID NO: 1437302 - RNA, 23 nt, Homo sapiens
aaauuauacuguagcugaugaaa

SEQ ID NO: 1437303 - RNA, 14 nt, Homo sapiens
aaauucacuuaggg

SEQ ID NO: 1437304 - RNA, 20 nt, Homo sapiens
aaauucccccacuugggagc

SEQ ID NO: 1437305 - RNA, 14 nt, Homo sapiens
aaauuccuguagca

SEQ ID NO: 1437306 - RNA, 12 nt, Homo sapiens
aaauugccuccu

SEQ ID NO: 1437307 - RNA, 19 nt, Homo sapiens
aaauugcuacauaguccaa

SEQ ID NO: 1437308 - RNA, 20 nt, Homo sapiens
aaauugcuacauaguccaaa

SEQ ID NO: 1437309 - RNA, 20 nt, Homo sapiens
aaauuggaauuuucuuaccc

SEQ ID NO: 1437310 - RNA, 14 nt, Homo sapiens
aaauuuguccaaug

SEQ ID NO: 1437311 - RNA, 20 nt, Homo sapiens
aacaaaaauguaaugaucau

SEQ ID NO: 1437312 - RNA, 13 nt, Homo sapiens
aacaaaauaucug

SEQ ID NO: 1437313 - RNA, 13 nt, Homo sapiens
aacaaccaugcca

SEQ ID NO: 1437314 - RNA, 19 nt, Homo sapiens
aacaaccuggucacaggac

SEQ ID NO: 1437315 - RNA, 14 nt, Homo sapiens
aacaacuacuguga

SEQ ID NO: 1437316 - RNA, 22 nt, Homo sapiens
aacaacuaggcuucagcauauu

SEQ ID NO: 1437317 - RNA, 18 nt, Homo sapiens
aacaagaaauuguuucuu

SEQ ID NO: 1437318 - RNA, 14 nt, Homo sapiens
aacaagaauuggaa

SEQ ID NO: 1437319 - RNA, 22 nt, Homo sapiens
aacaagagaaaaaacuagagcc

SEQ ID NO: 1437320 - RNA, 16 nt, Homo sapiens
aacaagggcagugaga

SEQ ID NO: 1437321 - RNA, 20 nt, Homo sapiens
aacaagguucccucugagaa

SEQ ID NO: 1437322 - RNA, 21 nt, Homo sapiens
aacaauacaugcugcuaauuc

SEQ ID NO: 1437323 - RNA, 22 nt, Homo sapiens
aacaauguaugugaaaguguaa

SEQ ID NO: 1437324 - RNA, 21 nt, Homo sapiens
aacaauuguccauggucucaa

SEQ ID NO: 1437325 - RNA, 17 nt, Homo sapiens
aacaauuuuuuccccaa

SEQ ID NO: 1437326 - RNA, 16 nt, Homo sapiens
aacacaagccacagaa

SEQ ID NO: 1437327 - RNA, 18 nt, Homo sapiens
aacacacauggaugcaca

SEQ ID NO: 1437328 - RNA, 16 nt, Homo sapiens
aacacaccacacuggc

SEQ ID NO: 1437329 - RNA, 16 nt, Homo sapiens
aacacagagcugcuau

SEQ ID NO: 1437330 - RNA, 18 nt, Homo sapiens
aacacauuacuugcacaa

SEQ ID NO: 1437331 - RNA, 16 nt, Homo sapiens
aacaccaccucuccag

SEQ ID NO: 1437332 - RNA, 21 nt, Homo sapiens
aacaccacuuugucucugaga

SEQ ID NO: 1437333 - RNA, 22 nt, Homo sapiens
aacaccuucuuggcuucuggga

SEQ ID NO: 1437334 - RNA, 23 nt, Homo sapiens
aacaccuucuuggcuucugggac

SEQ ID NO: 1437335 - RNA, 16 nt, Homo sapiens
aacacugugaagacaa

SEQ ID NO: 1437336 - RNA, 14 nt, Homo sapiens
aacagaagcaguug

SEQ ID NO: 1437337 - RNA, 15 nt, Homo sapiens
aacagagacucugga

SEQ ID NO: 1437338 - RNA, 20 nt, Homo sapiens
aacagaggaaucuaccugug

SEQ ID NO: 1437339 - RNA, 20 nt, Homo sapiens
aacagaggcaggaguggcag

SEQ ID NO: 1437340 - RNA, 16 nt, Homo sapiens
aacagaucuugaaauc

SEQ ID NO: 1437341 - RNA, 15 nt, Homo sapiens
aacagccccaaaguc

SEQ ID NO: 1437342 - RNA, 16 nt, Homo sapiens
aacaggaaaccacuua

SEQ ID NO: 1437343 - RNA, 22 nt, Homo sapiens
aacaggagcucuuaacuacagu

SEQ ID NO: 1437344 - RNA, 16 nt, Homo sapiens
aacaguaacugccauc

SEQ ID NO: 1437345 - RNA, 18 nt, Homo sapiens
aacaguauuuguacaaau

SEQ ID NO: 1437346 - RNA, 20 nt, Homo sapiens
aacaguuccuucagcuucca

SEQ ID NO: 1437347 - RNA, 20 nt, Homo sapiens
aacauaaaaucugugaauua

SEQ ID NO: 1437348 - RNA, 16 nt, Homo sapiens
aacauaauucacuuuc

SEQ ID NO: 1437349 - RNA, 16 nt, Homo sapiens
aacaucccaagccaga

SEQ ID NO: 1437350 - RNA, 20 nt, Homo sapiens
aacaucuauuauaaaaccau

SEQ ID NO: 1437351 - RNA, 20 nt, Homo sapiens
aacaugaaaaacacggcagc

SEQ ID NO: 1437352 - RNA, 18 nt, Homo sapiens
aacaugacacugaccuug

SEQ ID NO: 1437353 - RNA, 18 nt, Homo sapiens
aacauuaaacacuguaau

SEQ ID NO: 1437354 - RNA, 13 nt, Homo sapiens
aacauuaugccuu

SEQ ID NO: 1437355 - RNA, 21 nt, Homo sapiens
aacauucaucaagcuguacau

SEQ ID NO: 1437356 - RNA, 17 nt, Homo sapiens
aacauuccaaugcauug

SEQ ID NO: 1437357 - RNA, 17 nt, Homo sapiens
aacauuucuuaugauuu

SEQ ID NO: 1437358 - RNA, 20 nt, Homo sapiens
aaccaaaggaaucguuucaa

SEQ ID NO: 1437359 - RNA, 13 nt, Homo sapiens
aaccaaaugcugu

SEQ ID NO: 1437360 - RNA, 17 nt, Homo sapiens
aaccaaccaaccaacca

SEQ ID NO: 1437361 - RNA, 18 nt, Homo sapiens
aaccacagaacacugggu

SEQ ID NO: 1437362 - RNA, 18 nt, Homo sapiens
aaccaguuaagaauggaa

SEQ ID NO: 1437363 - RNA, 13 nt, Homo sapiens
aaccauaaacuuc

SEQ ID NO: 1437364 - RNA, 15 nt, Homo sapiens
aaccauaaacuucau

SEQ ID NO: 1437365 - RNA, 12 nt, Homo sapiens
aaccauaguuau

SEQ ID NO: 1437366 - RNA, 18 nt, Homo sapiens
aaccaucgcgugcaauga

SEQ ID NO: 1437367 - RNA, 15 nt, Homo sapiens
aaccauuacuguaau

SEQ ID NO: 1437368 - RNA, 20 nt, Homo sapiens
aacccaauucaggacuggcu

SEQ ID NO: 1437369 - RNA, 20 nt, Homo sapiens
aacccagcucccuucuuccc

SEQ ID NO: 1437370 - RNA, 13 nt, Homo sapiens
aacccaggacaag

SEQ ID NO: 1437371 - RNA, 18 nt, Homo sapiens
aaccccaacgcacaggaa

SEQ ID NO: 1437372 - RNA, 16 nt, Homo sapiens
aacccccgcuccagau

SEQ ID NO: 1437373 - RNA, 17 nt, Homo sapiens
aaccccgcggugcucug

SEQ ID NO: 1437374 - RNA, 19 nt, Homo sapiens
aacccgugccaaguccagg

SEQ ID NO: 1437375 - RNA, 18 nt, Homo sapiens
aacccucacuguguugga

SEQ ID NO: 1437376 - RNA, 19 nt, Homo sapiens
aacccuguauggcacuuau

SEQ ID NO: 1437377 - RNA, 20 nt, Homo sapiens
aacccuguggggccugaugg

SEQ ID NO: 1437378 - RNA, 20 nt, Homo sapiens
aaccuaccaccccuuccugu

SEQ ID NO: 1437379 - RNA, 17 nt, Homo sapiens
aaccuagcaucuuacaa

SEQ ID NO: 1437380 - RNA, 16 nt, Homo sapiens
aaguuauugauguuuu

SEQ ID NO: 1437381 - RNA, 19 nt, Homo sapiens
aaguuauuguguugccuua

SEQ ID NO: 1437382 - RNA, 14 nt, Homo sapiens
aaguucaacuucca

SEQ ID NO: 1437383 - RNA, 15 nt, Homo sapiens
aaguucucaauguga

SEQ ID NO: 1437384 - RNA, 22 nt, Homo sapiens
aaguuggguguaauuaggugaa

SEQ ID NO: 1437385 - RNA, 13 nt, Homo sapiens
aaguuuucaggac

SEQ ID NO: 1437386 - RNA, 20 nt, Homo sapiens
aaguuuuucagaaagcauua

SEQ ID NO: 1437387 - RNA, 13 nt, Homo sapiens
aauaaaaauaccu

SEQ ID NO: 1437388 - RNA, 21 nt, Homo sapiens
aauaaaccuggagaugaugau

SEQ ID NO: 1437389 - RNA, 22 nt, Homo sapiens
aauaaacuaguuuccaguggau

SEQ ID NO: 1437390 - RNA, 21 nt, Homo sapiens
aauaaagcugcugagaaucua

SEQ ID NO: 1437391 - RNA, 14 nt, Homo sapiens
aauaaagcuucauu

SEQ ID NO: 1437392 - RNA, 15 nt, Homo sapiens
aauaaaguaccauua

SEQ ID NO: 1437393 - RNA, 15 nt, Homo sapiens
aauaaauaaucugua

SEQ ID NO: 1437394 - RNA, 14 nt, Homo sapiens
aauaagaaacacaa

SEQ ID NO: 1437395 - RNA, 12 nt, Homo sapiens
aauaagcuuuau

SEQ ID NO: 1437396 - RNA, 20 nt, Homo sapiens
aauaaggcuccuucaugugg

SEQ ID NO: 1437397 - RNA, 17 nt, Homo sapiens
aauaaguccacaucuuc

SEQ ID NO: 1437398 - RNA, 15 nt, Homo sapiens
aauaauaaauccuca

SEQ ID NO: 1437399 - RNA, 15 nt, Homo sapiens
aauaauauuagcuua

SEQ ID NO: 1437400 - RNA, 13 nt, Homo sapiens
aauaauguauaca

SEQ ID NO: 1437401 - RNA, 14 nt, Homo sapiens
aauaauuaaugugu

SEQ ID NO: 1437402 - RNA, 14 nt, Homo sapiens
aauaauugauuuca

SEQ ID NO: 1437403 - RNA, 15 nt, Homo sapiens
aauacaaacaagcac

SEQ ID NO: 1437404 - RNA, 19 nt, Homo sapiens
aauacaugcugcuaauuca

SEQ ID NO: 1437405 - RNA, 17 nt, Homo sapiens
aauaccagaucacucaa

SEQ ID NO: 1437406 - RNA, 18 nt, Homo sapiens
aauaccagugaaccaaag

SEQ ID NO: 1437407 - RNA, 18 nt, Homo sapiens
aauaccauccugcccauu

SEQ ID NO: 1437408 - RNA, 18 nt, Homo sapiens
aauaccccuguuaagcaa

SEQ ID NO: 1437409 - RNA, 20 nt, Homo sapiens
aauaccuuaguuuuuuccac

SEQ ID NO: 1437410 - RNA, 12 nt, Homo sapiens
aauacuguacau

SEQ ID NO: 1437411 - RNA, 20 nt, Homo sapiens
aauagaagaacauccaagga

SEQ ID NO: 1437412 - RNA, 15 nt, Homo sapiens
aauagacacaucaaa

SEQ ID NO: 1437413 - RNA, 16 nt, Homo sapiens
aauagacaguagccaa

SEQ ID NO: 1437414 - RNA, 22 nt, Homo sapiens
aauagcacauccuccaacguua

SEQ ID NO: 1437415 - RNA, 23 nt, Homo sapiens
aauagccauguacuauaauguga

SEQ ID NO: 1437416 - RNA, 21 nt, Homo sapiens
aauagccuaauacaacaugua

SEQ ID NO: 1437417 - RNA, 12 nt, Homo sapiens
aauagcugcuag

SEQ ID NO: 1437418 - RNA, 14 nt, Homo sapiens
aauaggcauuugau

SEQ ID NO: 1437419 - RNA, 15 nt, Homo sapiens
aauauaaaacuuaca

SEQ ID NO: 1437420 - RNA, 13 nt, Homo sapiens
aauauaaaugcau

SEQ ID NO: 1437421 - RNA, 17 nt, Homo sapiens
aauauaucaauguaaca

SEQ ID NO: 1437422 - RNA, 17 nt, Homo sapiens
aauaucgagaacugcca

SEQ ID NO: 1437423 - RNA, 15 nt, Homo sapiens
aauaugauuacuuua

SEQ ID NO: 1437424 - RNA, 17 nt, Homo sapiens
aauaugggcucaaguca

SEQ ID NO: 1437425 - RNA, 20 nt, Homo sapiens
aauaugucugccacagagag

SEQ ID NO: 1437426 - RNA, 21 nt, Homo sapiens
aauauguuucuaaaaauuggu

SEQ ID NO: 1437427 - RNA, 14 nt, Homo sapiens
aauauuaccaaaaa

SEQ ID NO: 1437428 - RNA, 23 nt, Homo sapiens
aauauuaucacgcagaucacuaa

SEQ ID NO: 1437429 - RNA, 11 nt, Homo sapiens
aauauucaaua

SEQ ID NO: 1437430 - RNA, 23 nt, Homo sapiens
aauauucaauaaagcugcugaga

SEQ ID NO: 1437431 - RNA, 21 nt, Homo sapiens
aauauucccugacgacacuga

SEQ ID NO: 1437432 - RNA, 17 nt, Homo sapiens
aauauuuaaguauauag

SEQ ID NO: 1437433 - RNA, 14 nt, Homo sapiens
aauauuuaggcaag

SEQ ID NO: 1437434 - RNA, 18 nt, Homo sapiens
aauauuuaggcaagagaa

SEQ ID NO: 1437435 - RNA, 20 nt, Homo sapiens
aauauuucccccuuacuacu

SEQ ID NO: 1437436 - RNA, 18 nt, Homo sapiens
aauauuugcugacagcug

SEQ ID NO: 1437437 - RNA, 16 nt, Homo sapiens
aauauuuuagccuuaa

SEQ ID NO: 1437438 - RNA, 14 nt, Homo sapiens
aaucaaacuguaaa

SEQ ID NO: 1437439 - RNA, 20 nt, Homo sapiens
aaucaaauaugcaaagcacu

SEQ ID NO: 1437440 - RNA, 16 nt, Homo sapiens
aaucaagagugaguga

SEQ ID NO: 1437441 - RNA, 20 nt, Homo sapiens
aaucacaacacagagcugcu

SEQ ID NO: 1437442 - RNA, 21 nt, Homo sapiens
aaucacaacacagagcugcua

SEQ ID NO: 1437443 - RNA, 21 nt, Homo sapiens
aaucaccauguaacaaccaga

SEQ ID NO: 1437444 - RNA, 17 nt, Homo sapiens
aaucacuuuuaggaugu

SEQ ID NO: 1437445 - RNA, 17 nt, Homo sapiens
aaucagcauucucacuc

SEQ ID NO: 1437446 - RNA, 18 nt, Homo sapiens
aaucagcugcuacaagaa

SEQ ID NO: 1437447 - RNA, 22 nt, Homo sapiens
aaucaggcugaggugucuuaag

SEQ ID NO: 1437448 - RNA, 17 nt, Homo sapiens
aaucauggagcugagga

SEQ ID NO: 1437449 - RNA, 21 nt, Homo sapiens
aaucaugggauuuuacuagaa

SEQ ID NO: 1437450 - RNA, 20 nt, Homo sapiens
aaucauuucugcaucagcug

SEQ ID NO: 1437451 - RNA, 20 nt, Homo sapiens
aauccaaguuauuaaucuua

SEQ ID NO: 1437452 - RNA, 19 nt, Homo sapiens
aauccagagauaauugcca

SEQ ID NO: 1437453 - RNA, 15 nt, Homo sapiens
aaucccagcacuuug

SEQ ID NO: 1437454 - RNA, 17 nt, Homo sapiens
aaucccagcccuacccu

SEQ ID NO: 1437455 - RNA, 20 nt, Homo sapiens
aaucccuguuuaauauuuaa

SEQ ID NO: 1437456 - RNA, 23 nt, Homo sapiens
aauccucaacaacaaaccaaaac

SEQ ID NO: 1437457 - RNA, 22 nt, Homo sapiens
aauccucagguaguacugggaa

SEQ ID NO: 1437458 - RNA, 17 nt, Homo sapiens
aauccucccuuccuccc

SEQ ID NO: 1437459 - RNA, 23 nt, Homo sapiens
aauccugcuccugacucggucaa

SEQ ID NO: 1437460 - RNA, 20 nt, Homo sapiens
aauccuuaacauauuugcac

SEQ ID NO: 1437461 - RNA, 12 nt, Homo sapiens
aauccuuuccac

SEQ ID NO: 1437462 - RNA, 14 nt, Homo sapiens
aaucguagguguug

SEQ ID NO: 1437463 - RNA, 16 nt, Homo sapiens
aaucuaacuacaagga

SEQ ID NO: 1437464 - RNA, 19 nt, Homo sapiens
aaucuaacuacaaggacaa

SEQ ID NO: 1437465 - RNA, 13 nt, Homo sapiens
aaucuaugcaugu

SEQ ID NO: 1437466 - RNA, 14 nt, Homo sapiens
aaucucuaagccaa

SEQ ID NO: 1437467 - RNA, 13 nt, Homo sapiens
aaucugccauaaa

SEQ ID NO: 1437468 - RNA, 23 nt, Homo sapiens
aaucugccuaggguccuguccau

SEQ ID NO: 1437469 - RNA, 23 nt, Homo sapiens
aaucuggagagcuagaaccugga

SEQ ID NO: 1437470 - RNA, 20 nt, Homo sapiens
aaucuggcuccuguuuccau

SEQ ID NO: 1437471 - RNA, 14 nt, Homo sapiens
aaucuguagucacu

SEQ ID NO: 1437472 - RNA, 19 nt, Homo sapiens
aaucuuccagcaugcaucc

SEQ ID NO: 1437473 - RNA, 16 nt, Homo sapiens
aaucuuccugccucag

SEQ ID NO: 1437474 - RNA, 19 nt, Homo sapiens
aaucuucuccuaugcauuu

SEQ ID NO: 1437475 - RNA, 20 nt, Homo sapiens
aaucuuucagcacucagaaa

SEQ ID NO: 1437476 - RNA, 20 nt, Homo sapiens
aaugaaaauaagugaauaau

SEQ ID NO: 1437477 - RNA, 14 nt, Homo sapiens
aaugaaaccaaagc

SEQ ID NO: 1437478 - RNA, 19 nt, Homo sapiens
aaugaaaccaaagccagga

SEQ ID NO: 1437479 - RNA, 19 nt, Homo sapiens
aaugaagacccaguguaaa

SEQ ID NO: 1437480 - RNA, 22 nt, Homo sapiens
aaugacagaaugcuguuuuaaa

SEQ ID NO: 1437481 - RNA, 18 nt, Homo sapiens
aaugacaugcacugaccc

SEQ ID NO: 1437482 - RNA, 12 nt, Homo sapiens
aaugacuauaaa

SEQ ID NO: 1437483 - RNA, 23 nt, Homo sapiens
aaugagaaacuuugaucucugcu

SEQ ID NO: 1437484 - RNA, 23 nt, Homo sapiens
aaugagaagccaagcucuucaag

SEQ ID NO: 1437485 - RNA, 16 nt, Homo sapiens
aaugagacuugcucuc

SEQ ID NO: 1437486 - RNA, 18 nt, Homo sapiens
aaugaguucaacuuugag

SEQ ID NO: 1437487 - RNA, 16 nt, Homo sapiens
aaugaucauaagucua

SEQ ID NO: 1437488 - RNA, 15 nt, Homo sapiens
aaugaugccacuucc

SEQ ID NO: 1437489 - RNA, 16 nt, Homo sapiens
aaugaugccacuuccc

SEQ ID NO: 1437490 - RNA, 11 nt, Homo sapiens
aaugauuagaa

SEQ ID NO: 1437491 - RNA, 15 nt, Homo sapiens
aaugcacacacacag

SEQ ID NO: 1437492 - RNA, 19 nt, Homo sapiens
aaugcacgcacacaucagu

SEQ ID NO: 1437493 - RNA, 21 nt, Homo sapiens
aaugcauuauaggaucauuug

SEQ ID NO: 1437494 - RNA, 14 nt, Homo sapiens
aaugcauugcuaaa

SEQ ID NO: 1437495 - RNA, 14 nt, Homo sapiens
aaugccacagugaa

SEQ ID NO: 1437496 - RNA, 15 nt, Homo sapiens
aaugccaucacugga

SEQ ID NO: 1437497 - RNA, 18 nt, Homo sapiens
aaugccucuucuuuaugu

SEQ ID NO: 1437498 - RNA, 17 nt, Homo sapiens
aaugccuugacaacaga

SEQ ID NO: 1437499 - RNA, 14 nt, Homo sapiens
aaugcuccaugaaa

SEQ ID NO: 1437500 - RNA, 13 nt, Homo sapiens
aauggaagguugg

SEQ ID NO: 1437501 - RNA, 19 nt, Homo sapiens
aauggaugugcucacuggg

SEQ ID NO: 1437502 - RNA, 20 nt, Homo sapiens
aauggcaaguuuugauauga

SEQ ID NO: 1437503 - RNA, 14 nt, Homo sapiens
aaugggcacuggga

SEQ ID NO: 1437504 - RNA, 20 nt, Homo sapiens
aaugggugauauccugaaaa

SEQ ID NO: 1437505 - RNA, 14 nt, Homo sapiens
aauggucaguugua

SEQ ID NO: 1437506 - RNA, 15 nt, Homo sapiens
aauggugggaacccu

SEQ ID NO: 1437507 - RNA, 20 nt, Homo sapiens
aauguaagggaaacugccag

SEQ ID NO: 1437508 - RNA, 22 nt, Homo sapiens
aauguaagggaaacugccagca

SEQ ID NO: 1437509 - RNA, 15 nt, Homo sapiens
aauguauauacacau

SEQ ID NO: 1437510 - RNA, 15 nt, Homo sapiens
aauguauaugucauu

SEQ ID NO: 1437511 - RNA, 14 nt, Homo sapiens
aaugucaccaccuu

SEQ ID NO: 1437512 - RNA, 16 nt, Homo sapiens
aaugucuuacugugau

SEQ ID NO: 1437513 - RNA, 12 nt, Homo sapiens
aauguguacaaa

SEQ ID NO: 1437514 - RNA, 22 nt, Homo sapiens
aauguguauugaagaaaagcac

SEQ ID NO: 1437515 - RNA, 19 nt, Homo sapiens
aauguucaucaauucccau

SEQ ID NO: 1437516 - RNA, 23 nt, Homo sapiens
aauguucucuggguagguguuga

SEQ ID NO: 1437517 - RNA, 16 nt, Homo sapiens
aauguuuauguucuca

SEQ ID NO: 1437518 - RNA, 18 nt, Homo sapiens
aauguuugaguaccugau

SEQ ID NO: 1437519 - RNA, 21 nt, Homo sapiens
aauguuugaguuuucaaagau

SEQ ID NO: 1437520 - RNA, 23 nt, Homo sapiens
aauguuuuuauuuucucuaucaa

SEQ ID NO: 1437521 - RNA, 14 nt, Homo sapiens
aauuaaaguauaca

SEQ ID NO: 1437522 - RNA, 15 nt, Homo sapiens
aauuaagguuugccc

SEQ ID NO: 1437523 - RNA, 18 nt, Homo sapiens
aauuaaguaaaccaaaaa

SEQ ID NO: 1437524 - RNA, 14 nt, Homo sapiens
aauuaagugcaauu

SEQ ID NO: 1437525 - RNA, 22 nt, Homo sapiens
aauuauacuguagcugaugaaa

SEQ ID NO: 1437526 - RNA, 12 nt, Homo sapiens
aauuaugccaua

SEQ ID NO: 1437527 - RNA, 19 nt, Homo sapiens
aauuauuaugacucaauaa

SEQ ID NO: 1437528 - RNA, 23 nt, Homo sapiens
aauucaaugacagggaugccaac

SEQ ID NO: 1437529 - RNA, 19 nt, Homo sapiens
aauucagcacugauuucac

SEQ ID NO: 1437530 - RNA, 21 nt, Homo sapiens
aauucauuucaucuacuacag

SEQ ID NO: 1437531 - RNA, 16 nt, Homo sapiens
aauuccuagucacaau

SEQ ID NO: 1437532 - RNA, 14 nt, Homo sapiens
aauuccuggcauga

SEQ ID NO: 1437533 - RNA, 23 nt, Homo sapiens
aauucucaaaagaaaaggcaaaa

SEQ ID NO: 1437534 - RNA, 22 nt, Homo sapiens
aauucucagucaguaauugcca

SEQ ID NO: 1437535 - RNA, 22 nt, Homo sapiens
aauucuuauuuuuuaaaaagcu

SEQ ID NO: 1437536 - RNA, 19 nt, Homo sapiens
aauugaaauauaaugcaaa

SEQ ID NO: 1437537 - RNA, 16 nt, Homo sapiens
aauugacccaaaacgu

SEQ ID NO: 1437538 - RNA, 17 nt, Homo sapiens
aauugagaaacaugaau

SEQ ID NO: 1437539 - RNA, 14 nt, Homo sapiens
aauugauguugcug

SEQ ID NO: 1437540 - RNA, 13 nt, Homo sapiens
aauugauuauucu

SEQ ID NO: 1437541 - RNA, 12 nt, Homo sapiens
aauugauuucaa

SEQ ID NO: 1437542 - RNA, 18 nt, Homo sapiens
aauugcggggcccaccuu

SEQ ID NO: 1437543 - RNA, 21 nt, Homo sapiens
aauuggguggggggaaugagc

SEQ ID NO: 1437544 - RNA, 15 nt, Homo sapiens
aauugucaaauguca

SEQ ID NO: 1437545 - RNA, 13 nt, Homo sapiens
aauuguuaggaag

SEQ ID NO: 1437546 - RNA, 16 nt, Homo sapiens
aauuuagucacaccau

SEQ ID NO: 1437547 - RNA, 17 nt, Homo sapiens
aauuuagucacaccauc

SEQ ID NO: 1437548 - RNA, 18 nt, Homo sapiens
aauuuauuaaaaugauug

SEQ ID NO: 1437549 - RNA, 19 nt, Homo sapiens
aauuucauaccuaucaucu

SEQ ID NO: 1437550 - RNA, 22 nt, Homo sapiens
aauuuccacaagcauugcuuca

SEQ ID NO: 1437551 - RNA, 20 nt, Homo sapiens
aauuucuaccuuuacuacau

SEQ ID NO: 1437552 - RNA, 22 nt, Homo sapiens
aauuugaaaacauaaucugcaa

SEQ ID NO: 1437553 - RNA, 15 nt, Homo sapiens
acuaaaaaaugucua

SEQ ID NO: 1437554 - RNA, 14 nt, Homo sapiens
acuaaaagaauuug

SEQ ID NO: 1437555 - RNA, 14 nt, Homo sapiens
acuaaagauaucag

SEQ ID NO: 1437556 - RNA, 17 nt, Homo sapiens
acuaauuuaaaccagca

SEQ ID NO: 1437557 - RNA, 21 nt, Homo sapiens
acuacagaauaauguguuaaa

SEQ ID NO: 1437558 - RNA, 16 nt, Homo sapiens
acuacccgagcccagc

SEQ ID NO: 1437559 - RNA, 15 nt, Homo sapiens
acuacgcuugcucau

SEQ ID NO: 1437560 - RNA, 16 nt, Homo sapiens
acuacuacucaauggc

SEQ ID NO: 1437561 - RNA, 13 nt, Homo sapiens
acuagacauuacc

SEQ ID NO: 1437562 - RNA, 14 nt, Homo sapiens
acuagaucuccuau

SEQ ID NO: 1437563 - RNA, 18 nt, Homo sapiens
acuagucauagaaauacc

SEQ ID NO: 1437564 - RNA, 15 nt, Homo sapiens
acuaguuuccagugg

SEQ ID NO: 1437565 - RNA, 22 nt, Homo sapiens
acuauccucacucccauaagcu

SEQ ID NO: 1437566 - RNA, 18 nt, Homo sapiens
acuaucugugaaguuaca

SEQ ID NO: 1437567 - RNA, 15 nt, Homo sapiens
acuaugaucacagug

SEQ ID NO: 1437568 - RNA, 11 nt, Homo sapiens
acuaugcacaa

SEQ ID NO: 1437569 - RNA, 19 nt, Homo sapiens
acuauggagccuggcacag

SEQ ID NO: 1437570 - RNA, 16 nt, Homo sapiens
acuauuacaccaaaua

SEQ ID NO: 1437571 - RNA, 23 nt, Homo sapiens
acuauugaauuggauacaaggau

SEQ ID NO: 1437572 - RNA, 20 nt, Homo sapiens
acuauugguaauaaaccuug

SEQ ID NO: 1437573 - RNA, 17 nt, Homo sapiens
acuauuuaucugugcaa

SEQ ID NO: 1437574 - RNA, 23 nt, Homo sapiens
acuauuucacuaauaaacauuug

SEQ ID NO: 1437575 - RNA, 15 nt, Homo sapiens
acuauuugaagcaau

SEQ ID NO: 1437576 - RNA, 16 nt, Homo sapiens
acuauuuguuccacau

SEQ ID NO: 1437577 - RNA, 16 nt, Homo sapiens
acuauuuuaacuggga

SEQ ID NO: 1437578 - RNA, 13 nt, Homo sapiens
acucaaacucaag

SEQ ID NO: 1437579 - RNA, 20 nt, Homo sapiens
acucacaagaagaccagacu

SEQ ID NO: 1437580 - RNA, 12 nt, Homo sapiens
acucacccaagc

SEQ ID NO: 1437581 - RNA, 17 nt, Homo sapiens
acucacucauuccuuca

SEQ ID NO: 1437582 - RNA, 21 nt, Homo sapiens
acucacugacucuucuaugca

SEQ ID NO: 1437583 - RNA, 19 nt, Homo sapiens
acucagaaaagaaaaccau

SEQ ID NO: 1437584 - RNA, 16 nt, Homo sapiens
acucaguuuucuugca

SEQ ID NO: 1437585 - RNA, 16 nt, Homo sapiens
acucauauucugggcu

SEQ ID NO: 1437586 - RNA, 19 nt, Homo sapiens
acucaucccuguuccucaa

SEQ ID NO: 1437587 - RNA, 15 nt, Homo sapiens
acucaucuguuaucc

SEQ ID NO: 1437588 - RNA, 16 nt, Homo sapiens
acucauugucugugga

SEQ ID NO: 1437589 - RNA, 17 nt, Homo sapiens
acucauuuuuguuuuca

SEQ ID NO: 1437590 - RNA, 22 nt, Homo sapiens
acuccaaagaaauguaagggaa

SEQ ID NO: 1437591 - RNA, 20 nt, Homo sapiens
acuccagauuuuuuacagcu

SEQ ID NO: 1437592 - RNA, 15 nt, Homo sapiens
acuccaguggugaag

SEQ ID NO: 1437593 - RNA, 21 nt, Homo sapiens
acucccuucccccauccucca

SEQ ID NO: 1437594 - RNA, 19 nt, Homo sapiens
acuccggccaccuccucca

SEQ ID NO: 1437595 - RNA, 15 nt, Homo sapiens
acuccuccuugccug

SEQ ID NO: 1437596 - RNA, 16 nt, Homo sapiens
acuccugcccuguugu

SEQ ID NO: 1437597 - RNA, 12 nt, Homo sapiens
acuccuguuacu

SEQ ID NO: 1437598 - RNA, 14 nt, Homo sapiens
acuccuuccagcua

SEQ ID NO: 1437599 - RNA, 18 nt, Homo sapiens
acucuaagcuggagcucu

SEQ ID NO: 1437600 - RNA, 16 nt, Homo sapiens
acucuacgccaaagug

SEQ ID NO: 1437601 - RNA, 20 nt, Homo sapiens
acucuaggggucaggcucca

SEQ ID NO: 1437602 - RNA, 17 nt, Homo sapiens
acucuauguaugcaucu

SEQ ID NO: 1437603 - RNA, 22 nt, Homo sapiens
acucuccccucccucuuccuuc

SEQ ID NO: 1437604 - RNA, 22 nt, Homo sapiens
acucugaaaaacauuccaggaa

SEQ ID NO: 1437605 - RNA, 17 nt, Homo sapiens
acucugcaucagcacug

SEQ ID NO: 1437606 - RNA, 17 nt, Homo sapiens
acucuggagagacugug

SEQ ID NO: 1437607 - RNA, 19 nt, Homo sapiens
acucuggagagacugugcu

SEQ ID NO: 1437608 - RNA, 17 nt, Homo sapiens
acucugggcuccucaac

SEQ ID NO: 1437609 - RNA, 21 nt, Homo sapiens
acucuuaugaaaugggcuuua

SEQ ID NO: 1437610 - RNA, 16 nt, Homo sapiens
acucuuccaaaggcau

SEQ ID NO: 1437611 - RNA, 16 nt, Homo sapiens
acucuucccaccucag

SEQ ID NO: 1437612 - RNA, 19 nt, Homo sapiens
acugaaggagaaggugccc

SEQ ID NO: 1437613 - RNA, 19 nt, Homo sapiens
acugaauuugggccucuug

SEQ ID NO: 1437614 - RNA, 12 nt, Homo sapiens
acugacacagga

SEQ ID NO: 1437615 - RNA, 15 nt, Homo sapiens
acugacuaccagcua

SEQ ID NO: 1437616 - RNA, 20 nt, Homo sapiens
acugagagcagaugguccuc

SEQ ID NO: 1437617 - RNA, 21 nt, Homo sapiens
acugagccaaacacacuguaa

SEQ ID NO: 1437618 - RNA, 15 nt, Homo sapiens
acugagccugagaug

SEQ ID NO: 1437619 - RNA, 20 nt, Homo sapiens
acugaugcgaaaacuugaau

SEQ ID NO: 1437620 - RNA, 19 nt, Homo sapiens
acugauuucacaacagauc

SEQ ID NO: 1437621 - RNA, 20 nt, Homo sapiens
acugauuucacaacagauca

SEQ ID NO: 1437622 - RNA, 14 nt, Homo sapiens
acugcaaauuucaa

SEQ ID NO: 1437623 - RNA, 22 nt, Homo sapiens
acugcacaucuagagaaaaaca

SEQ ID NO: 1437624 - RNA, 19 nt, Homo sapiens
acugcagauagccagacac

SEQ ID NO: 1437625 - RNA, 20 nt, Homo sapiens
acugcauaaaccaaugagcu

SEQ ID NO: 1437626 - RNA, 21 nt, Homo sapiens
acugccaucaagaugagagaa

SEQ ID NO: 1437627 - RNA, 16 nt, Homo sapiens
acugccucuccagcac

SEQ ID NO: 1437628 - RNA, 22 nt, Homo sapiens
acugcucaagagaagcacauga

SEQ ID NO: 1437629 - RNA, 17 nt, Homo sapiens
acugcucaucauuccuu

SEQ ID NO: 1437630 - RNA, 20 nt, Homo sapiens
acugcuuuccagccugggca

SEQ ID NO: 1437631 - RNA, 14 nt, Homo sapiens
acuggaaccaggga

SEQ ID NO: 1437632 - RNA, 22 nt, Homo sapiens
acuggagaggcuagaaccaaga

SEQ ID NO: 1437633 - RNA, 15 nt, Homo sapiens
acuggagcaucugac

SEQ ID NO: 1437634 - RNA, 19 nt, Homo sapiens
acuggagcaucugacucac

SEQ ID NO: 1437635 - RNA, 12 nt, Homo sapiens
acuggcauuaaa

SEQ ID NO: 1437636 - RNA, 12 nt, Homo sapiens
acuggcauuaau

SEQ ID NO: 1437637 - RNA, 19 nt, Homo sapiens
acuggggucuguguggugc

SEQ ID NO: 1437638 - RNA, 21 nt, Homo sapiens
acuguaauuaaguaaaccaaa

SEQ ID NO: 1437639 - RNA, 17 nt, Homo sapiens
acuguacugagacauua

SEQ ID NO: 1437640 - RNA, 23 nt, Homo sapiens
agcacuuuaacccucucuucccu

SEQ ID NO: 1437641 - RNA, 16 nt, Homo sapiens
agcagauuguguaaca

SEQ ID NO: 1437642 - RNA, 13 nt, Homo sapiens
agcagauuuaaca

SEQ ID NO: 1437643 - RNA, 16 nt, Homo sapiens
agcagcauucagcaca

SEQ ID NO: 1437644 - RNA, 18 nt, Homo sapiens
agcagcccuaaggaucuc

SEQ ID NO: 1437645 - RNA, 15 nt, Homo sapiens
agcaggaacuuugcc

SEQ ID NO: 1437646 - RNA, 16 nt, Homo sapiens
agcaggcuacugucag

SEQ ID NO: 1437647 - RNA, 13 nt, Homo sapiens
agcagggacaccc

SEQ ID NO: 1437648 - RNA, 19 nt, Homo sapiens
agcaggguucugaggcaaa

SEQ ID NO: 1437649 - RNA, 19 nt, Homo sapiens
agcaggugguccugagacc

SEQ ID NO: 1437650 - RNA, 16 nt, Homo sapiens
agcaguaaacuuucuc

SEQ ID NO: 1437651 - RNA, 12 nt, Homo sapiens
agcagucagggu

SEQ ID NO: 1437652 - RNA, 19 nt, Homo sapiens
agcaguuguuauuuaguga

SEQ ID NO: 1437653 - RNA, 14 nt, Homo sapiens
agcauaaugcuccc

SEQ ID NO: 1437654 - RNA, 19 nt, Homo sapiens
agcauaauucggaagggaa

SEQ ID NO: 1437655 - RNA, 21 nt, Homo sapiens
agcauaccaguacucaguaua

SEQ ID NO: 1437656 - RNA, 11 nt, Homo sapiens
agcaucagaaa

SEQ ID NO: 1437657 - RNA, 13 nt, Homo sapiens
agcaucaugccuc

SEQ ID NO: 1437658 - RNA, 15 nt, Homo sapiens
agcaucugagcuccu

SEQ ID NO: 1437659 - RNA, 17 nt, Homo sapiens
agcaugaagacccugga

SEQ ID NO: 1437660 - RNA, 20 nt, Homo sapiens
agcaugaagguggggccagu

SEQ ID NO: 1437661 - RNA, 19 nt, Homo sapiens
agcaugcaauaaugugcaa

SEQ ID NO: 1437662 - RNA, 16 nt, Homo sapiens
agcauggacucugggu

SEQ ID NO: 1437663 - RNA, 22 nt, Homo sapiens
agcauuaacuuauugucuaggc

SEQ ID NO: 1437664 - RNA, 17 nt, Homo sapiens
agcauuguaaaugugcu

SEQ ID NO: 1437665 - RNA, 14 nt, Homo sapiens
agcauuuucuugaa

SEQ ID NO: 1437666 - RNA, 13 nt, Homo sapiens
agccaaaauacuu

SEQ ID NO: 1437667 - RNA, 14 nt, Homo sapiens
agccaaacaaaggc

SEQ ID NO: 1437668 - RNA, 23 nt, Homo sapiens
agccaaacacuguuucuaacuca

SEQ ID NO: 1437669 - RNA, 15 nt, Homo sapiens
agccaaaugcauggu

SEQ ID NO: 1437670 - RNA, 20 nt, Homo sapiens
agccaacacccugucuaaaa

SEQ ID NO: 1437671 - RNA, 19 nt, Homo sapiens
agccaaccaagagcacauu

SEQ ID NO: 1437672 - RNA, 21 nt, Homo sapiens
agccaacucacucuuaugaaa

SEQ ID NO: 1437673 - RNA, 18 nt, Homo sapiens
agccaacuuuaauugcuu

SEQ ID NO: 1437674 - RNA, 22 nt, Homo sapiens
agccaaguuauauugaauauau

SEQ ID NO: 1437675 - RNA, 19 nt, Homo sapiens
agccacaccuuuuccagga

SEQ ID NO: 1437676 - RNA, 15 nt, Homo sapiens
agccacagaagccag

SEQ ID NO: 1437677 - RNA, 13 nt, Homo sapiens
agccaccaagaca

SEQ ID NO: 1437678 - RNA, 15 nt, Homo sapiens
agccacuaccuucug

SEQ ID NO: 1437679 - RNA, 14 nt, Homo sapiens
agccacugccuuca

SEQ ID NO: 1437680 - RNA, 20 nt, Homo sapiens
agccagaaacguaacugugu

SEQ ID NO: 1437681 - RNA, 16 nt, Homo sapiens
agccagccggugccug

SEQ ID NO: 1437682 - RNA, 16 nt, Homo sapiens
agccagcucugcauua

SEQ ID NO: 1437683 - RNA, 12 nt, Homo sapiens
agccaguauuuc

SEQ ID NO: 1437684 - RNA, 12 nt, Homo sapiens
agccaguggcag

SEQ ID NO: 1437685 - RNA, 21 nt, Homo sapiens
agccaugaucgagccacugca

SEQ ID NO: 1437686 - RNA, 18 nt, Homo sapiens
agccaugccucaugccac

SEQ ID NO: 1437687 - RNA, 21 nt, Homo sapiens
agcccagccuagcgugcccug

SEQ ID NO: 1437688 - RNA, 19 nt, Homo sapiens
agccccaggccucuguguc

SEQ ID NO: 1437689 - RNA, 16 nt, Homo sapiens
agcccccuacugagaa

SEQ ID NO: 1437690 - RNA, 24 nt, Homo sapiens
agcccccuggaugggcauugggcu

SEQ ID NO: 1437691 - RNA, 20 nt, Homo sapiens
agccccggcugacaccugga

SEQ ID NO: 1437692 - RNA, 18 nt, Homo sapiens
agcccucaauaagccagc

SEQ ID NO: 1437693 - RNA, 19 nt, Homo sapiens
agcccucccuggcauguca

SEQ ID NO: 1437694 - RNA, 20 nt, Homo sapiens
agcccucgaaccaaggcagc

SEQ ID NO: 1437695 - RNA, 21 nt, Homo sapiens
agcccugggccccaccaccua

SEQ ID NO: 1437696 - RNA, 16 nt, Homo sapiens
agcccugggggccagc

SEQ ID NO: 1437697 - RNA, 15 nt, Homo sapiens
agcccuugaaccagc

SEQ ID NO: 1437698 - RNA, 19 nt, Homo sapiens
agccgcagacaaguaauca

SEQ ID NO: 1437699 - RNA, 16 nt, Homo sapiens
agccgcauggcacucu

SEQ ID NO: 1437700 - RNA, 12 nt, Homo sapiens
agccgcugugag

SEQ ID NO: 1437701 - RNA, 18 nt, Homo sapiens
agccggggcgaguggcac

SEQ ID NO: 1437702 - RNA, 15 nt, Homo sapiens
agccguccauggcac

SEQ ID NO: 1437703 - RNA, 13 nt, Homo sapiens
agccgugcacucc

SEQ ID NO: 1437704 - RNA, 19 nt, Homo sapiens
agccgugucguaugaccua

SEQ ID NO: 1437705 - RNA, 19 nt, Homo sapiens
agccuaacaugauuauuug

SEQ ID NO: 1437706 - RNA, 15 nt, Homo sapiens
agccuauuuauuuga

SEQ ID NO: 1437707 - RNA, 23 nt, Homo sapiens
agccucaagucuuauuuccucaa

SEQ ID NO: 1437708 - RNA, 15 nt, Homo sapiens
agccucagugccacu

SEQ ID NO: 1437709 - RNA, 14 nt, Homo sapiens
agccucccaaagug

SEQ ID NO: 1437710 - RNA, 17 nt, Homo sapiens
agccucccaaguagcug

SEQ ID NO: 1437711 - RNA, 21 nt, Homo sapiens
agccucccccucagaugaucu

SEQ ID NO: 1437712 - RNA, 18 nt, Homo sapiens
agccucccgaguagcugg

SEQ ID NO: 1437713 - RNA, 20 nt, Homo sapiens
agccuccuaauuugaucaca

SEQ ID NO: 1437714 - RNA, 15 nt, Homo sapiens
agccuccuccugacc

SEQ ID NO: 1437715 - RNA, 19 nt, Homo sapiens
agccuccuuuugcuugaaa

SEQ ID NO: 1437716 - RNA, 16 nt, Homo sapiens
agccugagucacuggu

SEQ ID NO: 1437717 - RNA, 20 nt, Homo sapiens
agccugauuauccuauaggc

SEQ ID NO: 1437718 - RNA, 18 nt, Homo sapiens
agccugcaaacucacugc

SEQ ID NO: 1437719 - RNA, 17 nt, Homo sapiens
agccugcccucagcaca

SEQ ID NO: 1437720 - RNA, 18 nt, Homo sapiens
agccuggaagccaaacaa

SEQ ID NO: 1437721 - RNA, 22 nt, Homo sapiens
agccuggagggaugccacccag

SEQ ID NO: 1437722 - RNA, 21 nt, Homo sapiens
agccuggcacagggcaguggg

SEQ ID NO: 1437723 - RNA, 14 nt, Homo sapiens
agccuguauagaca

SEQ ID NO: 1437724 - RNA, 15 nt, Homo sapiens
agccuguauagacag

SEQ ID NO: 1437725 - RNA, 16 nt, Homo sapiens
agccugugcuaaagaa

SEQ ID NO: 1437726 - RNA, 15 nt, Homo sapiens
agccuguugcugaag

SEQ ID NO: 1437727 - RNA, 21 nt, Homo sapiens
auuuguuguuuuuaacaacua

SEQ ID NO: 1437728 - RNA, 18 nt, Homo sapiens
auuuuaacauuuuccaaa

SEQ ID NO: 1437729 - RNA, 22 nt, Homo sapiens
auuuuaacuuccuuggacucau

SEQ ID NO: 1437730 - RNA, 14 nt, Homo sapiens
auuuuaauuaucuu

SEQ ID NO: 1437731 - RNA, 17 nt, Homo sapiens
auuuuagggcuguagac

SEQ ID NO: 1437732 - RNA, 15 nt, Homo sapiens
auuuuaguuccuuua

SEQ ID NO: 1437733 - RNA, 15 nt, Homo sapiens
auuuucacucugggc

SEQ ID NO: 1437734 - RNA, 14 nt, Homo sapiens
auuuucauuucacu

SEQ ID NO: 1437735 - RNA, 18 nt, Homo sapiens
auuuuccccuagcuuucc

SEQ ID NO: 1437736 - RNA, 22 nt, Homo sapiens
auuuucccuucgauauaugacu

SEQ ID NO: 1437737 - RNA, 21 nt, Homo sapiens
auuuucucuaaaauuucaaca

SEQ ID NO: 1437738 - RNA, 23 nt, Homo sapiens
auuuucuuucuuuuucuggaaau

SEQ ID NO: 1437739 - RNA, 14 nt, Homo sapiens
auuuucuuuuccau

SEQ ID NO: 1437740 - RNA, 22 nt, Homo sapiens
auuuugaaauaaacagguaaua

SEQ ID NO: 1437741 - RNA, 23 nt, Homo sapiens
auuuugcauugugugagcuucua

SEQ ID NO: 1437742 - RNA, 24 nt, Homo sapiens
auuuuguaugaaaaaucaauguca

SEQ ID NO: 1437743 - RNA, 20 nt, Homo sapiens
auuuuucaaccagcauuuua

SEQ ID NO: 1437744 - RNA, 12 nt, Homo sapiens
auuuuugcaaug

SEQ ID NO: 1437745 - RNA, 17 nt, Homo sapiens
auuuuugucauauguau

SEQ ID NO: 1437746 - RNA, 15 nt, Homo sapiens
auuuuuuaaagcuac

SEQ ID NO: 1437747 - RNA, 22 nt, Homo sapiens
auuuuuuaaaugacugcugaau

SEQ ID NO: 1437748 - RNA, 12 nt, Homo sapiens
auuuuuuccaca

SEQ ID NO: 1437749 - RNA, 18 nt, Homo sapiens
auuuuuuuauacuaccaa

SEQ ID NO: 1437750 - RNA, 14 nt, Homo sapiens
caaaaagacugugg

SEQ ID NO: 1437751 - RNA, 23 nt, Homo sapiens
caaaaaugaaagcaugucucaau

SEQ ID NO: 1437752 - RNA, 13 nt, Homo sapiens
caaaaauguaaug

SEQ ID NO: 1437753 - RNA, 11 nt, Homo sapiens
caaaacaacca

SEQ ID NO: 1437754 - RNA, 12 nt, Homo sapiens
caaaacacugug

SEQ ID NO: 1437755 - RNA, 13 nt, Homo sapiens
caaaacacugugu

SEQ ID NO: 1437756 - RNA, 16 nt, Homo sapiens
caaaacauacccagug

SEQ ID NO: 1437757 - RNA, 21 nt, Homo sapiens
caaaacguggguauuuccugc

SEQ ID NO: 1437758 - RNA, 16 nt, Homo sapiens
caaaagaugccauuca

SEQ ID NO: 1437759 - RNA, 17 nt, Homo sapiens
caaaagaugccauucau

SEQ ID NO: 1437760 - RNA, 14 nt, Homo sapiens
caaaagauucugua

SEQ ID NO: 1437761 - RNA, 22 nt, Homo sapiens
caaaagcaagacuguugcucaa

SEQ ID NO: 1437762 - RNA, 12 nt, Homo sapiens
caaaagccaaaa

SEQ ID NO: 1437763 - RNA, 21 nt, Homo sapiens
caaaagucaccacuccauucc

SEQ ID NO: 1437764 - RNA, 22 nt, Homo sapiens
caaaagucaccacuccauuccc

SEQ ID NO: 1437765 - RNA, 14 nt, Homo sapiens
caaaagugaucugu

SEQ ID NO: 1437766 - RNA, 19 nt, Homo sapiens
caaaauacuacacauccaa

SEQ ID NO: 1437767 - RNA, 19 nt, Homo sapiens
caaaauagagaaucccacu

SEQ ID NO: 1437768 - RNA, 16 nt, Homo sapiens
caaaauccaacuaaug

SEQ ID NO: 1437769 - RNA, 18 nt, Homo sapiens
caaaauggaagguuggag

SEQ ID NO: 1437770 - RNA, 21 nt, Homo sapiens
caaaauggacguacugguuua

SEQ ID NO: 1437771 - RNA, 19 nt, Homo sapiens
caaaauuuuauaagcaaau

SEQ ID NO: 1437772 - RNA, 19 nt, Homo sapiens
caaacaaaaucauggagcu

SEQ ID NO: 1437773 - RNA, 11 nt, Homo sapiens
caaacaagcac

SEQ ID NO: 1437774 - RNA, 15 nt, Homo sapiens
caaacacacuguaaa

SEQ ID NO: 1437775 - RNA, 12 nt, Homo sapiens
caaacacuccac

SEQ ID NO: 1437776 - RNA, 13 nt, Homo sapiens
caaacacugugua

SEQ ID NO: 1437777 - RNA, 16 nt, Homo sapiens
caaaccacaacugaca

SEQ ID NO: 1437778 - RNA, 21 nt, Homo sapiens
caaaccccauggagcagccag

SEQ ID NO: 1437779 - RNA, 14 nt, Homo sapiens
caaacuacaaagcu

SEQ ID NO: 1437780 - RNA, 16 nt, Homo sapiens
caaacuacauguaauc

SEQ ID NO: 1437781 - RNA, 14 nt, Homo sapiens
caaacuaugaucac

SEQ ID NO: 1437782 - RNA, 21 nt, Homo sapiens
caaacucucccccaaauguau

SEQ ID NO: 1437783 - RNA, 15 nt, Homo sapiens
caaagaaaagccaga

SEQ ID NO: 1437784 - RNA, 22 nt, Homo sapiens
caaagaaggcacagguguaaau

SEQ ID NO: 1437785 - RNA, 21 nt, Homo sapiens
caaagaauacuagaaugguag

SEQ ID NO: 1437786 - RNA, 19 nt, Homo sapiens
caaagagaaaucacagggg

SEQ ID NO: 1437787 - RNA, 17 nt, Homo sapiens
caaagauauauacacag

SEQ ID NO: 1437788 - RNA, 16 nt, Homo sapiens
caaaggaagacuugaa

SEQ ID NO: 1437789 - RNA, 18 nt, Homo sapiens
caaagucugugugaugaa

SEQ ID NO: 1437790 - RNA, 22 nt, Homo sapiens
caaagugacacagagcaauggu

SEQ ID NO: 1437791 - RNA, 17 nt, Homo sapiens
caaauaaacucuaaaca

SEQ ID NO: 1437792 - RNA, 17 nt, Homo sapiens
caaauaaaguaccauua

SEQ ID NO: 1437793 - RNA, 14 nt, Homo sapiens
caaauaaauggagu

SEQ ID NO: 1437794 - RNA, 14 nt, Homo sapiens
caaaucaaccccag

SEQ ID NO: 1437795 - RNA, 17 nt, Homo sapiens
caaauccacaagccauu

SEQ ID NO: 1437796 - RNA, 17 nt, Homo sapiens
caaauccucaccaucca

SEQ ID NO: 1437797 - RNA, 22 nt, Homo sapiens
caaaucuccaguauucuuguca

SEQ ID NO: 1437798 - RNA, 14 nt, Homo sapiens
caaaugacccaaag

SEQ ID NO: 1437799 - RNA, 23 nt, Homo sapiens
caaauguaaaauaaguauuucca

SEQ ID NO: 1437800 - RNA, 22 nt, Homo sapiens
caaauucauuuuuuucacugga

SEQ ID NO: 1437801 - RNA, 20 nt, Homo sapiens
caaauugcuacauaguccaa

SEQ ID NO: 1437802 - RNA, 11 nt, Homo sapiens
caaauuucaca

SEQ ID NO: 1437803 - RNA, 17 nt, Homo sapiens
caacaaacaaaacgcaa

SEQ ID NO: 1437804 - RNA, 19 nt, Homo sapiens
caacaaagcgagaucccau

SEQ ID NO: 1437805 - RNA, 19 nt, Homo sapiens
caacaacauccauguccua

SEQ ID NO: 1437806 - RNA, 15 nt, Homo sapiens
caacaauaaagacug

SEQ ID NO: 1437807 - RNA, 19 nt, Homo sapiens
caacacauuacuugcacaa

SEQ ID NO: 1437808 - RNA, 12 nt, Homo sapiens
caacacccaaag

SEQ ID NO: 1437809 - RNA, 19 nt, Homo sapiens
caacacuucucacaucuua

SEQ ID NO: 1437810 - RNA, 18 nt, Homo sapiens
caacagcucagagaugaa

SEQ ID NO: 1437811 - RNA, 16 nt, Homo sapiens
caacaggaacuuggag

SEQ ID NO: 1437812 - RNA, 22 nt, Homo sapiens
caacaggcuguucugcacugaa

SEQ ID NO: 1437813 - RNA, 21 nt, Homo sapiens
caacauaaggagaauguaucu

SEQ ID NO: 1437814 - RNA, 21 nt, Homo sapiens
cagaagcacauaugaacugga

SEQ ID NO: 1437815 - RNA, 15 nt, Homo sapiens
cagaagguugcucua

SEQ ID NO: 1437816 - RNA, 18 nt, Homo sapiens
cagaagguuugcaccccu

SEQ ID NO: 1437817 - RNA, 20 nt, Homo sapiens
cagaaucgcuaauagaacca

SEQ ID NO: 1437818 - RNA, 18 nt, Homo sapiens
cagaaucugcuguugcca

SEQ ID NO: 1437819 - RNA, 19 nt, Homo sapiens
cagaaugcucuacuucuuu

SEQ ID NO: 1437820 - RNA, 22 nt, Homo sapiens
cagaauguuuuuaaaauaugag

SEQ ID NO: 1437821 - RNA, 21 nt, Homo sapiens
cagaauuggccucaguguagu

SEQ ID NO: 1437822 - RNA, 16 nt, Homo sapiens
cagaauuuuaaagagc

SEQ ID NO: 1437823 - RNA, 14 nt, Homo sapiens
cagaccaccugcca

SEQ ID NO: 1437824 - RNA, 23 nt, Homo sapiens
cagaccaccugccagccaucaca

SEQ ID NO: 1437825 - RNA, 13 nt, Homo sapiens
cagaccagugaaa

SEQ ID NO: 1437826 - RNA, 17 nt, Homo sapiens
cagaccauccaccaggc

SEQ ID NO: 1437827 - RNA, 18 nt, Homo sapiens
cagaccauugucuuccaa

SEQ ID NO: 1437828 - RNA, 18 nt, Homo sapiens
cagaccuuuuauccacuu

SEQ ID NO: 1437829 - RNA, 19 nt, Homo sapiens
cagacgucucaagacugaa

SEQ ID NO: 1437830 - RNA, 16 nt, Homo sapiens
cagacuccugugcaac

SEQ ID NO: 1437831 - RNA, 18 nt, Homo sapiens
cagacucguucuucuggg

SEQ ID NO: 1437832 - RNA, 20 nt, Homo sapiens
cagacuucccugaauguauu

SEQ ID NO: 1437833 - RNA, 14 nt, Homo sapiens
cagacuucuccaga

SEQ ID NO: 1437834 - RNA, 18 nt, Homo sapiens
cagagaaaugugaagggu

SEQ ID NO: 1437835 - RNA, 21 nt, Homo sapiens
cagagaagaccaaagcauugc

SEQ ID NO: 1437836 - RNA, 14 nt, Homo sapiens
cagagacaccugca

SEQ ID NO: 1437837 - RNA, 19 nt, Homo sapiens
cagagaccccaggauccca

SEQ ID NO: 1437838 - RNA, 16 nt, Homo sapiens
cagagacgcaagggag

SEQ ID NO: 1437839 - RNA, 17 nt, Homo sapiens
cagagacggaagccuuu

SEQ ID NO: 1437840 - RNA, 13 nt, Homo sapiens
cagagacuauuua

SEQ ID NO: 1437841 - RNA, 14 nt, Homo sapiens
cagagacucuggaa

SEQ ID NO: 1437842 - RNA, 17 nt, Homo sapiens
cagagaguccucuggau

SEQ ID NO: 1437843 - RNA, 18 nt, Homo sapiens
cagagauacgcaaacaca

SEQ ID NO: 1437844 - RNA, 22 nt, Homo sapiens
cagagaugcaugcgcaggcuca

SEQ ID NO: 1437845 - RNA, 19 nt, Homo sapiens
cagagaugccuccaccgcu

SEQ ID NO: 1437846 - RNA, 14 nt, Homo sapiens
cagagcuuccucag

SEQ ID NO: 1437847 - RNA, 21 nt, Homo sapiens
cagaggauuuaacugugaacc

SEQ ID NO: 1437848 - RNA, 19 nt, Homo sapiens
cagaggcugcagaaggcca

SEQ ID NO: 1437849 - RNA, 18 nt, Homo sapiens
cagaggcuggcagugcug

SEQ ID NO: 1437850 - RNA, 14 nt, Homo sapiens
cagagggccuagga

SEQ ID NO: 1437851 - RNA, 18 nt, Homo sapiens
cagagguaaaagugugag

SEQ ID NO: 1437852 - RNA, 15 nt, Homo sapiens
cagaggugcugucag

SEQ ID NO: 1437853 - RNA, 15 nt, Homo sapiens
cagagguggcugcug

SEQ ID NO: 1437854 - RNA, 12 nt, Homo sapiens
cagaguccuaca

SEQ ID NO: 1437855 - RNA, 17 nt, Homo sapiens
cagaguggagcccucag

SEQ ID NO: 1437856 - RNA, 21 nt, Homo sapiens
cagaguggccccucaccuggg

SEQ ID NO: 1437857 - RNA, 18 nt, Homo sapiens
cagagugugcagacugau

SEQ ID NO: 1437858 - RNA, 21 nt, Homo sapiens
cagaguuccauguuuguacuc

SEQ ID NO: 1437859 - RNA, 18 nt, Homo sapiens
cagauaaaacauggacaa

SEQ ID NO: 1437860 - RNA, 17 nt, Homo sapiens
cagauaaagacagcuga

SEQ ID NO: 1437861 - RNA, 23 nt, Homo sapiens
cagauaaaggaaggagauacuca

SEQ ID NO: 1437862 - RNA, 21 nt, Homo sapiens
cagauacuucccauuuuggaa

SEQ ID NO: 1437863 - RNA, 17 nt, Homo sapiens
cagauauacacauggau

SEQ ID NO: 1437864 - RNA, 19 nt, Homo sapiens
cagauccucacaaccaccu

SEQ ID NO: 1437865 - RNA, 22 nt, Homo sapiens
cagaucgauccuggauucacuc

SEQ ID NO: 1437866 - RNA, 21 nt, Homo sapiens
cagaugaaauuuauuuccauc

SEQ ID NO: 1437867 - RNA, 12 nt, Homo sapiens
cagaugaucucu

SEQ ID NO: 1437868 - RNA, 23 nt, Homo sapiens
cagaugcacacacagaugcacac

SEQ ID NO: 1437869 - RNA, 23 nt, Homo sapiens
cagaugggcuguuucguguagug

SEQ ID NO: 1437870 - RNA, 15 nt, Homo sapiens
cagauggguauuaaa

SEQ ID NO: 1437871 - RNA, 20 nt, Homo sapiens
cagauggucacacagagaua

SEQ ID NO: 1437872 - RNA, 15 nt, Homo sapiens
cagauucccagagca

SEQ ID NO: 1437873 - RNA, 21 nt, Homo sapiens
cagauucuuccacuggcucca

SEQ ID NO: 1437874 - RNA, 13 nt, Homo sapiens
cagauugacaagg

SEQ ID NO: 1437875 - RNA, 14 nt, Homo sapiens
cagcaaaccucagu

SEQ ID NO: 1437876 - RNA, 18 nt, Homo sapiens
cagcaauagggugcaguu

SEQ ID NO: 1437877 - RNA, 21 nt, Homo sapiens
cagcacuccaccuugggaccu

SEQ ID NO: 1437878 - RNA, 20 nt, Homo sapiens
cagcacucccucccagagaa

SEQ ID NO: 1437879 - RNA, 20 nt, Homo sapiens
cagcacugaaaauaccauca

SEQ ID NO: 1437880 - RNA, 22 nt, Homo sapiens
cagcacugccggcccagugaca

SEQ ID NO: 1437881 - RNA, 11 nt, Homo sapiens
cagcacuuugg

SEQ ID NO: 1437882 - RNA, 23 nt, Homo sapiens
cagcagcccuaaggaucucucag

SEQ ID NO: 1437883 - RNA, 17 nt, Homo sapiens
cagcagcgguaccccag

SEQ ID NO: 1437884 - RNA, 21 nt, Homo sapiens
cagcagggucuugcuguaacu

SEQ ID NO: 1437885 - RNA, 21 nt, Homo sapiens
cagcauaccugcuggugcaga

SEQ ID NO: 1437886 - RNA, 20 nt, Homo sapiens
cagcauaccuuggacugacu

SEQ ID NO: 1437887 - RNA, 16 nt, Homo sapiens
cagcauuauucuucag

SEQ ID NO: 1437888 - RNA, 19 nt, Homo sapiens
cagcauuauucuucagaag

SEQ ID NO: 1437889 - RNA, 14 nt, Homo sapiens
cagccaacugcccc

SEQ ID NO: 1437890 - RNA, 15 nt, Homo sapiens
cagccacaaaguagu

SEQ ID NO: 1437891 - RNA, 14 nt, Homo sapiens
cagccaggggcugc

SEQ ID NO: 1437892 - RNA, 21 nt, Homo sapiens
cagccaucccgucuucuccaa

SEQ ID NO: 1437893 - RNA, 23 nt, Homo sapiens
cagccaucccgucuucuccaaca

SEQ ID NO: 1437894 - RNA, 19 nt, Homo sapiens
cagcccaacgggaagcaac

SEQ ID NO: 1437895 - RNA, 15 nt, Homo sapiens
cagcccagcuggugg

SEQ ID NO: 1437896 - RNA, 20 nt, Homo sapiens
cagcccauuuuaucuuugaa

SEQ ID NO: 1437897 - RNA, 13 nt, Homo sapiens
cagccuacugccu

SEQ ID NO: 1437898 - RNA, 13 nt, Homo sapiens
cagccucaagucu

SEQ ID NO: 1437899 - RNA, 15 nt, Homo sapiens
cagccucagugccac

SEQ ID NO: 1437900 - RNA, 23 nt, Homo sapiens
cauuacuuuaauacucaccuccu

SEQ ID NO: 1437901 - RNA, 22 nt, Homo sapiens
cauuagaaacugaaaacuguaa

SEQ ID NO: 1437902 - RNA, 23 nt, Homo sapiens
cauuagaaacugaaaacuguaaa

SEQ ID NO: 1437903 - RNA, 14 nt, Homo sapiens
cauuauacauuuga

SEQ ID NO: 1437904 - RNA, 21 nt, Homo sapiens
cauuaugugugcaugugugua

SEQ ID NO: 1437905 - RNA, 19 nt, Homo sapiens
cauuauuaaauguuucuca

SEQ ID NO: 1437906 - RNA, 12 nt, Homo sapiens
cauuauuccucc

SEQ ID NO: 1437907 - RNA, 16 nt, Homo sapiens
cauuauuccuccagga

SEQ ID NO: 1437908 - RNA, 17 nt, Homo sapiens
cauucaaaaaccugguu

SEQ ID NO: 1437909 - RNA, 14 nt, Homo sapiens
cauucaacugaaaa

SEQ ID NO: 1437910 - RNA, 21 nt, Homo sapiens
cauucacauuugauguacaug

SEQ ID NO: 1437911 - RNA, 23 nt, Homo sapiens
cauucaucaagcuguacauuugg

SEQ ID NO: 1437912 - RNA, 19 nt, Homo sapiens
cauuccaaggguaugggaa

SEQ ID NO: 1437913 - RNA, 14 nt, Homo sapiens
cauuccaccuuccc

SEQ ID NO: 1437914 - RNA, 12 nt, Homo sapiens
cauuccaggaaa

SEQ ID NO: 1437915 - RNA, 22 nt, Homo sapiens
cauuccccucgugugacucucu

SEQ ID NO: 1437916 - RNA, 17 nt, Homo sapiens
cauuccuguagucaaaa

SEQ ID NO: 1437917 - RNA, 13 nt, Homo sapiens
cauucuacacuga

SEQ ID NO: 1437918 - RNA, 16 nt, Homo sapiens
cauucucaucuacuca

SEQ ID NO: 1437919 - RNA, 22 nt, Homo sapiens
cauucugguuuugacaucagca

SEQ ID NO: 1437920 - RNA, 13 nt, Homo sapiens
cauugaauuugcc

SEQ ID NO: 1437921 - RNA, 19 nt, Homo sapiens
cauugaucaaauauuucaa

SEQ ID NO: 1437922 - RNA, 12 nt, Homo sapiens
cauuuacuuaac

SEQ ID NO: 1437923 - RNA, 23 nt, Homo sapiens
cauuuacuuaacagaacagucac

SEQ ID NO: 1437924 - RNA, 14 nt, Homo sapiens
cauuuaucccucaa

SEQ ID NO: 1437925 - RNA, 20 nt, Homo sapiens
cauuuauuuacaucuaugua

SEQ ID NO: 1437926 - RNA, 13 nt, Homo sapiens
cauuucaacucca

SEQ ID NO: 1437927 - RNA, 17 nt, Homo sapiens
cauuucaucuacuacag

SEQ ID NO: 1437928 - RNA, 20 nt, Homo sapiens
cauuucaucuacuacagggu

SEQ ID NO: 1437929 - RNA, 13 nt, Homo sapiens
cauuucccugugc

SEQ ID NO: 1437930 - RNA, 19 nt, Homo sapiens
cauuuccugacagaaggac

SEQ ID NO: 1437931 - RNA, 14 nt, Homo sapiens
cauuugagugucuu

SEQ ID NO: 1437932 - RNA, 22 nt, Homo sapiens
cauuuggauaaaaggaaccaac

SEQ ID NO: 1437933 - RNA, 18 nt, Homo sapiens
cauuuggguacgucuggg

SEQ ID NO: 1437934 - RNA, 15 nt, Homo sapiens
cauuuguacugaccc

SEQ ID NO: 1437935 - RNA, 22 nt, Homo sapiens
cauuuguggucacagccaugaa

SEQ ID NO: 1437936 - RNA, 21 nt, Homo sapiens
cauuuguuggaaugaauuaaa

SEQ ID NO: 1437937 - RNA, 15 nt, Homo sapiens
cauuuuauaaauuca

SEQ ID NO: 1437938 - RNA, 17 nt, Homo sapiens
cauuuuaugucauuaaa

SEQ ID NO: 1437939 - RNA, 17 nt, Homo sapiens
ccaaaaaaauacuugag

SEQ ID NO: 1437940 - RNA, 18 nt, Homo sapiens
ccaaaauaaaaccagcuc

SEQ ID NO: 1437941 - RNA, 13 nt, Homo sapiens
ccaaaaugcauuu

SEQ ID NO: 1437942 - RNA, 16 nt, Homo sapiens
ccaaacacacuguaaa

SEQ ID NO: 1437943 - RNA, 17 nt, Homo sapiens
ccaaacacacuguaaau

SEQ ID NO: 1437944 - RNA, 14 nt, Homo sapiens
ccaaaccgcaggca

SEQ ID NO: 1437945 - RNA, 19 nt, Homo sapiens
ccaaagaaauguaagggaa

SEQ ID NO: 1437946 - RNA, 17 nt, Homo sapiens
ccaaagaccaauauuca

SEQ ID NO: 1437947 - RNA, 18 nt, Homo sapiens
ccaaagacuacacuguug

SEQ ID NO: 1437948 - RNA, 13 nt, Homo sapiens
ccaaagagacugg

SEQ ID NO: 1437949 - RNA, 16 nt, Homo sapiens
ccaaagcucagacuug

SEQ ID NO: 1437950 - RNA, 20 nt, Homo sapiens
ccaaagugaccuacccagag

SEQ ID NO: 1437951 - RNA, 17 nt, Homo sapiens
ccaaauaaaguaccauu

SEQ ID NO: 1437952 - RNA, 19 nt, Homo sapiens
ccaaauauaaacuugugua

SEQ ID NO: 1437953 - RNA, 18 nt, Homo sapiens
ccaaauccacaagccauu

SEQ ID NO: 1437954 - RNA, 19 nt, Homo sapiens
ccaaaugcauggugcaguu

SEQ ID NO: 1437955 - RNA, 12 nt, Homo sapiens
ccaaauucccug

SEQ ID NO: 1437956 - RNA, 22 nt, Homo sapiens
ccaacaaacaaugccaucacug

SEQ ID NO: 1437957 - RNA, 23 nt, Homo sapiens
ccaacaggcuguucugcacugaa

SEQ ID NO: 1437958 - RNA, 14 nt, Homo sapiens
ccaaccuccugacc

SEQ ID NO: 1437959 - RNA, 22 nt, Homo sapiens
ccaaccuggaguauaauauuca

SEQ ID NO: 1437960 - RNA, 16 nt, Homo sapiens
ccaacgcacaggaaaa

SEQ ID NO: 1437961 - RNA, 12 nt, Homo sapiens
ccaacucuagcc

SEQ ID NO: 1437962 - RNA, 21 nt, Homo sapiens
ccaagaacuuuucccccaaag

SEQ ID NO: 1437963 - RNA, 18 nt, Homo sapiens
ccaagaaggugagugcuu

SEQ ID NO: 1437964 - RNA, 20 nt, Homo sapiens
ccaagacucugaaaucucag

SEQ ID NO: 1437965 - RNA, 17 nt, Homo sapiens
ccaagaggucuccauca

SEQ ID NO: 1437966 - RNA, 22 nt, Homo sapiens
ccaagauggaggggcugacuca

SEQ ID NO: 1437967 - RNA, 21 nt, Homo sapiens
ccaagcaaaaacaaaugggaa

SEQ ID NO: 1437968 - RNA, 15 nt, Homo sapiens
ccaagccauggugac

SEQ ID NO: 1437969 - RNA, 12 nt, Homo sapiens
ccaagcuuucuu

SEQ ID NO: 1437970 - RNA, 18 nt, Homo sapiens
ccaaggggguggacgcaa

SEQ ID NO: 1437971 - RNA, 16 nt, Homo sapiens
ccaaguccagguccug

SEQ ID NO: 1437972 - RNA, 14 nt, Homo sapiens
ccaagucuacuuca

SEQ ID NO: 1437973 - RNA, 21 nt, Homo sapiens
ccaagugaccauaaaggcaug

SEQ ID NO: 1437974 - RNA, 16 nt, Homo sapiens
ccaagugccaauauuu

SEQ ID NO: 1437975 - RNA, 18 nt, Homo sapiens
ccaauaaaagugacucuc

SEQ ID NO: 1437976 - RNA, 17 nt, Homo sapiens
ccaauaggcauuugauu

SEQ ID NO: 1437977 - RNA, 15 nt, Homo sapiens
ccaaucagcacugaa

SEQ ID NO: 1437978 - RNA, 13 nt, Homo sapiens
ccaaugauucaua

SEQ ID NO: 1437979 - RNA, 11 nt, Homo sapiens
ccaaugcacac

SEQ ID NO: 1437980 - RNA, 18 nt, Homo sapiens
ccaaugcacacacacaga

SEQ ID NO: 1437981 - RNA, 15 nt, Homo sapiens
ccaauggcuguaaac

SEQ ID NO: 1437982 - RNA, 12 nt, Homo sapiens
ccacaaacugau

SEQ ID NO: 1437983 - RNA, 13 nt, Homo sapiens
ccacaacugacac

SEQ ID NO: 1437984 - RNA, 18 nt, Homo sapiens
ccacaacugacacaggaa

SEQ ID NO: 1437985 - RNA, 19 nt, Homo sapiens
ccacaacugacacaggaaa

SEQ ID NO: 1437986 - RNA, 19 nt, Homo sapiens
ccacaaucugggacuuuca

SEQ ID NO: 1437987 - RNA, 14 nt, Homo sapiens
ccgcgugccaugca

SEQ ID NO: 1437988 - RNA, 12 nt, Homo sapiens
ccgcguggaaug

SEQ ID NO: 1437989 - RNA, 12 nt, Homo sapiens
ccggccagccuu

SEQ ID NO: 1437990 - RNA, 22 nt, Homo sapiens
ccggcucccuucuacagccuca

SEQ ID NO: 1437991 - RNA, 14 nt, Homo sapiens
ccggcuccugucau

SEQ ID NO: 1437992 - RNA, 16 nt, Homo sapiens
ccggcucuucaaagac

SEQ ID NO: 1437993 - RNA, 21 nt, Homo sapiens
ccgggacuucaaagccgugau

SEQ ID NO: 1437994 - RNA, 15 nt, Homo sapiens
ccgggccacuccuuc

SEQ ID NO: 1437995 - RNA, 20 nt, Homo sapiens
ccgggcugggagcucugcag

SEQ ID NO: 1437996 - RNA, 16 nt, Homo sapiens
ccggggcgaguggcac

SEQ ID NO: 1437997 - RNA, 11 nt, Homo sapiens
ccgucuucucc

SEQ ID NO: 1437998 - RNA, 12 nt, Homo sapiens
ccgugacagggc

SEQ ID NO: 1437999 - RNA, 14 nt, Homo sapiens
ccgugcacucccua

SEQ ID NO: 1438000 - RNA, 22 nt, Homo sapiens
ccgugcucgcccacaaacugau

SEQ ID NO: 1438001 - RNA, 19 nt, Homo sapiens
ccguguuacuguugcacug

SEQ ID NO: 1438002 - RNA, 14 nt, Homo sapiens
ccuaaagucucugc

SEQ ID NO: 1438003 - RNA, 14 nt, Homo sapiens
ccuaagaaaaucau

SEQ ID NO: 1438004 - RNA, 20 nt, Homo sapiens
ccuaaguauaaaugguuguc

SEQ ID NO: 1438005 - RNA, 23 nt, Homo sapiens
ccuaaugaaggaguucacuguaa

SEQ ID NO: 1438006 - RNA, 12 nt, Homo sapiens
ccuaccaaauau

SEQ ID NO: 1438007 - RNA, 23 nt, Homo sapiens
ccuaccaguuggccaugaugucu

SEQ ID NO: 1438008 - RNA, 14 nt, Homo sapiens
ccuacccacuucca

SEQ ID NO: 1438009 - RNA, 16 nt, Homo sapiens
ccuaccccaagaugcc

SEQ ID NO: 1438010 - RNA, 19 nt, Homo sapiens
ccuacugccucuccagcac

SEQ ID NO: 1438011 - RNA, 22 nt, Homo sapiens
ccuagaccugggccaaaagggc

SEQ ID NO: 1438012 - RNA, 21 nt, Homo sapiens
ccuagagugacucuaccugca

SEQ ID NO: 1438013 - RNA, 22 nt, Homo sapiens
ccuagagugacucuaccugcaa

SEQ ID NO: 1438014 - RNA, 21 nt, Homo sapiens
ccuagcauagguaugagccag

SEQ ID NO: 1438015 - RNA, 21 nt, Homo sapiens
ccuaggaauucccagcccaaa

SEQ ID NO: 1438016 - RNA, 20 nt, Homo sapiens
ccuaggguccuguccaugcc

SEQ ID NO: 1438017 - RNA, 13 nt, Homo sapiens
ccuagugcuauuc

SEQ ID NO: 1438018 - RNA, 12 nt, Homo sapiens
ccuagugcuguu

SEQ ID NO: 1438019 - RNA, 15 nt, Homo sapiens
ccuauaaugugugua

SEQ ID NO: 1438020 - RNA, 14 nt, Homo sapiens
ccuaucacugauag

SEQ ID NO: 1438021 - RNA, 23 nt, Homo sapiens
ccuaucagaaguuucucagcucc

SEQ ID NO: 1438022 - RNA, 16 nt, Homo sapiens
ccuaucuugugcucuu

SEQ ID NO: 1438023 - RNA, 15 nt, Homo sapiens
ccuauguccuaagga

SEQ ID NO: 1438024 - RNA, 20 nt, Homo sapiens
ccuauuuaugaaaaccauau

SEQ ID NO: 1438025 - RNA, 22 nt, Homo sapiens
ccuauuuuaauuggaauucugg

SEQ ID NO: 1438026 - RNA, 17 nt, Homo sapiens
ccuauuuucuuuuccau

SEQ ID NO: 1438027 - RNA, 14 nt, Homo sapiens
ccucaaaagcacuu

SEQ ID NO: 1438028 - RNA, 17 nt, Homo sapiens
ccucaaaugacccaaag

SEQ ID NO: 1438029 - RNA, 20 nt, Homo sapiens
ccucaaaugacccaaagacc

SEQ ID NO: 1438030 - RNA, 19 nt, Homo sapiens
ccucaaaugucagagcuau

SEQ ID NO: 1438031 - RNA, 16 nt, Homo sapiens
ccucaacaugguccuu

SEQ ID NO: 1438032 - RNA, 19 nt, Homo sapiens
ccucaauaagccagcaaac

SEQ ID NO: 1438033 - RNA, 12 nt, Homo sapiens
ccucacugaaaa

SEQ ID NO: 1438034 - RNA, 19 nt, Homo sapiens
ccucagacaauccacucuc

SEQ ID NO: 1438035 - RNA, 19 nt, Homo sapiens
ccucaggcugccaggaugg

SEQ ID NO: 1438036 - RNA, 17 nt, Homo sapiens
ccucaucucacugccca

SEQ ID NO: 1438037 - RNA, 20 nt, Homo sapiens
ccucaucugcagaaugggga

SEQ ID NO: 1438038 - RNA, 23 nt, Homo sapiens
ccucaucuugcccccucaucuca

SEQ ID NO: 1438039 - RNA, 18 nt, Homo sapiens
ccucaugugugcugugcu

SEQ ID NO: 1438040 - RNA, 14 nt, Homo sapiens
ccucauuuaccaua

SEQ ID NO: 1438041 - RNA, 21 nt, Homo sapiens
ccuccaagauuucagaagcca

SEQ ID NO: 1438042 - RNA, 21 nt, Homo sapiens
ccuccaagccauucacuuccc

SEQ ID NO: 1438043 - RNA, 15 nt, Homo sapiens
ccuccaccuaccugc

SEQ ID NO: 1438044 - RNA, 20 nt, Homo sapiens
ccucccaaagugcuaguauu

SEQ ID NO: 1438045 - RNA, 18 nt, Homo sapiens
ccucccaguuugcugggu

SEQ ID NO: 1438046 - RNA, 16 nt, Homo sapiens
ccucccauagcacugc

SEQ ID NO: 1438047 - RNA, 14 nt, Homo sapiens
ccucccucauucca

SEQ ID NO: 1438048 - RNA, 10 nt, Homo sapiens
ccucccugaa

SEQ ID NO: 1438049 - RNA, 20 nt, Homo sapiens
ccuccguguagugucuguaa

SEQ ID NO: 1438050 - RNA, 21 nt, Homo sapiens
ccuccuagaggugggcagcug

SEQ ID NO: 1438051 - RNA, 19 nt, Homo sapiens
ccuccucggaucaccgaga

SEQ ID NO: 1438052 - RNA, 15 nt, Homo sapiens
ccuccugauggccaa

SEQ ID NO: 1438053 - RNA, 23 nt, Homo sapiens
ccuccugccugcgggcaccuaca

SEQ ID NO: 1438054 - RNA, 23 nt, Homo sapiens
ccucgaacuccuggucucaagca

SEQ ID NO: 1438055 - RNA, 14 nt, Homo sapiens
ccucgccacgggga

SEQ ID NO: 1438056 - RNA, 23 nt, Homo sapiens
ccucgggggaaagcacaccucau

SEQ ID NO: 1438057 - RNA, 18 nt, Homo sapiens
ccucuaagccacucuucc

SEQ ID NO: 1438058 - RNA, 13 nt, Homo sapiens
ccucuacugccuu

SEQ ID NO: 1438059 - RNA, 15 nt, Homo sapiens
ccucuauuuugccac

SEQ ID NO: 1438060 - RNA, 17 nt, Homo sapiens
ccucuccuuccuuaccc

SEQ ID NO: 1438061 - RNA, 21 nt, Homo sapiens
ccucucuaggccuguugccuc

SEQ ID NO: 1438062 - RNA, 12 nt, Homo sapiens
ccucucucagga

SEQ ID NO: 1438063 - RNA, 17 nt, Homo sapiens
ccucucugcuccagaga

SEQ ID NO: 1438064 - RNA, 15 nt, Homo sapiens
ccucugaaaugccuc

SEQ ID NO: 1438065 - RNA, 15 nt, Homo sapiens
ccucugcagcacuuu

SEQ ID NO: 1438066 - RNA, 14 nt, Homo sapiens
ccucuguccaggca

SEQ ID NO: 1438067 - RNA, 16 nt, Homo sapiens
ccucuuccccuugccc

SEQ ID NO: 1438068 - RNA, 20 nt, Homo sapiens
ccucuuuauuuuuugauuga

SEQ ID NO: 1438069 - RNA, 15 nt, Homo sapiens
ccucuuucuacauuc

SEQ ID NO: 1438070 - RNA, 21 nt, Homo sapiens
ccugaaagucuguguccaauu

SEQ ID NO: 1438071 - RNA, 14 nt, Homo sapiens
ccugaaccccaugg

SEQ ID NO: 1438072 - RNA, 21 nt, Homo sapiens
ccugaagaacaguaacugcca

SEQ ID NO: 1438073 - RNA, 18 nt, Homo sapiens
ccugaagucccagcauug

SEQ ID NO: 1438074 - RNA, 22 nt, Homo sapiens
gaaaaguuaugagggucagggc

SEQ ID NO: 1438075 - RNA, 12 nt, Homo sapiens
gaaaauaaguga

SEQ ID NO: 1438076 - RNA, 18 nt, Homo sapiens
gaaaauaccaucaggccu

SEQ ID NO: 1438077 - RNA, 17 nt, Homo sapiens
gaaaauaugauguuuca

SEQ ID NO: 1438078 - RNA, 22 nt, Homo sapiens
gaaaaucaguuauauucuuuaa

SEQ ID NO: 1438079 - RNA, 14 nt, Homo sapiens
gaaaaugaacacag

SEQ ID NO: 1438080 - RNA, 21 nt, Homo sapiens
gaaaaugaagcccuauuacuu

SEQ ID NO: 1438081 - RNA, 14 nt, Homo sapiens
gaaaauguccuccc

SEQ ID NO: 1438082 - RNA, 21 nt, Homo sapiens
gaaaauucuguagguucugug

SEQ ID NO: 1438083 - RNA, 18 nt, Homo sapiens
gaaacaaaaaaguguucc

SEQ ID NO: 1438084 - RNA, 20 nt, Homo sapiens
gaaacaaauaagaccauaaa

SEQ ID NO: 1438085 - RNA, 18 nt, Homo sapiens
gaaacacucaacaauaaa

SEQ ID NO: 1438086 - RNA, 14 nt, Homo sapiens
gaaacaugacacug

SEQ ID NO: 1438087 - RNA, 14 nt, Homo sapiens
gaaacaugauguga

SEQ ID NO: 1438088 - RNA, 16 nt, Homo sapiens
gaaacccauuaggcau

SEQ ID NO: 1438089 - RNA, 12 nt, Homo sapiens
gaaaccuggcau

SEQ ID NO: 1438090 - RNA, 18 nt, Homo sapiens
gaaacggccccauugccu

SEQ ID NO: 1438091 - RNA, 18 nt, Homo sapiens
gaaacucacgaugaaauu

SEQ ID NO: 1438092 - RNA, 18 nt, Homo sapiens
gaaacugaaaacuguaaa

SEQ ID NO: 1438093 - RNA, 21 nt, Homo sapiens
gaaacugaggccauuauuuca

SEQ ID NO: 1438094 - RNA, 16 nt, Homo sapiens
gaaacuguaaauaugu

SEQ ID NO: 1438095 - RNA, 22 nt, Homo sapiens
gaaacuuccuuugagaauugug

SEQ ID NO: 1438096 - RNA, 14 nt, Homo sapiens
gaaagaaugcaaga

SEQ ID NO: 1438097 - RNA, 23 nt, Homo sapiens
gaaagaauuauuuuuguguuucu

SEQ ID NO: 1438098 - RNA, 15 nt, Homo sapiens
gaaagaguagugcau

SEQ ID NO: 1438099 - RNA, 19 nt, Homo sapiens
gaaagaguccuauuugcac

SEQ ID NO: 1438100 - RNA, 14 nt, Homo sapiens
gaaagauggaacuu

SEQ ID NO: 1438101 - RNA, 15 nt, Homo sapiens
gaaagccucuggaaa

SEQ ID NO: 1438102 - RNA, 23 nt, Homo sapiens
gaaaggaaagccaaacacuguuu

SEQ ID NO: 1438103 - RNA, 17 nt, Homo sapiens
gaaaggaagcuccacug

SEQ ID NO: 1438104 - RNA, 16 nt, Homo sapiens
gaaagugacuaccaga

SEQ ID NO: 1438105 - RNA, 14 nt, Homo sapiens
gaaaguucaaaaag

SEQ ID NO: 1438106 - RNA, 16 nt, Homo sapiens
gaaaguucagccagaa

SEQ ID NO: 1438107 - RNA, 16 nt, Homo sapiens
gaaauaaaccuggaga

SEQ ID NO: 1438108 - RNA, 13 nt, Homo sapiens
gaaauaauguucu

SEQ ID NO: 1438109 - RNA, 13 nt, Homo sapiens
gaaaucuguaauu

SEQ ID NO: 1438110 - RNA, 15 nt, Homo sapiens
gaaauguauccugau

SEQ ID NO: 1438111 - RNA, 16 nt, Homo sapiens
gaaaugugucuugucu

SEQ ID NO: 1438112 - RNA, 23 nt, Homo sapiens
gaaaugugucuugucuccauuug

SEQ ID NO: 1438113 - RNA, 21 nt, Homo sapiens
gaacaaugaauuauccagcau

SEQ ID NO: 1438114 - RNA, 20 nt, Homo sapiens
gaacaauuaaacagccaaau

SEQ ID NO: 1438115 - RNA, 13 nt, Homo sapiens
gaacaccuccuag

SEQ ID NO: 1438116 - RNA, 21 nt, Homo sapiens
gaacaccuuuguuuugcacug

SEQ ID NO: 1438117 - RNA, 22 nt, Homo sapiens
gaacacuaaacagacuauuuaa

SEQ ID NO: 1438118 - RNA, 21 nt, Homo sapiens
gaacacuggcaacaacaaagc

SEQ ID NO: 1438119 - RNA, 18 nt, Homo sapiens
gaacaucccaagccagaa

SEQ ID NO: 1438120 - RNA, 14 nt, Homo sapiens
gaaccaauaaugua

SEQ ID NO: 1438121 - RNA, 17 nt, Homo sapiens
gaaccaucucaauguaa

SEQ ID NO: 1438122 - RNA, 13 nt, Homo sapiens
gaaccauuacugu

SEQ ID NO: 1438123 - RNA, 12 nt, Homo sapiens
gaacccaggaca

SEQ ID NO: 1438124 - RNA, 16 nt, Homo sapiens
gaaccgugauaagccu

SEQ ID NO: 1438125 - RNA, 14 nt, Homo sapiens
gaaccucaaacugg

SEQ ID NO: 1438126 - RNA, 16 nt, Homo sapiens
gaaccuggagggcuag

SEQ ID NO: 1438127 - RNA, 16 nt, Homo sapiens
gaacgucuaguacaau

SEQ ID NO: 1438128 - RNA, 15 nt, Homo sapiens
gaacuagagaaggac

SEQ ID NO: 1438129 - RNA, 20 nt, Homo sapiens
gaacuauuucuacacagugg

SEQ ID NO: 1438130 - RNA, 15 nt, Homo sapiens
gaacucagagccccu

SEQ ID NO: 1438131 - RNA, 15 nt, Homo sapiens
gaacuccaguacuca

SEQ ID NO: 1438132 - RNA, 18 nt, Homo sapiens
gaacuccggaaugaccag

SEQ ID NO: 1438133 - RNA, 16 nt, Homo sapiens
gaacugaagaccucca

SEQ ID NO: 1438134 - RNA, 23 nt, Homo sapiens
gaacugagccaaacacacuguaa

SEQ ID NO: 1438135 - RNA, 17 nt, Homo sapiens
gaacugccccaucuccu

SEQ ID NO: 1438136 - RNA, 19 nt, Homo sapiens
gaacuggaggaguuccuug

SEQ ID NO: 1438137 - RNA, 14 nt, Homo sapiens
gaacuuauuuacac

SEQ ID NO: 1438138 - RNA, 20 nt, Homo sapiens
gaacuugcugcugagugcac

SEQ ID NO: 1438139 - RNA, 15 nt, Homo sapiens
gaacuuucacauagc

SEQ ID NO: 1438140 - RNA, 14 nt, Homo sapiens
gaagaaaacaugac

SEQ ID NO: 1438141 - RNA, 15 nt, Homo sapiens
gaagaaaacaugacu

SEQ ID NO: 1438142 - RNA, 17 nt, Homo sapiens
gaagaacauccaaggag

SEQ ID NO: 1438143 - RNA, 15 nt, Homo sapiens
gaagacacugcaaag

SEQ ID NO: 1438144 - RNA, 17 nt, Homo sapiens
gaagacccacgugcuag

SEQ ID NO: 1438145 - RNA, 16 nt, Homo sapiens
gaagacccaguguaaa

SEQ ID NO: 1438146 - RNA, 16 nt, Homo sapiens
gaagagaagcugagaa

SEQ ID NO: 1438147 - RNA, 15 nt, Homo sapiens
gaagagacucucuua

SEQ ID NO: 1438148 - RNA, 18 nt, Homo sapiens
gaagagacucucuuaggg

SEQ ID NO: 1438149 - RNA, 21 nt, Homo sapiens
gaagaggugagaguaagccuu

SEQ ID NO: 1438150 - RNA, 20 nt, Homo sapiens
gaagaguuucuccuuuugac

SEQ ID NO: 1438151 - RNA, 20 nt, Homo sapiens
gaagauacugacuagucaua

SEQ ID NO: 1438152 - RNA, 13 nt, Homo sapiens
gaagccacugccu

SEQ ID NO: 1438153 - RNA, 14 nt, Homo sapiens
gaagccacugccuu

SEQ ID NO: 1438154 - RNA, 20 nt, Homo sapiens
gaagccgucugacuccagag

SEQ ID NO: 1438155 - RNA, 13 nt, Homo sapiens
gaagcuccacugu

SEQ ID NO: 1438156 - RNA, 15 nt, Homo sapiens
gaagcuccacuguca

SEQ ID NO: 1438157 - RNA, 19 nt, Homo sapiens
gaagcugggagcuacaggg

SEQ ID NO: 1438158 - RNA, 16 nt, Homo sapiens
gaaggaagaagccaga

SEQ ID NO: 1438159 - RNA, 12 nt, Homo sapiens
gaaggacugugc

SEQ ID NO: 1438160 - RNA, 17 nt, Homo sapiens
gaaggcaaagagaccac

SEQ ID NO: 1438161 - RNA, 16 nt, Homo sapiens
gauacagaaugaaucc

SEQ ID NO: 1438162 - RNA, 17 nt, Homo sapiens
gauaccagauauuugaa

SEQ ID NO: 1438163 - RNA, 18 nt, Homo sapiens
gauagaacaaugcuauaa

SEQ ID NO: 1438164 - RNA, 23 nt, Homo sapiens
gauagucagcuguaccaagcccc

SEQ ID NO: 1438165 - RNA, 16 nt, Homo sapiens
gauauauacacaggau

SEQ ID NO: 1438166 - RNA, 23 nt, Homo sapiens
gauauauacauguuuaguauuau

SEQ ID NO: 1438167 - RNA, 15 nt, Homo sapiens
gauauauaccacuuu

SEQ ID NO: 1438168 - RNA, 12 nt, Homo sapiens
gauaucaccucu

SEQ ID NO: 1438169 - RNA, 16 nt, Homo sapiens
gauaucaccucucuuc

SEQ ID NO: 1438170 - RNA, 16 nt, Homo sapiens
gauaucacuuacucag

SEQ ID NO: 1438171 - RNA, 17 nt, Homo sapiens
gauaucugaacacauac

SEQ ID NO: 1438172 - RNA, 13 nt, Homo sapiens
gauaugcacacac

SEQ ID NO: 1438173 - RNA, 19 nt, Homo sapiens
gauaugcacacacauggau

SEQ ID NO: 1438174 - RNA, 17 nt, Homo sapiens
gauauguucaacuggag

SEQ ID NO: 1438175 - RNA, 13 nt, Homo sapiens
gauauuaaaggag

SEQ ID NO: 1438176 - RNA, 20 nt, Homo sapiens
gaucagaaggcuggggccag

SEQ ID NO: 1438177 - RNA, 18 nt, Homo sapiens
gaucauagguauuucaaa

SEQ ID NO: 1438178 - RNA, 21 nt, Homo sapiens
gaucauuuguuggaaugaauu

SEQ ID NO: 1438179 - RNA, 14 nt, Homo sapiens
gauccaccugccuu

SEQ ID NO: 1438180 - RNA, 14 nt, Homo sapiens
gaucccaggccagg

SEQ ID NO: 1438181 - RNA, 21 nt, Homo sapiens
gauccuugauaaaugccucau

SEQ ID NO: 1438182 - RNA, 18 nt, Homo sapiens
gaucgagccacugcacuc

SEQ ID NO: 1438183 - RNA, 12 nt, Homo sapiens
gaucgcaccuuu

SEQ ID NO: 1438184 - RNA, 20 nt, Homo sapiens
gaucgcgccacugcacuccg

SEQ ID NO: 1438185 - RNA, 12 nt, Homo sapiens
gaucgcugugaa

SEQ ID NO: 1438186 - RNA, 18 nt, Homo sapiens
gaucuaucaauagucaag

SEQ ID NO: 1438187 - RNA, 22 nt, Homo sapiens
gaucuccacaccaaagucaggg

SEQ ID NO: 1438188 - RNA, 15 nt, Homo sapiens
gaucuccccacucua

SEQ ID NO: 1438189 - RNA, 14 nt, Homo sapiens
gaucugaacacagu

SEQ ID NO: 1438190 - RNA, 14 nt, Homo sapiens
gaucugcacugggu

SEQ ID NO: 1438191 - RNA, 13 nt, Homo sapiens
gaucuuacaggua

SEQ ID NO: 1438192 - RNA, 17 nt, Homo sapiens
gaucuuucuauuccaaa

SEQ ID NO: 1438193 - RNA, 16 nt, Homo sapiens
gaugaaaaaugguccc

SEQ ID NO: 1438194 - RNA, 21 nt, Homo sapiens
gaugaaaaccuaacagggugg

SEQ ID NO: 1438195 - RNA, 22 nt, Homo sapiens
gaugaauagcgaaucaucucaa

SEQ ID NO: 1438196 - RNA, 19 nt, Homo sapiens
gaugaauuuuaucagccau

SEQ ID NO: 1438197 - RNA, 20 nt, Homo sapiens
gaugacgugaagccacagga

SEQ ID NO: 1438198 - RNA, 13 nt, Homo sapiens
gaugaucuacuca

SEQ ID NO: 1438199 - RNA, 22 nt, Homo sapiens
gaugaucuuuaaaauacacacu

SEQ ID NO: 1438200 - RNA, 18 nt, Homo sapiens
gaugcacagagauaugca

SEQ ID NO: 1438201 - RNA, 20 nt, Homo sapiens
gaugcacggcggcagggugg

SEQ ID NO: 1438202 - RNA, 24 nt, Homo sapiens
gaugccacccagcaacacagagcu

SEQ ID NO: 1438203 - RNA, 13 nt, Homo sapiens
gaugccacuuccc

SEQ ID NO: 1438204 - RNA, 21 nt, Homo sapiens
gaugcccccacccaccuguac

SEQ ID NO: 1438205 - RNA, 18 nt, Homo sapiens
gaugccggcaggccuucc

SEQ ID NO: 1438206 - RNA, 23 nt, Homo sapiens
gaugcuccuaguuugaccucaca

SEQ ID NO: 1438207 - RNA, 21 nt, Homo sapiens
gauggaauaaagcccuugaac

SEQ ID NO: 1438208 - RNA, 16 nt, Homo sapiens
gaugggcacaugagga

SEQ ID NO: 1438209 - RNA, 22 nt, Homo sapiens
gaugggucuccgcacuuggaaa

SEQ ID NO: 1438210 - RNA, 17 nt, Homo sapiens
gauguagaacuucaaga

SEQ ID NO: 1438211 - RNA, 20 nt, Homo sapiens
gauguccagaagaauauuca

SEQ ID NO: 1438212 - RNA, 17 nt, Homo sapiens
gaugugaaaaucaugaa

SEQ ID NO: 1438213 - RNA, 21 nt, Homo sapiens
gaugugaauugccugcagaga

SEQ ID NO: 1438214 - RNA, 17 nt, Homo sapiens
gaugugaucacugagac

SEQ ID NO: 1438215 - RNA, 13 nt, Homo sapiens
gaugugauuuauu

SEQ ID NO: 1438216 - RNA, 16 nt, Homo sapiens
gaugugcgcacacaca

SEQ ID NO: 1438217 - RNA, 13 nt, Homo sapiens
gaugugggguccc

SEQ ID NO: 1438218 - RNA, 21 nt, Homo sapiens
gauguguaaauggagcuugua

SEQ ID NO: 1438219 - RNA, 20 nt, Homo sapiens
gaugugugucucaccccuca

SEQ ID NO: 1438220 - RNA, 23 nt, Homo sapiens
gauguuaagcaaaggaaaccaaa

SEQ ID NO: 1438221 - RNA, 18 nt, Homo sapiens
gauguugcuggacuguca

SEQ ID NO: 1438222 - RNA, 22 nt, Homo sapiens
gauguuuuaaguuuaucuuuca

SEQ ID NO: 1438223 - RNA, 14 nt, Homo sapiens
gauuaaacagacuu

SEQ ID NO: 1438224 - RNA, 16 nt, Homo sapiens
gauuaaggugauguga

SEQ ID NO: 1438225 - RNA, 14 nt, Homo sapiens
gauuagaaugccuc

SEQ ID NO: 1438226 - RNA, 23 nt, Homo sapiens
gauuauacgacuuuuaagcaaag

SEQ ID NO: 1438227 - RNA, 13 nt, Homo sapiens
gauuauuugcacg

SEQ ID NO: 1438228 - RNA, 19 nt, Homo sapiens
gauucaacugcaucuccaa

SEQ ID NO: 1438229 - RNA, 20 nt, Homo sapiens
gauucacaaugaaaugcucu

SEQ ID NO: 1438230 - RNA, 21 nt, Homo sapiens
gauucacauaguuuauuucaa

SEQ ID NO: 1438231 - RNA, 14 nt, Homo sapiens
gauucaugccaauu

SEQ ID NO: 1438232 - RNA, 16 nt, Homo sapiens
gauuccucuugccucu

SEQ ID NO: 1438233 - RNA, 21 nt, Homo sapiens
gauuccugggcaagaaccuaa

SEQ ID NO: 1438234 - RNA, 22 nt, Homo sapiens
gauuccuuuugauggggagaaa

SEQ ID NO: 1438235 - RNA, 20 nt, Homo sapiens
gauucgugacaacaugcgac

SEQ ID NO: 1438236 - RNA, 22 nt, Homo sapiens
gauucuuccacuggcuccacau

SEQ ID NO: 1438237 - RNA, 16 nt, Homo sapiens
gauucuucugccucag

SEQ ID NO: 1438238 - RNA, 21 nt, Homo sapiens
gauugagugcuccugugugcu

SEQ ID NO: 1438239 - RNA, 20 nt, Homo sapiens
gauuggauuauucauuuaaa

SEQ ID NO: 1438240 - RNA, 19 nt, Homo sapiens
gauuggcuauaacaugucu

SEQ ID NO: 1438241 - RNA, 15 nt, Homo sapiens
gauuucacaucagcu

SEQ ID NO: 1438242 - RNA, 23 nt, Homo sapiens
gauuucagaagccaaguuuuucu

SEQ ID NO: 1438243 - RNA, 22 nt, Homo sapiens
gauuucaggauacucugucaga

SEQ ID NO: 1438244 - RNA, 18 nt, Homo sapiens
gauuucaguuacuuaccu

SEQ ID NO: 1438245 - RNA, 21 nt, Homo sapiens
gauuucaguuacuuaccugca

SEQ ID NO: 1438246 - RNA, 20 nt, Homo sapiens
gauuugcacccaugccauag

SEQ ID NO: 1438247 - RNA, 15 nt, Homo sapiens
gccuugcaguaggca

SEQ ID NO: 1438248 - RNA, 14 nt, Homo sapiens
gccuuucuccucca

SEQ ID NO: 1438249 - RNA, 18 nt, Homo sapiens
gccuuucuguaaccaaaa

SEQ ID NO: 1438250 - RNA, 13 nt, Homo sapiens
gcgagacugagag

SEQ ID NO: 1438251 - RNA, 23 nt, Homo sapiens
gcgagcugcucugcuauaugccu

SEQ ID NO: 1438252 - RNA, 13 nt, Homo sapiens
gcgagguguaaag

SEQ ID NO: 1438253 - RNA, 20 nt, Homo sapiens
gcgcacacacagauaugcac

SEQ ID NO: 1438254 - RNA, 17 nt, Homo sapiens
gcgcagcgcgugcacag

SEQ ID NO: 1438255 - RNA, 13 nt, Homo sapiens
gcgcaugugccag

SEQ ID NO: 1438256 - RNA, 17 nt, Homo sapiens
gcgccaggggaguuccu

SEQ ID NO: 1438257 - RNA, 15 nt, Homo sapiens
gcgccugugcugagg

SEQ ID NO: 1438258 - RNA, 15 nt, Homo sapiens
gcggagaguacagug

SEQ ID NO: 1438259 - RNA, 13 nt, Homo sapiens
gcggcuccagguc

SEQ ID NO: 1438260 - RNA, 16 nt, Homo sapiens
gcguacucagcacagc

SEQ ID NO: 1438261 - RNA, 21 nt, Homo sapiens
gcguagcugggacuacaggug

SEQ ID NO: 1438262 - RNA, 21 nt, Homo sapiens
gcgucagaccaguacugggaa

SEQ ID NO: 1438263 - RNA, 15 nt, Homo sapiens
gcgucccuguacaga

SEQ ID NO: 1438264 - RNA, 16 nt, Homo sapiens
gcgucucugcuuuaaa

SEQ ID NO: 1438265 - RNA, 18 nt, Homo sapiens
gcguuuggcccugugacu

SEQ ID NO: 1438266 - RNA, 16 nt, Homo sapiens
gcuaacuccagucucc

SEQ ID NO: 1438267 - RNA, 17 nt, Homo sapiens
gcuaacuccagucuccu

SEQ ID NO: 1438268 - RNA, 20 nt, Homo sapiens
gcuaacuguguguacauaua

SEQ ID NO: 1438269 - RNA, 13 nt, Homo sapiens
gcuaaggcucuau

SEQ ID NO: 1438270 - RNA, 19 nt, Homo sapiens
gcuaaucuucuuaugcaau

SEQ ID NO: 1438271 - RNA, 15 nt, Homo sapiens
gcuaauucaauuuau

SEQ ID NO: 1438272 - RNA, 21 nt, Homo sapiens
gcuacaaucuguucaauguuu

SEQ ID NO: 1438273 - RNA, 22 nt, Homo sapiens
gcuacucugugccagagccugg

SEQ ID NO: 1438274 - RNA, 19 nt, Homo sapiens
gcuacugcaaaugcuauau

SEQ ID NO: 1438275 - RNA, 11 nt, Homo sapiens
gcuagaaccug

SEQ ID NO: 1438276 - RNA, 13 nt, Homo sapiens
gcuagaaugcaca

SEQ ID NO: 1438277 - RNA, 19 nt, Homo sapiens
gcuagagugcaguggcaug

SEQ ID NO: 1438278 - RNA, 19 nt, Homo sapiens
gcuagagugcaguggugca

SEQ ID NO: 1438279 - RNA, 12 nt, Homo sapiens
gcuagugccuga

SEQ ID NO: 1438280 - RNA, 20 nt, Homo sapiens
gcuauaugccuuaagccaau

SEQ ID NO: 1438281 - RNA, 23 nt, Homo sapiens
gcuauauuuauuucuccgaauaa

SEQ ID NO: 1438282 - RNA, 17 nt, Homo sapiens
gcuaucgcaccacugug

SEQ ID NO: 1438283 - RNA, 17 nt, Homo sapiens
gcuauuuguucagagag

SEQ ID NO: 1438284 - RNA, 16 nt, Homo sapiens
gcucaaaucuauucag

SEQ ID NO: 1438285 - RNA, 19 nt, Homo sapiens
gcucaaucaugaguaccuc

SEQ ID NO: 1438286 - RNA, 20 nt, Homo sapiens
gcucacagcuggaacccugg

SEQ ID NO: 1438287 - RNA, 16 nt, Homo sapiens
gcucacgugucuuuag

SEQ ID NO: 1438288 - RNA, 14 nt, Homo sapiens
gcucacuguucuau

SEQ ID NO: 1438289 - RNA, 13 nt, Homo sapiens
gcucaucacugga

SEQ ID NO: 1438290 - RNA, 15 nt, Homo sapiens
gcucauuuuaggccu

SEQ ID NO: 1438291 - RNA, 19 nt, Homo sapiens
gcucauuuuaggccuccuc

SEQ ID NO: 1438292 - RNA, 13 nt, Homo sapiens
gcuccacugucac

SEQ ID NO: 1438293 - RNA, 21 nt, Homo sapiens
gcuccagagagaggaugcaga

SEQ ID NO: 1438294 - RNA, 21 nt, Homo sapiens
gcucccacuauggugggagac

SEQ ID NO: 1438295 - RNA, 14 nt, Homo sapiens
gcuccccacucugc

SEQ ID NO: 1438296 - RNA, 22 nt, Homo sapiens
gcucccccuucccaguagcucu

SEQ ID NO: 1438297 - RNA, 15 nt, Homo sapiens
gcuccgccucugucc

SEQ ID NO: 1438298 - RNA, 13 nt, Homo sapiens
gcuccuguuucca

SEQ ID NO: 1438299 - RNA, 21 nt, Homo sapiens
gcuccuuucuccagccagcaa

SEQ ID NO: 1438300 - RNA, 13 nt, Homo sapiens
gcucuaguuuuca

SEQ ID NO: 1438301 - RNA, 15 nt, Homo sapiens
gcucuggcaccacua

SEQ ID NO: 1438302 - RNA, 21 nt, Homo sapiens
gcucugggagggauguucuag

SEQ ID NO: 1438303 - RNA, 15 nt, Homo sapiens
gcucuucacucagcc

SEQ ID NO: 1438304 - RNA, 18 nt, Homo sapiens
gcucuucuaccauuugaa

SEQ ID NO: 1438305 - RNA, 21 nt, Homo sapiens
gcucuucuacguauaaauaug

SEQ ID NO: 1438306 - RNA, 12 nt, Homo sapiens
gcucuugggagu

SEQ ID NO: 1438307 - RNA, 15 nt, Homo sapiens
gcucuuuggggucag

SEQ ID NO: 1438308 - RNA, 20 nt, Homo sapiens
gcugaagugaaaaaaaaaga

SEQ ID NO: 1438309 - RNA, 21 nt, Homo sapiens
gcugacaucuccucuaucaca

SEQ ID NO: 1438310 - RNA, 19 nt, Homo sapiens
gcugacccagaguggaguc

SEQ ID NO: 1438311 - RNA, 13 nt, Homo sapiens
gcugagcucugag

SEQ ID NO: 1438312 - RNA, 13 nt, Homo sapiens
gcugagggcauua

SEQ ID NO: 1438313 - RNA, 13 nt, Homo sapiens
gcugaucaaugaa

SEQ ID NO: 1438314 - RNA, 20 nt, Homo sapiens
gcugauuuccaggccccuga

SEQ ID NO: 1438315 - RNA, 18 nt, Homo sapiens
gcugccaggacaccugcc

SEQ ID NO: 1438316 - RNA, 19 nt, Homo sapiens
gcugccccuggugcacugg

SEQ ID NO: 1438317 - RNA, 14 nt, Homo sapiens
gcugccugccuugg

SEQ ID NO: 1438318 - RNA, 24 nt, Homo sapiens
gcugccuuuuuuaacacuagaaaa

SEQ ID NO: 1438319 - RNA, 13 nt, Homo sapiens
gcugcucugccau

SEQ ID NO: 1438320 - RNA, 11 nt, Homo sapiens
gcugcugcuac

SEQ ID NO: 1438321 - RNA, 21 nt, Homo sapiens
gcuggaaauaaaccuggagau

SEQ ID NO: 1438322 - RNA, 19 nt, Homo sapiens
gcuggaguacagugacacg

SEQ ID NO: 1438323 - RNA, 14 nt, Homo sapiens
gcuggagugcagua

SEQ ID NO: 1438324 - RNA, 20 nt, Homo sapiens
gcuggagugcaguggugcga

SEQ ID NO: 1438325 - RNA, 22 nt, Homo sapiens
gcuggaucacuugaguucagga

SEQ ID NO: 1438326 - RNA, 20 nt, Homo sapiens
gcuggcaccucagacaaucc

SEQ ID NO: 1438327 - RNA, 19 nt, Homo sapiens
gcuggcccgucauguuccu

SEQ ID NO: 1438328 - RNA, 12 nt, Homo sapiens
gcuggccucuag

SEQ ID NO: 1438329 - RNA, 21 nt, Homo sapiens
gcugggaacauguaccacuga

SEQ ID NO: 1438330 - RNA, 22 nt, Homo sapiens
gcugggccaguuccuccaagag

SEQ ID NO: 1438331 - RNA, 14 nt, Homo sapiens
gcugggccccaccu

SEQ ID NO: 1438332 - RNA, 13 nt, Homo sapiens
gcuggguggugua

SEQ ID NO: 1438333 - RNA, 22 nt, Homo sapiens
gcugguacuaagaggcuauuua

SEQ ID NO: 1438334 - RNA, 12 nt, Homo sapiens
guucccuuuaaa

SEQ ID NO: 1438335 - RNA, 12 nt, Homo sapiens
guuccugcacuc

SEQ ID NO: 1438336 - RNA, 14 nt, Homo sapiens
guuccugcacucca

SEQ ID NO: 1438337 - RNA, 19 nt, Homo sapiens
guuccuguagaacugagaa

SEQ ID NO: 1438338 - RNA, 15 nt, Homo sapiens
guucguggcugcaaa

SEQ ID NO: 1438339 - RNA, 13 nt, Homo sapiens
guucuaucccacc

SEQ ID NO: 1438340 - RNA, 15 nt, Homo sapiens
guucuauuuguauau

SEQ ID NO: 1438341 - RNA, 16 nt, Homo sapiens
guucucuauuuugccu

SEQ ID NO: 1438342 - RNA, 18 nt, Homo sapiens
guucucucguaacugguu

SEQ ID NO: 1438343 - RNA, 19 nt, Homo sapiens
guucugaugggucccaaaa

SEQ ID NO: 1438344 - RNA, 15 nt, Homo sapiens
guucuggaaaccacg

SEQ ID NO: 1438345 - RNA, 19 nt, Homo sapiens
guucuuagcugaacaauga

SEQ ID NO: 1438346 - RNA, 21 nt, Homo sapiens
guucuuuuuuguuacagcuau

SEQ ID NO: 1438347 - RNA, 18 nt, Homo sapiens
guugagguacaguuugca

SEQ ID NO: 1438348 - RNA, 12 nt, Homo sapiens
guugaguguuca

SEQ ID NO: 1438349 - RNA, 15 nt, Homo sapiens
guugcaugauguauu

SEQ ID NO: 1438350 - RNA, 19 nt, Homo sapiens
guugcaugccuauguacuc

SEQ ID NO: 1438351 - RNA, 14 nt, Homo sapiens
guugcauuugucaa

SEQ ID NO: 1438352 - RNA, 16 nt, Homo sapiens
guugcccuaucgugau

SEQ ID NO: 1438353 - RNA, 22 nt, Homo sapiens
guugcucaaaucuauucagaca

SEQ ID NO: 1438354 - RNA, 16 nt, Homo sapiens
guugcucacucaggac

SEQ ID NO: 1438355 - RNA, 16 nt, Homo sapiens
guugcuggacugucau

SEQ ID NO: 1438356 - RNA, 22 nt, Homo sapiens
guuggacccgcucuggaccaac

SEQ ID NO: 1438357 - RNA, 21 nt, Homo sapiens
guuggagagcuagaaccugga

SEQ ID NO: 1438358 - RNA, 16 nt, Homo sapiens
guuggaggauggcacu

SEQ ID NO: 1438359 - RNA, 20 nt, Homo sapiens
guuggugacugaaacauuca

SEQ ID NO: 1438360 - RNA, 16 nt, Homo sapiens
guugguguauuugcca

SEQ ID NO: 1438361 - RNA, 17 nt, Homo sapiens
guuguaauaaaacuuau

SEQ ID NO: 1438362 - RNA, 15 nt, Homo sapiens
guugucacaccugaa

SEQ ID NO: 1438363 - RNA, 23 nt, Homo sapiens
guugucucucuaaacccaaauaa

SEQ ID NO: 1438364 - RNA, 21 nt, Homo sapiens
guugucugaagucacugcaca

SEQ ID NO: 1438365 - RNA, 15 nt, Homo sapiens
guuguucacauauau

SEQ ID NO: 1438366 - RNA, 19 nt, Homo sapiens
guuguucgccgcguggaau

SEQ ID NO: 1438367 - RNA, 12 nt, Homo sapiens
guuguuguucuc

SEQ ID NO: 1438368 - RNA, 12 nt, Homo sapiens
guuuaaagucaa

SEQ ID NO: 1438369 - RNA, 15 nt, Homo sapiens
guuuaccucuucuau

SEQ ID NO: 1438370 - RNA, 13 nt, Homo sapiens
guuuaugucauca

SEQ ID NO: 1438371 - RNA, 18 nt, Homo sapiens
guuuauuucaacuauuua

SEQ ID NO: 1438372 - RNA, 21 nt, Homo sapiens
guuuauuuuuuuaaaacacaa

SEQ ID NO: 1438373 - RNA, 14 nt, Homo sapiens
guuucaaaccagga

SEQ ID NO: 1438374 - RNA, 15 nt, Homo sapiens
guuucaaacuccuga

SEQ ID NO: 1438375 - RNA, 22 nt, Homo sapiens
guuucaaauggacucauggcuu

SEQ ID NO: 1438376 - RNA, 19 nt, Homo sapiens
guuucaggacauggggcau

SEQ ID NO: 1438377 - RNA, 15 nt, Homo sapiens
guuuccaaaaaggaa

SEQ ID NO: 1438378 - RNA, 16 nt, Homo sapiens
guuucuaacucagggg

SEQ ID NO: 1438379 - RNA, 15 nt, Homo sapiens
guuucuugugggcua

SEQ ID NO: 1438380 - RNA, 20 nt, Homo sapiens
guuugaaggaggugagggau

SEQ ID NO: 1438381 - RNA, 17 nt, Homo sapiens
guuugagcucaggcauu

SEQ ID NO: 1438382 - RNA, 13 nt, Homo sapiens
guuugaguucaaa

SEQ ID NO: 1438383 - RNA, 16 nt, Homo sapiens
guuugcaauuuuucca

SEQ ID NO: 1438384 - RNA, 12 nt, Homo sapiens
guuugcacuuug

SEQ ID NO: 1438385 - RNA, 18 nt, Homo sapiens
guuugcagaaaagcaccu

SEQ ID NO: 1438386 - RNA, 19 nt, Homo sapiens
guuugguuguaaaugcucg

SEQ ID NO: 1438387 - RNA, 21 nt, Homo sapiens
guuuguauagaguucauccca

SEQ ID NO: 1438388 - RNA, 21 nt, Homo sapiens
guuugucaggauggaauccua

SEQ ID NO: 1438389 - RNA, 23 nt, Homo sapiens
guuuguugugcuugcugguacua

SEQ ID NO: 1438390 - RNA, 21 nt, Homo sapiens
guuuuaagagaagaugugauu

SEQ ID NO: 1438391 - RNA, 18 nt, Homo sapiens
guuuuacuuuugucuucc

SEQ ID NO: 1438392 - RNA, 18 nt, Homo sapiens
guuuuauguucuagugau

SEQ ID NO: 1438393 - RNA, 16 nt, Homo sapiens
guuuucuaacuguaaa

SEQ ID NO: 1438394 - RNA, 17 nt, Homo sapiens
guuuugucucugcaucu

SEQ ID NO: 1438395 - RNA, 17 nt, Homo sapiens
guuuuuacuaaguaaaa

SEQ ID NO: 1438396 - RNA, 21 nt, Homo sapiens
guuuuuggcucuuucagagag

SEQ ID NO: 1438397 - RNA, 12 nt, Homo sapiens
guuuuuuuccaa

SEQ ID NO: 1438398 - RNA, 23 nt, Homo sapiens
uaaaaaaaaaaaauggcuucaga

SEQ ID NO: 1438399 - RNA, 16 nt, Homo sapiens
uaaaaaaauacaguaa

SEQ ID NO: 1438400 - RNA, 21 nt, Homo sapiens
uaaaaacauaaaauauacaaa

SEQ ID NO: 1438401 - RNA, 15 nt, Homo sapiens
uaaaaacuuguacua

SEQ ID NO: 1438402 - RNA, 19 nt, Homo sapiens
uaaaaaucaugagauccuu

SEQ ID NO: 1438403 - RNA, 14 nt, Homo sapiens
uaaaaaugcaacuu

SEQ ID NO: 1438404 - RNA, 12 nt, Homo sapiens
uaaaacaugugu

SEQ ID NO: 1438405 - RNA, 16 nt, Homo sapiens
uaaaacccagcaugua

SEQ ID NO: 1438406 - RNA, 17 nt, Homo sapiens
uaaaacuuuauggacac

SEQ ID NO: 1438407 - RNA, 22 nt, Homo sapiens
uaaaagaauaaaauugcacuuu

SEQ ID NO: 1438408 - RNA, 15 nt, Homo sapiens
uaaaagccacauaga

SEQ ID NO: 1438409 - RNA, 16 nt, Homo sapiens
uaaaagugacucucag

SEQ ID NO: 1438410 - RNA, 24 nt, Homo sapiens
uaaaauaacuuauaucaucagcau

SEQ ID NO: 1438411 - RNA, 17 nt, Homo sapiens
uaaaauaagaaugauuu

SEQ ID NO: 1438412 - RNA, 13 nt, Homo sapiens
uaaaauacaaaca

SEQ ID NO: 1438413 - RNA, 17 nt, Homo sapiens
uaaaauacacacucaaa

SEQ ID NO: 1438414 - RNA, 20 nt, Homo sapiens
uaaaauauuuuuugcuauau

SEQ ID NO: 1438415 - RNA, 13 nt, Homo sapiens
uaaaaucugugaa

SEQ ID NO: 1438416 - RNA, 14 nt, Homo sapiens
uaaaauguuauuau

SEQ ID NO: 1438417 - RNA, 15 nt, Homo sapiens
uaaaauuaugccaua

SEQ ID NO: 1438418 - RNA, 14 nt, Homo sapiens
uaaaauugcacuuu

SEQ ID NO: 1438419 - RNA, 15 nt, Homo sapiens
uaaaauugcacuuuu

SEQ ID NO: 1438420 - RNA, 17 nt, Homo sapiens
uaaaauuuaaccuacua

SEQ ID NO: 1438421 - RNA, 14 nt, Homo sapiens
ucugcuccagagag

SEQ ID NO: 1438422 - RNA, 21 nt, Homo sapiens
ucugcuguauacuguacugag

SEQ ID NO: 1438423 - RNA, 20 nt, Homo sapiens
ucugcuuccccaucuguuaa

SEQ ID NO: 1438424 - RNA, 19 nt, Homo sapiens
ucuggaaaacucaggauuc

SEQ ID NO: 1438425 - RNA, 15 nt, Homo sapiens
ucuggaagacaugau

SEQ ID NO: 1438426 - RNA, 15 nt, Homo sapiens
ucuggaccagccugu

SEQ ID NO: 1438427 - RNA, 14 nt, Homo sapiens
ucuggagccagaga

SEQ ID NO: 1438428 - RNA, 21 nt, Homo sapiens
ucuggaggacacacagucuca

SEQ ID NO: 1438429 - RNA, 17 nt, Homo sapiens
ucuggagucuccagugg

SEQ ID NO: 1438430 - RNA, 14 nt, Homo sapiens
ucuggccaggcaug

SEQ ID NO: 1438431 - RNA, 12 nt, Homo sapiens
ucuggccucaga

SEQ ID NO: 1438432 - RNA, 16 nt, Homo sapiens
ucugggaagauuucua

SEQ ID NO: 1438433 - RNA, 23 nt, Homo sapiens
ucugggcaguaaauccacagcca

SEQ ID NO: 1438434 - RNA, 17 nt, Homo sapiens
ucugggcccccacuuuc

SEQ ID NO: 1438435 - RNA, 17 nt, Homo sapiens
ucugguuugagcaauuu

SEQ ID NO: 1438436 - RNA, 20 nt, Homo sapiens
ucugguuuuaacaauuuccu

SEQ ID NO: 1438437 - RNA, 14 nt, Homo sapiens
ucuguaaacucaaa

SEQ ID NO: 1438438 - RNA, 10 nt, Homo sapiens
ucuguacaau

SEQ ID NO: 1438439 - RNA, 12 nt, Homo sapiens
ucuguaccuugc

SEQ ID NO: 1438440 - RNA, 21 nt, Homo sapiens
ucugucaccagcuaucuguca

SEQ ID NO: 1438441 - RNA, 14 nt, Homo sapiens
ucugucccaaagaa

SEQ ID NO: 1438442 - RNA, 13 nt, Homo sapiens
ucugucuggcuga

SEQ ID NO: 1438443 - RNA, 16 nt, Homo sapiens
ucugugcuuugacuca

SEQ ID NO: 1438444 - RNA, 13 nt, Homo sapiens
ucuguucacuuuu

SEQ ID NO: 1438445 - RNA, 22 nt, Homo sapiens
ucuguuuauaugacauuguuaa

SEQ ID NO: 1438446 - RNA, 15 nt, Homo sapiens
ucuguuuugugaccu

SEQ ID NO: 1438447 - RNA, 16 nt, Homo sapiens
ucuuaaguagggacuu

SEQ ID NO: 1438448 - RNA, 13 nt, Homo sapiens
ucuuaaucuaaga

SEQ ID NO: 1438449 - RNA, 21 nt, Homo sapiens
ucuuacaaccaagaacauuau

SEQ ID NO: 1438450 - RNA, 19 nt, Homo sapiens
ucuuaccuguaugucucca

SEQ ID NO: 1438451 - RNA, 16 nt, Homo sapiens
ucuuacuuaucaaaag

SEQ ID NO: 1438452 - RNA, 16 nt, Homo sapiens
ucuuagcugucugcuc

SEQ ID NO: 1438453 - RNA, 17 nt, Homo sapiens
ucuuagggcagucagua

SEQ ID NO: 1438454 - RNA, 17 nt, Homo sapiens
ucuuauagaaaguucaa

SEQ ID NO: 1438455 - RNA, 16 nt, Homo sapiens
ucuuaugaaaugggcu

SEQ ID NO: 1438456 - RNA, 19 nt, Homo sapiens
ucuuaugaaaugggcuuua

SEQ ID NO: 1438457 - RNA, 20 nt, Homo sapiens
ucuuauggaagaaaugggag

SEQ ID NO: 1438458 - RNA, 15 nt, Homo sapiens
ucuuauguuugcuuu

SEQ ID NO: 1438459 - RNA, 20 nt, Homo sapiens
ucuuauuucauuucuuugag

SEQ ID NO: 1438460 - RNA, 15 nt, Homo sapiens
ucuucacucccaaua

SEQ ID NO: 1438461 - RNA, 11 nt, Homo sapiens
ucuucagccac

SEQ ID NO: 1438462 - RNA, 15 nt, Homo sapiens
ucuucauucuuugaa

SEQ ID NO: 1438463 - RNA, 19 nt, Homo sapiens
ucuuccagggccucuggga

SEQ ID NO: 1438464 - RNA, 21 nt, Homo sapiens
ucuuccucccucauuccaccu

SEQ ID NO: 1438465 - RNA, 17 nt, Homo sapiens
ucuuccuuggccuauuc

SEQ ID NO: 1438466 - RNA, 16 nt, Homo sapiens
ucuucuaccauuugaa

SEQ ID NO: 1438467 - RNA, 21 nt, Homo sapiens
ucuugaacugguugugaauaa

SEQ ID NO: 1438468 - RNA, 20 nt, Homo sapiens
ucuugacauucaaggcauuu

SEQ ID NO: 1438469 - RNA, 18 nt, Homo sapiens
ucuugauaugaccuguua

SEQ ID NO: 1438470 - RNA, 17 nt, Homo sapiens
ucuugccccuccagaga

SEQ ID NO: 1438471 - RNA, 17 nt, Homo sapiens
ucuugccucucucagga

SEQ ID NO: 1438472 - RNA, 15 nt, Homo sapiens
ucuuggcaguauucc

SEQ ID NO: 1438473 - RNA, 16 nt, Homo sapiens
ucuuggcaguauucca

SEQ ID NO: 1438474 - RNA, 22 nt, Homo sapiens
ucuuguuguggaggcugaaaag

SEQ ID NO: 1438475 - RNA, 22 nt, Homo sapiens
ucuuguuuuuuuuuuccacuua

SEQ ID NO: 1438476 - RNA, 16 nt, Homo sapiens
ucuuuaaccucaucua

SEQ ID NO: 1438477 - RNA, 19 nt, Homo sapiens
ucuuuaucagugauggucu

SEQ ID NO: 1438478 - RNA, 16 nt, Homo sapiens
ucuuuauugcugugaa

SEQ ID NO: 1438479 - RNA, 14 nt, Homo sapiens
ucuuucagcacuca

SEQ ID NO: 1438480 - RNA, 12 nt, Homo sapiens
ucuuuccuccaa

SEQ ID NO: 1438481 - RNA, 20 nt, Homo sapiens
ucuuucuaacuccagugaag

SEQ ID NO: 1438482 - RNA, 19 nt, Homo sapiens
ucuuugaauuauaugucua

SEQ ID NO: 1438483 - RNA, 12 nt, Homo sapiens
ucuuugcaugga

SEQ ID NO: 1438484 - RNA, 15 nt, Homo sapiens
ucuuuuagugauacu

SEQ ID NO: 1438485 - RNA, 17 nt, Homo sapiens
ugaaaaaaaaaagacaa

SEQ ID NO: 1438486 - RNA, 17 nt, Homo sapiens
ugaaaaaaaguacaugu

SEQ ID NO: 1438487 - RNA, 19 nt, Homo sapiens
ugaaaaaaaguacauguau

SEQ ID NO: 1438488 - RNA, 15 nt, Homo sapiens
ugaaaaaaaugcauu

SEQ ID NO: 1438489 - RNA, 16 nt, Homo sapiens
ugaaaaauaugugcuu

SEQ ID NO: 1438490 - RNA, 17 nt, Homo sapiens
ugaaaacauaaucugca

SEQ ID NO: 1438491 - RNA, 11 nt, Homo sapiens
ugaaaaccaua

SEQ ID NO: 1438492 - RNA, 16 nt, Homo sapiens
ugaaaagacuccaaag

SEQ ID NO: 1438493 - RNA, 14 nt, Homo sapiens
ugaaaaugaaugcu

SEQ ID NO: 1438494 - RNA, 15 nt, Homo sapiens
ugaaaauuguagggu

SEQ ID NO: 1438495 - RNA, 11 nt, Homo sapiens
ugaaaccaaag

SEQ ID NO: 1438496 - RNA, 12 nt, Homo sapiens
ugaaaccaaaga

SEQ ID NO: 1438497 - RNA, 21 nt, Homo sapiens
ugaaacucuaccaacagccac

SEQ ID NO: 1438498 - RNA, 24 nt, Homo sapiens
ugaaacuuuagagauuaacgacaa

SEQ ID NO: 1438499 - RNA, 16 nt, Homo sapiens
ugaaagagaguaccau

SEQ ID NO: 1438500 - RNA, 18 nt, Homo sapiens
ugaaagaggcagcuugaa

SEQ ID NO: 1438501 - RNA, 12 nt, Homo sapiens
ugaaagaugcaa

SEQ ID NO: 1438502 - RNA, 13 nt, Homo sapiens
ugaaagauggguc

SEQ ID NO: 1438503 - RNA, 10 nt, Homo sapiens
ugaaagcaga

SEQ ID NO: 1438504 - RNA, 23 nt, Homo sapiens
ugaaaggaagcuccacugucacc

SEQ ID NO: 1438505 - RNA, 16 nt, Homo sapiens
ugaaaggcacacuuug

SEQ ID NO: 1438506 - RNA, 13 nt, Homo sapiens
ugaaagugguuug

SEQ ID NO: 1438507 - RNA, 13 nt, Homo sapiens
ugaaaguguaaaa

SEQ ID NO: 1438508 - RNA, 15 nt, Homo sapiens
ugcucuuucuugacu

SEQ ID NO: 1438509 - RNA, 15 nt, Homo sapiens
ugcugaaacaacaaa

SEQ ID NO: 1438510 - RNA, 19 nt, Homo sapiens
ugcugccaguccucugcau

SEQ ID NO: 1438511 - RNA, 11 nt, Homo sapiens
ugcugcuccua

SEQ ID NO: 1438512 - RNA, 19 nt, Homo sapiens
ugcugcugagugcaccacu

SEQ ID NO: 1438513 - RNA, 13 nt, Homo sapiens
ugcuggacuguca

SEQ ID NO: 1438514 - RNA, 20 nt, Homo sapiens
ugcugggcccuggccuggau

SEQ ID NO: 1438515 - RNA, 18 nt, Homo sapiens
ugcugggcucuccaccuc

SEQ ID NO: 1438516 - RNA, 17 nt, Homo sapiens
ugcuggguguugcauuu

SEQ ID NO: 1438517 - RNA, 15 nt, Homo sapiens
ugcuggugucauugc

SEQ ID NO: 1438518 - RNA, 15 nt, Homo sapiens
ugcugucaccuugcu

SEQ ID NO: 1438519 - RNA, 21 nt, Homo sapiens
ugcuuccgugcugaacuuuag

SEQ ID NO: 1438520 - RNA, 17 nt, Homo sapiens
ugcuugaaaccaaagau

SEQ ID NO: 1438521 - RNA, 19 nt, Homo sapiens
ugcuuuaaaguaccuguag

SEQ ID NO: 1438522 - RNA, 20 nt, Homo sapiens
ugcuuuaauuuucacucugg

SEQ ID NO: 1438523 - RNA, 14 nt, Homo sapiens
ugcuuuguauccau

SEQ ID NO: 1438524 - RNA, 14 nt, Homo sapiens
ugcuuuugccacuu

SEQ ID NO: 1438525 - RNA, 16 nt, Homo sapiens
ugcuuuuugacaugaa

SEQ ID NO: 1438526 - RNA, 17 nt, Homo sapiens
uggaaaaauacugccua

SEQ ID NO: 1438527 - RNA, 17 nt, Homo sapiens
uggaaaaucacaccacc

SEQ ID NO: 1438528 - RNA, 12 nt, Homo sapiens
uggaaacagggc

SEQ ID NO: 1438529 - RNA, 15 nt, Homo sapiens
uggaaacauuuacaa

SEQ ID NO: 1438530 - RNA, 18 nt, Homo sapiens
uggaaacuguaccauaca

SEQ ID NO: 1438531 - RNA, 16 nt, Homo sapiens
uggaaagacugauugu

SEQ ID NO: 1438532 - RNA, 14 nt, Homo sapiens
uggaaagcugauga

SEQ ID NO: 1438533 - RNA, 16 nt, Homo sapiens
uggaacacucucugag

SEQ ID NO: 1438534 - RNA, 15 nt, Homo sapiens
uggaacuucuaauau

SEQ ID NO: 1438535 - RNA, 14 nt, Homo sapiens
uggaagaaauggga

SEQ ID NO: 1438536 - RNA, 14 nt, Homo sapiens
uggaagaaauuccu

SEQ ID NO: 1438537 - RNA, 21 nt, Homo sapiens
uggaagaaggaagaagccaga

SEQ ID NO: 1438538 - RNA, 12 nt, Homo sapiens
uggaagauuugu

SEQ ID NO: 1438539 - RNA, 15 nt, Homo sapiens
uggaagcagaaagga

SEQ ID NO: 1438540 - RNA, 18 nt, Homo sapiens
uggaagcuguguccuugc

SEQ ID NO: 1438541 - RNA, 23 nt, Homo sapiens
uggaaugcagggaagagggcagu

SEQ ID NO: 1438542 - RNA, 15 nt, Homo sapiens
uggacaaaauggaag

SEQ ID NO: 1438543 - RNA, 22 nt, Homo sapiens
uggacaauaugaaucuuuucca

SEQ ID NO: 1438544 - RNA, 24 nt, Homo sapiens
uggacaucauguuuucuggugaug

SEQ ID NO: 1438545 - RNA, 13 nt, Homo sapiens
uggacaugauuua

SEQ ID NO: 1438546 - RNA, 16 nt, Homo sapiens
uggacaugcuuuggca

SEQ ID NO: 1438547 - RNA, 14 nt, Homo sapiens
uggacauuugccuu

SEQ ID NO: 1438548 - RNA, 15 nt, Homo sapiens
uggaccaacccuguu

SEQ ID NO: 1438549 - RNA, 19 nt, Homo sapiens
uggaccuauguccuaagga

SEQ ID NO: 1438550 - RNA, 22 nt, Homo sapiens
uggacguacugguuuaaccucc

SEQ ID NO: 1438551 - RNA, 16 nt, Homo sapiens
uggacucaguuuucuu

SEQ ID NO: 1438552 - RNA, 19 nt, Homo sapiens
uggacucaguuuucuugca

SEQ ID NO: 1438553 - RNA, 11 nt, Homo sapiens
uggacugggag

SEQ ID NO: 1438554 - RNA, 22 nt, Homo sapiens
uggacugguaaguaacuguggu

SEQ ID NO: 1438555 - RNA, 15 nt, Homo sapiens
uggacugucauagaa

SEQ ID NO: 1438556 - RNA, 15 nt, Homo sapiens
uggacugugugcaac

SEQ ID NO: 1438557 - RNA, 22 nt, Homo sapiens
uggagagaucauagcucacugu

SEQ ID NO: 1438558 - RNA, 15 nt, Homo sapiens
uggagaugaugauga

SEQ ID NO: 1438559 - RNA, 21 nt, Homo sapiens
uggagcaagugacaugccauc

SEQ ID NO: 1438560 - RNA, 17 nt, Homo sapiens
uggagcaucugacucac

SEQ ID NO: 1438561 - RNA, 21 nt, Homo sapiens
uggagcccagcauucaggggu

SEQ ID NO: 1438562 - RNA, 18 nt, Homo sapiens
uggaggaaagugauaucc

SEQ ID NO: 1438563 - RNA, 19 nt, Homo sapiens
uggaggccucacacccaga

SEQ ID NO: 1438564 - RNA, 14 nt, Homo sapiens
uggagggaugccac

SEQ ID NO: 1438565 - RNA, 19 nt, Homo sapiens
uggagggcuggaaucugga

SEQ ID NO: 1438566 - RNA, 20 nt, Homo sapiens
uggaggucacauucaggaag

SEQ ID NO: 1438567 - RNA, 19 nt, Homo sapiens
uggauacaagguuuggcaa

SEQ ID NO: 1438568 - RNA, 23 nt, Homo sapiens
uggauaccagauauuugaaucuu

SEQ ID NO: 1438569 - RNA, 22 nt, Homo sapiens
uggauacuagaucuuacaucug

SEQ ID NO: 1438570 - RNA, 14 nt, Homo sapiens
uggaugugcucacu

SEQ ID NO: 1438571 - RNA, 14 nt, Homo sapiens
uggauuauucauuu

SEQ ID NO: 1438572 - RNA, 15 nt, Homo sapiens
uggauucgugacaac

SEQ ID NO: 1438573 - RNA, 17 nt, Homo sapiens
uggcaaagguggcucuc

SEQ ID NO: 1438574 - RNA, 14 nt, Homo sapiens
uggcaaagugcugu

SEQ ID NO: 1438575 - RNA, 18 nt, Homo sapiens
uggcaacaacaaagccaa

SEQ ID NO: 1438576 - RNA, 14 nt, Homo sapiens
uggcaacaccuccu

SEQ ID NO: 1438577 - RNA, 15 nt, Homo sapiens
uggcaaccuguucuu

SEQ ID NO: 1438578 - RNA, 23 nt, Homo sapiens
uggcacccacuguggccuggcau

SEQ ID NO: 1438579 - RNA, 16 nt, Homo sapiens
uggcagccgugccuuc

SEQ ID NO: 1438580 - RNA, 18 nt, Homo sapiens
uggcaguguaugcucaua

SEQ ID NO: 1438581 - RNA, 15 nt, Homo sapiens
uggcaguuacagggc

SEQ ID NO: 1438582 - RNA, 14 nt, Homo sapiens
uggcccuucuugcc

SEQ ID NO: 1438583 - RNA, 19 nt, Homo sapiens
uggccuaaaaaugcaacuu

SEQ ID NO: 1438584 - RNA, 17 nt, Homo sapiens
uggcggcgcagagggaa

SEQ ID NO: 1438585 - RNA, 14 nt, Homo sapiens
uggcuaacacguga

SEQ ID NO: 1438586 - RNA, 14 nt, Homo sapiens
uggcuaauucccag

SEQ ID NO: 1438587 - RNA, 15 nt, Homo sapiens
uggcuauaaauauau

SEQ ID NO: 1438588 - RNA, 19 nt, Homo sapiens
uggcuccuuaggaacagcu

SEQ ID NO: 1438589 - RNA, 17 nt, Homo sapiens
uggcugaccccaaagag

SEQ ID NO: 1438590 - RNA, 16 nt, Homo sapiens
uggcugaggauuucaa

SEQ ID NO: 1438591 - RNA, 17 nt, Homo sapiens
uggcugcucauuccuuc

SEQ ID NO: 1438592 - RNA, 15 nt, Homo sapiens
uggcuggcacugagc

SEQ ID NO: 1438593 - RNA, 11 nt, Homo sapiens
uggcuguaaac

SEQ ID NO: 1438594 - RNA, 21 nt, Homo sapiens
uggcuuaauguuuauuccuga

SEQ ID NO: 1438595 - RNA, 19 nt, Homo sapiens
uucagaguuguacacugug

SEQ ID NO: 1438596 - RNA, 20 nt, Homo sapiens
uucagcgagacccuugcauu

SEQ ID NO: 1438597 - RNA, 13 nt, Homo sapiens
uucagcucuacag

SEQ ID NO: 1438598 - RNA, 16 nt, Homo sapiens
uucagcuucagacuuu

SEQ ID NO: 1438599 - RNA, 17 nt, Homo sapiens
uucaggaagaugaaaga

SEQ ID NO: 1438600 - RNA, 17 nt, Homo sapiens
uucagugcuguacuuga

SEQ ID NO: 1438601 - RNA, 18 nt, Homo sapiens
uucagugguccugucaag

SEQ ID NO: 1438602 - RNA, 22 nt, Homo sapiens
uucaguuccucuuugcauggaa

SEQ ID NO: 1438603 - RNA, 21 nt, Homo sapiens
uucaguuggcugacuuccaca

SEQ ID NO: 1438604 - RNA, 16 nt, Homo sapiens
uucauaagguaauuca

SEQ ID NO: 1438605 - RNA, 21 nt, Homo sapiens
uucauaagguaauucauggca

SEQ ID NO: 1438606 - RNA, 14 nt, Homo sapiens
uucaucaagcugua

SEQ ID NO: 1438607 - RNA, 21 nt, Homo sapiens
uucaucaauuuuuauacauau

SEQ ID NO: 1438608 - RNA, 23 nt, Homo sapiens
uucaucaauuuuuauacauauca

SEQ ID NO: 1438609 - RNA, 22 nt, Homo sapiens
uucaucagacuccugugcaacu

SEQ ID NO: 1438610 - RNA, 14 nt, Homo sapiens
uucaucuacuacag

SEQ ID NO: 1438611 - RNA, 19 nt, Homo sapiens
uucaucuacuacaggguga

SEQ ID NO: 1438612 - RNA, 20 nt, Homo sapiens
uucaugacuuuuccauguau

SEQ ID NO: 1438613 - RNA, 21 nt, Homo sapiens
uucauuaucucaaaacugcac

SEQ ID NO: 1438614 - RNA, 18 nt, Homo sapiens
uucauuuaaaaugauuag

SEQ ID NO: 1438615 - RNA, 14 nt, Homo sapiens
uuccaaaugaauga

SEQ ID NO: 1438616 - RNA, 18 nt, Homo sapiens
uuccaaccccuuuccacg

SEQ ID NO: 1438617 - RNA, 23 nt, Homo sapiens
uuccaaggguaugggaagccaua

SEQ ID NO: 1438618 - RNA, 21 nt, Homo sapiens
uuccaaguuccugcacuccag

SEQ ID NO: 1438619 - RNA, 16 nt, Homo sapiens
uuccacuggcuccaca

SEQ ID NO: 1438620 - RNA, 13 nt, Homo sapiens
uuccagcauuugc

SEQ ID NO: 1438621 - RNA, 22 nt, Homo sapiens
uuccagccccuauguuauugau

SEQ ID NO: 1438622 - RNA, 23 nt, Homo sapiens
uuccagggcauccgcagcccagg

SEQ ID NO: 1438623 - RNA, 17 nt, Homo sapiens
uuccaggggcacacaau

SEQ ID NO: 1438624 - RNA, 23 nt, Homo sapiens
uuccaugucgccucugcauucag

SEQ ID NO: 1438625 - RNA, 20 nt, Homo sapiens
uucccaaauaaacucuaaac

SEQ ID NO: 1438626 - RNA, 12 nt, Homo sapiens
uucccaguaauu

SEQ ID NO: 1438627 - RNA, 18 nt, Homo sapiens
uucccauccauaaggugc

SEQ ID NO: 1438628 - RNA, 21 nt, Homo sapiens
uucccauuacuuuaauacuca

SEQ ID NO: 1438629 - RNA, 17 nt, Homo sapiens
uuccccaagaaggugag

SEQ ID NO: 1438630 - RNA, 22 nt, Homo sapiens
uuccccucuacuccaugcacau

SEQ ID NO: 1438631 - RNA, 18 nt, Homo sapiens
uuccccucuguguccucu

SEQ ID NO: 1438632 - RNA, 19 nt, Homo sapiens
uucccuacuuccugugacu

SEQ ID NO: 1438633 - RNA, 22 nt, Homo sapiens
uucccugaauguauugaacuug

SEQ ID NO: 1438634 - RNA, 20 nt, Homo sapiens
uucccuguaugauuccuuga

SEQ ID NO: 1438635 - RNA, 19 nt, Homo sapiens
uucccuuccaguuccggga

SEQ ID NO: 1438636 - RNA, 18 nt, Homo sapiens
uucccuuggauguagucu

SEQ ID NO: 1438637 - RNA, 20 nt, Homo sapiens
uuccuaauaaguuugaucaa

SEQ ID NO: 1438638 - RNA, 16 nt, Homo sapiens
uuccuaauaugcuuua

SEQ ID NO: 1438639 - RNA, 19 nt, Homo sapiens
uuccuaauaugcuuuacaa

SEQ ID NO: 1438640 - RNA, 15 nt, Homo sapiens
uuccuacaaaaugga

SEQ ID NO: 1438641 - RNA, 23 nt, Homo sapiens
uuccuacacccuuggacuugagg

SEQ ID NO: 1438642 - RNA, 16 nt, Homo sapiens
uuccuacagauaguca

SEQ ID NO: 1438643 - RNA, 15 nt, Homo sapiens
uuccucgcaggucuc

SEQ ID NO: 1438644 - RNA, 12 nt, Homo sapiens
uuccucugucaa

SEQ ID NO: 1438645 - RNA, 17 nt, Homo sapiens
uuccuguugaaucuugc

SEQ ID NO: 1438646 - RNA, 16 nt, Homo sapiens
uuccuucccugggaag

SEQ ID NO: 1438647 - RNA, 20 nt, Homo sapiens
uuccuucuuucucuucccuc

SEQ ID NO: 1438648 - RNA, 16 nt, Homo sapiens
uuccuugauucacaau

SEQ ID NO: 1438649 - RNA, 15 nt, Homo sapiens
uucgagguggaucac

SEQ ID NO: 1438650 - RNA, 16 nt, Homo sapiens
uucuaacuccagugaa

SEQ ID NO: 1438651 - RNA, 19 nt, Homo sapiens
uucuaaguaaaaccacagc

SEQ ID NO: 1438652 - RNA, 18 nt, Homo sapiens
uucuaaguagauagaaag

SEQ ID NO: 1438653 - RNA, 12 nt, Homo sapiens
uucuaaguauuu

SEQ ID NO: 1438654 - RNA, 22 nt, Homo sapiens
uucuacacaguaaaaacuugua

SEQ ID NO: 1438655 - RNA, 18 nt, Homo sapiens
uucuacagccucagaaac

SEQ ID NO: 1438656 - RNA, 11 nt, Homo sapiens
uucuaggcauc

SEQ ID NO: 1438657 - RNA, 22 nt, Homo sapiens
uucuagucuccuuugcacugag

SEQ ID NO: 1438658 - RNA, 22 nt, Homo sapiens
uucucaaaugcuaaaugcaaac

SEQ ID NO: 1438659 - RNA, 20 nt, Homo sapiens
uucucaguaaauauuaaccu

SEQ ID NO: 1438660 - RNA, 23 nt, Homo sapiens
uucucaguaaauauuaaccugaa

SEQ ID NO: 1438661 - RNA, 16 nt, Homo sapiens
uucucaucauauugua

SEQ ID NO: 1438662 - RNA, 23 nt, Homo sapiens
uucuccagacccaccacaccgca

SEQ ID NO: 1438663 - RNA, 19 nt, Homo sapiens
uucuccuaggagaagcagc

SEQ ID NO: 1438664 - RNA, 23 nt, Homo sapiens
uucucgcuggaaucaauuuccca

SEQ ID NO: 1438665 - RNA, 19 nt, Homo sapiens
uucucgugguagaagccag

SEQ ID NO: 1438666 - RNA, 15 nt, Homo sapiens
uucucuauuuugccu

SEQ ID NO: 1438667 - RNA, 18 nt, Homo sapiens
uucucucuuauuccacuu

SEQ ID NO: 1438668 - RNA, 14 nt, Homo sapiens
uucugaaccauuac

SEQ ID NO: 1438669 - RNA, 20 nt, Homo sapiens
uucugagcauaaugcuccca

SEQ ID NO: 1438670 - RNA, 18 nt, Homo sapiens
uucugaugagacugcagc

SEQ ID NO: 1438671 - RNA, 12 nt, Homo sapiens
uucugcacugaa

SEQ ID NO: 1438672 - RNA, 14 nt, Homo sapiens
uucugcacugaaaa

SEQ ID NO: 1438673 - RNA, 21 nt, Homo sapiens
uucugccuccauucugaccau

SEQ ID NO: 1438674 - RNA, 18 nt, Homo sapiens
uucugcuguauacuguac

SEQ ID NO: 1438675 - RNA, 19 nt, Homo sapiens
uucuggacccuccacuuca

SEQ ID NO: 1438676 - RNA, 15 nt, Homo sapiens
uucuggcacugguug

SEQ ID NO: 1438677 - RNA, 23 nt, Homo sapiens
uucuggucuucacugccaugccu

SEQ ID NO: 1438678 - RNA, 13 nt, Homo sapiens
uucugugucauac

SEQ ID NO: 1438679 - RNA, 17 nt, Homo sapiens
uucuuaaagaguucuua

SEQ ID NO: 1438680 - RNA, 14 nt, Homo sapiens
uucuuaauaggcuu

SEQ ID NO: 1438681 - RNA, 22 nt, Homo sapiens
aagacacaccucuggaucccug

SEQ ID NO: 1438682 - RNA, 14 nt, Homo sapiens
aagacacagacugc

SEQ ID NO: 1438683 - RNA, 12 nt, Homo sapiens
aagacccagugu

SEQ ID NO: 1438684 - RNA, 21 nt, Homo sapiens
aagacccaguguaaagaauaa

SEQ ID NO: 1438685 - RNA, 18 nt, Homo sapiens
aagaccccagcuucauua

SEQ ID NO: 1438686 - RNA, 14 nt, Homo sapiens
aagaccccaucucu

SEQ ID NO: 1438687 - RNA, 19 nt, Homo sapiens
aagacgcucaagaauccuc

SEQ ID NO: 1438688 - RNA, 22 nt, Homo sapiens
aagacuaaccugcccacccacu

SEQ ID NO: 1438689 - RNA, 15 nt, Homo sapiens
aagacuacacuguug

SEQ ID NO: 1438690 - RNA, 21 nt, Homo sapiens
aagacucauucccuagaucuu

SEQ ID NO: 1438691 - RNA, 18 nt, Homo sapiens
aagacugcagcugcugaa

SEQ ID NO: 1438692 - RNA, 18 nt, Homo sapiens
aagacuugauacugcaau

SEQ ID NO: 1438693 - RNA, 21 nt, Homo sapiens
aagacuugauacugcaauaaa

SEQ ID NO: 1438694 - RNA, 23 nt, Homo sapiens
aagagacucucuuagggaaacca

SEQ ID NO: 1438695 - RNA, 21 nt, Homo sapiens
aagagagaacaacuacuguga

SEQ ID NO: 1438696 - RNA, 17 nt, Homo sapiens
aagagagacauugccuc

SEQ ID NO: 1438697 - RNA, 16 nt, Homo sapiens
aagaggaaaaaaagcc

SEQ ID NO: 1438698 - RNA, 23 nt, Homo sapiens
aagaggcccugucuguaccuaac

SEQ ID NO: 1438699 - RNA, 11 nt, Homo sapiens
aagagggaugu

SEQ ID NO: 1438700 - RNA, 15 nt, Homo sapiens
aagaguggacugaau

SEQ ID NO: 1438701 - RNA, 19 nt, Homo sapiens
aagaguuucuccuuuugac

SEQ ID NO: 1438702 - RNA, 12 nt, Homo sapiens
aagauaaagguu

SEQ ID NO: 1438703 - RNA, 19 nt, Homo sapiens
aagauaacaagaucuuuca

SEQ ID NO: 1438704 - RNA, 15 nt, Homo sapiens
aagauaacugagaau

SEQ ID NO: 1438705 - RNA, 13 nt, Homo sapiens
aagauauaugaau

SEQ ID NO: 1438706 - RNA, 23 nt, Homo sapiens
aagaucaaaagcuuauucaucug

SEQ ID NO: 1438707 - RNA, 13 nt, Homo sapiens
aagauccacccuc

SEQ ID NO: 1438708 - RNA, 23 nt, Homo sapiens
aagaugagauuugccagcacagg

SEQ ID NO: 1438709 - RNA, 15 nt, Homo sapiens
aagaugugauuuauu

SEQ ID NO: 1438710 - RNA, 15 nt, Homo sapiens
aagauuauuugcacg

SEQ ID NO: 1438711 - RNA, 21 nt, Homo sapiens
aagauucacauaguuuauuuc

SEQ ID NO: 1438712 - RNA, 19 nt, Homo sapiens
aagauucuguaagaauuaa

SEQ ID NO: 1438713 - RNA, 17 nt, Homo sapiens
aagauuucagaagccaa

SEQ ID NO: 1438714 - RNA, 20 nt, Homo sapiens
aagauuucuccugacuccag

SEQ ID NO: 1438715 - RNA, 18 nt, Homo sapiens
aagcaaaacaauaaacua

SEQ ID NO: 1438716 - RNA, 17 nt, Homo sapiens
aagcaaaagucagucuu

SEQ ID NO: 1438717 - RNA, 18 nt, Homo sapiens
aagcaaaggaaaccaaag

SEQ ID NO: 1438718 - RNA, 20 nt, Homo sapiens
aagcaagacuguugcucaaa

SEQ ID NO: 1438719 - RNA, 14 nt, Homo sapiens
aagcaagggcucca

SEQ ID NO: 1438720 - RNA, 17 nt, Homo sapiens
aaggcaaagagaccacu

SEQ ID NO: 1438721 - RNA, 14 nt, Homo sapiens
aaggcaacugugag

SEQ ID NO: 1438722 - RNA, 22 nt, Homo sapiens
aaggcaaggucaccugccucuu

SEQ ID NO: 1438723 - RNA, 13 nt, Homo sapiens
aaggcacaggugu

SEQ ID NO: 1438724 - RNA, 15 nt, Homo sapiens
aaggcauuucuauca

SEQ ID NO: 1438725 - RNA, 18 nt, Homo sapiens
aaggccagaaacuccuuu

SEQ ID NO: 1438726 - RNA, 18 nt, Homo sapiens
aaggcccacuguccagca

SEQ ID NO: 1438727 - RNA, 17 nt, Homo sapiens
aaggccugcccucccau

SEQ ID NO: 1438728 - RNA, 18 nt, Homo sapiens
aaggcuggggccagugua

SEQ ID NO: 1438729 - RNA, 19 nt, Homo sapiens
aaggcuugaaguaaccuua

SEQ ID NO: 1438730 - RNA, 20 nt, Homo sapiens
aaggcuugaaguaaccuuau

SEQ ID NO: 1438731 - RNA, 22 nt, Homo sapiens
aaggcuugaaguaaccuuauag

SEQ ID NO: 1438732 - RNA, 13 nt, Homo sapiens
aagggaaacuauu

SEQ ID NO: 1438733 - RNA, 21 nt, Homo sapiens
aagggauaaucaucucuguca

SEQ ID NO: 1438734 - RNA, 13 nt, Homo sapiens
aagggcugugcug

SEQ ID NO: 1438735 - RNA, 15 nt, Homo sapiens
aaggggaacgcagag

SEQ ID NO: 1438736 - RNA, 18 nt, Homo sapiens
aaggggaggggaugucag

SEQ ID NO: 1438737 - RNA, 22 nt, Homo sapiens
aaggggcaaagaaaagccagag

SEQ ID NO: 1438738 - RNA, 15 nt, Homo sapiens
aagguacuuaaagcu

SEQ ID NO: 1438739 - RNA, 21 nt, Homo sapiens
aagguagcuuaccugacacaa

SEQ ID NO: 1438740 - RNA, 14 nt, Homo sapiens
aagguaugggagag

SEQ ID NO: 1438741 - RNA, 19 nt, Homo sapiens
aaggucaauuucaguguau

SEQ ID NO: 1438742 - RNA, 22 nt, Homo sapiens
aaggucacacaguauuaaguga

SEQ ID NO: 1438743 - RNA, 20 nt, Homo sapiens
aaggucccauaauaaaaaga

SEQ ID NO: 1438744 - RNA, 16 nt, Homo sapiens
aaggucugcuuuucau

SEQ ID NO: 1438745 - RNA, 16 nt, Homo sapiens
aaggugaugugauuca

SEQ ID NO: 1438746 - RNA, 22 nt, Homo sapiens
aagguguugguguauuugccag

SEQ ID NO: 1438747 - RNA, 18 nt, Homo sapiens
aagguucccucugagaau

SEQ ID NO: 1438748 - RNA, 20 nt, Homo sapiens
aagguugugcccuccaccua

SEQ ID NO: 1438749 - RNA, 20 nt, Homo sapiens
aaguaaaacuugcugccuga

SEQ ID NO: 1438750 - RNA, 19 nt, Homo sapiens
aaguaaaggccucaucucc

SEQ ID NO: 1438751 - RNA, 16 nt, Homo sapiens
aaguaaauuacauuaa

SEQ ID NO: 1438752 - RNA, 22 nt, Homo sapiens
aaguaaauuuguccaauggcug

SEQ ID NO: 1438753 - RNA, 13 nt, Homo sapiens
aaguaacacucac

SEQ ID NO: 1438754 - RNA, 17 nt, Homo sapiens
aaguaauguuaauucuu

SEQ ID NO: 1438755 - RNA, 21 nt, Homo sapiens
aaguacaaauauuccuguuuc

SEQ ID NO: 1438756 - RNA, 19 nt, Homo sapiens
aaguaccccugauaagcaa

SEQ ID NO: 1438757 - RNA, 19 nt, Homo sapiens
aaguauaaagucacuucca

SEQ ID NO: 1438758 - RNA, 13 nt, Homo sapiens
aaguaucaugcau

SEQ ID NO: 1438759 - RNA, 14 nt, Homo sapiens
aaguauuaauguac

SEQ ID NO: 1438760 - RNA, 17 nt, Homo sapiens
aagucaacaaccaugcc

SEQ ID NO: 1438761 - RNA, 13 nt, Homo sapiens
aagucacugcaca

SEQ ID NO: 1438762 - RNA, 13 nt, Homo sapiens
aauaacagugugu

SEQ ID NO: 1438763 - RNA, 17 nt, Homo sapiens
aauaacuuauaucauca

SEQ ID NO: 1438764 - RNA, 16 nt, Homo sapiens
aauaagaaacaugaug

SEQ ID NO: 1438765 - RNA, 20 nt, Homo sapiens
aauaaguuugcuccuucaua

SEQ ID NO: 1438766 - RNA, 14 nt, Homo sapiens
aauaauacacuaau

SEQ ID NO: 1438767 - RNA, 20 nt, Homo sapiens
aauaauauauccacaucuaa

SEQ ID NO: 1438768 - RNA, 15 nt, Homo sapiens
aauaauauaugcuca

SEQ ID NO: 1438769 - RNA, 14 nt, Homo sapiens
aauaauauuagcuu

SEQ ID NO: 1438770 - RNA, 16 nt, Homo sapiens
aauaaugaacagcaga

SEQ ID NO: 1438771 - RNA, 15 nt, Homo sapiens
aauaauguauacaca

SEQ ID NO: 1438772 - RNA, 16 nt, Homo sapiens
aauaauguauacacau

SEQ ID NO: 1438773 - RNA, 20 nt, Homo sapiens
aauaauuagguuaacauugu

SEQ ID NO: 1438774 - RNA, 16 nt, Homo sapiens
aauaauuuaacuaauu

SEQ ID NO: 1438775 - RNA, 13 nt, Homo sapiens
aauacaacaugua

SEQ ID NO: 1438776 - RNA, 17 nt, Homo sapiens
aauacacacucaaauca

SEQ ID NO: 1438777 - RNA, 16 nt, Homo sapiens
aauacacuaauuccuu

SEQ ID NO: 1438778 - RNA, 17 nt, Homo sapiens
aauaccagugaaccaaa

SEQ ID NO: 1438779 - RNA, 20 nt, Homo sapiens
aauaccagugaaccaaagag

SEQ ID NO: 1438780 - RNA, 19 nt, Homo sapiens
aauaccccuguuaagcaau

SEQ ID NO: 1438781 - RNA, 20 nt, Homo sapiens
aauaccucaaccuaugguau

SEQ ID NO: 1438782 - RNA, 22 nt, Homo sapiens
aauacugauguuccuagugaaa

SEQ ID NO: 1438783 - RNA, 18 nt, Homo sapiens
aauacugccggucaccca

SEQ ID NO: 1438784 - RNA, 19 nt, Homo sapiens
aauacugccggucacccag

SEQ ID NO: 1438785 - RNA, 17 nt, Homo sapiens
aauacugcguguucuca

SEQ ID NO: 1438786 - RNA, 14 nt, Homo sapiens
aauacugcucugaa

SEQ ID NO: 1438787 - RNA, 11 nt, Homo sapiens
aauacuugagc

SEQ ID NO: 1438788 - RNA, 14 nt, Homo sapiens
aauagccauaugca

SEQ ID NO: 1438789 - RNA, 18 nt, Homo sapiens
aauagccauguacuauaa

SEQ ID NO: 1438790 - RNA, 18 nt, Homo sapiens
aauagccugcgcuguuuu

SEQ ID NO: 1438791 - RNA, 17 nt, Homo sapiens
aauagguuaauaucaau

SEQ ID NO: 1438792 - RNA, 14 nt, Homo sapiens
aauauaagaucuga

SEQ ID NO: 1438793 - RNA, 12 nt, Homo sapiens
aauauaaugcaa

SEQ ID NO: 1438794 - RNA, 15 nt, Homo sapiens
aauauaguagcagga

SEQ ID NO: 1438795 - RNA, 16 nt, Homo sapiens
aauauauuucuugcua

SEQ ID NO: 1438796 - RNA, 15 nt, Homo sapiens
aauaucaguuacuca

SEQ ID NO: 1438797 - RNA, 19 nt, Homo sapiens
aauaucauuaaauuggaau

SEQ ID NO: 1438798 - RNA, 14 nt, Homo sapiens
aauaugaauugaca

SEQ ID NO: 1438799 - RNA, 16 nt, Homo sapiens
aauaugcuuuacaauc

SEQ ID NO: 1438800 - RNA, 19 nt, Homo sapiens
aauauggacaaagaaggca

SEQ ID NO: 1438801 - RNA, 17 nt, Homo sapiens
aauauguugaguguuca

SEQ ID NO: 1438802 - RNA, 12 nt, Homo sapiens
aauauuaaggag

SEQ ID NO: 1438803 - RNA, 16 nt, Homo sapiens
aauauucaacaauuau

SEQ ID NO: 1438804 - RNA, 23 nt, Homo sapiens
aauauuccuauauguagcuuuau

SEQ ID NO: 1438805 - RNA, 18 nt, Homo sapiens
aauauuuaaacagcagug

SEQ ID NO: 1438806 - RNA, 19 nt, Homo sapiens
aaugacauucaguauauaa

SEQ ID NO: 1438807 - RNA, 13 nt, Homo sapiens
aaugacugucuaa

SEQ ID NO: 1438808 - RNA, 15 nt, Homo sapiens
aaugagugugacuau

SEQ ID NO: 1438809 - RNA, 22 nt, Homo sapiens
aaugauuuaaauuuauaauuaa

SEQ ID NO: 1438810 - RNA, 16 nt, Homo sapiens
aaugcacacacacaga

SEQ ID NO: 1438811 - RNA, 22 nt, Homo sapiens
aaugcaguccagaauaagugcu

SEQ ID NO: 1438812 - RNA, 18 nt, Homo sapiens
aaugcaugauuuuauaca

SEQ ID NO: 1438813 - RNA, 14 nt, Homo sapiens
aaugcauggugcag

SEQ ID NO: 1438814 - RNA, 17 nt, Homo sapiens
aaugccaucacuggaau

SEQ ID NO: 1438815 - RNA, 19 nt, Homo sapiens
aaugccuccaagccauuca

SEQ ID NO: 1438816 - RNA, 15 nt, Homo sapiens
aaugcuaaaugcaaa

SEQ ID NO: 1438817 - RNA, 15 nt, Homo sapiens
aauggaauacugaaa

SEQ ID NO: 1438818 - RNA, 19 nt, Homo sapiens
aauggagugggagaucagc

SEQ ID NO: 1438819 - RNA, 19 nt, Homo sapiens
aauggccauuguguuggga

SEQ ID NO: 1438820 - RNA, 23 nt, Homo sapiens
aauggcuguaaacuauaaacuac

SEQ ID NO: 1438821 - RNA, 23 nt, Homo sapiens
aauggggguggggaggcaagaac

SEQ ID NO: 1438822 - RNA, 20 nt, Homo sapiens
aauggguacaauguacauua

SEQ ID NO: 1438823 - RNA, 20 nt, Homo sapiens
aauguauauaaaguacuuua

SEQ ID NO: 1438824 - RNA, 17 nt, Homo sapiens
aauguauaugucauuua

SEQ ID NO: 1438825 - RNA, 13 nt, Homo sapiens
aauguaugugaaa

SEQ ID NO: 1438826 - RNA, 21 nt, Homo sapiens
aauguauuugucaaugcauca

SEQ ID NO: 1438827 - RNA, 16 nt, Homo sapiens
aaugucaguaaugcaa

SEQ ID NO: 1438828 - RNA, 20 nt, Homo sapiens
aaugucaucaaauauuacca

SEQ ID NO: 1438829 - RNA, 22 nt, Homo sapiens
aauguccuucuuuaucugugau

SEQ ID NO: 1438830 - RNA, 23 nt, Homo sapiens
aauguccuucuuuaucugugaua

SEQ ID NO: 1438831 - RNA, 21 nt, Homo sapiens
aaugucuuaaaaauauauuua

SEQ ID NO: 1438832 - RNA, 17 nt, Homo sapiens
aaugucuuacugugauc

SEQ ID NO: 1438833 - RNA, 16 nt, Homo sapiens
aaugugaccaggggug

SEQ ID NO: 1438834 - RNA, 21 nt, Homo sapiens
aaugugcaaauuuugcauuua

SEQ ID NO: 1438835 - RNA, 21 nt, Homo sapiens
aauguguggugcuaacuguau

SEQ ID NO: 1438836 - RNA, 17 nt, Homo sapiens
aauguguuaagugcagg

SEQ ID NO: 1438837 - RNA, 15 nt, Homo sapiens
aauguuguccaggaa

SEQ ID NO: 1438838 - RNA, 16 nt, Homo sapiens
aauguuguccaggaaa

SEQ ID NO: 1438839 - RNA, 22 nt, Homo sapiens
aauguuugucuggauuggcuau

SEQ ID NO: 1438840 - RNA, 20 nt, Homo sapiens
aauguuuucuucaucuguga

SEQ ID NO: 1438841 - RNA, 11 nt, Homo sapiens
aauuaaagccc

SEQ ID NO: 1438842 - RNA, 22 nt, Homo sapiens
aauuaacaaaagauucuguaag

SEQ ID NO: 1438843 - RNA, 19 nt, Homo sapiens
aauuaagagauacauuccc

SEQ ID NO: 1438844 - RNA, 14 nt, Homo sapiens
aauuaagguuugcc

SEQ ID NO: 1438845 - RNA, 12 nt, Homo sapiens
aauuaagugcaa

SEQ ID NO: 1438846 - RNA, 13 nt, Homo sapiens
aauuaagugcaau

SEQ ID NO: 1438847 - RNA, 22 nt, Homo sapiens
aauuaccagaguuguucugucu

SEQ ID NO: 1438848 - RNA, 12 nt, Homo sapiens
aauuacuucuuc

SEQ ID NO: 1438849 - RNA, 16 nt, Homo sapiens
aauuaguaauugucaa

SEQ ID NO: 1438850 - RNA, 18 nt, Homo sapiens
aauuauuauauguaacug

SEQ ID NO: 1438851 - RNA, 22 nt, Homo sapiens
acagacugugaguacagcagaa

SEQ ID NO: 1438852 - RNA, 17 nt, Homo sapiens
acagacuucuccagacc

SEQ ID NO: 1438853 - RNA, 15 nt, Homo sapiens
acagagacucuggaa

SEQ ID NO: 1438854 - RNA, 16 nt, Homo sapiens
acagagcccugugagg

SEQ ID NO: 1438855 - RNA, 19 nt, Homo sapiens
acagagcuggcugucuucc

SEQ ID NO: 1438856 - RNA, 18 nt, Homo sapiens
acagaggaagagcaggca

SEQ ID NO: 1438857 - RNA, 19 nt, Homo sapiens
acagaggauuguauugcaa

SEQ ID NO: 1438858 - RNA, 21 nt, Homo sapiens
acagaguaaauagcauucucu

SEQ ID NO: 1438859 - RNA, 13 nt, Homo sapiens
acagauaccccac

SEQ ID NO: 1438860 - RNA, 21 nt, Homo sapiens
acagauagacagugcugcccu

SEQ ID NO: 1438861 - RNA, 12 nt, Homo sapiens
acagauaugcac

SEQ ID NO: 1438862 - RNA, 17 nt, Homo sapiens
acagaugauaauaugcu

SEQ ID NO: 1438863 - RNA, 19 nt, Homo sapiens
acagaugcacacacaccga

SEQ ID NO: 1438864 - RNA, 16 nt, Homo sapiens
acagaugcacacacag

SEQ ID NO: 1438865 - RNA, 19 nt, Homo sapiens
acagauuuuagacaaggac

SEQ ID NO: 1438866 - RNA, 20 nt, Homo sapiens
acagcagcugaacagccaaa

SEQ ID NO: 1438867 - RNA, 13 nt, Homo sapiens
acagcaguaugaa

SEQ ID NO: 1438868 - RNA, 18 nt, Homo sapiens
acagccaacaaacauaga

SEQ ID NO: 1438869 - RNA, 20 nt, Homo sapiens
acagccagacuggcacaguu

SEQ ID NO: 1438870 - RNA, 19 nt, Homo sapiens
acagccagguuagccuuug

SEQ ID NO: 1438871 - RNA, 15 nt, Homo sapiens
acagcccagacuuua

SEQ ID NO: 1438872 - RNA, 17 nt, Homo sapiens
acagccugagccaaggc

SEQ ID NO: 1438873 - RNA, 19 nt, Homo sapiens
acagcgucccuagcaguga

SEQ ID NO: 1438874 - RNA, 13 nt, Homo sapiens
acagcucuuggca

SEQ ID NO: 1438875 - RNA, 16 nt, Homo sapiens
acagcuuaacauuuac

SEQ ID NO: 1438876 - RNA, 15 nt, Homo sapiens
acaggaaaccacuua

SEQ ID NO: 1438877 - RNA, 13 nt, Homo sapiens
acaggacucugcc

SEQ ID NO: 1438878 - RNA, 18 nt, Homo sapiens
acaggacuuaaaaugaca

SEQ ID NO: 1438879 - RNA, 17 nt, Homo sapiens
acaggagacccagagag

SEQ ID NO: 1438880 - RNA, 20 nt, Homo sapiens
acaggccauccauucacagc

SEQ ID NO: 1438881 - RNA, 14 nt, Homo sapiens
acaggcccaagaga

SEQ ID NO: 1438882 - RNA, 24 nt, Homo sapiens
acagggcucccgagucaugcacuc

SEQ ID NO: 1438883 - RNA, 19 nt, Homo sapiens
acaggggccccagaucugc

SEQ ID NO: 1438884 - RNA, 14 nt, Homo sapiens
acaggugcaagcca

SEQ ID NO: 1438885 - RNA, 13 nt, Homo sapiens
acaggugccucac

SEQ ID NO: 1438886 - RNA, 19 nt, Homo sapiens
acagguggcaggaccagga

SEQ ID NO: 1438887 - RNA, 12 nt, Homo sapiens
acagguguaaau

SEQ ID NO: 1438888 - RNA, 19 nt, Homo sapiens
acagguuuucagcaacuca

SEQ ID NO: 1438889 - RNA, 20 nt, Homo sapiens
acagguuuucagcaacucag

SEQ ID NO: 1438890 - RNA, 17 nt, Homo sapiens
acaguaacugccaucaa

SEQ ID NO: 1438891 - RNA, 12 nt, Homo sapiens
acaguagugcau

SEQ ID NO: 1438892 - RNA, 16 nt, Homo sapiens
acaguauuuguacaaa

SEQ ID NO: 1438893 - RNA, 13 nt, Homo sapiens
acagucucaggaa

SEQ ID NO: 1438894 - RNA, 13 nt, Homo sapiens
acagugaagggag

SEQ ID NO: 1438895 - RNA, 16 nt, Homo sapiens
acagugcccagcauga

SEQ ID NO: 1438896 - RNA, 20 nt, Homo sapiens
acagugccuggcaaggccuc

SEQ ID NO: 1438897 - RNA, 14 nt, Homo sapiens
acaguggaucucaa

SEQ ID NO: 1438898 - RNA, 18 nt, Homo sapiens
acagugggaacucugaca

SEQ ID NO: 1438899 - RNA, 20 nt, Homo sapiens
acaguuccuucagcuuccau

SEQ ID NO: 1438900 - RNA, 17 nt, Homo sapiens
acaguucuuggugacug

SEQ ID NO: 1438901 - RNA, 20 nt, Homo sapiens
acaguuuagugcuuuacaug

SEQ ID NO: 1438902 - RNA, 15 nt, Homo sapiens
acaguuugaugucau

SEQ ID NO: 1438903 - RNA, 24 nt, Homo sapiens
acaguuuugaaagaaaaauaccau

SEQ ID NO: 1438904 - RNA, 15 nt, Homo sapiens
acauaaacacauaca

SEQ ID NO: 1438905 - RNA, 13 nt, Homo sapiens
acauacacucaaa

SEQ ID NO: 1438906 - RNA, 21 nt, Homo sapiens
acauacauugccaauuuucca

SEQ ID NO: 1438907 - RNA, 19 nt, Homo sapiens
acauacgaaacacaaacca

SEQ ID NO: 1438908 - RNA, 15 nt, Homo sapiens
acauacgugucugug

SEQ ID NO: 1438909 - RNA, 22 nt, Homo sapiens
acauagagauaugcacacacag

SEQ ID NO: 1438910 - RNA, 19 nt, Homo sapiens
acauagauuaauggcacug

SEQ ID NO: 1438911 - RNA, 14 nt, Homo sapiens
acauaguaacucuu

SEQ ID NO: 1438912 - RNA, 22 nt, Homo sapiens
acauaguucuuacuacuugcca

SEQ ID NO: 1438913 - RNA, 22 nt, Homo sapiens
acauauauauauacacauacau

SEQ ID NO: 1438914 - RNA, 20 nt, Homo sapiens
acauaucaccucauggccua

SEQ ID NO: 1438915 - RNA, 14 nt, Homo sapiens
acauaugacauaua

SEQ ID NO: 1438916 - RNA, 15 nt, Homo sapiens
acauauggcacaacu

SEQ ID NO: 1438917 - RNA, 23 nt, Homo sapiens
acauauucuuuaaauuucaucuc

SEQ ID NO: 1438918 - RNA, 14 nt, Homo sapiens
acaucaaauuugcc

SEQ ID NO: 1438919 - RNA, 21 nt, Homo sapiens
acauccaaggagaaacagaga

SEQ ID NO: 1438920 - RNA, 14 nt, Homo sapiens
acauccauucccaa

SEQ ID NO: 1438921 - RNA, 16 nt, Homo sapiens
acaucccauugcccug

SEQ ID NO: 1438922 - RNA, 19 nt, Homo sapiens
acaucuauuauaaaaccau

SEQ ID NO: 1438923 - RNA, 15 nt, Homo sapiens
acaucugcagcucuu

SEQ ID NO: 1438924 - RNA, 14 nt, Homo sapiens
acaugacacugacc

SEQ ID NO: 1438925 - RNA, 13 nt, Homo sapiens
acaugacuaggaa

SEQ ID NO: 1438926 - RNA, 14 nt, Homo sapiens
acaugaugugagau

SEQ ID NO: 1438927 - RNA, 13 nt, Homo sapiens
acaugcacugacc

SEQ ID NO: 1438928 - RNA, 20 nt, Homo sapiens
acaugcgaccgugaccagga

SEQ ID NO: 1438929 - RNA, 19 nt, Homo sapiens
acauggacacaccagagug

SEQ ID NO: 1438930 - RNA, 16 nt, Homo sapiens
acauggcuggcacuga

SEQ ID NO: 1438931 - RNA, 17 nt, Homo sapiens
acauggugaaacccugu

SEQ ID NO: 1438932 - RNA, 21 nt, Homo sapiens
acauguaugcuauuacauaca

SEQ ID NO: 1438933 - RNA, 16 nt, Homo sapiens
acauguguguauauau

SEQ ID NO: 1438934 - RNA, 14 nt, Homo sapiens
acauuaaaagcuau

SEQ ID NO: 1438935 - RNA, 16 nt, Homo sapiens
acauuaagacacaccu

SEQ ID NO: 1438936 - RNA, 19 nt, Homo sapiens
acccgagcccagcuacauu

SEQ ID NO: 1438937 - RNA, 22 nt, Homo sapiens
acccgagcccagcuacauuccu

SEQ ID NO: 1438938 - RNA, 15 nt, Homo sapiens
acccgcucuggacca

SEQ ID NO: 1438939 - RNA, 22 nt, Homo sapiens
acccggcaggcuagaaccuggc

SEQ ID NO: 1438940 - RNA, 21 nt, Homo sapiens
acccgguuaccuuggccguga

SEQ ID NO: 1438941 - RNA, 19 nt, Homo sapiens
acccuaaugcuaguuucau

SEQ ID NO: 1438942 - RNA, 22 nt, Homo sapiens
acccuccccugucuucucucaa

SEQ ID NO: 1438943 - RNA, 16 nt, Homo sapiens
acccugcccacuccca

SEQ ID NO: 1438944 - RNA, 16 nt, Homo sapiens
acccugcgauuuugcc

SEQ ID NO: 1438945 - RNA, 14 nt, Homo sapiens
acccugggugccau

SEQ ID NO: 1438946 - RNA, 19 nt, Homo sapiens
acccugucuaaaaaacaua

SEQ ID NO: 1438947 - RNA, 14 nt, Homo sapiens
acccuguuuuacaa

SEQ ID NO: 1438948 - RNA, 21 nt, Homo sapiens
acccuucccaaucagcacuga

SEQ ID NO: 1438949 - RNA, 23 nt, Homo sapiens
accgauuugcacccaugccauag

SEQ ID NO: 1438950 - RNA, 22 nt, Homo sapiens
accggcgugcaccaccaugcca

SEQ ID NO: 1438951 - RNA, 18 nt, Homo sapiens
accgggacuucaaagccg

SEQ ID NO: 1438952 - RNA, 14 nt, Homo sapiens
accguggaccuucc

SEQ ID NO: 1438953 - RNA, 18 nt, Homo sapiens
accuacaagguugugccc

SEQ ID NO: 1438954 - RNA, 22 nt, Homo sapiens
accuaccaccuucccucuuucu

SEQ ID NO: 1438955 - RNA, 16 nt, Homo sapiens
accuaccaugcugcuu

SEQ ID NO: 1438956 - RNA, 14 nt, Homo sapiens
accuacuagacaau

SEQ ID NO: 1438957 - RNA, 16 nt, Homo sapiens
accuacucacacaggc

SEQ ID NO: 1438958 - RNA, 23 nt, Homo sapiens
accuagaagggcuagaaccugga

SEQ ID NO: 1438959 - RNA, 17 nt, Homo sapiens
accuagcaauuccauca

SEQ ID NO: 1438960 - RNA, 22 nt, Homo sapiens
accuagugguuucuacucucac

SEQ ID NO: 1438961 - RNA, 21 nt, Homo sapiens
accuaugucccuucucaugcc

SEQ ID NO: 1438962 - RNA, 17 nt, Homo sapiens
accucaaccuaugguau

SEQ ID NO: 1438963 - RNA, 12 nt, Homo sapiens
accucacaguga

SEQ ID NO: 1438964 - RNA, 21 nt, Homo sapiens
accucacgcucuggacaugau

SEQ ID NO: 1438965 - RNA, 13 nt, Homo sapiens
accucacuauuca

SEQ ID NO: 1438966 - RNA, 14 nt, Homo sapiens
accucacuauucaa

SEQ ID NO: 1438967 - RNA, 20 nt, Homo sapiens
accucagccaaacacagagc

SEQ ID NO: 1438968 - RNA, 17 nt, Homo sapiens
accucaucuacaagcau

SEQ ID NO: 1438969 - RNA, 22 nt, Homo sapiens
accucccccaagcagagcuucc

SEQ ID NO: 1438970 - RNA, 21 nt, Homo sapiens
accuccuacgucaaacaugaa

SEQ ID NO: 1438971 - RNA, 23 nt, Homo sapiens
accuccugaccugucaccgugag

SEQ ID NO: 1438972 - RNA, 13 nt, Homo sapiens
accucguccuccc

SEQ ID NO: 1438973 - RNA, 20 nt, Homo sapiens
accucuagugcuacugcuag

SEQ ID NO: 1438974 - RNA, 12 nt, Homo sapiens
accucugaccaa

SEQ ID NO: 1438975 - RNA, 14 nt, Homo sapiens
accucugaccaaca

SEQ ID NO: 1438976 - RNA, 20 nt, Homo sapiens
accucugugaggaaagcaca

SEQ ID NO: 1438977 - RNA, 12 nt, Homo sapiens
accucuuccuuc

SEQ ID NO: 1438978 - RNA, 14 nt, Homo sapiens
accucuucucuucc

SEQ ID NO: 1438979 - RNA, 18 nt, Homo sapiens
accucuucucuuccugua

SEQ ID NO: 1438980 - RNA, 16 nt, Homo sapiens
accugacaggccuucu

SEQ ID NO: 1438981 - RNA, 13 nt, Homo sapiens
accugagccugcc

SEQ ID NO: 1438982 - RNA, 20 nt, Homo sapiens
accugaggcuccugugcuac

SEQ ID NO: 1438983 - RNA, 14 nt, Homo sapiens
accugaucauuaca

SEQ ID NO: 1438984 - RNA, 23 nt, Homo sapiens
accugcaccuccccccacugcag

SEQ ID NO: 1438985 - RNA, 20 nt, Homo sapiens
accugcauguguuguacaau

SEQ ID NO: 1438986 - RNA, 17 nt, Homo sapiens
accugcccacccacucc

SEQ ID NO: 1438987 - RNA, 21 nt, Homo sapiens
accugccuuaacacacacacc

SEQ ID NO: 1438988 - RNA, 13 nt, Homo sapiens
gauucccagagac

SEQ ID NO: 1438989 - RNA, 19 nt, Homo sapiens
gauucccccagucauucug

SEQ ID NO: 1438990 - RNA, 13 nt, Homo sapiens
gauuguauugcaa

SEQ ID NO: 1438991 - RNA, 20 nt, Homo sapiens
gauuguccagugcaaccaca

SEQ ID NO: 1438992 - RNA, 15 nt, Homo sapiens
gauuuaacugugaac

SEQ ID NO: 1438993 - RNA, 15 nt, Homo sapiens
gauuuagauaugcaa

SEQ ID NO: 1438994 - RNA, 16 nt, Homo sapiens
gauuuaugaucacuug

SEQ ID NO: 1438995 - RNA, 18 nt, Homo sapiens
gauuucuucgcugcucua

SEQ ID NO: 1438996 - RNA, 15 nt, Homo sapiens
gauuugccaaaguga

SEQ ID NO: 1438997 - RNA, 22 nt, Homo sapiens
gauuugccagcacaggggcccc

SEQ ID NO: 1438998 - RNA, 16 nt, Homo sapiens
gauuuguucacaugca

SEQ ID NO: 1438999 - RNA, 19 nt, Homo sapiens
gauuuguucacaugcauca

SEQ ID NO: 1439000 - RNA, 14 nt, Homo sapiens
gauuuuaguucacu

SEQ ID NO: 1439001 - RNA, 16 nt, Homo sapiens
gauuuuauuugacaaa

SEQ ID NO: 1439002 - RNA, 13 nt, Homo sapiens
gauuuuccuuccu

SEQ ID NO: 1439003 - RNA, 23 nt, Homo sapiens
gauuuuuuuuuuaaaacuaucca

SEQ ID NO: 1439004 - RNA, 18 nt, Homo sapiens
gcaaaaaaaaaaauauua

SEQ ID NO: 1439005 - RNA, 21 nt, Homo sapiens
gcaaaaaaauuaaauuauuua

SEQ ID NO: 1439006 - RNA, 14 nt, Homo sapiens
gcaaaagcucugug

SEQ ID NO: 1439007 - RNA, 17 nt, Homo sapiens
gcaaaagcucuguguaa

SEQ ID NO: 1439008 - RNA, 20 nt, Homo sapiens
gcaaacacaccgaugcacac

SEQ ID NO: 1439009 - RNA, 15 nt, Homo sapiens
gcaaacacuguguau

SEQ ID NO: 1439010 - RNA, 17 nt, Homo sapiens
gcaaacuuuguauuaau

SEQ ID NO: 1439011 - RNA, 17 nt, Homo sapiens
gcaaagaaaagccagag

SEQ ID NO: 1439012 - RNA, 17 nt, Homo sapiens
gcaaaggaaaccaaagg

SEQ ID NO: 1439013 - RNA, 15 nt, Homo sapiens
gcaaaggccagcagc

SEQ ID NO: 1439014 - RNA, 22 nt, Homo sapiens
gcaaagucuaaaguuuacagua

SEQ ID NO: 1439015 - RNA, 19 nt, Homo sapiens
gcaaaguucccuacuuccu

SEQ ID NO: 1439016 - RNA, 18 nt, Homo sapiens
gcaaauguuucugcagua

SEQ ID NO: 1439017 - RNA, 16 nt, Homo sapiens
gcaaauuaaacuuuaa

SEQ ID NO: 1439018 - RNA, 14 nt, Homo sapiens
gcaaauuugauaca

SEQ ID NO: 1439019 - RNA, 19 nt, Homo sapiens
gcaacaccuccuugcuuug

SEQ ID NO: 1439020 - RNA, 17 nt, Homo sapiens
gcaacaggaacuuggag

SEQ ID NO: 1439021 - RNA, 22 nt, Homo sapiens
gcaaccaggauugacaggccau

SEQ ID NO: 1439022 - RNA, 16 nt, Homo sapiens
gcaacccucacugugu

SEQ ID NO: 1439023 - RNA, 22 nt, Homo sapiens
gcaagaaagccguacugucuau

SEQ ID NO: 1439024 - RNA, 18 nt, Homo sapiens
gcaagaagucaaaguaaa

SEQ ID NO: 1439025 - RNA, 18 nt, Homo sapiens
gcaagacuguugcucaaa

SEQ ID NO: 1439026 - RNA, 18 nt, Homo sapiens
gcaagagacucuggccuc

SEQ ID NO: 1439027 - RNA, 21 nt, Homo sapiens
gcaagauuucacaucagcuuu

SEQ ID NO: 1439028 - RNA, 14 nt, Homo sapiens
gcaagcaccaggcu

SEQ ID NO: 1439029 - RNA, 17 nt, Homo sapiens
gcaaggacggccuucaa

SEQ ID NO: 1439030 - RNA, 11 nt, Homo sapiens
gcaagggccag

SEQ ID NO: 1439031 - RNA, 15 nt, Homo sapiens
gcaaguuaaagaaaa

SEQ ID NO: 1439032 - RNA, 14 nt, Homo sapiens
gcaaguucagggaa

SEQ ID NO: 1439033 - RNA, 21 nt, Homo sapiens
gcaauagggugcaguuuucca

SEQ ID NO: 1439034 - RNA, 15 nt, Homo sapiens
gcaaugaaaccaaag

SEQ ID NO: 1439035 - RNA, 21 nt, Homo sapiens
gcaaugggagggggcuccaug

SEQ ID NO: 1439036 - RNA, 18 nt, Homo sapiens
gcaauucuccugccucag

SEQ ID NO: 1439037 - RNA, 14 nt, Homo sapiens
gcaauugacuguca

SEQ ID NO: 1439038 - RNA, 17 nt, Homo sapiens
gcaauuuucgaacauuc

SEQ ID NO: 1439039 - RNA, 18 nt, Homo sapiens
gcaauuuucgaacauucu

SEQ ID NO: 1439040 - RNA, 22 nt, Homo sapiens
gcacaagcuuguauauacauau

SEQ ID NO: 1439041 - RNA, 16 nt, Homo sapiens
gcacaaggcugaccaa

SEQ ID NO: 1439042 - RNA, 20 nt, Homo sapiens
gcacacaaugcuauugaaau

SEQ ID NO: 1439043 - RNA, 16 nt, Homo sapiens
gcacacacacaccaau

SEQ ID NO: 1439044 - RNA, 13 nt, Homo sapiens
gcacacacagaua

SEQ ID NO: 1439045 - RNA, 18 nt, Homo sapiens
gcacacacagauaugcac

SEQ ID NO: 1439046 - RNA, 24 nt, Homo sapiens
gcacacacagaugcacacacagau

SEQ ID NO: 1439047 - RNA, 14 nt, Homo sapiens
gcacacagucaccu

SEQ ID NO: 1439048 - RNA, 19 nt, Homo sapiens
gcacacggaugcacagaga

SEQ ID NO: 1439049 - RNA, 20 nt, Homo sapiens
gcacacuagccucuccagga

SEQ ID NO: 1439050 - RNA, 15 nt, Homo sapiens
gcacagagauaugca

SEQ ID NO: 1439051 - RNA, 16 nt, Homo sapiens
gcacagucugaugaca

SEQ ID NO: 1439052 - RNA, 12 nt, Homo sapiens
gcacauauuuga

SEQ ID NO: 1439053 - RNA, 17 nt, Homo sapiens
gcacaucacaacauuua

SEQ ID NO: 1439054 - RNA, 20 nt, Homo sapiens
gcacauccauucccaagaaa

SEQ ID NO: 1439055 - RNA, 11 nt, Homo sapiens
gcacaucucug

SEQ ID NO: 1439056 - RNA, 15 nt, Homo sapiens
gcacaugccaaugca

SEQ ID NO: 1439057 - RNA, 21 nt, Homo sapiens
gcacauguuauccacaagcaa

SEQ ID NO: 1439058 - RNA, 20 nt, Homo sapiens
gcaccacugcacuccagccu

SEQ ID NO: 1439059 - RNA, 21 nt, Homo sapiens
gcaccccuccuauaccauaug

SEQ ID NO: 1439060 - RNA, 13 nt, Homo sapiens
gcaccgagaccaa

SEQ ID NO: 1439061 - RNA, 19 nt, Homo sapiens
gcaccgagagagauggaau

SEQ ID NO: 1439062 - RNA, 14 nt, Homo sapiens
gcaccgucauggcu

SEQ ID NO: 1439063 - RNA, 24 nt, Homo sapiens
gcaccuacuuuauguauggagcuc

SEQ ID NO: 1439064 - RNA, 18 nt, Homo sapiens
gcaccuuaccaacuuucu

SEQ ID NO: 1439065 - RNA, 19 nt, Homo sapiens
gcaccuuuuauaccagaga

SEQ ID NO: 1439066 - RNA, 15 nt, Homo sapiens
gcaccuuuugcacau

SEQ ID NO: 1439067 - RNA, 23 nt, Homo sapiens
gcacuaaaaaguggcuaauucaa

SEQ ID NO: 1439068 - RNA, 22 nt, Homo sapiens
gcacuaccacgccaagcuaauu

SEQ ID NO: 1439069 - RNA, 22 nt, Homo sapiens
gcacucagaaaagaaaaccauu

SEQ ID NO: 1439070 - RNA, 17 nt, Homo sapiens
gcacuccagaauccaca

SEQ ID NO: 1439071 - RNA, 17 nt, Homo sapiens
gcacucccucccagaga

SEQ ID NO: 1439072 - RNA, 20 nt, Homo sapiens
gcacucccucccagagaaca

SEQ ID NO: 1439073 - RNA, 14 nt, Homo sapiens
gcacugacugggac

SEQ ID NO: 1439074 - RNA, 16 nt, Homo sapiens
gcacugaggaccagcc

SEQ ID NO: 1439075 - RNA, 13 nt, Homo sapiens
gccauuccuggaa

SEQ ID NO: 1439076 - RNA, 14 nt, Homo sapiens
gccauuccuggaau

SEQ ID NO: 1439077 - RNA, 16 nt, Homo sapiens
gcccaagagaugaaga

SEQ ID NO: 1439078 - RNA, 18 nt, Homo sapiens
gcccaagugccaucccac

SEQ ID NO: 1439079 - RNA, 19 nt, Homo sapiens
gcccaaucauuugcaaugc

SEQ ID NO: 1439080 - RNA, 21 nt, Homo sapiens
gcccaaucauuugcaaugccc

SEQ ID NO: 1439081 - RNA, 13 nt, Homo sapiens
gcccacaaagggg

SEQ ID NO: 1439082 - RNA, 18 nt, Homo sapiens
gcccacuguccagcagcc

SEQ ID NO: 1439083 - RNA, 22 nt, Homo sapiens
gcccagagaagcaaguggcuuu

SEQ ID NO: 1439084 - RNA, 20 nt, Homo sapiens
gcccagcagggccucaaagu

SEQ ID NO: 1439085 - RNA, 17 nt, Homo sapiens
gcccaggccugccuguu

SEQ ID NO: 1439086 - RNA, 19 nt, Homo sapiens
gcccaggcuggagugcagu

SEQ ID NO: 1439087 - RNA, 20 nt, Homo sapiens
gcccaggcuggagugcagug

SEQ ID NO: 1439088 - RNA, 17 nt, Homo sapiens
gcccagucgauaucuca

SEQ ID NO: 1439089 - RNA, 14 nt, Homo sapiens
gcccagugaccuga

SEQ ID NO: 1439090 - RNA, 18 nt, Homo sapiens
gcccaucauacgcauggu

SEQ ID NO: 1439091 - RNA, 20 nt, Homo sapiens
gcccauuuuucuagacuguc

SEQ ID NO: 1439092 - RNA, 18 nt, Homo sapiens
gccccccguguggcuuac

SEQ ID NO: 1439093 - RNA, 14 nt, Homo sapiens
gccccccuccuugc

SEQ ID NO: 1439094 - RNA, 13 nt, Homo sapiens
gccccucauuuau

SEQ ID NO: 1439095 - RNA, 23 nt, Homo sapiens
gccccucccugcuaccaaggccc

SEQ ID NO: 1439096 - RNA, 23 nt, Homo sapiens
gccccucgccuuuuaggcucagg

SEQ ID NO: 1439097 - RNA, 14 nt, Homo sapiens
gccccucuggccac

SEQ ID NO: 1439098 - RNA, 23 nt, Homo sapiens
gccccugguuaagggagaucugg

SEQ ID NO: 1439099 - RNA, 20 nt, Homo sapiens
gcccgggacagggucuugca

SEQ ID NO: 1439100 - RNA, 21 nt, Homo sapiens
gcccgucauguuccucaaaag

SEQ ID NO: 1439101 - RNA, 22 nt, Homo sapiens
gcccuacaucuucagcucccau

SEQ ID NO: 1439102 - RNA, 22 nt, Homo sapiens
gcuaaauucacagcgcuaugca

SEQ ID NO: 1439103 - RNA, 20 nt, Homo sapiens
gcuaaugaagcuauugagaa

SEQ ID NO: 1439104 - RNA, 16 nt, Homo sapiens
gcuacaaaaacacagc

SEQ ID NO: 1439105 - RNA, 20 nt, Homo sapiens
gcuacaccacucuggcagcc

SEQ ID NO: 1439106 - RNA, 19 nt, Homo sapiens
gcuacacuauugcauuguu

SEQ ID NO: 1439107 - RNA, 21 nt, Homo sapiens
gcuacucucuugccagcauuu

SEQ ID NO: 1439108 - RNA, 14 nt, Homo sapiens
gcuacuggcagcuc

SEQ ID NO: 1439109 - RNA, 13 nt, Homo sapiens
gcuacuugggagg

SEQ ID NO: 1439110 - RNA, 20 nt, Homo sapiens
gcuagagggcgacucuggug

SEQ ID NO: 1439111 - RNA, 14 nt, Homo sapiens
gcuagagugcagug

SEQ ID NO: 1439112 - RNA, 18 nt, Homo sapiens
gcuagaucuaguucucaa

SEQ ID NO: 1439113 - RNA, 18 nt, Homo sapiens
gcuagccagcuguguuca

SEQ ID NO: 1439114 - RNA, 13 nt, Homo sapiens
gcuaggauuacag

SEQ ID NO: 1439115 - RNA, 20 nt, Homo sapiens
gcuagugccugagaugcacg

SEQ ID NO: 1439116 - RNA, 18 nt, Homo sapiens
gcuaguucguagcuuucc

SEQ ID NO: 1439117 - RNA, 22 nt, Homo sapiens
gcuaguuuauuggaaguguuca

SEQ ID NO: 1439118 - RNA, 16 nt, Homo sapiens
gcuaucacacaguggg

SEQ ID NO: 1439119 - RNA, 15 nt, Homo sapiens
gcuauccaaauaacu

SEQ ID NO: 1439120 - RNA, 15 nt, Homo sapiens
gcuaucugcauuuau

SEQ ID NO: 1439121 - RNA, 14 nt, Homo sapiens
gcuaugccaagcca

SEQ ID NO: 1439122 - RNA, 18 nt, Homo sapiens
gcuauugugauaugacaa

SEQ ID NO: 1439123 - RNA, 22 nt, Homo sapiens
gcuauuuuauuuguauucauga

SEQ ID NO: 1439124 - RNA, 20 nt, Homo sapiens
gcucaaaucauuuaagaagg

SEQ ID NO: 1439125 - RNA, 15 nt, Homo sapiens
gcucacaagcccagg

SEQ ID NO: 1439126 - RNA, 20 nt, Homo sapiens
gcucacaccuguaaucccag

SEQ ID NO: 1439127 - RNA, 13 nt, Homo sapiens
gcucacucaggac

SEQ ID NO: 1439128 - RNA, 13 nt, Homo sapiens
gcucacuguucua

SEQ ID NO: 1439129 - RNA, 16 nt, Homo sapiens
gcucagacuugccagg

SEQ ID NO: 1439130 - RNA, 14 nt, Homo sapiens
gcucaucacuggau

SEQ ID NO: 1439131 - RNA, 17 nt, Homo sapiens
gcucauuuuuucuuaca

SEQ ID NO: 1439132 - RNA, 13 nt, Homo sapiens
gcuccagcaucca

SEQ ID NO: 1439133 - RNA, 23 nt, Homo sapiens
gcuccagggcagccuccaccuug

SEQ ID NO: 1439134 - RNA, 18 nt, Homo sapiens
gcuccaucuccaguggga

SEQ ID NO: 1439135 - RNA, 22 nt, Homo sapiens
gcuccgaaaaacuuuguuauau

SEQ ID NO: 1439136 - RNA, 16 nt, Homo sapiens
gcuccuccccucuuga

SEQ ID NO: 1439137 - RNA, 14 nt, Homo sapiens
gcuccuggaaccaa

SEQ ID NO: 1439138 - RNA, 14 nt, Homo sapiens
gcuccuugacuccu

SEQ ID NO: 1439139 - RNA, 17 nt, Homo sapiens
gcuccuuuaccuaccac

SEQ ID NO: 1439140 - RNA, 17 nt, Homo sapiens
gcucgcccacaaacuga

SEQ ID NO: 1439141 - RNA, 14 nt, Homo sapiens
gcucgcucuuggga

SEQ ID NO: 1439142 - RNA, 15 nt, Homo sapiens
gcucggggugcacag

SEQ ID NO: 1439143 - RNA, 16 nt, Homo sapiens
gcucuauuaagauuuc

SEQ ID NO: 1439144 - RNA, 22 nt, Homo sapiens
gcucucaccgggcuacuaccug

SEQ ID NO: 1439145 - RNA, 24 nt, Homo sapiens
gcucugaacaaacacugaaucaug

SEQ ID NO: 1439146 - RNA, 20 nt, Homo sapiens
gcucugagaggcccuggauc

SEQ ID NO: 1439147 - RNA, 22 nt, Homo sapiens
gcucugcaaugggcacugggau

SEQ ID NO: 1439148 - RNA, 17 nt, Homo sapiens
gcucugcuggucacugg

SEQ ID NO: 1439149 - RNA, 22 nt, Homo sapiens
gcugacccaaguguugagggga

SEQ ID NO: 1439150 - RNA, 15 nt, Homo sapiens
gcugacggaagccaa

SEQ ID NO: 1439151 - RNA, 14 nt, Homo sapiens
gcugagagacccaa

SEQ ID NO: 1439152 - RNA, 18 nt, Homo sapiens
gcugagccuucugaugag

SEQ ID NO: 1439153 - RNA, 20 nt, Homo sapiens
gcugagguccugaucagcuu

SEQ ID NO: 1439154 - RNA, 14 nt, Homo sapiens
gcugauucaagaaa

SEQ ID NO: 1439155 - RNA, 16 nt, Homo sapiens
gcugauucaagaaaca

SEQ ID NO: 1439156 - RNA, 18 nt, Homo sapiens
gcugcaaagugcaaauac

SEQ ID NO: 1439157 - RNA, 14 nt, Homo sapiens
gcugcaagggccag

SEQ ID NO: 1439158 - RNA, 20 nt, Homo sapiens
gcugcagcugggccccaugc

SEQ ID NO: 1439159 - RNA, 24 nt, Homo sapiens
gcugcagugacccagauauugcac

SEQ ID NO: 1439160 - RNA, 18 nt, Homo sapiens
gcugcauuugugucaucu

SEQ ID NO: 1439161 - RNA, 21 nt, Homo sapiens
gcugccaccacgucugccagg

SEQ ID NO: 1439162 - RNA, 16 nt, Homo sapiens
gcugccaggacaccug

SEQ ID NO: 1439163 - RNA, 17 nt, Homo sapiens
gcugccaggacaccugc

SEQ ID NO: 1439164 - RNA, 22 nt, Homo sapiens
guguucacacuguaaacauuca

SEQ ID NO: 1439165 - RNA, 18 nt, Homo sapiens
guguucucuauuuugccu

SEQ ID NO: 1439166 - RNA, 20 nt, Homo sapiens
guguugggaaaaaggccucu

SEQ ID NO: 1439167 - RNA, 16 nt, Homo sapiens
guguuuaaaacaugca

SEQ ID NO: 1439168 - RNA, 22 nt, Homo sapiens
guguuuaaaacaugcacgguga

SEQ ID NO: 1439169 - RNA, 13 nt, Homo sapiens
guguuucuuacag

SEQ ID NO: 1439170 - RNA, 20 nt, Homo sapiens
guuaaagggcagaaggggaa

SEQ ID NO: 1439171 - RNA, 13 nt, Homo sapiens
guuaacaguuuuu

SEQ ID NO: 1439172 - RNA, 14 nt, Homo sapiens
guuaagcaaaggaa

SEQ ID NO: 1439173 - RNA, 19 nt, Homo sapiens
guuaaggcagugacuuuag

SEQ ID NO: 1439174 - RNA, 12 nt, Homo sapiens
guuaagugcagg

SEQ ID NO: 1439175 - RNA, 18 nt, Homo sapiens
guuacaacaguaacacau

SEQ ID NO: 1439176 - RNA, 21 nt, Homo sapiens
guuacagcgagaggcagagaa

SEQ ID NO: 1439177 - RNA, 11 nt, Homo sapiens
guuacauauua

SEQ ID NO: 1439178 - RNA, 15 nt, Homo sapiens
guuacuguugcacug

SEQ ID NO: 1439179 - RNA, 21 nt, Homo sapiens
guuacuuaagaggcagagaag

SEQ ID NO: 1439180 - RNA, 15 nt, Homo sapiens
guuacuucacuuuaa

SEQ ID NO: 1439181 - RNA, 17 nt, Homo sapiens
guuacuugaaauaccag

SEQ ID NO: 1439182 - RNA, 21 nt, Homo sapiens
guuacuugaaauaccagugaa

SEQ ID NO: 1439183 - RNA, 17 nt, Homo sapiens
guuaggaaaauuucaca

SEQ ID NO: 1439184 - RNA, 22 nt, Homo sapiens
guuaggcacaggcugggaugga

SEQ ID NO: 1439185 - RNA, 13 nt, Homo sapiens
guuauauauauca

SEQ ID NO: 1439186 - RNA, 16 nt, Homo sapiens
guuauguuugcacuuu

SEQ ID NO: 1439187 - RNA, 16 nt, Homo sapiens
guuauuauuuugcacu

SEQ ID NO: 1439188 - RNA, 17 nt, Homo sapiens
guuauuauuuugcacug

SEQ ID NO: 1439189 - RNA, 18 nt, Homo sapiens
guuauuauuuugcacugu

SEQ ID NO: 1439190 - RNA, 19 nt, Homo sapiens
guuauuuaugccucuguau

SEQ ID NO: 1439191 - RNA, 21 nt, Homo sapiens
guuauuuuugucccugcuccu

SEQ ID NO: 1439192 - RNA, 17 nt, Homo sapiens
guucaaauccucaccau

SEQ ID NO: 1439193 - RNA, 12 nt, Homo sapiens
guucaagccaug

SEQ ID NO: 1439194 - RNA, 16 nt, Homo sapiens
guucaaguuaggagcu

SEQ ID NO: 1439195 - RNA, 22 nt, Homo sapiens
guucagaguuguacacugugua

SEQ ID NO: 1439196 - RNA, 19 nt, Homo sapiens
guuccaagaaagauccacc

SEQ ID NO: 1439197 - RNA, 14 nt, Homo sapiens
guuccauguuaaaa

SEQ ID NO: 1439198 - RNA, 18 nt, Homo sapiens
guucccagcagcugggcc

SEQ ID NO: 1439199 - RNA, 12 nt, Homo sapiens
guuccucaaaag

SEQ ID NO: 1439200 - RNA, 17 nt, Homo sapiens
guuccucuuugcaugga

SEQ ID NO: 1439201 - RNA, 21 nt, Homo sapiens
guucgccgcguggaaugugag

SEQ ID NO: 1439202 - RNA, 12 nt, Homo sapiens
guucuacaugag

SEQ ID NO: 1439203 - RNA, 21 nt, Homo sapiens
guucucuucuuuaaagggaug

SEQ ID NO: 1439204 - RNA, 18 nt, Homo sapiens
guucucuuugguguuaca

SEQ ID NO: 1439205 - RNA, 14 nt, Homo sapiens
guucugaguguuuu

SEQ ID NO: 1439206 - RNA, 22 nt, Homo sapiens
guucuggggaggaagggccagg

SEQ ID NO: 1439207 - RNA, 18 nt, Homo sapiens
guucuuacuacuugccac

SEQ ID NO: 1439208 - RNA, 18 nt, Homo sapiens
guucuuuaagaauuacag

SEQ ID NO: 1439209 - RNA, 14 nt, Homo sapiens
guugagaacaaaaa

SEQ ID NO: 1439210 - RNA, 14 nt, Homo sapiens
guuggaaauauuca

SEQ ID NO: 1439211 - RNA, 22 nt, Homo sapiens
guuggaccuucaucagaccacu

SEQ ID NO: 1439212 - RNA, 16 nt, Homo sapiens
guugggaccugugauc

SEQ ID NO: 1439213 - RNA, 15 nt, Homo sapiens
guugggagcacugga

SEQ ID NO: 1439214 - RNA, 21 nt, Homo sapiens
guuggugggggucagucacuu

SEQ ID NO: 1439215 - RNA, 17 nt, Homo sapiens
guuguaagcacugacug

SEQ ID NO: 1439216 - RNA, 15 nt, Homo sapiens
guuguacaagcucag

SEQ ID NO: 1439217 - RNA, 18 nt, Homo sapiens
guugugaaugucauucac

SEQ ID NO: 1439218 - RNA, 21 nt, Homo sapiens
guugugcccuccaccuaccug

SEQ ID NO: 1439219 - RNA, 22 nt, Homo sapiens
guuuaacugggagugauaugau

SEQ ID NO: 1439220 - RNA, 21 nt, Homo sapiens
guuuaauuaacuaugugaugu

SEQ ID NO: 1439221 - RNA, 13 nt, Homo sapiens
guuuagaucccau

SEQ ID NO: 1439222 - RNA, 17 nt, Homo sapiens
guuuagauuucaagaaa

SEQ ID NO: 1439223 - RNA, 18 nt, Homo sapiens
guuuaggcauccugugug

SEQ ID NO: 1439224 - RNA, 22 nt, Homo sapiens
guuuauccacccacaacaucua

SEQ ID NO: 1439225 - RNA, 20 nt, Homo sapiens
guuucauauccagcugagug

SEQ ID NO: 1439226 - RNA, 16 nt, Homo sapiens
guuucauuguguguua

SEQ ID NO: 1439227 - RNA, 24 nt, Homo sapiens
guuuccauaggaaucauguuggau

SEQ ID NO: 1439228 - RNA, 19 nt, Homo sapiens
guuuccaucagguuccauc

SEQ ID NO: 1439229 - RNA, 20 nt, Homo sapiens
guuucugaaccauuacugua

SEQ ID NO: 1439230 - RNA, 22 nt, Homo sapiens
guuucugaaccauuacuguaau

SEQ ID NO: 1439231 - RNA, 19 nt, Homo sapiens
guuugagcgcagaguaaaa

SEQ ID NO: 1439232 - RNA, 19 nt, Homo sapiens
guuuggaaguguuaacuau

SEQ ID NO: 1439233 - RNA, 16 nt, Homo sapiens
guuugggccacugcca

SEQ ID NO: 1439234 - RNA, 15 nt, Homo sapiens
guuuuaaucuucuca

SEQ ID NO: 1439235 - RNA, 20 nt, Homo sapiens
guuuuagagacuauggagcc

SEQ ID NO: 1439236 - RNA, 11 nt, Homo sapiens
guuuuuacuaa

SEQ ID NO: 1439237 - RNA, 19 nt, Homo sapiens
guuuuuuacuuccacagaa

SEQ ID NO: 1439238 - RNA, 13 nt, Homo sapiens
guuuuuucacaua

SEQ ID NO: 1439239 - RNA, 18 nt, Homo sapiens
guuuuuuuacaacauuca

SEQ ID NO: 1439240 - RNA, 13 nt, Homo sapiens
uaaaaaauggaac

SEQ ID NO: 1439241 - RNA, 16 nt, Homo sapiens
uaaaaacaaagaaaua

SEQ ID NO: 1439242 - RNA, 17 nt, Homo sapiens
uaaaaacuuccaucccu

SEQ ID NO: 1439243 - RNA, 12 nt, Homo sapiens
uaaaaacuugua

SEQ ID NO: 1439244 - RNA, 18 nt, Homo sapiens
uaaaaauggccauuugcu

SEQ ID NO: 1439245 - RNA, 19 nt, Homo sapiens
uaaaaauggccauuugcuu

SEQ ID NO: 1439246 - RNA, 20 nt, Homo sapiens
uaaaaauuccaaauggacua

SEQ ID NO: 1439247 - RNA, 22 nt, Homo sapiens
uaaaacagguggagaaauuccu

SEQ ID NO: 1439248 - RNA, 23 nt, Homo sapiens
uaaaacagguggagaaauuccuu

SEQ ID NO: 1439249 - RNA, 21 nt, Homo sapiens
uaaaacccagcauguacaaaa

SEQ ID NO: 1439250 - RNA, 19 nt, Homo sapiens
acauuaugugugcaugugu

SEQ ID NO: 1439251 - RNA, 14 nt, Homo sapiens
acauucacacaggg

SEQ ID NO: 1439252 - RNA, 14 nt, Homo sapiens
acauucaucaagcu

SEQ ID NO: 1439253 - RNA, 17 nt, Homo sapiens
acauucaucaagcugua

SEQ ID NO: 1439254 - RNA, 15 nt, Homo sapiens
acauuccacagugcc

SEQ ID NO: 1439255 - RNA, 17 nt, Homo sapiens
acauuccaggaaaccau

SEQ ID NO: 1439256 - RNA, 17 nt, Homo sapiens
acauucccuaucaaaac

SEQ ID NO: 1439257 - RNA, 18 nt, Homo sapiens
acauucuuuaucuugaca

SEQ ID NO: 1439258 - RNA, 17 nt, Homo sapiens
acauuguauguaucuau

SEQ ID NO: 1439259 - RNA, 21 nt, Homo sapiens
acauugucuggauaccagaua

SEQ ID NO: 1439260 - RNA, 13 nt, Homo sapiens
acauuuacaauaa

SEQ ID NO: 1439261 - RNA, 20 nt, Homo sapiens
acauuuacugaccauguacu

SEQ ID NO: 1439262 - RNA, 16 nt, Homo sapiens
acauuuccaaaugaau

SEQ ID NO: 1439263 - RNA, 16 nt, Homo sapiens
acauuucccugugcug

SEQ ID NO: 1439264 - RNA, 17 nt, Homo sapiens
acauuuuuuguuugcug

SEQ ID NO: 1439265 - RNA, 19 nt, Homo sapiens
accaaacucauucaccaaa

SEQ ID NO: 1439266 - RNA, 14 nt, Homo sapiens
accaaagagacugg

SEQ ID NO: 1439267 - RNA, 19 nt, Homo sapiens
accaaagccaccaagacag

SEQ ID NO: 1439268 - RNA, 20 nt, Homo sapiens
accaaagggaaaacucuuca

SEQ ID NO: 1439269 - RNA, 23 nt, Homo sapiens
accaaaucuucuccuaugcauuu

SEQ ID NO: 1439270 - RNA, 17 nt, Homo sapiens
accaacaguuccuucag

SEQ ID NO: 1439271 - RNA, 15 nt, Homo sapiens
accaacccucagagc

SEQ ID NO: 1439272 - RNA, 19 nt, Homo sapiens
accaacccuguuuccugag

SEQ ID NO: 1439273 - RNA, 17 nt, Homo sapiens
accaacuggagcacuga

SEQ ID NO: 1439274 - RNA, 23 nt, Homo sapiens
accaagaagggcuagaaccugga

SEQ ID NO: 1439275 - RNA, 14 nt, Homo sapiens
accaaggcagccuc

SEQ ID NO: 1439276 - RNA, 15 nt, Homo sapiens
accaagucuacuuca

SEQ ID NO: 1439277 - RNA, 17 nt, Homo sapiens
accaagucuacuucacu

SEQ ID NO: 1439278 - RNA, 15 nt, Homo sapiens
accaaguggcuccca

SEQ ID NO: 1439279 - RNA, 20 nt, Homo sapiens
accaaguucuggaaaccacg

SEQ ID NO: 1439280 - RNA, 14 nt, Homo sapiens
accaaucauuuuaa

SEQ ID NO: 1439281 - RNA, 12 nt, Homo sapiens
accaaucucuaa

SEQ ID NO: 1439282 - RNA, 17 nt, Homo sapiens
accaaugagcuguaucu

SEQ ID NO: 1439283 - RNA, 21 nt, Homo sapiens
accaaugccaagauaauucac

SEQ ID NO: 1439284 - RNA, 19 nt, Homo sapiens
accaauguacccaccgggc

SEQ ID NO: 1439285 - RNA, 18 nt, Homo sapiens
accaauuccaaguuuuaa

SEQ ID NO: 1439286 - RNA, 23 nt, Homo sapiens
accacagcggaggagcuccgcua

SEQ ID NO: 1439287 - RNA, 14 nt, Homo sapiens
accacuaggguccu

SEQ ID NO: 1439288 - RNA, 17 nt, Homo sapiens
accacuccauucccaac

SEQ ID NO: 1439289 - RNA, 18 nt, Homo sapiens
accacugagccugagaug

SEQ ID NO: 1439290 - RNA, 22 nt, Homo sapiens
accacugguuaaaauaaagccu

SEQ ID NO: 1439291 - RNA, 19 nt, Homo sapiens
accacuuugucucugagaa

SEQ ID NO: 1439292 - RNA, 13 nt, Homo sapiens
accagauauuuga

SEQ ID NO: 1439293 - RNA, 13 nt, Homo sapiens
accagauuugcua

SEQ ID NO: 1439294 - RNA, 16 nt, Homo sapiens
accagcagacacugcc

SEQ ID NO: 1439295 - RNA, 14 nt, Homo sapiens
accagcugccaaaa

SEQ ID NO: 1439296 - RNA, 21 nt, Homo sapiens
accaggaugaaggcgugcaag

SEQ ID NO: 1439297 - RNA, 13 nt, Homo sapiens
accagggugcaug

SEQ ID NO: 1439298 - RNA, 15 nt, Homo sapiens
accaggucaucuccu

SEQ ID NO: 1439299 - RNA, 16 nt, Homo sapiens
accaggucaucuccuu

SEQ ID NO: 1439300 - RNA, 15 nt, Homo sapiens
accaguacugggaag

SEQ ID NO: 1439301 - RNA, 15 nt, Homo sapiens
uaacugucaagucau

SEQ ID NO: 1439302 - RNA, 13 nt, Homo sapiens
uaacuuauuuucc

SEQ ID NO: 1439303 - RNA, 13 nt, Homo sapiens
uaacuucucugag

SEQ ID NO: 1439304 - RNA, 12 nt, Homo sapiens
uaacuugagggu

SEQ ID NO: 1439305 - RNA, 17 nt, Homo sapiens
uaacuuuuguaagacaa

SEQ ID NO: 1439306 - RNA, 16 nt, Homo sapiens
uaagaaaauacauaag

SEQ ID NO: 1439307 - RNA, 23 nt, Homo sapiens
uaagaaggaguucugacauucau

SEQ ID NO: 1439308 - RNA, 20 nt, Homo sapiens
uagacugaagagaccacagc

SEQ ID NO: 1439309 - RNA, 17 nt, Homo sapiens
uagagaagaucuaauac

SEQ ID NO: 1439310 - RNA, 22 nt, Homo sapiens
uagagaagccggcucuucaaag

SEQ ID NO: 1439311 - RNA, 15 nt, Homo sapiens
uagagacacagagau

SEQ ID NO: 1439312 - RNA, 14 nt, Homo sapiens
uagagauaugcaga

SEQ ID NO: 1439313 - RNA, 18 nt, Homo sapiens
uagagauaugcagaagga

SEQ ID NO: 1439314 - RNA, 23 nt, Homo sapiens
uagaggcaugaacacacauggau

SEQ ID NO: 1439315 - RNA, 17 nt, Homo sapiens
uagagugcaguggugca

SEQ ID NO: 1439316 - RNA, 18 nt, Homo sapiens
uagaucugauggugagcu

SEQ ID NO: 1439317 - RNA, 18 nt, Homo sapiens
uagauggguuauuucaac

SEQ ID NO: 1439318 - RNA, 20 nt, Homo sapiens
uagauuaccugccacuucca

SEQ ID NO: 1439319 - RNA, 19 nt, Homo sapiens
uagcaagaauugaggaaga

SEQ ID NO: 1439320 - RNA, 16 nt, Homo sapiens
uagcaauugacuguca

SEQ ID NO: 1439321 - RNA, 13 nt, Homo sapiens
uagcacugggaac

SEQ ID NO: 1439322 - RNA, 23 nt, Homo sapiens
uagcagaaaccaagucuacuuca

SEQ ID NO: 1439323 - RNA, 12 nt, Homo sapiens
uagcagaaggca

SEQ ID NO: 1439324 - RNA, 14 nt, Homo sapiens
uagcagauggagua

SEQ ID NO: 1439325 - RNA, 22 nt, Homo sapiens
uagcaggcuaugaaguugcaau

SEQ ID NO: 1439326 - RNA, 20 nt, Homo sapiens
uagccacaucacuacaguac

SEQ ID NO: 1439327 - RNA, 19 nt, Homo sapiens
uagccacugaucauuuuua

SEQ ID NO: 1439328 - RNA, 23 nt, Homo sapiens
uagccagccggggcgaguggcac

SEQ ID NO: 1439329 - RNA, 14 nt, Homo sapiens
uagccagcuguguu

SEQ ID NO: 1439330 - RNA, 18 nt, Homo sapiens
uagccggggguggugaca

SEQ ID NO: 1439331 - RNA, 16 nt, Homo sapiens
uagccucuccaggaau

SEQ ID NO: 1439332 - RNA, 16 nt, Homo sapiens
uagcgcuggcucagga

SEQ ID NO: 1439333 - RNA, 22 nt, Homo sapiens
uagcguucccaacaacauccau

SEQ ID NO: 1439334 - RNA, 21 nt, Homo sapiens
uagcuaacguguccgaaacca

SEQ ID NO: 1439335 - RNA, 23 nt, Homo sapiens
uagcugaagaaguuauucucaag

SEQ ID NO: 1439336 - RNA, 19 nt, Homo sapiens
uagcugagccuucugauga

SEQ ID NO: 1439337 - RNA, 14 nt, Homo sapiens
uagcugagcucaca

SEQ ID NO: 1439338 - RNA, 19 nt, Homo sapiens
uagcugaguuuaacaugug

SEQ ID NO: 1439339 - RNA, 20 nt, Homo sapiens
uagcugcccaggaugcugcu

SEQ ID NO: 1439340 - RNA, 17 nt, Homo sapiens
uagcuuaaauaaauuca

SEQ ID NO: 1439341 - RNA, 13 nt, Homo sapiens
uagcuuaccugac

SEQ ID NO: 1439342 - RNA, 20 nt, Homo sapiens
uagcuuucccaaauaaacuc

SEQ ID NO: 1439343 - RNA, 17 nt, Homo sapiens
uaggaaaaguacauuua

SEQ ID NO: 1439344 - RNA, 17 nt, Homo sapiens
uaggaaaaugcuucugu

SEQ ID NO: 1439345 - RNA, 14 nt, Homo sapiens
uaggaaauuccuuc

SEQ ID NO: 1439346 - RNA, 12 nt, Homo sapiens
uaggaacagcuc

SEQ ID NO: 1439347 - RNA, 15 nt, Homo sapiens
uaggaaccuaugaaa

SEQ ID NO: 1439348 - RNA, 18 nt, Homo sapiens
uaggaaccuaugaaacua

SEQ ID NO: 1439349 - RNA, 21 nt, Homo sapiens
uaggagacagucucaagcacu

SEQ ID NO: 1439350 - RNA, 15 nt, Homo sapiens
uaggagcaaagccug

SEQ ID NO: 1439351 - RNA, 19 nt, Homo sapiens
uaggcauccugugugcuga

SEQ ID NO: 1439352 - RNA, 11 nt, Homo sapiens
uaggggaugag

SEQ ID NO: 1439353 - RNA, 19 nt, Homo sapiens
uagguccuggcuucuagau

SEQ ID NO: 1439354 - RNA, 14 nt, Homo sapiens
uaggugugccaaac

SEQ ID NO: 1439355 - RNA, 13 nt, Homo sapiens
uagguuaaaugca

SEQ ID NO: 1439356 - RNA, 14 nt, Homo sapiens
uagguugugcaaau

SEQ ID NO: 1439357 - RNA, 17 nt, Homo sapiens
uaguaagccucccuccu

SEQ ID NO: 1439358 - RNA, 21 nt, Homo sapiens
uaguaaucccccuugccaaau

SEQ ID NO: 1439359 - RNA, 22 nt, Homo sapiens
uaguaauuguaaguaccccuga

SEQ ID NO: 1439360 - RNA, 13 nt, Homo sapiens
uagucaaaccaua

SEQ ID NO: 1439361 - RNA, 21 nt, Homo sapiens
uagucacugucucaacuacuc

SEQ ID NO: 1439362 - RNA, 15 nt, Homo sapiens
uaguccccaucagca

SEQ ID NO: 1439363 - RNA, 17 nt, Homo sapiens
uagugacuguaauuaau

SEQ ID NO: 1439364 - RNA, 19 nt, Homo sapiens
uagugagaaacugauuuau

SEQ ID NO: 1439365 - RNA, 14 nt, Homo sapiens
uagugcacuagcau

SEQ ID NO: 1439366 - RNA, 19 nt, Homo sapiens
uaguggccaaauagcacau

SEQ ID NO: 1439367 - RNA, 16 nt, Homo sapiens
uagugugugugcaugu

SEQ ID NO: 1439368 - RNA, 23 nt, Homo sapiens
uaguuaaguauuuacagauguua

SEQ ID NO: 1439369 - RNA, 15 nt, Homo sapiens
uaguuauuuacuuga

SEQ ID NO: 1439370 - RNA, 16 nt, Homo sapiens
uaguuauuuacuugaa

SEQ ID NO: 1439371 - RNA, 22 nt, Homo sapiens
uaguucccugaaaacccagaga

SEQ ID NO: 1439372 - RNA, 16 nt, Homo sapiens
uaguuccucuucuuaa

SEQ ID NO: 1439373 - RNA, 16 nt, Homo sapiens
uaguucuaucaggaaa

SEQ ID NO: 1439374 - RNA, 15 nt, Homo sapiens
uaguucucacugucu

SEQ ID NO: 1439375 - RNA, 19 nt, Homo sapiens
uaguucuugugcauguuua

SEQ ID NO: 1439376 - RNA, 22 nt, Homo sapiens
uaguuuaauuaacuaugugaug

SEQ ID NO: 1439377 - RNA, 22 nt, Homo sapiens
uaguuuacagaauggaaccaaa

SEQ ID NO: 1439378 - RNA, 17 nt, Homo sapiens
uaguuucugauucacua

SEQ ID NO: 1439379 - RNA, 15 nt, Homo sapiens
uaguuuucagccuug

SEQ ID NO: 1439380 - RNA, 21 nt, Homo sapiens
uauaaaauauguacauaauau

SEQ ID NO: 1439381 - RNA, 14 nt, Homo sapiens
uauaaaugcaugau

SEQ ID NO: 1439382 - RNA, 18 nt, Homo sapiens
uauaaauguguggugcua

SEQ ID NO: 1439383 - RNA, 13 nt, Homo sapiens
uauaaauguuugu

SEQ ID NO: 1439384 - RNA, 15 nt, Homo sapiens
uauaacaaacuacau

SEQ ID NO: 1439385 - RNA, 22 nt, Homo sapiens
uauaacaugucuuucagcauua

SEQ ID NO: 1439386 - RNA, 22 nt, Homo sapiens
uauaacuaagacauaugcauuu

SEQ ID NO: 1439387 - RNA, 15 nt, Homo sapiens
uauaagacuacuaua

SEQ ID NO: 1439388 - RNA, 17 nt, Homo sapiens
uauaagcagaagcacau

SEQ ID NO: 1439389 - RNA, 16 nt, Homo sapiens
uauaauacuaaagugu

SEQ ID NO: 1439390 - RNA, 14 nt, Homo sapiens
uauaauauaccaau

SEQ ID NO: 1439391 - RNA, 22 nt, Homo sapiens
uccuccuacuucccuuuccucc

SEQ ID NO: 1439392 - RNA, 21 nt, Homo sapiens
uccuccucucucuacuugaau

SEQ ID NO: 1439393 - RNA, 18 nt, Homo sapiens
uccucgggggaaagcaca

SEQ ID NO: 1439394 - RNA, 22 nt, Homo sapiens
uccucuacuacuuuuacuacag

SEQ ID NO: 1439395 - RNA, 18 nt, Homo sapiens
uccucuccacugccuucg

SEQ ID NO: 1439396 - RNA, 19 nt, Homo sapiens
uccucugcugacuccauau

SEQ ID NO: 1439397 - RNA, 13 nt, Homo sapiens
uccucugcugcuc

SEQ ID NO: 1439398 - RNA, 22 nt, Homo sapiens
uccucuguucuaucccacccaa

SEQ ID NO: 1439399 - RNA, 15 nt, Homo sapiens
uccucuugaaccaca

SEQ ID NO: 1439400 - RNA, 14 nt, Homo sapiens
uccucuugcaaaag

SEQ ID NO: 1439401 - RNA, 14 nt, Homo sapiens
uccucuugcucaaa

SEQ ID NO: 1439402 - RNA, 14 nt, Homo sapiens
uccugaagccucug

SEQ ID NO: 1439403 - RNA, 13 nt, Homo sapiens
uccugagcacugc

SEQ ID NO: 1439404 - RNA, 14 nt, Homo sapiens
uccugauaaacauu

SEQ ID NO: 1439405 - RNA, 20 nt, Homo sapiens
uccugcagccuccuccugac

SEQ ID NO: 1439406 - RNA, 21 nt, Homo sapiens
uccugcagccuccuccugacc

SEQ ID NO: 1439407 - RNA, 14 nt, Homo sapiens
uccugccaguugaa

SEQ ID NO: 1439408 - RNA, 11 nt, Homo sapiens
uccugcccaua

SEQ ID NO: 1439409 - RNA, 18 nt, Homo sapiens
uccugccuccagcacucc

SEQ ID NO: 1439410 - RNA, 16 nt, Homo sapiens
uccugcuagcuguaga

SEQ ID NO: 1439411 - RNA, 12 nt, Homo sapiens
uccuggaaccaa

SEQ ID NO: 1439412 - RNA, 13 nt, Homo sapiens
uccuggaaccaau

SEQ ID NO: 1439413 - RNA, 21 nt, Homo sapiens
uccuggcaucuuucaacaaug

SEQ ID NO: 1439414 - RNA, 18 nt, Homo sapiens
uccuggcaugacacucua

SEQ ID NO: 1439415 - RNA, 21 nt, Homo sapiens
uccuggcccucuucuuauuca

SEQ ID NO: 1439416 - RNA, 19 nt, Homo sapiens
uccuggcuuugacaugaaa

SEQ ID NO: 1439417 - RNA, 22 nt, Homo sapiens
uccuggggagcuucacaaacau

SEQ ID NO: 1439418 - RNA, 18 nt, Homo sapiens
uccuggguggacuuuuga

SEQ ID NO: 1439419 - RNA, 16 nt, Homo sapiens
uccugugccccucaga

SEQ ID NO: 1439420 - RNA, 12 nt, Homo sapiens
uccugugcuacu

SEQ ID NO: 1439421 - RNA, 18 nt, Homo sapiens
uccugugcuggacuguuu

SEQ ID NO: 1439422 - RNA, 12 nt, Homo sapiens
uccuguguacag

SEQ ID NO: 1439423 - RNA, 19 nt, Homo sapiens
uccuuaauagccauaugca

SEQ ID NO: 1439424 - RNA, 20 nt, Homo sapiens
uccuuaauagccauaugcaa

SEQ ID NO: 1439425 - RNA, 20 nt, Homo sapiens
uccuuacucccaggcacugu

SEQ ID NO: 1439426 - RNA, 16 nt, Homo sapiens
uccuuccagcuaguga

SEQ ID NO: 1439427 - RNA, 13 nt, Homo sapiens
uccuugauucaca

SEQ ID NO: 1439428 - RNA, 19 nt, Homo sapiens
uccuuggaaauacuuuauc

SEQ ID NO: 1439429 - RNA, 21 nt, Homo sapiens
uccuuggggcacagucauuca

SEQ ID NO: 1439430 - RNA, 14 nt, Homo sapiens
uccuuguaucugua

SEQ ID NO: 1439431 - RNA, 20 nt, Homo sapiens
uccuugugguuuaugucauc

SEQ ID NO: 1439432 - RNA, 22 nt, Homo sapiens
uccuuuaccuaccaccuucccu

SEQ ID NO: 1439433 - RNA, 23 nt, Homo sapiens
uccuuucucuaucccaagccaac

SEQ ID NO: 1439434 - RNA, 19 nt, Homo sapiens
uccuuugagaaugugauuc

SEQ ID NO: 1439435 - RNA, 23 nt, Homo sapiens
uccuuugaguuauaguuugcuuu

SEQ ID NO: 1439436 - RNA, 22 nt, Homo sapiens
uccuuuggccauuccaacagcu

SEQ ID NO: 1439437 - RNA, 15 nt, Homo sapiens
uccuuuugaccaaau

SEQ ID NO: 1439438 - RNA, 23 nt, Homo sapiens
ucgaaaauucauuucacauuaau

SEQ ID NO: 1439439 - RNA, 15 nt, Homo sapiens
ucgaguccccagaac

SEQ ID NO: 1439440 - RNA, 13 nt, Homo sapiens
ucgauauaugacu

SEQ ID NO: 1439441 - RNA, 22 nt, Homo sapiens
ucgauauaugacuuuuucucag

SEQ ID NO: 1439442 - RNA, 16 nt, Homo sapiens
ucgcccacaaacugau

SEQ ID NO: 1439443 - RNA, 13 nt, Homo sapiens
ucgccggccuugu

SEQ ID NO: 1439444 - RNA, 16 nt, Homo sapiens
ucgccuaggccuguga

SEQ ID NO: 1439445 - RNA, 17 nt, Homo sapiens
ucgcucuugggagucag

SEQ ID NO: 1439446 - RNA, 18 nt, Homo sapiens
ucgcugccaggacaccug

SEQ ID NO: 1439447 - RNA, 15 nt, Homo sapiens
ucguaaauauucccu

SEQ ID NO: 1439448 - RNA, 13 nt, Homo sapiens
ucguaaggguugc

SEQ ID NO: 1439449 - RNA, 16 nt, Homo sapiens
ucgugguagaagccag

SEQ ID NO: 1439450 - RNA, 17 nt, Homo sapiens
ucgugugauuuccuaca

SEQ ID NO: 1439451 - RNA, 18 nt, Homo sapiens
ucuaaagccaguggcagu

SEQ ID NO: 1439452 - RNA, 18 nt, Homo sapiens
ucuaaaucugagaucucc

SEQ ID NO: 1439453 - RNA, 14 nt, Homo sapiens
ucuaacaguauuug

SEQ ID NO: 1439454 - RNA, 12 nt, Homo sapiens
ucuaacauaugu

SEQ ID NO: 1439455 - RNA, 17 nt, Homo sapiens
ucuaacccccagugcca

SEQ ID NO: 1439456 - RNA, 15 nt, Homo sapiens
ucuaagccaacuuua

SEQ ID NO: 1439457 - RNA, 13 nt, Homo sapiens
ucuaaguauuuga

SEQ ID NO: 1439458 - RNA, 15 nt, Homo sapiens
ucuaagucuccaaga

SEQ ID NO: 1439459 - RNA, 19 nt, Homo sapiens
ucuaagugguauauacaua

SEQ ID NO: 1439460 - RNA, 20 nt, Homo sapiens
ucuaauacaaagaugagcuc

SEQ ID NO: 1439461 - RNA, 23 nt, Homo sapiens
ucuaauuuauacaaaauaauuua

SEQ ID NO: 1439462 - RNA, 23 nt, Homo sapiens
ucuacaagcauuugcccugugga

SEQ ID NO: 1439463 - RNA, 23 nt, Homo sapiens
ucuacacagcaguaugaaugaug

SEQ ID NO: 1439464 - RNA, 23 nt, Homo sapiens
ucuacacagugggaacucugaca

SEQ ID NO: 1439465 - RNA, 21 nt, Homo sapiens
ucuacagccucagaaaccaga

SEQ ID NO: 1439466 - RNA, 16 nt, Homo sapiens
ucuacauacuauggaa

SEQ ID NO: 1439467 - RNA, 16 nt, Homo sapiens
ucuaccaucuaaucua

SEQ ID NO: 1439468 - RNA, 18 nt, Homo sapiens
ucuaggcaucccagggga

SEQ ID NO: 1439469 - RNA, 14 nt, Homo sapiens
ucuagugacuuccu

SEQ ID NO: 1439470 - RNA, 23 nt, Homo sapiens
ucuaguuccucuucuuaagggga

SEQ ID NO: 1439471 - RNA, 16 nt, Homo sapiens
ucuauaaaauacuggu

SEQ ID NO: 1439472 - RNA, 20 nt, Homo sapiens
ucuauaauggaaacauuuac

SEQ ID NO: 1439473 - RNA, 18 nt, Homo sapiens
ucuauauuggucauugcc

SEQ ID NO: 1439474 - RNA, 14 nt, Homo sapiens
ucuaucacauuaca

SEQ ID NO: 1439475 - RNA, 14 nt, Homo sapiens
ucuaugaucuuggc

SEQ ID NO: 1439476 - RNA, 18 nt, Homo sapiens
ucuaugguugacauugua

SEQ ID NO: 1439477 - RNA, 14 nt, Homo sapiens
ucuauguaugcauc

SEQ ID NO: 1439478 - RNA, 15 nt, Homo sapiens
ucuauguaugcaucu

SEQ ID NO: 1439479 - RNA, 18 nt, Homo sapiens
ucuauguaugcaucuaua

SEQ ID NO: 1439480 - RNA, 16 nt, Homo sapiens
ucuauuuccuccccca

SEQ ID NO: 1439481 - RNA, 17 nt, Homo sapiens
ucucaaagaaagcauuu

SEQ ID NO: 1439482 - RNA, 21 nt, Homo sapiens
ucucaaauucucaaccuacca

SEQ ID NO: 1439483 - RNA, 14 nt, Homo sapiens
ucucaacuacucag

SEQ ID NO: 1439484 - RNA, 19 nt, Homo sapiens
ucucaagcucuuccuuacu

SEQ ID NO: 1439485 - RNA, 21 nt, Homo sapiens
ucucaaugugaaaaauguguc

SEQ ID NO: 1439486 - RNA, 20 nt, Homo sapiens
ucucaauuauuggccugcua

SEQ ID NO: 1439487 - RNA, 13 nt, Homo sapiens
ucucacacacaua

SEQ ID NO: 1439488 - RNA, 17 nt, Homo sapiens
ucucacuaaaauggaua

SEQ ID NO: 1439489 - RNA, 14 nt, Homo sapiens
ucucagaagguauu

SEQ ID NO: 1439490 - RNA, 14 nt, Homo sapiens
ucucagaauucuuc

SEQ ID NO: 1439491 - RNA, 21 nt, Homo sapiens
ucucagccauaaagugccagu

SEQ ID NO: 1439492 - RNA, 16 nt, Homo sapiens
ucucagccuaccauga

SEQ ID NO: 1439493 - RNA, 14 nt, Homo sapiens
ucucagccuccuca

SEQ ID NO: 1439494 - RNA, 23 nt, Homo sapiens
ucucaggaguaucuuaccuguaa

SEQ ID NO: 1439495 - RNA, 16 nt, Homo sapiens
ucucagugcucuccua

SEQ ID NO: 1439496 - RNA, 14 nt, Homo sapiens
ucucaguucagagu

SEQ ID NO: 1439497 - RNA, 22 nt, Homo sapiens
ucucaucagaaaugucaucaaa

SEQ ID NO: 1439498 - RNA, 13 nt, Homo sapiens
ucuccaaacauua

SEQ ID NO: 1439499 - RNA, 18 nt, Homo sapiens
ucuccaagaauacagaaa

SEQ ID NO: 1439500 - RNA, 24 nt, Homo sapiens
ucuccagccagcaaugauguccag

SEQ ID NO: 1439501 - RNA, 18 nt, Homo sapiens
ucuccagugugaauauau

SEQ ID NO: 1439502 - RNA, 22 nt, Homo sapiens
ucucccacauauucacauacgu

SEQ ID NO: 1439503 - RNA, 15 nt, Homo sapiens
ucuccgcacuuggaa

SEQ ID NO: 1439504 - RNA, 22 nt, Homo sapiens
ucuccucuaucacauuacauca

SEQ ID NO: 1439505 - RNA, 15 nt, Homo sapiens
ucuccucuccuagcc

SEQ ID NO: 1439506 - RNA, 18 nt, Homo sapiens
ucuccuguauaaucucuc

SEQ ID NO: 1439507 - RNA, 16 nt, Homo sapiens
ucuccuguccaaccua

SEQ ID NO: 1439508 - RNA, 13 nt, Homo sapiens
ucuccuugcacuu

SEQ ID NO: 1439509 - RNA, 14 nt, Homo sapiens
ucuccuugcacuuu

SEQ ID NO: 1439510 - RNA, 17 nt, Homo sapiens
ucuccuuugcacugagg

SEQ ID NO: 1439511 - RNA, 15 nt, Homo sapiens
ucuccuuuugaccaa

SEQ ID NO: 1439512 - RNA, 18 nt, Homo sapiens
ucuccuuuugaccaaaua

SEQ ID NO: 1439513 - RNA, 23 nt, Homo sapiens
ucuccuuuugaccaaauaaagua

SEQ ID NO: 1439514 - RNA, 21 nt, Homo sapiens
ucucggaccuuucagcuguga

SEQ ID NO: 1439515 - RNA, 20 nt, Homo sapiens
ucucuacccggcccagagac

SEQ ID NO: 1439516 - RNA, 15 nt, Homo sapiens
ucucuagccacuuug

SEQ ID NO: 1439517 - RNA, 17 nt, Homo sapiens
ucucuaucccaagccaa

SEQ ID NO: 1439518 - RNA, 21 nt, Homo sapiens
ucucuccacgguagcacuuga

SEQ ID NO: 1439519 - RNA, 20 nt, Homo sapiens
ucucuccucagacugcucaa

SEQ ID NO: 1439520 - RNA, 9 nt, Homo sapiens
ucucucuuu

SEQ ID NO: 1439521 - RNA, 18 nt, Homo sapiens
ucucugagaacagacguu

SEQ ID NO: 1439522 - RNA, 17 nt, Homo sapiens
ucucugcaaagacuaga

SEQ ID NO: 1439523 - RNA, 12 nt, Homo sapiens
ucucugcugcua

SEQ ID NO: 1439524 - RNA, 21 nt, Homo sapiens
ucucuuaccgcgagacugaga

SEQ ID NO: 1439525 - RNA, 21 nt, Homo sapiens
ucucuugccagcauuuucaca

SEQ ID NO: 1439526 - RNA, 16 nt, Homo sapiens
ucucuuggccuguccu

SEQ ID NO: 1439527 - RNA, 16 nt, Homo sapiens
ucucuuugguguuaca

SEQ ID NO: 1439528 - RNA, 19 nt, Homo sapiens
ucucuuuuuaccuuuaaca

SEQ ID NO: 1439529 - RNA, 18 nt, Homo sapiens
ucugaaacucacacaacu

SEQ ID NO: 1439530 - RNA, 19 nt, Homo sapiens
ucugaaaggcacacuuuga

SEQ ID NO: 1439531 - RNA, 12 nt, Homo sapiens
ucugaaaugccu

SEQ ID NO: 1439532 - RNA, 17 nt, Homo sapiens
ucugaacaaacacugaa

SEQ ID NO: 1439533 - RNA, 15 nt, Homo sapiens
ucugaaccauuacug

SEQ ID NO: 1439534 - RNA, 19 nt, Homo sapiens
ucugagaaagacuauucaa

SEQ ID NO: 1439535 - RNA, 20 nt, Homo sapiens
ucugagacuauaacugucau

SEQ ID NO: 1439536 - RNA, 15 nt, Homo sapiens
ucugagcacccccuc

SEQ ID NO: 1439537 - RNA, 21 nt, Homo sapiens
ucugaugaccuaaccuaagca

SEQ ID NO: 1439538 - RNA, 22 nt, Homo sapiens
ucugaugaccuaaccuaagcaa

SEQ ID NO: 1439539 - RNA, 16 nt, Homo sapiens
ucugaugggucccaaa

SEQ ID NO: 1439540 - RNA, 14 nt, Homo sapiens
ucugauuggcucac

SEQ ID NO: 1439541 - RNA, 20 nt, Homo sapiens
ucugcacuaauugacccaaa

SEQ ID NO: 1439542 - RNA, 21 nt, Homo sapiens
ucugcagggggugugucugcu

SEQ ID NO: 1439543 - RNA, 13 nt, Homo sapiens
ucuggauuuuccc

SEQ ID NO: 1439544 - RNA, 15 nt, Homo sapiens
ucuggccacugcugc

SEQ ID NO: 1439545 - RNA, 16 nt, Homo sapiens
ucuggccacugcugca

SEQ ID NO: 1439546 - RNA, 20 nt, Homo sapiens
ucuggcuuugucucuagccg

SEQ ID NO: 1439547 - RNA, 23 nt, Homo sapiens
ucugggagaaaugagauaaaaga

SEQ ID NO: 1439548 - RNA, 14 nt, Homo sapiens
ucugggagccugac

SEQ ID NO: 1439549 - RNA, 20 nt, Homo sapiens
ucugggauucccaccaaggu

SEQ ID NO: 1439550 - RNA, 21 nt, Homo sapiens
ucugggcaaugaaaccaaagc

SEQ ID NO: 1439551 - RNA, 18 nt, Homo sapiens
ucugggcccccacuuuca

SEQ ID NO: 1439552 - RNA, 22 nt, Homo sapiens
ucuguaggucccacucccacag

SEQ ID NO: 1439553 - RNA, 12 nt, Homo sapiens
ucugucaccagc

SEQ ID NO: 1439554 - RNA, 14 nt, Homo sapiens
ucugucaccagcua

SEQ ID NO: 1439555 - RNA, 12 nt, Homo sapiens
ucuguccaggcc

SEQ ID NO: 1439556 - RNA, 18 nt, Homo sapiens
ucuguccguuuacuccaa

SEQ ID NO: 1439557 - RNA, 17 nt, Homo sapiens
ucugugaagaaugaagu

SEQ ID NO: 1439558 - RNA, 14 nt, Homo sapiens
ucugugacugccaa

SEQ ID NO: 1439559 - RNA, 22 nt, Homo sapiens
ucugugcaaauccuugauacug

SEQ ID NO: 1439560 - RNA, 24 nt, Homo sapiens
ucuguguaaaucuaacuacaagga

SEQ ID NO: 1439561 - RNA, 14 nt, Homo sapiens
ucuguuauugcacu

SEQ ID NO: 1439562 - RNA, 16 nt, Homo sapiens
ucuguucugccuuccg

SEQ ID NO: 1439563 - RNA, 19 nt, Homo sapiens
ucuguuuuguuuugcugaa

SEQ ID NO: 1439564 - RNA, 16 nt, Homo sapiens
ucuuaaaauaacuuau

SEQ ID NO: 1439565 - RNA, 23 nt, Homo sapiens
ucuuaaaggagaaguagcuguga

SEQ ID NO: 1439566 - RNA, 18 nt, Homo sapiens
ucuuacaaaggugaaaau

SEQ ID NO: 1439567 - RNA, 14 nt, Homo sapiens
ucuuacacuacauu

SEQ ID NO: 1439568 - RNA, 16 nt, Homo sapiens
ucuuagaaguggacca

SEQ ID NO: 1439569 - RNA, 15 nt, Homo sapiens
ucuuagccucccaaa

SEQ ID NO: 1439570 - RNA, 17 nt, Homo sapiens
ucuuagcugucugcuca

SEQ ID NO: 1439571 - RNA, 13 nt, Homo sapiens
ucuuauuugcuca

SEQ ID NO: 1439572 - RNA, 13 nt, Homo sapiens
ucuucacaacaga

SEQ ID NO: 1439573 - RNA, 21 nt, Homo sapiens
ucuucagaauauggacaaaga

SEQ ID NO: 1439574 - RNA, 11 nt, Homo sapiens
ucuucagccau

SEQ ID NO: 1439575 - RNA, 22 nt, Homo sapiens
ucuucaggguguuaaggcagug

SEQ ID NO: 1439576 - RNA, 14 nt, Homo sapiens
ucuucaucugugac

SEQ ID NO: 1439577 - RNA, 16 nt, Homo sapiens
ucuuccagguacugau

SEQ ID NO: 1439578 - RNA, 21 nt, Homo sapiens
ucuuccaggucccagagggug

SEQ ID NO: 1439579 - RNA, 14 nt, Homo sapiens
ucuucccuccuucc

SEQ ID NO: 1439580 - RNA, 14 nt, Homo sapiens
ucuuccuaccaaau

SEQ ID NO: 1439581 - RNA, 13 nt, Homo sapiens
ucuuccugcaaag

SEQ ID NO: 1439582 - RNA, 20 nt, Homo sapiens
ucuuccuuacccugcgauuu

SEQ ID NO: 1439583 - RNA, 15 nt, Homo sapiens
ucuucgcugcuagag

SEQ ID NO: 1439584 - RNA, 16 nt, Homo sapiens
ucuucggggugugaug

SEQ ID NO: 1439585 - RNA, 13 nt, Homo sapiens
ucuucuaaccuca

SEQ ID NO: 1439586 - RNA, 23 nt, Homo sapiens
ucuucuauauuccgggugccauu

SEQ ID NO: 1439587 - RNA, 12 nt, Homo sapiens
ucuucuaugcaa

SEQ ID NO: 1439588 - RNA, 18 nt, Homo sapiens
ucuucuccaacaccaccu

SEQ ID NO: 1439589 - RNA, 14 nt, Homo sapiens
ucuucuccacugga

SEQ ID NO: 1439590 - RNA, 23 nt, Homo sapiens
ucuucugccccagcuuugcagga

SEQ ID NO: 1439591 - RNA, 13 nt, Homo sapiens
ucuucugccucag

SEQ ID NO: 1439592 - RNA, 22 nt, Homo sapiens
ucuucuuauucaugcuuucucc

SEQ ID NO: 1439593 - RNA, 13 nt, Homo sapiens
ucuugacauguaa

SEQ ID NO: 1439594 - RNA, 14 nt, Homo sapiens
ucuugcauugcaaa

SEQ ID NO: 1439595 - RNA, 15 nt, Homo sapiens
ucuuggaagugugug

SEQ ID NO: 1439596 - RNA, 24 nt, Homo sapiens
ucuugggggguuuuuacuccagug

SEQ ID NO: 1439597 - RNA, 19 nt, Homo sapiens
ucuuguccacagucuccca

SEQ ID NO: 1439598 - RNA, 15 nt, Homo sapiens
ucuugucuccauuug

SEQ ID NO: 1439599 - RNA, 17 nt, Homo sapiens
ucuuuaaaauaaggaua

SEQ ID NO: 1439600 - RNA, 18 nt, Homo sapiens
ucuuuaaauuucaucuca

SEQ ID NO: 1439601 - RNA, 21 nt, Homo sapiens
ucuuuaaccucaucuacaagc

SEQ ID NO: 1439602 - RNA, 13 nt, Homo sapiens
ucuuuaaguauug

SEQ ID NO: 1439603 - RNA, 21 nt, Homo sapiens
ucuuuaauguuguccaggaaa

SEQ ID NO: 1439604 - RNA, 20 nt, Homo sapiens
ucuuuacaauaaacauagcu

SEQ ID NO: 1439605 - RNA, 22 nt, Homo sapiens
ucuuuccccaccucuuccuucc

SEQ ID NO: 1439606 - RNA, 19 nt, Homo sapiens
ucuuucucccucaccccca

SEQ ID NO: 1439607 - RNA, 17 nt, Homo sapiens
ucuuucuuuaccugaga

SEQ ID NO: 1439608 - RNA, 17 nt, Homo sapiens
ucuuugaagagauuuca

SEQ ID NO: 1439609 - RNA, 16 nt, Homo sapiens
ucuuugcucauggcaa

SEQ ID NO: 1439610 - RNA, 22 nt, Homo sapiens
ucuuugcucauggcaacaguua

SEQ ID NO: 1439611 - RNA, 17 nt, Homo sapiens
ucuuuggggucagccag

SEQ ID NO: 1439612 - RNA, 14 nt, Homo sapiens
ucuuuguacauuuu

SEQ ID NO: 1439613 - RNA, 16 nt, Homo sapiens
ucuuuuacaauccuaa

SEQ ID NO: 1439614 - RNA, 17 nt, Homo sapiens
ucuuuucgaauguggcu

SEQ ID NO: 1439615 - RNA, 15 nt, Homo sapiens
ucuuuuucacacuga

SEQ ID NO: 1439616 - RNA, 16 nt, Homo sapiens
ugaaauugaaccuggu

SEQ ID NO: 1439617 - RNA, 19 nt, Homo sapiens
ugaaauuucccacacccca

SEQ ID NO: 1439618 - RNA, 23 nt, Homo sapiens
ugaacacacauggaugcacacac

SEQ ID NO: 1439619 - RNA, 18 nt, Homo sapiens
ugaacagcagaaagacug

SEQ ID NO: 1439620 - RNA, 11 nt, Homo sapiens
ugaacagccaa

SEQ ID NO: 1439621 - RNA, 16 nt, Homo sapiens
ugaacagccaaaugca

SEQ ID NO: 1439622 - RNA, 18 nt, Homo sapiens
ugaaccauuacuguaauu

SEQ ID NO: 1439623 - RNA, 15 nt, Homo sapiens
ugaacccuugugcuu

SEQ ID NO: 1439624 - RNA, 18 nt, Homo sapiens
ugaacggcugaauaugaa

SEQ ID NO: 1439625 - RNA, 22 nt, Homo sapiens
ugaacuaaguuuuuuacuucca

SEQ ID NO: 1439626 - RNA, 16 nt, Homo sapiens
ugaacuuucacauagc

SEQ ID NO: 1439627 - RNA, 21 nt, Homo sapiens
ugaacuuuuuaagaugaggca

SEQ ID NO: 1439628 - RNA, 16 nt, Homo sapiens
ugaagaaaggaacuga

SEQ ID NO: 1439629 - RNA, 19 nt, Homo sapiens
ugaagaagaguuucuccuu

SEQ ID NO: 1439630 - RNA, 14 nt, Homo sapiens
ugaagacaaaccac

SEQ ID NO: 1439631 - RNA, 22 nt, Homo sapiens
ugaagacccaguguaaagaaua

SEQ ID NO: 1439632 - RNA, 23 nt, Homo sapiens
ugaagacccaguguaaagaauaa

SEQ ID NO: 1439633 - RNA, 15 nt, Homo sapiens
ugaagagaagcugag

SEQ ID NO: 1439634 - RNA, 18 nt, Homo sapiens
ugaagagaccaagacucu

SEQ ID NO: 1439635 - RNA, 12 nt, Homo sapiens
ugaagaguacag

SEQ ID NO: 1439636 - RNA, 19 nt, Homo sapiens
ugaagauucuccugugcua

SEQ ID NO: 1439637 - RNA, 16 nt, Homo sapiens
ugaagccccuuguccu

SEQ ID NO: 1439638 - RNA, 20 nt, Homo sapiens
ugaagccccuuguccucucc

SEQ ID NO: 1439639 - RNA, 10 nt, Homo sapiens
ugaagccuau

SEQ ID NO: 1439640 - RNA, 17 nt, Homo sapiens
ugaaggaggugagggau

SEQ ID NO: 1439641 - RNA, 14 nt, Homo sapiens
ugaaggauaagaga

SEQ ID NO: 1439642 - RNA, 16 nt, Homo sapiens
ugaaggguaaagaagu

SEQ ID NO: 1439643 - RNA, 16 nt, Homo sapiens
ugaagguaacugagag

SEQ ID NO: 1439644 - RNA, 19 nt, Homo sapiens
ugaaguguaguggcaucca

SEQ ID NO: 1439645 - RNA, 20 nt, Homo sapiens
ugaaguguaguggcauccau

SEQ ID NO: 1439646 - RNA, 16 nt, Homo sapiens
ugaaguuacacaauua

SEQ ID NO: 1439647 - RNA, 21 nt, Homo sapiens
ugaaguuagggaugacuguga

SEQ ID NO: 1439648 - RNA, 22 nt, Homo sapiens
ugaauaauuuucuggcacuggu

SEQ ID NO: 1439649 - RNA, 22 nt, Homo sapiens
ugaauagauggguuauuucaac

SEQ ID NO: 1439650 - RNA, 21 nt, Homo sapiens
ugaauagcgaaucaucucaaa

SEQ ID NO: 1439651 - RNA, 17 nt, Homo sapiens
ugaaucagacccuaccc

SEQ ID NO: 1439652 - RNA, 15 nt, Homo sapiens
ugaaucuuacuccuu

SEQ ID NO: 1439653 - RNA, 19 nt, Homo sapiens
ugaaugccggggacagaga

SEQ ID NO: 1439654 - RNA, 16 nt, Homo sapiens
ugaaugguuccaugcc

SEQ ID NO: 1439655 - RNA, 19 nt, Homo sapiens
ugaaugucuuacugugauc

SEQ ID NO: 1439656 - RNA, 13 nt, Homo sapiens
ugaauguuuccaa

SEQ ID NO: 1439657 - RNA, 15 nt, Homo sapiens
ugaauucuuaugcuu

SEQ ID NO: 1439658 - RNA, 17 nt, Homo sapiens
ugaauuggaccauccua

SEQ ID NO: 1439659 - RNA, 14 nt, Homo sapiens
ugaauugucuucac

SEQ ID NO: 1439660 - RNA, 18 nt, Homo sapiens
ugaauuugccuuccucau

SEQ ID NO: 1439661 - RNA, 18 nt, Homo sapiens
ugaauuuggccagacaca

SEQ ID NO: 1439662 - RNA, 16 nt, Homo sapiens
ugaauuuuaaauguuc

SEQ ID NO: 1439663 - RNA, 14 nt, Homo sapiens
ugaauuuuguugcu

SEQ ID NO: 1439664 - RNA, 16 nt, Homo sapiens
ugacaagggcugaccu

SEQ ID NO: 1439665 - RNA, 15 nt, Homo sapiens
ugacaccaccaucua

SEQ ID NO: 1439666 - RNA, 15 nt, Homo sapiens
ugacaccgaguucca

SEQ ID NO: 1439667 - RNA, 21 nt, Homo sapiens
ugacaccgucccucagugaua

SEQ ID NO: 1439668 - RNA, 12 nt, Homo sapiens
ugacaccuggau

SEQ ID NO: 1439669 - RNA, 14 nt, Homo sapiens
ugacaucacuugua

SEQ ID NO: 1439670 - RNA, 19 nt, Homo sapiens
ugacaucucuuugauguca

SEQ ID NO: 1439671 - RNA, 21 nt, Homo sapiens
ugacaucuuauuuacuuguag

SEQ ID NO: 1439672 - RNA, 13 nt, Homo sapiens
ugacaugcacuga

SEQ ID NO: 1439673 - RNA, 14 nt, Homo sapiens
ugacaugucucaca

SEQ ID NO: 1439674 - RNA, 18 nt, Homo sapiens
ugacauuaagacacaccu

SEQ ID NO: 1439675 - RNA, 20 nt, Homo sapiens
ugacauugcuucugcuaaau

SEQ ID NO: 1439676 - RNA, 20 nt, Homo sapiens
ugaccaaauaaaguaccauu

SEQ ID NO: 1439677 - RNA, 14 nt, Homo sapiens
ugaccaacaguucc

SEQ ID NO: 1439678 - RNA, 16 nt, Homo sapiens
ugaccagcaaauacuc

SEQ ID NO: 1439679 - RNA, 11 nt, Homo sapiens
ugaccaggaac

SEQ ID NO: 1439680 - RNA, 18 nt, Homo sapiens
ugaccaggacuaaugcau

SEQ ID NO: 1439681 - RNA, 23 nt, Homo sapiens
ugaccaucucuuaggucuaauga

SEQ ID NO: 1439682 - RNA, 14 nt, Homo sapiens
ugaccccaaagagc

SEQ ID NO: 1439683 - RNA, 20 nt, Homo sapiens
ugaccccaucaccuacucac

SEQ ID NO: 1439684 - RNA, 17 nt, Homo sapiens
ugaccgagaacuuuuaa

SEQ ID NO: 1439685 - RNA, 19 nt, Homo sapiens
ugaccggcagaauguucug

SEQ ID NO: 1439686 - RNA, 14 nt, Homo sapiens
ugaccucagcugca

SEQ ID NO: 1439687 - RNA, 21 nt, Homo sapiens
ugaccucagcugcacauuccu

SEQ ID NO: 1439688 - RNA, 17 nt, Homo sapiens
ugagcaguagaagccug

SEQ ID NO: 1439689 - RNA, 18 nt, Homo sapiens
ugagcaugcacagcugcu

SEQ ID NO: 1439690 - RNA, 18 nt, Homo sapiens
ugagccaaacacacugua

SEQ ID NO: 1439691 - RNA, 12 nt, Homo sapiens
ugagccagguaa

SEQ ID NO: 1439692 - RNA, 14 nt, Homo sapiens
ugagcgcugaugau

SEQ ID NO: 1439693 - RNA, 17 nt, Homo sapiens
ugagcuggaucacuuga

SEQ ID NO: 1439694 - RNA, 19 nt, Homo sapiens
ugaggagagaaggacaugu

SEQ ID NO: 1439695 - RNA, 15 nt, Homo sapiens
ugaggagcugacaua

SEQ ID NO: 1439696 - RNA, 14 nt, Homo sapiens
ugaggcaaaggcca

SEQ ID NO: 1439697 - RNA, 19 nt, Homo sapiens
ugaggcagggcaaaugaca

SEQ ID NO: 1439698 - RNA, 13 nt, Homo sapiens
ugaggcccagaaa

SEQ ID NO: 1439699 - RNA, 16 nt, Homo sapiens
ugaggcuccugugcua

SEQ ID NO: 1439700 - RNA, 18 nt, Homo sapiens
ugaggggaccaaagccac

SEQ ID NO: 1439701 - RNA, 11 nt, Homo sapiens
ugagggucccc

SEQ ID NO: 1439702 - RNA, 18 nt, Homo sapiens
ugagggucuuugcaagaa

SEQ ID NO: 1439703 - RNA, 17 nt, Homo sapiens
ugaggugcccaggagaa

SEQ ID NO: 1439704 - RNA, 15 nt, Homo sapiens
ugagguggugccuuc

SEQ ID NO: 1439705 - RNA, 21 nt, Homo sapiens
ugagguuaaaauauaaauuaa

SEQ ID NO: 1439706 - RNA, 23 nt, Homo sapiens
ugagucaaaagccugggugagaa

SEQ ID NO: 1439707 - RNA, 14 nt, Homo sapiens
ugagucaugaucuc

SEQ ID NO: 1439708 - RNA, 20 nt, Homo sapiens
ugagucaugaucucccugcc

SEQ ID NO: 1439709 - RNA, 20 nt, Homo sapiens
ugagucugaguccugucucu

SEQ ID NO: 1439710 - RNA, 23 nt, Homo sapiens
ugagucugggcaaugaaaccaaa

SEQ ID NO: 1439711 - RNA, 18 nt, Homo sapiens
ugagugaauagcuuucag

SEQ ID NO: 1439712 - RNA, 16 nt, Homo sapiens
ugaguggcagccaugc

SEQ ID NO: 1439713 - RNA, 13 nt, Homo sapiens
ugaguguguuugu

SEQ ID NO: 1439714 - RNA, 15 nt, Homo sapiens
ugaguugcccaucau

SEQ ID NO: 1439715 - RNA, 15 nt, Homo sapiens
ugaguuucucuccac

SEQ ID NO: 1439716 - RNA, 18 nt, Homo sapiens
ugaguuugcuguuugcaa

SEQ ID NO: 1439717 - RNA, 15 nt, Homo sapiens
ugaguuuucaaagau

SEQ ID NO: 1439718 - RNA, 13 nt, Homo sapiens
ugauaaacauuaa

SEQ ID NO: 1439719 - RNA, 22 nt, Homo sapiens
ugauaagcaggaaggauggcaa

SEQ ID NO: 1439720 - RNA, 13 nt, Homo sapiens
ugauaagccuuuc

SEQ ID NO: 1439721 - RNA, 14 nt, Homo sapiens
ugauacauauguga

SEQ ID NO: 1439722 - RNA, 20 nt, Homo sapiens
ugauaguuaauuauuucaac

SEQ ID NO: 1439723 - RNA, 13 nt, Homo sapiens
ugauaucaccucu

SEQ ID NO: 1439724 - RNA, 14 nt, Homo sapiens
ugauaugaguauac

SEQ ID NO: 1439725 - RNA, 14 nt, Homo sapiens
ugauaugggacuga

SEQ ID NO: 1439726 - RNA, 16 nt, Homo sapiens
ugauauuuuaugcaaa

SEQ ID NO: 1439727 - RNA, 12 nt, Homo sapiens
ugaucaauccuu

SEQ ID NO: 1439728 - RNA, 17 nt, Homo sapiens
ugaucauggucagcuca

SEQ ID NO: 1439729 - RNA, 22 nt, Homo sapiens
ugaugaauagcgaaucaucuca

SEQ ID NO: 1439730 - RNA, 14 nt, Homo sapiens
ugaugaauuacuuc

SEQ ID NO: 1439731 - RNA, 13 nt, Homo sapiens
ugaugaugucucu

SEQ ID NO: 1439732 - RNA, 13 nt, Homo sapiens
ugaugccaagaaa

SEQ ID NO: 1439733 - RNA, 16 nt, Homo sapiens
ugaugguaagacugua

SEQ ID NO: 1439734 - RNA, 13 nt, Homo sapiens
ugauggugcugac

SEQ ID NO: 1439735 - RNA, 14 nt, Homo sapiens
ugaugguugcaaaa

SEQ ID NO: 1439736 - RNA, 16 nt, Homo sapiens
ugauguacuacauuaa

SEQ ID NO: 1439737 - RNA, 23 nt, Homo sapiens
ugauuauacgacuuuuaagcaaa

SEQ ID NO: 1439738 - RNA, 22 nt, Homo sapiens
ugauuaugccacugcuuuccag

SEQ ID NO: 1439739 - RNA, 14 nt, Homo sapiens
ugauucacuauuag

SEQ ID NO: 1439740 - RNA, 23 nt, Homo sapiens
ugauucuuucccuuccuuuccuc

SEQ ID NO: 1439741 - RNA, 22 nt, Homo sapiens
ugauuuagggaagcagggacac

SEQ ID NO: 1439742 - RNA, 16 nt, Homo sapiens
ugauuuaugaucacuu

SEQ ID NO: 1439743 - RNA, 18 nt, Homo sapiens
ugauuucacaacagauca

SEQ ID NO: 1439744 - RNA, 13 nt, Homo sapiens
ugauuucagggaa

SEQ ID NO: 1439745 - RNA, 14 nt, Homo sapiens
ugauuucucugaac

SEQ ID NO: 1439746 - RNA, 18 nt, Homo sapiens
ugauuugacccacucaca

SEQ ID NO: 1439747 - RNA, 17 nt, Homo sapiens
ugcaaacaguucuugga

SEQ ID NO: 1439748 - RNA, 13 nt, Homo sapiens
ugcaaacuuuauu

SEQ ID NO: 1439749 - RNA, 13 nt, Homo sapiens
ugcaaagcacuga

SEQ ID NO: 1439750 - RNA, 16 nt, Homo sapiens
ugcaaagugcccucau

SEQ ID NO: 1439751 - RNA, 21 nt, Homo sapiens
ugcaaauccuugauacugcuc

SEQ ID NO: 1439752 - RNA, 20 nt, Homo sapiens
ugcaaaugccuccaagccau

SEQ ID NO: 1439753 - RNA, 20 nt, Homo sapiens
ugcaagaaguacaugaagag

SEQ ID NO: 1439754 - RNA, 18 nt, Homo sapiens
ugcaagcagggcucugcc

SEQ ID NO: 1439755 - RNA, 20 nt, Homo sapiens
ugcaaggauucagcauuauu

SEQ ID NO: 1439756 - RNA, 16 nt, Homo sapiens
ugcaauauuuacauuu

SEQ ID NO: 1439757 - RNA, 15 nt, Homo sapiens
ugcacaaagcccuuc

SEQ ID NO: 1439758 - RNA, 20 nt, Homo sapiens
uuuuuauggaggcuuugcau

SEQ ID NO: 1439759 - RNA, 15 nt, Homo sapiens
uuuuucaacuuggaa

SEQ ID NO: 1439760 - RNA, 14 nt, Homo sapiens
aagaggucugagcc

SEQ ID NO: 1439761 - RNA, 21 nt, Homo sapiens
aagauaaauagaguuccaaau

SEQ ID NO: 1439762 - RNA, 15 nt, Homo sapiens
aagauaauucacucu

SEQ ID NO: 1439763 - RNA, 15 nt, Homo sapiens
aagauagcagggcau

SEQ ID NO: 1439764 - RNA, 17 nt, Homo sapiens
aagauaguaucuuuuaa

SEQ ID NO: 1439765 - RNA, 14 nt, Homo sapiens
aagaucccgugaaa

SEQ ID NO: 1439766 - RNA, 18 nt, Homo sapiens
aagaugagagaacuggag

SEQ ID NO: 1439767 - RNA, 21 nt, Homo sapiens
aagaugcuuuguuucuuucau

SEQ ID NO: 1439768 - RNA, 20 nt, Homo sapiens
aagauggaggggcugacuca

SEQ ID NO: 1439769 - RNA, 18 nt, Homo sapiens
aagaugucacaagggauu

SEQ ID NO: 1439770 - RNA, 22 nt, Homo sapiens
aagauguguugcuauccugaaa

SEQ ID NO: 1439771 - RNA, 17 nt, Homo sapiens
aagauuaaaaaguaaaa

SEQ ID NO: 1439772 - RNA, 22 nt, Homo sapiens
aagauuguccagugcaaccaca

SEQ ID NO: 1439773 - RNA, 21 nt, Homo sapiens
aagauuuagcacccuucugcu

SEQ ID NO: 1439774 - RNA, 14 nt, Homo sapiens
aagauuuuaccugg

SEQ ID NO: 1439775 - RNA, 16 nt, Homo sapiens
aagauuuuuaauuaca

SEQ ID NO: 1439776 - RNA, 22 nt, Homo sapiens
aagauuuuuuuuguaacuucaa

SEQ ID NO: 1439777 - RNA, 18 nt, Homo sapiens
aagcaaauuaguaauugu

SEQ ID NO: 1439778 - RNA, 11 nt, Homo sapiens
aagcaaccucc

SEQ ID NO: 1439779 - RNA, 16 nt, Homo sapiens
aagcacugacugggac

SEQ ID NO: 1439780 - RNA, 15 nt, Homo sapiens
aagcagggcucugcc

SEQ ID NO: 1439781 - RNA, 19 nt, Homo sapiens
aagcaucaaagcacuguuu

SEQ ID NO: 1439782 - RNA, 13 nt, Homo sapiens
acagucauucaca

SEQ ID NO: 1439783 - RNA, 19 nt, Homo sapiens
acaguccuaccucaguuca

SEQ ID NO: 1439784 - RNA, 14 nt, Homo sapiens
acagucucaagcac

SEQ ID NO: 1439785 - RNA, 17 nt, Homo sapiens
acagucucaagcacuaa

SEQ ID NO: 1439786 - RNA, 20 nt, Homo sapiens
acagucucaggaaaucaaau

SEQ ID NO: 1439787 - RNA, 19 nt, Homo sapiens
acagugcccuuuucaucuc

SEQ ID NO: 1439788 - RNA, 19 nt, Homo sapiens
acagugccuggcaaggccu

SEQ ID NO: 1439789 - RNA, 17 nt, Homo sapiens
acagugggugaggagau

SEQ ID NO: 1439790 - RNA, 19 nt, Homo sapiens
acaguguugaaaauguuca

SEQ ID NO: 1439791 - RNA, 18 nt, Homo sapiens
acaguuaugggacacuga

SEQ ID NO: 1439792 - RNA, 13 nt, Homo sapiens
acaguuccuucag

SEQ ID NO: 1439793 - RNA, 20 nt, Homo sapiens
acaguugugagauugugccc

SEQ ID NO: 1439794 - RNA, 16 nt, Homo sapiens
acaguuuucugagaaa

SEQ ID NO: 1439795 - RNA, 15 nt, Homo sapiens
acaguuuugccuuaa

SEQ ID NO: 1439796 - RNA, 16 nt, Homo sapiens
acauaaacacauacau

SEQ ID NO: 1439797 - RNA, 13 nt, Homo sapiens
acauaacuugaua

SEQ ID NO: 1439798 - RNA, 20 nt, Homo sapiens
acauaagaccauaacagcca

SEQ ID NO: 1439799 - RNA, 15 nt, Homo sapiens
acauaaucacaauaa

SEQ ID NO: 1439800 - RNA, 12 nt, Homo sapiens
acauacauacau

SEQ ID NO: 1439801 - RNA, 15 nt, Homo sapiens
acauacauacauaua

SEQ ID NO: 1439802 - RNA, 17 nt, Homo sapiens
acauagagauaugcaca

SEQ ID NO: 1439803 - RNA, 21 nt, Homo sapiens
acauagauuaauggcacugau

SEQ ID NO: 1439804 - RNA, 18 nt, Homo sapiens
acauaguucagccacaaa

SEQ ID NO: 1439805 - RNA, 16 nt, Homo sapiens
acauaguuuauuucaa

SEQ ID NO: 1439806 - RNA, 20 nt, Homo sapiens
acauauauauucuacauaua

SEQ ID NO: 1439807 - RNA, 22 nt, Homo sapiens
acauauguauuaagccaaacau

SEQ ID NO: 1439808 - RNA, 18 nt, Homo sapiens
acauauucuuuaaauuuc

SEQ ID NO: 1439809 - RNA, 17 nt, Homo sapiens
acaucacuacaguacag

SEQ ID NO: 1439810 - RNA, 20 nt, Homo sapiens
acaucagagugacauccagg

SEQ ID NO: 1439811 - RNA, 13 nt, Homo sapiens
acauccaaugcau

SEQ ID NO: 1439812 - RNA, 15 nt, Homo sapiens
acauccaaugcauag

SEQ ID NO: 1439813 - RNA, 19 nt, Homo sapiens
acauccauguccuaugugu

SEQ ID NO: 1439814 - RNA, 13 nt, Homo sapiens
acauccauuccca

SEQ ID NO: 1439815 - RNA, 14 nt, Homo sapiens
acaucccacagugg

SEQ ID NO: 1439816 - RNA, 20 nt, Homo sapiens
acaucuauuauaaaaccaug

SEQ ID NO: 1439817 - RNA, 23 nt, Homo sapiens
acaucuccucuaucacauuacau

SEQ ID NO: 1439818 - RNA, 14 nt, Homo sapiens
acaucuucagcucc

SEQ ID NO: 1439819 - RNA, 18 nt, Homo sapiens
acaugaacagaaacaaua

SEQ ID NO: 1439820 - RNA, 13 nt, Homo sapiens
acaugaaugcaca

SEQ ID NO: 1439821 - RNA, 23 nt, Homo sapiens
acaugaccuccguguagugucug

SEQ ID NO: 1439822 - RNA, 23 nt, Homo sapiens
acaugacuucugccccagcuuua

SEQ ID NO: 1439823 - RNA, 14 nt, Homo sapiens
acaugauacugaug

SEQ ID NO: 1439824 - RNA, 15 nt, Homo sapiens
acaugauccugaguu

SEQ ID NO: 1439825 - RNA, 14 nt, Homo sapiens
acaugcacauuuau

SEQ ID NO: 1439826 - RNA, 14 nt, Homo sapiens
acaugcacugaccc

SEQ ID NO: 1439827 - RNA, 18 nt, Homo sapiens
acaugcugcuaauucaaa

SEQ ID NO: 1439828 - RNA, 22 nt, Homo sapiens
acaugcuggauaaaaugucagu

SEQ ID NO: 1439829 - RNA, 17 nt, Homo sapiens
acaugcugugcucuuug

SEQ ID NO: 1439830 - RNA, 16 nt, Homo sapiens
acauggaugagcacac

SEQ ID NO: 1439831 - RNA, 22 nt, Homo sapiens
acauggcuggcacugagcagua

SEQ ID NO: 1439832 - RNA, 13 nt, Homo sapiens
acaugucuuucag

SEQ ID NO: 1439833 - RNA, 14 nt, Homo sapiens
acauuaugccuuaa

SEQ ID NO: 1439834 - RNA, 15 nt, Homo sapiens
acauuaugugugcau

SEQ ID NO: 1439835 - RNA, 21 nt, Homo sapiens
acauucaaggcauuucuauca

SEQ ID NO: 1439836 - RNA, 19 nt, Homo sapiens
acauucacacagggcucuu

SEQ ID NO: 1439837 - RNA, 19 nt, Homo sapiens
acauucaucaagcuguaca

SEQ ID NO: 1439838 - RNA, 16 nt, Homo sapiens
acauucccugcaucca

SEQ ID NO: 1439839 - RNA, 17 nt, Homo sapiens
acauucccugcauccaa

SEQ ID NO: 1439840 - RNA, 18 nt, Homo sapiens
acauugcuucugcuaaau

SEQ ID NO: 1439841 - RNA, 13 nt, Homo sapiens
acauugguauauu

SEQ ID NO: 1439842 - RNA, 13 nt, Homo sapiens
acauuguauauau

SEQ ID NO: 1439843 - RNA, 18 nt, Homo sapiens
acauuucccugugcugac

SEQ ID NO: 1439844 - RNA, 22 nt, Homo sapiens
acauuugguauauuaccucaaa

SEQ ID NO: 1439845 - RNA, 18 nt, Homo sapiens
acauuuucaauaauguga

SEQ ID NO: 1439846 - RNA, 15 nt, Homo sapiens
acauuuuuguacaca

SEQ ID NO: 1439847 - RNA, 22 nt, Homo sapiens
accaaacuggacuugucuuccu

SEQ ID NO: 1439848 - RNA, 13 nt, Homo sapiens
accaaagagacug

SEQ ID NO: 1439849 - RNA, 17 nt, Homo sapiens
accaacaaacaaugcca

SEQ ID NO: 1439850 - RNA, 14 nt, Homo sapiens
accaacauggagaa

SEQ ID NO: 1439851 - RNA, 12 nt, Homo sapiens
aauccacagcca

SEQ ID NO: 1439852 - RNA, 14 nt, Homo sapiens
aaucccagcacuuu

SEQ ID NO: 1439853 - RNA, 17 nt, Homo sapiens
aauccccggcugcuucc

SEQ ID NO: 1439854 - RNA, 22 nt, Homo sapiens
aaucccggucaugcuuuugcca

SEQ ID NO: 1439855 - RNA, 18 nt, Homo sapiens
aauccugccucuccccaa

SEQ ID NO: 1439856 - RNA, 16 nt, Homo sapiens
aauccuuaacauauuu

SEQ ID NO: 1439857 - RNA, 15 nt, Homo sapiens
aauccuuccaugaaa

SEQ ID NO: 1439858 - RNA, 14 nt, Homo sapiens
aaucgugucuucaa

SEQ ID NO: 1439859 - RNA, 19 nt, Homo sapiens
aaucuccacuguuauucua

SEQ ID NO: 1439860 - RNA, 16 nt, Homo sapiens
aaucucucuccuguau

SEQ ID NO: 1439861 - RNA, 20 nt, Homo sapiens
aaucugggcaucucgugcca

SEQ ID NO: 1439862 - RNA, 13 nt, Homo sapiens
aaucuuacuccuu

SEQ ID NO: 1439863 - RNA, 13 nt, Homo sapiens
aaucuuacuuugu

SEQ ID NO: 1439864 - RNA, 20 nt, Homo sapiens
aaucuucaagguguaaaaua

SEQ ID NO: 1439865 - RNA, 13 nt, Homo sapiens
aaugaaaccaaag

SEQ ID NO: 1439866 - RNA, 16 nt, Homo sapiens
aaugaaaccaaagcca

SEQ ID NO: 1439867 - RNA, 21 nt, Homo sapiens
aaugaagguuaggauuuaaca

SEQ ID NO: 1439868 - RNA, 18 nt, Homo sapiens
aaugaaugcuccaugaaa

SEQ ID NO: 1439869 - RNA, 20 nt, Homo sapiens
aaugacaauaaaaauuccaa

SEQ ID NO: 1439870 - RNA, 12 nt, Homo sapiens
aaugacauauuu

SEQ ID NO: 1439871 - RNA, 18 nt, Homo sapiens
aaugacauauuuuaucuu

SEQ ID NO: 1439872 - RNA, 15 nt, Homo sapiens
aaugacaugcacuga

SEQ ID NO: 1439873 - RNA, 17 nt, Homo sapiens
aaugacaugcacugacc

SEQ ID NO: 1439874 - RNA, 13 nt, Homo sapiens
aaugacccaaaga

SEQ ID NO: 1439875 - RNA, 14 nt, Homo sapiens
aaugacccaaagac

SEQ ID NO: 1439876 - RNA, 19 nt, Homo sapiens
aaugagaaggagucagaaa

SEQ ID NO: 1439877 - RNA, 24 nt, Homo sapiens
aaugagcaugaacuguccuuccau

SEQ ID NO: 1439878 - RNA, 17 nt, Homo sapiens
aaugagcuguaucugua

SEQ ID NO: 1439879 - RNA, 20 nt, Homo sapiens
aaugaugugaguacccagga

SEQ ID NO: 1439880 - RNA, 21 nt, Homo sapiens
aaugauguuuuagaaugauuc

SEQ ID NO: 1439881 - RNA, 19 nt, Homo sapiens
aaugauucauaacaaugua

SEQ ID NO: 1439882 - RNA, 11 nt, Homo sapiens
aaugcaacuuc

SEQ ID NO: 1439883 - RNA, 19 nt, Homo sapiens
aaugcacacacacagagau

SEQ ID NO: 1439884 - RNA, 17 nt, Homo sapiens
aaugcacauccauuccc

SEQ ID NO: 1439885 - RNA, 24 nt, Homo sapiens
aaugcaugauuuuauacauaguca

SEQ ID NO: 1439886 - RNA, 19 nt, Homo sapiens
aaugccucugcugugggcu

SEQ ID NO: 1439887 - RNA, 19 nt, Homo sapiens
aaugcuaagaaaugcugaa

SEQ ID NO: 1439888 - RNA, 17 nt, Homo sapiens
aaugcuaguuucauuca

SEQ ID NO: 1439889 - RNA, 21 nt, Homo sapiens
aaugcuggguguugcauuucu

SEQ ID NO: 1439890 - RNA, 21 nt, Homo sapiens
aaugcuguagaaugcuuggca

SEQ ID NO: 1439891 - RNA, 22 nt, Homo sapiens
aaugcuguuuuaaaaacaaaga

SEQ ID NO: 1439892 - RNA, 15 nt, Homo sapiens
aauggaaacauuuac

SEQ ID NO: 1439893 - RNA, 18 nt, Homo sapiens
aauggaugugcucacugg

SEQ ID NO: 1439894 - RNA, 15 nt, Homo sapiens
aaugggagaagagag

SEQ ID NO: 1439895 - RNA, 21 nt, Homo sapiens
aauggguacaauguacauuau

SEQ ID NO: 1439896 - RNA, 14 nt, Homo sapiens
aaugggugauaucc

SEQ ID NO: 1439897 - RNA, 22 nt, Homo sapiens
aauggugcaaauccuacugaau

SEQ ID NO: 1439898 - RNA, 18 nt, Homo sapiens
aauguagugaagggaugu

SEQ ID NO: 1439899 - RNA, 20 nt, Homo sapiens
aauguauauacacauauacc

SEQ ID NO: 1439900 - RNA, 11 nt, Homo sapiens
aauguauauau

SEQ ID NO: 1439901 - RNA, 14 nt, Homo sapiens
aauguaugcauuca

SEQ ID NO: 1439902 - RNA, 15 nt, Homo sapiens
aauguaugcauucau

SEQ ID NO: 1439903 - RNA, 12 nt, Homo sapiens
aaugucaucaaa

SEQ ID NO: 1439904 - RNA, 12 nt, Homo sapiens
aaugucauucac

SEQ ID NO: 1439905 - RNA, 13 nt, Homo sapiens
aaugucuguuuca

SEQ ID NO: 1439906 - RNA, 12 nt, Homo sapiens
aaugugccccau

SEQ ID NO: 1439907 - RNA, 18 nt, Homo sapiens
aauguguaagcauuguau

SEQ ID NO: 1439908 - RNA, 17 nt, Homo sapiens
aaugugugucugaagac

SEQ ID NO: 1439909 - RNA, 14 nt, Homo sapiens
aauguucacaacau

SEQ ID NO: 1439910 - RNA, 13 nt, Homo sapiens
aauguuguucucu

SEQ ID NO: 1439911 - RNA, 23 nt, Homo sapiens
aauguuuccaaccuggaguauaa

SEQ ID NO: 1439912 - RNA, 13 nt, Homo sapiens
aauuaaaaaccac

SEQ ID NO: 1439913 - RNA, 13 nt, Homo sapiens
aauuaacuaugug

SEQ ID NO: 1439914 - RNA, 17 nt, Homo sapiens
aauuaagagauacauuc

SEQ ID NO: 1439915 - RNA, 20 nt, Homo sapiens
aauuaaguaaauuacauuaa

SEQ ID NO: 1439916 - RNA, 21 nt, Homo sapiens
aauuagcugugugaaauacca

SEQ ID NO: 1439917 - RNA, 17 nt, Homo sapiens
cauuucaggggucguca

SEQ ID NO: 1439918 - RNA, 16 nt, Homo sapiens
cauuucccugugcuga

SEQ ID NO: 1439919 - RNA, 14 nt, Homo sapiens
cauuucuacuguga

SEQ ID NO: 1439920 - RNA, 22 nt, Homo sapiens
cauuucuggacccuccacuuca

SEQ ID NO: 1439921 - RNA, 20 nt, Homo sapiens
cauuuuaagaagacaugaca

SEQ ID NO: 1439922 - RNA, 15 nt, Homo sapiens
cauuuuagugacugu

SEQ ID NO: 1439923 - RNA, 22 nt, Homo sapiens
cauuuuggaaguuuucaggacu

SEQ ID NO: 1439924 - RNA, 15 nt, Homo sapiens
cauuuuguucuacau

SEQ ID NO: 1439925 - RNA, 22 nt, Homo sapiens
cauuuuuuucacuggaguuaca

SEQ ID NO: 1439926 - RNA, 21 nt, Homo sapiens
ccaaacacuguuucuaacuca

SEQ ID NO: 1439927 - RNA, 17 nt, Homo sapiens
ccaaaccagggugcaug

SEQ ID NO: 1439928 - RNA, 22 nt, Homo sapiens
ccaaaccgcaggcaaacggguc

SEQ ID NO: 1439929 - RNA, 19 nt, Homo sapiens
ccaaacucauucaccaaau

SEQ ID NO: 1439930 - RNA, 13 nt, Homo sapiens
ccaaagacuacac

SEQ ID NO: 1439931 - RNA, 16 nt, Homo sapiens
ccaaagacuacacugu

SEQ ID NO: 1439932 - RNA, 16 nt, Homo sapiens
ccaaagagacuggagc

SEQ ID NO: 1439933 - RNA, 15 nt, Homo sapiens
ccaaagccaccaaga

SEQ ID NO: 1439934 - RNA, 20 nt, Homo sapiens
ccaaaggcauccauagugca

SEQ ID NO: 1439935 - RNA, 15 nt, Homo sapiens
ccaaagugacacaga

SEQ ID NO: 1439936 - RNA, 20 nt, Homo sapiens
ccaaagugccacucauuccu

SEQ ID NO: 1439937 - RNA, 16 nt, Homo sapiens
ccaaauaaaaccucag

SEQ ID NO: 1439938 - RNA, 18 nt, Homo sapiens
ccaaauaaauguguaaau

SEQ ID NO: 1439939 - RNA, 19 nt, Homo sapiens
ccaaaugagacacauuaaa

SEQ ID NO: 1439940 - RNA, 11 nt, Homo sapiens
ccaaaugaugc

SEQ ID NO: 1439941 - RNA, 18 nt, Homo sapiens
ccaaaugaugccacuucc

SEQ ID NO: 1439942 - RNA, 16 nt, Homo sapiens
ccaacaaacaaugcca

SEQ ID NO: 1439943 - RNA, 12 nt, Homo sapiens
ccaacaauguug

SEQ ID NO: 1439944 - RNA, 23 nt, Homo sapiens
ccaacauuacuccauuacuaaag

SEQ ID NO: 1439945 - RNA, 15 nt, Homo sapiens
ccaacgggaagcaac

SEQ ID NO: 1439946 - RNA, 21 nt, Homo sapiens
ccaacuccuggagauuucagu

SEQ ID NO: 1439947 - RNA, 15 nt, Homo sapiens
ccaacucugcacucc

SEQ ID NO: 1439948 - RNA, 23 nt, Homo sapiens
ccaacuuguaaauacaccaccuc

SEQ ID NO: 1439949 - RNA, 16 nt, Homo sapiens
ccaagagagacauugc

SEQ ID NO: 1439950 - RNA, 14 nt, Homo sapiens
ccaagaugggcaca

SEQ ID NO: 1439951 - RNA, 15 nt, Homo sapiens
ccaagauucaaagag

SEQ ID NO: 1439952 - RNA, 13 nt, Homo sapiens
ccaagauuucaga

SEQ ID NO: 1439953 - RNA, 11 nt, Homo sapiens
ccaagccaugg

SEQ ID NO: 1439954 - RNA, 14 nt, Homo sapiens
ccaagccaugguga

SEQ ID NO: 1439955 - RNA, 17 nt, Homo sapiens
ccaagccauucacuucc

SEQ ID NO: 1439956 - RNA, 16 nt, Homo sapiens
ccaagcccucaauaag

SEQ ID NO: 1439957 - RNA, 16 nt, Homo sapiens
ccaaggaaacuugaau

SEQ ID NO: 1439958 - RNA, 13 nt, Homo sapiens
ccaaggaacaaga

SEQ ID NO: 1439959 - RNA, 19 nt, Homo sapiens
ccaaggaggaaaaacagac

SEQ ID NO: 1439960 - RNA, 16 nt, Homo sapiens
ccaaggcucugagcaa

SEQ ID NO: 1439961 - RNA, 14 nt, Homo sapiens
cgaggacaagugag

SEQ ID NO: 1439962 - RNA, 16 nt, Homo sapiens
cgagggauaauucaaa

SEQ ID NO: 1439963 - RNA, 13 nt, Homo sapiens
cgaggggcgcgau

SEQ ID NO: 1439964 - RNA, 22 nt, Homo sapiens
cgagucaauccccucauucagg

SEQ ID NO: 1439965 - RNA, 14 nt, Homo sapiens
cgagucucuucucc

SEQ ID NO: 1439966 - RNA, 14 nt, Homo sapiens
cgaucgcugugaaa

SEQ ID NO: 1439967 - RNA, 15 nt, Homo sapiens
cgaugcacacgcaca

SEQ ID NO: 1439968 - RNA, 15 nt, Homo sapiens
cgcaaacacaccgau

SEQ ID NO: 1439969 - RNA, 14 nt, Homo sapiens
cgcaaguucaggga

SEQ ID NO: 1439970 - RNA, 15 nt, Homo sapiens
cgcaaguucagggaa

SEQ ID NO: 1439971 - RNA, 17 nt, Homo sapiens
cgcacaaggcugaccaa

SEQ ID NO: 1439972 - RNA, 13 nt, Homo sapiens
cgcacacacagau

SEQ ID NO: 1439973 - RNA, 13 nt, Homo sapiens
cgcacacauggac

SEQ ID NO: 1439974 - RNA, 22 nt, Homo sapiens
cgcacccccacugcugcugcag

SEQ ID NO: 1439975 - RNA, 19 nt, Homo sapiens
cgcaucguggugugucaau

SEQ ID NO: 1439976 - RNA, 15 nt, Homo sapiens
cgccaaacacuccac

SEQ ID NO: 1439977 - RNA, 20 nt, Homo sapiens
cgccagacagauugcugaua

SEQ ID NO: 1439978 - RNA, 13 nt, Homo sapiens
cgccagggccaag

SEQ ID NO: 1439979 - RNA, 19 nt, Homo sapiens
cgccccucgcugcugcuac

SEQ ID NO: 1439980 - RNA, 21 nt, Homo sapiens
cgccuguaaucccagcacuuu

SEQ ID NO: 1439981 - RNA, 13 nt, Homo sapiens
cgcgagacugaga

SEQ ID NO: 1439982 - RNA, 18 nt, Homo sapiens
cgcgggaggcaccagcuc

SEQ ID NO: 1439983 - RNA, 18 nt, Homo sapiens
cgcuauagaauaaugcau

SEQ ID NO: 1439984 - RNA, 19 nt, Homo sapiens
cgcuccacguuucaggcag

SEQ ID NO: 1439985 - RNA, 14 nt, Homo sapiens
cgcucucucaggcg

SEQ ID NO: 1439986 - RNA, 12 nt, Homo sapiens
cgcuuugugagc

SEQ ID NO: 1439987 - RNA, 20 nt, Homo sapiens
cggacccugcccauaccccu

SEQ ID NO: 1439988 - RNA, 20 nt, Homo sapiens
cggagaagagcuguucacag

SEQ ID NO: 1439989 - RNA, 14 nt, Homo sapiens
cggagaguacagug

SEQ ID NO: 1439990 - RNA, 12 nt, Homo sapiens
cggagcugccag

SEQ ID NO: 1439991 - RNA, 15 nt, Homo sapiens
cggaggcggcuccag

SEQ ID NO: 1439992 - RNA, 19 nt, Homo sapiens
cggagggaggacaucauaa

SEQ ID NO: 1439993 - RNA, 16 nt, Homo sapiens
cggagguugcagugag

SEQ ID NO: 1439994 - RNA, 22 nt, Homo sapiens
cggaugugugucucaccccuca

SEQ ID NO: 1439995 - RNA, 15 nt, Homo sapiens
cggauuccuuuauga

SEQ ID NO: 1439996 - RNA, 17 nt, Homo sapiens
cggcaaccccaguucug

SEQ ID NO: 1439997 - RNA, 16 nt, Homo sapiens
cggcugcccgacucag

SEQ ID NO: 1439998 - RNA, 21 nt, Homo sapiens
cggcugcgucuccuccgcaca

SEQ ID NO: 1439999 - RNA, 17 nt, Homo sapiens
cgggagccguagagggu

SEQ ID NO: 1440000 - RNA, 18 nt, Homo sapiens
cgggcugggagcucugca

SEQ ID NO: 1440001 - RNA, 14 nt, Homo sapiens
cggggcacugcagg

SEQ ID NO: 1440002 - RNA, 20 nt, Homo sapiens
cgggggaaagcacaccucau

SEQ ID NO: 1440003 - RNA, 13 nt, Homo sapiens
cggguguguacac

SEQ ID NO: 1440004 - RNA, 15 nt, Homo sapiens
cggguuacuuucaca

SEQ ID NO: 1440005 - RNA, 21 nt, Homo sapiens
cgguggggcguagacuugaca

SEQ ID NO: 1440006 - RNA, 17 nt, Homo sapiens
cgguguuuaaagucaac

SEQ ID NO: 1440007 - RNA, 14 nt, Homo sapiens
cguagacuugacaa

SEQ ID NO: 1440008 - RNA, 14 nt, Homo sapiens
cguaguucccugaa

SEQ ID NO: 1440009 - RNA, 16 nt, Homo sapiens
cgucagaccaguacug

SEQ ID NO: 1440010 - RNA, 20 nt, Homo sapiens
cgucagaccaguacugggaa

SEQ ID NO: 1440011 - RNA, 20 nt, Homo sapiens
cgucccaaacagagggccac

SEQ ID NO: 1440012 - RNA, 15 nt, Homo sapiens
cgucucaagacugaa

SEQ ID NO: 1440013 - RNA, 20 nt, Homo sapiens
cgucucuacuaaaaauacaa

SEQ ID NO: 1440014 - RNA, 21 nt, Homo sapiens
cgucuucuccaacaccaccuc

SEQ ID NO: 1440015 - RNA, 15 nt, Homo sapiens
cgugaaauugaugcc

SEQ ID NO: 1440016 - RNA, 16 nt, Homo sapiens
cgugaugccaggacca

SEQ ID NO: 1440017 - RNA, 16 nt, Homo sapiens
cgugcaccaccaugcc

SEQ ID NO: 1440018 - RNA, 14 nt, Homo sapiens
cgugccaugaucug

SEQ ID NO: 1440019 - RNA, 15 nt, Homo sapiens
cgugguagaagccag

SEQ ID NO: 1440020 - RNA, 19 nt, Homo sapiens
cguggucuccuugcacuuu

SEQ ID NO: 1440021 - RNA, 18 nt, Homo sapiens
cguguagugucuguaaua

SEQ ID NO: 1440022 - RNA, 23 nt, Homo sapiens
cgugugaaguguaguggcaucca

SEQ ID NO: 1440023 - RNA, 14 nt, Homo sapiens
cguguggcuuacaa

SEQ ID NO: 1440024 - RNA, 18 nt, Homo sapiens
cguguuacuguugcacug

SEQ ID NO: 1440025 - RNA, 19 nt, Homo sapiens
cuaaaaauaaaccaaagga

SEQ ID NO: 1440026 - RNA, 15 nt, Homo sapiens
cuaaaacugcugaac

SEQ ID NO: 1440027 - RNA, 18 nt, Homo sapiens
cuaaaauucacuuagggu

SEQ ID NO: 1440028 - RNA, 18 nt, Homo sapiens
cuaaacaagggcagugag

SEQ ID NO: 1440029 - RNA, 12 nt, Homo sapiens
cuaaagacagaa

SEQ ID NO: 1440030 - RNA, 13 nt, Homo sapiens
cuaaagagcuuua

SEQ ID NO: 1440031 - RNA, 15 nt, Homo sapiens
cuaaagagcuuuagu

SEQ ID NO: 1440032 - RNA, 18 nt, Homo sapiens
cuaaagcuuucugacaag

SEQ ID NO: 1440033 - RNA, 19 nt, Homo sapiens
cuaaagggugcccacaaaa

SEQ ID NO: 1440034 - RNA, 13 nt, Homo sapiens
cuaaagugucuau

SEQ ID NO: 1440035 - RNA, 22 nt, Homo sapiens
cuaaauaguucuaucaggaaaa

SEQ ID NO: 1440036 - RNA, 15 nt, Homo sapiens
cuaaaucucuaauau

SEQ ID NO: 1440037 - RNA, 15 nt, Homo sapiens
cuaaaugaagugcaa

SEQ ID NO: 1440038 - RNA, 23 nt, Homo sapiens
cuaacccccagugccacagagaa

SEQ ID NO: 1440039 - RNA, 16 nt, Homo sapiens
cuaacuaucaaauaga

SEQ ID NO: 1440040 - RNA, 13 nt, Homo sapiens
cagaaggacucag

SEQ ID NO: 1440041 - RNA, 22 nt, Homo sapiens
cagaaggagggcagagccaugg

SEQ ID NO: 1440042 - RNA, 21 nt, Homo sapiens
cagaaggauauuuacuacuuu

SEQ ID NO: 1440043 - RNA, 14 nt, Homo sapiens
cagaagguauuccu

SEQ ID NO: 1440044 - RNA, 18 nt, Homo sapiens
cagaaugcucuacuucuu

SEQ ID NO: 1440045 - RNA, 11 nt, Homo sapiens
cagaaugucac

SEQ ID NO: 1440046 - RNA, 19 nt, Homo sapiens
cagaauuaacuccauucca

SEQ ID NO: 1440047 - RNA, 12 nt, Homo sapiens
cagaauugugca

SEQ ID NO: 1440048 - RNA, 17 nt, Homo sapiens
cagacaaaguaauuccu

SEQ ID NO: 1440049 - RNA, 21 nt, Homo sapiens
cagacaaaguaauuccucuca

SEQ ID NO: 1440050 - RNA, 17 nt, Homo sapiens
cagacaaguaaucacua

SEQ ID NO: 1440051 - RNA, 14 nt, Homo sapiens
cagacaauccacuc

SEQ ID NO: 1440052 - RNA, 15 nt, Homo sapiens
cagacagauugcuga

SEQ ID NO: 1440053 - RNA, 18 nt, Homo sapiens
cagacauacgaaacacaa

SEQ ID NO: 1440054 - RNA, 12 nt, Homo sapiens
cagacauuccaa

SEQ ID NO: 1440055 - RNA, 13 nt, Homo sapiens
cagaccaccugcc

SEQ ID NO: 1440056 - RNA, 24 nt, Homo sapiens
cagaccaccugccagccaucacaa

SEQ ID NO: 1440057 - RNA, 17 nt, Homo sapiens
cagaccauugucuucca

SEQ ID NO: 1440058 - RNA, 20 nt, Homo sapiens
cagacccccacucucauucc

SEQ ID NO: 1440059 - RNA, 22 nt, Homo sapiens
cagaccccuuggcuuuugcuug

SEQ ID NO: 1440060 - RNA, 21 nt, Homo sapiens
cagacuauuuaacuugagggu

SEQ ID NO: 1440061 - RNA, 16 nt, Homo sapiens
cagacucagacuccau

SEQ ID NO: 1440062 - RNA, 16 nt, Homo sapiens
cagacucccgcgugaa

SEQ ID NO: 1440063 - RNA, 15 nt, Homo sapiens
cagacucguucuucu

SEQ ID NO: 1440064 - RNA, 18 nt, Homo sapiens
cagagaagccccuaggca

SEQ ID NO: 1440065 - RNA, 21 nt, Homo sapiens
cagagaaguucuggcugaaca

SEQ ID NO: 1440066 - RNA, 18 nt, Homo sapiens
cagagaauauauacauuc

SEQ ID NO: 1440067 - RNA, 21 nt, Homo sapiens
cagagaccccaggaucccaga

SEQ ID NO: 1440068 - RNA, 20 nt, Homo sapiens
cagagaggccuuuuguuuaa

SEQ ID NO: 1440069 - RNA, 22 nt, Homo sapiens
cagagaggcugcucugccauac

SEQ ID NO: 1440070 - RNA, 23 nt, Homo sapiens
cagagagggcagagggguaggca

SEQ ID NO: 1440071 - RNA, 19 nt, Homo sapiens
cagagaggggcagguugac

SEQ ID NO: 1440072 - RNA, 14 nt, Homo sapiens
cagagauaugcaca

SEQ ID NO: 1440073 - RNA, 17 nt, Homo sapiens
cagagaugaaacuaugg

SEQ ID NO: 1440074 - RNA, 18 nt, Homo sapiens
cagagcccaagugccauc

SEQ ID NO: 1440075 - RNA, 15 nt, Homo sapiens
cagagccccacuccc

SEQ ID NO: 1440076 - RNA, 19 nt, Homo sapiens
cagagcugauggagaagga

SEQ ID NO: 1440077 - RNA, 17 nt, Homo sapiens
cagcgaaugaaugcugu

SEQ ID NO: 1440078 - RNA, 14 nt, Homo sapiens
cagcgaugugucac

SEQ ID NO: 1440079 - RNA, 15 nt, Homo sapiens
cagcgcgugcacagc

SEQ ID NO: 1440080 - RNA, 16 nt, Homo sapiens
cagcgcgugcacagcg

SEQ ID NO: 1440081 - RNA, 18 nt, Homo sapiens
cagcgucccuagcaguga

SEQ ID NO: 1440082 - RNA, 15 nt, Homo sapiens
cagcgugcuuagccu

SEQ ID NO: 1440083 - RNA, 15 nt, Homo sapiens
cagcuacauuccuca

SEQ ID NO: 1440084 - RNA, 22 nt, Homo sapiens
cagcuacauuccucagcugcca

SEQ ID NO: 1440085 - RNA, 14 nt, Homo sapiens
cagcugaacagcca

SEQ ID NO: 1440086 - RNA, 13 nt, Homo sapiens
cagcugacagaua

SEQ ID NO: 1440087 - RNA, 21 nt, Homo sapiens
cagcugauuuugucacugucu

SEQ ID NO: 1440088 - RNA, 18 nt, Homo sapiens
cagcugcagaugccacac

SEQ ID NO: 1440089 - RNA, 17 nt, Homo sapiens
cagcugcaucuacucag

SEQ ID NO: 1440090 - RNA, 12 nt, Homo sapiens
cagcugcugaag

SEQ ID NO: 1440091 - RNA, 21 nt, Homo sapiens
cagcuggacaauaugaaucuu

SEQ ID NO: 1440092 - RNA, 21 nt, Homo sapiens
cagcugggugguguacaagca

SEQ ID NO: 1440093 - RNA, 13 nt, Homo sapiens
cagcugucauuca

SEQ ID NO: 1440094 - RNA, 21 nt, Homo sapiens
cagcuucauuaugcagcugag

SEQ ID NO: 1440095 - RNA, 16 nt, Homo sapiens
cagcuugcucuucagu

SEQ ID NO: 1440096 - RNA, 14 nt, Homo sapiens
caggaaaccacuua

SEQ ID NO: 1440097 - RNA, 19 nt, Homo sapiens
caggaaaucaaauaugcaa

SEQ ID NO: 1440098 - RNA, 21 nt, Homo sapiens
caggaacagagacucuggaag

SEQ ID NO: 1440099 - RNA, 15 nt, Homo sapiens
caggaagagaaggag

SEQ ID NO: 1440100 - RNA, 15 nt, Homo sapiens
caggaaggacugugc

SEQ ID NO: 1440101 - RNA, 21 nt, Homo sapiens
caggaauaggcauuugccuaa

SEQ ID NO: 1440102 - RNA, 14 nt, Homo sapiens
caggacacaggccu

SEQ ID NO: 1440103 - RNA, 19 nt, Homo sapiens
caggacgcacccccacugc

SEQ ID NO: 1440104 - RNA, 20 nt, Homo sapiens
caggacgcacccccacugcu

SEQ ID NO: 1440105 - RNA, 22 nt, Homo sapiens
caggagaagcucaguagccuuu

SEQ ID NO: 1440106 - RNA, 23 nt, Homo sapiens
caggagcaaauguuucugcagua

SEQ ID NO: 1440107 - RNA, 22 nt, Homo sapiens
caggagguggagguugcaguga

SEQ ID NO: 1440108 - RNA, 23 nt, Homo sapiens
caggagguggagguugcagugag

SEQ ID NO: 1440109 - RNA, 20 nt, Homo sapiens
caggaguaucuuaccuguaa

SEQ ID NO: 1440110 - RNA, 22 nt, Homo sapiens
caggaucaaaccccgaccaccu

SEQ ID NO: 1440111 - RNA, 19 nt, Homo sapiens
caggaugaaggcgugcaag

SEQ ID NO: 1440112 - RNA, 12 nt, Homo sapiens
caggauucauug

SEQ ID NO: 1440113 - RNA, 14 nt, Homo sapiens
caggcaaacuugca

SEQ ID NO: 1440114 - RNA, 15 nt, Homo sapiens
caggcacugcugccc

SEQ ID NO: 1440115 - RNA, 18 nt, Homo sapiens
caggcagcgauggucuca

SEQ ID NO: 1440116 - RNA, 19 nt, Homo sapiens
cagucaccgacaacaugcu

SEQ ID NO: 1440117 - RNA, 13 nt, Homo sapiens
caguccucccacc

SEQ ID NO: 1440118 - RNA, 14 nt, Homo sapiens
cagucuugccuagg

SEQ ID NO: 1440119 - RNA, 21 nt, Homo sapiens
cagugaaagaguagugcauuu

SEQ ID NO: 1440120 - RNA, 14 nt, Homo sapiens
cagugaaccaaaga

SEQ ID NO: 1440121 - RNA, 15 nt, Homo sapiens
cagugaaccaaagag

SEQ ID NO: 1440122 - RNA, 21 nt, Homo sapiens
cagugaauuaaauuuucacua

SEQ ID NO: 1440123 - RNA, 16 nt, Homo sapiens
cagugacaaauuguaa

SEQ ID NO: 1440124 - RNA, 14 nt, Homo sapiens
cagugcaaccacac

SEQ ID NO: 1440125 - RNA, 19 nt, Homo sapiens
cagugcaagagacucuggc

SEQ ID NO: 1440126 - RNA, 20 nt, Homo sapiens
cagugcagggaaccgugaua

SEQ ID NO: 1440127 - RNA, 16 nt, Homo sapiens
cagugcccucauuuua

SEQ ID NO: 1440128 - RNA, 21 nt, Homo sapiens
cagugcuggggguuucuguag

SEQ ID NO: 1440129 - RNA, 15 nt, Homo sapiens
cagugcuguacuuga

SEQ ID NO: 1440130 - RNA, 17 nt, Homo sapiens
cagugcuguacuugaug

SEQ ID NO: 1440131 - RNA, 14 nt, Homo sapiens
caguggaucucaau

SEQ ID NO: 1440132 - RNA, 20 nt, Homo sapiens
caguggugaagaaaacuccu

SEQ ID NO: 1440133 - RNA, 19 nt, Homo sapiens
caguguaaagaauaaauga

SEQ ID NO: 1440134 - RNA, 20 nt, Homo sapiens
caguguaaagaauaaaugaa

SEQ ID NO: 1440135 - RNA, 18 nt, Homo sapiens
caguguccccuccacugu

SEQ ID NO: 1440136 - RNA, 19 nt, Homo sapiens
caguguuuuccuuugcacc

SEQ ID NO: 1440137 - RNA, 22 nt, Homo sapiens
caguuaacuuuaagacugagca

SEQ ID NO: 1440138 - RNA, 16 nt, Homo sapiens
caguuacuuaccugca

SEQ ID NO: 1440139 - RNA, 22 nt, Homo sapiens
caguuauaauuauuccacucaa

SEQ ID NO: 1440140 - RNA, 16 nt, Homo sapiens
caguucaaagcaggau

SEQ ID NO: 1440141 - RNA, 21 nt, Homo sapiens
caguuccuguagaacugagaa

SEQ ID NO: 1440142 - RNA, 19 nt, Homo sapiens
caguucgcagccacccuga

SEQ ID NO: 1440143 - RNA, 17 nt, Homo sapiens
caguuuggaaguguuaa

SEQ ID NO: 1440144 - RNA, 14 nt, Homo sapiens
caguuuugccuuaa

SEQ ID NO: 1440145 - RNA, 15 nt, Homo sapiens
caguuuuuaaacuag

SEQ ID NO: 1440146 - RNA, 17 nt, Homo sapiens
cauaaacacccaugaau

SEQ ID NO: 1440147 - RNA, 22 nt, Homo sapiens
cauaaacacccaugaaucaaag

SEQ ID NO: 1440148 - RNA, 17 nt, Homo sapiens
cauaaacuucaugguca

SEQ ID NO: 1440149 - RNA, 19 nt, Homo sapiens
cauaaaggcauggcauuug

SEQ ID NO: 1440150 - RNA, 13 nt, Homo sapiens
cauaaagugccag

SEQ ID NO: 1440151 - RNA, 16 nt, Homo sapiens
cauaacaugcuuuaga

SEQ ID NO: 1440152 - RNA, 14 nt, Homo sapiens
cauaacuugcugaa

SEQ ID NO: 1440153 - RNA, 15 nt, Homo sapiens
cauaaggcauauaca

SEQ ID NO: 1440154 - RNA, 19 nt, Homo sapiens
cauaagggacugugccaga

SEQ ID NO: 1440155 - RNA, 16 nt, Homo sapiens
cauaaucucauucaaa

SEQ ID NO: 1440156 - RNA, 19 nt, Homo sapiens
cauaauuuguacauaugua

SEQ ID NO: 1440157 - RNA, 17 nt, Homo sapiens
auuaucacaucaagcau

SEQ ID NO: 1440158 - RNA, 14 nt, Homo sapiens
auuaucaccagcag

SEQ ID NO: 1440159 - RNA, 21 nt, Homo sapiens
auuaucccccaaaaugcauuu

SEQ ID NO: 1440160 - RNA, 11 nt, Homo sapiens
auuaugcagcu

SEQ ID NO: 1440161 - RNA, 18 nt, Homo sapiens
auuaugccauagcaagau

SEQ ID NO: 1440162 - RNA, 18 nt, Homo sapiens
caccgucccucagugaua

SEQ ID NO: 1440163 - RNA, 17 nt, Homo sapiens
caccuaucacccaggcu

SEQ ID NO: 1440164 - RNA, 15 nt, Homo sapiens
caccucagugcccac

SEQ ID NO: 1440165 - RNA, 20 nt, Homo sapiens
caccucccaccccacuccag

SEQ ID NO: 1440166 - RNA, 20 nt, Homo sapiens
caccucugccucaaugugaa

SEQ ID NO: 1440167 - RNA, 19 nt, Homo sapiens
caccucuggcuuugucucu

SEQ ID NO: 1440168 - RNA, 16 nt, Homo sapiens
caccucuuuuugaaca

SEQ ID NO: 1440169 - RNA, 18 nt, Homo sapiens
caccugaccagaaugcgc

SEQ ID NO: 1440170 - RNA, 23 nt, Homo sapiens
caccuggauugcagacucaugaa

SEQ ID NO: 1440171 - RNA, 18 nt, Homo sapiens
caccuguuaaaauguaca

SEQ ID NO: 1440172 - RNA, 16 nt, Homo sapiens
caccuguugcaccuca

SEQ ID NO: 1440173 - RNA, 14 nt, Homo sapiens
caccuuauguauua

SEQ ID NO: 1440174 - RNA, 13 nt, Homo sapiens
caccuucaccuuc

SEQ ID NO: 1440175 - RNA, 20 nt, Homo sapiens
caccuuccuaauaugcuuua

SEQ ID NO: 1440176 - RNA, 21 nt, Homo sapiens
caccuugcuccuccuucugcu

SEQ ID NO: 1440177 - RNA, 19 nt, Homo sapiens
cacgaagcugugaacucag

SEQ ID NO: 1440178 - RNA, 13 nt, Homo sapiens
cacgaauccugac

SEQ ID NO: 1440179 - RNA, 14 nt, Homo sapiens
cacgccaacagccc

SEQ ID NO: 1440180 - RNA, 14 nt, Homo sapiens
cacgccaaugcaca

SEQ ID NO: 1440181 - RNA, 15 nt, Homo sapiens
cacgccaaugcacac

SEQ ID NO: 1440182 - RNA, 15 nt, Homo sapiens
cacggaugcacacac

SEQ ID NO: 1440183 - RNA, 14 nt, Homo sapiens
cacggaugcacaga

SEQ ID NO: 1440184 - RNA, 15 nt, Homo sapiens
cacgucuugcuauuu

SEQ ID NO: 1440185 - RNA, 15 nt, Homo sapiens
cacgugucuauaaug

SEQ ID NO: 1440186 - RNA, 16 nt, Homo sapiens
cacuaaaauucacuua

SEQ ID NO: 1440187 - RNA, 16 nt, Homo sapiens
cacuacaguacaguga

SEQ ID NO: 1440188 - RNA, 19 nt, Homo sapiens
cacuaccuucugaccuccc

SEQ ID NO: 1440189 - RNA, 14 nt, Homo sapiens
cacuagacugugcc

SEQ ID NO: 1440190 - RNA, 19 nt, Homo sapiens
cacuagguucaauucccug

SEQ ID NO: 1440191 - RNA, 18 nt, Homo sapiens
cacuauguugcccaggcu

SEQ ID NO: 1440192 - RNA, 19 nt, Homo sapiens
cacuauuuaucugugcaaa

SEQ ID NO: 1440193 - RNA, 16 nt, Homo sapiens
cacucaguuguuccua

SEQ ID NO: 1440194 - RNA, 14 nt, Homo sapiens
cacucccacuggaa

SEQ ID NO: 1440195 - RNA, 19 nt, Homo sapiens
cacuccucgguacucccau

SEQ ID NO: 1440196 - RNA, 18 nt, Homo sapiens
cacucuccccucccucuu

SEQ ID NO: 1440197 - RNA, 18 nt, Homo sapiens
cacucucuagcuuuaggg

SEQ ID NO: 1440198 - RNA, 19 nt, Homo sapiens
cacucugcaucagcacugc

SEQ ID NO: 1440199 - RNA, 20 nt, Homo sapiens
cacucuuauagaaaguucaa

SEQ ID NO: 1440200 - RNA, 22 nt, Homo sapiens
cacucuuaugaaaugggcuuua

SEQ ID NO: 1440201 - RNA, 18 nt, Homo sapiens
cacucuucauucuuugaa

SEQ ID NO: 1440202 - RNA, 17 nt, Homo sapiens
cacucuucccaccucag

SEQ ID NO: 1440203 - RNA, 15 nt, Homo sapiens
cacucuucuugagca

SEQ ID NO: 1440204 - RNA, 18 nt, Homo sapiens
cacugaaaauaccaucag

SEQ ID NO: 1440205 - RNA, 13 nt, Homo sapiens
cacugaaaugcua

SEQ ID NO: 1440206 - RNA, 18 nt, Homo sapiens
cacugauaauauguuuga

SEQ ID NO: 1440207 - RNA, 22 nt, Homo sapiens
cacugcagauagccagacacau

SEQ ID NO: 1440208 - RNA, 19 nt, Homo sapiens
cacugcaggggccgagcca

SEQ ID NO: 1440209 - RNA, 17 nt, Homo sapiens
cacugccagcagcuguu

SEQ ID NO: 1440210 - RNA, 14 nt, Homo sapiens
cacuggaggucaca

SEQ ID NO: 1440211 - RNA, 14 nt, Homo sapiens
cacuggaucuucag

SEQ ID NO: 1440212 - RNA, 22 nt, Homo sapiens
cacuggaucuucagaaggcuag

SEQ ID NO: 1440213 - RNA, 17 nt, Homo sapiens
cacuggcuccacaucca

SEQ ID NO: 1440214 - RNA, 23 nt, Homo sapiens
cacugggaugagccgcugugagc

SEQ ID NO: 1440215 - RNA, 18 nt, Homo sapiens
cacuguaagacucauucc

SEQ ID NO: 1440216 - RNA, 22 nt, Homo sapiens
cacuguguuggaggauggcacu

SEQ ID NO: 1440217 - RNA, 20 nt, Homo sapiens
cacuuacuaaccugguccua

SEQ ID NO: 1440218 - RNA, 15 nt, Homo sapiens
cacuucaaucugaga

SEQ ID NO: 1440219 - RNA, 17 nt, Homo sapiens
cacuuuaacugacuuaa

SEQ ID NO: 1440220 - RNA, 18 nt, Homo sapiens
cacuuugagaaccugugc

SEQ ID NO: 1440221 - RNA, 16 nt, Homo sapiens
cagaaaaacucuggga

SEQ ID NO: 1440222 - RNA, 16 nt, Homo sapiens
cagaaaacaaaagaga

SEQ ID NO: 1440223 - RNA, 23 nt, Homo sapiens
cagaaaacaaaucuucaaggugu

SEQ ID NO: 1440224 - RNA, 16 nt, Homo sapiens
cagaaaacacagccug

SEQ ID NO: 1440225 - RNA, 20 nt, Homo sapiens
cagaaaacacagccugugua

SEQ ID NO: 1440226 - RNA, 16 nt, Homo sapiens
cagaaaagaaaaccau

SEQ ID NO: 1440227 - RNA, 22 nt, Homo sapiens
cagaaacucaaccaucaaugga

SEQ ID NO: 1440228 - RNA, 23 nt, Homo sapiens
cagaaagaaguuaacuacagugu

SEQ ID NO: 1440229 - RNA, 14 nt, Homo sapiens
cagaacacagugcc

SEQ ID NO: 1440230 - RNA, 18 nt, Homo sapiens
cagaaccccuacaugaaa

SEQ ID NO: 1440231 - RNA, 20 nt, Homo sapiens
cagaagaaaaaguugcaguc

SEQ ID NO: 1440232 - RNA, 14 nt, Homo sapiens
cagaagacacugca

SEQ ID NO: 1440233 - RNA, 16 nt, Homo sapiens
cagaagacacugcaaa

SEQ ID NO: 1440234 - RNA, 17 nt, Homo sapiens
cagaagcagguucuuga

SEQ ID NO: 1440235 - RNA, 21 nt, Homo sapiens
cagaagcagguucuugauguc

SEQ ID NO: 1440236 - RNA, 23 nt, Homo sapiens
cagaagcaguugagucgucauca

SEQ ID NO: 1440237 - RNA, 20 nt, Homo sapiens
auaaaauuaugccauagcaa

SEQ ID NO: 1440238 - RNA, 18 nt, Homo sapiens
auaaacacccaugaauca

SEQ ID NO: 1440239 - RNA, 22 nt, Homo sapiens
auaaacacccaugaaucaaaga

SEQ ID NO: 1440240 - RNA, 21 nt, Homo sapiens
auaaacauugguauauuucca

SEQ ID NO: 1440241 - RNA, 20 nt, Homo sapiens
auaaacuaguuuccagugga

SEQ ID NO: 1440242 - RNA, 21 nt, Homo sapiens
auaaacuaguuuccaguggau

SEQ ID NO: 1440243 - RNA, 21 nt, Homo sapiens
auaaagaugucaaauaucuca

SEQ ID NO: 1440244 - RNA, 12 nt, Homo sapiens
auaaaguaccau

SEQ ID NO: 1440245 - RNA, 17 nt, Homo sapiens
auaaaguaccauuaguu

SEQ ID NO: 1440246 - RNA, 12 nt, Homo sapiens
auaaagugccag

SEQ ID NO: 1440247 - RNA, 17 nt, Homo sapiens
auaaaugaaucuuacuc

SEQ ID NO: 1440248 - RNA, 17 nt, Homo sapiens
auaaauguguaaaugug

SEQ ID NO: 1440249 - RNA, 15 nt, Homo sapiens
auaaauuaagacuuu

SEQ ID NO: 1440250 - RNA, 19 nt, Homo sapiens
auaaccccaggcaucccau

SEQ ID NO: 1440251 - RNA, 20 nt, Homo sapiens
auaaccuucaugaugaauua

SEQ ID NO: 1440252 - RNA, 21 nt, Homo sapiens
auaacuuaaaaaaaugacaga

SEQ ID NO: 1440253 - RNA, 15 nt, Homo sapiens
auaacuucucugagu

SEQ ID NO: 1440254 - RNA, 18 nt, Homo sapiens
auaacuuguccuauguca

SEQ ID NO: 1440255 - RNA, 14 nt, Homo sapiens
auaagaaacacaaa

SEQ ID NO: 1440256 - RNA, 20 nt, Homo sapiens
auaagaaacaugaugugaga

SEQ ID NO: 1440257 - RNA, 16 nt, Homo sapiens
auaagaaaguauaaag

SEQ ID NO: 1440258 - RNA, 19 nt, Homo sapiens
auaaggccagaaacuccuu

SEQ ID NO: 1440259 - RNA, 18 nt, Homo sapiens
auaaucaucucugucaca

SEQ ID NO: 1440260 - RNA, 14 nt, Homo sapiens
auaaugaacacgug

SEQ ID NO: 1440261 - RNA, 18 nt, Homo sapiens
auaaugcucccaucuccu

SEQ ID NO: 1440262 - RNA, 18 nt, Homo sapiens
auaaugguugacuggguu

SEQ ID NO: 1440263 - RNA, 22 nt, Homo sapiens
auaauguaagggucuguuguaa

SEQ ID NO: 1440264 - RNA, 20 nt, Homo sapiens
uuaaagaaagucgaauuaau

SEQ ID NO: 1440265 - RNA, 14 nt, Homo sapiens
uuaaagaaccaaaa

SEQ ID NO: 1440266 - RNA, 21 nt, Homo sapiens
uuaaagaaguaaauuugucca

SEQ ID NO: 1440267 - RNA, 18 nt, Homo sapiens
uuaaaguaccuguaguga

SEQ ID NO: 1440268 - RNA, 21 nt, Homo sapiens
uuaaagucaacaaccaugcca

SEQ ID NO: 1440269 - RNA, 18 nt, Homo sapiens
uuaaaguuuuauaugcau

SEQ ID NO: 1440270 - RNA, 21 nt, Homo sapiens
uuaaauauuaugugaaaucaa

SEQ ID NO: 1440271 - RNA, 15 nt, Homo sapiens
uuaaauguuucucaa

SEQ ID NO: 1440272 - RNA, 22 nt, Homo sapiens
uuaaauucugaacaauucucuc

SEQ ID NO: 1440273 - RNA, 17 nt, Homo sapiens
uuaaauuguaucuaauc

SEQ ID NO: 1440274 - RNA, 11 nt, Homo sapiens
uuaaauuugaa

SEQ ID NO: 1440275 - RNA, 14 nt, Homo sapiens
uuaacacauaacua

SEQ ID NO: 1440276 - RNA, 16 nt, Homo sapiens
uuaacagaaccagagg

SEQ ID NO: 1440277 - RNA, 20 nt, Homo sapiens
uuaacgacccagucaaugaa

SEQ ID NO: 1440278 - RNA, 17 nt, Homo sapiens
uuaacuaugugauguua

SEQ ID NO: 1440279 - RNA, 20 nt, Homo sapiens
uuaacugacuuaaguggcau

SEQ ID NO: 1440280 - RNA, 13 nt, Homo sapiens
uuaagacuuuaaa

SEQ ID NO: 1440281 - RNA, 21 nt, Homo sapiens
uuaagagaagaugugauuuau

SEQ ID NO: 1440282 - RNA, 14 nt, Homo sapiens
uuaagagauacauu

SEQ ID NO: 1440283 - RNA, 21 nt, Homo sapiens
uuaagcaaaggaaaccaaagg

SEQ ID NO: 1440284 - RNA, 21 nt, Homo sapiens
uuaaggagaggagaaacugag

SEQ ID NO: 1440285 - RNA, 17 nt, Homo sapiens
uuaaguaaaccaaaaag

SEQ ID NO: 1440286 - RNA, 20 nt, Homo sapiens
uuaauaaaaacuucagaaaa

SEQ ID NO: 1440287 - RNA, 16 nt, Homo sapiens
uuaauaaauucagaua

SEQ ID NO: 1440288 - RNA, 21 nt, Homo sapiens
uuaauaguuucugauucacua

SEQ ID NO: 1440289 - RNA, 14 nt, Homo sapiens
uuaauauaucccag

SEQ ID NO: 1440290 - RNA, 15 nt, Homo sapiens
uuaauaucaaugaag

SEQ ID NO: 1440291 - RNA, 17 nt, Homo sapiens
uuaauaugacaaaacaa

SEQ ID NO: 1440292 - RNA, 17 nt, Homo sapiens
uuaaugacaaggugaua

SEQ ID NO: 1440293 - RNA, 13 nt, Homo sapiens
uuaauguacaagu

SEQ ID NO: 1440294 - RNA, 17 nt, Homo sapiens
uuaauuggaauucugga

SEQ ID NO: 1440295 - RNA, 16 nt, Homo sapiens
uuacaaaggugaaaau

SEQ ID NO: 1440296 - RNA, 16 nt, Homo sapiens
uuacagagaaucugaa

SEQ ID NO: 1440297 - RNA, 11 nt, Homo sapiens
uuacagcugcc

SEQ ID NO: 1440298 - RNA, 16 nt, Homo sapiens
uuacauaauugcaaua

SEQ ID NO: 1440299 - RNA, 14 nt, Homo sapiens
uuacauuuauacau

SEQ ID NO: 1440300 - RNA, 19 nt, Homo sapiens
uuaccaacuuucuguaaac

SEQ ID NO: 1440301 - RNA, 14 nt, Homo sapiens
uuaccuccuaucag

SEQ ID NO: 1440302 - RNA, 17 nt, Homo sapiens
uuaccucuauuuugcca

SEQ ID NO: 1440303 - RNA, 17 nt, Homo sapiens
uuaccucuucuaugcaa

SEQ ID NO: 1440304 - RNA, 22 nt, Homo sapiens
uuacuccuuugcauuccaugau

SEQ ID NO: 1440305 - RNA, 15 nt, Homo sapiens
uuacucuggugcugu

SEQ ID NO: 1440306 - RNA, 21 nt, Homo sapiens
uuacugaaaacaaaauaucug

SEQ ID NO: 1440307 - RNA, 11 nt, Homo sapiens
uuacugugauc

SEQ ID NO: 1440308 - RNA, 12 nt, Homo sapiens
uuagaaugccuc

SEQ ID NO: 1440309 - RNA, 17 nt, Homo sapiens
uuagagauugccccaga

SEQ ID NO: 1440310 - RNA, 16 nt, Homo sapiens
uuagauuauauauucc

SEQ ID NO: 1440311 - RNA, 20 nt, Homo sapiens
uuagauuguuaaaauaacua

SEQ ID NO: 1440312 - RNA, 12 nt, Homo sapiens
uuagcccaagag

SEQ ID NO: 1440313 - RNA, 13 nt, Homo sapiens
uuagcugaacaau

SEQ ID NO: 1440314 - RNA, 23 nt, Homo sapiens
uuagcuguaaauacaugugugga

SEQ ID NO: 1440315 - RNA, 22 nt, Homo sapiens
uuaggauaaagaauauuuacaa

SEQ ID NO: 1440316 - RNA, 16 nt, Homo sapiens
uuagggaugacuguga

SEQ ID NO: 1440317 - RNA, 18 nt, Homo sapiens
uuagggaugacugugauu

SEQ ID NO: 1440318 - RNA, 14 nt, Homo sapiens
uuagggcuguagac

SEQ ID NO: 1440319 - RNA, 18 nt, Homo sapiens
uuaggugugccaaacuac

SEQ ID NO: 1440320 - RNA, 13 nt, Homo sapiens
uuaguaauuguaa

SEQ ID NO: 1440321 - RNA, 20 nt, Homo sapiens
uuaguccgcaaguucaggga

SEQ ID NO: 1440322 - RNA, 21 nt, Homo sapiens
uuagugucuugaauguaagaa

SEQ ID NO: 1440323 - RNA, 15 nt, Homo sapiens
uuaguuuguuuuaca

SEQ ID NO: 1440324 - RNA, 23 nt, Homo sapiens
uuauaaaagaauaaaauugcacu

SEQ ID NO: 1440325 - RNA, 17 nt, Homo sapiens
uuauaagaugucauccc

SEQ ID NO: 1440326 - RNA, 16 nt, Homo sapiens
uuauaauaauguucuc

SEQ ID NO: 1440327 - RNA, 21 nt, Homo sapiens
uuauaauucuugaaugaggca

SEQ ID NO: 1440328 - RNA, 16 nt, Homo sapiens
uuauacuccauacaua

SEQ ID NO: 1440329 - RNA, 19 nt, Homo sapiens
uuauacuguagcugaugaa

SEQ ID NO: 1440330 - RNA, 14 nt, Homo sapiens
uuauaucagccuga

SEQ ID NO: 1440331 - RNA, 18 nt, Homo sapiens
uuauauucaaggaucuca

SEQ ID NO: 1440332 - RNA, 23 nt, Homo sapiens
uuaucaaaaucuuucagcacuca

SEQ ID NO: 1440333 - RNA, 13 nt, Homo sapiens
uuauccacaagca

SEQ ID NO: 1440334 - RNA, 21 nt, Homo sapiens
uuauccuuaggaaaaugcuuc

SEQ ID NO: 1440335 - RNA, 11 nt, Homo sapiens
uuaucugcuag

SEQ ID NO: 1440336 - RNA, 17 nt, Homo sapiens
uuaucuguguugucucu

SEQ ID NO: 1440337 - RNA, 15 nt, Homo sapiens
uuaugcccucagaug

SEQ ID NO: 1440338 - RNA, 22 nt, Homo sapiens
uuauggcaagugauaucaccuc

SEQ ID NO: 1440339 - RNA, 19 nt, Homo sapiens
uuaugggaagacaaaacaa

SEQ ID NO: 1440340 - RNA, 19 nt, Homo sapiens
uuauguauuuuugucauau

SEQ ID NO: 1440341 - RNA, 17 nt, Homo sapiens
uuauguuugcacuuugu

SEQ ID NO: 1440342 - RNA, 15 nt, Homo sapiens
uuauuaauauugugc

SEQ ID NO: 1440343 - RNA, 16 nt, Homo sapiens
uuauuaccauuagcau

SEQ ID NO: 1440344 - RNA, 13 nt, Homo sapiens
uuauuagcaguag

SEQ ID NO: 1440345 - RNA, 17 nt, Homo sapiens
uuauucaagugccucuu

SEQ ID NO: 1440346 - RNA, 14 nt, Homo sapiens
uuauucugauucca

SEQ ID NO: 1440347 - RNA, 16 nt, Homo sapiens
uuauucugauuccacu

SEQ ID NO: 1440348 - RNA, 15 nt, Homo sapiens
uuauugcacuaugaa

SEQ ID NO: 1440349 - RNA, 20 nt, Homo sapiens
ucaggcagguuugccaguga

SEQ ID NO: 1440350 - RNA, 21 nt, Homo sapiens
ucaggcagguuugccagugaa

SEQ ID NO: 1440351 - RNA, 20 nt, Homo sapiens
ucagggagccuggaagccaa

SEQ ID NO: 1440352 - RNA, 14 nt, Homo sapiens
ucagguaguacugg

SEQ ID NO: 1440353 - RNA, 17 nt, Homo sapiens
ucagguaguacugggaa

SEQ ID NO: 1440354 - RNA, 13 nt, Homo sapiens
ucaggugauccac

SEQ ID NO: 1440355 - RNA, 19 nt, Homo sapiens
ucaggugcauuccaccaca

SEQ ID NO: 1440356 - RNA, 14 nt, Homo sapiens
ucaggugcuacaca

SEQ ID NO: 1440357 - RNA, 14 nt, Homo sapiens
ucagguggaaaaac

SEQ ID NO: 1440358 - RNA, 19 nt, Homo sapiens
ucagguucuuucugaaauc

SEQ ID NO: 1440359 - RNA, 13 nt, Homo sapiens
ucaguauagcauu

SEQ ID NO: 1440360 - RNA, 12 nt, Homo sapiens
ucaguccagaug

SEQ ID NO: 1440361 - RNA, 15 nt, Homo sapiens
ugaggcaaaggccag

SEQ ID NO: 1440362 - RNA, 13 nt, Homo sapiens
ugaggcaggagaa

SEQ ID NO: 1440363 - RNA, 16 nt, Homo sapiens
ugaggccuuacuuaaa

SEQ ID NO: 1440364 - RNA, 18 nt, Homo sapiens
ugaggcuccugugcuacu

SEQ ID NO: 1440365 - RNA, 23 nt, Homo sapiens
ugaggcugucgugagcuaugauu

SEQ ID NO: 1440366 - RNA, 21 nt, Homo sapiens
ugaggggaauagauuaccuga

SEQ ID NO: 1440367 - RNA, 18 nt, Homo sapiens
ugaggggcugacuucaau

SEQ ID NO: 1440368 - RNA, 21 nt, Homo sapiens
ugagguccugaucagcuucaa

SEQ ID NO: 1440369 - RNA, 22 nt, Homo sapiens
ugagguggagucucauucuguu

SEQ ID NO: 1440370 - RNA, 16 nt, Homo sapiens
ugaguaccucaaagga

SEQ ID NO: 1440371 - RNA, 16 nt, Homo sapiens
ugagucaaaagccugg

SEQ ID NO: 1440372 - RNA, 14 nt, Homo sapiens
ugagugaacaacua

SEQ ID NO: 1440373 - RNA, 18 nt, Homo sapiens
ugagugcuugucauggaa

SEQ ID NO: 1440374 - RNA, 16 nt, Homo sapiens
ugaguuauuuugcuaa

SEQ ID NO: 1440375 - RNA, 21 nt, Homo sapiens
ugaguugcccaucauacgcau

SEQ ID NO: 1440376 - RNA, 15 nt, Homo sapiens
ugauaaagcaguauu

SEQ ID NO: 1440377 - RNA, 18 nt, Homo sapiens
ugauaaagcaguauuugg

SEQ ID NO: 1440378 - RNA, 14 nt, Homo sapiens
ugauaaauucacau

SEQ ID NO: 1440379 - RNA, 16 nt, Homo sapiens
ugauaauaauugauca

SEQ ID NO: 1440380 - RNA, 15 nt, Homo sapiens
ugauacauaugugaa

SEQ ID NO: 1440381 - RNA, 18 nt, Homo sapiens
ugauacuucaggugcuuu

SEQ ID NO: 1440382 - RNA, 18 nt, Homo sapiens
ugauaucccccagccuca

SEQ ID NO: 1440383 - RNA, 18 nt, Homo sapiens
ugauauguaaacauaauu

SEQ ID NO: 1440384 - RNA, 19 nt, Homo sapiens
ugauauguucaacuggaga

SEQ ID NO: 1440385 - RNA, 17 nt, Homo sapiens
ugaucaaauauuucaac

SEQ ID NO: 1440386 - RNA, 17 nt, Homo sapiens
ugaucaauccuucuuau

SEQ ID NO: 1440387 - RNA, 12 nt, Homo sapiens
ugaucacaguga

SEQ ID NO: 1440388 - RNA, 19 nt, Homo sapiens
ugaucagugcaauugaccu

SEQ ID NO: 1440389 - RNA, 23 nt, Homo sapiens
ugaucggagccuccucucucaaa

SEQ ID NO: 1440390 - RNA, 14 nt, Homo sapiens
ugaucuaauuuaca

SEQ ID NO: 1440391 - RNA, 19 nt, Homo sapiens
ugaugacagacacuucuaa

SEQ ID NO: 1440392 - RNA, 23 nt, Homo sapiens
ugaugaggccucuuggaccucug

SEQ ID NO: 1440393 - RNA, 17 nt, Homo sapiens
ugaugauuugcuaucaa

SEQ ID NO: 1440394 - RNA, 18 nt, Homo sapiens
ugaugccccuuccccaag

SEQ ID NO: 1440395 - RNA, 17 nt, Homo sapiens
ugaugcgaaaacuugaa

SEQ ID NO: 1440396 - RNA, 21 nt, Homo sapiens
ugauggagauauuuacaugaa

SEQ ID NO: 1440397 - RNA, 15 nt, Homo sapiens
ugaugggacaucaaa

SEQ ID NO: 1440398 - RNA, 18 nt, Homo sapiens
ugauggugagcugggaag

SEQ ID NO: 1440399 - RNA, 11 nt, Homo sapiens
ugauggugcug

SEQ ID NO: 1440400 - RNA, 13 nt, Homo sapiens
ugauguccagaag

SEQ ID NO: 1440401 - RNA, 17 nt, Homo sapiens
ugauguuucacauaaaa

SEQ ID NO: 1440402 - RNA, 17 nt, Homo sapiens
ugauucugaaucugaaa

SEQ ID NO: 1440403 - RNA, 13 nt, Homo sapiens
ugauuucaagacc

SEQ ID NO: 1440404 - RNA, 13 nt, Homo sapiens
ugauuucaggaua

SEQ ID NO: 1440405 - RNA, 12 nt, Homo sapiens
ugauuugaccca

SEQ ID NO: 1440406 - RNA, 14 nt, Homo sapiens
ugauuugcuaucaa

SEQ ID NO: 1440407 - RNA, 21 nt, Homo sapiens
ugauuuuauacauagucacaa

SEQ ID NO: 1440408 - RNA, 15 nt, Homo sapiens
ugcaaaaguggaauc

SEQ ID NO: 1440409 - RNA, 19 nt, Homo sapiens
ugcaaacucacugcucaag

SEQ ID NO: 1440410 - RNA, 20 nt, Homo sapiens
ugcaaaguucccuacuuccu

SEQ ID NO: 1440411 - RNA, 15 nt, Homo sapiens
ugcaaaugccuccaa

SEQ ID NO: 1440412 - RNA, 17 nt, Homo sapiens
ugcaaccuuugccuccc

SEQ ID NO: 1440413 - RNA, 16 nt, Homo sapiens
ugcaacuucuaccucc

SEQ ID NO: 1440414 - RNA, 15 nt, Homo sapiens
ugcaagagacucugg

SEQ ID NO: 1440415 - RNA, 17 nt, Homo sapiens
ugcaagagacucuggcc

SEQ ID NO: 1440416 - RNA, 17 nt, Homo sapiens
ugcaagaguggacugaa

SEQ ID NO: 1440417 - RNA, 22 nt, Homo sapiens
ugcaaggugaacaccacuuugu

SEQ ID NO: 1440418 - RNA, 16 nt, Homo sapiens
ugcaagucauacuuag

SEQ ID NO: 1440419 - RNA, 16 nt, Homo sapiens
ugcaagugacaucucu

SEQ ID NO: 1440420 - RNA, 22 nt, Homo sapiens
ugcaagugcuaugccaagccau

SEQ ID NO: 1440421 - RNA, 17 nt, Homo sapiens
ugcaauucaucccagag

SEQ ID NO: 1440422 - RNA, 15 nt, Homo sapiens
uauacuauacaacaa

SEQ ID NO: 1440423 - RNA, 17 nt, Homo sapiens
uauacuguacugagaca

SEQ ID NO: 1440424 - RNA, 16 nt, Homo sapiens
uauagacaauuugccc

SEQ ID NO: 1440425 - RNA, 14 nt, Homo sapiens
uauagagauaugca

SEQ ID NO: 1440426 - RNA, 15 nt, Homo sapiens
uauagcguucccaac

SEQ ID NO: 1440427 - RNA, 21 nt, Homo sapiens
uauaggugcuacaaaaacaca

SEQ ID NO: 1440428 - RNA, 17 nt, Homo sapiens
uauucucuuaauuuuuc

SEQ ID NO: 1440429 - RNA, 15 nt, Homo sapiens
uauucugauuccacu

SEQ ID NO: 1440430 - RNA, 21 nt, Homo sapiens
uauucuggcugcaagggccag

SEQ ID NO: 1440431 - RNA, 23 nt, Homo sapiens
uauucuuaagggaacuuccacau

SEQ ID NO: 1440432 - RNA, 22 nt, Homo sapiens
uauugaaaaaucaccacaccaa

SEQ ID NO: 1440433 - RNA, 18 nt, Homo sapiens
uauugacaauaauuucag

SEQ ID NO: 1440434 - RNA, 21 nt, Homo sapiens
uauugagauaauuuauuuaau

SEQ ID NO: 1440435 - RNA, 20 nt, Homo sapiens
uauugauguuuccagaaaau

SEQ ID NO: 1440436 - RNA, 16 nt, Homo sapiens
uauugcgaaugugcag

SEQ ID NO: 1440437 - RNA, 21 nt, Homo sapiens
uauuggaaaggucauuguggc

SEQ ID NO: 1440438 - RNA, 20 nt, Homo sapiens
uauuggaugacuaacuauca

SEQ ID NO: 1440439 - RNA, 18 nt, Homo sapiens
uauugggccauagccuau

SEQ ID NO: 1440440 - RNA, 15 nt, Homo sapiens
uauuguauuacauuu

SEQ ID NO: 1440441 - RNA, 23 nt, Homo sapiens
uauuuaaaaaauaaaaaaauaca

SEQ ID NO: 1440442 - RNA, 19 nt, Homo sapiens
uauuuaacuggcuucagcc

SEQ ID NO: 1440443 - RNA, 22 nt, Homo sapiens
uauuuagaucuagaaacagauc

SEQ ID NO: 1440444 - RNA, 12 nt, Homo sapiens
uauuuauacucu

SEQ ID NO: 1440445 - RNA, 17 nt, Homo sapiens
uauuuaugccucuguau

SEQ ID NO: 1440446 - RNA, 22 nt, Homo sapiens
uauuuccccaccccacuauccu

SEQ ID NO: 1440447 - RNA, 12 nt, Homo sapiens
uauuugaaucuu

SEQ ID NO: 1440448 - RNA, 11 nt, Homo sapiens
uauuugccagc

SEQ ID NO: 1440449 - RNA, 20 nt, Homo sapiens
uauuuguaauagugacauau

SEQ ID NO: 1440450 - RNA, 14 nt, Homo sapiens
uauuuguaucacaa

SEQ ID NO: 1440451 - RNA, 17 nt, Homo sapiens
uauuuuuuuaagcugua

SEQ ID NO: 1440452 - RNA, 21 nt, Homo sapiens
uauuuuuuuaagcuguaaaaa

SEQ ID NO: 1440453 - RNA, 21 nt, Homo sapiens
uauuuuuuuuacugugcauac

SEQ ID NO: 1440454 - RNA, 19 nt, Homo sapiens
ucaaaacagagaugugaua

SEQ ID NO: 1440455 - RNA, 19 nt, Homo sapiens
ucaaaaguaaugcuucaau

SEQ ID NO: 1440456 - RNA, 20 nt, Homo sapiens
ucaaaaucuuucagcacuca

SEQ ID NO: 1440457 - RNA, 14 nt, Homo sapiens
ucaaaccaggauuu

SEQ ID NO: 1440458 - RNA, 20 nt, Homo sapiens
ucaaacuccuggacucaugc

SEQ ID NO: 1440459 - RNA, 19 nt, Homo sapiens
ucaaacugacaaccugugc

SEQ ID NO: 1440460 - RNA, 23 nt, Homo sapiens
ucaaagcucuauuaagauuucca

SEQ ID NO: 1440461 - RNA, 21 nt, Homo sapiens
ucaaagcuuuuuccagaggcu

SEQ ID NO: 1440462 - RNA, 18 nt, Homo sapiens
ucaaaguaaaacuugcug

SEQ ID NO: 1440463 - RNA, 18 nt, Homo sapiens
ucaaaguguaagcacuuc

SEQ ID NO: 1440464 - RNA, 20 nt, Homo sapiens
ucaaauauuaccaaaaaagu

SEQ ID NO: 1440465 - RNA, 20 nt, Homo sapiens
ucaaauggacucauggcuua

SEQ ID NO: 1440466 - RNA, 16 nt, Homo sapiens
ucaaauguuguucucu

SEQ ID NO: 1440467 - RNA, 23 nt, Homo sapiens
ucaaauuuugaugccaagaaagu

SEQ ID NO: 1440468 - RNA, 18 nt, Homo sapiens
ucaaauuuuuacugagaa

SEQ ID NO: 1440469 - RNA, 21 nt, Homo sapiens
ucaacaaguaacuuuguagaa

SEQ ID NO: 1440470 - RNA, 16 nt, Homo sapiens
ucaacaauaaagacug

SEQ ID NO: 1440471 - RNA, 16 nt, Homo sapiens
ucaacacucuucuuga

SEQ ID NO: 1440472 - RNA, 19 nt, Homo sapiens
ucaacaugccauaucucau

SEQ ID NO: 1440473 - RNA, 17 nt, Homo sapiens
ucaaccaggaacaugua

SEQ ID NO: 1440474 - RNA, 18 nt, Homo sapiens
ucaaccaggaacauguaa

SEQ ID NO: 1440475 - RNA, 22 nt, Homo sapiens
ucaaccugguggcaccagaugc

SEQ ID NO: 1440476 - RNA, 22 nt, Homo sapiens
ucaacugaaaagacucaguguu

SEQ ID NO: 1440477 - RNA, 10 nt, Homo sapiens
ucaacugagg

SEQ ID NO: 1440478 - RNA, 15 nt, Homo sapiens
ucaagaaacugagga

SEQ ID NO: 1440479 - RNA, 14 nt, Homo sapiens
ucaagagugcaguu

SEQ ID NO: 1440480 - RNA, 22 nt, Homo sapiens
ucaagcaauccuccugccucag

SEQ ID NO: 1440481 - RNA, 21 nt, Homo sapiens
ucaagcaugcaauaaugugca

SEQ ID NO: 1440482 - RNA, 18 nt, Homo sapiens
ucaagcccuuuacuugac

SEQ ID NO: 1440483 - RNA, 15 nt, Homo sapiens
ucaaguagaggcaau

SEQ ID NO: 1440484 - RNA, 20 nt, Homo sapiens
ucaagucuagaaaccaguau

SEQ ID NO: 1440485 - RNA, 13 nt, Homo sapiens
ucaagucuggauc

SEQ ID NO: 1440486 - RNA, 22 nt, Homo sapiens
ucaagugauccacccaccucag

SEQ ID NO: 1440487 - RNA, 20 nt, Homo sapiens
ucaaguuuuucagaaagcau

SEQ ID NO: 1440488 - RNA, 15 nt, Homo sapiens
ucaauaaaagaauuc

SEQ ID NO: 1440489 - RNA, 13 nt, Homo sapiens
ucaauaagccagc

SEQ ID NO: 1440490 - RNA, 15 nt, Homo sapiens
ucaauaagccagcaa

SEQ ID NO: 1440491 - RNA, 20 nt, Homo sapiens
ucaauaccccuguuaagcaa

SEQ ID NO: 1440492 - RNA, 13 nt, Homo sapiens
ucaauaugugauu

SEQ ID NO: 1440493 - RNA, 18 nt, Homo sapiens
ucaaucagugcagugaua

SEQ ID NO: 1440494 - RNA, 19 nt, Homo sapiens
ucaaucaucugugugaaaa

SEQ ID NO: 1440495 - RNA, 13 nt, Homo sapiens
ucaaugaccugua

SEQ ID NO: 1440496 - RNA, 19 nt, Homo sapiens
ucaauuaggcucugaaauc

SEQ ID NO: 1440497 - RNA, 13 nt, Homo sapiens
ucaauuaguacag

SEQ ID NO: 1440498 - RNA, 17 nt, Homo sapiens
ucaauuucccugacucc

SEQ ID NO: 1440499 - RNA, 18 nt, Homo sapiens
ucaauuuguaauugcuua

SEQ ID NO: 1440500 - RNA, 19 nt, Homo sapiens
ucaauuuuuauacauauca

SEQ ID NO: 1440501 - RNA, 16 nt, Homo sapiens
ucacaaaccaugcaaa

SEQ ID NO: 1440502 - RNA, 14 nt, Homo sapiens
ucacaaacuacaaa

SEQ ID NO: 1440503 - RNA, 16 nt, Homo sapiens
ucacaaacuacaaagc

SEQ ID NO: 1440504 - RNA, 23 nt, Homo sapiens
ugcaauuuccccucuguguccuc

SEQ ID NO: 1440505 - RNA, 14 nt, Homo sapiens
ugcacaaugggcaa

SEQ ID NO: 1440506 - RNA, 23 nt, Homo sapiens
ugcacacacacagagauaugcac

SEQ ID NO: 1440507 - RNA, 14 nt, Homo sapiens
ugcacacacagaug

SEQ ID NO: 1440508 - RNA, 14 nt, Homo sapiens
ugcacaccaaaaaa

SEQ ID NO: 1440509 - RNA, 17 nt, Homo sapiens
ugcacacggaugcacag

SEQ ID NO: 1440510 - RNA, 15 nt, Homo sapiens
ugcacagagauaugc

SEQ ID NO: 1440511 - RNA, 21 nt, Homo sapiens
ugcacagagauaugcacacac

SEQ ID NO: 1440512 - RNA, 20 nt, Homo sapiens
ugcacagcuaaaauaauaga

SEQ ID NO: 1440513 - RNA, 13 nt, Homo sapiens
ugcacagcugcuu

SEQ ID NO: 1440514 - RNA, 22 nt, Homo sapiens
ugcacagguuuucagcaacuca

SEQ ID NO: 1440515 - RNA, 15 nt, Homo sapiens
ugcacauccauuccc

SEQ ID NO: 1440516 - RNA, 21 nt, Homo sapiens
ugcacauccauucccaagaaa

SEQ ID NO: 1440517 - RNA, 20 nt, Homo sapiens
ugcaccuuaccaacuuucug

SEQ ID NO: 1440518 - RNA, 10 nt, Homo sapiens
ugcacuccau

SEQ ID NO: 1440519 - RNA, 11 nt, Homo sapiens
ugcacuuuuaa

SEQ ID NO: 1440520 - RNA, 19 nt, Homo sapiens
ugcagagaaucuguaguca

SEQ ID NO: 1440521 - RNA, 16 nt, Homo sapiens
ugcagagcugaagauu

SEQ ID NO: 1440522 - RNA, 14 nt, Homo sapiens
ugcagccaugacca

SEQ ID NO: 1440523 - RNA, 11 nt, Homo sapiens
ugcaguagcac

SEQ ID NO: 1440524 - RNA, 16 nt, Homo sapiens
ugcaguauuuuauuaa

SEQ ID NO: 1440525 - RNA, 20 nt, Homo sapiens
ugcaguccgcagucuggccu

SEQ ID NO: 1440526 - RNA, 20 nt, Homo sapiens
ugcaguggugcgaucuuggc

SEQ ID NO: 1440527 - RNA, 18 nt, Homo sapiens
ugcaguuccugaguaccu

SEQ ID NO: 1440528 - RNA, 20 nt, Homo sapiens
ugcaguuccugaguaccuuc

SEQ ID NO: 1440529 - RNA, 14 nt, Homo sapiens
ugcauauauuuuag

SEQ ID NO: 1440530 - RNA, 19 nt, Homo sapiens
ugccuguggggguccauuu

SEQ ID NO: 1440531 - RNA, 19 nt, Homo sapiens
ugccuguuuuucaaucuca

SEQ ID NO: 1440532 - RNA, 20 nt, Homo sapiens
ugccuuguaaacaugaaggg

SEQ ID NO: 1440533 - RNA, 20 nt, Homo sapiens
ugccuuuuuuaacacuagaa

SEQ ID NO: 1440534 - RNA, 21 nt, Homo sapiens
ugcgacuucacaaaaugcaag

SEQ ID NO: 1440535 - RNA, 11 nt, Homo sapiens
ugcgcacacac

SEQ ID NO: 1440536 - RNA, 21 nt, Homo sapiens
ugcgcacacacagauaugcac

SEQ ID NO: 1440537 - RNA, 18 nt, Homo sapiens
ugcggaaaugugucuugu

SEQ ID NO: 1440538 - RNA, 17 nt, Homo sapiens
ugcgggggagcuggaaa

SEQ ID NO: 1440539 - RNA, 19 nt, Homo sapiens
ugcuaacuguguguacaua

SEQ ID NO: 1440540 - RNA, 20 nt, Homo sapiens
ugcuaaucuucuuaugcaau

SEQ ID NO: 1440541 - RNA, 15 nt, Homo sapiens
ugcuaauucaaagcu

SEQ ID NO: 1440542 - RNA, 18 nt, Homo sapiens
ugcuaauucaaagcucua

SEQ ID NO: 1440543 - RNA, 18 nt, Homo sapiens
ugcuacacaaaagccaaa

SEQ ID NO: 1440544 - RNA, 21 nt, Homo sapiens
ugcuagugccugagaugcacg

SEQ ID NO: 1440545 - RNA, 19 nt, Homo sapiens
ugcuauaauauauaaugaa

SEQ ID NO: 1440546 - RNA, 18 nt, Homo sapiens
ugcuauauugcacuguga

SEQ ID NO: 1440547 - RNA, 20 nt, Homo sapiens
ugcuauuuuauuuguauuca

SEQ ID NO: 1440548 - RNA, 14 nt, Homo sapiens
ugcucgugugauuu

SEQ ID NO: 1440549 - RNA, 11 nt, Homo sapiens
ugcucugcuau

SEQ ID NO: 1440550 - RNA, 15 nt, Homo sapiens
ugcucuuagcugucu

SEQ ID NO: 1440551 - RNA, 19 nt, Homo sapiens
ugcugaauuucaggcauuu

SEQ ID NO: 1440552 - RNA, 11 nt, Homo sapiens
ugcugaccucu

SEQ ID NO: 1440553 - RNA, 23 nt, Homo sapiens
ugcugacggaagccaacuuggcu

SEQ ID NO: 1440554 - RNA, 20 nt, Homo sapiens
ugcugagaccccccaccacc

SEQ ID NO: 1440555 - RNA, 17 nt, Homo sapiens
ugcugaggcucugaccc

SEQ ID NO: 1440556 - RNA, 19 nt, Homo sapiens
ugcugcccugcucugggga

SEQ ID NO: 1440557 - RNA, 14 nt, Homo sapiens
ugcuggacugagga

SEQ ID NO: 1440558 - RNA, 13 nt, Homo sapiens
uggaugcacacac

SEQ ID NO: 1440559 - RNA, 15 nt, Homo sapiens
uggaugugggguccc

SEQ ID NO: 1440560 - RNA, 14 nt, Homo sapiens
uggauuauuuagau

SEQ ID NO: 1440561 - RNA, 19 nt, Homo sapiens
uggauuccagcauuugcca

SEQ ID NO: 1440562 - RNA, 12 nt, Homo sapiens
uggauugagggu

SEQ ID NO: 1440563 - RNA, 15 nt, Homo sapiens
uggcaaagugcugua

SEQ ID NO: 1440564 - RNA, 20 nt, Homo sapiens
uggcaaugaaaaauucucag

SEQ ID NO: 1440565 - RNA, 19 nt, Homo sapiens
uggcaauuguccccaggga

SEQ ID NO: 1440566 - RNA, 22 nt, Homo sapiens
uggcaauuuuuuuauacuacca

SEQ ID NO: 1440567 - RNA, 14 nt, Homo sapiens
uggcaccgagacca

SEQ ID NO: 1440568 - RNA, 15 nt, Homo sapiens
uggcaccucagacaa

SEQ ID NO: 1440569 - RNA, 18 nt, Homo sapiens
uggcacgugccugugauc

SEQ ID NO: 1440570 - RNA, 14 nt, Homo sapiens
uggcacugguugua

SEQ ID NO: 1440571 - RNA, 21 nt, Homo sapiens
uggcacuuggggcaccuugcu

SEQ ID NO: 1440572 - RNA, 22 nt, Homo sapiens
uggcagagaggaccccacugga

SEQ ID NO: 1440573 - RNA, 17 nt, Homo sapiens
uggcagccgugccuuca

SEQ ID NO: 1440574 - RNA, 13 nt, Homo sapiens
uggcagugaugaa

SEQ ID NO: 1440575 - RNA, 23 nt, Homo sapiens
uggcaguuacagggcccagguga

SEQ ID NO: 1440576 - RNA, 21 nt, Homo sapiens
uggcaguucucgcagauguua

SEQ ID NO: 1440577 - RNA, 18 nt, Homo sapiens
uggcauccccuuuauuaa

SEQ ID NO: 1440578 - RNA, 16 nt, Homo sapiens
uggccaacaugaugaa

SEQ ID NO: 1440579 - RNA, 19 nt, Homo sapiens
uggcccauagaaacaugac

SEQ ID NO: 1440580 - RNA, 22 nt, Homo sapiens
uggcccauagaaacaugacacu

SEQ ID NO: 1440581 - RNA, 14 nt, Homo sapiens
uggccccaugucuc

SEQ ID NO: 1440582 - RNA, 17 nt, Homo sapiens
uggccccucaccugggc

SEQ ID NO: 1440583 - RNA, 17 nt, Homo sapiens
uggcccgccccucgcug

SEQ ID NO: 1440584 - RNA, 19 nt, Homo sapiens
uggcccuuucuggaccaga

SEQ ID NO: 1440585 - RNA, 14 nt, Homo sapiens
uggccgugaggaca

SEQ ID NO: 1440586 - RNA, 15 nt, Homo sapiens
uggccuccugugcau

SEQ ID NO: 1440587 - RNA, 23 nt, Homo sapiens
uggccugcugggcucuccaccuc

SEQ ID NO: 1440588 - RNA, 16 nt, Homo sapiens
ugugaggcugggucca

SEQ ID NO: 1440589 - RNA, 14 nt, Homo sapiens
ugugauauaugcau

SEQ ID NO: 1440590 - RNA, 19 nt, Homo sapiens
ugugauauuuuuacuugca

SEQ ID NO: 1440591 - RNA, 17 nt, Homo sapiens
ugugauccuucaucgaa

SEQ ID NO: 1440592 - RNA, 18 nt, Homo sapiens
ugugaucuaucaauaguc

SEQ ID NO: 1440593 - RNA, 20 nt, Homo sapiens
ugugaucuaucaauagucaa

SEQ ID NO: 1440594 - RNA, 12 nt, Homo sapiens
ugugcaugaccu

SEQ ID NO: 1440595 - RNA, 22 nt, Homo sapiens
ugugccccauguccaaguccaa

SEQ ID NO: 1440596 - RNA, 16 nt, Homo sapiens
ugugcucuaagugaau

SEQ ID NO: 1440597 - RNA, 23 nt, Homo sapiens
uguggaauauaaagauggcugac

SEQ ID NO: 1440598 - RNA, 24 nt, Homo sapiens
uguggacaggacuaacacucagaa

SEQ ID NO: 1440599 - RNA, 17 nt, Homo sapiens
uguggcaguuacagggc

SEQ ID NO: 1440600 - RNA, 23 nt, Homo sapiens
uguggccuugcccgccagccuca

SEQ ID NO: 1440601 - RNA, 19 nt, Homo sapiens
uguggcuaucugcauuuau

SEQ ID NO: 1440602 - RNA, 17 nt, Homo sapiens
ugugggagccugcaaac

SEQ ID NO: 1440603 - RNA, 20 nt, Homo sapiens
ugugggaguaaaacuuuaau

SEQ ID NO: 1440604 - RNA, 20 nt, Homo sapiens
ugugggguccccaucauccc

SEQ ID NO: 1440605 - RNA, 19 nt, Homo sapiens
uguggguguggcaguuaca

SEQ ID NO: 1440606 - RNA, 15 nt, Homo sapiens
ugugguuuaugucau

SEQ ID NO: 1440607 - RNA, 22 nt, Homo sapiens
uguguaaauggcuggggggcca

SEQ ID NO: 1440608 - RNA, 13 nt, Homo sapiens
uguguacagggaa

SEQ ID NO: 1440609 - RNA, 13 nt, Homo sapiens
uguguauguguau

SEQ ID NO: 1440610 - RNA, 17 nt, Homo sapiens
uguguauuuaacugccu

SEQ ID NO: 1440611 - RNA, 15 nt, Homo sapiens
ugugucaaugccaca

SEQ ID NO: 1440612 - RNA, 20 nt, Homo sapiens
ugugucagaguaacaugcca

SEQ ID NO: 1440613 - RNA, 16 nt, Homo sapiens
uguguccccaccucag

SEQ ID NO: 1440614 - RNA, 22 nt, Homo sapiens
uguguccguggaaccaguccua

SEQ ID NO: 1440615 - RNA, 22 nt, Homo sapiens
ugugugaaauguauuaucacca

SEQ ID NO: 1440616 - RNA, 18 nt, Homo sapiens
ugugugcauguaugugca

SEQ ID NO: 1440617 - RNA, 15 nt, Homo sapiens
uguguggcaguucuc

SEQ ID NO: 1440618 - RNA, 15 nt, Homo sapiens
ugugugucugaagac

SEQ ID NO: 1440619 - RNA, 22 nt, Homo sapiens
ugugugugcauguaugugcaca

SEQ ID NO: 1440620 - RNA, 16 nt, Homo sapiens
uguguucacacuguaa

SEQ ID NO: 1440621 - RNA, 13 nt, Homo sapiens
uguguugggaccu

SEQ ID NO: 1440622 - RNA, 14 nt, Homo sapiens
uguguuuccuucag

SEQ ID NO: 1440623 - RNA, 13 nt, Homo sapiens
uguuaaacacgug

SEQ ID NO: 1440624 - RNA, 18 nt, Homo sapiens
uguuaaagcaucagagau

SEQ ID NO: 1440625 - RNA, 12 nt, Homo sapiens
uguuaagcaauu

SEQ ID NO: 1440626 - RNA, 22 nt, Homo sapiens
uguuaaguaacacucaccauca

SEQ ID NO: 1440627 - RNA, 13 nt, Homo sapiens
uguuaagugcagg

SEQ ID NO: 1440628 - RNA, 19 nt, Homo sapiens
uguuacacagcccaagagg

SEQ ID NO: 1440629 - RNA, 17 nt, Homo sapiens
uguuagauuccucuugc

SEQ ID NO: 1440630 - RNA, 20 nt, Homo sapiens
uguuauccacaagcaaugga

SEQ ID NO: 1440631 - RNA, 16 nt, Homo sapiens
uguuauguuugcacuu

SEQ ID NO: 1440632 - RNA, 18 nt, Homo sapiens
uguuauguuugcacuuug

SEQ ID NO: 1440633 - RNA, 18 nt, Homo sapiens
uguuauuauuuugcacug

SEQ ID NO: 1440634 - RNA, 21 nt, Homo sapiens
uguucacacuguaaacauuca

SEQ ID NO: 1440635 - RNA, 20 nt, Homo sapiens
uguucauuuuagugacugua

SEQ ID NO: 1440636 - RNA, 22 nt, Homo sapiens
uguucccuccagcagugguauu

SEQ ID NO: 1440637 - RNA, 15 nt, Homo sapiens
uguucuaaguauuug

SEQ ID NO: 1440638 - RNA, 13 nt, Homo sapiens
uguucucacuuau

SEQ ID NO: 1440639 - RNA, 19 nt, Homo sapiens
uguucuccggguguggccu

SEQ ID NO: 1440640 - RNA, 13 nt, Homo sapiens
uguucugcacuga

SEQ ID NO: 1440641 - RNA, 15 nt, Homo sapiens
uguucuguggcauag

SEQ ID NO: 1440642 - RNA, 15 nt, Homo sapiens
uguucuuagcugaac

SEQ ID NO: 1440643 - RNA, 18 nt, Homo sapiens
uguugaagccacugccuu

SEQ ID NO: 1440644 - RNA, 16 nt, Homo sapiens
uguugaaucuugcaca

SEQ ID NO: 1440645 - RNA, 18 nt, Homo sapiens
uguugccuggaagcacau

SEQ ID NO: 1440646 - RNA, 19 nt, Homo sapiens
uguuggacccgcucuggac

SEQ ID NO: 1440647 - RNA, 15 nt, Homo sapiens
uguuguaagcacuga

SEQ ID NO: 1440648 - RNA, 17 nt, Homo sapiens
uguuguacauacagagg

SEQ ID NO: 1440649 - RNA, 16 nt, Homo sapiens
uguugucacaccugaa

SEQ ID NO: 1440650 - RNA, 22 nt, Homo sapiens
uguugucauuauguacaauaca

SEQ ID NO: 1440651 - RNA, 22 nt, Homo sapiens
uguuguggguuuuuucacauaa

SEQ ID NO: 1440652 - RNA, 18 nt, Homo sapiens
uguuuaccucuucuaugc

SEQ ID NO: 1440653 - RNA, 15 nt, Homo sapiens
uguuuauacagcuca

SEQ ID NO: 1440654 - RNA, 15 nt, Homo sapiens
uguuucaccauacuu

SEQ ID NO: 1440655 - RNA, 17 nt, Homo sapiens
uguuucagggggccuuu

SEQ ID NO: 1440656 - RNA, 23 nt, Homo sapiens
uguuuccaugggucaaagccggu

SEQ ID NO: 1440657 - RNA, 16 nt, Homo sapiens
uguuucugaaugacau

SEQ ID NO: 1440658 - RNA, 13 nt, Homo sapiens
uguuugcacuuug

SEQ ID NO: 1440659 - RNA, 16 nt, Homo sapiens
uguuuguggaacaaaa

SEQ ID NO: 1440660 - RNA, 22 nt, Homo sapiens
uguuuuagcuccuugacuccuu

SEQ ID NO: 1440661 - RNA, 19 nt, Homo sapiens
uguuuuccuuugucaucau

SEQ ID NO: 1440662 - RNA, 15 nt, Homo sapiens
uguuuugcacugaca

SEQ ID NO: 1440663 - RNA, 15 nt, Homo sapiens
uguuuuuaacaacua

SEQ ID NO: 1440664 - RNA, 14 nt, Homo sapiens
uguuuuuaaguccu

SEQ ID NO: 1440665 - RNA, 17 nt, Homo sapiens
uguuuuugaaaagcuaa

SEQ ID NO: 1440666 - RNA, 13 nt, Homo sapiens
uguuuuuuuccaa

SEQ ID NO: 1440667 - RNA, 19 nt, Homo sapiens
uuaaaaaaaaauacugaug

SEQ ID NO: 1440668 - RNA, 14 nt, Homo sapiens
uuaaaaaagcaaaa

SEQ ID NO: 1440669 - RNA, 20 nt, Homo sapiens
uuaaaacguagaggauuuau

SEQ ID NO: 1440670 - RNA, 12 nt, Homo sapiens
uuaaaagaauuu

SEQ ID NO: 1440671 - RNA, 21 nt, Homo sapiens
uuaaacaaaauagaagcugua

SEQ ID NO: 1440672 - RNA, 24 nt, Homo sapiens
uuaaacauuugagagcuaacuaua

SEQ ID NO: 1440673 - RNA, 13 nt, Homo sapiens
uacaccauaugca

SEQ ID NO: 1440674 - RNA, 18 nt, Homo sapiens
uacacuaauaaaugccaa

SEQ ID NO: 1440675 - RNA, 14 nt, Homo sapiens
ucacaccaccugac

SEQ ID NO: 1440676 - RNA, 15 nt, Homo sapiens
ucacacccuaauaag

SEQ ID NO: 1440677 - RNA, 16 nt, Homo sapiens
ucacacucauaacuca

SEQ ID NO: 1440678 - RNA, 12 nt, Homo sapiens
ucacacuguaaa

SEQ ID NO: 1440679 - RNA, 20 nt, Homo sapiens
ucacagcagugcauaggcca

SEQ ID NO: 1440680 - RNA, 19 nt, Homo sapiens
ucacagugacccuucccaa

SEQ ID NO: 1440681 - RNA, 19 nt, Homo sapiens
ucacauaguuuauuucaac

SEQ ID NO: 1440682 - RNA, 15 nt, Homo sapiens
ucacaugauaccccu

SEQ ID NO: 1440683 - RNA, 16 nt, Homo sapiens
ucacaugauaccccuu

SEQ ID NO: 1440684 - RNA, 11 nt, Homo sapiens
ucaccaaaauu

SEQ ID NO: 1440685 - RNA, 19 nt, Homo sapiens
ucaccaagcucacaguucc

SEQ ID NO: 1440686 - RNA, 18 nt, Homo sapiens
ucaccagcagacacugcc

SEQ ID NO: 1440687 - RNA, 23 nt, Homo sapiens
ucaccaguuucugcggccuucca

SEQ ID NO: 1440688 - RNA, 14 nt, Homo sapiens
ucaccauacuucau

SEQ ID NO: 1440689 - RNA, 14 nt, Homo sapiens
ucacccacaucuaa

SEQ ID NO: 1440690 - RNA, 21 nt, Homo sapiens
ucacccagcuaaucuguaggg

SEQ ID NO: 1440691 - RNA, 14 nt, Homo sapiens
ucacccuucugggc

SEQ ID NO: 1440692 - RNA, 15 nt, Homo sapiens
ucacccuucugggca

SEQ ID NO: 1440693 - RNA, 16 nt, Homo sapiens
ucaccgacaacaugcu

SEQ ID NO: 1440694 - RNA, 22 nt, Homo sapiens
ucaccggagcuuucaaagaagg

SEQ ID NO: 1440695 - RNA, 13 nt, Homo sapiens
ucaccguggaccu

SEQ ID NO: 1440696 - RNA, 20 nt, Homo sapiens
ucaccuccucccagacuuuc

SEQ ID NO: 1440697 - RNA, 14 nt, Homo sapiens
ucaccucucuucag

SEQ ID NO: 1440698 - RNA, 17 nt, Homo sapiens
ucaccuguuacuugaaa

SEQ ID NO: 1440699 - RNA, 16 nt, Homo sapiens
ucaccuucaccuucau

SEQ ID NO: 1440700 - RNA, 12 nt, Homo sapiens
ucaccuugcuca

SEQ ID NO: 1440701 - RNA, 16 nt, Homo sapiens
ucaccuuggagccuga

SEQ ID NO: 1440702 - RNA, 19 nt, Homo sapiens
ucacgaaguuuguucauca

SEQ ID NO: 1440703 - RNA, 20 nt, Homo sapiens
ucacgucgucuucuguauac

SEQ ID NO: 1440704 - RNA, 19 nt, Homo sapiens
ucacuaaaguauaucuuua

SEQ ID NO: 1440705 - RNA, 23 nt, Homo sapiens
ucacuagagcugggaaacaggga

SEQ ID NO: 1440706 - RNA, 23 nt, Homo sapiens
ucacuagccaugauaacugcaau

SEQ ID NO: 1440707 - RNA, 15 nt, Homo sapiens
ucacucacucauucc

SEQ ID NO: 1440708 - RNA, 17 nt, Homo sapiens
ucacucagccacacccc

SEQ ID NO: 1440709 - RNA, 12 nt, Homo sapiens
ucacucugucag

SEQ ID NO: 1440710 - RNA, 17 nt, Homo sapiens
ucacucugucagccagc

SEQ ID NO: 1440711 - RNA, 18 nt, Homo sapiens
ucacucuuccugcaagga

SEQ ID NO: 1440712 - RNA, 19 nt, Homo sapiens
ucacugaguggcuugugau

SEQ ID NO: 1440713 - RNA, 14 nt, Homo sapiens
ucacugcucaagaa

SEQ ID NO: 1440714 - RNA, 18 nt, Homo sapiens
ucacugcuggcugccuua

SEQ ID NO: 1440715 - RNA, 17 nt, Homo sapiens
ucacugucccucaaaug

SEQ ID NO: 1440716 - RNA, 15 nt, Homo sapiens
ucacuucccugggaa

SEQ ID NO: 1440717 - RNA, 21 nt, Homo sapiens
ucacuucccugggaacucauc

SEQ ID NO: 1440718 - RNA, 14 nt, Homo sapiens
ucacuucgaugacu

SEQ ID NO: 1440719 - RNA, 15 nt, Homo sapiens
ucacuugaguguaau

SEQ ID NO: 1440720 - RNA, 14 nt, Homo sapiens
ucacuuuguuaaaa

SEQ ID NO: 1440721 - RNA, 18 nt, Homo sapiens
ucacuuuuuauuuugcca

SEQ ID NO: 1440722 - RNA, 23 nt, Homo sapiens
ucagaaagggagggcucugaggc

SEQ ID NO: 1440723 - RNA, 13 nt, Homo sapiens
ucagaaagucaua

SEQ ID NO: 1440724 - RNA, 15 nt, Homo sapiens
ucagaagacacugca

SEQ ID NO: 1440725 - RNA, 17 nt, Homo sapiens
ucagaauccacucuucu

SEQ ID NO: 1440726 - RNA, 19 nt, Homo sapiens
ucagaauuucuuugucauu

SEQ ID NO: 1440727 - RNA, 22 nt, Homo sapiens
ucagacaauccacucucaggag

SEQ ID NO: 1440728 - RNA, 13 nt, Homo sapiens
ucagacauuccaa

SEQ ID NO: 1440729 - RNA, 16 nt, Homo sapiens
ucagaccaguacuggg

SEQ ID NO: 1440730 - RNA, 18 nt, Homo sapiens
ucagaccaguacugggaa

SEQ ID NO: 1440731 - RNA, 14 nt, Homo sapiens
ucagacugagcucc

SEQ ID NO: 1440732 - RNA, 17 nt, Homo sapiens
ucagagaggcaugugau

SEQ ID NO: 1440733 - RNA, 20 nt, Homo sapiens
ucagauauuuuuucagaaau

SEQ ID NO: 1440734 - RNA, 16 nt, Homo sapiens
ucagaucugaacacag

SEQ ID NO: 1440735 - RNA, 20 nt, Homo sapiens
ucagaucugaacacaguuua

SEQ ID NO: 1440736 - RNA, 21 nt, Homo sapiens
ucagaugauucagaaauuuuc

SEQ ID NO: 1440737 - RNA, 20 nt, Homo sapiens
ucagauuugcuguucaccca

SEQ ID NO: 1440738 - RNA, 17 nt, Homo sapiens
ucagcaaggugugaaug

SEQ ID NO: 1440739 - RNA, 23 nt, Homo sapiens
ucagcacugaaaauaccaucagg

SEQ ID NO: 1440740 - RNA, 22 nt, Homo sapiens
ucagcacugccggcccagugac

SEQ ID NO: 1440741 - RNA, 14 nt, Homo sapiens
ucagcacuguuuca

SEQ ID NO: 1440742 - RNA, 12 nt, Homo sapiens
ucagcauaccuu

SEQ ID NO: 1440743 - RNA, 22 nt, Homo sapiens
ucagccaucccgucuucuccaa

SEQ ID NO: 1440744 - RNA, 17 nt, Homo sapiens
ucagcucuccugcugca

SEQ ID NO: 1440745 - RNA, 15 nt, Homo sapiens
ucagcuguaccaagc

SEQ ID NO: 1440746 - RNA, 20 nt, Homo sapiens
ucaggaaaucaaauaugcaa

SEQ ID NO: 1440747 - RNA, 17 nt, Homo sapiens
ucaggagaucgagacca

SEQ ID NO: 1440748 - RNA, 18 nt, Homo sapiens
ucaggagaucgagaccau

SEQ ID NO: 1440749 - RNA, 17 nt, Homo sapiens
ucaggaguuggagacca

SEQ ID NO: 1440750 - RNA, 21 nt, Homo sapiens
gcuaucugcauuuauaaaugu

SEQ ID NO: 1440751 - RNA, 14 nt, Homo sapiens
gcuauuacugucug

SEQ ID NO: 1440752 - RNA, 20 nt, Homo sapiens
gcuauugaacugagccaaac

SEQ ID NO: 1440753 - RNA, 21 nt, Homo sapiens
gcucaagucacuuuuauuuga

SEQ ID NO: 1440754 - RNA, 19 nt, Homo sapiens
gcucacaguacaauguuuc

SEQ ID NO: 1440755 - RNA, 12 nt, Homo sapiens
gcucacuguucu

SEQ ID NO: 1440756 - RNA, 10 nt, Homo sapiens
gcucagagau

SEQ ID NO: 1440757 - RNA, 19 nt, Homo sapiens
gcucagcccugacuggugc

SEQ ID NO: 1440758 - RNA, 21 nt, Homo sapiens
gcucagcccugacuggugcua

SEQ ID NO: 1440759 - RNA, 14 nt, Homo sapiens
gcucaguagccuuu

SEQ ID NO: 1440760 - RNA, 17 nt, Homo sapiens
gcuccagaauaugcaua

SEQ ID NO: 1440761 - RNA, 17 nt, Homo sapiens
gcuccagaucugcacug

SEQ ID NO: 1440762 - RNA, 16 nt, Homo sapiens
gcuccaucuccagugg

SEQ ID NO: 1440763 - RNA, 17 nt, Homo sapiens
gcuccuaguuugaccuc

SEQ ID NO: 1440764 - RNA, 15 nt, Homo sapiens
gcucucaccgggcua

SEQ ID NO: 1440765 - RNA, 16 nt, Homo sapiens
gcucugcccacuguga

SEQ ID NO: 1440766 - RNA, 23 nt, Homo sapiens
gcucugcccacugugaaaccacu

SEQ ID NO: 1440767 - RNA, 15 nt, Homo sapiens
gcucugccuccugcc

SEQ ID NO: 1440768 - RNA, 18 nt, Homo sapiens
gcucuggaaaaugugacc

SEQ ID NO: 1440769 - RNA, 20 nt, Homo sapiens
gcucuggaccaacccuguuu

SEQ ID NO: 1440770 - RNA, 13 nt, Homo sapiens
gcucuucaaagac

SEQ ID NO: 1440771 - RNA, 21 nt, Homo sapiens
gcucuucuaaccucagccaaa

SEQ ID NO: 1440772 - RNA, 16 nt, Homo sapiens
gcucuuggaagagcuc

SEQ ID NO: 1440773 - RNA, 14 nt, Homo sapiens
gcucuuuagcauug

SEQ ID NO: 1440774 - RNA, 13 nt, Homo sapiens
gcucuuucagaga

SEQ ID NO: 1440775 - RNA, 20 nt, Homo sapiens
gcugaagacaaaccacugua

SEQ ID NO: 1440776 - RNA, 18 nt, Homo sapiens
gcugaauagcuucuccaa

SEQ ID NO: 1440777 - RNA, 12 nt, Homo sapiens
gcugacaucucc

SEQ ID NO: 1440778 - RNA, 18 nt, Homo sapiens
gcugacuguacuccuccc

SEQ ID NO: 1440779 - RNA, 21 nt, Homo sapiens
gcugagagaguuaagugaaug

SEQ ID NO: 1440780 - RNA, 16 nt, Homo sapiens
gcugagcugaacccau

SEQ ID NO: 1440781 - RNA, 21 nt, Homo sapiens
gcugaggcaggaggaucgccu

SEQ ID NO: 1440782 - RNA, 17 nt, Homo sapiens
gcugaggugcccaggag

SEQ ID NO: 1440783 - RNA, 16 nt, Homo sapiens
gcugagucaccuccuc

SEQ ID NO: 1440784 - RNA, 19 nt, Homo sapiens
gcugauucaagaaacagaa

SEQ ID NO: 1440785 - RNA, 19 nt, Homo sapiens
gcugauuuugucacugucu

SEQ ID NO: 1440786 - RNA, 13 nt, Homo sapiens
gcugcacauuccu

SEQ ID NO: 1440787 - RNA, 14 nt, Homo sapiens
gcugcagaaggcca

SEQ ID NO: 1440788 - RNA, 16 nt, Homo sapiens
gcugcauuugugucau

SEQ ID NO: 1440789 - RNA, 18 nt, Homo sapiens
gcugcccaaucauuugca

SEQ ID NO: 1440790 - RNA, 22 nt, Homo sapiens
gcugcgucuccuccgcacaccu

SEQ ID NO: 1440791 - RNA, 14 nt, Homo sapiens
gcugcucuggaaaa

SEQ ID NO: 1440792 - RNA, 19 nt, Homo sapiens
gcugcugagaaucuagccu

SEQ ID NO: 1440793 - RNA, 20 nt, Homo sapiens
gcugcugagaaucuagccuc

SEQ ID NO: 1440794 - RNA, 12 nt, Homo sapiens
gcuggaagcaca

SEQ ID NO: 1440795 - RNA, 16 nt, Homo sapiens
gcuggacugaggacca

SEQ ID NO: 1440796 - RNA, 20 nt, Homo sapiens
gcuggaguggaguggcacga

SEQ ID NO: 1440797 - RNA, 16 nt, Homo sapiens
gcuggcaagcagggaa

SEQ ID NO: 1440798 - RNA, 13 nt, Homo sapiens
gcuggcacugagc

SEQ ID NO: 1440799 - RNA, 20 nt, Homo sapiens
gcuggcgccagggccugccg

SEQ ID NO: 1440800 - RNA, 20 nt, Homo sapiens
gcugggaaaaaaguuuugau

SEQ ID NO: 1440801 - RNA, 20 nt, Homo sapiens
gcugggaacauguaccacug

SEQ ID NO: 1440802 - RNA, 19 nt, Homo sapiens
gcugggcuuguagaccacu

SEQ ID NO: 1440803 - RNA, 13 nt, Homo sapiens
gcuggguguugca

SEQ ID NO: 1440804 - RNA, 21 nt, Homo sapiens
gcuggugucugagcuucagua

SEQ ID NO: 1440805 - RNA, 16 nt, Homo sapiens
gcuguaccaagccccu

SEQ ID NO: 1440806 - RNA, 17 nt, Homo sapiens
gcuguauacuguacuga

SEQ ID NO: 1440807 - RNA, 16 nt, Homo sapiens
gcugucaacauucaaa

SEQ ID NO: 1440808 - RNA, 16 nt, Homo sapiens
gcugucagcucaggug

SEQ ID NO: 1440809 - RNA, 12 nt, Homo sapiens
gcugucugcuca

SEQ ID NO: 1440810 - RNA, 19 nt, Homo sapiens
gcugugaggccccuggaca

SEQ ID NO: 1440811 - RNA, 11 nt, Homo sapiens
gcugugcugag

SEQ ID NO: 1440812 - RNA, 16 nt, Homo sapiens
gcuguggggcauagaa

SEQ ID NO: 1440813 - RNA, 15 nt, Homo sapiens
gcuguggugagggaa

SEQ ID NO: 1440814 - RNA, 19 nt, Homo sapiens
gcuguguuugagcuuucau

SEQ ID NO: 1440815 - RNA, 16 nt, Homo sapiens
uaacuccagugaagua

SEQ ID NO: 1440816 - RNA, 19 nt, Homo sapiens
gaaacaugacacugaccuu

SEQ ID NO: 1440817 - RNA, 16 nt, Homo sapiens
gaaacauuaugccuua

SEQ ID NO: 1440818 - RNA, 11 nt, Homo sapiens
gaaacauuuac

SEQ ID NO: 1440819 - RNA, 14 nt, Homo sapiens
gaaaccacucugaa

SEQ ID NO: 1440820 - RNA, 23 nt, Homo sapiens
gaaaccagaaggauauuuacuac

SEQ ID NO: 1440821 - RNA, 20 nt, Homo sapiens
gaaaccaguuaagaauggaa

SEQ ID NO: 1440822 - RNA, 17 nt, Homo sapiens
gaaaccuugcagcauuu

SEQ ID NO: 1440823 - RNA, 18 nt, Homo sapiens
gaaacuguaccauacaca

SEQ ID NO: 1440824 - RNA, 14 nt, Homo sapiens
gaaagaaaugccca

SEQ ID NO: 1440825 - RNA, 15 nt, Homo sapiens
gaaagagaguaccau

SEQ ID NO: 1440826 - RNA, 14 nt, Homo sapiens
gaaagaggcaguga

SEQ ID NO: 1440827 - RNA, 15 nt, Homo sapiens
gaaagaggcagugau

SEQ ID NO: 1440828 - RNA, 19 nt, Homo sapiens
gaaagcauuacauuuccaa

SEQ ID NO: 1440829 - RNA, 13 nt, Homo sapiens
gaaagccuuccau

SEQ ID NO: 1440830 - RNA, 18 nt, Homo sapiens
gaaaggagccggaccaag

SEQ ID NO: 1440831 - RNA, 17 nt, Homo sapiens
gaaaguauaaagucacu

SEQ ID NO: 1440832 - RNA, 15 nt, Homo sapiens
gaaaguaugugauau

SEQ ID NO: 1440833 - RNA, 14 nt, Homo sapiens
gaaagugacuacca

SEQ ID NO: 1440834 - RNA, 21 nt, Homo sapiens
gaaagugcaaagugcccucau

SEQ ID NO: 1440835 - RNA, 23 nt, Homo sapiens
gaaaguggccaugccacccuguu

SEQ ID NO: 1440836 - RNA, 15 nt, Homo sapiens
gaaauaaaaauaccu

SEQ ID NO: 1440837 - RNA, 13 nt, Homo sapiens
gaaauaaaccugg

SEQ ID NO: 1440838 - RNA, 23 nt, Homo sapiens
gaaauaauuguugauuaauuuga

SEQ ID NO: 1440839 - RNA, 22 nt, Homo sapiens
gaaauaccagugaaccaaagag

SEQ ID NO: 1440840 - RNA, 19 nt, Homo sapiens
gaaauauuuuacaguuuuu

SEQ ID NO: 1440841 - RNA, 15 nt, Homo sapiens
gaaaucaaagcgcca

SEQ ID NO: 1440842 - RNA, 15 nt, Homo sapiens
gaaaucauuguagaa

SEQ ID NO: 1440843 - RNA, 21 nt, Homo sapiens
gaaaucuuaaaaaccugccuc

SEQ ID NO: 1440844 - RNA, 18 nt, Homo sapiens
gaaaugagaaacuuugau

SEQ ID NO: 1440845 - RNA, 13 nt, Homo sapiens
gaaaugagcgaaa

SEQ ID NO: 1440846 - RNA, 23 nt, Homo sapiens
gaaaugcccaucuaugucccuug

SEQ ID NO: 1440847 - RNA, 21 nt, Homo sapiens
gaaaugggcuuuaacaaaaca

SEQ ID NO: 1440848 - RNA, 14 nt, Homo sapiens
gaaauuauuauuca

SEQ ID NO: 1440849 - RNA, 15 nt, Homo sapiens
gaaauugaaccuggu

SEQ ID NO: 1440850 - RNA, 19 nt, Homo sapiens
gaaauugcauuuccugaca

SEQ ID NO: 1440851 - RNA, 18 nt, Homo sapiens
gaaauuucccacacccca

SEQ ID NO: 1440852 - RNA, 14 nt, Homo sapiens
gaacaaugcuauaa

SEQ ID NO: 1440853 - RNA, 24 nt, Homo sapiens
gaacacagcaguucugcagaggac

SEQ ID NO: 1440854 - RNA, 14 nt, Homo sapiens
gaacacaucagcuu

SEQ ID NO: 1440855 - RNA, 14 nt, Homo sapiens
gaacacguggguau

SEQ ID NO: 1440856 - RNA, 14 nt, Homo sapiens
gaacacugucaucc

SEQ ID NO: 1440857 - RNA, 16 nt, Homo sapiens
gaacaguaacugccau

SEQ ID NO: 1440858 - RNA, 18 nt, Homo sapiens
gaacaguuuuuaagcuau

SEQ ID NO: 1440859 - RNA, 19 nt, Homo sapiens
gaacaguuuuuaagcuaua

SEQ ID NO: 1440860 - RNA, 12 nt, Homo sapiens
gaacaugacauu

SEQ ID NO: 1440861 - RNA, 17 nt, Homo sapiens
gaacauugucuggauac

SEQ ID NO: 1440862 - RNA, 18 nt, Homo sapiens
gaaccaaggcagccucca

SEQ ID NO: 1440863 - RNA, 21 nt, Homo sapiens
gaacccugcuugcacuuugua

SEQ ID NO: 1440864 - RNA, 17 nt, Homo sapiens
gaacccuuccugagacc

SEQ ID NO: 1440865 - RNA, 15 nt, Homo sapiens
gaaccucacugaaaa

SEQ ID NO: 1440866 - RNA, 11 nt, Homo sapiens
gaaccucaguu

SEQ ID NO: 1440867 - RNA, 16 nt, Homo sapiens
gaacuagaaccuggag

SEQ ID NO: 1440868 - RNA, 16 nt, Homo sapiens
gaacuaugaacuacaa

SEQ ID NO: 1440869 - RNA, 15 nt, Homo sapiens
gaacugcauaucgga

SEQ ID NO: 1440870 - RNA, 17 nt, Homo sapiens
gaacugcgugccagugu

SEQ ID NO: 1440871 - RNA, 15 nt, Homo sapiens
gaacuggacugugug

SEQ ID NO: 1440872 - RNA, 23 nt, Homo sapiens
gaacuggugcuuuaguaaugugg

SEQ ID NO: 1440873 - RNA, 22 nt, Homo sapiens
gaacugguucaagagacacugc

SEQ ID NO: 1440874 - RNA, 17 nt, Homo sapiens
gaacuuguucacagguu

SEQ ID NO: 1440875 - RNA, 18 nt, Homo sapiens
gaagaaaccccaagcagc

SEQ ID NO: 1440876 - RNA, 21 nt, Homo sapiens
gaagaaauccauaacaccccc

SEQ ID NO: 1440877 - RNA, 19 nt, Homo sapiens
gaagaacaguaacugccau

SEQ ID NO: 1440878 - RNA, 20 nt, Homo sapiens
gaagaacaucccaagccaga

SEQ ID NO: 1440879 - RNA, 13 nt, Homo sapiens
gaagaagccagac

SEQ ID NO: 1440880 - RNA, 14 nt, Homo sapiens
gaagaagcugagga

SEQ ID NO: 1440881 - RNA, 19 nt, Homo sapiens
gaagaaguuuaaaaaacca

SEQ ID NO: 1440882 - RNA, 20 nt, Homo sapiens
gaagaaguuuaaaaaaccau

SEQ ID NO: 1440883 - RNA, 19 nt, Homo sapiens
gaagaauauucaggacuua

SEQ ID NO: 1440884 - RNA, 16 nt, Homo sapiens
gaagacccacgugcua

SEQ ID NO: 1440885 - RNA, 19 nt, Homo sapiens
gaagacccacgugcuaggg

SEQ ID NO: 1440886 - RNA, 23 nt, Homo sapiens
gaagaccuccacauuaaguggcu

SEQ ID NO: 1440887 - RNA, 18 nt, Homo sapiens
gaagacuugaagcacaga

SEQ ID NO: 1440888 - RNA, 22 nt, Homo sapiens
gaagagagagagagagguucug

SEQ ID NO: 1440889 - RNA, 18 nt, Homo sapiens
gaagagcagcuggucaac

SEQ ID NO: 1440890 - RNA, 13 nt, Homo sapiens
gaagagcauugca

SEQ ID NO: 1440891 - RNA, 15 nt, Homo sapiens
gaagaguuaaaacag

SEQ ID NO: 1440892 - RNA, 14 nt, Homo sapiens
gaagauguugucau

SEQ ID NO: 1440893 - RNA, 12 nt, Homo sapiens
gaagcaaccucc

SEQ ID NO: 1440894 - RNA, 20 nt, Homo sapiens
gaagcagccuccuaauuuga

SEQ ID NO: 1440895 - RNA, 16 nt, Homo sapiens
gaagcaucaccaugca

SEQ ID NO: 1440896 - RNA, 18 nt, Homo sapiens
gaagcauuugauuuucaa

SEQ ID NO: 1440897 - RNA, 14 nt, Homo sapiens
gaagccacaggagc

SEQ ID NO: 1440898 - RNA, 13 nt, Homo sapiens
gaagccauauuca

SEQ ID NO: 1440899 - RNA, 19 nt, Homo sapiens
gaagccauauucacaccuc

SEQ ID NO: 1440900 - RNA, 15 nt, Homo sapiens
gaagccccaagccau

SEQ ID NO: 1440901 - RNA, 19 nt, Homo sapiens
gccauguacuauaauguga

SEQ ID NO: 1440902 - RNA, 17 nt, Homo sapiens
gccauguuuagauucca

SEQ ID NO: 1440903 - RNA, 23 nt, Homo sapiens
gccauuauuucaaccgcuugcca

SEQ ID NO: 1440904 - RNA, 17 nt, Homo sapiens
gccauucccacuaagcu

SEQ ID NO: 1440905 - RNA, 11 nt, Homo sapiens
gccauucugau

SEQ ID NO: 1440906 - RNA, 16 nt, Homo sapiens
gcccaagaggacugag

SEQ ID NO: 1440907 - RNA, 16 nt, Homo sapiens
gcccaaucauuugcaa

SEQ ID NO: 1440908 - RNA, 18 nt, Homo sapiens
gcccaaucauuugcaaug

SEQ ID NO: 1440909 - RNA, 14 nt, Homo sapiens
gcccacaauggagu

SEQ ID NO: 1440910 - RNA, 12 nt, Homo sapiens
gcccacagccaa

SEQ ID NO: 1440911 - RNA, 13 nt, Homo sapiens
gcccacaucccag

SEQ ID NO: 1440912 - RNA, 16 nt, Homo sapiens
gcccaccugcacguga

SEQ ID NO: 1440913 - RNA, 19 nt, Homo sapiens
gcccagaauucccagcugu

SEQ ID NO: 1440914 - RNA, 21 nt, Homo sapiens
gcccagccuccaagcuccauc

SEQ ID NO: 1440915 - RNA, 16 nt, Homo sapiens
gcccagcuacauuccu

SEQ ID NO: 1440916 - RNA, 16 nt, Homo sapiens
gcccaggcucugggaa

SEQ ID NO: 1440917 - RNA, 18 nt, Homo sapiens
gcccaucucaggugccac

SEQ ID NO: 1440918 - RNA, 17 nt, Homo sapiens
gccccaaaccagggugc

SEQ ID NO: 1440919 - RNA, 20 nt, Homo sapiens
gccccaacuccuuccagcua

SEQ ID NO: 1440920 - RNA, 18 nt, Homo sapiens
gccccagaaggcagggaa

SEQ ID NO: 1440921 - RNA, 19 nt, Homo sapiens
gccccaugaccuccagcuu

SEQ ID NO: 1440922 - RNA, 21 nt, Homo sapiens
gccccccccuugaaucugcag

SEQ ID NO: 1440923 - RNA, 21 nt, Homo sapiens
gccccccuccuugcucugcag

SEQ ID NO: 1440924 - RNA, 20 nt, Homo sapiens
gcccccucaucucacugccc

SEQ ID NO: 1440925 - RNA, 15 nt, Homo sapiens
uucgcugccaggaca

SEQ ID NO: 1440926 - RNA, 15 nt, Homo sapiens
uucgugacaacaugc

SEQ ID NO: 1440927 - RNA, 17 nt, Homo sapiens
uucuaaaugaagugcaa

SEQ ID NO: 1440928 - RNA, 14 nt, Homo sapiens
uucuaacuguaaau

SEQ ID NO: 1440929 - RNA, 20 nt, Homo sapiens
uucuaaguggggugcauccc

SEQ ID NO: 1440930 - RNA, 21 nt, Homo sapiens
uucuaauauuuuuagcucugu

SEQ ID NO: 1440931 - RNA, 13 nt, Homo sapiens
uucuacacaguaa

SEQ ID NO: 1440932 - RNA, 12 nt, Homo sapiens
uucuacagccuc

SEQ ID NO: 1440933 - RNA, 21 nt, Homo sapiens
uucuaggcaguucaaagcagg

SEQ ID NO: 1440934 - RNA, 21 nt, Homo sapiens
uucuaucccacccaacagcuc

SEQ ID NO: 1440935 - RNA, 17 nt, Homo sapiens
uucuaugcaaaugccuc

SEQ ID NO: 1440936 - RNA, 20 nt, Homo sapiens
uucuauggccauuacuaaca

SEQ ID NO: 1440937 - RNA, 22 nt, Homo sapiens
uucuaugguugacauuguauau

SEQ ID NO: 1440938 - RNA, 12 nt, Homo sapiens
uucuauuccuau

SEQ ID NO: 1440939 - RNA, 18 nt, Homo sapiens
uucucaucauauuguaug

SEQ ID NO: 1440940 - RNA, 21 nt, Homo sapiens
uucucaucauauuguauguaa

SEQ ID NO: 1440941 - RNA, 23 nt, Homo sapiens
uucuccaccaacuggagcacuga

SEQ ID NO: 1440942 - RNA, 19 nt, Homo sapiens
uucucccucacuccugcca

SEQ ID NO: 1440943 - RNA, 12 nt, Homo sapiens
uucucccugugu

SEQ ID NO: 1440944 - RNA, 19 nt, Homo sapiens
uucuccuccagguauuuga

SEQ ID NO: 1440945 - RNA, 19 nt, Homo sapiens
uucuccugacuccagugag

SEQ ID NO: 1440946 - RNA, 16 nt, Homo sapiens
uucuccugugacccca

SEQ ID NO: 1440947 - RNA, 16 nt, Homo sapiens
uucuccuuuugaccaa

SEQ ID NO: 1440948 - RNA, 17 nt, Homo sapiens
uucucuggguagguguu

SEQ ID NO: 1440949 - RNA, 23 nt, Homo sapiens
uucugacaagauaaaggaaguca

SEQ ID NO: 1440950 - RNA, 17 nt, Homo sapiens
uucugagaaagacuauu

SEQ ID NO: 1440951 - RNA, 16 nt, Homo sapiens
uucugauuucagaaau

SEQ ID NO: 1440952 - RNA, 19 nt, Homo sapiens
uucugcuccucuccaggca

SEQ ID NO: 1440953 - RNA, 15 nt, Homo sapiens
uucuguaaccaaaaa

SEQ ID NO: 1440954 - RNA, 12 nt, Homo sapiens
uucugucuguag

SEQ ID NO: 1440955 - RNA, 12 nt, Homo sapiens
uucuguggcuca

SEQ ID NO: 1440956 - RNA, 22 nt, Homo sapiens
uucugugggcuuggccuugugu

SEQ ID NO: 1440957 - RNA, 15 nt, Homo sapiens
uucuguuauugcacu

SEQ ID NO: 1440958 - RNA, 15 nt, Homo sapiens
uucuguucaucuuaa

SEQ ID NO: 1440959 - RNA, 14 nt, Homo sapiens
uucuguugauccca

SEQ ID NO: 1440960 - RNA, 13 nt, Homo sapiens
uucuguuuccaua

SEQ ID NO: 1440961 - RNA, 12 nt, Homo sapiens
uucuguuuccca

SEQ ID NO: 1440962 - RNA, 22 nt, Homo sapiens
uucuguuucuauucucuccuca

SEQ ID NO: 1440963 - RNA, 22 nt, Homo sapiens
uucuuaaaaguugugauuccag

SEQ ID NO: 1440964 - RNA, 21 nt, Homo sapiens
uucuuaaaauguuaacuggca

SEQ ID NO: 1440965 - RNA, 18 nt, Homo sapiens
uucuuaaucuccacuguu

SEQ ID NO: 1440966 - RNA, 21 nt, Homo sapiens
uucuucuaaugagucgacuuu

SEQ ID NO: 1440967 - RNA, 23 nt, Homo sapiens
uucuucuaaugagucgacuuuga

SEQ ID NO: 1440968 - RNA, 13 nt, Homo sapiens
uucuucuauucca

SEQ ID NO: 1440969 - RNA, 13 nt, Homo sapiens
uucuucugccuca

SEQ ID NO: 1440970 - RNA, 13 nt, Homo sapiens
uucuucugggaac

SEQ ID NO: 1440971 - RNA, 22 nt, Homo sapiens
uucuucuucagaagacacugca

SEQ ID NO: 1440972 - RNA, 13 nt, Homo sapiens
uucuugcagauca

SEQ ID NO: 1440973 - RNA, 20 nt, Homo sapiens
uucuuguauauuauggaaga

SEQ ID NO: 1440974 - RNA, 23 nt, Homo sapiens
uucuuuacuaaagauaucagagc

SEQ ID NO: 1440975 - RNA, 14 nt, Homo sapiens
uucuuucaaagugu

SEQ ID NO: 1440976 - RNA, 22 nt, Homo sapiens
uucuuugaaggauuuacugcaa

SEQ ID NO: 1440977 - RNA, 22 nt, Homo sapiens
uucuuuucagcagagucuagua

SEQ ID NO: 1440978 - RNA, 17 nt, Homo sapiens
uucuuuuucacacugau

SEQ ID NO: 1440979 - RNA, 13 nt, Homo sapiens
uugaaaccaaaga

SEQ ID NO: 1440980 - RNA, 21 nt, Homo sapiens
uugaaagugaauaaacuucag

SEQ ID NO: 1440981 - RNA, 21 nt, Homo sapiens
uugaaccuugguaaauuguaa

SEQ ID NO: 1440982 - RNA, 18 nt, Homo sapiens
uugaacugguucaugaaa

SEQ ID NO: 1440983 - RNA, 22 nt, Homo sapiens
uugaacuucauaagguaauuca

SEQ ID NO: 1440984 - RNA, 14 nt, Homo sapiens
uugaagaaaagcac

SEQ ID NO: 1440985 - RNA, 20 nt, Homo sapiens
uugaagaaaggaacugaggc

SEQ ID NO: 1440986 - RNA, 18 nt, Homo sapiens
uugaauaaagccugcuuu

SEQ ID NO: 1440987 - RNA, 18 nt, Homo sapiens
uugaaugcggaaccauag

SEQ ID NO: 1440988 - RNA, 17 nt, Homo sapiens
uugacaacaucccacag

SEQ ID NO: 1440989 - RNA, 20 nt, Homo sapiens
uugacacggugaaauccagg

SEQ ID NO: 1440990 - RNA, 11 nt, Homo sapiens
uugacauuccu

SEQ ID NO: 1440991 - RNA, 12 nt, Homo sapiens
uugaccaaauaa

SEQ ID NO: 1440992 - RNA, 19 nt, Homo sapiens
uugaccaaauaaaguacca

SEQ ID NO: 1440993 - RNA, 18 nt, Homo sapiens
uugaccggcagaauguuc

SEQ ID NO: 1440994 - RNA, 21 nt, Homo sapiens
uugacucuuguuuucaguuuc

SEQ ID NO: 1440995 - RNA, 18 nt, Homo sapiens
uugagaaagaaugagcau

SEQ ID NO: 1440996 - RNA, 14 nt, Homo sapiens
uugagaaccugugc

SEQ ID NO: 1440997 - RNA, 22 nt, Homo sapiens
gccaugauaacugcaauuuuaa

SEQ ID NO: 1440998 - RNA, 21 nt, Homo sapiens
gccaugaucgagccacugcac

SEQ ID NO: 1440999 - RNA, 18 nt, Homo sapiens
gccaugauggugcugacc

SEQ ID NO: 1441000 - RNA, 17 nt, Homo sapiens
gccaugccucaagaaca

SEQ ID NO: 1441001 - RNA, 14 nt, Homo sapiens
gccauucacuuccc

SEQ ID NO: 1441002 - RNA, 20 nt, Homo sapiens
gccauucagucuagcuuuua

SEQ ID NO: 1441003 - RNA, 13 nt, Homo sapiens
gccauuuguacug

SEQ ID NO: 1441004 - RNA, 14 nt, Homo sapiens
gcccaagaauagau

SEQ ID NO: 1441005 - RNA, 18 nt, Homo sapiens
gcccaagaggacugagac

SEQ ID NO: 1441006 - RNA, 13 nt, Homo sapiens
gcccaagugccau

SEQ ID NO: 1441007 - RNA, 20 nt, Homo sapiens
gcccacccacuccuuauauu

SEQ ID NO: 1441008 - RNA, 23 nt, Homo sapiens
gcccacccacuccuuauauugcu

SEQ ID NO: 1441009 - RNA, 20 nt, Homo sapiens
gcccagaaagaggcagugau

SEQ ID NO: 1441010 - RNA, 20 nt, Homo sapiens
gcccagccaacugccccggg

SEQ ID NO: 1441011 - RNA, 12 nt, Homo sapiens
gcccagcuacau

SEQ ID NO: 1441012 - RNA, 20 nt, Homo sapiens
gcccaggcuggagugcagua

SEQ ID NO: 1441013 - RNA, 17 nt, Homo sapiens
gcccaggcuggucuuga

SEQ ID NO: 1441014 - RNA, 13 nt, Homo sapiens
gcccagggagcaa

SEQ ID NO: 1441015 - RNA, 14 nt, Homo sapiens
gccccagaucugcc

SEQ ID NO: 1441016 - RNA, 15 nt, Homo sapiens
gcccccacccagucc

SEQ ID NO: 1441017 - RNA, 21 nt, Homo sapiens
gcccccagcagauggaaagaa

SEQ ID NO: 1441018 - RNA, 13 nt, Homo sapiens
gccccccccaugu

SEQ ID NO: 1441019 - RNA, 13 nt, Homo sapiens
gcccgggacaggg

SEQ ID NO: 1441020 - RNA, 22 nt, Homo sapiens
gcccgggacagggucuugcaag

SEQ ID NO: 1441021 - RNA, 23 nt, Homo sapiens
gcccuccuuaauagccauaugca

SEQ ID NO: 1441022 - RNA, 11 nt, Homo sapiens
gcccugaccuc

SEQ ID NO: 1441023 - RNA, 16 nt, Homo sapiens
gcccugcaccugugca

SEQ ID NO: 1441024 - RNA, 17 nt, Homo sapiens
gcccugcaccugugcag

SEQ ID NO: 1441025 - RNA, 20 nt, Homo sapiens
gcccuggcugaccccaaaga

SEQ ID NO: 1441026 - RNA, 18 nt, Homo sapiens
gcccuggggccuguacug

SEQ ID NO: 1441027 - RNA, 17 nt, Homo sapiens
gcccugguguguuucca

SEQ ID NO: 1441028 - RNA, 15 nt, Homo sapiens
gcccuucccacugga

SEQ ID NO: 1441029 - RNA, 18 nt, Homo sapiens
gcccuuccucuccacugc

SEQ ID NO: 1441030 - RNA, 21 nt, Homo sapiens
gcccuugcccugaccucccag

SEQ ID NO: 1441031 - RNA, 14 nt, Homo sapiens
gcccuuguccugcc

SEQ ID NO: 1441032 - RNA, 21 nt, Homo sapiens
gccgagauugcgccacugcag

SEQ ID NO: 1441033 - RNA, 23 nt, Homo sapiens
gccgcaaaucaaccccagacuca

SEQ ID NO: 1441034 - RNA, 14 nt, Homo sapiens
gccgcauggcacuc

SEQ ID NO: 1441035 - RNA, 23 nt, Homo sapiens
gccggcaaccccaguucugcucc

SEQ ID NO: 1441036 - RNA, 13 nt, Homo sapiens
gccggcucugccu

SEQ ID NO: 1441037 - RNA, 14 nt, Homo sapiens
gccgggcgcagugg

SEQ ID NO: 1441038 - RNA, 22 nt, Homo sapiens
gccgugcucgcccacaaacuga

SEQ ID NO: 1441039 - RNA, 18 nt, Homo sapiens
gccguuccgucccaaaca

SEQ ID NO: 1441040 - RNA, 17 nt, Homo sapiens
gccuaauucuuguuguu

SEQ ID NO: 1441041 - RNA, 21 nt, Homo sapiens
gccuaggaguugaguacagug

SEQ ID NO: 1441042 - RNA, 14 nt, Homo sapiens
gccuaggguccugu

SEQ ID NO: 1441043 - RNA, 18 nt, Homo sapiens
gccuaugauaaauucaca

SEQ ID NO: 1441044 - RNA, 12 nt, Homo sapiens
gccucaguucua

SEQ ID NO: 1441045 - RNA, 15 nt, Homo sapiens
gccucaucuccuuua

SEQ ID NO: 1441046 - RNA, 18 nt, Homo sapiens
gccuccaccgcugccuaa

SEQ ID NO: 1441047 - RNA, 20 nt, Homo sapiens
gccuccauucugaccauuuc

SEQ ID NO: 1441048 - RNA, 14 nt, Homo sapiens
gaaucuacagaaca

SEQ ID NO: 1441049 - RNA, 14 nt, Homo sapiens
gaaucuuacuccuu

SEQ ID NO: 1441050 - RNA, 21 nt, Homo sapiens
gaaugaccacgggccucaguu

SEQ ID NO: 1441051 - RNA, 17 nt, Homo sapiens
gaaugaggcaauuucaa

SEQ ID NO: 1441052 - RNA, 12 nt, Homo sapiens
gaaugauggacu

SEQ ID NO: 1441053 - RNA, 20 nt, Homo sapiens
gaaugauucccucuugcuau

SEQ ID NO: 1441054 - RNA, 14 nt, Homo sapiens
gaaugccacaguga

SEQ ID NO: 1441055 - RNA, 18 nt, Homo sapiens
gaaugccugucaguuuca

SEQ ID NO: 1441056 - RNA, 14 nt, Homo sapiens
gaauggaaccaaaa

SEQ ID NO: 1441057 - RNA, 18 nt, Homo sapiens
gaauggaaggcuuugcca

SEQ ID NO: 1441058 - RNA, 14 nt, Homo sapiens
gaaugucaguucau

SEQ ID NO: 1441059 - RNA, 18 nt, Homo sapiens
gaaugucuuacugugauc

SEQ ID NO: 1441060 - RNA, 23 nt, Homo sapiens
gaauguucccugcacccuggaaa

SEQ ID NO: 1441061 - RNA, 17 nt, Homo sapiens
gaauuaaacaacaaaca

SEQ ID NO: 1441062 - RNA, 17 nt, Homo sapiens
gaauuaaaucacggaug

SEQ ID NO: 1441063 - RNA, 20 nt, Homo sapiens
gaauuaucaugggaaaagac

SEQ ID NO: 1441064 - RNA, 12 nt, Homo sapiens
gaauucauguga

SEQ ID NO: 1441065 - RNA, 20 nt, Homo sapiens
gaauuccugacccacaggaa

SEQ ID NO: 1441066 - RNA, 23 nt, Homo sapiens
gaauuggccucaguguaguuaaa

SEQ ID NO: 1441067 - RNA, 23 nt, Homo sapiens
gaauuguuuccuuauuugcacuu

SEQ ID NO: 1441068 - RNA, 13 nt, Homo sapiens
gaauuuuguugcu

SEQ ID NO: 1441069 - RNA, 18 nt, Homo sapiens
gaauuuuguuuguugaug

SEQ ID NO: 1441070 - RNA, 14 nt, Homo sapiens
gacaaaccagagca

SEQ ID NO: 1441071 - RNA, 19 nt, Homo sapiens
gacaaaguugaauguaaag

SEQ ID NO: 1441072 - RNA, 16 nt, Homo sapiens
gacaaauaauaagcaa

SEQ ID NO: 1441073 - RNA, 13 nt, Homo sapiens
gacaacagacuga

SEQ ID NO: 1441074 - RNA, 15 nt, Homo sapiens
gacaagauaaaggaa

SEQ ID NO: 1441075 - RNA, 19 nt, Homo sapiens
gacaagcaagggcugugcu

SEQ ID NO: 1441076 - RNA, 22 nt, Homo sapiens
gacaagccaacuuguaaauaca

SEQ ID NO: 1441077 - RNA, 23 nt, Homo sapiens
gacaauaugauuuuaaauuugaa

SEQ ID NO: 1441078 - RNA, 11 nt, Homo sapiens
gacacacugua

SEQ ID NO: 1441079 - RNA, 12 nt, Homo sapiens
gacacacuguaa

SEQ ID NO: 1441080 - RNA, 16 nt, Homo sapiens
gacacagagggggccu

SEQ ID NO: 1441081 - RNA, 12 nt, Homo sapiens
gacaccaccauc

SEQ ID NO: 1441082 - RNA, 13 nt, Homo sapiens
gacaccaccaucu

SEQ ID NO: 1441083 - RNA, 18 nt, Homo sapiens
gacaccgucccucaguga

SEQ ID NO: 1441084 - RNA, 16 nt, Homo sapiens
gacaccugccuuaaca

SEQ ID NO: 1441085 - RNA, 22 nt, Homo sapiens
gacacuucuaaaugaagugcaa

SEQ ID NO: 1441086 - RNA, 20 nt, Homo sapiens
gacacuugccuucuucaccc

SEQ ID NO: 1441087 - RNA, 23 nt, Homo sapiens
gacagacauuuucaauaauguga

SEQ ID NO: 1441088 - RNA, 23 nt, Homo sapiens
gacagcagucuucuucacccgcu

SEQ ID NO: 1441089 - RNA, 21 nt, Homo sapiens
gaaaugggagaagagagacag

SEQ ID NO: 1441090 - RNA, 18 nt, Homo sapiens
gaaauuuaggaagcgaaa

SEQ ID NO: 1441091 - RNA, 22 nt, Homo sapiens
gaacaacuaggcuucagcauau

SEQ ID NO: 1441092 - RNA, 16 nt, Homo sapiens
gaacaauucucucuua

SEQ ID NO: 1441093 - RNA, 20 nt, Homo sapiens
gaacacacauggaugcacac

SEQ ID NO: 1441094 - RNA, 13 nt, Homo sapiens
gaacacagugccu

SEQ ID NO: 1441095 - RNA, 14 nt, Homo sapiens
gaacacagugccug

SEQ ID NO: 1441096 - RNA, 21 nt, Homo sapiens
gaacacaguuuagugcuuuac

SEQ ID NO: 1441097 - RNA, 17 nt, Homo sapiens
gaacaucccaagccaga

SEQ ID NO: 1441098 - RNA, 13 nt, Homo sapiens
gaacauguaccac

SEQ ID NO: 1441099 - RNA, 15 nt, Homo sapiens
gaacauucgaggugu

SEQ ID NO: 1441100 - RNA, 21 nt, Homo sapiens
gaaccaaggcagccuccagag

SEQ ID NO: 1441101 - RNA, 12 nt, Homo sapiens
gaaccaauaaug

SEQ ID NO: 1441102 - RNA, 17 nt, Homo sapiens
gaaccaaucccgugaaa

SEQ ID NO: 1441103 - RNA, 15 nt, Homo sapiens
gaaccauuacuguaa

SEQ ID NO: 1441104 - RNA, 16 nt, Homo sapiens
gaaccauuacuguaau

SEQ ID NO: 1441105 - RNA, 22 nt, Homo sapiens
gaaccccuggccucaagcaauc

SEQ ID NO: 1441106 - RNA, 16 nt, Homo sapiens
gaacccuuccugagac

SEQ ID NO: 1441107 - RNA, 22 nt, Homo sapiens
gaacccuuggagccaauggaga

SEQ ID NO: 1441108 - RNA, 21 nt, Homo sapiens
gaaccuuuaaaguaaaggccu

SEQ ID NO: 1441109 - RNA, 21 nt, Homo sapiens
gaacgagcacuggccagagag

SEQ ID NO: 1441110 - RNA, 13 nt, Homo sapiens
gaacgcucuuagc

SEQ ID NO: 1441111 - RNA, 21 nt, Homo sapiens
gaacucaucccuguuccucaa

SEQ ID NO: 1441112 - RNA, 19 nt, Homo sapiens
gaacuccaguacucaccca

SEQ ID NO: 1441113 - RNA, 18 nt, Homo sapiens
gaacugcgugccaguguc

SEQ ID NO: 1441114 - RNA, 13 nt, Homo sapiens
gaagaacaguaac

SEQ ID NO: 1441115 - RNA, 16 nt, Homo sapiens
gaagaaggaaacaccg

SEQ ID NO: 1441116 - RNA, 19 nt, Homo sapiens
gaagaaggaagaagccaga

SEQ ID NO: 1441117 - RNA, 12 nt, Homo sapiens
gaagaccaaaaa

SEQ ID NO: 1441118 - RNA, 20 nt, Homo sapiens
gaagaccaaagcauugccug

SEQ ID NO: 1441119 - RNA, 14 nt, Homo sapiens
gaagacccagugua

SEQ ID NO: 1441120 - RNA, 15 nt, Homo sapiens
gaagacccaguguaa

SEQ ID NO: 1441121 - RNA, 17 nt, Homo sapiens
gaagacccaguguaaag

SEQ ID NO: 1441122 - RNA, 21 nt, Homo sapiens
gaagacccaguguaaagaaua

SEQ ID NO: 1441123 - RNA, 23 nt, Homo sapiens
gaagacccaguguaaagaauaaa

SEQ ID NO: 1441124 - RNA, 21 nt, Homo sapiens
gaagacgccuuucuccuccaa

SEQ ID NO: 1441125 - RNA, 14 nt, Homo sapiens
gaagagaccaagac

SEQ ID NO: 1441126 - RNA, 18 nt, Homo sapiens
gaagagauuucaacauau

SEQ ID NO: 1441127 - RNA, 20 nt, Homo sapiens
gaagauaacuugagcaccgu

SEQ ID NO: 1441128 - RNA, 17 nt, Homo sapiens
gaagaucuaauaccauc

SEQ ID NO: 1441129 - RNA, 18 nt, Homo sapiens
gaagcaucaaagcacugu

SEQ ID NO: 1441130 - RNA, 16 nt, Homo sapiens
gaagccaacuuggcuu

SEQ ID NO: 1441131 - RNA, 13 nt, Homo sapiens
cuggcuccagaau

SEQ ID NO: 1441132 - RNA, 22 nt, Homo sapiens
cugggaacugguucaagagaca

SEQ ID NO: 1441133 - RNA, 12 nt, Homo sapiens
cugggaagacaa

SEQ ID NO: 1441134 - RNA, 19 nt, Homo sapiens
cugggaggucuccacugag

SEQ ID NO: 1441135 - RNA, 22 nt, Homo sapiens
cugggagugauaugauguguag

SEQ ID NO: 1441136 - RNA, 16 nt, Homo sapiens
cugggauaugacaagc

SEQ ID NO: 1441137 - RNA, 14 nt, Homo sapiens
cugggauguagaac

SEQ ID NO: 1441138 - RNA, 15 nt, Homo sapiens
cugggauguuuugag

SEQ ID NO: 1441139 - RNA, 21 nt, Homo sapiens
cugggauguuuugagggucuu

SEQ ID NO: 1441140 - RNA, 22 nt, Homo sapiens
cugggauuacaggcaugagcca

SEQ ID NO: 1441141 - RNA, 21 nt, Homo sapiens
cugggcaacagaugaagaccc

SEQ ID NO: 1441142 - RNA, 22 nt, Homo sapiens
cugggcaagggggaacaaauca

SEQ ID NO: 1441143 - RNA, 21 nt, Homo sapiens
cugggcagcugauuuugucac

SEQ ID NO: 1441144 - RNA, 19 nt, Homo sapiens
cugggcuuguuguuuuuaa

SEQ ID NO: 1441145 - RNA, 19 nt, Homo sapiens
cuggggucuguguggugcc

SEQ ID NO: 1441146 - RNA, 22 nt, Homo sapiens
cuggguccgccuuaaucuggaa

SEQ ID NO: 1441147 - RNA, 19 nt, Homo sapiens
cugggugguguacaagcau

SEQ ID NO: 1441148 - RNA, 21 nt, Homo sapiens
cugggugguguacaagcauuu

SEQ ID NO: 1441149 - RNA, 14 nt, Homo sapiens
cuggguucuagaac

SEQ ID NO: 1441150 - RNA, 23 nt, Homo sapiens
cuggguuuugucucugcaucuca

SEQ ID NO: 1441151 - RNA, 20 nt, Homo sapiens
cugguaauuuaagauuccag

SEQ ID NO: 1441152 - RNA, 19 nt, Homo sapiens
cugguaauuuguaucugaa

SEQ ID NO: 1441153 - RNA, 14 nt, Homo sapiens
cugguacaauccuu

SEQ ID NO: 1441154 - RNA, 17 nt, Homo sapiens
cuggucagguauuucag

SEQ ID NO: 1441155 - RNA, 20 nt, Homo sapiens
cugguggcaccagaugcaac

SEQ ID NO: 1441156 - RNA, 15 nt, Homo sapiens
cugguuagaaaugca

SEQ ID NO: 1441157 - RNA, 15 nt, Homo sapiens
cugguuuaaccuccu

SEQ ID NO: 1441158 - RNA, 12 nt, Homo sapiens
cugguuuuaaca

SEQ ID NO: 1441159 - RNA, 21 nt, Homo sapiens
cugguuuugacaucagcauua

SEQ ID NO: 1441160 - RNA, 18 nt, Homo sapiens
cuguaacucagacauucc

SEQ ID NO: 1441161 - RNA, 14 nt, Homo sapiens
cuguaagauugucc

SEQ ID NO: 1441162 - RNA, 13 nt, Homo sapiens
cuguaagcauucu

SEQ ID NO: 1441163 - RNA, 21 nt, Homo sapiens
cuguaaucccagcacuuuggg

SEQ ID NO: 1441164 - RNA, 16 nt, Homo sapiens
cuguaauuaagugcaa

SEQ ID NO: 1441165 - RNA, 17 nt, Homo sapiens
cuguacugagacauuac

SEQ ID NO: 1441166 - RNA, 16 nt, Homo sapiens
cuguagaaauguaucc

SEQ ID NO: 1441167 - RNA, 19 nt, Homo sapiens
cuguagaacaccccugugc

SEQ ID NO: 1441168 - RNA, 22 nt, Homo sapiens
cuguagaaugauuucaugcuau

SEQ ID NO: 1441169 - RNA, 20 nt, Homo sapiens
cuguagauaaagugguuuga

SEQ ID NO: 1441170 - RNA, 17 nt, Homo sapiens
cuguauauaauacuaaa

SEQ ID NO: 1441171 - RNA, 16 nt, Homo sapiens
cuguauauacaauaac

SEQ ID NO: 1441172 - RNA, 15 nt, Homo sapiens
cuucccaggaucccu

SEQ ID NO: 1441173 - RNA, 17 nt, Homo sapiens
cuuccccagacucagcu

SEQ ID NO: 1441174 - RNA, 15 nt, Homo sapiens
cuuccccagguccuu

SEQ ID NO: 1441175 - RNA, 19 nt, Homo sapiens
cuuccccuugcccuugccc

SEQ ID NO: 1441176 - RNA, 13 nt, Homo sapiens
cuucccugaucaa

SEQ ID NO: 1441177 - RNA, 22 nt, Homo sapiens
cuucccuucucuccuucccucu

SEQ ID NO: 1441178 - RNA, 20 nt, Homo sapiens
cuucccuuguauccagugau

SEQ ID NO: 1441179 - RNA, 21 nt, Homo sapiens
cuuccggaagaaaaagagcca

SEQ ID NO: 1441180 - RNA, 14 nt, Homo sapiens
cuuccggcucccuu

SEQ ID NO: 1441181 - RNA, 13 nt, Homo sapiens
cuuccuaccaaau

SEQ ID NO: 1441182 - RNA, 22 nt, Homo sapiens
cuuccucucaagcuagccagag

SEQ ID NO: 1441183 - RNA, 16 nt, Homo sapiens
cuuccugccaccaguc

SEQ ID NO: 1441184 - RNA, 17 nt, Homo sapiens
cuuccuggcuucuuacu

SEQ ID NO: 1441185 - RNA, 17 nt, Homo sapiens
cuuccugucaacacuuc

SEQ ID NO: 1441186 - RNA, 22 nt, Homo sapiens
cuucgcugccaggacaccugcc

SEQ ID NO: 1441187 - RNA, 12 nt, Homo sapiens
cuucgguuugua

SEQ ID NO: 1441188 - RNA, 20 nt, Homo sapiens
cuucuaaaugaagugcaaau

SEQ ID NO: 1441189 - RNA, 11 nt, Homo sapiens
cuucuacagcc

SEQ ID NO: 1441190 - RNA, 22 nt, Homo sapiens
cuucuauuccauggcuaacugg

SEQ ID NO: 1441191 - RNA, 21 nt, Homo sapiens
cuucuccaacaccaccucucc

SEQ ID NO: 1441192 - RNA, 17 nt, Homo sapiens
cuucucccaucuagugg

SEQ ID NO: 1441193 - RNA, 13 nt, Homo sapiens
cuucucccugugu

SEQ ID NO: 1441194 - RNA, 18 nt, Homo sapiens
cuucucuacagacuucuc

SEQ ID NO: 1441195 - RNA, 15 nt, Homo sapiens
cuucucuuucucuga

SEQ ID NO: 1441196 - RNA, 14 nt, Homo sapiens
cuucugacaagcaa

SEQ ID NO: 1441197 - RNA, 19 nt, Homo sapiens
cuucugacuuuuagaaaca

SEQ ID NO: 1441198 - RNA, 17 nt, Homo sapiens
cuucugcuguauacugu

SEQ ID NO: 1441199 - RNA, 22 nt, Homo sapiens
cuucugcuguauacuguacuga

SEQ ID NO: 1441200 - RNA, 19 nt, Homo sapiens
cuucuggagucuccagugg

SEQ ID NO: 1441201 - RNA, 20 nt, Homo sapiens
cuucuggagucuccaguggu

SEQ ID NO: 1441202 - RNA, 16 nt, Homo sapiens
cuucugggaagacaac

SEQ ID NO: 1441203 - RNA, 22 nt, Homo sapiens
cuucuguucucaaaugcuaaau

SEQ ID NO: 1441204 - RNA, 13 nt, Homo sapiens
cuucuguuuccau

SEQ ID NO: 1441205 - RNA, 13 nt, Homo sapiens
cuugaaaccaaag

SEQ ID NO: 1441206 - RNA, 16 nt, Homo sapiens
cuugaaacugagaugu

SEQ ID NO: 1441207 - RNA, 22 nt, Homo sapiens
cuugaaauaccagugaaccaaa

SEQ ID NO: 1441208 - RNA, 23 nt, Homo sapiens
cuugaaauaccagugaaccaaag

SEQ ID NO: 1441209 - RNA, 14 nt, Homo sapiens
cuugaaaugcauua

SEQ ID NO: 1441210 - RNA, 16 nt, Homo sapiens
cuugacuaucacauac

SEQ ID NO: 1441211 - RNA, 22 nt, Homo sapiens
cuugacucaacgagagcacuug

SEQ ID NO: 1441212 - RNA, 21 nt, Homo sapiens
cuugagagaaaaagugccccu

SEQ ID NO: 1441213 - RNA, 21 nt, Homo sapiens
cuugagguggugccuucucac

SEQ ID NO: 1441214 - RNA, 14 nt, Homo sapiens
cuugaguagaucug

SEQ ID NO: 1441215 - RNA, 14 nt, Homo sapiens
cuugagucugaggc

SEQ ID NO: 1441216 - RNA, 16 nt, Homo sapiens
ccaucuccauuucaca

SEQ ID NO: 1441217 - RNA, 16 nt, Homo sapiens
ccaucucugauuuuca

SEQ ID NO: 1441218 - RNA, 12 nt, Homo sapiens
ccaucuguagag

SEQ ID NO: 1441219 - RNA, 15 nt, Homo sapiens
ccaugaaucaaagac

SEQ ID NO: 1441220 - RNA, 17 nt, Homo sapiens
ccaugaggacaaagugu

SEQ ID NO: 1441221 - RNA, 17 nt, Homo sapiens
ccaugcauggugcauca

SEQ ID NO: 1441222 - RNA, 23 nt, Homo sapiens
ccaugccccccguggcuggcacc

SEQ ID NO: 1441223 - RNA, 15 nt, Homo sapiens
ccaugccucaagaac

SEQ ID NO: 1441224 - RNA, 20 nt, Homo sapiens
ccauguggaguggacauuca

SEQ ID NO: 1441225 - RNA, 21 nt, Homo sapiens
ccauguggaguggacauucaa

SEQ ID NO: 1441226 - RNA, 23 nt, Homo sapiens
ccauguggcugaagacauuccaa

SEQ ID NO: 1441227 - RNA, 17 nt, Homo sapiens
ccauguggguguggcag

SEQ ID NO: 1441228 - RNA, 15 nt, Homo sapiens
ccaugugugacucca

SEQ ID NO: 1441229 - RNA, 13 nt, Homo sapiens
ccauuaccugacu

SEQ ID NO: 1441230 - RNA, 13 nt, Homo sapiens
ccauuacuguaau

SEQ ID NO: 1441231 - RNA, 21 nt, Homo sapiens
ccauuacuuuaauacucaccu

SEQ ID NO: 1441232 - RNA, 18 nt, Homo sapiens
ccauuaggcaugccuaau

SEQ ID NO: 1441233 - RNA, 17 nt, Homo sapiens
ccauucacagccaggag

SEQ ID NO: 1441234 - RNA, 16 nt, Homo sapiens
ccauucccccaugugg

SEQ ID NO: 1441235 - RNA, 15 nt, Homo sapiens
ccauucccguggucu

SEQ ID NO: 1441236 - RNA, 19 nt, Homo sapiens
ccauugaccucagcugcac

SEQ ID NO: 1441237 - RNA, 16 nt, Homo sapiens
ccauugcccugugagg

SEQ ID NO: 1441238 - RNA, 22 nt, Homo sapiens
ccauugucgucuuuauguccgc

SEQ ID NO: 1441239 - RNA, 22 nt, Homo sapiens
cccaaaaccuuuccccagacac

SEQ ID NO: 1441240 - RNA, 20 nt, Homo sapiens
cccaaagcucagacuugcca

SEQ ID NO: 1441241 - RNA, 16 nt, Homo sapiens
cccaacgcacaggaaa

SEQ ID NO: 1441242 - RNA, 18 nt, Homo sapiens
cccaacuccuuccagcua

SEQ ID NO: 1441243 - RNA, 22 nt, Homo sapiens
cccaagaggacugagacuggca

SEQ ID NO: 1441244 - RNA, 11 nt, Homo sapiens
cccaagccaga

SEQ ID NO: 1441245 - RNA, 12 nt, Homo sapiens
cccaagccaugg

SEQ ID NO: 1441246 - RNA, 15 nt, Homo sapiens
cccaagccaugguga

SEQ ID NO: 1441247 - RNA, 23 nt, Homo sapiens
cccaaguguugaggggaccaaag

SEQ ID NO: 1441248 - RNA, 17 nt, Homo sapiens
cccaauaaaagugacuc

SEQ ID NO: 1441249 - RNA, 20 nt, Homo sapiens
cccaaugcacauccauuccc

SEQ ID NO: 1441250 - RNA, 12 nt, Homo sapiens
cccacagcacua

SEQ ID NO: 1441251 - RNA, 11 nt, Homo sapiens
cccaccaucua

SEQ ID NO: 1441252 - RNA, 23 nt, Homo sapiens
cccacuaagcuuucuccuuugag

SEQ ID NO: 1441253 - RNA, 18 nt, Homo sapiens
cccacuggaucuucagaa

SEQ ID NO: 1441254 - RNA, 15 nt, Homo sapiens
cccacuggcauuaaa

SEQ ID NO: 1441255 - RNA, 14 nt, Homo sapiens
cccacuguccagca

SEQ ID NO: 1441256 - RNA, 18 nt, Homo sapiens
cccacuuucaccaguuuc

SEQ ID NO: 1441257 - RNA, 20 nt, Homo sapiens
cccacuuucaccaguuucug

SEQ ID NO: 1441258 - RNA, 10 nt, Homo sapiens
cccagaacac

SEQ ID NO: 1441259 - RNA, 18 nt, Homo sapiens
cccagagcaaaauaauuu

SEQ ID NO: 1441260 - RNA, 23 nt, Homo sapiens
cccagaggccaggaaucugccau

SEQ ID NO: 1441261 - RNA, 16 nt, Homo sapiens
cccagcaacacaagcu

SEQ ID NO: 1441262 - RNA, 15 nt, Homo sapiens
cccagcagacuugag

SEQ ID NO: 1441263 - RNA, 15 nt, Homo sapiens
cccagcagggccuca

SEQ ID NO: 1441264 - RNA, 15 nt, Homo sapiens
cccagcauguacaaa

SEQ ID NO: 1441265 - RNA, 22 nt, Homo sapiens
auuuuugaaacccauuaggcau

SEQ ID NO: 1441266 - RNA, 22 nt, Homo sapiens
caaaaagaauuccaaccgacca

SEQ ID NO: 1441267 - RNA, 20 nt, Homo sapiens
caaaaauaaacuaguuucca

SEQ ID NO: 1441268 - RNA, 20 nt, Homo sapiens
caaaaauauaaccauuacau

SEQ ID NO: 1441269 - RNA, 17 nt, Homo sapiens
caaaacaaaaaaaaacu

SEQ ID NO: 1441270 - RNA, 18 nt, Homo sapiens
caaaacagagaugugaua

SEQ ID NO: 1441271 - RNA, 22 nt, Homo sapiens
caaaacucuccuacacuuccau

SEQ ID NO: 1441272 - RNA, 17 nt, Homo sapiens
caaaacugcacugucaa

SEQ ID NO: 1441273 - RNA, 23 nt, Homo sapiens
caaaacuuccuguuuguggaaca

SEQ ID NO: 1441274 - RNA, 12 nt, Homo sapiens
caaaagaagauu

SEQ ID NO: 1441275 - RNA, 14 nt, Homo sapiens
caaaagaugccauu

SEQ ID NO: 1441276 - RNA, 20 nt, Homo sapiens
caaaagcuuauucaucuguu

SEQ ID NO: 1441277 - RNA, 20 nt, Homo sapiens
caaaagguuucauguagauu

SEQ ID NO: 1441278 - RNA, 23 nt, Homo sapiens
caaaagucaccacuccauuccca

SEQ ID NO: 1441279 - RNA, 14 nt, Homo sapiens
caaaauauucugua

SEQ ID NO: 1441280 - RNA, 21 nt, Homo sapiens
caaaauguuuucuucaucugu

SEQ ID NO: 1441281 - RNA, 20 nt, Homo sapiens
caaaauucuaaaaauuugca

SEQ ID NO: 1441282 - RNA, 23 nt, Homo sapiens
caaacaccuccuagcaagaccug

SEQ ID NO: 1441283 - RNA, 15 nt, Homo sapiens
caaacaugaagugug

SEQ ID NO: 1441284 - RNA, 22 nt, Homo sapiens
caaacggaguacagacgucuca

SEQ ID NO: 1441285 - RNA, 18 nt, Homo sapiens
caaacuacagaauaaugu

SEQ ID NO: 1441286 - RNA, 15 nt, Homo sapiens
caaacuacauguaau

SEQ ID NO: 1441287 - RNA, 18 nt, Homo sapiens
caaacucacugcucaaga

SEQ ID NO: 1441288 - RNA, 20 nt, Homo sapiens
caaacugccuauauugauaa

SEQ ID NO: 1441289 - RNA, 21 nt, Homo sapiens
caaacuggggccucccugguc

SEQ ID NO: 1441290 - RNA, 16 nt, Homo sapiens
caaagaaaagccagag

SEQ ID NO: 1441291 - RNA, 20 nt, Homo sapiens
caaagaacugccccaucucc

SEQ ID NO: 1441292 - RNA, 23 nt, Homo sapiens
caaagacagagaagaccaaagca

SEQ ID NO: 1441293 - RNA, 12 nt, Homo sapiens
caaagacaugga

SEQ ID NO: 1441294 - RNA, 20 nt, Homo sapiens
caaagcgagaucccaucucu

SEQ ID NO: 1441295 - RNA, 15 nt, Homo sapiens
caaaggaaaccaaag

SEQ ID NO: 1441296 - RNA, 16 nt, Homo sapiens
caaaggaaaccaaagg

SEQ ID NO: 1441297 - RNA, 21 nt, Homo sapiens
caaaggcucccuguguucuca

SEQ ID NO: 1441298 - RNA, 18 nt, Homo sapiens
caaauaaugaacagcaga

SEQ ID NO: 1441299 - RNA, 15 nt, Homo sapiens
caaauaucucagagg

SEQ ID NO: 1441300 - RNA, 15 nt, Homo sapiens
caaaucaaccccaga

SEQ ID NO: 1441301 - RNA, 17 nt, Homo sapiens
caaauccucuaauugca

SEQ ID NO: 1441302 - RNA, 16 nt, Homo sapiens
caaaucuuaacuugaa

SEQ ID NO: 1441303 - RNA, 16 nt, Homo sapiens
caaaucuucaaggugu

SEQ ID NO: 1441304 - RNA, 14 nt, Homo sapiens
caaaugaacacgug

SEQ ID NO: 1441305 - RNA, 17 nt, Homo sapiens
caaaugacaugcacuga

SEQ ID NO: 1441306 - RNA, 18 nt, Homo sapiens
caaaugacaugcacugac

SEQ ID NO: 1441307 - RNA, 20 nt, Homo sapiens
caaaugacaugcacugaccc

SEQ ID NO: 1441308 - RNA, 16 nt, Homo sapiens
caaaugaggauaucau

SEQ ID NO: 1441309 - RNA, 17 nt, Homo sapiens
caaaugaggauaucauc

SEQ ID NO: 1441310 - RNA, 18 nt, Homo sapiens
caaaugaugccacuuccc

SEQ ID NO: 1441311 - RNA, 16 nt, Homo sapiens
caaaugcuaaaugcaa

SEQ ID NO: 1441312 - RNA, 11 nt, Homo sapiens
caaauucccug

SEQ ID NO: 1441313 - RNA, 17 nt, Homo sapiens
caaauucuuuuucacac

SEQ ID NO: 1441314 - RNA, 16 nt, Homo sapiens
caaauuguaacuacac

SEQ ID NO: 1441315 - RNA, 22 nt, Homo sapiens
caacaaaaucaauuuuuugcua

SEQ ID NO: 1441316 - RNA, 13 nt, Homo sapiens
caacaaaccaaaa

SEQ ID NO: 1441317 - RNA, 17 nt, Homo sapiens
ccgagagagauggaaua

SEQ ID NO: 1441318 - RNA, 16 nt, Homo sapiens
ccgagugagguguaca

SEQ ID NO: 1441319 - RNA, 21 nt, Homo sapiens
ccgauaucaaaaagacugugg

SEQ ID NO: 1441320 - RNA, 11 nt, Homo sapiens
ccgaugcacac

SEQ ID NO: 1441321 - RNA, 22 nt, Homo sapiens
ccgccuguccugccucucugcu

SEQ ID NO: 1441322 - RNA, 22 nt, Homo sapiens
ccgccuuccuccuccacagugc

SEQ ID NO: 1441323 - RNA, 16 nt, Homo sapiens
ccgcgugugacagucu

SEQ ID NO: 1441324 - RNA, 18 nt, Homo sapiens
ccggaagaaaaagagcca

SEQ ID NO: 1441325 - RNA, 19 nt, Homo sapiens
ccggaagaaaaagagccau

SEQ ID NO: 1441326 - RNA, 17 nt, Homo sapiens
ccggagagacagugaca

SEQ ID NO: 1441327 - RNA, 18 nt, Homo sapiens
ccgggcacugguggguga

SEQ ID NO: 1441328 - RNA, 15 nt, Homo sapiens
ccggggcagcccugc

SEQ ID NO: 1441329 - RNA, 11 nt, Homo sapiens
ccgugccuuca

SEQ ID NO: 1441330 - RNA, 15 nt, Homo sapiens
ccuaaaauacaaaca

SEQ ID NO: 1441331 - RNA, 17 nt, Homo sapiens
ccuaaacuguacaugug

SEQ ID NO: 1441332 - RNA, 20 nt, Homo sapiens
ccuaaagaggaaaagugcaa

SEQ ID NO: 1441333 - RNA, 15 nt, Homo sapiens
ccuaagaaaccccag

SEQ ID NO: 1441334 - RNA, 17 nt, Homo sapiens
ccuaagagagcaccugg

SEQ ID NO: 1441335 - RNA, 20 nt, Homo sapiens
ccuaagagagcaccugguga

SEQ ID NO: 1441336 - RNA, 16 nt, Homo sapiens
ccuaagaggcagugag

SEQ ID NO: 1441337 - RNA, 16 nt, Homo sapiens
ccuaagucacuuugag

SEQ ID NO: 1441338 - RNA, 23 nt, Homo sapiens
ccuaauaaguccacaucuucuca

SEQ ID NO: 1441339 - RNA, 16 nt, Homo sapiens
ccuaaucucauaccuc

SEQ ID NO: 1441340 - RNA, 15 nt, Homo sapiens
ccuacaaaauggagg

SEQ ID NO: 1441341 - RNA, 16 nt, Homo sapiens
ccuacaguggcuguca

SEQ ID NO: 1441342 - RNA, 14 nt, Homo sapiens
ccuacucagacugu

SEQ ID NO: 1441343 - RNA, 19 nt, Homo sapiens
ccuacucuauguaugcauc

SEQ ID NO: 1441344 - RNA, 18 nt, Homo sapiens
ccuacugccucuccagca

SEQ ID NO: 1441345 - RNA, 19 nt, Homo sapiens
ccuacuuccugcacugacc

SEQ ID NO: 1441346 - RNA, 20 nt, Homo sapiens
ccuacuuuauguauggagcu

SEQ ID NO: 1441347 - RNA, 23 nt, Homo sapiens
ccuacuuuauguauggagcucua

SEQ ID NO: 1441348 - RNA, 23 nt, Homo sapiens
ccuagaagggcuagaaccuggag

SEQ ID NO: 1441349 - RNA, 16 nt, Homo sapiens
ccuagaccugggccaa

SEQ ID NO: 1441350 - RNA, 16 nt, Homo sapiens
ccuagauucuacauau

SEQ ID NO: 1441351 - RNA, 22 nt, Homo sapiens
ccuagcaucucaugagugccaa

SEQ ID NO: 1441352 - RNA, 19 nt, Homo sapiens
ccuagccucgcucuuggca

SEQ ID NO: 1441353 - RNA, 14 nt, Homo sapiens
ccuaggauuccucc

SEQ ID NO: 1441354 - RNA, 18 nt, Homo sapiens
ccuaggccaaaugcacaa

SEQ ID NO: 1441355 - RNA, 19 nt, Homo sapiens
ccuagggguccacgggaag

SEQ ID NO: 1441356 - RNA, 23 nt, Homo sapiens
ccuauacauuucuguucaucuua

SEQ ID NO: 1441357 - RNA, 13 nt, Homo sapiens
ccuauauguagcu

SEQ ID NO: 1441358 - RNA, 17 nt, Homo sapiens
ccuauauguagcuuuau

SEQ ID NO: 1441359 - RNA, 22 nt, Homo sapiens
ccuaucauuuauuuacaucuau

SEQ ID NO: 1441360 - RNA, 22 nt, Homo sapiens
ccuauguccuaaggacacacua

SEQ ID NO: 1441361 - RNA, 19 nt, Homo sapiens
ccuauuacuguuucuggag

SEQ ID NO: 1441362 - RNA, 15 nt, Homo sapiens
ccuauuuauucauuc

SEQ ID NO: 1441363 - RNA, 18 nt, Homo sapiens
ccuauuuucuuuuccauu

SEQ ID NO: 1441364 - RNA, 18 nt, Homo sapiens
ccucaaaugacccaaaga

SEQ ID NO: 1441365 - RNA, 22 nt, Homo sapiens
ccucaaaugacccaaagaccaa

SEQ ID NO: 1441366 - RNA, 13 nt, Homo sapiens
ccucaaaugucag

SEQ ID NO: 1441367 - RNA, 20 nt, Homo sapiens
ccucacccccagcuuugcua

SEQ ID NO: 1441368 - RNA, 21 nt, Homo sapiens
ccucacccccagguguugcca

SEQ ID NO: 1441369 - RNA, 19 nt, Homo sapiens
ccucacgcucuggacauga

SEQ ID NO: 1441370 - RNA, 13 nt, Homo sapiens
ccucacuauucaa

SEQ ID NO: 1441371 - RNA, 20 nt, Homo sapiens
ccucagacaauccacucuca

SEQ ID NO: 1441372 - RNA, 15 nt, Homo sapiens
ccucagggacagaga

SEQ ID NO: 1441373 - RNA, 22 nt, Homo sapiens
ccucagggaucuugcauuccca

SEQ ID NO: 1441374 - RNA, 17 nt, Homo sapiens
ccucauuuaucccucaa

SEQ ID NO: 1441375 - RNA, 20 nt, Homo sapiens
ccuccaagcuccaucuccac

SEQ ID NO: 1441376 - RNA, 23 nt, Homo sapiens
ccuccagcacucccucccagaga

SEQ ID NO: 1441377 - RNA, 15 nt, Homo sapiens
ccuccauucugacca

SEQ ID NO: 1441378 - RNA, 22 nt, Homo sapiens
ccucccaggaacugggccaacu

SEQ ID NO: 1441379 - RNA, 22 nt, Homo sapiens
ccucccuauuaaccuagagauu

SEQ ID NO: 1441380 - RNA, 16 nt, Homo sapiens
ccucccucacaugaua

SEQ ID NO: 1441381 - RNA, 12 nt, Homo sapiens
ccucccuggcau

SEQ ID NO: 1441382 - RNA, 13 nt, Homo sapiens
ccucccugggguc

SEQ ID NO: 1441383 - RNA, 20 nt, Homo sapiens
ccucccugugugaaauguau

SEQ ID NO: 1441384 - RNA, 16 nt, Homo sapiens
ccucccuuucugggag

SEQ ID NO: 1441385 - RNA, 16 nt, Homo sapiens
ccuccguguagugucu

SEQ ID NO: 1441386 - RNA, 19 nt, Homo sapiens
ccuccuaaccuagagauug

SEQ ID NO: 1441387 - RNA, 19 nt, Homo sapiens
ccuccucccagacuuucua

SEQ ID NO: 1441388 - RNA, 19 nt, Homo sapiens
ccuccugccuccagcacuc

SEQ ID NO: 1441389 - RNA, 22 nt, Homo sapiens
ccuccugucuuagccucccaaa

SEQ ID NO: 1441390 - RNA, 18 nt, Homo sapiens
ccuccuuccccugugguc

SEQ ID NO: 1441391 - RNA, 14 nt, Homo sapiens
ccucggagcugcca

SEQ ID NO: 1441392 - RNA, 17 nt, Homo sapiens
ccucgguacucccauaa

SEQ ID NO: 1441393 - RNA, 13 nt, Homo sapiens
ccucuaagccacu

SEQ ID NO: 1441394 - RNA, 15 nt, Homo sapiens
ccucuccaauuguaa

SEQ ID NO: 1441395 - RNA, 14 nt, Homo sapiens
ccucugaaaugccu

SEQ ID NO: 1441396 - RNA, 20 nt, Homo sapiens
ccucugagaauuccaaggag

SEQ ID NO: 1441397 - RNA, 21 nt, Homo sapiens
ccucuggcuggcuaacuggaa

SEQ ID NO: 1441398 - RNA, 15 nt, Homo sapiens
ccucugggagccuga

SEQ ID NO: 1441399 - RNA, 22 nt, Homo sapiens
ccucugucaaugaaaaaaagua

SEQ ID NO: 1441400 - RNA, 17 nt, Homo sapiens
ccucuuaccuauguccc

SEQ ID NO: 1441401 - RNA, 14 nt, Homo sapiens
ccucuuauuugcuc

SEQ ID NO: 1441402 - RNA, 21 nt, Homo sapiens
ccucuuccgugacgucacugg

SEQ ID NO: 1441403 - RNA, 19 nt, Homo sapiens
ccucuucuuauucaugcuu

SEQ ID NO: 1441404 - RNA, 22 nt, Homo sapiens
ccucuuguugcagagauuuccu

SEQ ID NO: 1441405 - RNA, 13 nt, Homo sapiens
ccucuuuccccac

SEQ ID NO: 1441406 - RNA, 18 nt, Homo sapiens
ccucuuuucccucucuag

SEQ ID NO: 1441407 - RNA, 15 nt, Homo sapiens
ccugaaaauucugua

SEQ ID NO: 1441408 - RNA, 17 nt, Homo sapiens
ccugaauuuuguugcug

SEQ ID NO: 1441409 - RNA, 14 nt, Homo sapiens
ccugacagugccca

SEQ ID NO: 1441410 - RNA, 22 nt, Homo sapiens
ccugacauuaagacacaccucu

SEQ ID NO: 1441411 - RNA, 19 nt, Homo sapiens
ccugacccacaggaacugg

SEQ ID NO: 1441412 - RNA, 16 nt, Homo sapiens
ccugacuuugugaucc

SEQ ID NO: 1441413 - RNA, 20 nt, Homo sapiens
ccugagccaaggccuagugg

SEQ ID NO: 1441414 - RNA, 22 nt, Homo sapiens
ccugaggaucuagcuucaugcc

SEQ ID NO: 1441415 - RNA, 21 nt, Homo sapiens
ccugaggcuccugugcuacuu

SEQ ID NO: 1441416 - RNA, 22 nt, Homo sapiens
ccugagucggccccacauggga

SEQ ID NO: 1441417 - RNA, 19 nt, Homo sapiens
ccugaucauggucagcuca

SEQ ID NO: 1441418 - RNA, 17 nt, Homo sapiens
ccugaugaaaaauaugu

SEQ ID NO: 1441419 - RNA, 19 nt, Homo sapiens
ccugauuuagauaugcaaa

SEQ ID NO: 1441420 - RNA, 21 nt, Homo sapiens
ccugcaaacucacugcucaag

SEQ ID NO: 1441421 - RNA, 22 nt, Homo sapiens
ccugcagccuccuccugaccac

SEQ ID NO: 1441422 - RNA, 22 nt, Homo sapiens
ccugccagagcccaagugccau

SEQ ID NO: 1441423 - RNA, 17 nt, Homo sapiens
ccugccggacacagagg

SEQ ID NO: 1441424 - RNA, 13 nt, Homo sapiens
ccugccucaggcu

SEQ ID NO: 1441425 - RNA, 18 nt, Homo sapiens
ccugccucaggcuucuga

SEQ ID NO: 1441426 - RNA, 18 nt, Homo sapiens
ccugccucauccaccaau

SEQ ID NO: 1441427 - RNA, 20 nt, Homo sapiens
ccugccugcgggcaccuaca

SEQ ID NO: 1441428 - RNA, 21 nt, Homo sapiens
ccugcggcugcugugugccuu

SEQ ID NO: 1441429 - RNA, 17 nt, Homo sapiens
ccugcguugugagcucu

SEQ ID NO: 1441430 - RNA, 14 nt, Homo sapiens
ccugcuacacaaaa

SEQ ID NO: 1441431 - RNA, 16 nt, Homo sapiens
ccugcugagcucugag

SEQ ID NO: 1441432 - RNA, 16 nt, Homo sapiens
ccugcugcagcaugaa

SEQ ID NO: 1441433 - RNA, 23 nt, Homo sapiens
ccugcuggaaaccacacuucuug

SEQ ID NO: 1441434 - RNA, 16 nt, Homo sapiens
ccugcuggcaccucag

SEQ ID NO: 1441435 - RNA, 14 nt, Homo sapiens
ccugcugugcccuc

SEQ ID NO: 1441436 - RNA, 22 nt, Homo sapiens
ccugcugugcccucccauagca

SEQ ID NO: 1441437 - RNA, 15 nt, Homo sapiens
ccugcuuuuugacau

SEQ ID NO: 1441438 - RNA, 23 nt, Homo sapiens
ccuggaacuagaaacagaggugg

SEQ ID NO: 1441439 - RNA, 18 nt, Homo sapiens
ccuggaagccaaacaaag

SEQ ID NO: 1441440 - RNA, 20 nt, Homo sapiens
ccuggacugggagguagaua

SEQ ID NO: 1441441 - RNA, 16 nt, Homo sapiens
ccuggagggaggcucu

SEQ ID NO: 1441442 - RNA, 19 nt, Homo sapiens
ccuggauguguggggcaug

SEQ ID NO: 1441443 - RNA, 18 nt, Homo sapiens
ccuggcaagugggugaaa

SEQ ID NO: 1441444 - RNA, 13 nt, Homo sapiens
ccuggcaauguuu

SEQ ID NO: 1441445 - RNA, 14 nt, Homo sapiens
ccuggcaguugaau

SEQ ID NO: 1441446 - RNA, 15 nt, Homo sapiens
ccuggccggcaaccc

SEQ ID NO: 1441447 - RNA, 14 nt, Homo sapiens
ccuggccucacugg

SEQ ID NO: 1441448 - RNA, 21 nt, Homo sapiens
ccuggccuuugaggcaaaggc

SEQ ID NO: 1441449 - RNA, 17 nt, Homo sapiens
ccuggcucugcaauggg

SEQ ID NO: 1441450 - RNA, 16 nt, Homo sapiens
ccuggcuggcugaggg

SEQ ID NO: 1441451 - RNA, 20 nt, Homo sapiens
ccugggauguagcggugaag

SEQ ID NO: 1441452 - RNA, 18 nt, Homo sapiens
ccugggccccaccaccua

SEQ ID NO: 1441453 - RNA, 17 nt, Homo sapiens
ccugggcugucugucac

SEQ ID NO: 1441454 - RNA, 20 nt, Homo sapiens
ccugggcuugugaacaccuc

SEQ ID NO: 1441455 - RNA, 18 nt, Homo sapiens
ccugggggcagugacugg

SEQ ID NO: 1441456 - RNA, 15 nt, Homo sapiens
ccuggggguggcagg

SEQ ID NO: 1441457 - RNA, 12 nt, Homo sapiens
ccuguaacacaa

SEQ ID NO: 1441458 - RNA, 13 nt, Homo sapiens
ccuguaacacaag

SEQ ID NO: 1441459 - RNA, 23 nt, Homo sapiens
ccuguaccacaaacacauuacau

SEQ ID NO: 1441460 - RNA, 22 nt, Homo sapiens
ccuguacucuggagagacugug

SEQ ID NO: 1441461 - RNA, 15 nt, Homo sapiens
ccugucagagaucug

SEQ ID NO: 1441462 - RNA, 21 nt, Homo sapiens
ccugugaucuccacaccaaag

SEQ ID NO: 1441463 - RNA, 11 nt, Homo sapiens
ccugugcagca

SEQ ID NO: 1441464 - RNA, 22 nt, Homo sapiens
ccugugccaaccugaugccccu

SEQ ID NO: 1441465 - RNA, 16 nt, Homo sapiens
ccugugcuggacuguu

SEQ ID NO: 1441466 - RNA, 14 nt, Homo sapiens
ccuguuaagcaauu

SEQ ID NO: 1441467 - RNA, 22 nt, Homo sapiens
ccuguuacuugaaauaccagug

SEQ ID NO: 1441468 - RNA, 12 nt, Homo sapiens
ccuguuccucaa

SEQ ID NO: 1441469 - RNA, 15 nt, Homo sapiens
ccuguugcaccucag

SEQ ID NO: 1441470 - RNA, 16 nt, Homo sapiens
ccuguuuccauggguc

SEQ ID NO: 1441471 - RNA, 22 nt, Homo sapiens
ccuguuucugaaccauuacugu

SEQ ID NO: 1441472 - RNA, 20 nt, Homo sapiens
ccuuaaccucucuaagccac

SEQ ID NO: 1441473 - RNA, 21 nt, Homo sapiens
ccuuaagccaauauuuacuca

SEQ ID NO: 1441474 - RNA, 14 nt, Homo sapiens
ccuuacuacuucuu

SEQ ID NO: 1441475 - RNA, 14 nt, Homo sapiens
ccuuacucaccucu

SEQ ID NO: 1441476 - RNA, 11 nt, Homo sapiens
ccuuacucuga

SEQ ID NO: 1441477 - RNA, 19 nt, Homo sapiens
ccuuagagauugccccaga

SEQ ID NO: 1441478 - RNA, 16 nt, Homo sapiens
ccuuagauuagcucug

SEQ ID NO: 1441479 - RNA, 22 nt, Homo sapiens
ccuuagauuagcucuggaccag

SEQ ID NO: 1441480 - RNA, 23 nt, Homo sapiens
ccuuaggaaaaugcuucuguugu

SEQ ID NO: 1441481 - RNA, 21 nt, Homo sapiens
ccuucaugaugaauuacuucu

SEQ ID NO: 1441482 - RNA, 20 nt, Homo sapiens
ccuuccacuuugaguaccaa

SEQ ID NO: 1441483 - RNA, 21 nt, Homo sapiens
ccuucccaaucagcacugaaa

SEQ ID NO: 1441484 - RNA, 17 nt, Homo sapiens
ccuucccaguagcucuu

SEQ ID NO: 1441485 - RNA, 23 nt, Homo sapiens
caggaucugaguuauuuugcuaa

SEQ ID NO: 1441486 - RNA, 15 nt, Homo sapiens
caggaucuguacaau

SEQ ID NO: 1441487 - RNA, 17 nt, Homo sapiens
caggcagaucacaaggu

SEQ ID NO: 1441488 - RNA, 14 nt, Homo sapiens
caggcaucccaucc

SEQ ID NO: 1441489 - RNA, 17 nt, Homo sapiens
caggccccgcuugucca

SEQ ID NO: 1441490 - RNA, 22 nt, Homo sapiens
caggcccggcccagccuaggcc

SEQ ID NO: 1441491 - RNA, 16 nt, Homo sapiens
caggccugggacccag

SEQ ID NO: 1441492 - RNA, 14 nt, Homo sapiens
caggcgcaugugcc

SEQ ID NO: 1441493 - RNA, 15 nt, Homo sapiens
caggcgcaugugcca

SEQ ID NO: 1441494 - RNA, 22 nt, Homo sapiens
caggcuguaagcauucugagcu

SEQ ID NO: 1441495 - RNA, 18 nt, Homo sapiens
caggcuguucugcacuga

SEQ ID NO: 1441496 - RNA, 19 nt, Homo sapiens
caggcuguucugcacugaa

SEQ ID NO: 1441497 - RNA, 22 nt, Homo sapiens
cagggaacccugcuugcacuuu

SEQ ID NO: 1441498 - RNA, 22 nt, Homo sapiens
cagggaaccgugauaagccuuu

SEQ ID NO: 1441499 - RNA, 22 nt, Homo sapiens
cagggacucaaggguccagaag

SEQ ID NO: 1441500 - RNA, 13 nt, Homo sapiens
cagggaugccaac

SEQ ID NO: 1441501 - RNA, 18 nt, Homo sapiens
cagggauuuuuauuugua

SEQ ID NO: 1441502 - RNA, 22 nt, Homo sapiens
cagggcagccuccaccuugcuc

SEQ ID NO: 1441503 - RNA, 18 nt, Homo sapiens
cagggccucugggagccu

SEQ ID NO: 1441504 - RNA, 17 nt, Homo sapiens
caggggaccacaccucc

SEQ ID NO: 1441505 - RNA, 14 nt, Homo sapiens
caggggaguuccug

SEQ ID NO: 1441506 - RNA, 13 nt, Homo sapiens
caggggcugcuca

SEQ ID NO: 1441507 - RNA, 18 nt, Homo sapiens
caggggucgucaccaccu

SEQ ID NO: 1441508 - RNA, 23 nt, Homo sapiens
caggggucucccuggagugcagu

SEQ ID NO: 1441509 - RNA, 14 nt, Homo sapiens
caggguagggagaa

SEQ ID NO: 1441510 - RNA, 21 nt, Homo sapiens
cagggucucacuauguugccc

SEQ ID NO: 1441511 - RNA, 15 nt, Homo sapiens
cagggugagugaaug

SEQ ID NO: 1441512 - RNA, 14 nt, Homo sapiens
cagggugcauguga

SEQ ID NO: 1441513 - RNA, 12 nt, Homo sapiens
caggguggggga

SEQ ID NO: 1441514 - RNA, 21 nt, Homo sapiens
caggguuagcucacgugucuu

SEQ ID NO: 1441515 - RNA, 15 nt, Homo sapiens
caggguucugaggca

SEQ ID NO: 1441516 - RNA, 14 nt, Homo sapiens
caggguugaucaca

SEQ ID NO: 1441517 - RNA, 21 nt, Homo sapiens
caggguuucaccauauuggcc

SEQ ID NO: 1441518 - RNA, 15 nt, Homo sapiens
cagguaaugagggac

SEQ ID NO: 1441519 - RNA, 16 nt, Homo sapiens
cagguaguacugggaa

SEQ ID NO: 1441520 - RNA, 18 nt, Homo sapiens
cauucccuuuuccauaua

SEQ ID NO: 1441521 - RNA, 18 nt, Homo sapiens
cauuccugagucuuccag

SEQ ID NO: 1441522 - RNA, 14 nt, Homo sapiens
cauucgagguguca

SEQ ID NO: 1441523 - RNA, 14 nt, Homo sapiens
cauucugaccauuu

SEQ ID NO: 1441524 - RNA, 16 nt, Homo sapiens
cauucugaccauuuca

SEQ ID NO: 1441525 - RNA, 16 nt, Homo sapiens
cauucuguuugucucg

SEQ ID NO: 1441526 - RNA, 19 nt, Homo sapiens
cauugggcugacaccuacc

SEQ ID NO: 1441527 - RNA, 18 nt, Homo sapiens
cauugguuuuuguaguau

SEQ ID NO: 1441528 - RNA, 14 nt, Homo sapiens
cauuguaaucaaaa

SEQ ID NO: 1441529 - RNA, 17 nt, Homo sapiens
cauuguagaaacacagu

SEQ ID NO: 1441530 - RNA, 19 nt, Homo sapiens
cauugucgcucagcaauag

SEQ ID NO: 1441531 - RNA, 23 nt, Homo sapiens
cauuguguguuagcagcagugag

SEQ ID NO: 1441532 - RNA, 20 nt, Homo sapiens
cauuuaauacagcaguguca

SEQ ID NO: 1441533 - RNA, 21 nt, Homo sapiens
cauuuauaaaauaaugaacug

SEQ ID NO: 1441534 - RNA, 18 nt, Homo sapiens
cauuucuaauguaugcau

SEQ ID NO: 1441535 - RNA, 14 nt, Homo sapiens
cauuucuaucacau

SEQ ID NO: 1441536 - RNA, 23 nt, Homo sapiens
cauuucuuauuugugcucuguga

SEQ ID NO: 1441537 - RNA, 21 nt, Homo sapiens
cauuuguacugaccccaucac

SEQ ID NO: 1441538 - RNA, 22 nt, Homo sapiens
cauuuguguuauuauuuugcac

SEQ ID NO: 1441539 - RNA, 18 nt, Homo sapiens
cauuuuaaaaaauggaac

SEQ ID NO: 1441540 - RNA, 16 nt, Homo sapiens
cauuuucaaugcacau

SEQ ID NO: 1441541 - RNA, 17 nt, Homo sapiens
cauuuucaaugcacauu

SEQ ID NO: 1441542 - RNA, 17 nt, Homo sapiens
cauuuuuaauaugacaa

SEQ ID NO: 1441543 - RNA, 15 nt, Homo sapiens
cauuuuucauauucu

SEQ ID NO: 1441544 - RNA, 13 nt, Homo sapiens
cauuuuuggugua

SEQ ID NO: 1441545 - RNA, 17 nt, Homo sapiens
cauuuuuuucacuggag

SEQ ID NO: 1441546 - RNA, 13 nt, Homo sapiens
ccaaaaacuaaau

SEQ ID NO: 1441547 - RNA, 9 nt, Homo sapiens
ccaaaaagg

SEQ ID NO: 1441548 - RNA, 19 nt, Homo sapiens
ccaaaaaggaacacuggaa

SEQ ID NO: 1441549 - RNA, 15 nt, Homo sapiens
ccaaaaguacuuacc

SEQ ID NO: 1441550 - RNA, 13 nt, Homo sapiens
ccaaaauguuaau

SEQ ID NO: 1441551 - RNA, 17 nt, Homo sapiens
ccaaaauuaccaaaaau

SEQ ID NO: 1441552 - RNA, 14 nt, Homo sapiens
ccaaacacacugua

SEQ ID NO: 1441553 - RNA, 21 nt, Homo sapiens
ccaaagaacagccugagccaa

SEQ ID NO: 1441554 - RNA, 15 nt, Homo sapiens
ccaaagcauggacua

SEQ ID NO: 1441555 - RNA, 13 nt, Homo sapiens
ccaaagcauugcc

SEQ ID NO: 1441556 - RNA, 20 nt, Homo sapiens
ccaaagggaaaacucuucau

SEQ ID NO: 1441557 - RNA, 22 nt, Homo sapiens
ccaaaggggcugcuggggcaug

SEQ ID NO: 1441558 - RNA, 21 nt, Homo sapiens
ccaaagugacacagagcaaug

SEQ ID NO: 1441559 - RNA, 14 nt, Homo sapiens
ccaaauaaacucca

SEQ ID NO: 1441560 - RNA, 16 nt, Homo sapiens
ccaaauaaaguaccau

SEQ ID NO: 1441561 - RNA, 15 nt, Homo sapiens
ccaaauaaauauauu

SEQ ID NO: 1441562 - RNA, 16 nt, Homo sapiens
ccaaauaaauguguaa

SEQ ID NO: 1441563 - RNA, 24 nt, Homo sapiens
ccaaauaaggauuuguucacaugc

SEQ ID NO: 1441564 - RNA, 16 nt, Homo sapiens
ccaaauccacaagcca

SEQ ID NO: 1441565 - RNA, 13 nt, Homo sapiens
ccaaaugcugucu

SEQ ID NO: 1441566 - RNA, 13 nt, Homo sapiens
ccaaauuccaugu

SEQ ID NO: 1441567 - RNA, 19 nt, Homo sapiens
ccaaauuucauaccuauca

SEQ ID NO: 1441568 - RNA, 17 nt, Homo sapiens
ccaacaaacaaugccau

SEQ ID NO: 1441569 - RNA, 18 nt, Homo sapiens
auuaaacagacuuuagcu

SEQ ID NO: 1441570 - RNA, 13 nt, Homo sapiens
auuaaacagccaa

SEQ ID NO: 1441571 - RNA, 11 nt, Homo sapiens
auuaaagggua

SEQ ID NO: 1441572 - RNA, 13 nt, Homo sapiens
auuaaauucacau

SEQ ID NO: 1441573 - RNA, 17 nt, Homo sapiens
auuaaauucacaugcag

SEQ ID NO: 1441574 - RNA, 17 nt, Homo sapiens
auuaacgggcauguauu

SEQ ID NO: 1441575 - RNA, 15 nt, Homo sapiens
auuaacuaugugaug

SEQ ID NO: 1441576 - RNA, 15 nt, Homo sapiens
auuaauggcacugau

SEQ ID NO: 1441577 - RNA, 21 nt, Homo sapiens
auuacccccucauuguuuauu

SEQ ID NO: 1441578 - RNA, 23 nt, Homo sapiens
auuacugaaaacaaaauaucuga

SEQ ID NO: 1441579 - RNA, 16 nt, Homo sapiens
auuagcucuggaccag

SEQ ID NO: 1441580 - RNA, 23 nt, Homo sapiens
auuaggcuuuuaagaaacacagg

SEQ ID NO: 1441581 - RNA, 23 nt, Homo sapiens
auuauaaaaauaauauaugcuca

SEQ ID NO: 1441582 - RNA, 18 nt, Homo sapiens
auuauaaauaaaugccaa

SEQ ID NO: 1441583 - RNA, 12 nt, Homo sapiens
auuauaacuuaa

SEQ ID NO: 1441584 - RNA, 16 nt, Homo sapiens
auuauaagaugucauc

SEQ ID NO: 1441585 - RNA, 16 nt, Homo sapiens
auuauacucaaaauuc

SEQ ID NO: 1441586 - RNA, 16 nt, Homo sapiens
auuaucacgcagauca

SEQ ID NO: 1441587 - RNA, 23 nt, Homo sapiens
auuaucucaaaacugcacuguca

SEQ ID NO: 1441588 - RNA, 20 nt, Homo sapiens
auuaucuuuaauaaaauguu

SEQ ID NO: 1441589 - RNA, 20 nt, Homo sapiens
auuaugcacuggccacccaa

SEQ ID NO: 1441590 - RNA, 20 nt, Homo sapiens
auuauggcaagugauaucac

SEQ ID NO: 1441591 - RNA, 20 nt, Homo sapiens
auuaugggcgugaaccacca

SEQ ID NO: 1441592 - RNA, 14 nt, Homo sapiens
auuauuaugucuca

SEQ ID NO: 1441593 - RNA, 23 nt, Homo sapiens
auuauuccuccaggaaggagcaa

SEQ ID NO: 1441594 - RNA, 21 nt, Homo sapiens
auuauuucaaccgcuugccau

SEQ ID NO: 1441595 - RNA, 19 nt, Homo sapiens
auucaaaagaugccauuca

SEQ ID NO: 1441596 - RNA, 14 nt, Homo sapiens
auucaaagcagggu

SEQ ID NO: 1441597 - RNA, 13 nt, Homo sapiens
auucaaagcucua

SEQ ID NO: 1441598 - RNA, 16 nt, Homo sapiens
auucaagauuggacau

SEQ ID NO: 1441599 - RNA, 14 nt, Homo sapiens
auucaagccuguga

SEQ ID NO: 1441600 - RNA, 15 nt, Homo sapiens
auucaagccugugaa

SEQ ID NO: 1441601 - RNA, 15 nt, Homo sapiens
auucaaggaucucaa

SEQ ID NO: 1441602 - RNA, 21 nt, Homo sapiens
auucaaguugcuucucaugga

SEQ ID NO: 1441603 - RNA, 21 nt, Homo sapiens
auucaauaaagcugcugagaa

SEQ ID NO: 1441604 - RNA, 12 nt, Homo sapiens
auucacaaugaa

SEQ ID NO: 1441605 - RNA, 16 nt, Homo sapiens
auucacauuugaugua

SEQ ID NO: 1441606 - RNA, 16 nt, Homo sapiens
auucagaaagucauag

SEQ ID NO: 1441607 - RNA, 15 nt, Homo sapiens
auucagaccagugaa

SEQ ID NO: 1441608 - RNA, 17 nt, Homo sapiens
auucagcauuauuccuc

SEQ ID NO: 1441609 - RNA, 19 nt, Homo sapiens
auucagguauuuguaauag

SEQ ID NO: 1441610 - RNA, 18 nt, Homo sapiens
auucagugagacacagag

SEQ ID NO: 1441611 - RNA, 14 nt, Homo sapiens
auucagugguccug

SEQ ID NO: 1441612 - RNA, 11 nt, Homo sapiens
auucauaacaa

SEQ ID NO: 1441613 - RNA, 20 nt, Homo sapiens
auucaucauuccauaugacu

SEQ ID NO: 1441614 - RNA, 22 nt, Homo sapiens
auucauugaucaaauauuucaa

SEQ ID NO: 1441615 - RNA, 14 nt, Homo sapiens
auucauuguucaaa

SEQ ID NO: 1441616 - RNA, 21 nt, Homo sapiens
auucauuuaucaccagcauau

SEQ ID NO: 1441617 - RNA, 14 nt, Homo sapiens
auuccaacagcuca

SEQ ID NO: 1441618 - RNA, 16 nt, Homo sapiens
auuccaugggauguua

SEQ ID NO: 1441619 - RNA, 18 nt, Homo sapiens
auuccaugggauguuaag

SEQ ID NO: 1441620 - RNA, 13 nt, Homo sapiens
auucccaccaagg

SEQ ID NO: 1441621 - RNA, 22 nt, Homo sapiens
auuccccucgugugacucucuu

SEQ ID NO: 1441622 - RNA, 20 nt, Homo sapiens
ucaaucuucggggugugaug

SEQ ID NO: 1441623 - RNA, 22 nt, Homo sapiens
ucaaugaagauuuuuaauuaca

SEQ ID NO: 1441624 - RNA, 14 nt, Homo sapiens
ucaaugaccuguau

SEQ ID NO: 1441625 - RNA, 12 nt, Homo sapiens
ucaaugugaaaa

SEQ ID NO: 1441626 - RNA, 16 nt, Homo sapiens
ucaauucagugcugua

SEQ ID NO: 1441627 - RNA, 17 nt, Homo sapiens
ucaauuuuuugcuaaac

SEQ ID NO: 1441628 - RNA, 19 nt, Homo sapiens
ucacaaaaaggcauaugca

SEQ ID NO: 1441629 - RNA, 19 nt, Homo sapiens
ucacaaaucuuaacuugaa

SEQ ID NO: 1441630 - RNA, 23 nt, Homo sapiens
ucacaaaucuuaacuugaaggag

SEQ ID NO: 1441631 - RNA, 20 nt, Homo sapiens
ucacaacauuuacuuaacag

SEQ ID NO: 1441632 - RNA, 22 nt, Homo sapiens
ucacaagcccaggcuggagauc

SEQ ID NO: 1441633 - RNA, 13 nt, Homo sapiens
ucacaaguucaau

SEQ ID NO: 1441634 - RNA, 12 nt, Homo sapiens
ucacacagagau

SEQ ID NO: 1441635 - RNA, 18 nt, Homo sapiens
ucacacagggcucuuuga

SEQ ID NO: 1441636 - RNA, 17 nt, Homo sapiens
ucacacucauaacucau

SEQ ID NO: 1441637 - RNA, 19 nt, Homo sapiens
ucacacuguaaacauucau

SEQ ID NO: 1441638 - RNA, 20 nt, Homo sapiens
ucacagggccccagaaggca

SEQ ID NO: 1441639 - RNA, 15 nt, Homo sapiens
ucacaguuccucgcc

SEQ ID NO: 1441640 - RNA, 18 nt, Homo sapiens
ucacaguugacaaaaagc

SEQ ID NO: 1441641 - RNA, 19 nt, Homo sapiens
ucacauaacuucucugagu

SEQ ID NO: 1441642 - RNA, 23 nt, Homo sapiens
ucacaucuuaugcuaacuguaga

SEQ ID NO: 1441643 - RNA, 18 nt, Homo sapiens
ucacauuaauauuugcug

SEQ ID NO: 1441644 - RNA, 17 nt, Homo sapiens
ucaccacaccaaaccuc

SEQ ID NO: 1441645 - RNA, 15 nt, Homo sapiens
ucaccacuccauucc

SEQ ID NO: 1441646 - RNA, 16 nt, Homo sapiens
ucaccacuccauuccc

SEQ ID NO: 1441647 - RNA, 15 nt, Homo sapiens
gugaacacaucagcu

SEQ ID NO: 1441648 - RNA, 21 nt, Homo sapiens
gugaacaccuccuagccacau

SEQ ID NO: 1441649 - RNA, 16 nt, Homo sapiens
gugaacugcgugccag

SEQ ID NO: 1441650 - RNA, 13 nt, Homo sapiens
gugaagaacaucc

SEQ ID NO: 1441651 - RNA, 17 nt, Homo sapiens
gugaaugggacuauuca

SEQ ID NO: 1441652 - RNA, 13 nt, Homo sapiens
gugacaacaugcg

SEQ ID NO: 1441653 - RNA, 22 nt, Homo sapiens
gugacacacagcagcacugcag

SEQ ID NO: 1441654 - RNA, 14 nt, Homo sapiens
gugacagucuugca

SEQ ID NO: 1441655 - RNA, 15 nt, Homo sapiens
gugacaugccaucca

SEQ ID NO: 1441656 - RNA, 12 nt, Homo sapiens
gugacucucuug

SEQ ID NO: 1441657 - RNA, 22 nt, Homo sapiens
gugacuuccucgccucucccac

SEQ ID NO: 1441658 - RNA, 20 nt, Homo sapiens
gugagaaucaaaacucuccu

SEQ ID NO: 1441659 - RNA, 14 nt, Homo sapiens
gugagaccaaagga

SEQ ID NO: 1441660 - RNA, 23 nt, Homo sapiens
gugagaccaccucucaauauuca

SEQ ID NO: 1441661 - RNA, 19 nt, Homo sapiens
gugaguccgggaaucucuu

SEQ ID NO: 1441662 - RNA, 15 nt, Homo sapiens
gugaguggcagccau

SEQ ID NO: 1441663 - RNA, 16 nt, Homo sapiens
gugauacguacagcca

SEQ ID NO: 1441664 - RNA, 15 nt, Homo sapiens
gugauauaugcaugu

SEQ ID NO: 1441665 - RNA, 23 nt, Homo sapiens
gugaucagaaggcuggggccagu

SEQ ID NO: 1441666 - RNA, 13 nt, Homo sapiens
gugaucaucccau

SEQ ID NO: 1441667 - RNA, 21 nt, Homo sapiens
gugcaacgcuuuuugggagaa

SEQ ID NO: 1441668 - RNA, 23 nt, Homo sapiens
gugcaagccacuauguccagcua

SEQ ID NO: 1441669 - RNA, 15 nt, Homo sapiens
gugcaagucuuguca

SEQ ID NO: 1441670 - RNA, 23 nt, Homo sapiens
gugcagguaccugcgauguuuac

SEQ ID NO: 1441671 - RNA, 12 nt, Homo sapiens
gugcagugauac

SEQ ID NO: 1441672 - RNA, 18 nt, Homo sapiens
gugccaauauuucugaua

SEQ ID NO: 1441673 - RNA, 17 nt, Homo sapiens
gugccagcucaggugac

SEQ ID NO: 1441674 - RNA, 12 nt, Homo sapiens
gugccaucccac

SEQ ID NO: 1441675 - RNA, 15 nt, Homo sapiens
gugcccaccaacauc

SEQ ID NO: 1441676 - RNA, 12 nt, Homo sapiens
gugccugagaca

SEQ ID NO: 1441677 - RNA, 15 nt, Homo sapiens
gugccuggacauuug

SEQ ID NO: 1441678 - RNA, 12 nt, Homo sapiens
gugccugugauc

SEQ ID NO: 1441679 - RNA, 18 nt, Homo sapiens
gugccuuugaccaucucu

SEQ ID NO: 1441680 - RNA, 20 nt, Homo sapiens
gugcuaucgcaccacugugu

SEQ ID NO: 1441681 - RNA, 20 nt, Homo sapiens
gugcucgcccacaaacugau

SEQ ID NO: 1441682 - RNA, 15 nt, Homo sapiens
gugcugucagcucag

SEQ ID NO: 1441683 - RNA, 19 nt, Homo sapiens
gugcuuagccuccugaccu

SEQ ID NO: 1441684 - RNA, 13 nt, Homo sapiens
guggaacaaaagu

SEQ ID NO: 1441685 - RNA, 20 nt, Homo sapiens
guggagaaauuccuugauuc

SEQ ID NO: 1441686 - RNA, 15 nt, Homo sapiens
guggagguugcagug

SEQ ID NO: 1441687 - RNA, 17 nt, Homo sapiens
guggauaucuguguaua

SEQ ID NO: 1441688 - RNA, 23 nt, Homo sapiens
guggauuccugggcaagaaccua

SEQ ID NO: 1441689 - RNA, 19 nt, Homo sapiens
guggccucagcccucagaa

SEQ ID NO: 1441690 - RNA, 20 nt, Homo sapiens
gugggagagagacguguaca

SEQ ID NO: 1441691 - RNA, 21 nt, Homo sapiens
gugggaggggaaugccacagu

SEQ ID NO: 1441692 - RNA, 18 nt, Homo sapiens
guggucaaaccgcacuca

SEQ ID NO: 1441693 - RNA, 17 nt, Homo sapiens
guggucuccuugcacuu

SEQ ID NO: 1441694 - RNA, 21 nt, Homo sapiens
gugguuuaugucaucauacau

SEQ ID NO: 1441695 - RNA, 22 nt, Homo sapiens
guguaaauacaguggaucucaa

SEQ ID NO: 1441696 - RNA, 23 nt, Homo sapiens
guguaaauggagcuuguacauau

SEQ ID NO: 1441697 - RNA, 13 nt, Homo sapiens
guguacucuuuau

SEQ ID NO: 1441698 - RNA, 21 nt, Homo sapiens
guguagcugugaccugcugag

SEQ ID NO: 1441699 - RNA, 16 nt, Homo sapiens
guguaugcucauacuu

SEQ ID NO: 1441700 - RNA, 14 nt, Homo sapiens
gugucagagcuggg

SEQ ID NO: 1441701 - RNA, 14 nt, Homo sapiens
uauaguacuggcau

SEQ ID NO: 1441702 - RNA, 16 nt, Homo sapiens
uauaguuuauugacaa

SEQ ID NO: 1441703 - RNA, 15 nt, Homo sapiens
uauauacacauacau

SEQ ID NO: 1441704 - RNA, 13 nt, Homo sapiens
uauauacauucuu

SEQ ID NO: 1441705 - RNA, 17 nt, Homo sapiens
uauauaguagcauuuca

SEQ ID NO: 1441706 - RNA, 22 nt, Homo sapiens
uauauauacauacacuuguaua

SEQ ID NO: 1441707 - RNA, 14 nt, Homo sapiens
uauauaucaaggau

SEQ ID NO: 1441708 - RNA, 20 nt, Homo sapiens
uauauauugguaacauccuu

SEQ ID NO: 1441709 - RNA, 17 nt, Homo sapiens
uauaucuauaguaguca

SEQ ID NO: 1441710 - RNA, 14 nt, Homo sapiens
uauaucuaugucua

SEQ ID NO: 1441711 - RNA, 15 nt, Homo sapiens
uauaugcuauucaau

SEQ ID NO: 1441712 - RNA, 14 nt, Homo sapiens
uauauguaacugaa

SEQ ID NO: 1441713 - RNA, 23 nt, Homo sapiens
uauauguauauuaaaacugcacu

SEQ ID NO: 1441714 - RNA, 20 nt, Homo sapiens
uauauguguauauauacaua

SEQ ID NO: 1441715 - RNA, 21 nt, Homo sapiens
uauauguguauauauacauac

SEQ ID NO: 1441716 - RNA, 13 nt, Homo sapiens
uauauuauggaag

SEQ ID NO: 1441717 - RNA, 22 nt, Homo sapiens
uauauuggaaucuguaucagaa

SEQ ID NO: 1441718 - RNA, 21 nt, Homo sapiens
uauauuggucauugccuugcc

SEQ ID NO: 1441719 - RNA, 16 nt, Homo sapiens
uauauuuaauggcaau

SEQ ID NO: 1441720 - RNA, 14 nt, Homo sapiens
uauauuuauacucu

SEQ ID NO: 1441721 - RNA, 20 nt, Homo sapiens
uauauuugugugugugauau

SEQ ID NO: 1441722 - RNA, 17 nt, Homo sapiens
uaucaaaaagacugugg

SEQ ID NO: 1441723 - RNA, 19 nt, Homo sapiens
uaucaaaaaguacaauaau

SEQ ID NO: 1441724 - RNA, 20 nt, Homo sapiens
uaucaaaaaguacaauaaua

SEQ ID NO: 1441725 - RNA, 15 nt, Homo sapiens
uaucaaaacauauca

SEQ ID NO: 1441726 - RNA, 20 nt, Homo sapiens
uaucaccccuugaagccuuu

SEQ ID NO: 1441727 - RNA, 22 nt, Homo sapiens
guauuaauguguuaagugcagg

SEQ ID NO: 1441728 - RNA, 13 nt, Homo sapiens
guauugccacaau

SEQ ID NO: 1441729 - RNA, 14 nt, Homo sapiens
guauuuagugucuu

SEQ ID NO: 1441730 - RNA, 19 nt, Homo sapiens
guauuuuaaaacauaagaa

SEQ ID NO: 1441731 - RNA, 22 nt, Homo sapiens
guauuuuaggcagggauuugag

SEQ ID NO: 1441732 - RNA, 12 nt, Homo sapiens
guauuuugccag

SEQ ID NO: 1441733 - RNA, 17 nt, Homo sapiens
guauuuuguauuugcau

SEQ ID NO: 1441734 - RNA, 15 nt, Homo sapiens
guauuuuugucauau

SEQ ID NO: 1441735 - RNA, 20 nt, Homo sapiens
gucaaaccgcacucacccau

SEQ ID NO: 1441736 - RNA, 22 nt, Homo sapiens
gucaaauaucucagaggcuaua

SEQ ID NO: 1441737 - RNA, 18 nt, Homo sapiens
gucaauccccucauucag

SEQ ID NO: 1441738 - RNA, 17 nt, Homo sapiens
gucaauuaguacaguag

SEQ ID NO: 1441739 - RNA, 22 nt, Homo sapiens
gucacaagggauuggcaauugu

SEQ ID NO: 1441740 - RNA, 15 nt, Homo sapiens
gucacaccaucuuaa

SEQ ID NO: 1441741 - RNA, 18 nt, Homo sapiens
gucacauuguaacugaac

SEQ ID NO: 1441742 - RNA, 16 nt, Homo sapiens
gucacccuucugggca

SEQ ID NO: 1441743 - RNA, 19 nt, Homo sapiens
gucacuaaccaagccagaa

SEQ ID NO: 1441744 - RNA, 21 nt, Homo sapiens
gucacuaaccaagccagaaac

SEQ ID NO: 1441745 - RNA, 15 nt, Homo sapiens
gucagaccaguacug

SEQ ID NO: 1441746 - RNA, 19 nt, Homo sapiens
gucagaccaguacugggaa

SEQ ID NO: 1441747 - RNA, 13 nt, Homo sapiens
gucagaguucugc

SEQ ID NO: 1441748 - RNA, 17 nt, Homo sapiens
gucagaguucugcucua

SEQ ID NO: 1441749 - RNA, 22 nt, Homo sapiens
gucagauuugcuguucacccac

SEQ ID NO: 1441750 - RNA, 13 nt, Homo sapiens
gucaguugccaug

SEQ ID NO: 1441751 - RNA, 21 nt, Homo sapiens
gucaucaaauauuaccaaaaa

SEQ ID NO: 1441752 - RNA, 19 nt, Homo sapiens
gucaugcacucaggcagac

SEQ ID NO: 1441753 - RNA, 17 nt, Homo sapiens
gucauggaaaauguccu

SEQ ID NO: 1441754 - RNA, 15 nt, Homo sapiens
gucauucuacacuga

SEQ ID NO: 1441755 - RNA, 21 nt, Homo sapiens
gucauuuggugccaguauuuu

SEQ ID NO: 1441756 - RNA, 17 nt, Homo sapiens
guccaaagaacaagaaa

SEQ ID NO: 1441757 - RNA, 13 nt, Homo sapiens
guccaagggccau

SEQ ID NO: 1441758 - RNA, 22 nt, Homo sapiens
guccaauggcuguaaacuauaa

SEQ ID NO: 1441759 - RNA, 21 nt, Homo sapiens
guccacgggaagccuccguca

SEQ ID NO: 1441760 - RNA, 17 nt, Homo sapiens
guccagaauaagugcug

SEQ ID NO: 1441761 - RNA, 18 nt, Homo sapiens
guccagcuugcucuucag

SEQ ID NO: 1441762 - RNA, 12 nt, Homo sapiens
guccagugcaac

SEQ ID NO: 1441763 - RNA, 21 nt, Homo sapiens
gucccagagcaggaaugggaa

SEQ ID NO: 1441764 - RNA, 13 nt, Homo sapiens
guccccaccucag

SEQ ID NO: 1441765 - RNA, 17 nt, Homo sapiens
gucccccacgugugaag

SEQ ID NO: 1441766 - RNA, 17 nt, Homo sapiens
guccccuccacugucac

SEQ ID NO: 1441767 - RNA, 17 nt, Homo sapiens
guccccucuugacccau

SEQ ID NO: 1441768 - RNA, 15 nt, Homo sapiens
gucccucagugauac

SEQ ID NO: 1441769 - RNA, 18 nt, Homo sapiens
gucccucccaucucuacc

SEQ ID NO: 1441770 - RNA, 18 nt, Homo sapiens
guccgcaucacucugcau

SEQ ID NO: 1441771 - RNA, 19 nt, Homo sapiens
guccuccauuucaacucca

SEQ ID NO: 1441772 - RNA, 20 nt, Homo sapiens
guccucccacccuaccacag

SEQ ID NO: 1441773 - RNA, 14 nt, Homo sapiens
guccugagcacugc

SEQ ID NO: 1441774 - RNA, 17 nt, Homo sapiens
guccugcccucugggag

SEQ ID NO: 1441775 - RNA, 22 nt, Homo sapiens
guccugguggggcagcuccucu

SEQ ID NO: 1441776 - RNA, 19 nt, Homo sapiens
gucgaauguuagauuccuc

SEQ ID NO: 1441777 - RNA, 13 nt, Homo sapiens
gucuagacuuucu

SEQ ID NO: 1441778 - RNA, 20 nt, Homo sapiens
gucuagcauuaacuuauugu

SEQ ID NO: 1441779 - RNA, 15 nt, Homo sapiens
gucuauuaucuguag

SEQ ID NO: 1441780 - RNA, 19 nt, Homo sapiens
gucucaagagggcacuggu

SEQ ID NO: 1441781 - RNA, 15 nt, Homo sapiens
gcuguucugcacuga

SEQ ID NO: 1441782 - RNA, 17 nt, Homo sapiens
gcuguuugauagcagaa

SEQ ID NO: 1441783 - RNA, 14 nt, Homo sapiens
gcuuaauguuuauu

SEQ ID NO: 1441784 - RNA, 20 nt, Homo sapiens
gcuuagacuucgacucagga

SEQ ID NO: 1441785 - RNA, 22 nt, Homo sapiens
gcuuagaugagggugacuguca

SEQ ID NO: 1441786 - RNA, 18 nt, Homo sapiens
gcuuauauauauuugauu

SEQ ID NO: 1441787 - RNA, 15 nt, Homo sapiens
gcuuauucuugagca

SEQ ID NO: 1441788 - RNA, 21 nt, Homo sapiens
gcuucaucaauuuuuauacau

SEQ ID NO: 1441789 - RNA, 23 nt, Homo sapiens
gcuucauuugggaaauucagcuu

SEQ ID NO: 1441790 - RNA, 17 nt, Homo sapiens
gcuucccagaggccagg

SEQ ID NO: 1441791 - RNA, 15 nt, Homo sapiens
gcuucuagaucugga

SEQ ID NO: 1441792 - RNA, 13 nt, Homo sapiens
gcuucuccugacc

SEQ ID NO: 1441793 - RNA, 13 nt, Homo sapiens
gcuucuugugaaa

SEQ ID NO: 1441794 - RNA, 21 nt, Homo sapiens
gcuugcccuguuaaaagauga

SEQ ID NO: 1441795 - RNA, 22 nt, Homo sapiens
gcuuguaacuccaccaacccau

SEQ ID NO: 1441796 - RNA, 13 nt, Homo sapiens
gcuuguagcagaa

SEQ ID NO: 1441797 - RNA, 16 nt, Homo sapiens
gcuuguauauacauau

SEQ ID NO: 1441798 - RNA, 22 nt, Homo sapiens
gcuugugauuuuugaacaauac

SEQ ID NO: 1441799 - RNA, 15 nt, Homo sapiens
gcuuguuggcuuccg

SEQ ID NO: 1441800 - RNA, 22 nt, Homo sapiens
gcuuguuguuuuuaaguccugu

SEQ ID NO: 1441801 - RNA, 19 nt, Homo sapiens
gcuuucugaagcuuuacca

SEQ ID NO: 1441802 - RNA, 14 nt, Homo sapiens
gcuuuuuaauugag

SEQ ID NO: 1441803 - RNA, 15 nt, Homo sapiens
ggaaaaccagggaua

SEQ ID NO: 1441804 - RNA, 20 nt, Homo sapiens
ggaaaagaaucccugcagcc

SEQ ID NO: 1441805 - RNA, 17 nt, Homo sapiens
ggaaaaggccuggggug

SEQ ID NO: 1441806 - RNA, 22 nt, Homo sapiens
ggaaaagguagcuuaccugaca

SEQ ID NO: 1441807 - RNA, 18 nt, Homo sapiens
ggaaaauguccuguggug

SEQ ID NO: 1441808 - RNA, 12 nt, Homo sapiens
ggaaaaugugac

SEQ ID NO: 1441809 - RNA, 15 nt, Homo sapiens
ggaaagcagccguuu

SEQ ID NO: 1441810 - RNA, 14 nt, Homo sapiens
ggaaaggauucaug

SEQ ID NO: 1441811 - RNA, 21 nt, Homo sapiens
ggaaaugugucuugucuccau

SEQ ID NO: 1441812 - RNA, 22 nt, Homo sapiens
ggaacacccgacuccucaaaag

SEQ ID NO: 1441813 - RNA, 17 nt, Homo sapiens
ggaagaaagaaugcaag

SEQ ID NO: 1441814 - RNA, 13 nt, Homo sapiens
ggaagaagccaga

SEQ ID NO: 1441815 - RNA, 20 nt, Homo sapiens
ggaagaaggaagaagccaga

SEQ ID NO: 1441816 - RNA, 14 nt, Homo sapiens
ggaagagggcagua

SEQ ID NO: 1441817 - RNA, 13 nt, Homo sapiens
ggaagccaaacaa

SEQ ID NO: 1441818 - RNA, 20 nt, Homo sapiens
ggaagcggagcuugcaguga

SEQ ID NO: 1441819 - RNA, 14 nt, Homo sapiens
ggaagcuccacugu

SEQ ID NO: 1441820 - RNA, 11 nt, Homo sapiens
ggaagcuguuu

SEQ ID NO: 1441821 - RNA, 14 nt, Homo sapiens
ggaaggagugagau

SEQ ID NO: 1441822 - RNA, 14 nt, Homo sapiens
ggaagggacacaca

SEQ ID NO: 1441823 - RNA, 14 nt, Homo sapiens
ggaagucaccaaaa

SEQ ID NO: 1441824 - RNA, 21 nt, Homo sapiens
ggaagucucucccgauaucac

SEQ ID NO: 1441825 - RNA, 15 nt, Homo sapiens
ggaaguuuguucacu

SEQ ID NO: 1441826 - RNA, 22 nt, Homo sapiens
ggaauaaauugcuccuugacau

SEQ ID NO: 1441827 - RNA, 18 nt, Homo sapiens
ggaauagcccgaggaccg

SEQ ID NO: 1441828 - RNA, 16 nt, Homo sapiens
ggaaucaauuucccag

SEQ ID NO: 1441829 - RNA, 12 nt, Homo sapiens
ggaauuaccuua

SEQ ID NO: 1441830 - RNA, 12 nt, Homo sapiens
ggacaaaaugga

SEQ ID NO: 1441831 - RNA, 19 nt, Homo sapiens
ggacaaugccuugggagag

SEQ ID NO: 1441832 - RNA, 11 nt, Homo sapiens
ggacacagacc

SEQ ID NO: 1441833 - RNA, 17 nt, Homo sapiens
ggacaugauacugaugc

SEQ ID NO: 1441834 - RNA, 16 nt, Homo sapiens
ucuaggacuccacagu

SEQ ID NO: 1441835 - RNA, 15 nt, Homo sapiens
ucuagugcuacugcu

SEQ ID NO: 1441836 - RNA, 13 nt, Homo sapiens
ucuauaaauaacc

SEQ ID NO: 1441837 - RNA, 21 nt, Homo sapiens
ucuauagagaaaaacuuucau

SEQ ID NO: 1441838 - RNA, 15 nt, Homo sapiens
ucuauaguagucaau

SEQ ID NO: 1441839 - RNA, 17 nt, Homo sapiens
ucuaucaauagucaaga

SEQ ID NO: 1441840 - RNA, 19 nt, Homo sapiens
ucuaucccacccaacagcu

SEQ ID NO: 1441841 - RNA, 11 nt, Homo sapiens
ucuauguaucu

SEQ ID NO: 1441842 - RNA, 12 nt, Homo sapiens
ucuauguaucua

SEQ ID NO: 1441843 - RNA, 16 nt, Homo sapiens
ucuauuauaaaaccau

SEQ ID NO: 1441844 - RNA, 21 nt, Homo sapiens
ucucaaauccuugagcacuca

SEQ ID NO: 1441845 - RNA, 13 nt, Homo sapiens
ucucaaauucuca

SEQ ID NO: 1441846 - RNA, 16 nt, Homo sapiens
ucucaagcuagccaga

SEQ ID NO: 1441847 - RNA, 17 nt, Homo sapiens
ucucaaucagugcagug

SEQ ID NO: 1441848 - RNA, 20 nt, Homo sapiens
ucucacuuauaccaaaggga

SEQ ID NO: 1441849 - RNA, 22 nt, Homo sapiens
ucucagcccgggacagggucuu

SEQ ID NO: 1441850 - RNA, 21 nt, Homo sapiens
ucucagccuaccaugagaaua

SEQ ID NO: 1441851 - RNA, 18 nt, Homo sapiens
ucucagcgagguguaaag

SEQ ID NO: 1441852 - RNA, 17 nt, Homo sapiens
ucucauaccucugacca

SEQ ID NO: 1441853 - RNA, 15 nt, Homo sapiens
ucucaugagugccaa

SEQ ID NO: 1441854 - RNA, 21 nt, Homo sapiens
ucucaugagugccaagcaaaa

SEQ ID NO: 1441855 - RNA, 20 nt, Homo sapiens
ucuccacgguagcacuugac

SEQ ID NO: 1441856 - RNA, 17 nt, Homo sapiens
ucuccagacccaccaca

SEQ ID NO: 1441857 - RNA, 22 nt, Homo sapiens
ucuccagugguugcuguugaug

SEQ ID NO: 1441858 - RNA, 12 nt, Homo sapiens
ucucccaugcac

SEQ ID NO: 1441859 - RNA, 21 nt, Homo sapiens
ucuccccacucuaggggucag

SEQ ID NO: 1441860 - RNA, 22 nt, Homo sapiens
ucuccccccaacacaaucuuuc

SEQ ID NO: 1441861 - RNA, 19 nt, Homo sapiens
ucucccuggaucagaacag

SEQ ID NO: 1441862 - RNA, 16 nt, Homo sapiens
ucuccgcacuuggaaa

SEQ ID NO: 1441863 - RNA, 19 nt, Homo sapiens
ucuccucccaaaauacuac

SEQ ID NO: 1441864 - RNA, 16 nt, Homo sapiens
ucuccucccauggccu

SEQ ID NO: 1441865 - RNA, 16 nt, Homo sapiens
ucuccucugauuauca

SEQ ID NO: 1441866 - RNA, 17 nt, Homo sapiens
ucuccugacaugucuca

SEQ ID NO: 1441867 - RNA, 15 nt, Homo sapiens
ucuccuggcuuccca

SEQ ID NO: 1441868 - RNA, 21 nt, Homo sapiens
ucuccuuggaaauacuuuauc

SEQ ID NO: 1441869 - RNA, 19 nt, Homo sapiens
ucucgaacuccugaccuca

SEQ ID NO: 1441870 - RNA, 19 nt, Homo sapiens
ucucgcaguacauguuacu

SEQ ID NO: 1441871 - RNA, 18 nt, Homo sapiens
ucucguaacugguuucau

SEQ ID NO: 1441872 - RNA, 15 nt, Homo sapiens
ucucuagagugagaa

SEQ ID NO: 1441873 - RNA, 13 nt, Homo sapiens
ucucuaugaucuu

SEQ ID NO: 1441874 - RNA, 13 nt, Homo sapiens
ucucuauuccuga

SEQ ID NO: 1441875 - RNA, 20 nt, Homo sapiens
ucucuccaccgugacacaau

SEQ ID NO: 1441876 - RNA, 22 nt, Homo sapiens
ucucucccaccccggccuccac

SEQ ID NO: 1441877 - RNA, 23 nt, Homo sapiens
ucucucuaaaaauaaaaugaugu

SEQ ID NO: 1441878 - RNA, 16 nt, Homo sapiens
ucucucucucuacaaa

SEQ ID NO: 1441879 - RNA, 17 nt, Homo sapiens
ucucucugccuauuuau

SEQ ID NO: 1441880 - RNA, 13 nt, Homo sapiens
ucucugcaucuca

SEQ ID NO: 1441881 - RNA, 20 nt, Homo sapiens
ucucuggguagguguugaaa

SEQ ID NO: 1441882 - RNA, 19 nt, Homo sapiens
ucucugugcuuugacucac

SEQ ID NO: 1441883 - RNA, 22 nt, Homo sapiens
ucucuucagccccuagugcuau

SEQ ID NO: 1441884 - RNA, 23 nt, Homo sapiens
ucucuuucuuuuucugucucucu

SEQ ID NO: 1441885 - RNA, 22 nt, Homo sapiens
ucucuuuuguuccuggcuuuga

SEQ ID NO: 1441886 - RNA, 20 nt, Homo sapiens
ucugaaaaacauuccaggaa

SEQ ID NO: 1441887 - RNA, 14 nt, Homo sapiens
ucugaaagacagaa

SEQ ID NO: 1441888 - RNA, 19 nt, Homo sapiens
ucugaacacauacuagaaa

SEQ ID NO: 1441889 - RNA, 13 nt, Homo sapiens
ucugaaccauuac

SEQ ID NO: 1441890 - RNA, 20 nt, Homo sapiens
ucugaagacuaucuuugaag

SEQ ID NO: 1441891 - RNA, 15 nt, Homo sapiens
ucugaagucacugca

SEQ ID NO: 1441892 - RNA, 17 nt, Homo sapiens
ucugaagucacugcaca

SEQ ID NO: 1441893 - RNA, 15 nt, Homo sapiens
ucugaaugacaucaa

SEQ ID NO: 1441894 - RNA, 22 nt, Homo sapiens
ucugaauggugcuguuucuaua

SEQ ID NO: 1441895 - RNA, 16 nt, Homo sapiens
ucugacucacaagaag

SEQ ID NO: 1441896 - RNA, 17 nt, Homo sapiens
ucugagaauuccaagga

SEQ ID NO: 1441897 - RNA, 20 nt, Homo sapiens
ucugagcaagagcuggcaaa

SEQ ID NO: 1441898 - RNA, 18 nt, Homo sapiens
ucugaggaagaagggaua

SEQ ID NO: 1441899 - RNA, 21 nt, Homo sapiens
uggucaaccugcucacuguuc

SEQ ID NO: 1441900 - RNA, 19 nt, Homo sapiens
uggucacagccaugaaguc

SEQ ID NO: 1441901 - RNA, 14 nt, Homo sapiens
ugguccaggguuga

SEQ ID NO: 1441902 - RNA, 23 nt, Homo sapiens
uggucuaaaaauaaaccaaagga

SEQ ID NO: 1441903 - RNA, 16 nt, Homo sapiens
uggucuccuugcacuu

SEQ ID NO: 1441904 - RNA, 23 nt, Homo sapiens
uggugaaagaaaauucuuggaau

SEQ ID NO: 1441905 - RNA, 15 nt, Homo sapiens
uggugcgaucuuggc

SEQ ID NO: 1441906 - RNA, 14 nt, Homo sapiens
ugguggcaccagau

SEQ ID NO: 1441907 - RNA, 17 nt, Homo sapiens
ugguguaaugcacaauu

SEQ ID NO: 1441908 - RNA, 15 nt, Homo sapiens
ugguguaauuuauaa

SEQ ID NO: 1441909 - RNA, 16 nt, Homo sapiens
ugguuaccgaggaccc

SEQ ID NO: 1441910 - RNA, 20 nt, Homo sapiens
ugguucguguucauacugca

SEQ ID NO: 1441911 - RNA, 22 nt, Homo sapiens
ugguugcauuugucaaagcauu

SEQ ID NO: 1441912 - RNA, 21 nt, Homo sapiens
ugguuuucacauacacucaaa

SEQ ID NO: 1441913 - RNA, 15 nt, Homo sapiens
uguaaaucacuugua

SEQ ID NO: 1441914 - RNA, 18 nt, Homo sapiens
uucaaagacagagaagac

SEQ ID NO: 1441915 - RNA, 20 nt, Homo sapiens
uucaaagacagagaagacca

SEQ ID NO: 1441916 - RNA, 14 nt, Homo sapiens
uucaacaaugacua

SEQ ID NO: 1441917 - RNA, 11 nt, Homo sapiens
uucaacuggag

SEQ ID NO: 1441918 - RNA, 12 nt, Homo sapiens
uucaagacuuga

SEQ ID NO: 1441919 - RNA, 14 nt, Homo sapiens
uucaagagugcagu

SEQ ID NO: 1441920 - RNA, 21 nt, Homo sapiens
uucaaucccggaagggacuua

SEQ ID NO: 1441921 - RNA, 15 nt, Homo sapiens
uucaaugaccuguau

SEQ ID NO: 1441922 - RNA, 15 nt, Homo sapiens
uucaauucucaaaag

SEQ ID NO: 1441923 - RNA, 11 nt, Homo sapiens
uucacacugca

SEQ ID NO: 1441924 - RNA, 10 nt, Homo sapiens
uucacagcca

SEQ ID NO: 1441925 - RNA, 19 nt, Homo sapiens
uucacagccagacuggcac

SEQ ID NO: 1441926 - RNA, 16 nt, Homo sapiens
uucacagccaggagau

SEQ ID NO: 1441927 - RNA, 10 nt, Homo sapiens
uucacauaaa

SEQ ID NO: 1441928 - RNA, 18 nt, Homo sapiens
uucacauaaaaccucauu

SEQ ID NO: 1441929 - RNA, 19 nt, Homo sapiens
uucacauucccaucuguca

SEQ ID NO: 1441930 - RNA, 13 nt, Homo sapiens
uucacauuuugcc

SEQ ID NO: 1441931 - RNA, 16 nt, Homo sapiens
uucaccacauucguca

SEQ ID NO: 1441932 - RNA, 12 nt, Homo sapiens
uucaccaguuuc

SEQ ID NO: 1441933 - RNA, 15 nt, Homo sapiens
uucaccauacuucau

SEQ ID NO: 1441934 - RNA, 17 nt, Homo sapiens
uucaccccugcacuuca

SEQ ID NO: 1441935 - RNA, 14 nt, Homo sapiens
uucacuaaugacga

SEQ ID NO: 1441936 - RNA, 18 nt, Homo sapiens
uucacuguagaaugauuu

SEQ ID NO: 1441937 - RNA, 20 nt, Homo sapiens
uucacuguagaaugauuuca

SEQ ID NO: 1441938 - RNA, 20 nt, Homo sapiens
uucagaaauaaaaugaaaug

SEQ ID NO: 1441939 - RNA, 21 nt, Homo sapiens
uucagaagccccauuugcaca

SEQ ID NO: 1441940 - RNA, 22 nt, Homo sapiens
uucagaagccccauuugcacag

SEQ ID NO: 1441941 - RNA, 20 nt, Homo sapiens
uucagaccagugaaagagua

SEQ ID NO: 1441942 - RNA, 22 nt, Homo sapiens
uucagcaguaacaggaaaccac

SEQ ID NO: 1441943 - RNA, 20 nt, Homo sapiens
uucagcauuauuccuccagg

SEQ ID NO: 1441944 - RNA, 14 nt, Homo sapiens
uucagccccuccuc

SEQ ID NO: 1441945 - RNA, 16 nt, Homo sapiens
uucagcucuguuuuac

SEQ ID NO: 1441946 - RNA, 18 nt, Homo sapiens
uucagcugugaacaugga

SEQ ID NO: 1441947 - RNA, 23 nt, Homo sapiens
uucagcuucagacuuuuaucaaa

SEQ ID NO: 1441948 - RNA, 22 nt, Homo sapiens
uucaggacauggggcauagaaa

SEQ ID NO: 1441949 - RNA, 16 nt, Homo sapiens
uucaggacuggcucac

SEQ ID NO: 1441950 - RNA, 18 nt, Homo sapiens
uucagugucaacuauuca

SEQ ID NO: 1441951 - RNA, 19 nt, Homo sapiens
uucaguugaucacuggcaa

SEQ ID NO: 1441952 - RNA, 16 nt, Homo sapiens
uucaguuguacuucca

SEQ ID NO: 1441953 - RNA, 15 nt, Homo sapiens
uucaucagaccacuc

SEQ ID NO: 1441954 - RNA, 17 nt, Homo sapiens
uucaucuacuacagggu

SEQ ID NO: 1441955 - RNA, 16 nt, Homo sapiens
uucaucuggauuccag

SEQ ID NO: 1441956 - RNA, 20 nt, Homo sapiens
uucauuucuuuucauuguaa

SEQ ID NO: 1441957 - RNA, 16 nt, Homo sapiens
uuccaaaaugccaaau

SEQ ID NO: 1441958 - RNA, 23 nt, Homo sapiens
uuccaacaauggggugggcccau

SEQ ID NO: 1441959 - RNA, 17 nt, Homo sapiens
uuccaagucaacacucu

SEQ ID NO: 1441960 - RNA, 14 nt, Homo sapiens
uuccaagugccaau

SEQ ID NO: 1441961 - RNA, 22 nt, Homo sapiens
uuccaaguuccugcacuccaga

SEQ ID NO: 1441962 - RNA, 21 nt, Homo sapiens
uuccacacagggugcauguga

SEQ ID NO: 1441963 - RNA, 18 nt, Homo sapiens
uuccacaccuagcaucuc

SEQ ID NO: 1441964 - RNA, 20 nt, Homo sapiens
uuccacagaauacaagccac

SEQ ID NO: 1441965 - RNA, 19 nt, Homo sapiens
uuccaccaucaaaugcugu

SEQ ID NO: 1441966 - RNA, 19 nt, Homo sapiens
uuccacucaauaugugauu

SEQ ID NO: 1441967 - RNA, 16 nt, Homo sapiens
uuccacuucuaugcaa

SEQ ID NO: 1441968 - RNA, 18 nt, Homo sapiens
uuccacuucucuagagaa

SEQ ID NO: 1441969 - RNA, 18 nt, Homo sapiens
uuccacuuugaguaccaa

SEQ ID NO: 1441970 - RNA, 14 nt, Homo sapiens
uuccagcauuugcc

SEQ ID NO: 1441971 - RNA, 18 nt, Homo sapiens
uuccauaaacacccauga

SEQ ID NO: 1441972 - RNA, 17 nt, Homo sapiens
uucccaacaacauccau

SEQ ID NO: 1441973 - RNA, 20 nt, Homo sapiens
uucccaauaaaagugacucu

SEQ ID NO: 1441974 - RNA, 22 nt, Homo sapiens
uucccacuggaggucacauuca

SEQ ID NO: 1441975 - RNA, 17 nt, Homo sapiens
uuccccaaaggcaucca

SEQ ID NO: 1441976 - RNA, 15 nt, Homo sapiens
uuccccacucaauga

SEQ ID NO: 1441977 - RNA, 14 nt, Homo sapiens
uucccccagacaga

SEQ ID NO: 1441978 - RNA, 21 nt, Homo sapiens
uucccuaggcugagcuggcau

SEQ ID NO: 1441979 - RNA, 13 nt, Homo sapiens
uucccugagucac

SEQ ID NO: 1441980 - RNA, 17 nt, Homo sapiens
uucccuuugagguugcu

SEQ ID NO: 1441981 - RNA, 20 nt, Homo sapiens
uuccuaagccuguugcugaa

SEQ ID NO: 1441982 - RNA, 17 nt, Homo sapiens
uuccuacccaaccacuc

SEQ ID NO: 1441983 - RNA, 22 nt, Homo sapiens
uuccuauuuuaaaaccaugcag

SEQ ID NO: 1441984 - RNA, 22 nt, Homo sapiens
uuccucacuaguguaaacaaaa

SEQ ID NO: 1441985 - RNA, 14 nt, Homo sapiens
uuccucagcugcca

SEQ ID NO: 1441986 - RNA, 14 nt, Homo sapiens
uuaugucucaaaau

SEQ ID NO: 1441987 - RNA, 18 nt, Homo sapiens
uuaugugagccccuucag

SEQ ID NO: 1441988 - RNA, 14 nt, Homo sapiens
uuauguuugcuaaa

SEQ ID NO: 1441989 - RNA, 22 nt, Homo sapiens
uuauuaagugccugagacaccc

SEQ ID NO: 1441990 - RNA, 16 nt, Homo sapiens
uuauuauuagauucuc

SEQ ID NO: 1441991 - RNA, 13 nt, Homo sapiens
uuauucacuguaa

SEQ ID NO: 1441992 - RNA, 17 nt, Homo sapiens
uuauucauucagugaga

SEQ ID NO: 1441993 - RNA, 15 nt, Homo sapiens
uuauucccuuucaca

SEQ ID NO: 1441994 - RNA, 21 nt, Homo sapiens
uuauuccuaaaucuuccagca

SEQ ID NO: 1441995 - RNA, 15 nt, Homo sapiens
uuauucucuucacuc

SEQ ID NO: 1441996 - RNA, 15 nt, Homo sapiens
uuauucugauuccac

SEQ ID NO: 1441997 - RNA, 22 nt, Homo sapiens
uuauuuaguuggaggccuuuag

SEQ ID NO: 1441998 - RNA, 19 nt, Homo sapiens
uucaaacagucucaggaaa

SEQ ID NO: 1441999 - RNA, 17 nt, Homo sapiens
ucccuucuucccuagcc

SEQ ID NO: 1442000 - RNA, 16 nt, Homo sapiens
uccgacugcuagggag

SEQ ID NO: 1442001 - RNA, 13 nt, Homo sapiens
uccgccauuccaa

SEQ ID NO: 1442002 - RNA, 22 nt, Homo sapiens
uccgcugccaccacgucugcca

SEQ ID NO: 1442003 - RNA, 22 nt, Homo sapiens
uccggagggguugcgggggagc

SEQ ID NO: 1442004 - RNA, 12 nt, Homo sapiens
uccggcugccuc

SEQ ID NO: 1442005 - RNA, 23 nt, Homo sapiens
uccggguggaaaagaaucccugc

SEQ ID NO: 1442006 - RNA, 21 nt, Homo sapiens
uccuaaaucuuccagcaugca

SEQ ID NO: 1442007 - RNA, 20 nt, Homo sapiens
uccuaacccccuuacugugc

SEQ ID NO: 1442008 - RNA, 16 nt, Homo sapiens
uccuaaggacacacua

SEQ ID NO: 1442009 - RNA, 17 nt, Homo sapiens
uccuacagauagucaaa

SEQ ID NO: 1442010 - RNA, 16 nt, Homo sapiens
uccuacaguggcuguc

SEQ ID NO: 1442011 - RNA, 19 nt, Homo sapiens
uccuaccugcugcugcuau

SEQ ID NO: 1442012 - RNA, 17 nt, Homo sapiens
uccuacucagacuguug

SEQ ID NO: 1442013 - RNA, 23 nt, Homo sapiens
uccuagaauggaugugcucacug

SEQ ID NO: 1442014 - RNA, 14 nt, Homo sapiens
uccuagacauaguu

SEQ ID NO: 1442015 - RNA, 19 nt, Homo sapiens
uccuagaggugggcagcug

SEQ ID NO: 1442016 - RNA, 23 nt, Homo sapiens
uccuaucacugauaguguccaaa

SEQ ID NO: 1442017 - RNA, 20 nt, Homo sapiens
uccuauuucuuauagucaau

SEQ ID NO: 1442018 - RNA, 18 nt, Homo sapiens
uccuauuuuaaaaccaug

SEQ ID NO: 1442019 - RNA, 19 nt, Homo sapiens
uccucaacaacaaaccaaa

SEQ ID NO: 1442020 - RNA, 13 nt, Homo sapiens
uccucacuugccc

SEQ ID NO: 1442021 - RNA, 11 nt, Homo sapiens
auuauggugaa

SEQ ID NO: 1442022 - RNA, 18 nt, Homo sapiens
auuaugguguaaugcaca

SEQ ID NO: 1442023 - RNA, 15 nt, Homo sapiens
auuauguauguuuac

SEQ ID NO: 1442024 - RNA, 18 nt, Homo sapiens
auuaugugaaaucaaagc

SEQ ID NO: 1442025 - RNA, 18 nt, Homo sapiens
auuauucaagugccucuu

SEQ ID NO: 1442026 - RNA, 15 nt, Homo sapiens
auuauuccuccagga

SEQ ID NO: 1442027 - RNA, 11 nt, Homo sapiens
auuauucugau

SEQ ID NO: 1442028 - RNA, 21 nt, Homo sapiens
auuauucugauuccacuuuua

SEQ ID NO: 1442029 - RNA, 15 nt, Homo sapiens
auuauugugccucag

SEQ ID NO: 1442030 - RNA, 16 nt, Homo sapiens
auuauuuucacuguag

SEQ ID NO: 1442031 - RNA, 19 nt, Homo sapiens
auucaagaaacagaaguag

SEQ ID NO: 1442032 - RNA, 15 nt, Homo sapiens
auucaagugccucuu

SEQ ID NO: 1442033 - RNA, 22 nt, Homo sapiens
auucacagccaggagaugcugg

SEQ ID NO: 1442034 - RNA, 20 nt, Homo sapiens
auucacauaguuuauuucaa

SEQ ID NO: 1442035 - RNA, 23 nt, Homo sapiens
auucacuuauggcagaggaauau

SEQ ID NO: 1442036 - RNA, 21 nt, Homo sapiens
auucaggacuuaacggcucca

SEQ ID NO: 1442037 - RNA, 13 nt, Homo sapiens
auucauccaacag

SEQ ID NO: 1442038 - RNA, 14 nt, Homo sapiens
auucauccaacaga

SEQ ID NO: 1442039 - RNA, 18 nt, Homo sapiens
auucaucugggaggcaga

SEQ ID NO: 1442040 - RNA, 15 nt, Homo sapiens
auuccaaaacuuuaa

SEQ ID NO: 1442041 - RNA, 22 nt, Homo sapiens
auuccaacagcucaagucuucc

SEQ ID NO: 1442042 - RNA, 19 nt, Homo sapiens
auuccaaggaguuccauga

SEQ ID NO: 1442043 - RNA, 18 nt, Homo sapiens
auuccacuuuuauucauu

SEQ ID NO: 1442044 - RNA, 23 nt, Homo sapiens
auuccagagcacugcuccagugg

SEQ ID NO: 1442045 - RNA, 15 nt, Homo sapiens
auuccagcauuugcc

SEQ ID NO: 1442046 - RNA, 16 nt, Homo sapiens
auuccagcauuugcca

SEQ ID NO: 1442047 - RNA, 12 nt, Homo sapiens
auuccagugcag

SEQ ID NO: 1442048 - RNA, 22 nt, Homo sapiens
auuccauaaucaaucuaucaau

SEQ ID NO: 1442049 - RNA, 13 nt, Homo sapiens
auucccauucuac

SEQ ID NO: 1442050 - RNA, 13 nt, Homo sapiens
auucccuuuccca

SEQ ID NO: 1442051 - RNA, 20 nt, Homo sapiens
auuccuauauaguuuauuga

SEQ ID NO: 1442052 - RNA, 15 nt, Homo sapiens
auuccucagcugcca

SEQ ID NO: 1442053 - RNA, 15 nt, Homo sapiens
auuccuggcaugaca

SEQ ID NO: 1442054 - RNA, 15 nt, Homo sapiens
auuccuguagcaucu

SEQ ID NO: 1442055 - RNA, 18 nt, Homo sapiens
auuccuucacucauccag

SEQ ID NO: 1442056 - RNA, 14 nt, Homo sapiens
auuccuugauucac

SEQ ID NO: 1442057 - RNA, 13 nt, Homo sapiens
auucgccuguggg

SEQ ID NO: 1442058 - RNA, 18 nt, Homo sapiens
auucuacuucugucuucc

SEQ ID NO: 1442059 - RNA, 13 nt, Homo sapiens
auucuaggcaucc

SEQ ID NO: 1442060 - RNA, 13 nt, Homo sapiens
auucucaccagga

SEQ ID NO: 1442061 - RNA, 14 nt, Homo sapiens
auucucaccaggaa

SEQ ID NO: 1442062 - RNA, 14 nt, Homo sapiens
auucucacuccuac

SEQ ID NO: 1442063 - RNA, 19 nt, Homo sapiens
auucucuuacccagaauau

SEQ ID NO: 1442064 - RNA, 11 nt, Homo sapiens
auucugaccau

SEQ ID NO: 1442065 - RNA, 20 nt, Homo sapiens
auucuggcugcgggucucag

SEQ ID NO: 1442066 - RNA, 19 nt, Homo sapiens
auucuggucuucacugcca

SEQ ID NO: 1442067 - RNA, 16 nt, Homo sapiens
auucuguaagaaucaa

SEQ ID NO: 1442068 - RNA, 23 nt, Homo sapiens
auucuuaaaggaaaagucaacau

SEQ ID NO: 1442069 - RNA, 19 nt, Homo sapiens
auucuuaagggaacuucca

SEQ ID NO: 1442070 - RNA, 18 nt, Homo sapiens
auucuuaauaggcuuuau

SEQ ID NO: 1442071 - RNA, 15 nt, Homo sapiens
auucuucugccucag

SEQ ID NO: 1442072 - RNA, 14 nt, Homo sapiens
auugaaaauaugau

SEQ ID NO: 1442073 - RNA, 24 nt, Homo sapiens
auugaacuuucacauagcacagaa

SEQ ID NO: 1442074 - RNA, 17 nt, Homo sapiens
auugaagaaaagcacuu

SEQ ID NO: 1442075 - RNA, 21 nt, Homo sapiens
auugaaugauuacuauaugca

SEQ ID NO: 1442076 - RNA, 21 nt, Homo sapiens
auugaauguuuccaaccugga

SEQ ID NO: 1442077 - RNA, 15 nt, Homo sapiens
auugacaacauuuua

SEQ ID NO: 1442078 - RNA, 23 nt, Homo sapiens
auugaccucagcugcacauuccu

SEQ ID NO: 1442079 - RNA, 18 nt, Homo sapiens
auugacgcauauuuaacu

SEQ ID NO: 1442080 - RNA, 17 nt, Homo sapiens
auugacugucacuguuc

SEQ ID NO: 1442081 - RNA, 14 nt, Homo sapiens
auugagcugcagaa

SEQ ID NO: 1442082 - RNA, 19 nt, Homo sapiens
auugaucaaauauuucaac

SEQ ID NO: 1442083 - RNA, 13 nt, Homo sapiens
auugaugccagug

SEQ ID NO: 1442084 - RNA, 19 nt, Homo sapiens
auugaugccaguggaauac

SEQ ID NO: 1442085 - RNA, 13 nt, Homo sapiens
auugauguugcug

SEQ ID NO: 1442086 - RNA, 14 nt, Homo sapiens
auugauuauucuga

SEQ ID NO: 1442087 - RNA, 13 nt, Homo sapiens
auugcacuaugaa

SEQ ID NO: 1442088 - RNA, 11 nt, Homo sapiens
auugcacucag

SEQ ID NO: 1442089 - RNA, 13 nt, Homo sapiens
auugccugccaga

SEQ ID NO: 1442090 - RNA, 18 nt, Homo sapiens
auugcggggcccaccuua

SEQ ID NO: 1442091 - RNA, 19 nt, Homo sapiens
auuggaccauccuauuuaa

SEQ ID NO: 1442092 - RNA, 22 nt, Homo sapiens
auuggacuuccuugguuuggac

SEQ ID NO: 1442093 - RNA, 21 nt, Homo sapiens
auuggcaaacuuuguauuaau

SEQ ID NO: 1442094 - RNA, 13 nt, Homo sapiens
auugggugggggg

SEQ ID NO: 1442095 - RNA, 12 nt, Homo sapiens
auuggugcauuu

SEQ ID NO: 1442096 - RNA, 15 nt, Homo sapiens
auugguuucuaggca

SEQ ID NO: 1442097 - RNA, 13 nt, Homo sapiens
auuguacacuauc

SEQ ID NO: 1442098 - RNA, 18 nt, Homo sapiens
auuguauauucuggaaaa

SEQ ID NO: 1442099 - RNA, 22 nt, Homo sapiens
auuguauuuuagcaggguacau

SEQ ID NO: 1442100 - RNA, 16 nt, Homo sapiens
auugucagaguucugc

SEQ ID NO: 1442101 - RNA, 15 nt, Homo sapiens
auuguuaaaauaacu

SEQ ID NO: 1442102 - RNA, 21 nt, Homo sapiens
auuguucuuauccucaauuca

SEQ ID NO: 1442103 - RNA, 21 nt, Homo sapiens
auuuaaaaaacuaacacccag

SEQ ID NO: 1442104 - RNA, 18 nt, Homo sapiens
auuuaaaagcaucucagc

SEQ ID NO: 1442105 - RNA, 13 nt, Homo sapiens
auuuaaacuucuu

SEQ ID NO: 1442106 - RNA, 13 nt, Homo sapiens
auuuaacacuaaa

SEQ ID NO: 1442107 - RNA, 18 nt, Homo sapiens
auuuaaccuacuagacaa

SEQ ID NO: 1442108 - RNA, 12 nt, Homo sapiens
auuuaacuugag

SEQ ID NO: 1442109 - RNA, 22 nt, Homo sapiens
auuuaaggaagaaucuucugcc

SEQ ID NO: 1442110 - RNA, 13 nt, Homo sapiens
auuuaaguauaua

SEQ ID NO: 1442111 - RNA, 19 nt, Homo sapiens
auuuaauaagaaacaugau

SEQ ID NO: 1442112 - RNA, 19 nt, Homo sapiens
auuuaauggcaaugcaaaa

SEQ ID NO: 1442113 - RNA, 20 nt, Homo sapiens
auuuacugcaagaaguacau

SEQ ID NO: 1442114 - RNA, 11 nt, Homo sapiens
auuuacuuaac

SEQ ID NO: 1442115 - RNA, 20 nt, Homo sapiens
auuuacuuaauggguacaau

SEQ ID NO: 1442116 - RNA, 16 nt, Homo sapiens
auuuagauaugcaaaa

SEQ ID NO: 1442117 - RNA, 20 nt, Homo sapiens
auuuagauaugcaaaagcug

SEQ ID NO: 1442118 - RNA, 19 nt, Homo sapiens
auuuaggcaagagaaaaua

SEQ ID NO: 1442119 - RNA, 13 nt, Homo sapiens
auuuagugucuug

SEQ ID NO: 1442120 - RNA, 15 nt, Homo sapiens
auuuagugucuugaa

SEQ ID NO: 1442121 - RNA, 19 nt, Homo sapiens
auuuauaaacuagaucucc

SEQ ID NO: 1442122 - RNA, 13 nt, Homo sapiens
auuuaucccucaa

SEQ ID NO: 1442123 - RNA, 14 nt, Homo sapiens
auuuaucugugcaa

SEQ ID NO: 1442124 - RNA, 13 nt, Homo sapiens
auuuauguuuauu

SEQ ID NO: 1442125 - RNA, 13 nt, Homo sapiens
auuucaaaacaca

SEQ ID NO: 1442126 - RNA, 15 nt, Homo sapiens
auuucaacauaucau

SEQ ID NO: 1442127 - RNA, 14 nt, Homo sapiens
auuucacaucagcu

SEQ ID NO: 1442128 - RNA, 18 nt, Homo sapiens
auuucauaccuaucaucu

SEQ ID NO: 1442129 - RNA, 20 nt, Homo sapiens
auuucauaccuaucaucuua

SEQ ID NO: 1442130 - RNA, 21 nt, Homo sapiens
auuucauaccuaucaucuuaa

SEQ ID NO: 1442131 - RNA, 18 nt, Homo sapiens
auuucaucuacuacaggg

SEQ ID NO: 1442132 - RNA, 15 nt, Homo sapiens
auuucccaauacaua

SEQ ID NO: 1442133 - RNA, 15 nt, Homo sapiens
auuucccacacccca

SEQ ID NO: 1442134 - RNA, 19 nt, Homo sapiens
auuucccaccgcuuuguga

SEQ ID NO: 1442135 - RNA, 15 nt, Homo sapiens
auuucccagaaggga

SEQ ID NO: 1442136 - RNA, 20 nt, Homo sapiens
auuuccucccucacaugaua

SEQ ID NO: 1442137 - RNA, 18 nt, Homo sapiens
auuuccugcuacacaaaa

SEQ ID NO: 1442138 - RNA, 15 nt, Homo sapiens
auuucggagcaugaa

SEQ ID NO: 1442139 - RNA, 20 nt, Homo sapiens
auuucuccugacuccaguga

SEQ ID NO: 1442140 - RNA, 13 nt, Homo sapiens
auuucucuugcaa

SEQ ID NO: 1442141 - RNA, 17 nt, Homo sapiens
auuucugaaaugacaga

SEQ ID NO: 1442142 - RNA, 20 nt, Homo sapiens
auuugaaaacauaaucugca

SEQ ID NO: 1442143 - RNA, 14 nt, Homo sapiens
auuugaagaagagu

SEQ ID NO: 1442144 - RNA, 15 nt, Homo sapiens
auuugauuuugccca

SEQ ID NO: 1442145 - RNA, 14 nt, Homo sapiens
auuugcauauguau

SEQ ID NO: 1442146 - RNA, 15 nt, Homo sapiens
auuugccagcuuuau

SEQ ID NO: 1442147 - RNA, 13 nt, Homo sapiens
auuugcuaucaaa

SEQ ID NO: 1442148 - RNA, 13 nt, Homo sapiens
auuuggaaauuca

SEQ ID NO: 1442149 - RNA, 20 nt, Homo sapiens
auuuggauaaaaggaaccaa

SEQ ID NO: 1442150 - RNA, 17 nt, Homo sapiens
auuuguauuuugcuuaa

SEQ ID NO: 1442151 - RNA, 21 nt, Homo sapiens
auuuguggucacagccaugaa

SEQ ID NO: 1442152 - RNA, 23 nt, Homo sapiens
auuugugugugugauauaugcau

SEQ ID NO: 1442153 - RNA, 17 nt, Homo sapiens
auuuuaaaacagaagaa

SEQ ID NO: 1442154 - RNA, 16 nt, Homo sapiens
auuuuaaaacauaaga

SEQ ID NO: 1442155 - RNA, 20 nt, Homo sapiens
auuuuagcaggguacauauu

SEQ ID NO: 1442156 - RNA, 20 nt, Homo sapiens
auuuuccugaauauuaaucc

SEQ ID NO: 1442157 - RNA, 19 nt, Homo sapiens
auuuuccuuccuacacccu

SEQ ID NO: 1442158 - RNA, 19 nt, Homo sapiens
auuuucuggaauacaugaa

SEQ ID NO: 1442159 - RNA, 17 nt, Homo sapiens
auuuucuuuacagguau

SEQ ID NO: 1442160 - RNA, 22 nt, Homo sapiens
auuuugaggccagaggugcugu

SEQ ID NO: 1442161 - RNA, 18 nt, Homo sapiens
auuuugagucucaggccc

SEQ ID NO: 1442162 - RNA, 13 nt, Homo sapiens
auuuugcacuguu

SEQ ID NO: 1442163 - RNA, 23 nt, Homo sapiens
auuuugggggguaaucagcauua

SEQ ID NO: 1442164 - RNA, 22 nt, Homo sapiens
auuuugguuucuuccuuuccuc

SEQ ID NO: 1442165 - RNA, 19 nt, Homo sapiens
auuuugucaaaucauggcc

SEQ ID NO: 1442166 - RNA, 16 nt, Homo sapiens
auuuuuaacaccaugg

SEQ ID NO: 1442167 - RNA, 15 nt, Homo sapiens
auuuuuauacaccau

SEQ ID NO: 1442168 - RNA, 15 nt, Homo sapiens
auuuuuauacauauc

SEQ ID NO: 1442169 - RNA, 19 nt, Homo sapiens
auuuuugugaaaaugucaa

SEQ ID NO: 1442170 - RNA, 13 nt, Homo sapiens
auuuuugugauuu

SEQ ID NO: 1442171 - RNA, 22 nt, Homo sapiens
auuuuuguuuucauuaucucaa

SEQ ID NO: 1442172 - RNA, 21 nt, Homo sapiens
auuuuuuacagcugccugcag

SEQ ID NO: 1442173 - RNA, 16 nt, Homo sapiens
auuuuuuuaaaacaca

SEQ ID NO: 1442174 - RNA, 16 nt, Homo sapiens
auuuuuuuaacacaua

SEQ ID NO: 1442175 - RNA, 19 nt, Homo sapiens
auuuuuuuuguaacuucaa

SEQ ID NO: 1442176 - RNA, 18 nt, Homo sapiens
caaaaaaaaaccaugcau

SEQ ID NO: 1442177 - RNA, 14 nt, Homo sapiens
caaaaaaucuucca

SEQ ID NO: 1442178 - RNA, 14 nt, Homo sapiens
caaaaauaguauuc

SEQ ID NO: 1442179 - RNA, 20 nt, Homo sapiens
cacaauaaaggcugagcucu

SEQ ID NO: 1442180 - RNA, 15 nt, Homo sapiens
cacacaaacaccucc

SEQ ID NO: 1442181 - RNA, 22 nt, Homo sapiens
cacacaacuaggaaguggcuga

SEQ ID NO: 1442182 - RNA, 14 nt, Homo sapiens
cacacacacagaga

SEQ ID NO: 1442183 - RNA, 15 nt, Homo sapiens
cacacacacagagau

SEQ ID NO: 1442184 - RNA, 23 nt, Homo sapiens
cacacacagaugcacacacagau

SEQ ID NO: 1442185 - RNA, 15 nt, Homo sapiens
cacacacggaugcac

SEQ ID NO: 1442186 - RNA, 18 nt, Homo sapiens
cacacagcagcacugcag

SEQ ID NO: 1442187 - RNA, 11 nt, Homo sapiens
cacacauauac

SEQ ID NO: 1442188 - RNA, 15 nt, Homo sapiens
cacacauggaugcac

SEQ ID NO: 1442189 - RNA, 15 nt, Homo sapiens
cacaccaaugcgcac

SEQ ID NO: 1442190 - RNA, 15 nt, Homo sapiens
cacaccgaugcacac

SEQ ID NO: 1442191 - RNA, 19 nt, Homo sapiens
cacaccucuaggacuccac

SEQ ID NO: 1442192 - RNA, 19 nt, Homo sapiens
cacacggaugcacagagau

SEQ ID NO: 1442193 - RNA, 14 nt, Homo sapiens
cacacugacauuau

SEQ ID NO: 1442194 - RNA, 22 nt, Homo sapiens
cacacuguaaauauccacagac

SEQ ID NO: 1442195 - RNA, 20 nt, Homo sapiens
cacagaaauauauauacaua

SEQ ID NO: 1442196 - RNA, 14 nt, Homo sapiens
cacagaagccagga

SEQ ID NO: 1442197 - RNA, 21 nt, Homo sapiens
cacagacccacacauguuuac

SEQ ID NO: 1442198 - RNA, 13 nt, Homo sapiens
cacagacucccuc

SEQ ID NO: 1442199 - RNA, 16 nt, Homo sapiens
cacagacugcgauuug

SEQ ID NO: 1442200 - RNA, 22 nt, Homo sapiens
cacagagaggcugcucugccau

SEQ ID NO: 1442201 - RNA, 17 nt, Homo sapiens
cacagagauaugcacac

SEQ ID NO: 1442202 - RNA, 14 nt, Homo sapiens
cacagagaugcaug

SEQ ID NO: 1442203 - RNA, 19 nt, Homo sapiens
cacagagaugcaugcgcag

SEQ ID NO: 1442204 - RNA, 14 nt, Homo sapiens
cacagaugcacaca

SEQ ID NO: 1442205 - RNA, 19 nt, Homo sapiens
cacagaugcacacacagau

SEQ ID NO: 1442206 - RNA, 18 nt, Homo sapiens
cacagauggucacacaga

SEQ ID NO: 1442207 - RNA, 19 nt, Homo sapiens
cacagauuuuugggcucca

SEQ ID NO: 1442208 - RNA, 22 nt, Homo sapiens
cacaggaaaccaacacccaaag

SEQ ID NO: 1442209 - RNA, 18 nt, Homo sapiens
cacaggauccuauucuca

SEQ ID NO: 1442210 - RNA, 23 nt, Homo sapiens
cacaggcugggauggagcacuuc

SEQ ID NO: 1442211 - RNA, 13 nt, Homo sapiens
cacaggggagcag

SEQ ID NO: 1442212 - RNA, 13 nt, Homo sapiens
cacaggggcccca

SEQ ID NO: 1442213 - RNA, 13 nt, Homo sapiens
cacagugcaucuc

SEQ ID NO: 1442214 - RNA, 20 nt, Homo sapiens
cacauaauuugaauggugca

SEQ ID NO: 1442215 - RNA, 17 nt, Homo sapiens
cacauagagauaugcac

SEQ ID NO: 1442216 - RNA, 12 nt, Homo sapiens
cacauagcacag

SEQ ID NO: 1442217 - RNA, 17 nt, Homo sapiens
cacauaggcaauaucuu

SEQ ID NO: 1442218 - RNA, 22 nt, Homo sapiens
cacauaggcaauaucuuuaaua

SEQ ID NO: 1442219 - RNA, 14 nt, Homo sapiens
cacauauacauaua

SEQ ID NO: 1442220 - RNA, 13 nt, Homo sapiens
cacauauucacau

SEQ ID NO: 1442221 - RNA, 17 nt, Homo sapiens
cacaucacuacaguaca

SEQ ID NO: 1442222 - RNA, 13 nt, Homo sapiens
cacaucagcuuua

SEQ ID NO: 1442223 - RNA, 14 nt, Homo sapiens
cacaucagugcaca

SEQ ID NO: 1442224 - RNA, 18 nt, Homo sapiens
cacauccaccccacugga

SEQ ID NO: 1442225 - RNA, 18 nt, Homo sapiens
cacauccauucccaagaa

SEQ ID NO: 1442226 - RNA, 15 nt, Homo sapiens
cacaucccuuugaaa

SEQ ID NO: 1442227 - RNA, 20 nt, Homo sapiens
cacaucgcuacgcccaggag

SEQ ID NO: 1442228 - RNA, 21 nt, Homo sapiens
cacaugaaaaccauuaccuga

SEQ ID NO: 1442229 - RNA, 15 nt, Homo sapiens
cacaugcagucucag

SEQ ID NO: 1442230 - RNA, 23 nt, Homo sapiens
cacauguguucucuauuuugccu

SEQ ID NO: 1442231 - RNA, 20 nt, Homo sapiens
cacauguuauccacaagcaa

SEQ ID NO: 1442232 - RNA, 17 nt, Homo sapiens
cacauuacuugcacaag

SEQ ID NO: 1442233 - RNA, 15 nt, Homo sapiens
cacauucggacccug

SEQ ID NO: 1442234 - RNA, 21 nt, Homo sapiens
caccaaacugcacacacagcu

SEQ ID NO: 1442235 - RNA, 18 nt, Homo sapiens
caccaacuggagcacuga

SEQ ID NO: 1442236 - RNA, 21 nt, Homo sapiens
caccaauguacccaccgggcc

SEQ ID NO: 1442237 - RNA, 19 nt, Homo sapiens
caccaauuguacauucccu

SEQ ID NO: 1442238 - RNA, 20 nt, Homo sapiens
caccaauuguacauucccug

SEQ ID NO: 1442239 - RNA, 15 nt, Homo sapiens
caccacuuugucucu

SEQ ID NO: 1442240 - RNA, 16 nt, Homo sapiens
caccagaauugugcaa

SEQ ID NO: 1442241 - RNA, 16 nt, Homo sapiens
caccagcuaucuguca

SEQ ID NO: 1442242 - RNA, 15 nt, Homo sapiens
caccagucacugucc

SEQ ID NO: 1442243 - RNA, 22 nt, Homo sapiens
caccaguguccccuccacuguc

SEQ ID NO: 1442244 - RNA, 17 nt, Homo sapiens
caccaucaaaugcugua

SEQ ID NO: 1442245 - RNA, 16 nt, Homo sapiens
caccauguaacaacca

SEQ ID NO: 1442246 - RNA, 20 nt, Homo sapiens
caccauguaacaaccagaga

SEQ ID NO: 1442247 - RNA, 20 nt, Homo sapiens
caccauuguuccuuaccuuu

SEQ ID NO: 1442248 - RNA, 21 nt, Homo sapiens
caccauuguuccuuaccuuua

SEQ ID NO: 1442249 - RNA, 13 nt, Homo sapiens
cacccagcaaaga

SEQ ID NO: 1442250 - RNA, 18 nt, Homo sapiens
cacccaugaaucaaagac

SEQ ID NO: 1442251 - RNA, 19 nt, Homo sapiens
ccaugucgccucugcauuc

SEQ ID NO: 1442252 - RNA, 13 nt, Homo sapiens
ccauguuauguga

SEQ ID NO: 1442253 - RNA, 22 nt, Homo sapiens
ccauguuaugugacuaucuuua

SEQ ID NO: 1442254 - RNA, 15 nt, Homo sapiens
ccauguuuaaacuuu

SEQ ID NO: 1442255 - RNA, 15 nt, Homo sapiens
cccgaaugccuguca

SEQ ID NO: 1442256 - RNA, 18 nt, Homo sapiens
cccgcaguugugccaaag

SEQ ID NO: 1442257 - RNA, 22 nt, Homo sapiens
cccgccucuucuucuucagaag

SEQ ID NO: 1442258 - RNA, 15 nt, Homo sapiens
cccgcggugcucugg

SEQ ID NO: 1442259 - RNA, 23 nt, Homo sapiens
cccgcugggauuucuucgcugcu

SEQ ID NO: 1442260 - RNA, 11 nt, Homo sapiens
ccuauuugcac

SEQ ID NO: 1442261 - RNA, 20 nt, Homo sapiens
ccuauuuggggcuugcaugc

SEQ ID NO: 1442262 - RNA, 22 nt, Homo sapiens
ccucaaaguuggggcaggcugg

SEQ ID NO: 1442263 - RNA, 19 nt, Homo sapiens
ccucaacaacaaaccaaaa

SEQ ID NO: 1442264 - RNA, 20 nt, Homo sapiens
ccucaacaacaaaccaaaac

SEQ ID NO: 1442265 - RNA, 22 nt, Homo sapiens
ccucacuccuguuacuuaccua

SEQ ID NO: 1442266 - RNA, 17 nt, Homo sapiens
ccucacugaaugccuca

SEQ ID NO: 1442267 - RNA, 11 nt, Homo sapiens
ccucagaugau

SEQ ID NO: 1442268 - RNA, 14 nt, Homo sapiens
ccucagccaugagg

SEQ ID NO: 1442269 - RNA, 18 nt, Homo sapiens
ccucagcugcacauuccu

SEQ ID NO: 1442270 - RNA, 18 nt, Homo sapiens
ccucagggacaacauuuu

SEQ ID NO: 1442271 - RNA, 23 nt, Homo sapiens
ccucagggacagagacaccugca

SEQ ID NO: 1442272 - RNA, 23 nt, Homo sapiens
ccucagugccacuugacauuccu

SEQ ID NO: 1442273 - RNA, 12 nt, Homo sapiens
ccuccacuccac

SEQ ID NO: 1442274 - RNA, 17 nt, Homo sapiens
ccuccagagacaggaaa

SEQ ID NO: 1442275 - RNA, 19 nt, Homo sapiens
ccuccagcuccaguuucca

SEQ ID NO: 1442276 - RNA, 16 nt, Homo sapiens
ccuccagguauuugag

SEQ ID NO: 1442277 - RNA, 20 nt, Homo sapiens
ccuccauuucucuccaggaa

SEQ ID NO: 1442278 - RNA, 12 nt, Homo sapiens
ccucccaaagug

SEQ ID NO: 1442279 - RNA, 22 nt, Homo sapiens
ccucccagcagcgguaccccag

SEQ ID NO: 1442280 - RNA, 20 nt, Homo sapiens
ccucccaguuugcuggguuu

SEQ ID NO: 1442281 - RNA, 17 nt, Homo sapiens
ccuccccacaguccuca

SEQ ID NO: 1442282 - RNA, 15 nt, Homo sapiens
ccuccccacccugac

SEQ ID NO: 1442283 - RNA, 20 nt, Homo sapiens
ccucccgggggcacugccug

SEQ ID NO: 1442284 - RNA, 15 nt, Homo sapiens
ccucccuggucccuu

SEQ ID NO: 1442285 - RNA, 18 nt, Homo sapiens
ccuccuaaccuagagauu

SEQ ID NO: 1442286 - RNA, 23 nt, Homo sapiens
ccuccuaauuugaucacaguggc

SEQ ID NO: 1442287 - RNA, 14 nt, Homo sapiens
ccuccuccugacca

SEQ ID NO: 1442288 - RNA, 13 nt, Homo sapiens
ccuccucuuccuc

SEQ ID NO: 1442289 - RNA, 16 nt, Homo sapiens
ccuccugccuccagca

SEQ ID NO: 1442290 - RNA, 17 nt, Homo sapiens
ccuccugggaccaugga

SEQ ID NO: 1442291 - RNA, 20 nt, Homo sapiens
ccuccuuuucuuucucucuc

SEQ ID NO: 1442292 - RNA, 15 nt, Homo sapiens
ccuccuuuugcuuga

SEQ ID NO: 1442293 - RNA, 13 nt, Homo sapiens
ccucuaauugcau

SEQ ID NO: 1442294 - RNA, 13 nt, Homo sapiens
ccucuacugggaa

SEQ ID NO: 1442295 - RNA, 21 nt, Homo sapiens
ccucucccgcgggccuggaca

SEQ ID NO: 1442296 - RNA, 21 nt, Homo sapiens
ccucuccuuggaaauacuuua

SEQ ID NO: 1442297 - RNA, 19 nt, Homo sapiens
ccucugaaauuucccacac

SEQ ID NO: 1442298 - RNA, 19 nt, Homo sapiens
ccucugauacccagagcau

SEQ ID NO: 1442299 - RNA, 17 nt, Homo sapiens
ccucugcagcacuuuaa

SEQ ID NO: 1442300 - RNA, 18 nt, Homo sapiens
ccucuguugccaggcuag

SEQ ID NO: 1442301 - RNA, 22 nt, Homo sapiens
ccucuuccagggccucugggag

SEQ ID NO: 1442302 - RNA, 18 nt, Homo sapiens
ccucuuccccuugcccuu

SEQ ID NO: 1442303 - RNA, 13 nt, Homo sapiens
ccucuugcuauug

SEQ ID NO: 1442304 - RNA, 21 nt, Homo sapiens
ccucuuggaccucugcucuga

SEQ ID NO: 1442305 - RNA, 17 nt, Homo sapiens
ccucuuuccccaccucu

SEQ ID NO: 1442306 - RNA, 22 nt, Homo sapiens
ccucuuucuacauucucaucua

SEQ ID NO: 1442307 - RNA, 14 nt, Homo sapiens
ccugaaaaacugau

SEQ ID NO: 1442308 - RNA, 20 nt, Homo sapiens
ccugaagggugacaucccag

SEQ ID NO: 1442309 - RNA, 15 nt, Homo sapiens
ccugacaccaccauc

SEQ ID NO: 1442310 - RNA, 14 nt, Homo sapiens
ccugacaugucuca

SEQ ID NO: 1442311 - RNA, 21 nt, Homo sapiens
ccugacauuaagacacaccuc

SEQ ID NO: 1442312 - RNA, 13 nt, Homo sapiens
ccugaccgugcua

SEQ ID NO: 1442313 - RNA, 20 nt, Homo sapiens
ccugacuccucuaagccacu

SEQ ID NO: 1442314 - RNA, 22 nt, Homo sapiens
ccugagauggggaugagggcag

SEQ ID NO: 1442315 - RNA, 15 nt, Homo sapiens
ccugaggguccccac

SEQ ID NO: 1442316 - RNA, 19 nt, Homo sapiens
ccugaguuugggauugugg

SEQ ID NO: 1442317 - RNA, 13 nt, Homo sapiens
ccugauaagcaaa

SEQ ID NO: 1442318 - RNA, 13 nt, Homo sapiens
ccugaucaccucu

SEQ ID NO: 1442319 - RNA, 14 nt, Homo sapiens
ccugaucaugguca

SEQ ID NO: 1442320 - RNA, 12 nt, Homo sapiens
ccugauggugcu

SEQ ID NO: 1442321 - RNA, 23 nt, Homo sapiens
ccugauuagaugacucucagucc

SEQ ID NO: 1442322 - RNA, 17 nt, Homo sapiens
ccugcaaagggaacuga

SEQ ID NO: 1442323 - RNA, 24 nt, Homo sapiens
ccugcaccgagagagauggaauaa

SEQ ID NO: 1442324 - RNA, 13 nt, Homo sapiens
ccugcacuacucu

SEQ ID NO: 1442325 - RNA, 12 nt, Homo sapiens
ccugcacuccag

SEQ ID NO: 1442326 - RNA, 18 nt, Homo sapiens
ccugcacuccagaaucca

SEQ ID NO: 1442327 - RNA, 14 nt, Homo sapiens
ccugcauccaaucu

SEQ ID NO: 1442328 - RNA, 21 nt, Homo sapiens
ccugcccacuuagccguccau

SEQ ID NO: 1442329 - RNA, 15 nt, Homo sapiens
ccugcccaugugucc

SEQ ID NO: 1442330 - RNA, 14 nt, Homo sapiens
ccugccuaggaauu

SEQ ID NO: 1442331 - RNA, 10 nt, Homo sapiens
ccugccugua

SEQ ID NO: 1442332 - RNA, 10 nt, Homo sapiens
ccugccuuca

SEQ ID NO: 1442333 - RNA, 17 nt, Homo sapiens
ccugccuuugaaauucc

SEQ ID NO: 1442334 - RNA, 23 nt, Homo sapiens
ccugcgaaguggcucucaggggc

SEQ ID NO: 1442335 - RNA, 19 nt, Homo sapiens
ccugcgagaggucccugcu

SEQ ID NO: 1442336 - RNA, 13 nt, Homo sapiens
ccugcgggcaccu

SEQ ID NO: 1442337 - RNA, 20 nt, Homo sapiens
ccugcuacacaaaagccaaa

SEQ ID NO: 1442338 - RNA, 15 nt, Homo sapiens
aaaauaguaagccuc

SEQ ID NO: 1442339 - RNA, 18 nt, Homo sapiens
aaaauaguaagccucccu

SEQ ID NO: 1442340 - RNA, 22 nt, Homo sapiens
aaaaucacaaggcaacugugag

SEQ ID NO: 1442341 - RNA, 22 nt, Homo sapiens
aaaaucaucuuggccacuuuaa

SEQ ID NO: 1442342 - RNA, 13 nt, Homo sapiens
aaaauccaacuaa

SEQ ID NO: 1442343 - RNA, 13 nt, Homo sapiens
aaaaugaaauguc

SEQ ID NO: 1442344 - RNA, 22 nt, Homo sapiens
aaaauggagggagccaucccuu

SEQ ID NO: 1442345 - RNA, 16 nt, Homo sapiens
aaaauggccauuugcu

SEQ ID NO: 1442346 - RNA, 17 nt, Homo sapiens
aaaaugugucuguaaga

SEQ ID NO: 1442347 - RNA, 9 nt, Homo sapiens
aaaauugca

SEQ ID NO: 1442348 - RNA, 13 nt, Homo sapiens
aaacaaacccagg

SEQ ID NO: 1442349 - RNA, 21 nt, Homo sapiens
aaacaacuuguguucuauuaa

SEQ ID NO: 1442350 - RNA, 18 nt, Homo sapiens
aaacaaggggcuguuaca

SEQ ID NO: 1442351 - RNA, 15 nt, Homo sapiens
aaacacaaaccacaa

SEQ ID NO: 1442352 - RNA, 16 nt, Homo sapiens
aaacaggaccacaaaa

SEQ ID NO: 1442353 - RNA, 12 nt, Homo sapiens
aaacaguucuug

SEQ ID NO: 1442354 - RNA, 15 nt, Homo sapiens
aaacaguucuuggac

SEQ ID NO: 1442355 - RNA, 22 nt, Homo sapiens
aaacauacccuuuaucucugua

SEQ ID NO: 1442356 - RNA, 22 nt, Homo sapiens
aaacauucaucaagcuguacau

SEQ ID NO: 1442357 - RNA, 11 nt, Homo sapiens
aaacauucucu

SEQ ID NO: 1442358 - RNA, 17 nt, Homo sapiens
aaaccaagauagaucca

SEQ ID NO: 1442359 - RNA, 21 nt, Homo sapiens
aaaccaagucuacuucacuaa

SEQ ID NO: 1442360 - RNA, 17 nt, Homo sapiens
aaaccaauaguccccau

SEQ ID NO: 1442361 - RNA, 19 nt, Homo sapiens
aaaccaaugagcuguaucu

SEQ ID NO: 1442362 - RNA, 17 nt, Homo sapiens
aaaccacuguacauaua

SEQ ID NO: 1442363 - RNA, 12 nt, Homo sapiens
aaacccaaauaa

SEQ ID NO: 1442364 - RNA, 23 nt, Homo sapiens
aaacccaaauaaauguguaaaug

SEQ ID NO: 1442365 - RNA, 15 nt, Homo sapiens
aaacccagcucccuu

SEQ ID NO: 1442366 - RNA, 21 nt, Homo sapiens
aaacccagcucccuucuuccc

SEQ ID NO: 1442367 - RNA, 15 nt, Homo sapiens
aaacccaucagacag

SEQ ID NO: 1442368 - RNA, 14 nt, Homo sapiens
aaacccugucucua

SEQ ID NO: 1442369 - RNA, 17 nt, Homo sapiens
aaacccuucucuucucc

SEQ ID NO: 1442370 - RNA, 16 nt, Homo sapiens
aaacccuucuuuacua

SEQ ID NO: 1442371 - RNA, 17 nt, Homo sapiens
aaaccuggagaugauga

SEQ ID NO: 1442372 - RNA, 19 nt, Homo sapiens
aaaccuuuccccagacaca

SEQ ID NO: 1442373 - RNA, 16 nt, Homo sapiens
aaacuaaaucucuaau

SEQ ID NO: 1442374 - RNA, 18 nt, Homo sapiens
aaacuacacaucccuaau

SEQ ID NO: 1442375 - RNA, 21 nt, Homo sapiens
aaacugagaugugaacacauc

SEQ ID NO: 1442376 - RNA, 17 nt, Homo sapiens
aaacugcacugccaugu

SEQ ID NO: 1442377 - RNA, 15 nt, Homo sapiens
aaacugccuuucugc

SEQ ID NO: 1442378 - RNA, 17 nt, Homo sapiens
aaacuggcuguuugaua

SEQ ID NO: 1442379 - RNA, 22 nt, Homo sapiens
aaacugggugggauggaugcug

SEQ ID NO: 1442380 - RNA, 16 nt, Homo sapiens
aaacuguuaucacuua

SEQ ID NO: 1442381 - RNA, 15 nt, Homo sapiens
aaacuucauggucau

SEQ ID NO: 1442382 - RNA, 16 nt, Homo sapiens
aaacuugggucucuua

SEQ ID NO: 1442383 - RNA, 17 nt, Homo sapiens
aaacuuuagaguagcau

SEQ ID NO: 1442384 - RNA, 21 nt, Homo sapiens
aaagaagacgcucagcacugu

SEQ ID NO: 1442385 - RNA, 22 nt, Homo sapiens
aaagaaggaauucuaggcaucc

SEQ ID NO: 1442386 - RNA, 18 nt, Homo sapiens
aaagaauaaaugaaucuu

SEQ ID NO: 1442387 - RNA, 14 nt, Homo sapiens
aaagaauacagaaa

SEQ ID NO: 1442388 - RNA, 20 nt, Homo sapiens
aaagacaaaacuuccuguuu

SEQ ID NO: 1442389 - RNA, 18 nt, Homo sapiens
aaagacaccuacugagug

SEQ ID NO: 1442390 - RNA, 15 nt, Homo sapiens
aaagacagaauguca

SEQ ID NO: 1442391 - RNA, 20 nt, Homo sapiens
aaagaccaauauucaaaugc

SEQ ID NO: 1442392 - RNA, 15 nt, Homo sapiens
aaagacuacacuguu

SEQ ID NO: 1442393 - RNA, 16 nt, Homo sapiens
aaagacuacacuguug

SEQ ID NO: 1442394 - RNA, 14 nt, Homo sapiens
aaagacuccaaaga

SEQ ID NO: 1442395 - RNA, 17 nt, Homo sapiens
aaagacugauuaccucc

SEQ ID NO: 1442396 - RNA, 12 nt, Homo sapiens
cucugucagcca

SEQ ID NO: 1442397 - RNA, 19 nt, Homo sapiens
cucugugaggaaagcacac

SEQ ID NO: 1442398 - RNA, 23 nt, Homo sapiens
cucugugguuuuaaucuucucau

SEQ ID NO: 1442399 - RNA, 19 nt, Homo sapiens
cucuuagcuuucucagggg

SEQ ID NO: 1442400 - RNA, 18 nt, Homo sapiens
cucuucaacugaccagcc

SEQ ID NO: 1442401 - RNA, 20 nt, Homo sapiens
cucuuccaaaggcauaagac

SEQ ID NO: 1442402 - RNA, 15 nt, Homo sapiens
cucuucccaccucag

SEQ ID NO: 1442403 - RNA, 17 nt, Homo sapiens
cucuuccuuacucccag

SEQ ID NO: 1442404 - RNA, 23 nt, Homo sapiens
cucuucuacguauaaauaugaaa

SEQ ID NO: 1442405 - RNA, 16 nt, Homo sapiens
cucuucucuauuccug

SEQ ID NO: 1442406 - RNA, 14 nt, Homo sapiens
cucuugcauugcaa

SEQ ID NO: 1442407 - RNA, 16 nt, Homo sapiens
cucuugccagcauuuu

SEQ ID NO: 1442408 - RNA, 20 nt, Homo sapiens
cucuugcuuuguucuuuauu

SEQ ID NO: 1442409 - RNA, 21 nt, Homo sapiens
cucuugugcccuucugagccc

SEQ ID NO: 1442410 - RNA, 15 nt, Homo sapiens
cucuuuccuuccuuc

SEQ ID NO: 1442411 - RNA, 14 nt, Homo sapiens
cugaaaaacugauc

SEQ ID NO: 1442412 - RNA, 23 nt, Homo sapiens
cugaaaaaugguaauuguugcua

SEQ ID NO: 1442413 - RNA, 15 nt, Homo sapiens
cugaaaaucuaauau

SEQ ID NO: 1442414 - RNA, 13 nt, Homo sapiens
cugaaacaaaagu

SEQ ID NO: 1442415 - RNA, 15 nt, Homo sapiens
cugaaagcaguguau

SEQ ID NO: 1442416 - RNA, 16 nt, Homo sapiens
cugaaaggcacacuuu

SEQ ID NO: 1442417 - RNA, 21 nt, Homo sapiens
cugaagaaaaugaagcccuau

SEQ ID NO: 1442418 - RNA, 16 nt, Homo sapiens
cugaagacaaaccacu

SEQ ID NO: 1442419 - RNA, 22 nt, Homo sapiens
cugaagacuuacuuauucuucc

SEQ ID NO: 1442420 - RNA, 11 nt, Homo sapiens
cugaagccaga

SEQ ID NO: 1442421 - RNA, 17 nt, Homo sapiens
cugaauauaacaaccuu

SEQ ID NO: 1442422 - RNA, 22 nt, Homo sapiens
cugaauauggacccugcugaaa

SEQ ID NO: 1442423 - RNA, 18 nt, Homo sapiens
cugaaugugccuaaugga

SEQ ID NO: 1442424 - RNA, 14 nt, Homo sapiens
cugacaagcacugc

SEQ ID NO: 1442425 - RNA, 15 nt, Homo sapiens
cugacacaagaggaa

SEQ ID NO: 1442426 - RNA, 13 nt, Homo sapiens
cugacacaggaaa

SEQ ID NO: 1442427 - RNA, 15 nt, Homo sapiens
cugacaccaccaucu

SEQ ID NO: 1442428 - RNA, 12 nt, Homo sapiens
cugacaccuacc

SEQ ID NO: 1442429 - RNA, 17 nt, Homo sapiens
cugaccaacauggugaa

SEQ ID NO: 1442430 - RNA, 22 nt, Homo sapiens
cugacccuaaauguggacauca

SEQ ID NO: 1442431 - RNA, 20 nt, Homo sapiens
cugacccuccuccacuccac

SEQ ID NO: 1442432 - RNA, 16 nt, Homo sapiens
cugacgacacugaaga

SEQ ID NO: 1442433 - RNA, 14 nt, Homo sapiens
cugacuaccagcua

SEQ ID NO: 1442434 - RNA, 21 nt, Homo sapiens
cugacucacaagaagaccaga

SEQ ID NO: 1442435 - RNA, 15 nt, Homo sapiens
cugacuuugugaucc

SEQ ID NO: 1442436 - RNA, 18 nt, Homo sapiens
cugagaaacuuccuuuga

SEQ ID NO: 1442437 - RNA, 18 nt, Homo sapiens
cugagaaagacuauucaa

SEQ ID NO: 1442438 - RNA, 16 nt, Homo sapiens
cugagaauagugucug

SEQ ID NO: 1442439 - RNA, 15 nt, Homo sapiens
cuccagagacaggaa

SEQ ID NO: 1442440 - RNA, 16 nt, Homo sapiens
cuccagaggccaagga

SEQ ID NO: 1442441 - RNA, 20 nt, Homo sapiens
cuccaguuuccaaguuccug

SEQ ID NO: 1442442 - RNA, 17 nt, Homo sapiens
cuccaucaugcuugauu

SEQ ID NO: 1442443 - RNA, 19 nt, Homo sapiens
cuccauccggcuccuguca

SEQ ID NO: 1442444 - RNA, 17 nt, Homo sapiens
cuccaucuccacuccag

SEQ ID NO: 1442445 - RNA, 15 nt, Homo sapiens
cuccauuacuaaaga

SEQ ID NO: 1442446 - RNA, 15 nt, Homo sapiens
cucccacauugucac

SEQ ID NO: 1442447 - RNA, 13 nt, Homo sapiens
cucccaggaccaa

SEQ ID NO: 1442448 - RNA, 15 nt, Homo sapiens
cucccaggaccaaga

SEQ ID NO: 1442449 - RNA, 21 nt, Homo sapiens
cuccccagcccuuugcaggcc

SEQ ID NO: 1442450 - RNA, 17 nt, Homo sapiens
cucccccugccagugcc

SEQ ID NO: 1442451 - RNA, 12 nt, Homo sapiens
cuccccuaucca

SEQ ID NO: 1442452 - RNA, 13 nt, Homo sapiens
cuccccuuugccu

SEQ ID NO: 1442453 - RNA, 21 nt, Homo sapiens
cucccuaaccaaaugcugucu

SEQ ID NO: 1442454 - RNA, 19 nt, Homo sapiens
cucccuguguggcugcuga

SEQ ID NO: 1442455 - RNA, 20 nt, Homo sapiens
cuccgaauaaacgugcuccc

SEQ ID NO: 1442456 - RNA, 15 nt, Homo sapiens
cuccguguagugucu

SEQ ID NO: 1442457 - RNA, 12 nt, Homo sapiens
cuccuaaccuag

SEQ ID NO: 1442458 - RNA, 13 nt, Homo sapiens
cuccuaaccuaga

SEQ ID NO: 1442459 - RNA, 20 nt, Homo sapiens
cuccuaccugcugcugcuau

SEQ ID NO: 1442460 - RNA, 20 nt, Homo sapiens
cuccuagaggugggcagcug

SEQ ID NO: 1442461 - RNA, 13 nt, Homo sapiens
cuccucagacugc

SEQ ID NO: 1442462 - RNA, 21 nt, Homo sapiens
cuccucagaucugaacacagu

SEQ ID NO: 1442463 - RNA, 17 nt, Homo sapiens
cuccucccaacucuagc

SEQ ID NO: 1442464 - RNA, 19 nt, Homo sapiens
cuccucccaggaacugggc

SEQ ID NO: 1442465 - RNA, 21 nt, Homo sapiens
cuccucccaggaacugggcca

SEQ ID NO: 1442466 - RNA, 13 nt, Homo sapiens
cuccucuaucaca

SEQ ID NO: 1442467 - RNA, 15 nt, Homo sapiens
cuccucuaucacauu

SEQ ID NO: 1442468 - RNA, 21 nt, Homo sapiens
cuccucuccuagccccuguca

SEQ ID NO: 1442469 - RNA, 18 nt, Homo sapiens
cuccucucucuacuugaa

SEQ ID NO: 1442470 - RNA, 13 nt, Homo sapiens
cuccugugugcug

SEQ ID NO: 1442471 - RNA, 13 nt, Homo sapiens
cuccuguuuccau

SEQ ID NO: 1442472 - RNA, 21 nt, Homo sapiens
cuccuuaauagccauaugcaa

SEQ ID NO: 1442473 - RNA, 20 nt, Homo sapiens
cuccuuggucuaagugugcu

SEQ ID NO: 1442474 - RNA, 18 nt, Homo sapiens
cuccuuuugaccaaauaa

SEQ ID NO: 1442475 - RNA, 18 nt, Homo sapiens
cuccuuuuucuaccuuuu

SEQ ID NO: 1442476 - RNA, 16 nt, Homo sapiens
cucggccucccaaagu

SEQ ID NO: 1442477 - RNA, 21 nt, Homo sapiens
cucgggugcauuugagagaag

SEQ ID NO: 1442478 - RNA, 22 nt, Homo sapiens
cucggugaugcggacaucucag

SEQ ID NO: 1442479 - RNA, 16 nt, Homo sapiens
cucgguguaaaaccau

SEQ ID NO: 1442480 - RNA, 11 nt, Homo sapiens
cucguccuccc

SEQ ID NO: 1442481 - RNA, 20 nt, Homo sapiens
cucuaaaaauaaaaugaugu

SEQ ID NO: 1442482 - RNA, 17 nt, Homo sapiens
cucuaacgccugagccc

SEQ ID NO: 1442483 - RNA, 14 nt, Homo sapiens
cucuaaguuuagaa

SEQ ID NO: 1442484 - RNA, 16 nt, Homo sapiens
cucuacagacuucucc

SEQ ID NO: 1442485 - RNA, 23 nt, Homo sapiens
cucuacuacuuuuacuacaguga

SEQ ID NO: 1442486 - RNA, 21 nt, Homo sapiens
cucuacuugaauacucucaca

SEQ ID NO: 1442487 - RNA, 21 nt, Homo sapiens
cucuagaacaugcacauuuau

SEQ ID NO: 1442488 - RNA, 15 nt, Homo sapiens
cucuagagaacaugc

SEQ ID NO: 1442489 - RNA, 14 nt, Homo sapiens
cucuagauugagag

SEQ ID NO: 1442490 - RNA, 17 nt, Homo sapiens
cucuagcuacacuauug

SEQ ID NO: 1442491 - RNA, 17 nt, Homo sapiens
cucuaggccuguugccu

SEQ ID NO: 1442492 - RNA, 16 nt, Homo sapiens
cucuaugccccaaaua

SEQ ID NO: 1442493 - RNA, 13 nt, Homo sapiens
cucuauguaugca

SEQ ID NO: 1442494 - RNA, 15 nt, Homo sapiens
cucuauguaugcauc

SEQ ID NO: 1442495 - RNA, 22 nt, Homo sapiens
cucucaccgggcuacuaccugg

SEQ ID NO: 1442496 - RNA, 22 nt, Homo sapiens
cucucaggcgcaugugccaguu

SEQ ID NO: 1442497 - RNA, 13 nt, Homo sapiens
cucucaggggcca

SEQ ID NO: 1442498 - RNA, 13 nt, Homo sapiens
cucuccugcugca

SEQ ID NO: 1442499 - RNA, 19 nt, Homo sapiens
cucuccuuccuuacccaaa

SEQ ID NO: 1442500 - RNA, 19 nt, Homo sapiens
cucuccuuuggccauucca

SEQ ID NO: 1442501 - RNA, 18 nt, Homo sapiens
cucucuaaaaauaaaaug

SEQ ID NO: 1442502 - RNA, 13 nt, Homo sapiens
cucucugccuauu

SEQ ID NO: 1442503 - RNA, 19 nt, Homo sapiens
cucugaaacaaaaguauuu

SEQ ID NO: 1442504 - RNA, 19 nt, Homo sapiens
cucugaaaucucagaauuc

SEQ ID NO: 1442505 - RNA, 15 nt, Homo sapiens
cucugaaauuuccca

SEQ ID NO: 1442506 - RNA, 22 nt, Homo sapiens
cucugaauauuuuguaauaaag

SEQ ID NO: 1442507 - RNA, 20 nt, Homo sapiens
cucugacuggagucuaggaa

SEQ ID NO: 1442508 - RNA, 14 nt, Homo sapiens
cucugagaacagac

SEQ ID NO: 1442509 - RNA, 22 nt, Homo sapiens
cucugagaacagacguuaccaa

SEQ ID NO: 1442510 - RNA, 15 nt, Homo sapiens
cucugagugcuagcu

SEQ ID NO: 1442511 - RNA, 15 nt, Homo sapiens
cucugauaugggacu

SEQ ID NO: 1442512 - RNA, 16 nt, Homo sapiens
cucugauaugggacug

SEQ ID NO: 1442513 - RNA, 13 nt, Homo sapiens
cucugcaguauuu

SEQ ID NO: 1442514 - RNA, 14 nt, Homo sapiens
cucugcugaaggaa

SEQ ID NO: 1442515 - RNA, 13 nt, Homo sapiens
cucugcugcauuu

SEQ ID NO: 1442516 - RNA, 17 nt, Homo sapiens
cucuggaaaaugugacc

SEQ ID NO: 1442517 - RNA, 15 nt, Homo sapiens
cucuggaccagccug

SEQ ID NO: 1442518 - RNA, 19 nt, Homo sapiens
cucuggaccagccuguugg

SEQ ID NO: 1442519 - RNA, 16 nt, Homo sapiens
cucuggagccagagag

SEQ ID NO: 1442520 - RNA, 23 nt, Homo sapiens
cucuggccucagccgacugcaca

SEQ ID NO: 1442521 - RNA, 19 nt, Homo sapiens
cucuggcuuugucucuagc

SEQ ID NO: 1442522 - RNA, 21 nt, Homo sapiens
cucuggcuuugucucuagccg

SEQ ID NO: 1442523 - RNA, 22 nt, Homo sapiens
cucuggguagguguugaaaaug

SEQ ID NO: 1442524 - RNA, 19 nt, Homo sapiens
cugcauuugugucaucuug

SEQ ID NO: 1442525 - RNA, 22 nt, Homo sapiens
cugccaagagagggccaugcaa

SEQ ID NO: 1442526 - RNA, 11 nt, Homo sapiens
cugccaccacc

SEQ ID NO: 1442527 - RNA, 19 nt, Homo sapiens
cugccaccacgucugccag

SEQ ID NO: 1442528 - RNA, 12 nt, Homo sapiens
cugccacuucca

SEQ ID NO: 1442529 - RNA, 14 nt, Homo sapiens
cugccagagcuuug

SEQ ID NO: 1442530 - RNA, 14 nt, Homo sapiens
cugccauaaagcca

SEQ ID NO: 1442531 - RNA, 15 nt, Homo sapiens
cugccauaaagccau

SEQ ID NO: 1442532 - RNA, 17 nt, Homo sapiens
cugccaugccacugcca

SEQ ID NO: 1442533 - RNA, 16 nt, Homo sapiens
cugccaugcccagaga

SEQ ID NO: 1442534 - RNA, 15 nt, Homo sapiens
cugccauuacucugc

SEQ ID NO: 1442535 - RNA, 19 nt, Homo sapiens
cugccauugucgucuuuau

SEQ ID NO: 1442536 - RNA, 18 nt, Homo sapiens
cugcccacccacuccuua

SEQ ID NO: 1442537 - RNA, 13 nt, Homo sapiens
cugcccacuccca

SEQ ID NO: 1442538 - RNA, 20 nt, Homo sapiens
cugcccacucccaggaccaa

SEQ ID NO: 1442539 - RNA, 13 nt, Homo sapiens
cugcccauacccc

SEQ ID NO: 1442540 - RNA, 19 nt, Homo sapiens
cugcccccaucccacauga

SEQ ID NO: 1442541 - RNA, 17 nt, Homo sapiens
cugcccugcucugggga

SEQ ID NO: 1442542 - RNA, 17 nt, Homo sapiens
cugccucuccagcacuu

SEQ ID NO: 1442543 - RNA, 19 nt, Homo sapiens
cugccucuccagcacuucu

SEQ ID NO: 1442544 - RNA, 14 nt, Homo sapiens
cugccugagcccag

SEQ ID NO: 1442545 - RNA, 22 nt, Homo sapiens
cugccugguaugaguugcccau

SEQ ID NO: 1442546 - RNA, 14 nt, Homo sapiens
cugccuuguguaca

SEQ ID NO: 1442547 - RNA, 22 nt, Homo sapiens
cugcgucgaagcuuugaaggcc

SEQ ID NO: 1442548 - RNA, 14 nt, Homo sapiens
cugcuacacaaaag

SEQ ID NO: 1442549 - RNA, 21 nt, Homo sapiens
cugcucccaaauaaacuccag

SEQ ID NO: 1442550 - RNA, 14 nt, Homo sapiens
cugcucucuucagg

SEQ ID NO: 1442551 - RNA, 17 nt, Homo sapiens
cugcucugaggcuucca

SEQ ID NO: 1442552 - RNA, 18 nt, Homo sapiens
cugcucuggaaaauguga

SEQ ID NO: 1442553 - RNA, 18 nt, Homo sapiens
cugcugagugcaccacuu

SEQ ID NO: 1442554 - RNA, 19 nt, Homo sapiens
cugcugagugcaccacuuc

SEQ ID NO: 1442555 - RNA, 14 nt, Homo sapiens
cugcugaucaauga

SEQ ID NO: 1442556 - RNA, 19 nt, Homo sapiens
cugcugcagcaugaaggca

SEQ ID NO: 1442557 - RNA, 12 nt, Homo sapiens
cugcuguauacu

SEQ ID NO: 1442558 - RNA, 15 nt, Homo sapiens
cugcuguauacugua

SEQ ID NO: 1442559 - RNA, 22 nt, Homo sapiens
cugcugugcccucccauagcac

SEQ ID NO: 1442560 - RNA, 13 nt, Homo sapiens
cugcuuacuaaug

SEQ ID NO: 1442561 - RNA, 17 nt, Homo sapiens
cugcuuuuuaaguguua

SEQ ID NO: 1442562 - RNA, 21 nt, Homo sapiens
cugcuuuuuccagauucuucc

SEQ ID NO: 1442563 - RNA, 18 nt, Homo sapiens
cuggaaaacucaggauuc

SEQ ID NO: 1442564 - RNA, 22 nt, Homo sapiens
cuggaaaacucaggauucucac

SEQ ID NO: 1442565 - RNA, 16 nt, Homo sapiens
cuggaaaccacguggu

SEQ ID NO: 1442566 - RNA, 13 nt, Homo sapiens
cuggaacaccagg

SEQ ID NO: 1442567 - RNA, 23 nt, Homo sapiens
cuggaagaaggaagaagccagac

SEQ ID NO: 1442568 - RNA, 23 nt, Homo sapiens
cuggaaggucaauuucaguguau

SEQ ID NO: 1442569 - RNA, 14 nt, Homo sapiens
gaggcugcaugcuc

SEQ ID NO: 1442570 - RNA, 22 nt, Homo sapiens
gaggcugcggccuaggggucca

SEQ ID NO: 1442571 - RNA, 16 nt, Homo sapiens
gagggaggagaaugag

SEQ ID NO: 1442572 - RNA, 21 nt, Homo sapiens
gagggaugccacccagcaaca

SEQ ID NO: 1442573 - RNA, 16 nt, Homo sapiens
gagggccaggauuccu

SEQ ID NO: 1442574 - RNA, 20 nt, Homo sapiens
gagggcuagaaccuagaagg

SEQ ID NO: 1442575 - RNA, 18 nt, Homo sapiens
gagggcuagaaccuggag

SEQ ID NO: 1442576 - RNA, 19 nt, Homo sapiens
gagggcugggggcugaccc

SEQ ID NO: 1442577 - RNA, 16 nt, Homo sapiens
gaggggcugacucagu

SEQ ID NO: 1442578 - RNA, 19 nt, Homo sapiens
gaggguaaauaugacuccu

SEQ ID NO: 1442579 - RNA, 12 nt, Homo sapiens
gaggguugcuau

SEQ ID NO: 1442580 - RNA, 16 nt, Homo sapiens
gaggucacauucagga

SEQ ID NO: 1442581 - RNA, 21 nt, Homo sapiens
gaggucuccaucauggcagug

SEQ ID NO: 1442582 - RNA, 19 nt, Homo sapiens
gaggugagagaagaccucu

SEQ ID NO: 1442583 - RNA, 12 nt, Homo sapiens
gagguggcugcu

SEQ ID NO: 1442584 - RNA, 20 nt, Homo sapiens
gaggugggguacauuucucu

SEQ ID NO: 1442585 - RNA, 17 nt, Homo sapiens
gagguguggauaaggcu

SEQ ID NO: 1442586 - RNA, 18 nt, Homo sapiens
gagguugcagugagccau

SEQ ID NO: 1442587 - RNA, 17 nt, Homo sapiens
gaguaacaugccagcuu

SEQ ID NO: 1442588 - RNA, 22 nt, Homo sapiens
gaguaccaugaggguugcuauu

SEQ ID NO: 1442589 - RNA, 19 nt, Homo sapiens
gaguaccuuaaucugccau

SEQ ID NO: 1442590 - RNA, 15 nt, Homo sapiens
gaguaucuaaagcca

SEQ ID NO: 1442591 - RNA, 17 nt, Homo sapiens
gagucaugcacucaggc

SEQ ID NO: 1442592 - RNA, 21 nt, Homo sapiens
gaguccccagaaccagcugca

SEQ ID NO: 1442593 - RNA, 17 nt, Homo sapiens
gagucucuucuccacug

SEQ ID NO: 1442594 - RNA, 23 nt, Homo sapiens
gagucugggcaaugaaaccaaag

SEQ ID NO: 1442595 - RNA, 20 nt, Homo sapiens
gagucuugcucuguugccca

SEQ ID NO: 1442596 - RNA, 22 nt, Homo sapiens
gaguggcuugugauucugggau

SEQ ID NO: 1442597 - RNA, 15 nt, Homo sapiens
gagugguuguugcca

SEQ ID NO: 1442598 - RNA, 12 nt, Homo sapiens
uuauugcauaau

SEQ ID NO: 1442599 - RNA, 14 nt, Homo sapiens
uuauugucuaggcc

SEQ ID NO: 1442600 - RNA, 16 nt, Homo sapiens
uuauugugaucuauca

SEQ ID NO: 1442601 - RNA, 13 nt, Homo sapiens
uuauugugccuca

SEQ ID NO: 1442602 - RNA, 16 nt, Homo sapiens
uuauuuguagucuaau

SEQ ID NO: 1442603 - RNA, 16 nt, Homo sapiens
uuauuuguauuugcca

SEQ ID NO: 1442604 - RNA, 19 nt, Homo sapiens
uuauuuuuauaucagccug

SEQ ID NO: 1442605 - RNA, 19 nt, Homo sapiens
uucaaaagaugccauucau

SEQ ID NO: 1442606 - RNA, 12 nt, Homo sapiens
uucaaccagcau

SEQ ID NO: 1442607 - RNA, 20 nt, Homo sapiens
uucaaccugguggcaccaga

SEQ ID NO: 1442608 - RNA, 14 nt, Homo sapiens
uucaacuccagaag

SEQ ID NO: 1442609 - RNA, 12 nt, Homo sapiens
uucaacuuugag

SEQ ID NO: 1442610 - RNA, 15 nt, Homo sapiens
uucaagaaagcuuca

SEQ ID NO: 1442611 - RNA, 20 nt, Homo sapiens
uucaagacuugauacugcaa

SEQ ID NO: 1442612 - RNA, 16 nt, Homo sapiens
uucaagccugugaaua

SEQ ID NO: 1442613 - RNA, 14 nt, Homo sapiens
uucaaggaaaguga

SEQ ID NO: 1442614 - RNA, 13 nt, Homo sapiens
uucaagguguaaa

SEQ ID NO: 1442615 - RNA, 14 nt, Homo sapiens
uucaaguugagaac

SEQ ID NO: 1442616 - RNA, 18 nt, Homo sapiens
uucaaucuuugcuguaua

SEQ ID NO: 1442617 - RNA, 15 nt, Homo sapiens
uucaaugcacauuag

SEQ ID NO: 1442618 - RNA, 20 nt, Homo sapiens
uucacacagggcucuuugau

SEQ ID NO: 1442619 - RNA, 23 nt, Homo sapiens
uucacaccucacgcucuggacau

SEQ ID NO: 1442620 - RNA, 13 nt, Homo sapiens
uucacagccagac

SEQ ID NO: 1442621 - RNA, 14 nt, Homo sapiens
uucacagccaggag

SEQ ID NO: 1442622 - RNA, 20 nt, Homo sapiens
uucacauaaacacauacauu

SEQ ID NO: 1442623 - RNA, 19 nt, Homo sapiens
uucacauacacucaaacaa

SEQ ID NO: 1442624 - RNA, 16 nt, Homo sapiens
uucacaucagcuuuag

SEQ ID NO: 1442625 - RNA, 21 nt, Homo sapiens
uucacauuugauguacaugug

SEQ ID NO: 1442626 - RNA, 17 nt, Homo sapiens
uucaccaaaugaugcca

SEQ ID NO: 1442627 - RNA, 15 nt, Homo sapiens
uucacuagacugugc

SEQ ID NO: 1442628 - RNA, 15 nt, Homo sapiens
uucacugccaugccu

SEQ ID NO: 1442629 - RNA, 18 nt, Homo sapiens
uucacuguaagacucauu

SEQ ID NO: 1442630 - RNA, 14 nt, Homo sapiens
uucacuguugaaaa

SEQ ID NO: 1442631 - RNA, 14 nt, Homo sapiens
uucagaagacacug

SEQ ID NO: 1442632 - RNA, 17 nt, Homo sapiens
uucagaagguugcucua

SEQ ID NO: 1442633 - RNA, 14 nt, Homo sapiens
uucagaccagugaa

SEQ ID NO: 1442634 - RNA, 18 nt, Homo sapiens
uucagaccagugaaagag

SEQ ID NO: 1442635 - RNA, 17 nt, Homo sapiens
uucagauugacaaggua

SEQ ID NO: 1442636 - RNA, 13 nt, Homo sapiens
uucagccaccucu

SEQ ID NO: 1442637 - RNA, 13 nt, Homo sapiens
gguggaucaccug

SEQ ID NO: 1442638 - RNA, 22 nt, Homo sapiens
gguggauuccugggcaagaacc

SEQ ID NO: 1442639 - RNA, 20 nt, Homo sapiens
ggugucaggcagguuugcca

SEQ ID NO: 1442640 - RNA, 14 nt, Homo sapiens
gguguggcaguuac

SEQ ID NO: 1442641 - RNA, 17 nt, Homo sapiens
gguuaccuuuguuccca

SEQ ID NO: 1442642 - RNA, 19 nt, Homo sapiens
gguuaccuuuguucccaaa

SEQ ID NO: 1442643 - RNA, 15 nt, Homo sapiens
gguuagauaaugaau

SEQ ID NO: 1442644 - RNA, 20 nt, Homo sapiens
gguuaggauuuaacagucau

SEQ ID NO: 1442645 - RNA, 16 nt, Homo sapiens
gguucagacugagcuc

SEQ ID NO: 1442646 - RNA, 19 nt, Homo sapiens
gguucagcuaagcuaggaa

SEQ ID NO: 1442647 - RNA, 14 nt, Homo sapiens
gguucccagcagcu

SEQ ID NO: 1442648 - RNA, 23 nt, Homo sapiens
gguucugaaaguggcucuucuaa

SEQ ID NO: 1442649 - RNA, 23 nt, Homo sapiens
gguucuggggaggaagggccagg

SEQ ID NO: 1442650 - RNA, 22 nt, Homo sapiens
gguucuuuccaugcagacuccu

SEQ ID NO: 1442651 - RNA, 19 nt, Homo sapiens
gguugcgggggagcuggaa

SEQ ID NO: 1442652 - RNA, 22 nt, Homo sapiens
gguugugcccuccaccuaccug

SEQ ID NO: 1442653 - RNA, 19 nt, Homo sapiens
gguuuguguuugaguuuua

SEQ ID NO: 1442654 - RNA, 14 nt, Homo sapiens
guaaaaacuuguac

SEQ ID NO: 1442655 - RNA, 14 nt, Homo sapiens
guaaacauucucuc

SEQ ID NO: 1442656 - RNA, 15 nt, Homo sapiens
guaaagaaguuugau

SEQ ID NO: 1442657 - RNA, 17 nt, Homo sapiens
guaaauagcauucucua

SEQ ID NO: 1442658 - RNA, 15 nt, Homo sapiens
guaaauguuuagguu

SEQ ID NO: 1442659 - RNA, 14 nt, Homo sapiens
guaaauuacauuaa

SEQ ID NO: 1442660 - RNA, 17 nt, Homo sapiens
guaacaugccagcuucc

SEQ ID NO: 1442661 - RNA, 21 nt, Homo sapiens
guaacucagacauuccaaggg

SEQ ID NO: 1442662 - RNA, 17 nt, Homo sapiens
guaacuucuuaaucuaa

SEQ ID NO: 1442663 - RNA, 15 nt, Homo sapiens
guaagacucauuccc

SEQ ID NO: 1442664 - RNA, 18 nt, Homo sapiens
guaagguuauaacugugg

SEQ ID NO: 1442665 - RNA, 18 nt, Homo sapiens
guaauaguccauggacaa

SEQ ID NO: 1442666 - RNA, 18 nt, Homo sapiens
guaaucccagcuacucag

SEQ ID NO: 1442667 - RNA, 16 nt, Homo sapiens
guaauuaagugcaauu

SEQ ID NO: 1442668 - RNA, 12 nt, Homo sapiens
guacaaucucaa

SEQ ID NO: 1442669 - RNA, 13 nt, Homo sapiens
guacacacacaga

SEQ ID NO: 1442670 - RNA, 15 nt, Homo sapiens
guacagacgucucaa

SEQ ID NO: 1442671 - RNA, 20 nt, Homo sapiens
guacagacgucucaagacug

SEQ ID NO: 1442672 - RNA, 14 nt, Homo sapiens
guacagugagccaa

SEQ ID NO: 1442673 - RNA, 21 nt, Homo sapiens
guacaugaagagcagcugguc

SEQ ID NO: 1442674 - RNA, 22 nt, Homo sapiens
guacauuuggcauuuguguuau

SEQ ID NO: 1442675 - RNA, 18 nt, Homo sapiens
guaccccugauaagcaaa

SEQ ID NO: 1442676 - RNA, 21 nt, Homo sapiens
guaccucccccugccuuccaa

SEQ ID NO: 1442677 - RNA, 15 nt, Homo sapiens
guaccuugcagccau

SEQ ID NO: 1442678 - RNA, 21 nt, Homo sapiens
guacuacugcugcaaagugca

SEQ ID NO: 1442679 - RNA, 21 nt, Homo sapiens
guagaacaccccugugcaaau

SEQ ID NO: 1442680 - RNA, 21 nt, Homo sapiens
guagaaccacuuggcugcuca

SEQ ID NO: 1442681 - RNA, 12 nt, Homo sapiens
guagaagccagu

SEQ ID NO: 1442682 - RNA, 14 nt, Homo sapiens
guagaccacugucc

SEQ ID NO: 1442683 - RNA, 20 nt, Homo sapiens
guagccaaagguucacucuc

SEQ ID NO: 1442684 - RNA, 12 nt, Homo sapiens
guagcugaugaa

SEQ ID NO: 1442685 - RNA, 17 nt, Homo sapiens
guagcuuaccugacaca

SEQ ID NO: 1442686 - RNA, 13 nt, Homo sapiens
guaggcagggaac

SEQ ID NO: 1442687 - RNA, 12 nt, Homo sapiens
guagggcagcag

SEQ ID NO: 1442688 - RNA, 21 nt, Homo sapiens
guagucacuuuggagcuuuag

SEQ ID NO: 1442689 - RNA, 21 nt, Homo sapiens
guaguuucucuguaaggcaaa

SEQ ID NO: 1442690 - RNA, 12 nt, Homo sapiens
guauaaacauua

SEQ ID NO: 1442691 - RNA, 15 nt, Homo sapiens
guauaaacuaucagu

SEQ ID NO: 1442692 - RNA, 21 nt, Homo sapiens
guauaaccuucaugaugaauu

SEQ ID NO: 1442693 - RNA, 10 nt, Homo sapiens
guauaaucuc

SEQ ID NO: 1442694 - RNA, 23 nt, Homo sapiens
guauagcauuuuuauucaugcca

SEQ ID NO: 1442695 - RNA, 21 nt, Homo sapiens
guauauaauacuaaagugucu

SEQ ID NO: 1442696 - RNA, 15 nt, Homo sapiens
guauauacaauaaca

SEQ ID NO: 1442697 - RNA, 13 nt, Homo sapiens
guauauacauauu

SEQ ID NO: 1442698 - RNA, 14 nt, Homo sapiens
guauauacauauua

SEQ ID NO: 1442699 - RNA, 15 nt, Homo sapiens
guauauagaagucua

SEQ ID NO: 1442700 - RNA, 16 nt, Homo sapiens
guauauagaugugcaa

SEQ ID NO: 1442701 - RNA, 23 nt, Homo sapiens
guauaucaugaaacacuucucau

SEQ ID NO: 1442702 - RNA, 20 nt, Homo sapiens
guauaugugcauggacugug

SEQ ID NO: 1442703 - RNA, 20 nt, Homo sapiens
guauccaauaggcauuugau

SEQ ID NO: 1442704 - RNA, 14 nt, Homo sapiens
guauccuacuacuu

SEQ ID NO: 1442705 - RNA, 22 nt, Homo sapiens
guaugaccuaguaaacuuugua

SEQ ID NO: 1442706 - RNA, 22 nt, Homo sapiens
guaugcucauacuuggacaguu

SEQ ID NO: 1442707 - RNA, 15 nt, Homo sapiens
guaugggaagccaua

SEQ ID NO: 1442708 - RNA, 19 nt, Homo sapiens
guauguaaguaauugcauu

SEQ ID NO: 1442709 - RNA, 22 nt, Homo sapiens
guauguauggaugcguggauau

SEQ ID NO: 1442710 - RNA, 14 nt, Homo sapiens
guaugucugccuaa

SEQ ID NO: 1442711 - RNA, 18 nt, Homo sapiens
guaugugcacaugugucu

SEQ ID NO: 1442712 - RNA, 13 nt, Homo sapiens
uuccucuugccuc

SEQ ID NO: 1442713 - RNA, 14 nt, Homo sapiens
uuccucuugccucu

SEQ ID NO: 1442714 - RNA, 14 nt, Homo sapiens
uuccugaagccaga

SEQ ID NO: 1442715 - RNA, 13 nt, Homo sapiens
uuccugcacucca

SEQ ID NO: 1442716 - RNA, 18 nt, Homo sapiens
uuccugcuacacaaaagc

SEQ ID NO: 1442717 - RNA, 21 nt, Homo sapiens
uuccugggcaagaaccuaaag

SEQ ID NO: 1442718 - RNA, 23 nt, Homo sapiens
uuccuuacucccaggcacugucu

SEQ ID NO: 1442719 - RNA, 12 nt, Homo sapiens
uuccuucacuca

SEQ ID NO: 1442720 - RNA, 20 nt, Homo sapiens
uuccuucagugcaucuggga

SEQ ID NO: 1442721 - RNA, 18 nt, Homo sapiens
uuccuucugcacccagaa

SEQ ID NO: 1442722 - RNA, 11 nt, Homo sapiens
uuccuugagaa

SEQ ID NO: 1442723 - RNA, 20 nt, Homo sapiens
uucgacccuuucucugagag

SEQ ID NO: 1442724 - RNA, 23 nt, Homo sapiens
uucgauacaccgggccuggagaa

SEQ ID NO: 1442725 - RNA, 16 nt, Homo sapiens
uucgcugccaggacac

SEQ ID NO: 1442726 - RNA, 18 nt, Homo sapiens
uucguggagcccagcgag

SEQ ID NO: 1442727 - RNA, 16 nt, Homo sapiens
uucuaaauugagauuc

SEQ ID NO: 1442728 - RNA, 13 nt, Homo sapiens
uucuacaagcaua

SEQ ID NO: 1442729 - RNA, 22 nt, Homo sapiens
uucuacaccuguugcaccucag

SEQ ID NO: 1442730 - RNA, 15 nt, Homo sapiens
uucuaccauuugaau

SEQ ID NO: 1442731 - RNA, 22 nt, Homo sapiens
uucuaccuguguucauucuuac

SEQ ID NO: 1442732 - RNA, 20 nt, Homo sapiens
uucuagaucuggaaccuuac

SEQ ID NO: 1442733 - RNA, 13 nt, Homo sapiens
uucuagcuacaau

SEQ ID NO: 1442734 - RNA, 21 nt, Homo sapiens
uucuauugaaaaaucaccaca

SEQ ID NO: 1442735 - RNA, 19 nt, Homo sapiens
uucucaaucagugcaguga

SEQ ID NO: 1442736 - RNA, 20 nt, Homo sapiens
uucucaaucagugcagugau

SEQ ID NO: 1442737 - RNA, 17 nt, Homo sapiens
uucucacacuagccuua

SEQ ID NO: 1442738 - RNA, 20 nt, Homo sapiens
uucucacuccuaccugguaa

SEQ ID NO: 1442739 - RNA, 17 nt, Homo sapiens
uucucagccacaaaaua

SEQ ID NO: 1442740 - RNA, 18 nt, Homo sapiens
uucucaggacacaggccu

SEQ ID NO: 1442741 - RNA, 22 nt, Homo sapiens
uucucaguaaauauuaaccuga

SEQ ID NO: 1442742 - RNA, 14 nt, Homo sapiens
uucucaugugaucc

SEQ ID NO: 1442743 - RNA, 11 nt, Homo sapiens
uucuccacugg

SEQ ID NO: 1442744 - RNA, 14 nt, Homo sapiens
uucuccugccucag

SEQ ID NO: 1442745 - RNA, 22 nt, Homo sapiens
uucuccuguugcaaugacacau

SEQ ID NO: 1442746 - RNA, 19 nt, Homo sapiens
uucuccuuuugaccaaaua

SEQ ID NO: 1442747 - RNA, 15 nt, Homo sapiens
uucuccuuuuugccc

SEQ ID NO: 1442748 - RNA, 20 nt, Homo sapiens
uucucgugguagaagccagu

SEQ ID NO: 1442749 - RNA, 14 nt, Homo sapiens
uucucuaaauauga

SEQ ID NO: 1442750 - RNA, 20 nt, Homo sapiens
uucucucacuuugauuugcu

SEQ ID NO: 1442751 - RNA, 23 nt, Homo sapiens
uucucuguaaggcaaaauaaucu

SEQ ID NO: 1442752 - RNA, 20 nt, Homo sapiens
uuggggcacagucauucaca

SEQ ID NO: 1442753 - RNA, 12 nt, Homo sapiens
uugggggcucca

SEQ ID NO: 1442754 - RNA, 16 nt, Homo sapiens
uuggucccgugcagcu

SEQ ID NO: 1442755 - RNA, 11 nt, Homo sapiens
uuggugccacu

SEQ ID NO: 1442756 - RNA, 15 nt, Homo sapiens
uugguguauuugcca

SEQ ID NO: 1442757 - RNA, 20 nt, Homo sapiens
uuguaacgaagacacagacu

SEQ ID NO: 1442758 - RNA, 19 nt, Homo sapiens
uuguaaguuuaugucuaaa

SEQ ID NO: 1442759 - RNA, 21 nt, Homo sapiens
uuguaauaguccauggacaau

SEQ ID NO: 1442760 - RNA, 23 nt, Homo sapiens
uuguaaucauguuaccauuacaa

SEQ ID NO: 1442761 - RNA, 20 nt, Homo sapiens
uuguaccccaucccuuccuc

SEQ ID NO: 1442762 - RNA, 13 nt, Homo sapiens
uuguauauacuuc

SEQ ID NO: 1442763 - RNA, 21 nt, Homo sapiens
uuguauggagccucuucugcc

SEQ ID NO: 1442764 - RNA, 12 nt, Homo sapiens
uuguauuugcca

SEQ ID NO: 1442765 - RNA, 21 nt, Homo sapiens
uugucaauauuaaauacagac

SEQ ID NO: 1442766 - RNA, 12 nt, Homo sapiens
uugucagaauuu

SEQ ID NO: 1442767 - RNA, 20 nt, Homo sapiens
uugucagaauuucuuuguca

SEQ ID NO: 1442768 - RNA, 19 nt, Homo sapiens
uugucagaguucugcucua

SEQ ID NO: 1442769 - RNA, 12 nt, Homo sapiens
uugucauucaag

SEQ ID NO: 1442770 - RNA, 17 nt, Homo sapiens
uuguccugccagcugcc

SEQ ID NO: 1442771 - RNA, 16 nt, Homo sapiens
uugucgggacagagag

SEQ ID NO: 1442772 - RNA, 10 nt, Homo sapiens
uugucucaag

SEQ ID NO: 1442773 - RNA, 22 nt, Homo sapiens
uugucucucuaaacccaaauaa

SEQ ID NO: 1442774 - RNA, 20 nt, Homo sapiens
uugugacaggaaagcccucc

SEQ ID NO: 1442775 - RNA, 20 nt, Homo sapiens
uugugaccuucucuauauca

SEQ ID NO: 1442776 - RNA, 18 nt, Homo sapiens
uugugcuugcugguacua

SEQ ID NO: 1442777 - RNA, 18 nt, Homo sapiens
uuguggacaaguuuccca

SEQ ID NO: 1442778 - RNA, 12 nt, Homo sapiens
uugugucagaga

SEQ ID NO: 1442779 - RNA, 19 nt, Homo sapiens
uuguuaccuuucccaugcu

SEQ ID NO: 1442780 - RNA, 15 nt, Homo sapiens
uuguuauuuguacag

SEQ ID NO: 1442781 - RNA, 14 nt, Homo sapiens
uuguucacauauau

SEQ ID NO: 1442782 - RNA, 21 nt, Homo sapiens
uuguuccuacucagacuguug

SEQ ID NO: 1442783 - RNA, 19 nt, Homo sapiens
uuguucgccgcguggaaug

SEQ ID NO: 1442784 - RNA, 22 nt, Homo sapiens
uuguucgccgcguggaauguga

SEQ ID NO: 1442785 - RNA, 14 nt, Homo sapiens
uuguugcugucaag

SEQ ID NO: 1442786 - RNA, 12 nt, Homo sapiens
uuguuugggcca

SEQ ID NO: 1442787 - RNA, 20 nt, Homo sapiens
uuguuuuauauguaguacua

SEQ ID NO: 1442788 - RNA, 18 nt, Homo sapiens
uuguuuucauuaucucaa

SEQ ID NO: 1442789 - RNA, 23 nt, Homo sapiens
uuguuuucccgagcaaagucuaa

SEQ ID NO: 1442790 - RNA, 13 nt, Homo sapiens
uuuaaaaaaugga

SEQ ID NO: 1442791 - RNA, 16 nt, Homo sapiens
uuuaaaccagcagaaa

SEQ ID NO: 1442792 - RNA, 11 nt, Homo sapiens
uuuaaaguaaa

SEQ ID NO: 1442793 - RNA, 20 nt, Homo sapiens
uuuaaaguauguuauugcau

SEQ ID NO: 1442794 - RNA, 21 nt, Homo sapiens
uuuaaaguauguuauugcaua

SEQ ID NO: 1442795 - RNA, 12 nt, Homo sapiens
uuucccaccacc

SEQ ID NO: 1442796 - RNA, 19 nt, Homo sapiens
uuucccaccucaccugaga

SEQ ID NO: 1442797 - RNA, 17 nt, Homo sapiens
uuucccauuacuuuaau

SEQ ID NO: 1442798 - RNA, 14 nt, Homo sapiens
uuucccccaaagau

SEQ ID NO: 1442799 - RNA, 22 nt, Homo sapiens
uuuccuaaagucucugcugcua

SEQ ID NO: 1442800 - RNA, 22 nt, Homo sapiens
uuuccuaucuguaugucugccu

SEQ ID NO: 1442801 - RNA, 21 nt, Homo sapiens
uuuccucuuccccuugcccuu

SEQ ID NO: 1442802 - RNA, 15 nt, Homo sapiens
uuuccuugucucuca

SEQ ID NO: 1442803 - RNA, 18 nt, Homo sapiens
uuuccuugucucucauuc

SEQ ID NO: 1442804 - RNA, 15 nt, Homo sapiens
uuuccuuuuaugaga

SEQ ID NO: 1442805 - RNA, 13 nt, Homo sapiens
uuucgaacauucu

SEQ ID NO: 1442806 - RNA, 17 nt, Homo sapiens
uuucuaacucaggggug

SEQ ID NO: 1442807 - RNA, 21 nt, Homo sapiens
uuucuacaccuguugcaccuc

SEQ ID NO: 1442808 - RNA, 19 nt, Homo sapiens
uuucuaccuguguucauuc

SEQ ID NO: 1442809 - RNA, 13 nt, Homo sapiens
uuucuagacuguc

SEQ ID NO: 1442810 - RNA, 14 nt, Homo sapiens
uuucugagaaagac

SEQ ID NO: 1442811 - RNA, 23 nt, Homo sapiens
uuucugcucccucgacacuugau

SEQ ID NO: 1442812 - RNA, 21 nt, Homo sapiens
uuucuggauaucaagauguua

SEQ ID NO: 1442813 - RNA, 24 nt, Homo sapiens
uuucuggugccuauuuauucauuc

SEQ ID NO: 1442814 - RNA, 15 nt, Homo sapiens
uuucuuaaaaacagc

SEQ ID NO: 1442815 - RNA, 18 nt, Homo sapiens
uuucuuacccauauaucu

SEQ ID NO: 1442816 - RNA, 18 nt, Homo sapiens
uuucuuucuaacuccagu

SEQ ID NO: 1442817 - RNA, 15 nt, Homo sapiens
uuugaaacugaaugu

SEQ ID NO: 1442818 - RNA, 17 nt, Homo sapiens
uuugaaacugaauguuu

SEQ ID NO: 1442819 - RNA, 13 nt, Homo sapiens
uuugaauggugca

SEQ ID NO: 1442820 - RNA, 18 nt, Homo sapiens
uuugagcuggaaagcagc

SEQ ID NO: 1442821 - RNA, 18 nt, Homo sapiens
uuugaggagcagcuucag

SEQ ID NO: 1442822 - RNA, 16 nt, Homo sapiens
uuugaggcaaaggcca

SEQ ID NO: 1442823 - RNA, 15 nt, Homo sapiens
uuugaguuucucucc

SEQ ID NO: 1442824 - RNA, 21 nt, Homo sapiens
uuugcaauggcuauauggcaa

SEQ ID NO: 1442825 - RNA, 16 nt, Homo sapiens
uuugcacccaugccau

SEQ ID NO: 1442826 - RNA, 13 nt, Homo sapiens
uuugcacugacaa

SEQ ID NO: 1442827 - RNA, 12 nt, Homo sapiens
uuugcacugagg

SEQ ID NO: 1442828 - RNA, 19 nt, Homo sapiens
uuugcuuuguguaaauaca

SEQ ID NO: 1442829 - RNA, 16 nt, Homo sapiens
uuuggaaguguuaacu

SEQ ID NO: 1442830 - RNA, 17 nt, Homo sapiens
uuuggaugaccagaaca

SEQ ID NO: 1442831 - RNA, 16 nt, Homo sapiens
uuuggauguuuccacg

SEQ ID NO: 1442832 - RNA, 14 nt, Homo sapiens
uuuggccauuccaa

SEQ ID NO: 1442833 - RNA, 18 nt, Homo sapiens
uuugguaggcuuaucaaa

SEQ ID NO: 1442834 - RNA, 17 nt, Homo sapiens
uuugguuaccaauuuaa

SEQ ID NO: 1442835 - RNA, 12 nt, Homo sapiens
uuuguacagaga

SEQ ID NO: 1442836 - RNA, 12 nt, Homo sapiens
uuugucauauau

SEQ ID NO: 1442837 - RNA, 21 nt, Homo sapiens
ugugaaguguaguggcaucca

SEQ ID NO: 1442838 - RNA, 22 nt, Homo sapiens
ugugaauaaaaacccuguaugg

SEQ ID NO: 1442839 - RNA, 21 nt, Homo sapiens
ugugaauagucugugugcaca

SEQ ID NO: 1442840 - RNA, 13 nt, Homo sapiens
ugugacagucuug

SEQ ID NO: 1442841 - RNA, 15 nt, Homo sapiens
ugugacagucuugca

SEQ ID NO: 1442842 - RNA, 17 nt, Homo sapiens
ugugacccuacuuccug

SEQ ID NO: 1442843 - RNA, 20 nt, Homo sapiens
ugugagagcugguugcuaca

SEQ ID NO: 1442844 - RNA, 17 nt, Homo sapiens
ugugauguuaacuauua

SEQ ID NO: 1442845 - RNA, 20 nt, Homo sapiens
ugugauuuuaauuugauaca

SEQ ID NO: 1442846 - RNA, 12 nt, Homo sapiens
ugugauuuucag

SEQ ID NO: 1442847 - RNA, 18 nt, Homo sapiens
ugugauuuuugaacaaua

SEQ ID NO: 1442848 - RNA, 12 nt, Homo sapiens
ugugcagacuga

SEQ ID NO: 1442849 - RNA, 16 nt, Homo sapiens
ugugccgugacagggc

SEQ ID NO: 1442850 - RNA, 21 nt, Homo sapiens
ugugcgacuucacaaaaugca

SEQ ID NO: 1442851 - RNA, 15 nt, Homo sapiens
ugugcuggacuguuu

SEQ ID NO: 1442852 - RNA, 15 nt, Homo sapiens
ugugcuucacauaau

SEQ ID NO: 1442853 - RNA, 18 nt, Homo sapiens
uguggaggccugaugcug

SEQ ID NO: 1442854 - RNA, 19 nt, Homo sapiens
uguggaguggacauucaaa

SEQ ID NO: 1442855 - RNA, 19 nt, Homo sapiens
uguggauuccagcauuugc

SEQ ID NO: 1442856 - RNA, 13 nt, Homo sapiens
ugugguuuacuag

SEQ ID NO: 1442857 - RNA, 14 nt, Homo sapiens
ugugguuuauguca

SEQ ID NO: 1442858 - RNA, 20 nt, Homo sapiens
ugugguuuaugucaucauac

SEQ ID NO: 1442859 - RNA, 18 nt, Homo sapiens
uguguaauaagaaaguau

SEQ ID NO: 1442860 - RNA, 21 nt, Homo sapiens
uguguacauauauauucuaca

SEQ ID NO: 1442861 - RNA, 11 nt, Homo sapiens
uguguauauau

SEQ ID NO: 1442862 - RNA, 17 nt, Homo sapiens
uguguauauauguguau

SEQ ID NO: 1442863 - RNA, 22 nt, Homo sapiens
uguguccccucacucugucagc

SEQ ID NO: 1442864 - RNA, 13 nt, Homo sapiens
uguguccugauga

SEQ ID NO: 1442865 - RNA, 14 nt, Homo sapiens
ugugugaccccaaa

SEQ ID NO: 1442866 - RNA, 15 nt, Homo sapiens
ugugugaguauguau

SEQ ID NO: 1442867 - RNA, 18 nt, Homo sapiens
ugugugccgugacagggc

SEQ ID NO: 1442868 - RNA, 12 nt, Homo sapiens
uguguggcugcu

SEQ ID NO: 1442869 - RNA, 16 nt, Homo sapiens
uguguguauguauaca

SEQ ID NO: 1442870 - RNA, 17 nt, Homo sapiens
uguguucacacuguaaa

SEQ ID NO: 1442871 - RNA, 19 nt, Homo sapiens
uguguuccuaacauaaaau

SEQ ID NO: 1442872 - RNA, 20 nt, Homo sapiens
uguuaacuauuuauucccug

SEQ ID NO: 1442873 - RNA, 22 nt, Homo sapiens
uguuaagcaaaggaaaccaaag

SEQ ID NO: 1442874 - RNA, 19 nt, Homo sapiens
uguuagauagaauuuccaa

SEQ ID NO: 1442875 - RNA, 17 nt, Homo sapiens
uguuauguuugcacuuu

SEQ ID NO: 1442876 - RNA, 12 nt, Homo sapiens
uguucaauguuu

SEQ ID NO: 1442877 - RNA, 15 nt, Homo sapiens
uguucacacuguaaa

SEQ ID NO: 1442878 - RNA, 20 nt, Homo sapiens
uguucacagccagacuggca

SEQ ID NO: 1442879 - RNA, 15 nt, Homo sapiens
uguucacccacaucu

SEQ ID NO: 1442880 - RNA, 18 nt, Homo sapiens
uguucagagaggccuuuu

SEQ ID NO: 1442881 - RNA, 22 nt, Homo sapiens
uguucccuagcugaggaugaca

SEQ ID NO: 1442882 - RNA, 19 nt, Homo sapiens
uguuccuacucagacuguu

SEQ ID NO: 1442883 - RNA, 20 nt, Homo sapiens
uguuccuacucagacuguug

SEQ ID NO: 1442884 - RNA, 23 nt, Homo sapiens
uguuccuguugaaucuugcacau

SEQ ID NO: 1442885 - RNA, 19 nt, Homo sapiens
uguuccuugucacugguag

SEQ ID NO: 1442886 - RNA, 14 nt, Homo sapiens
uguucuaaguauuu

SEQ ID NO: 1442887 - RNA, 21 nt, Homo sapiens
uguucuacaugaggacucaua

SEQ ID NO: 1442888 - RNA, 21 nt, Homo sapiens
uguucuagcccucccuggcau

SEQ ID NO: 1442889 - RNA, 14 nt, Homo sapiens
uguucugcacugaa

SEQ ID NO: 1442890 - RNA, 16 nt, Homo sapiens
uguucuguugauccca

SEQ ID NO: 1442891 - RNA, 21 nt, Homo sapiens
uguucuuagcugaacaaugaa

SEQ ID NO: 1442892 - RNA, 14 nt, Homo sapiens
uguugaaucuugca

SEQ ID NO: 1442893 - RNA, 21 nt, Homo sapiens
uguugaugaggccucuuggac

SEQ ID NO: 1442894 - RNA, 14 nt, Homo sapiens
uguugauuacauaa

SEQ ID NO: 1442895 - RNA, 16 nt, Homo sapiens
uguugcaaugacacau

SEQ ID NO: 1442896 - RNA, 16 nt, Homo sapiens
uguugcgccacugaga

SEQ ID NO: 1442897 - RNA, 19 nt, Homo sapiens
uguuggauagucagcugua

SEQ ID NO: 1442898 - RNA, 16 nt, Homo sapiens
uguuggggcaguggua

SEQ ID NO: 1442899 - RNA, 19 nt, Homo sapiens
uguuguaaaugaccaagaa

SEQ ID NO: 1442900 - RNA, 21 nt, Homo sapiens
uguuguggguuuuuucacaua

SEQ ID NO: 1442901 - RNA, 20 nt, Homo sapiens
uguuguguauagaugcaaga

SEQ ID NO: 1442902 - RNA, 23 nt, Homo sapiens
uguuuacauaucaccucauggcc

SEQ ID NO: 1442903 - RNA, 14 nt, Homo sapiens
uguuuacuaaagag

SEQ ID NO: 1442904 - RNA, 20 nt, Homo sapiens
uguuucagcccgaagcugcu

SEQ ID NO: 1442905 - RNA, 16 nt, Homo sapiens
uguuuccacgggucuc

SEQ ID NO: 1442906 - RNA, 19 nt, Homo sapiens
uguuucuaaaacuaugguu

SEQ ID NO: 1442907 - RNA, 13 nt, Homo sapiens
uguuucuaacuca

SEQ ID NO: 1442908 - RNA, 22 nt, Homo sapiens
uguuucuauauuggucauugcc

SEQ ID NO: 1442909 - RNA, 22 nt, Homo sapiens
uguuucugaaccauuacuguaa

SEQ ID NO: 1442910 - RNA, 16 nt, Homo sapiens
uguuucuuucauauga

SEQ ID NO: 1442911 - RNA, 15 nt, Homo sapiens
uguuugaccuucaca

SEQ ID NO: 1442912 - RNA, 19 nt, Homo sapiens
uguuugauaugaaguguua

SEQ ID NO: 1442913 - RNA, 13 nt, Homo sapiens
uguuugcucuugc

SEQ ID NO: 1442914 - RNA, 20 nt, Homo sapiens
uguuugcugaagugaaaaaa

SEQ ID NO: 1442915 - RNA, 17 nt, Homo sapiens
uguuugucagauaugau

SEQ ID NO: 1442916 - RNA, 17 nt, Homo sapiens
uguuuuaaguugcuuua

SEQ ID NO: 1442917 - RNA, 13 nt, Homo sapiens
uguuuuaaguuua

SEQ ID NO: 1442918 - RNA, 20 nt, Homo sapiens
uguuuuaauuuuugugauuu

SEQ ID NO: 1442919 - RNA, 17 nt, Homo sapiens
uguuuuagcuccuugac

SEQ ID NO: 1442920 - RNA, 21 nt, Homo sapiens
uguuuucuaaaguuguucaca

SEQ ID NO: 1442921 - RNA, 19 nt, Homo sapiens
uguuuuuuuuuuccacuua

SEQ ID NO: 1442922 - RNA, 14 nt, Homo sapiens
uuccuucacucauc

SEQ ID NO: 1442923 - RNA, 19 nt, Homo sapiens
uuccuuuugauggggagaa

SEQ ID NO: 1442924 - RNA, 11 nt, Homo sapiens
uucgcuugcuu

SEQ ID NO: 1442925 - RNA, 20 nt, Homo sapiens
uucggacagugcccaugcaa

SEQ ID NO: 1442926 - RNA, 22 nt, Homo sapiens
uucuaagugguauauacauaug

SEQ ID NO: 1442927 - RNA, 18 nt, Homo sapiens
uucuaauguaugcauuca

SEQ ID NO: 1442928 - RNA, 15 nt, Homo sapiens
uucuaaugugugaau

SEQ ID NO: 1442929 - RNA, 14 nt, Homo sapiens
uucuacaaccagag

SEQ ID NO: 1442930 - RNA, 19 nt, Homo sapiens
uucuacauacuauggaauu

SEQ ID NO: 1442931 - RNA, 15 nt, Homo sapiens
uucuacugugacuga

SEQ ID NO: 1442932 - RNA, 15 nt, Homo sapiens
uucuaggcaucccag

SEQ ID NO: 1442933 - RNA, 16 nt, Homo sapiens
uucuaucuccaaauga

SEQ ID NO: 1442934 - RNA, 16 nt, Homo sapiens
uucuaugcaagccuug

SEQ ID NO: 1442935 - RNA, 13 nt, Homo sapiens
uucuauucaaaag

SEQ ID NO: 1442936 - RNA, 20 nt, Homo sapiens
uucuauugaaaaaucaccac

SEQ ID NO: 1442937 - RNA, 12 nt, Homo sapiens
uucuauuuacaa

SEQ ID NO: 1442938 - RNA, 16 nt, Homo sapiens
uucucacuccaccacc

SEQ ID NO: 1442939 - RNA, 23 nt, Homo sapiens
uucucauguugaagccacugccu

SEQ ID NO: 1442940 - RNA, 23 nt, Homo sapiens
uucuccucccuguuaucugcuag

SEQ ID NO: 1442941 - RNA, 11 nt, Homo sapiens
uucuccugacc

SEQ ID NO: 1442942 - RNA, 15 nt, Homo sapiens
uucuccuguugcaau

SEQ ID NO: 1442943 - RNA, 18 nt, Homo sapiens
uucucuaccgggcgaguc

SEQ ID NO: 1442944 - RNA, 19 nt, Homo sapiens
uucucuaucccaagccaac

SEQ ID NO: 1442945 - RNA, 15 nt, Homo sapiens
uucucucccauacca

SEQ ID NO: 1442946 - RNA, 16 nt, Homo sapiens
uucucuccuucuuccc

SEQ ID NO: 1442947 - RNA, 15 nt, Homo sapiens
uucucucguaacugg

SEQ ID NO: 1442948 - RNA, 17 nt, Homo sapiens
uucucuguaaggcaaaa

SEQ ID NO: 1442949 - RNA, 17 nt, Homo sapiens
uucucuuugguguuaca

SEQ ID NO: 1442950 - RNA, 18 nt, Homo sapiens
uucugaaacuucauaaau

SEQ ID NO: 1442951 - RNA, 17 nt, Homo sapiens
uucugaaccauuacugu

SEQ ID NO: 1442952 - RNA, 19 nt, Homo sapiens
uucugaaccauuacuguaa

SEQ ID NO: 1442953 - RNA, 22 nt, Homo sapiens
uucugaacuggaacaugggcau

SEQ ID NO: 1442954 - RNA, 18 nt, Homo sapiens
cuucucaucauauuguau

SEQ ID NO: 1442955 - RNA, 14 nt, Homo sapiens
cuucuccacuggau

SEQ ID NO: 1442956 - RNA, 15 nt, Homo sapiens
cuucuccccauucug

SEQ ID NO: 1442957 - RNA, 16 nt, Homo sapiens
cuucugcacccagaaa

SEQ ID NO: 1442958 - RNA, 19 nt, Homo sapiens
cuucugcuguauacuguac

SEQ ID NO: 1442959 - RNA, 16 nt, Homo sapiens
cuucuggagucuccag

SEQ ID NO: 1442960 - RNA, 17 nt, Homo sapiens
cuucugggaacccugcc

SEQ ID NO: 1442961 - RNA, 23 nt, Homo sapiens
cuucugggaagacaacuaggaua

SEQ ID NO: 1442962 - RNA, 12 nt, Homo sapiens
cuucugguccuu

SEQ ID NO: 1442963 - RNA, 17 nt, Homo sapiens
cuucugucugcagugug

SEQ ID NO: 1442964 - RNA, 14 nt, Homo sapiens
cuucuucagaagac

SEQ ID NO: 1442965 - RNA, 19 nt, Homo sapiens
cuucuugguuuggggagaa

SEQ ID NO: 1442966 - RNA, 11 nt, Homo sapiens
cuucuugugaa

SEQ ID NO: 1442967 - RNA, 15 nt, Homo sapiens
cuucuuuacuagaua

SEQ ID NO: 1442968 - RNA, 19 nt, Homo sapiens
cuucuuuuauaacuagucc

SEQ ID NO: 1442969 - RNA, 19 nt, Homo sapiens
cuugaaaaugaaaugacug

SEQ ID NO: 1442970 - RNA, 14 nt, Homo sapiens
cuugaaaccaaaga

SEQ ID NO: 1442971 - RNA, 12 nt, Homo sapiens
cuugaaauacca

SEQ ID NO: 1442972 - RNA, 12 nt, Homo sapiens
cuugaaaucuga

SEQ ID NO: 1442973 - RNA, 17 nt, Homo sapiens
cuugaaccacaguucua

SEQ ID NO: 1442974 - RNA, 13 nt, Homo sapiens
cuugaagcacaga

SEQ ID NO: 1442975 - RNA, 19 nt, Homo sapiens
cuugaauuccugaccucag

SEQ ID NO: 1442976 - RNA, 21 nt, Homo sapiens
cuugacaacaucccacagugg

SEQ ID NO: 1442977 - RNA, 13 nt, Homo sapiens
cuugacauguaau

SEQ ID NO: 1442978 - RNA, 12 nt, Homo sapiens
cuugacauuccu

SEQ ID NO: 1442979 - RNA, 12 nt, Homo sapiens
cuugacuaucac

SEQ ID NO: 1442980 - RNA, 21 nt, Homo sapiens
cuugaggcggauggcugugac

SEQ ID NO: 1442981 - RNA, 23 nt, Homo sapiens
cuugaggggcccacagacagauc

SEQ ID NO: 1442982 - RNA, 22 nt, Homo sapiens
cuugaggguaauaaacuuagaa

SEQ ID NO: 1442983 - RNA, 16 nt, Homo sapiens
cuugauaaaugccuca

SEQ ID NO: 1442984 - RNA, 12 nt, Homo sapiens
cuugauucacaa

SEQ ID NO: 1442985 - RNA, 15 nt, Homo sapiens
cuugauucacaauga

SEQ ID NO: 1442986 - RNA, 21 nt, Homo sapiens
cuugcagugagccgagauugc

SEQ ID NO: 1442987 - RNA, 18 nt, Homo sapiens
cuugcaucaagggcuuua

SEQ ID NO: 1442988 - RNA, 17 nt, Homo sapiens
cuugcccccucaucuca

SEQ ID NO: 1442989 - RNA, 23 nt, Homo sapiens
cuugcccccucaucucacugccc

SEQ ID NO: 1442990 - RNA, 16 nt, Homo sapiens
cuugcccugaccuccc

SEQ ID NO: 1442991 - RNA, 15 nt, Homo sapiens
cuugccugaggcuca

SEQ ID NO: 1442992 - RNA, 14 nt, Homo sapiens
cuugcuauauugcc

SEQ ID NO: 1442993 - RNA, 21 nt, Homo sapiens
cuugcuauuugagcaugcaca

SEQ ID NO: 1442994 - RNA, 16 nt, Homo sapiens
cuugcugcugagugca

SEQ ID NO: 1442995 - RNA, 12 nt, Homo sapiens
cuugcugugagc

SEQ ID NO: 1442996 - RNA, 21 nt, Homo sapiens
cuugcuuaguaugguucucag

SEQ ID NO: 1442997 - RNA, 22 nt, Homo sapiens
cuugcuuaugacaucacuugua

SEQ ID NO: 1442998 - RNA, 20 nt, Homo sapiens
cuuggaaaaagaaagaaaca

SEQ ID NO: 1442999 - RNA, 18 nt, Homo sapiens
cuuggagagucggccaga

SEQ ID NO: 1443000 - RNA, 19 nt, Homo sapiens
cuuggagagucggccagac

SEQ ID NO: 1443001 - RNA, 18 nt, Homo sapiens
cuuggagcccgugcagua

SEQ ID NO: 1443002 - RNA, 13 nt, Homo sapiens
cuuggcugugagg

SEQ ID NO: 1443003 - RNA, 13 nt, Homo sapiens
cuugggagucagg

SEQ ID NO: 1443004 - RNA, 14 nt, Homo sapiens
cuuggggucaccac

SEQ ID NO: 1443005 - RNA, 17 nt, Homo sapiens
cuuguagaccacugucc

SEQ ID NO: 1443006 - RNA, 18 nt, Homo sapiens
cuuguagcagaaggcaag

SEQ ID NO: 1443007 - RNA, 14 nt, Homo sapiens
cuuguauauacaua

SEQ ID NO: 1443008 - RNA, 19 nt, Homo sapiens
cuugucauggaaaaugucc

SEQ ID NO: 1443009 - RNA, 12 nt, Homo sapiens
cuugucucucau

SEQ ID NO: 1443010 - RNA, 17 nt, Homo sapiens
cuugucuuacauaauca

SEQ ID NO: 1443011 - RNA, 15 nt, Homo sapiens
cuugugaaaccacag

SEQ ID NO: 1443012 - RNA, 19 nt, Homo sapiens
cuugugaacaccuccuagc

SEQ ID NO: 1443013 - RNA, 18 nt, Homo sapiens
cuugugguuuaugucauc

SEQ ID NO: 1443014 - RNA, 21 nt, Homo sapiens
cuuguugucuauuaucuguag

SEQ ID NO: 1443015 - RNA, 22 nt, Homo sapiens
cuuuaaacuacccuccagagug

SEQ ID NO: 1443016 - RNA, 14 nt, Homo sapiens
cuuuaaagacuuaa

SEQ ID NO: 1443017 - RNA, 16 nt, Homo sapiens
cuuuaaccauggugcu

SEQ ID NO: 1443018 - RNA, 21 nt, Homo sapiens
cuuuaauacucaccuccuccc

SEQ ID NO: 1443019 - RNA, 11 nt, Homo sapiens
cuuuacuugac

SEQ ID NO: 1443020 - RNA, 23 nt, Homo sapiens
cuuuagaguagcaugagagaauu

SEQ ID NO: 1443021 - RNA, 17 nt, Homo sapiens
cuuuaucuugacauuca

SEQ ID NO: 1443022 - RNA, 15 nt, Homo sapiens
cuuuauugcugugaa

SEQ ID NO: 1443023 - RNA, 14 nt, Homo sapiens
cuuuauugugaucu

SEQ ID NO: 1443024 - RNA, 17 nt, Homo sapiens
cuuucacauagcacaga

SEQ ID NO: 1443025 - RNA, 14 nt, Homo sapiens
cuuuccuacucuca

SEQ ID NO: 1443026 - RNA, 21 nt, Homo sapiens
cuuucuacaccuguugcaccu

SEQ ID NO: 1443027 - RNA, 20 nt, Homo sapiens
cuuucuacuuuuucuagcua

SEQ ID NO: 1443028 - RNA, 15 nt, Homo sapiens
cuuucucagccacaa

SEQ ID NO: 1443029 - RNA, 19 nt, Homo sapiens
cuuucucaguucagaguug

SEQ ID NO: 1443030 - RNA, 15 nt, Homo sapiens
cuuucuggaaaagag

SEQ ID NO: 1443031 - RNA, 17 nt, Homo sapiens
cuuucuuuaccugagac

SEQ ID NO: 1443032 - RNA, 17 nt, Homo sapiens
cuuucuuuuucuggaaa

SEQ ID NO: 1443033 - RNA, 17 nt, Homo sapiens
cuuugacucaccuguua

SEQ ID NO: 1443034 - RNA, 16 nt, Homo sapiens
cuuugagaacaaugga

SEQ ID NO: 1443035 - RNA, 22 nt, Homo sapiens
cuuugaggugucucaaucugau

SEQ ID NO: 1443036 - RNA, 13 nt, Homo sapiens
cuuugaguaccaa

SEQ ID NO: 1443037 - RNA, 18 nt, Homo sapiens
cuuugaugucauauggaa

SEQ ID NO: 1443038 - RNA, 14 nt, Homo sapiens
cuuugcagcaauga

SEQ ID NO: 1443039 - RNA, 14 nt, Homo sapiens
cuuugcuuugugua

SEQ ID NO: 1443040 - RNA, 20 nt, Homo sapiens
cuuuggaaacaggaccacaa

SEQ ID NO: 1443041 - RNA, 14 nt, Homo sapiens
cuuuggccauucca

SEQ ID NO: 1443042 - RNA, 15 nt, Homo sapiens
cuuuguaugcacuuu

SEQ ID NO: 1443043 - RNA, 22 nt, Homo sapiens
cuuugucauucaagccugugaa

SEQ ID NO: 1443044 - RNA, 14 nt, Homo sapiens
cuuugugccuuuga

SEQ ID NO: 1443045 - RNA, 19 nt, Homo sapiens
cuuuguucacuagacugug

SEQ ID NO: 1443046 - RNA, 16 nt, Homo sapiens
cuuuguuuugcacuga

SEQ ID NO: 1443047 - RNA, 18 nt, Homo sapiens
cuuuuaagaaacacaggg

SEQ ID NO: 1443048 - RNA, 15 nt, Homo sapiens
cuuuuacagcucuug

SEQ ID NO: 1443049 - RNA, 16 nt, Homo sapiens
cuuuuacuacagugac

SEQ ID NO: 1443050 - RNA, 22 nt, Homo sapiens
cuuuuacuuuuugccccuucca

SEQ ID NO: 1443051 - RNA, 19 nt, Homo sapiens
cuuuuaguaaagucaagga

SEQ ID NO: 1443052 - RNA, 18 nt, Homo sapiens
cuuuucaaaacugcuaaa

SEQ ID NO: 1443053 - RNA, 12 nt, Homo sapiens
cuuuucacggga

SEQ ID NO: 1443054 - RNA, 18 nt, Homo sapiens
cuuuucaucuccagugug

SEQ ID NO: 1443055 - RNA, 19 nt, Homo sapiens
cuuuuccacuccuauggaa

SEQ ID NO: 1443056 - RNA, 21 nt, Homo sapiens
cuuuuccccggucccuugaga

SEQ ID NO: 1443057 - RNA, 17 nt, Homo sapiens
cuuuucugaggacucaa

SEQ ID NO: 1443058 - RNA, 21 nt, Homo sapiens
cuuuucuuuauugcugugaau

SEQ ID NO: 1443059 - RNA, 16 nt, Homo sapiens
cuuuucuuuuucuccc

SEQ ID NO: 1443060 - RNA, 22 nt, Homo sapiens
cuuuugacaaauucuuuuucac

SEQ ID NO: 1443061 - RNA, 21 nt, Homo sapiens
cuuuugaggggcugacuucaa

SEQ ID NO: 1443062 - RNA, 11 nt, Homo sapiens
cuuuugcacau

SEQ ID NO: 1443063 - RNA, 21 nt, Homo sapiens
cuuuuuaauuuuuugauugga

SEQ ID NO: 1443064 - RNA, 14 nt, Homo sapiens
cuuuuucacacuga

SEQ ID NO: 1443065 - RNA, 18 nt, Homo sapiens
cuuuuuccagauucuucc

SEQ ID NO: 1443066 - RNA, 21 nt, Homo sapiens
cuuuuuuccuccuguguacag

SEQ ID NO: 1443067 - RNA, 22 nt, Homo sapiens
cuuuuuuuauaucagaaugagg

SEQ ID NO: 1443068 - RNA, 22 nt, Homo sapiens
cuuuuuuuugagaauacacuau

SEQ ID NO: 1443069 - RNA, 13 nt, Homo sapiens
gaaaaaccaauga

SEQ ID NO: 1443070 - RNA, 22 nt, Homo sapiens
gaaaaaccaaugauucauaaca

SEQ ID NO: 1443071 - RNA, 20 nt, Homo sapiens
gaaaaacgaucgcugugaaa

SEQ ID NO: 1443072 - RNA, 14 nt, Homo sapiens
gaaaaagagccauu

SEQ ID NO: 1443073 - RNA, 15 nt, Homo sapiens
gaaaaaguugcaguc

SEQ ID NO: 1443074 - RNA, 12 nt, Homo sapiens
gaaaaauuccag

SEQ ID NO: 1443075 - RNA, 18 nt, Homo sapiens
gaaaacaaucacacucau

SEQ ID NO: 1443076 - RNA, 16 nt, Homo sapiens
gaaaacaugacuuuau

SEQ ID NO: 1443077 - RNA, 20 nt, Homo sapiens
gaaaacauucauccaguugc

SEQ ID NO: 1443078 - RNA, 17 nt, Homo sapiens
gaaaagccagaguucca

SEQ ID NO: 1443079 - RNA, 22 nt, Homo sapiens
gaaaagccagaguuccauguuu

SEQ ID NO: 1443080 - RNA, 21 nt, Homo sapiens
gaaaagguagcuuaccugaca

SEQ ID NO: 1443081 - RNA, 16 nt, Homo sapiens
gaaaaguuaugagggu

SEQ ID NO: 1443082 - RNA, 15 nt, Homo sapiens
gaaaauaauagccau

SEQ ID NO: 1443083 - RNA, 20 nt, Homo sapiens
gaaaaucaguuauauucuuu

SEQ ID NO: 1443084 - RNA, 15 nt, Homo sapiens
gaaaauguccucccu

SEQ ID NO: 1443085 - RNA, 15 nt, Homo sapiens
gaaaaugugacccag

SEQ ID NO: 1443086 - RNA, 19 nt, Homo sapiens
gaaacaacuuguguucuau

SEQ ID NO: 1443087 - RNA, 22 nt, Homo sapiens
gaaacaacuuguguucuauuaa

SEQ ID NO: 1443088 - RNA, 19 nt, Homo sapiens
gaaacaauuauuguacacu

SEQ ID NO: 1443089 - RNA, 18 nt, Homo sapiens
gaaacaccgagucucugu

SEQ ID NO: 1443090 - RNA, 16 nt, Homo sapiens
gaaacacucaacaaua

SEQ ID NO: 1443091 - RNA, 20 nt, Homo sapiens
gaaacagggcagugacaagu

SEQ ID NO: 1443092 - RNA, 16 nt, Homo sapiens
gaaacauuccgaagag

SEQ ID NO: 1443093 - RNA, 13 nt, Homo sapiens
gaaaccacagguu

SEQ ID NO: 1443094 - RNA, 14 nt, Homo sapiens
gaaagaaguaggca

SEQ ID NO: 1443095 - RNA, 23 nt, Homo sapiens
gaaagaaguuaacuacaguguuu

SEQ ID NO: 1443096 - RNA, 15 nt, Homo sapiens
gaaagaaucagucuu

SEQ ID NO: 1443097 - RNA, 16 nt, Homo sapiens
gaaagaguagugcauu

SEQ ID NO: 1443098 - RNA, 18 nt, Homo sapiens
gaaagaguccuauuugca

SEQ ID NO: 1443099 - RNA, 18 nt, Homo sapiens
gaaagcccgccucugucc

SEQ ID NO: 1443100 - RNA, 18 nt, Homo sapiens
gaaagccguacugucuau

SEQ ID NO: 1443101 - RNA, 20 nt, Homo sapiens
gaaagcuuaggcugcuuauu

SEQ ID NO: 1443102 - RNA, 18 nt, Homo sapiens
gaaagcuucaaacugcau

SEQ ID NO: 1443103 - RNA, 20 nt, Homo sapiens
gaaaggaagcuccacuguca

SEQ ID NO: 1443104 - RNA, 13 nt, Homo sapiens
gaaaggccaauaa

SEQ ID NO: 1443105 - RNA, 19 nt, Homo sapiens
gaaaggucauuguggcuau

SEQ ID NO: 1443106 - RNA, 17 nt, Homo sapiens
gaaaguaagugguagcu

SEQ ID NO: 1443107 - RNA, 17 nt, Homo sapiens
gaaagugguucuaugau

SEQ ID NO: 1443108 - RNA, 19 nt, Homo sapiens
gaaaguguuuaacuuguca

SEQ ID NO: 1443109 - RNA, 17 nt, Homo sapiens
gaaauaaaaagcaugac

SEQ ID NO: 1443110 - RNA, 17 nt, Homo sapiens
gaaauaaacagguaaua

SEQ ID NO: 1443111 - RNA, 14 nt, Homo sapiens
gaaauaaaccugga

SEQ ID NO: 1443112 - RNA, 16 nt, Homo sapiens
gaaauaaaugauguac

SEQ ID NO: 1443113 - RNA, 18 nt, Homo sapiens
gaaauaaauuuuguuuca

SEQ ID NO: 1443114 - RNA, 15 nt, Homo sapiens
gaaauaccagugaac

SEQ ID NO: 1443115 - RNA, 17 nt, Homo sapiens
gaaauaccagugaacca

SEQ ID NO: 1443116 - RNA, 19 nt, Homo sapiens
gaaauacuuuaucugugac

SEQ ID NO: 1443117 - RNA, 16 nt, Homo sapiens
gaaauagacaguauau

SEQ ID NO: 1443118 - RNA, 13 nt, Homo sapiens
gaaauauaaugca

SEQ ID NO: 1443119 - RNA, 15 nt, Homo sapiens
gaaauauaaugcaaa

SEQ ID NO: 1443120 - RNA, 21 nt, Homo sapiens
gaaauauuacaguagugcauu

SEQ ID NO: 1443121 - RNA, 13 nt, Homo sapiens
gaaauauucucuc

SEQ ID NO: 1443122 - RNA, 15 nt, Homo sapiens
gaaaucuccagugug

SEQ ID NO: 1443123 - RNA, 12 nt, Homo sapiens
gaaaucuugcaa

SEQ ID NO: 1443124 - RNA, 11 nt, Homo sapiens
gaaaugaagga

SEQ ID NO: 1443125 - RNA, 17 nt, Homo sapiens
gaaaugauaaagauguc

SEQ ID NO: 1443126 - RNA, 21 nt, Homo sapiens
gaaaugcccaucuaugucccu

SEQ ID NO: 1443127 - RNA, 14 nt, Homo sapiens
gaaauucuguggug

SEQ ID NO: 1443128 - RNA, 14 nt, Homo sapiens
gaaauugaaccugg

SEQ ID NO: 1443129 - RNA, 16 nt, Homo sapiens
gaaauugaugccagug

SEQ ID NO: 1443130 - RNA, 13 nt, Homo sapiens
gaaauugcuauuu

SEQ ID NO: 1443131 - RNA, 22 nt, Homo sapiens
gaacaaacuaugaucacaguga

SEQ ID NO: 1443132 - RNA, 13 nt, Homo sapiens
gaacaacaacaac

SEQ ID NO: 1443133 - RNA, 14 nt, Homo sapiens
gaacaaugaaugcu

SEQ ID NO: 1443134 - RNA, 19 nt, Homo sapiens
gaacaauggagauaucagu

SEQ ID NO: 1443135 - RNA, 21 nt, Homo sapiens
gaacacccgacuccucaaaag

SEQ ID NO: 1443136 - RNA, 14 nt, Homo sapiens
gaacacgcuuucac

SEQ ID NO: 1443137 - RNA, 15 nt, Homo sapiens
gaacaguaacugcca

SEQ ID NO: 1443138 - RNA, 20 nt, Homo sapiens
gaacagucacccuucugggc

SEQ ID NO: 1443139 - RNA, 15 nt, Homo sapiens
gaacauaaagcaaau

SEQ ID NO: 1443140 - RNA, 16 nt, Homo sapiens
gaacaugcacauuuau

SEQ ID NO: 1443141 - RNA, 17 nt, Homo sapiens
gaaccaagaagggcuag

SEQ ID NO: 1443142 - RNA, 17 nt, Homo sapiens
gaaccacagaacacugg

SEQ ID NO: 1443143 - RNA, 21 nt, Homo sapiens
gaacccauuuugagugacucg

SEQ ID NO: 1443144 - RNA, 19 nt, Homo sapiens
gaacccugcuugcacuuug

SEQ ID NO: 1443145 - RNA, 17 nt, Homo sapiens
gaaccuagaagggcuag

SEQ ID NO: 1443146 - RNA, 18 nt, Homo sapiens
gaaccucaaacuggguau

SEQ ID NO: 1443147 - RNA, 22 nt, Homo sapiens
gaacgcacuuuauaaaagcaaa

SEQ ID NO: 1443148 - RNA, 13 nt, Homo sapiens
gaacggggagaaa

SEQ ID NO: 1443149 - RNA, 21 nt, Homo sapiens
gaacuaaguuuuuuacuucca

SEQ ID NO: 1443150 - RNA, 21 nt, Homo sapiens
gaacuacaaagcuucuauccc

SEQ ID NO: 1443151 - RNA, 13 nt, Homo sapiens
gaacuagaaccug

SEQ ID NO: 1443152 - RNA, 18 nt, Homo sapiens
gaacuauuuauuucaccc

SEQ ID NO: 1443153 - RNA, 15 nt, Homo sapiens
gaacuauuucuacac

SEQ ID NO: 1443154 - RNA, 11 nt, Homo sapiens
gaacuccacuc

SEQ ID NO: 1443155 - RNA, 20 nt, Homo sapiens
gaacugccccaucuccuccc

SEQ ID NO: 1443156 - RNA, 16 nt, Homo sapiens
gaagaaaaagagccau

SEQ ID NO: 1443157 - RNA, 22 nt, Homo sapiens
gaagaaauggaaucagcuuuua

SEQ ID NO: 1443158 - RNA, 14 nt, Homo sapiens
gaagaaaugggaga

SEQ ID NO: 1443159 - RNA, 15 nt, Homo sapiens
gaagaaauucuguca

SEQ ID NO: 1443160 - RNA, 20 nt, Homo sapiens
gaagaacaguaacugccauc

SEQ ID NO: 1443161 - RNA, 21 nt, Homo sapiens
gaagaacaucccaagccagaa

SEQ ID NO: 1443162 - RNA, 14 nt, Homo sapiens
gaagaagaguuucu

SEQ ID NO: 1443163 - RNA, 12 nt, Homo sapiens
gaagaagccaga

SEQ ID NO: 1443164 - RNA, 21 nt, Homo sapiens
gaagaaguuuaaaaaaccaug

SEQ ID NO: 1443165 - RNA, 12 nt, Homo sapiens
gaagacacugca

SEQ ID NO: 1443166 - RNA, 12 nt, Homo sapiens
gaagacuggaag

SEQ ID NO: 1443167 - RNA, 14 nt, Homo sapiens
gaagagaagggaag

SEQ ID NO: 1443168 - RNA, 13 nt, Homo sapiens
gaagagaccacag

SEQ ID NO: 1443169 - RNA, 19 nt, Homo sapiens
gaagagacucucuuaggga

SEQ ID NO: 1443170 - RNA, 11 nt, Homo sapiens
gaagagcauug

SEQ ID NO: 1443171 - RNA, 14 nt, Homo sapiens
gaagaggaagcaag

SEQ ID NO: 1443172 - RNA, 17 nt, Homo sapiens
gaagauagaacaaugcu

SEQ ID NO: 1443173 - RNA, 17 nt, Homo sapiens
gaagaugaagagaagcu

SEQ ID NO: 1443174 - RNA, 18 nt, Homo sapiens
gaagauucuccugugcua

SEQ ID NO: 1443175 - RNA, 16 nt, Homo sapiens
gaagcacagagggcua

SEQ ID NO: 1443176 - RNA, 19 nt, Homo sapiens
gaagcacagagggcuaggg

SEQ ID NO: 1443177 - RNA, 17 nt, Homo sapiens
gaagcacagcagcaucu

SEQ ID NO: 1443178 - RNA, 23 nt, Homo sapiens
gaagcacuccucgguacucccau

SEQ ID NO: 1443179 - RNA, 20 nt, Homo sapiens
gaagcagguucuugauguca

SEQ ID NO: 1443180 - RNA, 18 nt, Homo sapiens
gaagccaaacaaaggccc

SEQ ID NO: 1443181 - RNA, 18 nt, Homo sapiens
gaagccccauuugcacag

SEQ ID NO: 1443182 - RNA, 23 nt, Homo sapiens
gaagcgacuauaaagguuuuuga

SEQ ID NO: 1443183 - RNA, 16 nt, Homo sapiens
gaagcuccacugucac

SEQ ID NO: 1443184 - RNA, 22 nt, Homo sapiens
gaagcugaggauccucacagga

SEQ ID NO: 1443185 - RNA, 21 nt, Homo sapiens
gaagcuguguccuugcaccug

SEQ ID NO: 1443186 - RNA, 14 nt, Homo sapiens
gaaggaguucacug

SEQ ID NO: 1443187 - RNA, 23 nt, Homo sapiens
gaaggaugucccggguguguaca

SEQ ID NO: 1443188 - RNA, 14 nt, Homo sapiens
gaaggccuuuucac

SEQ ID NO: 1443189 - RNA, 19 nt, Homo sapiens
gaaggcucccuaacacaca

SEQ ID NO: 1443190 - RNA, 10 nt, Homo sapiens
gaagggccag

SEQ ID NO: 1443191 - RNA, 11 nt, Homo sapiens
gaagggccagg

SEQ ID NO: 1443192 - RNA, 16 nt, Homo sapiens
gaagggugacauccca

SEQ ID NO: 1443193 - RNA, 22 nt, Homo sapiens
gaagguauuccuuuuguguaca

SEQ ID NO: 1443194 - RNA, 19 nt, Homo sapiens
gaagguuuguauauuguca

SEQ ID NO: 1443195 - RNA, 21 nt, Homo sapiens
gaagucaucagcuuugugcca

SEQ ID NO: 1443196 - RNA, 16 nt, Homo sapiens
gaagugagaaguucau

SEQ ID NO: 1443197 - RNA, 15 nt, Homo sapiens
gaaguggcagugaaa

SEQ ID NO: 1443198 - RNA, 19 nt, Homo sapiens
gaaguuccaguguucucuc

SEQ ID NO: 1443199 - RNA, 17 nt, Homo sapiens
gaauaaaauugcacuuu

SEQ ID NO: 1443200 - RNA, 17 nt, Homo sapiens
gaauaaacgugcucccc

SEQ ID NO: 1443201 - RNA, 17 nt, Homo sapiens
gaauaaaugaaucuuac

SEQ ID NO: 1443202 - RNA, 17 nt, Homo sapiens
gaauagccauguacuau

SEQ ID NO: 1443203 - RNA, 18 nt, Homo sapiens
gaauagcgaaucaucuca

SEQ ID NO: 1443204 - RNA, 23 nt, Homo sapiens
gaauauauggucugugugucuga

SEQ ID NO: 1443205 - RNA, 18 nt, Homo sapiens
gaauaugcuagugaugua

SEQ ID NO: 1443206 - RNA, 13 nt, Homo sapiens
gaaucaagcuaga

SEQ ID NO: 1443207 - RNA, 14 nt, Homo sapiens
gaaucaauuuccca

SEQ ID NO: 1443208 - RNA, 19 nt, Homo sapiens
gaaucaucucaaauccuug

SEQ ID NO: 1443209 - RNA, 14 nt, Homo sapiens
gaaucauuaucuua

SEQ ID NO: 1443210 - RNA, 22 nt, Homo sapiens
gaauccgccugcagaggacaga

SEQ ID NO: 1443211 - RNA, 21 nt, Homo sapiens
gaaugaaguggaggaaguaac

SEQ ID NO: 1443212 - RNA, 20 nt, Homo sapiens
gaaugcaaaaaaucuuccaa

SEQ ID NO: 1443213 - RNA, 24 nt, Homo sapiens
gaaugcacacuagccucuccagga

SEQ ID NO: 1443214 - RNA, 22 nt, Homo sapiens
ggacccccuggcccugccucau

SEQ ID NO: 1443215 - RNA, 13 nt, Homo sapiens
ggaccucugcucu

SEQ ID NO: 1443216 - RNA, 18 nt, Homo sapiens
ggaccuuccacacagggu

SEQ ID NO: 1443217 - RNA, 19 nt, Homo sapiens
ggaccuuccugccaccagu

SEQ ID NO: 1443218 - RNA, 19 nt, Homo sapiens
ggacuauuuaugaaggcaa

SEQ ID NO: 1443219 - RNA, 21 nt, Homo sapiens
ggacuccccaggccaggccac

SEQ ID NO: 1443220 - RNA, 20 nt, Homo sapiens
ggacucugccuuuuuucaca

SEQ ID NO: 1443221 - RNA, 22 nt, Homo sapiens
ggacugagccuggcccauagaa

SEQ ID NO: 1443222 - RNA, 17 nt, Homo sapiens
ggacuggaaccagggag

SEQ ID NO: 1443223 - RNA, 23 nt, Homo sapiens
ggacuggcuucucuuucucugag

SEQ ID NO: 1443224 - RNA, 17 nt, Homo sapiens
ggacuuuugaaaagcuu

SEQ ID NO: 1443225 - RNA, 18 nt, Homo sapiens
ggagaagaaagaggugac

SEQ ID NO: 1443226 - RNA, 19 nt, Homo sapiens
ggagaaggaaggcuccauc

SEQ ID NO: 1443227 - RNA, 16 nt, Homo sapiens
ggagaaucgcuuaaac

SEQ ID NO: 1443228 - RNA, 17 nt, Homo sapiens
ggagacacugugcuaua

SEQ ID NO: 1443229 - RNA, 18 nt, Homo sapiens
ggagaccucuacugccuu

SEQ ID NO: 1443230 - RNA, 20 nt, Homo sapiens
ggagagaggcucagccacac

SEQ ID NO: 1443231 - RNA, 15 nt, Homo sapiens
ggagagcagcuggcu

SEQ ID NO: 1443232 - RNA, 13 nt, Homo sapiens
ggagagcccuuca

SEQ ID NO: 1443233 - RNA, 14 nt, Homo sapiens
ggagaggacucugc

SEQ ID NO: 1443234 - RNA, 22 nt, Homo sapiens
ggagaggcggccucgugccaug

SEQ ID NO: 1443235 - RNA, 19 nt, Homo sapiens
ggagaguugaccguuuuca

SEQ ID NO: 1443236 - RNA, 14 nt, Homo sapiens
ggagaugaugauga

SEQ ID NO: 1443237 - RNA, 23 nt, Homo sapiens
ggagcaguaaacuuucucugcaa

SEQ ID NO: 1443238 - RNA, 18 nt, Homo sapiens
ggagccucccccucagau

SEQ ID NO: 1443239 - RNA, 19 nt, Homo sapiens
ggagcucacucccacugga

SEQ ID NO: 1443240 - RNA, 14 nt, Homo sapiens
ggagcuugcaguga

SEQ ID NO: 1443241 - RNA, 23 nt, Homo sapiens
ggagcuuuagcuucucugccaag

SEQ ID NO: 1443242 - RNA, 19 nt, Homo sapiens
ggaggaucgccugagccca

SEQ ID NO: 1443243 - RNA, 13 nt, Homo sapiens
ggaggccucaguu

SEQ ID NO: 1443244 - RNA, 14 nt, Homo sapiens
ggaggccugaugcu

SEQ ID NO: 1443245 - RNA, 21 nt, Homo sapiens
ggaggcugcucggggugcaca

SEQ ID NO: 1443246 - RNA, 14 nt, Homo sapiens
ggagggagggacaa

SEQ ID NO: 1443247 - RNA, 21 nt, Homo sapiens
ggagggccccucaugugugcu

SEQ ID NO: 1443248 - RNA, 19 nt, Homo sapiens
ggaggugggguacauuucu

SEQ ID NO: 1443249 - RNA, 18 nt, Homo sapiens
ggaguagaaaaaucucau

SEQ ID NO: 1443250 - RNA, 20 nt, Homo sapiens
ggaguucguggcugcaaaag

SEQ ID NO: 1443251 - RNA, 18 nt, Homo sapiens
ggaguuugacgagcucac

SEQ ID NO: 1443252 - RNA, 17 nt, Homo sapiens
ggauacagaaugaaucc

SEQ ID NO: 1443253 - RNA, 23 nt, Homo sapiens
ggauacagucuucuuacuuggaa

SEQ ID NO: 1443254 - RNA, 20 nt, Homo sapiens
ggauaucuguguauaugccc

SEQ ID NO: 1443255 - RNA, 13 nt, Homo sapiens
ggauauuuacuac

SEQ ID NO: 1443256 - RNA, 21 nt, Homo sapiens
ggaucagccuccgccauucca

SEQ ID NO: 1443257 - RNA, 18 nt, Homo sapiens
ggaucccaggccagggaa

SEQ ID NO: 1443258 - RNA, 14 nt, Homo sapiens
ggauccuuuccugg

SEQ ID NO: 1443259 - RNA, 16 nt, Homo sapiens
ggaugaugguugcaaa

SEQ ID NO: 1443260 - RNA, 16 nt, Homo sapiens
ggaugcacacacagau

SEQ ID NO: 1443261 - RNA, 14 nt, Homo sapiens
ggauggaagugucu

SEQ ID NO: 1443262 - RNA, 13 nt, Homo sapiens
ggauggagcacuu

SEQ ID NO: 1443263 - RNA, 23 nt, Homo sapiens
ggauggcacuccggccaccuccu

SEQ ID NO: 1443264 - RNA, 22 nt, Homo sapiens
ggauuccagagcacugcuccag

SEQ ID NO: 1443265 - RNA, 15 nt, Homo sapiens
ggauuccagcauuug

SEQ ID NO: 1443266 - RNA, 14 nt, Homo sapiens
ggauuuccucccuc

SEQ ID NO: 1443267 - RNA, 23 nt, Homo sapiens
ggauuugaagcaaagcaccagcu

SEQ ID NO: 1443268 - RNA, 17 nt, Homo sapiens
ggcaaagaaaagccaga

SEQ ID NO: 1443269 - RNA, 18 nt, Homo sapiens
ggcaaagaaaagccagag

SEQ ID NO: 1443270 - RNA, 15 nt, Homo sapiens
ggcaaagagaccacu

SEQ ID NO: 1443271 - RNA, 19 nt, Homo sapiens
ggcaaagguggcucuccag

SEQ ID NO: 1443272 - RNA, 23 nt, Homo sapiens
ggcaacaauacaugcugcuaauu

SEQ ID NO: 1443273 - RNA, 22 nt, Homo sapiens
ggcaaggacggccuucaacuga

SEQ ID NO: 1443274 - RNA, 13 nt, Homo sapiens
ggcaagugauauc

SEQ ID NO: 1443275 - RNA, 16 nt, Homo sapiens
ggcacaaaugcaccuc

SEQ ID NO: 1443276 - RNA, 23 nt, Homo sapiens
ggcacaaaugcaccucccaguuu

SEQ ID NO: 1443277 - RNA, 15 nt, Homo sapiens
ggcaccgcgugccau

SEQ ID NO: 1443278 - RNA, 21 nt, Homo sapiens
ggcaccuccuacgucaaacau

SEQ ID NO: 1443279 - RNA, 22 nt, Homo sapiens
ggcacugcaggggccgagccau

SEQ ID NO: 1443280 - RNA, 11 nt, Homo sapiens
ggcacugccug

SEQ ID NO: 1443281 - RNA, 22 nt, Homo sapiens
ggcagaagaauugaacccagga

SEQ ID NO: 1443282 - RNA, 21 nt, Homo sapiens
ggcagagaagccccuaggcaa

SEQ ID NO: 1443283 - RNA, 21 nt, Homo sapiens
ggcagaugaaauuuauuucca

SEQ ID NO: 1443284 - RNA, 22 nt, Homo sapiens
ggcagcuguagcucccgagcua

SEQ ID NO: 1443285 - RNA, 16 nt, Homo sapiens
ggcagcugucauucag

SEQ ID NO: 1443286 - RNA, 21 nt, Homo sapiens
ggcaguagacuauaagcagaa

SEQ ID NO: 1443287 - RNA, 22 nt, Homo sapiens
ggcaguuacagggcccagguga

SEQ ID NO: 1443288 - RNA, 11 nt, Homo sapiens
ggcauaugcaa

SEQ ID NO: 1443289 - RNA, 20 nt, Homo sapiens
ggcaugagggaucacagggc

SEQ ID NO: 1443290 - RNA, 19 nt, Homo sapiens
ggcaugccuuucuguaacc

SEQ ID NO: 1443291 - RNA, 16 nt, Homo sapiens
ggcaugugaugugcaa

SEQ ID NO: 1443292 - RNA, 19 nt, Homo sapiens
ggccagcugucgcaucuca

SEQ ID NO: 1443293 - RNA, 15 nt, Homo sapiens
ggccccugcaucccc

SEQ ID NO: 1443294 - RNA, 19 nt, Homo sapiens
ggcccgacagccuggcaca

SEQ ID NO: 1443295 - RNA, 13 nt, Homo sapiens
ggcccuccuugcc

SEQ ID NO: 1443296 - RNA, 15 nt, Homo sapiens
ggcccucuucuuauu

SEQ ID NO: 1443297 - RNA, 18 nt, Homo sapiens
ggccuaaucucauaccuc

SEQ ID NO: 1443298 - RNA, 14 nt, Homo sapiens
ggccuauuccggaa

SEQ ID NO: 1443299 - RNA, 16 nt, Homo sapiens
ggccucagaccaacuc

SEQ ID NO: 1443300 - RNA, 19 nt, Homo sapiens
ggccucccaaagugcuagu

SEQ ID NO: 1443301 - RNA, 12 nt, Homo sapiens
ggccucccucaa

SEQ ID NO: 1443302 - RNA, 16 nt, Homo sapiens
ggccugcccucaggga

SEQ ID NO: 1443303 - RNA, 17 nt, Homo sapiens
ggccuggcaagugggug

SEQ ID NO: 1443304 - RNA, 18 nt, Homo sapiens
ggccuguguagcugugac

SEQ ID NO: 1443305 - RNA, 16 nt, Homo sapiens
ggccuuguucugucac

SEQ ID NO: 1443306 - RNA, 22 nt, Homo sapiens
ggccuuuccugugccaaccuga

SEQ ID NO: 1443307 - RNA, 17 nt, Homo sapiens
ggcgaaucuacagaaca

SEQ ID NO: 1443308 - RNA, 19 nt, Homo sapiens
ggcgacagagcgagacucc

SEQ ID NO: 1443309 - RNA, 15 nt, Homo sapiens
ggcgcaucauaugca

SEQ ID NO: 1443310 - RNA, 11 nt, Homo sapiens
ggcgcgguggc

SEQ ID NO: 1443311 - RNA, 22 nt, Homo sapiens
ggcggaaaccuugcagcauuuu

SEQ ID NO: 1443312 - RNA, 16 nt, Homo sapiens
ggcgggcagggguucc

SEQ ID NO: 1443313 - RNA, 19 nt, Homo sapiens
ggcuaaacaagggcaguga

SEQ ID NO: 1443314 - RNA, 21 nt, Homo sapiens
ggcuaagaugagauuugccag

SEQ ID NO: 1443315 - RNA, 21 nt, Homo sapiens
ggcuaauucccagagugugaa

SEQ ID NO: 1443316 - RNA, 17 nt, Homo sapiens
ggcuagaaccuggagaa

SEQ ID NO: 1443317 - RNA, 17 nt, Homo sapiens
ggcuagaaucuggagag

SEQ ID NO: 1443318 - RNA, 19 nt, Homo sapiens
ggcuccaucuccaguggga

SEQ ID NO: 1443319 - RNA, 21 nt, Homo sapiens
ggcucccuccuggagcauccc

SEQ ID NO: 1443320 - RNA, 13 nt, Homo sapiens
ggcuccugucauc

SEQ ID NO: 1443321 - RNA, 13 nt, Homo sapiens
ggcuccugugcua

SEQ ID NO: 1443322 - RNA, 18 nt, Homo sapiens
ggcucuggagccagagag

SEQ ID NO: 1443323 - RNA, 14 nt, Homo sapiens
ggcucuucaaagac

SEQ ID NO: 1443324 - RNA, 19 nt, Homo sapiens
ggcugaauccgugguggca

SEQ ID NO: 1443325 - RNA, 15 nt, Homo sapiens
ggcugagcucuuauc

SEQ ID NO: 1443326 - RNA, 11 nt, Homo sapiens
ggcugcacaga

SEQ ID NO: 1443327 - RNA, 17 nt, Homo sapiens
ggcugccaggauggcgu

SEQ ID NO: 1443328 - RNA, 15 nt, Homo sapiens
ggcugcuggggcaug

SEQ ID NO: 1443329 - RNA, 18 nt, Homo sapiens
ggcuggcugaguggaaug

SEQ ID NO: 1443330 - RNA, 12 nt, Homo sapiens
ggcugguccuga

SEQ ID NO: 1443331 - RNA, 21 nt, Homo sapiens
ggcugucugucaccagcuauc

SEQ ID NO: 1443332 - RNA, 20 nt, Homo sapiens
ggcugugcucucaccagcug

SEQ ID NO: 1443333 - RNA, 13 nt, Homo sapiens
ggcuguucugcac

SEQ ID NO: 1443334 - RNA, 23 nt, Homo sapiens
ggcuuaaggagaggagaaacuga

SEQ ID NO: 1443335 - RNA, 21 nt, Homo sapiens
ggcuuagacuucgacucagga

SEQ ID NO: 1443336 - RNA, 14 nt, Homo sapiens
ggcuugcaugccaa

SEQ ID NO: 1443337 - RNA, 19 nt, Homo sapiens
ggcuuguagaccacugucc

SEQ ID NO: 1443338 - RNA, 13 nt, Homo sapiens
gggaaacagggag

SEQ ID NO: 1443339 - RNA, 21 nt, Homo sapiens
gggaagcugggggaagggugg

SEQ ID NO: 1443340 - RNA, 16 nt, Homo sapiens
gggaaggaagggacac

SEQ ID NO: 1443341 - RNA, 12 nt, Homo sapiens
gggaaugagcau

SEQ ID NO: 1443342 - RNA, 21 nt, Homo sapiens
gggaaugccacagugaaggga

SEQ ID NO: 1443343 - RNA, 20 nt, Homo sapiens
gggacaaaggagccugugaa

SEQ ID NO: 1443344 - RNA, 14 nt, Homo sapiens
gggaccagggaugg

SEQ ID NO: 1443345 - RNA, 15 nt, Homo sapiens
gggaccuauaucuca

SEQ ID NO: 1443346 - RNA, 16 nt, Homo sapiens
gggacuccaguucaca

SEQ ID NO: 1443347 - RNA, 13 nt, Homo sapiens
gggacugagccug

SEQ ID NO: 1443348 - RNA, 18 nt, Homo sapiens
gggacuucugucuucaca

SEQ ID NO: 1443349 - RNA, 11 nt, Homo sapiens
gggagcacaga

SEQ ID NO: 1443350 - RNA, 22 nt, Homo sapiens
gggagcaugggacugugccuuu

SEQ ID NO: 1443351 - RNA, 23 nt, Homo sapiens
gggagccccuaggaaagcagugu

SEQ ID NO: 1443352 - RNA, 13 nt, Homo sapiens
gggagcuggaaau

SEQ ID NO: 1443353 - RNA, 23 nt, Homo sapiens
gggaggccgaagcuaacagggaa

SEQ ID NO: 1443354 - RNA, 15 nt, Homo sapiens
gggaguguugucaca

SEQ ID NO: 1443355 - RNA, 22 nt, Homo sapiens
gggaugcacggcggcagggugg

SEQ ID NO: 1443356 - RNA, 18 nt, Homo sapiens
gggaugccacccagcaac

SEQ ID NO: 1443357 - RNA, 19 nt, Homo sapiens
gggauuggagggaagacag

SEQ ID NO: 1443358 - RNA, 23 nt, Homo sapiens
gggauuucuucgcugcucuagcu

SEQ ID NO: 1443359 - RNA, 23 nt, Homo sapiens
gggcaaagaacugccccaucucc

SEQ ID NO: 1443360 - RNA, 21 nt, Homo sapiens
gggcaacaauacaugcugcua

SEQ ID NO: 1443361 - RNA, 17 nt, Homo sapiens
gggcaacgacgguuuca

SEQ ID NO: 1443362 - RNA, 23 nt, Homo sapiens
gggcacgagagagucuuccaggu

SEQ ID NO: 1443363 - RNA, 18 nt, Homo sapiens
gggcacugaggaccagcc

SEQ ID NO: 1443364 - RNA, 12 nt, Homo sapiens
gggcacugccug

SEQ ID NO: 1443365 - RNA, 15 nt, Homo sapiens
gggcagggguuccca

SEQ ID NO: 1443366 - RNA, 13 nt, Homo sapiens
gggccagugcugg

SEQ ID NO: 1443367 - RNA, 21 nt, Homo sapiens
gggcccacagggaacccugcu

SEQ ID NO: 1443368 - RNA, 14 nt, Homo sapiens
gggcccuccuugcc

SEQ ID NO: 1443369 - RNA, 16 nt, Homo sapiens
gggcccugggccucag

SEQ ID NO: 1443370 - RNA, 15 nt, Homo sapiens
gggccuaggaggacc

SEQ ID NO: 1443371 - RNA, 22 nt, Homo sapiens
gggccugcugcgucagaccagu

SEQ ID NO: 1443372 - RNA, 14 nt, Homo sapiens
gggccugcugcuga

SEQ ID NO: 1443373 - RNA, 16 nt, Homo sapiens
gggccuggcuggcuga

SEQ ID NO: 1443374 - RNA, 23 nt, Homo sapiens
gggccuucacagugaccaucgca

SEQ ID NO: 1443375 - RNA, 19 nt, Homo sapiens
gggcuggcugcuggaagaa

SEQ ID NO: 1443376 - RNA, 12 nt, Homo sapiens
ggggaacagagc

SEQ ID NO: 1443377 - RNA, 20 nt, Homo sapiens
ggggcccugcaccugugcag

SEQ ID NO: 1443378 - RNA, 14 nt, Homo sapiens
gggggagcuggaaa

SEQ ID NO: 1443379 - RNA, 17 nt, Homo sapiens
gggggccuucacaguga

SEQ ID NO: 1443380 - RNA, 18 nt, Homo sapiens
ggguaugggaagccauau

SEQ ID NO: 1443381 - RNA, 20 nt, Homo sapiens
gggucccucggagcugccag

SEQ ID NO: 1443382 - RNA, 23 nt, Homo sapiens
gggucccugauaacaaccuggag

SEQ ID NO: 1443383 - RNA, 16 nt, Homo sapiens
ggguccuguccaugcc

SEQ ID NO: 1443384 - RNA, 20 nt, Homo sapiens
gggucuuugugagagugagc

SEQ ID NO: 1443385 - RNA, 21 nt, Homo sapiens
ggguggcccccugugccagcu

SEQ ID NO: 1443386 - RNA, 19 nt, Homo sapiens
ggguguuaaggcagugacu

SEQ ID NO: 1443387 - RNA, 14 nt, Homo sapiens
ggguuacuuucaca

SEQ ID NO: 1443388 - RNA, 18 nt, Homo sapiens
ggguuagcucacgugucu

SEQ ID NO: 1443389 - RNA, 22 nt, Homo sapiens
ggguugcggcgugaugucuuca

SEQ ID NO: 1443390 - RNA, 17 nt, Homo sapiens
ggguuucauauccagcu

SEQ ID NO: 1443391 - RNA, 15 nt, Homo sapiens
gguaaaaguuacuua

SEQ ID NO: 1443392 - RNA, 15 nt, Homo sapiens
gguacuacaaccaau

SEQ ID NO: 1443393 - RNA, 21 nt, Homo sapiens
gguagcuuaccugacacaaga

SEQ ID NO: 1443394 - RNA, 14 nt, Homo sapiens
gguaguacugggaa

SEQ ID NO: 1443395 - RNA, 22 nt, Homo sapiens
gguauauuuccauucaugccaa

SEQ ID NO: 1443396 - RNA, 16 nt, Homo sapiens
gguaugaguugcccau

SEQ ID NO: 1443397 - RNA, 21 nt, Homo sapiens
gguauuaaauugauguugcug

SEQ ID NO: 1443398 - RNA, 18 nt, Homo sapiens
ggucacuaaccaagccag

SEQ ID NO: 1443399 - RNA, 18 nt, Homo sapiens
ggucauuauuuuuuacaa

SEQ ID NO: 1443400 - RNA, 15 nt, Homo sapiens
gguccaggaaggcag

SEQ ID NO: 1443401 - RNA, 14 nt, Homo sapiens
ggucccagagggug

SEQ ID NO: 1443402 - RNA, 17 nt, Homo sapiens
gguccccaucaucccag

SEQ ID NO: 1443403 - RNA, 15 nt, Homo sapiens
gguccugagcacugc

SEQ ID NO: 1443404 - RNA, 20 nt, Homo sapiens
gguccugcaaucuccagggc

SEQ ID NO: 1443405 - RNA, 22 nt, Homo sapiens
gguccuugcaccccucacucug

SEQ ID NO: 1443406 - RNA, 20 nt, Homo sapiens
gguccuugucccaagcccag

SEQ ID NO: 1443407 - RNA, 22 nt, Homo sapiens
ggucucagcccgggacaggguc

SEQ ID NO: 1443408 - RNA, 20 nt, Homo sapiens
ggucuuugcaagaaucauua

SEQ ID NO: 1443409 - RNA, 17 nt, Homo sapiens
ggugaaauccaggucuc

SEQ ID NO: 1443410 - RNA, 15 nt, Homo sapiens
ggugcagaggugagc

SEQ ID NO: 1443411 - RNA, 18 nt, Homo sapiens
ggugcaguugacagcagg

SEQ ID NO: 1443412 - RNA, 12 nt, Homo sapiens
ggugcguggcug

SEQ ID NO: 1443413 - RNA, 16 nt, Homo sapiens
gguggcucuccaguua

SEQ ID NO: 1443414 - RNA, 13 nt, Homo sapiens
gguguauuugcca

SEQ ID NO: 1443415 - RNA, 19 nt, Homo sapiens
gguguugguguauuugcca

SEQ ID NO: 1443416 - RNA, 15 nt, Homo sapiens
gguguuuaaagucaa

SEQ ID NO: 1443417 - RNA, 12 nt, Homo sapiens
gguugaaggcag

SEQ ID NO: 1443418 - RNA, 13 nt, Homo sapiens
gguugcagugagc

SEQ ID NO: 1443419 - RNA, 16 nt, Homo sapiens
gguuucggagcacgua

SEQ ID NO: 1443420 - RNA, 14 nt, Homo sapiens
gguuucucuguaua

SEQ ID NO: 1443421 - RNA, 14 nt, Homo sapiens
guaaaaucuuggca

SEQ ID NO: 1443422 - RNA, 13 nt, Homo sapiens
guaaacauaauuc

SEQ ID NO: 1443423 - RNA, 12 nt, Homo sapiens
guaaaccaaaaa

SEQ ID NO: 1443424 - RNA, 13 nt, Homo sapiens
guaaaccaaaaag

SEQ ID NO: 1443425 - RNA, 19 nt, Homo sapiens
guaaacuauaaacuacugu

SEQ ID NO: 1443426 - RNA, 20 nt, Homo sapiens
guaaagaauaaaugaaucuu

SEQ ID NO: 1443427 - RNA, 18 nt, Homo sapiens
guaaauauccacagacuc

SEQ ID NO: 1443428 - RNA, 21 nt, Homo sapiens
guaaauccuauuauguguuca

SEQ ID NO: 1443429 - RNA, 14 nt, Homo sapiens
guaaaugccacaaa

SEQ ID NO: 1443430 - RNA, 11 nt, Homo sapiens
guaaaugcucg

SEQ ID NO: 1443431 - RNA, 21 nt, Homo sapiens
guaaaugcucgugugauuucc

SEQ ID NO: 1443432 - RNA, 18 nt, Homo sapiens
guaacacaagccacagaa

SEQ ID NO: 1443433 - RNA, 18 nt, Homo sapiens
guaacaugcaauuuugca

SEQ ID NO: 1443434 - RNA, 21 nt, Homo sapiens
guaacccgcucaucacuggau

SEQ ID NO: 1443435 - RNA, 21 nt, Homo sapiens
guaacugggaucgcaccuuuu

SEQ ID NO: 1443436 - RNA, 10 nt, Homo sapiens
guaacugugu

SEQ ID NO: 1443437 - RNA, 14 nt, Homo sapiens
guaagcauucugag

SEQ ID NO: 1443438 - RNA, 18 nt, Homo sapiens
guaauaaacgucuugcca

SEQ ID NO: 1443439 - RNA, 17 nt, Homo sapiens
guaaucccagcuacuca

SEQ ID NO: 1443440 - RNA, 16 nt, Homo sapiens
guaaucccccuugcca

SEQ ID NO: 1443441 - RNA, 12 nt, Homo sapiens
guaaugcacaau

SEQ ID NO: 1443442 - RNA, 19 nt, Homo sapiens
guaauuaaguaaaccaaaa

SEQ ID NO: 1443443 - RNA, 18 nt, Homo sapiens
guacaaguuuuguauaaa

SEQ ID NO: 1443444 - RNA, 22 nt, Homo sapiens
guacagaauuuuuaaugacuuu

SEQ ID NO: 1443445 - RNA, 10 nt, Homo sapiens
guacauguau

SEQ ID NO: 1443446 - RNA, 18 nt, Homo sapiens
guacauuucccugugcug

SEQ ID NO: 1443447 - RNA, 21 nt, Homo sapiens
guacauuucccugugcugacg

SEQ ID NO: 1443448 - RNA, 17 nt, Homo sapiens
guacauuuggcauuugu

SEQ ID NO: 1443449 - RNA, 21 nt, Homo sapiens
guaccaaauccacaagccauu

SEQ ID NO: 1443450 - RNA, 17 nt, Homo sapiens
guaccagaacuauuuau

SEQ ID NO: 1443451 - RNA, 12 nt, Homo sapiens
guaccagccagg

SEQ ID NO: 1443452 - RNA, 14 nt, Homo sapiens
guacccaccgggcc

SEQ ID NO: 1443453 - RNA, 14 nt, Homo sapiens
guacccuuccaccu

SEQ ID NO: 1443454 - RNA, 16 nt, Homo sapiens
guaccgcgucuacccu

SEQ ID NO: 1443455 - RNA, 17 nt, Homo sapiens
guacuccuuaaauuuau

SEQ ID NO: 1443456 - RNA, 15 nt, Homo sapiens
guacucucugcucua

SEQ ID NO: 1443457 - RNA, 19 nt, Homo sapiens
guacucuggagagacugug

SEQ ID NO: 1443458 - RNA, 20 nt, Homo sapiens
guacucuuaacuccuagccc

SEQ ID NO: 1443459 - RNA, 17 nt, Homo sapiens
guacugagacauuacag

SEQ ID NO: 1443460 - RNA, 18 nt, Homo sapiens
guacuuccuguguacucu

SEQ ID NO: 1443461 - RNA, 18 nt, Homo sapiens
guacuugugaccauugua

SEQ ID NO: 1443462 - RNA, 22 nt, Homo sapiens
guacuuguuucaccauacuuca

SEQ ID NO: 1443463 - RNA, 13 nt, Homo sapiens
guagaacugagaa

SEQ ID NO: 1443464 - RNA, 18 nt, Homo sapiens
guagagguuuuguuguuu

SEQ ID NO: 1443465 - RNA, 14 nt, Homo sapiens
guagauaacagcuu

SEQ ID NO: 1443466 - RNA, 16 nt, Homo sapiens
guagauuaccugccac

SEQ ID NO: 1443467 - RNA, 20 nt, Homo sapiens
guagcgagcugcucugcuau

SEQ ID NO: 1443468 - RNA, 18 nt, Homo sapiens
guagcguaacaaacaaaa

SEQ ID NO: 1443469 - RNA, 13 nt, Homo sapiens
guagcugaugaaa

SEQ ID NO: 1443470 - RNA, 22 nt, Homo sapiens
guagguacuucacauugcaaac

SEQ ID NO: 1443471 - RNA, 16 nt, Homo sapiens
guagucccagccacuc

SEQ ID NO: 1443472 - RNA, 19 nt, Homo sapiens
guagugauguuguuuggga

SEQ ID NO: 1443473 - RNA, 22 nt, Homo sapiens
guaguuaggaaauaaaaccuuu

SEQ ID NO: 1443474 - RNA, 17 nt, Homo sapiens
guauaaagucacuucca

SEQ ID NO: 1443475 - RNA, 23 nt, Homo sapiens
guauaaauguuauguuugcuaaa

SEQ ID NO: 1443476 - RNA, 20 nt, Homo sapiens
guauaaccccaccuugccaa

SEQ ID NO: 1443477 - RNA, 18 nt, Homo sapiens
guauaaugguugacuggg

SEQ ID NO: 1443478 - RNA, 19 nt, Homo sapiens
guauaaugguugacugggu

SEQ ID NO: 1443479 - RNA, 17 nt, Homo sapiens
guauagcugacaucucc

SEQ ID NO: 1443480 - RNA, 14 nt, Homo sapiens
guauauaauacuaa

SEQ ID NO: 1443481 - RNA, 23 nt, Homo sapiens
guauauaauacuaaagugucuau

SEQ ID NO: 1443482 - RNA, 13 nt, Homo sapiens
guauauacauaug

SEQ ID NO: 1443483 - RNA, 22 nt, Homo sapiens
guauaucaugaaacacuucuca

SEQ ID NO: 1443484 - RNA, 20 nt, Homo sapiens
guauauuaugguguaaugca

SEQ ID NO: 1443485 - RNA, 14 nt, Homo sapiens
guauauugucagau

SEQ ID NO: 1443486 - RNA, 14 nt, Homo sapiens
guauauuuaucaaa

SEQ ID NO: 1443487 - RNA, 19 nt, Homo sapiens
guaucuaccucacuauuca

SEQ ID NO: 1443488 - RNA, 20 nt, Homo sapiens
guaucuaccucacuauucaa

SEQ ID NO: 1443489 - RNA, 18 nt, Homo sapiens
ucaaugcaucaauuuacc

SEQ ID NO: 1443490 - RNA, 14 nt, Homo sapiens
ucaauuaguacagu

SEQ ID NO: 1443491 - RNA, 16 nt, Homo sapiens
ucaauuauuacauuua

SEQ ID NO: 1443492 - RNA, 15 nt, Homo sapiens
ucaauuuaaauaacc

SEQ ID NO: 1443493 - RNA, 21 nt, Homo sapiens
ucaauuuaccuacucuaugua

SEQ ID NO: 1443494 - RNA, 20 nt, Homo sapiens
ucacaaaaaggcauaugcaa

SEQ ID NO: 1443495 - RNA, 20 nt, Homo sapiens
ucacaacagaaaacccaaaa

SEQ ID NO: 1443496 - RNA, 23 nt, Homo sapiens
ucacaacagauuauuaccuuaca

SEQ ID NO: 1443497 - RNA, 21 nt, Homo sapiens
ucacaagggauuggcaauugu

SEQ ID NO: 1443498 - RNA, 18 nt, Homo sapiens
ucacacauccgcuucaua

SEQ ID NO: 1443499 - RNA, 16 nt, Homo sapiens
ucacaccaccugacag

SEQ ID NO: 1443500 - RNA, 17 nt, Homo sapiens
ucacacgggaagaucau

SEQ ID NO: 1443501 - RNA, 16 nt, Homo sapiens
ucacagcucuguagaa

SEQ ID NO: 1443502 - RNA, 21 nt, Homo sapiens
ucacauacaauuugcacuguu

SEQ ID NO: 1443503 - RNA, 15 nt, Homo sapiens
ucacauagcacagaa

SEQ ID NO: 1443504 - RNA, 17 nt, Homo sapiens
ucacauccaaugcauag

SEQ ID NO: 1443505 - RNA, 10 nt, Homo sapiens
ucaccaaaau

SEQ ID NO: 1443506 - RNA, 18 nt, Homo sapiens
ucaccacaccaaaccucu

SEQ ID NO: 1443507 - RNA, 17 nt, Homo sapiens
ucaccagaauugugcaa

SEQ ID NO: 1443508 - RNA, 18 nt, Homo sapiens
ucaccagaauugugcaaa

SEQ ID NO: 1443509 - RNA, 19 nt, Homo sapiens
ucaccaguguccccuccac

SEQ ID NO: 1443510 - RNA, 22 nt, Homo sapiens
ucacccacaucuaaugucucuu

SEQ ID NO: 1443511 - RNA, 14 nt, Homo sapiens
ucaccccugcacuu

SEQ ID NO: 1443512 - RNA, 19 nt, Homo sapiens
ucacccgagcuagagugca

SEQ ID NO: 1443513 - RNA, 20 nt, Homo sapiens
ucacccggaucccuccucac

SEQ ID NO: 1443514 - RNA, 22 nt, Homo sapiens
ucacccggaucccuccucacuu

SEQ ID NO: 1443515 - RNA, 14 nt, Homo sapiens
ucaccggagcuuuc

SEQ ID NO: 1443516 - RNA, 18 nt, Homo sapiens
ucaccgggcuacuaccug

SEQ ID NO: 1443517 - RNA, 15 nt, Homo sapiens
ucaccucugccucaa

SEQ ID NO: 1443518 - RNA, 18 nt, Homo sapiens
ucaccugggccuuuccug

SEQ ID NO: 1443519 - RNA, 13 nt, Homo sapiens
ucacgacucuucc

SEQ ID NO: 1443520 - RNA, 14 nt, Homo sapiens
ucacgacucuuccu

SEQ ID NO: 1443521 - RNA, 20 nt, Homo sapiens
ucacguacaccauaugcaag

SEQ ID NO: 1443522 - RNA, 17 nt, Homo sapiens
ucacuaauacuaauuca

SEQ ID NO: 1443523 - RNA, 15 nt, Homo sapiens
ucacuacagacgauu

SEQ ID NO: 1443524 - RNA, 21 nt, Homo sapiens
ucacuacagacgauuaacaca

SEQ ID NO: 1443525 - RNA, 15 nt, Homo sapiens
ucacuacaguacagu

SEQ ID NO: 1443526 - RNA, 22 nt, Homo sapiens
ucacuagccaugauaacugcaa

SEQ ID NO: 1443527 - RNA, 15 nt, Homo sapiens
ucacuaugguaugcu

SEQ ID NO: 1443528 - RNA, 19 nt, Homo sapiens
ucacuauguugcccaggcu

SEQ ID NO: 1443529 - RNA, 15 nt, Homo sapiens
ucacuauuacuugaa

SEQ ID NO: 1443530 - RNA, 19 nt, Homo sapiens
ucacucacuuuucuuuauu

SEQ ID NO: 1443531 - RNA, 20 nt, Homo sapiens
ucacucauuccuucacucau

SEQ ID NO: 1443532 - RNA, 19 nt, Homo sapiens
ucacuccacaacccaagaa

SEQ ID NO: 1443533 - RNA, 11 nt, Homo sapiens
ucacucccacu

SEQ ID NO: 1443534 - RNA, 19 nt, Homo sapiens
ucacucuucauucuuugaa

SEQ ID NO: 1443535 - RNA, 14 nt, Homo sapiens
ucacugcuaccucu

SEQ ID NO: 1443536 - RNA, 14 nt, Homo sapiens
ucacuggguucuag

SEQ ID NO: 1443537 - RNA, 15 nt, Homo sapiens
ucacugucccucaaa

SEQ ID NO: 1443538 - RNA, 19 nt, Homo sapiens
ucacugucccucaaaugac

SEQ ID NO: 1443539 - RNA, 17 nt, Homo sapiens
ucacuucagacaauuca

SEQ ID NO: 1443540 - RNA, 16 nt, Homo sapiens
ucacuuuaauucucau

SEQ ID NO: 1443541 - RNA, 17 nt, Homo sapiens
ucacuuuucuuuauugc

SEQ ID NO: 1443542 - RNA, 20 nt, Homo sapiens
ucagaauggaaagaaacuca

SEQ ID NO: 1443543 - RNA, 18 nt, Homo sapiens
ucagacaauccacucuca

SEQ ID NO: 1443544 - RNA, 19 nt, Homo sapiens
ucagacauuugguauauua

SEQ ID NO: 1443545 - RNA, 16 nt, Homo sapiens
ucagaccaacucucuc

SEQ ID NO: 1443546 - RNA, 17 nt, Homo sapiens
ucagaccaguacuggga

SEQ ID NO: 1443547 - RNA, 14 nt, Homo sapiens
ucagacucaucuac

SEQ ID NO: 1443548 - RNA, 17 nt, Homo sapiens
ucagacucccgcgugaa

SEQ ID NO: 1443549 - RNA, 17 nt, Homo sapiens
ucagacuccugugcaac

SEQ ID NO: 1443550 - RNA, 15 nt, Homo sapiens
ucagagccaccccua

SEQ ID NO: 1443551 - RNA, 19 nt, Homo sapiens
ucagagcugggaguagcau

SEQ ID NO: 1443552 - RNA, 15 nt, Homo sapiens
ucagcaaaccucagu

SEQ ID NO: 1443553 - RNA, 11 nt, Homo sapiens
ucagcacugaa

SEQ ID NO: 1443554 - RNA, 15 nt, Homo sapiens
ucagcagcccuccuc

SEQ ID NO: 1443555 - RNA, 15 nt, Homo sapiens
ucagcauuauuccuc

SEQ ID NO: 1443556 - RNA, 12 nt, Homo sapiens
ucagccaugagg

SEQ ID NO: 1443557 - RNA, 19 nt, Homo sapiens
ucagccauugcccugugag

SEQ ID NO: 1443558 - RNA, 22 nt, Homo sapiens
ucagccgcagacaaguaaucac

SEQ ID NO: 1443559 - RNA, 21 nt, Homo sapiens
ucagcggucauucuacacuga

SEQ ID NO: 1443560 - RNA, 22 nt, Homo sapiens
ucagcggucauucuacacugag

SEQ ID NO: 1443561 - RNA, 12 nt, Homo sapiens
ucagcucaggug

SEQ ID NO: 1443562 - RNA, 16 nt, Homo sapiens
ucagcugcacauuccu

SEQ ID NO: 1443563 - RNA, 17 nt, Homo sapiens
ucagcugugaacaugga

SEQ ID NO: 1443564 - RNA, 17 nt, Homo sapiens
ucagcuucaaggaguau

SEQ ID NO: 1443565 - RNA, 15 nt, Homo sapiens
ucaggaauacauuug

SEQ ID NO: 1443566 - RNA, 17 nt, Homo sapiens
ucaggaauacauuugga

SEQ ID NO: 1443567 - RNA, 24 nt, Homo sapiens
ucaggacggaaggucaguugccau

SEQ ID NO: 1443568 - RNA, 21 nt, Homo sapiens
ucaggcagacaagagcugcug

SEQ ID NO: 1443569 - RNA, 18 nt, Homo sapiens
ucaggcaggcaccuagca

SEQ ID NO: 1443570 - RNA, 19 nt, Homo sapiens
ucaggcagguuugccagug

SEQ ID NO: 1443571 - RNA, 16 nt, Homo sapiens
ucagggagccuggaag

SEQ ID NO: 1443572 - RNA, 21 nt, Homo sapiens
ucagugccacuugacauuccu

SEQ ID NO: 1443573 - RNA, 21 nt, Homo sapiens
ucaguguaugauauacuuuau

SEQ ID NO: 1443574 - RNA, 20 nt, Homo sapiens
ucaguguuuuuucacuuuag

SEQ ID NO: 1443575 - RNA, 19 nt, Homo sapiens
ucaguuauucagauugaca

SEQ ID NO: 1443576 - RNA, 20 nt, Homo sapiens
ucaguuucaauucagugcug

SEQ ID NO: 1443577 - RNA, 14 nt, Homo sapiens
ucauaaccauuccc

SEQ ID NO: 1443578 - RNA, 15 nt, Homo sapiens
ucauaaccauuccca

SEQ ID NO: 1443579 - RNA, 21 nt, Homo sapiens
ucauaagaaugaauaauaauu

SEQ ID NO: 1443580 - RNA, 23 nt, Homo sapiens
ucauagaaauaccucauucgccu

SEQ ID NO: 1443581 - RNA, 20 nt, Homo sapiens
ucauaggaaaaguacauuua

SEQ ID NO: 1443582 - RNA, 17 nt, Homo sapiens
ucauaugacaugccacc

SEQ ID NO: 1443583 - RNA, 15 nt, Homo sapiens
ucauauugaauguuu

SEQ ID NO: 1443584 - RNA, 20 nt, Homo sapiens
ucaucaauuuaaaaucauuc

SEQ ID NO: 1443585 - RNA, 15 nt, Homo sapiens
ucaucagcauaccuu

SEQ ID NO: 1443586 - RNA, 18 nt, Homo sapiens
ucaucagcauaccuuuau

SEQ ID NO: 1443587 - RNA, 23 nt, Homo sapiens
ucaucaguguccucuugcucaaa

SEQ ID NO: 1443588 - RNA, 17 nt, Homo sapiens
ucaucauacaugacuca

SEQ ID NO: 1443589 - RNA, 22 nt, Homo sapiens
ucaucuacacagcaguaugaau

SEQ ID NO: 1443590 - RNA, 15 nt, Homo sapiens
ucaucuacuacaggg

SEQ ID NO: 1443591 - RNA, 14 nt, Homo sapiens
ucaucucacugccc

SEQ ID NO: 1443592 - RNA, 20 nt, Homo sapiens
ucaucucaggccucccucaa

SEQ ID NO: 1443593 - RNA, 18 nt, Homo sapiens
ucaugaguuucccagaga

SEQ ID NO: 1443594 - RNA, 14 nt, Homo sapiens
ucaugauaaucugg

SEQ ID NO: 1443595 - RNA, 13 nt, Homo sapiens
ucaugccucugag

SEQ ID NO: 1443596 - RNA, 14 nt, Homo sapiens
ucaugccucugagg

SEQ ID NO: 1443597 - RNA, 13 nt, Homo sapiens
ucauguacuuccu

SEQ ID NO: 1443598 - RNA, 22 nt, Homo sapiens
ucaugucucagccuccucagua

SEQ ID NO: 1443599 - RNA, 17 nt, Homo sapiens
ucaugugugcaugugag

SEQ ID NO: 1443600 - RNA, 21 nt, Homo sapiens
ucauguugaagccacugccuu

SEQ ID NO: 1443601 - RNA, 19 nt, Homo sapiens
ucauuaucucaaaacugca

SEQ ID NO: 1443602 - RNA, 20 nt, Homo sapiens
ucauuaucucaaaacugcac

SEQ ID NO: 1443603 - RNA, 16 nt, Homo sapiens
ucauuauuuuuuacaa

SEQ ID NO: 1443604 - RNA, 23 nt, Homo sapiens
ucauucaccaaaugaugccacuu

SEQ ID NO: 1443605 - RNA, 15 nt, Homo sapiens
ucauucagaccagug

SEQ ID NO: 1443606 - RNA, 17 nt, Homo sapiens
ucauuccaccuucccau

SEQ ID NO: 1443607 - RNA, 12 nt, Homo sapiens
ucauucugggaa

SEQ ID NO: 1443608 - RNA, 17 nt, Homo sapiens
ucauuuuuuucacugga

SEQ ID NO: 1443609 - RNA, 14 nt, Homo sapiens
uccaaaacuuuaag

SEQ ID NO: 1443610 - RNA, 18 nt, Homo sapiens
uccaaaccgcaggcaaac

SEQ ID NO: 1443611 - RNA, 20 nt, Homo sapiens
uccaaccugccugugcauga

SEQ ID NO: 1443612 - RNA, 20 nt, Homo sapiens
uccaagcaaaaacaaauggg

SEQ ID NO: 1443613 - RNA, 22 nt, Homo sapiens
uccaagcauaccaacacgagca

SEQ ID NO: 1443614 - RNA, 22 nt, Homo sapiens
uccaagccauucacuuccccaa

SEQ ID NO: 1443615 - RNA, 23 nt, Homo sapiens
uccaaggaggucgggauggggcu

SEQ ID NO: 1443616 - RNA, 22 nt, Homo sapiens
uccaaggguaugggaagccaua

SEQ ID NO: 1443617 - RNA, 12 nt, Homo sapiens
uccaagucuuca

SEQ ID NO: 1443618 - RNA, 17 nt, Homo sapiens
uccaauaggcauuugau

SEQ ID NO: 1443619 - RNA, 16 nt, Homo sapiens
uccaauggcuguaaac

SEQ ID NO: 1443620 - RNA, 22 nt, Homo sapiens
uccaauugaacuuucacauagc

SEQ ID NO: 1443621 - RNA, 15 nt, Homo sapiens
uccacagacucccuc

SEQ ID NO: 1443622 - RNA, 23 nt, Homo sapiens
uccacagccaacaaacauagaaa

SEQ ID NO: 1443623 - RNA, 19 nt, Homo sapiens
uccacaguuuugccuuaaa

SEQ ID NO: 1443624 - RNA, 14 nt, Homo sapiens
uccacauuauacau

SEQ ID NO: 1443625 - RNA, 19 nt, Homo sapiens
uccacauuauacauuugau

SEQ ID NO: 1443626 - RNA, 15 nt, Homo sapiens
uccacccagcaaaga

SEQ ID NO: 1443627 - RNA, 15 nt, Homo sapiens
uccaccuuguuacac

SEQ ID NO: 1443628 - RNA, 23 nt, Homo sapiens
uccacugcaauacuaauugagaa

SEQ ID NO: 1443629 - RNA, 17 nt, Homo sapiens
uccacuuugaguaccaa

SEQ ID NO: 1443630 - RNA, 11 nt, Homo sapiens
uccacuuuuau

SEQ ID NO: 1443631 - RNA, 16 nt, Homo sapiens
uccagaaaaugaacac

SEQ ID NO: 1443632 - RNA, 14 nt, Homo sapiens
uccagaacugaggu

SEQ ID NO: 1443633 - RNA, 19 nt, Homo sapiens
uccagaacugaggucacug

SEQ ID NO: 1443634 - RNA, 16 nt, Homo sapiens
uccagaauaugcauaa

SEQ ID NO: 1443635 - RNA, 14 nt, Homo sapiens
uccagaauccacaa

SEQ ID NO: 1443636 - RNA, 17 nt, Homo sapiens
uccagacagagcccugu

SEQ ID NO: 1443637 - RNA, 19 nt, Homo sapiens
uccagaccauugucuucca

SEQ ID NO: 1443638 - RNA, 21 nt, Homo sapiens
uccagcacucccucccagaga

SEQ ID NO: 1443639 - RNA, 14 nt, Homo sapiens
uccagcaugcaucc

SEQ ID NO: 1443640 - RNA, 15 nt, Homo sapiens
uccagccaacauuua

SEQ ID NO: 1443641 - RNA, 16 nt, Homo sapiens
uccaggaaggcagcug

SEQ ID NO: 1443642 - RNA, 19 nt, Homo sapiens
uccaguauucuugucaaaa

SEQ ID NO: 1443643 - RNA, 16 nt, Homo sapiens
uccagucugaucugug

SEQ ID NO: 1443644 - RNA, 14 nt, Homo sapiens
uccauagugcacua

SEQ ID NO: 1443645 - RNA, 18 nt, Homo sapiens
uccauagugcacuagcau

SEQ ID NO: 1443646 - RNA, 21 nt, Homo sapiens
uccaucacuagccaugauaac

SEQ ID NO: 1443647 - RNA, 20 nt, Homo sapiens
uccaucauggcagugaugaa

SEQ ID NO: 1443648 - RNA, 14 nt, Homo sapiens
uccaucuccagugg

SEQ ID NO: 1443649 - RNA, 16 nt, Homo sapiens
uccaugcugccuccag

SEQ ID NO: 1443650 - RNA, 15 nt, Homo sapiens
uccauguuuguaaaa

SEQ ID NO: 1443651 - RNA, 15 nt, Homo sapiens
uccauucacagccag

SEQ ID NO: 1443652 - RNA, 22 nt, Homo sapiens
uuaauauuuaaacagcaguguu

SEQ ID NO: 1443653 - RNA, 11 nt, Homo sapiens
uuaaucccagu

SEQ ID NO: 1443654 - RNA, 19 nt, Homo sapiens
uuaaugaagacccagugua

SEQ ID NO: 1443655 - RNA, 14 nt, Homo sapiens
uuaauggcacugau

SEQ ID NO: 1443656 - RNA, 19 nt, Homo sapiens
uuaauguguuaagugcagg

SEQ ID NO: 1443657 - RNA, 19 nt, Homo sapiens
uuacacaguugcugucaua

SEQ ID NO: 1443658 - RNA, 14 nt, Homo sapiens
uuacagacugugag

SEQ ID NO: 1443659 - RNA, 19 nt, Homo sapiens
uuacagguaucaggcacag

SEQ ID NO: 1443660 - RNA, 12 nt, Homo sapiens
uuacauacaaau

SEQ ID NO: 1443661 - RNA, 14 nt, Homo sapiens
uuacauaucaccuc

SEQ ID NO: 1443662 - RNA, 21 nt, Homo sapiens
uuacauuuccaaaugaaugac

SEQ ID NO: 1443663 - RNA, 22 nt, Homo sapiens
uuacauuuccaaaugaaugacc

SEQ ID NO: 1443664 - RNA, 17 nt, Homo sapiens
uuaccuuggucaugcuu

SEQ ID NO: 1443665 - RNA, 22 nt, Homo sapiens
uuacuaacacgcauuguacacu

SEQ ID NO: 1443666 - RNA, 22 nt, Homo sapiens
uuacuaaugugccccaugucca

SEQ ID NO: 1443667 - RNA, 13 nt, Homo sapiens
uuacuacuugcca

SEQ ID NO: 1443668 - RNA, 22 nt, Homo sapiens
uuacucauaaggcauauacaaa

SEQ ID NO: 1443669 - RNA, 12 nt, Homo sapiens
uuacuccagugg

SEQ ID NO: 1443670 - RNA, 20 nt, Homo sapiens
uuacugaaaacaaaauaucu

SEQ ID NO: 1443671 - RNA, 22 nt, Homo sapiens
uuacugauucuccugucagaga

SEQ ID NO: 1443672 - RNA, 19 nt, Homo sapiens
uuacugcaaccuuugccuc

SEQ ID NO: 1443673 - RNA, 14 nt, Homo sapiens
uuacugugcauaca

SEQ ID NO: 1443674 - RNA, 17 nt, Homo sapiens
uuacuuaccuaaacaga

SEQ ID NO: 1443675 - RNA, 13 nt, Homo sapiens
uuacuuaggaaac

SEQ ID NO: 1443676 - RNA, 15 nt, Homo sapiens
uuacuucacuuuaau

SEQ ID NO: 1443677 - RNA, 21 nt, Homo sapiens
uuacuucacuuuaauucucau

SEQ ID NO: 1443678 - RNA, 16 nt, Homo sapiens
uuacuugcauugaaua

SEQ ID NO: 1443679 - RNA, 23 nt, Homo sapiens
uuacuuuaaaauaaaaaaguaac

SEQ ID NO: 1443680 - RNA, 23 nt, Homo sapiens
uuagagcccauuucaauucucaa

SEQ ID NO: 1443681 - RNA, 22 nt, Homo sapiens
uuagauacagagacuuggggaa

SEQ ID NO: 1443682 - RNA, 17 nt, Homo sapiens
uuagauuagcucuggac

SEQ ID NO: 1443683 - RNA, 17 nt, Homo sapiens
uuagcaauugacuguca

SEQ ID NO: 1443684 - RNA, 17 nt, Homo sapiens
uuagcuagaaugcacac

SEQ ID NO: 1443685 - RNA, 16 nt, Homo sapiens
uuagcugaacaaugaa

SEQ ID NO: 1443686 - RNA, 16 nt, Homo sapiens
uuagcugaagaaguua

SEQ ID NO: 1443687 - RNA, 21 nt, Homo sapiens
uuaggucauuacuaaccauag

SEQ ID NO: 1443688 - RNA, 15 nt, Homo sapiens
uuaguaauaaaaccc

SEQ ID NO: 1443689 - RNA, 23 nt, Homo sapiens
uuaguuuguuuuacaaauuuuuc

SEQ ID NO: 1443690 - RNA, 21 nt, Homo sapiens
uuauaaacuuuagaguagcau

SEQ ID NO: 1443691 - RNA, 13 nt, Homo sapiens
uuauacauaucag

SEQ ID NO: 1443692 - RNA, 21 nt, Homo sapiens
uuauacaucacagcagugcau

SEQ ID NO: 1443693 - RNA, 13 nt, Homo sapiens
uuauacauuugau

SEQ ID NO: 1443694 - RNA, 18 nt, Homo sapiens
uuauauagguugugcaaa

SEQ ID NO: 1443695 - RNA, 19 nt, Homo sapiens
uuauauaguauaccauaca

SEQ ID NO: 1443696 - RNA, 21 nt, Homo sapiens
uuauaugacaauccugaagaa

SEQ ID NO: 1443697 - RNA, 23 nt, Homo sapiens
uuauauucaaggaucucaaagaa

SEQ ID NO: 1443698 - RNA, 17 nt, Homo sapiens
uuauccugcuagcugua

SEQ ID NO: 1443699 - RNA, 20 nt, Homo sapiens
uuaucugaucgggauaacaa

SEQ ID NO: 1443700 - RNA, 12 nt, Homo sapiens
uuaucugugcaa

SEQ ID NO: 1443701 - RNA, 13 nt, Homo sapiens
uuaucugugcaaa

SEQ ID NO: 1443702 - RNA, 15 nt, Homo sapiens
uuaugaggcuauuaa

SEQ ID NO: 1443703 - RNA, 23 nt, Homo sapiens
uuaugccauagcaagauugcuua

SEQ ID NO: 1443704 - RNA, 17 nt, Homo sapiens
uuauguaacauccagaa

SEQ ID NO: 1443705 - RNA, 13 nt, Homo sapiens
uuauguaaucuca

SEQ ID NO: 1443706 - RNA, 19 nt, Homo sapiens
uuaugucaucauacaugac

SEQ ID NO: 1443707 - RNA, 22 nt, Homo sapiens
uuaugucaucauacaugacuca

SEQ ID NO: 1443708 - RNA, 14 nt, Homo sapiens
uaaacaaauaacaa

SEQ ID NO: 1443709 - RNA, 16 nt, Homo sapiens
uaaacaauguauuugu

SEQ ID NO: 1443710 - RNA, 18 nt, Homo sapiens
uaaacacauacauugcca

SEQ ID NO: 1443711 - RNA, 11 nt, Homo sapiens
uaaacagugcc

SEQ ID NO: 1443712 - RNA, 21 nt, Homo sapiens
uaaacauucaucaagcuguac

SEQ ID NO: 1443713 - RNA, 20 nt, Homo sapiens
uaaacauugguauauuucca

SEQ ID NO: 1443714 - RNA, 22 nt, Homo sapiens
uaaaccaaugagcuguaucugu

SEQ ID NO: 1443715 - RNA, 11 nt, Homo sapiens
uaaaccuggag

SEQ ID NO: 1443716 - RNA, 14 nt, Homo sapiens
uaaacuacuguaau

SEQ ID NO: 1443717 - RNA, 15 nt, Homo sapiens
uaaacuaguuuccag

SEQ ID NO: 1443718 - RNA, 14 nt, Homo sapiens
uaaacuguacaugu

SEQ ID NO: 1443719 - RNA, 17 nt, Homo sapiens
uaaacuuucucugcaaa

SEQ ID NO: 1443720 - RNA, 14 nt, Homo sapiens
uaaagaaguuugau

SEQ ID NO: 1443721 - RNA, 18 nt, Homo sapiens
uaaagaauaaaugaaucu

SEQ ID NO: 1443722 - RNA, 24 nt, Homo sapiens
uaaagcaguagacaauccccacau

SEQ ID NO: 1443723 - RNA, 14 nt, Homo sapiens
uaaagcccuugaac

SEQ ID NO: 1443724 - RNA, 19 nt, Homo sapiens
uaaagcuuucugacaagau

SEQ ID NO: 1443725 - RNA, 16 nt, Homo sapiens
uaaaggggagauacuc

SEQ ID NO: 1443726 - RNA, 20 nt, Homo sapiens
uaaaguacauuauuuaugaa

SEQ ID NO: 1443727 - RNA, 16 nt, Homo sapiens
uaaaguauauauuuau

SEQ ID NO: 1443728 - RNA, 21 nt, Homo sapiens
uaaagucaacaaccaugccag

SEQ ID NO: 1443729 - RNA, 16 nt, Homo sapiens
uaaaguccguauuucu

SEQ ID NO: 1443730 - RNA, 18 nt, Homo sapiens
uaaagugccuaccccagc

SEQ ID NO: 1443731 - RNA, 18 nt, Homo sapiens
uaaaguuaaaaaaaagcc

SEQ ID NO: 1443732 - RNA, 18 nt, Homo sapiens
uaaaguuguucacauaua

SEQ ID NO: 1443733 - RNA, 15 nt, Homo sapiens
uaaauaacagugugu

SEQ ID NO: 1443734 - RNA, 19 nt, Homo sapiens
uaaauacaguggaucucaa

SEQ ID NO: 1443735 - RNA, 17 nt, Homo sapiens
uaaauagaguuccaaau

SEQ ID NO: 1443736 - RNA, 14 nt, Homo sapiens
uaaauagugcagaa

SEQ ID NO: 1443737 - RNA, 13 nt, Homo sapiens
uaaauccuuccau

SEQ ID NO: 1443738 - RNA, 14 nt, Homo sapiens
uaaaucugagaucu

SEQ ID NO: 1443739 - RNA, 16 nt, Homo sapiens
uaaaucugagaucucc

SEQ ID NO: 1443740 - RNA, 16 nt, Homo sapiens
uaaaugaagugcaaau

SEQ ID NO: 1443741 - RNA, 17 nt, Homo sapiens
uaaaugaaucuuacucc

SEQ ID NO: 1443742 - RNA, 18 nt, Homo sapiens
uaaaugaaucuuacuccu

SEQ ID NO: 1443743 - RNA, 17 nt, Homo sapiens
uaaaugauguacuacau

SEQ ID NO: 1443744 - RNA, 18 nt, Homo sapiens
uaaaugcaaacacugugu

SEQ ID NO: 1443745 - RNA, 17 nt, Homo sapiens
uaaaugccaacauaccc

SEQ ID NO: 1443746 - RNA, 24 nt, Homo sapiens
uaaaugcucgugugauuuccuaca

SEQ ID NO: 1443747 - RNA, 17 nt, Homo sapiens
uaaaugggcagugccuc

SEQ ID NO: 1443748 - RNA, 16 nt, Homo sapiens
uaaauggugggaaccc

SEQ ID NO: 1443749 - RNA, 16 nt, Homo sapiens
uaaauguaucauagaa

SEQ ID NO: 1443750 - RNA, 17 nt, Homo sapiens
uaaauguuuuacaagaa

SEQ ID NO: 1443751 - RNA, 11 nt, Homo sapiens
uaaauucauuu

SEQ ID NO: 1443752 - RNA, 19 nt, Homo sapiens
uaaauugcuccuugacauu

SEQ ID NO: 1443753 - RNA, 12 nt, Homo sapiens
uaacaaccugga

SEQ ID NO: 1443754 - RNA, 19 nt, Homo sapiens
uaacaagguucuucuaaaa

SEQ ID NO: 1443755 - RNA, 20 nt, Homo sapiens
uaacaaguagcacccuggau

SEQ ID NO: 1443756 - RNA, 21 nt, Homo sapiens
uaacaauguaugugaaagugu

SEQ ID NO: 1443757 - RNA, 16 nt, Homo sapiens
uaacacacacaccucu

SEQ ID NO: 1443758 - RNA, 16 nt, Homo sapiens
uaacacagcugaacua

SEQ ID NO: 1443759 - RNA, 17 nt, Homo sapiens
uaacacucagaagccug

SEQ ID NO: 1443760 - RNA, 20 nt, Homo sapiens
uaacagaggcaggaguggca

SEQ ID NO: 1443761 - RNA, 20 nt, Homo sapiens
uaacauaaaauaaucgucuc

SEQ ID NO: 1443762 - RNA, 14 nt, Homo sapiens
uaacauuuuccaaa

SEQ ID NO: 1443763 - RNA, 14 nt, Homo sapiens
uaaccaaaugcugu

SEQ ID NO: 1443764 - RNA, 20 nt, Homo sapiens
uaacccgcucaucacuggau

SEQ ID NO: 1443765 - RNA, 14 nt, Homo sapiens
uaaccuacuagaca

SEQ ID NO: 1443766 - RNA, 12 nt, Homo sapiens
uaaccugaauua

SEQ ID NO: 1443767 - RNA, 16 nt, Homo sapiens
uaacgggcauguauua

SEQ ID NO: 1443768 - RNA, 22 nt, Homo sapiens
uaacuacaaggacaaugccuug

SEQ ID NO: 1443769 - RNA, 12 nt, Homo sapiens
uaacuacagugu

SEQ ID NO: 1443770 - RNA, 21 nt, Homo sapiens
uaacuacuuuuuauacuccau

SEQ ID NO: 1443771 - RNA, 19 nt, Homo sapiens
uaacuaguauuguccauau

SEQ ID NO: 1443772 - RNA, 22 nt, Homo sapiens
uaacuaguccuuuacuaaucca

SEQ ID NO: 1443773 - RNA, 15 nt, Homo sapiens
uaacucagacauucc

SEQ ID NO: 1443774 - RNA, 16 nt, Homo sapiens
uaacucagacauucca

SEQ ID NO: 1443775 - RNA, 21 nt, Homo sapiens
uaacucaggggugauucugaa

SEQ ID NO: 1443776 - RNA, 17 nt, Homo sapiens
uaacugagaauuuucua

SEQ ID NO: 1443777 - RNA, 21 nt, Homo sapiens
uaacugcaaagugaaguugcu

SEQ ID NO: 1443778 - RNA, 17 nt, Homo sapiens
uaacugccuuguguaca

SEQ ID NO: 1443779 - RNA, 19 nt, Homo sapiens
uaacuucucugagucugaa

SEQ ID NO: 1443780 - RNA, 21 nt, Homo sapiens
uaacuuggagagggacgaaga

SEQ ID NO: 1443781 - RNA, 16 nt, Homo sapiens
uaacuuggaguuucau

SEQ ID NO: 1443782 - RNA, 13 nt, Homo sapiens
uaagaaacauaac

SEQ ID NO: 1443783 - RNA, 15 nt, Homo sapiens
uaagaagacaugaca

SEQ ID NO: 1443784 - RNA, 23 nt, Homo sapiens
uaagaauggagcaguacauggga

SEQ ID NO: 1443785 - RNA, 18 nt, Homo sapiens
uaagaccauaacagccaa

SEQ ID NO: 1443786 - RNA, 14 nt, Homo sapiens
uaagacuacuauac

SEQ ID NO: 1443787 - RNA, 14 nt, Homo sapiens
uaagacucauuccc

SEQ ID NO: 1443788 - RNA, 21 nt, Homo sapiens
uaagaggauagaauacaugga

SEQ ID NO: 1443789 - RNA, 22 nt, Homo sapiens
uaagauacuggacuccucuucc

SEQ ID NO: 1443790 - RNA, 14 nt, Homo sapiens
uaagcacauguuua

SEQ ID NO: 1443791 - RNA, 19 nt, Homo sapiens
uaagcauuguauacauuga

SEQ ID NO: 1443792 - RNA, 14 nt, Homo sapiens
uaagccacucuucc

SEQ ID NO: 1443793 - RNA, 16 nt, Homo sapiens
uaaggaagaaucuucu

SEQ ID NO: 1443794 - RNA, 16 nt, Homo sapiens
uaaggacuucugcagc

SEQ ID NO: 1443795 - RNA, 15 nt, Homo sapiens
uacauuccucagcug

SEQ ID NO: 1443796 - RNA, 19 nt, Homo sapiens
uacauuccucagcugccaa

SEQ ID NO: 1443797 - RNA, 19 nt, Homo sapiens
uacauucuccuuuuugccc

SEQ ID NO: 1443798 - RNA, 18 nt, Homo sapiens
uacauugccaauuuucca

SEQ ID NO: 1443799 - RNA, 21 nt, Homo sapiens
uacauuucauaaggccugccc

SEQ ID NO: 1443800 - RNA, 15 nt, Homo sapiens
uacauuuggugcacu

SEQ ID NO: 1443801 - RNA, 16 nt, Homo sapiens
uaccaaaaaaguauuu

SEQ ID NO: 1443802 - RNA, 19 nt, Homo sapiens
uaccaaauccacaagccau

SEQ ID NO: 1443803 - RNA, 13 nt, Homo sapiens
uaccaagugacca

SEQ ID NO: 1443804 - RNA, 15 nt, Homo sapiens
uaccacuaugcaaua

SEQ ID NO: 1443805 - RNA, 18 nt, Homo sapiens
uaccagagaccugaggca

SEQ ID NO: 1443806 - RNA, 21 nt, Homo sapiens
uaccagauauuugaaucuuuc

SEQ ID NO: 1443807 - RNA, 22 nt, Homo sapiens
uaccagauauuugaaucuuucu

SEQ ID NO: 1443808 - RNA, 15 nt, Homo sapiens
uaccagaucacucaa

SEQ ID NO: 1443809 - RNA, 15 nt, Homo sapiens
uaccagcuaacucca

SEQ ID NO: 1443810 - RNA, 16 nt, Homo sapiens
uaccagugaaccaaag

SEQ ID NO: 1443811 - RNA, 14 nt, Homo sapiens
uaccaucuaaucua

SEQ ID NO: 1443812 - RNA, 18 nt, Homo sapiens
uaccaucuaaucuaugca

SEQ ID NO: 1443813 - RNA, 23 nt, Homo sapiens
uaccaucuaaucuaugcauguau

SEQ ID NO: 1443814 - RNA, 13 nt, Homo sapiens
uaccaugcugcuu

SEQ ID NO: 1443815 - RNA, 16 nt, Homo sapiens
uacccaauuuaauucc

SEQ ID NO: 1443816 - RNA, 12 nt, Homo sapiens
uacccacuucca

SEQ ID NO: 1443817 - RNA, 20 nt, Homo sapiens
uacccagagaauauauacau

SEQ ID NO: 1443818 - RNA, 17 nt, Homo sapiens
uacccaggaugauuucc

SEQ ID NO: 1443819 - RNA, 17 nt, Homo sapiens
uaccccaccucaugccu

SEQ ID NO: 1443820 - RNA, 23 nt, Homo sapiens
uacccucccagcgaguugcgcug

SEQ ID NO: 1443821 - RNA, 18 nt, Homo sapiens
uacccugcgauuuugccu

SEQ ID NO: 1443822 - RNA, 21 nt, Homo sapiens
uacccuucuuuaaaucaaaag

SEQ ID NO: 1443823 - RNA, 23 nt, Homo sapiens
uaccggcgugcaccaccaugcca

SEQ ID NO: 1443824 - RNA, 17 nt, Homo sapiens
uaccuaaaacugcugaa

SEQ ID NO: 1443825 - RNA, 15 nt, Homo sapiens
uaccuaucaucuuaa

SEQ ID NO: 1443826 - RNA, 19 nt, Homo sapiens
uaccucccccugccuucca

SEQ ID NO: 1443827 - RNA, 20 nt, Homo sapiens
uaccucccccugccuuccaa

SEQ ID NO: 1443828 - RNA, 21 nt, Homo sapiens
uaccucccccugccuuccaac

SEQ ID NO: 1443829 - RNA, 17 nt, Homo sapiens
uaccuccuguguggaag

SEQ ID NO: 1443830 - RNA, 18 nt, Homo sapiens
uaccuccuguguggaaga

SEQ ID NO: 1443831 - RNA, 21 nt, Homo sapiens
uaccugcauguguuguacaau

SEQ ID NO: 1443832 - RNA, 16 nt, Homo sapiens
uaccugcccucucuca

SEQ ID NO: 1443833 - RNA, 17 nt, Homo sapiens
uaccugcgauguuuacg

SEQ ID NO: 1443834 - RNA, 20 nt, Homo sapiens
uaccuguggugauguugcca

SEQ ID NO: 1443835 - RNA, 18 nt, Homo sapiens
uaccuugcagccaugacc

SEQ ID NO: 1443836 - RNA, 17 nt, Homo sapiens
uacgaccgggaggucca

SEQ ID NO: 1443837 - RNA, 23 nt, Homo sapiens
uacgcaaacacaccgaugcacac

SEQ ID NO: 1443838 - RNA, 19 nt, Homo sapiens
uacgugucuguguguauau

SEQ ID NO: 1443839 - RNA, 12 nt, Homo sapiens
uacuaaagacag

SEQ ID NO: 1443840 - RNA, 12 nt, Homo sapiens
uacuauguuaau

SEQ ID NO: 1443841 - RNA, 17 nt, Homo sapiens
uacuauuugaagcaaug

SEQ ID NO: 1443842 - RNA, 21 nt, Homo sapiens
uacucacccagggacuccagu

SEQ ID NO: 1443843 - RNA, 13 nt, Homo sapiens
uacucagacuguu

SEQ ID NO: 1443844 - RNA, 15 nt, Homo sapiens
uacucccauuuuccc

SEQ ID NO: 1443845 - RNA, 17 nt, Homo sapiens
uacuccucugacuggag

SEQ ID NO: 1443846 - RNA, 18 nt, Homo sapiens
uacucuggagagacugug

SEQ ID NO: 1443847 - RNA, 20 nt, Homo sapiens
uacucuggagagacugugcu

SEQ ID NO: 1443848 - RNA, 21 nt, Homo sapiens
uacucugugccagagccuggg

SEQ ID NO: 1443849 - RNA, 18 nt, Homo sapiens
uacucuuaacuccuagcc

SEQ ID NO: 1443850 - RNA, 17 nt, Homo sapiens
uacucuuucacucaggc

SEQ ID NO: 1443851 - RNA, 14 nt, Homo sapiens
uacugagacauuac

SEQ ID NO: 1443852 - RNA, 22 nt, Homo sapiens
uacugcaauaaauuauggcucu

SEQ ID NO: 1443853 - RNA, 13 nt, Homo sapiens
uacugccuagaaa

SEQ ID NO: 1443854 - RNA, 19 nt, Homo sapiens
uacugcuagauaucacuua

SEQ ID NO: 1443855 - RNA, 22 nt, Homo sapiens
uacugcucaucauuccuugaga

SEQ ID NO: 1443856 - RNA, 19 nt, Homo sapiens
uacuggaccccgccuccca

SEQ ID NO: 1443857 - RNA, 14 nt, Homo sapiens
uacugggaagacaa

SEQ ID NO: 1443858 - RNA, 13 nt, Homo sapiens
uacuguacuuaau

SEQ ID NO: 1443859 - RNA, 23 nt, Homo sapiens
uacuuaagcaaaagucagucuua

SEQ ID NO: 1443860 - RNA, 18 nt, Homo sapiens
uacuucggggcugggaag

SEQ ID NO: 1443861 - RNA, 19 nt, Homo sapiens
uacuugaaauaccagugaa

SEQ ID NO: 1443862 - RNA, 17 nt, Homo sapiens
uacuuguuuucacuuua

SEQ ID NO: 1443863 - RNA, 17 nt, Homo sapiens
uacuuuuuauacuccau

SEQ ID NO: 1443864 - RNA, 17 nt, Homo sapiens
uagaaaauuuucuaguc

SEQ ID NO: 1443865 - RNA, 13 nt, Homo sapiens
uagaaacaugaca

SEQ ID NO: 1443866 - RNA, 16 nt, Homo sapiens
uagaaauaauugaaag

SEQ ID NO: 1443867 - RNA, 14 nt, Homo sapiens
uagaaaugagccag

SEQ ID NO: 1443868 - RNA, 19 nt, Homo sapiens
uagaacacccacuggccag

SEQ ID NO: 1443869 - RNA, 18 nt, Homo sapiens
uagaaccaagcuucagag

SEQ ID NO: 1443870 - RNA, 18 nt, Homo sapiens
uagaaccacuuggcugcu

SEQ ID NO: 1443871 - RNA, 11 nt, Homo sapiens
uagaaccucac

SEQ ID NO: 1443872 - RNA, 11 nt, Homo sapiens
uagaaccugga

SEQ ID NO: 1443873 - RNA, 12 nt, Homo sapiens
uagaacugagaa

SEQ ID NO: 1443874 - RNA, 18 nt, Homo sapiens
uagaagccugcagcggca

SEQ ID NO: 1443875 - RNA, 22 nt, Homo sapiens
uagaagccugcagcggcacaaa

SEQ ID NO: 1443876 - RNA, 20 nt, Homo sapiens
uagaagggcuagaaccugga

SEQ ID NO: 1443877 - RNA, 12 nt, Homo sapiens
uagaaugcacac

SEQ ID NO: 1443878 - RNA, 18 nt, Homo sapiens
uagaauggaugugcucac

SEQ ID NO: 1443879 - RNA, 23 nt, Homo sapiens
uagaauguuacuuuggaaugacu

SEQ ID NO: 1443880 - RNA, 17 nt, Homo sapiens
uagaauuggagaguaaa

SEQ ID NO: 1443881 - RNA, 15 nt, Homo sapiens
uagaauuuaacauga

SEQ ID NO: 1443882 - RNA, 17 nt, Homo sapiens
uagaauuuaacaugacu

SEQ ID NO: 1443883 - RNA, 22 nt, Homo sapiens
uagacaaugaugugaguaccca

SEQ ID NO: 1443884 - RNA, 15 nt, Homo sapiens
uagacaguacucuua

SEQ ID NO: 1443885 - RNA, 22 nt, Homo sapiens
uagacaguacucuuaacuccua

SEQ ID NO: 1443886 - RNA, 19 nt, Homo sapiens
uagacuauauacaugugug

SEQ ID NO: 1443887 - RNA, 15 nt, Homo sapiens
uagagauaugcacac

SEQ ID NO: 1443888 - RNA, 19 nt, Homo sapiens
uagagcauaccaguacuca

SEQ ID NO: 1443889 - RNA, 17 nt, Homo sapiens
uagagugcaguggcaug

SEQ ID NO: 1443890 - RNA, 18 nt, Homo sapiens
uagaguuccaaauaagga

SEQ ID NO: 1443891 - RNA, 18 nt, Homo sapiens
uagauaucacuuacucag

SEQ ID NO: 1443892 - RNA, 19 nt, Homo sapiens
uagaucccaugucaccuca

SEQ ID NO: 1443893 - RNA, 22 nt, Homo sapiens
uagaucuaguucucaaucacug

SEQ ID NO: 1443894 - RNA, 23 nt, Homo sapiens
uagaucuuacaucugcagcucuu

SEQ ID NO: 1443895 - RNA, 18 nt, Homo sapiens
uagauuaauggcacugau

SEQ ID NO: 1443896 - RNA, 23 nt, Homo sapiens
uagauuccucuugccucucucag

SEQ ID NO: 1443897 - RNA, 20 nt, Homo sapiens
uagcaaccuucugcauucau

SEQ ID NO: 1443898 - RNA, 13 nt, Homo sapiens
uagcaauuccagg

SEQ ID NO: 1443899 - RNA, 14 nt, Homo sapiens
uagcagaaaccaag

SEQ ID NO: 1443900 - RNA, 15 nt, Homo sapiens
uagcaucucaugagu

SEQ ID NO: 1443901 - RNA, 21 nt, Homo sapiens
uagcaugccuccaaaaauuca

SEQ ID NO: 1443902 - RNA, 12 nt, Homo sapiens
uagccauaugca

SEQ ID NO: 1443903 - RNA, 15 nt, Homo sapiens
uagccauaugcaaua

SEQ ID NO: 1443904 - RNA, 20 nt, Homo sapiens
uagccuaauacaacauguag

SEQ ID NO: 1443905 - RNA, 19 nt, Homo sapiens
uagccugaauucuuuucaa

SEQ ID NO: 1443906 - RNA, 19 nt, Homo sapiens
uagccuuuggggacggcca

SEQ ID NO: 1443907 - RNA, 15 nt, Homo sapiens
uagcgaaucaucuca

SEQ ID NO: 1443908 - RNA, 16 nt, Homo sapiens
uagcgcucucuuccag

SEQ ID NO: 1443909 - RNA, 17 nt, Homo sapiens
uagcggaucucacucag

SEQ ID NO: 1443910 - RNA, 19 nt, Homo sapiens
uagcggugaagaguacaga

SEQ ID NO: 1443911 - RNA, 16 nt, Homo sapiens
uagcuaaugaaauuga

SEQ ID NO: 1443912 - RNA, 17 nt, Homo sapiens
uagcuagaagugggcca

SEQ ID NO: 1443913 - RNA, 14 nt, Homo sapiens
uagcuauugcaugu

SEQ ID NO: 1443914 - RNA, 21 nt, Homo sapiens
uagcuauuuucuuacagugga

SEQ ID NO: 1443915 - RNA, 21 nt, Homo sapiens
uagcugagccuucugaugaga

SEQ ID NO: 1443916 - RNA, 17 nt, Homo sapiens
uagcugagcgugguggc

SEQ ID NO: 1443917 - RNA, 12 nt, Homo sapiens
uagcugagcuca

SEQ ID NO: 1443918 - RNA, 16 nt, Homo sapiens
uagcugugaccugcug

SEQ ID NO: 1443919 - RNA, 20 nt, Homo sapiens
uagcuuggagggauggagag

SEQ ID NO: 1443920 - RNA, 17 nt, Homo sapiens
uaggaaauuccuucaua

SEQ ID NO: 1443921 - RNA, 21 nt, Homo sapiens
uaggacuauggguacauucca

SEQ ID NO: 1443922 - RNA, 23 nt, Homo sapiens
uaggagacagucucaagcacuaa

SEQ ID NO: 1443923 - RNA, 17 nt, Homo sapiens
uaggcagccucucugcu

SEQ ID NO: 1443924 - RNA, 23 nt, Homo sapiens
uaggcggucaugugugcauguga

SEQ ID NO: 1443925 - RNA, 15 nt, Homo sapiens
uagggaugacuguga

SEQ ID NO: 1443926 - RNA, 17 nt, Homo sapiens
uagggaugacugugauu

SEQ ID NO: 1443927 - RNA, 17 nt, Homo sapiens
uagggcagcagaucuuc

SEQ ID NO: 1443928 - RNA, 17 nt, Homo sapiens
uagggcagucaguagua

SEQ ID NO: 1443929 - RNA, 16 nt, Homo sapiens
uaggggaaguaugugu

SEQ ID NO: 1443930 - RNA, 21 nt, Homo sapiens
uagguagaauuuaacaugacu

SEQ ID NO: 1443931 - RNA, 20 nt, Homo sapiens
uaggucauuacuaaccauag

SEQ ID NO: 1443932 - RNA, 17 nt, Homo sapiens
uagguccaagggccaua

SEQ ID NO: 1443933 - RNA, 16 nt, Homo sapiens
uagguuuuuaugggaa

SEQ ID NO: 1443934 - RNA, 21 nt, Homo sapiens
uaguaagaaaacaucacugaa

SEQ ID NO: 1443935 - RNA, 20 nt, Homo sapiens
uaguaaucccccuugccaaa

SEQ ID NO: 1443936 - RNA, 20 nt, Homo sapiens
uaguaauugucaauaccccu

SEQ ID NO: 1443937 - RNA, 13 nt, Homo sapiens
uaguacugggaau

SEQ ID NO: 1443938 - RNA, 14 nt, Homo sapiens
uaguagcauuucaa

SEQ ID NO: 1443939 - RNA, 14 nt, Homo sapiens
uaguauaccauaca

SEQ ID NO: 1443940 - RNA, 22 nt, Homo sapiens
uagucaacaugccauaucucau

SEQ ID NO: 1443941 - RNA, 19 nt, Homo sapiens
uagucagaagcagguucuu

SEQ ID NO: 1443942 - RNA, 18 nt, Homo sapiens
uagucuccuuugcacuga

SEQ ID NO: 1443943 - RNA, 20 nt, Homo sapiens
uagucugcgucucugcuuua

SEQ ID NO: 1443944 - RNA, 14 nt, Homo sapiens
uagugccugagaug

SEQ ID NO: 1443945 - RNA, 16 nt, Homo sapiens
uaguggcauccauuuc

SEQ ID NO: 1443946 - RNA, 22 nt, Homo sapiens
uaguggcuuuuuuccuccugug

SEQ ID NO: 1443947 - RNA, 18 nt, Homo sapiens
uaguguguguguguauau

SEQ ID NO: 1443948 - RNA, 17 nt, Homo sapiens
uaguuaauuauuucaac

SEQ ID NO: 1443949 - RNA, 22 nt, Homo sapiens
uaguuccucuucuuaaggggau

SEQ ID NO: 1443950 - RNA, 14 nt, Homo sapiens
uaguuuauuucaac

SEQ ID NO: 1443951 - RNA, 19 nt, Homo sapiens
uaguuucauucauccauca

SEQ ID NO: 1443952 - RNA, 14 nt, Homo sapiens
uaguuucugauuca

SEQ ID NO: 1443953 - RNA, 20 nt, Homo sapiens
uaguuuuauaaaacucaguu

SEQ ID NO: 1443954 - RNA, 12 nt, Homo sapiens
uauaaaauacug

SEQ ID NO: 1443955 - RNA, 22 nt, Homo sapiens
uauaaacauugguauauuucca

SEQ ID NO: 1443956 - RNA, 23 nt, Homo sapiens
uauaaacauugguauauuuccau

SEQ ID NO: 1443957 - RNA, 21 nt, Homo sapiens
uauaacuaguccuuuacuaau

SEQ ID NO: 1443958 - RNA, 22 nt, Homo sapiens
uauaagaaaagcagacgcagca

SEQ ID NO: 1443959 - RNA, 20 nt, Homo sapiens
uauaagcagaagcacauaug

SEQ ID NO: 1443960 - RNA, 15 nt, Homo sapiens
uauaagcccagcucu

SEQ ID NO: 1443961 - RNA, 19 nt, Homo sapiens
uauaauacuaaagugucua

SEQ ID NO: 1443962 - RNA, 19 nt, Homo sapiens
uauaaugaacacgugggua

SEQ ID NO: 1443963 - RNA, 16 nt, Homo sapiens
uauaaugcaaaccaua

SEQ ID NO: 1443964 - RNA, 16 nt, Homo sapiens
uauaauucuacaggau

SEQ ID NO: 1443965 - RNA, 21 nt, Homo sapiens
uauacacacauauacauauau

SEQ ID NO: 1443966 - RNA, 13 nt, Homo sapiens
uauacacauggau

SEQ ID NO: 1443967 - RNA, 18 nt, Homo sapiens
uauacauaugacauauau

SEQ ID NO: 1443968 - RNA, 15 nt, Homo sapiens
uauucagcacuaaaa

SEQ ID NO: 1443969 - RNA, 12 nt, Homo sapiens
uauucaugccau

SEQ ID NO: 1443970 - RNA, 17 nt, Homo sapiens
uauuccaccauucacau

SEQ ID NO: 1443971 - RNA, 17 nt, Homo sapiens
uauucucuaagauauau

SEQ ID NO: 1443972 - RNA, 13 nt, Homo sapiens
uauucucuccuca

SEQ ID NO: 1443973 - RNA, 17 nt, Homo sapiens
uauucucuucacuccca

SEQ ID NO: 1443974 - RNA, 17 nt, Homo sapiens
uauucugauuccacuuu

SEQ ID NO: 1443975 - RNA, 11 nt, Homo sapiens
uauucuggaaa

SEQ ID NO: 1443976 - RNA, 14 nt, Homo sapiens
uauucuugucaaaa

SEQ ID NO: 1443977 - RNA, 18 nt, Homo sapiens
uauugaggauuaauuuau

SEQ ID NO: 1443978 - RNA, 14 nt, Homo sapiens
uauugauaugugaa

SEQ ID NO: 1443979 - RNA, 15 nt, Homo sapiens
uauugcugcugguaa

SEQ ID NO: 1443980 - RNA, 12 nt, Homo sapiens
uauugcugugaa

SEQ ID NO: 1443981 - RNA, 20 nt, Homo sapiens
uauuggaaaggucauugugg

SEQ ID NO: 1443982 - RNA, 20 nt, Homo sapiens
uauuggaccagaaguccuau

SEQ ID NO: 1443983 - RNA, 17 nt, Homo sapiens
uauugguaggauuuaua

SEQ ID NO: 1443984 - RNA, 16 nt, Homo sapiens
uauugguguugcccua

SEQ ID NO: 1443985 - RNA, 20 nt, Homo sapiens
uauugucggaagacuugcca

SEQ ID NO: 1443986 - RNA, 16 nt, Homo sapiens
uauugucuaggccaga

SEQ ID NO: 1443987 - RNA, 13 nt, Homo sapiens
uauuuaaacaauu

SEQ ID NO: 1443988 - RNA, 14 nt, Homo sapiens
uauuuaagccuuuu

SEQ ID NO: 1443989 - RNA, 17 nt, Homo sapiens
uauuuaaguauauagua

SEQ ID NO: 1443990 - RNA, 15 nt, Homo sapiens
uauuuagacaaaguu

SEQ ID NO: 1443991 - RNA, 15 nt, Homo sapiens
uauuuagugaacuac

SEQ ID NO: 1443992 - RNA, 16 nt, Homo sapiens
uauuuaguucuugagu

SEQ ID NO: 1443993 - RNA, 13 nt, Homo sapiens
uauuuauauauca

SEQ ID NO: 1443994 - RNA, 14 nt, Homo sapiens
uauuuaugccucug

SEQ ID NO: 1443995 - RNA, 13 nt, Homo sapiens
uauuuauucacug

SEQ ID NO: 1443996 - RNA, 19 nt, Homo sapiens
uauuuauuggggaucugca

SEQ ID NO: 1443997 - RNA, 21 nt, Homo sapiens
uauuucaaccgcuugccauau

SEQ ID NO: 1443998 - RNA, 16 nt, Homo sapiens
uauuucauccaguuug

SEQ ID NO: 1443999 - RNA, 14 nt, Homo sapiens
uauuucuacacagu

SEQ ID NO: 1444000 - RNA, 16 nt, Homo sapiens
uauuucucugaauuca

SEQ ID NO: 1444001 - RNA, 16 nt, Homo sapiens
uauuucugucauucaa

SEQ ID NO: 1444002 - RNA, 21 nt, Homo sapiens
uauuugaacuuauuuacacau

SEQ ID NO: 1444003 - RNA, 13 nt, Homo sapiens
uauuugaauauca

SEQ ID NO: 1444004 - RNA, 12 nt, Homo sapiens
uauuugccagcu

SEQ ID NO: 1444005 - RNA, 15 nt, Homo sapiens
uauuuuaagacguga

SEQ ID NO: 1444006 - RNA, 17 nt, Homo sapiens
uauuuuaagacgugaau

SEQ ID NO: 1444007 - RNA, 12 nt, Homo sapiens
uauuuugcacug

SEQ ID NO: 1444008 - RNA, 16 nt, Homo sapiens
uauuuugccagacuua

SEQ ID NO: 1444009 - RNA, 18 nt, Homo sapiens
uauuuuuuacaauggcca

SEQ ID NO: 1444010 - RNA, 16 nt, Homo sapiens
uauuuuuuacuuugcc

SEQ ID NO: 1444011 - RNA, 22 nt, Homo sapiens
uauuuuuucaauuuaaagguua

SEQ ID NO: 1444012 - RNA, 15 nt, Homo sapiens
ucaaaaagacugugg

SEQ ID NO: 1444013 - RNA, 14 nt, Homo sapiens
ucaaaaaguacaau

SEQ ID NO: 1444014 - RNA, 13 nt, Homo sapiens
ucaaaacaaucaa

SEQ ID NO: 1444015 - RNA, 17 nt, Homo sapiens
ucaaaacaauuggcaaa

SEQ ID NO: 1444016 - RNA, 17 nt, Homo sapiens
ucaaaacugcacuguca

SEQ ID NO: 1444017 - RNA, 13 nt, Homo sapiens
ucaaaagcacuug

SEQ ID NO: 1444018 - RNA, 18 nt, Homo sapiens
ucaaaccauaaacuucau

SEQ ID NO: 1444019 - RNA, 22 nt, Homo sapiens
ucaaagacaauggaaacuguac

SEQ ID NO: 1444020 - RNA, 20 nt, Homo sapiens
ucaaagacagagaagaccaa

SEQ ID NO: 1444021 - RNA, 16 nt, Homo sapiens
ucaaaguaaaacuugc

SEQ ID NO: 1444022 - RNA, 16 nt, Homo sapiens
ucaaaugacccaaaga

SEQ ID NO: 1444023 - RNA, 17 nt, Homo sapiens
ucaaaugacccaaagac

SEQ ID NO: 1444024 - RNA, 22 nt, Homo sapiens
ucaaaugacccaaagaccaaua

SEQ ID NO: 1444025 - RNA, 19 nt, Homo sapiens
ucaaaugucagagcuaugu

SEQ ID NO: 1444026 - RNA, 16 nt, Homo sapiens
ucaacaaccaugccag

SEQ ID NO: 1444027 - RNA, 17 nt, Homo sapiens
ucaacaagaguugucuu

SEQ ID NO: 1444028 - RNA, 17 nt, Homo sapiens
ucaacaauaaagacuga

SEQ ID NO: 1444029 - RNA, 22 nt, Homo sapiens
ucaacacccgccccccccaugu

SEQ ID NO: 1444030 - RNA, 17 nt, Homo sapiens
ucaaccgcuugccauau

SEQ ID NO: 1444031 - RNA, 21 nt, Homo sapiens
ucaaccugguggcaccagaug

SEQ ID NO: 1444032 - RNA, 13 nt, Homo sapiens
ucaacgugcauuu

SEQ ID NO: 1444033 - RNA, 13 nt, Homo sapiens
ucaacuaugauau

SEQ ID NO: 1444034 - RNA, 17 nt, Homo sapiens
ucaacugaaaagacuca

SEQ ID NO: 1444035 - RNA, 23 nt, Homo sapiens
ucaacuggagacacuauuuaucu

SEQ ID NO: 1444036 - RNA, 23 nt, Homo sapiens
ucaagaaaugaaugcuccaugaa

SEQ ID NO: 1444037 - RNA, 20 nt, Homo sapiens
ucaagacccuuuucuguaug

SEQ ID NO: 1444038 - RNA, 21 nt, Homo sapiens
ucaagcgauucuucugccuca

SEQ ID NO: 1444039 - RNA, 22 nt, Homo sapiens
ucaagcgauucuucugccucag

SEQ ID NO: 1444040 - RNA, 15 nt, Homo sapiens
ucaagcuagaaggcc

SEQ ID NO: 1444041 - RNA, 15 nt, Homo sapiens
ucaagcuagccagag

SEQ ID NO: 1444042 - RNA, 20 nt, Homo sapiens
ucaaguauuagggguaauau

SEQ ID NO: 1444043 - RNA, 18 nt, Homo sapiens
ucaaguuaggagcuuuua

SEQ ID NO: 1444044 - RNA, 15 nt, Homo sapiens
ucaaguugcuucuca

SEQ ID NO: 1444045 - RNA, 16 nt, Homo sapiens
ucaaguuuuucagaaa

SEQ ID NO: 1444046 - RNA, 19 nt, Homo sapiens
ucaauaaauuaaguuuuau

SEQ ID NO: 1444047 - RNA, 23 nt, Homo sapiens
ucaaugaaaaaaaguacauguau

SEQ ID NO: 1444048 - RNA, 12 nt, Homo sapiens
ucaaugaagauu

SEQ ID NO: 1444049 - RNA, 12 nt, Homo sapiens
ucaaugaccugu

SEQ ID NO: 1444050 - RNA, 21 nt, Homo sapiens
ucaaugauuauuuucauuaca

SEQ ID NO: 1444051 - RNA, 21 nt, Homo sapiens
ucaauguuucuuuuaucacga

SEQ ID NO: 1444052 - RNA, 18 nt, Homo sapiens
ucaauuaaaggcuuucag

SEQ ID NO: 1444053 - RNA, 17 nt, Homo sapiens
ucaauucagugcuguac

SEQ ID NO: 1444054 - RNA, 15 nt, Homo sapiens
ucaauuucaguguau

SEQ ID NO: 1444055 - RNA, 20 nt, Homo sapiens
ucauaccucugaccaacagg

SEQ ID NO: 1444056 - RNA, 12 nt, Homo sapiens
ucauauguauuu

SEQ ID NO: 1444057 - RNA, 23 nt, Homo sapiens
ucauauugguauucacuaaucug

SEQ ID NO: 1444058 - RNA, 22 nt, Homo sapiens
ucaucaauuuuuauacauauca

SEQ ID NO: 1444059 - RNA, 18 nt, Homo sapiens
ucaucagcuuugugccac

SEQ ID NO: 1444060 - RNA, 19 nt, Homo sapiens
ucaucauauuguauguaag

SEQ ID NO: 1444061 - RNA, 14 nt, Homo sapiens
ucauccauguccaa

SEQ ID NO: 1444062 - RNA, 21 nt, Homo sapiens
ucaucgaaaauucauuucaca

SEQ ID NO: 1444063 - RNA, 18 nt, Homo sapiens
ucaucuacaagcauuugc

SEQ ID NO: 1444064 - RNA, 17 nt, Homo sapiens
ucaucuauaacaugcau

SEQ ID NO: 1444065 - RNA, 14 nt, Homo sapiens
ucaucugauaugca

SEQ ID NO: 1444066 - RNA, 18 nt, Homo sapiens
ucaucuugacauguaaug

SEQ ID NO: 1444067 - RNA, 21 nt, Homo sapiens
ucaucuugcccccucaucuca

SEQ ID NO: 1444068 - RNA, 18 nt, Homo sapiens
ucaucuuggccacuuuaa

SEQ ID NO: 1444069 - RNA, 12 nt, Homo sapiens
ucaugacaaagu

SEQ ID NO: 1444070 - RNA, 16 nt, Homo sapiens
ucaugacacuauacag

SEQ ID NO: 1444071 - RNA, 16 nt, Homo sapiens
ucaugacauguuauau

SEQ ID NO: 1444072 - RNA, 19 nt, Homo sapiens
ucaugaguaccucaaagga

SEQ ID NO: 1444073 - RNA, 22 nt, Homo sapiens
ucaugaguggauggauggacag

SEQ ID NO: 1444074 - RNA, 15 nt, Homo sapiens
ucaugauaaucuggg

SEQ ID NO: 1444075 - RNA, 15 nt, Homo sapiens
ucaugcaaucuuccu

SEQ ID NO: 1444076 - RNA, 20 nt, Homo sapiens
ucaugcuuuaaaguguaaua

SEQ ID NO: 1444077 - RNA, 19 nt, Homo sapiens
ucauggaaguggcagugaa

SEQ ID NO: 1444078 - RNA, 19 nt, Homo sapiens
ucauggugacuaacaguua

SEQ ID NO: 1444079 - RNA, 17 nt, Homo sapiens
ucaugguguccagacag

SEQ ID NO: 1444080 - RNA, 13 nt, Homo sapiens
ucaugugugcaug

SEQ ID NO: 1444081 - RNA, 18 nt, Homo sapiens
ucauuacuaaccauaguu

SEQ ID NO: 1444082 - RNA, 16 nt, Homo sapiens
ucauuaugacucuuaa

SEQ ID NO: 1444083 - RNA, 14 nt, Homo sapiens
ucauucaaaacaac

SEQ ID NO: 1444084 - RNA, 13 nt, Homo sapiens
ucauuccaccuuc

SEQ ID NO: 1444085 - RNA, 19 nt, Homo sapiens
ucauucccuagaucuuucu

SEQ ID NO: 1444086 - RNA, 15 nt, Homo sapiens
ucauucuucuggcaa

SEQ ID NO: 1444087 - RNA, 15 nt, Homo sapiens
ucauucuuugaagga

SEQ ID NO: 1444088 - RNA, 17 nt, Homo sapiens
ucauuggccuucuuaaa

SEQ ID NO: 1444089 - RNA, 15 nt, Homo sapiens
ucauuucuacuguga

SEQ ID NO: 1444090 - RNA, 23 nt, Homo sapiens
ucauuucuuuucauuguaaucaa

SEQ ID NO: 1444091 - RNA, 12 nt, Homo sapiens
ucauuugaacaa

SEQ ID NO: 1444092 - RNA, 13 nt, Homo sapiens
ucauuugaacaac

SEQ ID NO: 1444093 - RNA, 23 nt, Homo sapiens
ucauuuugggaccuauaucucag

SEQ ID NO: 1444094 - RNA, 20 nt, Homo sapiens
uccaaaaaggaacacuggaa

SEQ ID NO: 1444095 - RNA, 19 nt, Homo sapiens
uccaaaaccuaaagaggaa

SEQ ID NO: 1444096 - RNA, 21 nt, Homo sapiens
uccaaagaaauguaagggaaa

SEQ ID NO: 1444097 - RNA, 15 nt, Homo sapiens
uccaaagacaagaaa

SEQ ID NO: 1444098 - RNA, 19 nt, Homo sapiens
uccaaaggcauaagacccu

SEQ ID NO: 1444099 - RNA, 18 nt, Homo sapiens
uccaaagugccacucauu

SEQ ID NO: 1444100 - RNA, 16 nt, Homo sapiens
uccaaaugaaugaccu

SEQ ID NO: 1444101 - RNA, 19 nt, Homo sapiens
uccaacagcucaagucuuc

SEQ ID NO: 1444102 - RNA, 16 nt, Homo sapiens
uccaacccaaccucau

SEQ ID NO: 1444103 - RNA, 16 nt, Homo sapiens
uccaaccccuuuccac

SEQ ID NO: 1444104 - RNA, 17 nt, Homo sapiens
uccaaccccuuuccacg

SEQ ID NO: 1444105 - RNA, 16 nt, Homo sapiens
uccaaccgaccagcuu

SEQ ID NO: 1444106 - RNA, 19 nt, Homo sapiens
uccaaccugccugugcaug

SEQ ID NO: 1444107 - RNA, 13 nt, Homo sapiens
uccaacuuaacau

SEQ ID NO: 1444108 - RNA, 16 nt, Homo sapiens
uccaagaaagauccac

SEQ ID NO: 1444109 - RNA, 16 nt, Homo sapiens
uccaagaauacagaaa

SEQ ID NO: 1444110 - RNA, 18 nt, Homo sapiens
uccaagaggucuccauca

SEQ ID NO: 1444111 - RNA, 12 nt, Homo sapiens
uccaagcccuuu

SEQ ID NO: 1444112 - RNA, 18 nt, Homo sapiens
uccaagcuucaagugaua

SEQ ID NO: 1444113 - RNA, 19 nt, Homo sapiens
uccaaguuccugcacucca

SEQ ID NO: 1444114 - RNA, 19 nt, Homo sapiens
uccaaguuuuaauuuuuaa

SEQ ID NO: 1444115 - RNA, 13 nt, Homo sapiens
uccaauggcugua

SEQ ID NO: 1444116 - RNA, 20 nt, Homo sapiens
uccacaccaaagucagggag

SEQ ID NO: 1444117 - RNA, 19 nt, Homo sapiens
uccacacugucagagcugu

SEQ ID NO: 1444118 - RNA, 15 nt, Homo sapiens
uccacagucucccau

SEQ ID NO: 1444119 - RNA, 14 nt, Homo sapiens
uccacagugcugcu

SEQ ID NO: 1444120 - RNA, 18 nt, Homo sapiens
uccacauuauacauuuga

SEQ ID NO: 1444121 - RNA, 20 nt, Homo sapiens
uccacccaggcugcacugca

SEQ ID NO: 1444122 - RNA, 20 nt, Homo sapiens
uccaccuuguuacacauuau

SEQ ID NO: 1444123 - RNA, 11 nt, Homo sapiens
uccacgagcua

SEQ ID NO: 1444124 - RNA, 20 nt, Homo sapiens
uccacgggaagccuccguca

SEQ ID NO: 1444125 - RNA, 14 nt, Homo sapiens
uccacucacuccag

SEQ ID NO: 1444126 - RNA, 15 nt, Homo sapiens
uccacucacuccagc

SEQ ID NO: 1444127 - RNA, 17 nt, Homo sapiens
uccacugaggaugugag

SEQ ID NO: 1444128 - RNA, 22 nt, Homo sapiens
uccacugaggaugugagccuga

SEQ ID NO: 1444129 - RNA, 16 nt, Homo sapiens
uccacuggcuccacau

SEQ ID NO: 1444130 - RNA, 20 nt, Homo sapiens
uccacuuagaaauugcauuu

SEQ ID NO: 1444131 - RNA, 14 nt, Homo sapiens
uccacuucucuaga

SEQ ID NO: 1444132 - RNA, 19 nt, Homo sapiens
uccagacagagcccuguga

SEQ ID NO: 1444133 - RNA, 13 nt, Homo sapiens
uccagaccaccug

SEQ ID NO: 1444134 - RNA, 15 nt, Homo sapiens
uccagagaguggcuc

SEQ ID NO: 1444135 - RNA, 19 nt, Homo sapiens
uccagaugccuuccugucu

SEQ ID NO: 1444136 - RNA, 16 nt, Homo sapiens
uccagccaacauuuaa

SEQ ID NO: 1444137 - RNA, 22 nt, Homo sapiens
uccagccaacauuuaaugagca

SEQ ID NO: 1444138 - RNA, 15 nt, Homo sapiens
uccagcccacacccc

SEQ ID NO: 1444139 - RNA, 15 nt, Homo sapiens
uccagccugggcaac

SEQ ID NO: 1444140 - RNA, 13 nt, Homo sapiens
uccaggacaugau

SEQ ID NO: 1444141 - RNA, 15 nt, Homo sapiens
uccagggagaccuag

SEQ ID NO: 1444142 - RNA, 21 nt, Homo sapiens
aacacgagcaggcuacuguca

SEQ ID NO: 1444143 - RNA, 17 nt, Homo sapiens
aacacuacauuacuuua

SEQ ID NO: 1444144 - RNA, 19 nt, Homo sapiens
aacacuagaaaacauucca

SEQ ID NO: 1444145 - RNA, 18 nt, Homo sapiens
aacacuagagucugucau

SEQ ID NO: 1444146 - RNA, 20 nt, Homo sapiens
aacacuccacccccuccagc

SEQ ID NO: 1444147 - RNA, 15 nt, Homo sapiens
aacacucuucuugag

SEQ ID NO: 1444148 - RNA, 16 nt, Homo sapiens
aacagagagagacaga

SEQ ID NO: 1444149 - RNA, 17 nt, Homo sapiens
aacagccaacagguggc

SEQ ID NO: 1444150 - RNA, 23 nt, Homo sapiens
aacagcccauuuuaucuuugaau

SEQ ID NO: 1444151 - RNA, 18 nt, Homo sapiens
aacagccccaaagucaau

SEQ ID NO: 1444152 - RNA, 22 nt, Homo sapiens
aacagcguguucuaaguauuug

SEQ ID NO: 1444153 - RNA, 14 nt, Homo sapiens
aacagucucaggaa

SEQ ID NO: 1444154 - RNA, 15 nt, Homo sapiens
aacauaucaauucaa

SEQ ID NO: 1444155 - RNA, 20 nt, Homo sapiens
aacauaugcauuaugaaguu

SEQ ID NO: 1444156 - RNA, 15 nt, Homo sapiens
aacaugacacugacc

SEQ ID NO: 1444157 - RNA, 18 nt, Homo sapiens
aacaugagcgcugaugau

SEQ ID NO: 1444158 - RNA, 15 nt, Homo sapiens
aacaugcacauuuau

SEQ ID NO: 1444159 - RNA, 12 nt, Homo sapiens
aacaugcacggu

SEQ ID NO: 1444160 - RNA, 20 nt, Homo sapiens
aacauguuuuguauguuaaa

SEQ ID NO: 1444161 - RNA, 17 nt, Homo sapiens
aacauugacuucuuggu

SEQ ID NO: 1444162 - RNA, 21 nt, Homo sapiens
aacauuuauuucaaacuauug

SEQ ID NO: 1444163 - RNA, 14 nt, Homo sapiens
aaccaagucuacuu

SEQ ID NO: 1444164 - RNA, 17 nt, Homo sapiens
aaccaagucuacuucac

SEQ ID NO: 1444165 - RNA, 19 nt, Homo sapiens
aaccaaucauuuuaagaag

SEQ ID NO: 1444166 - RNA, 9 nt, Homo sapiens
aaccaauga

SEQ ID NO: 1444167 - RNA, 12 nt, Homo sapiens
aaccaaugauuc

SEQ ID NO: 1444168 - RNA, 14 nt, Homo sapiens
aaccacuguacaua

SEQ ID NO: 1444169 - RNA, 18 nt, Homo sapiens
aaccagcagaaaagugcu

SEQ ID NO: 1444170 - RNA, 16 nt, Homo sapiens
aaccaggacucugccc

SEQ ID NO: 1444171 - RNA, 15 nt, Homo sapiens
aaccaugccagggau

SEQ ID NO: 1444172 - RNA, 14 nt, Homo sapiens
aaccauuacuguaa

SEQ ID NO: 1444173 - RNA, 19 nt, Homo sapiens
aacccaaggaacaagagaa

SEQ ID NO: 1444174 - RNA, 20 nt, Homo sapiens
aacccaccaucuacccacuu

SEQ ID NO: 1444175 - RNA, 12 nt, Homo sapiens
aacccaccugcu

SEQ ID NO: 1444176 - RNA, 15 nt, Homo sapiens
aacccauacuacccu

SEQ ID NO: 1444177 - RNA, 13 nt, Homo sapiens
aaccccuuuccac

SEQ ID NO: 1444178 - RNA, 23 nt, Homo sapiens
aacccgagaaaacaaacccaggu

SEQ ID NO: 1444179 - RNA, 13 nt, Homo sapiens
aacccucacugug

SEQ ID NO: 1444180 - RNA, 14 nt, Homo sapiens
aacccucacugugu

SEQ ID NO: 1444181 - RNA, 12 nt, Homo sapiens
aacccuccccaa

SEQ ID NO: 1444182 - RNA, 13 nt, Homo sapiens
aacccuccccaaa

SEQ ID NO: 1444183 - RNA, 15 nt, Homo sapiens
aacccucucuucccu

SEQ ID NO: 1444184 - RNA, 21 nt, Homo sapiens
aacccuuccuuucccaaguau

SEQ ID NO: 1444185 - RNA, 20 nt, Homo sapiens
aaccgcuugccauauuccga

SEQ ID NO: 1444186 - RNA, 19 nt, Homo sapiens
aaccggcauauuauuccau

SEQ ID NO: 1444187 - RNA, 16 nt, Homo sapiens
aaccgugauaagccuu

SEQ ID NO: 1444188 - RNA, 20 nt, Homo sapiens
aaccuacuagacaaugaugu

SEQ ID NO: 1444189 - RNA, 17 nt, Homo sapiens
aaccuaugaaacuauug

SEQ ID NO: 1444190 - RNA, 22 nt, Homo sapiens
aaccucagccaaacacagagcg

SEQ ID NO: 1444191 - RNA, 13 nt, Homo sapiens
aaccucagggaca

SEQ ID NO: 1444192 - RNA, 14 nt, Homo sapiens
aaccucauuuacca

SEQ ID NO: 1444193 - RNA, 17 nt, Homo sapiens
aaccucucuaagccaca

SEQ ID NO: 1444194 - RNA, 16 nt, Homo sapiens
aaccuggagaugauga

SEQ ID NO: 1444195 - RNA, 22 nt, Homo sapiens
aaccuggaggggcuagaaccua

SEQ ID NO: 1444196 - RNA, 20 nt, Homo sapiens
aaccuugauuuaaaauauca

SEQ ID NO: 1444197 - RNA, 16 nt, Homo sapiens
aacgaaugguacuaca

SEQ ID NO: 1444198 - RNA, 18 nt, Homo sapiens
aacgauucccccagucau

SEQ ID NO: 1444199 - RNA, 22 nt, Homo sapiens
aacgcaaagggcugaaagccau

SEQ ID NO: 1444200 - RNA, 17 nt, Homo sapiens
aacgcuuuuugggagaa

SEQ ID NO: 1444201 - RNA, 15 nt, Homo sapiens
aacggagagugcuug

SEQ ID NO: 1444202 - RNA, 16 nt, Homo sapiens
aacuaagacauaugca

SEQ ID NO: 1444203 - RNA, 21 nt, Homo sapiens
aacuacucagcucuccugcug

SEQ ID NO: 1444204 - RNA, 21 nt, Homo sapiens
aacuaguauuguccauaucag

SEQ ID NO: 1444205 - RNA, 17 nt, Homo sapiens
aacuaugugauguuaac

SEQ ID NO: 1444206 - RNA, 14 nt, Homo sapiens
aacuauuuauuuca

SEQ ID NO: 1444207 - RNA, 19 nt, Homo sapiens
aacuauuucuacacagugg

SEQ ID NO: 1444208 - RNA, 14 nt, Homo sapiens
aacucagagccucc

SEQ ID NO: 1444209 - RNA, 14 nt, Homo sapiens
aacucaucuguuau

SEQ ID NO: 1444210 - RNA, 19 nt, Homo sapiens
aacuccuuuagcagguggu

SEQ ID NO: 1444211 - RNA, 19 nt, Homo sapiens
aacucuccuacacuuccau

SEQ ID NO: 1444212 - RNA, 19 nt, Homo sapiens
aacucucugagauguguuc

SEQ ID NO: 1444213 - RNA, 23 nt, Homo sapiens
aacugaaucaagaaaugaaugcu

SEQ ID NO: 1444214 - RNA, 15 nt, Homo sapiens
aacugagccaaacac

SEQ ID NO: 1444215 - RNA, 17 nt, Homo sapiens
aacugaggucacugggu

SEQ ID NO: 1444216 - RNA, 12 nt, Homo sapiens
aacugccagcaa

SEQ ID NO: 1444217 - RNA, 20 nt, Homo sapiens
aacugcucugcccacuguga

SEQ ID NO: 1444218 - RNA, 17 nt, Homo sapiens
aacugcugaucaaugaa

SEQ ID NO: 1444219 - RNA, 15 nt, Homo sapiens
aacugcugauuugau

SEQ ID NO: 1444220 - RNA, 22 nt, Homo sapiens
aacuggacuugucuuccuuggc

SEQ ID NO: 1444221 - RNA, 20 nt, Homo sapiens
aacuggaggaguuccuugau

SEQ ID NO: 1444222 - RNA, 15 nt, Homo sapiens
aacuggggcuugcaa

SEQ ID NO: 1444223 - RNA, 15 nt, Homo sapiens
aacugguucaugaaa

SEQ ID NO: 1444224 - RNA, 18 nt, Homo sapiens
aacuguagauaaaguggu

SEQ ID NO: 1444225 - RNA, 13 nt, Homo sapiens
aacuguguguaca

SEQ ID NO: 1444226 - RNA, 22 nt, Homo sapiens
aacuguucuggccucagaccaa

SEQ ID NO: 1444227 - RNA, 22 nt, Homo sapiens
aaagguugacaauaaaugugcu

SEQ ID NO: 1444228 - RNA, 20 nt, Homo sapiens
aaaguaaaggccucaucucc

SEQ ID NO: 1444229 - RNA, 21 nt, Homo sapiens
aaaguaaaggccucaucuccu

SEQ ID NO: 1444230 - RNA, 23 nt, Homo sapiens
aaaguacucuuuaagagugaaau

SEQ ID NO: 1444231 - RNA, 16 nt, Homo sapiens
aaagucaaaaggugcc

SEQ ID NO: 1444232 - RNA, 15 nt, Homo sapiens
aaaguguaagcacuu

SEQ ID NO: 1444233 - RNA, 17 nt, Homo sapiens
aaaguuaaaaaaaagcc

SEQ ID NO: 1444234 - RNA, 23 nt, Homo sapiens
aaaguuaugguacuauguuagcc

SEQ ID NO: 1444235 - RNA, 15 nt, Homo sapiens
aaaguugcagucuca

SEQ ID NO: 1444236 - RNA, 15 nt, Homo sapiens
aaaguuuugaugaaa

SEQ ID NO: 1444237 - RNA, 17 nt, Homo sapiens
aaauaaaaugaaauguc

SEQ ID NO: 1444238 - RNA, 13 nt, Homo sapiens
aaauaaacaugag

SEQ ID NO: 1444239 - RNA, 17 nt, Homo sapiens
aaauaaaguaucaugca

SEQ ID NO: 1444240 - RNA, 15 nt, Homo sapiens
aaauaagaaugauuu

SEQ ID NO: 1444241 - RNA, 21 nt, Homo sapiens
aaauaaggauaauaaucauuc

SEQ ID NO: 1444242 - RNA, 13 nt, Homo sapiens
aaauaaugaacag

SEQ ID NO: 1444243 - RNA, 16 nt, Homo sapiens
aaauaauugauuucaa

SEQ ID NO: 1444244 - RNA, 16 nt, Homo sapiens
aaauacaaauuggaca

SEQ ID NO: 1444245 - RNA, 19 nt, Homo sapiens
aaauaguaagccucccucc

SEQ ID NO: 1444246 - RNA, 16 nt, Homo sapiens
aaauauaaacuugugu

SEQ ID NO: 1444247 - RNA, 18 nt, Homo sapiens
aaauauacaaacaugugg

SEQ ID NO: 1444248 - RNA, 13 nt, Homo sapiens
aaauauucucucc

SEQ ID NO: 1444249 - RNA, 16 nt, Homo sapiens
aaauauuuggucucua

SEQ ID NO: 1444250 - RNA, 19 nt, Homo sapiens
aaaucaaauaugcaaagca

SEQ ID NO: 1444251 - RNA, 15 nt, Homo sapiens
aaaucaaccccagac

SEQ ID NO: 1444252 - RNA, 16 nt, Homo sapiens
aaaucaaccccagacu

SEQ ID NO: 1444253 - RNA, 11 nt, Homo sapiens
aaaucacuugu

SEQ ID NO: 1444254 - RNA, 16 nt, Homo sapiens
aaaucagcacauuccu

SEQ ID NO: 1444255 - RNA, 18 nt, Homo sapiens
aaaucagcacauuccucc

SEQ ID NO: 1444256 - RNA, 15 nt, Homo sapiens
aaaucaguuauguca

SEQ ID NO: 1444257 - RNA, 21 nt, Homo sapiens
aaaucauggcaacauaauuca

SEQ ID NO: 1444258 - RNA, 18 nt, Homo sapiens
aaaucaugguuguaguga

SEQ ID NO: 1444259 - RNA, 16 nt, Homo sapiens
aaauccacaagccauu

SEQ ID NO: 1444260 - RNA, 18 nt, Homo sapiens
aaaucccauauauucuuc

SEQ ID NO: 1444261 - RNA, 20 nt, Homo sapiens
aaaucccuauuuaauuuucc

SEQ ID NO: 1444262 - RNA, 15 nt, Homo sapiens
aaauccuuccaugaa

SEQ ID NO: 1444263 - RNA, 19 nt, Homo sapiens
aaaucuaacuacaaggaca

SEQ ID NO: 1444264 - RNA, 12 nt, Homo sapiens
aaaucuccagug

SEQ ID NO: 1444265 - RNA, 15 nt, Homo sapiens
aaaucuccagugugc

SEQ ID NO: 1444266 - RNA, 20 nt, Homo sapiens
aaaucuuccaaagacaagaa

SEQ ID NO: 1444267 - RNA, 20 nt, Homo sapiens
aaaugaaggaauagcccgag

SEQ ID NO: 1444268 - RNA, 17 nt, Homo sapiens
aaaugaaguauuucuca

SEQ ID NO: 1444269 - RNA, 19 nt, Homo sapiens
aaaugaguucaacuuugag

SEQ ID NO: 1444270 - RNA, 16 nt, Homo sapiens
aaaugaugccacuucc

SEQ ID NO: 1444271 - RNA, 11 nt, Homo sapiens
aaaugcaacuu

SEQ ID NO: 1444272 - RNA, 23 nt, Homo sapiens
aaauggagaaauaggaccuucca

SEQ ID NO: 1444273 - RNA, 22 nt, Homo sapiens
aaauguaaaauaaguauuucca

SEQ ID NO: 1444274 - RNA, 13 nt, Homo sapiens
aaauguacacugg

SEQ ID NO: 1444275 - RNA, 13 nt, Homo sapiens
aaauguauauaca

SEQ ID NO: 1444276 - RNA, 17 nt, Homo sapiens
aaaugugucuugucucc

SEQ ID NO: 1444277 - RNA, 21 nt, Homo sapiens
aaaugugucuugucuccauuu

SEQ ID NO: 1444278 - RNA, 14 nt, Homo sapiens
aaauuaaaguauac

SEQ ID NO: 1444279 - RNA, 19 nt, Homo sapiens
aaauuaagagauacauucc

SEQ ID NO: 1444280 - RNA, 15 nt, Homo sapiens
aaauucuuuuucaca

SEQ ID NO: 1444281 - RNA, 22 nt, Homo sapiens
aaauucuuuuucacacugaugu

SEQ ID NO: 1444282 - RNA, 15 nt, Homo sapiens
aaauugaugccagug

SEQ ID NO: 1444283 - RNA, 15 nt, Homo sapiens
aaauuguacauuuga

SEQ ID NO: 1444284 - RNA, 14 nt, Homo sapiens
aaauuuaaccuacu

SEQ ID NO: 1444285 - RNA, 19 nt, Homo sapiens
aaauuucaaaagacauguu

SEQ ID NO: 1444286 - RNA, 21 nt, Homo sapiens
aaauuuguccaauggcuguaa

SEQ ID NO: 1444287 - RNA, 19 nt, Homo sapiens
aaauuuuuaucuuacuuuu

SEQ ID NO: 1444288 - RNA, 14 nt, Homo sapiens
aacaaaaucaugga

SEQ ID NO: 1444289 - RNA, 13 nt, Homo sapiens
aacaaacccaggu

SEQ ID NO: 1444290 - RNA, 13 nt, Homo sapiens
aacaaaucuucaa

SEQ ID NO: 1444291 - RNA, 18 nt, Homo sapiens
aacaacaauaacaacaau

SEQ ID NO: 1444292 - RNA, 20 nt, Homo sapiens
aacaacauccauguccuaug

SEQ ID NO: 1444293 - RNA, 22 nt, Homo sapiens
aacaaccuggucacaggacucu

SEQ ID NO: 1444294 - RNA, 21 nt, Homo sapiens
aacaaggacccuguuuuccac

SEQ ID NO: 1444295 - RNA, 12 nt, Homo sapiens
aacaaggcaaug

SEQ ID NO: 1444296 - RNA, 14 nt, Homo sapiens
aacaagggcaguga

SEQ ID NO: 1444297 - RNA, 22 nt, Homo sapiens
aacaaggggcuguuacauaaca

SEQ ID NO: 1444298 - RNA, 14 nt, Homo sapiens
aacaaggugucuuu

SEQ ID NO: 1444299 - RNA, 17 nt, Homo sapiens
aacaauaaagacugaga

SEQ ID NO: 1444300 - RNA, 16 nt, Homo sapiens
aacaauggagauauca

SEQ ID NO: 1444301 - RNA, 22 nt, Homo sapiens
aacaauuccaaaggaaucucca

SEQ ID NO: 1444302 - RNA, 14 nt, Homo sapiens
aacaauucucucuu

SEQ ID NO: 1444303 - RNA, 22 nt, Homo sapiens
aacacaaaccacaacugacaca

SEQ ID NO: 1444304 - RNA, 14 nt, Homo sapiens
aacacaagccacag

SEQ ID NO: 1444305 - RNA, 12 nt, Homo sapiens
aacacacuguaa

SEQ ID NO: 1444306 - RNA, 22 nt, Homo sapiens
aacaccacuuugucucugagaa

SEQ ID NO: 1444307 - RNA, 19 nt, Homo sapiens
aacacccaaagcauggacu

SEQ ID NO: 1444308 - RNA, 12 nt, Homo sapiens
aacacccaugaa

SEQ ID NO: 1444309 - RNA, 20 nt, Homo sapiens
aacacccgacuccucaaaag

SEQ ID NO: 1444310 - RNA, 13 nt, Homo sapiens
aacaccuccuagc

SEQ ID NO: 1444311 - RNA, 23 nt, Homo sapiens
agugauugugucugcauuguuau

SEQ ID NO: 1444312 - RNA, 15 nt, Homo sapiens
agugcaaagugcccu

SEQ ID NO: 1444313 - RNA, 23 nt, Homo sapiens
agugcaguggugcgaucuuggcu

SEQ ID NO: 1444314 - RNA, 14 nt, Homo sapiens
agugcaucucagcc

SEQ ID NO: 1444315 - RNA, 16 nt, Homo sapiens
agugccacucauuccu

SEQ ID NO: 1444316 - RNA, 19 nt, Homo sapiens
agugccacuugacauuccu

SEQ ID NO: 1444317 - RNA, 12 nt, Homo sapiens
agugccaggacu

SEQ ID NO: 1444318 - RNA, 15 nt, Homo sapiens
agugcccagcaugaa

SEQ ID NO: 1444319 - RNA, 13 nt, Homo sapiens
agugccugagaca

SEQ ID NO: 1444320 - RNA, 13 nt, Homo sapiens
agugccugcugaa

SEQ ID NO: 1444321 - RNA, 14 nt, Homo sapiens
agugccuuaccucc

SEQ ID NO: 1444322 - RNA, 16 nt, Homo sapiens
agugcuagcuagccag

SEQ ID NO: 1444323 - RNA, 16 nt, Homo sapiens
agugcuccugugugcu

SEQ ID NO: 1444324 - RNA, 16 nt, Homo sapiens
agugcuuccacuucua

SEQ ID NO: 1444325 - RNA, 13 nt, Homo sapiens
aguggagaggaaa

SEQ ID NO: 1444326 - RNA, 22 nt, Homo sapiens
aguggagaguguuccuguugaa

SEQ ID NO: 1444327 - RNA, 21 nt, Homo sapiens
aguggaugacgugaagccaca

SEQ ID NO: 1444328 - RNA, 17 nt, Homo sapiens
aguggaugcauuccuga

SEQ ID NO: 1444329 - RNA, 17 nt, Homo sapiens
aguggcaguguaugcuc

SEQ ID NO: 1444330 - RNA, 15 nt, Homo sapiens
aguggcauccauuuc

SEQ ID NO: 1444331 - RNA, 23 nt, Homo sapiens
aguggcucacgccuguaauccca

SEQ ID NO: 1444332 - RNA, 21 nt, Homo sapiens
aguggcuuuuuuccuccugug

SEQ ID NO: 1444333 - RNA, 15 nt, Homo sapiens
agugggaacucugac

SEQ ID NO: 1444334 - RNA, 17 nt, Homo sapiens
agugggaacucugacaa

SEQ ID NO: 1444335 - RNA, 19 nt, Homo sapiens
agugggaggugagaccacc

SEQ ID NO: 1444336 - RNA, 19 nt, Homo sapiens
agugggugguggaucuguc

SEQ ID NO: 1444337 - RNA, 14 nt, Homo sapiens
agugguuguugcca

SEQ ID NO: 1444338 - RNA, 21 nt, Homo sapiens
aguguccccuccacugucaca

SEQ ID NO: 1444339 - RNA, 14 nt, Homo sapiens
agugucuugaaugu

SEQ ID NO: 1444340 - RNA, 14 nt, Homo sapiens
aguguggaagcaga

SEQ ID NO: 1444341 - RNA, 16 nt, Homo sapiens
aguguguuuccuucag

SEQ ID NO: 1444342 - RNA, 15 nt, Homo sapiens
aggcggcuccagguc

SEQ ID NO: 1444343 - RNA, 18 nt, Homo sapiens
aggcggucaugugugcau

SEQ ID NO: 1444344 - RNA, 17 nt, Homo sapiens
aggcuauagcugggaac

SEQ ID NO: 1444345 - RNA, 19 nt, Homo sapiens
aggcucugggcucagggcu

SEQ ID NO: 1444346 - RNA, 12 nt, Homo sapiens
aggcucuuccau

SEQ ID NO: 1444347 - RNA, 16 nt, Homo sapiens
aggcugaccaagagag

SEQ ID NO: 1444348 - RNA, 14 nt, Homo sapiens
aggcugaggacuua

SEQ ID NO: 1444349 - RNA, 15 nt, Homo sapiens
aggcugcaugcucug

SEQ ID NO: 1444350 - RNA, 23 nt, Homo sapiens
aggcuggagauccuaacugagaa

SEQ ID NO: 1444351 - RNA, 14 nt, Homo sapiens
aggcuggggccagu

SEQ ID NO: 1444352 - RNA, 22 nt, Homo sapiens
aggcugggggcgggggagccaa

SEQ ID NO: 1444353 - RNA, 20 nt, Homo sapiens
aggcugucgugagcuaugau

SEQ ID NO: 1444354 - RNA, 23 nt, Homo sapiens
aggcugucgugagcuaugauuau

SEQ ID NO: 1444355 - RNA, 19 nt, Homo sapiens
aggcuuaaggagaggagaa

SEQ ID NO: 1444356 - RNA, 21 nt, Homo sapiens
aggcuuccagagaguccucug

SEQ ID NO: 1444357 - RNA, 12 nt, Homo sapiens
aggcuucuucag

SEQ ID NO: 1444358 - RNA, 19 nt, Homo sapiens
aggcuugaaguaaccuuau

SEQ ID NO: 1444359 - RNA, 16 nt, Homo sapiens
aggcuugccaccgggg

SEQ ID NO: 1444360 - RNA, 20 nt, Homo sapiens
aggcuuuuaagaaacacagg

SEQ ID NO: 1444361 - RNA, 14 nt, Homo sapiens
agggaaaguuaaaa

SEQ ID NO: 1444362 - RNA, 13 nt, Homo sapiens
agggaagcaggga

SEQ ID NO: 1444363 - RNA, 23 nt, Homo sapiens
agggaagcuguuugugugucugg

SEQ ID NO: 1444364 - RNA, 14 nt, Homo sapiens
agggagacagagac

SEQ ID NO: 1444365 - RNA, 13 nt, Homo sapiens
agggauguaucaa

SEQ ID NO: 1444366 - RNA, 15 nt, Homo sapiens
agggcaaucuugucc

SEQ ID NO: 1444367 - RNA, 21 nt, Homo sapiens
agggcagaaggggaagauacu

SEQ ID NO: 1444368 - RNA, 18 nt, Homo sapiens
agggccagcucacaagcc

SEQ ID NO: 1444369 - RNA, 13 nt, Homo sapiens
agggccucuggga

SEQ ID NO: 1444370 - RNA, 15 nt, Homo sapiens
agucaaaacagagau

SEQ ID NO: 1444371 - RNA, 12 nt, Homo sapiens
agucaacaacca

SEQ ID NO: 1444372 - RNA, 23 nt, Homo sapiens
agucaauccccucauucaggaaa

SEQ ID NO: 1444373 - RNA, 20 nt, Homo sapiens
agucaauuaaaggcuuucag

SEQ ID NO: 1444374 - RNA, 14 nt, Homo sapiens
agucaauuuuacaa

SEQ ID NO: 1444375 - RNA, 13 nt, Homo sapiens
agucaccaaaauu

SEQ ID NO: 1444376 - RNA, 17 nt, Homo sapiens
agucacccuucugggca

SEQ ID NO: 1444377 - RNA, 21 nt, Homo sapiens
agucacugucccucaaaugac

SEQ ID NO: 1444378 - RNA, 17 nt, Homo sapiens
agucagaacucuguguu

SEQ ID NO: 1444379 - RNA, 17 nt, Homo sapiens
agucagcuguaccaagc

SEQ ID NO: 1444380 - RNA, 16 nt, Homo sapiens
agucaguaauugccaa

SEQ ID NO: 1444381 - RNA, 16 nt, Homo sapiens
agucaguaguauucua

SEQ ID NO: 1444382 - RNA, 15 nt, Homo sapiens
agucauacugucacu

SEQ ID NO: 1444383 - RNA, 15 nt, Homo sapiens
agucaugcacucagg

SEQ ID NO: 1444384 - RNA, 21 nt, Homo sapiens
agucauugucgcucagcaaua

SEQ ID NO: 1444385 - RNA, 15 nt, Homo sapiens
aguccaacaauguug

SEQ ID NO: 1444386 - RNA, 22 nt, Homo sapiens
aguccaaccugccugugcauga

SEQ ID NO: 1444387 - RNA, 16 nt, Homo sapiens
aguccacaucuucuca

SEQ ID NO: 1444388 - RNA, 20 nt, Homo sapiens
aguccagaauaagugcuguu

SEQ ID NO: 1444389 - RNA, 18 nt, Homo sapiens
aguccagaugccuuccug

SEQ ID NO: 1444390 - RNA, 18 nt, Homo sapiens
aguccgcagucuggccug

SEQ ID NO: 1444391 - RNA, 20 nt, Homo sapiens
aguccuaucgacuuuauaca

SEQ ID NO: 1444392 - RNA, 15 nt, Homo sapiens
aguccuccucuuccu

SEQ ID NO: 1444393 - RNA, 20 nt, Homo sapiens
aguccuuugggauucuagga

SEQ ID NO: 1444394 - RNA, 21 nt, Homo sapiens
agucuaauuuugucaaaucau

SEQ ID NO: 1444395 - RNA, 18 nt, Homo sapiens
agucuacuucacuaauga

SEQ ID NO: 1444396 - RNA, 16 nt, Homo sapiens
agucucacucugucac

SEQ ID NO: 1444397 - RNA, 12 nt, Homo sapiens
agucuccagugg

SEQ ID NO: 1444398 - RNA, 12 nt, Homo sapiens
agucucuaugau

SEQ ID NO: 1444399 - RNA, 14 nt, Homo sapiens
agucucuaugaucu

SEQ ID NO: 1444400 - RNA, 18 nt, Homo sapiens
agucucucccgauaucac

SEQ ID NO: 1444401 - RNA, 21 nt, Homo sapiens
agucucugugcuuugacucac

SEQ ID NO: 1444402 - RNA, 21 nt, Homo sapiens
agucugaaagacagaauguca

SEQ ID NO: 1444403 - RNA, 21 nt, Homo sapiens
agucugaggccccuuaacuca

SEQ ID NO: 1444404 - RNA, 18 nt, Homo sapiens
agucugagguccugagca

SEQ ID NO: 1444405 - RNA, 14 nt, Homo sapiens
agucugaugacaca

SEQ ID NO: 1444406 - RNA, 21 nt, Homo sapiens
agucugggauguagaacuuca

SEQ ID NO: 1444407 - RNA, 17 nt, Homo sapiens
agucugggcaaugaaac

SEQ ID NO: 1444408 - RNA, 18 nt, Homo sapiens
agucuugcucuguugccc

SEQ ID NO: 1444409 - RNA, 21 nt, Homo sapiens
agucuugguuccucuacuacu

SEQ ID NO: 1444410 - RNA, 20 nt, Homo sapiens
agucuuuauuguguaucaua

SEQ ID NO: 1444411 - RNA, 22 nt, Homo sapiens
agucuuuccgucucccuaaaau

SEQ ID NO: 1444412 - RNA, 22 nt, Homo sapiens
agugaaaaaucuguggaaugua

SEQ ID NO: 1444413 - RNA, 14 nt, Homo sapiens
agugaaauaauuaa

SEQ ID NO: 1444414 - RNA, 21 nt, Homo sapiens
agugaaauaauuaaaaaccac

SEQ ID NO: 1444415 - RNA, 21 nt, Homo sapiens
agugaauugacccauguuccc

SEQ ID NO: 1444416 - RNA, 15 nt, Homo sapiens
agugacauccaggag

SEQ ID NO: 1444417 - RNA, 20 nt, Homo sapiens
agugacaucucuuugauguc

SEQ ID NO: 1444418 - RNA, 21 nt, Homo sapiens
agugacaucucuuugauguca

SEQ ID NO: 1444419 - RNA, 17 nt, Homo sapiens
agugaccccagccuccu

SEQ ID NO: 1444420 - RNA, 20 nt, Homo sapiens
agugaccccagccuccugcc

SEQ ID NO: 1444421 - RNA, 16 nt, Homo sapiens
agugaguuacagcgag

SEQ ID NO: 1444422 - RNA, 19 nt, Homo sapiens
agugauacauguacuccag

SEQ ID NO: 1444423 - RNA, 16 nt, Homo sapiens
agugauguacgagcug

SEQ ID NO: 1444424 - RNA, 15 nt, Homo sapiens
ugcaccaccaugcca

SEQ ID NO: 1444425 - RNA, 15 nt, Homo sapiens
ugcacgucuugcuau

SEQ ID NO: 1444426 - RNA, 17 nt, Homo sapiens
ugcacgucuugcuauuu

SEQ ID NO: 1444427 - RNA, 18 nt, Homo sapiens
ugcacuagccugugauua

SEQ ID NO: 1444428 - RNA, 20 nt, Homo sapiens
ugcacuccagccugggcaac

SEQ ID NO: 1444429 - RNA, 14 nt, Homo sapiens
ugcacugacaagau

SEQ ID NO: 1444430 - RNA, 17 nt, Homo sapiens
ugcacugacaagaugga

SEQ ID NO: 1444431 - RNA, 15 nt, Homo sapiens
ugcacugagggccac

SEQ ID NO: 1444432 - RNA, 10 nt, Homo sapiens
ugcacuuugu

SEQ ID NO: 1444433 - RNA, 17 nt, Homo sapiens
ugcacuuuuaaaccucu

SEQ ID NO: 1444434 - RNA, 18 nt, Homo sapiens
ugcagaagcaguguuucu

SEQ ID NO: 1444435 - RNA, 12 nt, Homo sapiens
ugcagagcaaug

SEQ ID NO: 1444436 - RNA, 18 nt, Homo sapiens
ugcagccacugugcugaa

SEQ ID NO: 1444437 - RNA, 21 nt, Homo sapiens
ugcagccccagcugacaccug

SEQ ID NO: 1444438 - RNA, 15 nt, Homo sapiens
ugcagcuuccuguca

SEQ ID NO: 1444439 - RNA, 22 nt, Homo sapiens
ugcaguauuuuauuaaagcaac

SEQ ID NO: 1444440 - RNA, 22 nt, Homo sapiens
ugcagucucagagacuauuuag

SEQ ID NO: 1444441 - RNA, 16 nt, Homo sapiens
ugcagucuuggcucac

SEQ ID NO: 1444442 - RNA, 14 nt, Homo sapiens
ugcaguugauucug

SEQ ID NO: 1444443 - RNA, 14 nt, Homo sapiens
ugcauaagauuaaa

SEQ ID NO: 1444444 - RNA, 21 nt, Homo sapiens
ugcaucaagggcuuuaucaaa

SEQ ID NO: 1444445 - RNA, 14 nt, Homo sapiens
ugcaucccccagca

SEQ ID NO: 1444446 - RNA, 18 nt, Homo sapiens
ugcaucccccagcacuga

SEQ ID NO: 1444447 - RNA, 22 nt, Homo sapiens
ugcaugauuuuauacauaguca

SEQ ID NO: 1444448 - RNA, 13 nt, Homo sapiens
ugcauguaugugc

SEQ ID NO: 1444449 - RNA, 14 nt, Homo sapiens
ugcauuguauuuag

SEQ ID NO: 1444450 - RNA, 14 nt, Homo sapiens
ugcauuugugucau

SEQ ID NO: 1444451 - RNA, 19 nt, Homo sapiens
ugcauuuucccagauacuu

SEQ ID NO: 1444452 - RNA, 13 nt, Homo sapiens
ugccaacauaccc

SEQ ID NO: 1444453 - RNA, 16 nt, Homo sapiens
ugccaagaaaguauuu

SEQ ID NO: 1444454 - RNA, 23 nt, Homo sapiens
ugccaagcccucaauaagccagc

SEQ ID NO: 1444455 - RNA, 12 nt, Homo sapiens
ugccacaaugcc

SEQ ID NO: 1444456 - RNA, 17 nt, Homo sapiens
ugccacucccugagcuu

SEQ ID NO: 1444457 - RNA, 14 nt, Homo sapiens
ugccacugccucuu

SEQ ID NO: 1444458 - RNA, 20 nt, Homo sapiens
ugccagagcccaagugccau

SEQ ID NO: 1444459 - RNA, 12 nt, Homo sapiens
ugccagcuuuau

SEQ ID NO: 1444460 - RNA, 22 nt, Homo sapiens
ugccaggaccagucccagagca

SEQ ID NO: 1444461 - RNA, 21 nt, Homo sapiens
ugccaggcguuggugccacuu

SEQ ID NO: 1444462 - RNA, 20 nt, Homo sapiens
ugccaggcuguaagcauucu

SEQ ID NO: 1444463 - RNA, 22 nt, Homo sapiens
ugccagugccuuaccuccugcc

SEQ ID NO: 1444464 - RNA, 19 nt, Homo sapiens
ugccauaccgcuggggaac

SEQ ID NO: 1444465 - RNA, 14 nt, Homo sapiens
ugccauagcaagau

SEQ ID NO: 1444466 - RNA, 23 nt, Homo sapiens
ugccaucaagaugagagaacugg

SEQ ID NO: 1444467 - RNA, 12 nt, Homo sapiens
ugccaugaucug

SEQ ID NO: 1444468 - RNA, 15 nt, Homo sapiens
ugccaugcccagaga

SEQ ID NO: 1444469 - RNA, 13 nt, Homo sapiens
ugccaugccucaa

SEQ ID NO: 1444470 - RNA, 17 nt, Homo sapiens
ugccaugucuuguucag

SEQ ID NO: 1444471 - RNA, 15 nt, Homo sapiens
ugcccaccacagcga

SEQ ID NO: 1444472 - RNA, 20 nt, Homo sapiens
ugcccaggcuggagugcagu

SEQ ID NO: 1444473 - RNA, 22 nt, Homo sapiens
ugccccagcuuuaucugucaca

SEQ ID NO: 1444474 - RNA, 14 nt, Homo sapiens
ugcccccaucuuuc

SEQ ID NO: 1444475 - RNA, 21 nt, Homo sapiens
ugccccucgcucgguccggcu

SEQ ID NO: 1444476 - RNA, 16 nt, Homo sapiens
ugccccuggccuuuga

SEQ ID NO: 1444477 - RNA, 12 nt, Homo sapiens
ugcccuaauuag

SEQ ID NO: 1444478 - RNA, 21 nt, Homo sapiens
ugcccuagcgcucucuuccag

SEQ ID NO: 1444479 - RNA, 20 nt, Homo sapiens
ugcccuaucauuuauuuaca

SEQ ID NO: 1444480 - RNA, 20 nt, Homo sapiens
ugcccucauuuguggcccaa

SEQ ID NO: 1444481 - RNA, 22 nt, Homo sapiens
ugcccucccauguugcaugccu

SEQ ID NO: 1444482 - RNA, 18 nt, Homo sapiens
ugcccugccccucuggcc

SEQ ID NO: 1444483 - RNA, 24 nt, Homo sapiens
ugcccuggagggaggcucuucagu

SEQ ID NO: 1444484 - RNA, 18 nt, Homo sapiens
ugcccugugagggcucac

SEQ ID NO: 1444485 - RNA, 20 nt, Homo sapiens
ugcccugugagggcucacuc

SEQ ID NO: 1444486 - RNA, 13 nt, Homo sapiens
ugccggacacaga

SEQ ID NO: 1444487 - RNA, 16 nt, Homo sapiens
ugccuaauuccuggca

SEQ ID NO: 1444488 - RNA, 12 nt, Homo sapiens
ugccuaccccag

SEQ ID NO: 1444489 - RNA, 13 nt, Homo sapiens
ugccuaccccagc

SEQ ID NO: 1444490 - RNA, 17 nt, Homo sapiens
ugccucaaugugaccag

SEQ ID NO: 1444491 - RNA, 13 nt, Homo sapiens
ugccuccaaaaau

SEQ ID NO: 1444492 - RNA, 18 nt, Homo sapiens
ugccucccuuucugggag

SEQ ID NO: 1444493 - RNA, 15 nt, Homo sapiens
ugccuccugggacca

SEQ ID NO: 1444494 - RNA, 17 nt, Homo sapiens
ugccucuccagcacuuc

SEQ ID NO: 1444495 - RNA, 17 nt, Homo sapiens
ugccucugaaaugccuc

SEQ ID NO: 1444496 - RNA, 21 nt, Homo sapiens
ugccucugccaugcccagaga

SEQ ID NO: 1444497 - RNA, 16 nt, Homo sapiens
ugccugaggcucaaga

SEQ ID NO: 1444498 - RNA, 22 nt, Homo sapiens
ugccugugcacggccagcugca

SEQ ID NO: 1444499 - RNA, 21 nt, Homo sapiens
ugccugugcaugaccugauca

SEQ ID NO: 1444500 - RNA, 20 nt, Homo sapiens
ugccuguucccauucuugca

SEQ ID NO: 1444501 - RNA, 16 nt, Homo sapiens
ugccuuugaccaucuc

SEQ ID NO: 1444502 - RNA, 18 nt, Homo sapiens
ugccuuuugcaaacuuua

SEQ ID NO: 1444503 - RNA, 21 nt, Homo sapiens
ugcgacgcagguguaccuccc

SEQ ID NO: 1444504 - RNA, 20 nt, Homo sapiens
ugcggaaaugugucuugucu

SEQ ID NO: 1444505 - RNA, 23 nt, Homo sapiens
ugcggcaggagcaggaacagaga

SEQ ID NO: 1444506 - RNA, 18 nt, Homo sapiens
ugcgggcaccuacaaggu

SEQ ID NO: 1444507 - RNA, 22 nt, Homo sapiens
ugcgucagaccaguacugggaa

SEQ ID NO: 1444508 - RNA, 15 nt, Homo sapiens
ugcgucgaagcuuug

SEQ ID NO: 1444509 - RNA, 22 nt, Homo sapiens
ugagaaacuuugaucucugcuu

SEQ ID NO: 1444510 - RNA, 12 nt, Homo sapiens
ugagaaccugug

SEQ ID NO: 1444511 - RNA, 16 nt, Homo sapiens
ugagaccgaaucucac

SEQ ID NO: 1444512 - RNA, 17 nt, Homo sapiens
ugagacggagucuugcu

SEQ ID NO: 1444513 - RNA, 22 nt, Homo sapiens
ugagacuauaaagcaguagaca

SEQ ID NO: 1444514 - RNA, 17 nt, Homo sapiens
ugagaggguuugaguca

SEQ ID NO: 1444515 - RNA, 22 nt, Homo sapiens
ugagaguaucaggucucccacg

SEQ ID NO: 1444516 - RNA, 15 nt, Homo sapiens
ugagauccuuuaaau

SEQ ID NO: 1444517 - RNA, 14 nt, Homo sapiens
ugagauguguucag

SEQ ID NO: 1444518 - RNA, 22 nt, Homo sapiens
ugagccagccuugcaguaggca

SEQ ID NO: 1444519 - RNA, 13 nt, Homo sapiens
ugagccugagaug

SEQ ID NO: 1444520 - RNA, 14 nt, Homo sapiens
ugagccugauuauc

SEQ ID NO: 1444521 - RNA, 21 nt, Homo sapiens
ugagccuggcccauagaaaca

SEQ ID NO: 1444522 - RNA, 15 nt, Homo sapiens
ugagcgcugaugauu

SEQ ID NO: 1444523 - RNA, 13 nt, Homo sapiens
ugagcucaggcau

SEQ ID NO: 1444524 - RNA, 17 nt, Homo sapiens
ugagcucaggcauuuga

SEQ ID NO: 1444525 - RNA, 17 nt, Homo sapiens
ugagcucccccuuccca

SEQ ID NO: 1444526 - RNA, 18 nt, Homo sapiens
ugaggaaagcacacaguc

SEQ ID NO: 1444527 - RNA, 20 nt, Homo sapiens
ugaggaagccuaaauaaaaa

SEQ ID NO: 1444528 - RNA, 13 nt, Homo sapiens
ugaggacauggag

SEQ ID NO: 1444529 - RNA, 23 nt, Homo sapiens
ugaggacuuaaaauauuccugca

SEQ ID NO: 1444530 - RNA, 22 nt, Homo sapiens
ugaggagcugacauagggguaa

SEQ ID NO: 1444531 - RNA, 12 nt, Homo sapiens
ugaggauuucaa

SEQ ID NO: 1444532 - RNA, 13 nt, Homo sapiens
ugaggauuucaag

SEQ ID NO: 1444533 - RNA, 17 nt, Homo sapiens
ugaggcggauggcugug

SEQ ID NO: 1444534 - RNA, 18 nt, Homo sapiens
ugagggaaauugcuauuu

SEQ ID NO: 1444535 - RNA, 16 nt, Homo sapiens
ugagggaagacgccuu

SEQ ID NO: 1444536 - RNA, 20 nt, Homo sapiens
ugagggacuggaaccaggga

SEQ ID NO: 1444537 - RNA, 12 nt, Homo sapiens
ugagggcucacu

SEQ ID NO: 1444538 - RNA, 19 nt, Homo sapiens
ugagguggugccuucucac

SEQ ID NO: 1444539 - RNA, 13 nt, Homo sapiens
ugaguaaaaucua

SEQ ID NO: 1444540 - RNA, 17 nt, Homo sapiens
ugagucagacauuuggu

SEQ ID NO: 1444541 - RNA, 15 nt, Homo sapiens
ugagucuccugugcc

SEQ ID NO: 1444542 - RNA, 22 nt, Homo sapiens
ugagucuuccagagccuaagaa

SEQ ID NO: 1444543 - RNA, 21 nt, Homo sapiens
ugagucuuggccugccuccca

SEQ ID NO: 1444544 - RNA, 22 nt, Homo sapiens
ugagugaccccagccuccugcc

SEQ ID NO: 1444545 - RNA, 21 nt, Homo sapiens
ugagugagaggguuugaguca

SEQ ID NO: 1444546 - RNA, 16 nt, Homo sapiens
ugagugcuccugugug

SEQ ID NO: 1444547 - RNA, 23 nt, Homo sapiens
ugaguggcuugugauucugggau

SEQ ID NO: 1444548 - RNA, 15 nt, Homo sapiens
ugagugugacuaugu

SEQ ID NO: 1444549 - RNA, 19 nt, Homo sapiens
ugaguugggaaaaacugac

SEQ ID NO: 1444550 - RNA, 14 nt, Homo sapiens
ugauaaacauuaaa

SEQ ID NO: 1444551 - RNA, 13 nt, Homo sapiens
ugauaagcaaauu

SEQ ID NO: 1444552 - RNA, 23 nt, Homo sapiens
ugauaauaaauuagguaagauaa

SEQ ID NO: 1444553 - RNA, 20 nt, Homo sapiens
ugauaaucugggcaucucgu

SEQ ID NO: 1444554 - RNA, 14 nt, Homo sapiens
ugauauaugcaugu

SEQ ID NO: 1444555 - RNA, 18 nt, Homo sapiens
ugauauuauggcaaguga

SEQ ID NO: 1444556 - RNA, 19 nt, Homo sapiens
ugauauuauggcaagugau

SEQ ID NO: 1444557 - RNA, 21 nt, Homo sapiens
ugauauuauggcaagugauau

SEQ ID NO: 1444558 - RNA, 16 nt, Homo sapiens
ugaucaaauauuucaa

SEQ ID NO: 1444559 - RNA, 11 nt, Homo sapiens
ugaucaaguca

SEQ ID NO: 1444560 - RNA, 15 nt, Homo sapiens
ugaucacacucuggg

SEQ ID NO: 1444561 - RNA, 17 nt, Homo sapiens
ugaucauuacauggcug

SEQ ID NO: 1444562 - RNA, 17 nt, Homo sapiens
ugaucuaucaauaguca

SEQ ID NO: 1444563 - RNA, 16 nt, Homo sapiens
ugaucuuggcacaaau

SEQ ID NO: 1444564 - RNA, 19 nt, Homo sapiens
ugaugaaaaauaugugcuu

SEQ ID NO: 1444565 - RNA, 16 nt, Homo sapiens
ugauggccaggccaga

SEQ ID NO: 1444566 - RNA, 11 nt, Homo sapiens
ugauguugcug

SEQ ID NO: 1444567 - RNA, 17 nt, Homo sapiens
ugauuaaacagacuuua

SEQ ID NO: 1444568 - RNA, 13 nt, Homo sapiens
ugauuaacuugcu

SEQ ID NO: 1444569 - RNA, 21 nt, Homo sapiens
ugauuagaaggcaaguuucua

SEQ ID NO: 1444570 - RNA, 14 nt, Homo sapiens
ugauuaugccacug

SEQ ID NO: 1444571 - RNA, 13 nt, Homo sapiens
ugauucacaauga

SEQ ID NO: 1444572 - RNA, 19 nt, Homo sapiens
ugauuuggaagagaggcac

SEQ ID NO: 1444573 - RNA, 22 nt, Homo sapiens
ugcaaacccugguugcuguauu

SEQ ID NO: 1444574 - RNA, 17 nt, Homo sapiens
ugcaaauggaagacaaa

SEQ ID NO: 1444575 - RNA, 19 nt, Homo sapiens
ugcaaauuuugcauuuagu

SEQ ID NO: 1444576 - RNA, 19 nt, Homo sapiens
ugcaagacaaaguugaaug

SEQ ID NO: 1444577 - RNA, 19 nt, Homo sapiens
ugcaagauuucacaucagc

SEQ ID NO: 1444578 - RNA, 19 nt, Homo sapiens
ugcaaggcuaagaaguacu

SEQ ID NO: 1444579 - RNA, 17 nt, Homo sapiens
ugcaaguggaugcauuc

SEQ ID NO: 1444580 - RNA, 18 nt, Homo sapiens
ugcaauaaaauaguauug

SEQ ID NO: 1444581 - RNA, 18 nt, Homo sapiens
ugcaauaaauuauggcuc

SEQ ID NO: 1444582 - RNA, 15 nt, Homo sapiens
ugcaauaaugugcaa

SEQ ID NO: 1444583 - RNA, 16 nt, Homo sapiens
ugcaauacuaauugag

SEQ ID NO: 1444584 - RNA, 17 nt, Homo sapiens
ugcaauauuuacauuuu

SEQ ID NO: 1444585 - RNA, 16 nt, Homo sapiens
ugcacaaagcccuucc

SEQ ID NO: 1444586 - RNA, 18 nt, Homo sapiens
ugcacaaugggcaauucu

SEQ ID NO: 1444587 - RNA, 18 nt, Homo sapiens
ugcacacaaacaccuccu

SEQ ID NO: 1444588 - RNA, 21 nt, Homo sapiens
ugcacacacacagagauaugc

SEQ ID NO: 1444589 - RNA, 21 nt, Homo sapiens
ugcacacacacggaugcacac

SEQ ID NO: 1444590 - RNA, 15 nt, Homo sapiens
ugcacacacagaugc

SEQ ID NO: 1444591 - RNA, 23 nt, Homo sapiens
ugcacacgcacauagagauaugc

SEQ ID NO: 1444592 - RNA, 17 nt, Homo sapiens
ugcacagagauaugcac

SEQ ID NO: 1444593 - RNA, 20 nt, Homo sapiens
ugcacauccauucccaagaa

SEQ ID NO: 1444594 - RNA, 18 nt, Homo sapiens
uaauaaaaaucauggcaa

SEQ ID NO: 1444595 - RNA, 24 nt, Homo sapiens
uaauaaaggucuuugcacauguga

SEQ ID NO: 1444596 - RNA, 22 nt, Homo sapiens
uaauaccuuaguuuuuuccaca

SEQ ID NO: 1444597 - RNA, 14 nt, Homo sapiens
uaauacucaccucc

SEQ ID NO: 1444598 - RNA, 21 nt, Homo sapiens
uaauagacaguagccaaguua

SEQ ID NO: 1444599 - RNA, 16 nt, Homo sapiens
uaauagccauaugcaa

SEQ ID NO: 1444600 - RNA, 17 nt, Homo sapiens
uaauagccauaugcaau

SEQ ID NO: 1444601 - RNA, 19 nt, Homo sapiens
uaauagcuuuuauuguaua

SEQ ID NO: 1444602 - RNA, 14 nt, Homo sapiens
uaauaguccaauau

SEQ ID NO: 1444603 - RNA, 12 nt, Homo sapiens
uaauauacuuua

SEQ ID NO: 1444604 - RNA, 14 nt, Homo sapiens
uaauauaugcucaa

SEQ ID NO: 1444605 - RNA, 13 nt, Homo sapiens
uaauaugcuuuac

SEQ ID NO: 1444606 - RNA, 13 nt, Homo sapiens
uaauauggcaaaa

SEQ ID NO: 1444607 - RNA, 16 nt, Homo sapiens
uaauauuuuuagcucu

SEQ ID NO: 1444608 - RNA, 20 nt, Homo sapiens
uaauccagagauaauugcca

SEQ ID NO: 1444609 - RNA, 13 nt, Homo sapiens
uaaucuguagggc

SEQ ID NO: 1444610 - RNA, 14 nt, Homo sapiens
uaaugaacagcaga

SEQ ID NO: 1444611 - RNA, 11 nt, Homo sapiens
uaaugagggac

SEQ ID NO: 1444612 - RNA, 16 nt, Homo sapiens
uaaugguugacugggu

SEQ ID NO: 1444613 - RNA, 17 nt, Homo sapiens
uaauguaauaauagaaa

SEQ ID NO: 1444614 - RNA, 14 nt, Homo sapiens
uaauguaugcauuc

SEQ ID NO: 1444615 - RNA, 15 nt, Homo sapiens
uaauguaugcauuca

SEQ ID NO: 1444616 - RNA, 20 nt, Homo sapiens
uaauguuaauucagcacuga

SEQ ID NO: 1444617 - RNA, 13 nt, Homo sapiens
uaauguugcuuag

SEQ ID NO: 1444618 - RNA, 15 nt, Homo sapiens
uaauuaaacaugauc

SEQ ID NO: 1444619 - RNA, 19 nt, Homo sapiens
uaauuaaguaaaccaaaaa

SEQ ID NO: 1444620 - RNA, 17 nt, Homo sapiens
uaauuagaacaauagcu

SEQ ID NO: 1444621 - RNA, 23 nt, Homo sapiens
uaauuagaacaauagcuauugca

SEQ ID NO: 1444622 - RNA, 15 nt, Homo sapiens
uaauuaggaucuaug

SEQ ID NO: 1444623 - RNA, 17 nt, Homo sapiens
uaauuaguuaacaguuu

SEQ ID NO: 1444624 - RNA, 22 nt, Homo sapiens
uaauucggaagggaaaacaguc

SEQ ID NO: 1444625 - RNA, 18 nt, Homo sapiens
uaauucucaugugauccu

SEQ ID NO: 1444626 - RNA, 17 nt, Homo sapiens
uaauucugcuucuagua

SEQ ID NO: 1444627 - RNA, 13 nt, Homo sapiens
uaauugauuucaa

SEQ ID NO: 1444628 - RNA, 22 nt, Homo sapiens
uaauugauuugacccacucaca

SEQ ID NO: 1444629 - RNA, 16 nt, Homo sapiens
uaauugcuuacauuuu

SEQ ID NO: 1444630 - RNA, 21 nt, Homo sapiens
uaauugugugacuuuuucaga

SEQ ID NO: 1444631 - RNA, 21 nt, Homo sapiens
uaauuuauuuaauauacuuua

SEQ ID NO: 1444632 - RNA, 16 nt, Homo sapiens
uaauuuauuucaucca

SEQ ID NO: 1444633 - RNA, 15 nt, Homo sapiens
uacaaaaacacagca

SEQ ID NO: 1444634 - RNA, 13 nt, Homo sapiens
uacaaacaagcac

SEQ ID NO: 1444635 - RNA, 16 nt, Homo sapiens
uacaaacaagcacaga

SEQ ID NO: 1444636 - RNA, 20 nt, Homo sapiens
uacaaacaagcacagacauu

SEQ ID NO: 1444637 - RNA, 12 nt, Homo sapiens
uacaacauguag

SEQ ID NO: 1444638 - RNA, 11 nt, Homo sapiens
uacaaccagag

SEQ ID NO: 1444639 - RNA, 13 nt, Homo sapiens
uacaagcauuugc

SEQ ID NO: 1444640 - RNA, 17 nt, Homo sapiens
uacaaggcacuugucac

SEQ ID NO: 1444641 - RNA, 14 nt, Homo sapiens
uacaaucucaaauu

SEQ ID NO: 1444642 - RNA, 16 nt, Homo sapiens
uacaaucucaaauucu

SEQ ID NO: 1444643 - RNA, 18 nt, Homo sapiens
uacaaucucaaauucuca

SEQ ID NO: 1444644 - RNA, 20 nt, Homo sapiens
uacaaugacaaguaugauga

SEQ ID NO: 1444645 - RNA, 18 nt, Homo sapiens
uacacacacagaugcaca

SEQ ID NO: 1444646 - RNA, 13 nt, Homo sapiens
uacacacauauac

SEQ ID NO: 1444647 - RNA, 19 nt, Homo sapiens
uacacacauauacauauau

SEQ ID NO: 1444648 - RNA, 20 nt, Homo sapiens
uacacagugggaacucugac

SEQ ID NO: 1444649 - RNA, 15 nt, Homo sapiens
uacacauauaccuau

SEQ ID NO: 1444650 - RNA, 20 nt, Homo sapiens
uacacauggaugcacgcaca

SEQ ID NO: 1444651 - RNA, 13 nt, Homo sapiens
ugaaagugcaaag

SEQ ID NO: 1444652 - RNA, 18 nt, Homo sapiens
ugaaauaccagugaacca

SEQ ID NO: 1444653 - RNA, 20 nt, Homo sapiens
ugaaaucgccguguuacugu

SEQ ID NO: 1444654 - RNA, 15 nt, Homo sapiens
ugaaaucucagaauu

SEQ ID NO: 1444655 - RNA, 19 nt, Homo sapiens
ugaaaugcuuguugaauca

SEQ ID NO: 1444656 - RNA, 21 nt, Homo sapiens
ugaaauuuucuagacuuucug

SEQ ID NO: 1444657 - RNA, 15 nt, Homo sapiens
ugaacacacauggau

SEQ ID NO: 1444658 - RNA, 21 nt, Homo sapiens
ugaacacacauggaugcacac

SEQ ID NO: 1444659 - RNA, 19 nt, Homo sapiens
ugaacaccacuuugucucu

SEQ ID NO: 1444660 - RNA, 23 nt, Homo sapiens
ugaacaccacuuugucucugaga

SEQ ID NO: 1444661 - RNA, 20 nt, Homo sapiens
ugaacaccuccuagccacau

SEQ ID NO: 1444662 - RNA, 12 nt, Homo sapiens
ugaacauuugcu

SEQ ID NO: 1444663 - RNA, 18 nt, Homo sapiens
ugaacgccaaacuaaagu

SEQ ID NO: 1444664 - RNA, 21 nt, Homo sapiens
ugaacuaaguuuuuuacuucc

SEQ ID NO: 1444665 - RNA, 21 nt, Homo sapiens
ugaacuauuucuacacagugg

SEQ ID NO: 1444666 - RNA, 21 nt, Homo sapiens
ugaacuuggaaagaaaugccc

SEQ ID NO: 1444667 - RNA, 17 nt, Homo sapiens
ugaacuuucacauagca

SEQ ID NO: 1444668 - RNA, 18 nt, Homo sapiens
ugaacuuucacauagcac

SEQ ID NO: 1444669 - RNA, 15 nt, Homo sapiens
ugaagaaaacuccuu

SEQ ID NO: 1444670 - RNA, 21 nt, Homo sapiens
ugaagaaaagugaaugcucaa

SEQ ID NO: 1444671 - RNA, 18 nt, Homo sapiens
ugaagaacaguaacugcc

SEQ ID NO: 1444672 - RNA, 22 nt, Homo sapiens
ugaagaacaucccaagccagaa

SEQ ID NO: 1444673 - RNA, 13 nt, Homo sapiens
ugaagacccagug

SEQ ID NO: 1444674 - RNA, 17 nt, Homo sapiens
ugaagacggauuacuaa

SEQ ID NO: 1444675 - RNA, 19 nt, Homo sapiens
ugaagagugagagggcaug

SEQ ID NO: 1444676 - RNA, 18 nt, Homo sapiens
ugaagcaaccuacuuuug

SEQ ID NO: 1444677 - RNA, 16 nt, Homo sapiens
ugaaggagaaggugcc

SEQ ID NO: 1444678 - RNA, 23 nt, Homo sapiens
ugaaggaggugagggaugugaau

SEQ ID NO: 1444679 - RNA, 19 nt, Homo sapiens
ugaaggaguccuugcauca

SEQ ID NO: 1444680 - RNA, 18 nt, Homo sapiens
ugaagguaacugagagca

SEQ ID NO: 1444681 - RNA, 16 nt, Homo sapiens
ugaaggucacucuucc

SEQ ID NO: 1444682 - RNA, 20 nt, Homo sapiens
ugaaguaaaggauugaucac

SEQ ID NO: 1444683 - RNA, 13 nt, Homo sapiens
ugaaguaaccuua

SEQ ID NO: 1444684 - RNA, 17 nt, Homo sapiens
ugaaguggccagaugag

SEQ ID NO: 1444685 - RNA, 18 nt, Homo sapiens
ugaaguugcaaugcuuca

SEQ ID NO: 1444686 - RNA, 17 nt, Homo sapiens
ugaauaaaaacccugua

SEQ ID NO: 1444687 - RNA, 20 nt, Homo sapiens
ugaauagcgaaucaucucaa

SEQ ID NO: 1444688 - RNA, 15 nt, Homo sapiens
ugaauauauggucug

SEQ ID NO: 1444689 - RNA, 12 nt, Homo sapiens
ugaauaucgaga

SEQ ID NO: 1444690 - RNA, 20 nt, Homo sapiens
ugaauaucgagaacugccau

SEQ ID NO: 1444691 - RNA, 14 nt, Homo sapiens
ugaauaugacaaag

SEQ ID NO: 1444692 - RNA, 20 nt, Homo sapiens
ugaaucaggggcaaacggag

SEQ ID NO: 1444693 - RNA, 17 nt, Homo sapiens
ugaaucuguuacugaaa

SEQ ID NO: 1444694 - RNA, 19 nt, Homo sapiens
ugaaugugccuaauggaga

SEQ ID NO: 1444695 - RNA, 23 nt, Homo sapiens
ugacaaauucuuuuucacacuga

SEQ ID NO: 1444696 - RNA, 18 nt, Homo sapiens
ugacaagcaagggcugug

SEQ ID NO: 1444697 - RNA, 21 nt, Homo sapiens
ugacaagcaagggcugugcug

SEQ ID NO: 1444698 - RNA, 14 nt, Homo sapiens
ugacaagcacugcu

SEQ ID NO: 1444699 - RNA, 15 nt, Homo sapiens
ugacaauaauuucag

SEQ ID NO: 1444700 - RNA, 15 nt, Homo sapiens
ugacaauggcagcua

SEQ ID NO: 1444701 - RNA, 14 nt, Homo sapiens
ugacacacagcagc

SEQ ID NO: 1444702 - RNA, 20 nt, Homo sapiens
ugacacacagcagcacugca

SEQ ID NO: 1444703 - RNA, 21 nt, Homo sapiens
ugacaccgaguuccaccccau

SEQ ID NO: 1444704 - RNA, 22 nt, Homo sapiens
ugacagauacauagauggacca

SEQ ID NO: 1444705 - RNA, 14 nt, Homo sapiens
ugacagcacuacaa

SEQ ID NO: 1444706 - RNA, 15 nt, Homo sapiens
ugacagcacuacaaa

SEQ ID NO: 1444707 - RNA, 16 nt, Homo sapiens
ugacagggaugccaac

SEQ ID NO: 1444708 - RNA, 19 nt, Homo sapiens
ugacagguucccagcagcu

SEQ ID NO: 1444709 - RNA, 12 nt, Homo sapiens
ugacagugaauu

SEQ ID NO: 1444710 - RNA, 18 nt, Homo sapiens
ugacauauauauguauau

SEQ ID NO: 1444711 - RNA, 14 nt, Homo sapiens
ugacaugcacugac

SEQ ID NO: 1444712 - RNA, 10 nt, Homo sapiens
ugaccaaaua

SEQ ID NO: 1444713 - RNA, 19 nt, Homo sapiens
ugaccaaauaaaguaccau

SEQ ID NO: 1444714 - RNA, 22 nt, Homo sapiens
ugaccauaaaggcauggcauuu

SEQ ID NO: 1444715 - RNA, 16 nt, Homo sapiens
ugaccauuucaggggu

SEQ ID NO: 1444716 - RNA, 12 nt, Homo sapiens
ugacccaaagac

SEQ ID NO: 1444717 - RNA, 23 nt, Homo sapiens
ugacccaagagguggggaccaaa

SEQ ID NO: 1444718 - RNA, 17 nt, Homo sapiens
uaaacugaaaaauguca

SEQ ID NO: 1444719 - RNA, 18 nt, Homo sapiens
uaaacugaaaaaugucag

SEQ ID NO: 1444720 - RNA, 21 nt, Homo sapiens
uaaacuguaucaaaucuguau

SEQ ID NO: 1444721 - RNA, 15 nt, Homo sapiens
uaaacuuguguauga

SEQ ID NO: 1444722 - RNA, 17 nt, Homo sapiens
uaaagaauaaaugaauc

SEQ ID NO: 1444723 - RNA, 19 nt, Homo sapiens
uaaagaauaaaugaaucuu

SEQ ID NO: 1444724 - RNA, 22 nt, Homo sapiens
uaaagaauaaaugaaucuuacu

SEQ ID NO: 1444725 - RNA, 23 nt, Homo sapiens
uaaagaaugcuggguguugcauu

SEQ ID NO: 1444726 - RNA, 21 nt, Homo sapiens
uaaagacagggaagagcagaa

SEQ ID NO: 1444727 - RNA, 16 nt, Homo sapiens
uaaagauaaaauaucc

SEQ ID NO: 1444728 - RNA, 18 nt, Homo sapiens
uaaagaugaucuacucag

SEQ ID NO: 1444729 - RNA, 13 nt, Homo sapiens
uaaagcccuugaa

SEQ ID NO: 1444730 - RNA, 22 nt, Homo sapiens
uaaagcugccggcacagaacuu

SEQ ID NO: 1444731 - RNA, 16 nt, Homo sapiens
uaaaggcccacuggca

SEQ ID NO: 1444732 - RNA, 17 nt, Homo sapiens
uaaagguagagaugugu

SEQ ID NO: 1444733 - RNA, 16 nt, Homo sapiens
uaaagucaacaaccau

SEQ ID NO: 1444734 - RNA, 18 nt, Homo sapiens
uaaauaaaguaucaugca

SEQ ID NO: 1444735 - RNA, 12 nt, Homo sapiens
uaaauacuguac

SEQ ID NO: 1444736 - RNA, 15 nt, Homo sapiens
uaaauagcauucucu

SEQ ID NO: 1444737 - RNA, 23 nt, Homo sapiens
uaaauauucccugacgacacuga

SEQ ID NO: 1444738 - RNA, 12 nt, Homo sapiens
uaaaucuaauca

SEQ ID NO: 1444739 - RNA, 13 nt, Homo sapiens
uaaaugaccaaga

SEQ ID NO: 1444740 - RNA, 12 nt, Homo sapiens
uaaaugcauuag

SEQ ID NO: 1444741 - RNA, 16 nt, Homo sapiens
uaaaugccaacauacc

SEQ ID NO: 1444742 - RNA, 17 nt, Homo sapiens
uaaaugccaacugguca

SEQ ID NO: 1444743 - RNA, 21 nt, Homo sapiens
uaaaugcugucaacuaugaua

SEQ ID NO: 1444744 - RNA, 18 nt, Homo sapiens
uaaauggcuggggggcca

SEQ ID NO: 1444745 - RNA, 13 nt, Homo sapiens
uaaauguauauac

SEQ ID NO: 1444746 - RNA, 14 nt, Homo sapiens
uaaaugugcuuaug

SEQ ID NO: 1444747 - RNA, 16 nt, Homo sapiens
uaaauguguaaaugug

SEQ ID NO: 1444748 - RNA, 19 nt, Homo sapiens
uaaauuauggcucuucacc

SEQ ID NO: 1444749 - RNA, 23 nt, Homo sapiens
uaaauucacauaggcaauaucuu

SEQ ID NO: 1444750 - RNA, 20 nt, Homo sapiens
uaaauugaaauauaaugcaa

SEQ ID NO: 1444751 - RNA, 23 nt, Homo sapiens
uaaauugcuuuuguugugacuuu

SEQ ID NO: 1444752 - RNA, 20 nt, Homo sapiens
uaaauuggugauaaguggaa

SEQ ID NO: 1444753 - RNA, 13 nt, Homo sapiens
uaaauuuauuuca

SEQ ID NO: 1444754 - RNA, 15 nt, Homo sapiens
uaaauuucaucucag

SEQ ID NO: 1444755 - RNA, 15 nt, Homo sapiens
uaacaaaacaagaaa

SEQ ID NO: 1444756 - RNA, 14 nt, Homo sapiens
uaacacaagccaca

SEQ ID NO: 1444757 - RNA, 17 nt, Homo sapiens
uaacacaagccacagaa

SEQ ID NO: 1444758 - RNA, 19 nt, Homo sapiens
uaacacaaguccugugaau

SEQ ID NO: 1444759 - RNA, 12 nt, Homo sapiens
uaacacaccaca

SEQ ID NO: 1444760 - RNA, 18 nt, Homo sapiens
uaacacucagaagccugg

SEQ ID NO: 1444761 - RNA, 15 nt, Homo sapiens
uaacagaacagucac

SEQ ID NO: 1444762 - RNA, 16 nt, Homo sapiens
uaacauauuugcacaa

SEQ ID NO: 1444763 - RNA, 22 nt, Homo sapiens
uaacaugaaaaacacggcagcu

SEQ ID NO: 1444764 - RNA, 12 nt, Homo sapiens
uaacaugcuuua

SEQ ID NO: 1444765 - RNA, 20 nt, Homo sapiens
uaaccccaacgcacaggaaa

SEQ ID NO: 1444766 - RNA, 13 nt, Homo sapiens
uaaccucaucuac

SEQ ID NO: 1444767 - RNA, 20 nt, Homo sapiens
uaacuccagucuccugacau

SEQ ID NO: 1444768 - RNA, 21 nt, Homo sapiens
uaacugaaggagaaggugccc

SEQ ID NO: 1444769 - RNA, 12 nt, Homo sapiens
uaacugcaauuu

SEQ ID NO: 1444770 - RNA, 22 nt, Homo sapiens
uaacuguagauaaagugguuug

SEQ ID NO: 1444771 - RNA, 21 nt, Homo sapiens
uaacuguggcuaauucacaua

SEQ ID NO: 1444772 - RNA, 21 nt, Homo sapiens
uaacuuaaauuuuaagcuuga

SEQ ID NO: 1444773 - RNA, 13 nt, Homo sapiens
uaacuuauaucau

SEQ ID NO: 1444774 - RNA, 16 nt, Homo sapiens
cuccggccugaugaca

SEQ ID NO: 1444775 - RNA, 15 nt, Homo sapiens
cuccuaaaacaugaa

SEQ ID NO: 1444776 - RNA, 22 nt, Homo sapiens
cuccucuguccaggcacugcug

SEQ ID NO: 1444777 - RNA, 16 nt, Homo sapiens
cuccugacaugucuca

SEQ ID NO: 1444778 - RNA, 15 nt, Homo sapiens
cuccugcccaggaga

SEQ ID NO: 1444779 - RNA, 19 nt, Homo sapiens
cuccugugaccccaccuug

SEQ ID NO: 1444780 - RNA, 14 nt, Homo sapiens
cuccugugcaacuu

SEQ ID NO: 1444781 - RNA, 21 nt, Homo sapiens
cuccuguguggacguugccug

SEQ ID NO: 1444782 - RNA, 15 nt, Homo sapiens
cuccuuccugugauu

SEQ ID NO: 1444783 - RNA, 13 nt, Homo sapiens
cuccuugcacuuu

SEQ ID NO: 1444784 - RNA, 14 nt, Homo sapiens
cuccuugcacuuuc

SEQ ID NO: 1444785 - RNA, 19 nt, Homo sapiens
cuccuuucuuucuaacucc

SEQ ID NO: 1444786 - RNA, 14 nt, Homo sapiens
cuccuuugcacuga

SEQ ID NO: 1444787 - RNA, 14 nt, Homo sapiens
cuccuuuugaccaa

SEQ ID NO: 1444788 - RNA, 23 nt, Homo sapiens
cuccuuuugcuugaaaccaaaga

SEQ ID NO: 1444789 - RNA, 16 nt, Homo sapiens
cucgaccucccaaagu

SEQ ID NO: 1444790 - RNA, 12 nt, Homo sapiens
cucgccuaggcc

SEQ ID NO: 1444791 - RNA, 17 nt, Homo sapiens
cucgccuaggccuguga

SEQ ID NO: 1444792 - RNA, 12 nt, Homo sapiens
cucguaccagcc

SEQ ID NO: 1444793 - RNA, 14 nt, Homo sapiens
cucguccacagggg

SEQ ID NO: 1444794 - RNA, 19 nt, Homo sapiens
cucuaagccacucuuccaa

SEQ ID NO: 1444795 - RNA, 16 nt, Homo sapiens
cucuaccgggcgaguc

SEQ ID NO: 1444796 - RNA, 14 nt, Homo sapiens
cucuacgccaaagu

SEQ ID NO: 1444797 - RNA, 14 nt, Homo sapiens
cucuacugccuugg

SEQ ID NO: 1444798 - RNA, 20 nt, Homo sapiens
cucuagccugggccagagaa

SEQ ID NO: 1444799 - RNA, 20 nt, Homo sapiens
cucuagugacuuccugguga

SEQ ID NO: 1444800 - RNA, 18 nt, Homo sapiens
cucuauguaugcaucuau

SEQ ID NO: 1444801 - RNA, 22 nt, Homo sapiens
cucuccauaucuccuuccccua

SEQ ID NO: 1444802 - RNA, 20 nt, Homo sapiens
cucucccaccccggccucca

SEQ ID NO: 1444803 - RNA, 20 nt, Homo sapiens
cucucccaugcacacaaaca

SEQ ID NO: 1444804 - RNA, 16 nt, Homo sapiens
cucuccuuuggccauu

SEQ ID NO: 1444805 - RNA, 16 nt, Homo sapiens
cucucuaaacccaaau

SEQ ID NO: 1444806 - RNA, 20 nt, Homo sapiens
cucucuacccggcccagaga

SEQ ID NO: 1444807 - RNA, 12 nt, Homo sapiens
cucucucagguc

SEQ ID NO: 1444808 - RNA, 14 nt, Homo sapiens
cucucuccugucca

SEQ ID NO: 1444809 - RNA, 17 nt, Homo sapiens
cucucugagaugccccu

SEQ ID NO: 1444810 - RNA, 21 nt, Homo sapiens
cucugacaagggcugaccugc

SEQ ID NO: 1444811 - RNA, 14 nt, Homo sapiens
cucugacuggaguc

SEQ ID NO: 1444812 - RNA, 18 nt, Homo sapiens
cucugcacuccauggcca

SEQ ID NO: 1444813 - RNA, 14 nt, Homo sapiens
cucugcagcacuuu

SEQ ID NO: 1444814 - RNA, 20 nt, Homo sapiens
cucugcauuaucugagguca

SEQ ID NO: 1444815 - RNA, 13 nt, Homo sapiens
cucugcuccagag

SEQ ID NO: 1444816 - RNA, 22 nt, Homo sapiens
cucugcuuuuuccagauucuuc

SEQ ID NO: 1444817 - RNA, 22 nt, Homo sapiens
cucuggaaaacucaggauucuc

SEQ ID NO: 1444818 - RNA, 16 nt, Homo sapiens
cucuggacaugauuua

SEQ ID NO: 1444819 - RNA, 13 nt, Homo sapiens
guuauucucuuca

SEQ ID NO: 1444820 - RNA, 13 nt, Homo sapiens
guuauucuugaca

SEQ ID NO: 1444821 - RNA, 19 nt, Homo sapiens
guuauugccucugaaaugc

SEQ ID NO: 1444822 - RNA, 21 nt, Homo sapiens
guuauuguaggcaaccuuccc

SEQ ID NO: 1444823 - RNA, 14 nt, Homo sapiens
guuauuuacuugaa

SEQ ID NO: 1444824 - RNA, 19 nt, Homo sapiens
guucaaauuuugcauugug

SEQ ID NO: 1444825 - RNA, 20 nt, Homo sapiens
guucaaguuauagauucaau

SEQ ID NO: 1444826 - RNA, 13 nt, Homo sapiens
guucaccuugccg

SEQ ID NO: 1444827 - RNA, 16 nt, Homo sapiens
guucagcuucagacuu

SEQ ID NO: 1444828 - RNA, 17 nt, Homo sapiens
guuccaugaagaccaca

SEQ ID NO: 1444829 - RNA, 13 nt, Homo sapiens
guuccauguuaaa

SEQ ID NO: 1444830 - RNA, 13 nt, Homo sapiens
guucccagcagcu

SEQ ID NO: 1444831 - RNA, 14 nt, Homo sapiens
guucccccagacag

SEQ ID NO: 1444832 - RNA, 16 nt, Homo sapiens
guuccuccaagagguc

SEQ ID NO: 1444833 - RNA, 16 nt, Homo sapiens
guucgagaccaaccug

SEQ ID NO: 1444834 - RNA, 17 nt, Homo sapiens
guucuauuuguauauau

SEQ ID NO: 1444835 - RNA, 14 nt, Homo sapiens
guucucacugucuc

SEQ ID NO: 1444836 - RNA, 21 nt, Homo sapiens
guucucacugucuccuggucu

SEQ ID NO: 1444837 - RNA, 20 nt, Homo sapiens
guucucuucuuuaaagggau

SEQ ID NO: 1444838 - RNA, 13 nt, Homo sapiens
guucuuagcugaa

SEQ ID NO: 1444839 - RNA, 21 nt, Homo sapiens
guucuuuaauguuguccagga

SEQ ID NO: 1444840 - RNA, 19 nt, Homo sapiens
guugaacacaauugauacu

SEQ ID NO: 1444841 - RNA, 16 nt, Homo sapiens
guugaagccacugccu

SEQ ID NO: 1444842 - RNA, 19 nt, Homo sapiens
guugagucgucaucacuuu

SEQ ID NO: 1444843 - RNA, 12 nt, Homo sapiens
guugaguucaag

SEQ ID NO: 1444844 - RNA, 15 nt, Homo sapiens
guugcacugaugucc

SEQ ID NO: 1444845 - RNA, 18 nt, Homo sapiens
guugcucaaaucuauuca

SEQ ID NO: 1444846 - RNA, 18 nt, Homo sapiens
guuggacccgcucuggac

SEQ ID NO: 1444847 - RNA, 16 nt, Homo sapiens
guuggagcuacugcaa

SEQ ID NO: 1444848 - RNA, 16 nt, Homo sapiens
guuguggaugcuccag

SEQ ID NO: 1444849 - RNA, 24 nt, Homo sapiens
guuguuuucagacucagacuccau

SEQ ID NO: 1444850 - RNA, 14 nt, Homo sapiens
guuuacagacugug

SEQ ID NO: 1444851 - RNA, 19 nt, Homo sapiens
guuuaccucuucuaugcaa

SEQ ID NO: 1444852 - RNA, 12 nt, Homo sapiens
guuuagauauau

SEQ ID NO: 1444853 - RNA, 18 nt, Homo sapiens
guuuaguauuaugucuua

SEQ ID NO: 1444854 - RNA, 15 nt, Homo sapiens
guuuaugucaucaua

SEQ ID NO: 1444855 - RNA, 20 nt, Homo sapiens
guuuaugucaucauacauga

SEQ ID NO: 1444856 - RNA, 14 nt, Homo sapiens
guuucaccauacuu

SEQ ID NO: 1444857 - RNA, 20 nt, Homo sapiens
guuucagaauuuuguauauu

SEQ ID NO: 1444858 - RNA, 16 nt, Homo sapiens
guuucaggacaugggg

SEQ ID NO: 1444859 - RNA, 11 nt, Homo sapiens
guuucauucau

SEQ ID NO: 1444860 - RNA, 14 nt, Homo sapiens
guuucauucaucca

SEQ ID NO: 1444861 - RNA, 16 nt, Homo sapiens
guuuccugaguaccag

SEQ ID NO: 1444862 - RNA, 20 nt, Homo sapiens
guuucuagcuagaaauauga

SEQ ID NO: 1444863 - RNA, 20 nt, Homo sapiens
guuucuccuuuugaccaaau

SEQ ID NO: 1444864 - RNA, 12 nt, Homo sapiens
guuucugagaaa

SEQ ID NO: 1444865 - RNA, 14 nt, Homo sapiens
guuucuugcucuga

SEQ ID NO: 1444866 - RNA, 15 nt, Homo sapiens
guuucuuucuguuau

SEQ ID NO: 1444867 - RNA, 14 nt, Homo sapiens
guuugagcuuucau

SEQ ID NO: 1444868 - RNA, 23 nt, Homo sapiens
guuugaucccuguuacccagaga

SEQ ID NO: 1444869 - RNA, 13 nt, Homo sapiens
guuuggggagaaa

SEQ ID NO: 1444870 - RNA, 22 nt, Homo sapiens
guuuguugaugugaaacauuau

SEQ ID NO: 1444871 - RNA, 20 nt, Homo sapiens
guuuuaaugacaaggugaua

SEQ ID NO: 1444872 - RNA, 18 nt, Homo sapiens
guuuuaauuuuugugauu

SEQ ID NO: 1444873 - RNA, 18 nt, Homo sapiens
guuuuauauguaguacua

SEQ ID NO: 1444874 - RNA, 13 nt, Homo sapiens
gcagacacugccg

SEQ ID NO: 1444875 - RNA, 12 nt, Homo sapiens
gcagacagcagg

SEQ ID NO: 1444876 - RNA, 15 nt, Homo sapiens
gcagaccgggggcca

SEQ ID NO: 1444877 - RNA, 16 nt, Homo sapiens
gcagaccgggggccag

SEQ ID NO: 1444878 - RNA, 15 nt, Homo sapiens
gcagagcuuccucag

SEQ ID NO: 1444879 - RNA, 12 nt, Homo sapiens
gcagaguauuuc

SEQ ID NO: 1444880 - RNA, 17 nt, Homo sapiens
gcagcaguuccaugaag

SEQ ID NO: 1444881 - RNA, 17 nt, Homo sapiens
gcagccaggggcugcuc

SEQ ID NO: 1444882 - RNA, 21 nt, Homo sapiens
gcagccaggggcugcucauca

SEQ ID NO: 1444883 - RNA, 17 nt, Homo sapiens
gcagccccacacccgcc

SEQ ID NO: 1444884 - RNA, 20 nt, Homo sapiens
gcagcccggcgccaccaucc

SEQ ID NO: 1444885 - RNA, 14 nt, Homo sapiens
gcagccuucugaca

SEQ ID NO: 1444886 - RNA, 22 nt, Homo sapiens
gcagcgguagcaucugagcucc

SEQ ID NO: 1444887 - RNA, 17 nt, Homo sapiens
gcagcuugaaacugaga

SEQ ID NO: 1444888 - RNA, 15 nt, Homo sapiens
gcaggaguagcugag

SEQ ID NO: 1444889 - RNA, 20 nt, Homo sapiens
gcaggaguagcugagcucac

SEQ ID NO: 1444890 - RNA, 12 nt, Homo sapiens
gcaggaucucag

SEQ ID NO: 1444891 - RNA, 21 nt, Homo sapiens
gcaggcaaacgggucgugaug

SEQ ID NO: 1444892 - RNA, 15 nt, Homo sapiens
gcaggcuacugucag

SEQ ID NO: 1444893 - RNA, 15 nt, Homo sapiens
gcaggcuagaaccug

SEQ ID NO: 1444894 - RNA, 21 nt, Homo sapiens
gcaggcuaugaaguugcaaug

SEQ ID NO: 1444895 - RNA, 15 nt, Homo sapiens
gcagggcaaaugaca

SEQ ID NO: 1444896 - RNA, 19 nt, Homo sapiens
gcagggcaaaugacaugca

SEQ ID NO: 1444897 - RNA, 16 nt, Homo sapiens
gcaggggccgagccau

SEQ ID NO: 1444898 - RNA, 16 nt, Homo sapiens
gcagguggcaucucua

SEQ ID NO: 1444899 - RNA, 17 nt, Homo sapiens
gcaguacuuuaccuccu

SEQ ID NO: 1444900 - RNA, 20 nt, Homo sapiens
gcaguagacuauaagcagaa

SEQ ID NO: 1444901 - RNA, 14 nt, Homo sapiens
gcaguauuccaugg

SEQ ID NO: 1444902 - RNA, 22 nt, Homo sapiens
gcagucagggugggaagaaaga

SEQ ID NO: 1444903 - RNA, 19 nt, Homo sapiens
gcaguccgcagucuggccu

SEQ ID NO: 1444904 - RNA, 16 nt, Homo sapiens
gcagugaacacacuca

SEQ ID NO: 1444905 - RNA, 21 nt, Homo sapiens
gcagugacuuuagaaacaaau

SEQ ID NO: 1444906 - RNA, 19 nt, Homo sapiens
gcaguucucgcagauguua

SEQ ID NO: 1444907 - RNA, 20 nt, Homo sapiens
gcaguucucgcagauguuac

SEQ ID NO: 1444908 - RNA, 13 nt, Homo sapiens
gcauaaaugcauu

SEQ ID NO: 1444909 - RNA, 14 nt, Homo sapiens
gcauaccugcuggu

SEQ ID NO: 1444910 - RNA, 21 nt, Homo sapiens
gcauagggucuggaacaccag

SEQ ID NO: 1444911 - RNA, 17 nt, Homo sapiens
gcauaguuuguucaaau

SEQ ID NO: 1444912 - RNA, 22 nt, Homo sapiens
gcaucaugccucugaggccagc

SEQ ID NO: 1444913 - RNA, 18 nt, Homo sapiens
gcauccagccuguguguu

SEQ ID NO: 1444914 - RNA, 17 nt, Homo sapiens
gcauccugugugcugac

SEQ ID NO: 1444915 - RNA, 23 nt, Homo sapiens
gcaucucagcggggcgcacaugu

SEQ ID NO: 1444916 - RNA, 15 nt, Homo sapiens
gcaucugacaugcau

SEQ ID NO: 1444917 - RNA, 14 nt, Homo sapiens
gcaugaccugauca

SEQ ID NO: 1444918 - RNA, 15 nt, Homo sapiens
gcauggugcuuucag

SEQ ID NO: 1444919 - RNA, 16 nt, Homo sapiens
gcauguaugugcacau

SEQ ID NO: 1444920 - RNA, 14 nt, Homo sapiens
gcaugugugugaug

SEQ ID NO: 1444921 - RNA, 15 nt, Homo sapiens
gcauuaaacauuuga

SEQ ID NO: 1444922 - RNA, 19 nt, Homo sapiens
gcauuacugggaagacaau

SEQ ID NO: 1444923 - RNA, 21 nt, Homo sapiens
gcauucauuucucuugcaaua

SEQ ID NO: 1444924 - RNA, 18 nt, Homo sapiens
gcauuccugagucuucca

SEQ ID NO: 1444925 - RNA, 22 nt, Homo sapiens
gcauugaauauauuauaaucuu

SEQ ID NO: 1444926 - RNA, 14 nt, Homo sapiens
gcauugcauggaca

SEQ ID NO: 1444927 - RNA, 15 nt, Homo sapiens
gcauuugauuuugcc

SEQ ID NO: 1444928 - RNA, 19 nt, Homo sapiens
gcauuuguuccaugccugc

SEQ ID NO: 1444929 - RNA, 15 nt, Homo sapiens
gcauuuucauuucac

SEQ ID NO: 1444930 - RNA, 14 nt, Homo sapiens
gccaaacacagagc

SEQ ID NO: 1444931 - RNA, 18 nt, Homo sapiens
gccaacaccuucuuggcu

SEQ ID NO: 1444932 - RNA, 23 nt, Homo sapiens
gccaacagccccccccuugaauc

SEQ ID NO: 1444933 - RNA, 15 nt, Homo sapiens
gccaagccaugucua

SEQ ID NO: 1444934 - RNA, 16 nt, Homo sapiens
gccaagcccucaauaa

SEQ ID NO: 1444935 - RNA, 16 nt, Homo sapiens
gccaagcugaagugaa

SEQ ID NO: 1444936 - RNA, 23 nt, Homo sapiens
gccaaggugggguauuuaccaca

SEQ ID NO: 1444937 - RNA, 18 nt, Homo sapiens
gccaauggagacugucuc

SEQ ID NO: 1444938 - RNA, 16 nt, Homo sapiens
gccacaucccuuugaa

SEQ ID NO: 1444939 - RNA, 13 nt, Homo sapiens
gccaccaagacag

SEQ ID NO: 1444940 - RNA, 17 nt, Homo sapiens
gccacggccuugugucu

SEQ ID NO: 1444941 - RNA, 14 nt, Homo sapiens
gccacuugacauuc

SEQ ID NO: 1444942 - RNA, 21 nt, Homo sapiens
gccagacacagauacaugggg

SEQ ID NO: 1444943 - RNA, 18 nt, Homo sapiens
gccagacuggcacaguuu

SEQ ID NO: 1444944 - RNA, 20 nt, Homo sapiens
gccagcacaggggccccaga

SEQ ID NO: 1444945 - RNA, 14 nt, Homo sapiens
gccagcagcuguuu

SEQ ID NO: 1444946 - RNA, 13 nt, Homo sapiens
gccagccaucaca

SEQ ID NO: 1444947 - RNA, 13 nt, Homo sapiens
gccagccucagug

SEQ ID NO: 1444948 - RNA, 17 nt, Homo sapiens
gccagccucagugccac

SEQ ID NO: 1444949 - RNA, 15 nt, Homo sapiens
gccaggaaucugcca

SEQ ID NO: 1444950 - RNA, 23 nt, Homo sapiens
gccaggauggcgugugugccgug

SEQ ID NO: 1444951 - RNA, 18 nt, Homo sapiens
gccaggcguuggugccac

SEQ ID NO: 1444952 - RNA, 19 nt, Homo sapiens
gccaggcuagagugcagug

SEQ ID NO: 1444953 - RNA, 16 nt, Homo sapiens
gccagggauccuuucc

SEQ ID NO: 1444954 - RNA, 22 nt, Homo sapiens
gccaguacagagaaauucugug

SEQ ID NO: 1444955 - RNA, 14 nt, Homo sapiens
gccauaaagccauu

SEQ ID NO: 1444956 - RNA, 14 nt, Homo sapiens
gccauagccccaua

SEQ ID NO: 1444957 - RNA, 22 nt, Homo sapiens
gccaucagggugggccacucuc

SEQ ID NO: 1444958 - RNA, 16 nt, Homo sapiens
gccaucccgucuucuc

SEQ ID NO: 1444959 - RNA, 17 nt, Homo sapiens
gauguacacacacagau

SEQ ID NO: 1444960 - RNA, 16 nt, Homo sapiens
gauguacgagcugcgc

SEQ ID NO: 1444961 - RNA, 23 nt, Homo sapiens
gaugucaaggacuccugucuguc

SEQ ID NO: 1444962 - RNA, 18 nt, Homo sapiens
gaugucacaugucagaga

SEQ ID NO: 1444963 - RNA, 17 nt, Homo sapiens
gaugucucuuguagaag

SEQ ID NO: 1444964 - RNA, 14 nt, Homo sapiens
gaugugaacacauc

SEQ ID NO: 1444965 - RNA, 16 nt, Homo sapiens
gaugugaucacugaga

SEQ ID NO: 1444966 - RNA, 17 nt, Homo sapiens
gauguucuggaccuccc

SEQ ID NO: 1444967 - RNA, 19 nt, Homo sapiens
gauguuuacagacugugag

SEQ ID NO: 1444968 - RNA, 14 nt, Homo sapiens
gauguuuguugcua

SEQ ID NO: 1444969 - RNA, 19 nt, Homo sapiens
gauuaagauacacuccugc

SEQ ID NO: 1444970 - RNA, 17 nt, Homo sapiens
gauuagaugacucucag

SEQ ID NO: 1444971 - RNA, 20 nt, Homo sapiens
gauuagcucuggaccagccu

SEQ ID NO: 1444972 - RNA, 12 nt, Homo sapiens
gauuauuugaac

SEQ ID NO: 1444973 - RNA, 23 nt, Homo sapiens
gauucacuaaagcagcacauagc

SEQ ID NO: 1444974 - RNA, 23 nt, Homo sapiens
gauucccccagucauucugggaa

SEQ ID NO: 1444975 - RNA, 15 nt, Homo sapiens
gauucuucugccuca

SEQ ID NO: 1444976 - RNA, 16 nt, Homo sapiens
gauugagaaguuuugu

SEQ ID NO: 1444977 - RNA, 12 nt, Homo sapiens
gauugagugcuc

SEQ ID NO: 1444978 - RNA, 18 nt, Homo sapiens
gauugcuuaaaauagcaa

SEQ ID NO: 1444979 - RNA, 17 nt, Homo sapiens
gauuggcucacccaagc

SEQ ID NO: 1444980 - RNA, 19 nt, Homo sapiens
gauugugguacaaucucaa

SEQ ID NO: 1444981 - RNA, 17 nt, Homo sapiens
gauuguucaucaugaca

SEQ ID NO: 1444982 - RNA, 15 nt, Homo sapiens
gauuuaaaauaucac

SEQ ID NO: 1444983 - RNA, 15 nt, Homo sapiens
gauuuaacacuaaaa

SEQ ID NO: 1444984 - RNA, 21 nt, Homo sapiens
gauuuaaugaagacccagugu

SEQ ID NO: 1444985 - RNA, 13 nt, Homo sapiens
gauuuauaucuau

SEQ ID NO: 1444986 - RNA, 13 nt, Homo sapiens
gauuucaggauac

SEQ ID NO: 1444987 - RNA, 22 nt, Homo sapiens
gauuuccuacagaaauacugcu

SEQ ID NO: 1444988 - RNA, 20 nt, Homo sapiens
gcaaaauaauaagaaggaaa

SEQ ID NO: 1444989 - RNA, 23 nt, Homo sapiens
gcaaacggaguacagacgucuca

SEQ ID NO: 1444990 - RNA, 18 nt, Homo sapiens
gcaaagacuagauccuuu

SEQ ID NO: 1444991 - RNA, 21 nt, Homo sapiens
gcaaagcaccagcuucuccag

SEQ ID NO: 1444992 - RNA, 16 nt, Homo sapiens
gcaaaggccagcagca

SEQ ID NO: 1444993 - RNA, 19 nt, Homo sapiens
gcaaagggcugaaagccau

SEQ ID NO: 1444994 - RNA, 12 nt, Homo sapiens
gcaaagucuaaa

SEQ ID NO: 1444995 - RNA, 14 nt, Homo sapiens
gcaaaugaguauuu

SEQ ID NO: 1444996 - RNA, 14 nt, Homo sapiens
gcaacaagaucuga

SEQ ID NO: 1444997 - RNA, 17 nt, Homo sapiens
gcaaccacacaccucac

SEQ ID NO: 1444998 - RNA, 23 nt, Homo sapiens
gcaacgcaggcccccaggugcca

SEQ ID NO: 1444999 - RNA, 16 nt, Homo sapiens
gcaagaguggacugaa

SEQ ID NO: 1445000 - RNA, 19 nt, Homo sapiens
gcaaggggcauuacuggga

SEQ ID NO: 1445001 - RNA, 14 nt, Homo sapiens
gcaaggugugaaug

SEQ ID NO: 1445002 - RNA, 12 nt, Homo sapiens
gcaagugauauc

SEQ ID NO: 1445003 - RNA, 15 nt, Homo sapiens
gcaaguggcuuucaa

SEQ ID NO: 1445004 - RNA, 16 nt, Homo sapiens
gcaaucacugaucuca

SEQ ID NO: 1445005 - RNA, 19 nt, Homo sapiens
gcaaugcccuaauuagggc

SEQ ID NO: 1445006 - RNA, 13 nt, Homo sapiens
gcaauucauccca

SEQ ID NO: 1445007 - RNA, 14 nt, Homo sapiens
gcacaaaugcaccu

SEQ ID NO: 1445008 - RNA, 15 nt, Homo sapiens
gcacacacacagaga

SEQ ID NO: 1445009 - RNA, 22 nt, Homo sapiens
gcacacacacagagauaugcac

SEQ ID NO: 1445010 - RNA, 19 nt, Homo sapiens
gcacacacaccgaugcuga

SEQ ID NO: 1445011 - RNA, 20 nt, Homo sapiens
gcacacacacggaugcacac

SEQ ID NO: 1445012 - RNA, 20 nt, Homo sapiens
gcacacacagauaugcacac

SEQ ID NO: 1445013 - RNA, 16 nt, Homo sapiens
gcacacaccgaugugc

SEQ ID NO: 1445014 - RNA, 18 nt, Homo sapiens
gcacaccucaugcugagc

SEQ ID NO: 1445015 - RNA, 23 nt, Homo sapiens
gcacagcccugggagggggcuau

SEQ ID NO: 1445016 - RNA, 15 nt, Homo sapiens
gcacaggcugggaug

SEQ ID NO: 1445017 - RNA, 18 nt, Homo sapiens
gcacagggaacaagcauu

SEQ ID NO: 1445018 - RNA, 13 nt, Homo sapiens
gcacauaacaugc

SEQ ID NO: 1445019 - RNA, 15 nt, Homo sapiens
gcacauaacaugcuu

SEQ ID NO: 1445020 - RNA, 22 nt, Homo sapiens
gcacauagagauaugcacacac

SEQ ID NO: 1445021 - RNA, 22 nt, Homo sapiens
gcacaucccugcccuccuacag

SEQ ID NO: 1445022 - RNA, 12 nt, Homo sapiens
gcacaucucugc

SEQ ID NO: 1445023 - RNA, 16 nt, Homo sapiens
gcacaucucugcagua

SEQ ID NO: 1445024 - RNA, 18 nt, Homo sapiens
gcacauggcuggcacuga

SEQ ID NO: 1445025 - RNA, 19 nt, Homo sapiens
gcaccacuguguauuuaac

SEQ ID NO: 1445026 - RNA, 16 nt, Homo sapiens
gcaccaucacacaugc

SEQ ID NO: 1445027 - RNA, 13 nt, Homo sapiens
gcaccaucucuga

SEQ ID NO: 1445028 - RNA, 16 nt, Homo sapiens
gcacccaggcuccaug

SEQ ID NO: 1445029 - RNA, 17 nt, Homo sapiens
gcaccccccaagcuguu

SEQ ID NO: 1445030 - RNA, 12 nt, Homo sapiens
gcacccuggauu

SEQ ID NO: 1445031 - RNA, 17 nt, Homo sapiens
gcacccuucuuuccucu

SEQ ID NO: 1445032 - RNA, 19 nt, Homo sapiens
gcacgcggcggacugggca

SEQ ID NO: 1445033 - RNA, 20 nt, Homo sapiens
gcacuaccacgccaagcuaa

SEQ ID NO: 1445034 - RNA, 12 nt, Homo sapiens
gcacuagcauuu

SEQ ID NO: 1445035 - RNA, 19 nt, Homo sapiens
gcacucccuuaggcauuau

SEQ ID NO: 1445036 - RNA, 18 nt, Homo sapiens
gcacucuucccaccucag

SEQ ID NO: 1445037 - RNA, 19 nt, Homo sapiens
gcacugaaaauaccaucag

SEQ ID NO: 1445038 - RNA, 15 nt, Homo sapiens
gcacugauguuguua

SEQ ID NO: 1445039 - RNA, 21 nt, Homo sapiens
gcacugccggcccagugacac

SEQ ID NO: 1445040 - RNA, 21 nt, Homo sapiens
gcacugcuaggcgagugccag

SEQ ID NO: 1445041 - RNA, 12 nt, Homo sapiens
gcacugggauga

SEQ ID NO: 1445042 - RNA, 18 nt, Homo sapiens
gcacuuuucugugucaua

SEQ ID NO: 1445043 - RNA, 17 nt, Homo sapiens
gcagacaccugccuuaa

SEQ ID NO: 1445044 - RNA, 19 nt, Homo sapiens
cggguguguacaccaaggu

SEQ ID NO: 1445045 - RNA, 18 nt, Homo sapiens
cgguaccuggcaauguuu

SEQ ID NO: 1445046 - RNA, 18 nt, Homo sapiens
cgguggcucuugccugua

SEQ ID NO: 1445047 - RNA, 20 nt, Homo sapiens
cgguuuguauuuagugucuu

SEQ ID NO: 1445048 - RNA, 17 nt, Homo sapiens
cgucagaccaguacugg

SEQ ID NO: 1445049 - RNA, 13 nt, Homo sapiens
cguccuuccucuc

SEQ ID NO: 1445050 - RNA, 19 nt, Homo sapiens
cgucuccugacaugucuca

SEQ ID NO: 1445051 - RNA, 15 nt, Homo sapiens
cgucuucuguauacu

SEQ ID NO: 1445052 - RNA, 19 nt, Homo sapiens
cgucuucuguauacugugg

SEQ ID NO: 1445053 - RNA, 17 nt, Homo sapiens
cgugaaaccccgucucu

SEQ ID NO: 1445054 - RNA, 14 nt, Homo sapiens
cgugacaacaugcg

SEQ ID NO: 1445055 - RNA, 18 nt, Homo sapiens
cgugagagaaucugccug

SEQ ID NO: 1445056 - RNA, 17 nt, Homo sapiens
cgugagcagcuuuggaa

SEQ ID NO: 1445057 - RNA, 13 nt, Homo sapiens
cgugauggucuga

SEQ ID NO: 1445058 - RNA, 13 nt, Homo sapiens
cgugccugugauc

SEQ ID NO: 1445059 - RNA, 19 nt, Homo sapiens
cguggugugucaaugccac

SEQ ID NO: 1445060 - RNA, 13 nt, Homo sapiens
cguguagugucug

SEQ ID NO: 1445061 - RNA, 18 nt, Homo sapiens
cguuacugcauacugauc

SEQ ID NO: 1445062 - RNA, 23 nt, Homo sapiens
cguuuugugugguggcaccuccu

SEQ ID NO: 1445063 - RNA, 17 nt, Homo sapiens
cuaaaaaauggugggag

SEQ ID NO: 1445064 - RNA, 21 nt, Homo sapiens
cuaaaaaguggcuaauucaau

SEQ ID NO: 1445065 - RNA, 15 nt, Homo sapiens
cuaaaaccugagcua

SEQ ID NO: 1445066 - RNA, 15 nt, Homo sapiens
cuaaacaauguauuu

SEQ ID NO: 1445067 - RNA, 20 nt, Homo sapiens
cuaaacagacuauuuaacuu

SEQ ID NO: 1445068 - RNA, 10 nt, Homo sapiens
cuaaacugua

SEQ ID NO: 1445069 - RNA, 12 nt, Homo sapiens
cuaaagauauca

SEQ ID NO: 1445070 - RNA, 14 nt, Homo sapiens
cuaaaggacuaaca

SEQ ID NO: 1445071 - RNA, 16 nt, Homo sapiens
cuaaauacuguacaua

SEQ ID NO: 1445072 - RNA, 11 nt, Homo sapiens
cuaaauaugau

SEQ ID NO: 1445073 - RNA, 23 nt, Homo sapiens
cuaaauccaaaugaggauaucau

SEQ ID NO: 1445074 - RNA, 15 nt, Homo sapiens
cuaacauauguauua

SEQ ID NO: 1445075 - RNA, 19 nt, Homo sapiens
cuaaccucagccaaacaca

SEQ ID NO: 1445076 - RNA, 15 nt, Homo sapiens
cuaacuccagugaag

SEQ ID NO: 1445077 - RNA, 20 nt, Homo sapiens
cuaagaaaugcugaaaauca

SEQ ID NO: 1445078 - RNA, 16 nt, Homo sapiens
cuaagccuguugcuga

SEQ ID NO: 1445079 - RNA, 12 nt, Homo sapiens
cuaagcuuucuc

SEQ ID NO: 1445080 - RNA, 17 nt, Homo sapiens
cuaaggcucuauuuccu

SEQ ID NO: 1445081 - RNA, 22 nt, Homo sapiens
cuaagggccacaucccacugcc

SEQ ID NO: 1445082 - RNA, 22 nt, Homo sapiens
cuaaguaaaaccacagcaguug

SEQ ID NO: 1445083 - RNA, 14 nt, Homo sapiens
cucaaaucuauuca

SEQ ID NO: 1445084 - RNA, 13 nt, Homo sapiens
cucaaaucuccag

SEQ ID NO: 1445085 - RNA, 18 nt, Homo sapiens
cucaaaugacccaaagac

SEQ ID NO: 1445086 - RNA, 14 nt, Homo sapiens
cucaaaugcuaaau

SEQ ID NO: 1445087 - RNA, 12 nt, Homo sapiens
cucaaaugucag

SEQ ID NO: 1445088 - RNA, 12 nt, Homo sapiens
cucaagacugaa

SEQ ID NO: 1445089 - RNA, 16 nt, Homo sapiens
cucaauaagccagcaa

SEQ ID NO: 1445090 - RNA, 15 nt, Homo sapiens
cucacaagaagacca

SEQ ID NO: 1445091 - RNA, 16 nt, Homo sapiens
cucacaagaagaccag

SEQ ID NO: 1445092 - RNA, 21 nt, Homo sapiens
cucacaagaagaccagacugu

SEQ ID NO: 1445093 - RNA, 14 nt, Homo sapiens
cucacacccuaaua

SEQ ID NO: 1445094 - RNA, 19 nt, Homo sapiens
cucacacgggguauuuuag

SEQ ID NO: 1445095 - RNA, 18 nt, Homo sapiens
cucacacuuggagcuaau

SEQ ID NO: 1445096 - RNA, 18 nt, Homo sapiens
cucacagaagaauaugac

SEQ ID NO: 1445097 - RNA, 20 nt, Homo sapiens
cucacaguacaauguuucag

SEQ ID NO: 1445098 - RNA, 16 nt, Homo sapiens
cucacaucuguccaga

SEQ ID NO: 1445099 - RNA, 19 nt, Homo sapiens
cucaccgggcuacuaccug

SEQ ID NO: 1445100 - RNA, 23 nt, Homo sapiens
cucaccguuggcuacccggucac

SEQ ID NO: 1445101 - RNA, 11 nt, Homo sapiens
cucaccucucu

SEQ ID NO: 1445102 - RNA, 14 nt, Homo sapiens
cucacuccuguuac

SEQ ID NO: 1445103 - RNA, 13 nt, Homo sapiens
cucagacauucca

SEQ ID NO: 1445104 - RNA, 12 nt, Homo sapiens
cucagacuguug

SEQ ID NO: 1445105 - RNA, 14 nt, Homo sapiens
cucagagacuauuu

SEQ ID NO: 1445106 - RNA, 23 nt, Homo sapiens
cucagccgugcacucccuaagaa

SEQ ID NO: 1445107 - RNA, 20 nt, Homo sapiens
cucagccucccgaguagcug

SEQ ID NO: 1445108 - RNA, 17 nt, Homo sapiens
cucagccuccucaguag

SEQ ID NO: 1445109 - RNA, 13 nt, Homo sapiens
cucaggagacaau

SEQ ID NO: 1445110 - RNA, 22 nt, Homo sapiens
cucagggaguuugacgagcuca

SEQ ID NO: 1445111 - RNA, 14 nt, Homo sapiens
cucagguaguacug

SEQ ID NO: 1445112 - RNA, 16 nt, Homo sapiens
cucaggucacuccagu

SEQ ID NO: 1445113 - RNA, 14 nt, Homo sapiens
cucaggucccugca

SEQ ID NO: 1445114 - RNA, 22 nt, Homo sapiens
cucagugccacuugacauuccu

SEQ ID NO: 1445115 - RNA, 22 nt, Homo sapiens
cucaguuuccucaccagaaaaa

SEQ ID NO: 1445116 - RNA, 19 nt, Homo sapiens
cucaucacccaguccuggc

SEQ ID NO: 1445117 - RNA, 13 nt, Homo sapiens
cucaucacuggau

SEQ ID NO: 1445118 - RNA, 15 nt, Homo sapiens
cucaucuacaagcau

SEQ ID NO: 1445119 - RNA, 18 nt, Homo sapiens
cucaucuacaagcauuug

SEQ ID NO: 1445120 - RNA, 12 nt, Homo sapiens
cucaucucacug

SEQ ID NO: 1445121 - RNA, 12 nt, Homo sapiens
cucaucuugccc

SEQ ID NO: 1445122 - RNA, 12 nt, Homo sapiens
cucaugugaucc

SEQ ID NO: 1445123 - RNA, 10 nt, Homo sapiens
cucauuccac

SEQ ID NO: 1445124 - RNA, 13 nt, Homo sapiens
cucauuccaccuu

SEQ ID NO: 1445125 - RNA, 13 nt, Homo sapiens
cucauuccuguag

SEQ ID NO: 1445126 - RNA, 16 nt, Homo sapiens
cucauuccuucacuca

SEQ ID NO: 1445127 - RNA, 23 nt, Homo sapiens
cucauuuuuguuuucauuaucuc

SEQ ID NO: 1445128 - RNA, 16 nt, Homo sapiens
cuccaaaaauucacau

SEQ ID NO: 1445129 - RNA, 14 nt, Homo sapiens
aacuuauaucauca

SEQ ID NO: 1445130 - RNA, 14 nt, Homo sapiens
cacagauaugcaca

SEQ ID NO: 1445131 - RNA, 21 nt, Homo sapiens
cacagcaagggugaugggaaa

SEQ ID NO: 1445132 - RNA, 19 nt, Homo sapiens
cacagcacccaggcuccau

SEQ ID NO: 1445133 - RNA, 17 nt, Homo sapiens
cacagcccgggugugcc

SEQ ID NO: 1445134 - RNA, 17 nt, Homo sapiens
cacagcgcuaugcaauu

SEQ ID NO: 1445135 - RNA, 23 nt, Homo sapiens
cacagcgucccuagcagugaacu

SEQ ID NO: 1445136 - RNA, 16 nt, Homo sapiens
cacagcugaacuauuu

SEQ ID NO: 1445137 - RNA, 23 nt, Homo sapiens
cacagcugagagacuuuuaauca

SEQ ID NO: 1445138 - RNA, 21 nt, Homo sapiens
cacagcugcagcugggcccca

SEQ ID NO: 1445139 - RNA, 23 nt, Homo sapiens
cacaggguuuuguauucuuuacu

SEQ ID NO: 1445140 - RNA, 21 nt, Homo sapiens
cacaguacaauguuucagaag

SEQ ID NO: 1445141 - RNA, 13 nt, Homo sapiens
cacagugggaacu

SEQ ID NO: 1445142 - RNA, 15 nt, Homo sapiens
cacaguuuugccuua

SEQ ID NO: 1445143 - RNA, 16 nt, Homo sapiens
cacauacaauuugcac

SEQ ID NO: 1445144 - RNA, 17 nt, Homo sapiens
cacauacauacacauac

SEQ ID NO: 1445145 - RNA, 20 nt, Homo sapiens
cacauacgugucugugugua

SEQ ID NO: 1445146 - RNA, 13 nt, Homo sapiens
cacauacuagaaa

SEQ ID NO: 1445147 - RNA, 15 nt, Homo sapiens
cacauagagauaugc

SEQ ID NO: 1445148 - RNA, 16 nt, Homo sapiens
cacauagagauaugca

SEQ ID NO: 1445149 - RNA, 19 nt, Homo sapiens
cacauagauuaauggcacu

SEQ ID NO: 1445150 - RNA, 21 nt, Homo sapiens
cacauagauuaauggcacuga

SEQ ID NO: 1445151 - RNA, 15 nt, Homo sapiens
cacauauggcacaac

SEQ ID NO: 1445152 - RNA, 21 nt, Homo sapiens
cacaucacuacaguacaguga

SEQ ID NO: 1445153 - RNA, 20 nt, Homo sapiens
cacaucagagugacauccag

SEQ ID NO: 1445154 - RNA, 14 nt, Homo sapiens
cacauccauuccca

SEQ ID NO: 1445155 - RNA, 16 nt, Homo sapiens
cacaucuaaugucucu

SEQ ID NO: 1445156 - RNA, 14 nt, Homo sapiens
cacauggacacaga

SEQ ID NO: 1445157 - RNA, 13 nt, Homo sapiens
cacauuacaucau

SEQ ID NO: 1445158 - RNA, 13 nt, Homo sapiens
cacauuccuccua

SEQ ID NO: 1445159 - RNA, 23 nt, Homo sapiens
cacauucuuaaaggaaaagucaa

SEQ ID NO: 1445160 - RNA, 15 nt, Homo sapiens
cacauuugauguaca

SEQ ID NO: 1445161 - RNA, 13 nt, Homo sapiens
caccaaagcuggc

SEQ ID NO: 1445162 - RNA, 15 nt, Homo sapiens
caccaaagucaggga

SEQ ID NO: 1445163 - RNA, 20 nt, Homo sapiens
caccaaaugaugccacuucc

SEQ ID NO: 1445164 - RNA, 22 nt, Homo sapiens
cacuugcccugccacuuugcau

SEQ ID NO: 1445165 - RNA, 20 nt, Homo sapiens
cacuugccuucuucacccag

SEQ ID NO: 1445166 - RNA, 19 nt, Homo sapiens
cacuugggucuucccugua

SEQ ID NO: 1445167 - RNA, 12 nt, Homo sapiens
cacuuucaccag

SEQ ID NO: 1445168 - RNA, 13 nt, Homo sapiens
cacuuuccuacaa

SEQ ID NO: 1445169 - RNA, 20 nt, Homo sapiens
cacuuuggcuucuccuguga

SEQ ID NO: 1445170 - RNA, 17 nt, Homo sapiens
cagaaaacaaaucuuca

SEQ ID NO: 1445171 - RNA, 21 nt, Homo sapiens
cagaaaccaagucuacuucac

SEQ ID NO: 1445172 - RNA, 12 nt, Homo sapiens
cagaaagcauua

SEQ ID NO: 1445173 - RNA, 18 nt, Homo sapiens
cagaaaguggccaugcca

SEQ ID NO: 1445174 - RNA, 19 nt, Homo sapiens
cagaaaguggccaugccac

SEQ ID NO: 1445175 - RNA, 20 nt, Homo sapiens
cagaaauaaaaugaaauguc

SEQ ID NO: 1445176 - RNA, 23 nt, Homo sapiens
cagaaauuccuucccacucaugu

SEQ ID NO: 1445177 - RNA, 19 nt, Homo sapiens
cagaacccuuccugagacc

SEQ ID NO: 1445178 - RNA, 18 nt, Homo sapiens
cagaacuguuguuuacuu

SEQ ID NO: 1445179 - RNA, 21 nt, Homo sapiens
cagaauacaagccacuaccuu

SEQ ID NO: 1445180 - RNA, 17 nt, Homo sapiens
cagaauauggacaaaga

SEQ ID NO: 1445181 - RNA, 23 nt, Homo sapiens
cagaaucucauagguugccaaua

SEQ ID NO: 1445182 - RNA, 13 nt, Homo sapiens
cagaauucuucag

SEQ ID NO: 1445183 - RNA, 16 nt, Homo sapiens
cagaauugugcaaaug

SEQ ID NO: 1445184 - RNA, 15 nt, Homo sapiens
cagacaccugccuua

SEQ ID NO: 1445185 - RNA, 22 nt, Homo sapiens
cagacauuuucaauaaugugaa

SEQ ID NO: 1445186 - RNA, 16 nt, Homo sapiens
cagaccacucccuucc

SEQ ID NO: 1445187 - RNA, 16 nt, Homo sapiens
cagaccaguacuggga

SEQ ID NO: 1445188 - RNA, 20 nt, Homo sapiens
cagaccgggguucaagccau

SEQ ID NO: 1445189 - RNA, 15 nt, Homo sapiens
cagacgucucaagac

SEQ ID NO: 1445190 - RNA, 17 nt, Homo sapiens
cagacgucucaagacug

SEQ ID NO: 1445191 - RNA, 17 nt, Homo sapiens
cagacuucacacugcaa

SEQ ID NO: 1445192 - RNA, 14 nt, Homo sapiens
cagacuucccugaa

SEQ ID NO: 1445193 - RNA, 21 nt, Homo sapiens
cagacuugccaggcucccuuu

SEQ ID NO: 1445194 - RNA, 14 nt, Homo sapiens
cagacuuuagcuua

SEQ ID NO: 1445195 - RNA, 17 nt, Homo sapiens
cagacuuucuacaccug

SEQ ID NO: 1445196 - RNA, 17 nt, Homo sapiens
cagagaaagaagagaca

SEQ ID NO: 1445197 - RNA, 15 nt, Homo sapiens
cagagaaauucugug

SEQ ID NO: 1445198 - RNA, 19 nt, Homo sapiens
cagagacaggcccaagaga

SEQ ID NO: 1445199 - RNA, 20 nt, Homo sapiens
cagagaccccaggaucccag

SEQ ID NO: 1445200 - RNA, 21 nt, Homo sapiens
cagagaggcaugugaugugca

SEQ ID NO: 1445201 - RNA, 13 nt, Homo sapiens
cagagagggccca

SEQ ID NO: 1445202 - RNA, 19 nt, Homo sapiens
cagagauacgcaaacacac

SEQ ID NO: 1445203 - RNA, 18 nt, Homo sapiens
cagagaugaaacuauggc

SEQ ID NO: 1445204 - RNA, 23 nt, Homo sapiens
cagagauggaggccgagccaaua

SEQ ID NO: 1445205 - RNA, 12 nt, Homo sapiens
cagagcaauggu

SEQ ID NO: 1445206 - RNA, 19 nt, Homo sapiens
cagagcacugcuccagugg

SEQ ID NO: 1445207 - RNA, 17 nt, Homo sapiens
cagagcaggaaugggaa

SEQ ID NO: 1445208 - RNA, 13 nt, Homo sapiens
cagagcaggcuca

SEQ ID NO: 1445209 - RNA, 15 nt, Homo sapiens
cagagccacuaccuu

SEQ ID NO: 1445210 - RNA, 12 nt, Homo sapiens
cagagccaguga

SEQ ID NO: 1445211 - RNA, 20 nt, Homo sapiens
cagagcgagacuccgucuca

SEQ ID NO: 1445212 - RNA, 20 nt, Homo sapiens
cagagcgagauuccgucuua

SEQ ID NO: 1445213 - RNA, 14 nt, Homo sapiens
cagagcuggaacac

SEQ ID NO: 1445214 - RNA, 16 nt, Homo sapiens
cagagcuggaaggcag

SEQ ID NO: 1445215 - RNA, 15 nt, Homo sapiens
aacugacaaccugug

SEQ ID NO: 1445216 - RNA, 18 nt, Homo sapiens
aacugaggaguagcugag

SEQ ID NO: 1445217 - RNA, 19 nt, Homo sapiens
aacugaggccauuauuuca

SEQ ID NO: 1445218 - RNA, 13 nt, Homo sapiens
aacugcgugccag

SEQ ID NO: 1445219 - RNA, 19 nt, Homo sapiens
aacuggaggaguuccuuga

SEQ ID NO: 1445220 - RNA, 11 nt, Homo sapiens
aacuggcuguu

SEQ ID NO: 1445221 - RNA, 22 nt, Homo sapiens
aacugugcccugccuucagcuu

SEQ ID NO: 1445222 - RNA, 17 nt, Homo sapiens
aacuuaaaaauauccau

SEQ ID NO: 1445223 - RNA, 16 nt, Homo sapiens
aacuuaaacauauucu

SEQ ID NO: 1445224 - RNA, 21 nt, Homo sapiens
aacuucuugaaucuagggagg

SEQ ID NO: 1445225 - RNA, 19 nt, Homo sapiens
aacuugaggacacaugucc

SEQ ID NO: 1445226 - RNA, 20 nt, Homo sapiens
aacuugaggacacaugucca

SEQ ID NO: 1445227 - RNA, 23 nt, Homo sapiens
aacuugaggacacauguccagug

SEQ ID NO: 1445228 - RNA, 16 nt, Homo sapiens
aacuuuugugcucccc

SEQ ID NO: 1445229 - RNA, 17 nt, Homo sapiens
aagaaaaaguugcaguc

SEQ ID NO: 1445230 - RNA, 13 nt, Homo sapiens
aagaaaagcaauc

SEQ ID NO: 1445231 - RNA, 22 nt, Homo sapiens
aagaaaaucaaagcugaggaca

SEQ ID NO: 1445232 - RNA, 15 nt, Homo sapiens
aagaaaauuauguau

SEQ ID NO: 1445233 - RNA, 16 nt, Homo sapiens
aagaaaauuauguauu

SEQ ID NO: 1445234 - RNA, 23 nt, Homo sapiens
aagaaauguaagggaaacugcca

SEQ ID NO: 1445235 - RNA, 21 nt, Homo sapiens
aagaaauuccuguagcaucuu

SEQ ID NO: 1445236 - RNA, 14 nt, Homo sapiens
aagaaauucuguca

SEQ ID NO: 1445237 - RNA, 11 nt, Homo sapiens
aagaagacugg

SEQ ID NO: 1445238 - RNA, 15 nt, Homo sapiens
aagaaggccacuggu

SEQ ID NO: 1445239 - RNA, 19 nt, Homo sapiens
aagaaguuaacuacagugu

SEQ ID NO: 1445240 - RNA, 17 nt, Homo sapiens
aagaauauuuacaauaa

SEQ ID NO: 1445241 - RNA, 14 nt, Homo sapiens
aagaaucaccucaa

SEQ ID NO: 1445242 - RNA, 15 nt, Homo sapiens
aagaaucaccucaaa

SEQ ID NO: 1445243 - RNA, 16 nt, Homo sapiens
aagaaucagucuugca

SEQ ID NO: 1445244 - RNA, 13 nt, Homo sapiens
aagaaucuaauag

SEQ ID NO: 1445245 - RNA, 22 nt, Homo sapiens
aagaauuuuuuuuaacauucca

SEQ ID NO: 1445246 - RNA, 18 nt, Homo sapiens
aagacaaaccacuguaca

SEQ ID NO: 1445247 - RNA, 18 nt, Homo sapiens
aagacauggaauuaccuu

SEQ ID NO: 1445248 - RNA, 20 nt, Homo sapiens
aagacgcucaagaauccucu

SEQ ID NO: 1445249 - RNA, 20 nt, Homo sapiens
aagacuauuaagagcaauaa

SEQ ID NO: 1445250 - RNA, 14 nt, Homo sapiens
aagacuauucaaac

SEQ ID NO: 1445251 - RNA, 13 nt, Homo sapiens
aagacuccaaaga

SEQ ID NO: 1445252 - RNA, 21 nt, Homo sapiens
aagacugggcuagggagaaug

SEQ ID NO: 1445253 - RNA, 14 nt, Homo sapiens
aagacuucuugggu

SEQ ID NO: 1445254 - RNA, 13 nt, Homo sapiens
aagagacagagcc

SEQ ID NO: 1445255 - RNA, 18 nt, Homo sapiens
aagagaccaagacucuga

SEQ ID NO: 1445256 - RNA, 20 nt, Homo sapiens
aagagacuggagcaucugac

SEQ ID NO: 1445257 - RNA, 18 nt, Homo sapiens
aagagagaaaucugaaaa

SEQ ID NO: 1445258 - RNA, 21 nt, Homo sapiens
aagagaggaaugccuguguga

SEQ ID NO: 1445259 - RNA, 20 nt, Homo sapiens
aagagaugggauuucaucau

SEQ ID NO: 1445260 - RNA, 21 nt, Homo sapiens
aagagauuucaacauaucauu

SEQ ID NO: 1445261 - RNA, 22 nt, Homo sapiens
aagagcuaaguucuaaguucau

SEQ ID NO: 1445262 - RNA, 15 nt, Homo sapiens
aagaggauagaauac

SEQ ID NO: 1445263 - RNA, 16 nt, Homo sapiens
aagaggcagcuugaaa

SEQ ID NO: 1445264 - RNA, 13 nt, Homo sapiens
aagaggcagugag

SEQ ID NO: 1445265 - RNA, 14 nt, Homo sapiens
aagaggcagugaga

SEQ ID NO: 1445266 - RNA, 21 nt, Homo sapiens
aagaggcuauuuaaaaguaua

SEQ ID NO: 1445267 - RNA, 12 nt, Homo sapiens
aagaggggaaaa

SEQ ID NO: 1445268 - RNA, 12 nt, Homo sapiens
aagaggugaccc

SEQ ID NO: 1445269 - RNA, 14 nt, Homo sapiens
aagaggugacccca

SEQ ID NO: 1445270 - RNA, 17 nt, Homo sapiens
aagaguagugcauuuaa

SEQ ID NO: 1445271 - RNA, 17 nt, Homo sapiens
aagaguauuuacaauaa

SEQ ID NO: 1445272 - RNA, 15 nt, Homo sapiens
aagagugagagggca

SEQ ID NO: 1445273 - RNA, 18 nt, Homo sapiens
aagaguuucuccuuuuga

SEQ ID NO: 1445274 - RNA, 19 nt, Homo sapiens
aagauaaaauauccucagg

SEQ ID NO: 1445275 - RNA, 20 nt, Homo sapiens
aagauaauuuguugggccau

SEQ ID NO: 1445276 - RNA, 15 nt, Homo sapiens
aagauccacccucaa

SEQ ID NO: 1445277 - RNA, 21 nt, Homo sapiens
aagauccacccucaaauguca

SEQ ID NO: 1445278 - RNA, 15 nt, Homo sapiens
aagaucuauauugua

SEQ ID NO: 1445279 - RNA, 13 nt, Homo sapiens
aagaucuuugccc

SEQ ID NO: 1445280 - RNA, 21 nt, Homo sapiens
aagaugaagagaagcugagaa

SEQ ID NO: 1445281 - RNA, 18 nt, Homo sapiens
aagauggcugacuuugcu

SEQ ID NO: 1445282 - RNA, 21 nt, Homo sapiens
aagauggcugugccucugccu

SEQ ID NO: 1445283 - RNA, 14 nt, Homo sapiens
aagauguacuugug

SEQ ID NO: 1445284 - RNA, 22 nt, Homo sapiens
aagaugugggcagugaugucac

SEQ ID NO: 1445285 - RNA, 18 nt, Homo sapiens
aagcaaaaccacugagcu

SEQ ID NO: 1445286 - RNA, 17 nt, Homo sapiens
aagcaaaggaaaccaaa

SEQ ID NO: 1445287 - RNA, 11 nt, Homo sapiens
aagcaaauaga

SEQ ID NO: 1445288 - RNA, 15 nt, Homo sapiens
aagcaaguggcuuuc

SEQ ID NO: 1445289 - RNA, 12 nt, Homo sapiens
aagcacaugugu

SEQ ID NO: 1445290 - RNA, 23 nt, Homo sapiens
aagcaccuagccucgcucuuggc

SEQ ID NO: 1445291 - RNA, 17 nt, Homo sapiens
aagcaccugccgaccuc

SEQ ID NO: 1445292 - RNA, 15 nt, Homo sapiens
aagcagaagcacaua

SEQ ID NO: 1445293 - RNA, 16 nt, Homo sapiens
aagcaguagacaaucc

SEQ ID NO: 1445294 - RNA, 20 nt, Homo sapiens
aagcagugaauaguaacaau

SEQ ID NO: 1445295 - RNA, 22 nt, Homo sapiens
aagcaucccgcuggugccuccc

SEQ ID NO: 1445296 - RNA, 23 nt, Homo sapiens
aagcaucucagccuaccaugaga

SEQ ID NO: 1445297 - RNA, 23 nt, Homo sapiens
aagcaugucucaauaguaaaaga

SEQ ID NO: 1445298 - RNA, 12 nt, Homo sapiens
aagcauuugccc

SEQ ID NO: 1445299 - RNA, 16 nt, Homo sapiens
aagcccagugaccuga

SEQ ID NO: 1445300 - RNA, 18 nt, Homo sapiens
aagcccccuacugagaaa

SEQ ID NO: 1445301 - RNA, 23 nt, Homo sapiens
aagccccuuggcccucucccaug

SEQ ID NO: 1445302 - RNA, 19 nt, Homo sapiens
acacuauaaagguugacaa

SEQ ID NO: 1445303 - RNA, 18 nt, Homo sapiens
acacuauugcauuguuca

SEQ ID NO: 1445304 - RNA, 18 nt, Homo sapiens
acacucuagugacuuccu

SEQ ID NO: 1445305 - RNA, 15 nt, Homo sapiens
acacugaaguuaaca

SEQ ID NO: 1445306 - RNA, 19 nt, Homo sapiens
acacugaggaggcugccuu

SEQ ID NO: 1445307 - RNA, 16 nt, Homo sapiens
acacugugaagacaau

SEQ ID NO: 1445308 - RNA, 16 nt, Homo sapiens
acacuuccauuaacuu

SEQ ID NO: 1445309 - RNA, 19 nt, Homo sapiens
acagaaauacugcucugaa

SEQ ID NO: 1445310 - RNA, 20 nt, Homo sapiens
acagaaauauauauacauau

SEQ ID NO: 1445311 - RNA, 18 nt, Homo sapiens
acagaagaucuauauugu

SEQ ID NO: 1445312 - RNA, 18 nt, Homo sapiens
acagaauaauguguuaaa

SEQ ID NO: 1445313 - RNA, 22 nt, Homo sapiens
acagaauggaaccaaaauguau

SEQ ID NO: 1445314 - RNA, 19 nt, Homo sapiens
acagacgucucaagacuga

SEQ ID NO: 1445315 - RNA, 23 nt, Homo sapiens
acagacugaauuuuaaauguuca

SEQ ID NO: 1445316 - RNA, 17 nt, Homo sapiens
acagagacaggcccaag

SEQ ID NO: 1445317 - RNA, 19 nt, Homo sapiens
acagagauaugcacacacc

SEQ ID NO: 1445318 - RNA, 15 nt, Homo sapiens
acagagaugugauaa

SEQ ID NO: 1445319 - RNA, 17 nt, Homo sapiens
acagagccaacucacuc

SEQ ID NO: 1445320 - RNA, 20 nt, Homo sapiens
acagagggggccuucacagu

SEQ ID NO: 1445321 - RNA, 23 nt, Homo sapiens
acagagggggccuucacagugac

SEQ ID NO: 1445322 - RNA, 24 nt, Homo sapiens
acagagguggcugcugugcuagug

SEQ ID NO: 1445323 - RNA, 18 nt, Homo sapiens
acagauauacacauggau

SEQ ID NO: 1445324 - RNA, 17 nt, Homo sapiens
acagaugugggcuuuga

SEQ ID NO: 1445325 - RNA, 20 nt, Homo sapiens
acagcacccaggcuccaugg

SEQ ID NO: 1445326 - RNA, 21 nt, Homo sapiens
acagcacccaggcuccauggg

SEQ ID NO: 1445327 - RNA, 15 nt, Homo sapiens
acagcacuccaccuu

SEQ ID NO: 1445328 - RNA, 18 nt, Homo sapiens
acagcacuuggcuccuua

SEQ ID NO: 1445329 - RNA, 20 nt, Homo sapiens
acagcagggucuugcuguaa

SEQ ID NO: 1445330 - RNA, 12 nt, Homo sapiens
acagcagguggg

SEQ ID NO: 1445331 - RNA, 13 nt, Homo sapiens
acagcagugcaua

SEQ ID NO: 1445332 - RNA, 22 nt, Homo sapiens
acagcccgggugugccugcccu

SEQ ID NO: 1445333 - RNA, 23 nt, Homo sapiens
acagcgcguccuucccuaaagac

SEQ ID NO: 1445334 - RNA, 19 nt, Homo sapiens
acagcucagagaugaaacu

SEQ ID NO: 1445335 - RNA, 13 nt, Homo sapiens
acaggaaaccacu

SEQ ID NO: 1445336 - RNA, 13 nt, Homo sapiens
acaggacugauuc

SEQ ID NO: 1445337 - RNA, 16 nt, Homo sapiens
acaggagacccagaga

SEQ ID NO: 1445338 - RNA, 13 nt, Homo sapiens
acaggagcucuua

SEQ ID NO: 1445339 - RNA, 14 nt, Homo sapiens
acaggaggggccca

SEQ ID NO: 1445340 - RNA, 19 nt, Homo sapiens
acaggauccuauucucacc

SEQ ID NO: 1445341 - RNA, 21 nt, Homo sapiens
acaggcccuuccucuccacug

SEQ ID NO: 1445342 - RNA, 22 nt, Homo sapiens
acaggcccuuccucuccacugc

SEQ ID NO: 1445343 - RNA, 22 nt, Homo sapiens
acaggcuaguucuaauucccua

SEQ ID NO: 1445344 - RNA, 16 nt, Homo sapiens
acagggcagugacaag

SEQ ID NO: 1445345 - RNA, 17 nt, Homo sapiens
acagggcucccgaguca

SEQ ID NO: 1445346 - RNA, 20 nt, Homo sapiens
acagggucuaccucugucac

SEQ ID NO: 1445347 - RNA, 12 nt, Homo sapiens
acagggugcaug

SEQ ID NO: 1445348 - RNA, 19 nt, Homo sapiens
acagguguuuauacagcuc

SEQ ID NO: 1445349 - RNA, 13 nt, Homo sapiens
acaguacagugag

SEQ ID NO: 1445350 - RNA, 20 nt, Homo sapiens
acagucaccgacaacaugcu

SEQ ID NO: 1445351 - RNA, 18 nt, Homo sapiens
acaguccucacagccucu

SEQ ID NO: 1445352 - RNA, 14 nt, Homo sapiens
acagucuugcauuc

SEQ ID NO: 1445353 - RNA, 17 nt, Homo sapiens
acagugagugaccccag

SEQ ID NO: 1445354 - RNA, 15 nt, Homo sapiens
acaguuuggaagugu

SEQ ID NO: 1445355 - RNA, 16 nt, Homo sapiens
acaguuuugccuuaaa

SEQ ID NO: 1445356 - RNA, 22 nt, Homo sapiens
acauaacacuauaaagguugac

SEQ ID NO: 1445357 - RNA, 15 nt, Homo sapiens
acauaacaugcuuua

SEQ ID NO: 1445358 - RNA, 20 nt, Homo sapiens
acauacagagguaacuauca

SEQ ID NO: 1445359 - RNA, 14 nt, Homo sapiens
acauacauacacau

SEQ ID NO: 1445360 - RNA, 15 nt, Homo sapiens
acauacauacauaca

SEQ ID NO: 1445361 - RNA, 17 nt, Homo sapiens
acauacauacauauaua

SEQ ID NO: 1445362 - RNA, 12 nt, Homo sapiens
acauacauauau

SEQ ID NO: 1445363 - RNA, 16 nt, Homo sapiens
acauagagauaugcac

SEQ ID NO: 1445364 - RNA, 18 nt, Homo sapiens
acauagagauaugcacac

SEQ ID NO: 1445365 - RNA, 12 nt, Homo sapiens
acauagcacaga

SEQ ID NO: 1445366 - RNA, 19 nt, Homo sapiens
acauauaccuauaaugugu

SEQ ID NO: 1445367 - RNA, 19 nt, Homo sapiens
acauaucaauucaacacau

SEQ ID NO: 1445368 - RNA, 16 nt, Homo sapiens
acauaugcauuaugaa

SEQ ID NO: 1445369 - RNA, 15 nt, Homo sapiens
acauauugagcacuu

SEQ ID NO: 1445370 - RNA, 14 nt, Homo sapiens
acaucaacauuccc

SEQ ID NO: 1445371 - RNA, 23 nt, Homo sapiens
acaucaccuuuuugacuuuucca

SEQ ID NO: 1445372 - RNA, 20 nt, Homo sapiens
acaucacuuguacaaaauaa

SEQ ID NO: 1445373 - RNA, 15 nt, Homo sapiens
acaucagagugacau

SEQ ID NO: 1445374 - RNA, 16 nt, Homo sapiens
acaucauccuccuuau

SEQ ID NO: 1445375 - RNA, 16 nt, Homo sapiens
acaucccaagccagaa

SEQ ID NO: 1445376 - RNA, 14 nt, Homo sapiens
acaucccacugcca

SEQ ID NO: 1445377 - RNA, 14 nt, Homo sapiens
acaucuauguaucu

SEQ ID NO: 1445378 - RNA, 16 nt, Homo sapiens
acaucuuauuuacuug

SEQ ID NO: 1445379 - RNA, 15 nt, Homo sapiens
acaucuucucagugu

SEQ ID NO: 1445380 - RNA, 14 nt, Homo sapiens
acaucuuuccuguc

SEQ ID NO: 1445381 - RNA, 19 nt, Homo sapiens
acaugaacagaaacaauaa

SEQ ID NO: 1445382 - RNA, 23 nt, Homo sapiens
acaugaauugcauuuuacuuuaa

SEQ ID NO: 1445383 - RNA, 20 nt, Homo sapiens
acaugaccagaaaacaaauc

SEQ ID NO: 1445384 - RNA, 16 nt, Homo sapiens
acaugcaauuuugcau

SEQ ID NO: 1445385 - RNA, 15 nt, Homo sapiens
acaugccagcuuccu

SEQ ID NO: 1445386 - RNA, 15 nt, Homo sapiens
acaugcgaccgugac

SEQ ID NO: 1445387 - RNA, 22 nt, Homo sapiens
acauggagagagacucaaagag

SEQ ID NO: 1445388 - RNA, 23 nt, Homo sapiens
acauggggcauagaaacugagga

SEQ ID NO: 1445389 - RNA, 16 nt, Homo sapiens
acuguagcugaugaaa

SEQ ID NO: 1445390 - RNA, 12 nt, Homo sapiens
acugucaaguca

SEQ ID NO: 1445391 - RNA, 15 nt, Homo sapiens
acugucgagucccca

SEQ ID NO: 1445392 - RNA, 19 nt, Homo sapiens
acugugaggggaaggccuu

SEQ ID NO: 1445393 - RNA, 22 nt, Homo sapiens
acugugcugggaacauguacca

SEQ ID NO: 1445394 - RNA, 19 nt, Homo sapiens
acuguggagguacacucuu

SEQ ID NO: 1445395 - RNA, 15 nt, Homo sapiens
acuguggccuggcau

SEQ ID NO: 1445396 - RNA, 19 nt, Homo sapiens
acugugugaagaaauggaa

SEQ ID NO: 1445397 - RNA, 20 nt, Homo sapiens
acuguuggagcuacugcaaa

SEQ ID NO: 1445398 - RNA, 19 nt, Homo sapiens
acuuaaggauggagccagc

SEQ ID NO: 1445399 - RNA, 16 nt, Homo sapiens
acuuaaguggcauuaa

SEQ ID NO: 1445400 - RNA, 19 nt, Homo sapiens
acuucaauccauguaggaa

SEQ ID NO: 1445401 - RNA, 14 nt, Homo sapiens
acuucacaauguau

SEQ ID NO: 1445402 - RNA, 13 nt, Homo sapiens
acuucagcccagc

SEQ ID NO: 1445403 - RNA, 11 nt, Homo sapiens
acuucagucuu

SEQ ID NO: 1445404 - RNA, 23 nt, Homo sapiens
acuucauucagaccagugaaaga

SEQ ID NO: 1445405 - RNA, 11 nt, Homo sapiens
acuucccugaa

SEQ ID NO: 1445406 - RNA, 14 nt, Homo sapiens
acuucccugggaac

SEQ ID NO: 1445407 - RNA, 17 nt, Homo sapiens
acuuccuguguacucuu

SEQ ID NO: 1445408 - RNA, 15 nt, Homo sapiens
acuucuaaaugaagu

SEQ ID NO: 1445409 - RNA, 17 nt, Homo sapiens
acuucuaagagcauaga

SEQ ID NO: 1445410 - RNA, 22 nt, Homo sapiens
acuucuaaguaaaaccacagca

SEQ ID NO: 1445411 - RNA, 18 nt, Homo sapiens
acuucucaggacacaggc

SEQ ID NO: 1445412 - RNA, 17 nt, Homo sapiens
acuucugagaccuuguu

SEQ ID NO: 1445413 - RNA, 19 nt, Homo sapiens
acuucugccccagcuuuau

SEQ ID NO: 1445414 - RNA, 15 nt, Homo sapiens
acuucugucuucaca

SEQ ID NO: 1445415 - RNA, 22 nt, Homo sapiens
acuucugucuucacaacagauu

SEQ ID NO: 1445416 - RNA, 16 nt, Homo sapiens
acuugaacccaggucu

SEQ ID NO: 1445417 - RNA, 15 nt, Homo sapiens
acuugaauacucuca

SEQ ID NO: 1445418 - RNA, 19 nt, Homo sapiens
acuugacaacaucccacag

SEQ ID NO: 1445419 - RNA, 13 nt, Homo sapiens
acuugacauuccu

SEQ ID NO: 1445420 - RNA, 13 nt, Homo sapiens
acuugagcaccgu

SEQ ID NO: 1445421 - RNA, 21 nt, Homo sapiens
acuugaugacagacacuucua

SEQ ID NO: 1445422 - RNA, 13 nt, Homo sapiens
acuugauuccuug

SEQ ID NO: 1445423 - RNA, 21 nt, Homo sapiens
acuugcccugccacuuugcau

SEQ ID NO: 1445424 - RNA, 14 nt, Homo sapiens
acuugcguccugca

SEQ ID NO: 1445425 - RNA, 20 nt, Homo sapiens
acuugcugaauuucaggcau

SEQ ID NO: 1445426 - RNA, 19 nt, Homo sapiens
acuuguugcugauucaaga

SEQ ID NO: 1445427 - RNA, 20 nt, Homo sapiens
acuuguugcugauucaagaa

SEQ ID NO: 1445428 - RNA, 21 nt, Homo sapiens
acuuguuucaccauacuucau

SEQ ID NO: 1445429 - RNA, 13 nt, Homo sapiens
acuuuaacccucu

SEQ ID NO: 1445430 - RNA, 17 nt, Homo sapiens
acuuuaacccucucuuc

SEQ ID NO: 1445431 - RNA, 18 nt, Homo sapiens
acuuuaacccucucuucc

SEQ ID NO: 1445432 - RNA, 14 nt, Homo sapiens
acuuuaaccuuaga

SEQ ID NO: 1445433 - RNA, 13 nt, Homo sapiens
acuuuaauucuca

SEQ ID NO: 1445434 - RNA, 19 nt, Homo sapiens
acuuuauuuguauuugcca

SEQ ID NO: 1445435 - RNA, 15 nt, Homo sapiens
acuuucagaguuuga

SEQ ID NO: 1445436 - RNA, 18 nt, Homo sapiens
acuuucagguacuaaaua

SEQ ID NO: 1445437 - RNA, 14 nt, Homo sapiens
acuuucucugcaaa

SEQ ID NO: 1445438 - RNA, 14 nt, Homo sapiens
acuuugaauaaugg

SEQ ID NO: 1445439 - RNA, 22 nt, Homo sapiens
acuuugaauaauggaaucuaua

SEQ ID NO: 1445440 - RNA, 18 nt, Homo sapiens
acuuuguguuuucaucuc

SEQ ID NO: 1445441 - RNA, 20 nt, Homo sapiens
acuuuugugcuccccuuugc

SEQ ID NO: 1445442 - RNA, 16 nt, Homo sapiens
acuuuuuagccaguga

SEQ ID NO: 1445443 - RNA, 12 nt, Homo sapiens
agaaaacacagc

SEQ ID NO: 1445444 - RNA, 15 nt, Homo sapiens
agaaaaucaguaauu

SEQ ID NO: 1445445 - RNA, 16 nt, Homo sapiens
agaaaaugaagcccua

SEQ ID NO: 1445446 - RNA, 16 nt, Homo sapiens
agaaaauuaguaauug

SEQ ID NO: 1445447 - RNA, 21 nt, Homo sapiens
agaaacacaaauguaaaauaa

SEQ ID NO: 1445448 - RNA, 19 nt, Homo sapiens
agaaacacucuuauuccca

SEQ ID NO: 1445449 - RNA, 20 nt, Homo sapiens
agaaacagauaccauacuca

SEQ ID NO: 1445450 - RNA, 12 nt, Homo sapiens
agaaacaugaca

SEQ ID NO: 1445451 - RNA, 20 nt, Homo sapiens
agaaacaugacacugaccuu

SEQ ID NO: 1445452 - RNA, 17 nt, Homo sapiens
agaaacguaacugugug

SEQ ID NO: 1445453 - RNA, 14 nt, Homo sapiens
agaaacuuaaacaa

SEQ ID NO: 1445454 - RNA, 17 nt, Homo sapiens
agaaagaggcagugauu

SEQ ID NO: 1445455 - RNA, 12 nt, Homo sapiens
agaaaguauuug

SEQ ID NO: 1445456 - RNA, 14 nt, Homo sapiens
agaaagugcagaau

SEQ ID NO: 1445457 - RNA, 19 nt, Homo sapiens
agaaauaaaaauaccucuu

SEQ ID NO: 1445458 - RNA, 17 nt, Homo sapiens
agaaauagacaguauau

SEQ ID NO: 1445459 - RNA, 13 nt, Homo sapiens
agaaaugggagaa

SEQ ID NO: 1445460 - RNA, 22 nt, Homo sapiens
agaaauuccuguagcaucuucu

SEQ ID NO: 1445461 - RNA, 12 nt, Homo sapiens
agaacacccacu

SEQ ID NO: 1445462 - RNA, 15 nt, Homo sapiens
agaaccuaaaguagc

SEQ ID NO: 1445463 - RNA, 23 nt, Homo sapiens
agaaccuggcagguuagaaccua

SEQ ID NO: 1445464 - RNA, 19 nt, Homo sapiens
agaacugaggucacugggu

SEQ ID NO: 1445465 - RNA, 22 nt, Homo sapiens
agaagaaaaaguugcagucuca

SEQ ID NO: 1445466 - RNA, 13 nt, Homo sapiens
agaagaccagacu

SEQ ID NO: 1445467 - RNA, 13 nt, Homo sapiens
agaagacuggaag

SEQ ID NO: 1445468 - RNA, 14 nt, Homo sapiens
agaagagcuguuca

SEQ ID NO: 1445469 - RNA, 16 nt, Homo sapiens
agaagaggcuggugcu

SEQ ID NO: 1445470 - RNA, 19 nt, Homo sapiens
agaagaucuaauaccaucc

SEQ ID NO: 1445471 - RNA, 16 nt, Homo sapiens
agaagcacauaugaac

SEQ ID NO: 1445472 - RNA, 17 nt, Homo sapiens
agaagcaucaccaugca

SEQ ID NO: 1445473 - RNA, 18 nt, Homo sapiens
agaagccaaaauacuucu

SEQ ID NO: 1445474 - RNA, 20 nt, Homo sapiens
agaagccacgcuguccucuc

SEQ ID NO: 1445475 - RNA, 21 nt, Homo sapiens
agaagccagacugguuagaca

SEQ ID NO: 1445476 - RNA, 18 nt, Homo sapiens
agccuugcaucaagggcu

SEQ ID NO: 1445477 - RNA, 22 nt, Homo sapiens
agcgaaauauuacaguagugca

SEQ ID NO: 1445478 - RNA, 14 nt, Homo sapiens
agcgaaucaucuca

SEQ ID NO: 1445479 - RNA, 22 nt, Homo sapiens
agcgcagguuuaguuuacucaa

SEQ ID NO: 1445480 - RNA, 23 nt, Homo sapiens
agcgcuguguuaggcacaggcug

SEQ ID NO: 1445481 - RNA, 14 nt, Homo sapiens
agcggaucucacuc

SEQ ID NO: 1445482 - RNA, 13 nt, Homo sapiens
agcgguaccccag

SEQ ID NO: 1445483 - RNA, 18 nt, Homo sapiens
agcguaacaaacaaaauc

SEQ ID NO: 1445484 - RNA, 16 nt, Homo sapiens
agcgucccuagcagug

SEQ ID NO: 1445485 - RNA, 18 nt, Homo sapiens
agcgucccuagcagugaa

SEQ ID NO: 1445486 - RNA, 15 nt, Homo sapiens
agcgugaaagcagau

SEQ ID NO: 1445487 - RNA, 22 nt, Homo sapiens
agcuacaaggaggacuugcagg

SEQ ID NO: 1445488 - RNA, 17 nt, Homo sapiens
agcuacucucuugccag

SEQ ID NO: 1445489 - RNA, 12 nt, Homo sapiens
agcuagaaccua

SEQ ID NO: 1445490 - RNA, 15 nt, Homo sapiens
agcuagaaccuggag

SEQ ID NO: 1445491 - RNA, 12 nt, Homo sapiens
agcuagccagag

SEQ ID NO: 1445492 - RNA, 14 nt, Homo sapiens
agcucacaagccca

SEQ ID NO: 1445493 - RNA, 14 nt, Homo sapiens
agcucacaguacaa

SEQ ID NO: 1445494 - RNA, 16 nt, Homo sapiens
agcucagacuugccag

SEQ ID NO: 1445495 - RNA, 18 nt, Homo sapiens
agcucagccgugcacucc

SEQ ID NO: 1445496 - RNA, 16 nt, Homo sapiens
agcuccucugcugcuc

SEQ ID NO: 1445497 - RNA, 14 nt, Homo sapiens
agcuccuugacucc

SEQ ID NO: 1445498 - RNA, 18 nt, Homo sapiens
agcucugaacaaacacug

SEQ ID NO: 1445499 - RNA, 14 nt, Homo sapiens
agcucuggaccagc

SEQ ID NO: 1445500 - RNA, 15 nt, Homo sapiens
agcucuguuuuacaa

SEQ ID NO: 1445501 - RNA, 20 nt, Homo sapiens
agcucuuacacuacauuaga

SEQ ID NO: 1445502 - RNA, 12 nt, Homo sapiens
agcugaacccau

SEQ ID NO: 1445503 - RNA, 12 nt, Homo sapiens
agcugaagugaa

SEQ ID NO: 1445504 - RNA, 13 nt, Homo sapiens
agcugacaucucc

SEQ ID NO: 1445505 - RNA, 21 nt, Homo sapiens
agcugagaagaagcugaggau

SEQ ID NO: 1445506 - RNA, 18 nt, Homo sapiens
agcugagaggaagaugaa

SEQ ID NO: 1445507 - RNA, 19 nt, Homo sapiens
agcugagaggaagaugaag

SEQ ID NO: 1445508 - RNA, 15 nt, Homo sapiens
agcugcacauuccug

SEQ ID NO: 1445509 - RNA, 13 nt, Homo sapiens
agcugcaucuacu

SEQ ID NO: 1445510 - RNA, 20 nt, Homo sapiens
agcugcaugggugccugcug

SEQ ID NO: 1445511 - RNA, 11 nt, Homo sapiens
agcugccaaaa

SEQ ID NO: 1445512 - RNA, 14 nt, Homo sapiens
agcugccaagcacu

SEQ ID NO: 1445513 - RNA, 16 nt, Homo sapiens
agcugcucccaaauaa

SEQ ID NO: 1445514 - RNA, 21 nt, Homo sapiens
agcugcugaaacaacaaauag

SEQ ID NO: 1445515 - RNA, 20 nt, Homo sapiens
agcugcuguccuuuuaggaa

SEQ ID NO: 1445516 - RNA, 21 nt, Homo sapiens
agcugcuugacuaucacauac

SEQ ID NO: 1445517 - RNA, 14 nt, Homo sapiens
agcuggaacccugg

SEQ ID NO: 1445518 - RNA, 14 nt, Homo sapiens
agcuggaagcacau

SEQ ID NO: 1445519 - RNA, 12 nt, Homo sapiens
agcuggugcugc

SEQ ID NO: 1445520 - RNA, 20 nt, Homo sapiens
agcuguauauauauaugugu

SEQ ID NO: 1445521 - RNA, 15 nt, Homo sapiens
agcugucgcaucuca

SEQ ID NO: 1445522 - RNA, 14 nt, Homo sapiens
agcugucuccagga

SEQ ID NO: 1445523 - RNA, 17 nt, Homo sapiens
agcuguguucacacugu

SEQ ID NO: 1445524 - RNA, 13 nt, Homo sapiens
agcuuaccugaca

SEQ ID NO: 1445525 - RNA, 14 nt, Homo sapiens
agcuucagacuuuu

SEQ ID NO: 1445526 - RNA, 18 nt, Homo sapiens
agcuucucugaugugaua

SEQ ID NO: 1445527 - RNA, 14 nt, Homo sapiens
agcuuggacagucu

SEQ ID NO: 1445528 - RNA, 13 nt, Homo sapiens
agcuuucucaggg

SEQ ID NO: 1445529 - RNA, 13 nt, Homo sapiens
agcuuugcaggau

SEQ ID NO: 1445530 - RNA, 20 nt, Homo sapiens
agcuuuugaggggcugacuu

SEQ ID NO: 1445531 - RNA, 14 nt, Homo sapiens
agcuuuugcuucau

SEQ ID NO: 1445532 - RNA, 15 nt, Homo sapiens
aggaaaaaaaugacu

SEQ ID NO: 1445533 - RNA, 22 nt, Homo sapiens
aggaaaccuggcauggugcuuu

SEQ ID NO: 1445534 - RNA, 21 nt, Homo sapiens
aggaaagccaaacacuguuuc

SEQ ID NO: 1445535 - RNA, 14 nt, Homo sapiens
aggaaagcccuccc

SEQ ID NO: 1445536 - RNA, 12 nt, Homo sapiens
aggaaagggauu

SEQ ID NO: 1445537 - RNA, 18 nt, Homo sapiens
aggaaaggggcgagcacc

SEQ ID NO: 1445538 - RNA, 22 nt, Homo sapiens
aggaaaucaaauaugcaaagca

SEQ ID NO: 1445539 - RNA, 15 nt, Homo sapiens
aggaacaagagaaaa

SEQ ID NO: 1445540 - RNA, 22 nt, Homo sapiens
aggaacccuuuuccuccagaca

SEQ ID NO: 1445541 - RNA, 19 nt, Homo sapiens
aggaaccucaaacugggua

SEQ ID NO: 1445542 - RNA, 12 nt, Homo sapiens
aggaacuguaca

SEQ ID NO: 1445543 - RNA, 15 nt, Homo sapiens
aggaagaagccagac

SEQ ID NO: 1445544 - RNA, 14 nt, Homo sapiens
aggaagacuugaag

SEQ ID NO: 1445545 - RNA, 20 nt, Homo sapiens
aggaagacuugaagcacaga

SEQ ID NO: 1445546 - RNA, 17 nt, Homo sapiens
aggaagcaagaaagccg

SEQ ID NO: 1445547 - RNA, 19 nt, Homo sapiens
aggaagccccaagccaugg

SEQ ID NO: 1445548 - RNA, 15 nt, Homo sapiens
aggaaggcagcugcu

SEQ ID NO: 1445549 - RNA, 15 nt, Homo sapiens
aggaagguggugcuu

SEQ ID NO: 1445550 - RNA, 18 nt, Homo sapiens
aggaauaagaauggagca

SEQ ID NO: 1445551 - RNA, 14 nt, Homo sapiens
aggaaucugccauu

SEQ ID NO: 1445552 - RNA, 21 nt, Homo sapiens
aggaauguccagacugugggu

SEQ ID NO: 1445553 - RNA, 15 nt, Homo sapiens
aggaauuguuuuuau

SEQ ID NO: 1445554 - RNA, 18 nt, Homo sapiens
aggacaaccauuccagac

SEQ ID NO: 1445555 - RNA, 11 nt, Homo sapiens
aggacaaugcc

SEQ ID NO: 1445556 - RNA, 19 nt, Homo sapiens
aggacaccagccuggugcc

SEQ ID NO: 1445557 - RNA, 18 nt, Homo sapiens
aggacagccgccuggaga

SEQ ID NO: 1445558 - RNA, 15 nt, Homo sapiens
aggaccugagccugc

SEQ ID NO: 1445559 - RNA, 15 nt, Homo sapiens
aggacuaacacucag

SEQ ID NO: 1445560 - RNA, 13 nt, Homo sapiens
aggacuugaaccc

SEQ ID NO: 1445561 - RNA, 19 nt, Homo sapiens
aggacuugugucucugugc

SEQ ID NO: 1445562 - RNA, 13 nt, Homo sapiens
aggagaaacugag

SEQ ID NO: 1445563 - RNA, 12 nt, Homo sapiens
aggagaagcagc

SEQ ID NO: 1445564 - RNA, 18 nt, Homo sapiens
caaucuccccuugcacua

SEQ ID NO: 1445565 - RNA, 17 nt, Homo sapiens
caaucuguucaauguuu

SEQ ID NO: 1445566 - RNA, 22 nt, Homo sapiens
caaugaccuguauuuugccaga

SEQ ID NO: 1445567 - RNA, 14 nt, Homo sapiens
caaugaugauuaaa

SEQ ID NO: 1445568 - RNA, 16 nt, Homo sapiens
caaugauucauaacaa

SEQ ID NO: 1445569 - RNA, 15 nt, Homo sapiens
caaugcacacacaca

SEQ ID NO: 1445570 - RNA, 17 nt, Homo sapiens
caaugcacacacacaga

SEQ ID NO: 1445571 - RNA, 18 nt, Homo sapiens
caaugcacauccauuccc

SEQ ID NO: 1445572 - RNA, 10 nt, Homo sapiens
caaugccauc

SEQ ID NO: 1445573 - RNA, 18 nt, Homo sapiens
caauggaaacuguaccau

SEQ ID NO: 1445574 - RNA, 21 nt, Homo sapiens
caauggagugggagaucagcc

SEQ ID NO: 1445575 - RNA, 19 nt, Homo sapiens
caauguuuuuaaaaaucug

SEQ ID NO: 1445576 - RNA, 19 nt, Homo sapiens
caauuaaacagccaaauaa

SEQ ID NO: 1445577 - RNA, 21 nt, Homo sapiens
caauuagcaauugacugucac

SEQ ID NO: 1445578 - RNA, 23 nt, Homo sapiens
caauuauggagugucaccagcug

SEQ ID NO: 1445579 - RNA, 15 nt, Homo sapiens
caauucccauugcau

SEQ ID NO: 1445580 - RNA, 17 nt, Homo sapiens
caauucuccugccucag

SEQ ID NO: 1445581 - RNA, 20 nt, Homo sapiens
caauugacugucacuguucc

SEQ ID NO: 1445582 - RNA, 15 nt, Homo sapiens
caauuguacauuccc

SEQ ID NO: 1445583 - RNA, 18 nt, Homo sapiens
caauuguccccagggaca

SEQ ID NO: 1445584 - RNA, 12 nt, Homo sapiens
caauugucugcc

SEQ ID NO: 1445585 - RNA, 14 nt, Homo sapiens
caauuucaguguau

SEQ ID NO: 1445586 - RNA, 18 nt, Homo sapiens
caauuuuuauacauauca

SEQ ID NO: 1445587 - RNA, 16 nt, Homo sapiens
caauuuuuugcuaaac

SEQ ID NO: 1445588 - RNA, 21 nt, Homo sapiens
cacaaaaaggcauaugcaaua

SEQ ID NO: 1445589 - RNA, 13 nt, Homo sapiens
cacaaacuuuaaa

SEQ ID NO: 1445590 - RNA, 11 nt, Homo sapiens
cacaacauuua

SEQ ID NO: 1445591 - RNA, 17 nt, Homo sapiens
cacaacauuuacuuaac

SEQ ID NO: 1445592 - RNA, 20 nt, Homo sapiens
cacaaggcugaccaagagag

SEQ ID NO: 1445593 - RNA, 21 nt, Homo sapiens
cacaaggcugaccaagagaga

SEQ ID NO: 1445594 - RNA, 17 nt, Homo sapiens
cacaaguagggagcuca

SEQ ID NO: 1445595 - RNA, 17 nt, Homo sapiens
cacaaucugggacuuuc

SEQ ID NO: 1445596 - RNA, 22 nt, Homo sapiens
cacaaucuuuccuugucucuca

SEQ ID NO: 1445597 - RNA, 15 nt, Homo sapiens
cacacaacagcagau

SEQ ID NO: 1445598 - RNA, 13 nt, Homo sapiens
cacacacagaugc

SEQ ID NO: 1445599 - RNA, 13 nt, Homo sapiens
cacacacauggau

SEQ ID NO: 1445600 - RNA, 13 nt, Homo sapiens
cacacaccucuag

SEQ ID NO: 1445601 - RNA, 19 nt, Homo sapiens
cacacacgccaaugcacac

SEQ ID NO: 1445602 - RNA, 22 nt, Homo sapiens
cacacacggaugcacacacaga

SEQ ID NO: 1445603 - RNA, 15 nt, Homo sapiens
cacacagagauaugc

SEQ ID NO: 1445604 - RNA, 17 nt, Homo sapiens
cacacagagauaugcac

SEQ ID NO: 1445605 - RNA, 21 nt, Homo sapiens
cacacagauaccccacguucu

SEQ ID NO: 1445606 - RNA, 15 nt, Homo sapiens
cacacagauaugcac

SEQ ID NO: 1445607 - RNA, 21 nt, Homo sapiens
cacacagaugcacacacagau

SEQ ID NO: 1445608 - RNA, 22 nt, Homo sapiens
cacacagauggucacacagaga

SEQ ID NO: 1445609 - RNA, 15 nt, Homo sapiens
cacacaucagugcac

SEQ ID NO: 1445610 - RNA, 18 nt, Homo sapiens
cacaccaaugcgcacaca

SEQ ID NO: 1445611 - RNA, 16 nt, Homo sapiens
cacaccgauguacaca

SEQ ID NO: 1445612 - RNA, 15 nt, Homo sapiens
cacaccgaugugcgc

SEQ ID NO: 1445613 - RNA, 20 nt, Homo sapiens
cacaccucacgcucuggaca

SEQ ID NO: 1445614 - RNA, 10 nt, Homo sapiens
cacaccucau

SEQ ID NO: 1445615 - RNA, 15 nt, Homo sapiens
cacacgcaggaacuc

SEQ ID NO: 1445616 - RNA, 20 nt, Homo sapiens
cacacuguaaauauccacag

SEQ ID NO: 1445617 - RNA, 16 nt, Homo sapiens
cacagagauaugcaca

SEQ ID NO: 1445618 - RNA, 14 nt, Homo sapiens
cacagagguuuuaa

SEQ ID NO: 1445619 - RNA, 15 nt, Homo sapiens
cacagauaugcacac

SEQ ID NO: 1445620 - RNA, 16 nt, Homo sapiens
cacagauaugcacaca

SEQ ID NO: 1445621 - RNA, 22 nt, Homo sapiens
cacagaugauuaaacagacuuu

SEQ ID NO: 1445622 - RNA, 13 nt, Homo sapiens
cacagaugcacac

SEQ ID NO: 1445623 - RNA, 17 nt, Homo sapiens
cacagcaagaugaauuu

SEQ ID NO: 1445624 - RNA, 13 nt, Homo sapiens
cacagcacccagg

SEQ ID NO: 1445625 - RNA, 15 nt, Homo sapiens
cacagcaguucugca

SEQ ID NO: 1445626 - RNA, 13 nt, Homo sapiens
cacagcccaagag

SEQ ID NO: 1445627 - RNA, 14 nt, Homo sapiens
cacagcccaagagg

SEQ ID NO: 1445628 - RNA, 19 nt, Homo sapiens
cacaggaacugggagauaa

SEQ ID NO: 1445629 - RNA, 22 nt, Homo sapiens
cacaggagacacugugcuauaa

SEQ ID NO: 1445630 - RNA, 22 nt, Homo sapiens
cacaggcagcuggaugagacuu

SEQ ID NO: 1445631 - RNA, 23 nt, Homo sapiens
cacaggccuguguagcugugacc

SEQ ID NO: 1445632 - RNA, 13 nt, Homo sapiens
cacagguuuucag

SEQ ID NO: 1445633 - RNA, 12 nt, Homo sapiens
cacagucauuca

SEQ ID NO: 1445634 - RNA, 13 nt, Homo sapiens
cacagucauucac

SEQ ID NO: 1445635 - RNA, 13 nt, Homo sapiens
cacagucucaguc

SEQ ID NO: 1445636 - RNA, 15 nt, Homo sapiens
cacagugcaucucag

SEQ ID NO: 1445637 - RNA, 18 nt, Homo sapiens
cacagugggugaggagau

SEQ ID NO: 1445638 - RNA, 21 nt, Homo sapiens
cacauaaacacauacauugcc

SEQ ID NO: 1445639 - RNA, 16 nt, Homo sapiens
cacauaacaugcuuua

SEQ ID NO: 1445640 - RNA, 15 nt, Homo sapiens
cacauacaauuugca

SEQ ID NO: 1445641 - RNA, 22 nt, Homo sapiens
cacauagauuaauggcacugau

SEQ ID NO: 1445642 - RNA, 13 nt, Homo sapiens
cacauccauuccc

SEQ ID NO: 1445643 - RNA, 15 nt, Homo sapiens
cacauggacacagac

SEQ ID NO: 1445644 - RNA, 16 nt, Homo sapiens
cacauggaugcacaca

SEQ ID NO: 1445645 - RNA, 17 nt, Homo sapiens
cacauuaaguggcuuuu

SEQ ID NO: 1445646 - RNA, 16 nt, Homo sapiens
cacauuacuugcacaa

SEQ ID NO: 1445647 - RNA, 17 nt, Homo sapiens
cacauucccaucuguca

SEQ ID NO: 1445648 - RNA, 18 nt, Homo sapiens
cacauuuauauauauaug

SEQ ID NO: 1445649 - RNA, 15 nt, Homo sapiens
caccaaaguauuaau

SEQ ID NO: 1445650 - RNA, 22 nt, Homo sapiens
caccaaguucuggaaaccacgu

SEQ ID NO: 1445651 - RNA, 14 nt, Homo sapiens
cagguccuuccuuu

SEQ ID NO: 1445652 - RNA, 17 nt, Homo sapiens
caggucuagacuuucuc

SEQ ID NO: 1445653 - RNA, 22 nt, Homo sapiens
caggugagcaauuagauuagua

SEQ ID NO: 1445654 - RNA, 22 nt, Homo sapiens
caggugauccacccaccuuggc

SEQ ID NO: 1445655 - RNA, 20 nt, Homo sapiens
caggugcaagccacuauguc

SEQ ID NO: 1445656 - RNA, 17 nt, Homo sapiens
caggugguccugagacc

SEQ ID NO: 1445657 - RNA, 14 nt, Homo sapiens
cagguguuuauaca

SEQ ID NO: 1445658 - RNA, 16 nt, Homo sapiens
cagguguuuauacagc

SEQ ID NO: 1445659 - RNA, 17 nt, Homo sapiens
cagguucagacugagcu

SEQ ID NO: 1445660 - RNA, 17 nt, Homo sapiens
cagguuccaucccgaaa

SEQ ID NO: 1445661 - RNA, 17 nt, Homo sapiens
cagguucccagcagcug

SEQ ID NO: 1445662 - RNA, 23 nt, Homo sapiens
cagguugccugggccacggugcc

SEQ ID NO: 1445663 - RNA, 12 nt, Homo sapiens
cagguuugccag

SEQ ID NO: 1445664 - RNA, 15 nt, Homo sapiens
caguaaaaacuugua

SEQ ID NO: 1445665 - RNA, 23 nt, Homo sapiens
caguaaacuuucucugcaaagac

SEQ ID NO: 1445666 - RNA, 19 nt, Homo sapiens
caguaaauauuaaccugaa

SEQ ID NO: 1445667 - RNA, 13 nt, Homo sapiens
caguacaauguuu

SEQ ID NO: 1445668 - RNA, 19 nt, Homo sapiens
caguacaugggaaaggagg

SEQ ID NO: 1445669 - RNA, 20 nt, Homo sapiens
caguagaggcaugaacacac

SEQ ID NO: 1445670 - RNA, 15 nt, Homo sapiens
caguaugaaugaugu

SEQ ID NO: 1445671 - RNA, 17 nt, Homo sapiens
caguauuccaugggaug

SEQ ID NO: 1445672 - RNA, 18 nt, Homo sapiens
cagucuacguucuccagc

SEQ ID NO: 1445673 - RNA, 16 nt, Homo sapiens
cagucucagaaagccu

SEQ ID NO: 1445674 - RNA, 19 nt, Homo sapiens
cagucucccauucucauau

SEQ ID NO: 1445675 - RNA, 12 nt, Homo sapiens
cagucuuggaau

SEQ ID NO: 1445676 - RNA, 12 nt, Homo sapiens
cagugacuggca

SEQ ID NO: 1445677 - RNA, 20 nt, Homo sapiens
cagugacugucguguuuaca

SEQ ID NO: 1445678 - RNA, 18 nt, Homo sapiens
cagugagaaaaagcuccu

SEQ ID NO: 1445679 - RNA, 18 nt, Homo sapiens
cagugagaagacuggcag

SEQ ID NO: 1445680 - RNA, 20 nt, Homo sapiens
cagugagccgagauugcgcc

SEQ ID NO: 1445681 - RNA, 22 nt, Homo sapiens
cagugagccgcaucuucuccau

SEQ ID NO: 1445682 - RNA, 23 nt, Homo sapiens
cagugauggcgcgggaggcacca

SEQ ID NO: 1445683 - RNA, 17 nt, Homo sapiens
cagugcaaccacacacc

SEQ ID NO: 1445684 - RNA, 11 nt, Homo sapiens
cagugcaagag

SEQ ID NO: 1445685 - RNA, 19 nt, Homo sapiens
cagugcacacggaugcaca

SEQ ID NO: 1445686 - RNA, 13 nt, Homo sapiens
cagugcccaugca

SEQ ID NO: 1445687 - RNA, 18 nt, Homo sapiens
cagugcccaugcaauggc

SEQ ID NO: 1445688 - RNA, 19 nt, Homo sapiens
cagugcccuuuucaucucc

SEQ ID NO: 1445689 - RNA, 16 nt, Homo sapiens
cagugccuggcaaggc

SEQ ID NO: 1445690 - RNA, 23 nt, Homo sapiens
caguggcugaauagcuucuccaa

SEQ ID NO: 1445691 - RNA, 18 nt, Homo sapiens
caguggugcgaucuuggc

SEQ ID NO: 1445692 - RNA, 20 nt, Homo sapiens
caguguccccuccacuguca

SEQ ID NO: 1445693 - RNA, 21 nt, Homo sapiens
caguguccccuccacugucac

SEQ ID NO: 1445694 - RNA, 19 nt, Homo sapiens
caguguccucuugcucaaa

SEQ ID NO: 1445695 - RNA, 20 nt, Homo sapiens
caguguuugggguguuucaa

SEQ ID NO: 1445696 - RNA, 23 nt, Homo sapiens
caguuccuccaagaggucuccau

SEQ ID NO: 1445697 - RNA, 16 nt, Homo sapiens
caguugggagcacugg

SEQ ID NO: 1445698 - RNA, 16 nt, Homo sapiens
caguuguuccuacuca

SEQ ID NO: 1445699 - RNA, 22 nt, Homo sapiens
cauaaaucuuguaaucauguua

SEQ ID NO: 1445700 - RNA, 20 nt, Homo sapiens
cauaaccccaggcaucccau

SEQ ID NO: 1445701 - RNA, 15 nt, Homo sapiens
cauaacuaguuuaau

SEQ ID NO: 1445702 - RNA, 14 nt, Homo sapiens
cauaacuucucuga

SEQ ID NO: 1445703 - RNA, 17 nt, Homo sapiens
cauaacuugcugaauuu

SEQ ID NO: 1445704 - RNA, 14 nt, Homo sapiens
cauaagaacgucau

SEQ ID NO: 1445705 - RNA, 19 nt, Homo sapiens
cauaagucuaaauaaauga

SEQ ID NO: 1445706 - RNA, 13 nt, Homo sapiens
cauaagugcaaua

SEQ ID NO: 1445707 - RNA, 14 nt, Homo sapiens
cauaauuagaacaa

SEQ ID NO: 1445708 - RNA, 18 nt, Homo sapiens
cauaauuugaauggugca

SEQ ID NO: 1445709 - RNA, 17 nt, Homo sapiens
cauacacucaaacaauc

SEQ ID NO: 1445710 - RNA, 19 nt, Homo sapiens
cauacacucaaacaaucau

SEQ ID NO: 1445711 - RNA, 15 nt, Homo sapiens
cauacauacauauau

SEQ ID NO: 1445712 - RNA, 14 nt, Homo sapiens
cauacauugccaau

SEQ ID NO: 1445713 - RNA, 13 nt, Homo sapiens
cauacuuggacag

SEQ ID NO: 1445714 - RNA, 19 nt, Homo sapiens
cauagaaacaugacacuga

SEQ ID NO: 1445715 - RNA, 19 nt, Homo sapiens
cauagaaauuacacccaaa

SEQ ID NO: 1445716 - RNA, 21 nt, Homo sapiens
cauagaaauuacacccaaaga

SEQ ID NO: 1445717 - RNA, 15 nt, Homo sapiens
cauagagauaugcac

SEQ ID NO: 1445718 - RNA, 16 nt, Homo sapiens
cauagagauaugcaca

SEQ ID NO: 1445719 - RNA, 17 nt, Homo sapiens
cauagagauaugcacac

SEQ ID NO: 1445720 - RNA, 20 nt, Homo sapiens
cauagagauaugcacacaca

SEQ ID NO: 1445721 - RNA, 17 nt, Homo sapiens
cauagauuaauggcacu

SEQ ID NO: 1445722 - RNA, 12 nt, Homo sapiens
cauagccuauaa

SEQ ID NO: 1445723 - RNA, 19 nt, Homo sapiens
cauagcgcuggcucaggaa

SEQ ID NO: 1445724 - RNA, 20 nt, Homo sapiens
cauagcgcuggcucaggaag

SEQ ID NO: 1445725 - RNA, 20 nt, Homo sapiens
cauaguucuuacuacuugcc

SEQ ID NO: 1445726 - RNA, 15 nt, Homo sapiens
cauauaccuauaaug

SEQ ID NO: 1445727 - RNA, 13 nt, Homo sapiens
cauauauauguau

SEQ ID NO: 1445728 - RNA, 17 nt, Homo sapiens
cauaucacguacaccau

SEQ ID NO: 1445729 - RNA, 14 nt, Homo sapiens
cauaucagaccucu

SEQ ID NO: 1445730 - RNA, 22 nt, Homo sapiens
cauaucauuuuuuuaacacaua

SEQ ID NO: 1445731 - RNA, 11 nt, Homo sapiens
cauaugcauuu

SEQ ID NO: 1445732 - RNA, 22 nt, Homo sapiens
cauauugacuuaauugcagcuu

SEQ ID NO: 1445733 - RNA, 19 nt, Homo sapiens
caucaaauauuaccaaaaa

SEQ ID NO: 1445734 - RNA, 13 nt, Homo sapiens
caucaagcuguac

SEQ ID NO: 1445735 - RNA, 17 nt, Homo sapiens
caucaauucccauugca

SEQ ID NO: 1445736 - RNA, 16 nt, Homo sapiens
caucacagcagugcau

SEQ ID NO: 1445737 - RNA, 19 nt, Homo sapiens
caucacccaguccuggcca

SEQ ID NO: 1445738 - RNA, 16 nt, Homo sapiens
ccaguccgccaaacac

SEQ ID NO: 1445739 - RNA, 20 nt, Homo sapiens
ccaguccuggggagcuucac

SEQ ID NO: 1445740 - RNA, 13 nt, Homo sapiens
ccagugaaccaaa

SEQ ID NO: 1445741 - RNA, 16 nt, Homo sapiens
ccagugaaccaaagag

SEQ ID NO: 1445742 - RNA, 17 nt, Homo sapiens
ccagugaaccaaagaga

SEQ ID NO: 1445743 - RNA, 17 nt, Homo sapiens
ccagugcaacaaaauca

SEQ ID NO: 1445744 - RNA, 13 nt, Homo sapiens
ccagugcagggaa

SEQ ID NO: 1445745 - RNA, 19 nt, Homo sapiens
ccaguggugaagaaaacuc

SEQ ID NO: 1445746 - RNA, 19 nt, Homo sapiens
ccaguuugcuuaguucuca

SEQ ID NO: 1445747 - RNA, 13 nt, Homo sapiens
ccauaaagugcca

SEQ ID NO: 1445748 - RNA, 12 nt, Homo sapiens
ccauaacagcca

SEQ ID NO: 1445749 - RNA, 13 nt, Homo sapiens
ccauaacagccaa

SEQ ID NO: 1445750 - RNA, 21 nt, Homo sapiens
ccauaaccccaggcaucccau

SEQ ID NO: 1445751 - RNA, 22 nt, Homo sapiens
ccauagaaacaugacacugacc

SEQ ID NO: 1445752 - RNA, 19 nt, Homo sapiens
ccauagcaagauugcuuaa

SEQ ID NO: 1445753 - RNA, 20 nt, Homo sapiens
ccauagugcacuagcauuuu

SEQ ID NO: 1445754 - RNA, 14 nt, Homo sapiens
ccaucaaaugcugu

SEQ ID NO: 1445755 - RNA, 15 nt, Homo sapiens
ccaucacacaugcau

SEQ ID NO: 1445756 - RNA, 15 nt, Homo sapiens
ccaucaccuacucac

SEQ ID NO: 1445757 - RNA, 13 nt, Homo sapiens
ccaucacuggaau

SEQ ID NO: 1445758 - RNA, 12 nt, Homo sapiens
ccaucacuggag

SEQ ID NO: 1445759 - RNA, 19 nt, Homo sapiens
ccaucagcuggguggugua

SEQ ID NO: 1445760 - RNA, 19 nt, Homo sapiens
ccauccauucacagccagg

SEQ ID NO: 1445761 - RNA, 14 nt, Homo sapiens
ccauccccuggacu

SEQ ID NO: 1445762 - RNA, 19 nt, Homo sapiens
ccauccccuggacugggag

SEQ ID NO: 1445763 - RNA, 20 nt, Homo sapiens
ccauccuaccaaugcaugca

SEQ ID NO: 1445764 - RNA, 16 nt, Homo sapiens
ccaucgcaaccaggau

SEQ ID NO: 1445765 - RNA, 15 nt, Homo sapiens
ccaucuaugucccuu

SEQ ID NO: 1445766 - RNA, 15 nt, Homo sapiens
ccaucucauucaggu

SEQ ID NO: 1445767 - RNA, 18 nt, Homo sapiens
ccaucugcuugguuggcu

SEQ ID NO: 1445768 - RNA, 14 nt, Homo sapiens
ccaugaagaccaca

SEQ ID NO: 1445769 - RNA, 19 nt, Homo sapiens
ccaugauaacugcaauuuu

SEQ ID NO: 1445770 - RNA, 22 nt, Homo sapiens
ccaugauggugcugaccucugg

SEQ ID NO: 1445771 - RNA, 12 nt, Homo sapiens
ccaugccucaag

SEQ ID NO: 1445772 - RNA, 14 nt, Homo sapiens
ccaugccugagggu

SEQ ID NO: 1445773 - RNA, 15 nt, Homo sapiens
ccaugggauguuaag

SEQ ID NO: 1445774 - RNA, 23 nt, Homo sapiens
ccaugggcuagugugaguggcag

SEQ ID NO: 1445775 - RNA, 16 nt, Homo sapiens
ccauggugcuuguuaa

SEQ ID NO: 1445776 - RNA, 17 nt, Homo sapiens
ccauguaucuaccucac

SEQ ID NO: 1445777 - RNA, 22 nt, Homo sapiens
ccauguggguguggcaguuaca

SEQ ID NO: 1445778 - RNA, 15 nt, Homo sapiens
ccauuaggcaugccu

SEQ ID NO: 1445779 - RNA, 18 nt, Homo sapiens
ccauucacagccaggaga

SEQ ID NO: 1445780 - RNA, 22 nt, Homo sapiens
ccauuccaagucaacacucuuc

SEQ ID NO: 1445781 - RNA, 17 nt, Homo sapiens
ccauuccagacugcuuc

SEQ ID NO: 1445782 - RNA, 21 nt, Homo sapiens
ccauucuacauacuauggaau

SEQ ID NO: 1445783 - RNA, 13 nt, Homo sapiens
ccauucugaccau

SEQ ID NO: 1445784 - RNA, 21 nt, Homo sapiens
ccauugaauuugccuuccuca

SEQ ID NO: 1445785 - RNA, 15 nt, Homo sapiens
ccauuuuaaaaacca

SEQ ID NO: 1445786 - RNA, 16 nt, Homo sapiens
ccauuuuaaaaaccaa

SEQ ID NO: 1445787 - RNA, 19 nt, Homo sapiens
ccauuuuggaaguuuucag

SEQ ID NO: 1445788 - RNA, 19 nt, Homo sapiens
cccaaagugcuaguauuau

SEQ ID NO: 1445789 - RNA, 20 nt, Homo sapiens
cccaaauuucauaccuauca

SEQ ID NO: 1445790 - RNA, 23 nt, Homo sapiens
cccaaccucaaugcccugccauu

SEQ ID NO: 1445791 - RNA, 15 nt, Homo sapiens
cccaacgcacaggaa

SEQ ID NO: 1445792 - RNA, 17 nt, Homo sapiens
cccaagccuggucuccu

SEQ ID NO: 1445793 - RNA, 19 nt, Homo sapiens
cccaaggggacuugugcca

SEQ ID NO: 1445794 - RNA, 14 nt, Homo sapiens
cccaagugccaucc

SEQ ID NO: 1445795 - RNA, 21 nt, Homo sapiens
cccaauacauaccacuuugaa

SEQ ID NO: 1445796 - RNA, 18 nt, Homo sapiens
cccaaucauuugcaaugc

SEQ ID NO: 1445797 - RNA, 13 nt, Homo sapiens
cccacaauggagu

SEQ ID NO: 1445798 - RNA, 18 nt, Homo sapiens
cccacagcacccaggcuc

SEQ ID NO: 1445799 - RNA, 13 nt, Homo sapiens
cccacaguccuca

SEQ ID NO: 1445800 - RNA, 15 nt, Homo sapiens
cccacauaccaucug

SEQ ID NO: 1445801 - RNA, 15 nt, Homo sapiens
cccacauauggcaca

SEQ ID NO: 1445802 - RNA, 21 nt, Homo sapiens
cccaccaacucugcacuccau

SEQ ID NO: 1445803 - RNA, 15 nt, Homo sapiens
cccaccccacuccag

SEQ ID NO: 1445804 - RNA, 14 nt, Homo sapiens
cccaccucaggcug

SEQ ID NO: 1445805 - RNA, 22 nt, Homo sapiens
cccacgagggucaggacuguga

SEQ ID NO: 1445806 - RNA, 22 nt, Homo sapiens
cccacucccaggaccaagauug

SEQ ID NO: 1445807 - RNA, 19 nt, Homo sapiens
cccagaaccacacuguuga

SEQ ID NO: 1445808 - RNA, 14 nt, Homo sapiens
cccagacucagcuc

SEQ ID NO: 1445809 - RNA, 20 nt, Homo sapiens
cccagagguuaucugccugg

SEQ ID NO: 1445810 - RNA, 21 nt, Homo sapiens
cccagagugugaaacuuccua

SEQ ID NO: 1445811 - RNA, 12 nt, Homo sapiens
cccagcaaagag

SEQ ID NO: 1445812 - RNA, 14 nt, Homo sapiens
cccagcaacacaga

SEQ ID NO: 1445813 - RNA, 11 nt, Homo sapiens
cccagcacuga

SEQ ID NO: 1445814 - RNA, 12 nt, Homo sapiens
cccagcacuuug

SEQ ID NO: 1445815 - RNA, 15 nt, Homo sapiens
cccagccaacugccc

SEQ ID NO: 1445816 - RNA, 15 nt, Homo sapiens
cccagccacucggga

SEQ ID NO: 1445817 - RNA, 17 nt, Homo sapiens
cccagcugucuguguca

SEQ ID NO: 1445818 - RNA, 12 nt, Homo sapiens
cccagcuuuauc

SEQ ID NO: 1445819 - RNA, 23 nt, Homo sapiens
cccaggagaagaaagaggugacc

SEQ ID NO: 1445820 - RNA, 17 nt, Homo sapiens
cccaggcaaacuugcac

SEQ ID NO: 1445821 - RNA, 21 nt, Homo sapiens
cccaggcccuaggauuccucc

SEQ ID NO: 1445822 - RNA, 15 nt, Homo sapiens
cccaggcugaagagu

SEQ ID NO: 1445823 - RNA, 19 nt, Homo sapiens
cccaggcuggagugcagua

SEQ ID NO: 1445824 - RNA, 15 nt, Homo sapiens
cccagguguggcugu

SEQ ID NO: 1445825 - RNA, 13 nt, Homo sapiens
gaaggccacuggu

SEQ ID NO: 1445826 - RNA, 19 nt, Homo sapiens
gaaggcuggggccagugua

SEQ ID NO: 1445827 - RNA, 18 nt, Homo sapiens
gaaggcuuugccaugggc

SEQ ID NO: 1445828 - RNA, 12 nt, Homo sapiens
gaagggccaguc

SEQ ID NO: 1445829 - RNA, 23 nt, Homo sapiens
gaaggggcaaagaaaagccagag

SEQ ID NO: 1445830 - RNA, 19 nt, Homo sapiens
gaagggggucaaaggaaga

SEQ ID NO: 1445831 - RNA, 14 nt, Homo sapiens
gaagucaccaaaau

SEQ ID NO: 1445832 - RNA, 19 nt, Homo sapiens
gaaguguaguggcauccau

SEQ ID NO: 1445833 - RNA, 14 nt, Homo sapiens
gaauaaaauugcac

SEQ ID NO: 1445834 - RNA, 19 nt, Homo sapiens
gaauaaaauugcacuuuua

SEQ ID NO: 1445835 - RNA, 16 nt, Homo sapiens
gaauaaaccauuuuua

SEQ ID NO: 1445836 - RNA, 11 nt, Homo sapiens
gaauaaagccu

SEQ ID NO: 1445837 - RNA, 18 nt, Homo sapiens
gaauaaagccugcuuuuu

SEQ ID NO: 1445838 - RNA, 22 nt, Homo sapiens
gaauaaaugaaucuuacuccuu

SEQ ID NO: 1445839 - RNA, 15 nt, Homo sapiens
gaauaccuucuucgc

SEQ ID NO: 1445840 - RNA, 15 nt, Homo sapiens
gaauagaugcugacu

SEQ ID NO: 1445841 - RNA, 13 nt, Homo sapiens
gaauaggcauuug

SEQ ID NO: 1445842 - RNA, 21 nt, Homo sapiens
gaauauauuauaaucuuccau

SEQ ID NO: 1445843 - RNA, 22 nt, Homo sapiens
gaauauauuugugugugugaua

SEQ ID NO: 1445844 - RNA, 20 nt, Homo sapiens
gaauaucauuaaauuggaau

SEQ ID NO: 1445845 - RNA, 19 nt, Homo sapiens
gaauaucgagaacugccau

SEQ ID NO: 1445846 - RNA, 20 nt, Homo sapiens
gaauauuaucaguggcugcc

SEQ ID NO: 1445847 - RNA, 15 nt, Homo sapiens
gaaucaaauugcuac

SEQ ID NO: 1445848 - RNA, 12 nt, Homo sapiens
gaaucagacuca

SEQ ID NO: 1445849 - RNA, 18 nt, Homo sapiens
gaaucagacuucacacug

SEQ ID NO: 1445850 - RNA, 12 nt, Homo sapiens
gaaucaucucaa

SEQ ID NO: 1445851 - RNA, 19 nt, Homo sapiens
gaaucguuucaaauggacu

SEQ ID NO: 1445852 - RNA, 13 nt, Homo sapiens
gaaucuacagaac

SEQ ID NO: 1445853 - RNA, 15 nt, Homo sapiens
gaaugacaacagaag

SEQ ID NO: 1445854 - RNA, 15 nt, Homo sapiens
gaaugauaagcagga

SEQ ID NO: 1445855 - RNA, 21 nt, Homo sapiens
gaaugauucccucuugcuauu

SEQ ID NO: 1445856 - RNA, 11 nt, Homo sapiens
gaaugccacag

SEQ ID NO: 1445857 - RNA, 20 nt, Homo sapiens
gaaugcggccgcauucccug

SEQ ID NO: 1445858 - RNA, 14 nt, Homo sapiens
gaaugcuccaugaa

SEQ ID NO: 1445859 - RNA, 15 nt, Homo sapiens
gaaugguccaggguu

SEQ ID NO: 1445860 - RNA, 19 nt, Homo sapiens
gaaugugguccagacguca

SEQ ID NO: 1445861 - RNA, 20 nt, Homo sapiens
gaauguuagauuccucuugc

SEQ ID NO: 1445862 - RNA, 17 nt, Homo sapiens
gaauguuuauguucuca

SEQ ID NO: 1445863 - RNA, 19 nt, Homo sapiens
gaauuauuuuuguguuucu

SEQ ID NO: 1445864 - RNA, 17 nt, Homo sapiens
gaauucuuuacaauaaa

SEQ ID NO: 1445865 - RNA, 16 nt, Homo sapiens
gaauuugggccucuug

SEQ ID NO: 1445866 - RNA, 14 nt, Homo sapiens
gaauuuuguauauu

SEQ ID NO: 1445867 - RNA, 14 nt, Homo sapiens
gacaaaacacugug

SEQ ID NO: 1445868 - RNA, 21 nt, Homo sapiens
gacaaaccagagcagagagca

SEQ ID NO: 1445869 - RNA, 15 nt, Homo sapiens
gacaaaggagccugu

SEQ ID NO: 1445870 - RNA, 22 nt, Homo sapiens
gacaaauauuguuaccaugaag

SEQ ID NO: 1445871 - RNA, 12 nt, Homo sapiens
gacaacauuuua

SEQ ID NO: 1445872 - RNA, 16 nt, Homo sapiens
gacaacugacaauaug

SEQ ID NO: 1445873 - RNA, 18 nt, Homo sapiens
gacaagaaggccacuggu

SEQ ID NO: 1445874 - RNA, 20 nt, Homo sapiens
gacaagcaagggcugugcug

SEQ ID NO: 1445875 - RNA, 20 nt, Homo sapiens
gacaaggggagggccaggau

SEQ ID NO: 1445876 - RNA, 23 nt, Homo sapiens
gacaaugaugugaguacccagga

SEQ ID NO: 1445877 - RNA, 14 nt, Homo sapiens
gacacaauccucaa

SEQ ID NO: 1445878 - RNA, 22 nt, Homo sapiens
gacacagcgucccuagcaguga

SEQ ID NO: 1445879 - RNA, 15 nt, Homo sapiens
gacaccuccauuucu

SEQ ID NO: 1445880 - RNA, 20 nt, Homo sapiens
gacacuauuuaucugugcaa

SEQ ID NO: 1445881 - RNA, 21 nt, Homo sapiens
gacacuauuuaucugugcaaa

SEQ ID NO: 1445882 - RNA, 15 nt, Homo sapiens
gacacugcaaaggcg

SEQ ID NO: 1445883 - RNA, 16 nt, Homo sapiens
gacaggacuaacacuc

SEQ ID NO: 1445884 - RNA, 19 nt, Homo sapiens
gacagggucucacuauguu

SEQ ID NO: 1445885 - RNA, 18 nt, Homo sapiens
gacagguucccagcagcu

SEQ ID NO: 1445886 - RNA, 18 nt, Homo sapiens
gacaguagccaaguuaua

SEQ ID NO: 1445887 - RNA, 16 nt, Homo sapiens
gacauauaccuucuca

SEQ ID NO: 1445888 - RNA, 13 nt, Homo sapiens
gacauaugcauuu

SEQ ID NO: 1445889 - RNA, 19 nt, Homo sapiens
gacaugccacccucuccau

SEQ ID NO: 1445890 - RNA, 20 nt, Homo sapiens
gacauggauuugaugaaagu

SEQ ID NO: 1445891 - RNA, 21 nt, Homo sapiens
gacaugucucacagacgcucc

SEQ ID NO: 1445892 - RNA, 16 nt, Homo sapiens
gacauuaaaagcuauc

SEQ ID NO: 1445893 - RNA, 14 nt, Homo sapiens
gacauugccuccac

SEQ ID NO: 1445894 - RNA, 22 nt, Homo sapiens
gaccaacauggugaaacccugu

SEQ ID NO: 1445895 - RNA, 17 nt, Homo sapiens
gaccaccugccagccau

SEQ ID NO: 1445896 - RNA, 20 nt, Homo sapiens
gaccaguugggagcacugga

SEQ ID NO: 1445897 - RNA, 23 nt, Homo sapiens
gaccauaaaggcauggcauuugu

SEQ ID NO: 1445898 - RNA, 15 nt, Homo sapiens
gaccauaaagggaaa

SEQ ID NO: 1445899 - RNA, 22 nt, Homo sapiens
gacccaagagguggggaccaaa

SEQ ID NO: 1445900 - RNA, 15 nt, Homo sapiens
gacccaggcccucca

SEQ ID NO: 1445901 - RNA, 12 nt, Homo sapiens
gaccccaaagag

SEQ ID NO: 1445902 - RNA, 21 nt, Homo sapiens
gaccccaaagagccuggagaa

SEQ ID NO: 1445903 - RNA, 12 nt, Homo sapiens
gaccccaucuca

SEQ ID NO: 1445904 - RNA, 16 nt, Homo sapiens
gaccccucccaaccuc

SEQ ID NO: 1445905 - RNA, 17 nt, Homo sapiens
gacccgcucuggaccaa

SEQ ID NO: 1445906 - RNA, 20 nt, Homo sapiens
gacccggaggggccuggcag

SEQ ID NO: 1445907 - RNA, 18 nt, Homo sapiens
gacccuucagggccagaa

SEQ ID NO: 1445908 - RNA, 17 nt, Homo sapiens
gaccuaaccuaagcaaa

SEQ ID NO: 1445909 - RNA, 13 nt, Homo sapiens
gaccucacaguga

SEQ ID NO: 1445910 - RNA, 14 nt, Homo sapiens
gaccuccacauuaa

SEQ ID NO: 1445911 - RNA, 13 nt, Homo sapiens
gaccucccaaagu

SEQ ID NO: 1445912 - RNA, 20 nt, Homo sapiens
gauuuuacagagaaucugaa

SEQ ID NO: 1445913 - RNA, 12 nt, Homo sapiens
gauuuuauacau

SEQ ID NO: 1445914 - RNA, 15 nt, Homo sapiens
gauuuucuauuuaug

SEQ ID NO: 1445915 - RNA, 23 nt, Homo sapiens
gauuuuuuguuauguuugcacuu

SEQ ID NO: 1445916 - RNA, 20 nt, Homo sapiens
gcaaaaaaauuaaauuauuu

SEQ ID NO: 1445917 - RNA, 23 nt, Homo sapiens
gcaaaaacaaaugggaaaauguc

SEQ ID NO: 1445918 - RNA, 23 nt, Homo sapiens
gcaaaacaaggacuagagcucag

SEQ ID NO: 1445919 - RNA, 12 nt, Homo sapiens
gcaaaagcgcag

SEQ ID NO: 1445920 - RNA, 12 nt, Homo sapiens
gcaaaagucauu

SEQ ID NO: 1445921 - RNA, 16 nt, Homo sapiens
gcaaaagucauuacac

SEQ ID NO: 1445922 - RNA, 14 nt, Homo sapiens
gcaaaauaaucuaa

SEQ ID NO: 1445923 - RNA, 22 nt, Homo sapiens
gcaaacagagugaaaugccauu

SEQ ID NO: 1445924 - RNA, 23 nt, Homo sapiens
gcaaacagagugaaaugccauuu

SEQ ID NO: 1445925 - RNA, 18 nt, Homo sapiens
gcaaacucacugcucaag

SEQ ID NO: 1445926 - RNA, 16 nt, Homo sapiens
gcaaagaaaagccaga

SEQ ID NO: 1445927 - RNA, 11 nt, Homo sapiens
gcaaagccugu

SEQ ID NO: 1445928 - RNA, 17 nt, Homo sapiens
gcaaagggagcacuggg

SEQ ID NO: 1445929 - RNA, 18 nt, Homo sapiens
gcaaagguggcucuccag

SEQ ID NO: 1445930 - RNA, 21 nt, Homo sapiens
gcaaauccuugauacugcuca

SEQ ID NO: 1445931 - RNA, 15 nt, Homo sapiens
gcaaaugacaugcac

SEQ ID NO: 1445932 - RNA, 21 nt, Homo sapiens
gcaaaugacaugcacugaccc

SEQ ID NO: 1445933 - RNA, 17 nt, Homo sapiens
gcaaauuuugcauuuag

SEQ ID NO: 1445934 - RNA, 20 nt, Homo sapiens
gcaacccaccaucuacccac

SEQ ID NO: 1445935 - RNA, 17 nt, Homo sapiens
gcaacccucacuguguu

SEQ ID NO: 1445936 - RNA, 19 nt, Homo sapiens
gcaaccucccaacccagag

SEQ ID NO: 1445937 - RNA, 18 nt, Homo sapiens
gcaacucuauagacuuuu

SEQ ID NO: 1445938 - RNA, 16 nt, Homo sapiens
gcaagaaggaaggagg

SEQ ID NO: 1445939 - RNA, 22 nt, Homo sapiens
gcaagaggugguagaaccacuu

SEQ ID NO: 1445940 - RNA, 20 nt, Homo sapiens
gcaagaugaccuacuaguuu

SEQ ID NO: 1445941 - RNA, 14 nt, Homo sapiens
gcaaggaagggugg

SEQ ID NO: 1445942 - RNA, 22 nt, Homo sapiens
gcaaggacugcagggacugcca

SEQ ID NO: 1445943 - RNA, 16 nt, Homo sapiens
gcaagggcugugcuga

SEQ ID NO: 1445944 - RNA, 22 nt, Homo sapiens
gcaagggcugugcugaggucac

SEQ ID NO: 1445945 - RNA, 15 nt, Homo sapiens
gcaaggugugaauga

SEQ ID NO: 1445946 - RNA, 20 nt, Homo sapiens
gcaagguuauaugcacuuuc

SEQ ID NO: 1445947 - RNA, 17 nt, Homo sapiens
gcaauacuaauugagaa

SEQ ID NO: 1445948 - RNA, 19 nt, Homo sapiens
gcaaucuuguccacagucu

SEQ ID NO: 1445949 - RNA, 17 nt, Homo sapiens
gcaaugggcacugggau

SEQ ID NO: 1445950 - RNA, 19 nt, Homo sapiens
gcaaugguagcaaaacaag

SEQ ID NO: 1445951 - RNA, 19 nt, Homo sapiens
gcaauuagauuaguauuuu

SEQ ID NO: 1445952 - RNA, 13 nt, Homo sapiens
gcaauuuuuccau

SEQ ID NO: 1445953 - RNA, 13 nt, Homo sapiens
gcacaaacuuuaa

SEQ ID NO: 1445954 - RNA, 18 nt, Homo sapiens
gcacaaggcugaccaaga

SEQ ID NO: 1445955 - RNA, 21 nt, Homo sapiens
gcacacacacagagauaugca

SEQ ID NO: 1445956 - RNA, 14 nt, Homo sapiens
gcacacacaccgau

SEQ ID NO: 1445957 - RNA, 17 nt, Homo sapiens
gcacacacagauaugca

SEQ ID NO: 1445958 - RNA, 15 nt, Homo sapiens
gcacacacagaugca

SEQ ID NO: 1445959 - RNA, 18 nt, Homo sapiens
gcacacacagaugcacac

SEQ ID NO: 1445960 - RNA, 20 nt, Homo sapiens
gcacacacagaugcacacac

SEQ ID NO: 1445961 - RNA, 11 nt, Homo sapiens
gcacaccucau

SEQ ID NO: 1445962 - RNA, 16 nt, Homo sapiens
gcacagagauaugcac

SEQ ID NO: 1445963 - RNA, 17 nt, Homo sapiens
gcacauagagauaugca

SEQ ID NO: 1445964 - RNA, 20 nt, Homo sapiens
gcacauagagauaugcacac

SEQ ID NO: 1445965 - RNA, 13 nt, Homo sapiens
gcacauauuugaa

SEQ ID NO: 1445966 - RNA, 14 nt, Homo sapiens
gcacauauuugaau

SEQ ID NO: 1445967 - RNA, 17 nt, Homo sapiens
gcacauccauucccaag

SEQ ID NO: 1445968 - RNA, 15 nt, Homo sapiens
gcaccaccaugccag

SEQ ID NO: 1445969 - RNA, 15 nt, Homo sapiens
gcaccacuguguauu

SEQ ID NO: 1445970 - RNA, 21 nt, Homo sapiens
gcaccauggaggcaggcuccc

SEQ ID NO: 1445971 - RNA, 15 nt, Homo sapiens
gcacccccuggagag

SEQ ID NO: 1445972 - RNA, 16 nt, Homo sapiens
gcaccccugucucuag

SEQ ID NO: 1445973 - RNA, 21 nt, Homo sapiens
gcacccuggauugaucggagc

SEQ ID NO: 1445974 - RNA, 22 nt, Homo sapiens
gcaccgagagagauggaauaaa

SEQ ID NO: 1445975 - RNA, 13 nt, Homo sapiens
gcaccuacuuuau

SEQ ID NO: 1445976 - RNA, 14 nt, Homo sapiens
gcaccuaucaccca

SEQ ID NO: 1445977 - RNA, 17 nt, Homo sapiens
gcaccucagacaaucca

SEQ ID NO: 1445978 - RNA, 21 nt, Homo sapiens
gcaccucuagugcuacugcua

SEQ ID NO: 1445979 - RNA, 15 nt, Homo sapiens
gcaccuggugaucac

SEQ ID NO: 1445980 - RNA, 21 nt, Homo sapiens
gcaccuguagucccagcuacu

SEQ ID NO: 1445981 - RNA, 20 nt, Homo sapiens
gcacgcacaugccaaugcac

SEQ ID NO: 1445982 - RNA, 16 nt, Homo sapiens
gcacgucuugcuauuu

SEQ ID NO: 1445983 - RNA, 13 nt, Homo sapiens
gcacuagcauuuu

SEQ ID NO: 1445984 - RNA, 18 nt, Homo sapiens
gcacucacccaugugcca

SEQ ID NO: 1445985 - RNA, 17 nt, Homo sapiens
gcacugacugggaccag

SEQ ID NO: 1445986 - RNA, 14 nt, Homo sapiens
gcacugccggccca

SEQ ID NO: 1445987 - RNA, 22 nt, Homo sapiens
gcacuggguugacuuucaggua

SEQ ID NO: 1445988 - RNA, 20 nt, Homo sapiens
gcacugugaccgagaacuuu

SEQ ID NO: 1445989 - RNA, 19 nt, Homo sapiens
gcacuuggggcaccuugcu

SEQ ID NO: 1445990 - RNA, 15 nt, Homo sapiens
gcacuuuaacugacu

SEQ ID NO: 1445991 - RNA, 15 nt, Homo sapiens
gcagaaaaacucugg

SEQ ID NO: 1445992 - RNA, 14 nt, Homo sapiens
gcagaaaagugcuu

SEQ ID NO: 1445993 - RNA, 21 nt, Homo sapiens
gcagaagaauugaacccagga

SEQ ID NO: 1445994 - RNA, 20 nt, Homo sapiens
gcagagcccgaauuccugac

SEQ ID NO: 1445995 - RNA, 21 nt, Homo sapiens
gcagagccugagucacugguc

SEQ ID NO: 1445996 - RNA, 21 nt, Homo sapiens
gcagagcggggaggugccuga

SEQ ID NO: 1445997 - RNA, 18 nt, Homo sapiens
gcagaggcggaaaccuug

SEQ ID NO: 1445998 - RNA, 21 nt, Homo sapiens
ggagacucaccucugccucaa

SEQ ID NO: 1445999 - RNA, 16 nt, Homo sapiens
ggagacugucucaaga

SEQ ID NO: 1446000 - RNA, 13 nt, Homo sapiens
ggagagaaguuuc

SEQ ID NO: 1446001 - RNA, 14 nt, Homo sapiens
ggagagaaguuucu

SEQ ID NO: 1446002 - RNA, 20 nt, Homo sapiens
ggagaguacagugagccaag

SEQ ID NO: 1446003 - RNA, 20 nt, Homo sapiens
ggagauaaaacucugugguu

SEQ ID NO: 1446004 - RNA, 18 nt, Homo sapiens
ggagccaucagcugggug

SEQ ID NO: 1446005 - RNA, 15 nt, Homo sapiens
ggagcccgugcagua

SEQ ID NO: 1446006 - RNA, 14 nt, Homo sapiens
ggagccgcugcuga

SEQ ID NO: 1446007 - RNA, 15 nt, Homo sapiens
ggagcuggaaauaaa

SEQ ID NO: 1446008 - RNA, 21 nt, Homo sapiens
ggagcuggaaauaaaccugga

SEQ ID NO: 1446009 - RNA, 18 nt, Homo sapiens
ggaggacacacagucuca

SEQ ID NO: 1446010 - RNA, 16 nt, Homo sapiens
ggaggaccugagccug

SEQ ID NO: 1446011 - RNA, 18 nt, Homo sapiens
ggaggacuccgggaccau

SEQ ID NO: 1446012 - RNA, 21 nt, Homo sapiens
ggaggauugcuucuugugaaa

SEQ ID NO: 1446013 - RNA, 16 nt, Homo sapiens
ggaggcaugccucuga

SEQ ID NO: 1446014 - RNA, 19 nt, Homo sapiens
ggagucagaaacuguuucu

SEQ ID NO: 1446015 - RNA, 20 nt, Homo sapiens
ggagugacggucccacacug

SEQ ID NO: 1446016 - RNA, 18 nt, Homo sapiens
ggagugagaucauuuucu

SEQ ID NO: 1446017 - RNA, 14 nt, Homo sapiens
ggagugagaucuua

SEQ ID NO: 1446018 - RNA, 12 nt, Homo sapiens
ggagugcaguuu

SEQ ID NO: 1446019 - RNA, 19 nt, Homo sapiens
ggaguugcucacucaggac

SEQ ID NO: 1446020 - RNA, 20 nt, Homo sapiens
ggauaaugcuguugccucau

SEQ ID NO: 1446021 - RNA, 19 nt, Homo sapiens
ggauaccagauauuugaau

SEQ ID NO: 1446022 - RNA, 20 nt, Homo sapiens
ggauaucaauuaauuugaaa

SEQ ID NO: 1446023 - RNA, 24 nt, Homo sapiens
ggauaucaucuuuucuaaucucuu

SEQ ID NO: 1446024 - RNA, 16 nt, Homo sapiens
ggaucacaaggucacu

SEQ ID NO: 1446025 - RNA, 14 nt, Homo sapiens
ggaucgcaccuuuu

SEQ ID NO: 1446026 - RNA, 14 nt, Homo sapiens
ggaugacugugauu

SEQ ID NO: 1446027 - RNA, 23 nt, Homo sapiens
ggaugaggaaccucaaacugggu

SEQ ID NO: 1446028 - RNA, 12 nt, Homo sapiens
ggaugcacacac

SEQ ID NO: 1446029 - RNA, 13 nt, Homo sapiens
ggaugccacccag

SEQ ID NO: 1446030 - RNA, 11 nt, Homo sapiens
ggauggcacuc

SEQ ID NO: 1446031 - RNA, 16 nt, Homo sapiens
ggauguguggggcaug

SEQ ID NO: 1446032 - RNA, 14 nt, Homo sapiens
ggauuacaggcaug

SEQ ID NO: 1446033 - RNA, 18 nt, Homo sapiens
ggauuccagcauuugcca

SEQ ID NO: 1446034 - RNA, 16 nt, Homo sapiens
ggcaaaaaaauuaaau

SEQ ID NO: 1446035 - RNA, 18 nt, Homo sapiens
ggcaaaaacuuccaucac

SEQ ID NO: 1446036 - RNA, 20 nt, Homo sapiens
ggcaaaugcuugauucuuuc

SEQ ID NO: 1446037 - RNA, 16 nt, Homo sapiens
ggcaacccucacugug

SEQ ID NO: 1446038 - RNA, 18 nt, Homo sapiens
ggcaacccucacuguguu

SEQ ID NO: 1446039 - RNA, 17 nt, Homo sapiens
ggcaacgacgguuucaa

SEQ ID NO: 1446040 - RNA, 12 nt, Homo sapiens
ggcaacugugag

SEQ ID NO: 1446041 - RNA, 15 nt, Homo sapiens
ggcaagcacuaccag

SEQ ID NO: 1446042 - RNA, 22 nt, Homo sapiens
ggcaagggcaacccaccaucua

SEQ ID NO: 1446043 - RNA, 15 nt, Homo sapiens
ggcaagggguuucca

SEQ ID NO: 1446044 - RNA, 12 nt, Homo sapiens
ggcaagugauau

SEQ ID NO: 1446045 - RNA, 17 nt, Homo sapiens
ggcaauugcggggccca

SEQ ID NO: 1446046 - RNA, 22 nt, Homo sapiens
ggcaauugcggggcccaccuua

SEQ ID NO: 1446047 - RNA, 20 nt, Homo sapiens
ggcacaaauuguacauuuga

SEQ ID NO: 1446048 - RNA, 18 nt, Homo sapiens
ggcacaggacugauucug

SEQ ID NO: 1446049 - RNA, 17 nt, Homo sapiens
ggcacagucauucacau

SEQ ID NO: 1446050 - RNA, 16 nt, Homo sapiens
ggcacauggcuggcac

SEQ ID NO: 1446051 - RNA, 18 nt, Homo sapiens
ggcaccagaaugcuaaag

SEQ ID NO: 1446052 - RNA, 16 nt, Homo sapiens
ggcacccaauguuuga

SEQ ID NO: 1446053 - RNA, 16 nt, Homo sapiens
ggcacgucccaugugc

SEQ ID NO: 1446054 - RNA, 12 nt, Homo sapiens
ggcacugccuga

SEQ ID NO: 1446055 - RNA, 13 nt, Homo sapiens
ggcagagccuuug

SEQ ID NO: 1446056 - RNA, 22 nt, Homo sapiens
ggcagccacacuucucaggaca

SEQ ID NO: 1446057 - RNA, 23 nt, Homo sapiens
ggcagcugauuuugucacugucu

SEQ ID NO: 1446058 - RNA, 20 nt, Homo sapiens
ggcagucugaacccuugugc

SEQ ID NO: 1446059 - RNA, 21 nt, Homo sapiens
ggcagugccuccugggaccau

SEQ ID NO: 1446060 - RNA, 13 nt, Homo sapiens
ggcagugcugauu

SEQ ID NO: 1446061 - RNA, 23 nt, Homo sapiens
ggcaguguaugcucauacuugga

SEQ ID NO: 1446062 - RNA, 22 nt, Homo sapiens
ggcaucugacaugcaucaucuc

SEQ ID NO: 1446063 - RNA, 19 nt, Homo sapiens
ggcaugaacacacauggau

SEQ ID NO: 1446064 - RNA, 13 nt, Homo sapiens
ggcaugugugccu

SEQ ID NO: 1446065 - RNA, 16 nt, Homo sapiens
ggcauuaaagugcugu

SEQ ID NO: 1446066 - RNA, 12 nt, Homo sapiens
ggcauugcaaag

SEQ ID NO: 1446067 - RNA, 15 nt, Homo sapiens
ggcauuuccugggug

SEQ ID NO: 1446068 - RNA, 12 nt, Homo sapiens
ggccaagcugaa

SEQ ID NO: 1446069 - RNA, 15 nt, Homo sapiens
ggccaagcugaggug

SEQ ID NO: 1446070 - RNA, 17 nt, Homo sapiens
ggccaccccgugccacc

SEQ ID NO: 1446071 - RNA, 11 nt, Homo sapiens
ggccagcucac

SEQ ID NO: 1446072 - RNA, 20 nt, Homo sapiens
ggccagcugucgcaucucag

SEQ ID NO: 1446073 - RNA, 20 nt, Homo sapiens
ggccaggcaggggugggaga

SEQ ID NO: 1446074 - RNA, 17 nt, Homo sapiens
ggccagggaaagcccgu

SEQ ID NO: 1446075 - RNA, 13 nt, Homo sapiens
ggccagguggcca

SEQ ID NO: 1446076 - RNA, 17 nt, Homo sapiens
ggccaugccacccuguu

SEQ ID NO: 1446077 - RNA, 23 nt, Homo sapiens
ggcccagugacaccgaguuccac

SEQ ID NO: 1446078 - RNA, 15 nt, Homo sapiens
ggccccagaacacag

SEQ ID NO: 1446079 - RNA, 16 nt, Homo sapiens
ggccccagaucugccu

SEQ ID NO: 1446080 - RNA, 15 nt, Homo sapiens
ggcccccugugccag

SEQ ID NO: 1446081 - RNA, 19 nt, Homo sapiens
ggcccugggccucaguuca

SEQ ID NO: 1446082 - RNA, 17 nt, Homo sapiens
ggccgaaggcagugcaa

SEQ ID NO: 1446083 - RNA, 15 nt, Homo sapiens
ggccgaguaccuuaa

SEQ ID NO: 1446084 - RNA, 22 nt, Homo sapiens
ggccucagcaccccugucucua

SEQ ID NO: 1446085 - RNA, 13 nt, Homo sapiens
gguauauuuccau

SEQ ID NO: 1446086 - RNA, 18 nt, Homo sapiens
gguccacccagcaaagag

SEQ ID NO: 1446087 - RNA, 17 nt, Homo sapiens
gguccacucagggcugc

SEQ ID NO: 1446088 - RNA, 16 nt, Homo sapiens
ggucuccuugcacuuu

SEQ ID NO: 1446089 - RNA, 18 nt, Homo sapiens
ggucuucugccagcccau

SEQ ID NO: 1446090 - RNA, 12 nt, Homo sapiens
ggugaaauccag

SEQ ID NO: 1446091 - RNA, 17 nt, Homo sapiens
ggugaagaacaucccaa

SEQ ID NO: 1446092 - RNA, 23 nt, Homo sapiens
ggugaagaacaucccaagccaga

SEQ ID NO: 1446093 - RNA, 18 nt, Homo sapiens
ggugacaggcccagugga

SEQ ID NO: 1446094 - RNA, 15 nt, Homo sapiens
ggugagaccaaagga

SEQ ID NO: 1446095 - RNA, 18 nt, Homo sapiens
ggugcaaauccuacugaa

SEQ ID NO: 1446096 - RNA, 19 nt, Homo sapiens
ggugcacuuuucuguguca

SEQ ID NO: 1446097 - RNA, 20 nt, Homo sapiens
ggugcacuuuucugugucau

SEQ ID NO: 1446098 - RNA, 21 nt, Homo sapiens
ggugcaguuuuccaggaauag

SEQ ID NO: 1446099 - RNA, 21 nt, Homo sapiens
ggugccaggcuguaagcauuc

SEQ ID NO: 1446100 - RNA, 20 nt, Homo sapiens
ggugcuaucgcaccacugug

SEQ ID NO: 1446101 - RNA, 17 nt, Homo sapiens
gguggagguugcaguga

SEQ ID NO: 1446102 - RNA, 12 nt, Homo sapiens
gguggcacgugc

SEQ ID NO: 1446103 - RNA, 14 nt, Homo sapiens
gguggcucuugccu

SEQ ID NO: 1446104 - RNA, 15 nt, Homo sapiens
ggugggauggaugcu

SEQ ID NO: 1446105 - RNA, 20 nt, Homo sapiens
gguggguacuugggugagga

SEQ ID NO: 1446106 - RNA, 18 nt, Homo sapiens
gguguaaaauaucuaccu

SEQ ID NO: 1446107 - RNA, 18 nt, Homo sapiens
ggugucuagcauuaacuu

SEQ ID NO: 1446108 - RNA, 14 nt, Homo sapiens
ggugugucaaugcc

SEQ ID NO: 1446109 - RNA, 17 nt, Homo sapiens
gguuagccuuugcccug

SEQ ID NO: 1446110 - RNA, 20 nt, Homo sapiens
gguuaucacuuuucuguaac

SEQ ID NO: 1446111 - RNA, 22 nt, Homo sapiens
gguuccuuuuucaacuuggaaa

SEQ ID NO: 1446112 - RNA, 17 nt, Homo sapiens
gguuuggggucugccac

SEQ ID NO: 1446113 - RNA, 16 nt, Homo sapiens
gguuuuaacaauuucc

SEQ ID NO: 1446114 - RNA, 13 nt, Homo sapiens
gguuuuuucacau

SEQ ID NO: 1446115 - RNA, 14 nt, Homo sapiens
guaaaaaaauauga

SEQ ID NO: 1446116 - RNA, 16 nt, Homo sapiens
guaaaaccacagcagu

SEQ ID NO: 1446117 - RNA, 15 nt, Homo sapiens
guaaaauaacaucag

SEQ ID NO: 1446118 - RNA, 22 nt, Homo sapiens
guaaacuauaaacuacuguaau

SEQ ID NO: 1446119 - RNA, 21 nt, Homo sapiens
guaaccaggucguccaagcaa

SEQ ID NO: 1446120 - RNA, 19 nt, Homo sapiens
guaacuauuacaccaaaua

SEQ ID NO: 1446121 - RNA, 16 nt, Homo sapiens
guaacuccaccaaccc

SEQ ID NO: 1446122 - RNA, 14 nt, Homo sapiens
guaagacucauucc

SEQ ID NO: 1446123 - RNA, 15 nt, Homo sapiens
guaagggaaacugcc

SEQ ID NO: 1446124 - RNA, 17 nt, Homo sapiens
guaagggaaacugccag

SEQ ID NO: 1446125 - RNA, 21 nt, Homo sapiens
guaauaaaacccagcauguac

SEQ ID NO: 1446126 - RNA, 14 nt, Homo sapiens
guaauaaaucugag

SEQ ID NO: 1446127 - RNA, 21 nt, Homo sapiens
guaauaccuuaguuuuuucca

SEQ ID NO: 1446128 - RNA, 15 nt, Homo sapiens
guaaucccagcacuu

SEQ ID NO: 1446129 - RNA, 16 nt, Homo sapiens
guaaucccagcacuuu

SEQ ID NO: 1446130 - RNA, 15 nt, Homo sapiens
guacaaauauuccug

SEQ ID NO: 1446131 - RNA, 12 nt, Homo sapiens
guacaagcauuu

SEQ ID NO: 1446132 - RNA, 11 nt, Homo sapiens
guacaauaaua

SEQ ID NO: 1446133 - RNA, 19 nt, Homo sapiens
guacagcagggucuugcug

SEQ ID NO: 1446134 - RNA, 19 nt, Homo sapiens
guacauucccugcauccaa

SEQ ID NO: 1446135 - RNA, 18 nt, Homo sapiens
guaccuuccuuaagccag

SEQ ID NO: 1446136 - RNA, 19 nt, Homo sapiens
guacuaagaggcuauuuaa

SEQ ID NO: 1446137 - RNA, 14 nt, Homo sapiens
guacuauaauguga

SEQ ID NO: 1446138 - RNA, 17 nt, Homo sapiens
guacucuuaacuccuag

SEQ ID NO: 1446139 - RNA, 21 nt, Homo sapiens
guacuuuauuuguauuugcca

SEQ ID NO: 1446140 - RNA, 22 nt, Homo sapiens
guacuuuauuuguauuugccau

SEQ ID NO: 1446141 - RNA, 14 nt, Homo sapiens
guagaaaucuguaa

SEQ ID NO: 1446142 - RNA, 19 nt, Homo sapiens
guagaagccugcagcggca

SEQ ID NO: 1446143 - RNA, 22 nt, Homo sapiens
guagaguuugaaggaggugagg

SEQ ID NO: 1446144 - RNA, 19 nt, Homo sapiens
guagaugccggcaggccuu

SEQ ID NO: 1446145 - RNA, 18 nt, Homo sapiens
guagcaaguucuagagaa

SEQ ID NO: 1446146 - RNA, 20 nt, Homo sapiens
guagguacuucacauugcaa

SEQ ID NO: 1446147 - RNA, 19 nt, Homo sapiens
guagguggauccagggaaa

SEQ ID NO: 1446148 - RNA, 15 nt, Homo sapiens
guaggugucugcacc

SEQ ID NO: 1446149 - RNA, 18 nt, Homo sapiens
guaguuguugaguucaag

SEQ ID NO: 1446150 - RNA, 11 nt, Homo sapiens
guauacuguac

SEQ ID NO: 1446151 - RNA, 15 nt, Homo sapiens
guauaguacuggcau

SEQ ID NO: 1446152 - RNA, 17 nt, Homo sapiens
guauauacacauauacc

SEQ ID NO: 1446153 - RNA, 19 nt, Homo sapiens
guauauauaguagcauuuc

SEQ ID NO: 1446154 - RNA, 15 nt, Homo sapiens
guauauauauauagu

SEQ ID NO: 1446155 - RNA, 16 nt, Homo sapiens
guauaugcuauucaau

SEQ ID NO: 1446156 - RNA, 23 nt, Homo sapiens
guaucuaaagccaguggcagugu

SEQ ID NO: 1446157 - RNA, 18 nt, Homo sapiens
guaucucggaccuuucag

SEQ ID NO: 1446158 - RNA, 13 nt, Homo sapiens
guaugcuggccag

SEQ ID NO: 1446159 - RNA, 20 nt, Homo sapiens
guauguauacacacauauac

SEQ ID NO: 1446160 - RNA, 21 nt, Homo sapiens
guauguauacacacauauaca

SEQ ID NO: 1446161 - RNA, 16 nt, Homo sapiens
guaugugcgugcaugu

SEQ ID NO: 1446162 - RNA, 15 nt, Homo sapiens
guauguuauugcaua

SEQ ID NO: 1446163 - RNA, 18 nt, Homo sapiens
guauuccuuuuguguaca

SEQ ID NO: 1446164 - RNA, 18 nt, Homo sapiens
guauugcuaaucauuaag

SEQ ID NO: 1446165 - RNA, 21 nt, Homo sapiens
guauuuuaggcagggauuuga

SEQ ID NO: 1446166 - RNA, 15 nt, Homo sapiens
guauuuuugucauag

SEQ ID NO: 1446167 - RNA, 18 nt, Homo sapiens
gucaaaacauucagguau

SEQ ID NO: 1446168 - RNA, 14 nt, Homo sapiens
gucaaaaggugccu

SEQ ID NO: 1446169 - RNA, 16 nt, Homo sapiens
gucaacaaccaugcca

SEQ ID NO: 1446170 - RNA, 16 nt, Homo sapiens
gucaaccagugaggcu

SEQ ID NO: 1446171 - RNA, 13 nt, Homo sapiens
gucaagggccagu

SEQ ID NO: 1446172 - RNA, 13 nt, Homo sapiens
uccagucuggauc

SEQ ID NO: 1446173 - RNA, 19 nt, Homo sapiens
uccaguuucccaccaccuu

SEQ ID NO: 1446174 - RNA, 18 nt, Homo sapiens
uccauaaacacccaugaa

SEQ ID NO: 1446175 - RNA, 19 nt, Homo sapiens
uccauaaacacccaugaau

SEQ ID NO: 1446176 - RNA, 21 nt, Homo sapiens
uccauaaacacccaugaauca

SEQ ID NO: 1446177 - RNA, 21 nt, Homo sapiens
uccauagugcacuagcauuuu

SEQ ID NO: 1446178 - RNA, 13 nt, Homo sapiens
uccauaucuucca

SEQ ID NO: 1446179 - RNA, 19 nt, Homo sapiens
uccauauggaggccucaca

SEQ ID NO: 1446180 - RNA, 22 nt, Homo sapiens
uccaucacccguacaggcaauu

SEQ ID NO: 1446181 - RNA, 22 nt, Homo sapiens
uccaucagguuccaucccgaaa

SEQ ID NO: 1446182 - RNA, 19 nt, Homo sapiens
uccaucauggcagugauga

SEQ ID NO: 1446183 - RNA, 18 nt, Homo sapiens
uccauccccaaacugugc

SEQ ID NO: 1446184 - RNA, 22 nt, Homo sapiens
uccauccggcuccugucauccc

SEQ ID NO: 1446185 - RNA, 16 nt, Homo sapiens
uccauccuaaucugaa

SEQ ID NO: 1446186 - RNA, 15 nt, Homo sapiens
uccaucuccacucca

SEQ ID NO: 1446187 - RNA, 12 nt, Homo sapiens
uccaucucuggc

SEQ ID NO: 1446188 - RNA, 22 nt, Homo sapiens
uccaugaaguuugaacuucaua

SEQ ID NO: 1446189 - RNA, 20 nt, Homo sapiens
uccaugucccuguauaauuc

SEQ ID NO: 1446190 - RNA, 22 nt, Homo sapiens
uccauuuauugcacucagcuuu

SEQ ID NO: 1446191 - RNA, 14 nt, Homo sapiens
uccauuugggauau

SEQ ID NO: 1446192 - RNA, 17 nt, Homo sapiens
ucccaaaagucaccacu

SEQ ID NO: 1446193 - RNA, 10 nt, Homo sapiens
ucccaaagaa

SEQ ID NO: 1446194 - RNA, 14 nt, Homo sapiens
ucccaaagcucaga

SEQ ID NO: 1446195 - RNA, 18 nt, Homo sapiens
ucccaaauaaacuccaga

SEQ ID NO: 1446196 - RNA, 23 nt, Homo sapiens
ucccaaccucaaugcccugccau

SEQ ID NO: 1446197 - RNA, 12 nt, Homo sapiens
ucccaagccaga

SEQ ID NO: 1446198 - RNA, 20 nt, Homo sapiens
ucccaaggugcuaggauuac

SEQ ID NO: 1446199 - RNA, 23 nt, Homo sapiens
ucccaaguauugcgaaugugcag

SEQ ID NO: 1446200 - RNA, 22 nt, Homo sapiens
ucccaauaaaagugacucucag

SEQ ID NO: 1446201 - RNA, 21 nt, Homo sapiens
ucccacccaacagcucagaga

SEQ ID NO: 1446202 - RNA, 15 nt, Homo sapiens
ucccacgacuguugu

SEQ ID NO: 1446203 - RNA, 20 nt, Homo sapiens
ucccacucauguuguuccca

SEQ ID NO: 1446204 - RNA, 14 nt, Homo sapiens
ucccagaaccacac

SEQ ID NO: 1446205 - RNA, 22 nt, Homo sapiens
ucccagaggcagagccugaguc

SEQ ID NO: 1446206 - RNA, 18 nt, Homo sapiens
ucccagaugccccagcaa

SEQ ID NO: 1446207 - RNA, 12 nt, Homo sapiens
ucccagcacuuu

SEQ ID NO: 1446208 - RNA, 20 nt, Homo sapiens
ucccagccccaggggugccu

SEQ ID NO: 1446209 - RNA, 15 nt, Homo sapiens
ucccagcuacucggg

SEQ ID NO: 1446210 - RNA, 20 nt, Homo sapiens
ucccagcugcagaugccaca

SEQ ID NO: 1446211 - RNA, 14 nt, Homo sapiens
ucccauccaucagc

SEQ ID NO: 1446212 - RNA, 18 nt, Homo sapiens
ucccauguugcaugccua

SEQ ID NO: 1446213 - RNA, 16 nt, Homo sapiens
ucccauucucauaugu

SEQ ID NO: 1446214 - RNA, 15 nt, Homo sapiens
ucccauucuugcaug

SEQ ID NO: 1446215 - RNA, 23 nt, Homo sapiens
uccccaaacauuaaucaccaaag

SEQ ID NO: 1446216 - RNA, 21 nt, Homo sapiens
uccccaagcuggcagcuguca

SEQ ID NO: 1446217 - RNA, 22 nt, Homo sapiens
uccccaaucccggucaugcuuu

SEQ ID NO: 1446218 - RNA, 20 nt, Homo sapiens
uccccacaccucccuacucc

SEQ ID NO: 1446219 - RNA, 18 nt, Homo sapiens
uccccacauauggcacaa

SEQ ID NO: 1446220 - RNA, 12 nt, Homo sapiens
uccccaccucag

SEQ ID NO: 1446221 - RNA, 23 nt, Homo sapiens
uccccagcccuggcucugcaaug

SEQ ID NO: 1446222 - RNA, 22 nt, Homo sapiens
ucccccuggggcuucuccugac

SEQ ID NO: 1446223 - RNA, 14 nt, Homo sapiens
uccccgggggagga

SEQ ID NO: 1446224 - RNA, 17 nt, Homo sapiens
uccccugaaaaacugau

SEQ ID NO: 1446225 - RNA, 20 nt, Homo sapiens
uccccugaaaaacugaucaa

SEQ ID NO: 1446226 - RNA, 16 nt, Homo sapiens
uccccuggacugggag

SEQ ID NO: 1446227 - RNA, 11 nt, Homo sapiens
uccccuguggu

SEQ ID NO: 1446228 - RNA, 19 nt, Homo sapiens
uccccuugcccuugcccug

SEQ ID NO: 1446229 - RNA, 14 nt, Homo sapiens
ucccgagcuacucu

SEQ ID NO: 1446230 - RNA, 17 nt, Homo sapiens
ucccgggggcacugccu

SEQ ID NO: 1446231 - RNA, 20 nt, Homo sapiens
ucccuaaaauaaaaaccaga

SEQ ID NO: 1446232 - RNA, 14 nt, Homo sapiens
ucccuagcagugaa

SEQ ID NO: 1446233 - RNA, 23 nt, Homo sapiens
ucccucccagauccucugcugac

SEQ ID NO: 1446234 - RNA, 22 nt, Homo sapiens
ucccucccgggggcacugccug

SEQ ID NO: 1446235 - RNA, 15 nt, Homo sapiens
ucccuccuaaccuag

SEQ ID NO: 1446236 - RNA, 21 nt, Homo sapiens
ucccucugagaauuccaagga

SEQ ID NO: 1446237 - RNA, 14 nt, Homo sapiens
ucccucuggcccug

SEQ ID NO: 1446238 - RNA, 17 nt, Homo sapiens
ucccugaaggccuucaa

SEQ ID NO: 1446239 - RNA, 22 nt, Homo sapiens
ucccugagagcucacaguacaa

SEQ ID NO: 1446240 - RNA, 16 nt, Homo sapiens
ucccugcuuaccugac

SEQ ID NO: 1446241 - RNA, 14 nt, Homo sapiens
ucccuggaccucug

SEQ ID NO: 1446242 - RNA, 18 nt, Homo sapiens
ucccugugcugacggaag

SEQ ID NO: 1446243 - RNA, 19 nt, Homo sapiens
ucccuguuaucugcuagau

SEQ ID NO: 1446244 - RNA, 14 nt, Homo sapiens
ucccuucuucccua

SEQ ID NO: 1446245 - RNA, 13 nt, Homo sapiens
ucccuugaaauuu

SEQ ID NO: 1446246 - RNA, 17 nt, Homo sapiens
ucccuugcucagugccu

SEQ ID NO: 1446247 - RNA, 17 nt, Homo sapiens
ucccuuggcagaguaug

SEQ ID NO: 1446248 - RNA, 18 nt, Homo sapiens
ucccuuuccuacucucag

SEQ ID NO: 1446249 - RNA, 18 nt, Homo sapiens
ucccuuuguggacaaguu

SEQ ID NO: 1446250 - RNA, 20 nt, Homo sapiens
ucccuuuuugucucucaugg

SEQ ID NO: 1446251 - RNA, 16 nt, Homo sapiens
uccgccaaacacucca

SEQ ID NO: 1446252 - RNA, 20 nt, Homo sapiens
uccggaagaaaaagagccau

SEQ ID NO: 1446253 - RNA, 19 nt, Homo sapiens
uccuaaaaauaagcuuuau

SEQ ID NO: 1446254 - RNA, 20 nt, Homo sapiens
uccuaacaaguagcacccug

SEQ ID NO: 1446255 - RNA, 21 nt, Homo sapiens
uccuacacccuuggacuugag

SEQ ID NO: 1446256 - RNA, 11 nt, Homo sapiens
uccuacugaug

SEQ ID NO: 1446257 - RNA, 16 nt, Homo sapiens
uccuacugauguuccu

SEQ ID NO: 1446258 - RNA, 21 nt, Homo sapiens
ugagacccucgccacggggag

SEQ ID NO: 1446259 - RNA, 19 nt, Homo sapiens
ugagagcugcucuggaaaa

SEQ ID NO: 1446260 - RNA, 18 nt, Homo sapiens
ugagaggguuugagucaa

SEQ ID NO: 1446261 - RNA, 17 nt, Homo sapiens
ugagaguaaugaggcuu

SEQ ID NO: 1446262 - RNA, 23 nt, Homo sapiens
ugagauccuuuaaauccuuccau

SEQ ID NO: 1446263 - RNA, 23 nt, Homo sapiens
ugagaucgugccguuacucucca

SEQ ID NO: 1446264 - RNA, 23 nt, Homo sapiens
ugagauguagccuggcccuggaa

SEQ ID NO: 1446265 - RNA, 15 nt, Homo sapiens
ugagauugugcccag

SEQ ID NO: 1446266 - RNA, 20 nt, Homo sapiens
ugagauuuaccagggaugua

SEQ ID NO: 1446267 - RNA, 17 nt, Homo sapiens
ugagcaaggacaaccug

SEQ ID NO: 1446268 - RNA, 17 nt, Homo sapiens
ugagcaauucauuucac

SEQ ID NO: 1446269 - RNA, 11 nt, Homo sapiens
ugagcacacac

SEQ ID NO: 1446270 - RNA, 17 nt, Homo sapiens
ugagccaaacacacugu

SEQ ID NO: 1446271 - RNA, 20 nt, Homo sapiens
ugagccaaacacacuguaaa

SEQ ID NO: 1446272 - RNA, 20 nt, Homo sapiens
ugagccaugaucgagccacu

SEQ ID NO: 1446273 - RNA, 14 nt, Homo sapiens
ugagccgcugugag

SEQ ID NO: 1446274 - RNA, 12 nt, Homo sapiens
ugagcugggaag

SEQ ID NO: 1446275 - RNA, 14 nt, Homo sapiens
ugagcuucaguaua

SEQ ID NO: 1446276 - RNA, 14 nt, Homo sapiens
ugaggaagccuaaa

SEQ ID NO: 1446277 - RNA, 12 nt, Homo sapiens
ugaggacacgug

SEQ ID NO: 1446278 - RNA, 22 nt, Homo sapiens
ugaggacauggagagagacuca

SEQ ID NO: 1446279 - RNA, 18 nt, Homo sapiens
ugaggaugugagccugau

SEQ ID NO: 1446280 - RNA, 17 nt, Homo sapiens
ugaggauguguuuugca

SEQ ID NO: 1446281 - RNA, 22 nt, Homo sapiens
ugaggcaaauggcacauggcug

SEQ ID NO: 1446282 - RNA, 19 nt, Homo sapiens
ugaggccgggcgcaguggc

SEQ ID NO: 1446283 - RNA, 15 nt, Homo sapiens
ugaggcuuccaggcu

SEQ ID NO: 1446284 - RNA, 14 nt, Homo sapiens
ugaggucacugggu

SEQ ID NO: 1446285 - RNA, 21 nt, Homo sapiens
ugaggucacuggguucuagaa

SEQ ID NO: 1446286 - RNA, 22 nt, Homo sapiens
ugagucucuaugaucuuggcac

SEQ ID NO: 1446287 - RNA, 22 nt, Homo sapiens
ugagugcuggauauuuuacuac

SEQ ID NO: 1446288 - RNA, 18 nt, Homo sapiens
ugaguggaucuccaagga

SEQ ID NO: 1446289 - RNA, 21 nt, Homo sapiens
ugaguuauaguuugcuuugcu

SEQ ID NO: 1446290 - RNA, 18 nt, Homo sapiens
ugaguuuccccacuuuag

SEQ ID NO: 1446291 - RNA, 19 nt, Homo sapiens
ugaguuugggauuguggua

SEQ ID NO: 1446292 - RNA, 21 nt, Homo sapiens
ugauaaacauuaaacacugua

SEQ ID NO: 1446293 - RNA, 14 nt, Homo sapiens
ugauaaagagggau

SEQ ID NO: 1446294 - RNA, 13 nt, Homo sapiens
ugauacugcaaua

SEQ ID NO: 1446295 - RNA, 14 nt, Homo sapiens
ugauauaugccuau

SEQ ID NO: 1446296 - RNA, 17 nt, Homo sapiens
ugauauuuuuacuugca

SEQ ID NO: 1446297 - RNA, 17 nt, Homo sapiens
ugaucaaaaauaaacua

SEQ ID NO: 1446298 - RNA, 22 nt, Homo sapiens
ugaucaaaaauaaacuaguuuc

SEQ ID NO: 1446299 - RNA, 12 nt, Homo sapiens
ugaucaacuguu

SEQ ID NO: 1446300 - RNA, 21 nt, Homo sapiens
ugaucaggcuauguauggaau

SEQ ID NO: 1446301 - RNA, 12 nt, Homo sapiens
ugaucaugguca

SEQ ID NO: 1446302 - RNA, 17 nt, Homo sapiens
ugauccuuuuauguuau

SEQ ID NO: 1446303 - RNA, 15 nt, Homo sapiens
ugaucgugccuauaa

SEQ ID NO: 1446304 - RNA, 18 nt, Homo sapiens
ugaugaggccucuuggac

SEQ ID NO: 1446305 - RNA, 17 nt, Homo sapiens
ugaugccccuuccccaa

SEQ ID NO: 1446306 - RNA, 15 nt, Homo sapiens
ugauggcgauucccu

SEQ ID NO: 1446307 - RNA, 18 nt, Homo sapiens
ugauggcguggcaacccu

SEQ ID NO: 1446308 - RNA, 16 nt, Homo sapiens
ugaugggucccaaaag

SEQ ID NO: 1446309 - RNA, 15 nt, Homo sapiens
ugaugugaaacauua

SEQ ID NO: 1446310 - RNA, 22 nt, Homo sapiens
ugauguuguuacugauucuccu

SEQ ID NO: 1446311 - RNA, 16 nt, Homo sapiens
ugauuauccuauaggc

SEQ ID NO: 1446312 - RNA, 23 nt, Homo sapiens
ugauucaaaagaugccauucaua

SEQ ID NO: 1446313 - RNA, 21 nt, Homo sapiens
ugauucacaaugaaaugcucu

SEQ ID NO: 1446314 - RNA, 12 nt, Homo sapiens
ugauucugggau

SEQ ID NO: 1446315 - RNA, 13 nt, Homo sapiens
ugauuggcucacc

SEQ ID NO: 1446316 - RNA, 18 nt, Homo sapiens
ugauuuuauacauaguca

SEQ ID NO: 1446317 - RNA, 17 nt, Homo sapiens
ugauuuugucacugucu

SEQ ID NO: 1446318 - RNA, 21 nt, Homo sapiens
ugauuuuuguaauaaaaggua

SEQ ID NO: 1446319 - RNA, 21 nt, Homo sapiens
ugcaaaggcgcagugcuucuc

SEQ ID NO: 1446320 - RNA, 17 nt, Homo sapiens
ugcaaaugcuauauugc

SEQ ID NO: 1446321 - RNA, 18 nt, Homo sapiens
ugcaaaugcuauauugca

SEQ ID NO: 1446322 - RNA, 17 nt, Homo sapiens
ugcaaccacacaccuca

SEQ ID NO: 1446323 - RNA, 16 nt, Homo sapiens
ugcaaccucacuaugg

SEQ ID NO: 1446324 - RNA, 17 nt, Homo sapiens
ugcaaccucuuccuccu

SEQ ID NO: 1446325 - RNA, 18 nt, Homo sapiens
ugcaagaguggacugaau

SEQ ID NO: 1446326 - RNA, 22 nt, Homo sapiens
ugcaaggauucagcauuauucc

SEQ ID NO: 1446327 - RNA, 23 nt, Homo sapiens
ugcaagugcuaugccaagccaug

SEQ ID NO: 1446328 - RNA, 14 nt, Homo sapiens
ugcaauauuuacau

SEQ ID NO: 1446329 - RNA, 18 nt, Homo sapiens
ugcaaugggcacugggau

SEQ ID NO: 1446330 - RNA, 9 nt, Homo sapiens
ugcacaauu

SEQ ID NO: 1446331 - RNA, 12 nt, Homo sapiens
ugcacaauuuga

SEQ ID NO: 1446332 - RNA, 17 nt, Homo sapiens
ugcacacacacagagau

SEQ ID NO: 1446333 - RNA, 22 nt, Homo sapiens
ugcacacacacagagauaugca

SEQ ID NO: 1446334 - RNA, 13 nt, Homo sapiens
ugcacacacagau

SEQ ID NO: 1446335 - RNA, 19 nt, Homo sapiens
ugcacacacagaugcacac

SEQ ID NO: 1446336 - RNA, 12 nt, Homo sapiens
ugcacaccaaaa

SEQ ID NO: 1446337 - RNA, 23 nt, Homo sapiens
ugcacaccaaaaaaauacuugag

SEQ ID NO: 1446338 - RNA, 12 nt, Homo sapiens
ugcacacgcaca

SEQ ID NO: 1446339 - RNA, 21 nt, Homo sapiens
ugcacacggaugcacagagau

SEQ ID NO: 1446340 - RNA, 16 nt, Homo sapiens
ugcacagagauaugca

SEQ ID NO: 1446341 - RNA, 18 nt, Homo sapiens
ugcacagagauaugcaca

SEQ ID NO: 1446342 - RNA, 19 nt, Homo sapiens
ugcacagagauaugcacac

SEQ ID NO: 1446343 - RNA, 21 nt, Homo sapiens
ugcacuaggucaaaacauuca

SEQ ID NO: 1446344 - RNA, 16 nt, Homo sapiens
uguagcagaaaccaag

SEQ ID NO: 1446345 - RNA, 22 nt, Homo sapiens
uguagcaucuucuggagucucc

SEQ ID NO: 1446346 - RNA, 23 nt, Homo sapiens
uguagcccucaugauaaucuggg

SEQ ID NO: 1446347 - RNA, 14 nt, Homo sapiens
uguaggcaaccuuc

SEQ ID NO: 1446348 - RNA, 19 nt, Homo sapiens
uguagguaauauuguucua

SEQ ID NO: 1446349 - RNA, 17 nt, Homo sapiens
uguaguucuugugcaug

SEQ ID NO: 1446350 - RNA, 17 nt, Homo sapiens
uguauauacacauauac

SEQ ID NO: 1446351 - RNA, 22 nt, Homo sapiens
uguauauugguugaaacuguua

SEQ ID NO: 1446352 - RNA, 18 nt, Homo sapiens
uguaucauuaauguaggu

SEQ ID NO: 1446353 - RNA, 17 nt, Homo sapiens
uguaucauuugaacaac

SEQ ID NO: 1446354 - RNA, 20 nt, Homo sapiens
uguaucuaccaucuaaucua

SEQ ID NO: 1446355 - RNA, 20 nt, Homo sapiens
uguaucuguaauuaauauuc

SEQ ID NO: 1446356 - RNA, 15 nt, Homo sapiens
uguaugcucauacuu

SEQ ID NO: 1446357 - RNA, 15 nt, Homo sapiens
uguaugugaaagugu

SEQ ID NO: 1446358 - RNA, 22 nt, Homo sapiens
uguauuacaucuaaugcuucaa

SEQ ID NO: 1446359 - RNA, 19 nt, Homo sapiens
uguauucaugaacuuggcu

SEQ ID NO: 1446360 - RNA, 19 nt, Homo sapiens
uguauuugucaaugcauca

SEQ ID NO: 1446361 - RNA, 17 nt, Homo sapiens
uguauuuuuguacccuu

SEQ ID NO: 1446362 - RNA, 14 nt, Homo sapiens
ugucaaauaucuca

SEQ ID NO: 1446363 - RNA, 21 nt, Homo sapiens
ugucaagaugaugaugaucuu

SEQ ID NO: 1446364 - RNA, 14 nt, Homo sapiens
ugucaaguacaagc

SEQ ID NO: 1446365 - RNA, 14 nt, Homo sapiens
ugucaaugcaucaa

SEQ ID NO: 1446366 - RNA, 17 nt, Homo sapiens
ugucaccuugcucagcc

SEQ ID NO: 1446367 - RNA, 18 nt, Homo sapiens
ugucacuguuccuuguca

SEQ ID NO: 1446368 - RNA, 21 nt, Homo sapiens
ugucagagcugggaguagcau

SEQ ID NO: 1446369 - RNA, 21 nt, Homo sapiens
ugucauauggaagaguuaaaa

SEQ ID NO: 1446370 - RNA, 22 nt, Homo sapiens
ugucaucaaauauuaccaaaaa

SEQ ID NO: 1446371 - RNA, 16 nt, Homo sapiens
ugucaucauacaugac

SEQ ID NO: 1446372 - RNA, 19 nt, Homo sapiens
ugucauucaagccugugaa

SEQ ID NO: 1446373 - RNA, 12 nt, Homo sapiens
ugucccaaagaa

SEQ ID NO: 1446374 - RNA, 17 nt, Homo sapiens
uguccccuccacuguca

SEQ ID NO: 1446375 - RNA, 23 nt, Homo sapiens
ugucccucaaaugacccaaagac

SEQ ID NO: 1446376 - RNA, 16 nt, Homo sapiens
uguccuggcaccaaau

SEQ ID NO: 1446377 - RNA, 13 nt, Homo sapiens
ugucgucuuuaug

SEQ ID NO: 1446378 - RNA, 16 nt, Homo sapiens
ugucuaaagagcuuua

SEQ ID NO: 1446379 - RNA, 16 nt, Homo sapiens
ugucuauaauggaaac

SEQ ID NO: 1446380 - RNA, 13 nt, Homo sapiens
ugucucagccucc

SEQ ID NO: 1446381 - RNA, 9 nt, Homo sapiens
ugucucucu

SEQ ID NO: 1446382 - RNA, 15 nt, Homo sapiens
ugucuggaagcugag

SEQ ID NO: 1446383 - RNA, 15 nt, Homo sapiens
ugucuggugguggca

SEQ ID NO: 1446384 - RNA, 17 nt, Homo sapiens
ugucuuagcuguauaca

SEQ ID NO: 1446385 - RNA, 16 nt, Homo sapiens
ugucuucacaaccucc

SEQ ID NO: 1446386 - RNA, 19 nt, Homo sapiens
ugucuuccaaccccagcug

SEQ ID NO: 1446387 - RNA, 22 nt, Homo sapiens
ugucuuguccccucuugaccca

SEQ ID NO: 1446388 - RNA, 18 nt, Homo sapiens
ugugaacauugucuggau

SEQ ID NO: 1446389 - RNA, 16 nt, Homo sapiens
ugugaauaaaaacccu

SEQ ID NO: 1446390 - RNA, 18 nt, Homo sapiens
ugugacagucuugcauuc

SEQ ID NO: 1446391 - RNA, 15 nt, Homo sapiens
ugugaccagggguga

SEQ ID NO: 1446392 - RNA, 16 nt, Homo sapiens
ugugacuaucuuuaug

SEQ ID NO: 1446393 - RNA, 18 nt, Homo sapiens
ugugacuauguuccaaua

SEQ ID NO: 1446394 - RNA, 22 nt, Homo sapiens
ugugacuccagccugcccucag

SEQ ID NO: 1446395 - RNA, 22 nt, Homo sapiens
ugugacuuuuuagccagugacu

SEQ ID NO: 1446396 - RNA, 19 nt, Homo sapiens
ugugacuuuuucagaguug

SEQ ID NO: 1446397 - RNA, 20 nt, Homo sapiens
ugugacuuuuucagaguugc

SEQ ID NO: 1446398 - RNA, 13 nt, Homo sapiens
ugugcaacaaaca

SEQ ID NO: 1446399 - RNA, 16 nt, Homo sapiens
ugugcaucuguacuca

SEQ ID NO: 1446400 - RNA, 20 nt, Homo sapiens
ugugcaugaaagagaaagac

SEQ ID NO: 1446401 - RNA, 15 nt, Homo sapiens
ugugcaugugagcac

SEQ ID NO: 1446402 - RNA, 20 nt, Homo sapiens
ugugccaccaccccuugacc

SEQ ID NO: 1446403 - RNA, 11 nt, Homo sapiens
ugugccagcuc

SEQ ID NO: 1446404 - RNA, 15 nt, Homo sapiens
ugugccccaugucca

SEQ ID NO: 1446405 - RNA, 20 nt, Homo sapiens
ugugcccuccaccuaccugc

SEQ ID NO: 1446406 - RNA, 15 nt, Homo sapiens
ugugccucagccucc

SEQ ID NO: 1446407 - RNA, 15 nt, Homo sapiens
ugugccuuacuuaag

SEQ ID NO: 1446408 - RNA, 18 nt, Homo sapiens
ugugccuuugaccaucuc

SEQ ID NO: 1446409 - RNA, 13 nt, Homo sapiens
ugugcgcacacac

SEQ ID NO: 1446410 - RNA, 12 nt, Homo sapiens
ugugcuauugaa

SEQ ID NO: 1446411 - RNA, 14 nt, Homo sapiens
ugugcucacugggg

SEQ ID NO: 1446412 - RNA, 17 nt, Homo sapiens
ugugcucuucugucugc

SEQ ID NO: 1446413 - RNA, 21 nt, Homo sapiens
ugugcugcccugcucugggga

SEQ ID NO: 1446414 - RNA, 18 nt, Homo sapiens
uguggcaguuacagggcc

SEQ ID NO: 1446415 - RNA, 18 nt, Homo sapiens
uguggccuguguccagca

SEQ ID NO: 1446416 - RNA, 22 nt, Homo sapiens
ugugggacugacauuucucaau

SEQ ID NO: 1446417 - RNA, 20 nt, Homo sapiens
ugugggcccagcuacaagga

SEQ ID NO: 1446418 - RNA, 17 nt, Homo sapiens
uguggguuuuuucacau

SEQ ID NO: 1446419 - RNA, 20 nt, Homo sapiens
uguggguuuuuucacauaaa

SEQ ID NO: 1446420 - RNA, 16 nt, Homo sapiens
ugugguacaaucucaa

SEQ ID NO: 1446421 - RNA, 22 nt, Homo sapiens
uguggugacaggcccaguggaa

SEQ ID NO: 1446422 - RNA, 21 nt, Homo sapiens
uguggugagggaagacgccuu

SEQ ID NO: 1446423 - RNA, 22 nt, Homo sapiens
uguguaaauacaguggaucuca

SEQ ID NO: 1446424 - RNA, 22 nt, Homo sapiens
uguguacucuuuauuucuagca

SEQ ID NO: 1446425 - RNA, 14 nt, Homo sapiens
uguguauauauaca

SEQ ID NO: 1446426 - RNA, 19 nt, Homo sapiens
uguguccccaccucaggcu

SEQ ID NO: 1446427 - RNA, 17 nt, Homo sapiens
ugugucccccccagugc

SEQ ID NO: 1446428 - RNA, 22 nt, Homo sapiens
uguguccuuggggcacagucau

SEQ ID NO: 1446429 - RNA, 14 nt, Homo sapiens
ugugugcauguaug

SEQ ID NO: 1446430 - RNA, 15 nt, Homo sapiens
uucuuacccauauau

SEQ ID NO: 1446431 - RNA, 21 nt, Homo sapiens
uucuucucccuguguggcugc

SEQ ID NO: 1446432 - RNA, 15 nt, Homo sapiens
uucuuuacauuugau

SEQ ID NO: 1446433 - RNA, 15 nt, Homo sapiens
uucuuucucuucccu

SEQ ID NO: 1446434 - RNA, 19 nt, Homo sapiens
uucuuuucaaaacugcuaa

SEQ ID NO: 1446435 - RNA, 13 nt, Homo sapiens
uucuuuugcucuu

SEQ ID NO: 1446436 - RNA, 16 nt, Homo sapiens
uucuuuuucacacuga

SEQ ID NO: 1446437 - RNA, 18 nt, Homo sapiens
uucuuuuucguuggugua

SEQ ID NO: 1446438 - RNA, 21 nt, Homo sapiens
uugaaaaugaaaugacugucu

SEQ ID NO: 1446439 - RNA, 14 nt, Homo sapiens
uugaaaauguucag

SEQ ID NO: 1446440 - RNA, 18 nt, Homo sapiens
uugaaacccauuaggcau

SEQ ID NO: 1446441 - RNA, 17 nt, Homo sapiens
uugaaauaccagugaac

SEQ ID NO: 1446442 - RNA, 21 nt, Homo sapiens
uugaaauaccagugaaccaaa

SEQ ID NO: 1446443 - RNA, 23 nt, Homo sapiens
uugaaauaccagugaaccaaaga

SEQ ID NO: 1446444 - RNA, 20 nt, Homo sapiens
uugaaaugagaaacuuugau

SEQ ID NO: 1446445 - RNA, 23 nt, Homo sapiens
uugaaaugagaaacuuugaucuc

SEQ ID NO: 1446446 - RNA, 13 nt, Homo sapiens
uugaaccaauaau

SEQ ID NO: 1446447 - RNA, 12 nt, Homo sapiens
uugaacugguuc

SEQ ID NO: 1446448 - RNA, 15 nt, Homo sapiens
uugaacugguuguga

SEQ ID NO: 1446449 - RNA, 19 nt, Homo sapiens
uugaacuuauuuacacaua

SEQ ID NO: 1446450 - RNA, 18 nt, Homo sapiens
uugaagaagaguuucucc

SEQ ID NO: 1446451 - RNA, 18 nt, Homo sapiens
uugaagagcauugcaugg

SEQ ID NO: 1446452 - RNA, 17 nt, Homo sapiens
uugaaucaaagcaguua

SEQ ID NO: 1446453 - RNA, 19 nt, Homo sapiens
uugacaaagaaacccaagu

SEQ ID NO: 1446454 - RNA, 15 nt, Homo sapiens
uugacaucagcauua

SEQ ID NO: 1446455 - RNA, 15 nt, Homo sapiens
uugaccucagcugca

SEQ ID NO: 1446456 - RNA, 15 nt, Homo sapiens
uugacgccaccauaa

SEQ ID NO: 1446457 - RNA, 13 nt, Homo sapiens
uugacuaucacau

SEQ ID NO: 1446458 - RNA, 22 nt, Homo sapiens
uugacuugugucuguccaagaa

SEQ ID NO: 1446459 - RNA, 18 nt, Homo sapiens
uugagaauacacuaucaa

SEQ ID NO: 1446460 - RNA, 21 nt, Homo sapiens
uugagguggugccuucucaca

SEQ ID NO: 1446461 - RNA, 17 nt, Homo sapiens
uugaucaaaucuaaugu

SEQ ID NO: 1446462 - RNA, 20 nt, Homo sapiens
uugaucccuguuacccagag

SEQ ID NO: 1446463 - RNA, 22 nt, Homo sapiens
uugauucacaaugaaaugcucu

SEQ ID NO: 1446464 - RNA, 22 nt, Homo sapiens
uugcaagacaaaguugaaugua

SEQ ID NO: 1446465 - RNA, 22 nt, Homo sapiens
uugcacuaggucaaaacauuca

SEQ ID NO: 1446466 - RNA, 13 nt, Homo sapiens
uugcauaugucau

SEQ ID NO: 1446467 - RNA, 20 nt, Homo sapiens
uugcauuugucaaagcauug

SEQ ID NO: 1446468 - RNA, 16 nt, Homo sapiens
uugccacaacccuguu

SEQ ID NO: 1446469 - RNA, 14 nt, Homo sapiens
uugccacacacugu

SEQ ID NO: 1446470 - RNA, 18 nt, Homo sapiens
uugccaugucuuguucag

SEQ ID NO: 1446471 - RNA, 17 nt, Homo sapiens
uugcccagagaugccuc

SEQ ID NO: 1446472 - RNA, 21 nt, Homo sapiens
uugcccaggcuggagugcagu

SEQ ID NO: 1446473 - RNA, 19 nt, Homo sapiens
uugcccccuccccacuuuu

SEQ ID NO: 1446474 - RNA, 18 nt, Homo sapiens
uugccccuuccacuuuga

SEQ ID NO: 1446475 - RNA, 19 nt, Homo sapiens
uugcccuggauuguugaca

SEQ ID NO: 1446476 - RNA, 17 nt, Homo sapiens
uugcccuucacaguguu

SEQ ID NO: 1446477 - RNA, 16 nt, Homo sapiens
uugccuggaagcacau

SEQ ID NO: 1446478 - RNA, 17 nt, Homo sapiens
uugcuacugguucagca

SEQ ID NO: 1446479 - RNA, 21 nt, Homo sapiens
uugcucuuggaaagcugauga

SEQ ID NO: 1446480 - RNA, 13 nt, Homo sapiens
uugcucuuuggua

SEQ ID NO: 1446481 - RNA, 14 nt, Homo sapiens
uugcuggacuguca

SEQ ID NO: 1446482 - RNA, 20 nt, Homo sapiens
uugcuucucauccccagucc

SEQ ID NO: 1446483 - RNA, 16 nt, Homo sapiens
uuggaaaguucagcca

SEQ ID NO: 1446484 - RNA, 20 nt, Homo sapiens
uuggaaggcucccuaacaca

SEQ ID NO: 1446485 - RNA, 14 nt, Homo sapiens
uuggaauacuaaaa

SEQ ID NO: 1446486 - RNA, 14 nt, Homo sapiens
uuggaauacuugaa

SEQ ID NO: 1446487 - RNA, 13 nt, Homo sapiens
uuggaaucuguau

SEQ ID NO: 1446488 - RNA, 19 nt, Homo sapiens
uuggacagucugagcugua

SEQ ID NO: 1446489 - RNA, 16 nt, Homo sapiens
uuggaccauccuauuu

SEQ ID NO: 1446490 - RNA, 22 nt, Homo sapiens
uuggagagcagcuggcucucca

SEQ ID NO: 1446491 - RNA, 20 nt, Homo sapiens
uuggagcaagugacaugcca

SEQ ID NO: 1446492 - RNA, 14 nt, Homo sapiens
uuggauguggagcu

SEQ ID NO: 1446493 - RNA, 15 nt, Homo sapiens
uuggcaaacuuugua

SEQ ID NO: 1446494 - RNA, 13 nt, Homo sapiens
uuggcaacagaag

SEQ ID NO: 1446495 - RNA, 15 nt, Homo sapiens
uuggcccucucccau

SEQ ID NO: 1446496 - RNA, 20 nt, Homo sapiens
uuggcuaucuacugagacau

SEQ ID NO: 1446497 - RNA, 11 nt, Homo sapiens
uuggcugugag

SEQ ID NO: 1446498 - RNA, 21 nt, Homo sapiens
uugggaaaaaggccucugucc

SEQ ID NO: 1446499 - RNA, 14 nt, Homo sapiens
uugggaaaacuggg

SEQ ID NO: 1446500 - RNA, 15 nt, Homo sapiens
uugggccucuuguac

SEQ ID NO: 1446501 - RNA, 21 nt, Homo sapiens
uuggggcacagucauucacau

SEQ ID NO: 1446502 - RNA, 17 nt, Homo sapiens
uugguacuuguuucacc

SEQ ID NO: 1446503 - RNA, 13 nt, Homo sapiens
uugguauauuucc

SEQ ID NO: 1446504 - RNA, 22 nt, Homo sapiens
uugguugaacuaugcugaagag

SEQ ID NO: 1446505 - RNA, 21 nt, Homo sapiens
uuguaaaccaucgcgugcaau

SEQ ID NO: 1446506 - RNA, 17 nt, Homo sapiens
uuguaacaauagcacaa

SEQ ID NO: 1446507 - RNA, 22 nt, Homo sapiens
uuguaagcacugacugggacca

SEQ ID NO: 1446508 - RNA, 22 nt, Homo sapiens
uuguaauaaaggucuuugcaca

SEQ ID NO: 1446509 - RNA, 17 nt, Homo sapiens
uuguaauaugucugcca

SEQ ID NO: 1446510 - RNA, 16 nt, Homo sapiens
uuguaaugucaccacc

SEQ ID NO: 1446511 - RNA, 15 nt, Homo sapiens
uuguacaauaccaga

SEQ ID NO: 1446512 - RNA, 12 nt, Homo sapiens
uuguacauauug

SEQ ID NO: 1446513 - RNA, 13 nt, Homo sapiens
uuguacucuugcu

SEQ ID NO: 1446514 - RNA, 19 nt, Homo sapiens
uuguagaaaugagccagaa

SEQ ID NO: 1446515 - RNA, 15 nt, Homo sapiens
uuguauguaucuauu

SEQ ID NO: 1446516 - RNA, 21 nt, Homo sapiens
uuguauguuaaagcaucagag

SEQ ID NO: 1446517 - RNA, 12 nt, Homo sapiens
uuguauugcaag

SEQ ID NO: 1446518 - RNA, 13 nt, Homo sapiens
uuguauuugccau

SEQ ID NO: 1446519 - RNA, 23 nt, Homo sapiens
uugucacuaugcuauuucuggcc

SEQ ID NO: 1446520 - RNA, 11 nt, Homo sapiens
uugucaugaau

SEQ ID NO: 1446521 - RNA, 14 nt, Homo sapiens
uuguccuaugucaa

SEQ ID NO: 1446522 - RNA, 11 nt, Homo sapiens
uugucucaaga

SEQ ID NO: 1446523 - RNA, 20 nt, Homo sapiens
uugucuguuuuuguaacuua

SEQ ID NO: 1446524 - RNA, 18 nt, Homo sapiens
uugugauuuuugaacaau

SEQ ID NO: 1446525 - RNA, 16 nt, Homo sapiens
uugugcccuccaccua

SEQ ID NO: 1446526 - RNA, 14 nt, Homo sapiens
uuguguacugauaa

SEQ ID NO: 1446527 - RNA, 17 nt, Homo sapiens
uuguguccccaccucag

SEQ ID NO: 1446528 - RNA, 13 nt, Homo sapiens
uuguuaugcuauu

SEQ ID NO: 1446529 - RNA, 12 nt, Homo sapiens
uuguuauuucag

SEQ ID NO: 1446530 - RNA, 18 nt, Homo sapiens
uuguucacuagacugugc

SEQ ID NO: 1446531 - RNA, 23 nt, Homo sapiens
uuguucgccgcguggaaugugag

SEQ ID NO: 1446532 - RNA, 16 nt, Homo sapiens
uuguugcugucaagau

SEQ ID NO: 1446533 - RNA, 14 nt, Homo sapiens
uuguuuuauauucu

SEQ ID NO: 1446534 - RNA, 13 nt, Homo sapiens
uuuaaaaagcuag

SEQ ID NO: 1446535 - RNA, 15 nt, Homo sapiens
uuuaaaaccaugcag

SEQ ID NO: 1446536 - RNA, 15 nt, Homo sapiens
uuuaaaagcaucuca

SEQ ID NO: 1446537 - RNA, 18 nt, Homo sapiens
uuuaaaaucacaacacag

SEQ ID NO: 1446538 - RNA, 21 nt, Homo sapiens
uuuaaaaucauuucugcauca

SEQ ID NO: 1446539 - RNA, 21 nt, Homo sapiens
uuuaaagcuuauuaaaacuca

SEQ ID NO: 1446540 - RNA, 22 nt, Homo sapiens
uuuaaagguagagaugugugug

SEQ ID NO: 1446541 - RNA, 18 nt, Homo sapiens
uuuaaagugguucuggau

SEQ ID NO: 1446542 - RNA, 17 nt, Homo sapiens
uuuaaaucaaacuguaa

SEQ ID NO: 1446543 - RNA, 20 nt, Homo sapiens
uuuaaaugaugauuccuuga

SEQ ID NO: 1446544 - RNA, 20 nt, Homo sapiens
uuuaaaugugcaguacacau

SEQ ID NO: 1446545 - RNA, 14 nt, Homo sapiens
uuuaaauguucaca

SEQ ID NO: 1446546 - RNA, 17 nt, Homo sapiens
uuuaacaaaacaagaaa

SEQ ID NO: 1446547 - RNA, 14 nt, Homo sapiens
uuuaacugcauaau

SEQ ID NO: 1446548 - RNA, 18 nt, Homo sapiens
uuuaacuggcuucagccu

SEQ ID NO: 1446549 - RNA, 16 nt, Homo sapiens
uuuaacuugaggguaa

SEQ ID NO: 1446550 - RNA, 14 nt, Homo sapiens
uuuaagaacgaagg

SEQ ID NO: 1446551 - RNA, 14 nt, Homo sapiens
uuuaagaacuguau

SEQ ID NO: 1446552 - RNA, 13 nt, Homo sapiens
uuuaagcuguaaa

SEQ ID NO: 1446553 - RNA, 17 nt, Homo sapiens
uuuaaguauauaguaua

SEQ ID NO: 1446554 - RNA, 17 nt, Homo sapiens
uuuacaaguguauauca

SEQ ID NO: 1446555 - RNA, 20 nt, Homo sapiens
uuuacagaauggaaccaaaa

SEQ ID NO: 1446556 - RNA, 14 nt, Homo sapiens
uuuacagacuguga

SEQ ID NO: 1446557 - RNA, 13 nt, Homo sapiens
uuuacagcugccu

SEQ ID NO: 1446558 - RNA, 17 nt, Homo sapiens
uuuaccuacucuaugua

SEQ ID NO: 1446559 - RNA, 20 nt, Homo sapiens
uuuacuaauccaacccauga

SEQ ID NO: 1446560 - RNA, 13 nt, Homo sapiens
uuuagauuguuaa

SEQ ID NO: 1446561 - RNA, 23 nt, Homo sapiens
uuuauaaaagaauaaaauugcac

SEQ ID NO: 1446562 - RNA, 18 nt, Homo sapiens
uuuauauuuuuauagaca

SEQ ID NO: 1446563 - RNA, 14 nt, Homo sapiens
uuuaucugugacca

SEQ ID NO: 1446564 - RNA, 21 nt, Homo sapiens
uuuaugucaucauacaugacu

SEQ ID NO: 1446565 - RNA, 14 nt, Homo sapiens
uuuauguucucaga

SEQ ID NO: 1446566 - RNA, 22 nt, Homo sapiens
uuuauuaguuaauauaucccag

SEQ ID NO: 1446567 - RNA, 16 nt, Homo sapiens
uuuauuggggugccua

SEQ ID NO: 1446568 - RNA, 21 nt, Homo sapiens
uuuauuuacaucuauguaucu

SEQ ID NO: 1446569 - RNA, 13 nt, Homo sapiens
uuuauuucucggg

SEQ ID NO: 1446570 - RNA, 15 nt, Homo sapiens
uuucaaaacacaucu

SEQ ID NO: 1446571 - RNA, 13 nt, Homo sapiens
uuucaaacuauug

SEQ ID NO: 1446572 - RNA, 23 nt, Homo sapiens
uuucaaacugaguaaauuggaaa

SEQ ID NO: 1446573 - RNA, 16 nt, Homo sapiens
uuucaacaaguaacuu

SEQ ID NO: 1446574 - RNA, 12 nt, Homo sapiens
uuucaaccagca

SEQ ID NO: 1446575 - RNA, 18 nt, Homo sapiens
uuucaaccgcuugccaua

SEQ ID NO: 1446576 - RNA, 12 nt, Homo sapiens
uuucaacuauuu

SEQ ID NO: 1446577 - RNA, 21 nt, Homo sapiens
uuucaagacuugauacugcaa

SEQ ID NO: 1446578 - RNA, 15 nt, Homo sapiens
uuucacauaaaaccu

SEQ ID NO: 1446579 - RNA, 17 nt, Homo sapiens
uuucacauaaacacaua

SEQ ID NO: 1446580 - RNA, 12 nt, Homo sapiens
uuucagcuaaag

SEQ ID NO: 1446581 - RNA, 22 nt, Homo sapiens
uuucauggaaguggcagugaaa

SEQ ID NO: 1446582 - RNA, 18 nt, Homo sapiens
uuucauuguaaucaaaaa

SEQ ID NO: 1446583 - RNA, 15 nt, Homo sapiens
uuuccacgagcuaua

SEQ ID NO: 1446584 - RNA, 23 nt, Homo sapiens
uuuccauugcuuauucuugagca

SEQ ID NO: 1446585 - RNA, 14 nt, Homo sapiens
uuucccacacccca

SEQ ID NO: 1446586 - RNA, 22 nt, Homo sapiens
uuucccaccaccuuggacuccu

SEQ ID NO: 1446587 - RNA, 21 nt, Homo sapiens
uuucccaccgcuuugugagcc

SEQ ID NO: 1446588 - RNA, 23 nt, Homo sapiens
uuucccaugauccagaacugagg

SEQ ID NO: 1446589 - RNA, 13 nt, Homo sapiens
uuucccuuccagu

SEQ ID NO: 1446590 - RNA, 16 nt, Homo sapiens
uuuccuccaaacuccu

SEQ ID NO: 1446591 - RNA, 13 nt, Homo sapiens
uuuccuccccacc

SEQ ID NO: 1446592 - RNA, 21 nt, Homo sapiens
uuuccucgccuaggccuguga

SEQ ID NO: 1446593 - RNA, 18 nt, Homo sapiens
uuucuaacuccagugaag

SEQ ID NO: 1446594 - RNA, 16 nt, Homo sapiens
uuucuaccuuuacuac

SEQ ID NO: 1446595 - RNA, 22 nt, Homo sapiens
uuucuccuuuugaccaaauaaa

SEQ ID NO: 1446596 - RNA, 14 nt, Homo sapiens
uuucugaguuucau

SEQ ID NO: 1446597 - RNA, 13 nt, Homo sapiens
uuucuguaaacuc

SEQ ID NO: 1446598 - RNA, 17 nt, Homo sapiens
uuucuguugccacaacc

SEQ ID NO: 1446599 - RNA, 20 nt, Homo sapiens
uuucuuaaauauuaugugaa

SEQ ID NO: 1446600 - RNA, 22 nt, Homo sapiens
uuucuuauagucaauguuucuu

SEQ ID NO: 1446601 - RNA, 19 nt, Homo sapiens
uuucuucuacaaccagagc

SEQ ID NO: 1446602 - RNA, 16 nt, Homo sapiens
uuucuuuuaucacgau

SEQ ID NO: 1446603 - RNA, 17 nt, Homo sapiens
uuucuuuuucugucucu

SEQ ID NO: 1446604 - RNA, 18 nt, Homo sapiens
aacugauuuaugaucacu

SEQ ID NO: 1446605 - RNA, 21 nt, Homo sapiens
aacuggaggaguuccuugauc

SEQ ID NO: 1446606 - RNA, 16 nt, Homo sapiens
aacuguaaaucacuug

SEQ ID NO: 1446607 - RNA, 14 nt, Homo sapiens
aacuguacauguga

SEQ ID NO: 1446608 - RNA, 23 nt, Homo sapiens
aacuguccuuccauuugggauau

SEQ ID NO: 1446609 - RNA, 14 nt, Homo sapiens
aacuguuguuuacu

SEQ ID NO: 1446610 - RNA, 14 nt, Homo sapiens
aacuuaaaagauuc

SEQ ID NO: 1446611 - RNA, 18 nt, Homo sapiens
aacuuauugucuaggcca

SEQ ID NO: 1446612 - RNA, 17 nt, Homo sapiens
aacuucagcaccaugga

SEQ ID NO: 1446613 - RNA, 23 nt, Homo sapiens
aacuuccacauuauacauuugau

SEQ ID NO: 1446614 - RNA, 12 nt, Homo sapiens
aacuucuuguug

SEQ ID NO: 1446615 - RNA, 15 nt, Homo sapiens
aacuugcauauguca

SEQ ID NO: 1446616 - RNA, 15 nt, Homo sapiens
aacuugcugcugagu

SEQ ID NO: 1446617 - RNA, 18 nt, Homo sapiens
aacuugggggaggaggaa

SEQ ID NO: 1446618 - RNA, 12 nt, Homo sapiens
aacuuguaaaua

SEQ ID NO: 1446619 - RNA, 13 nt, Homo sapiens
aacuuguccuaug

SEQ ID NO: 1446620 - RNA, 13 nt, Homo sapiens
aacuuuguauuaa

SEQ ID NO: 1446621 - RNA, 18 nt, Homo sapiens
aacuuuguauuaaugugu

SEQ ID NO: 1446622 - RNA, 13 nt, Homo sapiens
aacuuuugugcuc

SEQ ID NO: 1446623 - RNA, 15 nt, Homo sapiens
aacuuuugugcuccc

SEQ ID NO: 1446624 - RNA, 14 nt, Homo sapiens
aagaaaaaaucugc

SEQ ID NO: 1446625 - RNA, 12 nt, Homo sapiens
aagaaaaccauu

SEQ ID NO: 1446626 - RNA, 22 nt, Homo sapiens
aagaaaacuaacaaccaaccaa

SEQ ID NO: 1446627 - RNA, 14 nt, Homo sapiens
aagaaaaucaucuu

SEQ ID NO: 1446628 - RNA, 19 nt, Homo sapiens
aagaaacacucaacaauaa

SEQ ID NO: 1446629 - RNA, 23 nt, Homo sapiens
aagaaagaaacacucaacaauaa

SEQ ID NO: 1446630 - RNA, 22 nt, Homo sapiens
aagaaauggaaucagcuuuuaa

SEQ ID NO: 1446631 - RNA, 20 nt, Homo sapiens
aagaacaguaacugccauca

SEQ ID NO: 1446632 - RNA, 15 nt, Homo sapiens
aagaaccaguguuua

SEQ ID NO: 1446633 - RNA, 16 nt, Homo sapiens
aagaaccuaaaguagc

SEQ ID NO: 1446634 - RNA, 19 nt, Homo sapiens
aagaacugccccaucuccu

SEQ ID NO: 1446635 - RNA, 16 nt, Homo sapiens
aagaagacauggagac

SEQ ID NO: 1446636 - RNA, 15 nt, Homo sapiens
aagaagagaucagga

SEQ ID NO: 1446637 - RNA, 16 nt, Homo sapiens
aagaagagaucaggaa

SEQ ID NO: 1446638 - RNA, 16 nt, Homo sapiens
aagaagaguuucuccu

SEQ ID NO: 1446639 - RNA, 20 nt, Homo sapiens
aagaagcccugcugggccca

SEQ ID NO: 1446640 - RNA, 23 nt, Homo sapiens
aagaagggauaauagacacauca

SEQ ID NO: 1446641 - RNA, 20 nt, Homo sapiens
aagaaguguuccuucauuaa

SEQ ID NO: 1446642 - RNA, 22 nt, Homo sapiens
aagaaguguuccuucauuaacu

SEQ ID NO: 1446643 - RNA, 21 nt, Homo sapiens
aagaauaaaauugcacuuuua

SEQ ID NO: 1446644 - RNA, 16 nt, Homo sapiens
aagaauaaaugaaucu

SEQ ID NO: 1446645 - RNA, 15 nt, Homo sapiens
aagaaucaagcuaga

SEQ ID NO: 1446646 - RNA, 21 nt, Homo sapiens
aagaaucagaaacaggugcau

SEQ ID NO: 1446647 - RNA, 17 nt, Homo sapiens
aagaaugaauaauaauu

SEQ ID NO: 1446648 - RNA, 21 nt, Homo sapiens
aagaaugagcauugagacggu

SEQ ID NO: 1446649 - RNA, 20 nt, Homo sapiens
aagaauuccugaagccagau

SEQ ID NO: 1446650 - RNA, 13 nt, Homo sapiens
aagacaacauaac

SEQ ID NO: 1446651 - RNA, 17 nt, Homo sapiens
aagacacaccucuggau

SEQ ID NO: 1446652 - RNA, 15 nt, Homo sapiens
cauaaucucauucaa

SEQ ID NO: 1446653 - RNA, 14 nt, Homo sapiens
cauacauacauaca

SEQ ID NO: 1446654 - RNA, 14 nt, Homo sapiens
cauacauacauaua

SEQ ID NO: 1446655 - RNA, 16 nt, Homo sapiens
cauacauacauauaua

SEQ ID NO: 1446656 - RNA, 18 nt, Homo sapiens
cauacaugacucagcaua

SEQ ID NO: 1446657 - RNA, 14 nt, Homo sapiens
cauaccucugacca

SEQ ID NO: 1446658 - RNA, 18 nt, Homo sapiens
cauaccucugaccaacag

SEQ ID NO: 1446659 - RNA, 18 nt, Homo sapiens
cauacugaucccuuuccc

SEQ ID NO: 1446660 - RNA, 16 nt, Homo sapiens
cauagaaacaugacac

SEQ ID NO: 1446661 - RNA, 17 nt, Homo sapiens
cauagaaacaugacacu

SEQ ID NO: 1446662 - RNA, 21 nt, Homo sapiens
cauagaacuccggaaugacca

SEQ ID NO: 1446663 - RNA, 22 nt, Homo sapiens
cauagagauaugcacacacaga

SEQ ID NO: 1446664 - RNA, 19 nt, Homo sapiens
cauagauuaauggcacuga

SEQ ID NO: 1446665 - RNA, 15 nt, Homo sapiens
cauagcuacccaaaa

SEQ ID NO: 1446666 - RNA, 19 nt, Homo sapiens
cauaggcaauaucuuuaau

SEQ ID NO: 1446667 - RNA, 22 nt, Homo sapiens
cauaguaacucuuauggagacc

SEQ ID NO: 1446668 - RNA, 17 nt, Homo sapiens
cauaguuauuuacuuga

SEQ ID NO: 1446669 - RNA, 15 nt, Homo sapiens
cauaguuuauuucaa

SEQ ID NO: 1446670 - RNA, 21 nt, Homo sapiens
cauauaacuaagacauaugca

SEQ ID NO: 1446671 - RNA, 21 nt, Homo sapiens
cauauauauauacacauacau

SEQ ID NO: 1446672 - RNA, 15 nt, Homo sapiens
cauauauauauguau

SEQ ID NO: 1446673 - RNA, 19 nt, Homo sapiens
cauauauaugccuuaugua

SEQ ID NO: 1446674 - RNA, 16 nt, Homo sapiens
cauauauauguauaua

SEQ ID NO: 1446675 - RNA, 20 nt, Homo sapiens
cauauauauugaaaugcaaa

SEQ ID NO: 1446676 - RNA, 13 nt, Homo sapiens
cauaucaaaaagu

SEQ ID NO: 1446677 - RNA, 20 nt, Homo sapiens
cauaucuuccaggucccaga

SEQ ID NO: 1446678 - RNA, 11 nt, Homo sapiens
cauaugaacug

SEQ ID NO: 1446679 - RNA, 16 nt, Homo sapiens
cauaugcagugauaua

SEQ ID NO: 1446680 - RNA, 22 nt, Homo sapiens
cauauguauuuuguauuugcau

SEQ ID NO: 1446681 - RNA, 23 nt, Homo sapiens
cauauguauuuugucauauguau

SEQ ID NO: 1446682 - RNA, 13 nt, Homo sapiens
cauaugucugcuu

SEQ ID NO: 1446683 - RNA, 20 nt, Homo sapiens
cauaugugaauauggacuca

SEQ ID NO: 1446684 - RNA, 13 nt, Homo sapiens
cauauuauuccau

SEQ ID NO: 1446685 - RNA, 23 nt, Homo sapiens
cauauucugggcuccuggaacca

SEQ ID NO: 1446686 - RNA, 17 nt, Homo sapiens
cauauucuguucacuug

SEQ ID NO: 1446687 - RNA, 15 nt, Homo sapiens
cauauuuauauugua

SEQ ID NO: 1446688 - RNA, 13 nt, Homo sapiens
cauauuucuuugg

SEQ ID NO: 1446689 - RNA, 23 nt, Homo sapiens
cauauuuucacagguguggugua

SEQ ID NO: 1446690 - RNA, 22 nt, Homo sapiens
caucaagaugagagaacuggag

SEQ ID NO: 1446691 - RNA, 14 nt, Homo sapiens
caucaauaucacaa

SEQ ID NO: 1446692 - RNA, 16 nt, Homo sapiens
caucaauuuuuauaca

SEQ ID NO: 1446693 - RNA, 23 nt, Homo sapiens
caucacugaaaugcuagcugcaa

SEQ ID NO: 1446694 - RNA, 10 nt, Homo sapiens
caucagaaag

SEQ ID NO: 1446695 - RNA, 21 nt, Homo sapiens
caucagacuccugugcaacuu

SEQ ID NO: 1446696 - RNA, 22 nt, Homo sapiens
caucagagaugguaaucuacag

SEQ ID NO: 1446697 - RNA, 18 nt, Homo sapiens
caucaggccuaaucucau

SEQ ID NO: 1446698 - RNA, 15 nt, Homo sapiens
caucagggcaguggc

SEQ ID NO: 1446699 - RNA, 21 nt, Homo sapiens
caucagguuccaguugcuuga

SEQ ID NO: 1446700 - RNA, 16 nt, Homo sapiens
caucauauuguaugua

SEQ ID NO: 1446701 - RNA, 18 nt, Homo sapiens
caucauguuggccaggcu

SEQ ID NO: 1446702 - RNA, 18 nt, Homo sapiens
cauccaaggagaaacaga

SEQ ID NO: 1446703 - RNA, 21 nt, Homo sapiens
cauccaaggagaaacagagac

SEQ ID NO: 1446704 - RNA, 17 nt, Homo sapiens
cauccaguucaugagaa

SEQ ID NO: 1446705 - RNA, 19 nt, Homo sapiens
cauccauaaagcaagcuca

SEQ ID NO: 1446706 - RNA, 22 nt, Homo sapiens
cauccauagugcacuagcauuu

SEQ ID NO: 1446707 - RNA, 20 nt, Homo sapiens
cauccaucaggguuugcaaa

SEQ ID NO: 1446708 - RNA, 15 nt, Homo sapiens
caucccaagccagaa

SEQ ID NO: 1446709 - RNA, 17 nt, Homo sapiens
caucccagcugcuccca

SEQ ID NO: 1446710 - RNA, 17 nt, Homo sapiens
cauccccuggacuggga

SEQ ID NO: 1446711 - RNA, 16 nt, Homo sapiens
cauccggcuccuguca

SEQ ID NO: 1446712 - RNA, 14 nt, Homo sapiens
cauccugugugcug

SEQ ID NO: 1446713 - RNA, 20 nt, Homo sapiens
cauccuuuuacuuuuugccc

SEQ ID NO: 1446714 - RNA, 22 nt, Homo sapiens
caucguggugugucaaugccac

SEQ ID NO: 1446715 - RNA, 12 nt, Homo sapiens
caucuaaucuau

SEQ ID NO: 1446716 - RNA, 17 nt, Homo sapiens
caucuaaucuaugcaug

SEQ ID NO: 1446717 - RNA, 20 nt, Homo sapiens
caucuauguaucuaccaucu

SEQ ID NO: 1446718 - RNA, 12 nt, Homo sapiens
caucucagccua

SEQ ID NO: 1446719 - RNA, 19 nt, Homo sapiens
caucucaggccucccucaa

SEQ ID NO: 1446720 - RNA, 16 nt, Homo sapiens
caucucccucccacau

SEQ ID NO: 1446721 - RNA, 21 nt, Homo sapiens
caucugacaugcaucaucuca

SEQ ID NO: 1446722 - RNA, 14 nt, Homo sapiens
caucugauaugcag

SEQ ID NO: 1446723 - RNA, 16 nt, Homo sapiens
ccuccuaaccuagaga

SEQ ID NO: 1446724 - RNA, 15 nt, Homo sapiens
ccuccuaauuugauc

SEQ ID NO: 1446725 - RNA, 16 nt, Homo sapiens
ccuccucugcuugcau

SEQ ID NO: 1446726 - RNA, 15 nt, Homo sapiens
ccuccugcaccgaga

SEQ ID NO: 1446727 - RNA, 13 nt, Homo sapiens
ccucguaccagcc

SEQ ID NO: 1446728 - RNA, 17 nt, Homo sapiens
ccucucaucaguguccu

SEQ ID NO: 1446729 - RNA, 20 nt, Homo sapiens
ccucuccaggaaugccuccu

SEQ ID NO: 1446730 - RNA, 13 nt, Homo sapiens
ccucuccccucau

SEQ ID NO: 1446731 - RNA, 13 nt, Homo sapiens
ccucuccuuggaa

SEQ ID NO: 1446732 - RNA, 22 nt, Homo sapiens
ccucucuaagccacagcuucuu

SEQ ID NO: 1446733 - RNA, 14 nt, Homo sapiens
ccucugcagcacuu

SEQ ID NO: 1446734 - RNA, 12 nt, Homo sapiens
ccucugccucaa

SEQ ID NO: 1446735 - RNA, 13 nt, Homo sapiens
ccucugcucugag

SEQ ID NO: 1446736 - RNA, 19 nt, Homo sapiens
ccucuuaaagcugccugua

SEQ ID NO: 1446737 - RNA, 13 nt, Homo sapiens
ccucuugcucaaa

SEQ ID NO: 1446738 - RNA, 15 nt, Homo sapiens
ccucuuuucucugug

SEQ ID NO: 1446739 - RNA, 18 nt, Homo sapiens
ccucuuuucucugugcuu

SEQ ID NO: 1446740 - RNA, 17 nt, Homo sapiens
ccugaaaauuaugaguc

SEQ ID NO: 1446741 - RNA, 14 nt, Homo sapiens
ccugacaauggcag

SEQ ID NO: 1446742 - RNA, 18 nt, Homo sapiens
ccugacaccaccaucuau

SEQ ID NO: 1446743 - RNA, 21 nt, Homo sapiens
ccugacaccgucccucaguga

SEQ ID NO: 1446744 - RNA, 18 nt, Homo sapiens
ccugacagaaggacucag

SEQ ID NO: 1446745 - RNA, 12 nt, Homo sapiens
ccugaccuguca

SEQ ID NO: 1446746 - RNA, 16 nt, Homo sapiens
ccugaccuugugaucu

SEQ ID NO: 1446747 - RNA, 15 nt, Homo sapiens
ccugacgacacugaa

SEQ ID NO: 1446748 - RNA, 19 nt, Homo sapiens
ccuuuccuccccaccuucc

SEQ ID NO: 1446749 - RNA, 22 nt, Homo sapiens
ccuuucucgugguagaagccag

SEQ ID NO: 1446750 - RNA, 17 nt, Homo sapiens
ccuuucuuucuuccuuc

SEQ ID NO: 1446751 - RNA, 22 nt, Homo sapiens
ccuuugcaggcccagcagacuu

SEQ ID NO: 1446752 - RNA, 22 nt, Homo sapiens
ccuuugggaggcagcaucaggg

SEQ ID NO: 1446753 - RNA, 18 nt, Homo sapiens
ccuuuuagguagaauuua

SEQ ID NO: 1446754 - RNA, 22 nt, Homo sapiens
ccuuuuauucauauuuucacau

SEQ ID NO: 1446755 - RNA, 18 nt, Homo sapiens
ccuuuucaucuccagugu

SEQ ID NO: 1446756 - RNA, 18 nt, Homo sapiens
ccuuuugaccaaauaaag

SEQ ID NO: 1446757 - RNA, 21 nt, Homo sapiens
cgaaauauuacaguagugcau

SEQ ID NO: 1446758 - RNA, 19 nt, Homo sapiens
cgaacaaacugaugcgaaa

SEQ ID NO: 1446759 - RNA, 19 nt, Homo sapiens
cgaaccaucucaauguaag

SEQ ID NO: 1446760 - RNA, 17 nt, Homo sapiens
cgaagcugugaacucag

SEQ ID NO: 1446761 - RNA, 23 nt, Homo sapiens
cgaaggggaaaacccgcucucuc

SEQ ID NO: 1446762 - RNA, 19 nt, Homo sapiens
cgacgcagguguaccuccc

SEQ ID NO: 1446763 - RNA, 23 nt, Homo sapiens
cgacgguuucaaaccaggauuuu

SEQ ID NO: 1446764 - RNA, 20 nt, Homo sapiens
cgagauugcaccacugcacu

SEQ ID NO: 1446765 - RNA, 14 nt, Homo sapiens
cgagucaugcacuc

SEQ ID NO: 1446766 - RNA, 19 nt, Homo sapiens
cgagucucuucuccacugg

SEQ ID NO: 1446767 - RNA, 11 nt, Homo sapiens
cgaucuuggcu

SEQ ID NO: 1446768 - RNA, 19 nt, Homo sapiens
cgaugcuggggucaaagac

SEQ ID NO: 1446769 - RNA, 21 nt, Homo sapiens
cgcaaacacaccgaugcacac

SEQ ID NO: 1446770 - RNA, 15 nt, Homo sapiens
cgcaacaacaaggac

SEQ ID NO: 1446771 - RNA, 21 nt, Homo sapiens
cgcaagggagaagaaauccau

SEQ ID NO: 1446772 - RNA, 20 nt, Homo sapiens
cgcacaaggcugaccaagag

SEQ ID NO: 1446773 - RNA, 15 nt, Homo sapiens
cgcacacacaccgau

SEQ ID NO: 1446774 - RNA, 19 nt, Homo sapiens
cgcacauagagauaugcac

SEQ ID NO: 1446775 - RNA, 13 nt, Homo sapiens
cgcaccuaucacc

SEQ ID NO: 1446776 - RNA, 12 nt, Homo sapiens
cgcagauguuac

SEQ ID NO: 1446777 - RNA, 23 nt, Homo sapiens
cgccaucagggcaguggccaaga

SEQ ID NO: 1446778 - RNA, 23 nt, Homo sapiens
cgccucccagccccaggggugcc

SEQ ID NO: 1446779 - RNA, 17 nt, Homo sapiens
cgcgcagcgcgugcaca

SEQ ID NO: 1446780 - RNA, 17 nt, Homo sapiens
cgcuagagcagcccaaa

SEQ ID NO: 1446781 - RNA, 10 nt, Homo sapiens
cgcucuggac

SEQ ID NO: 1446782 - RNA, 22 nt, Homo sapiens
cgcucuuggcagguacucagcg

SEQ ID NO: 1446783 - RNA, 14 nt, Homo sapiens
cgcugccuugccau

SEQ ID NO: 1446784 - RNA, 17 nt, Homo sapiens
cggaagaaaaagagcca

SEQ ID NO: 1446785 - RNA, 20 nt, Homo sapiens
cggacacagagggggccuuc

SEQ ID NO: 1446786 - RNA, 14 nt, Homo sapiens
cggagaauugccuc

SEQ ID NO: 1446787 - RNA, 16 nt, Homo sapiens
cggagcuugcagugag

SEQ ID NO: 1446788 - RNA, 20 nt, Homo sapiens
cggagcuugcagugagccga

SEQ ID NO: 1446789 - RNA, 12 nt, Homo sapiens
cggagcuuucaa

SEQ ID NO: 1446790 - RNA, 17 nt, Homo sapiens
cggccagccuugcacug

SEQ ID NO: 1446791 - RNA, 20 nt, Homo sapiens
cggccuagggguccacggga

SEQ ID NO: 1446792 - RNA, 14 nt, Homo sapiens
cggcgccaccaucc

SEQ ID NO: 1446793 - RNA, 14 nt, Homo sapiens
cggcggcagggugg

SEQ ID NO: 1446794 - RNA, 13 nt, Homo sapiens
cggcuuccaggga

SEQ ID NO: 1446795 - RNA, 15 nt, Homo sapiens
cgggaggcugagaca

SEQ ID NO: 1446796 - RNA, 17 nt, Homo sapiens
cgggauuugaagcugua

SEQ ID NO: 1446797 - RNA, 13 nt, Homo sapiens
cgggcaagcacua

SEQ ID NO: 1446798 - RNA, 13 nt, Homo sapiens
cgggcugcacaga

SEQ ID NO: 1446799 - RNA, 22 nt, Homo sapiens
cggggaggaaagcaaaauccaa

SEQ ID NO: 1446800 - RNA, 17 nt, Homo sapiens
cgggggagcuggaaaua

SEQ ID NO: 1446801 - RNA, 17 nt, Homo sapiens
cggucccacacugguga

SEQ ID NO: 1446802 - RNA, 13 nt, Homo sapiens
cggugaaauccag

SEQ ID NO: 1446803 - RNA, 22 nt, Homo sapiens
cguaauguauuuauauguuaau

SEQ ID NO: 1446804 - RNA, 18 nt, Homo sapiens
cguagcuuucccaaauaa

SEQ ID NO: 1446805 - RNA, 11 nt, Homo sapiens
cguaucaugca

SEQ ID NO: 1446806 - RNA, 13 nt, Homo sapiens
cgucccaaacaga

SEQ ID NO: 1446807 - RNA, 14 nt, Homo sapiens
cuagccacaucacu

SEQ ID NO: 1446808 - RNA, 19 nt, Homo sapiens
cuaggagcugggaggaaaa

SEQ ID NO: 1446809 - RNA, 18 nt, Homo sapiens
cuaguauuguccauauca

SEQ ID NO: 1446810 - RNA, 18 nt, Homo sapiens
cuagugaagauguuguca

SEQ ID NO: 1446811 - RNA, 12 nt, Homo sapiens
cuagugcuacug

SEQ ID NO: 1446812 - RNA, 16 nt, Homo sapiens
cuaguggaaaugagcg

SEQ ID NO: 1446813 - RNA, 17 nt, Homo sapiens
cuauaacaugucuuuca

SEQ ID NO: 1446814 - RNA, 12 nt, Homo sapiens
cuauaaugugug

SEQ ID NO: 1446815 - RNA, 23 nt, Homo sapiens
cuauauaguuuauugacaauaau

SEQ ID NO: 1446816 - RNA, 16 nt, Homo sapiens
cuauauguagcuuuau

SEQ ID NO: 1446817 - RNA, 18 nt, Homo sapiens
cuauauuuagauuguuaa

SEQ ID NO: 1446818 - RNA, 14 nt, Homo sapiens
cuaucacauuacau

SEQ ID NO: 1446819 - RNA, 17 nt, Homo sapiens
cuaucacauuacaucau

SEQ ID NO: 1446820 - RNA, 12 nt, Homo sapiens
cuauccuuccag

SEQ ID NO: 1446821 - RNA, 15 nt, Homo sapiens
cuaucugugaaguua

SEQ ID NO: 1446822 - RNA, 12 nt, Homo sapiens
cuaucuuuauga

SEQ ID NO: 1446823 - RNA, 13 nt, Homo sapiens
cuaugaagucuuu

SEQ ID NO: 1446824 - RNA, 13 nt, Homo sapiens
cuaugacaugcaa

SEQ ID NO: 1446825 - RNA, 13 nt, Homo sapiens
cuaugaucuuggc

SEQ ID NO: 1446826 - RNA, 15 nt, Homo sapiens
cuaugcaaaugccuc

SEQ ID NO: 1446827 - RNA, 15 nt, Homo sapiens
cuaugcaagccuugc

SEQ ID NO: 1446828 - RNA, 20 nt, Homo sapiens
cuauggagagcccugggacc

SEQ ID NO: 1446829 - RNA, 13 nt, Homo sapiens
cuauguaugcauc

SEQ ID NO: 1446830 - RNA, 16 nt, Homo sapiens
cuauguaugcaucuau

SEQ ID NO: 1446831 - RNA, 15 nt, Homo sapiens
cuaugugauguuaac

SEQ ID NO: 1446832 - RNA, 16 nt, Homo sapiens
cuauuacaccaaauaa

SEQ ID NO: 1446833 - RNA, 22 nt, Homo sapiens
cuauuauaaaaucuuacuuugu

SEQ ID NO: 1446834 - RNA, 17 nt, Homo sapiens
cuauuauuuucuuuaaa

SEQ ID NO: 1446835 - RNA, 19 nt, Homo sapiens
cuauucaaaaggaaauaua

SEQ ID NO: 1446836 - RNA, 17 nt, Homo sapiens
cuauucaaacagucuca

SEQ ID NO: 1446837 - RNA, 22 nt, Homo sapiens
cuauuccauggcuaacuggcga

SEQ ID NO: 1446838 - RNA, 14 nt, Homo sapiens
cucccugcuaccaa

SEQ ID NO: 1446839 - RNA, 16 nt, Homo sapiens
cucccuggaucagaac

SEQ ID NO: 1446840 - RNA, 15 nt, Homo sapiens
cucccuuccucccua

SEQ ID NO: 1446841 - RNA, 14 nt, Homo sapiens
cuccgcacuuggaa

SEQ ID NO: 1446842 - RNA, 20 nt, Homo sapiens
cuccuccagggccacgugcc

SEQ ID NO: 1446843 - RNA, 20 nt, Homo sapiens
cuccucccaaaauacuacac

SEQ ID NO: 1446844 - RNA, 19 nt, Homo sapiens
cuccucccaacucuagccu

SEQ ID NO: 1446845 - RNA, 14 nt, Homo sapiens
cuccucuugccacu

SEQ ID NO: 1446846 - RNA, 13 nt, Homo sapiens
cuccugaaguuag

SEQ ID NO: 1446847 - RNA, 23 nt, Homo sapiens
cuccugacauuaagacacaccuc

SEQ ID NO: 1446848 - RNA, 20 nt, Homo sapiens
cuccugaccucaagugaucc

SEQ ID NO: 1446849 - RNA, 16 nt, Homo sapiens
cuccugaccugaggcu

SEQ ID NO: 1446850 - RNA, 17 nt, Homo sapiens
cuccugacuccagugag

SEQ ID NO: 1446851 - RNA, 18 nt, Homo sapiens
cuccugagcucaagugau

SEQ ID NO: 1446852 - RNA, 13 nt, Homo sapiens
cuccugauggcca

SEQ ID NO: 1446853 - RNA, 13 nt, Homo sapiens
cuccugcuggaug

SEQ ID NO: 1446854 - RNA, 17 nt, Homo sapiens
cuccugugcuacuuugc

SEQ ID NO: 1446855 - RNA, 14 nt, Homo sapiens
cuccugugugcugg

SEQ ID NO: 1446856 - RNA, 19 nt, Homo sapiens
cuccuuagcaggcuaugaa

SEQ ID NO: 1446857 - RNA, 13 nt, Homo sapiens
cuccuucccgccg

SEQ ID NO: 1446858 - RNA, 22 nt, Homo sapiens
cuccuuggugaagaacauccca

SEQ ID NO: 1446859 - RNA, 15 nt, Homo sapiens
cuccuuuugaccaaa

SEQ ID NO: 1446860 - RNA, 16 nt, Homo sapiens
cuccuuuugaccaaau

SEQ ID NO: 1446861 - RNA, 17 nt, Homo sapiens
cuccuuuugaccaaaua

SEQ ID NO: 1446862 - RNA, 24 nt, Homo sapiens
cuccuuuugcuguuuggauguuuc

SEQ ID NO: 1446863 - RNA, 19 nt, Homo sapiens
cuccuuuugcuugaaacca

SEQ ID NO: 1446864 - RNA, 13 nt, Homo sapiens
cuccuuuuugccc

SEQ ID NO: 1446865 - RNA, 18 nt, Homo sapiens
cucgaacuccugaccuca

SEQ ID NO: 1446866 - RNA, 14 nt, Homo sapiens
cucgccgucuguga

SEQ ID NO: 1446867 - RNA, 17 nt, Homo sapiens
cucggccucccaaagug

SEQ ID NO: 1446868 - RNA, 22 nt, Homo sapiens
cucgggggaaagcacaccucau

SEQ ID NO: 1446869 - RNA, 15 nt, Homo sapiens
cucggggugcacagg

SEQ ID NO: 1446870 - RNA, 16 nt, Homo sapiens
cucgugccaugaucug

SEQ ID NO: 1446871 - RNA, 15 nt, Homo sapiens
cucgugugauuuccu

SEQ ID NO: 1446872 - RNA, 19 nt, Homo sapiens
cucuaaaaauaaaaugaug

SEQ ID NO: 1446873 - RNA, 17 nt, Homo sapiens
cucuaagccaacuuuaa

SEQ ID NO: 1446874 - RNA, 22 nt, Homo sapiens
cucuaagccacucuuccaaagg

SEQ ID NO: 1446875 - RNA, 13 nt, Homo sapiens
cucuacgccaaag

SEQ ID NO: 1446876 - RNA, 11 nt, Homo sapiens
cucuacuacuu

SEQ ID NO: 1446877 - RNA, 19 nt, Homo sapiens
cucuaggccuguugccucg

SEQ ID NO: 1446878 - RNA, 14 nt, Homo sapiens
cucuagugcuacug

SEQ ID NO: 1446879 - RNA, 17 nt, Homo sapiens
cucuaugaucuuggcac

SEQ ID NO: 1446880 - RNA, 22 nt, Homo sapiens
cucuccuuggugaagaacaucc

SEQ ID NO: 1446881 - RNA, 17 nt, Homo sapiens
cucucuaaacccaaaua

SEQ ID NO: 1446882 - RNA, 13 nt, Homo sapiens
cucucucucucuu

SEQ ID NO: 1446883 - RNA, 12 nt, Homo sapiens
cucucugcucca

SEQ ID NO: 1446884 - RNA, 18 nt, Homo sapiens
cucucuuagggaaaccaa

SEQ ID NO: 1446885 - RNA, 20 nt, Homo sapiens
cucugaaacaaaaguauuua

SEQ ID NO: 1446886 - RNA, 20 nt, Homo sapiens
cucugagcaaauguggcucc

SEQ ID NO: 1446887 - RNA, 15 nt, Homo sapiens
cucugauacccagag

SEQ ID NO: 1446888 - RNA, 15 nt, Homo sapiens
cucugcagcacuuua

SEQ ID NO: 1446889 - RNA, 23 nt, Homo sapiens
cugcugcaggagccgcugcugag

SEQ ID NO: 1446890 - RNA, 18 nt, Homo sapiens
cugcugcugaccugauca

SEQ ID NO: 1446891 - RNA, 13 nt, Homo sapiens
cugcugcugcuau

SEQ ID NO: 1446892 - RNA, 20 nt, Homo sapiens
cugcugguaauuuguaucug

SEQ ID NO: 1446893 - RNA, 16 nt, Homo sapiens
cugcuguauacuguac

SEQ ID NO: 1446894 - RNA, 19 nt, Homo sapiens
cugcugucaccuugcucag

SEQ ID NO: 1446895 - RNA, 12 nt, Homo sapiens
cugcuguugcca

SEQ ID NO: 1446896 - RNA, 16 nt, Homo sapiens
cugcuuacuaaugugc

SEQ ID NO: 1446897 - RNA, 20 nt, Homo sapiens
cugcuuccaauuuucuggaa

SEQ ID NO: 1446898 - RNA, 12 nt, Homo sapiens
cugcuuggucaa

SEQ ID NO: 1446899 - RNA, 18 nt, Homo sapiens
cugcuuuguauccaugag

SEQ ID NO: 1446900 - RNA, 16 nt, Homo sapiens
cuggaaaacucaggau

SEQ ID NO: 1446901 - RNA, 20 nt, Homo sapiens
cuggaaaccacacuucuuga

SEQ ID NO: 1446902 - RNA, 22 nt, Homo sapiens
cuggaaaccacacuucuugaaa

SEQ ID NO: 1446903 - RNA, 16 nt, Homo sapiens
cuggaaucaauuuccc

SEQ ID NO: 1446904 - RNA, 13 nt, Homo sapiens
cuggacaagccaa

SEQ ID NO: 1446905 - RNA, 13 nt, Homo sapiens
cuggagaggacaa

SEQ ID NO: 1446906 - RNA, 19 nt, Homo sapiens
cuggagccagagagacaga

SEQ ID NO: 1446907 - RNA, 19 nt, Homo sapiens
cuggagcccgagggccuga

SEQ ID NO: 1446908 - RNA, 16 nt, Homo sapiens
cuggaggacacacagu

SEQ ID NO: 1446909 - RNA, 17 nt, Homo sapiens
cuggaggaguuccuuga

SEQ ID NO: 1446910 - RNA, 17 nt, Homo sapiens
cuggaggugggagacaa

SEQ ID NO: 1446911 - RNA, 13 nt, Homo sapiens
cuggagugcagug

SEQ ID NO: 1446912 - RNA, 20 nt, Homo sapiens
cuggaguggaguggcacgau

SEQ ID NO: 1446913 - RNA, 13 nt, Homo sapiens
cuggauggcacca

SEQ ID NO: 1446914 - RNA, 19 nt, Homo sapiens
cuggauugcagacucauga

SEQ ID NO: 1446915 - RNA, 21 nt, Homo sapiens
cuggcaaugaaaaauucucag

SEQ ID NO: 1446916 - RNA, 18 nt, Homo sapiens
cuggcacuuagcccaaga

SEQ ID NO: 1446917 - RNA, 20 nt, Homo sapiens
cuggcaucuuucaacaauga

SEQ ID NO: 1446918 - RNA, 14 nt, Homo sapiens
cuggcauggugcuu

SEQ ID NO: 1446919 - RNA, 16 nt, Homo sapiens
cuggccagcacccucu

SEQ ID NO: 1446920 - RNA, 21 nt, Homo sapiens
cuggcccuuucuggaccagau

SEQ ID NO: 1446921 - RNA, 16 nt, Homo sapiens
cuggccucaagcaauc

SEQ ID NO: 1446922 - RNA, 17 nt, Homo sapiens
cuggccuugucaggacc

SEQ ID NO: 1446923 - RNA, 22 nt, Homo sapiens
cuggccuugucaggacccaggc

SEQ ID NO: 1446924 - RNA, 22 nt, Homo sapiens
cuggcgaaccaucucaauguaa

SEQ ID NO: 1446925 - RNA, 12 nt, Homo sapiens
cuggcucaggaa

SEQ ID NO: 1446926 - RNA, 19 nt, Homo sapiens
cuggcugaccccaaagagc

SEQ ID NO: 1446927 - RNA, 12 nt, Homo sapiens
cuggcugccagg

SEQ ID NO: 1446928 - RNA, 15 nt, Homo sapiens
cuggcuucagccucc

SEQ ID NO: 1446929 - RNA, 22 nt, Homo sapiens
cuggcuucuguugcgccacuga

SEQ ID NO: 1446930 - RNA, 23 nt, Homo sapiens
cugggaaaaaaguuuugaugaaa

SEQ ID NO: 1446931 - RNA, 14 nt, Homo sapiens
cugggaaacaggga

SEQ ID NO: 1446932 - RNA, 17 nt, Homo sapiens
cugggaggcggagagua

SEQ ID NO: 1446933 - RNA, 19 nt, Homo sapiens
cugggauucccaccaaggu

SEQ ID NO: 1446934 - RNA, 15 nt, Homo sapiens
cugggccccaccacc

SEQ ID NO: 1446935 - RNA, 20 nt, Homo sapiens
aagcaauuauugugccucag

SEQ ID NO: 1446936 - RNA, 15 nt, Homo sapiens
aagcagagcuuccuc

SEQ ID NO: 1446937 - RNA, 17 nt, Homo sapiens
aagcagauuuaacaauu

SEQ ID NO: 1446938 - RNA, 19 nt, Homo sapiens
aagcagguggcaucucuaa

SEQ ID NO: 1446939 - RNA, 14 nt, Homo sapiens
aagcagguucuuga

SEQ ID NO: 1446940 - RNA, 23 nt, Homo sapiens
aagcaguuguuauuuagugauau

SEQ ID NO: 1446941 - RNA, 24 nt, Homo sapiens
aagcaucucagccuaccaugagaa

SEQ ID NO: 1446942 - RNA, 16 nt, Homo sapiens
aagcauggacuaaccc

SEQ ID NO: 1446943 - RNA, 19 nt, Homo sapiens
aagcauucugagcugggcu

SEQ ID NO: 1446944 - RNA, 16 nt, Homo sapiens
aagccauucacuuccc

SEQ ID NO: 1446945 - RNA, 22 nt, Homo sapiens
aagcccaccugcacgugaucug

SEQ ID NO: 1446946 - RNA, 18 nt, Homo sapiens
aagcccuccccaucccau

SEQ ID NO: 1446947 - RNA, 12 nt, Homo sapiens
aagcccuugaac

SEQ ID NO: 1446948 - RNA, 18 nt, Homo sapiens
aagccgugccuuucucug

SEQ ID NO: 1446949 - RNA, 16 nt, Homo sapiens
aagccuuuugcucaca

SEQ ID NO: 1446950 - RNA, 17 nt, Homo sapiens
aagcgauucuucugccu

SEQ ID NO: 1446951 - RNA, 14 nt, Homo sapiens
aagcuacaguuuug

SEQ ID NO: 1446952 - RNA, 17 nt, Homo sapiens
aagcuaguggcuucaaa

SEQ ID NO: 1446953 - RNA, 15 nt, Homo sapiens
aagcucagacuugcc

SEQ ID NO: 1446954 - RNA, 15 nt, Homo sapiens
aagcucaugagauga

SEQ ID NO: 1446955 - RNA, 12 nt, Homo sapiens
aagcuccacugu

SEQ ID NO: 1446956 - RNA, 14 nt, Homo sapiens
aagcuccacuguca

SEQ ID NO: 1446957 - RNA, 15 nt, Homo sapiens
aagcuccacugucac

SEQ ID NO: 1446958 - RNA, 11 nt, Homo sapiens
aagcucucuuu

SEQ ID NO: 1446959 - RNA, 19 nt, Homo sapiens
aagcugaacuuacugcuua

SEQ ID NO: 1446960 - RNA, 23 nt, Homo sapiens
aagcugaagaaaaugaagcccua

SEQ ID NO: 1446961 - RNA, 21 nt, Homo sapiens
aagcugaggauccucacagga

SEQ ID NO: 1446962 - RNA, 13 nt, Homo sapiens
aagcugcuuugga

SEQ ID NO: 1446963 - RNA, 18 nt, Homo sapiens
aagcuggagcucuuggaa

SEQ ID NO: 1446964 - RNA, 23 nt, Homo sapiens
aagcuggaggacuagaaccugga

SEQ ID NO: 1446965 - RNA, 13 nt, Homo sapiens
aagcuggcuuccu

SEQ ID NO: 1446966 - RNA, 21 nt, Homo sapiens
aagcugggccgaguaccuuaa

SEQ ID NO: 1446967 - RNA, 15 nt, Homo sapiens
aagcuuaaauugcuu

SEQ ID NO: 1446968 - RNA, 12 nt, Homo sapiens
aaggaaagccaa

SEQ ID NO: 1446969 - RNA, 13 nt, Homo sapiens
aaggaaccaacca

SEQ ID NO: 1446970 - RNA, 22 nt, Homo sapiens
aaggaacucuggcuuccaggua

SEQ ID NO: 1446971 - RNA, 14 nt, Homo sapiens
aaggaagacuugaa

SEQ ID NO: 1446972 - RNA, 19 nt, Homo sapiens
aaggaagcuccacugucac

SEQ ID NO: 1446973 - RNA, 18 nt, Homo sapiens
aaggaaggcuccaucucc

SEQ ID NO: 1446974 - RNA, 23 nt, Homo sapiens
aaggaagggacugacaagaagcu

SEQ ID NO: 1446975 - RNA, 19 nt, Homo sapiens
aaggacuccugucuguccu

SEQ ID NO: 1446976 - RNA, 23 nt, Homo sapiens
aaggagcaaaacgccucuuuucc

SEQ ID NO: 1446977 - RNA, 19 nt, Homo sapiens
aaggagccugugaacccag

SEQ ID NO: 1446978 - RNA, 20 nt, Homo sapiens
aaggagcucugaaucugaua

SEQ ID NO: 1446979 - RNA, 20 nt, Homo sapiens
aaggaggcaugccucugaua

SEQ ID NO: 1446980 - RNA, 17 nt, Homo sapiens
cugggccugcugcugag

SEQ ID NO: 1446981 - RNA, 16 nt, Homo sapiens
cugggcugucugucac

SEQ ID NO: 1446982 - RNA, 21 nt, Homo sapiens
cugggcugucugucaccagcu

SEQ ID NO: 1446983 - RNA, 19 nt, Homo sapiens
cuggggagaaugaagagcu

SEQ ID NO: 1446984 - RNA, 19 nt, Homo sapiens
cuggggccuguacugccug

SEQ ID NO: 1446985 - RNA, 18 nt, Homo sapiens
cuggggcucuaacgccug

SEQ ID NO: 1446986 - RNA, 18 nt, Homo sapiens
cugggggcagauauuucc

SEQ ID NO: 1446987 - RNA, 16 nt, Homo sapiens
cugggucucacuccug

SEQ ID NO: 1446988 - RNA, 18 nt, Homo sapiens
cugggugagaauccugcc

SEQ ID NO: 1446989 - RNA, 17 nt, Homo sapiens
cuggguuucucuguaua

SEQ ID NO: 1446990 - RNA, 23 nt, Homo sapiens
cugguaggaaggauaucggguca

SEQ ID NO: 1446991 - RNA, 16 nt, Homo sapiens
cugguccacucagggc

SEQ ID NO: 1446992 - RNA, 22 nt, Homo sapiens
cugguccuucucguuugcucua

SEQ ID NO: 1446993 - RNA, 21 nt, Homo sapiens
cuggugccuauuuauucauuc

SEQ ID NO: 1446994 - RNA, 12 nt, Homo sapiens
cugguguagcuc

SEQ ID NO: 1446995 - RNA, 13 nt, Homo sapiens
cugguuaauucca

SEQ ID NO: 1446996 - RNA, 16 nt, Homo sapiens
cugguuaauuccauaa

SEQ ID NO: 1446997 - RNA, 20 nt, Homo sapiens
cugguuucuguucuguugau

SEQ ID NO: 1446998 - RNA, 15 nt, Homo sapiens
cugguuugaaagccu

SEQ ID NO: 1446999 - RNA, 20 nt, Homo sapiens
cuguaaagucuaaucucuaa

SEQ ID NO: 1447000 - RNA, 12 nt, Homo sapiens
cuguaaaugcag

SEQ ID NO: 1447001 - RNA, 15 nt, Homo sapiens
cuguaacacaagcca

SEQ ID NO: 1447002 - RNA, 18 nt, Homo sapiens
cuguaacuucuuaaucua

SEQ ID NO: 1447003 - RNA, 21 nt, Homo sapiens
cuguaagauuguccagugcaa

SEQ ID NO: 1447004 - RNA, 22 nt, Homo sapiens
cuguaauuaaguaaaccaaaaa

SEQ ID NO: 1447005 - RNA, 19 nt, Homo sapiens
cuguaauuaauaucuugcu

SEQ ID NO: 1447006 - RNA, 21 nt, Homo sapiens
cuguacccaauuuaauuccau

SEQ ID NO: 1447007 - RNA, 20 nt, Homo sapiens
cuguagagccgcauggcacu

SEQ ID NO: 1447008 - RNA, 16 nt, Homo sapiens
cuguagauaaaguggu

SEQ ID NO: 1447009 - RNA, 17 nt, Homo sapiens
cuguagguuaaaugcag

SEQ ID NO: 1447010 - RNA, 21 nt, Homo sapiens
cuguagucccagccacucggg

SEQ ID NO: 1447011 - RNA, 20 nt, Homo sapiens
cuguauaaccccaccuugcc

SEQ ID NO: 1447012 - RNA, 16 nt, Homo sapiens
cuguauaguacuggca

SEQ ID NO: 1447013 - RNA, 23 nt, Homo sapiens
cuguauaguuaggauagcauuuu

SEQ ID NO: 1447014 - RNA, 19 nt, Homo sapiens
cuguauucagaucguauua

SEQ ID NO: 1447015 - RNA, 19 nt, Homo sapiens
cuguauuuugccagacuua

SEQ ID NO: 1447016 - RNA, 20 nt, Homo sapiens
cuguauuuugccagacuuaa

SEQ ID NO: 1447017 - RNA, 21 nt, Homo sapiens
cugucaacacuucucacaucu

SEQ ID NO: 1447018 - RNA, 22 nt, Homo sapiens
cuguccugccucucugcuccag

SEQ ID NO: 1447019 - RNA, 22 nt, Homo sapiens
cugucgcugcuucgugggauac

SEQ ID NO: 1447020 - RNA, 15 nt, Homo sapiens
gagacuuggggacca

SEQ ID NO: 1447021 - RNA, 17 nt, Homo sapiens
gagagacacucccaggg

SEQ ID NO: 1447022 - RNA, 23 nt, Homo sapiens
gagagacgcagcccugggggcca

SEQ ID NO: 1447023 - RNA, 19 nt, Homo sapiens
gagagaggcucagccacac

SEQ ID NO: 1447024 - RNA, 18 nt, Homo sapiens
gagagguagguggaucca

SEQ ID NO: 1447025 - RNA, 14 nt, Homo sapiens
gagaucgagaccau

SEQ ID NO: 1447026 - RNA, 18 nt, Homo sapiens
gagauggggacaggugaa

SEQ ID NO: 1447027 - RNA, 19 nt, Homo sapiens
gagauggggucuugcuaua

SEQ ID NO: 1447028 - RNA, 21 nt, Homo sapiens
gagcaaagucuaaaguuuaca

SEQ ID NO: 1447029 - RNA, 14 nt, Homo sapiens
gagcaacucuccac

SEQ ID NO: 1447030 - RNA, 16 nt, Homo sapiens
gagcacaaaaugauaa

SEQ ID NO: 1447031 - RNA, 19 nt, Homo sapiens
gagcacaaaaugauaauca

SEQ ID NO: 1447032 - RNA, 23 nt, Homo sapiens
gagcacugccaggagggacaaag

SEQ ID NO: 1447033 - RNA, 23 nt, Homo sapiens
gagcagagcugauggagaaggaa

SEQ ID NO: 1447034 - RNA, 15 nt, Homo sapiens
gagcagccagcguua

SEQ ID NO: 1447035 - RNA, 17 nt, Homo sapiens
gagcaguagaagccugc

SEQ ID NO: 1447036 - RNA, 15 nt, Homo sapiens
gagcagucagggugg

SEQ ID NO: 1447037 - RNA, 21 nt, Homo sapiens
gagcaugggacugugccuuug

SEQ ID NO: 1447038 - RNA, 21 nt, Homo sapiens
gagcauugagacggugcucgc

SEQ ID NO: 1447039 - RNA, 22 nt, Homo sapiens
gagcccaagugccaucccacau

SEQ ID NO: 1447040 - RNA, 15 nt, Homo sapiens
gagcccugguccuag

SEQ ID NO: 1447041 - RNA, 21 nt, Homo sapiens
gagccgagauugcaccacugc

SEQ ID NO: 1447042 - RNA, 24 nt, Homo sapiens
gagccgcugcugagcugcgugcca

SEQ ID NO: 1447043 - RNA, 17 nt, Homo sapiens
gagccugcaaacucacu

SEQ ID NO: 1447044 - RNA, 16 nt, Homo sapiens
gagccuggcacaggac

SEQ ID NO: 1447045 - RNA, 17 nt, Homo sapiens
gagccugugcuaaagaa

SEQ ID NO: 1447046 - RNA, 19 nt, Homo sapiens
gagcgagacuccgucucaa

SEQ ID NO: 1447047 - RNA, 18 nt, Homo sapiens
gagcuagaaccuggagag

SEQ ID NO: 1447048 - RNA, 11 nt, Homo sapiens
gagcuagaagc

SEQ ID NO: 1447049 - RNA, 18 nt, Homo sapiens
gagcucagccgugcacuc

SEQ ID NO: 1447050 - RNA, 20 nt, Homo sapiens
gagcucuggcuuugcaaggg

SEQ ID NO: 1447051 - RNA, 21 nt, Homo sapiens
gagcugaauuaccuuucacuu

SEQ ID NO: 1447052 - RNA, 15 nt, Homo sapiens
gagcuggaucacuug

SEQ ID NO: 1447053 - RNA, 17 nt, Homo sapiens
gagcuggcaaagguggc

SEQ ID NO: 1447054 - RNA, 21 nt, Homo sapiens
gagcuguaucuguaauuaaua

SEQ ID NO: 1447055 - RNA, 17 nt, Homo sapiens
gagcuguggacuuuguu

SEQ ID NO: 1447056 - RNA, 23 nt, Homo sapiens
gaggaauaagaauggagcaguac

SEQ ID NO: 1447057 - RNA, 17 nt, Homo sapiens
gaggacacacagucuca

SEQ ID NO: 1447058 - RNA, 18 nt, Homo sapiens
gaggacagagcuggcugu

SEQ ID NO: 1447059 - RNA, 17 nt, Homo sapiens
gaggacugagacuggca

SEQ ID NO: 1447060 - RNA, 19 nt, Homo sapiens
gaggacuugugucucugug

SEQ ID NO: 1447061 - RNA, 23 nt, Homo sapiens
gaggagcaagguuuaaauuuguu

SEQ ID NO: 1447062 - RNA, 18 nt, Homo sapiens
gaggagggcgugacucac

SEQ ID NO: 1447063 - RNA, 11 nt, Homo sapiens
gaggauaucau

SEQ ID NO: 1447064 - RNA, 14 nt, Homo sapiens
gaggaucccuccau

SEQ ID NO: 1447065 - RNA, 19 nt, Homo sapiens
gaggaugguuugagcucag

SEQ ID NO: 1447066 - RNA, 23 nt, Homo sapiens
gaggcauuccagccccuauguua

SEQ ID NO: 1447067 - RNA, 18 nt, Homo sapiens
gaggccaaggugggugga

SEQ ID NO: 1447068 - RNA, 19 nt, Homo sapiens
gaggcggagaguacaguga

SEQ ID NO: 1447069 - RNA, 15 nt, Homo sapiens
gaggcuccugugcua

SEQ ID NO: 1447070 - RNA, 13 nt, Homo sapiens
gaggcucuucagu

SEQ ID NO: 1447071 - RNA, 16 nt, Homo sapiens
gaggcugagcuggauc

SEQ ID NO: 1447072 - RNA, 20 nt, Homo sapiens
gagggaauuugaagaaagga

SEQ ID NO: 1447073 - RNA, 11 nt, Homo sapiens
gagggggcucc

SEQ ID NO: 1447074 - RNA, 18 nt, Homo sapiens
gaggucaagauuucagga

SEQ ID NO: 1447075 - RNA, 17 nt, Homo sapiens
gaggucgggauggggcu

SEQ ID NO: 1447076 - RNA, 22 nt, Homo sapiens
gaggucuccaucauggcaguga

SEQ ID NO: 1447077 - RNA, 20 nt, Homo sapiens
gagguggagguugcagugag

SEQ ID NO: 1447078 - RNA, 16 nt, Homo sapiens
gaggugucuuaagccu

SEQ ID NO: 1447079 - RNA, 13 nt, Homo sapiens
gagguugcaguga

SEQ ID NO: 1447080 - RNA, 19 nt, Homo sapiens
gagguuuggggucugccac

SEQ ID NO: 1447081 - RNA, 20 nt, Homo sapiens
gaguaacaugccagcuuccu

SEQ ID NO: 1447082 - RNA, 17 nt, Homo sapiens
gaguacagacgucucaa

SEQ ID NO: 1447083 - RNA, 21 nt, Homo sapiens
gaguacagauguaaaugccac

SEQ ID NO: 1447084 - RNA, 13 nt, Homo sapiens
gagucaccaggaa

SEQ ID NO: 1447085 - RNA, 13 nt, Homo sapiens
gagucaugcacuc

SEQ ID NO: 1447086 - RNA, 19 nt, Homo sapiens
gagucucccuuagcgccau

SEQ ID NO: 1447087 - RNA, 22 nt, Homo sapiens
gagugacggucccacacuggug

SEQ ID NO: 1447088 - RNA, 18 nt, Homo sapiens
gagugacucgaggguugg

SEQ ID NO: 1447089 - RNA, 20 nt, Homo sapiens
gagugcaccacuucaaguga

SEQ ID NO: 1447090 - RNA, 19 nt, Homo sapiens
gagugcaguuuccaauccc

SEQ ID NO: 1447091 - RNA, 23 nt, Homo sapiens
gagugcuagcuagccagcugugu

SEQ ID NO: 1447092 - RNA, 15 nt, Homo sapiens
gaguggagcccucag

SEQ ID NO: 1447093 - RNA, 14 nt, Homo sapiens
gaguggaucuccaa

SEQ ID NO: 1447094 - RNA, 19 nt, Homo sapiens
gaguggccccucaccuggg

SEQ ID NO: 1447095 - RNA, 21 nt, Homo sapiens
gagugggaaggagauggcaua

SEQ ID NO: 1447096 - RNA, 21 nt, Homo sapiens
gaguuauuuauuggcuggaga

SEQ ID NO: 1447097 - RNA, 15 nt, Homo sapiens
gaguucaacuuugag

SEQ ID NO: 1447098 - RNA, 14 nt, Homo sapiens
gaguucugggugga

SEQ ID NO: 1447099 - RNA, 13 nt, Homo sapiens
gaguugugaucau

SEQ ID NO: 1447100 - RNA, 21 nt, Homo sapiens
gaguuuaacuuugggcccaga

SEQ ID NO: 1447101 - RNA, 23 nt, Homo sapiens
gaguuugaaggaggugagggaug

SEQ ID NO: 1447102 - RNA, 17 nt, Homo sapiens
gauaaacuaaaagcaua

SEQ ID NO: 1447103 - RNA, 19 nt, Homo sapiens
gauaaauagaguuccaaau

SEQ ID NO: 1447104 - RNA, 20 nt, Homo sapiens
gauaaaucaguuaugucaau

SEQ ID NO: 1447105 - RNA, 22 nt, Homo sapiens
gauaacaaaaucacaagcaaua

SEQ ID NO: 1447106 - RNA, 15 nt, Homo sapiens
gauaacugagaauuu

SEQ ID NO: 1447107 - RNA, 17 nt, Homo sapiens
gauaaucaucucuguca

SEQ ID NO: 1447108 - RNA, 13 nt, Homo sapiens
gauacccagagca

SEQ ID NO: 1447109 - RNA, 17 nt, Homo sapiens
gauacccagagcauuac

SEQ ID NO: 1447110 - RNA, 14 nt, Homo sapiens
gauacugcaauaaa

SEQ ID NO: 1447111 - RNA, 16 nt, Homo sapiens
gauaguuaaaagacug

SEQ ID NO: 1447112 - RNA, 19 nt, Homo sapiens
gauauaugacuuuuucuca

SEQ ID NO: 1447113 - RNA, 20 nt, Homo sapiens
gauauaugacuuuuucucag

SEQ ID NO: 1447114 - RNA, 17 nt, Homo sapiens
gauaucaccucucuuca

SEQ ID NO: 1447115 - RNA, 15 nt, Homo sapiens
gauaucacuuacuca

SEQ ID NO: 1447116 - RNA, 22 nt, Homo sapiens
gauaucugaacacauacuagaa

SEQ ID NO: 1447117 - RNA, 13 nt, Homo sapiens
gauaugggacuga

SEQ ID NO: 1447118 - RNA, 13 nt, Homo sapiens
gauauugcacuag

SEQ ID NO: 1447119 - RNA, 16 nt, Homo sapiens
gaucacuggcaaugaa

SEQ ID NO: 1447120 - RNA, 15 nt, Homo sapiens
gaucacuuuguuaaa

SEQ ID NO: 1447121 - RNA, 19 nt, Homo sapiens
gaucacuuuguuaaaaaua

SEQ ID NO: 1447122 - RNA, 21 nt, Homo sapiens
gaucauuacauggcugugguu

SEQ ID NO: 1447123 - RNA, 15 nt, Homo sapiens
gauccaguugcacua

SEQ ID NO: 1447124 - RNA, 17 nt, Homo sapiens
gaucccagagcuuccca

SEQ ID NO: 1447125 - RNA, 20 nt, Homo sapiens
gauccccagccuacugccuc

SEQ ID NO: 1447126 - RNA, 13 nt, Homo sapiens
gaucgcugugaaa

SEQ ID NO: 1447127 - RNA, 14 nt, Homo sapiens
gaucuaauuuacau

SEQ ID NO: 1447128 - RNA, 13 nt, Homo sapiens
gaucuaguucuca

SEQ ID NO: 1447129 - RNA, 17 nt, Homo sapiens
gaucuaucaauagucaa

SEQ ID NO: 1447130 - RNA, 19 nt, Homo sapiens
gaucucccugccgccucaa

SEQ ID NO: 1447131 - RNA, 12 nt, Homo sapiens
gaucuucagagc

SEQ ID NO: 1447132 - RNA, 16 nt, Homo sapiens
gaucuugcauucccag

SEQ ID NO: 1447133 - RNA, 18 nt, Homo sapiens
gaugaccagaacaagguu

SEQ ID NO: 1447134 - RNA, 14 nt, Homo sapiens
gaugagcacacaca

SEQ ID NO: 1447135 - RNA, 19 nt, Homo sapiens
gaugcacagagauaugcac

SEQ ID NO: 1447136 - RNA, 20 nt, Homo sapiens
gaugcauuccugagucuucc

SEQ ID NO: 1447137 - RNA, 21 nt, Homo sapiens
gaugcauuccugagucuucca

SEQ ID NO: 1447138 - RNA, 13 nt, Homo sapiens
gaugcauuuccac

SEQ ID NO: 1447139 - RNA, 17 nt, Homo sapiens
gauggaauaaagcccuu

SEQ ID NO: 1447140 - RNA, 23 nt, Homo sapiens
gauggaauaaagcccuugaacca

SEQ ID NO: 1447141 - RNA, 18 nt, Homo sapiens
gauggaggggcugacuca

SEQ ID NO: 1447142 - RNA, 21 nt, Homo sapiens
gauggcugacuuugcucuuuc

SEQ ID NO: 1447143 - RNA, 17 nt, Homo sapiens
gaugggaccagggaugg

SEQ ID NO: 1447144 - RNA, 13 nt, Homo sapiens
gaugggaucccag

SEQ ID NO: 1447145 - RNA, 13 nt, Homo sapiens
gauguacacacac

SEQ ID NO: 1447146 - RNA, 23 nt, Homo sapiens
gauguacacacacagaugcacac

SEQ ID NO: 1447147 - RNA, 18 nt, Homo sapiens
gaugugcaagucuuguca

SEQ ID NO: 1447148 - RNA, 15 nt, Homo sapiens
gauguguaaauggag

SEQ ID NO: 1447149 - RNA, 18 nt, Homo sapiens
gauguuaagcaaaggaaa

SEQ ID NO: 1447150 - RNA, 17 nt, Homo sapiens
gauguuacaucacagug

SEQ ID NO: 1447151 - RNA, 15 nt, Homo sapiens
gauuaauguuuugua

SEQ ID NO: 1447152 - RNA, 17 nt, Homo sapiens
gauuaugccacugcuuu

SEQ ID NO: 1447153 - RNA, 12 nt, Homo sapiens
gauuauucugau

SEQ ID NO: 1447154 - RNA, 23 nt, Homo sapiens
gauuauuuguuauuuguacaguu

SEQ ID NO: 1447155 - RNA, 13 nt, Homo sapiens
gauucacuauuag

SEQ ID NO: 1447156 - RNA, 23 nt, Homo sapiens
gauucagcauuauuccuccagga

SEQ ID NO: 1447157 - RNA, 12 nt, Homo sapiens
gauuccagagag

SEQ ID NO: 1447158 - RNA, 17 nt, Homo sapiens
gcacugaggaccagcca

SEQ ID NO: 1447159 - RNA, 21 nt, Homo sapiens
gcacugcagauagccagacac

SEQ ID NO: 1447160 - RNA, 15 nt, Homo sapiens
gcacuuagcccaaga

SEQ ID NO: 1447161 - RNA, 22 nt, Homo sapiens
gcacuuggaaagguuucaagac

SEQ ID NO: 1447162 - RNA, 16 nt, Homo sapiens
gcagaaauguaucuau

SEQ ID NO: 1447163 - RNA, 16 nt, Homo sapiens
gcagaagcacauauga

SEQ ID NO: 1447164 - RNA, 19 nt, Homo sapiens
gcagagguaaaagugugag

SEQ ID NO: 1447165 - RNA, 20 nt, Homo sapiens
gcagagguaaaagugugagc

SEQ ID NO: 1447166 - RNA, 21 nt, Homo sapiens
gcagagugagacucgucucaa

SEQ ID NO: 1447167 - RNA, 20 nt, Homo sapiens
gcagauaaagacagcugaca

SEQ ID NO: 1447168 - RNA, 15 nt, Homo sapiens
gcagcccgaagccca

SEQ ID NO: 1447169 - RNA, 16 nt, Homo sapiens
gcagccuccuccugac

SEQ ID NO: 1447170 - RNA, 18 nt, Homo sapiens
gcagcgccucaucuucaa

SEQ ID NO: 1447171 - RNA, 14 nt, Homo sapiens
gcagcgcgugcaca

SEQ ID NO: 1447172 - RNA, 16 nt, Homo sapiens
gcagcgguaccccagg

SEQ ID NO: 1447173 - RNA, 22 nt, Homo sapiens
gcagcugucauggaaaagccca

SEQ ID NO: 1447174 - RNA, 23 nt, Homo sapiens
gcagcugucauggaaaagcccag

SEQ ID NO: 1447175 - RNA, 18 nt, Homo sapiens
gcaggaguagcugagcuc

SEQ ID NO: 1447176 - RNA, 22 nt, Homo sapiens
gcaggauccgcugccaccacgu

SEQ ID NO: 1447177 - RNA, 14 nt, Homo sapiens
gcaggcagccccac

SEQ ID NO: 1447178 - RNA, 15 nt, Homo sapiens
gcaggcucagacucu

SEQ ID NO: 1447179 - RNA, 21 nt, Homo sapiens
gcaggucccuuuuugucucuc

SEQ ID NO: 1447180 - RNA, 21 nt, Homo sapiens
gcagguugaccgggacuucaa

SEQ ID NO: 1447181 - RNA, 13 nt, Homo sapiens
gcaguacauguua

SEQ ID NO: 1447182 - RNA, 17 nt, Homo sapiens
gcagucucagaaagccu

SEQ ID NO: 1447183 - RNA, 15 nt, Homo sapiens
gcagugacuuuagaa

SEQ ID NO: 1447184 - RNA, 18 nt, Homo sapiens
gcagugagcuucuauuaa

SEQ ID NO: 1447185 - RNA, 13 nt, Homo sapiens
gcauacauguuca

SEQ ID NO: 1447186 - RNA, 17 nt, Homo sapiens
gcccuccaccuaccugc

SEQ ID NO: 1447187 - RNA, 19 nt, Homo sapiens
gcccucccccagcaguuga

SEQ ID NO: 1447188 - RNA, 18 nt, Homo sapiens
gcccuccuacagcacucc

SEQ ID NO: 1447189 - RNA, 11 nt, Homo sapiens
gcccucuggga

SEQ ID NO: 1447190 - RNA, 18 nt, Homo sapiens
gcccugccuggaggaccu

SEQ ID NO: 1447191 - RNA, 18 nt, Homo sapiens
gcccuggagggaggcucu

SEQ ID NO: 1447192 - RNA, 20 nt, Homo sapiens
gcccuggcuggaguucagug

SEQ ID NO: 1447193 - RNA, 22 nt, Homo sapiens
gcccugggaccgcuacaccacu

SEQ ID NO: 1447194 - RNA, 19 nt, Homo sapiens
gcccugggccccaccaccu

SEQ ID NO: 1447195 - RNA, 19 nt, Homo sapiens
gcccugguguguuuccaga

SEQ ID NO: 1447196 - RNA, 14 nt, Homo sapiens
gcccuucgcugcca

SEQ ID NO: 1447197 - RNA, 22 nt, Homo sapiens
gcccuucgcugccaggacaccu

SEQ ID NO: 1447198 - RNA, 15 nt, Homo sapiens
gcccuucugaugaga

SEQ ID NO: 1447199 - RNA, 22 nt, Homo sapiens
gcccuucugaugagaaaggccu

SEQ ID NO: 1447200 - RNA, 19 nt, Homo sapiens
gcccuugcccugaccuccc

SEQ ID NO: 1447201 - RNA, 17 nt, Homo sapiens
gcccuuuggguacuacu

SEQ ID NO: 1447202 - RNA, 21 nt, Homo sapiens
gccgagauugcaccacugcac

SEQ ID NO: 1447203 - RNA, 16 nt, Homo sapiens
gccgcagggacgggga

SEQ ID NO: 1447204 - RNA, 13 nt, Homo sapiens
gccgcccaaagag

SEQ ID NO: 1447205 - RNA, 21 nt, Homo sapiens
gccgccuggagaugacuugag

SEQ ID NO: 1447206 - RNA, 13 nt, Homo sapiens
gccgcgugugaca

SEQ ID NO: 1447207 - RNA, 14 nt, Homo sapiens
gccgcgugugacag

SEQ ID NO: 1447208 - RNA, 19 nt, Homo sapiens
gccggcucuucaaagacaa

SEQ ID NO: 1447209 - RNA, 17 nt, Homo sapiens
gccuaaaaaugcaacuu

SEQ ID NO: 1447210 - RNA, 19 nt, Homo sapiens
gccuaacaugauuauuuga

SEQ ID NO: 1447211 - RNA, 12 nt, Homo sapiens
gccuacugccuc

SEQ ID NO: 1447212 - RNA, 23 nt, Homo sapiens
gccuagauccacacacagaggaa

SEQ ID NO: 1447213 - RNA, 12 nt, Homo sapiens
gccucaagaaca

SEQ ID NO: 1447214 - RNA, 14 nt, Homo sapiens
gccucagugccacu

SEQ ID NO: 1447215 - RNA, 17 nt, Homo sapiens
gccucagugccacuuga

SEQ ID NO: 1447216 - RNA, 23 nt, Homo sapiens
gccucauauuuaaagacagggaa

SEQ ID NO: 1447217 - RNA, 13 nt, Homo sapiens
gccucaucuucaa

SEQ ID NO: 1447218 - RNA, 16 nt, Homo sapiens
gccuccaagcuccauc

SEQ ID NO: 1447219 - RNA, 18 nt, Homo sapiens
gccuccaccucuccuugg

SEQ ID NO: 1447220 - RNA, 10 nt, Homo sapiens
gccuccacuc

SEQ ID NO: 1447221 - RNA, 13 nt, Homo sapiens
gccuccagcacuc

SEQ ID NO: 1447222 - RNA, 17 nt, Homo sapiens
gccucccaaagugcugg

SEQ ID NO: 1447223 - RNA, 9 nt, Homo sapiens
gccucggga

SEQ ID NO: 1447224 - RNA, 18 nt, Homo sapiens
gccucguaccagccagga

SEQ ID NO: 1447225 - RNA, 18 nt, Homo sapiens
gccucgugccaugaucug

SEQ ID NO: 1447226 - RNA, 13 nt, Homo sapiens
gccucucugcucc

SEQ ID NO: 1447227 - RNA, 14 nt, Homo sapiens
gccucuuccagggc

SEQ ID NO: 1447228 - RNA, 21 nt, Homo sapiens
gccugaaugucuuacugugau

SEQ ID NO: 1447229 - RNA, 18 nt, Homo sapiens
gccugagucuccugugcc

SEQ ID NO: 1447230 - RNA, 21 nt, Homo sapiens
gccugagugcuuuaccuuuaa

SEQ ID NO: 1447231 - RNA, 13 nt, Homo sapiens
gccugcagccucc

SEQ ID NO: 1447232 - RNA, 14 nt, Homo sapiens
gccugccucugcca

SEQ ID NO: 1447233 - RNA, 20 nt, Homo sapiens
gccuggaagccaaacaaagg

SEQ ID NO: 1447234 - RNA, 19 nt, Homo sapiens
gccuggcaagugggugaaa

SEQ ID NO: 1447235 - RNA, 20 nt, Homo sapiens
gccuggccuccugccucuac

SEQ ID NO: 1447236 - RNA, 21 nt, Homo sapiens
gccuggcuccccacgagucac

SEQ ID NO: 1447237 - RNA, 15 nt, Homo sapiens
gccugggacccagcu

SEQ ID NO: 1447238 - RNA, 18 nt, Homo sapiens
gccugguagaauugggaa

SEQ ID NO: 1447239 - RNA, 18 nt, Homo sapiens
gccugucaguuucaugga

SEQ ID NO: 1447240 - RNA, 13 nt, Homo sapiens
gccuguguagcug

SEQ ID NO: 1447241 - RNA, 17 nt, Homo sapiens
gccuguucauggcagau

SEQ ID NO: 1447242 - RNA, 22 nt, Homo sapiens
gccuuaaauuuuugucauuuua

SEQ ID NO: 1447243 - RNA, 14 nt, Homo sapiens
gccuugccaugucu

SEQ ID NO: 1447244 - RNA, 15 nt, Homo sapiens
gccuuugaccaucuc

SEQ ID NO: 1447245 - RNA, 14 nt, Homo sapiens
gccuuugaggcaaa

SEQ ID NO: 1447246 - RNA, 20 nt, Homo sapiens
gcugccaugccacugccagg

SEQ ID NO: 1447247 - RNA, 21 nt, Homo sapiens
gcugcccaaucauuugcaaug

SEQ ID NO: 1447248 - RNA, 19 nt, Homo sapiens
gcugcggccuaggggucca

SEQ ID NO: 1447249 - RNA, 23 nt, Homo sapiens
gcugcgucagaccaguacuggga

SEQ ID NO: 1447250 - RNA, 17 nt, Homo sapiens
gcugcucucaugccugc

SEQ ID NO: 1447251 - RNA, 13 nt, Homo sapiens
gcugcucugcuau

SEQ ID NO: 1447252 - RNA, 23 nt, Homo sapiens
gcugcucuuagugcccgccuagg

SEQ ID NO: 1447253 - RNA, 15 nt, Homo sapiens
gcugcugagaaccug

SEQ ID NO: 1447254 - RNA, 18 nt, Homo sapiens
gcugcugagaaucuagcc

SEQ ID NO: 1447255 - RNA, 15 nt, Homo sapiens
gcugcuuguccugcu

SEQ ID NO: 1447256 - RNA, 18 nt, Homo sapiens
gcuggacggggacugggg

SEQ ID NO: 1447257 - RNA, 13 nt, Homo sapiens
gcuggacugagga

SEQ ID NO: 1447258 - RNA, 21 nt, Homo sapiens
gcuggagcaaaagucauuaca

SEQ ID NO: 1447259 - RNA, 20 nt, Homo sapiens
gcuggagugcaguagcacga

SEQ ID NO: 1447260 - RNA, 21 nt, Homo sapiens
gcuggcaccgcgugccaugca

SEQ ID NO: 1447261 - RNA, 20 nt, Homo sapiens
gcugggaguagcauggacuc

SEQ ID NO: 1447262 - RNA, 15 nt, Homo sapiens
gcuggggaacagagc

SEQ ID NO: 1447263 - RNA, 15 nt, Homo sapiens
gcuggggccagugua

SEQ ID NO: 1447264 - RNA, 14 nt, Homo sapiens
gcugguacuaagag

SEQ ID NO: 1447265 - RNA, 23 nt, Homo sapiens
gcuguauauaggggucaauguga

SEQ ID NO: 1447266 - RNA, 18 nt, Homo sapiens
gcugucaggacaccagcc

SEQ ID NO: 1447267 - RNA, 13 nt, Homo sapiens
gcuguccuuuuag

SEQ ID NO: 1447268 - RNA, 12 nt, Homo sapiens
gugaaccaaaga

SEQ ID NO: 1447269 - RNA, 13 nt, Homo sapiens
gugaaccaaagag

SEQ ID NO: 1447270 - RNA, 15 nt, Homo sapiens
gugaauuucuucacu

SEQ ID NO: 1447271 - RNA, 20 nt, Homo sapiens
gugacaucucuuugauguca

SEQ ID NO: 1447272 - RNA, 14 nt, Homo sapiens
gugaccagggguga

SEQ ID NO: 1447273 - RNA, 17 nt, Homo sapiens
gugacugaacgagggau

SEQ ID NO: 1447274 - RNA, 20 nt, Homo sapiens
gugacuuuuuagccagugac

SEQ ID NO: 1447275 - RNA, 16 nt, Homo sapiens
gugagaaaaggggcau

SEQ ID NO: 1447276 - RNA, 21 nt, Homo sapiens
gugagaagacuggcaggcagc

SEQ ID NO: 1447277 - RNA, 13 nt, Homo sapiens
gugagaccaccuc

SEQ ID NO: 1447278 - RNA, 18 nt, Homo sapiens
gugagaugggacauucca

SEQ ID NO: 1447279 - RNA, 18 nt, Homo sapiens
gugagccgugucguauga

SEQ ID NO: 1447280 - RNA, 18 nt, Homo sapiens
gugaguacccaggaugau

SEQ ID NO: 1447281 - RNA, 23 nt, Homo sapiens
gugauacaacuucaagugcaugc

SEQ ID NO: 1447282 - RNA, 22 nt, Homo sapiens
gugaucacugagacagccacuu

SEQ ID NO: 1447283 - RNA, 17 nt, Homo sapiens
gugauuuggaagagagg

SEQ ID NO: 1447284 - RNA, 14 nt, Homo sapiens
gugauuuuugaaca

SEQ ID NO: 1447285 - RNA, 18 nt, Homo sapiens
gugcaccacuucaaguga

SEQ ID NO: 1447286 - RNA, 15 nt, Homo sapiens
gugcacuagcauuuu

SEQ ID NO: 1447287 - RNA, 18 nt, Homo sapiens
gugcacuagccugugauu

SEQ ID NO: 1447288 - RNA, 17 nt, Homo sapiens
gugcagucuuggcucac

SEQ ID NO: 1447289 - RNA, 12 nt, Homo sapiens
gugcaugcucuc

SEQ ID NO: 1447290 - RNA, 22 nt, Homo sapiens
gugcauuaacuuaaaagauuca

SEQ ID NO: 1447291 - RNA, 14 nt, Homo sapiens
gugccacucauucc

SEQ ID NO: 1447292 - RNA, 17 nt, Homo sapiens
gugccaguuauggcuau

SEQ ID NO: 1447293 - RNA, 13 nt, Homo sapiens
gugcccacaaaau

SEQ ID NO: 1447294 - RNA, 17 nt, Homo sapiens
gugcccucccauagcac

SEQ ID NO: 1447295 - RNA, 14 nt, Homo sapiens
gugccugagacacc

SEQ ID NO: 1447296 - RNA, 18 nt, Homo sapiens
gugccugagacacccggu

SEQ ID NO: 1447297 - RNA, 17 nt, Homo sapiens
gugcgugcauguguaua

SEQ ID NO: 1447298 - RNA, 18 nt, Homo sapiens
gugcuacaaaaacacagc

SEQ ID NO: 1447299 - RNA, 15 nt, Homo sapiens
gugcuagaugugcaa

SEQ ID NO: 1447300 - RNA, 23 nt, Homo sapiens
gugcugcauggagugagcaguag

SEQ ID NO: 1447301 - RNA, 16 nt, Homo sapiens
gugcugccaguccucu

SEQ ID NO: 1447302 - RNA, 15 nt, Homo sapiens
gugcugugucugcac

SEQ ID NO: 1447303 - RNA, 22 nt, Homo sapiens
gugcuuccacuucuaugcaaau

SEQ ID NO: 1447304 - RNA, 15 nt, Homo sapiens
gugcuugucauggaa

SEQ ID NO: 1447305 - RNA, 12 nt, Homo sapiens
guggacaccugc

SEQ ID NO: 1447306 - RNA, 21 nt, Homo sapiens
guggagaaauuccuugauuca

SEQ ID NO: 1447307 - RNA, 16 nt, Homo sapiens
guggagcuccugcugg

SEQ ID NO: 1447308 - RNA, 18 nt, Homo sapiens
guggaggaaaauccaugg

SEQ ID NO: 1447309 - RNA, 14 nt, Homo sapiens
guggaggacuuuga

SEQ ID NO: 1447310 - RNA, 13 nt, Homo sapiens
guggagguugcag

SEQ ID NO: 1447311 - RNA, 16 nt, Homo sapiens
guggagguugcaguga

SEQ ID NO: 1447312 - RNA, 16 nt, Homo sapiens
guggauaucuguguau

SEQ ID NO: 1447313 - RNA, 21 nt, Homo sapiens
guggcagauaaucagccucuu

SEQ ID NO: 1447314 - RNA, 22 nt, Homo sapiens
guggcaucucuaauuggaagaa

SEQ ID NO: 1447315 - RNA, 13 nt, Homo sapiens
guggcucuugccu

SEQ ID NO: 1447316 - RNA, 15 nt, Homo sapiens
gugggcuccuuacag

SEQ ID NO: 1447317 - RNA, 14 nt, Homo sapiens
gugguacagcacug

SEQ ID NO: 1447318 - RNA, 23 nt, Homo sapiens
gugguagaagccaguacagagaa

SEQ ID NO: 1447319 - RNA, 18 nt, Homo sapiens
gugguauauuuguguaug

SEQ ID NO: 1447320 - RNA, 20 nt, Homo sapiens
guggugacaggcccagugga

SEQ ID NO: 1447321 - RNA, 15 nt, Homo sapiens
gugguuguuuuguca

SEQ ID NO: 1447322 - RNA, 18 nt, Homo sapiens
guguaaagaauaaaugaa

SEQ ID NO: 1447323 - RNA, 19 nt, Homo sapiens
guguaaagaauaaaugaau

SEQ ID NO: 1447324 - RNA, 14 nt, Homo sapiens
guguaagcauugua

SEQ ID NO: 1447325 - RNA, 17 nt, Homo sapiens
guguacauguuggguau

SEQ ID NO: 1447326 - RNA, 13 nt, Homo sapiens
guguagugucugu

SEQ ID NO: 1447327 - RNA, 19 nt, Homo sapiens
guguaucgcugccuugcca

SEQ ID NO: 1447328 - RNA, 13 nt, Homo sapiens
guguauuugccag

SEQ ID NO: 1447329 - RNA, 18 nt, Homo sapiens
gugucaaagauuuuaccu

SEQ ID NO: 1447330 - RNA, 22 nt, Homo sapiens
gugucagagcugggaguagcau

SEQ ID NO: 1447331 - RNA, 19 nt, Homo sapiens
guguccccucacucuguca

SEQ ID NO: 1447332 - RNA, 16 nt, Homo sapiens
guguccccuccacugu

SEQ ID NO: 1447333 - RNA, 17 nt, Homo sapiens
guguccccuccacuguc

SEQ ID NO: 1447334 - RNA, 23 nt, Homo sapiens
gugucugcacccaggggugggga

SEQ ID NO: 1447335 - RNA, 23 nt, Homo sapiens
gugugaaguguaguggcauccau

SEQ ID NO: 1447336 - RNA, 20 nt, Homo sapiens
gugugacagucuugcauucu

SEQ ID NO: 1447337 - RNA, 14 nt, Homo sapiens
gugugucaaugcca

SEQ ID NO: 1447338 - RNA, 14 nt, Homo sapiens
gugugucucgucuc

SEQ ID NO: 1447339 - RNA, 13 nt, Homo sapiens
gugugugugauau

SEQ ID NO: 1447340 - RNA, 13 nt, Homo sapiens
gugugugugcaug

SEQ ID NO: 1447341 - RNA, 16 nt, Homo sapiens
guguuacuguugcacu

SEQ ID NO: 1447342 - RNA, 21 nt, Homo sapiens
uagaagcuguaguagcccuuu

SEQ ID NO: 1447343 - RNA, 21 nt, Homo sapiens
uagacaguacucuuaacuccu

SEQ ID NO: 1447344 - RNA, 23 nt, Homo sapiens
uagacuauaagcagaagcacaua

SEQ ID NO: 1447345 - RNA, 14 nt, Homo sapiens
gucucugcugcuaa

SEQ ID NO: 1447346 - RNA, 15 nt, Homo sapiens
gucugaaagacagaa

SEQ ID NO: 1447347 - RNA, 15 nt, Homo sapiens
gucuggggcuuuuag

SEQ ID NO: 1447348 - RNA, 14 nt, Homo sapiens
gucugucaccagcu

SEQ ID NO: 1447349 - RNA, 20 nt, Homo sapiens
gucugugugaugaacuuucu

SEQ ID NO: 1447350 - RNA, 14 nt, Homo sapiens
gucuguguggugcc

SEQ ID NO: 1447351 - RNA, 15 nt, Homo sapiens
gucuucacucuucau

SEQ ID NO: 1447352 - RNA, 13 nt, Homo sapiens
gucuucccuguau

SEQ ID NO: 1447353 - RNA, 22 nt, Homo sapiens
gucuuuaacaucuugaacuggu

SEQ ID NO: 1447354 - RNA, 17 nt, Homo sapiens
gucuuuuccacuccuau

SEQ ID NO: 1447355 - RNA, 21 nt, Homo sapiens
gugaaacccugucucuacuaa

SEQ ID NO: 1447356 - RNA, 15 nt, Homo sapiens
gugaaagaggcagcu

SEQ ID NO: 1447357 - RNA, 18 nt, Homo sapiens
gugaacaccuccuagcca

SEQ ID NO: 1447358 - RNA, 14 nt, Homo sapiens
uauacaaacaugug

SEQ ID NO: 1447359 - RNA, 19 nt, Homo sapiens
uauacagauucuagccaaa

SEQ ID NO: 1447360 - RNA, 14 nt, Homo sapiens
uauacagcucagcu

SEQ ID NO: 1447361 - RNA, 12 nt, Homo sapiens
uauacauuugau

SEQ ID NO: 1447362 - RNA, 18 nt, Homo sapiens
uauacauuugauguauug

SEQ ID NO: 1447363 - RNA, 13 nt, Homo sapiens
uauacuucacuca

SEQ ID NO: 1447364 - RNA, 18 nt, Homo sapiens
uauagcguggguuaucag

SEQ ID NO: 1447365 - RNA, 13 nt, Homo sapiens
uauagcugggaac

SEQ ID NO: 1447366 - RNA, 14 nt, Homo sapiens
uauaguagcauuuc

SEQ ID NO: 1447367 - RNA, 14 nt, Homo sapiens
uauagucacaagag

SEQ ID NO: 1447368 - RNA, 17 nt, Homo sapiens
uauauaaagccucacau

SEQ ID NO: 1447369 - RNA, 12 nt, Homo sapiens
uauauacauuuc

SEQ ID NO: 1447370 - RNA, 19 nt, Homo sapiens
uauauaggaaacauuguua

SEQ ID NO: 1447371 - RNA, 17 nt, Homo sapiens
uauauagguugugcaaa

SEQ ID NO: 1447372 - RNA, 20 nt, Homo sapiens
uauauaguaaugcacucuca

SEQ ID NO: 1447373 - RNA, 23 nt, Homo sapiens
uauauaguaaugcacucucagua

SEQ ID NO: 1447374 - RNA, 16 nt, Homo sapiens
uauauaguauaccaua

SEQ ID NO: 1447375 - RNA, 19 nt, Homo sapiens
uauauaguauaccauacau

SEQ ID NO: 1447376 - RNA, 11 nt, Homo sapiens
uauauauagua

SEQ ID NO: 1447377 - RNA, 14 nt, Homo sapiens
uauauauguauaua

SEQ ID NO: 1447378 - RNA, 18 nt, Homo sapiens
uauauaugugcaguauuu

SEQ ID NO: 1447379 - RNA, 13 nt, Homo sapiens
uauauauuacuug

SEQ ID NO: 1447380 - RNA, 19 nt, Homo sapiens
uauauauuuuuucaauuua

SEQ ID NO: 1447381 - RNA, 13 nt, Homo sapiens
uauaucaucagca

SEQ ID NO: 1447382 - RNA, 17 nt, Homo sapiens
uauaucgcuuaaucuua

SEQ ID NO: 1447383 - RNA, 20 nt, Homo sapiens
uauauguaguacuaacuaag

SEQ ID NO: 1447384 - RNA, 15 nt, Homo sapiens
uauauuaaaguguua

SEQ ID NO: 1447385 - RNA, 13 nt, Homo sapiens
uauauucuuuaaa

SEQ ID NO: 1447386 - RNA, 17 nt, Homo sapiens
uauauuugaauaucauu

SEQ ID NO: 1447387 - RNA, 17 nt, Homo sapiens
uauauuuguguaugugu

SEQ ID NO: 1447388 - RNA, 19 nt, Homo sapiens
uauauuuuugguugucaau

SEQ ID NO: 1447389 - RNA, 23 nt, Homo sapiens
uaucaaggauguucuggcuuuac

SEQ ID NO: 1447390 - RNA, 22 nt, Homo sapiens
uaucacauuacaucauccuccu

SEQ ID NO: 1447391 - RNA, 19 nt, Homo sapiens
uaucaggccaagaccccag

SEQ ID NO: 1447392 - RNA, 19 nt, Homo sapiens
uaucaugaaacacuucuca

SEQ ID NO: 1447393 - RNA, 17 nt, Homo sapiens
uaucauuuugcacgugc

SEQ ID NO: 1447394 - RNA, 22 nt, Homo sapiens
uauccacccagcccauucucuc

SEQ ID NO: 1447395 - RNA, 17 nt, Homo sapiens
uauccacuuaccuagau

SEQ ID NO: 1447396 - RNA, 24 nt, Homo sapiens
uauccacuuaccuagauucuacau

SEQ ID NO: 1447397 - RNA, 22 nt, Homo sapiens
uauccuguacauuucacaaaaa

SEQ ID NO: 1447398 - RNA, 19 nt, Homo sapiens
uauccuucuagaucauaca

SEQ ID NO: 1447399 - RNA, 14 nt, Homo sapiens
uaucugaggucaca

SEQ ID NO: 1447400 - RNA, 15 nt, Homo sapiens
uaucuggacaagcca

SEQ ID NO: 1447401 - RNA, 13 nt, Homo sapiens
uaucuguguauau

SEQ ID NO: 1447402 - RNA, 14 nt, Homo sapiens
uaucuucauacaau

SEQ ID NO: 1447403 - RNA, 14 nt, Homo sapiens
uaugaacuacaaag

SEQ ID NO: 1447404 - RNA, 22 nt, Homo sapiens
uaugaaguugcaaugcuucaca

SEQ ID NO: 1447405 - RNA, 14 nt, Homo sapiens
uaugacaauccuga

SEQ ID NO: 1447406 - RNA, 20 nt, Homo sapiens
uaugagucucuaugaucuug

SEQ ID NO: 1447407 - RNA, 23 nt, Homo sapiens
uaugagucucuaugaucuuggca

SEQ ID NO: 1447408 - RNA, 19 nt, Homo sapiens
uaugaguggcuucugggag

SEQ ID NO: 1447409 - RNA, 21 nt, Homo sapiens
uaugaguggcuucugggagau

SEQ ID NO: 1447410 - RNA, 15 nt, Homo sapiens
uaugaucuaauacaa

SEQ ID NO: 1447411 - RNA, 19 nt, Homo sapiens
uaugcaaacaguucuugga

SEQ ID NO: 1447412 - RNA, 14 nt, Homo sapiens
uaugcaaaugccuc

SEQ ID NO: 1447413 - RNA, 21 nt, Homo sapiens
uaugcaauuuuuaaacuagua

SEQ ID NO: 1447414 - RNA, 18 nt, Homo sapiens
uaugcacacacagaugca

SEQ ID NO: 1447415 - RNA, 17 nt, Homo sapiens
uaugcacacacauggau

SEQ ID NO: 1447416 - RNA, 16 nt, Homo sapiens
uaugcauucauccaac

SEQ ID NO: 1447417 - RNA, 14 nt, Homo sapiens
uaugcccacucuaa

SEQ ID NO: 1447418 - RNA, 15 nt, Homo sapiens
uaugccucuguauuu

SEQ ID NO: 1447419 - RNA, 12 nt, Homo sapiens
uaugcuagugau

SEQ ID NO: 1447420 - RNA, 21 nt, Homo sapiens
uauggacucaguuuucuugca

SEQ ID NO: 1447421 - RNA, 19 nt, Homo sapiens
uauggaucccaauucauuu

SEQ ID NO: 1447422 - RNA, 13 nt, Homo sapiens
uauggcaagugau

SEQ ID NO: 1447423 - RNA, 20 nt, Homo sapiens
uaugggggcacugaggacca

SEQ ID NO: 1447424 - RNA, 12 nt, Homo sapiens
uaugggugcugg

SEQ ID NO: 1447425 - RNA, 15 nt, Homo sapiens
uaugguugauuccca

SEQ ID NO: 1447426 - RNA, 17 nt, Homo sapiens
uauguauauagaugugc

SEQ ID NO: 1447427 - RNA, 23 nt, Homo sapiens
uauguaugcaucuauauguguau

SEQ ID NO: 1447428 - RNA, 13 nt, Homo sapiens
uauguauggaaua

SEQ ID NO: 1447429 - RNA, 20 nt, Homo sapiens
uauguauuuuugucauagca

SEQ ID NO: 1447430 - RNA, 13 nt, Homo sapiens
uaugucaucauac

SEQ ID NO: 1447431 - RNA, 14 nt, Homo sapiens
uaugugauguuaac

SEQ ID NO: 1447432 - RNA, 17 nt, Homo sapiens
uaugugcgugcaugugu

SEQ ID NO: 1447433 - RNA, 17 nt, Homo sapiens
uauguguauauauacau

SEQ ID NO: 1447434 - RNA, 20 nt, Homo sapiens
uauguuuacauaucaccuca

SEQ ID NO: 1447435 - RNA, 13 nt, Homo sapiens
uauguuugcacuu

SEQ ID NO: 1447436 - RNA, 21 nt, Homo sapiens
uauuaaaauuuuuugauguca

SEQ ID NO: 1447437 - RNA, 14 nt, Homo sapiens
uauuaaagaugugu

SEQ ID NO: 1447438 - RNA, 15 nt, Homo sapiens
uauuaagauguauaa

SEQ ID NO: 1447439 - RNA, 19 nt, Homo sapiens
uauuaagugccugagacac

SEQ ID NO: 1447440 - RNA, 22 nt, Homo sapiens
uauuaauacugccggucaccca

SEQ ID NO: 1447441 - RNA, 15 nt, Homo sapiens
uauuagaacaggcaa

SEQ ID NO: 1447442 - RNA, 13 nt, Homo sapiens
uauuagcuuauau

SEQ ID NO: 1447443 - RNA, 19 nt, Homo sapiens
uauuauugaagauuuacca

SEQ ID NO: 1447444 - RNA, 13 nt, Homo sapiens
uauucaaguauua

SEQ ID NO: 1447445 - RNA, 16 nt, Homo sapiens
ucuaccauuugaauuu

SEQ ID NO: 1447446 - RNA, 13 nt, Homo sapiens
ucuacuacagggu

SEQ ID NO: 1447447 - RNA, 14 nt, Homo sapiens
ucuacuacagggug

SEQ ID NO: 1447448 - RNA, 17 nt, Homo sapiens
ucuacuccaugcacaua

SEQ ID NO: 1447449 - RNA, 17 nt, Homo sapiens
ucuacugagacaugacu

SEQ ID NO: 1447450 - RNA, 15 nt, Homo sapiens
ucuacuucagucuuc

SEQ ID NO: 1447451 - RNA, 17 nt, Homo sapiens
ucuagaagauaucauga

SEQ ID NO: 1447452 - RNA, 18 nt, Homo sapiens
ucuagcuucaugccucag

SEQ ID NO: 1447453 - RNA, 15 nt, Homo sapiens
ucuagcuuuagggga

SEQ ID NO: 1447454 - RNA, 14 nt, Homo sapiens
ucuaggacuccaca

SEQ ID NO: 1447455 - RNA, 13 nt, Homo sapiens
ucugccaagcccu

SEQ ID NO: 1447456 - RNA, 22 nt, Homo sapiens
ucugcccacugugaaaccacua

SEQ ID NO: 1447457 - RNA, 15 nt, Homo sapiens
ucugccccagcuuua

SEQ ID NO: 1447458 - RNA, 14 nt, Homo sapiens
ucugcccugccucc

SEQ ID NO: 1447459 - RNA, 15 nt, Homo sapiens
ucugcguuacaacag

SEQ ID NO: 1447460 - RNA, 18 nt, Homo sapiens
ucugcuccucuccaggca

SEQ ID NO: 1447461 - RNA, 22 nt, Homo sapiens
ucugcucugaggcuuccagaga

SEQ ID NO: 1447462 - RNA, 16 nt, Homo sapiens
ucugcuguauacugua

SEQ ID NO: 1447463 - RNA, 16 nt, Homo sapiens
ucuggaauacaugaaa

SEQ ID NO: 1447464 - RNA, 19 nt, Homo sapiens
ucuggacccuccacuucaa

SEQ ID NO: 1447465 - RNA, 14 nt, Homo sapiens
ucuggauaacaaga

SEQ ID NO: 1447466 - RNA, 21 nt, Homo sapiens
ucuggauggauuugaagcaaa

SEQ ID NO: 1447467 - RNA, 17 nt, Homo sapiens
ucuuuuuccuuuugcca

SEQ ID NO: 1447468 - RNA, 18 nt, Homo sapiens
ugaaaaacaaaaauaaca

SEQ ID NO: 1447469 - RNA, 12 nt, Homo sapiens
ugaaaaacauuc

SEQ ID NO: 1447470 - RNA, 21 nt, Homo sapiens
ugaaaaaugguaauuguugcu

SEQ ID NO: 1447471 - RNA, 22 nt, Homo sapiens
ugaaaaauucucagucaguaau

SEQ ID NO: 1447472 - RNA, 18 nt, Homo sapiens
ugaaaaccauaugauauu

SEQ ID NO: 1447473 - RNA, 15 nt, Homo sapiens
ugaaaauaugauguu

SEQ ID NO: 1447474 - RNA, 23 nt, Homo sapiens
ugaaacugagaugugaacacauc

SEQ ID NO: 1447475 - RNA, 20 nt, Homo sapiens
ugaaacuucauaaauguuca

SEQ ID NO: 1447476 - RNA, 11 nt, Homo sapiens
ugaaagcacag

SEQ ID NO: 1447477 - RNA, 21 nt, Homo sapiens
ugaaauaccagugaaccaaag

SEQ ID NO: 1447478 - RNA, 22 nt, Homo sapiens
ugaaauaccagugaaccaaaga

SEQ ID NO: 1447479 - RNA, 23 nt, Homo sapiens
ugaaauaccagugaaccaaagag

SEQ ID NO: 1447480 - RNA, 20 nt, Homo sapiens
ugaccugcugagcucugaga

SEQ ID NO: 1447481 - RNA, 21 nt, Homo sapiens
ugaccugucaccgugagcagc

SEQ ID NO: 1447482 - RNA, 12 nt, Homo sapiens
ugacgagcucac

SEQ ID NO: 1447483 - RNA, 16 nt, Homo sapiens
ugacuaccagcuaacu

SEQ ID NO: 1447484 - RNA, 21 nt, Homo sapiens
ugacuaucacauacaauuugc

SEQ ID NO: 1447485 - RNA, 19 nt, Homo sapiens
ugacucaacgagagcacuu

SEQ ID NO: 1447486 - RNA, 17 nt, Homo sapiens
ugacucuaccugcaaga

SEQ ID NO: 1447487 - RNA, 15 nt, Homo sapiens
ugacuuccacaccua

SEQ ID NO: 1447488 - RNA, 18 nt, Homo sapiens
ugacuucucccaucuagu

SEQ ID NO: 1447489 - RNA, 15 nt, Homo sapiens
ugagaaacugauuua

SEQ ID NO: 1447490 - RNA, 16 nt, Homo sapiens
ugagaaagaaugagca

SEQ ID NO: 1447491 - RNA, 21 nt, Homo sapiens
ugagaacaagucacagcugca

SEQ ID NO: 1447492 - RNA, 18 nt, Homo sapiens
ugagaagcugggcaugaa

SEQ ID NO: 1447493 - RNA, 18 nt, Homo sapiens
ugagcacccccucauucc

SEQ ID NO: 1447494 - RNA, 22 nt, Homo sapiens
ugagcacugccaggagggacaa

SEQ ID NO: 1447495 - RNA, 19 nt, Homo sapiens
uggcaccucagacaaucca

SEQ ID NO: 1447496 - RNA, 19 nt, Homo sapiens
uggcacgugccugugaucc

SEQ ID NO: 1447497 - RNA, 19 nt, Homo sapiens
uggcacucccuaaccaaau

SEQ ID NO: 1447498 - RNA, 14 nt, Homo sapiens
uggcagaccaucuc

SEQ ID NO: 1447499 - RNA, 21 nt, Homo sapiens
uggcagcgccucaucuucaac

SEQ ID NO: 1447500 - RNA, 13 nt, Homo sapiens
uggcaggugcaga

SEQ ID NO: 1447501 - RNA, 15 nt, Homo sapiens
uggcaugauuuauau

SEQ ID NO: 1447502 - RNA, 11 nt, Homo sapiens
uggcaugucag

SEQ ID NO: 1447503 - RNA, 17 nt, Homo sapiens
uggcauuuguugugacu

SEQ ID NO: 1447504 - RNA, 12 nt, Homo sapiens
uggccaagcuga

SEQ ID NO: 1447505 - RNA, 23 nt, Homo sapiens
uggccacugggucucacuccuga

SEQ ID NO: 1447506 - RNA, 22 nt, Homo sapiens
uggccaggagguuggugacuga

SEQ ID NO: 1447507 - RNA, 18 nt, Homo sapiens
uggccauuccaacagcuc

SEQ ID NO: 1447508 - RNA, 15 nt, Homo sapiens
uggccauuguguugg

SEQ ID NO: 1447509 - RNA, 15 nt, Homo sapiens
uggccccaggguuga

SEQ ID NO: 1447510 - RNA, 18 nt, Homo sapiens
uggccccgggcucuggcc

SEQ ID NO: 1447511 - RNA, 22 nt, Homo sapiens
uggccgaucggggcacugcagg

SEQ ID NO: 1447512 - RNA, 22 nt, Homo sapiens
uggccgggugcgguggcucacg

SEQ ID NO: 1447513 - RNA, 15 nt, Homo sapiens
uggccugcugggaac

SEQ ID NO: 1447514 - RNA, 19 nt, Homo sapiens
uggccugcugggcucucca

SEQ ID NO: 1447515 - RNA, 16 nt, Homo sapiens
uggccuggcaucgcau

SEQ ID NO: 1447516 - RNA, 20 nt, Homo sapiens
uggccuuccccuuuugccug

SEQ ID NO: 1447517 - RNA, 23 nt, Homo sapiens
uggcgacugcagcugcaccauca

SEQ ID NO: 1447518 - RNA, 15 nt, Homo sapiens
uggcgcaucauaugc

SEQ ID NO: 1447519 - RNA, 21 nt, Homo sapiens
uggcggcuuccuguccacucu

SEQ ID NO: 1447520 - RNA, 14 nt, Homo sapiens
uggcuaacuggcga

SEQ ID NO: 1447521 - RNA, 22 nt, Homo sapiens
uggcuaauucccagagugugaa

SEQ ID NO: 1447522 - RNA, 12 nt, Homo sapiens
uggcucuucacc

SEQ ID NO: 1447523 - RNA, 22 nt, Homo sapiens
uggcugcagugacccagauauu

SEQ ID NO: 1447524 - RNA, 14 nt, Homo sapiens
uggcuggcacugag

SEQ ID NO: 1447525 - RNA, 22 nt, Homo sapiens
uggcuguaaacuauaaacuacu

SEQ ID NO: 1447526 - RNA, 11 nt, Homo sapiens
uggcugugagg

SEQ ID NO: 1447527 - RNA, 17 nt, Homo sapiens
uggcuuagaaaucuuua

SEQ ID NO: 1447528 - RNA, 21 nt, Homo sapiens
ugggaaaggaaaaccagggau

SEQ ID NO: 1447529 - RNA, 18 nt, Homo sapiens
ugggaacccgacugugaa

SEQ ID NO: 1447530 - RNA, 15 nt, Homo sapiens
ugggaacuccacucu

SEQ ID NO: 1447531 - RNA, 23 nt, Homo sapiens
ugggaagccauauucacaccuca

SEQ ID NO: 1447532 - RNA, 13 nt, Homo sapiens
ugggaagcuugcu

SEQ ID NO: 1447533 - RNA, 19 nt, Homo sapiens
ugggaaggcuaaguucagu

SEQ ID NO: 1447534 - RNA, 12 nt, Homo sapiens
ugggacacugaa

SEQ ID NO: 1447535 - RNA, 14 nt, Homo sapiens
ugggacccuugaga

SEQ ID NO: 1447536 - RNA, 22 nt, Homo sapiens
ugggagucaggaccuccgggga

SEQ ID NO: 1447537 - RNA, 13 nt, Homo sapiens
ugggaugggaucc

SEQ ID NO: 1447538 - RNA, 12 nt, Homo sapiens
ugggauucccac

SEQ ID NO: 1447539 - RNA, 23 nt, Homo sapiens
ugggcaacauaguaagaccccau

SEQ ID NO: 1447540 - RNA, 14 nt, Homo sapiens
ugggccacugccag

SEQ ID NO: 1447541 - RNA, 16 nt, Homo sapiens
ugggccccaccaccua

SEQ ID NO: 1447542 - RNA, 15 nt, Homo sapiens
ugggccucaguucaa

SEQ ID NO: 1447543 - RNA, 15 nt, Homo sapiens
uggggagggagacag

SEQ ID NO: 1447544 - RNA, 16 nt, Homo sapiens
uggggcaccuugcucc

SEQ ID NO: 1447545 - RNA, 15 nt, Homo sapiens
uggggcaggaucuca

SEQ ID NO: 1447546 - RNA, 12 nt, Homo sapiens
uggggccagugc

SEQ ID NO: 1447547 - RNA, 19 nt, Homo sapiens
ugggggucagucacuugaa

SEQ ID NO: 1447548 - RNA, 14 nt, Homo sapiens
uggggucaaagacu

SEQ ID NO: 1447549 - RNA, 19 nt, Homo sapiens
uggggucuugcuauauugc

SEQ ID NO: 1447550 - RNA, 18 nt, Homo sapiens
ugggguucccccagacag

SEQ ID NO: 1447551 - RNA, 16 nt, Homo sapiens
uggguaacugucaagu

SEQ ID NO: 1447552 - RNA, 17 nt, Homo sapiens
uggguauccuacuacuu

SEQ ID NO: 1447553 - RNA, 21 nt, Homo sapiens
ugggucuucccuguaugauuc

SEQ ID NO: 1447554 - RNA, 20 nt, Homo sapiens
uggguggggcugcuccucca

SEQ ID NO: 1447555 - RNA, 17 nt, Homo sapiens
uggguuuucuaacugua

SEQ ID NO: 1447556 - RNA, 15 nt, Homo sapiens
ugguaaaacacagau

SEQ ID NO: 1447557 - RNA, 18 nt, Homo sapiens
ugguaaacauucucucag

SEQ ID NO: 1447558 - RNA, 16 nt, Homo sapiens
ugguaauuuguaucug

SEQ ID NO: 1447559 - RNA, 13 nt, Homo sapiens
ugguacaauccuu

SEQ ID NO: 1447560 - RNA, 17 nt, Homo sapiens
ugguauauuuguguaug

SEQ ID NO: 1447561 - RNA, 20 nt, Homo sapiens
ugguaugaacuugaggacac

SEQ ID NO: 1447562 - RNA, 20 nt, Homo sapiens
uggucacacagagauacgca

SEQ ID NO: 1447563 - RNA, 21 nt, Homo sapiens
uggucacacagagauacgcaa

SEQ ID NO: 1447564 - RNA, 17 nt, Homo sapiens
uggucauggacagauag

SEQ ID NO: 1447565 - RNA, 17 nt, Homo sapiens
uggucuccucccaaaau

SEQ ID NO: 1447566 - RNA, 18 nt, Homo sapiens
uggucuccuugcacuuuc

SEQ ID NO: 1447567 - RNA, 20 nt, Homo sapiens
uggucuuuccuaucauggag

SEQ ID NO: 1447568 - RNA, 21 nt, Homo sapiens
uggugaagaguaguuuacuag

SEQ ID NO: 1447569 - RNA, 17 nt, Homo sapiens
uggugacacacagcagc

SEQ ID NO: 1447570 - RNA, 17 nt, Homo sapiens
uggugacugaaacauuc

SEQ ID NO: 1447571 - RNA, 22 nt, Homo sapiens
uggugcacuuuucugugucaua

SEQ ID NO: 1447572 - RNA, 21 nt, Homo sapiens
uggugccuauuuauucauuca

SEQ ID NO: 1447573 - RNA, 22 nt, Homo sapiens
uggugccuucucacaucugucc

SEQ ID NO: 1447574 - RNA, 20 nt, Homo sapiens
uggugcuguggccaggguga

SEQ ID NO: 1447575 - RNA, 15 nt, Homo sapiens
ugguggaucugucca

SEQ ID NO: 1447576 - RNA, 16 nt, Homo sapiens
ugguggaucuguccaa

SEQ ID NO: 1447577 - RNA, 12 nt, Homo sapiens
uggugggaaccc

SEQ ID NO: 1447578 - RNA, 14 nt, Homo sapiens
ugguguauuugcca

SEQ ID NO: 1447579 - RNA, 15 nt, Homo sapiens
ugguguauuugccag

SEQ ID NO: 1447580 - RNA, 23 nt, Homo sapiens
uuuaacuuggaguuucauuucuu

SEQ ID NO: 1447581 - RNA, 21 nt, Homo sapiens
uuuaagagaagaugugauuua

SEQ ID NO: 1447582 - RNA, 20 nt, Homo sapiens
uuuaaguggcuuucagcaaa

SEQ ID NO: 1447583 - RNA, 16 nt, Homo sapiens
uuuaauauacuuuaaa

SEQ ID NO: 1447584 - RNA, 12 nt, Homo sapiens
uuuaauuaucuu

SEQ ID NO: 1447585 - RNA, 16 nt, Homo sapiens
uuuacagaacuguugu

SEQ ID NO: 1447586 - RNA, 14 nt, Homo sapiens
uuuacaucuaugua

SEQ ID NO: 1447587 - RNA, 20 nt, Homo sapiens
uuuaccacuaugcaauauau

SEQ ID NO: 1447588 - RNA, 22 nt, Homo sapiens
uuuacuggaccccgccucccag

SEQ ID NO: 1447589 - RNA, 17 nt, Homo sapiens
uuuagaacuguauguca

SEQ ID NO: 1447590 - RNA, 19 nt, Homo sapiens
uuuagagauggggucuugc

SEQ ID NO: 1447591 - RNA, 18 nt, Homo sapiens
uuuagcaggguacauauu

SEQ ID NO: 1447592 - RNA, 18 nt, Homo sapiens
uuuagcauugaagugucg

SEQ ID NO: 1447593 - RNA, 18 nt, Homo sapiens
uuuagccuggauguugcu

SEQ ID NO: 1447594 - RNA, 22 nt, Homo sapiens
uuuaguauguggcguaucaugc

SEQ ID NO: 1447595 - RNA, 23 nt, Homo sapiens
uuuagucaacaugccauaucuca

SEQ ID NO: 1447596 - RNA, 18 nt, Homo sapiens
uuuauacaccauuguucc

SEQ ID NO: 1447597 - RNA, 17 nt, Homo sapiens
uuuauacauaucagaaa

SEQ ID NO: 1447598 - RNA, 18 nt, Homo sapiens
uuuauuauaugauuauca

SEQ ID NO: 1447599 - RNA, 15 nt, Homo sapiens
uuuauugcuuaaucc

SEQ ID NO: 1447600 - RNA, 13 nt, Homo sapiens
uuuauugugaucu

SEQ ID NO: 1447601 - RNA, 22 nt, Homo sapiens
uuuauuuuuuuaaaacacaaau

SEQ ID NO: 1447602 - RNA, 12 nt, Homo sapiens
uuucaaaacaca

SEQ ID NO: 1447603 - RNA, 19 nt, Homo sapiens
uuucaaagauguguugcua

SEQ ID NO: 1447604 - RNA, 14 nt, Homo sapiens
uuucaacauaucau

SEQ ID NO: 1447605 - RNA, 13 nt, Homo sapiens
uuucaacuccaga

SEQ ID NO: 1447606 - RNA, 23 nt, Homo sapiens
uuucaagaccuucuccccauucu

SEQ ID NO: 1447607 - RNA, 14 nt, Homo sapiens
uuucaagacuugau

SEQ ID NO: 1447608 - RNA, 22 nt, Homo sapiens
uuucaaucucaucugauaugca

SEQ ID NO: 1447609 - RNA, 15 nt, Homo sapiens
uuucaaugaccugua

SEQ ID NO: 1447610 - RNA, 21 nt, Homo sapiens
uuucacaaaaaggcauaugca

SEQ ID NO: 1447611 - RNA, 14 nt, Homo sapiens
uuucagaauuuugu

SEQ ID NO: 1447612 - RNA, 17 nt, Homo sapiens
uuucagagccagugaag

SEQ ID NO: 1447613 - RNA, 15 nt, Homo sapiens
uuucaucuccagugu

SEQ ID NO: 1447614 - RNA, 12 nt, Homo sapiens
uuuccacaccau

SEQ ID NO: 1447615 - RNA, 14 nt, Homo sapiens
uuuccccucagagc

SEQ ID NO: 1447616 - RNA, 22 nt, Homo sapiens
uugagcuuucaugaguuuccca

SEQ ID NO: 1447617 - RNA, 20 nt, Homo sapiens
uugaggccugcccucaggga

SEQ ID NO: 1447618 - RNA, 19 nt, Homo sapiens
uugaggcggauggcuguga

SEQ ID NO: 1447619 - RNA, 14 nt, Homo sapiens
uugaguagaucugc

SEQ ID NO: 1447620 - RNA, 20 nt, Homo sapiens
uugauaguuaauuauuucaa

SEQ ID NO: 1447621 - RNA, 17 nt, Homo sapiens
uugaucaaauauuucaa

SEQ ID NO: 1447622 - RNA, 11 nt, Homo sapiens
uugauggaccc

SEQ ID NO: 1447623 - RNA, 18 nt, Homo sapiens
uugauggagcuacuuuaa

SEQ ID NO: 1447624 - RNA, 23 nt, Homo sapiens
uugauuauucugauuccacuuuu

SEQ ID NO: 1447625 - RNA, 17 nt, Homo sapiens
uugauucacaaugaaau

SEQ ID NO: 1447626 - RNA, 22 nt, Homo sapiens
uugcaaacccugguugcuguau

SEQ ID NO: 1447627 - RNA, 19 nt, Homo sapiens
uugcaagauuuaacacuaa

SEQ ID NO: 1447628 - RNA, 19 nt, Homo sapiens
uugcacauaacaugcuuua

SEQ ID NO: 1447629 - RNA, 11 nt, Homo sapiens
uugcacugugg

SEQ ID NO: 1447630 - RNA, 16 nt, Homo sapiens
uugcagauccuugaua

SEQ ID NO: 1447631 - RNA, 19 nt, Homo sapiens
uugcagcugagugaaaaau

SEQ ID NO: 1447632 - RNA, 16 nt, Homo sapiens
uugcagugagccauga

SEQ ID NO: 1447633 - RNA, 21 nt, Homo sapiens
uugccauuucucugcuuaccc

SEQ ID NO: 1447634 - RNA, 23 nt, Homo sapiens
uugcccaucauacgcaugguccu

SEQ ID NO: 1447635 - RNA, 19 nt, Homo sapiens
uugcccugaguggaucucc

SEQ ID NO: 1447636 - RNA, 19 nt, Homo sapiens
uugcccuugcccugaccuc

SEQ ID NO: 1447637 - RNA, 14 nt, Homo sapiens
uugccuaaacccua

SEQ ID NO: 1447638 - RNA, 16 nt, Homo sapiens
uugccucucucaggag

SEQ ID NO: 1447639 - RNA, 15 nt, Homo sapiens
uugcuaaaauauuau

SEQ ID NO: 1447640 - RNA, 14 nt, Homo sapiens
uugcucagugccuc

SEQ ID NO: 1447641 - RNA, 14 nt, Homo sapiens
uugcuccuugacau

SEQ ID NO: 1447642 - RNA, 15 nt, Homo sapiens
uugcuguuugcaauu

SEQ ID NO: 1447643 - RNA, 14 nt, Homo sapiens
uuggaauucuggau

SEQ ID NO: 1447644 - RNA, 18 nt, Homo sapiens
uuggacaacugacaauau

SEQ ID NO: 1447645 - RNA, 14 nt, Homo sapiens
uuggacagcugcuu

SEQ ID NO: 1447646 - RNA, 21 nt, Homo sapiens
uuggacccgcucuggaccaac

SEQ ID NO: 1447647 - RNA, 15 nt, Homo sapiens
uuggagcuacugcaa

SEQ ID NO: 1447648 - RNA, 18 nt, Homo sapiens
uuggauuauucauuuaaa

SEQ ID NO: 1447649 - RNA, 23 nt, Homo sapiens
uuggcucaggcagacaagagcug

SEQ ID NO: 1447650 - RNA, 20 nt, Homo sapiens
aagcaugcaauaaugugcaa

SEQ ID NO: 1447651 - RNA, 13 nt, Homo sapiens
aagccaggaguug

SEQ ID NO: 1447652 - RNA, 10 nt, Homo sapiens
aagcccaguu

SEQ ID NO: 1447653 - RNA, 22 nt, Homo sapiens
aagccccaccuuuaaguccucu

SEQ ID NO: 1447654 - RNA, 13 nt, Homo sapiens
aagcccuugaacc

SEQ ID NO: 1447655 - RNA, 22 nt, Homo sapiens
aagccggcucuucaaagacaau

SEQ ID NO: 1447656 - RNA, 22 nt, Homo sapiens
aagccucccuccucguccccug

SEQ ID NO: 1447657 - RNA, 15 nt, Homo sapiens
aagccuguugcugaa

SEQ ID NO: 1447658 - RNA, 18 nt, Homo sapiens
aagccuuuugcucacaaa

SEQ ID NO: 1447659 - RNA, 18 nt, Homo sapiens
aagcggagcuugcaguga

SEQ ID NO: 1447660 - RNA, 16 nt, Homo sapiens
aagcuccacugucacc

SEQ ID NO: 1447661 - RNA, 13 nt, Homo sapiens
aagcucuguguaa

SEQ ID NO: 1447662 - RNA, 19 nt, Homo sapiens
aagcugagaagaagcugag

SEQ ID NO: 1447663 - RNA, 19 nt, Homo sapiens
aagcugagacccucgccac

SEQ ID NO: 1447664 - RNA, 21 nt, Homo sapiens
aagcugaggugcccaggagaa

SEQ ID NO: 1447665 - RNA, 21 nt, Homo sapiens
aagcugagugacuguaggcag

SEQ ID NO: 1447666 - RNA, 22 nt, Homo sapiens
aagcugguaaacuauuugucuu

SEQ ID NO: 1447667 - RNA, 22 nt, Homo sapiens
aagcuguguccuugcaccugca

SEQ ID NO: 1447668 - RNA, 23 nt, Homo sapiens
aagcuguguccuugcaccugcau

SEQ ID NO: 1447669 - RNA, 14 nt, Homo sapiens
aagcuucaagugau

SEQ ID NO: 1447670 - RNA, 13 nt, Homo sapiens
aaggaagacuuga

SEQ ID NO: 1447671 - RNA, 12 nt, Homo sapiens
aaggaagcucca

SEQ ID NO: 1447672 - RNA, 18 nt, Homo sapiens
aaggaagcuccacuguca

SEQ ID NO: 1447673 - RNA, 23 nt, Homo sapiens
aaggagacucaccucugccucaa

SEQ ID NO: 1447674 - RNA, 23 nt, Homo sapiens
aaggagauauggcuaguggcaau

SEQ ID NO: 1447675 - RNA, 12 nt, Homo sapiens
aaggagccagga

SEQ ID NO: 1447676 - RNA, 23 nt, Homo sapiens
aaggagccuuucuuauggaagaa

SEQ ID NO: 1447677 - RNA, 22 nt, Homo sapiens
aaggaggacgguuaacuuguau

SEQ ID NO: 1447678 - RNA, 17 nt, Homo sapiens
aaggaguaaguacaaau

SEQ ID NO: 1447679 - RNA, 17 nt, Homo sapiens
aaggaguccuugcauca

SEQ ID NO: 1447680 - RNA, 20 nt, Homo sapiens
aaggauaucgggucacuguc

SEQ ID NO: 1447681 - RNA, 14 nt, Homo sapiens
aaggauauuuacua

SEQ ID NO: 1447682 - RNA, 14 nt, Homo sapiens
aaggcacaggugua

SEQ ID NO: 1447683 - RNA, 21 nt, Homo sapiens
aaggcaggagaaucgcuuaaa

SEQ ID NO: 1447684 - RNA, 20 nt, Homo sapiens
aaggcagugaacacacucag

SEQ ID NO: 1447685 - RNA, 15 nt, Homo sapiens
aaggccacaugucac

SEQ ID NO: 1447686 - RNA, 19 nt, Homo sapiens
aaggccacaugucaccgug

SEQ ID NO: 1447687 - RNA, 17 nt, Homo sapiens
aaggccuggggugaccc

SEQ ID NO: 1447688 - RNA, 13 nt, Homo sapiens
aaggcuccaucuc

SEQ ID NO: 1447689 - RNA, 12 nt, Homo sapiens
aaggcugaccaa

SEQ ID NO: 1447690 - RNA, 18 nt, Homo sapiens
aaggcugggcaccucuag

SEQ ID NO: 1447691 - RNA, 17 nt, Homo sapiens
aaggcuggggccagugu

SEQ ID NO: 1447692 - RNA, 14 nt, Homo sapiens
aagggaagcuguuu

SEQ ID NO: 1447693 - RNA, 21 nt, Homo sapiens
aagggauaauagacacaucaa

SEQ ID NO: 1447694 - RNA, 17 nt, Homo sapiens
aagggcaacccaccauc

SEQ ID NO: 1447695 - RNA, 23 nt, Homo sapiens
aagggcacgagagagucuuccag

SEQ ID NO: 1447696 - RNA, 9 nt, Homo sapiens
aagggccag

SEQ ID NO: 1447697 - RNA, 14 nt, Homo sapiens
aagggccagcccua

SEQ ID NO: 1447698 - RNA, 17 nt, Homo sapiens
aagggcuagaaccugga

SEQ ID NO: 1447699 - RNA, 17 nt, Homo sapiens
aaggggcaccugggaaa

SEQ ID NO: 1447700 - RNA, 18 nt, Homo sapiens
aaggggcauuacugggaa

SEQ ID NO: 1447701 - RNA, 15 nt, Homo sapiens
aagggugacauccca

SEQ ID NO: 1447702 - RNA, 18 nt, Homo sapiens
aagggugggaagcuugcu

SEQ ID NO: 1447703 - RNA, 20 nt, Homo sapiens
aaggucaauuucaguguaug

SEQ ID NO: 1447704 - RNA, 15 nt, Homo sapiens
aaggucucugaacuc

SEQ ID NO: 1447705 - RNA, 16 nt, Homo sapiens
aaggugaagagaccaa

SEQ ID NO: 1447706 - RNA, 14 nt, Homo sapiens
aaggugagugcuug

SEQ ID NO: 1447707 - RNA, 23 nt, Homo sapiens
aagguguaaaauaucuaccugcc

SEQ ID NO: 1447708 - RNA, 18 nt, Homo sapiens
aagguuaaaaaguucaua

SEQ ID NO: 1447709 - RNA, 15 nt, Homo sapiens
aagguuauaacugug

SEQ ID NO: 1447710 - RNA, 22 nt, Homo sapiens
aagguugcugaggcucugaccc

SEQ ID NO: 1447711 - RNA, 17 nt, Homo sapiens
aagguuucauguagauu

SEQ ID NO: 1447712 - RNA, 13 nt, Homo sapiens
aaguaaaaccaca

SEQ ID NO: 1447713 - RNA, 15 nt, Homo sapiens
aaguaaaaccacagc

SEQ ID NO: 1447714 - RNA, 13 nt, Homo sapiens
cauggaugcacac

SEQ ID NO: 1447715 - RNA, 22 nt, Homo sapiens
cauggaugcacgcacaugccaa

SEQ ID NO: 1447716 - RNA, 15 nt, Homo sapiens
cauggccuucccucc

SEQ ID NO: 1447717 - RNA, 22 nt, Homo sapiens
cauggggcauagaaacugagga

SEQ ID NO: 1447718 - RNA, 16 nt, Homo sapiens
caugguacuaguguuu

SEQ ID NO: 1447719 - RNA, 21 nt, Homo sapiens
cauggugacuaacaguuacau

SEQ ID NO: 1447720 - RNA, 12 nt, Homo sapiens
caugucaccuca

SEQ ID NO: 1447721 - RNA, 17 nt, Homo sapiens
caugucucaauaguaaa

SEQ ID NO: 1447722 - RNA, 13 nt, Homo sapiens
caugucucacaga

SEQ ID NO: 1447723 - RNA, 19 nt, Homo sapiens
caugugaaaauaauagcca

SEQ ID NO: 1447724 - RNA, 23 nt, Homo sapiens
cauguggaguggacauucaaaaa

SEQ ID NO: 1447725 - RNA, 20 nt, Homo sapiens
cauguguggauguguaaaug

SEQ ID NO: 1447726 - RNA, 21 nt, Homo sapiens
cauguguucucuauuuugccu

SEQ ID NO: 1447727 - RNA, 13 nt, Homo sapiens
cauuaaaagcuac

SEQ ID NO: 1447728 - RNA, 16 nt, Homo sapiens
cauuaauauuugcuga

SEQ ID NO: 1447729 - RNA, 16 nt, Homo sapiens
cauuaaucaccaaagu

SEQ ID NO: 1447730 - RNA, 15 nt, Homo sapiens
cauuaauguuaauuc

SEQ ID NO: 1447731 - RNA, 13 nt, Homo sapiens
cauuacaguuugg

SEQ ID NO: 1447732 - RNA, 14 nt, Homo sapiens
cauuacuugcacaa

SEQ ID NO: 1447733 - RNA, 15 nt, Homo sapiens
cauuacuugcacaag

SEQ ID NO: 1447734 - RNA, 14 nt, Homo sapiens
cauuagaaacugaa

SEQ ID NO: 1447735 - RNA, 13 nt, Homo sapiens
cauuagagugaga

SEQ ID NO: 1447736 - RNA, 23 nt, Homo sapiens
cauuagcauucugguuuugacau

SEQ ID NO: 1447737 - RNA, 15 nt, Homo sapiens
cauuagucacuuuga

SEQ ID NO: 1447738 - RNA, 15 nt, Homo sapiens
cauuauacauuugau

SEQ ID NO: 1447739 - RNA, 16 nt, Homo sapiens
cauuauguacaauaca

SEQ ID NO: 1447740 - RNA, 17 nt, Homo sapiens
cauuauuaaauguuucu

SEQ ID NO: 1447741 - RNA, 22 nt, Homo sapiens
cauucaaaacaaccauccugcu

SEQ ID NO: 1447742 - RNA, 11 nt, Homo sapiens
cauucaaagaa

SEQ ID NO: 1447743 - RNA, 19 nt, Homo sapiens
cauucacauuugauguaca

SEQ ID NO: 1447744 - RNA, 16 nt, Homo sapiens
cauucagaccagugaa

SEQ ID NO: 1447745 - RNA, 18 nt, Homo sapiens
cauuccaaagaacagccu

SEQ ID NO: 1447746 - RNA, 23 nt, Homo sapiens
cauuccuguagucaaaaucuggu

SEQ ID NO: 1447747 - RNA, 11 nt, Homo sapiens
cauucugacca

SEQ ID NO: 1447748 - RNA, 22 nt, Homo sapiens
cauucuuaaaggaaaagucaac

SEQ ID NO: 1447749 - RNA, 23 nt, Homo sapiens
cauugcaacaagguuaccucuau

SEQ ID NO: 1447750 - RNA, 17 nt, Homo sapiens
cauugccuccaccucuc

SEQ ID NO: 1447751 - RNA, 14 nt, Homo sapiens
cauugccuugccaa

SEQ ID NO: 1447752 - RNA, 17 nt, Homo sapiens
cauugcuucugcuaaau

SEQ ID NO: 1447753 - RNA, 19 nt, Homo sapiens
cauuggguuguagccaaag

SEQ ID NO: 1447754 - RNA, 13 nt, Homo sapiens
cauuguaugugcu

SEQ ID NO: 1447755 - RNA, 22 nt, Homo sapiens
cauuuaccucgaggcucuucca

SEQ ID NO: 1447756 - RNA, 20 nt, Homo sapiens
cagaggagggcgugacucac

SEQ ID NO: 1447757 - RNA, 19 nt, Homo sapiens
cagaggggugcugcuccua

SEQ ID NO: 1447758 - RNA, 17 nt, Homo sapiens
cagaggguagggcagca

SEQ ID NO: 1447759 - RNA, 20 nt, Homo sapiens
cagagguggcugcugugcua

SEQ ID NO: 1447760 - RNA, 23 nt, Homo sapiens
cagagguggcugcugugcuagug

SEQ ID NO: 1447761 - RNA, 17 nt, Homo sapiens
cagagugaaaugccauu

SEQ ID NO: 1447762 - RNA, 15 nt, Homo sapiens
cagaguucugcucua

SEQ ID NO: 1447763 - RNA, 15 nt, Homo sapiens
cagaguugcuuuaaa

SEQ ID NO: 1447764 - RNA, 17 nt, Homo sapiens
cagaguuguacacugug

SEQ ID NO: 1447765 - RNA, 18 nt, Homo sapiens
cagaguuguacacugugu

SEQ ID NO: 1447766 - RNA, 21 nt, Homo sapiens
cagauaacaaccccggacaaa

SEQ ID NO: 1447767 - RNA, 16 nt, Homo sapiens
cagauauacacaugga

SEQ ID NO: 1447768 - RNA, 20 nt, Homo sapiens
cagauaugcacacacaugga

SEQ ID NO: 1447769 - RNA, 19 nt, Homo sapiens
cagauauuaaauaacagug

SEQ ID NO: 1447770 - RNA, 18 nt, Homo sapiens
cagaucccauccaucagc

SEQ ID NO: 1447771 - RNA, 14 nt, Homo sapiens
cagauccucacaac

SEQ ID NO: 1447772 - RNA, 22 nt, Homo sapiens
cagauccucugcugacuccaua

SEQ ID NO: 1447773 - RNA, 16 nt, Homo sapiens
cagaucugaacacagu

SEQ ID NO: 1447774 - RNA, 16 nt, Homo sapiens
cagaugccuuccuguc

SEQ ID NO: 1447775 - RNA, 22 nt, Homo sapiens
cagaugcuggggagaaugaaga

SEQ ID NO: 1447776 - RNA, 17 nt, Homo sapiens
cagauggaaagaaagca

SEQ ID NO: 1447777 - RNA, 17 nt, Homo sapiens
cagauguaaaugccaca

SEQ ID NO: 1447778 - RNA, 21 nt, Homo sapiens
cagcacugccggcccagugac

SEQ ID NO: 1447779 - RNA, 16 nt, Homo sapiens
cagcacuuguguuguc

SEQ ID NO: 1447780 - RNA, 18 nt, Homo sapiens
cagcacuuguguugucug

SEQ ID NO: 1447781 - RNA, 16 nt, Homo sapiens
cagcagaaaaucuuuu

SEQ ID NO: 1447782 - RNA, 16 nt, Homo sapiens
cagcagcccuaaggau

SEQ ID NO: 1447783 - RNA, 12 nt, Homo sapiens
cagcagcugaac

SEQ ID NO: 1447784 - RNA, 21 nt, Homo sapiens
cagcaguugaaaagacuccaa

SEQ ID NO: 1447785 - RNA, 22 nt, Homo sapiens
cagcauaccuuuauugugaucu

SEQ ID NO: 1447786 - RNA, 14 nt, Homo sapiens
cagcauucaggggu

SEQ ID NO: 1447787 - RNA, 17 nt, Homo sapiens
cagccaacaaacauaga

SEQ ID NO: 1447788 - RNA, 14 nt, Homo sapiens
cagccacacuucuc

SEQ ID NO: 1447789 - RNA, 17 nt, Homo sapiens
cagccagguuagccuuu

SEQ ID NO: 1447790 - RNA, 21 nt, Homo sapiens
cagccccagcugacaccugga

SEQ ID NO: 1447791 - RNA, 21 nt, Homo sapiens
cagccccggcugacaccugga

SEQ ID NO: 1447792 - RNA, 13 nt, Homo sapiens
cagcccuauggau

SEQ ID NO: 1447793 - RNA, 16 nt, Homo sapiens
cagcccugacuggugc

SEQ ID NO: 1447794 - RNA, 22 nt, Homo sapiens
cagccgccuggagaugacuuga

SEQ ID NO: 1447795 - RNA, 20 nt, Homo sapiens
cagccucagaaaccagacuc

SEQ ID NO: 1447796 - RNA, 22 nt, Homo sapiens
cagccuccccacauauggcaca

SEQ ID NO: 1447797 - RNA, 20 nt, Homo sapiens
cagccuccccaccuucuuca

SEQ ID NO: 1447798 - RNA, 18 nt, Homo sapiens
cagccuccgccauuccaa

SEQ ID NO: 1447799 - RNA, 19 nt, Homo sapiens
cagccuccucaguagcuag

SEQ ID NO: 1447800 - RNA, 16 nt, Homo sapiens
cagccuccuccugacc

SEQ ID NO: 1447801 - RNA, 20 nt, Homo sapiens
cagccugguuuucacauaca

SEQ ID NO: 1447802 - RNA, 22 nt, Homo sapiens
cagccuugcaucaagggcuuua

SEQ ID NO: 1447803 - RNA, 23 nt, Homo sapiens
caggcauuugaggcugucgugag

SEQ ID NO: 1447804 - RNA, 18 nt, Homo sapiens
caggccagaaaacauaug

SEQ ID NO: 1447805 - RNA, 14 nt, Homo sapiens
caggccaggccacc

SEQ ID NO: 1447806 - RNA, 14 nt, Homo sapiens
caggcccaagagau

SEQ ID NO: 1447807 - RNA, 17 nt, Homo sapiens
caggccgccugccauac

SEQ ID NO: 1447808 - RNA, 16 nt, Homo sapiens
caggccggguggccaa

SEQ ID NO: 1447809 - RNA, 17 nt, Homo sapiens
caggcuacugucagcuc

SEQ ID NO: 1447810 - RNA, 13 nt, Homo sapiens
caggcucugggaa

SEQ ID NO: 1447811 - RNA, 17 nt, Homo sapiens
caggcuggagugcagua

SEQ ID NO: 1447812 - RNA, 23 nt, Homo sapiens
caggcuugccaccggggaaccca

SEQ ID NO: 1447813 - RNA, 16 nt, Homo sapiens
cagggaauugauucaa

SEQ ID NO: 1447814 - RNA, 23 nt, Homo sapiens
cagggagcaacucuccacuccau

SEQ ID NO: 1447815 - RNA, 16 nt, Homo sapiens
cagggaggaugccaca

SEQ ID NO: 1447816 - RNA, 17 nt, Homo sapiens
cagggaugccaacaccu

SEQ ID NO: 1447817 - RNA, 22 nt, Homo sapiens
cagggcaaaugacaugcacuga

SEQ ID NO: 1447818 - RNA, 23 nt, Homo sapiens
cagggcaaaugacaugcacugac

SEQ ID NO: 1447819 - RNA, 18 nt, Homo sapiens
cagggcaggcuugccacc

SEQ ID NO: 1447820 - RNA, 14 nt, Homo sapiens
cagggccucaaagu

SEQ ID NO: 1447821 - RNA, 14 nt, Homo sapiens
cagggccugucuca

SEQ ID NO: 1447822 - RNA, 20 nt, Homo sapiens
caggggugcuaugacaugca

SEQ ID NO: 1447823 - RNA, 19 nt, Homo sapiens
caggguaucccagaccccu

SEQ ID NO: 1447824 - RNA, 19 nt, Homo sapiens
cagggucuaccucugucac

SEQ ID NO: 1447825 - RNA, 13 nt, Homo sapiens
cagggucuugcaa

SEQ ID NO: 1447826 - RNA, 16 nt, Homo sapiens
cagggucuugcuguaa

SEQ ID NO: 1447827 - RNA, 21 nt, Homo sapiens
caggguucugaggcaaauggc

SEQ ID NO: 1447828 - RNA, 20 nt, Homo sapiens
caggguugaucacacucugg

SEQ ID NO: 1447829 - RNA, 21 nt, Homo sapiens
cagguacugauccuguuucuu

SEQ ID NO: 1447830 - RNA, 17 nt, Homo sapiens
cagguagggccagcuca

SEQ ID NO: 1447831 - RNA, 13 nt, Homo sapiens
cagguaguacugg

SEQ ID NO: 1447832 - RNA, 21 nt, Homo sapiens
cagguauuuuaacugugugaa

SEQ ID NO: 1447833 - RNA, 19 nt, Homo sapiens
caggucauuauuuuuuaca

SEQ ID NO: 1447834 - RNA, 14 nt, Homo sapiens
caggugaauggagg

SEQ ID NO: 1447835 - RNA, 17 nt, Homo sapiens
caguaaacuuucucugc

SEQ ID NO: 1447836 - RNA, 19 nt, Homo sapiens
caguaaacuuucucugcaa

SEQ ID NO: 1447837 - RNA, 14 nt, Homo sapiens
caguaaauccacag

SEQ ID NO: 1447838 - RNA, 21 nt, Homo sapiens
caguaacauuuggagugugua

SEQ ID NO: 1447839 - RNA, 13 nt, Homo sapiens
caguacaugggaa

SEQ ID NO: 1447840 - RNA, 13 nt, Homo sapiens
caguaggcuuuau

SEQ ID NO: 1447841 - RNA, 12 nt, Homo sapiens
caguaguauucu

SEQ ID NO: 1447842 - RNA, 12 nt, Homo sapiens
caguagugcauu

SEQ ID NO: 1447843 - RNA, 21 nt, Homo sapiens
caguauaggccaucaauauca

SEQ ID NO: 1447844 - RNA, 17 nt, Homo sapiens
caguauauuuauaguca

SEQ ID NO: 1447845 - RNA, 20 nt, Homo sapiens
caguauauuuauagucacaa

SEQ ID NO: 1447846 - RNA, 13 nt, Homo sapiens
caguauuccaugg

SEQ ID NO: 1447847 - RNA, 17 nt, Homo sapiens
caguauucuugucaaaa

SEQ ID NO: 1447848 - RNA, 19 nt, Homo sapiens
caguauuuguacaaauacu

SEQ ID NO: 1447849 - RNA, 13 nt, Homo sapiens
cauacacauugga

SEQ ID NO: 1447850 - RNA, 21 nt, Homo sapiens
cauacagagguaacuaucaau

SEQ ID NO: 1447851 - RNA, 15 nt, Homo sapiens
cauacauacauacau

SEQ ID NO: 1447852 - RNA, 18 nt, Homo sapiens
cauacauacauacauaua

SEQ ID NO: 1447853 - RNA, 21 nt, Homo sapiens
cauacaugacucagcauaccu

SEQ ID NO: 1447854 - RNA, 15 nt, Homo sapiens
cauaccucugaccaa

SEQ ID NO: 1447855 - RNA, 15 nt, Homo sapiens
cauacgcaugguccu

SEQ ID NO: 1447856 - RNA, 15 nt, Homo sapiens
cauacgugucugugu

SEQ ID NO: 1447857 - RNA, 22 nt, Homo sapiens
cauacguguuaggaggcugcau

SEQ ID NO: 1447858 - RNA, 20 nt, Homo sapiens
cauacuuggacaguuaggga

SEQ ID NO: 1447859 - RNA, 15 nt, Homo sapiens
cauacuuucccacag

SEQ ID NO: 1447860 - RNA, 19 nt, Homo sapiens
cauacuuucccacagcacu

SEQ ID NO: 1447861 - RNA, 19 nt, Homo sapiens
cauagagaagaucuaauac

SEQ ID NO: 1447862 - RNA, 22 nt, Homo sapiens
cauagcauuagcugcuuccucc

SEQ ID NO: 1447863 - RNA, 19 nt, Homo sapiens
cauaguuauuuacuugaaa

SEQ ID NO: 1447864 - RNA, 19 nt, Homo sapiens
cauauauauucuacauaua

SEQ ID NO: 1447865 - RNA, 18 nt, Homo sapiens
cauauauauugaaaugca

SEQ ID NO: 1447866 - RNA, 21 nt, Homo sapiens
cauauauguauauauaugcac

SEQ ID NO: 1447867 - RNA, 22 nt, Homo sapiens
cauaucacguacaccauaugca

SEQ ID NO: 1447868 - RNA, 20 nt, Homo sapiens
cauaucuccuuccccuacac

SEQ ID NO: 1447869 - RNA, 22 nt, Homo sapiens
cauauguauuuugucauaugua

SEQ ID NO: 1447870 - RNA, 22 nt, Homo sapiens
cauauguauuuuugucauagca

SEQ ID NO: 1447871 - RNA, 19 nt, Homo sapiens
cauauucuuuaaauuucau

SEQ ID NO: 1447872 - RNA, 23 nt, Homo sapiens
cauauucuuuaaauuucaucuca

SEQ ID NO: 1447873 - RNA, 20 nt, Homo sapiens
caucaaauauuaccaaaaaa

SEQ ID NO: 1447874 - RNA, 21 nt, Homo sapiens
caucaagaugagagaacugga

SEQ ID NO: 1447875 - RNA, 21 nt, Homo sapiens
caucaauuuuuauacauauca

SEQ ID NO: 1447876 - RNA, 22 nt, Homo sapiens
caucagacagguaaaugggcag

SEQ ID NO: 1447877 - RNA, 18 nt, Homo sapiens
caucagacuccugugcaa

SEQ ID NO: 1447878 - RNA, 17 nt, Homo sapiens
caucagagugacaucca

SEQ ID NO: 1447879 - RNA, 15 nt, Homo sapiens
caucagcauaccuuu

SEQ ID NO: 1447880 - RNA, 20 nt, Homo sapiens
caucagcuugcccuguuaaa

SEQ ID NO: 1447881 - RNA, 15 nt, Homo sapiens
caucaggguuugcaa

SEQ ID NO: 1447882 - RNA, 21 nt, Homo sapiens
caucaguguccucuugcucaa

SEQ ID NO: 1447883 - RNA, 22 nt, Homo sapiens
caucaguguccucuugcucaaa

SEQ ID NO: 1447884 - RNA, 19 nt, Homo sapiens
cauccaacuccuggagauu

SEQ ID NO: 1447885 - RNA, 22 nt, Homo sapiens
cauccaaugcauaguuuguuca

SEQ ID NO: 1447886 - RNA, 14 nt, Homo sapiens
caucccaagccaga

SEQ ID NO: 1447887 - RNA, 22 nt, Homo sapiens
caucccacaugaucuugagauu

SEQ ID NO: 1447888 - RNA, 16 nt, Homo sapiens
cauccccagcgauucc

SEQ ID NO: 1447889 - RNA, 16 nt, Homo sapiens
caucccccagcacuga

SEQ ID NO: 1447890 - RNA, 16 nt, Homo sapiens
caucccuacuuuucaa

SEQ ID NO: 1447891 - RNA, 14 nt, Homo sapiens
cauccuccuucuuc

SEQ ID NO: 1447892 - RNA, 20 nt, Homo sapiens
auauacauauguagacuaua

SEQ ID NO: 1447893 - RNA, 21 nt, Homo sapiens
auauaucuaugucuauaucau

SEQ ID NO: 1447894 - RNA, 19 nt, Homo sapiens
auauauguguauauauaca

SEQ ID NO: 1447895 - RNA, 14 nt, Homo sapiens
auauauugcugcug

SEQ ID NO: 1447896 - RNA, 15 nt, Homo sapiens
auaucaagauguuaa

SEQ ID NO: 1447897 - RNA, 22 nt, Homo sapiens
auaucaauuaauuugaaaacau

SEQ ID NO: 1447898 - RNA, 14 nt, Homo sapiens
auaucaccucucuu

SEQ ID NO: 1447899 - RNA, 14 nt, Homo sapiens
auaucagagcucuu

SEQ ID NO: 1447900 - RNA, 14 nt, Homo sapiens
auaucaucagcaua

SEQ ID NO: 1447901 - RNA, 16 nt, Homo sapiens
auaucaucagcauacc

SEQ ID NO: 1447902 - RNA, 18 nt, Homo sapiens
auaucaucagcauaccuu

SEQ ID NO: 1447903 - RNA, 22 nt, Homo sapiens
auaucaugcuuuaaaguguaau

SEQ ID NO: 1447904 - RNA, 16 nt, Homo sapiens
auauccagcugaguga

SEQ ID NO: 1447905 - RNA, 20 nt, Homo sapiens
auauccccucaaaauccaag

SEQ ID NO: 1447906 - RNA, 20 nt, Homo sapiens
auauccuggcccccugggcu

SEQ ID NO: 1447907 - RNA, 21 nt, Homo sapiens
auaucuaccugcccucucuca

SEQ ID NO: 1447908 - RNA, 18 nt, Homo sapiens
auaucuauaguagucaau

SEQ ID NO: 1447909 - RNA, 21 nt, Homo sapiens
auaucugaacacauacuagaa

SEQ ID NO: 1447910 - RNA, 13 nt, Homo sapiens
auaugaguauaca

SEQ ID NO: 1447911 - RNA, 14 nt, Homo sapiens
auaugaguauacaa

SEQ ID NO: 1447912 - RNA, 18 nt, Homo sapiens
auaugauuuuuauccaug

SEQ ID NO: 1447913 - RNA, 14 nt, Homo sapiens
auaugcaaagcacu

SEQ ID NO: 1447914 - RNA, 17 nt, Homo sapiens
auaugcaauauuuacau

SEQ ID NO: 1447915 - RNA, 16 nt, Homo sapiens
auaugcacacaccgau

SEQ ID NO: 1447916 - RNA, 16 nt, Homo sapiens
auaugcuuuacaaucu

SEQ ID NO: 1447917 - RNA, 14 nt, Homo sapiens
auauggaggccuca

SEQ ID NO: 1447918 - RNA, 16 nt, Homo sapiens
auaugggcucaaguca

SEQ ID NO: 1447919 - RNA, 14 nt, Homo sapiens
auauguauauacau

SEQ ID NO: 1447920 - RNA, 22 nt, Homo sapiens
auauguauuuugucauauguau

SEQ ID NO: 1447921 - RNA, 18 nt, Homo sapiens
auauguauuuuugucaua

SEQ ID NO: 1447922 - RNA, 22 nt, Homo sapiens
auaugucugcuucuguccagga

SEQ ID NO: 1447923 - RNA, 21 nt, Homo sapiens
auauguguauauauacauaca

SEQ ID NO: 1447924 - RNA, 20 nt, Homo sapiens
auauucaaggaucucaaaga

SEQ ID NO: 1447925 - RNA, 13 nt, Homo sapiens
auauuccugcauu

SEQ ID NO: 1447926 - RNA, 21 nt, Homo sapiens
auauuccugcauuugugaaau

SEQ ID NO: 1447927 - RNA, 21 nt, Homo sapiens
auauucuacauauauguauau

SEQ ID NO: 1447928 - RNA, 19 nt, Homo sapiens
auauugauaaaaccauaca

SEQ ID NO: 1447929 - RNA, 21 nt, Homo sapiens
auauuguggguaacgugagaa

SEQ ID NO: 1447930 - RNA, 15 nt, Homo sapiens
auauuuauagcaauc

SEQ ID NO: 1447931 - RNA, 19 nt, Homo sapiens
auauuuauggggggagaac

SEQ ID NO: 1447932 - RNA, 14 nt, Homo sapiens
auauuuccauucau

SEQ ID NO: 1447933 - RNA, 20 nt, Homo sapiens
auauuucccaauacauacca

SEQ ID NO: 1447934 - RNA, 19 nt, Homo sapiens
auauuugaaucuuucuuac

SEQ ID NO: 1447935 - RNA, 14 nt, Homo sapiens
auauuuuagaugca

SEQ ID NO: 1447936 - RNA, 23 nt, Homo sapiens
auauuuucuggguuaaaacccca

SEQ ID NO: 1447937 - RNA, 13 nt, Homo sapiens
aucaaaacauauc

SEQ ID NO: 1447938 - RNA, 14 nt, Homo sapiens
aucaaaacauauca

SEQ ID NO: 1447939 - RNA, 15 nt, Homo sapiens
aucaaaacauaucaa

SEQ ID NO: 1447940 - RNA, 21 nt, Homo sapiens
aucaaagacauggaauuaccu

SEQ ID NO: 1447941 - RNA, 19 nt, Homo sapiens
aucaaaguuccuguucacc

SEQ ID NO: 1447942 - RNA, 20 nt, Homo sapiens
aucaaauaugcaaagcacug

SEQ ID NO: 1447943 - RNA, 17 nt, Homo sapiens
aucaaaucagucuugga

SEQ ID NO: 1447944 - RNA, 14 nt, Homo sapiens
aucaaauugcuaca

SEQ ID NO: 1447945 - RNA, 22 nt, Homo sapiens
aucaaauugcuacauaguccaa

SEQ ID NO: 1447946 - RNA, 18 nt, Homo sapiens
aucaaauuugccaccacu

SEQ ID NO: 1447947 - RNA, 22 nt, Homo sapiens
aucaacauucccccaacauuac

SEQ ID NO: 1447948 - RNA, 15 nt, Homo sapiens
aucaagaauauucaa

SEQ ID NO: 1447949 - RNA, 13 nt, Homo sapiens
aucaagcuguaca

SEQ ID NO: 1447950 - RNA, 23 nt, Homo sapiens
aucaauccuucuuauguuugcuu

SEQ ID NO: 1447951 - RNA, 18 nt, Homo sapiens
aucaauuauuacauuuau

SEQ ID NO: 1447952 - RNA, 17 nt, Homo sapiens
aucaauuuguaauugcu

SEQ ID NO: 1447953 - RNA, 16 nt, Homo sapiens
aucaauuuuuauacau

SEQ ID NO: 1447954 - RNA, 11 nt, Homo sapiens
aucacaacauu

SEQ ID NO: 1447955 - RNA, 15 nt, Homo sapiens
aucacaccucugggc

SEQ ID NO: 1447956 - RNA, 16 nt, Homo sapiens
aucacaccucugggcu

SEQ ID NO: 1447957 - RNA, 19 nt, Homo sapiens
aucaccagcagacacugcc

SEQ ID NO: 1447958 - RNA, 20 nt, Homo sapiens
aucaccagcagacacugccg

SEQ ID NO: 1447959 - RNA, 17 nt, Homo sapiens
aucacgcagaucacuaa

SEQ ID NO: 1447960 - RNA, 16 nt, Homo sapiens
aucagaaaugucauca

SEQ ID NO: 1447961 - RNA, 14 nt, Homo sapiens
aucagacucaucua

SEQ ID NO: 1447962 - RNA, 18 nt, Homo sapiens
aucagacuccugugcaac

SEQ ID NO: 1447963 - RNA, 12 nt, Homo sapiens
aucagcacugaa

SEQ ID NO: 1447964 - RNA, 23 nt, Homo sapiens
aucagcacugccggcccagugac

SEQ ID NO: 1447965 - RNA, 20 nt, Homo sapiens
aucagccacaccuuuuccag

SEQ ID NO: 1447966 - RNA, 22 nt, Homo sapiens
aucagccucacugagcuaauaa

SEQ ID NO: 1447967 - RNA, 21 nt, Homo sapiens
aucagccuccgccauuccaag

SEQ ID NO: 1447968 - RNA, 15 nt, Homo sapiens
aucagcgcccuggag

SEQ ID NO: 1447969 - RNA, 22 nt, Homo sapiens
aucagugcacacggaugcacag

SEQ ID NO: 1447970 - RNA, 13 nt, Homo sapiens
aucagugcaguga

SEQ ID NO: 1447971 - RNA, 14 nt, Homo sapiens
aucagugcagugau

SEQ ID NO: 1447972 - RNA, 19 nt, Homo sapiens
aucaguggacaaggggaga

SEQ ID NO: 1447973 - RNA, 20 nt, Homo sapiens
aucaguguccucuugcucaa

SEQ ID NO: 1447974 - RNA, 19 nt, Homo sapiens
aucauaaccaugugaaaag

SEQ ID NO: 1447975 - RNA, 21 nt, Homo sapiens
aucauacaugacucagcauac

SEQ ID NO: 1447976 - RNA, 22 nt, Homo sapiens
aauugucaauaccccuguuaag

SEQ ID NO: 1447977 - RNA, 17 nt, Homo sapiens
aauugugcgacuucaca

SEQ ID NO: 1447978 - RNA, 15 nt, Homo sapiens
aauuuaaaaucauuc

SEQ ID NO: 1447979 - RNA, 13 nt, Homo sapiens
aauuuaaccuacu

SEQ ID NO: 1447980 - RNA, 18 nt, Homo sapiens
aauuuauacacacaaaaa

SEQ ID NO: 1447981 - RNA, 15 nt, Homo sapiens
aauuuauuucaaaaa

SEQ ID NO: 1447982 - RNA, 23 nt, Homo sapiens
aauuucacauuaauauuugcuga

SEQ ID NO: 1447983 - RNA, 20 nt, Homo sapiens
aauuucauaccuaucaucuu

SEQ ID NO: 1447984 - RNA, 21 nt, Homo sapiens
aauuucauaccuaucaucuua

SEQ ID NO: 1447985 - RNA, 15 nt, Homo sapiens
aauuugccaccacua

SEQ ID NO: 1447986 - RNA, 18 nt, Homo sapiens
aauuuguuuuauauucuc

SEQ ID NO: 1447987 - RNA, 19 nt, Homo sapiens
aauuuguuuuauauucucu

SEQ ID NO: 1447988 - RNA, 14 nt, Homo sapiens
aauuuuaaauguuc

SEQ ID NO: 1447989 - RNA, 14 nt, Homo sapiens
aauuuuaacauuuu

SEQ ID NO: 1447990 - RNA, 17 nt, Homo sapiens
aauuuucaagagaagaa

SEQ ID NO: 1447991 - RNA, 20 nt, Homo sapiens
aauuuuccagggcucaaaaa

SEQ ID NO: 1447992 - RNA, 14 nt, Homo sapiens
aauuuugcauugug

SEQ ID NO: 1447993 - RNA, 11 nt, Homo sapiens
aauuuuuccau

SEQ ID NO: 1447994 - RNA, 21 nt, Homo sapiens
acaaaaauguaaugaucauaa

SEQ ID NO: 1447995 - RNA, 12 nt, Homo sapiens
acaaaauaauuu

SEQ ID NO: 1447996 - RNA, 13 nt, Homo sapiens
acaaaauaauuua

SEQ ID NO: 1447997 - RNA, 12 nt, Homo sapiens
acaaaaugcaag

SEQ ID NO: 1447998 - RNA, 23 nt, Homo sapiens
acaaaauuagcugaagaaguuau

SEQ ID NO: 1447999 - RNA, 14 nt, Homo sapiens
acaaacaagcacag

SEQ ID NO: 1448000 - RNA, 14 nt, Homo sapiens
acaaacaaugccau

SEQ ID NO: 1448001 - RNA, 14 nt, Homo sapiens
acaaaccacuguac

SEQ ID NO: 1448002 - RNA, 17 nt, Homo sapiens
acaaaccacuguacaua

SEQ ID NO: 1448003 - RNA, 23 nt, Homo sapiens
acaaagagucuugguuccucuac

SEQ ID NO: 1448004 - RNA, 23 nt, Homo sapiens
acaaagcugaagaaaaugaagcc

SEQ ID NO: 1448005 - RNA, 14 nt, Homo sapiens
acaaaggugaaaau

SEQ ID NO: 1448006 - RNA, 19 nt, Homo sapiens
acaaaguaguugucccuuu

SEQ ID NO: 1448007 - RNA, 13 nt, Homo sapiens
acaaauacuacag

SEQ ID NO: 1448008 - RNA, 20 nt, Homo sapiens
acaaauacugccuaguguau

SEQ ID NO: 1448009 - RNA, 17 nt, Homo sapiens
acaaauuauguuacauc

SEQ ID NO: 1448010 - RNA, 21 nt, Homo sapiens
acaaauucuuuuucacacuga

SEQ ID NO: 1448011 - RNA, 19 nt, Homo sapiens
acaaauuuuuuucuuguuu

SEQ ID NO: 1448012 - RNA, 13 nt, Homo sapiens
acaacaaaccaaa

SEQ ID NO: 1448013 - RNA, 14 nt, Homo sapiens
acaacauuuacuua

SEQ ID NO: 1448014 - RNA, 19 nt, Homo sapiens
acaaccaauuccaaguuuu

SEQ ID NO: 1448015 - RNA, 16 nt, Homo sapiens
acaaccuccgugcugg

SEQ ID NO: 1448016 - RNA, 19 nt, Homo sapiens
acaagagcugcuguccuuu

SEQ ID NO: 1448017 - RNA, 17 nt, Homo sapiens
acaagauaacugagaau

SEQ ID NO: 1448018 - RNA, 11 nt, Homo sapiens
acaagauuccc

SEQ ID NO: 1448019 - RNA, 12 nt, Homo sapiens
acaagcaaugga

SEQ ID NO: 1448020 - RNA, 14 nt, Homo sapiens
acaagcauuugccc

SEQ ID NO: 1448021 - RNA, 18 nt, Homo sapiens
acaaggcugaccaagaga

SEQ ID NO: 1448022 - RNA, 20 nt, Homo sapiens
acaagguucccucugagaau

SEQ ID NO: 1448023 - RNA, 14 nt, Homo sapiens
acaaguuucccaaa

SEQ ID NO: 1448024 - RNA, 21 nt, Homo sapiens
acaauaaauauucugcaugga

SEQ ID NO: 1448025 - RNA, 18 nt, Homo sapiens
acaauaaggucaaugcca

SEQ ID NO: 1448026 - RNA, 16 nt, Homo sapiens
acaauacgugaaagau

SEQ ID NO: 1448027 - RNA, 13 nt, Homo sapiens
acaauaucuucau

SEQ ID NO: 1448028 - RNA, 22 nt, Homo sapiens
acaaucaugagucagacauuug

SEQ ID NO: 1448029 - RNA, 21 nt, Homo sapiens
acaauccccacauaccaucug

SEQ ID NO: 1448030 - RNA, 12 nt, Homo sapiens
acaaucugggac

SEQ ID NO: 1448031 - RNA, 22 nt, Homo sapiens
acaaucuuuccuugucucucau

SEQ ID NO: 1448032 - RNA, 16 nt, Homo sapiens
acaaugccaucacugg

SEQ ID NO: 1448033 - RNA, 17 nt, Homo sapiens
acaaugccaucacugga

SEQ ID NO: 1448034 - RNA, 17 nt, Homo sapiens
acaaugccuugggagag

SEQ ID NO: 1448035 - RNA, 17 nt, Homo sapiens
acaauggagugggagau

SEQ ID NO: 1448036 - RNA, 21 nt, Homo sapiens
acaauggcuaauucccagagu

SEQ ID NO: 1448037 - RNA, 23 nt, Homo sapiens
acaauguaugugaaaguguaaaa

SEQ ID NO: 1448038 - RNA, 23 nt, Homo sapiens
acaauugggagauuaucuuucaa

SEQ ID NO: 1448039 - RNA, 23 nt, Homo sapiens
acaauuugagcaauucauuucac

SEQ ID NO: 1448040 - RNA, 15 nt, Homo sapiens
acacaaaagccaaaa

SEQ ID NO: 1448041 - RNA, 13 nt, Homo sapiens
acacaacuaggaa

SEQ ID NO: 1448042 - RNA, 19 nt, Homo sapiens
acacaagccacagaagcca

SEQ ID NO: 1448043 - RNA, 17 nt, Homo sapiens
acagcuuaacauuuaca

SEQ ID NO: 1448044 - RNA, 19 nt, Homo sapiens
acagcuucuucaucuuuaa

SEQ ID NO: 1448045 - RNA, 18 nt, Homo sapiens
acaggacuaacacucaga

SEQ ID NO: 1448046 - RNA, 18 nt, Homo sapiens
acaggaggaaucauguca

SEQ ID NO: 1448047 - RNA, 22 nt, Homo sapiens
acaggaggggcccacaauggag

SEQ ID NO: 1448048 - RNA, 14 nt, Homo sapiens
acaggcaagugaag

SEQ ID NO: 1448049 - RNA, 16 nt, Homo sapiens
acaggccauccauuca

SEQ ID NO: 1448050 - RNA, 23 nt, Homo sapiens
acaggcccggcccagccuaggcc

SEQ ID NO: 1448051 - RNA, 23 nt, Homo sapiens
acaggcccuugggguucccccag

SEQ ID NO: 1448052 - RNA, 19 nt, Homo sapiens
acaggcuguucugcacuga

SEQ ID NO: 1448053 - RNA, 21 nt, Homo sapiens
acaggcuguucugcacugaaa

SEQ ID NO: 1448054 - RNA, 20 nt, Homo sapiens
acagggaacaagcauucucc

SEQ ID NO: 1448055 - RNA, 15 nt, Homo sapiens
acagggcauggccag

SEQ ID NO: 1448056 - RNA, 15 nt, Homo sapiens
acaggggaucaaagu

SEQ ID NO: 1448057 - RNA, 14 nt, Homo sapiens
acagguaaccacaa

SEQ ID NO: 1448058 - RNA, 14 nt, Homo sapiens
acaguaacugccau

SEQ ID NO: 1448059 - RNA, 22 nt, Homo sapiens
agaauaaaugaaucuuacuccu

SEQ ID NO: 1448060 - RNA, 12 nt, Homo sapiens
agaauaaugugu

SEQ ID NO: 1448061 - RNA, 17 nt, Homo sapiens
agaauauuuacaauaaa

SEQ ID NO: 1448062 - RNA, 18 nt, Homo sapiens
agaaucaaauugcuacau

SEQ ID NO: 1448063 - RNA, 19 nt, Homo sapiens
agaaucgcuuaaacccagg

SEQ ID NO: 1448064 - RNA, 15 nt, Homo sapiens
agaaugaagacuguu

SEQ ID NO: 1448065 - RNA, 20 nt, Homo sapiens
agaaugcaagaguggacuga

SEQ ID NO: 1448066 - RNA, 16 nt, Homo sapiens
agaaugcccaacucuu

SEQ ID NO: 1448067 - RNA, 22 nt, Homo sapiens
agaauggaugugcucacugggg

SEQ ID NO: 1448068 - RNA, 21 nt, Homo sapiens
agaauguuacuuuggaaugac

SEQ ID NO: 1448069 - RNA, 16 nt, Homo sapiens
agaauucacaccuuag

SEQ ID NO: 1448070 - RNA, 14 nt, Homo sapiens
agaauuguaucauu

SEQ ID NO: 1448071 - RNA, 13 nt, Homo sapiens
agaauuuuccuaa

SEQ ID NO: 1448072 - RNA, 19 nt, Homo sapiens
agacaaaaucuuaaaugcc

SEQ ID NO: 1448073 - RNA, 15 nt, Homo sapiens
agacaaaccacugua

SEQ ID NO: 1448074 - RNA, 13 nt, Homo sapiens
agacaaaguucaa

SEQ ID NO: 1448075 - RNA, 19 nt, Homo sapiens
agagauggaauaaagcccu

SEQ ID NO: 1448076 - RNA, 21 nt, Homo sapiens
agagauggaauaaagcccuug

SEQ ID NO: 1448077 - RNA, 23 nt, Homo sapiens
agagauggaauaaagcccuugaa

SEQ ID NO: 1448078 - RNA, 14 nt, Homo sapiens
agagcagcuggcuc

SEQ ID NO: 1448079 - RNA, 12 nt, Homo sapiens
agagcaggcuca

SEQ ID NO: 1448080 - RNA, 11 nt, Homo sapiens
agagccaguga

SEQ ID NO: 1448081 - RNA, 18 nt, Homo sapiens
agagccagugaaggagcc

SEQ ID NO: 1448082 - RNA, 21 nt, Homo sapiens
agagccgcaaaucaaccccag

SEQ ID NO: 1448083 - RNA, 14 nt, Homo sapiens
agagccuccuccag

SEQ ID NO: 1448084 - RNA, 23 nt, Homo sapiens
agagcuauggugagguguggaua

SEQ ID NO: 1448085 - RNA, 17 nt, Homo sapiens
agagcuucccaggaucc

SEQ ID NO: 1448086 - RNA, 17 nt, Homo sapiens
agagcuuuuuuacauaa

SEQ ID NO: 1448087 - RNA, 19 nt, Homo sapiens
agaggaauaagaauggagc

SEQ ID NO: 1448088 - RNA, 11 nt, Homo sapiens
agaggacaaga

SEQ ID NO: 1448089 - RNA, 22 nt, Homo sapiens
agaggacagagcuggcugucuu

SEQ ID NO: 1448090 - RNA, 17 nt, Homo sapiens
agaggagagaggcucag

SEQ ID NO: 1448091 - RNA, 23 nt, Homo sapiens
agaggagguuuggggucugccac

SEQ ID NO: 1448092 - RNA, 22 nt, Homo sapiens
agugauuuccuguauaauuuaa

SEQ ID NO: 1448093 - RNA, 16 nt, Homo sapiens
agugcacuguauauag

SEQ ID NO: 1448094 - RNA, 17 nt, Homo sapiens
agugccaauauuucuga

SEQ ID NO: 1448095 - RNA, 18 nt, Homo sapiens
agugccaauauuucugau

SEQ ID NO: 1448096 - RNA, 20 nt, Homo sapiens
agugccacuugacauuccuu

SEQ ID NO: 1448097 - RNA, 15 nt, Homo sapiens
agugccaucccacau

SEQ ID NO: 1448098 - RNA, 16 nt, Homo sapiens
agugcccagcaugaag

SEQ ID NO: 1448099 - RNA, 18 nt, Homo sapiens
agugccuccugggaccau

SEQ ID NO: 1448100 - RNA, 14 nt, Homo sapiens
agugccugagaugc

SEQ ID NO: 1448101 - RNA, 14 nt, Homo sapiens
agugccuggcaagg

SEQ ID NO: 1448102 - RNA, 15 nt, Homo sapiens
agugcuaugccaagc

SEQ ID NO: 1448103 - RNA, 11 nt, Homo sapiens
agugcugccau

SEQ ID NO: 1448104 - RNA, 16 nt, Homo sapiens
agugcuuggguggugg

SEQ ID NO: 1448105 - RNA, 15 nt, Homo sapiens
aguggaauacaguga

SEQ ID NO: 1448106 - RNA, 20 nt, Homo sapiens
aguggauuuuccugaauauu

SEQ ID NO: 1448107 - RNA, 13 nt, Homo sapiens
aguggcuuuuuaa

SEQ ID NO: 1448108 - RNA, 16 nt, Homo sapiens
agugguauauacauau

SEQ ID NO: 1448109 - RNA, 17 nt, Homo sapiens
aguggugcgaucuuggc

SEQ ID NO: 1448110 - RNA, 20 nt, Homo sapiens
aguggugcgaucuuggcuca

SEQ ID NO: 1448111 - RNA, 19 nt, Homo sapiens
aguguaaccuugcaucuca

SEQ ID NO: 1448112 - RNA, 20 nt, Homo sapiens
agugucaccagcugccaaaa

SEQ ID NO: 1448113 - RNA, 14 nt, Homo sapiens
aguguccucuugcu

SEQ ID NO: 1448114 - RNA, 19 nt, Homo sapiens
aguguuccccaucuggguc

SEQ ID NO: 1448115 - RNA, 21 nt, Homo sapiens
aguuaaaagacugcagcugcu

SEQ ID NO: 1448116 - RNA, 14 nt, Homo sapiens
aguuaacuacagug

SEQ ID NO: 1448117 - RNA, 22 nt, Homo sapiens
aguuaagaauggaagaaaacgg

SEQ ID NO: 1448118 - RNA, 13 nt, Homo sapiens
aguuaaguauuua

SEQ ID NO: 1448119 - RNA, 19 nt, Homo sapiens
aguuauggcuauaggugcu

SEQ ID NO: 1448120 - RNA, 17 nt, Homo sapiens
aguuauuaaacaguguu

SEQ ID NO: 1448121 - RNA, 14 nt, Homo sapiens
aguucaacuuugag

SEQ ID NO: 1448122 - RNA, 20 nt, Homo sapiens
aguuccuccaagaggucucc

SEQ ID NO: 1448123 - RNA, 13 nt, Homo sapiens
aguuccugcacuc

SEQ ID NO: 1448124 - RNA, 16 nt, Homo sapiens
aguuccugcacuccag

SEQ ID NO: 1448125 - RNA, 13 nt, Homo sapiens
aguucuaauuccc

SEQ ID NO: 1448126 - RNA, 14 nt, Homo sapiens
aguucuaggcauag

SEQ ID NO: 1448127 - RNA, 17 nt, Homo sapiens
aguucuguuguccauca

SEQ ID NO: 1448128 - RNA, 17 nt, Homo sapiens
aguugaacacugucauc

SEQ ID NO: 1448129 - RNA, 20 nt, Homo sapiens
aguugcgcugggagacgcug

SEQ ID NO: 1448130 - RNA, 22 nt, Homo sapiens
aguugcuuuaaaguaccuguag

SEQ ID NO: 1448131 - RNA, 20 nt, Homo sapiens
aguuguuuucccgagcaaag

SEQ ID NO: 1448132 - RNA, 18 nt, Homo sapiens
aguuuaauagauguuacu

SEQ ID NO: 1448133 - RNA, 22 nt, Homo sapiens
aguuuacagaauggaaccaaaa

SEQ ID NO: 1448134 - RNA, 13 nt, Homo sapiens
aguuuaucuuuca

SEQ ID NO: 1448135 - RNA, 16 nt, Homo sapiens
aguuucccaaauuccc

SEQ ID NO: 1448136 - RNA, 11 nt, Homo sapiens
aguuuccccac

SEQ ID NO: 1448137 - RNA, 18 nt, Homo sapiens
aguuuccucaccagaaaa

SEQ ID NO: 1448138 - RNA, 15 nt, Homo sapiens
aguuucugauucacu

SEQ ID NO: 1448139 - RNA, 21 nt, Homo sapiens
aguuugcuuauguaaucucac

SEQ ID NO: 1448140 - RNA, 17 nt, Homo sapiens
aguuugcuuuguaugca

SEQ ID NO: 1448141 - RNA, 13 nt, Homo sapiens
aguuuguuuuaca

SEQ ID NO: 1448142 - RNA, 13 nt, Homo sapiens
aguuuucaaagau

SEQ ID NO: 1448143 - RNA, 19 nt, Homo sapiens
aguuuuucagaaagcauua

SEQ ID NO: 1448144 - RNA, 22 nt, Homo sapiens
aguuuuucagaaagcauuacau

SEQ ID NO: 1448145 - RNA, 15 nt, Homo sapiens
auaaaaauaccucuu

SEQ ID NO: 1448146 - RNA, 16 nt, Homo sapiens
auaaaaauacuaugaa

SEQ ID NO: 1448147 - RNA, 21 nt, Homo sapiens
auaaaauauacaaacaugugg

SEQ ID NO: 1448148 - RNA, 23 nt, Homo sapiens
auaaaauauuuuugaaaggcaug

SEQ ID NO: 1448149 - RNA, 15 nt, Homo sapiens
auaaaaugauguaug

SEQ ID NO: 1448150 - RNA, 15 nt, Homo sapiens
auaaaauuaugccau

SEQ ID NO: 1448151 - RNA, 16 nt, Homo sapiens
auaaaauuaugccaua

SEQ ID NO: 1448152 - RNA, 18 nt, Homo sapiens
auaaugucgaacucugaa

SEQ ID NO: 1448153 - RNA, 13 nt, Homo sapiens
auaaugugcaaau

SEQ ID NO: 1448154 - RNA, 15 nt, Homo sapiens
auaauugacaugggc

SEQ ID NO: 1448155 - RNA, 16 nt, Homo sapiens
auacaaacaagcacag

SEQ ID NO: 1448156 - RNA, 13 nt, Homo sapiens
auacaacauguag

SEQ ID NO: 1448157 - RNA, 19 nt, Homo sapiens
auacaagccacuaccuucu

SEQ ID NO: 1448158 - RNA, 14 nt, Homo sapiens
auacacacauauac

SEQ ID NO: 1448159 - RNA, 20 nt, Homo sapiens
auacacagaugauaauaugc

SEQ ID NO: 1448160 - RNA, 15 nt, Homo sapiens
auacacauacauaca

SEQ ID NO: 1448161 - RNA, 22 nt, Homo sapiens
auacacugaaguuaacagagac

SEQ ID NO: 1448162 - RNA, 21 nt, Homo sapiens
auacagccccaaaccagggug

SEQ ID NO: 1448163 - RNA, 16 nt, Homo sapiens
auacagcucagcuuuu

SEQ ID NO: 1448164 - RNA, 14 nt, Homo sapiens
auacauacauauau

SEQ ID NO: 1448165 - RNA, 14 nt, Homo sapiens
auacauaccacuuu

SEQ ID NO: 1448166 - RNA, 19 nt, Homo sapiens
auacaucacagcagugcau

SEQ ID NO: 1448167 - RNA, 13 nt, Homo sapiens
auacaugcugcua

SEQ ID NO: 1448168 - RNA, 17 nt, Homo sapiens
auacccuuuaucucugu

SEQ ID NO: 1448169 - RNA, 19 nt, Homo sapiens
auacgaaacacaaaccaca

SEQ ID NO: 1448170 - RNA, 18 nt, Homo sapiens
auacgaccgggaggucca

SEQ ID NO: 1448171 - RNA, 22 nt, Homo sapiens
auacgcaaacacaccgaugcac

SEQ ID NO: 1448172 - RNA, 21 nt, Homo sapiens
auacuaauugagaaacaugaa

SEQ ID NO: 1448173 - RNA, 22 nt, Homo sapiens
auacuagaaagcucugcaugug

SEQ ID NO: 1448174 - RNA, 17 nt, Homo sapiens
auacugccggucaccca

SEQ ID NO: 1448175 - RNA, 22 nt, Homo sapiens
auacuguacugagacauuacag

SEQ ID NO: 1448176 - RNA, 14 nt, Homo sapiens
auacuucacucacu

SEQ ID NO: 1448177 - RNA, 16 nt, Homo sapiens
auagaaagcuguuuau

SEQ ID NO: 1448178 - RNA, 19 nt, Homo sapiens
auagaaagugccagaaagu

SEQ ID NO: 1448179 - RNA, 14 nt, Homo sapiens
auagaauacaugga

SEQ ID NO: 1448180 - RNA, 14 nt, Homo sapiens
auagacagugcugc

SEQ ID NO: 1448181 - RNA, 20 nt, Homo sapiens
auagagcuuucaaguacaug

SEQ ID NO: 1448182 - RNA, 12 nt, Homo sapiens
auagaugugcaa

SEQ ID NO: 1448183 - RNA, 16 nt, Homo sapiens
auagauuaauggcacu

SEQ ID NO: 1448184 - RNA, 18 nt, Homo sapiens
auagauuaauggcacuga

SEQ ID NO: 1448185 - RNA, 24 nt, Homo sapiens
auagauugagaaguuuuguacaga

SEQ ID NO: 1448186 - RNA, 16 nt, Homo sapiens
auagccauaugcaaua

SEQ ID NO: 1448187 - RNA, 18 nt, Homo sapiens
auagcuauuuucuuacag

SEQ ID NO: 1448188 - RNA, 21 nt, Homo sapiens
auagcucacuguaaccucaaa

SEQ ID NO: 1448189 - RNA, 23 nt, Homo sapiens
auagcugggaacccgacugugaa

SEQ ID NO: 1448190 - RNA, 19 nt, Homo sapiens
auaggaccuuccacacagg

SEQ ID NO: 1448191 - RNA, 18 nt, Homo sapiens
auaggcauuugauuuugc

SEQ ID NO: 1448192 - RNA, 19 nt, Homo sapiens
auaggcauuugauuuugcc

SEQ ID NO: 1448193 - RNA, 19 nt, Homo sapiens
auaggccaucaauaucaca

SEQ ID NO: 1448194 - RNA, 22 nt, Homo sapiens
auaggcuggagaagcucaccca

SEQ ID NO: 1448195 - RNA, 17 nt, Homo sapiens
auagguaugagccaggg

SEQ ID NO: 1448196 - RNA, 20 nt, Homo sapiens
auaggugcuacaaaaacaca

SEQ ID NO: 1448197 - RNA, 17 nt, Homo sapiens
auaguaacuacuuuuua

SEQ ID NO: 1448198 - RNA, 19 nt, Homo sapiens
auaguacuggcaugguacg

SEQ ID NO: 1448199 - RNA, 20 nt, Homo sapiens
auaguauucaggugagcaau

SEQ ID NO: 1448200 - RNA, 17 nt, Homo sapiens
auaguccauggacaaua

SEQ ID NO: 1448201 - RNA, 18 nt, Homo sapiens
auaguuaauuauuucaac

SEQ ID NO: 1448202 - RNA, 22 nt, Homo sapiens
auaguuauuguuuuauguucua

SEQ ID NO: 1448203 - RNA, 16 nt, Homo sapiens
auaguuauuuacuuga

SEQ ID NO: 1448204 - RNA, 16 nt, Homo sapiens
auauaacaaccuuuaa

SEQ ID NO: 1448205 - RNA, 21 nt, Homo sapiens
auauaauacuaaagugucuau

SEQ ID NO: 1448206 - RNA, 17 nt, Homo sapiens
auauacaauaacauaau

SEQ ID NO: 1448207 - RNA, 14 nt, Homo sapiens
auauacacauacau

SEQ ID NO: 1448208 - RNA, 13 nt, Homo sapiens
auauacauaugac

SEQ ID NO: 1448209 - RNA, 14 nt, Homo sapiens
accaucguccuucc

SEQ ID NO: 1448210 - RNA, 13 nt, Homo sapiens
accaucuuggcca

SEQ ID NO: 1448211 - RNA, 17 nt, Homo sapiens
accauugaccucagcug

SEQ ID NO: 1448212 - RNA, 14 nt, Homo sapiens
accauugucuucca

SEQ ID NO: 1448213 - RNA, 17 nt, Homo sapiens
acccacaucuaaugucu

SEQ ID NO: 1448214 - RNA, 22 nt, Homo sapiens
acccaccaucuacccacuuacu

SEQ ID NO: 1448215 - RNA, 21 nt, Homo sapiens
acccacccagugucuuucgag

SEQ ID NO: 1448216 - RNA, 16 nt, Homo sapiens
acccaccuguacucug

SEQ ID NO: 1448217 - RNA, 14 nt, Homo sapiens
acccacucacacuu

SEQ ID NO: 1448218 - RNA, 14 nt, Homo sapiens
acccagcauguaca

SEQ ID NO: 1448219 - RNA, 21 nt, Homo sapiens
acccagcuacucuguccaggc

SEQ ID NO: 1448220 - RNA, 15 nt, Homo sapiens
acccagggugcauua

SEQ ID NO: 1448221 - RNA, 15 nt, Homo sapiens
acccaguauaugcua

SEQ ID NO: 1448222 - RNA, 22 nt, Homo sapiens
acccauccuaccaaugcaugca

SEQ ID NO: 1448223 - RNA, 13 nt, Homo sapiens
acccaugccauag

SEQ ID NO: 1448224 - RNA, 21 nt, Homo sapiens
accccacauuggacuuccuug

SEQ ID NO: 1448225 - RNA, 23 nt, Homo sapiens
accccagccuccugccuacccca

SEQ ID NO: 1448226 - RNA, 15 nt, Homo sapiens
accccaggcauccca

SEQ ID NO: 1448227 - RNA, 12 nt, Homo sapiens
accccaguuuuu

SEQ ID NO: 1448228 - RNA, 11 nt, Homo sapiens
accccaucuca

SEQ ID NO: 1448229 - RNA, 12 nt, Homo sapiens
accccaucucau

SEQ ID NO: 1448230 - RNA, 17 nt, Homo sapiens
accccauuuguggucac

SEQ ID NO: 1448231 - RNA, 13 nt, Homo sapiens
acccccaucuuuu

SEQ ID NO: 1448232 - RNA, 13 nt, Homo sapiens
accccuacaugaa

SEQ ID NO: 1448233 - RNA, 13 nt, Homo sapiens
accccugucucua

SEQ ID NO: 1448234 - RNA, 14 nt, Homo sapiens
acccgacugugaaa

SEQ ID NO: 1448235 - RNA, 16 nt, Homo sapiens
acccuaaaacaugugu

SEQ ID NO: 1448236 - RNA, 21 nt, Homo sapiens
acccuaagccuccuuuugcuu

SEQ ID NO: 1448237 - RNA, 18 nt, Homo sapiens
acccuaaugcuaguuuca

SEQ ID NO: 1448238 - RNA, 15 nt, Homo sapiens
acccucacuguguug

SEQ ID NO: 1448239 - RNA, 14 nt, Homo sapiens
acccucgaugaagc

SEQ ID NO: 1448240 - RNA, 14 nt, Homo sapiens
acccucucuucccu

SEQ ID NO: 1448241 - RNA, 23 nt, Homo sapiens
acccugaccgugcuaacugugug

SEQ ID NO: 1448242 - RNA, 18 nt, Homo sapiens
acccuggaauucagcacc

SEQ ID NO: 1448243 - RNA, 22 nt, Homo sapiens
acccuucccaaucagcacugaa

SEQ ID NO: 1448244 - RNA, 22 nt, Homo sapiens
acccuuccuacagauagucaaa

SEQ ID NO: 1448245 - RNA, 17 nt, Homo sapiens
acccuuucucugagaga

SEQ ID NO: 1448246 - RNA, 20 nt, Homo sapiens
accgagcgcuuucuggaaaa

SEQ ID NO: 1448247 - RNA, 17 nt, Homo sapiens
accgggcuacuaccugg

SEQ ID NO: 1448248 - RNA, 16 nt, Homo sapiens
accgggguucaagcca

SEQ ID NO: 1448249 - RNA, 10 nt, Homo sapiens
accuaccugc

SEQ ID NO: 1448250 - RNA, 15 nt, Homo sapiens
accuacucuauguau

SEQ ID NO: 1448251 - RNA, 15 nt, Homo sapiens
accuagcaucuuaca

SEQ ID NO: 1448252 - RNA, 13 nt, Homo sapiens
accuagugcuguu

SEQ ID NO: 1448253 - RNA, 17 nt, Homo sapiens
accuaugucccuucuca

SEQ ID NO: 1448254 - RNA, 22 nt, Homo sapiens
accucaccagaauugugcaaau

SEQ ID NO: 1448255 - RNA, 17 nt, Homo sapiens
accucacgcucuggaca

SEQ ID NO: 1448256 - RNA, 18 nt, Homo sapiens
accucaggcagaggaugu

SEQ ID NO: 1448257 - RNA, 19 nt, Homo sapiens
accucagggacaacauuuu

SEQ ID NO: 1448258 - RNA, 21 nt, Homo sapiens
accucaugcugagcgcugugu

SEQ ID NO: 1448259 - RNA, 17 nt, Homo sapiens
accuccacccacugucc

SEQ ID NO: 1448260 - RNA, 18 nt, Homo sapiens
accuccauuucucuccag

SEQ ID NO: 1448261 - RNA, 15 nt, Homo sapiens
accucccagcccuau

SEQ ID NO: 1448262 - RNA, 19 nt, Homo sapiens
accucccccugccuuccaa

SEQ ID NO: 1448263 - RNA, 20 nt, Homo sapiens
accuccuccacucacuccag

SEQ ID NO: 1448264 - RNA, 17 nt, Homo sapiens
accuccuguguggaaga

SEQ ID NO: 1448265 - RNA, 22 nt, Homo sapiens
accucggcucacugcagccucc

SEQ ID NO: 1448266 - RNA, 14 nt, Homo sapiens
accucuacugccuu

SEQ ID NO: 1448267 - RNA, 16 nt, Homo sapiens
accucuagugcuacug

SEQ ID NO: 1448268 - RNA, 15 nt, Homo sapiens
accucuucuaugcaa

SEQ ID NO: 1448269 - RNA, 21 nt, Homo sapiens
accucuuuauuuuuugauuga

SEQ ID NO: 1448270 - RNA, 13 nt, Homo sapiens
accugcagauucu

SEQ ID NO: 1448271 - RNA, 22 nt, Homo sapiens
accugccacuuccaggagccca

SEQ ID NO: 1448272 - RNA, 16 nt, Homo sapiens
accugcccucucucag

SEQ ID NO: 1448273 - RNA, 19 nt, Homo sapiens
accugcucuccucuugcca

SEQ ID NO: 1448274 - RNA, 18 nt, Homo sapiens
accugcugagcucugaga

SEQ ID NO: 1448275 - RNA, 21 nt, Homo sapiens
accuggagagcuagaaccuag

SEQ ID NO: 1448276 - RNA, 21 nt, Homo sapiens
accuggagggcuagaaccuag

SEQ ID NO: 1448277 - RNA, 22 nt, Homo sapiens
accuggagggcuagaaccuaga

SEQ ID NO: 1448278 - RNA, 23 nt, Homo sapiens
accuggagggcuggaaucuggag

SEQ ID NO: 1448279 - RNA, 21 nt, Homo sapiens
accuggcagguuagaaccuag

SEQ ID NO: 1448280 - RNA, 16 nt, Homo sapiens
accugggcccuggggc

SEQ ID NO: 1448281 - RNA, 19 nt, Homo sapiens
accugguuccuguccucaa

SEQ ID NO: 1448282 - RNA, 19 nt, Homo sapiens
accugugcucuaagugaau

SEQ ID NO: 1448283 - RNA, 22 nt, Homo sapiens
accuguucuuccuaccaaauau

SEQ ID NO: 1448284 - RNA, 17 nt, Homo sapiens
accuuaaucugccauaa

SEQ ID NO: 1448285 - RNA, 14 nt, Homo sapiens
acuucugucuuccu

SEQ ID NO: 1448286 - RNA, 22 nt, Homo sapiens
acuugaaauaccagugaaccaa

SEQ ID NO: 1448287 - RNA, 13 nt, Homo sapiens
acuugaacccagg

SEQ ID NO: 1448288 - RNA, 19 nt, Homo sapiens
acuugccaggcucccuuuc

SEQ ID NO: 1448289 - RNA, 23 nt, Homo sapiens
acuugcugcugagugcaccacuu

SEQ ID NO: 1448290 - RNA, 13 nt, Homo sapiens
acuuggcugcuca

SEQ ID NO: 1448291 - RNA, 17 nt, Homo sapiens
acuuggggcaccuugcu

SEQ ID NO: 1448292 - RNA, 19 nt, Homo sapiens
acuuggggcaccuugcucc

SEQ ID NO: 1448293 - RNA, 22 nt, Homo sapiens
acuugguuuuuggcucuuucag

SEQ ID NO: 1448294 - RNA, 23 nt, Homo sapiens
acuuguaaauaaauagauuugau

SEQ ID NO: 1448295 - RNA, 16 nt, Homo sapiens
acuugugucuguccaa

SEQ ID NO: 1448296 - RNA, 13 nt, Homo sapiens
acuuuaaugggag

SEQ ID NO: 1448297 - RNA, 14 nt, Homo sapiens
acuuuaaugggagg

SEQ ID NO: 1448298 - RNA, 23 nt, Homo sapiens
acuuuacaggagguuguggaugc

SEQ ID NO: 1448299 - RNA, 20 nt, Homo sapiens
acuuuagaguagcaugagag

SEQ ID NO: 1448300 - RNA, 22 nt, Homo sapiens
acuuuauaaauaaacaugagcg

SEQ ID NO: 1448301 - RNA, 22 nt, Homo sapiens
acuuucuguugccacaacccug

SEQ ID NO: 1448302 - RNA, 16 nt, Homo sapiens
acuuugaucucugcuu

SEQ ID NO: 1448303 - RNA, 19 nt, Homo sapiens
acuuuggcuucuccuguga

SEQ ID NO: 1448304 - RNA, 17 nt, Homo sapiens
acuuugucucugagaac

SEQ ID NO: 1448305 - RNA, 17 nt, Homo sapiens
acuuuucuaacauaugu

SEQ ID NO: 1448306 - RNA, 20 nt, Homo sapiens
acuuuucuaacauaugucua

SEQ ID NO: 1448307 - RNA, 23 nt, Homo sapiens
acuuuucugugucauaccacaau

SEQ ID NO: 1448308 - RNA, 19 nt, Homo sapiens
acuuuuucugagcuuuuca

SEQ ID NO: 1448309 - RNA, 13 nt, Homo sapiens
agaaaaaccaaug

SEQ ID NO: 1448310 - RNA, 14 nt, Homo sapiens
agaaaacauuccaa

SEQ ID NO: 1448311 - RNA, 13 nt, Homo sapiens
agaaaagccagag

SEQ ID NO: 1448312 - RNA, 18 nt, Homo sapiens
agaaaaucaucuuggcca

SEQ ID NO: 1448313 - RNA, 16 nt, Homo sapiens
agaaaaucuuuuacua

SEQ ID NO: 1448314 - RNA, 15 nt, Homo sapiens
agaaaauuaguaauu

SEQ ID NO: 1448315 - RNA, 18 nt, Homo sapiens
agaaaauuaguaauugua

SEQ ID NO: 1448316 - RNA, 16 nt, Homo sapiens
agaaacaugaauuauu

SEQ ID NO: 1448317 - RNA, 16 nt, Homo sapiens
agaaacguaacugugu

SEQ ID NO: 1448318 - RNA, 13 nt, Homo sapiens
agaaacucaccau

SEQ ID NO: 1448319 - RNA, 23 nt, Homo sapiens
agaaacugaggccauuauuucaa

SEQ ID NO: 1448320 - RNA, 12 nt, Homo sapiens
agaaacuuccuu

SEQ ID NO: 1448321 - RNA, 15 nt, Homo sapiens
agaaagaaugcaaga

SEQ ID NO: 1448322 - RNA, 16 nt, Homo sapiens
agaaagcaacaguuac

SEQ ID NO: 1448323 - RNA, 23 nt, Homo sapiens
agaaaggagcucugaaucugaua

SEQ ID NO: 1448324 - RNA, 20 nt, Homo sapiens
agaaaguguuuaacuuguca

SEQ ID NO: 1448325 - RNA, 16 nt, Homo sapiens
agaaauacugcucuga

SEQ ID NO: 1448326 - RNA, 16 nt, Homo sapiens
agaaauauauauacau

SEQ ID NO: 1448327 - RNA, 12 nt, Homo sapiens
agaaaugggaga

SEQ ID NO: 1448328 - RNA, 15 nt, Homo sapiens
agaaauguauccuga

SEQ ID NO: 1448329 - RNA, 14 nt, Homo sapiens
agaaauuagcugug

SEQ ID NO: 1448330 - RNA, 13 nt, Homo sapiens
agaaauuccugua

SEQ ID NO: 1448331 - RNA, 22 nt, Homo sapiens
agaaauugcauuuccugacaga

SEQ ID NO: 1448332 - RNA, 23 nt, Homo sapiens
agaaauuuucauucagguauuug

SEQ ID NO: 1448333 - RNA, 15 nt, Homo sapiens
agaacaaacaccucc

SEQ ID NO: 1448334 - RNA, 23 nt, Homo sapiens
agaacaaugcuauaauauauaau

SEQ ID NO: 1448335 - RNA, 20 nt, Homo sapiens
agaacaauuaaacagccaaa

SEQ ID NO: 1448336 - RNA, 21 nt, Homo sapiens
agaacaccuuuguuuugcacu

SEQ ID NO: 1448337 - RNA, 19 nt, Homo sapiens
agaacaguaacugccauca

SEQ ID NO: 1448338 - RNA, 18 nt, Homo sapiens
agaacauggccuaagggc

SEQ ID NO: 1448339 - RNA, 21 nt, Homo sapiens
agaaccaagcuucagagccua

SEQ ID NO: 1448340 - RNA, 17 nt, Homo sapiens
agaaccacuuggcugcu

SEQ ID NO: 1448341 - RNA, 21 nt, Homo sapiens
agaaccacuuggcugcucauu

SEQ ID NO: 1448342 - RNA, 13 nt, Homo sapiens
agaacccuuccug

SEQ ID NO: 1448343 - RNA, 18 nt, Homo sapiens
agaacccuuggagccaau

SEQ ID NO: 1448344 - RNA, 23 nt, Homo sapiens
agaaccuggagagcuagaaccua

SEQ ID NO: 1448345 - RNA, 17 nt, Homo sapiens
agaacugccccaucucc

SEQ ID NO: 1448346 - RNA, 18 nt, Homo sapiens
agaacugccccaucuccu

SEQ ID NO: 1448347 - RNA, 21 nt, Homo sapiens
agaacugcuaaauacuguaca

SEQ ID NO: 1448348 - RNA, 14 nt, Homo sapiens
agaacuucaagaag

SEQ ID NO: 1448349 - RNA, 18 nt, Homo sapiens
agaagaaauucugucaua

SEQ ID NO: 1448350 - RNA, 15 nt, Homo sapiens
agaagacacagggga

SEQ ID NO: 1448351 - RNA, 13 nt, Homo sapiens
agaagacacugca

SEQ ID NO: 1448352 - RNA, 14 nt, Homo sapiens
agaagagacaggag

SEQ ID NO: 1448353 - RNA, 19 nt, Homo sapiens
agaagaggcuggugcugug

SEQ ID NO: 1448354 - RNA, 16 nt, Homo sapiens
agaagcagaaacuggc

SEQ ID NO: 1448355 - RNA, 22 nt, Homo sapiens
agaaggauggcauuuuuugcaa

SEQ ID NO: 1448356 - RNA, 16 nt, Homo sapiens
agaaggcacaggugua

SEQ ID NO: 1448357 - RNA, 15 nt, Homo sapiens
agaagggccagcccu

SEQ ID NO: 1448358 - RNA, 14 nt, Homo sapiens
agaagguugcucua

SEQ ID NO: 1448359 - RNA, 22 nt, Homo sapiens
agaagguuugcaccccuccuau

SEQ ID NO: 1448360 - RNA, 17 nt, Homo sapiens
agaaguaaaagcuaauu

SEQ ID NO: 1448361 - RNA, 21 nt, Homo sapiens
agaaguaggggaagacaugca

SEQ ID NO: 1448362 - RNA, 19 nt, Homo sapiens
agaaguguuccuucauuaa

SEQ ID NO: 1448363 - RNA, 17 nt, Homo sapiens
agaaguuaacuacagug

SEQ ID NO: 1448364 - RNA, 18 nt, Homo sapiens
agaaguuaacuacagugu

SEQ ID NO: 1448365 - RNA, 22 nt, Homo sapiens
agaaguucuggcugaacacugg

SEQ ID NO: 1448366 - RNA, 17 nt, Homo sapiens
agaaguuuuguacagag

SEQ ID NO: 1448367 - RNA, 14 nt, Homo sapiens
agaauaaaugaauc

SEQ ID NO: 1448368 - RNA, 15 nt, Homo sapiens
agaauaaaugaaucu

SEQ ID NO: 1448369 - RNA, 15 nt, Homo sapiens
ugcuggacugaggac

SEQ ID NO: 1448370 - RNA, 18 nt, Homo sapiens
ugcuggccuggaucuccc

SEQ ID NO: 1448371 - RNA, 14 nt, Homo sapiens
ugcuggcugccuua

SEQ ID NO: 1448372 - RNA, 18 nt, Homo sapiens
ugcuggggguuucuguag

SEQ ID NO: 1448373 - RNA, 16 nt, Homo sapiens
ugcuguacuugaugac

SEQ ID NO: 1448374 - RNA, 18 nt, Homo sapiens
ugcuguauauccccucaa

SEQ ID NO: 1448375 - RNA, 14 nt, Homo sapiens
ugcugucagcucag

SEQ ID NO: 1448376 - RNA, 23 nt, Homo sapiens
ugcugugcccucccauagcacug

SEQ ID NO: 1448377 - RNA, 21 nt, Homo sapiens
ugcuuaaauuauuuuuauaca

SEQ ID NO: 1448378 - RNA, 19 nt, Homo sapiens
ugcuuccacuucuaugcaa

SEQ ID NO: 1448379 - RNA, 20 nt, Homo sapiens
ugcuuccuccccuccuggca

SEQ ID NO: 1448380 - RNA, 13 nt, Homo sapiens
ugcuucuaguauu

SEQ ID NO: 1448381 - RNA, 13 nt, Homo sapiens
ugcuucugcuaaa

SEQ ID NO: 1448382 - RNA, 23 nt, Homo sapiens
ugcuugaaaugagaaacuuugau

SEQ ID NO: 1448383 - RNA, 13 nt, Homo sapiens
ugcuugacuauca

SEQ ID NO: 1448384 - RNA, 13 nt, Homo sapiens
ugcuugcacuuug

SEQ ID NO: 1448385 - RNA, 20 nt, Homo sapiens
ugcuuuccagccugggcaac

SEQ ID NO: 1448386 - RNA, 16 nt, Homo sapiens
uggaaaacucaggauu

SEQ ID NO: 1448387 - RNA, 14 nt, Homo sapiens
uggaaacaggacca

SEQ ID NO: 1448388 - RNA, 19 nt, Homo sapiens
uggaaacagggcagugaca

SEQ ID NO: 1448389 - RNA, 17 nt, Homo sapiens
uggaaagaaucuaauag

SEQ ID NO: 1448390 - RNA, 15 nt, Homo sapiens
uggaaaguucagcca

SEQ ID NO: 1448391 - RNA, 15 nt, Homo sapiens
uggaaauaaaccugg

SEQ ID NO: 1448392 - RNA, 13 nt, Homo sapiens
uggaaauacuuua

SEQ ID NO: 1448393 - RNA, 17 nt, Homo sapiens
uggaaauuuuguccauu

SEQ ID NO: 1448394 - RNA, 18 nt, Homo sapiens
uggaacacucucugagau

SEQ ID NO: 1448395 - RNA, 22 nt, Homo sapiens
uggaacccuggugucuccucca

SEQ ID NO: 1448396 - RNA, 15 nt, Homo sapiens
uggaaggcccacugu

SEQ ID NO: 1448397 - RNA, 14 nt, Homo sapiens
uggaauaaagcccu

SEQ ID NO: 1448398 - RNA, 19 nt, Homo sapiens
uggaauaaagcccuugaac

SEQ ID NO: 1448399 - RNA, 15 nt, Homo sapiens
uggaaucaaggaauc

SEQ ID NO: 1448400 - RNA, 12 nt, Homo sapiens
uggaaucuggag

SEQ ID NO: 1448401 - RNA, 17 nt, Homo sapiens
uggaauuuguaaguuua

SEQ ID NO: 1448402 - RNA, 23 nt, Homo sapiens
uggaauuuucuuacccauauauc

SEQ ID NO: 1448403 - RNA, 22 nt, Homo sapiens
uggacacuuauggggacagcau

SEQ ID NO: 1448404 - RNA, 13 nt, Homo sapiens
uggaccagccugu

SEQ ID NO: 1448405 - RNA, 12 nt, Homo sapiens
uggaccaguaga

SEQ ID NO: 1448406 - RNA, 14 nt, Homo sapiens
uggacccugcugaa

SEQ ID NO: 1448407 - RNA, 18 nt, Homo sapiens
uggacuugaggauuuuga

SEQ ID NO: 1448408 - RNA, 19 nt, Homo sapiens
uggagaaauaaaaauaccu

SEQ ID NO: 1448409 - RNA, 22 nt, Homo sapiens
uggagaaauaaaaauaccucuu

SEQ ID NO: 1448410 - RNA, 19 nt, Homo sapiens
uggagaagugucguuuuca

SEQ ID NO: 1448411 - RNA, 22 nt, Homo sapiens
uggagaccaggccugagcaaca

SEQ ID NO: 1448412 - RNA, 16 nt, Homo sapiens
uggagcccgugcagua

SEQ ID NO: 1448413 - RNA, 18 nt, Homo sapiens
uggagccuggcacaggac

SEQ ID NO: 1448414 - RNA, 18 nt, Homo sapiens
uggagcuccugcuggaug

SEQ ID NO: 1448415 - RNA, 12 nt, Homo sapiens
uggaggcugcuc

SEQ ID NO: 1448416 - RNA, 14 nt, Homo sapiens
uggagggacaggga

SEQ ID NO: 1448417 - RNA, 18 nt, Homo sapiens
uggagggaggcucuucag

SEQ ID NO: 1448418 - RNA, 14 nt, Homo sapiens
uggagguugcagug

SEQ ID NO: 1448419 - RNA, 16 nt, Homo sapiens
uggaguggacauucaa

SEQ ID NO: 1448420 - RNA, 19 nt, Homo sapiens
uggaguugugaucauccca

SEQ ID NO: 1448421 - RNA, 21 nt, Homo sapiens
uggauacagaaugaaucccau

SEQ ID NO: 1448422 - RNA, 17 nt, Homo sapiens
uggauauccacgcagca

SEQ ID NO: 1448423 - RNA, 20 nt, Homo sapiens
uggauccagggaaaagcagu

SEQ ID NO: 1448424 - RNA, 19 nt, Homo sapiens
uggaucccaauucauuuca

SEQ ID NO: 1448425 - RNA, 18 nt, Homo sapiens
uggaugacuaacuaucaa

SEQ ID NO: 1448426 - RNA, 19 nt, Homo sapiens
ugguuuauauaaggcagua

SEQ ID NO: 1448427 - RNA, 18 nt, Homo sapiens
uguaaaagagucaucugg

SEQ ID NO: 1448428 - RNA, 19 nt, Homo sapiens
uguaaaauaaguauuucca

SEQ ID NO: 1448429 - RNA, 21 nt, Homo sapiens
uguaaacagcuaauaaugaag

SEQ ID NO: 1448430 - RNA, 12 nt, Homo sapiens
uguaaacaugaa

SEQ ID NO: 1448431 - RNA, 19 nt, Homo sapiens
uguaaacuauaaacuacug

SEQ ID NO: 1448432 - RNA, 23 nt, Homo sapiens
uguaaacuauaaacuacuguaau

SEQ ID NO: 1448433 - RNA, 20 nt, Homo sapiens
uguaaauaaauagauuugau

SEQ ID NO: 1448434 - RNA, 14 nt, Homo sapiens
uguaaaugcauuag

SEQ ID NO: 1448435 - RNA, 18 nt, Homo sapiens
uguaaaugccacaaagaa

SEQ ID NO: 1448436 - RNA, 20 nt, Homo sapiens
uguaaaugcucgugugauuu

SEQ ID NO: 1448437 - RNA, 19 nt, Homo sapiens
uguaacaugcaauuuugca

SEQ ID NO: 1448438 - RNA, 18 nt, Homo sapiens
uguaacuucuuaaucuaa

SEQ ID NO: 1448439 - RNA, 16 nt, Homo sapiens
uguaagacucauuccc

SEQ ID NO: 1448440 - RNA, 14 nt, Homo sapiens
uguaagcacugacu

SEQ ID NO: 1448441 - RNA, 18 nt, Homo sapiens
uguaaguuuaugucuaaa

SEQ ID NO: 1448442 - RNA, 17 nt, Homo sapiens
uguaaucccagcacuuu

SEQ ID NO: 1448443 - RNA, 17 nt, Homo sapiens
uguacacacacagaugc

SEQ ID NO: 1448444 - RNA, 12 nt, Homo sapiens
uguacacugugu

SEQ ID NO: 1448445 - RNA, 18 nt, Homo sapiens
uguacauuucacaaaaag

SEQ ID NO: 1448446 - RNA, 18 nt, Homo sapiens
uguaccauacacauugga

SEQ ID NO: 1448447 - RNA, 14 nt, Homo sapiens
uguacccuuccuac

SEQ ID NO: 1448448 - RNA, 19 nt, Homo sapiens
uguacccuuccuacagaua

SEQ ID NO: 1448449 - RNA, 15 nt, Homo sapiens
uguaccuaugugaca

SEQ ID NO: 1448450 - RNA, 10 nt, Homo sapiens
uguacuugug

SEQ ID NO: 1448451 - RNA, 14 nt, Homo sapiens
uguagaacugagaa

SEQ ID NO: 1448452 - RNA, 21 nt, Homo sapiens
uguagauuaccugccacuucc

SEQ ID NO: 1448453 - RNA, 16 nt, Homo sapiens
uguagcuuuauccuua

SEQ ID NO: 1448454 - RNA, 16 nt, Homo sapiens
uguaggguaaggugcc

SEQ ID NO: 1448455 - RNA, 19 nt, Homo sapiens
uguaguggcauccauuucu

SEQ ID NO: 1448456 - RNA, 23 nt, Homo sapiens
uguauaaccccaccuugccaagc

SEQ ID NO: 1448457 - RNA, 22 nt, Homo sapiens
uguauaauuuaacagugcccuu

SEQ ID NO: 1448458 - RNA, 18 nt, Homo sapiens
uguauacuguacugagac

SEQ ID NO: 1448459 - RNA, 17 nt, Homo sapiens
uguauauaaaugaacaa

SEQ ID NO: 1448460 - RNA, 17 nt, Homo sapiens
uguauauacauuucaua

SEQ ID NO: 1448461 - RNA, 15 nt, Homo sapiens
uguaucuaauccuca

SEQ ID NO: 1448462 - RNA, 19 nt, Homo sapiens
uguaucuaccucacuauuc

SEQ ID NO: 1448463 - RNA, 23 nt, Homo sapiens
uguaucuucugcagacacugugg

SEQ ID NO: 1448464 - RNA, 22 nt, Homo sapiens
uguaugaaaauuccugugauuu

SEQ ID NO: 1448465 - RNA, 22 nt, Homo sapiens
uguauguaggcaauacauguau

SEQ ID NO: 1448466 - RNA, 23 nt, Homo sapiens
uguauguuuacauaucaccucau

SEQ ID NO: 1448467 - RNA, 15 nt, Homo sapiens
uguauuauguaugcg

SEQ ID NO: 1448468 - RNA, 15 nt, Homo sapiens
uguauuuaacugccu

SEQ ID NO: 1448469 - RNA, 12 nt, Homo sapiens
uguauuugccag

SEQ ID NO: 1448470 - RNA, 19 nt, Homo sapiens
uguauuuuugucauaugua

SEQ ID NO: 1448471 - RNA, 13 nt, Homo sapiens
ugucaauaccccu

SEQ ID NO: 1448472 - RNA, 14 nt, Homo sapiens
ugucaccagcaaca

SEQ ID NO: 1448473 - RNA, 18 nt, Homo sapiens
ugucaccagcugccaaaa

SEQ ID NO: 1448474 - RNA, 18 nt, Homo sapiens
ugucacccugcagagcua

SEQ ID NO: 1448475 - RNA, 20 nt, Homo sapiens
ugucaccucagcugauauua

SEQ ID NO: 1448476 - RNA, 20 nt, Homo sapiens
ugucagagcugggaguagca

SEQ ID NO: 1448477 - RNA, 14 nt, Homo sapiens
ugucaggacaccag

SEQ ID NO: 1448478 - RNA, 23 nt, Homo sapiens
ugucaucccauauaacuaagaca

SEQ ID NO: 1448479 - RNA, 23 nt, Homo sapiens
ugucauuaaauggggcucacaaa

SEQ ID NO: 1448480 - RNA, 12 nt, Homo sapiens
uguccagcagcc

SEQ ID NO: 1448481 - RNA, 18 nt, Homo sapiens
uguccagugcaaccacac

SEQ ID NO: 1448482 - RNA, 15 nt, Homo sapiens
uguccccuccacugu

SEQ ID NO: 1448483 - RNA, 22 nt, Homo sapiens
uguccccucuccccucauggag

SEQ ID NO: 1448484 - RNA, 22 nt, Homo sapiens
uguccuaaaauacaaacaagca

SEQ ID NO: 1448485 - RNA, 16 nt, Homo sapiens
uguccucuugcucaaa

SEQ ID NO: 1448486 - RNA, 15 nt, Homo sapiens
ugucgcaucucagcg

SEQ ID NO: 1448487 - RNA, 17 nt, Homo sapiens
ugucuauguugugaucc

SEQ ID NO: 1448488 - RNA, 20 nt, Homo sapiens
ugucuauguugugauccuuc

SEQ ID NO: 1448489 - RNA, 15 nt, Homo sapiens
ugucucaacuacuca

SEQ ID NO: 1448490 - RNA, 18 nt, Homo sapiens
ugucucaacuacucagcu

SEQ ID NO: 1448491 - RNA, 14 nt, Homo sapiens
ugucucacacagca

SEQ ID NO: 1448492 - RNA, 10 nt, Homo sapiens
ugucucucau

SEQ ID NO: 1448493 - RNA, 13 nt, Homo sapiens
ugucucugagaac

SEQ ID NO: 1448494 - RNA, 16 nt, Homo sapiens
ugucucugcaucucau

SEQ ID NO: 1448495 - RNA, 21 nt, Homo sapiens
ugucugauuggcucacccaag

SEQ ID NO: 1448496 - RNA, 14 nt, Homo sapiens
ugucugcacccagg

SEQ ID NO: 1448497 - RNA, 17 nt, Homo sapiens
ugucugcucaguaauuu

SEQ ID NO: 1448498 - RNA, 17 nt, Homo sapiens
ugucugucaccagcuau

SEQ ID NO: 1448499 - RNA, 22 nt, Homo sapiens
ugucuguuuuuguaacuuaaaa

SEQ ID NO: 1448500 - RNA, 23 nt, Homo sapiens
ugugaaaggaagcuccacuguca

SEQ ID NO: 1448501 - RNA, 19 nt, Homo sapiens
ugugaacacaucagcuugc

SEQ ID NO: 1448502 - RNA, 16 nt, Homo sapiens
ugugaacccaggacaa

SEQ ID NO: 1448503 - RNA, 23 nt, Homo sapiens
ugugaacucagagccccucccug

SEQ ID NO: 1448504 - RNA, 12 nt, Homo sapiens
ugugaaugaccu

SEQ ID NO: 1448505 - RNA, 19 nt, Homo sapiens
ugugaccacauacguguua

SEQ ID NO: 1448506 - RNA, 18 nt, Homo sapiens
ugugacccagggugcauu

SEQ ID NO: 1448507 - RNA, 18 nt, Homo sapiens
ugugaccccaccuugacg

SEQ ID NO: 1448508 - RNA, 21 nt, Homo sapiens
ugugaccuguuagaugugaca

SEQ ID NO: 1448509 - RNA, 15 nt, Homo sapiens
ugugacuauguucca

SEQ ID NO: 1448510 - RNA, 17 nt, Homo sapiens
ugugacugccaaggugu

SEQ ID NO: 1448511 - RNA, 19 nt, Homo sapiens
gcacuggguuguccaggga

SEQ ID NO: 1448512 - RNA, 18 nt, Homo sapiens
gcacuguaaaugcagccu

SEQ ID NO: 1448513 - RNA, 22 nt, Homo sapiens
gcacuuuaacccucucuucccu

SEQ ID NO: 1448514 - RNA, 19 nt, Homo sapiens
gcacuuuauaaaagcaaaa

SEQ ID NO: 1448515 - RNA, 14 nt, Homo sapiens
gcagaaaacacagc

SEQ ID NO: 1448516 - RNA, 22 nt, Homo sapiens
gcagaaaccaagucuacuucac

SEQ ID NO: 1448517 - RNA, 16 nt, Homo sapiens
gcagacaccugccuua

SEQ ID NO: 1448518 - RNA, 12 nt, Homo sapiens
gcagacagagaa

SEQ ID NO: 1448519 - RNA, 22 nt, Homo sapiens
gcagacaggaggaaucauguca

SEQ ID NO: 1448520 - RNA, 17 nt, Homo sapiens
gcagaccaucuccagca

SEQ ID NO: 1448521 - RNA, 14 nt, Homo sapiens
gcagagagaagccu

SEQ ID NO: 1448522 - RNA, 16 nt, Homo sapiens
gcagagccugagucac

SEQ ID NO: 1448523 - RNA, 23 nt, Homo sapiens
gcagaggauguucuggaccuccc

SEQ ID NO: 1448524 - RNA, 21 nt, Homo sapiens
gcagaggcggaaaccuugcag

SEQ ID NO: 1448525 - RNA, 18 nt, Homo sapiens
gcagaggugagcagagga

SEQ ID NO: 1448526 - RNA, 14 nt, Homo sapiens
gcagcaacucccac

SEQ ID NO: 1448527 - RNA, 11 nt, Homo sapiens
gcagcaaugag

SEQ ID NO: 1448528 - RNA, 22 nt, Homo sapiens
gcagcacuuuaacccucucuuc

SEQ ID NO: 1448529 - RNA, 16 nt, Homo sapiens
gcagccccacacccgc

SEQ ID NO: 1448530 - RNA, 23 nt, Homo sapiens
gcagcccgaagcccaguuucccu

SEQ ID NO: 1448531 - RNA, 20 nt, Homo sapiens
gcagcccuaaggaucucuca

SEQ ID NO: 1448532 - RNA, 17 nt, Homo sapiens
gcagccuucuuuucaaa

SEQ ID NO: 1448533 - RNA, 21 nt, Homo sapiens
gcagcugucauggaaaagccc

SEQ ID NO: 1448534 - RNA, 13 nt, Homo sapiens
gcagcuuguagcc

SEQ ID NO: 1448535 - RNA, 14 nt, Homo sapiens
gcaggaguagcuga

SEQ ID NO: 1448536 - RNA, 13 nt, Homo sapiens
gcaggaucucagc

SEQ ID NO: 1448537 - RNA, 18 nt, Homo sapiens
gccuuucuuauggaagaa

SEQ ID NO: 1448538 - RNA, 22 nt, Homo sapiens
gccuuuugcucacaaaaccugg

SEQ ID NO: 1448539 - RNA, 14 nt, Homo sapiens
gcgaguugcgcugg

SEQ ID NO: 1448540 - RNA, 21 nt, Homo sapiens
gcgcaacaacaaggacccugu

SEQ ID NO: 1448541 - RNA, 16 nt, Homo sapiens
gcgcagcgcgugcaca

SEQ ID NO: 1448542 - RNA, 15 nt, Homo sapiens
gcgcaugugccaguu

SEQ ID NO: 1448543 - RNA, 16 nt, Homo sapiens
gcgggaggcaccagcu

SEQ ID NO: 1448544 - RNA, 22 nt, Homo sapiens
gcguacucagcacagcagugga

SEQ ID NO: 1448545 - RNA, 20 nt, Homo sapiens
gcgucgcuggacaacccaga

SEQ ID NO: 1448546 - RNA, 17 nt, Homo sapiens
gcgugacucacccaagc

SEQ ID NO: 1448547 - RNA, 19 nt, Homo sapiens
gcuaaacaagggcagugag

SEQ ID NO: 1448548 - RNA, 12 nt, Homo sapiens
gcuaaaugcaaa

SEQ ID NO: 1448549 - RNA, 19 nt, Homo sapiens
gcuaacuguguguacauau

SEQ ID NO: 1448550 - RNA, 21 nt, Homo sapiens
gcuacaagaaugcaaaaaauc

SEQ ID NO: 1448551 - RNA, 18 nt, Homo sapiens
gcuacacaaaagccaaaa

SEQ ID NO: 1448552 - RNA, 15 nt, Homo sapiens
gcuacaccacucugg

SEQ ID NO: 1448553 - RNA, 15 nt, Homo sapiens
gcuacucucuugcca

SEQ ID NO: 1448554 - RNA, 22 nt, Homo sapiens
gcuacucucuugccagcauuuu

SEQ ID NO: 1448555 - RNA, 21 nt, Homo sapiens
gcuagcugcaagugacaucuc

SEQ ID NO: 1448556 - RNA, 17 nt, Homo sapiens
gcuaggaaugaaauccu

SEQ ID NO: 1448557 - RNA, 18 nt, Homo sapiens
gcuauaugccuuaagcca

SEQ ID NO: 1448558 - RNA, 13 nt, Homo sapiens
gcuauauugcacu

SEQ ID NO: 1448559 - RNA, 21 nt, Homo sapiens
ggauccccagccuacugccuc

SEQ ID NO: 1448560 - RNA, 14 nt, Homo sapiens
ggauccgcugccac

SEQ ID NO: 1448561 - RNA, 16 nt, Homo sapiens
ggaucuguccaaggaa

SEQ ID NO: 1448562 - RNA, 20 nt, Homo sapiens
ggaugaagauucuccugugc

SEQ ID NO: 1448563 - RNA, 21 nt, Homo sapiens
ggauggaauccuacagccucc

SEQ ID NO: 1448564 - RNA, 14 nt, Homo sapiens
ggaugugugucuca

SEQ ID NO: 1448565 - RNA, 15 nt, Homo sapiens
ggauguguuuugcac

SEQ ID NO: 1448566 - RNA, 20 nt, Homo sapiens
ggauuaaugguccugugaug

SEQ ID NO: 1448567 - RNA, 18 nt, Homo sapiens
ggauuuaacagucauuua

SEQ ID NO: 1448568 - RNA, 23 nt, Homo sapiens
ggauuuuuuguuauguuugcacu

SEQ ID NO: 1448569 - RNA, 18 nt, Homo sapiens
ggcaacagaugaagaccc

SEQ ID NO: 1448570 - RNA, 18 nt, Homo sapiens
ggcaacauaguaagaccc

SEQ ID NO: 1448571 - RNA, 20 nt, Homo sapiens
ggcaacauaguaagacccca

SEQ ID NO: 1448572 - RNA, 15 nt, Homo sapiens
ggcaacccaccaucu

SEQ ID NO: 1448573 - RNA, 20 nt, Homo sapiens
ggcaagggcaacccaccauc

SEQ ID NO: 1448574 - RNA, 16 nt, Homo sapiens
ggcaaugaaaccaaag

SEQ ID NO: 1448575 - RNA, 21 nt, Homo sapiens
ggcaauuuuuuuauacuacca

SEQ ID NO: 1448576 - RNA, 20 nt, Homo sapiens
ggcacacaaugcuauugaaa

SEQ ID NO: 1448577 - RNA, 17 nt, Homo sapiens
ggcacauggcuggcacu

SEQ ID NO: 1448578 - RNA, 18 nt, Homo sapiens
ggcaccacgaagcuguga

SEQ ID NO: 1448579 - RNA, 22 nt, Homo sapiens
ggcaccuacaagguugugcccu

SEQ ID NO: 1448580 - RNA, 16 nt, Homo sapiens
ggcacgccaacagccc

SEQ ID NO: 1448581 - RNA, 19 nt, Homo sapiens
ggcacucuucccaccucag

SEQ ID NO: 1448582 - RNA, 20 nt, Homo sapiens
ggcacugauaauauguuuga

SEQ ID NO: 1448583 - RNA, 18 nt, Homo sapiens
ggcagaaaacacagccug

SEQ ID NO: 1448584 - RNA, 22 nt, Homo sapiens
ggcagaaaacacagccugugua

SEQ ID NO: 1448585 - RNA, 12 nt, Homo sapiens
ggcagagaagaa

SEQ ID NO: 1448586 - RNA, 21 nt, Homo sapiens
ggcaggaguagcugagcucac

SEQ ID NO: 1448587 - RNA, 16 nt, Homo sapiens
ggcagggcaaaugaca

SEQ ID NO: 1448588 - RNA, 23 nt, Homo sapiens
ggcaggggugggagagccagcuc

SEQ ID NO: 1448589 - RNA, 12 nt, Homo sapiens
ggcaggugcaga

SEQ ID NO: 1448590 - RNA, 17 nt, Homo sapiens
ggcaguuuaaagcacaa

SEQ ID NO: 1448591 - RNA, 13 nt, Homo sapiens
ggcauccugugug

SEQ ID NO: 1448592 - RNA, 15 nt, Homo sapiens
ggcaucugacaugca

SEQ ID NO: 1448593 - RNA, 21 nt, Homo sapiens
ggcaucuuucaacaaugacua

SEQ ID NO: 1448594 - RNA, 14 nt, Homo sapiens
ggcaugacacucua

SEQ ID NO: 1448595 - RNA, 13 nt, Homo sapiens
ggccaacaugaug

SEQ ID NO: 1448596 - RNA, 18 nt, Homo sapiens
ggccaagcaccuagccuc

SEQ ID NO: 1448597 - RNA, 16 nt, Homo sapiens
ggccacucuguuggug

SEQ ID NO: 1448598 - RNA, 20 nt, Homo sapiens
ggccacucuguugguggccu

SEQ ID NO: 1448599 - RNA, 17 nt, Homo sapiens
ggccacuguggccagag

SEQ ID NO: 1448600 - RNA, 17 nt, Homo sapiens
ggcccaagccuggucuc

SEQ ID NO: 1448601 - RNA, 15 nt, Homo sapiens
ggcccagagaagcaa

SEQ ID NO: 1448602 - RNA, 15 nt, Homo sapiens
ggccccccuccaggc

SEQ ID NO: 1448603 - RNA, 21 nt, Homo sapiens
ggcccuucuugccuacuaugc

SEQ ID NO: 1448604 - RNA, 20 nt, Homo sapiens
ggccuaagggccacauccca

SEQ ID NO: 1448605 - RNA, 20 nt, Homo sapiens
ggccuagggguccacgggaa

SEQ ID NO: 1448606 - RNA, 20 nt, Homo sapiens
ggccucacacccagagggua

SEQ ID NO: 1448607 - RNA, 19 nt, Homo sapiens
ggccuccugugcaucugua

SEQ ID NO: 1448608 - RNA, 22 nt, Homo sapiens
ggccugggggcagugacuggca

SEQ ID NO: 1448609 - RNA, 19 nt, Homo sapiens
ggccuggggugacccggca

SEQ ID NO: 1448610 - RNA, 19 nt, Homo sapiens
ggccuuacuuaaacccagc

SEQ ID NO: 1448611 - RNA, 18 nt, Homo sapiens
ggccuucacagugaccau

SEQ ID NO: 1448612 - RNA, 19 nt, Homo sapiens
ggcgagcucuggcuuugca

SEQ ID NO: 1448613 - RNA, 15 nt, Homo sapiens
ggcgucggaaaugau

SEQ ID NO: 1448614 - RNA, 20 nt, Homo sapiens
ggcuaaacaagggcagugag

SEQ ID NO: 1448615 - RNA, 21 nt, Homo sapiens
ggcuaccccuucauggugacu

SEQ ID NO: 1448616 - RNA, 13 nt, Homo sapiens
ggcuacuaccugg

SEQ ID NO: 1448617 - RNA, 15 nt, Homo sapiens
ggcuaucugcauuua

SEQ ID NO: 1448618 - RNA, 19 nt, Homo sapiens
ggcucaagaggcccaggga

SEQ ID NO: 1448619 - RNA, 12 nt, Homo sapiens
ggcucacagcug

SEQ ID NO: 1448620 - RNA, 23 nt, Homo sapiens
ggcucaccccucucccccgccca

SEQ ID NO: 1448621 - RNA, 20 nt, Homo sapiens
ggcucaggaagaaaccccaa

SEQ ID NO: 1448622 - RNA, 15 nt, Homo sapiens
ggcuccagguccgga

SEQ ID NO: 1448623 - RNA, 22 nt, Homo sapiens
ggcucccuaacacacacagcgg

SEQ ID NO: 1448624 - RNA, 15 nt, Homo sapiens
ggcucuaacgccuga

SEQ ID NO: 1448625 - RNA, 15 nt, Homo sapiens
ggcucuuucagagag

SEQ ID NO: 1448626 - RNA, 23 nt, Homo sapiens
ggcugaauagcuucuccaaaggc

SEQ ID NO: 1448627 - RNA, 16 nt, Homo sapiens
ggcugacaccuggauu

SEQ ID NO: 1448628 - RNA, 21 nt, Homo sapiens
gggaacuggccaagcugaggu

SEQ ID NO: 1448629 - RNA, 14 nt, Homo sapiens
gggacagcauaccu

SEQ ID NO: 1448630 - RNA, 21 nt, Homo sapiens
gggaccaugaagagacucucu

SEQ ID NO: 1448631 - RNA, 16 nt, Homo sapiens
gggacgaucuuugaau

SEQ ID NO: 1448632 - RNA, 23 nt, Homo sapiens
gggagagacacucccagggacaa

SEQ ID NO: 1448633 - RNA, 15 nt, Homo sapiens
gggagagcagagggu

SEQ ID NO: 1448634 - RNA, 19 nt, Homo sapiens
gggagagcgaaggggguca

SEQ ID NO: 1448635 - RNA, 20 nt, Homo sapiens
gggagccuaaggaagcgugg

SEQ ID NO: 1448636 - RNA, 19 nt, Homo sapiens
gggauucuaggaaacccaa

SEQ ID NO: 1448637 - RNA, 18 nt, Homo sapiens
gggcaagaaccuaaagua

SEQ ID NO: 1448638 - RNA, 11 nt, Homo sapiens
gggcacugccu

SEQ ID NO: 1448639 - RNA, 18 nt, Homo sapiens
gggcaggaguagcugagc

SEQ ID NO: 1448640 - RNA, 16 nt, Homo sapiens
gggcaggaucucagcc

SEQ ID NO: 1448641 - RNA, 18 nt, Homo sapiens
gggcagucguaaggguug

SEQ ID NO: 1448642 - RNA, 21 nt, Homo sapiens
gggccagcugucgcaucucag

SEQ ID NO: 1448643 - RNA, 13 nt, Homo sapiens
gggccuacugcca

SEQ ID NO: 1448644 - RNA, 19 nt, Homo sapiens
gggccuauggagagcccug

SEQ ID NO: 1448645 - RNA, 20 nt, Homo sapiens
gggccuggcuggcugagggc

SEQ ID NO: 1448646 - RNA, 15 nt, Homo sapiens
gggccuggggcuccu

SEQ ID NO: 1448647 - RNA, 22 nt, Homo sapiens
gggcuagggagaaugcagagag

SEQ ID NO: 1448648 - RNA, 12 nt, Homo sapiens
gggcuagggagg

SEQ ID NO: 1448649 - RNA, 22 nt, Homo sapiens
gggcuuguagaccacuguccug

SEQ ID NO: 1448650 - RNA, 19 nt, Homo sapiens
ggggagcaguaaacuuucu

SEQ ID NO: 1448651 - RNA, 22 nt, Homo sapiens
ggggagcccccucuuccacuca

SEQ ID NO: 1448652 - RNA, 23 nt, Homo sapiens
ggggagcugggguacagguuugg

SEQ ID NO: 1448653 - RNA, 20 nt, Homo sapiens
ggggaguguuuuuguaucac

SEQ ID NO: 1448654 - RNA, 23 nt, Homo sapiens
ggggcagcccugccugcggggga

SEQ ID NO: 1448655 - RNA, 17 nt, Homo sapiens
gggggaauaaagacaga

SEQ ID NO: 1448656 - RNA, 13 nt, Homo sapiens
ggggguuccguga

SEQ ID NO: 1448657 - RNA, 17 nt, Homo sapiens
gggguaugagcugccaa

SEQ ID NO: 1448658 - RNA, 18 nt, Homo sapiens
gggguaugagcugccaag

SEQ ID NO: 1448659 - RNA, 20 nt, Homo sapiens
ggggucgucaccaccucucc

SEQ ID NO: 1448660 - RNA, 17 nt, Homo sapiens
ggggucuguguggugcc

SEQ ID NO: 1448661 - RNA, 18 nt, Homo sapiens
ggguaagguaugggagag

SEQ ID NO: 1448662 - RNA, 21 nt, Homo sapiens
ggguccauuuggguacgucug

SEQ ID NO: 1448663 - RNA, 14 nt, Homo sapiens
gggucccagggaag

SEQ ID NO: 1448664 - RNA, 20 nt, Homo sapiens
gggucucacuauguugccca

SEQ ID NO: 1448665 - RNA, 16 nt, Homo sapiens
gggucuguguggugcc

SEQ ID NO: 1448666 - RNA, 14 nt, Homo sapiens
gggugacaucccag

SEQ ID NO: 1448667 - RNA, 16 nt, Homo sapiens
gggugcgguggcucac

SEQ ID NO: 1448668 - RNA, 18 nt, Homo sapiens
gggugggccagauccaaa

SEQ ID NO: 1448669 - RNA, 22 nt, Homo sapiens
ggguucaagcaauugucugccu

SEQ ID NO: 1448670 - RNA, 15 nt, Homo sapiens
ggguucaucuaggga

SEQ ID NO: 1448671 - RNA, 22 nt, Homo sapiens
ggguuuugucucugcaucucau

SEQ ID NO: 1448672 - RNA, 23 nt, Homo sapiens
ggguuuuuaaucuuugugacagg

SEQ ID NO: 1448673 - RNA, 14 nt, Homo sapiens
gguaaacauucucu

SEQ ID NO: 1448674 - RNA, 11 nt, Homo sapiens
gguaaucagca

SEQ ID NO: 1448675 - RNA, 13 nt, Homo sapiens
gguacagcagggu

SEQ ID NO: 1448676 - RNA, 16 nt, Homo sapiens
gguacauuucccugug

SEQ ID NO: 1448677 - RNA, 20 nt, Homo sapiens
gguagaaaaggcuagguaca

SEQ ID NO: 1448678 - RNA, 22 nt, Homo sapiens
gguaguuuagaucccaugucac

SEQ ID NO: 1448679 - RNA, 20 nt, Homo sapiens
gguauaaugguugacugggu

SEQ ID NO: 1448680 - RNA, 21 nt, Homo sapiens
gguauaaugguugacuggguu

SEQ ID NO: 1448681 - RNA, 17 nt, Homo sapiens
gguauaauuuuuaucca

SEQ ID NO: 1448682 - RNA, 14 nt, Homo sapiens
gguaucuccaggau

SEQ ID NO: 1448683 - RNA, 12 nt, Homo sapiens
gguaugagcuga

SEQ ID NO: 1448684 - RNA, 14 nt, Homo sapiens
gguauuagcaccuc

SEQ ID NO: 1448685 - RNA, 21 nt, Homo sapiens
gguauucuuaagggaacuucc

SEQ ID NO: 1448686 - RNA, 17 nt, Homo sapiens
gguauuuaccacagcag

SEQ ID NO: 1448687 - RNA, 23 nt, Homo sapiens
ggucaaccugcucacuguucuau

SEQ ID NO: 1448688 - RNA, 13 nt, Homo sapiens
ggucaagggccag

SEQ ID NO: 1448689 - RNA, 14 nt, Homo sapiens
ggucaagggccagu

SEQ ID NO: 1448690 - RNA, 15 nt, Homo sapiens
ggucacggcaaagga

SEQ ID NO: 1448691 - RNA, 14 nt, Homo sapiens
ggucagucacuuga

SEQ ID NO: 1448692 - RNA, 17 nt, Homo sapiens
ggucaugcuuuugccac

SEQ ID NO: 1448693 - RNA, 16 nt, Homo sapiens
gguccagacccacucc

SEQ ID NO: 1448694 - RNA, 21 nt, Homo sapiens
gguccuaacccccuuacugug

SEQ ID NO: 1448695 - RNA, 18 nt, Homo sapiens
gguccugauuucagggaa

SEQ ID NO: 1448696 - RNA, 17 nt, Homo sapiens
gguccuguucccuaccc

SEQ ID NO: 1448697 - RNA, 15 nt, Homo sapiens
ggucguccaagcaaa

SEQ ID NO: 1448698 - RNA, 21 nt, Homo sapiens
ggucguggagagcuaggagca

SEQ ID NO: 1448699 - RNA, 18 nt, Homo sapiens
ggucuccgcacuuggaaa

SEQ ID NO: 1448700 - RNA, 18 nt, Homo sapiens
uacacucucuagcuuuag

SEQ ID NO: 1448701 - RNA, 13 nt, Homo sapiens
uacacuuguauaa

SEQ ID NO: 1448702 - RNA, 20 nt, Homo sapiens
uacagaaauacugcucugaa

SEQ ID NO: 1448703 - RNA, 19 nt, Homo sapiens
uacagaaugaaucccauaa

SEQ ID NO: 1448704 - RNA, 14 nt, Homo sapiens
uacagacgucucaa

SEQ ID NO: 1448705 - RNA, 18 nt, Homo sapiens
uacagauagucaaaccau

SEQ ID NO: 1448706 - RNA, 17 nt, Homo sapiens
uacagauguaaaugcca

SEQ ID NO: 1448707 - RNA, 19 nt, Homo sapiens
uacagauuuuagacaagga

SEQ ID NO: 1448708 - RNA, 18 nt, Homo sapiens
uacagcucuuggcauuuu

SEQ ID NO: 1448709 - RNA, 15 nt, Homo sapiens
uacaguagugcauug

SEQ ID NO: 1448710 - RNA, 16 nt, Homo sapiens
uacagugagccaagau

SEQ ID NO: 1448711 - RNA, 14 nt, Homo sapiens
uacaguggcuguca

SEQ ID NO: 1448712 - RNA, 12 nt, Homo sapiens
uacaguguuauu

SEQ ID NO: 1448713 - RNA, 14 nt, Homo sapiens
uacauaacaagaaa

SEQ ID NO: 1448714 - RNA, 15 nt, Homo sapiens
uacauauguagacua

SEQ ID NO: 1448715 - RNA, 15 nt, Homo sapiens
uacauaugugaauau

SEQ ID NO: 1448716 - RNA, 24 nt, Homo sapiens
uacaucaccuuuuugacuuuucca

SEQ ID NO: 1448717 - RNA, 13 nt, Homo sapiens
uacaucuauguau

SEQ ID NO: 1448718 - RNA, 19 nt, Homo sapiens
uacaugcugugcucuuuga

SEQ ID NO: 1448719 - RNA, 21 nt, Homo sapiens
uacauguaucuaaacaaugua

SEQ ID NO: 1448720 - RNA, 14 nt, Homo sapiens
uacauguuacuugu

SEQ ID NO: 1448721 - RNA, 24 nt, Homo sapiens
uacauucccuaucaaaacauauca

SEQ ID NO: 1448722 - RNA, 13 nt, Homo sapiens
uacauugaucaag

SEQ ID NO: 1448723 - RNA, 15 nt, Homo sapiens
uacauuuaauacagc

SEQ ID NO: 1448724 - RNA, 15 nt, Homo sapiens
uacauuucccugugc

SEQ ID NO: 1448725 - RNA, 15 nt, Homo sapiens
uaccaaaauguuaau

SEQ ID NO: 1448726 - RNA, 18 nt, Homo sapiens
uaccaagccccuuggccc

SEQ ID NO: 1448727 - RNA, 16 nt, Homo sapiens
uaccaaguccugggaa

SEQ ID NO: 1448728 - RNA, 14 nt, Homo sapiens
uaccaaugcaugca

SEQ ID NO: 1448729 - RNA, 16 nt, Homo sapiens
uaccacaaacacauua

SEQ ID NO: 1448730 - RNA, 17 nt, Homo sapiens
uaccagggauguagauu

SEQ ID NO: 1448731 - RNA, 15 nt, Homo sapiens
uaccauacauuauca

SEQ ID NO: 1448732 - RNA, 17 nt, Homo sapiens
uaccccugauaagcaaa

SEQ ID NO: 1448733 - RNA, 19 nt, Homo sapiens
uaccgugggucaaccuggg

SEQ ID NO: 1448734 - RNA, 22 nt, Homo sapiens
uaccuauaauguguguaugugu

SEQ ID NO: 1448735 - RNA, 21 nt, Homo sapiens
uaccugacggacguccugcug

SEQ ID NO: 1448736 - RNA, 11 nt, Homo sapiens
uaccugggaaa

SEQ ID NO: 1448737 - RNA, 23 nt, Homo sapiens
uacgaaacacaaaccacaacuga

SEQ ID NO: 1448738 - RNA, 20 nt, Homo sapiens
uacgguaccuggcaauguuu

SEQ ID NO: 1448739 - RNA, 22 nt, Homo sapiens
uacuaaugugccccauguccaa

SEQ ID NO: 1448740 - RNA, 14 nt, Homo sapiens
uacuacacauccaa

SEQ ID NO: 1448741 - RNA, 17 nt, Homo sapiens
uacuacccgagcccagc

SEQ ID NO: 1448742 - RNA, 22 nt, Homo sapiens
uacuacccgagcccagcuacau

SEQ ID NO: 1448743 - RNA, 23 nt, Homo sapiens
uacuacuuuuacuacagugacaa

SEQ ID NO: 1448744 - RNA, 19 nt, Homo sapiens
uacuagaucuuacaucugc

SEQ ID NO: 1448745 - RNA, 16 nt, Homo sapiens
uacuagcaggaauauu

SEQ ID NO: 1448746 - RNA, 22 nt, Homo sapiens
uacuaguguguguguguauaua

SEQ ID NO: 1448747 - RNA, 12 nt, Homo sapiens
uacuccugugcu

SEQ ID NO: 1448748 - RNA, 18 nt, Homo sapiens
uacucuauguaugcaucu

SEQ ID NO: 1448749 - RNA, 11 nt, Homo sapiens
uacucucaccg

SEQ ID NO: 1448750 - RNA, 14 nt, Homo sapiens
uacucuccaaccug

SEQ ID NO: 1448751 - RNA, 22 nt, Homo sapiens
uacucuggagagacugugcugg

SEQ ID NO: 1448752 - RNA, 21 nt, Homo sapiens
uacugaaagguuacccuguaa

SEQ ID NO: 1448753 - RNA, 14 nt, Homo sapiens
uacugauauuucau

SEQ ID NO: 1448754 - RNA, 13 nt, Homo sapiens
uacuuaacugugu

SEQ ID NO: 1448755 - RNA, 20 nt, Homo sapiens
uacuuaacugugugaagaaa

SEQ ID NO: 1448756 - RNA, 19 nt, Homo sapiens
uacuuaauggguacaaugu

SEQ ID NO: 1448757 - RNA, 15 nt, Homo sapiens
uacuuaggaauuucu

SEQ ID NO: 1448758 - RNA, 17 nt, Homo sapiens
uacuuauucuagauuac

SEQ ID NO: 1448759 - RNA, 15 nt, Homo sapiens
uacuucacuaaugac

SEQ ID NO: 1448760 - RNA, 19 nt, Homo sapiens
uacuuccuguguacucuuu

SEQ ID NO: 1448761 - RNA, 17 nt, Homo sapiens
uacuucggggcugggaa

SEQ ID NO: 1448762 - RNA, 22 nt, Homo sapiens
uacuucugucuuccuucauuau

SEQ ID NO: 1448763 - RNA, 18 nt, Homo sapiens
uacuugaauacucucaca

SEQ ID NO: 1448764 - RNA, 12 nt, Homo sapiens
uacuuuaccucc

SEQ ID NO: 1448765 - RNA, 21 nt, Homo sapiens
uacuuuauguauggagcucua

SEQ ID NO: 1448766 - RNA, 17 nt, Homo sapiens
uacuuucuguugccaca

SEQ ID NO: 1448767 - RNA, 17 nt, Homo sapiens
uagaaaaaucucauucc

SEQ ID NO: 1448768 - RNA, 20 nt, Homo sapiens
uagaaaagcaaagggugcua

SEQ ID NO: 1448769 - RNA, 12 nt, Homo sapiens
uagaaacacagu

SEQ ID NO: 1448770 - RNA, 17 nt, Homo sapiens
uagaaacaugacacuga

SEQ ID NO: 1448771 - RNA, 14 nt, Homo sapiens
uagaaaguucaaaa

SEQ ID NO: 1448772 - RNA, 17 nt, Homo sapiens
uagaacaaugcuauaau

SEQ ID NO: 1448773 - RNA, 16 nt, Homo sapiens
uagaacacugcauuag

SEQ ID NO: 1448774 - RNA, 17 nt, Homo sapiens
uagaaccucaccuguua

SEQ ID NO: 1448775 - RNA, 16 nt, Homo sapiens
uagaacuccaguacuc

SEQ ID NO: 1448776 - RNA, 17 nt, Homo sapiens
uagaaggccacauguca

SEQ ID NO: 1448777 - RNA, 19 nt, Homo sapiens
uagaauaaaauuguaaaau

SEQ ID NO: 1448778 - RNA, 12 nt, Homo sapiens
uagaaucuggag

SEQ ID NO: 1448779 - RNA, 14 nt, Homo sapiens
uagaaugauucccu

SEQ ID NO: 1448780 - RNA, 16 nt, Homo sapiens
uagaauggaugugcuc

SEQ ID NO: 1448781 - RNA, 12 nt, Homo sapiens
uagaauugggaa

SEQ ID NO: 1448782 - RNA, 16 nt, Homo sapiens
uagaauuuaacaugac

SEQ ID NO: 1448783 - RNA, 21 nt, Homo sapiens
uauaguggccaaauagcacau

SEQ ID NO: 1448784 - RNA, 21 nt, Homo sapiens
uauaguuuauugacaauaauu

SEQ ID NO: 1448785 - RNA, 12 nt, Homo sapiens
uauauaauacua

SEQ ID NO: 1448786 - RNA, 13 nt, Homo sapiens
uauauaguagcau

SEQ ID NO: 1448787 - RNA, 16 nt, Homo sapiens
uauauauauguguaua

SEQ ID NO: 1448788 - RNA, 15 nt, Homo sapiens
uauauaucaaggaug

SEQ ID NO: 1448789 - RNA, 16 nt, Homo sapiens
uauauauguguauaua

SEQ ID NO: 1448790 - RNA, 18 nt, Homo sapiens
uauauauguguguguaua

SEQ ID NO: 1448791 - RNA, 18 nt, Homo sapiens
uauauccacaucuaagaa

SEQ ID NO: 1448792 - RNA, 14 nt, Homo sapiens
uauaugcacauaua

SEQ ID NO: 1448793 - RNA, 14 nt, Homo sapiens
uauauguauauuaa

SEQ ID NO: 1448794 - RNA, 19 nt, Homo sapiens
uauaugucuaauucuaugu

SEQ ID NO: 1448795 - RNA, 13 nt, Homo sapiens
uauauguguauau

SEQ ID NO: 1448796 - RNA, 17 nt, Homo sapiens
uauauguguguguauau

SEQ ID NO: 1448797 - RNA, 18 nt, Homo sapiens
uauauuaaaguguuauac

SEQ ID NO: 1448798 - RNA, 19 nt, Homo sapiens
uauauuccgcacucaagga

SEQ ID NO: 1448799 - RNA, 15 nt, Homo sapiens
uauauugcugcuggu

SEQ ID NO: 1448800 - RNA, 17 nt, Homo sapiens
uauauuuccauucaugc

SEQ ID NO: 1448801 - RNA, 24 nt, Homo sapiens
uaucaaagagaaguuacauauuag

SEQ ID NO: 1448802 - RNA, 14 nt, Homo sapiens
uaucaauagucaag

SEQ ID NO: 1448803 - RNA, 14 nt, Homo sapiens
uaucaaugaagauu

SEQ ID NO: 1448804 - RNA, 15 nt, Homo sapiens
uaucaauuacagucc

SEQ ID NO: 1448805 - RNA, 14 nt, Homo sapiens
uaucaccucucuuc

SEQ ID NO: 1448806 - RNA, 14 nt, Homo sapiens
uaucacgauauuau

SEQ ID NO: 1448807 - RNA, 16 nt, Homo sapiens
uaucagaccucugauc

SEQ ID NO: 1448808 - RNA, 19 nt, Homo sapiens
uaucauuuauuuacaucua

SEQ ID NO: 1448809 - RNA, 19 nt, Homo sapiens
uauccaauaggcauuugau

SEQ ID NO: 1448810 - RNA, 16 nt, Homo sapiens
uauccacaucuaagaa

SEQ ID NO: 1448811 - RNA, 17 nt, Homo sapiens
uauccaggacucuguca

SEQ ID NO: 1448812 - RNA, 12 nt, Homo sapiens
uauccauggcaa

SEQ ID NO: 1448813 - RNA, 15 nt, Homo sapiens
uaucccagaccccuc

SEQ ID NO: 1448814 - RNA, 23 nt, Homo sapiens
uauccccaaacaccaugaaucuu

SEQ ID NO: 1448815 - RNA, 14 nt, Homo sapiens
uauccccucaaaau

SEQ ID NO: 1448816 - RNA, 22 nt, Homo sapiens
uauccugauaaacauuaaacac

SEQ ID NO: 1448817 - RNA, 15 nt, Homo sapiens
uaucgcugccuugcc

SEQ ID NO: 1448818 - RNA, 22 nt, Homo sapiens
uaucuaccaucuaaucuaugca

SEQ ID NO: 1448819 - RNA, 18 nt, Homo sapiens
uaucuaccucacuauuca

SEQ ID NO: 1448820 - RNA, 21 nt, Homo sapiens
uaucuaccugcccucucucag

SEQ ID NO: 1448821 - RNA, 20 nt, Homo sapiens
uaucuccaaaugagacacau

SEQ ID NO: 1448822 - RNA, 12 nt, Homo sapiens
uaucucucugcc

SEQ ID NO: 1448823 - RNA, 21 nt, Homo sapiens
uaucugaacacauacuagaaa

SEQ ID NO: 1448824 - RNA, 21 nt, Homo sapiens
uaucuuguucuuuaaaaucac

SEQ ID NO: 1448825 - RNA, 18 nt, Homo sapiens
uaugagcaccccuaugcc

SEQ ID NO: 1448826 - RNA, 14 nt, Homo sapiens
uaugaggcuauuaa

SEQ ID NO: 1448827 - RNA, 20 nt, Homo sapiens
uaugaugauuugcuaucaaa

SEQ ID NO: 1448828 - RNA, 20 nt, Homo sapiens
uaugcaauauaucaauguaa

SEQ ID NO: 1448829 - RNA, 14 nt, Homo sapiens
uaugcagaauguuu

SEQ ID NO: 1448830 - RNA, 22 nt, Homo sapiens
uaugcagggagcugggcuucca

SEQ ID NO: 1448831 - RNA, 17 nt, Homo sapiens
uaugcgcaauguggcau

SEQ ID NO: 1448832 - RNA, 19 nt, Homo sapiens
uauggaagaaaugggagaa

SEQ ID NO: 1448833 - RNA, 16 nt, Homo sapiens
uauggacucaguuuuc

SEQ ID NO: 1448834 - RNA, 15 nt, Homo sapiens
uauggagagcccugg

SEQ ID NO: 1448835 - RNA, 19 nt, Homo sapiens
uauggaggccucacaccca

SEQ ID NO: 1448836 - RNA, 14 nt, Homo sapiens
uauggcaagugaua

SEQ ID NO: 1448837 - RNA, 15 nt, Homo sapiens
uauggcaugauuuau

SEQ ID NO: 1448838 - RNA, 14 nt, Homo sapiens
uaugggacacugaa

SEQ ID NO: 1448839 - RNA, 16 nt, Homo sapiens
uaugggcgugaaccac

SEQ ID NO: 1448840 - RNA, 14 nt, Homo sapiens
uauguaaucucacc

SEQ ID NO: 1448841 - RNA, 12 nt, Homo sapiens
uauguaucuacc

SEQ ID NO: 1448842 - RNA, 23 nt, Homo sapiens
uauguaucuaccaucuaaucuau

SEQ ID NO: 1448843 - RNA, 22 nt, Homo sapiens
uauguaugaguggcuucuggga

SEQ ID NO: 1448844 - RNA, 14 nt, Homo sapiens
uauguaugcgugca

SEQ ID NO: 1448845 - RNA, 17 nt, Homo sapiens
uauguauuuuugucaua

SEQ ID NO: 1448846 - RNA, 17 nt, Homo sapiens
uaugugcgucucucuuu

SEQ ID NO: 1448847 - RNA, 16 nt, Homo sapiens
uaugugcuucacauaa

SEQ ID NO: 1448848 - RNA, 18 nt, Homo sapiens
uauguggcguaucaugca

SEQ ID NO: 1448849 - RNA, 19 nt, Homo sapiens
uauguuaaagcaucagaga

SEQ ID NO: 1448850 - RNA, 14 nt, Homo sapiens
uauguuugcacuuu

SEQ ID NO: 1448851 - RNA, 17 nt, Homo sapiens
uauuaacgggcauguau

SEQ ID NO: 1448852 - RNA, 23 nt, Homo sapiens
uauuaagauuuccaagugccaau

SEQ ID NO: 1448853 - RNA, 24 nt, Homo sapiens
uauuagcuguaaauacaugugugg

SEQ ID NO: 1448854 - RNA, 16 nt, Homo sapiens
uauuagcuuauauauu

SEQ ID NO: 1448855 - RNA, 16 nt, Homo sapiens
uauuaucaguggcugc

SEQ ID NO: 1448856 - RNA, 15 nt, Homo sapiens
uauuauggcaaguga

SEQ ID NO: 1448857 - RNA, 23 nt, Homo sapiens
uauuauggcaagugauaucaccu

SEQ ID NO: 1448858 - RNA, 14 nt, Homo sapiens
uauuaugucucaaa

SEQ ID NO: 1448859 - RNA, 15 nt, Homo sapiens
uauuauugagcucua

SEQ ID NO: 1448860 - RNA, 16 nt, Homo sapiens
uauuauugagcucuau

SEQ ID NO: 1448861 - RNA, 13 nt, Homo sapiens
uauuauuguggaa

SEQ ID NO: 1448862 - RNA, 14 nt, Homo sapiens
ucacaacagaucaa

SEQ ID NO: 1448863 - RNA, 18 nt, Homo sapiens
ucacaaccaccuaaucag

SEQ ID NO: 1448864 - RNA, 15 nt, Homo sapiens
ucacaagaagaccag

SEQ ID NO: 1448865 - RNA, 16 nt, Homo sapiens
ucacaagaagaccaga

SEQ ID NO: 1448866 - RNA, 18 nt, Homo sapiens
ucacaagaaucaccucaa

SEQ ID NO: 1448867 - RNA, 16 nt, Homo sapiens
ucacaagcaauaauua

SEQ ID NO: 1448868 - RNA, 18 nt, Homo sapiens
ucacaaggcaacugugag

SEQ ID NO: 1448869 - RNA, 20 nt, Homo sapiens
ucacaauaauauauccacau

SEQ ID NO: 1448870 - RNA, 18 nt, Homo sapiens
ucacaauagauuucucaa

SEQ ID NO: 1448871 - RNA, 13 nt, Homo sapiens
ucacaaugaaaug

SEQ ID NO: 1448872 - RNA, 16 nt, Homo sapiens
ucaguccccauggcac

SEQ ID NO: 1448873 - RNA, 17 nt, Homo sapiens
ucagugaaaaauaauua

SEQ ID NO: 1448874 - RNA, 13 nt, Homo sapiens
ucaguuaacauua

SEQ ID NO: 1448875 - RNA, 18 nt, Homo sapiens
ucaguuacucagcccugg

SEQ ID NO: 1448876 - RNA, 17 nt, Homo sapiens
ucaguuccucuuugcau

SEQ ID NO: 1448877 - RNA, 18 nt, Homo sapiens
ucaguuguuccuacucag

SEQ ID NO: 1448878 - RNA, 14 nt, Homo sapiens
ucaguuguuuuccc

SEQ ID NO: 1448879 - RNA, 14 nt, Homo sapiens
ucauacaaugacaa

SEQ ID NO: 1448880 - RNA, 16 nt, Homo sapiens
ucauaccuaucaucuu

SEQ ID NO: 1448881 - RNA, 20 nt, Homo sapiens
ucauaugaaaaaaaugcauu

SEQ ID NO: 1448882 - RNA, 14 nt, Homo sapiens
ucauauuuuguaua

SEQ ID NO: 1448883 - RNA, 20 nt, Homo sapiens
ucauauuuuguauauaucug

SEQ ID NO: 1448884 - RNA, 20 nt, Homo sapiens
ucaucaaauauuaccaaaaa

SEQ ID NO: 1448885 - RNA, 19 nt, Homo sapiens
ucaucacuggaugaagauu

SEQ ID NO: 1448886 - RNA, 22 nt, Homo sapiens
ucaucagaagauaacuugagca

SEQ ID NO: 1448887 - RNA, 20 nt, Homo sapiens
ucaucaggcuuggaaugaau

SEQ ID NO: 1448888 - RNA, 22 nt, Homo sapiens
ucaucaggcuuggaaugaauuc

SEQ ID NO: 1448889 - RNA, 14 nt, Homo sapiens
ucaucaggucauua

SEQ ID NO: 1448890 - RNA, 18 nt, Homo sapiens
ucaucauacaugacucag

SEQ ID NO: 1448891 - RNA, 19 nt, Homo sapiens
ucaucauguuggccaggcu

SEQ ID NO: 1448892 - RNA, 20 nt, Homo sapiens
ucaucuacaagcauuugccc

SEQ ID NO: 1448893 - RNA, 16 nt, Homo sapiens
ucaucuacuacagggu

SEQ ID NO: 1448894 - RNA, 19 nt, Homo sapiens
ucaucuccuuuauugcagu

SEQ ID NO: 1448895 - RNA, 14 nt, Homo sapiens
ucaugacuuuucca

SEQ ID NO: 1448896 - RNA, 20 nt, Homo sapiens
ucaugcaagugcuaugccaa

SEQ ID NO: 1448897 - RNA, 23 nt, Homo sapiens
ucaugcucagcccugacuggugc

SEQ ID NO: 1448898 - RNA, 16 nt, Homo sapiens
ucauggaaaagcccag

SEQ ID NO: 1448899 - RNA, 15 nt, Homo sapiens
ucaugugauccuuuu

SEQ ID NO: 1448900 - RNA, 14 nt, Homo sapiens
ucaugugugcaugu

SEQ ID NO: 1448901 - RNA, 15 nt, Homo sapiens
ucauguuccucaaaa

SEQ ID NO: 1448902 - RNA, 15 nt, Homo sapiens
ucauuacuaaccaua

SEQ ID NO: 1448903 - RNA, 22 nt, Homo sapiens
ucauuauuuuuuacaauggcca

SEQ ID NO: 1448904 - RNA, 20 nt, Homo sapiens
ucauucagguauuuguaaua

SEQ ID NO: 1448905 - RNA, 15 nt, Homo sapiens
ucauuccuucacuca

SEQ ID NO: 1448906 - RNA, 17 nt, Homo sapiens
ucauucgccugugggaa

SEQ ID NO: 1448907 - RNA, 16 nt, Homo sapiens
ucauucuuugaaggau

SEQ ID NO: 1448908 - RNA, 17 nt, Homo sapiens
ucauuguagaaacacag

SEQ ID NO: 1448909 - RNA, 14 nt, Homo sapiens
ucauugucugugga

SEQ ID NO: 1448910 - RNA, 21 nt, Homo sapiens
ucauuuauucuucuuuuccaa

SEQ ID NO: 1448911 - RNA, 20 nt, Homo sapiens
ucauuuuaaaaaauggaaca

SEQ ID NO: 1448912 - RNA, 16 nt, Homo sapiens
ucauuuugagucucag

SEQ ID NO: 1448913 - RNA, 23 nt, Homo sapiens
ucauuuuuuucacuggaguuaca

SEQ ID NO: 1448914 - RNA, 20 nt, Homo sapiens
uccaaauaaggauuuguuca

SEQ ID NO: 1448915 - RNA, 19 nt, Homo sapiens
uccaaaugauuuucaucaa

SEQ ID NO: 1448916 - RNA, 23 nt, Homo sapiens
uccaacagaguuauuuauuggcu

SEQ ID NO: 1448917 - RNA, 19 nt, Homo sapiens
uccaacagugagucuguca

SEQ ID NO: 1448918 - RNA, 16 nt, Homo sapiens
uccaagucaacacucu

SEQ ID NO: 1448919 - RNA, 20 nt, Homo sapiens
uccaaguuccugcacuccag

SEQ ID NO: 1448920 - RNA, 16 nt, Homo sapiens
uccaaugcauugcuaa

SEQ ID NO: 1448921 - RNA, 19 nt, Homo sapiens
uccaauggaauacugaaaa

SEQ ID NO: 1448922 - RNA, 12 nt, Homo sapiens
uccaauugaacu

SEQ ID NO: 1448923 - RNA, 20 nt, Homo sapiens
uccaauugaacuuucacaua

SEQ ID NO: 1448924 - RNA, 20 nt, Homo sapiens
uccacaagauucccagagac

SEQ ID NO: 1448925 - RNA, 19 nt, Homo sapiens
uccacaccaaagucaggga

SEQ ID NO: 1448926 - RNA, 20 nt, Homo sapiens
uccacaccuagcaucucaug

SEQ ID NO: 1448927 - RNA, 16 nt, Homo sapiens
uccacaccuggucuga

SEQ ID NO: 1448928 - RNA, 19 nt, Homo sapiens
uccacagaauacaagccac

SEQ ID NO: 1448929 - RNA, 14 nt, Homo sapiens
uccacaucuucuca

SEQ ID NO: 1448930 - RNA, 19 nt, Homo sapiens
uccaccauucacauuugau

SEQ ID NO: 1448931 - RNA, 20 nt, Homo sapiens
uccaccccacuggaucuuca

SEQ ID NO: 1448932 - RNA, 14 nt, Homo sapiens
uccacccuaucccu

SEQ ID NO: 1448933 - RNA, 18 nt, Homo sapiens
uccaccgcagaaggaagg

SEQ ID NO: 1448934 - RNA, 13 nt, Homo sapiens
uccaccuaccugc

SEQ ID NO: 1448935 - RNA, 15 nt, Homo sapiens
uccacgagcuauauu

SEQ ID NO: 1448936 - RNA, 16 nt, Homo sapiens
uccacgcacacaugga

SEQ ID NO: 1448937 - RNA, 20 nt, Homo sapiens
uccacgggucucacuuauac

SEQ ID NO: 1448938 - RNA, 13 nt, Homo sapiens
uccacucacucca

SEQ ID NO: 1448939 - RNA, 15 nt, Homo sapiens
uccacucagcaguaa

SEQ ID NO: 1448940 - RNA, 21 nt, Homo sapiens
uccacuuaccuagauucuaca

SEQ ID NO: 1448941 - RNA, 22 nt, Homo sapiens
uccacuuaccuagauucuacau

SEQ ID NO: 1448942 - RNA, 11 nt, Homo sapiens
uccacuuagaa

SEQ ID NO: 1448943 - RNA, 15 nt, Homo sapiens
uccagacauacgaaa

SEQ ID NO: 1448944 - RNA, 22 nt, Homo sapiens
uccagacccugccugagcccag

SEQ ID NO: 1448945 - RNA, 19 nt, Homo sapiens
ugaaacuucauaaauguuc

SEQ ID NO: 1448946 - RNA, 17 nt, Homo sapiens
ugaaagaaucagucuug

SEQ ID NO: 1448947 - RNA, 17 nt, Homo sapiens
ugaaagaguagugcauu

SEQ ID NO: 1448948 - RNA, 18 nt, Homo sapiens
ugaaagaguagugcauuu

SEQ ID NO: 1448949 - RNA, 19 nt, Homo sapiens
ugaaagaugcaagcaccug

SEQ ID NO: 1448950 - RNA, 22 nt, Homo sapiens
ugaaaggaagcuccacugucac

SEQ ID NO: 1448951 - RNA, 23 nt, Homo sapiens
ugaaaguaugugauaucugaaca

SEQ ID NO: 1448952 - RNA, 19 nt, Homo sapiens
ugaaauaauuaaaaaccac

SEQ ID NO: 1448953 - RNA, 20 nt, Homo sapiens
ugaaaucuuugcagcaauga

SEQ ID NO: 1448954 - RNA, 11 nt, Homo sapiens
ugaaaugcuag

SEQ ID NO: 1448955 - RNA, 14 nt, Homo sapiens
ugaaaugggcuuua

SEQ ID NO: 1448956 - RNA, 15 nt, Homo sapiens
ugaaauugaugccag

SEQ ID NO: 1448957 - RNA, 20 nt, Homo sapiens
ugaacaaaaaaaacaaaaag

SEQ ID NO: 1448958 - RNA, 17 nt, Homo sapiens
ugaacaauucucucuua

SEQ ID NO: 1448959 - RNA, 20 nt, Homo sapiens
ugaacacaauugauacuuca

SEQ ID NO: 1448960 - RNA, 14 nt, Homo sapiens
ugaacacacaugga

SEQ ID NO: 1448961 - RNA, 17 nt, Homo sapiens
ugaacacacauggaugc

SEQ ID NO: 1448962 - RNA, 14 nt, Homo sapiens
ugaacacaucagcu

SEQ ID NO: 1448963 - RNA, 15 nt, Homo sapiens
ugaacaccacuuugu

SEQ ID NO: 1448964 - RNA, 18 nt, Homo sapiens
ugaacauugucuggauac

SEQ ID NO: 1448965 - RNA, 13 nt, Homo sapiens
ugaaccaaagaga

SEQ ID NO: 1448966 - RNA, 13 nt, Homo sapiens
ugaaccauuacug

SEQ ID NO: 1448967 - RNA, 13 nt, Homo sapiens
ugaacugcugauu

SEQ ID NO: 1448968 - RNA, 14 nt, Homo sapiens
ugaacuguccuucc

SEQ ID NO: 1448969 - RNA, 22 nt, Homo sapiens
ugaacuuuccaaaaccuaaaga

SEQ ID NO: 1448970 - RNA, 20 nt, Homo sapiens
ugaagaaaagcacuuuuuaa

SEQ ID NO: 1448971 - RNA, 17 nt, Homo sapiens
ugaagaaaggaacugag

SEQ ID NO: 1448972 - RNA, 21 nt, Homo sapiens
ugaagaacaucccaagccaga

SEQ ID NO: 1448973 - RNA, 13 nt, Homo sapiens
ugaagacauucca

SEQ ID NO: 1448974 - RNA, 15 nt, Homo sapiens
ugaagaccacaucca

SEQ ID NO: 1448975 - RNA, 20 nt, Homo sapiens
ugaagacccuggaguucaaa

SEQ ID NO: 1448976 - RNA, 21 nt, Homo sapiens
ugaagagauuucaacauauca

SEQ ID NO: 1448977 - RNA, 17 nt, Homo sapiens
ugaagaguaguuuacua

SEQ ID NO: 1448978 - RNA, 20 nt, Homo sapiens
ugaagauucuccugugcuag

SEQ ID NO: 1448979 - RNA, 17 nt, Homo sapiens
ugaagccacugccuuca

SEQ ID NO: 1448980 - RNA, 15 nt, Homo sapiens
ugaagccagauccac

SEQ ID NO: 1448981 - RNA, 18 nt, Homo sapiens
ugaagccccuuguccucu

SEQ ID NO: 1448982 - RNA, 21 nt, Homo sapiens
ugaagcugacagcacuacaaa

SEQ ID NO: 1448983 - RNA, 20 nt, Homo sapiens
ugaagcuucacucacuguca

SEQ ID NO: 1448984 - RNA, 14 nt, Homo sapiens
ugaaggcgugcaag

SEQ ID NO: 1448985 - RNA, 17 nt, Homo sapiens
ugaagguggggccagug

SEQ ID NO: 1448986 - RNA, 15 nt, Homo sapiens
ugaaguauuucucac

SEQ ID NO: 1448987 - RNA, 12 nt, Homo sapiens
ugaagugcaaau

SEQ ID NO: 1448988 - RNA, 15 nt, Homo sapiens
ugaauaaaaacccug

SEQ ID NO: 1448989 - RNA, 21 nt, Homo sapiens
ugaauaaagccugcuuuuuaa

SEQ ID NO: 1448990 - RNA, 19 nt, Homo sapiens
ugaaucccauaucuaccca

SEQ ID NO: 1448991 - RNA, 19 nt, Homo sapiens
ugaaugccucaaugugacc

SEQ ID NO: 1448992 - RNA, 11 nt, Homo sapiens
ugaaugcucaa

SEQ ID NO: 1448993 - RNA, 18 nt, Homo sapiens
ugaauguauaaagacacc

SEQ ID NO: 1448994 - RNA, 18 nt, Homo sapiens
ugaauuggauacaaggau

SEQ ID NO: 1448995 - RNA, 17 nt, Homo sapiens
ugaauuugccuuccuca

SEQ ID NO: 1448996 - RNA, 19 nt, Homo sapiens
ugacaacaucccacagugg

SEQ ID NO: 1448997 - RNA, 15 nt, Homo sapiens
ugacaagauggaaaa

SEQ ID NO: 1448998 - RNA, 23 nt, Homo sapiens
ugacaauaugauuuuaaauuuga

SEQ ID NO: 1448999 - RNA, 20 nt, Homo sapiens
ugacaccgucccucagugau

SEQ ID NO: 1449000 - RNA, 15 nt, Homo sapiens
ugacacgguaggcca

SEQ ID NO: 1449001 - RNA, 17 nt, Homo sapiens
ugacagcaggugggaaa

SEQ ID NO: 1449002 - RNA, 21 nt, Homo sapiens
ugacagccuccgucagacucc

SEQ ID NO: 1449003 - RNA, 20 nt, Homo sapiens
ugacaggccauccauucaca

SEQ ID NO: 1449004 - RNA, 12 nt, Homo sapiens
ugacaguauauu

SEQ ID NO: 1449005 - RNA, 21 nt, Homo sapiens
ugacaguauauuugaaacugu

SEQ ID NO: 1449006 - RNA, 19 nt, Homo sapiens
ugacaucuccucuaucaca

SEQ ID NO: 1449007 - RNA, 15 nt, Homo sapiens
ugacaugcacugacc

SEQ ID NO: 1449008 - RNA, 17 nt, Homo sapiens
ugacaugcaucaucuca

SEQ ID NO: 1449009 - RNA, 14 nt, Homo sapiens
ugacaugccaucca

SEQ ID NO: 1449010 - RNA, 15 nt, Homo sapiens
ugacaugucucacag

SEQ ID NO: 1449011 - RNA, 13 nt, Homo sapiens
ugacauuaagaca

SEQ ID NO: 1449012 - RNA, 23 nt, Homo sapiens
ugacauucacccuucaacauaaa

SEQ ID NO: 1449013 - RNA, 15 nt, Homo sapiens
ugacauuguauguau

SEQ ID NO: 1449014 - RNA, 16 nt, Homo sapiens
ugacauuguauguauc

SEQ ID NO: 1449015 - RNA, 20 nt, Homo sapiens
ugaccaagagagaaagaagu

SEQ ID NO: 1449016 - RNA, 16 nt, Homo sapiens
ugaccaucgcaaccag

SEQ ID NO: 1449017 - RNA, 13 nt, Homo sapiens
ugacccaaagacc

SEQ ID NO: 1449018 - RNA, 15 nt, Homo sapiens
ugacccacccagugu

SEQ ID NO: 1449019 - RNA, 20 nt, Homo sapiens
ugacccacucacacuuggag

SEQ ID NO: 1449020 - RNA, 16 nt, Homo sapiens
ugacccuccaccgcag

SEQ ID NO: 1449021 - RNA, 19 nt, Homo sapiens
ugaccuaaccuaagcaaaa

SEQ ID NO: 1449022 - RNA, 19 nt, Homo sapiens
ugaccuaguaaacuuugua

SEQ ID NO: 1449023 - RNA, 22 nt, Homo sapiens
ugaccugaggcuccugugcuac

SEQ ID NO: 1449024 - RNA, 20 nt, Homo sapiens
ugaccugcugugcaccuuac

SEQ ID NO: 1449025 - RNA, 22 nt, Homo sapiens
ugaccugcugugcaccuuacau

SEQ ID NO: 1449026 - RNA, 12 nt, Homo sapiens
ugacuaccagcu

SEQ ID NO: 1449027 - RNA, 17 nt, Homo sapiens
ugacuaucacauacaau

SEQ ID NO: 1449028 - RNA, 18 nt, Homo sapiens
ugacucagcauaccugcu

SEQ ID NO: 1449029 - RNA, 13 nt, Homo sapiens
ugacucgguguaa

SEQ ID NO: 1449030 - RNA, 16 nt, Homo sapiens
uauuauuuuuuccaca

SEQ ID NO: 1449031 - RNA, 15 nt, Homo sapiens
uauucaaggaucuca

SEQ ID NO: 1449032 - RNA, 21 nt, Homo sapiens
uauucagauauaaaacaguuu

SEQ ID NO: 1449033 - RNA, 23 nt, Homo sapiens
uauucauucauuuacucauucau

SEQ ID NO: 1449034 - RNA, 21 nt, Homo sapiens
uauuccacuggcgcaucauau

SEQ ID NO: 1449035 - RNA, 16 nt, Homo sapiens
uauucccaacugcucu

SEQ ID NO: 1449036 - RNA, 14 nt, Homo sapiens
uauucccuguuaaa

SEQ ID NO: 1449037 - RNA, 12 nt, Homo sapiens
uauuccuaucug

SEQ ID NO: 1449038 - RNA, 14 nt, Homo sapiens
ugacugaaacauuc

SEQ ID NO: 1449039 - RNA, 15 nt, Homo sapiens
ugacugaaacauuca

SEQ ID NO: 1449040 - RNA, 14 nt, Homo sapiens
ugacugaaaccacu

SEQ ID NO: 1449041 - RNA, 21 nt, Homo sapiens
ugacuggcacccaauguuuga

SEQ ID NO: 1449042 - RNA, 20 nt, Homo sapiens
ugacuuccucgccucuccca

SEQ ID NO: 1449043 - RNA, 22 nt, Homo sapiens
ugacuucugccccagcuuuauc

SEQ ID NO: 1449044 - RNA, 21 nt, Homo sapiens
ugagaaacaugaauuauuucc

SEQ ID NO: 1449045 - RNA, 16 nt, Homo sapiens
ugagaaacugauuuau

SEQ ID NO: 1449046 - RNA, 18 nt, Homo sapiens
ugagaaagacuauucaaa

SEQ ID NO: 1449047 - RNA, 18 nt, Homo sapiens
ugagaaggagucagaaac

SEQ ID NO: 1449048 - RNA, 17 nt, Homo sapiens
ugagacuauaacuguca

SEQ ID NO: 1449049 - RNA, 14 nt, Homo sapiens
ugagagacccaagg

SEQ ID NO: 1449050 - RNA, 19 nt, Homo sapiens
ugagaucuccacggucaga

SEQ ID NO: 1449051 - RNA, 16 nt, Homo sapiens
ugagaucuuacaggua

SEQ ID NO: 1449052 - RNA, 17 nt, Homo sapiens
ugagaugggacauucca

SEQ ID NO: 1449053 - RNA, 14 nt, Homo sapiens
ugagauugccccua

SEQ ID NO: 1449054 - RNA, 17 nt, Homo sapiens
ugagcaccgucauggcu

SEQ ID NO: 1449055 - RNA, 14 nt, Homo sapiens
ugagcacugccagg

SEQ ID NO: 1449056 - RNA, 22 nt, Homo sapiens
ugagccuucugaugagacugca

SEQ ID NO: 1449057 - RNA, 13 nt, Homo sapiens
ugagcgcuguguu

SEQ ID NO: 1449058 - RNA, 14 nt, Homo sapiens
ugagcgcuguguua

SEQ ID NO: 1449059 - RNA, 20 nt, Homo sapiens
ugagcugaagacaaaccacu

SEQ ID NO: 1449060 - RNA, 12 nt, Homo sapiens
ugaggacaaaga

SEQ ID NO: 1449061 - RNA, 20 nt, Homo sapiens
ugaggagagaaggacaugug

SEQ ID NO: 1449062 - RNA, 15 nt, Homo sapiens
ugcaucagcugcuga

SEQ ID NO: 1449063 - RNA, 19 nt, Homo sapiens
ugcauccccuuggcuguga

SEQ ID NO: 1449064 - RNA, 18 nt, Homo sapiens
ugcauccguaguucccug

SEQ ID NO: 1449065 - RNA, 15 nt, Homo sapiens
ugcaugaccugauca

SEQ ID NO: 1449066 - RNA, 21 nt, Homo sapiens
ugcaugaccugaucauuacau

SEQ ID NO: 1449067 - RNA, 14 nt, Homo sapiens
ugcauggaauuugu

SEQ ID NO: 1449068 - RNA, 16 nt, Homo sapiens
ugcauucccagugguc

SEQ ID NO: 1449069 - RNA, 23 nt, Homo sapiens
ugcauuuauaaauguguggugcu

SEQ ID NO: 1449070 - RNA, 23 nt, Homo sapiens
ugcauuugucaaagcauugagau

SEQ ID NO: 1449071 - RNA, 21 nt, Homo sapiens
ugcauuuucccagauacuucc

SEQ ID NO: 1449072 - RNA, 18 nt, Homo sapiens
ugccaagaaaguauuugg

SEQ ID NO: 1449073 - RNA, 16 nt, Homo sapiens
ugccaaugcacgcaca

SEQ ID NO: 1449074 - RNA, 14 nt, Homo sapiens
ugccacaaugccuc

SEQ ID NO: 1449075 - RNA, 14 nt, Homo sapiens
ugccacucauuccu

SEQ ID NO: 1449076 - RNA, 14 nt, Homo sapiens
ugccacuucccaga

SEQ ID NO: 1449077 - RNA, 17 nt, Homo sapiens
ugccacuugacauuccu

SEQ ID NO: 1449078 - RNA, 12 nt, Homo sapiens
ugccacuuugca

SEQ ID NO: 1449079 - RNA, 22 nt, Homo sapiens
ugccacuuuucaugucauuuga

SEQ ID NO: 1449080 - RNA, 18 nt, Homo sapiens
ugccagacuuaaaucaca

SEQ ID NO: 1449081 - RNA, 21 nt, Homo sapiens
ugccagagcccaagugccauc

SEQ ID NO: 1449082 - RNA, 15 nt, Homo sapiens
ugccagcucagguga

SEQ ID NO: 1449083 - RNA, 18 nt, Homo sapiens
ugccaggcuguaagcauu

SEQ ID NO: 1449084 - RNA, 19 nt, Homo sapiens
ugccaguggaauacaguga

SEQ ID NO: 1449085 - RNA, 14 nt, Homo sapiens
ugccauaaagccau

SEQ ID NO: 1449086 - RNA, 15 nt, Homo sapiens
ugccaugccucaaga

SEQ ID NO: 1449087 - RNA, 18 nt, Homo sapiens
ugccaugguuaccgagga

SEQ ID NO: 1449088 - RNA, 18 nt, Homo sapiens
ugccauguuuagauucca

SEQ ID NO: 1449089 - RNA, 22 nt, Homo sapiens
ugccauucagucuagcuuuuaa

SEQ ID NO: 1449090 - RNA, 18 nt, Homo sapiens
ugccauucccacuaagcu

SEQ ID NO: 1449091 - RNA, 15 nt, Homo sapiens
ugcccacucuaauau

SEQ ID NO: 1449092 - RNA, 19 nt, Homo sapiens
ugcccacucuaauauucaa

SEQ ID NO: 1449093 - RNA, 21 nt, Homo sapiens
ugcccagaauucccagcuguc

SEQ ID NO: 1449094 - RNA, 19 nt, Homo sapiens
ugcccagagaaucagggca

SEQ ID NO: 1449095 - RNA, 15 nt, Homo sapiens
ugcccaucauacgca

SEQ ID NO: 1449096 - RNA, 22 nt, Homo sapiens
ugcccauuguccuuaccguccu

SEQ ID NO: 1449097 - RNA, 15 nt, Homo sapiens
ugccccagcuuuauc

SEQ ID NO: 1449098 - RNA, 18 nt, Homo sapiens
ugccccgccuccccgaaa

SEQ ID NO: 1449099 - RNA, 18 nt, Homo sapiens
ugccccuuccacuuugag

SEQ ID NO: 1449100 - RNA, 17 nt, Homo sapiens
ugcccgaccccaucuca

SEQ ID NO: 1449101 - RNA, 18 nt, Homo sapiens
ugcccgaccccaucucau

SEQ ID NO: 1449102 - RNA, 22 nt, Homo sapiens
ugcccucuccuuccuuacccaa

SEQ ID NO: 1449103 - RNA, 23 nt, Homo sapiens
ugcccugcgaaguggcucucagg

SEQ ID NO: 1449104 - RNA, 22 nt, Homo sapiens
ugcccuuggccugaagucccag

SEQ ID NO: 1449105 - RNA, 20 nt, Homo sapiens
ugcccuugggguaagccaga

SEQ ID NO: 1449106 - RNA, 16 nt, Homo sapiens
ugccgagccuaaugaa

SEQ ID NO: 1449107 - RNA, 14 nt, Homo sapiens
ugccgugacagggc

SEQ ID NO: 1449108 - RNA, 14 nt, Homo sapiens
ugccuaccccaaga

SEQ ID NO: 1449109 - RNA, 19 nt, Homo sapiens
ugccuaggguccuguccau

SEQ ID NO: 1449110 - RNA, 14 nt, Homo sapiens
ugccucagccuccc

SEQ ID NO: 1449111 - RNA, 15 nt, Homo sapiens
ugccucauaccccac

SEQ ID NO: 1449112 - RNA, 15 nt, Homo sapiens
ugccuccagcacucc

SEQ ID NO: 1449113 - RNA, 15 nt, Homo sapiens
ugccucuaccuggac

SEQ ID NO: 1449114 - RNA, 14 nt, Homo sapiens
ugccucuccccaaa

SEQ ID NO: 1449115 - RNA, 14 nt, Homo sapiens
ugccucucucagga

SEQ ID NO: 1449116 - RNA, 15 nt, Homo sapiens
ugccucuguauuuaa

SEQ ID NO: 1449117 - RNA, 15 nt, Homo sapiens
ugccucuucuuuaug

SEQ ID NO: 1449118 - RNA, 19 nt, Homo sapiens
ugccugggccugugcagca

SEQ ID NO: 1449119 - RNA, 23 nt, Homo sapiens
ugccuggguuuucuaacuguaaa

SEQ ID NO: 1449120 - RNA, 16 nt, Homo sapiens
ugccugugaucccagc

SEQ ID NO: 1449121 - RNA, 15 nt, Homo sapiens
uggccuucaguguac

SEQ ID NO: 1449122 - RNA, 23 nt, Homo sapiens
uggccuugugucagagcugggag

SEQ ID NO: 1449123 - RNA, 16 nt, Homo sapiens
uggcgcaucauaugca

SEQ ID NO: 1449124 - RNA, 14 nt, Homo sapiens
uggcgccagggcca

SEQ ID NO: 1449125 - RNA, 21 nt, Homo sapiens
uggcuauaacaugucuuucag

SEQ ID NO: 1449126 - RNA, 17 nt, Homo sapiens
uggcucacuacagccuc

SEQ ID NO: 1449127 - RNA, 15 nt, Homo sapiens
uggcucucagaaggu

SEQ ID NO: 1449128 - RNA, 14 nt, Homo sapiens
uggcugcugugcua

SEQ ID NO: 1449129 - RNA, 18 nt, Homo sapiens
uggcuguccccagcaccu

SEQ ID NO: 1449130 - RNA, 18 nt, Homo sapiens
uggcuguuauucuuccac

SEQ ID NO: 1449131 - RNA, 21 nt, Homo sapiens
uggcuucugugcacuagccug

SEQ ID NO: 1449132 - RNA, 17 nt, Homo sapiens
uggcuucuguugcgcca

SEQ ID NO: 1449133 - RNA, 11 nt, Homo sapiens
uggcuucuuac

SEQ ID NO: 1449134 - RNA, 14 nt, Homo sapiens
uggcuugacuggau

SEQ ID NO: 1449135 - RNA, 14 nt, Homo sapiens
ugggaaagcauugu

SEQ ID NO: 1449136 - RNA, 22 nt, Homo sapiens
ugggaaaggaaaaccagggaua

SEQ ID NO: 1449137 - RNA, 19 nt, Homo sapiens
ugggaagaaagaaugcaag

SEQ ID NO: 1449138 - RNA, 13 nt, Homo sapiens
ugggacagaggag

SEQ ID NO: 1449139 - RNA, 14 nt, Homo sapiens
ugggaccugugauc

SEQ ID NO: 1449140 - RNA, 19 nt, Homo sapiens
ugggaccuguguucuugcu

SEQ ID NO: 1449141 - RNA, 21 nt, Homo sapiens
ugggagccugacagugcccag

SEQ ID NO: 1449142 - RNA, 16 nt, Homo sapiens
ugggaguagcauggac

SEQ ID NO: 1449143 - RNA, 19 nt, Homo sapiens
ugggaucgcaccuuuuaua

SEQ ID NO: 1449144 - RNA, 16 nt, Homo sapiens
ugggcaaugaaaccaa

SEQ ID NO: 1449145 - RNA, 13 nt, Homo sapiens
ugggcaccucuag

SEQ ID NO: 1449146 - RNA, 21 nt, Homo sapiens
ugggcaccuuccuaauaugcu

SEQ ID NO: 1449147 - RNA, 13 nt, Homo sapiens
ugggcacugggau

SEQ ID NO: 1449148 - RNA, 18 nt, Homo sapiens
ugggcagcugucauggaa

SEQ ID NO: 1449149 - RNA, 21 nt, Homo sapiens
ugggccagcugucgcaucuca

SEQ ID NO: 1449150 - RNA, 16 nt, Homo sapiens
ugggccuccaaagccc

SEQ ID NO: 1449151 - RNA, 19 nt, Homo sapiens
ugggccugcugcugagaac

SEQ ID NO: 1449152 - RNA, 14 nt, Homo sapiens
ugggcuuccagaaa

SEQ ID NO: 1449153 - RNA, 21 nt, Homo sapiens
ugggcuuguagaccacugucc

SEQ ID NO: 1449154 - RNA, 21 nt, Homo sapiens
uggggagaccucuacugccuu

SEQ ID NO: 1449155 - RNA, 13 nt, Homo sapiens
uggggaucugcau

SEQ ID NO: 1449156 - RNA, 20 nt, Homo sapiens
ugggguucaucuagggacac

SEQ ID NO: 1449157 - RNA, 17 nt, Homo sapiens
ugggucaagggccaguc

SEQ ID NO: 1449158 - RNA, 20 nt, Homo sapiens
ugggugccgggcugcacaga

SEQ ID NO: 1449159 - RNA, 21 nt, Homo sapiens
uggguggggcugcuccuccag

SEQ ID NO: 1449160 - RNA, 18 nt, Homo sapiens
uggguuuucuaacuguaa

SEQ ID NO: 1449161 - RNA, 23 nt, Homo sapiens
ugguaacacaaauuuucaccugc

SEQ ID NO: 1449162 - RNA, 15 nt, Homo sapiens
ugguauuaauacugc

SEQ ID NO: 1449163 - RNA, 16 nt, Homo sapiens
ugguccccacagccuc

SEQ ID NO: 1449164 - RNA, 21 nt, Homo sapiens
uggucuucacugccaugccuc

SEQ ID NO: 1449165 - RNA, 20 nt, Homo sapiens
uggucuuguggaauugggag

SEQ ID NO: 1449166 - RNA, 20 nt, Homo sapiens
uggugaagaacaucccaagc

SEQ ID NO: 1449167 - RNA, 19 nt, Homo sapiens
uggugacaugugccuguaa

SEQ ID NO: 1449168 - RNA, 12 nt, Homo sapiens
uggugacugucc

SEQ ID NO: 1449169 - RNA, 14 nt, Homo sapiens
uggugaucagugca

SEQ ID NO: 1449170 - RNA, 13 nt, Homo sapiens
uggugucaggcag

SEQ ID NO: 1449171 - RNA, 23 nt, Homo sapiens
ugguuacagcccagacuuuacca

SEQ ID NO: 1449172 - RNA, 16 nt, Homo sapiens
ugguuacucuggugcu

SEQ ID NO: 1449173 - RNA, 22 nt, Homo sapiens
ugguuagccuuaguuucucaga

SEQ ID NO: 1449174 - RNA, 15 nt, Homo sapiens
ugguuccuaagccug

SEQ ID NO: 1449175 - RNA, 14 nt, Homo sapiens
ugguugacauugua

SEQ ID NO: 1449176 - RNA, 21 nt, Homo sapiens
cuuuucaguguuuuuucacuu

SEQ ID NO: 1449177 - RNA, 16 nt, Homo sapiens
cuuuucugugucauac

SEQ ID NO: 1449178 - RNA, 13 nt, Homo sapiens
cuuuugaccaaau

SEQ ID NO: 1449179 - RNA, 15 nt, Homo sapiens
cuuuugaccaaauaa

SEQ ID NO: 1449180 - RNA, 23 nt, Homo sapiens
cuuuugaccaaauaaaguaccau

SEQ ID NO: 1449181 - RNA, 11 nt, Homo sapiens
cuuuuucacac

SEQ ID NO: 1449182 - RNA, 14 nt, Homo sapiens
cuuuuucuaccuuu

SEQ ID NO: 1449183 - RNA, 13 nt, Homo sapiens
cuuuuugaucuca

SEQ ID NO: 1449184 - RNA, 19 nt, Homo sapiens
cuuuuugggagaaugaugu

SEQ ID NO: 1449185 - RNA, 14 nt, Homo sapiens
cuuuuuuucuuugg

SEQ ID NO: 1449186 - RNA, 18 nt, Homo sapiens
gaaaaaaaauaauagaaa

SEQ ID NO: 1449187 - RNA, 17 nt, Homo sapiens
gaaaaaaaguacaugua

SEQ ID NO: 1449188 - RNA, 22 nt, Homo sapiens
gaaaaaacuagagccugugcua

SEQ ID NO: 1449189 - RNA, 19 nt, Homo sapiens
gaaaaaaguuuugaugaaa

SEQ ID NO: 1449190 - RNA, 18 nt, Homo sapiens
gaaaaacauuccaggaaa

SEQ ID NO: 1449191 - RNA, 19 nt, Homo sapiens
gaaaaacauuccaggaaac

SEQ ID NO: 1449192 - RNA, 16 nt, Homo sapiens
gaaaaacuuuguuaua

SEQ ID NO: 1449193 - RNA, 22 nt, Homo sapiens
gaaaaaggccaguggaaauuca

SEQ ID NO: 1449194 - RNA, 22 nt, Homo sapiens
gaaaaaugggaacaaggcaaug

SEQ ID NO: 1449195 - RNA, 14 nt, Homo sapiens
gaaaacaaacccag

SEQ ID NO: 1449196 - RNA, 12 nt, Homo sapiens
gaaaacauaugc

SEQ ID NO: 1449197 - RNA, 12 nt, Homo sapiens
gaaaacaugacu

SEQ ID NO: 1449198 - RNA, 13 nt, Homo sapiens
gaaaacaugacuu

SEQ ID NO: 1449199 - RNA, 22 nt, Homo sapiens
gaaaaccucauuuaccauaaaa

SEQ ID NO: 1449200 - RNA, 23 nt, Homo sapiens
gaaaagaacacuagagucuguca

SEQ ID NO: 1449201 - RNA, 19 nt, Homo sapiens
gaaaagaccaguccaugag

SEQ ID NO: 1449202 - RNA, 19 nt, Homo sapiens
gaaaagguucuucaucccu

SEQ ID NO: 1449203 - RNA, 22 nt, Homo sapiens
gaaaaguggauggaagugucug

SEQ ID NO: 1449204 - RNA, 20 nt, Homo sapiens
gaaaauauauuuaauaccuu

SEQ ID NO: 1449205 - RNA, 17 nt, Homo sapiens
gaaaaucaucuuggcca

SEQ ID NO: 1449206 - RNA, 12 nt, Homo sapiens
gaaaauguucau

SEQ ID NO: 1449207 - RNA, 15 nt, Homo sapiens
gaaaauuaugagucu

SEQ ID NO: 1449208 - RNA, 22 nt, Homo sapiens
gaaacacaaaccacaacugaca

SEQ ID NO: 1449209 - RNA, 23 nt, Homo sapiens
gaaacagagguggcugcugugcu

SEQ ID NO: 1449210 - RNA, 16 nt, Homo sapiens
gaaacaugaauuauuu

SEQ ID NO: 1449211 - RNA, 14 nt, Homo sapiens
cuucuuaaucugaa

SEQ ID NO: 1449212 - RNA, 20 nt, Homo sapiens
cuucuucaucuugacaugua

SEQ ID NO: 1449213 - RNA, 16 nt, Homo sapiens
cuucuuccuuaauuca

SEQ ID NO: 1449214 - RNA, 15 nt, Homo sapiens
cuucuugugaaacca

SEQ ID NO: 1449215 - RNA, 18 nt, Homo sapiens
cuucuuguguccugauga

SEQ ID NO: 1449216 - RNA, 16 nt, Homo sapiens
cuucuuucaaagugua

SEQ ID NO: 1449217 - RNA, 22 nt, Homo sapiens
cuucuuucaaaguguaagcacu

SEQ ID NO: 1449218 - RNA, 14 nt, Homo sapiens
cuucuuuuccaauu

SEQ ID NO: 1449219 - RNA, 16 nt, Homo sapiens
cuugaaauaccaguga

SEQ ID NO: 1449220 - RNA, 22 nt, Homo sapiens
cuugaagauuagguacuaucug

SEQ ID NO: 1449221 - RNA, 13 nt, Homo sapiens
cuugaaucaaagc

SEQ ID NO: 1449222 - RNA, 17 nt, Homo sapiens
cuugaaucaaagcaguu

SEQ ID NO: 1449223 - RNA, 19 nt, Homo sapiens
cuugaaucuguuacugaaa

SEQ ID NO: 1449224 - RNA, 23 nt, Homo sapiens
cuugaauguaagaacaugaccuc

SEQ ID NO: 1449225 - RNA, 17 nt, Homo sapiens
cuugacaacagacugaa

SEQ ID NO: 1449226 - RNA, 20 nt, Homo sapiens
cuugacacggugaaauccag

SEQ ID NO: 1449227 - RNA, 18 nt, Homo sapiens
cuugauggagauauuuac

SEQ ID NO: 1449228 - RNA, 13 nt, Homo sapiens
cuugccaggcucc

SEQ ID NO: 1449229 - RNA, 13 nt, Homo sapiens
cuugcguacucag

SEQ ID NO: 1449230 - RNA, 20 nt, Homo sapiens
cuugcucugagugcuagcua

SEQ ID NO: 1449231 - RNA, 13 nt, Homo sapiens
cuugcugccugaa

SEQ ID NO: 1449232 - RNA, 23 nt, Homo sapiens
cuugcuggacggggacuggggau

SEQ ID NO: 1449233 - RNA, 15 nt, Homo sapiens
cuugcuuuccccggg

SEQ ID NO: 1449234 - RNA, 19 nt, Homo sapiens
cuugcuuugggcuuugcag

SEQ ID NO: 1449235 - RNA, 17 nt, Homo sapiens
cuuggaaagcugaugau

SEQ ID NO: 1449236 - RNA, 15 nt, Homo sapiens
cuuggaaagguuuca

SEQ ID NO: 1449237 - RNA, 19 nt, Homo sapiens
cuuggacuauuauaauuua

SEQ ID NO: 1449238 - RNA, 13 nt, Homo sapiens
cuuggacuccucc

SEQ ID NO: 1449239 - RNA, 13 nt, Homo sapiens
cuuggacuugagg

SEQ ID NO: 1449240 - RNA, 20 nt, Homo sapiens
cuuggagacaaaaucuuaaa

SEQ ID NO: 1449241 - RNA, 17 nt, Homo sapiens
cuuggagcccgugcagu

SEQ ID NO: 1449242 - RNA, 18 nt, Homo sapiens
cuugggaccuguuuagag

SEQ ID NO: 1449243 - RNA, 19 nt, Homo sapiens
cuugggaguguugucacac

SEQ ID NO: 1449244 - RNA, 19 nt, Homo sapiens
cuugggcaaaaugacaagg

SEQ ID NO: 1449245 - RNA, 23 nt, Homo sapiens
cuuggggagaccucuacugccuu

SEQ ID NO: 1449246 - RNA, 17 nt, Homo sapiens
cuuggucuaagugugcu

SEQ ID NO: 1449247 - RNA, 23 nt, Homo sapiens
cuuguaaaccaucgcgugcaaug

SEQ ID NO: 1449248 - RNA, 13 nt, Homo sapiens
cuaacuccaguga

SEQ ID NO: 1449249 - RNA, 11 nt, Homo sapiens
cuaacuguaaa

SEQ ID NO: 1449250 - RNA, 14 nt, Homo sapiens
cuaagacaccugca

SEQ ID NO: 1449251 - RNA, 13 nt, Homo sapiens
cuaagccacucuu

SEQ ID NO: 1449252 - RNA, 17 nt, Homo sapiens
cuaagccacucuuccaa

SEQ ID NO: 1449253 - RNA, 12 nt, Homo sapiens
cuaagccuccuu

SEQ ID NO: 1449254 - RNA, 13 nt, Homo sapiens
cuaagccuguugc

SEQ ID NO: 1449255 - RNA, 17 nt, Homo sapiens
cuaagggccacauccca

SEQ ID NO: 1449256 - RNA, 18 nt, Homo sapiens
cuaagggccacaucccac

SEQ ID NO: 1449257 - RNA, 18 nt, Homo sapiens
cuaaguaaaaccacagca

SEQ ID NO: 1449258 - RNA, 16 nt, Homo sapiens
cuaauacaacauguag

SEQ ID NO: 1449259 - RNA, 18 nt, Homo sapiens
cuaauagaaccaagaauu

SEQ ID NO: 1449260 - RNA, 22 nt, Homo sapiens
cuaaucagcauucucacuccua

SEQ ID NO: 1449261 - RNA, 19 nt, Homo sapiens
cuaaugagucgacuuugag

SEQ ID NO: 1449262 - RNA, 20 nt, Homo sapiens
cuaaugcuucaaguguugcu

SEQ ID NO: 1449263 - RNA, 17 nt, Homo sapiens
cuaauguaugcauucau

SEQ ID NO: 1449264 - RNA, 21 nt, Homo sapiens
cuaauuuauccugaaauuuca

SEQ ID NO: 1449265 - RNA, 13 nt, Homo sapiens
cuacaaaaacaca

SEQ ID NO: 1449266 - RNA, 16 nt, Homo sapiens
cuacaaagcugaagaa

SEQ ID NO: 1449267 - RNA, 22 nt, Homo sapiens
cuacaaaggagacgggggagca

SEQ ID NO: 1449268 - RNA, 21 nt, Homo sapiens
cuacaacaaauacuacaggcc

SEQ ID NO: 1449269 - RNA, 21 nt, Homo sapiens
cuacaagcauuugcccugugg

SEQ ID NO: 1449270 - RNA, 18 nt, Homo sapiens
cuacacaaaagccaaaag

SEQ ID NO: 1449271 - RNA, 19 nt, Homo sapiens
cuacagccuccucggggga

SEQ ID NO: 1449272 - RNA, 11 nt, Homo sapiens
cuacauuccuc

SEQ ID NO: 1449273 - RNA, 21 nt, Homo sapiens
cuaccaaagcaccuuagcugg

SEQ ID NO: 1449274 - RNA, 18 nt, Homo sapiens
cuaccauuugaauuugug

SEQ ID NO: 1449275 - RNA, 23 nt, Homo sapiens
cuaccgagucucuucuccacugg

SEQ ID NO: 1449276 - RNA, 18 nt, Homo sapiens
cuacguauaaauaugaaa

SEQ ID NO: 1449277 - RNA, 14 nt, Homo sapiens
cuacuaaaaacaca

SEQ ID NO: 1449278 - RNA, 21 nt, Homo sapiens
cuacucacacaggcauuuccu

SEQ ID NO: 1449279 - RNA, 15 nt, Homo sapiens
cuacugagacaugac

SEQ ID NO: 1449280 - RNA, 13 nt, Homo sapiens
cuacuggcagcuc

SEQ ID NO: 1449281 - RNA, 18 nt, Homo sapiens
cuacuucacuaaugacga

SEQ ID NO: 1449282 - RNA, 19 nt, Homo sapiens
cuacuuccugugacuucag

SEQ ID NO: 1449283 - RNA, 16 nt, Homo sapiens
cuacuuuuuauacucc

SEQ ID NO: 1449284 - RNA, 20 nt, Homo sapiens
cuacuuuuucuagcuacaau

SEQ ID NO: 1449285 - RNA, 15 nt, Homo sapiens
cuagaaaacauucca

SEQ ID NO: 1449286 - RNA, 22 nt, Homo sapiens
cuagaacacccacuggccaguc

SEQ ID NO: 1449287 - RNA, 18 nt, Homo sapiens
cuagaaggccacauguca

SEQ ID NO: 1449288 - RNA, 12 nt, Homo sapiens
cuagaagucaaa

SEQ ID NO: 1449289 - RNA, 18 nt, Homo sapiens
cuagaaucuggagagcua

SEQ ID NO: 1449290 - RNA, 14 nt, Homo sapiens
cuagagaacaugcc

SEQ ID NO: 1449291 - RNA, 23 nt, Homo sapiens
cuagagaagaggcuggugcugug

SEQ ID NO: 1449292 - RNA, 19 nt, Homo sapiens
cuagagaaggacccggagg

SEQ ID NO: 1449293 - RNA, 14 nt, Homo sapiens
cuagagugcagugg

SEQ ID NO: 1449294 - RNA, 15 nt, Homo sapiens
cuagauccacacaca

SEQ ID NO: 1449295 - RNA, 12 nt, Homo sapiens
cuagcaucucau

SEQ ID NO: 1449296 - RNA, 17 nt, Homo sapiens
cuagcaucucaugagug

SEQ ID NO: 1449297 - RNA, 21 nt, Homo sapiens
cuagcaucucaugagugccaa

SEQ ID NO: 1449298 - RNA, 22 nt, Homo sapiens
cuagcauuuucuugaaccaaua

SEQ ID NO: 1449299 - RNA, 21 nt, Homo sapiens
cuagccaccucccaccccacu

SEQ ID NO: 1449300 - RNA, 18 nt, Homo sapiens
cuagcccucucacauuua

SEQ ID NO: 1449301 - RNA, 20 nt, Homo sapiens
cuagccgcgugugacagucu

SEQ ID NO: 1449302 - RNA, 18 nt, Homo sapiens
cuagccugggccagagaa

SEQ ID NO: 1449303 - RNA, 19 nt, Homo sapiens
cuagcuagaaauaugauuu

SEQ ID NO: 1449304 - RNA, 14 nt, Homo sapiens
cuagcugcaaguga

SEQ ID NO: 1449305 - RNA, 17 nt, Homo sapiens
cuagcugcaagugacau

SEQ ID NO: 1449306 - RNA, 21 nt, Homo sapiens
cuagcuuuaggggaccaugaa

SEQ ID NO: 1449307 - RNA, 22 nt, Homo sapiens
cuaggaaacccaaggaacaaga

SEQ ID NO: 1449308 - RNA, 16 nt, Homo sapiens
cuaggacuccacaguu

SEQ ID NO: 1449309 - RNA, 19 nt, Homo sapiens
cuaggaguugaguacagug

SEQ ID NO: 1449310 - RNA, 21 nt, Homo sapiens
cuaggccacuccuccaaagga

SEQ ID NO: 1449311 - RNA, 18 nt, Homo sapiens
cuaggccagagcgggggu

SEQ ID NO: 1449312 - RNA, 22 nt, Homo sapiens
cuagggcuggagggacagggag

SEQ ID NO: 1449313 - RNA, 13 nt, Homo sapiens
cuaggggagacac

SEQ ID NO: 1449314 - RNA, 16 nt, Homo sapiens
cuaguagcggaucuca

SEQ ID NO: 1449315 - RNA, 16 nt, Homo sapiens
cuaguccuuuacuaau

SEQ ID NO: 1449316 - RNA, 22 nt, Homo sapiens
cuagugaaagaggcagcuugaa

SEQ ID NO: 1449317 - RNA, 22 nt, Homo sapiens
cuagugugaguggcagccaugc

SEQ ID NO: 1449318 - RNA, 18 nt, Homo sapiens
cuaguuccucuucuuaag

SEQ ID NO: 1449319 - RNA, 16 nt, Homo sapiens
cuaguucuaauucccu

SEQ ID NO: 1449320 - RNA, 17 nt, Homo sapiens
cuaguucuaauucccua

SEQ ID NO: 1449321 - RNA, 13 nt, Homo sapiens
cuaguuucauuca

SEQ ID NO: 1449322 - RNA, 20 nt, Homo sapiens
cuauaaaaagaaguguuccu

SEQ ID NO: 1449323 - RNA, 15 nt, Homo sapiens
cuauaaacuacugua

SEQ ID NO: 1449324 - RNA, 23 nt, Homo sapiens
cuauaggugcuacaaaaacacag

SEQ ID NO: 1449325 - RNA, 17 nt, Homo sapiens
cuauaugucuagcucau

SEQ ID NO: 1449326 - RNA, 21 nt, Homo sapiens
cuauauguguauuauguaugc

SEQ ID NO: 1449327 - RNA, 20 nt, Homo sapiens
cuauauuggaaucuguauca

SEQ ID NO: 1449328 - RNA, 16 nt, Homo sapiens
cuaucaaaacauauca

SEQ ID NO: 1449329 - RNA, 15 nt, Homo sapiens
cuaucacacaguggg

SEQ ID NO: 1449330 - RNA, 12 nt, Homo sapiens
cuaucacauaca

SEQ ID NO: 1449331 - RNA, 21 nt, Homo sapiens
cuaucacauacaauuugcacu

SEQ ID NO: 1449332 - RNA, 14 nt, Homo sapiens
cuaucccaagccaa

SEQ ID NO: 1449333 - RNA, 14 nt, Homo sapiens
cuaucgcaccacug

SEQ ID NO: 1449334 - RNA, 15 nt, Homo sapiens
cuaucgcaccacugu

SEQ ID NO: 1449335 - RNA, 20 nt, Homo sapiens
cuaucuauggcccugcaaaa

SEQ ID NO: 1449336 - RNA, 14 nt, Homo sapiens
cuaucuccaaauga

SEQ ID NO: 1449337 - RNA, 12 nt, Homo sapiens
cuaucugugaag

SEQ ID NO: 1449338 - RNA, 21 nt, Homo sapiens
cuaugagaauugggauuacau

SEQ ID NO: 1449339 - RNA, 14 nt, Homo sapiens
cuaugauaaauuca

SEQ ID NO: 1449340 - RNA, 15 nt, Homo sapiens
cuaugaucacaguga

SEQ ID NO: 1449341 - RNA, 14 nt, Homo sapiens
cuaugccaagccau

SEQ ID NO: 1449342 - RNA, 13 nt, Homo sapiens
cuaugcugaagag

SEQ ID NO: 1449343 - RNA, 10 nt, Homo sapiens
cuauggaugu

SEQ ID NO: 1449344 - RNA, 15 nt, Homo sapiens
cuaugggggcacuga

SEQ ID NO: 1449345 - RNA, 20 nt, Homo sapiens
cuauguaucuaccaucuaau

SEQ ID NO: 1449346 - RNA, 22 nt, Homo sapiens
cuauguauggaauacaguguua

SEQ ID NO: 1449347 - RNA, 22 nt, Homo sapiens
cuaugucuuguuuuaaguugcu

SEQ ID NO: 1449348 - RNA, 20 nt, Homo sapiens
cuauuaaagugauuucauuc

SEQ ID NO: 1449349 - RNA, 18 nt, Homo sapiens
cuauuaguuuucuuugua

SEQ ID NO: 1449350 - RNA, 14 nt, Homo sapiens
cuauucagaauuga

SEQ ID NO: 1449351 - RNA, 14 nt, Homo sapiens
cuauucucuccuca

SEQ ID NO: 1449352 - RNA, 13 nt, Homo sapiens
cuauugaauugga

SEQ ID NO: 1449353 - RNA, 16 nt, Homo sapiens
cuauuggaaugugguc

SEQ ID NO: 1449354 - RNA, 15 nt, Homo sapiens
cuauuuaacuugagg

SEQ ID NO: 1449355 - RNA, 21 nt, Homo sapiens
cuauuuauucauucagugaga

SEQ ID NO: 1449356 - RNA, 18 nt, Homo sapiens
cuauuuauucccuguuaa

SEQ ID NO: 1449357 - RNA, 21 nt, Homo sapiens
cuauuuggggcuugcaugcca

SEQ ID NO: 1449358 - RNA, 18 nt, Homo sapiens
cuauuuguuguuuuuaac

SEQ ID NO: 1449359 - RNA, 19 nt, Homo sapiens
cuauuuuaagacgugaaug

SEQ ID NO: 1449360 - RNA, 15 nt, Homo sapiens
cuauuuuauucccuu

SEQ ID NO: 1449361 - RNA, 14 nt, Homo sapiens
cuauuuuugaggaa

SEQ ID NO: 1449362 - RNA, 19 nt, Homo sapiens
cucaaaagauuguuuuaua

SEQ ID NO: 1449363 - RNA, 21 nt, Homo sapiens
cucaaacccuguggggccuga

SEQ ID NO: 1449364 - RNA, 21 nt, Homo sapiens
cucaaaugacccaaagaccaa

SEQ ID NO: 1449365 - RNA, 17 nt, Homo sapiens
cucaacaacaaaccaaa

SEQ ID NO: 1449366 - RNA, 19 nt, Homo sapiens
cucaacaauaaaacauuau

SEQ ID NO: 1449367 - RNA, 18 nt, Homo sapiens
cucaacaauaaagacuga

SEQ ID NO: 1449368 - RNA, 11 nt, Homo sapiens
cucaagacuga

SEQ ID NO: 1449369 - RNA, 16 nt, Homo sapiens
cucaagacugaaacgg

SEQ ID NO: 1449370 - RNA, 14 nt, Homo sapiens
cucaagcacuaaaa

SEQ ID NO: 1449371 - RNA, 17 nt, Homo sapiens
cucaagucuucccugau

SEQ ID NO: 1449372 - RNA, 19 nt, Homo sapiens
cucaagucuucccugauca

SEQ ID NO: 1449373 - RNA, 20 nt, Homo sapiens
cucaaucaugaguaccucaa

SEQ ID NO: 1449374 - RNA, 19 nt, Homo sapiens
cucacaagaagaccagacu

SEQ ID NO: 1449375 - RNA, 14 nt, Homo sapiens
cucacacacauaga

SEQ ID NO: 1449376 - RNA, 20 nt, Homo sapiens
cucacccgccccacucccuc

SEQ ID NO: 1449377 - RNA, 17 nt, Homo sapiens
cucaccuguuacugaaa

SEQ ID NO: 1449378 - RNA, 23 nt, Homo sapiens
cucaccuguuacuugaaauacca

SEQ ID NO: 1449379 - RNA, 11 nt, Homo sapiens
cucacuauguu

SEQ ID NO: 1449380 - RNA, 23 nt, Homo sapiens
cucacuauucaaguauuaggggu

SEQ ID NO: 1449381 - RNA, 16 nt, Homo sapiens
cucacucccauaagcu

SEQ ID NO: 1449382 - RNA, 15 nt, Homo sapiens
cucacucuuaugaaa

SEQ ID NO: 1449383 - RNA, 17 nt, Homo sapiens
cucagacuguugcacuc

SEQ ID NO: 1449384 - RNA, 23 nt, Homo sapiens
cucagagaauuucuaccauuuca

SEQ ID NO: 1449385 - RNA, 18 nt, Homo sapiens
cucagcaaggugugaaug

SEQ ID NO: 1449386 - RNA, 12 nt, Homo sapiens
cucagcauaccu

SEQ ID NO: 1449387 - RNA, 13 nt, Homo sapiens
cucagcauaccug

SEQ ID NO: 1449388 - RNA, 21 nt, Homo sapiens
cucagcauaccugcuggugca

SEQ ID NO: 1449389 - RNA, 21 nt, Homo sapiens
cucagccauaaagugccaguu

SEQ ID NO: 1449390 - RNA, 23 nt, Homo sapiens
cucagcccugggccccaccaccu

SEQ ID NO: 1449391 - RNA, 20 nt, Homo sapiens
cucagccucccaaguagcug

SEQ ID NO: 1449392 - RNA, 20 nt, Homo sapiens
cucaggacggaaggucaguu

SEQ ID NO: 1449393 - RNA, 17 nt, Homo sapiens
cucagguaguacuggga

SEQ ID NO: 1449394 - RNA, 10 nt, Homo sapiens
cucauaauag

SEQ ID NO: 1449395 - RNA, 14 nt, Homo sapiens
cucaucacccaguc

SEQ ID NO: 1449396 - RNA, 22 nt, Homo sapiens
cucaucaguguccucuugcuca

SEQ ID NO: 1449397 - RNA, 23 nt, Homo sapiens
cucaucaguguccucuugcucaa

SEQ ID NO: 1449398 - RNA, 14 nt, Homo sapiens
cucaucccuguucc

SEQ ID NO: 1449399 - RNA, 13 nt, Homo sapiens
cucauccuccuuc

SEQ ID NO: 1449400 - RNA, 21 nt, Homo sapiens
cucaucuacaagcauuugccc

SEQ ID NO: 1449401 - RNA, 15 nt, Homo sapiens
cucaugaccuugaaa

SEQ ID NO: 1449402 - RNA, 19 nt, Homo sapiens
cucaugagugccaagcaaa

SEQ ID NO: 1449403 - RNA, 11 nt, Homo sapiens
cucaugucuca

SEQ ID NO: 1449404 - RNA, 20 nt, Homo sapiens
cucauguugaagccacugcc

SEQ ID NO: 1449405 - RNA, 23 nt, Homo sapiens
cucauguugaagccacugccuuc

SEQ ID NO: 1449406 - RNA, 15 nt, Homo sapiens
cucauguuguuccca

SEQ ID NO: 1449407 - RNA, 21 nt, Homo sapiens
cucauucauuuauucauucau

SEQ ID NO: 1449408 - RNA, 18 nt, Homo sapiens
cucauuccuguagucaaa

SEQ ID NO: 1449409 - RNA, 22 nt, Homo sapiens
cucauuguuuauuaacaaauua

SEQ ID NO: 1449410 - RNA, 16 nt, Homo sapiens
cucauuuaucccucaa

SEQ ID NO: 1449411 - RNA, 17 nt, Homo sapiens
cucauuuuuguuuucau

SEQ ID NO: 1449412 - RNA, 22 nt, Homo sapiens
cuccaaagaaauguaagggaaa

SEQ ID NO: 1449413 - RNA, 20 nt, Homo sapiens
cuccaaaugagacacauuaa

SEQ ID NO: 1449414 - RNA, 13 nt, Homo sapiens
cuccaagcuccau

SEQ ID NO: 1449415 - RNA, 21 nt, Homo sapiens
cuccaccaacuggagcacuga

SEQ ID NO: 1449416 - RNA, 14 nt, Homo sapiens
cuccacucacucca

SEQ ID NO: 1449417 - RNA, 13 nt, Homo sapiens
cuccacuccagau

SEQ ID NO: 1449418 - RNA, 15 nt, Homo sapiens
auggcuggggggcca

SEQ ID NO: 1449419 - RNA, 17 nt, Homo sapiens
auggcugugccucugcc

SEQ ID NO: 1449420 - RNA, 18 nt, Homo sapiens
auggcuuggggagcagag

SEQ ID NO: 1449421 - RNA, 17 nt, Homo sapiens
gccaggcacugcccuuu

SEQ ID NO: 1449422 - RNA, 18 nt, Homo sapiens
gccaggccagagggcagu

SEQ ID NO: 1449423 - RNA, 18 nt, Homo sapiens
gccagggcaaugaugaau

SEQ ID NO: 1449424 - RNA, 15 nt, Homo sapiens
gccagggcagcauuu

SEQ ID NO: 1449425 - RNA, 17 nt, Homo sapiens
gccaggggcugguggga

SEQ ID NO: 1449426 - RNA, 12 nt, Homo sapiens
gccagguggcca

SEQ ID NO: 1449427 - RNA, 15 nt, Homo sapiens
gccagugagggcagu

SEQ ID NO: 1449428 - RNA, 17 nt, Homo sapiens
gccagugagggcagucc

SEQ ID NO: 1449429 - RNA, 18 nt, Homo sapiens
gccagugccagcaccugc

SEQ ID NO: 1449430 - RNA, 21 nt, Homo sapiens
gccaguggggccuguggaaug

SEQ ID NO: 1449431 - RNA, 14 nt, Homo sapiens
gccagugucauccg

SEQ ID NO: 1449432 - RNA, 16 nt, Homo sapiens
gccauaaugacucaga

SEQ ID NO: 1449433 - RNA, 17 nt, Homo sapiens
gccauaauucuaaguua

SEQ ID NO: 1449434 - RNA, 16 nt, Homo sapiens
gccaucaugccugacu

SEQ ID NO: 1449435 - RNA, 15 nt, Homo sapiens
gccaucgaccuggag

SEQ ID NO: 1449436 - RNA, 22 nt, Homo sapiens
gccaugagaugauacauccaaa

SEQ ID NO: 1449437 - RNA, 16 nt, Homo sapiens
gccaugauggccuuac

SEQ ID NO: 1449438 - RNA, 15 nt, Homo sapiens
gccaugcaaugccaa

SEQ ID NO: 1449439 - RNA, 17 nt, Homo sapiens
gccauggcaacuuagag

SEQ ID NO: 1449440 - RNA, 17 nt, Homo sapiens
gccauggggcccuccca

SEQ ID NO: 1449441 - RNA, 20 nt, Homo sapiens
gccauguauaaaugugauau

SEQ ID NO: 1449442 - RNA, 16 nt, Homo sapiens
gccauguccaaagagg

SEQ ID NO: 1449443 - RNA, 20 nt, Homo sapiens
gccauuccacuccacucagg

SEQ ID NO: 1449444 - RNA, 14 nt, Homo sapiens
gcccacacccaggc

SEQ ID NO: 1449445 - RNA, 21 nt, Homo sapiens
gcccacugcccaaugccugcu

SEQ ID NO: 1449446 - RNA, 14 nt, Homo sapiens
gcccagacccagug

SEQ ID NO: 1449447 - RNA, 15 nt, Homo sapiens
gcccagacccagugg

SEQ ID NO: 1449448 - RNA, 22 nt, Homo sapiens
gcccagacgcagcugagucgga

SEQ ID NO: 1449449 - RNA, 15 nt, Homo sapiens
gcccagagcccagcu

SEQ ID NO: 1449450 - RNA, 17 nt, Homo sapiens
gcccagagcccagcucc

SEQ ID NO: 1449451 - RNA, 15 nt, Homo sapiens
gcccagcacaggaau

SEQ ID NO: 1449452 - RNA, 11 nt, Homo sapiens
gcccagcacug

SEQ ID NO: 1449453 - RNA, 17 nt, Homo sapiens
gcccaggauuauuguca

SEQ ID NO: 1449454 - RNA, 18 nt, Homo sapiens
gcccaggcaacaguacuu

SEQ ID NO: 1449455 - RNA, 20 nt, Homo sapiens
gcccaggcuggagugcagug

SEQ ID NO: 1449456 - RNA, 20 nt, Homo sapiens
gcccaggcugggaacucauc

SEQ ID NO: 1449457 - RNA, 17 nt, Homo sapiens
gcccaggcugugcagcg

SEQ ID NO: 1449458 - RNA, 23 nt, Homo sapiens
gcccagggggagcuaucacugua

SEQ ID NO: 1449459 - RNA, 22 nt, Homo sapiens
gcccagguucgagacccaaacc

SEQ ID NO: 1449460 - RNA, 18 nt, Homo sapiens
gcccauaucugugaaaug

SEQ ID NO: 1449461 - RNA, 18 nt, Homo sapiens
gcccaugggauauguggu

SEQ ID NO: 1449462 - RNA, 16 nt, Homo sapiens
gccccaaccugcugaa

SEQ ID NO: 1449463 - RNA, 16 nt, Homo sapiens
gccccaccaucuugcu

SEQ ID NO: 1449464 - RNA, 23 nt, Homo sapiens
gccccaccccaccuccacuccca

SEQ ID NO: 1449465 - RNA, 15 nt, Homo sapiens
gccccagaccccagg

SEQ ID NO: 1449466 - RNA, 19 nt, Homo sapiens
gccccagggaguccagggu

SEQ ID NO: 1449467 - RNA, 14 nt, Homo sapiens
gccccaguccaugc

SEQ ID NO: 1449468 - RNA, 15 nt, Homo sapiens
gccccauuccuugcg

SEQ ID NO: 1449469 - RNA, 21 nt, Homo sapiens
gcccccaccgugggcagggag

SEQ ID NO: 1449470 - RNA, 21 nt, Homo sapiens
gcccccagauagagcugggug

SEQ ID NO: 1449471 - RNA, 22 nt, Homo sapiens
gccccccacaccuuuuccccaa

SEQ ID NO: 1449472 - RNA, 18 nt, Homo sapiens
gcccccuccacaccagug

SEQ ID NO: 1449473 - RNA, 14 nt, Homo sapiens
gccccgccacagcc

SEQ ID NO: 1449474 - RNA, 13 nt, Homo sapiens
gccccuacugcug

SEQ ID NO: 1449475 - RNA, 16 nt, Homo sapiens
gccccuacugcuguga

SEQ ID NO: 1449476 - RNA, 14 nt, Homo sapiens
gccccucucaccaa

SEQ ID NO: 1449477 - RNA, 14 nt, Homo sapiens
gccccucugaccug

SEQ ID NO: 1449478 - RNA, 17 nt, Homo sapiens
gccccucugaccugcac

SEQ ID NO: 1449479 - RNA, 22 nt, Homo sapiens
gccccucuuccccaaugcucca

SEQ ID NO: 1449480 - RNA, 18 nt, Homo sapiens
gccccugccccauuuccu

SEQ ID NO: 1449481 - RNA, 14 nt, Homo sapiens
gccccugucauccu

SEQ ID NO: 1449482 - RNA, 23 nt, Homo sapiens
gccccugucauccucaugcugcu

SEQ ID NO: 1449483 - RNA, 15 nt, Homo sapiens
gcccgcugcaaugcc

SEQ ID NO: 1449484 - RNA, 13 nt, Homo sapiens
gcccguacccagc

SEQ ID NO: 1449485 - RNA, 21 nt, Homo sapiens
gcccgucauguuccucaaaag

SEQ ID NO: 1449486 - RNA, 21 nt, Homo sapiens
gcccuaccugauuggugcaac

SEQ ID NO: 1449487 - RNA, 23 nt, Homo sapiens
gcccuauggauuugaaguuugcc

SEQ ID NO: 1449488 - RNA, 20 nt, Homo sapiens
gcccucauuacugggccuua

SEQ ID NO: 1449489 - RNA, 20 nt, Homo sapiens
gcccuccuuugccuuccacc

SEQ ID NO: 1449490 - RNA, 14 nt, Homo sapiens
gcccucgcugcuuc

SEQ ID NO: 1449491 - RNA, 18 nt, Homo sapiens
gcccucugaacuugccuu

SEQ ID NO: 1449492 - RNA, 20 nt, Homo sapiens
gcccugauguguccucaggg

SEQ ID NO: 1449493 - RNA, 16 nt, Homo sapiens
gaaacauuacaguuca

SEQ ID NO: 1449494 - RNA, 16 nt, Homo sapiens
gaaacauuaugccuua

SEQ ID NO: 1449495 - RNA, 12 nt, Homo sapiens
gaaaccaugacu

SEQ ID NO: 1449496 - RNA, 23 nt, Homo sapiens
gaaaccccaucucuacuaaaaau

SEQ ID NO: 1449497 - RNA, 15 nt, Homo sapiens
gaaacccccagugua

SEQ ID NO: 1449498 - RNA, 14 nt, Homo sapiens
gaaaccccgucucu

SEQ ID NO: 1449499 - RNA, 18 nt, Homo sapiens
gaaaccuacacacuguca

SEQ ID NO: 1449500 - RNA, 14 nt, Homo sapiens
gaaacgucaugugu

SEQ ID NO: 1449501 - RNA, 14 nt, Homo sapiens
gaaacuaagccagg

SEQ ID NO: 1449502 - RNA, 20 nt, Homo sapiens
gaaacuaauauuuuauguga

SEQ ID NO: 1449503 - RNA, 21 nt, Homo sapiens
gaaacuaccaggugugccugg

SEQ ID NO: 1449504 - RNA, 16 nt, Homo sapiens
gaaacuauacauuuau

SEQ ID NO: 1449505 - RNA, 14 nt, Homo sapiens
gaaacucaaaaaua

SEQ ID NO: 1449506 - RNA, 16 nt, Homo sapiens
gaaacucacacucccc

SEQ ID NO: 1449507 - RNA, 19 nt, Homo sapiens
gaaacugaagcuguucuca

SEQ ID NO: 1449508 - RNA, 17 nt, Homo sapiens
gaaacugcgaggccagu

SEQ ID NO: 1449509 - RNA, 17 nt, Homo sapiens
gaaacugcuaaauucua

SEQ ID NO: 1449510 - RNA, 14 nt, Homo sapiens
gaaacuuagaucau

SEQ ID NO: 1449511 - RNA, 14 nt, Homo sapiens
gaaacuucaguuga

SEQ ID NO: 1449512 - RNA, 22 nt, Homo sapiens
gaaacuuuacaaccugauguca

SEQ ID NO: 1449513 - RNA, 16 nt, Homo sapiens
gaaacuuugccucaag

SEQ ID NO: 1449514 - RNA, 23 nt, Homo sapiens
gaaagaaguguggggauuuucac

SEQ ID NO: 1449515 - RNA, 21 nt, Homo sapiens
gaaagaccaucuccccaggcu

SEQ ID NO: 1449516 - RNA, 18 nt, Homo sapiens
gaaagagacuccgucuca

SEQ ID NO: 1449517 - RNA, 18 nt, Homo sapiens
gaaagaugaucauuugua

SEQ ID NO: 1449518 - RNA, 14 nt, Homo sapiens
gaaagauggaacuu

SEQ ID NO: 1449519 - RNA, 16 nt, Homo sapiens
gaaagcccucaugugc

SEQ ID NO: 1449520 - RNA, 14 nt, Homo sapiens
gaaagccucacuga

SEQ ID NO: 1449521 - RNA, 20 nt, Homo sapiens
gaaagccugggugacauuug

SEQ ID NO: 1449522 - RNA, 19 nt, Homo sapiens
gaaagcucacuguagcuuu

SEQ ID NO: 1449523 - RNA, 17 nt, Homo sapiens
gaaagcugaguguuuca

SEQ ID NO: 1449524 - RNA, 21 nt, Homo sapiens
gaaaggaaauaguaccuucaa

SEQ ID NO: 1449525 - RNA, 17 nt, Homo sapiens
gaaaggaagcuccacug

SEQ ID NO: 1449526 - RNA, 20 nt, Homo sapiens
gaaaggaagcuccacuguca

SEQ ID NO: 1449527 - RNA, 17 nt, Homo sapiens
gaaagggaaaagggaga

SEQ ID NO: 1449528 - RNA, 13 nt, Homo sapiens
gaaagggagcuau

SEQ ID NO: 1449529 - RNA, 21 nt, Homo sapiens
gaaagggguuggggugacagu

SEQ ID NO: 1449530 - RNA, 19 nt, Homo sapiens
gaaagguacuauauuugcu

SEQ ID NO: 1449531 - RNA, 22 nt, Homo sapiens
gaaagguacuauauuugcuaga

SEQ ID NO: 1449532 - RNA, 16 nt, Homo sapiens
gaaagucaccaggacu

SEQ ID NO: 1449533 - RNA, 17 nt, Homo sapiens
gaaaguccagcacugga

SEQ ID NO: 1449534 - RNA, 18 nt, Homo sapiens
gaaaguccagcacuggaa

SEQ ID NO: 1449535 - RNA, 14 nt, Homo sapiens
gaaaguuuuggaaa

SEQ ID NO: 1449536 - RNA, 19 nt, Homo sapiens
gaaauaaaggaugugauug

SEQ ID NO: 1449537 - RNA, 16 nt, Homo sapiens
gaaauagacaguauau

SEQ ID NO: 1449538 - RNA, 13 nt, Homo sapiens
gaaauaggaaaua

SEQ ID NO: 1449539 - RNA, 22 nt, Homo sapiens
gaaauaguaccuucaauacuua

SEQ ID NO: 1449540 - RNA, 19 nt, Homo sapiens
gaaauauccagaacauacu

SEQ ID NO: 1449541 - RNA, 14 nt, Homo sapiens
gaaauauuccuuaa

SEQ ID NO: 1449542 - RNA, 15 nt, Homo sapiens
gaaaucaagcauaaa

SEQ ID NO: 1449543 - RNA, 14 nt, Homo sapiens
gaaaucaaugcaag

SEQ ID NO: 1449544 - RNA, 16 nt, Homo sapiens
gaaaucaguguuuuag

SEQ ID NO: 1449545 - RNA, 21 nt, Homo sapiens
gaaaucauaguuuaaacugca

SEQ ID NO: 1449546 - RNA, 23 nt, Homo sapiens
gaaaucauuuuacccuuggcuca

SEQ ID NO: 1449547 - RNA, 16 nt, Homo sapiens
gaaaucuuuaugugau

SEQ ID NO: 1449548 - RNA, 12 nt, Homo sapiens
gaaaugcaaaac

SEQ ID NO: 1449549 - RNA, 19 nt, Homo sapiens
gaaaugcuguuaguaaauu

SEQ ID NO: 1449550 - RNA, 16 nt, Homo sapiens
gaaauuaagaaggcaa

SEQ ID NO: 1449551 - RNA, 17 nt, Homo sapiens
gaaauuaagaaggcaaa

SEQ ID NO: 1449552 - RNA, 21 nt, Homo sapiens
gaaauuaguuucaaauuuacc

SEQ ID NO: 1449553 - RNA, 17 nt, Homo sapiens
ugugcgugaaacacacc

SEQ ID NO: 1449554 - RNA, 16 nt, Homo sapiens
ugugcuucauuccaau

SEQ ID NO: 1449555 - RNA, 21 nt, Homo sapiens
uguggaaagaaagaccaucuc

SEQ ID NO: 1449556 - RNA, 15 nt, Homo sapiens
uguggaagagcauua

SEQ ID NO: 1449557 - RNA, 23 nt, Homo sapiens
uguggacccccacccugcacuuu

SEQ ID NO: 1449558 - RNA, 14 nt, Homo sapiens
uguggagggcauuu

SEQ ID NO: 1449559 - RNA, 16 nt, Homo sapiens
uguggauggucauugc

SEQ ID NO: 1449560 - RNA, 17 nt, Homo sapiens
uguggauggucauugca

SEQ ID NO: 1449561 - RNA, 21 nt, Homo sapiens
uguggauucuucccacacaga

SEQ ID NO: 1449562 - RNA, 20 nt, Homo sapiens
uguggauuuucuacuguaag

SEQ ID NO: 1449563 - RNA, 15 nt, Homo sapiens
uguggcagugguuuu

SEQ ID NO: 1449564 - RNA, 23 nt, Homo sapiens
uguggcccagggaagccaaaaga

SEQ ID NO: 1449565 - RNA, 16 nt, Homo sapiens
uguggccccaacacaa

SEQ ID NO: 1449566 - RNA, 15 nt, Homo sapiens
uguggccccuuuuac

SEQ ID NO: 1449567 - RNA, 18 nt, Homo sapiens
uguggggaagaguggucu

SEQ ID NO: 1449568 - RNA, 12 nt, Homo sapiens
ugugggggccaa

SEQ ID NO: 1449569 - RNA, 16 nt, Homo sapiens
uguggguggcacugac

SEQ ID NO: 1449570 - RNA, 13 nt, Homo sapiens
uguggguguccug

SEQ ID NO: 1449571 - RNA, 13 nt, Homo sapiens
uuaaaacagaagc

SEQ ID NO: 1449572 - RNA, 13 nt, Homo sapiens
uuaaaaccaaaga

SEQ ID NO: 1449573 - RNA, 22 nt, Homo sapiens
uuaaaagguuaaauauugucau

SEQ ID NO: 1449574 - RNA, 17 nt, Homo sapiens
uuaaaauaaugaauaca

SEQ ID NO: 1449575 - RNA, 14 nt, Homo sapiens
uuaaaauaccuaga

SEQ ID NO: 1449576 - RNA, 22 nt, Homo sapiens
uuaaaauauuuaucugauuaag

SEQ ID NO: 1449577 - RNA, 14 nt, Homo sapiens
uuaaaaucaguauu

SEQ ID NO: 1449578 - RNA, 14 nt, Homo sapiens
uuaaaaucugugaa

SEQ ID NO: 1449579 - RNA, 16 nt, Homo sapiens
uuaaaaucugugaaga

SEQ ID NO: 1449580 - RNA, 18 nt, Homo sapiens
uuaaaauggcuacacuca

SEQ ID NO: 1449581 - RNA, 16 nt, Homo sapiens
uuaaaauuuaucuuaa

SEQ ID NO: 1449582 - RNA, 15 nt, Homo sapiens
uuaaacaccuccuca

SEQ ID NO: 1449583 - RNA, 20 nt, Homo sapiens
uuaaacauaagcuaaaucau

SEQ ID NO: 1449584 - RNA, 20 nt, Homo sapiens
uuaaacuuucaauugucacu

SEQ ID NO: 1449585 - RNA, 16 nt, Homo sapiens
uuaaacuuuuaauuca

SEQ ID NO: 1449586 - RNA, 16 nt, Homo sapiens
uuaaagaaagaagugu

SEQ ID NO: 1449587 - RNA, 15 nt, Homo sapiens
uuaaagaaccaucag

SEQ ID NO: 1449588 - RNA, 12 nt, Homo sapiens
uuaaagcaaaaa

SEQ ID NO: 1449589 - RNA, 18 nt, Homo sapiens
uuaaagcagacagucaca

SEQ ID NO: 1449590 - RNA, 21 nt, Homo sapiens
uugaaaaaaacuucauucucg

SEQ ID NO: 1449591 - RNA, 16 nt, Homo sapiens
uugaaaaaaguacaua

SEQ ID NO: 1449592 - RNA, 14 nt, Homo sapiens
uugaaaaaggugau

SEQ ID NO: 1449593 - RNA, 14 nt, Homo sapiens
uugaaaagcuauua

SEQ ID NO: 1449594 - RNA, 13 nt, Homo sapiens
uugaaagaaccag

SEQ ID NO: 1449595 - RNA, 14 nt, Homo sapiens
uugaaagaaccaga

SEQ ID NO: 1449596 - RNA, 16 nt, Homo sapiens
uugaaagcauccaugu

SEQ ID NO: 1449597 - RNA, 21 nt, Homo sapiens
uugaaaggagaugucuuggaa

SEQ ID NO: 1449598 - RNA, 18 nt, Homo sapiens
uugaaauuugccuugagu

SEQ ID NO: 1449599 - RNA, 23 nt, Homo sapiens
uugaacaacuaggcuucagcaua

SEQ ID NO: 1449600 - RNA, 21 nt, Homo sapiens
uugaacaagaugugggccuug

SEQ ID NO: 1449601 - RNA, 15 nt, Homo sapiens
uugaacucuguaaaa

SEQ ID NO: 1449602 - RNA, 19 nt, Homo sapiens
uugaacuuuaagaagcagu

SEQ ID NO: 1449603 - RNA, 19 nt, Homo sapiens
uugaagaaaggaaccuggg

SEQ ID NO: 1449604 - RNA, 13 nt, Homo sapiens
uugaaguuuacaa

SEQ ID NO: 1449605 - RNA, 20 nt, Homo sapiens
uugaaucuacaaaaaacaac

SEQ ID NO: 1449606 - RNA, 19 nt, Homo sapiens
uugaaucuauuucacuuau

SEQ ID NO: 1449607 - RNA, 22 nt, Homo sapiens
uugaaugaaaaauuuaagcauu

SEQ ID NO: 1449608 - RNA, 19 nt, Homo sapiens
uugaaugugguuacuuccu

SEQ ID NO: 1449609 - RNA, 18 nt, Homo sapiens
uugacaacaaccuaugca

SEQ ID NO: 1449610 - RNA, 11 nt, Homo sapiens
uugacacugaa

SEQ ID NO: 1449611 - RNA, 19 nt, Homo sapiens
uugacaguucauauguacc

SEQ ID NO: 1449612 - RNA, 14 nt, Homo sapiens
uugacaucagcauu

SEQ ID NO: 1449613 - RNA, 11 nt, Homo sapiens
uugaccacaga

SEQ ID NO: 1449614 - RNA, 12 nt, Homo sapiens
uugaccacagag

SEQ ID NO: 1449615 - RNA, 24 nt, Homo sapiens
uugacucauggcagcuguuucuca

SEQ ID NO: 1449616 - RNA, 17 nt, Homo sapiens
uugacucuaaaugcagu

SEQ ID NO: 1449617 - RNA, 23 nt, Homo sapiens
uugacuuucugauuggugauuca

SEQ ID NO: 1449618 - RNA, 12 nt, Homo sapiens
uugagaaugagu

SEQ ID NO: 1449619 - RNA, 17 nt, Homo sapiens
uugagacaggaugguua

SEQ ID NO: 1449620 - RNA, 15 nt, Homo sapiens
uugagacugauucag

SEQ ID NO: 1449621 - RNA, 16 nt, Homo sapiens
uugagagccaguggcg

SEQ ID NO: 1449622 - RNA, 18 nt, Homo sapiens
uugagaguugcuggugua

SEQ ID NO: 1449623 - RNA, 18 nt, Homo sapiens
uugagcaccgucauggcu

SEQ ID NO: 1449624 - RNA, 22 nt, Homo sapiens
uugagcaguggcugguccaggg

SEQ ID NO: 1449625 - RNA, 21 nt, Homo sapiens
uugagcuucauauaccagcaa

SEQ ID NO: 1449626 - RNA, 17 nt, Homo sapiens
uugaggagcugcacuga

SEQ ID NO: 1449627 - RNA, 18 nt, Homo sapiens
uugaggagcugcacugau

SEQ ID NO: 1449628 - RNA, 23 nt, Homo sapiens
uugaggucaaguaagaagacaug

SEQ ID NO: 1449629 - RNA, 22 nt, Homo sapiens
uugauacaacauuaaggaauuu

SEQ ID NO: 1449630 - RNA, 19 nt, Homo sapiens
uugauagcaaacacugggg

SEQ ID NO: 1449631 - RNA, 12 nt, Homo sapiens
uugauauacuuu

SEQ ID NO: 1449632 - RNA, 16 nt, Homo sapiens
uugauauuugcauuga

SEQ ID NO: 1449633 - RNA, 12 nt, Homo sapiens
uugaucaaugaa

SEQ ID NO: 1449634 - RNA, 21 nt, Homo sapiens
uugaucuggaacccagacuca

SEQ ID NO: 1449635 - RNA, 17 nt, Homo sapiens
uugaugacccucugacc

SEQ ID NO: 1449636 - RNA, 18 nt, Homo sapiens
uugauggugacagcugca

SEQ ID NO: 1449637 - RNA, 17 nt, Homo sapiens
uugaugugaaacauuau

SEQ ID NO: 1449638 - RNA, 20 nt, Homo sapiens
uugauuccugguuugacuca

SEQ ID NO: 1449639 - RNA, 21 nt, Homo sapiens
uugauuccugguuugacucag

SEQ ID NO: 1449640 - RNA, 22 nt, Homo sapiens
uugauuccugguuugacucagu

SEQ ID NO: 1449641 - RNA, 16 nt, Homo sapiens
uugcaaaucuugaaau

SEQ ID NO: 1449642 - RNA, 23 nt, Homo sapiens
uugcaaccucuuugcucaacaga

SEQ ID NO: 1449643 - RNA, 19 nt, Homo sapiens
uugcaagacccucccaugg

SEQ ID NO: 1449644 - RNA, 20 nt, Homo sapiens
uugcaagaugugaauuauug

SEQ ID NO: 1449645 - RNA, 19 nt, Homo sapiens
uugcacauaacaugcuuua

SEQ ID NO: 1449646 - RNA, 18 nt, Homo sapiens
uugcagugagcugagauc

SEQ ID NO: 1449647 - RNA, 15 nt, Homo sapiens
uugcaguugcucuga

SEQ ID NO: 1449648 - RNA, 20 nt, Homo sapiens
uugcauaguaccaaucauuu

SEQ ID NO: 1449649 - RNA, 13 nt, Homo sapiens
uugcauaugucau

SEQ ID NO: 1449650 - RNA, 10 nt, Homo sapiens
uugcauuugg

SEQ ID NO: 1449651 - RNA, 16 nt, Homo sapiens
uugccacaacccuguu

SEQ ID NO: 1449652 - RNA, 13 nt, Homo sapiens
uugccacauuuag

SEQ ID NO: 1449653 - RNA, 13 nt, Homo sapiens
uugcccaccccuc

SEQ ID NO: 1449654 - RNA, 17 nt, Homo sapiens
uugcccagacuacaggg

SEQ ID NO: 1449655 - RNA, 19 nt, Homo sapiens
uugcccugaguggaucucc

SEQ ID NO: 1449656 - RNA, 17 nt, Homo sapiens
uugcccuucacaguguu

SEQ ID NO: 1449657 - RNA, 16 nt, Homo sapiens
uugccgcuguauaaag

SEQ ID NO: 1449658 - RNA, 13 nt, Homo sapiens
uugccguaccaau

SEQ ID NO: 1449659 - RNA, 22 nt, Homo sapiens
uugccuaaaauauauuccugag

SEQ ID NO: 1449660 - RNA, 19 nt, Homo sapiens
uugccuaauaaacauccuu

SEQ ID NO: 1449661 - RNA, 19 nt, Homo sapiens
uugccucaaugccaguaac

SEQ ID NO: 1449662 - RNA, 14 nt, Homo sapiens
uugccucauauugu

SEQ ID NO: 1449663 - RNA, 13 nt, Homo sapiens
uugccucuaccag

SEQ ID NO: 1449664 - RNA, 21 nt, Homo sapiens
uugccucuucuuugugccuuu

SEQ ID NO: 1449665 - RNA, 18 nt, Homo sapiens
uugccucuuucacauuga

SEQ ID NO: 1449666 - RNA, 14 nt, Homo sapiens
uugccuggugaaug

SEQ ID NO: 1449667 - RNA, 22 nt, Homo sapiens
uugccuucaucuucacugcaau

SEQ ID NO: 1449668 - RNA, 16 nt, Homo sapiens
uugcgcucucaagacc

SEQ ID NO: 1449669 - RNA, 22 nt, Homo sapiens
uugcgcucucaagaccagagac

SEQ ID NO: 1449670 - RNA, 21 nt, Homo sapiens
uugcggaagcuguuggaugau

SEQ ID NO: 1449671 - RNA, 16 nt, Homo sapiens
uugcuaaaauauaauu

SEQ ID NO: 1449672 - RNA, 12 nt, Homo sapiens
uugcuacauucu

SEQ ID NO: 1449673 - RNA, 13 nt, Homo sapiens
uugcuagcaguaa

SEQ ID NO: 1449674 - RNA, 15 nt, Homo sapiens
uugcuauagagccua

SEQ ID NO: 1449675 - RNA, 23 nt, Homo sapiens
uugcucauaagcaauaccagcaa

SEQ ID NO: 1449676 - RNA, 20 nt, Homo sapiens
uugcucuaggaagacauuuu

SEQ ID NO: 1449677 - RNA, 16 nt, Homo sapiens
uugcucucagcugcca

SEQ ID NO: 1449678 - RNA, 19 nt, Homo sapiens
uugcucucgacaguaucca

SEQ ID NO: 1449679 - RNA, 17 nt, Homo sapiens
uugcugaaaaugguauu

SEQ ID NO: 1449680 - RNA, 16 nt, Homo sapiens
uugcugauccaugaga

SEQ ID NO: 1449681 - RNA, 20 nt, Homo sapiens
uugcugccuuaaugacauuc

SEQ ID NO: 1449682 - RNA, 20 nt, Homo sapiens
uugcugucuuggggucccac

SEQ ID NO: 1449683 - RNA, 17 nt, Homo sapiens
uugcuuuugugaacuuu

SEQ ID NO: 1449684 - RNA, 20 nt, Homo sapiens
uuggaaacaaaaauguacaa

SEQ ID NO: 1449685 - RNA, 14 nt, Homo sapiens
uuggaaaguacucc

SEQ ID NO: 1449686 - RNA, 21 nt, Homo sapiens
uuggaacaacugauacuucac

SEQ ID NO: 1449687 - RNA, 14 nt, Homo sapiens
uuggaacagaaugu

SEQ ID NO: 1449688 - RNA, 21 nt, Homo sapiens
uuggaagaaaaaaaucuucuc

SEQ ID NO: 1449689 - RNA, 19 nt, Homo sapiens
uuggaagaggcugagacau

SEQ ID NO: 1449690 - RNA, 15 nt, Homo sapiens
uuggaagcauacaaa

SEQ ID NO: 1449691 - RNA, 15 nt, Homo sapiens
uuggaaggggccuug

SEQ ID NO: 1449692 - RNA, 19 nt, Homo sapiens
uuggaauuuguaaccucag

SEQ ID NO: 1449693 - RNA, 23 nt, Homo sapiens
uuggacaaucaugaaauaugcau

SEQ ID NO: 1449694 - RNA, 19 nt, Homo sapiens
uuggaccuguucaaaaagg

SEQ ID NO: 1449695 - RNA, 19 nt, Homo sapiens
uuggacuggauaagugcua

SEQ ID NO: 1449696 - RNA, 18 nt, Homo sapiens
uuggacuguaagggauug

SEQ ID NO: 1449697 - RNA, 18 nt, Homo sapiens
uuggaguuagguccucac

SEQ ID NO: 1449698 - RNA, 17 nt, Homo sapiens
uuggauguaaaacugaa

SEQ ID NO: 1449699 - RNA, 12 nt, Homo sapiens
uuggauuugaca

SEQ ID NO: 1449700 - RNA, 23 nt, Homo sapiens
uuggauuuuugacucuggcaaag

SEQ ID NO: 1449701 - RNA, 20 nt, Homo sapiens
uuggcaaaagccuuguguau

SEQ ID NO: 1449702 - RNA, 19 nt, Homo sapiens
uuggcaccugcacacucca

SEQ ID NO: 1449703 - RNA, 13 nt, Homo sapiens
uuggcaccuguag

SEQ ID NO: 1449704 - RNA, 13 nt, Homo sapiens
uuggcaugccauu

SEQ ID NO: 1449705 - RNA, 13 nt, Homo sapiens
uuggccacugucu

SEQ ID NO: 1449706 - RNA, 23 nt, Homo sapiens
uuggccaugggucccauucuugg

SEQ ID NO: 1449707 - RNA, 15 nt, Homo sapiens
uuggcuacacacaaa

SEQ ID NO: 1449708 - RNA, 22 nt, Homo sapiens
uuggcuacacacaaaccaguau

SEQ ID NO: 1449709 - RNA, 14 nt, Homo sapiens
uuggcucaauccuc

SEQ ID NO: 1449710 - RNA, 21 nt, Homo sapiens
uuggcucccaagucacaccca

SEQ ID NO: 1449711 - RNA, 21 nt, Homo sapiens
uugggaaaaaaacuuggcacu

SEQ ID NO: 1449712 - RNA, 15 nt, Homo sapiens
uugggacucaggaua

SEQ ID NO: 1449713 - RNA, 16 nt, Homo sapiens
uugggagacaugugac

SEQ ID NO: 1449714 - RNA, 12 nt, Homo sapiens
uugggagcaaaa

SEQ ID NO: 1449715 - RNA, 22 nt, Homo sapiens
uugggaggcugaggcaggagaa

SEQ ID NO: 1449716 - RNA, 15 nt, Homo sapiens
uugggauaguguucu

SEQ ID NO: 1449717 - RNA, 20 nt, Homo sapiens
uugggcaccagcucaugcca

SEQ ID NO: 1449718 - RNA, 13 nt, Homo sapiens
uugggcaugccau

SEQ ID NO: 1449719 - RNA, 14 nt, Homo sapiens
uugggcaugccauu

SEQ ID NO: 1449720 - RNA, 21 nt, Homo sapiens
uugggccagugaacaggguaa

SEQ ID NO: 1449721 - RNA, 20 nt, Homo sapiens
uugggcuggaugccgaggua

SEQ ID NO: 1449722 - RNA, 10 nt, Homo sapiens
uuggggacuc

SEQ ID NO: 1449723 - RNA, 18 nt, Homo sapiens
uuggguacugggugcugu

SEQ ID NO: 1449724 - RNA, 13 nt, Homo sapiens
uugggucuuugaa

SEQ ID NO: 1449725 - RNA, 17 nt, Homo sapiens
uuggguucacagugcau

SEQ ID NO: 1449726 - RNA, 21 nt, Homo sapiens
uugguacuacuagaugucuuu

SEQ ID NO: 1449727 - RNA, 14 nt, Homo sapiens
uugguacuuuuaug

SEQ ID NO: 1449728 - RNA, 16 nt, Homo sapiens
uugguccuggggacca

SEQ ID NO: 1449729 - RNA, 14 nt, Homo sapiens
uuggugaauuucac

SEQ ID NO: 1449730 - RNA, 15 nt, Homo sapiens
uugguggaugugaug

SEQ ID NO: 1449731 - RNA, 22 nt, Homo sapiens
uugguguauguaugaguaucug

SEQ ID NO: 1449732 - RNA, 17 nt, Homo sapiens
uuguaacauaaugcacu

SEQ ID NO: 1449733 - RNA, 13 nt, Homo sapiens
uuguaaccugcau

SEQ ID NO: 1449734 - RNA, 22 nt, Homo sapiens
uuguaagaguguagaagcauuc

SEQ ID NO: 1449735 - RNA, 17 nt, Homo sapiens
uuguaaguaaauugccu

SEQ ID NO: 1449736 - RNA, 23 nt, Homo sapiens
uuguaaguggucgcuuacuuuga

SEQ ID NO: 1449737 - RNA, 14 nt, Homo sapiens
uuguaauaagcaau

SEQ ID NO: 1449738 - RNA, 22 nt, Homo sapiens
uuguaauacuuucuaugugaca

SEQ ID NO: 1449739 - RNA, 15 nt, Homo sapiens
uuguaauuccuuacu

SEQ ID NO: 1449740 - RNA, 20 nt, Homo sapiens
uuguacagugucugugccau

SEQ ID NO: 1449741 - RNA, 18 nt, Homo sapiens
uuguaccucuaaguacau

SEQ ID NO: 1449742 - RNA, 23 nt, Homo sapiens
uuguagaaauuaacaaaugugcu

SEQ ID NO: 1449743 - RNA, 13 nt, Homo sapiens
uuguagcacugag

SEQ ID NO: 1449744 - RNA, 16 nt, Homo sapiens
uuguagcacugagggu

SEQ ID NO: 1449745 - RNA, 21 nt, Homo sapiens
uuguaggagaaacucccaugu

SEQ ID NO: 1449746 - RNA, 19 nt, Homo sapiens
uuguauauugucagauauu

SEQ ID NO: 1449747 - RNA, 17 nt, Homo sapiens
uuguaucaaagugugau

SEQ ID NO: 1449748 - RNA, 19 nt, Homo sapiens
uugucacuuuuuaugcuau

SEQ ID NO: 1449749 - RNA, 18 nt, Homo sapiens
uugucaguucuuggugcu

SEQ ID NO: 1449750 - RNA, 22 nt, Homo sapiens
uugucauguggcuaaaugccua

SEQ ID NO: 1449751 - RNA, 18 nt, Homo sapiens
uugucuaaacaaugcuga

SEQ ID NO: 1449752 - RNA, 13 nt, Homo sapiens
uugucuacacucu

SEQ ID NO: 1449753 - RNA, 20 nt, Homo sapiens
uugucucuagagcagggauu

SEQ ID NO: 1449754 - RNA, 22 nt, Homo sapiens
uugucugaacuugcauugugau

SEQ ID NO: 1449755 - RNA, 13 nt, Homo sapiens
uugucuguaaaua

SEQ ID NO: 1449756 - RNA, 20 nt, Homo sapiens
uugucuguuuuuguaacuua

SEQ ID NO: 1449757 - RNA, 20 nt, Homo sapiens
uugucuuuccuggcacuaac

SEQ ID NO: 1449758 - RNA, 17 nt, Homo sapiens
uugugaguuuaccuugu

SEQ ID NO: 1449759 - RNA, 15 nt, Homo sapiens
uugugaugaugcugu

SEQ ID NO: 1449760 - RNA, 20 nt, Homo sapiens
uugugaugucuuuucuuggc

SEQ ID NO: 1449761 - RNA, 16 nt, Homo sapiens
uugugcuccaaacaaa

SEQ ID NO: 1449762 - RNA, 21 nt, Homo sapiens
uugugcuccuucggauaugau

SEQ ID NO: 1449763 - RNA, 21 nt, Homo sapiens
uugugcugcaccuggucauac

SEQ ID NO: 1449764 - RNA, 14 nt, Homo sapiens
uuguggugcauuga

SEQ ID NO: 1449765 - RNA, 14 nt, Homo sapiens
uugugguuaaucug

SEQ ID NO: 1449766 - RNA, 15 nt, Homo sapiens
uuguguuagccucuu

SEQ ID NO: 1449767 - RNA, 15 nt, Homo sapiens
uuguuaucagucaau

SEQ ID NO: 1449768 - RNA, 16 nt, Homo sapiens
uuguuaucagucaaua

SEQ ID NO: 1449769 - RNA, 13 nt, Homo sapiens
uuguuauuuugga

SEQ ID NO: 1449770 - RNA, 11 nt, Homo sapiens
uuguucaauua

SEQ ID NO: 1449771 - RNA, 20 nt, Homo sapiens
uuguucuuuggaaauacaca

SEQ ID NO: 1449772 - RNA, 20 nt, Homo sapiens
uuguuggaucuucaauggcu

SEQ ID NO: 1449773 - RNA, 15 nt, Homo sapiens
uuguuggaugaaauu

SEQ ID NO: 1449774 - RNA, 13 nt, Homo sapiens
uuguuguuauuaa

SEQ ID NO: 1449775 - RNA, 13 nt, Homo sapiens
uuguuguuugcuu

SEQ ID NO: 1449776 - RNA, 23 nt, Homo sapiens
uuguuuaaagaauaaaguccaaa

SEQ ID NO: 1449777 - RNA, 21 nt, Homo sapiens
uuguuucaaaugaaacuuuaa

SEQ ID NO: 1449778 - RNA, 16 nt, Homo sapiens
uuguuucugcauucau

SEQ ID NO: 1449779 - RNA, 21 nt, Homo sapiens
uuguuuuaugcucagggucaa

SEQ ID NO: 1449780 - RNA, 18 nt, Homo sapiens
uuguuuuuauuguaaaac

SEQ ID NO: 1449781 - RNA, 15 nt, Homo sapiens
uuuaaaauaaauucc

SEQ ID NO: 1449782 - RNA, 20 nt, Homo sapiens
uuuaaaauaaauuccuacaa

SEQ ID NO: 1449783 - RNA, 16 nt, Homo sapiens
uuuaaaauauuacaca

SEQ ID NO: 1449784 - RNA, 18 nt, Homo sapiens
uuuaaaauauuugaauga

SEQ ID NO: 1449785 - RNA, 15 nt, Homo sapiens
uuuaaaauucaauua

SEQ ID NO: 1449786 - RNA, 18 nt, Homo sapiens
uuuaaauggcuacuuugg

SEQ ID NO: 1449787 - RNA, 15 nt, Homo sapiens
uuuaaauuguuucau

SEQ ID NO: 1449788 - RNA, 18 nt, Homo sapiens
uuuaacccuaaucuuuca

SEQ ID NO: 1449789 - RNA, 17 nt, Homo sapiens
uuuaaccgcacaugcac

SEQ ID NO: 1449790 - RNA, 19 nt, Homo sapiens
uuuaagaaaaguauuuuga

SEQ ID NO: 1449791 - RNA, 18 nt, Homo sapiens
uuuaagaauaucuguaau

SEQ ID NO: 1449792 - RNA, 17 nt, Homo sapiens
uuuaagaguuacuuaau

SEQ ID NO: 1449793 - RNA, 17 nt, Homo sapiens
uuuaagcagcgccagug

SEQ ID NO: 1449794 - RNA, 14 nt, Homo sapiens
uuuaagcagucuca

SEQ ID NO: 1449795 - RNA, 13 nt, Homo sapiens
uuuaagcaucaaa

SEQ ID NO: 1449796 - RNA, 23 nt, Homo sapiens
uuuaaggauguugccacuggcaa

SEQ ID NO: 1449797 - RNA, 13 nt, Homo sapiens
uuuaagguacuua

SEQ ID NO: 1449798 - RNA, 19 nt, Homo sapiens
uuuaauacaggguagauaa

SEQ ID NO: 1449799 - RNA, 19 nt, Homo sapiens
uuuaauagaaauaaauucc

SEQ ID NO: 1449800 - RNA, 16 nt, Homo sapiens
uuuaauagaauauaau

SEQ ID NO: 1449801 - RNA, 16 nt, Homo sapiens
uuuaaucaaguugaau

SEQ ID NO: 1449802 - RNA, 19 nt, Homo sapiens
uuuaaucauuuugccucuu

SEQ ID NO: 1449803 - RNA, 15 nt, Homo sapiens
uuuaauggcauguca

SEQ ID NO: 1449804 - RNA, 22 nt, Homo sapiens
uuuaauucucauuuguucucac

SEQ ID NO: 1449805 - RNA, 14 nt, Homo sapiens
uuuacaaccugaug

SEQ ID NO: 1449806 - RNA, 15 nt, Homo sapiens
uuuacaaggugacaa

SEQ ID NO: 1449807 - RNA, 23 nt, Homo sapiens
uuuacaauaaaacuuugcugcca

SEQ ID NO: 1449808 - RNA, 15 nt, Homo sapiens
uuuacaaucugcacu

SEQ ID NO: 1449809 - RNA, 20 nt, Homo sapiens
uuuacagaaaagacucugac

SEQ ID NO: 1449810 - RNA, 22 nt, Homo sapiens
uuuacagauaucugaauggaag

SEQ ID NO: 1449811 - RNA, 23 nt, Homo sapiens
uuuacauguguagccuauguugu

SEQ ID NO: 1449812 - RNA, 20 nt, Homo sapiens
uuuaccaaggauauuuacag

SEQ ID NO: 1449813 - RNA, 19 nt, Homo sapiens
uuuaccaguuaauuacuca

SEQ ID NO: 1449814 - RNA, 21 nt, Homo sapiens
uuuaccccucacaauccuugc

SEQ ID NO: 1449815 - RNA, 19 nt, Homo sapiens
uuuaccuguauacagugca

SEQ ID NO: 1449816 - RNA, 21 nt, Homo sapiens
uuuacgcuuaguuaucagcuu

SEQ ID NO: 1449817 - RNA, 23 nt, Homo sapiens
uuuacguuugauacaacauuaag

SEQ ID NO: 1449818 - RNA, 13 nt, Homo sapiens
uuuacuaccuuau

SEQ ID NO: 1449819 - RNA, 16 nt, Homo sapiens
uuuacuuuguacuugu

SEQ ID NO: 1449820 - RNA, 16 nt, Homo sapiens
uuuacuuuuaccacua

SEQ ID NO: 1449821 - RNA, 16 nt, Homo sapiens
uuuagaaaugcaaaau

SEQ ID NO: 1449822 - RNA, 16 nt, Homo sapiens
uuuagcagaggagcca

SEQ ID NO: 1449823 - RNA, 22 nt, Homo sapiens
uuuaggaaaaucacuuugucua

SEQ ID NO: 1449824 - RNA, 13 nt, Homo sapiens
uuuaggagugugu

SEQ ID NO: 1449825 - RNA, 12 nt, Homo sapiens
uuuagggagaac

SEQ ID NO: 1449826 - RNA, 17 nt, Homo sapiens
uuuaguucuuacugcuu

SEQ ID NO: 1449827 - RNA, 12 nt, Homo sapiens
uuuauacaggaa

SEQ ID NO: 1449828 - RNA, 18 nt, Homo sapiens
uuuauagaggcuagcuuc

SEQ ID NO: 1449829 - RNA, 19 nt, Homo sapiens
uuuauagagugucucaggg

SEQ ID NO: 1449830 - RNA, 13 nt, Homo sapiens
uuuauauacuggg

SEQ ID NO: 1449831 - RNA, 19 nt, Homo sapiens
uuuauauguugcuauaaua

SEQ ID NO: 1449832 - RNA, 14 nt, Homo sapiens
uuuaucaaagcaua

SEQ ID NO: 1449833 - RNA, 19 nt, Homo sapiens
uuuaucacuucauucacau

SEQ ID NO: 1449834 - RNA, 22 nt, Homo sapiens
uuuaucacuucauucacauuca

SEQ ID NO: 1449835 - RNA, 17 nt, Homo sapiens
uuuauccaaaaugugua

SEQ ID NO: 1449836 - RNA, 14 nt, Homo sapiens
uuuaucccauggaa

SEQ ID NO: 1449837 - RNA, 20 nt, Homo sapiens
uuuaucuaaauuaaagccuu

SEQ ID NO: 1449838 - RNA, 19 nt, Homo sapiens
uuuaucugugaauucagau

SEQ ID NO: 1449839 - RNA, 14 nt, Homo sapiens
uuuaucuguucuug

SEQ ID NO: 1449840 - RNA, 17 nt, Homo sapiens
uuuaucuugucucuggg

SEQ ID NO: 1449841 - RNA, 11 nt, Homo sapiens
uuuaugaaaug

SEQ ID NO: 1449842 - RNA, 13 nt, Homo sapiens
uuuaugacucuua

SEQ ID NO: 1449843 - RNA, 13 nt, Homo sapiens
uuuaugaguacuu

SEQ ID NO: 1449844 - RNA, 13 nt, Homo sapiens
uuuauggccucag

SEQ ID NO: 1449845 - RNA, 19 nt, Homo sapiens
uuuauguuugaaugauuua

SEQ ID NO: 1449846 - RNA, 13 nt, Homo sapiens
uuuauuaccucug

SEQ ID NO: 1449847 - RNA, 17 nt, Homo sapiens
uuuauuauuuucaccug

SEQ ID NO: 1449848 - RNA, 15 nt, Homo sapiens
uuuauucaguaaaca

SEQ ID NO: 1449849 - RNA, 14 nt, Homo sapiens
uuuauucauccagc

SEQ ID NO: 1449850 - RNA, 21 nt, Homo sapiens
uuuauucauuagcugugauuu

SEQ ID NO: 1449851 - RNA, 11 nt, Homo sapiens
uuuauugccuc

SEQ ID NO: 1449852 - RNA, 15 nt, Homo sapiens
uuuauuuaaagcauu

SEQ ID NO: 1449853 - RNA, 14 nt, Homo sapiens
uuuauuuccacuaa

SEQ ID NO: 1449854 - RNA, 16 nt, Homo sapiens
uuuauuuccacuaaaa

SEQ ID NO: 1449855 - RNA, 18 nt, Homo sapiens
uuuauuuuguaauuauga

SEQ ID NO: 1449856 - RNA, 19 nt, Homo sapiens
uuucaaagauguguugcua

SEQ ID NO: 1449857 - RNA, 13 nt, Homo sapiens
uuucaaagcuaaa

SEQ ID NO: 1449858 - RNA, 13 nt, Homo sapiens
uuucaaagugaua

SEQ ID NO: 1449859 - RNA, 14 nt, Homo sapiens
uuucaaaugaucuu

SEQ ID NO: 1449860 - RNA, 12 nt, Homo sapiens
uuucaacuauuu

SEQ ID NO: 1449861 - RNA, 15 nt, Homo sapiens
uuucaauugucacuu

SEQ ID NO: 1449862 - RNA, 13 nt, Homo sapiens
uuucacacacaca

SEQ ID NO: 1449863 - RNA, 12 nt, Homo sapiens
uuucacauugaa

SEQ ID NO: 1449864 - RNA, 16 nt, Homo sapiens
uuucacuuugcucuca

SEQ ID NO: 1449865 - RNA, 15 nt, Homo sapiens
uuucagaaaauauua

SEQ ID NO: 1449866 - RNA, 17 nt, Homo sapiens
uuucagauaaacaacaa

SEQ ID NO: 1449867 - RNA, 21 nt, Homo sapiens
uuucagaucauauuucacaau

SEQ ID NO: 1449868 - RNA, 18 nt, Homo sapiens
uuucaguugccauugaca

SEQ ID NO: 1449869 - RNA, 19 nt, Homo sapiens
uuucauagagauuugucua

SEQ ID NO: 1449870 - RNA, 17 nt, Homo sapiens
uuucauauguugcucag

SEQ ID NO: 1449871 - RNA, 14 nt, Homo sapiens
uuucuauucuguca

SEQ ID NO: 1449872 - RNA, 15 nt, Homo sapiens
uuucuccuuagucuu

SEQ ID NO: 1449873 - RNA, 15 nt, Homo sapiens
uuucucugccaguga

SEQ ID NO: 1449874 - RNA, 16 nt, Homo sapiens
uuucucugccagugac

SEQ ID NO: 1449875 - RNA, 17 nt, Homo sapiens
uuucugagaugcucacu

SEQ ID NO: 1449876 - RNA, 14 nt, Homo sapiens
uuucugaguuucau

SEQ ID NO: 1449877 - RNA, 15 nt, Homo sapiens
uuucugauaccacug

SEQ ID NO: 1449878 - RNA, 21 nt, Homo sapiens
uuucugggucuuuugcuacua

SEQ ID NO: 1449879 - RNA, 17 nt, Homo sapiens
uuucuguugccacaacc

SEQ ID NO: 1449880 - RNA, 16 nt, Homo sapiens
uuucuucaugcaauga

SEQ ID NO: 1449881 - RNA, 23 nt, Homo sapiens
uuucuucuacugcuaucuacuac

SEQ ID NO: 1449882 - RNA, 12 nt, Homo sapiens
uuucuugcagau

SEQ ID NO: 1449883 - RNA, 13 nt, Homo sapiens
uuucuugcuuuca

SEQ ID NO: 1449884 - RNA, 14 nt, Homo sapiens
uuucuuuaucauug

SEQ ID NO: 1449885 - RNA, 23 nt, Homo sapiens
uuucuuucaaaaguagagcaaaa

SEQ ID NO: 1449886 - RNA, 15 nt, Homo sapiens
uuucuuuuaagcuau

SEQ ID NO: 1449887 - RNA, 18 nt, Homo sapiens
uuucuuuuuuauacucaa

SEQ ID NO: 1449888 - RNA, 18 nt, Homo sapiens
uuugaaaaaaguacauau

SEQ ID NO: 1449889 - RNA, 17 nt, Homo sapiens
uuugaagcagucuugcu

SEQ ID NO: 1449890 - RNA, 12 nt, Homo sapiens
uuugaaggcaaa

SEQ ID NO: 1449891 - RNA, 14 nt, Homo sapiens
uuugaaguuuacau

SEQ ID NO: 1449892 - RNA, 19 nt, Homo sapiens
uuugacaaaacccacuguu

SEQ ID NO: 1449893 - RNA, 14 nt, Homo sapiens
uuugacaaccauga

SEQ ID NO: 1449894 - RNA, 12 nt, Homo sapiens
uuugacacugaa

SEQ ID NO: 1449895 - RNA, 17 nt, Homo sapiens
uuugaccggaucuacac

SEQ ID NO: 1449896 - RNA, 14 nt, Homo sapiens
uuugacuugaauau

SEQ ID NO: 1449897 - RNA, 20 nt, Homo sapiens
uuugacuuucuucugaauau

SEQ ID NO: 1449898 - RNA, 19 nt, Homo sapiens
uuugacuuugcccaggcau

SEQ ID NO: 1449899 - RNA, 15 nt, Homo sapiens
uuugagcgcgcugag

SEQ ID NO: 1449900 - RNA, 21 nt, Homo sapiens
uuugagguagaaaugcaaggg

SEQ ID NO: 1449901 - RNA, 17 nt, Homo sapiens
uuugaggugaggguugg

SEQ ID NO: 1449902 - RNA, 19 nt, Homo sapiens
uuugauacaagaaagcaau

SEQ ID NO: 1449903 - RNA, 19 nt, Homo sapiens
uuugauagggaacugggga

SEQ ID NO: 1449904 - RNA, 17 nt, Homo sapiens
uuugauauuugcauuga

SEQ ID NO: 1449905 - RNA, 17 nt, Homo sapiens
uuugauccaggugccaa

SEQ ID NO: 1449906 - RNA, 12 nt, Homo sapiens
uuugaugccauu

SEQ ID NO: 1449907 - RNA, 14 nt, Homo sapiens
uuugauuuacauau

SEQ ID NO: 1449908 - RNA, 21 nt, Homo sapiens
uuugcaaaauuuccaguaccu

SEQ ID NO: 1449909 - RNA, 19 nt, Homo sapiens
uuugcaacucccuggguaa

SEQ ID NO: 1449910 - RNA, 17 nt, Homo sapiens
uuugcagauuuauuuag

SEQ ID NO: 1449911 - RNA, 15 nt, Homo sapiens
uuugcauguuuugua

SEQ ID NO: 1449912 - RNA, 17 nt, Homo sapiens
uuugccaaggcaaaaaa

SEQ ID NO: 1449913 - RNA, 17 nt, Homo sapiens
uuugccagugccucuca

SEQ ID NO: 1449914 - RNA, 11 nt, Homo sapiens
uuugccuuccu

SEQ ID NO: 1449915 - RNA, 23 nt, Homo sapiens
uuugccuuccuuucuccaggacc

SEQ ID NO: 1449916 - RNA, 19 nt, Homo sapiens
uuugccuuggcuuugccag

SEQ ID NO: 1449917 - RNA, 18 nt, Homo sapiens
uuugcuguggaacuacau

SEQ ID NO: 1449918 - RNA, 22 nt, Homo sapiens
uuuggagccucccuucugccuu

SEQ ID NO: 1449919 - RNA, 18 nt, Homo sapiens
uuuggcuagguaucauuc

SEQ ID NO: 1449920 - RNA, 14 nt, Homo sapiens
uuugggccagacau

SEQ ID NO: 1449921 - RNA, 19 nt, Homo sapiens
uuugggccccucagagccc

SEQ ID NO: 1449922 - RNA, 23 nt, Homo sapiens
uuuggggaaaaaagcacauacau

SEQ ID NO: 1449923 - RNA, 21 nt, Homo sapiens
uuuggggaaaggcuuggcaca

SEQ ID NO: 1449924 - RNA, 19 nt, Homo sapiens
uuuggggagcaggaggcca

SEQ ID NO: 1449925 - RNA, 23 nt, Homo sapiens
uuugggggguguuuuguggggcu

SEQ ID NO: 1449926 - RNA, 11 nt, Homo sapiens
uuugggguccc

SEQ ID NO: 1449927 - RNA, 17 nt, Homo sapiens
uuuggguuuugggucuu

SEQ ID NO: 1449928 - RNA, 19 nt, Homo sapiens
uuugguagaugcaugacuu

SEQ ID NO: 1449929 - RNA, 18 nt, Homo sapiens
uuuggucgaggaguaaca

SEQ ID NO: 1449930 - RNA, 20 nt, Homo sapiens
uuuggucuguuuugccuuca

SEQ ID NO: 1449931 - RNA, 16 nt, Homo sapiens
uuugguuaaacccaug

SEQ ID NO: 1449932 - RNA, 18 nt, Homo sapiens
uuugguuccacaaucucu

SEQ ID NO: 1449933 - RNA, 18 nt, Homo sapiens
uuuguaagugcugcuaua

SEQ ID NO: 1449934 - RNA, 15 nt, Homo sapiens
uuuguaaugcugcac

SEQ ID NO: 1449935 - RNA, 20 nt, Homo sapiens
uuuguaaugcugcacagaaa

SEQ ID NO: 1449936 - RNA, 15 nt, Homo sapiens
uuuguauuuauuaau

SEQ ID NO: 1449937 - RNA, 12 nt, Homo sapiens
uuugucagaaac

SEQ ID NO: 1449938 - RNA, 23 nt, Homo sapiens
uuugucagaggcacaaaaggguu

SEQ ID NO: 1449939 - RNA, 23 nt, Homo sapiens
uuugugaaaugaaaacauguaau

SEQ ID NO: 1449940 - RNA, 14 nt, Homo sapiens
uuugugguaguccu

SEQ ID NO: 1449941 - RNA, 22 nt, Homo sapiens
uuuguuacagccaagugccaaa

SEQ ID NO: 1449942 - RNA, 22 nt, Homo sapiens
uuuguucaaugcuagaacaacg

SEQ ID NO: 1449943 - RNA, 10 nt, Homo sapiens
uuuguucccu

SEQ ID NO: 1449944 - RNA, 15 nt, Homo sapiens
uuuguugagcaugac

SEQ ID NO: 1449945 - RNA, 21 nt, Homo sapiens
uuuucucuguguuuguuccua

SEQ ID NO: 1449946 - RNA, 20 nt, Homo sapiens
uuuucucuuagaacauugua

SEQ ID NO: 1449947 - RNA, 14 nt, Homo sapiens
uuuucugccaggga

SEQ ID NO: 1449948 - RNA, 17 nt, Homo sapiens
uuuucuuauugcgcugc

SEQ ID NO: 1449949 - RNA, 18 nt, Homo sapiens
uuuugacaucagcauuag

SEQ ID NO: 1449950 - RNA, 11 nt, Homo sapiens
uuuugauugcc

SEQ ID NO: 1449951 - RNA, 14 nt, Homo sapiens
uuuuggguauuaau

SEQ ID NO: 1449952 - RNA, 18 nt, Homo sapiens
uuuugguuccacaaucuc

SEQ ID NO: 1449953 - RNA, 20 nt, Homo sapiens
uuuugguuuaaaaaguuuca

SEQ ID NO: 1449954 - RNA, 17 nt, Homo sapiens
uuuugugcaaagccaaa

SEQ ID NO: 1449955 - RNA, 22 nt, Homo sapiens
uuuugugucaaaaggacauuua

SEQ ID NO: 1449956 - RNA, 16 nt, Homo sapiens
uuuuguguuuugguua

SEQ ID NO: 1449957 - RNA, 15 nt, Homo sapiens
uuuuuaacugauucu

SEQ ID NO: 1449958 - RNA, 21 nt, Homo sapiens
uuuuuaauggcaauaggacau

SEQ ID NO: 1449959 - RNA, 20 nt, Homo sapiens
uuuuuagcugguggcaauaa

SEQ ID NO: 1449960 - RNA, 15 nt, Homo sapiens
uuuuucauucauccc

SEQ ID NO: 1449961 - RNA, 18 nt, Homo sapiens
uuuuuccucccagugaga

SEQ ID NO: 1449962 - RNA, 16 nt, Homo sapiens
uuuuucuccucuccau

SEQ ID NO: 1449963 - RNA, 19 nt, Homo sapiens
uuuuucucuuugugguuuc

SEQ ID NO: 1449964 - RNA, 19 nt, Homo sapiens
uuuuuguuaucagucaaua

SEQ ID NO: 1449965 - RNA, 23 nt, Homo sapiens
uuuuuuaaaacacuaaaagcagc

SEQ ID NO: 1449966 - RNA, 13 nt, Homo sapiens
uuuuuucccccac

SEQ ID NO: 1449967 - RNA, 12 nt, Homo sapiens
uuuuuuccuuaa

SEQ ID NO: 1449968 - RNA, 13 nt, Homo sapiens
uuuuuuucuccuc

SEQ ID NO: 1449969 - RNA, 18 nt, Homo sapiens
aaccccaguggauucuca

SEQ ID NO: 1449970 - RNA, 19 nt, Homo sapiens
aaccccaucucuacugaaa

SEQ ID NO: 1449971 - RNA, 20 nt, Homo sapiens
aaccccauguccucagcauu

SEQ ID NO: 1449972 - RNA, 13 nt, Homo sapiens
aacccccagugua

SEQ ID NO: 1449973 - RNA, 17 nt, Homo sapiens
aacccccgccaccucag

SEQ ID NO: 1449974 - RNA, 16 nt, Homo sapiens
aaccccgucucuacua

SEQ ID NO: 1449975 - RNA, 16 nt, Homo sapiens
aacccggcacugcccu

SEQ ID NO: 1449976 - RNA, 13 nt, Homo sapiens
aacccuaccuguc

SEQ ID NO: 1449977 - RNA, 22 nt, Homo sapiens
aacccuggaucaguccuuugau

SEQ ID NO: 1449978 - RNA, 23 nt, Homo sapiens
aacccuucccucaccuuggcacc

SEQ ID NO: 1449979 - RNA, 16 nt, Homo sapiens
aaccgcacaugcacac

SEQ ID NO: 1449980 - RNA, 16 nt, Homo sapiens
aaccguguccagcaca

SEQ ID NO: 1449981 - RNA, 12 nt, Homo sapiens
aaccuaccuccc

SEQ ID NO: 1449982 - RNA, 12 nt, Homo sapiens
aaccuagaauuu

SEQ ID NO: 1449983 - RNA, 20 nt, Homo sapiens
aaccuaggcaaagaguauau

SEQ ID NO: 1449984 - RNA, 16 nt, Homo sapiens
aaccucaaagugacua

SEQ ID NO: 1449985 - RNA, 16 nt, Homo sapiens
aaccucaccauuguga

SEQ ID NO: 1449986 - RNA, 21 nt, Homo sapiens
aaccucagccuggccagacac

SEQ ID NO: 1449987 - RNA, 15 nt, Homo sapiens
aaccucauuccccaa

SEQ ID NO: 1449988 - RNA, 21 nt, Homo sapiens
aaccucauuccccaaccacuu

SEQ ID NO: 1449989 - RNA, 14 nt, Homo sapiens
aaccucauugacaa

SEQ ID NO: 1449990 - RNA, 16 nt, Homo sapiens
aaccucauugcagcua

SEQ ID NO: 1449991 - RNA, 20 nt, Homo sapiens
aaccuccgcauccgggguuc

SEQ ID NO: 1449992 - RNA, 19 nt, Homo sapiens
acuggccccuacuuugugg

SEQ ID NO: 1449993 - RNA, 19 nt, Homo sapiens
acuggcuucucuugaguca

SEQ ID NO: 1449994 - RNA, 18 nt, Homo sapiens
acugggaggcagggcucu

SEQ ID NO: 1449995 - RNA, 23 nt, Homo sapiens
acuggggccuccagaacucacug

SEQ ID NO: 1449996 - RNA, 20 nt, Homo sapiens
acugggugaaucuggcagga

SEQ ID NO: 1449997 - RNA, 16 nt, Homo sapiens
acugguauguguggau

SEQ ID NO: 1449998 - RNA, 22 nt, Homo sapiens
acugguauguguggaugaugcu

SEQ ID NO: 1449999 - RNA, 19 nt, Homo sapiens
acugguuuggucaguuaca

SEQ ID NO: 1450000 - RNA, 23 nt, Homo sapiens
acuguaacguuuucuuucacaca

SEQ ID NO: 1450001 - RNA, 12 nt, Homo sapiens
acuguacauuua

SEQ ID NO: 1450002 - RNA, 17 nt, Homo sapiens
acugucacuuugcucug

SEQ ID NO: 1450003 - RNA, 22 nt, Homo sapiens
acuguccagagagcaacucuga

SEQ ID NO: 1450004 - RNA, 23 nt, Homo sapiens
acuguccccacgccgggaaccaa

SEQ ID NO: 1450005 - RNA, 16 nt, Homo sapiens
acugucccuugccuca

SEQ ID NO: 1450006 - RNA, 21 nt, Homo sapiens
acuguccugaccaucgcacac

SEQ ID NO: 1450007 - RNA, 12 nt, Homo sapiens
acugucucaaga

SEQ ID NO: 1450008 - RNA, 18 nt, Homo sapiens
acugugaaguuacaugca

SEQ ID NO: 1450009 - RNA, 18 nt, Homo sapiens
acuguggcuagugacaaa

SEQ ID NO: 1450010 - RNA, 21 nt, Homo sapiens
acuguggcuagugacaaauaa

SEQ ID NO: 1450011 - RNA, 14 nt, Homo sapiens
acuguggcucugca

SEQ ID NO: 1450012 - RNA, 22 nt, Homo sapiens
acugugggauguguucuucuuu

SEQ ID NO: 1450013 - RNA, 13 nt, Homo sapiens
acugugugccagg

SEQ ID NO: 1450014 - RNA, 16 nt, Homo sapiens
acuguugcaaacucag

SEQ ID NO: 1450015 - RNA, 19 nt, Homo sapiens
acuguugcaaacucagugc

SEQ ID NO: 1450016 - RNA, 17 nt, Homo sapiens
acuguugccaccaugua

SEQ ID NO: 1450017 - RNA, 20 nt, Homo sapiens
acuguuuuguaagugcugcu

SEQ ID NO: 1450018 - RNA, 21 nt, Homo sapiens
acuguuuuguaagugcugcua

SEQ ID NO: 1450019 - RNA, 14 nt, Homo sapiens
acuuaaccuuuuaa

SEQ ID NO: 1450020 - RNA, 15 nt, Homo sapiens
acuuaagacugugua

SEQ ID NO: 1450021 - RNA, 23 nt, Homo sapiens
acuuacuauaauuugacuugaau

SEQ ID NO: 1450022 - RNA, 22 nt, Homo sapiens
acuuagaaauugcauuuccuga

SEQ ID NO: 1450023 - RNA, 23 nt, Homo sapiens
acuuagaaauugcauuuccugac

SEQ ID NO: 1450024 - RNA, 12 nt, Homo sapiens
acuuagugacaa

SEQ ID NO: 1450025 - RNA, 18 nt, Homo sapiens
acuuauaccugcuaucag

SEQ ID NO: 1450026 - RNA, 22 nt, Homo sapiens
acuuaucccaagagaaugaaau

SEQ ID NO: 1450027 - RNA, 22 nt, Homo sapiens
acuuaugagauaauuaaugauu

SEQ ID NO: 1450028 - RNA, 13 nt, Homo sapiens
acuuauugccaaa

SEQ ID NO: 1450029 - RNA, 11 nt, Homo sapiens
acuucaaagag

SEQ ID NO: 1450030 - RNA, 19 nt, Homo sapiens
acuucaaguuaaagugaau

SEQ ID NO: 1450031 - RNA, 13 nt, Homo sapiens
acuucaauaucca

SEQ ID NO: 1450032 - RNA, 19 nt, Homo sapiens
acuucaauccauguaggaa

SEQ ID NO: 1450033 - RNA, 18 nt, Homo sapiens
acuucaaugcacauggug

SEQ ID NO: 1450034 - RNA, 15 nt, Homo sapiens
acuucacacuaugga

SEQ ID NO: 1450035 - RNA, 19 nt, Homo sapiens
acuucagaaauauaugcag

SEQ ID NO: 1450036 - RNA, 20 nt, Homo sapiens
acuucagaagcaaacaauau

SEQ ID NO: 1450037 - RNA, 12 nt, Homo sapiens
acuucagcagua

SEQ ID NO: 1450038 - RNA, 19 nt, Homo sapiens
acuucagcaguaccuauaa

SEQ ID NO: 1450039 - RNA, 23 nt, Homo sapiens
acuucagccaggugaacuggaau

SEQ ID NO: 1450040 - RNA, 18 nt, Homo sapiens
acuucauauugcugagag

SEQ ID NO: 1450041 - RNA, 18 nt, Homo sapiens
acuucauucacauucaga

SEQ ID NO: 1450042 - RNA, 16 nt, Homo sapiens
acuuccaugacauaag

SEQ ID NO: 1450043 - RNA, 14 nt, Homo sapiens
acuucccagugaau

SEQ ID NO: 1450044 - RNA, 14 nt, Homo sapiens
acuuccccacaggc

SEQ ID NO: 1450045 - RNA, 18 nt, Homo sapiens
acuuccuacguauccugc

SEQ ID NO: 1450046 - RNA, 20 nt, Homo sapiens
acuuccugccauggaucucu

SEQ ID NO: 1450047 - RNA, 14 nt, Homo sapiens
acuuccugcuacag

SEQ ID NO: 1450048 - RNA, 14 nt, Homo sapiens
acuucgaaaccugg

SEQ ID NO: 1450049 - RNA, 18 nt, Homo sapiens
acuucgacucaggaucca

SEQ ID NO: 1450050 - RNA, 15 nt, Homo sapiens
acuucuaccaggacg

SEQ ID NO: 1450051 - RNA, 19 nt, Homo sapiens
acuucugaaaccucugggu

SEQ ID NO: 1450052 - RNA, 15 nt, Homo sapiens
acuucuggaagucau

SEQ ID NO: 1450053 - RNA, 19 nt, Homo sapiens
acuugaaagcauccaugug

SEQ ID NO: 1450054 - RNA, 17 nt, Homo sapiens
acuugaaauuugccuug

SEQ ID NO: 1450055 - RNA, 21 nt, Homo sapiens
acuugaaucaaagcaguuaac

SEQ ID NO: 1450056 - RNA, 17 nt, Homo sapiens
acuugacauguagcuuc

SEQ ID NO: 1450057 - RNA, 13 nt, Homo sapiens
acuugaccucauc

SEQ ID NO: 1450058 - RNA, 22 nt, Homo sapiens
acuugacugggugagacccaaa

SEQ ID NO: 1450059 - RNA, 13 nt, Homo sapiens
acuugagaaaaua

SEQ ID NO: 1450060 - RNA, 20 nt, Homo sapiens
acuugagaaaauaucuugcu

SEQ ID NO: 1450061 - RNA, 13 nt, Homo sapiens
acuugagcaccgu

SEQ ID NO: 1450062 - RNA, 19 nt, Homo sapiens
acuugauguguuaucucuu

SEQ ID NO: 1450063 - RNA, 15 nt, Homo sapiens
acuugcauugugauu

SEQ ID NO: 1450064 - RNA, 19 nt, Homo sapiens
acuugcugaggccaagcca

SEQ ID NO: 1450065 - RNA, 17 nt, Homo sapiens
acuugcugcugucuugu

SEQ ID NO: 1450066 - RNA, 18 nt, Homo sapiens
acuugggaaacuauucau

SEQ ID NO: 1450067 - RNA, 20 nt, Homo sapiens
acuuggggguaaaggucugu

SEQ ID NO: 1450068 - RNA, 19 nt, Homo sapiens
acuuguggccucaagcaau

SEQ ID NO: 1450069 - RNA, 16 nt, Homo sapiens
acuuguuccagcucuu

SEQ ID NO: 1450070 - RNA, 16 nt, Homo sapiens
acuuuaaaagacugaa

SEQ ID NO: 1450071 - RNA, 14 nt, Homo sapiens
acuuuaaaaugcca

SEQ ID NO: 1450072 - RNA, 14 nt, Homo sapiens
acuuuaacugacuu

SEQ ID NO: 1450073 - RNA, 16 nt, Homo sapiens
acuuuaacugacuuaa

SEQ ID NO: 1450074 - RNA, 14 nt, Homo sapiens
acuuuaagauguuu

SEQ ID NO: 1450075 - RNA, 13 nt, Homo sapiens
acuuuaagcacua

SEQ ID NO: 1450076 - RNA, 13 nt, Homo sapiens
acuuuaaugaacu

SEQ ID NO: 1450077 - RNA, 19 nt, Homo sapiens
acuuuacaaccugauguca

SEQ ID NO: 1450078 - RNA, 16 nt, Homo sapiens
acuuuauaaauaucaa

SEQ ID NO: 1450079 - RNA, 23 nt, Homo sapiens
agagcagcuuuaaacucagggac

SEQ ID NO: 1450080 - RNA, 20 nt, Homo sapiens
agagcaggaagcauucagag

SEQ ID NO: 1450081 - RNA, 14 nt, Homo sapiens
agagcaggacucca

SEQ ID NO: 1450082 - RNA, 13 nt, Homo sapiens
agagcccagcucc

SEQ ID NO: 1450083 - RNA, 12 nt, Homo sapiens
agagcugucacu

SEQ ID NO: 1450084 - RNA, 23 nt, Homo sapiens
agagcuuguaauaaauacugcag

SEQ ID NO: 1450085 - RNA, 21 nt, Homo sapiens
agagcuugugcuccucuugau

SEQ ID NO: 1450086 - RNA, 23 nt, Homo sapiens
agagcuuugugcuugucauucca

SEQ ID NO: 1450087 - RNA, 14 nt, Homo sapiens
agaggaaaaugccu

SEQ ID NO: 1450088 - RNA, 22 nt, Homo sapiens
agaggaaaccaguuuggugaua

SEQ ID NO: 1450089 - RNA, 13 nt, Homo sapiens
agaggaaagaccu

SEQ ID NO: 1450090 - RNA, 21 nt, Homo sapiens
agaggaaaugucacagaagca

SEQ ID NO: 1450091 - RNA, 13 nt, Homo sapiens
agaggaacagcac

SEQ ID NO: 1450092 - RNA, 23 nt, Homo sapiens
agaggagccagacagacccugaa

SEQ ID NO: 1450093 - RNA, 16 nt, Homo sapiens
agaggaggggaaaguc

SEQ ID NO: 1450094 - RNA, 23 nt, Homo sapiens
agaggagguuuggggucugccac

SEQ ID NO: 1450095 - RNA, 13 nt, Homo sapiens
agaggagugcagc

SEQ ID NO: 1450096 - RNA, 22 nt, Homo sapiens
agaggauaaggaggcacugcug

SEQ ID NO: 1450097 - RNA, 13 nt, Homo sapiens
agaggaugugcaa

SEQ ID NO: 1450098 - RNA, 13 nt, Homo sapiens
agaggcagagaaa

SEQ ID NO: 1450099 - RNA, 14 nt, Homo sapiens
agaggcagugacag

SEQ ID NO: 1450100 - RNA, 14 nt, Homo sapiens
agaggccauggcag

SEQ ID NO: 1450101 - RNA, 15 nt, Homo sapiens
agaggcccugugguc

SEQ ID NO: 1450102 - RNA, 15 nt, Homo sapiens
agaggcucugagaaa

SEQ ID NO: 1450103 - RNA, 18 nt, Homo sapiens
agaggcugccccucucac

SEQ ID NO: 1450104 - RNA, 17 nt, Homo sapiens
agagggaccauguguca

SEQ ID NO: 1450105 - RNA, 15 nt, Homo sapiens
agagggagaaacuuc

SEQ ID NO: 1450106 - RNA, 13 nt, Homo sapiens
agagggcuuccuc

SEQ ID NO: 1450107 - RNA, 16 nt, Homo sapiens
agaggggaagggccag

SEQ ID NO: 1450108 - RNA, 18 nt, Homo sapiens
agaggggauucacaaggu

SEQ ID NO: 1450109 - RNA, 13 nt, Homo sapiens
agaggguacuuua

SEQ ID NO: 1450110 - RNA, 22 nt, Homo sapiens
agagguagguaggaucauccca

SEQ ID NO: 1450111 - RNA, 19 nt, Homo sapiens
agagguauuccucucuuaa

SEQ ID NO: 1450112 - RNA, 13 nt, Homo sapiens
agaggugcuucug

SEQ ID NO: 1450113 - RNA, 21 nt, Homo sapiens
agaggugcuucugccugugca

SEQ ID NO: 1450114 - RNA, 17 nt, Homo sapiens
agagguggagugucaca

SEQ ID NO: 1450115 - RNA, 21 nt, Homo sapiens
agagguggagugucacaucuc

SEQ ID NO: 1450116 - RNA, 16 nt, Homo sapiens
agaguaaaaacugaau

SEQ ID NO: 1450117 - RNA, 22 nt, Homo sapiens
agaguaaaccuugaagggcuuu

SEQ ID NO: 1450118 - RNA, 20 nt, Homo sapiens
agaguauaugcacuuuccaa

SEQ ID NO: 1450119 - RNA, 19 nt, Homo sapiens
agaguaucagaucuaucuu

SEQ ID NO: 1450120 - RNA, 15 nt, Homo sapiens
agaguauccuaccca

SEQ ID NO: 1450121 - RNA, 18 nt, Homo sapiens
agagucacuugaugugcc

SEQ ID NO: 1450122 - RNA, 12 nt, Homo sapiens
agagucagcucu

SEQ ID NO: 1450123 - RNA, 12 nt, Homo sapiens
agagucaucuga

SEQ ID NO: 1450124 - RNA, 17 nt, Homo sapiens
agaguccagugcucugc

SEQ ID NO: 1450125 - RNA, 14 nt, Homo sapiens
agagucgcaucuca

SEQ ID NO: 1450126 - RNA, 21 nt, Homo sapiens
agagucuggccuggacccuga

SEQ ID NO: 1450127 - RNA, 16 nt, Homo sapiens
agagugacuaguacaa

SEQ ID NO: 1450128 - RNA, 17 nt, Homo sapiens
agagugacuaguacaaa

SEQ ID NO: 1450129 - RNA, 20 nt, Homo sapiens
agagugagacucccucucaa

SEQ ID NO: 1450130 - RNA, 14 nt, Homo sapiens
agagugauugcagc

SEQ ID NO: 1450131 - RNA, 15 nt, Homo sapiens
agagugauugcagcu

SEQ ID NO: 1450132 - RNA, 21 nt, Homo sapiens
agagugccguaacaacugugg

SEQ ID NO: 1450133 - RNA, 22 nt, Homo sapiens
agaguggaaccaacacuaacau

SEQ ID NO: 1450134 - RNA, 17 nt, Homo sapiens
agaguggucgagugaca

SEQ ID NO: 1450135 - RNA, 19 nt, Homo sapiens
agaguggucuuucuggaga

SEQ ID NO: 1450136 - RNA, 14 nt, Homo sapiens
agaguggugcugcu

SEQ ID NO: 1450137 - RNA, 15 nt, Homo sapiens
agaguggugcugcuu

SEQ ID NO: 1450138 - RNA, 20 nt, Homo sapiens
agagugucucagggugcaga

SEQ ID NO: 1450139 - RNA, 22 nt, Homo sapiens
agaguguuucuuccacaacaga

SEQ ID NO: 1450140 - RNA, 24 nt, Homo sapiens
agaguuuccugaaacaacuuggaa

SEQ ID NO: 1450141 - RNA, 14 nt, Homo sapiens
agauaaaccaauaa

SEQ ID NO: 1450142 - RNA, 20 nt, Homo sapiens
agauaaaccaauaaauccac

SEQ ID NO: 1450143 - RNA, 23 nt, Homo sapiens
agauaacaagaucuuucaggaaa

SEQ ID NO: 1450144 - RNA, 18 nt, Homo sapiens
agauaaccuguacuucaa

SEQ ID NO: 1450145 - RNA, 13 nt, Homo sapiens
agauaacuaggaa

SEQ ID NO: 1450146 - RNA, 13 nt, Homo sapiens
agauaacucuccu

SEQ ID NO: 1450147 - RNA, 21 nt, Homo sapiens
agauaacuugagcaccgucau

SEQ ID NO: 1450148 - RNA, 13 nt, Homo sapiens
agauaagcaagag

SEQ ID NO: 1450149 - RNA, 15 nt, Homo sapiens
agauaauugcuauuu

SEQ ID NO: 1450150 - RNA, 22 nt, Homo sapiens
agauaauuggcaacugggugaa

SEQ ID NO: 1450151 - RNA, 20 nt, Homo sapiens
agauaccggugcuucuggaa

SEQ ID NO: 1450152 - RNA, 16 nt, Homo sapiens
agauagcuacagugua

SEQ ID NO: 1450153 - RNA, 16 nt, Homo sapiens
agauaggaaacugaag

SEQ ID NO: 1450154 - RNA, 22 nt, Homo sapiens
agauagguggugccaguggcuu

SEQ ID NO: 1450155 - RNA, 23 nt, Homo sapiens
agauauacauaucaaguauguug

SEQ ID NO: 1450156 - RNA, 15 nt, Homo sapiens
agauauuguacauaa

SEQ ID NO: 1450157 - RNA, 19 nt, Homo sapiens
agauauugugaaguacaua

SEQ ID NO: 1450158 - RNA, 22 nt, Homo sapiens
agauauuguugaaauaauugaa

SEQ ID NO: 1450159 - RNA, 12 nt, Homo sapiens
agauauuucaca

SEQ ID NO: 1450160 - RNA, 16 nt, Homo sapiens
agauauuuccauuucu

SEQ ID NO: 1450161 - RNA, 22 nt, Homo sapiens
agaucaaaauaaaaagugacac

SEQ ID NO: 1450162 - RNA, 20 nt, Homo sapiens
agaucaaacaugcauggaug

SEQ ID NO: 1450163 - RNA, 17 nt, Homo sapiens
agaucacgccacugcac

SEQ ID NO: 1450164 - RNA, 17 nt, Homo sapiens
agaucacgucacugcac

SEQ ID NO: 1450165 - RNA, 11 nt, Homo sapiens
agaucagucag

SEQ ID NO: 1450166 - RNA, 19 nt, Homo sapiens
agaucaugucucacuucac

SEQ ID NO: 1450167 - RNA, 22 nt, Homo sapiens
agaucucucgaaugcugagaag

SEQ ID NO: 1450168 - RNA, 17 nt, Homo sapiens
agaucuguccucagccu

SEQ ID NO: 1450169 - RNA, 20 nt, Homo sapiens
agaugaacaugguguucaac

SEQ ID NO: 1450170 - RNA, 17 nt, Homo sapiens
agaugaaguuuuauaca

SEQ ID NO: 1450171 - RNA, 15 nt, Homo sapiens
agaugauacauccaa

SEQ ID NO: 1450172 - RNA, 19 nt, Homo sapiens
agaugauggaugccaauau

SEQ ID NO: 1450173 - RNA, 16 nt, Homo sapiens
agaugcaaugugcuac

SEQ ID NO: 1450174 - RNA, 14 nt, Homo sapiens
agaugcauacaaag

SEQ ID NO: 1450175 - RNA, 17 nt, Homo sapiens
agaugcaucacugggug

SEQ ID NO: 1450176 - RNA, 21 nt, Homo sapiens
agaugccagcauauacugaag

SEQ ID NO: 1450177 - RNA, 14 nt, Homo sapiens
agaugccccagccu

SEQ ID NO: 1450178 - RNA, 23 nt, Homo sapiens
agaugccgcggaaggucccucag

SEQ ID NO: 1450179 - RNA, 21 nt, Homo sapiens
agaugcuagaaaaauguucuu

SEQ ID NO: 1450180 - RNA, 15 nt, Homo sapiens
agaugcucacuuuau

SEQ ID NO: 1450181 - RNA, 22 nt, Homo sapiens
agaugcuguaggugguauguga

SEQ ID NO: 1450182 - RNA, 15 nt, Homo sapiens
agauggaaugcugug

SEQ ID NO: 1450183 - RNA, 17 nt, Homo sapiens
agaugggggaacuguga

SEQ ID NO: 1450184 - RNA, 11 nt, Homo sapiens
agaugucaagc

SEQ ID NO: 1450185 - RNA, 23 nt, Homo sapiens
agaugucgcccuacucaccugag

SEQ ID NO: 1450186 - RNA, 18 nt, Homo sapiens
agaugugaaaacaucuca

SEQ ID NO: 1450187 - RNA, 18 nt, Homo sapiens
agauguguuuuugggaag

SEQ ID NO: 1450188 - RNA, 15 nt, Homo sapiens
agauguuugccucau

SEQ ID NO: 1450189 - RNA, 16 nt, Homo sapiens
agauuagaaacuacca

SEQ ID NO: 1450190 - RNA, 16 nt, Homo sapiens
agauuauaaacugacu

SEQ ID NO: 1450191 - RNA, 22 nt, Homo sapiens
agauuauagaaguagcaaaaag

SEQ ID NO: 1450192 - RNA, 18 nt, Homo sapiens
agauuccccugugucauc

SEQ ID NO: 1450193 - RNA, 14 nt, Homo sapiens
agauucuaccacac

SEQ ID NO: 1450194 - RNA, 15 nt, Homo sapiens
agauucugugaucuu

SEQ ID NO: 1450195 - RNA, 21 nt, Homo sapiens
agauugagcuuagauugccuc

SEQ ID NO: 1450196 - RNA, 17 nt, Homo sapiens
agauugcaccacugcuc

SEQ ID NO: 1450197 - RNA, 19 nt, Homo sapiens
agauuggcaugccauugaa

SEQ ID NO: 1450198 - RNA, 22 nt, Homo sapiens
agauuguuaggagugguucuca

SEQ ID NO: 1450199 - RNA, 17 nt, Homo sapiens
agauuuaacaauuccaa

SEQ ID NO: 1450200 - RNA, 12 nt, Homo sapiens
agauuuauuagu

SEQ ID NO: 1450201 - RNA, 13 nt, Homo sapiens
agauuucuucucu

SEQ ID NO: 1450202 - RNA, 17 nt, Homo sapiens
agauuugggugaacaaa

SEQ ID NO: 1450203 - RNA, 13 nt, Homo sapiens
agauuuugcaccu

SEQ ID NO: 1450204 - RNA, 18 nt, Homo sapiens
agauuuugcaccuguaaa

SEQ ID NO: 1450205 - RNA, 16 nt, Homo sapiens
agcaaaaacauguaug

SEQ ID NO: 1450206 - RNA, 20 nt, Homo sapiens
agcaaaacaauaaacuagca

SEQ ID NO: 1450207 - RNA, 17 nt, Homo sapiens
agcaaaacgcauggagu

SEQ ID NO: 1450208 - RNA, 16 nt, Homo sapiens
agcaaagcugaugaca

SEQ ID NO: 1450209 - RNA, 17 nt, Homo sapiens
agcaaaguuuuaccugu

SEQ ID NO: 1450210 - RNA, 18 nt, Homo sapiens
agcaaauggcagaaccaa

SEQ ID NO: 1450211 - RNA, 16 nt, Homo sapiens
agcaaauguugggaaa

SEQ ID NO: 1450212 - RNA, 16 nt, Homo sapiens
agcaacucuugauuau

SEQ ID NO: 1450213 - RNA, 14 nt, Homo sapiens
agcaagaccuggag

SEQ ID NO: 1450214 - RNA, 17 nt, Homo sapiens
agcaagacuccaucuca

SEQ ID NO: 1450215 - RNA, 14 nt, Homo sapiens
agcaagcuauucaa

SEQ ID NO: 1450216 - RNA, 13 nt, Homo sapiens
agcaaggagcaca

SEQ ID NO: 1450217 - RNA, 21 nt, Homo sapiens
agcaaggcuggguaaugugaa

SEQ ID NO: 1450218 - RNA, 23 nt, Homo sapiens
agcaaggucauuucuucagucag

SEQ ID NO: 1450219 - RNA, 18 nt, Homo sapiens
agcaauaccagcaauuca

SEQ ID NO: 1450220 - RNA, 19 nt, Homo sapiens
agcaaucugauucagcauc

SEQ ID NO: 1450221 - RNA, 14 nt, Homo sapiens
agcaaugacaucuc

SEQ ID NO: 1450222 - RNA, 14 nt, Homo sapiens
agcaaugaugucca

SEQ ID NO: 1450223 - RNA, 20 nt, Homo sapiens
agcaaugggacuggagucag

SEQ ID NO: 1450224 - RNA, 17 nt, Homo sapiens
agcaauucuccugccuc

SEQ ID NO: 1450225 - RNA, 18 nt, Homo sapiens
agcaauuucucuuuaaaa

SEQ ID NO: 1450226 - RNA, 22 nt, Homo sapiens
agcaauuugauaaaauauacuu

SEQ ID NO: 1450227 - RNA, 22 nt, Homo sapiens
agcacaagccacaagucuucca

SEQ ID NO: 1450228 - RNA, 15 nt, Homo sapiens
agcacacagggcagu

SEQ ID NO: 1450229 - RNA, 12 nt, Homo sapiens
agcacagugugu

SEQ ID NO: 1450230 - RNA, 15 nt, Homo sapiens
agcaccacccuaguc

SEQ ID NO: 1450231 - RNA, 19 nt, Homo sapiens
agcacccagguuuugcacu

SEQ ID NO: 1450232 - RNA, 14 nt, Homo sapiens
agcacccauuccaa

SEQ ID NO: 1450233 - RNA, 14 nt, Homo sapiens
agcaccccuugccg

SEQ ID NO: 1450234 - RNA, 15 nt, Homo sapiens
agcaccggccucggg

SEQ ID NO: 1450235 - RNA, 16 nt, Homo sapiens
agcaccuguaauccca

SEQ ID NO: 1450236 - RNA, 22 nt, Homo sapiens
agcacggacucuuacugcuaac

SEQ ID NO: 1450237 - RNA, 23 nt, Homo sapiens
agcacuacauaaacugacuuuau

SEQ ID NO: 1450238 - RNA, 22 nt, Homo sapiens
agcacuacugggugucauuuca

SEQ ID NO: 1450239 - RNA, 19 nt, Homo sapiens
agcacuccgcaucaccuca

SEQ ID NO: 1450240 - RNA, 17 nt, Homo sapiens
agcacuggggagucuuu

SEQ ID NO: 1450241 - RNA, 18 nt, Homo sapiens
agcacugucccuugccuc

SEQ ID NO: 1450242 - RNA, 21 nt, Homo sapiens
agcacuguuggagcuacugca

SEQ ID NO: 1450243 - RNA, 14 nt, Homo sapiens
agcacuuccauggg

SEQ ID NO: 1450244 - RNA, 18 nt, Homo sapiens
agcacuuccuugccaguc

SEQ ID NO: 1450245 - RNA, 15 nt, Homo sapiens
agcagaacuucugaa

SEQ ID NO: 1450246 - RNA, 17 nt, Homo sapiens
agcagaacuucugaaac

SEQ ID NO: 1450247 - RNA, 20 nt, Homo sapiens
agcagacaggccccgugagg

SEQ ID NO: 1450248 - RNA, 12 nt, Homo sapiens
agcagaccuccu

SEQ ID NO: 1450249 - RNA, 17 nt, Homo sapiens
agcagagacaugacuca

SEQ ID NO: 1450250 - RNA, 18 nt, Homo sapiens
agcagagagggauggguu

SEQ ID NO: 1450251 - RNA, 18 nt, Homo sapiens
agcagagcagcucugcua

SEQ ID NO: 1450252 - RNA, 15 nt, Homo sapiens
agcagaugguuucca

SEQ ID NO: 1450253 - RNA, 21 nt, Homo sapiens
agcagcccuaaggaucucuca

SEQ ID NO: 1450254 - RNA, 15 nt, Homo sapiens
agcagcccugucacg

SEQ ID NO: 1450255 - RNA, 15 nt, Homo sapiens
agcagugaaguauaa

SEQ ID NO: 1450256 - RNA, 15 nt, Homo sapiens
agcagugaucucagg

SEQ ID NO: 1450257 - RNA, 16 nt, Homo sapiens
agcagugaugaaaaug

SEQ ID NO: 1450258 - RNA, 16 nt, Homo sapiens
agcagugccuuccaua

SEQ ID NO: 1450259 - RNA, 15 nt, Homo sapiens
agcagugucuuccau

SEQ ID NO: 1450260 - RNA, 16 nt, Homo sapiens
agcagugucuuccaua

SEQ ID NO: 1450261 - RNA, 15 nt, Homo sapiens
agcaguguucucaca

SEQ ID NO: 1450262 - RNA, 14 nt, Homo sapiens
agcaguguuuuaga

SEQ ID NO: 1450263 - RNA, 14 nt, Homo sapiens
agcauaaguauaca

SEQ ID NO: 1450264 - RNA, 22 nt, Homo sapiens
agcauauaggugauguuugcuc

SEQ ID NO: 1450265 - RNA, 11 nt, Homo sapiens
agcauccaugu

SEQ ID NO: 1450266 - RNA, 14 nt, Homo sapiens
agcaucgggagcac

SEQ ID NO: 1450267 - RNA, 22 nt, Homo sapiens
agcaucgggagcacccagagca

SEQ ID NO: 1450268 - RNA, 23 nt, Homo sapiens
agcaucuaucucaucuaucucaa

SEQ ID NO: 1450269 - RNA, 20 nt, Homo sapiens
agcaugaccugugaccagca

SEQ ID NO: 1450270 - RNA, 14 nt, Homo sapiens
agcaugagacuuuc

SEQ ID NO: 1450271 - RNA, 17 nt, Homo sapiens
agcaugaggacagacca

SEQ ID NO: 1450272 - RNA, 23 nt, Homo sapiens
agcaugaggacagaccacagagc

SEQ ID NO: 1450273 - RNA, 19 nt, Homo sapiens
agcaugagguguugugcau

SEQ ID NO: 1450274 - RNA, 19 nt, Homo sapiens
agcaugcuucccagaggga

SEQ ID NO: 1450275 - RNA, 18 nt, Homo sapiens
agcauguggaugacacaa

SEQ ID NO: 1450276 - RNA, 22 nt, Homo sapiens
agcauuacgugagccagguaau

SEQ ID NO: 1450277 - RNA, 16 nt, Homo sapiens
agcauuccuauugaca

SEQ ID NO: 1450278 - RNA, 18 nt, Homo sapiens
agcauucuugucacaaua

SEQ ID NO: 1450279 - RNA, 22 nt, Homo sapiens
agcauuuacagaaacgcaucca

SEQ ID NO: 1450280 - RNA, 20 nt, Homo sapiens
agcauuuccaacaccacaga

SEQ ID NO: 1450281 - RNA, 18 nt, Homo sapiens
agcauuucuagcagugau

SEQ ID NO: 1450282 - RNA, 19 nt, Homo sapiens
agccaaacccuugucagug

SEQ ID NO: 1450283 - RNA, 23 nt, Homo sapiens
agccaaauaaaaucuauacauac

SEQ ID NO: 1450284 - RNA, 15 nt, Homo sapiens
agccaagauugcacc

SEQ ID NO: 1450285 - RNA, 20 nt, Homo sapiens
agccaagauugcaccacugc

SEQ ID NO: 1450286 - RNA, 23 nt, Homo sapiens
agccaagcuuguuaucagcuuuc

SEQ ID NO: 1450287 - RNA, 12 nt, Homo sapiens
agccaaggcagg

SEQ ID NO: 1450288 - RNA, 15 nt, Homo sapiens
agccaauuagcucua

SEQ ID NO: 1450289 - RNA, 17 nt, Homo sapiens
agccacaagucuuccag

SEQ ID NO: 1450290 - RNA, 14 nt, Homo sapiens
agccacagaccacc

SEQ ID NO: 1450291 - RNA, 16 nt, Homo sapiens
agccaccucucccuca

SEQ ID NO: 1450292 - RNA, 13 nt, Homo sapiens
agccacucuucca

SEQ ID NO: 1450293 - RNA, 13 nt, Homo sapiens
agccacuugucag

SEQ ID NO: 1450294 - RNA, 13 nt, Homo sapiens
agccagauucaaa

SEQ ID NO: 1450295 - RNA, 12 nt, Homo sapiens
agccagccugac

SEQ ID NO: 1450296 - RNA, 17 nt, Homo sapiens
agccagcugcuuuuugu

SEQ ID NO: 1450297 - RNA, 20 nt, Homo sapiens
agccagcuuacuagcacuuu

SEQ ID NO: 1450298 - RNA, 18 nt, Homo sapiens
agccaggaaguacuucca

SEQ ID NO: 1450299 - RNA, 13 nt, Homo sapiens
agccaggacaucu

SEQ ID NO: 1450300 - RNA, 18 nt, Homo sapiens
agccaggacaucucugcc

SEQ ID NO: 1450301 - RNA, 19 nt, Homo sapiens
agccaggccaacagcaccu

SEQ ID NO: 1450302 - RNA, 23 nt, Homo sapiens
agccaggccugggggcagccucu

SEQ ID NO: 1450303 - RNA, 16 nt, Homo sapiens
agccaggcugccaagg

SEQ ID NO: 1450304 - RNA, 17 nt, Homo sapiens
agccagugccauuccac

SEQ ID NO: 1450305 - RNA, 22 nt, Homo sapiens
agccaguuuggguaaaauacuu

SEQ ID NO: 1450306 - RNA, 22 nt, Homo sapiens
agccauacuuaucucucugugc

SEQ ID NO: 1450307 - RNA, 21 nt, Homo sapiens
agccaucuaaugcuuguuuau

SEQ ID NO: 1450308 - RNA, 17 nt, Homo sapiens
agccaugcaaugccaaa

SEQ ID NO: 1450309 - RNA, 21 nt, Homo sapiens
agccauguccugcugcuucug

SEQ ID NO: 1450310 - RNA, 18 nt, Homo sapiens
agcccagaauagcuuuga

SEQ ID NO: 1450311 - RNA, 11 nt, Homo sapiens
agcccagagac

SEQ ID NO: 1450312 - RNA, 15 nt, Homo sapiens
agcccagccugggag

SEQ ID NO: 1450313 - RNA, 19 nt, Homo sapiens
agcccauccaaacacugag

SEQ ID NO: 1450314 - RNA, 18 nt, Homo sapiens
agcccauggugaauguau

SEQ ID NO: 1450315 - RNA, 16 nt, Homo sapiens
agccccacaacuuuaa

SEQ ID NO: 1450316 - RNA, 20 nt, Homo sapiens
agccccagagggucaggguu

SEQ ID NO: 1450317 - RNA, 20 nt, Homo sapiens
agccccucccccaucuccca

SEQ ID NO: 1450318 - RNA, 21 nt, Homo sapiens
agccccucccccaucucccac

SEQ ID NO: 1450319 - RNA, 23 nt, Homo sapiens
agccccugaccccugucuguccc

SEQ ID NO: 1450320 - RNA, 20 nt, Homo sapiens
agcccguuagccccagggau

SEQ ID NO: 1450321 - RNA, 19 nt, Homo sapiens
agcccuaaguggcugccuu

SEQ ID NO: 1450322 - RNA, 12 nt, Homo sapiens
agcccugaaccc

SEQ ID NO: 1450323 - RNA, 15 nt, Homo sapiens
agcccugaacgugag

SEQ ID NO: 1450324 - RNA, 19 nt, Homo sapiens
agcccugcagcccaccaga

SEQ ID NO: 1450325 - RNA, 15 nt, Homo sapiens
agcccuuuacuugac

SEQ ID NO: 1450326 - RNA, 19 nt, Homo sapiens
agcccuuugcuaaaauaua

SEQ ID NO: 1450327 - RNA, 13 nt, Homo sapiens
agccgcugugagc

SEQ ID NO: 1450328 - RNA, 14 nt, Homo sapiens
agccggcacagggu

SEQ ID NO: 1450329 - RNA, 21 nt, Homo sapiens
agccguccuucuaaugaagac

SEQ ID NO: 1450330 - RNA, 13 nt, Homo sapiens
agccgugaacugu

SEQ ID NO: 1450331 - RNA, 14 nt, Homo sapiens
agccgugaugcuca

SEQ ID NO: 1450332 - RNA, 15 nt, Homo sapiens
agccguguguucaaa

SEQ ID NO: 1450333 - RNA, 20 nt, Homo sapiens
agccuaaaagugggcuugau

SEQ ID NO: 1450334 - RNA, 15 nt, Homo sapiens
agccuacagaugaac

SEQ ID NO: 1450335 - RNA, 18 nt, Homo sapiens
agccuagcggagcccagc

SEQ ID NO: 1450336 - RNA, 19 nt, Homo sapiens
agccucaugccaacccugg

SEQ ID NO: 1450337 - RNA, 22 nt, Homo sapiens
agccucccaaguagcugagacu

SEQ ID NO: 1450338 - RNA, 17 nt, Homo sapiens
agccuccccgugccaaa

SEQ ID NO: 1450339 - RNA, 18 nt, Homo sapiens
agccuccccgugccaaaa

SEQ ID NO: 1450340 - RNA, 23 nt, Homo sapiens
agccuccugcccagcacaggaau

SEQ ID NO: 1450341 - RNA, 19 nt, Homo sapiens
agccuccuuuugcuugaaa

SEQ ID NO: 1450342 - RNA, 15 nt, Homo sapiens
agccucucaccugga

SEQ ID NO: 1450343 - RNA, 22 nt, Homo sapiens
aauuuuaguucuuacugcuuaa

SEQ ID NO: 1450344 - RNA, 21 nt, Homo sapiens
aauuuucuagauuuucuacuu

SEQ ID NO: 1450345 - RNA, 21 nt, Homo sapiens
aauuuucuucauacuuaaaaa

SEQ ID NO: 1450346 - RNA, 24 nt, Homo sapiens
aauuuucuucaugcaaugacaucu

SEQ ID NO: 1450347 - RNA, 17 nt, Homo sapiens
aauuuuuaagcugcaaa

SEQ ID NO: 1450348 - RNA, 15 nt, Homo sapiens
aauuuuuacugagaa

SEQ ID NO: 1450349 - RNA, 19 nt, Homo sapiens
aauuuuugcuaugcuguaa

SEQ ID NO: 1450350 - RNA, 21 nt, Homo sapiens
aauuuuuuaguauaaguacau

SEQ ID NO: 1450351 - RNA, 21 nt, Homo sapiens
aauuuuuucccagacuacuau

SEQ ID NO: 1450352 - RNA, 23 nt, Homo sapiens
acaaaaaaauauauuuaaugaua

SEQ ID NO: 1450353 - RNA, 16 nt, Homo sapiens
acaaaacuacaugaga

SEQ ID NO: 1450354 - RNA, 15 nt, Homo sapiens
acaaaagauguaucc

SEQ ID NO: 1450355 - RNA, 22 nt, Homo sapiens
acaaaauggucauccaaacuca

SEQ ID NO: 1450356 - RNA, 13 nt, Homo sapiens
acaaaauguucac

SEQ ID NO: 1450357 - RNA, 23 nt, Homo sapiens
acaaaauuuuauuuugugcucau

SEQ ID NO: 1450358 - RNA, 15 nt, Homo sapiens
acaaacaaacagaaa

SEQ ID NO: 1450359 - RNA, 11 nt, Homo sapiens
acaaacagacc

SEQ ID NO: 1450360 - RNA, 16 nt, Homo sapiens
acuauugaaaucaagc

SEQ ID NO: 1450361 - RNA, 14 nt, Homo sapiens
acuauugcauuuau

SEQ ID NO: 1450362 - RNA, 16 nt, Homo sapiens
acuauuuguuccacau

SEQ ID NO: 1450363 - RNA, 23 nt, Homo sapiens
acucaaacgccgcugacugccac

SEQ ID NO: 1450364 - RNA, 13 nt, Homo sapiens
acucaaacuugag

SEQ ID NO: 1450365 - RNA, 12 nt, Homo sapiens
acucaacauguu

SEQ ID NO: 1450366 - RNA, 15 nt, Homo sapiens
acucaaucuacaggc

SEQ ID NO: 1450367 - RNA, 12 nt, Homo sapiens
acucaccaucug

SEQ ID NO: 1450368 - RNA, 17 nt, Homo sapiens
acucaccuguucucacu

SEQ ID NO: 1450369 - RNA, 23 nt, Homo sapiens
acucacugaggguaucugacaau

SEQ ID NO: 1450370 - RNA, 14 nt, Homo sapiens
acucacugcucaag

SEQ ID NO: 1450371 - RNA, 13 nt, Homo sapiens
acucacugugauc

SEQ ID NO: 1450372 - RNA, 15 nt, Homo sapiens
acucacuuguaagaa

SEQ ID NO: 1450373 - RNA, 15 nt, Homo sapiens
acucagagacuucac

SEQ ID NO: 1450374 - RNA, 18 nt, Homo sapiens
acucagaggcagugacag

SEQ ID NO: 1450375 - RNA, 12 nt, Homo sapiens
acucagcacaag

SEQ ID NO: 1450376 - RNA, 13 nt, Homo sapiens
acucaggccagug

SEQ ID NO: 1450377 - RNA, 16 nt, Homo sapiens
acucagggagcauuua

SEQ ID NO: 1450378 - RNA, 16 nt, Homo sapiens
acucaggguucaucug

SEQ ID NO: 1450379 - RNA, 17 nt, Homo sapiens
acucaggguucaucugu

SEQ ID NO: 1450380 - RNA, 23 nt, Homo sapiens
acucagguucuucagggccaguc

SEQ ID NO: 1450381 - RNA, 20 nt, Homo sapiens
acucauaggcuuauuuccaa

SEQ ID NO: 1450382 - RNA, 17 nt, Homo sapiens
acucauccauccccugg

SEQ ID NO: 1450383 - RNA, 20 nt, Homo sapiens
acucaucuuagugccugaga

SEQ ID NO: 1450384 - RNA, 13 nt, Homo sapiens
acucauucagucc

SEQ ID NO: 1450385 - RNA, 15 nt, Homo sapiens
acucauucaguccca

SEQ ID NO: 1450386 - RNA, 13 nt, Homo sapiens
acucauugcugag

SEQ ID NO: 1450387 - RNA, 22 nt, Homo sapiens
acucauuucauuccuaacacag

SEQ ID NO: 1450388 - RNA, 19 nt, Homo sapiens
acuccacccuccuacaggu

SEQ ID NO: 1450389 - RNA, 20 nt, Homo sapiens
acuccaccgaccaacugccc

SEQ ID NO: 1450390 - RNA, 13 nt, Homo sapiens
acuccagugccag

SEQ ID NO: 1450391 - RNA, 15 nt, Homo sapiens
acuccaguggugaag

SEQ ID NO: 1450392 - RNA, 16 nt, Homo sapiens
acucccgccucagggc

SEQ ID NO: 1450393 - RNA, 17 nt, Homo sapiens
acucccgccucagggcc

SEQ ID NO: 1450394 - RNA, 17 nt, Homo sapiens
acucccuugguggcaag

SEQ ID NO: 1450395 - RNA, 13 nt, Homo sapiens
acuccuagacuuu

SEQ ID NO: 1450396 - RNA, 19 nt, Homo sapiens
acuccuccaaggaaaggga

SEQ ID NO: 1450397 - RNA, 16 nt, Homo sapiens
acuccugcccuguugu

SEQ ID NO: 1450398 - RNA, 13 nt, Homo sapiens
acucuaaacugca

SEQ ID NO: 1450399 - RNA, 19 nt, Homo sapiens
acucuaagcucagugcucu

SEQ ID NO: 1450400 - RNA, 21 nt, Homo sapiens
acucuagaugaaguuuuacau

SEQ ID NO: 1450401 - RNA, 23 nt, Homo sapiens
acucucacccgaccggugcauga

SEQ ID NO: 1450402 - RNA, 16 nt, Homo sapiens
acucuccaauguucua

SEQ ID NO: 1450403 - RNA, 18 nt, Homo sapiens
acucucugguuuacuuca

SEQ ID NO: 1450404 - RNA, 12 nt, Homo sapiens
acucugaaccac

SEQ ID NO: 1450405 - RNA, 13 nt, Homo sapiens
acucugagcugcu

SEQ ID NO: 1450406 - RNA, 19 nt, Homo sapiens
acucugccuacagaacuuc

SEQ ID NO: 1450407 - RNA, 15 nt, Homo sapiens
acucugccuuucuaa

SEQ ID NO: 1450408 - RNA, 18 nt, Homo sapiens
acucuggaccauauacca

SEQ ID NO: 1450409 - RNA, 18 nt, Homo sapiens
acucuggugcuccugcau

SEQ ID NO: 1450410 - RNA, 17 nt, Homo sapiens
acucugguuucuaccag

SEQ ID NO: 1450411 - RNA, 20 nt, Homo sapiens
acucugucuuaaaugagaag

SEQ ID NO: 1450412 - RNA, 17 nt, Homo sapiens
acucuuccaccucccaa

SEQ ID NO: 1450413 - RNA, 17 nt, Homo sapiens
acucuugaaguacuuaa

SEQ ID NO: 1450414 - RNA, 18 nt, Homo sapiens
acucuuguggucaucaug

SEQ ID NO: 1450415 - RNA, 20 nt, Homo sapiens
acugaaaaaucuaagugaua

SEQ ID NO: 1450416 - RNA, 14 nt, Homo sapiens
acugaaacuucccu

SEQ ID NO: 1450417 - RNA, 14 nt, Homo sapiens
acugaaaguuuaac

SEQ ID NO: 1450418 - RNA, 16 nt, Homo sapiens
acugaacuucagagca

SEQ ID NO: 1450419 - RNA, 20 nt, Homo sapiens
acugaagcaaagaagggaau

SEQ ID NO: 1450420 - RNA, 14 nt, Homo sapiens
acugaaguuucaca

SEQ ID NO: 1450421 - RNA, 21 nt, Homo sapiens
acugaauaaagcacgugcaag

SEQ ID NO: 1450422 - RNA, 21 nt, Homo sapiens
acugacaacauuauaacugua

SEQ ID NO: 1450423 - RNA, 17 nt, Homo sapiens
acugacaaccucaucca

SEQ ID NO: 1450424 - RNA, 20 nt, Homo sapiens
acugacccugauacaggcau

SEQ ID NO: 1450425 - RNA, 12 nt, Homo sapiens
acugacuacccu

SEQ ID NO: 1450426 - RNA, 18 nt, Homo sapiens
acugacugccuugcuaaa

SEQ ID NO: 1450427 - RNA, 12 nt, Homo sapiens
acugacuuucau

SEQ ID NO: 1450428 - RNA, 19 nt, Homo sapiens
acugagcugagaccacuga

SEQ ID NO: 1450429 - RNA, 12 nt, Homo sapiens
acugagggccac

SEQ ID NO: 1450430 - RNA, 19 nt, Homo sapiens
acugagguugggguguacu

SEQ ID NO: 1450431 - RNA, 22 nt, Homo sapiens
acugaguagcucuccugacuuu

SEQ ID NO: 1450432 - RNA, 20 nt, Homo sapiens
acugaguguuauuugcacac

SEQ ID NO: 1450433 - RNA, 15 nt, Homo sapiens
acugauaucuggccu

SEQ ID NO: 1450434 - RNA, 20 nt, Homo sapiens
acugaucacccaaugcauca

SEQ ID NO: 1450435 - RNA, 19 nt, Homo sapiens
acugauuucacaacagauc

SEQ ID NO: 1450436 - RNA, 16 nt, Homo sapiens
acugcaaaccauggug

SEQ ID NO: 1450437 - RNA, 20 nt, Homo sapiens
acugcaaagcucggugcucc

SEQ ID NO: 1450438 - RNA, 16 nt, Homo sapiens
acugcaagcucugccu

SEQ ID NO: 1450439 - RNA, 16 nt, Homo sapiens
acugcaccaacgagcu

SEQ ID NO: 1450440 - RNA, 16 nt, Homo sapiens
acugcaccaagucuca

SEQ ID NO: 1450441 - RNA, 18 nt, Homo sapiens
acugcaccgccucagggu

SEQ ID NO: 1450442 - RNA, 21 nt, Homo sapiens
acugcaccuggcccagaugau

SEQ ID NO: 1450443 - RNA, 16 nt, Homo sapiens
acugcaggaccuccag

SEQ ID NO: 1450444 - RNA, 16 nt, Homo sapiens
acugcauguaagccaa

SEQ ID NO: 1450445 - RNA, 12 nt, Homo sapiens
acugccaagaaa

SEQ ID NO: 1450446 - RNA, 13 nt, Homo sapiens
acugccacccaca

SEQ ID NO: 1450447 - RNA, 20 nt, Homo sapiens
aacuucaguccaacugucaa

SEQ ID NO: 1450448 - RNA, 12 nt, Homo sapiens
aacuuccaguca

SEQ ID NO: 1450449 - RNA, 16 nt, Homo sapiens
aacuucccagugaauu

SEQ ID NO: 1450450 - RNA, 22 nt, Homo sapiens
aacuucccuuaagagucaucca

SEQ ID NO: 1450451 - RNA, 12 nt, Homo sapiens
aacuuccuucuc

SEQ ID NO: 1450452 - RNA, 17 nt, Homo sapiens
aacuucuuccugugaag

SEQ ID NO: 1450453 - RNA, 18 nt, Homo sapiens
aacuucuuuuaaaccuca

SEQ ID NO: 1450454 - RNA, 14 nt, Homo sapiens
aacuugacccccuu

SEQ ID NO: 1450455 - RNA, 14 nt, Homo sapiens
aacuugcugaucca

SEQ ID NO: 1450456 - RNA, 20 nt, Homo sapiens
aacuuguggccucaagcaau

SEQ ID NO: 1450457 - RNA, 22 nt, Homo sapiens
aacuuguuugguaguuagccau

SEQ ID NO: 1450458 - RNA, 16 nt, Homo sapiens
aacuuuaaacauugac

SEQ ID NO: 1450459 - RNA, 23 nt, Homo sapiens
aacuuuaaacauugacgauuccu

SEQ ID NO: 1450460 - RNA, 19 nt, Homo sapiens
aacuuuccucgccugacaa

SEQ ID NO: 1450461 - RNA, 22 nt, Homo sapiens
aacuuuccucgccugacaacca

SEQ ID NO: 1450462 - RNA, 17 nt, Homo sapiens
aacuuuucgacauauuu

SEQ ID NO: 1450463 - RNA, 18 nt, Homo sapiens
aacuuuucuaacagaaag

SEQ ID NO: 1450464 - RNA, 17 nt, Homo sapiens
aacuuuuugcaugcuua

SEQ ID NO: 1450465 - RNA, 16 nt, Homo sapiens
aagaaaaacaccgcuu

SEQ ID NO: 1450466 - RNA, 21 nt, Homo sapiens
aagaaaaacaccgcuucugcc

SEQ ID NO: 1450467 - RNA, 14 nt, Homo sapiens
aagaaaaacaucuu

SEQ ID NO: 1450468 - RNA, 23 nt, Homo sapiens
aagaaaaagaccuaugagcacau

SEQ ID NO: 1450469 - RNA, 24 nt, Homo sapiens
aauccaguauuauccacaauuauu

SEQ ID NO: 1450470 - RNA, 20 nt, Homo sapiens
aauccaugaacagcauuaga

SEQ ID NO: 1450471 - RNA, 14 nt, Homo sapiens
aaucccgugaaaga

SEQ ID NO: 1450472 - RNA, 20 nt, Homo sapiens
aaucccuguuuaauauuuaa

SEQ ID NO: 1450473 - RNA, 17 nt, Homo sapiens
aauccuaaauaauguua

SEQ ID NO: 1450474 - RNA, 22 nt, Homo sapiens
aauccuacuuuucgaacaccaa

SEQ ID NO: 1450475 - RNA, 17 nt, Homo sapiens
aauccuauuaaaacaca

SEQ ID NO: 1450476 - RNA, 13 nt, Homo sapiens
aauccugccauuu

SEQ ID NO: 1450477 - RNA, 21 nt, Homo sapiens
aauccugcucacaaaaucacu

SEQ ID NO: 1450478 - RNA, 17 nt, Homo sapiens
aauccuuaacacauuca

SEQ ID NO: 1450479 - RNA, 15 nt, Homo sapiens
aauccuuaucccaag

SEQ ID NO: 1450480 - RNA, 18 nt, Homo sapiens
aauccuuuacuguuaguc

SEQ ID NO: 1450481 - RNA, 14 nt, Homo sapiens
aaucgaacuaugaa

SEQ ID NO: 1450482 - RNA, 12 nt, Homo sapiens
aaucguccuccc

SEQ ID NO: 1450483 - RNA, 21 nt, Homo sapiens
aaucuaacaucguggcugugg

SEQ ID NO: 1450484 - RNA, 22 nt, Homo sapiens
aaucuagguucaggaagaccac

SEQ ID NO: 1450485 - RNA, 15 nt, Homo sapiens
aaucuauguuugcac

SEQ ID NO: 1450486 - RNA, 18 nt, Homo sapiens
aaucucaaauaacuaaaa

SEQ ID NO: 1450487 - RNA, 19 nt, Homo sapiens
aaucucaaugaagccagcu

SEQ ID NO: 1450488 - RNA, 11 nt, Homo sapiens
aaucucacaaa

SEQ ID NO: 1450489 - RNA, 19 nt, Homo sapiens
aaucucagaugcaguuugg

SEQ ID NO: 1450490 - RNA, 14 nt, Homo sapiens
aaucuccaguuuuc

SEQ ID NO: 1450491 - RNA, 16 nt, Homo sapiens
aaucucucugcagcug

SEQ ID NO: 1450492 - RNA, 22 nt, Homo sapiens
aaucucuucuuugcugcaguca

SEQ ID NO: 1450493 - RNA, 13 nt, Homo sapiens
aaucugacauauu

SEQ ID NO: 1450494 - RNA, 15 nt, Homo sapiens
aaucugaguauauau

SEQ ID NO: 1450495 - RNA, 17 nt, Homo sapiens
aaucugauguuaaccaa

SEQ ID NO: 1450496 - RNA, 19 nt, Homo sapiens
aaucugauguuaaccaaug

SEQ ID NO: 1450497 - RNA, 16 nt, Homo sapiens
aaucugcacacuccag

SEQ ID NO: 1450498 - RNA, 19 nt, Homo sapiens
aaucuggguaucuuuccag

SEQ ID NO: 1450499 - RNA, 13 nt, Homo sapiens
aaucuguauaaau

SEQ ID NO: 1450500 - RNA, 17 nt, Homo sapiens
aaucuguguaacuguaa

SEQ ID NO: 1450501 - RNA, 16 nt, Homo sapiens
aaucuuacaacaggcu

SEQ ID NO: 1450502 - RNA, 20 nt, Homo sapiens
aaucuugucuaacauucccg

SEQ ID NO: 1450503 - RNA, 14 nt, Homo sapiens
aaucuuugugacag

SEQ ID NO: 1450504 - RNA, 17 nt, Homo sapiens
aaugaaacugcugugaa

SEQ ID NO: 1450505 - RNA, 16 nt, Homo sapiens
aaugaacuaacugaca

SEQ ID NO: 1450506 - RNA, 15 nt, Homo sapiens
aaugaagacaaugau

SEQ ID NO: 1450507 - RNA, 22 nt, Homo sapiens
aaugaagacuacauuugugaac

SEQ ID NO: 1450508 - RNA, 20 nt, Homo sapiens
aaugaauuuuauaaucugca

SEQ ID NO: 1450509 - RNA, 20 nt, Homo sapiens
aaugacaauaaaaauuccaa

SEQ ID NO: 1450510 - RNA, 14 nt, Homo sapiens
aaugacaucucagg

SEQ ID NO: 1450511 - RNA, 15 nt, Homo sapiens
aaugacaucucaggg

SEQ ID NO: 1450512 - RNA, 10 nt, Homo sapiens
aaugacauuc

SEQ ID NO: 1450513 - RNA, 20 nt, Homo sapiens
aaugagaaggcagccaccag

SEQ ID NO: 1450514 - RNA, 18 nt, Homo sapiens
aaugagcacccauuccaa

SEQ ID NO: 1450515 - RNA, 14 nt, Homo sapiens
aaugagccaugaga

SEQ ID NO: 1450516 - RNA, 17 nt, Homo sapiens
aaugaggucuguuuaaa

SEQ ID NO: 1450517 - RNA, 18 nt, Homo sapiens
aaugaucagcaucuguga

SEQ ID NO: 1450518 - RNA, 23 nt, Homo sapiens
aaugaucuugaagaugacaaaag

SEQ ID NO: 1450519 - RNA, 14 nt, Homo sapiens
aaugauguuuuccu

SEQ ID NO: 1450520 - RNA, 11 nt, Homo sapiens
aaugauuagaa

SEQ ID NO: 1450521 - RNA, 19 nt, Homo sapiens
aaugauuggaauauuacaa

SEQ ID NO: 1450522 - RNA, 15 nt, Homo sapiens
aaugauuuuacuuaa

SEQ ID NO: 1450523 - RNA, 18 nt, Homo sapiens
aaugauuuuaucugugaa

SEQ ID NO: 1450524 - RNA, 9 nt, Homo sapiens
aaugcaaaa

SEQ ID NO: 1450525 - RNA, 15 nt, Homo sapiens
aaugcaaaacuuuag

SEQ ID NO: 1450526 - RNA, 21 nt, Homo sapiens
aaugcaagggggacacaugaa

SEQ ID NO: 1450527 - RNA, 14 nt, Homo sapiens
aaugcacauuuuau

SEQ ID NO: 1450528 - RNA, 19 nt, Homo sapiens
aaugcaucacguaccccac

SEQ ID NO: 1450529 - RNA, 13 nt, Homo sapiens
aaugccacaaaac

SEQ ID NO: 1450530 - RNA, 17 nt, Homo sapiens
aaugccacaaaacugac

SEQ ID NO: 1450531 - RNA, 14 nt, Homo sapiens
aaugccugugccaa

SEQ ID NO: 1450532 - RNA, 20 nt, Homo sapiens
aaugccuuugagacaguuuc

SEQ ID NO: 1450533 - RNA, 10 nt, Homo sapiens
aaugcuccau

SEQ ID NO: 1450534 - RNA, 12 nt, Homo sapiens
aaugcuccccac

SEQ ID NO: 1450535 - RNA, 20 nt, Homo sapiens
aaugcucuuuacuucaugga

SEQ ID NO: 1450536 - RNA, 13 nt, Homo sapiens
aaugcugagguua

SEQ ID NO: 1450537 - RNA, 15 nt, Homo sapiens
aaugcugcuacuuaa

SEQ ID NO: 1450538 - RNA, 22 nt, Homo sapiens
aaugcuucagauauuauugcuu

SEQ ID NO: 1450539 - RNA, 17 nt, Homo sapiens
aaugcuucauaugagga

SEQ ID NO: 1450540 - RNA, 12 nt, Homo sapiens
aauggaucacaa

SEQ ID NO: 1450541 - RNA, 16 nt, Homo sapiens
aauggcagaaccaaag

SEQ ID NO: 1450542 - RNA, 19 nt, Homo sapiens
aauggcaucaauauacaua

SEQ ID NO: 1450543 - RNA, 20 nt, Homo sapiens
aauggcuaagauaccaaaac

SEQ ID NO: 1450544 - RNA, 12 nt, Homo sapiens
aauggggccaga

SEQ ID NO: 1450545 - RNA, 14 nt, Homo sapiens
aauggucauccaaa

SEQ ID NO: 1450546 - RNA, 15 nt, Homo sapiens
aauggucauccaaac

SEQ ID NO: 1450547 - RNA, 21 nt, Homo sapiens
aaugguucagaauuaaacuuu

SEQ ID NO: 1450548 - RNA, 17 nt, Homo sapiens
aauguaaaauauaucau

SEQ ID NO: 1450549 - RNA, 23 nt, Homo sapiens
aauguaauacuccuaagacuuau

SEQ ID NO: 1450550 - RNA, 16 nt, Homo sapiens
aauguacaacugcacc

SEQ ID NO: 1450551 - RNA, 16 nt, Homo sapiens
aauguaccugauguac

SEQ ID NO: 1450552 - RNA, 16 nt, Homo sapiens
aauguaucuuggugcu

SEQ ID NO: 1450553 - RNA, 14 nt, Homo sapiens
agggguccagccuc

SEQ ID NO: 1450554 - RNA, 22 nt, Homo sapiens
aggggugaaaggggggaaccag

SEQ ID NO: 1450555 - RNA, 18 nt, Homo sapiens
aggggugggccugugaau

SEQ ID NO: 1450556 - RNA, 24 nt, Homo sapiens
agggguugagggaagguucuucau

SEQ ID NO: 1450557 - RNA, 20 nt, Homo sapiens
agggguuugagaugcuguag

SEQ ID NO: 1450558 - RNA, 19 nt, Homo sapiens
agggucaggcggggugcug

SEQ ID NO: 1450559 - RNA, 13 nt, Homo sapiens
aggguccagugga

SEQ ID NO: 1450560 - RNA, 14 nt, Homo sapiens
aggguccaguggau

SEQ ID NO: 1450561 - RNA, 18 nt, Homo sapiens
aggguccuccuccaucuu

SEQ ID NO: 1450562 - RNA, 21 nt, Homo sapiens
agggucucgcugucacuggcu

SEQ ID NO: 1450563 - RNA, 19 nt, Homo sapiens
agggucuucuuacaugcau

SEQ ID NO: 1450564 - RNA, 20 nt, Homo sapiens
aggguggguguccaugugca

SEQ ID NO: 1450565 - RNA, 23 nt, Homo sapiens
aggguuaacccuucaucuuccug

SEQ ID NO: 1450566 - RNA, 18 nt, Homo sapiens
aggguuacugacguguaa

SEQ ID NO: 1450567 - RNA, 15 nt, Homo sapiens
aggguuccaaagggc

SEQ ID NO: 1450568 - RNA, 17 nt, Homo sapiens
aggguuccuguagaccu

SEQ ID NO: 1450569 - RNA, 23 nt, Homo sapiens
aggguuggcaccugcacacucca

SEQ ID NO: 1450570 - RNA, 22 nt, Homo sapiens
agguaaauucuuaauguucaca

SEQ ID NO: 1450571 - RNA, 22 nt, Homo sapiens
agguaaauuuuuaggcaaagau

SEQ ID NO: 1450572 - RNA, 12 nt, Homo sapiens
agguaacauguu

SEQ ID NO: 1450573 - RNA, 20 nt, Homo sapiens
agguaccagcugcgcuugcu

SEQ ID NO: 1450574 - RNA, 19 nt, Homo sapiens
agguagaaauaucugaaaa

SEQ ID NO: 1450575 - RNA, 21 nt, Homo sapiens
agguaguguugagacccaggc

SEQ ID NO: 1450576 - RNA, 15 nt, Homo sapiens
agguaguuuggauau

SEQ ID NO: 1450577 - RNA, 16 nt, Homo sapiens
agguauggcucugcac

SEQ ID NO: 1450578 - RNA, 12 nt, Homo sapiens
aggucaccagca

SEQ ID NO: 1450579 - RNA, 12 nt, Homo sapiens
aggucacuccug

SEQ ID NO: 1450580 - RNA, 12 nt, Homo sapiens
aggucacuggaa

SEQ ID NO: 1450581 - RNA, 12 nt, Homo sapiens
aggucaggagau

SEQ ID NO: 1450582 - RNA, 22 nt, Homo sapiens
aggucagggagugcuggcucac

SEQ ID NO: 1450583 - RNA, 13 nt, Homo sapiens
agguccucuacuu

SEQ ID NO: 1450584 - RNA, 21 nt, Homo sapiens
agguccuuauguccugucaua

SEQ ID NO: 1450585 - RNA, 14 nt, Homo sapiens
aggucuaccccugg

SEQ ID NO: 1450586 - RNA, 17 nt, Homo sapiens
aggucuccuaaaacugg

SEQ ID NO: 1450587 - RNA, 21 nt, Homo sapiens
aggugacugaaggcugucagg

SEQ ID NO: 1450588 - RNA, 14 nt, Homo sapiens
aggugagcccucau

SEQ ID NO: 1450589 - RNA, 17 nt, Homo sapiens
aggugauccaccugccu

SEQ ID NO: 1450590 - RNA, 11 nt, Homo sapiens
aggugcacagg

SEQ ID NO: 1450591 - RNA, 14 nt, Homo sapiens
aggugcacugcuuu

SEQ ID NO: 1450592 - RNA, 21 nt, Homo sapiens
aggugcgaaugacaguagcau

SEQ ID NO: 1450593 - RNA, 21 nt, Homo sapiens
aggugcuauguucuuagugga

SEQ ID NO: 1450594 - RNA, 22 nt, Homo sapiens
aggugcucauuguaaccauuuc

SEQ ID NO: 1450595 - RNA, 20 nt, Homo sapiens
aggugcugacuucaucuccc

SEQ ID NO: 1450596 - RNA, 21 nt, Homo sapiens
agguggaaaaacagcauguac

SEQ ID NO: 1450597 - RNA, 16 nt, Homo sapiens
agguggaacucaguca

SEQ ID NO: 1450598 - RNA, 16 nt, Homo sapiens
agguggagaacuggga

SEQ ID NO: 1450599 - RNA, 17 nt, Homo sapiens
agguggagacccugaga

SEQ ID NO: 1450600 - RNA, 16 nt, Homo sapiens
agguggagugucacau

SEQ ID NO: 1450601 - RNA, 20 nt, Homo sapiens
agguggagugucacaucucu

SEQ ID NO: 1450602 - RNA, 19 nt, Homo sapiens
agguggcaggaccaggacu

SEQ ID NO: 1450603 - RNA, 16 nt, Homo sapiens
agguggccccaguuca

SEQ ID NO: 1450604 - RNA, 12 nt, Homo sapiens
aggugggcacug

SEQ ID NO: 1450605 - RNA, 21 nt, Homo sapiens
aggugggcaugccacccucac

SEQ ID NO: 1450606 - RNA, 19 nt, Homo sapiens
aggugggccuugcuaccuc

SEQ ID NO: 1450607 - RNA, 12 nt, Homo sapiens
aggugggugcug

SEQ ID NO: 1450608 - RNA, 13 nt, Homo sapiens
aggugggugcugc

SEQ ID NO: 1450609 - RNA, 21 nt, Homo sapiens
aggugucuggccugaggucaa

SEQ ID NO: 1450610 - RNA, 19 nt, Homo sapiens
agguuauagaguagaagau

SEQ ID NO: 1450611 - RNA, 14 nt, Homo sapiens
agguuauauccaau

SEQ ID NO: 1450612 - RNA, 13 nt, Homo sapiens
agguucacugagc

SEQ ID NO: 1450613 - RNA, 16 nt, Homo sapiens
agguucagcugaagcu

SEQ ID NO: 1450614 - RNA, 19 nt, Homo sapiens
agguuccuuaucugucaca

SEQ ID NO: 1450615 - RNA, 21 nt, Homo sapiens
agguucugcccuuauggagcu

SEQ ID NO: 1450616 - RNA, 18 nt, Homo sapiens
agguucuuagugucacuu

SEQ ID NO: 1450617 - RNA, 19 nt, Homo sapiens
agguucuuagugucacuua

SEQ ID NO: 1450618 - RNA, 18 nt, Homo sapiens
agguucuucagggccagu

SEQ ID NO: 1450619 - RNA, 15 nt, Homo sapiens
agguucuugggauac

SEQ ID NO: 1450620 - RNA, 22 nt, Homo sapiens
agguucuuuuuuuuuucaggaa

SEQ ID NO: 1450621 - RNA, 19 nt, Homo sapiens
agguuggagcccagggcau

SEQ ID NO: 1450622 - RNA, 23 nt, Homo sapiens
agguugucugaagucacugcaca

SEQ ID NO: 1450623 - RNA, 15 nt, Homo sapiens
agguuuacauuguca

SEQ ID NO: 1450624 - RNA, 21 nt, Homo sapiens
agguuuuaaccgcacaugcac

SEQ ID NO: 1450625 - RNA, 23 nt, Homo sapiens
agguuuuaaccgcacaugcacac

SEQ ID NO: 1450626 - RNA, 19 nt, Homo sapiens
aguaaacaugugggaaaaa

SEQ ID NO: 1450627 - RNA, 16 nt, Homo sapiens
aguaaaggcaaacuua

SEQ ID NO: 1450628 - RNA, 20 nt, Homo sapiens
aguaaagucaacauaugcaa

SEQ ID NO: 1450629 - RNA, 17 nt, Homo sapiens
aguaaauauuucaggca

SEQ ID NO: 1450630 - RNA, 22 nt, Homo sapiens
aguaaaugcuagguuaauucca

SEQ ID NO: 1450631 - RNA, 16 nt, Homo sapiens
aguaaauugcucuguu

SEQ ID NO: 1450632 - RNA, 19 nt, Homo sapiens
aguaacacacuuccagugu

SEQ ID NO: 1450633 - RNA, 18 nt, Homo sapiens
aguaacuucacauuaaaa

SEQ ID NO: 1450634 - RNA, 16 nt, Homo sapiens
aguaagaugcacugaa

SEQ ID NO: 1450635 - RNA, 13 nt, Homo sapiens
aguaaguacgugu

SEQ ID NO: 1450636 - RNA, 22 nt, Homo sapiens
aguaaguacuuaauaaacugug

SEQ ID NO: 1450637 - RNA, 14 nt, Homo sapiens
aguuuacccaugaa

SEQ ID NO: 1450638 - RNA, 20 nt, Homo sapiens
aguuuauaaaugugaacuua

SEQ ID NO: 1450639 - RNA, 13 nt, Homo sapiens
aguuuaucuuuca

SEQ ID NO: 1450640 - RNA, 21 nt, Homo sapiens
aguuuauuuuuauacuuucag

SEQ ID NO: 1450641 - RNA, 22 nt, Homo sapiens
aguuucagagaaauacuuucag

SEQ ID NO: 1450642 - RNA, 14 nt, Homo sapiens
aguuucaucaguca

SEQ ID NO: 1450643 - RNA, 20 nt, Homo sapiens
aguuuccuaggaugucaugu

SEQ ID NO: 1450644 - RNA, 13 nt, Homo sapiens
aguuugagacagg

SEQ ID NO: 1450645 - RNA, 20 nt, Homo sapiens
aguuugagacaggagaccug

SEQ ID NO: 1450646 - RNA, 15 nt, Homo sapiens
aguuugcacaacaag

SEQ ID NO: 1450647 - RNA, 17 nt, Homo sapiens
aguuugcuuuguaugca

SEQ ID NO: 1450648 - RNA, 19 nt, Homo sapiens
aguuugcuuuguaugcacu

SEQ ID NO: 1450649 - RNA, 16 nt, Homo sapiens
aguuuggguaaaauac

SEQ ID NO: 1450650 - RNA, 19 nt, Homo sapiens
aguuugguccuggggacca

SEQ ID NO: 1450651 - RNA, 17 nt, Homo sapiens
aguuugucagacuuuaa

SEQ ID NO: 1450652 - RNA, 13 nt, Homo sapiens
aguuuucaaguca

SEQ ID NO: 1450653 - RNA, 13 nt, Homo sapiens
aguuuuccaugaa

SEQ ID NO: 1450654 - RNA, 15 nt, Homo sapiens
aguuuucuguaguca

SEQ ID NO: 1450655 - RNA, 21 nt, Homo sapiens
aguuuuggcaaggcugacaga

SEQ ID NO: 1450656 - RNA, 10 nt, Homo sapiens
aguuuuuacu

SEQ ID NO: 1450657 - RNA, 19 nt, Homo sapiens
auacauaucgcugacuuca

SEQ ID NO: 1450658 - RNA, 20 nt, Homo sapiens
auacauggaaacgcaaauga

SEQ ID NO: 1450659 - RNA, 15 nt, Homo sapiens
auacaugugccgaau

SEQ ID NO: 1450660 - RNA, 20 nt, Homo sapiens
auacauucuuuaucuugaca

SEQ ID NO: 1450661 - RNA, 18 nt, Homo sapiens
auacauuuaugcacauuc

SEQ ID NO: 1450662 - RNA, 21 nt, Homo sapiens
auaccaacuguacaaaauaac

SEQ ID NO: 1450663 - RNA, 15 nt, Homo sapiens
auaccaucugguacu

SEQ ID NO: 1450664 - RNA, 21 nt, Homo sapiens
auaccccggugugccugugga

SEQ ID NO: 1450665 - RNA, 20 nt, Homo sapiens
auacccuggagcaagaccug

SEQ ID NO: 1450666 - RNA, 21 nt, Homo sapiens
auaccucaacccccauuucua

SEQ ID NO: 1450667 - RNA, 13 nt, Homo sapiens
auaccugcacugu

SEQ ID NO: 1450668 - RNA, 13 nt, Homo sapiens
auaccuggcuuuu

SEQ ID NO: 1450669 - RNA, 21 nt, Homo sapiens
auacgccuguaguccuagcca

SEQ ID NO: 1450670 - RNA, 16 nt, Homo sapiens
auacuaguagucauac

SEQ ID NO: 1450671 - RNA, 14 nt, Homo sapiens
auacuauugccuca

SEQ ID NO: 1450672 - RNA, 16 nt, Homo sapiens
auacuauugccucaua

SEQ ID NO: 1450673 - RNA, 20 nt, Homo sapiens
auacuauuuaauuauuucac

SEQ ID NO: 1450674 - RNA, 13 nt, Homo sapiens
auacugacuccua

SEQ ID NO: 1450675 - RNA, 15 nt, Homo sapiens
auacugcuacuguaa

SEQ ID NO: 1450676 - RNA, 21 nt, Homo sapiens
auaugaguuacugaaggugau

SEQ ID NO: 1450677 - RNA, 14 nt, Homo sapiens
auaugauaaaacac

SEQ ID NO: 1450678 - RNA, 23 nt, Homo sapiens
auaugaucuguuuuguaucuuaa

SEQ ID NO: 1450679 - RNA, 18 nt, Homo sapiens
auaugcagcugugauacu

SEQ ID NO: 1450680 - RNA, 22 nt, Homo sapiens
auaugcagugauauggcagaag

SEQ ID NO: 1450681 - RNA, 17 nt, Homo sapiens
auaugccugcaaucuga

SEQ ID NO: 1450682 - RNA, 16 nt, Homo sapiens
auaugcuuuacaaucu

SEQ ID NO: 1450683 - RNA, 22 nt, Homo sapiens
auauguaggugucugcacccag

SEQ ID NO: 1450684 - RNA, 14 nt, Homo sapiens
auaugucugauaau

SEQ ID NO: 1450685 - RNA, 23 nt, Homo sapiens
auauguguaugcacaguaaaaau

SEQ ID NO: 1450686 - RNA, 15 nt, Homo sapiens
auauguugcuauaau

SEQ ID NO: 1450687 - RNA, 21 nt, Homo sapiens
auauuaagaaagacuaucuaa

SEQ ID NO: 1450688 - RNA, 14 nt, Homo sapiens
auauuaagcacuuu

SEQ ID NO: 1450689 - RNA, 13 nt, Homo sapiens
auauuacagugaa

SEQ ID NO: 1450690 - RNA, 13 nt, Homo sapiens
auauuaguauuaa

SEQ ID NO: 1450691 - RNA, 18 nt, Homo sapiens
auauuauuugcuaauuaa

SEQ ID NO: 1450692 - RNA, 20 nt, Homo sapiens
auauucuaagccaguuuuca

SEQ ID NO: 1450693 - RNA, 16 nt, Homo sapiens
auauucuuugguugug

SEQ ID NO: 1450694 - RNA, 11 nt, Homo sapiens
auauugcccag

SEQ ID NO: 1450695 - RNA, 13 nt, Homo sapiens
auccaggugccaa

SEQ ID NO: 1450696 - RNA, 16 nt, Homo sapiens
auccagucucccaacu

SEQ ID NO: 1450697 - RNA, 12 nt, Homo sapiens
auccagugacaa

SEQ ID NO: 1450698 - RNA, 17 nt, Homo sapiens
auccauauugagucaaa

SEQ ID NO: 1450699 - RNA, 13 nt, Homo sapiens
auccaucccucca

SEQ ID NO: 1450700 - RNA, 19 nt, Homo sapiens
auccaucccuccauucauc

SEQ ID NO: 1450701 - RNA, 14 nt, Homo sapiens
auccauccuuccaa

SEQ ID NO: 1450702 - RNA, 16 nt, Homo sapiens
auccaugcuucucauc

SEQ ID NO: 1450703 - RNA, 16 nt, Homo sapiens
auccauuaaaaauggg

SEQ ID NO: 1450704 - RNA, 15 nt, Homo sapiens
auccauucacaguuc

SEQ ID NO: 1450705 - RNA, 15 nt, Homo sapiens
auccauugaacuaaa

SEQ ID NO: 1450706 - RNA, 16 nt, Homo sapiens
aucccaagugcacuuu

SEQ ID NO: 1450707 - RNA, 18 nt, Homo sapiens
aucccaauccuuauccca

SEQ ID NO: 1450708 - RNA, 20 nt, Homo sapiens
aucccagcaagcgagcuuua

SEQ ID NO: 1450709 - RNA, 22 nt, Homo sapiens
auccccaaguggugaaugacac

SEQ ID NO: 1450710 - RNA, 18 nt, Homo sapiens
aucccccaaaaugcauuu

SEQ ID NO: 1450711 - RNA, 17 nt, Homo sapiens
aucccccuggggcacuu

SEQ ID NO: 1450712 - RNA, 15 nt, Homo sapiens
auccccucccaucau

SEQ ID NO: 1450713 - RNA, 22 nt, Homo sapiens
auccccuuuggcuaccugaugg

SEQ ID NO: 1450714 - RNA, 18 nt, Homo sapiens
aucccguaccucuuccca

SEQ ID NO: 1450715 - RNA, 13 nt, Homo sapiens
auuugaacacugg

SEQ ID NO: 1450716 - RNA, 19 nt, Homo sapiens
auuugaacucuucaaucuc

SEQ ID NO: 1450717 - RNA, 18 nt, Homo sapiens
auuugaauuucaguaaac

SEQ ID NO: 1450718 - RNA, 20 nt, Homo sapiens
auuugacuucagccagguga

SEQ ID NO: 1450719 - RNA, 17 nt, Homo sapiens
auuugagagcuaacuau

SEQ ID NO: 1450720 - RNA, 23 nt, Homo sapiens
auuugauaguugguguucaaaaa

SEQ ID NO: 1450721 - RNA, 15 nt, Homo sapiens
auuugaucacuacaa

SEQ ID NO: 1450722 - RNA, 16 nt, Homo sapiens
auuugaucacuacaag

SEQ ID NO: 1450723 - RNA, 15 nt, Homo sapiens
auuugaugugacuuu

SEQ ID NO: 1450724 - RNA, 16 nt, Homo sapiens
auuugauuaacaaaua

SEQ ID NO: 1450725 - RNA, 22 nt, Homo sapiens
auuugauucgcccuccucccug

SEQ ID NO: 1450726 - RNA, 23 nt, Homo sapiens
auuugauucuccagccaaccuca

SEQ ID NO: 1450727 - RNA, 13 nt, Homo sapiens
auuugcacacugc

SEQ ID NO: 1450728 - RNA, 16 nt, Homo sapiens
auuugcacacugcacu

SEQ ID NO: 1450729 - RNA, 19 nt, Homo sapiens
auuugcacacugcacuguu

SEQ ID NO: 1450730 - RNA, 16 nt, Homo sapiens
auuugcauuaaauuca

SEQ ID NO: 1450731 - RNA, 20 nt, Homo sapiens
auuugccuuucugggagcag

SEQ ID NO: 1450732 - RNA, 17 nt, Homo sapiens
auuugcuguuuuaaaca

SEQ ID NO: 1450733 - RNA, 17 nt, Homo sapiens
auuuggacaagugcugu

SEQ ID NO: 1450734 - RNA, 17 nt, Homo sapiens
auuugggccugcuccag

SEQ ID NO: 1450735 - RNA, 20 nt, Homo sapiens
auuuggguucugccugccag

SEQ ID NO: 1450736 - RNA, 13 nt, Homo sapiens
auuuggucugcca

SEQ ID NO: 1450737 - RNA, 17 nt, Homo sapiens
auuugguggaugugaug

SEQ ID NO: 1450738 - RNA, 22 nt, Homo sapiens
auuuguaagggcucucaaagau

SEQ ID NO: 1450739 - RNA, 15 nt, Homo sapiens
auuuguagcacugag

SEQ ID NO: 1450740 - RNA, 15 nt, Homo sapiens
caaacuuucacuuug

SEQ ID NO: 1450741 - RNA, 20 nt, Homo sapiens
caaagaaaaauaacccuuug

SEQ ID NO: 1450742 - RNA, 22 nt, Homo sapiens
caaagaacaaacauccuugcaa

SEQ ID NO: 1450743 - RNA, 14 nt, Homo sapiens
caaagaacuacccc

SEQ ID NO: 1450744 - RNA, 13 nt, Homo sapiens
caaagaaggcauu

SEQ ID NO: 1450745 - RNA, 18 nt, Homo sapiens
caaagaaugggcuugaaa

SEQ ID NO: 1450746 - RNA, 20 nt, Homo sapiens
caaagaaugggcuugaaaca

SEQ ID NO: 1450747 - RNA, 16 nt, Homo sapiens
caaagagcacauuuac

SEQ ID NO: 1450748 - RNA, 13 nt, Homo sapiens
caaagaggcugcc

SEQ ID NO: 1450749 - RNA, 19 nt, Homo sapiens
caaagaguauauguucccu

SEQ ID NO: 1450750 - RNA, 21 nt, Homo sapiens
caaagaguauguuguaagaaa

SEQ ID NO: 1450751 - RNA, 23 nt, Homo sapiens
caaagaucaaaauaaaaagugac

SEQ ID NO: 1450752 - RNA, 22 nt, Homo sapiens
caaagaucuguccucagccuug

SEQ ID NO: 1450753 - RNA, 13 nt, Homo sapiens
caaagaugcccca

SEQ ID NO: 1450754 - RNA, 22 nt, Homo sapiens
caaagcaggaauugguggcaga

SEQ ID NO: 1450755 - RNA, 13 nt, Homo sapiens
caaagccaaaacc

SEQ ID NO: 1450756 - RNA, 20 nt, Homo sapiens
caaagccacauuauuucuag

SEQ ID NO: 1450757 - RNA, 13 nt, Homo sapiens
caaagccagugaa

SEQ ID NO: 1450758 - RNA, 22 nt, Homo sapiens
caaagcguuucuuuacuucuca

SEQ ID NO: 1450759 - RNA, 22 nt, Homo sapiens
caaagcugaugacaacuuccca

SEQ ID NO: 1450760 - RNA, 16 nt, Homo sapiens
caaaggcgacaauaaa

SEQ ID NO: 1450761 - RNA, 17 nt, Homo sapiens
caaaguaccuugaacuc

SEQ ID NO: 1450762 - RNA, 20 nt, Homo sapiens
caaaguccuuuuuuuccauc

SEQ ID NO: 1450763 - RNA, 17 nt, Homo sapiens
caaagugagacuccguc

SEQ ID NO: 1450764 - RNA, 20 nt, Homo sapiens
caaagugagacuccgucaca

SEQ ID NO: 1450765 - RNA, 12 nt, Homo sapiens
caaagugaggag

SEQ ID NO: 1450766 - RNA, 17 nt, Homo sapiens
caaagugugauauacaa

SEQ ID NO: 1450767 - RNA, 16 nt, Homo sapiens
caaaguguuaaucuua

SEQ ID NO: 1450768 - RNA, 20 nt, Homo sapiens
caaaguuuaaauguauuuua

SEQ ID NO: 1450769 - RNA, 13 nt, Homo sapiens
caaauaaaaucua

SEQ ID NO: 1450770 - RNA, 16 nt, Homo sapiens
caaauaaagugcaguu

SEQ ID NO: 1450771 - RNA, 18 nt, Homo sapiens
caaauaaagugcaguuua

SEQ ID NO: 1450772 - RNA, 15 nt, Homo sapiens
caaauaaauaucauc

SEQ ID NO: 1450773 - RNA, 22 nt, Homo sapiens
caaauaauagaauugcucccua

SEQ ID NO: 1450774 - RNA, 15 nt, Homo sapiens
caaauauaagacauu

SEQ ID NO: 1450775 - RNA, 18 nt, Homo sapiens
caaauauaagacauuugu

SEQ ID NO: 1450776 - RNA, 18 nt, Homo sapiens
caaaucagaaacuuguga

SEQ ID NO: 1450777 - RNA, 17 nt, Homo sapiens
caaauccucuaauugca

SEQ ID NO: 1450778 - RNA, 15 nt, Homo sapiens
caaauccuuccaaaa

SEQ ID NO: 1450779 - RNA, 21 nt, Homo sapiens
caaaucuggguaucuuuccag

SEQ ID NO: 1450780 - RNA, 19 nt, Homo sapiens
caaaucuugggugggugaa

SEQ ID NO: 1450781 - RNA, 14 nt, Homo sapiens
caaaugacaaaaag

SEQ ID NO: 1450782 - RNA, 16 nt, Homo sapiens
caaaugagagugguua

SEQ ID NO: 1450783 - RNA, 13 nt, Homo sapiens
caaaugaugccau

SEQ ID NO: 1450784 - RNA, 19 nt, Homo sapiens
caaaugccugguaccagag

SEQ ID NO: 1450785 - RNA, 20 nt, Homo sapiens
caaaugccugguaccagagg

SEQ ID NO: 1450786 - RNA, 20 nt, Homo sapiens
caaauguacagugguccuuu

SEQ ID NO: 1450787 - RNA, 14 nt, Homo sapiens
caaauguccuccag

SEQ ID NO: 1450788 - RNA, 14 nt, Homo sapiens
caaaugugcugcuu

SEQ ID NO: 1450789 - RNA, 15 nt, Homo sapiens
caaauuaagaaucua

SEQ ID NO: 1450790 - RNA, 15 nt, Homo sapiens
caaauuaaggcauaa

SEQ ID NO: 1450791 - RNA, 15 nt, Homo sapiens
caaauuauaaaaagc

SEQ ID NO: 1450792 - RNA, 22 nt, Homo sapiens
caaauucauuuuuuucacugga

SEQ ID NO: 1450793 - RNA, 21 nt, Homo sapiens
caaauucggauguaugaucuc

SEQ ID NO: 1450794 - RNA, 20 nt, Homo sapiens
caacaaagaaugggcuugaa

SEQ ID NO: 1450795 - RNA, 14 nt, Homo sapiens
caacaaccuaugca

SEQ ID NO: 1450796 - RNA, 19 nt, Homo sapiens
caacaacuuacacuuauuu

SEQ ID NO: 1450797 - RNA, 20 nt, Homo sapiens
caacaaggcugcacagcuca

SEQ ID NO: 1450798 - RNA, 14 nt, Homo sapiens
caacaaugacuuaa

SEQ ID NO: 1450799 - RNA, 15 nt, Homo sapiens
caacaauugguaaaa

SEQ ID NO: 1450800 - RNA, 21 nt, Homo sapiens
caacacaguugggacccaaaa

SEQ ID NO: 1450801 - RNA, 15 nt, Homo sapiens
caacaccaagcacag

SEQ ID NO: 1450802 - RNA, 15 nt, Homo sapiens
caacaccacuaggaa

SEQ ID NO: 1450803 - RNA, 14 nt, Homo sapiens
caacacugcugcuc

SEQ ID NO: 1450804 - RNA, 22 nt, Homo sapiens
caacacugcugcuccagugcag

SEQ ID NO: 1450805 - RNA, 19 nt, Homo sapiens
caacacuggugugaccuga

SEQ ID NO: 1450806 - RNA, 21 nt, Homo sapiens
caacacugucacuagucucac

SEQ ID NO: 1450807 - RNA, 15 nt, Homo sapiens
caacagacuguugag

SEQ ID NO: 1450808 - RNA, 21 nt, Homo sapiens
caacagagcaagacuccaucu

SEQ ID NO: 1450809 - RNA, 19 nt, Homo sapiens
caacaggaaggaaccagaa

SEQ ID NO: 1450810 - RNA, 12 nt, Homo sapiens
caacauaacuga

SEQ ID NO: 1450811 - RNA, 22 nt, Homo sapiens
caacauaauuaaauuuugaguu

SEQ ID NO: 1450812 - RNA, 16 nt, Homo sapiens
caacauccuuaaguca

SEQ ID NO: 1450813 - RNA, 24 nt, Homo sapiens
caacaucgugaaaccccaucucua

SEQ ID NO: 1450814 - RNA, 22 nt, Homo sapiens
caacaucuuuuuaaccugcaaa

SEQ ID NO: 1450815 - RNA, 21 nt, Homo sapiens
cacagggguucccuucucuca

SEQ ID NO: 1450816 - RNA, 15 nt, Homo sapiens
cacagggucugcucu

SEQ ID NO: 1450817 - RNA, 13 nt, Homo sapiens
cacagugcaucuc

SEQ ID NO: 1450818 - RNA, 15 nt, Homo sapiens
cacagugcaucucag

SEQ ID NO: 1450819 - RNA, 17 nt, Homo sapiens
cacagugcugaccagac

SEQ ID NO: 1450820 - RNA, 11 nt, Homo sapiens
cacagugucug

SEQ ID NO: 1450821 - RNA, 23 nt, Homo sapiens
cacaguuuauuuuuauacuuuca

SEQ ID NO: 1450822 - RNA, 16 nt, Homo sapiens
cacauaacaugcuuua

SEQ ID NO: 1450823 - RNA, 20 nt, Homo sapiens
cacauaaggacguguguaaa

SEQ ID NO: 1450824 - RNA, 17 nt, Homo sapiens
cacauccaucccuccau

SEQ ID NO: 1450825 - RNA, 13 nt, Homo sapiens
cacaucuagugag

SEQ ID NO: 1450826 - RNA, 13 nt, Homo sapiens
cacaucugucacg

SEQ ID NO: 1450827 - RNA, 19 nt, Homo sapiens
cacaugaaaccuacacacu

SEQ ID NO: 1450828 - RNA, 15 nt, Homo sapiens
cacaugaaugcaguc

SEQ ID NO: 1450829 - RNA, 17 nt, Homo sapiens
cacaugaccugaucacu

SEQ ID NO: 1450830 - RNA, 23 nt, Homo sapiens
cacaugcacacacacacaucuca

SEQ ID NO: 1450831 - RNA, 20 nt, Homo sapiens
cacauuagaauaaaagguag

SEQ ID NO: 1450832 - RNA, 23 nt, Homo sapiens
cacauuaucgggagcagugucuu

SEQ ID NO: 1450833 - RNA, 14 nt, Homo sapiens
cacauuauguaucu

SEQ ID NO: 1450834 - RNA, 19 nt, Homo sapiens
cacauucaauagcauauca

SEQ ID NO: 1450835 - RNA, 18 nt, Homo sapiens
cacauucccccaccagcu

SEQ ID NO: 1450836 - RNA, 18 nt, Homo sapiens
cacauugaaugcgcuuua

SEQ ID NO: 1450837 - RNA, 20 nt, Homo sapiens
cacauuggucauugugaaua

SEQ ID NO: 1450838 - RNA, 15 nt, Homo sapiens
cacauugugccuuuu

SEQ ID NO: 1450839 - RNA, 20 nt, Homo sapiens
cacauuuacaaaauuacaca

SEQ ID NO: 1450840 - RNA, 15 nt, Homo sapiens
cacauuucuaugcca

SEQ ID NO: 1450841 - RNA, 20 nt, Homo sapiens
cacauuucuuugcauuccag

SEQ ID NO: 1450842 - RNA, 15 nt, Homo sapiens
caccaaagacaguug

SEQ ID NO: 1450843 - RNA, 22 nt, Homo sapiens
caccaacauugcuugugccaca

SEQ ID NO: 1450844 - RNA, 14 nt, Homo sapiens
caauaacacugucu

SEQ ID NO: 1450845 - RNA, 15 nt, Homo sapiens
caauaacacugucuc

SEQ ID NO: 1450846 - RNA, 15 nt, Homo sapiens
caauaacuucugacc

SEQ ID NO: 1450847 - RNA, 19 nt, Homo sapiens
caauaauauuguuguauaa

SEQ ID NO: 1450848 - RNA, 23 nt, Homo sapiens
caauaaugugacgaaaguggaaa

SEQ ID NO: 1450849 - RNA, 14 nt, Homo sapiens
caauacaaauagau

SEQ ID NO: 1450850 - RNA, 19 nt, Homo sapiens
caauacgccuuuaaagguu

SEQ ID NO: 1450851 - RNA, 15 nt, Homo sapiens
caauagagacuguag

SEQ ID NO: 1450852 - RNA, 15 nt, Homo sapiens
caauagcauaucaca

SEQ ID NO: 1450853 - RNA, 19 nt, Homo sapiens
caauagcauaucacagaga

SEQ ID NO: 1450854 - RNA, 15 nt, Homo sapiens
caauaucauaucauc

SEQ ID NO: 1450855 - RNA, 18 nt, Homo sapiens
caauauuugguauuucaa

SEQ ID NO: 1450856 - RNA, 21 nt, Homo sapiens
caauauuuuuauaucaugcaa

SEQ ID NO: 1450857 - RNA, 22 nt, Homo sapiens
caauauuuuuauaucaugcaaa

SEQ ID NO: 1450858 - RNA, 19 nt, Homo sapiens
caaucaguauguauucuuu

SEQ ID NO: 1450859 - RNA, 17 nt, Homo sapiens
caaucauaauaccugcu

SEQ ID NO: 1450860 - RNA, 22 nt, Homo sapiens
caaucaugaaauaugcaucuca

SEQ ID NO: 1450861 - RNA, 19 nt, Homo sapiens
caaucccaacuacguaaua

SEQ ID NO: 1450862 - RNA, 18 nt, Homo sapiens
caauccuugccacagugu

SEQ ID NO: 1450863 - RNA, 20 nt, Homo sapiens
caaucuaaagauacaguguc

SEQ ID NO: 1450864 - RNA, 18 nt, Homo sapiens
caaucugcaguuuaacaa

SEQ ID NO: 1450865 - RNA, 22 nt, Homo sapiens
caaucuggcccuuacacacuca

SEQ ID NO: 1450866 - RNA, 16 nt, Homo sapiens
caaucuucuacuuuaa

SEQ ID NO: 1450867 - RNA, 19 nt, Homo sapiens
caaugaaaaauguaauuua

SEQ ID NO: 1450868 - RNA, 13 nt, Homo sapiens
caaugaccaaaca

SEQ ID NO: 1450869 - RNA, 17 nt, Homo sapiens
caaugaguaacaggaaa

SEQ ID NO: 1450870 - RNA, 14 nt, Homo sapiens
caaugauauugaca

SEQ ID NO: 1450871 - RNA, 11 nt, Homo sapiens
caaugccagua

SEQ ID NO: 1450872 - RNA, 16 nt, Homo sapiens
gacaguggaugcugcu

SEQ ID NO: 1450873 - RNA, 18 nt, Homo sapiens
gacauacauauuaucuca

SEQ ID NO: 1450874 - RNA, 19 nt, Homo sapiens
gacauacauauuaucucau

SEQ ID NO: 1450875 - RNA, 23 nt, Homo sapiens
gacauacauucccucuaauuuga

SEQ ID NO: 1450876 - RNA, 21 nt, Homo sapiens
gacauacugcauguaagccaa

SEQ ID NO: 1450877 - RNA, 20 nt, Homo sapiens
gacauagauauuuucacaau

SEQ ID NO: 1450878 - RNA, 13 nt, Homo sapiens
gacauaugcauuu

SEQ ID NO: 1450879 - RNA, 16 nt, Homo sapiens
gacauauuaugccuga

SEQ ID NO: 1450880 - RNA, 14 nt, Homo sapiens
gacaucacagcagc

SEQ ID NO: 1450881 - RNA, 12 nt, Homo sapiens
gacaucaucaag

SEQ ID NO: 1450882 - RNA, 19 nt, Homo sapiens
gacaucggccuccaugacc

SEQ ID NO: 1450883 - RNA, 14 nt, Homo sapiens
gacaucucaggggc

SEQ ID NO: 1450884 - RNA, 18 nt, Homo sapiens
gacaucucaggggccaga

SEQ ID NO: 1450885 - RNA, 15 nt, Homo sapiens
gacaugugaaaccuu

SEQ ID NO: 1450886 - RNA, 13 nt, Homo sapiens
gacaugugacauu

SEQ ID NO: 1450887 - RNA, 14 nt, Homo sapiens
gacaugugacauuu

SEQ ID NO: 1450888 - RNA, 21 nt, Homo sapiens
gacauuaacaguuuuccauga

SEQ ID NO: 1450889 - RNA, 16 nt, Homo sapiens
gacauucaaggcauuu

SEQ ID NO: 1450890 - RNA, 22 nt, Homo sapiens
gacauucaaggcauuucuauca

SEQ ID NO: 1450891 - RNA, 20 nt, Homo sapiens
gacauuuuuugcuauaauca

SEQ ID NO: 1450892 - RNA, 14 nt, Homo sapiens
gaccaagcacaaaa

SEQ ID NO: 1450893 - RNA, 20 nt, Homo sapiens
gaccaauugugcugccauuu

SEQ ID NO: 1450894 - RNA, 19 nt, Homo sapiens
gaccacagcacagccaaca

SEQ ID NO: 1450895 - RNA, 23 nt, Homo sapiens
gaccacuuccaggggaaccugcc

SEQ ID NO: 1450896 - RNA, 14 nt, Homo sapiens
gaccagagcaguuu

SEQ ID NO: 1450897 - RNA, 18 nt, Homo sapiens
gaccagagcaguuucauc

SEQ ID NO: 1450898 - RNA, 14 nt, Homo sapiens
gaccagcccggcca

SEQ ID NO: 1450899 - RNA, 23 nt, Homo sapiens
gaccauggagggggcuugcacuc

SEQ ID NO: 1450900 - RNA, 13 nt, Homo sapiens
gacccaccuucaa

SEQ ID NO: 1450901 - RNA, 20 nt, Homo sapiens
gacccaguggacucuuccac

SEQ ID NO: 1450902 - RNA, 17 nt, Homo sapiens
gaccccacugccaagug

SEQ ID NO: 1450903 - RNA, 20 nt, Homo sapiens
gaccccagcugccaaggaaa

SEQ ID NO: 1450904 - RNA, 16 nt, Homo sapiens
gacccccccccaacuc

SEQ ID NO: 1450905 - RNA, 19 nt, Homo sapiens
gacccccgcaaguuugcac

SEQ ID NO: 1450906 - RNA, 15 nt, Homo sapiens
gaccccugaccucac

SEQ ID NO: 1450907 - RNA, 23 nt, Homo sapiens
gaccccuucggcagcuacucaga

SEQ ID NO: 1450908 - RNA, 14 nt, Homo sapiens
gacccgcucuccau

SEQ ID NO: 1450909 - RNA, 15 nt, Homo sapiens
gacccuagcucuuuc

SEQ ID NO: 1450910 - RNA, 21 nt, Homo sapiens
gacccucauggcccccagggg

SEQ ID NO: 1450911 - RNA, 18 nt, Homo sapiens
gacccuccccacccugaa

SEQ ID NO: 1450912 - RNA, 20 nt, Homo sapiens
gacccucugacccuagcucu

SEQ ID NO: 1450913 - RNA, 17 nt, Homo sapiens
gacccugucuucugggc

SEQ ID NO: 1450914 - RNA, 16 nt, Homo sapiens
gacccuuuucucagga

SEQ ID NO: 1450915 - RNA, 18 nt, Homo sapiens
gaccgcccccuccucuag

SEQ ID NO: 1450916 - RNA, 17 nt, Homo sapiens
gaccggugcaugaugcu

SEQ ID NO: 1450917 - RNA, 14 nt, Homo sapiens
gaccguacucucac

SEQ ID NO: 1450918 - RNA, 15 nt, Homo sapiens
gaccgugaccaucuu

SEQ ID NO: 1450919 - RNA, 23 nt, Homo sapiens
gaccuaacauucgaucucauuca

SEQ ID NO: 1450920 - RNA, 13 nt, Homo sapiens
gaccuaaccacuu

SEQ ID NO: 1450921 - RNA, 22 nt, Homo sapiens
gaccucaggugauccacccacc

SEQ ID NO: 1450922 - RNA, 14 nt, Homo sapiens
gaccucauguuguu

SEQ ID NO: 1450923 - RNA, 19 nt, Homo sapiens
gaccucucauaaauuuacu

SEQ ID NO: 1450924 - RNA, 15 nt, Homo sapiens
gaccugauccuggag

SEQ ID NO: 1450925 - RNA, 16 nt, Homo sapiens
gaccugccuccugccu

SEQ ID NO: 1450926 - RNA, 17 nt, Homo sapiens
gaccuggagacugacaa

SEQ ID NO: 1450927 - RNA, 12 nt, Homo sapiens
gaccuggcacug

SEQ ID NO: 1450928 - RNA, 16 nt, Homo sapiens
gaccuggcagcucugg

SEQ ID NO: 1450929 - RNA, 16 nt, Homo sapiens
gaccuggcuggugaca

SEQ ID NO: 1450930 - RNA, 16 nt, Homo sapiens
gaccuggucaggguga

SEQ ID NO: 1450931 - RNA, 17 nt, Homo sapiens
gaccuuaggccuuccuc

SEQ ID NO: 1450932 - RNA, 19 nt, Homo sapiens
gaccuuaucugugcgugaa

SEQ ID NO: 1450933 - RNA, 19 nt, Homo sapiens
gaccuugcugauggugaca

SEQ ID NO: 1450934 - RNA, 15 nt, Homo sapiens
gaccuuggcagccca

SEQ ID NO: 1450935 - RNA, 23 nt, Homo sapiens
gaccuuuuuuuuuuuaauggcaa

SEQ ID NO: 1450936 - RNA, 14 nt, Homo sapiens
gacgaaaguggaaa

SEQ ID NO: 1450937 - RNA, 16 nt, Homo sapiens
gacggucccacacugg

SEQ ID NO: 1450938 - RNA, 16 nt, Homo sapiens
gacguccuccguccau

SEQ ID NO: 1450939 - RNA, 13 nt, Homo sapiens
gacguugcagggu

SEQ ID NO: 1450940 - RNA, 14 nt, Homo sapiens
gacuaauuucaaaa

SEQ ID NO: 1450941 - RNA, 12 nt, Homo sapiens
gacuacaaccaa

SEQ ID NO: 1450942 - RNA, 15 nt, Homo sapiens
gacuacuauuuucuu

SEQ ID NO: 1450943 - RNA, 17 nt, Homo sapiens
gacuacuccaagggaau

SEQ ID NO: 1450944 - RNA, 22 nt, Homo sapiens
gacuacuuagcauccuaagaaa

SEQ ID NO: 1450945 - RNA, 18 nt, Homo sapiens
gacuagaggcuugcauaa

SEQ ID NO: 1450946 - RNA, 21 nt, Homo sapiens
gacuagccaggaaguacuucc

SEQ ID NO: 1450947 - RNA, 18 nt, Homo sapiens
gacuagugacacauugua

SEQ ID NO: 1450948 - RNA, 17 nt, Homo sapiens
gacuauggugcugccuu

SEQ ID NO: 1450949 - RNA, 15 nt, Homo sapiens
gacuauguaaacuac

SEQ ID NO: 1450950 - RNA, 18 nt, Homo sapiens
gacucaagacacugagau

SEQ ID NO: 1450951 - RNA, 20 nt, Homo sapiens
gacucaccuguucucacucc

SEQ ID NO: 1450952 - RNA, 12 nt, Homo sapiens
gacuccaucucu

SEQ ID NO: 1450953 - RNA, 20 nt, Homo sapiens
gacucuaagcucagugcucu

SEQ ID NO: 1450954 - RNA, 17 nt, Homo sapiens
gacucuuuagagcagcu

SEQ ID NO: 1450955 - RNA, 19 nt, Homo sapiens
gacucuuuugagugguaau

SEQ ID NO: 1450956 - RNA, 16 nt, Homo sapiens
gacugaagacucagcc

SEQ ID NO: 1450957 - RNA, 14 nt, Homo sapiens
gacugaagcaaaga

SEQ ID NO: 1450958 - RNA, 14 nt, Homo sapiens
gacugacaaccuca

SEQ ID NO: 1450959 - RNA, 15 nt, Homo sapiens
gacugacaaccucau

SEQ ID NO: 1450960 - RNA, 20 nt, Homo sapiens
gacugaccccagugguaucc

SEQ ID NO: 1450961 - RNA, 19 nt, Homo sapiens
gacugcaagcugcuugccc

SEQ ID NO: 1450962 - RNA, 15 nt, Homo sapiens
gacugcgaacacuga

SEQ ID NO: 1450963 - RNA, 22 nt, Homo sapiens
gacugcuggcaugcagugcccu

SEQ ID NO: 1450964 - RNA, 19 nt, Homo sapiens
gacugcuucaucugcugua

SEQ ID NO: 1450965 - RNA, 17 nt, Homo sapiens
gacuggagcucaucugc

SEQ ID NO: 1450966 - RNA, 13 nt, Homo sapiens
gacuguagaagaa

SEQ ID NO: 1450967 - RNA, 21 nt, Homo sapiens
gacuguccucuccccuccagc

SEQ ID NO: 1450968 - RNA, 16 nt, Homo sapiens
gacugucucacuuaau

SEQ ID NO: 1450969 - RNA, 14 nt, Homo sapiens
gacugucuuucaga

SEQ ID NO: 1450970 - RNA, 13 nt, Homo sapiens
gacugugaccacc

SEQ ID NO: 1450971 - RNA, 16 nt, Homo sapiens
gacuguugccacuuaa

SEQ ID NO: 1450972 - RNA, 17 nt, Homo sapiens
gacuguugccacuuaac

SEQ ID NO: 1450973 - RNA, 14 nt, Homo sapiens
gacuguugcucaaa

SEQ ID NO: 1450974 - RNA, 22 nt, Homo sapiens
gagcagugccaaucgggcagaa

SEQ ID NO: 1450975 - RNA, 20 nt, Homo sapiens
gagcaguuugccaccccugu

SEQ ID NO: 1450976 - RNA, 22 nt, Homo sapiens
gagcauuuccaacaccacagac

SEQ ID NO: 1450977 - RNA, 15 nt, Homo sapiens
gagccaccgugccug

SEQ ID NO: 1450978 - RNA, 12 nt, Homo sapiens
gagccagacaga

SEQ ID NO: 1450979 - RNA, 24 nt, Homo sapiens
gagcccagggcaucuugcuggcua

SEQ ID NO: 1450980 - RNA, 16 nt, Homo sapiens
gagccccagcuacccu

SEQ ID NO: 1450981 - RNA, 17 nt, Homo sapiens
gagcccccaccacaaac

SEQ ID NO: 1450982 - RNA, 18 nt, Homo sapiens
gagcccugguggaucuug

SEQ ID NO: 1450983 - RNA, 13 nt, Homo sapiens
gagccuccagucc

SEQ ID NO: 1450984 - RNA, 16 nt, Homo sapiens
gagccuccugugccug

SEQ ID NO: 1450985 - RNA, 16 nt, Homo sapiens
gagccuuccacaguga

SEQ ID NO: 1450986 - RNA, 18 nt, Homo sapiens
gagcgagacuccgucuca

SEQ ID NO: 1450987 - RNA, 16 nt, Homo sapiens
gagcgucacggccaag

SEQ ID NO: 1450988 - RNA, 14 nt, Homo sapiens
gagcgucaggguug

SEQ ID NO: 1450989 - RNA, 13 nt, Homo sapiens
gagcuacugauga

SEQ ID NO: 1450990 - RNA, 23 nt, Homo sapiens
gagcuaugugacucggauggucu

SEQ ID NO: 1450991 - RNA, 21 nt, Homo sapiens
gagcucacacuccaguggcag

SEQ ID NO: 1450992 - RNA, 21 nt, Homo sapiens
gagcucaggucccaggccagc

SEQ ID NO: 1450993 - RNA, 13 nt, Homo sapiens
gagcucagugugu

SEQ ID NO: 1450994 - RNA, 21 nt, Homo sapiens
gagcuccccagaucucccacu

SEQ ID NO: 1450995 - RNA, 16 nt, Homo sapiens
gagcugaagaccuaaa

SEQ ID NO: 1450996 - RNA, 14 nt, Homo sapiens
gagcugcagggugg

SEQ ID NO: 1450997 - RNA, 15 nt, Homo sapiens
gagcugcagguuccu

SEQ ID NO: 1450998 - RNA, 12 nt, Homo sapiens
gagcugccagug

SEQ ID NO: 1450999 - RNA, 17 nt, Homo sapiens
gagcuggcaaagguggc

SEQ ID NO: 1451000 - RNA, 17 nt, Homo sapiens
gagcuggggggcgugga

SEQ ID NO: 1451001 - RNA, 18 nt, Homo sapiens
gagcugucccaccugcac

SEQ ID NO: 1451002 - RNA, 19 nt, Homo sapiens
gagcugucccaccugcaca

SEQ ID NO: 1451003 - RNA, 21 nt, Homo sapiens
gagcuuccccaagcacggugu

SEQ ID NO: 1451004 - RNA, 18 nt, Homo sapiens
gagcuuccuucugugaaa

SEQ ID NO: 1451005 - RNA, 19 nt, Homo sapiens
gagcuuguggaguugauga

SEQ ID NO: 1451006 - RNA, 20 nt, Homo sapiens
gagcuuuuaaaaauguccug

SEQ ID NO: 1451007 - RNA, 14 nt, Homo sapiens
gaggaacacugcac

SEQ ID NO: 1451008 - RNA, 17 nt, Homo sapiens
gaggaacacugcacucu

SEQ ID NO: 1451009 - RNA, 17 nt, Homo sapiens
gaggaacuguccagaga

SEQ ID NO: 1451010 - RNA, 17 nt, Homo sapiens
gaggaauucagcucagc

SEQ ID NO: 1451011 - RNA, 14 nt, Homo sapiens
gaggagguucacug

SEQ ID NO: 1451012 - RNA, 13 nt, Homo sapiens
gaggaguaacaau

SEQ ID NO: 1451013 - RNA, 19 nt, Homo sapiens
gaggauaagccacugggca

SEQ ID NO: 1451014 - RNA, 18 nt, Homo sapiens
gaggaugggucagagcua

SEQ ID NO: 1451015 - RNA, 15 nt, Homo sapiens
gaggcaagaaaagga

SEQ ID NO: 1451016 - RNA, 20 nt, Homo sapiens
gaggcaagaaaaggacaaau

SEQ ID NO: 1451017 - RNA, 19 nt, Homo sapiens
gaggcaagugugggccacu

SEQ ID NO: 1451018 - RNA, 21 nt, Homo sapiens
gaggcaagugugggggguccu

SEQ ID NO: 1451019 - RNA, 21 nt, Homo sapiens
gaggcaggagaauggugugaa

SEQ ID NO: 1451020 - RNA, 20 nt, Homo sapiens
gaggcaggaggauugcuuga

SEQ ID NO: 1451021 - RNA, 14 nt, Homo sapiens
gaggccagacccac

SEQ ID NO: 1451022 - RNA, 18 nt, Homo sapiens
gaggcccuccugugcugg

SEQ ID NO: 1451023 - RNA, 18 nt, Homo sapiens
gaggccgaggcgggugga

SEQ ID NO: 1451024 - RNA, 20 nt, Homo sapiens
gaggccugcauguccggcug

SEQ ID NO: 1451025 - RNA, 20 nt, Homo sapiens
gaggccugcccucagggauc

SEQ ID NO: 1451026 - RNA, 17 nt, Homo sapiens
gaggccuggacuuuccu

SEQ ID NO: 1451027 - RNA, 22 nt, Homo sapiens
gaggccuggacuuuccugcaac

SEQ ID NO: 1451028 - RNA, 17 nt, Homo sapiens
gaggcgaugccacgcuu

SEQ ID NO: 1451029 - RNA, 16 nt, Homo sapiens
gaggcgcacaguguga

SEQ ID NO: 1451030 - RNA, 19 nt, Homo sapiens
gaggcggagaguacaguga

SEQ ID NO: 1451031 - RNA, 22 nt, Homo sapiens
gaggcuauggaggguccuccuc

SEQ ID NO: 1451032 - RNA, 12 nt, Homo sapiens
gaggcugagaca

SEQ ID NO: 1451033 - RNA, 16 nt, Homo sapiens
gaggcugccccucuca

SEQ ID NO: 1451034 - RNA, 18 nt, Homo sapiens
gaggcugccccucucacc

SEQ ID NO: 1451035 - RNA, 20 nt, Homo sapiens
gaggcugccccucucaccaa

SEQ ID NO: 1451036 - RNA, 15 nt, Homo sapiens
gaggcugugucagaa

SEQ ID NO: 1451037 - RNA, 20 nt, Homo sapiens
gaggcuuugggagcaaaaua

SEQ ID NO: 1451038 - RNA, 15 nt, Homo sapiens
gagggagagggaggu

SEQ ID NO: 1451039 - RNA, 16 nt, Homo sapiens
gagggcccagcccaga

SEQ ID NO: 1451040 - RNA, 17 nt, Homo sapiens
gagggccccgcccagug

SEQ ID NO: 1451041 - RNA, 22 nt, Homo sapiens
gagggcccuccgaccacuucca

SEQ ID NO: 1451042 - RNA, 20 nt, Homo sapiens
gagggcggggagaaucucag

SEQ ID NO: 1451043 - RNA, 20 nt, Homo sapiens
gagggcuggcuggccucacc

SEQ ID NO: 1451044 - RNA, 22 nt, Homo sapiens
gagggcuuccucuagaagccaa

SEQ ID NO: 1451045 - RNA, 23 nt, Homo sapiens
gagggcuuccucuagaagccaag

SEQ ID NO: 1451046 - RNA, 18 nt, Homo sapiens
gagggggcuugaagccaa

SEQ ID NO: 1451047 - RNA, 12 nt, Homo sapiens
gagggucagggu

SEQ ID NO: 1451048 - RNA, 21 nt, Homo sapiens
gaggguuccucuuaggucaga

SEQ ID NO: 1451049 - RNA, 15 nt, Homo sapiens
gaggguuuugcucuu

SEQ ID NO: 1451050 - RNA, 21 nt, Homo sapiens
gagguaaaagugugagcagug

SEQ ID NO: 1451051 - RNA, 13 nt, Homo sapiens
gagguacucuccu

SEQ ID NO: 1451052 - RNA, 17 nt, Homo sapiens
gagguagccgaccugag

SEQ ID NO: 1451053 - RNA, 23 nt, Homo sapiens
gaggucagggagugcuggcucac

SEQ ID NO: 1451054 - RNA, 15 nt, Homo sapiens
gaggucauacaugca

SEQ ID NO: 1451055 - RNA, 18 nt, Homo sapiens
gaggucuuuugacaugug

SEQ ID NO: 1451056 - RNA, 15 nt, Homo sapiens
gaggugggauccucc

SEQ ID NO: 1451057 - RNA, 20 nt, Homo sapiens
gaggugggauccucccucau

SEQ ID NO: 1451058 - RNA, 21 nt, Homo sapiens
gaggugggcaugccacccuca

SEQ ID NO: 1451059 - RNA, 14 nt, Homo sapiens
gagguuaggaguag

SEQ ID NO: 1451060 - RNA, 15 nt, Homo sapiens
gagguuauaggucac

SEQ ID NO: 1451061 - RNA, 17 nt, Homo sapiens
gagguucugagaccagu

SEQ ID NO: 1451062 - RNA, 19 nt, Homo sapiens
gagguuuggggucugccac

SEQ ID NO: 1451063 - RNA, 16 nt, Homo sapiens
gaguaaauacagguag

SEQ ID NO: 1451064 - RNA, 19 nt, Homo sapiens
gaguaacauuugcuguuuu

SEQ ID NO: 1451065 - RNA, 15 nt, Homo sapiens
gaguacaaacacagg

SEQ ID NO: 1451066 - RNA, 13 nt, Homo sapiens
gaguaccuggacc

SEQ ID NO: 1451067 - RNA, 14 nt, Homo sapiens
gaguagaauugcau

SEQ ID NO: 1451068 - RNA, 19 nt, Homo sapiens
gagucacugccaagucaua

SEQ ID NO: 1451069 - RNA, 22 nt, Homo sapiens
gagucagaucuuucuccuugaa

SEQ ID NO: 1451070 - RNA, 20 nt, Homo sapiens
gagucaggccuuaauuuuca

SEQ ID NO: 1451071 - RNA, 21 nt, Homo sapiens
gagucauggcuaauuuaacac

SEQ ID NO: 1451072 - RNA, 16 nt, Homo sapiens
gaguccacugcuccau

SEQ ID NO: 1451073 - RNA, 15 nt, Homo sapiens
gaguccucacuccca

SEQ ID NO: 1451074 - RNA, 20 nt, Homo sapiens
gagucgcaucucagugcagg

SEQ ID NO: 1451075 - RNA, 22 nt, Homo sapiens
gacuguugcucaaaucuauuca

SEQ ID NO: 1451076 - RNA, 13 nt, Homo sapiens
gacuuacugggug

SEQ ID NO: 1451077 - RNA, 13 nt, Homo sapiens
gacuuauugccaa

SEQ ID NO: 1451078 - RNA, 18 nt, Homo sapiens
gacuuauuuaaacucugu

SEQ ID NO: 1451079 - RNA, 20 nt, Homo sapiens
gacuucauugucccucuuca

SEQ ID NO: 1451080 - RNA, 22 nt, Homo sapiens
gacuuccccucaacaugcugcc

SEQ ID NO: 1451081 - RNA, 16 nt, Homo sapiens
gacuuccuacuugguc

SEQ ID NO: 1451082 - RNA, 19 nt, Homo sapiens
gacuucucuuuugcacauc

SEQ ID NO: 1451083 - RNA, 17 nt, Homo sapiens
gacuugauuagugccuu

SEQ ID NO: 1451084 - RNA, 23 nt, Homo sapiens
gacuuggacaggagucagugucu

SEQ ID NO: 1451085 - RNA, 18 nt, Homo sapiens
gacuuguuugucuuccau

SEQ ID NO: 1451086 - RNA, 15 nt, Homo sapiens
gacuuuagaaauaaa

SEQ ID NO: 1451087 - RNA, 18 nt, Homo sapiens
gacuuucaguaaacauaa

SEQ ID NO: 1451088 - RNA, 18 nt, Homo sapiens
gacuuucaugcagccuaa

SEQ ID NO: 1451089 - RNA, 13 nt, Homo sapiens
gacuuugcugauu

SEQ ID NO: 1451090 - RNA, 18 nt, Homo sapiens
gacuuuuaaucagugaag

SEQ ID NO: 1451091 - RNA, 18 nt, Homo sapiens
gacuuuuucaaagauuua

SEQ ID NO: 1451092 - RNA, 19 nt, Homo sapiens
gagaaaaaagaaguguccg

SEQ ID NO: 1451093 - RNA, 21 nt, Homo sapiens
gagaaaaaugcuccccacagc

SEQ ID NO: 1451094 - RNA, 12 nt, Homo sapiens
gagaaaacaugc

SEQ ID NO: 1451095 - RNA, 22 nt, Homo sapiens
gagaaaauaaagaccuugcuua

SEQ ID NO: 1451096 - RNA, 20 nt, Homo sapiens
gagaaaccuuauuguaccuc

SEQ ID NO: 1451097 - RNA, 23 nt, Homo sapiens
gagaaauacuuucaggcacuaag

SEQ ID NO: 1451098 - RNA, 13 nt, Homo sapiens
gagaaauggccaa

SEQ ID NO: 1451099 - RNA, 14 nt, Homo sapiens
gagaaaugugucau

SEQ ID NO: 1451100 - RNA, 21 nt, Homo sapiens
gagaacuuuuugcaugcuuau

SEQ ID NO: 1451101 - RNA, 20 nt, Homo sapiens
gagaagcggauuuccaggga

SEQ ID NO: 1451102 - RNA, 17 nt, Homo sapiens
gagaagcucacccaaua

SEQ ID NO: 1451103 - RNA, 16 nt, Homo sapiens
gagaaggugcagguga

SEQ ID NO: 1451104 - RNA, 13 nt, Homo sapiens
gagaaucacugga

SEQ ID NO: 1451105 - RNA, 19 nt, Homo sapiens
gagaaugugagaagccagc

SEQ ID NO: 1451106 - RNA, 15 nt, Homo sapiens
gagacaccaaccgac

SEQ ID NO: 1451107 - RNA, 16 nt, Homo sapiens
gagacagaccacuugc

SEQ ID NO: 1451108 - RNA, 19 nt, Homo sapiens
gagacagcugauacuucau

SEQ ID NO: 1451109 - RNA, 22 nt, Homo sapiens
gagacagcugauacuucauuua

SEQ ID NO: 1451110 - RNA, 19 nt, Homo sapiens
gagacagugacuggugcca

SEQ ID NO: 1451111 - RNA, 14 nt, Homo sapiens
gagacagugaggcu

SEQ ID NO: 1451112 - RNA, 14 nt, Homo sapiens
gagacauacuugaa

SEQ ID NO: 1451113 - RNA, 22 nt, Homo sapiens
gagacauacuugaagggccaga

SEQ ID NO: 1451114 - RNA, 15 nt, Homo sapiens
gagacaugugacauu

SEQ ID NO: 1451115 - RNA, 12 nt, Homo sapiens
gagaccagugua

SEQ ID NO: 1451116 - RNA, 15 nt, Homo sapiens
gagacccaacagcag

SEQ ID NO: 1451117 - RNA, 13 nt, Homo sapiens
gagacccugccac

SEQ ID NO: 1451118 - RNA, 17 nt, Homo sapiens
gagaccuuuucaacuug

SEQ ID NO: 1451119 - RNA, 14 nt, Homo sapiens
gagacgacaggcga

SEQ ID NO: 1451120 - RNA, 15 nt, Homo sapiens
gagacgcacacagcu

SEQ ID NO: 1451121 - RNA, 14 nt, Homo sapiens
gagacucacaggaa

SEQ ID NO: 1451122 - RNA, 16 nt, Homo sapiens
gagacuccgucacaac

SEQ ID NO: 1451123 - RNA, 16 nt, Homo sapiens
gagacucuagggucca

SEQ ID NO: 1451124 - RNA, 13 nt, Homo sapiens
gagacugggucuc

SEQ ID NO: 1451125 - RNA, 16 nt, Homo sapiens
gagacugucccugaaa

SEQ ID NO: 1451126 - RNA, 14 nt, Homo sapiens
gagacuuacugggu

SEQ ID NO: 1451127 - RNA, 17 nt, Homo sapiens
gagacuuuacauggaug

SEQ ID NO: 1451128 - RNA, 14 nt, Homo sapiens
gagagagaugacaa

SEQ ID NO: 1451129 - RNA, 15 nt, Homo sapiens
gagagagcuuggaau

SEQ ID NO: 1451130 - RNA, 12 nt, Homo sapiens
gagagauguuuu

SEQ ID NO: 1451131 - RNA, 22 nt, Homo sapiens
gagagcagcuuuaaacucaggg

SEQ ID NO: 1451132 - RNA, 18 nt, Homo sapiens
gagagcuuaaauugucau

SEQ ID NO: 1451133 - RNA, 22 nt, Homo sapiens
gagaggaaagaccuacauuccc

SEQ ID NO: 1451134 - RNA, 13 nt, Homo sapiens
gagaggagccaga

SEQ ID NO: 1451135 - RNA, 15 nt, Homo sapiens
gagaggaugugcaag

SEQ ID NO: 1451136 - RNA, 18 nt, Homo sapiens
gagaggcacucagugagc

SEQ ID NO: 1451137 - RNA, 13 nt, Homo sapiens
gagaggcaggcau

SEQ ID NO: 1451138 - RNA, 18 nt, Homo sapiens
gagagggaagagugcauu

SEQ ID NO: 1451139 - RNA, 23 nt, Homo sapiens
gagagggagucagucuucacuug

SEQ ID NO: 1451140 - RNA, 13 nt, Homo sapiens
gagaggggggcca

SEQ ID NO: 1451141 - RNA, 16 nt, Homo sapiens
gagaguaaaccuugaa

SEQ ID NO: 1451142 - RNA, 20 nt, Homo sapiens
gagaguacagugagccaaga

SEQ ID NO: 1451143 - RNA, 22 nt, Homo sapiens
gagagucgcaucucagugcagg

SEQ ID NO: 1451144 - RNA, 14 nt, Homo sapiens
gagagugaaaccau

SEQ ID NO: 1451145 - RNA, 17 nt, Homo sapiens
gagauagucucauucug

SEQ ID NO: 1451146 - RNA, 13 nt, Homo sapiens
gagauauuuacau

SEQ ID NO: 1451147 - RNA, 20 nt, Homo sapiens
gagaucacgucacugcacuc

SEQ ID NO: 1451148 - RNA, 21 nt, Homo sapiens
gagaucaugccacuacacucc

SEQ ID NO: 1451149 - RNA, 14 nt, Homo sapiens
gagaucaugucuca

SEQ ID NO: 1451150 - RNA, 23 nt, Homo sapiens
gagauccuuuagugcacccagug

SEQ ID NO: 1451151 - RNA, 20 nt, Homo sapiens
gagaucgcaucauugcacuc

SEQ ID NO: 1451152 - RNA, 20 nt, Homo sapiens
gagaucgcgccacugcacuc

SEQ ID NO: 1451153 - RNA, 14 nt, Homo sapiens
gagaugacagggaa

SEQ ID NO: 1451154 - RNA, 15 nt, Homo sapiens
gagaugaccagggau

SEQ ID NO: 1451155 - RNA, 21 nt, Homo sapiens
gagaugcuucucuccuugccc

SEQ ID NO: 1451156 - RNA, 15 nt, Homo sapiens
gagaugggaaggcac

SEQ ID NO: 1451157 - RNA, 19 nt, Homo sapiens
gagauggucacaugaccca

SEQ ID NO: 1451158 - RNA, 12 nt, Homo sapiens
gagaugucuucu

SEQ ID NO: 1451159 - RNA, 18 nt, Homo sapiens
gagauuacuuugcugccu

SEQ ID NO: 1451160 - RNA, 21 nt, Homo sapiens
gagauucaagggacccaugag

SEQ ID NO: 1451161 - RNA, 19 nt, Homo sapiens
gagauuccagucuacuuga

SEQ ID NO: 1451162 - RNA, 20 nt, Homo sapiens
gagauugugccacuucacuc

SEQ ID NO: 1451163 - RNA, 17 nt, Homo sapiens
gagcaaaaggcagcuca

SEQ ID NO: 1451164 - RNA, 12 nt, Homo sapiens
gagcaaccucuc

SEQ ID NO: 1451165 - RNA, 14 nt, Homo sapiens
gagcacaagccaca

SEQ ID NO: 1451166 - RNA, 16 nt, Homo sapiens
gagcacccauuccaaa

SEQ ID NO: 1451167 - RNA, 20 nt, Homo sapiens
gagcaccuuugcacaggaug

SEQ ID NO: 1451168 - RNA, 20 nt, Homo sapiens
gagcacugcguuuuccuagc

SEQ ID NO: 1451169 - RNA, 17 nt, Homo sapiens
gagcagaaagcugugaa

SEQ ID NO: 1451170 - RNA, 17 nt, Homo sapiens
gagcagaagaucaagga

SEQ ID NO: 1451171 - RNA, 23 nt, Homo sapiens
gagcagacaccagcagcccuguc

SEQ ID NO: 1451172 - RNA, 17 nt, Homo sapiens
gagcagaggucucccaa

SEQ ID NO: 1451173 - RNA, 15 nt, Homo sapiens
gagcagccacaacca

SEQ ID NO: 1451174 - RNA, 18 nt, Homo sapiens
gagcagccucuggacagc

SEQ ID NO: 1451175 - RNA, 22 nt, Homo sapiens
gagcagcuuuaaacucagggac

SEQ ID NO: 1451176 - RNA, 14 nt, Homo sapiens
gagcaggaggccaa

SEQ ID NO: 1451177 - RNA, 17 nt, Homo sapiens
uaauauaagcugccaua

SEQ ID NO: 1451178 - RNA, 13 nt, Homo sapiens
uaauauaauaaua

SEQ ID NO: 1451179 - RNA, 22 nt, Homo sapiens
uaauauaccagcuuguaugcaa

SEQ ID NO: 1451180 - RNA, 12 nt, Homo sapiens
uaauaucuguga

SEQ ID NO: 1451181 - RNA, 13 nt, Homo sapiens
uaauaugcuuuac

SEQ ID NO: 1451182 - RNA, 18 nt, Homo sapiens
uaauauuguauugcugcu

SEQ ID NO: 1451183 - RNA, 19 nt, Homo sapiens
uaaucaaggccagugcuaa

SEQ ID NO: 1451184 - RNA, 20 nt, Homo sapiens
uaaucacuauuguuccagca

SEQ ID NO: 1451185 - RNA, 21 nt, Homo sapiens
uaaucagcaagaauuugaucg

SEQ ID NO: 1451186 - RNA, 15 nt, Homo sapiens
uaaucccagcacuuu

SEQ ID NO: 1451187 - RNA, 19 nt, Homo sapiens
uaaucccaguacucuggga

SEQ ID NO: 1451188 - RNA, 21 nt, Homo sapiens
uaaucuagguguggcugugaa

SEQ ID NO: 1451189 - RNA, 15 nt, Homo sapiens
uaaucucagcacuuu

SEQ ID NO: 1451190 - RNA, 21 nt, Homo sapiens
uaaucuguaagcauaagcuua

SEQ ID NO: 1451191 - RNA, 20 nt, Homo sapiens
uaaugaaaaugaauaucuau

SEQ ID NO: 1451192 - RNA, 23 nt, Homo sapiens
uaaugaaaaugaauaucuauuaa

SEQ ID NO: 1451193 - RNA, 15 nt, Homo sapiens
uaaugaaaaugucag

SEQ ID NO: 1451194 - RNA, 13 nt, Homo sapiens
uaaugaacaugug

SEQ ID NO: 1451195 - RNA, 23 nt, Homo sapiens
uaaugaagacaaugauauugaca

SEQ ID NO: 1451196 - RNA, 13 nt, Homo sapiens
uaaugacauuccc

SEQ ID NO: 1451197 - RNA, 17 nt, Homo sapiens
uaaugauuuuacuuaac

SEQ ID NO: 1451198 - RNA, 12 nt, Homo sapiens
uaaugcauuugu

SEQ ID NO: 1451199 - RNA, 15 nt, Homo sapiens
uaauggcaucaauau

SEQ ID NO: 1451200 - RNA, 18 nt, Homo sapiens
uaauggggacacagauca

SEQ ID NO: 1451201 - RNA, 21 nt, Homo sapiens
uaaugguguagaacacuaauu

SEQ ID NO: 1451202 - RNA, 14 nt, Homo sapiens
uaauguacaucugg

SEQ ID NO: 1451203 - RNA, 21 nt, Homo sapiens
uaauguauuuguuugcaauuu

SEQ ID NO: 1451204 - RNA, 22 nt, Homo sapiens
uaaugucuucauaaaguacuug

SEQ ID NO: 1451205 - RNA, 18 nt, Homo sapiens
uaauguggcuucuggaau

SEQ ID NO: 1451206 - RNA, 13 nt, Homo sapiens
uaauguuacauua

SEQ ID NO: 1451207 - RNA, 22 nt, Homo sapiens
uaauguuacugaucaugcauug

SEQ ID NO: 1451208 - RNA, 20 nt, Homo sapiens
uaauguuguaauucaugcca

SEQ ID NO: 1451209 - RNA, 19 nt, Homo sapiens
uaauguuuuauacuguuua

SEQ ID NO: 1451210 - RNA, 21 nt, Homo sapiens
uaauuaaaaaguuaaucuuca

SEQ ID NO: 1451211 - RNA, 14 nt, Homo sapiens
uaauuaauauucau

SEQ ID NO: 1451212 - RNA, 12 nt, Homo sapiens
uaauuaauuuca

SEQ ID NO: 1451213 - RNA, 22 nt, Homo sapiens
uaauuagcauggccccagucca

SEQ ID NO: 1451214 - RNA, 17 nt, Homo sapiens
uaauuagggguugcuaa

SEQ ID NO: 1451215 - RNA, 16 nt, Homo sapiens
uaauuauaaauaucau

SEQ ID NO: 1451216 - RNA, 12 nt, Homo sapiens
uaauuauugcuu

SEQ ID NO: 1451217 - RNA, 15 nt, Homo sapiens
uaauuauuucacuuu

SEQ ID NO: 1451218 - RNA, 16 nt, Homo sapiens
uaauucaacccagcca

SEQ ID NO: 1451219 - RNA, 16 nt, Homo sapiens
uaauugacaacacagc

SEQ ID NO: 1451220 - RNA, 19 nt, Homo sapiens
uaauugaucaaauucauuu

SEQ ID NO: 1451221 - RNA, 19 nt, Homo sapiens
uaauugccuaaaucuccag

SEQ ID NO: 1451222 - RNA, 15 nt, Homo sapiens
uaauuggucauguga

SEQ ID NO: 1451223 - RNA, 19 nt, Homo sapiens
uaauuguuuaaaaugccuc

SEQ ID NO: 1451224 - RNA, 17 nt, Homo sapiens
uaauuuaaacaccuccu

SEQ ID NO: 1451225 - RNA, 16 nt, Homo sapiens
uaauuuaacacccuuu

SEQ ID NO: 1451226 - RNA, 21 nt, Homo sapiens
uaauuuaucuugucucugggc

SEQ ID NO: 1451227 - RNA, 13 nt, Homo sapiens
uaauuuaugcaag

SEQ ID NO: 1451228 - RNA, 21 nt, Homo sapiens
uaauuucacucucugcauuga

SEQ ID NO: 1451229 - RNA, 22 nt, Homo sapiens
uaauuucacucucugcauugac

SEQ ID NO: 1451230 - RNA, 17 nt, Homo sapiens
uaauuuccuuuuugaca

SEQ ID NO: 1451231 - RNA, 22 nt, Homo sapiens
uaauuucuuugaucuggacaga

SEQ ID NO: 1451232 - RNA, 15 nt, Homo sapiens
uaauuuuccaaugca

SEQ ID NO: 1451233 - RNA, 18 nt, Homo sapiens
uaauuuuccaaugcacag

SEQ ID NO: 1451234 - RNA, 14 nt, Homo sapiens
uaauuuuguuguuu

SEQ ID NO: 1451235 - RNA, 19 nt, Homo sapiens
uaauuuuuccuauauugca

SEQ ID NO: 1451236 - RNA, 22 nt, Homo sapiens
uaauuuuuucccagacuacuau

SEQ ID NO: 1451237 - RNA, 19 nt, Homo sapiens
uaauuuuuuguacuuuuag

SEQ ID NO: 1451238 - RNA, 16 nt, Homo sapiens
uacaaaaaaguaaccu

SEQ ID NO: 1451239 - RNA, 15 nt, Homo sapiens
uacaaaauccagcua

SEQ ID NO: 1451240 - RNA, 20 nt, Homo sapiens
uacaaaauccagcuaugaau

SEQ ID NO: 1451241 - RNA, 14 nt, Homo sapiens
uacaaacugcaaua

SEQ ID NO: 1451242 - RNA, 17 nt, Homo sapiens
uacaaagaaaaagccaa

SEQ ID NO: 1451243 - RNA, 23 nt, Homo sapiens
uacaaaugucuucaugaccuacu

SEQ ID NO: 1451244 - RNA, 16 nt, Homo sapiens
uacaacuucagcagua

SEQ ID NO: 1451245 - RNA, 23 nt, Homo sapiens
uacaagaguggagagaagcucuu

SEQ ID NO: 1451246 - RNA, 14 nt, Homo sapiens
uacaaggcuuuauc

SEQ ID NO: 1451247 - RNA, 21 nt, Homo sapiens
gugaaaccccaucucuacuaa

SEQ ID NO: 1451248 - RNA, 13 nt, Homo sapiens
gugaaacuaacag

SEQ ID NO: 1451249 - RNA, 14 nt, Homo sapiens
gugaaaugcuggca

SEQ ID NO: 1451250 - RNA, 12 nt, Homo sapiens
gugaacaucccc

SEQ ID NO: 1451251 - RNA, 20 nt, Homo sapiens
gugaaccacuucauucugca

SEQ ID NO: 1451252 - RNA, 17 nt, Homo sapiens
gugaaccuuaguaccua

SEQ ID NO: 1451253 - RNA, 13 nt, Homo sapiens
gugaacugugcau

SEQ ID NO: 1451254 - RNA, 19 nt, Homo sapiens
gugaagaggaaaaugccuc

SEQ ID NO: 1451255 - RNA, 20 nt, Homo sapiens
gugaagagggagaagcauga

SEQ ID NO: 1451256 - RNA, 20 nt, Homo sapiens
gugaauacuugaacucuguu

SEQ ID NO: 1451257 - RNA, 16 nt, Homo sapiens
gugaaugaacacucuu

SEQ ID NO: 1451258 - RNA, 20 nt, Homo sapiens
gugaauguggauucuuccca

SEQ ID NO: 1451259 - RNA, 18 nt, Homo sapiens
gugaauuauugacacuga

SEQ ID NO: 1451260 - RNA, 21 nt, Homo sapiens
gugacagacaggcucuuagca

SEQ ID NO: 1451261 - RNA, 20 nt, Homo sapiens
gugacagaccacaucuuuau

SEQ ID NO: 1451262 - RNA, 14 nt, Homo sapiens
gugacagugccugg

SEQ ID NO: 1451263 - RNA, 17 nt, Homo sapiens
gugacaugugaaaccuu

SEQ ID NO: 1451264 - RNA, 14 nt, Homo sapiens
gugaccagggguga

SEQ ID NO: 1451265 - RNA, 16 nt, Homo sapiens
gugaccccugaccuca

SEQ ID NO: 1451266 - RNA, 23 nt, Homo sapiens
gugaccccugaccucacugugac

SEQ ID NO: 1451267 - RNA, 21 nt, Homo sapiens
gugagacccugucucuacuaa

SEQ ID NO: 1451268 - RNA, 18 nt, Homo sapiens
gugagacuguaaguuaca

SEQ ID NO: 1451269 - RNA, 20 nt, Homo sapiens
gugagacuguaaguuacaug

SEQ ID NO: 1451270 - RNA, 17 nt, Homo sapiens
gugaggagguucacuga

SEQ ID NO: 1451271 - RNA, 13 nt, Homo sapiens
gugagucaccugc

SEQ ID NO: 1451272 - RNA, 13 nt, Homo sapiens
gugagugugacag

SEQ ID NO: 1451273 - RNA, 21 nt, Homo sapiens
gugaguuacagcgagaggcag

SEQ ID NO: 1451274 - RNA, 20 nt, Homo sapiens
gugauaaugccccaaggaca

SEQ ID NO: 1451275 - RNA, 19 nt, Homo sapiens
gugauauacugguucacau

SEQ ID NO: 1451276 - RNA, 23 nt, Homo sapiens
gugauauacugguucacauccua

SEQ ID NO: 1451277 - RNA, 16 nt, Homo sapiens
gugaugagagaaugga

SEQ ID NO: 1451278 - RNA, 18 nt, Homo sapiens
gugauucgcccaccucag

SEQ ID NO: 1451279 - RNA, 23 nt, Homo sapiens
gugauugaaccagcucaucucca

SEQ ID NO: 1451280 - RNA, 14 nt, Homo sapiens
gugauugcacagaa

SEQ ID NO: 1451281 - RNA, 19 nt, Homo sapiens
gugauuucaccccacagac

SEQ ID NO: 1451282 - RNA, 19 nt, Homo sapiens
gugauuucagagagggcag

SEQ ID NO: 1451283 - RNA, 21 nt, Homo sapiens
gugauuuuggacuagccacuu

SEQ ID NO: 1451284 - RNA, 22 nt, Homo sapiens
gugcacauuucuuugcauucca

SEQ ID NO: 1451285 - RNA, 14 nt, Homo sapiens
gugcacucugcuaa

SEQ ID NO: 1451286 - RNA, 22 nt, Homo sapiens
gugcacuuuaagaggugggagc

SEQ ID NO: 1451287 - RNA, 19 nt, Homo sapiens
gugcagccccuuccuggug

SEQ ID NO: 1451288 - RNA, 23 nt, Homo sapiens
gugcagcgcagcuggacucugca

SEQ ID NO: 1451289 - RNA, 16 nt, Homo sapiens
gugcagcugauuuuaa

SEQ ID NO: 1451290 - RNA, 20 nt, Homo sapiens
gugcaguggcaugaugucaa

SEQ ID NO: 1451291 - RNA, 19 nt, Homo sapiens
gugcaguggcgugaucucg

SEQ ID NO: 1451292 - RNA, 19 nt, Homo sapiens
gugcaguggugugaucuca

SEQ ID NO: 1451293 - RNA, 12 nt, Homo sapiens
gugccaaaaauc

SEQ ID NO: 1451294 - RNA, 21 nt, Homo sapiens
gugccacugcccgagcuggug

SEQ ID NO: 1451295 - RNA, 23 nt, Homo sapiens
gugccacugcccgagcuggugca

SEQ ID NO: 1451296 - RNA, 17 nt, Homo sapiens
gugccacuggaccucag

SEQ ID NO: 1451297 - RNA, 18 nt, Homo sapiens
gugccacuggaccucagu

SEQ ID NO: 1451298 - RNA, 15 nt, Homo sapiens
gugccagcaaugaca

SEQ ID NO: 1451299 - RNA, 21 nt, Homo sapiens
gugccagcaaugacaucucag

SEQ ID NO: 1451300 - RNA, 15 nt, Homo sapiens
gugccagcaccugcc

SEQ ID NO: 1451301 - RNA, 21 nt, Homo sapiens
gugccaguucuuuccauaaua

SEQ ID NO: 1451302 - RNA, 16 nt, Homo sapiens
gugccauugcacucca

SEQ ID NO: 1451303 - RNA, 21 nt, Homo sapiens
gugccccagggaguccagggu

SEQ ID NO: 1451304 - RNA, 19 nt, Homo sapiens
gugccccaugccuguccag

SEQ ID NO: 1451305 - RNA, 17 nt, Homo sapiens
gugcccuuugggguccc

SEQ ID NO: 1451306 - RNA, 15 nt, Homo sapiens
gugccgaaugugcag

SEQ ID NO: 1451307 - RNA, 20 nt, Homo sapiens
gugccgugugagugugacag

SEQ ID NO: 1451308 - RNA, 22 nt, Homo sapiens
gugccucugggacuggacaauu

SEQ ID NO: 1451309 - RNA, 15 nt, Homo sapiens
gugccuggacauuug

SEQ ID NO: 1451310 - RNA, 14 nt, Homo sapiens
gugccuuuugcaga

SEQ ID NO: 1451311 - RNA, 16 nt, Homo sapiens
gugcgcgaugugacag

SEQ ID NO: 1451312 - RNA, 23 nt, Homo sapiens
gugcuccugugggagaucuucac

SEQ ID NO: 1451313 - RNA, 23 nt, Homo sapiens
gugcugcagauuugauauuugca

SEQ ID NO: 1451314 - RNA, 19 nt, Homo sapiens
gugcugccuugcuucugua

SEQ ID NO: 1451315 - RNA, 18 nt, Homo sapiens
gugcugggauuacaggug

SEQ ID NO: 1451316 - RNA, 16 nt, Homo sapiens
gugcugggcauuuuua

SEQ ID NO: 1451317 - RNA, 16 nt, Homo sapiens
gugcugggggaaugag

SEQ ID NO: 1451318 - RNA, 14 nt, Homo sapiens
gugcugguuuauuu

SEQ ID NO: 1451319 - RNA, 18 nt, Homo sapiens
gugcuuaaaaaucauuga

SEQ ID NO: 1451320 - RNA, 20 nt, Homo sapiens
gguuggggugacagucauca

SEQ ID NO: 1451321 - RNA, 15 nt, Homo sapiens
gguuucaaagugaua

SEQ ID NO: 1451322 - RNA, 14 nt, Homo sapiens
gguuucaccugggc

SEQ ID NO: 1451323 - RNA, 22 nt, Homo sapiens
gguuucucucuacagugccaac

SEQ ID NO: 1451324 - RNA, 17 nt, Homo sapiens
gguuuggggucugccac

SEQ ID NO: 1451325 - RNA, 16 nt, Homo sapiens
gguuugguccuugaac

SEQ ID NO: 1451326 - RNA, 15 nt, Homo sapiens
gguuugucaguucuu

SEQ ID NO: 1451327 - RNA, 19 nt, Homo sapiens
gguuuguguuugaguuuua

SEQ ID NO: 1451328 - RNA, 19 nt, Homo sapiens
gguuuguuauaucagggaa

SEQ ID NO: 1451329 - RNA, 23 nt, Homo sapiens
gguuuuagacgaggccacagcug

SEQ ID NO: 1451330 - RNA, 15 nt, Homo sapiens
guaaaaacuguucuc

SEQ ID NO: 1451331 - RNA, 14 nt, Homo sapiens
guaaaacaguuaca

SEQ ID NO: 1451332 - RNA, 20 nt, Homo sapiens
guaaacagauggcacuuuga

SEQ ID NO: 1451333 - RNA, 21 nt, Homo sapiens
guaaacagauggcacuuugaa

SEQ ID NO: 1451334 - RNA, 17 nt, Homo sapiens
guaaagucaacauaugc

SEQ ID NO: 1451335 - RNA, 18 nt, Homo sapiens
guaaagucaacauaugca

SEQ ID NO: 1451336 - RNA, 19 nt, Homo sapiens
guaaagucaacauaugcaa

SEQ ID NO: 1451337 - RNA, 18 nt, Homo sapiens
guaaauacuguaaaugca

SEQ ID NO: 1451338 - RNA, 16 nt, Homo sapiens
guaaauaguauuugag

SEQ ID NO: 1451339 - RNA, 14 nt, Homo sapiens
guaaauaugaaucu

SEQ ID NO: 1451340 - RNA, 14 nt, Homo sapiens
guaaaugguguaca

SEQ ID NO: 1451341 - RNA, 15 nt, Homo sapiens
guaaauguccauuua

SEQ ID NO: 1451342 - RNA, 15 nt, Homo sapiens
guaaauguccugcua

SEQ ID NO: 1451343 - RNA, 15 nt, Homo sapiens
guaaauucaaccacu

SEQ ID NO: 1451344 - RNA, 19 nt, Homo sapiens
guaacaacuguggucaauc

SEQ ID NO: 1451345 - RNA, 20 nt, Homo sapiens
guaacagccaggaguguuaa

SEQ ID NO: 1451346 - RNA, 15 nt, Homo sapiens
guauuuugacacugg

SEQ ID NO: 1451347 - RNA, 16 nt, Homo sapiens
gucaaacagugccaaa

SEQ ID NO: 1451348 - RNA, 16 nt, Homo sapiens
gucaaacuaauucuca

SEQ ID NO: 1451349 - RNA, 16 nt, Homo sapiens
gucaaagcaaguuuca

SEQ ID NO: 1451350 - RNA, 15 nt, Homo sapiens
gucaacaacuuacac

SEQ ID NO: 1451351 - RNA, 22 nt, Homo sapiens
gucaacaucaaagagcacauuu

SEQ ID NO: 1451352 - RNA, 21 nt, Homo sapiens
gucaacaucuuuuacauucug

SEQ ID NO: 1451353 - RNA, 22 nt, Homo sapiens
gucaacuccaacguaugugguu

SEQ ID NO: 1451354 - RNA, 18 nt, Homo sapiens
gucaagaaacagccagca

SEQ ID NO: 1451355 - RNA, 20 nt, Homo sapiens
gucaaggcaguagaacucca

SEQ ID NO: 1451356 - RNA, 16 nt, Homo sapiens
gucaaugccugucuua

SEQ ID NO: 1451357 - RNA, 14 nt, Homo sapiens
gucaaugugcagug

SEQ ID NO: 1451358 - RNA, 14 nt, Homo sapiens
gucacaauccuaac

SEQ ID NO: 1451359 - RNA, 13 nt, Homo sapiens
gucacagggccaa

SEQ ID NO: 1451360 - RNA, 20 nt, Homo sapiens
gucacaucagauaagacaua

SEQ ID NO: 1451361 - RNA, 18 nt, Homo sapiens
gucaccagcuaucuguca

SEQ ID NO: 1451362 - RNA, 16 nt, Homo sapiens
gucacggccaagugua

SEQ ID NO: 1451363 - RNA, 11 nt, Homo sapiens
gucacuccugg

SEQ ID NO: 1451364 - RNA, 21 nt, Homo sapiens
gucacugacucaagacacuga

SEQ ID NO: 1451365 - RNA, 17 nt, Homo sapiens
gucacuuuuuggccaug

SEQ ID NO: 1451366 - RNA, 12 nt, Homo sapiens
gucagagcuaaa

SEQ ID NO: 1451367 - RNA, 13 nt, Homo sapiens
gucagagcuaaac

SEQ ID NO: 1451368 - RNA, 21 nt, Homo sapiens
gucagaguccagugcucugcc

SEQ ID NO: 1451369 - RNA, 17 nt, Homo sapiens
gucagccauaucuccau

SEQ ID NO: 1451370 - RNA, 21 nt, Homo sapiens
gucagcuacuaaugauguuuu

SEQ ID NO: 1451371 - RNA, 16 nt, Homo sapiens
gucagcucucugcccu

SEQ ID NO: 1451372 - RNA, 13 nt, Homo sapiens
gucaggacuguga

SEQ ID NO: 1451373 - RNA, 22 nt, Homo sapiens
gucaggauucuucaaggagaau

SEQ ID NO: 1451374 - RNA, 17 nt, Homo sapiens
gucaggcagggugcagu

SEQ ID NO: 1451375 - RNA, 16 nt, Homo sapiens
gucaggcccccagugg

SEQ ID NO: 1451376 - RNA, 21 nt, Homo sapiens
gucaggcggggugcuguggug

SEQ ID NO: 1451377 - RNA, 15 nt, Homo sapiens
gucaggcugcagagg

SEQ ID NO: 1451378 - RNA, 18 nt, Homo sapiens
gucagucuucacuugcac

SEQ ID NO: 1451379 - RNA, 12 nt, Homo sapiens
gucagugucugg

SEQ ID NO: 1451380 - RNA, 15 nt, Homo sapiens
gucauaacucagccc

SEQ ID NO: 1451381 - RNA, 17 nt, Homo sapiens
gucauccucaugcugcu

SEQ ID NO: 1451382 - RNA, 16 nt, Homo sapiens
gucaugcuucaucauu

SEQ ID NO: 1451383 - RNA, 21 nt, Homo sapiens
gucaugucucugguggugcug

SEQ ID NO: 1451384 - RNA, 14 nt, Homo sapiens
gucauucauucaag

SEQ ID NO: 1451385 - RNA, 19 nt, Homo sapiens
gucauucuagaaacaggaa

SEQ ID NO: 1451386 - RNA, 13 nt, Homo sapiens
gucauugaccucu

SEQ ID NO: 1451387 - RNA, 23 nt, Homo sapiens
gucauuggccacugucuccacuc

SEQ ID NO: 1451388 - RNA, 14 nt, Homo sapiens
gucauuguauguua

SEQ ID NO: 1451389 - RNA, 20 nt, Homo sapiens
guccaacaagaaugcauucc

SEQ ID NO: 1451390 - RNA, 13 nt, Homo sapiens
guccaacugucaa

SEQ ID NO: 1451391 - RNA, 15 nt, Homo sapiens
guccacugcuccauu

SEQ ID NO: 1451392 - RNA, 18 nt, Homo sapiens
guccagaagaauauucag

SEQ ID NO: 1451393 - RNA, 15 nt, Homo sapiens
guccagcucguucuc

SEQ ID NO: 1451394 - RNA, 21 nt, Homo sapiens
guccaugcugaugauuuugca

SEQ ID NO: 1451395 - RNA, 18 nt, Homo sapiens
guccaugugcacccggcc

SEQ ID NO: 1451396 - RNA, 14 nt, Homo sapiens
guccauugauguau

SEQ ID NO: 1451397 - RNA, 18 nt, Homo sapiens
gucccacuacaucuggga

SEQ ID NO: 1451398 - RNA, 15 nt, Homo sapiens
gucccagacaauucc

SEQ ID NO: 1451399 - RNA, 15 nt, Homo sapiens
gucccagcuacucag

SEQ ID NO: 1451400 - RNA, 12 nt, Homo sapiens
gucccagucucu

SEQ ID NO: 1451401 - RNA, 14 nt, Homo sapiens
gucccauuccucag

SEQ ID NO: 1451402 - RNA, 18 nt, Homo sapiens
guccccauccccaccagc

SEQ ID NO: 1451403 - RNA, 21 nt, Homo sapiens
guccccccucaagaguacaga

SEQ ID NO: 1451404 - RNA, 23 nt, Homo sapiens
guccccuccacugucacauugua

SEQ ID NO: 1451405 - RNA, 18 nt, Homo sapiens
gucccggggccagcacuu

SEQ ID NO: 1451406 - RNA, 17 nt, Homo sapiens
gucccuuucccuaccuu

SEQ ID NO: 1451407 - RNA, 17 nt, Homo sapiens
guccuacuaucacugaa

SEQ ID NO: 1451408 - RNA, 19 nt, Homo sapiens
guccucacgcagacacacc

SEQ ID NO: 1451409 - RNA, 18 nt, Homo sapiens
guccucauuuacuggauu

SEQ ID NO: 1451410 - RNA, 15 nt, Homo sapiens
guccucuucugggcc

SEQ ID NO: 1451411 - RNA, 15 nt, Homo sapiens
guccugacacuauuc

SEQ ID NO: 1451412 - RNA, 20 nt, Homo sapiens
guccugaugcugugcucaau

SEQ ID NO: 1451413 - RNA, 21 nt, Homo sapiens
guccuugugaguccaucuaac

SEQ ID NO: 1451414 - RNA, 13 nt, Homo sapiens
guccuuucuugca

SEQ ID NO: 1451415 - RNA, 14 nt, Homo sapiens
guccuuugugaaua

SEQ ID NO: 1451416 - RNA, 19 nt, Homo sapiens
gucgaauuccuacugacaa

SEQ ID NO: 1451417 - RNA, 14 nt, Homo sapiens
gucgcaucucagug

SEQ ID NO: 1451418 - RNA, 20 nt, Homo sapiens
gucggaacccaagcuuagaa

SEQ ID NO: 1451419 - RNA, 19 nt, Homo sapiens
gucuaaacaaaauugcaau

SEQ ID NO: 1451420 - RNA, 17 nt, Homo sapiens
gucuacauacuuucauc

SEQ ID NO: 1451421 - RNA, 13 nt, Homo sapiens
ggcuugaagccaa

SEQ ID NO: 1451422 - RNA, 20 nt, Homo sapiens
ggcuugaccaggcuuggccu

SEQ ID NO: 1451423 - RNA, 19 nt, Homo sapiens
ggcuugggcaccagcucau

SEQ ID NO: 1451424 - RNA, 23 nt, Homo sapiens
ggcuuucucuuccccuuccuguu

SEQ ID NO: 1451425 - RNA, 22 nt, Homo sapiens
gggaaacuuagaucaucaguca

SEQ ID NO: 1451426 - RNA, 14 nt, Homo sapiens
gggaaagaaaggga

SEQ ID NO: 1451427 - RNA, 18 nt, Homo sapiens
gggaaagcuucauucucc

SEQ ID NO: 1451428 - RNA, 14 nt, Homo sapiens
gggaacauguccua

SEQ ID NO: 1451429 - RNA, 21 nt, Homo sapiens
gggaaccaugaagacaggaug

SEQ ID NO: 1451430 - RNA, 20 nt, Homo sapiens
gggaagagggggcuggccau

SEQ ID NO: 1451431 - RNA, 22 nt, Homo sapiens
gggaauucauuuucaucacugg

SEQ ID NO: 1451432 - RNA, 16 nt, Homo sapiens
gggaauuuauugccuc

SEQ ID NO: 1451433 - RNA, 14 nt, Homo sapiens
gggacagagccaug

SEQ ID NO: 1451434 - RNA, 15 nt, Homo sapiens
gggacagagccaugc

SEQ ID NO: 1451435 - RNA, 14 nt, Homo sapiens
gggacagcccacug

SEQ ID NO: 1451436 - RNA, 21 nt, Homo sapiens
gggacaucaaaaacagcagaa

SEQ ID NO: 1451437 - RNA, 19 nt, Homo sapiens
gggacauugcaauuugcag

SEQ ID NO: 1451438 - RNA, 22 nt, Homo sapiens
gggaccaacugggcccaagaca

SEQ ID NO: 1451439 - RNA, 15 nt, Homo sapiens
gggaccgacuuucca

SEQ ID NO: 1451440 - RNA, 14 nt, Homo sapiens
gggacuccaugcug

SEQ ID NO: 1451441 - RNA, 15 nt, Homo sapiens
gggacuggagucaga

SEQ ID NO: 1451442 - RNA, 13 nt, Homo sapiens
gggacuguuccaa

SEQ ID NO: 1451443 - RNA, 14 nt, Homo sapiens
gggacuguuccaaa

SEQ ID NO: 1451444 - RNA, 12 nt, Homo sapiens
gggagacuggaa

SEQ ID NO: 1451445 - RNA, 16 nt, Homo sapiens
gggagagacaggcagc

SEQ ID NO: 1451446 - RNA, 21 nt, Homo sapiens
gggagaucaugucucacuuca

SEQ ID NO: 1451447 - RNA, 14 nt, Homo sapiens
gggaggcaagaaaa

SEQ ID NO: 1451448 - RNA, 21 nt, Homo sapiens
gggaggcccugagacagggau

SEQ ID NO: 1451449 - RNA, 20 nt, Homo sapiens
gggaggcggagguugcaaug

SEQ ID NO: 1451450 - RNA, 16 nt, Homo sapiens
gggaggucagugcuuc

SEQ ID NO: 1451451 - RNA, 20 nt, Homo sapiens
gggagguggagauugcagug

SEQ ID NO: 1451452 - RNA, 12 nt, Homo sapiens
gggagugucuaa

SEQ ID NO: 1451453 - RNA, 23 nt, Homo sapiens
gggauaaguaaguuugauuucau

SEQ ID NO: 1451454 - RNA, 17 nt, Homo sapiens
gggauccguacauucaa

SEQ ID NO: 1451455 - RNA, 17 nt, Homo sapiens
gggaugggaacacuggu

SEQ ID NO: 1451456 - RNA, 23 nt, Homo sapiens
gggauuuuuggcuacacacaaac

SEQ ID NO: 1451457 - RNA, 18 nt, Homo sapiens
gggcaccagcucaugcca

SEQ ID NO: 1451458 - RNA, 22 nt, Homo sapiens
gggcacucccuugguggcaaga

SEQ ID NO: 1451459 - RNA, 15 nt, Homo sapiens
gggcagcauagcaag

SEQ ID NO: 1451460 - RNA, 17 nt, Homo sapiens
gggcaggaagcuuguca

SEQ ID NO: 1451461 - RNA, 21 nt, Homo sapiens
gggcaggcugggccaugucca

SEQ ID NO: 1451462 - RNA, 22 nt, Homo sapiens
gggcauagaucagaagacuaca

SEQ ID NO: 1451463 - RNA, 14 nt, Homo sapiens
gggcauccauacca

SEQ ID NO: 1451464 - RNA, 11 nt, Homo sapiens
gggcaucuccu

SEQ ID NO: 1451465 - RNA, 21 nt, Homo sapiens
gggcaugccuugugcuguuaa

SEQ ID NO: 1451466 - RNA, 16 nt, Homo sapiens
gggcauggguccaggg

SEQ ID NO: 1451467 - RNA, 14 nt, Homo sapiens
gggccacccagcca

SEQ ID NO: 1451468 - RNA, 14 nt, Homo sapiens
gggccacuggggac

SEQ ID NO: 1451469 - RNA, 21 nt, Homo sapiens
gggccagcacuuccaugggaa

SEQ ID NO: 1451470 - RNA, 20 nt, Homo sapiens
gggccaguccuccugggagc

SEQ ID NO: 1451471 - RNA, 22 nt, Homo sapiens
gggccgaauccccucccuguca

SEQ ID NO: 1451472 - RNA, 16 nt, Homo sapiens
gggccucccaccagag

SEQ ID NO: 1451473 - RNA, 16 nt, Homo sapiens
gggccucgggaccuca

SEQ ID NO: 1451474 - RNA, 16 nt, Homo sapiens
gggccugaccaaacag

SEQ ID NO: 1451475 - RNA, 21 nt, Homo sapiens
gggccuggcaggccagugucu

SEQ ID NO: 1451476 - RNA, 17 nt, Homo sapiens
gggccugggacuuccau

SEQ ID NO: 1451477 - RNA, 21 nt, Homo sapiens
gggccugggacuuccaugccu

SEQ ID NO: 1451478 - RNA, 18 nt, Homo sapiens
gggccuggggccugagag

SEQ ID NO: 1451479 - RNA, 18 nt, Homo sapiens
gggccuuucuguguccua

SEQ ID NO: 1451480 - RNA, 21 nt, Homo sapiens
gggcggcaggaccagccagca

SEQ ID NO: 1451481 - RNA, 21 nt, Homo sapiens
gggcgugaaccaccaugccca

SEQ ID NO: 1451482 - RNA, 18 nt, Homo sapiens
gggcguggagagcccggc

SEQ ID NO: 1451483 - RNA, 17 nt, Homo sapiens
gggcguugggagccuag

SEQ ID NO: 1451484 - RNA, 19 nt, Homo sapiens
gggcugaaagaacauggac

SEQ ID NO: 1451485 - RNA, 14 nt, Homo sapiens
gggcugcccucucc

SEQ ID NO: 1451486 - RNA, 16 nt, Homo sapiens
gggcuggccccagcca

SEQ ID NO: 1451487 - RNA, 11 nt, Homo sapiens
gggcugugcau

SEQ ID NO: 1451488 - RNA, 18 nt, Homo sapiens
ggggaacugcguggugcu

SEQ ID NO: 1451489 - RNA, 16 nt, Homo sapiens
ggggagagacaggcag

SEQ ID NO: 1451490 - RNA, 22 nt, Homo sapiens
ggggcaggaggaggccaacuca

SEQ ID NO: 1451491 - RNA, 18 nt, Homo sapiens
ggggcaggcugggccaug

SEQ ID NO: 1451492 - RNA, 14 nt, Homo sapiens
ggggcagggccuuc

SEQ ID NO: 1451493 - RNA, 18 nt, Homo sapiens
ggggccgggcgcgguggc

SEQ ID NO: 1451494 - RNA, 13 nt, Homo sapiens
ggggccuccagaa

SEQ ID NO: 1451495 - RNA, 21 nt, Homo sapiens
ggggccuuccuguguggccug

SEQ ID NO: 1451496 - RNA, 16 nt, Homo sapiens
ggggcgagcacuguga

SEQ ID NO: 1451497 - RNA, 14 nt, Homo sapiens
ggggcuacugugac

SEQ ID NO: 1451498 - RNA, 19 nt, Homo sapiens
gggggaaaaaaaaaaaaga

SEQ ID NO: 1451499 - RNA, 16 nt, Homo sapiens
ggaggaaagcuugaag

SEQ ID NO: 1451500 - RNA, 18 nt, Homo sapiens
ggaggaacacugcacucu

SEQ ID NO: 1451501 - RNA, 15 nt, Homo sapiens
ggaggaccagagcua

SEQ ID NO: 1451502 - RNA, 23 nt, Homo sapiens
ggaggaugucccugggccagggu

SEQ ID NO: 1451503 - RNA, 20 nt, Homo sapiens
ggaggcagaggcugcauuga

SEQ ID NO: 1451504 - RNA, 19 nt, Homo sapiens
ggaggcggagcuugcagug

SEQ ID NO: 1451505 - RNA, 20 nt, Homo sapiens
ggaggcggagguugcaauga

SEQ ID NO: 1451506 - RNA, 18 nt, Homo sapiens
ggaggcggugguagagag

SEQ ID NO: 1451507 - RNA, 13 nt, Homo sapiens
ggaggcugcagug

SEQ ID NO: 1451508 - RNA, 14 nt, Homo sapiens
ggaggcugcaguga

SEQ ID NO: 1451509 - RNA, 14 nt, Homo sapiens
ggagggcaguuuuc

SEQ ID NO: 1451510 - RNA, 21 nt, Homo sapiens
ggagggcccuccgaccacuuc

SEQ ID NO: 1451511 - RNA, 15 nt, Homo sapiens
ggagggcgguggaca

SEQ ID NO: 1451512 - RNA, 19 nt, Homo sapiens
ggaggucauacaugcauac

SEQ ID NO: 1451513 - RNA, 19 nt, Homo sapiens
ggagguggaggcugcagug

SEQ ID NO: 1451514 - RNA, 21 nt, Homo sapiens
ggagguuacagugagccaaga

SEQ ID NO: 1451515 - RNA, 16 nt, Homo sapiens
ggagucagucuucacu

SEQ ID NO: 1451516 - RNA, 22 nt, Homo sapiens
ggagucucugccacccacucag

SEQ ID NO: 1451517 - RNA, 22 nt, Homo sapiens
ggagucuugcucugucacccag

SEQ ID NO: 1451518 - RNA, 22 nt, Homo sapiens
ggagugaccaaaggugugcccu

SEQ ID NO: 1451519 - RNA, 12 nt, Homo sapiens
ggagugcaguuu

SEQ ID NO: 1451520 - RNA, 22 nt, Homo sapiens
ggaguuccggaauuauucugug

SEQ ID NO: 1451521 - RNA, 21 nt, Homo sapiens
ggaguuuucuggagugagcac

SEQ ID NO: 1451522 - RNA, 16 nt, Homo sapiens
ggauaacacauuugau

SEQ ID NO: 1451523 - RNA, 20 nt, Homo sapiens
ggauaacacuggcuucaggc

SEQ ID NO: 1451524 - RNA, 19 nt, Homo sapiens
ggauaacuuagguggcaag

SEQ ID NO: 1451525 - RNA, 19 nt, Homo sapiens
ggauaagccacugggcacu

SEQ ID NO: 1451526 - RNA, 17 nt, Homo sapiens
ggauacuggugcaguca

SEQ ID NO: 1451527 - RNA, 15 nt, Homo sapiens
ggauacuucauuaaa

SEQ ID NO: 1451528 - RNA, 19 nt, Homo sapiens
ggauagaucaaagucaaaa

SEQ ID NO: 1451529 - RNA, 19 nt, Homo sapiens
ggauauaaaaauaauguca

SEQ ID NO: 1451530 - RNA, 13 nt, Homo sapiens
ggauauugacaag

SEQ ID NO: 1451531 - RNA, 17 nt, Homo sapiens
ggauauugucagucuuu

SEQ ID NO: 1451532 - RNA, 16 nt, Homo sapiens
ggaucacaagauggaa

SEQ ID NO: 1451533 - RNA, 16 nt, Homo sapiens
ggaucacaaggucacu

SEQ ID NO: 1451534 - RNA, 19 nt, Homo sapiens
ggauccccccacagccccu

SEQ ID NO: 1451535 - RNA, 19 nt, Homo sapiens
ggauccucuccacuccaug

SEQ ID NO: 1451536 - RNA, 15 nt, Homo sapiens
ggauccugggucaaa

SEQ ID NO: 1451537 - RNA, 14 nt, Homo sapiens
ggaucuacacccac

SEQ ID NO: 1451538 - RNA, 19 nt, Homo sapiens
ggaucuccaaggaccaggu

SEQ ID NO: 1451539 - RNA, 18 nt, Homo sapiens
ggaucuugccacauuucu

SEQ ID NO: 1451540 - RNA, 22 nt, Homo sapiens
ggaucuuguaauccagugcccu

SEQ ID NO: 1451541 - RNA, 17 nt, Homo sapiens
ggaucuuuucauucuca

SEQ ID NO: 1451542 - RNA, 20 nt, Homo sapiens
ggaugaagauucuccugugc

SEQ ID NO: 1451543 - RNA, 20 nt, Homo sapiens
ggaugauacgaaugauguca

SEQ ID NO: 1451544 - RNA, 22 nt, Homo sapiens
ggaugccaaccggucacccagg

SEQ ID NO: 1451545 - RNA, 15 nt, Homo sapiens
ggaugcgcagugccu

SEQ ID NO: 1451546 - RNA, 15 nt, Homo sapiens
ggaugcuggccuuug

SEQ ID NO: 1451547 - RNA, 15 nt, Homo sapiens
ggauggccguggaug

SEQ ID NO: 1451548 - RNA, 16 nt, Homo sapiens
ggaugggaacacuggu

SEQ ID NO: 1451549 - RNA, 18 nt, Homo sapiens
ggauguaagccuggagcu

SEQ ID NO: 1451550 - RNA, 17 nt, Homo sapiens
ggaugucccugggccag

SEQ ID NO: 1451551 - RNA, 20 nt, Homo sapiens
ggauguuuugucccauuucc

SEQ ID NO: 1451552 - RNA, 21 nt, Homo sapiens
ggauuaagaaaccuugcucuc

SEQ ID NO: 1451553 - RNA, 21 nt, Homo sapiens
ggauuacaggugugggccacu

SEQ ID NO: 1451554 - RNA, 23 nt, Homo sapiens
ggauuaccagggacuaucuuugc

SEQ ID NO: 1451555 - RNA, 14 nt, Homo sapiens
ggauuauucauuua

SEQ ID NO: 1451556 - RNA, 16 nt, Homo sapiens
ggauuauuuaauaaca

SEQ ID NO: 1451557 - RNA, 14 nt, Homo sapiens
ggauuccacuaucu

SEQ ID NO: 1451558 - RNA, 19 nt, Homo sapiens
ggauuccgucuucucucau

SEQ ID NO: 1451559 - RNA, 19 nt, Homo sapiens
ggauugcuaaucaccaaag

SEQ ID NO: 1451560 - RNA, 23 nt, Homo sapiens
ggauuugaagcaaagcaccagcu

SEQ ID NO: 1451561 - RNA, 12 nt, Homo sapiens
ggcaaaauaugg

SEQ ID NO: 1451562 - RNA, 22 nt, Homo sapiens
ggcaaagagagucgcaucucag

SEQ ID NO: 1451563 - RNA, 13 nt, Homo sapiens
ggcaaaguguuuu

SEQ ID NO: 1451564 - RNA, 18 nt, Homo sapiens
ggcaaaucagaugcagcu

SEQ ID NO: 1451565 - RNA, 20 nt, Homo sapiens
ggcaaucacggcucacugua

SEQ ID NO: 1451566 - RNA, 16 nt, Homo sapiens
ggcaaucucagaugca

SEQ ID NO: 1451567 - RNA, 19 nt, Homo sapiens
ggcaaucucagaugcaguu

SEQ ID NO: 1451568 - RNA, 19 nt, Homo sapiens
ggcaauuucaccaccaaau

SEQ ID NO: 1451569 - RNA, 14 nt, Homo sapiens
ggcacaagugucag

SEQ ID NO: 1451570 - RNA, 19 nt, Homo sapiens
ggcacagggucugcucuuu

SEQ ID NO: 1451571 - RNA, 11 nt, Homo sapiens
ggcacauuccc

SEQ ID NO: 1451572 - RNA, 19 nt, Homo sapiens
ggcaccagacacccaggac

SEQ ID NO: 1451573 - RNA, 17 nt, Homo sapiens
ggcaccagcucaugcca

SEQ ID NO: 1451574 - RNA, 23 nt, Homo sapiens
ggcaccuuaagauuuugcaccug

SEQ ID NO: 1451575 - RNA, 14 nt, Homo sapiens
ggcacgguggcuca

SEQ ID NO: 1451576 - RNA, 21 nt, Homo sapiens
ggcacgucgcccgcugagcug

SEQ ID NO: 1451577 - RNA, 20 nt, Homo sapiens
ggcacugcccuuuucaggaa

SEQ ID NO: 1451578 - RNA, 15 nt, Homo sapiens
ggcagaaaauuacau

SEQ ID NO: 1451579 - RNA, 17 nt, Homo sapiens
gcagcauuuuauuuacc

SEQ ID NO: 1451580 - RNA, 22 nt, Homo sapiens
gcagccaacccggcacugcccu

SEQ ID NO: 1451581 - RNA, 19 nt, Homo sapiens
gcagccacgaggugcaaca

SEQ ID NO: 1451582 - RNA, 13 nt, Homo sapiens
gcagcccaugccc

SEQ ID NO: 1451583 - RNA, 23 nt, Homo sapiens
gcagcccaugcccaccugcccau

SEQ ID NO: 1451584 - RNA, 20 nt, Homo sapiens
gcagcccuaaggaucucuca

SEQ ID NO: 1451585 - RNA, 17 nt, Homo sapiens
gcagccuccaacacaag

SEQ ID NO: 1451586 - RNA, 18 nt, Homo sapiens
gcagcggaggcgugcguu

SEQ ID NO: 1451587 - RNA, 20 nt, Homo sapiens
gcagcgucacucuaccuaau

SEQ ID NO: 1451588 - RNA, 22 nt, Homo sapiens
gcagcuaccagguguucuacac

SEQ ID NO: 1451589 - RNA, 23 nt, Homo sapiens
gcagcucccauuucaucagcaag

SEQ ID NO: 1451590 - RNA, 20 nt, Homo sapiens
gcagcucccuuucucaggag

SEQ ID NO: 1451591 - RNA, 17 nt, Homo sapiens
gcagcuguuucucauga

SEQ ID NO: 1451592 - RNA, 18 nt, Homo sapiens
gcaggaagcauucagaga

SEQ ID NO: 1451593 - RNA, 23 nt, Homo sapiens
gcaggaagcauucagagagcagc

SEQ ID NO: 1451594 - RNA, 22 nt, Homo sapiens
ggaaccucagccuggccagaca

SEQ ID NO: 1451595 - RNA, 23 nt, Homo sapiens
ggaaccuugcuguccugaucugu

SEQ ID NO: 1451596 - RNA, 21 nt, Homo sapiens
ggaacuagagggauacacuga

SEQ ID NO: 1451597 - RNA, 22 nt, Homo sapiens
ggaacuagagggauacacugaa

SEQ ID NO: 1451598 - RNA, 16 nt, Homo sapiens
ggaacucagauccagg

SEQ ID NO: 1451599 - RNA, 14 nt, Homo sapiens
ggaacucucuccac

SEQ ID NO: 1451600 - RNA, 14 nt, Homo sapiens
ggaacuucaucaua

SEQ ID NO: 1451601 - RNA, 18 nt, Homo sapiens
ggaagaaugaacacuccc

SEQ ID NO: 1451602 - RNA, 13 nt, Homo sapiens
ggaagacugacag

SEQ ID NO: 1451603 - RNA, 12 nt, Homo sapiens
ggaagagcuaau

SEQ ID NO: 1451604 - RNA, 13 nt, Homo sapiens
ggaagaguguuuc

SEQ ID NO: 1451605 - RNA, 20 nt, Homo sapiens
ggaagcaaguuuucuuccau

SEQ ID NO: 1451606 - RNA, 23 nt, Homo sapiens
ggaagcagggguggggggugcag

SEQ ID NO: 1451607 - RNA, 20 nt, Homo sapiens
ggaagccggaggguguuuau

SEQ ID NO: 1451608 - RNA, 18 nt, Homo sapiens
ggaagcggcccuaaggga

SEQ ID NO: 1451609 - RNA, 15 nt, Homo sapiens
ggaagcuaauuugca

SEQ ID NO: 1451610 - RNA, 20 nt, Homo sapiens
ggaagcuaccagagcucuau

SEQ ID NO: 1451611 - RNA, 14 nt, Homo sapiens
ggaagcuccacugu

SEQ ID NO: 1451612 - RNA, 17 nt, Homo sapiens
ggaagcucugaagucac

SEQ ID NO: 1451613 - RNA, 21 nt, Homo sapiens
ggaaggaacagcaaugguguc

SEQ ID NO: 1451614 - RNA, 21 nt, Homo sapiens
ggaaggaacauggagcuguca

SEQ ID NO: 1451615 - RNA, 14 nt, Homo sapiens
ggaaggaaccagaa

SEQ ID NO: 1451616 - RNA, 19 nt, Homo sapiens
ggaagggggguugcagugg

SEQ ID NO: 1451617 - RNA, 18 nt, Homo sapiens
ggaaggugccucuggaug

SEQ ID NO: 1451618 - RNA, 16 nt, Homo sapiens
ggaaguaaagccucaa

SEQ ID NO: 1451619 - RNA, 17 nt, Homo sapiens
ggaagucagcaugccuc

SEQ ID NO: 1451620 - RNA, 23 nt, Homo sapiens
ggaagugaagagggagaagggau

SEQ ID NO: 1451621 - RNA, 16 nt, Homo sapiens
ggaauaacuuuuacac

SEQ ID NO: 1451622 - RNA, 18 nt, Homo sapiens
ggaauauaucaguaccuc

SEQ ID NO: 1451623 - RNA, 23 nt, Homo sapiens
ggaauauguuagagaauuuccuu

SEQ ID NO: 1451624 - RNA, 18 nt, Homo sapiens
ggaaucacuggcuguuaa

SEQ ID NO: 1451625 - RNA, 22 nt, Homo sapiens
ggaaucacuggcuguuaaucuu

SEQ ID NO: 1451626 - RNA, 13 nt, Homo sapiens
ggaaucagucagc

SEQ ID NO: 1451627 - RNA, 19 nt, Homo sapiens
ggaauccugcucacaaaau

SEQ ID NO: 1451628 - RNA, 20 nt, Homo sapiens
ggaauccuuuggugccaacu

SEQ ID NO: 1451629 - RNA, 16 nt, Homo sapiens
ggaaucuucugaauuu

SEQ ID NO: 1451630 - RNA, 20 nt, Homo sapiens
ggaaugaccagccuguccaa

SEQ ID NO: 1451631 - RNA, 21 nt, Homo sapiens
ggaauggaaagcggaguuccu

SEQ ID NO: 1451632 - RNA, 23 nt, Homo sapiens
ggaauuacaaaacucagagaaau

SEQ ID NO: 1451633 - RNA, 23 nt, Homo sapiens
ggaauucauuuucaucacuggga

SEQ ID NO: 1451634 - RNA, 15 nt, Homo sapiens
ggaauugauuugcau

SEQ ID NO: 1451635 - RNA, 22 nt, Homo sapiens
ggacaaggagugugaccacuga

SEQ ID NO: 1451636 - RNA, 12 nt, Homo sapiens
ggacaagggauu

SEQ ID NO: 1451637 - RNA, 20 nt, Homo sapiens
ggacaagugcuguugggaua

SEQ ID NO: 1451638 - RNA, 20 nt, Homo sapiens
ggacaccccuuauccaggac

SEQ ID NO: 1451639 - RNA, 18 nt, Homo sapiens
ggacaccuuuuaacucac

SEQ ID NO: 1451640 - RNA, 19 nt, Homo sapiens
ggacacucaaacacaucau

SEQ ID NO: 1451641 - RNA, 11 nt, Homo sapiens
ggacacugaga

SEQ ID NO: 1451642 - RNA, 9 nt, Homo sapiens
ggacacugc

SEQ ID NO: 1451643 - RNA, 21 nt, Homo sapiens
ggacacugugcccagcccgga

SEQ ID NO: 1451644 - RNA, 21 nt, Homo sapiens
ggacacuuccguagacuguuu

SEQ ID NO: 1451645 - RNA, 17 nt, Homo sapiens
ggacagaugaaugccgu

SEQ ID NO: 1451646 - RNA, 20 nt, Homo sapiens
ggacagaugaaugccgugga

SEQ ID NO: 1451647 - RNA, 18 nt, Homo sapiens
ggacagccccacccuggu

SEQ ID NO: 1451648 - RNA, 16 nt, Homo sapiens
ggacaggagucagugu

SEQ ID NO: 1451649 - RNA, 13 nt, Homo sapiens
ggacagguggugc

SEQ ID NO: 1451650 - RNA, 15 nt, Homo sapiens
ggacagugaggucac

SEQ ID NO: 1451651 - RNA, 19 nt, Homo sapiens
ggacauuuaaaauucaauu

SEQ ID NO: 1451652 - RNA, 18 nt, Homo sapiens
ggaccaaggggugggcca

SEQ ID NO: 1451653 - RNA, 16 nt, Homo sapiens
ggaccagaagcauuuc

SEQ ID NO: 1451654 - RNA, 17 nt, Homo sapiens
ggaccaggauacuggac

SEQ ID NO: 1451655 - RNA, 11 nt, Homo sapiens
ggaccaggugc

SEQ ID NO: 1451656 - RNA, 17 nt, Homo sapiens
ggaccauucauacccac

SEQ ID NO: 1451657 - RNA, 12 nt, Homo sapiens
ggaccucaggug

SEQ ID NO: 1451658 - RNA, 23 nt, Homo sapiens
ggacgccugcaggagagagcagc

SEQ ID NO: 1451659 - RNA, 23 nt, Homo sapiens
ggacggcuguggaccguggacag

SEQ ID NO: 1451660 - RNA, 13 nt, Homo sapiens
ggacuagccacuu

SEQ ID NO: 1451661 - RNA, 19 nt, Homo sapiens
ggacuauauuugggccugc

SEQ ID NO: 1451662 - RNA, 12 nt, Homo sapiens
ggacuccaugcu

SEQ ID NO: 1451663 - RNA, 12 nt, Homo sapiens
ggacucuuccac

SEQ ID NO: 1451664 - RNA, 19 nt, Homo sapiens
ggacuggaggugggcaugc

SEQ ID NO: 1451665 - RNA, 22 nt, Homo sapiens
ggacuggaggugggcaugccac

SEQ ID NO: 1451666 - RNA, 15 nt, Homo sapiens
ggacuuccauuugcu

SEQ ID NO: 1451667 - RNA, 23 nt, Homo sapiens
ggacuugauagcaaacacugggg

SEQ ID NO: 1451668 - RNA, 22 nt, Homo sapiens
ggacuugguuuguuauaucagg

SEQ ID NO: 1451669 - RNA, 22 nt, Homo sapiens
ggacuuugguucucuccaggaa

SEQ ID NO: 1451670 - RNA, 13 nt, Homo sapiens
ggagaaacccuuc

SEQ ID NO: 1451671 - RNA, 22 nt, Homo sapiens
ggagaaagcagccauuggcacu

SEQ ID NO: 1451672 - RNA, 15 nt, Homo sapiens
ggagaagagugucag

SEQ ID NO: 1451673 - RNA, 17 nt, Homo sapiens
ggagaagcaugaaaaag

SEQ ID NO: 1451674 - RNA, 17 nt, Homo sapiens
ggagaaggcagugauua

SEQ ID NO: 1451675 - RNA, 14 nt, Homo sapiens
ggagaccuggcacu

SEQ ID NO: 1451676 - RNA, 18 nt, Homo sapiens
uuuccuuugguccuucaa

SEQ ID NO: 1451677 - RNA, 18 nt, Homo sapiens
uuuccuuuuugacacuga

SEQ ID NO: 1451678 - RNA, 22 nt, Homo sapiens
uuucgcaccuaccaucagggac

SEQ ID NO: 1451679 - RNA, 13 nt, Homo sapiens
uuaguguugugga

SEQ ID NO: 1451680 - RNA, 21 nt, Homo sapiens
uuaguuucaaauuuaccucag

SEQ ID NO: 1451681 - RNA, 17 nt, Homo sapiens
uuauaaaaaaugguuca

SEQ ID NO: 1451682 - RNA, 15 nt, Homo sapiens
uuauaaaaagaauga

SEQ ID NO: 1451683 - RNA, 16 nt, Homo sapiens
uuauaaaaagaaugaa

SEQ ID NO: 1451684 - RNA, 16 nt, Homo sapiens
uuauaaaauuaagcaa

SEQ ID NO: 1451685 - RNA, 21 nt, Homo sapiens
uuauaaauaaacuguugcucg

SEQ ID NO: 1451686 - RNA, 13 nt, Homo sapiens
uugcuaagcauau

SEQ ID NO: 1451687 - RNA, 20 nt, Homo sapiens
uugcucaacagaacauaugu

SEQ ID NO: 1451688 - RNA, 11 nt, Homo sapiens
uugcucagggg

SEQ ID NO: 1451689 - RNA, 23 nt, Homo sapiens
uugcucagugggggcagagccac

SEQ ID NO: 1451690 - RNA, 13 nt, Homo sapiens
uugcucuccuaga

SEQ ID NO: 1451691 - RNA, 20 nt, Homo sapiens
uugcuuccccuuuugccaau

SEQ ID NO: 1451692 - RNA, 18 nt, Homo sapiens
uugcuucuccagugguga

SEQ ID NO: 1451693 - RNA, 14 nt, Homo sapiens
uugcuucucuagcu

SEQ ID NO: 1451694 - RNA, 18 nt, Homo sapiens
uugcuugggacauugcaa

SEQ ID NO: 1451695 - RNA, 22 nt, Homo sapiens
uugcuuuagcacaggacaacuu

SEQ ID NO: 1451696 - RNA, 16 nt, Homo sapiens
uugcuuugcugaccaa

SEQ ID NO: 1451697 - RNA, 13 nt, Homo sapiens
uuggaaacagaga

SEQ ID NO: 1451698 - RNA, 21 nt, Homo sapiens
uuggaagaggaacagcacugg

SEQ ID NO: 1451699 - RNA, 23 nt, Homo sapiens
uuggaagcauacaaagcaguuua

SEQ ID NO: 1451700 - RNA, 15 nt, Homo sapiens
uuggaaguacaugaa

SEQ ID NO: 1451701 - RNA, 18 nt, Homo sapiens
uuggaaguacaugaauac

SEQ ID NO: 1451702 - RNA, 13 nt, Homo sapiens
uuggaauggcaau

SEQ ID NO: 1451703 - RNA, 13 nt, Homo sapiens
uuggaauuuguaa

SEQ ID NO: 1451704 - RNA, 20 nt, Homo sapiens
uuggacaggagucagugucu

SEQ ID NO: 1451705 - RNA, 23 nt, Homo sapiens
uuggacugggugcggugacucau

SEQ ID NO: 1451706 - RNA, 21 nt, Homo sapiens
uuggagccaauguguggcuca

SEQ ID NO: 1451707 - RNA, 17 nt, Homo sapiens
uuggagguuaaggcaua

SEQ ID NO: 1451708 - RNA, 12 nt, Homo sapiens
uuggaucuugaa

SEQ ID NO: 1451709 - RNA, 21 nt, Homo sapiens
uuggaugggagugggcaccuc

SEQ ID NO: 1451710 - RNA, 15 nt, Homo sapiens
uuggcaaacuuugua

SEQ ID NO: 1451711 - RNA, 22 nt, Homo sapiens
uuggcaccagacacccaggacu

SEQ ID NO: 1451712 - RNA, 12 nt, Homo sapiens
uuggcccaggau

SEQ ID NO: 1451713 - RNA, 21 nt, Homo sapiens
uuggccgugguccagcucuug

SEQ ID NO: 1451714 - RNA, 19 nt, Homo sapiens
uuggccucccaaagugcua

SEQ ID NO: 1451715 - RNA, 23 nt, Homo sapiens
uuggccugucuuuggauuguuaa

SEQ ID NO: 1451716 - RNA, 23 nt, Homo sapiens
uuggcugggaagacuauggugcu

SEQ ID NO: 1451717 - RNA, 11 nt, Homo sapiens
uuggcugugag

SEQ ID NO: 1451718 - RNA, 14 nt, Homo sapiens
uugggacauugcaa

SEQ ID NO: 1451719 - RNA, 20 nt, Homo sapiens
uugggacauugcaauuugca

SEQ ID NO: 1451720 - RNA, 16 nt, Homo sapiens
uugggacccaaaacac

SEQ ID NO: 1451721 - RNA, 21 nt, Homo sapiens
uugggagcaccgccugugaaa

SEQ ID NO: 1451722 - RNA, 13 nt, Homo sapiens
uugggagcacugg

SEQ ID NO: 1451723 - RNA, 14 nt, Homo sapiens
uugggaggccaagg

SEQ ID NO: 1451724 - RNA, 16 nt, Homo sapiens
uugggauauucugaaa

SEQ ID NO: 1451725 - RNA, 14 nt, Homo sapiens
uugggcaacagagc

SEQ ID NO: 1451726 - RNA, 12 nt, Homo sapiens
uugggcauguga

SEQ ID NO: 1451727 - RNA, 18 nt, Homo sapiens
uugggcuauuuggacuca

SEQ ID NO: 1451728 - RNA, 15 nt, Homo sapiens
uuggggaaaaaagca

SEQ ID NO: 1451729 - RNA, 20 nt, Homo sapiens
uuggggaagccaggugagcu

SEQ ID NO: 1451730 - RNA, 16 nt, Homo sapiens
uuggguucacagugca

SEQ ID NO: 1451731 - RNA, 20 nt, Homo sapiens
uugguaaaacucacugugau

SEQ ID NO: 1451732 - RNA, 23 nt, Homo sapiens
uugguccagagcggaggcugugu

SEQ ID NO: 1451733 - RNA, 13 nt, Homo sapiens
uugguuacuucau

SEQ ID NO: 1451734 - RNA, 21 nt, Homo sapiens
uugguucaauaaagcacugag

SEQ ID NO: 1451735 - RNA, 16 nt, Homo sapiens
uugguuccuucugccc

SEQ ID NO: 1451736 - RNA, 18 nt, Homo sapiens
uugguuugcaaccucuuu

SEQ ID NO: 1451737 - RNA, 20 nt, Homo sapiens
uuguaaauacacauagcaug

SEQ ID NO: 1451738 - RNA, 19 nt, Homo sapiens
uuguaaauacugcuugacc

SEQ ID NO: 1451739 - RNA, 17 nt, Homo sapiens
uuguaacuaggcucaga

SEQ ID NO: 1451740 - RNA, 20 nt, Homo sapiens
uuguaagaguggaaccaaca

SEQ ID NO: 1451741 - RNA, 15 nt, Homo sapiens
uuguaagaguguaga

SEQ ID NO: 1451742 - RNA, 13 nt, Homo sapiens
uuguaagccauaa

SEQ ID NO: 1451743 - RNA, 17 nt, Homo sapiens
uuguaaugcugcacaga

SEQ ID NO: 1451744 - RNA, 14 nt, Homo sapiens
uuguacacugcugu

SEQ ID NO: 1451745 - RNA, 16 nt, Homo sapiens
uuguacagaauauuuc

SEQ ID NO: 1451746 - RNA, 17 nt, Homo sapiens
uuguaccauuuucuauc

SEQ ID NO: 1451747 - RNA, 18 nt, Homo sapiens
uuguaggagaaacuccca

SEQ ID NO: 1451748 - RNA, 23 nt, Homo sapiens
uuguauauuacacauuuguacag

SEQ ID NO: 1451749 - RNA, 19 nt, Homo sapiens
uuguaucaacacuguuacu

SEQ ID NO: 1451750 - RNA, 22 nt, Homo sapiens
uuguauuuuaacucauaccuuu

SEQ ID NO: 1451751 - RNA, 19 nt, Homo sapiens
uugucaaagaagucauucu

SEQ ID NO: 1451752 - RNA, 13 nt, Homo sapiens
uuguccacccacc

SEQ ID NO: 1451753 - RNA, 14 nt, Homo sapiens
uugucccucugcua

SEQ ID NO: 1451754 - RNA, 18 nt, Homo sapiens
uuguccugagauggaaaa

SEQ ID NO: 1451755 - RNA, 20 nt, Homo sapiens
uugucuguuuguuucaagaa

SEQ ID NO: 1451756 - RNA, 15 nt, Homo sapiens
uugucuuauugcacc

SEQ ID NO: 1451757 - RNA, 19 nt, Homo sapiens
uugucuuuucaaaauauua

SEQ ID NO: 1451758 - RNA, 21 nt, Homo sapiens
uugugaacuuuuuguagggga

SEQ ID NO: 1451759 - RNA, 23 nt, Homo sapiens
uugugaaguggaaauguucuaaa

SEQ ID NO: 1451760 - RNA, 15 nt, Homo sapiens
uugugagccaccacg

SEQ ID NO: 1451761 - RNA, 15 nt, Homo sapiens
uugugaugucuuuuc

SEQ ID NO: 1451762 - RNA, 16 nt, Homo sapiens
uugugauuucuuuaaa

SEQ ID NO: 1451763 - RNA, 23 nt, Homo sapiens
uugugauuuuuuuaauagugcuu

SEQ ID NO: 1451764 - RNA, 16 nt, Homo sapiens
uugugucagauuacca

SEQ ID NO: 1451765 - RNA, 13 nt, Homo sapiens
uugugugaugcgc

SEQ ID NO: 1451766 - RNA, 21 nt, Homo sapiens
uugugugugaugugaagccaa

SEQ ID NO: 1451767 - RNA, 17 nt, Homo sapiens
uugugugugggcuguga

SEQ ID NO: 1451768 - RNA, 21 nt, Homo sapiens
uuguguguuuauuucacuuga

SEQ ID NO: 1451769 - RNA, 14 nt, Homo sapiens
uuguguucugcucc

SEQ ID NO: 1451770 - RNA, 13 nt, Homo sapiens
uuguuacagcuuc

SEQ ID NO: 1451771 - RNA, 13 nt, Homo sapiens
uuguuauaccauu

SEQ ID NO: 1451772 - RNA, 18 nt, Homo sapiens
uuguuaucagauauguga

SEQ ID NO: 1451773 - RNA, 23 nt, Homo sapiens
uuguucaaacaauaucauaucau

SEQ ID NO: 1451774 - RNA, 16 nt, Homo sapiens
uuguucaguugccaag

SEQ ID NO: 1451775 - RNA, 19 nt, Homo sapiens
uuguucauccuauuguuga

SEQ ID NO: 1451776 - RNA, 19 nt, Homo sapiens
uuguugcaagaugugaauu

SEQ ID NO: 1451777 - RNA, 14 nt, Homo sapiens
uuguugcagccaaa

SEQ ID NO: 1451778 - RNA, 20 nt, Homo sapiens
uuguugccuucaucuucacu

SEQ ID NO: 1451779 - RNA, 13 nt, Homo sapiens
uuguuguugccaa

SEQ ID NO: 1451780 - RNA, 22 nt, Homo sapiens
uuguuuaauuuuuauuucuucc

SEQ ID NO: 1451781 - RNA, 21 nt, Homo sapiens
uuguuucccaucagacuguca

SEQ ID NO: 1451782 - RNA, 15 nt, Homo sapiens
uuguuucuuaugcca

SEQ ID NO: 1451783 - RNA, 15 nt, Homo sapiens
uuguuugucuuccau

SEQ ID NO: 1451784 - RNA, 19 nt, Homo sapiens
uguucugaggauucagggg

SEQ ID NO: 1451785 - RNA, 20 nt, Homo sapiens
uguucuggccucagaccaac

SEQ ID NO: 1451786 - RNA, 15 nt, Homo sapiens
uguucuguggcauag

SEQ ID NO: 1451787 - RNA, 14 nt, Homo sapiens
uguugaaguuuaca

SEQ ID NO: 1451788 - RNA, 12 nt, Homo sapiens
uguugacauaca

SEQ ID NO: 1451789 - RNA, 21 nt, Homo sapiens
uguugagccaggccugggucu

SEQ ID NO: 1451790 - RNA, 16 nt, Homo sapiens
uguugaggcugucaca

SEQ ID NO: 1451791 - RNA, 18 nt, Homo sapiens
uguugauaaaccauaaau

SEQ ID NO: 1451792 - RNA, 17 nt, Homo sapiens
uguugcaaacucagugc

SEQ ID NO: 1451793 - RNA, 14 nt, Homo sapiens
uguugcacacucac

SEQ ID NO: 1451794 - RNA, 10 nt, Homo sapiens
uguugccagc

SEQ ID NO: 1451795 - RNA, 21 nt, Homo sapiens
uguugccuaagcuggucucaa

SEQ ID NO: 1451796 - RNA, 17 nt, Homo sapiens
uguugcgcucccaccuc

SEQ ID NO: 1451797 - RNA, 16 nt, Homo sapiens
uguuggggcaguggua

SEQ ID NO: 1451798 - RNA, 20 nt, Homo sapiens
uguugguauuauauaauuca

SEQ ID NO: 1451799 - RNA, 18 nt, Homo sapiens
uguugguucuuagaccuc

SEQ ID NO: 1451800 - RNA, 13 nt, Homo sapiens
uguuguaugggga

SEQ ID NO: 1451801 - RNA, 20 nt, Homo sapiens
uguuguguauagaugcaaga

SEQ ID NO: 1451802 - RNA, 18 nt, Homo sapiens
uguuguugaggcugucac

SEQ ID NO: 1451803 - RNA, 15 nt, Homo sapiens
uguuuaaaguggcaa

SEQ ID NO: 1451804 - RNA, 21 nt, Homo sapiens
uguuuacuucucaccauuuga

SEQ ID NO: 1451805 - RNA, 22 nt, Homo sapiens
uguuuauucauccagcaguguu

SEQ ID NO: 1451806 - RNA, 17 nt, Homo sapiens
uguuucauuuaccucua

SEQ ID NO: 1451807 - RNA, 15 nt, Homo sapiens
uguuucccagauuuc

SEQ ID NO: 1451808 - RNA, 12 nt, Homo sapiens
uguuucucauau

SEQ ID NO: 1451809 - RNA, 22 nt, Homo sapiens
uguuucucugccgcuaccuccc

SEQ ID NO: 1451810 - RNA, 16 nt, Homo sapiens
uguuucuggauuugca

SEQ ID NO: 1451811 - RNA, 12 nt, Homo sapiens
uguuugccucau

SEQ ID NO: 1451812 - RNA, 16 nt, Homo sapiens
uguuuggacagcugau

SEQ ID NO: 1451813 - RNA, 23 nt, Homo sapiens
uguuugguaguuagccaucuaau

SEQ ID NO: 1451814 - RNA, 21 nt, Homo sapiens
uguuuuaaacucuccuaguca

SEQ ID NO: 1451815 - RNA, 16 nt, Homo sapiens
uguuuuaagacugaau

SEQ ID NO: 1451816 - RNA, 20 nt, Homo sapiens
uguuuuacccuauacaucca

SEQ ID NO: 1451817 - RNA, 21 nt, Homo sapiens
uguuuucucuggaaugguaca

SEQ ID NO: 1451818 - RNA, 21 nt, Homo sapiens
uguuuucugacuaauuaggca

SEQ ID NO: 1451819 - RNA, 22 nt, Homo sapiens
uguuuugauuuguagcacugag

SEQ ID NO: 1451820 - RNA, 13 nt, Homo sapiens
uguuuuuaagcug

SEQ ID NO: 1451821 - RNA, 20 nt, Homo sapiens
uguuuuucuuuuuccacaag

SEQ ID NO: 1451822 - RNA, 20 nt, Homo sapiens
uuaaaaaaaauuaaaaccaa

SEQ ID NO: 1451823 - RNA, 22 nt, Homo sapiens
uuaaaaaaaauuaaaaccaauu

SEQ ID NO: 1451824 - RNA, 22 nt, Homo sapiens
uuaaaaaaucucaaauuuggau

SEQ ID NO: 1451825 - RNA, 20 nt, Homo sapiens
uuaaaaacuagagcacagaa

SEQ ID NO: 1451826 - RNA, 16 nt, Homo sapiens
uuaaaaauagacacuc

SEQ ID NO: 1451827 - RNA, 16 nt, Homo sapiens
uuaaaaaucuguaaau

SEQ ID NO: 1451828 - RNA, 13 nt, Homo sapiens
uuaaaacacagcu

SEQ ID NO: 1451829 - RNA, 21 nt, Homo sapiens
uuaaaagggucguuaccagag

SEQ ID NO: 1451830 - RNA, 13 nt, Homo sapiens
uuaaaauaaugaa

SEQ ID NO: 1451831 - RNA, 19 nt, Homo sapiens
uuaaaaugagagucacuug

SEQ ID NO: 1451832 - RNA, 13 nt, Homo sapiens
uuaaaaugccaau

SEQ ID NO: 1451833 - RNA, 20 nt, Homo sapiens
uuaaaauugcuauguuacua

SEQ ID NO: 1451834 - RNA, 18 nt, Homo sapiens
uuaaaauuguaaccugca

SEQ ID NO: 1451835 - RNA, 17 nt, Homo sapiens
uuaaacaaaugguccau

SEQ ID NO: 1451836 - RNA, 20 nt, Homo sapiens
uuaaacagaugugaauauuc

SEQ ID NO: 1451837 - RNA, 18 nt, Homo sapiens
uuaaacauugaaguaaug

SEQ ID NO: 1451838 - RNA, 12 nt, Homo sapiens
uuaaacucaggg

SEQ ID NO: 1451839 - RNA, 11 nt, Homo sapiens
uuaaacucugu

SEQ ID NO: 1451840 - RNA, 17 nt, Homo sapiens
uuaaagacucaaggugg

SEQ ID NO: 1451841 - RNA, 18 nt, Homo sapiens
uuaaaggcaucuacacaa

SEQ ID NO: 1451842 - RNA, 22 nt, Homo sapiens
uuaaaggcugugguaguacucc

SEQ ID NO: 1451843 - RNA, 22 nt, Homo sapiens
uuaaaggguauacuaagugaua

SEQ ID NO: 1451844 - RNA, 19 nt, Homo sapiens
uuaaaggguguacuuauau

SEQ ID NO: 1451845 - RNA, 15 nt, Homo sapiens
uuaaaguuacuuugu

SEQ ID NO: 1451846 - RNA, 19 nt, Homo sapiens
uuaaauaaaguuacuugaa

SEQ ID NO: 1451847 - RNA, 16 nt, Homo sapiens
uuaaaucaaaagggag

SEQ ID NO: 1451848 - RNA, 20 nt, Homo sapiens
uuaaaugcaauaauuuuacu

SEQ ID NO: 1451849 - RNA, 19 nt, Homo sapiens
uuaaauggcaguauuucau

SEQ ID NO: 1451850 - RNA, 15 nt, Homo sapiens
uuaacaaaauccuca

SEQ ID NO: 1451851 - RNA, 23 nt, Homo sapiens
uuaacaaauuauguuacaucugu

SEQ ID NO: 1451852 - RNA, 13 nt, Homo sapiens
uuaacacauucaa

SEQ ID NO: 1451853 - RNA, 14 nt, Homo sapiens
uuaacacauucaau

SEQ ID NO: 1451854 - RNA, 21 nt, Homo sapiens
uuaacauacacguuaacugca

SEQ ID NO: 1451855 - RNA, 11 nt, Homo sapiens
uuaacaucuca

SEQ ID NO: 1451856 - RNA, 11 nt, Homo sapiens
uuaacaugucg

SEQ ID NO: 1451857 - RNA, 17 nt, Homo sapiens
uuaaccccauguccuca

SEQ ID NO: 1451858 - RNA, 13 nt, Homo sapiens
uuaaccuuuccag

SEQ ID NO: 1451859 - RNA, 18 nt, Homo sapiens
uuaacuuccaauuuacau

SEQ ID NO: 1451860 - RNA, 12 nt, Homo sapiens
uuaagaacuuca

SEQ ID NO: 1451861 - RNA, 22 nt, Homo sapiens
uuaagaauugaguaauggugua

SEQ ID NO: 1451862 - RNA, 18 nt, Homo sapiens
uuaagaauuucacaagcu

SEQ ID NO: 1451863 - RNA, 19 nt, Homo sapiens
uuaagauccacaaaugaag

SEQ ID NO: 1451864 - RNA, 21 nt, Homo sapiens
uuaagauuuuacaaaagagga

SEQ ID NO: 1451865 - RNA, 14 nt, Homo sapiens
uuaagcacuacaua

SEQ ID NO: 1451866 - RNA, 13 nt, Homo sapiens
uuaagcacuuuaa

SEQ ID NO: 1451867 - RNA, 21 nt, Homo sapiens
uuaagcagaggaauaacauca

SEQ ID NO: 1451868 - RNA, 20 nt, Homo sapiens
uuaagcagauggaaugcugu

SEQ ID NO: 1451869 - RNA, 18 nt, Homo sapiens
uuaagccuuauaaaccaa

SEQ ID NO: 1451870 - RNA, 16 nt, Homo sapiens
uuaagcuuucagcuca

SEQ ID NO: 1451871 - RNA, 21 nt, Homo sapiens
uuaaggaaacucuuaucucag

SEQ ID NO: 1451872 - RNA, 21 nt, Homo sapiens
uuaagguauuucgaaacugcc

SEQ ID NO: 1451873 - RNA, 22 nt, Homo sapiens
uuaaguagaaaaguugcagaug

SEQ ID NO: 1451874 - RNA, 22 nt, Homo sapiens
uuaaguauguuauuuucuguug

SEQ ID NO: 1451875 - RNA, 20 nt, Homo sapiens
uuaagugacuauagaaugca

SEQ ID NO: 1451876 - RNA, 20 nt, Homo sapiens
uuaaguuauugauguuuuaa

SEQ ID NO: 1451877 - RNA, 19 nt, Homo sapiens
uuaauaaagaauuaacaga

SEQ ID NO: 1451878 - RNA, 20 nt, Homo sapiens
uuaauaaauauuacagugaa

SEQ ID NO: 1451879 - RNA, 23 nt, Homo sapiens
uuaauaaucagcaagaauuugau

SEQ ID NO: 1451880 - RNA, 16 nt, Homo sapiens
uuaauacauugaucag

SEQ ID NO: 1451881 - RNA, 14 nt, Homo sapiens
uuaauaguauuuau

SEQ ID NO: 1451882 - RNA, 23 nt, Homo sapiens
uuaauauguuaaccucaguguca

SEQ ID NO: 1451883 - RNA, 22 nt, Homo sapiens
uuaauauuuaaacagcaguguu

SEQ ID NO: 1451884 - RNA, 23 nt, Homo sapiens
uuaaucauuuccccauaacucaa

SEQ ID NO: 1451885 - RNA, 21 nt, Homo sapiens
uuaauccuguaccaaaucuga

SEQ ID NO: 1451886 - RNA, 16 nt, Homo sapiens
ugcccugguccaggga

SEQ ID NO: 1451887 - RNA, 17 nt, Homo sapiens
ugcccugugcaugccau

SEQ ID NO: 1451888 - RNA, 18 nt, Homo sapiens
ugcccugugcaugccaug

SEQ ID NO: 1451889 - RNA, 22 nt, Homo sapiens
ugccgaaccaaaagaauuugca

SEQ ID NO: 1451890 - RNA, 17 nt, Homo sapiens
ugccguaacaacugugg

SEQ ID NO: 1451891 - RNA, 22 nt, Homo sapiens
ugccuagcaagcuggccucuac

SEQ ID NO: 1451892 - RNA, 15 nt, Homo sapiens
ugccuaguaacacau

SEQ ID NO: 1451893 - RNA, 15 nt, Homo sapiens
ugccucaaugccagu

SEQ ID NO: 1451894 - RNA, 19 nt, Homo sapiens
ugccucccagguuccagca

SEQ ID NO: 1451895 - RNA, 20 nt, Homo sapiens
ugccucuaccaguuggcaga

SEQ ID NO: 1451896 - RNA, 20 nt, Homo sapiens
ugccuggccaggcagaucug

SEQ ID NO: 1451897 - RNA, 21 nt, Homo sapiens
ugccuggcuucuuucucucag

SEQ ID NO: 1451898 - RNA, 19 nt, Homo sapiens
ugccuggugaauggccuuc

SEQ ID NO: 1451899 - RNA, 11 nt, Homo sapiens
ugccuguguau

SEQ ID NO: 1451900 - RNA, 21 nt, Homo sapiens
ugccuguuaaggaaacuuuau

SEQ ID NO: 1451901 - RNA, 21 nt, Homo sapiens
ugccuuacaggguaacugugc

SEQ ID NO: 1451902 - RNA, 13 nt, Homo sapiens
ugccuucaaacaa

SEQ ID NO: 1451903 - RNA, 20 nt, Homo sapiens
ugccuucaaaucaaucugua

SEQ ID NO: 1451904 - RNA, 16 nt, Homo sapiens
ugccuucacuuuacaa

SEQ ID NO: 1451905 - RNA, 22 nt, Homo sapiens
ugccuucagaggauaaauauca

SEQ ID NO: 1451906 - RNA, 20 nt, Homo sapiens
ugccuucaucuucacugcaa

SEQ ID NO: 1451907 - RNA, 16 nt, Homo sapiens
ugccuuccagccacau

SEQ ID NO: 1451908 - RNA, 16 nt, Homo sapiens
ugccuucuuauugcuu

SEQ ID NO: 1451909 - RNA, 22 nt, Homo sapiens
ugccuugcuagcugaccuggag

SEQ ID NO: 1451910 - RNA, 22 nt, Homo sapiens
ugccuugggccuugcugcugcu

SEQ ID NO: 1451911 - RNA, 18 nt, Homo sapiens
ugccuuucgaggccugaa

SEQ ID NO: 1451912 - RNA, 20 nt, Homo sapiens
ugcgaagacccucuugccca

SEQ ID NO: 1451913 - RNA, 17 nt, Homo sapiens
ugcgaccgugaccagga

SEQ ID NO: 1451914 - RNA, 21 nt, Homo sapiens
ugcgagacgcacacagcugag

SEQ ID NO: 1451915 - RNA, 22 nt, Homo sapiens
ugcgcagacccugccacucuca

SEQ ID NO: 1451916 - RNA, 22 nt, Homo sapiens
ugcgccaguccugcuaccuccc

SEQ ID NO: 1451917 - RNA, 15 nt, Homo sapiens
ugcgcucccaccuca

SEQ ID NO: 1451918 - RNA, 18 nt, Homo sapiens
ugcgggugaacaaagcag

SEQ ID NO: 1451919 - RNA, 13 nt, Homo sapiens
ugcgguuccucau

SEQ ID NO: 1451920 - RNA, 22 nt, Homo sapiens
ugcgugauucaaugaaccacaa

SEQ ID NO: 1451921 - RNA, 22 nt, Homo sapiens
ugcuaaaugcuacauacuccaa

SEQ ID NO: 1451922 - RNA, 12 nt, Homo sapiens
ugcuaacaaugc

SEQ ID NO: 1451923 - RNA, 12 nt, Homo sapiens
ugcuaaccugga

SEQ ID NO: 1451924 - RNA, 21 nt, Homo sapiens
ugcuaaucagggaggucauuu

SEQ ID NO: 1451925 - RNA, 20 nt, Homo sapiens
ugcuacaaauacucuuagga

SEQ ID NO: 1451926 - RNA, 17 nt, Homo sapiens
ugcuacacauacaggau

SEQ ID NO: 1451927 - RNA, 20 nt, Homo sapiens
ugcuacaguuauuaaucugg

SEQ ID NO: 1451928 - RNA, 14 nt, Homo sapiens
ugcuacauacucca

SEQ ID NO: 1451929 - RNA, 17 nt, Homo sapiens
ugcuacuuaauuccuuu

SEQ ID NO: 1451930 - RNA, 20 nt, Homo sapiens
ugcuagaugugcaaaugcaa

SEQ ID NO: 1451931 - RNA, 13 nt, Homo sapiens
ugcuaguauuuga

SEQ ID NO: 1451932 - RNA, 12 nt, Homo sapiens
ugcuauaaucau

SEQ ID NO: 1451933 - RNA, 19 nt, Homo sapiens
ugcuauagagccuaccugu

SEQ ID NO: 1451934 - RNA, 23 nt, Homo sapiens
ugcuauaggcuggagaagcucac

SEQ ID NO: 1451935 - RNA, 21 nt, Homo sapiens
ugcuauccccaucucccugcc

SEQ ID NO: 1451936 - RNA, 17 nt, Homo sapiens
ugcucaauaaacacuug

SEQ ID NO: 1451937 - RNA, 16 nt, Homo sapiens
ugcucauugaacuuua

SEQ ID NO: 1451938 - RNA, 20 nt, Homo sapiens
ugcucauuguaaccauuucu

SEQ ID NO: 1451939 - RNA, 14 nt, Homo sapiens
ugcuccagggcuuu

SEQ ID NO: 1451940 - RNA, 18 nt, Homo sapiens
ugcuccagugcaggagac

SEQ ID NO: 1451941 - RNA, 21 nt, Homo sapiens
ugcucccagcagcccuaagga

SEQ ID NO: 1451942 - RNA, 20 nt, Homo sapiens
ugcucccucagccucagagg

SEQ ID NO: 1451943 - RNA, 22 nt, Homo sapiens
ugcuccuuggcuuaccugaccu

SEQ ID NO: 1451944 - RNA, 17 nt, Homo sapiens
ugcucuaggaagacauu

SEQ ID NO: 1451945 - RNA, 21 nt, Homo sapiens
ugcucuaugaaacugcacauu

SEQ ID NO: 1451946 - RNA, 13 nt, Homo sapiens
ugcucugagccac

SEQ ID NO: 1451947 - RNA, 13 nt, Homo sapiens
ugcucugccaccc

SEQ ID NO: 1451948 - RNA, 21 nt, Homo sapiens
ugcucugguuagaaaaaggac

SEQ ID NO: 1451949 - RNA, 21 nt, Homo sapiens
ugcucugguuguuucuguucc

SEQ ID NO: 1451950 - RNA, 14 nt, Homo sapiens
ugcucuuugcugca

SEQ ID NO: 1451951 - RNA, 18 nt, Homo sapiens
ugcugaccagacagccuc

SEQ ID NO: 1451952 - RNA, 19 nt, Homo sapiens
ugcugagugaaugaacaaa

SEQ ID NO: 1451953 - RNA, 16 nt, Homo sapiens
ugcugauugaagacac

SEQ ID NO: 1451954 - RNA, 16 nt, Homo sapiens
ugcugcuacaaugucc

SEQ ID NO: 1451955 - RNA, 12 nt, Homo sapiens
ugcugcuuuaau

SEQ ID NO: 1451956 - RNA, 16 nt, Homo sapiens
ugcuggaaaugcugac

SEQ ID NO: 1451957 - RNA, 21 nt, Homo sapiens
ugcuggacgccgagaaggccu

SEQ ID NO: 1451958 - RNA, 17 nt, Homo sapiens
ugcuggaucacagcugc

SEQ ID NO: 1451959 - RNA, 22 nt, Homo sapiens
ugcuggcauuugcaccuaccuc

SEQ ID NO: 1451960 - RNA, 18 nt, Homo sapiens
ugcugggauuacaggcau

SEQ ID NO: 1451961 - RNA, 23 nt, Homo sapiens
ugcugggauuacaggcgugaucc

SEQ ID NO: 1451962 - RNA, 18 nt, Homo sapiens
ugcugggcugggcccucu

SEQ ID NO: 1451963 - RNA, 14 nt, Homo sapiens
ugcugguagcacuu

SEQ ID NO: 1451964 - RNA, 15 nt, Homo sapiens
ugcuguacccagaug

SEQ ID NO: 1451965 - RNA, 20 nt, Homo sapiens
ugcuguauaugcaaugucca

SEQ ID NO: 1451966 - RNA, 21 nt, Homo sapiens
ugcuguaugcugaucaucgcc

SEQ ID NO: 1451967 - RNA, 20 nt, Homo sapiens
ugcuguccugaucugugaua

SEQ ID NO: 1451968 - RNA, 22 nt, Homo sapiens
ugcugugaggcuguccuguaca

SEQ ID NO: 1451969 - RNA, 21 nt, Homo sapiens
ugcuguuauuuuaucugcuau

SEQ ID NO: 1451970 - RNA, 14 nt, Homo sapiens
ugcuguucagugcc

SEQ ID NO: 1451971 - RNA, 21 nt, Homo sapiens
ugcuguuucacaauaccucau

SEQ ID NO: 1451972 - RNA, 16 nt, Homo sapiens
ugauaauaauugauca

SEQ ID NO: 1451973 - RNA, 16 nt, Homo sapiens
ugauacaguacuuuga

SEQ ID NO: 1451974 - RNA, 23 nt, Homo sapiens
ugauacauguuuccaauuauccu

SEQ ID NO: 1451975 - RNA, 23 nt, Homo sapiens
ugauacauuuaagguauauugcu

SEQ ID NO: 1451976 - RNA, 15 nt, Homo sapiens
ugauaccacugcacu

SEQ ID NO: 1451977 - RNA, 14 nt, Homo sapiens
ugauacccugaauu

SEQ ID NO: 1451978 - RNA, 15 nt, Homo sapiens
ugauaccugcacugu

SEQ ID NO: 1451979 - RNA, 19 nt, Homo sapiens
ugauacgcaacauaauuaa

SEQ ID NO: 1451980 - RNA, 23 nt, Homo sapiens
ugauacucuuucuaaugcugaua

SEQ ID NO: 1451981 - RNA, 16 nt, Homo sapiens
ugauacuucacuacuu

SEQ ID NO: 1451982 - RNA, 12 nt, Homo sapiens
ugauacuuuuaa

SEQ ID NO: 1451983 - RNA, 16 nt, Homo sapiens
ugauagaaaagugugg

SEQ ID NO: 1451984 - RNA, 11 nt, Homo sapiens
ugauagcuuua

SEQ ID NO: 1451985 - RNA, 19 nt, Homo sapiens
ugauauggcagaagacacc

SEQ ID NO: 1451986 - RNA, 19 nt, Homo sapiens
ugauaugugaaugcucaua

SEQ ID NO: 1451987 - RNA, 23 nt, Homo sapiens
ugauauucaggcuacucauucag

SEQ ID NO: 1451988 - RNA, 21 nt, Homo sapiens
ugaucaaguccuuugugaaua

SEQ ID NO: 1451989 - RNA, 17 nt, Homo sapiens
ugaucagaguuccuccu

SEQ ID NO: 1451990 - RNA, 22 nt, Homo sapiens
ugaucagaguuccuccuacuua

SEQ ID NO: 1451991 - RNA, 16 nt, Homo sapiens
ugaucagcaucuguga

SEQ ID NO: 1451992 - RNA, 21 nt, Homo sapiens
ugaucauguguggaaguuauu

SEQ ID NO: 1451993 - RNA, 20 nt, Homo sapiens
ugaucauuauaucauuggaa

SEQ ID NO: 1451994 - RNA, 23 nt, Homo sapiens
ugaucauuuuccccccacucucc

SEQ ID NO: 1451995 - RNA, 22 nt, Homo sapiens
ugauccccaaguggugaaugac

SEQ ID NO: 1451996 - RNA, 23 nt, Homo sapiens
ugaucggagccuccucucucaaa

SEQ ID NO: 1451997 - RNA, 19 nt, Homo sapiens
ugaucuacuucauagcucc

SEQ ID NO: 1451998 - RNA, 19 nt, Homo sapiens
ugaucucggcucacugcaa

SEQ ID NO: 1451999 - RNA, 17 nt, Homo sapiens
ugaucucucuagcuuug

SEQ ID NO: 1452000 - RNA, 16 nt, Homo sapiens
ugaucuggacagaaca

SEQ ID NO: 1452001 - RNA, 17 nt, Homo sapiens
ugaucuugauugugggu

SEQ ID NO: 1452002 - RNA, 11 nt, Homo sapiens
ugaucuugccu

SEQ ID NO: 1452003 - RNA, 23 nt, Homo sapiens
ugaugaaauaaaacuacaugguc

SEQ ID NO: 1452004 - RNA, 12 nt, Homo sapiens
ugaugaagucac

SEQ ID NO: 1452005 - RNA, 16 nt, Homo sapiens
ugaugagaauuucuaa

SEQ ID NO: 1452006 - RNA, 13 nt, Homo sapiens
ugaugauuuugca

SEQ ID NO: 1452007 - RNA, 14 nt, Homo sapiens
ugaugccauggcag

SEQ ID NO: 1452008 - RNA, 17 nt, Homo sapiens
ugaugcuauuuaugcaa

SEQ ID NO: 1452009 - RNA, 13 nt, Homo sapiens
ugauggaaauauu

SEQ ID NO: 1452010 - RNA, 17 nt, Homo sapiens
ugauggcaacagaucug

SEQ ID NO: 1452011 - RNA, 15 nt, Homo sapiens
ugauggccaccagcu

SEQ ID NO: 1452012 - RNA, 19 nt, Homo sapiens
ugauggugacauugcaccu

SEQ ID NO: 1452013 - RNA, 19 nt, Homo sapiens
ugaugguggacuaagcaau

SEQ ID NO: 1452014 - RNA, 20 nt, Homo sapiens
ugauuaacaucuacaaucag

SEQ ID NO: 1452015 - RNA, 19 nt, Homo sapiens
ugauuacuaucauggcaua

SEQ ID NO: 1452016 - RNA, 21 nt, Homo sapiens
ugauuagaaggcaaguuucua

SEQ ID NO: 1452017 - RNA, 19 nt, Homo sapiens
ugauucauaguaacuucuu

SEQ ID NO: 1452018 - RNA, 22 nt, Homo sapiens
ugauucuccugccucagccucc

SEQ ID NO: 1452019 - RNA, 19 nt, Homo sapiens
ugauugacacacagcacuc

SEQ ID NO: 1452020 - RNA, 21 nt, Homo sapiens
ugauugacacacagcacucuc

SEQ ID NO: 1452021 - RNA, 18 nt, Homo sapiens
ugauuucacaacagauca

SEQ ID NO: 1452022 - RNA, 14 nt, Homo sapiens
ugauuucauuucaa

SEQ ID NO: 1452023 - RNA, 18 nt, Homo sapiens
ugauuuguagcacugagg

SEQ ID NO: 1452024 - RNA, 19 nt, Homo sapiens
ugauuuuacuuaacucauu

SEQ ID NO: 1452025 - RNA, 17 nt, Homo sapiens
ugauuuuagccaugccu

SEQ ID NO: 1452026 - RNA, 22 nt, Homo sapiens
ugauuuuuugcauuccugacaa

SEQ ID NO: 1452027 - RNA, 21 nt, Homo sapiens
ugcaaaaaaaaaaaaagcaau

SEQ ID NO: 1452028 - RNA, 16 nt, Homo sapiens
ugcaaaacacuaaaga

SEQ ID NO: 1452029 - RNA, 13 nt, Homo sapiens
ugcaaaacuuuag

SEQ ID NO: 1452030 - RNA, 23 nt, Homo sapiens
ugcaaaauacuguacauugugaa

SEQ ID NO: 1452031 - RNA, 12 nt, Homo sapiens
ugcaaaaucacu

SEQ ID NO: 1452032 - RNA, 13 nt, Homo sapiens
ugcaaaauuucca

SEQ ID NO: 1452033 - RNA, 23 nt, Homo sapiens
ugcaaagucaaaacuauagccau

SEQ ID NO: 1452034 - RNA, 22 nt, Homo sapiens
ugcaaauaggcagaauggaauc

SEQ ID NO: 1452035 - RNA, 19 nt, Homo sapiens
ugcaacccagucacacugu

SEQ ID NO: 1452036 - RNA, 22 nt, Homo sapiens
ugcaacccagucacacuguggc

SEQ ID NO: 1452037 - RNA, 16 nt, Homo sapiens
ugcaacccuuaccccu

SEQ ID NO: 1452038 - RNA, 21 nt, Homo sapiens
ugcaaccucuuggccugauca

SEQ ID NO: 1452039 - RNA, 21 nt, Homo sapiens
ugcaaccucuuugcucaacag

SEQ ID NO: 1452040 - RNA, 18 nt, Homo sapiens
ugcaacuggaguuccuua

SEQ ID NO: 1452041 - RNA, 15 nt, Homo sapiens
ugcaagcacaucugc

SEQ ID NO: 1452042 - RNA, 14 nt, Homo sapiens
ugcaagccagggau

SEQ ID NO: 1452043 - RNA, 19 nt, Homo sapiens
ugcaaggccugguguuucu

SEQ ID NO: 1452044 - RNA, 18 nt, Homo sapiens
ugcaagggggacacauga

SEQ ID NO: 1452045 - RNA, 18 nt, Homo sapiens
ugcaauaggugugcguca

SEQ ID NO: 1452046 - RNA, 15 nt, Homo sapiens
ugcaaucuucuacuu

SEQ ID NO: 1452047 - RNA, 19 nt, Homo sapiens
ugcaaugccuagacuuccc

SEQ ID NO: 1452048 - RNA, 14 nt, Homo sapiens
ugcacaagaaugga

SEQ ID NO: 1452049 - RNA, 23 nt, Homo sapiens
ugcacaagaauggaucacaagau

SEQ ID NO: 1452050 - RNA, 20 nt, Homo sapiens
ugcacacguuugugagcucc

SEQ ID NO: 1452051 - RNA, 16 nt, Homo sapiens
ugcacacucacuugua

SEQ ID NO: 1452052 - RNA, 16 nt, Homo sapiens
ugcacaggaugcuggc

SEQ ID NO: 1452053 - RNA, 23 nt, Homo sapiens
ugcacagggggaggccauaaaga

SEQ ID NO: 1452054 - RNA, 15 nt, Homo sapiens
ugcacaucuagugag

SEQ ID NO: 1452055 - RNA, 24 nt, Homo sapiens
ugcacaugauuguauaagcaugcu

SEQ ID NO: 1452056 - RNA, 17 nt, Homo sapiens
ugaaaagacucaguguu

SEQ ID NO: 1452057 - RNA, 12 nt, Homo sapiens
ugaaaagccaaa

SEQ ID NO: 1452058 - RNA, 15 nt, Homo sapiens
ugaaaagcuucuuaa

SEQ ID NO: 1452059 - RNA, 15 nt, Homo sapiens
ugaaaagguugccug

SEQ ID NO: 1452060 - RNA, 17 nt, Homo sapiens
ugaaaaguuacuaccug

SEQ ID NO: 1452061 - RNA, 20 nt, Homo sapiens
ugaaaauauuuuguugccuu

SEQ ID NO: 1452062 - RNA, 16 nt, Homo sapiens
ugaaaaugaauaucua

SEQ ID NO: 1452063 - RNA, 13 nt, Homo sapiens
ugaaaaugacauu

SEQ ID NO: 1452064 - RNA, 22 nt, Homo sapiens
ugaaaauguauguguaaguauu

SEQ ID NO: 1452065 - RNA, 19 nt, Homo sapiens
ugaaaauuuuuacauucau

SEQ ID NO: 1452066 - RNA, 13 nt, Homo sapiens
ugaaacacagcug

SEQ ID NO: 1452067 - RNA, 12 nt, Homo sapiens
ugaaaccaaaga

SEQ ID NO: 1452068 - RNA, 20 nt, Homo sapiens
ugaaaccaccgugaaccaga

SEQ ID NO: 1452069 - RNA, 15 nt, Homo sapiens
ugaaaccaugacugu

SEQ ID NO: 1452070 - RNA, 14 nt, Homo sapiens
ugaaacccacagau

SEQ ID NO: 1452071 - RNA, 11 nt, Homo sapiens
ugaaacuaaga

SEQ ID NO: 1452072 - RNA, 20 nt, Homo sapiens
ugaaacuauuuuaccugaac

SEQ ID NO: 1452073 - RNA, 13 nt, Homo sapiens
ugaaacugcauaa

SEQ ID NO: 1452074 - RNA, 23 nt, Homo sapiens
ugaaacuuguuuauuauguacaa

SEQ ID NO: 1452075 - RNA, 14 nt, Homo sapiens
ugaaagaaccagag

SEQ ID NO: 1452076 - RNA, 18 nt, Homo sapiens
ugacagaguucacuauaa

SEQ ID NO: 1452077 - RNA, 20 nt, Homo sapiens
ugacagcuucaugaaacugu

SEQ ID NO: 1452078 - RNA, 16 nt, Homo sapiens
ugacaguaaaucucac

SEQ ID NO: 1452079 - RNA, 19 nt, Homo sapiens
ugacauacauauuaucuca

SEQ ID NO: 1452080 - RNA, 18 nt, Homo sapiens
ugacaucucaguucacug

SEQ ID NO: 1452081 - RNA, 12 nt, Homo sapiens
ugacaugugcaa

SEQ ID NO: 1452082 - RNA, 23 nt, Homo sapiens
ugacauucacccuucaacauaaa

SEQ ID NO: 1452083 - RNA, 13 nt, Homo sapiens
ugacauuccaggg

SEQ ID NO: 1452084 - RNA, 17 nt, Homo sapiens
ugacauugcguuugacc

SEQ ID NO: 1452085 - RNA, 20 nt, Homo sapiens
ugacauuuauauauugaauu

SEQ ID NO: 1452086 - RNA, 20 nt, Homo sapiens
ugaccaaaacaaacaaacag

SEQ ID NO: 1452087 - RNA, 15 nt, Homo sapiens
ugaccaagaacugca

SEQ ID NO: 1452088 - RNA, 24 nt, Homo sapiens
ugaccaaguuauaaaucaauguca

SEQ ID NO: 1452089 - RNA, 12 nt, Homo sapiens
ugaccacagcac

SEQ ID NO: 1452090 - RNA, 13 nt, Homo sapiens
ugaccagaagccu

SEQ ID NO: 1452091 - RNA, 17 nt, Homo sapiens
ugaccaucugcuuuuau

SEQ ID NO: 1452092 - RNA, 17 nt, Homo sapiens
ugacccuccccuaguca

SEQ ID NO: 1452093 - RNA, 20 nt, Homo sapiens
ugacccucugacccuagcuc

SEQ ID NO: 1452094 - RNA, 24 nt, Homo sapiens
ugaccguacucucacauguggcaa

SEQ ID NO: 1452095 - RNA, 16 nt, Homo sapiens
ugaccucacugugacc

SEQ ID NO: 1452096 - RNA, 14 nt, Homo sapiens
ugaccucaggugau

SEQ ID NO: 1452097 - RNA, 15 nt, Homo sapiens
ugaccucccagugac

SEQ ID NO: 1452098 - RNA, 20 nt, Homo sapiens
ugaccucgcccuccacaaau

SEQ ID NO: 1452099 - RNA, 13 nt, Homo sapiens
ugaccucuugcug

SEQ ID NO: 1452100 - RNA, 17 nt, Homo sapiens
ugaccugugaccagcac

SEQ ID NO: 1452101 - RNA, 16 nt, Homo sapiens
ugaccuguuauuacca

SEQ ID NO: 1452102 - RNA, 14 nt, Homo sapiens
ugaccuugcugaug

SEQ ID NO: 1452103 - RNA, 15 nt, Homo sapiens
ugaccuuugaccucg

SEQ ID NO: 1452104 - RNA, 22 nt, Homo sapiens
ugacgacaagugcugaacagug

SEQ ID NO: 1452105 - RNA, 15 nt, Homo sapiens
ugacggcaccaucug

SEQ ID NO: 1452106 - RNA, 18 nt, Homo sapiens
ugacggcgcccccagugu

SEQ ID NO: 1452107 - RNA, 20 nt, Homo sapiens
ugacggucccacacugguga

SEQ ID NO: 1452108 - RNA, 19 nt, Homo sapiens
ugacuaaagcuauguuaca

SEQ ID NO: 1452109 - RNA, 17 nt, Homo sapiens
ugacuauggcuaccaaa

SEQ ID NO: 1452110 - RNA, 22 nt, Homo sapiens
ugacuauuauauuuccaagaaa

SEQ ID NO: 1452111 - RNA, 16 nt, Homo sapiens
ugacucacuuauccca

SEQ ID NO: 1452112 - RNA, 20 nt, Homo sapiens
ugacucauccccacagcugg

SEQ ID NO: 1452113 - RNA, 18 nt, Homo sapiens
ugacucccaaguuuccau

SEQ ID NO: 1452114 - RNA, 19 nt, Homo sapiens
ugacucccagaucagucag

SEQ ID NO: 1452115 - RNA, 13 nt, Homo sapiens
ugacuccuaccug

SEQ ID NO: 1452116 - RNA, 19 nt, Homo sapiens
ugacuccucuaagccacuc

SEQ ID NO: 1452117 - RNA, 15 nt, Homo sapiens
ugacucucacaagau

SEQ ID NO: 1452118 - RNA, 17 nt, Homo sapiens
ugacugaugcugagauu

SEQ ID NO: 1452119 - RNA, 16 nt, Homo sapiens
ugacugccacccacac

SEQ ID NO: 1452120 - RNA, 24 nt, Homo sapiens
ugacuguaacauauucuguaugaa

SEQ ID NO: 1452121 - RNA, 21 nt, Homo sapiens
ugacuuccugaacaaccagcu

SEQ ID NO: 1452122 - RNA, 22 nt, Homo sapiens
ugacuuccugaacaaccagcug

SEQ ID NO: 1452123 - RNA, 14 nt, Homo sapiens
ugacuuccugccau

SEQ ID NO: 1452124 - RNA, 19 nt, Homo sapiens
ugacuucuccaggucucac

SEQ ID NO: 1452125 - RNA, 17 nt, Homo sapiens
ugacuugugucccauga

SEQ ID NO: 1452126 - RNA, 20 nt, Homo sapiens
ugacuuucaguaaacauaaa

SEQ ID NO: 1452127 - RNA, 22 nt, Homo sapiens
ugacuuucugauuggugauuca

SEQ ID NO: 1452128 - RNA, 15 nt, Homo sapiens
ugacuuuuaauguca

SEQ ID NO: 1452129 - RNA, 17 nt, Homo sapiens
ugagaaauggccaaaua

SEQ ID NO: 1452130 - RNA, 23 nt, Homo sapiens
ugagaaaugggacuuaacuccuu

SEQ ID NO: 1452131 - RNA, 13 nt, Homo sapiens
ugagaacuccuga

SEQ ID NO: 1452132 - RNA, 14 nt, Homo sapiens
ugagaacuugacaa

SEQ ID NO: 1452133 - RNA, 15 nt, Homo sapiens
ugagaacuugacaag

SEQ ID NO: 1452134 - RNA, 14 nt, Homo sapiens
ugagaacuuuccau

SEQ ID NO: 1452135 - RNA, 20 nt, Homo sapiens
ugagaaggcagccaccagcg

SEQ ID NO: 1452136 - RNA, 15 nt, Homo sapiens
ugagaauguggaaua

SEQ ID NO: 1452137 - RNA, 20 nt, Homo sapiens
ugagaauguggaauaccuaa

SEQ ID NO: 1452138 - RNA, 20 nt, Homo sapiens
ugagacaguuucuuagcuuu

SEQ ID NO: 1452139 - RNA, 11 nt, Homo sapiens
ugagaccagug

SEQ ID NO: 1452140 - RNA, 18 nt, Homo sapiens
ugagaccaguguaucagg

SEQ ID NO: 1452141 - RNA, 19 nt, Homo sapiens
ugagagcugcucuggaaaa

SEQ ID NO: 1452142 - RNA, 14 nt, Homo sapiens
ugagaggcaaugau

SEQ ID NO: 1452143 - RNA, 22 nt, Homo sapiens
ugagaguaucaggucucccacg

SEQ ID NO: 1452144 - RNA, 15 nt, Homo sapiens
ugagagugaaaccau

SEQ ID NO: 1452145 - RNA, 19 nt, Homo sapiens
ugagauccggcaacaucaa

SEQ ID NO: 1452146 - RNA, 22 nt, Homo sapiens
ugagaugauacauccaaagcag

SEQ ID NO: 1452147 - RNA, 21 nt, Homo sapiens
ugagaugcuguaggugguaug

SEQ ID NO: 1452148 - RNA, 13 nt, Homo sapiens
ugagauucuucag

SEQ ID NO: 1452149 - RNA, 21 nt, Homo sapiens
ugagauuuccuccuggccuuu

SEQ ID NO: 1452150 - RNA, 17 nt, Homo sapiens
ugagcaaggacauugcc

SEQ ID NO: 1452151 - RNA, 22 nt, Homo sapiens
ugagcaaggagcacaagccaca

SEQ ID NO: 1452152 - RNA, 14 nt, Homo sapiens
ugagcaauggagug

SEQ ID NO: 1452153 - RNA, 23 nt, Homo sapiens
ugagcacuuagcaggcaccgcca

SEQ ID NO: 1452154 - RNA, 16 nt, Homo sapiens
ugagcagaagaucaag

SEQ ID NO: 1452155 - RNA, 19 nt, Homo sapiens
ugagcagugagcagaaagc

SEQ ID NO: 1452156 - RNA, 14 nt, Homo sapiens
ugagccacagacca

SEQ ID NO: 1452157 - RNA, 16 nt, Homo sapiens
ugagccaguggugcua

SEQ ID NO: 1452158 - RNA, 18 nt, Homo sapiens
ugagcccggaugcuucuc

SEQ ID NO: 1452159 - RNA, 14 nt, Homo sapiens
ugagcgcauggcaa

SEQ ID NO: 1452160 - RNA, 20 nt, Homo sapiens
ugagcgucacggccaagugu

SEQ ID NO: 1452161 - RNA, 18 nt, Homo sapiens
ugagcuccccagaucucc

SEQ ID NO: 1452162 - RNA, 20 nt, Homo sapiens
ugagcuggggacucagggac

SEQ ID NO: 1452163 - RNA, 18 nt, Homo sapiens
ugaggaaaugauccccaa

SEQ ID NO: 1452164 - RNA, 16 nt, Homo sapiens
ugaggaaggaacagca

SEQ ID NO: 1452165 - RNA, 14 nt, Homo sapiens
ugaggauugcugau

SEQ ID NO: 1452166 - RNA, 18 nt, Homo sapiens
ugaggcagauagcacugg

SEQ ID NO: 1452167 - RNA, 13 nt, Homo sapiens
ugaggcaggagaa

SEQ ID NO: 1452168 - RNA, 19 nt, Homo sapiens
ugaggcuauggaggguccu

SEQ ID NO: 1452169 - RNA, 14 nt, Homo sapiens
ugaggcugcaccca

SEQ ID NO: 1452170 - RNA, 23 nt, Homo sapiens
ugaggcugggcgucuaugcugcu

SEQ ID NO: 1452171 - RNA, 13 nt, Homo sapiens
ugaggcugucaca

SEQ ID NO: 1452172 - RNA, 21 nt, Homo sapiens
ugagggaggaagaaggcagug

SEQ ID NO: 1452173 - RNA, 14 nt, Homo sapiens
ugaggggucucgga

SEQ ID NO: 1452174 - RNA, 12 nt, Homo sapiens
ugaggggugcug

SEQ ID NO: 1452175 - RNA, 13 nt, Homo sapiens
ugaggggugcugg

SEQ ID NO: 1452176 - RNA, 15 nt, Homo sapiens
ugaggucacagucca

SEQ ID NO: 1452177 - RNA, 16 nt, Homo sapiens
ugaggucucuugaggg

SEQ ID NO: 1452178 - RNA, 20 nt, Homo sapiens
uaccugcacguucauaacca

SEQ ID NO: 1452179 - RNA, 22 nt, Homo sapiens
uaccuguaagggcaaagucaau

SEQ ID NO: 1452180 - RNA, 11 nt, Homo sapiens
uaccuguguac

SEQ ID NO: 1452181 - RNA, 15 nt, Homo sapiens
uaccuugaacucuua

SEQ ID NO: 1452182 - RNA, 16 nt, Homo sapiens
uaccuuuuauguagca

SEQ ID NO: 1452183 - RNA, 17 nt, Homo sapiens
uacguccugccuggcac

SEQ ID NO: 1452184 - RNA, 12 nt, Homo sapiens
uacgugccacuc

SEQ ID NO: 1452185 - RNA, 16 nt, Homo sapiens
uacguuugauacaaca

SEQ ID NO: 1452186 - RNA, 16 nt, Homo sapiens
uacuaaaacacugaaa

SEQ ID NO: 1452187 - RNA, 18 nt, Homo sapiens
uacuaaaguuuuacagaa

SEQ ID NO: 1452188 - RNA, 21 nt, Homo sapiens
uacuaauuccacaccuuuuau

SEQ ID NO: 1452189 - RNA, 22 nt, Homo sapiens
uacuaccugucaagguuugugu

SEQ ID NO: 1452190 - RNA, 13 nt, Homo sapiens
uacuagcacuuug

SEQ ID NO: 1452191 - RNA, 14 nt, Homo sapiens
uacuagcacuuuga

SEQ ID NO: 1452192 - RNA, 16 nt, Homo sapiens
uacuaguuuucaauca

SEQ ID NO: 1452193 - RNA, 22 nt, Homo sapiens
uacuccuuuugccacugcugug

SEQ ID NO: 1452194 - RNA, 20 nt, Homo sapiens
uacucuaucagagaaaaaca

SEQ ID NO: 1452195 - RNA, 17 nt, Homo sapiens
uacucuggggugcugcc

SEQ ID NO: 1452196 - RNA, 18 nt, Homo sapiens
uacugaaggaaaaacaca

SEQ ID NO: 1452197 - RNA, 16 nt, Homo sapiens
uacugauaauuuugcu

SEQ ID NO: 1452198 - RNA, 13 nt, Homo sapiens
uacugaucuuacu

SEQ ID NO: 1452199 - RNA, 13 nt, Homo sapiens
uacugaugaaaua

SEQ ID NO: 1452200 - RNA, 12 nt, Homo sapiens
uacugcugugaa

SEQ ID NO: 1452201 - RNA, 22 nt, Homo sapiens
uacuggacgcuguccugagaug

SEQ ID NO: 1452202 - RNA, 16 nt, Homo sapiens
uacuggauuugacuuc

SEQ ID NO: 1452203 - RNA, 15 nt, Homo sapiens
uacugggagaaucac

SEQ ID NO: 1452204 - RNA, 17 nt, Homo sapiens
uacugggugucauuuca

SEQ ID NO: 1452205 - RNA, 23 nt, Homo sapiens
uacugggugucauuucauuccau

SEQ ID NO: 1452206 - RNA, 13 nt, Homo sapiens
uacuguaauuccu

SEQ ID NO: 1452207 - RNA, 12 nt, Homo sapiens
uacuguacuuaa

SEQ ID NO: 1452208 - RNA, 21 nt, Homo sapiens
uucuuaaggaagaagaguauu

SEQ ID NO: 1452209 - RNA, 14 nt, Homo sapiens
uucuuacaugcauu

SEQ ID NO: 1452210 - RNA, 18 nt, Homo sapiens
uucuuacccaauuuccca

SEQ ID NO: 1452211 - RNA, 14 nt, Homo sapiens
uucuuacugcuuaa

SEQ ID NO: 1452212 - RNA, 14 nt, Homo sapiens
uucuuagucauuac

SEQ ID NO: 1452213 - RNA, 14 nt, Homo sapiens
uucuucagggccag

SEQ ID NO: 1452214 - RNA, 14 nt, Homo sapiens
uucuucauacuuaa

SEQ ID NO: 1452215 - RNA, 14 nt, Homo sapiens
uucuucaugaucca

SEQ ID NO: 1452216 - RNA, 17 nt, Homo sapiens
uucuucaugcaaugaca

SEQ ID NO: 1452217 - RNA, 12 nt, Homo sapiens
uucuucauuuca

SEQ ID NO: 1452218 - RNA, 20 nt, Homo sapiens
uucuuccccuuacucucaca

SEQ ID NO: 1452219 - RNA, 21 nt, Homo sapiens
uucuuccuuaaagcauuugca

SEQ ID NO: 1452220 - RNA, 12 nt, Homo sapiens
uucuucuagcuc

SEQ ID NO: 1452221 - RNA, 18 nt, Homo sapiens
uucuugcuacccaugacu

SEQ ID NO: 1452222 - RNA, 18 nt, Homo sapiens
uucuugcucuaucucuca

SEQ ID NO: 1452223 - RNA, 20 nt, Homo sapiens
uucuugcuuucaauuacaaa

SEQ ID NO: 1452224 - RNA, 22 nt, Homo sapiens
uucuuggugcucuguguuccca

SEQ ID NO: 1452225 - RNA, 15 nt, Homo sapiens
uucuuggugguggau

SEQ ID NO: 1452226 - RNA, 15 nt, Homo sapiens
uucuuuacaauuuca

SEQ ID NO: 1452227 - RNA, 20 nt, Homo sapiens
uucuuuaccaaggauauuua

SEQ ID NO: 1452228 - RNA, 12 nt, Homo sapiens
uucuuucucuca

SEQ ID NO: 1452229 - RNA, 12 nt, Homo sapiens
uucuuucugucu

SEQ ID NO: 1452230 - RNA, 20 nt, Homo sapiens
uucuuugacaccacaccauc

SEQ ID NO: 1452231 - RNA, 14 nt, Homo sapiens
uucuuuggaggcag

SEQ ID NO: 1452232 - RNA, 13 nt, Homo sapiens
uucuuugugccuu

SEQ ID NO: 1452233 - RNA, 14 nt, Homo sapiens
uucuuuucacuucg

SEQ ID NO: 1452234 - RNA, 16 nt, Homo sapiens
uugaaaacucacagaa

SEQ ID NO: 1452235 - RNA, 16 nt, Homo sapiens
uugaaacaaucugaau

SEQ ID NO: 1452236 - RNA, 22 nt, Homo sapiens
uugaaacagcagucccaguauu

SEQ ID NO: 1452237 - RNA, 13 nt, Homo sapiens
uugaaaccaaaga

SEQ ID NO: 1452238 - RNA, 15 nt, Homo sapiens
uugaaagaaccagag

SEQ ID NO: 1452239 - RNA, 17 nt, Homo sapiens
uugaaauacuaaaagca

SEQ ID NO: 1452240 - RNA, 21 nt, Homo sapiens
uugaaaucaaugcaagaguga

SEQ ID NO: 1452241 - RNA, 15 nt, Homo sapiens
uugaaaugcuguuag

SEQ ID NO: 1452242 - RNA, 21 nt, Homo sapiens
uugaacauguuuaauggguau

SEQ ID NO: 1452243 - RNA, 20 nt, Homo sapiens
uugaaccauccacuuacaua

SEQ ID NO: 1452244 - RNA, 20 nt, Homo sapiens
uugaacucuuagugauugag

SEQ ID NO: 1452245 - RNA, 13 nt, Homo sapiens
uugaacugaaguc

SEQ ID NO: 1452246 - RNA, 18 nt, Homo sapiens
uugaagagcauugcaugg

SEQ ID NO: 1452247 - RNA, 15 nt, Homo sapiens
uugaaguacuuaaca

SEQ ID NO: 1452248 - RNA, 15 nt, Homo sapiens
uugaaguagcucuuu

SEQ ID NO: 1452249 - RNA, 22 nt, Homo sapiens
uugaagucaugcuccccugugc

SEQ ID NO: 1452250 - RNA, 13 nt, Homo sapiens
uugaagucuauaa

SEQ ID NO: 1452251 - RNA, 21 nt, Homo sapiens
uugaauggguccauuuugccc

SEQ ID NO: 1452252 - RNA, 17 nt, Homo sapiens
uugaauguggucucagg

SEQ ID NO: 1452253 - RNA, 14 nt, Homo sapiens
uugaaugugucagg

SEQ ID NO: 1452254 - RNA, 22 nt, Homo sapiens
uugaauuguaggugacuauuau

SEQ ID NO: 1452255 - RNA, 15 nt, Homo sapiens
uugacaaaacccacu

SEQ ID NO: 1452256 - RNA, 11 nt, Homo sapiens
uugacaaugau

SEQ ID NO: 1452257 - RNA, 18 nt, Homo sapiens
uugacacugaaaguuuug

SEQ ID NO: 1452258 - RNA, 12 nt, Homo sapiens
uugacacugaac

SEQ ID NO: 1452259 - RNA, 13 nt, Homo sapiens
uugacaggauuau

SEQ ID NO: 1452260 - RNA, 16 nt, Homo sapiens
uugacauacauucccu

SEQ ID NO: 1452261 - RNA, 15 nt, Homo sapiens
uugacaucagcauua

SEQ ID NO: 1452262 - RNA, 23 nt, Homo sapiens
uugaccgcaacucacacauuccc

SEQ ID NO: 1452263 - RNA, 14 nt, Homo sapiens
uugaccuugaccau

SEQ ID NO: 1452264 - RNA, 21 nt, Homo sapiens
uugacuaaagcuauguuacau

SEQ ID NO: 1452265 - RNA, 15 nt, Homo sapiens
uugacuagugcaauu

SEQ ID NO: 1452266 - RNA, 13 nt, Homo sapiens
uugacucaguucc

SEQ ID NO: 1452267 - RNA, 19 nt, Homo sapiens
uugacucuaaaugcaguuu

SEQ ID NO: 1452268 - RNA, 12 nt, Homo sapiens
uugacugcauug

SEQ ID NO: 1452269 - RNA, 12 nt, Homo sapiens
uugagacauuua

SEQ ID NO: 1452270 - RNA, 15 nt, Homo sapiens
uugagacauuuacau

SEQ ID NO: 1452271 - RNA, 21 nt, Homo sapiens
uugagcugauauaaauucugu

SEQ ID NO: 1452272 - RNA, 14 nt, Homo sapiens
uugagcuucugggg

SEQ ID NO: 1452273 - RNA, 18 nt, Homo sapiens
uugaggggcccuggccag

SEQ ID NO: 1452274 - RNA, 17 nt, Homo sapiens
uugaguagaguugauca

SEQ ID NO: 1452275 - RNA, 16 nt, Homo sapiens
uugauaccugcacugu

SEQ ID NO: 1452276 - RNA, 15 nt, Homo sapiens
uugauauuaucuaca

SEQ ID NO: 1452277 - RNA, 20 nt, Homo sapiens
uugaucccuguuacccagag

SEQ ID NO: 1452278 - RNA, 16 nt, Homo sapiens
uugaugaaaagauuua

SEQ ID NO: 1452279 - RNA, 14 nt, Homo sapiens
uugauuaaaacauu

SEQ ID NO: 1452280 - RNA, 22 nt, Homo sapiens
uugauugaggagcugcacugau

SEQ ID NO: 1452281 - RNA, 15 nt, Homo sapiens
uugauuuuaaugaau

SEQ ID NO: 1452282 - RNA, 21 nt, Homo sapiens
uugauuuuaaugaaugccuaa

SEQ ID NO: 1452283 - RNA, 17 nt, Homo sapiens
uugauuuuauaugcuau

SEQ ID NO: 1452284 - RNA, 22 nt, Homo sapiens
augguuauuuaugcacuguggg

SEQ ID NO: 1452285 - RNA, 15 nt, Homo sapiens
augguugccaggacg

SEQ ID NO: 1452286 - RNA, 14 nt, Homo sapiens
augguuuuacucau

SEQ ID NO: 1452287 - RNA, 21 nt, Homo sapiens
auguaaaagaacuuacugauu

SEQ ID NO: 1452288 - RNA, 21 nt, Homo sapiens
auguaacgaaugguacuacaa

SEQ ID NO: 1452289 - RNA, 14 nt, Homo sapiens
auguaacugugcca

SEQ ID NO: 1452290 - RNA, 16 nt, Homo sapiens
auguaagaauucagaa

SEQ ID NO: 1452291 - RNA, 21 nt, Homo sapiens
auguaauugaauaaaguugaa

SEQ ID NO: 1452292 - RNA, 16 nt, Homo sapiens
auguaauuuaggguac

SEQ ID NO: 1452293 - RNA, 14 nt, Homo sapiens
auguacaacugcac

SEQ ID NO: 1452294 - RNA, 18 nt, Homo sapiens
auguacaugaagaagcua

SEQ ID NO: 1452295 - RNA, 16 nt, Homo sapiens
auguacuuguuugcaa

SEQ ID NO: 1452296 - RNA, 21 nt, Homo sapiens
auguagaauauauuuccuuau

SEQ ID NO: 1452297 - RNA, 21 nt, Homo sapiens
auguagcaaaacgcauggagu

SEQ ID NO: 1452298 - RNA, 15 nt, Homo sapiens
auguagcacauaaac

SEQ ID NO: 1452299 - RNA, 15 nt, Homo sapiens
auguagcccauccuu

SEQ ID NO: 1452300 - RNA, 21 nt, Homo sapiens
auguauaaacauaaguugcau

SEQ ID NO: 1452301 - RNA, 16 nt, Homo sapiens
auguauaaaugugaua

SEQ ID NO: 1452302 - RNA, 18 nt, Homo sapiens
auguauauauacacggua

SEQ ID NO: 1452303 - RNA, 17 nt, Homo sapiens
auguaucaguguccuuu

SEQ ID NO: 1452304 - RNA, 20 nt, Homo sapiens
auguaucccaacuccuauaa

SEQ ID NO: 1452305 - RNA, 21 nt, Homo sapiens
auguaucuuggugcugcugaa

SEQ ID NO: 1452306 - RNA, 16 nt, Homo sapiens
auguaugacaagacaa

SEQ ID NO: 1452307 - RNA, 14 nt, Homo sapiens
auguauguauuuau

SEQ ID NO: 1452308 - RNA, 22 nt, Homo sapiens
augucaacuucuggcuccucaa

SEQ ID NO: 1452309 - RNA, 15 nt, Homo sapiens
augucacauucuauu

SEQ ID NO: 1452310 - RNA, 19 nt, Homo sapiens
augucagacagaacuugaa

SEQ ID NO: 1452311 - RNA, 12 nt, Homo sapiens
augucauuuagu

SEQ ID NO: 1452312 - RNA, 11 nt, Homo sapiens
auguccaaaga

SEQ ID NO: 1452313 - RNA, 15 nt, Homo sapiens
augucccugggccag

SEQ ID NO: 1452314 - RNA, 23 nt, Homo sapiens
auguccggcugaaggcugagugu

SEQ ID NO: 1452315 - RNA, 13 nt, Homo sapiens
auguccucagggc

SEQ ID NO: 1452316 - RNA, 19 nt, Homo sapiens
augucgaugcacaguaucu

SEQ ID NO: 1452317 - RNA, 22 nt, Homo sapiens
augucuauaaucccagcacuuu

SEQ ID NO: 1452318 - RNA, 21 nt, Homo sapiens
augucucuuuggcgaccuccu

SEQ ID NO: 1452319 - RNA, 15 nt, Homo sapiens
augucugauaaugau

SEQ ID NO: 1452320 - RNA, 15 nt, Homo sapiens
augucuuaguuauaa

SEQ ID NO: 1452321 - RNA, 20 nt, Homo sapiens
augucuucucguuaaggaga

SEQ ID NO: 1452322 - RNA, 16 nt, Homo sapiens
augugaaaacaucuca

SEQ ID NO: 1452323 - RNA, 17 nt, Homo sapiens
augugaaaacaucucaa

SEQ ID NO: 1452324 - RNA, 12 nt, Homo sapiens
augugaagccaa

SEQ ID NO: 1452325 - RNA, 11 nt, Homo sapiens
augugaagggu

SEQ ID NO: 1452326 - RNA, 18 nt, Homo sapiens
augugaauuauugacacu

SEQ ID NO: 1452327 - RNA, 20 nt, Homo sapiens
augugagagauucugugauc

SEQ ID NO: 1452328 - RNA, 17 nt, Homo sapiens
augugauauaaggauuu

SEQ ID NO: 1452329 - RNA, 16 nt, Homo sapiens
augugaugcaagccag

SEQ ID NO: 1452330 - RNA, 15 nt, Homo sapiens
augugcacccggccu

SEQ ID NO: 1452331 - RNA, 10 nt, Homo sapiens
augugccuuu

SEQ ID NO: 1452332 - RNA, 22 nt, Homo sapiens
auguggaccuuagaauacaguu

SEQ ID NO: 1452333 - RNA, 19 nt, Homo sapiens
auguggagaagagugcccu

SEQ ID NO: 1452334 - RNA, 19 nt, Homo sapiens
auguggagcucagcaacaa

SEQ ID NO: 1452335 - RNA, 16 nt, Homo sapiens
auguggauaacuuuac

SEQ ID NO: 1452336 - RNA, 15 nt, Homo sapiens
auuuccaacaccaca

SEQ ID NO: 1452337 - RNA, 18 nt, Homo sapiens
auuuccaacaccacagac

SEQ ID NO: 1452338 - RNA, 13 nt, Homo sapiens
auuuccacaaaau

SEQ ID NO: 1452339 - RNA, 21 nt, Homo sapiens
auuucccuaaaauacauuuaa

SEQ ID NO: 1452340 - RNA, 18 nt, Homo sapiens
auuucccugcagaccuca

SEQ ID NO: 1452341 - RNA, 19 nt, Homo sapiens
auuuccucagcuuaucucu

SEQ ID NO: 1452342 - RNA, 18 nt, Homo sapiens
auuuccugauaacauuau

SEQ ID NO: 1452343 - RNA, 14 nt, Homo sapiens
auuuccuguucccu

SEQ ID NO: 1452344 - RNA, 20 nt, Homo sapiens
auuuccuuuauacugugaag

SEQ ID NO: 1452345 - RNA, 14 nt, Homo sapiens
auuucgaaacugcc

SEQ ID NO: 1452346 - RNA, 14 nt, Homo sapiens
auuucuaaucaaaa

SEQ ID NO: 1452347 - RNA, 20 nt, Homo sapiens
auuucuagaagcacaugugu

SEQ ID NO: 1452348 - RNA, 22 nt, Homo sapiens
auuucuccaggauuuccugcuu

SEQ ID NO: 1452349 - RNA, 23 nt, Homo sapiens
auuucugguuguuaugugaucau

SEQ ID NO: 1452350 - RNA, 12 nt, Homo sapiens
auuucugugauu

SEQ ID NO: 1452351 - RNA, 18 nt, Homo sapiens
auuucuguucacuuugua

SEQ ID NO: 1452352 - RNA, 22 nt, Homo sapiens
auuucuucaaauccuuccaaaa

SEQ ID NO: 1452353 - RNA, 11 nt, Homo sapiens
auuucuuccca

SEQ ID NO: 1452354 - RNA, 17 nt, Homo sapiens
auuucuucuacugcuau

SEQ ID NO: 1452355 - RNA, 21 nt, Homo sapiens
auuucuuuucuggccaaaagc

SEQ ID NO: 1452356 - RNA, 17 nt, Homo sapiens
auuugaaaccaggacau

SEQ ID NO: 1452357 - RNA, 21 nt, Homo sapiens
auuugaaaccaggacauuaaa

SEQ ID NO: 1452358 - RNA, 19 nt, Homo sapiens
auuugaagcaucacauaaa

SEQ ID NO: 1452359 - RNA, 22 nt, Homo sapiens
auuugaauagccuguuccuuua

SEQ ID NO: 1452360 - RNA, 18 nt, Homo sapiens
auuugaccggaucuacac

SEQ ID NO: 1452361 - RNA, 22 nt, Homo sapiens
auuugaccggaucuacacccac

SEQ ID NO: 1452362 - RNA, 19 nt, Homo sapiens
auuugaggucaaguaagaa

SEQ ID NO: 1452363 - RNA, 19 nt, Homo sapiens
auuugcaaaggcgacaaua

SEQ ID NO: 1452364 - RNA, 15 nt, Homo sapiens
auuugcaacauuuac

SEQ ID NO: 1452365 - RNA, 17 nt, Homo sapiens
auuugcacacugcacug

SEQ ID NO: 1452366 - RNA, 21 nt, Homo sapiens
auuugcagguauuauaccauu

SEQ ID NO: 1452367 - RNA, 14 nt, Homo sapiens
auuugcauggauuu

SEQ ID NO: 1452368 - RNA, 21 nt, Homo sapiens
auuugccuucugaaaugugac

SEQ ID NO: 1452369 - RNA, 15 nt, Homo sapiens
auuuggauugcuaau

SEQ ID NO: 1452370 - RNA, 20 nt, Homo sapiens
auuugggagggaaaagggaa

SEQ ID NO: 1452371 - RNA, 20 nt, Homo sapiens
auuugggccugcuccagacc

SEQ ID NO: 1452372 - RNA, 15 nt, Homo sapiens
auuugggugaacaaa

SEQ ID NO: 1452373 - RNA, 22 nt, Homo sapiens
auuuggucacacucucaccuag

SEQ ID NO: 1452374 - RNA, 17 nt, Homo sapiens
auuuggucugccagaau

SEQ ID NO: 1452375 - RNA, 17 nt, Homo sapiens
auuuguaaaucugccac

SEQ ID NO: 1452376 - RNA, 20 nt, Homo sapiens
auuuguaacacagucauucu

SEQ ID NO: 1452377 - RNA, 20 nt, Homo sapiens
auuuguaauugaacuuaucc

SEQ ID NO: 1452378 - RNA, 21 nt, Homo sapiens
auuuguaccucuaaguacaua

SEQ ID NO: 1452379 - RNA, 13 nt, Homo sapiens
auuuguagcacug

SEQ ID NO: 1452380 - RNA, 20 nt, Homo sapiens
auuuguaguggaaacauuua

SEQ ID NO: 1452381 - RNA, 17 nt, Homo sapiens
auuugucauucauucaa

SEQ ID NO: 1452382 - RNA, 15 nt, Homo sapiens
auuugugagacugua

SEQ ID NO: 1452383 - RNA, 14 nt, Homo sapiens
auuuguuaucucaa

SEQ ID NO: 1452384 - RNA, 13 nt, Homo sapiens
auuuguuccugcu

SEQ ID NO: 1452385 - RNA, 14 nt, Homo sapiens
auuuguuucaaugg

SEQ ID NO: 1452386 - RNA, 13 nt, Homo sapiens
auuuuaaagacaa

SEQ ID NO: 1452387 - RNA, 14 nt, Homo sapiens
auuuuaaagacaaa

SEQ ID NO: 1452388 - RNA, 13 nt, Homo sapiens
cacuggacacuuc

SEQ ID NO: 1452389 - RNA, 19 nt, Homo sapiens
cacuggagguugaagccaa

SEQ ID NO: 1452390 - RNA, 14 nt, Homo sapiens
cacuggaugcagaa

SEQ ID NO: 1452391 - RNA, 19 nt, Homo sapiens
cacuggcuucaggcaaagc

SEQ ID NO: 1452392 - RNA, 23 nt, Homo sapiens
cacugggaugagccgcugugagc

SEQ ID NO: 1452393 - RNA, 22 nt, Homo sapiens
cacugguggccgugguggggcc

SEQ ID NO: 1452394 - RNA, 21 nt, Homo sapiens
cacugguuuggucaguuacaa

SEQ ID NO: 1452395 - RNA, 19 nt, Homo sapiens
cacugguuuguucccugug

SEQ ID NO: 1452396 - RNA, 22 nt, Homo sapiens
cacuguaauuaaaacuauuuag

SEQ ID NO: 1452397 - RNA, 23 nt, Homo sapiens
cacuguacuuguagaguggugcu

SEQ ID NO: 1452398 - RNA, 16 nt, Homo sapiens
cacugucacccuccac

SEQ ID NO: 1452399 - RNA, 20 nt, Homo sapiens
cacugucaugcuucaucauu

SEQ ID NO: 1452400 - RNA, 21 nt, Homo sapiens
cacuguccugggccugcagaa

SEQ ID NO: 1452401 - RNA, 19 nt, Homo sapiens
cacugucuccuuucucuua

SEQ ID NO: 1452402 - RNA, 22 nt, Homo sapiens
cacugucugagaauuuccaaaa

SEQ ID NO: 1452403 - RNA, 16 nt, Homo sapiens
cacugugagcaccuga

SEQ ID NO: 1452404 - RNA, 15 nt, Homo sapiens
cacuguggagcucag

SEQ ID NO: 1452405 - RNA, 23 nt, Homo sapiens
cacuguuacuuucguacauuggc

SEQ ID NO: 1452406 - RNA, 22 nt, Homo sapiens
cacuguugcaaacucagugcaa

SEQ ID NO: 1452407 - RNA, 17 nt, Homo sapiens
cacuuaagacuguguau

SEQ ID NO: 1452408 - RNA, 17 nt, Homo sapiens
cacuuaaugauacaugu

SEQ ID NO: 1452409 - RNA, 18 nt, Homo sapiens
cacuuacacuuuaugcac

SEQ ID NO: 1452410 - RNA, 19 nt, Homo sapiens
cacuuaguccuuuaucauc

SEQ ID NO: 1452411 - RNA, 18 nt, Homo sapiens
cacuuagucuguacuuca

SEQ ID NO: 1452412 - RNA, 17 nt, Homo sapiens
cacuuaucccaagagaa

SEQ ID NO: 1452413 - RNA, 13 nt, Homo sapiens
cacuucaucugau

SEQ ID NO: 1452414 - RNA, 16 nt, Homo sapiens
cacuuccccacaggcu

SEQ ID NO: 1452415 - RNA, 19 nt, Homo sapiens
cacuuccuuuuaccugccc

SEQ ID NO: 1452416 - RNA, 18 nt, Homo sapiens
cacuucuaaaugcauauc

SEQ ID NO: 1452417 - RNA, 13 nt, Homo sapiens
cacuugagaggau

SEQ ID NO: 1452418 - RNA, 20 nt, Homo sapiens
cacuugccuucuucacccag

SEQ ID NO: 1452419 - RNA, 13 nt, Homo sapiens
cacuuggaugcag

SEQ ID NO: 1452420 - RNA, 23 nt, Homo sapiens
cacuugggccacacuacccaccu

SEQ ID NO: 1452421 - RNA, 17 nt, Homo sapiens
cacuuuaacugacuuaa

SEQ ID NO: 1452422 - RNA, 13 nt, Homo sapiens
cacuuuacuacuc

SEQ ID NO: 1452423 - RNA, 15 nt, Homo sapiens
cacuuuagaaagcug

SEQ ID NO: 1452424 - RNA, 20 nt, Homo sapiens
cacuuuagauauacauauca

SEQ ID NO: 1452425 - RNA, 17 nt, Homo sapiens
cacuuuagggcuguaaa

SEQ ID NO: 1452426 - RNA, 16 nt, Homo sapiens
cacuuuauaaauauca

SEQ ID NO: 1452427 - RNA, 19 nt, Homo sapiens
cacuuucauuauagcagag

SEQ ID NO: 1452428 - RNA, 19 nt, Homo sapiens
cacuuugagaagcugaggu

SEQ ID NO: 1452429 - RNA, 22 nt, Homo sapiens
cacuuugcacugauauaucaug

SEQ ID NO: 1452430 - RNA, 19 nt, Homo sapiens
cacuuugggaggcugaggc

SEQ ID NO: 1452431 - RNA, 15 nt, Homo sapiens
cacuuuguccauuug

SEQ ID NO: 1452432 - RNA, 18 nt, Homo sapiens
cacuuugucuaacucaga

SEQ ID NO: 1452433 - RNA, 16 nt, Homo sapiens
cacuuuguugcaagau

SEQ ID NO: 1452434 - RNA, 22 nt, Homo sapiens
cacuuuguugcaagaugugaau

SEQ ID NO: 1452435 - RNA, 14 nt, Homo sapiens
cacuuuucugcaag

SEQ ID NO: 1452436 - RNA, 15 nt, Homo sapiens
cacuuuuguucugcu

SEQ ID NO: 1452437 - RNA, 20 nt, Homo sapiens
cagaaaauauuauguguuuc

SEQ ID NO: 1452438 - RNA, 22 nt, Homo sapiens
cagagggguaggcagagccuuu

SEQ ID NO: 1452439 - RNA, 15 nt, Homo sapiens
cagaggguacuuuaa

SEQ ID NO: 1452440 - RNA, 16 nt, Homo sapiens
cagagguugcagugag

SEQ ID NO: 1452441 - RNA, 13 nt, Homo sapiens
cagaguaucagau

SEQ ID NO: 1452442 - RNA, 11 nt, Homo sapiens
cagagugugaa

SEQ ID NO: 1452443 - RNA, 14 nt, Homo sapiens
cagaguuguugcuu

SEQ ID NO: 1452444 - RNA, 18 nt, Homo sapiens
cagauaaaacauggacaa

SEQ ID NO: 1452445 - RNA, 14 nt, Homo sapiens
cagauaacucuccu

SEQ ID NO: 1452446 - RNA, 14 nt, Homo sapiens
cagauaacuuugac

SEQ ID NO: 1452447 - RNA, 20 nt, Homo sapiens
cagauaagacauaucucuaa

SEQ ID NO: 1452448 - RNA, 18 nt, Homo sapiens
cagauagagaaauaguga

SEQ ID NO: 1452449 - RNA, 21 nt, Homo sapiens
cagauagcacugggugugaga

SEQ ID NO: 1452450 - RNA, 15 nt, Homo sapiens
cagauccccacuguc

SEQ ID NO: 1452451 - RNA, 14 nt, Homo sapiens
cagauccucacaac

SEQ ID NO: 1452452 - RNA, 16 nt, Homo sapiens
cagaucgcaccacugc

SEQ ID NO: 1452453 - RNA, 16 nt, Homo sapiens
cagaugauuguucaaa

SEQ ID NO: 1452454 - RNA, 13 nt, Homo sapiens
cagaugcaguuug

SEQ ID NO: 1452455 - RNA, 19 nt, Homo sapiens
cagaugccuacaaccaucc

SEQ ID NO: 1452456 - RNA, 21 nt, Homo sapiens
cagaugccucagccuacuuuc

SEQ ID NO: 1452457 - RNA, 21 nt, Homo sapiens
cagaugcuguuaguaccuaca

SEQ ID NO: 1452458 - RNA, 17 nt, Homo sapiens
cagauggcaauuucacu

SEQ ID NO: 1452459 - RNA, 14 nt, Homo sapiens
cagauggcacuuug

SEQ ID NO: 1452460 - RNA, 19 nt, Homo sapiens
cagauggggcacugaccca

SEQ ID NO: 1452461 - RNA, 21 nt, Homo sapiens
cagaugugaaaacaucucaau

SEQ ID NO: 1452462 - RNA, 20 nt, Homo sapiens
cagaugugagccaccgugcc

SEQ ID NO: 1452463 - RNA, 22 nt, Homo sapiens
cagauuggguuggaaugcuuuc

SEQ ID NO: 1452464 - RNA, 16 nt, Homo sapiens
cagauuucagaucaua

SEQ ID NO: 1452465 - RNA, 16 nt, Homo sapiens
cagauuuuacaaaaga

SEQ ID NO: 1452466 - RNA, 16 nt, Homo sapiens
cagauuuugcuguaua

SEQ ID NO: 1452467 - RNA, 16 nt, Homo sapiens
cagcaaugacaucuca

SEQ ID NO: 1452468 - RNA, 17 nt, Homo sapiens
cagcaaugccauuucag

SEQ ID NO: 1452469 - RNA, 20 nt, Homo sapiens
cagcaauucuccugccucag

SEQ ID NO: 1452470 - RNA, 16 nt, Homo sapiens
cagcaccaaccacagc

SEQ ID NO: 1452471 - RNA, 20 nt, Homo sapiens
cagcacucugaaacugagaa

SEQ ID NO: 1452472 - RNA, 15 nt, Homo sapiens
cagcacucuuaucua

SEQ ID NO: 1452473 - RNA, 17 nt, Homo sapiens
cagcacucuuaucuaca

SEQ ID NO: 1452474 - RNA, 20 nt, Homo sapiens
cagcacuggaagccagagaa

SEQ ID NO: 1452475 - RNA, 13 nt, Homo sapiens
cagcagcccucaa

SEQ ID NO: 1452476 - RNA, 17 nt, Homo sapiens
cagcagcugaacagcca

SEQ ID NO: 1452477 - RNA, 17 nt, Homo sapiens
cagcagcuucaccagag

SEQ ID NO: 1452478 - RNA, 19 nt, Homo sapiens
cagcaggagagacugagca

SEQ ID NO: 1452479 - RNA, 18 nt, Homo sapiens
cagcaggcauggauccag

SEQ ID NO: 1452480 - RNA, 16 nt, Homo sapiens
cagcaggggaggugag

SEQ ID NO: 1452481 - RNA, 14 nt, Homo sapiens
cagcagugaguaau

SEQ ID NO: 1452482 - RNA, 23 nt, Homo sapiens
cagcagugaguaaucaauacaga

SEQ ID NO: 1452483 - RNA, 22 nt, Homo sapiens
cagcauccaccuuggcucugcc

SEQ ID NO: 1452484 - RNA, 14 nt, Homo sapiens
cagcaucugugaug

SEQ ID NO: 1452485 - RNA, 14 nt, Homo sapiens
cagcaucuuuaaca

SEQ ID NO: 1452486 - RNA, 21 nt, Homo sapiens
cagcaugaaaaugcaguuucu

SEQ ID NO: 1452487 - RNA, 16 nt, Homo sapiens
cagcaugccugaacua

SEQ ID NO: 1452488 - RNA, 15 nt, Homo sapiens
cagcaugccuucaaa

SEQ ID NO: 1452489 - RNA, 20 nt, Homo sapiens
cagcaugccuucaaaucaau

SEQ ID NO: 1452490 - RNA, 15 nt, Homo sapiens
cagugaccacaccaa

SEQ ID NO: 1452491 - RNA, 23 nt, Homo sapiens
cagugaccccugaccucacugug

SEQ ID NO: 1452492 - RNA, 16 nt, Homo sapiens
cagugagcugagauca

SEQ ID NO: 1452493 - RNA, 17 nt, Homo sapiens
cagugaugcugugcuau

SEQ ID NO: 1452494 - RNA, 16 nt, Homo sapiens
cagugccaacuccuca

SEQ ID NO: 1452495 - RNA, 22 nt, Homo sapiens
cagugccagcaaugacaucuca

SEQ ID NO: 1452496 - RNA, 16 nt, Homo sapiens
cagugccagcaccugc

SEQ ID NO: 1452497 - RNA, 15 nt, Homo sapiens
cagugcccuacaaag

SEQ ID NO: 1452498 - RNA, 22 nt, Homo sapiens
cagugccuggacaaaugaugcc

SEQ ID NO: 1452499 - RNA, 16 nt, Homo sapiens
cagugccuuccauaau

SEQ ID NO: 1452500 - RNA, 16 nt, Homo sapiens
cagugcgguuccucau

SEQ ID NO: 1452501 - RNA, 18 nt, Homo sapiens
cagugcugggaccagagc

SEQ ID NO: 1452502 - RNA, 18 nt, Homo sapiens
caguggauugauuauaaa

SEQ ID NO: 1452503 - RNA, 17 nt, Homo sapiens
caguggcagacaaacag

SEQ ID NO: 1452504 - RNA, 16 nt, Homo sapiens
caguggcaugauguca

SEQ ID NO: 1452505 - RNA, 21 nt, Homo sapiens
cagugggcguugggagccuag

SEQ ID NO: 1452506 - RNA, 19 nt, Homo sapiens
caguggggccuguggaaug

SEQ ID NO: 1452507 - RNA, 17 nt, Homo sapiens
cagugguauccugugac

SEQ ID NO: 1452508 - RNA, 23 nt, Homo sapiens
cagugguauccugugacauguaa

SEQ ID NO: 1452509 - RNA, 16 nt, Homo sapiens
caguggugacauaguc

SEQ ID NO: 1452510 - RNA, 19 nt, Homo sapiens
cagugguuuuauacugaag

SEQ ID NO: 1452511 - RNA, 22 nt, Homo sapiens
caguguaauaauaaaucguccu

SEQ ID NO: 1452512 - RNA, 16 nt, Homo sapiens
caguguaauccagggg

SEQ ID NO: 1452513 - RNA, 14 nt, Homo sapiens
caguguacauggaa

SEQ ID NO: 1452514 - RNA, 20 nt, Homo sapiens
cagugucugugccauggauu

SEQ ID NO: 1452515 - RNA, 15 nt, Homo sapiens
cagugucuuccauaa

SEQ ID NO: 1452516 - RNA, 16 nt, Homo sapiens
cagugucuuccauaau

SEQ ID NO: 1452517 - RNA, 14 nt, Homo sapiens
cagugugacaucua

SEQ ID NO: 1452518 - RNA, 18 nt, Homo sapiens
caguguuccccaucuggg

SEQ ID NO: 1452519 - RNA, 13 nt, Homo sapiens
caguguucucaca

SEQ ID NO: 1452520 - RNA, 18 nt, Homo sapiens
caguguuuuaaauucuga

SEQ ID NO: 1452521 - RNA, 17 nt, Homo sapiens
caguuaccacacaucua

SEQ ID NO: 1452522 - RNA, 20 nt, Homo sapiens
caguuaggguuuugcaauaa

SEQ ID NO: 1452523 - RNA, 20 nt, Homo sapiens
caguuaugugaaugaucucu

SEQ ID NO: 1452524 - RNA, 23 nt, Homo sapiens
caguuauuaaucuggacauucga

SEQ ID NO: 1452525 - RNA, 16 nt, Homo sapiens
caguucaccuugaaga

SEQ ID NO: 1452526 - RNA, 22 nt, Homo sapiens
caguucagacacuaccccauau

SEQ ID NO: 1452527 - RNA, 21 nt, Homo sapiens
caguuccuguagaacugagaa

SEQ ID NO: 1452528 - RNA, 19 nt, Homo sapiens
caguucucacuccuaggag

SEQ ID NO: 1452529 - RNA, 16 nt, Homo sapiens
caguucucucccuucc

SEQ ID NO: 1452530 - RNA, 14 nt, Homo sapiens
caguucugucauau

SEQ ID NO: 1452531 - RNA, 18 nt, Homo sapiens
caguucuuugggccagac

SEQ ID NO: 1452532 - RNA, 16 nt, Homo sapiens
caguugaucaaugaau

SEQ ID NO: 1452533 - RNA, 14 nt, Homo sapiens
caguugggacucag

SEQ ID NO: 1452534 - RNA, 21 nt, Homo sapiens
caguuggggaagccaggugag

SEQ ID NO: 1452535 - RNA, 20 nt, Homo sapiens
caguuucagguguuuaguug

SEQ ID NO: 1452536 - RNA, 15 nt, Homo sapiens
caguuugauaccugc

SEQ ID NO: 1452537 - RNA, 19 nt, Homo sapiens
caguuuuauaaaaagugga

SEQ ID NO: 1452538 - RNA, 23 nt, Homo sapiens
caguuuuauauuuauaagccuua

SEQ ID NO: 1452539 - RNA, 21 nt, Homo sapiens
caguuuuaucuuuaaucuccu

SEQ ID NO: 1452540 - RNA, 19 nt, Homo sapiens
caucugcaguacagucuua

SEQ ID NO: 1452541 - RNA, 18 nt, Homo sapiens
caucuggaaggacaucua

SEQ ID NO: 1452542 - RNA, 15 nt, Homo sapiens
caucuggaaucugga

SEQ ID NO: 1452543 - RNA, 17 nt, Homo sapiens
caucuggauuuucacac

SEQ ID NO: 1452544 - RNA, 16 nt, Homo sapiens
caucuucacugcaauu

SEQ ID NO: 1452545 - RNA, 17 nt, Homo sapiens
caucuugaucaaccaaa

SEQ ID NO: 1452546 - RNA, 18 nt, Homo sapiens
caucuugaucaaccaaaa

SEQ ID NO: 1452547 - RNA, 14 nt, Homo sapiens
caucuuuaacacag

SEQ ID NO: 1452548 - RNA, 15 nt, Homo sapiens
caucuuuaacacagc

SEQ ID NO: 1452549 - RNA, 23 nt, Homo sapiens
caucuuuguggcgggagugcuca

SEQ ID NO: 1452550 - RNA, 19 nt, Homo sapiens
caugaaaauagcucuuuca

SEQ ID NO: 1452551 - RNA, 19 nt, Homo sapiens
caugaaaauuuuaaaaaua

SEQ ID NO: 1452552 - RNA, 14 nt, Homo sapiens
caugaaacugucca

SEQ ID NO: 1452553 - RNA, 18 nt, Homo sapiens
caugaaaguggacaagga

SEQ ID NO: 1452554 - RNA, 16 nt, Homo sapiens
caugaaauucuuccua

SEQ ID NO: 1452555 - RNA, 15 nt, Homo sapiens
caugaaccaagugga

SEQ ID NO: 1452556 - RNA, 18 nt, Homo sapiens
caugaagcccaagugaaa

SEQ ID NO: 1452557 - RNA, 21 nt, Homo sapiens
caugaagcccaagugaaauca

SEQ ID NO: 1452558 - RNA, 16 nt, Homo sapiens
caugaagcgaaacaca

SEQ ID NO: 1452559 - RNA, 18 nt, Homo sapiens
caugaaggauaaaagccc

SEQ ID NO: 1452560 - RNA, 21 nt, Homo sapiens
caugaauauaaaugggaaauc

SEQ ID NO: 1452561 - RNA, 17 nt, Homo sapiens
caugaauccaguccaga

SEQ ID NO: 1452562 - RNA, 17 nt, Homo sapiens
caugaauguaucaggaa

SEQ ID NO: 1452563 - RNA, 19 nt, Homo sapiens
caugacaaacacacaucca

SEQ ID NO: 1452564 - RNA, 13 nt, Homo sapiens
caugacauaugac

SEQ ID NO: 1452565 - RNA, 18 nt, Homo sapiens
caugaccugcgcucucag

SEQ ID NO: 1452566 - RNA, 18 nt, Homo sapiens
caugaccugugaccagca

SEQ ID NO: 1452567 - RNA, 18 nt, Homo sapiens
caugagaaagaauuugag

SEQ ID NO: 1452568 - RNA, 18 nt, Homo sapiens
caugagaccacuguuauc

SEQ ID NO: 1452569 - RNA, 22 nt, Homo sapiens
caugagcuauuuccauuccaga

SEQ ID NO: 1452570 - RNA, 17 nt, Homo sapiens
caugaggacagaccaca

SEQ ID NO: 1452571 - RNA, 19 nt, Homo sapiens
caugaggccaucucaggag

SEQ ID NO: 1452572 - RNA, 16 nt, Homo sapiens
caugauaaaugauaga

SEQ ID NO: 1452573 - RNA, 16 nt, Homo sapiens
caugaucauagcucac

SEQ ID NO: 1452574 - RNA, 14 nt, Homo sapiens
caugaugagaguuu

SEQ ID NO: 1452575 - RNA, 13 nt, Homo sapiens
caugaugcugccc

SEQ ID NO: 1452576 - RNA, 18 nt, Homo sapiens
caugauggcaacagaucu

SEQ ID NO: 1452577 - RNA, 15 nt, Homo sapiens
caugauguagagugu

SEQ ID NO: 1452578 - RNA, 19 nt, Homo sapiens
caugauguuaaccagaaua

SEQ ID NO: 1452579 - RNA, 14 nt, Homo sapiens
caugauucuuuaau

SEQ ID NO: 1452580 - RNA, 16 nt, Homo sapiens
caugauuuccuugaau

SEQ ID NO: 1452581 - RNA, 17 nt, Homo sapiens
caugauuuccuugaaug

SEQ ID NO: 1452582 - RNA, 11 nt, Homo sapiens
caugcacacac

SEQ ID NO: 1452583 - RNA, 22 nt, Homo sapiens
caugcacacacacacaucucau

SEQ ID NO: 1452584 - RNA, 21 nt, Homo sapiens
caugcagcaaggggacaucuu

SEQ ID NO: 1452585 - RNA, 22 nt, Homo sapiens
caugcagcaaggggacaucuua

SEQ ID NO: 1452586 - RNA, 23 nt, Homo sapiens
caugcaggcccuuugaagccuca

SEQ ID NO: 1452587 - RNA, 22 nt, Homo sapiens
caugcaguugcagugaauucau

SEQ ID NO: 1452588 - RNA, 18 nt, Homo sapiens
caugcaguugugggaccg

SEQ ID NO: 1452589 - RNA, 21 nt, Homo sapiens
caugcauggauggguccucac

SEQ ID NO: 1452590 - RNA, 16 nt, Homo sapiens
caugcauguuugguua

SEQ ID NO: 1452591 - RNA, 22 nt, Homo sapiens
aaucaacaaaauggucauccaa

SEQ ID NO: 1452592 - RNA, 23 nt, Homo sapiens
aaucaagcuuuugcuugauccag

SEQ ID NO: 1452593 - RNA, 20 nt, Homo sapiens
aaucaaguuguaacuuauau

SEQ ID NO: 1452594 - RNA, 13 nt, Homo sapiens
aaucaaucugcag

SEQ ID NO: 1452595 - RNA, 21 nt, Homo sapiens
aaucaaucuguaaaacuaaga

SEQ ID NO: 1452596 - RNA, 19 nt, Homo sapiens
aaucaaugcaagagugauu

SEQ ID NO: 1452597 - RNA, 11 nt, Homo sapiens
aaucacacugu

SEQ ID NO: 1452598 - RNA, 18 nt, Homo sapiens
aaucaccauguaagcacu

SEQ ID NO: 1452599 - RNA, 14 nt, Homo sapiens
aaucagcauucuca

SEQ ID NO: 1452600 - RNA, 12 nt, Homo sapiens
aaucagugaaga

SEQ ID NO: 1452601 - RNA, 16 nt, Homo sapiens
aaucauaaaacuugau

SEQ ID NO: 1452602 - RNA, 16 nt, Homo sapiens
aaucauacuuagcaaa

SEQ ID NO: 1452603 - RNA, 21 nt, Homo sapiens
aaucauaguuuaaacugcauu

SEQ ID NO: 1452604 - RNA, 23 nt, Homo sapiens
aaucaucuauaaagaagaacuug

SEQ ID NO: 1452605 - RNA, 21 nt, Homo sapiens
aaucaugugggugagccagug

SEQ ID NO: 1452606 - RNA, 17 nt, Homo sapiens
aauccagagagcuuaaa

SEQ ID NO: 1452607 - RNA, 19 nt, Homo sapiens
aauccagcuacgaauauag

SEQ ID NO: 1452608 - RNA, 20 nt, Homo sapiens
aauccaggcagauccaggac

SEQ ID NO: 1452609 - RNA, 22 nt, Homo sapiens
aauccauuaucgagcagcauuu

SEQ ID NO: 1452610 - RNA, 15 nt, Homo sapiens
aaucccagcuacuug

SEQ ID NO: 1452611 - RNA, 21 nt, Homo sapiens
aaucccagggaaggacuugga

SEQ ID NO: 1452612 - RNA, 14 nt, Homo sapiens
aauccgaaguauga

SEQ ID NO: 1452613 - RNA, 20 nt, Homo sapiens
aauccgcauugauggccuca

SEQ ID NO: 1452614 - RNA, 13 nt, Homo sapiens
aauccuggaccaa

SEQ ID NO: 1452615 - RNA, 20 nt, Homo sapiens
aauccuucccugcucuugca

SEQ ID NO: 1452616 - RNA, 15 nt, Homo sapiens
aauccuuuacuguua

SEQ ID NO: 1452617 - RNA, 15 nt, Homo sapiens
aauccuuucugccca

SEQ ID NO: 1452618 - RNA, 22 nt, Homo sapiens
aaucgacuguauucgugcauuu

SEQ ID NO: 1452619 - RNA, 21 nt, Homo sapiens
aaucguccagcgaccuuccuc

SEQ ID NO: 1452620 - RNA, 17 nt, Homo sapiens
aaucuaaggauaaugaa

SEQ ID NO: 1452621 - RNA, 17 nt, Homo sapiens
aaucuaggaagcucaga

SEQ ID NO: 1452622 - RNA, 13 nt, Homo sapiens
aaucuaggugugg

SEQ ID NO: 1452623 - RNA, 16 nt, Homo sapiens
aaucucacaaaugauc

SEQ ID NO: 1452624 - RNA, 15 nt, Homo sapiens
aaucucccacuccag

SEQ ID NO: 1452625 - RNA, 16 nt, Homo sapiens
aaucucccacuccagc

SEQ ID NO: 1452626 - RNA, 16 nt, Homo sapiens
aaucucuugcacucaa

SEQ ID NO: 1452627 - RNA, 21 nt, Homo sapiens
aaucugaagaagaaaugaaua

SEQ ID NO: 1452628 - RNA, 22 nt, Homo sapiens
aaucugaagauugcgguuuaca

SEQ ID NO: 1452629 - RNA, 21 nt, Homo sapiens
aaucugaccaaaacaaacaaa

SEQ ID NO: 1452630 - RNA, 20 nt, Homo sapiens
aaucugagccagugcuuuaa

SEQ ID NO: 1452631 - RNA, 23 nt, Homo sapiens
aaucugagccagugcuuuaaugg

SEQ ID NO: 1452632 - RNA, 13 nt, Homo sapiens
aaucugagcugca

SEQ ID NO: 1452633 - RNA, 22 nt, Homo sapiens
aaucugaguagagcagccacaa

SEQ ID NO: 1452634 - RNA, 16 nt, Homo sapiens
aaucugcucacuuuaa

SEQ ID NO: 1452635 - RNA, 20 nt, Homo sapiens
aaucugcugcauagcucuau

SEQ ID NO: 1452636 - RNA, 14 nt, Homo sapiens
aaucugugaugaca

SEQ ID NO: 1452637 - RNA, 17 nt, Homo sapiens
aaucugugaugacauuc

SEQ ID NO: 1452638 - RNA, 20 nt, Homo sapiens
aaucugugaugacauucccu

SEQ ID NO: 1452639 - RNA, 12 nt, Homo sapiens
aaucuucuacuu

SEQ ID NO: 1452640 - RNA, 20 nt, Homo sapiens
aaucuuuggguaacuucaaa

SEQ ID NO: 1452641 - RNA, 13 nt, Homo sapiens
aaugaaacacagc

SEQ ID NO: 1452642 - RNA, 14 nt, Homo sapiens
aggacuacaaccaa

SEQ ID NO: 1452643 - RNA, 17 nt, Homo sapiens
aggacuauagcccaggu

SEQ ID NO: 1452644 - RNA, 11 nt, Homo sapiens
aggacucuucc

SEQ ID NO: 1452645 - RNA, 22 nt, Homo sapiens
aggacugagcacccucuggauu

SEQ ID NO: 1452646 - RNA, 15 nt, Homo sapiens
aggacuugaaagcau

SEQ ID NO: 1452647 - RNA, 17 nt, Homo sapiens
aggacuuguuuacaaag

SEQ ID NO: 1452648 - RNA, 17 nt, Homo sapiens
aggagaaucacuggaac

SEQ ID NO: 1452649 - RNA, 20 nt, Homo sapiens
aggagaaugaauacugggaa

SEQ ID NO: 1452650 - RNA, 18 nt, Homo sapiens
aggagaccacggggagca

SEQ ID NO: 1452651 - RNA, 22 nt, Homo sapiens
aggagaccuacccuccacaggc

SEQ ID NO: 1452652 - RNA, 22 nt, Homo sapiens
aggagaccuggcacuggaugca

SEQ ID NO: 1452653 - RNA, 23 nt, Homo sapiens
aggagacuuuacauggaugccaa

SEQ ID NO: 1452654 - RNA, 15 nt, Homo sapiens
aggagacuuucaugc

SEQ ID NO: 1452655 - RNA, 16 nt, Homo sapiens
aggagacuuucaugca

SEQ ID NO: 1452656 - RNA, 19 nt, Homo sapiens
aggagacuuucaugcagcc

SEQ ID NO: 1452657 - RNA, 16 nt, Homo sapiens
aggagccgaccgggaa

SEQ ID NO: 1452658 - RNA, 15 nt, Homo sapiens
aggagccggcugccu

SEQ ID NO: 1452659 - RNA, 17 nt, Homo sapiens
aggagccggugcucugg

SEQ ID NO: 1452660 - RNA, 14 nt, Homo sapiens
aggaggagcaccuc

SEQ ID NO: 1452661 - RNA, 17 nt, Homo sapiens
aggagggccccuggggc

SEQ ID NO: 1452662 - RNA, 19 nt, Homo sapiens
aggagggccgaggugggcu

SEQ ID NO: 1452663 - RNA, 18 nt, Homo sapiens
aggaggggucucaugucc

SEQ ID NO: 1452664 - RNA, 20 nt, Homo sapiens
aggagguggaggcugcagug

SEQ ID NO: 1452665 - RNA, 21 nt, Homo sapiens
aggaggugggauaucacuucc

SEQ ID NO: 1452666 - RNA, 11 nt, Homo sapiens
aggaguacaau

SEQ ID NO: 1452667 - RNA, 20 nt, Homo sapiens
aggaguacaaugcccagauc

SEQ ID NO: 1452668 - RNA, 19 nt, Homo sapiens
aggaguacuccaagacaga

SEQ ID NO: 1452669 - RNA, 14 nt, Homo sapiens
aggagucucugcca

SEQ ID NO: 1452670 - RNA, 22 nt, Homo sapiens
aggagucucugccacccacuca

SEQ ID NO: 1452671 - RNA, 14 nt, Homo sapiens
aggagucugugcag

SEQ ID NO: 1452672 - RNA, 21 nt, Homo sapiens
aggaguguccucuucccucuc

SEQ ID NO: 1452673 - RNA, 17 nt, Homo sapiens
aggaguguccugcccau

SEQ ID NO: 1452674 - RNA, 22 nt, Homo sapiens
aggaguuacagggaaguggucu

SEQ ID NO: 1452675 - RNA, 13 nt, Homo sapiens
aggaguucaagac

SEQ ID NO: 1452676 - RNA, 20 nt, Homo sapiens
aggauacuggacgcuguccu

SEQ ID NO: 1452677 - RNA, 18 nt, Homo sapiens
aggauacuuuacaugguu

SEQ ID NO: 1452678 - RNA, 16 nt, Homo sapiens
aggauaugauggucac

SEQ ID NO: 1452679 - RNA, 14 nt, Homo sapiens
aggauauugucagu

SEQ ID NO: 1452680 - RNA, 17 nt, Homo sapiens
aggauauuuucuuccaa

SEQ ID NO: 1452681 - RNA, 23 nt, Homo sapiens
aggaugaggugguggaguggagu

SEQ ID NO: 1452682 - RNA, 18 nt, Homo sapiens
aggaugucacagggccaa

SEQ ID NO: 1452683 - RNA, 22 nt, Homo sapiens
aggaugucaugucugcuuguca

SEQ ID NO: 1452684 - RNA, 19 nt, Homo sapiens
aggaugugauuguggaaug

SEQ ID NO: 1452685 - RNA, 23 nt, Homo sapiens
aggauguugccacuggcaaaugu

SEQ ID NO: 1452686 - RNA, 22 nt, Homo sapiens
aggauuaauaaagauggcacuu

SEQ ID NO: 1452687 - RNA, 23 nt, Homo sapiens
aggauuauaaaugaaauuugcaa

SEQ ID NO: 1452688 - RNA, 19 nt, Homo sapiens
aggauuauuugcucagggg

SEQ ID NO: 1452689 - RNA, 20 nt, Homo sapiens
aggauuccgucuucucucau

SEQ ID NO: 1452690 - RNA, 20 nt, Homo sapiens
aggcaaaauugauauacuuu

SEQ ID NO: 1452691 - RNA, 14 nt, Homo sapiens
aggcaaaauugcaa

SEQ ID NO: 1452692 - RNA, 19 nt, Homo sapiens
aggcaagauugauguuucc

SEQ ID NO: 1452693 - RNA, 17 nt, Homo sapiens
aggcaagcuaacugcuu

SEQ ID NO: 1452694 - RNA, 21 nt, Homo sapiens
agggagcuaucaggaacagcu

SEQ ID NO: 1452695 - RNA, 20 nt, Homo sapiens
agggagcugaguaacaccau

SEQ ID NO: 1452696 - RNA, 15 nt, Homo sapiens
agggagggcugucau

SEQ ID NO: 1452697 - RNA, 16 nt, Homo sapiens
agggagggcugucauc

SEQ ID NO: 1452698 - RNA, 14 nt, Homo sapiens
agggaggucacugg

SEQ ID NO: 1452699 - RNA, 14 nt, Homo sapiens
agggagguggcaag

SEQ ID NO: 1452700 - RNA, 17 nt, Homo sapiens
agggagugcuggcucac

SEQ ID NO: 1452701 - RNA, 14 nt, Homo sapiens
agggaucuugcaaa

SEQ ID NO: 1452702 - RNA, 22 nt, Homo sapiens
agggaucuugcauucccagugg

SEQ ID NO: 1452703 - RNA, 19 nt, Homo sapiens
agggauuugaggugagggu

SEQ ID NO: 1452704 - RNA, 22 nt, Homo sapiens
agggcaaaaagucuacauacuu

SEQ ID NO: 1452705 - RNA, 22 nt, Homo sapiens
agggcacccuaguucuaccuca

SEQ ID NO: 1452706 - RNA, 14 nt, Homo sapiens
agggcagaggugga

SEQ ID NO: 1452707 - RNA, 23 nt, Homo sapiens
agggcagggcaucuccugugcau

SEQ ID NO: 1452708 - RNA, 16 nt, Homo sapiens
agggcagggcucugau

SEQ ID NO: 1452709 - RNA, 18 nt, Homo sapiens
agggcaucuccugugcau

SEQ ID NO: 1452710 - RNA, 21 nt, Homo sapiens
agggcauguguaugugucugc

SEQ ID NO: 1452711 - RNA, 19 nt, Homo sapiens
agggcccacccaugucacc

SEQ ID NO: 1452712 - RNA, 22 nt, Homo sapiens
agggcccagugacaaggcccug

SEQ ID NO: 1452713 - RNA, 20 nt, Homo sapiens
agggcccccaucucaugccc

SEQ ID NO: 1452714 - RNA, 17 nt, Homo sapiens
agggccgaggaggugcc

SEQ ID NO: 1452715 - RNA, 16 nt, Homo sapiens
agggcucccuaaacuu

SEQ ID NO: 1452716 - RNA, 14 nt, Homo sapiens
agggcugcccugag

SEQ ID NO: 1452717 - RNA, 19 nt, Homo sapiens
agggcugucaucugugcac

SEQ ID NO: 1452718 - RNA, 16 nt, Homo sapiens
agggcuuccuaaaaau

SEQ ID NO: 1452719 - RNA, 13 nt, Homo sapiens
aggggaauggagg

SEQ ID NO: 1452720 - RNA, 15 nt, Homo sapiens
aggggacaagggauu

SEQ ID NO: 1452721 - RNA, 18 nt, Homo sapiens
aggggcaacuguaugaaa

SEQ ID NO: 1452722 - RNA, 23 nt, Homo sapiens
aggggcccaaauucuuucagugg

SEQ ID NO: 1452723 - RNA, 17 nt, Homo sapiens
aggggccucccugugac

SEQ ID NO: 1452724 - RNA, 21 nt, Homo sapiens
aggggccuuagggcacugggc

SEQ ID NO: 1452725 - RNA, 21 nt, Homo sapiens
aggggcugaaagaacauggac

SEQ ID NO: 1452726 - RNA, 14 nt, Homo sapiens
aggggcuggcacug

SEQ ID NO: 1452727 - RNA, 13 nt, Homo sapiens
aggggcuguguuu

SEQ ID NO: 1452728 - RNA, 20 nt, Homo sapiens
aggggcuguguuuccaucuc

SEQ ID NO: 1452729 - RNA, 15 nt, Homo sapiens
agggggaaggcuugg

SEQ ID NO: 1452730 - RNA, 20 nt, Homo sapiens
agggggguugugaggccugg

SEQ ID NO: 1452731 - RNA, 13 nt, Homo sapiens
agggguauguucc

SEQ ID NO: 1452732 - RNA, 22 nt, Homo sapiens
agggguggggguggaggcuucc

SEQ ID NO: 1452733 - RNA, 23 nt, Homo sapiens
agggguuaaagcagacagucaca

SEQ ID NO: 1452734 - RNA, 23 nt, Homo sapiens
agggguuugagaugcuguaggug

SEQ ID NO: 1452735 - RNA, 17 nt, Homo sapiens
aggguaccgucuucucc

SEQ ID NO: 1452736 - RNA, 20 nt, Homo sapiens
aggguacuuuaagacauacu

SEQ ID NO: 1452737 - RNA, 20 nt, Homo sapiens
aggguagauaaccuguacuu

SEQ ID NO: 1452738 - RNA, 23 nt, Homo sapiens
aggguagucugguuucuagacuu

SEQ ID NO: 1452739 - RNA, 22 nt, Homo sapiens
agggucaggguuggaggccugu

SEQ ID NO: 1452740 - RNA, 15 nt, Homo sapiens
agggucggccuguac

SEQ ID NO: 1452741 - RNA, 13 nt, Homo sapiens
agggucucuucag

SEQ ID NO: 1452742 - RNA, 23 nt, Homo sapiens
agggucugcucuuucucugccag

SEQ ID NO: 1452743 - RNA, 23 nt, Homo sapiens
agggucugugugaaugugggcac

SEQ ID NO: 1452744 - RNA, 23 nt, Homo sapiens
agggucuucuuacaugcauuuga

SEQ ID NO: 1452745 - RNA, 23 nt, Homo sapiens
agggugacccugaagugagcaca

SEQ ID NO: 1452746 - RNA, 19 nt, Homo sapiens
agggugcaguaucaugccc

SEQ ID NO: 1452747 - RNA, 15 nt, Homo sapiens
aggguggaugacagg

SEQ ID NO: 1452748 - RNA, 22 nt, Homo sapiens
aggguggcacucaacucugagc

SEQ ID NO: 1452749 - RNA, 23 nt, Homo sapiens
agggugggguaaccaaauguugg

SEQ ID NO: 1452750 - RNA, 17 nt, Homo sapiens
agggugugaugaaguca

SEQ ID NO: 1452751 - RNA, 15 nt, Homo sapiens
aggguucaucugucc

SEQ ID NO: 1452752 - RNA, 18 nt, Homo sapiens
aggguucaucuguccaug

SEQ ID NO: 1452753 - RNA, 14 nt, Homo sapiens
aggguuccaaaggg

SEQ ID NO: 1452754 - RNA, 18 nt, Homo sapiens
aggguuugauagcacuua

SEQ ID NO: 1452755 - RNA, 19 nt, Homo sapiens
agguaauccggagugagca

SEQ ID NO: 1452756 - RNA, 23 nt, Homo sapiens
agguaauccuauuaaaacacagc

SEQ ID NO: 1452757 - RNA, 20 nt, Homo sapiens
agguacuauauuugcuagac

SEQ ID NO: 1452758 - RNA, 20 nt, Homo sapiens
agguagcccagcacugugaa

SEQ ID NO: 1452759 - RNA, 18 nt, Homo sapiens
agguagccgggcucugca

SEQ ID NO: 1452760 - RNA, 16 nt, Homo sapiens
agguaggaagcacuga

SEQ ID NO: 1452761 - RNA, 18 nt, Homo sapiens
agguaugcaaucaaaucu

SEQ ID NO: 1452762 - RNA, 17 nt, Homo sapiens
aggucaaaaaucugucc

SEQ ID NO: 1452763 - RNA, 20 nt, Homo sapiens
aggucaaacuaauucucaca

SEQ ID NO: 1452764 - RNA, 21 nt, Homo sapiens
aggucaaagcaaguuucauca

SEQ ID NO: 1452765 - RNA, 22 nt, Homo sapiens
aggucaaggcugcagugagcca

SEQ ID NO: 1452766 - RNA, 14 nt, Homo sapiens
aggucaaguaagaa

SEQ ID NO: 1452767 - RNA, 16 nt, Homo sapiens
aggucaauuuccugau

SEQ ID NO: 1452768 - RNA, 18 nt, Homo sapiens
aggucaauuuccugaugc

SEQ ID NO: 1452769 - RNA, 19 nt, Homo sapiens
aggucaauuuccugaugca

SEQ ID NO: 1452770 - RNA, 19 nt, Homo sapiens
aggucaccaagcaguggcc

SEQ ID NO: 1452771 - RNA, 21 nt, Homo sapiens
aggucaggacggcuccucaga

SEQ ID NO: 1452772 - RNA, 16 nt, Homo sapiens
aggucaggaguugaag

SEQ ID NO: 1452773 - RNA, 12 nt, Homo sapiens
aggucagugcuu

SEQ ID NO: 1452774 - RNA, 22 nt, Homo sapiens
aggucagugcuucgugccucga

SEQ ID NO: 1452775 - RNA, 19 nt, Homo sapiens
aggucauacaugcauacaa

SEQ ID NO: 1452776 - RNA, 22 nt, Homo sapiens
aggucauauauuuuuugcuacu

SEQ ID NO: 1452777 - RNA, 23 nt, Homo sapiens
agguccaccgagccccugacccc

SEQ ID NO: 1452778 - RNA, 15 nt, Homo sapiens
aggucccucagacau

SEQ ID NO: 1452779 - RNA, 20 nt, Homo sapiens
agguccucuacuuaaugaga

SEQ ID NO: 1452780 - RNA, 20 nt, Homo sapiens
aggucucacgggcaugggca

SEQ ID NO: 1452781 - RNA, 17 nt, Homo sapiens
aggucucauucuuccaa

SEQ ID NO: 1452782 - RNA, 16 nt, Homo sapiens
aggucugaaauggagg

SEQ ID NO: 1452783 - RNA, 20 nt, Homo sapiens
aggucuguacguuaccucuu

SEQ ID NO: 1452784 - RNA, 19 nt, Homo sapiens
aggugaaaauccaucucau

SEQ ID NO: 1452785 - RNA, 15 nt, Homo sapiens
aggugacauuugcuc

SEQ ID NO: 1452786 - RNA, 16 nt, Homo sapiens
aggugacccugaugaa

SEQ ID NO: 1452787 - RNA, 13 nt, Homo sapiens
aggugacugggaa

SEQ ID NO: 1452788 - RNA, 20 nt, Homo sapiens
aggugauucgcccaccucag

SEQ ID NO: 1452789 - RNA, 20 nt, Homo sapiens
aggugcgcgccaccgugccu

SEQ ID NO: 1452790 - RNA, 19 nt, Homo sapiens
aggugcuaucgcaccacug

SEQ ID NO: 1452791 - RNA, 13 nt, Homo sapiens
aggugcugaugag

SEQ ID NO: 1452792 - RNA, 16 nt, Homo sapiens
aggugcuuauucucaa

SEQ ID NO: 1452793 - RNA, 18 nt, Homo sapiens
agguggaacaagcacaga

SEQ ID NO: 1452794 - RNA, 14 nt, Homo sapiens
auauguaccaugua

SEQ ID NO: 1452795 - RNA, 14 nt, Homo sapiens
auauguagcucauc

SEQ ID NO: 1452796 - RNA, 12 nt, Homo sapiens
auauguaugggu

SEQ ID NO: 1452797 - RNA, 15 nt, Homo sapiens
auauguucagauuau

SEQ ID NO: 1452798 - RNA, 13 nt, Homo sapiens
auauguugcuaua

SEQ ID NO: 1452799 - RNA, 21 nt, Homo sapiens
auauuaucuacaaacacugca

SEQ ID NO: 1452800 - RNA, 17 nt, Homo sapiens
auauuaugaaauuucac

SEQ ID NO: 1452801 - RNA, 18 nt, Homo sapiens
auauuaugaaauuucacu

SEQ ID NO: 1452802 - RNA, 21 nt, Homo sapiens
auauucaggcuacucauucag

SEQ ID NO: 1452803 - RNA, 18 nt, Homo sapiens
auauucuauuaacuuuaa

SEQ ID NO: 1452804 - RNA, 14 nt, Homo sapiens
auauugacuuguau

SEQ ID NO: 1452805 - RNA, 23 nt, Homo sapiens
auauugggguuggaacauuucag

SEQ ID NO: 1452806 - RNA, 13 nt, Homo sapiens
auauuuacuaccu

SEQ ID NO: 1452807 - RNA, 19 nt, Homo sapiens
auauuuauagcaauccaug

SEQ ID NO: 1452808 - RNA, 20 nt, Homo sapiens
auauuucaggcauacugaca

SEQ ID NO: 1452809 - RNA, 15 nt, Homo sapiens
auauuucuaacuaua

SEQ ID NO: 1452810 - RNA, 17 nt, Homo sapiens
auauuucuugcuuucaa

SEQ ID NO: 1452811 - RNA, 18 nt, Homo sapiens
auauuugcugagugaaug

SEQ ID NO: 1452812 - RNA, 18 nt, Homo sapiens
auauuuuguaacuauuac

SEQ ID NO: 1452813 - RNA, 18 nt, Homo sapiens
auauuuuguuuugugcag

SEQ ID NO: 1452814 - RNA, 17 nt, Homo sapiens
auauuuuuccacuuaaa

SEQ ID NO: 1452815 - RNA, 14 nt, Homo sapiens
aucaaaaaguuuau

SEQ ID NO: 1452816 - RNA, 18 nt, Homo sapiens
aucaaaagcuuauucauc

SEQ ID NO: 1452817 - RNA, 16 nt, Homo sapiens
aucaaaaucacuaucu

SEQ ID NO: 1452818 - RNA, 17 nt, Homo sapiens
aucaaaaucacuaucuu

SEQ ID NO: 1452819 - RNA, 23 nt, Homo sapiens
aucaaacaugcauggaugggucc

SEQ ID NO: 1452820 - RNA, 18 nt, Homo sapiens
aucaacaucuuggucaga

SEQ ID NO: 1452821 - RNA, 22 nt, Homo sapiens
aucaaccuggcaaaaaugcaac

SEQ ID NO: 1452822 - RNA, 12 nt, Homo sapiens
aucaauauacau

SEQ ID NO: 1452823 - RNA, 17 nt, Homo sapiens
aucaauauacauaauac

SEQ ID NO: 1452824 - RNA, 22 nt, Homo sapiens
aucaauccugggcaaucagaca

SEQ ID NO: 1452825 - RNA, 16 nt, Homo sapiens
aucaaucugcaguuua

SEQ ID NO: 1452826 - RNA, 19 nt, Homo sapiens
aucaaucugcaguuuaaca

SEQ ID NO: 1452827 - RNA, 11 nt, Homo sapiens
aucaaugucac

SEQ ID NO: 1452828 - RNA, 13 nt, Homo sapiens
aucaaugucacuu

SEQ ID NO: 1452829 - RNA, 15 nt, Homo sapiens
aucaaugucacuuaa

SEQ ID NO: 1452830 - RNA, 19 nt, Homo sapiens
aucaauuggcagugacuuu

SEQ ID NO: 1452831 - RNA, 18 nt, Homo sapiens
aucacaaauuucacuuau

SEQ ID NO: 1452832 - RNA, 19 nt, Homo sapiens
aucacaacauuuacuuaac

SEQ ID NO: 1452833 - RNA, 16 nt, Homo sapiens
aucacaagauggaauu

SEQ ID NO: 1452834 - RNA, 20 nt, Homo sapiens
aucacaguguuugcaauggu

SEQ ID NO: 1452835 - RNA, 21 nt, Homo sapiens
aucacauuauuugcauguuac

SEQ ID NO: 1452836 - RNA, 15 nt, Homo sapiens
aucaccauauuguaa

SEQ ID NO: 1452837 - RNA, 14 nt, Homo sapiens
aucacucuaaaaaa

SEQ ID NO: 1452838 - RNA, 12 nt, Homo sapiens
aucacugaauuu

SEQ ID NO: 1452839 - RNA, 19 nt, Homo sapiens
aucacuggcuggccugagc

SEQ ID NO: 1452840 - RNA, 19 nt, Homo sapiens
aucagaauagccacauuug

SEQ ID NO: 1452841 - RNA, 14 nt, Homo sapiens
aucagacagagauu

SEQ ID NO: 1452842 - RNA, 17 nt, Homo sapiens
aucagagccagucucac

SEQ ID NO: 1452843 - RNA, 22 nt, Homo sapiens
aucagcaugaaaaugcaguuuc

SEQ ID NO: 1452844 - RNA, 20 nt, Homo sapiens
aucaggaaggaaaugacacc

SEQ ID NO: 1452845 - RNA, 18 nt, Homo sapiens
augacaucucaggggcca

SEQ ID NO: 1452846 - RNA, 13 nt, Homo sapiens
augacccacuguc

SEQ ID NO: 1452847 - RNA, 21 nt, Homo sapiens
augacccccgcaaguuugcac

SEQ ID NO: 1452848 - RNA, 12 nt, Homo sapiens
augacuaaagag

SEQ ID NO: 1452849 - RNA, 21 nt, Homo sapiens
augacuaguaaacauguggga

SEQ ID NO: 1452850 - RNA, 16 nt, Homo sapiens
augacugaugacauau

SEQ ID NO: 1452851 - RNA, 10 nt, Homo sapiens
augacugggc

SEQ ID NO: 1452852 - RNA, 20 nt, Homo sapiens
augagaguaauugcuugaca

SEQ ID NO: 1452853 - RNA, 13 nt, Homo sapiens
augagcagucaca

SEQ ID NO: 1452854 - RNA, 22 nt, Homo sapiens
augaggaaggaacagcaauggu

SEQ ID NO: 1452855 - RNA, 23 nt, Homo sapiens
augaggaccaagggcaccuggag

SEQ ID NO: 1452856 - RNA, 15 nt, Homo sapiens
augaggcaaugucag

SEQ ID NO: 1452857 - RNA, 16 nt, Homo sapiens
augagggaaaaugagu

SEQ ID NO: 1452858 - RNA, 16 nt, Homo sapiens
augaguaacaggaaaa

SEQ ID NO: 1452859 - RNA, 16 nt, Homo sapiens
augaguaacauuugcu

SEQ ID NO: 1452860 - RNA, 17 nt, Homo sapiens
augaguaauacaucaaa

SEQ ID NO: 1452861 - RNA, 22 nt, Homo sapiens
augagucggauacccuggagca

SEQ ID NO: 1452862 - RNA, 18 nt, Homo sapiens
augaguuuuucaguuuug

SEQ ID NO: 1452863 - RNA, 20 nt, Homo sapiens
augaguuuuugauagcuuua

SEQ ID NO: 1452864 - RNA, 14 nt, Homo sapiens
augauaaugaaacu

SEQ ID NO: 1452865 - RNA, 22 nt, Homo sapiens
augaucaaguccuuugugaaua

SEQ ID NO: 1452866 - RNA, 18 nt, Homo sapiens
augaucagcaucugugau

SEQ ID NO: 1452867 - RNA, 17 nt, Homo sapiens
augaucagcuguuuguc

SEQ ID NO: 1452868 - RNA, 20 nt, Homo sapiens
augaucagcuguuugucaua

SEQ ID NO: 1452869 - RNA, 15 nt, Homo sapiens
augauccagaacagu

SEQ ID NO: 1452870 - RNA, 20 nt, Homo sapiens
augaucccuguguugucucu

SEQ ID NO: 1452871 - RNA, 21 nt, Homo sapiens
augaucucucuagcuuuguca

SEQ ID NO: 1452872 - RNA, 14 nt, Homo sapiens
augaugacuccucu

SEQ ID NO: 1452873 - RNA, 23 nt, Homo sapiens
augaugagucgguccucuuucca

SEQ ID NO: 1452874 - RNA, 15 nt, Homo sapiens
augaugauguggaag

SEQ ID NO: 1452875 - RNA, 19 nt, Homo sapiens
augauggccuuacacugaa

SEQ ID NO: 1452876 - RNA, 23 nt, Homo sapiens
augauguagagugugguuaugaa

SEQ ID NO: 1452877 - RNA, 15 nt, Homo sapiens
augauuaaacuuccu

SEQ ID NO: 1452878 - RNA, 18 nt, Homo sapiens
augauuggaauauuacaa

SEQ ID NO: 1452879 - RNA, 17 nt, Homo sapiens
augauuuugcuuuccaa

SEQ ID NO: 1452880 - RNA, 16 nt, Homo sapiens
augcaaaguagcaauu

SEQ ID NO: 1452881 - RNA, 22 nt, Homo sapiens
augcaaggaaggaaagaaagaa

SEQ ID NO: 1452882 - RNA, 20 nt, Homo sapiens
augcacacacacacaucuca

SEQ ID NO: 1452883 - RNA, 22 nt, Homo sapiens
augcacaguaucuuuucuuuca

SEQ ID NO: 1452884 - RNA, 17 nt, Homo sapiens
augcacauagcuaucaa

SEQ ID NO: 1452885 - RNA, 16 nt, Homo sapiens
augcaccccugagcca

SEQ ID NO: 1452886 - RNA, 20 nt, Homo sapiens
augcagcaaggggacaucuu

SEQ ID NO: 1452887 - RNA, 21 nt, Homo sapiens
augcagcaaggggacaucuua

SEQ ID NO: 1452888 - RNA, 20 nt, Homo sapiens
augcagccagccaucaaaua

SEQ ID NO: 1452889 - RNA, 18 nt, Homo sapiens
augcagugauauggcaga

SEQ ID NO: 1452890 - RNA, 22 nt, Homo sapiens
augcagugccggcugccaagac

SEQ ID NO: 1452891 - RNA, 21 nt, Homo sapiens
augcauaaauaugcagugaua

SEQ ID NO: 1452892 - RNA, 18 nt, Homo sapiens
augcauauccugagccau

SEQ ID NO: 1452893 - RNA, 18 nt, Homo sapiens
augcauauugcccuggag

SEQ ID NO: 1452894 - RNA, 17 nt, Homo sapiens
augcaucaaaagacuua

SEQ ID NO: 1452895 - RNA, 13 nt, Homo sapiens
augcaucacuggg

SEQ ID NO: 1452896 - RNA, 16 nt, Homo sapiens
augcauggugccccag

SEQ ID NO: 1452897 - RNA, 21 nt, Homo sapiens
augcauggugccccaggacca

SEQ ID NO: 1452898 - RNA, 19 nt, Homo sapiens
augcauuuuuaauaugaca

SEQ ID NO: 1452899 - RNA, 12 nt, Homo sapiens
augccaagacag

SEQ ID NO: 1452900 - RNA, 20 nt, Homo sapiens
augccaaggccguggggcuc

SEQ ID NO: 1452901 - RNA, 16 nt, Homo sapiens
augccacaaaacugac

SEQ ID NO: 1452902 - RNA, 15 nt, Homo sapiens
augccacguggucac

SEQ ID NO: 1452903 - RNA, 21 nt, Homo sapiens
augccacguggucacugugca

SEQ ID NO: 1452904 - RNA, 18 nt, Homo sapiens
augccagcauauacugaa

SEQ ID NO: 1452905 - RNA, 21 nt, Homo sapiens
augccagcuacuuccuccucc

SEQ ID NO: 1452906 - RNA, 14 nt, Homo sapiens
augcccagcagggg

SEQ ID NO: 1452907 - RNA, 16 nt, Homo sapiens
augcccgccagugcac

SEQ ID NO: 1452908 - RNA, 13 nt, Homo sapiens
augccguggauug

SEQ ID NO: 1452909 - RNA, 22 nt, Homo sapiens
augccuaauaaacaauucaagu

SEQ ID NO: 1452910 - RNA, 21 nt, Homo sapiens
augccuagacuucccaacagc

SEQ ID NO: 1452911 - RNA, 16 nt, Homo sapiens
augccucaauucacau

SEQ ID NO: 1452912 - RNA, 21 nt, Homo sapiens
augccugccccccucaucuca

SEQ ID NO: 1452913 - RNA, 17 nt, Homo sapiens
augccuguaaucucagc

SEQ ID NO: 1452914 - RNA, 14 nt, Homo sapiens
augccugucuuaga

SEQ ID NO: 1452915 - RNA, 16 nt, Homo sapiens
augccuuaaaauggaa

SEQ ID NO: 1452916 - RNA, 14 nt, Homo sapiens
augccuugaugauu

SEQ ID NO: 1452917 - RNA, 18 nt, Homo sapiens
augccuugugcuguuaau

SEQ ID NO: 1452918 - RNA, 19 nt, Homo sapiens
augcguacguuuccugaga

SEQ ID NO: 1452919 - RNA, 20 nt, Homo sapiens
augcuaacaaagacaaaagu

SEQ ID NO: 1452920 - RNA, 13 nt, Homo sapiens
augcuauauugca

SEQ ID NO: 1452921 - RNA, 14 nt, Homo sapiens
augcuauuuauuaa

SEQ ID NO: 1452922 - RNA, 22 nt, Homo sapiens
augcucagcccugacuggugcu

SEQ ID NO: 1452923 - RNA, 14 nt, Homo sapiens
augcucagggucaa

SEQ ID NO: 1452924 - RNA, 16 nt, Homo sapiens
augcucauugaacuuu

SEQ ID NO: 1452925 - RNA, 21 nt, Homo sapiens
augcuccaaauauaagacauu

SEQ ID NO: 1452926 - RNA, 15 nt, Homo sapiens
augcucugugccaga

SEQ ID NO: 1452927 - RNA, 16 nt, Homo sapiens
augcucuuuacuucau

SEQ ID NO: 1452928 - RNA, 14 nt, Homo sapiens
augcugauaugauc

SEQ ID NO: 1452929 - RNA, 18 nt, Homo sapiens
augcugcaggacuugaga

SEQ ID NO: 1452930 - RNA, 13 nt, Homo sapiens
augcugccuggug

SEQ ID NO: 1452931 - RNA, 16 nt, Homo sapiens
augcugccuggugggg

SEQ ID NO: 1452932 - RNA, 10 nt, Homo sapiens
augcugcuau

SEQ ID NO: 1452933 - RNA, 11 nt, Homo sapiens
augcugcuaug

SEQ ID NO: 1452934 - RNA, 20 nt, Homo sapiens
augcugcugggccucugccu

SEQ ID NO: 1452935 - RNA, 16 nt, Homo sapiens
augcuggcagccaugg

SEQ ID NO: 1452936 - RNA, 15 nt, Homo sapiens
augcugggcaaugag

SEQ ID NO: 1452937 - RNA, 19 nt, Homo sapiens
augcugguuuucuacccaa

SEQ ID NO: 1452938 - RNA, 22 nt, Homo sapiens
augcuguauauccuuucuaaca

SEQ ID NO: 1452939 - RNA, 14 nt, Homo sapiens
augcugugcucaau

SEQ ID NO: 1452940 - RNA, 19 nt, Homo sapiens
augcuguggcuccuuccua

SEQ ID NO: 1452941 - RNA, 21 nt, Homo sapiens
augcuguuaguaccuacauca

SEQ ID NO: 1452942 - RNA, 15 nt, Homo sapiens
augcuucagauauua

SEQ ID NO: 1452943 - RNA, 14 nt, Homo sapiens
augcuucaugugcu

SEQ ID NO: 1452944 - RNA, 15 nt, Homo sapiens
augcuuugcuucaaa

SEQ ID NO: 1452945 - RNA, 13 nt, Homo sapiens
auggaaaaaccau

SEQ ID NO: 1452946 - RNA, 21 nt, Homo sapiens
auggaaaucacauuuacaaaa

SEQ ID NO: 1452947 - RNA, 16 nt, Homo sapiens
cauguuccucaaaagc

SEQ ID NO: 1452948 - RNA, 21 nt, Homo sapiens
cauguuguugaggcugucaca

SEQ ID NO: 1452949 - RNA, 22 nt, Homo sapiens
cauguuuugauuuguagcacug

SEQ ID NO: 1452950 - RNA, 22 nt, Homo sapiens
cauuaaaaaaauuagaaaguag

SEQ ID NO: 1452951 - RNA, 14 nt, Homo sapiens
cauuaaacuugaag

SEQ ID NO: 1452952 - RNA, 15 nt, Homo sapiens
cauuaccuccaucca

SEQ ID NO: 1452953 - RNA, 17 nt, Homo sapiens
cauuaccuccauccauc

SEQ ID NO: 1452954 - RNA, 21 nt, Homo sapiens
cauuagaauuuacagcaagaa

SEQ ID NO: 1452955 - RNA, 23 nt, Homo sapiens
cauuagcauucugguuuugacau

SEQ ID NO: 1452956 - RNA, 21 nt, Homo sapiens
cauuauagauuuucauguucu

SEQ ID NO: 1452957 - RNA, 15 nt, Homo sapiens
cauuaucaguugaca

SEQ ID NO: 1452958 - RNA, 20 nt, Homo sapiens
cauuaucaguugacagugua

SEQ ID NO: 1452959 - RNA, 18 nt, Homo sapiens
cauuaucgggagcagugu

SEQ ID NO: 1452960 - RNA, 15 nt, Homo sapiens
cauuaucucacuuag

SEQ ID NO: 1452961 - RNA, 21 nt, Homo sapiens
cauuaucuggaauauugugau

SEQ ID NO: 1452962 - RNA, 12 nt, Homo sapiens
cauuauguauga

SEQ ID NO: 1452963 - RNA, 17 nt, Homo sapiens
cauucaacucuccaaug

SEQ ID NO: 1452964 - RNA, 22 nt, Homo sapiens
cauucaauguuuaugcaaggaa

SEQ ID NO: 1452965 - RNA, 22 nt, Homo sapiens
cauucacaguucuuugggccag

SEQ ID NO: 1452966 - RNA, 20 nt, Homo sapiens
cauucagugauuacugucaa

SEQ ID NO: 1452967 - RNA, 19 nt, Homo sapiens
cauucaguuaaaaauccag

SEQ ID NO: 1452968 - RNA, 20 nt, Homo sapiens
cauucauccuuccauccauc

SEQ ID NO: 1452969 - RNA, 17 nt, Homo sapiens
cauucaugugggcauuu

SEQ ID NO: 1452970 - RNA, 19 nt, Homo sapiens
cauucaugugggcauuucu

SEQ ID NO: 1452971 - RNA, 13 nt, Homo sapiens
cauuccacuccac

SEQ ID NO: 1452972 - RNA, 18 nt, Homo sapiens
cauuccagaaucuugacu

SEQ ID NO: 1452973 - RNA, 12 nt, Homo sapiens
cauuccuaacac

SEQ ID NO: 1452974 - RNA, 21 nt, Homo sapiens
cauuccugaaagaaacaguua

SEQ ID NO: 1452975 - RNA, 17 nt, Homo sapiens
cauucgacauaccccac

SEQ ID NO: 1452976 - RNA, 17 nt, Homo sapiens
cauucgggccacagggc

SEQ ID NO: 1452977 - RNA, 14 nt, Homo sapiens
cauucuacugaaaa

SEQ ID NO: 1452978 - RNA, 16 nt, Homo sapiens
cauucuagaaacagga

SEQ ID NO: 1452979 - RNA, 17 nt, Homo sapiens
cauucuaguacuuggga

SEQ ID NO: 1452980 - RNA, 21 nt, Homo sapiens
cauucuauccccaaucagcuc

SEQ ID NO: 1452981 - RNA, 15 nt, Homo sapiens
cauucuauuuuagaa

SEQ ID NO: 1452982 - RNA, 15 nt, Homo sapiens
cauucuccugccuca

SEQ ID NO: 1452983 - RNA, 18 nt, Homo sapiens
cauucuuuaucuugacau

SEQ ID NO: 1452984 - RNA, 19 nt, Homo sapiens
cauugaagccgacucuggc

SEQ ID NO: 1452985 - RNA, 18 nt, Homo sapiens
cauugaaguaaugaauuu

SEQ ID NO: 1452986 - RNA, 23 nt, Homo sapiens
cauugaccgcgacuaauuucaaa

SEQ ID NO: 1452987 - RNA, 23 nt, Homo sapiens
cauugagcugauauaaauucugu

SEQ ID NO: 1452988 - RNA, 13 nt, Homo sapiens
cauugaugacccu

SEQ ID NO: 1452989 - RNA, 14 nt, Homo sapiens
cauugcaauuugca

SEQ ID NO: 1452990 - RNA, 13 nt, Homo sapiens
cauugcacuccag

SEQ ID NO: 1452991 - RNA, 17 nt, Homo sapiens
cauugcuuuccacugag

SEQ ID NO: 1452992 - RNA, 23 nt, Homo sapiens
cauugcuuuugggagacuggaaa

SEQ ID NO: 1452993 - RNA, 21 nt, Homo sapiens
cauuggauucaucagcauuug

SEQ ID NO: 1452994 - RNA, 22 nt, Homo sapiens
cauuggauucaucagcauuugg

SEQ ID NO: 1452995 - RNA, 13 nt, Homo sapiens
cauuguaguuaau

SEQ ID NO: 1452996 - RNA, 18 nt, Homo sapiens
cauugugccuaaguccag

SEQ ID NO: 1452997 - RNA, 23 nt, Homo sapiens
ccuuggccucccaaagugcuagu

SEQ ID NO: 1452998 - RNA, 15 nt, Homo sapiens
ccuuggcucaauccu

SEQ ID NO: 1452999 - RNA, 20 nt, Homo sapiens
ccuugggucauugaccucuc

SEQ ID NO: 1453000 - RNA, 12 nt, Homo sapiens
ccuuguaaaaua

SEQ ID NO: 1453001 - RNA, 22 nt, Homo sapiens
ccuugucccgucuggaccuggg

SEQ ID NO: 1453002 - RNA, 19 nt, Homo sapiens
ccuugugagagcccauucc

SEQ ID NO: 1453003 - RNA, 15 nt, Homo sapiens
ccuuuaacacagacc

SEQ ID NO: 1453004 - RNA, 17 nt, Homo sapiens
ccuuuacuugucuuucu

SEQ ID NO: 1453005 - RNA, 23 nt, Homo sapiens
ccuuuaucaaaaaaagacucagc

SEQ ID NO: 1453006 - RNA, 17 nt, Homo sapiens
ccuuuaucauccuuaaa

SEQ ID NO: 1453007 - RNA, 14 nt, Homo sapiens
ccuuuaucucugag

SEQ ID NO: 1453008 - RNA, 17 nt, Homo sapiens
ccuuucaucacacuggg

SEQ ID NO: 1453009 - RNA, 18 nt, Homo sapiens
ccuuuccuuuucuuuaaa

SEQ ID NO: 1453010 - RNA, 13 nt, Homo sapiens
ccuuucgagcucu

SEQ ID NO: 1453011 - RNA, 23 nt, Homo sapiens
ccuuucuacaacugauugcaaca

SEQ ID NO: 1453012 - RNA, 19 nt, Homo sapiens
ccuuugaauaaaaaugcac

SEQ ID NO: 1453013 - RNA, 14 nt, Homo sapiens
ccuuugagguugau

SEQ ID NO: 1453014 - RNA, 19 nt, Homo sapiens
ccuuugaguuuuguauuca

SEQ ID NO: 1453015 - RNA, 13 nt, Homo sapiens
ccuuugccuucca

SEQ ID NO: 1453016 - RNA, 16 nt, Homo sapiens
ccuuuggaaagccauu

SEQ ID NO: 1453017 - RNA, 22 nt, Homo sapiens
ccuuuggggagcaggaggccaa

SEQ ID NO: 1453018 - RNA, 15 nt, Homo sapiens
ccuuuguagcuacuu

SEQ ID NO: 1453019 - RNA, 14 nt, Homo sapiens
ccuuuuaaaaaccu

SEQ ID NO: 1453020 - RNA, 15 nt, Homo sapiens
ccuuuuaacugccaa

SEQ ID NO: 1453021 - RNA, 16 nt, Homo sapiens
ccuuuuaccugcccaa

SEQ ID NO: 1453022 - RNA, 12 nt, Homo sapiens
ccuuuuccagaa

SEQ ID NO: 1453023 - RNA, 18 nt, Homo sapiens
ccuuuuccccagucccag

SEQ ID NO: 1453024 - RNA, 21 nt, Homo sapiens
ccuuuuccuuauuugccuucu

SEQ ID NO: 1453025 - RNA, 13 nt, Homo sapiens
ccuuuucucucac

SEQ ID NO: 1453026 - RNA, 21 nt, Homo sapiens
ccuuuucuuuuucccuugaac

SEQ ID NO: 1453027 - RNA, 22 nt, Homo sapiens
ccuuuugcacauaacaugcuuu

SEQ ID NO: 1453028 - RNA, 12 nt, Homo sapiens
ccuuuugcugcg

SEQ ID NO: 1453029 - RNA, 16 nt, Homo sapiens
ccuuuuggcacugaga

SEQ ID NO: 1453030 - RNA, 22 nt, Homo sapiens
cgaagaucgugccauugcacuc

SEQ ID NO: 1453031 - RNA, 14 nt, Homo sapiens
cgaauggcagcaua

SEQ ID NO: 1453032 - RNA, 20 nt, Homo sapiens
cgacaagugcugaacagugg

SEQ ID NO: 1453033 - RNA, 13 nt, Homo sapiens
cgacaccguguca

SEQ ID NO: 1453034 - RNA, 13 nt, Homo sapiens
cgacauaccccac

SEQ ID NO: 1453035 - RNA, 15 nt, Homo sapiens
cgaccaacugcccua

SEQ ID NO: 1453036 - RNA, 18 nt, Homo sapiens
cgaccccuaguucccucu

SEQ ID NO: 1453037 - RNA, 18 nt, Homo sapiens
cgaccuggagacugacaa

SEQ ID NO: 1453038 - RNA, 16 nt, Homo sapiens
cgacgcugacugcccu

SEQ ID NO: 1453039 - RNA, 22 nt, Homo sapiens
cgacuaauuucaaaaugcuuuu

SEQ ID NO: 1453040 - RNA, 21 nt, Homo sapiens
cgacuccugccugaguuucca

SEQ ID NO: 1453041 - RNA, 13 nt, Homo sapiens
cgacugggcucaa

SEQ ID NO: 1453042 - RNA, 19 nt, Homo sapiens
cgagacccuggauggggcu

SEQ ID NO: 1453043 - RNA, 15 nt, Homo sapiens
cgagacuccgucuca

SEQ ID NO: 1453044 - RNA, 17 nt, Homo sapiens
cgagacuccgucucaaa

SEQ ID NO: 1453045 - RNA, 20 nt, Homo sapiens
cgagacuugguuucaaaaaa

SEQ ID NO: 1453046 - RNA, 16 nt, Homo sapiens
cgagagaggagccaga

SEQ ID NO: 1453047 - RNA, 16 nt, Homo sapiens
cgagcacuguccagua

SEQ ID NO: 1453048 - RNA, 14 nt, Homo sapiens
cgagcacugugagc

SEQ ID NO: 1453049 - RNA, 13 nt, Homo sapiens
cgagcucuuggcc

SEQ ID NO: 1453050 - RNA, 23 nt, Homo sapiens
cgugguaugucugccauguugcc

SEQ ID NO: 1453051 - RNA, 17 nt, Homo sapiens
cguugcccccagacuuc

SEQ ID NO: 1453052 - RNA, 22 nt, Homo sapiens
cguuggccggaggucaugauga

SEQ ID NO: 1453053 - RNA, 22 nt, Homo sapiens
cuaaaaaacagaggccauggca

SEQ ID NO: 1453054 - RNA, 15 nt, Homo sapiens
cuaaaaagcaaaaau

SEQ ID NO: 1453055 - RNA, 14 nt, Homo sapiens
cuaaaacugcauuu

SEQ ID NO: 1453056 - RNA, 17 nt, Homo sapiens
cuaaaacuggccugacu

SEQ ID NO: 1453057 - RNA, 21 nt, Homo sapiens
cuaaaauaauuuuauuaugca

SEQ ID NO: 1453058 - RNA, 13 nt, Homo sapiens
cuaaaauauuauu

SEQ ID NO: 1453059 - RNA, 15 nt, Homo sapiens
cuaaaauuagaugaa

SEQ ID NO: 1453060 - RNA, 13 nt, Homo sapiens
cuaaaauuccacu

SEQ ID NO: 1453061 - RNA, 16 nt, Homo sapiens
cuaaacaaaauugcaa

SEQ ID NO: 1453062 - RNA, 23 nt, Homo sapiens
cuaaacuccuuccuggccugaga

SEQ ID NO: 1453063 - RNA, 23 nt, Homo sapiens
cuaaacucuuuuucauccaggcc

SEQ ID NO: 1453064 - RNA, 20 nt, Homo sapiens
cuaaacuucaccuacauuau

SEQ ID NO: 1453065 - RNA, 15 nt, Homo sapiens
cuaaagagcccuugc

SEQ ID NO: 1453066 - RNA, 22 nt, Homo sapiens
cuaaagauaauauuacuguuua

SEQ ID NO: 1453067 - RNA, 20 nt, Homo sapiens
cuaaagcagaggcaacacug

SEQ ID NO: 1453068 - RNA, 21 nt, Homo sapiens
cuaaagguggugaggcaauaa

SEQ ID NO: 1453069 - RNA, 22 nt, Homo sapiens
cuaaaguuaaauaggauauuaa

SEQ ID NO: 1453070 - RNA, 21 nt, Homo sapiens
cuaaauaauguuaucugugua

SEQ ID NO: 1453071 - RNA, 14 nt, Homo sapiens
cuaaauaucuguca

SEQ ID NO: 1453072 - RNA, 18 nt, Homo sapiens
cuaaaucugccuuuucau

SEQ ID NO: 1453073 - RNA, 16 nt, Homo sapiens
cuaaaugaacuaauga

SEQ ID NO: 1453074 - RNA, 11 nt, Homo sapiens
cuaaauuugaa

SEQ ID NO: 1453075 - RNA, 15 nt, Homo sapiens
cuaaauuugguucua

SEQ ID NO: 1453076 - RNA, 21 nt, Homo sapiens
cuaaauuuucugaaacugcau

SEQ ID NO: 1453077 - RNA, 16 nt, Homo sapiens
cuaacaucuaaaaaua

SEQ ID NO: 1453078 - RNA, 14 nt, Homo sapiens
cuaaccacuucaga

SEQ ID NO: 1453079 - RNA, 16 nt, Homo sapiens
cuaaccagccugguca

SEQ ID NO: 1453080 - RNA, 17 nt, Homo sapiens
cuaaccaguuaccacac

SEQ ID NO: 1453081 - RNA, 15 nt, Homo sapiens
cuaacugcagaccau

SEQ ID NO: 1453082 - RNA, 23 nt, Homo sapiens
cuaagacugugacaacugucuaa

SEQ ID NO: 1453083 - RNA, 21 nt, Homo sapiens
cuaagccacucuuccaaaggc

SEQ ID NO: 1453084 - RNA, 15 nt, Homo sapiens
cuaagcgcacauuca

SEQ ID NO: 1453085 - RNA, 18 nt, Homo sapiens
cuaagcuauucaguaaua

SEQ ID NO: 1453086 - RNA, 14 nt, Homo sapiens
cuaaggaucucuca

SEQ ID NO: 1453087 - RNA, 20 nt, Homo sapiens
cuaagugggagaaggacuau

SEQ ID NO: 1453088 - RNA, 15 nt, Homo sapiens
cuaaguuauuuacuu

SEQ ID NO: 1453089 - RNA, 19 nt, Homo sapiens
cuaaguuauuuacuuuuac

SEQ ID NO: 1453090 - RNA, 13 nt, Homo sapiens
cuaauaugccuag

SEQ ID NO: 1453091 - RNA, 24 nt, Homo sapiens
cuaaucaagaaaaacaucuuuggc

SEQ ID NO: 1453092 - RNA, 17 nt, Homo sapiens
cuaaucagcauucucac

SEQ ID NO: 1453093 - RNA, 22 nt, Homo sapiens
cuaaucagcauucucacuccua

SEQ ID NO: 1453094 - RNA, 13 nt, Homo sapiens
cuaaugcuuuaag

SEQ ID NO: 1453095 - RNA, 16 nt, Homo sapiens
cuaauggggacacaga

SEQ ID NO: 1453096 - RNA, 15 nt, Homo sapiens
cuaauguaauaacug

SEQ ID NO: 1453097 - RNA, 19 nt, Homo sapiens
cuaaugugguuauuucucu

SEQ ID NO: 1453098 - RNA, 13 nt, Homo sapiens
cuaauuaggcaag

SEQ ID NO: 1453099 - RNA, 17 nt, Homo sapiens
cuggcuuugcacuugac

SEQ ID NO: 1453100 - RNA, 23 nt, Homo sapiens
cuggcuuuuuccucugagcccag

SEQ ID NO: 1453101 - RNA, 21 nt, Homo sapiens
cugggaacaacuucaguccaa

SEQ ID NO: 1453102 - RNA, 22 nt, Homo sapiens
cugggaacaacuucaguccaac

SEQ ID NO: 1453103 - RNA, 18 nt, Homo sapiens
cugggacacuuaacagau

SEQ ID NO: 1453104 - RNA, 16 nt, Homo sapiens
cugggagucacacagu

SEQ ID NO: 1453105 - RNA, 18 nt, Homo sapiens
cugggauauggcugccca

SEQ ID NO: 1453106 - RNA, 18 nt, Homo sapiens
cugggauggaggggagug

SEQ ID NO: 1453107 - RNA, 23 nt, Homo sapiens
cugggauuacaggcgugagccac

SEQ ID NO: 1453108 - RNA, 21 nt, Homo sapiens
cugggauuacaggcgugaucc

SEQ ID NO: 1453109 - RNA, 13 nt, Homo sapiens
cugggcaaucaga

SEQ ID NO: 1453110 - RNA, 14 nt, Homo sapiens
cugggcagcauagc

SEQ ID NO: 1453111 - RNA, 22 nt, Homo sapiens
cugggcagcauagcaagacaca

SEQ ID NO: 1453112 - RNA, 22 nt, Homo sapiens
cugggcauauccaccaccuccc

SEQ ID NO: 1453113 - RNA, 13 nt, Homo sapiens
cugggcauugcuu

SEQ ID NO: 1453114 - RNA, 15 nt, Homo sapiens
cugggccauguccaa

SEQ ID NO: 1453115 - RNA, 17 nt, Homo sapiens
cugggcggccucuugcu

SEQ ID NO: 1453116 - RNA, 18 nt, Homo sapiens
cugggcgucuaugcugcu

SEQ ID NO: 1453117 - RNA, 17 nt, Homo sapiens
cugggcuauugcugcug

SEQ ID NO: 1453118 - RNA, 21 nt, Homo sapiens
cugggcuggggccaccauccc

SEQ ID NO: 1453119 - RNA, 16 nt, Homo sapiens
cuggggaggugaacug

SEQ ID NO: 1453120 - RNA, 20 nt, Homo sapiens
cuggggagugguuaggcagc

SEQ ID NO: 1453121 - RNA, 15 nt, Homo sapiens
cuggggcaaugggag

SEQ ID NO: 1453122 - RNA, 18 nt, Homo sapiens
cuggggcaggucacuuua

SEQ ID NO: 1453123 - RNA, 19 nt, Homo sapiens
cuggggcaggucacuuuac

SEQ ID NO: 1453124 - RNA, 19 nt, Homo sapiens
cuggggccuagcgaucucu

SEQ ID NO: 1453125 - RNA, 13 nt, Homo sapiens
cugggggccaagg

SEQ ID NO: 1453126 - RNA, 17 nt, Homo sapiens
cuggggggcaccccagc

SEQ ID NO: 1453127 - RNA, 23 nt, Homo sapiens
cugggguggggguggggagaccu

SEQ ID NO: 1453128 - RNA, 23 nt, Homo sapiens
cuggguacugaaagccuuaggga

SEQ ID NO: 1453129 - RNA, 19 nt, Homo sapiens
cugggugaccucacuuuag

SEQ ID NO: 1453130 - RNA, 17 nt, Homo sapiens
cugggugcggugacuca

SEQ ID NO: 1453131 - RNA, 18 nt, Homo sapiens
cuggguuucuagagguca

SEQ ID NO: 1453132 - RNA, 14 nt, Homo sapiens
cugguaauauugac

SEQ ID NO: 1453133 - RNA, 22 nt, Homo sapiens
cugguaauauugacuuguauau

SEQ ID NO: 1453134 - RNA, 17 nt, Homo sapiens
cugguacuuagaguuuc

SEQ ID NO: 1453135 - RNA, 17 nt, Homo sapiens
cugguagguugggacac

SEQ ID NO: 1453136 - RNA, 16 nt, Homo sapiens
cugguauguguggaug

SEQ ID NO: 1453137 - RNA, 20 nt, Homo sapiens
cugguauuguuuacguuuga

SEQ ID NO: 1453138 - RNA, 15 nt, Homo sapiens
cuggucagaugauau

SEQ ID NO: 1453139 - RNA, 23 nt, Homo sapiens
cuggucagucugcccuugucacu

SEQ ID NO: 1453140 - RNA, 15 nt, Homo sapiens
cuggucgccuuccac

SEQ ID NO: 1453141 - RNA, 13 nt, Homo sapiens
cuggugcuccugc

SEQ ID NO: 1453142 - RNA, 15 nt, Homo sapiens
cugguggaccacagg

SEQ ID NO: 1453143 - RNA, 22 nt, Homo sapiens
cugguggcacaggaguguccuc

SEQ ID NO: 1453144 - RNA, 23 nt, Homo sapiens
cuggugggccuuucuguguccua

SEQ ID NO: 1453145 - RNA, 15 nt, Homo sapiens
cuggugugaccugag

SEQ ID NO: 1453146 - RNA, 15 nt, Homo sapiens
cugguuacucagggu

SEQ ID NO: 1453147 - RNA, 23 nt, Homo sapiens
cugguugaacucugguggcacag

SEQ ID NO: 1453148 - RNA, 19 nt, Homo sapiens
cugguugucauuuuugcag

SEQ ID NO: 1453149 - RNA, 14 nt, Homo sapiens
cugguuuacuucaa

SEQ ID NO: 1453150 - RNA, 15 nt, Homo sapiens
cugguuuucugccaa

SEQ ID NO: 1453151 - RNA, 17 nt, Homo sapiens
cugguuuucugccaaug

SEQ ID NO: 1453152 - RNA, 15 nt, Homo sapiens
cuguaaagugccuua

SEQ ID NO: 1453153 - RNA, 21 nt, Homo sapiens
cuguaaauacuguaaaugcau

SEQ ID NO: 1453154 - RNA, 22 nt, Homo sapiens
cuguaaauaugaaucugcucac

SEQ ID NO: 1453155 - RNA, 22 nt, Homo sapiens
cuguaaggcaggcccauucaga

SEQ ID NO: 1453156 - RNA, 23 nt, Homo sapiens
cuguaaguaacuucacauuaaaa

SEQ ID NO: 1453157 - RNA, 20 nt, Homo sapiens
cuguaauauuuagcuguaaa

SEQ ID NO: 1453158 - RNA, 21 nt, Homo sapiens
cuguaaucccagcuacuuggg

SEQ ID NO: 1453159 - RNA, 14 nt, Homo sapiens
cuguaauuccagcu

SEQ ID NO: 1453160 - RNA, 15 nt, Homo sapiens
cuguaauuccagcua

SEQ ID NO: 1453161 - RNA, 19 nt, Homo sapiens
cuguaauuccagcuacuca

SEQ ID NO: 1453162 - RNA, 23 nt, Homo sapiens
cuguacaaaguagaagucuuaga

SEQ ID NO: 1453163 - RNA, 18 nt, Homo sapiens
cuguaccucaucccauga

SEQ ID NO: 1453164 - RNA, 22 nt, Homo sapiens
cuguacuccagccugggugaca

SEQ ID NO: 1453165 - RNA, 18 nt, Homo sapiens
cuguacucuugaauacaa

SEQ ID NO: 1453166 - RNA, 17 nt, Homo sapiens
cuguagacuagugccgu

SEQ ID NO: 1453167 - RNA, 12 nt, Homo sapiens
cuguagucccag

SEQ ID NO: 1453168 - RNA, 19 nt, Homo sapiens
cuguagucccagcuacucg

SEQ ID NO: 1453169 - RNA, 14 nt, Homo sapiens
cuguagucccaguu

SEQ ID NO: 1453170 - RNA, 20 nt, Homo sapiens
cuguauaaccccaccuugcc

SEQ ID NO: 1453171 - RNA, 13 nt, Homo sapiens
cuguauaagugga

SEQ ID NO: 1453172 - RNA, 23 nt, Homo sapiens
cuguauagacaugcuaccacugg

SEQ ID NO: 1453173 - RNA, 22 nt, Homo sapiens
cuguaugucaauaaacaacagc

SEQ ID NO: 1453174 - RNA, 15 nt, Homo sapiens
cuguauucugaccca

SEQ ID NO: 1453175 - RNA, 22 nt, Homo sapiens
cuguauugucugaacuugcauu

SEQ ID NO: 1453176 - RNA, 17 nt, Homo sapiens
cuguauuucaagaccuc

SEQ ID NO: 1453177 - RNA, 17 nt, Homo sapiens
cugucaaggcugcuuag

SEQ ID NO: 1453178 - RNA, 23 nt, Homo sapiens
cugucacagaguagaaacucaaa

SEQ ID NO: 1453179 - RNA, 15 nt, Homo sapiens
cugucagucacagcc

SEQ ID NO: 1453180 - RNA, 19 nt, Homo sapiens
cugucauccucaugcugcu

SEQ ID NO: 1453181 - RNA, 19 nt, Homo sapiens
cugucauuaguauuucaca

SEQ ID NO: 1453182 - RNA, 17 nt, Homo sapiens
cuguccaccaagaucaa

SEQ ID NO: 1453183 - RNA, 17 nt, Homo sapiens
cuguccacugggccauu

SEQ ID NO: 1453184 - RNA, 12 nt, Homo sapiens
cuguccagcucc

SEQ ID NO: 1453185 - RNA, 19 nt, Homo sapiens
cuguccccaaaaugugaug

SEQ ID NO: 1453186 - RNA, 17 nt, Homo sapiens
cugucccucuuuggcag

SEQ ID NO: 1453187 - RNA, 16 nt, Homo sapiens
cuguccuaagcacuuu

SEQ ID NO: 1453188 - RNA, 19 nt, Homo sapiens
cuguccucagccuugccag

SEQ ID NO: 1453189 - RNA, 20 nt, Homo sapiens
cuguccucagccuugccaga

SEQ ID NO: 1453190 - RNA, 17 nt, Homo sapiens
cuguccugaccaucgca

SEQ ID NO: 1453191 - RNA, 17 nt, Homo sapiens
cuguccugaucugugau

SEQ ID NO: 1453192 - RNA, 21 nt, Homo sapiens
cuguccuuuuccccuacagaa

SEQ ID NO: 1453193 - RNA, 13 nt, Homo sapiens
cugucucuuuaag

SEQ ID NO: 1453194 - RNA, 16 nt, Homo sapiens
cugucugucaccagcu

SEQ ID NO: 1453195 - RNA, 19 nt, Homo sapiens
cugucugucaccagcuauc

SEQ ID NO: 1453196 - RNA, 21 nt, Homo sapiens
cugucuuagaugucaagcuga

SEQ ID NO: 1453197 - RNA, 13 nt, Homo sapiens
cugucuuccucaa

SEQ ID NO: 1453198 - RNA, 21 nt, Homo sapiens
cugugaaaguacauuuggaga

SEQ ID NO: 1453199 - RNA, 18 nt, Homo sapiens
cugugacuucuccagguc

SEQ ID NO: 1453200 - RNA, 18 nt, Homo sapiens
cugugagaggcagcuauc

SEQ ID NO: 1453201 - RNA, 19 nt, Homo sapiens
cugugagcccagcuggguc

SEQ ID NO: 1453202 - RNA, 13 nt, Homo sapiens
cugugaguguaag

SEQ ID NO: 1453203 - RNA, 22 nt, Homo sapiens
cugugcaaccucuuggccugau

SEQ ID NO: 1453204 - RNA, 17 nt, Homo sapiens
cugugcagcacgucuca

SEQ ID NO: 1453205 - RNA, 13 nt, Homo sapiens
cugugcaugccau

SEQ ID NO: 1453206 - RNA, 16 nt, Homo sapiens
cugugcccacucccua

SEQ ID NO: 1453207 - RNA, 17 nt, Homo sapiens
cugugcuguguuuaauc

SEQ ID NO: 1453208 - RNA, 12 nt, Homo sapiens
cuguggaugcuu

SEQ ID NO: 1453209 - RNA, 19 nt, Homo sapiens
cuguggauggcaucaaaca

SEQ ID NO: 1453210 - RNA, 16 nt, Homo sapiens
cuguggcaucuuugcc

SEQ ID NO: 1453211 - RNA, 19 nt, Homo sapiens
cuguggcuucccaugucuu

SEQ ID NO: 1453212 - RNA, 15 nt, Homo sapiens
cugugggcagcaccc

SEQ ID NO: 1453213 - RNA, 22 nt, Homo sapiens
cugugggccccucaacagccaa

SEQ ID NO: 1453214 - RNA, 18 nt, Homo sapiens
cugugguuacagugcaga

SEQ ID NO: 1453215 - RNA, 23 nt, Homo sapiens
cuguguaacuguaaaacauugaa

SEQ ID NO: 1453216 - RNA, 16 nt, Homo sapiens
cugugucagaaacuga

SEQ ID NO: 1453217 - RNA, 23 nt, Homo sapiens
cugugugaccucaggccagugug

SEQ ID NO: 1453218 - RNA, 21 nt, Homo sapiens
cuguguggacugugaugccac

SEQ ID NO: 1453219 - RNA, 15 nt, Homo sapiens
cuguguuuccaucuc

SEQ ID NO: 1453220 - RNA, 15 nt, Homo sapiens
cuguuaacuaugaca

SEQ ID NO: 1453221 - RNA, 16 nt, Homo sapiens
cuguuaacuaugacag

SEQ ID NO: 1453222 - RNA, 13 nt, Homo sapiens
cuguuaauaguca

SEQ ID NO: 1453223 - RNA, 15 nt, Homo sapiens
cuguuaauauucuau

SEQ ID NO: 1453224 - RNA, 17 nt, Homo sapiens
cuguuacuuaccuaaac

SEQ ID NO: 1453225 - RNA, 21 nt, Homo sapiens
cuguuaggaacagcaguguuc

SEQ ID NO: 1453226 - RNA, 21 nt, Homo sapiens
cuguuaguaaauuucugugau

SEQ ID NO: 1453227 - RNA, 16 nt, Homo sapiens
cuguuagucauuugcu

SEQ ID NO: 1453228 - RNA, 22 nt, Homo sapiens
cuguuauuaccauuagcauucu

SEQ ID NO: 1453229 - RNA, 19 nt, Homo sapiens
cuguuauuuuaucugcuau

SEQ ID NO: 1453230 - RNA, 16 nt, Homo sapiens
cuguucuaacauguaa

SEQ ID NO: 1453231 - RNA, 17 nt, Homo sapiens
cuguucuccaggcuuca

SEQ ID NO: 1453232 - RNA, 20 nt, Homo sapiens
cuguucucuugggaacugaa

SEQ ID NO: 1453233 - RNA, 20 nt, Homo sapiens
cuguugugaucuugcauuca

SEQ ID NO: 1453234 - RNA, 13 nt, Homo sapiens
cuguuuaacauuu

SEQ ID NO: 1453235 - RNA, 15 nt, Homo sapiens
cuguuuccaguggua

SEQ ID NO: 1453236 - RNA, 20 nt, Homo sapiens
cuguuucccuuucacuggca

SEQ ID NO: 1453237 - RNA, 15 nt, Homo sapiens
cuguuuugccuucac

SEQ ID NO: 1453238 - RNA, 22 nt, Homo sapiens
cuguuuuguaagugcugcuaua

SEQ ID NO: 1453239 - RNA, 21 nt, Homo sapiens
cuguuuuucucuaaugcuuga

SEQ ID NO: 1453240 - RNA, 22 nt, Homo sapiens
cuguuuuuuuuuuuuagccaua

SEQ ID NO: 1453241 - RNA, 16 nt, Homo sapiens
cuuaaaaaauguccau

SEQ ID NO: 1453242 - RNA, 19 nt, Homo sapiens
cuuaaaauaauauacaugc

SEQ ID NO: 1453243 - RNA, 17 nt, Homo sapiens
cuuaaaauauauuucag

SEQ ID NO: 1453244 - RNA, 15 nt, Homo sapiens
cuuaaaaucugugaa

SEQ ID NO: 1453245 - RNA, 16 nt, Homo sapiens
cuuaaaauuaccagac

SEQ ID NO: 1453246 - RNA, 20 nt, Homo sapiens
cuuaaacagcagauuucaga

SEQ ID NO: 1453247 - RNA, 16 nt, Homo sapiens
cuuaaagaaguucccc

SEQ ID NO: 1453248 - RNA, 21 nt, Homo sapiens
cuuaaauauauaauguugcca

SEQ ID NO: 1453249 - RNA, 14 nt, Homo sapiens
cuuaaauccauccu

SEQ ID NO: 1453250 - RNA, 22 nt, Homo sapiens
cuuaaauguagcaauggcacug

SEQ ID NO: 1453251 - RNA, 13 nt, Homo sapiens
cuuaacacauuca

SEQ ID NO: 1453252 - RNA, 18 nt, Homo sapiens
cuuaacacuaucauggac

SEQ ID NO: 1453253 - RNA, 15 nt, Homo sapiens
cuuaacauucauaga

SEQ ID NO: 1453254 - RNA, 22 nt, Homo sapiens
cuuaacccccuagaaagacaga

SEQ ID NO: 1453255 - RNA, 12 nt, Homo sapiens
cuuaagauuugg

SEQ ID NO: 1453256 - RNA, 17 nt, Homo sapiens
cuuaagauuuugcaccu

SEQ ID NO: 1453257 - RNA, 19 nt, Homo sapiens
cuuaagauuuugcaccugu

SEQ ID NO: 1453258 - RNA, 14 nt, Homo sapiens
cuuaagcaaaagaa

SEQ ID NO: 1453259 - RNA, 12 nt, Homo sapiens
cuuaagcaaagg

SEQ ID NO: 1453260 - RNA, 11 nt, Homo sapiens
cuuaagccaua

SEQ ID NO: 1453261 - RNA, 20 nt, Homo sapiens
cuuaagcuuccgccgucuca

SEQ ID NO: 1453262 - RNA, 21 nt, Homo sapiens
cuuaagcuuccgccgucucaa

SEQ ID NO: 1453263 - RNA, 20 nt, Homo sapiens
cuuaaggaagaagaguauua

SEQ ID NO: 1453264 - RNA, 23 nt, Homo sapiens
cuuaauaaaggcccccacuucuc

SEQ ID NO: 1453265 - RNA, 16 nt, Homo sapiens
cuuaauaaauauuaca

SEQ ID NO: 1453266 - RNA, 21 nt, Homo sapiens
cuuaauaaauauuacagugaa

SEQ ID NO: 1453267 - RNA, 19 nt, Homo sapiens
cuuaauaaauuguguuucc

SEQ ID NO: 1453268 - RNA, 16 nt, Homo sapiens
cuuaauacuaccuuga

SEQ ID NO: 1453269 - RNA, 14 nt, Homo sapiens
cuuaauauguucuu

SEQ ID NO: 1453270 - RNA, 13 nt, Homo sapiens
cuuaaucuaaucu

SEQ ID NO: 1453271 - RNA, 13 nt, Homo sapiens
cuuacacaucuca

SEQ ID NO: 1453272 - RNA, 17 nt, Homo sapiens
cuuacagaacuacuucu

SEQ ID NO: 1453273 - RNA, 21 nt, Homo sapiens
cuuacaggguaacugugcuga

SEQ ID NO: 1453274 - RNA, 13 nt, Homo sapiens
cuuacauggcgcu

SEQ ID NO: 1453275 - RNA, 17 nt, Homo sapiens
cuuacauguguaaaggu

SEQ ID NO: 1453276 - RNA, 16 nt, Homo sapiens
cuuaccucacagugau

SEQ ID NO: 1453277 - RNA, 18 nt, Homo sapiens
cuuaccugaccucuugcu

SEQ ID NO: 1453278 - RNA, 13 nt, Homo sapiens
cuuacuacacuga

SEQ ID NO: 1453279 - RNA, 18 nt, Homo sapiens
cuuacuagaccuguaacu

SEQ ID NO: 1453280 - RNA, 14 nt, Homo sapiens
cuuacuauuacaua

SEQ ID NO: 1453281 - RNA, 15 nt, Homo sapiens
cuuacuggcaaacau

SEQ ID NO: 1453282 - RNA, 21 nt, Homo sapiens
cuuacugguccuuaccagaga

SEQ ID NO: 1453283 - RNA, 15 nt, Homo sapiens
cuuagaaauacuugu

SEQ ID NO: 1453284 - RNA, 20 nt, Homo sapiens
cuuagaacauuuuaauucau

SEQ ID NO: 1453285 - RNA, 19 nt, Homo sapiens
cuuagaauuauuugcacua

SEQ ID NO: 1453286 - RNA, 22 nt, Homo sapiens
cuuagagaggacaauacugggg

SEQ ID NO: 1453287 - RNA, 13 nt, Homo sapiens
cuuagauugccuc

SEQ ID NO: 1453288 - RNA, 18 nt, Homo sapiens
cuuagcaacucagagaaa

SEQ ID NO: 1453289 - RNA, 18 nt, Homo sapiens
cuuagcccuguguccuga

SEQ ID NO: 1453290 - RNA, 18 nt, Homo sapiens
cuuaggcccuagcggcag

SEQ ID NO: 1453291 - RNA, 23 nt, Homo sapiens
cuuaggccuuccucucuccagau

SEQ ID NO: 1453292 - RNA, 15 nt, Homo sapiens
cuuagggugaaccac

SEQ ID NO: 1453293 - RNA, 15 nt, Homo sapiens
cuuagucaugguguu

SEQ ID NO: 1453294 - RNA, 16 nt, Homo sapiens
cuuauaaaaaucuuaa

SEQ ID NO: 1453295 - RNA, 19 nt, Homo sapiens
cuuauaagaaagaucaaag

SEQ ID NO: 1453296 - RNA, 15 nt, Homo sapiens
cuuauacauuugaua

SEQ ID NO: 1453297 - RNA, 23 nt, Homo sapiens
cuuauaguguuuggacagcugau

SEQ ID NO: 1453298 - RNA, 23 nt, Homo sapiens
cuuauccauaggcgcaggugcac

SEQ ID NO: 1453299 - RNA, 15 nt, Homo sapiens
cuuaucccaagagaa

SEQ ID NO: 1453300 - RNA, 22 nt, Homo sapiens
cuuaucucagucaugcauaaau

SEQ ID NO: 1453301 - RNA, 17 nt, Homo sapiens
cuuaucugugcgugaaa

SEQ ID NO: 1453302 - RNA, 20 nt, Homo sapiens
cuaucauaauucagcacuua

SEQ ID NO: 1453303 - RNA, 22 nt, Homo sapiens
cuauccaaagaacuugauuugc

SEQ ID NO: 1453304 - RNA, 18 nt, Homo sapiens
cuaucccugcggccucca

SEQ ID NO: 1453305 - RNA, 15 nt, Homo sapiens
cuaucgcaccacugu

SEQ ID NO: 1453306 - RNA, 17 nt, Homo sapiens
cuaucguuauuauaaau

SEQ ID NO: 1453307 - RNA, 15 nt, Homo sapiens
cuaugaagaguauua

SEQ ID NO: 1453308 - RNA, 16 nt, Homo sapiens
cuaugcagccacauca

SEQ ID NO: 1453309 - RNA, 18 nt, Homo sapiens
cuaugcauuaagaguaaa

SEQ ID NO: 1453310 - RNA, 13 nt, Homo sapiens
cuaugugccccag

SEQ ID NO: 1453311 - RNA, 14 nt, Homo sapiens
cuauguuacuauuu

SEQ ID NO: 1453312 - RNA, 11 nt, Homo sapiens
cuauguucccc

SEQ ID NO: 1453313 - RNA, 21 nt, Homo sapiens
cuauguugccuaagcuggucu

SEQ ID NO: 1453314 - RNA, 14 nt, Homo sapiens
cuauguuuauuuac

SEQ ID NO: 1453315 - RNA, 20 nt, Homo sapiens
cuauuaaaacagccaaaacu

SEQ ID NO: 1453316 - RNA, 23 nt, Homo sapiens
cuauuaacuuuaauucucuuuca

SEQ ID NO: 1453317 - RNA, 12 nt, Homo sapiens
cuauuaagguga

SEQ ID NO: 1453318 - RNA, 23 nt, Homo sapiens
cuauuaaugauaaaaauaaugca

SEQ ID NO: 1453319 - RNA, 14 nt, Homo sapiens
cuauucagaauuga

SEQ ID NO: 1453320 - RNA, 12 nt, Homo sapiens
cuauuccugcug

SEQ ID NO: 1453321 - RNA, 23 nt, Homo sapiens
cuauucugagcauacucaacaaa

SEQ ID NO: 1453322 - RNA, 17 nt, Homo sapiens
cuauucuguaucauuga

SEQ ID NO: 1453323 - RNA, 21 nt, Homo sapiens
cuauuguuacauuauguggaa

SEQ ID NO: 1453324 - RNA, 21 nt, Homo sapiens
cuauuuaauuauuucacuuua

SEQ ID NO: 1453325 - RNA, 19 nt, Homo sapiens
cuauuucuucuacugcuau

SEQ ID NO: 1453326 - RNA, 12 nt, Homo sapiens
cuauuugccaug

SEQ ID NO: 1453327 - RNA, 21 nt, Homo sapiens
cuauuuucaacauaacugaag

SEQ ID NO: 1453328 - RNA, 19 nt, Homo sapiens
cucaaaaaauaauuaguua

SEQ ID NO: 1453329 - RNA, 12 nt, Homo sapiens
cucaaacacauc

SEQ ID NO: 1453330 - RNA, 18 nt, Homo sapiens
cucaaagugacuauucag

SEQ ID NO: 1453331 - RNA, 15 nt, Homo sapiens
cucaaauaacuaaaa

SEQ ID NO: 1453332 - RNA, 12 nt, Homo sapiens
cucaacagccaa

SEQ ID NO: 1453333 - RNA, 14 nt, Homo sapiens
cucaagaccagaga

SEQ ID NO: 1453334 - RNA, 17 nt, Homo sapiens
cucaaggaauuugcauu

SEQ ID NO: 1453335 - RNA, 19 nt, Homo sapiens
cucaagguggucaguaaau

SEQ ID NO: 1453336 - RNA, 19 nt, Homo sapiens
cucaauaaauugcaacaua

SEQ ID NO: 1453337 - RNA, 22 nt, Homo sapiens
cucaauaauauaauaauaguua

SEQ ID NO: 1453338 - RNA, 10 nt, Homo sapiens
cucaauguuu

SEQ ID NO: 1453339 - RNA, 23 nt, Homo sapiens
cucacaacuuggguucuucucag

SEQ ID NO: 1453340 - RNA, 19 nt, Homo sapiens
cucacaccuguaaucccaa

SEQ ID NO: 1453341 - RNA, 21 nt, Homo sapiens
cucacagagugcauugugagg

SEQ ID NO: 1453342 - RNA, 13 nt, Homo sapiens
cucaccaccugcc

SEQ ID NO: 1453343 - RNA, 17 nt, Homo sapiens
cucaccaccugccucua

SEQ ID NO: 1453344 - RNA, 12 nt, Homo sapiens
cucacgccugua

SEQ ID NO: 1453345 - RNA, 17 nt, Homo sapiens
cucacgccuguaauccc

SEQ ID NO: 1453346 - RNA, 15 nt, Homo sapiens
cucacucaccaucug

SEQ ID NO: 1453347 - RNA, 16 nt, Homo sapiens
cucacucccuguuuua

SEQ ID NO: 1453348 - RNA, 20 nt, Homo sapiens
cucacuccuaggagagccaa

SEQ ID NO: 1453349 - RNA, 15 nt, Homo sapiens
cucacugaaacaugg

SEQ ID NO: 1453350 - RNA, 16 nt, Homo sapiens
cucacuguucugcaaa

SEQ ID NO: 1453351 - RNA, 17 nt, Homo sapiens
cucacuguugaauuuuc

SEQ ID NO: 1453352 - RNA, 21 nt, Homo sapiens
cucacuuugaagagugugagg

SEQ ID NO: 1453353 - RNA, 14 nt, Homo sapiens
cucagaacccaucc

SEQ ID NO: 1453354 - RNA, 20 nt, Homo sapiens
cucagaacuugcugcugucu

SEQ ID NO: 1453355 - RNA, 16 nt, Homo sapiens
cuuccaugugccuuuc

SEQ ID NO: 1453356 - RNA, 24 nt, Homo sapiens
cuuccauuaacuuagcauguguug

SEQ ID NO: 1453357 - RNA, 19 nt, Homo sapiens
cuucccacucaccccggca

SEQ ID NO: 1453358 - RNA, 14 nt, Homo sapiens
cuucccagugaauu

SEQ ID NO: 1453359 - RNA, 19 nt, Homo sapiens
cuucccaugggcagaggac

SEQ ID NO: 1453360 - RNA, 13 nt, Homo sapiens
cuuccccagagag

SEQ ID NO: 1453361 - RNA, 16 nt, Homo sapiens
cuucccuaaucuucca

SEQ ID NO: 1453362 - RNA, 21 nt, Homo sapiens
cuucccucucugcagacuucc

SEQ ID NO: 1453363 - RNA, 12 nt, Homo sapiens
cuucccugauug

SEQ ID NO: 1453364 - RNA, 20 nt, Homo sapiens
cuucccuuucugcuuguguu

SEQ ID NO: 1453365 - RNA, 20 nt, Homo sapiens
cuuccuaauaugcuuuacaa

SEQ ID NO: 1453366 - RNA, 13 nt, Homo sapiens
cuuccuacucuuc

SEQ ID NO: 1453367 - RNA, 18 nt, Homo sapiens
cuuccucacuaugacacu

SEQ ID NO: 1453368 - RNA, 17 nt, Homo sapiens
cuuccuccucgcugcca

SEQ ID NO: 1453369 - RNA, 18 nt, Homo sapiens
cuuccucuagaagccaag

SEQ ID NO: 1453370 - RNA, 12 nt, Homo sapiens
cuuccugcagua

SEQ ID NO: 1453371 - RNA, 18 nt, Homo sapiens
cuuccuggaguacaaaca

SEQ ID NO: 1453372 - RNA, 20 nt, Homo sapiens
cuuccuggcuccaacacugc

SEQ ID NO: 1453373 - RNA, 17 nt, Homo sapiens
cuuccugggcaaagaag

SEQ ID NO: 1453374 - RNA, 23 nt, Homo sapiens
cuuccuguccccaaaaugugaug

SEQ ID NO: 1453375 - RNA, 14 nt, Homo sapiens
cuuccuguguccug

SEQ ID NO: 1453376 - RNA, 23 nt, Homo sapiens
cuuccuguguggccugccuucac

SEQ ID NO: 1453377 - RNA, 12 nt, Homo sapiens
cuuccuucaggg

SEQ ID NO: 1453378 - RNA, 22 nt, Homo sapiens
cuuccuuucuccaggaccaaua

SEQ ID NO: 1453379 - RNA, 18 nt, Homo sapiens
cuuccuuuuaacugccaa

SEQ ID NO: 1453380 - RNA, 17 nt, Homo sapiens
cuucggaguuucuuagu

SEQ ID NO: 1453381 - RNA, 14 nt, Homo sapiens
cuucggcaucuucu

SEQ ID NO: 1453382 - RNA, 18 nt, Homo sapiens
cuucuaggucacuucuca

SEQ ID NO: 1453383 - RNA, 14 nt, Homo sapiens
cuucucagccacaa

SEQ ID NO: 1453384 - RNA, 15 nt, Homo sapiens
cuucuccaaaugaga

SEQ ID NO: 1453385 - RNA, 15 nt, Homo sapiens
cuucuccccuuccau

SEQ ID NO: 1453386 - RNA, 22 nt, Homo sapiens
cuucucuauugggcacagccua

SEQ ID NO: 1453387 - RNA, 19 nt, Homo sapiens
cuucucuauuucuggauga

SEQ ID NO: 1453388 - RNA, 16 nt, Homo sapiens
cuucucugcacuuaua

SEQ ID NO: 1453389 - RNA, 13 nt, Homo sapiens
cuucucugcucca

SEQ ID NO: 1453390 - RNA, 21 nt, Homo sapiens
cuucugaacguggcacucuuc

SEQ ID NO: 1453391 - RNA, 14 nt, Homo sapiens
cuucugcaacaucu

SEQ ID NO: 1453392 - RNA, 13 nt, Homo sapiens
cuucugcacacaa

SEQ ID NO: 1453393 - RNA, 14 nt, Homo sapiens
cuucuggcuguaga

SEQ ID NO: 1453394 - RNA, 16 nt, Homo sapiens
cuucugggcacagugg

SEQ ID NO: 1453395 - RNA, 19 nt, Homo sapiens
cuucuggggguagaucuca

SEQ ID NO: 1453396 - RNA, 15 nt, Homo sapiens
cuucuggggguggug

SEQ ID NO: 1453397 - RNA, 14 nt, Homo sapiens
cuucuuacuauuaa

SEQ ID NO: 1453398 - RNA, 16 nt, Homo sapiens
cuucuuuuacuugaaa

SEQ ID NO: 1453399 - RNA, 21 nt, Homo sapiens
cuugaaaagcuaguguaccuc

SEQ ID NO: 1453400 - RNA, 21 nt, Homo sapiens
cuugaaaggaagagcuaauaa

SEQ ID NO: 1453401 - RNA, 22 nt, Homo sapiens
cuugguuaaaauggcuacacuc

SEQ ID NO: 1453402 - RNA, 16 nt, Homo sapiens
cuugguucacugcaac

SEQ ID NO: 1453403 - RNA, 21 nt, Homo sapiens
cuugguuuuuauaccauucag

SEQ ID NO: 1453404 - RNA, 16 nt, Homo sapiens
cuuguagaguggugcu

SEQ ID NO: 1453405 - RNA, 19 nt, Homo sapiens
cuuguaggauaagugaaau

SEQ ID NO: 1453406 - RNA, 22 nt, Homo sapiens
cuuguauuaaacucuucacaaa

SEQ ID NO: 1453407 - RNA, 14 nt, Homo sapiens
cuugucauuccaga

SEQ ID NO: 1453408 - RNA, 15 nt, Homo sapiens
cuugucauuccagag

SEQ ID NO: 1453409 - RNA, 16 nt, Homo sapiens
cuugucauuccagagu

SEQ ID NO: 1453410 - RNA, 16 nt, Homo sapiens
cuuguccugaugcugu

SEQ ID NO: 1453411 - RNA, 22 nt, Homo sapiens
cuugugagagcccauucccacc

SEQ ID NO: 1453412 - RNA, 14 nt, Homo sapiens
cuuguggguccaug

SEQ ID NO: 1453413 - RNA, 13 nt, Homo sapiens
cuugugugugaug

SEQ ID NO: 1453414 - RNA, 18 nt, Homo sapiens
cuugugugugggcuguga

SEQ ID NO: 1453415 - RNA, 21 nt, Homo sapiens
cuugugugugggcugugagug

SEQ ID NO: 1453416 - RNA, 23 nt, Homo sapiens
cuuguuucacacuagucacauuc

SEQ ID NO: 1453417 - RNA, 22 nt, Homo sapiens
cuuguuucccagauuucaggaa

SEQ ID NO: 1453418 - RNA, 15 nt, Homo sapiens
cuuguuugucuucca

SEQ ID NO: 1453419 - RNA, 20 nt, Homo sapiens
cuuguuuuauauaccuggcu

SEQ ID NO: 1453420 - RNA, 14 nt, Homo sapiens
cuuguuuucuugcc

SEQ ID NO: 1453421 - RNA, 18 nt, Homo sapiens
cuuuaaaaagcaguccuc

SEQ ID NO: 1453422 - RNA, 21 nt, Homo sapiens
cuuuaaccccaaauuuggcua

SEQ ID NO: 1453423 - RNA, 15 nt, Homo sapiens
cuuuaacucauaaaa

SEQ ID NO: 1453424 - RNA, 17 nt, Homo sapiens
cuuuaacuuuuacaaaa

SEQ ID NO: 1453425 - RNA, 18 nt, Homo sapiens
cuuuaauagaaguuuuau

SEQ ID NO: 1453426 - RNA, 21 nt, Homo sapiens
cuuuaaugaacuaacugacag

SEQ ID NO: 1453427 - RNA, 20 nt, Homo sapiens
cuuuacaaucugcacuuuaa

SEQ ID NO: 1453428 - RNA, 18 nt, Homo sapiens
cuuuacaccaacuccuaa

SEQ ID NO: 1453429 - RNA, 20 nt, Homo sapiens
cuuuacuucauggacuucca

SEQ ID NO: 1453430 - RNA, 22 nt, Homo sapiens
cuuuagcagggaagucacuuca

SEQ ID NO: 1453431 - RNA, 21 nt, Homo sapiens
cuuuaggcgugggcugaccag

SEQ ID NO: 1453432 - RNA, 15 nt, Homo sapiens
cuuuauaaauaucaa

SEQ ID NO: 1453433 - RNA, 13 nt, Homo sapiens
cuuuauacauuag

SEQ ID NO: 1453434 - RNA, 18 nt, Homo sapiens
cuuuauauggaugauuca

SEQ ID NO: 1453435 - RNA, 12 nt, Homo sapiens
cuuuauuuuaga

SEQ ID NO: 1453436 - RNA, 13 nt, Homo sapiens
cuuucaaaagccu

SEQ ID NO: 1453437 - RNA, 14 nt, Homo sapiens
cuuucaaaagccuu

SEQ ID NO: 1453438 - RNA, 20 nt, Homo sapiens
cuuucaagucugacucucca

SEQ ID NO: 1453439 - RNA, 21 nt, Homo sapiens
cuuucaauuacaaagcaguua

SEQ ID NO: 1453440 - RNA, 13 nt, Homo sapiens
cuuucacuuugaa

SEQ ID NO: 1453441 - RNA, 20 nt, Homo sapiens
cuuucagcucagcuaaugaa

SEQ ID NO: 1453442 - RNA, 17 nt, Homo sapiens
cuuuccaccaagcguuu

SEQ ID NO: 1453443 - RNA, 19 nt, Homo sapiens
cuuucccuucaguacccuc

SEQ ID NO: 1453444 - RNA, 20 nt, Homo sapiens
cuuuccuccacccauaauaa

SEQ ID NO: 1453445 - RNA, 19 nt, Homo sapiens
gaacucagcugaggccuug

SEQ ID NO: 1453446 - RNA, 19 nt, Homo sapiens
gaacucagcugucuguggc

SEQ ID NO: 1453447 - RNA, 12 nt, Homo sapiens
gaacucaguccu

SEQ ID NO: 1453448 - RNA, 22 nt, Homo sapiens
gaacuguuuuguaagugcugcu

SEQ ID NO: 1453449 - RNA, 14 nt, Homo sapiens
gaacuugccuuaaa

SEQ ID NO: 1453450 - RNA, 22 nt, Homo sapiens
gaacuugccuuaaacacucacc

SEQ ID NO: 1453451 - RNA, 18 nt, Homo sapiens
gaacuuuaagaagcagug

SEQ ID NO: 1453452 - RNA, 21 nt, Homo sapiens
gaacuuuaagaagcaguguuu

SEQ ID NO: 1453453 - RNA, 23 nt, Homo sapiens
gaacuuuaagaagcaguguuuua

SEQ ID NO: 1453454 - RNA, 14 nt, Homo sapiens
gaacuuuaagcaac

SEQ ID NO: 1453455 - RNA, 24 nt, Homo sapiens
gaacuuuaagcaacaagaccacca

SEQ ID NO: 1453456 - RNA, 17 nt, Homo sapiens
gaacuuuaagucucacc

SEQ ID NO: 1453457 - RNA, 22 nt, Homo sapiens
gaacuuuuuuagaaaugcaaaa

SEQ ID NO: 1453458 - RNA, 20 nt, Homo sapiens
gaagaaagagcaacaaucca

SEQ ID NO: 1453459 - RNA, 21 nt, Homo sapiens
gaagaacuggaaccccagcuu

SEQ ID NO: 1453460 - RNA, 14 nt, Homo sapiens
gaagaacuugcaug

SEQ ID NO: 1453461 - RNA, 19 nt, Homo sapiens
gaagaauauucaggacuua

SEQ ID NO: 1453462 - RNA, 13 nt, Homo sapiens
gaagaaugaaaau

SEQ ID NO: 1453463 - RNA, 12 nt, Homo sapiens
gaagacacugca

SEQ ID NO: 1453464 - RNA, 19 nt, Homo sapiens
gaagacagcugcuggguca

SEQ ID NO: 1453465 - RNA, 12 nt, Homo sapiens
gaagacaggaug

SEQ ID NO: 1453466 - RNA, 23 nt, Homo sapiens
gaagacaucuuauccauccucac

SEQ ID NO: 1453467 - RNA, 21 nt, Homo sapiens
gaagaccuaaagugcuugcuu

SEQ ID NO: 1453468 - RNA, 15 nt, Homo sapiens
gaagacuauggugcu

SEQ ID NO: 1453469 - RNA, 14 nt, Homo sapiens
gaagagaccaagac

SEQ ID NO: 1453470 - RNA, 15 nt, Homo sapiens
gaagaggaaagggag

SEQ ID NO: 1453471 - RNA, 17 nt, Homo sapiens
gaagagggacagaugaa

SEQ ID NO: 1453472 - RNA, 12 nt, Homo sapiens
gaagaguauuaa

SEQ ID NO: 1453473 - RNA, 21 nt, Homo sapiens
gaagaguggacaaacagggaa

SEQ ID NO: 1453474 - RNA, 21 nt, Homo sapiens
gaagaucaacgccucacugaa

SEQ ID NO: 1453475 - RNA, 18 nt, Homo sapiens
gaagaugaucauuugccc

SEQ ID NO: 1453476 - RNA, 19 nt, Homo sapiens
gaagcaacaggaaucaaga

SEQ ID NO: 1453477 - RNA, 19 nt, Homo sapiens
gaagcacuacaccuugccu

SEQ ID NO: 1453478 - RNA, 16 nt, Homo sapiens
gaagcagaagugcaau

SEQ ID NO: 1453479 - RNA, 18 nt, Homo sapiens
gaagcagaagugcaaucc

SEQ ID NO: 1453480 - RNA, 23 nt, Homo sapiens
gaagcaguuuaugagacagcuga

SEQ ID NO: 1453481 - RNA, 18 nt, Homo sapiens
gaagcauuccuucuuuga

SEQ ID NO: 1453482 - RNA, 17 nt, Homo sapiens
gaagccuggacucugcc

SEQ ID NO: 1453483 - RNA, 23 nt, Homo sapiens
gaagccugugccucccagcuuaa

SEQ ID NO: 1453484 - RNA, 18 nt, Homo sapiens
gaagcgaaacacagagaa

SEQ ID NO: 1453485 - RNA, 21 nt, Homo sapiens
gaagcggauuuccagggauau

SEQ ID NO: 1453486 - RNA, 14 nt, Homo sapiens
gaagcuccacuguc

SEQ ID NO: 1453487 - RNA, 16 nt, Homo sapiens
gaagcuccacugucac

SEQ ID NO: 1453488 - RNA, 13 nt, Homo sapiens
gaagcugcugacc

SEQ ID NO: 1453489 - RNA, 18 nt, Homo sapiens
gaagcuguuguacauuua

SEQ ID NO: 1453490 - RNA, 19 nt, Homo sapiens
gaagcuucuaaauggugcu

SEQ ID NO: 1453491 - RNA, 22 nt, Homo sapiens
gaagcuucuaaauggugcugca

SEQ ID NO: 1453492 - RNA, 22 nt, Homo sapiens
gaaggaacagcaauggugucag

SEQ ID NO: 1453493 - RNA, 14 nt, Homo sapiens
gaaggaacuuccag

SEQ ID NO: 1453494 - RNA, 21 nt, Homo sapiens
gaaggagaguccccugaaggu

SEQ ID NO: 1453495 - RNA, 19 nt, Homo sapiens
gaaggcuucuuagcgcagu

SEQ ID NO: 1453496 - RNA, 19 nt, Homo sapiens
gaagggacacacaagaaga

SEQ ID NO: 1453497 - RNA, 10 nt, Homo sapiens
gaagggccag

SEQ ID NO: 1453498 - RNA, 17 nt, Homo sapiens
gaagggcgagugaaucu

SEQ ID NO: 1453499 - RNA, 17 nt, Homo sapiens
gaagggggacacuccau

SEQ ID NO: 1453500 - RNA, 19 nt, Homo sapiens
gaagggggggcuacauuau

SEQ ID NO: 1453501 - RNA, 15 nt, Homo sapiens
gaagggguuccucaa

SEQ ID NO: 1453502 - RNA, 12 nt, Homo sapiens
gaaggguggaug

SEQ ID NO: 1453503 - RNA, 19 nt, Homo sapiens
gaagguagcccagcacugu

SEQ ID NO: 1453504 - RNA, 22 nt, Homo sapiens
gaagguauuccuuuuguguaca

SEQ ID NO: 1453505 - RNA, 16 nt, Homo sapiens
gcaagcaccuguuaau

SEQ ID NO: 1453506 - RNA, 11 nt, Homo sapiens
gcaagccagac

SEQ ID NO: 1453507 - RNA, 16 nt, Homo sapiens
gcaaggcccugcugcc

SEQ ID NO: 1453508 - RNA, 23 nt, Homo sapiens
gcaaguaaaaaggcuaaauggaa

SEQ ID NO: 1453509 - RNA, 15 nt, Homo sapiens
gcaaguccacugggg

SEQ ID NO: 1453510 - RNA, 17 nt, Homo sapiens
gcaagucuuccaugacc

SEQ ID NO: 1453511 - RNA, 16 nt, Homo sapiens
gcaaguuuccaucauc

SEQ ID NO: 1453512 - RNA, 21 nt, Homo sapiens
gcaauauaucugaagagcuau

SEQ ID NO: 1453513 - RNA, 11 nt, Homo sapiens
gcaaucacaac

SEQ ID NO: 1453514 - RNA, 20 nt, Homo sapiens
gcaaucacggcucacuguag

SEQ ID NO: 1453515 - RNA, 16 nt, Homo sapiens
gcaaucacugaucuca

SEQ ID NO: 1453516 - RNA, 23 nt, Homo sapiens
gcaaucuuugccuuuaucucuga

SEQ ID NO: 1453517 - RNA, 22 nt, Homo sapiens
gcaaugccaaucuucaguauuu

SEQ ID NO: 1453518 - RNA, 13 nt, Homo sapiens
gcaaugccauuuc

SEQ ID NO: 1453519 - RNA, 16 nt, Homo sapiens
gcaaugcccugugcau

SEQ ID NO: 1453520 - RNA, 22 nt, Homo sapiens
gcaauggcgccugcucccucca

SEQ ID NO: 1453521 - RNA, 17 nt, Homo sapiens
gcaaugggcacugggau

SEQ ID NO: 1453522 - RNA, 12 nt, Homo sapiens
gcaaugugcuac

SEQ ID NO: 1453523 - RNA, 16 nt, Homo sapiens
gcaauuucacugaugu

SEQ ID NO: 1453524 - RNA, 16 nt, Homo sapiens
gcaauuuucuaagcaa

SEQ ID NO: 1453525 - RNA, 18 nt, Homo sapiens
gcacaaggccaucugggc

SEQ ID NO: 1453526 - RNA, 22 nt, Homo sapiens
gcacaagggcacgugaagucau

SEQ ID NO: 1453527 - RNA, 19 nt, Homo sapiens
gcacacagcaggcuuucaa

SEQ ID NO: 1453528 - RNA, 21 nt, Homo sapiens
gcacagaaggaaucugugcag

SEQ ID NO: 1453529 - RNA, 16 nt, Homo sapiens
gcacagaccaguuuca

SEQ ID NO: 1453530 - RNA, 21 nt, Homo sapiens
gcacaggaguguccucuuccc

SEQ ID NO: 1453531 - RNA, 14 nt, Homo sapiens
gcacaggcagaugu

SEQ ID NO: 1453532 - RNA, 19 nt, Homo sapiens
gcacaguagagcaaaucua

SEQ ID NO: 1453533 - RNA, 16 nt, Homo sapiens
gcacaguccagaccca

SEQ ID NO: 1453534 - RNA, 19 nt, Homo sapiens
gcacaguguaauccagggg

SEQ ID NO: 1453535 - RNA, 14 nt, Homo sapiens
gcacauuucuuugc

SEQ ID NO: 1453536 - RNA, 13 nt, Homo sapiens
gcaccacugcacu

SEQ ID NO: 1453537 - RNA, 15 nt, Homo sapiens
gcaccacuguguauu

SEQ ID NO: 1453538 - RNA, 17 nt, Homo sapiens
gcaccagacacccagga

SEQ ID NO: 1453539 - RNA, 14 nt, Homo sapiens
gcaguuggcagaaa

SEQ ID NO: 1453540 - RNA, 18 nt, Homo sapiens
gcaguuuaagagcagaac

SEQ ID NO: 1453541 - RNA, 15 nt, Homo sapiens
gcaguuuaugagaca

SEQ ID NO: 1453542 - RNA, 23 nt, Homo sapiens
gcaguuucugacacuuguuguug

SEQ ID NO: 1453543 - RNA, 18 nt, Homo sapiens
gcauaauaagcuaaagag

SEQ ID NO: 1453544 - RNA, 14 nt, Homo sapiens
gcauaauagucaau

SEQ ID NO: 1453545 - RNA, 23 nt, Homo sapiens
gcauacagacuggggacccugga

SEQ ID NO: 1453546 - RNA, 18 nt, Homo sapiens
gcauauuuuaaugcaguu

SEQ ID NO: 1453547 - RNA, 19 nt, Homo sapiens
gcaucagaccugcauugaa

SEQ ID NO: 1453548 - RNA, 20 nt, Homo sapiens
gcaucagucccccugugcau

SEQ ID NO: 1453549 - RNA, 14 nt, Homo sapiens
gcauccuggccaac

SEQ ID NO: 1453550 - RNA, 18 nt, Homo sapiens
gcaucggacaagaccccc

SEQ ID NO: 1453551 - RNA, 23 nt, Homo sapiens
gcaucgggagcacccagagcacc

SEQ ID NO: 1453552 - RNA, 20 nt, Homo sapiens
gcaucuagauuauggagcuu

SEQ ID NO: 1453553 - RNA, 12 nt, Homo sapiens
gcaucugugaug

SEQ ID NO: 1453554 - RNA, 15 nt, Homo sapiens
gcaugaaccuggacc

SEQ ID NO: 1453555 - RNA, 17 nt, Homo sapiens
gcaugaauccaguccag

SEQ ID NO: 1453556 - RNA, 19 nt, Homo sapiens
gcaugagaaagaauuugag

SEQ ID NO: 1453557 - RNA, 23 nt, Homo sapiens
gcaugcagccagccaucaaauag

SEQ ID NO: 1453558 - RNA, 16 nt, Homo sapiens
gcaugcagugcccuca

SEQ ID NO: 1453559 - RNA, 18 nt, Homo sapiens
gcaugccacccucacaca

SEQ ID NO: 1453560 - RNA, 20 nt, Homo sapiens
gcaugccauugaaacuaaga

SEQ ID NO: 1453561 - RNA, 21 nt, Homo sapiens
gcauggacaccccuuauccag

SEQ ID NO: 1453562 - RNA, 18 nt, Homo sapiens
gcauggauggguccucac

SEQ ID NO: 1453563 - RNA, 21 nt, Homo sapiens
gcauggcaagucacaugcgua

SEQ ID NO: 1453564 - RNA, 20 nt, Homo sapiens
gcauggccccaguccaugcu

SEQ ID NO: 1453565 - RNA, 17 nt, Homo sapiens
gcauggucccugccuua

SEQ ID NO: 1453566 - RNA, 13 nt, Homo sapiens
gcauggugcaguu

SEQ ID NO: 1453567 - RNA, 21 nt, Homo sapiens
gcaugugcugugaccauuuau

SEQ ID NO: 1453568 - RNA, 15 nt, Homo sapiens
gcaugugugauuuca

SEQ ID NO: 1453569 - RNA, 21 nt, Homo sapiens
gcauuagcucuuagacccaca

SEQ ID NO: 1453570 - RNA, 19 nt, Homo sapiens
gcauucauuuuuauagcaa

SEQ ID NO: 1453571 - RNA, 17 nt, Homo sapiens
gcauuccagcugucacu

SEQ ID NO: 1453572 - RNA, 20 nt, Homo sapiens
gcauuccaucccuuccugaa

SEQ ID NO: 1453573 - RNA, 19 nt, Homo sapiens
gcauucuaucguuauuaua

SEQ ID NO: 1453574 - RNA, 14 nt, Homo sapiens
gcauucuauugccu

SEQ ID NO: 1453575 - RNA, 23 nt, Homo sapiens
gcauugauggccucaauguggca

SEQ ID NO: 1453576 - RNA, 14 nt, Homo sapiens
gcauugcuuuccac

SEQ ID NO: 1453577 - RNA, 21 nt, Homo sapiens
gcauuguugagguggucugaa

SEQ ID NO: 1453578 - RNA, 21 nt, Homo sapiens
gcauuuacagaaacgcaucca

SEQ ID NO: 1453579 - RNA, 16 nt, Homo sapiens
gcauuuagucuugcca

SEQ ID NO: 1453580 - RNA, 12 nt, Homo sapiens
gcauuucuugcg

SEQ ID NO: 1453581 - RNA, 19 nt, Homo sapiens
gcauuugucuguguuugaa

SEQ ID NO: 1453582 - RNA, 19 nt, Homo sapiens
gcauuuucuucucugcacu

SEQ ID NO: 1453583 - RNA, 16 nt, Homo sapiens
gcauuuugcuauugua

SEQ ID NO: 1453584 - RNA, 15 nt, Homo sapiens
gcauuuuucugggag

SEQ ID NO: 1453585 - RNA, 14 nt, Homo sapiens
gccaaagacuguaa

SEQ ID NO: 1453586 - RNA, 18 nt, Homo sapiens
gccaaaggaugugauaua

SEQ ID NO: 1453587 - RNA, 15 nt, Homo sapiens
gccaaauaaaaucua

SEQ ID NO: 1453588 - RNA, 13 nt, Homo sapiens
gccaaauguaauu

SEQ ID NO: 1453589 - RNA, 20 nt, Homo sapiens
gccaacaaagaacacuaacu

SEQ ID NO: 1453590 - RNA, 12 nt, Homo sapiens
gccaacccagcc

SEQ ID NO: 1453591 - RNA, 12 nt, Homo sapiens
gccaacugaaaa

SEQ ID NO: 1453592 - RNA, 20 nt, Homo sapiens
gccaacuuucucugcaacua

SEQ ID NO: 1453593 - RNA, 14 nt, Homo sapiens
gccaagaacgcagg

SEQ ID NO: 1453594 - RNA, 16 nt, Homo sapiens
gccaagacagugaagu

SEQ ID NO: 1453595 - RNA, 16 nt, Homo sapiens
gccaagagaauauccg

SEQ ID NO: 1453596 - RNA, 21 nt, Homo sapiens
gccaagauugcaccacugcuc

SEQ ID NO: 1453597 - RNA, 23 nt, Homo sapiens
gccaagcuuucuucuacaaccag

SEQ ID NO: 1453598 - RNA, 21 nt, Homo sapiens
gccaaggggugggccugugaa

SEQ ID NO: 1453599 - RNA, 22 nt, Homo sapiens
gccaaggggugggccugugaau

SEQ ID NO: 1453600 - RNA, 23 nt, Homo sapiens
gccaaggugggguauuuaccaca

SEQ ID NO: 1453601 - RNA, 19 nt, Homo sapiens
gccaaugccccacuggcag

SEQ ID NO: 1453602 - RNA, 16 nt, Homo sapiens
gccaauucacaaguua

SEQ ID NO: 1453603 - RNA, 20 nt, Homo sapiens
gccacaaaacugacaguaaa

SEQ ID NO: 1453604 - RNA, 14 nt, Homo sapiens
gccacaacugcccc

SEQ ID NO: 1453605 - RNA, 15 nt, Homo sapiens
gccacaagucuucca

SEQ ID NO: 1453606 - RNA, 11 nt, Homo sapiens
gccacagccau

SEQ ID NO: 1453607 - RNA, 20 nt, Homo sapiens
gccaccuccagacaccagug

SEQ ID NO: 1453608 - RNA, 11 nt, Homo sapiens
gccaccucucc

SEQ ID NO: 1453609 - RNA, 23 nt, Homo sapiens
gccaccucucuccuuugcugagg

SEQ ID NO: 1453610 - RNA, 15 nt, Homo sapiens
gccacgcacugggcc

SEQ ID NO: 1453611 - RNA, 18 nt, Homo sapiens
gccacggcugagccuuca

SEQ ID NO: 1453612 - RNA, 14 nt, Homo sapiens
gccacgugggcaaa

SEQ ID NO: 1453613 - RNA, 20 nt, Homo sapiens
gccacuccagaccccuggcu

SEQ ID NO: 1453614 - RNA, 23 nt, Homo sapiens
gccacugagaagugcacuuuaag

SEQ ID NO: 1453615 - RNA, 13 nt, Homo sapiens
gccacugcacucc

SEQ ID NO: 1453616 - RNA, 23 nt, Homo sapiens
gccacuggaaggaacauggagcu

SEQ ID NO: 1453617 - RNA, 15 nt, Homo sapiens
gccacuggaccucag

SEQ ID NO: 1453618 - RNA, 12 nt, Homo sapiens
gccagaagugaa

SEQ ID NO: 1453619 - RNA, 19 nt, Homo sapiens
gccagacaugccacaagga

SEQ ID NO: 1453620 - RNA, 22 nt, Homo sapiens
gccagagaaaauguuggaagag

SEQ ID NO: 1453621 - RNA, 17 nt, Homo sapiens
gccagagaugcuggacu

SEQ ID NO: 1453622 - RNA, 13 nt, Homo sapiens
gccagagggcagu

SEQ ID NO: 1453623 - RNA, 19 nt, Homo sapiens
gccagaugugaaaacaucu

SEQ ID NO: 1453624 - RNA, 21 nt, Homo sapiens
gccagcaaugacaucucaggg

SEQ ID NO: 1453625 - RNA, 17 nt, Homo sapiens
gccagcaaugaugucca

SEQ ID NO: 1453626 - RNA, 18 nt, Homo sapiens
gccagcacacagggcagu

SEQ ID NO: 1453627 - RNA, 14 nt, Homo sapiens
gccagcacgccgcu

SEQ ID NO: 1453628 - RNA, 11 nt, Homo sapiens
gccagcacuuc

SEQ ID NO: 1453629 - RNA, 15 nt, Homo sapiens
gccagccagugccau

SEQ ID NO: 1453630 - RNA, 14 nt, Homo sapiens
gccagccaucaaau

SEQ ID NO: 1453631 - RNA, 21 nt, Homo sapiens
gccagccugucccauggacac

SEQ ID NO: 1453632 - RNA, 21 nt, Homo sapiens
gccagcgggcacagggcacca

SEQ ID NO: 1453633 - RNA, 14 nt, Homo sapiens
gccagcuacuuccu

SEQ ID NO: 1453634 - RNA, 20 nt, Homo sapiens
gccagcugggagcacuggug

SEQ ID NO: 1453635 - RNA, 22 nt, Homo sapiens
gccagcugugggacaauuaucu

SEQ ID NO: 1453636 - RNA, 22 nt, Homo sapiens
gccaggaaucacuggcuguuaa

SEQ ID NO: 1453637 - RNA, 14 nt, Homo sapiens
gccaggacaccagu

SEQ ID NO: 1453638 - RNA, 21 nt, Homo sapiens
gccaggacaugcagcccagaa

SEQ ID NO: 1453639 - RNA, 22 nt, Homo sapiens
gccaggauggucucgaucuccu

SEQ ID NO: 1453640 - RNA, 17 nt, Homo sapiens
aaaauuauacuaacuua

SEQ ID NO: 1453641 - RNA, 13 nt, Homo sapiens
aaaauucccauuu

SEQ ID NO: 1453642 - RNA, 21 nt, Homo sapiens
aaaauucuauuacaguauguc

SEQ ID NO: 1453643 - RNA, 17 nt, Homo sapiens
aaaauucuuaaguaugu

SEQ ID NO: 1453644 - RNA, 12 nt, Homo sapiens
aaaauuucaguc

SEQ ID NO: 1453645 - RNA, 16 nt, Homo sapiens
aaaauuuuuacauuca

SEQ ID NO: 1453646 - RNA, 22 nt, Homo sapiens
aaacaaaaaaaccucuaugcaa

SEQ ID NO: 1453647 - RNA, 11 nt, Homo sapiens
aaacaaaaaug

SEQ ID NO: 1453648 - RNA, 10 nt, Homo sapiens
aaacaaagug

SEQ ID NO: 1453649 - RNA, 13 nt, Homo sapiens
aaacaaauaugca

SEQ ID NO: 1453650 - RNA, 21 nt, Homo sapiens
aaacaacuuguacuuguuuca

SEQ ID NO: 1453651 - RNA, 21 nt, Homo sapiens
aaacaagacuccucaucauga

SEQ ID NO: 1453652 - RNA, 19 nt, Homo sapiens
aaacaauuggcaaacuuug

SEQ ID NO: 1453653 - RNA, 13 nt, Homo sapiens
aaacaauuuaaac

SEQ ID NO: 1453654 - RNA, 22 nt, Homo sapiens
aaacacaaauagaacauuccau

SEQ ID NO: 1453655 - RNA, 16 nt, Homo sapiens
aaacacaugccuuaaa

SEQ ID NO: 1453656 - RNA, 22 nt, Homo sapiens
aaacaccuagcuuuauucuuca

SEQ ID NO: 1453657 - RNA, 12 nt, Homo sapiens
aaacacuccacc

SEQ ID NO: 1453658 - RNA, 20 nt, Homo sapiens
aaacagaaagcauccuaaau

SEQ ID NO: 1453659 - RNA, 14 nt, Homo sapiens
aaacagaagccuga

SEQ ID NO: 1453660 - RNA, 15 nt, Homo sapiens
aaacagagaugugau

SEQ ID NO: 1453661 - RNA, 21 nt, Homo sapiens
aaacagauaacaccaaaccaa

SEQ ID NO: 1453662 - RNA, 15 nt, Homo sapiens
aaacagaugccccag

SEQ ID NO: 1453663 - RNA, 19 nt, Homo sapiens
aaacagauggcacuuugaa

SEQ ID NO: 1453664 - RNA, 21 nt, Homo sapiens
aaacagcagauuucagaucau

SEQ ID NO: 1453665 - RNA, 16 nt, Homo sapiens
aaacaggaacaaucca

SEQ ID NO: 1453666 - RNA, 13 nt, Homo sapiens
aaacagggcaaag

SEQ ID NO: 1453667 - RNA, 18 nt, Homo sapiens
aaacagguauauacuuug

SEQ ID NO: 1453668 - RNA, 16 nt, Homo sapiens
aaacauccuugcaaau

SEQ ID NO: 1453669 - RNA, 22 nt, Homo sapiens
aaacauguuucugccuucuuua

SEQ ID NO: 1453670 - RNA, 15 nt, Homo sapiens
aaacauuaaugcaau

SEQ ID NO: 1453671 - RNA, 21 nt, Homo sapiens
aaacauugaaguaaugaauuu

SEQ ID NO: 1453672 - RNA, 17 nt, Homo sapiens
aaacauuggacagugag

SEQ ID NO: 1453673 - RNA, 11 nt, Homo sapiens
aaaccaaagau

SEQ ID NO: 1453674 - RNA, 17 nt, Homo sapiens
aaaccaccgugaaccag

SEQ ID NO: 1453675 - RNA, 23 nt, Homo sapiens
aaacccaagugccuucagaggau

SEQ ID NO: 1453676 - RNA, 20 nt, Homo sapiens
aaaccccaucuuuacuaaaa

SEQ ID NO: 1453677 - RNA, 16 nt, Homo sapiens
aaaccgcacucaccca

SEQ ID NO: 1453678 - RNA, 23 nt, Homo sapiens
aaaccguccccuccuucccucac

SEQ ID NO: 1453679 - RNA, 15 nt, Homo sapiens
aaaccguggucucau

SEQ ID NO: 1453680 - RNA, 15 nt, Homo sapiens
aaaccuaguacugcc

SEQ ID NO: 1453681 - RNA, 14 nt, Homo sapiens
aaaccuauguuugc

SEQ ID NO: 1453682 - RNA, 15 nt, Homo sapiens
aaaccuccagccucc

SEQ ID NO: 1453683 - RNA, 14 nt, Homo sapiens
aaaccugugugcca

SEQ ID NO: 1453684 - RNA, 22 nt, Homo sapiens
aaaccuucaucugaaacccaca

SEQ ID NO: 1453685 - RNA, 18 nt, Homo sapiens
aaaccuugcucuccucau

SEQ ID NO: 1453686 - RNA, 12 nt, Homo sapiens
aaaccuuucuac

SEQ ID NO: 1453687 - RNA, 19 nt, Homo sapiens
aaacgucuucuaaacuucc

SEQ ID NO: 1453688 - RNA, 20 nt, Homo sapiens
aaacgucuucuaaacuuccc

SEQ ID NO: 1453689 - RNA, 16 nt, Homo sapiens
aaacuaagagcucuca

SEQ ID NO: 1453690 - RNA, 13 nt, Homo sapiens
aaacuaagccagg

SEQ ID NO: 1453691 - RNA, 15 nt, Homo sapiens
aaacuaccaauccca

SEQ ID NO: 1453692 - RNA, 21 nt, Homo sapiens
aaacuagcagaagaacuagua

SEQ ID NO: 1453693 - RNA, 18 nt, Homo sapiens
aaacuauucaugaauauu

SEQ ID NO: 1453694 - RNA, 19 nt, Homo sapiens
aaacuauuggaaaguacuc

SEQ ID NO: 1453695 - RNA, 15 nt, Homo sapiens
aaacuauuugggaua

SEQ ID NO: 1453696 - RNA, 15 nt, Homo sapiens
aaaggcugguggcaa

SEQ ID NO: 1453697 - RNA, 14 nt, Homo sapiens
aaaggggcacuggu

SEQ ID NO: 1453698 - RNA, 22 nt, Homo sapiens
aaaggguugggagcugaugaaa

SEQ ID NO: 1453699 - RNA, 12 nt, Homo sapiens
aaaggucuuaaa

SEQ ID NO: 1453700 - RNA, 16 nt, Homo sapiens
aaaggugagcccucau

SEQ ID NO: 1453701 - RNA, 21 nt, Homo sapiens
aaaggugguccuuccuaccuc

SEQ ID NO: 1453702 - RNA, 14 nt, Homo sapiens
aaagguugccugaa

SEQ ID NO: 1453703 - RNA, 13 nt, Homo sapiens
aaagguuguguag

SEQ ID NO: 1453704 - RNA, 15 nt, Homo sapiens
aaaguaaagacugua

SEQ ID NO: 1453705 - RNA, 13 nt, Homo sapiens
aaaguaaggugca

SEQ ID NO: 1453706 - RNA, 20 nt, Homo sapiens
aaaguaaguuaauaauguau

SEQ ID NO: 1453707 - RNA, 14 nt, Homo sapiens
aaaguacaaaaauu

SEQ ID NO: 1453708 - RNA, 13 nt, Homo sapiens
aaaguagauugag

SEQ ID NO: 1453709 - RNA, 17 nt, Homo sapiens
aaaguagggaccucaga

SEQ ID NO: 1453710 - RNA, 15 nt, Homo sapiens
aaaguccacaguuua

SEQ ID NO: 1453711 - RNA, 18 nt, Homo sapiens
aaagucuacauacuuuca

SEQ ID NO: 1453712 - RNA, 16 nt, Homo sapiens
aaagucuauucaaaag

SEQ ID NO: 1453713 - RNA, 14 nt, Homo sapiens
aaagugacuauuca

SEQ ID NO: 1453714 - RNA, 10 nt, Homo sapiens
aaagugcaua

SEQ ID NO: 1453715 - RNA, 11 nt, Homo sapiens
aaagugcauau

SEQ ID NO: 1453716 - RNA, 20 nt, Homo sapiens
aaagugcugggauuacaggu

SEQ ID NO: 1453717 - RNA, 16 nt, Homo sapiens
aaaguggaaauggaga

SEQ ID NO: 1453718 - RNA, 15 nt, Homo sapiens
aaaguggcaaucuca

SEQ ID NO: 1453719 - RNA, 14 nt, Homo sapiens
aaaguggccaugcc

SEQ ID NO: 1453720 - RNA, 14 nt, Homo sapiens
aaagugggcuugau

SEQ ID NO: 1453721 - RNA, 17 nt, Homo sapiens
aaaguguaaguucacaa

SEQ ID NO: 1453722 - RNA, 19 nt, Homo sapiens
aaagugugagcucuucccu

SEQ ID NO: 1453723 - RNA, 15 nt, Homo sapiens
aaaguuaaacauuga

SEQ ID NO: 1453724 - RNA, 18 nt, Homo sapiens
aaaguuacuauucuguau

SEQ ID NO: 1453725 - RNA, 15 nt, Homo sapiens
aaaguuccuuccuaa

SEQ ID NO: 1453726 - RNA, 14 nt, Homo sapiens
aaaguucugggacu

SEQ ID NO: 1453727 - RNA, 18 nt, Homo sapiens
aaaguucuugguggugga

SEQ ID NO: 1453728 - RNA, 13 nt, Homo sapiens
aaaguugccuuua

SEQ ID NO: 1453729 - RNA, 19 nt, Homo sapiens
aaaguugccuuuauuugcu

SEQ ID NO: 1453730 - RNA, 19 nt, Homo sapiens
aaaguuuaucacacagugu

SEQ ID NO: 1453731 - RNA, 16 nt, Homo sapiens
aaauaaaaaaagacaa

SEQ ID NO: 1453732 - RNA, 17 nt, Homo sapiens
aaauaaaaggaagccaa

SEQ ID NO: 1453733 - RNA, 14 nt, Homo sapiens
aaauaaaaucacca

SEQ ID NO: 1453734 - RNA, 14 nt, Homo sapiens
aaauaaacaucagu

SEQ ID NO: 1453735 - RNA, 21 nt, Homo sapiens
aaauaaccacaagguccacuc

SEQ ID NO: 1453736 - RNA, 23 nt, Homo sapiens
aaauaacuaaaagguaugcaauc

SEQ ID NO: 1453737 - RNA, 19 nt, Homo sapiens
aaauaauaaacaguggaau

SEQ ID NO: 1453738 - RNA, 12 nt, Homo sapiens
aaauaauaugca

SEQ ID NO: 1453739 - RNA, 19 nt, Homo sapiens
aaauaauauggcuaugcuu

SEQ ID NO: 1453740 - RNA, 14 nt, Homo sapiens
aaauaaugaauaca

SEQ ID NO: 1453741 - RNA, 17 nt, Homo sapiens
aaauaauucaugauuca

SEQ ID NO: 1453742 - RNA, 16 nt, Homo sapiens
aaauaauuuuaucucu

SEQ ID NO: 1453743 - RNA, 11 nt, Homo sapiens
aaauacaauaa

SEQ ID NO: 1453744 - RNA, 17 nt, Homo sapiens
aaauacacuugugauua

SEQ ID NO: 1453745 - RNA, 13 nt, Homo sapiens
aaauacugugccu

SEQ ID NO: 1453746 - RNA, 18 nt, Homo sapiens
aaauuucaguccagaaga

SEQ ID NO: 1453747 - RNA, 18 nt, Homo sapiens
aaauuugauugauuugaa

SEQ ID NO: 1453748 - RNA, 16 nt, Homo sapiens
aaauuuuuacugagaa

SEQ ID NO: 1453749 - RNA, 15 nt, Homo sapiens
aaauuuuuaggcaaa

SEQ ID NO: 1453750 - RNA, 18 nt, Homo sapiens
aacaaacauccuugcaaa

SEQ ID NO: 1453751 - RNA, 16 nt, Homo sapiens
aacaaagcagccacga

SEQ ID NO: 1453752 - RNA, 15 nt, Homo sapiens
aacaaaugugcugcu

SEQ ID NO: 1453753 - RNA, 15 nt, Homo sapiens
aacaaauuauguuac

SEQ ID NO: 1453754 - RNA, 20 nt, Homo sapiens
aacaaauucauauucugucu

SEQ ID NO: 1453755 - RNA, 13 nt, Homo sapiens
aacaacaacuauc

SEQ ID NO: 1453756 - RNA, 14 nt, Homo sapiens
aacaacuacuguga

SEQ ID NO: 1453757 - RNA, 13 nt, Homo sapiens
aacaacucuaguc

SEQ ID NO: 1453758 - RNA, 18 nt, Homo sapiens
aacaacucuccagugccu

SEQ ID NO: 1453759 - RNA, 15 nt, Homo sapiens
aacaacuucagucca

SEQ ID NO: 1453760 - RNA, 18 nt, Homo sapiens
aacaagaaugcauucccu

SEQ ID NO: 1453761 - RNA, 20 nt, Homo sapiens
aacaagacuccucaucauga

SEQ ID NO: 1453762 - RNA, 18 nt, Homo sapiens
aacaagcuccaccuucca

SEQ ID NO: 1453763 - RNA, 13 nt, Homo sapiens
aacaaugacuuaa

SEQ ID NO: 1453764 - RNA, 14 nt, Homo sapiens
aacaauucugugac

SEQ ID NO: 1453765 - RNA, 15 nt, Homo sapiens
aacaauucugugaca

SEQ ID NO: 1453766 - RNA, 13 nt, Homo sapiens
aacaauugguaaa

SEQ ID NO: 1453767 - RNA, 23 nt, Homo sapiens
aacaauuuuaggaggaccagagc

SEQ ID NO: 1453768 - RNA, 23 nt, Homo sapiens
aacacagagaagcggauuuccag

SEQ ID NO: 1453769 - RNA, 20 nt, Homo sapiens
aacacagcaacaaugacuua

SEQ ID NO: 1453770 - RNA, 23 nt, Homo sapiens
aacacagcuuacaaucgcaaauc

SEQ ID NO: 1453771 - RNA, 21 nt, Homo sapiens
aacacagcuuuacaacuucca

SEQ ID NO: 1453772 - RNA, 13 nt, Homo sapiens
aacacauucaaua

SEQ ID NO: 1453773 - RNA, 23 nt, Homo sapiens
aacacauucuuauuaauucuuca

SEQ ID NO: 1453774 - RNA, 17 nt, Homo sapiens
aacaccaaaaagggauc

SEQ ID NO: 1453775 - RNA, 22 nt, Homo sapiens
aacaccaaaaaugaugcgcauc

SEQ ID NO: 1453776 - RNA, 15 nt, Homo sapiens
aacaccaagcacagc

SEQ ID NO: 1453777 - RNA, 20 nt, Homo sapiens
aacacccgacuccucaaaag

SEQ ID NO: 1453778 - RNA, 22 nt, Homo sapiens
aacacccuguagguucuugaua

SEQ ID NO: 1453779 - RNA, 17 nt, Homo sapiens
aacacguuggcucaguc

SEQ ID NO: 1453780 - RNA, 14 nt, Homo sapiens
aacacuaaacauuc

SEQ ID NO: 1453781 - RNA, 17 nt, Homo sapiens
aacacuacauuacuuua

SEQ ID NO: 1453782 - RNA, 14 nt, Homo sapiens
aacacugcacucuu

SEQ ID NO: 1453783 - RNA, 21 nt, Homo sapiens
aacacuggugggcagcugagg

SEQ ID NO: 1453784 - RNA, 13 nt, Homo sapiens
aacacugugcaaa

SEQ ID NO: 1453785 - RNA, 16 nt, Homo sapiens
aacacuucgagcacug

SEQ ID NO: 1453786 - RNA, 18 nt, Homo sapiens
aacagaaagcauccuaaa

SEQ ID NO: 1453787 - RNA, 16 nt, Homo sapiens
aacagaagcuuccauu

SEQ ID NO: 1453788 - RNA, 13 nt, Homo sapiens
aacagacaauauu

SEQ ID NO: 1453789 - RNA, 14 nt, Homo sapiens
aacagaugccccag

SEQ ID NO: 1453790 - RNA, 17 nt, Homo sapiens
aacagcaauggugucag

SEQ ID NO: 1453791 - RNA, 14 nt, Homo sapiens
aacagcaccucccc

SEQ ID NO: 1453792 - RNA, 20 nt, Homo sapiens
aacagcagugaucucagggc

SEQ ID NO: 1453793 - RNA, 18 nt, Homo sapiens
aacagcaguguucucaca

SEQ ID NO: 1453794 - RNA, 15 nt, Homo sapiens
aacagccaacuagcc

SEQ ID NO: 1453795 - RNA, 16 nt, Homo sapiens
aacagccaagugugac

SEQ ID NO: 1453796 - RNA, 14 nt, Homo sapiens
aacagcucucaccu

SEQ ID NO: 1453797 - RNA, 23 nt, Homo sapiens
aacagcugaggucucuugaggga

SEQ ID NO: 1453798 - RNA, 15 nt, Homo sapiens
aauggggaauucucu

SEQ ID NO: 1453799 - RNA, 13 nt, Homo sapiens
aauggggccagau

SEQ ID NO: 1453800 - RNA, 12 nt, Homo sapiens
aauggucaucca

SEQ ID NO: 1453801 - RNA, 19 nt, Homo sapiens
aaugguggaguguagccuc

SEQ ID NO: 1453802 - RNA, 20 nt, Homo sapiens
aauguaaauuaaaauuucca

SEQ ID NO: 1453803 - RNA, 15 nt, Homo sapiens
aauguaacugugcca

SEQ ID NO: 1453804 - RNA, 13 nt, Homo sapiens
aauguaugugcuc

SEQ ID NO: 1453805 - RNA, 14 nt, Homo sapiens
aauguaugugcucu

SEQ ID NO: 1453806 - RNA, 17 nt, Homo sapiens
aauguauuuguuugcaa

SEQ ID NO: 1453807 - RNA, 19 nt, Homo sapiens
aauguauuuuaagugaauu

SEQ ID NO: 1453808 - RNA, 19 nt, Homo sapiens
aaugucaauacuuacuucu

SEQ ID NO: 1453809 - RNA, 19 nt, Homo sapiens
aaugucacaaccucucuga

SEQ ID NO: 1453810 - RNA, 12 nt, Homo sapiens
aaugucacuuaa

SEQ ID NO: 1453811 - RNA, 16 nt, Homo sapiens
aaugucagaaaccagu

SEQ ID NO: 1453812 - RNA, 15 nt, Homo sapiens
aaugucaguauuuca

SEQ ID NO: 1453813 - RNA, 19 nt, Homo sapiens
aaugucaguguuugggaaa

SEQ ID NO: 1453814 - RNA, 13 nt, Homo sapiens
aauguccauuuau

SEQ ID NO: 1453815 - RNA, 22 nt, Homo sapiens
aaugucgauuaaaaucacucuc

SEQ ID NO: 1453816 - RNA, 17 nt, Homo sapiens
aaugugacgaaagugga

SEQ ID NO: 1453817 - RNA, 21 nt, Homo sapiens
aaugugauauuugaagcauca

SEQ ID NO: 1453818 - RNA, 18 nt, Homo sapiens
aaugugcagaugcaauug

SEQ ID NO: 1453819 - RNA, 19 nt, Homo sapiens
aauguuaaggaaacucuua

SEQ ID NO: 1453820 - RNA, 16 nt, Homo sapiens
aauguuacaguaacaa

SEQ ID NO: 1453821 - RNA, 16 nt, Homo sapiens
aauguuacauuauuau

SEQ ID NO: 1453822 - RNA, 18 nt, Homo sapiens
aauguuagucauuguuau

SEQ ID NO: 1453823 - RNA, 22 nt, Homo sapiens
aauguucuguuugcuguggaac

SEQ ID NO: 1453824 - RNA, 19 nt, Homo sapiens
aauguugaaaaguaauuga

SEQ ID NO: 1453825 - RNA, 14 nt, Homo sapiens
aauguuugcauaaa

SEQ ID NO: 1453826 - RNA, 22 nt, Homo sapiens
aauuaaaaauaccaacuguaca

SEQ ID NO: 1453827 - RNA, 17 nt, Homo sapiens
aauuaaaacacuuucaa

SEQ ID NO: 1453828 - RNA, 18 nt, Homo sapiens
aauuaaaacacuuucaaa

SEQ ID NO: 1453829 - RNA, 12 nt, Homo sapiens
aauuaaaaccaa

SEQ ID NO: 1453830 - RNA, 13 nt, Homo sapiens
aauuaaaaccaau

SEQ ID NO: 1453831 - RNA, 23 nt, Homo sapiens
aauuaaaacuaagcacaaagcca

SEQ ID NO: 1453832 - RNA, 12 nt, Homo sapiens
aauuaacuugag

SEQ ID NO: 1453833 - RNA, 16 nt, Homo sapiens
aauuacaaaacucaga

SEQ ID NO: 1453834 - RNA, 22 nt, Homo sapiens
aauuagaauaguguucugcaaa

SEQ ID NO: 1453835 - RNA, 13 nt, Homo sapiens
aauuagaugaacu

SEQ ID NO: 1453836 - RNA, 12 nt, Homo sapiens
aauuaguuucaa

SEQ ID NO: 1453837 - RNA, 15 nt, Homo sapiens
aauuauaagucacaa

SEQ ID NO: 1453838 - RNA, 14 nt, Homo sapiens
aauuaucaagcuuu

SEQ ID NO: 1453839 - RNA, 14 nt, Homo sapiens
aauuaucuauagcu

SEQ ID NO: 1453840 - RNA, 20 nt, Homo sapiens
aauuauugacacugaacuua

SEQ ID NO: 1453841 - RNA, 18 nt, Homo sapiens
aauuauugcuguauguaa

SEQ ID NO: 1453842 - RNA, 13 nt, Homo sapiens
aauucaacccagc

SEQ ID NO: 1453843 - RNA, 16 nt, Homo sapiens
aauucaccaacacagu

SEQ ID NO: 1453844 - RNA, 13 nt, Homo sapiens
aauucagcacuua

SEQ ID NO: 1453845 - RNA, 16 nt, Homo sapiens
aauucauaaucacucu

SEQ ID NO: 1453846 - RNA, 20 nt, Homo sapiens
aauucauuuucaucacuggg

SEQ ID NO: 1453847 - RNA, 18 nt, Homo sapiens
aauuccagcaaaagagcu

SEQ ID NO: 1453848 - RNA, 16 nt, Homo sapiens
aauuccauuaucuuau

SEQ ID NO: 1453849 - RNA, 22 nt, Homo sapiens
aauuccuauauccugugacugu

SEQ ID NO: 1453850 - RNA, 17 nt, Homo sapiens
aauucguaaucaucccc

SEQ ID NO: 1453851 - RNA, 19 nt, Homo sapiens
aauucuaaagagcacuuac

SEQ ID NO: 1453852 - RNA, 16 nt, Homo sapiens
aauucuaacaagucau

SEQ ID NO: 1453853 - RNA, 19 nt, Homo sapiens
aauucuaaguuauuuacuu

SEQ ID NO: 1453854 - RNA, 21 nt, Homo sapiens
aauucuaaguuauuuacuuuu

SEQ ID NO: 1453855 - RNA, 18 nt, Homo sapiens
aauucucacaucccucua

SEQ ID NO: 1453856 - RNA, 16 nt, Homo sapiens
aauucucagaaucuca

SEQ ID NO: 1453857 - RNA, 20 nt, Homo sapiens
aauucugcccuuuucucuca

SEQ ID NO: 1453858 - RNA, 20 nt, Homo sapiens
aauucuuacccuguacauau

SEQ ID NO: 1453859 - RNA, 18 nt, Homo sapiens
aauucuuccuuagacuua

SEQ ID NO: 1453860 - RNA, 15 nt, Homo sapiens
aauucuuucaguggc

SEQ ID NO: 1453861 - RNA, 18 nt, Homo sapiens
aauugaaacuaguuauuu

SEQ ID NO: 1453862 - RNA, 23 nt, Homo sapiens
aauugaagagagauauaucugaa

SEQ ID NO: 1453863 - RNA, 13 nt, Homo sapiens
aauugacaggauu

SEQ ID NO: 1453864 - RNA, 13 nt, Homo sapiens
aauugauuugcau

SEQ ID NO: 1453865 - RNA, 22 nt, Homo sapiens
aauugccauuggacaguugucu

SEQ ID NO: 1453866 - RNA, 10 nt, Homo sapiens
aauugcucaa

SEQ ID NO: 1453867 - RNA, 22 nt, Homo sapiens
aauugguaaaacucacugugau

SEQ ID NO: 1453868 - RNA, 23 nt, Homo sapiens
aauuguaacgacuucuccaucuc

SEQ ID NO: 1453869 - RNA, 20 nt, Homo sapiens
aauugucuuuugucaugugg

SEQ ID NO: 1453870 - RNA, 15 nt, Homo sapiens
aauuguuuugcacuu

SEQ ID NO: 1453871 - RNA, 15 nt, Homo sapiens
aauuuaacugcuuaa

SEQ ID NO: 1453872 - RNA, 14 nt, Homo sapiens
aauuuacacugcca

SEQ ID NO: 1453873 - RNA, 19 nt, Homo sapiens
aauuuagaaauauaauuga

SEQ ID NO: 1453874 - RNA, 18 nt, Homo sapiens
aauuuauaaauauauuca

SEQ ID NO: 1453875 - RNA, 20 nt, Homo sapiens
aauuuaucuugucucugggc

SEQ ID NO: 1453876 - RNA, 11 nt, Homo sapiens
aauuuaugcaa

SEQ ID NO: 1453877 - RNA, 18 nt, Homo sapiens
aauuuauuaacuaaucaa

SEQ ID NO: 1453878 - RNA, 16 nt, Homo sapiens
aauuuauucacauaua

SEQ ID NO: 1453879 - RNA, 22 nt, Homo sapiens
aauuucacgcuuuuaauucuca

SEQ ID NO: 1453880 - RNA, 20 nt, Homo sapiens
aauuucaguaaacaaugaau

SEQ ID NO: 1453881 - RNA, 22 nt, Homo sapiens
aauuuccacaagcauugcuuca

SEQ ID NO: 1453882 - RNA, 17 nt, Homo sapiens
aauuucuaaaaaacaga

SEQ ID NO: 1453883 - RNA, 21 nt, Homo sapiens
aauuucuacuucuggaaguca

SEQ ID NO: 1453884 - RNA, 11 nt, Homo sapiens
aauuucuagag

SEQ ID NO: 1453885 - RNA, 19 nt, Homo sapiens
aauuucucuuuaaaaccau

SEQ ID NO: 1453886 - RNA, 21 nt, Homo sapiens
aauuugaaaccaggacauuaa

SEQ ID NO: 1453887 - RNA, 11 nt, Homo sapiens
aauuugaacug

SEQ ID NO: 1453888 - RNA, 18 nt, Homo sapiens
aauuugagauucuacagu

SEQ ID NO: 1453889 - RNA, 17 nt, Homo sapiens
aauuugaugauuuucau

SEQ ID NO: 1453890 - RNA, 21 nt, Homo sapiens
aauuugauguuuacaggugga

SEQ ID NO: 1453891 - RNA, 16 nt, Homo sapiens
aauuugauuuacauau

SEQ ID NO: 1453892 - RNA, 18 nt, Homo sapiens
aauuuggccugcacuaau

SEQ ID NO: 1453893 - RNA, 21 nt, Homo sapiens
aauuuggguacugggugcugu

SEQ ID NO: 1453894 - RNA, 20 nt, Homo sapiens
aauuugggugagcugcaccu

SEQ ID NO: 1453895 - RNA, 16 nt, Homo sapiens
aauuuggguucugccu

SEQ ID NO: 1453896 - RNA, 16 nt, Homo sapiens
aauuuguaggaaaaag

SEQ ID NO: 1453897 - RNA, 15 nt, Homo sapiens
aauuuuaccauucag

SEQ ID NO: 1453898 - RNA, 17 nt, Homo sapiens
aauuuuauaacagaauu

SEQ ID NO: 1453899 - RNA, 20 nt, Homo sapiens
aauuuucacaaaaugucuca

SEQ ID NO: 1453900 - RNA, 15 nt, Homo sapiens
aauuuucaguauaau

SEQ ID NO: 1453901 - RNA, 16 nt, Homo sapiens
acauugguauucuggg

SEQ ID NO: 1453902 - RNA, 20 nt, Homo sapiens
acauuguuugucugucuuca

SEQ ID NO: 1453903 - RNA, 17 nt, Homo sapiens
acauuuaaaauugcuau

SEQ ID NO: 1453904 - RNA, 15 nt, Homo sapiens
acauuuaguccugua

SEQ ID NO: 1453905 - RNA, 20 nt, Homo sapiens
acauuuaugaguaacuauua

SEQ ID NO: 1453906 - RNA, 19 nt, Homo sapiens
acauuucccccgagcucuu

SEQ ID NO: 1453907 - RNA, 19 nt, Homo sapiens
acauuucuaucaguacuuu

SEQ ID NO: 1453908 - RNA, 19 nt, Homo sapiens
acauuucuuugcauuccag

SEQ ID NO: 1453909 - RNA, 16 nt, Homo sapiens
acauuugcuguuuuaa

SEQ ID NO: 1453910 - RNA, 14 nt, Homo sapiens
acauuuuacauuaa

SEQ ID NO: 1453911 - RNA, 13 nt, Homo sapiens
acauuuugacaca

SEQ ID NO: 1453912 - RNA, 16 nt, Homo sapiens
acauuuugacacaaaa

SEQ ID NO: 1453913 - RNA, 23 nt, Homo sapiens
acauuuuuuuuaacuacuauauu

SEQ ID NO: 1453914 - RNA, 13 nt, Homo sapiens
accaaaaccacag

SEQ ID NO: 1453915 - RNA, 14 nt, Homo sapiens
accaaaagugcucc

SEQ ID NO: 1453916 - RNA, 15 nt, Homo sapiens
accaaaauccgacug

SEQ ID NO: 1453917 - RNA, 18 nt, Homo sapiens
accaaaucugacauauua

SEQ ID NO: 1453918 - RNA, 15 nt, Homo sapiens
accaaccacagcauc

SEQ ID NO: 1453919 - RNA, 22 nt, Homo sapiens
accaacugaaguggcuaaagag

SEQ ID NO: 1453920 - RNA, 15 nt, Homo sapiens
accaagacucugaaa

SEQ ID NO: 1453921 - RNA, 14 nt, Homo sapiens
accaagcacagcag

SEQ ID NO: 1453922 - RNA, 18 nt, Homo sapiens
accaagcguuucccaguc

SEQ ID NO: 1453923 - RNA, 20 nt, Homo sapiens
accaagcuggcuuguuucuu

SEQ ID NO: 1453924 - RNA, 21 nt, Homo sapiens
accaaggacugagcacccucu

SEQ ID NO: 1453925 - RNA, 17 nt, Homo sapiens
accaaggauauuuacag

SEQ ID NO: 1453926 - RNA, 21 nt, Homo sapiens
accaaggcgggagcaucucuu

SEQ ID NO: 1453927 - RNA, 23 nt, Homo sapiens
accaaguuauaaaucaaugucac

SEQ ID NO: 1453928 - RNA, 13 nt, Homo sapiens
accaauagcuuua

SEQ ID NO: 1453929 - RNA, 22 nt, Homo sapiens
accacaaccaccuucaccugga

SEQ ID NO: 1453930 - RNA, 21 nt, Homo sapiens
accacaagggcucucuuaggc

SEQ ID NO: 1453931 - RNA, 22 nt, Homo sapiens
accacaagggcucucuuaggca

SEQ ID NO: 1453932 - RNA, 11 nt, Homo sapiens
accacacaaag

SEQ ID NO: 1453933 - RNA, 14 nt, Homo sapiens
accacagggccaga

SEQ ID NO: 1453934 - RNA, 17 nt, Homo sapiens
accacccgaaaugccac

SEQ ID NO: 1453935 - RNA, 19 nt, Homo sapiens
accaccucccucaccaaca

SEQ ID NO: 1453936 - RNA, 23 nt, Homo sapiens
accaccugacgcugcaugagaca

SEQ ID NO: 1453937 - RNA, 17 nt, Homo sapiens
accaccuucaccuggau

SEQ ID NO: 1453938 - RNA, 21 nt, Homo sapiens
accacuaagaauucaaacugg

SEQ ID NO: 1453939 - RNA, 17 nt, Homo sapiens
accacuagaacucucca

SEQ ID NO: 1453940 - RNA, 18 nt, Homo sapiens
accacuagaacucuccau

SEQ ID NO: 1453941 - RNA, 21 nt, Homo sapiens
accacugaguaccaggggcug

SEQ ID NO: 1453942 - RNA, 16 nt, Homo sapiens
accacuguguauuuaa

SEQ ID NO: 1453943 - RNA, 15 nt, Homo sapiens
accagaagcauuuca

SEQ ID NO: 1453944 - RNA, 15 nt, Homo sapiens
accagacacccagga

SEQ ID NO: 1453945 - RNA, 15 nt, Homo sapiens
accagagacgcccag

SEQ ID NO: 1453946 - RNA, 20 nt, Homo sapiens
accagagaggcucugagaaa

SEQ ID NO: 1453947 - RNA, 14 nt, Homo sapiens
accagagcaguuuc

SEQ ID NO: 1453948 - RNA, 14 nt, Homo sapiens
accagagcauuucc

SEQ ID NO: 1453949 - RNA, 15 nt, Homo sapiens
accagagcauuucca

SEQ ID NO: 1453950 - RNA, 12 nt, Homo sapiens
accagagcucua

SEQ ID NO: 1453951 - RNA, 20 nt, Homo sapiens
accagaugucgcccuacuca

SEQ ID NO: 1453952 - RNA, 13 nt, Homo sapiens
accagcacugucu

SEQ ID NO: 1453953 - RNA, 14 nt, Homo sapiens
accagccauacuua

SEQ ID NO: 1453954 - RNA, 20 nt, Homo sapiens
accagcccugaccccagugu

SEQ ID NO: 1453955 - RNA, 21 nt, Homo sapiens
accagcuaucugucaucucuc

SEQ ID NO: 1453956 - RNA, 13 nt, Homo sapiens
accaggcacugcc

SEQ ID NO: 1453957 - RNA, 17 nt, Homo sapiens
accaggcuucuuccuac

SEQ ID NO: 1453958 - RNA, 23 nt, Homo sapiens
accaggugcaugcaugcccucuc

SEQ ID NO: 1453959 - RNA, 22 nt, Homo sapiens
accaguaucgcucauagaucag

SEQ ID NO: 1453960 - RNA, 13 nt, Homo sapiens
accaguaugacag

SEQ ID NO: 1453961 - RNA, 14 nt, Homo sapiens
accaguccagguag

SEQ ID NO: 1453962 - RNA, 16 nt, Homo sapiens
accagugugacaucua

SEQ ID NO: 1453963 - RNA, 14 nt, Homo sapiens
accaguuaccacac

SEQ ID NO: 1453964 - RNA, 17 nt, Homo sapiens
accaguuggcagacagc

SEQ ID NO: 1453965 - RNA, 17 nt, Homo sapiens
accaguugggagcacug

SEQ ID NO: 1453966 - RNA, 19 nt, Homo sapiens
accaguugggagcacugga

SEQ ID NO: 1453967 - RNA, 14 nt, Homo sapiens
accauaacagccaa

SEQ ID NO: 1453968 - RNA, 13 nt, Homo sapiens
accauaauguuac

SEQ ID NO: 1453969 - RNA, 14 nt, Homo sapiens
accauaauguuaca

SEQ ID NO: 1453970 - RNA, 16 nt, Homo sapiens
accauauaccaucucc

SEQ ID NO: 1453971 - RNA, 20 nt, Homo sapiens
accauauaccaucuccagcu

SEQ ID NO: 1453972 - RNA, 15 nt, Homo sapiens
accauccagugacaa

SEQ ID NO: 1453973 - RNA, 13 nt, Homo sapiens
accaucugauuaa

SEQ ID NO: 1453974 - RNA, 21 nt, Homo sapiens
accaucuggaaggacaucuac

SEQ ID NO: 1453975 - RNA, 13 nt, Homo sapiens
accaucuuggcca

SEQ ID NO: 1453976 - RNA, 15 nt, Homo sapiens
accaugagaugguuu

SEQ ID NO: 1453977 - RNA, 9 nt, Homo sapiens
accaugcug

SEQ ID NO: 1453978 - RNA, 23 nt, Homo sapiens
accauguauucauccagaguucu

SEQ ID NO: 1453979 - RNA, 20 nt, Homo sapiens
accauguggauaacuuuaca

SEQ ID NO: 1453980 - RNA, 17 nt, Homo sapiens
accauuaagucaugugu

SEQ ID NO: 1453981 - RNA, 21 nt, Homo sapiens
accauucuaccugaggccagg

SEQ ID NO: 1453982 - RNA, 18 nt, Homo sapiens
acccaaucugcacacucc

SEQ ID NO: 1453983 - RNA, 17 nt, Homo sapiens
acccaauucaaauugac

SEQ ID NO: 1453984 - RNA, 16 nt, Homo sapiens
acccacacagcugccc

SEQ ID NO: 1453985 - RNA, 21 nt, Homo sapiens
acccacuucuaaauagcaauu

SEQ ID NO: 1453986 - RNA, 17 nt, Homo sapiens
acccagaccccaggcug

SEQ ID NO: 1453987 - RNA, 15 nt, Homo sapiens
acccagccaugcaau

SEQ ID NO: 1453988 - RNA, 16 nt, Homo sapiens
acccagcccagcuugc

SEQ ID NO: 1453989 - RNA, 21 nt, Homo sapiens
acccagcccuuguuagauuca

SEQ ID NO: 1453990 - RNA, 16 nt, Homo sapiens
acccagggugugaaca

SEQ ID NO: 1453991 - RNA, 12 nt, Homo sapiens
acccagucucau

SEQ ID NO: 1453992 - RNA, 23 nt, Homo sapiens
acccauaauaagagaauguuccu

SEQ ID NO: 1453993 - RNA, 23 nt, Homo sapiens
acccaucggguaagaugcuccug

SEQ ID NO: 1453994 - RNA, 13 nt, Homo sapiens
acccaugacuuua

SEQ ID NO: 1453995 - RNA, 15 nt, Homo sapiens
acccaugacuuuaua

SEQ ID NO: 1453996 - RNA, 22 nt, Homo sapiens
acccaugggcucugacagaaag

SEQ ID NO: 1453997 - RNA, 20 nt, Homo sapiens
accccaacaauugugugaau

SEQ ID NO: 1453998 - RNA, 12 nt, Homo sapiens
accccaaccuca

SEQ ID NO: 1453999 - RNA, 20 nt, Homo sapiens
accccagccucgccugucac

SEQ ID NO: 1454000 - RNA, 17 nt, Homo sapiens
accccagcucccuagga

SEQ ID NO: 1454001 - RNA, 17 nt, Homo sapiens
accccaguggauucuca

SEQ ID NO: 1454002 - RNA, 15 nt, Homo sapiens
accccaucucuacua

SEQ ID NO: 1454003 - RNA, 16 nt, Homo sapiens
accccaucucuacuga

SEQ ID NO: 1454004 - RNA, 16 nt, Homo sapiens
acuugcugauccauga

SEQ ID NO: 1454005 - RNA, 17 nt, Homo sapiens
acuugcugauccaugag

SEQ ID NO: 1454006 - RNA, 16 nt, Homo sapiens
acuugcuuuaugccuu

SEQ ID NO: 1454007 - RNA, 15 nt, Homo sapiens
acuuggaacuaggcu

SEQ ID NO: 1454008 - RNA, 22 nt, Homo sapiens
acuugggugacggcagucgaug

SEQ ID NO: 1454009 - RNA, 23 nt, Homo sapiens
acuuguaagaaaaugagacaaaa

SEQ ID NO: 1454010 - RNA, 19 nt, Homo sapiens
acuugucuucccuucugau

SEQ ID NO: 1454011 - RNA, 17 nt, Homo sapiens
acuugugaaacacagcu

SEQ ID NO: 1454012 - RNA, 22 nt, Homo sapiens
acuugugauuuuuauaauacaa

SEQ ID NO: 1454013 - RNA, 22 nt, Homo sapiens
acuugugugugggcugugagug

SEQ ID NO: 1454014 - RNA, 18 nt, Homo sapiens
acuuguucuguacuugua

SEQ ID NO: 1454015 - RNA, 15 nt, Homo sapiens
acuuguuuuaugcuc

SEQ ID NO: 1454016 - RNA, 20 nt, Homo sapiens
acuuuaaacuugucuuuuca

SEQ ID NO: 1454017 - RNA, 13 nt, Homo sapiens
acuuuaagucuca

SEQ ID NO: 1454018 - RNA, 18 nt, Homo sapiens
acuuuaagucucacccau

SEQ ID NO: 1454019 - RNA, 15 nt, Homo sapiens
acuuuaagugaaaga

SEQ ID NO: 1454020 - RNA, 14 nt, Homo sapiens
acuuuaaugaacua

SEQ ID NO: 1454021 - RNA, 17 nt, Homo sapiens
acuuuacaaccugaugu

SEQ ID NO: 1454022 - RNA, 14 nt, Homo sapiens
acuuuauaguuguu

SEQ ID NO: 1454023 - RNA, 22 nt, Homo sapiens
acuuuauuucugaucuauacaa

SEQ ID NO: 1454024 - RNA, 16 nt, Homo sapiens
acuuucacacuaagaa

SEQ ID NO: 1454025 - RNA, 17 nt, Homo sapiens
acuuucauuccuucaga

SEQ ID NO: 1454026 - RNA, 20 nt, Homo sapiens
acuuucugauuggugauuca

SEQ ID NO: 1454027 - RNA, 15 nt, Homo sapiens
acuuucuucugaaua

SEQ ID NO: 1454028 - RNA, 23 nt, Homo sapiens
acuuugacuuucuucugaauauu

SEQ ID NO: 1454029 - RNA, 18 nt, Homo sapiens
acuuugaguuagugccau

SEQ ID NO: 1454030 - RNA, 20 nt, Homo sapiens
acuuugauuuuauaugcuau

SEQ ID NO: 1454031 - RNA, 14 nt, Homo sapiens
acuuugcacugaua

SEQ ID NO: 1454032 - RNA, 16 nt, Homo sapiens
acuuugggaucaaaua

SEQ ID NO: 1454033 - RNA, 17 nt, Homo sapiens
acuuugggauucuuucc

SEQ ID NO: 1454034 - RNA, 21 nt, Homo sapiens
acuuugguucucuccaggaag

SEQ ID NO: 1454035 - RNA, 13 nt, Homo sapiens
acuuuguaaaaua

SEQ ID NO: 1454036 - RNA, 19 nt, Homo sapiens
acuuuguauuaauguguua

SEQ ID NO: 1454037 - RNA, 23 nt, Homo sapiens
acuuuguauuuguucaguaugca

SEQ ID NO: 1454038 - RNA, 16 nt, Homo sapiens
acuuuuaaucagugaa

SEQ ID NO: 1454039 - RNA, 13 nt, Homo sapiens
acuuuuauaagaa

SEQ ID NO: 1454040 - RNA, 23 nt, Homo sapiens
acuuuuauuuuuugguggugaaa

SEQ ID NO: 1454041 - RNA, 19 nt, Homo sapiens
acuuuucggagacagugac

SEQ ID NO: 1454042 - RNA, 18 nt, Homo sapiens
acuuuucguuaacauuga

SEQ ID NO: 1454043 - RNA, 17 nt, Homo sapiens
acuuuucuaacauaugu

SEQ ID NO: 1454044 - RNA, 17 nt, Homo sapiens
acuuuugaaaagcuuuu

SEQ ID NO: 1454045 - RNA, 20 nt, Homo sapiens
acuuuuuuugguauaauguu

SEQ ID NO: 1454046 - RNA, 19 nt, Homo sapiens
agaaaaaaaccacacaaag

SEQ ID NO: 1454047 - RNA, 17 nt, Homo sapiens
agaaaaaaagagugaaa

SEQ ID NO: 1454048 - RNA, 20 nt, Homo sapiens
agaaaaaauaacacacauau

SEQ ID NO: 1454049 - RNA, 20 nt, Homo sapiens
agaaaaaggacucugcuuca

SEQ ID NO: 1454050 - RNA, 19 nt, Homo sapiens
agaaaacaggcaaauuccu

SEQ ID NO: 1454051 - RNA, 13 nt, Homo sapiens
agaaaagcccauu

SEQ ID NO: 1454052 - RNA, 20 nt, Homo sapiens
agaaaaggcagcuaaaggaa

SEQ ID NO: 1454053 - RNA, 19 nt, Homo sapiens
agaaaaguagguuuacauu

SEQ ID NO: 1454054 - RNA, 17 nt, Homo sapiens
agaaaauagagcuuuua

SEQ ID NO: 1454055 - RNA, 12 nt, Homo sapiens
agaaaauaucuu

SEQ ID NO: 1454056 - RNA, 22 nt, Homo sapiens
agaaaauauuauguguuuccau

SEQ ID NO: 1454057 - RNA, 23 nt, Homo sapiens
agaaaaugacuuauuucugcucu

SEQ ID NO: 1454058 - RNA, 16 nt, Homo sapiens
agaaaaugagacaaaa

SEQ ID NO: 1454059 - RNA, 18 nt, Homo sapiens
agaaacagagcaguacca

SEQ ID NO: 1454060 - RNA, 20 nt, Homo sapiens
agaaacccaaauugggacaa

SEQ ID NO: 1454061 - RNA, 13 nt, Homo sapiens
agaaaccucggga

SEQ ID NO: 1454062 - RNA, 14 nt, Homo sapiens
agaaaccugacuca

SEQ ID NO: 1454063 - RNA, 19 nt, Homo sapiens
agaaacucaaaaauauuug

SEQ ID NO: 1454064 - RNA, 21 nt, Homo sapiens
agaaacuccuguuucuccuua

SEQ ID NO: 1454065 - RNA, 21 nt, Homo sapiens
agaaagacucugagaugugga

SEQ ID NO: 1454066 - RNA, 15 nt, Homo sapiens
agaaagagucaggcc

SEQ ID NO: 1454067 - RNA, 15 nt, Homo sapiens
agaaagaucaaagac

SEQ ID NO: 1454068 - RNA, 23 nt, Homo sapiens
agaaagcacgugucucagacugc

SEQ ID NO: 1454069 - RNA, 14 nt, Homo sapiens
agaaagcuucuuca

SEQ ID NO: 1454070 - RNA, 19 nt, Homo sapiens
agaaaguaaaaaguugcuu

SEQ ID NO: 1454071 - RNA, 21 nt, Homo sapiens
agaaauaaucccuguaauauu

SEQ ID NO: 1454072 - RNA, 13 nt, Homo sapiens
agaaauauaugca

SEQ ID NO: 1454073 - RNA, 17 nt, Homo sapiens
agaaaucauaguuuaaa

SEQ ID NO: 1454074 - RNA, 17 nt, Homo sapiens
agaaauccugcaaugaa

SEQ ID NO: 1454075 - RNA, 18 nt, Homo sapiens
agaaaucuagaagacugu

SEQ ID NO: 1454076 - RNA, 18 nt, Homo sapiens
agaaaugaugauguggaa

SEQ ID NO: 1454077 - RNA, 20 nt, Homo sapiens
agaaaugcaagggggacaca

SEQ ID NO: 1454078 - RNA, 22 nt, Homo sapiens
agaaauggccaaauauauuucc

SEQ ID NO: 1454079 - RNA, 12 nt, Homo sapiens
agaaaugucuaa

SEQ ID NO: 1454080 - RNA, 19 nt, Homo sapiens
agaaauguuguucauuauu

SEQ ID NO: 1454081 - RNA, 15 nt, Homo sapiens
agaaauuaacaaaug

SEQ ID NO: 1454082 - RNA, 15 nt, Homo sapiens
agaaauuauaaacaa

SEQ ID NO: 1454083 - RNA, 22 nt, Homo sapiens
agaaauugcauuuccugacaga

SEQ ID NO: 1454084 - RNA, 20 nt, Homo sapiens
agaacaagaccccgucucaa

SEQ ID NO: 1454085 - RNA, 15 nt, Homo sapiens
agaacagagugcaac

SEQ ID NO: 1454086 - RNA, 12 nt, Homo sapiens
agaacaggguca

SEQ ID NO: 1454087 - RNA, 23 nt, Homo sapiens
agaaccauaaagaaaagaugaaa

SEQ ID NO: 1454088 - RNA, 13 nt, Homo sapiens
agaaccucuuccc

SEQ ID NO: 1454089 - RNA, 20 nt, Homo sapiens
agaaccuggaaaaauuccag

SEQ ID NO: 1454090 - RNA, 17 nt, Homo sapiens
agaaccuuaaagaacca

SEQ ID NO: 1454091 - RNA, 11 nt, Homo sapiens
agaacuacuuc

SEQ ID NO: 1454092 - RNA, 21 nt, Homo sapiens
agaacucaaauggggccagau

SEQ ID NO: 1454093 - RNA, 13 nt, Homo sapiens
agaacuccugacu

SEQ ID NO: 1454094 - RNA, 22 nt, Homo sapiens
agaacucuccaucuuauuuuca

SEQ ID NO: 1454095 - RNA, 15 nt, Homo sapiens
agaacuucagaaaga

SEQ ID NO: 1454096 - RNA, 19 nt, Homo sapiens
agaacuucagaaagacuug

SEQ ID NO: 1454097 - RNA, 21 nt, Homo sapiens
agaacuucccugauugaccug

SEQ ID NO: 1454098 - RNA, 15 nt, Homo sapiens
agaacuugauuugca

SEQ ID NO: 1454099 - RNA, 19 nt, Homo sapiens
agaacuugcagcugauguu

SEQ ID NO: 1454100 - RNA, 22 nt, Homo sapiens
agaagaaacuuugccucaagac

SEQ ID NO: 1454101 - RNA, 18 nt, Homo sapiens
agaagacaccagagcaga

SEQ ID NO: 1454102 - RNA, 13 nt, Homo sapiens
agaagacacugca

SEQ ID NO: 1454103 - RNA, 13 nt, Homo sapiens
agaagacucugac

SEQ ID NO: 1454104 - RNA, 14 nt, Homo sapiens
agaagagacaggag

SEQ ID NO: 1454105 - RNA, 22 nt, Homo sapiens
agaagcccugauguguccucag

SEQ ID NO: 1454106 - RNA, 14 nt, Homo sapiens
agaucuaugggaag

SEQ ID NO: 1454107 - RNA, 17 nt, Homo sapiens
agaucugcacucaccuc

SEQ ID NO: 1454108 - RNA, 22 nt, Homo sapiens
agaucuggucccuugcagcuag

SEQ ID NO: 1454109 - RNA, 17 nt, Homo sapiens
agaucuuucaggaaaga

SEQ ID NO: 1454110 - RNA, 20 nt, Homo sapiens
agaucuuucaggaaagacgg

SEQ ID NO: 1454111 - RNA, 14 nt, Homo sapiens
agaugaacucugaa

SEQ ID NO: 1454112 - RNA, 18 nt, Homo sapiens
agaugacggaugccuaga

SEQ ID NO: 1454113 - RNA, 15 nt, Homo sapiens
agaugagcagucaca

SEQ ID NO: 1454114 - RNA, 19 nt, Homo sapiens
agaugagcagucacacugu

SEQ ID NO: 1454115 - RNA, 16 nt, Homo sapiens
agaugagggguugagg

SEQ ID NO: 1454116 - RNA, 19 nt, Homo sapiens
agaugauacauccaaagca

SEQ ID NO: 1454117 - RNA, 13 nt, Homo sapiens
agaugaucucucc

SEQ ID NO: 1454118 - RNA, 21 nt, Homo sapiens
agaugcaugacuuguguguga

SEQ ID NO: 1454119 - RNA, 18 nt, Homo sapiens
agaugccccagagcuguu

SEQ ID NO: 1454120 - RNA, 23 nt, Homo sapiens
agaugccccagccugcuuucaca

SEQ ID NO: 1454121 - RNA, 14 nt, Homo sapiens
agaugccuacaacc

SEQ ID NO: 1454122 - RNA, 18 nt, Homo sapiens
agaugcuaaaaucccugg

SEQ ID NO: 1454123 - RNA, 20 nt, Homo sapiens
agaugcugacuguacuccuc

SEQ ID NO: 1454124 - RNA, 14 nt, Homo sapiens
agaugcuggcccag

SEQ ID NO: 1454125 - RNA, 20 nt, Homo sapiens
agaugcugguuuucuaccca

SEQ ID NO: 1454126 - RNA, 17 nt, Homo sapiens
agauggacaacucaaug

SEQ ID NO: 1454127 - RNA, 15 nt, Homo sapiens
agauggcaauuucac

SEQ ID NO: 1454128 - RNA, 18 nt, Homo sapiens
agaugguguggguguccu

SEQ ID NO: 1454129 - RNA, 16 nt, Homo sapiens
agauguauauauuucc

SEQ ID NO: 1454130 - RNA, 17 nt, Homo sapiens
agauguauauauuuccu

SEQ ID NO: 1454131 - RNA, 21 nt, Homo sapiens
agauguauuauaccagugaaa

SEQ ID NO: 1454132 - RNA, 12 nt, Homo sapiens
agaugucaaaac

SEQ ID NO: 1454133 - RNA, 22 nt, Homo sapiens
agaugucauuuaguucagcauc

SEQ ID NO: 1454134 - RNA, 16 nt, Homo sapiens
agaugugaaaacaucu

SEQ ID NO: 1454135 - RNA, 16 nt, Homo sapiens
agaugugucuauggcu

SEQ ID NO: 1454136 - RNA, 12 nt, Homo sapiens
agauuaacaaca

SEQ ID NO: 1454137 - RNA, 17 nt, Homo sapiens
agauuagaugugccaau

SEQ ID NO: 1454138 - RNA, 16 nt, Homo sapiens
agauuccccuguguca

SEQ ID NO: 1454139 - RNA, 13 nt, Homo sapiens
agauucuaccaca

SEQ ID NO: 1454140 - RNA, 14 nt, Homo sapiens
agauugacaacgcc

SEQ ID NO: 1454141 - RNA, 15 nt, Homo sapiens
agauugcaccacugc

SEQ ID NO: 1454142 - RNA, 22 nt, Homo sapiens
agauugccucucuagacaacua

SEQ ID NO: 1454143 - RNA, 21 nt, Homo sapiens
agauugcugaaaaaguagauu

SEQ ID NO: 1454144 - RNA, 23 nt, Homo sapiens
agauugugccacuucacuccagc

SEQ ID NO: 1454145 - RNA, 14 nt, Homo sapiens
agauuuaagcacaa

SEQ ID NO: 1454146 - RNA, 13 nt, Homo sapiens
agauuuacccauc

SEQ ID NO: 1454147 - RNA, 13 nt, Homo sapiens
agauuuauuuagu

SEQ ID NO: 1454148 - RNA, 14 nt, Homo sapiens
agauuucagaucau

SEQ ID NO: 1454149 - RNA, 17 nt, Homo sapiens
agauuuggcuugacaaa

SEQ ID NO: 1454150 - RNA, 16 nt, Homo sapiens
agauuuuaaagacaaa

SEQ ID NO: 1454151 - RNA, 23 nt, Homo sapiens
agauuuucauguucuugcaguca

SEQ ID NO: 1454152 - RNA, 22 nt, Homo sapiens
agauuuugaaugcuuccugaca

SEQ ID NO: 1454153 - RNA, 19 nt, Homo sapiens
agauuuuuaagaacuucau

SEQ ID NO: 1454154 - RNA, 22 nt, Homo sapiens
agauuuuucggaggccccacug

SEQ ID NO: 1454155 - RNA, 17 nt, Homo sapiens
agauuuuuuauugcuag

SEQ ID NO: 1454156 - RNA, 16 nt, Homo sapiens
agcaaaaaguauugaa

SEQ ID NO: 1454157 - RNA, 19 nt, Homo sapiens
agcaaaaugcuucugcaca

SEQ ID NO: 1454158 - RNA, 18 nt, Homo sapiens
agcaaacacuuacagaau

SEQ ID NO: 1454159 - RNA, 22 nt, Homo sapiens
agcaaaucuacuucaacacuuc

SEQ ID NO: 1454160 - RNA, 20 nt, Homo sapiens
agcaaaugcuauuugauaac

SEQ ID NO: 1454161 - RNA, 12 nt, Homo sapiens
agcaacaaugac

SEQ ID NO: 1454162 - RNA, 15 nt, Homo sapiens
agcaacaucucggga

SEQ ID NO: 1454163 - RNA, 22 nt, Homo sapiens
agcaacaucuuuuuaaccugca

SEQ ID NO: 1454164 - RNA, 12 nt, Homo sapiens
agcaacauuugu

SEQ ID NO: 1454165 - RNA, 18 nt, Homo sapiens
agcaacccuaacaguaag

SEQ ID NO: 1454166 - RNA, 23 nt, Homo sapiens
agcaacgccccuccaaaccucca

SEQ ID NO: 1454167 - RNA, 13 nt, Homo sapiens
agcaacucagaga

SEQ ID NO: 1454168 - RNA, 14 nt, Homo sapiens
agcaacucagagaa

SEQ ID NO: 1454169 - RNA, 19 nt, Homo sapiens
agcaacucugagaucuaag

SEQ ID NO: 1454170 - RNA, 14 nt, Homo sapiens
agcaacugucuuau

SEQ ID NO: 1454171 - RNA, 18 nt, Homo sapiens
agcaagacucugucucaa

SEQ ID NO: 1454172 - RNA, 19 nt, Homo sapiens
agcaagaugugaaagaaga

SEQ ID NO: 1454173 - RNA, 16 nt, Homo sapiens
agcaagugugcacucc

SEQ ID NO: 1454174 - RNA, 16 nt, Homo sapiens
agcaaguuuucuucca

SEQ ID NO: 1454175 - RNA, 15 nt, Homo sapiens
agcaauccuccugcc

SEQ ID NO: 1454176 - RNA, 17 nt, Homo sapiens
agcaaugacaucucagg

SEQ ID NO: 1454177 - RNA, 14 nt, Homo sapiens
agcaaugccauuuc

SEQ ID NO: 1454178 - RNA, 17 nt, Homo sapiens
agcaauggcacuguugc

SEQ ID NO: 1454179 - RNA, 19 nt, Homo sapiens
agcaaugggacuggaguca

SEQ ID NO: 1454180 - RNA, 19 nt, Homo sapiens
agcacaagcagagugcaca

SEQ ID NO: 1454181 - RNA, 20 nt, Homo sapiens
agcacaaggccaucugggcu

SEQ ID NO: 1454182 - RNA, 20 nt, Homo sapiens
agcacagaaggaaucugugc

SEQ ID NO: 1454183 - RNA, 21 nt, Homo sapiens
agcacagggggauucugagca

SEQ ID NO: 1454184 - RNA, 17 nt, Homo sapiens
agcaccacacccagugg

SEQ ID NO: 1454185 - RNA, 15 nt, Homo sapiens
agcaccaggacucag

SEQ ID NO: 1454186 - RNA, 13 nt, Homo sapiens
agcacccauucca

SEQ ID NO: 1454187 - RNA, 21 nt, Homo sapiens
agcaccuccgccagauccugc

SEQ ID NO: 1454188 - RNA, 17 nt, Homo sapiens
agcacuacauaaacuga

SEQ ID NO: 1454189 - RNA, 18 nt, Homo sapiens
agcacuacauaaacugac

SEQ ID NO: 1454190 - RNA, 18 nt, Homo sapiens
agcacugaaaauaguguu

SEQ ID NO: 1454191 - RNA, 15 nt, Homo sapiens
agcacuguccaguau

SEQ ID NO: 1454192 - RNA, 17 nt, Homo sapiens
agcacugucucaguuuc

SEQ ID NO: 1454193 - RNA, 19 nt, Homo sapiens
agcacuuuagaucacuuga

SEQ ID NO: 1454194 - RNA, 13 nt, Homo sapiens
agcacuuugcaac

SEQ ID NO: 1454195 - RNA, 15 nt, Homo sapiens
agcacuuugccaugc

SEQ ID NO: 1454196 - RNA, 22 nt, Homo sapiens
agcagaaaucuagaagacuguc

SEQ ID NO: 1454197 - RNA, 21 nt, Homo sapiens
agcagaacucuugacuuccug

SEQ ID NO: 1454198 - RNA, 20 nt, Homo sapiens
agcagaagagaaaauguugu

SEQ ID NO: 1454199 - RNA, 23 nt, Homo sapiens
agcagaccaccccgccugcccuc

SEQ ID NO: 1454200 - RNA, 20 nt, Homo sapiens
agcagacucuggaggccugu

SEQ ID NO: 1454201 - RNA, 22 nt, Homo sapiens
agcagagaagguaaggugugaa

SEQ ID NO: 1454202 - RNA, 22 nt, Homo sapiens
agcagagaccuuccaaggacau

SEQ ID NO: 1454203 - RNA, 13 nt, Homo sapiens
agcagagcaggca

SEQ ID NO: 1454204 - RNA, 20 nt, Homo sapiens
agcagaggaauaacaucacc

SEQ ID NO: 1454205 - RNA, 16 nt, Homo sapiens
agcagaggcccugugg

SEQ ID NO: 1454206 - RNA, 15 nt, Homo sapiens
agcagaggucuccca

SEQ ID NO: 1454207 - RNA, 17 nt, Homo sapiens
agcagagugcacagcug

SEQ ID NO: 1454208 - RNA, 23 nt, Homo sapiens
auagagacggagauccuaagguc

SEQ ID NO: 1454209 - RNA, 12 nt, Homo sapiens
auagaggcuagc

SEQ ID NO: 1454210 - RNA, 18 nt, Homo sapiens
auagaguaaauacaggua

SEQ ID NO: 1454211 - RNA, 15 nt, Homo sapiens
auagaguauaugcac

SEQ ID NO: 1454212 - RNA, 17 nt, Homo sapiens
auagagugucucagggu

SEQ ID NO: 1454213 - RNA, 15 nt, Homo sapiens
auagauauuuucaca

SEQ ID NO: 1454214 - RNA, 22 nt, Homo sapiens
auagaugcuggcccagggccca

SEQ ID NO: 1454215 - RNA, 11 nt, Homo sapiens
auagcacuuuc

SEQ ID NO: 1454216 - RNA, 20 nt, Homo sapiens
auagcagagggguaagagag

SEQ ID NO: 1454217 - RNA, 18 nt, Homo sapiens
auagcagaugguuuccac

SEQ ID NO: 1454218 - RNA, 18 nt, Homo sapiens
auagcaguugaaacaaga

SEQ ID NO: 1454219 - RNA, 16 nt, Homo sapiens
auagccauugaucaua

SEQ ID NO: 1454220 - RNA, 14 nt, Homo sapiens
auaggaauugcaca

SEQ ID NO: 1454221 - RNA, 16 nt, Homo sapiens
auaggacauacugcau

SEQ ID NO: 1454222 - RNA, 20 nt, Homo sapiens
auaggacucuagacggcauc

SEQ ID NO: 1454223 - RNA, 18 nt, Homo sapiens
auaggcauuaacacaaag

SEQ ID NO: 1454224 - RNA, 15 nt, Homo sapiens
auaggccugggugcu

SEQ ID NO: 1454225 - RNA, 22 nt, Homo sapiens
auaggcuggagaagcucaccca

SEQ ID NO: 1454226 - RNA, 20 nt, Homo sapiens
auagguuuuucucauguauc

SEQ ID NO: 1454227 - RNA, 21 nt, Homo sapiens
auaguaccaguaggggcuuau

SEQ ID NO: 1454228 - RNA, 16 nt, Homo sapiens
auaguaccucugcuau

SEQ ID NO: 1454229 - RNA, 18 nt, Homo sapiens
auagucaauuucuacuuc

SEQ ID NO: 1454230 - RNA, 16 nt, Homo sapiens
auaguccagacacuua

SEQ ID NO: 1454231 - RNA, 18 nt, Homo sapiens
auagucucugcccucaua

SEQ ID NO: 1454232 - RNA, 18 nt, Homo sapiens
auagugaacauauggaaa

SEQ ID NO: 1454233 - RNA, 20 nt, Homo sapiens
auaguuuaaacugcauuaua

SEQ ID NO: 1454234 - RNA, 22 nt, Homo sapiens
auaguuuguuuuuaaacuaaua

SEQ ID NO: 1454235 - RNA, 23 nt, Homo sapiens
auauaacccuaggaauuuagaca

SEQ ID NO: 1454236 - RNA, 18 nt, Homo sapiens
auauaaggaaagcaauaa

SEQ ID NO: 1454237 - RNA, 16 nt, Homo sapiens
auauaaguacugacca

SEQ ID NO: 1454238 - RNA, 14 nt, Homo sapiens
auauaauccuguga

SEQ ID NO: 1454239 - RNA, 21 nt, Homo sapiens
auauaauucacucaagcacug

SEQ ID NO: 1454240 - RNA, 19 nt, Homo sapiens
auauaauucccaagcuuuu

SEQ ID NO: 1454241 - RNA, 16 nt, Homo sapiens
auauaauuucaaacca

SEQ ID NO: 1454242 - RNA, 13 nt, Homo sapiens
auauacagaggaa

SEQ ID NO: 1454243 - RNA, 12 nt, Homo sapiens
auauaccaagcu

SEQ ID NO: 1454244 - RNA, 19 nt, Homo sapiens
auauaccuggcuuuuacuu

SEQ ID NO: 1454245 - RNA, 22 nt, Homo sapiens
auauaccuggcuuuuacuuuau

SEQ ID NO: 1454246 - RNA, 18 nt, Homo sapiens
auauacugguucacaucc

SEQ ID NO: 1454247 - RNA, 20 nt, Homo sapiens
auauagguuuuucucaugua

SEQ ID NO: 1454248 - RNA, 17 nt, Homo sapiens
auauaguaaacacucaa

SEQ ID NO: 1454249 - RNA, 19 nt, Homo sapiens
auauaguaacacacuucca

SEQ ID NO: 1454250 - RNA, 17 nt, Homo sapiens
auauauacccacaugua

SEQ ID NO: 1454251 - RNA, 12 nt, Homo sapiens
auauauaugcac

SEQ ID NO: 1454252 - RNA, 21 nt, Homo sapiens
auauaucuaugucuauaucau

SEQ ID NO: 1454253 - RNA, 18 nt, Homo sapiens
auauaugcagcugugaua

SEQ ID NO: 1454254 - RNA, 18 nt, Homo sapiens
auauaugccuucccccac

SEQ ID NO: 1454255 - RNA, 19 nt, Homo sapiens
auauauuuccuuauucaga

SEQ ID NO: 1454256 - RNA, 12 nt, Homo sapiens
auaucuaaaaac

SEQ ID NO: 1454257 - RNA, 23 nt, Homo sapiens
auaucuccauggcccugucccag

SEQ ID NO: 1454258 - RNA, 15 nt, Homo sapiens
auaucuguggucuuc

SEQ ID NO: 1454259 - RNA, 14 nt, Homo sapiens
auaugaagacauaa

SEQ ID NO: 1454260 - RNA, 17 nt, Homo sapiens
auaugaaggauuacucu

SEQ ID NO: 1454261 - RNA, 19 nt, Homo sapiens
auaugagacguuuuuggaa

SEQ ID NO: 1454262 - RNA, 18 nt, Homo sapiens
auauggaggaggcucugg

SEQ ID NO: 1454263 - RNA, 14 nt, Homo sapiens
auauguaguauaau

SEQ ID NO: 1454264 - RNA, 20 nt, Homo sapiens
auauguccgcagaauggacu

SEQ ID NO: 1454265 - RNA, 14 nt, Homo sapiens
auauguugcucagu

SEQ ID NO: 1454266 - RNA, 19 nt, Homo sapiens
auauuaacaacaauaacac

SEQ ID NO: 1454267 - RNA, 19 nt, Homo sapiens
auauuaauuuuccaaugca

SEQ ID NO: 1454268 - RNA, 12 nt, Homo sapiens
auauuaucucau

SEQ ID NO: 1454269 - RNA, 13 nt, Homo sapiens
auauuaugccuga

SEQ ID NO: 1454270 - RNA, 21 nt, Homo sapiens
auauucugaagcaacauuuua

SEQ ID NO: 1454271 - RNA, 17 nt, Homo sapiens
auauucugcaacacugu

SEQ ID NO: 1454272 - RNA, 17 nt, Homo sapiens
auauucuggcccaggga

SEQ ID NO: 1454273 - RNA, 17 nt, Homo sapiens
auauucuuugguuguga

SEQ ID NO: 1454274 - RNA, 17 nt, Homo sapiens
auauugacacugucccu

SEQ ID NO: 1454275 - RNA, 17 nt, Homo sapiens
auauuguauaggggcaa

SEQ ID NO: 1454276 - RNA, 15 nt, Homo sapiens
auauugucagucuuu

SEQ ID NO: 1454277 - RNA, 19 nt, Homo sapiens
auauuuagcuguaaacuga

SEQ ID NO: 1454278 - RNA, 13 nt, Homo sapiens
auauuuaucugau

SEQ ID NO: 1454279 - RNA, 14 nt, Homo sapiens
auauuuauguagau

SEQ ID NO: 1454280 - RNA, 19 nt, Homo sapiens
auauuuauuuaaagcauug

SEQ ID NO: 1454281 - RNA, 21 nt, Homo sapiens
auauuuauuuauguguucaca

SEQ ID NO: 1454282 - RNA, 22 nt, Homo sapiens
auauuuccaagaaauauuccuu

SEQ ID NO: 1454283 - RNA, 17 nt, Homo sapiens
auauuuccugacuugag

SEQ ID NO: 1454284 - RNA, 16 nt, Homo sapiens
auauuucuaacuauau

SEQ ID NO: 1454285 - RNA, 23 nt, Homo sapiens
auauuuguauauuacacauuugu

SEQ ID NO: 1454286 - RNA, 18 nt, Homo sapiens
auauuuuuagauaguuag

SEQ ID NO: 1454287 - RNA, 16 nt, Homo sapiens
auauuuuuccacuuaa

SEQ ID NO: 1454288 - RNA, 19 nt, Homo sapiens
auauuuuugguugucaaua

SEQ ID NO: 1454289 - RNA, 14 nt, Homo sapiens
aucaaaacucuccu

SEQ ID NO: 1454290 - RNA, 20 nt, Homo sapiens
aucaaaauaaaaagugacac

SEQ ID NO: 1454291 - RNA, 15 nt, Homo sapiens
aucaaagaacaaaca

SEQ ID NO: 1454292 - RNA, 12 nt, Homo sapiens
aucaaauacuuu

SEQ ID NO: 1454293 - RNA, 12 nt, Homo sapiens
aucaacaaagaa

SEQ ID NO: 1454294 - RNA, 14 nt, Homo sapiens
aucaacccacuuaa

SEQ ID NO: 1454295 - RNA, 20 nt, Homo sapiens
aucaacgccucacugaaaca

SEQ ID NO: 1454296 - RNA, 14 nt, Homo sapiens
aucaacucuaauag

SEQ ID NO: 1454297 - RNA, 22 nt, Homo sapiens
aucaagcuuuuaaaaacuagag

SEQ ID NO: 1454298 - RNA, 20 nt, Homo sapiens
aucaauaaagaaaacuucca

SEQ ID NO: 1454299 - RNA, 15 nt, Homo sapiens
aucaauauacauaau

SEQ ID NO: 1454300 - RNA, 21 nt, Homo sapiens
aucaaugcaagagugauugca

SEQ ID NO: 1454301 - RNA, 12 nt, Homo sapiens
aucaauguuucu

SEQ ID NO: 1454302 - RNA, 17 nt, Homo sapiens
aucaauuuguaauugcu

SEQ ID NO: 1454303 - RNA, 11 nt, Homo sapiens
aucacaacauu

SEQ ID NO: 1454304 - RNA, 12 nt, Homo sapiens
aucacacuguaa

SEQ ID NO: 1454305 - RNA, 16 nt, Homo sapiens
aucacaguauuaucug

SEQ ID NO: 1454306 - RNA, 21 nt, Homo sapiens
aucacaguguuugcaauggug

SEQ ID NO: 1454307 - RNA, 17 nt, Homo sapiens
aucacgacgcugcagag

SEQ ID NO: 1454308 - RNA, 14 nt, Homo sapiens
aucacgccuggcua

SEQ ID NO: 1454309 - RNA, 21 nt, Homo sapiens
aucacuagaagaaaagcccau

SEQ ID NO: 1454310 - RNA, 21 nt, Homo sapiens
aucacuaucuuucugauaaca

SEQ ID NO: 1454311 - RNA, 18 nt, Homo sapiens
augucuguagcuccucaa

SEQ ID NO: 1454312 - RNA, 16 nt, Homo sapiens
augucuguuaacuuaa

SEQ ID NO: 1454313 - RNA, 18 nt, Homo sapiens
augucuucauucccaagg

SEQ ID NO: 1454314 - RNA, 14 nt, Homo sapiens
augugaacaaccug

SEQ ID NO: 1454315 - RNA, 21 nt, Homo sapiens
augugaagccaauucagacag

SEQ ID NO: 1454316 - RNA, 20 nt, Homo sapiens
augugaauuauugacacuga

SEQ ID NO: 1454317 - RNA, 13 nt, Homo sapiens
augugcacuucaa

SEQ ID NO: 1454318 - RNA, 19 nt, Homo sapiens
augugcagguuuugaaaau

SEQ ID NO: 1454319 - RNA, 11 nt, Homo sapiens
augugccaagg

SEQ ID NO: 1454320 - RNA, 17 nt, Homo sapiens
augugccgaaugugcag

SEQ ID NO: 1454321 - RNA, 20 nt, Homo sapiens
augugccuuucuuugccucu

SEQ ID NO: 1454322 - RNA, 21 nt, Homo sapiens
auguggagcucagcaacaagg

SEQ ID NO: 1454323 - RNA, 18 nt, Homo sapiens
auguggccaagcacaucu

SEQ ID NO: 1454324 - RNA, 15 nt, Homo sapiens
augugggugagccag

SEQ ID NO: 1454325 - RNA, 12 nt, Homo sapiens
auguggucucag

SEQ ID NO: 1454326 - RNA, 15 nt, Homo sapiens
auguguccucaggga

SEQ ID NO: 1454327 - RNA, 14 nt, Homo sapiens
augugugaggagcu

SEQ ID NO: 1454328 - RNA, 14 nt, Homo sapiens
augugugauuucac

SEQ ID NO: 1454329 - RNA, 21 nt, Homo sapiens
auguguggcucagugccugga

SEQ ID NO: 1454330 - RNA, 19 nt, Homo sapiens
auguguguguauguuugca

SEQ ID NO: 1454331 - RNA, 18 nt, Homo sapiens
auguguuuauucauccag

SEQ ID NO: 1454332 - RNA, 18 nt, Homo sapiens
auguguuuuaucacuuca

SEQ ID NO: 1454333 - RNA, 17 nt, Homo sapiens
auguuacacuaagggug

SEQ ID NO: 1454334 - RNA, 14 nt, Homo sapiens
auguuacugaccag

SEQ ID NO: 1454335 - RNA, 16 nt, Homo sapiens
auguuacugaccagca

SEQ ID NO: 1454336 - RNA, 15 nt, Homo sapiens
auguuacugcuucau

SEQ ID NO: 1454337 - RNA, 21 nt, Homo sapiens
auguuaguagaaauuuuacaa

SEQ ID NO: 1454338 - RNA, 14 nt, Homo sapiens
auguucacugugag

SEQ ID NO: 1454339 - RNA, 21 nt, Homo sapiens
auguugugauguauucuagcu

SEQ ID NO: 1454340 - RNA, 20 nt, Homo sapiens
auguuuacuuuucagggcau

SEQ ID NO: 1454341 - RNA, 13 nt, Homo sapiens
auguuucaaaaaa

SEQ ID NO: 1454342 - RNA, 15 nt, Homo sapiens
auguuucaaauacuu

SEQ ID NO: 1454343 - RNA, 21 nt, Homo sapiens
auguuucaagaaaauggauuu

SEQ ID NO: 1454344 - RNA, 18 nt, Homo sapiens
auguuugcacacuugugu

SEQ ID NO: 1454345 - RNA, 13 nt, Homo sapiens
auguuuuugacuc

SEQ ID NO: 1454346 - RNA, 15 nt, Homo sapiens
auguuuuugacucuu

SEQ ID NO: 1454347 - RNA, 21 nt, Homo sapiens
auguuuuuugccacagcuuuu

SEQ ID NO: 1454348 - RNA, 14 nt, Homo sapiens
auuaaagacagagg

SEQ ID NO: 1454349 - RNA, 19 nt, Homo sapiens
auuaaauaguuauauaauu

SEQ ID NO: 1454350 - RNA, 14 nt, Homo sapiens
auuaaauccaauaa

SEQ ID NO: 1454351 - RNA, 15 nt, Homo sapiens
auuaaauuuaacucu

SEQ ID NO: 1454352 - RNA, 19 nt, Homo sapiens
auuaacaguuuuccaugaa

SEQ ID NO: 1454353 - RNA, 11 nt, Homo sapiens
auuaacuaauc

SEQ ID NO: 1454354 - RNA, 21 nt, Homo sapiens
auuaagaaaccuugcucuccu

SEQ ID NO: 1454355 - RNA, 21 nt, Homo sapiens
auuaagcagaaauccugcaau

SEQ ID NO: 1454356 - RNA, 23 nt, Homo sapiens
auuaagcagaaauccugcaauga

SEQ ID NO: 1454357 - RNA, 23 nt, Homo sapiens
auuaagguauuucgaaacugcca

SEQ ID NO: 1454358 - RNA, 20 nt, Homo sapiens
auuaauaaagauggcacuuu

SEQ ID NO: 1454359 - RNA, 13 nt, Homo sapiens
auuaauacugaag

SEQ ID NO: 1454360 - RNA, 17 nt, Homo sapiens
auuaauaguuugucuau

SEQ ID NO: 1454361 - RNA, 24 nt, Homo sapiens
auuaauauauaguccagacacuua

SEQ ID NO: 1454362 - RNA, 20 nt, Homo sapiens
auuaauguguuaagugcagg

SEQ ID NO: 1454363 - RNA, 23 nt, Homo sapiens
auuaauguuaauucagcacugau

SEQ ID NO: 1454364 - RNA, 12 nt, Homo sapiens
auuaauucaccu

SEQ ID NO: 1454365 - RNA, 15 nt, Homo sapiens
auuaauucuucaccu

SEQ ID NO: 1454366 - RNA, 19 nt, Homo sapiens
auuaauuguuuugcacuuu

SEQ ID NO: 1454367 - RNA, 23 nt, Homo sapiens
auuaauuuuuaaggauguugcca

SEQ ID NO: 1454368 - RNA, 13 nt, Homo sapiens
auuacaacuaagu

SEQ ID NO: 1454369 - RNA, 17 nt, Homo sapiens
auuacaggcgugaucca

SEQ ID NO: 1454370 - RNA, 17 nt, Homo sapiens
auuacauggaacuuuuc

SEQ ID NO: 1454371 - RNA, 15 nt, Homo sapiens
auuaccuccauccau

SEQ ID NO: 1454372 - RNA, 23 nt, Homo sapiens
auuacuaucauaauucagcacuu

SEQ ID NO: 1454373 - RNA, 14 nt, Homo sapiens
auuacucaguuuau

SEQ ID NO: 1454374 - RNA, 14 nt, Homo sapiens
auuacugauuuugu

SEQ ID NO: 1454375 - RNA, 12 nt, Homo sapiens
auuacuguguaa

SEQ ID NO: 1454376 - RNA, 18 nt, Homo sapiens
auuacuguugcauuuacu

SEQ ID NO: 1454377 - RNA, 19 nt, Homo sapiens
auuacuguugcauuuacuu

SEQ ID NO: 1454378 - RNA, 19 nt, Homo sapiens
auuagaaaaaaauuacuaa

SEQ ID NO: 1454379 - RNA, 13 nt, Homo sapiens
auuagaugaacuc

SEQ ID NO: 1454380 - RNA, 23 nt, Homo sapiens
auuagcagcaucuuuaacacagc

SEQ ID NO: 1454381 - RNA, 23 nt, Homo sapiens
auuagcauggccccaguccaugc

SEQ ID NO: 1454382 - RNA, 22 nt, Homo sapiens
auuagcauucugguuuugacau

SEQ ID NO: 1454383 - RNA, 17 nt, Homo sapiens
auuagcuggcgcauauu

SEQ ID NO: 1454384 - RNA, 15 nt, Homo sapiens
auuaggaaguguaac

SEQ ID NO: 1454385 - RNA, 15 nt, Homo sapiens
auuaggacuguauaa

SEQ ID NO: 1454386 - RNA, 20 nt, Homo sapiens
auuaguugaaaggccucaag

SEQ ID NO: 1454387 - RNA, 16 nt, Homo sapiens
auuauaaauaaauaga

SEQ ID NO: 1454388 - RNA, 22 nt, Homo sapiens
auuauaaauaaauagauguguc

SEQ ID NO: 1454389 - RNA, 23 nt, Homo sapiens
auuauacgcuggcaacacagagg

SEQ ID NO: 1454390 - RNA, 16 nt, Homo sapiens
auuauagccacauccc

SEQ ID NO: 1454391 - RNA, 14 nt, Homo sapiens
auuauauguucaga

SEQ ID NO: 1454392 - RNA, 22 nt, Homo sapiens
auuaucugugucaaaagccaga

SEQ ID NO: 1454393 - RNA, 11 nt, Homo sapiens
auuaugacaau

SEQ ID NO: 1454394 - RNA, 20 nt, Homo sapiens
auuaugaguaguguggaauu

SEQ ID NO: 1454395 - RNA, 15 nt, Homo sapiens
auuaugccacuuccu

SEQ ID NO: 1454396 - RNA, 20 nt, Homo sapiens
auuaugggcgugaaccacca

SEQ ID NO: 1454397 - RNA, 18 nt, Homo sapiens
auuauuauucuucauaac

SEQ ID NO: 1454398 - RNA, 13 nt, Homo sapiens
auuauuauuucca

SEQ ID NO: 1454399 - RNA, 15 nt, Homo sapiens
auuauucaaaaacau

SEQ ID NO: 1454400 - RNA, 20 nt, Homo sapiens
auuauugucaaagaagucau

SEQ ID NO: 1454401 - RNA, 19 nt, Homo sapiens
auuauuuaugugaaaguca

SEQ ID NO: 1454402 - RNA, 20 nt, Homo sapiens
auuauuugucauucauucaa

SEQ ID NO: 1454403 - RNA, 17 nt, Homo sapiens
auuauuuucuucaucca

SEQ ID NO: 1454404 - RNA, 16 nt, Homo sapiens
auucaaaaauuaucua

SEQ ID NO: 1454405 - RNA, 16 nt, Homo sapiens
auucaaaucacaugga

SEQ ID NO: 1454406 - RNA, 22 nt, Homo sapiens
auucaacaagagcacuacauuc

SEQ ID NO: 1454407 - RNA, 16 nt, Homo sapiens
auucaacucuccaaug

SEQ ID NO: 1454408 - RNA, 19 nt, Homo sapiens
auucaagggacccaugagu

SEQ ID NO: 1454409 - RNA, 20 nt, Homo sapiens
auucaauagcauaucacaga

SEQ ID NO: 1454410 - RNA, 18 nt, Homo sapiens
auucacaaaauuuccaca

SEQ ID NO: 1454411 - RNA, 14 nt, Homo sapiens
auucacaguaauau

SEQ ID NO: 1454412 - RNA, 13 nt, Homo sapiens
auucaccaaaaua

SEQ ID NO: 1454413 - RNA, 16 nt, Homo sapiens
auucacuugcauuucu

SEQ ID NO: 1454414 - RNA, 24 nt, Homo sapiens
caaaguauaaccauaugauacuau

SEQ ID NO: 1454415 - RNA, 14 nt, Homo sapiens
caaaguauuugcug

SEQ ID NO: 1454416 - RNA, 16 nt, Homo sapiens
caaagucaaaaauagc

SEQ ID NO: 1454417 - RNA, 20 nt, Homo sapiens
caaagugacauuccugaguc

SEQ ID NO: 1454418 - RNA, 16 nt, Homo sapiens
caaagugacuauucag

SEQ ID NO: 1454419 - RNA, 21 nt, Homo sapiens
caaaguguuuuuuauugaaug

SEQ ID NO: 1454420 - RNA, 22 nt, Homo sapiens
caaauaaaacuagugacagcuu

SEQ ID NO: 1454421 - RNA, 13 nt, Homo sapiens
caaauaaaagcca

SEQ ID NO: 1454422 - RNA, 12 nt, Homo sapiens
caaauaaacuca

SEQ ID NO: 1454423 - RNA, 14 nt, Homo sapiens
caaauaagaaaccu

SEQ ID NO: 1454424 - RNA, 22 nt, Homo sapiens
caaauaaguauuuauaauagca

SEQ ID NO: 1454425 - RNA, 22 nt, Homo sapiens
caaauaauaaaaacagaaggaa

SEQ ID NO: 1454426 - RNA, 15 nt, Homo sapiens
caaauaguaaucugu

SEQ ID NO: 1454427 - RNA, 18 nt, Homo sapiens
caaauagugcaacuauga

SEQ ID NO: 1454428 - RNA, 16 nt, Homo sapiens
caaauauuguugacaa

SEQ ID NO: 1454429 - RNA, 12 nt, Homo sapiens
caaauauuuccc

SEQ ID NO: 1454430 - RNA, 17 nt, Homo sapiens
caaaucaaacauauucu

SEQ ID NO: 1454431 - RNA, 18 nt, Homo sapiens
caaaucaaacauauucua

SEQ ID NO: 1454432 - RNA, 13 nt, Homo sapiens
caaaucaaucugu

SEQ ID NO: 1454433 - RNA, 20 nt, Homo sapiens
caaaucagaccuggcugcuu

SEQ ID NO: 1454434 - RNA, 22 nt, Homo sapiens
caaaucguccagcgaccuuccu

SEQ ID NO: 1454435 - RNA, 15 nt, Homo sapiens
caaaucugacauauu

SEQ ID NO: 1454436 - RNA, 19 nt, Homo sapiens
caaaucuggcuccuuuaca

SEQ ID NO: 1454437 - RNA, 14 nt, Homo sapiens
caaaugaaacuuua

SEQ ID NO: 1454438 - RNA, 15 nt, Homo sapiens
caaaugaauuuucca

SEQ ID NO: 1454439 - RNA, 14 nt, Homo sapiens
caaaugagccauga

SEQ ID NO: 1454440 - RNA, 16 nt, Homo sapiens
caaaugcuauuugaua

SEQ ID NO: 1454441 - RNA, 16 nt, Homo sapiens
caaaugcucucucaaa

SEQ ID NO: 1454442 - RNA, 18 nt, Homo sapiens
caaaugggaaaaccagac

SEQ ID NO: 1454443 - RNA, 17 nt, Homo sapiens
caaaugugauacauuua

SEQ ID NO: 1454444 - RNA, 17 nt, Homo sapiens
caaauucaguuucauaa

SEQ ID NO: 1454445 - RNA, 18 nt, Homo sapiens
caaauucauauucugucu

SEQ ID NO: 1454446 - RNA, 22 nt, Homo sapiens
caaauucggauguaugaucucu

SEQ ID NO: 1454447 - RNA, 22 nt, Homo sapiens
caaauugggacaacagugcuuu

SEQ ID NO: 1454448 - RNA, 19 nt, Homo sapiens
caaauuguaguucuugucu

SEQ ID NO: 1454449 - RNA, 16 nt, Homo sapiens
caaauugucaccugcu

SEQ ID NO: 1454450 - RNA, 20 nt, Homo sapiens
caaauuuuagaacuuuaccu

SEQ ID NO: 1454451 - RNA, 17 nt, Homo sapiens
caaauuuuuacugagaa

SEQ ID NO: 1454452 - RNA, 18 nt, Homo sapiens
caacaaaugaauuuucca

SEQ ID NO: 1454453 - RNA, 22 nt, Homo sapiens
caacaaccggccaccagauguc

SEQ ID NO: 1454454 - RNA, 21 nt, Homo sapiens
caacaauccaucucucaagua

SEQ ID NO: 1454455 - RNA, 22 nt, Homo sapiens
caacaaugacuuaaccauauaa

SEQ ID NO: 1454456 - RNA, 23 nt, Homo sapiens
caacacaagcuggaagcacaugu

SEQ ID NO: 1454457 - RNA, 13 nt, Homo sapiens
caacacacacugu

SEQ ID NO: 1454458 - RNA, 13 nt, Homo sapiens
caacacagaggaa

SEQ ID NO: 1454459 - RNA, 18 nt, Homo sapiens
caacacccaaguugaaga

SEQ ID NO: 1454460 - RNA, 18 nt, Homo sapiens
caacagaagcuuccauuc

SEQ ID NO: 1454461 - RNA, 16 nt, Homo sapiens
caacaggcuugugcaa

SEQ ID NO: 1454462 - RNA, 22 nt, Homo sapiens
caacagguggcaggaccaggac

SEQ ID NO: 1454463 - RNA, 18 nt, Homo sapiens
caacaguuuuuuaugcua

SEQ ID NO: 1454464 - RNA, 15 nt, Homo sapiens
caacauaacugaagg

SEQ ID NO: 1454465 - RNA, 13 nt, Homo sapiens
caacauaugcaaa

SEQ ID NO: 1454466 - RNA, 21 nt, Homo sapiens
caacaugaugaaaccccaucu

SEQ ID NO: 1454467 - RNA, 16 nt, Homo sapiens
caacaugcgaccguga

SEQ ID NO: 1454468 - RNA, 17 nt, Homo sapiens
caacaugcgaccgugac

SEQ ID NO: 1454469 - RNA, 21 nt, Homo sapiens
caacauggcaaaaccccaucu

SEQ ID NO: 1454470 - RNA, 18 nt, Homo sapiens
caacauggugaaacccug

SEQ ID NO: 1454471 - RNA, 20 nt, Homo sapiens
caacauguuacugaccagca

SEQ ID NO: 1454472 - RNA, 18 nt, Homo sapiens
caaccaagucaugugcau

SEQ ID NO: 1454473 - RNA, 15 nt, Homo sapiens
caaccaauuuacacu

SEQ ID NO: 1454474 - RNA, 18 nt, Homo sapiens
caaccaauuuacacugcc

SEQ ID NO: 1454475 - RNA, 21 nt, Homo sapiens
caaccacuguaaaaugaaauu

SEQ ID NO: 1454476 - RNA, 22 nt, Homo sapiens
caaccagccaggcagguccaca

SEQ ID NO: 1454477 - RNA, 22 nt, Homo sapiens
caaccaguuuauccaccaagaa

SEQ ID NO: 1454478 - RNA, 12 nt, Homo sapiens
caaccccagugg

SEQ ID NO: 1454479 - RNA, 23 nt, Homo sapiens
caacccgagucauucguucugug

SEQ ID NO: 1454480 - RNA, 17 nt, Homo sapiens
caacccggcacugcccu

SEQ ID NO: 1454481 - RNA, 18 nt, Homo sapiens
caaccggucacccaggag

SEQ ID NO: 1454482 - RNA, 19 nt, Homo sapiens
caaccucauugacaagaac

SEQ ID NO: 1454483 - RNA, 14 nt, Homo sapiens
caaccugaagacac

SEQ ID NO: 1454484 - RNA, 22 nt, Homo sapiens
caaccugcugaagggcagaggu

SEQ ID NO: 1454485 - RNA, 21 nt, Homo sapiens
caaccuggcaaaaaugcaaca

SEQ ID NO: 1454486 - RNA, 20 nt, Homo sapiens
caacgauaaaauuacaaaag

SEQ ID NO: 1454487 - RNA, 16 nt, Homo sapiens
caacggccgacugccu

SEQ ID NO: 1454488 - RNA, 15 nt, Homo sapiens
caacuacugugauca

SEQ ID NO: 1454489 - RNA, 20 nt, Homo sapiens
caacuauuuuuccaaaauaa

SEQ ID NO: 1454490 - RNA, 21 nt, Homo sapiens
caacucuccccugaccuguga

SEQ ID NO: 1454491 - RNA, 23 nt, Homo sapiens
caacugaccugaccccauuccug

SEQ ID NO: 1454492 - RNA, 14 nt, Homo sapiens
caacugacuuguau

SEQ ID NO: 1454493 - RNA, 14 nt, Homo sapiens
caacugauugcaac

SEQ ID NO: 1454494 - RNA, 21 nt, Homo sapiens
caacugcaucuccaaacauua

SEQ ID NO: 1454495 - RNA, 21 nt, Homo sapiens
caacugcugcaugucccugug

SEQ ID NO: 1454496 - RNA, 13 nt, Homo sapiens
caacuguuuucau

SEQ ID NO: 1454497 - RNA, 14 nt, Homo sapiens
caacuucagcagua

SEQ ID NO: 1454498 - RNA, 21 nt, Homo sapiens
caacuuccagagaagccaugg

SEQ ID NO: 1454499 - RNA, 15 nt, Homo sapiens
caacuuccuguugau

SEQ ID NO: 1454500 - RNA, 21 nt, Homo sapiens
caacuugaaauuauaucugug

SEQ ID NO: 1454501 - RNA, 16 nt, Homo sapiens
caacuugagggcccag

SEQ ID NO: 1454502 - RNA, 22 nt, Homo sapiens
caacuugauuuuuucaaaaaag

SEQ ID NO: 1454503 - RNA, 18 nt, Homo sapiens
caacuuggguucuucuca

SEQ ID NO: 1454504 - RNA, 22 nt, Homo sapiens
caacuuuagcuaguaucuucaa

SEQ ID NO: 1454505 - RNA, 15 nt, Homo sapiens
caacuuuguuuucca

SEQ ID NO: 1454506 - RNA, 22 nt, Homo sapiens
caagaaaaccuagaucugcacu

SEQ ID NO: 1454507 - RNA, 22 nt, Homo sapiens
caagaaaagggcugacauuuuc

SEQ ID NO: 1454508 - RNA, 16 nt, Homo sapiens
caagaaacgucuucua

SEQ ID NO: 1454509 - RNA, 12 nt, Homo sapiens
caagaaauuacu

SEQ ID NO: 1454510 - RNA, 15 nt, Homo sapiens
caagaacugaaacca

SEQ ID NO: 1454511 - RNA, 15 nt, Homo sapiens
caagaagugccaguu

SEQ ID NO: 1454512 - RNA, 16 nt, Homo sapiens
caagaauguaacucca

SEQ ID NO: 1454513 - RNA, 15 nt, Homo sapiens
caagacaaaaagcca

SEQ ID NO: 1454514 - RNA, 22 nt, Homo sapiens
caagacagcaugccuucaaauc

SEQ ID NO: 1454515 - RNA, 16 nt, Homo sapiens
caagaccucugugcac

SEQ ID NO: 1454516 - RNA, 19 nt, Homo sapiens
cacuucagaaauauaugca

SEQ ID NO: 1454517 - RNA, 20 nt, Homo sapiens
cacuucagaaauauaugcag

SEQ ID NO: 1454518 - RNA, 20 nt, Homo sapiens
cacuucauccccucccagau

SEQ ID NO: 1454519 - RNA, 12 nt, Homo sapiens
cacuucaucuga

SEQ ID NO: 1454520 - RNA, 17 nt, Homo sapiens
cacuucauucacauuca

SEQ ID NO: 1454521 - RNA, 18 nt, Homo sapiens
cacuucauucacauucag

SEQ ID NO: 1454522 - RNA, 18 nt, Homo sapiens
cacuucauucugcagggu

SEQ ID NO: 1454523 - RNA, 17 nt, Homo sapiens
cacuucccuacauggag

SEQ ID NO: 1454524 - RNA, 16 nt, Homo sapiens
cacuuccuugccaguc

SEQ ID NO: 1454525 - RNA, 19 nt, Homo sapiens
cacuucgagcacuguccag

SEQ ID NO: 1454526 - RNA, 21 nt, Homo sapiens
cacuucuuguuccccacugac

SEQ ID NO: 1454527 - RNA, 18 nt, Homo sapiens
cacuugaaugugucacua

SEQ ID NO: 1454528 - RNA, 13 nt, Homo sapiens
cacuugaggucag

SEQ ID NO: 1454529 - RNA, 15 nt, Homo sapiens
cacuugaugauacaa

SEQ ID NO: 1454530 - RNA, 12 nt, Homo sapiens
cacuugcacugg

SEQ ID NO: 1454531 - RNA, 22 nt, Homo sapiens
cacuuguaagaaaaugagacaa

SEQ ID NO: 1454532 - RNA, 21 nt, Homo sapiens
cacuugugcaguguugacagu

SEQ ID NO: 1454533 - RNA, 22 nt, Homo sapiens
cacuuguuguugaacauggcua

SEQ ID NO: 1454534 - RNA, 15 nt, Homo sapiens
cacuuuaaaccuguu

SEQ ID NO: 1454535 - RNA, 17 nt, Homo sapiens
cacuuuauaaauaucaa

SEQ ID NO: 1454536 - RNA, 22 nt, Homo sapiens
cagaaacagugggagcccugac

SEQ ID NO: 1454537 - RNA, 23 nt, Homo sapiens
cagaaacagugggagcccugacc

SEQ ID NO: 1454538 - RNA, 18 nt, Homo sapiens
cagaaagcagauaccuca

SEQ ID NO: 1454539 - RNA, 21 nt, Homo sapiens
cagaaaguaucacaaauggaa

SEQ ID NO: 1454540 - RNA, 19 nt, Homo sapiens
cagaaauccugcaaugaaa

SEQ ID NO: 1454541 - RNA, 15 nt, Homo sapiens
cagaaauggacugga

SEQ ID NO: 1454542 - RNA, 21 nt, Homo sapiens
cagaaauggggaauucucuaa

SEQ ID NO: 1454543 - RNA, 22 nt, Homo sapiens
cagaacaguggcucguauccca

SEQ ID NO: 1454544 - RNA, 17 nt, Homo sapiens
cagaacaucgauaugua

SEQ ID NO: 1454545 - RNA, 20 nt, Homo sapiens
cagaaccucuuccccagaaa

SEQ ID NO: 1454546 - RNA, 19 nt, Homo sapiens
cagaaccuucaacccagug

SEQ ID NO: 1454547 - RNA, 16 nt, Homo sapiens
cagaacuaccaugaga

SEQ ID NO: 1454548 - RNA, 14 nt, Homo sapiens
cagaacucccacaa

SEQ ID NO: 1454549 - RNA, 18 nt, Homo sapiens
cagaacuucccugauuga

SEQ ID NO: 1454550 - RNA, 19 nt, Homo sapiens
cagaagaccccugacucau

SEQ ID NO: 1454551 - RNA, 20 nt, Homo sapiens
cagaagaccccugacucauc

SEQ ID NO: 1454552 - RNA, 21 nt, Homo sapiens
cagaagauccaagaggcccug

SEQ ID NO: 1454553 - RNA, 15 nt, Homo sapiens
cagaagcaagccaga

SEQ ID NO: 1454554 - RNA, 20 nt, Homo sapiens
cagaagcaggguacccuuug

SEQ ID NO: 1454555 - RNA, 12 nt, Homo sapiens
cagaagcccuga

SEQ ID NO: 1454556 - RNA, 15 nt, Homo sapiens
cagaagccuccaagc

SEQ ID NO: 1454557 - RNA, 14 nt, Homo sapiens
cagaaguacuccua

SEQ ID NO: 1454558 - RNA, 22 nt, Homo sapiens
cagaaugcugcaggacuugaga

SEQ ID NO: 1454559 - RNA, 12 nt, Homo sapiens
cagaauuaugaa

SEQ ID NO: 1454560 - RNA, 19 nt, Homo sapiens
cagaauuaugaagagguau

SEQ ID NO: 1454561 - RNA, 15 nt, Homo sapiens
cagaauuuccacugu

SEQ ID NO: 1454562 - RNA, 12 nt, Homo sapiens
cagacaaaugga

SEQ ID NO: 1454563 - RNA, 15 nt, Homo sapiens
cagacaaaugugguu

SEQ ID NO: 1454564 - RNA, 15 nt, Homo sapiens
cagacaaugauccag

SEQ ID NO: 1454565 - RNA, 14 nt, Homo sapiens
cagacacacccaca

SEQ ID NO: 1454566 - RNA, 11 nt, Homo sapiens
cagacaccagu

SEQ ID NO: 1454567 - RNA, 16 nt, Homo sapiens
cagacacuaaguuaua

SEQ ID NO: 1454568 - RNA, 15 nt, Homo sapiens
cagacacuaccccau

SEQ ID NO: 1454569 - RNA, 20 nt, Homo sapiens
cagacagccguuuguucuac

SEQ ID NO: 1454570 - RNA, 21 nt, Homo sapiens
cagacagccguuuguucuaca

SEQ ID NO: 1454571 - RNA, 19 nt, Homo sapiens
cagacauacauuuaugcac

SEQ ID NO: 1454572 - RNA, 19 nt, Homo sapiens
cagacaucggccuccauga

SEQ ID NO: 1454573 - RNA, 12 nt, Homo sapiens
cagaccagugac

SEQ ID NO: 1454574 - RNA, 19 nt, Homo sapiens
cagacccugccacucucac

SEQ ID NO: 1454575 - RNA, 13 nt, Homo sapiens
cagaccuccuagc

SEQ ID NO: 1454576 - RNA, 23 nt, Homo sapiens
cagacggcggccaggcacagggc

SEQ ID NO: 1454577 - RNA, 17 nt, Homo sapiens
cagacguugccugagaa

SEQ ID NO: 1454578 - RNA, 16 nt, Homo sapiens
cagacugucaagaaga

SEQ ID NO: 1454579 - RNA, 13 nt, Homo sapiens
cagacuucagcug

SEQ ID NO: 1454580 - RNA, 15 nt, Homo sapiens
cagacuuccuugaga

SEQ ID NO: 1454581 - RNA, 18 nt, Homo sapiens
cagagaaacuuaagcaaa

SEQ ID NO: 1454582 - RNA, 16 nt, Homo sapiens
cagagaaagaaguccu

SEQ ID NO: 1454583 - RNA, 17 nt, Homo sapiens
cagagaaauacuuucag

SEQ ID NO: 1454584 - RNA, 13 nt, Homo sapiens
cagagaagcugga

SEQ ID NO: 1454585 - RNA, 21 nt, Homo sapiens
cagagaagguaaggugugaac

SEQ ID NO: 1454586 - RNA, 18 nt, Homo sapiens
cagagaauauauacauuc

SEQ ID NO: 1454587 - RNA, 20 nt, Homo sapiens
cagagaauucucuuauccaa

SEQ ID NO: 1454588 - RNA, 13 nt, Homo sapiens
cagagacauacuu

SEQ ID NO: 1454589 - RNA, 21 nt, Homo sapiens
cagagacugggaugggaacac

SEQ ID NO: 1454590 - RNA, 20 nt, Homo sapiens
cagagagagagaaggcagca

SEQ ID NO: 1454591 - RNA, 19 nt, Homo sapiens
cagagagccuggugcugcu

SEQ ID NO: 1454592 - RNA, 23 nt, Homo sapiens
cagagagggcagagggguaggca

SEQ ID NO: 1454593 - RNA, 16 nt, Homo sapiens
cagagauaaaccaaua

SEQ ID NO: 1454594 - RNA, 20 nt, Homo sapiens
cagagaucgagaccauccua

SEQ ID NO: 1454595 - RNA, 15 nt, Homo sapiens
cagagcaagacuguc

SEQ ID NO: 1454596 - RNA, 18 nt, Homo sapiens
cagagcaagacugucuca

SEQ ID NO: 1454597 - RNA, 18 nt, Homo sapiens
cagagcacuuugcaacuc

SEQ ID NO: 1454598 - RNA, 15 nt, Homo sapiens
cagagcagaugcaga

SEQ ID NO: 1454599 - RNA, 22 nt, Homo sapiens
cagagcagaugcagagagccau

SEQ ID NO: 1454600 - RNA, 15 nt, Homo sapiens
cagagcauacaacag

SEQ ID NO: 1454601 - RNA, 18 nt, Homo sapiens
cagagccagaugcaggac

SEQ ID NO: 1454602 - RNA, 14 nt, Homo sapiens
cagagccagucuca

SEQ ID NO: 1454603 - RNA, 16 nt, Homo sapiens
cagagcccagcuccaa

SEQ ID NO: 1454604 - RNA, 20 nt, Homo sapiens
cagagcucuggguugugcac

SEQ ID NO: 1454605 - RNA, 22 nt, Homo sapiens
cagagcuggguggggacaguga

SEQ ID NO: 1454606 - RNA, 13 nt, Homo sapiens
cagaggagcucua

SEQ ID NO: 1454607 - RNA, 23 nt, Homo sapiens
cagaggagcucuacccugcuccc

SEQ ID NO: 1454608 - RNA, 14 nt, Homo sapiens
cagaggagugcagc

SEQ ID NO: 1454609 - RNA, 23 nt, Homo sapiens
cagaggagugcagccuucuccau

SEQ ID NO: 1454610 - RNA, 14 nt, Homo sapiens
cagaggauggugag

SEQ ID NO: 1454611 - RNA, 23 nt, Homo sapiens
cagaggcucuugaugguggacua

SEQ ID NO: 1454612 - RNA, 22 nt, Homo sapiens
cagagggagaauccaaggguug

SEQ ID NO: 1454613 - RNA, 17 nt, Homo sapiens
cagagggcaguggcccu

SEQ ID NO: 1454614 - RNA, 21 nt, Homo sapiens
cagaggucaggaagcaggggu

SEQ ID NO: 1454615 - RNA, 22 nt, Homo sapiens
cagaggucaggaagcaggggug

SEQ ID NO: 1454616 - RNA, 15 nt, Homo sapiens
cagaggucucccaaa

SEQ ID NO: 1454617 - RNA, 19 nt, Homo sapiens
cagagucaggcuguugcgc

SEQ ID NO: 1454618 - RNA, 17 nt, Homo sapiens
cccugcagacucuggca

SEQ ID NO: 1454619 - RNA, 22 nt, Homo sapiens
cccugccacauacaggugcuca

SEQ ID NO: 1454620 - RNA, 15 nt, Homo sapiens
cccugcccaaugaga

SEQ ID NO: 1454621 - RNA, 17 nt, Homo sapiens
cccugccccguggagcc

SEQ ID NO: 1454622 - RNA, 23 nt, Homo sapiens
cccugccuguuaaggaaacuuua

SEQ ID NO: 1454623 - RNA, 16 nt, Homo sapiens
cccugcgccuccagag

SEQ ID NO: 1454624 - RNA, 23 nt, Homo sapiens
cccugcgcgggaccaucuggaau

SEQ ID NO: 1454625 - RNA, 19 nt, Homo sapiens
cccugcgggugaacaaagc

SEQ ID NO: 1454626 - RNA, 16 nt, Homo sapiens
cccugcggucaggcug

SEQ ID NO: 1454627 - RNA, 14 nt, Homo sapiens
cccugcugaccucc

SEQ ID NO: 1454628 - RNA, 17 nt, Homo sapiens
cccugcuuugcaucuuu

SEQ ID NO: 1454629 - RNA, 18 nt, Homo sapiens
cccuggaaggacauccau

SEQ ID NO: 1454630 - RNA, 14 nt, Homo sapiens
cccuggagcaagac

SEQ ID NO: 1454631 - RNA, 17 nt, Homo sapiens
cccuggagcaagaccug

SEQ ID NO: 1454632 - RNA, 20 nt, Homo sapiens
cccuggaucuaccagcauaa

SEQ ID NO: 1454633 - RNA, 14 nt, Homo sapiens
cccugggguggcca

SEQ ID NO: 1454634 - RNA, 21 nt, Homo sapiens
cccuggugaaucaccuggcug

SEQ ID NO: 1454635 - RNA, 21 nt, Homo sapiens
cccuggugggccaacaaagaa

SEQ ID NO: 1454636 - RNA, 12 nt, Homo sapiens
cccugucauccu

SEQ ID NO: 1454637 - RNA, 19 nt, Homo sapiens
cccuguccuaagcacuuua

SEQ ID NO: 1454638 - RNA, 12 nt, Homo sapiens
cccugucuugcu

SEQ ID NO: 1454639 - RNA, 14 nt, Homo sapiens
cccuguggcacuca

SEQ ID NO: 1454640 - RNA, 19 nt, Homo sapiens
cccuuaaugaaauacauca

SEQ ID NO: 1454641 - RNA, 14 nt, Homo sapiens
cccuuacacacuca

SEQ ID NO: 1454642 - RNA, 15 nt, Homo sapiens
cccuuacuguuucac

SEQ ID NO: 1454643 - RNA, 15 nt, Homo sapiens
cccuuagugacucuu

SEQ ID NO: 1454644 - RNA, 13 nt, Homo sapiens
cccuucacacccc

SEQ ID NO: 1454645 - RNA, 20 nt, Homo sapiens
cccuucccucaccuuggcac

SEQ ID NO: 1454646 - RNA, 16 nt, Homo sapiens
cccuucccucugggca

SEQ ID NO: 1454647 - RNA, 14 nt, Homo sapiens
cccuuccuguuuca

SEQ ID NO: 1454648 - RNA, 15 nt, Homo sapiens
cccuuccuguuucag

SEQ ID NO: 1454649 - RNA, 14 nt, Homo sapiens
cccuucggcagcua

SEQ ID NO: 1454650 - RNA, 17 nt, Homo sapiens
cccuucuggacacugag

SEQ ID NO: 1454651 - RNA, 21 nt, Homo sapiens
cccuugcaaucuucuacuuua

SEQ ID NO: 1454652 - RNA, 12 nt, Homo sapiens
cccuugcucuca

SEQ ID NO: 1454653 - RNA, 14 nt, Homo sapiens
cccuuuauguaucu

SEQ ID NO: 1454654 - RNA, 15 nt, Homo sapiens
cccuuugaagccuca

SEQ ID NO: 1454655 - RNA, 12 nt, Homo sapiens
cccuuugcuaaa

SEQ ID NO: 1454656 - RNA, 14 nt, Homo sapiens
cccuuugcuucaaa

SEQ ID NO: 1454657 - RNA, 15 nt, Homo sapiens
cccuuuggggagcag

SEQ ID NO: 1454658 - RNA, 13 nt, Homo sapiens
ccgaaugugcagg

SEQ ID NO: 1454659 - RNA, 17 nt, Homo sapiens
ccgacuccucaaaagca

SEQ ID NO: 1454660 - RNA, 13 nt, Homo sapiens
ccgacugccugug

SEQ ID NO: 1454661 - RNA, 15 nt, Homo sapiens
ccgaggggagggcag

SEQ ID NO: 1454662 - RNA, 15 nt, Homo sapiens
ccgagucucuucucc

SEQ ID NO: 1454663 - RNA, 16 nt, Homo sapiens
ccgagucuugcucugu

SEQ ID NO: 1454664 - RNA, 15 nt, Homo sapiens
ccgauaaugcaugaa

SEQ ID NO: 1454665 - RNA, 16 nt, Homo sapiens
ccgaugaacaaguuua

SEQ ID NO: 1454666 - RNA, 14 nt, Homo sapiens
ccgcacaugcacac

SEQ ID NO: 1454667 - RNA, 14 nt, Homo sapiens
ccgcaccgcuggga

SEQ ID NO: 1454668 - RNA, 20 nt, Homo sapiens
ccgcaggcagacuacacagg

SEQ ID NO: 1454669 - RNA, 22 nt, Homo sapiens
ccgcaggugggugcugcccugu

SEQ ID NO: 1454670 - RNA, 12 nt, Homo sapiens
ccgcugagcuga

SEQ ID NO: 1454671 - RNA, 21 nt, Homo sapiens
ccgcugcuuccuggcugggaa

SEQ ID NO: 1454672 - RNA, 15 nt, Homo sapiens
ccgcuuggcacauga

SEQ ID NO: 1454673 - RNA, 15 nt, Homo sapiens
ccggaaccacagggc

SEQ ID NO: 1454674 - RNA, 16 nt, Homo sapiens
ccggaaccacagggcc

SEQ ID NO: 1454675 - RNA, 17 nt, Homo sapiens
ccggagagggagucagu

SEQ ID NO: 1454676 - RNA, 13 nt, Homo sapiens
ccggccaccagau

SEQ ID NO: 1454677 - RNA, 23 nt, Homo sapiens
ccggcgaaauaaaaucagaguug

SEQ ID NO: 1454678 - RNA, 16 nt, Homo sapiens
ccggcgccccugccac

SEQ ID NO: 1454679 - RNA, 21 nt, Homo sapiens
ccggcuaugggacugcagugc

SEQ ID NO: 1454680 - RNA, 12 nt, Homo sapiens
ccggugcucugg

SEQ ID NO: 1454681 - RNA, 17 nt, Homo sapiens
ccguacaucugcaauau

SEQ ID NO: 1454682 - RNA, 12 nt, Homo sapiens
ccguacauucaa

SEQ ID NO: 1454683 - RNA, 16 nt, Homo sapiens
ccguauugguauacuu

SEQ ID NO: 1454684 - RNA, 20 nt, Homo sapiens
ccguccacguccuccaagcu

SEQ ID NO: 1454685 - RNA, 15 nt, Homo sapiens
ccgugaacucuggug

SEQ ID NO: 1454686 - RNA, 21 nt, Homo sapiens
ccgugccaaaaaucuuuucau

SEQ ID NO: 1454687 - RNA, 17 nt, Homo sapiens
ccguggagacugagauc

SEQ ID NO: 1454688 - RNA, 11 nt, Homo sapiens
ccgugguccaa

SEQ ID NO: 1454689 - RNA, 15 nt, Homo sapiens
ccguguaaaccaaag

SEQ ID NO: 1454690 - RNA, 20 nt, Homo sapiens
ccgugugagugugacagggc

SEQ ID NO: 1454691 - RNA, 15 nt, Homo sapiens
ccguuaaaaaaucaa

SEQ ID NO: 1454692 - RNA, 18 nt, Homo sapiens
ccguucugugcacaaaac

SEQ ID NO: 1454693 - RNA, 20 nt, Homo sapiens
ccuaaaacaccugguaggag

SEQ ID NO: 1454694 - RNA, 11 nt, Homo sapiens
ccuaaaaucuu

SEQ ID NO: 1454695 - RNA, 20 nt, Homo sapiens
ccuaaacucuuuuucaucca

SEQ ID NO: 1454696 - RNA, 13 nt, Homo sapiens
ccuaaaggacucu

SEQ ID NO: 1454697 - RNA, 22 nt, Homo sapiens
ccuaaaucugccuuuucaucua

SEQ ID NO: 1454698 - RNA, 19 nt, Homo sapiens
ccuaacacggugcucauuu

SEQ ID NO: 1454699 - RNA, 15 nt, Homo sapiens
ccuaaccacuuagca

SEQ ID NO: 1454700 - RNA, 21 nt, Homo sapiens
ccuaacugaaagaugaucauu

SEQ ID NO: 1454701 - RNA, 18 nt, Homo sapiens
ccuaagagaugggacuag

SEQ ID NO: 1454702 - RNA, 11 nt, Homo sapiens
ccuaagcacuu

SEQ ID NO: 1454703 - RNA, 13 nt, Homo sapiens
ccuaagcacuuua

SEQ ID NO: 1454704 - RNA, 18 nt, Homo sapiens
ccuaagcagaaaacuggc

SEQ ID NO: 1454705 - RNA, 16 nt, Homo sapiens
ccuaaggaaccuuccu

SEQ ID NO: 1454706 - RNA, 15 nt, Homo sapiens
ccuaaggaucucuca

SEQ ID NO: 1454707 - RNA, 15 nt, Homo sapiens
ccuaagggagugucu

SEQ ID NO: 1454708 - RNA, 16 nt, Homo sapiens
ccuacacacacccagg

SEQ ID NO: 1454709 - RNA, 12 nt, Homo sapiens
ccuacagaauuu

SEQ ID NO: 1454710 - RNA, 19 nt, Homo sapiens
ccuacagcacuacugggug

SEQ ID NO: 1454711 - RNA, 23 nt, Homo sapiens
ccuacagucaucugccaccacac

SEQ ID NO: 1454712 - RNA, 14 nt, Homo sapiens
ccuacauuaucuca

SEQ ID NO: 1454713 - RNA, 23 nt, Homo sapiens
ccuacauugugcugcaccugguc

SEQ ID NO: 1454714 - RNA, 14 nt, Homo sapiens
ccuaccacaguguc

SEQ ID NO: 1454715 - RNA, 14 nt, Homo sapiens
ccuaccccagggcc

SEQ ID NO: 1454716 - RNA, 11 nt, Homo sapiens
ccuaccuuuau

SEQ ID NO: 1454717 - RNA, 15 nt, Homo sapiens
ccuacguauccugca

SEQ ID NO: 1454718 - RNA, 23 nt, Homo sapiens
ccuacuguucggacaaaaaaagu

SEQ ID NO: 1454719 - RNA, 22 nt, Homo sapiens
ccuagacuuugggaucaaauaa

SEQ ID NO: 1454720 - RNA, 20 nt, Homo sapiens
ccuagaucugcacucaccuc

SEQ ID NO: 1454721 - RNA, 18 nt, Homo sapiens
ccuagcucucccagugaa

SEQ ID NO: 1454722 - RNA, 16 nt, Homo sapiens
cgccugacaaccacug

SEQ ID NO: 1454723 - RNA, 18 nt, Homo sapiens
cgccuguaauuccagcua

SEQ ID NO: 1454724 - RNA, 20 nt, Homo sapiens
cgcgcaccuguaaucccagc

SEQ ID NO: 1454725 - RNA, 14 nt, Homo sapiens
cgcggaagugacca

SEQ ID NO: 1454726 - RNA, 20 nt, Homo sapiens
cgcuaccagcagacucugga

SEQ ID NO: 1454727 - RNA, 18 nt, Homo sapiens
cgcuacccacuucuaaau

SEQ ID NO: 1454728 - RNA, 12 nt, Homo sapiens
cgcuauugauuu

SEQ ID NO: 1454729 - RNA, 16 nt, Homo sapiens
cgcugacuucauggaa

SEQ ID NO: 1454730 - RNA, 20 nt, Homo sapiens
cgcugagcugaguggccagc

SEQ ID NO: 1454731 - RNA, 15 nt, Homo sapiens
cgcuguccugagaug

SEQ ID NO: 1454732 - RNA, 14 nt, Homo sapiens
cgcuuaagcuuuca

SEQ ID NO: 1454733 - RNA, 23 nt, Homo sapiens
cgcuucuccaagucugcugauga

SEQ ID NO: 1454734 - RNA, 21 nt, Homo sapiens
cggaaaccucccuuuacagca

SEQ ID NO: 1454735 - RNA, 23 nt, Homo sapiens
cggaagcugucgacuucaugaca

SEQ ID NO: 1454736 - RNA, 22 nt, Homo sapiens
cggacaagacccccagcacuug

SEQ ID NO: 1454737 - RNA, 14 nt, Homo sapiens
cggacaaguuuuaa

SEQ ID NO: 1454738 - RNA, 20 nt, Homo sapiens
cggacauacucucugccugg

SEQ ID NO: 1454739 - RNA, 14 nt, Homo sapiens
cggagaguacagug

SEQ ID NO: 1454740 - RNA, 22 nt, Homo sapiens
cggagggccccugcgugggggc

SEQ ID NO: 1454741 - RNA, 17 nt, Homo sapiens
cggagucuugcucuguu

SEQ ID NO: 1454742 - RNA, 21 nt, Homo sapiens
cggaucuggggcucugggaua

SEQ ID NO: 1454743 - RNA, 23 nt, Homo sapiens
cggauggaccaaccugcucuguc

SEQ ID NO: 1454744 - RNA, 16 nt, Homo sapiens
cggauuccagcccaca

SEQ ID NO: 1454745 - RNA, 19 nt, Homo sapiens
cggcagacgggaggggaaa

SEQ ID NO: 1454746 - RNA, 18 nt, Homo sapiens
cggccacucuaccugaac

SEQ ID NO: 1454747 - RNA, 21 nt, Homo sapiens
cggcgcccaccacccccucaa

SEQ ID NO: 1454748 - RNA, 14 nt, Homo sapiens
cggcucacugcaac

SEQ ID NO: 1454749 - RNA, 16 nt, Homo sapiens
cggcucgauuucucca

SEQ ID NO: 1454750 - RNA, 14 nt, Homo sapiens
cggcugccaagaca

SEQ ID NO: 1454751 - RNA, 14 nt, Homo sapiens
cggcuucaccugcg

SEQ ID NO: 1454752 - RNA, 14 nt, Homo sapiens
cggcuugauuuccg

SEQ ID NO: 1454753 - RNA, 21 nt, Homo sapiens
cgggaagcaagaugugaaaga

SEQ ID NO: 1454754 - RNA, 22 nt, Homo sapiens
cgggagaucaugucucacuuca

SEQ ID NO: 1454755 - RNA, 16 nt, Homo sapiens
cgggaggcugggcaca

SEQ ID NO: 1454756 - RNA, 14 nt, Homo sapiens
cgggcacggucaca

SEQ ID NO: 1454757 - RNA, 21 nt, Homo sapiens
cgggccuggagaacuagagaa

SEQ ID NO: 1454758 - RNA, 13 nt, Homo sapiens
cgggcuaacggga

SEQ ID NO: 1454759 - RNA, 13 nt, Homo sapiens
cggggaagccgag

SEQ ID NO: 1454760 - RNA, 16 nt, Homo sapiens
cggggacccccaacuc

SEQ ID NO: 1454761 - RNA, 16 nt, Homo sapiens
cggggagcaaaccagc

SEQ ID NO: 1454762 - RNA, 17 nt, Homo sapiens
cggggccagcaccacuu

SEQ ID NO: 1454763 - RNA, 20 nt, Homo sapiens
cggucccaguuuuguugccc

SEQ ID NO: 1454764 - RNA, 22 nt, Homo sapiens
cggugcuagcuugacacaguca

SEQ ID NO: 1454765 - RNA, 14 nt, Homo sapiens
cggugcucuggaag

SEQ ID NO: 1454766 - RNA, 20 nt, Homo sapiens
cgguuugaaaauaugccugc

SEQ ID NO: 1454767 - RNA, 12 nt, Homo sapiens
cgguuuuagcuu

SEQ ID NO: 1454768 - RNA, 20 nt, Homo sapiens
cguaauuaaaggaacagagu

SEQ ID NO: 1454769 - RNA, 11 nt, Homo sapiens
cguagccucag

SEQ ID NO: 1454770 - RNA, 19 nt, Homo sapiens
cguagcuccauauuggaca

SEQ ID NO: 1454771 - RNA, 20 nt, Homo sapiens
cguccagcuggaagggucaa

SEQ ID NO: 1454772 - RNA, 23 nt, Homo sapiens
cguccauaguucugaggucccug

SEQ ID NO: 1454773 - RNA, 13 nt, Homo sapiens
cgucccaccagcu

SEQ ID NO: 1454774 - RNA, 13 nt, Homo sapiens
cgucccuaccucc

SEQ ID NO: 1454775 - RNA, 13 nt, Homo sapiens
cguccuccgucca

SEQ ID NO: 1454776 - RNA, 13 nt, Homo sapiens
cgucuaugcugcu

SEQ ID NO: 1454777 - RNA, 14 nt, Homo sapiens
cgucuaugcugcuu

SEQ ID NO: 1454778 - RNA, 23 nt, Homo sapiens
cgucuuccugaguggugccaaac

SEQ ID NO: 1454779 - RNA, 12 nt, Homo sapiens
cgugaaacacac

SEQ ID NO: 1454780 - RNA, 17 nt, Homo sapiens
cgugaaaccccaucucu

SEQ ID NO: 1454781 - RNA, 14 nt, Homo sapiens
cgugacaacaugcg

SEQ ID NO: 1454782 - RNA, 15 nt, Homo sapiens
cgugaggucccagga

SEQ ID NO: 1454783 - RNA, 20 nt, Homo sapiens
cgugcauuuuuggaucauuu

SEQ ID NO: 1454784 - RNA, 20 nt, Homo sapiens
cgugccaaaaaucuuuucau

SEQ ID NO: 1454785 - RNA, 14 nt, Homo sapiens
cgugccaugaucug

SEQ ID NO: 1454786 - RNA, 17 nt, Homo sapiens
cgugccuguuugcuuag

SEQ ID NO: 1454787 - RNA, 14 nt, Homo sapiens
cguggagaaaauca

SEQ ID NO: 1454788 - RNA, 18 nt, Homo sapiens
cguggcaaauuaacuuga

SEQ ID NO: 1454789 - RNA, 18 nt, Homo sapiens
cgugggcaaacaggcagu

SEQ ID NO: 1454790 - RNA, 12 nt, Homo sapiens
cguggucccuga

SEQ ID NO: 1454791 - RNA, 16 nt, Homo sapiens
cguguccagcacagaa

SEQ ID NO: 1454792 - RNA, 15 nt, Homo sapiens
cguguguagaguuaa

SEQ ID NO: 1454793 - RNA, 20 nt, Homo sapiens
cguguugcaugaaggagcag

SEQ ID NO: 1454794 - RNA, 22 nt, Homo sapiens
cguuaagggaaggaacucuggc

SEQ ID NO: 1454795 - RNA, 11 nt, Homo sapiens
cguuaccagag

SEQ ID NO: 1454796 - RNA, 12 nt, Homo sapiens
cguuaccagaga

SEQ ID NO: 1454797 - RNA, 20 nt, Homo sapiens
cguuaggaaaaccagagccu

SEQ ID NO: 1454798 - RNA, 23 nt, Homo sapiens
cguuaguguauuuuauguguggc

SEQ ID NO: 1454799 - RNA, 13 nt, Homo sapiens
cguucacucccaa

SEQ ID NO: 1454800 - RNA, 19 nt, Homo sapiens
cguuccuauugucauuaaa

SEQ ID NO: 1454801 - RNA, 13 nt, Homo sapiens
cguuguguuguug

SEQ ID NO: 1454802 - RNA, 18 nt, Homo sapiens
cguuugugagcucccagc

SEQ ID NO: 1454803 - RNA, 23 nt, Homo sapiens
cuaaaaaaaaaauccagccucau

SEQ ID NO: 1454804 - RNA, 23 nt, Homo sapiens
cuaaaaacacaaaaauuagccag

SEQ ID NO: 1454805 - RNA, 14 nt, Homo sapiens
cuaaaaacuuagaa

SEQ ID NO: 1454806 - RNA, 12 nt, Homo sapiens
cuaaaacuuaac

SEQ ID NO: 1454807 - RNA, 17 nt, Homo sapiens
cuaaaacuuaacauuca

SEQ ID NO: 1454808 - RNA, 12 nt, Homo sapiens
cuaaaagauuau

SEQ ID NO: 1454809 - RNA, 22 nt, Homo sapiens
cuaaaagcguuggauguagcau

SEQ ID NO: 1454810 - RNA, 16 nt, Homo sapiens
cuaaaagguaugcaau

SEQ ID NO: 1454811 - RNA, 21 nt, Homo sapiens
cuaaaaggugaccaaugaugg

SEQ ID NO: 1454812 - RNA, 13 nt, Homo sapiens
cuaaaaguacaaa

SEQ ID NO: 1454813 - RNA, 21 nt, Homo sapiens
cuaaaaguuacuuaccacaga

SEQ ID NO: 1454814 - RNA, 20 nt, Homo sapiens
cuaaaaucccuggaucacga

SEQ ID NO: 1454815 - RNA, 22 nt, Homo sapiens
cuaaaaugauuuuaucugugaa

SEQ ID NO: 1454816 - RNA, 21 nt, Homo sapiens
cuaaaauugcuucuuuaccaa

SEQ ID NO: 1454817 - RNA, 20 nt, Homo sapiens
cuaaacaaugcugauuuggu

SEQ ID NO: 1454818 - RNA, 16 nt, Homo sapiens
cuaaaccccuguccca

SEQ ID NO: 1454819 - RNA, 20 nt, Homo sapiens
cuaaagccaaggguauccaa

SEQ ID NO: 1454820 - RNA, 16 nt, Homo sapiens
cuaaagccagccugac

SEQ ID NO: 1454821 - RNA, 18 nt, Homo sapiens
cuaaagcuauguuacaug

SEQ ID NO: 1454822 - RNA, 20 nt, Homo sapiens
cuaaaggaaaaaacuuugac

SEQ ID NO: 1454823 - RNA, 16 nt, Homo sapiens
cuaaaggacucuccag

SEQ ID NO: 1454824 - RNA, 15 nt, Homo sapiens
cuaaaggugcacugc

SEQ ID NO: 1454825 - RNA, 16 nt, Homo sapiens
cucccugaagccuuug

SEQ ID NO: 1454826 - RNA, 12 nt, Homo sapiens
cucccugccacc

SEQ ID NO: 1454827 - RNA, 19 nt, Homo sapiens
cucccugguguaguguauu

SEQ ID NO: 1454828 - RNA, 18 nt, Homo sapiens
cucccuguuuuaauucaa

SEQ ID NO: 1454829 - RNA, 18 nt, Homo sapiens
cucccuuugccagugccu

SEQ ID NO: 1454830 - RNA, 21 nt, Homo sapiens
cuccgaccacuuccaggggaa

SEQ ID NO: 1454831 - RNA, 15 nt, Homo sapiens
cuccgagacagucca

SEQ ID NO: 1454832 - RNA, 13 nt, Homo sapiens
cuccgcaacagcc

SEQ ID NO: 1454833 - RNA, 16 nt, Homo sapiens
cuccgcaacagccaag

SEQ ID NO: 1454834 - RNA, 22 nt, Homo sapiens
cuccuaggggaacagaccagug

SEQ ID NO: 1454835 - RNA, 16 nt, Homo sapiens
cuccucaggcacacag

SEQ ID NO: 1454836 - RNA, 21 nt, Homo sapiens
cuccucaggcacacagcuacu

SEQ ID NO: 1454837 - RNA, 16 nt, Homo sapiens
cuccucgcugccagau

SEQ ID NO: 1454838 - RNA, 14 nt, Homo sapiens
cuccucggagagca

SEQ ID NO: 1454839 - RNA, 13 nt, Homo sapiens
cuccucggaggau

SEQ ID NO: 1454840 - RNA, 21 nt, Homo sapiens
cuccucuaguaagaugcacug

SEQ ID NO: 1454841 - RNA, 19 nt, Homo sapiens
cuccucucuagaaccuccu

SEQ ID NO: 1454842 - RNA, 19 nt, Homo sapiens
cuccugaccucaggugauu

SEQ ID NO: 1454843 - RNA, 14 nt, Homo sapiens
cuccugagccugug

SEQ ID NO: 1454844 - RNA, 23 nt, Homo sapiens
cuccugaggcuuuggauuugaca

SEQ ID NO: 1454845 - RNA, 16 nt, Homo sapiens
cuccugauagucuuuc

SEQ ID NO: 1454846 - RNA, 12 nt, Homo sapiens
cuccugccugag

SEQ ID NO: 1454847 - RNA, 16 nt, Homo sapiens
cuccuggggucacuca

SEQ ID NO: 1454848 - RNA, 21 nt, Homo sapiens
cuccugucuuaugguccagaa

SEQ ID NO: 1454849 - RNA, 20 nt, Homo sapiens
cuccugugcuagaugugcaa

SEQ ID NO: 1454850 - RNA, 19 nt, Homo sapiens
cuccuuaagaacacaaagc

SEQ ID NO: 1454851 - RNA, 19 nt, Homo sapiens
cuccuuagcaggcuaugaa

SEQ ID NO: 1454852 - RNA, 23 nt, Homo sapiens
cuccuuauagacacuugcuccca

SEQ ID NO: 1454853 - RNA, 13 nt, Homo sapiens
cuccuuccagugu

SEQ ID NO: 1454854 - RNA, 21 nt, Homo sapiens
cuccuucccaccccuacacac

SEQ ID NO: 1454855 - RNA, 15 nt, Homo sapiens
cuccuucccauuucu

SEQ ID NO: 1454856 - RNA, 20 nt, Homo sapiens
cuccuugaauaucuuucgau

SEQ ID NO: 1454857 - RNA, 21 nt, Homo sapiens
cuccuugcccagacuacaggg

SEQ ID NO: 1454858 - RNA, 15 nt, Homo sapiens
cucgaaacacagaaa

SEQ ID NO: 1454859 - RNA, 17 nt, Homo sapiens
cucgaugcagacagggg

SEQ ID NO: 1454860 - RNA, 22 nt, Homo sapiens
cucgcaaacguuucuugaacaa

SEQ ID NO: 1454861 - RNA, 20 nt, Homo sapiens
cucggacagcccaucugccu

SEQ ID NO: 1454862 - RNA, 21 nt, Homo sapiens
cucgggaaacuuagaucauca

SEQ ID NO: 1454863 - RNA, 15 nt, Homo sapiens
cucgugagucauuua

SEQ ID NO: 1454864 - RNA, 14 nt, Homo sapiens
cucuaaacugcaaa

SEQ ID NO: 1454865 - RNA, 22 nt, Homo sapiens
cucuaagccacucuuccaaagg

SEQ ID NO: 1454866 - RNA, 17 nt, Homo sapiens
cucuaagcucagugcuc

SEQ ID NO: 1454867 - RNA, 23 nt, Homo sapiens
cucuaagcucagugcucucucca

SEQ ID NO: 1454868 - RNA, 17 nt, Homo sapiens
cucuaaggcaguagaau

SEQ ID NO: 1454869 - RNA, 19 nt, Homo sapiens
cucuacaucuucugccuua

SEQ ID NO: 1454870 - RNA, 16 nt, Homo sapiens
cucuacccugcucccu

SEQ ID NO: 1454871 - RNA, 15 nt, Homo sapiens
cucuacgugcuccuc

SEQ ID NO: 1454872 - RNA, 20 nt, Homo sapiens
cucuacuaaaaauacaaaaa

SEQ ID NO: 1454873 - RNA, 18 nt, Homo sapiens
cucuacuguuuaacaaca

SEQ ID NO: 1454874 - RNA, 14 nt, Homo sapiens
cucuagaagccaag

SEQ ID NO: 1454875 - RNA, 22 nt, Homo sapiens
cucuagccugggccacagggcg

SEQ ID NO: 1454876 - RNA, 14 nt, Homo sapiens
cucuagugggacag

SEQ ID NO: 1454877 - RNA, 17 nt, Homo sapiens
cucuauucucugcaauu

SEQ ID NO: 1454878 - RNA, 17 nt, Homo sapiens
cucuauugauacucuuu

SEQ ID NO: 1454879 - RNA, 21 nt, Homo sapiens
cucuauuuguaauugaacuua

SEQ ID NO: 1454880 - RNA, 22 nt, Homo sapiens
cucuauuuugugaugaugcugu

SEQ ID NO: 1454881 - RNA, 23 nt, Homo sapiens
cucucaccccaacuaguagcuaa

SEQ ID NO: 1454882 - RNA, 17 nt, Homo sapiens
cucucagcaggcaaaga

SEQ ID NO: 1454883 - RNA, 14 nt, Homo sapiens
cucucagcugacca

SEQ ID NO: 1454884 - RNA, 17 nt, Homo sapiens
cucuccaauacucaggu

SEQ ID NO: 1454885 - RNA, 18 nt, Homo sapiens
cucuccaucuuccacgaa

SEQ ID NO: 1454886 - RNA, 13 nt, Homo sapiens
cucucccagugaa

SEQ ID NO: 1454887 - RNA, 18 nt, Homo sapiens
cucuccccagcccagaga

SEQ ID NO: 1454888 - RNA, 16 nt, Homo sapiens
cucuccugacuuuuaa

SEQ ID NO: 1454889 - RNA, 15 nt, Homo sapiens
cucucgacaguaucc

SEQ ID NO: 1454890 - RNA, 16 nt, Homo sapiens
cucucgacaguaucca

SEQ ID NO: 1454891 - RNA, 18 nt, Homo sapiens
cucucgacaguauccaca

SEQ ID NO: 1454892 - RNA, 19 nt, Homo sapiens
cucugaaaucucagaauuc

SEQ ID NO: 1454893 - RNA, 14 nt, Homo sapiens
cucugaccagagau

SEQ ID NO: 1454894 - RNA, 17 nt, Homo sapiens
cucugaccugcacuggg

SEQ ID NO: 1454895 - RNA, 12 nt, Homo sapiens
cucugauaccuc

SEQ ID NO: 1454896 - RNA, 16 nt, Homo sapiens
cucugcacuacugaca

SEQ ID NO: 1454897 - RNA, 17 nt, Homo sapiens
cucugcacuacugacau

SEQ ID NO: 1454898 - RNA, 19 nt, Homo sapiens
cucugcaucuccugucuuu

SEQ ID NO: 1454899 - RNA, 20 nt, Homo sapiens
cucugcauuaucugagguca

SEQ ID NO: 1454900 - RNA, 15 nt, Homo sapiens
cucugcuacuccauc

SEQ ID NO: 1454901 - RNA, 16 nt, Homo sapiens
cucugcuucaguccac

SEQ ID NO: 1454902 - RNA, 17 nt, Homo sapiens
cucuggaccauauacca

SEQ ID NO: 1454903 - RNA, 15 nt, Homo sapiens
cucuggcacccaucu

SEQ ID NO: 1454904 - RNA, 22 nt, Homo sapiens
cucuggggucuuuuuaugcauu

SEQ ID NO: 1454905 - RNA, 15 nt, Homo sapiens
cucuggggugcugcc

SEQ ID NO: 1454906 - RNA, 16 nt, Homo sapiens
cucuggguugugcaca

SEQ ID NO: 1454907 - RNA, 15 nt, Homo sapiens
cucugguaauauuga

SEQ ID NO: 1454908 - RNA, 13 nt, Homo sapiens
cucugguggcaca

SEQ ID NO: 1454909 - RNA, 17 nt, Homo sapiens
cucugguuagaaaaagg

SEQ ID NO: 1454910 - RNA, 13 nt, Homo sapiens
cucuguauguacu

SEQ ID NO: 1454911 - RNA, 12 nt, Homo sapiens
cucugucaguca

SEQ ID NO: 1454912 - RNA, 21 nt, Homo sapiens
cucugugaacgauuuagaaag

SEQ ID NO: 1454913 - RNA, 19 nt, Homo sapiens
cucuguuucccuuucacug

SEQ ID NO: 1454914 - RNA, 16 nt, Homo sapiens
cucuuagacccacaga

SEQ ID NO: 1454915 - RNA, 14 nt, Homo sapiens
cucuuagugauuga

SEQ ID NO: 1454916 - RNA, 12 nt, Homo sapiens
cucuuaucucag

SEQ ID NO: 1454917 - RNA, 19 nt, Homo sapiens
cucuucagaaaacccuuuu

SEQ ID NO: 1454918 - RNA, 22 nt, Homo sapiens
cucuucccuuuccccagcauca

SEQ ID NO: 1454919 - RNA, 16 nt, Homo sapiens
cucuuccugcaaggac

SEQ ID NO: 1454920 - RNA, 16 nt, Homo sapiens
cucuucggaugaggcc

SEQ ID NO: 1454921 - RNA, 22 nt, Homo sapiens
cucuucuucauucuaucaagcc

SEQ ID NO: 1454922 - RNA, 21 nt, Homo sapiens
cucuugaaguacuuaacauac

SEQ ID NO: 1454923 - RNA, 17 nt, Homo sapiens
cucuugcccauccugac

SEQ ID NO: 1454924 - RNA, 12 nt, Homo sapiens
cucuugcucaaa

SEQ ID NO: 1454925 - RNA, 14 nt, Homo sapiens
cucuugcucaguga

SEQ ID NO: 1454926 - RNA, 12 nt, Homo sapiens
cucuugcugucu

SEQ ID NO: 1454927 - RNA, 21 nt, Homo sapiens
cucuugggaacugaacucacu

SEQ ID NO: 1454928 - RNA, 17 nt, Homo sapiens
cuuaauuccuuucucau

SEQ ID NO: 1454929 - RNA, 23 nt, Homo sapiens
cuuaauuuccuuuuugacacuga

SEQ ID NO: 1454930 - RNA, 17 nt, Homo sapiens
cuuaauuucuaaagaua

SEQ ID NO: 1454931 - RNA, 17 nt, Homo sapiens
cuuaauuuucaguauaa

SEQ ID NO: 1454932 - RNA, 13 nt, Homo sapiens
cuuacaacccagg

SEQ ID NO: 1454933 - RNA, 20 nt, Homo sapiens
cuuacaauuggcacuaaaga

SEQ ID NO: 1454934 - RNA, 18 nt, Homo sapiens
cuuacacuuuaugcacaa

SEQ ID NO: 1454935 - RNA, 20 nt, Homo sapiens
cuuacacuuuaugcacaaaa

SEQ ID NO: 1454936 - RNA, 16 nt, Homo sapiens
cuuacagaacuacuuc

SEQ ID NO: 1454937 - RNA, 12 nt, Homo sapiens
cuuacagaauua

SEQ ID NO: 1454938 - RNA, 13 nt, Homo sapiens
cuuaccauauguu

SEQ ID NO: 1454939 - RNA, 16 nt, Homo sapiens
cuuacuagaccuguaa

SEQ ID NO: 1454940 - RNA, 18 nt, Homo sapiens
cuuacucuugauuguggg

SEQ ID NO: 1454941 - RNA, 13 nt, Homo sapiens
cuuacuggugcua

SEQ ID NO: 1454942 - RNA, 14 nt, Homo sapiens
cuuacuguaacgga

SEQ ID NO: 1454943 - RNA, 15 nt, Homo sapiens
cuuacuucuuagcac

SEQ ID NO: 1454944 - RNA, 14 nt, Homo sapiens
cuuacuuugaguua

SEQ ID NO: 1454945 - RNA, 13 nt, Homo sapiens
cuuagaauccaaa

SEQ ID NO: 1454946 - RNA, 19 nt, Homo sapiens
cuuagaauuugggggaaaa

SEQ ID NO: 1454947 - RNA, 16 nt, Homo sapiens
cuuagacuucgacuca

SEQ ID NO: 1454948 - RNA, 15 nt, Homo sapiens
cuuagagaggacaau

SEQ ID NO: 1454949 - RNA, 19 nt, Homo sapiens
cuuagauguuccaguaauc

SEQ ID NO: 1454950 - RNA, 13 nt, Homo sapiens
cuuagcauguccc

SEQ ID NO: 1454951 - RNA, 11 nt, Homo sapiens
cuuagcugccu

SEQ ID NO: 1454952 - RNA, 13 nt, Homo sapiens
cuuaguaucucau

SEQ ID NO: 1454953 - RNA, 12 nt, Homo sapiens
cuuagugacaaa

SEQ ID NO: 1454954 - RNA, 16 nt, Homo sapiens
cuuagugacaaaauag

SEQ ID NO: 1454955 - RNA, 18 nt, Homo sapiens
cuuaguguauaaaaacca

SEQ ID NO: 1454956 - RNA, 18 nt, Homo sapiens
cuuaguuguucaguugcc

SEQ ID NO: 1454957 - RNA, 22 nt, Homo sapiens
cuuauauuuggcccaaacucau

SEQ ID NO: 1454958 - RNA, 22 nt, Homo sapiens
cuuaucugugcgugaaacacac

SEQ ID NO: 1454959 - RNA, 18 nt, Homo sapiens
cuuaugacuugcuacuuu

SEQ ID NO: 1454960 - RNA, 16 nt, Homo sapiens
cuuaugcaaucuaugu

SEQ ID NO: 1454961 - RNA, 16 nt, Homo sapiens
cuuaugccagcgugac

SEQ ID NO: 1454962 - RNA, 23 nt, Homo sapiens
cuuauggaauugauuugcauuga

SEQ ID NO: 1454963 - RNA, 12 nt, Homo sapiens
cuuauuccucua

SEQ ID NO: 1454964 - RNA, 16 nt, Homo sapiens
cuuauuuaacuuaaca

SEQ ID NO: 1454965 - RNA, 23 nt, Homo sapiens
cuuauuuaaugccgauauacucu

SEQ ID NO: 1454966 - RNA, 23 nt, Homo sapiens
cuucaaaagcuuuuuacucaaag

SEQ ID NO: 1454967 - RNA, 17 nt, Homo sapiens
cuucaaaccccuacuga

SEQ ID NO: 1454968 - RNA, 20 nt, Homo sapiens
cuucaaacugugaagcauuu

SEQ ID NO: 1454969 - RNA, 23 nt, Homo sapiens
cuucaaauugucuuuugucaugu

SEQ ID NO: 1454970 - RNA, 15 nt, Homo sapiens
cuucaacauccugcc

SEQ ID NO: 1454971 - RNA, 12 nt, Homo sapiens
cuucaacccagu

SEQ ID NO: 1454972 - RNA, 14 nt, Homo sapiens
cuucaaggcuucca

SEQ ID NO: 1454973 - RNA, 13 nt, Homo sapiens
cuucaauacuuaa

SEQ ID NO: 1454974 - RNA, 19 nt, Homo sapiens
cuucaaucucuugcacuca

SEQ ID NO: 1454975 - RNA, 22 nt, Homo sapiens
cuucaaugggcucuuccaacaa

SEQ ID NO: 1454976 - RNA, 14 nt, Homo sapiens
cuucacaguguuuc

SEQ ID NO: 1454977 - RNA, 17 nt, Homo sapiens
cuucacccuggagccca

SEQ ID NO: 1454978 - RNA, 19 nt, Homo sapiens
cuucaccuacauuaucuca

SEQ ID NO: 1454979 - RNA, 20 nt, Homo sapiens
cuucacuacuuuaauaaaga

SEQ ID NO: 1454980 - RNA, 11 nt, Homo sapiens
cuucacugaca

SEQ ID NO: 1454981 - RNA, 12 nt, Homo sapiens
cuucacugacag

SEQ ID NO: 1454982 - RNA, 18 nt, Homo sapiens
cuucacuucugacucuuc

SEQ ID NO: 1454983 - RNA, 13 nt, Homo sapiens
cuucacuugcacu

SEQ ID NO: 1454984 - RNA, 17 nt, Homo sapiens
cuucagaagacacugca

SEQ ID NO: 1454985 - RNA, 13 nt, Homo sapiens
cuucagaauuaga

SEQ ID NO: 1454986 - RNA, 17 nt, Homo sapiens
cuucagaggagaaagaa

SEQ ID NO: 1454987 - RNA, 21 nt, Homo sapiens
cuucagaggauaaauaucaau

SEQ ID NO: 1454988 - RNA, 24 nt, Homo sapiens
cuucagauggugaagcauucuccc

SEQ ID NO: 1454989 - RNA, 22 nt, Homo sapiens
cuucagcugggucacauccauc

SEQ ID NO: 1454990 - RNA, 23 nt, Homo sapiens
cuucaggaacuggggcuuugccu

SEQ ID NO: 1454991 - RNA, 14 nt, Homo sapiens
cuucagggccaguc

SEQ ID NO: 1454992 - RNA, 18 nt, Homo sapiens
cuucagggccuugcugcu

SEQ ID NO: 1454993 - RNA, 11 nt, Homo sapiens
cuucagggugg

SEQ ID NO: 1454994 - RNA, 13 nt, Homo sapiens
cuucagguggaug

SEQ ID NO: 1454995 - RNA, 22 nt, Homo sapiens
cuucaguauuuuuaaauuguaa

SEQ ID NO: 1454996 - RNA, 22 nt, Homo sapiens
cuucaucgaaucuacuaauucc

SEQ ID NO: 1454997 - RNA, 19 nt, Homo sapiens
cuucaucuucacugcaauu

SEQ ID NO: 1454998 - RNA, 18 nt, Homo sapiens
cuucauggaacucagcug

SEQ ID NO: 1454999 - RNA, 17 nt, Homo sapiens
cuucauuuccaccaggc

SEQ ID NO: 1455000 - RNA, 11 nt, Homo sapiens
cuuccaaggau

SEQ ID NO: 1455001 - RNA, 17 nt, Homo sapiens
cuuccaaucuugcuuug

SEQ ID NO: 1455002 - RNA, 20 nt, Homo sapiens
cuuccacaacugcugcaugu

SEQ ID NO: 1455003 - RNA, 18 nt, Homo sapiens
cuuccagagaagccaugg

SEQ ID NO: 1455004 - RNA, 13 nt, Homo sapiens
cuuccagcaauaa

SEQ ID NO: 1455005 - RNA, 23 nt, Homo sapiens
cuuccagguguuacuguaauucc

SEQ ID NO: 1455006 - RNA, 18 nt, Homo sapiens
cuuccagugucugucauu

SEQ ID NO: 1455007 - RNA, 22 nt, Homo sapiens
cuuccauaauuaugacaguuau

SEQ ID NO: 1455008 - RNA, 19 nt, Homo sapiens
cuuccauccaucuuuccau

SEQ ID NO: 1455009 - RNA, 11 nt, Homo sapiens
cuuccauuugc

SEQ ID NO: 1455010 - RNA, 12 nt, Homo sapiens
cuuccauuugcu

SEQ ID NO: 1455011 - RNA, 22 nt, Homo sapiens
cuuccauuuucccccacuacug

SEQ ID NO: 1455012 - RNA, 17 nt, Homo sapiens
cuucccagagggagcag

SEQ ID NO: 1455013 - RNA, 21 nt, Homo sapiens
cuucccaugucuuucuccaaa

SEQ ID NO: 1455014 - RNA, 20 nt, Homo sapiens
cuucccggcgucccuaccuc

SEQ ID NO: 1455015 - RNA, 17 nt, Homo sapiens
cuucccuaaucuuccac

SEQ ID NO: 1455016 - RNA, 21 nt, Homo sapiens
cuucccucucugaugucccag

SEQ ID NO: 1455017 - RNA, 13 nt, Homo sapiens
cuucccugcauuu

SEQ ID NO: 1455018 - RNA, 19 nt, Homo sapiens
cuucccuuuauuacaagaa

SEQ ID NO: 1455019 - RNA, 22 nt, Homo sapiens
cuuccuaaugucagaacagagu

SEQ ID NO: 1455020 - RNA, 23 nt, Homo sapiens
cuuccuacacguuagauuugccg

SEQ ID NO: 1455021 - RNA, 13 nt, Homo sapiens
cuuccuacuguag

SEQ ID NO: 1455022 - RNA, 14 nt, Homo sapiens
cuuccuaggucaug

SEQ ID NO: 1455023 - RNA, 16 nt, Homo sapiens
cuuccuauaauuuuag

SEQ ID NO: 1455024 - RNA, 13 nt, Homo sapiens
cuuccuccagcug

SEQ ID NO: 1455025 - RNA, 18 nt, Homo sapiens
cuuccuccucgcugccag

SEQ ID NO: 1455026 - RNA, 23 nt, Homo sapiens
cuuccucgguagcagaggcccug

SEQ ID NO: 1455027 - RNA, 15 nt, Homo sapiens
cuuccucuccacugc

SEQ ID NO: 1455028 - RNA, 17 nt, Homo sapiens
cuuccugaguggugcca

SEQ ID NO: 1455029 - RNA, 15 nt, Homo sapiens
cuuccuguccagcuc

SEQ ID NO: 1455030 - RNA, 20 nt, Homo sapiens
cuuccuuaaagcauuugcaa

SEQ ID NO: 1455031 - RNA, 15 nt, Homo sapiens
gcaucaguugcuaua

SEQ ID NO: 1455032 - RNA, 15 nt, Homo sapiens
gcaucaucaaaaacu

SEQ ID NO: 1455033 - RNA, 20 nt, Homo sapiens
gcauccccccugcucagcaa

SEQ ID NO: 1455034 - RNA, 19 nt, Homo sapiens
gcaucccugagacagggag

SEQ ID NO: 1455035 - RNA, 15 nt, Homo sapiens
gcaucuacacaauuu

SEQ ID NO: 1455036 - RNA, 20 nt, Homo sapiens
gcaucuacacagccuggacu

SEQ ID NO: 1455037 - RNA, 15 nt, Homo sapiens
gcaucucagugcagg

SEQ ID NO: 1455038 - RNA, 23 nt, Homo sapiens
gcaucugggauucccaccaaggu

SEQ ID NO: 1455039 - RNA, 14 nt, Homo sapiens
gcaugaccugugac

SEQ ID NO: 1455040 - RNA, 22 nt, Homo sapiens
gcaugaucuuucugcaggaaau

SEQ ID NO: 1455041 - RNA, 11 nt, Homo sapiens
gcaugcacauc

SEQ ID NO: 1455042 - RNA, 21 nt, Homo sapiens
gcaugcauuuugcagcaguga

SEQ ID NO: 1455043 - RNA, 14 nt, Homo sapiens
gcaugccacccuca

SEQ ID NO: 1455044 - RNA, 15 nt, Homo sapiens
gcauggaagcuguga

SEQ ID NO: 1455045 - RNA, 13 nt, Homo sapiens
gcauguagacugu

SEQ ID NO: 1455046 - RNA, 22 nt, Homo sapiens
gcauguccuuugcgccugugac

SEQ ID NO: 1455047 - RNA, 18 nt, Homo sapiens
gcaugucucaauaguaaa

SEQ ID NO: 1455048 - RNA, 16 nt, Homo sapiens
gcauguguauuuccag

SEQ ID NO: 1455049 - RNA, 13 nt, Homo sapiens
gcauuaaauucac

SEQ ID NO: 1455050 - RNA, 23 nt, Homo sapiens
gcauuaggaguguuucauuugau

SEQ ID NO: 1455051 - RNA, 17 nt, Homo sapiens
gcauucgggccacaggg

SEQ ID NO: 1455052 - RNA, 14 nt, Homo sapiens
gcauugcauggaca

SEQ ID NO: 1455053 - RNA, 17 nt, Homo sapiens
gcauugcuucagaauga

SEQ ID NO: 1455054 - RNA, 12 nt, Homo sapiens
gcauuuacuuuu

SEQ ID NO: 1455055 - RNA, 16 nt, Homo sapiens
gcauuuagaaaucaag

SEQ ID NO: 1455056 - RNA, 18 nt, Homo sapiens
gcauuuagaaaucaagca

SEQ ID NO: 1455057 - RNA, 13 nt, Homo sapiens
gcauuuagcuucu

SEQ ID NO: 1455058 - RNA, 19 nt, Homo sapiens
gcauuucuuuucuggccaa

SEQ ID NO: 1455059 - RNA, 21 nt, Homo sapiens
gcauuugucaaugacaguuuc

SEQ ID NO: 1455060 - RNA, 13 nt, Homo sapiens
gcauuuguucacu

SEQ ID NO: 1455061 - RNA, 12 nt, Homo sapiens
gcauuuuccucc

SEQ ID NO: 1455062 - RNA, 17 nt, Homo sapiens
gcauuuugucaguuuua

SEQ ID NO: 1455063 - RNA, 15 nt, Homo sapiens
gcauuuuuaaauaca

SEQ ID NO: 1455064 - RNA, 24 nt, Homo sapiens
gccaaaaacaaaaaauagcuuuca

SEQ ID NO: 1455065 - RNA, 20 nt, Homo sapiens
gccaaaagucccucccugcc

SEQ ID NO: 1455066 - RNA, 17 nt, Homo sapiens
gccaaacccaugaggca

SEQ ID NO: 1455067 - RNA, 18 nt, Homo sapiens
gccaaacccuugucagug

SEQ ID NO: 1455068 - RNA, 14 nt, Homo sapiens
gccaaauuuuggcc

SEQ ID NO: 1455069 - RNA, 21 nt, Homo sapiens
gccaacauggugagacccugu

SEQ ID NO: 1455070 - RNA, 17 nt, Homo sapiens
gccaaccggucacccag

SEQ ID NO: 1455071 - RNA, 17 nt, Homo sapiens
gccaacucacugaacua

SEQ ID NO: 1455072 - RNA, 13 nt, Homo sapiens
gccaacuccucac

SEQ ID NO: 1455073 - RNA, 12 nt, Homo sapiens
gccaacuuuguu

SEQ ID NO: 1455074 - RNA, 19 nt, Homo sapiens
gccaagaaacgucuucuaa

SEQ ID NO: 1455075 - RNA, 20 nt, Homo sapiens
gccaagaucgcgccacugca

SEQ ID NO: 1455076 - RNA, 21 nt, Homo sapiens
gccaagauuuuccucuuguga

SEQ ID NO: 1455077 - RNA, 22 nt, Homo sapiens
gccaagcuuguuaucagcuuuc

SEQ ID NO: 1455078 - RNA, 18 nt, Homo sapiens
gccaaggcuaauccaauu

SEQ ID NO: 1455079 - RNA, 18 nt, Homo sapiens
gccaagggcugagugucc

SEQ ID NO: 1455080 - RNA, 13 nt, Homo sapiens
gccaagguaggca

SEQ ID NO: 1455081 - RNA, 21 nt, Homo sapiens
gccaauaaaaaguucagaguu

SEQ ID NO: 1455082 - RNA, 18 nt, Homo sapiens
gccaaucuucaguauuuu

SEQ ID NO: 1455083 - RNA, 15 nt, Homo sapiens
gccaaucuuguuuua

SEQ ID NO: 1455084 - RNA, 16 nt, Homo sapiens
gccacaagucuuccag

SEQ ID NO: 1455085 - RNA, 13 nt, Homo sapiens
gccacacuaccca

SEQ ID NO: 1455086 - RNA, 22 nt, Homo sapiens
gccacagcugcuguucucagga

SEQ ID NO: 1455087 - RNA, 11 nt, Homo sapiens
gccacauuucu

SEQ ID NO: 1455088 - RNA, 18 nt, Homo sapiens
gccacauuuggaauacuu

SEQ ID NO: 1455089 - RNA, 17 nt, Homo sapiens
gccaccagaugugacag

SEQ ID NO: 1455090 - RNA, 23 nt, Homo sapiens
gccaccagcgaaugcuaggucuc

SEQ ID NO: 1455091 - RNA, 22 nt, Homo sapiens
gccacccucacacacacagcug

SEQ ID NO: 1455092 - RNA, 19 nt, Homo sapiens
gccaccuggcaaaggaccc

SEQ ID NO: 1455093 - RNA, 21 nt, Homo sapiens
gccacuccuggggucacucag

SEQ ID NO: 1455094 - RNA, 16 nt, Homo sapiens
gccagaugauuguuca

SEQ ID NO: 1455095 - RNA, 18 nt, Homo sapiens
gccagaugauuguucaaa

SEQ ID NO: 1455096 - RNA, 15 nt, Homo sapiens
gccagaugcaggaca

SEQ ID NO: 1455097 - RNA, 20 nt, Homo sapiens
gccagaugugaaaacaucuc

SEQ ID NO: 1455098 - RNA, 18 nt, Homo sapiens
gccagcaaugacaucuca

SEQ ID NO: 1455099 - RNA, 16 nt, Homo sapiens
gccagcagggcaucuu

SEQ ID NO: 1455100 - RNA, 20 nt, Homo sapiens
gccagcagggcaucuuggaa

SEQ ID NO: 1455101 - RNA, 17 nt, Homo sapiens
gccagcauauacugaag

SEQ ID NO: 1455102 - RNA, 17 nt, Homo sapiens
gccagccagugccauuc

SEQ ID NO: 1455103 - RNA, 15 nt, Homo sapiens
gccagccgggagcuu

SEQ ID NO: 1455104 - RNA, 13 nt, Homo sapiens
gccagcgggcaca

SEQ ID NO: 1455105 - RNA, 21 nt, Homo sapiens
gccagcucaccccaucauccc

SEQ ID NO: 1455106 - RNA, 22 nt, Homo sapiens
gccagcugcugcuggaucacag

SEQ ID NO: 1455107 - RNA, 17 nt, Homo sapiens
gccaggaaguacuucca

SEQ ID NO: 1455108 - RNA, 12 nt, Homo sapiens
gccaggacacca

SEQ ID NO: 1455109 - RNA, 14 nt, Homo sapiens
gccaggacaucucu

SEQ ID NO: 1455110 - RNA, 15 nt, Homo sapiens
gccaggagcugucac

SEQ ID NO: 1455111 - RNA, 18 nt, Homo sapiens
gccaggcaugguggcuca

SEQ ID NO: 1455112 - RNA, 15 nt, Homo sapiens
gccaggccaccagga

SEQ ID NO: 1455113 - RNA, 21 nt, Homo sapiens
gccaggguggucuugaucucc

SEQ ID NO: 1455114 - RNA, 11 nt, Homo sapiens
gccaguauuuu

SEQ ID NO: 1455115 - RNA, 15 nt, Homo sapiens
gccaguccugcuacc

SEQ ID NO: 1455116 - RNA, 12 nt, Homo sapiens
gccagugacaga

SEQ ID NO: 1455117 - RNA, 15 nt, Homo sapiens
gccagugccauucca

SEQ ID NO: 1455118 - RNA, 21 nt, Homo sapiens
gccagugccauuccacuccac

SEQ ID NO: 1455119 - RNA, 14 nt, Homo sapiens
gccagugccucuca

SEQ ID NO: 1455120 - RNA, 23 nt, Homo sapiens
gccagugcuuuaauggcauguca

SEQ ID NO: 1455121 - RNA, 18 nt, Homo sapiens
gccauacugccuuugcag

SEQ ID NO: 1455122 - RNA, 14 nt, Homo sapiens
gccauacuuuacaa

SEQ ID NO: 1455123 - RNA, 18 nt, Homo sapiens
gccaucaccauaaccucu

SEQ ID NO: 1455124 - RNA, 18 nt, Homo sapiens
gccaucacuagaagaaaa

SEQ ID NO: 1455125 - RNA, 17 nt, Homo sapiens
gccaucaugccugacua

SEQ ID NO: 1455126 - RNA, 20 nt, Homo sapiens
gccaugcucaggagccacca

SEQ ID NO: 1455127 - RNA, 22 nt, Homo sapiens
gccauggcagacaguagacaga

SEQ ID NO: 1455128 - RNA, 14 nt, Homo sapiens
gccauguccaaaga

SEQ ID NO: 1455129 - RNA, 15 nt, Homo sapiens
gccauguccaaagag

SEQ ID NO: 1455130 - RNA, 14 nt, Homo sapiens
gcccaagaauagau

SEQ ID NO: 1455131 - RNA, 13 nt, Homo sapiens
gcccacacccagg

SEQ ID NO: 1455132 - RNA, 16 nt, Homo sapiens
gcccacccugggagac

SEQ ID NO: 1455133 - RNA, 17 nt, Homo sapiens
gcccacugcuggugcca

SEQ ID NO: 1455134 - RNA, 19 nt, Homo sapiens
gcugcuuuaggaauucugc

SEQ ID NO: 1455135 - RNA, 14 nt, Homo sapiens
gcuggaaaugcuga

SEQ ID NO: 1455136 - RNA, 12 nt, Homo sapiens
gcuggaacccga

SEQ ID NO: 1455137 - RNA, 15 nt, Homo sapiens
gcuggaagcaaagua

SEQ ID NO: 1455138 - RNA, 12 nt, Homo sapiens
gcuggaagcaca

SEQ ID NO: 1455139 - RNA, 19 nt, Homo sapiens
gcuggaauucuaacaaguc

SEQ ID NO: 1455140 - RNA, 15 nt, Homo sapiens
gcuggacaugcugac

SEQ ID NO: 1455141 - RNA, 13 nt, Homo sapiens
gcuggagugcagu

SEQ ID NO: 1455142 - RNA, 20 nt, Homo sapiens
gcuggagugcaguggcauga

SEQ ID NO: 1455143 - RNA, 18 nt, Homo sapiens
gcuggagugcaguggugu

SEQ ID NO: 1455144 - RNA, 17 nt, Homo sapiens
gcuggauaaaaugaggu

SEQ ID NO: 1455145 - RNA, 12 nt, Homo sapiens
gcuggaucugcu

SEQ ID NO: 1455146 - RNA, 19 nt, Homo sapiens
gcuggcaugcagugcccuc

SEQ ID NO: 1455147 - RNA, 18 nt, Homo sapiens
gcuggccuccuaugccuc

SEQ ID NO: 1455148 - RNA, 18 nt, Homo sapiens
gcuggccucuggcucuca

SEQ ID NO: 1455149 - RNA, 17 nt, Homo sapiens
gcuggcucacaguacag

SEQ ID NO: 1455150 - RNA, 16 nt, Homo sapiens
gcugggacguggcuca

SEQ ID NO: 1455151 - RNA, 19 nt, Homo sapiens
gcugggaguucuagaacca

SEQ ID NO: 1455152 - RNA, 22 nt, Homo sapiens
gcugggauuacaggugugggcc

SEQ ID NO: 1455153 - RNA, 19 nt, Homo sapiens
gcugggccauguccaaaga

SEQ ID NO: 1455154 - RNA, 22 nt, Homo sapiens
gcugggcgugcuagagguugca

SEQ ID NO: 1455155 - RNA, 15 nt, Homo sapiens
gcugggggacugggg

SEQ ID NO: 1455156 - RNA, 15 nt, Homo sapiens
gcugggucacaucca

SEQ ID NO: 1455157 - RNA, 23 nt, Homo sapiens
gcugggucaggcagggugcagua

SEQ ID NO: 1455158 - RNA, 13 nt, Homo sapiens
gcuggucagggug

SEQ ID NO: 1455159 - RNA, 22 nt, Homo sapiens
gcuggucccggggccagcacuu

SEQ ID NO: 1455160 - RNA, 23 nt, Homo sapiens
gcuggucccggggccagcacuuc

SEQ ID NO: 1455161 - RNA, 19 nt, Homo sapiens
gcuggucucugcugaaggu

SEQ ID NO: 1455162 - RNA, 13 nt, Homo sapiens
gcuguagaugaca

SEQ ID NO: 1455163 - RNA, 14 nt, Homo sapiens
gcuguagaugacaa

SEQ ID NO: 1455164 - RNA, 16 nt, Homo sapiens
gcuguauguaaacugu

SEQ ID NO: 1455165 - RNA, 19 nt, Homo sapiens
gcugucacucugugccuuu

SEQ ID NO: 1455166 - RNA, 16 nt, Homo sapiens
gcugucaucugugcac

SEQ ID NO: 1455167 - RNA, 18 nt, Homo sapiens
gcuguccucccaccucag

SEQ ID NO: 1455168 - RNA, 19 nt, Homo sapiens
gcugucguuguuguggaag

SEQ ID NO: 1455169 - RNA, 16 nt, Homo sapiens
gcugucuggggccuuu

SEQ ID NO: 1455170 - RNA, 18 nt, Homo sapiens
gcugucuggggccuuuau

SEQ ID NO: 1455171 - RNA, 14 nt, Homo sapiens
gcuguggagcaaaa

SEQ ID NO: 1455172 - RNA, 19 nt, Homo sapiens
gcuguggaggauugcuauc

SEQ ID NO: 1455173 - RNA, 23 nt, Homo sapiens
gcugugggaaguccucccuggug

SEQ ID NO: 1455174 - RNA, 13 nt, Homo sapiens
gcuguguuugcag

SEQ ID NO: 1455175 - RNA, 17 nt, Homo sapiens
gcuguuauuucuucccu

SEQ ID NO: 1455176 - RNA, 14 nt, Homo sapiens
gcuguugcauuuag

SEQ ID NO: 1455177 - RNA, 22 nt, Homo sapiens
gcuguuuccagugguaugaccu

SEQ ID NO: 1455178 - RNA, 15 nt, Homo sapiens
gcuguuugacaccuc

SEQ ID NO: 1455179 - RNA, 15 nt, Homo sapiens
gcuguuuguagugaa

SEQ ID NO: 1455180 - RNA, 14 nt, Homo sapiens
gcuguuuguuucau

SEQ ID NO: 1455181 - RNA, 22 nt, Homo sapiens
gcuuaaauuucuuaugugacau

SEQ ID NO: 1455182 - RNA, 19 nt, Homo sapiens
gcuuaacacuugaccuaaa

SEQ ID NO: 1455183 - RNA, 20 nt, Homo sapiens
gcuuaaccuuuccaguuuau

SEQ ID NO: 1455184 - RNA, 18 nt, Homo sapiens
gcuuaucuuagaagcacu

SEQ ID NO: 1455185 - RNA, 13 nt, Homo sapiens
gcuucaagugccu

SEQ ID NO: 1455186 - RNA, 14 nt, Homo sapiens
gcuucacuguauaa

SEQ ID NO: 1455187 - RNA, 15 nt, Homo sapiens
gcuucaguugcauau

SEQ ID NO: 1455188 - RNA, 21 nt, Homo sapiens
gcuucauaaaugaagcagcuu

SEQ ID NO: 1455189 - RNA, 16 nt, Homo sapiens
gcuucccaacuucaua

SEQ ID NO: 1455190 - RNA, 14 nt, Homo sapiens
gcuucccagaggga

SEQ ID NO: 1455191 - RNA, 17 nt, Homo sapiens
gcuuccgccgucucaac

SEQ ID NO: 1455192 - RNA, 23 nt, Homo sapiens
gcuuccuccccucggaaggugcg

SEQ ID NO: 1455193 - RNA, 16 nt, Homo sapiens
gcuuccuucugugaaa

SEQ ID NO: 1455194 - RNA, 23 nt, Homo sapiens
gcuucuaaauggugcugcagauu

SEQ ID NO: 1455195 - RNA, 13 nt, Homo sapiens
gcuucucagccac

SEQ ID NO: 1455196 - RNA, 15 nt, Homo sapiens
gcuucuccaugagac

SEQ ID NO: 1455197 - RNA, 21 nt, Homo sapiens
gcuucuggggguagaucucaa

SEQ ID NO: 1455198 - RNA, 15 nt, Homo sapiens
gcuucuucacaggca

SEQ ID NO: 1455199 - RNA, 17 nt, Homo sapiens
gcuucuucacaggcacu

SEQ ID NO: 1455200 - RNA, 20 nt, Homo sapiens
gcuucuucugaaagaauuau

SEQ ID NO: 1455201 - RNA, 13 nt, Homo sapiens
gcuucuuuaccaa

SEQ ID NO: 1455202 - RNA, 15 nt, Homo sapiens
gcuucuuucccuuag

SEQ ID NO: 1455203 - RNA, 21 nt, Homo sapiens
gcuugacaacaaccuaugcac

SEQ ID NO: 1455204 - RNA, 15 nt, Homo sapiens
gcuugagcccaggag

SEQ ID NO: 1455205 - RNA, 10 nt, Homo sapiens
gcuugcucuu

SEQ ID NO: 1455206 - RNA, 19 nt, Homo sapiens
gcuugcugguagcacuugc

SEQ ID NO: 1455207 - RNA, 17 nt, Homo sapiens
gcuuggggaacccauga

SEQ ID NO: 1455208 - RNA, 18 nt, Homo sapiens
gcuugucaaaagaaauaa

SEQ ID NO: 1455209 - RNA, 13 nt, Homo sapiens
gcuugucaggggg

SEQ ID NO: 1455210 - RNA, 20 nt, Homo sapiens
gcuugucuuaaaauaaugaa

SEQ ID NO: 1455211 - RNA, 11 nt, Homo sapiens
gcuuguguuaa

SEQ ID NO: 1455212 - RNA, 22 nt, Homo sapiens
gcuuuaaacucagggacagagc

SEQ ID NO: 1455213 - RNA, 15 nt, Homo sapiens
gcuuuacugcaugaa

SEQ ID NO: 1455214 - RNA, 13 nt, Homo sapiens
gcuuuaugcacau

SEQ ID NO: 1455215 - RNA, 18 nt, Homo sapiens
gcuuucuucuuaaccuau

SEQ ID NO: 1455216 - RNA, 22 nt, Homo sapiens
gcuuugagagcaacgucacugg

SEQ ID NO: 1455217 - RNA, 15 nt, Homo sapiens
gcuuugcacaggaaa

SEQ ID NO: 1455218 - RNA, 15 nt, Homo sapiens
gcuuugcacuugacc

SEQ ID NO: 1455219 - RNA, 16 nt, Homo sapiens
gcuuugcccaccccuc

SEQ ID NO: 1455220 - RNA, 14 nt, Homo sapiens
gcuuugccuugcag

SEQ ID NO: 1455221 - RNA, 23 nt, Homo sapiens
gcuuuguauucaaaaauuaucua

SEQ ID NO: 1455222 - RNA, 17 nt, Homo sapiens
gcuuuguccugaaggaa

SEQ ID NO: 1455223 - RNA, 21 nt, Homo sapiens
gcuuuguguaucucauuuaau

SEQ ID NO: 1455224 - RNA, 15 nt, Homo sapiens
gcuuuucggcaaagc

SEQ ID NO: 1455225 - RNA, 15 nt, Homo sapiens
ggaaaaaaagcaaaa

SEQ ID NO: 1455226 - RNA, 19 nt, Homo sapiens
ggaaaaacaaaugccauau

SEQ ID NO: 1455227 - RNA, 19 nt, Homo sapiens
ggaaaaaccaauagcuuua

SEQ ID NO: 1455228 - RNA, 21 nt, Homo sapiens
ggaaaaaucuuggauuaugaa

SEQ ID NO: 1455229 - RNA, 14 nt, Homo sapiens
ggaaaacgugcuuu

SEQ ID NO: 1455230 - RNA, 22 nt, Homo sapiens
ggaaaacuguguugccacagua

SEQ ID NO: 1455231 - RNA, 17 nt, Homo sapiens
ggaaaagaaauugcaug

SEQ ID NO: 1455232 - RNA, 24 nt, Homo sapiens
ggaaaauaaacugacacuuauuaa

SEQ ID NO: 1455233 - RNA, 12 nt, Homo sapiens
ggaaaaugagua

SEQ ID NO: 1455234 - RNA, 19 nt, Homo sapiens
ggaaaaugccuccauggca

SEQ ID NO: 1455235 - RNA, 20 nt, Homo sapiens
ggaaaccucccuuuacagca

SEQ ID NO: 1455236 - RNA, 16 nt, Homo sapiens
ggaaacuauucaugaa

SEQ ID NO: 1455237 - RNA, 13 nt, Homo sapiens
ggcugaugaucca

SEQ ID NO: 1455238 - RNA, 19 nt, Homo sapiens
ggcugcagugagcugagau

SEQ ID NO: 1455239 - RNA, 17 nt, Homo sapiens
ggcugccccucucacca

SEQ ID NO: 1455240 - RNA, 11 nt, Homo sapiens
ggcugcucccc

SEQ ID NO: 1455241 - RNA, 20 nt, Homo sapiens
ggcugcuuggagcagccuaa

SEQ ID NO: 1455242 - RNA, 19 nt, Homo sapiens
ggcuggaguggaguggcgu

SEQ ID NO: 1455243 - RNA, 13 nt, Homo sapiens
ggcuggcacugac

SEQ ID NO: 1455244 - RNA, 14 nt, Homo sapiens
ggcuggccucccaa

SEQ ID NO: 1455245 - RNA, 21 nt, Homo sapiens
ggcugggaagacuauggugcu

SEQ ID NO: 1455246 - RNA, 13 nt, Homo sapiens
ggcugggccaugu

SEQ ID NO: 1455247 - RNA, 19 nt, Homo sapiens
ggcuguguuuccaucucaa

SEQ ID NO: 1455248 - RNA, 20 nt, Homo sapiens
ggcuuaacacuaucauggac

SEQ ID NO: 1455249 - RNA, 18 nt, Homo sapiens
ggcuucacuguauaaaua

SEQ ID NO: 1455250 - RNA, 19 nt, Homo sapiens
ggcuuccucuagaagccaa

SEQ ID NO: 1455251 - RNA, 23 nt, Homo sapiens
ggcuucucucucuagcagcaccu

SEQ ID NO: 1455252 - RNA, 16 nt, Homo sapiens
ggcuugaaaugcauua

SEQ ID NO: 1455253 - RNA, 14 nt, Homo sapiens
ggcuugaagccaaa

SEQ ID NO: 1455254 - RNA, 19 nt, Homo sapiens
ggcuuggccugcugugauu

SEQ ID NO: 1455255 - RNA, 18 nt, Homo sapiens
ggcuuggguucacagugc

SEQ ID NO: 1455256 - RNA, 16 nt, Homo sapiens
ggcuuuucccuugcuu

SEQ ID NO: 1455257 - RNA, 16 nt, Homo sapiens
ggcuuuucuagccuau

SEQ ID NO: 1455258 - RNA, 20 nt, Homo sapiens
ggcuuuuugccaucugugau

SEQ ID NO: 1455259 - RNA, 13 nt, Homo sapiens
gggaaaaccagac

SEQ ID NO: 1455260 - RNA, 13 nt, Homo sapiens
gggaaaaggagua

SEQ ID NO: 1455261 - RNA, 14 nt, Homo sapiens
gggaaacgggguga

SEQ ID NO: 1455262 - RNA, 19 nt, Homo sapiens
gggaaaguaaauauuucag

SEQ ID NO: 1455263 - RNA, 14 nt, Homo sapiens
gggaacagaccagu

SEQ ID NO: 1455264 - RNA, 20 nt, Homo sapiens
gggaacgaugugucuguauu

SEQ ID NO: 1455265 - RNA, 23 nt, Homo sapiens
gggaacuuuuuuagaaaugcaaa

SEQ ID NO: 1455266 - RNA, 17 nt, Homo sapiens
gggaagacuauggugcu

SEQ ID NO: 1455267 - RNA, 16 nt, Homo sapiens
gggaagcagccagcuc

SEQ ID NO: 1455268 - RNA, 19 nt, Homo sapiens
gggaagcggcccuaaggga

SEQ ID NO: 1455269 - RNA, 23 nt, Homo sapiens
gggaagcuggcuuucuggcugcu

SEQ ID NO: 1455270 - RNA, 20 nt, Homo sapiens
gggaaguccucccugguguc

SEQ ID NO: 1455271 - RNA, 16 nt, Homo sapiens
gggaaugagcccagag

SEQ ID NO: 1455272 - RNA, 17 nt, Homo sapiens
gggacaauaaauuuugc

SEQ ID NO: 1455273 - RNA, 14 nt, Homo sapiens
gggaccagggaugg

SEQ ID NO: 1455274 - RNA, 16 nt, Homo sapiens
gggacucagggccaug

SEQ ID NO: 1455275 - RNA, 16 nt, Homo sapiens
gggacugggagucaga

SEQ ID NO: 1455276 - RNA, 22 nt, Homo sapiens
gggacuguuccaaagccaguga

SEQ ID NO: 1455277 - RNA, 12 nt, Homo sapiens
gggagaaaaaga

SEQ ID NO: 1455278 - RNA, 21 nt, Homo sapiens
gggagaaaaagaaacacaaga

SEQ ID NO: 1455279 - RNA, 13 nt, Homo sapiens
gggagaacgggaa

SEQ ID NO: 1455280 - RNA, 13 nt, Homo sapiens
gggagaaggcagu

SEQ ID NO: 1455281 - RNA, 14 nt, Homo sapiens
gggagaaggcauga

SEQ ID NO: 1455282 - RNA, 21 nt, Homo sapiens
gggagauucaagggacccaug

SEQ ID NO: 1455283 - RNA, 21 nt, Homo sapiens
gggagcagaaacagccauugc

SEQ ID NO: 1455284 - RNA, 13 nt, Homo sapiens
gggagcagugucu

SEQ ID NO: 1455285 - RNA, 11 nt, Homo sapiens
gggagccagcc

SEQ ID NO: 1455286 - RNA, 22 nt, Homo sapiens
gggagcccacuguccugggccu

SEQ ID NO: 1455287 - RNA, 20 nt, Homo sapiens
gggagccgcuucuccaaguc

SEQ ID NO: 1455288 - RNA, 23 nt, Homo sapiens
gggaggauugcuugaacccaaga

SEQ ID NO: 1455289 - RNA, 16 nt, Homo sapiens
gggagucagagcccug

SEQ ID NO: 1455290 - RNA, 21 nt, Homo sapiens
gggagucagucuucacuugca

SEQ ID NO: 1455291 - RNA, 18 nt, Homo sapiens
gggauauggcugcccagg

SEQ ID NO: 1455292 - RNA, 23 nt, Homo sapiens
gggaucuuccuugggaugaucuu

SEQ ID NO: 1455293 - RNA, 13 nt, Homo sapiens
gggaucuugcaaa

SEQ ID NO: 1455294 - RNA, 19 nt, Homo sapiens
gggaugagccgcugugagc

SEQ ID NO: 1455295 - RNA, 20 nt, Homo sapiens
gggaugcugggcugggcccu

SEQ ID NO: 1455296 - RNA, 23 nt, Homo sapiens
gggauucacaaggugaagaacug

SEQ ID NO: 1455297 - RNA, 15 nt, Homo sapiens
gggauucaggcugcu

SEQ ID NO: 1455298 - RNA, 16 nt, Homo sapiens
gggauucugagcagug

SEQ ID NO: 1455299 - RNA, 23 nt, Homo sapiens
gggcaaaagacgggaagcaagau

SEQ ID NO: 1455300 - RNA, 13 nt, Homo sapiens
gggcaaagaagaa

SEQ ID NO: 1455301 - RNA, 17 nt, Homo sapiens
gggcacggucacacggc

SEQ ID NO: 1455302 - RNA, 17 nt, Homo sapiens
gggcagcauagcaagac

SEQ ID NO: 1455303 - RNA, 17 nt, Homo sapiens
gggcagcgccaggcuga

SEQ ID NO: 1455304 - RNA, 21 nt, Homo sapiens
gggcaggaggaggccaacuca

SEQ ID NO: 1455305 - RNA, 19 nt, Homo sapiens
gggcauccugugccacuaa

SEQ ID NO: 1455306 - RNA, 15 nt, Homo sapiens
gggccacacuaccca

SEQ ID NO: 1455307 - RNA, 18 nt, Homo sapiens
gggccacauggguccacu

SEQ ID NO: 1455308 - RNA, 12 nt, Homo sapiens
gggccagcacuu

SEQ ID NO: 1455309 - RNA, 13 nt, Homo sapiens
gggccaguccucc

SEQ ID NO: 1455310 - RNA, 11 nt, Homo sapiens
gggccagugaa

SEQ ID NO: 1455311 - RNA, 17 nt, Homo sapiens
gggccauguccaaagag

SEQ ID NO: 1455312 - RNA, 15 nt, Homo sapiens
gggcccccaucucau

SEQ ID NO: 1455313 - RNA, 22 nt, Homo sapiens
gggcccucuuucccugcgagac

SEQ ID NO: 1455314 - RNA, 15 nt, Homo sapiens
gggcccugcacagau

SEQ ID NO: 1455315 - RNA, 15 nt, Homo sapiens
gggccgaauccccuc

SEQ ID NO: 1455316 - RNA, 17 nt, Homo sapiens
gggccucaaggacuuga

SEQ ID NO: 1455317 - RNA, 20 nt, Homo sapiens
gggccucugccccucccaac

SEQ ID NO: 1455318 - RNA, 20 nt, Homo sapiens
gggccugagagaauuggcuc

SEQ ID NO: 1455319 - RNA, 16 nt, Homo sapiens
gggccugcuccagacc

SEQ ID NO: 1455320 - RNA, 22 nt, Homo sapiens
gggccuggcaggccagugucug

SEQ ID NO: 1455321 - RNA, 12 nt, Homo sapiens
gggccuugcuga

SEQ ID NO: 1455322 - RNA, 21 nt, Homo sapiens
gggcgccaccgccacccgcag

SEQ ID NO: 1455323 - RNA, 17 nt, Homo sapiens
gggcggcccacacccag

SEQ ID NO: 1455324 - RNA, 23 nt, Homo sapiens
gggcuagagaaaucagcugcuau

SEQ ID NO: 1455325 - RNA, 16 nt, Homo sapiens
gggcuagugacuugug

SEQ ID NO: 1455326 - RNA, 15 nt, Homo sapiens
gggcuccagccaucu

SEQ ID NO: 1455327 - RNA, 23 nt, Homo sapiens
gggcucccggagagggagucagu

SEQ ID NO: 1455328 - RNA, 16 nt, Homo sapiens
gggcucuacgucccag

SEQ ID NO: 1455329 - RNA, 18 nt, Homo sapiens
gggcucuucuuggcagag

SEQ ID NO: 1455330 - RNA, 16 nt, Homo sapiens
gggcuggcacugacug

SEQ ID NO: 1455331 - RNA, 20 nt, Homo sapiens
gggcugucaucugugcacug

SEQ ID NO: 1455332 - RNA, 16 nt, Homo sapiens
gggcuuaccaggugag

SEQ ID NO: 1455333 - RNA, 22 nt, Homo sapiens
gggcuuaccaggugagaaguga

SEQ ID NO: 1455334 - RNA, 13 nt, Homo sapiens
ggggaaaggcuug

SEQ ID NO: 1455335 - RNA, 20 nt, Homo sapiens
ggggaagcggcccuaaggga

SEQ ID NO: 1455336 - RNA, 17 nt, Homo sapiens
ggggacaagggauuuga

SEQ ID NO: 1455337 - RNA, 15 nt, Homo sapiens
ggggacugucuuuca

SEQ ID NO: 1455338 - RNA, 19 nt, Homo sapiens
ggggcacacuacagagcag

SEQ ID NO: 1455339 - RNA, 23 nt, Homo sapiens
ggggcaccuuaagauuuugcacc

SEQ ID NO: 1455340 - RNA, 19 nt, Homo sapiens
gucuaggucuccucagggu

SEQ ID NO: 1455341 - RNA, 12 nt, Homo sapiens
gucuaugcugcu

SEQ ID NO: 1455342 - RNA, 15 nt, Homo sapiens
gucuauggcacuaau

SEQ ID NO: 1455343 - RNA, 20 nt, Homo sapiens
gucucaaccccucacaggag

SEQ ID NO: 1455344 - RNA, 12 nt, Homo sapiens
gucucaccagcc

SEQ ID NO: 1455345 - RNA, 13 nt, Homo sapiens
gucucaguuuuca

SEQ ID NO: 1455346 - RNA, 13 nt, Homo sapiens
gucucauucuguc

SEQ ID NO: 1455347 - RNA, 22 nt, Homo sapiens
gucucauuucucauaauuuugc

SEQ ID NO: 1455348 - RNA, 15 nt, Homo sapiens
gucuccuacuccuga

SEQ ID NO: 1455349 - RNA, 17 nt, Homo sapiens
gucuccuacuccugacu

SEQ ID NO: 1455350 - RNA, 21 nt, Homo sapiens
gucucuauaccaaccaaacca

SEQ ID NO: 1455351 - RNA, 20 nt, Homo sapiens
gucucucggguucaagcaau

SEQ ID NO: 1455352 - RNA, 18 nt, Homo sapiens
gucugagaauuuccaaaa

SEQ ID NO: 1455353 - RNA, 21 nt, Homo sapiens
gucugauuggcucacccaagc

SEQ ID NO: 1455354 - RNA, 20 nt, Homo sapiens
gucugcaugugcacgguggc

SEQ ID NO: 1455355 - RNA, 17 nt, Homo sapiens
gucugcuuaguaucuca

SEQ ID NO: 1455356 - RNA, 20 nt, Homo sapiens
gucugcuuaguaucucauca

SEQ ID NO: 1455357 - RNA, 16 nt, Homo sapiens
gucugggagucacaca

SEQ ID NO: 1455358 - RNA, 16 nt, Homo sapiens
gucugguuaguuaaaa

SEQ ID NO: 1455359 - RNA, 14 nt, Homo sapiens
gucugucaccagcu

SEQ ID NO: 1455360 - RNA, 15 nt, Homo sapiens
gucuuaauguacaca

SEQ ID NO: 1455361 - RNA, 15 nt, Homo sapiens
gucuuagauguauau

SEQ ID NO: 1455362 - RNA, 13 nt, Homo sapiens
gucuucaacaucc

SEQ ID NO: 1455363 - RNA, 15 nt, Homo sapiens
gucuuccacuucaau

SEQ ID NO: 1455364 - RNA, 14 nt, Homo sapiens
gucuuccaugaccc

SEQ ID NO: 1455365 - RNA, 14 nt, Homo sapiens
gucuucccuaccuc

SEQ ID NO: 1455366 - RNA, 20 nt, Homo sapiens
gucuucccuucugauugaug

SEQ ID NO: 1455367 - RNA, 17 nt, Homo sapiens
gucuucuggacaggcuc

SEQ ID NO: 1455368 - RNA, 13 nt, Homo sapiens
gucuuuaacucau

SEQ ID NO: 1455369 - RNA, 22 nt, Homo sapiens
gucuuucggggugcuccugugg

SEQ ID NO: 1455370 - RNA, 12 nt, Homo sapiens
gugaaaauauga

SEQ ID NO: 1455371 - RNA, 15 nt, Homo sapiens
gugaaccaucauuau

SEQ ID NO: 1455372 - RNA, 15 nt, Homo sapiens
gugaacugugcauag

SEQ ID NO: 1455373 - RNA, 21 nt, Homo sapiens
gugaagaacacuacugcuaaa

SEQ ID NO: 1455374 - RNA, 18 nt, Homo sapiens
gugaagagauacagccuu

SEQ ID NO: 1455375 - RNA, 20 nt, Homo sapiens
gugaagaugguuucaauuca

SEQ ID NO: 1455376 - RNA, 22 nt, Homo sapiens
gugaauacugcuacagcaauuu

SEQ ID NO: 1455377 - RNA, 22 nt, Homo sapiens
gugaauacuuacuauaauuuga

SEQ ID NO: 1455378 - RNA, 17 nt, Homo sapiens
gugaaugaaacacucag

SEQ ID NO: 1455379 - RNA, 13 nt, Homo sapiens
gugaaugaucucu

SEQ ID NO: 1455380 - RNA, 16 nt, Homo sapiens
gugaauuucacaagcu

SEQ ID NO: 1455381 - RNA, 13 nt, Homo sapiens
gugacacagcagc

SEQ ID NO: 1455382 - RNA, 13 nt, Homo sapiens
gugacacauugua

SEQ ID NO: 1455383 - RNA, 15 nt, Homo sapiens
gugacagggccagug

SEQ ID NO: 1455384 - RNA, 15 nt, Homo sapiens
gugacauuugggaga

SEQ ID NO: 1455385 - RNA, 23 nt, Homo sapiens
gugacauuugggagacaugugac

SEQ ID NO: 1455386 - RNA, 11 nt, Homo sapiens
gugaccagcac

SEQ ID NO: 1455387 - RNA, 23 nt, Homo sapiens
gugaccauggaggccagugccag

SEQ ID NO: 1455388 - RNA, 18 nt, Homo sapiens
gugacuucccuucuaacc

SEQ ID NO: 1455389 - RNA, 21 nt, Homo sapiens
gugacuucuccaggucucacg

SEQ ID NO: 1455390 - RNA, 22 nt, Homo sapiens
gugacuuugucucuccuggcug

SEQ ID NO: 1455391 - RNA, 20 nt, Homo sapiens
gugagaaucaaaacucuccu

SEQ ID NO: 1455392 - RNA, 22 nt, Homo sapiens
gugagagugggagggagguaac

SEQ ID NO: 1455393 - RNA, 16 nt, Homo sapiens
gugaggaagaacuaca

SEQ ID NO: 1455394 - RNA, 16 nt, Homo sapiens
gugagugagacucugc

SEQ ID NO: 1455395 - RNA, 15 nt, Homo sapiens
gugauaaugcagacu

SEQ ID NO: 1455396 - RNA, 14 nt, Homo sapiens
gugaucuuggcuca

SEQ ID NO: 1455397 - RNA, 22 nt, Homo sapiens
gugaugacauucccugcuaaua

SEQ ID NO: 1455398 - RNA, 12 nt, Homo sapiens
gugaugaugcug

SEQ ID NO: 1455399 - RNA, 13 nt, Homo sapiens
gugaugaugcugu

SEQ ID NO: 1455400 - RNA, 17 nt, Homo sapiens
gugauugcagcuuuaug

SEQ ID NO: 1455401 - RNA, 24 nt, Homo sapiens
gugauuucaccccacagacacuua

SEQ ID NO: 1455402 - RNA, 21 nt, Homo sapiens
gugcaaacgccuagauugcuu

SEQ ID NO: 1455403 - RNA, 16 nt, Homo sapiens
gugcaacccagucaca

SEQ ID NO: 1455404 - RNA, 20 nt, Homo sapiens
gugcacccaugggcucugac

SEQ ID NO: 1455405 - RNA, 11 nt, Homo sapiens
gugcacuucaa

SEQ ID NO: 1455406 - RNA, 15 nt, Homo sapiens
gugcagucacuggag

SEQ ID NO: 1455407 - RNA, 17 nt, Homo sapiens
gugcaguugacagcagg

SEQ ID NO: 1455408 - RNA, 15 nt, Homo sapiens
gugcaucccugagac

SEQ ID NO: 1455409 - RNA, 22 nt, Homo sapiens
gugcaugcaugcccucucugag

SEQ ID NO: 1455410 - RNA, 18 nt, Homo sapiens
gugcauuuguucagcucc

SEQ ID NO: 1455411 - RNA, 11 nt, Homo sapiens
gugccaaaaau

SEQ ID NO: 1455412 - RNA, 14 nt, Homo sapiens
gugccacucagaga

SEQ ID NO: 1455413 - RNA, 20 nt, Homo sapiens
gugccagcaaugacaucuca

SEQ ID NO: 1455414 - RNA, 20 nt, Homo sapiens
gugccagggcccaccccagc

SEQ ID NO: 1455415 - RNA, 12 nt, Homo sapiens
gugccaguuccu

SEQ ID NO: 1455416 - RNA, 15 nt, Homo sapiens
gugccaguucuuucc

SEQ ID NO: 1455417 - RNA, 21 nt, Homo sapiens
gugccauuuuaagaguuacuu

SEQ ID NO: 1455418 - RNA, 18 nt, Homo sapiens
gugcccacccugggagac

SEQ ID NO: 1455419 - RNA, 13 nt, Homo sapiens
gugccccaugccu

SEQ ID NO: 1455420 - RNA, 14 nt, Homo sapiens
gugcccuacucauu

SEQ ID NO: 1455421 - RNA, 10 nt, Homo sapiens
gugcccucca

SEQ ID NO: 1455422 - RNA, 17 nt, Homo sapiens
gugcuaucgcaccacug

SEQ ID NO: 1455423 - RNA, 21 nt, Homo sapiens
gugcuaugaauuuucaaguaa

SEQ ID NO: 1455424 - RNA, 14 nt, Homo sapiens
gugcucacauagga

SEQ ID NO: 1455425 - RNA, 13 nt, Homo sapiens
gugcucagagggc

SEQ ID NO: 1455426 - RNA, 13 nt, Homo sapiens
gugcucauuuaag

SEQ ID NO: 1455427 - RNA, 14 nt, Homo sapiens
gugcuccaguucca

SEQ ID NO: 1455428 - RNA, 18 nt, Homo sapiens
gugcucuuggcugacccc

SEQ ID NO: 1455429 - RNA, 14 nt, Homo sapiens
gugcugccauuuga

SEQ ID NO: 1455430 - RNA, 15 nt, Homo sapiens
gugcuggagacacuc

SEQ ID NO: 1455431 - RNA, 19 nt, Homo sapiens
gugcugggauuacaggugu

SEQ ID NO: 1455432 - RNA, 18 nt, Homo sapiens
gugcugugggcagcaccc

SEQ ID NO: 1455433 - RNA, 19 nt, Homo sapiens
gugcuucuggaaacuacca

SEQ ID NO: 1455434 - RNA, 16 nt, Homo sapiens
gugcuugcuggugccu

SEQ ID NO: 1455435 - RNA, 14 nt, Homo sapiens
guggaacucaguca

SEQ ID NO: 1455436 - RNA, 20 nt, Homo sapiens
guggaccacaggcaucuaca

SEQ ID NO: 1455437 - RNA, 23 nt, Homo sapiens
guggagacccugccacagccaga

SEQ ID NO: 1455438 - RNA, 15 nt, Homo sapiens
guggaggauugcuau

SEQ ID NO: 1455439 - RNA, 13 nt, Homo sapiens
guggaggcuuccu

SEQ ID NO: 1455440 - RNA, 12 nt, Homo sapiens
guggagggccac

SEQ ID NO: 1455441 - RNA, 22 nt, Homo sapiens
guggaggguggggggcgcugag

SEQ ID NO: 1455442 - RNA, 13 nt, Homo sapiens
guggagugucaca

SEQ ID NO: 1455443 - RNA, 19 nt, Homo sapiens
ucagaccugcauugaacag

SEQ ID NO: 1455444 - RNA, 17 nt, Homo sapiens
ucagagaaauacuuuca

SEQ ID NO: 1455445 - RNA, 18 nt, Homo sapiens
ucagagaaauacuuucag

SEQ ID NO: 1455446 - RNA, 15 nt, Homo sapiens
ucagagcuaaacucc

SEQ ID NO: 1455447 - RNA, 14 nt, Homo sapiens
ucagaggagcucua

SEQ ID NO: 1455448 - RNA, 18 nt, Homo sapiens
ucagaggccugcugccag

SEQ ID NO: 1455449 - RNA, 14 nt, Homo sapiens
ucagaguccuugca

SEQ ID NO: 1455450 - RNA, 16 nt, Homo sapiens
ucagaguccuugcaaa

SEQ ID NO: 1455451 - RNA, 21 nt, Homo sapiens
ucagauacaugguugugaccu

SEQ ID NO: 1455452 - RNA, 16 nt, Homo sapiens
ucagauaggagugaau

SEQ ID NO: 1455453 - RNA, 16 nt, Homo sapiens
ucagauaucaaaauuc

SEQ ID NO: 1455454 - RNA, 23 nt, Homo sapiens
ucagaugcuguuaguaccuacau

SEQ ID NO: 1455455 - RNA, 18 nt, Homo sapiens
ucagauggagguucucag

SEQ ID NO: 1455456 - RNA, 18 nt, Homo sapiens
ucagauuguuaucuauca

SEQ ID NO: 1455457 - RNA, 20 nt, Homo sapiens
ucagauuguuaucuaucaac

SEQ ID NO: 1455458 - RNA, 22 nt, Homo sapiens
ucagauuguuaucuaucaacua

SEQ ID NO: 1455459 - RNA, 13 nt, Homo sapiens
ucagcaaaccauu

SEQ ID NO: 1455460 - RNA, 17 nt, Homo sapiens
ucagcaccugacccugu

SEQ ID NO: 1455461 - RNA, 16 nt, Homo sapiens
ucagcagugaaguaua

SEQ ID NO: 1455462 - RNA, 14 nt, Homo sapiens
ucagcaucugugau

SEQ ID NO: 1455463 - RNA, 23 nt, Homo sapiens
ucagccaagcuuguuaucagcuu

SEQ ID NO: 1455464 - RNA, 16 nt, Homo sapiens
ucagccaggcugcuaa

SEQ ID NO: 1455465 - RNA, 21 nt, Homo sapiens
ucagccaggcugcuaaccugg

SEQ ID NO: 1455466 - RNA, 21 nt, Homo sapiens
ucagccaguggcuagcgcaag

SEQ ID NO: 1455467 - RNA, 13 nt, Homo sapiens
ucagcccucagaa

SEQ ID NO: 1455468 - RNA, 23 nt, Homo sapiens
ucagccuacuuucacacuaagaa

SEQ ID NO: 1455469 - RNA, 22 nt, Homo sapiens
ucagccuggccagacacaggcc

SEQ ID NO: 1455470 - RNA, 19 nt, Homo sapiens
ucagcgugggccagaggca

SEQ ID NO: 1455471 - RNA, 20 nt, Homo sapiens
ucagcuaagggaagacauuu

SEQ ID NO: 1455472 - RNA, 16 nt, Homo sapiens
ucagcuacacaaggaa

SEQ ID NO: 1455473 - RNA, 16 nt, Homo sapiens
ucagcuauaccugcac

SEQ ID NO: 1455474 - RNA, 12 nt, Homo sapiens
ucagcugccuca

SEQ ID NO: 1455475 - RNA, 22 nt, Homo sapiens
ucagcugccugaaacagccaug

SEQ ID NO: 1455476 - RNA, 20 nt, Homo sapiens
ucagcugggucacauccauc

SEQ ID NO: 1455477 - RNA, 19 nt, Homo sapiens
ucagcuuucagggccaugg

SEQ ID NO: 1455478 - RNA, 14 nt, Homo sapiens
ucaggaaaacaccc

SEQ ID NO: 1455479 - RNA, 18 nt, Homo sapiens
ucaggaaggggugugcug

SEQ ID NO: 1455480 - RNA, 20 nt, Homo sapiens
ucaggacucaaucuacaggc

SEQ ID NO: 1455481 - RNA, 16 nt, Homo sapiens
ucaggaucacugggcu

SEQ ID NO: 1455482 - RNA, 16 nt, Homo sapiens
ucaggcagggugcagu

SEQ ID NO: 1455483 - RNA, 17 nt, Homo sapiens
ucaggcagggugcagua

SEQ ID NO: 1455484 - RNA, 19 nt, Homo sapiens
ucaggcaggguuaaacugc

SEQ ID NO: 1455485 - RNA, 13 nt, Homo sapiens
ucaggccagccca

SEQ ID NO: 1455486 - RNA, 21 nt, Homo sapiens
ucaggccagugugucucugaa

SEQ ID NO: 1455487 - RNA, 16 nt, Homo sapiens
ucaggccugugcccac

SEQ ID NO: 1455488 - RNA, 22 nt, Homo sapiens
ucagggccuggcaggccagugu

SEQ ID NO: 1455489 - RNA, 15 nt, Homo sapiens
ucaggggacuugaau

SEQ ID NO: 1455490 - RNA, 14 nt, Homo sapiens
ucaguaaacaauga

SEQ ID NO: 1455491 - RNA, 14 nt, Homo sapiens
ucaguaaaccuguc

SEQ ID NO: 1455492 - RNA, 19 nt, Homo sapiens
ucaguauuagaugcacuua

SEQ ID NO: 1455493 - RNA, 16 nt, Homo sapiens
ucaguauuucaacuga

SEQ ID NO: 1455494 - RNA, 14 nt, Homo sapiens
ucagucaacaacuu

SEQ ID NO: 1455495 - RNA, 20 nt, Homo sapiens
ucagucaacaacuuacacuu

SEQ ID NO: 1455496 - RNA, 20 nt, Homo sapiens
ucagucacacacacauacaa

SEQ ID NO: 1455497 - RNA, 20 nt, Homo sapiens
ucaguccacuucugcucugg

SEQ ID NO: 1455498 - RNA, 15 nt, Homo sapiens
ucaguccuuugauca

SEQ ID NO: 1455499 - RNA, 18 nt, Homo sapiens
ucagucucuguguaauca

SEQ ID NO: 1455500 - RNA, 19 nt, Homo sapiens
ucagucuucacuugcacug

SEQ ID NO: 1455501 - RNA, 14 nt, Homo sapiens
ucagugaaagccag

SEQ ID NO: 1455502 - RNA, 20 nt, Homo sapiens
ucagugaagaugccagugaa

SEQ ID NO: 1455503 - RNA, 22 nt, Homo sapiens
ucagugacagaguucacuauaa

SEQ ID NO: 1455504 - RNA, 17 nt, Homo sapiens
ucagugauuacugucaa

SEQ ID NO: 1455505 - RNA, 14 nt, Homo sapiens
ucagugcaggagag

SEQ ID NO: 1455506 - RNA, 20 nt, Homo sapiens
ucagugccgaccugcgccaa

SEQ ID NO: 1455507 - RNA, 14 nt, Homo sapiens
ucaguguacaugga

SEQ ID NO: 1455508 - RNA, 15 nt, Homo sapiens
ucaguguacauggaa

SEQ ID NO: 1455509 - RNA, 17 nt, Homo sapiens
ucaguguaccauuugcc

SEQ ID NO: 1455510 - RNA, 13 nt, Homo sapiens
ucagugugucuaa

SEQ ID NO: 1455511 - RNA, 18 nt, Homo sapiens
ucaguguugagaugggga

SEQ ID NO: 1455512 - RNA, 15 nt, Homo sapiens
ucaguguuugggaaa

SEQ ID NO: 1455513 - RNA, 16 nt, Homo sapiens
ucaguuaacuauugca

SEQ ID NO: 1455514 - RNA, 20 nt, Homo sapiens
ucaguucccaccaucugauu

SEQ ID NO: 1455515 - RNA, 21 nt, Homo sapiens
ucaguucccccaguaccucca

SEQ ID NO: 1455516 - RNA, 23 nt, Homo sapiens
ucaguuuuauuuuugccaaggca

SEQ ID NO: 1455517 - RNA, 16 nt, Homo sapiens
ucaguuuuuuguuuua

SEQ ID NO: 1455518 - RNA, 20 nt, Homo sapiens
ucauaaaugaagcagcuuua

SEQ ID NO: 1455519 - RNA, 21 nt, Homo sapiens
ucauaagaaugaauaauaauu

SEQ ID NO: 1455520 - RNA, 15 nt, Homo sapiens
ucauaagaauucugu

SEQ ID NO: 1455521 - RNA, 16 nt, Homo sapiens
ucauaauucagcacuu

SEQ ID NO: 1455522 - RNA, 20 nt, Homo sapiens
ucauaauucagcacuuaacu

SEQ ID NO: 1455523 - RNA, 15 nt, Homo sapiens
ucauaauuuugcaaa

SEQ ID NO: 1455524 - RNA, 16 nt, Homo sapiens
ucauacuaguagucau

SEQ ID NO: 1455525 - RNA, 13 nt, Homo sapiens
ucauagcauuaac

SEQ ID NO: 1455526 - RNA, 20 nt, Homo sapiens
ucauaggaaaaguacauuua

SEQ ID NO: 1455527 - RNA, 14 nt, Homo sapiens
ucauaguaacuucu

SEQ ID NO: 1455528 - RNA, 16 nt, Homo sapiens
ucauauaccagcaaua

SEQ ID NO: 1455529 - RNA, 20 nt, Homo sapiens
ucauauaccagcaauauauc

SEQ ID NO: 1455530 - RNA, 15 nt, Homo sapiens
ucauauacugccaug

SEQ ID NO: 1455531 - RNA, 21 nt, Homo sapiens
ucaucaaagcucacaccaaau

SEQ ID NO: 1455532 - RNA, 21 nt, Homo sapiens
ucaucaacaaagaaauauuau

SEQ ID NO: 1455533 - RNA, 18 nt, Homo sapiens
ucaucaagcaggaauuau

SEQ ID NO: 1455534 - RNA, 19 nt, Homo sapiens
ucaucacagggauuuagac

SEQ ID NO: 1455535 - RNA, 12 nt, Homo sapiens
ucaucacuggau

SEQ ID NO: 1455536 - RNA, 23 nt, Homo sapiens
ucaucagcuaucguuaguguauu

SEQ ID NO: 1455537 - RNA, 16 nt, Homo sapiens
ucaucauucccucuca

SEQ ID NO: 1455538 - RNA, 14 nt, Homo sapiens
ucauccaacuuaug

SEQ ID NO: 1455539 - RNA, 20 nt, Homo sapiens
ucauccaggcccaacuguga

SEQ ID NO: 1455540 - RNA, 15 nt, Homo sapiens
ucaucccuaugggau

SEQ ID NO: 1455541 - RNA, 15 nt, Homo sapiens
ucauccugacucugc

SEQ ID NO: 1455542 - RNA, 19 nt, Homo sapiens
ucauccugccuucauggaa

SEQ ID NO: 1455543 - RNA, 12 nt, Homo sapiens
ucauccuuccau

SEQ ID NO: 1455544 - RNA, 17 nt, Homo sapiens
ucauccuuggucuuugu

SEQ ID NO: 1455545 - RNA, 19 nt, Homo sapiens
uccugcccagcacaggaau

SEQ ID NO: 1455546 - RNA, 19 nt, Homo sapiens
uccugcccuuccugaagaa

SEQ ID NO: 1455547 - RNA, 17 nt, Homo sapiens
uccugccgcaacaguuu

SEQ ID NO: 1455548 - RNA, 15 nt, Homo sapiens
uccugccuucaugga

SEQ ID NO: 1455549 - RNA, 22 nt, Homo sapiens
uccugcugcggaggagcugccu

SEQ ID NO: 1455550 - RNA, 18 nt, Homo sapiens
uccuggaguacaaacaca

SEQ ID NO: 1455551 - RNA, 15 nt, Homo sapiens
uccuggauuccucac

SEQ ID NO: 1455552 - RNA, 21 nt, Homo sapiens
uccuggauuccucacuuugaa

SEQ ID NO: 1455553 - RNA, 13 nt, Homo sapiens
uccuggccugaga

SEQ ID NO: 1455554 - RNA, 14 nt, Homo sapiens
uccuggcugggaac

SEQ ID NO: 1455555 - RNA, 22 nt, Homo sapiens
uccugggcucaagcaauccucc

SEQ ID NO: 1455556 - RNA, 15 nt, Homo sapiens
uccuggggucacuca

SEQ ID NO: 1455557 - RNA, 18 nt, Homo sapiens
uccuggguggacuuuuga

SEQ ID NO: 1455558 - RNA, 22 nt, Homo sapiens
uccuguacauugugggauguuc

SEQ ID NO: 1455559 - RNA, 17 nt, Homo sapiens
uccuguacuguauggaa

SEQ ID NO: 1455560 - RNA, 18 nt, Homo sapiens
uccuguauucuucaacca

SEQ ID NO: 1455561 - RNA, 16 nt, Homo sapiens
uccugugaaaauauga

SEQ ID NO: 1455562 - RNA, 23 nt, Homo sapiens
uccuguggguguucuuuccugcc

SEQ ID NO: 1455563 - RNA, 14 nt, Homo sapiens
uccuguguccugaa

SEQ ID NO: 1455564 - RNA, 17 nt, Homo sapiens
uccuguguguacucugu

SEQ ID NO: 1455565 - RNA, 14 nt, Homo sapiens
uccuguucagugag

SEQ ID NO: 1455566 - RNA, 16 nt, Homo sapiens
uccuguuucuccuuag

SEQ ID NO: 1455567 - RNA, 17 nt, Homo sapiens
uccuguuuuucugggug

SEQ ID NO: 1455568 - RNA, 16 nt, Homo sapiens
uccuuaaaaaucacac

SEQ ID NO: 1455569 - RNA, 21 nt, Homo sapiens
uccuuaaaaaucacacuguaa

SEQ ID NO: 1455570 - RNA, 21 nt, Homo sapiens
uccuuaaaacaauucugugac

SEQ ID NO: 1455571 - RNA, 17 nt, Homo sapiens
uccuuaacacauucaau

SEQ ID NO: 1455572 - RNA, 14 nt, Homo sapiens
uccuuaagggacaa

SEQ ID NO: 1455573 - RNA, 12 nt, Homo sapiens
uccuuaaguaua

SEQ ID NO: 1455574 - RNA, 13 nt, Homo sapiens
uccuuaccgcaca

SEQ ID NO: 1455575 - RNA, 16 nt, Homo sapiens
uccuuagacucuuuuc

SEQ ID NO: 1455576 - RNA, 13 nt, Homo sapiens
uccuuaguguaua

SEQ ID NO: 1455577 - RNA, 15 nt, Homo sapiens
uccuuauuugccuuc

SEQ ID NO: 1455578 - RNA, 21 nt, Homo sapiens
uccuuauuuugugugcuuucc

SEQ ID NO: 1455579 - RNA, 15 nt, Homo sapiens
uccuucaagaacucu

SEQ ID NO: 1455580 - RNA, 18 nt, Homo sapiens
uccuuccacaacugcugc

SEQ ID NO: 1455581 - RNA, 13 nt, Homo sapiens
uccuuccauccau

SEQ ID NO: 1455582 - RNA, 15 nt, Homo sapiens
uccuuccauccaucu

SEQ ID NO: 1455583 - RNA, 16 nt, Homo sapiens
uccuuccaucccuacc

SEQ ID NO: 1455584 - RNA, 22 nt, Homo sapiens
uccuucccucucaugacuugca

SEQ ID NO: 1455585 - RNA, 17 nt, Homo sapiens
uccuucccucucugaug

SEQ ID NO: 1455586 - RNA, 23 nt, Homo sapiens
uccuuccugcuugaguucccaga

SEQ ID NO: 1455587 - RNA, 15 nt, Homo sapiens
uccuuccuucagggu

SEQ ID NO: 1455588 - RNA, 20 nt, Homo sapiens
uccuuggagggacaugacua

SEQ ID NO: 1455589 - RNA, 10 nt, Homo sapiens
uccuuggcau

SEQ ID NO: 1455590 - RNA, 15 nt, Homo sapiens
uccuuucacaaccuu

SEQ ID NO: 1455591 - RNA, 17 nt, Homo sapiens
uccuuucacuucuuucc

SEQ ID NO: 1455592 - RNA, 23 nt, Homo sapiens
uccuuuccaagcuccucgugaua

SEQ ID NO: 1455593 - RNA, 19 nt, Homo sapiens
uccuuucuccaggaccaau

SEQ ID NO: 1455594 - RNA, 12 nt, Homo sapiens
uccuuucuuuuc

SEQ ID NO: 1455595 - RNA, 20 nt, Homo sapiens
uccuuugaagaaaaagacac

SEQ ID NO: 1455596 - RNA, 15 nt, Homo sapiens
uccuuugcagggcag

SEQ ID NO: 1455597 - RNA, 13 nt, Homo sapiens
uccuuugugcuua

SEQ ID NO: 1455598 - RNA, 17 nt, Homo sapiens
uccuuuuuaaaugacuu

SEQ ID NO: 1455599 - RNA, 23 nt, Homo sapiens
uccuuuuucugauuagcuuugug

SEQ ID NO: 1455600 - RNA, 16 nt, Homo sapiens
uccuuuuugacacuga

SEQ ID NO: 1455601 - RNA, 19 nt, Homo sapiens
uccuuuuuuauacaggaaa

SEQ ID NO: 1455602 - RNA, 18 nt, Homo sapiens
ucgaaaccugggauucag

SEQ ID NO: 1455603 - RNA, 15 nt, Homo sapiens
ucgaaaucaaaccac

SEQ ID NO: 1455604 - RNA, 14 nt, Homo sapiens
ucgaagcuccguga

SEQ ID NO: 1455605 - RNA, 18 nt, Homo sapiens
ucgaaugaacaaagucca

SEQ ID NO: 1455606 - RNA, 17 nt, Homo sapiens
ucgaguuuuaaacuggu

SEQ ID NO: 1455607 - RNA, 20 nt, Homo sapiens
ucgcaaaaacguaucuccua

SEQ ID NO: 1455608 - RNA, 21 nt, Homo sapiens
ucgcaaacguuucuugaacaa

SEQ ID NO: 1455609 - RNA, 16 nt, Homo sapiens
ucgcaucucagugcag

SEQ ID NO: 1455610 - RNA, 19 nt, Homo sapiens
ucgcaucucagugcaggag

SEQ ID NO: 1455611 - RNA, 14 nt, Homo sapiens
ucgcauuugucaau

SEQ ID NO: 1455612 - RNA, 21 nt, Homo sapiens
ucgccccaggcccucccugac

SEQ ID NO: 1455613 - RNA, 20 nt, Homo sapiens
ucgcccuccucccugucaua

SEQ ID NO: 1455614 - RNA, 14 nt, Homo sapiens
ucgccuguggagcu

SEQ ID NO: 1455615 - RNA, 15 nt, Homo sapiens
ucgcgccacugcacu

SEQ ID NO: 1455616 - RNA, 18 nt, Homo sapiens
ucgcuccagacuugggaa

SEQ ID NO: 1455617 - RNA, 17 nt, Homo sapiens
ucgcuggggauggaauu

SEQ ID NO: 1455618 - RNA, 19 nt, Homo sapiens
ucggaagggguuccucaaa

SEQ ID NO: 1455619 - RNA, 20 nt, Homo sapiens
ucggagacagugacuggugc

SEQ ID NO: 1455620 - RNA, 12 nt, Homo sapiens
ucggcaucuucu

SEQ ID NO: 1455621 - RNA, 22 nt, Homo sapiens
ucggcauguggaggaaggcagc

SEQ ID NO: 1455622 - RNA, 15 nt, Homo sapiens
ucggcuuuuugccau

SEQ ID NO: 1455623 - RNA, 15 nt, Homo sapiens
ucgggccacagggcg

SEQ ID NO: 1455624 - RNA, 13 nt, Homo sapiens
ucggucacuccaa

SEQ ID NO: 1455625 - RNA, 16 nt, Homo sapiens
ucgguggcucaugccu

SEQ ID NO: 1455626 - RNA, 20 nt, Homo sapiens
ucgguggucuccaccuguca

SEQ ID NO: 1455627 - RNA, 15 nt, Homo sapiens
ucgugagucauuuaa

SEQ ID NO: 1455628 - RNA, 16 nt, Homo sapiens
ucguuuugaugccauu

SEQ ID NO: 1455629 - RNA, 22 nt, Homo sapiens
ucuaaaagcguuggauguagca

SEQ ID NO: 1455630 - RNA, 21 nt, Homo sapiens
ucuaaaauugcuucuuuacca

SEQ ID NO: 1455631 - RNA, 22 nt, Homo sapiens
ucuaaacagugggaguaccaaa

SEQ ID NO: 1455632 - RNA, 21 nt, Homo sapiens
ucuaaacuuccccaucuucua

SEQ ID NO: 1455633 - RNA, 20 nt, Homo sapiens
ucuaaagguggugaggcaau

SEQ ID NO: 1455634 - RNA, 23 nt, Homo sapiens
ucuaaaugcauauccugagccau

SEQ ID NO: 1455635 - RNA, 20 nt, Homo sapiens
ucuaaauggugcugcagauu

SEQ ID NO: 1455636 - RNA, 24 nt, Homo sapiens
ucuaaauuugaauguuaagcagau

SEQ ID NO: 1455637 - RNA, 22 nt, Homo sapiens
ucuaaauuuugucuuuaacuca

SEQ ID NO: 1455638 - RNA, 14 nt, Homo sapiens
ucuaacaagucaua

SEQ ID NO: 1455639 - RNA, 21 nt, Homo sapiens
ucuaaccuugaaugcugccag

SEQ ID NO: 1455640 - RNA, 12 nt, Homo sapiens
ucuaacucuccc

SEQ ID NO: 1455641 - RNA, 13 nt, Homo sapiens
ucuaagugauaua

SEQ ID NO: 1455642 - RNA, 19 nt, Homo sapiens
ucuaauaaaauauaaucua

SEQ ID NO: 1455643 - RNA, 14 nt, Homo sapiens
ucuaauaaacuugg

SEQ ID NO: 1455644 - RNA, 22 nt, Homo sapiens
ucuaaucuuuuaauguauuugu

SEQ ID NO: 1455645 - RNA, 23 nt, Homo sapiens
ucuaaugugguuauuucucugau

SEQ ID NO: 1455646 - RNA, 20 nt, Homo sapiens
ucuaauuaauuguaaucuga

SEQ ID NO: 1455647 - RNA, 19 nt, Homo sapiens
ugaaaccuacacacuguca

SEQ ID NO: 1455648 - RNA, 15 nt, Homo sapiens
ugaaacugcugugaa

SEQ ID NO: 1455649 - RNA, 18 nt, Homo sapiens
ugaaacuggcacugaauu

SEQ ID NO: 1455650 - RNA, 22 nt, Homo sapiens
ugaaagaaagcugagaagaaug

SEQ ID NO: 1455651 - RNA, 22 nt, Homo sapiens
ugaaagaagagaugagaaauga

SEQ ID NO: 1455652 - RNA, 11 nt, Homo sapiens
ugaaagaucuu

SEQ ID NO: 1455653 - RNA, 19 nt, Homo sapiens
ugaaagcugagaacuccug

SEQ ID NO: 1455654 - RNA, 16 nt, Homo sapiens
ugaaaggauguggaag

SEQ ID NO: 1455655 - RNA, 23 nt, Homo sapiens
ugaaauacuauuuaaagccuccu

SEQ ID NO: 1455656 - RNA, 14 nt, Homo sapiens
ugaaauaugcaucu

SEQ ID NO: 1455657 - RNA, 15 nt, Homo sapiens
ugaaaucucagaauu

SEQ ID NO: 1455658 - RNA, 19 nt, Homo sapiens
ugaaaucuuuaugugauau

SEQ ID NO: 1455659 - RNA, 15 nt, Homo sapiens
ugaaaugcuggcauu

SEQ ID NO: 1455660 - RNA, 16 nt, Homo sapiens
ugaaaugcuggcauuu

SEQ ID NO: 1455661 - RNA, 18 nt, Homo sapiens
ugaaaugcuggcauuugc

SEQ ID NO: 1455662 - RNA, 16 nt, Homo sapiens
ugaaauggauacuaca

SEQ ID NO: 1455663 - RNA, 15 nt, Homo sapiens
ugaaauuacugugua

SEQ ID NO: 1455664 - RNA, 16 nt, Homo sapiens
ugaaauuagggcccaa

SEQ ID NO: 1455665 - RNA, 15 nt, Homo sapiens
ugaaauuauaucugu

SEQ ID NO: 1455666 - RNA, 17 nt, Homo sapiens
ugaaauucacaguaaua

SEQ ID NO: 1455667 - RNA, 13 nt, Homo sapiens
ugaaauucuuccu

SEQ ID NO: 1455668 - RNA, 13 nt, Homo sapiens
ugaaauuuauuca

SEQ ID NO: 1455669 - RNA, 16 nt, Homo sapiens
ugaaauuuuaauugaa

SEQ ID NO: 1455670 - RNA, 16 nt, Homo sapiens
ugaacacaggcagcuu

SEQ ID NO: 1455671 - RNA, 17 nt, Homo sapiens
ugaacaccuauugcacu

SEQ ID NO: 1455672 - RNA, 21 nt, Homo sapiens
ugaacacucuuuugcuuuauu

SEQ ID NO: 1455673 - RNA, 19 nt, Homo sapiens
ugaacacuggcuaaagaua

SEQ ID NO: 1455674 - RNA, 11 nt, Homo sapiens
ugaacagaauu

SEQ ID NO: 1455675 - RNA, 11 nt, Homo sapiens
ugaacagccaa

SEQ ID NO: 1455676 - RNA, 16 nt, Homo sapiens
ugaacagccaaaugca

SEQ ID NO: 1455677 - RNA, 14 nt, Homo sapiens
ugaacaggcaugca

SEQ ID NO: 1455678 - RNA, 22 nt, Homo sapiens
ugaacauccccucccaucauua

SEQ ID NO: 1455679 - RNA, 18 nt, Homo sapiens
ugaacaugugaaguuaua

SEQ ID NO: 1455680 - RNA, 14 nt, Homo sapiens
ugaacuacuaaagu

SEQ ID NO: 1455681 - RNA, 18 nt, Homo sapiens
ugaacuagggaagcucag

SEQ ID NO: 1455682 - RNA, 17 nt, Homo sapiens
ugaacucuuucuggccu

SEQ ID NO: 1455683 - RNA, 20 nt, Homo sapiens
ugaacuucuuugaauuuacu

SEQ ID NO: 1455684 - RNA, 21 nt, Homo sapiens
ugaacuuuuuaagaugaggca

SEQ ID NO: 1455685 - RNA, 20 nt, Homo sapiens
ugaagaaagacucugagaug

SEQ ID NO: 1455686 - RNA, 23 nt, Homo sapiens
ugaagaagagacucuuugcauau

SEQ ID NO: 1455687 - RNA, 23 nt, Homo sapiens
ugaagaauauuuaagaaaagcac

SEQ ID NO: 1455688 - RNA, 19 nt, Homo sapiens
ugaagacauuucugcucuc

SEQ ID NO: 1455689 - RNA, 15 nt, Homo sapiens
ugaagacuagaaaau

SEQ ID NO: 1455690 - RNA, 17 nt, Homo sapiens
ugaagagauacagccuu

SEQ ID NO: 1455691 - RNA, 18 nt, Homo sapiens
ugaagagggagaagcaug

SEQ ID NO: 1455692 - RNA, 18 nt, Homo sapiens
ugaagagggagaagggau

SEQ ID NO: 1455693 - RNA, 19 nt, Homo sapiens
ugaagaugacaaaaguaaa

SEQ ID NO: 1455694 - RNA, 23 nt, Homo sapiens
ugaagaugcagcucacuacccua

SEQ ID NO: 1455695 - RNA, 21 nt, Homo sapiens
ugaagaugccagugaaacuuc

SEQ ID NO: 1455696 - RNA, 23 nt, Homo sapiens
ugaagauguuucaaaaaaucuga

SEQ ID NO: 1455697 - RNA, 15 nt, Homo sapiens
ugaagcagguuccca

SEQ ID NO: 1455698 - RNA, 15 nt, Homo sapiens
ugaagcagucuugcu

SEQ ID NO: 1455699 - RNA, 16 nt, Homo sapiens
ugaagcagucuugcuc

SEQ ID NO: 1455700 - RNA, 16 nt, Homo sapiens
ugaaggaaucauucca

SEQ ID NO: 1455701 - RNA, 22 nt, Homo sapiens
ugaaggaugcggcaggugcucu

SEQ ID NO: 1455702 - RNA, 18 nt, Homo sapiens
ugaaggcagcagaauauu

SEQ ID NO: 1455703 - RNA, 14 nt, Homo sapiens
ugaaggcccaagag

SEQ ID NO: 1455704 - RNA, 13 nt, Homo sapiens
ugaaggcugagug

SEQ ID NO: 1455705 - RNA, 17 nt, Homo sapiens
ugaaggcugaguguccg

SEQ ID NO: 1455706 - RNA, 16 nt, Homo sapiens
ugaaggggaggucaca

SEQ ID NO: 1455707 - RNA, 16 nt, Homo sapiens
ugaaggguaaagaagu

SEQ ID NO: 1455708 - RNA, 16 nt, Homo sapiens
ugaaggucacucuucc

SEQ ID NO: 1455709 - RNA, 14 nt, Homo sapiens
ugaaggugaccucu

SEQ ID NO: 1455710 - RNA, 13 nt, Homo sapiens
ugaaggugauuca

SEQ ID NO: 1455711 - RNA, 18 nt, Homo sapiens
ugaagucuugcucugcca

SEQ ID NO: 1455712 - RNA, 21 nt, Homo sapiens
ugaagugaaugaaacacucag

SEQ ID NO: 1455713 - RNA, 16 nt, Homo sapiens
ugaagugcauccaaag

SEQ ID NO: 1455714 - RNA, 16 nt, Homo sapiens
ugaaguucaaaugccc

SEQ ID NO: 1455715 - RNA, 18 nt, Homo sapiens
ugaaguugcaaugcuuca

SEQ ID NO: 1455716 - RNA, 15 nt, Homo sapiens
ugaaguuuacaauca

SEQ ID NO: 1455717 - RNA, 19 nt, Homo sapiens
ugaaguuugugggggccaa

SEQ ID NO: 1455718 - RNA, 22 nt, Homo sapiens
ugaauaaacugaaaauggaccu

SEQ ID NO: 1455719 - RNA, 21 nt, Homo sapiens
ugaauaaagcacgugcaagga

SEQ ID NO: 1455720 - RNA, 22 nt, Homo sapiens
ugaauaaaguguaaguucacaa

SEQ ID NO: 1455721 - RNA, 20 nt, Homo sapiens
ugaauacauuuccaaaaugg

SEQ ID NO: 1455722 - RNA, 15 nt, Homo sapiens
ugaauagaaauggga

SEQ ID NO: 1455723 - RNA, 23 nt, Homo sapiens
ugaauagccuggccaccagccau

SEQ ID NO: 1455724 - RNA, 20 nt, Homo sapiens
ugaauauuuauauuucacua

SEQ ID NO: 1455725 - RNA, 12 nt, Homo sapiens
ugaaucaaugaa

SEQ ID NO: 1455726 - RNA, 14 nt, Homo sapiens
ugaaucaccuggcu

SEQ ID NO: 1455727 - RNA, 23 nt, Homo sapiens
ugaauccaaaagaaaaacagcca

SEQ ID NO: 1455728 - RNA, 20 nt, Homo sapiens
ugaaucugguguuggggaaa

SEQ ID NO: 1455729 - RNA, 20 nt, Homo sapiens
ugaaugaacacucuuuugcu

SEQ ID NO: 1455730 - RNA, 21 nt, Homo sapiens
ugaaugacacgccuaagguca

SEQ ID NO: 1455731 - RNA, 15 nt, Homo sapiens
ugaaugauacccuga

SEQ ID NO: 1455732 - RNA, 14 nt, Homo sapiens
ugaaugcaaaguag

SEQ ID NO: 1455733 - RNA, 14 nt, Homo sapiens
ugaaugcuccauua

SEQ ID NO: 1455734 - RNA, 23 nt, Homo sapiens
ugaaugcuccauuaauccaggga

SEQ ID NO: 1455735 - RNA, 13 nt, Homo sapiens
ugaaugcugccag

SEQ ID NO: 1455736 - RNA, 13 nt, Homo sapiens
ugaaugugucacu

SEQ ID NO: 1455737 - RNA, 14 nt, Homo sapiens
ugaaugugucaggu

SEQ ID NO: 1455738 - RNA, 15 nt, Homo sapiens
ugaauuaaucaucua

SEQ ID NO: 1455739 - RNA, 18 nt, Homo sapiens
ugaauuauugacacugaa

SEQ ID NO: 1455740 - RNA, 22 nt, Homo sapiens
ugaauucggaacuguccuuucc

SEQ ID NO: 1455741 - RNA, 22 nt, Homo sapiens
ugaauuguuaauucacagaaua

SEQ ID NO: 1455742 - RNA, 16 nt, Homo sapiens
ugaauuucccacauac

SEQ ID NO: 1455743 - RNA, 21 nt, Homo sapiens
ugaauuuggccugcacuaauu

SEQ ID NO: 1455744 - RNA, 21 nt, Homo sapiens
ugaauuuggucuguauagucu

SEQ ID NO: 1455745 - RNA, 21 nt, Homo sapiens
ugaauuuucaaguaauuguga

SEQ ID NO: 1455746 - RNA, 14 nt, Homo sapiens
ugaauuuucccuga

SEQ ID NO: 1455747 - RNA, 13 nt, Homo sapiens
ugaauuuucuuca

SEQ ID NO: 1455748 - RNA, 17 nt, Homo sapiens
ugacaaccucauccagg

SEQ ID NO: 1455749 - RNA, 17 nt, Homo sapiens
ugcaaaucaaacauauu

SEQ ID NO: 1455750 - RNA, 18 nt, Homo sapiens
ugcaaaucaaacauauuc

SEQ ID NO: 1455751 - RNA, 19 nt, Homo sapiens
ugcaaaucaaacauauucu

SEQ ID NO: 1455752 - RNA, 17 nt, Homo sapiens
ugcaaaugcuauauugc

SEQ ID NO: 1455753 - RNA, 18 nt, Homo sapiens
ugcaaaugcuauauugca

SEQ ID NO: 1455754 - RNA, 22 nt, Homo sapiens
ugcaacagcuacagucuaaaau

SEQ ID NO: 1455755 - RNA, 19 nt, Homo sapiens
ugcaacaggcuugugcaac

SEQ ID NO: 1455756 - RNA, 17 nt, Homo sapiens
ugcaaccuccgccuccc

SEQ ID NO: 1455757 - RNA, 13 nt, Homo sapiens
ugcaaccucugcc

SEQ ID NO: 1455758 - RNA, 14 nt, Homo sapiens
ugcaaccucugccu

SEQ ID NO: 1455759 - RNA, 19 nt, Homo sapiens
ugcaagcacaucugcauuu

SEQ ID NO: 1455760 - RNA, 15 nt, Homo sapiens
ugcaagccagggaug

SEQ ID NO: 1455761 - RNA, 21 nt, Homo sapiens
ugcaagccugucugagacuca

SEQ ID NO: 1455762 - RNA, 17 nt, Homo sapiens
ugcaagguauuucucca

SEQ ID NO: 1455763 - RNA, 16 nt, Homo sapiens
ugcaaguccacugggg

SEQ ID NO: 1455764 - RNA, 20 nt, Homo sapiens
ugcaaguuagggucuaugua

SEQ ID NO: 1455765 - RNA, 16 nt, Homo sapiens
ugcaauaugaauucaa

SEQ ID NO: 1455766 - RNA, 12 nt, Homo sapiens
ugcaaucuucua

SEQ ID NO: 1455767 - RNA, 13 nt, Homo sapiens
ugcaaugucacaa

SEQ ID NO: 1455768 - RNA, 22 nt, Homo sapiens
ugcaaugucacaaccucucuga

SEQ ID NO: 1455769 - RNA, 13 nt, Homo sapiens
ugcaaugugcuac

SEQ ID NO: 1455770 - RNA, 21 nt, Homo sapiens
ugcacagaauuuguauguauu

SEQ ID NO: 1455771 - RNA, 21 nt, Homo sapiens
ugcacaggcagauguuugccu

SEQ ID NO: 1455772 - RNA, 16 nt, Homo sapiens
ugcacaguaaaaaugg

SEQ ID NO: 1455773 - RNA, 19 nt, Homo sapiens
ugcacaguugccacauuua

SEQ ID NO: 1455774 - RNA, 20 nt, Homo sapiens
ugcaccaacaucuacaagau

SEQ ID NO: 1455775 - RNA, 19 nt, Homo sapiens
ugcaccagagcaaccucuc

SEQ ID NO: 1455776 - RNA, 21 nt, Homo sapiens
ugcacccaacuacugagcuga

SEQ ID NO: 1455777 - RNA, 15 nt, Homo sapiens
ugcacccacgugcau

SEQ ID NO: 1455778 - RNA, 19 nt, Homo sapiens
ugcaccuuucggcagagga

SEQ ID NO: 1455779 - RNA, 19 nt, Homo sapiens
ugcacgcgcgcgugcacac

SEQ ID NO: 1455780 - RNA, 14 nt, Homo sapiens
ugcacuaaagccag

SEQ ID NO: 1455781 - RNA, 19 nt, Homo sapiens
ugcacuaaagccagccuga

SEQ ID NO: 1455782 - RNA, 23 nt, Homo sapiens
ugcacugaauaaagcacgugcaa

SEQ ID NO: 1455783 - RNA, 15 nt, Homo sapiens
ugcacugagggccac

SEQ ID NO: 1455784 - RNA, 22 nt, Homo sapiens
ugcacuggggagcccgucucag

SEQ ID NO: 1455785 - RNA, 14 nt, Homo sapiens
ugcacuggggccac

SEQ ID NO: 1455786 - RNA, 22 nt, Homo sapiens
ugcacuguccugaccaucgcac

SEQ ID NO: 1455787 - RNA, 15 nt, Homo sapiens
ugcacugugaaggac

SEQ ID NO: 1455788 - RNA, 22 nt, Homo sapiens
ugcacuuauaagaaagaucaaa

SEQ ID NO: 1455789 - RNA, 21 nt, Homo sapiens
ugcacuuuagauauacauauc

SEQ ID NO: 1455790 - RNA, 22 nt, Homo sapiens
ugcacuuuagauauacauauca

SEQ ID NO: 1455791 - RNA, 23 nt, Homo sapiens
ugcagaaaaagaaaaaaacuaua

SEQ ID NO: 1455792 - RNA, 20 nt, Homo sapiens
ugcagaacaucgauauguau

SEQ ID NO: 1455793 - RNA, 20 nt, Homo sapiens
ugcagaggauaaggaggcac

SEQ ID NO: 1455794 - RNA, 21 nt, Homo sapiens
ugcagaggauaaggaggcacu

SEQ ID NO: 1455795 - RNA, 19 nt, Homo sapiens
ugcagaggucagacuaaga

SEQ ID NO: 1455796 - RNA, 18 nt, Homo sapiens
ugcagcaaggggacaucu

SEQ ID NO: 1455797 - RNA, 19 nt, Homo sapiens
ugcagcacucuuaucuaca

SEQ ID NO: 1455798 - RNA, 22 nt, Homo sapiens
ugcagcauggucccugccuuag

SEQ ID NO: 1455799 - RNA, 18 nt, Homo sapiens
ugcagccacaucacggca

SEQ ID NO: 1455800 - RNA, 15 nt, Homo sapiens
ugcagcccaugccca

SEQ ID NO: 1455801 - RNA, 17 nt, Homo sapiens
ugcagccuuugccuccc

SEQ ID NO: 1455802 - RNA, 19 nt, Homo sapiens
ugcaggagcaguuugccac

SEQ ID NO: 1455803 - RNA, 16 nt, Homo sapiens
ugcaggcgauggggca

SEQ ID NO: 1455804 - RNA, 21 nt, Homo sapiens
ugcaggcugcagucccuggaa

SEQ ID NO: 1455805 - RNA, 19 nt, Homo sapiens
ugcagggaaugcaauccuu

SEQ ID NO: 1455806 - RNA, 13 nt, Homo sapiens
ugcaggggucccc

SEQ ID NO: 1455807 - RNA, 22 nt, Homo sapiens
ugcagguguccugagcaccaca

SEQ ID NO: 1455808 - RNA, 21 nt, Homo sapiens
ugcagguuccuuaucugucac

SEQ ID NO: 1455809 - RNA, 17 nt, Homo sapiens
ugcaguagcacgaucuc

SEQ ID NO: 1455810 - RNA, 14 nt, Homo sapiens
ugcagucacuggag

SEQ ID NO: 1455811 - RNA, 15 nt, Homo sapiens
ugcagucaucuacuu

SEQ ID NO: 1455812 - RNA, 15 nt, Homo sapiens
ugcagucccuggaaa

SEQ ID NO: 1455813 - RNA, 20 nt, Homo sapiens
ugcagucggugguaccugag

SEQ ID NO: 1455814 - RNA, 21 nt, Homo sapiens
ugcagucggugguaccugaga

SEQ ID NO: 1455815 - RNA, 17 nt, Homo sapiens
ugcaguggcgugaucuc

SEQ ID NO: 1455816 - RNA, 16 nt, Homo sapiens
ugcaguuggacucuca

SEQ ID NO: 1455817 - RNA, 15 nt, Homo sapiens
ugcaguuucuucauc

SEQ ID NO: 1455818 - RNA, 14 nt, Homo sapiens
ugcaguuuuacuaa

SEQ ID NO: 1455819 - RNA, 22 nt, Homo sapiens
ugcaguuuuugccuggguccca

SEQ ID NO: 1455820 - RNA, 19 nt, Homo sapiens
ugcauaaauaugcagugau

SEQ ID NO: 1455821 - RNA, 14 nt, Homo sapiens
ugcauaauaagcua

SEQ ID NO: 1455822 - RNA, 16 nt, Homo sapiens
ugcauacuacucucaa

SEQ ID NO: 1455823 - RNA, 17 nt, Homo sapiens
ugcaucucaaaauuauu

SEQ ID NO: 1455824 - RNA, 23 nt, Homo sapiens
ugcaucuuuguuacuuccuuaug

SEQ ID NO: 1455825 - RNA, 19 nt, Homo sapiens
ugcauguaccauuugcaug

SEQ ID NO: 1455826 - RNA, 14 nt, Homo sapiens
ugcauucacauuga

SEQ ID NO: 1455827 - RNA, 13 nt, Homo sapiens
ugcauucuggcca

SEQ ID NO: 1455828 - RNA, 12 nt, Homo sapiens
ugcauugaacag

SEQ ID NO: 1455829 - RNA, 12 nt, Homo sapiens
ugcauugacuua

SEQ ID NO: 1455830 - RNA, 11 nt, Homo sapiens
ugcauuuacuu

SEQ ID NO: 1455831 - RNA, 15 nt, Homo sapiens
ugcauuuacuuuuaa

SEQ ID NO: 1455832 - RNA, 21 nt, Homo sapiens
ugcauuucaagcagcugaaga

SEQ ID NO: 1455833 - RNA, 22 nt, Homo sapiens
ugcauuucauaaacuaauagaa

SEQ ID NO: 1455834 - RNA, 14 nt, Homo sapiens
ugcauuuuuauuaa

SEQ ID NO: 1455835 - RNA, 16 nt, Homo sapiens
ugcauuuuugugaaau

SEQ ID NO: 1455836 - RNA, 10 nt, Homo sapiens
ugccaaaaau

SEQ ID NO: 1455837 - RNA, 13 nt, Homo sapiens
ugccaacugccag

SEQ ID NO: 1455838 - RNA, 22 nt, Homo sapiens
ugccaagagggucugauggcac

SEQ ID NO: 1455839 - RNA, 21 nt, Homo sapiens
ugccaaggaaacccccagugu

SEQ ID NO: 1455840 - RNA, 17 nt, Homo sapiens
ugccacagccagaggag

SEQ ID NO: 1455841 - RNA, 21 nt, Homo sapiens
ugccacaggaggggaaguagg

SEQ ID NO: 1455842 - RNA, 12 nt, Homo sapiens
ugccacagugug

SEQ ID NO: 1455843 - RNA, 16 nt, Homo sapiens
ugccaccaaaagugcu

SEQ ID NO: 1455844 - RNA, 19 nt, Homo sapiens
ugccaccacaccuggcuaa

SEQ ID NO: 1455845 - RNA, 11 nt, Homo sapiens
ugccacccaca

SEQ ID NO: 1455846 - RNA, 23 nt, Homo sapiens
ugccacccucacacacacagcug

SEQ ID NO: 1455847 - RNA, 14 nt, Homo sapiens
ugccacguggucac

SEQ ID NO: 1455848 - RNA, 11 nt, Homo sapiens
ugccacuaauu

SEQ ID NO: 1455849 - RNA, 18 nt, Homo sapiens
ugccagaaagcauaaaau

SEQ ID NO: 1455850 - RNA, 22 nt, Homo sapiens
ugccagaggcugaugucaagca

SEQ ID NO: 1455851 - RNA, 14 nt, Homo sapiens
uugaaugcugccag

SEQ ID NO: 1455852 - RNA, 15 nt, Homo sapiens
uugaauggguuugcu

SEQ ID NO: 1455853 - RNA, 22 nt, Homo sapiens
uugaauuaauaucccuacaugu

SEQ ID NO: 1455854 - RNA, 19 nt, Homo sapiens
uugacaaaaguaaauggga

SEQ ID NO: 1455855 - RNA, 13 nt, Homo sapiens
uugacacacagca

SEQ ID NO: 1455856 - RNA, 20 nt, Homo sapiens
uugacaccacaccaucaggc

SEQ ID NO: 1455857 - RNA, 17 nt, Homo sapiens
uugacacuuguugucca

SEQ ID NO: 1455858 - RNA, 14 nt, Homo sapiens
uugacauaacacua

SEQ ID NO: 1455859 - RNA, 11 nt, Homo sapiens
uugaccaaaga

SEQ ID NO: 1455860 - RNA, 17 nt, Homo sapiens
uugaccaagaacugcau

SEQ ID NO: 1455861 - RNA, 18 nt, Homo sapiens
uugaccaagaacugcaug

SEQ ID NO: 1455862 - RNA, 22 nt, Homo sapiens
uugaccacgucaucgggccaga

SEQ ID NO: 1455863 - RNA, 18 nt, Homo sapiens
uugaccggaucuacaccc

SEQ ID NO: 1455864 - RNA, 16 nt, Homo sapiens
uugaccugcugaaguc

SEQ ID NO: 1455865 - RNA, 16 nt, Homo sapiens
uugacuaacaagaaug

SEQ ID NO: 1455866 - RNA, 22 nt, Homo sapiens
uugacuagggauucaggcugcu

SEQ ID NO: 1455867 - RNA, 14 nt, Homo sapiens
uugacucauggcag

SEQ ID NO: 1455868 - RNA, 14 nt, Homo sapiens
uugagacaggagac

SEQ ID NO: 1455869 - RNA, 16 nt, Homo sapiens
uugagagcaacgucac

SEQ ID NO: 1455870 - RNA, 14 nt, Homo sapiens
uugagagccagugg

SEQ ID NO: 1455871 - RNA, 19 nt, Homo sapiens
uugagcagaagaucaagga

SEQ ID NO: 1455872 - RNA, 20 nt, Homo sapiens
uugagcaguggcugguccag

SEQ ID NO: 1455873 - RNA, 22 nt, Homo sapiens
uugagugguaaucauauguguc

SEQ ID NO: 1455874 - RNA, 16 nt, Homo sapiens
uugagugucaagcuga

SEQ ID NO: 1455875 - RNA, 22 nt, Homo sapiens
uugaguuuuuccucccagugag

SEQ ID NO: 1455876 - RNA, 19 nt, Homo sapiens
uugaugauuaauucaccuu

SEQ ID NO: 1455877 - RNA, 14 nt, Homo sapiens
uugaugcgacugua

SEQ ID NO: 1455878 - RNA, 18 nt, Homo sapiens
uugauguuuguggccuca

SEQ ID NO: 1455879 - RNA, 16 nt, Homo sapiens
uugauuaaaacauuau

SEQ ID NO: 1455880 - RNA, 21 nt, Homo sapiens
uugauugaggagcugcacuga

SEQ ID NO: 1455881 - RNA, 14 nt, Homo sapiens
uugauuggugauua

SEQ ID NO: 1455882 - RNA, 19 nt, Homo sapiens
uugauugucagcuacuaau

SEQ ID NO: 1455883 - RNA, 15 nt, Homo sapiens
uugauuuacauauau

SEQ ID NO: 1455884 - RNA, 17 nt, Homo sapiens
uugauuuguagcacuga

SEQ ID NO: 1455885 - RNA, 14 nt, Homo sapiens
uugcaacagacugu

SEQ ID NO: 1455886 - RNA, 17 nt, Homo sapiens
uugcaaccacugcaacg

SEQ ID NO: 1455887 - RNA, 15 nt, Homo sapiens
uugcaagaaucauua

SEQ ID NO: 1455888 - RNA, 15 nt, Homo sapiens
uugcacaauccauga

SEQ ID NO: 1455889 - RNA, 16 nt, Homo sapiens
uugcacacugcacugu

SEQ ID NO: 1455890 - RNA, 13 nt, Homo sapiens
uugcacagaauuu

SEQ ID NO: 1455891 - RNA, 11 nt, Homo sapiens
uugcacaggau

SEQ ID NO: 1455892 - RNA, 21 nt, Homo sapiens
uugcaccaggcacugcugcac

SEQ ID NO: 1455893 - RNA, 11 nt, Homo sapiens
uugcacuuugu

SEQ ID NO: 1455894 - RNA, 15 nt, Homo sapiens
uugcagcugauguug

SEQ ID NO: 1455895 - RNA, 13 nt, Homo sapiens
uugcagggcagcc

SEQ ID NO: 1455896 - RNA, 16 nt, Homo sapiens
uugcaggguccucuuc

SEQ ID NO: 1455897 - RNA, 23 nt, Homo sapiens
uugcagguggggguugcuguaua

SEQ ID NO: 1455898 - RNA, 16 nt, Homo sapiens
uugcauaggaauugca

SEQ ID NO: 1455899 - RNA, 21 nt, Homo sapiens
uugcaugaagagaagcaauuu

SEQ ID NO: 1455900 - RNA, 16 nt, Homo sapiens
uugccaaaaacaaaaa

SEQ ID NO: 1455901 - RNA, 18 nt, Homo sapiens
uugccaaagagaaacaaa

SEQ ID NO: 1455902 - RNA, 23 nt, Homo sapiens
uugccaacaccacagaaaugggg

SEQ ID NO: 1455903 - RNA, 23 nt, Homo sapiens
uugccaaucuuguuuuaagcaaa

SEQ ID NO: 1455904 - RNA, 13 nt, Homo sapiens
uugccacauuucu

SEQ ID NO: 1455905 - RNA, 12 nt, Homo sapiens
uugccacuuaac

SEQ ID NO: 1455906 - RNA, 19 nt, Homo sapiens
uugccauuaaacuuaccug

SEQ ID NO: 1455907 - RNA, 20 nt, Homo sapiens
uugcccaggcuggucucaaa

SEQ ID NO: 1455908 - RNA, 19 nt, Homo sapiens
uugccccuggcuuugccuc

SEQ ID NO: 1455909 - RNA, 23 nt, Homo sapiens
uugccucccgggcucaagcgauu

SEQ ID NO: 1455910 - RNA, 17 nt, Homo sapiens
uugccucuaccaguugg

SEQ ID NO: 1455911 - RNA, 19 nt, Homo sapiens
uugccuggggucugagcau

SEQ ID NO: 1455912 - RNA, 16 nt, Homo sapiens
uugccuucacccauaa

SEQ ID NO: 1455913 - RNA, 18 nt, Homo sapiens
uugccuucucuguucccu

SEQ ID NO: 1455914 - RNA, 15 nt, Homo sapiens
uugcuaaaagauuau

SEQ ID NO: 1455915 - RNA, 22 nt, Homo sapiens
uugcuaagaagcgagcacugac

SEQ ID NO: 1455916 - RNA, 14 nt, Homo sapiens
uugcuacauucuaa

SEQ ID NO: 1455917 - RNA, 18 nt, Homo sapiens
uugcuauaauaaagaagu

SEQ ID NO: 1455918 - RNA, 19 nt, Homo sapiens
uugcucuacaaugacacac

SEQ ID NO: 1455919 - RNA, 15 nt, Homo sapiens
uugcucucagcugcc

SEQ ID NO: 1455920 - RNA, 13 nt, Homo sapiens
uugcucugccacc

SEQ ID NO: 1455921 - RNA, 18 nt, Homo sapiens
uugcucuuacuacacuga

SEQ ID NO: 1455922 - RNA, 16 nt, Homo sapiens
uugcugguagcacuug

SEQ ID NO: 1455923 - RNA, 18 nt, Homo sapiens
uugcugguagcacuugcu

SEQ ID NO: 1455924 - RNA, 21 nt, Homo sapiens
uugcugucauaagaaugaaua

SEQ ID NO: 1455925 - RNA, 19 nt, Homo sapiens
uugcuguccugaucuguga

SEQ ID NO: 1455926 - RNA, 13 nt, Homo sapiens
uugcuguguaaaa

SEQ ID NO: 1455927 - RNA, 13 nt, Homo sapiens
uugcuguguuuaa

SEQ ID NO: 1455928 - RNA, 23 nt, Homo sapiens
uugcuucccggcgucccuaccuc

SEQ ID NO: 1455929 - RNA, 20 nt, Homo sapiens
uugcuucuguaguacuccuu

SEQ ID NO: 1455930 - RNA, 22 nt, Homo sapiens
uugcuugacaacaaccuaugca

SEQ ID NO: 1455931 - RNA, 15 nt, Homo sapiens
uugcuuggugcuggu

SEQ ID NO: 1455932 - RNA, 20 nt, Homo sapiens
uugcuuggugcugguuuauu

SEQ ID NO: 1455933 - RNA, 15 nt, Homo sapiens
uugcuuuauuccaga

SEQ ID NO: 1455934 - RNA, 11 nt, Homo sapiens
uugcuuucuau

SEQ ID NO: 1455935 - RNA, 19 nt, Homo sapiens
uugcuuugauuuacagcaa

SEQ ID NO: 1455936 - RNA, 21 nt, Homo sapiens
uuggaaauagaaagaagccau

SEQ ID NO: 1455937 - RNA, 16 nt, Homo sapiens
uuggacauccccagaa

SEQ ID NO: 1455938 - RNA, 19 nt, Homo sapiens
uuggacuguaagggauuga

SEQ ID NO: 1455939 - RNA, 21 nt, Homo sapiens
uuggagagucagaucuuucuc

SEQ ID NO: 1455940 - RNA, 12 nt, Homo sapiens
uuggagcugucu

SEQ ID NO: 1455941 - RNA, 19 nt, Homo sapiens
uuggagcuuuuuucuuuaa

SEQ ID NO: 1455942 - RNA, 18 nt, Homo sapiens
uuggagguaaauuauguc

SEQ ID NO: 1455943 - RNA, 18 nt, Homo sapiens
uuggagugcgggugggcu

SEQ ID NO: 1455944 - RNA, 12 nt, Homo sapiens
uuggaguuuucu

SEQ ID NO: 1455945 - RNA, 19 nt, Homo sapiens
uuggaucuucaauggcuuu

SEQ ID NO: 1455946 - RNA, 18 nt, Homo sapiens
uuggauuauucauuuaaa

SEQ ID NO: 1455947 - RNA, 12 nt, Homo sapiens
uuggcaaugcau

SEQ ID NO: 1455948 - RNA, 13 nt, Homo sapiens
uuggcacacagca

SEQ ID NO: 1455949 - RNA, 14 nt, Homo sapiens
uuggcaccagacac

SEQ ID NO: 1455950 - RNA, 20 nt, Homo sapiens
uuggcaccgcuucucagcca

SEQ ID NO: 1455951 - RNA, 15 nt, Homo sapiens
uuggcacugagauau

SEQ ID NO: 1455952 - RNA, 11 nt, Homo sapiens
uuggcacugug

SEQ ID NO: 1455953 - RNA, 16 nt, Homo sapiens
uuggcacuguggagcu

SEQ ID NO: 1455954 - RNA, 17 nt, Homo sapiens
uuuuucccagacuacua

SEQ ID NO: 1455955 - RNA, 13 nt, Homo sapiens
uuuuucuccagcu

SEQ ID NO: 1455956 - RNA, 22 nt, Homo sapiens
uuuuucuuugagacugggucuc

SEQ ID NO: 1455957 - RNA, 22 nt, Homo sapiens
uuuuugacucccagaucaguca

SEQ ID NO: 1455958 - RNA, 18 nt, Homo sapiens
uuuuugcugcugccucuu

SEQ ID NO: 1455959 - RNA, 14 nt, Homo sapiens
uuuuuggcagggag

SEQ ID NO: 1455960 - RNA, 14 nt, Homo sapiens
uuuuuguaacugga

SEQ ID NO: 1455961 - RNA, 14 nt, Homo sapiens
uuuuuguaauguga

SEQ ID NO: 1455962 - RNA, 13 nt, Homo sapiens
uuuuuuaaacuag

SEQ ID NO: 1455963 - RNA, 17 nt, Homo sapiens
uuuuuugccaaggcuaa

SEQ ID NO: 1455964 - RNA, 16 nt, Homo sapiens
uugcucuuucaucucu

SEQ ID NO: 1455965 - RNA, 18 nt, Homo sapiens
uugcugauggcuugacau

SEQ ID NO: 1455966 - RNA, 13 nt, Homo sapiens
uugcugaugguga

SEQ ID NO: 1455967 - RNA, 12 nt, Homo sapiens
uugcugcacuuu

SEQ ID NO: 1455968 - RNA, 11 nt, Homo sapiens
uugcuguauau

SEQ ID NO: 1455969 - RNA, 14 nt, Homo sapiens
uugcuuaaaucagu

SEQ ID NO: 1455970 - RNA, 17 nt, Homo sapiens
uugcuugggacauugca

SEQ ID NO: 1455971 - RNA, 18 nt, Homo sapiens
uugcuugugccacacccu

SEQ ID NO: 1455972 - RNA, 10 nt, Homo sapiens
uugcuuuaug

SEQ ID NO: 1455973 - RNA, 12 nt, Homo sapiens
uugcuuuccacu

SEQ ID NO: 1455974 - RNA, 18 nt, Homo sapiens
uugcuuuucacauccauu

SEQ ID NO: 1455975 - RNA, 20 nt, Homo sapiens
uuggaaaaacaacagcgaca

SEQ ID NO: 1455976 - RNA, 16 nt, Homo sapiens
uuggaauaaaacuguc

SEQ ID NO: 1455977 - RNA, 14 nt, Homo sapiens
uuggaauauuacaa

SEQ ID NO: 1455978 - RNA, 12 nt, Homo sapiens
uuggaaugcuuu

SEQ ID NO: 1455979 - RNA, 12 nt, Homo sapiens
uuggaauucacc

SEQ ID NO: 1455980 - RNA, 17 nt, Homo sapiens
uuggacagcugauaaau

SEQ ID NO: 1455981 - RNA, 17 nt, Homo sapiens
uuggagagaagggcauu

SEQ ID NO: 1455982 - RNA, 12 nt, Homo sapiens
uuggagcacucu

SEQ ID NO: 1455983 - RNA, 15 nt, Homo sapiens
uuggagcuacugcaa

SEQ ID NO: 1455984 - RNA, 20 nt, Homo sapiens
uuggagcugucccaccugca

SEQ ID NO: 1455985 - RNA, 18 nt, Homo sapiens
uuggauaaguuucuauuc

SEQ ID NO: 1455986 - RNA, 18 nt, Homo sapiens
uuggauauauuauuguaa

SEQ ID NO: 1455987 - RNA, 21 nt, Homo sapiens
uuggauuaugaagugacucuc

SEQ ID NO: 1455988 - RNA, 19 nt, Homo sapiens
uuggauuuauaaaugcuau

SEQ ID NO: 1455989 - RNA, 18 nt, Homo sapiens
uuggcaacaggacagagu

SEQ ID NO: 1455990 - RNA, 13 nt, Homo sapiens
uuggcaccagaca

SEQ ID NO: 1455991 - RNA, 17 nt, Homo sapiens
uuggcauaauagucaau

SEQ ID NO: 1455992 - RNA, 23 nt, Homo sapiens
uuggcaugccauugaaacuaaga

SEQ ID NO: 1455993 - RNA, 22 nt, Homo sapiens
uuggccucagaauucacaaaau

SEQ ID NO: 1455994 - RNA, 16 nt, Homo sapiens
uuggcuauaaccucca

SEQ ID NO: 1455995 - RNA, 14 nt, Homo sapiens
uuggcugaccccuc

SEQ ID NO: 1455996 - RNA, 17 nt, Homo sapiens
uuggcuuaaauaaucuc

SEQ ID NO: 1455997 - RNA, 18 nt, Homo sapiens
uuggcuuaaauaaucucu

SEQ ID NO: 1455998 - RNA, 18 nt, Homo sapiens
uugggacaauuguuuuaa

SEQ ID NO: 1455999 - RNA, 17 nt, Homo sapiens
uugggagacaugugaca

SEQ ID NO: 1456000 - RNA, 22 nt, Homo sapiens
uugggaggcugaggcaagagaa

SEQ ID NO: 1456001 - RNA, 21 nt, Homo sapiens
uugggauauucugaaacuuga

SEQ ID NO: 1456002 - RNA, 16 nt, Homo sapiens
uugggccagacaugcc

SEQ ID NO: 1456003 - RNA, 15 nt, Homo sapiens
uugggccugcuccag

SEQ ID NO: 1456004 - RNA, 23 nt, Homo sapiens
uugggcuuaguauuucucaggaa

SEQ ID NO: 1456005 - RNA, 13 nt, Homo sapiens
uuggggucaggaa

SEQ ID NO: 1456006 - RNA, 20 nt, Homo sapiens
uugguaguggaauagugaau

SEQ ID NO: 1456007 - RNA, 13 nt, Homo sapiens
uuggucaguuaca

SEQ ID NO: 1456008 - RNA, 23 nt, Homo sapiens
uuggucucugcccugccuacuuu

SEQ ID NO: 1456009 - RNA, 23 nt, Homo sapiens
uuggucuguuuugccuucaccca

SEQ ID NO: 1456010 - RNA, 22 nt, Homo sapiens
uuggugaauuucacaagcuauu

SEQ ID NO: 1456011 - RNA, 13 nt, Homo sapiens
uuggugcuagaaa

SEQ ID NO: 1456012 - RNA, 13 nt, Homo sapiens
uugguggauguga

SEQ ID NO: 1456013 - RNA, 20 nt, Homo sapiens
uugguggcgcgcaccuguag

SEQ ID NO: 1456014 - RNA, 13 nt, Homo sapiens
uugguuauucuaa

SEQ ID NO: 1456015 - RNA, 21 nt, Homo sapiens
uuguaaaagggaaagaaggcc

SEQ ID NO: 1456016 - RNA, 21 nt, Homo sapiens
uuguaagaaagacaagacauu

SEQ ID NO: 1456017 - RNA, 16 nt, Homo sapiens
uuguaagaguguagaa

SEQ ID NO: 1456018 - RNA, 19 nt, Homo sapiens
uuguaagggcucucaaaga

SEQ ID NO: 1456019 - RNA, 20 nt, Homo sapiens
uuguaagucaguguugagau

SEQ ID NO: 1456020 - RNA, 15 nt, Homo sapiens
uuguaagugcugcua

SEQ ID NO: 1456021 - RNA, 16 nt, Homo sapiens
uuguaagugcugcuau

SEQ ID NO: 1456022 - RNA, 23 nt, Homo sapiens
uuguaauaaauacugcagcuuga

SEQ ID NO: 1456023 - RNA, 15 nt, Homo sapiens
uuguaaucaagccuu

SEQ ID NO: 1456024 - RNA, 13 nt, Homo sapiens
uuguaauugcuua

SEQ ID NO: 1456025 - RNA, 22 nt, Homo sapiens
uuguacacugcuguacccagau

SEQ ID NO: 1456026 - RNA, 22 nt, Homo sapiens
uuguacaggaacugcauugacu

SEQ ID NO: 1456027 - RNA, 13 nt, Homo sapiens
uuguagagcagau

SEQ ID NO: 1456028 - RNA, 14 nt, Homo sapiens
uuguagaugugauu

SEQ ID NO: 1456029 - RNA, 16 nt, Homo sapiens
uuguagaugugauuaa

SEQ ID NO: 1456030 - RNA, 21 nt, Homo sapiens
uuguagggcuuuagcuuucuu

SEQ ID NO: 1456031 - RNA, 13 nt, Homo sapiens
uuguauaauuucg

SEQ ID NO: 1456032 - RNA, 20 nt, Homo sapiens
uuguauaggggcaacuguau

SEQ ID NO: 1456033 - RNA, 16 nt, Homo sapiens
uuguauauuauggaag

SEQ ID NO: 1456034 - RNA, 16 nt, Homo sapiens
uuguaucaaaguguga

SEQ ID NO: 1456035 - RNA, 15 nt, Homo sapiens
uuguaucuugccuaa

SEQ ID NO: 1456036 - RNA, 16 nt, Homo sapiens
uuguaucuuuuauccu

SEQ ID NO: 1456037 - RNA, 20 nt, Homo sapiens
uuguauuaguauugugaaua

SEQ ID NO: 1456038 - RNA, 14 nt, Homo sapiens
uuguauugacuauu

SEQ ID NO: 1456039 - RNA, 15 nt, Homo sapiens
uugucaaaaggaagu

SEQ ID NO: 1456040 - RNA, 21 nt, Homo sapiens
uugucaauauuaaauacagac

SEQ ID NO: 1456041 - RNA, 15 nt, Homo sapiens
uuuuaacugccaaga

SEQ ID NO: 1456042 - RNA, 22 nt, Homo sapiens
uuuuaagaagacauacugcuug

SEQ ID NO: 1456043 - RNA, 15 nt, Homo sapiens
uuuuaagcugcaaau

SEQ ID NO: 1456044 - RNA, 18 nt, Homo sapiens
uuuuaauacauugaucag

SEQ ID NO: 1456045 - RNA, 21 nt, Homo sapiens
uuuuaauccuuaacacauuca

SEQ ID NO: 1456046 - RNA, 13 nt, Homo sapiens
uuuuaauuuaaca

SEQ ID NO: 1456047 - RNA, 16 nt, Homo sapiens
uuuuacucugccuaca

SEQ ID NO: 1456048 - RNA, 11 nt, Homo sapiens
uuuuacuucca

SEQ ID NO: 1456049 - RNA, 13 nt, Homo sapiens
uuuuauauguugc

SEQ ID NO: 1456050 - RNA, 22 nt, Homo sapiens
uuuuaucacuucauucacauuc

SEQ ID NO: 1456051 - RNA, 22 nt, Homo sapiens
uuuuauggacaguaaguccagu

SEQ ID NO: 1456052 - RNA, 14 nt, Homo sapiens
uuuuauuacucuca

SEQ ID NO: 1456053 - RNA, 19 nt, Homo sapiens
uuuucaauuugagauucua

SEQ ID NO: 1456054 - RNA, 10 nt, Homo sapiens
uuuucacuga

SEQ ID NO: 1456055 - RNA, 22 nt, Homo sapiens
uuuucagaaaauauuauguguu

SEQ ID NO: 1456056 - RNA, 15 nt, Homo sapiens
uuuucagauccugaa

SEQ ID NO: 1456057 - RNA, 15 nt, Homo sapiens
uuuucaucacuggga

SEQ ID NO: 1456058 - RNA, 11 nt, Homo sapiens
uuuucauucau

SEQ ID NO: 1456059 - RNA, 12 nt, Homo sapiens
uuuuccacccau

SEQ ID NO: 1456060 - RNA, 21 nt, Homo sapiens
uuuuccaucauuuuacaguga

SEQ ID NO: 1456061 - RNA, 16 nt, Homo sapiens
uuuucccagucuguga

SEQ ID NO: 1456062 - RNA, 15 nt, Homo sapiens
uuuuccuccaggcaa

SEQ ID NO: 1456063 - RNA, 18 nt, Homo sapiens
uuuuccuguucagugaga

SEQ ID NO: 1456064 - RNA, 18 nt, Homo sapiens
uuucauuaaagaauguuu

SEQ ID NO: 1456065 - RNA, 11 nt, Homo sapiens
uuucauuccau

SEQ ID NO: 1456066 - RNA, 22 nt, Homo sapiens
uuucauuccuaacacagcaugu

SEQ ID NO: 1456067 - RNA, 21 nt, Homo sapiens
uuucauugcccgaaaccagag

SEQ ID NO: 1456068 - RNA, 21 nt, Homo sapiens
uuuccacgcaguucuuuccau

SEQ ID NO: 1456069 - RNA, 19 nt, Homo sapiens
uuuccagacuuccuugaga

SEQ ID NO: 1456070 - RNA, 12 nt, Homo sapiens
uuuccaucauuu

SEQ ID NO: 1456071 - RNA, 19 nt, Homo sapiens
uuuccauccauuaccucca

SEQ ID NO: 1456072 - RNA, 22 nt, Homo sapiens
uuuccaugcacccucauacaca

SEQ ID NO: 1456073 - RNA, 19 nt, Homo sapiens
uuucccagagucaucugau

SEQ ID NO: 1456074 - RNA, 20 nt, Homo sapiens
uuucccccgagcucuuggcc

SEQ ID NO: 1456075 - RNA, 23 nt, Homo sapiens
uuucccuaggaaacucacacucc

SEQ ID NO: 1456076 - RNA, 15 nt, Homo sapiens
uuucccuugaacugu

SEQ ID NO: 1456077 - RNA, 22 nt, Homo sapiens
uuuccucagccuuaagaaccau

SEQ ID NO: 1456078 - RNA, 15 nt, Homo sapiens
uuuccugcggcauca

SEQ ID NO: 1456079 - RNA, 19 nt, Homo sapiens
uuuccuuuuugacacugaa

SEQ ID NO: 1456080 - RNA, 21 nt, Homo sapiens
uuucggaggccccacugaugc

SEQ ID NO: 1456081 - RNA, 16 nt, Homo sapiens
uuucguagguugacua

SEQ ID NO: 1456082 - RNA, 17 nt, Homo sapiens
uuucgugcacucugcua

SEQ ID NO: 1456083 - RNA, 19 nt, Homo sapiens
uuucguuaacauugaccaa

SEQ ID NO: 1456084 - RNA, 13 nt, Homo sapiens
uuucuaagagaag

SEQ ID NO: 1456085 - RNA, 15 nt, Homo sapiens
uuucuaccagcucau

SEQ ID NO: 1456086 - RNA, 15 nt, Homo sapiens
uuucuagaagcacau

SEQ ID NO: 1456087 - RNA, 21 nt, Homo sapiens
gcuaaucaaagccagggucuc

SEQ ID NO: 1456088 - RNA, 17 nt, Homo sapiens
gcuaauccaauuauuau

SEQ ID NO: 1456089 - RNA, 21 nt, Homo sapiens
gcuaauguaauaacugugaag

SEQ ID NO: 1456090 - RNA, 20 nt, Homo sapiens
gcuacagagccgagcaauau

SEQ ID NO: 1456091 - RNA, 21 nt, Homo sapiens
gcuacauacuccaacugaaau

SEQ ID NO: 1456092 - RNA, 14 nt, Homo sapiens
gcuacgaccugguc

SEQ ID NO: 1456093 - RNA, 22 nt, Homo sapiens
gcuacugacuauggcuaccaaa

SEQ ID NO: 1456094 - RNA, 19 nt, Homo sapiens
gcuacugcaaaugcuauau

SEQ ID NO: 1456095 - RNA, 23 nt, Homo sapiens
gcuacuuuugcaggauaauaauu

SEQ ID NO: 1456096 - RNA, 15 nt, Homo sapiens
gcuagaaaacauuuu

SEQ ID NO: 1456097 - RNA, 15 nt, Homo sapiens
gcuagaaggcaaagu

SEQ ID NO: 1456098 - RNA, 18 nt, Homo sapiens
gcuagagcugacagcuuu

SEQ ID NO: 1456099 - RNA, 22 nt, Homo sapiens
gcuaggcgcuggggagacugau

SEQ ID NO: 1456100 - RNA, 11 nt, Homo sapiens
gcuaguauuug

SEQ ID NO: 1456101 - RNA, 18 nt, Homo sapiens
gcuagucugcccuaugga

SEQ ID NO: 1456102 - RNA, 20 nt, Homo sapiens
gcuagugacuugugucccau

SEQ ID NO: 1456103 - RNA, 15 nt, Homo sapiens
gcuaguguaccuccu

SEQ ID NO: 1456104 - RNA, 18 nt, Homo sapiens
gcuauaauaaagaagugu

SEQ ID NO: 1456105 - RNA, 19 nt, Homo sapiens
gcuauaccugcacguucau

SEQ ID NO: 1456106 - RNA, 22 nt, Homo sapiens
gcuaugaaaacagcuaucucac

SEQ ID NO: 1456107 - RNA, 23 nt, Homo sapiens
gcuauggucagguuauacuccuc

SEQ ID NO: 1456108 - RNA, 20 nt, Homo sapiens
gcuauucccucaaaucugag

SEQ ID NO: 1456109 - RNA, 19 nt, Homo sapiens
gcuauuucuucuacugcua

SEQ ID NO: 1456110 - RNA, 16 nt, Homo sapiens
gcucaaaucuauucag

SEQ ID NO: 1456111 - RNA, 22 nt, Homo sapiens
gcucaacagaacauauguugca

SEQ ID NO: 1456112 - RNA, 23 nt, Homo sapiens
gcucaauauuccugaaugaaaua

SEQ ID NO: 1456113 - RNA, 13 nt, Homo sapiens
gcucacaccaaau

SEQ ID NO: 1456114 - RNA, 18 nt, Homo sapiens
gcucacagauugagguaa

SEQ ID NO: 1456115 - RNA, 21 nt, Homo sapiens
gcucacccaagcaaggccaaa

SEQ ID NO: 1456116 - RNA, 16 nt, Homo sapiens
gcucagaacuugcugc

SEQ ID NO: 1456117 - RNA, 17 nt, Homo sapiens
gcucagauggacuggga

SEQ ID NO: 1456118 - RNA, 14 nt, Homo sapiens
gcucagccaagcuu

SEQ ID NO: 1456119 - RNA, 19 nt, Homo sapiens
gcucagcccugacuggugc

SEQ ID NO: 1456120 - RNA, 14 nt, Homo sapiens
gcucagcgccagcc

SEQ ID NO: 1456121 - RNA, 16 nt, Homo sapiens
gcucaggucaacugac

SEQ ID NO: 1456122 - RNA, 16 nt, Homo sapiens
gcucauagaucagcaa

SEQ ID NO: 1456123 - RNA, 13 nt, Homo sapiens
gcucaucacugga

SEQ ID NO: 1456124 - RNA, 19 nt, Homo sapiens
gcucaugccuguaaucuca

SEQ ID NO: 1456125 - RNA, 22 nt, Homo sapiens
gcuccaaccugcaaagaucugu

SEQ ID NO: 1456126 - RNA, 20 nt, Homo sapiens
gcuccaccagcagcauggca

SEQ ID NO: 1456127 - RNA, 21 nt, Homo sapiens
gcuccaccuuccaaaggaccu

SEQ ID NO: 1456128 - RNA, 16 nt, Homo sapiens
gcuccacgaagccuua

SEQ ID NO: 1456129 - RNA, 23 nt, Homo sapiens
gcuccacgaagccuuaagccaua

SEQ ID NO: 1456130 - RNA, 13 nt, Homo sapiens
gcuccacugucac

SEQ ID NO: 1456131 - RNA, 14 nt, Homo sapiens
gcuccagaaauguc

SEQ ID NO: 1456132 - RNA, 13 nt, Homo sapiens
gcuccagugcagg

SEQ ID NO: 1456133 - RNA, 14 nt, Homo sapiens
gcucccacagaaca

SEQ ID NO: 1456134 - RNA, 20 nt, Homo sapiens
gcuccccacaccuuccaggg

SEQ ID NO: 1456135 - RNA, 14 nt, Homo sapiens
gcuccccccagugg

SEQ ID NO: 1456136 - RNA, 20 nt, Homo sapiens
gcuccccuccucggcuuccu

SEQ ID NO: 1456137 - RNA, 14 nt, Homo sapiens
gcuccggccugucc

SEQ ID NO: 1456138 - RNA, 18 nt, Homo sapiens
gcuccuccugcccugucc

SEQ ID NO: 1456139 - RNA, 22 nt, Homo sapiens
gcuccucuaguaagaugcacug

SEQ ID NO: 1456140 - RNA, 14 nt, Homo sapiens
gcuccuggaaccaa

SEQ ID NO: 1456141 - RNA, 15 nt, Homo sapiens
gcucgagcaguccug

SEQ ID NO: 1456142 - RNA, 20 nt, Homo sapiens
gcucgugggauguccuacua

SEQ ID NO: 1456143 - RNA, 13 nt, Homo sapiens
gcucuacccauga

SEQ ID NO: 1456144 - RNA, 22 nt, Homo sapiens
gcucuauauaugaagugaaaaa

SEQ ID NO: 1456145 - RNA, 19 nt, Homo sapiens
gcucucagaagguauuccu

SEQ ID NO: 1456146 - RNA, 21 nt, Homo sapiens
gccucaguuuccucaucugca

SEQ ID NO: 1456147 - RNA, 21 nt, Homo sapiens
gccucauauuguccucugcaa

SEQ ID NO: 1456148 - RNA, 23 nt, Homo sapiens
gccucauauuuaaagacagggaa

SEQ ID NO: 1456149 - RNA, 16 nt, Homo sapiens
gccuccaagcacagag

SEQ ID NO: 1456150 - RNA, 17 nt, Homo sapiens
gccuccagcuucaggca

SEQ ID NO: 1456151 - RNA, 20 nt, Homo sapiens
gccuccauggcagaagucaa

SEQ ID NO: 1456152 - RNA, 13 nt, Homo sapiens
gccucccaccaga

SEQ ID NO: 1456153 - RNA, 19 nt, Homo sapiens
gccucccacccccaucucu

SEQ ID NO: 1456154 - RNA, 18 nt, Homo sapiens
gccucccugaagccuuug

SEQ ID NO: 1456155 - RNA, 15 nt, Homo sapiens
gccucccugccagua

SEQ ID NO: 1456156 - RNA, 19 nt, Homo sapiens
gccuccucccacaagcacc

SEQ ID NO: 1456157 - RNA, 17 nt, Homo sapiens
gccuccugcugccacaa

SEQ ID NO: 1456158 - RNA, 18 nt, Homo sapiens
gccucgggaccucaggug

SEQ ID NO: 1456159 - RNA, 18 nt, Homo sapiens
gccucuggaauugcucaa

SEQ ID NO: 1456160 - RNA, 19 nt, Homo sapiens
gccucuuuucucugugcuu

SEQ ID NO: 1456161 - RNA, 17 nt, Homo sapiens
gccugaaauuucaccau

SEQ ID NO: 1456162 - RNA, 21 nt, Homo sapiens
gccugaaguuugugggggcca

SEQ ID NO: 1456163 - RNA, 13 nt, Homo sapiens
gccugacaaccac

SEQ ID NO: 1456164 - RNA, 16 nt, Homo sapiens
gccugaccuuccuucc

SEQ ID NO: 1456165 - RNA, 20 nt, Homo sapiens
gccugagaggcaggcauaga

SEQ ID NO: 1456166 - RNA, 20 nt, Homo sapiens
gccugagcaacucuugauua

SEQ ID NO: 1456167 - RNA, 14 nt, Homo sapiens
gccugaucuugccu

SEQ ID NO: 1456168 - RNA, 18 nt, Homo sapiens
gccugaugcucccucccc

SEQ ID NO: 1456169 - RNA, 13 nt, Homo sapiens
gccugcaagcuuc

SEQ ID NO: 1456170 - RNA, 11 nt, Homo sapiens
gccugcacugg

SEQ ID NO: 1456171 - RNA, 16 nt, Homo sapiens
gccugcaucugugaaa

SEQ ID NO: 1456172 - RNA, 20 nt, Homo sapiens
gccugcccccuugggugacc

SEQ ID NO: 1456173 - RNA, 19 nt, Homo sapiens
gccugcuguggacccuguc

SEQ ID NO: 1456174 - RNA, 23 nt, Homo sapiens
gccuggaucuccccacucuaggg

SEQ ID NO: 1456175 - RNA, 21 nt, Homo sapiens
gccuggcaggccagugucugg

SEQ ID NO: 1456176 - RNA, 20 nt, Homo sapiens
gccuggccaacauggugaaa

SEQ ID NO: 1456177 - RNA, 20 nt, Homo sapiens
gccuggccaauacggcaaaa

SEQ ID NO: 1456178 - RNA, 21 nt, Homo sapiens
gccuggggcaggucacuuuac

SEQ ID NO: 1456179 - RNA, 15 nt, Homo sapiens
gccuggggucuggag

SEQ ID NO: 1456180 - RNA, 23 nt, Homo sapiens
gccugggucccacucaggugaaa

SEQ ID NO: 1456181 - RNA, 14 nt, Homo sapiens
gccuggugcagugg

SEQ ID NO: 1456182 - RNA, 20 nt, Homo sapiens
gccuguaaucccagcacuuu

SEQ ID NO: 1456183 - RNA, 22 nt, Homo sapiens
gccuguaaucccagcacuuugg

SEQ ID NO: 1456184 - RNA, 13 nt, Homo sapiens
gccuguaguccca

SEQ ID NO: 1456185 - RNA, 10 nt, Homo sapiens
gccugucauu

SEQ ID NO: 1456186 - RNA, 21 nt, Homo sapiens
gccugucccauggacacucca

SEQ ID NO: 1456187 - RNA, 17 nt, Homo sapiens
gccugugcccacucccu

SEQ ID NO: 1456188 - RNA, 12 nt, Homo sapiens
gccuguggaaug

SEQ ID NO: 1456189 - RNA, 22 nt, Homo sapiens
gccuguggguuugguccuugaa

SEQ ID NO: 1456190 - RNA, 15 nt, Homo sapiens
gccugugguuaacau

SEQ ID NO: 1456191 - RNA, 20 nt, Homo sapiens
gccugugguuaacaucucag

SEQ ID NO: 1456192 - RNA, 21 nt, Homo sapiens
gccugugguuaacaucucaga

SEQ ID NO: 1456193 - RNA, 20 nt, Homo sapiens
gccuuaaaccuaccucccac

SEQ ID NO: 1456194 - RNA, 16 nt, Homo sapiens
gccuuagugggccagg

SEQ ID NO: 1456195 - RNA, 16 nt, Homo sapiens
gccuuauaaaccaauc

SEQ ID NO: 1456196 - RNA, 14 nt, Homo sapiens
gccuuaucuugcac

SEQ ID NO: 1456197 - RNA, 19 nt, Homo sapiens
gccuucacgugucuguucc

SEQ ID NO: 1456198 - RNA, 17 nt, Homo sapiens
gccuucagcaugccuga

SEQ ID NO: 1456199 - RNA, 20 nt, Homo sapiens
gccuuccagcugcugucuuc

SEQ ID NO: 1456200 - RNA, 20 nt, Homo sapiens
gccuuccauaauuaugacag

SEQ ID NO: 1456201 - RNA, 16 nt, Homo sapiens
gccuucccaugaaucu

SEQ ID NO: 1456202 - RNA, 18 nt, Homo sapiens
gccuucuuauugcuuuua

SEQ ID NO: 1456203 - RNA, 16 nt, Homo sapiens
gccuugaaaccaccuu

SEQ ID NO: 1456204 - RNA, 14 nt, Homo sapiens
gccuugcuuguuaa

SEQ ID NO: 1456205 - RNA, 20 nt, Homo sapiens
gccuuugaauaaaaaugcac

SEQ ID NO: 1456206 - RNA, 15 nt, Homo sapiens
gccuuugacauuuaa

SEQ ID NO: 1456207 - RNA, 15 nt, Homo sapiens
gccuuuguuucccau

SEQ ID NO: 1456208 - RNA, 19 nt, Homo sapiens
gccuuuugcugcgcaccaa

SEQ ID NO: 1456209 - RNA, 19 nt, Homo sapiens
gccuuuugugcaaagccaa

SEQ ID NO: 1456210 - RNA, 20 nt, Homo sapiens
gccuuuuuguauaaaauaga

SEQ ID NO: 1456211 - RNA, 18 nt, Homo sapiens
gcgaaaaccuuccucagc

SEQ ID NO: 1456212 - RNA, 14 nt, Homo sapiens
gcgagcaccuguaa

SEQ ID NO: 1456213 - RNA, 20 nt, Homo sapiens
gcgagcacugugagcaccug

SEQ ID NO: 1456214 - RNA, 21 nt, Homo sapiens
gcgagcacugugagcaccuga

SEQ ID NO: 1456215 - RNA, 22 nt, Homo sapiens
gcgauccaccugucucagccuc

SEQ ID NO: 1456216 - RNA, 18 nt, Homo sapiens
gcgaugaggggacauuuu

SEQ ID NO: 1456217 - RNA, 15 nt, Homo sapiens
gcgccacugcacucc

SEQ ID NO: 1456218 - RNA, 22 nt, Homo sapiens
gcgccagccugucccauggaca

SEQ ID NO: 1456219 - RNA, 16 nt, Homo sapiens
gcgccuguaauuccag

SEQ ID NO: 1456220 - RNA, 19 nt, Homo sapiens
gcgccuguaauuccagcua

SEQ ID NO: 1456221 - RNA, 14 nt, Homo sapiens
gcgcgugcacacac

SEQ ID NO: 1456222 - RNA, 19 nt, Homo sapiens
gcgcucggcuccaccccag

SEQ ID NO: 1456223 - RNA, 18 nt, Homo sapiens
gcgcuucccaacuucaua

SEQ ID NO: 1456224 - RNA, 21 nt, Homo sapiens
gcggaaagccuguaagccugc

SEQ ID NO: 1456225 - RNA, 17 nt, Homo sapiens
gcggagguugcaaugag

SEQ ID NO: 1456226 - RNA, 19 nt, Homo sapiens
gcggagucuguccugugac

SEQ ID NO: 1456227 - RNA, 15 nt, Homo sapiens
gcgggaggcagaguu

SEQ ID NO: 1456228 - RNA, 20 nt, Homo sapiens
gcggugacucaugccuguaa

SEQ ID NO: 1456229 - RNA, 12 nt, Homo sapiens
gcgguggcucac

SEQ ID NO: 1456230 - RNA, 22 nt, Homo sapiens
gcgguggcucacgccuguaauc

SEQ ID NO: 1456231 - RNA, 21 nt, Homo sapiens
gcguauuggcuuuuucagagu

SEQ ID NO: 1456232 - RNA, 18 nt, Homo sapiens
gcgucccagucucuggca

SEQ ID NO: 1456233 - RNA, 12 nt, Homo sapiens
gcgugacaauaa

SEQ ID NO: 1456234 - RNA, 19 nt, Homo sapiens
gcgugauccaccacaccug

SEQ ID NO: 1456235 - RNA, 13 nt, Homo sapiens
gcgugauucaaug

SEQ ID NO: 1456236 - RNA, 20 nt, Homo sapiens
gcguggugcucuuugcugca

SEQ ID NO: 1456237 - RNA, 19 nt, Homo sapiens
gcguuacugcuugaccaaa

SEQ ID NO: 1456238 - RNA, 19 nt, Homo sapiens
gcguuguugcauguuugaa

SEQ ID NO: 1456239 - RNA, 22 nt, Homo sapiens
gcguuuuuuaaauguauacuau

SEQ ID NO: 1456240 - RNA, 20 nt, Homo sapiens
gcuaaaccaaggacugagca

SEQ ID NO: 1456241 - RNA, 16 nt, Homo sapiens
gcuaaacugaugacuu

SEQ ID NO: 1456242 - RNA, 17 nt, Homo sapiens
gcuaaacugaugacuua

SEQ ID NO: 1456243 - RNA, 21 nt, Homo sapiens
gcuaaaucauauuaguauuaa

SEQ ID NO: 1456244 - RNA, 11 nt, Homo sapiens
gcuaaaugcac

SEQ ID NO: 1456245 - RNA, 17 nt, Homo sapiens
gcuaagggugggugcuc

SEQ ID NO: 1456246 - RNA, 13 nt, Homo sapiens
gcuaaguacacaa

SEQ ID NO: 1456247 - RNA, 22 nt, Homo sapiens
gccagcuuacuagcacuuugag

SEQ ID NO: 1456248 - RNA, 16 nt, Homo sapiens
gccaggacgaauugag

SEQ ID NO: 1456249 - RNA, 16 nt, Homo sapiens
gccaggcuggucucaa

SEQ ID NO: 1456250 - RNA, 19 nt, Homo sapiens
gccagggucugugugaaug

SEQ ID NO: 1456251 - RNA, 22 nt, Homo sapiens
gccaggguggguguccaugugc

SEQ ID NO: 1456252 - RNA, 17 nt, Homo sapiens
gccaggugaacuggaau

SEQ ID NO: 1456253 - RNA, 14 nt, Homo sapiens
gccaggugagcucu

SEQ ID NO: 1456254 - RNA, 17 nt, Homo sapiens
gccagugccagcaccug

SEQ ID NO: 1456255 - RNA, 16 nt, Homo sapiens
gccagugccauuccac

SEQ ID NO: 1456256 - RNA, 18 nt, Homo sapiens
gccagugccucucacccc

SEQ ID NO: 1456257 - RNA, 13 nt, Homo sapiens
gccaguggugcua

SEQ ID NO: 1456258 - RNA, 14 nt, Homo sapiens
gccauaacagacca

SEQ ID NO: 1456259 - RNA, 19 nt, Homo sapiens
gccauaauucuaaguuauu

SEQ ID NO: 1456260 - RNA, 17 nt, Homo sapiens
gccaucaaauagugaau

SEQ ID NO: 1456261 - RNA, 12 nt, Homo sapiens
gccaucaugccu

SEQ ID NO: 1456262 - RNA, 15 nt, Homo sapiens
gccaucgccaaguaa

SEQ ID NO: 1456263 - RNA, 16 nt, Homo sapiens
gccaugagaugauaca

SEQ ID NO: 1456264 - RNA, 13 nt, Homo sapiens
gccaugagggaca

SEQ ID NO: 1456265 - RNA, 23 nt, Homo sapiens
gccaugccaggccagagggcagu

SEQ ID NO: 1456266 - RNA, 13 nt, Homo sapiens
gccauguccaaag

SEQ ID NO: 1456267 - RNA, 23 nt, Homo sapiens
gccauguuucaagaaaauggauu

SEQ ID NO: 1456268 - RNA, 17 nt, Homo sapiens
gccauucucccccucag

SEQ ID NO: 1456269 - RNA, 13 nt, Homo sapiens
gccauugaccacc

SEQ ID NO: 1456270 - RNA, 23 nt, Homo sapiens
gccauugaucauaaacugacuau

SEQ ID NO: 1456271 - RNA, 14 nt, Homo sapiens
gccauugcacucca

SEQ ID NO: 1456272 - RNA, 13 nt, Homo sapiens
gccauuguucacc

SEQ ID NO: 1456273 - RNA, 22 nt, Homo sapiens
gccauuuuggguuuugggucuu

SEQ ID NO: 1456274 - RNA, 16 nt, Homo sapiens
gcccaaauucuuucag

SEQ ID NO: 1456275 - RNA, 15 nt, Homo sapiens
gcccaacugcgcaga

SEQ ID NO: 1456276 - RNA, 22 nt, Homo sapiens
gcccaagcuucccuccaucccc

SEQ ID NO: 1456277 - RNA, 15 nt, Homo sapiens
gcccacacccaggcc

SEQ ID NO: 1456278 - RNA, 13 nt, Homo sapiens
gcccacacuugag

SEQ ID NO: 1456279 - RNA, 13 nt, Homo sapiens
gcccacaucccag

SEQ ID NO: 1456280 - RNA, 21 nt, Homo sapiens
gcccacgccuguaaucccagc

SEQ ID NO: 1456281 - RNA, 19 nt, Homo sapiens
gcccacuguuaauauucua

SEQ ID NO: 1456282 - RNA, 21 nt, Homo sapiens
gcccagagcaggaagcauuca

SEQ ID NO: 1456283 - RNA, 15 nt, Homo sapiens
gcccagagccuggcu

SEQ ID NO: 1456284 - RNA, 16 nt, Homo sapiens
gcccagaggguggcaa

SEQ ID NO: 1456285 - RNA, 21 nt, Homo sapiens
gcccagaucgcaccacugcac

SEQ ID NO: 1456286 - RNA, 19 nt, Homo sapiens
gcccagccccuacugcugu

SEQ ID NO: 1456287 - RNA, 13 nt, Homo sapiens
gcccagccuggga

SEQ ID NO: 1456288 - RNA, 14 nt, Homo sapiens
gcccagcgcggcca

SEQ ID NO: 1456289 - RNA, 17 nt, Homo sapiens
gcccaggagaccacggg

SEQ ID NO: 1456290 - RNA, 19 nt, Homo sapiens
gcccaggcuggagugcagu

SEQ ID NO: 1456291 - RNA, 22 nt, Homo sapiens
gcccaucacaggguugggccca

SEQ ID NO: 1456292 - RNA, 21 nt, Homo sapiens
gcccauccaaacacugaggca

SEQ ID NO: 1456293 - RNA, 14 nt, Homo sapiens
gcccauccagucuc

SEQ ID NO: 1456294 - RNA, 22 nt, Homo sapiens
gcccaugccaaggccucccuca

SEQ ID NO: 1456295 - RNA, 16 nt, Homo sapiens
gcccauuucuccauac

SEQ ID NO: 1456296 - RNA, 22 nt, Homo sapiens
gccccacacagcuacagcuuuc

SEQ ID NO: 1456297 - RNA, 14 nt, Homo sapiens
gccccacccaagcc

SEQ ID NO: 1456298 - RNA, 20 nt, Homo sapiens
gccccauccaacacuggaug

SEQ ID NO: 1456299 - RNA, 22 nt, Homo sapiens
gcccccacugucccccuaccca

SEQ ID NO: 1456300 - RNA, 13 nt, Homo sapiens
gcccccagcagag

SEQ ID NO: 1456301 - RNA, 13 nt, Homo sapiens
gcccccaguggga

SEQ ID NO: 1456302 - RNA, 22 nt, Homo sapiens
gccccccagccuucacugacag

SEQ ID NO: 1456303 - RNA, 18 nt, Homo sapiens
gcccccuugggugaccuc

SEQ ID NO: 1456304 - RNA, 20 nt, Homo sapiens
gccccggcaagccacaggaa

SEQ ID NO: 1456305 - RNA, 17 nt, Homo sapiens
gccccggccuccucgga

SEQ ID NO: 1456306 - RNA, 17 nt, Homo sapiens
gccccucccaacccagc

SEQ ID NO: 1456307 - RNA, 19 nt, Homo sapiens
gccccucugaccugcacug

SEQ ID NO: 1456308 - RNA, 16 nt, Homo sapiens
ccuggcucugcaaugg

SEQ ID NO: 1456309 - RNA, 13 nt, Homo sapiens
ccuggcugaugau

SEQ ID NO: 1456310 - RNA, 16 nt, Homo sapiens
ccuggcuuuuacuuua

SEQ ID NO: 1456311 - RNA, 14 nt, Homo sapiens
ccugggagacagac

SEQ ID NO: 1456312 - RNA, 22 nt, Homo sapiens
ccugggaugaggggugcugggu

SEQ ID NO: 1456313 - RNA, 16 nt, Homo sapiens
ccugggcccuuccuau

SEQ ID NO: 1456314 - RNA, 21 nt, Homo sapiens
ccuggggagugguuaggcagc

SEQ ID NO: 1456315 - RNA, 17 nt, Homo sapiens
ccuggggcgagcacugu

SEQ ID NO: 1456316 - RNA, 19 nt, Homo sapiens
ccuggggcgagcacuguga

SEQ ID NO: 1456317 - RNA, 20 nt, Homo sapiens
ccuggggcgagcacugugag

SEQ ID NO: 1456318 - RNA, 15 nt, Homo sapiens
ccuggggcugugcau

SEQ ID NO: 1456319 - RNA, 22 nt, Homo sapiens
ccugggugacauuugggagaca

SEQ ID NO: 1456320 - RNA, 17 nt, Homo sapiens
ccuggucaacaugguga

SEQ ID NO: 1456321 - RNA, 13 nt, Homo sapiens
ccuggugcugcug

SEQ ID NO: 1456322 - RNA, 17 nt, Homo sapiens
ccuguaauauuuagcug

SEQ ID NO: 1456323 - RNA, 20 nt, Homo sapiens
ccuguaaucccagcuacuug

SEQ ID NO: 1456324 - RNA, 19 nt, Homo sapiens
ccuguaaucucagcacuuu

SEQ ID NO: 1456325 - RNA, 20 nt, Homo sapiens
ccuguaaucucagcacuuug

SEQ ID NO: 1456326 - RNA, 12 nt, Homo sapiens
ccuguacauaug

SEQ ID NO: 1456327 - RNA, 20 nt, Homo sapiens
ccuguaccucaucccaugag

SEQ ID NO: 1456328 - RNA, 16 nt, Homo sapiens
ccuguacggacacugu

SEQ ID NO: 1456329 - RNA, 13 nt, Homo sapiens
gcagaacuugaag

SEQ ID NO: 1456330 - RNA, 18 nt, Homo sapiens
gcagaagcagaagugcaa

SEQ ID NO: 1456331 - RNA, 22 nt, Homo sapiens
gcagaagucaacgccucggugg

SEQ ID NO: 1456332 - RNA, 13 nt, Homo sapiens
gcagaagugcaau

SEQ ID NO: 1456333 - RNA, 13 nt, Homo sapiens
gcagaauaaucuu

SEQ ID NO: 1456334 - RNA, 14 nt, Homo sapiens
gcagaauccagcua

SEQ ID NO: 1456335 - RNA, 15 nt, Homo sapiens
gcagacaaguggaca

SEQ ID NO: 1456336 - RNA, 15 nt, Homo sapiens
gcagacaccagcagc

SEQ ID NO: 1456337 - RNA, 21 nt, Homo sapiens
gcagacagcuccacccuggcc

SEQ ID NO: 1456338 - RNA, 15 nt, Homo sapiens
gcagacuacacagga

SEQ ID NO: 1456339 - RNA, 17 nt, Homo sapiens
gcagacuacacaggaug

SEQ ID NO: 1456340 - RNA, 19 nt, Homo sapiens
gcagagaaacuuaagcaaa

SEQ ID NO: 1456341 - RNA, 18 nt, Homo sapiens
gcagagcaaagugcggug

SEQ ID NO: 1456342 - RNA, 23 nt, Homo sapiens
gcagagcaccuuugcacaggaug

SEQ ID NO: 1456343 - RNA, 14 nt, Homo sapiens
gcagaggagccaug

SEQ ID NO: 1456344 - RNA, 15 nt, Homo sapiens
gcagaggcaacacug

SEQ ID NO: 1456345 - RNA, 21 nt, Homo sapiens
gcagaggcuguggugagccaa

SEQ ID NO: 1456346 - RNA, 19 nt, Homo sapiens
gcagagguaaaagugugag

SEQ ID NO: 1456347 - RNA, 21 nt, Homo sapiens
gcagaggucagacuaagaaau

SEQ ID NO: 1456348 - RNA, 21 nt, Homo sapiens
gcagauccccacuguccuacc

SEQ ID NO: 1456349 - RNA, 18 nt, Homo sapiens
gcagcaccaaccacagca

SEQ ID NO: 1456350 - RNA, 19 nt, Homo sapiens
gcagcaccguucugugcac

SEQ ID NO: 1456351 - RNA, 20 nt, Homo sapiens
gcagcaccguucugugcaca

SEQ ID NO: 1456352 - RNA, 14 nt, Homo sapiens
gcagccaacccggc

SEQ ID NO: 1456353 - RNA, 19 nt, Homo sapiens
gcagccacaaccaaaaaau

SEQ ID NO: 1456354 - RNA, 13 nt, Homo sapiens
gcagccaccagcg

SEQ ID NO: 1456355 - RNA, 22 nt, Homo sapiens
gcagccccgucugcccaccauu

SEQ ID NO: 1456356 - RNA, 17 nt, Homo sapiens
gcagcgccaggcugacc

SEQ ID NO: 1456357 - RNA, 16 nt, Homo sapiens
gcagcgccagugacag

SEQ ID NO: 1456358 - RNA, 15 nt, Homo sapiens
gcagcuacucagagg

SEQ ID NO: 1456359 - RNA, 21 nt, Homo sapiens
gcagcucccauuucaucagca

SEQ ID NO: 1456360 - RNA, 18 nt, Homo sapiens
gcagcuggggcuagggga

SEQ ID NO: 1456361 - RNA, 19 nt, Homo sapiens
gcagcugguggaagaccug

SEQ ID NO: 1456362 - RNA, 21 nt, Homo sapiens
gcagcuuuaaacucagggaca

SEQ ID NO: 1456363 - RNA, 18 nt, Homo sapiens
gcaggagaaucacuggaa

SEQ ID NO: 1456364 - RNA, 17 nt, Homo sapiens
gcaggagaauggcguga

SEQ ID NO: 1456365 - RNA, 18 nt, Homo sapiens
gcaggagaauggugugaa

SEQ ID NO: 1456366 - RNA, 20 nt, Homo sapiens
gcaggaguggugcagacaga

SEQ ID NO: 1456367 - RNA, 15 nt, Homo sapiens
gcaggcugggccaug

SEQ ID NO: 1456368 - RNA, 17 nt, Homo sapiens
gcagggcccagugacaa

SEQ ID NO: 1456369 - RNA, 22 nt, Homo sapiens
cagagaagcggauuuccaggga

SEQ ID NO: 1456370 - RNA, 22 nt, Homo sapiens
cagagacacuaacgacuucagg

SEQ ID NO: 1456371 - RNA, 17 nt, Homo sapiens
cagagacauacuugaag

SEQ ID NO: 1456372 - RNA, 23 nt, Homo sapiens
cagagagccauuuugugaaugga

SEQ ID NO: 1456373 - RNA, 18 nt, Homo sapiens
cagagaugaacaucuaac

SEQ ID NO: 1456374 - RNA, 15 nt, Homo sapiens
cagagcaaccucuca

SEQ ID NO: 1456375 - RNA, 14 nt, Homo sapiens
cagagcaagacugu

SEQ ID NO: 1456376 - RNA, 17 nt, Homo sapiens
cagagcacccccugcuc

SEQ ID NO: 1456377 - RNA, 21 nt, Homo sapiens
cagagcaccuuugcacaggau

SEQ ID NO: 1456378 - RNA, 13 nt, Homo sapiens
cagagcaguuuca

SEQ ID NO: 1456379 - RNA, 16 nt, Homo sapiens
cagagcauacaacaga

SEQ ID NO: 1456380 - RNA, 15 nt, Homo sapiens
cagagccagaugcag

SEQ ID NO: 1456381 - RNA, 16 nt, Homo sapiens
cagagccagucucacc

SEQ ID NO: 1456382 - RNA, 15 nt, Homo sapiens
cagagcuauggugcu

SEQ ID NO: 1456383 - RNA, 22 nt, Homo sapiens
cagaggaauaacaucaccacug

SEQ ID NO: 1456384 - RNA, 22 nt, Homo sapiens
cagaggcagcccgcacaccugc

SEQ ID NO: 1456385 - RNA, 21 nt, Homo sapiens
cagagggcaguggcccuccac

SEQ ID NO: 1456386 - RNA, 22 nt, Homo sapiens
cagagggcggggagaaucucag

SEQ ID NO: 1456387 - RNA, 16 nt, Homo sapiens
cagagggcuugugaac

SEQ ID NO: 1456388 - RNA, 13 nt, Homo sapiens
cagagguauuccu

SEQ ID NO: 1456389 - RNA, 13 nt, Homo sapiens
cagaggucuccca

SEQ ID NO: 1456390 - RNA, 12 nt, Homo sapiens
cagagucaucuc

SEQ ID NO: 1456391 - RNA, 19 nt, Homo sapiens
cagagucugggccucugac

SEQ ID NO: 1456392 - RNA, 19 nt, Homo sapiens
cagagucuucagagacuuc

SEQ ID NO: 1456393 - RNA, 22 nt, Homo sapiens
cagaguuggacuucuagacuca

SEQ ID NO: 1456394 - RNA, 18 nt, Homo sapiens
cagaguuugccuuccuuu

SEQ ID NO: 1456395 - RNA, 16 nt, Homo sapiens
cagauaacaccaaacc

SEQ ID NO: 1456396 - RNA, 13 nt, Homo sapiens
cagauaccucacc

SEQ ID NO: 1456397 - RNA, 18 nt, Homo sapiens
cagauagauauaugcucu

SEQ ID NO: 1456398 - RNA, 20 nt, Homo sapiens
cagauagcaucagaccugca

SEQ ID NO: 1456399 - RNA, 23 nt, Homo sapiens
cagauagguggugccaguggcuu

SEQ ID NO: 1456400 - RNA, 19 nt, Homo sapiens
cagauauauuuaagccuua

SEQ ID NO: 1456401 - RNA, 12 nt, Homo sapiens
cagauauuucac

SEQ ID NO: 1456402 - RNA, 19 nt, Homo sapiens
cagaucgcaccacugcacu

SEQ ID NO: 1456403 - RNA, 23 nt, Homo sapiens
cagaucuaucuugucaaucccaa

SEQ ID NO: 1456404 - RNA, 22 nt, Homo sapiens
cagaucuggucuaguuaaccua

SEQ ID NO: 1456405 - RNA, 23 nt, Homo sapiens
cagaucuggucuaguuaaccuag

SEQ ID NO: 1456406 - RNA, 22 nt, Homo sapiens
cagaucuuugcugccagccacu

SEQ ID NO: 1456407 - RNA, 15 nt, Homo sapiens
cagaugaaaugcauc

SEQ ID NO: 1456408 - RNA, 21 nt, Homo sapiens
cagaugaaauguucuguucac

SEQ ID NO: 1456409 - RNA, 20 nt, Homo sapiens
cagaugaacucuuucuggcc

SEQ ID NO: 1456410 - RNA, 22 nt, Homo sapiens
cagaugauauaauuuaacugug

SEQ ID NO: 1456411 - RNA, 14 nt, Homo sapiens
cagaugaucucucc

SEQ ID NO: 1456412 - RNA, 15 nt, Homo sapiens
cagaugcagggcagu

SEQ ID NO: 1456413 - RNA, 19 nt, Homo sapiens
cagauggaaaaacugaggc

SEQ ID NO: 1456414 - RNA, 19 nt, Homo sapiens
cagauggaaacucuuuaac

SEQ ID NO: 1456415 - RNA, 13 nt, Homo sapiens
cagaugggccacg

SEQ ID NO: 1456416 - RNA, 19 nt, Homo sapiens
cagaugugaaaacaucuca

SEQ ID NO: 1456417 - RNA, 13 nt, Homo sapiens
cagauuggaccag

SEQ ID NO: 1456418 - RNA, 16 nt, Homo sapiens
cagauuuacuaaauca

SEQ ID NO: 1456419 - RNA, 16 nt, Homo sapiens
cagcaaccugacucag

SEQ ID NO: 1456420 - RNA, 20 nt, Homo sapiens
cagcaagcccuacagagcug

SEQ ID NO: 1456421 - RNA, 12 nt, Homo sapiens
cagcaagcuuug

SEQ ID NO: 1456422 - RNA, 16 nt, Homo sapiens
cagcaaggcccugcug

SEQ ID NO: 1456423 - RNA, 18 nt, Homo sapiens
cagcaaggggacaucuua

SEQ ID NO: 1456424 - RNA, 17 nt, Homo sapiens
cagcaaugacaucucag

SEQ ID NO: 1456425 - RNA, 21 nt, Homo sapiens
cagcaauggugucaguaucca

SEQ ID NO: 1456426 - RNA, 13 nt, Homo sapiens
cagcaauuccuga

SEQ ID NO: 1456427 - RNA, 16 nt, Homo sapiens
cagcaauuugauaaaa

SEQ ID NO: 1456428 - RNA, 16 nt, Homo sapiens
cagcacacagggcagu

SEQ ID NO: 1456429 - RNA, 20 nt, Homo sapiens
cagcacaccugccgucuuca

SEQ ID NO: 1456430 - RNA, 10 nt, Homo sapiens
cagcacuaac

SEQ ID NO: 1456431 - RNA, 17 nt, Homo sapiens
cagcacucugaaacuga

SEQ ID NO: 1456432 - RNA, 19 nt, Homo sapiens
cagcacucugaaacugaga

SEQ ID NO: 1456433 - RNA, 17 nt, Homo sapiens
cagcagaacuucugaaa

SEQ ID NO: 1456434 - RNA, 16 nt, Homo sapiens
cagcagcccuaaggau

SEQ ID NO: 1456435 - RNA, 23 nt, Homo sapiens
cagcagcccuaaggaucucucag

SEQ ID NO: 1456436 - RNA, 18 nt, Homo sapiens
cagcagugaguaaucaau

SEQ ID NO: 1456437 - RNA, 21 nt, Homo sapiens
cagcaguguucucacagugug

SEQ ID NO: 1456438 - RNA, 19 nt, Homo sapiens
cagcaucacuccccaagga

SEQ ID NO: 1456439 - RNA, 21 nt, Homo sapiens
cagcaugaccugugaccagca

SEQ ID NO: 1456440 - RNA, 22 nt, Homo sapiens
cagcaugaggacagaccacaga

SEQ ID NO: 1456441 - RNA, 13 nt, Homo sapiens
cagcaugccuuca

SEQ ID NO: 1456442 - RNA, 19 nt, Homo sapiens
cagcaugccuucaaaucaa

SEQ ID NO: 1456443 - RNA, 17 nt, Homo sapiens
cagcauucucacuccua

SEQ ID NO: 1456444 - RNA, 14 nt, Homo sapiens
cagcauugccagua

SEQ ID NO: 1456445 - RNA, 18 nt, Homo sapiens
cagcauuuagucuugcca

SEQ ID NO: 1456446 - RNA, 14 nt, Homo sapiens
cagccaacugaaaa

SEQ ID NO: 1456447 - RNA, 13 nt, Homo sapiens
cagccaaguguga

SEQ ID NO: 1456448 - RNA, 12 nt, Homo sapiens
cagccacaacca

SEQ ID NO: 1456449 - RNA, 13 nt, Homo sapiens
cagccagauccuc

SEQ ID NO: 1456450 - RNA, 19 nt, Homo sapiens
cagccaggacaucucugcc

SEQ ID NO: 1456451 - RNA, 15 nt, Homo sapiens
cagccaggcugcuaa

SEQ ID NO: 1456452 - RNA, 15 nt, Homo sapiens
cagccagugccauuc

SEQ ID NO: 1456453 - RNA, 19 nt, Homo sapiens
cagccaucaaauagugaau

SEQ ID NO: 1456454 - RNA, 15 nt, Homo sapiens
cagcccaaagcugca

SEQ ID NO: 1456455 - RNA, 14 nt, Homo sapiens
cagcccaaccuuca

SEQ ID NO: 1456456 - RNA, 18 nt, Homo sapiens
cagcccaaccuucacauc

SEQ ID NO: 1456457 - RNA, 19 nt, Homo sapiens
cagcccagacccaguggac

SEQ ID NO: 1456458 - RNA, 12 nt, Homo sapiens
cagccccggggu

SEQ ID NO: 1456459 - RNA, 21 nt, Homo sapiens
cagcccuagagccugccugga

SEQ ID NO: 1456460 - RNA, 16 nt, Homo sapiens
cagcccucaacaggcc

SEQ ID NO: 1456461 - RNA, 16 nt, Homo sapiens
cagcccugacuggugc

SEQ ID NO: 1456462 - RNA, 13 nt, Homo sapiens
cagcccugcagug

SEQ ID NO: 1456463 - RNA, 14 nt, Homo sapiens
cagacuacacagga

SEQ ID NO: 1456464 - RNA, 15 nt, Homo sapiens
cagacuacacaggau

SEQ ID NO: 1456465 - RNA, 14 nt, Homo sapiens
cagacucccauucc

SEQ ID NO: 1456466 - RNA, 15 nt, Homo sapiens
cagacuggagugcag

SEQ ID NO: 1456467 - RNA, 17 nt, Homo sapiens
cagagaaaaaugcuccc

SEQ ID NO: 1456468 - RNA, 23 nt, Homo sapiens
cagagaaaggggagcccacuguc

SEQ ID NO: 1456469 - RNA, 19 nt, Homo sapiens
cagagaaauacuuucaggc

SEQ ID NO: 1456470 - RNA, 23 nt, Homo sapiens
auggaccagugguuuccagucau

SEQ ID NO: 1456471 - RNA, 20 nt, Homo sapiens
auggacuuccacugccaucc

SEQ ID NO: 1456472 - RNA, 19 nt, Homo sapiens
auggagaggcggccucgug

SEQ ID NO: 1456473 - RNA, 22 nt, Homo sapiens
auggaggccagugccagcaccu

SEQ ID NO: 1456474 - RNA, 18 nt, Homo sapiens
auggagggaaugcucaga

SEQ ID NO: 1456475 - RNA, 19 nt, Homo sapiens
auggaggucauacaugcau

SEQ ID NO: 1456476 - RNA, 22 nt, Homo sapiens
auggaugaaucucccacuccag

SEQ ID NO: 1456477 - RNA, 14 nt, Homo sapiens
auggcaaacugcca

SEQ ID NO: 1456478 - RNA, 22 nt, Homo sapiens
auggcaccacugcacuccagcc

SEQ ID NO: 1456479 - RNA, 16 nt, Homo sapiens
auggcagaaccaaagc

SEQ ID NO: 1456480 - RNA, 15 nt, Homo sapiens
auggcagaagacacc

SEQ ID NO: 1456481 - RNA, 18 nt, Homo sapiens
auggcagcuguuucucau

SEQ ID NO: 1456482 - RNA, 16 nt, Homo sapiens
auggccuuugcuuaug

SEQ ID NO: 1456483 - RNA, 17 nt, Homo sapiens
auggcucuggcacagug

SEQ ID NO: 1456484 - RNA, 19 nt, Homo sapiens
augggaagcauguggauga

SEQ ID NO: 1456485 - RNA, 14 nt, Homo sapiens
augggaccagggau

SEQ ID NO: 1456486 - RNA, 18 nt, Homo sapiens
augggagcugaggccaca

SEQ ID NO: 1456487 - RNA, 16 nt, Homo sapiens
augggagggcauucca

SEQ ID NO: 1456488 - RNA, 23 nt, Homo sapiens
augggagggggcuugaagccaaa

SEQ ID NO: 1456489 - RNA, 14 nt, Homo sapiens
augggagugggcac

SEQ ID NO: 1456490 - RNA, 17 nt, Homo sapiens
augggauucagugcuuc

SEQ ID NO: 1456491 - RNA, 20 nt, Homo sapiens
augggcuccugccccuuuca

SEQ ID NO: 1456492 - RNA, 20 nt, Homo sapiens
augggcucuuccaacaagga

SEQ ID NO: 1456493 - RNA, 16 nt, Homo sapiens
auggggaaaaaacugu

SEQ ID NO: 1456494 - RNA, 15 nt, Homo sapiens
augggggcaucucuu

SEQ ID NO: 1456495 - RNA, 15 nt, Homo sapiens
augggggccaggaca

SEQ ID NO: 1456496 - RNA, 12 nt, Homo sapiens
auggguccaggg

SEQ ID NO: 1456497 - RNA, 12 nt, Homo sapiens
augguccagaaa

SEQ ID NO: 1456498 - RNA, 14 nt, Homo sapiens
augguccagaaacu

SEQ ID NO: 1456499 - RNA, 20 nt, Homo sapiens
augguccaggaucuccacug

SEQ ID NO: 1456500 - RNA, 16 nt, Homo sapiens
auggucuaacacuggc

SEQ ID NO: 1456501 - RNA, 16 nt, Homo sapiens
auggugaaacccuguc

SEQ ID NO: 1456502 - RNA, 19 nt, Homo sapiens
auggugaagaacuagcaua

SEQ ID NO: 1456503 - RNA, 20 nt, Homo sapiens
auggugcaaauccuacugaa

SEQ ID NO: 1456504 - RNA, 20 nt, Homo sapiens
augguggcgcgcaccuguaa

SEQ ID NO: 1456505 - RNA, 17 nt, Homo sapiens
auggugguaacugauaa

SEQ ID NO: 1456506 - RNA, 19 nt, Homo sapiens
augguggugugugccugua

SEQ ID NO: 1456507 - RNA, 13 nt, Homo sapiens
auggugucaugcc

SEQ ID NO: 1456508 - RNA, 15 nt, Homo sapiens
augguucccaauaaa

SEQ ID NO: 1456509 - RNA, 15 nt, Homo sapiens
augguugauggaaaa

SEQ ID NO: 1456510 - RNA, 15 nt, Homo sapiens
augguuuccauuuac

SEQ ID NO: 1456511 - RNA, 19 nt, Homo sapiens
augguuuuacucaugugca

SEQ ID NO: 1456512 - RNA, 13 nt, Homo sapiens
auguaaacauaag

SEQ ID NO: 1456513 - RNA, 14 nt, Homo sapiens
auguaauuuaugca

SEQ ID NO: 1456514 - RNA, 15 nt, Homo sapiens
auguacagacauaca

SEQ ID NO: 1456515 - RNA, 13 nt, Homo sapiens
auguacuauccaa

SEQ ID NO: 1456516 - RNA, 15 nt, Homo sapiens
auguagauuuguaca

SEQ ID NO: 1456517 - RNA, 18 nt, Homo sapiens
auguaucaaugaguaaca

SEQ ID NO: 1456518 - RNA, 14 nt, Homo sapiens
auguaugugcacug

SEQ ID NO: 1456519 - RNA, 18 nt, Homo sapiens
augucacaaccucucuga

SEQ ID NO: 1456520 - RNA, 18 nt, Homo sapiens
augucacagggccaacuu

SEQ ID NO: 1456521 - RNA, 22 nt, Homo sapiens
augucacagggccaacuugagg

SEQ ID NO: 1456522 - RNA, 20 nt, Homo sapiens
augucauagguaagaaacac

SEQ ID NO: 1456523 - RNA, 14 nt, Homo sapiens
augucauauuccau

SEQ ID NO: 1456524 - RNA, 22 nt, Homo sapiens
auguccagaagaauauucagga

SEQ ID NO: 1456525 - RNA, 17 nt, Homo sapiens
auguccauuuauaucau

SEQ ID NO: 1456526 - RNA, 15 nt, Homo sapiens
auguccucagcauuu

SEQ ID NO: 1456527 - RNA, 22 nt, Homo sapiens
augucuaauaaaauauaaucua

SEQ ID NO: 1456528 - RNA, 17 nt, Homo sapiens
augucuauaaucccagc

SEQ ID NO: 1456529 - RNA, 19 nt, Homo sapiens
augucuaucaacuuuaauc

SEQ ID NO: 1456530 - RNA, 22 nt, Homo sapiens
augucuguagcuccucaacuca

SEQ ID NO: 1456531 - RNA, 22 nt, Homo sapiens
augucuuuuacccggcacauuc

SEQ ID NO: 1456532 - RNA, 19 nt, Homo sapiens
augucuuuuauuuacuuuu

SEQ ID NO: 1456533 - RNA, 14 nt, Homo sapiens
augugaaagucaaa

SEQ ID NO: 1456534 - RNA, 20 nt, Homo sapiens
augugaacaaccugcucaca

SEQ ID NO: 1456535 - RNA, 21 nt, Homo sapiens
augugagugccuuuugcagaa

SEQ ID NO: 1456536 - RNA, 22 nt, Homo sapiens
augugauuuuccuuuguagcua

SEQ ID NO: 1456537 - RNA, 17 nt, Homo sapiens
augugccaauaaccaag

SEQ ID NO: 1456538 - RNA, 14 nt, Homo sapiens
augugccaguuccu

SEQ ID NO: 1456539 - RNA, 13 nt, Homo sapiens
augugcugucacg

SEQ ID NO: 1456540 - RNA, 21 nt, Homo sapiens
auguggaagaacuuaggcauc

SEQ ID NO: 1456541 - RNA, 19 nt, Homo sapiens
auguggagcuacugaugaa

SEQ ID NO: 1456542 - RNA, 14 nt, Homo sapiens
auguggcauguuca

SEQ ID NO: 1456543 - RNA, 15 nt, Homo sapiens
auguggcccucugga

SEQ ID NO: 1456544 - RNA, 19 nt, Homo sapiens
auguggcccucuggaucca

SEQ ID NO: 1456545 - RNA, 20 nt, Homo sapiens
augugguguauauccuucca

SEQ ID NO: 1456546 - RNA, 17 nt, Homo sapiens
augugucaucaggagaa

SEQ ID NO: 1456547 - RNA, 22 nt, Homo sapiens
auguguccccucacucugucag

SEQ ID NO: 1456548 - RNA, 20 nt, Homo sapiens
augugugguggccucagcug

SEQ ID NO: 1456549 - RNA, 21 nt, Homo sapiens
auguuaaagguucacaggggu

SEQ ID NO: 1456550 - RNA, 16 nt, Homo sapiens
auguuaaccucagugu

SEQ ID NO: 1456551 - RNA, 18 nt, Homo sapiens
auguuaaggaaacucuua

SEQ ID NO: 1456552 - RNA, 12 nt, Homo sapiens
auguuacagauu

SEQ ID NO: 1456553 - RNA, 13 nt, Homo sapiens
auguuacugacca

SEQ ID NO: 1456554 - RNA, 16 nt, Homo sapiens
auguuagaaugagauc

SEQ ID NO: 1456555 - RNA, 20 nt, Homo sapiens
auguuagagaauuuccuuac

SEQ ID NO: 1456556 - RNA, 19 nt, Homo sapiens
auguuagggugcucuggaa

SEQ ID NO: 1456557 - RNA, 12 nt, Homo sapiens
auguuauaucau

SEQ ID NO: 1456558 - RNA, 20 nt, Homo sapiens
auguuauguaccauaugauc

SEQ ID NO: 1456559 - RNA, 22 nt, Homo sapiens
auguuauuuuguguacaaguug

SEQ ID NO: 1456560 - RNA, 19 nt, Homo sapiens
auguucagaauguacggaa

SEQ ID NO: 1456561 - RNA, 17 nt, Homo sapiens
auguuccgagaagaaca

SEQ ID NO: 1456562 - RNA, 15 nt, Homo sapiens
auguucucagauuuc

SEQ ID NO: 1456563 - RNA, 15 nt, Homo sapiens
auguucugacauuaa

SEQ ID NO: 1456564 - RNA, 19 nt, Homo sapiens
auguucuuuaaaggcaucu

SEQ ID NO: 1456565 - RNA, 18 nt, Homo sapiens
auguuguaagaaagacaa

SEQ ID NO: 1456566 - RNA, 20 nt, Homo sapiens
auguuguugaggcugucaca

SEQ ID NO: 1456567 - RNA, 14 nt, Homo sapiens
auguuuaaagauca

SEQ ID NO: 1456568 - RNA, 17 nt, Homo sapiens
auguuuauuuacuaauu

SEQ ID NO: 1456569 - RNA, 19 nt, Homo sapiens
auguuuauuuuucuugucu

SEQ ID NO: 1456570 - RNA, 15 nt, Homo sapiens
auguuugaaugauuu

SEQ ID NO: 1456571 - RNA, 20 nt, Homo sapiens
cacucccucugccuucaggc

SEQ ID NO: 1456572 - RNA, 21 nt, Homo sapiens
cacucccuugguggcaagagc

SEQ ID NO: 1456573 - RNA, 16 nt, Homo sapiens
cacucucuucccuuuc

SEQ ID NO: 1456574 - RNA, 14 nt, Homo sapiens
cacucugaaacuga

SEQ ID NO: 1456575 - RNA, 17 nt, Homo sapiens
cacucugggcuguaacg

SEQ ID NO: 1456576 - RNA, 23 nt, Homo sapiens
cacucugguggcaggugccuugu

SEQ ID NO: 1456577 - RNA, 16 nt, Homo sapiens
aucagaccauaauguu

SEQ ID NO: 1456578 - RNA, 13 nt, Homo sapiens
aucagacuaguga

SEQ ID NO: 1456579 - RNA, 16 nt, Homo sapiens
aucagacuagugacaa

SEQ ID NO: 1456580 - RNA, 15 nt, Homo sapiens
aucagagggugacug

SEQ ID NO: 1456581 - RNA, 20 nt, Homo sapiens
aucagaguuccuccuacuua

SEQ ID NO: 1456582 - RNA, 14 nt, Homo sapiens
aucagauacaucac

SEQ ID NO: 1456583 - RNA, 17 nt, Homo sapiens
aucagcaaccugacuca

SEQ ID NO: 1456584 - RNA, 15 nt, Homo sapiens
aucagcaucacccgg

SEQ ID NO: 1456585 - RNA, 18 nt, Homo sapiens
aucagcuuucagggccau

SEQ ID NO: 1456586 - RNA, 18 nt, Homo sapiens
aucaggacagguggugca

SEQ ID NO: 1456587 - RNA, 15 nt, Homo sapiens
aucagggacaggaug

SEQ ID NO: 1456588 - RNA, 17 nt, Homo sapiens
aucaggggauacaggcc

SEQ ID NO: 1456589 - RNA, 21 nt, Homo sapiens
aucaggggugcauucuggcca

SEQ ID NO: 1456590 - RNA, 12 nt, Homo sapiens
aucaggucuccc

SEQ ID NO: 1456591 - RNA, 17 nt, Homo sapiens
aucagugaagaugccag

SEQ ID NO: 1456592 - RNA, 16 nt, Homo sapiens
aucaguguuguugcuc

SEQ ID NO: 1456593 - RNA, 14 nt, Homo sapiens
aucauaaaaucaaa

SEQ ID NO: 1456594 - RNA, 16 nt, Homo sapiens
aucauacuuacuaguu

SEQ ID NO: 1456595 - RNA, 23 nt, Homo sapiens
aucaucaaagcucacaccaaauu

SEQ ID NO: 1456596 - RNA, 14 nt, Homo sapiens
aucauccaagacag

SEQ ID NO: 1456597 - RNA, 18 nt, Homo sapiens
aucauccccauccuccag

SEQ ID NO: 1456598 - RNA, 22 nt, Homo sapiens
aucaucuauaaagaagaacuug

SEQ ID NO: 1456599 - RNA, 13 nt, Homo sapiens
aucaucuguagau

SEQ ID NO: 1456600 - RNA, 16 nt, Homo sapiens
aucauggcaacauaau

SEQ ID NO: 1456601 - RNA, 16 nt, Homo sapiens
aucauucccucucauc

SEQ ID NO: 1456602 - RNA, 20 nt, Homo sapiens
auccaaaaauagcccugcaa

SEQ ID NO: 1456603 - RNA, 14 nt, Homo sapiens
auccaaacacugag

SEQ ID NO: 1456604 - RNA, 21 nt, Homo sapiens
auccaaagaacuugauuugca

SEQ ID NO: 1456605 - RNA, 19 nt, Homo sapiens
auccaacacuggaugguca

SEQ ID NO: 1456606 - RNA, 14 nt, Homo sapiens
auccaacauccaga

SEQ ID NO: 1456607 - RNA, 23 nt, Homo sapiens
auccaagaaggccuucauggccc

SEQ ID NO: 1456608 - RNA, 23 nt, Homo sapiens
auccaaggguugagagccagugg

SEQ ID NO: 1456609 - RNA, 15 nt, Homo sapiens
auccaaucugugaug

SEQ ID NO: 1456610 - RNA, 20 nt, Homo sapiens
auccacaaaugaagggauau

SEQ ID NO: 1456611 - RNA, 19 nt, Homo sapiens
auccaccaagaacauaaga

SEQ ID NO: 1456612 - RNA, 17 nt, Homo sapiens
auccagaacugcacucu

SEQ ID NO: 1456613 - RNA, 19 nt, Homo sapiens
auccagaggguugugauuu

SEQ ID NO: 1456614 - RNA, 20 nt, Homo sapiens
auccagcaauuccugagcca

SEQ ID NO: 1456615 - RNA, 12 nt, Homo sapiens
auccagcacugg

SEQ ID NO: 1456616 - RNA, 17 nt, Homo sapiens
auccagcacuggugaac

SEQ ID NO: 1456617 - RNA, 20 nt, Homo sapiens
auccagcucuugcucaguga

SEQ ID NO: 1456618 - RNA, 17 nt, Homo sapiens
auccaggacucugucaa

SEQ ID NO: 1456619 - RNA, 20 nt, Homo sapiens
auccagggcccccaucucau

SEQ ID NO: 1456620 - RNA, 17 nt, Homo sapiens
auccauaacuuuagucu

SEQ ID NO: 1456621 - RNA, 23 nt, Homo sapiens
auccauaggcgcaggugcacagg

SEQ ID NO: 1456622 - RNA, 17 nt, Homo sapiens
auccaugaacagcauua

SEQ ID NO: 1456623 - RNA, 21 nt, Homo sapiens
auccauguuaguuuuuacuuu

SEQ ID NO: 1456624 - RNA, 18 nt, Homo sapiens
auccauuaccuccaucca

SEQ ID NO: 1456625 - RNA, 20 nt, Homo sapiens
auccauuaccuccauccauc

SEQ ID NO: 1456626 - RNA, 15 nt, Homo sapiens
aucccagcacuuugg

SEQ ID NO: 1456627 - RNA, 14 nt, Homo sapiens
aucccaguacucug

SEQ ID NO: 1456628 - RNA, 17 nt, Homo sapiens
aucccauccaucagcuc

SEQ ID NO: 1456629 - RNA, 17 nt, Homo sapiens
aucccauggaaccacua

SEQ ID NO: 1456630 - RNA, 15 nt, Homo sapiens
aucccauguauuuau

SEQ ID NO: 1456631 - RNA, 11 nt, Homo sapiens
auccccacugu

SEQ ID NO: 1456632 - RNA, 12 nt, Homo sapiens
auccccaucucc

SEQ ID NO: 1456633 - RNA, 17 nt, Homo sapiens
auccccuggacugggag

SEQ ID NO: 1456634 - RNA, 22 nt, Homo sapiens
aucccguaccucuucccaugac

SEQ ID NO: 1456635 - RNA, 23 nt, Homo sapiens
aucccguaccucuucccaugacu

SEQ ID NO: 1456636 - RNA, 19 nt, Homo sapiens
aucccucgggaagcagcca

SEQ ID NO: 1456637 - RNA, 22 nt, Homo sapiens
aucccugacaucuggaaucugg

SEQ ID NO: 1456638 - RNA, 16 nt, Homo sapiens
aucccugccuguuaag

SEQ ID NO: 1456639 - RNA, 21 nt, Homo sapiens
aucccuggggcugugcauucc

SEQ ID NO: 1456640 - RNA, 18 nt, Homo sapiens
aucccuguaauauuuagc

SEQ ID NO: 1456641 - RNA, 12 nt, Homo sapiens
auccuaccccac

SEQ ID NO: 1456642 - RNA, 15 nt, Homo sapiens
auccuagccaacauc

SEQ ID NO: 1456643 - RNA, 15 nt, Homo sapiens
auccuagucauucuu

SEQ ID NO: 1456644 - RNA, 18 nt, Homo sapiens
auccucaaacgacagagg

SEQ ID NO: 1456645 - RNA, 13 nt, Homo sapiens
auccucaagagaa

SEQ ID NO: 1456646 - RNA, 14 nt, Homo sapiens
auccucaugcugcu

SEQ ID NO: 1456647 - RNA, 16 nt, Homo sapiens
auccugagucaugugu

SEQ ID NO: 1456648 - RNA, 22 nt, Homo sapiens
auccuguaccaaaucugacaua

SEQ ID NO: 1456649 - RNA, 22 nt, Homo sapiens
auccuguauucuucaaccagug

SEQ ID NO: 1456650 - RNA, 18 nt, Homo sapiens
auccugucuuuaaggaaa

SEQ ID NO: 1456651 - RNA, 16 nt, Homo sapiens
auccuuaacacauuca

SEQ ID NO: 1456652 - RNA, 15 nt, Homo sapiens
auccuuccaaagaau

SEQ ID NO: 1456653 - RNA, 18 nt, Homo sapiens
auccuucuccaccaaaga

SEQ ID NO: 1456654 - RNA, 14 nt, Homo sapiens
auccuugcaggugg

SEQ ID NO: 1456655 - RNA, 24 nt, Homo sapiens
auccuuggaaauuggaagagcaca

SEQ ID NO: 1456656 - RNA, 14 nt, Homo sapiens
aucgaucaugaugu

SEQ ID NO: 1456657 - RNA, 13 nt, Homo sapiens
aucgcaaaucaaa

SEQ ID NO: 1456658 - RNA, 15 nt, Homo sapiens
aucggccuccaugac

SEQ ID NO: 1456659 - RNA, 22 nt, Homo sapiens
aucguccagcgaccuuccucau

SEQ ID NO: 1456660 - RNA, 18 nt, Homo sapiens
aucguccucccaggccag

SEQ ID NO: 1456661 - RNA, 19 nt, Homo sapiens
aucguggccuugaccucca

SEQ ID NO: 1456662 - RNA, 20 nt, Homo sapiens
aucguuccaguucccacuug

SEQ ID NO: 1456663 - RNA, 14 nt, Homo sapiens
aucuaaaaacuuag

SEQ ID NO: 1456664 - RNA, 17 nt, Homo sapiens
aucuaaaaacuuagaaa

SEQ ID NO: 1456665 - RNA, 14 nt, Homo sapiens
aucuaaggauguca

SEQ ID NO: 1456666 - RNA, 17 nt, Homo sapiens
aucuaaggaugucacag

SEQ ID NO: 1456667 - RNA, 20 nt, Homo sapiens
aucuaaggaugucacagggc

SEQ ID NO: 1456668 - RNA, 22 nt, Homo sapiens
aucuaauauggccacaguaguc

SEQ ID NO: 1456669 - RNA, 17 nt, Homo sapiens
aucuaauuacaucauga

SEQ ID NO: 1456670 - RNA, 13 nt, Homo sapiens
aucuacaagccaa

SEQ ID NO: 1456671 - RNA, 12 nt, Homo sapiens
aucuacacagcc

SEQ ID NO: 1456672 - RNA, 22 nt, Homo sapiens
aucuacuucaacacuucaugua

SEQ ID NO: 1456673 - RNA, 20 nt, Homo sapiens
aucuagguguggcugugaag

SEQ ID NO: 1456674 - RNA, 15 nt, Homo sapiens
aucuagguucaggaa

SEQ ID NO: 1456675 - RNA, 22 nt, Homo sapiens
aucuagguucaggaagaccaca

SEQ ID NO: 1456676 - RNA, 19 nt, Homo sapiens
aucuauaaagaagaacuug

SEQ ID NO: 1456677 - RNA, 18 nt, Homo sapiens
aucuauagcuaaguacac

SEQ ID NO: 1456678 - RNA, 21 nt, Homo sapiens
augacgucaucaucacauuca

SEQ ID NO: 1456679 - RNA, 14 nt, Homo sapiens
cuucgacucaggau

SEQ ID NO: 1456680 - RNA, 19 nt, Homo sapiens
cuucgaggcuuuacagugu

SEQ ID NO: 1456681 - RNA, 17 nt, Homo sapiens
cuucggcagcuacucag

SEQ ID NO: 1456682 - RNA, 19 nt, Homo sapiens
cuucggggcgaugcucccu

SEQ ID NO: 1456683 - RNA, 21 nt, Homo sapiens
cuucguguucuguauucugac

SEQ ID NO: 1456684 - RNA, 18 nt, Homo sapiens
cuucuaaaaacuucucaa

SEQ ID NO: 1456685 - RNA, 21 nt, Homo sapiens
cuucuaaacccaauccaaaug

SEQ ID NO: 1456686 - RNA, 16 nt, Homo sapiens
cuucuacugcuaucua

SEQ ID NO: 1456687 - RNA, 21 nt, Homo sapiens
cuucuaggucacuucucacaa

SEQ ID NO: 1456688 - RNA, 11 nt, Homo sapiens
cuucucaagac

SEQ ID NO: 1456689 - RNA, 19 nt, Homo sapiens
cuucucagccacaaacccu

SEQ ID NO: 1456690 - RNA, 15 nt, Homo sapiens
cuucucaucugcaaa

SEQ ID NO: 1456691 - RNA, 14 nt, Homo sapiens
cuucuccaccaaag

SEQ ID NO: 1456692 - RNA, 15 nt, Homo sapiens
cuucuccaccaaaga

SEQ ID NO: 1456693 - RNA, 17 nt, Homo sapiens
cuucuccgccagccucc

SEQ ID NO: 1456694 - RNA, 14 nt, Homo sapiens
cuucucuccuugcc

SEQ ID NO: 1456695 - RNA, 22 nt, Homo sapiens
cuucugaugucucuaaagcacu

SEQ ID NO: 1456696 - RNA, 17 nt, Homo sapiens
cuucugcaacaucuuaa

SEQ ID NO: 1456697 - RNA, 15 nt, Homo sapiens
cuucugcucagcucu

SEQ ID NO: 1456698 - RNA, 23 nt, Homo sapiens
cuucuggggcaggcugggccaug

SEQ ID NO: 1456699 - RNA, 16 nt, Homo sapiens
cuucuguucugcagac

SEQ ID NO: 1456700 - RNA, 22 nt, Homo sapiens
cuucuuauggaauugauuugca

SEQ ID NO: 1456701 - RNA, 14 nt, Homo sapiens
cuucuucagaagac

SEQ ID NO: 1456702 - RNA, 13 nt, Homo sapiens
cuucuuguucccc

SEQ ID NO: 1456703 - RNA, 19 nt, Homo sapiens
cuucuuucccuuagugacu

SEQ ID NO: 1456704 - RNA, 23 nt, Homo sapiens
cuugaaaagcuaguguaccuccu

SEQ ID NO: 1456705 - RNA, 14 nt, Homo sapiens
cuugaaaccaaaga

SEQ ID NO: 1456706 - RNA, 15 nt, Homo sapiens
cuugaagccaaagaa

SEQ ID NO: 1456707 - RNA, 16 nt, Homo sapiens
cuugaaggugcugacg

SEQ ID NO: 1456708 - RNA, 13 nt, Homo sapiens
cuugaaucaaagc

SEQ ID NO: 1456709 - RNA, 19 nt, Homo sapiens
cuugaauuccugaccucag

SEQ ID NO: 1456710 - RNA, 12 nt, Homo sapiens
cuugacaugugc

SEQ ID NO: 1456711 - RNA, 17 nt, Homo sapiens
cuugaccguacucucac

SEQ ID NO: 1456712 - RNA, 15 nt, Homo sapiens
cuugacucauggcag

SEQ ID NO: 1456713 - RNA, 13 nt, Homo sapiens
cuugacugcauug

SEQ ID NO: 1456714 - RNA, 21 nt, Homo sapiens
cuugagaaaccuuauuguacc

SEQ ID NO: 1456715 - RNA, 12 nt, Homo sapiens
cuugagugcucu

SEQ ID NO: 1456716 - RNA, 14 nt, Homo sapiens
cuugaguguguuac

SEQ ID NO: 1456717 - RNA, 20 nt, Homo sapiens
cuugaguuggaguacuauau

SEQ ID NO: 1456718 - RNA, 18 nt, Homo sapiens
cuugauacauguaauucu

SEQ ID NO: 1456719 - RNA, 19 nt, Homo sapiens
cuugauagcaaacacuggg

SEQ ID NO: 1456720 - RNA, 15 nt, Homo sapiens
cuugaugcaugcaca

SEQ ID NO: 1456721 - RNA, 20 nt, Homo sapiens
cuugauuagugccuucugcc

SEQ ID NO: 1456722 - RNA, 12 nt, Homo sapiens
cuugauuccagu

SEQ ID NO: 1456723 - RNA, 21 nt, Homo sapiens
cuugauuccugguuugacuca

SEQ ID NO: 1456724 - RNA, 17 nt, Homo sapiens
cuugcagcuaguuuucu

SEQ ID NO: 1456725 - RNA, 18 nt, Homo sapiens
cuugcagcugauguugga

SEQ ID NO: 1456726 - RNA, 18 nt, Homo sapiens
cuugcaguuaaggguuag

SEQ ID NO: 1456727 - RNA, 16 nt, Homo sapiens
cuugcaguugcucuga

SEQ ID NO: 1456728 - RNA, 17 nt, Homo sapiens
cuugcaguugcucugac

SEQ ID NO: 1456729 - RNA, 17 nt, Homo sapiens
cuugcauaggcucuuaa

SEQ ID NO: 1456730 - RNA, 15 nt, Homo sapiens
cuugcauagucaaua

SEQ ID NO: 1456731 - RNA, 12 nt, Homo sapiens
cuugccagagau

SEQ ID NO: 1456732 - RNA, 20 nt, Homo sapiens
cuugccuaaggugcguaguc

SEQ ID NO: 1456733 - RNA, 15 nt, Homo sapiens
cuugccuaucaaaga

SEQ ID NO: 1456734 - RNA, 17 nt, Homo sapiens
cuugcucuguuacccag

SEQ ID NO: 1456735 - RNA, 18 nt, Homo sapiens
cuugcugacaacuuccag

SEQ ID NO: 1456736 - RNA, 16 nt, Homo sapiens
cuugcugcugagugca

SEQ ID NO: 1456737 - RNA, 21 nt, Homo sapiens
cuugcugcugcugcacccaac

SEQ ID NO: 1456738 - RNA, 19 nt, Homo sapiens
cuugcuucucuagcucucu

SEQ ID NO: 1456739 - RNA, 16 nt, Homo sapiens
cuuggacaaaccuaga

SEQ ID NO: 1456740 - RNA, 14 nt, Homo sapiens
cuuggacaagacaa

SEQ ID NO: 1456741 - RNA, 21 nt, Homo sapiens
cuuggacuguguuuuuccucc

SEQ ID NO: 1456742 - RNA, 18 nt, Homo sapiens
cuuggaggccaccgggac

SEQ ID NO: 1456743 - RNA, 14 nt, Homo sapiens
cuuggaugugguuu

SEQ ID NO: 1456744 - RNA, 17 nt, Homo sapiens
cuuggccuacagucauc

SEQ ID NO: 1456745 - RNA, 18 nt, Homo sapiens
cuuggcuccaccacugau

SEQ ID NO: 1456746 - RNA, 23 nt, Homo sapiens
cuuggcucugccaguggaucccc

SEQ ID NO: 1456747 - RNA, 16 nt, Homo sapiens
cuuggcuuuucuagcc

SEQ ID NO: 1456748 - RNA, 20 nt, Homo sapiens
cuugggaaaaaaacuuggca

SEQ ID NO: 1456749 - RNA, 17 nt, Homo sapiens
cuugggacauugcaauu

SEQ ID NO: 1456750 - RNA, 17 nt, Homo sapiens
cuugggagcaccgccug

SEQ ID NO: 1456751 - RNA, 14 nt, Homo sapiens
cuugggaugaucuu

SEQ ID NO: 1456752 - RNA, 21 nt, Homo sapiens
cuugggcaccagcucaugcca

SEQ ID NO: 1456753 - RNA, 16 nt, Homo sapiens
cuugggccuugcugcu

SEQ ID NO: 1456754 - RNA, 16 nt, Homo sapiens
cuuggguucacagugc

SEQ ID NO: 1456755 - RNA, 16 nt, Homo sapiens
cuuggugcugcugaau

SEQ ID NO: 1456756 - RNA, 17 nt, Homo sapiens
cuuggugugauugcaca

SEQ ID NO: 1456757 - RNA, 16 nt, Homo sapiens
cuuguaaagacugguu

SEQ ID NO: 1456758 - RNA, 22 nt, Homo sapiens
cuuguacagugucugugccaug

SEQ ID NO: 1456759 - RNA, 16 nt, Homo sapiens
cuugucccuuucccua

SEQ ID NO: 1456760 - RNA, 15 nt, Homo sapiens
cuuguccugaugcug

SEQ ID NO: 1456761 - RNA, 11 nt, Homo sapiens
cuuguccuucc

SEQ ID NO: 1456762 - RNA, 19 nt, Homo sapiens
cuuguccuugagugcucuu

SEQ ID NO: 1456763 - RNA, 16 nt, Homo sapiens
cuugucugucuaguua

SEQ ID NO: 1456764 - RNA, 19 nt, Homo sapiens
cuugugaaacacagcuguu

SEQ ID NO: 1456765 - RNA, 18 nt, Homo sapiens
cuuguggguccaugcuaa

SEQ ID NO: 1456766 - RNA, 15 nt, Homo sapiens
cuugugucccaugau

SEQ ID NO: 1456767 - RNA, 19 nt, Homo sapiens
cuugugucuuuggugggga

SEQ ID NO: 1456768 - RNA, 23 nt, Homo sapiens
cuuguuaucagcuuucagggcca

SEQ ID NO: 1456769 - RNA, 15 nt, Homo sapiens
cuuguucugggcuca

SEQ ID NO: 1456770 - RNA, 17 nt, Homo sapiens
cuuguucuguacuugua

SEQ ID NO: 1456771 - RNA, 23 nt, Homo sapiens
cuuguuggugacaccucaccuca

SEQ ID NO: 1456772 - RNA, 22 nt, Homo sapiens
cuuguuguugaacauggcuaaa

SEQ ID NO: 1456773 - RNA, 16 nt, Homo sapiens
cuuguuugucuuccau

SEQ ID NO: 1456774 - RNA, 22 nt, Homo sapiens
cuuguuuuacccuauacaucca

SEQ ID NO: 1456775 - RNA, 13 nt, Homo sapiens
cuuuaaacucagg

SEQ ID NO: 1456776 - RNA, 16 nt, Homo sapiens
cuuuaaacucagggac

SEQ ID NO: 1456777 - RNA, 16 nt, Homo sapiens
cuuuaaaggcaucuac

SEQ ID NO: 1456778 - RNA, 19 nt, Homo sapiens
cuuuaaagucagguccaau

SEQ ID NO: 1456779 - RNA, 21 nt, Homo sapiens
cuuuaaaguuacuauucugua

SEQ ID NO: 1456780 - RNA, 12 nt, Homo sapiens
cuuuaagcacua

SEQ ID NO: 1456781 - RNA, 16 nt, Homo sapiens
cuuaagccuuuugcuc

SEQ ID NO: 1456782 - RNA, 21 nt, Homo sapiens
cuuaagccuuuugcucacaaa

SEQ ID NO: 1456783 - RNA, 23 nt, Homo sapiens
cuuaaggggggcagggagugaug

SEQ ID NO: 1456784 - RNA, 16 nt, Homo sapiens
cuuaauacccuaauaa

SEQ ID NO: 1456785 - RNA, 14 nt, Homo sapiens
cuuaauauguuaac

SEQ ID NO: 1456786 - RNA, 15 nt, Homo sapiens
cuuaaugacauuccc

SEQ ID NO: 1456787 - RNA, 15 nt, Homo sapiens
cuuaauguuuauucc

SEQ ID NO: 1456788 - RNA, 14 nt, Homo sapiens
cuuaauuuucagua

SEQ ID NO: 1456789 - RNA, 15 nt, Homo sapiens
cuuacccaauuuccc

SEQ ID NO: 1456790 - RNA, 17 nt, Homo sapiens
cuuaccugaccucuugc

SEQ ID NO: 1456791 - RNA, 16 nt, Homo sapiens
cuuacuacacugagga

SEQ ID NO: 1456792 - RNA, 15 nt, Homo sapiens
cuuacuuaugccaua

SEQ ID NO: 1456793 - RNA, 14 nt, Homo sapiens
cuuacuuugcuuga

SEQ ID NO: 1456794 - RNA, 18 nt, Homo sapiens
cuuagaaauugcauuucc

SEQ ID NO: 1456795 - RNA, 16 nt, Homo sapiens
cuuagaagugcuauaa

SEQ ID NO: 1456796 - RNA, 14 nt, Homo sapiens
cuuagagauugcau

SEQ ID NO: 1456797 - RNA, 17 nt, Homo sapiens
cuuagcagcuuccagau

SEQ ID NO: 1456798 - RNA, 14 nt, Homo sapiens
cuuagccagaguua

SEQ ID NO: 1456799 - RNA, 18 nt, Homo sapiens
cuuagcugucucagagau

SEQ ID NO: 1456800 - RNA, 21 nt, Homo sapiens
cuuagcuucuauuauagccac

SEQ ID NO: 1456801 - RNA, 22 nt, Homo sapiens
cuuaguaucucaucaacaaaga

SEQ ID NO: 1456802 - RNA, 18 nt, Homo sapiens
cuuaguauuucucaggaa

SEQ ID NO: 1456803 - RNA, 13 nt, Homo sapiens
cuuagucauuacu

SEQ ID NO: 1456804 - RNA, 14 nt, Homo sapiens
cuuagugauugaga

SEQ ID NO: 1456805 - RNA, 15 nt, Homo sapiens
cuuagugucacuuac

SEQ ID NO: 1456806 - RNA, 20 nt, Homo sapiens
cuuaguguuguggacacugc

SEQ ID NO: 1456807 - RNA, 20 nt, Homo sapiens
cuuauaagaaagaucaaaga

SEQ ID NO: 1456808 - RNA, 20 nt, Homo sapiens
cuuauagacacuugcuccca

SEQ ID NO: 1456809 - RNA, 23 nt, Homo sapiens
cuuauauugaagacaauuugaua

SEQ ID NO: 1456810 - RNA, 18 nt, Homo sapiens
cuuaucccucucuucccc

SEQ ID NO: 1456811 - RNA, 22 nt, Homo sapiens
cuuaucuggcccucgacacuca

SEQ ID NO: 1456812 - RNA, 12 nt, Homo sapiens
cuuaucuugcac

SEQ ID NO: 1456813 - RNA, 17 nt, Homo sapiens
cuuaugacuugcuacuu

SEQ ID NO: 1456814 - RNA, 22 nt, Homo sapiens
cuuauguugcacaaugagaaaa

SEQ ID NO: 1456815 - RNA, 19 nt, Homo sapiens
cuuauuucuagaagcacau

SEQ ID NO: 1456816 - RNA, 20 nt, Homo sapiens
cuuauuucuagaagcacaug

SEQ ID NO: 1456817 - RNA, 16 nt, Homo sapiens
cuuauuuugcauucca

SEQ ID NO: 1456818 - RNA, 21 nt, Homo sapiens
cuucaaaacggggcagccaaa

SEQ ID NO: 1456819 - RNA, 19 nt, Homo sapiens
cuucaaagaggaaccagga

SEQ ID NO: 1456820 - RNA, 19 nt, Homo sapiens
cuucaaaucaaucuguaaa

SEQ ID NO: 1456821 - RNA, 16 nt, Homo sapiens
cuucaagaacucuggg

SEQ ID NO: 1456822 - RNA, 22 nt, Homo sapiens
cuucaaggcccauaucugugaa

SEQ ID NO: 1456823 - RNA, 21 nt, Homo sapiens
cuucaagugccuuuugcugcg

SEQ ID NO: 1456824 - RNA, 19 nt, Homo sapiens
cuucaaguuaaagugaaua

SEQ ID NO: 1456825 - RNA, 17 nt, Homo sapiens
cuucaaguuguaaaaau

SEQ ID NO: 1456826 - RNA, 14 nt, Homo sapiens
cuucaauacuuaaa

SEQ ID NO: 1456827 - RNA, 16 nt, Homo sapiens
cuucaaugcuagaaaa

SEQ ID NO: 1456828 - RNA, 14 nt, Homo sapiens
cuucacaccauuca

SEQ ID NO: 1456829 - RNA, 13 nt, Homo sapiens
cuucacagaacac

SEQ ID NO: 1456830 - RNA, 18 nt, Homo sapiens
cuucacagcccugcagug

SEQ ID NO: 1456831 - RNA, 13 nt, Homo sapiens
cuucacaguguuu

SEQ ID NO: 1456832 - RNA, 17 nt, Homo sapiens
cuucacgcccuuggcca

SEQ ID NO: 1456833 - RNA, 16 nt, Homo sapiens
cuucacuguauaaaua

SEQ ID NO: 1456834 - RNA, 15 nt, Homo sapiens
cuucacuugcacugg

SEQ ID NO: 1456835 - RNA, 18 nt, Homo sapiens
cuucagaaauauaugcag

SEQ ID NO: 1456836 - RNA, 20 nt, Homo sapiens
cuucagaagacacugcaaag

SEQ ID NO: 1456837 - RNA, 23 nt, Homo sapiens
cuucagaagacacugcaaaggcg

SEQ ID NO: 1456838 - RNA, 12 nt, Homo sapiens
cuucagacaccc

SEQ ID NO: 1456839 - RNA, 18 nt, Homo sapiens
cuucagauacaaacugca

SEQ ID NO: 1456840 - RNA, 14 nt, Homo sapiens
cuucagauagaaaa

SEQ ID NO: 1456841 - RNA, 20 nt, Homo sapiens
cuucaggaaaauaaauauca

SEQ ID NO: 1456842 - RNA, 21 nt, Homo sapiens
cuucagggcagggcucugaua

SEQ ID NO: 1456843 - RNA, 22 nt, Homo sapiens
cuucagguuaucgaaauaacaa

SEQ ID NO: 1456844 - RNA, 20 nt, Homo sapiens
cuucaguccacuucugcucu

SEQ ID NO: 1456845 - RNA, 22 nt, Homo sapiens
cuucagucuugaauuucuaaaa

SEQ ID NO: 1456846 - RNA, 15 nt, Homo sapiens
cuucauauaccagca

SEQ ID NO: 1456847 - RNA, 19 nt, Homo sapiens
cuucauauaccagcaauau

SEQ ID NO: 1456848 - RNA, 16 nt, Homo sapiens
cuucauaucaucacaa

SEQ ID NO: 1456849 - RNA, 14 nt, Homo sapiens
cuucauggaacuca

SEQ ID NO: 1456850 - RNA, 16 nt, Homo sapiens
cuucauucacauucag

SEQ ID NO: 1456851 - RNA, 24 nt, Homo sapiens
cuucauuugaugcuaaauaggaga

SEQ ID NO: 1456852 - RNA, 18 nt, Homo sapiens
ccuguagacuagugccgu

SEQ ID NO: 1456853 - RNA, 19 nt, Homo sapiens
ccugucauccuuggucuuu

SEQ ID NO: 1456854 - RNA, 22 nt, Homo sapiens
ccugucauucuagaaacaggaa

SEQ ID NO: 1456855 - RNA, 22 nt, Homo sapiens
ccuguccagauuauuggcugcu

SEQ ID NO: 1456856 - RNA, 21 nt, Homo sapiens
ccuguccccaaaaugugaugc

SEQ ID NO: 1456857 - RNA, 17 nt, Homo sapiens
ccuguccuccaacacca

SEQ ID NO: 1456858 - RNA, 22 nt, Homo sapiens
ccuguccuuucuugcagauucu

SEQ ID NO: 1456859 - RNA, 17 nt, Homo sapiens
ccugucuccagcugccu

SEQ ID NO: 1456860 - RNA, 21 nt, Homo sapiens
ccugucuucugggcacagugg

SEQ ID NO: 1456861 - RNA, 16 nt, Homo sapiens
ccugucuugcugucau

SEQ ID NO: 1456862 - RNA, 15 nt, Homo sapiens
ccugucuuuaaggaa

SEQ ID NO: 1456863 - RNA, 12 nt, Homo sapiens
ccugugacaugg

SEQ ID NO: 1456864 - RNA, 12 nt, Homo sapiens
ccugugacuguc

SEQ ID NO: 1456865 - RNA, 11 nt, Homo sapiens
ccugugcagcc

SEQ ID NO: 1456866 - RNA, 14 nt, Homo sapiens
ccugugccaucacc

SEQ ID NO: 1456867 - RNA, 21 nt, Homo sapiens
ccugugcuuguguuugcugcu

SEQ ID NO: 1456868 - RNA, 14 nt, Homo sapiens
ccuguggagcucag

SEQ ID NO: 1456869 - RNA, 22 nt, Homo sapiens
ccuguggguguucuuuccugcc

SEQ ID NO: 1456870 - RNA, 14 nt, Homo sapiens
ccuguguacuuccc

SEQ ID NO: 1456871 - RNA, 15 nt, Homo sapiens
ccugugucaucccau

SEQ ID NO: 1456872 - RNA, 14 nt, Homo sapiens
ccuguucacucuac

SEQ ID NO: 1456873 - RNA, 19 nt, Homo sapiens
ccuguuccccaaggacucu

SEQ ID NO: 1456874 - RNA, 20 nt, Homo sapiens
ccuguuccccaaggacucuu

SEQ ID NO: 1456875 - RNA, 18 nt, Homo sapiens
ccuguuuucgcaccuacc

SEQ ID NO: 1456876 - RNA, 22 nt, Homo sapiens
ccuguuuucgcaccuaccauca

SEQ ID NO: 1456877 - RNA, 15 nt, Homo sapiens
ccuuaaaaaucacac

SEQ ID NO: 1456878 - RNA, 15 nt, Homo sapiens
ccuuaaaacaauucu

SEQ ID NO: 1456879 - RNA, 13 nt, Homo sapiens
ccuuaagagucau

SEQ ID NO: 1456880 - RNA, 17 nt, Homo sapiens
ccuuaaguauaucaugu

SEQ ID NO: 1456881 - RNA, 12 nt, Homo sapiens
ccuuacacugaa

SEQ ID NO: 1456882 - RNA, 14 nt, Homo sapiens
ccuuacacugaaaa

SEQ ID NO: 1456883 - RNA, 18 nt, Homo sapiens
ccuuacagaacuacuucu

SEQ ID NO: 1456884 - RNA, 20 nt, Homo sapiens
ccuuacagaacuacuucuua

SEQ ID NO: 1456885 - RNA, 20 nt, Homo sapiens
ccuuaguuauaauucugugu

SEQ ID NO: 1456886 - RNA, 22 nt, Homo sapiens
ccuuauauuuacaauaaaugaa

SEQ ID NO: 1456887 - RNA, 13 nt, Homo sapiens
ccuucaccuggau

SEQ ID NO: 1456888 - RNA, 15 nt, Homo sapiens
ccuucagcaccugac

SEQ ID NO: 1456889 - RNA, 21 nt, Homo sapiens
ccuucagcaugccugaacuac

SEQ ID NO: 1456890 - RNA, 22 nt, Homo sapiens
ccuucaggguuuaauagacuga

SEQ ID NO: 1456891 - RNA, 20 nt, Homo sapiens
ccuucaucuucacugcaauu

SEQ ID NO: 1456892 - RNA, 13 nt, Homo sapiens
ccuuccagccaca

SEQ ID NO: 1456893 - RNA, 23 nt, Homo sapiens
ccuucccuagcuuuagacccugg

SEQ ID NO: 1456894 - RNA, 24 nt, Homo sapiens
ccuuccuaugcuguucacuggaca

SEQ ID NO: 1456895 - RNA, 14 nt, Homo sapiens
ccuuccucugcucc

SEQ ID NO: 1456896 - RNA, 15 nt, Homo sapiens
ccuucuacauuugag

SEQ ID NO: 1456897 - RNA, 15 nt, Homo sapiens
ccuucucugcuccac

SEQ ID NO: 1456898 - RNA, 17 nt, Homo sapiens
ccuucucuuaguuauug

SEQ ID NO: 1456899 - RNA, 23 nt, Homo sapiens
ccuucugauugauggugcuauuu

SEQ ID NO: 1456900 - RNA, 17 nt, Homo sapiens
ccuugaucccaauccuu

SEQ ID NO: 1456901 - RNA, 14 nt, Homo sapiens
ccuugcaaccucac

SEQ ID NO: 1456902 - RNA, 18 nt, Homo sapiens
ccuugcaacuucauguca

SEQ ID NO: 1456903 - RNA, 23 nt, Homo sapiens
ccuugcaagguuaagcaaggugg

SEQ ID NO: 1456904 - RNA, 14 nt, Homo sapiens
ccuugcagccacau

SEQ ID NO: 1456905 - RNA, 23 nt, Homo sapiens
ccuugcaguuuuacuaaaacacu

SEQ ID NO: 1456906 - RNA, 20 nt, Homo sapiens
ccuugcccagacuacagggc

SEQ ID NO: 1456907 - RNA, 17 nt, Homo sapiens
ccuugcugcugcugcac

SEQ ID NO: 1456908 - RNA, 19 nt, Homo sapiens
ccuugcuguccugaucugu

SEQ ID NO: 1456909 - RNA, 14 nt, Homo sapiens
ccuugcuuccugau

SEQ ID NO: 1456910 - RNA, 19 nt, Homo sapiens
ccuuggagggacaugacua

SEQ ID NO: 1456911 - RNA, 22 nt, Homo sapiens
ccuuggccaugggucccauucu

SEQ ID NO: 1456912 - RNA, 13 nt, Homo sapiens
ccuuggcucugcc

SEQ ID NO: 1456913 - RNA, 19 nt, Homo sapiens
ccuuggcuuuucuagccua

SEQ ID NO: 1456914 - RNA, 16 nt, Homo sapiens
ccuugggcaguucuca

SEQ ID NO: 1456915 - RNA, 17 nt, Homo sapiens
ccuuggguagugagcag

SEQ ID NO: 1456916 - RNA, 17 nt, Homo sapiens
ccuuguuccaauuugac

SEQ ID NO: 1456917 - RNA, 20 nt, Homo sapiens
ccuuuaaagaugaacucuga

SEQ ID NO: 1456918 - RNA, 13 nt, Homo sapiens
ccuuuacaccaac

SEQ ID NO: 1456919 - RNA, 24 nt, Homo sapiens
ccuuuagaggguaccgucuucucc

SEQ ID NO: 1456920 - RNA, 21 nt, Homo sapiens
ccuuuaucaaaaaaagacuca

SEQ ID NO: 1456921 - RNA, 16 nt, Homo sapiens
ccuuucccaucuucca

SEQ ID NO: 1456922 - RNA, 19 nt, Homo sapiens
ccuuucccccuucucuuag

SEQ ID NO: 1456923 - RNA, 11 nt, Homo sapiens
ccuuuccuguc

SEQ ID NO: 1456924 - RNA, 14 nt, Homo sapiens
ccuuucuuugccuc

SEQ ID NO: 1456925 - RNA, 12 nt, Homo sapiens
ccuuugccagug

SEQ ID NO: 1456926 - RNA, 19 nt, Homo sapiens
ccuuugccuuccaccccca

SEQ ID NO: 1456927 - RNA, 23 nt, Homo sapiens
ccuuuguccuccugcugccagua

SEQ ID NO: 1456928 - RNA, 14 nt, Homo sapiens
ccuuuuaacugcca

SEQ ID NO: 1456929 - RNA, 21 nt, Homo sapiens
ccuuuuagccuaguucaucca

SEQ ID NO: 1456930 - RNA, 23 nt, Homo sapiens
ccuuuuauuuuuuaagguaacaa

SEQ ID NO: 1456931 - RNA, 16 nt, Homo sapiens
ccuuuugccaaucuca

SEQ ID NO: 1456932 - RNA, 12 nt, Homo sapiens
ccuuuugugcaa

SEQ ID NO: 1456933 - RNA, 15 nt, Homo sapiens
ccuuuuugacacuga

SEQ ID NO: 1456934 - RNA, 17 nt, Homo sapiens
ccuuuuuguuucaauga

SEQ ID NO: 1456935 - RNA, 17 nt, Homo sapiens
ccuuuuuuauacaggaa

SEQ ID NO: 1456936 - RNA, 15 nt, Homo sapiens
ccuuuuuuucccaaa

SEQ ID NO: 1456937 - RNA, 21 nt, Homo sapiens
cgaaaccgguggggcugguuc

SEQ ID NO: 1456938 - RNA, 10 nt, Homo sapiens
cgaaacugcc

SEQ ID NO: 1456939 - RNA, 12 nt, Homo sapiens
cgaaaguggaaa

SEQ ID NO: 1456940 - RNA, 20 nt, Homo sapiens
cgaacaccaaaaaugaugcg

SEQ ID NO: 1456941 - RNA, 14 nt, Homo sapiens
cgaaguagcuugcu

SEQ ID NO: 1456942 - RNA, 17 nt, Homo sapiens
cgaaucuacuaauucca

SEQ ID NO: 1456943 - RNA, 23 nt, Homo sapiens
cgaaucuuccgauggaugaaucu

SEQ ID NO: 1456944 - RNA, 17 nt, Homo sapiens
cgaauucgcuguuaccg

SEQ ID NO: 1456945 - RNA, 23 nt, Homo sapiens
cgacagaggagcuuuucuggaau

SEQ ID NO: 1456946 - RNA, 19 nt, Homo sapiens
cgaccacuuccaggggaac

SEQ ID NO: 1456947 - RNA, 11 nt, Homo sapiens
cgacccauuca

SEQ ID NO: 1456948 - RNA, 16 nt, Homo sapiens
cgaccugcgccaaucc

SEQ ID NO: 1456949 - RNA, 17 nt, Homo sapiens
cgacuaauuucaaaaug

SEQ ID NO: 1456950 - RNA, 16 nt, Homo sapiens
cgacugaugaaggcau

SEQ ID NO: 1456951 - RNA, 22 nt, Homo sapiens
cgacugccugugaaguggaugg

SEQ ID NO: 1456952 - RNA, 20 nt, Homo sapiens
cgacuucaugacaagcauuu

SEQ ID NO: 1456953 - RNA, 14 nt, Homo sapiens
cgagaucaagagau

SEQ ID NO: 1456954 - RNA, 17 nt, Homo sapiens
cagccucccuuugauga

SEQ ID NO: 1456955 - RNA, 19 nt, Homo sapiens
cagccucuagcaccaggac

SEQ ID NO: 1456956 - RNA, 20 nt, Homo sapiens
cagccugcucuagugggaca

SEQ ID NO: 1456957 - RNA, 15 nt, Homo sapiens
cagccugcuuucaca

SEQ ID NO: 1456958 - RNA, 19 nt, Homo sapiens
cagccuggccaacauggca

SEQ ID NO: 1456959 - RNA, 16 nt, Homo sapiens
cagccuuccguaucca

SEQ ID NO: 1456960 - RNA, 16 nt, Homo sapiens
cagccuugccagagau

SEQ ID NO: 1456961 - RNA, 18 nt, Homo sapiens
cagcgccagugacaguca

SEQ ID NO: 1456962 - RNA, 21 nt, Homo sapiens
cagcgggaucucguaucuuua

SEQ ID NO: 1456963 - RNA, 17 nt, Homo sapiens
cagcgggcacagggcac

SEQ ID NO: 1456964 - RNA, 22 nt, Homo sapiens
cagcuacgaauauagaggguuu

SEQ ID NO: 1456965 - RNA, 20 nt, Homo sapiens
cagcuagaaaaggccuucuu

SEQ ID NO: 1456966 - RNA, 14 nt, Homo sapiens
cagcuagugccuuu

SEQ ID NO: 1456967 - RNA, 18 nt, Homo sapiens
cagcuaucugucaucucu

SEQ ID NO: 1456968 - RNA, 23 nt, Homo sapiens
cagcucaacggaagaggcugcug

SEQ ID NO: 1456969 - RNA, 17 nt, Homo sapiens
cagcucagacccagacc

SEQ ID NO: 1456970 - RNA, 17 nt, Homo sapiens
cagcucagcgccagccu

SEQ ID NO: 1456971 - RNA, 16 nt, Homo sapiens
cagcucagugagcugg

SEQ ID NO: 1456972 - RNA, 14 nt, Homo sapiens
cagcucuccaauac

SEQ ID NO: 1456973 - RNA, 14 nt, Homo sapiens
cagcugacccggcc

SEQ ID NO: 1456974 - RNA, 20 nt, Homo sapiens
cagcugaggccuugccuuga

SEQ ID NO: 1456975 - RNA, 18 nt, Homo sapiens
cagcugcaagccagggau

SEQ ID NO: 1456976 - RNA, 21 nt, Homo sapiens
cagcuggcuuugcacuugacc

SEQ ID NO: 1456977 - RNA, 16 nt, Homo sapiens
cagcugggcaaagcca

SEQ ID NO: 1456978 - RNA, 23 nt, Homo sapiens
cagcuguggccuaggcuaccuca

SEQ ID NO: 1456979 - RNA, 15 nt, Homo sapiens
cagcuuagauuucau

SEQ ID NO: 1456980 - RNA, 17 nt, Homo sapiens
cagcuuagauuucauag

SEQ ID NO: 1456981 - RNA, 17 nt, Homo sapiens
cagcuucuucacaggca

SEQ ID NO: 1456982 - RNA, 22 nt, Homo sapiens
cagcuugggaauccugcuaaag

SEQ ID NO: 1456983 - RNA, 23 nt, Homo sapiens
cagcuuugggaucccacccuggg

SEQ ID NO: 1456984 - RNA, 13 nt, Homo sapiens
cagcuuuuccuca

SEQ ID NO: 1456985 - RNA, 14 nt, Homo sapiens
cagcuuuugcaacu

SEQ ID NO: 1456986 - RNA, 16 nt, Homo sapiens
cagcuuuugcaacuua

SEQ ID NO: 1456987 - RNA, 19 nt, Homo sapiens
cagcuuuuguuguuuauau

SEQ ID NO: 1456988 - RNA, 14 nt, Homo sapiens
caggaaauagucac

SEQ ID NO: 1456989 - RNA, 19 nt, Homo sapiens
caggaacacccgacuccuc

SEQ ID NO: 1456990 - RNA, 15 nt, Homo sapiens
caggaacagaaggau

SEQ ID NO: 1456991 - RNA, 15 nt, Homo sapiens
caggaagccagagcc

SEQ ID NO: 1456992 - RNA, 13 nt, Homo sapiens
caggaagcucucu

SEQ ID NO: 1456993 - RNA, 23 nt, Homo sapiens
caggaaggaaaugacaccaaaua

SEQ ID NO: 1456994 - RNA, 20 nt, Homo sapiens
caggaagggagaacuugaaa

SEQ ID NO: 1456995 - RNA, 21 nt, Homo sapiens
caggaagggcaggaaggagag

SEQ ID NO: 1456996 - RNA, 19 nt, Homo sapiens
caggaaguggccaaaagcu

SEQ ID NO: 1456997 - RNA, 22 nt, Homo sapiens
caggaaucgguggucuccaccu

SEQ ID NO: 1456998 - RNA, 21 nt, Homo sapiens
caggaauuccucuuuugcuua

SEQ ID NO: 1456999 - RNA, 14 nt, Homo sapiens
caggacaaguggua

SEQ ID NO: 1457000 - RNA, 16 nt, Homo sapiens
caggacagaugccaca

SEQ ID NO: 1457001 - RNA, 15 nt, Homo sapiens
caggaccaguuugau

SEQ ID NO: 1457002 - RNA, 19 nt, Homo sapiens
caggacuauauuugggccu

SEQ ID NO: 1457003 - RNA, 22 nt, Homo sapiens
caggacugaguccccuccagga

SEQ ID NO: 1457004 - RNA, 12 nt, Homo sapiens
caggacuguuga

SEQ ID NO: 1457005 - RNA, 17 nt, Homo sapiens
caggacuuggucugauu

SEQ ID NO: 1457006 - RNA, 16 nt, Homo sapiens
caggacuuguuuacaa

SEQ ID NO: 1457007 - RNA, 19 nt, Homo sapiens
caggagaccacggggagca

SEQ ID NO: 1457008 - RNA, 20 nt, Homo sapiens
caggagaccacggggagcaa

SEQ ID NO: 1457009 - RNA, 19 nt, Homo sapiens
caggagagacagugaggcu

SEQ ID NO: 1457010 - RNA, 23 nt, Homo sapiens
caggagaggauggcccaggguga

SEQ ID NO: 1457011 - RNA, 14 nt, Homo sapiens
caggagcaauggga

SEQ ID NO: 1457012 - RNA, 17 nt, Homo sapiens
caggagcaguuugccac

SEQ ID NO: 1457013 - RNA, 18 nt, Homo sapiens
caggagcccggcuuccac

SEQ ID NO: 1457014 - RNA, 11 nt, Homo sapiens
caggagcucuu

SEQ ID NO: 1457015 - RNA, 14 nt, Homo sapiens
caggaggaagugag

SEQ ID NO: 1457016 - RNA, 13 nt, Homo sapiens
caggaggccaaua

SEQ ID NO: 1457017 - RNA, 19 nt, Homo sapiens
caggaggggaacugaguca

SEQ ID NO: 1457018 - RNA, 22 nt, Homo sapiens
caggagguggaggcugcaguga

SEQ ID NO: 1457019 - RNA, 16 nt, Homo sapiens
caggagucagugucug

SEQ ID NO: 1457020 - RNA, 17 nt, Homo sapiens
caggagucucugccacc

SEQ ID NO: 1457021 - RNA, 20 nt, Homo sapiens
caggagucucugccacccac

SEQ ID NO: 1457022 - RNA, 21 nt, Homo sapiens
caggagucucugccacccacu

SEQ ID NO: 1457023 - RNA, 20 nt, Homo sapiens
caggaguguggccacguggg

SEQ ID NO: 1457024 - RNA, 15 nt, Homo sapiens
caggauacucuguca

SEQ ID NO: 1457025 - RNA, 16 nt, Homo sapiens
caggauuucuaaucaa

SEQ ID NO: 1457026 - RNA, 15 nt, Homo sapiens
caggcaaaauugaua

SEQ ID NO: 1457027 - RNA, 14 nt, Homo sapiens
caggcaacgcacaa

SEQ ID NO: 1457028 - RNA, 20 nt, Homo sapiens
caggcaacgcacaaaacaga

SEQ ID NO: 1457029 - RNA, 16 nt, Homo sapiens
caggcaagugggacca

SEQ ID NO: 1457030 - RNA, 14 nt, Homo sapiens
caggcaauuucacc

SEQ ID NO: 1457031 - RNA, 19 nt, Homo sapiens
caggcaccucuuccuugau

SEQ ID NO: 1457032 - RNA, 17 nt, Homo sapiens
caggcacgggucccugc

SEQ ID NO: 1457033 - RNA, 16 nt, Homo sapiens
caggcacuaagacuaa

SEQ ID NO: 1457034 - RNA, 18 nt, Homo sapiens
caggcagagaaucauacu

SEQ ID NO: 1457035 - RNA, 20 nt, Homo sapiens
caggcagcacagugugugaa

SEQ ID NO: 1457036 - RNA, 20 nt, Homo sapiens
caggcaugaaauacugugcc

SEQ ID NO: 1457037 - RNA, 18 nt, Homo sapiens
caggcaugaaauucuucc

SEQ ID NO: 1457038 - RNA, 21 nt, Homo sapiens
caggcaugaggaaucugggag

SEQ ID NO: 1457039 - RNA, 23 nt, Homo sapiens
caggcaugucccaugugagcugc

SEQ ID NO: 1457040 - RNA, 14 nt, Homo sapiens
caggccagcccagc

SEQ ID NO: 1457041 - RNA, 13 nt, Homo sapiens
caggccagugucu

SEQ ID NO: 1457042 - RNA, 14 nt, Homo sapiens
caggccagugucug

SEQ ID NO: 1457043 - RNA, 15 nt, Homo sapiens
caggccauacuuuac

SEQ ID NO: 1457044 - RNA, 17 nt, Homo sapiens
caggccauacuuuacaa

SEQ ID NO: 1457045 - RNA, 17 nt, Homo sapiens
caggccaugugagccac

SEQ ID NO: 1457046 - RNA, 17 nt, Homo sapiens
caggccccgugaggcaa

SEQ ID NO: 1457047 - RNA, 22 nt, Homo sapiens
ccucccucucucuucugcucca

SEQ ID NO: 1457048 - RNA, 13 nt, Homo sapiens
ccucccuuugaug

SEQ ID NO: 1457049 - RNA, 16 nt, Homo sapiens
ccuccgaccacuucca

SEQ ID NO: 1457050 - RNA, 19 nt, Homo sapiens
ccuccucagaggacaguuu

SEQ ID NO: 1457051 - RNA, 14 nt, Homo sapiens
ccuccucuagcugu

SEQ ID NO: 1457052 - RNA, 13 nt, Homo sapiens
ccuccugcugcag

SEQ ID NO: 1457053 - RNA, 15 nt, Homo sapiens
ccuccuguaaauggu

SEQ ID NO: 1457054 - RNA, 13 nt, Homo sapiens
ccuccugugggga

SEQ ID NO: 1457055 - RNA, 14 nt, Homo sapiens
ccuccuucgggaca

SEQ ID NO: 1457056 - RNA, 15 nt, Homo sapiens
ccucgcccuccacaa

SEQ ID NO: 1457057 - RNA, 19 nt, Homo sapiens
ccucuaaauuuccauaucc

SEQ ID NO: 1457058 - RNA, 12 nt, Homo sapiens
ccucucaccaaa

SEQ ID NO: 1457059 - RNA, 16 nt, Homo sapiens
ccucucagcauuuccu

SEQ ID NO: 1457060 - RNA, 18 nt, Homo sapiens
ccucucaggcucuugacu

SEQ ID NO: 1457061 - RNA, 17 nt, Homo sapiens
ccucucaucaguguccu

SEQ ID NO: 1457062 - RNA, 20 nt, Homo sapiens
ccucuccaggaaugccuccu

SEQ ID NO: 1457063 - RNA, 21 nt, Homo sapiens
ccucucccccuccuccaggga

SEQ ID NO: 1457064 - RNA, 15 nt, Homo sapiens
ccucuccuccagugu

SEQ ID NO: 1457065 - RNA, 17 nt, Homo sapiens
ccucucuuaaaugcaag

SEQ ID NO: 1457066 - RNA, 17 nt, Homo sapiens
ccucugaacuugccuua

SEQ ID NO: 1457067 - RNA, 18 nt, Homo sapiens
auggacaugaucuucuuu

SEQ ID NO: 1457068 - RNA, 14 nt, Homo sapiens
aaacauacuucuaa

SEQ ID NO: 1457069 - RNA, 14 nt, Homo sapiens
aaacauagcaucuc

SEQ ID NO: 1457070 - RNA, 21 nt, Homo sapiens
aaacaucuaauaaguauauaa

SEQ ID NO: 1457071 - RNA, 16 nt, Homo sapiens
aaacaugauuguuuac

SEQ ID NO: 1457072 - RNA, 17 nt, Homo sapiens
aaacauguaugugcauu

SEQ ID NO: 1457073 - RNA, 20 nt, Homo sapiens
aaacauuauaaaaauugaca

SEQ ID NO: 1457074 - RNA, 15 nt, Homo sapiens
aaacauuucauuucc

SEQ ID NO: 1457075 - RNA, 18 nt, Homo sapiens
aaaccaaagagggcuucc

SEQ ID NO: 1457076 - RNA, 19 nt, Homo sapiens
aaaccaagccguggcuucc

SEQ ID NO: 1457077 - RNA, 15 nt, Homo sapiens
aaaccacuagaacuc

SEQ ID NO: 1457078 - RNA, 16 nt, Homo sapiens
aaaccacuagaacucu

SEQ ID NO: 1457079 - RNA, 14 nt, Homo sapiens
aaaccauccaguga

SEQ ID NO: 1457080 - RNA, 13 nt, Homo sapiens
aaaccaugacugu

SEQ ID NO: 1457081 - RNA, 19 nt, Homo sapiens
aaacccauucccucuccag

SEQ ID NO: 1457082 - RNA, 17 nt, Homo sapiens
aaaccgauaaugcauga

SEQ ID NO: 1457083 - RNA, 16 nt, Homo sapiens
aaaccuaggucuccag

SEQ ID NO: 1457084 - RNA, 12 nt, Homo sapiens
aaaccucugggu

SEQ ID NO: 1457085 - RNA, 15 nt, Homo sapiens
aaaccuggaugucac

SEQ ID NO: 1457086 - RNA, 14 nt, Homo sapiens
aaaccuuccucagc

SEQ ID NO: 1457087 - RNA, 13 nt, Homo sapiens
aaacgaaucauug

SEQ ID NO: 1457088 - RNA, 22 nt, Homo sapiens
aaacgauaaaauguggauuaaa

SEQ ID NO: 1457089 - RNA, 13 nt, Homo sapiens
aaacgcuaccucu

SEQ ID NO: 1457090 - RNA, 17 nt, Homo sapiens
aaacuaaacucuuacca

SEQ ID NO: 1457091 - RNA, 21 nt, Homo sapiens
aaacuaaaggugcacugcuuu

SEQ ID NO: 1457092 - RNA, 16 nt, Homo sapiens
aaacuaacacccaguc

SEQ ID NO: 1457093 - RNA, 23 nt, Homo sapiens
aaacuaaccuugaauaaggccca

SEQ ID NO: 1457094 - RNA, 14 nt, Homo sapiens
aaacuaagcacaaa

SEQ ID NO: 1457095 - RNA, 19 nt, Homo sapiens
aaacucacaagugcucauc

SEQ ID NO: 1457096 - RNA, 20 nt, Homo sapiens
aaacucacagaacuauguac

SEQ ID NO: 1457097 - RNA, 15 nt, Homo sapiens
aaacucauuggcuua

SEQ ID NO: 1457098 - RNA, 20 nt, Homo sapiens
aaacuccugaccucagguga

SEQ ID NO: 1457099 - RNA, 17 nt, Homo sapiens
aaacucuuuuucaucca

SEQ ID NO: 1457100 - RNA, 21 nt, Homo sapiens
aaacugacaguaaaucucaca

SEQ ID NO: 1457101 - RNA, 23 nt, Homo sapiens
aaacugcaauagagacuguagau

SEQ ID NO: 1457102 - RNA, 14 nt, Homo sapiens
aaacugcacauugg

SEQ ID NO: 1457103 - RNA, 14 nt, Homo sapiens
aaacugcugugaau

SEQ ID NO: 1457104 - RNA, 21 nt, Homo sapiens
aaacuggcugcuuuguucaau

SEQ ID NO: 1457105 - RNA, 21 nt, Homo sapiens
aaacugggggcucuguauaua

SEQ ID NO: 1457106 - RNA, 22 nt, Homo sapiens
aaacugucucccccauugcucu

SEQ ID NO: 1457107 - RNA, 18 nt, Homo sapiens
aaacugucuuuaaaagag

SEQ ID NO: 1457108 - RNA, 21 nt, Homo sapiens
aaacugugaagcauuuacaga

SEQ ID NO: 1457109 - RNA, 17 nt, Homo sapiens
aaacuuacaaacuuugu

SEQ ID NO: 1457110 - RNA, 21 nt, Homo sapiens
aaacuuaccuaagugacauuu

SEQ ID NO: 1457111 - RNA, 12 nt, Homo sapiens
aaacuucaccua

SEQ ID NO: 1457112 - RNA, 19 nt, Homo sapiens
aaacuugguuucugugaga

SEQ ID NO: 1457113 - RNA, 23 nt, Homo sapiens
aaacuuuaggcccugccccagau

SEQ ID NO: 1457114 - RNA, 18 nt, Homo sapiens
aaagaaaaagaccuauga

SEQ ID NO: 1457115 - RNA, 16 nt, Homo sapiens
aaagaaagcugagaag

SEQ ID NO: 1457116 - RNA, 17 nt, Homo sapiens
aaagaaauugcaugcag

SEQ ID NO: 1457117 - RNA, 13 nt, Homo sapiens
aaagaaccagaga

SEQ ID NO: 1457118 - RNA, 13 nt, Homo sapiens
aaagaagaacuug

SEQ ID NO: 1457119 - RNA, 17 nt, Homo sapiens
aaagaauaaaguccaaa

SEQ ID NO: 1457120 - RNA, 17 nt, Homo sapiens
aaagaauuaccaagaga

SEQ ID NO: 1457121 - RNA, 13 nt, Homo sapiens
aaagaauuugcac

SEQ ID NO: 1457122 - RNA, 17 nt, Homo sapiens
aaagacauucuuccaaa

SEQ ID NO: 1457123 - RNA, 13 nt, Homo sapiens
aaagacucugacc

SEQ ID NO: 1457124 - RNA, 15 nt, Homo sapiens
aaagacucugagaug

SEQ ID NO: 1457125 - RNA, 19 nt, Homo sapiens
aaagacuguacaaaguaga

SEQ ID NO: 1457126 - RNA, 20 nt, Homo sapiens
aaagacuguacaaaguagaa

SEQ ID NO: 1457127 - RNA, 20 nt, Homo sapiens
aaagagcuccaaauugaauc

SEQ ID NO: 1457128 - RNA, 14 nt, Homo sapiens
aaagaggaagcaaa

SEQ ID NO: 1457129 - RNA, 18 nt, Homo sapiens
aaagaguauauguucccu

SEQ ID NO: 1457130 - RNA, 20 nt, Homo sapiens
aaagauaacaagaucuuuca

SEQ ID NO: 1457131 - RNA, 16 nt, Homo sapiens
aaagauacgacuuuau

SEQ ID NO: 1457132 - RNA, 22 nt, Homo sapiens
aaagaugcaaggaccaggacuc

SEQ ID NO: 1457133 - RNA, 15 nt, Homo sapiens
aaagauggaugugcu

SEQ ID NO: 1457134 - RNA, 19 nt, Homo sapiens
aaagauuagcaaggucauu

SEQ ID NO: 1457135 - RNA, 22 nt, Homo sapiens
aaagcaaacacuuacagaauua

SEQ ID NO: 1457136 - RNA, 20 nt, Homo sapiens
aaagcaaguuucaucaguca

SEQ ID NO: 1457137 - RNA, 13 nt, Homo sapiens
aaagcacauacau

SEQ ID NO: 1457138 - RNA, 23 nt, Homo sapiens
aaagcacgugucucagacugcau

SEQ ID NO: 1457139 - RNA, 13 nt, Homo sapiens
aaagcacugagca

SEQ ID NO: 1457140 - RNA, 24 nt, Homo sapiens
aaagcagaauuuuaaugugaagac

SEQ ID NO: 1457141 - RNA, 17 nt, Homo sapiens
aaagcaguaaauuugcu

SEQ ID NO: 1457142 - RNA, 10 nt, Homo sapiens
aaagcauuuc

SEQ ID NO: 1457143 - RNA, 11 nt, Homo sapiens
aaagccaguga

SEQ ID NO: 1457144 - RNA, 17 nt, Homo sapiens
aaagccuagaagagcuu

SEQ ID NO: 1457145 - RNA, 21 nt, Homo sapiens
aaagcguuucuuuacuucuca

SEQ ID NO: 1457146 - RNA, 16 nt, Homo sapiens
aaagcuaauuaaucau

SEQ ID NO: 1457147 - RNA, 22 nt, Homo sapiens
aaagcuacugggccuccucuca

SEQ ID NO: 1457148 - RNA, 22 nt, Homo sapiens
aaagcuaguguaccuccucuca

SEQ ID NO: 1457149 - RNA, 17 nt, Homo sapiens
aaagcuauauaagacaa

SEQ ID NO: 1457150 - RNA, 15 nt, Homo sapiens
aaagcucuguugcaa

SEQ ID NO: 1457151 - RNA, 12 nt, Homo sapiens
aaagcugccauu

SEQ ID NO: 1457152 - RNA, 11 nt, Homo sapiens
aaagcuucccc

SEQ ID NO: 1457153 - RNA, 21 nt, Homo sapiens
aaagcuuuuagaaauacugca

SEQ ID NO: 1457154 - RNA, 17 nt, Homo sapiens
aaaggaaaaauaaucaa

SEQ ID NO: 1457155 - RNA, 18 nt, Homo sapiens
aaaggaagccuugcucau

SEQ ID NO: 1457156 - RNA, 22 nt, Homo sapiens
aaaggaaggcuucugugucaau

SEQ ID NO: 1457157 - RNA, 16 nt, Homo sapiens
aaaggacaucagcaaa

SEQ ID NO: 1457158 - RNA, 22 nt, Homo sapiens
aaaggacaucagcaaacaggau

SEQ ID NO: 1457159 - RNA, 12 nt, Homo sapiens
aaaggacuguaa

SEQ ID NO: 1457160 - RNA, 15 nt, Homo sapiens
aaaggaugugauaua

SEQ ID NO: 1457161 - RNA, 17 nt, Homo sapiens
aaaggcccccacuucuc

SEQ ID NO: 1457162 - RNA, 22 nt, Homo sapiens
aaaggcccccuacgccaaucaa

SEQ ID NO: 1457163 - RNA, 20 nt, Homo sapiens
aaaggcugccgaggacccuc

SEQ ID NO: 1457164 - RNA, 13 nt, Homo sapiens
aaagggaaguagu

SEQ ID NO: 1457165 - RNA, 22 nt, Homo sapiens
aaagggauguuauuauccuugg

SEQ ID NO: 1457166 - RNA, 23 nt, Homo sapiens
aaagggccuugacaucaguuccu

SEQ ID NO: 1457167 - RNA, 13 nt, Homo sapiens
aaaggggcacugg

SEQ ID NO: 1457168 - RNA, 19 nt, Homo sapiens
aaagguauaugacugagcg

SEQ ID NO: 1457169 - RNA, 13 nt, Homo sapiens
aaaggugacuggg

SEQ ID NO: 1457170 - RNA, 15 nt, Homo sapiens
aaagguucucaggug

SEQ ID NO: 1457171 - RNA, 14 nt, Homo sapiens
aaaugugcuuaugu

SEQ ID NO: 1457172 - RNA, 16 nt, Homo sapiens
aaauguuuaccagugu

SEQ ID NO: 1457173 - RNA, 12 nt, Homo sapiens
aaauuaagaagg

SEQ ID NO: 1457174 - RNA, 22 nt, Homo sapiens
aaauuacacaguuaaugccaca

SEQ ID NO: 1457175 - RNA, 12 nt, Homo sapiens
aaauuacuaauu

SEQ ID NO: 1457176 - RNA, 20 nt, Homo sapiens
aaauuagaaaguagccacgu

SEQ ID NO: 1457177 - RNA, 16 nt, Homo sapiens
aaauuaggacuguaua

SEQ ID NO: 1457178 - RNA, 14 nt, Homo sapiens
aaauuauaucucag

SEQ ID NO: 1457179 - RNA, 17 nt, Homo sapiens
aaauuauguauguuuac

SEQ ID NO: 1457180 - RNA, 19 nt, Homo sapiens
aaauuauugcuguauguaa

SEQ ID NO: 1457181 - RNA, 15 nt, Homo sapiens
aaauucaagccuuag

SEQ ID NO: 1457182 - RNA, 12 nt, Homo sapiens
aaauucaauauu

SEQ ID NO: 1457183 - RNA, 18 nt, Homo sapiens
aaauucaauuaggauuaa

SEQ ID NO: 1457184 - RNA, 11 nt, Homo sapiens
aaauucacugu

SEQ ID NO: 1457185 - RNA, 14 nt, Homo sapiens
aaauuccagaagaa

SEQ ID NO: 1457186 - RNA, 15 nt, Homo sapiens
aaauuccauuaucuu

SEQ ID NO: 1457187 - RNA, 22 nt, Homo sapiens
aaauucccaacuucucuugcuu

SEQ ID NO: 1457188 - RNA, 16 nt, Homo sapiens
aaauuccuacaacuua

SEQ ID NO: 1457189 - RNA, 19 nt, Homo sapiens
aaauucuaaagagcacuua

SEQ ID NO: 1457190 - RNA, 15 nt, Homo sapiens
aaauucuucacaugu

SEQ ID NO: 1457191 - RNA, 17 nt, Homo sapiens
aaauugagacauuuaca

SEQ ID NO: 1457192 - RNA, 19 nt, Homo sapiens
aaauugcaauuucuuaggu

SEQ ID NO: 1457193 - RNA, 19 nt, Homo sapiens
aaauugggacaacagugcu

SEQ ID NO: 1457194 - RNA, 13 nt, Homo sapiens
aaauuggucccaa

SEQ ID NO: 1457195 - RNA, 24 nt, Homo sapiens
aaauugucuuuugucauguggcua

SEQ ID NO: 1457196 - RNA, 24 nt, Homo sapiens
aaauuuaagugcguguguagaguu

SEQ ID NO: 1457197 - RNA, 14 nt, Homo sapiens
aaauuucaccacug

SEQ ID NO: 1457198 - RNA, 23 nt, Homo sapiens
aaauuuccaguaccuuugucaca

SEQ ID NO: 1457199 - RNA, 16 nt, Homo sapiens
aaauuugaauuucagu

SEQ ID NO: 1457200 - RNA, 13 nt, Homo sapiens
aaauuuguaaguu

SEQ ID NO: 1457201 - RNA, 14 nt, Homo sapiens
aaauuuuacaauag

SEQ ID NO: 1457202 - RNA, 12 nt, Homo sapiens
aaauuuuacuuc

SEQ ID NO: 1457203 - RNA, 22 nt, Homo sapiens
aaauuuuaguucuuacugcuua

SEQ ID NO: 1457204 - RNA, 21 nt, Homo sapiens
aaauuuugaguucuacauaag

SEQ ID NO: 1457205 - RNA, 23 nt, Homo sapiens
aacaaaaaucuguguaacuguaa

SEQ ID NO: 1457206 - RNA, 15 nt, Homo sapiens
aacaaaaauguacaa

SEQ ID NO: 1457207 - RNA, 14 nt, Homo sapiens
aacaaaauugcaau

SEQ ID NO: 1457208 - RNA, 23 nt, Homo sapiens
aacaaacuggcugcuuuguucaa

SEQ ID NO: 1457209 - RNA, 19 nt, Homo sapiens
aacaaagaaauaauggucu

SEQ ID NO: 1457210 - RNA, 12 nt, Homo sapiens
aacaaauaugca

SEQ ID NO: 1457211 - RNA, 23 nt, Homo sapiens
aacaaauucauauucugucugga

SEQ ID NO: 1457212 - RNA, 21 nt, Homo sapiens
aacaaccguuggaaacauaac

SEQ ID NO: 1457213 - RNA, 20 nt, Homo sapiens
aacaacguugacaaguuuug

SEQ ID NO: 1457214 - RNA, 19 nt, Homo sapiens
aacaagaguugucuugucc

SEQ ID NO: 1457215 - RNA, 14 nt, Homo sapiens
aacaaggucugcuc

SEQ ID NO: 1457216 - RNA, 22 nt, Homo sapiens
aacaagguggugugaucuuaau

SEQ ID NO: 1457217 - RNA, 20 nt, Homo sapiens
aacaagguucccucugagaa

SEQ ID NO: 1457218 - RNA, 15 nt, Homo sapiens
aacaauaucauauca

SEQ ID NO: 1457219 - RNA, 13 nt, Homo sapiens
aacaaugaagaua

SEQ ID NO: 1457220 - RNA, 15 nt, Homo sapiens
aacaaugaagauaaa

SEQ ID NO: 1457221 - RNA, 20 nt, Homo sapiens
aacaaugcugauuuggugac

SEQ ID NO: 1457222 - RNA, 16 nt, Homo sapiens
aacaauuacuggcuca

SEQ ID NO: 1457223 - RNA, 22 nt, Homo sapiens
aacaauuccaaaggaaucucca

SEQ ID NO: 1457224 - RNA, 22 nt, Homo sapiens
aacaauugggagauuaucuuuc

SEQ ID NO: 1457225 - RNA, 24 nt, Homo sapiens
aacaauugguaaaacucacuguga

SEQ ID NO: 1457226 - RNA, 17 nt, Homo sapiens
aacacaaagcucuguca

SEQ ID NO: 1457227 - RNA, 15 nt, Homo sapiens
aacacaaaguguaua

SEQ ID NO: 1457228 - RNA, 13 nt, Homo sapiens
aacacaagcaaaa

SEQ ID NO: 1457229 - RNA, 21 nt, Homo sapiens
aacacaaggcuccaagaccua

SEQ ID NO: 1457230 - RNA, 14 nt, Homo sapiens
aacacaauaugaau

SEQ ID NO: 1457231 - RNA, 12 nt, Homo sapiens
aacacacaaaaa

SEQ ID NO: 1457232 - RNA, 19 nt, Homo sapiens
aacacagcaacaaugacuu

SEQ ID NO: 1457233 - RNA, 20 nt, Homo sapiens
aacaccacuaauuguguaca

SEQ ID NO: 1457234 - RNA, 15 nt, Homo sapiens
aacaccuagcuuuau

SEQ ID NO: 1457235 - RNA, 21 nt, Homo sapiens
aacaccuagcuuuauucuuca

SEQ ID NO: 1457236 - RNA, 20 nt, Homo sapiens
aacacuaucauggacuacac

SEQ ID NO: 1457237 - RNA, 21 nt, Homo sapiens
aacacugcugcuccagugcag

SEQ ID NO: 1457238 - RNA, 18 nt, Homo sapiens
aacacuggugugaccuga

SEQ ID NO: 1457239 - RNA, 14 nt, Homo sapiens
aacacugugcaaag

SEQ ID NO: 1457240 - RNA, 19 nt, Homo sapiens
aacacuuauacugacuuuc

SEQ ID NO: 1457241 - RNA, 18 nt, Homo sapiens
aacagaaaccuauccuca

SEQ ID NO: 1457242 - RNA, 17 nt, Homo sapiens
aacagaaagcauccuaa

SEQ ID NO: 1457243 - RNA, 22 nt, Homo sapiens
aacagaaagccugggugacauu

SEQ ID NO: 1457244 - RNA, 14 nt, Homo sapiens
aacagaagcuucca

SEQ ID NO: 1457245 - RNA, 14 nt, Homo sapiens
aacagaccagugac

SEQ ID NO: 1457246 - RNA, 22 nt, Homo sapiens
aacagagcaagacuccaucuca

SEQ ID NO: 1457247 - RNA, 22 nt, Homo sapiens
aacagaggggcagccaggacau

SEQ ID NO: 1457248 - RNA, 14 nt, Homo sapiens
aacagagugcaacc

SEQ ID NO: 1457249 - RNA, 22 nt, Homo sapiens
aacagagugcaacccagucaca

SEQ ID NO: 1457250 - RNA, 14 nt, Homo sapiens
aacagauaacacca

SEQ ID NO: 1457251 - RNA, 21 nt, Homo sapiens
aacagcaccuccccgcuggga

SEQ ID NO: 1457252 - RNA, 19 nt, Homo sapiens
aacagcagauuucagauca

SEQ ID NO: 1457253 - RNA, 22 nt, Homo sapiens
aacagcagucccaguauucuca

SEQ ID NO: 1457254 - RNA, 13 nt, Homo sapiens
aacagcaguguuc

SEQ ID NO: 1457255 - RNA, 18 nt, Homo sapiens
aacagcaucaugucauaa

SEQ ID NO: 1457256 - RNA, 12 nt, Homo sapiens
aacagcauguac

SEQ ID NO: 1457257 - RNA, 21 nt, Homo sapiens
aacagccuaucuuugugugac

SEQ ID NO: 1457258 - RNA, 21 nt, Homo sapiens
aacagcgggagaccugugcua

SEQ ID NO: 1457259 - RNA, 22 nt, Homo sapiens
aacagcgggagaccugugcuag

SEQ ID NO: 1457260 - RNA, 16 nt, Homo sapiens
aacagcugcauuagaa

SEQ ID NO: 1457261 - RNA, 20 nt, Homo sapiens
aacagcuguaaucuaugaau

SEQ ID NO: 1457262 - RNA, 15 nt, Homo sapiens
aacagcugucucuaa

SEQ ID NO: 1457263 - RNA, 18 nt, Homo sapiens
aacaggaaggaaccagaa

SEQ ID NO: 1457264 - RNA, 12 nt, Homo sapiens
aacaggcauuug

SEQ ID NO: 1457265 - RNA, 21 nt, Homo sapiens
aacaggguuugauagcacuua

SEQ ID NO: 1457266 - RNA, 18 nt, Homo sapiens
aacagguauauacuuuga

SEQ ID NO: 1457267 - RNA, 19 nt, Homo sapiens
aacagguauauacuuugaa

SEQ ID NO: 1457268 - RNA, 12 nt, Homo sapiens
aacagugccaaa

SEQ ID NO: 1457269 - RNA, 14 nt, Homo sapiens
aacaguuacuccag

SEQ ID NO: 1457270 - RNA, 19 nt, Homo sapiens
aacaguugcauuuagcuuc

SEQ ID NO: 1457271 - RNA, 16 nt, Homo sapiens
aacaguuuuccaugaa

SEQ ID NO: 1457272 - RNA, 23 nt, Homo sapiens
aacauacuucuaaaauucccauu

SEQ ID NO: 1457273 - RNA, 15 nt, Homo sapiens
aacauagcaucucag

SEQ ID NO: 1457274 - RNA, 14 nt, Homo sapiens
aacauaugauuuca

SEQ ID NO: 1457275 - RNA, 15 nt, Homo sapiens
aacauaugcaaaaua

SEQ ID NO: 1457276 - RNA, 15 nt, Homo sapiens
aacaucgauauguau

SEQ ID NO: 1457277 - RNA, 21 nt, Homo sapiens
aacaucuuggucagauuugaa

SEQ ID NO: 1457278 - RNA, 17 nt, Homo sapiens
aacaucuuuuacauucu

SEQ ID NO: 1457279 - RNA, 20 nt, Homo sapiens
aacaugaaguuggaagccau

SEQ ID NO: 1457280 - RNA, 19 nt, Homo sapiens
aacaugauuguuuacagcu

SEQ ID NO: 1457281 - RNA, 16 nt, Homo sapiens
aacauggagcugucau

SEQ ID NO: 1457282 - RNA, 19 nt, Homo sapiens
aacauguaaaacaguuaca

SEQ ID NO: 1457283 - RNA, 19 nt, Homo sapiens
aacauguaugugcauuuca

SEQ ID NO: 1457284 - RNA, 21 nt, Homo sapiens
aacauguuagaagcaaugaau

SEQ ID NO: 1457285 - RNA, 23 nt, Homo sapiens
aacauuccauuugaagcagugau

SEQ ID NO: 1457286 - RNA, 17 nt, Homo sapiens
aacauuccuuagucuca

SEQ ID NO: 1457287 - RNA, 18 nt, Homo sapiens
aacauuccuuagucucaa

SEQ ID NO: 1457288 - RNA, 11 nt, Homo sapiens
aacauucugua

SEQ ID NO: 1457289 - RNA, 14 nt, Homo sapiens
aacauugaccaaga

SEQ ID NO: 1457290 - RNA, 16 nt, Homo sapiens
aacauugacgauuccu

SEQ ID NO: 1457291 - RNA, 13 nt, Homo sapiens
aacauugugauca

SEQ ID NO: 1457292 - RNA, 14 nt, Homo sapiens
aacauuuguuccug

SEQ ID NO: 1457293 - RNA, 23 nt, Homo sapiens
aacauuuuauuuuuaaaauauua

SEQ ID NO: 1457294 - RNA, 13 nt, Homo sapiens
aaccaacaauaua

SEQ ID NO: 1457295 - RNA, 14 nt, Homo sapiens
aaccaauaaaggaa

SEQ ID NO: 1457296 - RNA, 11 nt, Homo sapiens
aaccacagggc

SEQ ID NO: 1457297 - RNA, 18 nt, Homo sapiens
aaccacagucuauaccau

SEQ ID NO: 1457298 - RNA, 11 nt, Homo sapiens
aaccacugugg

SEQ ID NO: 1457299 - RNA, 11 nt, Homo sapiens
aaccacuucag

SEQ ID NO: 1457300 - RNA, 18 nt, Homo sapiens
aaccacuucauucuugaa

SEQ ID NO: 1457301 - RNA, 19 nt, Homo sapiens
aaccagguuuagacaguau

SEQ ID NO: 1457302 - RNA, 18 nt, Homo sapiens
aaccaguuaugugaauga

SEQ ID NO: 1457303 - RNA, 18 nt, Homo sapiens
aaccaucacccccaggac

SEQ ID NO: 1457304 - RNA, 14 nt, Homo sapiens
aaccaucagcauca

SEQ ID NO: 1457305 - RNA, 18 nt, Homo sapiens
aacccaagagcaagggcu

SEQ ID NO: 1457306 - RNA, 18 nt, Homo sapiens
aacccaaggacugaggga

SEQ ID NO: 1457307 - RNA, 20 nt, Homo sapiens
aacccaaucugcacacucca

SEQ ID NO: 1457308 - RNA, 18 nt, Homo sapiens
aacccacagaugucucug

SEQ ID NO: 1457309 - RNA, 15 nt, Homo sapiens
aacccacagccaaac

SEQ ID NO: 1457310 - RNA, 20 nt, Homo sapiens
aacccaggagauggaaguug

SEQ ID NO: 1457311 - RNA, 16 nt, Homo sapiens
aacccaggaguggaua

SEQ ID NO: 1457312 - RNA, 17 nt, Homo sapiens
aacccagggugugaaca

SEQ ID NO: 1457313 - RNA, 23 nt, Homo sapiens
aaccccaacaauugugugaauua

SEQ ID NO: 1457314 - RNA, 21 nt, Homo sapiens
aaccccaagcugccucugggc

SEQ ID NO: 1457315 - RNA, 23 nt, Homo sapiens
aaccccgagcugggggguuggca

SEQ ID NO: 1457316 - RNA, 16 nt, Homo sapiens
aaccccugcuccaguc

SEQ ID NO: 1457317 - RNA, 18 nt, Homo sapiens
aacccggggcuggugggc

SEQ ID NO: 1457318 - RNA, 18 nt, Homo sapiens
aacccucuggggagcuca

SEQ ID NO: 1457319 - RNA, 12 nt, Homo sapiens
aacccugucuga

SEQ ID NO: 1457320 - RNA, 12 nt, Homo sapiens
aaccgacaggcc

SEQ ID NO: 1457321 - RNA, 14 nt, Homo sapiens
aaccgauaaugcau

SEQ ID NO: 1457322 - RNA, 18 nt, Homo sapiens
aaccguggucucauguaa

SEQ ID NO: 1457323 - RNA, 14 nt, Homo sapiens
aaccuaguacugcc

SEQ ID NO: 1457324 - RNA, 17 nt, Homo sapiens
aaccuaugaaacuauug

SEQ ID NO: 1457325 - RNA, 13 nt, Homo sapiens
aaccucaaaaugu

SEQ ID NO: 1457326 - RNA, 14 nt, Homo sapiens
aaccuccagccucc

SEQ ID NO: 1457327 - RNA, 14 nt, Homo sapiens
aaccuccauucuau

SEQ ID NO: 1457328 - RNA, 18 nt, Homo sapiens
aaccucuaugcaaucuga

SEQ ID NO: 1457329 - RNA, 17 nt, Homo sapiens
aaccucuucuggcucaa

SEQ ID NO: 1457330 - RNA, 14 nt, Homo sapiens
aaccugcugaaggg

SEQ ID NO: 1457331 - RNA, 17 nt, Homo sapiens
aaccuggauccagcacu

SEQ ID NO: 1457332 - RNA, 19 nt, Homo sapiens
aaccugguggcaccagaug

SEQ ID NO: 1457333 - RNA, 21 nt, Homo sapiens
aaccuuaaagaaccaucagca

SEQ ID NO: 1457334 - RNA, 17 nt, Homo sapiens
aaccuuaaauauauaau

SEQ ID NO: 1457335 - RNA, 19 nt, Homo sapiens
aaccuuauauuuacaauaa

SEQ ID NO: 1457336 - RNA, 15 nt, Homo sapiens
aaccuucaacccagu

SEQ ID NO: 1457337 - RNA, 19 nt, Homo sapiens
aaccuucacaucugucacg

SEQ ID NO: 1457338 - RNA, 21 nt, Homo sapiens
aaccuugcuguccugaucugu

SEQ ID NO: 1457339 - RNA, 23 nt, Homo sapiens
aaccuugcuguccugaucuguga

SEQ ID NO: 1457340 - RNA, 16 nt, Homo sapiens
aacgauaaaauuacaa

SEQ ID NO: 1457341 - RNA, 19 nt, Homo sapiens
aacgauuuuaugaaaugac

SEQ ID NO: 1457342 - RNA, 23 nt, Homo sapiens
aacgauuuuaugaaaugaccucu

SEQ ID NO: 1457343 - RNA, 11 nt, Homo sapiens
aacgccagucu

SEQ ID NO: 1457344 - RNA, 19 nt, Homo sapiens
aacgcccuuuccuccucag

SEQ ID NO: 1457345 - RNA, 18 nt, Homo sapiens
aacgccgcugacugccac

SEQ ID NO: 1457346 - RNA, 16 nt, Homo sapiens
aacgcguaucuaggcu

SEQ ID NO: 1457347 - RNA, 24 nt, Homo sapiens
aacggcucagacaggcagauuuga

SEQ ID NO: 1457348 - RNA, 22 nt, Homo sapiens
aacgucauguguuuugccaaag

SEQ ID NO: 1457349 - RNA, 15 nt, Homo sapiens
aacguggcacuggua

SEQ ID NO: 1457350 - RNA, 17 nt, Homo sapiens
aacuaaaaggaagucau

SEQ ID NO: 1457351 - RNA, 20 nt, Homo sapiens
aacuaaaaggaagucaucca

SEQ ID NO: 1457352 - RNA, 15 nt, Homo sapiens
aacuaaacagauaaa

SEQ ID NO: 1457353 - RNA, 17 nt, Homo sapiens
aacuaagacauaugcau

SEQ ID NO: 1457354 - RNA, 22 nt, Homo sapiens
aacuaauaaaagcauaaaugca

SEQ ID NO: 1457355 - RNA, 16 nt, Homo sapiens
aacuaaucaccauauu

SEQ ID NO: 1457356 - RNA, 14 nt, Homo sapiens
aacuaauucucaca

SEQ ID NO: 1457357 - RNA, 13 nt, Homo sapiens
aacuacugugauc

SEQ ID NO: 1457358 - RNA, 11 nt, Homo sapiens
aacuacuucuu

SEQ ID NO: 1457359 - RNA, 17 nt, Homo sapiens
aacuagaauuuauucaa

SEQ ID NO: 1457360 - RNA, 13 nt, Homo sapiens
aacuagcuuuugc

SEQ ID NO: 1457361 - RNA, 21 nt, Homo sapiens
aacuaggcucagagaugugca

SEQ ID NO: 1457362 - RNA, 20 nt, Homo sapiens
aacuagguuuuugcuucucc

SEQ ID NO: 1457363 - RNA, 18 nt, Homo sapiens
aacuauaagcccacuguu

SEQ ID NO: 1457364 - RNA, 19 nt, Homo sapiens
aacuaugguucccaauaaa

SEQ ID NO: 1457365 - RNA, 16 nt, Homo sapiens
aacuauguacuuuaaa

SEQ ID NO: 1457366 - RNA, 10 nt, Homo sapiens
aacuauuuau

SEQ ID NO: 1457367 - RNA, 18 nt, Homo sapiens
aacucaaauggggccaga

SEQ ID NO: 1457368 - RNA, 22 nt, Homo sapiens
aacucaauuucuugguauuauu

SEQ ID NO: 1457369 - RNA, 22 nt, Homo sapiens
aacucacaagugcucaucuguu

SEQ ID NO: 1457370 - RNA, 16 nt, Homo sapiens
aacucacucugggcug

SEQ ID NO: 1457371 - RNA, 12 nt, Homo sapiens
aacucacuguga

SEQ ID NO: 1457372 - RNA, 23 nt, Homo sapiens
aacucagauccagggacagaggc

SEQ ID NO: 1457373 - RNA, 19 nt, Homo sapiens
aacucagggacagagccau

SEQ ID NO: 1457374 - RNA, 20 nt, Homo sapiens
aacucagggacagagccaug

SEQ ID NO: 1457375 - RNA, 15 nt, Homo sapiens
aacucaguccuguac

SEQ ID NO: 1457376 - RNA, 16 nt, Homo sapiens
aagacucuauucucaa

SEQ ID NO: 1457377 - RNA, 17 nt, Homo sapiens
aagacugaaucuaccug

SEQ ID NO: 1457378 - RNA, 19 nt, Homo sapiens
aagacugucagcuuccaaa

SEQ ID NO: 1457379 - RNA, 21 nt, Homo sapiens
aagacuucucuuuugcacauc

SEQ ID NO: 1457380 - RNA, 14 nt, Homo sapiens
aagacuuguaauau

SEQ ID NO: 1457381 - RNA, 16 nt, Homo sapiens
aagagaagagggccca

SEQ ID NO: 1457382 - RNA, 14 nt, Homo sapiens
aagagaagcaauuu

SEQ ID NO: 1457383 - RNA, 16 nt, Homo sapiens
aagagacuccgucuca

SEQ ID NO: 1457384 - RNA, 17 nt, Homo sapiens
aagagagucgcaucuca

SEQ ID NO: 1457385 - RNA, 22 nt, Homo sapiens
aagagcaggacuccaggcccaa

SEQ ID NO: 1457386 - RNA, 13 nt, Homo sapiens
aagagcuaauaaa

SEQ ID NO: 1457387 - RNA, 14 nt, Homo sapiens
aagaggaacagcac

SEQ ID NO: 1457388 - RNA, 22 nt, Homo sapiens
aagaggagcacuuccaaaauuc

SEQ ID NO: 1457389 - RNA, 21 nt, Homo sapiens
aagaggcugccccucucacca

SEQ ID NO: 1457390 - RNA, 17 nt, Homo sapiens
aagagggggcuggccau

SEQ ID NO: 1457391 - RNA, 13 nt, Homo sapiens
aagaggugggagc

SEQ ID NO: 1457392 - RNA, 22 nt, Homo sapiens
aagaguacagaagcuuuagcaa

SEQ ID NO: 1457393 - RNA, 13 nt, Homo sapiens
aagaguaguaaua

SEQ ID NO: 1457394 - RNA, 15 nt, Homo sapiens
aagaguauguuguaa

SEQ ID NO: 1457395 - RNA, 18 nt, Homo sapiens
aagagucauauugcccag

SEQ ID NO: 1457396 - RNA, 18 nt, Homo sapiens
aagagugacuaguacaaa

SEQ ID NO: 1457397 - RNA, 16 nt, Homo sapiens
aagagugauugcagcu

SEQ ID NO: 1457398 - RNA, 15 nt, Homo sapiens
aagauaacugagaau

SEQ ID NO: 1457399 - RNA, 15 nt, Homo sapiens
aagauacaaguuuca

SEQ ID NO: 1457400 - RNA, 22 nt, Homo sapiens
aagauagaugcacuuaugcagu

SEQ ID NO: 1457401 - RNA, 22 nt, Homo sapiens
aagaucaaggaguacaaugccc

SEQ ID NO: 1457402 - RNA, 14 nt, Homo sapiens
aagaucaauucccu

SEQ ID NO: 1457403 - RNA, 21 nt, Homo sapiens
aagaucuguaaguaacuucac

SEQ ID NO: 1457404 - RNA, 18 nt, Homo sapiens
aagaucuguccucagccu

SEQ ID NO: 1457405 - RNA, 22 nt, Homo sapiens
aagaugauggcucauuuacacu

SEQ ID NO: 1457406 - RNA, 21 nt, Homo sapiens
aagaugccagugaaacuucaa

SEQ ID NO: 1457407 - RNA, 17 nt, Homo sapiens
aagauggaaaucacauu

SEQ ID NO: 1457408 - RNA, 22 nt, Homo sapiens
aagaugguauauuugguacugu

SEQ ID NO: 1457409 - RNA, 17 nt, Homo sapiens
aagauguauccuuccaa

SEQ ID NO: 1457410 - RNA, 22 nt, Homo sapiens
aagauguguugcuauccugaaa

SEQ ID NO: 1457411 - RNA, 21 nt, Homo sapiens
aagauucacauaguuuauuuc

SEQ ID NO: 1457412 - RNA, 20 nt, Homo sapiens
aagauucauauuuacuucuu

SEQ ID NO: 1457413 - RNA, 17 nt, Homo sapiens
aagauucuccugugcua

SEQ ID NO: 1457414 - RNA, 20 nt, Homo sapiens
aagauucuuaaaaauugaau

SEQ ID NO: 1457415 - RNA, 15 nt, Homo sapiens
aagauugcaccacug

SEQ ID NO: 1457416 - RNA, 19 nt, Homo sapiens
aagauuuuauuuauggaau

SEQ ID NO: 1457417 - RNA, 19 nt, Homo sapiens
aagauuuugcaccuguaaa

SEQ ID NO: 1457418 - RNA, 21 nt, Homo sapiens
aagcaaaaaaugaaugucuaa

SEQ ID NO: 1457419 - RNA, 13 nt, Homo sapiens
aagcaauugucug

SEQ ID NO: 1457420 - RNA, 18 nt, Homo sapiens
aagcaauuucuugcucua

SEQ ID NO: 1457421 - RNA, 15 nt, Homo sapiens
aagcacaaagccauu

SEQ ID NO: 1457422 - RNA, 19 nt, Homo sapiens
aagcacagauguucuucaa

SEQ ID NO: 1457423 - RNA, 15 nt, Homo sapiens
aagcaccccaugcca

SEQ ID NO: 1457424 - RNA, 19 nt, Homo sapiens
aagcaccugcaugugcugu

SEQ ID NO: 1457425 - RNA, 21 nt, Homo sapiens
aagcacugauaucuggccuaa

SEQ ID NO: 1457426 - RNA, 13 nt, Homo sapiens
aagcagaauuuaa

SEQ ID NO: 1457427 - RNA, 16 nt, Homo sapiens
aagcaggguacccuuu

SEQ ID NO: 1457428 - RNA, 16 nt, Homo sapiens
aagcagucucacugca

SEQ ID NO: 1457429 - RNA, 16 nt, Homo sapiens
aagcagucuugcucug

SEQ ID NO: 1457430 - RNA, 17 nt, Homo sapiens
aagcaguggccuuuuuc

SEQ ID NO: 1457431 - RNA, 16 nt, Homo sapiens
aagcauguagacugug

SEQ ID NO: 1457432 - RNA, 23 nt, Homo sapiens
aagcaugucucaauaguaaaaga

SEQ ID NO: 1457433 - RNA, 17 nt, Homo sapiens
aagcauugacuugccgu

SEQ ID NO: 1457434 - RNA, 11 nt, Homo sapiens
aagcauuguuu

SEQ ID NO: 1457435 - RNA, 20 nt, Homo sapiens
aagcauuugcaacagcuaca

SEQ ID NO: 1457436 - RNA, 11 nt, Homo sapiens
aagccaaagaa

SEQ ID NO: 1457437 - RNA, 19 nt, Homo sapiens
aagccaauucagacaggca

SEQ ID NO: 1457438 - RNA, 18 nt, Homo sapiens
aagccacaagucuuccag

SEQ ID NO: 1457439 - RNA, 13 nt, Homo sapiens
aagccacuugaaa

SEQ ID NO: 1457440 - RNA, 15 nt, Homo sapiens
aagcccaauauuaua

SEQ ID NO: 1457441 - RNA, 19 nt, Homo sapiens
aagcccauuuguguacaca

SEQ ID NO: 1457442 - RNA, 14 nt, Homo sapiens
aagcccuaagugac

SEQ ID NO: 1457443 - RNA, 21 nt, Homo sapiens
aagcccugaaccccaagcgcu

SEQ ID NO: 1457444 - RNA, 15 nt, Homo sapiens
aagcccuuuacuuga

SEQ ID NO: 1457445 - RNA, 23 nt, Homo sapiens
aagccggcuugauuuccgugaac

SEQ ID NO: 1457446 - RNA, 23 nt, Homo sapiens
aagccucagcuacccacuauccu

SEQ ID NO: 1457447 - RNA, 12 nt, Homo sapiens
aagccugucauu

SEQ ID NO: 1457448 - RNA, 23 nt, Homo sapiens
aagccuuauuucuagaagcacau

SEQ ID NO: 1457449 - RNA, 14 nt, Homo sapiens
aagccuuccuacac

SEQ ID NO: 1457450 - RNA, 16 nt, Homo sapiens
aagccuuuugcucaca

SEQ ID NO: 1457451 - RNA, 16 nt, Homo sapiens
aagcguucagugaugu

SEQ ID NO: 1457452 - RNA, 18 nt, Homo sapiens
aagcguuggauguagcau

SEQ ID NO: 1457453 - RNA, 15 nt, Homo sapiens
aagcuagacagaucc

SEQ ID NO: 1457454 - RNA, 14 nt, Homo sapiens
aagcuagguguuua

SEQ ID NO: 1457455 - RNA, 17 nt, Homo sapiens
aagcuaguguaccuccu

SEQ ID NO: 1457456 - RNA, 19 nt, Homo sapiens
aagcucagugcucucucca

SEQ ID NO: 1457457 - RNA, 13 nt, Homo sapiens
aagcuccucguga

SEQ ID NO: 1457458 - RNA, 15 nt, Homo sapiens
aagcuccucgugaua

SEQ ID NO: 1457459 - RNA, 22 nt, Homo sapiens
aagcuccuguccucccaucccc

SEQ ID NO: 1457460 - RNA, 16 nt, Homo sapiens
aagcucugaagucaca

SEQ ID NO: 1457461 - RNA, 20 nt, Homo sapiens
aagcucugccucccggguuc

SEQ ID NO: 1457462 - RNA, 23 nt, Homo sapiens
aagcucuguuccaugcaacugga

SEQ ID NO: 1457463 - RNA, 17 nt, Homo sapiens
aagcucuguugcaauua

SEQ ID NO: 1457464 - RNA, 17 nt, Homo sapiens
aagcugagaagaaugaa

SEQ ID NO: 1457465 - RNA, 20 nt, Homo sapiens
aagcugaugacaacuuccca

SEQ ID NO: 1457466 - RNA, 12 nt, Homo sapiens
aagcugcuccag

SEQ ID NO: 1457467 - RNA, 13 nt, Homo sapiens
aagcugcuuuaaa

SEQ ID NO: 1457468 - RNA, 21 nt, Homo sapiens
aagcuguucucaggaucacug

SEQ ID NO: 1457469 - RNA, 17 nt, Homo sapiens
aagcuguuguacauuua

SEQ ID NO: 1457470 - RNA, 16 nt, Homo sapiens
aagcuuaacacuugac

SEQ ID NO: 1457471 - RNA, 12 nt, Homo sapiens
aagcuuauguca

SEQ ID NO: 1457472 - RNA, 21 nt, Homo sapiens
aagcuucagggccuugcugcu

SEQ ID NO: 1457473 - RNA, 12 nt, Homo sapiens
aagcuucuaucc

SEQ ID NO: 1457474 - RNA, 18 nt, Homo sapiens
aagcuugaagcuguggag

SEQ ID NO: 1457475 - RNA, 20 nt, Homo sapiens
aagcuuggggaacccaugag

SEQ ID NO: 1457476 - RNA, 15 nt, Homo sapiens
aagcuugucacugga

SEQ ID NO: 1457477 - RNA, 20 nt, Homo sapiens
aagcuuguuaucagcuuuca

SEQ ID NO: 1457478 - RNA, 18 nt, Homo sapiens
aaggaaaccaagugguca

SEQ ID NO: 1457479 - RNA, 21 nt, Homo sapiens
agccgagaucgcgccacugca

SEQ ID NO: 1457480 - RNA, 23 nt, Homo sapiens
agccgagaucgcgccacugcacu

SEQ ID NO: 1457481 - RNA, 16 nt, Homo sapiens
agccgcuucugacugc

SEQ ID NO: 1457482 - RNA, 15 nt, Homo sapiens
agccgguaacugucc

SEQ ID NO: 1457483 - RNA, 19 nt, Homo sapiens
agccguccuucuaaugaag

SEQ ID NO: 1457484 - RNA, 15 nt, Homo sapiens
agccgugaugcucag

SEQ ID NO: 1457485 - RNA, 17 nt, Homo sapiens
agccgugaugcucaggc

SEQ ID NO: 1457486 - RNA, 22 nt, Homo sapiens
agccuacuuucacacuaagaaa

SEQ ID NO: 1457487 - RNA, 16 nt, Homo sapiens
agccuauuuaccugca

SEQ ID NO: 1457488 - RNA, 16 nt, Homo sapiens
agccucaagaugaagg

SEQ ID NO: 1457489 - RNA, 12 nt, Homo sapiens
agccucaagucu

SEQ ID NO: 1457490 - RNA, 14 nt, Homo sapiens
agccuccaacacaa

SEQ ID NO: 1457491 - RNA, 23 nt, Homo sapiens
agccuccaccugauauucaggcu

SEQ ID NO: 1457492 - RNA, 12 nt, Homo sapiens
agccuccacugc

SEQ ID NO: 1457493 - RNA, 22 nt, Homo sapiens
agccucccccucagaugaucuc

SEQ ID NO: 1457494 - RNA, 15 nt, Homo sapiens
agccuccccgugcca

SEQ ID NO: 1457495 - RNA, 19 nt, Homo sapiens
agccuccccgugccaaaaa

SEQ ID NO: 1457496 - RNA, 20 nt, Homo sapiens
agccuccccgugccaaaaau

SEQ ID NO: 1457497 - RNA, 15 nt, Homo sapiens
agccuccucucucaa

SEQ ID NO: 1457498 - RNA, 16 nt, Homo sapiens
agccucuggcauuaga

SEQ ID NO: 1457499 - RNA, 21 nt, Homo sapiens
agccugagcagagacaugacu

SEQ ID NO: 1457500 - RNA, 13 nt, Homo sapiens
agccugcacuggg

SEQ ID NO: 1457501 - RNA, 14 nt, Homo sapiens
agccugcuggucac

SEQ ID NO: 1457502 - RNA, 13 nt, Homo sapiens
agccuggccagac

SEQ ID NO: 1457503 - RNA, 16 nt, Homo sapiens
agccugggagcccaga

SEQ ID NO: 1457504 - RNA, 17 nt, Homo sapiens
agccugggccaucucuu

SEQ ID NO: 1457505 - RNA, 23 nt, Homo sapiens
agccuguggcaucuuugccuugg

SEQ ID NO: 1457506 - RNA, 15 nt, Homo sapiens
agccuuaagccauag

SEQ ID NO: 1457507 - RNA, 20 nt, Homo sapiens
agccuuccguauccaucgaa

SEQ ID NO: 1457508 - RNA, 13 nt, Homo sapiens
agcgaaucucugc

SEQ ID NO: 1457509 - RNA, 14 nt, Homo sapiens
agcgaaucucugcc

SEQ ID NO: 1457510 - RNA, 18 nt, Homo sapiens
agcgcaucaggccuggca

SEQ ID NO: 1457511 - RNA, 18 nt, Homo sapiens
agcggagaggaagccagc

SEQ ID NO: 1457512 - RNA, 22 nt, Homo sapiens
agcggcccuaagggagugucua

SEQ ID NO: 1457513 - RNA, 14 nt, Homo sapiens
agcgggcacagggc

SEQ ID NO: 1457514 - RNA, 19 nt, Homo sapiens
agcgggcuugacugcauug

SEQ ID NO: 1457515 - RNA, 15 nt, Homo sapiens
agcguagcuaaguga

SEQ ID NO: 1457516 - RNA, 17 nt, Homo sapiens
agcguagcuaagugaaa

SEQ ID NO: 1457517 - RNA, 15 nt, Homo sapiens
agcgucccagucucu

SEQ ID NO: 1457518 - RNA, 21 nt, Homo sapiens
agcuaacagucccuauggaaa

SEQ ID NO: 1457519 - RNA, 19 nt, Homo sapiens
agcuaaccaguuaccacac

SEQ ID NO: 1457520 - RNA, 20 nt, Homo sapiens
agcuaaccccaagcugccuc

SEQ ID NO: 1457521 - RNA, 14 nt, Homo sapiens
agcuaagaaccugg

SEQ ID NO: 1457522 - RNA, 20 nt, Homo sapiens
agcuaaguacacaauaagca

SEQ ID NO: 1457523 - RNA, 19 nt, Homo sapiens
agcuacacaaggaaggcau

SEQ ID NO: 1457524 - RNA, 13 nt, Homo sapiens
agcuacaggacau

SEQ ID NO: 1457525 - RNA, 21 nt, Homo sapiens
agcuacucuccccacgagggc

SEQ ID NO: 1457526 - RNA, 14 nt, Homo sapiens
agcuacugacuaug

SEQ ID NO: 1457527 - RNA, 19 nt, Homo sapiens
agcuagaaaacaggcaaau

SEQ ID NO: 1457528 - RNA, 16 nt, Homo sapiens
agcuagaaaacauuuu

SEQ ID NO: 1457529 - RNA, 17 nt, Homo sapiens
agcuagugaagaccaga

SEQ ID NO: 1457530 - RNA, 13 nt, Homo sapiens
agcuagugccuuu

SEQ ID NO: 1457531 - RNA, 14 nt, Homo sapiens
agcuagugccuuua

SEQ ID NO: 1457532 - RNA, 17 nt, Homo sapiens
agcuaguuaggagccca

SEQ ID NO: 1457533 - RNA, 14 nt, Homo sapiens
agcuauauccaugu

SEQ ID NO: 1457534 - RNA, 12 nt, Homo sapiens
agcuaucacugu

SEQ ID NO: 1457535 - RNA, 16 nt, Homo sapiens
agcuaucugucaucuc

SEQ ID NO: 1457536 - RNA, 23 nt, Homo sapiens
agcuaugaaaacagcuaucucac

SEQ ID NO: 1457537 - RNA, 14 nt, Homo sapiens
agcuaugaauauag

SEQ ID NO: 1457538 - RNA, 15 nt, Homo sapiens
agcuauggugcuugc

SEQ ID NO: 1457539 - RNA, 22 nt, Homo sapiens
agcuauuuucaacauaacugaa

SEQ ID NO: 1457540 - RNA, 19 nt, Homo sapiens
agcucagaaacgaaaucua

SEQ ID NO: 1457541 - RNA, 17 nt, Homo sapiens
agcucagucccaucaga

SEQ ID NO: 1457542 - RNA, 16 nt, Homo sapiens
agcucagugcucucuc

SEQ ID NO: 1457543 - RNA, 22 nt, Homo sapiens
agcucaugcauuucaagcagcu

SEQ ID NO: 1457544 - RNA, 19 nt, Homo sapiens
agcuccccagaucucccac

SEQ ID NO: 1457545 - RNA, 15 nt, Homo sapiens
agcucccggggacga

SEQ ID NO: 1457546 - RNA, 22 nt, Homo sapiens
agcucccggggacgacgcugac

SEQ ID NO: 1457547 - RNA, 14 nt, Homo sapiens
agcuccuaccucug

SEQ ID NO: 1457548 - RNA, 20 nt, Homo sapiens
agcuccuaccucugugccag

SEQ ID NO: 1457549 - RNA, 21 nt, Homo sapiens
agcuccuuggagcaggcaaaa

SEQ ID NO: 1457550 - RNA, 13 nt, Homo sapiens
agcucgugugccu

SEQ ID NO: 1457551 - RNA, 19 nt, Homo sapiens
agcucuacgugcuccucag

SEQ ID NO: 1457552 - RNA, 15 nt, Homo sapiens
agcucucccagugaa

SEQ ID NO: 1457553 - RNA, 16 nt, Homo sapiens
agcucuccugacuuuu

SEQ ID NO: 1457554 - RNA, 22 nt, Homo sapiens
agcucuggccacaacagggcau

SEQ ID NO: 1457555 - RNA, 22 nt, Homo sapiens
agcucuggggacagcuuccuca

SEQ ID NO: 1457556 - RNA, 18 nt, Homo sapiens
agcucuggguugugcaca

SEQ ID NO: 1457557 - RNA, 18 nt, Homo sapiens
agcugaacaauaggcugu

SEQ ID NO: 1457558 - RNA, 12 nt, Homo sapiens
agcugaacccau

SEQ ID NO: 1457559 - RNA, 15 nt, Homo sapiens
agcugaagcuggugc

SEQ ID NO: 1457560 - RNA, 13 nt, Homo sapiens
agcugaaugccuc

SEQ ID NO: 1457561 - RNA, 22 nt, Homo sapiens
agcugaccccgagaagugcucu

SEQ ID NO: 1457562 - RNA, 19 nt, Homo sapiens
agcugacccggccucucug

SEQ ID NO: 1457563 - RNA, 22 nt, Homo sapiens
agcugagauugugccacuucac

SEQ ID NO: 1457564 - RNA, 15 nt, Homo sapiens
agcugaggccuugcc

SEQ ID NO: 1457565 - RNA, 23 nt, Homo sapiens
agcugaguuuccuaugggaacaa

SEQ ID NO: 1457566 - RNA, 18 nt, Homo sapiens
agcugaucauaagugaau

SEQ ID NO: 1457567 - RNA, 13 nt, Homo sapiens
agcugcaccugau

SEQ ID NO: 1457568 - RNA, 19 nt, Homo sapiens
agcugcacugaucacccaa

SEQ ID NO: 1457569 - RNA, 14 nt, Homo sapiens
agcugcaggugcca

SEQ ID NO: 1457570 - RNA, 19 nt, Homo sapiens
agcugcccuccuuguccac

SEQ ID NO: 1457571 - RNA, 16 nt, Homo sapiens
agcugccucacuuccu

SEQ ID NO: 1457572 - RNA, 19 nt, Homo sapiens
agcugccuucccuagcuuu

SEQ ID NO: 1457573 - RNA, 16 nt, Homo sapiens
agcugccuuggcucag

SEQ ID NO: 1457574 - RNA, 19 nt, Homo sapiens
agcugcuauccccaucucc

SEQ ID NO: 1457575 - RNA, 20 nt, Homo sapiens
agcugcucugaaaucuccuu

SEQ ID NO: 1457576 - RNA, 16 nt, Homo sapiens
agcugcuggcuugcag

SEQ ID NO: 1457577 - RNA, 12 nt, Homo sapiens
agcuggaacccg

SEQ ID NO: 1457578 - RNA, 22 nt, Homo sapiens
agcuggaagggucaacaucuuu

SEQ ID NO: 1457579 - RNA, 23 nt, Homo sapiens
agcuggaagggucaacaucuuuu

SEQ ID NO: 1457580 - RNA, 22 nt, Homo sapiens
agcuggcuuguuucuuaugcca

SEQ ID NO: 1457581 - RNA, 12 nt, Homo sapiens
agcugggagcac

SEQ ID NO: 1457582 - RNA, 16 nt, Homo sapiens
aggagagccaaccucg

SEQ ID NO: 1457583 - RNA, 23 nt, Homo sapiens
aggagaggaaaaguaaggugcag

SEQ ID NO: 1457584 - RNA, 14 nt, Homo sapiens
aggagcacuuccaa

SEQ ID NO: 1457585 - RNA, 21 nt, Homo sapiens
aggagcagccugaacccgggg

SEQ ID NO: 1457586 - RNA, 21 nt, Homo sapiens
aggagccauugcucuccuaga

SEQ ID NO: 1457587 - RNA, 20 nt, Homo sapiens
aggagcggccagaagaucua

SEQ ID NO: 1457588 - RNA, 18 nt, Homo sapiens
aggagcuucuuguuuccu

SEQ ID NO: 1457589 - RNA, 15 nt, Homo sapiens
aggaggagauggcca

SEQ ID NO: 1457590 - RNA, 23 nt, Homo sapiens
aggaggagcaccuccgccagauc

SEQ ID NO: 1457591 - RNA, 16 nt, Homo sapiens
aggaggcacugcugau

SEQ ID NO: 1457592 - RNA, 16 nt, Homo sapiens
aggaggccaaacuguc

SEQ ID NO: 1457593 - RNA, 20 nt, Homo sapiens
aggaggcucccgaggggaag

SEQ ID NO: 1457594 - RNA, 16 nt, Homo sapiens
aggagggcccuaccug

SEQ ID NO: 1457595 - RNA, 22 nt, Homo sapiens
aggaggggaggaacacugcacu

SEQ ID NO: 1457596 - RNA, 23 nt, Homo sapiens
aggaggggucuggguacuucuug

SEQ ID NO: 1457597 - RNA, 22 nt, Homo sapiens
aggaggugcuaucgcaccacug

SEQ ID NO: 1457598 - RNA, 23 nt, Homo sapiens
aggaggugcuaucgcaccacugu

SEQ ID NO: 1457599 - RNA, 22 nt, Homo sapiens
aggagguuuggggucugccacc

SEQ ID NO: 1457600 - RNA, 14 nt, Homo sapiens
aggaguaauggcau

SEQ ID NO: 1457601 - RNA, 17 nt, Homo sapiens
aggaguacaaugcccag

SEQ ID NO: 1457602 - RNA, 16 nt, Homo sapiens
aggagucaaaacuaca

SEQ ID NO: 1457603 - RNA, 17 nt, Homo sapiens
aggagugugaccacuga

SEQ ID NO: 1457604 - RNA, 18 nt, Homo sapiens
aggagugugaccacugaa

SEQ ID NO: 1457605 - RNA, 16 nt, Homo sapiens
aggauaucacauugga

SEQ ID NO: 1457606 - RNA, 14 nt, Homo sapiens
aggaucacugggcu

SEQ ID NO: 1457607 - RNA, 19 nt, Homo sapiens
aggaucccugaucccauuu

SEQ ID NO: 1457608 - RNA, 14 nt, Homo sapiens
aggaucucucagga

SEQ ID NO: 1457609 - RNA, 21 nt, Homo sapiens
aggaugaauguaugugcacug

SEQ ID NO: 1457610 - RNA, 23 nt, Homo sapiens
aggaugagagcccagagguaaca

SEQ ID NO: 1457611 - RNA, 12 nt, Homo sapiens
aggaugugauau

SEQ ID NO: 1457612 - RNA, 13 nt, Homo sapiens
aggaugugcaagc

SEQ ID NO: 1457613 - RNA, 16 nt, Homo sapiens
aggauguuuuucauga

SEQ ID NO: 1457614 - RNA, 14 nt, Homo sapiens
aggauuauugucaa

SEQ ID NO: 1457615 - RNA, 15 nt, Homo sapiens
aggauuauuugcuca

SEQ ID NO: 1457616 - RNA, 17 nt, Homo sapiens
aggauuuuuauugauug

SEQ ID NO: 1457617 - RNA, 16 nt, Homo sapiens
aggcaaaaaacucuua

SEQ ID NO: 1457618 - RNA, 15 nt, Homo sapiens
aggcaacauccaaaa

SEQ ID NO: 1457619 - RNA, 19 nt, Homo sapiens
aggcacagcugaguuauga

SEQ ID NO: 1457620 - RNA, 13 nt, Homo sapiens
aggcacugcugau

SEQ ID NO: 1457621 - RNA, 21 nt, Homo sapiens
aggcagaggcuguggugagcc

SEQ ID NO: 1457622 - RNA, 18 nt, Homo sapiens
aggcagagguugcagugu

SEQ ID NO: 1457623 - RNA, 16 nt, Homo sapiens
aggcagauagcacugg

SEQ ID NO: 1457624 - RNA, 19 nt, Homo sapiens
aggcagcucaccccugggc

SEQ ID NO: 1457625 - RNA, 19 nt, Homo sapiens
aggcagcuggaugagacuu

SEQ ID NO: 1457626 - RNA, 18 nt, Homo sapiens
aggcagcuucaagugccu

SEQ ID NO: 1457627 - RNA, 18 nt, Homo sapiens
aggcagcuucuacuccug

SEQ ID NO: 1457628 - RNA, 21 nt, Homo sapiens
aggcagcuucuacuccugccu

SEQ ID NO: 1457629 - RNA, 24 nt, Homo sapiens
aggcagcuucuacuccugccucau

SEQ ID NO: 1457630 - RNA, 17 nt, Homo sapiens
aggcaggagaacuacuu

SEQ ID NO: 1457631 - RNA, 15 nt, Homo sapiens
aggcaggagguacaa

SEQ ID NO: 1457632 - RNA, 22 nt, Homo sapiens
aggcaggcugggacggaccagc

SEQ ID NO: 1457633 - RNA, 21 nt, Homo sapiens
aggcagggcucucccgugcau

SEQ ID NO: 1457634 - RNA, 18 nt, Homo sapiens
aggcagguccacagagag

SEQ ID NO: 1457635 - RNA, 16 nt, Homo sapiens
aggcaguagaacucca

SEQ ID NO: 1457636 - RNA, 19 nt, Homo sapiens
aggcauaagaaaacuaaga

SEQ ID NO: 1457637 - RNA, 22 nt, Homo sapiens
aggcauaagacccuaagccucc

SEQ ID NO: 1457638 - RNA, 16 nt, Homo sapiens
aggcaucuacacagcc

SEQ ID NO: 1457639 - RNA, 17 nt, Homo sapiens
aggcaugaaauacugug

SEQ ID NO: 1457640 - RNA, 20 nt, Homo sapiens
aggcaugaaauacugugccu

SEQ ID NO: 1457641 - RNA, 20 nt, Homo sapiens
aggcauuaauguuucuaucu

SEQ ID NO: 1457642 - RNA, 19 nt, Homo sapiens
aggccacacucagcacaag

SEQ ID NO: 1457643 - RNA, 19 nt, Homo sapiens
aggccagagggcaguggcc

SEQ ID NO: 1457644 - RNA, 19 nt, Homo sapiens
aggccagugccagcaccug

SEQ ID NO: 1457645 - RNA, 21 nt, Homo sapiens
aggccauggcagaauaaucuu

SEQ ID NO: 1457646 - RNA, 19 nt, Homo sapiens
aggccauuuggacucugcc

SEQ ID NO: 1457647 - RNA, 14 nt, Homo sapiens
aggcccaacuguga

SEQ ID NO: 1457648 - RNA, 13 nt, Homo sapiens
aggcccauguaua

SEQ ID NO: 1457649 - RNA, 19 nt, Homo sapiens
aggccccagccucccugaa

SEQ ID NO: 1457650 - RNA, 21 nt, Homo sapiens
aggcccugagcuuuguccuga

SEQ ID NO: 1457651 - RNA, 14 nt, Homo sapiens
aggcccuguccuaa

SEQ ID NO: 1457652 - RNA, 20 nt, Homo sapiens
aggcccuguccuaagcacuu

SEQ ID NO: 1457653 - RNA, 22 nt, Homo sapiens
aggcccuuccucuccacugccu

SEQ ID NO: 1457654 - RNA, 22 nt, Homo sapiens
aggccgagagcagacaccagca

SEQ ID NO: 1457655 - RNA, 23 nt, Homo sapiens
aggccggaaaaggcgcaucuaac

SEQ ID NO: 1457656 - RNA, 20 nt, Homo sapiens
aggccgggcgcaguggcuca

SEQ ID NO: 1457657 - RNA, 22 nt, Homo sapiens
aggccgggcgcaguggcucacg

SEQ ID NO: 1457658 - RNA, 13 nt, Homo sapiens
aggccgugugucu

SEQ ID NO: 1457659 - RNA, 22 nt, Homo sapiens
aggccuauaaccccagcucccu

SEQ ID NO: 1457660 - RNA, 14 nt, Homo sapiens
aggccuggacuuuc

SEQ ID NO: 1457661 - RNA, 15 nt, Homo sapiens
aggccuggauaauau

SEQ ID NO: 1457662 - RNA, 14 nt, Homo sapiens
aggccugugccuug

SEQ ID NO: 1457663 - RNA, 15 nt, Homo sapiens
aggcgauccaccugu

SEQ ID NO: 1457664 - RNA, 19 nt, Homo sapiens
aggcgauccaccugucuca

SEQ ID NO: 1457665 - RNA, 16 nt, Homo sapiens
aggcgcaggugcacag

SEQ ID NO: 1457666 - RNA, 21 nt, Homo sapiens
aggcgccccuucccccuccaa

SEQ ID NO: 1457667 - RNA, 17 nt, Homo sapiens
aggcgccgcacuuccuu

SEQ ID NO: 1457668 - RNA, 16 nt, Homo sapiens
aggcgccugccaucau

SEQ ID NO: 1457669 - RNA, 15 nt, Homo sapiens
aggcuaccucaagac

SEQ ID NO: 1457670 - RNA, 21 nt, Homo sapiens
aggcuagaacacuacagggga

SEQ ID NO: 1457671 - RNA, 15 nt, Homo sapiens
aggcuauguauggaa

SEQ ID NO: 1457672 - RNA, 19 nt, Homo sapiens
aggcucaggucccuggggc

SEQ ID NO: 1457673 - RNA, 16 nt, Homo sapiens
aggcucauggacgaga

SEQ ID NO: 1457674 - RNA, 18 nt, Homo sapiens
aggcucuguggagggcau

SEQ ID NO: 1457675 - RNA, 13 nt, Homo sapiens
aggcucuuagcag

SEQ ID NO: 1457676 - RNA, 15 nt, Homo sapiens
aggcugaaagacagg

SEQ ID NO: 1457677 - RNA, 18 nt, Homo sapiens
aggcugaccacagcacag

SEQ ID NO: 1457678 - RNA, 12 nt, Homo sapiens
aggcugcaguga

SEQ ID NO: 1457679 - RNA, 16 nt, Homo sapiens
aggcugccccucucac

SEQ ID NO: 1457680 - RNA, 22 nt, Homo sapiens
aggcugggaacucaucugguug

SEQ ID NO: 1457681 - RNA, 18 nt, Homo sapiens
aggcugggccauguccaa

SEQ ID NO: 1457682 - RNA, 14 nt, Homo sapiens
aggcugguggcaag

SEQ ID NO: 1457683 - RNA, 16 nt, Homo sapiens
aggcugugggccucaa

SEQ ID NO: 1457684 - RNA, 13 nt, Homo sapiens
agguggugcaaau

SEQ ID NO: 1457685 - RNA, 16 nt, Homo sapiens
aggugugcccuguaca

SEQ ID NO: 1457686 - RNA, 17 nt, Homo sapiens
agguguggcggcgagca

SEQ ID NO: 1457687 - RNA, 23 nt, Homo sapiens
agguguggggacacagcagugag

SEQ ID NO: 1457688 - RNA, 20 nt, Homo sapiens
agguguuauaucuaugcaaa

SEQ ID NO: 1457689 - RNA, 15 nt, Homo sapiens
agguguuuaguugca

SEQ ID NO: 1457690 - RNA, 15 nt, Homo sapiens
agguuauacuccucc

SEQ ID NO: 1457691 - RNA, 15 nt, Homo sapiens
agguucacugagcuc

SEQ ID NO: 1457692 - RNA, 22 nt, Homo sapiens
agguucccuguucuuccuccag

SEQ ID NO: 1457693 - RNA, 20 nt, Homo sapiens
agguucucagguguugccaa

SEQ ID NO: 1457694 - RNA, 18 nt, Homo sapiens
agguucugagaccagugu

SEQ ID NO: 1457695 - RNA, 16 nt, Homo sapiens
agguugaacuuugcca

SEQ ID NO: 1457696 - RNA, 22 nt, Homo sapiens
agguugaagaaaggaaccuggg

SEQ ID NO: 1457697 - RNA, 17 nt, Homo sapiens
agguugagacuacuuaa

SEQ ID NO: 1457698 - RNA, 16 nt, Homo sapiens
agguugccugaaaaau

SEQ ID NO: 1457699 - RNA, 14 nt, Homo sapiens
agguuuacauucau

SEQ ID NO: 1457700 - RNA, 17 nt, Homo sapiens
agguuucccccugucuc

SEQ ID NO: 1457701 - RNA, 15 nt, Homo sapiens
agguuuuuacuguga

SEQ ID NO: 1457702 - RNA, 19 nt, Homo sapiens
agguuuuucucauguaucu

SEQ ID NO: 1457703 - RNA, 19 nt, Homo sapiens
aguaaaaacuguucucuau

SEQ ID NO: 1457704 - RNA, 16 nt, Homo sapiens
aguaaaaauacaagca

SEQ ID NO: 1457705 - RNA, 19 nt, Homo sapiens
aguaaacgauaaaaugugg

SEQ ID NO: 1457706 - RNA, 12 nt, Homo sapiens
aguaaagucaac

SEQ ID NO: 1457707 - RNA, 13 nt, Homo sapiens
aguaaagucaaca

SEQ ID NO: 1457708 - RNA, 17 nt, Homo sapiens
aguaaauaacaggcauu

SEQ ID NO: 1457709 - RNA, 13 nt, Homo sapiens
aguaaaucucaca

SEQ ID NO: 1457710 - RNA, 14 nt, Homo sapiens
aguaaauuaggcag

SEQ ID NO: 1457711 - RNA, 17 nt, Homo sapiens
aguaacgcgucuuccug

SEQ ID NO: 1457712 - RNA, 12 nt, Homo sapiens
aguaacuuugaa

SEQ ID NO: 1457713 - RNA, 14 nt, Homo sapiens
aguaaggugcaguu

SEQ ID NO: 1457714 - RNA, 15 nt, Homo sapiens
aguaauagagcaaaa

SEQ ID NO: 1457715 - RNA, 22 nt, Homo sapiens
aguaauagagcaaaauugaugu

SEQ ID NO: 1457716 - RNA, 17 nt, Homo sapiens
aguaaucaauacagaca

SEQ ID NO: 1457717 - RNA, 19 nt, Homo sapiens
aguaaucaauacagacaag

SEQ ID NO: 1457718 - RNA, 15 nt, Homo sapiens
aguacacagauaccu

SEQ ID NO: 1457719 - RNA, 18 nt, Homo sapiens
aguacagugagccaagau

SEQ ID NO: 1457720 - RNA, 12 nt, Homo sapiens
aguacaucucua

SEQ ID NO: 1457721 - RNA, 21 nt, Homo sapiens
aguaccaaagaaauuauaaac

SEQ ID NO: 1457722 - RNA, 15 nt, Homo sapiens
aguacccaucuagua

SEQ ID NO: 1457723 - RNA, 18 nt, Homo sapiens
aguaccccccuaccacac

SEQ ID NO: 1457724 - RNA, 20 nt, Homo sapiens
aguaccgcccucggggcccg

SEQ ID NO: 1457725 - RNA, 13 nt, Homo sapiens
aguaccuggaccu

SEQ ID NO: 1457726 - RNA, 14 nt, Homo sapiens
aguaccuucaauac

SEQ ID NO: 1457727 - RNA, 17 nt, Homo sapiens
aguaccuucaauacuua

SEQ ID NO: 1457728 - RNA, 16 nt, Homo sapiens
aguacuuauguugcac

SEQ ID NO: 1457729 - RNA, 13 nt, Homo sapiens
aguagaacugucu

SEQ ID NO: 1457730 - RNA, 15 nt, Homo sapiens
aguagaaugguggcu

SEQ ID NO: 1457731 - RNA, 18 nt, Homo sapiens
aguagagcaaaucuauga

SEQ ID NO: 1457732 - RNA, 21 nt, Homo sapiens
aguagagcagccacaaccaaa

SEQ ID NO: 1457733 - RNA, 16 nt, Homo sapiens
aguagaggcuauggac

SEQ ID NO: 1457734 - RNA, 19 nt, Homo sapiens
aguagauuuuaaagacaaa

SEQ ID NO: 1457735 - RNA, 21 nt, Homo sapiens
aguagauuuuaaagacaaaau

SEQ ID NO: 1457736 - RNA, 16 nt, Homo sapiens
aguagcauacauuuau

SEQ ID NO: 1457737 - RNA, 20 nt, Homo sapiens
aguagcugggauuacaggug

SEQ ID NO: 1457738 - RNA, 17 nt, Homo sapiens
aguaggggcuacuguga

SEQ ID NO: 1457739 - RNA, 22 nt, Homo sapiens
aguagguuuacauucaucucau

SEQ ID NO: 1457740 - RNA, 13 nt, Homo sapiens
aguaguacuugaa

SEQ ID NO: 1457741 - RNA, 20 nt, Homo sapiens
aguagucauacucccuggug

SEQ ID NO: 1457742 - RNA, 14 nt, Homo sapiens
aguaguuagcuuuc

SEQ ID NO: 1457743 - RNA, 23 nt, Homo sapiens
aguaguuuuuacagcuguguuau

SEQ ID NO: 1457744 - RNA, 18 nt, Homo sapiens
aguauacuuuuccccugu

SEQ ID NO: 1457745 - RNA, 20 nt, Homo sapiens
aguauauucuuugguuguga

SEQ ID NO: 1457746 - RNA, 21 nt, Homo sapiens
aguauauuuauagucacaaga

SEQ ID NO: 1457747 - RNA, 15 nt, Homo sapiens
aguauccaggcuuug

SEQ ID NO: 1457748 - RNA, 22 nt, Homo sapiens
aguaucuagcaaucacaacacu

SEQ ID NO: 1457749 - RNA, 23 nt, Homo sapiens
aguaucuguauguauauauacac

SEQ ID NO: 1457750 - RNA, 19 nt, Homo sapiens
aguaugagucaaugugcag

SEQ ID NO: 1457751 - RNA, 20 nt, Homo sapiens
aguauggcuccuccauaucu

SEQ ID NO: 1457752 - RNA, 15 nt, Homo sapiens
aguauuaauacuacc

SEQ ID NO: 1457753 - RNA, 23 nt, Homo sapiens
aguauugaaauguuugcauaaag

SEQ ID NO: 1457754 - RNA, 14 nt, Homo sapiens
aguauuucucagga

SEQ ID NO: 1457755 - RNA, 22 nt, Homo sapiens
agucaaaacagagaugugauaa

SEQ ID NO: 1457756 - RNA, 16 nt, Homo sapiens
agucaaaagagagaag

SEQ ID NO: 1457757 - RNA, 18 nt, Homo sapiens
agucaaagaugccccauu

SEQ ID NO: 1457758 - RNA, 12 nt, Homo sapiens
agucaacaaacu

SEQ ID NO: 1457759 - RNA, 15 nt, Homo sapiens
agucaacauaugcaa

SEQ ID NO: 1457760 - RNA, 16 nt, Homo sapiens
agucaacgccucggug

SEQ ID NO: 1457761 - RNA, 15 nt, Homo sapiens
agucaauuucuacuu

SEQ ID NO: 1457762 - RNA, 12 nt, Homo sapiens
agucacacagug

SEQ ID NO: 1457763 - RNA, 21 nt, Homo sapiens
agucacaguuagguagcuuua

SEQ ID NO: 1457764 - RNA, 14 nt, Homo sapiens
agucacugcacagu

SEQ ID NO: 1457765 - RNA, 23 nt, Homo sapiens
agucacugcacagugcaucucag

SEQ ID NO: 1457766 - RNA, 18 nt, Homo sapiens
agucacuucaccaucaac

SEQ ID NO: 1457767 - RNA, 21 nt, Homo sapiens
agucacuuugccagagccuga

SEQ ID NO: 1457768 - RNA, 19 nt, Homo sapiens
agucagaguccagugcucu

SEQ ID NO: 1457769 - RNA, 15 nt, Homo sapiens
agucaggcaggguua

SEQ ID NO: 1457770 - RNA, 21 nt, Homo sapiens
agucaucacauuucuaugcca

SEQ ID NO: 1457771 - RNA, 23 nt, Homo sapiens
agucauccaacaagaagaaauau

SEQ ID NO: 1457772 - RNA, 18 nt, Homo sapiens
agucauccagucuauuca

SEQ ID NO: 1457773 - RNA, 19 nt, Homo sapiens
agucauggcuaauuuaaca

SEQ ID NO: 1457774 - RNA, 18 nt, Homo sapiens
agucaugugugaacacau

SEQ ID NO: 1457775 - RNA, 14 nt, Homo sapiens
agucauucuucccu

SEQ ID NO: 1457776 - RNA, 21 nt, Homo sapiens
aguccacuuguucuguacuug

SEQ ID NO: 1457777 - RNA, 22 nt, Homo sapiens
aguccagacacuuaacucaauu

SEQ ID NO: 1457778 - RNA, 16 nt, Homo sapiens
aguccagauauuucac

SEQ ID NO: 1457779 - RNA, 15 nt, Homo sapiens
agucccagcuacuca

SEQ ID NO: 1457780 - RNA, 14 nt, Homo sapiens
agucccaguauucu

SEQ ID NO: 1457781 - RNA, 16 nt, Homo sapiens
agucccaguauucuca

SEQ ID NO: 1457782 - RNA, 19 nt, Homo sapiens
aguccgacccagacaucca

SEQ ID NO: 1457783 - RNA, 17 nt, Homo sapiens
aguccuagccacucagg

SEQ ID NO: 1457784 - RNA, 18 nt, Homo sapiens
aguccuccacucgaccca

SEQ ID NO: 1457785 - RNA, 18 nt, Homo sapiens
aguccugacacuauucau

SEQ ID NO: 1457786 - RNA, 22 nt, Homo sapiens
aguccugcuaccucccuugccu

SEQ ID NO: 1457787 - RNA, 19 nt, Homo sapiens
auaaauugcauaaagcaua

SEQ ID NO: 1457788 - RNA, 17 nt, Homo sapiens
auaaauuguagggcuuu

SEQ ID NO: 1457789 - RNA, 23 nt, Homo sapiens
auaaauuuuauaacagaauuaaa

SEQ ID NO: 1457790 - RNA, 14 nt, Homo sapiens
auaacaauguuaag

SEQ ID NO: 1457791 - RNA, 22 nt, Homo sapiens
auaacacagagagacagacuug

SEQ ID NO: 1457792 - RNA, 16 nt, Homo sapiens
auaacaguuacuccag

SEQ ID NO: 1457793 - RNA, 18 nt, Homo sapiens
auaacaguuacuccagua

SEQ ID NO: 1457794 - RNA, 15 nt, Homo sapiens
auaacaucaccacug

SEQ ID NO: 1457795 - RNA, 19 nt, Homo sapiens
auaaccagccauuggcuau

SEQ ID NO: 1457796 - RNA, 17 nt, Homo sapiens
auaaccauaugauacua

SEQ ID NO: 1457797 - RNA, 16 nt, Homo sapiens
auaaccccaccuugcc

SEQ ID NO: 1457798 - RNA, 18 nt, Homo sapiens
auaacccuacacccagac

SEQ ID NO: 1457799 - RNA, 17 nt, Homo sapiens
auaacucggauuccagc

SEQ ID NO: 1457800 - RNA, 16 nt, Homo sapiens
auaacuuuacagaaau

SEQ ID NO: 1457801 - RNA, 17 nt, Homo sapiens
auaagaaagaucaaaga

SEQ ID NO: 1457802 - RNA, 13 nt, Homo sapiens
auaagaagcaaau

SEQ ID NO: 1457803 - RNA, 20 nt, Homo sapiens
auaagauugacuuugaaucu

SEQ ID NO: 1457804 - RNA, 11 nt, Homo sapiens
auaagcaagag

SEQ ID NO: 1457805 - RNA, 19 nt, Homo sapiens
auaagcacugaaaaacaac

SEQ ID NO: 1457806 - RNA, 15 nt, Homo sapiens
auaaggaaagcaaua

SEQ ID NO: 1457807 - RNA, 16 nt, Homo sapiens
auaaggaaagcaauaa

SEQ ID NO: 1457808 - RNA, 19 nt, Homo sapiens
auaaggaucagaacagcag

SEQ ID NO: 1457809 - RNA, 20 nt, Homo sapiens
auaaggcugagggcugccag

SEQ ID NO: 1457810 - RNA, 16 nt, Homo sapiens
auaaguagaaagaauu

SEQ ID NO: 1457811 - RNA, 23 nt, Homo sapiens
auaagugggucaaguacaccagc

SEQ ID NO: 1457812 - RNA, 20 nt, Homo sapiens
auaaguuauuuuuguacaug

SEQ ID NO: 1457813 - RNA, 22 nt, Homo sapiens
auaauagcacuaaugcuuuaag

SEQ ID NO: 1457814 - RNA, 15 nt, Homo sapiens
auaaucacucuaauu

SEQ ID NO: 1457815 - RNA, 16 nt, Homo sapiens
auaaucagucaugugu

SEQ ID NO: 1457816 - RNA, 16 nt, Homo sapiens
auaaucagugugucua

SEQ ID NO: 1457817 - RNA, 17 nt, Homo sapiens
auaaugcaugaagcaac

SEQ ID NO: 1457818 - RNA, 19 nt, Homo sapiens
auaaugccccaaggacaag

SEQ ID NO: 1457819 - RNA, 22 nt, Homo sapiens
auaaugcuuucacaacauuugc

SEQ ID NO: 1457820 - RNA, 20 nt, Homo sapiens
auaaugguuuuuaacaccuu

SEQ ID NO: 1457821 - RNA, 21 nt, Homo sapiens
auaauguuacauuauuaucaa

SEQ ID NO: 1457822 - RNA, 22 nt, Homo sapiens
auaauguuaucuguguagcaag

SEQ ID NO: 1457823 - RNA, 22 nt, Homo sapiens
auaauucacucaagcacugaua

SEQ ID NO: 1457824 - RNA, 15 nt, Homo sapiens
auaauucccuaucuu

SEQ ID NO: 1457825 - RNA, 22 nt, Homo sapiens
auaauuccuauauccugugacu

SEQ ID NO: 1457826 - RNA, 23 nt, Homo sapiens
auaauuccuauauccugugacug

SEQ ID NO: 1457827 - RNA, 20 nt, Homo sapiens
auaauugcucauaagcaaua

SEQ ID NO: 1457828 - RNA, 12 nt, Homo sapiens
auaauuguugaa

SEQ ID NO: 1457829 - RNA, 21 nt, Homo sapiens
auaauuguugaaauuuugcaa

SEQ ID NO: 1457830 - RNA, 16 nt, Homo sapiens
auaauuucaaaccaca

SEQ ID NO: 1457831 - RNA, 17 nt, Homo sapiens
auaauuucaaaccacac

SEQ ID NO: 1457832 - RNA, 19 nt, Homo sapiens
auaauuucaaaccacacau

SEQ ID NO: 1457833 - RNA, 18 nt, Homo sapiens
auaauuuuuaauuuggcu

SEQ ID NO: 1457834 - RNA, 20 nt, Homo sapiens
auacaaacuacagaguuuau

SEQ ID NO: 1457835 - RNA, 15 nt, Homo sapiens
auacaaagcaguuua

SEQ ID NO: 1457836 - RNA, 21 nt, Homo sapiens
auacaaaguguaccaacauaa

SEQ ID NO: 1457837 - RNA, 13 nt, Homo sapiens
auacaaauggauu

SEQ ID NO: 1457838 - RNA, 19 nt, Homo sapiens
auacaacauuaaggaauuu

SEQ ID NO: 1457839 - RNA, 22 nt, Homo sapiens
auacaacauuaaggaauuugau

SEQ ID NO: 1457840 - RNA, 16 nt, Homo sapiens
auacaagaaagcaaug

SEQ ID NO: 1457841 - RNA, 19 nt, Homo sapiens
auacaagaaagcaaugcca

SEQ ID NO: 1457842 - RNA, 23 nt, Homo sapiens
auacaauggguaucgcugagacu

SEQ ID NO: 1457843 - RNA, 21 nt, Homo sapiens
auacacgguauuuauagagag

SEQ ID NO: 1457844 - RNA, 15 nt, Homo sapiens
auacacuaugaagau

SEQ ID NO: 1457845 - RNA, 22 nt, Homo sapiens
auacacugaaguuaacagagac

SEQ ID NO: 1457846 - RNA, 13 nt, Homo sapiens
auacacuuacacu

SEQ ID NO: 1457847 - RNA, 13 nt, Homo sapiens
auacaggugcuca

SEQ ID NO: 1457848 - RNA, 12 nt, Homo sapiens
auacagugucug

SEQ ID NO: 1457849 - RNA, 20 nt, Homo sapiens
auacauaucgcugacuucau

SEQ ID NO: 1457850 - RNA, 14 nt, Homo sapiens
auacauauuaucuc

SEQ ID NO: 1457851 - RNA, 18 nt, Homo sapiens
auacaugcauacaaagag

SEQ ID NO: 1457852 - RNA, 23 nt, Homo sapiens
auacauucccucuaauuugaacu

SEQ ID NO: 1457853 - RNA, 22 nt, Homo sapiens
auaccaauuacauggaacuuuu

SEQ ID NO: 1457854 - RNA, 13 nt, Homo sapiens
auaccacugcacu

SEQ ID NO: 1457855 - RNA, 17 nt, Homo sapiens
auacccugaauuuggcc

SEQ ID NO: 1457856 - RNA, 22 nt, Homo sapiens
auaccugcacguucauaaccaa

SEQ ID NO: 1457857 - RNA, 15 nt, Homo sapiens
auaccuggcuuuuac

SEQ ID NO: 1457858 - RNA, 19 nt, Homo sapiens
auaccuggcuuuuacuuua

SEQ ID NO: 1457859 - RNA, 12 nt, Homo sapiens
auaccuuaucca

SEQ ID NO: 1457860 - RNA, 19 nt, Homo sapiens
auaccuuccccacaucuga

SEQ ID NO: 1457861 - RNA, 19 nt, Homo sapiens
auaccuucuuaaguuuuca

SEQ ID NO: 1457862 - RNA, 19 nt, Homo sapiens
auacgcucaggugguugug

SEQ ID NO: 1457863 - RNA, 15 nt, Homo sapiens
auacguagcucucuu

SEQ ID NO: 1457864 - RNA, 20 nt, Homo sapiens
auacguuugaaauaguugau

SEQ ID NO: 1457865 - RNA, 15 nt, Homo sapiens
auacuauugccucau

SEQ ID NO: 1457866 - RNA, 23 nt, Homo sapiens
auacuauuuaauuauuucacuuu

SEQ ID NO: 1457867 - RNA, 14 nt, Homo sapiens
auacucaacaaaac

SEQ ID NO: 1457868 - RNA, 22 nt, Homo sapiens
auacucaggacuccucuccgca

SEQ ID NO: 1457869 - RNA, 23 nt, Homo sapiens
auacucuagaugaaguuuuacau

SEQ ID NO: 1457870 - RNA, 22 nt, Homo sapiens
auacugcauguaagccaaguca

SEQ ID NO: 1457871 - RNA, 15 nt, Homo sapiens
auacugccuuugcag

SEQ ID NO: 1457872 - RNA, 23 nt, Homo sapiens
auacuggacgcuguccugagaug

SEQ ID NO: 1457873 - RNA, 22 nt, Homo sapiens
auacuguaaaugcauuggaaua

SEQ ID NO: 1457874 - RNA, 22 nt, Homo sapiens
auacuguaggcacacuuugcac

SEQ ID NO: 1457875 - RNA, 13 nt, Homo sapiens
auacuuacuauaa

SEQ ID NO: 1457876 - RNA, 21 nt, Homo sapiens
auacuuauauuucccuaaaau

SEQ ID NO: 1457877 - RNA, 18 nt, Homo sapiens
auacuugccuucugauag

SEQ ID NO: 1457878 - RNA, 9 nt, Homo sapiens
auacuuguc

SEQ ID NO: 1457879 - RNA, 13 nt, Homo sapiens
auacuuuacaaag

SEQ ID NO: 1457880 - RNA, 13 nt, Homo sapiens
auacuuucaggca

SEQ ID NO: 1457881 - RNA, 12 nt, Homo sapiens
auacuuuuggcu

SEQ ID NO: 1457882 - RNA, 19 nt, Homo sapiens
auacuuuuggcuccucuag

SEQ ID NO: 1457883 - RNA, 21 nt, Homo sapiens
auacuuuugugaacaaaaauu

SEQ ID NO: 1457884 - RNA, 15 nt, Homo sapiens
auagaaaacuugaca

SEQ ID NO: 1457885 - RNA, 21 nt, Homo sapiens
auagaaugagcacccauucca

SEQ ID NO: 1457886 - RNA, 12 nt, Homo sapiens
auagacaaauag

SEQ ID NO: 1457887 - RNA, 17 nt, Homo sapiens
auagacuuauugccaaa

SEQ ID NO: 1457888 - RNA, 19 nt, Homo sapiens
auagacuuauugccaaaaa

SEQ ID NO: 1457889 - RNA, 21 nt, Homo sapiens
caguguccccuccacugucac

SEQ ID NO: 1457890 - RNA, 17 nt, Homo sapiens
cagugucccuuuugcua

SEQ ID NO: 1457891 - RNA, 16 nt, Homo sapiens
caguguccuccaagug

SEQ ID NO: 1457892 - RNA, 13 nt, Homo sapiens
cagugucuuccau

SEQ ID NO: 1457893 - RNA, 19 nt, Homo sapiens
caguguuacuguguuuauc

SEQ ID NO: 1457894 - RNA, 19 nt, Homo sapiens
caguuaacuauugcauuua

SEQ ID NO: 1457895 - RNA, 19 nt, Homo sapiens
caguuaaucagcaaccuga

SEQ ID NO: 1457896 - RNA, 18 nt, Homo sapiens
caguuaauucaaugugaa

SEQ ID NO: 1457897 - RNA, 15 nt, Homo sapiens
caguuacaaaguaau

SEQ ID NO: 1457898 - RNA, 16 nt, Homo sapiens
caguuacuccaguaua

SEQ ID NO: 1457899 - RNA, 15 nt, Homo sapiens
caguuagacuagucc

SEQ ID NO: 1457900 - RNA, 19 nt, Homo sapiens
caguuaugcagaauccaaa

SEQ ID NO: 1457901 - RNA, 12 nt, Homo sapiens
caguucagauaa

SEQ ID NO: 1457902 - RNA, 21 nt, Homo sapiens
caguucaggagucccaaggaa

SEQ ID NO: 1457903 - RNA, 16 nt, Homo sapiens
caguucauuauuuugu

SEQ ID NO: 1457904 - RNA, 17 nt, Homo sapiens
caguucuuggugcucug

SEQ ID NO: 1457905 - RNA, 23 nt, Homo sapiens
caguugagcuucauauaccagca

SEQ ID NO: 1457906 - RNA, 14 nt, Homo sapiens
caguugcauuuagc

SEQ ID NO: 1457907 - RNA, 22 nt, Homo sapiens
caguugcccuagcccagacucu

SEQ ID NO: 1457908 - RNA, 21 nt, Homo sapiens
caguuguuuguuuuugcuugu

SEQ ID NO: 1457909 - RNA, 16 nt, Homo sapiens
caguuuauuccagagc

SEQ ID NO: 1457910 - RNA, 18 nt, Homo sapiens
caguuugauaccugcacu

SEQ ID NO: 1457911 - RNA, 14 nt, Homo sapiens
caguuuuccaugaa

SEQ ID NO: 1457912 - RNA, 14 nt, Homo sapiens
caguuuuguugccc

SEQ ID NO: 1457913 - RNA, 13 nt, Homo sapiens
cauaaacaauuca

SEQ ID NO: 1457914 - RNA, 15 nt, Homo sapiens
cauaaaucacaaaua

SEQ ID NO: 1457915 - RNA, 17 nt, Homo sapiens
cauaaaugaagcagcuu

SEQ ID NO: 1457916 - RNA, 22 nt, Homo sapiens
cauaaauuagaggucuccaaaa

SEQ ID NO: 1457917 - RNA, 14 nt, Homo sapiens
cauaacccaugaag

SEQ ID NO: 1457918 - RNA, 19 nt, Homo sapiens
cauaacuaguggcucucag

SEQ ID NO: 1457919 - RNA, 17 nt, Homo sapiens
cauaacugaaggcauau

SEQ ID NO: 1457920 - RNA, 22 nt, Homo sapiens
cauaacugccuugaaccuguga

SEQ ID NO: 1457921 - RNA, 18 nt, Homo sapiens
cauaagcaauaccagcaa

SEQ ID NO: 1457922 - RNA, 20 nt, Homo sapiens
cauaaguuuaggauaaaaua

SEQ ID NO: 1457923 - RNA, 20 nt, Homo sapiens
cauaauaaaucacacauuca

SEQ ID NO: 1457924 - RNA, 16 nt, Homo sapiens
cauaauguuacauuau

SEQ ID NO: 1457925 - RNA, 14 nt, Homo sapiens
cauaauucagcacu

SEQ ID NO: 1457926 - RNA, 19 nt, Homo sapiens
cauacaggauuugaacuca

SEQ ID NO: 1457927 - RNA, 17 nt, Homo sapiens
cauacauauuaucucau

SEQ ID NO: 1457928 - RNA, 18 nt, Homo sapiens
cauacaugcauacaaaga

SEQ ID NO: 1457929 - RNA, 21 nt, Homo sapiens
cauacauucccucuaauuuga

SEQ ID NO: 1457930 - RNA, 21 nt, Homo sapiens
cauacauuuaugcacauucac

SEQ ID NO: 1457931 - RNA, 17 nt, Homo sapiens
cauaccguguaccucag

SEQ ID NO: 1457932 - RNA, 23 nt, Homo sapiens
cauacuaguagucauacucccug

SEQ ID NO: 1457933 - RNA, 16 nt, Homo sapiens
cauacuccuuccauca

SEQ ID NO: 1457934 - RNA, 15 nt, Homo sapiens
cauacuuaucucucu

SEQ ID NO: 1457935 - RNA, 16 nt, Homo sapiens
cauacuucuucauuca

SEQ ID NO: 1457936 - RNA, 14 nt, Homo sapiens
cauagaaaacuuga

SEQ ID NO: 1457937 - RNA, 19 nt, Homo sapiens
cauagcaagacacaucccu

SEQ ID NO: 1457938 - RNA, 15 nt, Homo sapiens
cauagcuuccaugag

SEQ ID NO: 1457939 - RNA, 17 nt, Homo sapiens
cauaguuuaaacugcau

SEQ ID NO: 1457940 - RNA, 18 nt, Homo sapiens
cauaguuuaaacugcauu

SEQ ID NO: 1457941 - RNA, 14 nt, Homo sapiens
cauauaaccaaaau

SEQ ID NO: 1457942 - RNA, 21 nt, Homo sapiens
cauauaacuaagacauaugca

SEQ ID NO: 1457943 - RNA, 16 nt, Homo sapiens
cauauaccagcaauau

SEQ ID NO: 1457944 - RNA, 21 nt, Homo sapiens
cauauauauuaauacugguau

SEQ ID NO: 1457945 - RNA, 15 nt, Homo sapiens
cauauaucaaaguga

SEQ ID NO: 1457946 - RNA, 23 nt, Homo sapiens
cauauauuuauugaguaccuacu

SEQ ID NO: 1457947 - RNA, 14 nt, Homo sapiens
cauaucagaacugu

SEQ ID NO: 1457948 - RNA, 15 nt, Homo sapiens
cauaucagaacugug

SEQ ID NO: 1457949 - RNA, 18 nt, Homo sapiens
cauaucaguugagcuuca

SEQ ID NO: 1457950 - RNA, 13 nt, Homo sapiens
cauaucuuuauua

SEQ ID NO: 1457951 - RNA, 21 nt, Homo sapiens
cauaugaggaggaugucccug

SEQ ID NO: 1457952 - RNA, 22 nt, Homo sapiens
cauaugaggaggaugucccugg

SEQ ID NO: 1457953 - RNA, 11 nt, Homo sapiens
cauaugcauuu

SEQ ID NO: 1457954 - RNA, 23 nt, Homo sapiens
cauauggaggaggcucuggaguc

SEQ ID NO: 1457955 - RNA, 23 nt, Homo sapiens
cauauguaguauaauuucuagaa

SEQ ID NO: 1457956 - RNA, 13 nt, Homo sapiens
cauauuaagcacu

SEQ ID NO: 1457957 - RNA, 15 nt, Homo sapiens
cauauucuaaaacca

SEQ ID NO: 1457958 - RNA, 17 nt, Homo sapiens
cauauucuguucacuug

SEQ ID NO: 1457959 - RNA, 21 nt, Homo sapiens
cauauugcaggauucuguaau

SEQ ID NO: 1457960 - RNA, 18 nt, Homo sapiens
cauauuguugcauugcuu

SEQ ID NO: 1457961 - RNA, 13 nt, Homo sapiens
cauauuuacuucu

SEQ ID NO: 1457962 - RNA, 20 nt, Homo sapiens
caucaaaaaagauagaucua

SEQ ID NO: 1457963 - RNA, 17 nt, Homo sapiens
caucaaaagacuuaaaa

SEQ ID NO: 1457964 - RNA, 12 nt, Homo sapiens
caucaaagccuu

SEQ ID NO: 1457965 - RNA, 14 nt, Homo sapiens
caucaauaucacaa

SEQ ID NO: 1457966 - RNA, 16 nt, Homo sapiens
caucacaggacacggg

SEQ ID NO: 1457967 - RNA, 23 nt, Homo sapiens
caucacccgggaacuuuuuuaga

SEQ ID NO: 1457968 - RNA, 15 nt, Homo sapiens
caucacguaccccac

SEQ ID NO: 1457969 - RNA, 22 nt, Homo sapiens
caucacuagaagaaaagcccau

SEQ ID NO: 1457970 - RNA, 20 nt, Homo sapiens
caucacuggguguugaucuu

SEQ ID NO: 1457971 - RNA, 23 nt, Homo sapiens
caucagagccagucucaccuuca

SEQ ID NO: 1457972 - RNA, 12 nt, Homo sapiens
caucagggacag

SEQ ID NO: 1457973 - RNA, 20 nt, Homo sapiens
caucagucccccugugcaua

SEQ ID NO: 1457974 - RNA, 22 nt, Homo sapiens
caucaguguccucuugcucaaa

SEQ ID NO: 1457975 - RNA, 12 nt, Homo sapiens
caucaguucccc

SEQ ID NO: 1457976 - RNA, 20 nt, Homo sapiens
caucauccuaagcuauucag

SEQ ID NO: 1457977 - RNA, 12 nt, Homo sapiens
caucaucuaugg

SEQ ID NO: 1457978 - RNA, 21 nt, Homo sapiens
caucaugcggugggugcugcc

SEQ ID NO: 1457979 - RNA, 16 nt, Homo sapiens
caucaugggcuggaca

SEQ ID NO: 1457980 - RNA, 19 nt, Homo sapiens
caucauugugcuagcugau

SEQ ID NO: 1457981 - RNA, 21 nt, Homo sapiens
caucauuuugagaaugcugac

SEQ ID NO: 1457982 - RNA, 18 nt, Homo sapiens
caucauuuugcauucaaa

SEQ ID NO: 1457983 - RNA, 19 nt, Homo sapiens
cauccaauuuaucaaggaa

SEQ ID NO: 1457984 - RNA, 12 nt, Homo sapiens
cauccagcagug

SEQ ID NO: 1457985 - RNA, 17 nt, Homo sapiens
cauccaggcccaacugu

SEQ ID NO: 1457986 - RNA, 16 nt, Homo sapiens
cauccaggucuugacu

SEQ ID NO: 1457987 - RNA, 20 nt, Homo sapiens
cauccagguggagacccuga

SEQ ID NO: 1457988 - RNA, 17 nt, Homo sapiens
cauccagugacaaacca

SEQ ID NO: 1457989 - RNA, 14 nt, Homo sapiens
cauccauuaccucc

SEQ ID NO: 1457990 - RNA, 19 nt, Homo sapiens
caucccagcaccugccucc

SEQ ID NO: 1457991 - RNA, 17 nt, Homo sapiens
cauguggcuaaaugccu

SEQ ID NO: 1457992 - RNA, 18 nt, Homo sapiens
cauguguaauaugcacaa

SEQ ID NO: 1457993 - RNA, 16 nt, Homo sapiens
caugugucacuugugc

SEQ ID NO: 1457994 - RNA, 23 nt, Homo sapiens
cauguguccccucacucugucag

SEQ ID NO: 1457995 - RNA, 21 nt, Homo sapiens
cauguuaccaucuuacuugag

SEQ ID NO: 1457996 - RNA, 17 nt, Homo sapiens
cauguuacucaguguua

SEQ ID NO: 1457997 - RNA, 19 nt, Homo sapiens
cauguuuugauuuguagca

SEQ ID NO: 1457998 - RNA, 20 nt, Homo sapiens
cauuaaaaauguuaguauuu

SEQ ID NO: 1457999 - RNA, 20 nt, Homo sapiens
cauuaaauaccuauaugaau

SEQ ID NO: 1458000 - RNA, 18 nt, Homo sapiens
cauuaaauucacaaacuu

SEQ ID NO: 1458001 - RNA, 23 nt, Homo sapiens
cauuacagagaggagaaacacau

SEQ ID NO: 1458002 - RNA, 16 nt, Homo sapiens
cauuaccuccauccau

SEQ ID NO: 1458003 - RNA, 20 nt, Homo sapiens
cauuagcauucugguuuuga

SEQ ID NO: 1458004 - RNA, 19 nt, Homo sapiens
cauuaggucccucacucca

SEQ ID NO: 1458005 - RNA, 18 nt, Homo sapiens
cauuaguauuucacaaga

SEQ ID NO: 1458006 - RNA, 15 nt, Homo sapiens
cauuagucacuuuga

SEQ ID NO: 1458007 - RNA, 14 nt, Homo sapiens
cauuauaugcaaau

SEQ ID NO: 1458008 - RNA, 18 nt, Homo sapiens
cauuaucgagcagcauuu

SEQ ID NO: 1458009 - RNA, 19 nt, Homo sapiens
cauuauuuuuccacuuugu

SEQ ID NO: 1458010 - RNA, 17 nt, Homo sapiens
cauucaauagcauauca

SEQ ID NO: 1458011 - RNA, 19 nt, Homo sapiens
cauucaauagcauaucaca

SEQ ID NO: 1458012 - RNA, 14 nt, Homo sapiens
cauucaauauugac

SEQ ID NO: 1458013 - RNA, 18 nt, Homo sapiens
cauucaauguuuaugcaa

SEQ ID NO: 1458014 - RNA, 17 nt, Homo sapiens
cauucacuacaggugaa

SEQ ID NO: 1458015 - RNA, 14 nt, Homo sapiens
cauucacuagcuuu

SEQ ID NO: 1458016 - RNA, 18 nt, Homo sapiens
cauucagagcuauggugc

SEQ ID NO: 1458017 - RNA, 14 nt, Homo sapiens
cauucauccuucca

SEQ ID NO: 1458018 - RNA, 19 nt, Homo sapiens
cauuccauugccuagcucu

SEQ ID NO: 1458019 - RNA, 14 nt, Homo sapiens
cauuccugauccca

SEQ ID NO: 1458020 - RNA, 13 nt, Homo sapiens
cauuccugcucaa

SEQ ID NO: 1458021 - RNA, 22 nt, Homo sapiens
cauucgggagaucaugucucac

SEQ ID NO: 1458022 - RNA, 13 nt, Homo sapiens
cauucuagguagg

SEQ ID NO: 1458023 - RNA, 19 nt, Homo sapiens
cauucucgugagucauuua

SEQ ID NO: 1458024 - RNA, 17 nt, Homo sapiens
cauucugcauugcuaga

SEQ ID NO: 1458025 - RNA, 18 nt, Homo sapiens
cauucugcauugcuagau

SEQ ID NO: 1458026 - RNA, 17 nt, Homo sapiens
cauucuggaaaagcaaa

SEQ ID NO: 1458027 - RNA, 13 nt, Homo sapiens
cauucuuccaaaa

SEQ ID NO: 1458028 - RNA, 14 nt, Homo sapiens
cauucuuccaaaaa

SEQ ID NO: 1458029 - RNA, 21 nt, Homo sapiens
cauucuucccuaaucuuccac

SEQ ID NO: 1458030 - RNA, 13 nt, Homo sapiens
cauucuuggccca

SEQ ID NO: 1458031 - RNA, 23 nt, Homo sapiens
cauucuuguuuuaagugccuuua

SEQ ID NO: 1458032 - RNA, 22 nt, Homo sapiens
cauugaaacuaagagcucucaa

SEQ ID NO: 1458033 - RNA, 16 nt, Homo sapiens
cauugacaagaacuga

SEQ ID NO: 1458034 - RNA, 20 nt, Homo sapiens
cauugaugacccucugaccc

SEQ ID NO: 1458035 - RNA, 17 nt, Homo sapiens
cauugauggccucaaug

SEQ ID NO: 1458036 - RNA, 14 nt, Homo sapiens
cauugcacuuugau

SEQ ID NO: 1458037 - RNA, 18 nt, Homo sapiens
cauugcccgaaaccagag

SEQ ID NO: 1458038 - RNA, 21 nt, Homo sapiens
cauugccuaacuacuaguuuu

SEQ ID NO: 1458039 - RNA, 13 nt, Homo sapiens
cauugccuagcuc

SEQ ID NO: 1458040 - RNA, 17 nt, Homo sapiens
cauugcuaaacugauga

SEQ ID NO: 1458041 - RNA, 19 nt, Homo sapiens
cauuggaccuguucaaaaa

SEQ ID NO: 1458042 - RNA, 20 nt, Homo sapiens
cauuggauucaucagcauuu

SEQ ID NO: 1458043 - RNA, 19 nt, Homo sapiens
cauuggcacuguggagcuc

SEQ ID NO: 1458044 - RNA, 20 nt, Homo sapiens
cauugggguuccgcacuuuc

SEQ ID NO: 1458045 - RNA, 17 nt, Homo sapiens
cauuggucauugugaau

SEQ ID NO: 1458046 - RNA, 15 nt, Homo sapiens
cauugugaggguuaa

SEQ ID NO: 1458047 - RNA, 15 nt, Homo sapiens
cauuguuggcgcuga

SEQ ID NO: 1458048 - RNA, 15 nt, Homo sapiens
cauuuaauuuaguga

SEQ ID NO: 1458049 - RNA, 22 nt, Homo sapiens
cauuuacagaaacgcauccagc

SEQ ID NO: 1458050 - RNA, 14 nt, Homo sapiens
cauuuaccaguaua

SEQ ID NO: 1458051 - RNA, 23 nt, Homo sapiens
cauuuacuuaacagaacagucac

SEQ ID NO: 1458052 - RNA, 22 nt, Homo sapiens
cauuuagaaaauagagcuuuua

SEQ ID NO: 1458053 - RNA, 13 nt, Homo sapiens
cauuuagaacuug

SEQ ID NO: 1458054 - RNA, 15 nt, Homo sapiens
cauuuagaacuugca

SEQ ID NO: 1458055 - RNA, 20 nt, Homo sapiens
cauuuauucaaaguuaaaag

SEQ ID NO: 1458056 - RNA, 15 nt, Homo sapiens
cauuucaaacagucu

SEQ ID NO: 1458057 - RNA, 15 nt, Homo sapiens
cauuucaaaguuugg

SEQ ID NO: 1458058 - RNA, 16 nt, Homo sapiens
cauuucagauauucca

SEQ ID NO: 1458059 - RNA, 22 nt, Homo sapiens
cauuucauuaagguuccaguua

SEQ ID NO: 1458060 - RNA, 15 nt, Homo sapiens
cauuuccaagcacuu

SEQ ID NO: 1458061 - RNA, 14 nt, Homo sapiens
cauuucccacaucu

SEQ ID NO: 1458062 - RNA, 18 nt, Homo sapiens
cauuucuacugugacuga

SEQ ID NO: 1458063 - RNA, 19 nt, Homo sapiens
cauuucucauaccuucccc

SEQ ID NO: 1458064 - RNA, 20 nt, Homo sapiens
cauuucucuuccccuuagaa

SEQ ID NO: 1458065 - RNA, 15 nt, Homo sapiens
cauuucugcucucag

SEQ ID NO: 1458066 - RNA, 21 nt, Homo sapiens
cauuugacugaagaugcagcu

SEQ ID NO: 1458067 - RNA, 20 nt, Homo sapiens
cauuugaguugcccaucuug

SEQ ID NO: 1458068 - RNA, 23 nt, Homo sapiens
cauuugauaugugaaugcucaua

SEQ ID NO: 1458069 - RNA, 20 nt, Homo sapiens
cauuugauggccaccagcuu

SEQ ID NO: 1458070 - RNA, 13 nt, Homo sapiens
cauuugcaccuac

SEQ ID NO: 1458071 - RNA, 16 nt, Homo sapiens
cauuugcaccuaccuc

SEQ ID NO: 1458072 - RNA, 15 nt, Homo sapiens
cauuugcauuugcuc

SEQ ID NO: 1458073 - RNA, 21 nt, Homo sapiens
cauuuguauuguucauaauau

SEQ ID NO: 1458074 - RNA, 23 nt, Homo sapiens
cauuuguauuguucauaauauca

SEQ ID NO: 1458075 - RNA, 15 nt, Homo sapiens
cauuuguguacacag

SEQ ID NO: 1458076 - RNA, 18 nt, Homo sapiens
cauuuguucucacaccaa

SEQ ID NO: 1458077 - RNA, 13 nt, Homo sapiens
cauuuuaaaaaca

SEQ ID NO: 1458078 - RNA, 14 nt, Homo sapiens
cauuuuacacaaag

SEQ ID NO: 1458079 - RNA, 20 nt, Homo sapiens
cauuuucccccacuacugca

SEQ ID NO: 1458080 - RNA, 15 nt, Homo sapiens
cauuuucuuucaugg

SEQ ID NO: 1458081 - RNA, 19 nt, Homo sapiens
cauuuugcaaaauuuccag

SEQ ID NO: 1458082 - RNA, 18 nt, Homo sapiens
cauuuugcccuuccauag

SEQ ID NO: 1458083 - RNA, 17 nt, Homo sapiens
cauuuuuacguacuuga

SEQ ID NO: 1458084 - RNA, 18 nt, Homo sapiens
cauuuuuaucccauugag

SEQ ID NO: 1458085 - RNA, 22 nt, Homo sapiens
cauuuuucacuuugcucucaau

SEQ ID NO: 1458086 - RNA, 11 nt, Homo sapiens
cauuuuugcug

SEQ ID NO: 1458087 - RNA, 19 nt, Homo sapiens
cauuuuuugggcagcaauu

SEQ ID NO: 1458088 - RNA, 22 nt, Homo sapiens
ccaaaaaaaaaagaaguuacuu

SEQ ID NO: 1458089 - RNA, 15 nt, Homo sapiens
ccaaaaaacuacuuc

SEQ ID NO: 1458090 - RNA, 13 nt, Homo sapiens
ccaaaaacauguu

SEQ ID NO: 1458091 - RNA, 12 nt, Homo sapiens
ccaaaacacagg

SEQ ID NO: 1458092 - RNA, 13 nt, Homo sapiens
ccaaaagaagccc

SEQ ID NO: 1458093 - RNA, 12 nt, Homo sapiens
ccacugcuccau

SEQ ID NO: 1458094 - RNA, 19 nt, Homo sapiens
ccacugggaccaacccugg

SEQ ID NO: 1458095 - RNA, 23 nt, Homo sapiens
ccacuggggaggaauccuggacc

SEQ ID NO: 1458096 - RNA, 22 nt, Homo sapiens
ccacuggucuguagggauuuuu

SEQ ID NO: 1458097 - RNA, 16 nt, Homo sapiens
ccacugucuccacuca

SEQ ID NO: 1458098 - RNA, 15 nt, Homo sapiens
ccacuucauccccuc

SEQ ID NO: 1458099 - RNA, 17 nt, Homo sapiens
ccagaaccucagcauuu

SEQ ID NO: 1458100 - RNA, 13 nt, Homo sapiens
ccagaacucuucc

SEQ ID NO: 1458101 - RNA, 18 nt, Homo sapiens
ccagaacugcacucuuca

SEQ ID NO: 1458102 - RNA, 16 nt, Homo sapiens
ccagaagaauauucag

SEQ ID NO: 1458103 - RNA, 20 nt, Homo sapiens
ccagaaguagcuuugcacuu

SEQ ID NO: 1458104 - RNA, 13 nt, Homo sapiens
ccagaauagcuuu

SEQ ID NO: 1458105 - RNA, 17 nt, Homo sapiens
ccagaauaucugggauu

SEQ ID NO: 1458106 - RNA, 12 nt, Homo sapiens
ccagaaugcugc

SEQ ID NO: 1458107 - RNA, 13 nt, Homo sapiens
ccagacaaaugga

SEQ ID NO: 1458108 - RNA, 22 nt, Homo sapiens
ccagacacuggcguuacugcuu

SEQ ID NO: 1458109 - RNA, 19 nt, Homo sapiens
ccagacccaccacaccgca

SEQ ID NO: 1458110 - RNA, 12 nt, Homo sapiens
ccagacccagug

SEQ ID NO: 1458111 - RNA, 22 nt, Homo sapiens
ccagaccuagcaggcuguucca

SEQ ID NO: 1458112 - RNA, 14 nt, Homo sapiens
ccagacggugugca

SEQ ID NO: 1458113 - RNA, 15 nt, Homo sapiens
ccagacucagacauu

SEQ ID NO: 1458114 - RNA, 23 nt, Homo sapiens
ccagacuccaccgucagcuguaa

SEQ ID NO: 1458115 - RNA, 16 nt, Homo sapiens
ccagagcagaugcaga

SEQ ID NO: 1458116 - RNA, 15 nt, Homo sapiens
ccagagcauuuccaa

SEQ ID NO: 1458117 - RNA, 14 nt, Homo sapiens
ccagagcccagcuc

SEQ ID NO: 1458118 - RNA, 20 nt, Homo sapiens
ccagagccccccacaaugau

SEQ ID NO: 1458119 - RNA, 20 nt, Homo sapiens
ccagaggcagcucgugugcc

SEQ ID NO: 1458120 - RNA, 14 nt, Homo sapiens
ccagaggugcuucu

SEQ ID NO: 1458121 - RNA, 20 nt, Homo sapiens
ccagaguggccuggccagga

SEQ ID NO: 1458122 - RNA, 22 nt, Homo sapiens
ccagauaacuuucggcagguuc

SEQ ID NO: 1458123 - RNA, 15 nt, Homo sapiens
ccagauguuggacca

SEQ ID NO: 1458124 - RNA, 12 nt, Homo sapiens
ccagcaaagagu

SEQ ID NO: 1458125 - RNA, 20 nt, Homo sapiens
ccagcacacggcugccugac

SEQ ID NO: 1458126 - RNA, 21 nt, Homo sapiens
ccagcacagcuuagauuucau

SEQ ID NO: 1458127 - RNA, 18 nt, Homo sapiens
ccagcacucugaaacuga

SEQ ID NO: 1458128 - RNA, 21 nt, Homo sapiens
ccagcagagggggaguagcca

SEQ ID NO: 1458129 - RNA, 21 nt, Homo sapiens
ccagcauauacugaagucuuu

SEQ ID NO: 1458130 - RNA, 14 nt, Homo sapiens
ccagcaucuggaag

SEQ ID NO: 1458131 - RNA, 22 nt, Homo sapiens
ccagccaccccgggcucucugc

SEQ ID NO: 1458132 - RNA, 15 nt, Homo sapiens
ccagccagauccucu

SEQ ID NO: 1458133 - RNA, 10 nt, Homo sapiens
ccagcccaga

SEQ ID NO: 1458134 - RNA, 13 nt, Homo sapiens
ccagcccagagac

SEQ ID NO: 1458135 - RNA, 22 nt, Homo sapiens
ccagcccauccaaacacugagg

SEQ ID NO: 1458136 - RNA, 18 nt, Homo sapiens
ccagccccggcaagccac

SEQ ID NO: 1458137 - RNA, 19 nt, Homo sapiens
ccagccuccccgugccaaa

SEQ ID NO: 1458138 - RNA, 20 nt, Homo sapiens
ccagccugaggcagccacuu

SEQ ID NO: 1458139 - RNA, 19 nt, Homo sapiens
ccagccuguccaacagagg

SEQ ID NO: 1458140 - RNA, 20 nt, Homo sapiens
ccagccuuggugccaccaaa

SEQ ID NO: 1458141 - RNA, 17 nt, Homo sapiens
ccagcgggcacagggca

SEQ ID NO: 1458142 - RNA, 17 nt, Homo sapiens
ccagcuacucaggaguc

SEQ ID NO: 1458143 - RNA, 15 nt, Homo sapiens
ccagcuauuuacaca

SEQ ID NO: 1458144 - RNA, 15 nt, Homo sapiens
ccagcucagucccau

SEQ ID NO: 1458145 - RNA, 13 nt, Homo sapiens
ccagcucaucucc

SEQ ID NO: 1458146 - RNA, 21 nt, Homo sapiens
ccagcuccaaccugcaaagau

SEQ ID NO: 1458147 - RNA, 17 nt, Homo sapiens
ccagcucccuagacugc

SEQ ID NO: 1458148 - RNA, 19 nt, Homo sapiens
ccagcucccuaggagacca

SEQ ID NO: 1458149 - RNA, 13 nt, Homo sapiens
ccagcugcacuga

SEQ ID NO: 1458150 - RNA, 20 nt, Homo sapiens
ccagcugccuuggacugugu

SEQ ID NO: 1458151 - RNA, 20 nt, Homo sapiens
ccagcugcuuuuugugauuu

SEQ ID NO: 1458152 - RNA, 20 nt, Homo sapiens
ccagcuuaaaggcaguauuu

SEQ ID NO: 1458153 - RNA, 23 nt, Homo sapiens
ccaggaagguagcccagcacugu

SEQ ID NO: 1458154 - RNA, 13 nt, Homo sapiens
ccaggacccugaa

SEQ ID NO: 1458155 - RNA, 22 nt, Homo sapiens
ccaggacccugaaggggccaug

SEQ ID NO: 1458156 - RNA, 19 nt, Homo sapiens
ccaggacgcccucacugca

SEQ ID NO: 1458157 - RNA, 22 nt, Homo sapiens
ccaggacggggcacaaguguca

SEQ ID NO: 1458158 - RNA, 14 nt, Homo sapiens
ccaggcacagggcc

SEQ ID NO: 1458159 - RNA, 17 nt, Homo sapiens
ccaggccaacagcaccu

SEQ ID NO: 1458160 - RNA, 12 nt, Homo sapiens
ccaggcccagau

SEQ ID NO: 1458161 - RNA, 21 nt, Homo sapiens
ccaggcugagugagccacaga

SEQ ID NO: 1458162 - RNA, 17 nt, Homo sapiens
ccaggcuggacugcaau

SEQ ID NO: 1458163 - RNA, 13 nt, Homo sapiens
ccaggcuggagac

SEQ ID NO: 1458164 - RNA, 17 nt, Homo sapiens
ccaggcuggagugcagu

SEQ ID NO: 1458165 - RNA, 18 nt, Homo sapiens
ccaggcuggagugcagua

SEQ ID NO: 1458166 - RNA, 12 nt, Homo sapiens
ccaggcuguagg

SEQ ID NO: 1458167 - RNA, 20 nt, Homo sapiens
ccagggaagaagaucaacgc

SEQ ID NO: 1458168 - RNA, 15 nt, Homo sapiens
ccagggagcaagaca

SEQ ID NO: 1458169 - RNA, 16 nt, Homo sapiens
ccagggagggaagugu

SEQ ID NO: 1458170 - RNA, 14 nt, Homo sapiens
ccagggaucacugg

SEQ ID NO: 1458171 - RNA, 16 nt, Homo sapiens
ccagggccuccagggc

SEQ ID NO: 1458172 - RNA, 16 nt, Homo sapiens
ccagggcugcccugag

SEQ ID NO: 1458173 - RNA, 17 nt, Homo sapiens
ccagggcuuugcuccag

SEQ ID NO: 1458174 - RNA, 22 nt, Homo sapiens
ccaggggcccuugggacagcca

SEQ ID NO: 1458175 - RNA, 22 nt, Homo sapiens
ccaggguugaucacacucuggg

SEQ ID NO: 1458176 - RNA, 15 nt, Homo sapiens
ccagguaccacccuu

SEQ ID NO: 1458177 - RNA, 15 nt, Homo sapiens
ccaggucucacgggc

SEQ ID NO: 1458178 - RNA, 13 nt, Homo sapiens
ccaggugaaggag

SEQ ID NO: 1458179 - RNA, 16 nt, Homo sapiens
ccaggugagaagugag

SEQ ID NO: 1458180 - RNA, 19 nt, Homo sapiens
ccagguguucuacacucau

SEQ ID NO: 1458181 - RNA, 14 nt, Homo sapiens
ccaguaaagccuua

SEQ ID NO: 1458182 - RNA, 16 nt, Homo sapiens
ccaguaauugguccga

SEQ ID NO: 1458183 - RNA, 19 nt, Homo sapiens
ccaguauaugcugauggac

SEQ ID NO: 1458184 - RNA, 13 nt, Homo sapiens
ccaguaucgcuca

SEQ ID NO: 1458185 - RNA, 14 nt, Homo sapiens
ccaguccuccagac

SEQ ID NO: 1458186 - RNA, 20 nt, Homo sapiens
ccagucugugaagucaagaa

SEQ ID NO: 1458187 - RNA, 14 nt, Homo sapiens
ccagugagggcagu

SEQ ID NO: 1458188 - RNA, 15 nt, Homo sapiens
ccagugcacagggaa

SEQ ID NO: 1458189 - RNA, 12 nt, Homo sapiens
ccagugccauuc

SEQ ID NO: 1458190 - RNA, 13 nt, Homo sapiens
ccaguggacucuu

SEQ ID NO: 1458191 - RNA, 19 nt, Homo sapiens
ccaguggugaagaaaacuc

SEQ ID NO: 1458192 - RNA, 17 nt, Homo sapiens
ccaguguaugucuugua

SEQ ID NO: 1458193 - RNA, 11 nt, Homo sapiens
ccagugucugu

SEQ ID NO: 1458194 - RNA, 20 nt, Homo sapiens
ccaguguuuacaaggugaca

SEQ ID NO: 1458195 - RNA, 21 nt, Homo sapiens
ccaguucagacacuaccccau

SEQ ID NO: 1458196 - RNA, 15 nt, Homo sapiens
cccaggcugggaacu

SEQ ID NO: 1458197 - RNA, 17 nt, Homo sapiens
cccaggcugggaacuca

SEQ ID NO: 1458198 - RNA, 17 nt, Homo sapiens
cccagggaagccaaaag

SEQ ID NO: 1458199 - RNA, 20 nt, Homo sapiens
cccagggaauccagccauga

SEQ ID NO: 1458200 - RNA, 12 nt, Homo sapiens
cccagggggaga

SEQ ID NO: 1458201 - RNA, 15 nt, Homo sapiens
cccagguaccacccu

SEQ ID NO: 1458202 - RNA, 18 nt, Homo sapiens
cccaguaacugcaccaac

SEQ ID NO: 1458203 - RNA, 17 nt, Homo sapiens
cccaguaccuccaagca

SEQ ID NO: 1458204 - RNA, 14 nt, Homo sapiens
cccaguccaugcuu

SEQ ID NO: 1458205 - RNA, 11 nt, Homo sapiens
cccagucccau

SEQ ID NO: 1458206 - RNA, 15 nt, Homo sapiens
cccagucccauuccu

SEQ ID NO: 1458207 - RNA, 15 nt, Homo sapiens
cccaguccuccagac

SEQ ID NO: 1458208 - RNA, 23 nt, Homo sapiens
cccaguuaaauuuucauuucaga

SEQ ID NO: 1458209 - RNA, 17 nt, Homo sapiens
cccauaauuuucuucau

SEQ ID NO: 1458210 - RNA, 13 nt, Homo sapiens
cccauacucagcc

SEQ ID NO: 1458211 - RNA, 23 nt, Homo sapiens
cccauaucugugaaaugcuggca

SEQ ID NO: 1458212 - RNA, 20 nt, Homo sapiens
cccaucagacugucaagaag

SEQ ID NO: 1458213 - RNA, 19 nt, Homo sapiens
cccaucccaccccuccauu

SEQ ID NO: 1458214 - RNA, 15 nt, Homo sapiens
cccaucucuacugaa

SEQ ID NO: 1458215 - RNA, 16 nt, Homo sapiens
cccaucuuaucaagga

SEQ ID NO: 1458216 - RNA, 23 nt, Homo sapiens
cccaucuuguuucacacuaguca

SEQ ID NO: 1458217 - RNA, 17 nt, Homo sapiens
cccaugcacugugaagg

SEQ ID NO: 1458218 - RNA, 22 nt, Homo sapiens
cccaugccgacggggacugcuu

SEQ ID NO: 1458219 - RNA, 17 nt, Homo sapiens
cccauugcucuaugaaa

SEQ ID NO: 1458220 - RNA, 16 nt, Homo sapiens
cccauuugucccagac

SEQ ID NO: 1458221 - RNA, 17 nt, Homo sapiens
cccauuuugagugacuc

SEQ ID NO: 1458222 - RNA, 14 nt, Homo sapiens
cccauuuugcaaaa

SEQ ID NO: 1458223 - RNA, 21 nt, Homo sapiens
cccauuuuuaaaauacauugu

SEQ ID NO: 1458224 - RNA, 20 nt, Homo sapiens
ccccaacaaaccauccagug

SEQ ID NO: 1458225 - RNA, 16 nt, Homo sapiens
ccccaaccugcugaag

SEQ ID NO: 1458226 - RNA, 13 nt, Homo sapiens
ccccaaggacaag

SEQ ID NO: 1458227 - RNA, 11 nt, Homo sapiens
ccccaauccaa

SEQ ID NO: 1458228 - RNA, 18 nt, Homo sapiens
ccccaauuucggauuuuu

SEQ ID NO: 1458229 - RNA, 13 nt, Homo sapiens
ccccacacagcua

SEQ ID NO: 1458230 - RNA, 19 nt, Homo sapiens
ccccaccauccagguggag

SEQ ID NO: 1458231 - RNA, 10 nt, Homo sapiens
ccccagagag

SEQ ID NO: 1458232 - RNA, 11 nt, Homo sapiens
ccccagcacuu

SEQ ID NO: 1458233 - RNA, 15 nt, Homo sapiens
ccccagccugggcca

SEQ ID NO: 1458234 - RNA, 19 nt, Homo sapiens
ccccaggggacaagggauu

SEQ ID NO: 1458235 - RNA, 17 nt, Homo sapiens
ccccaggggucccagcc

SEQ ID NO: 1458236 - RNA, 18 nt, Homo sapiens
ccccagguuccauaccau

SEQ ID NO: 1458237 - RNA, 12 nt, Homo sapiens
ccccagucccag

SEQ ID NO: 1458238 - RNA, 23 nt, Homo sapiens
ccccaguucaaucucccgcugcu

SEQ ID NO: 1458239 - RNA, 17 nt, Homo sapiens
ccccauccaacacugga

SEQ ID NO: 1458240 - RNA, 17 nt, Homo sapiens
ccccauccccaccagcu

SEQ ID NO: 1458241 - RNA, 13 nt, Homo sapiens
ccccaucugucca

SEQ ID NO: 1458242 - RNA, 13 nt, Homo sapiens
ccccaugaacucu

SEQ ID NO: 1458243 - RNA, 18 nt, Homo sapiens
ccccaugccuguccagcc

SEQ ID NO: 1458244 - RNA, 16 nt, Homo sapiens
cccccaaaucaagcag

SEQ ID NO: 1458245 - RNA, 10 nt, Homo sapiens
cccccagugg

SEQ ID NO: 1458246 - RNA, 19 nt, Homo sapiens
cccccaucuuuacaaagaa

SEQ ID NO: 1458247 - RNA, 19 nt, Homo sapiens
cccccuguagacuagugcc

SEQ ID NO: 1458248 - RNA, 12 nt, Homo sapiens
cccccugugcau

SEQ ID NO: 1458249 - RNA, 21 nt, Homo sapiens
ccccgacacccagcccagcuu

SEQ ID NO: 1458250 - RNA, 14 nt, Homo sapiens
ccccuaagagccau

SEQ ID NO: 1458251 - RNA, 12 nt, Homo sapiens
ccccuccacugu

SEQ ID NO: 1458252 - RNA, 18 nt, Homo sapiens
ccccucgugcgcaucuca

SEQ ID NO: 1458253 - RNA, 17 nt, Homo sapiens
ccccucugucuugugaa

SEQ ID NO: 1458254 - RNA, 22 nt, Homo sapiens
ccccugcuggcucuucugccca

SEQ ID NO: 1458255 - RNA, 17 nt, Homo sapiens
ccccuggacugggaggu

SEQ ID NO: 1458256 - RNA, 15 nt, Homo sapiens
ccccuggcugugcuc

SEQ ID NO: 1458257 - RNA, 20 nt, Homo sapiens
ccccuguagacuagugccgu

SEQ ID NO: 1458258 - RNA, 21 nt, Homo sapiens
ccccuuaguuauaauucugug

SEQ ID NO: 1458259 - RNA, 14 nt, Homo sapiens
ccccuucuguguca

SEQ ID NO: 1458260 - RNA, 15 nt, Homo sapiens
cccgaaauucuagcu

SEQ ID NO: 1458261 - RNA, 18 nt, Homo sapiens
cccgaugcugcuauggaa

SEQ ID NO: 1458262 - RNA, 22 nt, Homo sapiens
cccgccucuucuucuucagaag

SEQ ID NO: 1458263 - RNA, 20 nt, Homo sapiens
cccgcuuuuccuuucugcca

SEQ ID NO: 1458264 - RNA, 19 nt, Homo sapiens
cccggaugugaauggcaug

SEQ ID NO: 1458265 - RNA, 17 nt, Homo sapiens
cccggggccagcacuuc

SEQ ID NO: 1458266 - RNA, 17 nt, Homo sapiens
cccggggcuccacugaa

SEQ ID NO: 1458267 - RNA, 11 nt, Homo sapiens
cccgugacugc

SEQ ID NO: 1458268 - RNA, 23 nt, Homo sapiens
cccguuucauuuagucaugugac

SEQ ID NO: 1458269 - RNA, 21 nt, Homo sapiens
cccuaaaaauccagacucuuu

SEQ ID NO: 1458270 - RNA, 18 nt, Homo sapiens
cccuacacacacacuccc

SEQ ID NO: 1458271 - RNA, 15 nt, Homo sapiens
cccuacucaccugag

SEQ ID NO: 1458272 - RNA, 14 nt, Homo sapiens
cccuagacauggac

SEQ ID NO: 1458273 - RNA, 19 nt, Homo sapiens
cccuagccuugcuuguuaa

SEQ ID NO: 1458274 - RNA, 20 nt, Homo sapiens
cccuaggaaacucacacucc

SEQ ID NO: 1458275 - RNA, 14 nt, Homo sapiens
cccuaggaacucag

SEQ ID NO: 1458276 - RNA, 14 nt, Homo sapiens
cccuaggagaccaa

SEQ ID NO: 1458277 - RNA, 20 nt, Homo sapiens
cccuagggauuuaaagggac

SEQ ID NO: 1458278 - RNA, 22 nt, Homo sapiens
cccuaguuaguguuuugccuca

SEQ ID NO: 1458279 - RNA, 12 nt, Homo sapiens
cccucacaggag

SEQ ID NO: 1458280 - RNA, 21 nt, Homo sapiens
cccucaccuuggcaccagaca

SEQ ID NO: 1458281 - RNA, 13 nt, Homo sapiens
cccucagacuuca

SEQ ID NO: 1458282 - RNA, 21 nt, Homo sapiens
cccucaggggaaaacuguuac

SEQ ID NO: 1458283 - RNA, 18 nt, Homo sapiens
cccucauucuacugaaaa

SEQ ID NO: 1458284 - RNA, 22 nt, Homo sapiens
cccuccaccgccacuaugggcc

SEQ ID NO: 1458285 - RNA, 14 nt, Homo sapiens
cccuccacugucac

SEQ ID NO: 1458286 - RNA, 19 nt, Homo sapiens
cccuccauucauccuucca

SEQ ID NO: 1458287 - RNA, 22 nt, Homo sapiens
cccuccauucauccuuccaucc

SEQ ID NO: 1458288 - RNA, 15 nt, Homo sapiens
cccuccccugccauu

SEQ ID NO: 1458289 - RNA, 22 nt, Homo sapiens
cccucggacagcccaucugccu

SEQ ID NO: 1458290 - RNA, 12 nt, Homo sapiens
cccucucacuuu

SEQ ID NO: 1458291 - RNA, 21 nt, Homo sapiens
cccucuccugcccagaugccc

SEQ ID NO: 1458292 - RNA, 13 nt, Homo sapiens
cccucucugccag

SEQ ID NO: 1458293 - RNA, 15 nt, Homo sapiens
cccucuuuggcaguu

SEQ ID NO: 1458294 - RNA, 20 nt, Homo sapiens
cccugaccucacugugaccu

SEQ ID NO: 1458295 - RNA, 19 nt, Homo sapiens
cccugagcaggaaaguuua

SEQ ID NO: 1458296 - RNA, 18 nt, Homo sapiens
cccugaguggaucuccaa

SEQ ID NO: 1458297 - RNA, 19 nt, Homo sapiens
cccugauuguguauauuca

SEQ ID NO: 1458298 - RNA, 20 nt, Homo sapiens
cccugcaaacagaacagggu

SEQ ID NO: 1458299 - RNA, 14 nt, Homo sapiens
gaaaaaaaaaccca

SEQ ID NO: 1458300 - RNA, 19 nt, Homo sapiens
gaaaaaauuagcugggcau

SEQ ID NO: 1458301 - RNA, 16 nt, Homo sapiens
gaaaaacagcauguac

SEQ ID NO: 1458302 - RNA, 15 nt, Homo sapiens
gaaaaacuuccauga

SEQ ID NO: 1458303 - RNA, 21 nt, Homo sapiens
gaaaaaucggcuuaccauuaa

SEQ ID NO: 1458304 - RNA, 14 nt, Homo sapiens
gaaaaccuagaucu

SEQ ID NO: 1458305 - RNA, 21 nt, Homo sapiens
gaaaaccuagaucugcacuca

SEQ ID NO: 1458306 - RNA, 22 nt, Homo sapiens
gaaaaccugaagacugaggaca

SEQ ID NO: 1458307 - RNA, 13 nt, Homo sapiens
gaaaacuauacaa

SEQ ID NO: 1458308 - RNA, 19 nt, Homo sapiens
gaaaacuuaugcugauuua

SEQ ID NO: 1458309 - RNA, 22 nt, Homo sapiens
gaaaacuugacauguagcuucu

SEQ ID NO: 1458310 - RNA, 20 nt, Homo sapiens
gaaaagaaauugcaugcagu

SEQ ID NO: 1458311 - RNA, 12 nt, Homo sapiens
gaaaagauuuua

SEQ ID NO: 1458312 - RNA, 16 nt, Homo sapiens
gaaaagccaaauaaaa

SEQ ID NO: 1458313 - RNA, 20 nt, Homo sapiens
gaaaagcugaucauaaguga

SEQ ID NO: 1458314 - RNA, 14 nt, Homo sapiens
gaaaagcugccauu

SEQ ID NO: 1458315 - RNA, 15 nt, Homo sapiens
gaaaagcugccauuu

SEQ ID NO: 1458316 - RNA, 18 nt, Homo sapiens
gaaaaggccuucuuccca

SEQ ID NO: 1458317 - RNA, 15 nt, Homo sapiens
gaaaagggaucugcu

SEQ ID NO: 1458318 - RNA, 16 nt, Homo sapiens
gaaaagggcugacauu

SEQ ID NO: 1458319 - RNA, 16 nt, Homo sapiens
gaaaaguacauuuaau

SEQ ID NO: 1458320 - RNA, 20 nt, Homo sapiens
gaaaagugcauauuuaucca

SEQ ID NO: 1458321 - RNA, 23 nt, Homo sapiens
gaaaaguuuccuaggaugucaug

SEQ ID NO: 1458322 - RNA, 14 nt, Homo sapiens
gaaaauaucuugcu

SEQ ID NO: 1458323 - RNA, 16 nt, Homo sapiens
gaaaauauggguugca

SEQ ID NO: 1458324 - RNA, 11 nt, Homo sapiens
gaaaaugucag

SEQ ID NO: 1458325 - RNA, 18 nt, Homo sapiens
gaaaauguuuaccagugu

SEQ ID NO: 1458326 - RNA, 14 nt, Homo sapiens
gaaaauuauaucuc

SEQ ID NO: 1458327 - RNA, 21 nt, Homo sapiens
gaaaauucuguagguucugug

SEQ ID NO: 1458328 - RNA, 22 nt, Homo sapiens
gaaaauugggcaugccauuaca

SEQ ID NO: 1458329 - RNA, 18 nt, Homo sapiens
gaaaauuuuaaaaauaca

SEQ ID NO: 1458330 - RNA, 16 nt, Homo sapiens
gaaaauuuuacuucca

SEQ ID NO: 1458331 - RNA, 14 nt, Homo sapiens
gaaacaacagggga

SEQ ID NO: 1458332 - RNA, 12 nt, Homo sapiens
gaaacaacuugg

SEQ ID NO: 1458333 - RNA, 18 nt, Homo sapiens
gaaacaagccugccauaa

SEQ ID NO: 1458334 - RNA, 22 nt, Homo sapiens
gaaacaauggcuaagauaccaa

SEQ ID NO: 1458335 - RNA, 22 nt, Homo sapiens
gaaacaauguggagucucccuc

SEQ ID NO: 1458336 - RNA, 23 nt, Homo sapiens
gaaacacaucuucccuagagggu

SEQ ID NO: 1458337 - RNA, 13 nt, Homo sapiens
gaaacacauucuu

SEQ ID NO: 1458338 - RNA, 10 nt, Homo sapiens
gaaacauuua

SEQ ID NO: 1458339 - RNA, 21 nt, Homo sapiens
gaaacauuuuguggucauuaa

SEQ ID NO: 1458340 - RNA, 16 nt, Homo sapiens
gaaaccagagccuuuc

SEQ ID NO: 1458341 - RNA, 13 nt, Homo sapiens
gaaacccacagau

SEQ ID NO: 1458342 - RNA, 17 nt, Homo sapiens
gaaacccaggaguggau

SEQ ID NO: 1458343 - RNA, 14 nt, Homo sapiens
gaaaccccaucucu

SEQ ID NO: 1458344 - RNA, 17 nt, Homo sapiens
gaaacccccaguguaau

SEQ ID NO: 1458345 - RNA, 18 nt, Homo sapiens
gaaacccccaguguaaua

SEQ ID NO: 1458346 - RNA, 18 nt, Homo sapiens
gaaaccgccuaguuuacu

SEQ ID NO: 1458347 - RNA, 17 nt, Homo sapiens
gaaaccuuauuguaccu

SEQ ID NO: 1458348 - RNA, 20 nt, Homo sapiens
gaaaccuuauuguaccucuc

SEQ ID NO: 1458349 - RNA, 21 nt, Homo sapiens
gaaacgucuucuaaacuuccc

SEQ ID NO: 1458350 - RNA, 15 nt, Homo sapiens
gaaacuaaacucuua

SEQ ID NO: 1458351 - RNA, 16 nt, Homo sapiens
gaaacucaaaaauauu

SEQ ID NO: 1458352 - RNA, 22 nt, Homo sapiens
gaaacugauuucuucagaauua

SEQ ID NO: 1458353 - RNA, 21 nt, Homo sapiens
gaaacugcucccaucauuccu

SEQ ID NO: 1458354 - RNA, 14 nt, Homo sapiens
gaaacuggcacuga

SEQ ID NO: 1458355 - RNA, 19 nt, Homo sapiens
gaaacuugugaaguggaaa

SEQ ID NO: 1458356 - RNA, 19 nt, Homo sapiens
gaaacuuuaaaagacugaa

SEQ ID NO: 1458357 - RNA, 13 nt, Homo sapiens
gaaagaaagggaa

SEQ ID NO: 1458358 - RNA, 13 nt, Homo sapiens
gaaagaaccagag

SEQ ID NO: 1458359 - RNA, 22 nt, Homo sapiens
gaaagagcagucagaguccagu

SEQ ID NO: 1458360 - RNA, 15 nt, Homo sapiens
gaaagaggaagcaaa

SEQ ID NO: 1458361 - RNA, 22 nt, Homo sapiens
gaaagaugguguggguguccug

SEQ ID NO: 1458362 - RNA, 14 nt, Homo sapiens
gaaagcccucuugg

SEQ ID NO: 1458363 - RNA, 18 nt, Homo sapiens
gaaagccugggugacauu

SEQ ID NO: 1458364 - RNA, 14 nt, Homo sapiens
gaaagccuuaggga

SEQ ID NO: 1458365 - RNA, 18 nt, Homo sapiens
gaaagcuauauaagacaa

SEQ ID NO: 1458366 - RNA, 17 nt, Homo sapiens
gaaagggguugggguga

SEQ ID NO: 1458367 - RNA, 19 nt, Homo sapiens
gaaagggguuggggugaca

SEQ ID NO: 1458368 - RNA, 18 nt, Homo sapiens
gaaaggucucagcuugua

SEQ ID NO: 1458369 - RNA, 16 nt, Homo sapiens
gaaagguuuuccuuau

SEQ ID NO: 1458370 - RNA, 16 nt, Homo sapiens
gaaaguacauuuggag

SEQ ID NO: 1458371 - RNA, 14 nt, Homo sapiens
gaaagugcauauga

SEQ ID NO: 1458372 - RNA, 17 nt, Homo sapiens
gaaaguggaaauggaga

SEQ ID NO: 1458373 - RNA, 20 nt, Homo sapiens
gaaagugugagcucuucccu

SEQ ID NO: 1458374 - RNA, 15 nt, Homo sapiens
gaaauaaaucagaga

SEQ ID NO: 1458375 - RNA, 18 nt, Homo sapiens
gaaauaaauucugauucu

SEQ ID NO: 1458376 - RNA, 21 nt, Homo sapiens
gaaauaauugaagagagaaau

SEQ ID NO: 1458377 - RNA, 23 nt, Homo sapiens
gaaauacacuguuaucuucacuu

SEQ ID NO: 1458378 - RNA, 16 nt, Homo sapiens
gaaauacuauaacaua

SEQ ID NO: 1458379 - RNA, 13 nt, Homo sapiens
gaaauacuuucag

SEQ ID NO: 1458380 - RNA, 20 nt, Homo sapiens
gaaauagaagcaaaugacaa

SEQ ID NO: 1458381 - RNA, 15 nt, Homo sapiens
gaaauagacaguaua

SEQ ID NO: 1458382 - RNA, 15 nt, Homo sapiens
gaaauagugacaagu

SEQ ID NO: 1458383 - RNA, 20 nt, Homo sapiens
gaaauauggaacuuacauug

SEQ ID NO: 1458384 - RNA, 22 nt, Homo sapiens
gaaauccuuccuaaacccaaug

SEQ ID NO: 1458385 - RNA, 22 nt, Homo sapiens
gaaaucuaaaagaauuuuacca

SEQ ID NO: 1458386 - RNA, 17 nt, Homo sapiens
gaaaucuagaagacugu

SEQ ID NO: 1458387 - RNA, 18 nt, Homo sapiens
gaaaucuagaagacuguc

SEQ ID NO: 1458388 - RNA, 21 nt, Homo sapiens
gaaaugaaauauuguuuccaa

SEQ ID NO: 1458389 - RNA, 23 nt, Homo sapiens
gaaaugauccccaaguggugaau

SEQ ID NO: 1458390 - RNA, 22 nt, Homo sapiens
gaaaugaugaaaagguugccug

SEQ ID NO: 1458391 - RNA, 17 nt, Homo sapiens
gaaaugcuguuaguaaa

SEQ ID NO: 1458392 - RNA, 20 nt, Homo sapiens
gaaauggauuuaucaucacc

SEQ ID NO: 1458393 - RNA, 13 nt, Homo sapiens
gaaauuacugugu

SEQ ID NO: 1458394 - RNA, 17 nt, Homo sapiens
gaaauuauaucuguggu

SEQ ID NO: 1458395 - RNA, 18 nt, Homo sapiens
gaaauuauaucugugguc

SEQ ID NO: 1458396 - RNA, 13 nt, Homo sapiens
gaaauuugcaaaa

SEQ ID NO: 1458397 - RNA, 14 nt, Homo sapiens
gaacaaacaaugaa

SEQ ID NO: 1458398 - RNA, 21 nt, Homo sapiens
gaacaaacacugcaguuuccu

SEQ ID NO: 1458399 - RNA, 17 nt, Homo sapiens
gaacaacgccugucaca

SEQ ID NO: 1458400 - RNA, 17 nt, Homo sapiens
gaacaauccauaacuuu

SEQ ID NO: 1458401 - RNA, 17 nt, Homo sapiens
gaacacugcacucuuaa

SEQ ID NO: 1458402 - RNA, 17 nt, Homo sapiens
gaacagaaggaugaaug

SEQ ID NO: 1458403 - RNA, 19 nt, Homo sapiens
gaacagaaggaugaaugag

SEQ ID NO: 1458404 - RNA, 19 nt, Homo sapiens
gaacagcaauggugucagu

SEQ ID NO: 1458405 - RNA, 17 nt, Homo sapiens
gaacagcgggagaccug

SEQ ID NO: 1458406 - RNA, 23 nt, Homo sapiens
gaacagcgggagaccugugcuag

SEQ ID NO: 1458407 - RNA, 17 nt, Homo sapiens
gaacaucauaacccaug

SEQ ID NO: 1458408 - RNA, 23 nt, Homo sapiens
gaacauuccuuagucucaagggc

SEQ ID NO: 1458409 - RNA, 19 nt, Homo sapiens
gaaccaaaagaauuugcac

SEQ ID NO: 1458410 - RNA, 12 nt, Homo sapiens
gaaccacagggc

SEQ ID NO: 1458411 - RNA, 21 nt, Homo sapiens
gaaccagagaggcucugagaa

SEQ ID NO: 1458412 - RNA, 15 nt, Homo sapiens
gaaccaggaggacaa

SEQ ID NO: 1458413 - RNA, 15 nt, Homo sapiens
gaacccagaaggcag

SEQ ID NO: 1458414 - RNA, 23 nt, Homo sapiens
gaaccccgucgaggggcucucag

SEQ ID NO: 1458415 - RNA, 23 nt, Homo sapiens
gaacccgggagguggagauugca

SEQ ID NO: 1458416 - RNA, 12 nt, Homo sapiens
gaacccugagca

SEQ ID NO: 1458417 - RNA, 19 nt, Homo sapiens
gaacccugcuugcacuuug

SEQ ID NO: 1458418 - RNA, 21 nt, Homo sapiens
gaacccugcuugcacuuugua

SEQ ID NO: 1458419 - RNA, 19 nt, Homo sapiens
gaaccucagccuggccaga

SEQ ID NO: 1458420 - RNA, 15 nt, Homo sapiens
gaaccucugucucau

SEQ ID NO: 1458421 - RNA, 21 nt, Homo sapiens
gaaccugagcuauuuuccucu

SEQ ID NO: 1458422 - RNA, 21 nt, Homo sapiens
gaaccuggaaaaauuccagaa

SEQ ID NO: 1458423 - RNA, 15 nt, Homo sapiens
gaaccuggaacuugg

SEQ ID NO: 1458424 - RNA, 13 nt, Homo sapiens
gaacuacuaaagu

SEQ ID NO: 1458425 - RNA, 20 nt, Homo sapiens
gaacuccaccgaccaacugc

SEQ ID NO: 1458426 - RNA, 14 nt, Homo sapiens
gaacucccucugga

SEQ ID NO: 1458427 - RNA, 18 nt, Homo sapiens
gaacucucaagugucuua

SEQ ID NO: 1458428 - RNA, 11 nt, Homo sapiens
gaacucuccau

SEQ ID NO: 1458429 - RNA, 21 nt, Homo sapiens
gaacucuucaaucucuugcac

SEQ ID NO: 1458430 - RNA, 15 nt, Homo sapiens
gaacugcauugacuu

SEQ ID NO: 1458431 - RNA, 16 nt, Homo sapiens
gaacuggcaauugucu

SEQ ID NO: 1458432 - RNA, 15 nt, Homo sapiens
gaacuguccagagag

SEQ ID NO: 1458433 - RNA, 19 nt, Homo sapiens
gaacuucuuugaauuuacu

SEQ ID NO: 1458434 - RNA, 20 nt, Homo sapiens
gaacuuuuuuagaaaugcaa

SEQ ID NO: 1458435 - RNA, 16 nt, Homo sapiens
gaagaaaagcugccau

SEQ ID NO: 1458436 - RNA, 14 nt, Homo sapiens
gaagaaacuuugcc

SEQ ID NO: 1458437 - RNA, 20 nt, Homo sapiens
gaagaaacuuugccucaaga

SEQ ID NO: 1458438 - RNA, 13 nt, Homo sapiens
gaagaacauagaa

SEQ ID NO: 1458439 - RNA, 13 nt, Homo sapiens
gaagaacuugcau

SEQ ID NO: 1458440 - RNA, 12 nt, Homo sapiens
gaagaagcuaaa

SEQ ID NO: 1458441 - RNA, 17 nt, Homo sapiens
gaagaagugagcagugu

SEQ ID NO: 1458442 - RNA, 22 nt, Homo sapiens
gaagaaugcacaagaauggauc

SEQ ID NO: 1458443 - RNA, 14 nt, Homo sapiens
gaagaauugccaau

SEQ ID NO: 1458444 - RNA, 20 nt, Homo sapiens
gaagaauuggggauucucua

SEQ ID NO: 1458445 - RNA, 12 nt, Homo sapiens
gaagacucugac

SEQ ID NO: 1458446 - RNA, 14 nt, Homo sapiens
gaagagaagcugcu

SEQ ID NO: 1458447 - RNA, 16 nt, Homo sapiens
gaagagaagcugcuga

SEQ ID NO: 1458448 - RNA, 11 nt, Homo sapiens
gaagagcauug

SEQ ID NO: 1458449 - RNA, 18 nt, Homo sapiens
gaagagggggcuggccau

SEQ ID NO: 1458450 - RNA, 20 nt, Homo sapiens
gaagauaacuugagcaccgu

SEQ ID NO: 1458451 - RNA, 16 nt, Homo sapiens
gaagauagaugcacuu

SEQ ID NO: 1458452 - RNA, 15 nt, Homo sapiens
gaagauuacccucaa

SEQ ID NO: 1458453 - RNA, 21 nt, Homo sapiens
gaagauugcgguuuacagcua

SEQ ID NO: 1458454 - RNA, 17 nt, Homo sapiens
gaagcaaagaagggaau

SEQ ID NO: 1458455 - RNA, 12 nt, Homo sapiens
gaagcacuacac

SEQ ID NO: 1458456 - RNA, 17 nt, Homo sapiens
gaagcaggguacccuuu

SEQ ID NO: 1458457 - RNA, 18 nt, Homo sapiens
gaagcaggguacccuuug

SEQ ID NO: 1458458 - RNA, 15 nt, Homo sapiens
gaagcagugccuucc

SEQ ID NO: 1458459 - RNA, 15 nt, Homo sapiens
gaagcauucucccca

SEQ ID NO: 1458460 - RNA, 23 nt, Homo sapiens
gaagcccugauguguccucaggg

SEQ ID NO: 1458461 - RNA, 15 nt, Homo sapiens
gaagccuuaagccau

SEQ ID NO: 1458462 - RNA, 18 nt, Homo sapiens
gaagcuacuucuccacug

SEQ ID NO: 1458463 - RNA, 15 nt, Homo sapiens
gaagcuccacuguca

SEQ ID NO: 1458464 - RNA, 16 nt, Homo sapiens
gaagcucugaagucac

SEQ ID NO: 1458465 - RNA, 16 nt, Homo sapiens
gaagcugagacacaaa

SEQ ID NO: 1458466 - RNA, 16 nt, Homo sapiens
gaagcuggugcgcccu

SEQ ID NO: 1458467 - RNA, 14 nt, Homo sapiens
gaaggaaaaugaua

SEQ ID NO: 1458468 - RNA, 19 nt, Homo sapiens
gaaggaacucuggcuucca

SEQ ID NO: 1458469 - RNA, 23 nt, Homo sapiens
gaaggaugucccggguguguaca

SEQ ID NO: 1458470 - RNA, 13 nt, Homo sapiens
gaaggauuaccug

SEQ ID NO: 1458471 - RNA, 15 nt, Homo sapiens
gaaggauuacucucc

SEQ ID NO: 1458472 - RNA, 20 nt, Homo sapiens
gaaggcagagguugcaguga

SEQ ID NO: 1458473 - RNA, 18 nt, Homo sapiens
gaaggcccugcugaguca

SEQ ID NO: 1458474 - RNA, 19 nt, Homo sapiens
gaagggaauuuauugccuc

SEQ ID NO: 1458475 - RNA, 19 nt, Homo sapiens
gaagggaguggcucuguaa

SEQ ID NO: 1458476 - RNA, 16 nt, Homo sapiens
gaagggcauuaaccug

SEQ ID NO: 1458477 - RNA, 12 nt, Homo sapiens
gaagggccagag

SEQ ID NO: 1458478 - RNA, 12 nt, Homo sapiens
gaagggccaguc

SEQ ID NO: 1458479 - RNA, 16 nt, Homo sapiens
gaagggggacacucca

SEQ ID NO: 1458480 - RNA, 19 nt, Homo sapiens
gaaggugaaagugcaguuc

SEQ ID NO: 1458481 - RNA, 12 nt, Homo sapiens
gaaggugccucu

SEQ ID NO: 1458482 - RNA, 18 nt, Homo sapiens
gaaguaaacagauggcac

SEQ ID NO: 1458483 - RNA, 16 nt, Homo sapiens
gaaguacuccuauugc

SEQ ID NO: 1458484 - RNA, 16 nt, Homo sapiens
gaaguauuucugugga

SEQ ID NO: 1458485 - RNA, 22 nt, Homo sapiens
gaaguauuuuccuccaggcaaa

SEQ ID NO: 1458486 - RNA, 16 nt, Homo sapiens
gaagucacugcacagu

SEQ ID NO: 1458487 - RNA, 13 nt, Homo sapiens
gaagucaucucau

SEQ ID NO: 1458488 - RNA, 20 nt, Homo sapiens
gaagucuucucugccuguaa

SEQ ID NO: 1458489 - RNA, 20 nt, Homo sapiens
gaagugaaugaaacacucag

SEQ ID NO: 1458490 - RNA, 19 nt, Homo sapiens
gaagugcuggcaaccacua

SEQ ID NO: 1458491 - RNA, 14 nt, Homo sapiens
gaaguggacuggag

SEQ ID NO: 1458492 - RNA, 18 nt, Homo sapiens
gaagugguaggaaagccu

SEQ ID NO: 1458493 - RNA, 15 nt, Homo sapiens
gaagugucacagccu

SEQ ID NO: 1458494 - RNA, 17 nt, Homo sapiens
gaagugugagcgccuug

SEQ ID NO: 1458495 - RNA, 15 nt, Homo sapiens
gaaguuacaugcaua

SEQ ID NO: 1458496 - RNA, 13 nt, Homo sapiens
gaaguuacuuugu

SEQ ID NO: 1458497 - RNA, 12 nt, Homo sapiens
gaaguuugccaa

SEQ ID NO: 1458498 - RNA, 13 nt, Homo sapiens
gaauaagaagcaa

SEQ ID NO: 1458499 - RNA, 12 nt, Homo sapiens
gaauaaggccca

SEQ ID NO: 1458500 - RNA, 14 nt, Homo sapiens
gaauaauaccuaag

SEQ ID NO: 1458501 - RNA, 19 nt, Homo sapiens
gaauagcuuugaauguggc

SEQ ID NO: 1458502 - RNA, 18 nt, Homo sapiens
gaauaguccauccccaga

SEQ ID NO: 1458503 - RNA, 17 nt, Homo sapiens
gaauauaaacauauaca

SEQ ID NO: 1458504 - RNA, 13 nt, Homo sapiens
gaauauaauuuca

SEQ ID NO: 1458505 - RNA, 18 nt, Homo sapiens
gaauauuuauuaccucug

SEQ ID NO: 1458506 - RNA, 16 nt, Homo sapiens
gaaucaaaaauugaag

SEQ ID NO: 1458507 - RNA, 17 nt, Homo sapiens
gaaucacuggcuguuaa

SEQ ID NO: 1458508 - RNA, 21 nt, Homo sapiens
gaaucaugagccugcuggaag

SEQ ID NO: 1458509 - RNA, 18 nt, Homo sapiens
gaaucauuaauacaaaga

SEQ ID NO: 1458510 - RNA, 14 nt, Homo sapiens
gaaucauuaucuua

SEQ ID NO: 1458511 - RNA, 21 nt, Homo sapiens
gaaucccccuugccaccccac

SEQ ID NO: 1458512 - RNA, 13 nt, Homo sapiens
gaaucccuagucc

SEQ ID NO: 1458513 - RNA, 20 nt, Homo sapiens
gaauccuggaccaagcacaa

SEQ ID NO: 1458514 - RNA, 17 nt, Homo sapiens
gaaucgcuuaaaccugg

SEQ ID NO: 1458515 - RNA, 14 nt, Homo sapiens
gaaucuaaaccuua

SEQ ID NO: 1458516 - RNA, 22 nt, Homo sapiens
gaaucuaaaccuuacaugugua

SEQ ID NO: 1458517 - RNA, 19 nt, Homo sapiens
gaaucuacaaaaaacaaca

SEQ ID NO: 1458518 - RNA, 21 nt, Homo sapiens
gaaucuauccauugaacuaaa

SEQ ID NO: 1458519 - RNA, 14 nt, Homo sapiens
gaaucuauuucacu

SEQ ID NO: 1458520 - RNA, 15 nt, Homo sapiens
gaaucucguucccaa

SEQ ID NO: 1458521 - RNA, 13 nt, Homo sapiens
gaaucucucccuc

SEQ ID NO: 1458522 - RNA, 19 nt, Homo sapiens
gaaucugguguuggggaaa

SEQ ID NO: 1458523 - RNA, 19 nt, Homo sapiens
gaaucuguaaagaaauaua

SEQ ID NO: 1458524 - RNA, 20 nt, Homo sapiens
gaaucugugcagaugagcag

SEQ ID NO: 1458525 - RNA, 17 nt, Homo sapiens
gaaucuuaaugcuugua

SEQ ID NO: 1458526 - RNA, 20 nt, Homo sapiens
gaaucuucacaaaacacuuc

SEQ ID NO: 1458527 - RNA, 13 nt, Homo sapiens
gaaugaaacugau

SEQ ID NO: 1458528 - RNA, 15 nt, Homo sapiens
gaaugaacacucccc

SEQ ID NO: 1458529 - RNA, 22 nt, Homo sapiens
gaaugaacuaugucgaugcaca

SEQ ID NO: 1458530 - RNA, 18 nt, Homo sapiens
gaaugaccagccugucca

SEQ ID NO: 1458531 - RNA, 21 nt, Homo sapiens
gaaugagaagaggcugcugca

SEQ ID NO: 1458532 - RNA, 20 nt, Homo sapiens
gaaugaucagcaucugugau

SEQ ID NO: 1458533 - RNA, 19 nt, Homo sapiens
gaaugcaaaguagcaauuu

SEQ ID NO: 1458534 - RNA, 18 nt, Homo sapiens
gaaugcacaagaauggau

SEQ ID NO: 1458535 - RNA, 15 nt, Homo sapiens
gaaugcugcacuaau

SEQ ID NO: 1458536 - RNA, 17 nt, Homo sapiens
gaauggauuuaucagaa

SEQ ID NO: 1458537 - RNA, 14 nt, Homo sapiens
gaauguaugugcac

SEQ ID NO: 1458538 - RNA, 17 nt, Homo sapiens
gaaugugauauuugaag

SEQ ID NO: 1458539 - RNA, 18 nt, Homo sapiens
gaauguggaauaccuaag

SEQ ID NO: 1458540 - RNA, 23 nt, Homo sapiens
gaauguguggccugcacagugaa

SEQ ID NO: 1458541 - RNA, 15 nt, Homo sapiens
gaauguuaagcagau

SEQ ID NO: 1458542 - RNA, 17 nt, Homo sapiens
gaauguuuuacugugaa

SEQ ID NO: 1458543 - RNA, 17 nt, Homo sapiens
gaauuaaaacuucuuaa

SEQ ID NO: 1458544 - RNA, 14 nt, Homo sapiens
gaauuaaccuggug

SEQ ID NO: 1458545 - RNA, 14 nt, Homo sapiens
gaauuaccaagaga

SEQ ID NO: 1458546 - RNA, 17 nt, Homo sapiens
gaauuauauguucagau

SEQ ID NO: 1458547 - RNA, 20 nt, Homo sapiens
gaauuaugucguaagucacu

SEQ ID NO: 1458548 - RNA, 19 nt, Homo sapiens
gaauuccucuuuugcuuaa

SEQ ID NO: 1458549 - RNA, 21 nt, Homo sapiens
gaauugagauaauaucuguga

SEQ ID NO: 1458550 - RNA, 23 nt, Homo sapiens
gaauugagauaauaucugugagg

SEQ ID NO: 1458551 - RNA, 19 nt, Homo sapiens
gaauuguaggugacuauua

SEQ ID NO: 1458552 - RNA, 18 nt, Homo sapiens
gaauuucacaagcuauuu

SEQ ID NO: 1458553 - RNA, 16 nt, Homo sapiens
gaauuuccacuguaau

SEQ ID NO: 1458554 - RNA, 11 nt, Homo sapiens
gaauuugcacc

SEQ ID NO: 1458555 - RNA, 15 nt, Homo sapiens
gaauuuuaagugcuu

SEQ ID NO: 1458556 - RNA, 20 nt, Homo sapiens
gaauuuucucuaacuucaag

SEQ ID NO: 1458557 - RNA, 19 nt, Homo sapiens
gaauuuuuuuuaacauucc

SEQ ID NO: 1458558 - RNA, 14 nt, Homo sapiens
gacaaaacaauccc

SEQ ID NO: 1458559 - RNA, 21 nt, Homo sapiens
gacaaaaggaaaggucucagc

SEQ ID NO: 1458560 - RNA, 16 nt, Homo sapiens
gacaaagugagacucc

SEQ ID NO: 1458561 - RNA, 16 nt, Homo sapiens
gacaacaaccuaugca

SEQ ID NO: 1458562 - RNA, 16 nt, Homo sapiens
gacaaccuccauucua

SEQ ID NO: 1458563 - RNA, 14 nt, Homo sapiens
gacaacgaugaauu

SEQ ID NO: 1458564 - RNA, 15 nt, Homo sapiens
gacaacucaaugaaa

SEQ ID NO: 1458565 - RNA, 17 nt, Homo sapiens
gacaacugcacaugaaa

SEQ ID NO: 1458566 - RNA, 13 nt, Homo sapiens
gacaacugugacu

SEQ ID NO: 1458567 - RNA, 21 nt, Homo sapiens
gacaagaauaauucaauuuua

SEQ ID NO: 1458568 - RNA, 19 nt, Homo sapiens
gacaaucaugaaauaugca

SEQ ID NO: 1458569 - RNA, 20 nt, Homo sapiens
gacaaucaugaaauaugcau

SEQ ID NO: 1458570 - RNA, 15 nt, Homo sapiens
gacaauuaucaacca

SEQ ID NO: 1458571 - RNA, 16 nt, Homo sapiens
gacacacaaaucccau

SEQ ID NO: 1458572 - RNA, 16 nt, Homo sapiens
gacacagcagugguau

SEQ ID NO: 1458573 - RNA, 22 nt, Homo sapiens
gacaccagagcagaugcagaga

SEQ ID NO: 1458574 - RNA, 15 nt, Homo sapiens
gacacccacccugug

SEQ ID NO: 1458575 - RNA, 23 nt, Homo sapiens
gacaccccugcucuacccaugag

SEQ ID NO: 1458576 - RNA, 16 nt, Homo sapiens
gacaccucaccucacc

SEQ ID NO: 1458577 - RNA, 22 nt, Homo sapiens
gacacuuaauacuaccuugaaa

SEQ ID NO: 1458578 - RNA, 17 nt, Homo sapiens
gacagaaugguggagug

SEQ ID NO: 1458579 - RNA, 14 nt, Homo sapiens
gacagaccuggaca

SEQ ID NO: 1458580 - RNA, 16 nt, Homo sapiens
gacagagcgagacucc

SEQ ID NO: 1458581 - RNA, 22 nt, Homo sapiens
gacagagggcucaccucuugcc

SEQ ID NO: 1458582 - RNA, 17 nt, Homo sapiens
gacagaugaaugccgug

SEQ ID NO: 1458583 - RNA, 18 nt, Homo sapiens
gacagcaucccuucccac

SEQ ID NO: 1458584 - RNA, 16 nt, Homo sapiens
gacagcauugccagua

SEQ ID NO: 1458585 - RNA, 13 nt, Homo sapiens
gacagccuggcac

SEQ ID NO: 1458586 - RNA, 22 nt, Homo sapiens
gacagcugcugggucaggccac

SEQ ID NO: 1458587 - RNA, 16 nt, Homo sapiens
gacagcugugugacau

SEQ ID NO: 1458588 - RNA, 13 nt, Homo sapiens
gacaggaagcugg

SEQ ID NO: 1458589 - RNA, 16 nt, Homo sapiens
gacaggaagcuggcag

SEQ ID NO: 1458590 - RNA, 14 nt, Homo sapiens
gacagugccuggga

SEQ ID NO: 1458591 - RNA, 19 nt, Homo sapiens
gacauacauuuaugcacau

SEQ ID NO: 1458592 - RNA, 18 nt, Homo sapiens
gacauaccccacugggca

SEQ ID NO: 1458593 - RNA, 23 nt, Homo sapiens
gacauacucucugccuggugguc

SEQ ID NO: 1458594 - RNA, 13 nt, Homo sapiens
gacaucucagggg

SEQ ID NO: 1458595 - RNA, 19 nt, Homo sapiens
gacaucuuaggcuggccag

SEQ ID NO: 1458596 - RNA, 11 nt, Homo sapiens
gacaugcauug

SEQ ID NO: 1458597 - RNA, 14 nt, Homo sapiens
gacauguagcuucu

SEQ ID NO: 1458598 - RNA, 15 nt, Homo sapiens
gacauguagcuucuu

SEQ ID NO: 1458599 - RNA, 19 nt, Homo sapiens
gacauugaccuauuuccag

SEQ ID NO: 1458600 - RNA, 22 nt, Homo sapiens
gacauuuaauuuagugaucuua

SEQ ID NO: 1458601 - RNA, 19 nt, Homo sapiens
gaccaauugugcugccauu

SEQ ID NO: 1458602 - RNA, 17 nt, Homo sapiens
gaccacagcacagccaa

SEQ ID NO: 1458603 - RNA, 19 nt, Homo sapiens
gaccacagcaucauuuugc

SEQ ID NO: 1458604 - RNA, 14 nt, Homo sapiens
gaccacaucuuuau

SEQ ID NO: 1458605 - RNA, 23 nt, Homo sapiens
gaccaccaccccaacaaaccauc

SEQ ID NO: 1458606 - RNA, 16 nt, Homo sapiens
gaccacggggagcaaa

SEQ ID NO: 1458607 - RNA, 22 nt, Homo sapiens
gaccacucugucuuguguuucc

SEQ ID NO: 1458608 - RNA, 17 nt, Homo sapiens
gaccagaagcauuucac

SEQ ID NO: 1458609 - RNA, 20 nt, Homo sapiens
gaccagguugucacugagaa

SEQ ID NO: 1458610 - RNA, 15 nt, Homo sapiens
gaccauggaggccag

SEQ ID NO: 1458611 - RNA, 23 nt, Homo sapiens
gaccauuaauaaagacacuggca

SEQ ID NO: 1458612 - RNA, 15 nt, Homo sapiens
gaccauucauaccca

SEQ ID NO: 1458613 - RNA, 17 nt, Homo sapiens
gacccaacagcagugau

SEQ ID NO: 1458614 - RNA, 19 nt, Homo sapiens
gacccaccuucaagcagcu

SEQ ID NO: 1458615 - RNA, 13 nt, Homo sapiens
gacccaugggaga

SEQ ID NO: 1458616 - RNA, 12 nt, Homo sapiens
gaccccaaagag

SEQ ID NO: 1458617 - RNA, 20 nt, Homo sapiens
gaccccaaauuaagaaucua

SEQ ID NO: 1458618 - RNA, 18 nt, Homo sapiens
gaccccacugccaagugg

SEQ ID NO: 1458619 - RNA, 14 nt, Homo sapiens
gacccccagcacuu

SEQ ID NO: 1458620 - RNA, 23 nt, Homo sapiens
gacccccagcacuuggggguuca

SEQ ID NO: 1458621 - RNA, 18 nt, Homo sapiens
gaccccugacucaucauu

SEQ ID NO: 1458622 - RNA, 20 nt, Homo sapiens
gacccggaggggccuggcag

SEQ ID NO: 1458623 - RNA, 16 nt, Homo sapiens
gacccuccccuaguca

SEQ ID NO: 1458624 - RNA, 23 nt, Homo sapiens
gacccucgggccccauccucauc

SEQ ID NO: 1458625 - RNA, 21 nt, Homo sapiens
gacccucugaaugguccaggg

SEQ ID NO: 1458626 - RNA, 15 nt, Homo sapiens
gacccugaggcccug

SEQ ID NO: 1458627 - RNA, 19 nt, Homo sapiens
gacccugccacagccagag

SEQ ID NO: 1458628 - RNA, 15 nt, Homo sapiens
gacccugccacucuc

SEQ ID NO: 1458629 - RNA, 16 nt, Homo sapiens
gacccuggucugagga

SEQ ID NO: 1458630 - RNA, 20 nt, Homo sapiens
gaccuacuguucggacaaaa

SEQ ID NO: 1458631 - RNA, 17 nt, Homo sapiens
gaccuaugagcacauag

SEQ ID NO: 1458632 - RNA, 14 nt, Homo sapiens
gaccucaggugauu

SEQ ID NO: 1458633 - RNA, 17 nt, Homo sapiens
gaccuccaaccaggagu

SEQ ID NO: 1458634 - RNA, 20 nt, Homo sapiens
gaccucucauaaauuuacuu

SEQ ID NO: 1458635 - RNA, 14 nt, Homo sapiens
gaccugauccugga

SEQ ID NO: 1458636 - RNA, 16 nt, Homo sapiens
gaccuggagacugaca

SEQ ID NO: 1458637 - RNA, 17 nt, Homo sapiens
gaccuggagaugcugcc

SEQ ID NO: 1458638 - RNA, 20 nt, Homo sapiens
gaccuggcugccccucaccu

SEQ ID NO: 1458639 - RNA, 14 nt, Homo sapiens
gaccuggugcugag

SEQ ID NO: 1458640 - RNA, 17 nt, Homo sapiens
gaccuguaaucauauaa

SEQ ID NO: 1458641 - RNA, 15 nt, Homo sapiens
gaccuuccucaucca

SEQ ID NO: 1458642 - RNA, 18 nt, Homo sapiens
gaccuugaaggguaaaga

SEQ ID NO: 1458643 - RNA, 19 nt, Homo sapiens
gacguacuuugugcuggga

SEQ ID NO: 1458644 - RNA, 14 nt, Homo sapiens
gacguagaaagauc

SEQ ID NO: 1458645 - RNA, 19 nt, Homo sapiens
gacguucauuauguaugaa

SEQ ID NO: 1458646 - RNA, 15 nt, Homo sapiens
gacuaagcauugagc

SEQ ID NO: 1458647 - RNA, 18 nt, Homo sapiens
gacuaagccuaccugcuc

SEQ ID NO: 1458648 - RNA, 23 nt, Homo sapiens
gacuaagccuaccugcucuccaa

SEQ ID NO: 1458649 - RNA, 18 nt, Homo sapiens
gacuaaucaccuacucaa

SEQ ID NO: 1458650 - RNA, 15 nt, Homo sapiens
gacuaauuaggcaag

SEQ ID NO: 1458651 - RNA, 22 nt, Homo sapiens
gacuaauuucaaaaugcuuuuu

SEQ ID NO: 1458652 - RNA, 20 nt, Homo sapiens
gacuacaaccaauuuacacu

SEQ ID NO: 1458653 - RNA, 20 nt, Homo sapiens
gacuacauuugugaacaaaa

SEQ ID NO: 1458654 - RNA, 19 nt, Homo sapiens
gacuacuauacaaacuaca

SEQ ID NO: 1458655 - RNA, 17 nt, Homo sapiens
gacuagaggcuugcaua

SEQ ID NO: 1458656 - RNA, 16 nt, Homo sapiens
gacuagaugauggaug

SEQ ID NO: 1458657 - RNA, 17 nt, Homo sapiens
gacuauggcuaccaaaa

SEQ ID NO: 1458658 - RNA, 16 nt, Homo sapiens
gacucaaucuacaggc

SEQ ID NO: 1458659 - RNA, 19 nt, Homo sapiens
gacucaccucauccuuacc

SEQ ID NO: 1458660 - RNA, 17 nt, Homo sapiens
gacucaggccagugugu

SEQ ID NO: 1458661 - RNA, 17 nt, Homo sapiens
gacucagggccaugccu

SEQ ID NO: 1458662 - RNA, 21 nt, Homo sapiens
gacucagggccaugccugccc

SEQ ID NO: 1458663 - RNA, 12 nt, Homo sapiens
gacucaguucca

SEQ ID NO: 1458664 - RNA, 12 nt, Homo sapiens
gacuccaucuca

SEQ ID NO: 1458665 - RNA, 13 nt, Homo sapiens
gacuccaucucaa

SEQ ID NO: 1458666 - RNA, 13 nt, Homo sapiens
gacucccacaaca

SEQ ID NO: 1458667 - RNA, 20 nt, Homo sapiens
gacucccggagccugugcag

SEQ ID NO: 1458668 - RNA, 22 nt, Homo sapiens
gacuccuaccugcccuggaaca

SEQ ID NO: 1458669 - RNA, 15 nt, Homo sapiens
gacuccuccuccaaa

SEQ ID NO: 1458670 - RNA, 12 nt, Homo sapiens
gacucucaggga

SEQ ID NO: 1458671 - RNA, 16 nt, Homo sapiens
gacucuccagccaccc

SEQ ID NO: 1458672 - RNA, 20 nt, Homo sapiens
gacucugguuucucauucuu

SEQ ID NO: 1458673 - RNA, 21 nt, Homo sapiens
gacucuugaaguacuuaacau

SEQ ID NO: 1458674 - RNA, 18 nt, Homo sapiens
gacugacaaccucaucca

SEQ ID NO: 1458675 - RNA, 23 nt, Homo sapiens
gacugauguuacaucacaguguu

SEQ ID NO: 1458676 - RNA, 15 nt, Homo sapiens
gacugcaagcugcuu

SEQ ID NO: 1458677 - RNA, 13 nt, Homo sapiens
gacuggagcucau

SEQ ID NO: 1458678 - RNA, 23 nt, Homo sapiens
gacuguugaugccuuugaguuuu

SEQ ID NO: 1458679 - RNA, 13 nt, Homo sapiens
gacuguugcucaa

SEQ ID NO: 1458680 - RNA, 14 nt, Homo sapiens
gacuuaaugugauu

SEQ ID NO: 1458681 - RNA, 16 nt, Homo sapiens
gacuucagccagguga

SEQ ID NO: 1458682 - RNA, 12 nt, Homo sapiens
gacuucaucugg

SEQ ID NO: 1458683 - RNA, 16 nt, Homo sapiens
gacuucuaccugcccu

SEQ ID NO: 1458684 - RNA, 20 nt, Homo sapiens
gacuuggucugauuucagga

SEQ ID NO: 1458685 - RNA, 15 nt, Homo sapiens
gacuuuaagugaaag

SEQ ID NO: 1458686 - RNA, 23 nt, Homo sapiens
gacuuuagaaauaaauguaccug

SEQ ID NO: 1458687 - RNA, 15 nt, Homo sapiens
gacuuuuaaugucau

SEQ ID NO: 1458688 - RNA, 15 nt, Homo sapiens
gagaaaaugccucaa

SEQ ID NO: 1458689 - RNA, 13 nt, Homo sapiens
gagaaaccagcuu

SEQ ID NO: 1458690 - RNA, 16 nt, Homo sapiens
gagaaagcagccauug

SEQ ID NO: 1458691 - RNA, 15 nt, Homo sapiens
gagaaauacuuucag

SEQ ID NO: 1458692 - RNA, 17 nt, Homo sapiens
gagaaauccuuccuaaa

SEQ ID NO: 1458693 - RNA, 22 nt, Homo sapiens
gagaaauccuuccuaaacccaa

SEQ ID NO: 1458694 - RNA, 19 nt, Homo sapiens
gagaaaugaauaauuuccc

SEQ ID NO: 1458695 - RNA, 20 nt, Homo sapiens
gagaacacguuggcucaguc

SEQ ID NO: 1458696 - RNA, 17 nt, Homo sapiens
gagaacuugaaacagau

SEQ ID NO: 1458697 - RNA, 21 nt, Homo sapiens
gagaagaggcugcugcagaca

SEQ ID NO: 1458698 - RNA, 18 nt, Homo sapiens
gagaagcuccucucccca

SEQ ID NO: 1458699 - RNA, 14 nt, Homo sapiens
gagaagcugcugac

SEQ ID NO: 1458700 - RNA, 13 nt, Homo sapiens
gagaaguauacau

SEQ ID NO: 1458701 - RNA, 14 nt, Homo sapiens
gagacacaucuccu

SEQ ID NO: 1458702 - RNA, 11 nt, Homo sapiens
gagacacucca

SEQ ID NO: 1458703 - RNA, 14 nt, Homo sapiens
gagacagauaacuc

SEQ ID NO: 1458704 - RNA, 18 nt, Homo sapiens
gagacagcgcuaaggaug

SEQ ID NO: 1458705 - RNA, 22 nt, Homo sapiens
gagacagugacuggugccagug

SEQ ID NO: 1458706 - RNA, 23 nt, Homo sapiens
gagacauacuugaagggccagag

SEQ ID NO: 1458707 - RNA, 13 nt, Homo sapiens
gagacaugugaca

SEQ ID NO: 1458708 - RNA, 23 nt, Homo sapiens
gagaccacugaguaccaggggcu

SEQ ID NO: 1458709 - RNA, 18 nt, Homo sapiens
gagacccuuuucucagga

SEQ ID NO: 1458710 - RNA, 14 nt, Homo sapiens
gagggcuaauaucu

SEQ ID NO: 1458711 - RNA, 21 nt, Homo sapiens
gagggcucaccucuugccuuc

SEQ ID NO: 1458712 - RNA, 17 nt, Homo sapiens
gaggggcucucagcuca

SEQ ID NO: 1458713 - RNA, 19 nt, Homo sapiens
gaggguaaauaaaccacug

SEQ ID NO: 1458714 - RNA, 21 nt, Homo sapiens
gagggugaggggcuggcacug

SEQ ID NO: 1458715 - RNA, 17 nt, Homo sapiens
gaggguuggcaccugca

SEQ ID NO: 1458716 - RNA, 22 nt, Homo sapiens
gagguaacgggugccugcugcg

SEQ ID NO: 1458717 - RNA, 15 nt, Homo sapiens
gaggucacaguccac

SEQ ID NO: 1458718 - RNA, 12 nt, Homo sapiens
gaggucacugga

SEQ ID NO: 1458719 - RNA, 13 nt, Homo sapiens
gaggucacuggaa

SEQ ID NO: 1458720 - RNA, 23 nt, Homo sapiens
gaggucaggaguugaagaccagc

SEQ ID NO: 1458721 - RNA, 22 nt, Homo sapiens
gaggucagugcuucgugccucg

SEQ ID NO: 1458722 - RNA, 20 nt, Homo sapiens
gagguggagauugcagugag

SEQ ID NO: 1458723 - RNA, 20 nt, Homo sapiens
gaggugggaggauugcuuga

SEQ ID NO: 1458724 - RNA, 16 nt, Homo sapiens
gaggugucuuaagccu

SEQ ID NO: 1458725 - RNA, 16 nt, Homo sapiens
gagguguuggcuuugu

SEQ ID NO: 1458726 - RNA, 15 nt, Homo sapiens
gaguaaauacaggua

SEQ ID NO: 1458727 - RNA, 17 nt, Homo sapiens
gaguaacaggugccuuc

SEQ ID NO: 1458728 - RNA, 23 nt, Homo sapiens
gaguaaucaauacagacaagguu

SEQ ID NO: 1458729 - RNA, 19 nt, Homo sapiens
gaguaccuacugugugcca

SEQ ID NO: 1458730 - RNA, 15 nt, Homo sapiens
gaguacuccaagaca

SEQ ID NO: 1458731 - RNA, 17 nt, Homo sapiens
gaguagggacucagggc

SEQ ID NO: 1458732 - RNA, 20 nt, Homo sapiens
gaguagggacucagggccau

SEQ ID NO: 1458733 - RNA, 16 nt, Homo sapiens
gaguagggaguucauc

SEQ ID NO: 1458734 - RNA, 18 nt, Homo sapiens
gaguaguauuaaaagcua

SEQ ID NO: 1458735 - RNA, 16 nt, Homo sapiens
gagucaaugugcagug

SEQ ID NO: 1458736 - RNA, 18 nt, Homo sapiens
gagucaaugugcagugua

SEQ ID NO: 1458737 - RNA, 14 nt, Homo sapiens
gagucacacagugu

SEQ ID NO: 1458738 - RNA, 18 nt, Homo sapiens
gagucagucuucacuugc

SEQ ID NO: 1458739 - RNA, 19 nt, Homo sapiens
gagucauccagcucuugcu

SEQ ID NO: 1458740 - RNA, 18 nt, Homo sapiens
gagucauggcuaauuuaa

SEQ ID NO: 1458741 - RNA, 19 nt, Homo sapiens
gagucucagaaacuccccu

SEQ ID NO: 1458742 - RNA, 15 nt, Homo sapiens
gagucugaggccuga

SEQ ID NO: 1458743 - RNA, 18 nt, Homo sapiens
gagucuugcucuguuacc

SEQ ID NO: 1458744 - RNA, 18 nt, Homo sapiens
gagugaaaccaugacugu

SEQ ID NO: 1458745 - RNA, 15 nt, Homo sapiens
gagugaaccuaccuu

SEQ ID NO: 1458746 - RNA, 18 nt, Homo sapiens
gagugacucgaggguugg

SEQ ID NO: 1458747 - RNA, 13 nt, Homo sapiens
gagugagccagug

SEQ ID NO: 1458748 - RNA, 14 nt, Homo sapiens
gagugcucuugcua

SEQ ID NO: 1458749 - RNA, 14 nt, Homo sapiens
gaguggaaggucua

SEQ ID NO: 1458750 - RNA, 16 nt, Homo sapiens
gaguggccagccagug

SEQ ID NO: 1458751 - RNA, 22 nt, Homo sapiens
gaguggccagccagugccauuc

SEQ ID NO: 1458752 - RNA, 16 nt, Homo sapiens
gaguggcccaccgugg

SEQ ID NO: 1458753 - RNA, 17 nt, Homo sapiens
gaguggucgagugacac

SEQ ID NO: 1458754 - RNA, 11 nt, Homo sapiens
gaguggugcca

SEQ ID NO: 1458755 - RNA, 16 nt, Homo sapiens
gaguguagacuguggc

SEQ ID NO: 1458756 - RNA, 15 nt, Homo sapiens
gagugucaagcugac

SEQ ID NO: 1458757 - RNA, 14 nt, Homo sapiens
gaguguccggcuga

SEQ ID NO: 1458758 - RNA, 18 nt, Homo sapiens
gagugugguuaugaacuu

SEQ ID NO: 1458759 - RNA, 16 nt, Homo sapiens
gaguguuauuugcaca

SEQ ID NO: 1458760 - RNA, 21 nt, Homo sapiens
gaguucccucuucuaacccaa

SEQ ID NO: 1458761 - RNA, 17 nt, Homo sapiens
gaguuccuaacaggaug

SEQ ID NO: 1458762 - RNA, 19 nt, Homo sapiens
gaguucgaggcugcaguca

SEQ ID NO: 1458763 - RNA, 19 nt, Homo sapiens
gaguugaucaaaaucaauu

SEQ ID NO: 1458764 - RNA, 22 nt, Homo sapiens
gaguuuaauuuuugaaaacugg

SEQ ID NO: 1458765 - RNA, 14 nt, Homo sapiens
gaguuucgagguag

SEQ ID NO: 1458766 - RNA, 21 nt, Homo sapiens
gaguuugagcugccuucccua

SEQ ID NO: 1458767 - RNA, 23 nt, Homo sapiens
gaguuuuuaguggaagcuucuaa

SEQ ID NO: 1458768 - RNA, 23 nt, Homo sapiens
gauaaaauuacaggauaucacau

SEQ ID NO: 1458769 - RNA, 15 nt, Homo sapiens
gauaaagcacccugu

SEQ ID NO: 1458770 - RNA, 14 nt, Homo sapiens
gauaaaucauuuca

SEQ ID NO: 1458771 - RNA, 19 nt, Homo sapiens
gauaaaucauuucaguauc

SEQ ID NO: 1458772 - RNA, 17 nt, Homo sapiens
gauaaaugacacaauga

SEQ ID NO: 1458773 - RNA, 18 nt, Homo sapiens
gauaacuaggaaauccau

SEQ ID NO: 1458774 - RNA, 16 nt, Homo sapiens
gauaacuuagguggca

SEQ ID NO: 1458775 - RNA, 20 nt, Homo sapiens
gauaagacacccccucaaac

SEQ ID NO: 1458776 - RNA, 17 nt, Homo sapiens
gauaaugauuugcucuu

SEQ ID NO: 1458777 - RNA, 18 nt, Homo sapiens
gauaaugccccaaggaca

SEQ ID NO: 1458778 - RNA, 14 nt, Homo sapiens
gauaauuaaugauu

SEQ ID NO: 1458779 - RNA, 23 nt, Homo sapiens
gauaauuuauuaaaggugguccu

SEQ ID NO: 1458780 - RNA, 14 nt, Homo sapiens
gauacagaucucag

SEQ ID NO: 1458781 - RNA, 14 nt, Homo sapiens
gauacauauacuga

SEQ ID NO: 1458782 - RNA, 12 nt, Homo sapiens
gauacauuucau

SEQ ID NO: 1458783 - RNA, 21 nt, Homo sapiens
gauacccauagcuuccaugag

SEQ ID NO: 1458784 - RNA, 13 nt, Homo sapiens
gauaccugcacug

SEQ ID NO: 1458785 - RNA, 19 nt, Homo sapiens
gauacugaguaaauccaug

SEQ ID NO: 1458786 - RNA, 20 nt, Homo sapiens
gauagauauaugcucugcau

SEQ ID NO: 1458787 - RNA, 20 nt, Homo sapiens
gauagaugcacuuaugcagu

SEQ ID NO: 1458788 - RNA, 12 nt, Homo sapiens
gauagcacuuuc

SEQ ID NO: 1458789 - RNA, 15 nt, Homo sapiens
gauagggaacugggg

SEQ ID NO: 1458790 - RNA, 15 nt, Homo sapiens
gauagucucauucug

SEQ ID NO: 1458791 - RNA, 18 nt, Homo sapiens
gauagucucauucuguca

SEQ ID NO: 1458792 - RNA, 11 nt, Homo sapiens
gauaguguucu

SEQ ID NO: 1458793 - RNA, 22 nt, Homo sapiens
gauauauaaguguacauaugug

SEQ ID NO: 1458794 - RNA, 13 nt, Homo sapiens
gauauaugcucug

SEQ ID NO: 1458795 - RNA, 22 nt, Homo sapiens
gauauaugcucugcauguuaca

SEQ ID NO: 1458796 - RNA, 20 nt, Homo sapiens
gauauauuuaagccuuauaa

SEQ ID NO: 1458797 - RNA, 21 nt, Homo sapiens
gauaucacuuccaugacauaa

SEQ ID NO: 1458798 - RNA, 21 nt, Homo sapiens
gauaucaugccccuguacucc

SEQ ID NO: 1458799 - RNA, 18 nt, Homo sapiens
gauaucugcagggacaga

SEQ ID NO: 1458800 - RNA, 19 nt, Homo sapiens
gauaucugcagggacagag

SEQ ID NO: 1458801 - RNA, 22 nt, Homo sapiens
gauaucugcagggacagagcau

SEQ ID NO: 1458802 - RNA, 15 nt, Homo sapiens
gauaugaaggauuac

SEQ ID NO: 1458803 - RNA, 18 nt, Homo sapiens
gauauuaacaacaauaac

SEQ ID NO: 1458804 - RNA, 18 nt, Homo sapiens
gaucaauaaaaugugauu

SEQ ID NO: 1458805 - RNA, 18 nt, Homo sapiens
gaucacuacaaguauuau

SEQ ID NO: 1458806 - RNA, 21 nt, Homo sapiens
gaucacuggcuggccugagca

SEQ ID NO: 1458807 - RNA, 15 nt, Homo sapiens
gaucagcaucuguga

SEQ ID NO: 1458808 - RNA, 17 nt, Homo sapiens
gaucagcaucugugaug

SEQ ID NO: 1458809 - RNA, 19 nt, Homo sapiens
gaucaguguuguugcucua

SEQ ID NO: 1458810 - RNA, 18 nt, Homo sapiens
gaucaucgccagaggugc

SEQ ID NO: 1458811 - RNA, 22 nt, Homo sapiens
gaucaucgccagaggugcuuca

SEQ ID NO: 1458812 - RNA, 19 nt, Homo sapiens
gauuucugguugauuugua

SEQ ID NO: 1458813 - RNA, 18 nt, Homo sapiens
gauuuggucacacucuca

SEQ ID NO: 1458814 - RNA, 13 nt, Homo sapiens
gauuuggugacca

SEQ ID NO: 1458815 - RNA, 16 nt, Homo sapiens
gauuuguagcacugag

SEQ ID NO: 1458816 - RNA, 18 nt, Homo sapiens
gauuuguaugcucauuga

SEQ ID NO: 1458817 - RNA, 12 nt, Homo sapiens
gauuuguugcca

SEQ ID NO: 1458818 - RNA, 18 nt, Homo sapiens
gauuuuaaaaagucuuca

SEQ ID NO: 1458819 - RNA, 16 nt, Homo sapiens
gauuuuagccaugccu

SEQ ID NO: 1458820 - RNA, 19 nt, Homo sapiens
gauuuuaugaaaugaccuc

SEQ ID NO: 1458821 - RNA, 14 nt, Homo sapiens
gauuuuccuuugua

SEQ ID NO: 1458822 - RNA, 21 nt, Homo sapiens
gauuuuucucaaaguuuugaa

SEQ ID NO: 1458823 - RNA, 19 nt, Homo sapiens
gcaaaaccacuagaacucu

SEQ ID NO: 1458824 - RNA, 16 nt, Homo sapiens
gcaaaaggccucuugu

SEQ ID NO: 1458825 - RNA, 13 nt, Homo sapiens
gcaaaaucacuua

SEQ ID NO: 1458826 - RNA, 23 nt, Homo sapiens
gcaaaaugaguugugaugaauca

SEQ ID NO: 1458827 - RNA, 20 nt, Homo sapiens
gcaaaauuugaugccaggac

SEQ ID NO: 1458828 - RNA, 22 nt, Homo sapiens
gcaaaauuugaugccaggacac

SEQ ID NO: 1458829 - RNA, 12 nt, Homo sapiens
gcaaacaaguug

SEQ ID NO: 1458830 - RNA, 17 nt, Homo sapiens
gcaaacguuucuugaac

SEQ ID NO: 1458831 - RNA, 15 nt, Homo sapiens
gcaaagccaaaaccu

SEQ ID NO: 1458832 - RNA, 14 nt, Homo sapiens
gcaaauaaauauca

SEQ ID NO: 1458833 - RNA, 16 nt, Homo sapiens
gcaaaugacaaaaagc

SEQ ID NO: 1458834 - RNA, 12 nt, Homo sapiens
gcaaaugcauuc

SEQ ID NO: 1458835 - RNA, 14 nt, Homo sapiens
gcaacaaaugaauu

SEQ ID NO: 1458836 - RNA, 15 nt, Homo sapiens
gcaacagagcaagac

SEQ ID NO: 1458837 - RNA, 21 nt, Homo sapiens
gcaacagagcaagacuccauc

SEQ ID NO: 1458838 - RNA, 12 nt, Homo sapiens
gcaacaguuuuu

SEQ ID NO: 1458839 - RNA, 16 nt, Homo sapiens
gcaacucugagaucua

SEQ ID NO: 1458840 - RNA, 23 nt, Homo sapiens
gcaacugggucugacaugaacac

SEQ ID NO: 1458841 - RNA, 15 nt, Homo sapiens
gcaacuguaugaaaa

SEQ ID NO: 1458842 - RNA, 14 nt, Homo sapiens
gcaacuuaauacuc

SEQ ID NO: 1458843 - RNA, 15 nt, Homo sapiens
gcaagaacagugggc

SEQ ID NO: 1458844 - RNA, 16 nt, Homo sapiens
gcaagaccagucacuc

SEQ ID NO: 1458845 - RNA, 17 nt, Homo sapiens
gcaagacuccaucucaa

SEQ ID NO: 1458846 - RNA, 18 nt, Homo sapiens
gcaagcaggaccuggcau

SEQ ID NO: 1458847 - RNA, 21 nt, Homo sapiens
gcaagccagggaugaagaaag

SEQ ID NO: 1458848 - RNA, 18 nt, Homo sapiens
gcaagccugucugagacu

SEQ ID NO: 1458849 - RNA, 17 nt, Homo sapiens
gcaagcguugugcagag

SEQ ID NO: 1458850 - RNA, 15 nt, Homo sapiens
gcaagcucugccucc

SEQ ID NO: 1458851 - RNA, 22 nt, Homo sapiens
gcaagcugcuugcccaagucac

SEQ ID NO: 1458852 - RNA, 18 nt, Homo sapiens
gcaaggccugguguuucu

SEQ ID NO: 1458853 - RNA, 16 nt, Homo sapiens
gcaagucuuccaugac

SEQ ID NO: 1458854 - RNA, 13 nt, Homo sapiens
gcaaguuacucug

SEQ ID NO: 1458855 - RNA, 18 nt, Homo sapiens
gcaauaaaaaucauagua

SEQ ID NO: 1458856 - RNA, 19 nt, Homo sapiens
gcaauaaaucugacccagu

SEQ ID NO: 1458857 - RNA, 19 nt, Homo sapiens
gcaauaaccucaaagugac

SEQ ID NO: 1458858 - RNA, 23 nt, Homo sapiens
gcaaucaaguccuacaagcuaaa

SEQ ID NO: 1458859 - RNA, 22 nt, Homo sapiens
gcaaucacggcucacuguaguc

SEQ ID NO: 1458860 - RNA, 23 nt, Homo sapiens
gcaauccuucccugcucuugcag

SEQ ID NO: 1458861 - RNA, 16 nt, Homo sapiens
gcaaucucagaugcag

SEQ ID NO: 1458862 - RNA, 14 nt, Homo sapiens
gcaaucuuugccuu

SEQ ID NO: 1458863 - RNA, 21 nt, Homo sapiens
gcaauugaauuaaauuaggaa

SEQ ID NO: 1458864 - RNA, 22 nt, Homo sapiens
gcaauuucauaugcuguauauc

SEQ ID NO: 1458865 - RNA, 17 nt, Homo sapiens
gcaauuuuguguaaauu

SEQ ID NO: 1458866 - RNA, 14 nt, Homo sapiens
gcacaagccacaag

SEQ ID NO: 1458867 - RNA, 20 nt, Homo sapiens
gcacaauggcucacaccugu

SEQ ID NO: 1458868 - RNA, 22 nt, Homo sapiens
gcacaauuuuaauucaaaagau

SEQ ID NO: 1458869 - RNA, 17 nt, Homo sapiens
gcacacaccuccgagac

SEQ ID NO: 1458870 - RNA, 14 nt, Homo sapiens
gcacacagggcagu

SEQ ID NO: 1458871 - RNA, 14 nt, Homo sapiens
gcacacugcacugu

SEQ ID NO: 1458872 - RNA, 11 nt, Homo sapiens
gcacacuuugc

SEQ ID NO: 1458873 - RNA, 17 nt, Homo sapiens
gcacagaaauuuucaau

SEQ ID NO: 1458874 - RNA, 18 nt, Homo sapiens
gcacagaaggaaucugug

SEQ ID NO: 1458875 - RNA, 19 nt, Homo sapiens
gcacagaaggaaucugugc

SEQ ID NO: 1458876 - RNA, 11 nt, Homo sapiens
gcacagaauuu

SEQ ID NO: 1458877 - RNA, 16 nt, Homo sapiens
gcacagaauuugucag

SEQ ID NO: 1458878 - RNA, 13 nt, Homo sapiens
gcacagaggucag

SEQ ID NO: 1458879 - RNA, 21 nt, Homo sapiens
gcacagcugaguuaugaugua

SEQ ID NO: 1458880 - RNA, 22 nt, Homo sapiens
gcacaggaguguccucuucccu

SEQ ID NO: 1458881 - RNA, 16 nt, Homo sapiens
gcacagggcaccagag

SEQ ID NO: 1458882 - RNA, 20 nt, Homo sapiens
gcacaguaucuuuucuuuca

SEQ ID NO: 1458883 - RNA, 18 nt, Homo sapiens
gcacaguugccacauuua

SEQ ID NO: 1458884 - RNA, 13 nt, Homo sapiens
gcacauaacaugc

SEQ ID NO: 1458885 - RNA, 12 nt, Homo sapiens
gcacaucaggag

SEQ ID NO: 1458886 - RNA, 22 nt, Homo sapiens
gcacauugaaagagaaccaguu

SEQ ID NO: 1458887 - RNA, 21 nt, Homo sapiens
gcacauuuaaggcgccauugc

SEQ ID NO: 1458888 - RNA, 15 nt, Homo sapiens
gcacauuucuuugca

SEQ ID NO: 1458889 - RNA, 17 nt, Homo sapiens
gcacauuuggacauuuc

SEQ ID NO: 1458890 - RNA, 21 nt, Homo sapiens
gcaccaaugcccagcagggga

SEQ ID NO: 1458891 - RNA, 14 nt, Homo sapiens
gcaccacccuaguc

SEQ ID NO: 1458892 - RNA, 20 nt, Homo sapiens
gcaccacugcucuccagccu

SEQ ID NO: 1458893 - RNA, 14 nt, Homo sapiens
gcaccagugugaca

SEQ ID NO: 1458894 - RNA, 16 nt, Homo sapiens
gcaccaucuggaagga

SEQ ID NO: 1458895 - RNA, 22 nt, Homo sapiens
gcacccaacuacugagcugaga

SEQ ID NO: 1458896 - RNA, 22 nt, Homo sapiens
gcacccaggacuuccauuugcu

SEQ ID NO: 1458897 - RNA, 13 nt, Homo sapiens
gcacccaucugca

SEQ ID NO: 1458898 - RNA, 20 nt, Homo sapiens
gcacccccugcuccaccagc

SEQ ID NO: 1458899 - RNA, 19 nt, Homo sapiens
gcacccuaguucuaccuca

SEQ ID NO: 1458900 - RNA, 16 nt, Homo sapiens
gcacccuggacaaaga

SEQ ID NO: 1458901 - RNA, 21 nt, Homo sapiens
gcacccuguaucacagacugg

SEQ ID NO: 1458902 - RNA, 18 nt, Homo sapiens
gcaccgcuucucagccac

SEQ ID NO: 1458903 - RNA, 14 nt, Homo sapiens
gcaccgucauggcu

SEQ ID NO: 1458904 - RNA, 21 nt, Homo sapiens
gcaccuaauccaggcagaucc

SEQ ID NO: 1458905 - RNA, 17 nt, Homo sapiens
gcaccuccagccugaac

SEQ ID NO: 1458906 - RNA, 13 nt, Homo sapiens
gcaccucuuccuu

SEQ ID NO: 1458907 - RNA, 17 nt, Homo sapiens
gcaccugcaugugcugu

SEQ ID NO: 1458908 - RNA, 19 nt, Homo sapiens
gcaccugcaugugcuguca

SEQ ID NO: 1458909 - RNA, 12 nt, Homo sapiens
gcaccugugcag

SEQ ID NO: 1458910 - RNA, 17 nt, Homo sapiens
gcaccuuugcacaggau

SEQ ID NO: 1458911 - RNA, 12 nt, Homo sapiens
gcacgcacacac

SEQ ID NO: 1458912 - RNA, 18 nt, Homo sapiens
gcacgguggcucaggccu

SEQ ID NO: 1458913 - RNA, 22 nt, Homo sapiens
gcacguggccucuugagcagug

SEQ ID NO: 1458914 - RNA, 12 nt, Homo sapiens
gcacgugucuca

SEQ ID NO: 1458915 - RNA, 23 nt, Homo sapiens
uaaauaguauuugagaguucuaa

SEQ ID NO: 1458916 - RNA, 17 nt, Homo sapiens
uaaauaucacaguauua

SEQ ID NO: 1458917 - RNA, 16 nt, Homo sapiens
uaaauaugcagugaua

SEQ ID NO: 1458918 - RNA, 16 nt, Homo sapiens
uaaauccaugcaccua

SEQ ID NO: 1458919 - RNA, 20 nt, Homo sapiens
uaaauccucauguuacucag

SEQ ID NO: 1458920 - RNA, 22 nt, Homo sapiens
uaaaucugaguauauauuuaca

SEQ ID NO: 1458921 - RNA, 13 nt, Homo sapiens
uaaaucugccaca

SEQ ID NO: 1458922 - RNA, 21 nt, Homo sapiens
uaaaucuguucugggcucuuu

SEQ ID NO: 1458923 - RNA, 18 nt, Homo sapiens
uaaaucuuccuugugagg

SEQ ID NO: 1458924 - RNA, 11 nt, Homo sapiens
uaaaugaacua

SEQ ID NO: 1458925 - RNA, 15 nt, Homo sapiens
uaaaugaucacucca

SEQ ID NO: 1458926 - RNA, 21 nt, Homo sapiens
uaaaugauucuuagugacuuu

SEQ ID NO: 1458927 - RNA, 12 nt, Homo sapiens
uaaaugcauugg

SEQ ID NO: 1458928 - RNA, 22 nt, Homo sapiens
uaaauguagcaauggcacuguu

SEQ ID NO: 1458929 - RNA, 21 nt, Homo sapiens
uaaauguauacuauaguacca

SEQ ID NO: 1458930 - RNA, 19 nt, Homo sapiens
uaaauguaucuuauucaca

SEQ ID NO: 1458931 - RNA, 22 nt, Homo sapiens
uaaauguauuuaauuaaaucuc

SEQ ID NO: 1458932 - RNA, 14 nt, Homo sapiens
uaaaugugaacuua

SEQ ID NO: 1458933 - RNA, 13 nt, Homo sapiens
uaaaugugcuuug

SEQ ID NO: 1458934 - RNA, 13 nt, Homo sapiens
uaaauuaagcaug

SEQ ID NO: 1458935 - RNA, 18 nt, Homo sapiens
uaaauuauuugcuaagca

SEQ ID NO: 1458936 - RNA, 20 nt, Homo sapiens
uaaauucuauaggaacauau

SEQ ID NO: 1458937 - RNA, 16 nt, Homo sapiens
uaaauuguaccaucau

SEQ ID NO: 1458938 - RNA, 22 nt, Homo sapiens
uaaauuuaaagauauuguucaa

SEQ ID NO: 1458939 - RNA, 20 nt, Homo sapiens
uaaauuuguaaguuucaggu

SEQ ID NO: 1458940 - RNA, 21 nt, Homo sapiens
uaaauuuuauaacagaauuaa

SEQ ID NO: 1458941 - RNA, 13 nt, Homo sapiens
uaacaacuguggu

SEQ ID NO: 1458942 - RNA, 20 nt, Homo sapiens
uaacaccaucgaucaugaug

SEQ ID NO: 1458943 - RNA, 21 nt, Homo sapiens
uaacacccuuuagaaccuuaa

SEQ ID NO: 1458944 - RNA, 23 nt, Homo sapiens
uaacagaaagccugggugacauu

SEQ ID NO: 1458945 - RNA, 19 nt, Homo sapiens
uaacagaacagcuucaggu

SEQ ID NO: 1458946 - RNA, 15 nt, Homo sapiens
uaacagaauacauag

SEQ ID NO: 1458947 - RNA, 19 nt, Homo sapiens
uaacagaauuaaaguagau

SEQ ID NO: 1458948 - RNA, 15 nt, Homo sapiens
uaacagaugcaaugu

SEQ ID NO: 1458949 - RNA, 22 nt, Homo sapiens
uaacaggcucaauauuccugaa

SEQ ID NO: 1458950 - RNA, 17 nt, Homo sapiens
uaacaguuuuccaugaa

SEQ ID NO: 1458951 - RNA, 15 nt, Homo sapiens
uaacauaaugcacuu

SEQ ID NO: 1458952 - RNA, 22 nt, Homo sapiens
uaacaucuaaaaauagacuuaa

SEQ ID NO: 1458953 - RNA, 16 nt, Homo sapiens
uaacaucuguuaucaa

SEQ ID NO: 1458954 - RNA, 23 nt, Homo sapiens
uaacauggugaaaccccgucucu

SEQ ID NO: 1458955 - RNA, 13 nt, Homo sapiens
uaaccacagcucc

SEQ ID NO: 1458956 - RNA, 20 nt, Homo sapiens
uaaccagacacaaacugcca

SEQ ID NO: 1458957 - RNA, 20 nt, Homo sapiens
uaacccgcucaucacuggau

SEQ ID NO: 1458958 - RNA, 15 nt, Homo sapiens
uaacccucacccaca

SEQ ID NO: 1458959 - RNA, 17 nt, Homo sapiens
uaaccgcacaugcacac

SEQ ID NO: 1458960 - RNA, 20 nt, Homo sapiens
uaaccgcuugguuugcaacc

SEQ ID NO: 1458961 - RNA, 14 nt, Homo sapiens
uaaccucaguguca

SEQ ID NO: 1458962 - RNA, 19 nt, Homo sapiens
uaaccucagugucauuuau

SEQ ID NO: 1458963 - RNA, 18 nt, Homo sapiens
uaaccucugcacuacuga

SEQ ID NO: 1458964 - RNA, 12 nt, Homo sapiens
uaaccuggugcu

SEQ ID NO: 1458965 - RNA, 17 nt, Homo sapiens
uaaccuugaaugcugcc

SEQ ID NO: 1458966 - RNA, 18 nt, Homo sapiens
uaacgccagcacacuauu

SEQ ID NO: 1458967 - RNA, 14 nt, Homo sapiens
uaacguggcacugg

SEQ ID NO: 1458968 - RNA, 15 nt, Homo sapiens
uaacuaaucaagaaa

SEQ ID NO: 1458969 - RNA, 17 nt, Homo sapiens
uaacuagaauuuauuca

SEQ ID NO: 1458970 - RNA, 22 nt, Homo sapiens
uaacuaggcucagagaugugca

SEQ ID NO: 1458971 - RNA, 15 nt, Homo sapiens
uaacuauauuugcuu

SEQ ID NO: 1458972 - RNA, 18 nt, Homo sapiens
uaacucaccucucaaggu

SEQ ID NO: 1458973 - RNA, 15 nt, Homo sapiens
uaacucagaauuauu

SEQ ID NO: 1458974 - RNA, 13 nt, Homo sapiens
uaacugacagcuu

SEQ ID NO: 1458975 - RNA, 17 nt, Homo sapiens
uaacugcagaguaaauu

SEQ ID NO: 1458976 - RNA, 21 nt, Homo sapiens
uaacugcuuucuguuccaaau

SEQ ID NO: 1458977 - RNA, 12 nt, Homo sapiens
uaacugugcuga

SEQ ID NO: 1458978 - RNA, 12 nt, Homo sapiens
uaacuuagcuug

SEQ ID NO: 1458979 - RNA, 14 nt, Homo sapiens
uaacuucacauuaa

SEQ ID NO: 1458980 - RNA, 22 nt, Homo sapiens
uaacuuguuugguaguuagcca

SEQ ID NO: 1458981 - RNA, 16 nt, Homo sapiens
uaacuuuaaguuucag

SEQ ID NO: 1458982 - RNA, 16 nt, Homo sapiens
uaacuuugacuuucuu

SEQ ID NO: 1458983 - RNA, 18 nt, Homo sapiens
uaagaaaaaaacuugucu

SEQ ID NO: 1458984 - RNA, 20 nt, Homo sapiens
uaagaaaauacaauaaacua

SEQ ID NO: 1458985 - RNA, 13 nt, Homo sapiens
uaagaaacauaac

SEQ ID NO: 1458986 - RNA, 17 nt, Homo sapiens
uaagaaauaugugagau

SEQ ID NO: 1458987 - RNA, 18 nt, Homo sapiens
uaagaagagacugggaag

SEQ ID NO: 1458988 - RNA, 19 nt, Homo sapiens
uaagaauucaaacuggggc

SEQ ID NO: 1458989 - RNA, 20 nt, Homo sapiens
uaagaauuguuuuugaauuu

SEQ ID NO: 1458990 - RNA, 14 nt, Homo sapiens
uaagaauuucacaa

SEQ ID NO: 1458991 - RNA, 20 nt, Homo sapiens
uaagaauuucacaagcuauu

SEQ ID NO: 1458992 - RNA, 19 nt, Homo sapiens
uaagaauuuuucagcacuu

SEQ ID NO: 1458993 - RNA, 21 nt, Homo sapiens
uaagacaugauuuccuugaau

SEQ ID NO: 1458994 - RNA, 14 nt, Homo sapiens
uaagagaugggacu

SEQ ID NO: 1458995 - RNA, 21 nt, Homo sapiens
uaagaggauagaauacaugga

SEQ ID NO: 1458996 - RNA, 20 nt, Homo sapiens
uaagauauucagaaguauau

SEQ ID NO: 1458997 - RNA, 19 nt, Homo sapiens
uaagauccacaaaugaagg

SEQ ID NO: 1458998 - RNA, 14 nt, Homo sapiens
uaagauuuugcacc

SEQ ID NO: 1458999 - RNA, 20 nt, Homo sapiens
uaagcaccaggacgcccucg

SEQ ID NO: 1459000 - RNA, 14 nt, Homo sapiens
uaagcagaggaaua

SEQ ID NO: 1459001 - RNA, 20 nt, Homo sapiens
uaagcauuaccacucaggca

SEQ ID NO: 1459002 - RNA, 14 nt, Homo sapiens
uaagccacucuucc

SEQ ID NO: 1459003 - RNA, 19 nt, Homo sapiens
uaagccauaggcccaggau

SEQ ID NO: 1459004 - RNA, 20 nt, Homo sapiens
uaagcccggauagacuuauu

SEQ ID NO: 1459005 - RNA, 15 nt, Homo sapiens
uaaggacauuuccca

SEQ ID NO: 1459006 - RNA, 17 nt, Homo sapiens
uaaggacguguguaaau

SEQ ID NO: 1459007 - RNA, 16 nt, Homo sapiens
uaaggaugucacaggg

SEQ ID NO: 1459008 - RNA, 18 nt, Homo sapiens
uaaggaugucacagggcc

SEQ ID NO: 1459009 - RNA, 14 nt, Homo sapiens
uaaggauguugcca

SEQ ID NO: 1459010 - RNA, 21 nt, Homo sapiens
uaagggcuggucucugcugaa

SEQ ID NO: 1459011 - RNA, 20 nt, Homo sapiens
uaagguacuuaaagcuucua

SEQ ID NO: 1459012 - RNA, 21 nt, Homo sapiens
uaaggucaaacuaauucucac

SEQ ID NO: 1459013 - RNA, 20 nt, Homo sapiens
uaaggucacauugugccuuu

SEQ ID NO: 1459014 - RNA, 12 nt, Homo sapiens
uaaggugcaguu

SEQ ID NO: 1459015 - RNA, 18 nt, Homo sapiens
uaaguaaguuugauuuca

SEQ ID NO: 1459016 - RNA, 23 nt, Homo sapiens
uaaguacuagaugcaucacuggg

SEQ ID NO: 1459017 - RNA, 23 nt, Homo sapiens
uaaguacuauguaucaaugagua

SEQ ID NO: 1459018 - RNA, 11 nt, Homo sapiens
uaagugauaua

SEQ ID NO: 1459019 - RNA, 19 nt, Homo sapiens
uaagugauuuguaugucua

SEQ ID NO: 1459020 - RNA, 14 nt, Homo sapiens
uaagugcugcuaua

SEQ ID NO: 1459021 - RNA, 21 nt, Homo sapiens
uaaguucuaugaagaguauua

SEQ ID NO: 1459022 - RNA, 16 nt, Homo sapiens
uaaguucuuaugagga

SEQ ID NO: 1459023 - RNA, 23 nt, Homo sapiens
uaaguuguagaaauuaacaaaug

SEQ ID NO: 1459024 - RNA, 23 nt, Homo sapiens
uaaguuucaggauacaugugccg

SEQ ID NO: 1459025 - RNA, 19 nt, Homo sapiens
uaauaaagaaauauuuacc

SEQ ID NO: 1459026 - RNA, 16 nt, Homo sapiens
uaauaaagacacuggc

SEQ ID NO: 1459027 - RNA, 15 nt, Homo sapiens
uaauaaaguauauaa

SEQ ID NO: 1459028 - RNA, 24 nt, Homo sapiens
uaauaaaucucuucuuugcugcag

SEQ ID NO: 1459029 - RNA, 21 nt, Homo sapiens
uaauaacugugaaguuuacau

SEQ ID NO: 1459030 - RNA, 22 nt, Homo sapiens
uaauaagagaauguuccuacuc

SEQ ID NO: 1459031 - RNA, 15 nt, Homo sapiens
uaauacagggcauuu

SEQ ID NO: 1459032 - RNA, 15 nt, Homo sapiens
uaauacaugauugca

SEQ ID NO: 1459033 - RNA, 23 nt, Homo sapiens
uaauacuacccauagaaaacuug

SEQ ID NO: 1459034 - RNA, 14 nt, Homo sapiens
uaauacugaaggac

SEQ ID NO: 1459035 - RNA, 20 nt, Homo sapiens
uaauacugaaggacacagca

SEQ ID NO: 1459036 - RNA, 12 nt, Homo sapiens
uaauacuggaau

SEQ ID NO: 1459037 - RNA, 18 nt, Homo sapiens
uaauacuugaugcaugca

SEQ ID NO: 1459038 - RNA, 12 nt, Homo sapiens
uaauauacuuua

SEQ ID NO: 1459039 - RNA, 17 nt, Homo sapiens
uaauauaguuauugcac

SEQ ID NO: 1459040 - RNA, 14 nt, Homo sapiens
uaauaucaugugca

SEQ ID NO: 1459041 - RNA, 18 nt, Homo sapiens
uaauaucccuacauguau

SEQ ID NO: 1459042 - RNA, 20 nt, Homo sapiens
uaauaucugugaggugcuga

SEQ ID NO: 1459043 - RNA, 20 nt, Homo sapiens
uaauaugaguaauacaucaa

SEQ ID NO: 1459044 - RNA, 22 nt, Homo sapiens
uaaucaaaauugucucuucuga

SEQ ID NO: 1459045 - RNA, 16 nt, Homo sapiens
uaaucacucuaauuaa

SEQ ID NO: 1459046 - RNA, 16 nt, Homo sapiens
uaaucauccccauccu

SEQ ID NO: 1459047 - RNA, 19 nt, Homo sapiens
uaaucccaacacuuugaga

SEQ ID NO: 1459048 - RNA, 20 nt, Homo sapiens
uaaucccagcuacuugggag

SEQ ID NO: 1459049 - RNA, 18 nt, Homo sapiens
uaauccuuaacacauuca

SEQ ID NO: 1459050 - RNA, 20 nt, Homo sapiens
uaauccuucucauuacccac

SEQ ID NO: 1459051 - RNA, 14 nt, Homo sapiens
uaaucuaugaauuc

SEQ ID NO: 1459052 - RNA, 14 nt, Homo sapiens
uaaucucagcacuu

SEQ ID NO: 1459053 - RNA, 17 nt, Homo sapiens
uaaucucucugcagcug

SEQ ID NO: 1459054 - RNA, 14 nt, Homo sapiens
uaaucugaaauucu

SEQ ID NO: 1459055 - RNA, 15 nt, Homo sapiens
uaaucugauguuaac

SEQ ID NO: 1459056 - RNA, 18 nt, Homo sapiens
uaaucuggaauaugcaac

SEQ ID NO: 1459057 - RNA, 16 nt, Homo sapiens
uaaucuguaagcauaa

SEQ ID NO: 1459058 - RNA, 16 nt, Homo sapiens
uaaucuguguguauau

SEQ ID NO: 1459059 - RNA, 19 nt, Homo sapiens
uaaucuuccauacuucuuc

SEQ ID NO: 1459060 - RNA, 15 nt, Homo sapiens
uaaugaaaaugaaua

SEQ ID NO: 1459061 - RNA, 22 nt, Homo sapiens
uaaugaaagacuguacaaagua

SEQ ID NO: 1459062 - RNA, 16 nt, Homo sapiens
uaaugaauacauuucc

SEQ ID NO: 1459063 - RNA, 12 nt, Homo sapiens
uaaugacucucu

SEQ ID NO: 1459064 - RNA, 16 nt, Homo sapiens
uaaugagggugugaga

SEQ ID NO: 1459065 - RNA, 22 nt, Homo sapiens
uaaugauaaaaauaaugcauuu

SEQ ID NO: 1459066 - RNA, 21 nt, Homo sapiens
uaaugauacauguuuccaauu

SEQ ID NO: 1459067 - RNA, 12 nt, Homo sapiens
uaaugcuuuuau

SEQ ID NO: 1459068 - RNA, 19 nt, Homo sapiens
uaauggguaugcucagguc

SEQ ID NO: 1459069 - RNA, 18 nt, Homo sapiens
uaauguacacauugcauu

SEQ ID NO: 1459070 - RNA, 22 nt, Homo sapiens
uaaugucauagguaagaaacac

SEQ ID NO: 1459071 - RNA, 14 nt, Homo sapiens
uaaugucucacugu

SEQ ID NO: 1459072 - RNA, 23 nt, Homo sapiens
uaaugugaaguagaauccuaaau

SEQ ID NO: 1459073 - RNA, 19 nt, Homo sapiens
uaaugugugguggccucag

SEQ ID NO: 1459074 - RNA, 15 nt, Homo sapiens
uaauguuaauucagc

SEQ ID NO: 1459075 - RNA, 22 nt, Homo sapiens
uaauguuguaauucaugccagg

SEQ ID NO: 1459076 - RNA, 18 nt, Homo sapiens
uaauguuuaauauugaga

SEQ ID NO: 1459077 - RNA, 23 nt, Homo sapiens
uaauuaaauuuugaguucuacau

SEQ ID NO: 1459078 - RNA, 20 nt, Homo sapiens
uaauuaaugucaguauuuca

SEQ ID NO: 1459079 - RNA, 13 nt, Homo sapiens
uaauuacaccaua

SEQ ID NO: 1459080 - RNA, 20 nt, Homo sapiens
uaauuacuuauuguauuuau

SEQ ID NO: 1459081 - RNA, 19 nt, Homo sapiens
uaauuaguaagcuagcaaa

SEQ ID NO: 1459082 - RNA, 21 nt, Homo sapiens
uaauuaucggaagcagugccu

SEQ ID NO: 1459083 - RNA, 16 nt, Homo sapiens
uaauucaaaagaucaa

SEQ ID NO: 1459084 - RNA, 14 nt, Homo sapiens
uaauucagcacuua

SEQ ID NO: 1459085 - RNA, 14 nt, Homo sapiens
uaauucaugauuca

SEQ ID NO: 1459086 - RNA, 18 nt, Homo sapiens
uaauuccagucauuuugg

SEQ ID NO: 1459087 - RNA, 15 nt, Homo sapiens
uaauucuagcacuuu

SEQ ID NO: 1459088 - RNA, 14 nt, Homo sapiens
uaauucucuuucaa

SEQ ID NO: 1459089 - RNA, 17 nt, Homo sapiens
uaauugaccuacuuugg

SEQ ID NO: 1459090 - RNA, 14 nt, Homo sapiens
uaauugcuugacaa

SEQ ID NO: 1459091 - RNA, 16 nt, Homo sapiens
uaauuuacagcuuuca

SEQ ID NO: 1459092 - RNA, 16 nt, Homo sapiens
uaauuuauuuugucca

SEQ ID NO: 1459093 - RNA, 17 nt, Homo sapiens
uaauuucaggaauugaa

SEQ ID NO: 1459094 - RNA, 21 nt, Homo sapiens
uaauuucugaaaugugcagcu

SEQ ID NO: 1459095 - RNA, 23 nt, Homo sapiens
uaauuugaaugugguuacuuccu

SEQ ID NO: 1459096 - RNA, 15 nt, Homo sapiens
uaauuuuggauuuug

SEQ ID NO: 1459097 - RNA, 22 nt, Homo sapiens
uaauuuuuccuauauugcauua

SEQ ID NO: 1459098 - RNA, 20 nt, Homo sapiens
uacaaaaauuagcugggcau

SEQ ID NO: 1459099 - RNA, 17 nt, Homo sapiens
uacaaaaauuagcugug

SEQ ID NO: 1459100 - RNA, 18 nt, Homo sapiens
uacaaaacuuccaggcua

SEQ ID NO: 1459101 - RNA, 16 nt, Homo sapiens
uacaacauuaaggaau

SEQ ID NO: 1459102 - RNA, 15 nt, Homo sapiens
uacaaccaauuccaa

SEQ ID NO: 1459103 - RNA, 11 nt, Homo sapiens
uacaaccagag

SEQ ID NO: 1459104 - RNA, 19 nt, Homo sapiens
uacaacucuauuuaauuaa

SEQ ID NO: 1459105 - RNA, 15 nt, Homo sapiens
uacaacugauugcaa

SEQ ID NO: 1459106 - RNA, 13 nt, Homo sapiens
uacaagcaggcac

SEQ ID NO: 1459107 - RNA, 19 nt, Homo sapiens
uacaaggcuuuaucucagg

SEQ ID NO: 1459108 - RNA, 20 nt, Homo sapiens
uacaaggcuuuaucucaggg

SEQ ID NO: 1459109 - RNA, 21 nt, Homo sapiens
uacaauaaaacuuugcugcca

SEQ ID NO: 1459110 - RNA, 23 nt, Homo sapiens
uacaauaggugcuuauucucaaa

SEQ ID NO: 1459111 - RNA, 19 nt, Homo sapiens
uacaaucaaggccacugcu

SEQ ID NO: 1459112 - RNA, 20 nt, Homo sapiens
uacaaucagccacauucuag

SEQ ID NO: 1459113 - RNA, 23 nt, Homo sapiens
uacaaucaggagugguggaaccu

SEQ ID NO: 1459114 - RNA, 17 nt, Homo sapiens
uacaauuaauaguuugu

SEQ ID NO: 1459115 - RNA, 13 nt, Homo sapiens
uacaauugugagc

SEQ ID NO: 1459116 - RNA, 15 nt, Homo sapiens
uacacaaggaaggca

SEQ ID NO: 1459117 - RNA, 17 nt, Homo sapiens
uacacaaggaaggcauu

SEQ ID NO: 1459118 - RNA, 15 nt, Homo sapiens
uacacacgugagcaa

SEQ ID NO: 1459119 - RNA, 15 nt, Homo sapiens
uacugcuuaauucaa

SEQ ID NO: 1459120 - RNA, 12 nt, Homo sapiens
uacugcuucauu

SEQ ID NO: 1459121 - RNA, 17 nt, Homo sapiens
uacugcuugaccaaaga

SEQ ID NO: 1459122 - RNA, 18 nt, Homo sapiens
uacugcuugaccaaagag

SEQ ID NO: 1459123 - RNA, 14 nt, Homo sapiens
uacuggguucuuag

SEQ ID NO: 1459124 - RNA, 15 nt, Homo sapiens
uacuuaaagcuucua

SEQ ID NO: 1459125 - RNA, 14 nt, Homo sapiens
uacuuacuccccac

SEQ ID NO: 1459126 - RNA, 21 nt, Homo sapiens
uacuuauguugcacaaugaga

SEQ ID NO: 1459127 - RNA, 17 nt, Homo sapiens
uacuuauucuagauuac

SEQ ID NO: 1459128 - RNA, 22 nt, Homo sapiens
uacuucaacacuucauguauug

SEQ ID NO: 1459129 - RNA, 17 nt, Homo sapiens
uacuucauggacuucca

SEQ ID NO: 1459130 - RNA, 11 nt, Homo sapiens
uacuucauuaa

SEQ ID NO: 1459131 - RNA, 15 nt, Homo sapiens
uacuuccuacuguag

SEQ ID NO: 1459132 - RNA, 23 nt, Homo sapiens
uacuucucacuaauuuguaggaa

SEQ ID NO: 1459133 - RNA, 20 nt, Homo sapiens
uacuucuggaagucaucuca

SEQ ID NO: 1459134 - RNA, 20 nt, Homo sapiens
uacuugagaggcugaggcaa

SEQ ID NO: 1459135 - RNA, 23 nt, Homo sapiens
uacuugagugguguguguuauca

SEQ ID NO: 1459136 - RNA, 20 nt, Homo sapiens
uacuugggaggcugaggcag

SEQ ID NO: 1459137 - RNA, 20 nt, Homo sapiens
uacuuggucuggccacuguc

SEQ ID NO: 1459138 - RNA, 22 nt, Homo sapiens
uacuuuauuucugaucuauaca

SEQ ID NO: 1459139 - RNA, 16 nt, Homo sapiens
uacuuucuaugugaca

SEQ ID NO: 1459140 - RNA, 19 nt, Homo sapiens
uacuuugaguuagugccau

SEQ ID NO: 1459141 - RNA, 17 nt, Homo sapiens
uacuuuuaaacuuugau

SEQ ID NO: 1459142 - RNA, 22 nt, Homo sapiens
uacuuuuucugguguguuaaca

SEQ ID NO: 1459143 - RNA, 22 nt, Homo sapiens
uacuuuuuucuuauuuaacuua

SEQ ID NO: 1459144 - RNA, 21 nt, Homo sapiens
uagaaaaggcagcuaaaggaa

SEQ ID NO: 1459145 - RNA, 23 nt, Homo sapiens
uagaaaaugacuuauuucugcuc

SEQ ID NO: 1459146 - RNA, 15 nt, Homo sapiens
uagaaaaugguccaa

SEQ ID NO: 1459147 - RNA, 20 nt, Homo sapiens
uagaaacucaggauggucau

SEQ ID NO: 1459148 - RNA, 11 nt, Homo sapiens
uagaaaugcaa

SEQ ID NO: 1459149 - RNA, 17 nt, Homo sapiens
uagaacguaaccacgga

SEQ ID NO: 1459150 - RNA, 21 nt, Homo sapiens
uagaacuaucugcauuaucua

SEQ ID NO: 1459151 - RNA, 23 nt, Homo sapiens
uagaacucugggcugccauguga

SEQ ID NO: 1459152 - RNA, 17 nt, Homo sapiens
uagaagacaacaggcau

SEQ ID NO: 1459153 - RNA, 14 nt, Homo sapiens
uagaagacugucag

SEQ ID NO: 1459154 - RNA, 18 nt, Homo sapiens
uagaagauagaugcacuu

SEQ ID NO: 1459155 - RNA, 11 nt, Homo sapiens
uagaagccaag

SEQ ID NO: 1459156 - RNA, 23 nt, Homo sapiens
uagaagccugcagaauccagcua

SEQ ID NO: 1459157 - RNA, 22 nt, Homo sapiens
uagaaguuaaugauuuuacuua

SEQ ID NO: 1459158 - RNA, 23 nt, Homo sapiens
uagaauaaauucccaacuucucu

SEQ ID NO: 1459159 - RNA, 19 nt, Homo sapiens
uagaauuauaagucacaaa

SEQ ID NO: 1459160 - RNA, 18 nt, Homo sapiens
uagaauuaucaagcuuuu

SEQ ID NO: 1459161 - RNA, 12 nt, Homo sapiens
uagaauugcauu

SEQ ID NO: 1459162 - RNA, 18 nt, Homo sapiens
uagacaaauagaaaaugg

SEQ ID NO: 1459163 - RNA, 20 nt, Homo sapiens
uagacugcaguggacagucc

SEQ ID NO: 1459164 - RNA, 15 nt, Homo sapiens
uagacuuaaaucuca

SEQ ID NO: 1459165 - RNA, 22 nt, Homo sapiens
uagacuugccaacaccacagaa

SEQ ID NO: 1459166 - RNA, 12 nt, Homo sapiens
uagagaagcaag

SEQ ID NO: 1459167 - RNA, 15 nt, Homo sapiens
uagagaauuuccuua

SEQ ID NO: 1459168 - RNA, 16 nt, Homo sapiens
uagagacgggauuucc

SEQ ID NO: 1459169 - RNA, 14 nt, Homo sapiens
uagagacuguagau

SEQ ID NO: 1459170 - RNA, 15 nt, Homo sapiens
uagagacuguagauu

SEQ ID NO: 1459171 - RNA, 14 nt, Homo sapiens
uagagagagacuau

SEQ ID NO: 1459172 - RNA, 18 nt, Homo sapiens
uagagauagcuacagugu

SEQ ID NO: 1459173 - RNA, 20 nt, Homo sapiens
uagagauagcuacaguguaa

SEQ ID NO: 1459174 - RNA, 19 nt, Homo sapiens
uagagcagccacaaccaaa

SEQ ID NO: 1459175 - RNA, 18 nt, Homo sapiens
uagagcucuauuucucua

SEQ ID NO: 1459176 - RNA, 16 nt, Homo sapiens
uagagcugcagggugg

SEQ ID NO: 1459177 - RNA, 15 nt, Homo sapiens
uagagggggucucag

SEQ ID NO: 1459178 - RNA, 16 nt, Homo sapiens
uagagugucucagggu

SEQ ID NO: 1459179 - RNA, 15 nt, Homo sapiens
uagaguuccauauau

SEQ ID NO: 1459180 - RNA, 23 nt, Homo sapiens
uagauaaccuguacuucaaguua

SEQ ID NO: 1459181 - RNA, 14 nt, Homo sapiens
uagauauacauauc

SEQ ID NO: 1459182 - RNA, 14 nt, Homo sapiens
uagauauaugccuu

SEQ ID NO: 1459183 - RNA, 21 nt, Homo sapiens
uagauauugugaaguacauau

SEQ ID NO: 1459184 - RNA, 16 nt, Homo sapiens
uagaucagaagacuac

SEQ ID NO: 1459185 - RNA, 13 nt, Homo sapiens
uagaucuuucuag

SEQ ID NO: 1459186 - RNA, 23 nt, Homo sapiens
uagaugcacuuaugcaguaaauu

SEQ ID NO: 1459187 - RNA, 17 nt, Homo sapiens
uagauguauauauuucc

SEQ ID NO: 1459188 - RNA, 12 nt, Homo sapiens
uagaugugcauu

SEQ ID NO: 1459189 - RNA, 21 nt, Homo sapiens
uagauucuuaauucaugagga

SEQ ID NO: 1459190 - RNA, 22 nt, Homo sapiens
uagauugagcuuagauugccuc

SEQ ID NO: 1459191 - RNA, 23 nt, Homo sapiens
uagauugcagaaaauucugugcc

SEQ ID NO: 1459192 - RNA, 23 nt, Homo sapiens
uagauugcuuucuucuuaaccua

SEQ ID NO: 1459193 - RNA, 17 nt, Homo sapiens
uagauuuguacaggagu

SEQ ID NO: 1459194 - RNA, 16 nt, Homo sapiens
uagauuuuaaagacaa

SEQ ID NO: 1459195 - RNA, 17 nt, Homo sapiens
uagcaagacacaucccu

SEQ ID NO: 1459196 - RNA, 16 nt, Homo sapiens
uagcaaggucauuucu

SEQ ID NO: 1459197 - RNA, 23 nt, Homo sapiens
uagcaauugacagagaauaacuc

SEQ ID NO: 1459198 - RNA, 17 nt, Homo sapiens
uagcaccaggacucaga

SEQ ID NO: 1459199 - RNA, 10 nt, Homo sapiens
uagcacugag

SEQ ID NO: 1459200 - RNA, 20 nt, Homo sapiens
uagcacuuucuacaauguga

SEQ ID NO: 1459201 - RNA, 14 nt, Homo sapiens
uagcagacaguguu

SEQ ID NO: 1459202 - RNA, 18 nt, Homo sapiens
uagcaggccuaagacaug

SEQ ID NO: 1459203 - RNA, 20 nt, Homo sapiens
uagcauaguaccucugcuau

SEQ ID NO: 1459204 - RNA, 15 nt, Homo sapiens
uagcauuaugcaauu

SEQ ID NO: 1459205 - RNA, 16 nt, Homo sapiens
uagcauuaugcaauua

SEQ ID NO: 1459206 - RNA, 18 nt, Homo sapiens
uagccaaacccuugucag

SEQ ID NO: 1459207 - RNA, 15 nt, Homo sapiens
uagccaccagugucc

SEQ ID NO: 1459208 - RNA, 16 nt, Homo sapiens
uagccacuugucagag

SEQ ID NO: 1459209 - RNA, 18 nt, Homo sapiens
uagccagcacacagggca

SEQ ID NO: 1459210 - RNA, 22 nt, Homo sapiens
uagccagccccucuuccccaau

SEQ ID NO: 1459211 - RNA, 16 nt, Homo sapiens
uagccaggauggucuc

SEQ ID NO: 1459212 - RNA, 23 nt, Homo sapiens
uagccaggguggucuugaucucc

SEQ ID NO: 1459213 - RNA, 19 nt, Homo sapiens
uagccagugcuccaggcac

SEQ ID NO: 1459214 - RNA, 19 nt, Homo sapiens
uagcccagacucugagcug

SEQ ID NO: 1459215 - RNA, 13 nt, Homo sapiens
uagcccagcacug

SEQ ID NO: 1459216 - RNA, 14 nt, Homo sapiens
uagcccagcacugu

SEQ ID NO: 1459217 - RNA, 17 nt, Homo sapiens
uagcccuucaagugcac

SEQ ID NO: 1459218 - RNA, 18 nt, Homo sapiens
uagccuauuuaccugcag

SEQ ID NO: 1459219 - RNA, 15 nt, Homo sapiens
uagcucuauuuacuu

SEQ ID NO: 1459220 - RNA, 22 nt, Homo sapiens
uagcugacggcuggguguuuca

SEQ ID NO: 1459221 - RNA, 12 nt, Homo sapiens
uauaucagggaa

SEQ ID NO: 1459222 - RNA, 13 nt, Homo sapiens
uauaucauaugua

SEQ ID NO: 1459223 - RNA, 12 nt, Homo sapiens
uauauccaugua

SEQ ID NO: 1459224 - RNA, 12 nt, Homo sapiens
uauauguaccgu

SEQ ID NO: 1459225 - RNA, 16 nt, Homo sapiens
uauauguuuauauacu

SEQ ID NO: 1459226 - RNA, 13 nt, Homo sapiens
uauauuauggaag

SEQ ID NO: 1459227 - RNA, 19 nt, Homo sapiens
uauauuccgcacucaagga

SEQ ID NO: 1459228 - RNA, 20 nt, Homo sapiens
uauauugaagacaauuugau

SEQ ID NO: 1459229 - RNA, 14 nt, Homo sapiens
uauauuuguacaaa

SEQ ID NO: 1459230 - RNA, 19 nt, Homo sapiens
uauauuugugauagcacuu

SEQ ID NO: 1459231 - RNA, 16 nt, Homo sapiens
uaucaaaaucacuauc

SEQ ID NO: 1459232 - RNA, 12 nt, Homo sapiens
uaucaacuuuag

SEQ ID NO: 1459233 - RNA, 21 nt, Homo sapiens
uaucacauuuaccauaauuua

SEQ ID NO: 1459234 - RNA, 19 nt, Homo sapiens
uaucacugaacaaacuaaa

SEQ ID NO: 1459235 - RNA, 14 nt, Homo sapiens
uaucagaauucuca

SEQ ID NO: 1459236 - RNA, 18 nt, Homo sapiens
uaucagaucuaucuuguc

SEQ ID NO: 1459237 - RNA, 17 nt, Homo sapiens
uaucaggggugcauucu

SEQ ID NO: 1459238 - RNA, 22 nt, Homo sapiens
uaucaggggugcauucuggcca

SEQ ID NO: 1459239 - RNA, 12 nt, Homo sapiens
uaucaguaccuc

SEQ ID NO: 1459240 - RNA, 19 nt, Homo sapiens
uaucaguguuuuaaauucu

SEQ ID NO: 1459241 - RNA, 18 nt, Homo sapiens
uaucauaauucagcacuu

SEQ ID NO: 1459242 - RNA, 19 nt, Homo sapiens
uaucauaauucagcacuua

SEQ ID NO: 1459243 - RNA, 20 nt, Homo sapiens
uaucauccugccuucaugga

SEQ ID NO: 1459244 - RNA, 17 nt, Homo sapiens
uaucaugcccugugcaa

SEQ ID NO: 1459245 - RNA, 14 nt, Homo sapiens
uaucaugugcacuu

SEQ ID NO: 1459246 - RNA, 13 nt, Homo sapiens
uaucauugcuaaa

SEQ ID NO: 1459247 - RNA, 14 nt, Homo sapiens
uauccaaguuggac

SEQ ID NO: 1459248 - RNA, 15 nt, Homo sapiens
uauccaaucugugau

SEQ ID NO: 1459249 - RNA, 13 nt, Homo sapiens
uaucccucucuuc

SEQ ID NO: 1459250 - RNA, 20 nt, Homo sapiens
uauccgaacuuuaauuucag

SEQ ID NO: 1459251 - RNA, 19 nt, Homo sapiens
uauccuagucauucuuccc

SEQ ID NO: 1459252 - RNA, 22 nt, Homo sapiens
uauccugcgaccuugcaaccuc

SEQ ID NO: 1459253 - RNA, 19 nt, Homo sapiens
uauccugggagcacugcgu

SEQ ID NO: 1459254 - RNA, 18 nt, Homo sapiens
uauccuuucuaacaaaaa

SEQ ID NO: 1459255 - RNA, 13 nt, Homo sapiens
uaucgaucucuua

SEQ ID NO: 1459256 - RNA, 17 nt, Homo sapiens
uaucgggaacaguguuu

SEQ ID NO: 1459257 - RNA, 22 nt, Homo sapiens
uaucgggagaggggauucacaa

SEQ ID NO: 1459258 - RNA, 17 nt, Homo sapiens
uaucgggagcagugucu

SEQ ID NO: 1459259 - RNA, 21 nt, Homo sapiens
uaucgggagcagugucuucca

SEQ ID NO: 1459260 - RNA, 20 nt, Homo sapiens
uaucuaauauauaugaauaa

SEQ ID NO: 1459261 - RNA, 17 nt, Homo sapiens
uaucuagcaaucacaac

SEQ ID NO: 1459262 - RNA, 12 nt, Homo sapiens
uaucuaugcaaa

SEQ ID NO: 1459263 - RNA, 23 nt, Homo sapiens
uaucucaggggccaacuaggcag

SEQ ID NO: 1459264 - RNA, 14 nt, Homo sapiens
uaucugaggucaca

SEQ ID NO: 1459265 - RNA, 22 nt, Homo sapiens
uaucugcagggacagagcauug

SEQ ID NO: 1459266 - RNA, 21 nt, Homo sapiens
uaucuggccuaaaaucuugga

SEQ ID NO: 1459267 - RNA, 17 nt, Homo sapiens
uaucuucaaacuuucac

SEQ ID NO: 1459268 - RNA, 16 nt, Homo sapiens
uaucuugauaaacuag

SEQ ID NO: 1459269 - RNA, 19 nt, Homo sapiens
uaucuugggauaguuccca

SEQ ID NO: 1459270 - RNA, 20 nt, Homo sapiens
uaugaaaacagcuaucucac

SEQ ID NO: 1459271 - RNA, 18 nt, Homo sapiens
uaugaaaagaggggacca

SEQ ID NO: 1459272 - RNA, 19 nt, Homo sapiens
uaugaaaauacaacuuaaa

SEQ ID NO: 1459273 - RNA, 12 nt, Homo sapiens
uaugaaacugca

SEQ ID NO: 1459274 - RNA, 16 nt, Homo sapiens
uaugaaaugaccucug

SEQ ID NO: 1459275 - RNA, 20 nt, Homo sapiens
uaugaagugacucucacaag

SEQ ID NO: 1459276 - RNA, 21 nt, Homo sapiens
uaugaagugacucucacaaga

SEQ ID NO: 1459277 - RNA, 20 nt, Homo sapiens
uaugaauaaagaaugccauu

SEQ ID NO: 1459278 - RNA, 17 nt, Homo sapiens
uaugaauaagcacuuga

SEQ ID NO: 1459279 - RNA, 23 nt, Homo sapiens
uaugaauggguggaaagguguga

SEQ ID NO: 1459280 - RNA, 14 nt, Homo sapiens
uaugacaagacaau

SEQ ID NO: 1459281 - RNA, 19 nt, Homo sapiens
uaugacacugagcaagauc

SEQ ID NO: 1459282 - RNA, 16 nt, Homo sapiens
uaugaccagaagccuu

SEQ ID NO: 1459283 - RNA, 11 nt, Homo sapiens
uaugaccagug

SEQ ID NO: 1459284 - RNA, 22 nt, Homo sapiens
uaugagccaggcaucauacuaa

SEQ ID NO: 1459285 - RNA, 21 nt, Homo sapiens
uaugaguuuuugauagcuuua

SEQ ID NO: 1459286 - RNA, 17 nt, Homo sapiens
uaugauaaaacacugcc

SEQ ID NO: 1459287 - RNA, 19 nt, Homo sapiens
uaugauaaaacacugcccu

SEQ ID NO: 1459288 - RNA, 16 nt, Homo sapiens
uaugauauauugcugu

SEQ ID NO: 1459289 - RNA, 19 nt, Homo sapiens
uaugaucucucuagcuuug

SEQ ID NO: 1459290 - RNA, 13 nt, Homo sapiens
uaugaugcacuua

SEQ ID NO: 1459291 - RNA, 18 nt, Homo sapiens
uaugauucagauuguuau

SEQ ID NO: 1459292 - RNA, 19 nt, Homo sapiens
uaugauuguuucucaaauc

SEQ ID NO: 1459293 - RNA, 20 nt, Homo sapiens
uaugauuuaagguacuuaaa

SEQ ID NO: 1459294 - RNA, 20 nt, Homo sapiens
uaugcaaaauacuguacauu

SEQ ID NO: 1459295 - RNA, 21 nt, Homo sapiens
uaugcaaaucaaacauauucu

SEQ ID NO: 1459296 - RNA, 16 nt, Homo sapiens
uaugcagcugugauac

SEQ ID NO: 1459297 - RNA, 12 nt, Homo sapiens
uaugcauaucag

SEQ ID NO: 1459298 - RNA, 22 nt, Homo sapiens
uaugccaggcccauuuccugcu

SEQ ID NO: 1459299 - RNA, 23 nt, Homo sapiens
uaugcccggaccuccaucagagc

SEQ ID NO: 1459300 - RNA, 23 nt, Homo sapiens
uaugccugaaugacuccacuguu

SEQ ID NO: 1459301 - RNA, 16 nt, Homo sapiens
uaugccugccucuuuc

SEQ ID NO: 1459302 - RNA, 18 nt, Homo sapiens
uaugcuauugaaguuuug

SEQ ID NO: 1459303 - RNA, 16 nt, Homo sapiens
uauggaauacaguguu

SEQ ID NO: 1459304 - RNA, 20 nt, Homo sapiens
uaugguuauuuaugcacugu

SEQ ID NO: 1459305 - RNA, 23 nt, Homo sapiens
uauguaguaauugacaugugcca

SEQ ID NO: 1459306 - RNA, 13 nt, Homo sapiens
uauguauauacau

SEQ ID NO: 1459307 - RNA, 19 nt, Homo sapiens
uaugucacuagaauggaua

SEQ ID NO: 1459308 - RNA, 20 nt, Homo sapiens
uauguccgcagaauggacuu

SEQ ID NO: 1459309 - RNA, 20 nt, Homo sapiens
uaugugcacugucacuuugc

SEQ ID NO: 1459310 - RNA, 12 nt, Homo sapiens
uauguguaaaau

SEQ ID NO: 1459311 - RNA, 18 nt, Homo sapiens
uaugugugaggagcugcu

SEQ ID NO: 1459312 - RNA, 12 nt, Homo sapiens
uauguugcaaga

SEQ ID NO: 1459313 - RNA, 17 nt, Homo sapiens
uauguuuacuucucacc

SEQ ID NO: 1459314 - RNA, 16 nt, Homo sapiens
uauuaaaacacagcuu

SEQ ID NO: 1459315 - RNA, 19 nt, Homo sapiens
uauuaaauauauacugacu

SEQ ID NO: 1459316 - RNA, 23 nt, Homo sapiens
uauuaauaugaguuacugaaggu

SEQ ID NO: 1459317 - RNA, 14 nt, Homo sapiens
uauuaauucuucac

SEQ ID NO: 1459318 - RNA, 20 nt, Homo sapiens
uauuaauuguuuugcacuuu

SEQ ID NO: 1459319 - RNA, 23 nt, Homo sapiens
uauuaauuuuuaaggauguugcc

SEQ ID NO: 1459320 - RNA, 12 nt, Homo sapiens
uauuacuguugc

SEQ ID NO: 1459321 - RNA, 20 nt, Homo sapiens
uauuacuguugcauuuacuu

SEQ ID NO: 1459322 - RNA, 14 nt, Homo sapiens
uauuagaaauuaga

SEQ ID NO: 1459323 - RNA, 16 nt, Homo sapiens
ugggacuggagucaga

SEQ ID NO: 1459324 - RNA, 18 nt, Homo sapiens
ugggagacacagcaagac

SEQ ID NO: 1459325 - RNA, 15 nt, Homo sapiens
ugggagacaugugac

SEQ ID NO: 1459326 - RNA, 18 nt, Homo sapiens
ugggagacaugugacauu

SEQ ID NO: 1459327 - RNA, 20 nt, Homo sapiens
ugggagacuggaaaagggaa

SEQ ID NO: 1459328 - RNA, 19 nt, Homo sapiens
ugggagaguaaaccuugaa

SEQ ID NO: 1459329 - RNA, 19 nt, Homo sapiens
ugggagaucuucacucugg

SEQ ID NO: 1459330 - RNA, 15 nt, Homo sapiens
ugggagcaccgccug

SEQ ID NO: 1459331 - RNA, 21 nt, Homo sapiens
ugggaggcaagaaaaggacaa

SEQ ID NO: 1459332 - RNA, 12 nt, Homo sapiens
ugggaguacuga

SEQ ID NO: 1459333 - RNA, 23 nt, Homo sapiens
ugggauacuauuuaauuauuuca

SEQ ID NO: 1459334 - RNA, 17 nt, Homo sapiens
ugggauaucacuuccau

SEQ ID NO: 1459335 - RNA, 17 nt, Homo sapiens
ugggaucugucacacca

SEQ ID NO: 1459336 - RNA, 20 nt, Homo sapiens
ugggaucugucacaccagcc

SEQ ID NO: 1459337 - RNA, 19 nt, Homo sapiens
ugggauguccuacuaucac

SEQ ID NO: 1459338 - RNA, 21 nt, Homo sapiens
ugggauguccuacuaucacug

SEQ ID NO: 1459339 - RNA, 15 nt, Homo sapiens
ugggauguucagcac

SEQ ID NO: 1459340 - RNA, 16 nt, Homo sapiens
ugggauuugcugugua

SEQ ID NO: 1459341 - RNA, 18 nt, Homo sapiens
ugggcaacagagcaagau

SEQ ID NO: 1459342 - RNA, 15 nt, Homo sapiens
ugggcacagagguca

SEQ ID NO: 1459343 - RNA, 22 nt, Homo sapiens
ugggcacagcucuucacaccau

SEQ ID NO: 1459344 - RNA, 14 nt, Homo sapiens
ugggcacaguggac

SEQ ID NO: 1459345 - RNA, 19 nt, Homo sapiens
ugggcacaguggacucagc

SEQ ID NO: 1459346 - RNA, 23 nt, Homo sapiens
ugggcacucccuugguggcaaga

SEQ ID NO: 1459347 - RNA, 14 nt, Homo sapiens
ugggcagaaagugg

SEQ ID NO: 1459348 - RNA, 15 nt, Homo sapiens
ugggcagcaggggua

SEQ ID NO: 1459349 - RNA, 17 nt, Homo sapiens
ugggcauagccauggaa

SEQ ID NO: 1459350 - RNA, 23 nt, Homo sapiens
ugggcauagguaagcugugccuu

SEQ ID NO: 1459351 - RNA, 18 nt, Homo sapiens
ugggcauucuuguuucaa

SEQ ID NO: 1459352 - RNA, 19 nt, Homo sapiens
ugggcauuuuucuuacuuu

SEQ ID NO: 1459353 - RNA, 16 nt, Homo sapiens
ugggccagacaugcca

SEQ ID NO: 1459354 - RNA, 13 nt, Homo sapiens
ugggccagggucu

SEQ ID NO: 1459355 - RNA, 14 nt, Homo sapiens
ugggccauguccaa

SEQ ID NO: 1459356 - RNA, 17 nt, Homo sapiens
ugggcccaggacuguug

SEQ ID NO: 1459357 - RNA, 13 nt, Homo sapiens
ugggccguuacau

SEQ ID NO: 1459358 - RNA, 20 nt, Homo sapiens
ugggccuugcaagaugggag

SEQ ID NO: 1459359 - RNA, 20 nt, Homo sapiens
ugggccuugcugcugcugca

SEQ ID NO: 1459360 - RNA, 19 nt, Homo sapiens
ugggcuauuuggacucagg

SEQ ID NO: 1459361 - RNA, 23 nt, Homo sapiens
ugggcucugugcagucacuggag

SEQ ID NO: 1459362 - RNA, 21 nt, Homo sapiens
ugggcugguaucucagaaagu

SEQ ID NO: 1459363 - RNA, 23 nt, Homo sapiens
ugggcuucaguaaguccccggcg

SEQ ID NO: 1459364 - RNA, 21 nt, Homo sapiens
uggggaaaagugaauuucaca

SEQ ID NO: 1459365 - RNA, 19 nt, Homo sapiens
uggggaagaguggucuuga

SEQ ID NO: 1459366 - RNA, 14 nt, Homo sapiens
uggggaccaggugc

SEQ ID NO: 1459367 - RNA, 18 nt, Homo sapiens
uggggagcaggaggccaa

SEQ ID NO: 1459368 - RNA, 20 nt, Homo sapiens
uggggaggccuauuccugcu

SEQ ID NO: 1459369 - RNA, 19 nt, Homo sapiens
uggggaugguccacuguca

SEQ ID NO: 1459370 - RNA, 16 nt, Homo sapiens
uggggauuuucacuga

SEQ ID NO: 1459371 - RNA, 19 nt, Homo sapiens
uggggcaggcugggccaug

SEQ ID NO: 1459372 - RNA, 16 nt, Homo sapiens
uggggcaggucacuuu

SEQ ID NO: 1459373 - RNA, 14 nt, Homo sapiens
uggggccagaucca

SEQ ID NO: 1459374 - RNA, 15 nt, Homo sapiens
uggggccagauccag

SEQ ID NO: 1459375 - RNA, 11 nt, Homo sapiens
uggggccugug

SEQ ID NO: 1459376 - RNA, 19 nt, Homo sapiens
uggggcuuccagcucagaa

SEQ ID NO: 1459377 - RNA, 19 nt, Homo sapiens
ugggggacgugggcauuuu

SEQ ID NO: 1459378 - RNA, 14 nt, Homo sapiens
ugggggacuggggg

SEQ ID NO: 1459379 - RNA, 22 nt, Homo sapiens
ugggggcagggcugugcuugaa

SEQ ID NO: 1459380 - RNA, 14 nt, Homo sapiens
ugggggugaagucu

SEQ ID NO: 1459381 - RNA, 22 nt, Homo sapiens
uggggucugugaucacccucuc

SEQ ID NO: 1459382 - RNA, 19 nt, Homo sapiens
ugggguugcaaccacugca

SEQ ID NO: 1459383 - RNA, 18 nt, Homo sapiens
ugggguuggaacauuuca

SEQ ID NO: 1459384 - RNA, 16 nt, Homo sapiens
ugggguuucaccaucu

SEQ ID NO: 1459385 - RNA, 15 nt, Homo sapiens
uggguagaugugcaa

SEQ ID NO: 1459386 - RNA, 15 nt, Homo sapiens
ugggucacauccauc

SEQ ID NO: 1459387 - RNA, 15 nt, Homo sapiens
uggguccaucagaga

SEQ ID NO: 1459388 - RNA, 22 nt, Homo sapiens
uggguccucgcugcuggcugcu

SEQ ID NO: 1459389 - RNA, 14 nt, Homo sapiens
ugggucuauguucc

SEQ ID NO: 1459390 - RNA, 22 nt, Homo sapiens
ugggucugggagucacacagug

SEQ ID NO: 1459391 - RNA, 16 nt, Homo sapiens
ugggugacaaagugag

SEQ ID NO: 1459392 - RNA, 14 nt, Homo sapiens
ugggugcucagaau

SEQ ID NO: 1459393 - RNA, 19 nt, Homo sapiens
ugggugucauuucauucca

SEQ ID NO: 1459394 - RNA, 14 nt, Homo sapiens
ugguaaaauacuuc

SEQ ID NO: 1459395 - RNA, 21 nt, Homo sapiens
ugguaaaaugcaucaaaagac

SEQ ID NO: 1459396 - RNA, 15 nt, Homo sapiens
ugguaauaacaaacg

SEQ ID NO: 1459397 - RNA, 20 nt, Homo sapiens
ugguaauauugacuuguaua

SEQ ID NO: 1459398 - RNA, 13 nt, Homo sapiens
ugguagagauuca

SEQ ID NO: 1459399 - RNA, 19 nt, Homo sapiens
ugguagcgggcgccuguag

SEQ ID NO: 1459400 - RNA, 16 nt, Homo sapiens
ugguaguuaugugaag

SEQ ID NO: 1459401 - RNA, 20 nt, Homo sapiens
ugguaugcuggccagcaccc

SEQ ID NO: 1459402 - RNA, 13 nt, Homo sapiens
ugguaugugacac

SEQ ID NO: 1459403 - RNA, 21 nt, Homo sapiens
uggucaagauuuugaaugcuu

SEQ ID NO: 1459404 - RNA, 20 nt, Homo sapiens
uggucaauccgaaguaugag

SEQ ID NO: 1459405 - RNA, 15 nt, Homo sapiens
uggucacacacugau

SEQ ID NO: 1459406 - RNA, 14 nt, Homo sapiens
uggucacacucuca

SEQ ID NO: 1459407 - RNA, 22 nt, Homo sapiens
uggucaccaaaucagcugcuac

SEQ ID NO: 1459408 - RNA, 15 nt, Homo sapiens
uggucacugugcacu

SEQ ID NO: 1459409 - RNA, 13 nt, Homo sapiens
uggucauccaaac

SEQ ID NO: 1459410 - RNA, 16 nt, Homo sapiens
uggucccaagacauga

SEQ ID NO: 1459411 - RNA, 19 nt, Homo sapiens
uggucccagaguggcugca

SEQ ID NO: 1459412 - RNA, 21 nt, Homo sapiens
uggucccggggccagcacuuc

SEQ ID NO: 1459413 - RNA, 18 nt, Homo sapiens
ugguccugcagaagcaga

SEQ ID NO: 1459414 - RNA, 20 nt, Homo sapiens
uggucucaaacuuguggccu

SEQ ID NO: 1459415 - RNA, 20 nt, Homo sapiens
uggugaacugagcugggcag

SEQ ID NO: 1459416 - RNA, 21 nt, Homo sapiens
uggugaaguaaauuaggcagu

SEQ ID NO: 1459417 - RNA, 14 nt, Homo sapiens
uggugacauugcac

SEQ ID NO: 1459418 - RNA, 21 nt, Homo sapiens
uggugacauugcaccuggaug

SEQ ID NO: 1459419 - RNA, 21 nt, Homo sapiens
uggugacgcacggcauuagcu

SEQ ID NO: 1459420 - RNA, 13 nt, Homo sapiens
uggugaggcaaua

SEQ ID NO: 1459421 - RNA, 18 nt, Homo sapiens
uggugaggcgaaggccag

SEQ ID NO: 1459422 - RNA, 14 nt, Homo sapiens
uggugauccucuau

SEQ ID NO: 1459423 - RNA, 23 nt, Homo sapiens
uggugcuaaaugcuacauacucc

SEQ ID NO: 1459424 - RNA, 14 nt, Homo sapiens
uggugcucuuugcu

SEQ ID NO: 1459425 - RNA, 16 nt, Homo sapiens
ugucauuucauuccau

SEQ ID NO: 1459426 - RNA, 17 nt, Homo sapiens
ugucccaaccccagugg

SEQ ID NO: 1459427 - RNA, 23 nt, Homo sapiens
ugucccacgugucuuccacuuug

SEQ ID NO: 1459428 - RNA, 13 nt, Homo sapiens
ugucccagaguua

SEQ ID NO: 1459429 - RNA, 12 nt, Homo sapiens
ugucccauuucc

SEQ ID NO: 1459430 - RNA, 11 nt, Homo sapiens
uguccccaaaa

SEQ ID NO: 1459431 - RNA, 14 nt, Homo sapiens
ugucccccuaccca

SEQ ID NO: 1459432 - RNA, 18 nt, Homo sapiens
ugucccccuacccaccga

SEQ ID NO: 1459433 - RNA, 16 nt, Homo sapiens
ugucccugaaaccuag

SEQ ID NO: 1459434 - RNA, 23 nt, Homo sapiens
ugucccuuucuuggccaguuauc

SEQ ID NO: 1459435 - RNA, 19 nt, Homo sapiens
uguccuaccaguugcccua

SEQ ID NO: 1459436 - RNA, 19 nt, Homo sapiens
uguccucagccuugccaga

SEQ ID NO: 1459437 - RNA, 20 nt, Homo sapiens
uguccucagggcuacagcag

SEQ ID NO: 1459438 - RNA, 15 nt, Homo sapiens
uguccugaucuguga

SEQ ID NO: 1459439 - RNA, 21 nt, Homo sapiens
uguccugcuggcuuccagcuu

SEQ ID NO: 1459440 - RNA, 21 nt, Homo sapiens
uguccuguacauugugggaug

SEQ ID NO: 1459441 - RNA, 16 nt, Homo sapiens
uguccuucuccaucua

SEQ ID NO: 1459442 - RNA, 17 nt, Homo sapiens
ugucggcuuuuugccau

SEQ ID NO: 1459443 - RNA, 17 nt, Homo sapiens
ugucuaaaaugucagug

SEQ ID NO: 1459444 - RNA, 17 nt, Homo sapiens
ugucuaauaaaauauaa

SEQ ID NO: 1459445 - RNA, 16 nt, Homo sapiens
ugucuaauaguuauuc

SEQ ID NO: 1459446 - RNA, 23 nt, Homo sapiens
ugucuagaauguggauuugauuc

SEQ ID NO: 1459447 - RNA, 18 nt, Homo sapiens
ugucucagacugcaugua

SEQ ID NO: 1459448 - RNA, 18 nt, Homo sapiens
ugucuccuuucucuuaug

SEQ ID NO: 1459449 - RNA, 16 nt, Homo sapiens
ugucugacaaccucuu

SEQ ID NO: 1459450 - RNA, 21 nt, Homo sapiens
ugucugauuggcucacccaag

SEQ ID NO: 1459451 - RNA, 14 nt, Homo sapiens
ugucugcacccagg

SEQ ID NO: 1459452 - RNA, 19 nt, Homo sapiens
ugucugccuggagugcugu

SEQ ID NO: 1459453 - RNA, 21 nt, Homo sapiens
ugucugcuugucaaaagaaau

SEQ ID NO: 1459454 - RNA, 19 nt, Homo sapiens
ugucuggagugacagacca

SEQ ID NO: 1459455 - RNA, 22 nt, Homo sapiens
ugucugggugaccucacuuuag

SEQ ID NO: 1459456 - RNA, 22 nt, Homo sapiens
ugucuguaucggagacagugau

SEQ ID NO: 1459457 - RNA, 17 nt, Homo sapiens
ugucugucaccagcuau

SEQ ID NO: 1459458 - RNA, 15 nt, Homo sapiens
ugucuguuaacuuaa

SEQ ID NO: 1459459 - RNA, 19 nt, Homo sapiens
ugucuguuuguuucaagaa

SEQ ID NO: 1459460 - RNA, 13 nt, Homo sapiens
ugucuuccacuuu

SEQ ID NO: 1459461 - RNA, 12 nt, Homo sapiens
ugucuuccauaa

SEQ ID NO: 1459462 - RNA, 13 nt, Homo sapiens
ugucuucugggca

SEQ ID NO: 1459463 - RNA, 18 nt, Homo sapiens
ugucuuguguuuccacag

SEQ ID NO: 1459464 - RNA, 19 nt, Homo sapiens
ugucuuuauaaucuacucc

SEQ ID NO: 1459465 - RNA, 15 nt, Homo sapiens
ugugaaacacagcug

SEQ ID NO: 1459466 - RNA, 15 nt, Homo sapiens
ugugaaacuuucauu

SEQ ID NO: 1459467 - RNA, 15 nt, Homo sapiens
ugugaagagcaagag

SEQ ID NO: 1459468 - RNA, 21 nt, Homo sapiens
ugugaagugaaugaaacacuc

SEQ ID NO: 1459469 - RNA, 13 nt, Homo sapiens
ugugaauggauug

SEQ ID NO: 1459470 - RNA, 17 nt, Homo sapiens
ugugaauguggauucuu

SEQ ID NO: 1459471 - RNA, 23 nt, Homo sapiens
ugugaccacugaagcaccacagg

SEQ ID NO: 1459472 - RNA, 15 nt, Homo sapiens
ugugaccauuuauaa

SEQ ID NO: 1459473 - RNA, 17 nt, Homo sapiens
ugugaccccacugccaa

SEQ ID NO: 1459474 - RNA, 22 nt, Homo sapiens
ugugacccccaaguccuauccu

SEQ ID NO: 1459475 - RNA, 23 nt, Homo sapiens
ugugacucuaagcucagugcucu

SEQ ID NO: 1459476 - RNA, 14 nt, Homo sapiens
ugugagacuguaag

SEQ ID NO: 1459477 - RNA, 22 nt, Homo sapiens
ugugagauuuuuuauugcuagu

SEQ ID NO: 1459478 - RNA, 20 nt, Homo sapiens
ugugagcuucagauggugaa

SEQ ID NO: 1459479 - RNA, 20 nt, Homo sapiens
ugugagggcagugcaaggag

SEQ ID NO: 1459480 - RNA, 16 nt, Homo sapiens
ugugauauacaaagug

SEQ ID NO: 1459481 - RNA, 16 nt, Homo sapiens
ugugauguuuguccug

SEQ ID NO: 1459482 - RNA, 19 nt, Homo sapiens
ugugauugcugccauaauu

SEQ ID NO: 1459483 - RNA, 23 nt, Homo sapiens
ugugcacgcgcgcgugcacacac

SEQ ID NO: 1459484 - RNA, 18 nt, Homo sapiens
ugugcacugucacuuugc

SEQ ID NO: 1459485 - RNA, 13 nt, Homo sapiens
ugugccaccaagc

SEQ ID NO: 1459486 - RNA, 14 nt, Homo sapiens
ugugcccacucccu

SEQ ID NO: 1459487 - RNA, 13 nt, Homo sapiens
ugugcuacagaug

SEQ ID NO: 1459488 - RNA, 16 nt, Homo sapiens
uguggaagagcauuag

SEQ ID NO: 1459489 - RNA, 13 nt, Homo sapiens
uguggacugugau

SEQ ID NO: 1459490 - RNA, 16 nt, Homo sapiens
uguggaugagaggaac

SEQ ID NO: 1459491 - RNA, 15 nt, Homo sapiens
uguggcccaagacaa

SEQ ID NO: 1459492 - RNA, 17 nt, Homo sapiens
uguggccccaccgagcu

SEQ ID NO: 1459493 - RNA, 16 nt, Homo sapiens
uguggccugccuucac

SEQ ID NO: 1459494 - RNA, 14 nt, Homo sapiens
ugugggcugugagu

SEQ ID NO: 1459495 - RNA, 14 nt, Homo sapiens
ugugggcuugacca

SEQ ID NO: 1459496 - RNA, 20 nt, Homo sapiens
uguggggacacagcagugag

SEQ ID NO: 1459497 - RNA, 13 nt, Homo sapiens
uguggggauuuuc

SEQ ID NO: 1459498 - RNA, 18 nt, Homo sapiens
uguggguguacauuuugu

SEQ ID NO: 1459499 - RNA, 12 nt, Homo sapiens
uguggucauccu

SEQ ID NO: 1459500 - RNA, 21 nt, Homo sapiens
ugugguccagguccuuuccac

SEQ ID NO: 1459501 - RNA, 13 nt, Homo sapiens
uguggucucagga

SEQ ID NO: 1459502 - RNA, 22 nt, Homo sapiens
uguggugagcagaaguggagcu

SEQ ID NO: 1459503 - RNA, 14 nt, Homo sapiens
uguggugaggggcu

SEQ ID NO: 1459504 - RNA, 15 nt, Homo sapiens
uguguaaauuucuca

SEQ ID NO: 1459505 - RNA, 13 nt, Homo sapiens
uguguaauaugca

SEQ ID NO: 1459506 - RNA, 16 nt, Homo sapiens
uguguauguuugcaca

SEQ ID NO: 1459507 - RNA, 17 nt, Homo sapiens
uguguauuuaacugccu

SEQ ID NO: 1459508 - RNA, 21 nt, Homo sapiens
uguguauuuacgcuuugauuc

SEQ ID NO: 1459509 - RNA, 18 nt, Homo sapiens
uguguauuuccagugcaa

SEQ ID NO: 1459510 - RNA, 19 nt, Homo sapiens
uguguauuuccagugcaau

SEQ ID NO: 1459511 - RNA, 16 nt, Homo sapiens
ugugucaaaagccaga

SEQ ID NO: 1459512 - RNA, 22 nt, Homo sapiens
ugugucagaaacugaagcuguu

SEQ ID NO: 1459513 - RNA, 21 nt, Homo sapiens
ugugucccgaauccacagucg

SEQ ID NO: 1459514 - RNA, 13 nt, Homo sapiens
ugugucugucagc

SEQ ID NO: 1459515 - RNA, 17 nt, Homo sapiens
ugugugagaauaaacua

SEQ ID NO: 1459516 - RNA, 14 nt, Homo sapiens
uguguggacuguga

SEQ ID NO: 1459517 - RNA, 15 nt, Homo sapiens
uguguggccugccuu

SEQ ID NO: 1459518 - RNA, 14 nt, Homo sapiens
ugugugggcuguga

SEQ ID NO: 1459519 - RNA, 19 nt, Homo sapiens
uguguguauguuugcacac

SEQ ID NO: 1459520 - RNA, 13 nt, Homo sapiens
uguguucugucac

SEQ ID NO: 1459521 - RNA, 18 nt, Homo sapiens
uguguucugucaccaacu

SEQ ID NO: 1459522 - RNA, 13 nt, Homo sapiens
uguguugccacag

SEQ ID NO: 1459523 - RNA, 22 nt, Homo sapiens
uguguugucuucagcagucaau

SEQ ID NO: 1459524 - RNA, 17 nt, Homo sapiens
uguguuuauuucacuug

SEQ ID NO: 1459525 - RNA, 13 nt, Homo sapiens
uguuaagugcagg

SEQ ID NO: 1459526 - RNA, 18 nt, Homo sapiens
uguuaccacugguaacau

SEQ ID NO: 1459527 - RNA, 20 nt, Homo sapiens
uguuacgcacacguacuuaa

SEQ ID NO: 1459528 - RNA, 21 nt, Homo sapiens
uuaacuuuucuaacagaaagc

SEQ ID NO: 1459529 - RNA, 13 nt, Homo sapiens
uuaagaaaauaca

SEQ ID NO: 1459530 - RNA, 15 nt, Homo sapiens
uuaagaagacauacu

SEQ ID NO: 1459531 - RNA, 22 nt, Homo sapiens
uuaagaaugucgauuaaaauca

SEQ ID NO: 1459532 - RNA, 14 nt, Homo sapiens
uuaagaauuucaca

SEQ ID NO: 1459533 - RNA, 18 nt, Homo sapiens
uuaagaccuggcagcucu

SEQ ID NO: 1459534 - RNA, 19 nt, Homo sapiens
uuaagauuuuacaaaagag

SEQ ID NO: 1459535 - RNA, 18 nt, Homo sapiens
uuaagcagcgccagugac

SEQ ID NO: 1459536 - RNA, 16 nt, Homo sapiens
uuaagcgugucuguau

SEQ ID NO: 1459537 - RNA, 19 nt, Homo sapiens
uuaagcuauccacagcuua

SEQ ID NO: 1459538 - RNA, 14 nt, Homo sapiens
uuaagcugauccug

SEQ ID NO: 1459539 - RNA, 19 nt, Homo sapiens
uuaagcuuccgccgucuca

SEQ ID NO: 1459540 - RNA, 15 nt, Homo sapiens
uuaaggauugugaua

SEQ ID NO: 1459541 - RNA, 14 nt, Homo sapiens
uuaaggccugaauc

SEQ ID NO: 1459542 - RNA, 15 nt, Homo sapiens
uuaaguucacaaccu

SEQ ID NO: 1459543 - RNA, 15 nt, Homo sapiens
uuaaguuuaucuuuc

SEQ ID NO: 1459544 - RNA, 21 nt, Homo sapiens
uuaauaaaaacaaccuugcau

SEQ ID NO: 1459545 - RNA, 15 nt, Homo sapiens
uuaauaaacuacucu

SEQ ID NO: 1459546 - RNA, 20 nt, Homo sapiens
uuaauacauugaucaggcca

SEQ ID NO: 1459547 - RNA, 16 nt, Homo sapiens
uuaauaccagcuuaaa

SEQ ID NO: 1459548 - RNA, 12 nt, Homo sapiens
uuaauagacuga

SEQ ID NO: 1459549 - RNA, 21 nt, Homo sapiens
uuaauaguuuugauccuaaau

SEQ ID NO: 1459550 - RNA, 20 nt, Homo sapiens
uuaauauuuuuccacuuaaa

SEQ ID NO: 1459551 - RNA, 12 nt, Homo sapiens
uuaauccagcug

SEQ ID NO: 1459552 - RNA, 19 nt, Homo sapiens
uuaauccuuaacacauuca

SEQ ID NO: 1459553 - RNA, 12 nt, Homo sapiens
uuaaugagauag

SEQ ID NO: 1459554 - RNA, 19 nt, Homo sapiens
uuaaugccacaaaacugac

SEQ ID NO: 1459555 - RNA, 15 nt, Homo sapiens
uuaaugcuucauuca

SEQ ID NO: 1459556 - RNA, 12 nt, Homo sapiens
uuaaugcuugua

SEQ ID NO: 1459557 - RNA, 17 nt, Homo sapiens
uuaauggguaugcucag

SEQ ID NO: 1459558 - RNA, 19 nt, Homo sapiens
uuaauguguuaagugcagg

SEQ ID NO: 1459559 - RNA, 18 nt, Homo sapiens
uuaauuaauggaaucuuc

SEQ ID NO: 1459560 - RNA, 17 nt, Homo sapiens
uuaauuacaacugcuau

SEQ ID NO: 1459561 - RNA, 19 nt, Homo sapiens
uuaauucucuuucaaagcu

SEQ ID NO: 1459562 - RNA, 15 nt, Homo sapiens
uuaauucuucaccug

SEQ ID NO: 1459563 - RNA, 19 nt, Homo sapiens
uuaauuuccuuuuugacac

SEQ ID NO: 1459564 - RNA, 14 nt, Homo sapiens
uuaauuucuaaaga

SEQ ID NO: 1459565 - RNA, 13 nt, Homo sapiens
uuacaaacugcaa

SEQ ID NO: 1459566 - RNA, 15 nt, Homo sapiens
uuacaaacugcaaua

SEQ ID NO: 1459567 - RNA, 12 nt, Homo sapiens
uuacaacuaagu

SEQ ID NO: 1459568 - RNA, 12 nt, Homo sapiens
uuacaagccuaa

SEQ ID NO: 1459569 - RNA, 14 nt, Homo sapiens
uuacaaggugacaa

SEQ ID NO: 1459570 - RNA, 19 nt, Homo sapiens
uuacaaucagccacauucu

SEQ ID NO: 1459571 - RNA, 14 nt, Homo sapiens
uuacaaucauugcu

SEQ ID NO: 1459572 - RNA, 14 nt, Homo sapiens
uuacacaaagggaa

SEQ ID NO: 1459573 - RNA, 17 nt, Homo sapiens
uuacacaaauuugccug

SEQ ID NO: 1459574 - RNA, 19 nt, Homo sapiens
uuacacagaaaugcugcug

SEQ ID NO: 1459575 - RNA, 19 nt, Homo sapiens
uuacacaguugcugucaua

SEQ ID NO: 1459576 - RNA, 16 nt, Homo sapiens
uuacaccaacuccuaa

SEQ ID NO: 1459577 - RNA, 15 nt, Homo sapiens
uuacacguaccucuc

SEQ ID NO: 1459578 - RNA, 19 nt, Homo sapiens
uuacagaaaagacucugac

SEQ ID NO: 1459579 - RNA, 21 nt, Homo sapiens
uuacagaaaagacucugacca

SEQ ID NO: 1459580 - RNA, 15 nt, Homo sapiens
uuacagaacuacuuc

SEQ ID NO: 1459581 - RNA, 20 nt, Homo sapiens
uuacagagaggagaaacaca

SEQ ID NO: 1459582 - RNA, 16 nt, Homo sapiens
uuacaggaacuucauc

SEQ ID NO: 1459583 - RNA, 18 nt, Homo sapiens
uuacagggagcugggaca

SEQ ID NO: 1459584 - RNA, 23 nt, Homo sapiens
uuacagugagccaagauugcacc

SEQ ID NO: 1459585 - RNA, 16 nt, Homo sapiens
uuacagugcagacagg

SEQ ID NO: 1459586 - RNA, 18 nt, Homo sapiens
uuacauagguauauauau

SEQ ID NO: 1459587 - RNA, 14 nt, Homo sapiens
uuacauuguugagc

SEQ ID NO: 1459588 - RNA, 18 nt, Homo sapiens
uuaccaucuuacuugagc

SEQ ID NO: 1459589 - RNA, 17 nt, Homo sapiens
uuacccucuuugcugca

SEQ ID NO: 1459590 - RNA, 15 nt, Homo sapiens
uuaccuccauccauc

SEQ ID NO: 1459591 - RNA, 12 nt, Homo sapiens
uuaccucugaua

SEQ ID NO: 1459592 - RNA, 22 nt, Homo sapiens
uuaccugggcauucuuguuuca

SEQ ID NO: 1459593 - RNA, 14 nt, Homo sapiens
uuaccuggggaucc

SEQ ID NO: 1459594 - RNA, 20 nt, Homo sapiens
uuaccuugaaaugcuguuag

SEQ ID NO: 1459595 - RNA, 13 nt, Homo sapiens
uuacgugagccag

SEQ ID NO: 1459596 - RNA, 16 nt, Homo sapiens
uuacuaagcuuugcca

SEQ ID NO: 1459597 - RNA, 16 nt, Homo sapiens
uuacuauaauuugacu

SEQ ID NO: 1459598 - RNA, 16 nt, Homo sapiens
uuacuaucauaauuca

SEQ ID NO: 1459599 - RNA, 19 nt, Homo sapiens
uuacuaugacugcucccca

SEQ ID NO: 1459600 - RNA, 23 nt, Homo sapiens
uuacucaaggaauuugcauuuag

SEQ ID NO: 1459601 - RNA, 14 nt, Homo sapiens
uuacucucacaccu

SEQ ID NO: 1459602 - RNA, 18 nt, Homo sapiens
uuacugcuugaccaaaga

SEQ ID NO: 1459603 - RNA, 16 nt, Homo sapiens
uuacuugcauugaaua

SEQ ID NO: 1459604 - RNA, 17 nt, Homo sapiens
uuacuuuuaccacuauu

SEQ ID NO: 1459605 - RNA, 15 nt, Homo sapiens
uuacuuuuauuugca

SEQ ID NO: 1459606 - RNA, 14 nt, Homo sapiens
uuagaaaaauuccu

SEQ ID NO: 1459607 - RNA, 13 nt, Homo sapiens
uuagaaaacuaga

SEQ ID NO: 1459608 - RNA, 17 nt, Homo sapiens
uuagaaaauagagcuuu

SEQ ID NO: 1459609 - RNA, 21 nt, Homo sapiens
uuagaaacugauuucuucaga

SEQ ID NO: 1459610 - RNA, 12 nt, Homo sapiens
uuagaacuugca

SEQ ID NO: 1459611 - RNA, 19 nt, Homo sapiens
uuagaagcugagacacaaa

SEQ ID NO: 1459612 - RNA, 15 nt, Homo sapiens
uuagaauguugaaaa

SEQ ID NO: 1459613 - RNA, 17 nt, Homo sapiens
uuagaguugcucuacaa

SEQ ID NO: 1459614 - RNA, 22 nt, Homo sapiens
uuagauacagagacuuggggaa

SEQ ID NO: 1459615 - RNA, 14 nt, Homo sapiens
uuagauguuucaca

SEQ ID NO: 1459616 - RNA, 16 nt, Homo sapiens
uuagauuauauauucc

SEQ ID NO: 1459617 - RNA, 20 nt, Homo sapiens
uuagcagcaacugaagacaa

SEQ ID NO: 1459618 - RNA, 17 nt, Homo sapiens
uuagcaugcuacaguua

SEQ ID NO: 1459619 - RNA, 16 nt, Homo sapiens
uuagcauguuguugaa

SEQ ID NO: 1459620 - RNA, 15 nt, Homo sapiens
uuagccccagggauc

SEQ ID NO: 1459621 - RNA, 18 nt, Homo sapiens
uuagcugucucagagaua

SEQ ID NO: 1459622 - RNA, 13 nt, Homo sapiens
uuagcuugcacau

SEQ ID NO: 1459623 - RNA, 20 nt, Homo sapiens
uuaggaacagcaguguucuc

SEQ ID NO: 1459624 - RNA, 23 nt, Homo sapiens
uuaggaaguuuucuguagucauu

SEQ ID NO: 1459625 - RNA, 18 nt, Homo sapiens
uuaggaguaccauaauuc

SEQ ID NO: 1459626 - RNA, 18 nt, Homo sapiens
uuaggugagacaguugcc

SEQ ID NO: 1459627 - RNA, 23 nt, Homo sapiens
uuagguggugguagagaagcaag

SEQ ID NO: 1459628 - RNA, 18 nt, Homo sapiens
uuaguaaauuucugugau

SEQ ID NO: 1459629 - RNA, 21 nt, Homo sapiens
uuaguagagacgggauuuccc

SEQ ID NO: 1459630 - RNA, 16 nt, Homo sapiens
uuaguauucauucugc

SEQ ID NO: 1459631 - RNA, 19 nt, Homo sapiens
uucagcacccccacccacc

SEQ ID NO: 1459632 - RNA, 15 nt, Homo sapiens
uucagcaucacuaaa

SEQ ID NO: 1459633 - RNA, 19 nt, Homo sapiens
uucaggaagcucucuuaaa

SEQ ID NO: 1459634 - RNA, 18 nt, Homo sapiens
uucaggccuacagccaca

SEQ ID NO: 1459635 - RNA, 22 nt, Homo sapiens
uucaggcucugcccaggaacuc

SEQ ID NO: 1459636 - RNA, 13 nt, Homo sapiens
uucagggccaguc

SEQ ID NO: 1459637 - RNA, 21 nt, Homo sapiens
uucaguaaacaacuuguacuu

SEQ ID NO: 1459638 - RNA, 15 nt, Homo sapiens
uucaguacuugugaa

SEQ ID NO: 1459639 - RNA, 23 nt, Homo sapiens
uucaguacuugugaaacacagcu

SEQ ID NO: 1459640 - RNA, 13 nt, Homo sapiens
uucaguaugcaaa

SEQ ID NO: 1459641 - RNA, 22 nt, Homo sapiens
uucaguggcuaccuacauacaa

SEQ ID NO: 1459642 - RNA, 22 nt, Homo sapiens
uucaguguacauggaauaacau

SEQ ID NO: 1459643 - RNA, 18 nt, Homo sapiens
uucagugucaacuauuca

SEQ ID NO: 1459644 - RNA, 19 nt, Homo sapiens
uucaguugaucacuggcaa

SEQ ID NO: 1459645 - RNA, 13 nt, Homo sapiens
uucaguugccaag

SEQ ID NO: 1459646 - RNA, 18 nt, Homo sapiens
uucauaauaucaugugca

SEQ ID NO: 1459647 - RNA, 20 nt, Homo sapiens
uucauaauaucaugugcacu

SEQ ID NO: 1459648 - RNA, 15 nt, Homo sapiens
uucauauauacaggc

SEQ ID NO: 1459649 - RNA, 13 nt, Homo sapiens
uucaucacacugg

SEQ ID NO: 1459650 - RNA, 21 nt, Homo sapiens
uucaucccucgggugugcuau

SEQ ID NO: 1459651 - RNA, 19 nt, Homo sapiens
uucaugauuagcaaguuac

SEQ ID NO: 1459652 - RNA, 13 nt, Homo sapiens
uucauggccccag

SEQ ID NO: 1459653 - RNA, 14 nt, Homo sapiens
uucauguggcugua

SEQ ID NO: 1459654 - RNA, 20 nt, Homo sapiens
uucauguuugcuucauaaau

SEQ ID NO: 1459655 - RNA, 18 nt, Homo sapiens
uucauuaauacagggcau

SEQ ID NO: 1459656 - RNA, 23 nt, Homo sapiens
uucauuccuaacacagcaugugu

SEQ ID NO: 1459657 - RNA, 19 nt, Homo sapiens
uucauuccuucagauuugg

SEQ ID NO: 1459658 - RNA, 14 nt, Homo sapiens
uucauuuaccucua

SEQ ID NO: 1459659 - RNA, 21 nt, Homo sapiens
uuccaaaauaauuuuaagaaa

SEQ ID NO: 1459660 - RNA, 15 nt, Homo sapiens
uuccaaacacauaca

SEQ ID NO: 1459661 - RNA, 21 nt, Homo sapiens
uuccaaagcuuuauuaccagu

SEQ ID NO: 1459662 - RNA, 20 nt, Homo sapiens
uuccaaaggcauaagacccu

SEQ ID NO: 1459663 - RNA, 14 nt, Homo sapiens
uuccaacaccacag

SEQ ID NO: 1459664 - RNA, 17 nt, Homo sapiens
uuccaccuccaccacau

SEQ ID NO: 1459665 - RNA, 11 nt, Homo sapiens
uuccacuccac

SEQ ID NO: 1459666 - RNA, 23 nt, Homo sapiens
uuccacucccuuugccagugccu

SEQ ID NO: 1459667 - RNA, 23 nt, Homo sapiens
uuccacuuagaaauugcauuucc

SEQ ID NO: 1459668 - RNA, 14 nt, Homo sapiens
uuccacuuugcaua

SEQ ID NO: 1459669 - RNA, 14 nt, Homo sapiens
uuccagaaaggaua

SEQ ID NO: 1459670 - RNA, 23 nt, Homo sapiens
uuccagaagaagagaagcugcug

SEQ ID NO: 1459671 - RNA, 16 nt, Homo sapiens
uuccagaaucuugacu

SEQ ID NO: 1459672 - RNA, 15 nt, Homo sapiens
uuccagaaugcugaa

SEQ ID NO: 1459673 - RNA, 19 nt, Homo sapiens
uuccagacuuccuugagac

SEQ ID NO: 1459674 - RNA, 23 nt, Homo sapiens
uuccagauguggauuuggcaaaa

SEQ ID NO: 1459675 - RNA, 12 nt, Homo sapiens
uuccagcugcug

SEQ ID NO: 1459676 - RNA, 20 nt, Homo sapiens
uuccaggccugaucuugccu

SEQ ID NO: 1459677 - RNA, 14 nt, Homo sapiens
uuccagguguuacu

SEQ ID NO: 1459678 - RNA, 14 nt, Homo sapiens
uuccaguacuuccu

SEQ ID NO: 1459679 - RNA, 23 nt, Homo sapiens
uuccaguacuuccugcaguacaa

SEQ ID NO: 1459680 - RNA, 16 nt, Homo sapiens
uuccagucuacuugag

SEQ ID NO: 1459681 - RNA, 16 nt, Homo sapiens
uuccaguuauaaauau

SEQ ID NO: 1459682 - RNA, 17 nt, Homo sapiens
uuccaugguuaccugac

SEQ ID NO: 1459683 - RNA, 13 nt, Homo sapiens
uuccaugugccuu

SEQ ID NO: 1459684 - RNA, 14 nt, Homo sapiens
uuccauuaucuuau

SEQ ID NO: 1459685 - RNA, 16 nt, Homo sapiens
uuccauuaugauucuu

SEQ ID NO: 1459686 - RNA, 15 nt, Homo sapiens
uuccauuccaagccu

SEQ ID NO: 1459687 - RNA, 22 nt, Homo sapiens
uuccauugaagccgacucuggc

SEQ ID NO: 1459688 - RNA, 23 nt, Homo sapiens
uuccauugaagccgacucuggcc

SEQ ID NO: 1459689 - RNA, 16 nt, Homo sapiens
uuccauugccuagcuc

SEQ ID NO: 1459690 - RNA, 21 nt, Homo sapiens
uucccagagcacuuugcaacu

SEQ ID NO: 1459691 - RNA, 14 nt, Homo sapiens
uucccagcuaggaa

SEQ ID NO: 1459692 - RNA, 18 nt, Homo sapiens
uucccauaucaaaagaca

SEQ ID NO: 1459693 - RNA, 19 nt, Homo sapiens
uucccaucgcugucacagg

SEQ ID NO: 1459694 - RNA, 20 nt, Homo sapiens
uucccaucuuccaaggguac

SEQ ID NO: 1459695 - RNA, 13 nt, Homo sapiens
uucccaugacugc

SEQ ID NO: 1459696 - RNA, 20 nt, Homo sapiens
uuccccaaggacucuuccac

SEQ ID NO: 1459697 - RNA, 12 nt, Homo sapiens
uuccccacugac

SEQ ID NO: 1459698 - RNA, 16 nt, Homo sapiens
uuccccaucuucuaaa

SEQ ID NO: 1459699 - RNA, 12 nt, Homo sapiens
uuccccucugcu

SEQ ID NO: 1459700 - RNA, 17 nt, Homo sapiens
uuccccucuucugcuaa

SEQ ID NO: 1459701 - RNA, 15 nt, Homo sapiens
uuccccuugccuaaa

SEQ ID NO: 1459702 - RNA, 14 nt, Homo sapiens
uucccgaugaacaa

SEQ ID NO: 1459703 - RNA, 13 nt, Homo sapiens
uucccuccccaga

SEQ ID NO: 1459704 - RNA, 16 nt, Homo sapiens
uucccucugcucagcc

SEQ ID NO: 1459705 - RNA, 21 nt, Homo sapiens
uucccucuuggugugauugca

SEQ ID NO: 1459706 - RNA, 18 nt, Homo sapiens
uucccugaccucccucua

SEQ ID NO: 1459707 - RNA, 23 nt, Homo sapiens
uucccugcuuccaggaaacucca

SEQ ID NO: 1459708 - RNA, 14 nt, Homo sapiens
uucccuugcuggaa

SEQ ID NO: 1459709 - RNA, 15 nt, Homo sapiens
uucccuuuccccagc

SEQ ID NO: 1459710 - RNA, 16 nt, Homo sapiens
uuccgauacaaagugu

SEQ ID NO: 1459711 - RNA, 21 nt, Homo sapiens
uuccgucaccacgacuggcca

SEQ ID NO: 1459712 - RNA, 19 nt, Homo sapiens
uuccuaauaugcuuuacaa

SEQ ID NO: 1459713 - RNA, 22 nt, Homo sapiens
uuccuacacguuagauuugccg

SEQ ID NO: 1459714 - RNA, 21 nt, Homo sapiens
uuccuauaauuuuagacauuc

SEQ ID NO: 1459715 - RNA, 22 nt, Homo sapiens
uuccuaugcuguucacuggaca

SEQ ID NO: 1459716 - RNA, 12 nt, Homo sapiens
uuccucacuaug

SEQ ID NO: 1459717 - RNA, 16 nt, Homo sapiens
uuccucagcugugugg

SEQ ID NO: 1459718 - RNA, 15 nt, Homo sapiens
uuccuccuacuuaca

SEQ ID NO: 1459719 - RNA, 16 nt, Homo sapiens
uuccucuauacaucuc

SEQ ID NO: 1459720 - RNA, 21 nt, Homo sapiens
uuccugaagggggacacucca

SEQ ID NO: 1459721 - RNA, 15 nt, Homo sapiens
uuccugaaugaaaua

SEQ ID NO: 1459722 - RNA, 19 nt, Homo sapiens
uuccugaguggugccaaac

SEQ ID NO: 1459723 - RNA, 18 nt, Homo sapiens
uuccugccccagacagac

SEQ ID NO: 1459724 - RNA, 16 nt, Homo sapiens
uuccugcuuccgagau

SEQ ID NO: 1459725 - RNA, 15 nt, Homo sapiens
uuccuggcugaugau

SEQ ID NO: 1459726 - RNA, 17 nt, Homo sapiens
uuccugguuugacucag

SEQ ID NO: 1459727 - RNA, 22 nt, Homo sapiens
uuccugguuugacucaguucca

SEQ ID NO: 1459728 - RNA, 19 nt, Homo sapiens
uuccuguucccuuggaaua

SEQ ID NO: 1459729 - RNA, 16 nt, Homo sapiens
uuccuuaaacugugug

SEQ ID NO: 1459730 - RNA, 13 nt, Homo sapiens
uuccuuagucuca

SEQ ID NO: 1459731 - RNA, 12 nt, Homo sapiens
uuccuucaaugu

SEQ ID NO: 1459732 - RNA, 14 nt, Homo sapiens
uuccuucucugggu

SEQ ID NO: 1459733 - RNA, 21 nt, Homo sapiens
uuccuugguguucaaaaacca

SEQ ID NO: 1459734 - RNA, 12 nt, Homo sapiens
agcuuccaugag

SEQ ID NO: 1459735 - RNA, 16 nt, Homo sapiens
agcuuccgccgucuca

SEQ ID NO: 1459736 - RNA, 17 nt, Homo sapiens
agcuuccuucugugaaa

SEQ ID NO: 1459737 - RNA, 17 nt, Homo sapiens
agcuucuggggaugcag

SEQ ID NO: 1459738 - RNA, 21 nt, Homo sapiens
agcuucuucugaaagaauuau

SEQ ID NO: 1459739 - RNA, 18 nt, Homo sapiens
agcuugcauagucaauau

SEQ ID NO: 1459740 - RNA, 19 nt, Homo sapiens
agcuugggcaacagagcaa

SEQ ID NO: 1459741 - RNA, 20 nt, Homo sapiens
agcuuguggccccuuuuacu

SEQ ID NO: 1459742 - RNA, 19 nt, Homo sapiens
agcuuguuaucagcuuuca

SEQ ID NO: 1459743 - RNA, 16 nt, Homo sapiens
agcuuuaaacucaggg

SEQ ID NO: 1459744 - RNA, 14 nt, Homo sapiens
agcuuuagcuucau

SEQ ID NO: 1459745 - RNA, 22 nt, Homo sapiens
agcuuuauuuuuuaaguauuua

SEQ ID NO: 1459746 - RNA, 13 nt, Homo sapiens
agcuuucugccau

SEQ ID NO: 1459747 - RNA, 17 nt, Homo sapiens
aacuauuacaccaaaua

SEQ ID NO: 1459748 - RNA, 20 nt, Homo sapiens
aacuauugcauuuauaugua

SEQ ID NO: 1459749 - RNA, 23 nt, Homo sapiens
aacucaaauggggccagauccag

SEQ ID NO: 1459750 - RNA, 14 nt, Homo sapiens
aacucacacauucc

SEQ ID NO: 1459751 - RNA, 15 nt, Homo sapiens
aacucacucugggcu

SEQ ID NO: 1459752 - RNA, 17 nt, Homo sapiens
aacucagaucugucuga

SEQ ID NO: 1459753 - RNA, 16 nt, Homo sapiens
aacuccuauaauuccc

SEQ ID NO: 1459754 - RNA, 19 nt, Homo sapiens
aacucuccuacacuuccau

SEQ ID NO: 1459755 - RNA, 16 nt, Homo sapiens
aacucugaaccaccuu

SEQ ID NO: 1459756 - RNA, 18 nt, Homo sapiens
aacucugagaucuaagga

SEQ ID NO: 1459757 - RNA, 19 nt, Homo sapiens
aacucugguaaaugaucac

SEQ ID NO: 1459758 - RNA, 14 nt, Homo sapiens
aacucuuccuccaa

SEQ ID NO: 1459759 - RNA, 22 nt, Homo sapiens
aacucuugacuuccugccaugg

SEQ ID NO: 1459760 - RNA, 20 nt, Homo sapiens
aacucuugguauuacccucc

SEQ ID NO: 1459761 - RNA, 14 nt, Homo sapiens
aacugaacucacuu

SEQ ID NO: 1459762 - RNA, 19 nt, Homo sapiens
aacugagguucuugggaua

SEQ ID NO: 1459763 - RNA, 20 nt, Homo sapiens
aacugaguguuauuugcaca

SEQ ID NO: 1459764 - RNA, 19 nt, Homo sapiens
aacugcaggagcaguuugc

SEQ ID NO: 1459765 - RNA, 21 nt, Homo sapiens
aacugcauggaccuaacauuc

SEQ ID NO: 1459766 - RNA, 19 nt, Homo sapiens
aacugccucgaaacacaga

SEQ ID NO: 1459767 - RNA, 13 nt, Homo sapiens
aacuggaaugccu

SEQ ID NO: 1459768 - RNA, 23 nt, Homo sapiens
aacuggggaaugggguauggaag

SEQ ID NO: 1459769 - RNA, 21 nt, Homo sapiens
aacugggggcucuguauauag

SEQ ID NO: 1459770 - RNA, 23 nt, Homo sapiens
aacugguuccuagggauguguga

SEQ ID NO: 1459771 - RNA, 13 nt, Homo sapiens
aacugguuguaua

SEQ ID NO: 1459772 - RNA, 18 nt, Homo sapiens
aacuguaugggagcuuaa

SEQ ID NO: 1459773 - RNA, 12 nt, Homo sapiens
aacuguauuuau

SEQ ID NO: 1459774 - RNA, 19 nt, Homo sapiens
aacuguauuuugaauccuu

SEQ ID NO: 1459775 - RNA, 13 nt, Homo sapiens
aacuguccaccaa

SEQ ID NO: 1459776 - RNA, 15 nt, Homo sapiens
aacugucuuccucaa

SEQ ID NO: 1459777 - RNA, 22 nt, Homo sapiens
aacugugaaguuuacauuguaa

SEQ ID NO: 1459778 - RNA, 15 nt, Homo sapiens
aacuguggucaaucc

SEQ ID NO: 1459779 - RNA, 14 nt, Homo sapiens
aacuguguuuacuc

SEQ ID NO: 1459780 - RNA, 20 nt, Homo sapiens
aacuguugauugcaggaaua

SEQ ID NO: 1459781 - RNA, 11 nt, Homo sapiens
aacuguugcuc

SEQ ID NO: 1459782 - RNA, 17 nt, Homo sapiens
aacuuaaaaauauccau

SEQ ID NO: 1459783 - RNA, 16 nt, Homo sapiens
aacuuaaacauauucu

SEQ ID NO: 1459784 - RNA, 20 nt, Homo sapiens
aacuuagaucaucagucacc

SEQ ID NO: 1459785 - RNA, 16 nt, Homo sapiens
aacuuagcuugcacau

SEQ ID NO: 1459786 - RNA, 17 nt, Homo sapiens
aacuuauggaaagccca

SEQ ID NO: 1459787 - RNA, 15 nt, Homo sapiens
aacuucaaagaggaa

SEQ ID NO: 1459788 - RNA, 22 nt, Homo sapiens
aacuucaccuacauuaucucac

SEQ ID NO: 1459789 - RNA, 13 nt, Homo sapiens
aacuucauuugau

SEQ ID NO: 1459790 - RNA, 15 nt, Homo sapiens
aacuucccugauuga

SEQ ID NO: 1459791 - RNA, 23 nt, Homo sapiens
aacuucccugauugaccugcucc

SEQ ID NO: 1459792 - RNA, 15 nt, Homo sapiens
aacuugaaacagauu

SEQ ID NO: 1459793 - RNA, 11 nt, Homo sapiens
aacuuggcacu

SEQ ID NO: 1459794 - RNA, 12 nt, Homo sapiens
aacuuguaaaua

SEQ ID NO: 1459795 - RNA, 15 nt, Homo sapiens
aacuuuaaugaacua

SEQ ID NO: 1459796 - RNA, 20 nt, Homo sapiens
aacuuuauaaggaaauguau

SEQ ID NO: 1459797 - RNA, 22 nt, Homo sapiens
aacuuucagaggcaauagguaa

SEQ ID NO: 1459798 - RNA, 21 nt, Homo sapiens
agucauucuucccuaaucuuc

SEQ ID NO: 1459799 - RNA, 15 nt, Homo sapiens
agucauugaggcccu

SEQ ID NO: 1459800 - RNA, 21 nt, Homo sapiens
agucauuugcugagcauguac

SEQ ID NO: 1459801 - RNA, 16 nt, Homo sapiens
aguccacaguacauaa

SEQ ID NO: 1459802 - RNA, 16 nt, Homo sapiens
aguccacuucugcucu

SEQ ID NO: 1459803 - RNA, 16 nt, Homo sapiens
aguccagcacuggaag

SEQ ID NO: 1459804 - RNA, 17 nt, Homo sapiens
aguccaguaaagccuua

SEQ ID NO: 1459805 - RNA, 19 nt, Homo sapiens
aguccauggugucaugcca

SEQ ID NO: 1459806 - RNA, 16 nt, Homo sapiens
agucccagcuacuuga

SEQ ID NO: 1459807 - RNA, 20 nt, Homo sapiens
aguccccucaccuccucuaa

SEQ ID NO: 1459808 - RNA, 17 nt, Homo sapiens
aguccuacaagcuaaaa

SEQ ID NO: 1459809 - RNA, 13 nt, Homo sapiens
aguccucauuuac

SEQ ID NO: 1459810 - RNA, 12 nt, Homo sapiens
aguccucuagca

SEQ ID NO: 1459811 - RNA, 19 nt, Homo sapiens
aguccugacacuauucauu

SEQ ID NO: 1459812 - RNA, 16 nt, Homo sapiens
aguccugacugggcug

SEQ ID NO: 1459813 - RNA, 17 nt, Homo sapiens
aguccuguacucugggg

SEQ ID NO: 1459814 - RNA, 15 nt, Homo sapiens
aguccuuugugaaua

SEQ ID NO: 1459815 - RNA, 19 nt, Homo sapiens
agucgcaucucagugcagg

SEQ ID NO: 1459816 - RNA, 23 nt, Homo sapiens
agucgugccuguuugcuuagcau

SEQ ID NO: 1459817 - RNA, 13 nt, Homo sapiens
agucucaaaaaua

SEQ ID NO: 1459818 - RNA, 13 nt, Homo sapiens
agucucaccagcc

SEQ ID NO: 1459819 - RNA, 14 nt, Homo sapiens
agucucauucuguc

SEQ ID NO: 1459820 - RNA, 16 nt, Homo sapiens
agucucauucugucac

SEQ ID NO: 1459821 - RNA, 23 nt, Homo sapiens
agucuccucucugagacugcuaa

SEQ ID NO: 1459822 - RNA, 16 nt, Homo sapiens
agucucuagguucuga

SEQ ID NO: 1459823 - RNA, 20 nt, Homo sapiens
agucucuguguaaucaucug

SEQ ID NO: 1459824 - RNA, 13 nt, Homo sapiens
agucugaaacugg

SEQ ID NO: 1459825 - RNA, 13 nt, Homo sapiens
agucugaacagcu

SEQ ID NO: 1459826 - RNA, 13 nt, Homo sapiens
agucugaagcugg

SEQ ID NO: 1459827 - RNA, 18 nt, Homo sapiens
agucugaggccugaguga

SEQ ID NO: 1459828 - RNA, 21 nt, Homo sapiens
agucugcccuauggauuugaa

SEQ ID NO: 1459829 - RNA, 12 nt, Homo sapiens
agucuggcaaca

SEQ ID NO: 1459830 - RNA, 19 nt, Homo sapiens
agucugucugucugaugau

SEQ ID NO: 1459831 - RNA, 20 nt, Homo sapiens
agucuuccacuucaaugcac

SEQ ID NO: 1459832 - RNA, 19 nt, Homo sapiens
agucuucucauagcauuaa

SEQ ID NO: 1459833 - RNA, 23 nt, Homo sapiens
agucuugguuucucucuacagug

SEQ ID NO: 1459834 - RNA, 20 nt, Homo sapiens
agugaaaauuuuuacauuca

SEQ ID NO: 1459835 - RNA, 20 nt, Homo sapiens
agugaagaugccagugaaac

SEQ ID NO: 1459836 - RNA, 14 nt, Homo sapiens
agugaaucuguauu

SEQ ID NO: 1459837 - RNA, 23 nt, Homo sapiens
agugacaaaauagacaauuugca

SEQ ID NO: 1459838 - RNA, 16 nt, Homo sapiens
agugacaaaccaucca

SEQ ID NO: 1459839 - RNA, 14 nt, Homo sapiens
agugacacagcagc

SEQ ID NO: 1459840 - RNA, 15 nt, Homo sapiens
agugacacagcagcu

SEQ ID NO: 1459841 - RNA, 12 nt, Homo sapiens
agugaccuggaa

SEQ ID NO: 1459842 - RNA, 21 nt, Homo sapiens
agugaccuuuucuucauuuug

SEQ ID NO: 1459843 - RNA, 13 nt, Homo sapiens
agugacugacccc

SEQ ID NO: 1459844 - RNA, 20 nt, Homo sapiens
agugacuggugccaguguca

SEQ ID NO: 1459845 - RNA, 14 nt, Homo sapiens
agugagacuguguu

SEQ ID NO: 1459846 - RNA, 22 nt, Homo sapiens
agugaggagcccauacucagcc

SEQ ID NO: 1459847 - RNA, 22 nt, Homo sapiens
agugagggucuucuuacaugca

SEQ ID NO: 1459848 - RNA, 21 nt, Homo sapiens
auuuuaaaggcagagaaguuc

SEQ ID NO: 1459849 - RNA, 19 nt, Homo sapiens
auuuuaaaguaaaagucua

SEQ ID NO: 1459850 - RNA, 17 nt, Homo sapiens
auuuuaagaauuucaca

SEQ ID NO: 1459851 - RNA, 19 nt, Homo sapiens
auuuuaagaauuucacaag

SEQ ID NO: 1459852 - RNA, 17 nt, Homo sapiens
auuuuacacaaagggaa

SEQ ID NO: 1459853 - RNA, 18 nt, Homo sapiens
auuuuacaggugcgaaug

SEQ ID NO: 1459854 - RNA, 20 nt, Homo sapiens
auuuuagaauaaauucccaa

SEQ ID NO: 1459855 - RNA, 15 nt, Homo sapiens
auuuuaucugcuaug

SEQ ID NO: 1459856 - RNA, 17 nt, Homo sapiens
auuuuaugagacagggu

SEQ ID NO: 1459857 - RNA, 21 nt, Homo sapiens
auuuucacuagguuugaauga

SEQ ID NO: 1459858 - RNA, 15 nt, Homo sapiens
auuuucagccuacag

SEQ ID NO: 1459859 - RNA, 12 nt, Homo sapiens
auuuucaguaua

SEQ ID NO: 1459860 - RNA, 14 nt, Homo sapiens
auuuucaguauaau

SEQ ID NO: 1459861 - RNA, 15 nt, Homo sapiens
auuuucauucauuca

SEQ ID NO: 1459862 - RNA, 23 nt, Homo sapiens
auuuucccagucugugaagucaa

SEQ ID NO: 1459863 - RNA, 18 nt, Homo sapiens
auuuuccuguucagugag

SEQ ID NO: 1459864 - RNA, 17 nt, Homo sapiens
auuuuccuuuguagcua

SEQ ID NO: 1459865 - RNA, 14 nt, Homo sapiens
auuuucuacuguaa

SEQ ID NO: 1459866 - RNA, 15 nt, Homo sapiens
auuuucuuaaaccaa

SEQ ID NO: 1459867 - RNA, 11 nt, Homo sapiens
auuuucuugcu

SEQ ID NO: 1459868 - RNA, 17 nt, Homo sapiens
auuuugagaucaucagu

SEQ ID NO: 1459869 - RNA, 15 nt, Homo sapiens
auuuugaguucuaca

SEQ ID NO: 1459870 - RNA, 14 nt, Homo sapiens
auuuugcauuccag

SEQ ID NO: 1459871 - RNA, 15 nt, Homo sapiens
auuuugcauuccaga

SEQ ID NO: 1459872 - RNA, 15 nt, Homo sapiens
auuuuggccaaagug

SEQ ID NO: 1459873 - RNA, 18 nt, Homo sapiens
auuuugggaagaaaaccu

SEQ ID NO: 1459874 - RNA, 18 nt, Homo sapiens
auuuugggguaagacuuu

SEQ ID NO: 1459875 - RNA, 13 nt, Homo sapiens
auuuugguacuuu

SEQ ID NO: 1459876 - RNA, 17 nt, Homo sapiens
auuuugugaugaugcug

SEQ ID NO: 1459877 - RNA, 19 nt, Homo sapiens
auuuuguuuuaauccuuaa

SEQ ID NO: 1459878 - RNA, 19 nt, Homo sapiens
auuuuuaaggauguugcca

SEQ ID NO: 1459879 - RNA, 12 nt, Homo sapiens
auuuuuacuuca

SEQ ID NO: 1459880 - RNA, 22 nt, Homo sapiens
auuuuucaauauauugaacuuu

SEQ ID NO: 1459881 - RNA, 23 nt, Homo sapiens
auuuuucacuuugcucucaauua

SEQ ID NO: 1459882 - RNA, 22 nt, Homo sapiens
auuuuucagcacuuaacuacuu

SEQ ID NO: 1459883 - RNA, 23 nt, Homo sapiens
auuuuugaaaaaaguacauauuu

SEQ ID NO: 1459884 - RNA, 18 nt, Homo sapiens
auuuuugaagcaaagaag

SEQ ID NO: 1459885 - RNA, 23 nt, Homo sapiens
auuuuuggggaaaaaagcacaua

SEQ ID NO: 1459886 - RNA, 19 nt, Homo sapiens
auuuuuguuaguuuacaau

SEQ ID NO: 1459887 - RNA, 15 nt, Homo sapiens
auuuuuuaauaaaga

SEQ ID NO: 1459888 - RNA, 15 nt, Homo sapiens
auuuuuuuaaacaua

SEQ ID NO: 1459889 - RNA, 19 nt, Homo sapiens
auuuuuuuugagaccgagu

SEQ ID NO: 1459890 - RNA, 20 nt, Homo sapiens
caaaaaaaaccuucagugaa

SEQ ID NO: 1459891 - RNA, 16 nt, Homo sapiens
caaaaaaacaaaaaag

SEQ ID NO: 1459892 - RNA, 19 nt, Homo sapiens
caaaaaaaccucuaugcaa

SEQ ID NO: 1459893 - RNA, 16 nt, Homo sapiens
caaaaaacuacuucuu

SEQ ID NO: 1459894 - RNA, 21 nt, Homo sapiens
caaaaaagucaacaaacugca

SEQ ID NO: 1459895 - RNA, 18 nt, Homo sapiens
caaaaagccuuuuccaga

SEQ ID NO: 1459896 - RNA, 19 nt, Homo sapiens
caaaaaucguuuugcccga

SEQ ID NO: 1459897 - RNA, 21 nt, Homo sapiens
caaaaaugaaagcaugucuca

SEQ ID NO: 1459898 - RNA, 23 nt, Homo sapiens
caaaaaugaaagcaugucucaau

SEQ ID NO: 1459899 - RNA, 15 nt, Homo sapiens
caaaaauuagcugug

SEQ ID NO: 1459900 - RNA, 20 nt, Homo sapiens
caaaaauuauugauugcuuu

SEQ ID NO: 1459901 - RNA, 20 nt, Homo sapiens
caaaacucagagaaaugugu

SEQ ID NO: 1459902 - RNA, 23 nt, Homo sapiens
caaaacucucugguuuacuucaa

SEQ ID NO: 1459903 - RNA, 16 nt, Homo sapiens
caaaacugacaguaaa

SEQ ID NO: 1459904 - RNA, 22 nt, Homo sapiens
caaaagaggagcacuuccaaaa

SEQ ID NO: 1459905 - RNA, 15 nt, Homo sapiens
caaaaggcagcucac

SEQ ID NO: 1459906 - RNA, 16 nt, Homo sapiens
caaaaggcagcucacc

SEQ ID NO: 1459907 - RNA, 15 nt, Homo sapiens
caaaagggcuuccua

SEQ ID NO: 1459908 - RNA, 21 nt, Homo sapiens
caaaaguuucuuacucaagga

SEQ ID NO: 1459909 - RNA, 22 nt, Homo sapiens
caaaaguuucuuacucaaggaa

SEQ ID NO: 1459910 - RNA, 17 nt, Homo sapiens
caaaauagucuucucaa

SEQ ID NO: 1459911 - RNA, 12 nt, Homo sapiens
caaaaugucuca

SEQ ID NO: 1459912 - RNA, 15 nt, Homo sapiens
caaaaugugaugcuu

SEQ ID NO: 1459913 - RNA, 14 nt, Homo sapiens
caaaauguucacaa

SEQ ID NO: 1459914 - RNA, 13 nt, Homo sapiens
caaaauugaugug

SEQ ID NO: 1459915 - RNA, 19 nt, Homo sapiens
caaaauugcaaaucuugaa

SEQ ID NO: 1459916 - RNA, 18 nt, Homo sapiens
caaacacugcaguuuccu

SEQ ID NO: 1459917 - RNA, 17 nt, Homo sapiens
caaacagaacaggguca

SEQ ID NO: 1459918 - RNA, 17 nt, Homo sapiens
caaacagaacugcaguc

SEQ ID NO: 1459919 - RNA, 13 nt, Homo sapiens
caaacaggcaguu

SEQ ID NO: 1459920 - RNA, 22 nt, Homo sapiens
caaacaggcaguuggccagaga

SEQ ID NO: 1459921 - RNA, 21 nt, Homo sapiens
caaaccaaaccccguagcucc

SEQ ID NO: 1459922 - RNA, 15 nt, Homo sapiens
caaaccagacaccug

SEQ ID NO: 1459923 - RNA, 15 nt, Homo sapiens
caaaccauugcucuu

SEQ ID NO: 1459924 - RNA, 13 nt, Homo sapiens
caaacccauuccc

SEQ ID NO: 1459925 - RNA, 17 nt, Homo sapiens
caaaccugaccacagaa

SEQ ID NO: 1459926 - RNA, 19 nt, Homo sapiens
caaaccuguagaugcagaa

SEQ ID NO: 1459927 - RNA, 22 nt, Homo sapiens
caaaccuucugccuuugauguu

SEQ ID NO: 1459928 - RNA, 19 nt, Homo sapiens
caaacuacaauuaaaacua

SEQ ID NO: 1459929 - RNA, 17 nt, Homo sapiens
caaacucauuggcuuaa

SEQ ID NO: 1459930 - RNA, 15 nt, Homo sapiens
caaacuccugaccuc

SEQ ID NO: 1459931 - RNA, 20 nt, Homo sapiens
caaacuguagaaaugaugau

SEQ ID NO: 1459932 - RNA, 14 nt, Homo sapiens
caaacuuccaguca

SEQ ID NO: 1459933 - RNA, 16 nt, Homo sapiens
caaacuuuuauacucu

SEQ ID NO: 1459934 - RNA, 15 nt, Homo sapiens
caaagaaagaugaaa

SEQ ID NO: 1459935 - RNA, 14 nt, Homo sapiens
caaagacuguaaau

SEQ ID NO: 1459936 - RNA, 22 nt, Homo sapiens
caaagaguauguuguaagaaag

SEQ ID NO: 1459937 - RNA, 18 nt, Homo sapiens
caaagauaauuuauuuca

SEQ ID NO: 1459938 - RNA, 17 nt, Homo sapiens
caaagauauauacacag

SEQ ID NO: 1459939 - RNA, 23 nt, Homo sapiens
caaagcaaguuucaucagucaau

SEQ ID NO: 1459940 - RNA, 23 nt, Homo sapiens
caaagcagccacgaggugcaaca

SEQ ID NO: 1459941 - RNA, 22 nt, Homo sapiens
caaagcggucccugucccucua

SEQ ID NO: 1459942 - RNA, 23 nt, Homo sapiens
caaagcguuucuuuacuucucac

SEQ ID NO: 1459943 - RNA, 14 nt, Homo sapiens
caaaggaugugaua

SEQ ID NO: 1459944 - RNA, 17 nt, Homo sapiens
caaaggcauaucuucua

SEQ ID NO: 1459945 - RNA, 17 nt, Homo sapiens
caaaggggacagcugug

SEQ ID NO: 1459946 - RNA, 15 nt, Homo sapiens
caaaguagcaauuuc

SEQ ID NO: 1459947 - RNA, 18 nt, Homo sapiens
caaaguccuuuuuuucca

SEQ ID NO: 1459948 - RNA, 20 nt, Homo sapiens
caaagugacuguuuggcuua

SEQ ID NO: 1459949 - RNA, 17 nt, Homo sapiens
auaaauguacauuaauu

SEQ ID NO: 1459950 - RNA, 14 nt, Homo sapiens
auaaauuauggcau

SEQ ID NO: 1459951 - RNA, 20 nt, Homo sapiens
auaacaaaauggacauggug

SEQ ID NO: 1459952 - RNA, 15 nt, Homo sapiens
auaacaaugacacua

SEQ ID NO: 1459953 - RNA, 17 nt, Homo sapiens
auaacaccagugggaau

SEQ ID NO: 1459954 - RNA, 19 nt, Homo sapiens
auaacacuggcuucaggca

SEQ ID NO: 1459955 - RNA, 12 nt, Homo sapiens
auaacacugucu

SEQ ID NO: 1459956 - RNA, 12 nt, Homo sapiens
auaacagaauua

SEQ ID NO: 1459957 - RNA, 13 nt, Homo sapiens
auaacagaauuaa

SEQ ID NO: 1459958 - RNA, 19 nt, Homo sapiens
auaacagccgcuccagagu

SEQ ID NO: 1459959 - RNA, 21 nt, Homo sapiens
auaacccuaggaauuuagaca

SEQ ID NO: 1459960 - RNA, 19 nt, Homo sapiens
auaaccuuuuuguauauca

SEQ ID NO: 1459961 - RNA, 23 nt, Homo sapiens
auaacucuacccuggcacuauaa

SEQ ID NO: 1459962 - RNA, 23 nt, Homo sapiens
auaacucuguaaaaacacugaaa

SEQ ID NO: 1459963 - RNA, 14 nt, Homo sapiens
auaacuucugaccu

SEQ ID NO: 1459964 - RNA, 21 nt, Homo sapiens
auaagaauuuuucagcacuua

SEQ ID NO: 1459965 - RNA, 13 nt, Homo sapiens
auaagacauuugu

SEQ ID NO: 1459966 - RNA, 13 nt, Homo sapiens
auaagacuacuau

SEQ ID NO: 1459967 - RNA, 14 nt, Homo sapiens
auaagagauccuuu

SEQ ID NO: 1459968 - RNA, 13 nt, Homo sapiens
auaagagauuugg

SEQ ID NO: 1459969 - RNA, 19 nt, Homo sapiens
auaagcaaaaacaaaaaga

SEQ ID NO: 1459970 - RNA, 17 nt, Homo sapiens
auaagccacucuguccc

SEQ ID NO: 1459971 - RNA, 23 nt, Homo sapiens
auaaguacuagaugcaucacugg

SEQ ID NO: 1459972 - RNA, 17 nt, Homo sapiens
auaagugcuauugcaga

SEQ ID NO: 1459973 - RNA, 21 nt, Homo sapiens
auaauaaaacuaaacuuucau

SEQ ID NO: 1459974 - RNA, 12 nt, Homo sapiens
auaauaaaucac

SEQ ID NO: 1459975 - RNA, 12 nt, Homo sapiens
auaauauacaug

SEQ ID NO: 1459976 - RNA, 16 nt, Homo sapiens
auaauaucaugugcac

SEQ ID NO: 1459977 - RNA, 24 nt, Homo sapiens
auaauauccagccucccacaagaa

SEQ ID NO: 1459978 - RNA, 16 nt, Homo sapiens
auaaucccagcacuuu

SEQ ID NO: 1459979 - RNA, 14 nt, Homo sapiens
auaaucuaauuaca

SEQ ID NO: 1459980 - RNA, 12 nt, Homo sapiens
auaaucuacucc

SEQ ID NO: 1459981 - RNA, 21 nt, Homo sapiens
auaaucuuuggguaacuucaa

SEQ ID NO: 1459982 - RNA, 16 nt, Homo sapiens
auaaugauaguuauaa

SEQ ID NO: 1459983 - RNA, 20 nt, Homo sapiens
auaauggcaucaauauacau

SEQ ID NO: 1459984 - RNA, 19 nt, Homo sapiens
auaauguaaacgcaaacag

SEQ ID NO: 1459985 - RNA, 19 nt, Homo sapiens
auaauguuaacauggacau

SEQ ID NO: 1459986 - RNA, 16 nt, Homo sapiens
auaauuauuuauguga

SEQ ID NO: 1459987 - RNA, 22 nt, Homo sapiens
auaauucagcacuuaacuauga

SEQ ID NO: 1459988 - RNA, 16 nt, Homo sapiens
auaauucuacuuugag

SEQ ID NO: 1459989 - RNA, 15 nt, Homo sapiens
auaauuuaacuucag

SEQ ID NO: 1459990 - RNA, 14 nt, Homo sapiens
auaauuucuacucu

SEQ ID NO: 1459991 - RNA, 20 nt, Homo sapiens
auaauuucuagaaacaaaca

SEQ ID NO: 1459992 - RNA, 16 nt, Homo sapiens
auaauuuuagacauuc

SEQ ID NO: 1459993 - RNA, 15 nt, Homo sapiens
auacaacaggcagug

SEQ ID NO: 1459994 - RNA, 21 nt, Homo sapiens
auacaaggugagugugacuuc

SEQ ID NO: 1459995 - RNA, 16 nt, Homo sapiens
auacacagaugaaggu

SEQ ID NO: 1459996 - RNA, 23 nt, Homo sapiens
auacacguuacugaucuuacuca

SEQ ID NO: 1459997 - RNA, 13 nt, Homo sapiens
auacacuaugaag

SEQ ID NO: 1459998 - RNA, 20 nt, Homo sapiens
auacacuuuuuaaaaucuca

SEQ ID NO: 1459999 - RNA, 21 nt, Homo sapiens
auacagauagaguuccauaua

SEQ ID NO: 1460000 - RNA, 17 nt, Homo sapiens
caaagugcggcugccau

SEQ ID NO: 1460001 - RNA, 11 nt, Homo sapiens
caaagugcugg

SEQ ID NO: 1460002 - RNA, 15 nt, Homo sapiens
caaaguguauacaug

SEQ ID NO: 1460003 - RNA, 22 nt, Homo sapiens
caaaguuaaaagcaaacacuua

SEQ ID NO: 1460004 - RNA, 20 nt, Homo sapiens
caaaguuugcucaaggagaa

SEQ ID NO: 1460005 - RNA, 19 nt, Homo sapiens
caaaguuuggauuguauca

SEQ ID NO: 1460006 - RNA, 15 nt, Homo sapiens
caaauaaagugcagu

SEQ ID NO: 1460007 - RNA, 22 nt, Homo sapiens
caaauacauggauaacacauuu

SEQ ID NO: 1460008 - RNA, 22 nt, Homo sapiens
caaauagaaccacuaugaagcu

SEQ ID NO: 1460009 - RNA, 13 nt, Homo sapiens
caaauagcaaaga

SEQ ID NO: 1460010 - RNA, 19 nt, Homo sapiens
caaaucacaucucaccucc

SEQ ID NO: 1460011 - RNA, 15 nt, Homo sapiens
caaaucagcugcuac

SEQ ID NO: 1460012 - RNA, 13 nt, Homo sapiens
caaaucucuucaa

SEQ ID NO: 1460013 - RNA, 16 nt, Homo sapiens
caaaucugacauauua

SEQ ID NO: 1460014 - RNA, 20 nt, Homo sapiens
caaaucugagggagcugagu

SEQ ID NO: 1460015 - RNA, 17 nt, Homo sapiens
caaaucugauggccuua

SEQ ID NO: 1460016 - RNA, 16 nt, Homo sapiens
caaaucuugaaauuaa

SEQ ID NO: 1460017 - RNA, 18 nt, Homo sapiens
caaaucuuggguggguga

SEQ ID NO: 1460018 - RNA, 16 nt, Homo sapiens
caaaugagccaugaga

SEQ ID NO: 1460019 - RNA, 12 nt, Homo sapiens
caaaugcuauau

SEQ ID NO: 1460020 - RNA, 19 nt, Homo sapiens
caaauggggccagauccag

SEQ ID NO: 1460021 - RNA, 23 nt, Homo sapiens
caaaugucuucaugaccuacuuc

SEQ ID NO: 1460022 - RNA, 13 nt, Homo sapiens
caaaugugcugcu

SEQ ID NO: 1460023 - RNA, 23 nt, Homo sapiens
caaauucauuuuuuucacuggag

SEQ ID NO: 1460024 - RNA, 19 nt, Homo sapiens
caaauugcugggauuacag

SEQ ID NO: 1460025 - RNA, 23 nt, Homo sapiens
caacaaaauggucauccaaacuc

SEQ ID NO: 1460026 - RNA, 19 nt, Homo sapiens
caacaaagccaacagucaa

SEQ ID NO: 1460027 - RNA, 17 nt, Homo sapiens
caacaacaacaaaaagc

SEQ ID NO: 1460028 - RNA, 15 nt, Homo sapiens
caacaagaccaccac

SEQ ID NO: 1460029 - RNA, 20 nt, Homo sapiens
caacaauugugugaauuaau

SEQ ID NO: 1460030 - RNA, 20 nt, Homo sapiens
caacacaugucuagcuuuca

SEQ ID NO: 1460031 - RNA, 19 nt, Homo sapiens
caacaccccucccugccac

SEQ ID NO: 1460032 - RNA, 11 nt, Homo sapiens
caacacuggaa

SEQ ID NO: 1460033 - RNA, 12 nt, Homo sapiens
caacagccaugc

SEQ ID NO: 1460034 - RNA, 19 nt, Homo sapiens
caacaggcuuaugaauaua

SEQ ID NO: 1460035 - RNA, 15 nt, Homo sapiens
caacauaggccugcu

SEQ ID NO: 1460036 - RNA, 20 nt, Homo sapiens
caacauauauuuauugagua

SEQ ID NO: 1460037 - RNA, 21 nt, Homo sapiens
caacaucgugaaaccccaucu

SEQ ID NO: 1460038 - RNA, 15 nt, Homo sapiens
caacaugcuccaaau

SEQ ID NO: 1460039 - RNA, 12 nt, Homo sapiens
caaccaauucca

SEQ ID NO: 1460040 - RNA, 13 nt, Homo sapiens
caaccacaugcag

SEQ ID NO: 1460041 - RNA, 12 nt, Homo sapiens
caaccacugugg

SEQ ID NO: 1460042 - RNA, 17 nt, Homo sapiens
caaccccugcuccaguc

SEQ ID NO: 1460043 - RNA, 14 nt, Homo sapiens
caacccgagucauu

SEQ ID NO: 1460044 - RNA, 14 nt, Homo sapiens
caaccuaugcacca

SEQ ID NO: 1460045 - RNA, 13 nt, Homo sapiens
caaccucuuugcu

SEQ ID NO: 1460046 - RNA, 17 nt, Homo sapiens
caaccucuuuuuccucc

SEQ ID NO: 1460047 - RNA, 21 nt, Homo sapiens
caaccugaaauuuauucacau

SEQ ID NO: 1460048 - RNA, 16 nt, Homo sapiens
caaccuggcaaaaaug

SEQ ID NO: 1460049 - RNA, 23 nt, Homo sapiens
caaccuguuuuggucacaucacu

SEQ ID NO: 1460050 - RNA, 13 nt, Homo sapiens
caagcacuuuaau

SEQ ID NO: 1460051 - RNA, 20 nt, Homo sapiens
caagcagcugaagaaaaaau

SEQ ID NO: 1460052 - RNA, 20 nt, Homo sapiens
caagcauugcuucagaauga

SEQ ID NO: 1460053 - RNA, 23 nt, Homo sapiens
caagcauuuugugaacuagggaa

SEQ ID NO: 1460054 - RNA, 18 nt, Homo sapiens
caagccacaagucuucca

SEQ ID NO: 1460055 - RNA, 22 nt, Homo sapiens
caagccagcuuacuagcacuuu

SEQ ID NO: 1460056 - RNA, 22 nt, Homo sapiens
caagcuaaaauuagaugaacuc

SEQ ID NO: 1460057 - RNA, 17 nt, Homo sapiens
caagcugaccuugcuga

SEQ ID NO: 1460058 - RNA, 12 nt, Homo sapiens
caagcugcauuu

SEQ ID NO: 1460059 - RNA, 18 nt, Homo sapiens
caagcuuguuaucagcuu

SEQ ID NO: 1460060 - RNA, 20 nt, Homo sapiens
caagcuuuguauauaaauga

SEQ ID NO: 1460061 - RNA, 14 nt, Homo sapiens
caagcuuuugcuug

SEQ ID NO: 1460062 - RNA, 20 nt, Homo sapiens
caaggaaaaacaggucuuca

SEQ ID NO: 1460063 - RNA, 22 nt, Homo sapiens
caaggaaacccccaguguaaua

SEQ ID NO: 1460064 - RNA, 15 nt, Homo sapiens
caaggaauaaaugag

SEQ ID NO: 1460065 - RNA, 18 nt, Homo sapiens
caaggaaugccugugcca

SEQ ID NO: 1460066 - RNA, 22 nt, Homo sapiens
caaggacguggaugacccuccc

SEQ ID NO: 1460067 - RNA, 22 nt, Homo sapiens
caaggagaaugaauacugggaa

SEQ ID NO: 1460068 - RNA, 18 nt, Homo sapiens
caaggagcacaagccaca

SEQ ID NO: 1460069 - RNA, 18 nt, Homo sapiens
caaggaguacuccaagac

SEQ ID NO: 1460070 - RNA, 17 nt, Homo sapiens
caaggccagaugcacau

SEQ ID NO: 1460071 - RNA, 15 nt, Homo sapiens
caaggccagugcuaa

SEQ ID NO: 1460072 - RNA, 24 nt, Homo sapiens
caaggcccugagcuuuguccugaa

SEQ ID NO: 1460073 - RNA, 17 nt, Homo sapiens
caaggccugguguuucu

SEQ ID NO: 1460074 - RNA, 15 nt, Homo sapiens
caaggcuuuaucuca

SEQ ID NO: 1460075 - RNA, 16 nt, Homo sapiens
caagggacccaugagu

SEQ ID NO: 1460076 - RNA, 20 nt, Homo sapiens
caaggguucuuggugaugcu

SEQ ID NO: 1460077 - RNA, 15 nt, Homo sapiens
caaggucauuucuuc

SEQ ID NO: 1460078 - RNA, 22 nt, Homo sapiens
caagguccucucaguucucucc

SEQ ID NO: 1460079 - RNA, 12 nt, Homo sapiens
caaggucugcuc

SEQ ID NO: 1460080 - RNA, 12 nt, Homo sapiens
caaggugacaaa

SEQ ID NO: 1460081 - RNA, 23 nt, Homo sapiens
caaggugggccuugcuaccucaa

SEQ ID NO: 1460082 - RNA, 18 nt, Homo sapiens
caagguggggggaucaca

SEQ ID NO: 1460083 - RNA, 17 nt, Homo sapiens
caagguggucaguaaau

SEQ ID NO: 1460084 - RNA, 21 nt, Homo sapiens
caagguggucaguaaauaaca

SEQ ID NO: 1460085 - RNA, 16 nt, Homo sapiens
caaguaaaaaggcuaa

SEQ ID NO: 1460086 - RNA, 21 nt, Homo sapiens
caaguaagaaagugaagcaaa

SEQ ID NO: 1460087 - RNA, 14 nt, Homo sapiens
caaguauaugugaa

SEQ ID NO: 1460088 - RNA, 19 nt, Homo sapiens
caaguauguugagaguugc

SEQ ID NO: 1460089 - RNA, 21 nt, Homo sapiens
caaguauguugagaguugcug

SEQ ID NO: 1460090 - RNA, 21 nt, Homo sapiens
caaguauguuuguacaguaug

SEQ ID NO: 1460091 - RNA, 17 nt, Homo sapiens
caaguccuuaccucuuc

SEQ ID NO: 1460092 - RNA, 21 nt, Homo sapiens
caagugagagagaugggagcu

SEQ ID NO: 1460093 - RNA, 17 nt, Homo sapiens
caagugcgugccgugug

SEQ ID NO: 1460094 - RNA, 12 nt, Homo sapiens
caaguggcaugu

SEQ ID NO: 1460095 - RNA, 16 nt, Homo sapiens
caagugggaucuguca

SEQ ID NO: 1460096 - RNA, 20 nt, Homo sapiens
caagugguaugaccagugau

SEQ ID NO: 1460097 - RNA, 20 nt, Homo sapiens
caagugguguuuauugcaau

SEQ ID NO: 1460098 - RNA, 17 nt, Homo sapiens
caagugugcacuccagc

SEQ ID NO: 1460099 - RNA, 17 nt, Homo sapiens
caaguuacagugaugcu

SEQ ID NO: 1460100 - RNA, 18 nt, Homo sapiens
caaguuacucugccuuuc

SEQ ID NO: 1460101 - RNA, 18 nt, Homo sapiens
caaguugcuuuuaccuga

SEQ ID NO: 1460102 - RNA, 20 nt, Homo sapiens
caaguuucugauaccacugc

SEQ ID NO: 1460103 - RNA, 17 nt, Homo sapiens
caauaaagcacugagca

SEQ ID NO: 1460104 - RNA, 15 nt, Homo sapiens
caauaaaucuuucaa

SEQ ID NO: 1460105 - RNA, 13 nt, Homo sapiens
caauaacaaacug

SEQ ID NO: 1460106 - RNA, 18 nt, Homo sapiens
caauaacuacuguguucc

SEQ ID NO: 1460107 - RNA, 19 nt, Homo sapiens
caauaauauaauaauaguu

SEQ ID NO: 1460108 - RNA, 16 nt, Homo sapiens
caauauauugaacuuu

SEQ ID NO: 1460109 - RNA, 18 nt, Homo sapiens
caauauccaaaccaaaua

SEQ ID NO: 1460110 - RNA, 18 nt, Homo sapiens
caauauuaugaaauuuca

SEQ ID NO: 1460111 - RNA, 13 nt, Homo sapiens
caauauugccaug

SEQ ID NO: 1460112 - RNA, 18 nt, Homo sapiens
caauauuuuuauaucaug

SEQ ID NO: 1460113 - RNA, 17 nt, Homo sapiens
caaucaugaaauaugca

SEQ ID NO: 1460114 - RNA, 15 nt, Homo sapiens
caaucauuucuauua

SEQ ID NO: 1460115 - RNA, 20 nt, Homo sapiens
caaucccacguacuuauaaa

SEQ ID NO: 1460116 - RNA, 18 nt, Homo sapiens
caauccgaaguaugaggg

SEQ ID NO: 1460117 - RNA, 15 nt, Homo sapiens
caauccuuuaccacu

SEQ ID NO: 1460118 - RNA, 15 nt, Homo sapiens
caaucuauguuugca

SEQ ID NO: 1460119 - RNA, 18 nt, Homo sapiens
caaucuauguuugcacuu

SEQ ID NO: 1460120 - RNA, 19 nt, Homo sapiens
caaucuguaaaacuaagaa

SEQ ID NO: 1460121 - RNA, 13 nt, Homo sapiens
caaucuuugccuu

SEQ ID NO: 1460122 - RNA, 15 nt, Homo sapiens
caaucuuugccuuua

SEQ ID NO: 1460123 - RNA, 20 nt, Homo sapiens
caaucuuugccuuuaucucu

SEQ ID NO: 1460124 - RNA, 21 nt, Homo sapiens
caaugaaaaauguaauuuaga

SEQ ID NO: 1460125 - RNA, 16 nt, Homo sapiens
caaugaacaucccuuu

SEQ ID NO: 1460126 - RNA, 15 nt, Homo sapiens
caaugaaccacaaaa

SEQ ID NO: 1460127 - RNA, 16 nt, Homo sapiens
caaugaagaaguuucu

SEQ ID NO: 1460128 - RNA, 21 nt, Homo sapiens
caaugacaucucaggggccag

SEQ ID NO: 1460129 - RNA, 18 nt, Homo sapiens
caaugagauugaauuuca

SEQ ID NO: 1460130 - RNA, 19 nt, Homo sapiens
caaugauauugacacuguc

SEQ ID NO: 1460131 - RNA, 14 nt, Homo sapiens
caaugaugauuaaa

SEQ ID NO: 1460132 - RNA, 14 nt, Homo sapiens
caaugccauuucag

SEQ ID NO: 1460133 - RNA, 15 nt, Homo sapiens
caaugcccagaucaa

SEQ ID NO: 1460134 - RNA, 23 nt, Homo sapiens
caaugccccuggaucuaccagca

SEQ ID NO: 1460135 - RNA, 16 nt, Homo sapiens
caaugcuccaucccaa

SEQ ID NO: 1460136 - RNA, 16 nt, Homo sapiens
caauggagacugucuc

SEQ ID NO: 1460137 - RNA, 18 nt, Homo sapiens
caauggaguggcugccau

SEQ ID NO: 1460138 - RNA, 21 nt, Homo sapiens
caauggaguggcugccaugga

SEQ ID NO: 1460139 - RNA, 20 nt, Homo sapiens
caaugggacuggagucagau

SEQ ID NO: 1460140 - RNA, 19 nt, Homo sapiens
caaugggagcugaggccac

SEQ ID NO: 1460141 - RNA, 16 nt, Homo sapiens
caaugggcucuuccaa

SEQ ID NO: 1460142 - RNA, 15 nt, Homo sapiens
caaugucaaugugaa

SEQ ID NO: 1460143 - RNA, 20 nt, Homo sapiens
caaugucacaaccucucuga

SEQ ID NO: 1460144 - RNA, 19 nt, Homo sapiens
caaugucaggaacagaagg

SEQ ID NO: 1460145 - RNA, 16 nt, Homo sapiens
caaugucugcugagga

SEQ ID NO: 1460146 - RNA, 17 nt, Homo sapiens
caaugucugguuaguua

SEQ ID NO: 1460147 - RNA, 17 nt, Homo sapiens
caaugugaacuuuauua

SEQ ID NO: 1460148 - RNA, 13 nt, Homo sapiens
caauguucuauua

SEQ ID NO: 1460149 - RNA, 22 nt, Homo sapiens
caauuaaaaaaaauuaaaacca

SEQ ID NO: 1460150 - RNA, 18 nt, Homo sapiens
caauucaaauugacugaa

SEQ ID NO: 1460151 - RNA, 22 nt, Homo sapiens
ccaguguccccuccacugucac

SEQ ID NO: 1460152 - RNA, 22 nt, Homo sapiens
ccaguguggaguggguaaucca

SEQ ID NO: 1460153 - RNA, 18 nt, Homo sapiens
ccaguguuguuuguaaau

SEQ ID NO: 1460154 - RNA, 15 nt, Homo sapiens
ccaguucacccugau

SEQ ID NO: 1460155 - RNA, 19 nt, Homo sapiens
ccaguugaucaaugaauaa

SEQ ID NO: 1460156 - RNA, 12 nt, Homo sapiens
ccauaacagcca

SEQ ID NO: 1460157 - RNA, 19 nt, Homo sapiens
ccauaauccuuucugccga

SEQ ID NO: 1460158 - RNA, 15 nt, Homo sapiens
ccauaauuauuauuu

SEQ ID NO: 1460159 - RNA, 22 nt, Homo sapiens
ccauaauuauuauuuccagugu

SEQ ID NO: 1460160 - RNA, 16 nt, Homo sapiens
ccauaguaccauuuau

SEQ ID NO: 1460161 - RNA, 14 nt, Homo sapiens
ccauaguauaauca

SEQ ID NO: 1460162 - RNA, 22 nt, Homo sapiens
ccauagucgugccuguuugcuu

SEQ ID NO: 1460163 - RNA, 19 nt, Homo sapiens
ccauaucccuuccucucag

SEQ ID NO: 1460164 - RNA, 12 nt, Homo sapiens
ccaucagacugu

SEQ ID NO: 1460165 - RNA, 15 nt, Homo sapiens
ccaucagacugucaa

SEQ ID NO: 1460166 - RNA, 19 nt, Homo sapiens
ccaucauccuuuguucuga

SEQ ID NO: 1460167 - RNA, 22 nt, Homo sapiens
ccauccagccgcugcacaucac

SEQ ID NO: 1460168 - RNA, 14 nt, Homo sapiens
ccauccaucuuucc

SEQ ID NO: 1460169 - RNA, 20 nt, Homo sapiens
ccauccaucuuuccauccau

SEQ ID NO: 1460170 - RNA, 17 nt, Homo sapiens
ccauccauuaccuccau

SEQ ID NO: 1460171 - RNA, 15 nt, Homo sapiens
ccauccucacugcug

SEQ ID NO: 1460172 - RNA, 16 nt, Homo sapiens
ccauccuguauucuuc

SEQ ID NO: 1460173 - RNA, 23 nt, Homo sapiens
ccaucgaccuggagacugacaac

SEQ ID NO: 1460174 - RNA, 17 nt, Homo sapiens
ccaucgcaggaugacag

SEQ ID NO: 1460175 - RNA, 15 nt, Homo sapiens
ccaucucgggcacag

SEQ ID NO: 1460176 - RNA, 16 nt, Homo sapiens
ccaucucuaccaucau

SEQ ID NO: 1460177 - RNA, 23 nt, Homo sapiens
ccaucugggcuuauauguacuuu

SEQ ID NO: 1460178 - RNA, 14 nt, Homo sapiens
ccaugaagaccaca

SEQ ID NO: 1460179 - RNA, 21 nt, Homo sapiens
ccaugaagcgaaacacagaga

SEQ ID NO: 1460180 - RNA, 18 nt, Homo sapiens
ccaugaccugcgcucuca

SEQ ID NO: 1460181 - RNA, 20 nt, Homo sapiens
ccaugagaugauacauccaa

SEQ ID NO: 1460182 - RNA, 21 nt, Homo sapiens
ccaugagcaccccaaggcugc

SEQ ID NO: 1460183 - RNA, 23 nt, Homo sapiens
ccaugcacccucauacacagaaa

SEQ ID NO: 1460184 - RNA, 10 nt, Homo sapiens
ccaugccacc

SEQ ID NO: 1460185 - RNA, 17 nt, Homo sapiens
ccaugccccuggaccag

SEQ ID NO: 1460186 - RNA, 15 nt, Homo sapiens
ccaugcuaacaaaga

SEQ ID NO: 1460187 - RNA, 17 nt, Homo sapiens
ccaugcucaaccacugu

SEQ ID NO: 1460188 - RNA, 12 nt, Homo sapiens
ccaugcugccag

SEQ ID NO: 1460189 - RNA, 20 nt, Homo sapiens
ccaugcugggccacugggga

SEQ ID NO: 1460190 - RNA, 19 nt, Homo sapiens
ccaugcuucucaucugcaa

SEQ ID NO: 1460191 - RNA, 14 nt, Homo sapiens
ccauggacacucca

SEQ ID NO: 1460192 - RNA, 23 nt, Homo sapiens
ccaugggagauuuggagcugucu

SEQ ID NO: 1460193 - RNA, 13 nt, Homo sapiens
ccaugguuuuacu

SEQ ID NO: 1460194 - RNA, 13 nt, Homo sapiens
ccauguccaaaga

SEQ ID NO: 1460195 - RNA, 21 nt, Homo sapiens
ccauguccaaagaggcugccc

SEQ ID NO: 1460196 - RNA, 21 nt, Homo sapiens
ccaugucuuuggacaaccaug

SEQ ID NO: 1460197 - RNA, 12 nt, Homo sapiens
ccauguuugcug

SEQ ID NO: 1460198 - RNA, 16 nt, Homo sapiens
ccauuaccuccaucca

SEQ ID NO: 1460199 - RNA, 20 nt, Homo sapiens
ccauucagagcuauggugcu

SEQ ID NO: 1460200 - RNA, 18 nt, Homo sapiens
cccagcuaagaaccugga

SEQ ID NO: 1460201 - RNA, 15 nt, Homo sapiens
cccagcuacucggga

SEQ ID NO: 1460202 - RNA, 13 nt, Homo sapiens
cccagcuugccaa

SEQ ID NO: 1460203 - RNA, 21 nt, Homo sapiens
cccaggaaagguuuuccuuau

SEQ ID NO: 1460204 - RNA, 15 nt, Homo sapiens
cccaggaaguggcca

SEQ ID NO: 1460205 - RNA, 24 nt, Homo sapiens
cccaggaguggauaacacuggcuu

SEQ ID NO: 1460206 - RNA, 19 nt, Homo sapiens
cccaggccgggguggagca

SEQ ID NO: 1460207 - RNA, 19 nt, Homo sapiens
cccaggcuggagugcagua

SEQ ID NO: 1460208 - RNA, 15 nt, Homo sapiens
cccaggcuguucucc

SEQ ID NO: 1460209 - RNA, 15 nt, Homo sapiens
cccagggaucacugg

SEQ ID NO: 1460210 - RNA, 15 nt, Homo sapiens
cccagggcagggugg

SEQ ID NO: 1460211 - RNA, 20 nt, Homo sapiens
cccagguggaaggcagacag

SEQ ID NO: 1460212 - RNA, 17 nt, Homo sapiens
cccagguggagggcaca

SEQ ID NO: 1460213 - RNA, 23 nt, Homo sapiens
cccagguggcccuaaaggacucu

SEQ ID NO: 1460214 - RNA, 13 nt, Homo sapiens
cccaguccaugcu

SEQ ID NO: 1460215 - RNA, 19 nt, Homo sapiens
cccagucccagacaauucc

SEQ ID NO: 1460216 - RNA, 17 nt, Homo sapiens
cccagugcccccacuga

SEQ ID NO: 1460217 - RNA, 19 nt, Homo sapiens
cccaguucauugcacuuug

SEQ ID NO: 1460218 - RNA, 21 nt, Homo sapiens
cccaguucauugcacuuugau

SEQ ID NO: 1460219 - RNA, 22 nt, Homo sapiens
cccaguuugauaccugcacugu

SEQ ID NO: 1460220 - RNA, 19 nt, Homo sapiens
cccauaauuauuauuucca

SEQ ID NO: 1460221 - RNA, 14 nt, Homo sapiens
cccauagcuuccau

SEQ ID NO: 1460222 - RNA, 23 nt, Homo sapiens
cccauagguggcugagcaucgga

SEQ ID NO: 1460223 - RNA, 13 nt, Homo sapiens
cccauccaaacac

SEQ ID NO: 1460224 - RNA, 15 nt, Homo sapiens
cccauccccaccagc

SEQ ID NO: 1460225 - RNA, 16 nt, Homo sapiens
cccauccccaccagcu

SEQ ID NO: 1460226 - RNA, 16 nt, Homo sapiens
cccaucucuacuaaaa

SEQ ID NO: 1460227 - RNA, 16 nt, Homo sapiens
cccauggacacuccag

SEQ ID NO: 1460228 - RNA, 13 nt, Homo sapiens
cccauggccacuu

SEQ ID NO: 1460229 - RNA, 18 nt, Homo sapiens
cccaugggggcacuugag

SEQ ID NO: 1460230 - RNA, 18 nt, Homo sapiens
cccauguuggccaggcug

SEQ ID NO: 1460231 - RNA, 14 nt, Homo sapiens
cccauuuccugcuu

SEQ ID NO: 1460232 - RNA, 14 nt, Homo sapiens
ccccaaccacagag

SEQ ID NO: 1460233 - RNA, 13 nt, Homo sapiens
ccccacaccccag

SEQ ID NO: 1460234 - RNA, 21 nt, Homo sapiens
ccccacaggcuggcgcucggc

SEQ ID NO: 1460235 - RNA, 10 nt, Homo sapiens
ccccaccaga

SEQ ID NO: 1460236 - RNA, 16 nt, Homo sapiens
ccccacccugcacuuu

SEQ ID NO: 1460237 - RNA, 11 nt, Homo sapiens
ccccacugaca

SEQ ID NO: 1460238 - RNA, 12 nt, Homo sapiens
ccccagcacuug

SEQ ID NO: 1460239 - RNA, 14 nt, Homo sapiens
ccccagcccagaga

SEQ ID NO: 1460240 - RNA, 12 nt, Homo sapiens
ccccaggacaag

SEQ ID NO: 1460241 - RNA, 14 nt, Homo sapiens
ccccaggcccuuca

SEQ ID NO: 1460242 - RNA, 19 nt, Homo sapiens
ccccaggcuggagugcagu

SEQ ID NO: 1460243 - RNA, 16 nt, Homo sapiens
ccccaggcuguucucc

SEQ ID NO: 1460244 - RNA, 15 nt, Homo sapiens
ccccaucuuuacaaa

SEQ ID NO: 1460245 - RNA, 13 nt, Homo sapiens
ccccaugcacugu

SEQ ID NO: 1460246 - RNA, 15 nt, Homo sapiens
ccccaugcacuguga

SEQ ID NO: 1460247 - RNA, 13 nt, Homo sapiens
ccccauuggcacc

SEQ ID NO: 1460248 - RNA, 21 nt, Homo sapiens
ccccauuuccuccucaucuga

SEQ ID NO: 1460249 - RNA, 18 nt, Homo sapiens
cccccaccccucugccaa

SEQ ID NO: 1460250 - RNA, 18 nt, Homo sapiens
cuccucucugggccuuug

SEQ ID NO: 1460251 - RNA, 11 nt, Homo sapiens
cuccucuguca

SEQ ID NO: 1460252 - RNA, 17 nt, Homo sapiens
cuccugaccucagguga

SEQ ID NO: 1460253 - RNA, 20 nt, Homo sapiens
cuccugaccucaggugaucc

SEQ ID NO: 1460254 - RNA, 14 nt, Homo sapiens
cuccugacuuuuaa

SEQ ID NO: 1460255 - RNA, 18 nt, Homo sapiens
cuccugcaucucaugagu

SEQ ID NO: 1460256 - RNA, 19 nt, Homo sapiens
cuccugcccagcacaggaa

SEQ ID NO: 1460257 - RNA, 23 nt, Homo sapiens
cuccugcucuuucuacaugacug

SEQ ID NO: 1460258 - RNA, 12 nt, Homo sapiens
cuccugcugcag

SEQ ID NO: 1460259 - RNA, 20 nt, Homo sapiens
cuccuggaaccuugcugucc

SEQ ID NO: 1460260 - RNA, 14 nt, Homo sapiens
cuccuguacacuga

SEQ ID NO: 1460261 - RNA, 16 nt, Homo sapiens
cuccuuccaccucccu

SEQ ID NO: 1460262 - RNA, 16 nt, Homo sapiens
cuccuucccacucuuc

SEQ ID NO: 1460263 - RNA, 16 nt, Homo sapiens
cuccuugcaggugaca

SEQ ID NO: 1460264 - RNA, 16 nt, Homo sapiens
cuccuuggcuuaccug

SEQ ID NO: 1460265 - RNA, 17 nt, Homo sapiens
cuccuuguccacccacc

SEQ ID NO: 1460266 - RNA, 16 nt, Homo sapiens
cuccuuuaauuaaugg

SEQ ID NO: 1460267 - RNA, 13 nt, Homo sapiens
cuccuuuagccau

SEQ ID NO: 1460268 - RNA, 19 nt, Homo sapiens
cuccuuuguguguguguca

SEQ ID NO: 1460269 - RNA, 22 nt, Homo sapiens
cuccuuugugugugugucagcu

SEQ ID NO: 1460270 - RNA, 14 nt, Homo sapiens
cuccuuuugaggcu

SEQ ID NO: 1460271 - RNA, 14 nt, Homo sapiens
cucgaaacacagaa

SEQ ID NO: 1460272 - RNA, 16 nt, Homo sapiens
cucgagcaguccugcc

SEQ ID NO: 1460273 - RNA, 20 nt, Homo sapiens
cucgagcaucagagcuucca

SEQ ID NO: 1460274 - RNA, 23 nt, Homo sapiens
cucgcccuccuuucugugcccua

SEQ ID NO: 1460275 - RNA, 17 nt, Homo sapiens
cucgcuuuguugcccag

SEQ ID NO: 1460276 - RNA, 23 nt, Homo sapiens
cucggccuccucccacaagcacc

SEQ ID NO: 1460277 - RNA, 20 nt, Homo sapiens
cucgggaagccccauccaac

SEQ ID NO: 1460278 - RNA, 14 nt, Homo sapiens
cucgggagccaugu

SEQ ID NO: 1460279 - RNA, 15 nt, Homo sapiens
cucuaaaagaaaaag

SEQ ID NO: 1460280 - RNA, 14 nt, Homo sapiens
cucuaaaucuuccu

SEQ ID NO: 1460281 - RNA, 14 nt, Homo sapiens
cucuaaaugcaguu

SEQ ID NO: 1460282 - RNA, 18 nt, Homo sapiens
cucuaagcucagugcucu

SEQ ID NO: 1460283 - RNA, 16 nt, Homo sapiens
cucuacagacuucucc

SEQ ID NO: 1460284 - RNA, 17 nt, Homo sapiens
cucuaccccugcuccca

SEQ ID NO: 1460285 - RNA, 16 nt, Homo sapiens
cucuacuuaaugagau

SEQ ID NO: 1460286 - RNA, 19 nt, Homo sapiens
cucuagacaagauauugua

SEQ ID NO: 1460287 - RNA, 17 nt, Homo sapiens
cucuaguaagaugcacu

SEQ ID NO: 1460288 - RNA, 21 nt, Homo sapiens
cucuagugucuuuugccuuua

SEQ ID NO: 1460289 - RNA, 24 nt, Homo sapiens
cucuaugaccucgcccuccacaaa

SEQ ID NO: 1460290 - RNA, 13 nt, Homo sapiens
cucuauucucaaa

SEQ ID NO: 1460291 - RNA, 12 nt, Homo sapiens
cucucaagucaa

SEQ ID NO: 1460292 - RNA, 19 nt, Homo sapiens
cucucaccuaaaaaaagag

SEQ ID NO: 1460293 - RNA, 18 nt, Homo sapiens
cucucagagcaucuggcu

SEQ ID NO: 1460294 - RNA, 21 nt, Homo sapiens
cucucagaggccugcugccag

SEQ ID NO: 1460295 - RNA, 15 nt, Homo sapiens
cucucagcugaccau

SEQ ID NO: 1460296 - RNA, 17 nt, Homo sapiens
cucucagcugaccauca

SEQ ID NO: 1460297 - RNA, 16 nt, Homo sapiens
cucucaguguuuugga

SEQ ID NO: 1460298 - RNA, 14 nt, Homo sapiens
cucuucccaugacu

SEQ ID NO: 1460299 - RNA, 16 nt, Homo sapiens
cucuucccaugacugc

SEQ ID NO: 1460300 - RNA, 22 nt, Homo sapiens
cucuuccuccucgcugccagau

SEQ ID NO: 1460301 - RNA, 12 nt, Homo sapiens
cucuucugcuaa

SEQ ID NO: 1460302 - RNA, 14 nt, Homo sapiens
cucuucuuacuggu

SEQ ID NO: 1460303 - RNA, 18 nt, Homo sapiens
cucuugaaguacuuaaca

SEQ ID NO: 1460304 - RNA, 20 nt, Homo sapiens
cucuugagggagcuuagcca

SEQ ID NO: 1460305 - RNA, 17 nt, Homo sapiens
cucuugagucacacugc

SEQ ID NO: 1460306 - RNA, 15 nt, Homo sapiens
cucuuggccugauca

SEQ ID NO: 1460307 - RNA, 17 nt, Homo sapiens
cucuuguauaugaugau

SEQ ID NO: 1460308 - RNA, 21 nt, Homo sapiens
cucuuguccucuucugcucuu

SEQ ID NO: 1460309 - RNA, 15 nt, Homo sapiens
cucuuucaaagcuaa

SEQ ID NO: 1460310 - RNA, 17 nt, Homo sapiens
cucuuucuacaugacug

SEQ ID NO: 1460311 - RNA, 18 nt, Homo sapiens
cucuuucuacaugacugg

SEQ ID NO: 1460312 - RNA, 16 nt, Homo sapiens
cugaaacaacuuggaa

SEQ ID NO: 1460313 - RNA, 24 nt, Homo sapiens
cugaaaccucugggucaucucuca

SEQ ID NO: 1460314 - RNA, 20 nt, Homo sapiens
cugaaagaugggcaaaagac

SEQ ID NO: 1460315 - RNA, 15 nt, Homo sapiens
cugaaagccauuugu

SEQ ID NO: 1460316 - RNA, 17 nt, Homo sapiens
cugaaagccuuagggaa

SEQ ID NO: 1460317 - RNA, 22 nt, Homo sapiens
cugaaaggauguggaagagcau

SEQ ID NO: 1460318 - RNA, 21 nt, Homo sapiens
cugaaaucuccuuuagccauc

SEQ ID NO: 1460319 - RNA, 22 nt, Homo sapiens
cugaacuuuguggucgacauca

SEQ ID NO: 1460320 - RNA, 23 nt, Homo sapiens
cugaagauugcgguuuacagcua

SEQ ID NO: 1460321 - RNA, 19 nt, Homo sapiens
cugaagcaaagaagggaau

SEQ ID NO: 1460322 - RNA, 20 nt, Homo sapiens
cugaaggggaggucacagcc

SEQ ID NO: 1460323 - RNA, 22 nt, Homo sapiens
cugaaggugauucaccaaaaua

SEQ ID NO: 1460324 - RNA, 16 nt, Homo sapiens
cugaagugucacagcc

SEQ ID NO: 1460325 - RNA, 16 nt, Homo sapiens
cugaaucagcaugaaa

SEQ ID NO: 1460326 - RNA, 14 nt, Homo sapiens
cugaaucaugagcc

SEQ ID NO: 1460327 - RNA, 23 nt, Homo sapiens
cugaauccauaaaggcauaccuu

SEQ ID NO: 1460328 - RNA, 18 nt, Homo sapiens
cugaaugacuccacuguu

SEQ ID NO: 1460329 - RNA, 15 nt, Homo sapiens
cugaaugguuuucaa

SEQ ID NO: 1460330 - RNA, 21 nt, Homo sapiens
cugaauguuuaaagaucauga

SEQ ID NO: 1460331 - RNA, 19 nt, Homo sapiens
cugaauucuucuagcuccu

SEQ ID NO: 1460332 - RNA, 20 nt, Homo sapiens
cugaauucuuuuucauuuga

SEQ ID NO: 1460333 - RNA, 19 nt, Homo sapiens
cugaauuuggccugcacua

SEQ ID NO: 1460334 - RNA, 16 nt, Homo sapiens
cugacaacaugcuagg

SEQ ID NO: 1460335 - RNA, 16 nt, Homo sapiens
cugacaagauggucca

SEQ ID NO: 1460336 - RNA, 13 nt, Homo sapiens
cugacaagcacug

SEQ ID NO: 1460337 - RNA, 12 nt, Homo sapiens
cugacacaguca

SEQ ID NO: 1460338 - RNA, 22 nt, Homo sapiens
cugacagacaaugauccaguca

SEQ ID NO: 1460339 - RNA, 22 nt, Homo sapiens
cugacaucacagcagccuccaa

SEQ ID NO: 1460340 - RNA, 16 nt, Homo sapiens
cugaccaaaacaaaca

SEQ ID NO: 1460341 - RNA, 17 nt, Homo sapiens
cugacccagugccccca

SEQ ID NO: 1460342 - RNA, 16 nt, Homo sapiens
cugaccccagugguau

SEQ ID NO: 1460343 - RNA, 13 nt, Homo sapiens
cugaccccagugu

SEQ ID NO: 1460344 - RNA, 19 nt, Homo sapiens
cugacccugcuucaaauau

SEQ ID NO: 1460345 - RNA, 20 nt, Homo sapiens
cugauggacaggugucugag

SEQ ID NO: 1460346 - RNA, 19 nt, Homo sapiens
cugauggagcucagaauuc

SEQ ID NO: 1460347 - RNA, 18 nt, Homo sapiens
cugauggccuuaauuucc

SEQ ID NO: 1460348 - RNA, 17 nt, Homo sapiens
cugauggugacauugca

SEQ ID NO: 1460349 - RNA, 19 nt, Homo sapiens
cugauguaccugaugcuau

SEQ ID NO: 1460350 - RNA, 18 nt, Homo sapiens
cugauguguccucaggga

SEQ ID NO: 1460351 - RNA, 17 nt, Homo sapiens
cugauguuaaaauucca

SEQ ID NO: 1460352 - RNA, 20 nt, Homo sapiens
cugauuagaaaugaccaaua

SEQ ID NO: 1460353 - RNA, 20 nt, Homo sapiens
cugauucuuaugauuacuau

SEQ ID NO: 1460354 - RNA, 17 nt, Homo sapiens
cugauuuuuagcuuuac

SEQ ID NO: 1460355 - RNA, 14 nt, Homo sapiens
cugcaagccaggga

SEQ ID NO: 1460356 - RNA, 16 nt, Homo sapiens
cugcaaguccacuggg

SEQ ID NO: 1460357 - RNA, 19 nt, Homo sapiens
cugcaaucugagccagugc

SEQ ID NO: 1460358 - RNA, 21 nt, Homo sapiens
cugcaaucugagccagugcuu

SEQ ID NO: 1460359 - RNA, 23 nt, Homo sapiens
cugcacagccuagacauccaggu

SEQ ID NO: 1460360 - RNA, 17 nt, Homo sapiens
cugcacccacccaggag

SEQ ID NO: 1460361 - RNA, 17 nt, Homo sapiens
cugcacccacgugcauu

SEQ ID NO: 1460362 - RNA, 18 nt, Homo sapiens
cugcacguucauaaccaa

SEQ ID NO: 1460363 - RNA, 14 nt, Homo sapiens
cugcacuacugaca

SEQ ID NO: 1460364 - RNA, 16 nt, Homo sapiens
cugcacucuaaacugc

SEQ ID NO: 1460365 - RNA, 18 nt, Homo sapiens
cugcacugaucacccaau

SEQ ID NO: 1460366 - RNA, 15 nt, Homo sapiens
cugcacuggggccac

SEQ ID NO: 1460367 - RNA, 22 nt, Homo sapiens
cugcacuguccugaccaucgca

SEQ ID NO: 1460368 - RNA, 23 nt, Homo sapiens
cugcacuguccugaccaucgcac

SEQ ID NO: 1460369 - RNA, 16 nt, Homo sapiens
cugcagaacagcauca

SEQ ID NO: 1460370 - RNA, 18 nt, Homo sapiens
cugcagaacagcaucaug

SEQ ID NO: 1460371 - RNA, 21 nt, Homo sapiens
cugcagaagcagaagugcaau

SEQ ID NO: 1460372 - RNA, 18 nt, Homo sapiens
cugcagaccucaagccau

SEQ ID NO: 1460373 - RNA, 17 nt, Homo sapiens
cugcagacucuggcaga

SEQ ID NO: 1460374 - RNA, 18 nt, Homo sapiens
cugcagagagaagccugu

SEQ ID NO: 1460375 - RNA, 15 nt, Homo sapiens
cugcagagcaccuuu

SEQ ID NO: 1460376 - RNA, 13 nt, Homo sapiens
cugcagauuugau

SEQ ID NO: 1460377 - RNA, 16 nt, Homo sapiens
cugcagccucauacuc

SEQ ID NO: 1460378 - RNA, 16 nt, Homo sapiens
cugcaggagcaguuug

SEQ ID NO: 1460379 - RNA, 16 nt, Homo sapiens
cugcagggacagagca

SEQ ID NO: 1460380 - RNA, 20 nt, Homo sapiens
cugcagggcuggucagggug

SEQ ID NO: 1460381 - RNA, 17 nt, Homo sapiens
cugcaguggacaguccc

SEQ ID NO: 1460382 - RNA, 23 nt, Homo sapiens
cugcaguggacaguccccaccuu

SEQ ID NO: 1460383 - RNA, 12 nt, Homo sapiens
cugcaguuuccu

SEQ ID NO: 1460384 - RNA, 15 nt, Homo sapiens
cugcaucugugaaaa

SEQ ID NO: 1460385 - RNA, 22 nt, Homo sapiens
cugcaugacaaacacacaucca

SEQ ID NO: 1460386 - RNA, 13 nt, Homo sapiens
cugccaccugccc

SEQ ID NO: 1460387 - RNA, 13 nt, Homo sapiens
cugccagggagcu

SEQ ID NO: 1460388 - RNA, 17 nt, Homo sapiens
cugccauguugccccuu

SEQ ID NO: 1460389 - RNA, 11 nt, Homo sapiens
cugccauuucc

SEQ ID NO: 1460390 - RNA, 21 nt, Homo sapiens
cugcccagaccccucuggcca

SEQ ID NO: 1460391 - RNA, 13 nt, Homo sapiens
cuggaaccuugcu

SEQ ID NO: 1460392 - RNA, 16 nt, Homo sapiens
cuggaagccagagaaa

SEQ ID NO: 1460393 - RNA, 15 nt, Homo sapiens
cuggaagucaucuca

SEQ ID NO: 1460394 - RNA, 16 nt, Homo sapiens
cuggaauuacaaaacu

SEQ ID NO: 1460395 - RNA, 15 nt, Homo sapiens
cuggaauucuaacaa

SEQ ID NO: 1460396 - RNA, 23 nt, Homo sapiens
cuggacaaaggaguaguagcuga

SEQ ID NO: 1460397 - RNA, 22 nt, Homo sapiens
cuggacaggcucugcuucucca

SEQ ID NO: 1460398 - RNA, 14 nt, Homo sapiens
cuggaccaagcaca

SEQ ID NO: 1460399 - RNA, 16 nt, Homo sapiens
cuggaccaagcacaaa

SEQ ID NO: 1460400 - RNA, 22 nt, Homo sapiens
cuggacggcaggcucacugcca

SEQ ID NO: 1460401 - RNA, 12 nt, Homo sapiens
cuggacugggag

SEQ ID NO: 1460402 - RNA, 22 nt, Homo sapiens
cuggagagguuaaggugcaaua

SEQ ID NO: 1460403 - RNA, 17 nt, Homo sapiens
cuggagaugcugccugg

SEQ ID NO: 1460404 - RNA, 20 nt, Homo sapiens
cuggagccuccacugccucu

SEQ ID NO: 1460405 - RNA, 14 nt, Homo sapiens
cuggagccuuugaa

SEQ ID NO: 1460406 - RNA, 18 nt, Homo sapiens
cuggagcucaucugcaaa

SEQ ID NO: 1460407 - RNA, 17 nt, Homo sapiens
cuggaggccuuccagcu

SEQ ID NO: 1460408 - RNA, 16 nt, Homo sapiens
cuggagugcugugcug

SEQ ID NO: 1460409 - RNA, 20 nt, Homo sapiens
cuggaguggaguggcgugau

SEQ ID NO: 1460410 - RNA, 22 nt, Homo sapiens
cuggaguugaucuggaacccag

SEQ ID NO: 1460411 - RNA, 21 nt, Homo sapiens
cuggaguuguggugaggccac

SEQ ID NO: 1460412 - RNA, 14 nt, Homo sapiens
cuggaucagggaau

SEQ ID NO: 1460413 - RNA, 22 nt, Homo sapiens
cuggauccccucugucuacaaa

SEQ ID NO: 1460414 - RNA, 16 nt, Homo sapiens
cuggauggucaucucg

SEQ ID NO: 1460415 - RNA, 19 nt, Homo sapiens
cuggauuugcaggugaaca

SEQ ID NO: 1460416 - RNA, 22 nt, Homo sapiens
cuggcacaguguaauccagggg

SEQ ID NO: 1460417 - RNA, 17 nt, Homo sapiens
cuggcacuauaauguaa

SEQ ID NO: 1460418 - RNA, 21 nt, Homo sapiens
cuggcaggagccggcugccua

SEQ ID NO: 1460419 - RNA, 21 nt, Homo sapiens
cuggcagggcccagugacaag

SEQ ID NO: 1460420 - RNA, 19 nt, Homo sapiens
cuggcauuugcaccuaccu

SEQ ID NO: 1460421 - RNA, 17 nt, Homo sapiens
cuggccaauacggcaaa

SEQ ID NO: 1460422 - RNA, 13 nt, Homo sapiens
cuggccaccagcc

SEQ ID NO: 1460423 - RNA, 16 nt, Homo sapiens
cuggccagcacccucu

SEQ ID NO: 1460424 - RNA, 16 nt, Homo sapiens
cuggcccagaugauau

SEQ ID NO: 1460425 - RNA, 14 nt, Homo sapiens
cuggcccagccaaa

SEQ ID NO: 1460426 - RNA, 18 nt, Homo sapiens
cuggcccuuacacacuca

SEQ ID NO: 1460427 - RNA, 15 nt, Homo sapiens
cuggccugagaguca

SEQ ID NO: 1460428 - RNA, 21 nt, Homo sapiens
cuggcuaauuuuuuguacuuu

SEQ ID NO: 1460429 - RNA, 20 nt, Homo sapiens
cuggcuccagagauggucac

SEQ ID NO: 1460430 - RNA, 14 nt, Homo sapiens
cuggcugagguucc

SEQ ID NO: 1460431 - RNA, 18 nt, Homo sapiens
cuggcugagguuccucug

SEQ ID NO: 1460432 - RNA, 12 nt, Homo sapiens
cuggcugaugau

SEQ ID NO: 1460433 - RNA, 15 nt, Homo sapiens
cuggcugaugaucca

SEQ ID NO: 1460434 - RNA, 19 nt, Homo sapiens
cuggcuggugacagaacau

SEQ ID NO: 1460435 - RNA, 20 nt, Homo sapiens
cuggcuucucuugagucaca

SEQ ID NO: 1460436 - RNA, 12 nt, Homo sapiens
cuggcuugacag

SEQ ID NO: 1460437 - RNA, 23 nt, Homo sapiens
cuggcuuggggucaagaaacagc

SEQ ID NO: 1460438 - RNA, 21 nt, Homo sapiens
uuccuguguggccugccuuca

SEQ ID NO: 1460439 - RNA, 15 nt, Homo sapiens
uuccuguucagugag

SEQ ID NO: 1460440 - RNA, 23 nt, Homo sapiens
uuccuguugauguucagaaugga

SEQ ID NO: 1460441 - RNA, 23 nt, Homo sapiens
uuccuuaaagcauuugcaacagc

SEQ ID NO: 1460442 - RNA, 15 nt, Homo sapiens
uuccuuagucucaag

SEQ ID NO: 1460443 - RNA, 19 nt, Homo sapiens
uuccuucauuuccaccagg

SEQ ID NO: 1460444 - RNA, 15 nt, Homo sapiens
uuccuuggcuuuaug

SEQ ID NO: 1460445 - RNA, 16 nt, Homo sapiens
uuccuugggaugaucu

SEQ ID NO: 1460446 - RNA, 22 nt, Homo sapiens
uuccuuguuccaauuugacaaa

SEQ ID NO: 1460447 - RNA, 17 nt, Homo sapiens
uuccuuuaugugaauuu

SEQ ID NO: 1460448 - RNA, 18 nt, Homo sapiens
uuccuuucuacaauuuca

SEQ ID NO: 1460449 - RNA, 13 nt, Homo sapiens
uuccuuuggguua

SEQ ID NO: 1460450 - RNA, 20 nt, Homo sapiens
uuccuuuucccugcuuccag

SEQ ID NO: 1460451 - RNA, 19 nt, Homo sapiens
uuccuuuuugacacugaaa

SEQ ID NO: 1460452 - RNA, 14 nt, Homo sapiens
uucgaacaccaaaa

SEQ ID NO: 1460453 - RNA, 20 nt, Homo sapiens
uucgagaccagccuggccaa

SEQ ID NO: 1460454 - RNA, 18 nt, Homo sapiens
uucgaggacuacaaccaa

SEQ ID NO: 1460455 - RNA, 16 nt, Homo sapiens
uucgauauuucaggaa

SEQ ID NO: 1460456 - RNA, 23 nt, Homo sapiens
uucgcaccuaccaucagggacag

SEQ ID NO: 1460457 - RNA, 20 nt, Homo sapiens
uucgcgugcccucgcugcuu

SEQ ID NO: 1460458 - RNA, 19 nt, Homo sapiens
uucggcagcuacucagagg

SEQ ID NO: 1460459 - RNA, 20 nt, Homo sapiens
uucguagguugacuaucuuu

SEQ ID NO: 1460460 - RNA, 23 nt, Homo sapiens
uucguggggaacugcguggugcu

SEQ ID NO: 1460461 - RNA, 21 nt, Homo sapiens
uucuaaccuugaaugcugcca

SEQ ID NO: 1460462 - RNA, 18 nt, Homo sapiens
uucuaaugcugauaugau

SEQ ID NO: 1460463 - RNA, 17 nt, Homo sapiens
uucuacaacugauugca

SEQ ID NO: 1460464 - RNA, 21 nt, Homo sapiens
uucuacuuuaagguuugcaga

SEQ ID NO: 1460465 - RNA, 15 nt, Homo sapiens
uucuagaaacaaaca

SEQ ID NO: 1460466 - RNA, 17 nt, Homo sapiens
uucuagguaggggccca

SEQ ID NO: 1460467 - RNA, 16 nt, Homo sapiens
uucuagucuuggccag

SEQ ID NO: 1460468 - RNA, 16 nt, Homo sapiens
uucuaguggucuuugu

SEQ ID NO: 1460469 - RNA, 15 nt, Homo sapiens
uucuaucauggaaua

SEQ ID NO: 1460470 - RNA, 19 nt, Homo sapiens
uucuaugaagaguauuaau

SEQ ID NO: 1460471 - RNA, 23 nt, Homo sapiens
uucuaugcuguuuguagugaaau

SEQ ID NO: 1460472 - RNA, 14 nt, Homo sapiens
uucuauuaacuuua

SEQ ID NO: 1460473 - RNA, 19 nt, Homo sapiens
uucuauugccuucuuugaa

SEQ ID NO: 1460474 - RNA, 21 nt, Homo sapiens
uucucaaaguuaauucaccua

SEQ ID NO: 1460475 - RNA, 13 nt, Homo sapiens
uucucaaucuccu

SEQ ID NO: 1460476 - RNA, 22 nt, Homo sapiens
uucucacaucccucuaaaagua

SEQ ID NO: 1460477 - RNA, 23 nt, Homo sapiens
uucuccagacccaccacaccgca

SEQ ID NO: 1460478 - RNA, 20 nt, Homo sapiens
uucuccauacgcacugguau

SEQ ID NO: 1460479 - RNA, 18 nt, Homo sapiens
uucuccauaucaaaacga

SEQ ID NO: 1460480 - RNA, 23 nt, Homo sapiens
uucucccacaugaggccaucuca

SEQ ID NO: 1460481 - RNA, 17 nt, Homo sapiens
uucucccagcacacggc

SEQ ID NO: 1460482 - RNA, 14 nt, Homo sapiens
uucuccugccucag

SEQ ID NO: 1460483 - RNA, 19 nt, Homo sapiens
uucuccuguuuauucccau

SEQ ID NO: 1460484 - RNA, 18 nt, Homo sapiens
uucuccuuuuacuucacu

SEQ ID NO: 1460485 - RNA, 20 nt, Homo sapiens
uucucuauuagacuuuagaa

SEQ ID NO: 1460486 - RNA, 19 nt, Homo sapiens
uucucugccgcuaccuccc

SEQ ID NO: 1460487 - RNA, 19 nt, Homo sapiens
uucucugguaauauugacu

SEQ ID NO: 1460488 - RNA, 21 nt, Homo sapiens
uucucuguguuuguuccuaca

SEQ ID NO: 1460489 - RNA, 21 nt, Homo sapiens
uucucuuagaacauuguauua

SEQ ID NO: 1460490 - RNA, 21 nt, Homo sapiens
uucucuugaaaaguucaggga

SEQ ID NO: 1460491 - RNA, 11 nt, Homo sapiens
uucugacacag

SEQ ID NO: 1460492 - RNA, 14 nt, Homo sapiens
uucugagaccagug

SEQ ID NO: 1460493 - RNA, 18 nt, Homo sapiens
uucugagcauacucaaca

SEQ ID NO: 1460494 - RNA, 14 nt, Homo sapiens
uucugagccauuca

SEQ ID NO: 1460495 - RNA, 17 nt, Homo sapiens
uucugaggucccugugu

SEQ ID NO: 1460496 - RNA, 19 nt, Homo sapiens
uucugaguagagcuuguaa

SEQ ID NO: 1460497 - RNA, 14 nt, Homo sapiens
uucugaucagaggu

SEQ ID NO: 1460498 - RNA, 17 nt, Homo sapiens
uucugcauauguugaau

SEQ ID NO: 1460499 - RNA, 14 nt, Homo sapiens
uucugccugugcag

SEQ ID NO: 1460500 - RNA, 19 nt, Homo sapiens
uucugcuuuaucuuuucau

SEQ ID NO: 1460501 - RNA, 16 nt, Homo sapiens
uucuggaaaagcaaaa

SEQ ID NO: 1460502 - RNA, 14 nt, Homo sapiens
uucuggaauguaau

SEQ ID NO: 1460503 - RNA, 17 nt, Homo sapiens
uucuggagugagcacuc

SEQ ID NO: 1460504 - RNA, 18 nt, Homo sapiens
uucuggccucagaccaac

SEQ ID NO: 1460505 - RNA, 16 nt, Homo sapiens
uucugggacuacaggc

SEQ ID NO: 1460506 - RNA, 23 nt, Homo sapiens
uucugggagacacccaaagggug

SEQ ID NO: 1460507 - RNA, 16 nt, Homo sapiens
uucugggggacagaga

SEQ ID NO: 1460508 - RNA, 16 nt, Homo sapiens
uucuggguccugaaga

SEQ ID NO: 1460509 - RNA, 14 nt, Homo sapiens
uucuguauucugac

SEQ ID NO: 1460510 - RNA, 14 nt, Homo sapiens
uucugucaauuuca

SEQ ID NO: 1460511 - RNA, 10 nt, Homo sapiens
uucugucacc

SEQ ID NO: 1460512 - RNA, 15 nt, Homo sapiens
uucuguccuaccuuu

SEQ ID NO: 1460513 - RNA, 21 nt, Homo sapiens
uucuguccuuuuggcacugag

SEQ ID NO: 1460514 - RNA, 16 nt, Homo sapiens
uucugugaaauauaau

SEQ ID NO: 1460515 - RNA, 13 nt, Homo sapiens
uucuguugccaca

SEQ ID NO: 1460516 - RNA, 20 nt, Homo sapiens
agccugugccucccagcuua

SEQ ID NO: 1460517 - RNA, 22 nt, Homo sapiens
agccuuaccuugaaaugcuguu

SEQ ID NO: 1460518 - RNA, 16 nt, Homo sapiens
agccuuagcugccagu

SEQ ID NO: 1460519 - RNA, 19 nt, Homo sapiens
agccuuauuuaugauguau

SEQ ID NO: 1460520 - RNA, 15 nt, Homo sapiens
agccuuguaaauaac

SEQ ID NO: 1460521 - RNA, 20 nt, Homo sapiens
agccuuuuccagaagaucug

SEQ ID NO: 1460522 - RNA, 19 nt, Homo sapiens
agcgaugaggggacauuuu

SEQ ID NO: 1460523 - RNA, 21 nt, Homo sapiens
agcgcaacggcuccuuugcca

SEQ ID NO: 1460524 - RNA, 19 nt, Homo sapiens
agcgcugagugggagaagg

SEQ ID NO: 1460525 - RNA, 14 nt, Homo sapiens
agcgcuuucuggaa

SEQ ID NO: 1460526 - RNA, 20 nt, Homo sapiens
agcgggcuugacugcauugc

SEQ ID NO: 1460527 - RNA, 13 nt, Homo sapiens
agcgucugggaac

SEQ ID NO: 1460528 - RNA, 24 nt, Homo sapiens
agcgugcauaaguuaacuuccaau

SEQ ID NO: 1460529 - RNA, 21 nt, Homo sapiens
agcgugggccagaggcagcuc

SEQ ID NO: 1460530 - RNA, 17 nt, Homo sapiens
agcguguuuacaugugu

SEQ ID NO: 1460531 - RNA, 17 nt, Homo sapiens
agcguucccagcagggg

SEQ ID NO: 1460532 - RNA, 18 nt, Homo sapiens
agcuaaaaugauuuuauc

SEQ ID NO: 1460533 - RNA, 18 nt, Homo sapiens
agcuaaacggauuccaaa

SEQ ID NO: 1460534 - RNA, 16 nt, Homo sapiens
agcuaaacuccuuccu

SEQ ID NO: 1460535 - RNA, 12 nt, Homo sapiens
agcuaaccauca

SEQ ID NO: 1460536 - RNA, 21 nt, Homo sapiens
agcuaagggugggugcucaga

SEQ ID NO: 1460537 - RNA, 23 nt, Homo sapiens
agcuaaggucacauugugccuuu

SEQ ID NO: 1460538 - RNA, 13 nt, Homo sapiens
agcuaaguacaca

SEQ ID NO: 1460539 - RNA, 22 nt, Homo sapiens
agcuaauguaauaacugugaag

SEQ ID NO: 1460540 - RNA, 15 nt, Homo sapiens
agcuacaggacauuu

SEQ ID NO: 1460541 - RNA, 16 nt, Homo sapiens
agcuacaggacauuuu

SEQ ID NO: 1460542 - RNA, 14 nt, Homo sapiens
agcuaccagguguu

SEQ ID NO: 1460543 - RNA, 16 nt, Homo sapiens
agcuacccacuauccu

SEQ ID NO: 1460544 - RNA, 21 nt, Homo sapiens
agcuaccucaaacuuccaguc

SEQ ID NO: 1460545 - RNA, 16 nt, Homo sapiens
agcuacuaaugauguu

SEQ ID NO: 1460546 - RNA, 20 nt, Homo sapiens
agcuacucgggaggcugaga

SEQ ID NO: 1460547 - RNA, 23 nt, Homo sapiens
agcuacugugugugugaaugaac

SEQ ID NO: 1460548 - RNA, 20 nt, Homo sapiens
agcuaggaagagcaggacuc

SEQ ID NO: 1460549 - RNA, 15 nt, Homo sapiens
agcuauccacagcuu

SEQ ID NO: 1460550 - RNA, 17 nt, Homo sapiens
agcuauccacagcuuac

SEQ ID NO: 1460551 - RNA, 19 nt, Homo sapiens
agcuaugcccggaccucca

SEQ ID NO: 1460552 - RNA, 23 nt, Homo sapiens
agcuauggacagcauugccagua

SEQ ID NO: 1460553 - RNA, 23 nt, Homo sapiens
agcuaugugacucggauggucuu

SEQ ID NO: 1460554 - RNA, 20 nt, Homo sapiens
agcuauuuaucuguaguaaa

SEQ ID NO: 1460555 - RNA, 16 nt, Homo sapiens
agcucaucugcaaaag

SEQ ID NO: 1460556 - RNA, 13 nt, Homo sapiens
agcuccacuguca

SEQ ID NO: 1460557 - RNA, 14 nt, Homo sapiens
agcuccacugucac

SEQ ID NO: 1460558 - RNA, 21 nt, Homo sapiens
agcucccccaggcuguucucc

SEQ ID NO: 1460559 - RNA, 18 nt, Homo sapiens
agcucccuaggagaccaa

SEQ ID NO: 1460560 - RNA, 15 nt, Homo sapiens
agcuccggccugucc

SEQ ID NO: 1460561 - RNA, 15 nt, Homo sapiens
agcuccucuccugga

SEQ ID NO: 1460562 - RNA, 16 nt, Homo sapiens
agcucgcauuugucaa

SEQ ID NO: 1460563 - RNA, 12 nt, Homo sapiens
agcucucuaggc

SEQ ID NO: 1460564 - RNA, 13 nt, Homo sapiens
agcucugaaguca

SEQ ID NO: 1460565 - RNA, 15 nt, Homo sapiens
agcucuggguugugc

SEQ ID NO: 1460566 - RNA, 21 nt, Homo sapiens
agcucuuggccuuugcauuua

SEQ ID NO: 1460567 - RNA, 20 nt, Homo sapiens
agcugaacagccaaaugcau

SEQ ID NO: 1460568 - RNA, 18 nt, Homo sapiens
agcugaauuaucuauaca

SEQ ID NO: 1460569 - RNA, 13 nt, Homo sapiens
agcugaccuggag

SEQ ID NO: 1460570 - RNA, 21 nt, Homo sapiens
agcugagaucacgccacugca

SEQ ID NO: 1460571 - RNA, 16 nt, Homo sapiens
agcugagaucgugcua

SEQ ID NO: 1460572 - RNA, 15 nt, Homo sapiens
agcugaggacacacc

SEQ ID NO: 1460573 - RNA, 21 nt, Homo sapiens
agcugaguggccagccagugc

SEQ ID NO: 1460574 - RNA, 18 nt, Homo sapiens
agcugauuuuaacaauaa

SEQ ID NO: 1460575 - RNA, 12 nt, Homo sapiens
agcugcacugau

SEQ ID NO: 1460576 - RNA, 19 nt, Homo sapiens
agcugcagccccuugcucu

SEQ ID NO: 1460577 - RNA, 13 nt, Homo sapiens
agcugcauuucag

SEQ ID NO: 1460578 - RNA, 18 nt, Homo sapiens
agcugcccuagcugaccc

SEQ ID NO: 1460579 - RNA, 15 nt, Homo sapiens
agcugcucugagcca

SEQ ID NO: 1460580 - RNA, 17 nt, Homo sapiens
agcugcucugagccaca

SEQ ID NO: 1460581 - RNA, 14 nt, Homo sapiens
agcugcugcugcuc

SEQ ID NO: 1460582 - RNA, 18 nt, Homo sapiens
agcugcugcuggaucaca

SEQ ID NO: 1460583 - RNA, 21 nt, Homo sapiens
agcugcugcuggaucacagcu

SEQ ID NO: 1460584 - RNA, 14 nt, Homo sapiens
agcuggaagcacau

SEQ ID NO: 1460585 - RNA, 14 nt, Homo sapiens
agcuggcaaaggug

SEQ ID NO: 1460586 - RNA, 19 nt, Homo sapiens
agcuggcaaagguggcucu

SEQ ID NO: 1460587 - RNA, 24 nt, Homo sapiens
agcuggcuuguuucuuaugccaga

SEQ ID NO: 1460588 - RNA, 17 nt, Homo sapiens
agcugggacuacagggg

SEQ ID NO: 1460589 - RNA, 14 nt, Homo sapiens
agcugggagcacug

SEQ ID NO: 1460590 - RNA, 18 nt, Homo sapiens
agcugggauuacaggugu

SEQ ID NO: 1460591 - RNA, 17 nt, Homo sapiens
agcugggcaaagccaca

SEQ ID NO: 1460592 - RNA, 16 nt, Homo sapiens
agcugggcagaccccu

SEQ ID NO: 1460593 - RNA, 22 nt, Homo sapiens
agcuggggaccugguacccucc

SEQ ID NO: 1460594 - RNA, 20 nt, Homo sapiens
agcuguaacccucacccaca

SEQ ID NO: 1460595 - RNA, 14 nt, Homo sapiens
agcugucacuuuug

SEQ ID NO: 1460596 - RNA, 17 nt, Homo sapiens
agcugucaggcugauua

SEQ ID NO: 1460597 - RNA, 15 nt, Homo sapiens
agcugugacuucucc

SEQ ID NO: 1460598 - RNA, 18 nt, Homo sapiens
agcuguggaggauugcua

SEQ ID NO: 1460599 - RNA, 17 nt, Homo sapiens
agcugugggacaauuau

SEQ ID NO: 1460600 - RNA, 17 nt, Homo sapiens
agcuguuuauggccuca

SEQ ID NO: 1460601 - RNA, 16 nt, Homo sapiens
agcuuaaaaucuguga

SEQ ID NO: 1460602 - RNA, 20 nt, Homo sapiens
agcuuacuggcaaacaugaa

SEQ ID NO: 1460603 - RNA, 15 nt, Homo sapiens
agcuuagauugccuc

SEQ ID NO: 1460604 - RNA, 17 nt, Homo sapiens
agcuuagcugucucaga

SEQ ID NO: 1460605 - RNA, 20 nt, Homo sapiens
accccugcucuacccaugag

SEQ ID NO: 1460606 - RNA, 14 nt, Homo sapiens
accccuuagccucc

SEQ ID NO: 1460607 - RNA, 18 nt, Homo sapiens
accccuuagccucccuga

SEQ ID NO: 1460608 - RNA, 20 nt, Homo sapiens
accccuugccggugaaggau

SEQ ID NO: 1460609 - RNA, 17 nt, Homo sapiens
accccuuuuugccuuac

SEQ ID NO: 1460610 - RNA, 21 nt, Homo sapiens
acccgaccggugcaugaugcu

SEQ ID NO: 1460611 - RNA, 17 nt, Homo sapiens
acccgggggagcccagu

SEQ ID NO: 1460612 - RNA, 22 nt, Homo sapiens
acccgguccugcccuuccugaa

SEQ ID NO: 1460613 - RNA, 19 nt, Homo sapiens
acccuacacccagacccca

SEQ ID NO: 1460614 - RNA, 20 nt, Homo sapiens
acccuagccuugcuuguuaa

SEQ ID NO: 1460615 - RNA, 18 nt, Homo sapiens
acccuauacaacuggaca

SEQ ID NO: 1460616 - RNA, 14 nt, Homo sapiens
acccucauacacag

SEQ ID NO: 1460617 - RNA, 19 nt, Homo sapiens
acccuccccuagucacuca

SEQ ID NO: 1460618 - RNA, 20 nt, Homo sapiens
acccuccugccccacacucc

SEQ ID NO: 1460619 - RNA, 17 nt, Homo sapiens
acccucuccuccagugu

SEQ ID NO: 1460620 - RNA, 17 nt, Homo sapiens
acccugaaggggccaug

SEQ ID NO: 1460621 - RNA, 21 nt, Homo sapiens
acccugaaugguuccaugccu

SEQ ID NO: 1460622 - RNA, 16 nt, Homo sapiens
acccugaguucaucca

SEQ ID NO: 1460623 - RNA, 20 nt, Homo sapiens
acccugccaggcugcuaaag

SEQ ID NO: 1460624 - RNA, 18 nt, Homo sapiens
acccugccuuaucuugca

SEQ ID NO: 1460625 - RNA, 20 nt, Homo sapiens
acccugcgucgaaggaugcu

SEQ ID NO: 1460626 - RNA, 23 nt, Homo sapiens
acccuggagcccauccagucucc

SEQ ID NO: 1460627 - RNA, 21 nt, Homo sapiens
acccugggagccaguccucca

SEQ ID NO: 1460628 - RNA, 18 nt, Homo sapiens
acccuguaccucauccca

SEQ ID NO: 1460629 - RNA, 22 nt, Homo sapiens
acccugucaaguuaacaaggaa

SEQ ID NO: 1460630 - RNA, 17 nt, Homo sapiens
acccuucacaccccagg

SEQ ID NO: 1460631 - RNA, 23 nt, Homo sapiens
acccuugaaccaauaaaggaaca

SEQ ID NO: 1460632 - RNA, 17 nt, Homo sapiens
acccuugacaccugcug

SEQ ID NO: 1460633 - RNA, 22 nt, Homo sapiens
acccuugugagagcccauuccc

SEQ ID NO: 1460634 - RNA, 19 nt, Homo sapiens
acccuuguuuacacauacc

SEQ ID NO: 1460635 - RNA, 14 nt, Homo sapiens
acccuuugcuguga

SEQ ID NO: 1460636 - RNA, 20 nt, Homo sapiens
accgagcgcuuucuggaaaa

SEQ ID NO: 1460637 - RNA, 16 nt, Homo sapiens
accgagucucuucucc

SEQ ID NO: 1460638 - RNA, 16 nt, Homo sapiens
accgauaaugcaugaa

SEQ ID NO: 1460639 - RNA, 16 nt, Homo sapiens
accgcuugguuugcaa

SEQ ID NO: 1460640 - RNA, 18 nt, Homo sapiens
accggaucuacacccacc

SEQ ID NO: 1460641 - RNA, 22 nt, Homo sapiens
accggggccagcaccacuuccu

SEQ ID NO: 1460642 - RNA, 19 nt, Homo sapiens
accggugcaugaugcugcc

SEQ ID NO: 1460643 - RNA, 21 nt, Homo sapiens
accgguggggcugguucugua

SEQ ID NO: 1460644 - RNA, 17 nt, Homo sapiens
accgucacccaacauca

SEQ ID NO: 1460645 - RNA, 21 nt, Homo sapiens
accgucuucucccuauucccu

SEQ ID NO: 1460646 - RNA, 14 nt, Homo sapiens
accgugaccaucuu

SEQ ID NO: 1460647 - RNA, 21 nt, Homo sapiens
accguucagugucccaggcag

SEQ ID NO: 1460648 - RNA, 15 nt, Homo sapiens
accuaauccaggcag

SEQ ID NO: 1460649 - RNA, 18 nt, Homo sapiens
accuaauccaggcagauc

SEQ ID NO: 1460650 - RNA, 15 nt, Homo sapiens
accuaccacaguguc

SEQ ID NO: 1460651 - RNA, 13 nt, Homo sapiens
accuaccaucagg

SEQ ID NO: 1460652 - RNA, 16 nt, Homo sapiens
accuaccaucagggac

SEQ ID NO: 1460653 - RNA, 17 nt, Homo sapiens
accuacccuccacaggc

SEQ ID NO: 1460654 - RNA, 16 nt, Homo sapiens
accuagaguuuuauca

SEQ ID NO: 1460655 - RNA, 17 nt, Homo sapiens
accuagcaggcuguucc

SEQ ID NO: 1460656 - RNA, 22 nt, Homo sapiens
accucaacauugcauggugcua

SEQ ID NO: 1460657 - RNA, 22 nt, Homo sapiens
accucacuuuaggcagcuguaa

SEQ ID NO: 1460658 - RNA, 16 nt, Homo sapiens
accucaggcagcucaa

SEQ ID NO: 1460659 - RNA, 21 nt, Homo sapiens
accucaguucccucuugcuca

SEQ ID NO: 1460660 - RNA, 12 nt, Homo sapiens
accucaguuuua

SEQ ID NO: 1460661 - RNA, 16 nt, Homo sapiens
accucauccaggcuac

SEQ ID NO: 1460662 - RNA, 22 nt, Homo sapiens
accucaugggaagcauguggau

SEQ ID NO: 1460663 - RNA, 13 nt, Homo sapiens
accuccacuccca

SEQ ID NO: 1460664 - RNA, 17 nt, Homo sapiens
accuccagacaccagug

SEQ ID NO: 1460665 - RNA, 18 nt, Homo sapiens
accucccuccccgucuca

SEQ ID NO: 1460666 - RNA, 21 nt, Homo sapiens
accucccugacccgucuaaua

SEQ ID NO: 1460667 - RNA, 17 nt, Homo sapiens
accuccgccccugcccc

SEQ ID NO: 1460668 - RNA, 14 nt, Homo sapiens
accuccuuuaccag

SEQ ID NO: 1460669 - RNA, 13 nt, Homo sapiens
accucuaugcaau

SEQ ID NO: 1460670 - RNA, 18 nt, Homo sapiens
accucucucagagcaucu

SEQ ID NO: 1460671 - RNA, 13 nt, Homo sapiens
accucucugggcc

SEQ ID NO: 1460672 - RNA, 14 nt, Homo sapiens
accucugcacuacu

SEQ ID NO: 1460673 - RNA, 15 nt, Homo sapiens
accucugccccagau

SEQ ID NO: 1460674 - RNA, 17 nt, Homo sapiens
accucuggcacccaucu

SEQ ID NO: 1460675 - RNA, 12 nt, Homo sapiens
accucuguggac

SEQ ID NO: 1460676 - RNA, 16 nt, Homo sapiens
accucuucccaugacu

SEQ ID NO: 1460677 - RNA, 18 nt, Homo sapiens
accucuucccaugacugc

SEQ ID NO: 1460678 - RNA, 20 nt, Homo sapiens
accucuucccaugacugcac

SEQ ID NO: 1460679 - RNA, 14 nt, Homo sapiens
accucuuccuugau

SEQ ID NO: 1460680 - RNA, 20 nt, Homo sapiens
accucuuugucccagaguua

SEQ ID NO: 1460681 - RNA, 19 nt, Homo sapiens
accugaaauuuauucacau

SEQ ID NO: 1460682 - RNA, 16 nt, Homo sapiens
accugaagacugagga

SEQ ID NO: 1460683 - RNA, 17 nt, Homo sapiens
accugaagacugaggac

SEQ ID NO: 1460684 - RNA, 13 nt, Homo sapiens
accugacucuugc

SEQ ID NO: 1460685 - RNA, 23 nt, Homo sapiens
accugagggggcccaucccugcc

SEQ ID NO: 1460686 - RNA, 21 nt, Homo sapiens
accugagucugcaugugcacg

SEQ ID NO: 1460687 - RNA, 18 nt, Homo sapiens
accugaucacuagccugu

SEQ ID NO: 1460688 - RNA, 18 nt, Homo sapiens
accugcacacuccaucuc

SEQ ID NO: 1460689 - RNA, 19 nt, Homo sapiens
accugcagggacuccaugc

SEQ ID NO: 1460690 - RNA, 22 nt, Homo sapiens
acaguagagcaaaucuaugaga

SEQ ID NO: 1460691 - RNA, 17 nt, Homo sapiens
acaguagguuggcagua

SEQ ID NO: 1460692 - RNA, 23 nt, Homo sapiens
acaguaucuacuugcauguguau

SEQ ID NO: 1460693 - RNA, 16 nt, Homo sapiens
acaguaugagucaaug

SEQ ID NO: 1460694 - RNA, 17 nt, Homo sapiens
acagucaucugccacca

SEQ ID NO: 1460695 - RNA, 16 nt, Homo sapiens
acaguccuugggguua

SEQ ID NO: 1460696 - RNA, 14 nt, Homo sapiens
acagucucacuuug

SEQ ID NO: 1460697 - RNA, 21 nt, Homo sapiens
acagugaaguucaaaugcccu

SEQ ID NO: 1460698 - RNA, 22 nt, Homo sapiens
acagugaucuccauauguuaca

SEQ ID NO: 1460699 - RNA, 12 nt, Homo sapiens
acagugaugccg

SEQ ID NO: 1460700 - RNA, 12 nt, Homo sapiens
acagugaugcug

SEQ ID NO: 1460701 - RNA, 22 nt, Homo sapiens
acaguggaggaagagggacaga

SEQ ID NO: 1460702 - RNA, 16 nt, Homo sapiens
acaguggccaaagagg

SEQ ID NO: 1460703 - RNA, 22 nt, Homo sapiens
acagugucugugccauggauuu

SEQ ID NO: 1460704 - RNA, 22 nt, Homo sapiens
acaguuacacuugacagacaaa

SEQ ID NO: 1460705 - RNA, 16 nt, Homo sapiens
acaguuacuccaguau

SEQ ID NO: 1460706 - RNA, 17 nt, Homo sapiens
acaguuagguagcuuua

SEQ ID NO: 1460707 - RNA, 21 nt, Homo sapiens
acaguucauguuugcuucaua

SEQ ID NO: 1460708 - RNA, 17 nt, Homo sapiens
acaguucuuugggccag

SEQ ID NO: 1460709 - RNA, 18 nt, Homo sapiens
acaguugcauuuagcuuc

SEQ ID NO: 1460710 - RNA, 11 nt, Homo sapiens
acaguuuucag

SEQ ID NO: 1460711 - RNA, 21 nt, Homo sapiens
acauaaaagaauuuuuuuguc

SEQ ID NO: 1460712 - RNA, 16 nt, Homo sapiens
acauaaacaauucaug

SEQ ID NO: 1460713 - RNA, 16 nt, Homo sapiens
acauaacggaaaguuu

SEQ ID NO: 1460714 - RNA, 20 nt, Homo sapiens
acauaacucuguaaaaacac

SEQ ID NO: 1460715 - RNA, 21 nt, Homo sapiens
acauaacucuguaaaaacacu

SEQ ID NO: 1460716 - RNA, 18 nt, Homo sapiens
acauaaguguugguagca

SEQ ID NO: 1460717 - RNA, 18 nt, Homo sapiens
acauacauauuaucucau

SEQ ID NO: 1460718 - RNA, 14 nt, Homo sapiens
acauacuccaacug

SEQ ID NO: 1460719 - RNA, 18 nt, Homo sapiens
acauacuggccuggacug

SEQ ID NO: 1460720 - RNA, 15 nt, Homo sapiens
acauagcaucucagg

SEQ ID NO: 1460721 - RNA, 16 nt, Homo sapiens
acauaguuuauuucaa

SEQ ID NO: 1460722 - RNA, 22 nt, Homo sapiens
acauauaaaauguaauuacuua

SEQ ID NO: 1460723 - RNA, 17 nt, Homo sapiens
acauauguaaacauaag

SEQ ID NO: 1460724 - RNA, 22 nt, Homo sapiens
acauauuaggaaaauauggguu

SEQ ID NO: 1460725 - RNA, 23 nt, Homo sapiens
acauauugcaggauucuguaaua

SEQ ID NO: 1460726 - RNA, 11 nt, Homo sapiens
acaucaaagag

SEQ ID NO: 1460727 - RNA, 20 nt, Homo sapiens
acaucaaucuaaagauacag

SEQ ID NO: 1460728 - RNA, 16 nt, Homo sapiens
acaucacaacauuuac

SEQ ID NO: 1460729 - RNA, 17 nt, Homo sapiens
acauccaaaauaguuaa

SEQ ID NO: 1460730 - RNA, 20 nt, Homo sapiens
acauccaaagcagacagcuc

SEQ ID NO: 1460731 - RNA, 21 nt, Homo sapiens
acauccguugugcuugccugc

SEQ ID NO: 1460732 - RNA, 22 nt, Homo sapiens
acauccuuucuuuuaaugaugc

SEQ ID NO: 1460733 - RNA, 18 nt, Homo sapiens
acaucggccuccaugacc

SEQ ID NO: 1460734 - RNA, 17 nt, Homo sapiens
acaucgugaaacccugu

SEQ ID NO: 1460735 - RNA, 15 nt, Homo sapiens
acaucuaugauauaa

SEQ ID NO: 1460736 - RNA, 22 nt, Homo sapiens
acaucucagacccuuuagccaa

SEQ ID NO: 1460737 - RNA, 12 nt, Homo sapiens
acaucucagggg

SEQ ID NO: 1460738 - RNA, 18 nt, Homo sapiens
acaucucgggaguccucu

SEQ ID NO: 1460739 - RNA, 18 nt, Homo sapiens
acaucugagagaugacag

SEQ ID NO: 1460740 - RNA, 20 nt, Homo sapiens
acaucugagagaugacaggg

SEQ ID NO: 1460741 - RNA, 15 nt, Homo sapiens
acaucuguauacccu

SEQ ID NO: 1460742 - RNA, 23 nt, Homo sapiens
acaucuucugccuuagucucagu

SEQ ID NO: 1460743 - RNA, 18 nt, Homo sapiens
acaucuuggucagauuug

SEQ ID NO: 1460744 - RNA, 12 nt, Homo sapiens
acaugaaaguuu

SEQ ID NO: 1460745 - RNA, 14 nt, Homo sapiens
acaugaagaagcua

SEQ ID NO: 1460746 - RNA, 13 nt, Homo sapiens
acaugaaugcaca

SEQ ID NO: 1460747 - RNA, 17 nt, Homo sapiens
acaugacaacuuugcca

SEQ ID NO: 1460748 - RNA, 23 nt, Homo sapiens
acaugcagcccagaauagcuuug

SEQ ID NO: 1460749 - RNA, 17 nt, Homo sapiens
acaugcagcccaugccc

SEQ ID NO: 1460750 - RNA, 20 nt, Homo sapiens
acaugcgaccgugaccagga

SEQ ID NO: 1460751 - RNA, 17 nt, Homo sapiens
acaugcgguagccagca

SEQ ID NO: 1460752 - RNA, 15 nt, Homo sapiens
acaugcuuaccagau

SEQ ID NO: 1460753 - RNA, 15 nt, Homo sapiens
acauggaugccaacc

SEQ ID NO: 1460754 - RNA, 14 nt, Homo sapiens
acauggcuaaauac

SEQ ID NO: 1460755 - RNA, 18 nt, Homo sapiens
acauggcuguguuugcag

SEQ ID NO: 1460756 - RNA, 22 nt, Homo sapiens
acaugguacgaauggcagcaua

SEQ ID NO: 1460757 - RNA, 18 nt, Homo sapiens
acauggugaaacccuguc

SEQ ID NO: 1460758 - RNA, 17 nt, Homo sapiens
acaugguuguaauaugc

SEQ ID NO: 1460759 - RNA, 19 nt, Homo sapiens
acauguaauuaaguacuau

SEQ ID NO: 1460760 - RNA, 23 nt, Homo sapiens
acauguagguaggaagcacugaa

SEQ ID NO: 1460761 - RNA, 12 nt, Homo sapiens
acauguauugca

SEQ ID NO: 1460762 - RNA, 19 nt, Homo sapiens
acauguauugcacauugua

SEQ ID NO: 1460763 - RNA, 19 nt, Homo sapiens
acaugugccgaaugugcag

SEQ ID NO: 1460764 - RNA, 22 nt, Homo sapiens
acauguucauggguuuaccacu

SEQ ID NO: 1460765 - RNA, 12 nt, Homo sapiens
acauuagaauaa

SEQ ID NO: 1460766 - RNA, 19 nt, Homo sapiens
acauuauuuaauauaguaa

SEQ ID NO: 1460767 - RNA, 15 nt, Homo sapiens
acauucaauagcaua

SEQ ID NO: 1460768 - RNA, 15 nt, Homo sapiens
acauucaucaauauc

SEQ ID NO: 1460769 - RNA, 17 nt, Homo sapiens
acauuccauuugaagca

SEQ ID NO: 1460770 - RNA, 18 nt, Homo sapiens
acauuccccucccaccuc

SEQ ID NO: 1460771 - RNA, 21 nt, Homo sapiens
acauucccucuaauuugaacu

SEQ ID NO: 1460772 - RNA, 15 nt, Homo sapiens
acauuccugcauuca

SEQ ID NO: 1460773 - RNA, 20 nt, Homo sapiens
acauucugcaagcacaucug

SEQ ID NO: 1460774 - RNA, 13 nt, Homo sapiens
acauucuuccaaa

SEQ ID NO: 1460775 - RNA, 18 nt, Homo sapiens
acacuaacauauaauguu

SEQ ID NO: 1460776 - RNA, 20 nt, Homo sapiens
acacuaaccuggguucccuu

SEQ ID NO: 1460777 - RNA, 16 nt, Homo sapiens
acacuaccacauuaaa

SEQ ID NO: 1460778 - RNA, 20 nt, Homo sapiens
acacuaugaagauguuucaa

SEQ ID NO: 1460779 - RNA, 22 nt, Homo sapiens
acacucaauaaauugcaacaua

SEQ ID NO: 1460780 - RNA, 14 nt, Homo sapiens
acacucaccaugaa

SEQ ID NO: 1460781 - RNA, 12 nt, Homo sapiens
acacuccagugc

SEQ ID NO: 1460782 - RNA, 21 nt, Homo sapiens
acacuccagugccagcaauga

SEQ ID NO: 1460783 - RNA, 23 nt, Homo sapiens
acacuccagugccagcaaugaca

SEQ ID NO: 1460784 - RNA, 15 nt, Homo sapiens
acacugaaaauguca

SEQ ID NO: 1460785 - RNA, 15 nt, Homo sapiens
acacugaaguuaaca

SEQ ID NO: 1460786 - RNA, 20 nt, Homo sapiens
acacugagcaagaucuuguc

SEQ ID NO: 1460787 - RNA, 19 nt, Homo sapiens
acacugcagaacagcauca

SEQ ID NO: 1460788 - RNA, 18 nt, Homo sapiens
acacugcaguuuccugga

SEQ ID NO: 1460789 - RNA, 20 nt, Homo sapiens
acacugcugcuccagugcag

SEQ ID NO: 1460790 - RNA, 18 nt, Homo sapiens
acacuggaacauggcuag

SEQ ID NO: 1460791 - RNA, 18 nt, Homo sapiens
acacugucacuagucuca

SEQ ID NO: 1460792 - RNA, 15 nt, Homo sapiens
acacugucuucugau

SEQ ID NO: 1460793 - RNA, 18 nt, Homo sapiens
acacuguuacuuucguac

SEQ ID NO: 1460794 - RNA, 14 nt, Homo sapiens
acacuuaaugauac

SEQ ID NO: 1460795 - RNA, 14 nt, Homo sapiens
acacuuggaugcag

SEQ ID NO: 1460796 - RNA, 16 nt, Homo sapiens
acacuuggaugcaggg

SEQ ID NO: 1460797 - RNA, 18 nt, Homo sapiens
acacuuguuguccaguug

SEQ ID NO: 1460798 - RNA, 15 nt, Homo sapiens
acagaaacgcaucca

SEQ ID NO: 1460799 - RNA, 13 nt, Homo sapiens
acagaaacuggau

SEQ ID NO: 1460800 - RNA, 21 nt, Homo sapiens
acagaaagagacuccgucuca

SEQ ID NO: 1460801 - RNA, 14 nt, Homo sapiens
acagaacacccaau

SEQ ID NO: 1460802 - RNA, 23 nt, Homo sapiens
acagaacagggucauguuugcag

SEQ ID NO: 1460803 - RNA, 18 nt, Homo sapiens
acagaacauauguugcaa

SEQ ID NO: 1460804 - RNA, 13 nt, Homo sapiens
acagaacauuuau

SEQ ID NO: 1460805 - RNA, 13 nt, Homo sapiens
acagaacuacuuc

SEQ ID NO: 1460806 - RNA, 22 nt, Homo sapiens
acagaacuuuuccucuguauca

SEQ ID NO: 1460807 - RNA, 23 nt, Homo sapiens
acagaagacccgcucuccaucuu

SEQ ID NO: 1460808 - RNA, 22 nt, Homo sapiens
acagaagcagcuaaaccaagga

SEQ ID NO: 1460809 - RNA, 16 nt, Homo sapiens
acagaaggaugaauga

SEQ ID NO: 1460810 - RNA, 15 nt, Homo sapiens
acagaaggauguccc

SEQ ID NO: 1460811 - RNA, 15 nt, Homo sapiens
acagaagucuccuca

SEQ ID NO: 1460812 - RNA, 16 nt, Homo sapiens
acagaauaauccagua

SEQ ID NO: 1460813 - RNA, 17 nt, Homo sapiens
acagaauuugucagaaa

SEQ ID NO: 1460814 - RNA, 20 nt, Homo sapiens
acagacaccaaguuccguca

SEQ ID NO: 1460815 - RNA, 16 nt, Homo sapiens
acagacacuuacaugg

SEQ ID NO: 1460816 - RNA, 13 nt, Homo sapiens
acagaccagugac

SEQ ID NO: 1460817 - RNA, 17 nt, Homo sapiens
acagacuccacccuccu

SEQ ID NO: 1460818 - RNA, 19 nt, Homo sapiens
acagagaagcggauuucca

SEQ ID NO: 1460819 - RNA, 18 nt, Homo sapiens
acagagauugaacuccaa

SEQ ID NO: 1460820 - RNA, 15 nt, Homo sapiens
acagagcguccuucc

SEQ ID NO: 1460821 - RNA, 13 nt, Homo sapiens
acagagugcauug

SEQ ID NO: 1460822 - RNA, 21 nt, Homo sapiens
acagaguggucuuucuggaga

SEQ ID NO: 1460823 - RNA, 23 nt, Homo sapiens
acagaguucacaggaggccagug

SEQ ID NO: 1460824 - RNA, 14 nt, Homo sapiens
acagaguucacuau

SEQ ID NO: 1460825 - RNA, 22 nt, Homo sapiens
acagauccaaugggaguccaug

SEQ ID NO: 1460826 - RNA, 22 nt, Homo sapiens
acagauccuuuuuccaucauuu

SEQ ID NO: 1460827 - RNA, 12 nt, Homo sapiens
acagaugaaggu

SEQ ID NO: 1460828 - RNA, 19 nt, Homo sapiens
acagaugcaaugugcuacu

SEQ ID NO: 1460829 - RNA, 13 nt, Homo sapiens
acagaugccccag

SEQ ID NO: 1460830 - RNA, 23 nt, Homo sapiens
acagcaaccucuucaugagcuug

SEQ ID NO: 1460831 - RNA, 19 nt, Homo sapiens
acagcaagacuccgucuca

SEQ ID NO: 1460832 - RNA, 20 nt, Homo sapiens
acagcagcugaacagccaaa

SEQ ID NO: 1460833 - RNA, 23 nt, Homo sapiens
acagcagcuucaccagagcauuu

SEQ ID NO: 1460834 - RNA, 15 nt, Homo sapiens
acagcaggcuuucaa

SEQ ID NO: 1460835 - RNA, 16 nt, Homo sapiens
acagcaucauuuugca

SEQ ID NO: 1460836 - RNA, 16 nt, Homo sapiens
acagcaugccuucaaa

SEQ ID NO: 1460837 - RNA, 13 nt, Homo sapiens
acagcauguguau

SEQ ID NO: 1460838 - RNA, 14 nt, Homo sapiens
acagcauguguauu

SEQ ID NO: 1460839 - RNA, 23 nt, Homo sapiens
acagcccuccacuccagcucuga

SEQ ID NO: 1460840 - RNA, 17 nt, Homo sapiens
acagccguguguucaaa

SEQ ID NO: 1460841 - RNA, 16 nt, Homo sapiens
acagccguuuguucua

SEQ ID NO: 1460842 - RNA, 23 nt, Homo sapiens
acagccuccccacccaggaugac

SEQ ID NO: 1460843 - RNA, 17 nt, Homo sapiens
acagccucuuacuugcc

SEQ ID NO: 1460844 - RNA, 14 nt, Homo sapiens
acagccuggaccac

SEQ ID NO: 1460845 - RNA, 18 nt, Homo sapiens
acagccuggcacagggca

SEQ ID NO: 1460846 - RNA, 12 nt, Homo sapiens
acagcuacucuc

SEQ ID NO: 1460847 - RNA, 19 nt, Homo sapiens
acagcuaucgaacuucaca

SEQ ID NO: 1460848 - RNA, 15 nt, Homo sapiens
acagcugcccuagcu

SEQ ID NO: 1460849 - RNA, 17 nt, Homo sapiens
acagcuggagcucucaa

SEQ ID NO: 1460850 - RNA, 15 nt, Homo sapiens
acagcuucaugccuu

SEQ ID NO: 1460851 - RNA, 13 nt, Homo sapiens
acagcuuccucac

SEQ ID NO: 1460852 - RNA, 23 nt, Homo sapiens
acaggaagguagaaauaucugaa

SEQ ID NO: 1460853 - RNA, 16 nt, Homo sapiens
acaggacaacuuuaca

SEQ ID NO: 1460854 - RNA, 16 nt, Homo sapiens
acaggagaaucucuug

SEQ ID NO: 1460855 - RNA, 18 nt, Homo sapiens
acaggaggaaucauguca

SEQ ID NO: 1460856 - RNA, 19 nt, Homo sapiens
acaggauccuauucucacc

SEQ ID NO: 1460857 - RNA, 17 nt, Homo sapiens
acaggaugaccuggaua

SEQ ID NO: 1460858 - RNA, 18 nt, Homo sapiens
acaggauuuguaauuccu

SEQ ID NO: 1460859 - RNA, 13 nt, Homo sapiens
acaggcaccugcc

SEQ ID NO: 1460860 - RNA, 16 nt, Homo sapiens
uuuuauaaaagccuug

SEQ ID NO: 1460861 - RNA, 20 nt, Homo sapiens
uuuuauaagacuacuauaca

SEQ ID NO: 1460862 - RNA, 22 nt, Homo sapiens
uggaucuaccagcauaaauauc

SEQ ID NO: 1460863 - RNA, 22 nt, Homo sapiens
uggaucugcuuguugcauuucc

SEQ ID NO: 1460864 - RNA, 16 nt, Homo sapiens
uggaugacacaauccc

SEQ ID NO: 1460865 - RNA, 21 nt, Homo sapiens
uggaugacccuccccuaguca

SEQ ID NO: 1460866 - RNA, 20 nt, Homo sapiens
uggaugauucagaaauugga

SEQ ID NO: 1460867 - RNA, 14 nt, Homo sapiens
uggaugcacuuuca

SEQ ID NO: 1460868 - RNA, 22 nt, Homo sapiens
uggaugccaaccggucacccag

SEQ ID NO: 1460869 - RNA, 14 nt, Homo sapiens
uggaugcugugaag

SEQ ID NO: 1460870 - RNA, 11 nt, Homo sapiens
uggauggggcu

SEQ ID NO: 1460871 - RNA, 21 nt, Homo sapiens
uggauggggcuuccagcucag

SEQ ID NO: 1460872 - RNA, 13 nt, Homo sapiens
uggauguucugac

SEQ ID NO: 1460873 - RNA, 18 nt, Homo sapiens
uggauuccucacuuugaa

SEQ ID NO: 1460874 - RNA, 23 nt, Homo sapiens
ugcuuguugcauuuccagcugug

SEQ ID NO: 1460875 - RNA, 21 nt, Homo sapiens
ugcuuugaaacuugccugggg

SEQ ID NO: 1460876 - RNA, 17 nt, Homo sapiens
ugcuuuguaugcacuuu

SEQ ID NO: 1460877 - RNA, 22 nt, Homo sapiens
ugcuuuguuuuaauaaacagua

SEQ ID NO: 1460878 - RNA, 21 nt, Homo sapiens
ugcuuuugguugggggcagau

SEQ ID NO: 1460879 - RNA, 21 nt, Homo sapiens
ugcuuuuuaaagaaugcucuu

SEQ ID NO: 1460880 - RNA, 17 nt, Homo sapiens
ugcuuuuuuaaauauua

SEQ ID NO: 1460881 - RNA, 17 nt, Homo sapiens
uggaaaaaccauuugaa

SEQ ID NO: 1460882 - RNA, 15 nt, Homo sapiens
uggaaaacuguguug

SEQ ID NO: 1460883 - RNA, 19 nt, Homo sapiens
uggaaaagaacuguacugu

SEQ ID NO: 1460884 - RNA, 13 nt, Homo sapiens
uggaaaagcaaaa

SEQ ID NO: 1460885 - RNA, 22 nt, Homo sapiens
uggaaaagcaaaacuguagggg

SEQ ID NO: 1460886 - RNA, 17 nt, Homo sapiens
uggaaaaugugacccag

SEQ ID NO: 1460887 - RNA, 12 nt, Homo sapiens
uggaaacuaaga

SEQ ID NO: 1460888 - RNA, 17 nt, Homo sapiens
uggaaagaaucuaauag

SEQ ID NO: 1460889 - RNA, 21 nt, Homo sapiens
uggaaagacaaacugcacagg

SEQ ID NO: 1460890 - RNA, 22 nt, Homo sapiens
uggaaauagaaagaagccauau

SEQ ID NO: 1460891 - RNA, 16 nt, Homo sapiens
uggaacaagcacagau

SEQ ID NO: 1460892 - RNA, 20 nt, Homo sapiens
uggaacaccuuggggucccu

SEQ ID NO: 1460893 - RNA, 16 nt, Homo sapiens
uggaacagaagacagc

SEQ ID NO: 1460894 - RNA, 23 nt, Homo sapiens
uggaaccaacacuaacauauaau

SEQ ID NO: 1460895 - RNA, 15 nt, Homo sapiens
uggaacccagacuca

SEQ ID NO: 1460896 - RNA, 14 nt, Homo sapiens
uggaaccccagcuu

SEQ ID NO: 1460897 - RNA, 19 nt, Homo sapiens
uggaaccuuguuuuggaca

SEQ ID NO: 1460898 - RNA, 23 nt, Homo sapiens
uggaacgcuaaugaaacacagcu

SEQ ID NO: 1460899 - RNA, 15 nt, Homo sapiens
uggaacuguccuucc

SEQ ID NO: 1460900 - RNA, 17 nt, Homo sapiens
uggaagaggaacagcac

SEQ ID NO: 1460901 - RNA, 20 nt, Homo sapiens
uggaagaguguuucuuccac

SEQ ID NO: 1460902 - RNA, 13 nt, Homo sapiens
uggaagauuggaa

SEQ ID NO: 1460903 - RNA, 17 nt, Homo sapiens
uggaagcucugaaguca

SEQ ID NO: 1460904 - RNA, 22 nt, Homo sapiens
uggaagcucugaagucacauca

SEQ ID NO: 1460905 - RNA, 12 nt, Homo sapiens
uggaagggucaa

SEQ ID NO: 1460906 - RNA, 16 nt, Homo sapiens
uggaaguaaagccuca

SEQ ID NO: 1460907 - RNA, 14 nt, Homo sapiens
uggaaguacaugaa

SEQ ID NO: 1460908 - RNA, 22 nt, Homo sapiens
uggaagucuccaugaagagcuu

SEQ ID NO: 1460909 - RNA, 15 nt, Homo sapiens
uggaauaaaacuguc

SEQ ID NO: 1460910 - RNA, 17 nt, Homo sapiens
uggaauaaaacugucuc

SEQ ID NO: 1460911 - RNA, 20 nt, Homo sapiens
uggaauaaaguugcagauga

SEQ ID NO: 1460912 - RNA, 14 nt, Homo sapiens
uggaauaacaugua

SEQ ID NO: 1460913 - RNA, 20 nt, Homo sapiens
uggaauaacucuguggcauu

SEQ ID NO: 1460914 - RNA, 16 nt, Homo sapiens
uggaauguacucuguu

SEQ ID NO: 1460915 - RNA, 13 nt, Homo sapiens
uggaauugcucaa

SEQ ID NO: 1460916 - RNA, 15 nt, Homo sapiens
uggaauuuguucaag

SEQ ID NO: 1460917 - RNA, 15 nt, Homo sapiens
uggacaggagucagu

SEQ ID NO: 1460918 - RNA, 16 nt, Homo sapiens
uggacaggcucugcuu

SEQ ID NO: 1460919 - RNA, 21 nt, Homo sapiens
uggacagugaggucacagucc

SEQ ID NO: 1460920 - RNA, 15 nt, Homo sapiens
uggacauaacauuuu

SEQ ID NO: 1460921 - RNA, 22 nt, Homo sapiens
uggaccaggaagcccugaaucc

SEQ ID NO: 1460922 - RNA, 14 nt, Homo sapiens
uggaccaugccaga

SEQ ID NO: 1460923 - RNA, 15 nt, Homo sapiens
uggaccuaacauucg

SEQ ID NO: 1460924 - RNA, 21 nt, Homo sapiens
uggaccugcccugggccacac

SEQ ID NO: 1460925 - RNA, 15 nt, Homo sapiens
uggaccugccuccug

SEQ ID NO: 1460926 - RNA, 13 nt, Homo sapiens
uggacuaagcaau

SEQ ID NO: 1460927 - RNA, 13 nt, Homo sapiens
uggacucuuccac

SEQ ID NO: 1460928 - RNA, 18 nt, Homo sapiens
uggacuggaggugggcau

SEQ ID NO: 1460929 - RNA, 11 nt, Homo sapiens
uggacugggag

SEQ ID NO: 1460930 - RNA, 21 nt, Homo sapiens
uggacuuccagugcucagagg

SEQ ID NO: 1460931 - RNA, 22 nt, Homo sapiens
uggacuuccagugcucagaggg

SEQ ID NO: 1460932 - RNA, 21 nt, Homo sapiens
uggacuuggcaggugccuguu

SEQ ID NO: 1460933 - RNA, 16 nt, Homo sapiens
uggacuuuugaagucc

SEQ ID NO: 1460934 - RNA, 18 nt, Homo sapiens
uggagaagcuagaaggca

SEQ ID NO: 1460935 - RNA, 22 nt, Homo sapiens
uggagacaagggcaucaucuau

SEQ ID NO: 1460936 - RNA, 14 nt, Homo sapiens
uggagacacaacua

SEQ ID NO: 1460937 - RNA, 22 nt, Homo sapiens
uggagacacaacuauuuuucca

SEQ ID NO: 1460938 - RNA, 22 nt, Homo sapiens
uggagacagacugauguguaua

SEQ ID NO: 1460939 - RNA, 18 nt, Homo sapiens
uggagacccugcaaacag

SEQ ID NO: 1460940 - RNA, 19 nt, Homo sapiens
uggagacccugccacagcc

SEQ ID NO: 1460941 - RNA, 23 nt, Homo sapiens
uggagacccugccacagccagag

SEQ ID NO: 1460942 - RNA, 13 nt, Homo sapiens
uggagacugacaa

SEQ ID NO: 1460943 - RNA, 21 nt, Homo sapiens
uggagacugauggccaggcaa

SEQ ID NO: 1460944 - RNA, 14 nt, Homo sapiens
uggagaggaaccca

SEQ ID NO: 1460945 - RNA, 21 nt, Homo sapiens
uggagagugagcuacagagcc

SEQ ID NO: 1460946 - RNA, 22 nt, Homo sapiens
uggagcacauguuacugcuuca

SEQ ID NO: 1460947 - RNA, 21 nt, Homo sapiens
uggagcuaauggcgaucaucu

SEQ ID NO: 1460948 - RNA, 23 nt, Homo sapiens
uggagcucacacuccaguggcag

SEQ ID NO: 1460949 - RNA, 11 nt, Homo sapiens
uggagcuguca

SEQ ID NO: 1460950 - RNA, 16 nt, Homo sapiens
uggaggccgcagccaa

SEQ ID NO: 1460951 - RNA, 11 nt, Homo sapiens
uggaggcuucc

SEQ ID NO: 1460952 - RNA, 19 nt, Homo sapiens
uggagggaaugcucagaaa

SEQ ID NO: 1460953 - RNA, 16 nt, Homo sapiens
uggagggacaugacua

SEQ ID NO: 1460954 - RNA, 14 nt, Homo sapiens
uggagggacuuuua

SEQ ID NO: 1460955 - RNA, 20 nt, Homo sapiens
uggaggucacauucaggaag

SEQ ID NO: 1460956 - RNA, 11 nt, Homo sapiens
uggagugcagg

SEQ ID NO: 1460957 - RNA, 22 nt, Homo sapiens
uggaguggcugccauggaagga

SEQ ID NO: 1460958 - RNA, 17 nt, Homo sapiens
uggagugucacaucucu

SEQ ID NO: 1460959 - RNA, 15 nt, Homo sapiens
uggaguuucucuguu

SEQ ID NO: 1460960 - RNA, 12 nt, Homo sapiens
uggaucagaaua

SEQ ID NO: 1460961 - RNA, 14 nt, Homo sapiens
uggaucuaccagca

SEQ ID NO: 1460962 - RNA, 17 nt, Homo sapiens
uggaucuaccagcauaa

SEQ ID NO: 1460963 - RNA, 13 nt, Homo sapiens
uccugaaagccaa

SEQ ID NO: 1460964 - RNA, 21 nt, Homo sapiens
uccugaagggggacacuccau

SEQ ID NO: 1460965 - RNA, 14 nt, Homo sapiens
uccugacacuauuc

SEQ ID NO: 1460966 - RNA, 16 nt, Homo sapiens
uccugaccucagguga

SEQ ID NO: 1460967 - RNA, 17 nt, Homo sapiens
uccugagaagcauguaa

SEQ ID NO: 1460968 - RNA, 13 nt, Homo sapiens
uccugaucuguga

SEQ ID NO: 1460969 - RNA, 18 nt, Homo sapiens
uccugaugcuuuugucua

SEQ ID NO: 1460970 - RNA, 19 nt, Homo sapiens
uccugcagaaguacuccua

SEQ ID NO: 1460971 - RNA, 16 nt, Homo sapiens
uccugccccacacucc

SEQ ID NO: 1460972 - RNA, 17 nt, Homo sapiens
uccugccccacacuccc

SEQ ID NO: 1460973 - RNA, 22 nt, Homo sapiens
uccugccccagauggcuuugug

SEQ ID NO: 1460974 - RNA, 12 nt, Homo sapiens
uccuggaaccaa

SEQ ID NO: 1460975 - RNA, 23 nt, Homo sapiens
uccuggaaccaaucccgugaaag

SEQ ID NO: 1460976 - RNA, 13 nt, Homo sapiens
uccuggcacuaac

SEQ ID NO: 1460977 - RNA, 19 nt, Homo sapiens
uccuggccaacauggugaa

SEQ ID NO: 1460978 - RNA, 21 nt, Homo sapiens
uccugggcauggguccagggc

SEQ ID NO: 1460979 - RNA, 15 nt, Homo sapiens
uccugguccuggaca

SEQ ID NO: 1460980 - RNA, 16 nt, Homo sapiens
uccugguuugacucag

SEQ ID NO: 1460981 - RNA, 15 nt, Homo sapiens
uccuguaaauggugu

SEQ ID NO: 1460982 - RNA, 15 nt, Homo sapiens
uccuguacucugggg

SEQ ID NO: 1460983 - RNA, 13 nt, Homo sapiens
uccuguauaagca

SEQ ID NO: 1460984 - RNA, 14 nt, Homo sapiens
uccuguccagcucc

SEQ ID NO: 1460985 - RNA, 23 nt, Homo sapiens
uccuguccccaaaaugugaugcu

SEQ ID NO: 1460986 - RNA, 13 nt, Homo sapiens
uccugugacuguc

SEQ ID NO: 1460987 - RNA, 20 nt, Homo sapiens
uccugugacugucucacuua

SEQ ID NO: 1460988 - RNA, 21 nt, Homo sapiens
uccuguguggccugccuucac

SEQ ID NO: 1460989 - RNA, 17 nt, Homo sapiens
uccuuaguuggcuggaa

SEQ ID NO: 1460990 - RNA, 15 nt, Homo sapiens
uccuuaucugucaca

SEQ ID NO: 1460991 - RNA, 14 nt, Homo sapiens
uccuuauuugccuu

SEQ ID NO: 1460992 - RNA, 16 nt, Homo sapiens
uccuuccaauuuggaa

SEQ ID NO: 1460993 - RNA, 19 nt, Homo sapiens
uccuuccccagcuuugcug

SEQ ID NO: 1460994 - RNA, 21 nt, Homo sapiens
uccuuccuaaacccaaugacu

SEQ ID NO: 1460995 - RNA, 22 nt, Homo sapiens
uccuucuucaacgccaucucca

SEQ ID NO: 1460996 - RNA, 15 nt, Homo sapiens
uccuuggaaauugga

SEQ ID NO: 1460997 - RNA, 18 nt, Homo sapiens
uccuugggaugaucuuga

SEQ ID NO: 1460998 - RNA, 12 nt, Homo sapiens
uccuuguaaaau

SEQ ID NO: 1460999 - RNA, 14 nt, Homo sapiens
uccuugucacuuua

SEQ ID NO: 1461000 - RNA, 22 nt, Homo sapiens
uccuuuaaagaugaacucugaa

SEQ ID NO: 1461001 - RNA, 16 nt, Homo sapiens
uccuuuauacugugaa

SEQ ID NO: 1461002 - RNA, 15 nt, Homo sapiens
uccuuucuccaggac

SEQ ID NO: 1461003 - RNA, 15 nt, Homo sapiens
uccuuucuugcagau

SEQ ID NO: 1461004 - RNA, 14 nt, Homo sapiens
uccuuuuuuauucc

SEQ ID NO: 1461005 - RNA, 14 nt, Homo sapiens
ucgaagcuguuaau

SEQ ID NO: 1461006 - RNA, 19 nt, Homo sapiens
ucgacuguauucgugcauu

SEQ ID NO: 1461007 - RNA, 14 nt, Homo sapiens
ucgaggggcucuca

SEQ ID NO: 1461008 - RNA, 15 nt, Homo sapiens
ucgaggggcucucag

SEQ ID NO: 1461009 - RNA, 17 nt, Homo sapiens
ucgaugcagugcuucca

SEQ ID NO: 1461010 - RNA, 22 nt, Homo sapiens
ucgcaacaggaaggaaccagaa

SEQ ID NO: 1461011 - RNA, 15 nt, Homo sapiens
ucgcaccacugcacu

SEQ ID NO: 1461012 - RNA, 18 nt, Homo sapiens
ucgcaccauugcacucca

SEQ ID NO: 1461013 - RNA, 15 nt, Homo sapiens
ucgcaccugugcugg

SEQ ID NO: 1461014 - RNA, 23 nt, Homo sapiens
ucgccaacauggugagacccugu

SEQ ID NO: 1461015 - RNA, 15 nt, Homo sapiens
ucgccauuguucacc

SEQ ID NO: 1461016 - RNA, 21 nt, Homo sapiens
ucgcccugcgguagaugggag

SEQ ID NO: 1461017 - RNA, 15 nt, Homo sapiens
ucgcugccagaugau

SEQ ID NO: 1461018 - RNA, 22 nt, Homo sapiens
ucgcugccagaugauuguucaa

SEQ ID NO: 1461019 - RNA, 13 nt, Homo sapiens
ucggaacagcaga

SEQ ID NO: 1461020 - RNA, 23 nt, Homo sapiens
ucggacaagacccccagcacuug

SEQ ID NO: 1461021 - RNA, 13 nt, Homo sapiens
ucggcacccugca

SEQ ID NO: 1461022 - RNA, 16 nt, Homo sapiens
ucggcagcuacucaga

SEQ ID NO: 1461023 - RNA, 14 nt, Homo sapiens
ucggccuccaugac

SEQ ID NO: 1461024 - RNA, 13 nt, Homo sapiens
ucggcucacugca

SEQ ID NO: 1461025 - RNA, 21 nt, Homo sapiens
ucggcuuuuugccaucuguga

SEQ ID NO: 1461026 - RNA, 17 nt, Homo sapiens
ucgggccccauccucau

SEQ ID NO: 1461027 - RNA, 20 nt, Homo sapiens
ucgguagaggauuucuaguu

SEQ ID NO: 1461028 - RNA, 22 nt, Homo sapiens
ucggucacuccaacucccuuaa

SEQ ID NO: 1461029 - RNA, 14 nt, Homo sapiens
ucguaagucacuga

SEQ ID NO: 1461030 - RNA, 18 nt, Homo sapiens
ucguaguguuaaguuaua

SEQ ID NO: 1461031 - RNA, 18 nt, Homo sapiens
ucgugaaaccccaucucu

SEQ ID NO: 1461032 - RNA, 18 nt, Homo sapiens
ucgugggccgcacugggg

SEQ ID NO: 1461033 - RNA, 18 nt, Homo sapiens
ucgugggguaacaucugu

SEQ ID NO: 1461034 - RNA, 15 nt, Homo sapiens
ucguguggaucuugc

SEQ ID NO: 1461035 - RNA, 23 nt, Homo sapiens
ucguuuucgcuggggauggaauu

SEQ ID NO: 1461036 - RNA, 22 nt, Homo sapiens
ucguuuugcccgauuccguauu

SEQ ID NO: 1461037 - RNA, 17 nt, Homo sapiens
ucuaaaaucccuuucaa

SEQ ID NO: 1461038 - RNA, 19 nt, Homo sapiens
ucuaaaauguguuuuauca

SEQ ID NO: 1461039 - RNA, 22 nt, Homo sapiens
ucuaaagcagaggcaacacugg

SEQ ID NO: 1461040 - RNA, 23 nt, Homo sapiens
ucuaaauuugaauguuaagcaga

SEQ ID NO: 1461041 - RNA, 12 nt, Homo sapiens
uccaaguacuuu

SEQ ID NO: 1461042 - RNA, 17 nt, Homo sapiens
uccaauauuuucuuuaa

SEQ ID NO: 1461043 - RNA, 14 nt, Homo sapiens
uccaaucuugcuuu

SEQ ID NO: 1461044 - RNA, 24 nt, Homo sapiens
uccaaucuugcuuuguguaucuca

SEQ ID NO: 1461045 - RNA, 18 nt, Homo sapiens
uccaaugcacaguugcca

SEQ ID NO: 1461046 - RNA, 19 nt, Homo sapiens
uccaauggaauacugaaaa

SEQ ID NO: 1461047 - RNA, 19 nt, Homo sapiens
uccaaugucugcugaggag

SEQ ID NO: 1461048 - RNA, 16 nt, Homo sapiens
uccaauuaguuuccuu

SEQ ID NO: 1461049 - RNA, 19 nt, Homo sapiens
uccacaaaugauguuuuca

SEQ ID NO: 1461050 - RNA, 14 nt, Homo sapiens
uccacacuaccaca

SEQ ID NO: 1461051 - RNA, 11 nt, Homo sapiens
uccacagcuua

SEQ ID NO: 1461052 - RNA, 15 nt, Homo sapiens
uccacauuugucaca

SEQ ID NO: 1461053 - RNA, 13 nt, Homo sapiens
uccaccagcagca

SEQ ID NO: 1461054 - RNA, 15 nt, Homo sapiens
uccacccagcaaaga

SEQ ID NO: 1461055 - RNA, 22 nt, Homo sapiens
uccacccauaauccuuucugcc

SEQ ID NO: 1461056 - RNA, 13 nt, Homo sapiens
uccacccuuggcc

SEQ ID NO: 1461057 - RNA, 16 nt, Homo sapiens
uccaccuagacuguaa

SEQ ID NO: 1461058 - RNA, 23 nt, Homo sapiens
uccaccuccaccacaucugccag

SEQ ID NO: 1461059 - RNA, 22 nt, Homo sapiens
uccaccuccucuccaccugcug

SEQ ID NO: 1461060 - RNA, 19 nt, Homo sapiens
uccaccucgggcacauuuu

SEQ ID NO: 1461061 - RNA, 13 nt, Homo sapiens
uccaccugucuca

SEQ ID NO: 1461062 - RNA, 23 nt, Homo sapiens
uccaccuguggguguagccaggu

SEQ ID NO: 1461063 - RNA, 14 nt, Homo sapiens
uccacgcaguucuu

SEQ ID NO: 1461064 - RNA, 21 nt, Homo sapiens
uccacucagguucuucagggc

SEQ ID NO: 1461065 - RNA, 16 nt, Homo sapiens
uccacuccacucaggu

SEQ ID NO: 1461066 - RNA, 16 nt, Homo sapiens
uccacucccuuugcca

SEQ ID NO: 1461067 - RNA, 16 nt, Homo sapiens
uccacucuugugguca

SEQ ID NO: 1461068 - RNA, 21 nt, Homo sapiens
uccacugcguuguccacaaga

SEQ ID NO: 1461069 - RNA, 23 nt, Homo sapiens
uccacuggggaggaauccuggac

SEQ ID NO: 1461070 - RNA, 15 nt, Homo sapiens
uccacuuacauauau

SEQ ID NO: 1461071 - RNA, 14 nt, Homo sapiens
uccacuucuuccuu

SEQ ID NO: 1461072 - RNA, 19 nt, Homo sapiens
uccacuugagugucaagcu

SEQ ID NO: 1461073 - RNA, 22 nt, Homo sapiens
uccacuuguucuguacuuguaa

SEQ ID NO: 1461074 - RNA, 14 nt, Homo sapiens
uccagaacugcacu

SEQ ID NO: 1461075 - RNA, 20 nt, Homo sapiens
uccagaaggauccaagacaa

SEQ ID NO: 1461076 - RNA, 16 nt, Homo sapiens
uccagaauaaaacgca

SEQ ID NO: 1461077 - RNA, 20 nt, Homo sapiens
uccagacuuccuugagacac

SEQ ID NO: 1461078 - RNA, 14 nt, Homo sapiens
uccagagaaaagag

SEQ ID NO: 1461079 - RNA, 23 nt, Homo sapiens
uccagagguauuccucucuuaaa

SEQ ID NO: 1461080 - RNA, 17 nt, Homo sapiens
uccagagguccuccgua

SEQ ID NO: 1461081 - RNA, 19 nt, Homo sapiens
uccagauccuucaaagagu

SEQ ID NO: 1461082 - RNA, 12 nt, Homo sapiens
uccagauggcaa

SEQ ID NO: 1461083 - RNA, 23 nt, Homo sapiens
uccagcaaaagagcuauugccaa

SEQ ID NO: 1461084 - RNA, 13 nt, Homo sapiens
uccagcagcuuuc

SEQ ID NO: 1461085 - RNA, 22 nt, Homo sapiens
uccagccaaccucauugcagcu

SEQ ID NO: 1461086 - RNA, 15 nt, Homo sapiens
uccagcccaggacuc

SEQ ID NO: 1461087 - RNA, 12 nt, Homo sapiens
uccagcucugag

SEQ ID NO: 1461088 - RNA, 10 nt, Homo sapiens
uccagcugcc

SEQ ID NO: 1461089 - RNA, 15 nt, Homo sapiens
uccagcuuucugcca

SEQ ID NO: 1461090 - RNA, 14 nt, Homo sapiens
uccaggccucuagu

SEQ ID NO: 1461091 - RNA, 16 nt, Homo sapiens
uccagggcaaggccau

SEQ ID NO: 1461092 - RNA, 20 nt, Homo sapiens
uccagggcuauaggguguga

SEQ ID NO: 1461093 - RNA, 23 nt, Homo sapiens
uccagggcuauagggugugauga

SEQ ID NO: 1461094 - RNA, 21 nt, Homo sapiens
uccagguuuccuuaagggaca

SEQ ID NO: 1461095 - RNA, 21 nt, Homo sapiens
uccaguccaaagccggcuuga

SEQ ID NO: 1461096 - RNA, 16 nt, Homo sapiens
uccagucccaugaccu

SEQ ID NO: 1461097 - RNA, 13 nt, Homo sapiens
uccagugcaggag

SEQ ID NO: 1461098 - RNA, 19 nt, Homo sapiens
uccagugccagcaaugaca

SEQ ID NO: 1461099 - RNA, 20 nt, Homo sapiens
uccagugucugucauuucag

SEQ ID NO: 1461100 - RNA, 20 nt, Homo sapiens
uccagugugggcuugaccag

SEQ ID NO: 1461101 - RNA, 23 nt, Homo sapiens
uccaguuuuauaaaaaguggaga

SEQ ID NO: 1461102 - RNA, 15 nt, Homo sapiens
uccauaccaucuggu

SEQ ID NO: 1461103 - RNA, 22 nt, Homo sapiens
uccauagccuaaucccugggca

SEQ ID NO: 1461104 - RNA, 21 nt, Homo sapiens
uccauaggcgcaggugcacag

SEQ ID NO: 1461105 - RNA, 14 nt, Homo sapiens
uccaucccuacccc

SEQ ID NO: 1461106 - RNA, 21 nt, Homo sapiens
uccauccgguggccuauucca

SEQ ID NO: 1461107 - RNA, 16 nt, Homo sapiens
uccaucucuucugcaa

SEQ ID NO: 1461108 - RNA, 22 nt, Homo sapiens
uccaucuuccacgaaaugggcc

SEQ ID NO: 1461109 - RNA, 13 nt, Homo sapiens
uccaucuuucuac

SEQ ID NO: 1461110 - RNA, 14 nt, Homo sapiens
uccaugcuccucac

SEQ ID NO: 1461111 - RNA, 20 nt, Homo sapiens
uccauguuugauguaucuga

SEQ ID NO: 1461112 - RNA, 14 nt, Homo sapiens
uccauuccagaaua

SEQ ID NO: 1461113 - RNA, 16 nt, Homo sapiens
uccauugccuagcucu

SEQ ID NO: 1461114 - RNA, 20 nt, Homo sapiens
uccauuuccccuccuuccca

SEQ ID NO: 1461115 - RNA, 19 nt, Homo sapiens
uccauuuuuguaagccaua

SEQ ID NO: 1461116 - RNA, 14 nt, Homo sapiens
ucccaacacuguca

SEQ ID NO: 1461117 - RNA, 21 nt, Homo sapiens
ucauaaaaaaaugucaaggaa

SEQ ID NO: 1461118 - RNA, 15 nt, Homo sapiens
ucauaagacaaugga

SEQ ID NO: 1461119 - RNA, 23 nt, Homo sapiens
ucauaauaucaugugcacuucaa

SEQ ID NO: 1461120 - RNA, 21 nt, Homo sapiens
ucauaaucacucuaauuaauu

SEQ ID NO: 1461121 - RNA, 22 nt, Homo sapiens
ucauaauuaaaauuuaucuuaa

SEQ ID NO: 1461122 - RNA, 20 nt, Homo sapiens
ucauaauuccuacagcacua

SEQ ID NO: 1461123 - RNA, 13 nt, Homo sapiens
ucauacaugcaua

SEQ ID NO: 1461124 - RNA, 14 nt, Homo sapiens
ucauacaugcauac

SEQ ID NO: 1461125 - RNA, 11 nt, Homo sapiens
ucauaccuuau

SEQ ID NO: 1461126 - RNA, 18 nt, Homo sapiens
ucauacuaaacuucaccu

SEQ ID NO: 1461127 - RNA, 14 nt, Homo sapiens
ucauacuacugaaa

SEQ ID NO: 1461128 - RNA, 16 nt, Homo sapiens
ucauauccaagaucaa

SEQ ID NO: 1461129 - RNA, 15 nt, Homo sapiens
ucauauguugcucag

SEQ ID NO: 1461130 - RNA, 14 nt, Homo sapiens
ucauauuaguauua

SEQ ID NO: 1461131 - RNA, 17 nt, Homo sapiens
ucauauuguugcauugc

SEQ ID NO: 1461132 - RNA, 15 nt, Homo sapiens
ucaucacauucaggg

SEQ ID NO: 1461133 - RNA, 20 nt, Homo sapiens
ucaucaggaaggaaaugaca

SEQ ID NO: 1461134 - RNA, 13 nt, Homo sapiens
ucaucaggaugaa

SEQ ID NO: 1461135 - RNA, 12 nt, Homo sapiens
ucaucauggcaa

SEQ ID NO: 1461136 - RNA, 23 nt, Homo sapiens
ucauccccacagcuggcucugac

SEQ ID NO: 1461137 - RNA, 18 nt, Homo sapiens
ucauccccucccagaugu

SEQ ID NO: 1461138 - RNA, 18 nt, Homo sapiens
ucaucccuucucuuccag

SEQ ID NO: 1461139 - RNA, 15 nt, Homo sapiens
ucauccuuaccgcac

SEQ ID NO: 1461140 - RNA, 17 nt, Homo sapiens
ucauccuuccauccauc

SEQ ID NO: 1461141 - RNA, 17 nt, Homo sapiens
ucaucguaaacauacuu

SEQ ID NO: 1461142 - RNA, 13 nt, Homo sapiens
ucaucucauucca

SEQ ID NO: 1461143 - RNA, 20 nt, Homo sapiens
ucaucuccaucauaugccug

SEQ ID NO: 1461144 - RNA, 20 nt, Homo sapiens
ucaucucucacacauuccag

SEQ ID NO: 1461145 - RNA, 23 nt, Homo sapiens
ucaucuguagauacuagcuaucu

SEQ ID NO: 1461146 - RNA, 16 nt, Homo sapiens
ucaucuguuguagauu

SEQ ID NO: 1461147 - RNA, 14 nt, Homo sapiens
ucaucuucacugca

SEQ ID NO: 1461148 - RNA, 18 nt, Homo sapiens
ucaucuuccuguguccug

SEQ ID NO: 1461149 - RNA, 21 nt, Homo sapiens
ucaugaaacuguccaccaaga

SEQ ID NO: 1461150 - RNA, 10 nt, Homo sapiens
ucaugaaauu

SEQ ID NO: 1461151 - RNA, 17 nt, Homo sapiens
ucaugaagcccaaguga

SEQ ID NO: 1461152 - RNA, 13 nt, Homo sapiens
ucaugacauauga

SEQ ID NO: 1461153 - RNA, 14 nt, Homo sapiens
ucaugagccugcug

SEQ ID NO: 1461154 - RNA, 16 nt, Homo sapiens
ucaugagccugcugga

SEQ ID NO: 1461155 - RNA, 19 nt, Homo sapiens
ucaugagcguuagacugac

SEQ ID NO: 1461156 - RNA, 20 nt, Homo sapiens
ucaugagcuugaacaaggac

SEQ ID NO: 1461157 - RNA, 14 nt, Homo sapiens
ucaugagugaauaa

SEQ ID NO: 1461158 - RNA, 16 nt, Homo sapiens
ucaugauuucauuuca

SEQ ID NO: 1461159 - RNA, 22 nt, Homo sapiens
ucaugcauuucaagcagcugaa

SEQ ID NO: 1461160 - RNA, 23 nt, Homo sapiens
ucaugccaccauggccagccaac

SEQ ID NO: 1461161 - RNA, 20 nt, Homo sapiens
ucaugccccuggcugggacg

SEQ ID NO: 1461162 - RNA, 17 nt, Homo sapiens
ucaugccuguaaucuca

SEQ ID NO: 1461163 - RNA, 23 nt, Homo sapiens
ucaugcucagcccugacuggugc

SEQ ID NO: 1461164 - RNA, 20 nt, Homo sapiens
ucauggaugggggaacucag

SEQ ID NO: 1461165 - RNA, 17 nt, Homo sapiens
ucauggcuaauuuaaca

SEQ ID NO: 1461166 - RNA, 20 nt, Homo sapiens
ucaugggagggggcuugaag

SEQ ID NO: 1461167 - RNA, 13 nt, Homo sapiens
ucauguauguuau

SEQ ID NO: 1461168 - RNA, 16 nt, Homo sapiens
ucaugucucacuucac

SEQ ID NO: 1461169 - RNA, 15 nt, Homo sapiens
ucaugugcacuucaa

SEQ ID NO: 1461170 - RNA, 19 nt, Homo sapiens
ucauguguaauaugcacaa

SEQ ID NO: 1461171 - RNA, 20 nt, Homo sapiens
ucauguucacugugagugaa

SEQ ID NO: 1461172 - RNA, 14 nt, Homo sapiens
ucauguuccucaaa

SEQ ID NO: 1461173 - RNA, 13 nt, Homo sapiens
ucauguucuugca

SEQ ID NO: 1461174 - RNA, 21 nt, Homo sapiens
ucauguuguugaggcugucac

SEQ ID NO: 1461175 - RNA, 21 nt, Homo sapiens
ucauuacccuucccugcacua

SEQ ID NO: 1461176 - RNA, 17 nt, Homo sapiens
ucauuauuggaauuaac

SEQ ID NO: 1461177 - RNA, 19 nt, Homo sapiens
ucauuauuuugugguucua

SEQ ID NO: 1461178 - RNA, 20 nt, Homo sapiens
ucauuauuuuuccacuuugu

SEQ ID NO: 1461179 - RNA, 18 nt, Homo sapiens
ucauucaacucuccaaug

SEQ ID NO: 1461180 - RNA, 23 nt, Homo sapiens
ucauucaacucuccaauguucua

SEQ ID NO: 1461181 - RNA, 16 nt, Homo sapiens
ucauucaauauugaca

SEQ ID NO: 1461182 - RNA, 14 nt, Homo sapiens
ucauucacauucag

SEQ ID NO: 1461183 - RNA, 13 nt, Homo sapiens
ucauucuacugaa

SEQ ID NO: 1461184 - RNA, 21 nt, Homo sapiens
ucauugaaguauuuuccucca

SEQ ID NO: 1461185 - RNA, 18 nt, Homo sapiens
ucauugacaagaacugaa

SEQ ID NO: 1461186 - RNA, 14 nt, Homo sapiens
ucauugcacuuuga

SEQ ID NO: 1461187 - RNA, 20 nt, Homo sapiens
ucauugcgugauucaaugaa

SEQ ID NO: 1461188 - RNA, 23 nt, Homo sapiens
ucauuggccacugucuccacuca

SEQ ID NO: 1461189 - RNA, 15 nt, Homo sapiens
ucauuguuucugcau

SEQ ID NO: 1461190 - RNA, 22 nt, Homo sapiens
ucauuuacuuuuaaacuuugau

SEQ ID NO: 1461191 - RNA, 14 nt, Homo sapiens
ucauuuagaacuug

SEQ ID NO: 1461192 - RNA, 19 nt, Homo sapiens
guuauuaauuaauauucau

SEQ ID NO: 1461193 - RNA, 15 nt, Homo sapiens
guuauuuaugcacug

SEQ ID NO: 1461194 - RNA, 19 nt, Homo sapiens
guuauuuaugccucuguau

SEQ ID NO: 1461195 - RNA, 19 nt, Homo sapiens
guuauuucucugauuugca

SEQ ID NO: 1461196 - RNA, 17 nt, Homo sapiens
guuauuuuaucugcuau

SEQ ID NO: 1461197 - RNA, 13 nt, Homo sapiens
guucaaagcacag

SEQ ID NO: 1461198 - RNA, 20 nt, Homo sapiens
guucaauaaagcacugagca

SEQ ID NO: 1461199 - RNA, 16 nt, Homo sapiens
guucacucccaaccug

SEQ ID NO: 1461200 - RNA, 24 nt, Homo sapiens
guucacugagcuccccagaucucc

SEQ ID NO: 1461201 - RNA, 18 nt, Homo sapiens
guucacuggacacuucac

SEQ ID NO: 1461202 - RNA, 13 nt, Homo sapiens
guucaggguccuu

SEQ ID NO: 1461203 - RNA, 19 nt, Homo sapiens
guucauggguuuaccacua

SEQ ID NO: 1461204 - RNA, 14 nt, Homo sapiens
guucaugugccucu

SEQ ID NO: 1461205 - RNA, 22 nt, Homo sapiens
guucauuggcaagaugaaauaa

SEQ ID NO: 1461206 - RNA, 14 nt, Homo sapiens
guuccaguaccgcc

SEQ ID NO: 1461207 - RNA, 13 nt, Homo sapiens
guuccccagagaa

SEQ ID NO: 1461208 - RNA, 15 nt, Homo sapiens
guucccccagcaagc

SEQ ID NO: 1461209 - RNA, 16 nt, Homo sapiens
guucccccaguaccuc

SEQ ID NO: 1461210 - RNA, 22 nt, Homo sapiens
guucccugacuccuccaaggaa

SEQ ID NO: 1461211 - RNA, 19 nt, Homo sapiens
guucccuguucuuccucca

SEQ ID NO: 1461212 - RNA, 15 nt, Homo sapiens
guuccuauugucauu

SEQ ID NO: 1461213 - RNA, 17 nt, Homo sapiens
guuccugacaucacagc

SEQ ID NO: 1461214 - RNA, 16 nt, Homo sapiens
guuccuggcugaugau

SEQ ID NO: 1461215 - RNA, 19 nt, Homo sapiens
guucguggggaacugcgug

SEQ ID NO: 1461216 - RNA, 17 nt, Homo sapiens
guucuacacucaucuua

SEQ ID NO: 1461217 - RNA, 23 nt, Homo sapiens
guucucagagccaaguccucccu

SEQ ID NO: 1461218 - RNA, 18 nt, Homo sapiens
guucucucguaacugguu

SEQ ID NO: 1461219 - RNA, 15 nt, Homo sapiens
guucugaaagugacu

SEQ ID NO: 1461220 - RNA, 20 nt, Homo sapiens
uaaaacucacugugaucaau

SEQ ID NO: 1461221 - RNA, 23 nt, Homo sapiens
uaaaacugaacuucagagcauga

SEQ ID NO: 1461222 - RNA, 21 nt, Homo sapiens
uaaaacugauuuuuagcuuua

SEQ ID NO: 1461223 - RNA, 20 nt, Homo sapiens
uaaaacuuaccuaagugaca

SEQ ID NO: 1461224 - RNA, 13 nt, Homo sapiens
uaaaacuucuuaa

SEQ ID NO: 1461225 - RNA, 12 nt, Homo sapiens
uaaaacuuuccu

SEQ ID NO: 1461226 - RNA, 23 nt, Homo sapiens
uaaaagaaccgagcaauuuucug

SEQ ID NO: 1461227 - RNA, 22 nt, Homo sapiens
uaaaagauuuuuuuuaaucuag

SEQ ID NO: 1461228 - RNA, 21 nt, Homo sapiens
uaaaaggaaagaaaacaucuu

SEQ ID NO: 1461229 - RNA, 20 nt, Homo sapiens
uaaaagguaugguggggaua

SEQ ID NO: 1461230 - RNA, 22 nt, Homo sapiens
uaaaagguuaaauauugucaua

SEQ ID NO: 1461231 - RNA, 18 nt, Homo sapiens
uaaaagguugcauacuga

SEQ ID NO: 1461232 - RNA, 20 nt, Homo sapiens
uaaaaguaaacuacuguuag

SEQ ID NO: 1461233 - RNA, 16 nt, Homo sapiens
uaaaagugacucucag

SEQ ID NO: 1461234 - RNA, 13 nt, Homo sapiens
uaaaaguuacuua

SEQ ID NO: 1461235 - RNA, 20 nt, Homo sapiens
uaaaaguucuuuuugcucua

SEQ ID NO: 1461236 - RNA, 14 nt, Homo sapiens
uaaaauaagagauc

SEQ ID NO: 1461237 - RNA, 16 nt, Homo sapiens
uaaaauacuauugccu

SEQ ID NO: 1461238 - RNA, 21 nt, Homo sapiens
uaaaauacuuuuacucugccu

SEQ ID NO: 1461239 - RNA, 22 nt, Homo sapiens
uaaaauagaaacauuuguaugg

SEQ ID NO: 1461240 - RNA, 14 nt, Homo sapiens
uaaaauauaaucua

SEQ ID NO: 1461241 - RNA, 14 nt, Homo sapiens
uaaaauauggcuau

SEQ ID NO: 1461242 - RNA, 18 nt, Homo sapiens
uaaaauauuuaucugauu

SEQ ID NO: 1461243 - RNA, 18 nt, Homo sapiens
uaaaauauuugaaugaaa

SEQ ID NO: 1461244 - RNA, 19 nt, Homo sapiens
uaaaaugaaauuacuacaa

SEQ ID NO: 1461245 - RNA, 20 nt, Homo sapiens
uaaaaugaaauuacuacaaa

SEQ ID NO: 1461246 - RNA, 19 nt, Homo sapiens
uaaaauguacucagcuauc

SEQ ID NO: 1461247 - RNA, 18 nt, Homo sapiens
uaaaaugugaagugaaug

SEQ ID NO: 1461248 - RNA, 22 nt, Homo sapiens
uaaaauguguuuuaucacuuca

SEQ ID NO: 1461249 - RNA, 17 nt, Homo sapiens
uaaaauucagaugcugu

SEQ ID NO: 1461250 - RNA, 12 nt, Homo sapiens
uaaaauugcuau

SEQ ID NO: 1461251 - RNA, 19 nt, Homo sapiens
uaaaauugcuucuuuacca

SEQ ID NO: 1461252 - RNA, 15 nt, Homo sapiens
uaaaauuucuaagag

SEQ ID NO: 1461253 - RNA, 15 nt, Homo sapiens
uaaacaaauucauau

SEQ ID NO: 1461254 - RNA, 22 nt, Homo sapiens
uaaacaacuuguacuuguuuca

SEQ ID NO: 1461255 - RNA, 18 nt, Homo sapiens
uaaacaauucaugccuuu

SEQ ID NO: 1461256 - RNA, 19 nt, Homo sapiens
uaaacacaaaguguauaca

SEQ ID NO: 1461257 - RNA, 18 nt, Homo sapiens
uaaacacuuguagagcag

SEQ ID NO: 1461258 - RNA, 18 nt, Homo sapiens
uaaacagauggcacuuug

SEQ ID NO: 1461259 - RNA, 19 nt, Homo sapiens
uaaacagauggcacuuuga

SEQ ID NO: 1461260 - RNA, 17 nt, Homo sapiens
uaaacauugaaguaaug

SEQ ID NO: 1461261 - RNA, 16 nt, Homo sapiens
uaaacauuucauuucc

SEQ ID NO: 1461262 - RNA, 19 nt, Homo sapiens
uaaaccaaggacugagcac

SEQ ID NO: 1461263 - RNA, 16 nt, Homo sapiens
uaaaccaagugaucaa

SEQ ID NO: 1461264 - RNA, 23 nt, Homo sapiens
uaaaccagguuuagacaguauga

SEQ ID NO: 1461265 - RNA, 21 nt, Homo sapiens
uaaaccuugaagggcuuuauu

SEQ ID NO: 1461266 - RNA, 19 nt, Homo sapiens
uaaacuaauauuuguuuca

SEQ ID NO: 1461267 - RNA, 14 nt, Homo sapiens
uaaacuaggaauuu

SEQ ID NO: 1461268 - RNA, 16 nt, Homo sapiens
uaaacugaaaauggac

SEQ ID NO: 1461269 - RNA, 20 nt, Homo sapiens
uaaacugaauauaaagcuua

SEQ ID NO: 1461270 - RNA, 15 nt, Homo sapiens
uaaacugacuuuauc

SEQ ID NO: 1461271 - RNA, 22 nt, Homo sapiens
uaaacuugaguuggaguacuau

SEQ ID NO: 1461272 - RNA, 18 nt, Homo sapiens
uaaagaaggauaaauugu

SEQ ID NO: 1461273 - RNA, 14 nt, Homo sapiens
uaaagaaugccauu

SEQ ID NO: 1461274 - RNA, 19 nt, Homo sapiens
uaaagaauuaacagagauu

SEQ ID NO: 1461275 - RNA, 18 nt, Homo sapiens
uaaagaauucgguugaaa

SEQ ID NO: 1461276 - RNA, 21 nt, Homo sapiens
uaaagcacccuguaucacaga

SEQ ID NO: 1461277 - RNA, 20 nt, Homo sapiens
uaaagcagaggcaacacugg

SEQ ID NO: 1461278 - RNA, 18 nt, Homo sapiens
uaaagcauuccccaaaga

SEQ ID NO: 1461279 - RNA, 20 nt, Homo sapiens
uaaagcccaaccuccugacc

SEQ ID NO: 1461280 - RNA, 14 nt, Homo sapiens
uaaagccuccucau

SEQ ID NO: 1461281 - RNA, 20 nt, Homo sapiens
uaaagccuguggguuugguc

SEQ ID NO: 1461282 - RNA, 19 nt, Homo sapiens
uaaagcuauguuacaugga

SEQ ID NO: 1461283 - RNA, 23 nt, Homo sapiens
uaaagcuuuuauucguccuuuga

SEQ ID NO: 1461284 - RNA, 16 nt, Homo sapiens
uaaaguauauauuuau

SEQ ID NO: 1461285 - RNA, 14 nt, Homo sapiens
uaaagucaacauau

SEQ ID NO: 1461286 - RNA, 18 nt, Homo sapiens
uaaagucaacauaugcaa

SEQ ID NO: 1461287 - RNA, 16 nt, Homo sapiens
uaaagucacagaauua

SEQ ID NO: 1461288 - RNA, 20 nt, Homo sapiens
uaaaguccaaagucagaucu

SEQ ID NO: 1461289 - RNA, 23 nt, Homo sapiens
uaaaguccuuggacuguuuugaa

SEQ ID NO: 1461290 - RNA, 16 nt, Homo sapiens
uaaagucucucugacu

SEQ ID NO: 1461291 - RNA, 15 nt, Homo sapiens
gcuggacgugcgcga

SEQ ID NO: 1461292 - RNA, 16 nt, Homo sapiens
gcuggagaggaaccca

SEQ ID NO: 1461293 - RNA, 23 nt, Homo sapiens
gcuggaggccucaggugcugucc

SEQ ID NO: 1461294 - RNA, 16 nt, Homo sapiens
gcuggagguggggcga

SEQ ID NO: 1461295 - RNA, 14 nt, Homo sapiens
gcuggagugcagua

SEQ ID NO: 1461296 - RNA, 20 nt, Homo sapiens
gcuggagugcagugguguga

SEQ ID NO: 1461297 - RNA, 13 nt, Homo sapiens
gcuggcaaccacu

SEQ ID NO: 1461298 - RNA, 22 nt, Homo sapiens
gcugggaagacgccugagcuca

SEQ ID NO: 1461299 - RNA, 17 nt, Homo sapiens
gcugggagcacuggugu

SEQ ID NO: 1461300 - RNA, 22 nt, Homo sapiens
gcugggauuacaggugugugcc

SEQ ID NO: 1461301 - RNA, 18 nt, Homo sapiens
gcugggcaugguggcgca

SEQ ID NO: 1461302 - RNA, 16 nt, Homo sapiens
gcugggccauguccaa

SEQ ID NO: 1461303 - RNA, 23 nt, Homo sapiens
gcuggggccaccaucccugaugg

SEQ ID NO: 1461304 - RNA, 12 nt, Homo sapiens
gcugggugggcc

SEQ ID NO: 1461305 - RNA, 12 nt, Homo sapiens
gcuggucagggu

SEQ ID NO: 1461306 - RNA, 23 nt, Homo sapiens
gcuggugccccacagcuaccuga

SEQ ID NO: 1461307 - RNA, 15 nt, Homo sapiens
gcugguggugcugca

SEQ ID NO: 1461308 - RNA, 13 nt, Homo sapiens
gcuguagauccca

SEQ ID NO: 1461309 - RNA, 21 nt, Homo sapiens
gcugucaucugugcacugccc

SEQ ID NO: 1461310 - RNA, 18 nt, Homo sapiens
gcuguccugaucugugau

SEQ ID NO: 1461311 - RNA, 14 nt, Homo sapiens
gcuguccugcagca

SEQ ID NO: 1461312 - RNA, 14 nt, Homo sapiens
gcugucuucuggac

SEQ ID NO: 1461313 - RNA, 23 nt, Homo sapiens
gcugugaccauuuauaauguuag

SEQ ID NO: 1461314 - RNA, 22 nt, Homo sapiens
gcugugagccccugguccugag

SEQ ID NO: 1461315 - RNA, 22 nt, Homo sapiens
gcuguggagagggucaaggagu

SEQ ID NO: 1461316 - RNA, 15 nt, Homo sapiens
gcuguggccagggug

SEQ ID NO: 1461317 - RNA, 16 nt, Homo sapiens
gcugugugaaacaugg

SEQ ID NO: 1461318 - RNA, 16 nt, Homo sapiens
gcuguguuuccaucuc

SEQ ID NO: 1461319 - RNA, 15 nt, Homo sapiens
gcuguuccugagaaa

SEQ ID NO: 1461320 - RNA, 20 nt, Homo sapiens
gcuguuuccauagggugaca

SEQ ID NO: 1461321 - RNA, 13 nt, Homo sapiens
gcuuaaaauaagc

SEQ ID NO: 1461322 - RNA, 13 nt, Homo sapiens
gcuuaaacaaagu

SEQ ID NO: 1461323 - RNA, 20 nt, Homo sapiens
gcuuaacacuaucauggacu

SEQ ID NO: 1461324 - RNA, 20 nt, Homo sapiens
gcuuacaaagccuuacacag

SEQ ID NO: 1461325 - RNA, 18 nt, Homo sapiens
gcuuacauuuuuacaaua

SEQ ID NO: 1461326 - RNA, 15 nt, Homo sapiens
gcuuaccaucucuac

SEQ ID NO: 1461327 - RNA, 20 nt, Homo sapiens
gcuuagacuucgacucagga

SEQ ID NO: 1461328 - RNA, 15 nt, Homo sapiens
gcuuagagaggacaa

SEQ ID NO: 1461329 - RNA, 14 nt, Homo sapiens
gcuuagauuucaua

SEQ ID NO: 1461330 - RNA, 12 nt, Homo sapiens
gcuuagcauucc

SEQ ID NO: 1461331 - RNA, 19 nt, Homo sapiens
gcuuaguauuucucaggaa

SEQ ID NO: 1461332 - RNA, 16 nt, Homo sapiens
gcuuaguuaucagcuu

SEQ ID NO: 1461333 - RNA, 21 nt, Homo sapiens
gcuuauacacuuacacuuuau

SEQ ID NO: 1461334 - RNA, 13 nt, Homo sapiens
gcuuaugaauaua

SEQ ID NO: 1461335 - RNA, 15 nt, Homo sapiens
gcuucaaggcuucca

SEQ ID NO: 1461336 - RNA, 14 nt, Homo sapiens
gcuucaggcaaagc

SEQ ID NO: 1461337 - RNA, 14 nt, Homo sapiens
gcuucaguugcaua

SEQ ID NO: 1461338 - RNA, 17 nt, Homo sapiens
gcuucauuccaaucuau

SEQ ID NO: 1461339 - RNA, 15 nt, Homo sapiens
gcuuccaugauucua

SEQ ID NO: 1461340 - RNA, 20 nt, Homo sapiens
gcuuccuacccacaccucug

SEQ ID NO: 1461341 - RNA, 19 nt, Homo sapiens
gcuuccugaugcugggcaa

SEQ ID NO: 1461342 - RNA, 13 nt, Homo sapiens
gcuucgcuggaaa

SEQ ID NO: 1461343 - RNA, 17 nt, Homo sapiens
gcuucuaugguugacau

SEQ ID NO: 1461344 - RNA, 20 nt, Homo sapiens
gcuucuccuucuccuuccca

SEQ ID NO: 1461345 - RNA, 22 nt, Homo sapiens
gcuucuccuucuccuucccauu

SEQ ID NO: 1461346 - RNA, 17 nt, Homo sapiens
gcuucucucuccagggu

SEQ ID NO: 1461347 - RNA, 19 nt, Homo sapiens
gcuucucuugagucacacu

SEQ ID NO: 1461348 - RNA, 18 nt, Homo sapiens
gcuucuguaguacuccuu

SEQ ID NO: 1461349 - RNA, 19 nt, Homo sapiens
gcuucuguaguacuccuua

SEQ ID NO: 1461350 - RNA, 14 nt, Homo sapiens
gcuucuuucucuca

SEQ ID NO: 1461351 - RNA, 19 nt, Homo sapiens
gcuugaaaaggugaccuug

SEQ ID NO: 1461352 - RNA, 13 nt, Homo sapiens
gcuugaagccaaa

SEQ ID NO: 1461353 - RNA, 16 nt, Homo sapiens
gcuugaagccaaagaa

SEQ ID NO: 1461354 - RNA, 22 nt, Homo sapiens
gcuugggcaccagcucaugcca

SEQ ID NO: 1461355 - RNA, 11 nt, Homo sapiens
gcuugggcauu

SEQ ID NO: 1461356 - RNA, 17 nt, Homo sapiens
gcuuggguucacagugc

SEQ ID NO: 1461357 - RNA, 13 nt, Homo sapiens
gcuuguaaucaag

SEQ ID NO: 1461358 - RNA, 16 nt, Homo sapiens
gcuuguuguuugcgca

SEQ ID NO: 1461359 - RNA, 17 nt, Homo sapiens
gcuuuaaacucagggac

SEQ ID NO: 1461360 - RNA, 17 nt, Homo sapiens
gcuuuaaaugucugcau

SEQ ID NO: 1461361 - RNA, 13 nt, Homo sapiens
gcuuuagggcaau

SEQ ID NO: 1461362 - RNA, 14 nt, Homo sapiens
gcuuucagggccau

SEQ ID NO: 1461363 - RNA, 13 nt, Homo sapiens
gcuuuccaagcuu

SEQ ID NO: 1461364 - RNA, 20 nt, Homo sapiens
gcuuuccacauuugucacag

SEQ ID NO: 1461365 - RNA, 20 nt, Homo sapiens
gcuuucguaguuuucauuua

SEQ ID NO: 1461366 - RNA, 21 nt, Homo sapiens
gcuuucucuggacacugccac

SEQ ID NO: 1461367 - RNA, 23 nt, Homo sapiens
gcuuugcccaccccucacucccc

SEQ ID NO: 1461368 - RNA, 18 nt, Homo sapiens
gcuuugcuucaaauccau

SEQ ID NO: 1461369 - RNA, 21 nt, Homo sapiens
gcuuugguuccuucucugggu

SEQ ID NO: 1461370 - RNA, 14 nt, Homo sapiens
gcuuugguuuauau

SEQ ID NO: 1461371 - RNA, 23 nt, Homo sapiens
gcuuuguugaaugaagcagagaa

SEQ ID NO: 1461372 - RNA, 21 nt, Homo sapiens
gcuuuuaugauauauauaugc

SEQ ID NO: 1461373 - RNA, 14 nt, Homo sapiens
gcuuuuccucccuu

SEQ ID NO: 1461374 - RNA, 15 nt, Homo sapiens
gcccggaccuccauc

SEQ ID NO: 1461375 - RNA, 18 nt, Homo sapiens
gcccgugcccuggugaau

SEQ ID NO: 1461376 - RNA, 15 nt, Homo sapiens
gcccuacauugugcu

SEQ ID NO: 1461377 - RNA, 13 nt, Homo sapiens
gcccuacucaccu

SEQ ID NO: 1461378 - RNA, 16 nt, Homo sapiens
gcccuacucaccugag

SEQ ID NO: 1461379 - RNA, 15 nt, Homo sapiens
gcccuagacuggcug

SEQ ID NO: 1461380 - RNA, 16 nt, Homo sapiens
gcccuagcccagacuc

SEQ ID NO: 1461381 - RNA, 17 nt, Homo sapiens
gcccuagcccagacucu

SEQ ID NO: 1461382 - RNA, 13 nt, Homo sapiens
gcccuauucugcc

SEQ ID NO: 1461383 - RNA, 16 nt, Homo sapiens
gcccucagaacaaucc

SEQ ID NO: 1461384 - RNA, 22 nt, Homo sapiens
gcccuccucgggccgaggccca

SEQ ID NO: 1461385 - RNA, 15 nt, Homo sapiens
gcccuccucugucaa

SEQ ID NO: 1461386 - RNA, 16 nt, Homo sapiens
gcccuccuuucugugc

SEQ ID NO: 1461387 - RNA, 20 nt, Homo sapiens
gcccucgacacucaccauga

SEQ ID NO: 1461388 - RNA, 11 nt, Homo sapiens
gcccucgcugc

SEQ ID NO: 1461389 - RNA, 15 nt, Homo sapiens
gcccucucucugggc

SEQ ID NO: 1461390 - RNA, 23 nt, Homo sapiens
gcccucuggauccagccaugccu

SEQ ID NO: 1461391 - RNA, 19 nt, Homo sapiens
gcccugagcuuuguccuga

SEQ ID NO: 1461392 - RNA, 20 nt, Homo sapiens
gcuaacccccuucuacugag

SEQ ID NO: 1461393 - RNA, 17 nt, Homo sapiens
gcuaagauaccaaaacc

SEQ ID NO: 1461394 - RNA, 23 nt, Homo sapiens
gcuaaggaugguuuuaucuuccc

SEQ ID NO: 1461395 - RNA, 19 nt, Homo sapiens
gcuaaggcccccaaacaua

SEQ ID NO: 1461396 - RNA, 15 nt, Homo sapiens
gcuaagggugggugc

SEQ ID NO: 1461397 - RNA, 23 nt, Homo sapiens
gcuacaguuauuaaucuggacau

SEQ ID NO: 1461398 - RNA, 23 nt, Homo sapiens
gcuaccagguguucuacacucau

SEQ ID NO: 1461399 - RNA, 10 nt, Homo sapiens
gcuaccuccc

SEQ ID NO: 1461400 - RNA, 23 nt, Homo sapiens
gcuacugaugaaaucugcuagaa

SEQ ID NO: 1461401 - RNA, 13 nt, Homo sapiens
gcuacuugggagg

SEQ ID NO: 1461402 - RNA, 22 nt, Homo sapiens
gcuagaaaaggccuucuuccca

SEQ ID NO: 1461403 - RNA, 14 nt, Homo sapiens
gcuagaguccucac

SEQ ID NO: 1461404 - RNA, 15 nt, Homo sapiens
gcuauaauaaagaag

SEQ ID NO: 1461405 - RNA, 14 nt, Homo sapiens
gcuauagcuacagg

SEQ ID NO: 1461406 - RNA, 15 nt, Homo sapiens
gcuauccacagcuua

SEQ ID NO: 1461407 - RNA, 13 nt, Homo sapiens
gcuaugcuauuga

SEQ ID NO: 1461408 - RNA, 17 nt, Homo sapiens
gcuauggcccagaaaca

SEQ ID NO: 1461409 - RNA, 13 nt, Homo sapiens
gcuauuuaugcaa

SEQ ID NO: 1461410 - RNA, 17 nt, Homo sapiens
gcucaagaggccacuua

SEQ ID NO: 1461411 - RNA, 12 nt, Homo sapiens
gcucaagcugac

SEQ ID NO: 1461412 - RNA, 21 nt, Homo sapiens
gcucaagcuguccucccaccu

SEQ ID NO: 1461413 - RNA, 15 nt, Homo sapiens
gcucaauauuccuga

SEQ ID NO: 1461414 - RNA, 12 nt, Homo sapiens
gcucaccagccc

SEQ ID NO: 1461415 - RNA, 20 nt, Homo sapiens
gcucacucuggauuccacac

SEQ ID NO: 1461416 - RNA, 15 nt, Homo sapiens
gcucagaauaaggca

SEQ ID NO: 1461417 - RNA, 21 nt, Homo sapiens
gcucagcccugacuggugcua

SEQ ID NO: 1461418 - RNA, 21 nt, Homo sapiens
gcucaggaaggggugugcuga

SEQ ID NO: 1461419 - RNA, 14 nt, Homo sapiens
gcucagugcucucu

SEQ ID NO: 1461420 - RNA, 15 nt, Homo sapiens
gcucagugcucucuc

SEQ ID NO: 1461421 - RNA, 21 nt, Homo sapiens
gcucauaagcaauaccagcaa

SEQ ID NO: 1461422 - RNA, 20 nt, Homo sapiens
gcucaugucuauaaucccag

SEQ ID NO: 1461423 - RNA, 22 nt, Homo sapiens
gcucauuuuuucuucuccuaaa

SEQ ID NO: 1461424 - RNA, 21 nt, Homo sapiens
gcuccaacccccgccaccuca

SEQ ID NO: 1461425 - RNA, 16 nt, Homo sapiens
gcuccaaccugcaaag

SEQ ID NO: 1461426 - RNA, 13 nt, Homo sapiens
gcuccaccccagg

SEQ ID NO: 1461427 - RNA, 17 nt, Homo sapiens
gcuccacgaagccuuaa

SEQ ID NO: 1461428 - RNA, 13 nt, Homo sapiens
gcuccacugaaca

SEQ ID NO: 1461429 - RNA, 17 nt, Homo sapiens
gcuccaggccugcagca

SEQ ID NO: 1461430 - RNA, 17 nt, Homo sapiens
gcuccagugcaggagac

SEQ ID NO: 1461431 - RNA, 13 nt, Homo sapiens
gcuccaguuccag

SEQ ID NO: 1461432 - RNA, 12 nt, Homo sapiens
gcucccaugacc

SEQ ID NO: 1461433 - RNA, 12 nt, Homo sapiens
gcucccauuccu

SEQ ID NO: 1461434 - RNA, 20 nt, Homo sapiens
gcucccccaggcuguucucc

SEQ ID NO: 1461435 - RNA, 22 nt, Homo sapiens
gcuccccggacauacucucugc

SEQ ID NO: 1461436 - RNA, 22 nt, Homo sapiens
gcucccgaagaaugaacccaag

SEQ ID NO: 1461437 - RNA, 16 nt, Homo sapiens
gcucccuagacugcau

SEQ ID NO: 1461438 - RNA, 16 nt, Homo sapiens
gcucccuuucucagga

SEQ ID NO: 1461439 - RNA, 13 nt, Homo sapiens
gcuccggggccag

SEQ ID NO: 1461440 - RNA, 13 nt, Homo sapiens
gcuccuccagggu

SEQ ID NO: 1461441 - RNA, 20 nt, Homo sapiens
gcuccuccuugcccagacua

SEQ ID NO: 1461442 - RNA, 20 nt, Homo sapiens
gcuccucuccccagcccaga

SEQ ID NO: 1461443 - RNA, 15 nt, Homo sapiens
gcuccugaggggcau

SEQ ID NO: 1461444 - RNA, 18 nt, Homo sapiens
gcuccuuggcuuaccuga

SEQ ID NO: 1461445 - RNA, 19 nt, Homo sapiens
gcucgcauuugucaaugac

SEQ ID NO: 1461446 - RNA, 16 nt, Homo sapiens
gcucucaagucaagga

SEQ ID NO: 1461447 - RNA, 20 nt, Homo sapiens
gcucucaagucaaggaagcu

SEQ ID NO: 1461448 - RNA, 17 nt, Homo sapiens
gcucuccugacuuuuaa

SEQ ID NO: 1461449 - RNA, 14 nt, Homo sapiens
gcucucgacaguau

SEQ ID NO: 1461450 - RNA, 15 nt, Homo sapiens
gcucugacaagaugg

SEQ ID NO: 1461451 - RNA, 21 nt, Homo sapiens
gcucugagacccuuuucucag

SEQ ID NO: 1461452 - RNA, 15 nt, Homo sapiens
gcucugcuaugagug

SEQ ID NO: 1461453 - RNA, 16 nt, Homo sapiens
gcucuggaguccugcu

SEQ ID NO: 1461454 - RNA, 14 nt, Homo sapiens
gcucuggccacaac

SEQ ID NO: 1461455 - RNA, 17 nt, Homo sapiens
gcucugggauagcugac

SEQ ID NO: 1461456 - RNA, 18 nt, Homo sapiens
gcucuuaugugugccuuu

SEQ ID NO: 1461457 - RNA, 20 nt, Homo sapiens
gcucuuaugugugccuuugu

SEQ ID NO: 1461458 - RNA, 17 nt, Homo sapiens
gcugaaagaacauggac

SEQ ID NO: 1461459 - RNA, 14 nt, Homo sapiens
gcugaagugucaca

SEQ ID NO: 1461460 - RNA, 22 nt, Homo sapiens
gcugaaugccuccuguggggaa

SEQ ID NO: 1461461 - RNA, 19 nt, Homo sapiens
gcugacacgcucaguugaa

SEQ ID NO: 1461462 - RNA, 18 nt, Homo sapiens
gcugacagagcucugggu

SEQ ID NO: 1461463 - RNA, 14 nt, Homo sapiens
gcugaccacagcac

SEQ ID NO: 1461464 - RNA, 18 nt, Homo sapiens
gcugacuguacuccuccc

SEQ ID NO: 1461465 - RNA, 21 nt, Homo sapiens
gcugagaauguggaauaccua

SEQ ID NO: 1461466 - RNA, 14 nt, Homo sapiens
gcugagcgccagga

SEQ ID NO: 1461467 - RNA, 16 nt, Homo sapiens
gcugagcugaacccau

SEQ ID NO: 1461468 - RNA, 17 nt, Homo sapiens
gcugagcugaguggcca

SEQ ID NO: 1461469 - RNA, 16 nt, Homo sapiens
gcugaggcaagagaau

SEQ ID NO: 1461470 - RNA, 18 nt, Homo sapiens
gcugaggccaagccacuc

SEQ ID NO: 1461471 - RNA, 20 nt, Homo sapiens
gcugaggcccccagcugccu

SEQ ID NO: 1461472 - RNA, 18 nt, Homo sapiens
gcugagggccugcuggag

SEQ ID NO: 1461473 - RNA, 19 nt, Homo sapiens
gcugaguagggacucaggg

SEQ ID NO: 1461474 - RNA, 13 nt, Homo sapiens
gcugaguccagag

SEQ ID NO: 1461475 - RNA, 20 nt, Homo sapiens
gcugaguccagagcuugugc

SEQ ID NO: 1461476 - RNA, 16 nt, Homo sapiens
gccaacugaaaauccu

SEQ ID NO: 1461477 - RNA, 20 nt, Homo sapiens
gccaagaugacacaacugca

SEQ ID NO: 1461478 - RNA, 22 nt, Homo sapiens
gccaagaugacacaacugcacu

SEQ ID NO: 1461479 - RNA, 21 nt, Homo sapiens
gccaaggaaacccccagugua

SEQ ID NO: 1461480 - RNA, 23 nt, Homo sapiens
gccaaggaaacccccaguguaau

SEQ ID NO: 1461481 - RNA, 20 nt, Homo sapiens
gccaagggaaaggggugcuu

SEQ ID NO: 1461482 - RNA, 20 nt, Homo sapiens
gccaaggggugggccuguga

SEQ ID NO: 1461483 - RNA, 20 nt, Homo sapiens
gccaagguaggcagaucacc

SEQ ID NO: 1461484 - RNA, 16 nt, Homo sapiens
gccaaguggggugcug

SEQ ID NO: 1461485 - RNA, 19 nt, Homo sapiens
gccaaucccgccaugcuca

SEQ ID NO: 1461486 - RNA, 19 nt, Homo sapiens
gccacaaaacugacaguaa

SEQ ID NO: 1461487 - RNA, 11 nt, Homo sapiens
gccacaaccaa

SEQ ID NO: 1461488 - RNA, 19 nt, Homo sapiens
gccacaaugcaguucugag

SEQ ID NO: 1461489 - RNA, 23 nt, Homo sapiens
gccacacccaggggaaggcccug

SEQ ID NO: 1461490 - RNA, 19 nt, Homo sapiens
gccacacgcacuggugcca

SEQ ID NO: 1461491 - RNA, 21 nt, Homo sapiens
gccacagaccuaggauuucau

SEQ ID NO: 1461492 - RNA, 18 nt, Homo sapiens
gccacagcagguccucca

SEQ ID NO: 1461493 - RNA, 22 nt, Homo sapiens
gaaaagcuaguguaccuccucu

SEQ ID NO: 1461494 - RNA, 17 nt, Homo sapiens
gaaaagcuauuagccag

SEQ ID NO: 1461495 - RNA, 23 nt, Homo sapiens
gaaaagcuauuagccaggaucau

SEQ ID NO: 1461496 - RNA, 18 nt, Homo sapiens
gaaaagcugccauuuccc

SEQ ID NO: 1461497 - RNA, 23 nt, Homo sapiens
gaaaagcuucuuaauuaauuuga

SEQ ID NO: 1461498 - RNA, 13 nt, Homo sapiens
gaaaaggacaaau

SEQ ID NO: 1461499 - RNA, 16 nt, Homo sapiens
gaaaagguugccugaa

SEQ ID NO: 1461500 - RNA, 19 nt, Homo sapiens
gaaaaguguccuucuugcu

SEQ ID NO: 1461501 - RNA, 16 nt, Homo sapiens
gaaaauaaacaucagu

SEQ ID NO: 1461502 - RNA, 14 nt, Homo sapiens
gaaaauaaacugac

SEQ ID NO: 1461503 - RNA, 21 nt, Homo sapiens
gaaaauaaauaucacaguauu

SEQ ID NO: 1461504 - RNA, 22 nt, Homo sapiens
gaaaauaaauaucacaguauua

SEQ ID NO: 1461505 - RNA, 18 nt, Homo sapiens
gaaaauaauuaauuucau

SEQ ID NO: 1461506 - RNA, 16 nt, Homo sapiens
gaaaauagcucuuuca

SEQ ID NO: 1461507 - RNA, 18 nt, Homo sapiens
gaaaauaucuugcuuuca

SEQ ID NO: 1461508 - RNA, 21 nt, Homo sapiens
aacuucaccuacauuaucuca

SEQ ID NO: 1461509 - RNA, 12 nt, Homo sapiens
aacuucauucuc

SEQ ID NO: 1461510 - RNA, 15 nt, Homo sapiens
aacuuccaauuuaca

SEQ ID NO: 1461511 - RNA, 19 nt, Homo sapiens
aacuuccgcugaggggucu

SEQ ID NO: 1461512 - RNA, 20 nt, Homo sapiens
aacuuccuacguauccugca

SEQ ID NO: 1461513 - RNA, 20 nt, Homo sapiens
aacuugcacgacgccugcca

SEQ ID NO: 1461514 - RNA, 15 nt, Homo sapiens
aacuugcauauguca

SEQ ID NO: 1461515 - RNA, 15 nt, Homo sapiens
aacuugcugcugagu

SEQ ID NO: 1461516 - RNA, 18 nt, Homo sapiens
aacuuggguucuucucag

SEQ ID NO: 1461517 - RNA, 19 nt, Homo sapiens
aacuuguccuuccucaaga

SEQ ID NO: 1461518 - RNA, 14 nt, Homo sapiens
aacuuuaagucuca

SEQ ID NO: 1461519 - RNA, 22 nt, Homo sapiens
aagcaaacacuuacagaauuau

SEQ ID NO: 1461520 - RNA, 15 nt, Homo sapiens
aagcaaauguuggga

SEQ ID NO: 1461521 - RNA, 15 nt, Homo sapiens
aagcaaggcuuuaaa

SEQ ID NO: 1461522 - RNA, 18 nt, Homo sapiens
aagcaaggcuuuaaauga

SEQ ID NO: 1461523 - RNA, 21 nt, Homo sapiens
aagcaaguuucaucagucaau

SEQ ID NO: 1461524 - RNA, 18 nt, Homo sapiens
aagcaaguuuucuuccau

SEQ ID NO: 1461525 - RNA, 20 nt, Homo sapiens
aagcacaagcagagugcaca

SEQ ID NO: 1461526 - RNA, 13 nt, Homo sapiens
aagcacaucugca

SEQ ID NO: 1461527 - RNA, 22 nt, Homo sapiens
aagcacaucuuugaccacguca

SEQ ID NO: 1461528 - RNA, 22 nt, Homo sapiens
aagcacgugucucagacugcau

SEQ ID NO: 1461529 - RNA, 14 nt, Homo sapiens
aagcacuacaccuu

SEQ ID NO: 1461530 - RNA, 19 nt, Homo sapiens
aaaggaagcuccacuguca

SEQ ID NO: 1461531 - RNA, 13 nt, Homo sapiens
aaaggaaucucca

SEQ ID NO: 1461532 - RNA, 16 nt, Homo sapiens
aaaggacucuccagcc

SEQ ID NO: 1461533 - RNA, 21 nt, Homo sapiens
aaaggacucugcuucagucca

SEQ ID NO: 1461534 - RNA, 21 nt, Homo sapiens
aaaggauguuuugucccauuu

SEQ ID NO: 1461535 - RNA, 15 nt, Homo sapiens
aaaggccucuuguaa

SEQ ID NO: 1461536 - RNA, 22 nt, Homo sapiens
aaaggcuagaacacuacagggg

SEQ ID NO: 1461537 - RNA, 21 nt, Homo sapiens
aaagggaaggugacugaaggc

SEQ ID NO: 1461538 - RNA, 16 nt, Homo sapiens
aaagggugacuuacau

SEQ ID NO: 1461539 - RNA, 13 nt, Homo sapiens
aaagguacuauau

SEQ ID NO: 1461540 - RNA, 16 nt, Homo sapiens
aaaggugaccaaugau

SEQ ID NO: 1461541 - RNA, 22 nt, Homo sapiens
acauucuuguuuuaagugccuu

SEQ ID NO: 1461542 - RNA, 23 nt, Homo sapiens
acauucuuguuuuaagugccuuu

SEQ ID NO: 1461543 - RNA, 19 nt, Homo sapiens
acauugaaagagaaccagu

SEQ ID NO: 1461544 - RNA, 20 nt, Homo sapiens
acauugaccaagaacugcau

SEQ ID NO: 1461545 - RNA, 16 nt, Homo sapiens
acauugaccgcaacuc

SEQ ID NO: 1461546 - RNA, 20 nt, Homo sapiens
acauugcauucuauugccuu

SEQ ID NO: 1461547 - RNA, 16 nt, Homo sapiens
acauugcuugugccac

SEQ ID NO: 1461548 - RNA, 20 nt, Homo sapiens
acauugcuugugccacaccc

SEQ ID NO: 1461549 - RNA, 19 nt, Homo sapiens
acauuggacagugagguca

SEQ ID NO: 1461550 - RNA, 12 nt, Homo sapiens
acauugugccuu

SEQ ID NO: 1461551 - RNA, 20 nt, Homo sapiens
acauugugggauguucagca

SEQ ID NO: 1461552 - RNA, 23 nt, Homo sapiens
acauugugucagauuaccaguua

SEQ ID NO: 1461553 - RNA, 19 nt, Homo sapiens
acauuuaaauguaacuuau

SEQ ID NO: 1461554 - RNA, 14 nt, Homo sapiens
acauuuagaacuuu

SEQ ID NO: 1461555 - RNA, 18 nt, Homo sapiens
acauuuauccaagaccug

SEQ ID NO: 1461556 - RNA, 13 nt, Homo sapiens
acauuuccuuaca

SEQ ID NO: 1461557 - RNA, 14 nt, Homo sapiens
acauuucuuugcau

SEQ ID NO: 1461558 - RNA, 20 nt, Homo sapiens
acauuugacaaaacuaaccu

SEQ ID NO: 1461559 - RNA, 17 nt, Homo sapiens
acauuuggacauuucca

SEQ ID NO: 1461560 - RNA, 15 nt, Homo sapiens
acauuuguuccugga

SEQ ID NO: 1461561 - RNA, 23 nt, Homo sapiens
acauuuguuccuggaguuuugau

SEQ ID NO: 1461562 - RNA, 14 nt, Homo sapiens
acauuuucuuucau

SEQ ID NO: 1461563 - RNA, 15 nt, Homo sapiens
acauuuuuccaguaa

SEQ ID NO: 1461564 - RNA, 18 nt, Homo sapiens
acauuuuuccguuugcuu

SEQ ID NO: 1461565 - RNA, 23 nt, Homo sapiens
acauuuuuugggcagcaauuuaa

SEQ ID NO: 1461566 - RNA, 13 nt, Homo sapiens
accaaaaagggau

SEQ ID NO: 1461567 - RNA, 15 nt, Homo sapiens
accaaaaaugaugcg

SEQ ID NO: 1461568 - RNA, 15 nt, Homo sapiens
accaaaagugcuccc

SEQ ID NO: 1461569 - RNA, 18 nt, Homo sapiens
accaaaauagucuucuca

SEQ ID NO: 1461570 - RNA, 21 nt, Homo sapiens
accaaaggugugcccuguaca

SEQ ID NO: 1461571 - RNA, 15 nt, Homo sapiens
accaaauaauuucau

SEQ ID NO: 1461572 - RNA, 18 nt, Homo sapiens
accaacugggcccaagac

SEQ ID NO: 1461573 - RNA, 15 nt, Homo sapiens
accaacuguacaaaa

SEQ ID NO: 1461574 - RNA, 18 nt, Homo sapiens
accaagaacauaagaauu

SEQ ID NO: 1461575 - RNA, 23 nt, Homo sapiens
accaagcguuucccagucuuagc

SEQ ID NO: 1461576 - RNA, 18 nt, Homo sapiens
accaaggaagcagccuca

SEQ ID NO: 1461577 - RNA, 17 nt, Homo sapiens
accaagucaaacuugga

SEQ ID NO: 1461578 - RNA, 20 nt, Homo sapiens
accaaugcccagcaggggag

SEQ ID NO: 1461579 - RNA, 12 nt, Homo sapiens
accacaaggaaa

SEQ ID NO: 1461580 - RNA, 21 nt, Homo sapiens
accacaccuggcccuugcaau

SEQ ID NO: 1461581 - RNA, 16 nt, Homo sapiens
accacagcacagccaa

SEQ ID NO: 1461582 - RNA, 13 nt, Homo sapiens
accacagcugcag

SEQ ID NO: 1461583 - RNA, 18 nt, Homo sapiens
accacagggccagaggga

SEQ ID NO: 1461584 - RNA, 13 nt, Homo sapiens
accacagugucug

SEQ ID NO: 1461585 - RNA, 17 nt, Homo sapiens
accacauccuccgucca

SEQ ID NO: 1461586 - RNA, 13 nt, Homo sapiens
accacaucugcca

SEQ ID NO: 1461587 - RNA, 15 nt, Homo sapiens
accacccucccugac

SEQ ID NO: 1461588 - RNA, 22 nt, Homo sapiens
accaccuggggagagccugcuu

SEQ ID NO: 1461589 - RNA, 18 nt, Homo sapiens
accacgacuggccagggc

SEQ ID NO: 1461590 - RNA, 17 nt, Homo sapiens
accacgauucucccaaa

SEQ ID NO: 1461591 - RNA, 15 nt, Homo sapiens
accacgguagugccu

SEQ ID NO: 1461592 - RNA, 21 nt, Homo sapiens
accacuacaugcagcccaugc

SEQ ID NO: 1461593 - RNA, 17 nt, Homo sapiens
accacugcacuccaguc

SEQ ID NO: 1461594 - RNA, 12 nt, Homo sapiens
accacuuccagg

SEQ ID NO: 1461595 - RNA, 14 nt, Homo sapiens
accacuuccugcua

SEQ ID NO: 1461596 - RNA, 15 nt, Homo sapiens
accagaagccaaaga

SEQ ID NO: 1461597 - RNA, 16 nt, Homo sapiens
accagacacguacaaa

SEQ ID NO: 1461598 - RNA, 15 nt, Homo sapiens
accagacccugaauu

SEQ ID NO: 1461599 - RNA, 13 nt, Homo sapiens
accagagcaguuu

SEQ ID NO: 1461600 - RNA, 13 nt, Homo sapiens
accagagcauuuc

SEQ ID NO: 1461601 - RNA, 18 nt, Homo sapiens
accagccauacuuaucuc

SEQ ID NO: 1461602 - RNA, 18 nt, Homo sapiens
accagcccugaccccagu

SEQ ID NO: 1461603 - RNA, 22 nt, Homo sapiens
accagccuggucaacaugguga

SEQ ID NO: 1461604 - RNA, 17 nt, Homo sapiens
accaggacuauagccca

SEQ ID NO: 1461605 - RNA, 15 nt, Homo sapiens
accaggaggacaaga

SEQ ID NO: 1461606 - RNA, 22 nt, Homo sapiens
accaggcaccucuuccuugaug

SEQ ID NO: 1461607 - RNA, 12 nt, Homo sapiens
accaggccucug

SEQ ID NO: 1461608 - RNA, 22 nt, Homo sapiens
accaggcugaagucagcucaga

SEQ ID NO: 1461609 - RNA, 13 nt, Homo sapiens
accagggaugcug

SEQ ID NO: 1461610 - RNA, 11 nt, Homo sapiens
accagggaugg

SEQ ID NO: 1461611 - RNA, 22 nt, Homo sapiens
accagggccgaggaggugccug

SEQ ID NO: 1461612 - RNA, 21 nt, Homo sapiens
accaggggugauuucagagag

SEQ ID NO: 1461613 - RNA, 18 nt, Homo sapiens
accagggugguugggacg

SEQ ID NO: 1461614 - RNA, 12 nt, Homo sapiens
accagugaaaag

SEQ ID NO: 1461615 - RNA, 20 nt, Homo sapiens
accaguguccccuccacugu

SEQ ID NO: 1461616 - RNA, 22 nt, Homo sapiens
accaguguccccuccacuguca

SEQ ID NO: 1461617 - RNA, 18 nt, Homo sapiens
accagugugacaucuaca

SEQ ID NO: 1461618 - RNA, 13 nt, Homo sapiens
accauaacagcca

SEQ ID NO: 1461619 - RNA, 15 nt, Homo sapiens
accauauaccaucuc

SEQ ID NO: 1461620 - RNA, 17 nt, Homo sapiens
accauauuuuuuguaaa

SEQ ID NO: 1461621 - RNA, 19 nt, Homo sapiens
accaucccugauggcagaa

SEQ ID NO: 1461622 - RNA, 14 nt, Homo sapiens
accauccuguauuc

SEQ ID NO: 1461623 - RNA, 17 nt, Homo sapiens
accaucgaucaugaugu

SEQ ID NO: 1461624 - RNA, 18 nt, Homo sapiens
accaucuccccaggcuau

SEQ ID NO: 1461625 - RNA, 19 nt, Homo sapiens
accaucuggaaggacaucu

SEQ ID NO: 1461626 - RNA, 22 nt, Homo sapiens
accaucuggaaggacaucuaca

SEQ ID NO: 1461627 - RNA, 16 nt, Homo sapiens
accaugaaauauccag

SEQ ID NO: 1461628 - RNA, 14 nt, Homo sapiens
accaugacugugac

SEQ ID NO: 1461629 - RNA, 19 nt, Homo sapiens
accauggugagaaauugac

SEQ ID NO: 1461630 - RNA, 22 nt, Homo sapiens
acccaaaacacaggaagucagu

SEQ ID NO: 1461631 - RNA, 22 nt, Homo sapiens
acccaacugacuuguaucuguc

SEQ ID NO: 1461632 - RNA, 18 nt, Homo sapiens
acccacaccucugccaga

SEQ ID NO: 1461633 - RNA, 22 nt, Homo sapiens
acccacagacugguuuugcaac

SEQ ID NO: 1461634 - RNA, 12 nt, Homo sapiens
acccacagaugu

SEQ ID NO: 1461635 - RNA, 14 nt, Homo sapiens
acccacagaugucu

SEQ ID NO: 1461636 - RNA, 16 nt, Homo sapiens
acccacagaugucucu

SEQ ID NO: 1461637 - RNA, 18 nt, Homo sapiens
acccacagccccugcugg

SEQ ID NO: 1461638 - RNA, 15 nt, Homo sapiens
acccacgugcauuca

SEQ ID NO: 1461639 - RNA, 19 nt, Homo sapiens
acccagaaggcagagguug

SEQ ID NO: 1461640 - RNA, 14 nt, Homo sapiens
acccaggaguggau

SEQ ID NO: 1461641 - RNA, 19 nt, Homo sapiens
acccaggcccgcaccgcug

SEQ ID NO: 1461642 - RNA, 19 nt, Homo sapiens
acccaggcuggagugcagu

SEQ ID NO: 1461643 - RNA, 14 nt, Homo sapiens
aaggcuuugaguua

SEQ ID NO: 1461644 - RNA, 23 nt, Homo sapiens
aagggaauacugugcauaagcca

SEQ ID NO: 1461645 - RNA, 22 nt, Homo sapiens
aagggacaccccuacacacacc

SEQ ID NO: 1461646 - RNA, 18 nt, Homo sapiens
aagggacggggaagccga

SEQ ID NO: 1461647 - RNA, 16 nt, Homo sapiens
aagggacguccuccaa

SEQ ID NO: 1461648 - RNA, 21 nt, Homo sapiens
aagggaggggcuguguuucca

SEQ ID NO: 1461649 - RNA, 16 nt, Homo sapiens
aagggaucuuccuugg

SEQ ID NO: 1461650 - RNA, 23 nt, Homo sapiens
aagggauuugaggugaggguugg

SEQ ID NO: 1461651 - RNA, 14 nt, Homo sapiens
aagggcaucaucua

SEQ ID NO: 1461652 - RNA, 12 nt, Homo sapiens
aaggggcacugg

SEQ ID NO: 1461653 - RNA, 18 nt, Homo sapiens
aagggggggcuacauuau

SEQ ID NO: 1461654 - RNA, 14 nt, Homo sapiens
aaggggugggccac

SEQ ID NO: 1461655 - RNA, 13 nt, Homo sapiens
aaggguacugaaa

SEQ ID NO: 1461656 - RNA, 18 nt, Homo sapiens
aagggucguuaccagaga

SEQ ID NO: 1461657 - RNA, 19 nt, Homo sapiens
aaggguggaggguaaucuc

SEQ ID NO: 1461658 - RNA, 16 nt, Homo sapiens
aagggugggugcucag

SEQ ID NO: 1461659 - RNA, 20 nt, Homo sapiens
aagguagcccagcacuguga

SEQ ID NO: 1461660 - RNA, 16 nt, Homo sapiens
aagguaugcaaucaaa

SEQ ID NO: 1461661 - RNA, 15 nt, Homo sapiens
aagguauuucuccag

SEQ ID NO: 1461662 - RNA, 18 nt, Homo sapiens
aaggucaagggaaaaccc

SEQ ID NO: 1461663 - RNA, 13 nt, Homo sapiens
aaggucaccagca

SEQ ID NO: 1461664 - RNA, 23 nt, Homo sapiens
aagguccaacaagaaugcauucc

SEQ ID NO: 1461665 - RNA, 21 nt, Homo sapiens
aagguccacucccugcuccac

SEQ ID NO: 1461666 - RNA, 15 nt, Homo sapiens
aaggucucauucuuc

SEQ ID NO: 1461667 - RNA, 21 nt, Homo sapiens
aaggucugcucugcuccugaa

SEQ ID NO: 1461668 - RNA, 16 nt, Homo sapiens
aaggugaaagugcagu

SEQ ID NO: 1461669 - RNA, 20 nt, Homo sapiens
aagguggguggaucacuuga

SEQ ID NO: 1461670 - RNA, 19 nt, Homo sapiens
aaggugugagacugggaag

SEQ ID NO: 1461671 - RNA, 12 nt, Homo sapiens
aagguucacagg

SEQ ID NO: 1461672 - RNA, 21 nt, Homo sapiens
aagguuggcccccacgugggg

SEQ ID NO: 1461673 - RNA, 20 nt, Homo sapiens
aagguuucauguucacugug

SEQ ID NO: 1461674 - RNA, 22 nt, Homo sapiens
aagguuuuguugcuagcccuuc

SEQ ID NO: 1461675 - RNA, 15 nt, Homo sapiens
aaguaaauauuucag

SEQ ID NO: 1461676 - RNA, 18 nt, Homo sapiens
aaguaacuuaaggaccuu

SEQ ID NO: 1461677 - RNA, 17 nt, Homo sapiens
aaguaaguuugauuuca

SEQ ID NO: 1461678 - RNA, 17 nt, Homo sapiens
aaguaauguuaauucuu

SEQ ID NO: 1461679 - RNA, 14 nt, Homo sapiens
aaguaauugugaaa

SEQ ID NO: 1461680 - RNA, 15 nt, Homo sapiens
aaguaauuugaauag

SEQ ID NO: 1461681 - RNA, 15 nt, Homo sapiens
aaguacagccuggac

SEQ ID NO: 1461682 - RNA, 13 nt, Homo sapiens
aaguacccuuuug

SEQ ID NO: 1461683 - RNA, 16 nt, Homo sapiens
aaguagaauccuaaau

SEQ ID NO: 1461684 - RNA, 20 nt, Homo sapiens
aaguagcugagacuacaggu

SEQ ID NO: 1461685 - RNA, 17 nt, Homo sapiens
aaguagguuuacauuca

SEQ ID NO: 1461686 - RNA, 16 nt, Homo sapiens
aaguaucacucuaaaa

SEQ ID NO: 1461687 - RNA, 16 nt, Homo sapiens
aaguaugagggaaaau

SEQ ID NO: 1461688 - RNA, 12 nt, Homo sapiens
aaguauuagcca

SEQ ID NO: 1461689 - RNA, 15 nt, Homo sapiens
aaguauuauuuuaca

SEQ ID NO: 1461690 - RNA, 16 nt, Homo sapiens
aaguauuauuuuacaa

SEQ ID NO: 1461691 - RNA, 15 nt, Homo sapiens
aaguauuucugugga

SEQ ID NO: 1461692 - RNA, 20 nt, Homo sapiens
aaguauuuugaaguuuacau

SEQ ID NO: 1461693 - RNA, 15 nt, Homo sapiens
aagucacacccacuc

SEQ ID NO: 1461694 - RNA, 23 nt, Homo sapiens
aagucacugcacagugcaucuca

SEQ ID NO: 1461695 - RNA, 22 nt, Homo sapiens
aagucagaucuggucuaguuaa

SEQ ID NO: 1461696 - RNA, 16 nt, Homo sapiens
aagucagguccaauuu

SEQ ID NO: 1461697 - RNA, 13 nt, Homo sapiens
aaguccacugggg

SEQ ID NO: 1461698 - RNA, 14 nt, Homo sapiens
aaguccacuggggc

SEQ ID NO: 1461699 - RNA, 16 nt, Homo sapiens
aaguccccucuacuuu

SEQ ID NO: 1461700 - RNA, 22 nt, Homo sapiens
aagucuaaacaaaauugcaauu

SEQ ID NO: 1461701 - RNA, 13 nt, Homo sapiens
aagucuccaugaa

SEQ ID NO: 1461702 - RNA, 18 nt, Homo sapiens
aagucucucguaguguua

SEQ ID NO: 1461703 - RNA, 20 nt, Homo sapiens
aagucugucugucugaugau

SEQ ID NO: 1461704 - RNA, 14 nt, Homo sapiens
aagucuuccaugac

SEQ ID NO: 1461705 - RNA, 15 nt, Homo sapiens
aagucuuccaugacc

SEQ ID NO: 1461706 - RNA, 16 nt, Homo sapiens
aagucuuccaugaccc

SEQ ID NO: 1461707 - RNA, 21 nt, Homo sapiens
aagucuugcucugccacccag

SEQ ID NO: 1461708 - RNA, 21 nt, Homo sapiens
aagugaagagggagaagggau

SEQ ID NO: 1461709 - RNA, 22 nt, Homo sapiens
aagugaggagaaugaaauguau

SEQ ID NO: 1461710 - RNA, 22 nt, Homo sapiens
aagugauaucccccagccucaa

SEQ ID NO: 1461711 - RNA, 23 nt, Homo sapiens
aagugcauaugaaauccuugacu

SEQ ID NO: 1461712 - RNA, 14 nt, Homo sapiens
aagugcgugaaugu

SEQ ID NO: 1461713 - RNA, 18 nt, Homo sapiens
aagugcgugaauguaugu

SEQ ID NO: 1461714 - RNA, 21 nt, Homo sapiens
aagugcgugccgugugagugu

SEQ ID NO: 1461715 - RNA, 23 nt, Homo sapiens
aagugcgugccgugugaguguga

SEQ ID NO: 1461716 - RNA, 18 nt, Homo sapiens
aagugcuauuucuugcau

SEQ ID NO: 1461717 - RNA, 18 nt, Homo sapiens
aagugcuggcaaccacua

SEQ ID NO: 1461718 - RNA, 21 nt, Homo sapiens
aagugcugggauuacaggugu

SEQ ID NO: 1461719 - RNA, 16 nt, Homo sapiens
aagugcuguugggaua

SEQ ID NO: 1461720 - RNA, 15 nt, Homo sapiens
aaguggaacugcccu

SEQ ID NO: 1461721 - RNA, 14 nt, Homo sapiens
aaguggccaugcca

SEQ ID NO: 1461722 - RNA, 20 nt, Homo sapiens
aaguggcuacugacuacccu

SEQ ID NO: 1461723 - RNA, 23 nt, Homo sapiens
aagugggaucugucacaccagcc

SEQ ID NO: 1461724 - RNA, 20 nt, Homo sapiens
aaguggucgcuuacuuugag

SEQ ID NO: 1461725 - RNA, 15 nt, Homo sapiens
aaguggugaaugaca

SEQ ID NO: 1461726 - RNA, 15 nt, Homo sapiens
aaguguaaauccuuu

SEQ ID NO: 1461727 - RNA, 12 nt, Homo sapiens
aaguguaacaau

SEQ ID NO: 1461728 - RNA, 16 nt, Homo sapiens
aaguguccuucuugcu

SEQ ID NO: 1461729 - RNA, 16 nt, Homo sapiens
aaguguuuuuuauuga

SEQ ID NO: 1461730 - RNA, 20 nt, Homo sapiens
aaguuaaccccauguccuca

SEQ ID NO: 1461731 - RNA, 15 nt, Homo sapiens
aaguuaacuuccaau

SEQ ID NO: 1461732 - RNA, 16 nt, Homo sapiens
acugcaugaaugaaac

SEQ ID NO: 1461733 - RNA, 19 nt, Homo sapiens
acugcauuuuuaaauacaa

SEQ ID NO: 1461734 - RNA, 14 nt, Homo sapiens
acugcccccgccac

SEQ ID NO: 1461735 - RNA, 23 nt, Homo sapiens
acugccucccauccuucccucau

SEQ ID NO: 1461736 - RNA, 19 nt, Homo sapiens
acugcgccgaccccgccac

SEQ ID NO: 1461737 - RNA, 19 nt, Homo sapiens
acugcguggugcucuuugc

SEQ ID NO: 1461738 - RNA, 20 nt, Homo sapiens
acugcuaggcgagugccagg

SEQ ID NO: 1461739 - RNA, 21 nt, Homo sapiens
acugcucagaacuugcugcug

SEQ ID NO: 1461740 - RNA, 12 nt, Homo sapiens
acugcugcacaa

SEQ ID NO: 1461741 - RNA, 20 nt, Homo sapiens
acugcugcacaacaagauac

SEQ ID NO: 1461742 - RNA, 17 nt, Homo sapiens
acugcugcuccagugca

SEQ ID NO: 1461743 - RNA, 15 nt, Homo sapiens
acugcuguacccaga

SEQ ID NO: 1461744 - RNA, 15 nt, Homo sapiens
acugcugugaaugug

SEQ ID NO: 1461745 - RNA, 14 nt, Homo sapiens
acuggaaccaggga

SEQ ID NO: 1461746 - RNA, 21 nt, Homo sapiens
acuggaauaagaagcaaauaa

SEQ ID NO: 1461747 - RNA, 12 nt, Homo sapiens
acuggaccucag

SEQ ID NO: 1461748 - RNA, 16 nt, Homo sapiens
acuggagcaugcagag

SEQ ID NO: 1461749 - RNA, 19 nt, Homo sapiens
acuggagguugaagccaag

SEQ ID NO: 1461750 - RNA, 15 nt, Homo sapiens
acuggaguuccuuau

SEQ ID NO: 1461751 - RNA, 21 nt, Homo sapiens
acuggaguuuuggacuggaua

SEQ ID NO: 1461752 - RNA, 17 nt, Homo sapiens
acuggauucauucucau

SEQ ID NO: 1461753 - RNA, 15 nt, Homo sapiens
acuggcaugggagac

SEQ ID NO: 1461754 - RNA, 20 nt, Homo sapiens
acuggcuguuaaucuuucaa

SEQ ID NO: 1461755 - RNA, 17 nt, Homo sapiens
acuggcuucucuugagu

SEQ ID NO: 1461756 - RNA, 21 nt, Homo sapiens
acuggcuucucuugagucaca

SEQ ID NO: 1461757 - RNA, 14 nt, Homo sapiens
acugggaaucaaga

SEQ ID NO: 1461758 - RNA, 16 nt, Homo sapiens
acugggacgccuucag

SEQ ID NO: 1461759 - RNA, 17 nt, Homo sapiens
acugggccuuagugggc

SEQ ID NO: 1461760 - RNA, 14 nt, Homo sapiens
acugggcucaagag

SEQ ID NO: 1461761 - RNA, 22 nt, Homo sapiens
acuggggaggaauccuggacca

SEQ ID NO: 1461762 - RNA, 23 nt, Homo sapiens
acuggggaggaauccuggaccaa

SEQ ID NO: 1461763 - RNA, 17 nt, Homo sapiens
acugggucugacaugaa

SEQ ID NO: 1461764 - RNA, 17 nt, Homo sapiens
acugggugguccaaaga

SEQ ID NO: 1461765 - RNA, 23 nt, Homo sapiens
acuggguguugaucuuacaagau

SEQ ID NO: 1461766 - RNA, 22 nt, Homo sapiens
acugguauuguuuacguuugau

SEQ ID NO: 1461767 - RNA, 21 nt, Homo sapiens
acugguuuggucaguuacaaa

SEQ ID NO: 1461768 - RNA, 14 nt, Homo sapiens
acuguacauuguga

SEQ ID NO: 1461769 - RNA, 17 nt, Homo sapiens
acuguacugacuugagg

SEQ ID NO: 1461770 - RNA, 22 nt, Homo sapiens
acuguauguuuacuucucacca

SEQ ID NO: 1461771 - RNA, 18 nt, Homo sapiens
acugucacuguuucucug

SEQ ID NO: 1461772 - RNA, 19 nt, Homo sapiens
acuguccccacgccgggaa

SEQ ID NO: 1461773 - RNA, 14 nt, Homo sapiens
acugucccuugccu

SEQ ID NO: 1461774 - RNA, 19 nt, Homo sapiens
acugucuccuuucucuuau

SEQ ID NO: 1461775 - RNA, 23 nt, Homo sapiens
acugugccuuguuucaacaguuu

SEQ ID NO: 1461776 - RNA, 18 nt, Homo sapiens
acuguggagcucagugug

SEQ ID NO: 1461777 - RNA, 14 nt, Homo sapiens
acuguggucauccu

SEQ ID NO: 1461778 - RNA, 13 nt, Homo sapiens
acuguuccaaagc

SEQ ID NO: 1461779 - RNA, 23 nt, Homo sapiens
acuguucucuauuagacuuuaga

SEQ ID NO: 1461780 - RNA, 23 nt, Homo sapiens
acuguugagaggguuacuuacau

SEQ ID NO: 1461781 - RNA, 13 nt, Homo sapiens
acuguugcucaaa

SEQ ID NO: 1461782 - RNA, 20 nt, Homo sapiens
acuguuggagcuacugcaaa

SEQ ID NO: 1461783 - RNA, 19 nt, Homo sapiens
acuguuuuucucuaaugcu

SEQ ID NO: 1461784 - RNA, 16 nt, Homo sapiens
acuuaacuacuuuguu

SEQ ID NO: 1461785 - RNA, 19 nt, Homo sapiens
acuuaaggauggagccagc

SEQ ID NO: 1461786 - RNA, 17 nt, Homo sapiens
acuuaaguggcauuaaa

SEQ ID NO: 1461787 - RNA, 22 nt, Homo sapiens
acuuaauaaauauuacagugaa

SEQ ID NO: 1461788 - RNA, 23 nt, Homo sapiens
acuuaauacucaaaugaguaaca

SEQ ID NO: 1461789 - RNA, 22 nt, Homo sapiens
acuuaccacucgugcaucccug

SEQ ID NO: 1461790 - RNA, 17 nt, Homo sapiens
acuuagauugugcuccu

SEQ ID NO: 1461791 - RNA, 17 nt, Homo sapiens
acuuagcaugucccuac

SEQ ID NO: 1461792 - RNA, 18 nt, Homo sapiens
acuuagcuugcacaugaa

SEQ ID NO: 1461793 - RNA, 19 nt, Homo sapiens
acuuagcuugcacaugaau

SEQ ID NO: 1461794 - RNA, 21 nt, Homo sapiens
acuuagguggcaagcugugac

SEQ ID NO: 1461795 - RNA, 15 nt, Homo sapiens
acuuauaguacauga

SEQ ID NO: 1461796 - RNA, 22 nt, Homo sapiens
acuuauauugaagacaauuuga

SEQ ID NO: 1461797 - RNA, 23 nt, Homo sapiens
acuuauauugaagacaauuugau

SEQ ID NO: 1461798 - RNA, 21 nt, Homo sapiens
acuuauauuuaaaacuugccu

SEQ ID NO: 1461799 - RNA, 15 nt, Homo sapiens
acuuauuaacuaaga

SEQ ID NO: 1461800 - RNA, 20 nt, Homo sapiens
acuucaaagaggaaccagga

SEQ ID NO: 1461801 - RNA, 13 nt, Homo sapiens
acuucagaaauau

SEQ ID NO: 1461802 - RNA, 16 nt, Homo sapiens
acuucagccaggugaa

SEQ ID NO: 1461803 - RNA, 16 nt, Homo sapiens
acuucagcugccugaa

SEQ ID NO: 1461804 - RNA, 23 nt, Homo sapiens
acuucaguuuuauuuuugccaag

SEQ ID NO: 1461805 - RNA, 17 nt, Homo sapiens
acuucauauuguugcau

SEQ ID NO: 1461806 - RNA, 16 nt, Homo sapiens
acuucauucacauuca

SEQ ID NO: 1461807 - RNA, 17 nt, Homo sapiens
acuucauucacauucag

SEQ ID NO: 1461808 - RNA, 18 nt, Homo sapiens
acuucauuugaugcuaaa

SEQ ID NO: 1461809 - RNA, 16 nt, Homo sapiens
acuuccacugccaucc

SEQ ID NO: 1461810 - RNA, 13 nt, Homo sapiens
acuuccaugacau

SEQ ID NO: 1461811 - RNA, 14 nt, Homo sapiens
acuuccaugacaua

SEQ ID NO: 1461812 - RNA, 16 nt, Homo sapiens
acuuccauuaacuuag

SEQ ID NO: 1461813 - RNA, 14 nt, Homo sapiens
acuuccauuugcuu

SEQ ID NO: 1461814 - RNA, 16 nt, Homo sapiens
acuuccugccauggau

SEQ ID NO: 1461815 - RNA, 15 nt, Homo sapiens
acuucuaaaugcaua

SEQ ID NO: 1461816 - RNA, 17 nt, Homo sapiens
acuucuaauaucauuca

SEQ ID NO: 1461817 - RNA, 21 nt, Homo sapiens
acuucuaauuuauauuaucca

SEQ ID NO: 1461818 - RNA, 21 nt, Homo sapiens
acuucucugccuuugacauuu

SEQ ID NO: 1461819 - RNA, 19 nt, Homo sapiens
acuaugaagcuaccucaaa

SEQ ID NO: 1461820 - RNA, 16 nt, Homo sapiens
acuaugacacugagca

SEQ ID NO: 1461821 - RNA, 11 nt, Homo sapiens
acuaugcacaa

SEQ ID NO: 1461822 - RNA, 19 nt, Homo sapiens
acuaugggcccgagcucau

SEQ ID NO: 1461823 - RNA, 11 nt, Homo sapiens
acuauggugcu

SEQ ID NO: 1461824 - RNA, 16 nt, Homo sapiens
acuauuaaaacagcca

SEQ ID NO: 1461825 - RNA, 16 nt, Homo sapiens
acuauuacaccaaaua

SEQ ID NO: 1461826 - RNA, 21 nt, Homo sapiens
acuauuguuacauuaugugga

SEQ ID NO: 1461827 - RNA, 23 nt, Homo sapiens
acucaacauguuacugaccagca

SEQ ID NO: 1461828 - RNA, 13 nt, Homo sapiens
acucaagcacuga

SEQ ID NO: 1461829 - RNA, 16 nt, Homo sapiens
acucacaagugcucau

SEQ ID NO: 1461830 - RNA, 12 nt, Homo sapiens
acucacacuccc

SEQ ID NO: 1461831 - RNA, 15 nt, Homo sapiens
acucacagucucuuu

SEQ ID NO: 1461832 - RNA, 19 nt, Homo sapiens
acucacccugggagccagu

SEQ ID NO: 1461833 - RNA, 20 nt, Homo sapiens
acucacuccacaacccaaga

SEQ ID NO: 1461834 - RNA, 12 nt, Homo sapiens
acucacugugau

SEQ ID NO: 1461835 - RNA, 20 nt, Homo sapiens
acucacuuaucccaagagaa

SEQ ID NO: 1461836 - RNA, 17 nt, Homo sapiens
acucagagaaacaaugg

SEQ ID NO: 1461837 - RNA, 14 nt, Homo sapiens
acucagcugcucug

SEQ ID NO: 1461838 - RNA, 23 nt, Homo sapiens
acucagcugcucugcaagcagaa

SEQ ID NO: 1461839 - RNA, 17 nt, Homo sapiens
acucagcuguccugcag

SEQ ID NO: 1461840 - RNA, 14 nt, Homo sapiens
acucaggcauuuga

SEQ ID NO: 1461841 - RNA, 16 nt, Homo sapiens
acucauauucugggcu

SEQ ID NO: 1461842 - RNA, 20 nt, Homo sapiens
acuccaaugucugcugagga

SEQ ID NO: 1461843 - RNA, 14 nt, Homo sapiens
acuccacagaguga

SEQ ID NO: 1461844 - RNA, 14 nt, Homo sapiens
acuccacucagguu

SEQ ID NO: 1461845 - RNA, 21 nt, Homo sapiens
acuccacucagguucuucagg

SEQ ID NO: 1461846 - RNA, 15 nt, Homo sapiens
acuccagccugggca

SEQ ID NO: 1461847 - RNA, 19 nt, Homo sapiens
acuccagcgcugaguggga

SEQ ID NO: 1461848 - RNA, 20 nt, Homo sapiens
acuccagcugggagacacag

SEQ ID NO: 1461849 - RNA, 21 nt, Homo sapiens
acuccagcuugggcaacagag

SEQ ID NO: 1461850 - RNA, 22 nt, Homo sapiens
acuccagcuugggcaacagagc

SEQ ID NO: 1461851 - RNA, 18 nt, Homo sapiens
acuccaggcccaaggcuc

SEQ ID NO: 1461852 - RNA, 17 nt, Homo sapiens
acuccaguguacauagu

SEQ ID NO: 1461853 - RNA, 12 nt, Homo sapiens
acuccaucucaa

SEQ ID NO: 1461854 - RNA, 13 nt, Homo sapiens
acuccaugcugcc

SEQ ID NO: 1461855 - RNA, 18 nt, Homo sapiens
acuccaugcugccagccu

SEQ ID NO: 1461856 - RNA, 15 nt, Homo sapiens
acucccauuccugaa

SEQ ID NO: 1461857 - RNA, 19 nt, Homo sapiens
acuccccuuaaucuaaucu

SEQ ID NO: 1461858 - RNA, 22 nt, Homo sapiens
acuccucaaaagcaaaugagau

SEQ ID NO: 1461859 - RNA, 20 nt, Homo sapiens
acuccucuccgcaguuccug

SEQ ID NO: 1461860 - RNA, 14 nt, Homo sapiens
acuccucuuuacac

SEQ ID NO: 1461861 - RNA, 12 nt, Homo sapiens
acuccugcaaaa

SEQ ID NO: 1461862 - RNA, 19 nt, Homo sapiens
acuccugggcucaagcaau

SEQ ID NO: 1461863 - RNA, 17 nt, Homo sapiens
acuccugggcucaagcg

SEQ ID NO: 1461864 - RNA, 21 nt, Homo sapiens
acuccuuaggcuuuguugaau

SEQ ID NO: 1461865 - RNA, 13 nt, Homo sapiens
acuccuuccauca

SEQ ID NO: 1461866 - RNA, 22 nt, Homo sapiens
acuccuugcaggugacauuugc

SEQ ID NO: 1461867 - RNA, 22 nt, Homo sapiens
acuccuuguaaagacuguagaa

SEQ ID NO: 1461868 - RNA, 21 nt, Homo sapiens
acuccuuuugguuuaccuggg

SEQ ID NO: 1461869 - RNA, 16 nt, Homo sapiens
acucgcaccugugcug

SEQ ID NO: 1461870 - RNA, 14 nt, Homo sapiens
acucggauuccagc

SEQ ID NO: 1461871 - RNA, 15 nt, Homo sapiens
acucuaggguccagu

SEQ ID NO: 1461872 - RNA, 18 nt, Homo sapiens
acucucaagugucuuagg

SEQ ID NO: 1461873 - RNA, 14 nt, Homo sapiens
acucucacaugugg

SEQ ID NO: 1461874 - RNA, 20 nt, Homo sapiens
acucucugguuuacuucaaa

SEQ ID NO: 1461875 - RNA, 16 nt, Homo sapiens
acucugaaacugagaa

SEQ ID NO: 1461876 - RNA, 18 nt, Homo sapiens
acucugaaaucucagaau

SEQ ID NO: 1461877 - RNA, 17 nt, Homo sapiens
acucugagaucuaagga

SEQ ID NO: 1461878 - RNA, 11 nt, Homo sapiens
acucugagaug

SEQ ID NO: 1461879 - RNA, 14 nt, Homo sapiens
acucugaguccacu

SEQ ID NO: 1461880 - RNA, 19 nt, Homo sapiens
acucuggggugcugccuga

SEQ ID NO: 1461881 - RNA, 20 nt, Homo sapiens
acucuggggugcugccugaa

SEQ ID NO: 1461882 - RNA, 18 nt, Homo sapiens
acucuguaaaaacacuga

SEQ ID NO: 1461883 - RNA, 14 nt, Homo sapiens
acucuuaucuacau

SEQ ID NO: 1461884 - RNA, 18 nt, Homo sapiens
acucuuccaccucccaac

SEQ ID NO: 1461885 - RNA, 15 nt, Homo sapiens
acucuucucggcuca

SEQ ID NO: 1461886 - RNA, 20 nt, Homo sapiens
acucuucuuacuggugcuau

SEQ ID NO: 1461887 - RNA, 18 nt, Homo sapiens
acucuucuuuaagccaua

SEQ ID NO: 1461888 - RNA, 21 nt, Homo sapiens
acucuugaaguacuuaacaua

SEQ ID NO: 1461889 - RNA, 19 nt, Homo sapiens
acucuugaauagacuucca

SEQ ID NO: 1461890 - RNA, 15 nt, Homo sapiens
acucuugaugugaag

SEQ ID NO: 1461891 - RNA, 17 nt, Homo sapiens
acugaaacgucuaggaa

SEQ ID NO: 1461892 - RNA, 21 nt, Homo sapiens
acugaacuuaauaacugugua

SEQ ID NO: 1461893 - RNA, 19 nt, Homo sapiens
acugaagcaaagaagggaa

SEQ ID NO: 1461894 - RNA, 18 nt, Homo sapiens
acugaagugaacuaugaa

SEQ ID NO: 1461895 - RNA, 14 nt, Homo sapiens
acugaaguggcuaa

SEQ ID NO: 1461896 - RNA, 22 nt, Homo sapiens
acugacaacaugcuagguagug

SEQ ID NO: 1461897 - RNA, 18 nt, Homo sapiens
acugacaguaaaucucac

SEQ ID NO: 1461898 - RNA, 16 nt, Homo sapiens
acugacccuaacugca

SEQ ID NO: 1461899 - RNA, 18 nt, Homo sapiens
acugagcugggcaggaag

SEQ ID NO: 1461900 - RNA, 17 nt, Homo sapiens
acugagggacucugaag

SEQ ID NO: 1461901 - RNA, 18 nt, Homo sapiens
acugaguguuauuugcac

SEQ ID NO: 1461902 - RNA, 17 nt, Homo sapiens
acugauaucuggccuaa

SEQ ID NO: 1461903 - RNA, 13 nt, Homo sapiens
acugaucacccaa

SEQ ID NO: 1461904 - RNA, 17 nt, Homo sapiens
acugaugaaaucugcua

SEQ ID NO: 1461905 - RNA, 12 nt, Homo sapiens
acugaugaaggc

SEQ ID NO: 1461906 - RNA, 15 nt, Homo sapiens
acugauggccaggca

SEQ ID NO: 1461907 - RNA, 12 nt, Homo sapiens
acugaugguuca

SEQ ID NO: 1461908 - RNA, 20 nt, Homo sapiens
acugauuucacaacagauca

SEQ ID NO: 1461909 - RNA, 17 nt, Homo sapiens
acugauuuuuagcuuua

SEQ ID NO: 1461910 - RNA, 20 nt, Homo sapiens
acugauuuuuagcuuuacaa

SEQ ID NO: 1461911 - RNA, 23 nt, Homo sapiens
acugcaaccucugccucccaggu

SEQ ID NO: 1461912 - RNA, 20 nt, Homo sapiens
acugcaagcugcuugcccaa

SEQ ID NO: 1461913 - RNA, 16 nt, Homo sapiens
acugcacaguagagca

SEQ ID NO: 1461914 - RNA, 18 nt, Homo sapiens
acugcacagugcaucuca

SEQ ID NO: 1461915 - RNA, 17 nt, Homo sapiens
acugcacccagcuccag

SEQ ID NO: 1461916 - RNA, 22 nt, Homo sapiens
acugcagaacagcaucauguca

SEQ ID NO: 1461917 - RNA, 15 nt, Homo sapiens
acugcaggaccucca

SEQ ID NO: 1461918 - RNA, 17 nt, Homo sapiens
acugcaggaccuccagc

SEQ ID NO: 1461919 - RNA, 20 nt, Homo sapiens
acugcaggagcaguuugcca

SEQ ID NO: 1461920 - RNA, 21 nt, Homo sapiens
acugcaguggacaguccccac

SEQ ID NO: 1461921 - RNA, 12 nt, Homo sapiens
auguuugcacac

SEQ ID NO: 1461922 - RNA, 20 nt, Homo sapiens
acuugucuaauucguaggga

SEQ ID NO: 1461923 - RNA, 22 nt, Homo sapiens
acuugugcugaucgugcuaaau

SEQ ID NO: 1461924 - RNA, 17 nt, Homo sapiens
acuuguuugucuuccau

SEQ ID NO: 1461925 - RNA, 15 nt, Homo sapiens
acuuuaaugaacuaa

SEQ ID NO: 1461926 - RNA, 21 nt, Homo sapiens
acuuuaaugaacuaacugaca

SEQ ID NO: 1461927 - RNA, 17 nt, Homo sapiens
acuuuaccucuguggac

SEQ ID NO: 1461928 - RNA, 13 nt, Homo sapiens
acuuuagaaauaa

SEQ ID NO: 1461929 - RNA, 21 nt, Homo sapiens
acuuuagaagugcauuucuga

SEQ ID NO: 1461930 - RNA, 13 nt, Homo sapiens
acuuuaucaauua

SEQ ID NO: 1461931 - RNA, 18 nt, Homo sapiens
acuuucaugcagccuaaa

SEQ ID NO: 1461932 - RNA, 20 nt, Homo sapiens
acuuucccguuuuauuccag

SEQ ID NO: 1461933 - RNA, 17 nt, Homo sapiens
acuuuccucgccugaca

SEQ ID NO: 1461934 - RNA, 11 nt, Homo sapiens
acuuuccugca

SEQ ID NO: 1461935 - RNA, 16 nt, Homo sapiens
acuuugaaucugcaac

SEQ ID NO: 1461936 - RNA, 13 nt, Homo sapiens
acuuugacuuucu

SEQ ID NO: 1461937 - RNA, 18 nt, Homo sapiens
acuuugacuuugcccagg

SEQ ID NO: 1461938 - RNA, 17 nt, Homo sapiens
acuuugcuuaguauuga

SEQ ID NO: 1461939 - RNA, 20 nt, Homo sapiens
acuuugcuugcucauaugca

SEQ ID NO: 1461940 - RNA, 17 nt, Homo sapiens
acuuugcuugcuuugaa

SEQ ID NO: 1461941 - RNA, 24 nt, Homo sapiens
acuuuggaaacaaaaauguacaau

SEQ ID NO: 1461942 - RNA, 17 nt, Homo sapiens
acuuugggaggccaagg

SEQ ID NO: 1461943 - RNA, 22 nt, Homo sapiens
acuuugggcuuaguauuucuca

SEQ ID NO: 1461944 - RNA, 12 nt, Homo sapiens
acuuuguaaaau

SEQ ID NO: 1461945 - RNA, 15 nt, Homo sapiens
acuuuguacuugugu

SEQ ID NO: 1461946 - RNA, 16 nt, Homo sapiens
acuuuuaaacuuugau

SEQ ID NO: 1461947 - RNA, 22 nt, Homo sapiens
acuuuuaaguugcugaugaacu

SEQ ID NO: 1461948 - RNA, 13 nt, Homo sapiens
acuuuuaauguca

SEQ ID NO: 1461949 - RNA, 22 nt, Homo sapiens
acuuuuaguagagacaggguuu

SEQ ID NO: 1461950 - RNA, 21 nt, Homo sapiens
acuuuucggagacagugacug

SEQ ID NO: 1461951 - RNA, 13 nt, Homo sapiens
acuuuugaagucc

SEQ ID NO: 1461952 - RNA, 19 nt, Homo sapiens
acuuuuuaguuguucagca

SEQ ID NO: 1461953 - RNA, 19 nt, Homo sapiens
acuuuuuuagaaaugcaaa

SEQ ID NO: 1461954 - RNA, 22 nt, Homo sapiens
acuuuuuucuuauuuaacuuaa

SEQ ID NO: 1461955 - RNA, 19 nt, Homo sapiens
agaaaaaaagagugaaaaa

SEQ ID NO: 1461956 - RNA, 21 nt, Homo sapiens
agaaaaacaccgcuucugccu

SEQ ID NO: 1461957 - RNA, 20 nt, Homo sapiens
agaaaaauauauacuaaaca

SEQ ID NO: 1461958 - RNA, 13 nt, Homo sapiens
agaaaacaacuuc

SEQ ID NO: 1461959 - RNA, 15 nt, Homo sapiens
agaaaagaagacauu

SEQ ID NO: 1461960 - RNA, 16 nt, Homo sapiens
agaaaagcugccauuu

SEQ ID NO: 1461961 - RNA, 19 nt, Homo sapiens
agaaaagcugccauuuccc

SEQ ID NO: 1461962 - RNA, 19 nt, Homo sapiens
agaaaaggacaaauaucuu

SEQ ID NO: 1461963 - RNA, 20 nt, Homo sapiens
agaaaaggccuucuucccaa

SEQ ID NO: 1461964 - RNA, 21 nt, Homo sapiens
agaaaaguagguuuacauuca

SEQ ID NO: 1461965 - RNA, 13 nt, Homo sapiens
agaaaaguauuuu

SEQ ID NO: 1461966 - RNA, 17 nt, Homo sapiens
agaaaauggaaugcuac

SEQ ID NO: 1461967 - RNA, 22 nt, Homo sapiens
agaaaauguugagaaucccaaa

SEQ ID NO: 1461968 - RNA, 16 nt, Homo sapiens
agaaaauuagacugug

SEQ ID NO: 1461969 - RNA, 20 nt, Homo sapiens
agaaacaaacuccauuacuc

SEQ ID NO: 1461970 - RNA, 23 nt, Homo sapiens
agaaacaaccguuggaaacauaa

SEQ ID NO: 1461971 - RNA, 22 nt, Homo sapiens
agaaacagugggagcccugacc

SEQ ID NO: 1461972 - RNA, 14 nt, Homo sapiens
agaaacgucuucua

SEQ ID NO: 1461973 - RNA, 21 nt, Homo sapiens
agaaacuagaaaugugaauga

SEQ ID NO: 1461974 - RNA, 18 nt, Homo sapiens
agaaacuaugaagaucug

SEQ ID NO: 1461975 - RNA, 13 nt, Homo sapiens
agaaacucaccau

SEQ ID NO: 1461976 - RNA, 12 nt, Homo sapiens
agaaacucccau

SEQ ID NO: 1461977 - RNA, 18 nt, Homo sapiens
agaaacuugugaagugga

SEQ ID NO: 1461978 - RNA, 22 nt, Homo sapiens
agaaacuuuauacauuaguaaa

SEQ ID NO: 1461979 - RNA, 17 nt, Homo sapiens
agaaagacucugagaug

SEQ ID NO: 1461980 - RNA, 22 nt, Homo sapiens
agaaagacucugagauguggag

SEQ ID NO: 1461981 - RNA, 22 nt, Homo sapiens
agaaagacuugguugguagggu

SEQ ID NO: 1461982 - RNA, 14 nt, Homo sapiens
agaaagaucaaaga

SEQ ID NO: 1461983 - RNA, 23 nt, Homo sapiens
agaaagcagccauuggcacugug

SEQ ID NO: 1461984 - RNA, 14 nt, Homo sapiens
agaaagcaugauau

SEQ ID NO: 1461985 - RNA, 14 nt, Homo sapiens
agaaaggaaccugg

SEQ ID NO: 1461986 - RNA, 13 nt, Homo sapiens
agaaagugccuga

SEQ ID NO: 1461987 - RNA, 23 nt, Homo sapiens
agaaaguguuuuauuuucaaauc

SEQ ID NO: 1461988 - RNA, 15 nt, Homo sapiens
agaaauaauaugcau

SEQ ID NO: 1461989 - RNA, 20 nt, Homo sapiens
agaaauaauaugcauuguca

SEQ ID NO: 1461990 - RNA, 23 nt, Homo sapiens
agaaauacaauucuacauuguca

SEQ ID NO: 1461991 - RNA, 13 nt, Homo sapiens
agaaauacuugug

SEQ ID NO: 1461992 - RNA, 17 nt, Homo sapiens
agaaauacuuucaggca

SEQ ID NO: 1461993 - RNA, 17 nt, Homo sapiens
agaaauagacaguauau

SEQ ID NO: 1461994 - RNA, 19 nt, Homo sapiens
agaaauauggaacuuacau

SEQ ID NO: 1461995 - RNA, 14 nt, Homo sapiens
agaaauauuccaaa

SEQ ID NO: 1461996 - RNA, 23 nt, Homo sapiens
agaaaucauaguuuaaacugcau

SEQ ID NO: 1461997 - RNA, 16 nt, Homo sapiens
agaaaucuggucuugu

SEQ ID NO: 1461998 - RNA, 22 nt, Homo sapiens
agaaaucuuguuggcaaaucag

SEQ ID NO: 1461999 - RNA, 14 nt, Homo sapiens
agaaaugaacaaaa

SEQ ID NO: 1462000 - RNA, 12 nt, Homo sapiens
agaaauggccaa

SEQ ID NO: 1462001 - RNA, 20 nt, Homo sapiens
agaaauuaacaaaugugcug

SEQ ID NO: 1462002 - RNA, 23 nt, Homo sapiens
agaaauuaacaaaugugcugcuu

SEQ ID NO: 1462003 - RNA, 13 nt, Homo sapiens
agaaauuccccaa

SEQ ID NO: 1462004 - RNA, 20 nt, Homo sapiens
agaacaaaagcgacccauuc

SEQ ID NO: 1462005 - RNA, 10 nt, Homo sapiens
agaacacagg

SEQ ID NO: 1462006 - RNA, 21 nt, Homo sapiens
agaacacccaauucaaauuga

SEQ ID NO: 1462007 - RNA, 17 nt, Homo sapiens
agaacacuacugcuaaa

SEQ ID NO: 1462008 - RNA, 14 nt, Homo sapiens
agaacagagugcaa

SEQ ID NO: 1462009 - RNA, 13 nt, Homo sapiens
aggaccugugucc

SEQ ID NO: 1462010 - RNA, 15 nt, Homo sapiens
aggacguguguaaau

SEQ ID NO: 1462011 - RNA, 14 nt, Homo sapiens
aggacucagaggau

SEQ ID NO: 1462012 - RNA, 21 nt, Homo sapiens
aggacucuauuuuaaggacug

SEQ ID NO: 1462013 - RNA, 23 nt, Homo sapiens
aggacugcgggacuugggucuca

SEQ ID NO: 1462014 - RNA, 16 nt, Homo sapiens
aggacuuccauuugcu

SEQ ID NO: 1462015 - RNA, 17 nt, Homo sapiens
aggagaaacacaucuuc

SEQ ID NO: 1462016 - RNA, 21 nt, Homo sapiens
aggagaacaucauaacccaug

SEQ ID NO: 1462017 - RNA, 17 nt, Homo sapiens
aguuaugauguaaucuc

SEQ ID NO: 1462018 - RNA, 18 nt, Homo sapiens
aguuaugauguaaucucu

SEQ ID NO: 1462019 - RNA, 16 nt, Homo sapiens
aguuauguucagucac

SEQ ID NO: 1462020 - RNA, 16 nt, Homo sapiens
aguuauuaaucuggac

SEQ ID NO: 1462021 - RNA, 17 nt, Homo sapiens
aguuauuuacuuuuacc

SEQ ID NO: 1462022 - RNA, 16 nt, Homo sapiens
aguucagagucuucag

SEQ ID NO: 1462023 - RNA, 19 nt, Homo sapiens
aguucaguccacaggcaug

SEQ ID NO: 1462024 - RNA, 16 nt, Homo sapiens
aguucauaauguggug

SEQ ID NO: 1462025 - RNA, 17 nt, Homo sapiens
aguucauauguaccaug

SEQ ID NO: 1462026 - RNA, 23 nt, Homo sapiens
aguuccaggccugaucuugccug

SEQ ID NO: 1462027 - RNA, 17 nt, Homo sapiens
aguucccuuggccucag

SEQ ID NO: 1462028 - RNA, 23 nt, Homo sapiens
aguuccugcuacaacuucagcag

SEQ ID NO: 1462029 - RNA, 22 nt, Homo sapiens
aguuccuuggagggacaugacu

SEQ ID NO: 1462030 - RNA, 14 nt, Homo sapiens
aguucuggaccugg

SEQ ID NO: 1462031 - RNA, 17 nt, Homo sapiens
aguucuggucagaugau

SEQ ID NO: 1462032 - RNA, 16 nt, Homo sapiens
aguucuuaaaguuuaa

SEQ ID NO: 1462033 - RNA, 17 nt, Homo sapiens
aguucuuugggccagac

SEQ ID NO: 1462034 - RNA, 18 nt, Homo sapiens
aguugaagcuaagauuua

SEQ ID NO: 1462035 - RNA, 21 nt, Homo sapiens
aguugaucuggaacccagacu

SEQ ID NO: 1462036 - RNA, 21 nt, Homo sapiens
aguugaugggggccaggacac

SEQ ID NO: 1462037 - RNA, 14 nt, Homo sapiens
aguugcauuuagcu

SEQ ID NO: 1462038 - RNA, 19 nt, Homo sapiens
aguugcauuuagcuucuuu

SEQ ID NO: 1462039 - RNA, 23 nt, Homo sapiens
aguuggaaaaacaaaugccauau

SEQ ID NO: 1462040 - RNA, 17 nt, Homo sapiens
aguuggacucucaggga

SEQ ID NO: 1462041 - RNA, 17 nt, Homo sapiens
aguuggcaaaauggggu

SEQ ID NO: 1462042 - RNA, 20 nt, Homo sapiens
aguugucagcuuugacuuua

SEQ ID NO: 1462043 - RNA, 18 nt, Homo sapiens
aguuguggugaggccacc

SEQ ID NO: 1462044 - RNA, 19 nt, Homo sapiens
aguuguuuuauauguugcu

SEQ ID NO: 1462045 - RNA, 16 nt, Homo sapiens
aguuuaaagcuuuuau

SEQ ID NO: 1462046 - RNA, 15 nt, Homo sapiens
aguuuaaaguugcac

SEQ ID NO: 1462047 - RNA, 16 nt, Homo sapiens
aguuuacaaucagcca

SEQ ID NO: 1462048 - RNA, 15 nt, Homo sapiens
aguuuaucacacagu

SEQ ID NO: 1462049 - RNA, 14 nt, Homo sapiens
aguuuaugauuuaa

SEQ ID NO: 1462050 - RNA, 22 nt, Homo sapiens
aguuuaugcugugcuaaauauc

SEQ ID NO: 1462051 - RNA, 18 nt, Homo sapiens
aguuuauguuguacaaug

SEQ ID NO: 1462052 - RNA, 18 nt, Homo sapiens
aguuucaaacuuacuauu

SEQ ID NO: 1462053 - RNA, 21 nt, Homo sapiens
aguuucagagaaauacuuuca

SEQ ID NO: 1462054 - RNA, 21 nt, Homo sapiens
aguuucauguacaagaugaag

SEQ ID NO: 1462055 - RNA, 15 nt, Homo sapiens
aguuuccauauguua

SEQ ID NO: 1462056 - RNA, 21 nt, Homo sapiens
aguuuccuaugggaacaauug

SEQ ID NO: 1462057 - RNA, 18 nt, Homo sapiens
aguuugaagccugugccu

SEQ ID NO: 1462058 - RNA, 13 nt, Homo sapiens
aguuugagaccag

SEQ ID NO: 1462059 - RNA, 16 nt, Homo sapiens
aguuugauaccugcac

SEQ ID NO: 1462060 - RNA, 10 nt, Homo sapiens
aguuugauau

SEQ ID NO: 1462061 - RNA, 19 nt, Homo sapiens
aguuugcaaauaggcagaa

SEQ ID NO: 1462062 - RNA, 17 nt, Homo sapiens
aguuugcaaugucacaa

SEQ ID NO: 1462063 - RNA, 11 nt, Homo sapiens
aguuugcaguu

SEQ ID NO: 1462064 - RNA, 18 nt, Homo sapiens
aguuuguuuuuaaacuaa

SEQ ID NO: 1462065 - RNA, 19 nt, Homo sapiens
aguuuuaguuuucucuuag

SEQ ID NO: 1462066 - RNA, 23 nt, Homo sapiens
aguuuuauuuuuucgugcacucu

SEQ ID NO: 1462067 - RNA, 19 nt, Homo sapiens
aguuuuccuacacuugaga

SEQ ID NO: 1462068 - RNA, 13 nt, Homo sapiens
aguuuuguugccc

SEQ ID NO: 1462069 - RNA, 15 nt, Homo sapiens
auaaaaacauuucuu

SEQ ID NO: 1462070 - RNA, 14 nt, Homo sapiens
auaaaaacugcuua

SEQ ID NO: 1462071 - RNA, 14 nt, Homo sapiens
auaaaaagcagaau

SEQ ID NO: 1462072 - RNA, 20 nt, Homo sapiens
auaaaaagugacacagcagc

SEQ ID NO: 1462073 - RNA, 18 nt, Homo sapiens
auaaaaaguucagaguuc

SEQ ID NO: 1462074 - RNA, 12 nt, Homo sapiens
auaaaacuauua

SEQ ID NO: 1462075 - RNA, 19 nt, Homo sapiens
auaaaacuucacauuuaug

SEQ ID NO: 1462076 - RNA, 13 nt, Homo sapiens
auaaaacuuuccu

SEQ ID NO: 1462077 - RNA, 13 nt, Homo sapiens
auaaaagguagua

SEQ ID NO: 1462078 - RNA, 22 nt, Homo sapiens
auaaaauaauuauaaauaucau

SEQ ID NO: 1462079 - RNA, 15 nt, Homo sapiens
auaaaaucagaguug

SEQ ID NO: 1462080 - RNA, 13 nt, Homo sapiens
auaaaaugugauu

SEQ ID NO: 1462081 - RNA, 18 nt, Homo sapiens
auaaaauugaaaguaaua

SEQ ID NO: 1462082 - RNA, 21 nt, Homo sapiens
auaaacacuuguagagcagau

SEQ ID NO: 1462083 - RNA, 22 nt, Homo sapiens
auaaacauccuucaagaacucu

SEQ ID NO: 1462084 - RNA, 16 nt, Homo sapiens
auaaacauuucauuuc

SEQ ID NO: 1462085 - RNA, 15 nt, Homo sapiens
auaaaccacugugcg

SEQ ID NO: 1462086 - RNA, 14 nt, Homo sapiens
auaaacccaguugc

SEQ ID NO: 1462087 - RNA, 17 nt, Homo sapiens
auaaacccaguugccau

SEQ ID NO: 1462088 - RNA, 12 nt, Homo sapiens
auaaagaacaau

SEQ ID NO: 1462089 - RNA, 14 nt, Homo sapiens
auaaagaauacuau

SEQ ID NO: 1462090 - RNA, 17 nt, Homo sapiens
auaaagagacagugaua

SEQ ID NO: 1462091 - RNA, 16 nt, Homo sapiens
auaaagauaauacugu

SEQ ID NO: 1462092 - RNA, 22 nt, Homo sapiens
auaaagaucaaacaugcaugga

SEQ ID NO: 1462093 - RNA, 15 nt, Homo sapiens
auaaagcacgugcaa

SEQ ID NO: 1462094 - RNA, 13 nt, Homo sapiens
auaaagcugugcu

SEQ ID NO: 1462095 - RNA, 14 nt, Homo sapiens
auaaaguccugaca

SEQ ID NO: 1462096 - RNA, 14 nt, Homo sapiens
auaaagucucucug

SEQ ID NO: 1462097 - RNA, 13 nt, Homo sapiens
auaaagugcaguu

SEQ ID NO: 1462098 - RNA, 16 nt, Homo sapiens
auaaaguuacuugaau

SEQ ID NO: 1462099 - RNA, 14 nt, Homo sapiens
auaaauauauuuau

SEQ ID NO: 1462100 - RNA, 11 nt, Homo sapiens
auaaauaucaa

SEQ ID NO: 1462101 - RNA, 14 nt, Homo sapiens
auaaauaugcagug

SEQ ID NO: 1462102 - RNA, 13 nt, Homo sapiens
auaaauauuucuc

SEQ ID NO: 1462103 - RNA, 21 nt, Homo sapiens
auaaauauuucucaacugagg

SEQ ID NO: 1462104 - RNA, 19 nt, Homo sapiens
auaaaucaaugucacuuaa

SEQ ID NO: 1462105 - RNA, 23 nt, Homo sapiens
auaaaucagagagcaaggcaucg

SEQ ID NO: 1462106 - RNA, 13 nt, Homo sapiens
auaaaucauaaaa

SEQ ID NO: 1462107 - RNA, 23 nt, Homo sapiens
auaaaucguccucccaggccagg

SEQ ID NO: 1462108 - RNA, 16 nt, Homo sapiens
auaaaugacacaauga

SEQ ID NO: 1462109 - RNA, 14 nt, Homo sapiens
auaaauguauucaa

SEQ ID NO: 1462110 - RNA, 12 nt, Homo sapiens
auaaauucccaa

SEQ ID NO: 1462111 - RNA, 22 nt, Homo sapiens
auaaauuuaaacuuacaaacuu

SEQ ID NO: 1462112 - RNA, 14 nt, Homo sapiens
auaaauuugguucu

SEQ ID NO: 1462113 - RNA, 20 nt, Homo sapiens
auaacagaaagccuggguga

SEQ ID NO: 1462114 - RNA, 13 nt, Homo sapiens
auaacagcauucu

SEQ ID NO: 1462115 - RNA, 20 nt, Homo sapiens
auaaccccagcucccuagga

SEQ ID NO: 1462116 - RNA, 11 nt, Homo sapiens
auagucuuuca

SEQ ID NO: 1462117 - RNA, 19 nt, Homo sapiens
auagugaaaccccaucucu

SEQ ID NO: 1462118 - RNA, 23 nt, Homo sapiens
auagugauugauagaguguuauc

SEQ ID NO: 1462119 - RNA, 18 nt, Homo sapiens
aggcugccccucucacca

SEQ ID NO: 1462120 - RNA, 17 nt, Homo sapiens
aggcugcgacugaugaa

SEQ ID NO: 1462121 - RNA, 18 nt, Homo sapiens
aggcugcgacugaugaag

SEQ ID NO: 1462122 - RNA, 15 nt, Homo sapiens
aggcuggacugcaau

SEQ ID NO: 1462123 - RNA, 17 nt, Homo sapiens
aggcuggcacaggacau

SEQ ID NO: 1462124 - RNA, 22 nt, Homo sapiens
aggcugggcacagaggucagga

SEQ ID NO: 1462125 - RNA, 12 nt, Homo sapiens
aggcugggccau

SEQ ID NO: 1462126 - RNA, 21 nt, Homo sapiens
aggcugggccauguccaaaga

SEQ ID NO: 1462127 - RNA, 23 nt, Homo sapiens
aggcugggccauguccaaagagg

SEQ ID NO: 1462128 - RNA, 23 nt, Homo sapiens
aggcugucaggauucuucaagga

SEQ ID NO: 1462129 - RNA, 11 nt, Homo sapiens
aggcuguucuc

SEQ ID NO: 1462130 - RNA, 12 nt, Homo sapiens
aggcuuacuuca

SEQ ID NO: 1462131 - RNA, 15 nt, Homo sapiens
aggcuucacccugaa

SEQ ID NO: 1462132 - RNA, 22 nt, Homo sapiens
aggcuucccugacuugcuuuag

SEQ ID NO: 1462133 - RNA, 14 nt, Homo sapiens
aggcuucuuccuac

SEQ ID NO: 1462134 - RNA, 15 nt, Homo sapiens
aggcuugggauuugc

SEQ ID NO: 1462135 - RNA, 14 nt, Homo sapiens
aggcuuuacagugu

SEQ ID NO: 1462136 - RNA, 16 nt, Homo sapiens
aggcuuuaucucaggg

SEQ ID NO: 1462137 - RNA, 12 nt, Homo sapiens
agggaaaacugc

SEQ ID NO: 1462138 - RNA, 13 nt, Homo sapiens
agggaaaacugca

SEQ ID NO: 1462139 - RNA, 22 nt, Homo sapiens
agggaaggaacucuggcuucca

SEQ ID NO: 1462140 - RNA, 22 nt, Homo sapiens
agggaagguucuucaugaucca

SEQ ID NO: 1462141 - RNA, 16 nt, Homo sapiens
agggaauacugugcau

SEQ ID NO: 1462142 - RNA, 15 nt, Homo sapiens
agggacagagcauug

SEQ ID NO: 1462143 - RNA, 16 nt, Homo sapiens
agggacagaugaaugc

SEQ ID NO: 1462144 - RNA, 16 nt, Homo sapiens
agggaccaugugucac

SEQ ID NO: 1462145 - RNA, 21 nt, Homo sapiens
agggacucagggccaugccug

SEQ ID NO: 1462146 - RNA, 20 nt, Homo sapiens
agggacugacaaaagacuug

SEQ ID NO: 1462147 - RNA, 17 nt, Homo sapiens
agggagaaaaagaaaca

SEQ ID NO: 1462148 - RNA, 14 nt, Homo sapiens
agggagcucugggg

SEQ ID NO: 1462149 - RNA, 20 nt, Homo sapiens
agggagcucuggggacagcu

SEQ ID NO: 1462150 - RNA, 16 nt, Homo sapiens
agggagguuugugaga

SEQ ID NO: 1462151 - RNA, 23 nt, Homo sapiens
agggaugaagaaagacucugaga

SEQ ID NO: 1462152 - RNA, 16 nt, Homo sapiens
agggauuccccuaacc

SEQ ID NO: 1462153 - RNA, 20 nt, Homo sapiens
agggauuuaaagggacaccc

SEQ ID NO: 1462154 - RNA, 13 nt, Homo sapiens
agggcaccuggag

SEQ ID NO: 1462155 - RNA, 15 nt, Homo sapiens
agggcagaaagguuc

SEQ ID NO: 1462156 - RNA, 14 nt, Homo sapiens
agggcaucaucuau

SEQ ID NO: 1462157 - RNA, 20 nt, Homo sapiens
agggccguugcccccagacu

SEQ ID NO: 1462158 - RNA, 20 nt, Homo sapiens
agggccuggcaggccagugu

SEQ ID NO: 1462159 - RNA, 17 nt, Homo sapiens
agggcgagacuccgucu

SEQ ID NO: 1462160 - RNA, 20 nt, Homo sapiens
agggcgagacuccgucucaa

SEQ ID NO: 1462161 - RNA, 18 nt, Homo sapiens
agggcuagcaucccugag

SEQ ID NO: 1462162 - RNA, 15 nt, Homo sapiens
agggcuggucagggu

SEQ ID NO: 1462163 - RNA, 22 nt, Homo sapiens
aggggaaaagaaaaucuuuuaa

SEQ ID NO: 1462164 - RNA, 16 nt, Homo sapiens
aggggcagccaggaca

SEQ ID NO: 1462165 - RNA, 14 nt, Homo sapiens
aggggcccacaggg

SEQ ID NO: 1462166 - RNA, 14 nt, Homo sapiens
aggggcccuuggga

SEQ ID NO: 1462167 - RNA, 22 nt, Homo sapiens
aggggccuugcugaguggcgca

SEQ ID NO: 1462168 - RNA, 14 nt, Homo sapiens
aggggcuacuguga

SEQ ID NO: 1462169 - RNA, 12 nt, Homo sapiens
aggggcucucag

SEQ ID NO: 1462170 - RNA, 22 nt, Homo sapiens
aggggcugcagggccacuggaa

SEQ ID NO: 1462171 - RNA, 23 nt, Homo sapiens
aggggcuguugaauuucccacau

SEQ ID NO: 1462172 - RNA, 15 nt, Homo sapiens
agggggacacuccau

SEQ ID NO: 1462173 - RNA, 22 nt, Homo sapiens
agggggagccccuucugcucag

SEQ ID NO: 1462174 - RNA, 17 nt, Homo sapiens
aggggugauuucagaga

SEQ ID NO: 1462175 - RNA, 13 nt, Homo sapiens
aggggugcauucu

SEQ ID NO: 1462176 - RNA, 19 nt, Homo sapiens
aggggugguccugacucaa

SEQ ID NO: 1462177 - RNA, 13 nt, Homo sapiens
agggguuccucaa

SEQ ID NO: 1462178 - RNA, 19 nt, Homo sapiens
agggguugagggaagguuc

SEQ ID NO: 1462179 - RNA, 20 nt, Homo sapiens
agggucaaggaguacuccaa

SEQ ID NO: 1462180 - RNA, 21 nt, Homo sapiens
agggucccauuucucacugag

SEQ ID NO: 1462181 - RNA, 14 nt, Homo sapiens
agggucucuucagg

SEQ ID NO: 1462182 - RNA, 17 nt, Homo sapiens
agggucugugugaaugu

SEQ ID NO: 1462183 - RNA, 18 nt, Homo sapiens
agggucuucccuaccuca

SEQ ID NO: 1462184 - RNA, 17 nt, Homo sapiens
agggucuuugcaagaau

SEQ ID NO: 1462185 - RNA, 22 nt, Homo sapiens
agggugaagcuauuuaucugua

SEQ ID NO: 1462186 - RNA, 16 nt, Homo sapiens
aggguggcccuugcag

SEQ ID NO: 1462187 - RNA, 16 nt, Homo sapiens
aggguuaaggccugaa

SEQ ID NO: 1462188 - RNA, 13 nt, Homo sapiens
aggguuacuaugc

SEQ ID NO: 1462189 - RNA, 16 nt, Homo sapiens
aggguucuaaguggga

SEQ ID NO: 1462190 - RNA, 16 nt, Homo sapiens
aggguuggcaccugca

SEQ ID NO: 1462191 - RNA, 20 nt, Homo sapiens
aggguugggcccagaucugg

SEQ ID NO: 1462192 - RNA, 23 nt, Homo sapiens
aggguuggguucaucugagcaag

SEQ ID NO: 1462193 - RNA, 20 nt, Homo sapiens
aggguuucaccauguugccc

SEQ ID NO: 1462194 - RNA, 19 nt, Homo sapiens
agguaauuuuuacccuaau

SEQ ID NO: 1462195 - RNA, 14 nt, Homo sapiens
agguagacuuugcu

SEQ ID NO: 1462196 - RNA, 17 nt, Homo sapiens
agguaggaucaucccac

SEQ ID NO: 1462197 - RNA, 17 nt, Homo sapiens
agguaugaucucuucug

SEQ ID NO: 1462198 - RNA, 18 nt, Homo sapiens
agguauuucgaaacugcc

SEQ ID NO: 1462199 - RNA, 21 nt, Homo sapiens
agguauuuuguagaugugauu

SEQ ID NO: 1462200 - RNA, 15 nt, Homo sapiens
aggucccaggaagug

SEQ ID NO: 1462201 - RNA, 18 nt, Homo sapiens
agguccuaaagaugcuga

SEQ ID NO: 1462202 - RNA, 20 nt, Homo sapiens
agguccuccaucccaacagc

SEQ ID NO: 1462203 - RNA, 11 nt, Homo sapiens
aggucuaucaa

SEQ ID NO: 1462204 - RNA, 13 nt, Homo sapiens
aggucuccaaaau

SEQ ID NO: 1462205 - RNA, 16 nt, Homo sapiens
aggucugacacgucug

SEQ ID NO: 1462206 - RNA, 20 nt, Homo sapiens
aggucugcucugcuccugaa

SEQ ID NO: 1462207 - RNA, 20 nt, Homo sapiens
aggucuguuuaaaguggcaa

SEQ ID NO: 1462208 - RNA, 18 nt, Homo sapiens
aggugaaaauccaucuca

SEQ ID NO: 1462209 - RNA, 22 nt, Homo sapiens
aggugacagaggcgaaggcaga

SEQ ID NO: 1462210 - RNA, 21 nt, Homo sapiens
aggugacaugugaaaccuuuu

SEQ ID NO: 1462211 - RNA, 15 nt, Homo sapiens
aggugacugaaggcu

SEQ ID NO: 1462212 - RNA, 23 nt, Homo sapiens
aggugauccacccaccuuggccu

SEQ ID NO: 1462213 - RNA, 23 nt, Homo sapiens
aggugauuuguaugcucauugaa

SEQ ID NO: 1462214 - RNA, 14 nt, Homo sapiens
aggugccucagacu

SEQ ID NO: 1462215 - RNA, 13 nt, Homo sapiens
aggugcucugugg

SEQ ID NO: 1462216 - RNA, 19 nt, Homo sapiens
aggugcugacuucaucucc

SEQ ID NO: 1462217 - RNA, 24 nt, Homo sapiens
agguggcaagcugugacuucucca

SEQ ID NO: 1462218 - RNA, 22 nt, Homo sapiens
agguggccccaguucaaucucc

SEQ ID NO: 1462219 - RNA, 16 nt, Homo sapiens
agguggcccuaaagga

SEQ ID NO: 1462220 - RNA, 14 nt, Homo sapiens
aggagacauuggua

SEQ ID NO: 1462221 - RNA, 12 nt, Homo sapiens
aggagaccaagg

SEQ ID NO: 1462222 - RNA, 14 nt, Homo sapiens
aggagaccagcuca

SEQ ID NO: 1462223 - RNA, 15 nt, Homo sapiens
aggagacuagauugc

SEQ ID NO: 1462224 - RNA, 21 nt, Homo sapiens
aggagacuuuacauggaugcc

SEQ ID NO: 1462225 - RNA, 13 nt, Homo sapiens
aggagagagcagc

SEQ ID NO: 1462226 - RNA, 19 nt, Homo sapiens
aggagagaggcucuggggc

SEQ ID NO: 1462227 - RNA, 20 nt, Homo sapiens
aggagauggaaguugcagug

SEQ ID NO: 1462228 - RNA, 16 nt, Homo sapiens
aggagauuucaugccu

SEQ ID NO: 1462229 - RNA, 19 nt, Homo sapiens
aggagccuuuugcucucug

SEQ ID NO: 1462230 - RNA, 20 nt, Homo sapiens
aggaggacauuuggugggcu

SEQ ID NO: 1462231 - RNA, 13 nt, Homo sapiens
aggaggccaauaa

SEQ ID NO: 1462232 - RNA, 21 nt, Homo sapiens
aggaggccuccaucucaugua

SEQ ID NO: 1462233 - RNA, 19 nt, Homo sapiens
aggagggguuaaagcugcc

SEQ ID NO: 1462234 - RNA, 22 nt, Homo sapiens
aggagguuauaccaggauuuau

SEQ ID NO: 1462235 - RNA, 19 nt, Homo sapiens
aggagguuuggggucugcc

SEQ ID NO: 1462236 - RNA, 14 nt, Homo sapiens
aggaguaccuggac

SEQ ID NO: 1462237 - RNA, 14 nt, Homo sapiens
aggagucgggagca

SEQ ID NO: 1462238 - RNA, 19 nt, Homo sapiens
aggagucgggagcacagcu

SEQ ID NO: 1462239 - RNA, 15 nt, Homo sapiens
aggagugguucucau

SEQ ID NO: 1462240 - RNA, 19 nt, Homo sapiens
aggagugugugacauucca

SEQ ID NO: 1462241 - RNA, 21 nt, Homo sapiens
aggaguuggaauguuguaguu

SEQ ID NO: 1462242 - RNA, 13 nt, Homo sapiens
aggauaagccacu

SEQ ID NO: 1462243 - RNA, 17 nt, Homo sapiens
aggauagaauacaugga

SEQ ID NO: 1462244 - RNA, 15 nt, Homo sapiens
aggauauuaacaaca

SEQ ID NO: 1462245 - RNA, 19 nt, Homo sapiens
aggauauuaacaacaauaa

SEQ ID NO: 1462246 - RNA, 16 nt, Homo sapiens
aggauauuuucuucca

SEQ ID NO: 1462247 - RNA, 17 nt, Homo sapiens
aggaucaguuaacuauu

SEQ ID NO: 1462248 - RNA, 14 nt, Homo sapiens
aggaugaauguaug

SEQ ID NO: 1462249 - RNA, 17 nt, Homo sapiens
aggaugaguuacuugaa

SEQ ID NO: 1462250 - RNA, 14 nt, Homo sapiens
aggauggcaaagag

SEQ ID NO: 1462251 - RNA, 18 nt, Homo sapiens
aggauggcaaagagaguc

SEQ ID NO: 1462252 - RNA, 19 nt, Homo sapiens
aggaugguccagaauucac

SEQ ID NO: 1462253 - RNA, 23 nt, Homo sapiens
aggaugguggacuacaaaauaca

SEQ ID NO: 1462254 - RNA, 14 nt, Homo sapiens
aggauguaguucug

SEQ ID NO: 1462255 - RNA, 21 nt, Homo sapiens
aggaugucccugggccagggu

SEQ ID NO: 1462256 - RNA, 13 nt, Homo sapiens
aggaugugauaua

SEQ ID NO: 1462257 - RNA, 21 nt, Homo sapiens
aggauguggaagagcauuagc

SEQ ID NO: 1462258 - RNA, 11 nt, Homo sapiens
aggauguugcc

SEQ ID NO: 1462259 - RNA, 14 nt, Homo sapiens
aggauucagcuauu

SEQ ID NO: 1462260 - RNA, 22 nt, Homo sapiens
aggauucucaccagcugugucc

SEQ ID NO: 1462261 - RNA, 15 nt, Homo sapiens
aggauuucaugauuu

SEQ ID NO: 1462262 - RNA, 21 nt, Homo sapiens
aggauuugaaccaugaaguca

SEQ ID NO: 1462263 - RNA, 19 nt, Homo sapiens
aggcaaacugcaaaccaug

SEQ ID NO: 1462264 - RNA, 12 nt, Homo sapiens
aggcaacacugg

SEQ ID NO: 1462265 - RNA, 14 nt, Homo sapiens
aggcaacauccaaa

SEQ ID NO: 1462266 - RNA, 19 nt, Homo sapiens
aggcaagcaggaccuggca

SEQ ID NO: 1462267 - RNA, 13 nt, Homo sapiens
aggcaauuucacc

SEQ ID NO: 1462268 - RNA, 18 nt, Homo sapiens
aggcacacagcuacucuc

SEQ ID NO: 1462269 - RNA, 15 nt, Homo sapiens
aggcacacuuugcac

SEQ ID NO: 1462270 - RNA, 21 nt, Homo sapiens
aggcacccucagggagccucc

SEQ ID NO: 1462271 - RNA, 19 nt, Homo sapiens
aggcaccugccaccaugcc

SEQ ID NO: 1462272 - RNA, 16 nt, Homo sapiens
aggcagagaaucauac

SEQ ID NO: 1462273 - RNA, 20 nt, Homo sapiens
aggcagagaaucauacuuag

SEQ ID NO: 1462274 - RNA, 16 nt, Homo sapiens
aggcagcacagugugu

SEQ ID NO: 1462275 - RNA, 13 nt, Homo sapiens
aggcagccacuuc

SEQ ID NO: 1462276 - RNA, 21 nt, Homo sapiens
aggcagcuaucugcacucuaa

SEQ ID NO: 1462277 - RNA, 17 nt, Homo sapiens
aggcaggagaauggugu

SEQ ID NO: 1462278 - RNA, 23 nt, Homo sapiens
aggcagggugcaguaucaugccc

SEQ ID NO: 1462279 - RNA, 18 nt, Homo sapiens
aggcaggguuaaacugca

SEQ ID NO: 1462280 - RNA, 17 nt, Homo sapiens
aggcagguugagacuac

SEQ ID NO: 1462281 - RNA, 18 nt, Homo sapiens
aggcaguauuuugugucc

SEQ ID NO: 1462282 - RNA, 23 nt, Homo sapiens
aggcaguauuuuguguccuccag

SEQ ID NO: 1462283 - RNA, 17 nt, Homo sapiens
aggcagucugggcacuu

SEQ ID NO: 1462284 - RNA, 16 nt, Homo sapiens
aggcauagaggcuucu

SEQ ID NO: 1462285 - RNA, 21 nt, Homo sapiens
aggcaucauacuaaacuucac

SEQ ID NO: 1462286 - RNA, 17 nt, Homo sapiens
aggcaucucuguacuuu

SEQ ID NO: 1462287 - RNA, 16 nt, Homo sapiens
aggcaugauguuaacc

SEQ ID NO: 1462288 - RNA, 13 nt, Homo sapiens
aggcauggcagaa

SEQ ID NO: 1462289 - RNA, 15 nt, Homo sapiens
aggcaugggugcaag

SEQ ID NO: 1462290 - RNA, 13 nt, Homo sapiens
aggccaagcauuu

SEQ ID NO: 1462291 - RNA, 16 nt, Homo sapiens
aggccacacgcacugg

SEQ ID NO: 1462292 - RNA, 18 nt, Homo sapiens
aggccacagcugccaucg

SEQ ID NO: 1462293 - RNA, 22 nt, Homo sapiens
aggccaccccuaggaacucagu

SEQ ID NO: 1462294 - RNA, 18 nt, Homo sapiens
aggccagcaacucccagc

SEQ ID NO: 1462295 - RNA, 12 nt, Homo sapiens
aggccagugcua

SEQ ID NO: 1462296 - RNA, 14 nt, Homo sapiens
aggccagugucugg

SEQ ID NO: 1462297 - RNA, 21 nt, Homo sapiens
aggcccaacugugagcaagga

SEQ ID NO: 1462298 - RNA, 20 nt, Homo sapiens
aggcccaguucacccugauu

SEQ ID NO: 1462299 - RNA, 20 nt, Homo sapiens
aggcccuagcggcagaaagg

SEQ ID NO: 1462300 - RNA, 14 nt, Homo sapiens
aggcccuggcugag

SEQ ID NO: 1462301 - RNA, 19 nt, Homo sapiens
aggccgggcgcaguggcuc

SEQ ID NO: 1462302 - RNA, 23 nt, Homo sapiens
aggccgugcaguggcugugccac

SEQ ID NO: 1462303 - RNA, 17 nt, Homo sapiens
aggccuauuuauuaaua

SEQ ID NO: 1462304 - RNA, 12 nt, Homo sapiens
aggccucaagaa

SEQ ID NO: 1462305 - RNA, 12 nt, Homo sapiens
aggccugaauca

SEQ ID NO: 1462306 - RNA, 19 nt, Homo sapiens
aggccugagcgagugucca

SEQ ID NO: 1462307 - RNA, 21 nt, Homo sapiens
aggccugccucccacuucacu

SEQ ID NO: 1462308 - RNA, 17 nt, Homo sapiens
aggccugcugccagugc

SEQ ID NO: 1462309 - RNA, 20 nt, Homo sapiens
aggccuggacuuuccugcaa

SEQ ID NO: 1462310 - RNA, 21 nt, Homo sapiens
aggccuuugugucuguguccu

SEQ ID NO: 1462311 - RNA, 18 nt, Homo sapiens
aggcgauggggcaagaca

SEQ ID NO: 1462312 - RNA, 18 nt, Homo sapiens
aggcggagcuugcaguga

SEQ ID NO: 1462313 - RNA, 20 nt, Homo sapiens
aggcgggagcaucucuugag

SEQ ID NO: 1462314 - RNA, 20 nt, Homo sapiens
aggcuacucauucaguccca

SEQ ID NO: 1462315 - RNA, 20 nt, Homo sapiens
aggcuagaacacuacagggg

SEQ ID NO: 1462316 - RNA, 17 nt, Homo sapiens
aggcucaauauuccuga

SEQ ID NO: 1462317 - RNA, 23 nt, Homo sapiens
aggcucuuaagcagcauggaaaa

SEQ ID NO: 1462318 - RNA, 17 nt, Homo sapiens
aggcugaggcaagagaa

SEQ ID NO: 1462319 - RNA, 18 nt, Homo sapiens
aggcugaggcaggaggau

SEQ ID NO: 1462320 - RNA, 11 nt, Homo sapiens
aggcugagggc

SEQ ID NO: 1462321 - RNA, 13 nt, Homo sapiens
aggcugcagugag

SEQ ID NO: 1462322 - RNA, 23 nt, Homo sapiens
cuguagaaaugaugauguggaag

SEQ ID NO: 1462323 - RNA, 18 nt, Homo sapiens
cuguagacuagugccgua

SEQ ID NO: 1462324 - RNA, 15 nt, Homo sapiens
cuguagaguugcuga

SEQ ID NO: 1462325 - RNA, 15 nt, Homo sapiens
cuguagguucuugau

SEQ ID NO: 1462326 - RNA, 21 nt, Homo sapiens
cuguagucccagccacucggg

SEQ ID NO: 1462327 - RNA, 21 nt, Homo sapiens
cuguagucccagcuacucggg

SEQ ID NO: 1462328 - RNA, 18 nt, Homo sapiens
cuguagucccagcuacuu

SEQ ID NO: 1462329 - RNA, 22 nt, Homo sapiens
cuguauaaguuauuuuuguaca

SEQ ID NO: 1462330 - RNA, 19 nt, Homo sapiens
cuguaucacagacuggcaa

SEQ ID NO: 1462331 - RNA, 15 nt, Homo sapiens
cuguauggaaacacu

SEQ ID NO: 1462332 - RNA, 15 nt, Homo sapiens
cuguauuuauuuuag

SEQ ID NO: 1462333 - RNA, 16 nt, Homo sapiens
cugucaacaucaaaga

SEQ ID NO: 1462334 - RNA, 12 nt, Homo sapiens
cugucaagaaga

SEQ ID NO: 1462335 - RNA, 19 nt, Homo sapiens
cugucaaguuaacaaggaa

SEQ ID NO: 1462336 - RNA, 18 nt, Homo sapiens
cugucaauaaacagcuuc

SEQ ID NO: 1462337 - RNA, 21 nt, Homo sapiens
cugucacguucuccacacggg

SEQ ID NO: 1462338 - RNA, 18 nt, Homo sapiens
cugucacuagucucacca

SEQ ID NO: 1462339 - RNA, 21 nt, Homo sapiens
cugucacuagucucaccagcc

SEQ ID NO: 1462340 - RNA, 18 nt, Homo sapiens
cugucaggauucuucaag

SEQ ID NO: 1462341 - RNA, 20 nt, Homo sapiens
cugucauccucaugcugcuc

SEQ ID NO: 1462342 - RNA, 16 nt, Homo sapiens
cugucauuuguuguga

SEQ ID NO: 1462343 - RNA, 23 nt, Homo sapiens
cuguccacugggccauuguggug

SEQ ID NO: 1462344 - RNA, 14 nt, Homo sapiens
cugucccacccaca

SEQ ID NO: 1462345 - RNA, 14 nt, Homo sapiens
cugucccaccugca

SEQ ID NO: 1462346 - RNA, 23 nt, Homo sapiens
cugucccagccccggcaagccac

SEQ ID NO: 1462347 - RNA, 20 nt, Homo sapiens
cugucccccuacccaccgau

SEQ ID NO: 1462348 - RNA, 13 nt, Homo sapiens
cuguccuaccuuu

SEQ ID NO: 1462349 - RNA, 22 nt, Homo sapiens
cuguccucagccuugccagaga

SEQ ID NO: 1462350 - RNA, 18 nt, Homo sapiens
cuguccugaucugugaua

SEQ ID NO: 1462351 - RNA, 22 nt, Homo sapiens
cuguccugcagcaaacacucca

SEQ ID NO: 1462352 - RNA, 14 nt, Homo sapiens
cugucucagagaua

SEQ ID NO: 1462353 - RNA, 14 nt, Homo sapiens
cugucucagccucc

SEQ ID NO: 1462354 - RNA, 14 nt, Homo sapiens
cugucugacaaccu

SEQ ID NO: 1462355 - RNA, 15 nt, Homo sapiens
cugucugggggccag

SEQ ID NO: 1462356 - RNA, 17 nt, Homo sapiens
cugucugucaccagcua

SEQ ID NO: 1462357 - RNA, 20 nt, Homo sapiens
cugucuuccaaggagaccaa

SEQ ID NO: 1462358 - RNA, 14 nt, Homo sapiens
cugucuuuaauucu

SEQ ID NO: 1462359 - RNA, 20 nt, Homo sapiens
cugucuuuauaaucuacucc

SEQ ID NO: 1462360 - RNA, 13 nt, Homo sapiens
cugugaaacuggc

SEQ ID NO: 1462361 - RNA, 22 nt, Homo sapiens
cugugaggccccuggacaagca

SEQ ID NO: 1462362 - RNA, 17 nt, Homo sapiens
cugugauaugccauagg

SEQ ID NO: 1462363 - RNA, 15 nt, Homo sapiens
cugugaugacauucc

SEQ ID NO: 1462364 - RNA, 19 nt, Homo sapiens
cugugcacaaaacccagac

SEQ ID NO: 1462365 - RNA, 22 nt, Homo sapiens
cugugcacgcgcgcgugcacac

SEQ ID NO: 1462366 - RNA, 17 nt, Homo sapiens
cugugcagggcugguuu

SEQ ID NO: 1462367 - RNA, 18 nt, Homo sapiens
cugugcaucuagccucaa

SEQ ID NO: 1462368 - RNA, 20 nt, Homo sapiens
cugugccuucagcuguugca

SEQ ID NO: 1462369 - RNA, 23 nt, Homo sapiens
cugugccuucagcuguugcagau

SEQ ID NO: 1462370 - RNA, 15 nt, Homo sapiens
cugugcuaguuuuac

SEQ ID NO: 1462371 - RNA, 21 nt, Homo sapiens
cuguggaacuacauuacugua

SEQ ID NO: 1462372 - RNA, 13 nt, Homo sapiens
cuguggaugcuuc

SEQ ID NO: 1462373 - RNA, 16 nt, Homo sapiens
cuguggccugccaguc

SEQ ID NO: 1462374 - RNA, 22 nt, Homo sapiens
cugugggcauggucaaaggcuc

SEQ ID NO: 1462375 - RNA, 21 nt, Homo sapiens
cuguggguuugguccuugaac

SEQ ID NO: 1462376 - RNA, 13 nt, Homo sapiens
cugugguccccga

SEQ ID NO: 1462377 - RNA, 13 nt, Homo sapiens
cugugguggagaa

SEQ ID NO: 1462378 - RNA, 17 nt, Homo sapiens
cugugguuaacaucuca

SEQ ID NO: 1462379 - RNA, 20 nt, Homo sapiens
cuguguauauaguuuuuacc

SEQ ID NO: 1462380 - RNA, 21 nt, Homo sapiens
cuguguauuuaacugccuugu

SEQ ID NO: 1462381 - RNA, 13 nt, Homo sapiens
cugugucauuuca

SEQ ID NO: 1462382 - RNA, 20 nt, Homo sapiens
cuguguuuuuccuccauaaa

SEQ ID NO: 1462383 - RNA, 14 nt, Homo sapiens
cuguuaacuaugac

SEQ ID NO: 1462384 - RNA, 14 nt, Homo sapiens
cuguuaauagucau

SEQ ID NO: 1462385 - RNA, 14 nt, Homo sapiens
cuguuacccagaga

SEQ ID NO: 1462386 - RNA, 13 nt, Homo sapiens
cuguuacccaggc

SEQ ID NO: 1462387 - RNA, 14 nt, Homo sapiens
cuguucacuuugua

SEQ ID NO: 1462388 - RNA, 19 nt, Homo sapiens
cuguuccaaagccagugaa

SEQ ID NO: 1462389 - RNA, 15 nt, Homo sapiens
cuguuccccagagaa

SEQ ID NO: 1462390 - RNA, 21 nt, Homo sapiens
cuguucccccacccuccaugc

SEQ ID NO: 1462391 - RNA, 18 nt, Homo sapiens
cuguucccuugcaggggu

SEQ ID NO: 1462392 - RNA, 12 nt, Homo sapiens
cuguucuuccuc

SEQ ID NO: 1462393 - RNA, 18 nt, Homo sapiens
cuguugaaucugagcugc

SEQ ID NO: 1462394 - RNA, 13 nt, Homo sapiens
gaagcucacccaa

SEQ ID NO: 1462395 - RNA, 17 nt, Homo sapiens
gaagcucacccaauaaa

SEQ ID NO: 1462396 - RNA, 13 nt, Homo sapiens
gaagcuccacugu

SEQ ID NO: 1462397 - RNA, 21 nt, Homo sapiens
gaagcuccugggggaugcucu

SEQ ID NO: 1462398 - RNA, 22 nt, Homo sapiens
gaagcugcugaccaauugugcu

SEQ ID NO: 1462399 - RNA, 16 nt, Homo sapiens
gaagcuggccugagag

SEQ ID NO: 1462400 - RNA, 19 nt, Homo sapiens
gaagcuuaaaaucugugaa

SEQ ID NO: 1462401 - RNA, 15 nt, Homo sapiens
gaagcuuccauucca

SEQ ID NO: 1462402 - RNA, 21 nt, Homo sapiens
gaaggaagucagcaugccucu

SEQ ID NO: 1462403 - RNA, 13 nt, Homo sapiens
gaaggaagugaag

SEQ ID NO: 1462404 - RNA, 13 nt, Homo sapiens
gaaggacauuuua

SEQ ID NO: 1462405 - RNA, 14 nt, Homo sapiens
gaaggcagagccau

SEQ ID NO: 1462406 - RNA, 19 nt, Homo sapiens
gaaggcagagguugcagug

SEQ ID NO: 1462407 - RNA, 16 nt, Homo sapiens
gaaggcagccaccagc

SEQ ID NO: 1462408 - RNA, 13 nt, Homo sapiens
gaaggcaugccua

SEQ ID NO: 1462409 - RNA, 15 nt, Homo sapiens
gaaggcugagugucc

SEQ ID NO: 1462410 - RNA, 15 nt, Homo sapiens
gaagggaauccuccu

SEQ ID NO: 1462411 - RNA, 15 nt, Homo sapiens
gaagggaauugcuca

SEQ ID NO: 1462412 - RNA, 17 nt, Homo sapiens
gaagggaauugcucaga

SEQ ID NO: 1462413 - RNA, 21 nt, Homo sapiens
gaagggcuuggccagcgcugu

SEQ ID NO: 1462414 - RNA, 17 nt, Homo sapiens
gaaggucuauuggccaa

SEQ ID NO: 1462415 - RNA, 19 nt, Homo sapiens
gaagguuggugaauuucac

SEQ ID NO: 1462416 - RNA, 23 nt, Homo sapiens
gaaguaacaaaagaagugacauc

SEQ ID NO: 1462417 - RNA, 12 nt, Homo sapiens
gaaguacaugaa

SEQ ID NO: 1462418 - RNA, 14 nt, Homo sapiens
gaaguagcucuuuu

SEQ ID NO: 1462419 - RNA, 16 nt, Homo sapiens
gaaguagcuucagagg

SEQ ID NO: 1462420 - RNA, 14 nt, Homo sapiens
gaaguaugagggaa

SEQ ID NO: 1462421 - RNA, 22 nt, Homo sapiens
gaaguaugagggaaaaugagua

SEQ ID NO: 1462422 - RNA, 20 nt, Homo sapiens
gaagucaccccuuucugucc

SEQ ID NO: 1462423 - RNA, 21 nt, Homo sapiens
gaagucauccagucuauucac

SEQ ID NO: 1462424 - RNA, 21 nt, Homo sapiens
gaagucaucucauuccacugu

SEQ ID NO: 1462425 - RNA, 12 nt, Homo sapiens
gaagucauucuu

SEQ ID NO: 1462426 - RNA, 19 nt, Homo sapiens
gaaguccccucuacuuuaa

SEQ ID NO: 1462427 - RNA, 18 nt, Homo sapiens
gaagucuaaaagcagaaa

SEQ ID NO: 1462428 - RNA, 17 nt, Homo sapiens
cuggaagcuaauuugca

SEQ ID NO: 1462429 - RNA, 14 nt, Homo sapiens
cuggaaggacaucu

SEQ ID NO: 1462430 - RNA, 18 nt, Homo sapiens
cuggaagggguccagccu

SEQ ID NO: 1462431 - RNA, 18 nt, Homo sapiens
cuggaagucaucucauuc

SEQ ID NO: 1462432 - RNA, 20 nt, Homo sapiens
cuggaauguaaucaauguuu

SEQ ID NO: 1462433 - RNA, 23 nt, Homo sapiens
cuggaauuaaaaggaaagucaag

SEQ ID NO: 1462434 - RNA, 18 nt, Homo sapiens
cuggaauucuucugcaac

SEQ ID NO: 1462435 - RNA, 21 nt, Homo sapiens
cuggacaaagaaauuccccaa

SEQ ID NO: 1462436 - RNA, 12 nt, Homo sapiens
cuggacugcaau

SEQ ID NO: 1462437 - RNA, 20 nt, Homo sapiens
cuggagauaugaaggauuac

SEQ ID NO: 1462438 - RNA, 17 nt, Homo sapiens
cuggagcucaucugcaa

SEQ ID NO: 1462439 - RNA, 20 nt, Homo sapiens
cuggaggaaauccuaccuuu

SEQ ID NO: 1462440 - RNA, 21 nt, Homo sapiens
cuggagggacuuuuaaucagu

SEQ ID NO: 1462441 - RNA, 16 nt, Homo sapiens
cuggaggucacauuca

SEQ ID NO: 1462442 - RNA, 12 nt, Homo sapiens
cuggagugcagu

SEQ ID NO: 1462443 - RNA, 17 nt, Homo sapiens
cuggagugcaguggcau

SEQ ID NO: 1462444 - RNA, 20 nt, Homo sapiens
cuggagugcaguggcgugau

SEQ ID NO: 1462445 - RNA, 20 nt, Homo sapiens
cuggagugcaguggugugau

SEQ ID NO: 1462446 - RNA, 16 nt, Homo sapiens
cuggaguguggcugag

SEQ ID NO: 1462447 - RNA, 21 nt, Homo sapiens
cuggauaacuuagguggcaag

SEQ ID NO: 1462448 - RNA, 18 nt, Homo sapiens
cuggaucacgacgcugca

SEQ ID NO: 1462449 - RNA, 15 nt, Homo sapiens
cuggaucuaccagca

SEQ ID NO: 1462450 - RNA, 19 nt, Homo sapiens
cuggaugagacuuccaaac

SEQ ID NO: 1462451 - RNA, 18 nt, Homo sapiens
cuggaugcacuuucauua

SEQ ID NO: 1462452 - RNA, 21 nt, Homo sapiens
cuggaugccagcuguguccuu

SEQ ID NO: 1462453 - RNA, 21 nt, Homo sapiens
cuggauggggcuuccagcuca

SEQ ID NO: 1462454 - RNA, 21 nt, Homo sapiens
cuggaugucugggugaccuca

SEQ ID NO: 1462455 - RNA, 15 nt, Homo sapiens
cuggauucgugacaa

SEQ ID NO: 1462456 - RNA, 14 nt, Homo sapiens
cuggcaacacagag

SEQ ID NO: 1462457 - RNA, 19 nt, Homo sapiens
cuggcaagucuuccaugac

SEQ ID NO: 1462458 - RNA, 20 nt, Homo sapiens
cuggcaagucuuccaugacc

SEQ ID NO: 1462459 - RNA, 12 nt, Homo sapiens
cuggcacccauc

SEQ ID NO: 1462460 - RNA, 12 nt, Homo sapiens
cuggcacugacu

SEQ ID NO: 1462461 - RNA, 20 nt, Homo sapiens
cuggcagcaucuucacuucu

SEQ ID NO: 1462462 - RNA, 23 nt, Homo sapiens
cuggcaggagccggcugccuacc

SEQ ID NO: 1462463 - RNA, 13 nt, Homo sapiens
cuggcaggcaaga

SEQ ID NO: 1462464 - RNA, 14 nt, Homo sapiens
cuggcauuaagggc

SEQ ID NO: 1462465 - RNA, 22 nt, Homo sapiens
cuggcauuccuucugaccacag

SEQ ID NO: 1462466 - RNA, 21 nt, Homo sapiens
cuggccacaguaauuggucau

SEQ ID NO: 1462467 - RNA, 20 nt, Homo sapiens
cuggccagcaaggcagguug

SEQ ID NO: 1462468 - RNA, 18 nt, Homo sapiens
cuggcccagaugauauaa

SEQ ID NO: 1462469 - RNA, 18 nt, Homo sapiens
cuggcccagggaauccag

SEQ ID NO: 1462470 - RNA, 23 nt, Homo sapiens
cuggcccucgacacucaccauga

SEQ ID NO: 1462471 - RNA, 20 nt, Homo sapiens
cuggccuaaaaucuuggaag

SEQ ID NO: 1462472 - RNA, 22 nt, Homo sapiens
cuggccucagccgacugcacag

SEQ ID NO: 1462473 - RNA, 21 nt, Homo sapiens
cuggccuuuccugguuuucau

SEQ ID NO: 1462474 - RNA, 14 nt, Homo sapiens
cuggcucucagaag

SEQ ID NO: 1462475 - RNA, 15 nt, Homo sapiens
cuggcucuguuugau

SEQ ID NO: 1462476 - RNA, 18 nt, Homo sapiens
cuggcugagcugaaccca

SEQ ID NO: 1462477 - RNA, 15 nt, Homo sapiens
cuggcugccccucac

SEQ ID NO: 1462478 - RNA, 22 nt, Homo sapiens
cugggaagacgccugagcucac

SEQ ID NO: 1462479 - RNA, 16 nt, Homo sapiens
cugggagacugaagac

SEQ ID NO: 1462480 - RNA, 16 nt, Homo sapiens
cugggagcacuggugu

SEQ ID NO: 1462481 - RNA, 20 nt, Homo sapiens
cugggaggcaucaguugcua

SEQ ID NO: 1462482 - RNA, 15 nt, Homo sapiens
cugggaguguccuua

SEQ ID NO: 1462483 - RNA, 15 nt, Homo sapiens
cugggauguuuugag

SEQ ID NO: 1462484 - RNA, 14 nt, Homo sapiens
cugggccauugugg

SEQ ID NO: 1462485 - RNA, 15 nt, Homo sapiens
cugggccugaccaaa

SEQ ID NO: 1462486 - RNA, 14 nt, Homo sapiens
cugggcucaagcaa

SEQ ID NO: 1462487 - RNA, 20 nt, Homo sapiens
cugggcuccguuguaccaag

SEQ ID NO: 1462488 - RNA, 17 nt, Homo sapiens
cugggcuccuccagggu

SEQ ID NO: 1462489 - RNA, 22 nt, Homo sapiens
cugggcugcuacccagaaauca

SEQ ID NO: 1462490 - RNA, 13 nt, Homo sapiens
cugggcuguaacg

SEQ ID NO: 1462491 - RNA, 17 nt, Homo sapiens
cuggggaacuagaggga

SEQ ID NO: 1462492 - RNA, 17 nt, Homo sapiens
cuggggaccuggcacug

SEQ ID NO: 1462493 - RNA, 15 nt, Homo sapiens
cuggggagcucagga

SEQ ID NO: 1462494 - RNA, 13 nt, Homo sapiens
cuggggccaccau

SEQ ID NO: 1462495 - RNA, 16 nt, Homo sapiens
cuggggggccauuucc

SEQ ID NO: 1462496 - RNA, 17 nt, Homo sapiens
cuggggugcugccugaa

SEQ ID NO: 1462497 - RNA, 21 nt, Homo sapiens
cugggucucgcuuuguugccc

SEQ ID NO: 1462498 - RNA, 19 nt, Homo sapiens
cuggguggccucgggacac

SEQ ID NO: 1462499 - RNA, 12 nt, Homo sapiens
cuggguggugga

SEQ ID NO: 1462500 - RNA, 16 nt, Homo sapiens
cucuggcucucauggg

SEQ ID NO: 1462501 - RNA, 22 nt, Homo sapiens
cucuggcucucaugggguccaa

SEQ ID NO: 1462502 - RNA, 17 nt, Homo sapiens
cucugggccuucucacc

SEQ ID NO: 1462503 - RNA, 17 nt, Homo sapiens
cucuggggucuuuuuau

SEQ ID NO: 1462504 - RNA, 18 nt, Homo sapiens
cucugguaaaugaucacu

SEQ ID NO: 1462505 - RNA, 21 nt, Homo sapiens
cucuggugcuccugcaucuca

SEQ ID NO: 1462506 - RNA, 20 nt, Homo sapiens
cucuguaaaaacacugaaaa

SEQ ID NO: 1462507 - RNA, 19 nt, Homo sapiens
cucuguaggucauuggcca

SEQ ID NO: 1462508 - RNA, 12 nt, Homo sapiens
cucuguauuccg

SEQ ID NO: 1462509 - RNA, 22 nt, Homo sapiens
cucuguauuccgauacaaagug

SEQ ID NO: 1462510 - RNA, 19 nt, Homo sapiens
cucugugcagucacuggag

SEQ ID NO: 1462511 - RNA, 14 nt, Homo sapiens
cucuuagcaaaaac

SEQ ID NO: 1462512 - RNA, 17 nt, Homo sapiens
cucuuaugugugccuuu

SEQ ID NO: 1462513 - RNA, 20 nt, Homo sapiens
cucuucaauagcuaagcauc

SEQ ID NO: 1462514 - RNA, 15 nt, Homo sapiens
cucuucccaugacug

SEQ ID NO: 1462515 - RNA, 22 nt, Homo sapiens
cucuuccuacccaaccacucaa

SEQ ID NO: 1462516 - RNA, 18 nt, Homo sapiens
cucuucgccuuucccacc

SEQ ID NO: 1462517 - RNA, 12 nt, Homo sapiens
cucuucugcaag

SEQ ID NO: 1462518 - RNA, 12 nt, Homo sapiens
cucuucuggaau

SEQ ID NO: 1462519 - RNA, 23 nt, Homo sapiens
cucuucuggggcaggcugggcca

SEQ ID NO: 1462520 - RNA, 13 nt, Homo sapiens
cucuugaggccag

SEQ ID NO: 1462521 - RNA, 20 nt, Homo sapiens
cucuuggccggauguccuca

SEQ ID NO: 1462522 - RNA, 22 nt, Homo sapiens
cucuuguaagucaucuacuuaa

SEQ ID NO: 1462523 - RNA, 21 nt, Homo sapiens
cucuuguauaugaugaucugg

SEQ ID NO: 1462524 - RNA, 15 nt, Homo sapiens
cucuuuaaucuucag

SEQ ID NO: 1462525 - RNA, 17 nt, Homo sapiens
cucuuucucugccagug

SEQ ID NO: 1462526 - RNA, 22 nt, Homo sapiens
ccaccucccugacccgucuaau

SEQ ID NO: 1462527 - RNA, 19 nt, Homo sapiens
ccaccucuguggcauugaa

SEQ ID NO: 1462528 - RNA, 15 nt, Homo sapiens
ccaccugcccaucac

SEQ ID NO: 1462529 - RNA, 16 nt, Homo sapiens
ccaccugccugcaucu

SEQ ID NO: 1462530 - RNA, 15 nt, Homo sapiens
ccaccuggcauuccu

SEQ ID NO: 1462531 - RNA, 21 nt, Homo sapiens
ccacgagggucaggacuguga

SEQ ID NO: 1462532 - RNA, 23 nt, Homo sapiens
ccacggccuguacggacacugug

SEQ ID NO: 1462533 - RNA, 22 nt, Homo sapiens
ccacuaggguccaccaggaguu

SEQ ID NO: 1462534 - RNA, 17 nt, Homo sapiens
ccacucagguucuucag

SEQ ID NO: 1462535 - RNA, 12 nt, Homo sapiens
ccacuccacuca

SEQ ID NO: 1462536 - RNA, 16 nt, Homo sapiens
ccacuccagcucugag

SEQ ID NO: 1462537 - RNA, 15 nt, Homo sapiens
ccacucuaccaaaua

SEQ ID NO: 1462538 - RNA, 18 nt, Homo sapiens
ccacugaagcaccacagg

SEQ ID NO: 1462539 - RNA, 12 nt, Homo sapiens
ccacugaccaga

SEQ ID NO: 1462540 - RNA, 14 nt, Homo sapiens
ccacugcaaaacac

SEQ ID NO: 1462541 - RNA, 18 nt, Homo sapiens
ccacugcguuguccacaa

SEQ ID NO: 1462542 - RNA, 20 nt, Homo sapiens
ccacugggccauuguggugu

SEQ ID NO: 1462543 - RNA, 13 nt, Homo sapiens
ccacuggggacuu

SEQ ID NO: 1462544 - RNA, 22 nt, Homo sapiens
ccacuguaauuaaaacuauuua

SEQ ID NO: 1462545 - RNA, 20 nt, Homo sapiens
ccacugugguggcaguggag

SEQ ID NO: 1462546 - RNA, 23 nt, Homo sapiens
ccacuguugguauuauauaauuc

SEQ ID NO: 1462547 - RNA, 13 nt, Homo sapiens
ccacuuacauaua

SEQ ID NO: 1462548 - RNA, 13 nt, Homo sapiens
ccacuuccugcua

SEQ ID NO: 1462549 - RNA, 21 nt, Homo sapiens
ccacuuccuuuuaacugccaa

SEQ ID NO: 1462550 - RNA, 14 nt, Homo sapiens
ccacuuguucugua

SEQ ID NO: 1462551 - RNA, 23 nt, Homo sapiens
ccagaaaagauggaaaagaaauu

SEQ ID NO: 1462552 - RNA, 13 nt, Homo sapiens
ccagaaaugucua

SEQ ID NO: 1462553 - RNA, 15 nt, Homo sapiens
ccagaacugccccca

SEQ ID NO: 1462554 - RNA, 21 nt, Homo sapiens
ccagaagaacaguaggugaca

SEQ ID NO: 1462555 - RNA, 22 nt, Homo sapiens
ccagaaggcagagguugcagug

SEQ ID NO: 1462556 - RNA, 22 nt, Homo sapiens
ccagaaucuugacuuucugauu

SEQ ID NO: 1462557 - RNA, 17 nt, Homo sapiens
ccagacuggagugcagg

SEQ ID NO: 1462558 - RNA, 15 nt, Homo sapiens
ccagagaaaagaguc

SEQ ID NO: 1462559 - RNA, 20 nt, Homo sapiens
ccagagacauacuugaaggg

SEQ ID NO: 1462560 - RNA, 18 nt, Homo sapiens
ccagagagcaacucugag

SEQ ID NO: 1462561 - RNA, 23 nt, Homo sapiens
ccagagccccccacaaugaugau

SEQ ID NO: 1462562 - RNA, 15 nt, Homo sapiens
ccagagcugccagug

SEQ ID NO: 1462563 - RNA, 20 nt, Homo sapiens
ccagagcugggaggcauggc

SEQ ID NO: 1462564 - RNA, 16 nt, Homo sapiens
ccagaggaacugucca

SEQ ID NO: 1462565 - RNA, 15 nt, Homo sapiens
ccagaggauggugag

SEQ ID NO: 1462566 - RNA, 15 nt, Homo sapiens
ccagaggcaguaacc

SEQ ID NO: 1462567 - RNA, 19 nt, Homo sapiens
ccagaucgcaccacugcac

SEQ ID NO: 1462568 - RNA, 13 nt, Homo sapiens
ccagaugauauaa

SEQ ID NO: 1462569 - RNA, 19 nt, Homo sapiens
ccagaugugaaaacaucuc

SEQ ID NO: 1462570 - RNA, 18 nt, Homo sapiens
ccagauugacgacaagug

SEQ ID NO: 1462571 - RNA, 16 nt, Homo sapiens
ccagcaacacaagcug

SEQ ID NO: 1462572 - RNA, 16 nt, Homo sapiens
ccagcaccaacaccac

SEQ ID NO: 1462573 - RNA, 12 nt, Homo sapiens
ccagcacccucu

SEQ ID NO: 1462574 - RNA, 12 nt, Homo sapiens
ccagcaccugcc

SEQ ID NO: 1462575 - RNA, 21 nt, Homo sapiens
ccagcacuuuagaucacuuga

SEQ ID NO: 1462576 - RNA, 22 nt, Homo sapiens
ccagcacuuuagaucacuugag

SEQ ID NO: 1462577 - RNA, 12 nt, Homo sapiens
ccagcacuuugg

SEQ ID NO: 1462578 - RNA, 16 nt, Homo sapiens
ccagcacuuugggagg

SEQ ID NO: 1462579 - RNA, 15 nt, Homo sapiens
ccagcagacucugga

SEQ ID NO: 1462580 - RNA, 18 nt, Homo sapiens
ccagcagggccucaaagu

SEQ ID NO: 1462581 - RNA, 16 nt, Homo sapiens
ccagcaguguugcuca

SEQ ID NO: 1462582 - RNA, 15 nt, Homo sapiens
ccagcauauacugaa

SEQ ID NO: 1462583 - RNA, 12 nt, Homo sapiens
ccagcaucugga

SEQ ID NO: 1462584 - RNA, 22 nt, Homo sapiens
ccagccaaccucauugcagcua

SEQ ID NO: 1462585 - RNA, 14 nt, Homo sapiens
ccagccagugccau

SEQ ID NO: 1462586 - RNA, 15 nt, Homo sapiens
ccagccccacacagc

SEQ ID NO: 1462587 - RNA, 17 nt, Homo sapiens
ccagccgaaaagcuuuu

SEQ ID NO: 1462588 - RNA, 20 nt, Homo sapiens
ccagccgugaugcucaggcu

SEQ ID NO: 1462589 - RNA, 19 nt, Homo sapiens
ccagccuggccaacauggc

SEQ ID NO: 1462590 - RNA, 20 nt, Homo sapiens
ccagccugggcagccaggcu

SEQ ID NO: 1462591 - RNA, 20 nt, Homo sapiens
ccagccuggggaacagagca

SEQ ID NO: 1462592 - RNA, 23 nt, Homo sapiens
ccagccugugguuacagugcaga

SEQ ID NO: 1462593 - RNA, 14 nt, Homo sapiens
ccagcgcaccuguu

SEQ ID NO: 1462594 - RNA, 16 nt, Homo sapiens
ccagcgggcacagggc

SEQ ID NO: 1462595 - RNA, 15 nt, Homo sapiens
ccagcgucccagucu

SEQ ID NO: 1462596 - RNA, 15 nt, Homo sapiens
ccagcuacucaggag

SEQ ID NO: 1462597 - RNA, 15 nt, Homo sapiens
ccagcuacucgggag

SEQ ID NO: 1462598 - RNA, 17 nt, Homo sapiens
ccagcucagaacccauc

SEQ ID NO: 1462599 - RNA, 18 nt, Homo sapiens
ccagcucauacaaaauaa

SEQ ID NO: 1462600 - RNA, 16 nt, Homo sapiens
ccagcuccaaggggaa

SEQ ID NO: 1462601 - RNA, 19 nt, Homo sapiens
ccagcugcaggaaucaaaa

SEQ ID NO: 1462602 - RNA, 13 nt, Homo sapiens
ccagcugcugucu

SEQ ID NO: 1462603 - RNA, 12 nt, Homo sapiens
ccagcugucacu

SEQ ID NO: 1462604 - RNA, 16 nt, Homo sapiens
ccagcugugcacuuuc

SEQ ID NO: 1462605 - RNA, 13 nt, Homo sapiens
ccagcuuacuagc

SEQ ID NO: 1462606 - RNA, 14 nt, Homo sapiens
ccagcuucaggcag

SEQ ID NO: 1462607 - RNA, 22 nt, Homo sapiens
ccaggaacucgcaccugugcug

SEQ ID NO: 1462608 - RNA, 15 nt, Homo sapiens
ccaggaccaagccac

SEQ ID NO: 1462609 - RNA, 22 nt, Homo sapiens
ccaggacgcuucugaaugcugc

SEQ ID NO: 1462610 - RNA, 17 nt, Homo sapiens
ccaggacugaccucuuc

SEQ ID NO: 1462611 - RNA, 20 nt, Homo sapiens
ccaggagauggguccagggg

SEQ ID NO: 1462612 - RNA, 17 nt, Homo sapiens
ccaggaguuugagacca

SEQ ID NO: 1462613 - RNA, 16 nt, Homo sapiens
cccaaggaagagccaa

SEQ ID NO: 1462614 - RNA, 17 nt, Homo sapiens
cccaaggaagagccaau

SEQ ID NO: 1462615 - RNA, 22 nt, Homo sapiens
cccaauuucggauuuuuuccaa

SEQ ID NO: 1462616 - RNA, 17 nt, Homo sapiens
cccacaaccuuccagcu

SEQ ID NO: 1462617 - RNA, 20 nt, Homo sapiens
cccacaagugccacugcccg

SEQ ID NO: 1462618 - RNA, 15 nt, Homo sapiens
cccacaccucugcca

SEQ ID NO: 1462619 - RNA, 14 nt, Homo sapiens
cccacccagucuca

SEQ ID NO: 1462620 - RNA, 21 nt, Homo sapiens
cccacccccuucucugcucca

SEQ ID NO: 1462621 - RNA, 14 nt, Homo sapiens
cccacgugcauuca

SEQ ID NO: 1462622 - RNA, 11 nt, Homo sapiens
cccacucccua

SEQ ID NO: 1462623 - RNA, 18 nt, Homo sapiens
cccacugacccacucgga

SEQ ID NO: 1462624 - RNA, 22 nt, Homo sapiens
cccacugcuggugccagggugg

SEQ ID NO: 1462625 - RNA, 12 nt, Homo sapiens
cccagaaggcag

SEQ ID NO: 1462626 - RNA, 14 nt, Homo sapiens
cccagaaguggcua

SEQ ID NO: 1462627 - RNA, 13 nt, Homo sapiens
cccagacacuggc

SEQ ID NO: 1462628 - RNA, 23 nt, Homo sapiens
cccagacacuggcguuacugcuu

SEQ ID NO: 1462629 - RNA, 20 nt, Homo sapiens
cucaaccucaccauugugaa

SEQ ID NO: 1462630 - RNA, 23 nt, Homo sapiens
cucaagaccagagacccaacagc

SEQ ID NO: 1462631 - RNA, 16 nt, Homo sapiens
cucaagaugaaggcaa

SEQ ID NO: 1462632 - RNA, 20 nt, Homo sapiens
cucaagccccauuuccucac

SEQ ID NO: 1462633 - RNA, 16 nt, Homo sapiens
cucaagcuguccuccc

SEQ ID NO: 1462634 - RNA, 15 nt, Homo sapiens
cucaaucuacaggcc

SEQ ID NO: 1462635 - RNA, 16 nt, Homo sapiens
cucaaucuacaggcca

SEQ ID NO: 1462636 - RNA, 23 nt, Homo sapiens
cucaaucuacaggccagcaccuu

SEQ ID NO: 1462637 - RNA, 22 nt, Homo sapiens
cucaaucuccucucucuuuccu

SEQ ID NO: 1462638 - RNA, 23 nt, Homo sapiens
cucaaugaaaauuuaaagggaaa

SEQ ID NO: 1462639 - RNA, 14 nt, Homo sapiens
cucacaaaaucacu

SEQ ID NO: 1462640 - RNA, 23 nt, Homo sapiens
cucacaaugucccuucagcaccu

SEQ ID NO: 1462641 - RNA, 15 nt, Homo sapiens
cucacacacacagcu

SEQ ID NO: 1462642 - RNA, 16 nt, Homo sapiens
cucacacuaaucugaa

SEQ ID NO: 1462643 - RNA, 16 nt, Homo sapiens
cucacagaacuaugua

SEQ ID NO: 1462644 - RNA, 20 nt, Homo sapiens
cucacagaugugacuguaua

SEQ ID NO: 1462645 - RNA, 14 nt, Homo sapiens
cucaccccugggca

SEQ ID NO: 1462646 - RNA, 15 nt, Homo sapiens
cucaccucuugccuu

SEQ ID NO: 1462647 - RNA, 18 nt, Homo sapiens
cucaccuggacuccagua

SEQ ID NO: 1462648 - RNA, 23 nt, Homo sapiens
cucaccugucuaggucuccucag

SEQ ID NO: 1462649 - RNA, 23 nt, Homo sapiens
cucacgcagacacacccacagaa

SEQ ID NO: 1462650 - RNA, 19 nt, Homo sapiens
cucacgcccuaagcgcaca

SEQ ID NO: 1462651 - RNA, 13 nt, Homo sapiens
cucacgccuguaa

SEQ ID NO: 1462652 - RNA, 21 nt, Homo sapiens
cucacugaggguaucugacaa

SEQ ID NO: 1462653 - RNA, 15 nt, Homo sapiens
ccccuacugcuguga

SEQ ID NO: 1462654 - RNA, 17 nt, Homo sapiens
ccccucacaauccuugc

SEQ ID NO: 1462655 - RNA, 16 nt, Homo sapiens
ccccucagaugaucuc

SEQ ID NO: 1462656 - RNA, 14 nt, Homo sapiens
ccccugcacaguug

SEQ ID NO: 1462657 - RNA, 19 nt, Homo sapiens
ccccuggaucuaccagcau

SEQ ID NO: 1462658 - RNA, 23 nt, Homo sapiens
ccccuggcuccagagauggucac

SEQ ID NO: 1462659 - RNA, 21 nt, Homo sapiens
ccccugggcaggugugugugg

SEQ ID NO: 1462660 - RNA, 16 nt, Homo sapiens
ccccugugucauccca

SEQ ID NO: 1462661 - RNA, 22 nt, Homo sapiens
ccccuuauccaggacucuguca

SEQ ID NO: 1462662 - RNA, 13 nt, Homo sapiens
ccccuugcucuca

SEQ ID NO: 1462663 - RNA, 16 nt, Homo sapiens
ccccuuuucugcauuu

SEQ ID NO: 1462664 - RNA, 20 nt, Homo sapiens
ccccuuuucugcauuuugcu

SEQ ID NO: 1462665 - RNA, 14 nt, Homo sapiens
cccgaaaugccacg

SEQ ID NO: 1462666 - RNA, 13 nt, Homo sapiens
cccgacagccugg

SEQ ID NO: 1462667 - RNA, 16 nt, Homo sapiens
cccgacuccucaaaag

SEQ ID NO: 1462668 - RNA, 21 nt, Homo sapiens
cccgcagugcugggaccagag

SEQ ID NO: 1462669 - RNA, 22 nt, Homo sapiens
cccgcagugcugggaccagagc

SEQ ID NO: 1462670 - RNA, 14 nt, Homo sapiens
cauggcugaaguca

SEQ ID NO: 1462671 - RNA, 15 nt, Homo sapiens
caugggggcacuuga

SEQ ID NO: 1462672 - RNA, 14 nt, Homo sapiens
cauggguccagggc

SEQ ID NO: 1462673 - RNA, 18 nt, Homo sapiens
caugguuaccugaccuaa

SEQ ID NO: 1462674 - RNA, 16 nt, Homo sapiens
caugguuuugaaaugc

SEQ ID NO: 1462675 - RNA, 17 nt, Homo sapiens
cauguacauacccuggc

SEQ ID NO: 1462676 - RNA, 13 nt, Homo sapiens
cauguagcuucuu

SEQ ID NO: 1462677 - RNA, 18 nt, Homo sapiens
cauguaugacaagacaau

SEQ ID NO: 1462678 - RNA, 22 nt, Homo sapiens
cauguauggaaucccacuguau

SEQ ID NO: 1462679 - RNA, 20 nt, Homo sapiens
cauguauucauccagaguuc

SEQ ID NO: 1462680 - RNA, 15 nt, Homo sapiens
caugucucaauagua

SEQ ID NO: 1462681 - RNA, 17 nt, Homo sapiens
caugugagccaccgcug

SEQ ID NO: 1462682 - RNA, 13 nt, Homo sapiens
caugugcaccugc

SEQ ID NO: 1462683 - RNA, 14 nt, Homo sapiens
caugugcaccugcc

SEQ ID NO: 1462684 - RNA, 14 nt, Homo sapiens
caugugcacuucaa

SEQ ID NO: 1462685 - RNA, 17 nt, Homo sapiens
caugugccagggcaaug

SEQ ID NO: 1462686 - RNA, 18 nt, Homo sapiens
caugugccgaaugugcag

SEQ ID NO: 1462687 - RNA, 22 nt, Homo sapiens
cauguggcuaaaugccuaauaa

SEQ ID NO: 1462688 - RNA, 14 nt, Homo sapiens
caugugggcacgga

SEQ ID NO: 1462689 - RNA, 19 nt, Homo sapiens
caugugguuucuaugcaaa

SEQ ID NO: 1462690 - RNA, 14 nt, Homo sapiens
cauguguauacaua

SEQ ID NO: 1462691 - RNA, 14 nt, Homo sapiens
cauguguauguguc

SEQ ID NO: 1462692 - RNA, 13 nt, Homo sapiens
cauguguauuucc

SEQ ID NO: 1462693 - RNA, 13 nt, Homo sapiens
cauguucacugug

SEQ ID NO: 1462694 - RNA, 13 nt, Homo sapiens
cauguucaugggu

SEQ ID NO: 1462695 - RNA, 22 nt, Homo sapiens
cauguuggccaggcuggucuca

SEQ ID NO: 1462696 - RNA, 22 nt, Homo sapiens
cauguuucaagaaaauggauuu

SEQ ID NO: 1462697 - RNA, 11 nt, Homo sapiens
cauguuugcag

SEQ ID NO: 1462698 - RNA, 13 nt, Homo sapiens
cauuaaaugacaa

SEQ ID NO: 1462699 - RNA, 21 nt, Homo sapiens
cauuaacaguuuuccaugaaa

SEQ ID NO: 1462700 - RNA, 16 nt, Homo sapiens
cauuaaggaauuugau

SEQ ID NO: 1462701 - RNA, 14 nt, Homo sapiens
cauuaauacaaaga

SEQ ID NO: 1462702 - RNA, 18 nt, Homo sapiens
cauuaauagcagccuuuc

SEQ ID NO: 1462703 - RNA, 15 nt, Homo sapiens
cauuaauguuaauuc

SEQ ID NO: 1462704 - RNA, 20 nt, Homo sapiens
cauuacacgaucaccugcau

SEQ ID NO: 1462705 - RNA, 12 nt, Homo sapiens
cauuaccacuca

SEQ ID NO: 1462706 - RNA, 22 nt, Homo sapiens
cauuauaucauuggaacaacug

SEQ ID NO: 1462707 - RNA, 21 nt, Homo sapiens
cauuaugaguaguguggaauu

SEQ ID NO: 1462708 - RNA, 13 nt, Homo sapiens
cauuauucauuua

SEQ ID NO: 1462709 - RNA, 17 nt, Homo sapiens
cauuauuuugaauguga

SEQ ID NO: 1462710 - RNA, 21 nt, Homo sapiens
cauucaauauugacauuugua

SEQ ID NO: 1462711 - RNA, 13 nt, Homo sapiens
cauucacaguucu

SEQ ID NO: 1462712 - RNA, 17 nt, Homo sapiens
cauucacuugcauuucu

SEQ ID NO: 1462713 - RNA, 19 nt, Homo sapiens
cauucaggcaacgcacaaa

SEQ ID NO: 1462714 - RNA, 22 nt, Homo sapiens
cauucagugauuacugucaagg

SEQ ID NO: 1462715 - RNA, 22 nt, Homo sapiens
cauuccaggaccagaagcauuu

SEQ ID NO: 1462716 - RNA, 13 nt, Homo sapiens
cauuccauuugaa

SEQ ID NO: 1462717 - RNA, 15 nt, Homo sapiens
cauucccagugguca

SEQ ID NO: 1462718 - RNA, 17 nt, Homo sapiens
cauucccccaccagcug

SEQ ID NO: 1462719 - RNA, 16 nt, Homo sapiens
cauucccucuccugcc

SEQ ID NO: 1462720 - RNA, 20 nt, Homo sapiens
cauuccugaaagaaacaguu

SEQ ID NO: 1462721 - RNA, 13 nt, Homo sapiens
cauuccugaagaa

SEQ ID NO: 1462722 - RNA, 19 nt, Homo sapiens
cauuccugaagaaccaguc

SEQ ID NO: 1462723 - RNA, 16 nt, Homo sapiens
cauuccuuugucuuca

SEQ ID NO: 1462724 - RNA, 18 nt, Homo sapiens
cauucuagaaacaggaaa

SEQ ID NO: 1462725 - RNA, 16 nt, Homo sapiens
cauucuccugccucag

SEQ ID NO: 1462726 - RNA, 18 nt, Homo sapiens
cauucugcaagcacaucu

SEQ ID NO: 1462727 - RNA, 22 nt, Homo sapiens
cauucugguuuugacaucagca

SEQ ID NO: 1462728 - RNA, 12 nt, Homo sapiens
cauucugucacc

SEQ ID NO: 1462729 - RNA, 21 nt, Homo sapiens
cauucugucacccagacugga

SEQ ID NO: 1462730 - RNA, 23 nt, Homo sapiens
cauucuuauuaauucuucaccug

SEQ ID NO: 1462731 - RNA, 20 nt, Homo sapiens
cauugaccaagaacugcaug

SEQ ID NO: 1462732 - RNA, 15 nt, Homo sapiens
cauugcaauuugcag

SEQ ID NO: 1462733 - RNA, 16 nt, Homo sapiens
cauugcacuccagcug

SEQ ID NO: 1462734 - RNA, 15 nt, Homo sapiens
cauugcaguuuaaga

SEQ ID NO: 1462735 - RNA, 16 nt, Homo sapiens
cauugccgcuguauaa

SEQ ID NO: 1462736 - RNA, 15 nt, Homo sapiens
cauugcuuuccacug

SEQ ID NO: 1462737 - RNA, 22 nt, Homo sapiens
cauugcuuuugggagacuggaa

SEQ ID NO: 1462738 - RNA, 12 nt, Homo sapiens
cauuggcacugu

SEQ ID NO: 1462739 - RNA, 12 nt, Homo sapiens
cauuggcuuaaa

SEQ ID NO: 1462740 - RNA, 14 nt, Homo sapiens
cauugggauauucu

SEQ ID NO: 1462741 - RNA, 17 nt, Homo sapiens
cauugguaagaaugagc

SEQ ID NO: 1462742 - RNA, 23 nt, Homo sapiens
cauugguuggaagcuaccagagc

SEQ ID NO: 1462743 - RNA, 21 nt, Homo sapiens
cauuguaaaguuuaugucacc

SEQ ID NO: 1462744 - RNA, 18 nt, Homo sapiens
cauuguacuaccugugua

SEQ ID NO: 1462745 - RNA, 12 nt, Homo sapiens
cauugucccuga

SEQ ID NO: 1462746 - RNA, 21 nt, Homo sapiens
cauugucccugaaugcuccau

SEQ ID NO: 1462747 - RNA, 23 nt, Homo sapiens
cauugucgcuauugauuuuuacu

SEQ ID NO: 1462748 - RNA, 20 nt, Homo sapiens
cauugugaagcaccuacuau

SEQ ID NO: 1462749 - RNA, 11 nt, Homo sapiens
cauuguucucc

SEQ ID NO: 1462750 - RNA, 17 nt, Homo sapiens
cauuguucuccucgucc

SEQ ID NO: 1462751 - RNA, 19 nt, Homo sapiens
cauuguugagguggucuga

SEQ ID NO: 1462752 - RNA, 20 nt, Homo sapiens
cauuuaaaaaaaucacaaaa

SEQ ID NO: 1462753 - RNA, 22 nt, Homo sapiens
cauuuaaaauugcuauguuacu

SEQ ID NO: 1462754 - RNA, 21 nt, Homo sapiens
cauuuagaacuugcagcugau

SEQ ID NO: 1462755 - RNA, 22 nt, Homo sapiens
cauuuagaggacauucuggaaa

SEQ ID NO: 1462756 - RNA, 16 nt, Homo sapiens
cauuuagucaugugac

SEQ ID NO: 1462757 - RNA, 17 nt, Homo sapiens
cauuuagucaugugacc

SEQ ID NO: 1462758 - RNA, 15 nt, Homo sapiens
cauuuaguccuguac

SEQ ID NO: 1462759 - RNA, 15 nt, Homo sapiens
cauauauacccacau

SEQ ID NO: 1462760 - RNA, 18 nt, Homo sapiens
cauauauauugaaaugca

SEQ ID NO: 1462761 - RNA, 19 nt, Homo sapiens
cauauaugugaucugggca

SEQ ID NO: 1462762 - RNA, 16 nt, Homo sapiens
cauaucaauuggcagu

SEQ ID NO: 1462763 - RNA, 16 nt, Homo sapiens
cauaucaucacauuga

SEQ ID NO: 1462764 - RNA, 15 nt, Homo sapiens
cauauccaccaccuc

SEQ ID NO: 1462765 - RNA, 16 nt, Homo sapiens
cauaucccuuccucuc

SEQ ID NO: 1462766 - RNA, 22 nt, Homo sapiens
cauaugagcuuccuucugugaa

SEQ ID NO: 1462767 - RNA, 20 nt, Homo sapiens
cauauguauauauauauaug

SEQ ID NO: 1462768 - RNA, 14 nt, Homo sapiens
cauauguugcaaga

SEQ ID NO: 1462769 - RNA, 13 nt, Homo sapiens
caauugugcugcc

SEQ ID NO: 1462770 - RNA, 19 nt, Homo sapiens
caauuuaacuagacacaga

SEQ ID NO: 1462771 - RNA, 23 nt, Homo sapiens
caauuucacgcuuuuaauucuca

SEQ ID NO: 1462772 - RNA, 10 nt, Homo sapiens
caauuucacu

SEQ ID NO: 1462773 - RNA, 14 nt, Homo sapiens
caauuucagacucc

SEQ ID NO: 1462774 - RNA, 15 nt, Homo sapiens
caauuucagacuccc

SEQ ID NO: 1462775 - RNA, 14 nt, Homo sapiens
caauuucuugguau

SEQ ID NO: 1462776 - RNA, 17 nt, Homo sapiens
caauuugacaaaaccca

SEQ ID NO: 1462777 - RNA, 22 nt, Homo sapiens
caauuugagauucuacaguaag

SEQ ID NO: 1462778 - RNA, 13 nt, Homo sapiens
caauuugccuuuu

SEQ ID NO: 1462779 - RNA, 19 nt, Homo sapiens
caauuuguaauugcuuaca

SEQ ID NO: 1462780 - RNA, 18 nt, Homo sapiens
caauuuuugucucagaag

SEQ ID NO: 1462781 - RNA, 15 nt, Homo sapiens
cacaaauaaaagcca

SEQ ID NO: 1462782 - RNA, 21 nt, Homo sapiens
cacaaaucagaccuggcugcu

SEQ ID NO: 1462783 - RNA, 22 nt, Homo sapiens
cacaagauggaaaucacauuua

SEQ ID NO: 1462784 - RNA, 22 nt, Homo sapiens
cacaagccacaagucuuccaga

SEQ ID NO: 1462785 - RNA, 18 nt, Homo sapiens
cacaaggaaggcauuugg

SEQ ID NO: 1462786 - RNA, 16 nt, Homo sapiens
cacaaggacuuccugu

SEQ ID NO: 1462787 - RNA, 13 nt, Homo sapiens
cacaagucuucca

SEQ ID NO: 1462788 - RNA, 16 nt, Homo sapiens
cacaaguggaccuuag

SEQ ID NO: 1462789 - RNA, 20 nt, Homo sapiens
cacaauagcaguugaaacaa

SEQ ID NO: 1462790 - RNA, 23 nt, Homo sapiens
cacaauccuguggaucugggcaa

SEQ ID NO: 1462791 - RNA, 16 nt, Homo sapiens
cacaauccuugccaca

SEQ ID NO: 1462792 - RNA, 21 nt, Homo sapiens
cacacaaaaagugucucugcc

SEQ ID NO: 1462793 - RNA, 15 nt, Homo sapiens
cacacaacuguccau

SEQ ID NO: 1462794 - RNA, 10 nt, Homo sapiens
cacacacaaa

SEQ ID NO: 1462795 - RNA, 13 nt, Homo sapiens
cacacacccagcu

SEQ ID NO: 1462796 - RNA, 21 nt, Homo sapiens
cacacacgcuuucuuaugcaa

SEQ ID NO: 1462797 - RNA, 22 nt, Homo sapiens
cacacacuguucugaaagugac

SEQ ID NO: 1462798 - RNA, 22 nt, Homo sapiens
cacacagcuacucuccccacga

SEQ ID NO: 1462799 - RNA, 15 nt, Homo sapiens
cacacagcugcccua

SEQ ID NO: 1462800 - RNA, 16 nt, Homo sapiens
cacacagcugcccuag

SEQ ID NO: 1462801 - RNA, 20 nt, Homo sapiens
cacacagguggggacugggc

SEQ ID NO: 1462802 - RNA, 11 nt, Homo sapiens
cacacaguguu

SEQ ID NO: 1462803 - RNA, 15 nt, Homo sapiens
cacacaguguuuuaa

SEQ ID NO: 1462804 - RNA, 18 nt, Homo sapiens
cacacauuauuaccccac

SEQ ID NO: 1462805 - RNA, 19 nt, Homo sapiens
cacaccaacagugugaagu

SEQ ID NO: 1462806 - RNA, 21 nt, Homo sapiens
cacacccacucccuuccccau

SEQ ID NO: 1462807 - RNA, 17 nt, Homo sapiens
cacaccugccgucuuca

SEQ ID NO: 1462808 - RNA, 15 nt, Homo sapiens
cacacgcaggaacuc

SEQ ID NO: 1462809 - RNA, 22 nt, Homo sapiens
cacacgcuuucuuaugcaaucu

SEQ ID NO: 1462810 - RNA, 14 nt, Homo sapiens
cacacguacuuaaa

SEQ ID NO: 1462811 - RNA, 16 nt, Homo sapiens
cacagaaauuuucaau

SEQ ID NO: 1462812 - RNA, 17 nt, Homo sapiens
cacagaauagcacaaac

SEQ ID NO: 1462813 - RNA, 15 nt, Homo sapiens
cacagaggagugcag

SEQ ID NO: 1462814 - RNA, 17 nt, Homo sapiens
cacagaggagugcagcc

SEQ ID NO: 1462815 - RNA, 13 nt, Homo sapiens
cacagaggcugcc

SEQ ID NO: 1462816 - RNA, 19 nt, Homo sapiens
cacagaggucaggaagcag

SEQ ID NO: 1462817 - RNA, 13 nt, Homo sapiens
cacagaugucucu

SEQ ID NO: 1462818 - RNA, 13 nt, Homo sapiens
cacagcacagcca

SEQ ID NO: 1462819 - RNA, 16 nt, Homo sapiens
cacagcacucucuaaa

SEQ ID NO: 1462820 - RNA, 22 nt, Homo sapiens
cacagcaucauuuugcauucaa

SEQ ID NO: 1462821 - RNA, 23 nt, Homo sapiens
cacagcaucgggagcacccagag

SEQ ID NO: 1462822 - RNA, 18 nt, Homo sapiens
cacagcauguguauuucc

SEQ ID NO: 1462823 - RNA, 14 nt, Homo sapiens
cacagccaacacgc

SEQ ID NO: 1462824 - RNA, 21 nt, Homo sapiens
cacagcccugcagugcccuag

SEQ ID NO: 1462825 - RNA, 15 nt, Homo sapiens
cacagccuccagggc

SEQ ID NO: 1462826 - RNA, 20 nt, Homo sapiens
cacagcggaggagaccagcu

SEQ ID NO: 1462827 - RNA, 17 nt, Homo sapiens
cacagcggagucugucc

SEQ ID NO: 1462828 - RNA, 21 nt, Homo sapiens
cacagcugccaucgaccugga

SEQ ID NO: 1462829 - RNA, 19 nt, Homo sapiens
cacagcuuagaagugcuau

SEQ ID NO: 1462830 - RNA, 22 nt, Homo sapiens
cacaggaaucgguggucuccac

SEQ ID NO: 1462831 - RNA, 13 nt, Homo sapiens
cacaggaugcugg

SEQ ID NO: 1462832 - RNA, 17 nt, Homo sapiens
cacaggcgaggacccug

SEQ ID NO: 1462833 - RNA, 19 nt, Homo sapiens
cacagggcccgcagugcug

SEQ ID NO: 1462834 - RNA, 16 nt, Homo sapiens
cacagggcggugcuag

SEQ ID NO: 1462835 - RNA, 22 nt, Homo sapiens
cacagggggauucugagcagug

SEQ ID NO: 1462836 - RNA, 16 nt, Homo sapiens
cacagguucaugccac

SEQ ID NO: 1462837 - RNA, 16 nt, Homo sapiens
cacagucaauucugau

SEQ ID NO: 1462838 - RNA, 17 nt, Homo sapiens
cacaguccucauuuacu

SEQ ID NO: 1462839 - RNA, 22 nt, Homo sapiens
cacagucucuuuaaucuucagu

SEQ ID NO: 1462840 - RNA, 15 nt, Homo sapiens
cacaguggccaaaga

SEQ ID NO: 1462841 - RNA, 12 nt, Homo sapiens
cacauagugaaa

SEQ ID NO: 1462842 - RNA, 13 nt, Homo sapiens
cacaucugcauuu

SEQ ID NO: 1462843 - RNA, 15 nt, Homo sapiens
cacaucuuuccucaa

SEQ ID NO: 1462844 - RNA, 17 nt, Homo sapiens
cacaugaaaccuacaca

SEQ ID NO: 1462845 - RNA, 14 nt, Homo sapiens
cacaugaggccauc

SEQ ID NO: 1462846 - RNA, 15 nt, Homo sapiens
cacaugaugugcaua

SEQ ID NO: 1462847 - RNA, 18 nt, Homo sapiens
cacauguuacugcuucau

SEQ ID NO: 1462848 - RNA, 17 nt, Homo sapiens
cacauuauguaucuuag

SEQ ID NO: 1462849 - RNA, 22 nt, Homo sapiens
cacauucuauuuuggguauuaa

SEQ ID NO: 1462850 - RNA, 21 nt, Homo sapiens
cacauugcauucuauugccuu

SEQ ID NO: 1462851 - RNA, 23 nt, Homo sapiens
cacauuggauucaucagcauuug

SEQ ID NO: 1462852 - RNA, 14 nt, Homo sapiens
cacauuugauucug

SEQ ID NO: 1462853 - RNA, 22 nt, Homo sapiens
caccaaaagugcuccccaaaag

SEQ ID NO: 1462854 - RNA, 20 nt, Homo sapiens
caccaaagccaccucuguca

SEQ ID NO: 1462855 - RNA, 15 nt, Homo sapiens
caccaaccugcauuu

SEQ ID NO: 1462856 - RNA, 19 nt, Homo sapiens
caccaagaucaagcagaga

SEQ ID NO: 1462857 - RNA, 13 nt, Homo sapiens
caccacaccauca

SEQ ID NO: 1462858 - RNA, 16 nt, Homo sapiens
caccacaccuggcuaa

SEQ ID NO: 1462859 - RNA, 19 nt, Homo sapiens
caccacggcguuguaccug

SEQ ID NO: 1462860 - RNA, 14 nt, Homo sapiens
caccagccauccuc

SEQ ID NO: 1462861 - RNA, 18 nt, Homo sapiens
caccaggccgugccuugu

SEQ ID NO: 1462862 - RNA, 16 nt, Homo sapiens
caccagugcgugcucc

SEQ ID NO: 1462863 - RNA, 15 nt, Homo sapiens
caccaguuauuccuu

SEQ ID NO: 1462864 - RNA, 23 nt, Homo sapiens
caccaugaagcgaaacacagaga

SEQ ID NO: 1462865 - RNA, 17 nt, Homo sapiens
caccauguauucaucca

SEQ ID NO: 1462866 - RNA, 18 nt, Homo sapiens
cagugaccccugaccuca

SEQ ID NO: 1462867 - RNA, 18 nt, Homo sapiens
cagugagaaaaagcuccu

SEQ ID NO: 1462868 - RNA, 14 nt, Homo sapiens
cagugagccaagau

SEQ ID NO: 1462869 - RNA, 19 nt, Homo sapiens
cagugagcugagauugugc

SEQ ID NO: 1462870 - RNA, 20 nt, Homo sapiens
cagugagcugauaucaugcc

SEQ ID NO: 1462871 - RNA, 20 nt, Homo sapiens
cagugaguaaucaauacaga

SEQ ID NO: 1462872 - RNA, 15 nt, Homo sapiens
cagugaucuccauau

SEQ ID NO: 1462873 - RNA, 23 nt, Homo sapiens
cagugaugcugugcuaugaauuu

SEQ ID NO: 1462874 - RNA, 22 nt, Homo sapiens
uuccaucuccaggagacuuuca

SEQ ID NO: 1462875 - RNA, 14 nt, Homo sapiens
uuccaugauucuau

SEQ ID NO: 1462876 - RNA, 14 nt, Homo sapiens
uuccaugugccuuu

SEQ ID NO: 1462877 - RNA, 13 nt, Homo sapiens
uuccauugauuca

SEQ ID NO: 1462878 - RNA, 23 nt, Homo sapiens
uucccaauuaggaaguguaacag

SEQ ID NO: 1462879 - RNA, 17 nt, Homo sapiens
uucccagagucaucuga

SEQ ID NO: 1462880 - RNA, 23 nt, Homo sapiens
uucccaggagauggguccagggg

SEQ ID NO: 1462881 - RNA, 17 nt, Homo sapiens
uucccaucugcaccccu

SEQ ID NO: 1462882 - RNA, 15 nt, Homo sapiens
uuccccaaccacaga

SEQ ID NO: 1462883 - RNA, 16 nt, Homo sapiens
uuccccaaugcuccau

SEQ ID NO: 1462884 - RNA, 17 nt, Homo sapiens
uucccccaccagcugca

SEQ ID NO: 1462885 - RNA, 15 nt, Homo sapiens
uucccccaguaccuc

SEQ ID NO: 1462886 - RNA, 20 nt, Homo sapiens
uuccccuuagaaacacugca

SEQ ID NO: 1462887 - RNA, 19 nt, Homo sapiens
uucccuaaaauacauuuaa

SEQ ID NO: 1462888 - RNA, 19 nt, Homo sapiens
uucccuaccauucagugau

SEQ ID NO: 1462889 - RNA, 23 nt, Homo sapiens
uucccuaggaaacucacacuccc

SEQ ID NO: 1462890 - RNA, 13 nt, Homo sapiens
uucccuccaguga

SEQ ID NO: 1462891 - RNA, 15 nt, Homo sapiens
uucccucuugcucag

SEQ ID NO: 1462892 - RNA, 16 nt, Homo sapiens
uucccuuagugacucu

SEQ ID NO: 1462893 - RNA, 15 nt, Homo sapiens
uuccgauacaaagug

SEQ ID NO: 1462894 - RNA, 21 nt, Homo sapiens
uuccgauggaugaaucuccca

SEQ ID NO: 1462895 - RNA, 17 nt, Homo sapiens
uuccuacccaaccacuc

SEQ ID NO: 1462896 - RNA, 14 nt, Homo sapiens
uuccucacuuugaa

SEQ ID NO: 1462897 - RNA, 15 nt, Homo sapiens
uuccucacuuugaag

SEQ ID NO: 1462898 - RNA, 13 nt, Homo sapiens
uuccucaggguuc

SEQ ID NO: 1462899 - RNA, 20 nt, Homo sapiens
uuccuccaagcuauucaauu

SEQ ID NO: 1462900 - RNA, 23 nt, Homo sapiens
uuccucccagcauaggauucauu

SEQ ID NO: 1462901 - RNA, 14 nt, Homo sapiens
uuccucgccugaca

SEQ ID NO: 1462902 - RNA, 22 nt, Homo sapiens
uuccucuaugaaaauuauaucu

SEQ ID NO: 1462903 - RNA, 16 nt, Homo sapiens
uuccucuguaagauau

SEQ ID NO: 1462904 - RNA, 14 nt, Homo sapiens
uuccucuuacugua

SEQ ID NO: 1462905 - RNA, 17 nt, Homo sapiens
uuccugcagccccagaa

SEQ ID NO: 1462906 - RNA, 21 nt, Homo sapiens
uuccugcgcgucaucucugac

SEQ ID NO: 1462907 - RNA, 19 nt, Homo sapiens
uuccuggaguacaaacaca

SEQ ID NO: 1462908 - RNA, 14 nt, Homo sapiens
uuccugguuugacu

SEQ ID NO: 1462909 - RNA, 15 nt, Homo sapiens
uuccuguccagcucc

SEQ ID NO: 1462910 - RNA, 22 nt, Homo sapiens
uuccuguggggggaaguccaug

SEQ ID NO: 1462911 - RNA, 15 nt, Homo sapiens
uuccuuaaacugugu

SEQ ID NO: 1462912 - RNA, 18 nt, Homo sapiens
uuccuuaauccagcugau

SEQ ID NO: 1462913 - RNA, 18 nt, Homo sapiens
uuccuucaaugugcauaa

SEQ ID NO: 1462914 - RNA, 19 nt, Homo sapiens
uuccuuccagauccugggu

SEQ ID NO: 1462915 - RNA, 21 nt, Homo sapiens
uuccuucuggccucugcugaa

SEQ ID NO: 1462916 - RNA, 23 nt, Homo sapiens
uuccuuuaaagaugaacucugaa

SEQ ID NO: 1462917 - RNA, 19 nt, Homo sapiens
uuccuuuauacacagugga

SEQ ID NO: 1462918 - RNA, 17 nt, Homo sapiens
uuccuuuauacugugaa

SEQ ID NO: 1462919 - RNA, 14 nt, Homo sapiens
uuccuuucugccac

SEQ ID NO: 1462920 - RNA, 21 nt, Homo sapiens
uuccuuuguagcuacuuuugc

SEQ ID NO: 1462921 - RNA, 20 nt, Homo sapiens
uuccuuuuuaauaugcuuaa

SEQ ID NO: 1462922 - RNA, 13 nt, Homo sapiens
uucgacuaccuuu

SEQ ID NO: 1462923 - RNA, 18 nt, Homo sapiens
uucggauguaugaucucu

SEQ ID NO: 1462924 - RNA, 12 nt, Homo sapiens
uucgguuucaaa

SEQ ID NO: 1462925 - RNA, 15 nt, Homo sapiens
uucgugacaacaugc

SEQ ID NO: 1462926 - RNA, 21 nt, Homo sapiens
uucuaacccaacugacuugua

SEQ ID NO: 1462927 - RNA, 16 nt, Homo sapiens
uucuaacgccagcaca

SEQ ID NO: 1462928 - RNA, 20 nt, Homo sapiens
uucuaauuuauauuauccau

SEQ ID NO: 1462929 - RNA, 19 nt, Homo sapiens
uucuaauuucaaaaauaua

SEQ ID NO: 1462930 - RNA, 14 nt, Homo sapiens
uucuacaaccagag

SEQ ID NO: 1462931 - RNA, 20 nt, Homo sapiens
uucuacgggauggccagaga

SEQ ID NO: 1462932 - RNA, 23 nt, Homo sapiens
uucuacuucuggaagucaucuca

SEQ ID NO: 1462933 - RNA, 12 nt, Homo sapiens
uucuacuuuaag

SEQ ID NO: 1462934 - RNA, 21 nt, Homo sapiens
uucuagcucuauuuacuucua

SEQ ID NO: 1462935 - RNA, 21 nt, Homo sapiens
uucuauacaacaggcagugga

SEQ ID NO: 1462936 - RNA, 21 nt, Homo sapiens
uucuauaugaauuuaaauaua

SEQ ID NO: 1462937 - RNA, 18 nt, Homo sapiens
uucuauugccuucuuuga

SEQ ID NO: 1462938 - RNA, 14 nt, Homo sapiens
uucucaaaauuccu

SEQ ID NO: 1462939 - RNA, 21 nt, Homo sapiens
uucucagaaucucaaauaacu

SEQ ID NO: 1462940 - RNA, 22 nt, Homo sapiens
uucucagaccugcgcacuccau

SEQ ID NO: 1462941 - RNA, 23 nt, Homo sapiens
uucucauaauuccuacagcacua

SEQ ID NO: 1462942 - RNA, 14 nt, Homo sapiens
uucucaucccacgc

SEQ ID NO: 1462943 - RNA, 18 nt, Homo sapiens
uucucauuacccacccga

SEQ ID NO: 1462944 - RNA, 17 nt, Homo sapiens
uucucauucguggcaug

SEQ ID NO: 1462945 - RNA, 17 nt, Homo sapiens
uucucauuuguucucac

SEQ ID NO: 1462946 - RNA, 17 nt, Homo sapiens
uucuccucguccaucag

SEQ ID NO: 1462947 - RNA, 14 nt, Homo sapiens
uucuccuugaauau

SEQ ID NO: 1462948 - RNA, 13 nt, Homo sapiens
uucaaacugugaa

SEQ ID NO: 1462949 - RNA, 22 nt, Homo sapiens
uucaaacugugaagcauuuaca

SEQ ID NO: 1462950 - RNA, 12 nt, Homo sapiens
uucaaacuuaaa

SEQ ID NO: 1462951 - RNA, 13 nt, Homo sapiens
uucaaagcacaga

SEQ ID NO: 1462952 - RNA, 22 nt, Homo sapiens
uucaaauacaaaguaaauacaa

SEQ ID NO: 1462953 - RNA, 22 nt, Homo sapiens
uucaaaucacauggaacuuuag

SEQ ID NO: 1462954 - RNA, 12 nt, Homo sapiens
uucaaaugaaac

SEQ ID NO: 1462955 - RNA, 20 nt, Homo sapiens
uucaacaaccggccaccaga

SEQ ID NO: 1462956 - RNA, 19 nt, Homo sapiens
uucaacaguuuuugcuaau

SEQ ID NO: 1462957 - RNA, 18 nt, Homo sapiens
uucaacccagccaugcaa

SEQ ID NO: 1462958 - RNA, 15 nt, Homo sapiens
uucaaccucauugac

SEQ ID NO: 1462959 - RNA, 23 nt, Homo sapiens
uucaagaagugccaguugaucaa

SEQ ID NO: 1462960 - RNA, 12 nt, Homo sapiens
uucaagauccuc

SEQ ID NO: 1462961 - RNA, 16 nt, Homo sapiens
uucaagccuuagauaa

SEQ ID NO: 1462962 - RNA, 16 nt, Homo sapiens
uucaaguaauugugaa

SEQ ID NO: 1462963 - RNA, 22 nt, Homo sapiens
uucaagugauucuccugccuca

SEQ ID NO: 1462964 - RNA, 22 nt, Homo sapiens
uucaauaaacuuuuuuugucug

SEQ ID NO: 1462965 - RNA, 17 nt, Homo sapiens
uucaauagcauaucaca

SEQ ID NO: 1462966 - RNA, 16 nt, Homo sapiens
uucaaucauaauaccu

SEQ ID NO: 1462967 - RNA, 14 nt, Homo sapiens
uucaauccuacuuu

SEQ ID NO: 1462968 - RNA, 12 nt, Homo sapiens
uucaaucucuug

SEQ ID NO: 1462969 - RNA, 14 nt, Homo sapiens
uucaaugaaccaca

SEQ ID NO: 1462970 - RNA, 10 nt, Homo sapiens
uucaaugagg

SEQ ID NO: 1462971 - RNA, 16 nt, Homo sapiens
uucacacuguccccca

SEQ ID NO: 1462972 - RNA, 12 nt, Homo sapiens
uucacacuuuuu

SEQ ID NO: 1462973 - RNA, 16 nt, Homo sapiens
uucacaggcacuccug

SEQ ID NO: 1462974 - RNA, 21 nt, Homo sapiens
uucacaguucuuugggccaga

SEQ ID NO: 1462975 - RNA, 17 nt, Homo sapiens
uucacauugaaacccag

SEQ ID NO: 1462976 - RNA, 21 nt, Homo sapiens
uucaccaaaauagucuucuca

SEQ ID NO: 1462977 - RNA, 15 nt, Homo sapiens
uucaccagagcauuu

SEQ ID NO: 1462978 - RNA, 18 nt, Homo sapiens
uucaccagagcauuucca

SEQ ID NO: 1462979 - RNA, 14 nt, Homo sapiens
uucaccucuaucca

SEQ ID NO: 1462980 - RNA, 15 nt, Homo sapiens
uucacgccauucucc

SEQ ID NO: 1462981 - RNA, 20 nt, Homo sapiens
uucacuccagccugggugac

SEQ ID NO: 1462982 - RNA, 18 nt, Homo sapiens
uucacugaaggugauuca

SEQ ID NO: 1462983 - RNA, 18 nt, Homo sapiens
uucacugagcuccccaga

SEQ ID NO: 1462984 - RNA, 19 nt, Homo sapiens
uucacugagcuccccagau

SEQ ID NO: 1462985 - RNA, 16 nt, Homo sapiens
uucacugcgaagaccc

SEQ ID NO: 1462986 - RNA, 14 nt, Homo sapiens
uucacuuuacaaau

SEQ ID NO: 1462987 - RNA, 17 nt, Homo sapiens
uucagaaauauaugcag

SEQ ID NO: 1462988 - RNA, 15 nt, Homo sapiens
uucagaagacacugc

SEQ ID NO: 1462989 - RNA, 24 nt, Homo sapiens
uucagaagcuagugaccaucuuca

SEQ ID NO: 1462990 - RNA, 23 nt, Homo sapiens
uucagaauguacggaaagaugau

SEQ ID NO: 1462991 - RNA, 13 nt, Homo sapiens
uucagacacuacc

SEQ ID NO: 1462992 - RNA, 17 nt, Homo sapiens
uucagacacuaccccau

SEQ ID NO: 1462993 - RNA, 17 nt, Homo sapiens
uucagagccaagccuua

SEQ ID NO: 1462994 - RNA, 19 nt, Homo sapiens
uucagagccaagccuuaaa

SEQ ID NO: 1462995 - RNA, 16 nt, Homo sapiens
uucagauacaaacugc

SEQ ID NO: 1462996 - RNA, 19 nt, Homo sapiens
uucagauauauuuuucaca

SEQ ID NO: 1462997 - RNA, 12 nt, Homo sapiens
uucagauauuau

SEQ ID NO: 1462998 - RNA, 19 nt, Homo sapiens
uucagauauuauugcuuua

SEQ ID NO: 1462999 - RNA, 15 nt, Homo sapiens
uucagauauuccagg

SEQ ID NO: 1463000 - RNA, 20 nt, Homo sapiens
uucagaugcuguuaguaccu

SEQ ID NO: 1463001 - RNA, 22 nt, Homo sapiens
uucagauuuuaaaaagucuuca

SEQ ID NO: 1463002 - RNA, 22 nt, Homo sapiens
uucagcacugucccuugccuca

SEQ ID NO: 1463003 - RNA, 21 nt, Homo sapiens
uucagcauccgcaggugcugg

SEQ ID NO: 1463004 - RNA, 20 nt, Homo sapiens
uucagcucagcuaaugaagu

SEQ ID NO: 1463005 - RNA, 19 nt, Homo sapiens
uucagcuucuaugcauuaa

SEQ ID NO: 1463006 - RNA, 17 nt, Homo sapiens
uucaggaagaugaaaga

SEQ ID NO: 1463007 - RNA, 16 nt, Homo sapiens
uucagugauguggggu

SEQ ID NO: 1463008 - RNA, 13 nt, Homo sapiens
uucagugcuucuu

SEQ ID NO: 1463009 - RNA, 16 nt, Homo sapiens
uucaguguacauggaa

SEQ ID NO: 1463010 - RNA, 21 nt, Homo sapiens
uucaguucagauaauuggcaa

SEQ ID NO: 1463011 - RNA, 23 nt, Homo sapiens
uucauaauuaaaauuuaucuuaa

SEQ ID NO: 1463012 - RNA, 17 nt, Homo sapiens
uucauaguaauuucacu

SEQ ID NO: 1463013 - RNA, 15 nt, Homo sapiens
uucauaugcuguaua

SEQ ID NO: 1463014 - RNA, 23 nt, Homo sapiens
uucauccaggccugccaagguga

SEQ ID NO: 1463015 - RNA, 14 nt, Homo sapiens
uucaucuaauguga

SEQ ID NO: 1463016 - RNA, 13 nt, Homo sapiens
uucaugaaacugu

SEQ ID NO: 1463017 - RNA, 15 nt, Homo sapiens
uucaugagcauucau

SEQ ID NO: 1463018 - RNA, 17 nt, Homo sapiens
uucaugagcuugaacaa

SEQ ID NO: 1463019 - RNA, 18 nt, Homo sapiens
uucaugagcuugaacaag

SEQ ID NO: 1463020 - RNA, 14 nt, Homo sapiens
uucaugcagccuaa

SEQ ID NO: 1463021 - RNA, 13 nt, Homo sapiens
uucaugccuuuca

SEQ ID NO: 1463022 - RNA, 14 nt, Homo sapiens
uuacauaucaccuc

SEQ ID NO: 1463023 - RNA, 14 nt, Homo sapiens
uuacauuguucaau

SEQ ID NO: 1463024 - RNA, 21 nt, Homo sapiens
uuacauuuuuugggcagcaau

SEQ ID NO: 1463025 - RNA, 22 nt, Homo sapiens
uuaccaggaagcagauacauau

SEQ ID NO: 1463026 - RNA, 15 nt, Homo sapiens
uuaccaggugagaag

SEQ ID NO: 1463027 - RNA, 15 nt, Homo sapiens
uuaccccucacaauc

SEQ ID NO: 1463028 - RNA, 20 nt, Homo sapiens
uuaccgccugucucuuuaag

SEQ ID NO: 1463029 - RNA, 14 nt, Homo sapiens
uuaccuaaacagau

SEQ ID NO: 1463030 - RNA, 21 nt, Homo sapiens
uuaccuagauuuacagccuca

SEQ ID NO: 1463031 - RNA, 14 nt, Homo sapiens
uuacgcccaucuca

SEQ ID NO: 1463032 - RNA, 14 nt, Homo sapiens
uuacuaaaaacaca

SEQ ID NO: 1463033 - RNA, 22 nt, Homo sapiens
uuacuaaagguuuuaaccgcac

SEQ ID NO: 1463034 - RNA, 21 nt, Homo sapiens
uuacuaagcuuugccagcugc

SEQ ID NO: 1463035 - RNA, 21 nt, Homo sapiens
uuacuauucuguaucauugau

SEQ ID NO: 1463036 - RNA, 21 nt, Homo sapiens
uuacucaugugcagguuuuga

SEQ ID NO: 1463037 - RNA, 20 nt, Homo sapiens
uuacugagcuucucugugaa

SEQ ID NO: 1463038 - RNA, 12 nt, Homo sapiens
uuacugcuugac

SEQ ID NO: 1463039 - RNA, 17 nt, Homo sapiens
uuagaaacacugcaaau

SEQ ID NO: 1463040 - RNA, 16 nt, Homo sapiens
uuagaaauacugcaag

SEQ ID NO: 1463041 - RNA, 15 nt, Homo sapiens
uuagaaauugcauuu

SEQ ID NO: 1463042 - RNA, 12 nt, Homo sapiens
uuagaacuauua

SEQ ID NO: 1463043 - RNA, 14 nt, Homo sapiens
uuagaauacaguuu

SEQ ID NO: 1463044 - RNA, 21 nt, Homo sapiens
uuagaauaguguucugcaaaa

SEQ ID NO: 1463045 - RNA, 16 nt, Homo sapiens
uuagaauguugaaaag

SEQ ID NO: 1463046 - RNA, 18 nt, Homo sapiens
uuagacguccuccgucca

SEQ ID NO: 1463047 - RNA, 23 nt, Homo sapiens
uuagagaauuuccuuacucuuga

SEQ ID NO: 1463048 - RNA, 12 nt, Homo sapiens
uuagcagacagg

SEQ ID NO: 1463049 - RNA, 21 nt, Homo sapiens
uuagcauguaugacaagacaa

SEQ ID NO: 1463050 - RNA, 21 nt, Homo sapiens
uuagcauuuuucaaaugaucu

SEQ ID NO: 1463051 - RNA, 21 nt, Homo sapiens
uuagcccuguguccugaguua

SEQ ID NO: 1463052 - RNA, 22 nt, Homo sapiens
uuagcuuccugccccagacaga

SEQ ID NO: 1463053 - RNA, 14 nt, Homo sapiens
uuaggagaaaccag

SEQ ID NO: 1463054 - RNA, 23 nt, Homo sapiens
uuaggauuuaacagucauuuaaa

SEQ ID NO: 1463055 - RNA, 16 nt, Homo sapiens
uuaggcaccagaagaa

SEQ ID NO: 1463056 - RNA, 12 nt, Homo sapiens
uuaguaauuucu

SEQ ID NO: 1463057 - RNA, 16 nt, Homo sapiens
uuaguaauuucuugcu

SEQ ID NO: 1463058 - RNA, 14 nt, Homo sapiens
uuaguauaaguaca

SEQ ID NO: 1463059 - RNA, 21 nt, Homo sapiens
uuaguauuaauacuacccaua

SEQ ID NO: 1463060 - RNA, 11 nt, Homo sapiens
uuaguauuuau

SEQ ID NO: 1463061 - RNA, 16 nt, Homo sapiens
uuaguauuuuaauccu

SEQ ID NO: 1463062 - RNA, 11 nt, Homo sapiens
uuagucuccca

SEQ ID NO: 1463063 - RNA, 19 nt, Homo sapiens
uuagucuuaauguacacau

SEQ ID NO: 1463064 - RNA, 20 nt, Homo sapiens
uuaguuuacaauauuaugaa

SEQ ID NO: 1463065 - RNA, 20 nt, Homo sapiens
uuaguuuacaaucagccaca

SEQ ID NO: 1463066 - RNA, 21 nt, Homo sapiens
uuauaaacuuuagaguagcau

SEQ ID NO: 1463067 - RNA, 12 nt, Homo sapiens
uuauaaauauca

SEQ ID NO: 1463068 - RNA, 13 nt, Homo sapiens
uuauaacaagugu

SEQ ID NO: 1463069 - RNA, 14 nt, Homo sapiens
uuauaacagaauua

SEQ ID NO: 1463070 - RNA, 17 nt, Homo sapiens
uuauaagacuacuauac

SEQ ID NO: 1463071 - RNA, 14 nt, Homo sapiens
uuauaagacuggaa

SEQ ID NO: 1463072 - RNA, 13 nt, Homo sapiens
uuauaaguucaca

SEQ ID NO: 1463073 - RNA, 21 nt, Homo sapiens
uuauaauucuugaaugaggca

SEQ ID NO: 1463074 - RNA, 14 nt, Homo sapiens
uuauaauugcaucu

SEQ ID NO: 1463075 - RNA, 15 nt, Homo sapiens
uuauacacaguggau

SEQ ID NO: 1463076 - RNA, 16 nt, Homo sapiens
uuauacgcuggcaaca

SEQ ID NO: 1463077 - RNA, 16 nt, Homo sapiens
uuauauauaaagaagg

SEQ ID NO: 1463078 - RNA, 13 nt, Homo sapiens
uuauaucaugcaa

SEQ ID NO: 1463079 - RNA, 20 nt, Homo sapiens
uuauaucuaaaucuguccaa

SEQ ID NO: 1463080 - RNA, 22 nt, Homo sapiens
uuauauguggacuaaauaucug

SEQ ID NO: 1463081 - RNA, 17 nt, Homo sapiens
uuauauuaauguacuug

SEQ ID NO: 1463082 - RNA, 23 nt, Homo sapiens
uuauauuuccaagaaauauuccu

SEQ ID NO: 1463083 - RNA, 14 nt, Homo sapiens
uuauauuuggccca

SEQ ID NO: 1463084 - RNA, 20 nt, Homo sapiens
uuaucacuucauucacauuc

SEQ ID NO: 1463085 - RNA, 14 nt, Homo sapiens
uuaucagucauaac

SEQ ID NO: 1463086 - RNA, 21 nt, Homo sapiens
uuauccaccaagaacauaaga

SEQ ID NO: 1463087 - RNA, 18 nt, Homo sapiens
uuaucuacaaacacugca

SEQ ID NO: 1463088 - RNA, 12 nt, Homo sapiens
uuaucugcuaug

SEQ ID NO: 1463089 - RNA, 20 nt, Homo sapiens
uuaucugugcgugaaacaca

SEQ ID NO: 1463090 - RNA, 21 nt, Homo sapiens
uuaucugugucaaaagccaga

SEQ ID NO: 1463091 - RNA, 13 nt, Homo sapiens
uuaucuucacuuu

SEQ ID NO: 1463092 - RNA, 20 nt, Homo sapiens
uuaucuugcaccccaaagcu

SEQ ID NO: 1463093 - RNA, 15 nt, Homo sapiens
uuaucuuggacugac

SEQ ID NO: 1463094 - RNA, 13 nt, Homo sapiens
uuaucuugggaua

SEQ ID NO: 1463095 - RNA, 17 nt, Homo sapiens
ugugagggacaugcuca

SEQ ID NO: 1463096 - RNA, 12 nt, Homo sapiens
ugugauaugauu

SEQ ID NO: 1463097 - RNA, 15 nt, Homo sapiens
ugugauuacaaggcu

SEQ ID NO: 1463098 - RNA, 17 nt, Homo sapiens
ugugauugcacagaauu

SEQ ID NO: 1463099 - RNA, 16 nt, Homo sapiens
ugugcacgagugggaa

SEQ ID NO: 1463100 - RNA, 23 nt, Homo sapiens
ugugcacuuucuucucuuuccca

SEQ ID NO: 1463101 - RNA, 21 nt, Homo sapiens
ugugcaguguugacaguucau

SEQ ID NO: 1463102 - RNA, 21 nt, Homo sapiens
ugugcugcagcucccauuuca

SEQ ID NO: 1463103 - RNA, 11 nt, Homo sapiens
ugugcugccau

SEQ ID NO: 1463104 - RNA, 12 nt, Homo sapiens
uguggacacugc

SEQ ID NO: 1463105 - RNA, 17 nt, Homo sapiens
uguggacuaaauaucug

SEQ ID NO: 1463106 - RNA, 16 nt, Homo sapiens
uguggaggauugcuau

SEQ ID NO: 1463107 - RNA, 20 nt, Homo sapiens
uguggaggcuaucaacaaag

SEQ ID NO: 1463108 - RNA, 21 nt, Homo sapiens
uguggcacucagggagcauuu

SEQ ID NO: 1463109 - RNA, 13 nt, Homo sapiens
uguggcagagcca

SEQ ID NO: 1463110 - RNA, 14 nt, Homo sapiens
uguggcccaagaca

SEQ ID NO: 1463111 - RNA, 18 nt, Homo sapiens
uguggcuucccaugucuu

SEQ ID NO: 1463112 - RNA, 17 nt, Homo sapiens
ugugggagccugcaaac

SEQ ID NO: 1463113 - RNA, 18 nt, Homo sapiens
uguggguuugguccuuga

SEQ ID NO: 1463114 - RNA, 21 nt, Homo sapiens
uguggucaauccgaaguauga

SEQ ID NO: 1463115 - RNA, 14 nt, Homo sapiens
uguggucauccugc

SEQ ID NO: 1463116 - RNA, 15 nt, Homo sapiens
uguggucauccugcc

SEQ ID NO: 1463117 - RNA, 18 nt, Homo sapiens
ugugguggccucagcuga

SEQ ID NO: 1463118 - RNA, 20 nt, Homo sapiens
ugugguuaacaucucagaaa

SEQ ID NO: 1463119 - RNA, 14 nt, Homo sapiens
ugugguuccucugc

SEQ ID NO: 1463120 - RNA, 15 nt, Homo sapiens
ugugguuuacgugua

SEQ ID NO: 1463121 - RNA, 22 nt, Homo sapiens
uguguaacuguaaaacauugaa

SEQ ID NO: 1463122 - RNA, 13 nt, Homo sapiens
ugugucauguaua

SEQ ID NO: 1463123 - RNA, 22 nt, Homo sapiens
uguguccccucacucugucagc

SEQ ID NO: 1463124 - RNA, 13 nt, Homo sapiens
ugugugacauucc

SEQ ID NO: 1463125 - RNA, 16 nt, Homo sapiens
uguguggcagagccag

SEQ ID NO: 1463126 - RNA, 12 nt, Homo sapiens
uguguguggcag

SEQ ID NO: 1463127 - RNA, 14 nt, Homo sapiens
uguguuaucucuua

SEQ ID NO: 1463128 - RNA, 22 nt, Homo sapiens
uguguucugucaccaacugaag

SEQ ID NO: 1463129 - RNA, 18 nt, Homo sapiens
uguguuguaauucuucag

SEQ ID NO: 1463130 - RNA, 14 nt, Homo sapiens
uguguugucuucag

SEQ ID NO: 1463131 - RNA, 19 nt, Homo sapiens
uguguuuauucauccagca

SEQ ID NO: 1463132 - RNA, 18 nt, Homo sapiens
uguuaacauggacaugau

SEQ ID NO: 1463133 - RNA, 23 nt, Homo sapiens
uguuaauucacagaauagcacaa

SEQ ID NO: 1463134 - RNA, 16 nt, Homo sapiens
uguuacucaguguuag

SEQ ID NO: 1463135 - RNA, 16 nt, Homo sapiens
uguuacucugguucuu

SEQ ID NO: 1463136 - RNA, 16 nt, Homo sapiens
uguuacugaucaugca

SEQ ID NO: 1463137 - RNA, 14 nt, Homo sapiens
uguuacuguaauuc

SEQ ID NO: 1463138 - RNA, 15 nt, Homo sapiens
uguuauaucagggaa

SEQ ID NO: 1463139 - RNA, 14 nt, Homo sapiens
uguuaucagucaua

SEQ ID NO: 1463140 - RNA, 12 nt, Homo sapiens
uguuaugugauc

SEQ ID NO: 1463141 - RNA, 15 nt, Homo sapiens
uguuauuuaacagcu

SEQ ID NO: 1463142 - RNA, 14 nt, Homo sapiens
uguuauuugcacac

SEQ ID NO: 1463143 - RNA, 22 nt, Homo sapiens
uguuauuugcacacugcacugu

SEQ ID NO: 1463144 - RNA, 22 nt, Homo sapiens
uguuccagauccuucaaagagu

SEQ ID NO: 1463145 - RNA, 22 nt, Homo sapiens
uguuccaugaaggcagagccau

SEQ ID NO: 1463146 - RNA, 14 nt, Homo sapiens
uguucccugacucc

SEQ ID NO: 1463147 - RNA, 18 nt, Homo sapiens
uguucccuuacuguuuca

SEQ ID NO: 1463148 - RNA, 17 nt, Homo sapiens
uguuccuggcugaugau

SEQ ID NO: 1463149 - RNA, 16 nt, Homo sapiens
uguucgacuaccuuuu

SEQ ID NO: 1463150 - RNA, 13 nt, Homo sapiens
uguucuacacuca

SEQ ID NO: 1463151 - RNA, 14 nt, Homo sapiens
uguucuauuguggg

SEQ ID NO: 1463152 - RNA, 19 nt, Homo sapiens
uguucuccggguguggccu

SEQ ID NO: 1463153 - RNA, 20 nt, Homo sapiens
uguucugacccugcuucaaa

SEQ ID NO: 1463154 - RNA, 13 nt, Homo sapiens
uguucugauuaga

SEQ ID NO: 1463155 - RNA, 17 nt, Homo sapiens
uguucuguauucugacc

SEQ ID NO: 1463156 - RNA, 18 nt, Homo sapiens
uguugaaucugagcugca

SEQ ID NO: 1463157 - RNA, 18 nt, Homo sapiens
uguugcaccaggcacugc

SEQ ID NO: 1463158 - RNA, 19 nt, Homo sapiens
uguugcaccaggcacugcu

SEQ ID NO: 1463159 - RNA, 21 nt, Homo sapiens
uguugcauuuacuuuuaauaa

SEQ ID NO: 1463160 - RNA, 11 nt, Homo sapiens
uguugccaaau

SEQ ID NO: 1463161 - RNA, 24 nt, Homo sapiens
uguugccacuggcaaauguaacug

SEQ ID NO: 1463162 - RNA, 18 nt, Homo sapiens
uguugccuaagcuggucu

SEQ ID NO: 1463163 - RNA, 15 nt, Homo sapiens
uguugcuuguaauca

SEQ ID NO: 1463164 - RNA, 21 nt, Homo sapiens
uguuguaaccugcugugauac

SEQ ID NO: 1463165 - RNA, 20 nt, Homo sapiens
uguuguaucaaagugugaua

SEQ ID NO: 1463166 - RNA, 19 nt, Homo sapiens
uguuuaagaaaaaauaaca

SEQ ID NO: 1463167 - RNA, 14 nt, Homo sapiens
uguagaacugagaa

SEQ ID NO: 1463168 - RNA, 20 nt, Homo sapiens
uguagaagaaagagcaacaa

SEQ ID NO: 1463169 - RNA, 21 nt, Homo sapiens
uguagaagacaaaauguucac

SEQ ID NO: 1463170 - RNA, 22 nt, Homo sapiens
uguagacuguggcuagugacaa

SEQ ID NO: 1463171 - RNA, 12 nt, Homo sapiens
uguagauauugu

SEQ ID NO: 1463172 - RNA, 17 nt, Homo sapiens
uguagauauugugaagu

SEQ ID NO: 1463173 - RNA, 17 nt, Homo sapiens
uguagaugacaaccucc

SEQ ID NO: 1463174 - RNA, 14 nt, Homo sapiens
uguagaugugauua

SEQ ID NO: 1463175 - RNA, 13 nt, Homo sapiens
uguagaugugcau

SEQ ID NO: 1463176 - RNA, 16 nt, Homo sapiens
uguagcguguuuacau

SEQ ID NO: 1463177 - RNA, 15 nt, Homo sapiens
uguagcugugucaug

SEQ ID NO: 1463178 - RNA, 16 nt, Homo sapiens
uguagcuucuucugaa

SEQ ID NO: 1463179 - RNA, 21 nt, Homo sapiens
uguaggcuggggcggggccca

SEQ ID NO: 1463180 - RNA, 15 nt, Homo sapiens
uguagguaauauugu

SEQ ID NO: 1463181 - RNA, 13 nt, Homo sapiens
uguaguacuccuu

SEQ ID NO: 1463182 - RNA, 21 nt, Homo sapiens
uguagucccagcuacuuggga

SEQ ID NO: 1463183 - RNA, 18 nt, Homo sapiens
uguaguccuagccacuca

SEQ ID NO: 1463184 - RNA, 21 nt, Homo sapiens
uguauaaccccaccuugccaa

SEQ ID NO: 1463185 - RNA, 21 nt, Homo sapiens
uguauauacaguuauuuugga

SEQ ID NO: 1463186 - RNA, 18 nt, Homo sapiens
uguauauuuuuauauugu

SEQ ID NO: 1463187 - RNA, 15 nt, Homo sapiens
uguaucaaguggcau

SEQ ID NO: 1463188 - RNA, 17 nt, Homo sapiens
uguaucauuugaacaac

SEQ ID NO: 1463189 - RNA, 18 nt, Homo sapiens
uguaucggagacagugau

SEQ ID NO: 1463190 - RNA, 15 nt, Homo sapiens
uguaucgggcaaaaa

SEQ ID NO: 1463191 - RNA, 16 nt, Homo sapiens
uguaucuuauucacau

SEQ ID NO: 1463192 - RNA, 23 nt, Homo sapiens
uguaugaguaucuguauguauau

SEQ ID NO: 1463193 - RNA, 16 nt, Homo sapiens
uguaugccaagugaga

SEQ ID NO: 1463194 - RNA, 23 nt, Homo sapiens
uguaugugagagauucugugauc

SEQ ID NO: 1463195 - RNA, 23 nt, Homo sapiens
uguauguuuacauaucaccucau

SEQ ID NO: 1463196 - RNA, 14 nt, Homo sapiens
uguauucauccaga

SEQ ID NO: 1463197 - RNA, 17 nt, Homo sapiens
uguauucuucaaccuca

SEQ ID NO: 1463198 - RNA, 18 nt, Homo sapiens
uguauucuucaaccucau

SEQ ID NO: 1463199 - RNA, 16 nt, Homo sapiens
uguauuguucccagug

SEQ ID NO: 1463200 - RNA, 16 nt, Homo sapiens
uguauuuugacacugg

SEQ ID NO: 1463201 - RNA, 15 nt, Homo sapiens
ugucaaaacaagacu

SEQ ID NO: 1463202 - RNA, 14 nt, Homo sapiens
ugucaaaagccaga

SEQ ID NO: 1463203 - RNA, 15 nt, Homo sapiens
ugucaaaagccagau

SEQ ID NO: 1463204 - RNA, 19 nt, Homo sapiens
ugucaauuucccucagguu

SEQ ID NO: 1463205 - RNA, 12 nt, Homo sapiens
ugucacaucucu

SEQ ID NO: 1463206 - RNA, 13 nt, Homo sapiens
ugucacauugcau

SEQ ID NO: 1463207 - RNA, 23 nt, Homo sapiens
ugucaccaacugaaguggcuaaa

SEQ ID NO: 1463208 - RNA, 14 nt, Homo sapiens
ugucaccaugccca

SEQ ID NO: 1463209 - RNA, 22 nt, Homo sapiens
ugucaccuacgugccacuccug

SEQ ID NO: 1463210 - RNA, 19 nt, Homo sapiens
ugucaccucuguuaagguu

SEQ ID NO: 1463211 - RNA, 22 nt, Homo sapiens
ugucacuacucacagucucuuu

SEQ ID NO: 1463212 - RNA, 16 nt, Homo sapiens
ugucacucugugccuu

SEQ ID NO: 1463213 - RNA, 23 nt, Homo sapiens
ugucacuucgcgugcccucgcug

SEQ ID NO: 1463214 - RNA, 21 nt, Homo sapiens
ugucagaaaccaguuauguga

SEQ ID NO: 1463215 - RNA, 15 nt, Homo sapiens
ugucagcaauuuaac

SEQ ID NO: 1463216 - RNA, 17 nt, Homo sapiens
ugucagcccaugugcac

SEQ ID NO: 1463217 - RNA, 16 nt, Homo sapiens
ugucagcuuccaaaca

SEQ ID NO: 1463218 - RNA, 16 nt, Homo sapiens
ugucaggaggcagaag

SEQ ID NO: 1463219 - RNA, 16 nt, Homo sapiens
ugucagugacaguauu

SEQ ID NO: 1463220 - RNA, 15 nt, Homo sapiens
ugucauagagcugca

SEQ ID NO: 1463221 - RNA, 15 nt, Homo sapiens
ugucaucugugcacu

SEQ ID NO: 1463222 - RNA, 23 nt, Homo sapiens
ugucaugucucugguggugcugg

SEQ ID NO: 1463223 - RNA, 22 nt, Homo sapiens
ugucauuaguauuucacaagaa

SEQ ID NO: 1463224 - RNA, 19 nt, Homo sapiens
ugucauuucauuccauugc

SEQ ID NO: 1463225 - RNA, 17 nt, Homo sapiens
uguccaaagaggcugcc

SEQ ID NO: 1463226 - RNA, 22 nt, Homo sapiens
ugucccaaaccagacaccugga

SEQ ID NO: 1463227 - RNA, 12 nt, Homo sapiens
ugucccagaugg

SEQ ID NO: 1463228 - RNA, 20 nt, Homo sapiens
uguccccaaaaugugaugcu

SEQ ID NO: 1463229 - RNA, 16 nt, Homo sapiens
uguccccuccacuguc

SEQ ID NO: 1463230 - RNA, 17 nt, Homo sapiens
uguccccuccacuguca

SEQ ID NO: 1463231 - RNA, 19 nt, Homo sapiens
uguccccucugcaugcccu

SEQ ID NO: 1463232 - RNA, 16 nt, Homo sapiens
ugucccucacuguuga

SEQ ID NO: 1463233 - RNA, 24 nt, Homo sapiens
ugucccugugggugaaacagaaca

SEQ ID NO: 1463234 - RNA, 16 nt, Homo sapiens
uguccuaaaaagacac

SEQ ID NO: 1463235 - RNA, 11 nt, Homo sapiens
uguccuaagca

SEQ ID NO: 1463236 - RNA, 22 nt, Homo sapiens
uguccucagccuugccagagau

SEQ ID NO: 1463237 - RNA, 13 nt, Homo sapiens
uguccuccaacac

SEQ ID NO: 1463238 - RNA, 14 nt, Homo sapiens
uaucaggggugcau

SEQ ID NO: 1463239 - RNA, 21 nt, Homo sapiens
uaucaucacauugagcugaua

SEQ ID NO: 1463240 - RNA, 11 nt, Homo sapiens
uaucaugcaaa

SEQ ID NO: 1463241 - RNA, 19 nt, Homo sapiens
uaucaugcccugugcaacc

SEQ ID NO: 1463242 - RNA, 15 nt, Homo sapiens
uaucaugugcacuuc

SEQ ID NO: 1463243 - RNA, 16 nt, Homo sapiens
uaucauuggaacaacu

SEQ ID NO: 1463244 - RNA, 15 nt, Homo sapiens
uauccaaaccaaaua

SEQ ID NO: 1463245 - RNA, 23 nt, Homo sapiens
uauccacagcuuacagcaauuug

SEQ ID NO: 1463246 - RNA, 17 nt, Homo sapiens
uauccaggacucuguca

SEQ ID NO: 1463247 - RNA, 16 nt, Homo sapiens
uauccauugaacuaaa

SEQ ID NO: 1463248 - RNA, 22 nt, Homo sapiens
uaucccccgccuuuaguucucc

SEQ ID NO: 1463249 - RNA, 15 nt, Homo sapiens
uauccgaacuuuaau

SEQ ID NO: 1463250 - RNA, 14 nt, Homo sapiens
uauccuuagcucac

SEQ ID NO: 1463251 - RNA, 22 nt, Homo sapiens
uauccuuccaaaaaauuaaaac

SEQ ID NO: 1463252 - RNA, 12 nt, Homo sapiens
uaucuacuacaa

SEQ ID NO: 1463253 - RNA, 23 nt, Homo sapiens
uaucuggcccucgacacucacca

SEQ ID NO: 1463254 - RNA, 15 nt, Homo sapiens
uaucugggauucuac

SEQ ID NO: 1463255 - RNA, 15 nt, Homo sapiens
uaucugucauauagu

SEQ ID NO: 1463256 - RNA, 20 nt, Homo sapiens
uaucuuccaaaugcaauuug

SEQ ID NO: 1463257 - RNA, 20 nt, Homo sapiens
uaucuuuauuaaucacuauu

SEQ ID NO: 1463258 - RNA, 18 nt, Homo sapiens
uaucuuucgauaaacaac

SEQ ID NO: 1463259 - RNA, 15 nt, Homo sapiens
uaugaaacugcacau

SEQ ID NO: 1463260 - RNA, 18 nt, Homo sapiens
uaugaaacugcacauugg

SEQ ID NO: 1463261 - RNA, 16 nt, Homo sapiens
uaugaaauccuugacu

SEQ ID NO: 1463262 - RNA, 13 nt, Homo sapiens
uaugaaaugaccu

SEQ ID NO: 1463263 - RNA, 15 nt, Homo sapiens
uaugaagaguauuaa

SEQ ID NO: 1463264 - RNA, 17 nt, Homo sapiens
uaugaaggaaucauucc

SEQ ID NO: 1463265 - RNA, 19 nt, Homo sapiens
uaugagcuugcucauuaau

SEQ ID NO: 1463266 - RNA, 12 nt, Homo sapiens
uaugagggaaaa

SEQ ID NO: 1463267 - RNA, 18 nt, Homo sapiens
uaugagggaaaaugagua

SEQ ID NO: 1463268 - RNA, 17 nt, Homo sapiens
uaugaguaguguggaau

SEQ ID NO: 1463269 - RNA, 21 nt, Homo sapiens
uaugagucggauacccuggag

SEQ ID NO: 1463270 - RNA, 12 nt, Homo sapiens
uaugaugcacuu

SEQ ID NO: 1463271 - RNA, 23 nt, Homo sapiens
uaugauguaaucucucugcagcu

SEQ ID NO: 1463272 - RNA, 17 nt, Homo sapiens
uaugauuguuucucaaa

SEQ ID NO: 1463273 - RNA, 15 nt, Homo sapiens
uaugcaaguuagggu

SEQ ID NO: 1463274 - RNA, 13 nt, Homo sapiens
uaugcaaucugag

SEQ ID NO: 1463275 - RNA, 16 nt, Homo sapiens
uaugcaauuagguuuu

SEQ ID NO: 1463276 - RNA, 14 nt, Homo sapiens
uaugcacauucacg

SEQ ID NO: 1463277 - RNA, 14 nt, Homo sapiens
uaugccuucacuuu

SEQ ID NO: 1463278 - RNA, 13 nt, Homo sapiens
uaugccuucuuau

SEQ ID NO: 1463279 - RNA, 18 nt, Homo sapiens
uaugcucagggucaauuu

SEQ ID NO: 1463280 - RNA, 15 nt, Homo sapiens
uaugcucauugaacu

SEQ ID NO: 1463281 - RNA, 18 nt, Homo sapiens
uaugcucauugaacuuua

SEQ ID NO: 1463282 - RNA, 19 nt, Homo sapiens
uaugcucauugaacuuuaa

SEQ ID NO: 1463283 - RNA, 22 nt, Homo sapiens
uaugcuggagauggacaacuca

SEQ ID NO: 1463284 - RNA, 12 nt, Homo sapiens
uaugcuggccag

SEQ ID NO: 1463285 - RNA, 14 nt, Homo sapiens
uauggcuccuccau

SEQ ID NO: 1463286 - RNA, 16 nt, Homo sapiens
uauggcuccuccauau

SEQ ID NO: 1463287 - RNA, 16 nt, Homo sapiens
uaugggcgugaaccac

SEQ ID NO: 1463288 - RNA, 20 nt, Homo sapiens
uaugguaaaaguuacuuauu

SEQ ID NO: 1463289 - RNA, 14 nt, Homo sapiens
uauguacaugagaa

SEQ ID NO: 1463290 - RNA, 19 nt, Homo sapiens
uauguaccauguacaugaa

SEQ ID NO: 1463291 - RNA, 16 nt, Homo sapiens
uauguagaugugcauu

SEQ ID NO: 1463292 - RNA, 22 nt, Homo sapiens
uauguauaaacauaaguugcau

SEQ ID NO: 1463293 - RNA, 14 nt, Homo sapiens
uauguauaucauuc

SEQ ID NO: 1463294 - RNA, 17 nt, Homo sapiens
uauguauaucauucuac

SEQ ID NO: 1463295 - RNA, 14 nt, Homo sapiens
uaugucguaaguca

SEQ ID NO: 1463296 - RNA, 22 nt, Homo sapiens
uaugugaaaaaaaugagacuua

SEQ ID NO: 1463297 - RNA, 16 nt, Homo sapiens
ucuucuacaaccagag

SEQ ID NO: 1463298 - RNA, 14 nt, Homo sapiens
ucuucuacugcuau

SEQ ID NO: 1463299 - RNA, 14 nt, Homo sapiens
ucuucuacuuuaag

SEQ ID NO: 1463300 - RNA, 14 nt, Homo sapiens
ucuucuauaucuga

SEQ ID NO: 1463301 - RNA, 14 nt, Homo sapiens
ucuucuccacugga

SEQ ID NO: 1463302 - RNA, 17 nt, Homo sapiens
ucuucuccuaugcauuu

SEQ ID NO: 1463303 - RNA, 18 nt, Homo sapiens
ucuucucuauuucuggau

SEQ ID NO: 1463304 - RNA, 22 nt, Homo sapiens
ucuucugaauauuuuaucuuuc

SEQ ID NO: 1463305 - RNA, 14 nt, Homo sapiens
ucuucuuacaugca

SEQ ID NO: 1463306 - RNA, 18 nt, Homo sapiens
ucuucuuuaagccauaga

SEQ ID NO: 1463307 - RNA, 21 nt, Homo sapiens
ucuugaaauuaagaaggcaaa

SEQ ID NO: 1463308 - RNA, 16 nt, Homo sapiens
ucuugaaguacuuaac

SEQ ID NO: 1463309 - RNA, 15 nt, Homo sapiens
ucuugaggccaggag

SEQ ID NO: 1463310 - RNA, 23 nt, Homo sapiens
ucuugaguauaagaaaugcauau

SEQ ID NO: 1463311 - RNA, 13 nt, Homo sapiens
ucuugcaccccaa

SEQ ID NO: 1463312 - RNA, 15 nt, Homo sapiens
ucuugccacauuucu

SEQ ID NO: 1463313 - RNA, 23 nt, Homo sapiens
ucuugccuaaggugcguagucca

SEQ ID NO: 1463314 - RNA, 14 nt, Homo sapiens
ucuugcucugccac

SEQ ID NO: 1463315 - RNA, 19 nt, Homo sapiens
ucuugcucugccacccagg

SEQ ID NO: 1463316 - RNA, 19 nt, Homo sapiens
ucuugcuuucuaugcuguu

SEQ ID NO: 1463317 - RNA, 20 nt, Homo sapiens
ucuuggccggauguccucag

SEQ ID NO: 1463318 - RNA, 20 nt, Homo sapiens
ucuugggacccccacuaaga

SEQ ID NO: 1463319 - RNA, 21 nt, Homo sapiens
ucuugggcccaggacuguuga

SEQ ID NO: 1463320 - RNA, 24 nt, Homo sapiens
ucuugggggguuuuuacuccagug

SEQ ID NO: 1463321 - RNA, 15 nt, Homo sapiens
ucuugguacuacuag

SEQ ID NO: 1463322 - RNA, 17 nt, Homo sapiens
ucuuggugaacacacau

SEQ ID NO: 1463323 - RNA, 16 nt, Homo sapiens
ucuuggugcucugugu

SEQ ID NO: 1463324 - RNA, 22 nt, Homo sapiens
ucuuguaagucaucuacuuaau

SEQ ID NO: 1463325 - RNA, 17 nt, Homo sapiens
ucuuguauacacauaua

SEQ ID NO: 1463326 - RNA, 17 nt, Homo sapiens
ucuugucauugccagcu

SEQ ID NO: 1463327 - RNA, 12 nt, Homo sapiens
ucuuguggucau

SEQ ID NO: 1463328 - RNA, 20 nt, Homo sapiens
ucuuguggucaucauggcca

SEQ ID NO: 1463329 - RNA, 17 nt, Homo sapiens
ucuuguuccccacugac

SEQ ID NO: 1463330 - RNA, 12 nt, Homo sapiens
ucuuuaccugag

SEQ ID NO: 1463331 - RNA, 23 nt, Homo sapiens
ucuuuaguauaauugaccuacuu

SEQ ID NO: 1463332 - RNA, 13 nt, Homo sapiens
ucuuuauacagcu

SEQ ID NO: 1463333 - RNA, 24 nt, Homo sapiens
uggggcaggcugggccauguccaa

SEQ ID NO: 1463334 - RNA, 22 nt, Homo sapiens
uggggcaggucacuuuaccucu

SEQ ID NO: 1463335 - RNA, 18 nt, Homo sapiens
uggggcgagcacugugag

SEQ ID NO: 1463336 - RNA, 10 nt, Homo sapiens
uggggcuccu

SEQ ID NO: 1463337 - RNA, 21 nt, Homo sapiens
ugggggacugggagucagagc

SEQ ID NO: 1463338 - RNA, 16 nt, Homo sapiens
ugggggcugugauauu

SEQ ID NO: 1463339 - RNA, 12 nt, Homo sapiens
uggggucacuca

SEQ ID NO: 1463340 - RNA, 15 nt, Homo sapiens
uggggucuuuuuaug

SEQ ID NO: 1463341 - RNA, 21 nt, Homo sapiens
uggggucuuuuuaugcauuug

SEQ ID NO: 1463342 - RNA, 21 nt, Homo sapiens
uggggugcugccugaauccau

SEQ ID NO: 1463343 - RNA, 23 nt, Homo sapiens
uggggugucaauaaagcugugcu

SEQ ID NO: 1463344 - RNA, 17 nt, Homo sapiens
ugggguuucaccaucuu

SEQ ID NO: 1463345 - RNA, 21 nt, Homo sapiens
uggguaaugugaaggcccaag

SEQ ID NO: 1463346 - RNA, 23 nt, Homo sapiens
uggguacugaaagccuuagggaa

SEQ ID NO: 1463347 - RNA, 15 nt, Homo sapiens
ugggucuucccugua

SEQ ID NO: 1463348 - RNA, 21 nt, Homo sapiens
ugggucuucccuguaugauuc

SEQ ID NO: 1463349 - RNA, 16 nt, Homo sapiens
uggguggaaaggugug

SEQ ID NO: 1463350 - RNA, 21 nt, Homo sapiens
uggguguuucaguuugaaaau

SEQ ID NO: 1463351 - RNA, 13 nt, Homo sapiens
uggguuauuucaa

SEQ ID NO: 1463352 - RNA, 12 nt, Homo sapiens
uggguuccagag

SEQ ID NO: 1463353 - RNA, 20 nt, Homo sapiens
ugguaaaacucacugugauc

SEQ ID NO: 1463354 - RNA, 23 nt, Homo sapiens
ugguaacuuuuuuuuaaagcuca

SEQ ID NO: 1463355 - RNA, 23 nt, Homo sapiens
ugguaagaaaaagcaaaaggcau

SEQ ID NO: 1463356 - RNA, 14 nt, Homo sapiens
ugguaagcaccagg

SEQ ID NO: 1463357 - RNA, 14 nt, Homo sapiens
ugguacagcacugu

SEQ ID NO: 1463358 - RNA, 19 nt, Homo sapiens
ugguaccagaggaugguga

SEQ ID NO: 1463359 - RNA, 21 nt, Homo sapiens
ugguacugacuuugcuugcuu

SEQ ID NO: 1463360 - RNA, 15 nt, Homo sapiens
ugguaggcauuuccu

SEQ ID NO: 1463361 - RNA, 19 nt, Homo sapiens
ugguaguggaauagugaau

SEQ ID NO: 1463362 - RNA, 17 nt, Homo sapiens
ugguauauucagucucu

SEQ ID NO: 1463363 - RNA, 18 nt, Homo sapiens
uggucacuucuucugucc

SEQ ID NO: 1463364 - RNA, 12 nt, Homo sapiens
uggucagaugau

SEQ ID NO: 1463365 - RNA, 23 nt, Homo sapiens
uggucaguaaauaacaggcauuu

SEQ ID NO: 1463366 - RNA, 15 nt, Homo sapiens
uggucauccaaacuc

SEQ ID NO: 1463367 - RNA, 14 nt, Homo sapiens
ugguccaggguuga

SEQ ID NO: 1463368 - RNA, 20 nt, Homo sapiens
uggucccggggccagcacuu

SEQ ID NO: 1463369 - RNA, 17 nt, Homo sapiens
ugguccuuccuaccucu

SEQ ID NO: 1463370 - RNA, 14 nt, Homo sapiens
ugguccuugaacaa

SEQ ID NO: 1463371 - RNA, 16 nt, Homo sapiens
uggucgagugacacac

SEQ ID NO: 1463372 - RNA, 15 nt, Homo sapiens
uggucugccagaaua

SEQ ID NO: 1463373 - RNA, 13 nt, Homo sapiens
uggucuggccacu

SEQ ID NO: 1463374 - RNA, 17 nt, Homo sapiens
uggucuguuugacuuua

SEQ ID NO: 1463375 - RNA, 20 nt, Homo sapiens
uggucuuuccuaucauggag

SEQ ID NO: 1463376 - RNA, 22 nt, Homo sapiens
uggucuuuguaucuuccauauu

SEQ ID NO: 1463377 - RNA, 16 nt, Homo sapiens
uggugaaagcugagaa

SEQ ID NO: 1463378 - RNA, 12 nt, Homo sapiens
uggugcagacag

SEQ ID NO: 1463379 - RNA, 20 nt, Homo sapiens
uggugccaccagccuuccug

SEQ ID NO: 1463380 - RNA, 15 nt, Homo sapiens
uggugccccacagcu

SEQ ID NO: 1463381 - RNA, 19 nt, Homo sapiens
uggugccccaggaccagcu

SEQ ID NO: 1463382 - RNA, 22 nt, Homo sapiens
uggugccccaggaccagcucag

SEQ ID NO: 1463383 - RNA, 24 nt, Homo sapiens
ugguggaguguagccuccaccuga

SEQ ID NO: 1463384 - RNA, 17 nt, Homo sapiens
ugguggcaaauaucuca

SEQ ID NO: 1463385 - RNA, 18 nt, Homo sapiens
ugguggcagauuuuacaa

SEQ ID NO: 1463386 - RNA, 19 nt, Homo sapiens
ugguggcucacgccuguaa

SEQ ID NO: 1463387 - RNA, 19 nt, Homo sapiens
ugguggcucaugccuguaa

SEQ ID NO: 1463388 - RNA, 16 nt, Homo sapiens
ugguggguucagggga

SEQ ID NO: 1463389 - RNA, 14 nt, Homo sapiens
uggugucaguaucc

SEQ ID NO: 1463390 - RNA, 13 nt, Homo sapiens
uggugugaucucg

SEQ ID NO: 1463391 - RNA, 15 nt, Homo sapiens
uggugugauugcaca

SEQ ID NO: 1463392 - RNA, 17 nt, Homo sapiens
uggugugauugcacaga

SEQ ID NO: 1463393 - RNA, 17 nt, Homo sapiens
ugguguggccagcacuc

SEQ ID NO: 1463394 - RNA, 21 nt, Homo sapiens
ugguguggccagcacucugaa

SEQ ID NO: 1463395 - RNA, 19 nt, Homo sapiens
ugguguucaaaaaaacacu

SEQ ID NO: 1463396 - RNA, 20 nt, Homo sapiens
ugguuaggcagcaagcuuug

SEQ ID NO: 1463397 - RNA, 13 nt, Homo sapiens
ugguuaugaaaga

SEQ ID NO: 1463398 - RNA, 19 nt, Homo sapiens
ugguuauucuaagcccuuu

SEQ ID NO: 1463399 - RNA, 17 nt, Homo sapiens
ugguucuuagaccucaa

SEQ ID NO: 1463400 - RNA, 19 nt, Homo sapiens
ugguuuacauuuaaagcau

SEQ ID NO: 1463401 - RNA, 21 nt, Homo sapiens
ugguuuacauuuaaagcauug

SEQ ID NO: 1463402 - RNA, 22 nt, Homo sapiens
ugguuuaccuggggauccaauu

SEQ ID NO: 1463403 - RNA, 18 nt, Homo sapiens
ucugccaccacaccuggc

SEQ ID NO: 1463404 - RNA, 16 nt, Homo sapiens
ucugccagaagauccc

SEQ ID NO: 1463405 - RNA, 16 nt, Homo sapiens
ucugccagaauacugg

SEQ ID NO: 1463406 - RNA, 14 nt, Homo sapiens
ucugccagaccuua

SEQ ID NO: 1463407 - RNA, 13 nt, Homo sapiens
ucugccccagaua

SEQ ID NO: 1463408 - RNA, 21 nt, Homo sapiens
ucugcccgcuccauggaaaag

SEQ ID NO: 1463409 - RNA, 19 nt, Homo sapiens
ucugcccuguguacuuccc

SEQ ID NO: 1463410 - RNA, 18 nt, Homo sapiens
ucugcccuuuccuaggcc

SEQ ID NO: 1463411 - RNA, 16 nt, Homo sapiens
ucugccgcuaccuccc

SEQ ID NO: 1463412 - RNA, 20 nt, Homo sapiens
ucugccuuaaaaccaaagag

SEQ ID NO: 1463413 - RNA, 13 nt, Homo sapiens
ucugccuucaggc

SEQ ID NO: 1463414 - RNA, 22 nt, Homo sapiens
ucugcuaauucgagucauggcu

SEQ ID NO: 1463415 - RNA, 13 nt, Homo sapiens
ucugcuaugcuau

SEQ ID NO: 1463416 - RNA, 10 nt, Homo sapiens
ucugcuccac

SEQ ID NO: 1463417 - RNA, 17 nt, Homo sapiens
ucugcuccugaagcccu

SEQ ID NO: 1463418 - RNA, 19 nt, Homo sapiens
ucugcuugcucuuguccua

SEQ ID NO: 1463419 - RNA, 12 nt, Homo sapiens
ucugcuugucaa

SEQ ID NO: 1463420 - RNA, 23 nt, Homo sapiens
ucugcuuuuuaaagaaugcucuu

SEQ ID NO: 1463421 - RNA, 22 nt, Homo sapiens
ucuggaaagaggcucuggacag

SEQ ID NO: 1463422 - RNA, 15 nt, Homo sapiens
ucuggaaggacaucu

SEQ ID NO: 1463423 - RNA, 14 nt, Homo sapiens
ucuggaagucaucu

SEQ ID NO: 1463424 - RNA, 13 nt, Homo sapiens
ucuggaaucugga

SEQ ID NO: 1463425 - RNA, 15 nt, Homo sapiens
ucuggaaugcacuga

SEQ ID NO: 1463426 - RNA, 14 nt, Homo sapiens
ucuggaauugcuca

SEQ ID NO: 1463427 - RNA, 15 nt, Homo sapiens
ucuggaccccaaaga

SEQ ID NO: 1463428 - RNA, 16 nt, Homo sapiens
ucuggaggucucugaa

SEQ ID NO: 1463429 - RNA, 20 nt, Homo sapiens
ucuggcagccucccauccag

SEQ ID NO: 1463430 - RNA, 18 nt, Homo sapiens
ucuggccaaaagcaguaa

SEQ ID NO: 1463431 - RNA, 17 nt, Homo sapiens
ucuggccggagcugccu

SEQ ID NO: 1463432 - RNA, 21 nt, Homo sapiens
ucuggcucagggucaaagaca

SEQ ID NO: 1463433 - RNA, 19 nt, Homo sapiens
ucuggcugccccaaccugc

SEQ ID NO: 1463434 - RNA, 20 nt, Homo sapiens
ucugggauucccaccaaggu

SEQ ID NO: 1463435 - RNA, 21 nt, Homo sapiens
ucuggggccuuuaucaaaaaa

SEQ ID NO: 1463436 - RNA, 23 nt, Homo sapiens
ucugggggaaaaagccauaucau

SEQ ID NO: 1463437 - RNA, 15 nt, Homo sapiens
ucugggugaccucac

SEQ ID NO: 1463438 - RNA, 19 nt, Homo sapiens
ucugguuucuaccagcuca

SEQ ID NO: 1463439 - RNA, 12 nt, Homo sapiens
ucuguaaauacu

SEQ ID NO: 1463440 - RNA, 17 nt, Homo sapiens
ucaagcacuuacagcuc

SEQ ID NO: 1463441 - RNA, 20 nt, Homo sapiens
ucaagccccacgaugacugc

SEQ ID NO: 1463442 - RNA, 14 nt, Homo sapiens
ucaagcgauccucc

SEQ ID NO: 1463443 - RNA, 20 nt, Homo sapiens
ucaagcuggaagaagugagc

SEQ ID NO: 1463444 - RNA, 21 nt, Homo sapiens
ucaagcuggaagaagugagca

SEQ ID NO: 1463445 - RNA, 18 nt, Homo sapiens
ucaaggaaugaagaacaa

SEQ ID NO: 1463446 - RNA, 14 nt, Homo sapiens
ucaaggaauuugca

SEQ ID NO: 1463447 - RNA, 15 nt, Homo sapiens
ucaaggaguacaaug

SEQ ID NO: 1463448 - RNA, 19 nt, Homo sapiens
ucaaggcaguagaacucca

SEQ ID NO: 1463449 - RNA, 13 nt, Homo sapiens
ucaaggugggccu

SEQ ID NO: 1463450 - RNA, 17 nt, Homo sapiens
ucaagguggucaguaaa

SEQ ID NO: 1463451 - RNA, 16 nt, Homo sapiens
ucaaguaauugugaaa

SEQ ID NO: 1463452 - RNA, 15 nt, Homo sapiens
ucaaguagaggcaau

SEQ ID NO: 1463453 - RNA, 16 nt, Homo sapiens
ucaagucaaucauuuc

SEQ ID NO: 1463454 - RNA, 19 nt, Homo sapiens
ucaaguccuacaagcuaaa

SEQ ID NO: 1463455 - RNA, 21 nt, Homo sapiens
ucaagugauucuccugccuca

SEQ ID NO: 1463456 - RNA, 13 nt, Homo sapiens
ucaaguucauuga

SEQ ID NO: 1463457 - RNA, 21 nt, Homo sapiens
ucaaguuuuggguauguuuaa

SEQ ID NO: 1463458 - RNA, 21 nt, Homo sapiens
ucaauaaaaguaaagacugua

SEQ ID NO: 1463459 - RNA, 17 nt, Homo sapiens
ucaauaaacaacagcug

SEQ ID NO: 1463460 - RNA, 22 nt, Homo sapiens
ucaauaaacagcuucaugccuu

SEQ ID NO: 1463461 - RNA, 15 nt, Homo sapiens
ucaauagaucuccag

SEQ ID NO: 1463462 - RNA, 17 nt, Homo sapiens
ucaauauuaaauacaga

SEQ ID NO: 1463463 - RNA, 21 nt, Homo sapiens
ucaauauuuuuauaucaugca

SEQ ID NO: 1463464 - RNA, 21 nt, Homo sapiens
ucaaucauaauaccugcugug

SEQ ID NO: 1463465 - RNA, 15 nt, Homo sapiens
ucaaucauugagugg

SEQ ID NO: 1463466 - RNA, 15 nt, Homo sapiens
ucaauccucuaagcu

SEQ ID NO: 1463467 - RNA, 16 nt, Homo sapiens
ucaaucugcaguuuaa

SEQ ID NO: 1463468 - RNA, 18 nt, Homo sapiens
ucaaucuguaaaacuaag

SEQ ID NO: 1463469 - RNA, 21 nt, Homo sapiens
ucaaucuuuggaggcuuuuaa

SEQ ID NO: 1463470 - RNA, 24 nt, Homo sapiens
ucaaugaagccagcucacagugcu

SEQ ID NO: 1463471 - RNA, 23 nt, Homo sapiens
ucaaugcaagagugauugcagcu

SEQ ID NO: 1463472 - RNA, 12 nt, Homo sapiens
ucaaugccagua

SEQ ID NO: 1463473 - RNA, 16 nt, Homo sapiens
ucaauggaaagcugcu

SEQ ID NO: 1463474 - RNA, 20 nt, Homo sapiens
ucaaugggcucuuccaacaa

SEQ ID NO: 1463475 - RNA, 16 nt, Homo sapiens
ucaaugugaacacugg

SEQ ID NO: 1463476 - RNA, 13 nt, Homo sapiens
ucaauuacaaagc

SEQ ID NO: 1463477 - RNA, 15 nt, Homo sapiens
ucaauuuaaauaacc

SEQ ID NO: 1463478 - RNA, 17 nt, Homo sapiens
ucaauuuccugaugcau

SEQ ID NO: 1463479 - RNA, 18 nt, Homo sapiens
ucaauuucuugguauuau

SEQ ID NO: 1463480 - RNA, 18 nt, Homo sapiens
ucacaaaaucacuuuaag

SEQ ID NO: 1463481 - RNA, 15 nt, Homo sapiens
ucgcccaacuccacc

SEQ ID NO: 1463482 - RNA, 17 nt, Homo sapiens
ucgcccaggagacaucc

SEQ ID NO: 1463483 - RNA, 18 nt, Homo sapiens
ucgcccuacucaccugag

SEQ ID NO: 1463484 - RNA, 14 nt, Homo sapiens
ucgcugccagauga

SEQ ID NO: 1463485 - RNA, 10 nt, Homo sapiens
ucgcuuuaug

SEQ ID NO: 1463486 - RNA, 16 nt, Homo sapiens
ucgcuuuguugcccag

SEQ ID NO: 1463487 - RNA, 18 nt, Homo sapiens
ucggagacagugaucucc

SEQ ID NO: 1463488 - RNA, 12 nt, Homo sapiens
ucggauaugauu

SEQ ID NO: 1463489 - RNA, 17 nt, Homo sapiens
ucggaugaggcccucau

SEQ ID NO: 1463490 - RNA, 14 nt, Homo sapiens
ucggccccaucucu

SEQ ID NO: 1463491 - RNA, 16 nt, Homo sapiens
ucggccuccaugaccu

SEQ ID NO: 1463492 - RNA, 16 nt, Homo sapiens
ucggcuccaccccagg

SEQ ID NO: 1463493 - RNA, 20 nt, Homo sapiens
ucggcuccccauguguccug

SEQ ID NO: 1463494 - RNA, 12 nt, Homo sapiens
ucggcuuuuugc

SEQ ID NO: 1463495 - RNA, 11 nt, Homo sapiens
ucgggacauca

SEQ ID NO: 1463496 - RNA, 16 nt, Homo sapiens
ucgggagccaugucau

SEQ ID NO: 1463497 - RNA, 14 nt, Homo sapiens
ucgggccacagggc

SEQ ID NO: 1463498 - RNA, 15 nt, Homo sapiens
ucgggccagaaggcg

SEQ ID NO: 1463499 - RNA, 14 nt, Homo sapiens
ucggggacccugcg

SEQ ID NO: 1463500 - RNA, 13 nt, Homo sapiens
ucggggugcuccu

SEQ ID NO: 1463501 - RNA, 13 nt, Homo sapiens
ucgugaaacccug

SEQ ID NO: 1463502 - RNA, 13 nt, Homo sapiens
ucgugacaacaug

SEQ ID NO: 1463503 - RNA, 13 nt, Homo sapiens
ucgugcacucugc

SEQ ID NO: 1463504 - RNA, 13 nt, Homo sapiens
ucguuaccagaga

SEQ ID NO: 1463505 - RNA, 18 nt, Homo sapiens
ucguuauuguuguugcca

SEQ ID NO: 1463506 - RNA, 13 nt, Homo sapiens
ucuaaaaacuuag

SEQ ID NO: 1463507 - RNA, 21 nt, Homo sapiens
ucuaaacagugggaguaccaa

SEQ ID NO: 1463508 - RNA, 12 nt, Homo sapiens
ucuaaaccuuac

SEQ ID NO: 1463509 - RNA, 20 nt, Homo sapiens
ucuaaagauacagugucuga

SEQ ID NO: 1463510 - RNA, 16 nt, Homo sapiens
ucuaacauguuaucaa

SEQ ID NO: 1463511 - RNA, 12 nt, Homo sapiens
ucuaacauuucc

SEQ ID NO: 1463512 - RNA, 14 nt, Homo sapiens
ucuaaccacuucag

SEQ ID NO: 1463513 - RNA, 13 nt, Homo sapiens
ucuaacgcuuuaa

SEQ ID NO: 1463514 - RNA, 20 nt, Homo sapiens
ucuaagauaguaacaaugaa

SEQ ID NO: 1463515 - RNA, 16 nt, Homo sapiens
ucuaagccaguuuuca

SEQ ID NO: 1463516 - RNA, 17 nt, Homo sapiens
ucuaagccuuuccauaa

SEQ ID NO: 1463517 - RNA, 12 nt, Homo sapiens
ucuaagugauau

SEQ ID NO: 1463518 - RNA, 14 nt, Homo sapiens
ucuaagugggagaa

SEQ ID NO: 1463519 - RNA, 18 nt, Homo sapiens
ucuaauccuuuuccuuau

SEQ ID NO: 1463520 - RNA, 14 nt, Homo sapiens
ucuaaucgaaagaa

SEQ ID NO: 1463521 - RNA, 15 nt, Homo sapiens
ucuaaugcauguauu

SEQ ID NO: 1463522 - RNA, 19 nt, Homo sapiens
ucuaauggggacacagauc

SEQ ID NO: 1463523 - RNA, 14 nt, Homo sapiens
ucuacaaaggccau

SEQ ID NO: 1463524 - RNA, 13 nt, Homo sapiens
ucuacaaccagag

SEQ ID NO: 1463525 - RNA, 12 nt, Homo sapiens
ucuacacagccu

SEQ ID NO: 1463526 - RNA, 20 nt, Homo sapiens
ucuacagagaagauucuugu

SEQ ID NO: 1463527 - RNA, 20 nt, Homo sapiens
ucuacagugccaacuccuca

SEQ ID NO: 1463528 - RNA, 21 nt, Homo sapiens
ucuacaguuaggguugaguua

SEQ ID NO: 1463529 - RNA, 15 nt, Homo sapiens
ucuaccagcauaaau

SEQ ID NO: 1463530 - RNA, 19 nt, Homo sapiens
ucuacuaaaaauacaaaaa

SEQ ID NO: 1463531 - RNA, 12 nt, Homo sapiens
ucuacuaauucc

SEQ ID NO: 1463532 - RNA, 23 nt, Homo sapiens
ucuacuagggaaaaauaaacaca

SEQ ID NO: 1463533 - RNA, 21 nt, Homo sapiens
ucuacucugucuuaaaugaga

SEQ ID NO: 1463534 - RNA, 18 nt, Homo sapiens
ucuacuucauagcuccuu

SEQ ID NO: 1463535 - RNA, 15 nt, Homo sapiens
ucuacuuuaucaauu

SEQ ID NO: 1463536 - RNA, 13 nt, Homo sapiens
ucuagaagccaag

SEQ ID NO: 1463537 - RNA, 19 nt, Homo sapiens
ucuagaauuauaagucaca

SEQ ID NO: 1463538 - RNA, 21 nt, Homo sapiens
ucuagaauuauaagucacaaa

SEQ ID NO: 1463539 - RNA, 20 nt, Homo sapiens
ucuagacuagcaaucucuuc

SEQ ID NO: 1463540 - RNA, 18 nt, Homo sapiens
ucuagauuauaaacugac

SEQ ID NO: 1463541 - RNA, 18 nt, Homo sapiens
ucuagauuuucuacuuua

SEQ ID NO: 1463542 - RNA, 22 nt, Homo sapiens
ucuagguaggggcccacuucac

SEQ ID NO: 1463543 - RNA, 16 nt, Homo sapiens
ucuaggucacuucuca

SEQ ID NO: 1463544 - RNA, 19 nt, Homo sapiens
ucuaguaagaugcacugaa

SEQ ID NO: 1463545 - RNA, 20 nt, Homo sapiens
ucuagugucuuuugccuuua

SEQ ID NO: 1463546 - RNA, 19 nt, Homo sapiens
uagauugcuuucuucuuaa

SEQ ID NO: 1463547 - RNA, 14 nt, Homo sapiens
uagcaaaauugagg

SEQ ID NO: 1463548 - RNA, 13 nt, Homo sapiens
uagcaaacacugg

SEQ ID NO: 1463549 - RNA, 16 nt, Homo sapiens
uagcaaacacuggggg

SEQ ID NO: 1463550 - RNA, 14 nt, Homo sapiens
uagcaagugugcac

SEQ ID NO: 1463551 - RNA, 14 nt, Homo sapiens
uagcagacaggccc

SEQ ID NO: 1463552 - RNA, 17 nt, Homo sapiens
uagcagaggcccugugg

SEQ ID NO: 1463553 - RNA, 14 nt, Homo sapiens
uagcagcaacugaa

SEQ ID NO: 1463554 - RNA, 22 nt, Homo sapiens
uagcagcaccguucugugcaca

SEQ ID NO: 1463555 - RNA, 22 nt, Homo sapiens
uagcaggcuaugaaguugcaau

SEQ ID NO: 1463556 - RNA, 20 nt, Homo sapiens
uagcauagcuuauuauugaa

SEQ ID NO: 1463557 - RNA, 20 nt, Homo sapiens
uagccagcacacagggcagu

SEQ ID NO: 1463558 - RNA, 16 nt, Homo sapiens
uagccaggauccacaa

SEQ ID NO: 1463559 - RNA, 16 nt, Homo sapiens
uagccaucuaaugcuu

SEQ ID NO: 1463560 - RNA, 12 nt, Homo sapiens
uagcccagcacu

SEQ ID NO: 1463561 - RNA, 16 nt, Homo sapiens
uagcccagcacuguga

SEQ ID NO: 1463562 - RNA, 14 nt, Homo sapiens
uagcccugucugcu

SEQ ID NO: 1463563 - RNA, 16 nt, Homo sapiens
uagccucuccaggaau

SEQ ID NO: 1463564 - RNA, 16 nt, Homo sapiens
uagcuaagcaucuccu

SEQ ID NO: 1463565 - RNA, 18 nt, Homo sapiens
uagcuacuguaugcaaag

SEQ ID NO: 1463566 - RNA, 18 nt, Homo sapiens
uagcucacugcagccuca

SEQ ID NO: 1463567 - RNA, 14 nt, Homo sapiens
uagcucauccuuua

SEQ ID NO: 1463568 - RNA, 17 nt, Homo sapiens
uagcugagcgugguggc

SEQ ID NO: 1463569 - RNA, 23 nt, Homo sapiens
uagcugugucauguauauaccuu

SEQ ID NO: 1463570 - RNA, 14 nt, Homo sapiens
uagcuuagcugucu

SEQ ID NO: 1463571 - RNA, 22 nt, Homo sapiens
uagcuucugcuuuucugcccug

SEQ ID NO: 1463572 - RNA, 20 nt, Homo sapiens
uagcuuggagggauggagag

SEQ ID NO: 1463573 - RNA, 13 nt, Homo sapiens
uagcuuuacaaau

SEQ ID NO: 1463574 - RNA, 23 nt, Homo sapiens
uagcuuuagggcaauauugccau

SEQ ID NO: 1463575 - RNA, 15 nt, Homo sapiens
uagcuuuauucuuca

SEQ ID NO: 1463576 - RNA, 14 nt, Homo sapiens
uagcuuuuauucau

SEQ ID NO: 1463577 - RNA, 18 nt, Homo sapiens
uaggaaaaaaauaguaaa

SEQ ID NO: 1463578 - RNA, 20 nt, Homo sapiens
uaggaaaaccagagccuaua

SEQ ID NO: 1463579 - RNA, 21 nt, Homo sapiens
uaggaacucaguccuguacuc

SEQ ID NO: 1463580 - RNA, 17 nt, Homo sapiens
uaggaauggaagcuuca

SEQ ID NO: 1463581 - RNA, 20 nt, Homo sapiens
uaggaauucguaaucauccc

SEQ ID NO: 1463582 - RNA, 19 nt, Homo sapiens
uaggagaaaccagcuuuua

SEQ ID NO: 1463583 - RNA, 16 nt, Homo sapiens
uaggagugguucucau

SEQ ID NO: 1463584 - RNA, 14 nt, Homo sapiens
uaggauaagccacu

SEQ ID NO: 1463585 - RNA, 15 nt, Homo sapiens
uaggccugucccuug

SEQ ID NO: 1463586 - RNA, 17 nt, Homo sapiens
uaggcgcaggugcacag

SEQ ID NO: 1463587 - RNA, 14 nt, Homo sapiens
uaggcuagcuauuu

SEQ ID NO: 1463588 - RNA, 21 nt, Homo sapiens
uaggcucuuaugugugccuuu

SEQ ID NO: 1463589 - RNA, 14 nt, Homo sapiens
uagggaacugggga

SEQ ID NO: 1463590 - RNA, 22 nt, Homo sapiens
uagggacucagggccaugccug

SEQ ID NO: 1463591 - RNA, 15 nt, Homo sapiens
uagggaguaccugcu

SEQ ID NO: 1463592 - RNA, 13 nt, Homo sapiens
uagggcuguaaaa

SEQ ID NO: 1463593 - RNA, 23 nt, Homo sapiens
uagggggagccccuucugcucag

SEQ ID NO: 1463594 - RNA, 16 nt, Homo sapiens
uaggggucaggcucca

SEQ ID NO: 1463595 - RNA, 15 nt, Homo sapiens
uaggguccaccagga

SEQ ID NO: 1463596 - RNA, 13 nt, Homo sapiens
uagguagacuuug

SEQ ID NO: 1463597 - RNA, 15 nt, Homo sapiens
uagguagacuuugcu

SEQ ID NO: 1463598 - RNA, 12 nt, Homo sapiens
uagguagccuug

SEQ ID NO: 1463599 - RNA, 12 nt, Homo sapiens
uagguagcuuua

SEQ ID NO: 1463600 - RNA, 20 nt, Homo sapiens
uagguaggggcccacuucac

SEQ ID NO: 1463601 - RNA, 21 nt, Homo sapiens
uagguauuucuaacgccagca

SEQ ID NO: 1463602 - RNA, 11 nt, Homo sapiens
uagguggcaag

SEQ ID NO: 1463603 - RNA, 16 nt, Homo sapiens
uagguggugccagugg

SEQ ID NO: 1463604 - RNA, 22 nt, Homo sapiens
uaguaauuucacucucugcauu

SEQ ID NO: 1463605 - RNA, 18 nt, Homo sapiens
uaguagauuuuaaagaca

SEQ ID NO: 1463606 - RNA, 22 nt, Homo sapiens
uaguauuggagcacauguuacu

SEQ ID NO: 1463607 - RNA, 18 nt, Homo sapiens
uaguauuucucaggaaga

SEQ ID NO: 1463608 - RNA, 22 nt, Homo sapiens
uagucaauauuugguauuucaa

SEQ ID NO: 1463609 - RNA, 17 nt, Homo sapiens
uagucaauuucuacuuc

SEQ ID NO: 1463610 - RNA, 22 nt, Homo sapiens
uaguccaaauaacaaguaccaa

SEQ ID NO: 1463611 - RNA, 15 nt, Homo sapiens
uagucccagcuacuu

SEQ ID NO: 1463612 - RNA, 20 nt, Homo sapiens
uagucccagcuacuugagag

SEQ ID NO: 1463613 - RNA, 18 nt, Homo sapiens
uagucuccuuugcacuga

SEQ ID NO: 1463614 - RNA, 15 nt, Homo sapiens
uagucucuccccugg

SEQ ID NO: 1463615 - RNA, 17 nt, Homo sapiens
uagugaauacugcuaca

SEQ ID NO: 1463616 - RNA, 15 nt, Homo sapiens
uagugaauggucucu

SEQ ID NO: 1463617 - RNA, 21 nt, Homo sapiens
uagugacucuugaaguacuua

SEQ ID NO: 1463618 - RNA, 21 nt, Homo sapiens
uagugacuugugucccaugau

SEQ ID NO: 1463619 - RNA, 17 nt, Homo sapiens
uaguguaacuugcuuaa

SEQ ID NO: 1463620 - RNA, 13 nt, Homo sapiens
uaguguaccuccu

SEQ ID NO: 1463621 - RNA, 12 nt, Homo sapiens
uagugucacuua

SEQ ID NO: 1463622 - RNA, 18 nt, Homo sapiens
uaguguuguggacacugc

SEQ ID NO: 1463623 - RNA, 16 nt, Homo sapiens
uaguuaauuauuucaa

SEQ ID NO: 1463624 - RNA, 17 nt, Homo sapiens
uaguuaauuauuucaac

SEQ ID NO: 1463625 - RNA, 13 nt, Homo sapiens
uaguuagcuuucu

SEQ ID NO: 1463626 - RNA, 23 nt, Homo sapiens
uaguuccagaaggauccaagaca

SEQ ID NO: 1463627 - RNA, 13 nt, Homo sapiens
uaguucuaccuca

SEQ ID NO: 1463628 - RNA, 21 nt, Homo sapiens
uaguugaucuacaaaggccau

SEQ ID NO: 1463629 - RNA, 23 nt, Homo sapiens
uaguuguaaaccaagugaucaaa

SEQ ID NO: 1463630 - RNA, 13 nt, Homo sapiens
uaguugugcuuuu

SEQ ID NO: 1463631 - RNA, 14 nt, Homo sapiens
uaguuuauuucaac

SEQ ID NO: 1463632 - RNA, 23 nt, Homo sapiens
uaguuuugauccuaaaucugccu

SEQ ID NO: 1463633 - RNA, 22 nt, Homo sapiens
uaguuuuuaccuaccacagugu

SEQ ID NO: 1463634 - RNA, 22 nt, Homo sapiens
uauaaagcauguggucuuauag

SEQ ID NO: 1463635 - RNA, 16 nt, Homo sapiens
uauaaaucaaugucac

SEQ ID NO: 1463636 - RNA, 21 nt, Homo sapiens
uauaaaugaaucugguguugg

SEQ ID NO: 1463637 - RNA, 20 nt, Homo sapiens
uauaaauuuuauaacagaau

SEQ ID NO: 1463638 - RNA, 21 nt, Homo sapiens
uauaaauuuuauaacagaauu

SEQ ID NO: 1463639 - RNA, 14 nt, Homo sapiens
uauaacagaauuaa

SEQ ID NO: 1463640 - RNA, 19 nt, Homo sapiens
uauaacauucaguucccac

SEQ ID NO: 1463641 - RNA, 19 nt, Homo sapiens
uauaaccccaccuugccaa

SEQ ID NO: 1463642 - RNA, 17 nt, Homo sapiens
uauaaccuuguuccaaa

SEQ ID NO: 1463643 - RNA, 11 nt, Homo sapiens
uauaagacauu

SEQ ID NO: 1463644 - RNA, 15 nt, Homo sapiens
uauaagacuacuaua

SEQ ID NO: 1463645 - RNA, 19 nt, Homo sapiens
uauaagauucauauuuacu

SEQ ID NO: 1463646 - RNA, 16 nt, Homo sapiens
uauaaucuaauuacau

SEQ ID NO: 1463647 - RNA, 17 nt, Homo sapiens
uauaaucuccauuucaa

SEQ ID NO: 1463648 - RNA, 21 nt, Homo sapiens
uacuaauuuucuagauuuucu

SEQ ID NO: 1463649 - RNA, 19 nt, Homo sapiens
uacuacaaacuucaaagag

SEQ ID NO: 1463650 - RNA, 15 nt, Homo sapiens
uacuacacugaggag

SEQ ID NO: 1463651 - RNA, 14 nt, Homo sapiens
uacuaccacaagga

SEQ ID NO: 1463652 - RNA, 15 nt, Homo sapiens
uacuaccacaaggaa

SEQ ID NO: 1463653 - RNA, 14 nt, Homo sapiens
uacuaccugucaag

SEQ ID NO: 1463654 - RNA, 12 nt, Homo sapiens
uacuauaugauu

SEQ ID NO: 1463655 - RNA, 19 nt, Homo sapiens
uacuaucacugaacaaacu

SEQ ID NO: 1463656 - RNA, 17 nt, Homo sapiens
uacuauucccuuugacu

SEQ ID NO: 1463657 - RNA, 15 nt, Homo sapiens
uacuccaagacagag

SEQ ID NO: 1463658 - RNA, 19 nt, Homo sapiens
uacucgggaggcugagaca

SEQ ID NO: 1463659 - RNA, 15 nt, Homo sapiens
uacucucaugcugca

SEQ ID NO: 1463660 - RNA, 21 nt, Homo sapiens
uacucucugccugguggucag

SEQ ID NO: 1463661 - RNA, 21 nt, Homo sapiens
uacucuguccauuuauccaca

SEQ ID NO: 1463662 - RNA, 16 nt, Homo sapiens
uacucuugaauacaag

SEQ ID NO: 1463663 - RNA, 23 nt, Homo sapiens
uacugacaacauuauaacuguau

SEQ ID NO: 1463664 - RNA, 22 nt, Homo sapiens
uacugaggugcuauguucuuag

SEQ ID NO: 1463665 - RNA, 19 nt, Homo sapiens
uacugauccucgcaugaug

SEQ ID NO: 1463666 - RNA, 19 nt, Homo sapiens
uacugaugaaaucugcuag

SEQ ID NO: 1463667 - RNA, 21 nt, Homo sapiens
uacugcaggaccuccagcuga

SEQ ID NO: 1463668 - RNA, 16 nt, Homo sapiens
uacuguaaaugcauug

SEQ ID NO: 1463669 - RNA, 21 nt, Homo sapiens
uacuguaggcacacuuugcac

SEQ ID NO: 1463670 - RNA, 17 nt, Homo sapiens
uacuguauggaaacacu

SEQ ID NO: 1463671 - RNA, 19 nt, Homo sapiens
uacuuaaaaauagucuucc

SEQ ID NO: 1463672 - RNA, 14 nt, Homo sapiens
uacuuaacauacac

SEQ ID NO: 1463673 - RNA, 19 nt, Homo sapiens
uacuuaauuccuuucucau

SEQ ID NO: 1463674 - RNA, 19 nt, Homo sapiens
uacuuacuccccacugaug

SEQ ID NO: 1463675 - RNA, 19 nt, Homo sapiens
uacuuauauccacacugca

SEQ ID NO: 1463676 - RNA, 15 nt, Homo sapiens
uacuuauguugcaca

SEQ ID NO: 1463677 - RNA, 12 nt, Homo sapiens
uacuucacuacu

SEQ ID NO: 1463678 - RNA, 14 nt, Homo sapiens
uacuucacuucaaa

SEQ ID NO: 1463679 - RNA, 20 nt, Homo sapiens
uacuucaugagcauucauaa

SEQ ID NO: 1463680 - RNA, 12 nt, Homo sapiens
uacuucucacca

SEQ ID NO: 1463681 - RNA, 18 nt, Homo sapiens
uacuucuuauacauuuga

SEQ ID NO: 1463682 - RNA, 16 nt, Homo sapiens
uacuugaaaaaguaaa

SEQ ID NO: 1463683 - RNA, 15 nt, Homo sapiens
uacuugagccuuuaa

SEQ ID NO: 1463684 - RNA, 14 nt, Homo sapiens
uacuugccaagaaa

SEQ ID NO: 1463685 - RNA, 16 nt, Homo sapiens
uacuuggaacuaggcu

SEQ ID NO: 1463686 - RNA, 20 nt, Homo sapiens
uacuuguagaguggugcugc

SEQ ID NO: 1463687 - RNA, 17 nt, Homo sapiens
uacuuugguaguggaau

SEQ ID NO: 1463688 - RNA, 22 nt, Homo sapiens
uacuuugguuucugucuguaag

SEQ ID NO: 1463689 - RNA, 15 nt, Homo sapiens
uacuuuuacucugcc

SEQ ID NO: 1463690 - RNA, 16 nt, Homo sapiens
uacuuuuacucugccu

SEQ ID NO: 1463691 - RNA, 20 nt, Homo sapiens
uacuuuuauaauaaaaggaa

SEQ ID NO: 1463692 - RNA, 19 nt, Homo sapiens
uacuuuuuuauagcuuaac

SEQ ID NO: 1463693 - RNA, 17 nt, Homo sapiens
uaauucacucaagcacu

SEQ ID NO: 1463694 - RNA, 20 nt, Homo sapiens
uaauucacucaagcacugau

SEQ ID NO: 1463695 - RNA, 19 nt, Homo sapiens
uaauucagcacugauuuca

SEQ ID NO: 1463696 - RNA, 19 nt, Homo sapiens
uaauuccaauuauaugaga

SEQ ID NO: 1463697 - RNA, 17 nt, Homo sapiens
uaauuccuacagcacua

SEQ ID NO: 1463698 - RNA, 20 nt, Homo sapiens
uaauucuuauuuaaguuauu

SEQ ID NO: 1463699 - RNA, 15 nt, Homo sapiens
uaauugaacuaacaa

SEQ ID NO: 1463700 - RNA, 19 nt, Homo sapiens
uaauugaccuacuuuggua

SEQ ID NO: 1463701 - RNA, 12 nt, Homo sapiens
uaauugguucuu

SEQ ID NO: 1463702 - RNA, 14 nt, Homo sapiens
uaauuuaacaaacu

SEQ ID NO: 1463703 - RNA, 16 nt, Homo sapiens
uaauuuauuucaucca

SEQ ID NO: 1463704 - RNA, 18 nt, Homo sapiens
uaauuucaugggacuaaa

SEQ ID NO: 1463705 - RNA, 22 nt, Homo sapiens
uaauuuccuuuuugacacugaa

SEQ ID NO: 1463706 - RNA, 19 nt, Homo sapiens
uaauuuucuagauuuucua

SEQ ID NO: 1463707 - RNA, 23 nt, Homo sapiens
uaauuuuuccuuccucuguaaga

SEQ ID NO: 1463708 - RNA, 15 nt, Homo sapiens
uacaaaaaacaacaa

SEQ ID NO: 1463709 - RNA, 19 nt, Homo sapiens
uacaaaaauagcugggcau

SEQ ID NO: 1463710 - RNA, 18 nt, Homo sapiens
uacaaaagauguauccuu

SEQ ID NO: 1463711 - RNA, 16 nt, Homo sapiens
uacaaacuucaaagag

SEQ ID NO: 1463712 - RNA, 14 nt, Homo sapiens
uacaaaguauuugc

SEQ ID NO: 1463713 - RNA, 21 nt, Homo sapiens
uacaaagucagggcguucaua

SEQ ID NO: 1463714 - RNA, 13 nt, Homo sapiens
uacaacaggcagu

SEQ ID NO: 1463715 - RNA, 19 nt, Homo sapiens
uacaacuaagugauuugua

SEQ ID NO: 1463716 - RNA, 20 nt, Homo sapiens
uacaacugcaccugucauca

SEQ ID NO: 1463717 - RNA, 18 nt, Homo sapiens
uacaacugccucgaaaca

SEQ ID NO: 1463718 - RNA, 18 nt, Homo sapiens
uacaacuugcauauguca

SEQ ID NO: 1463719 - RNA, 16 nt, Homo sapiens
uacaagucagcuccag

SEQ ID NO: 1463720 - RNA, 23 nt, Homo sapiens
uacaaguuguuauuguugaacau

SEQ ID NO: 1463721 - RNA, 13 nt, Homo sapiens
uacaaguuucaga

SEQ ID NO: 1463722 - RNA, 17 nt, Homo sapiens
uacaaguuucagacagg

SEQ ID NO: 1463723 - RNA, 20 nt, Homo sapiens
uacaauaggugcuuauucuc

SEQ ID NO: 1463724 - RNA, 17 nt, Homo sapiens
uacaauccuguuuauaa

SEQ ID NO: 1463725 - RNA, 22 nt, Homo sapiens
uacaaugaaagcccucaugugc

SEQ ID NO: 1463726 - RNA, 12 nt, Homo sapiens
uacaauugugag

SEQ ID NO: 1463727 - RNA, 12 nt, Homo sapiens
uacaauuucacu

SEQ ID NO: 1463728 - RNA, 23 nt, Homo sapiens
uacacaaggaaggcauuuggacc

SEQ ID NO: 1463729 - RNA, 14 nt, Homo sapiens
uacacacacacucc

SEQ ID NO: 1463730 - RNA, 23 nt, Homo sapiens
uacacacacccaggcccaugcca

SEQ ID NO: 1463731 - RNA, 16 nt, Homo sapiens
uacacagaugaaggug

SEQ ID NO: 1463732 - RNA, 16 nt, Homo sapiens
uacacauagcauguaa

SEQ ID NO: 1463733 - RNA, 17 nt, Homo sapiens
uacaccuuagugcagcg

SEQ ID NO: 1463734 - RNA, 21 nt, Homo sapiens
uacacuaaaaggugaccaaug

SEQ ID NO: 1463735 - RNA, 15 nt, Homo sapiens
uacacuaacauuucc

SEQ ID NO: 1463736 - RNA, 15 nt, Homo sapiens
uacacuaaccaaauc

SEQ ID NO: 1463737 - RNA, 23 nt, Homo sapiens
uacacucuugacuagugcaauuu

SEQ ID NO: 1463738 - RNA, 18 nt, Homo sapiens
uacacugaaaaugucaca

SEQ ID NO: 1463739 - RNA, 14 nt, Homo sapiens
uacacuuuguugca

SEQ ID NO: 1463740 - RNA, 13 nt, Homo sapiens
uacagacaagguu

SEQ ID NO: 1463741 - RNA, 18 nt, Homo sapiens
uacagacuucuccagacc

SEQ ID NO: 1463742 - RNA, 13 nt, Homo sapiens
uacagaugggcaa

SEQ ID NO: 1463743 - RNA, 17 nt, Homo sapiens
uacagcagugucaucag

SEQ ID NO: 1463744 - RNA, 14 nt, Homo sapiens
uacagcucuggcca

SEQ ID NO: 1463745 - RNA, 11 nt, Homo sapiens
uacagcuuucu

SEQ ID NO: 1463746 - RNA, 19 nt, Homo sapiens
uacaggaagguagaaauau

SEQ ID NO: 1463747 - RNA, 19 nt, Homo sapiens
uacaggccauacuuuacaa

SEQ ID NO: 1463748 - RNA, 20 nt, Homo sapiens
uacaggcgugauccaccaca

SEQ ID NO: 1463749 - RNA, 20 nt, Homo sapiens
uacaggguuuuuaccuguca

SEQ ID NO: 1463750 - RNA, 17 nt, Homo sapiens
uacagguaccaguucuu

SEQ ID NO: 1463751 - RNA, 22 nt, Homo sapiens
uacaggugcgcgccaccgugcc

SEQ ID NO: 1463752 - RNA, 23 nt, Homo sapiens
uacaguaacaaauaaagugcagu

SEQ ID NO: 1463753 - RNA, 22 nt, Homo sapiens
uacagugaugcugugcuaugaa

SEQ ID NO: 1463754 - RNA, 14 nt, Homo sapiens
uacaguuauuuugg

SEQ ID NO: 1463755 - RNA, 13 nt, Homo sapiens
uacauaagaccau

SEQ ID NO: 1463756 - RNA, 14 nt, Homo sapiens
uacauagagaauaa

SEQ ID NO: 1463757 - RNA, 16 nt, Homo sapiens
uacauauuaucucauu

SEQ ID NO: 1463758 - RNA, 20 nt, Homo sapiens
uacauccagucacuuugcca

SEQ ID NO: 1463759 - RNA, 16 nt, Homo sapiens
uacaucccagccugug

SEQ ID NO: 1463760 - RNA, 23 nt, Homo sapiens
uacaucugcaauaugaauucaag

SEQ ID NO: 1463761 - RNA, 21 nt, Homo sapiens
uacaugagaaggaacuuccag

SEQ ID NO: 1463762 - RNA, 16 nt, Homo sapiens
uacaugcuggggucaa

SEQ ID NO: 1463763 - RNA, 19 nt, Homo sapiens
uacaugugccgaaugugca

SEQ ID NO: 1463764 - RNA, 11 nt, Homo sapiens
uacauguuaag

SEQ ID NO: 1463765 - RNA, 20 nt, Homo sapiens
uacauucugcaagcacaucu

SEQ ID NO: 1463766 - RNA, 22 nt, Homo sapiens
uacauucugcaagcacaucugc

SEQ ID NO: 1463767 - RNA, 15 nt, Homo sapiens
uacauugugcugcac

SEQ ID NO: 1463768 - RNA, 23 nt, Homo sapiens
uacauuguuugucugucuucaua

SEQ ID NO: 1463769 - RNA, 17 nt, Homo sapiens
uaccaacauaaguguug

SEQ ID NO: 1463770 - RNA, 14 nt, Homo sapiens
uaccaaucucugaa

SEQ ID NO: 1463771 - RNA, 18 nt, Homo sapiens
uaccacagugucuguauc

SEQ ID NO: 1463772 - RNA, 14 nt, Homo sapiens
uaccacugcacugu

SEQ ID NO: 1463773 - RNA, 19 nt, Homo sapiens
uaccaggggcugggcuccc

SEQ ID NO: 1463774 - RNA, 23 nt, Homo sapiens
uaccaguucagacacuaccccau

SEQ ID NO: 1463775 - RNA, 13 nt, Homo sapiens
uaccaguugccuu

SEQ ID NO: 1463776 - RNA, 13 nt, Homo sapiens
uacccaaacguga

SEQ ID NO: 1463777 - RNA, 21 nt, Homo sapiens
uacccacauguacagacauac

SEQ ID NO: 1463778 - RNA, 20 nt, Homo sapiens
uacccagagaauauauacau

SEQ ID NO: 1463779 - RNA, 23 nt, Homo sapiens
uacccagagaauauauacauucu

SEQ ID NO: 1463780 - RNA, 18 nt, Homo sapiens
uaccgccugucucuuuaa

SEQ ID NO: 1463781 - RNA, 20 nt, Homo sapiens
uaccuacauacguguuccua

SEQ ID NO: 1463782 - RNA, 15 nt, Homo sapiens
uaccuaccacagugu

SEQ ID NO: 1463783 - RNA, 17 nt, Homo sapiens
uaccucaucccaugaga

SEQ ID NO: 1463784 - RNA, 20 nt, Homo sapiens
uaccuccauccauccuucca

SEQ ID NO: 1463785 - RNA, 17 nt, Homo sapiens
uaccucuaaguacauau

SEQ ID NO: 1463786 - RNA, 19 nt, Homo sapiens
uaccugagauggaggaguc

SEQ ID NO: 1463787 - RNA, 14 nt, Homo sapiens
uaccugauggaccu

SEQ ID NO: 1463788 - RNA, 17 nt, Homo sapiens
uaccuguauacagugca

SEQ ID NO: 1463789 - RNA, 23 nt, Homo sapiens
uaccuguuuuguggucagcugua

SEQ ID NO: 1463790 - RNA, 18 nt, Homo sapiens
uaccuuaagagacacucc

SEQ ID NO: 1463791 - RNA, 22 nt, Homo sapiens
uacguuccuauugucauuaaag

SEQ ID NO: 1463792 - RNA, 19 nt, Homo sapiens
uacguuugaaauaguugau

SEQ ID NO: 1463793 - RNA, 17 nt, Homo sapiens
uacuaaaacacugaaaa

SEQ ID NO: 1463794 - RNA, 12 nt, Homo sapiens
uaagaauuucac

SEQ ID NO: 1463795 - RNA, 19 nt, Homo sapiens
uaagacaauggacccuuuu

SEQ ID NO: 1463796 - RNA, 14 nt, Homo sapiens
uaagacuacuauac

SEQ ID NO: 1463797 - RNA, 15 nt, Homo sapiens
uaagagaaugaauua

SEQ ID NO: 1463798 - RNA, 17 nt, Homo sapiens
uaagagcagaacagauc

SEQ ID NO: 1463799 - RNA, 17 nt, Homo sapiens
uaagagccauuuagggg

SEQ ID NO: 1463800 - RNA, 24 nt, Homo sapiens
uaagaguagcaaguucuagagaag

SEQ ID NO: 1463801 - RNA, 19 nt, Homo sapiens
uaagagugccguaacaacu

SEQ ID NO: 1463802 - RNA, 24 nt, Homo sapiens
uaagaguggaaccaacacuaacau

SEQ ID NO: 1463803 - RNA, 22 nt, Homo sapiens
uaagauacuggacuccucuucc

SEQ ID NO: 1463804 - RNA, 14 nt, Homo sapiens
uaagauccacaaau

SEQ ID NO: 1463805 - RNA, 15 nt, Homo sapiens
uaagaugcacugaaa

SEQ ID NO: 1463806 - RNA, 17 nt, Homo sapiens
uaagauuuugcaccugu

SEQ ID NO: 1463807 - RNA, 21 nt, Homo sapiens
uaagcaaaaugcuucugcaca

SEQ ID NO: 1463808 - RNA, 15 nt, Homo sapiens
uaagcaauaccagca

SEQ ID NO: 1463809 - RNA, 17 nt, Homo sapiens
uaagcagcgccagugac

SEQ ID NO: 1463810 - RNA, 12 nt, Homo sapiens
uaagcagucuca

SEQ ID NO: 1463811 - RNA, 20 nt, Homo sapiens
uaagcauaagcuuaugcuua

SEQ ID NO: 1463812 - RNA, 22 nt, Homo sapiens
uaagcccggauagacuuauugc

SEQ ID NO: 1463813 - RNA, 15 nt, Homo sapiens
uaagccuuuccauaa

SEQ ID NO: 1463814 - RNA, 17 nt, Homo sapiens
uaagccuuuugcucaca

SEQ ID NO: 1463815 - RNA, 15 nt, Homo sapiens
uaagcuagcaaauag

SEQ ID NO: 1463816 - RNA, 15 nt, Homo sapiens
uaagcucagugcucu

SEQ ID NO: 1463817 - RNA, 21 nt, Homo sapiens
uaagcuuaugcuuaaauucaa

SEQ ID NO: 1463818 - RNA, 15 nt, Homo sapiens
uaaggagacugaggc

SEQ ID NO: 1463819 - RNA, 16 nt, Homo sapiens
uaaggcuuuaguguau

SEQ ID NO: 1463820 - RNA, 14 nt, Homo sapiens
uaagggacaacauc

SEQ ID NO: 1463821 - RNA, 17 nt, Homo sapiens
uaagggaguuacaucuu

SEQ ID NO: 1463822 - RNA, 23 nt, Homo sapiens
uaaggggggcagggagugaugau

SEQ ID NO: 1463823 - RNA, 20 nt, Homo sapiens
uaaggguuaguuuacaauca

SEQ ID NO: 1463824 - RNA, 20 nt, Homo sapiens
uaagguauuucgaaacugcc

SEQ ID NO: 1463825 - RNA, 13 nt, Homo sapiens
uaaggucacagcu

SEQ ID NO: 1463826 - RNA, 19 nt, Homo sapiens
uaaggugcaauaagaauuu

SEQ ID NO: 1463827 - RNA, 21 nt, Homo sapiens
uaaguaaagucaacauaugca

SEQ ID NO: 1463828 - RNA, 15 nt, Homo sapiens
uaaguaacauaacua

SEQ ID NO: 1463829 - RNA, 17 nt, Homo sapiens
uaaguaacuucacauua

SEQ ID NO: 1463830 - RNA, 13 nt, Homo sapiens
uaaguaauuauuc

SEQ ID NO: 1463831 - RNA, 22 nt, Homo sapiens
uaaguacuauguaucaaugagu

SEQ ID NO: 1463832 - RNA, 11 nt, Homo sapiens
uaagugcugcu

SEQ ID NO: 1463833 - RNA, 18 nt, Homo sapiens
uaaguguugguagcacuu

SEQ ID NO: 1463834 - RNA, 14 nt, Homo sapiens
uaaguuauuuacuu

SEQ ID NO: 1463835 - RNA, 22 nt, Homo sapiens
uaaguucuaugaagaguauuaa

SEQ ID NO: 1463836 - RNA, 14 nt, Homo sapiens
uaaguugcauuuag

SEQ ID NO: 1463837 - RNA, 17 nt, Homo sapiens
uaaguuucaggugacau

SEQ ID NO: 1463838 - RNA, 21 nt, Homo sapiens
uaauaaaacagcugucucuaa

SEQ ID NO: 1463839 - RNA, 13 nt, Homo sapiens
uaauaaacauccu

SEQ ID NO: 1463840 - RNA, 13 nt, Homo sapiens
uaauaaagacacu

SEQ ID NO: 1463841 - RNA, 14 nt, Homo sapiens
uaauaaauacugca

SEQ ID NO: 1463842 - RNA, 17 nt, Homo sapiens
uaauaacuguguacugu

SEQ ID NO: 1463843 - RNA, 11 nt, Homo sapiens
uaauaagcaau

SEQ ID NO: 1463844 - RNA, 14 nt, Homo sapiens
uaauacagcagugu

SEQ ID NO: 1463845 - RNA, 14 nt, Homo sapiens
uaauacaucaaaga

SEQ ID NO: 1463846 - RNA, 19 nt, Homo sapiens
uaauaccucuuacuuugcu

SEQ ID NO: 1463847 - RNA, 18 nt, Homo sapiens
uaauacuccuaagacuua

SEQ ID NO: 1463848 - RNA, 18 nt, Homo sapiens
uaauagaaauaaauuccu

SEQ ID NO: 1463849 - RNA, 12 nt, Homo sapiens
uaauagucauca

SEQ ID NO: 1463850 - RNA, 18 nt, Homo sapiens
uaauaguuuaacugaaag

SEQ ID NO: 1463851 - RNA, 22 nt, Homo sapiens
uaauauaaaaagcuuccaugau

SEQ ID NO: 1463852 - RNA, 13 nt, Homo sapiens
uaauauacuuuaa

SEQ ID NO: 1463853 - RNA, 13 nt, Homo sapiens
uaauauaguagau

SEQ ID NO: 1463854 - RNA, 14 nt, Homo sapiens
uaauaucugugagg

SEQ ID NO: 1463855 - RNA, 23 nt, Homo sapiens
uaauaugaguaauacaucaaaga

SEQ ID NO: 1463856 - RNA, 17 nt, Homo sapiens
uaauaugccuagcacaa

SEQ ID NO: 1463857 - RNA, 14 nt, Homo sapiens
uaauaugcugccaa

SEQ ID NO: 1463858 - RNA, 16 nt, Homo sapiens
uaauauugacuuguau

SEQ ID NO: 1463859 - RNA, 17 nt, Homo sapiens
uaauauuguauugcugc

SEQ ID NO: 1463860 - RNA, 15 nt, Homo sapiens
uaauauuuagcugua

SEQ ID NO: 1463861 - RNA, 19 nt, Homo sapiens
uaauauuuuuccacuuaaa

SEQ ID NO: 1463862 - RNA, 16 nt, Homo sapiens
uaaucacaaauuucac

SEQ ID NO: 1463863 - RNA, 17 nt, Homo sapiens
uaaucacaaauuucacu

SEQ ID NO: 1463864 - RNA, 15 nt, Homo sapiens
uaaucaccucucugu

SEQ ID NO: 1463865 - RNA, 12 nt, Homo sapiens
uaaucacucuaa

SEQ ID NO: 1463866 - RNA, 22 nt, Homo sapiens
uaaucacucuaauuaauuguaa

SEQ ID NO: 1463867 - RNA, 22 nt, Homo sapiens
uaaucagggaggucauuuuggu

SEQ ID NO: 1463868 - RNA, 18 nt, Homo sapiens
uaaucaucuauaaagaag

SEQ ID NO: 1463869 - RNA, 20 nt, Homo sapiens
uaaucaugugggugagccag

SEQ ID NO: 1463870 - RNA, 12 nt, Homo sapiens
uaauccaggcac

SEQ ID NO: 1463871 - RNA, 18 nt, Homo sapiens
uaauccaggcagauccag

SEQ ID NO: 1463872 - RNA, 15 nt, Homo sapiens
uaauccaguguuacu

SEQ ID NO: 1463873 - RNA, 17 nt, Homo sapiens
uaaucccaacacuuuga

SEQ ID NO: 1463874 - RNA, 19 nt, Homo sapiens
uaaucccagcuacucggga

SEQ ID NO: 1463875 - RNA, 11 nt, Homo sapiens
uaauccuuaac

SEQ ID NO: 1463876 - RNA, 13 nt, Homo sapiens
uaaucuguagggc

SEQ ID NO: 1463877 - RNA, 14 nt, Homo sapiens
uaaugaaacacagc

SEQ ID NO: 1463878 - RNA, 14 nt, Homo sapiens
uaaugaacauguga

SEQ ID NO: 1463879 - RNA, 17 nt, Homo sapiens
uaaugaacuaacugaca

SEQ ID NO: 1463880 - RNA, 18 nt, Homo sapiens
uaaugaauuuuuaugaua

SEQ ID NO: 1463881 - RNA, 11 nt, Homo sapiens
uaaugagggac

SEQ ID NO: 1463882 - RNA, 13 nt, Homo sapiens
uaaugaugccaug

SEQ ID NO: 1463883 - RNA, 15 nt, Homo sapiens
uaaugccagcccuuu

SEQ ID NO: 1463884 - RNA, 19 nt, Homo sapiens
uaaugccauuaucccugaa

SEQ ID NO: 1463885 - RNA, 18 nt, Homo sapiens
uaaugccccaaggacaag

SEQ ID NO: 1463886 - RNA, 14 nt, Homo sapiens
uaaugcuucauuca

SEQ ID NO: 1463887 - RNA, 20 nt, Homo sapiens
uaauggcagcuagugccuuu

SEQ ID NO: 1463888 - RNA, 12 nt, Homo sapiens
uaauggcauuuu

SEQ ID NO: 1463889 - RNA, 17 nt, Homo sapiens
uaauggggacacagauc

SEQ ID NO: 1463890 - RNA, 18 nt, Homo sapiens
uaaugguuuuuaacaccu

SEQ ID NO: 1463891 - RNA, 19 nt, Homo sapiens
uaauguauuuguuugcaau

SEQ ID NO: 1463892 - RNA, 11 nt, Homo sapiens
uaaugugaagg

SEQ ID NO: 1463893 - RNA, 20 nt, Homo sapiens
uaauguuaauucagcacuga

SEQ ID NO: 1463894 - RNA, 17 nt, Homo sapiens
uaauuauaaauaucauu

SEQ ID NO: 1463895 - RNA, 19 nt, Homo sapiens
uaauuauuauuuccagugu

SEQ ID NO: 1463896 - RNA, 14 nt, Homo sapiens
uaauucaaauaaua

SEQ ID NO: 1463897 - RNA, 15 nt, Homo sapiens
uaaagcacgugcaag

SEQ ID NO: 1463898 - RNA, 17 nt, Homo sapiens
uaaagcauaaguauaca

SEQ ID NO: 1463899 - RNA, 18 nt, Homo sapiens
uaaagcauauuggugcua

SEQ ID NO: 1463900 - RNA, 21 nt, Homo sapiens
uaaagcuuaauaaaaacaacc

SEQ ID NO: 1463901 - RNA, 23 nt, Homo sapiens
uaaaggaagcaaguuuucuucca

SEQ ID NO: 1463902 - RNA, 13 nt, Homo sapiens
uaaaggcaucuac

SEQ ID NO: 1463903 - RNA, 23 nt, Homo sapiens
uaaagguuucauguucacuguga

SEQ ID NO: 1463904 - RNA, 14 nt, Homo sapiens
uaaagucugaauca

SEQ ID NO: 1463905 - RNA, 20 nt, Homo sapiens
uaaagugaauaaccacuuaa

SEQ ID NO: 1463906 - RNA, 21 nt, Homo sapiens
uaaagugaauaaccacuuaaa

SEQ ID NO: 1463907 - RNA, 11 nt, Homo sapiens
uaaagugcagu

SEQ ID NO: 1463908 - RNA, 16 nt, Homo sapiens
uaaaguguucugccag

SEQ ID NO: 1463909 - RNA, 18 nt, Homo sapiens
uaaaguuaaaagaaugua

SEQ ID NO: 1463910 - RNA, 14 nt, Homo sapiens
uaaaguugcacaug

SEQ ID NO: 1463911 - RNA, 18 nt, Homo sapiens
uaaauaagagauuuggag

SEQ ID NO: 1463912 - RNA, 21 nt, Homo sapiens
uaaauaaugaauaaacugaau

SEQ ID NO: 1463913 - RNA, 13 nt, Homo sapiens
uaaauacagguag

SEQ ID NO: 1463914 - RNA, 20 nt, Homo sapiens
uaaauacuguaaaugcauug

SEQ ID NO: 1463915 - RNA, 17 nt, Homo sapiens
uaaauagcuauauccau

SEQ ID NO: 1463916 - RNA, 23 nt, Homo sapiens
uaaauagcuauauccauguacug

SEQ ID NO: 1463917 - RNA, 12 nt, Homo sapiens
uaaauauaauua

SEQ ID NO: 1463918 - RNA, 15 nt, Homo sapiens
uaaauauauauucua

SEQ ID NO: 1463919 - RNA, 18 nt, Homo sapiens
uaaauaucacaguauuau

SEQ ID NO: 1463920 - RNA, 20 nt, Homo sapiens
uaaauaucauccugccuuca

SEQ ID NO: 1463921 - RNA, 13 nt, Homo sapiens
uaaauaugcagug

SEQ ID NO: 1463922 - RNA, 21 nt, Homo sapiens
uaaauaugccuaaaauacuua

SEQ ID NO: 1463923 - RNA, 19 nt, Homo sapiens
uaaauaugccuaguaacac

SEQ ID NO: 1463924 - RNA, 15 nt, Homo sapiens
uaaauauuacaguga

SEQ ID NO: 1463925 - RNA, 17 nt, Homo sapiens
uaaauauuagaagccug

SEQ ID NO: 1463926 - RNA, 14 nt, Homo sapiens
uaaauauugucaua

SEQ ID NO: 1463927 - RNA, 16 nt, Homo sapiens
uaaauauuucaggcau

SEQ ID NO: 1463928 - RNA, 19 nt, Homo sapiens
uaaaucaaugucacuuaaa

SEQ ID NO: 1463929 - RNA, 20 nt, Homo sapiens
uaaaucaggacagguggugc

SEQ ID NO: 1463930 - RNA, 19 nt, Homo sapiens
uaaaucauauuaguauuaa

SEQ ID NO: 1463931 - RNA, 15 nt, Homo sapiens
uaaaucauuucagua

SEQ ID NO: 1463932 - RNA, 15 nt, Homo sapiens
uaaaucguccuccca

SEQ ID NO: 1463933 - RNA, 16 nt, Homo sapiens
uaaaucguccucccag

SEQ ID NO: 1463934 - RNA, 20 nt, Homo sapiens
uaaaucguccucccaggcca

SEQ ID NO: 1463935 - RNA, 14 nt, Homo sapiens
uaaaucuccagugg

SEQ ID NO: 1463936 - RNA, 15 nt, Homo sapiens
uaaaugaacuaauga

SEQ ID NO: 1463937 - RNA, 22 nt, Homo sapiens
uaaaugagagggaaucgacugu

SEQ ID NO: 1463938 - RNA, 16 nt, Homo sapiens
uaaaugcaccaagaaa

SEQ ID NO: 1463939 - RNA, 19 nt, Homo sapiens
uaaaugccaggccuggcaa

SEQ ID NO: 1463940 - RNA, 23 nt, Homo sapiens
uaaaugcuauuuuuuauuuuacu

SEQ ID NO: 1463941 - RNA, 21 nt, Homo sapiens
uaaaugcugucaacuaugaua

SEQ ID NO: 1463942 - RNA, 18 nt, Homo sapiens
uaaauggugcugcagauu

SEQ ID NO: 1463943 - RNA, 21 nt, Homo sapiens
uaaauguagcgacugucaaca

SEQ ID NO: 1463944 - RNA, 13 nt, Homo sapiens
uaaauuagcuuuu

SEQ ID NO: 1463945 - RNA, 14 nt, Homo sapiens
uaaauuaguauuua

SEQ ID NO: 1463946 - RNA, 13 nt, Homo sapiens
uaaauuccacacu

SEQ ID NO: 1463947 - RNA, 18 nt, Homo sapiens
uaaauucccaacuucucu

SEQ ID NO: 1463948 - RNA, 15 nt, Homo sapiens
uaaauucuaagccau

SEQ ID NO: 1463949 - RNA, 14 nt, Homo sapiens
uaaauuuaacucug

SEQ ID NO: 1463950 - RNA, 18 nt, Homo sapiens
uaaauuuuauaacagaau

SEQ ID NO: 1463951 - RNA, 18 nt, Homo sapiens
uaacaacaauaacacugu

SEQ ID NO: 1463952 - RNA, 20 nt, Homo sapiens
uaacaacaauaacacugucu

SEQ ID NO: 1463953 - RNA, 16 nt, Homo sapiens
uaacaaugacuuguac

SEQ ID NO: 1463954 - RNA, 23 nt, Homo sapiens
uaacacauuaucgggagcagugu

SEQ ID NO: 1463955 - RNA, 24 nt, Homo sapiens
uaacacauucaauagcauaucaca

SEQ ID NO: 1463956 - RNA, 21 nt, Homo sapiens
uaacacauuuuuuaacuaaua

SEQ ID NO: 1463957 - RNA, 15 nt, Homo sapiens
uaacacggugcucau

SEQ ID NO: 1463958 - RNA, 16 nt, Homo sapiens
uaacacggugcucauu

SEQ ID NO: 1463959 - RNA, 19 nt, Homo sapiens
uaacacuggcuucaggcaa

SEQ ID NO: 1463960 - RNA, 22 nt, Homo sapiens
uaacagaaagccugggugacau

SEQ ID NO: 1463961 - RNA, 20 nt, Homo sapiens
uaacagaguaucagaucuau

SEQ ID NO: 1463962 - RNA, 21 nt, Homo sapiens
uaacagauggaaaaacugagg

SEQ ID NO: 1463963 - RNA, 16 nt, Homo sapiens
uaacaggaaaauuuua

SEQ ID NO: 1463964 - RNA, 19 nt, Homo sapiens
uaacaguucacuuuuuaca

SEQ ID NO: 1463965 - RNA, 15 nt, Homo sapiens
uaacaucaccacugu

SEQ ID NO: 1463966 - RNA, 19 nt, Homo sapiens
uaacauggacugcuucauc

SEQ ID NO: 1463967 - RNA, 20 nt, Homo sapiens
uaacauguaauuaaguacua

SEQ ID NO: 1463968 - RNA, 21 nt, Homo sapiens
uaacauguaauuaaguacuau

SEQ ID NO: 1463969 - RNA, 17 nt, Homo sapiens
uaacauguuaucaaauc

SEQ ID NO: 1463970 - RNA, 17 nt, Homo sapiens
uaacauuaacuuuggaa

SEQ ID NO: 1463971 - RNA, 15 nt, Homo sapiens
uaaccaacaauauaa

SEQ ID NO: 1463972 - RNA, 16 nt, Homo sapiens
uaacccucacccacag

SEQ ID NO: 1463973 - RNA, 17 nt, Homo sapiens
uaaccucaaagugacua

SEQ ID NO: 1463974 - RNA, 14 nt, Homo sapiens
uaaccucugcacua

SEQ ID NO: 1463975 - RNA, 22 nt, Homo sapiens
uaaccugcaaaaucuguucuaa

SEQ ID NO: 1463976 - RNA, 17 nt, Homo sapiens
uaaccuuauauuuacaa

SEQ ID NO: 1463977 - RNA, 18 nt, Homo sapiens
uaacgaaugguacuacaa

SEQ ID NO: 1463978 - RNA, 19 nt, Homo sapiens
uaacgacuucuccaucucc

SEQ ID NO: 1463979 - RNA, 14 nt, Homo sapiens
uaacgcgucuuccu

SEQ ID NO: 1463980 - RNA, 14 nt, Homo sapiens
uaacuaacuggcag

SEQ ID NO: 1463981 - RNA, 12 nt, Homo sapiens
uaacuacauuua

SEQ ID NO: 1463982 - RNA, 18 nt, Homo sapiens
uaacuauauuugcuuuuu

SEQ ID NO: 1463983 - RNA, 18 nt, Homo sapiens
uaacuaugagccaggcau

SEQ ID NO: 1463984 - RNA, 20 nt, Homo sapiens
uaacuaugagcuugcucauu

SEQ ID NO: 1463985 - RNA, 15 nt, Homo sapiens
uaacuauugcauuua

SEQ ID NO: 1463986 - RNA, 14 nt, Homo sapiens
uaacugccaagaaa

SEQ ID NO: 1463987 - RNA, 17 nt, Homo sapiens
uaacugccuuguguaca

SEQ ID NO: 1463988 - RNA, 23 nt, Homo sapiens
uaacuguaguguagucaggugcu

SEQ ID NO: 1463989 - RNA, 16 nt, Homo sapiens
uaacugugcugaaugc

SEQ ID NO: 1463990 - RNA, 13 nt, Homo sapiens
uaacuguguuuua

SEQ ID NO: 1463991 - RNA, 23 nt, Homo sapiens
uaacuguuaacuaugacagauau

SEQ ID NO: 1463992 - RNA, 20 nt, Homo sapiens
uaacuuauuuuaaauaugcc

SEQ ID NO: 1463993 - RNA, 20 nt, Homo sapiens
uaacuucaaggcccauaucu

SEQ ID NO: 1463994 - RNA, 13 nt, Homo sapiens
uaacuuccugcug

SEQ ID NO: 1463995 - RNA, 20 nt, Homo sapiens
uaacuuuucaaugacauuuu

SEQ ID NO: 1463996 - RNA, 16 nt, Homo sapiens
uaagaaaauacauaag

SEQ ID NO: 1463997 - RNA, 17 nt, Homo sapiens
uaagaagagccauagcu

SEQ ID NO: 1463998 - RNA, 15 nt, Homo sapiens
aaacugugaagcauu

SEQ ID NO: 1463999 - RNA, 13 nt, Homo sapiens
aaacuguggugcu

SEQ ID NO: 1464000 - RNA, 14 nt, Homo sapiens
aaacuguguugcca

SEQ ID NO: 1464001 - RNA, 23 nt, Homo sapiens
aaacuguucucuauuagacuuua

SEQ ID NO: 1464002 - RNA, 19 nt, Homo sapiens
aaacuuagaucaucaguca

SEQ ID NO: 1464003 - RNA, 22 nt, Homo sapiens
aaacuucaccuacauuaucuca

SEQ ID NO: 1464004 - RNA, 17 nt, Homo sapiens
aaacuugacauguagcu

SEQ ID NO: 1464005 - RNA, 18 nt, Homo sapiens
aaacuuggauacuuggau

SEQ ID NO: 1464006 - RNA, 21 nt, Homo sapiens
aaacuuuagaguagcaugaga

SEQ ID NO: 1464007 - RNA, 14 nt, Homo sapiens
aaacuuugucaugg

SEQ ID NO: 1464008 - RNA, 17 nt, Homo sapiens
aaacuuuucugcugaua

SEQ ID NO: 1464009 - RNA, 22 nt, Homo sapiens
aaagaaauuuaaguucuaugag

SEQ ID NO: 1464010 - RNA, 23 nt, Homo sapiens
aaagaagagaugagaaaugauga

SEQ ID NO: 1464011 - RNA, 23 nt, Homo sapiens
aaagaaggcauuugcaggguccu

SEQ ID NO: 1464012 - RNA, 17 nt, Homo sapiens
aaagaauuauuugccuu

SEQ ID NO: 1464013 - RNA, 22 nt, Homo sapiens
aaagaauuggccaggcauggug

SEQ ID NO: 1464014 - RNA, 11 nt, Homo sapiens
aaagacaaauu

SEQ ID NO: 1464015 - RNA, 18 nt, Homo sapiens
aaagacaccuacugagug

SEQ ID NO: 1464016 - RNA, 16 nt, Homo sapiens
aaagacagaagcuuaa

SEQ ID NO: 1464017 - RNA, 22 nt, Homo sapiens
aaagaccuuuuccaugcacccu

SEQ ID NO: 1464018 - RNA, 17 nt, Homo sapiens
aaagacuguacaaagua

SEQ ID NO: 1464019 - RNA, 11 nt, Homo sapiens
aaagacuguag

SEQ ID NO: 1464020 - RNA, 21 nt, Homo sapiens
aaagagcaacaauccaucucu

SEQ ID NO: 1464021 - RNA, 16 nt, Homo sapiens
aaagagccuggagaag

SEQ ID NO: 1464022 - RNA, 22 nt, Homo sapiens
aaagaggcugccccucucacca

SEQ ID NO: 1464023 - RNA, 14 nt, Homo sapiens
aaagagggcuuccu

SEQ ID NO: 1464024 - RNA, 17 nt, Homo sapiens
aaagagggcuuccucua

SEQ ID NO: 1464025 - RNA, 16 nt, Homo sapiens
aaagaugaaguuuuau

SEQ ID NO: 1464026 - RNA, 21 nt, Homo sapiens
aaagaugaucuacucagaaau

SEQ ID NO: 1464027 - RNA, 23 nt, Homo sapiens
aaagaugguggagauuggcaugc

SEQ ID NO: 1464028 - RNA, 17 nt, Homo sapiens
aaagauuguuggaugaa

SEQ ID NO: 1464029 - RNA, 17 nt, Homo sapiens
aaagcaaaugacuagua

SEQ ID NO: 1464030 - RNA, 23 nt, Homo sapiens
aaagcaauauuuuggaguauguu

SEQ ID NO: 1464031 - RNA, 22 nt, Homo sapiens
aaagcagacagcuccacccugg

SEQ ID NO: 1464032 - RNA, 12 nt, Homo sapiens
aaagcagcaucu

SEQ ID NO: 1464033 - RNA, 12 nt, Homo sapiens
aaagcagccacg

SEQ ID NO: 1464034 - RNA, 16 nt, Homo sapiens
aaagcagccacgaggu

SEQ ID NO: 1464035 - RNA, 21 nt, Homo sapiens
aaagcaguaaauuugcuagca

SEQ ID NO: 1464036 - RNA, 14 nt, Homo sapiens
aaagcauccaugug

SEQ ID NO: 1464037 - RNA, 17 nt, Homo sapiens
aaagcaucuaucucauc

SEQ ID NO: 1464038 - RNA, 18 nt, Homo sapiens
aaagccaaauaaaaaucu

SEQ ID NO: 1464039 - RNA, 18 nt, Homo sapiens
aaagcccaaccuccugac

SEQ ID NO: 1464040 - RNA, 18 nt, Homo sapiens
aaagccccaaaugguggu

SEQ ID NO: 1464041 - RNA, 16 nt, Homo sapiens
aaagccucgggccaca

SEQ ID NO: 1464042 - RNA, 16 nt, Homo sapiens
aaagccuuguguauau

SEQ ID NO: 1464043 - RNA, 17 nt, Homo sapiens
aaagccuuuuccagaag

SEQ ID NO: 1464044 - RNA, 23 nt, Homo sapiens
aaagccuuuuccagaagaucuga

SEQ ID NO: 1464045 - RNA, 15 nt, Homo sapiens
aaagcuaaauuccac

SEQ ID NO: 1464046 - RNA, 17 nt, Homo sapiens
aaagcuagguguuuaau

SEQ ID NO: 1464047 - RNA, 18 nt, Homo sapiens
aaagcuuuaaaugucugc

SEQ ID NO: 1464048 - RNA, 15 nt, Homo sapiens
aaaggaaaccaagug

SEQ ID NO: 1464049 - RNA, 15 nt, Homo sapiens
aaaggaacaguugca

SEQ ID NO: 1464050 - RNA, 20 nt, Homo sapiens
aaaggaagcuccacugucac

SEQ ID NO: 1464051 - RNA, 22 nt, Homo sapiens
aaaggacucugcuucaguccac

SEQ ID NO: 1464052 - RNA, 19 nt, Homo sapiens
aaaggauaugguagcauuu

SEQ ID NO: 1464053 - RNA, 17 nt, Homo sapiens
aaaggcaguucagucca

SEQ ID NO: 1464054 - RNA, 16 nt, Homo sapiens
aaaugccuccauggca

SEQ ID NO: 1464055 - RNA, 21 nt, Homo sapiens
aaaugcuagguuaauuccaau

SEQ ID NO: 1464056 - RNA, 17 nt, Homo sapiens
aaaugcucucucaaauu

SEQ ID NO: 1464057 - RNA, 15 nt, Homo sapiens
aaauggcagaaccaa

SEQ ID NO: 1464058 - RNA, 15 nt, Homo sapiens
aaauggccaaauaua

SEQ ID NO: 1464059 - RNA, 22 nt, Homo sapiens
aaauggugcugcagauuugaua

SEQ ID NO: 1464060 - RNA, 13 nt, Homo sapiens
aaauguaacugug

SEQ ID NO: 1464061 - RNA, 19 nt, Homo sapiens
aaauguaacugugccaguu

SEQ ID NO: 1464062 - RNA, 20 nt, Homo sapiens
aaauguaauacuccuaagac

SEQ ID NO: 1464063 - RNA, 15 nt, Homo sapiens
aaauguaauugaaua

SEQ ID NO: 1464064 - RNA, 11 nt, Homo sapiens
aaauguacaau

SEQ ID NO: 1464065 - RNA, 16 nt, Homo sapiens
aaauguacauuaauua

SEQ ID NO: 1464066 - RNA, 12 nt, Homo sapiens
aaauguagcaau

SEQ ID NO: 1464067 - RNA, 14 nt, Homo sapiens
aaauguauacuaua

SEQ ID NO: 1464068 - RNA, 15 nt, Homo sapiens
aaauguauacuauag

SEQ ID NO: 1464069 - RNA, 12 nt, Homo sapiens
aaauguaugugc

SEQ ID NO: 1464070 - RNA, 16 nt, Homo sapiens
aaauguccguguaaaa

SEQ ID NO: 1464071 - RNA, 23 nt, Homo sapiens
aaaugucuauuauuaugaagaau

SEQ ID NO: 1464072 - RNA, 19 nt, Homo sapiens
aaaugucuuuguaagucag

SEQ ID NO: 1464073 - RNA, 16 nt, Homo sapiens
aaaugugaagugaaug

SEQ ID NO: 1464074 - RNA, 13 nt, Homo sapiens
aaauguggauuaa

SEQ ID NO: 1464075 - RNA, 19 nt, Homo sapiens
aaaugugguuacacacuuu

SEQ ID NO: 1464076 - RNA, 14 nt, Homo sapiens
aaauguuaugacua

SEQ ID NO: 1464077 - RNA, 18 nt, Homo sapiens
aaauguuaugacuaugua

SEQ ID NO: 1464078 - RNA, 22 nt, Homo sapiens
aaauguuauuuuuuaauuauua

SEQ ID NO: 1464079 - RNA, 18 nt, Homo sapiens
aaauguugagaaucccaa

SEQ ID NO: 1464080 - RNA, 14 nt, Homo sapiens
aaauuaaaaccaau

SEQ ID NO: 1464081 - RNA, 15 nt, Homo sapiens
aaauuaaaaccaauu

SEQ ID NO: 1464082 - RNA, 20 nt, Homo sapiens
aaauuacacaguuaaugcca

SEQ ID NO: 1464083 - RNA, 17 nt, Homo sapiens
aaauuagcugugugaaa

SEQ ID NO: 1464084 - RNA, 17 nt, Homo sapiens
aaauuaugaccauggua

SEQ ID NO: 1464085 - RNA, 18 nt, Homo sapiens
aaauuauguauguuuaca

SEQ ID NO: 1464086 - RNA, 14 nt, Homo sapiens
aaauuaugugacau

SEQ ID NO: 1464087 - RNA, 15 nt, Homo sapiens
aaauucagaugcugu

SEQ ID NO: 1464088 - RNA, 17 nt, Homo sapiens
aaauucagaugcuguua

SEQ ID NO: 1464089 - RNA, 22 nt, Homo sapiens
aaauuccccaagcaccuucccc

SEQ ID NO: 1464090 - RNA, 19 nt, Homo sapiens
aaauucuagagccagcugu

SEQ ID NO: 1464091 - RNA, 20 nt, Homo sapiens
aaauucuauaggaacauaug

SEQ ID NO: 1464092 - RNA, 14 nt, Homo sapiens
aaauucucugcgau

SEQ ID NO: 1464093 - RNA, 9 nt, Homo sapiens
aaauucugu

SEQ ID NO: 1464094 - RNA, 20 nt, Homo sapiens
aaauugcuucuuuaccaagg

SEQ ID NO: 1464095 - RNA, 13 nt, Homo sapiens
aaauuguguuucc

SEQ ID NO: 1464096 - RNA, 19 nt, Homo sapiens
aaauuucacuucaggagaa

SEQ ID NO: 1464097 - RNA, 20 nt, Homo sapiens
aaauuuuucuuuucuugauu

SEQ ID NO: 1464098 - RNA, 21 nt, Homo sapiens
aacaaaaaaaccucuaugcaa

SEQ ID NO: 1464099 - RNA, 21 nt, Homo sapiens
aaacaccacuaauuguguaca

SEQ ID NO: 1464100 - RNA, 22 nt, Homo sapiens
aaacaccguguuuucugacaca

SEQ ID NO: 1464101 - RNA, 23 nt, Homo sapiens
aaacaccguguuuucugacacag

SEQ ID NO: 1464102 - RNA, 16 nt, Homo sapiens
aaacagaacaggguca

SEQ ID NO: 1464103 - RNA, 14 nt, Homo sapiens
aaacagaucugaau

SEQ ID NO: 1464104 - RNA, 16 nt, Homo sapiens
aaacagauuucauacc

SEQ ID NO: 1464105 - RNA, 20 nt, Homo sapiens
aaacagcagauuucagauca

SEQ ID NO: 1464106 - RNA, 20 nt, Homo sapiens
aaacagccaagauuuuccuc

SEQ ID NO: 1464107 - RNA, 22 nt, Homo sapiens
aaacaggcaguuggccagagag

SEQ ID NO: 1464108 - RNA, 22 nt, Homo sapiens
aaacaggguuugauagcacuua

SEQ ID NO: 1464109 - RNA, 24 nt, Homo sapiens
aaacaggguuugauagcacuuaaa

SEQ ID NO: 1464110 - RNA, 23 nt, Homo sapiens
aaacauaauaaaucacacauuca

SEQ ID NO: 1464111 - RNA, 19 nt, Homo sapiens
aaacaugaccuuccacaau

SEQ ID NO: 1464112 - RNA, 17 nt, Homo sapiens
aaacaugauuguuuaca

SEQ ID NO: 1464113 - RNA, 16 nt, Homo sapiens
aaacauguaugugcau

SEQ ID NO: 1464114 - RNA, 17 nt, Homo sapiens
aaaccaaggacugagca

SEQ ID NO: 1464115 - RNA, 15 nt, Homo sapiens
aaaccaauucaccaa

SEQ ID NO: 1464116 - RNA, 16 nt, Homo sapiens
aaaccaccaggcaucc

SEQ ID NO: 1464117 - RNA, 21 nt, Homo sapiens
aaaccacuagaacucuccauc

SEQ ID NO: 1464118 - RNA, 14 nt, Homo sapiens
aaaccaggacauua

SEQ ID NO: 1464119 - RNA, 11 nt, Homo sapiens
aaaccaugacu

SEQ ID NO: 1464120 - RNA, 13 nt, Homo sapiens
aaacccaauccaa

SEQ ID NO: 1464121 - RNA, 15 nt, Homo sapiens
aaaccccaaacuguu

SEQ ID NO: 1464122 - RNA, 19 nt, Homo sapiens
aaaccccaucuuuacuaaa

SEQ ID NO: 1464123 - RNA, 14 nt, Homo sapiens
aaaccucaaaaugu

SEQ ID NO: 1464124 - RNA, 14 nt, Homo sapiens
aaaccucuaugcaa

SEQ ID NO: 1464125 - RNA, 22 nt, Homo sapiens
aaaccugggaccccgagcuucc

SEQ ID NO: 1464126 - RNA, 23 nt, Homo sapiens
aaaccuguagaugcagaaaaaga

SEQ ID NO: 1464127 - RNA, 13 nt, Homo sapiens
aaaccuuccccag

SEQ ID NO: 1464128 - RNA, 17 nt, Homo sapiens
aaacgagggcugaugga

SEQ ID NO: 1464129 - RNA, 22 nt, Homo sapiens
aaacgauucugagccauucaca

SEQ ID NO: 1464130 - RNA, 16 nt, Homo sapiens
aaacggauuccaaaga

SEQ ID NO: 1464131 - RNA, 14 nt, Homo sapiens
aaacgucuaggaaa

SEQ ID NO: 1464132 - RNA, 16 nt, Homo sapiens
aaacuaaaagacauuu

SEQ ID NO: 1464133 - RNA, 23 nt, Homo sapiens
aaacuaagagcucucaagucaag

SEQ ID NO: 1464134 - RNA, 12 nt, Homo sapiens
aaacuacuucuu

SEQ ID NO: 1464135 - RNA, 21 nt, Homo sapiens
aaacuauacacuuaaugauac

SEQ ID NO: 1464136 - RNA, 20 nt, Homo sapiens
aaacucagggacagagccau

SEQ ID NO: 1464137 - RNA, 17 nt, Homo sapiens
aaacucauuggcuuaaa

SEQ ID NO: 1464138 - RNA, 16 nt, Homo sapiens
aaacugacuuuauccu

SEQ ID NO: 1464139 - RNA, 21 nt, Homo sapiens
aaacugauuucuucagaauua

SEQ ID NO: 1464140 - RNA, 20 nt, Homo sapiens
aaacugauuuuuagcuuuac

SEQ ID NO: 1464141 - RNA, 20 nt, Homo sapiens
aaacugcauuuccuuucuac

SEQ ID NO: 1464142 - RNA, 21 nt, Homo sapiens
aaacugcuuacuuaugccaua

SEQ ID NO: 1464143 - RNA, 19 nt, Homo sapiens
aaacuguacagaauuucca

SEQ ID NO: 1464144 - RNA, 14 nt, Homo sapiens
aaacugucuugccc

SEQ ID NO: 1464145 - RNA, 21 nt, Homo sapiens
ccagaggaauaacuuagcuug

SEQ ID NO: 1464146 - RNA, 14 nt, Homo sapiens
ccagaggagggcag

SEQ ID NO: 1464147 - RNA, 18 nt, Homo sapiens
ccagaggaugucacaaag

SEQ ID NO: 1464148 - RNA, 12 nt, Homo sapiens
ccagaggcaucu

SEQ ID NO: 1464149 - RNA, 20 nt, Homo sapiens
ccagagucuagcguagugca

SEQ ID NO: 1464150 - RNA, 15 nt, Homo sapiens
ccagauauuucacau

SEQ ID NO: 1464151 - RNA, 12 nt, Homo sapiens
ccagauccagcc

SEQ ID NO: 1464152 - RNA, 22 nt, Homo sapiens
ccagauccuucaaagagucaua

SEQ ID NO: 1464153 - RNA, 17 nt, Homo sapiens
ccagaucgcaccacugc

SEQ ID NO: 1464154 - RNA, 18 nt, Homo sapiens
ccagaugagaagucugcu

SEQ ID NO: 1464155 - RNA, 19 nt, Homo sapiens
ccagaugagaagucugcua

SEQ ID NO: 1464156 - RNA, 22 nt, Homo sapiens
ccagaugcccuuuggaaagcca

SEQ ID NO: 1464157 - RNA, 19 nt, Homo sapiens
ccagaugucgcccuacuca

SEQ ID NO: 1464158 - RNA, 16 nt, Homo sapiens
ccagauguuggaccaa

SEQ ID NO: 1464159 - RNA, 18 nt, Homo sapiens
ccagauguuuccagacuu

SEQ ID NO: 1464160 - RNA, 16 nt, Homo sapiens
ccagauucuaccacac

SEQ ID NO: 1464161 - RNA, 22 nt, Homo sapiens
ccagauugacgacaagugcuga

SEQ ID NO: 1464162 - RNA, 23 nt, Homo sapiens
ccagauugacgacaagugcugaa

SEQ ID NO: 1464163 - RNA, 22 nt, Homo sapiens
ccagcaaaagagcuauugccaa

SEQ ID NO: 1464164 - RNA, 17 nt, Homo sapiens
ccagcaaugacaucuca

SEQ ID NO: 1464165 - RNA, 22 nt, Homo sapiens
ccagcaaugacaucucaggggc

SEQ ID NO: 1464166 - RNA, 18 nt, Homo sapiens
ccauccuucccuuuggag

SEQ ID NO: 1464167 - RNA, 14 nt, Homo sapiens
ccaucgaagcagau

SEQ ID NO: 1464168 - RNA, 14 nt, Homo sapiens
ccaucuaugagcug

SEQ ID NO: 1464169 - RNA, 21 nt, Homo sapiens
ccaucugccaaaaauuacuga

SEQ ID NO: 1464170 - RNA, 23 nt, Homo sapiens
ccaugaacagcauuagaauuuac

SEQ ID NO: 1464171 - RNA, 19 nt, Homo sapiens
ccaugaagcgaaacacaga

SEQ ID NO: 1464172 - RNA, 21 nt, Homo sapiens
ccaugagacccuggugccugg

SEQ ID NO: 1464173 - RNA, 20 nt, Homo sapiens
ccaugaggcaaugucaggaa

SEQ ID NO: 1464174 - RNA, 22 nt, Homo sapiens
ccaugauggccuuacacugaaa

SEQ ID NO: 1464175 - RNA, 21 nt, Homo sapiens
ccaugccaggaaccuguccua

SEQ ID NO: 1464176 - RNA, 15 nt, Homo sapiens
ccaugcucaaccacu

SEQ ID NO: 1464177 - RNA, 22 nt, Homo sapiens
ccauggacacuccagugccagc

SEQ ID NO: 1464178 - RNA, 21 nt, Homo sapiens
ccauggagggggcuugcacuc

SEQ ID NO: 1464179 - RNA, 16 nt, Homo sapiens
ccauguacaugaagaa

SEQ ID NO: 1464180 - RNA, 20 nt, Homo sapiens
ccauguauucauccagaguu

SEQ ID NO: 1464181 - RNA, 17 nt, Homo sapiens
ccauguauuuaucucua

SEQ ID NO: 1464182 - RNA, 10 nt, Homo sapiens
ccauguccaa

SEQ ID NO: 1464183 - RNA, 15 nt, Homo sapiens
ccauuaaaguucuca

SEQ ID NO: 1464184 - RNA, 15 nt, Homo sapiens
ccauuaauccaggga

SEQ ID NO: 1464185 - RNA, 15 nt, Homo sapiens
ccauucacuacaggu

SEQ ID NO: 1464186 - RNA, 22 nt, Homo sapiens
ccauuccacuccacucagguuc

SEQ ID NO: 1464187 - RNA, 16 nt, Homo sapiens
ccauuccugaucccau

SEQ ID NO: 1464188 - RNA, 13 nt, Homo sapiens
ccauugagacuau

SEQ ID NO: 1464189 - RNA, 16 nt, Homo sapiens
ccauugagacuauuua

SEQ ID NO: 1464190 - RNA, 20 nt, Homo sapiens
ccauugccccagaccuggaa

SEQ ID NO: 1464191 - RNA, 15 nt, Homo sapiens
ccauuggauuacuuu

SEQ ID NO: 1464192 - RNA, 21 nt, Homo sapiens
ccauuuauaauguuaguagaa

SEQ ID NO: 1464193 - RNA, 21 nt, Homo sapiens
ccauuuguuggggcaguggua

SEQ ID NO: 1464194 - RNA, 21 nt, Homo sapiens
ccauuuucaacugcuuugaaa

SEQ ID NO: 1464195 - RNA, 14 nt, Homo sapiens
ccauuuugcaaaau

SEQ ID NO: 1464196 - RNA, 18 nt, Homo sapiens
ccauuuuggugucuuucu

SEQ ID NO: 1464197 - RNA, 16 nt, Homo sapiens
ccauuuuuaaaauaca

SEQ ID NO: 1464198 - RNA, 13 nt, Homo sapiens
cccaaaacacagg

SEQ ID NO: 1464199 - RNA, 18 nt, Homo sapiens
cccaaauucuuucagugg

SEQ ID NO: 1464200 - RNA, 13 nt, Homo sapiens
cccaacccauuca

SEQ ID NO: 1464201 - RNA, 13 nt, Homo sapiens
cccaacccuggcu

SEQ ID NO: 1464202 - RNA, 16 nt, Homo sapiens
cccaacugacuuguau

SEQ ID NO: 1464203 - RNA, 23 nt, Homo sapiens
cccaacugaguguuauuugcaca

SEQ ID NO: 1464204 - RNA, 18 nt, Homo sapiens
cccaacuucauacuggca

SEQ ID NO: 1464205 - RNA, 19 nt, Homo sapiens
cccaacuucauacuggcag

SEQ ID NO: 1464206 - RNA, 21 nt, Homo sapiens
cccaagacaugaagacaucuu

SEQ ID NO: 1464207 - RNA, 17 nt, Homo sapiens
cccaagaugucaaaaca

SEQ ID NO: 1464208 - RNA, 22 nt, Homo sapiens
cccaagcugccucugggccaug

SEQ ID NO: 1464209 - RNA, 15 nt, Homo sapiens
cccaagucacaccca

SEQ ID NO: 1464210 - RNA, 15 nt, Homo sapiens
cccaagucccuguca

SEQ ID NO: 1464211 - RNA, 22 nt, Homo sapiens
cccaagucccugucauuugaac

SEQ ID NO: 1464212 - RNA, 18 nt, Homo sapiens
cccaagugaaaucaaagg

SEQ ID NO: 1464213 - RNA, 13 nt, Homo sapiens
cccaaugccugcu

SEQ ID NO: 1464214 - RNA, 16 nt, Homo sapiens
cccacaaccacaugua

SEQ ID NO: 1464215 - RNA, 16 nt, Homo sapiens
cccacaacgacuuuau

SEQ ID NO: 1464216 - RNA, 15 nt, Homo sapiens
cccacagaaccuuca

SEQ ID NO: 1464217 - RNA, 14 nt, Homo sapiens
cccacagacugguu

SEQ ID NO: 1464218 - RNA, 17 nt, Homo sapiens
cccacagcuaccugaga

SEQ ID NO: 1464219 - RNA, 23 nt, Homo sapiens
cccacagcugagaauguggaaua

SEQ ID NO: 1464220 - RNA, 20 nt, Homo sapiens
cccaccagagugaugugugg

SEQ ID NO: 1464221 - RNA, 14 nt, Homo sapiens
cccaccagguguca

SEQ ID NO: 1464222 - RNA, 13 nt, Homo sapiens
cccacccagucuc

SEQ ID NO: 1464223 - RNA, 23 nt, Homo sapiens
cccaccccuagccaccagugucc

SEQ ID NO: 1464224 - RNA, 18 nt, Homo sapiens
cccacgugucuuccacuu

SEQ ID NO: 1464225 - RNA, 16 nt, Homo sapiens
cccacuccagcgcuga

SEQ ID NO: 1464226 - RNA, 20 nt, Homo sapiens
cccagaacuucccugauuga

SEQ ID NO: 1464227 - RNA, 18 nt, Homo sapiens
cccagacaauuccauuca

SEQ ID NO: 1464228 - RNA, 20 nt, Homo sapiens
cccagacaauuccauucaau

SEQ ID NO: 1464229 - RNA, 13 nt, Homo sapiens
cccagacucugag

SEQ ID NO: 1464230 - RNA, 19 nt, Homo sapiens
cccagagacauacuugaag

SEQ ID NO: 1464231 - RNA, 22 nt, Homo sapiens
cccagagacauacuugaagggc

SEQ ID NO: 1464232 - RNA, 12 nt, Homo sapiens
cccagagcacuu

SEQ ID NO: 1464233 - RNA, 16 nt, Homo sapiens
cccagagucaucugau

SEQ ID NO: 1464234 - RNA, 21 nt, Homo sapiens
cccagagugugaaacuuccua

SEQ ID NO: 1464235 - RNA, 15 nt, Homo sapiens
cccagauacuuccca

SEQ ID NO: 1464236 - RNA, 19 nt, Homo sapiens
cccagauuccccuguguca

SEQ ID NO: 1464237 - RNA, 24 nt, Homo sapiens
cccagcaaaggggagucucagcuu

SEQ ID NO: 1464238 - RNA, 23 nt, Homo sapiens
cccagcagaggcaggcugggacg

SEQ ID NO: 1464239 - RNA, 15 nt, Homo sapiens
cccagcagggccuca

SEQ ID NO: 1464240 - RNA, 21 nt, Homo sapiens
cccagcaggugcugacuucau

SEQ ID NO: 1464241 - RNA, 13 nt, Homo sapiens
cccagcaucacuc

SEQ ID NO: 1464242 - RNA, 15 nt, Homo sapiens
cccagccacucggga

SEQ ID NO: 1464243 - RNA, 15 nt, Homo sapiens
cccagcccugcugca

SEQ ID NO: 1464244 - RNA, 13 nt, Homo sapiens
cccagccucuggc

SEQ ID NO: 1464245 - RNA, 12 nt, Homo sapiens
cccagcuacucg

SEQ ID NO: 1464246 - RNA, 13 nt, Homo sapiens
cccagcuacuuga

SEQ ID NO: 1464247 - RNA, 21 nt, Homo sapiens
cccagcuaucuauauggaauu

SEQ ID NO: 1464248 - RNA, 17 nt, Homo sapiens
cccagcucaaugcaaug

SEQ ID NO: 1464249 - RNA, 20 nt, Homo sapiens
ccaacugaguguuauuugca

SEQ ID NO: 1464250 - RNA, 21 nt, Homo sapiens
ccaacuucauuugaugcuaaa

SEQ ID NO: 1464251 - RNA, 21 nt, Homo sapiens
ccaacuuccuguugauguuca

SEQ ID NO: 1464252 - RNA, 22 nt, Homo sapiens
ccaacuugagggcccagagcag

SEQ ID NO: 1464253 - RNA, 13 nt, Homo sapiens
ccaagaacugcau

SEQ ID NO: 1464254 - RNA, 22 nt, Homo sapiens
ccaagacaaaaagccacaauga

SEQ ID NO: 1464255 - RNA, 16 nt, Homo sapiens
ccaagacagagacaga

SEQ ID NO: 1464256 - RNA, 15 nt, Homo sapiens
ccaagaguaacuuua

SEQ ID NO: 1464257 - RNA, 21 nt, Homo sapiens
ccaagcuuguuaucagcuuuc

SEQ ID NO: 1464258 - RNA, 12 nt, Homo sapiens
ccaagcuuucuu

SEQ ID NO: 1464259 - RNA, 22 nt, Homo sapiens
ccaaggaaacccccaguguaau

SEQ ID NO: 1464260 - RNA, 19 nt, Homo sapiens
ccaaggaaacgcuaccucu

SEQ ID NO: 1464261 - RNA, 16 nt, Homo sapiens
ccaaggauauuuacag

SEQ ID NO: 1464262 - RNA, 16 nt, Homo sapiens
ccaagggcaccuggag

SEQ ID NO: 1464263 - RNA, 18 nt, Homo sapiens
ccaaggguugagagccag

SEQ ID NO: 1464264 - RNA, 22 nt, Homo sapiens
ccaaguaaacaggguaccucaa

SEQ ID NO: 1464265 - RNA, 20 nt, Homo sapiens
ccaaguccuauccuaaauaa

SEQ ID NO: 1464266 - RNA, 16 nt, Homo sapiens
ccaauaaaaaguucag

SEQ ID NO: 1464267 - RNA, 20 nt, Homo sapiens
ccaauagcaaggcugugcau

SEQ ID NO: 1464268 - RNA, 15 nt, Homo sapiens
ccaaucaguuuauac

SEQ ID NO: 1464269 - RNA, 19 nt, Homo sapiens
ccaaucuuaaacauaauaa

SEQ ID NO: 1464270 - RNA, 14 nt, Homo sapiens
cauucaacugaaaa

SEQ ID NO: 1464271 - RNA, 16 nt, Homo sapiens
cauucaauauugacau

SEQ ID NO: 1464272 - RNA, 12 nt, Homo sapiens
cauucacauuca

SEQ ID NO: 1464273 - RNA, 13 nt, Homo sapiens
cauucacauucag

SEQ ID NO: 1464274 - RNA, 17 nt, Homo sapiens
cauucagagagcagcuu

SEQ ID NO: 1464275 - RNA, 19 nt, Homo sapiens
cauucagagcuauggugcu

SEQ ID NO: 1464276 - RNA, 21 nt, Homo sapiens
cauucagggcuauuuuuuccc

SEQ ID NO: 1464277 - RNA, 13 nt, Homo sapiens
cauucaguauuaa

SEQ ID NO: 1464278 - RNA, 23 nt, Homo sapiens
cauucaguuaauucaaugugaac

SEQ ID NO: 1464279 - RNA, 15 nt, Homo sapiens
cauucauccuuccau

SEQ ID NO: 1464280 - RNA, 16 nt, Homo sapiens
cauucaucucauucca

SEQ ID NO: 1464281 - RNA, 16 nt, Homo sapiens
cauuccauuugaagca

SEQ ID NO: 1464282 - RNA, 17 nt, Homo sapiens
cauucccucucaucuca

SEQ ID NO: 1464283 - RNA, 22 nt, Homo sapiens
cauuccucagcuucuucacagg

SEQ ID NO: 1464284 - RNA, 14 nt, Homo sapiens
cauuccugacaaag

SEQ ID NO: 1464285 - RNA, 17 nt, Homo sapiens
cauuccuuugucuucaa

SEQ ID NO: 1464286 - RNA, 17 nt, Homo sapiens
cauucuauuuuggguau

SEQ ID NO: 1464287 - RNA, 12 nt, Homo sapiens
cauucuccugcc

SEQ ID NO: 1464288 - RNA, 20 nt, Homo sapiens
cauugaaagagaaccaguuu

SEQ ID NO: 1464289 - RNA, 16 nt, Homo sapiens
cauugaacacaaacug

SEQ ID NO: 1464290 - RNA, 14 nt, Homo sapiens
cauugaacuuuaag

SEQ ID NO: 1464291 - RNA, 13 nt, Homo sapiens
caccaacuccuaa

SEQ ID NO: 1464292 - RNA, 19 nt, Homo sapiens
caccaacugaaguggcuaa

SEQ ID NO: 1464293 - RNA, 12 nt, Homo sapiens
caccacaaacuu

SEQ ID NO: 1464294 - RNA, 16 nt, Homo sapiens
caccacagacacacac

SEQ ID NO: 1464295 - RNA, 22 nt, Homo sapiens
caccacugaaacccugcacuua

SEQ ID NO: 1464296 - RNA, 19 nt, Homo sapiens
caccacugcucuccagccu

SEQ ID NO: 1464297 - RNA, 15 nt, Homo sapiens
caccagacacccagg

SEQ ID NO: 1464298 - RNA, 17 nt, Homo sapiens
caccagagcaaccucuc

SEQ ID NO: 1464299 - RNA, 21 nt, Homo sapiens
caccagcccugaccccagugu

SEQ ID NO: 1464300 - RNA, 18 nt, Homo sapiens
caccaggacucagaggau

SEQ ID NO: 1464301 - RNA, 16 nt, Homo sapiens
caccauaaccucuggg

SEQ ID NO: 1464302 - RNA, 12 nt, Homo sapiens
cacccaccagag

SEQ ID NO: 1464303 - RNA, 13 nt, Homo sapiens
cacccaccagagu

SEQ ID NO: 1464304 - RNA, 19 nt, Homo sapiens
cacccaccauauuguuuga

SEQ ID NO: 1464305 - RNA, 18 nt, Homo sapiens
cacccaccuaugugccaa

SEQ ID NO: 1464306 - RNA, 16 nt, Homo sapiens
cacccacgugcauuca

SEQ ID NO: 1464307 - RNA, 23 nt, Homo sapiens
cacccacgugcauucacauugac

SEQ ID NO: 1464308 - RNA, 13 nt, Homo sapiens
cacccaggcacuu

SEQ ID NO: 1464309 - RNA, 16 nt, Homo sapiens
cacccagugacugaca

SEQ ID NO: 1464310 - RNA, 14 nt, Homo sapiens
cacccccagcucaa

SEQ ID NO: 1464311 - RNA, 14 nt, Homo sapiens
caccccucugccaa

SEQ ID NO: 1464312 - RNA, 13 nt, Homo sapiens
caccccugcaguu

SEQ ID NO: 1464313 - RNA, 16 nt, Homo sapiens
cacccgcccacagcca

SEQ ID NO: 1464314 - RNA, 21 nt, Homo sapiens
cacccuccugccccacacucc

SEQ ID NO: 1464315 - RNA, 16 nt, Homo sapiens
cacccuggaggauuuc

SEQ ID NO: 1464316 - RNA, 23 nt, Homo sapiens
cacccuggggccuggaccugccu

SEQ ID NO: 1464317 - RNA, 15 nt, Homo sapiens
cacccugugccauca

SEQ ID NO: 1464318 - RNA, 19 nt, Homo sapiens
cacccuuggacaagacaaa

SEQ ID NO: 1464319 - RNA, 22 nt, Homo sapiens
cacccuuguccuugagugcucu

SEQ ID NO: 1464320 - RNA, 12 nt, Homo sapiens
caccguucugug

SEQ ID NO: 1464321 - RNA, 18 nt, Homo sapiens
caccuaauaggcugggag

SEQ ID NO: 1464322 - RNA, 20 nt, Homo sapiens
caccuaauccaggcagaucc

SEQ ID NO: 1464323 - RNA, 19 nt, Homo sapiens
caccuacgcgagucuuacu

SEQ ID NO: 1464324 - RNA, 13 nt, Homo sapiens
caccuaugugcca

SEQ ID NO: 1464325 - RNA, 16 nt, Homo sapiens
caccucacccggccuc

SEQ ID NO: 1464326 - RNA, 23 nt, Homo sapiens
caccuccgccagauccugcagaa

SEQ ID NO: 1464327 - RNA, 14 nt, Homo sapiens
caccugcacacucc

SEQ ID NO: 1464328 - RNA, 17 nt, Homo sapiens
caccuggcugagcaguu

SEQ ID NO: 1464329 - RNA, 15 nt, Homo sapiens
caccugggacaggga

SEQ ID NO: 1464330 - RNA, 14 nt, Homo sapiens
caccuguaauccca

SEQ ID NO: 1464331 - RNA, 14 nt, Homo sapiens
caccugucauucua

SEQ ID NO: 1464332 - RNA, 19 nt, Homo sapiens
caccuguucucacucccug

SEQ ID NO: 1464333 - RNA, 20 nt, Homo sapiens
caccuucaccuggaugugca

SEQ ID NO: 1464334 - RNA, 17 nt, Homo sapiens
caccuugccaagcuuuc

SEQ ID NO: 1464335 - RNA, 22 nt, Homo sapiens
caccuugcgauucugcagccac

SEQ ID NO: 1464336 - RNA, 22 nt, Homo sapiens
caccuuggcaccagacacccag

SEQ ID NO: 1464337 - RNA, 18 nt, Homo sapiens
cacgagugggaaggacuu

SEQ ID NO: 1464338 - RNA, 15 nt, Homo sapiens
cacgauuggagaaua

SEQ ID NO: 1464339 - RNA, 17 nt, Homo sapiens
cacgcaugugugcugca

SEQ ID NO: 1464340 - RNA, 22 nt, Homo sapiens
cacgccuguaaucccagcacuu

SEQ ID NO: 1464341 - RNA, 18 nt, Homo sapiens
cacggaggagggaugcug

SEQ ID NO: 1464342 - RNA, 17 nt, Homo sapiens
cacggcguuuuuuuaca

SEQ ID NO: 1464343 - RNA, 18 nt, Homo sapiens
cacgggcaugggcacucc

SEQ ID NO: 1464344 - RNA, 12 nt, Homo sapiens
cacggggcacag

SEQ ID NO: 1464345 - RNA, 16 nt, Homo sapiens
cacgguggcucaggcc

SEQ ID NO: 1464346 - RNA, 19 nt, Homo sapiens
cacgguuuggaaauauuca

SEQ ID NO: 1464347 - RNA, 20 nt, Homo sapiens
cacgugggcaaacaggcagu

SEQ ID NO: 1464348 - RNA, 14 nt, Homo sapiens
cacguuaccauuua

SEQ ID NO: 1464349 - RNA, 16 nt, Homo sapiens
cacuaaaagaucgcag

SEQ ID NO: 1464350 - RNA, 21 nt, Homo sapiens
cacuaaaccgauaaugcauga

SEQ ID NO: 1464351 - RNA, 13 nt, Homo sapiens
cacuaaagcuuca

SEQ ID NO: 1464352 - RNA, 22 nt, Homo sapiens
cacuaacauuucccccgagcuc

SEQ ID NO: 1464353 - RNA, 20 nt, Homo sapiens
cacuaaccaaaucucucaaa

SEQ ID NO: 1464354 - RNA, 18 nt, Homo sapiens
cacuaaggccgugucucu

SEQ ID NO: 1464355 - RNA, 14 nt, Homo sapiens
cacuacugcuaaau

SEQ ID NO: 1464356 - RNA, 21 nt, Homo sapiens
cacuacugggugucauuucau

SEQ ID NO: 1464357 - RNA, 12 nt, Homo sapiens
cacuagccugug

SEQ ID NO: 1464358 - RNA, 16 nt, Homo sapiens
cacuagccugugcacg

SEQ ID NO: 1464359 - RNA, 18 nt, Homo sapiens
cacuagggcagccgagug

SEQ ID NO: 1464360 - RNA, 12 nt, Homo sapiens
cacuagucucac

SEQ ID NO: 1464361 - RNA, 20 nt, Homo sapiens
cacuauaauguaagcucuac

SEQ ID NO: 1464362 - RNA, 15 nt, Homo sapiens
cacuaucauggacua

SEQ ID NO: 1464363 - RNA, 17 nt, Homo sapiens
cacucaggauugggaau

SEQ ID NO: 1464364 - RNA, 14 nt, Homo sapiens
cacucaggugaaaa

SEQ ID NO: 1464365 - RNA, 18 nt, Homo sapiens
cacucagguucuucaggg

SEQ ID NO: 1464366 - RNA, 22 nt, Homo sapiens
cacucaguuuaugcugugcuaa

SEQ ID NO: 1464367 - RNA, 15 nt, Homo sapiens
cacuccagcucugag

SEQ ID NO: 1464368 - RNA, 16 nt, Homo sapiens
cacuccagucuggcaa

SEQ ID NO: 1464369 - RNA, 13 nt, Homo sapiens
cacuccagugcca

SEQ ID NO: 1464370 - RNA, 21 nt, Homo sapiens
cacuccaguggcagacaaaca

SEQ ID NO: 1464371 - RNA, 14 nt, Homo sapiens
cacucccaccucac

SEQ ID NO: 1464372 - RNA, 20 nt, Homo sapiens
cacucccuguuuuaauucaa

SEQ ID NO: 1464373 - RNA, 14 nt, Homo sapiens
cacuccugaacccc

SEQ ID NO: 1464374 - RNA, 14 nt, Homo sapiens
cacucuaaacugca

SEQ ID NO: 1464375 - RNA, 22 nt, Homo sapiens
cacucuaccugaaccugcacac

SEQ ID NO: 1464376 - RNA, 16 nt, Homo sapiens
cacucucagugcuucu

SEQ ID NO: 1464377 - RNA, 22 nt, Homo sapiens
cacucucuaaaucuuccuugug

SEQ ID NO: 1464378 - RNA, 21 nt, Homo sapiens
cacucuuaucuacauaaggau

SEQ ID NO: 1464379 - RNA, 22 nt, Homo sapiens
cacugaaaaugucacauucuau

SEQ ID NO: 1464380 - RNA, 23 nt, Homo sapiens
cacugaacuccaccgaccaacug

SEQ ID NO: 1464381 - RNA, 15 nt, Homo sapiens
cacugacucaagaca

SEQ ID NO: 1464382 - RNA, 16 nt, Homo sapiens
cacugacucugacuca

SEQ ID NO: 1464383 - RNA, 17 nt, Homo sapiens
cacugacucugacucau

SEQ ID NO: 1464384 - RNA, 19 nt, Homo sapiens
cacugagaagauugugaau

SEQ ID NO: 1464385 - RNA, 20 nt, Homo sapiens
cacugagcuccccagaucuc

SEQ ID NO: 1464386 - RNA, 13 nt, Homo sapiens
cacugagggccac

SEQ ID NO: 1464387 - RNA, 19 nt, Homo sapiens
cacugaggguggcacucaa

SEQ ID NO: 1464388 - RNA, 15 nt, Homo sapiens
cacugauaagacugu

SEQ ID NO: 1464389 - RNA, 16 nt, Homo sapiens
cacugaucacccaaug

SEQ ID NO: 1464390 - RNA, 17 nt, Homo sapiens
cacugaugcuguucucu

SEQ ID NO: 1464391 - RNA, 15 nt, Homo sapiens
cacugcacuccagcu

SEQ ID NO: 1464392 - RNA, 11 nt, Homo sapiens
cacugcacugu

SEQ ID NO: 1464393 - RNA, 18 nt, Homo sapiens
cacugcagaacagcauca

SEQ ID NO: 1464394 - RNA, 19 nt, Homo sapiens
cacugccaggccagccucc

SEQ ID NO: 1464395 - RNA, 22 nt, Homo sapiens
cacugcccuguucaugugccuc

SEQ ID NO: 1464396 - RNA, 22 nt, Homo sapiens
cacugccuggcccaaaacgucu

SEQ ID NO: 1464397 - RNA, 16 nt, Homo sapiens
cacuggaccucagucc

SEQ ID NO: 1464398 - RNA, 15 nt, Homo sapiens
cacuggagcaugcag

SEQ ID NO: 1464399 - RNA, 18 nt, Homo sapiens
cacuggcagcaucuucac

SEQ ID NO: 1464400 - RNA, 15 nt, Homo sapiens
cacugggaguguccu

SEQ ID NO: 1464401 - RNA, 17 nt, Homo sapiens
cacugggccagcccugc

SEQ ID NO: 1464402 - RNA, 23 nt, Homo sapiens
cacuggggaggaauccuggacca

SEQ ID NO: 1464403 - RNA, 21 nt, Homo sapiens
cacugggggaacagaugcuaa

SEQ ID NO: 1464404 - RNA, 17 nt, Homo sapiens
cacuggguguugaucuu

SEQ ID NO: 1464405 - RNA, 16 nt, Homo sapiens
cacugguaacauguga

SEQ ID NO: 1464406 - RNA, 14 nt, Homo sapiens
cacuguacuuguag

SEQ ID NO: 1464407 - RNA, 17 nt, Homo sapiens
cacuguaugauuuauaa

SEQ ID NO: 1464408 - RNA, 16 nt, Homo sapiens
cacuguccaguauucu

SEQ ID NO: 1464409 - RNA, 18 nt, Homo sapiens
cacugucccuugccucaa

SEQ ID NO: 1464410 - RNA, 14 nt, Homo sapiens
cacuguccuaccag

SEQ ID NO: 1464411 - RNA, 15 nt, Homo sapiens
cacugugagcaccug

SEQ ID NO: 1464412 - RNA, 23 nt, Homo sapiens
cacugugagugaaaauuuuuaca

SEQ ID NO: 1464413 - RNA, 13 nt, Homo sapiens
cacuguuagcuuu

SEQ ID NO: 1464414 - RNA, 18 nt, Homo sapiens
cacuuaaaaaauguccau

SEQ ID NO: 1464415 - RNA, 16 nt, Homo sapiens
cacuuaaugauacaug

SEQ ID NO: 1464416 - RNA, 20 nt, Homo sapiens
cacuuaaugauacauguuuc

SEQ ID NO: 1464417 - RNA, 15 nt, Homo sapiens
cacuuacagaauuau

SEQ ID NO: 1464418 - RNA, 22 nt, Homo sapiens
cacuuauaagaaagaucaaaga

SEQ ID NO: 1464419 - RNA, 18 nt, Homo sapiens
cacuucaaugcacauggu

SEQ ID NO: 1464420 - RNA, 23 nt, Homo sapiens
cacuucagcugggucacauccau

SEQ ID NO: 1464421 - RNA, 16 nt, Homo sapiens
cacuucccuacaugga

SEQ ID NO: 1464422 - RNA, 15 nt, Homo sapiens
cacuuccuugccagu

SEQ ID NO: 1464423 - RNA, 22 nt, Homo sapiens
cacuucgcgugcccucgcugcu

SEQ ID NO: 1464424 - RNA, 16 nt, Homo sapiens
cacuucuaaaugcaua

SEQ ID NO: 1464425 - RNA, 21 nt, Homo sapiens
cacuucucucuccccaucccc

SEQ ID NO: 1464426 - RNA, 12 nt, Homo sapiens
cacuugaccuca

SEQ ID NO: 1464427 - RNA, 16 nt, Homo sapiens
cacuuggaugcagggu

SEQ ID NO: 1464428 - RNA, 23 nt, Homo sapiens
cacuuggggguaaaggucugugg

SEQ ID NO: 1464429 - RNA, 20 nt, Homo sapiens
cacuuuaccucuguggaccu

SEQ ID NO: 1464430 - RNA, 20 nt, Homo sapiens
cacuuugaaggggccucacc

SEQ ID NO: 1464431 - RNA, 14 nt, Homo sapiens
cacuuugcucuggg

SEQ ID NO: 1464432 - RNA, 18 nt, Homo sapiens
cacuuuuuaaaaucucaa

SEQ ID NO: 1464433 - RNA, 14 nt, Homo sapiens
cagaaaacaaaaaa

SEQ ID NO: 1464434 - RNA, 12 nt, Homo sapiens
cagaaaauuaca

SEQ ID NO: 1464435 - RNA, 15 nt, Homo sapiens
cagaaacagccauug

SEQ ID NO: 1464436 - RNA, 21 nt, Homo sapiens
cagaaacuagaaaugugaaug

SEQ ID NO: 1464437 - RNA, 18 nt, Homo sapiens
cagaaacuuuacaaccug

SEQ ID NO: 1464438 - RNA, 20 nt, Homo sapiens
cagaaaguaucacaaaugga

SEQ ID NO: 1464439 - RNA, 12 nt, Homo sapiens
cagaaaugcugc

SEQ ID NO: 1464440 - RNA, 21 nt, Homo sapiens
cagaacacagcaauuccucag

SEQ ID NO: 1464441 - RNA, 18 nt, Homo sapiens
cagaacacgagacagcuu

SEQ ID NO: 1464442 - RNA, 18 nt, Homo sapiens
cagaacagcaucauguca

SEQ ID NO: 1464443 - RNA, 18 nt, Homo sapiens
cagaacaucgauauguau

SEQ ID NO: 1464444 - RNA, 12 nt, Homo sapiens
cagaaccaaagc

SEQ ID NO: 1464445 - RNA, 14 nt, Homo sapiens
cagaacuacuucuu

SEQ ID NO: 1464446 - RNA, 22 nt, Homo sapiens
cagaacugcagucagcaugaau

SEQ ID NO: 1464447 - RNA, 16 nt, Homo sapiens
cagaacugcccccacu

SEQ ID NO: 1464448 - RNA, 13 nt, Homo sapiens
cagaacuucugaa

SEQ ID NO: 1464449 - RNA, 16 nt, Homo sapiens
cagaacuugaaggguu

SEQ ID NO: 1464450 - RNA, 21 nt, Homo sapiens
cagaacuugaaugugucaggu

SEQ ID NO: 1464451 - RNA, 18 nt, Homo sapiens
cagaagaauauucaggac

SEQ ID NO: 1464452 - RNA, 15 nt, Homo sapiens
cagaagaaugggaau

SEQ ID NO: 1464453 - RNA, 14 nt, Homo sapiens
cagaagacaaaaag

SEQ ID NO: 1464454 - RNA, 16 nt, Homo sapiens
cagaagacacugcaaa

SEQ ID NO: 1464455 - RNA, 17 nt, Homo sapiens
cagaagacccgcucucc

SEQ ID NO: 1464456 - RNA, 11 nt, Homo sapiens
cagaagaucug

SEQ ID NO: 1464457 - RNA, 16 nt, Homo sapiens
cagaagaugccagcuu

SEQ ID NO: 1464458 - RNA, 17 nt, Homo sapiens
cagaagcagaagugcaa

SEQ ID NO: 1464459 - RNA, 18 nt, Homo sapiens
cagaagcagaagugcaau

SEQ ID NO: 1464460 - RNA, 19 nt, Homo sapiens
cagaagcagcagaccuccu

SEQ ID NO: 1464461 - RNA, 14 nt, Homo sapiens
cagaagcauuucac

SEQ ID NO: 1464462 - RNA, 14 nt, Homo sapiens
cagaagccugaugc

SEQ ID NO: 1464463 - RNA, 17 nt, Homo sapiens
cagaagccuggacucug

SEQ ID NO: 1464464 - RNA, 14 nt, Homo sapiens
cagaagccuuggaa

SEQ ID NO: 1464465 - RNA, 13 nt, Homo sapiens
cagaagcuuaaaa

SEQ ID NO: 1464466 - RNA, 15 nt, Homo sapiens
auauuguacauaaaa

SEQ ID NO: 1464467 - RNA, 12 nt, Homo sapiens
auauugugauuc

SEQ ID NO: 1464468 - RNA, 14 nt, Homo sapiens
auauugugccccau

SEQ ID NO: 1464469 - RNA, 21 nt, Homo sapiens
auauuguugacaacugugacu

SEQ ID NO: 1464470 - RNA, 20 nt, Homo sapiens
auauuuacaauaaaugaaga

SEQ ID NO: 1464471 - RNA, 18 nt, Homo sapiens
auauuuaugucuauuuaa

SEQ ID NO: 1464472 - RNA, 13 nt, Homo sapiens
auauuucaggcau

SEQ ID NO: 1464473 - RNA, 18 nt, Homo sapiens
auauuugaagcaucacau

SEQ ID NO: 1464474 - RNA, 21 nt, Homo sapiens
auauuugaauuuuaaaucuaa

SEQ ID NO: 1464475 - RNA, 13 nt, Homo sapiens
auauuugcuagac

SEQ ID NO: 1464476 - RNA, 13 nt, Homo sapiens
auauuuggaagaa

SEQ ID NO: 1464477 - RNA, 19 nt, Homo sapiens
auauuugggccugcuccag

SEQ ID NO: 1464478 - RNA, 16 nt, Homo sapiens
auauuuugcauaguac

SEQ ID NO: 1464479 - RNA, 22 nt, Homo sapiens
auauuuuuaguagagacagggu

SEQ ID NO: 1464480 - RNA, 20 nt, Homo sapiens
aucaaaagggagagaacaaa

SEQ ID NO: 1464481 - RNA, 17 nt, Homo sapiens
aucaaagaaagaugaaa

SEQ ID NO: 1464482 - RNA, 15 nt, Homo sapiens
aucaaagagcacauu

SEQ ID NO: 1464483 - RNA, 23 nt, Homo sapiens
aucaaagugugauauacaaagug

SEQ ID NO: 1464484 - RNA, 23 nt, Homo sapiens
aucaaaucugcuuuuuaaagaau

SEQ ID NO: 1464485 - RNA, 12 nt, Homo sapiens
aucaaccaaaaa

SEQ ID NO: 1464486 - RNA, 13 nt, Homo sapiens
aucaacuuuagcu

SEQ ID NO: 1464487 - RNA, 17 nt, Homo sapiens
aucaagcccuuuacuug

SEQ ID NO: 1464488 - RNA, 22 nt, Homo sapiens
aucaaggaguacaaugcccaga

SEQ ID NO: 1464489 - RNA, 13 nt, Homo sapiens
aucaaggugcuga

SEQ ID NO: 1464490 - RNA, 19 nt, Homo sapiens
aucaaguccuuugugaaua

SEQ ID NO: 1464491 - RNA, 22 nt, Homo sapiens
aucaagucuuuuuuauauuuau

SEQ ID NO: 1464492 - RNA, 23 nt, Homo sapiens
aucaagugugcuuuagcuugaaa

SEQ ID NO: 1464493 - RNA, 13 nt, Homo sapiens
aucaaugcaagag

SEQ ID NO: 1464494 - RNA, 16 nt, Homo sapiens
aucaaugcaagaguga

SEQ ID NO: 1464495 - RNA, 22 nt, Homo sapiens
aucaaugcaagagugauugcag

SEQ ID NO: 1464496 - RNA, 16 nt, Homo sapiens
aucaaugucacuuaaa

SEQ ID NO: 1464497 - RNA, 23 nt, Homo sapiens
aucaauguucacgcaacuugaaa

SEQ ID NO: 1464498 - RNA, 22 nt, Homo sapiens
aucaauuggaaaucaauccugu

SEQ ID NO: 1464499 - RNA, 15 nt, Homo sapiens
aucacaaauuucacu

SEQ ID NO: 1464500 - RNA, 19 nt, Homo sapiens
aucacacugggugguggcc

SEQ ID NO: 1464501 - RNA, 12 nt, Homo sapiens
aucacaguauua

SEQ ID NO: 1464502 - RNA, 13 nt, Homo sapiens
aucacaguauuau

SEQ ID NO: 1464503 - RNA, 21 nt, Homo sapiens
aucacgucacugcacuccagc

SEQ ID NO: 1464504 - RNA, 22 nt, Homo sapiens
aucacgucacugcacuccagcu

SEQ ID NO: 1464505 - RNA, 16 nt, Homo sapiens
aucacuaaaccgauaa

SEQ ID NO: 1464506 - RNA, 16 nt, Homo sapiens
aucacuagccugucau

SEQ ID NO: 1464507 - RNA, 23 nt, Homo sapiens
aucacuccccaaggaagagccaa

SEQ ID NO: 1464508 - RNA, 19 nt, Homo sapiens
aucacugacucugacucau

SEQ ID NO: 1464509 - RNA, 19 nt, Homo sapiens
aucacuggguguugaucuu

SEQ ID NO: 1464510 - RNA, 21 nt, Homo sapiens
aucacuguauagacaugcuac

SEQ ID NO: 1464511 - RNA, 22 nt, Homo sapiens
aucagaccauaauguuacauua

SEQ ID NO: 1464512 - RNA, 13 nt, Homo sapiens
aucagaccaugaa

SEQ ID NO: 1464513 - RNA, 15 nt, Homo sapiens
aucagaccugcauug

SEQ ID NO: 1464514 - RNA, 24 nt, Homo sapiens
aucagaccugucuuccaaggagac

SEQ ID NO: 1464515 - RNA, 19 nt, Homo sapiens
aucagaguuccuccuacuu

SEQ ID NO: 1464516 - RNA, 13 nt, Homo sapiens
aucagcauuaguc

SEQ ID NO: 1464517 - RNA, 14 nt, Homo sapiens
aucagggaauccag

SEQ ID NO: 1464518 - RNA, 16 nt, Homo sapiens
aucaguaccucucaag

SEQ ID NO: 1464519 - RNA, 23 nt, Homo sapiens
aucagucaacaacuuacacuuau

SEQ ID NO: 1464520 - RNA, 18 nt, Homo sapiens
aucaguguuuuaaauucu

SEQ ID NO: 1464521 - RNA, 14 nt, Homo sapiens
aucaguguuuuaga

SEQ ID NO: 1464522 - RNA, 20 nt, Homo sapiens
aucaguucccccaguaccuc

SEQ ID NO: 1464523 - RNA, 14 nt, Homo sapiens
aucaguuggaguuu

SEQ ID NO: 1464524 - RNA, 19 nt, Homo sapiens
aucauaaacugacuaucau

SEQ ID NO: 1464525 - RNA, 16 nt, Homo sapiens
aucauaagacaaugga

SEQ ID NO: 1464526 - RNA, 22 nt, Homo sapiens
aucauaauucagcacuuaacua

SEQ ID NO: 1464527 - RNA, 21 nt, Homo sapiens
aucauauuaguauuaauacua

SEQ ID NO: 1464528 - RNA, 19 nt, Homo sapiens
aucaucaaaaacuuuggag

SEQ ID NO: 1464529 - RNA, 21 nt, Homo sapiens
aucauccccauccuccagaga

SEQ ID NO: 1464530 - RNA, 23 nt, Homo sapiens
aucaucuccaucauaugccugac

SEQ ID NO: 1464531 - RNA, 17 nt, Homo sapiens
aucaucuguagauacua

SEQ ID NO: 1464532 - RNA, 23 nt, Homo sapiens
aucaugaaaguccagcacuggaa

SEQ ID NO: 1464533 - RNA, 20 nt, Homo sapiens
aucaugccccuguacuccag

SEQ ID NO: 1464534 - RNA, 19 nt, Homo sapiens
aucauguccauacacuuug

SEQ ID NO: 1464535 - RNA, 20 nt, Homo sapiens
aucauuuacuuuuaaacuuu

SEQ ID NO: 1464536 - RNA, 18 nt, Homo sapiens
aucauuuuauuauaaucc

SEQ ID NO: 1464537 - RNA, 16 nt, Homo sapiens
auccaagaaucaguga

SEQ ID NO: 1464538 - RNA, 21 nt, Homo sapiens
auccaauauguuuccaucacu

SEQ ID NO: 1464539 - RNA, 23 nt, Homo sapiens
auccacccgggggagcccaguga

SEQ ID NO: 1464540 - RNA, 23 nt, Homo sapiens
auccaccuuggcucugccagugg

SEQ ID NO: 1464541 - RNA, 20 nt, Homo sapiens
auccacucuucuagggauau

SEQ ID NO: 1464542 - RNA, 21 nt, Homo sapiens
auccacugggcacaacugcaa

SEQ ID NO: 1464543 - RNA, 23 nt, Homo sapiens
auccagagagcuuaaauugucau

SEQ ID NO: 1464544 - RNA, 18 nt, Homo sapiens
auccagaggguugugauu

SEQ ID NO: 1464545 - RNA, 14 nt, Homo sapiens
auccagcaguguug

SEQ ID NO: 1464546 - RNA, 15 nt, Homo sapiens
auccagcccaugccg

SEQ ID NO: 1464547 - RNA, 14 nt, Homo sapiens
auccaggaggcaga

SEQ ID NO: 1464548 - RNA, 18 nt, Homo sapiens
aucccgugaaagaauuau

SEQ ID NO: 1464549 - RNA, 13 nt, Homo sapiens
aucccuacaugua

SEQ ID NO: 1464550 - RNA, 14 nt, Homo sapiens
aucccuccauucau

SEQ ID NO: 1464551 - RNA, 22 nt, Homo sapiens
aucccuccauucauccuuccau

SEQ ID NO: 1464552 - RNA, 15 nt, Homo sapiens
aucccucucuucccc

SEQ ID NO: 1464553 - RNA, 23 nt, Homo sapiens
aucccuggggcugugcauuccca

SEQ ID NO: 1464554 - RNA, 13 nt, Homo sapiens
aucccuguaauau

SEQ ID NO: 1464555 - RNA, 20 nt, Homo sapiens
aucccuuccucucaggcucu

SEQ ID NO: 1464556 - RNA, 20 nt, Homo sapiens
aucccuuuuucaaugaauuu

SEQ ID NO: 1464557 - RNA, 13 nt, Homo sapiens
auccgaaguauga

SEQ ID NO: 1464558 - RNA, 19 nt, Homo sapiens
auccgaaguaugagggaaa

SEQ ID NO: 1464559 - RNA, 20 nt, Homo sapiens
auccuaccccuuugcacuug

SEQ ID NO: 1464560 - RNA, 21 nt, Homo sapiens
auccuaccccuuugcacuugu

SEQ ID NO: 1464561 - RNA, 17 nt, Homo sapiens
auccuagucauucuucc

SEQ ID NO: 1464562 - RNA, 11 nt, Homo sapiens
auccuauuuau

SEQ ID NO: 1464563 - RNA, 15 nt, Homo sapiens
auccucacaaccacc

SEQ ID NO: 1464564 - RNA, 20 nt, Homo sapiens
auccucacugggugggguga

SEQ ID NO: 1464565 - RNA, 17 nt, Homo sapiens
auccucacuuugcugcc

SEQ ID NO: 1464566 - RNA, 15 nt, Homo sapiens
auccuccaguaccuu

SEQ ID NO: 1464567 - RNA, 15 nt, Homo sapiens
auccucccaccucag

SEQ ID NO: 1464568 - RNA, 20 nt, Homo sapiens
auccucccaccucagcuucu

SEQ ID NO: 1464569 - RNA, 18 nt, Homo sapiens
auccucccuccaccucaa

SEQ ID NO: 1464570 - RNA, 23 nt, Homo sapiens
auccucucccccuccuccaggga

SEQ ID NO: 1464571 - RNA, 20 nt, Homo sapiens
auccugcagaaguacuccua

SEQ ID NO: 1464572 - RNA, 22 nt, Homo sapiens
auccugccagccccacacagcu

SEQ ID NO: 1464573 - RNA, 22 nt, Homo sapiens
auccugguuucauaacuuccug

SEQ ID NO: 1464574 - RNA, 20 nt, Homo sapiens
auccuguaccaaaucugaca

SEQ ID NO: 1464575 - RNA, 20 nt, Homo sapiens
auccuguauaagcacugaaa

SEQ ID NO: 1464576 - RNA, 17 nt, Homo sapiens
auccuuaaaacaauucu

SEQ ID NO: 1464577 - RNA, 15 nt, Homo sapiens
auccuuaaaggugag

SEQ ID NO: 1464578 - RNA, 13 nt, Homo sapiens
auccuuccaacau

SEQ ID NO: 1464579 - RNA, 18 nt, Homo sapiens
auccuucuggcuguagau

SEQ ID NO: 1464580 - RNA, 21 nt, Homo sapiens
auccuuuaccacucuaccaaa

SEQ ID NO: 1464581 - RNA, 19 nt, Homo sapiens
aucgaaucuacuaauucca

SEQ ID NO: 1464582 - RNA, 19 nt, Homo sapiens
aucgagaccauccuggcua

SEQ ID NO: 1464583 - RNA, 18 nt, Homo sapiens
aucgcacacuggggcccc

SEQ ID NO: 1464584 - RNA, 16 nt, Homo sapiens
aucgcaccacugcacu

SEQ ID NO: 1464585 - RNA, 15 nt, Homo sapiens
aucgcgccacugcac

SEQ ID NO: 1464586 - RNA, 13 nt, Homo sapiens
aucgguaggcaaa

SEQ ID NO: 1464587 - RNA, 18 nt, Homo sapiens
aucgugaaaccccaucuc

SEQ ID NO: 1464588 - RNA, 23 nt, Homo sapiens
aucuaacgcuuuaaauggcuacu

SEQ ID NO: 1464589 - RNA, 18 nt, Homo sapiens
aucuaaggaugucacagg

SEQ ID NO: 1464590 - RNA, 14 nt, Homo sapiens
aucuacaacuccaa

SEQ ID NO: 1464591 - RNA, 19 nt, Homo sapiens
aucuacauaaggaugaagg

SEQ ID NO: 1464592 - RNA, 11 nt, Homo sapiens
aucuaccagca

SEQ ID NO: 1464593 - RNA, 14 nt, Homo sapiens
aucuacuaauucca

SEQ ID NO: 1464594 - RNA, 16 nt, Homo sapiens
aucuacuaauuccaca

SEQ ID NO: 1464595 - RNA, 22 nt, Homo sapiens
aucuacuccuuguaaagacugu

SEQ ID NO: 1464596 - RNA, 18 nt, Homo sapiens
aucuacuucaacacuuca

SEQ ID NO: 1464597 - RNA, 15 nt, Homo sapiens
aucuagaagacuguc

SEQ ID NO: 1464598 - RNA, 13 nt, Homo sapiens
aucuauacauacc

SEQ ID NO: 1464599 - RNA, 14 nt, Homo sapiens
aucuaucaacuaua

SEQ ID NO: 1464600 - RNA, 15 nt, Homo sapiens
aucuaucaacuauaa

SEQ ID NO: 1464601 - RNA, 15 nt, Homo sapiens
aucuauuucacuuau

SEQ ID NO: 1464602 - RNA, 15 nt, Homo sapiens
aucucaaagaaggca

SEQ ID NO: 1464603 - RNA, 14 nt, Homo sapiens
aucucaauuugcag

SEQ ID NO: 1464604 - RNA, 13 nt, Homo sapiens
aucucagcacuuu

SEQ ID NO: 1464605 - RNA, 15 nt, Homo sapiens
aucucauugcuuaca

SEQ ID NO: 1464606 - RNA, 22 nt, Homo sapiens
aucucauugcuuacaagccuaa

SEQ ID NO: 1464607 - RNA, 20 nt, Homo sapiens
aucucccacccuguaccuca

SEQ ID NO: 1464608 - RNA, 14 nt, Homo sapiens
aucucccacuccag

SEQ ID NO: 1464609 - RNA, 21 nt, Homo sapiens
aucuccucucucuuuccucca

SEQ ID NO: 1464610 - RNA, 19 nt, Homo sapiens
aucuccugugcauggguga

SEQ ID NO: 1464611 - RNA, 20 nt, Homo sapiens
aucucuaauuccauccauaa

SEQ ID NO: 1464612 - RNA, 20 nt, Homo sapiens
aucucuacuaccacaaggaa

SEQ ID NO: 1464613 - RNA, 13 nt, Homo sapiens
aucucuacugcuu

SEQ ID NO: 1464614 - RNA, 16 nt, Homo sapiens
aucucucaaaucuguu

SEQ ID NO: 1464615 - RNA, 22 nt, Homo sapiens
aucucucccuccccugccauuu

SEQ ID NO: 1464616 - RNA, 18 nt, Homo sapiens
aucucugcccucuucuca

SEQ ID NO: 1464617 - RNA, 16 nt, Homo sapiens
aucucuuauuuuacaa

SEQ ID NO: 1464618 - RNA, 16 nt, Homo sapiens
aucucuuccuacccaa

SEQ ID NO: 1464619 - RNA, 14 nt, Homo sapiens
aucucuucuggugu

SEQ ID NO: 1464620 - RNA, 23 nt, Homo sapiens
aucucuuguauaugaugaucugg

SEQ ID NO: 1464621 - RNA, 22 nt, Homo sapiens
aucucuuuuggucccauccucu

SEQ ID NO: 1464622 - RNA, 17 nt, Homo sapiens
aucugaaacccacagau

SEQ ID NO: 1464623 - RNA, 13 nt, Homo sapiens
aucugacaagacu

SEQ ID NO: 1464624 - RNA, 13 nt, Homo sapiens
aucugacauauua

SEQ ID NO: 1464625 - RNA, 18 nt, Homo sapiens
aucugauauuuuaaaaag

SEQ ID NO: 1464626 - RNA, 18 nt, Homo sapiens
aucugauguuaaccaaug

SEQ ID NO: 1464627 - RNA, 16 nt, Homo sapiens
aucugcacucaccuca

SEQ ID NO: 1464628 - RNA, 14 nt, Homo sapiens
aucugcagcuaacu

SEQ ID NO: 1464629 - RNA, 15 nt, Homo sapiens
aucugcaguuuaaca

SEQ ID NO: 1464630 - RNA, 19 nt, Homo sapiens
auugaccaagaacugcaug

SEQ ID NO: 1464631 - RNA, 20 nt, Homo sapiens
auugaccuauuuccagaaau

SEQ ID NO: 1464632 - RNA, 18 nt, Homo sapiens
auugacgacaagugcuga

SEQ ID NO: 1464633 - RNA, 17 nt, Homo sapiens
auugaggaaauauuaau

SEQ ID NO: 1464634 - RNA, 18 nt, Homo sapiens
auugaggagcugcacuga

SEQ ID NO: 1464635 - RNA, 15 nt, Homo sapiens
auugaggcccugcug

SEQ ID NO: 1464636 - RNA, 18 nt, Homo sapiens
auugauagaguguuauca

SEQ ID NO: 1464637 - RNA, 11 nt, Homo sapiens
auugcacuaaa

SEQ ID NO: 1464638 - RNA, 17 nt, Homo sapiens
auugccaaccaguuuga

SEQ ID NO: 1464639 - RNA, 22 nt, Homo sapiens
auugcccccucucacuuuagca

SEQ ID NO: 1464640 - RNA, 15 nt, Homo sapiens
auugccugcagagag

SEQ ID NO: 1464641 - RNA, 16 nt, Homo sapiens
auugcuaauuuagaga

SEQ ID NO: 1464642 - RNA, 14 nt, Homo sapiens
auugcucccuacca

SEQ ID NO: 1464643 - RNA, 15 nt, Homo sapiens
auugcuuuuaugaua

SEQ ID NO: 1464644 - RNA, 19 nt, Homo sapiens
auugcuuuuuuaaauauua

SEQ ID NO: 1464645 - RNA, 14 nt, Homo sapiens
auuggaagagcaca

SEQ ID NO: 1464646 - RNA, 17 nt, Homo sapiens
auuggaagcauacaaag

SEQ ID NO: 1464647 - RNA, 18 nt, Homo sapiens
auuggaauuaaccuggug

SEQ ID NO: 1464648 - RNA, 13 nt, Homo sapiens
auuggacagugag

SEQ ID NO: 1464649 - RNA, 18 nt, Homo sapiens
auuggagcugaagaccua

SEQ ID NO: 1464650 - RNA, 23 nt, Homo sapiens
auuggagucacugccaagucaua

SEQ ID NO: 1464651 - RNA, 21 nt, Homo sapiens
auuggcaaacuuuguauuaau

SEQ ID NO: 1464652 - RNA, 20 nt, Homo sapiens
auuggcaccuaauccaggca

SEQ ID NO: 1464653 - RNA, 21 nt, Homo sapiens
auuggcaccuaauccaggcag

SEQ ID NO: 1464654 - RNA, 19 nt, Homo sapiens
auuugugaaagaagacagc

SEQ ID NO: 1464655 - RNA, 19 nt, Homo sapiens
auuuguuaaaauuaucaau

SEQ ID NO: 1464656 - RNA, 20 nt, Homo sapiens
auuuguuuucuucuguaugu

SEQ ID NO: 1464657 - RNA, 14 nt, Homo sapiens
auuuuaaaaacaua

SEQ ID NO: 1464658 - RNA, 17 nt, Homo sapiens
auuuuaaaacagaagaa

SEQ ID NO: 1464659 - RNA, 18 nt, Homo sapiens
auuuuaaagacucaaggu

SEQ ID NO: 1464660 - RNA, 16 nt, Homo sapiens
auuuuaagaagacaua

SEQ ID NO: 1464661 - RNA, 21 nt, Homo sapiens
auuuuaagaauuucacaagcu

SEQ ID NO: 1464662 - RNA, 19 nt, Homo sapiens
auuuuaaguaacauaacua

SEQ ID NO: 1464663 - RNA, 13 nt, Homo sapiens
auuuuaauacagg

SEQ ID NO: 1464664 - RNA, 15 nt, Homo sapiens
auuuuaauacauuga

SEQ ID NO: 1464665 - RNA, 14 nt, Homo sapiens
auuuuacaguaucu

SEQ ID NO: 1464666 - RNA, 13 nt, Homo sapiens
auuuuacuaaaaa

SEQ ID NO: 1464667 - RNA, 14 nt, Homo sapiens
auuuuacuuaacuc

SEQ ID NO: 1464668 - RNA, 13 nt, Homo sapiens
auuuuacuuccau

SEQ ID NO: 1464669 - RNA, 15 nt, Homo sapiens
auuuuagccaugccu

SEQ ID NO: 1464670 - RNA, 23 nt, Homo sapiens
auuuuaguauucauucugcauug

SEQ ID NO: 1464671 - RNA, 16 nt, Homo sapiens
auuuuauuuuacuauu

SEQ ID NO: 1464672 - RNA, 19 nt, Homo sapiens
auuuucaacauaacugaag

SEQ ID NO: 1464673 - RNA, 20 nt, Homo sapiens
auuuucagaaaauauuaugu

SEQ ID NO: 1464674 - RNA, 13 nt, Homo sapiens
auuuucaguuaca

SEQ ID NO: 1464675 - RNA, 13 nt, Homo sapiens
auuuuccaaugca

SEQ ID NO: 1464676 - RNA, 23 nt, Homo sapiens
auuuuccacgcaguucuuuccau

SEQ ID NO: 1464677 - RNA, 14 nt, Homo sapiens
auuuucuacaauua

SEQ ID NO: 1464678 - RNA, 16 nt, Homo sapiens
auuuucuauuuaugua

SEQ ID NO: 1464679 - RNA, 16 nt, Homo sapiens
auuuucuucucugcac

SEQ ID NO: 1464680 - RNA, 20 nt, Homo sapiens
auuuucuucucugcacuuau

SEQ ID NO: 1464681 - RNA, 13 nt, Homo sapiens
auuuugaagaaua

SEQ ID NO: 1464682 - RNA, 20 nt, Homo sapiens
auuuugaguucuacauaagu

SEQ ID NO: 1464683 - RNA, 13 nt, Homo sapiens
auuuugcaaaaau

SEQ ID NO: 1464684 - RNA, 11 nt, Homo sapiens
auuuugcccag

SEQ ID NO: 1464685 - RNA, 20 nt, Homo sapiens
auuuuggagaguuuccugaa

SEQ ID NO: 1464686 - RNA, 20 nt, Homo sapiens
auuuuggauaaaucauuuca

SEQ ID NO: 1464687 - RNA, 14 nt, Homo sapiens
auuuuggcgcuauu

SEQ ID NO: 1464688 - RNA, 21 nt, Homo sapiens
auuuugggagugacucaagaa

SEQ ID NO: 1464689 - RNA, 16 nt, Homo sapiens
auuuuguggucauuaa

SEQ ID NO: 1464690 - RNA, 16 nt, Homo sapiens
auuuuguugcuuucuu

SEQ ID NO: 1464691 - RNA, 13 nt, Homo sapiens
auuuuuauacuga

SEQ ID NO: 1464692 - RNA, 16 nt, Homo sapiens
auuuuucagcacuuaa

SEQ ID NO: 1464693 - RNA, 14 nt, Homo sapiens
auuuuuccacuuaa

SEQ ID NO: 1464694 - RNA, 15 nt, Homo sapiens
auuuuuccacuuaaa

SEQ ID NO: 1464695 - RNA, 13 nt, Homo sapiens
auuuuucuaucaa

SEQ ID NO: 1464696 - RNA, 14 nt, Homo sapiens
auuuuugucuuaua

SEQ ID NO: 1464697 - RNA, 16 nt, Homo sapiens
auuuuuguuaguuuac

SEQ ID NO: 1464698 - RNA, 14 nt, Homo sapiens
auuuuuugcuacuu

SEQ ID NO: 1464699 - RNA, 18 nt, Homo sapiens
auuuuuugggcagcaauu

SEQ ID NO: 1464700 - RNA, 16 nt, Homo sapiens
auuuuuuuuugaagca

SEQ ID NO: 1464701 - RNA, 19 nt, Homo sapiens
caaaaaaaaaaaaaugcac

SEQ ID NO: 1464702 - RNA, 13 nt, Homo sapiens
caaaaaacuacuu

SEQ ID NO: 1464703 - RNA, 15 nt, Homo sapiens
caaaaaacuacuucu

SEQ ID NO: 1464704 - RNA, 11 nt, Homo sapiens
caaaaaaucug

SEQ ID NO: 1464705 - RNA, 17 nt, Homo sapiens
caaaaaaucugaccaaa

SEQ ID NO: 1464706 - RNA, 16 nt, Homo sapiens
caaaaacguaucuccu

SEQ ID NO: 1464707 - RNA, 14 nt, Homo sapiens
caaaaacuacacau

SEQ ID NO: 1464708 - RNA, 12 nt, Homo sapiens
caaaaacuuugg

SEQ ID NO: 1464709 - RNA, 13 nt, Homo sapiens
caaaaacuuugga

SEQ ID NO: 1464710 - RNA, 15 nt, Homo sapiens
caaaaagcuucccca

SEQ ID NO: 1464711 - RNA, 22 nt, Homo sapiens
caaaaaguuuaucacacagugu

SEQ ID NO: 1464712 - RNA, 19 nt, Homo sapiens
caaaaauaaauuguaauaa

SEQ ID NO: 1464713 - RNA, 17 nt, Homo sapiens
caaaaauagacaacugu

SEQ ID NO: 1464714 - RNA, 17 nt, Homo sapiens
caaaaauauuuacacuu

SEQ ID NO: 1464715 - RNA, 12 nt, Homo sapiens
caaaaaugaacu

SEQ ID NO: 1464716 - RNA, 14 nt, Homo sapiens
caaaaauuaucuau

SEQ ID NO: 1464717 - RNA, 19 nt, Homo sapiens
caaaacccaugcauuucau

SEQ ID NO: 1464718 - RNA, 18 nt, Homo sapiens
caaaaccugauguuaaaa

SEQ ID NO: 1464719 - RNA, 12 nt, Homo sapiens
caaaacucuccu

SEQ ID NO: 1464720 - RNA, 15 nt, Homo sapiens
caaaacugacaguaa

SEQ ID NO: 1464721 - RNA, 22 nt, Homo sapiens
caaaacuuuaaugaacuaacug

SEQ ID NO: 1464722 - RNA, 22 nt, Homo sapiens
caaaagcaagacuguugcucaa

SEQ ID NO: 1464723 - RNA, 20 nt, Homo sapiens
caaaagcaguaaauuugcua

SEQ ID NO: 1464724 - RNA, 20 nt, Homo sapiens
caaaagcuuauucaucuguu

SEQ ID NO: 1464725 - RNA, 15 nt, Homo sapiens
caaaagcuuuuuacu

SEQ ID NO: 1464726 - RNA, 11 nt, Homo sapiens
caaaaguagag

SEQ ID NO: 1464727 - RNA, 12 nt, Homo sapiens
caaaagugcucc

SEQ ID NO: 1464728 - RNA, 18 nt, Homo sapiens
caaaauaaaaagugacac

SEQ ID NO: 1464729 - RNA, 23 nt, Homo sapiens
caaaauagucuucucaaauuaga

SEQ ID NO: 1464730 - RNA, 17 nt, Homo sapiens
caaaauauuuuuugcaa

SEQ ID NO: 1464731 - RNA, 12 nt, Homo sapiens
caaaaucucuac

SEQ ID NO: 1464732 - RNA, 13 nt, Homo sapiens
caacugccaagaa

SEQ ID NO: 1464733 - RNA, 23 nt, Homo sapiens
caacuugauuuuuucaaaaaagu

SEQ ID NO: 1464734 - RNA, 23 nt, Homo sapiens
caagaaaacaacuucaauaucca

SEQ ID NO: 1464735 - RNA, 22 nt, Homo sapiens
caagaaagcucacuguagcuuu

SEQ ID NO: 1464736 - RNA, 13 nt, Homo sapiens
caagaaccucucc

SEQ ID NO: 1464737 - RNA, 21 nt, Homo sapiens
caagaaccuggaaaaauucca

SEQ ID NO: 1464738 - RNA, 18 nt, Homo sapiens
caagaacugcauggaccu

SEQ ID NO: 1464739 - RNA, 17 nt, Homo sapiens
caagaaggaacaauaaa

SEQ ID NO: 1464740 - RNA, 19 nt, Homo sapiens
caagaagugguccaucucc

SEQ ID NO: 1464741 - RNA, 15 nt, Homo sapiens
caagaauaaaggcag

SEQ ID NO: 1464742 - RNA, 13 nt, Homo sapiens
caagaaugcauuc

SEQ ID NO: 1464743 - RNA, 14 nt, Homo sapiens
caagaaugcauucc

SEQ ID NO: 1464744 - RNA, 13 nt, Homo sapiens
caagacaaaaagc

SEQ ID NO: 1464745 - RNA, 18 nt, Homo sapiens
caagacacaucccuacaa

SEQ ID NO: 1464746 - RNA, 17 nt, Homo sapiens
caagacccccagcacuu

SEQ ID NO: 1464747 - RNA, 18 nt, Homo sapiens
caagacccccagcacuug

SEQ ID NO: 1464748 - RNA, 18 nt, Homo sapiens
caagaccucugugcacuu

SEQ ID NO: 1464749 - RNA, 16 nt, Homo sapiens
caagacuauaccuuau

SEQ ID NO: 1464750 - RNA, 19 nt, Homo sapiens
caagacuccaucucaaaaa

SEQ ID NO: 1464751 - RNA, 21 nt, Homo sapiens
caagagaaaauguguaauuca

SEQ ID NO: 1464752 - RNA, 15 nt, Homo sapiens
caagagugauugcag

SEQ ID NO: 1464753 - RNA, 19 nt, Homo sapiens
caagaucgcaccauugcac

SEQ ID NO: 1464754 - RNA, 21 nt, Homo sapiens
caagaucgcaccauugcacuc

SEQ ID NO: 1464755 - RNA, 20 nt, Homo sapiens
caagaucgcgccacugcacu

SEQ ID NO: 1464756 - RNA, 19 nt, Homo sapiens
caagaucugaaauaaauga

SEQ ID NO: 1464757 - RNA, 13 nt, Homo sapiens
caagaucuuucag

SEQ ID NO: 1464758 - RNA, 12 nt, Homo sapiens
caagauugcacc

SEQ ID NO: 1464759 - RNA, 21 nt, Homo sapiens
caagcaaaaacaaaugggaaa

SEQ ID NO: 1464760 - RNA, 13 nt, Homo sapiens
caagcaacacaga

SEQ ID NO: 1464761 - RNA, 14 nt, Homo sapiens
caagcaaggccaaa

SEQ ID NO: 1464762 - RNA, 22 nt, Homo sapiens
caagcaccuguuaauaaagguc

SEQ ID NO: 1464763 - RNA, 15 nt, Homo sapiens
caagcagagugcaca

SEQ ID NO: 1464764 - RNA, 15 nt, Homo sapiens
caagcauuccugcuc

SEQ ID NO: 1464765 - RNA, 16 nt, Homo sapiens
caagcccaggugccag

SEQ ID NO: 1464766 - RNA, 21 nt, Homo sapiens
caagcgauccucccaccucag

SEQ ID NO: 1464767 - RNA, 14 nt, Homo sapiens
caagcuaacugcuu

SEQ ID NO: 1464768 - RNA, 16 nt, Homo sapiens
caagcuccucgugaua

SEQ ID NO: 1464769 - RNA, 22 nt, Homo sapiens
caagcugcucugagccacagug

SEQ ID NO: 1464770 - RNA, 18 nt, Homo sapiens
caagcuuaauagcccucc

SEQ ID NO: 1464771 - RNA, 20 nt, Homo sapiens
caaggaaacccccaguguaa

SEQ ID NO: 1464772 - RNA, 23 nt, Homo sapiens
caaggaagagccaauguuuucca

SEQ ID NO: 1464773 - RNA, 19 nt, Homo sapiens
caaggaaggcauuuggacc

SEQ ID NO: 1464774 - RNA, 17 nt, Homo sapiens
caaggacauugccccaa

SEQ ID NO: 1464775 - RNA, 22 nt, Homo sapiens
caaggagaccaaguccuggcua

SEQ ID NO: 1464776 - RNA, 17 nt, Homo sapiens
caaggagcacaagccac

SEQ ID NO: 1464777 - RNA, 19 nt, Homo sapiens
caaggcccauaucugugaa

SEQ ID NO: 1464778 - RNA, 17 nt, Homo sapiens
caaggcugcacagcuca

SEQ ID NO: 1464779 - RNA, 19 nt, Homo sapiens
caaggcuuuauauuuuuaa

SEQ ID NO: 1464780 - RNA, 19 nt, Homo sapiens
caagggggacugucuuuca

SEQ ID NO: 1464781 - RNA, 20 nt, Homo sapiens
caaggggugggccugugaau

SEQ ID NO: 1464782 - RNA, 21 nt, Homo sapiens
caaggguucuuggugaugcug

SEQ ID NO: 1464783 - RNA, 23 nt, Homo sapiens
caaggguucuuggugaugcuggc

SEQ ID NO: 1464784 - RNA, 15 nt, Homo sapiens
caagguccacucccu

SEQ ID NO: 1464785 - RNA, 19 nt, Homo sapiens
caagguccccuccacaucc

SEQ ID NO: 1464786 - RNA, 21 nt, Homo sapiens
caagguggccuuugugcugcg

SEQ ID NO: 1464787 - RNA, 23 nt, Homo sapiens
caaguaaaaaggcuaaauggaag

SEQ ID NO: 1464788 - RNA, 18 nt, Homo sapiens
caaguaaaacaaaaccac

SEQ ID NO: 1464789 - RNA, 21 nt, Homo sapiens
caaguacaccagccaccucca

SEQ ID NO: 1464790 - RNA, 17 nt, Homo sapiens
caaguauuauuuuacaa

SEQ ID NO: 1464791 - RNA, 22 nt, Homo sapiens
caagucacacagcuagugaaga

SEQ ID NO: 1464792 - RNA, 12 nt, Homo sapiens
caagucacaccc

SEQ ID NO: 1464793 - RNA, 18 nt, Homo sapiens
caagucaugugcauuucc

SEQ ID NO: 1464794 - RNA, 16 nt, Homo sapiens
caagucuuccaugacc

SEQ ID NO: 1464795 - RNA, 15 nt, Homo sapiens
caagugcccccucac

SEQ ID NO: 1464796 - RNA, 23 nt, Homo sapiens
caaguuaaagugaauaaccacuu

SEQ ID NO: 1464797 - RNA, 21 nt, Homo sapiens
caaguucgucuguugugcgaa

SEQ ID NO: 1464798 - RNA, 14 nt, Homo sapiens
caaguucuucaccu

SEQ ID NO: 1464799 - RNA, 13 nt, Homo sapiens
caaguuuauucag

SEQ ID NO: 1464800 - RNA, 16 nt, Homo sapiens
caaguuucaucaguca

SEQ ID NO: 1464801 - RNA, 19 nt, Homo sapiens
caaguuucugauaccacug

SEQ ID NO: 1464802 - RNA, 17 nt, Homo sapiens
caaguuuuguggggcuu

SEQ ID NO: 1464803 - RNA, 19 nt, Homo sapiens
caauaaaaguuuucuccaa

SEQ ID NO: 1464804 - RNA, 15 nt, Homo sapiens
caauaaacuuagagg

SEQ ID NO: 1464805 - RNA, 15 nt, Homo sapiens
caauaaauuuugcca

SEQ ID NO: 1464806 - RNA, 20 nt, Homo sapiens
caaugcccugugcaugccau

SEQ ID NO: 1464807 - RNA, 19 nt, Homo sapiens
caauggaguggcugccaug

SEQ ID NO: 1464808 - RNA, 14 nt, Homo sapiens
caauggcggacuca

SEQ ID NO: 1464809 - RNA, 13 nt, Homo sapiens
caaugggagcuga

SEQ ID NO: 1464810 - RNA, 17 nt, Homo sapiens
caaugguuaacaucuuc

SEQ ID NO: 1464811 - RNA, 15 nt, Homo sapiens
caauguccuaaaaag

SEQ ID NO: 1464812 - RNA, 15 nt, Homo sapiens
caaugugaacacugg

SEQ ID NO: 1464813 - RNA, 17 nt, Homo sapiens
caauguuuuccacccau

SEQ ID NO: 1464814 - RNA, 13 nt, Homo sapiens
caauguuuugcuu

SEQ ID NO: 1464815 - RNA, 15 nt, Homo sapiens
caauuacuauucccu

SEQ ID NO: 1464816 - RNA, 13 nt, Homo sapiens
caauuccucuggg

SEQ ID NO: 1464817 - RNA, 14 nt, Homo sapiens
caauuccuucuuca

SEQ ID NO: 1464818 - RNA, 23 nt, Homo sapiens
caauugguaaaacucacugugau

SEQ ID NO: 1464819 - RNA, 12 nt, Homo sapiens
caauugucugcc

SEQ ID NO: 1464820 - RNA, 14 nt, Homo sapiens
caauuuacacugcc

SEQ ID NO: 1464821 - RNA, 17 nt, Homo sapiens
caauuuuagauaucaug

SEQ ID NO: 1464822 - RNA, 20 nt, Homo sapiens
cacaaaauguaggguuauaa

SEQ ID NO: 1464823 - RNA, 16 nt, Homo sapiens
cacaaaaugucucagu

SEQ ID NO: 1464824 - RNA, 13 nt, Homo sapiens
cacaaacccaagg

SEQ ID NO: 1464825 - RNA, 23 nt, Homo sapiens
cacaaaggguugggagcugauga

SEQ ID NO: 1464826 - RNA, 19 nt, Homo sapiens
cacaaaugaagggauauaa

SEQ ID NO: 1464827 - RNA, 18 nt, Homo sapiens
cacaaauuuguaaacuuu

SEQ ID NO: 1464828 - RNA, 16 nt, Homo sapiens
cacaaccuuccagcuc

SEQ ID NO: 1464829 - RNA, 18 nt, Homo sapiens
cacaacugcaauaacuuc

SEQ ID NO: 1464830 - RNA, 21 nt, Homo sapiens
cacaacuuggguucuucucag

SEQ ID NO: 1464831 - RNA, 17 nt, Homo sapiens
cacaagaaguagcuuca

SEQ ID NO: 1464832 - RNA, 20 nt, Homo sapiens
cacaagcagagugcacagcu

SEQ ID NO: 1464833 - RNA, 14 nt, Homo sapiens
cacaagucuuccag

SEQ ID NO: 1464834 - RNA, 23 nt, Homo sapiens
cacaagugguguuuauugcaaua

SEQ ID NO: 1464835 - RNA, 14 nt, Homo sapiens
cacaaguuacacug

SEQ ID NO: 1464836 - RNA, 18 nt, Homo sapiens
cacaaguuacacugccau

SEQ ID NO: 1464837 - RNA, 22 nt, Homo sapiens
cacaaucccuggggcugugcau

SEQ ID NO: 1464838 - RNA, 21 nt, Homo sapiens
cacaauccuugccacagugug

SEQ ID NO: 1464839 - RNA, 20 nt, Homo sapiens
cacaauuuuaauucaaaaga

SEQ ID NO: 1464840 - RNA, 13 nt, Homo sapiens
cacacaaaccagu

SEQ ID NO: 1464841 - RNA, 13 nt, Homo sapiens
cacacacacaaac

SEQ ID NO: 1464842 - RNA, 21 nt, Homo sapiens
cacacacccagcuugugccug

SEQ ID NO: 1464843 - RNA, 10 nt, Homo sapiens
cacacacucc

SEQ ID NO: 1464844 - RNA, 13 nt, Homo sapiens
cacacagcacucu

SEQ ID NO: 1464845 - RNA, 15 nt, Homo sapiens
cacacaucuaugaua

SEQ ID NO: 1464846 - RNA, 19 nt, Homo sapiens
cacaccacaaccaccuuca

SEQ ID NO: 1464847 - RNA, 13 nt, Homo sapiens
cacaccagucaca

SEQ ID NO: 1464848 - RNA, 21 nt, Homo sapiens
cacaccagucacaugaccuga

SEQ ID NO: 1464849 - RNA, 17 nt, Homo sapiens
cacaccugaacuugccu

SEQ ID NO: 1464850 - RNA, 15 nt, Homo sapiens
cacaccuuccagggc

SEQ ID NO: 1464851 - RNA, 17 nt, Homo sapiens
cacaccuuuuauugaca

SEQ ID NO: 1464852 - RNA, 18 nt, Homo sapiens
cacacgcacuggugccaa

SEQ ID NO: 1464853 - RNA, 16 nt, Homo sapiens
cacacuguaaauauga

SEQ ID NO: 1464854 - RNA, 13 nt, Homo sapiens
cacacuuugcacu

SEQ ID NO: 1464855 - RNA, 21 nt, Homo sapiens
cacagaacuauguacuuuaaa

SEQ ID NO: 1464856 - RNA, 20 nt, Homo sapiens
cacagaauuuguauguauuu

SEQ ID NO: 1464857 - RNA, 18 nt, Homo sapiens
cacagacacaauauguau

SEQ ID NO: 1464858 - RNA, 15 nt, Homo sapiens
cacagacagauccca

SEQ ID NO: 1464859 - RNA, 16 nt, Homo sapiens
cacagaccaccugcuu

SEQ ID NO: 1464860 - RNA, 19 nt, Homo sapiens
cacagaccccuagggauuu

SEQ ID NO: 1464861 - RNA, 16 nt, Homo sapiens
cacagaguagaaacuc

SEQ ID NO: 1464862 - RNA, 14 nt, Homo sapiens
cacagauauuucca

SEQ ID NO: 1464863 - RNA, 17 nt, Homo sapiens
cacagcaacaaugacuu

SEQ ID NO: 1464864 - RNA, 18 nt, Homo sapiens
cacagcaucauuuugcau

SEQ ID NO: 1464865 - RNA, 11 nt, Homo sapiens
cacagccaaac

SEQ ID NO: 1464866 - RNA, 20 nt, Homo sapiens
cacagccuccucugucugcc

SEQ ID NO: 1464867 - RNA, 13 nt, Homo sapiens
cacagcuacagcu

SEQ ID NO: 1464868 - RNA, 14 nt, Homo sapiens
cacagcuacagcuu

SEQ ID NO: 1464869 - RNA, 16 nt, Homo sapiens
cacagcuacagcuuuc

SEQ ID NO: 1464870 - RNA, 17 nt, Homo sapiens
cacagcuacagcuuucu

SEQ ID NO: 1464871 - RNA, 20 nt, Homo sapiens
cacagcugaguuaugaugua

SEQ ID NO: 1464872 - RNA, 13 nt, Homo sapiens
cacagcugcccua

SEQ ID NO: 1464873 - RNA, 19 nt, Homo sapiens
cacagcugcugcuggaaau

SEQ ID NO: 1464874 - RNA, 23 nt, Homo sapiens
cacagcugcuuucuguugucauu

SEQ ID NO: 1464875 - RNA, 21 nt, Homo sapiens
cacagcuuagaagugcuauaa

SEQ ID NO: 1464876 - RNA, 21 nt, Homo sapiens
cacaggauuuguaauuccuua

SEQ ID NO: 1464877 - RNA, 23 nt, Homo sapiens
cacaggcccuggcugaggucucu

SEQ ID NO: 1464878 - RNA, 17 nt, Homo sapiens
cacagggccaacuugag

SEQ ID NO: 1464879 - RNA, 17 nt, Homo sapiens
cacagggcccgcagugc

SEQ ID NO: 1464880 - RNA, 15 nt, Homo sapiens
aauaauuaauuucau

SEQ ID NO: 1464881 - RNA, 17 nt, Homo sapiens
aauaauuaguaagcuag

SEQ ID NO: 1464882 - RNA, 19 nt, Homo sapiens
aauaauuaguaagcuagca

SEQ ID NO: 1464883 - RNA, 18 nt, Homo sapiens
aauaauucaugauucaac

SEQ ID NO: 1464884 - RNA, 22 nt, Homo sapiens
aauaauuuuaagaaaucaaaga

SEQ ID NO: 1464885 - RNA, 18 nt, Homo sapiens
aauaauuuuauuaugcaa

SEQ ID NO: 1464886 - RNA, 12 nt, Homo sapiens
aauacaaaaaug

SEQ ID NO: 1464887 - RNA, 16 nt, Homo sapiens
aauacaaaaaugagcu

SEQ ID NO: 1464888 - RNA, 15 nt, Homo sapiens
aauacaaguuucuga

SEQ ID NO: 1464889 - RNA, 14 nt, Homo sapiens
aauacacuguuauc

SEQ ID NO: 1464890 - RNA, 23 nt, Homo sapiens
aauacagauagauauaugcucug

SEQ ID NO: 1464891 - RNA, 19 nt, Homo sapiens
aauacaggggugaaagggg

SEQ ID NO: 1464892 - RNA, 21 nt, Homo sapiens
aauacauaucgcugacuucau

SEQ ID NO: 1464893 - RNA, 15 nt, Homo sapiens
aauacaugcaucuca

SEQ ID NO: 1464894 - RNA, 21 nt, Homo sapiens
aauaccuagaccuaaacggcu

SEQ ID NO: 1464895 - RNA, 21 nt, Homo sapiens
aauaccucuuacuuugcuuga

SEQ ID NO: 1464896 - RNA, 17 nt, Homo sapiens
aauacggcaaaaccuca

SEQ ID NO: 1464897 - RNA, 15 nt, Homo sapiens
aauacuguacauugu

SEQ ID NO: 1464898 - RNA, 21 nt, Homo sapiens
aauacuuacuauaauuugacu

SEQ ID NO: 1464899 - RNA, 13 nt, Homo sapiens
aauacuuacuucu

SEQ ID NO: 1464900 - RNA, 19 nt, Homo sapiens
aauacuucaugagcauuca

SEQ ID NO: 1464901 - RNA, 11 nt, Homo sapiens
aauacuuucag

SEQ ID NO: 1464902 - RNA, 16 nt, Homo sapiens
aauagaaacauuugua

SEQ ID NO: 1464903 - RNA, 13 nt, Homo sapiens
aauagaacuacaa

SEQ ID NO: 1464904 - RNA, 21 nt, Homo sapiens
aauagaauauaauuaucggaa

SEQ ID NO: 1464905 - RNA, 16 nt, Homo sapiens
aauagacaauuugcac

SEQ ID NO: 1464906 - RNA, 17 nt, Homo sapiens
aauagauaaacuauaca

SEQ ID NO: 1464907 - RNA, 17 nt, Homo sapiens
aauagccacauuuggaa

SEQ ID NO: 1464908 - RNA, 20 nt, Homo sapiens
aauaguaccuucaauacuua

SEQ ID NO: 1464909 - RNA, 14 nt, Homo sapiens
aauaguauuugcau

SEQ ID NO: 1464910 - RNA, 13 nt, Homo sapiens
aauagucaauuuc

SEQ ID NO: 1464911 - RNA, 14 nt, Homo sapiens
aauagucuucucaa

SEQ ID NO: 1464912 - RNA, 14 nt, Homo sapiens
aauaguuuacaugu

SEQ ID NO: 1464913 - RNA, 18 nt, Homo sapiens
aauaguuuugauccuaaa

SEQ ID NO: 1464914 - RNA, 14 nt, Homo sapiens
aauauaaagcuuaa

SEQ ID NO: 1464915 - RNA, 17 nt, Homo sapiens
aauauaauuuucaaaaa

SEQ ID NO: 1464916 - RNA, 15 nt, Homo sapiens
aauauauaguccaga

SEQ ID NO: 1464917 - RNA, 14 nt, Homo sapiens
aauauauauuuuag

SEQ ID NO: 1464918 - RNA, 15 nt, Homo sapiens
aauauaugucugaua

SEQ ID NO: 1464919 - RNA, 15 nt, Homo sapiens
aauauauuuugccau

SEQ ID NO: 1464920 - RNA, 19 nt, Homo sapiens
aauauauuuuuagacucau

SEQ ID NO: 1464921 - RNA, 20 nt, Homo sapiens
aauaucacaguauuaucugu

SEQ ID NO: 1464922 - RNA, 18 nt, Homo sapiens
aauaucaugugcacuuca

SEQ ID NO: 1464923 - RNA, 17 nt, Homo sapiens
aauauccaaaccaaaua

SEQ ID NO: 1464924 - RNA, 17 nt, Homo sapiens
aauaucuugcuuucaaa

SEQ ID NO: 1464925 - RNA, 14 nt, Homo sapiens
aauaugaguacaaa

SEQ ID NO: 1464926 - RNA, 17 nt, Homo sapiens
aauaugaguuacugaag

SEQ ID NO: 1464927 - RNA, 18 nt, Homo sapiens
aauaugauuuuauuugac

SEQ ID NO: 1464928 - RNA, 19 nt, Homo sapiens
aauaugcacaauagcaguu

SEQ ID NO: 1464929 - RNA, 14 nt, Homo sapiens
aauaugcagugaua

SEQ ID NO: 1464930 - RNA, 15 nt, Homo sapiens
aauaugggggccuuu

SEQ ID NO: 1464931 - RNA, 18 nt, Homo sapiens
aauauggguugcauuugg

SEQ ID NO: 1464932 - RNA, 22 nt, Homo sapiens
aauauguagcucauccuuuaca

SEQ ID NO: 1464933 - RNA, 14 nt, Homo sapiens
aauaugucaguuug

SEQ ID NO: 1464934 - RNA, 20 nt, Homo sapiens
aauauguucuuuuaaaugau

SEQ ID NO: 1464935 - RNA, 13 nt, Homo sapiens
aauauuacaguga

SEQ ID NO: 1464936 - RNA, 18 nt, Homo sapiens
aauauuagaagccugcag

SEQ ID NO: 1464937 - RNA, 17 nt, Homo sapiens
aauauuauuugcuaauu

SEQ ID NO: 1464938 - RNA, 22 nt, Homo sapiens
aauauugcuuuggucauaugag

SEQ ID NO: 1464939 - RNA, 22 nt, Homo sapiens
aauauuguauugcugcugugcg

SEQ ID NO: 1464940 - RNA, 15 nt, Homo sapiens
aauauugucugccuu

SEQ ID NO: 1464941 - RNA, 14 nt, Homo sapiens
aauauugugcaaac

SEQ ID NO: 1464942 - RNA, 23 nt, Homo sapiens
aauauuguugacaacugugacug

SEQ ID NO: 1464943 - RNA, 19 nt, Homo sapiens
aauauuuaaacagcagugu

SEQ ID NO: 1464944 - RNA, 20 nt, Homo sapiens
aauauuuagcuguaaacuga

SEQ ID NO: 1464945 - RNA, 15 nt, Homo sapiens
aauauuuaucugauu

SEQ ID NO: 1464946 - RNA, 20 nt, Homo sapiens
aauauuuccuuaaacugugu

SEQ ID NO: 1464947 - RNA, 18 nt, Homo sapiens
aauauuucuuucaugucu

SEQ ID NO: 1464948 - RNA, 19 nt, Homo sapiens
aauauuuuaagaauuucac

SEQ ID NO: 1464949 - RNA, 21 nt, Homo sapiens
aauauuuuguaaugcugcaca

SEQ ID NO: 1464950 - RNA, 19 nt, Homo sapiens
aauauuuuguuuugugcag

SEQ ID NO: 1464951 - RNA, 23 nt, Homo sapiens
aauauuuuuauaucaugcaaaau

SEQ ID NO: 1464952 - RNA, 17 nt, Homo sapiens
aauauuuuuauauuucc

SEQ ID NO: 1464953 - RNA, 23 nt, Homo sapiens
aaucaaaacucacaagugcucau

SEQ ID NO: 1464954 - RNA, 13 nt, Homo sapiens
aaucaaauagcau

SEQ ID NO: 1464955 - RNA, 12 nt, Homo sapiens
aaucaacucuaa

SEQ ID NO: 1464956 - RNA, 15 nt, Homo sapiens
aaucacacugucuuc

SEQ ID NO: 1464957 - RNA, 15 nt, Homo sapiens
aaucacaucucaccu

SEQ ID NO: 1464958 - RNA, 14 nt, Homo sapiens
aaucaccucucugu

SEQ ID NO: 1464959 - RNA, 21 nt, Homo sapiens
aaucacuaucuuucugauaac

SEQ ID NO: 1464960 - RNA, 11 nt, Homo sapiens
aaucacuggaa

SEQ ID NO: 1464961 - RNA, 18 nt, Homo sapiens
aaucacuggcuguuaauc

SEQ ID NO: 1464962 - RNA, 20 nt, Homo sapiens
agagagccauuuugugaaug

SEQ ID NO: 1464963 - RNA, 14 nt, Homo sapiens
agagaggaugugca

SEQ ID NO: 1464964 - RNA, 23 nt, Homo sapiens
agagagucgcaucucagugcagg

SEQ ID NO: 1464965 - RNA, 20 nt, Homo sapiens
agagauggggucucacagug

SEQ ID NO: 1464966 - RNA, 17 nt, Homo sapiens
agagauuuggagcacuc

SEQ ID NO: 1464967 - RNA, 20 nt, Homo sapiens
agagcaaaacucugucucaa

SEQ ID NO: 1464968 - RNA, 17 nt, Homo sapiens
agagcaaaucuaugaga

SEQ ID NO: 1464969 - RNA, 13 nt, Homo sapiens
agagcaaaugcua

SEQ ID NO: 1464970 - RNA, 21 nt, Homo sapiens
agagcaacaauccaucucuca

SEQ ID NO: 1464971 - RNA, 15 nt, Homo sapiens
agagcaagacuccau

SEQ ID NO: 1464972 - RNA, 20 nt, Homo sapiens
agagcaagacucugucucaa

SEQ ID NO: 1464973 - RNA, 13 nt, Homo sapiens
agagcaauuguaa

SEQ ID NO: 1464974 - RNA, 23 nt, Homo sapiens
agagcaccuuugcacaggaugcu

SEQ ID NO: 1464975 - RNA, 15 nt, Homo sapiens
agagcagaugcagag

SEQ ID NO: 1464976 - RNA, 13 nt, Homo sapiens
acugcccuaagcc

SEQ ID NO: 1464977 - RNA, 14 nt, Homo sapiens
acugcguggugcuc

SEQ ID NO: 1464978 - RNA, 18 nt, Homo sapiens
acugcguuguccacaaga

SEQ ID NO: 1464979 - RNA, 17 nt, Homo sapiens
acugcuacaaucaaggc

SEQ ID NO: 1464980 - RNA, 19 nt, Homo sapiens
acugcugcuccagugcagg

SEQ ID NO: 1464981 - RNA, 12 nt, Homo sapiens
acugcugugaau

SEQ ID NO: 1464982 - RNA, 16 nt, Homo sapiens
acugcuugaccaaaga

SEQ ID NO: 1464983 - RNA, 18 nt, Homo sapiens
acugcuuucuguuccaaa

SEQ ID NO: 1464984 - RNA, 22 nt, Homo sapiens
acuggaaccccagcuucccucc

SEQ ID NO: 1464985 - RNA, 23 nt, Homo sapiens
acuggaauauaauuucaaaccac

SEQ ID NO: 1464986 - RNA, 13 nt, Homo sapiens
acuggaccuggug

SEQ ID NO: 1464987 - RNA, 21 nt, Homo sapiens
acuggacgcuguccugagaug

SEQ ID NO: 1464988 - RNA, 15 nt, Homo sapiens
acuggaggugggcau

SEQ ID NO: 1464989 - RNA, 19 nt, Homo sapiens
acuggcacacugcucuuaa

SEQ ID NO: 1464990 - RNA, 13 nt, Homo sapiens
acuggcagcaucu

SEQ ID NO: 1464991 - RNA, 15 nt, Homo sapiens
aauguaugugcucuu

SEQ ID NO: 1464992 - RNA, 18 nt, Homo sapiens
aauguauuuugacacugg

SEQ ID NO: 1464993 - RNA, 14 nt, Homo sapiens
aaugucacauucua

SEQ ID NO: 1464994 - RNA, 14 nt, Homo sapiens
aaugucacuuaaag

SEQ ID NO: 1464995 - RNA, 19 nt, Homo sapiens
aaugucagaaaccaguuau

SEQ ID NO: 1464996 - RNA, 22 nt, Homo sapiens
aaugucauuuaagggaguuaca

SEQ ID NO: 1464997 - RNA, 19 nt, Homo sapiens
aauguccccacgguacuua

SEQ ID NO: 1464998 - RNA, 21 nt, Homo sapiens
aaugucuucauaaaguacuug

SEQ ID NO: 1464999 - RNA, 16 nt, Homo sapiens
aaugucuucaugaccu

SEQ ID NO: 1465000 - RNA, 12 nt, Homo sapiens
aaugugaacuua

SEQ ID NO: 1465001 - RNA, 18 nt, Homo sapiens
aaugugcagcucccauuu

SEQ ID NO: 1465002 - RNA, 20 nt, Homo sapiens
aauguggauuaaagugccca

SEQ ID NO: 1465003 - RNA, 20 nt, Homo sapiens
aauguguuuuaucacuucau

SEQ ID NO: 1465004 - RNA, 14 nt, Homo sapiens
aauguuaauguuau

SEQ ID NO: 1465005 - RNA, 18 nt, Homo sapiens
aauguuaauguuauauca

SEQ ID NO: 1465006 - RNA, 18 nt, Homo sapiens
aauguuacugaucaugca

SEQ ID NO: 1465007 - RNA, 20 nt, Homo sapiens
aauguuacugaucaugcauu

SEQ ID NO: 1465008 - RNA, 14 nt, Homo sapiens
aauguuaugacuau

SEQ ID NO: 1465009 - RNA, 13 nt, Homo sapiens
acaaacuaaaaau

SEQ ID NO: 1465010 - RNA, 11 nt, Homo sapiens
acaaacugcaa

SEQ ID NO: 1465011 - RNA, 23 nt, Homo sapiens
acaaacuggcugcuuuguucaau

SEQ ID NO: 1465012 - RNA, 15 nt, Homo sapiens
acaaacuucaaagag

SEQ ID NO: 1465013 - RNA, 13 nt, Homo sapiens
acaaagcaguuua

SEQ ID NO: 1465014 - RNA, 18 nt, Homo sapiens
acaaaggcaguucagucc

SEQ ID NO: 1465015 - RNA, 19 nt, Homo sapiens
acaaagugacauuccugag

SEQ ID NO: 1465016 - RNA, 21 nt, Homo sapiens
acaaagugaggagaaugaaau

SEQ ID NO: 1465017 - RNA, 18 nt, Homo sapiens
acaaauaaacucauuuaa

SEQ ID NO: 1465018 - RNA, 19 nt, Homo sapiens
acaaauagugcaacuauga

SEQ ID NO: 1465019 - RNA, 15 nt, Homo sapiens
acaaauaugucaguu

SEQ ID NO: 1465020 - RNA, 18 nt, Homo sapiens
acaaaugggaaaaccaga

SEQ ID NO: 1465021 - RNA, 23 nt, Homo sapiens
acaacagugcuuuguaaauugug

SEQ ID NO: 1465022 - RNA, 17 nt, Homo sapiens
acaacauuauaacugua

SEQ ID NO: 1465023 - RNA, 19 nt, Homo sapiens
acaacauuuacuuaacaga

SEQ ID NO: 1465024 - RNA, 22 nt, Homo sapiens
acaaccaacggccgacugccug

SEQ ID NO: 1465025 - RNA, 18 nt, Homo sapiens
acaaccaucccugccaca

SEQ ID NO: 1465026 - RNA, 19 nt, Homo sapiens
acaacccaccccgcuuucg

SEQ ID NO: 1465027 - RNA, 15 nt, Homo sapiens
acaaccucauccagg

SEQ ID NO: 1465028 - RNA, 17 nt, Homo sapiens
acaacgccugucacaga

SEQ ID NO: 1465029 - RNA, 16 nt, Homo sapiens
acaacuauuuuuccaa

SEQ ID NO: 1465030 - RNA, 16 nt, Homo sapiens
acaacuccuacaugau

SEQ ID NO: 1465031 - RNA, 12 nt, Homo sapiens
acaacugugacu

SEQ ID NO: 1465032 - RNA, 17 nt, Homo sapiens
acaacuguggucaaucc

SEQ ID NO: 1465033 - RNA, 18 nt, Homo sapiens
acaacuguggucaauccg

SEQ ID NO: 1465034 - RNA, 16 nt, Homo sapiens
acaacuucaauaucca

SEQ ID NO: 1465035 - RNA, 16 nt, Homo sapiens
acaacuucagcaguac

SEQ ID NO: 1465036 - RNA, 22 nt, Homo sapiens
acaacuuccucccuuacagagc

SEQ ID NO: 1465037 - RNA, 20 nt, Homo sapiens
acaacuuggguucuucucag

SEQ ID NO: 1465038 - RNA, 14 nt, Homo sapiens
acaagaaccucucc

SEQ ID NO: 1465039 - RNA, 11 nt, Homo sapiens
acaagaagcug

SEQ ID NO: 1465040 - RNA, 18 nt, Homo sapiens
acaagaauguaacuccag

SEQ ID NO: 1465041 - RNA, 22 nt, Homo sapiens
acaagaauuucuugguaagaag

SEQ ID NO: 1465042 - RNA, 14 nt, Homo sapiens
acaagacauugugu

SEQ ID NO: 1465043 - RNA, 20 nt, Homo sapiens
acaagauccuccugcugcag

SEQ ID NO: 1465044 - RNA, 12 nt, Homo sapiens
acaagauugaaa

SEQ ID NO: 1465045 - RNA, 15 nt, Homo sapiens
acaagcugcauuuca

SEQ ID NO: 1465046 - RNA, 17 nt, Homo sapiens
acaagcuggaagcacau

SEQ ID NO: 1465047 - RNA, 16 nt, Homo sapiens
acaaggaugacaagaa

SEQ ID NO: 1465048 - RNA, 19 nt, Homo sapiens
acaagguugguugcuaaga

SEQ ID NO: 1465049 - RNA, 21 nt, Homo sapiens
acaaguauuauuuuacaauca

SEQ ID NO: 1465050 - RNA, 15 nt, Homo sapiens
acaagugcugaacag

SEQ ID NO: 1465051 - RNA, 18 nt, Homo sapiens
acaaguuuuaauccagaa

SEQ ID NO: 1465052 - RNA, 18 nt, Homo sapiens
acaauaaaaauuccaaau

SEQ ID NO: 1465053 - RNA, 16 nt, Homo sapiens
acaauaaaacauuaau

SEQ ID NO: 1465054 - RNA, 21 nt, Homo sapiens
acaauaaauguauucaaauac

SEQ ID NO: 1465055 - RNA, 23 nt, Homo sapiens
acaauacugggguuggacuguaa

SEQ ID NO: 1465056 - RNA, 20 nt, Homo sapiens
acaauauauuuaguuguaaa

SEQ ID NO: 1465057 - RNA, 20 nt, Homo sapiens
acaauauuaugaaauuucac

SEQ ID NO: 1465058 - RNA, 23 nt, Homo sapiens
acaaucaacucuaauagugcuua

SEQ ID NO: 1465059 - RNA, 19 nt, Homo sapiens
acaauccaugaacagcauu

SEQ ID NO: 1465060 - RNA, 20 nt, Homo sapiens
acaaucccuggggcugugca

SEQ ID NO: 1465061 - RNA, 23 nt, Homo sapiens
acaauuauaaacucauuuugcuu

SEQ ID NO: 1465062 - RNA, 16 nt, Homo sapiens
acaauuccuagauaaa

SEQ ID NO: 1465063 - RNA, 17 nt, Homo sapiens
acaauuggcacuaaaga

SEQ ID NO: 1465064 - RNA, 23 nt, Homo sapiens
acaauugggagauuaucuuucaa

SEQ ID NO: 1465065 - RNA, 17 nt, Homo sapiens
acaauuugauacauaau

SEQ ID NO: 1465066 - RNA, 13 nt, Homo sapiens
acacaaaaauuag

SEQ ID NO: 1465067 - RNA, 16 nt, Homo sapiens
acacaaagcucuguca

SEQ ID NO: 1465068 - RNA, 15 nt, Homo sapiens
acacaaauuuguaaa

SEQ ID NO: 1465069 - RNA, 18 nt, Homo sapiens
acacaaggcuccaagacc

SEQ ID NO: 1465070 - RNA, 20 nt, Homo sapiens
acacaaggcuccaagaccua

SEQ ID NO: 1465071 - RNA, 18 nt, Homo sapiens
acacaaggugcaaaucaa

SEQ ID NO: 1465072 - RNA, 20 nt, Homo sapiens
acacaauuguuuuaccuguu

SEQ ID NO: 1465073 - RNA, 15 nt, Homo sapiens
acacacaaagcacau

SEQ ID NO: 1465074 - RNA, 14 nt, Homo sapiens
acacacacacugcc

SEQ ID NO: 1465075 - RNA, 17 nt, Homo sapiens
acacacauacaaaaugu

SEQ ID NO: 1465076 - RNA, 15 nt, Homo sapiens
acacacuuccagugu

SEQ ID NO: 1465077 - RNA, 18 nt, Homo sapiens
acacagacuccacccucc

SEQ ID NO: 1465078 - RNA, 14 nt, Homo sapiens
acacagaugaaggu

SEQ ID NO: 1465079 - RNA, 16 nt, Homo sapiens
acacagcaacaaugac

SEQ ID NO: 1465080 - RNA, 23 nt, Homo sapiens
acacagcacucucuaaaucuucc

SEQ ID NO: 1465081 - RNA, 16 nt, Homo sapiens
acacagcuacagcuuu

SEQ ID NO: 1465082 - RNA, 23 nt, Homo sapiens
acacagcugcccuagcugacccc

SEQ ID NO: 1465083 - RNA, 12 nt, Homo sapiens
acacaggaugag

SEQ ID NO: 1465084 - RNA, 16 nt, Homo sapiens
acacaggcuguccuua

SEQ ID NO: 1465085 - RNA, 17 nt, Homo sapiens
acacaggcuucaucaag

SEQ ID NO: 1465086 - RNA, 18 nt, Homo sapiens
acacauaaggacgugugu

SEQ ID NO: 1465087 - RNA, 14 nt, Homo sapiens
acacaugccuuaaa

SEQ ID NO: 1465088 - RNA, 16 nt, Homo sapiens
acacauuguacauggu

SEQ ID NO: 1465089 - RNA, 21 nt, Homo sapiens
acacauuguacaugguacgaa

SEQ ID NO: 1465090 - RNA, 14 nt, Homo sapiens
acacauuuguacag

SEQ ID NO: 1465091 - RNA, 13 nt, Homo sapiens
acaccaccaacau

SEQ ID NO: 1465092 - RNA, 19 nt, Homo sapiens
acaccagagcagaugcaga

SEQ ID NO: 1465093 - RNA, 18 nt, Homo sapiens
aaggcccugcugcccaau

SEQ ID NO: 1465094 - RNA, 21 nt, Homo sapiens
aaggccugacuucugcuggca

SEQ ID NO: 1465095 - RNA, 16 nt, Homo sapiens
aaggccugguguuucu

SEQ ID NO: 1465096 - RNA, 21 nt, Homo sapiens
aaggcucuuacccccuuuuaa

SEQ ID NO: 1465097 - RNA, 16 nt, Homo sapiens
aagggaaacaggcuaa

SEQ ID NO: 1465098 - RNA, 13 nt, Homo sapiens
aagggaaacuauu

SEQ ID NO: 1465099 - RNA, 14 nt, Homo sapiens
aagggaauccuccu

SEQ ID NO: 1465100 - RNA, 12 nt, Homo sapiens
aagggacuccca

SEQ ID NO: 1465101 - RNA, 22 nt, Homo sapiens
aagggagagaacaaaagcuaua

SEQ ID NO: 1465102 - RNA, 17 nt, Homo sapiens
aagggcugaguguccag

SEQ ID NO: 1465103 - RNA, 18 nt, Homo sapiens
aagggcuugauggugaca

SEQ ID NO: 1465104 - RNA, 18 nt, Homo sapiens
aaggggcccaaauucuuu

SEQ ID NO: 1465105 - RNA, 23 nt, Homo sapiens
aaggggccucaccgagugggggc

SEQ ID NO: 1465106 - RNA, 17 nt, Homo sapiens
aagggguuggggugaca

SEQ ID NO: 1465107 - RNA, 14 nt, Homo sapiens
aagggucuugacuc

SEQ ID NO: 1465108 - RNA, 21 nt, Homo sapiens
aagggugcccuuugggguccc

SEQ ID NO: 1465109 - RNA, 19 nt, Homo sapiens
aagggugggugcucagaau

SEQ ID NO: 1465110 - RNA, 16 nt, Homo sapiens
aaggguuucucuauua

SEQ ID NO: 1465111 - RNA, 13 nt, Homo sapiens
aagguaugguggg

SEQ ID NO: 1465112 - RNA, 19 nt, Homo sapiens
aaggucaaacuaauucuca

SEQ ID NO: 1465113 - RNA, 21 nt, Homo sapiens
aaggucaaacuaauucucaca

SEQ ID NO: 1465114 - RNA, 18 nt, Homo sapiens
aagguccucugucaguca

SEQ ID NO: 1465115 - RNA, 22 nt, Homo sapiens
aaggucuuugacggcaccaucu

SEQ ID NO: 1465116 - RNA, 16 nt, Homo sapiens
aaggugaagagaccaa

SEQ ID NO: 1465117 - RNA, 15 nt, Homo sapiens
aaggugaccuugcaa

SEQ ID NO: 1465118 - RNA, 14 nt, Homo sapiens
aaggugcuacuuga

SEQ ID NO: 1465119 - RNA, 14 nt, Homo sapiens
aagguggaugccaa

SEQ ID NO: 1465120 - RNA, 21 nt, Homo sapiens
aaggugggaaggaugguccag

SEQ ID NO: 1465121 - RNA, 13 nt, Homo sapiens
aagguuaaaccca

SEQ ID NO: 1465122 - RNA, 14 nt, Homo sapiens
aagguucagcugaa

SEQ ID NO: 1465123 - RNA, 20 nt, Homo sapiens
aagguucucagguguugcca

SEQ ID NO: 1465124 - RNA, 22 nt, Homo sapiens
aagguuguguagcugugucaug

SEQ ID NO: 1465125 - RNA, 17 nt, Homo sapiens
aagguuuuuacugugag

SEQ ID NO: 1465126 - RNA, 14 nt, Homo sapiens
aaguaaauugccug

SEQ ID NO: 1465127 - RNA, 18 nt, Homo sapiens
aaguaaguuaauaaugua

SEQ ID NO: 1465128 - RNA, 22 nt, Homo sapiens
aaguaauuucuuugaucuggac

SEQ ID NO: 1465129 - RNA, 11 nt, Homo sapiens
aaguacauauu

SEQ ID NO: 1465130 - RNA, 14 nt, Homo sapiens
aaguagcugagacu

SEQ ID NO: 1465131 - RNA, 15 nt, Homo sapiens
aaguauacaguucaa

SEQ ID NO: 1465132 - RNA, 19 nt, Homo sapiens
aaguauauaauccugugaa

SEQ ID NO: 1465133 - RNA, 14 nt, Homo sapiens
aaguaucacucuaa

SEQ ID NO: 1465134 - RNA, 17 nt, Homo sapiens
aagucaaucauuucuca

SEQ ID NO: 1465135 - RNA, 14 nt, Homo sapiens
aagucacugacccu

SEQ ID NO: 1465136 - RNA, 13 nt, Homo sapiens
aagucauagccau

SEQ ID NO: 1465137 - RNA, 14 nt, Homo sapiens
aagucaucuacuua

SEQ ID NO: 1465138 - RNA, 15 nt, Homo sapiens
aaguccccucuacuu

SEQ ID NO: 1465139 - RNA, 17 nt, Homo sapiens
aaguccuuucuaaguau

SEQ ID NO: 1465140 - RNA, 17 nt, Homo sapiens
aagucuagagucucaga

SEQ ID NO: 1465141 - RNA, 15 nt, Homo sapiens
aagucugacucucca

SEQ ID NO: 1465142 - RNA, 15 nt, Homo sapiens
aagucugcuacccuc

SEQ ID NO: 1465143 - RNA, 14 nt, Homo sapiens
aagucugucugucu

SEQ ID NO: 1465144 - RNA, 17 nt, Homo sapiens
aagucuuauuuccucaa

SEQ ID NO: 1465145 - RNA, 16 nt, Homo sapiens
aagucuucagggaagg

SEQ ID NO: 1465146 - RNA, 14 nt, Homo sapiens
aagugaacuaugaa

SEQ ID NO: 1465147 - RNA, 15 nt, Homo sapiens
aagugacuauagaau

SEQ ID NO: 1465148 - RNA, 15 nt, Homo sapiens
aagugauacuaucca

SEQ ID NO: 1465149 - RNA, 15 nt, Homo sapiens
aagugaucaaacuac

SEQ ID NO: 1465150 - RNA, 13 nt, Homo sapiens
aagugcacuuuaa

SEQ ID NO: 1465151 - RNA, 15 nt, Homo sapiens
aagugcauauuuauc

SEQ ID NO: 1465152 - RNA, 21 nt, Homo sapiens
aagugccaaaugcucucucaa

SEQ ID NO: 1465153 - RNA, 17 nt, Homo sapiens
aagugcucuaacuuuuc

SEQ ID NO: 1465154 - RNA, 18 nt, Homo sapiens
aagugcugagauuacaca

SEQ ID NO: 1465155 - RNA, 20 nt, Homo sapiens
aagugcugggauuacaggca

SEQ ID NO: 1465156 - RNA, 22 nt, Homo sapiens
aagugggaucugucacaccagc

SEQ ID NO: 1465157 - RNA, 16 nt, Homo sapiens
aaguguaccuguguac

SEQ ID NO: 1465158 - RNA, 24 nt, Homo sapiens
aaguguauuuauuuuacagcucau

SEQ ID NO: 1465159 - RNA, 15 nt, Homo sapiens
aagugucaacucuuu

SEQ ID NO: 1465160 - RNA, 17 nt, Homo sapiens
aagugucucugccuuga

SEQ ID NO: 1465161 - RNA, 11 nt, Homo sapiens
aagugugagua

SEQ ID NO: 1465162 - RNA, 20 nt, Homo sapiens
aagugugauauacaaagugu

SEQ ID NO: 1465163 - RNA, 15 nt, Homo sapiens
aaguuaaagugaaua

SEQ ID NO: 1465164 - RNA, 16 nt, Homo sapiens
aaguuaaucuucaugg

SEQ ID NO: 1465165 - RNA, 13 nt, Homo sapiens
aaguuacuuuaug

SEQ ID NO: 1465166 - RNA, 12 nt, Homo sapiens
aaguuacuuugu

SEQ ID NO: 1465167 - RNA, 21 nt, Homo sapiens
aaguuauaguauaucuggaca

SEQ ID NO: 1465168 - RNA, 17 nt, Homo sapiens
aaguuauuaacuuuaau

SEQ ID NO: 1465169 - RNA, 16 nt, Homo sapiens
aaguuauugauguuuu

SEQ ID NO: 1465170 - RNA, 13 nt, Homo sapiens
aaguuauuuacuu

SEQ ID NO: 1465171 - RNA, 16 nt, Homo sapiens
aaguuauuuacuuuua

SEQ ID NO: 1465172 - RNA, 18 nt, Homo sapiens
aaguuccaguguucucuc

SEQ ID NO: 1465173 - RNA, 20 nt, Homo sapiens
aaguuccccuuauguggguu

SEQ ID NO: 1465174 - RNA, 22 nt, Homo sapiens
aaguucgaagcuccgugaguga

SEQ ID NO: 1465175 - RNA, 19 nt, Homo sapiens
aaguucugaagaugaugcg

SEQ ID NO: 1465176 - RNA, 14 nt, Homo sapiens
aaguucuucaccuc

SEQ ID NO: 1465177 - RNA, 20 nt, Homo sapiens
aaguugaagcuaagauuuag

SEQ ID NO: 1465178 - RNA, 12 nt, Homo sapiens
aaguugacuuau

SEQ ID NO: 1465179 - RNA, 22 nt, Homo sapiens
aaguugacuuauaguacaugau

SEQ ID NO: 1465180 - RNA, 22 nt, Homo sapiens
aaguugcauuccuuugucuuca

SEQ ID NO: 1465181 - RNA, 20 nt, Homo sapiens
aaguugcugaugaacucuua

SEQ ID NO: 1465182 - RNA, 19 nt, Homo sapiens
aaguuuacaaucaaaggaa

SEQ ID NO: 1465183 - RNA, 14 nt, Homo sapiens
aaguuuaucuuuca

SEQ ID NO: 1465184 - RNA, 18 nt, Homo sapiens
aaguuucccuuccuccau

SEQ ID NO: 1465185 - RNA, 16 nt, Homo sapiens
aaguuucugucuuccu

SEQ ID NO: 1465186 - RNA, 17 nt, Homo sapiens
aaguuugcacucuuuga

SEQ ID NO: 1465187 - RNA, 17 nt, Homo sapiens
aaguuugggccagugaa

SEQ ID NO: 1465188 - RNA, 19 nt, Homo sapiens
aaguuuucuuccaugauuu

SEQ ID NO: 1465189 - RNA, 17 nt, Homo sapiens
aauaaaaaguucagagu

SEQ ID NO: 1465190 - RNA, 20 nt, Homo sapiens
aauaaaacagcugucucuaa

SEQ ID NO: 1465191 - RNA, 13 nt, Homo sapiens
aauaaacaucagu

SEQ ID NO: 1465192 - RNA, 16 nt, Homo sapiens
aauaaacgcauuauca

SEQ ID NO: 1465193 - RNA, 21 nt, Homo sapiens
aauaaagaaugccauuucuca

SEQ ID NO: 1465194 - RNA, 14 nt, Homo sapiens
aauaaagcuucauu

SEQ ID NO: 1465195 - RNA, 17 nt, Homo sapiens
aagauccuucgggugcu

SEQ ID NO: 1465196 - RNA, 20 nt, Homo sapiens
aagaucgcaccauugcacuc

SEQ ID NO: 1465197 - RNA, 20 nt, Homo sapiens
aagaugacacaacugcacuc

SEQ ID NO: 1465198 - RNA, 19 nt, Homo sapiens
aagaugacggaugccuaga

SEQ ID NO: 1465199 - RNA, 12 nt, Homo sapiens
aagaugcuccug

SEQ ID NO: 1465200 - RNA, 18 nt, Homo sapiens
aagauguuucaaaaaauc

SEQ ID NO: 1465201 - RNA, 22 nt, Homo sapiens
aagauuacccugagcugcagcu

SEQ ID NO: 1465202 - RNA, 21 nt, Homo sapiens
aagauucauauuuacuucuua

SEQ ID NO: 1465203 - RNA, 13 nt, Homo sapiens
aagauugauacuu

SEQ ID NO: 1465204 - RNA, 14 nt, Homo sapiens
aagauugcugaaaa

SEQ ID NO: 1465205 - RNA, 15 nt, Homo sapiens
aagauuuaugaugca

SEQ ID NO: 1465206 - RNA, 15 nt, Homo sapiens
aagauuuucagaaaa

SEQ ID NO: 1465207 - RNA, 19 nt, Homo sapiens
aagauuuugaaugcuuccu

SEQ ID NO: 1465208 - RNA, 10 nt, Homo sapiens
aagcaaaaag

SEQ ID NO: 1465209 - RNA, 13 nt, Homo sapiens
aagcaaacacuua

SEQ ID NO: 1465210 - RNA, 20 nt, Homo sapiens
aagcaagacuguugcucaaa

SEQ ID NO: 1465211 - RNA, 17 nt, Homo sapiens
aagcaagcccuggccag

SEQ ID NO: 1465212 - RNA, 13 nt, Homo sapiens
aagcaaggccaaa

SEQ ID NO: 1465213 - RNA, 20 nt, Homo sapiens
aagcaaguagcuuuccacau

SEQ ID NO: 1465214 - RNA, 14 nt, Homo sapiens
aagcaaguuuucuu

SEQ ID NO: 1465215 - RNA, 17 nt, Homo sapiens
aagcaaguuuucuucca

SEQ ID NO: 1465216 - RNA, 20 nt, Homo sapiens
aaccuccgccucccggguuc

SEQ ID NO: 1465217 - RNA, 13 nt, Homo sapiens
aaccucuaugcaa

SEQ ID NO: 1465218 - RNA, 20 nt, Homo sapiens
aaccuggaaucuacaagcca

SEQ ID NO: 1465219 - RNA, 21 nt, Homo sapiens
aaccuggaaucuacaagccaa

SEQ ID NO: 1465220 - RNA, 23 nt, Homo sapiens
aaccuggaccccuucggcagcua

SEQ ID NO: 1465221 - RNA, 17 nt, Homo sapiens
aaccugguggcaccaga

SEQ ID NO: 1465222 - RNA, 14 nt, Homo sapiens
aaccugugugccau

SEQ ID NO: 1465223 - RNA, 16 nt, Homo sapiens
aaccuuauauuuacaa

SEQ ID NO: 1465224 - RNA, 18 nt, Homo sapiens
aaccuuauuguaccucuc

SEQ ID NO: 1465225 - RNA, 16 nt, Homo sapiens
aaccuugaaugcugcc

SEQ ID NO: 1465226 - RNA, 20 nt, Homo sapiens
aaccuugaaugcugccagug

SEQ ID NO: 1465227 - RNA, 17 nt, Homo sapiens
aacgaaucgauucugca

SEQ ID NO: 1465228 - RNA, 22 nt, Homo sapiens
aacgcaaagggcugaaagccau

SEQ ID NO: 1465229 - RNA, 17 nt, Homo sapiens
aacgccgcugacugcca

SEQ ID NO: 1465230 - RNA, 13 nt, Homo sapiens
aacgguccaugaa

SEQ ID NO: 1465231 - RNA, 19 nt, Homo sapiens
aacgucuaggaaaucuaga

SEQ ID NO: 1465232 - RNA, 17 nt, Homo sapiens
aacguuuugaacuaaua

SEQ ID NO: 1465233 - RNA, 21 nt, Homo sapiens
aacuaagaaaauucuauguua

SEQ ID NO: 1465234 - RNA, 19 nt, Homo sapiens
aacuaagaaauaugcacaa

SEQ ID NO: 1465235 - RNA, 13 nt, Homo sapiens
aacuaagagcucu

SEQ ID NO: 1465236 - RNA, 22 nt, Homo sapiens
aacuaaucaagaaaaacaucuu

SEQ ID NO: 1465237 - RNA, 23 nt, Homo sapiens
aacuaaucugauguuaaccaaug

SEQ ID NO: 1465238 - RNA, 17 nt, Homo sapiens
aacuacuucuuacuucu

SEQ ID NO: 1465239 - RNA, 12 nt, Homo sapiens
aacuacuucuuu

SEQ ID NO: 1465240 - RNA, 16 nt, Homo sapiens
aacuagagcacagaag

SEQ ID NO: 1465241 - RNA, 20 nt, Homo sapiens
aacuagagcacagaaggaau

SEQ ID NO: 1465242 - RNA, 14 nt, Homo sapiens
aacuaguauucccu

SEQ ID NO: 1465243 - RNA, 14 nt, Homo sapiens
aacuaugacagaua

SEQ ID NO: 1465244 - RNA, 18 nt, Homo sapiens
aacuaugacagauauauu

SEQ ID NO: 1465245 - RNA, 17 nt, Homo sapiens
aacuaugagcuugcuca

SEQ ID NO: 1465246 - RNA, 15 nt, Homo sapiens
aacuauuaaugauaa

SEQ ID NO: 1465247 - RNA, 17 nt, Homo sapiens
aacuauuuauugaauga

SEQ ID NO: 1465248 - RNA, 19 nt, Homo sapiens
aacucaaaaauauuugcug

SEQ ID NO: 1465249 - RNA, 16 nt, Homo sapiens
aacucaacuuugacaa

SEQ ID NO: 1465250 - RNA, 18 nt, Homo sapiens
aacucaaggacuuugcag

SEQ ID NO: 1465251 - RNA, 16 nt, Homo sapiens
aacucacaagugcuca

SEQ ID NO: 1465252 - RNA, 18 nt, Homo sapiens
aacucacaagugcucauc

SEQ ID NO: 1465253 - RNA, 13 nt, Homo sapiens
aacucacacuccc

SEQ ID NO: 1465254 - RNA, 14 nt, Homo sapiens
aacucacugagggu

SEQ ID NO: 1465255 - RNA, 21 nt, Homo sapiens
aacucacugaggguaucugac

SEQ ID NO: 1465256 - RNA, 15 nt, Homo sapiens
aacucacugcucaag

SEQ ID NO: 1465257 - RNA, 14 nt, Homo sapiens
aacucacugugauc

SEQ ID NO: 1465258 - RNA, 13 nt, Homo sapiens
aacucagauccag

SEQ ID NO: 1465259 - RNA, 18 nt, Homo sapiens
aacucagaucugucugau

SEQ ID NO: 1465260 - RNA, 12 nt, Homo sapiens
aacucagggaca

SEQ ID NO: 1465261 - RNA, 22 nt, Homo sapiens
aacucaguccuguacucugggg

SEQ ID NO: 1465262 - RNA, 19 nt, Homo sapiens
aacuccugaccucagguga

SEQ ID NO: 1465263 - RNA, 21 nt, Homo sapiens
aacuccugaccucaggugauu

SEQ ID NO: 1465264 - RNA, 16 nt, Homo sapiens
aacucuacaucuagca

SEQ ID NO: 1465265 - RNA, 13 nt, Homo sapiens
aacucucaagugu

SEQ ID NO: 1465266 - RNA, 12 nt, Homo sapiens
aacucucuccac

SEQ ID NO: 1465267 - RNA, 17 nt, Homo sapiens
aacucugggcugccaug

SEQ ID NO: 1465268 - RNA, 15 nt, Homo sapiens
aacucugguuucuac

SEQ ID NO: 1465269 - RNA, 14 nt, Homo sapiens
aacucuuacucuua

SEQ ID NO: 1465270 - RNA, 13 nt, Homo sapiens
aacucuuaucuca

SEQ ID NO: 1465271 - RNA, 20 nt, Homo sapiens
aacucuuucuggccugccuu

SEQ ID NO: 1465272 - RNA, 19 nt, Homo sapiens
aacugacaguaaaucucac

SEQ ID NO: 1465273 - RNA, 16 nt, Homo sapiens
aacugauaaguuucau

SEQ ID NO: 1465274 - RNA, 18 nt, Homo sapiens
aacugauuuuuagcuuua

SEQ ID NO: 1465275 - RNA, 22 nt, Homo sapiens
aacugcaggagcaguuugccac

SEQ ID NO: 1465276 - RNA, 19 nt, Homo sapiens
aacugccaggcugccuccu

SEQ ID NO: 1465277 - RNA, 13 nt, Homo sapiens
aacuguaugcuca

SEQ ID NO: 1465278 - RNA, 13 nt, Homo sapiens
aacugucaaccua

SEQ ID NO: 1465279 - RNA, 17 nt, Homo sapiens
aacugucuuccucaaaa

SEQ ID NO: 1465280 - RNA, 17 nt, Homo sapiens
aacugugaagcauuuac

SEQ ID NO: 1465281 - RNA, 20 nt, Homo sapiens
aacugugaauacuugaacuc

SEQ ID NO: 1465282 - RNA, 13 nt, Homo sapiens
aacugugccuugu

SEQ ID NO: 1465283 - RNA, 13 nt, Homo sapiens
aacuguguugcca

SEQ ID NO: 1465284 - RNA, 23 nt, Homo sapiens
aacuguuuuguaagugcugcuau

SEQ ID NO: 1465285 - RNA, 17 nt, Homo sapiens
aacuuaaaaaaaugaca

SEQ ID NO: 1465286 - RNA, 21 nt, Homo sapiens
aacuuaccacccccauacuau

SEQ ID NO: 1465287 - RNA, 16 nt, Homo sapiens
aacuuagagauugcau

SEQ ID NO: 1465288 - RNA, 23 nt, Homo sapiens
aacuuaggcccuagcggcagaaa

SEQ ID NO: 1465289 - RNA, 18 nt, Homo sapiens
aacuuauggaaagcccau

SEQ ID NO: 1465290 - RNA, 21 nt, Homo sapiens
aacuuauucuuugaguaaugu

SEQ ID NO: 1465291 - RNA, 13 nt, Homo sapiens
aacuucaaagagg

SEQ ID NO: 1465292 - RNA, 16 nt, Homo sapiens
aacuucaccuacauua

SEQ ID NO: 1465293 - RNA, 20 nt, Homo sapiens
aacuucaccuacauuaucuc

SEQ ID NO: 1465294 - RNA, 23 nt, Homo sapiens
aacuucagagcaugaaaaucaca

SEQ ID NO: 1465295 - RNA, 14 nt, Homo sapiens
ugaaagaccuucuc

SEQ ID NO: 1465296 - RNA, 17 nt, Homo sapiens
ugaaagagauuacuuaa

SEQ ID NO: 1465297 - RNA, 17 nt, Homo sapiens
ugaaagcucuguugcaa

SEQ ID NO: 1465298 - RNA, 23 nt, Homo sapiens
ugaaaggagaugucuuggaacau

SEQ ID NO: 1465299 - RNA, 13 nt, Homo sapiens
ugaaagggcaaua

SEQ ID NO: 1465300 - RNA, 23 nt, Homo sapiens
ugaaagguacuauauuugcuaga

SEQ ID NO: 1465301 - RNA, 21 nt, Homo sapiens
ugaaauaaaacuacaugguca

SEQ ID NO: 1465302 - RNA, 18 nt, Homo sapiens
ugaaauaacaaaauggac

SEQ ID NO: 1465303 - RNA, 23 nt, Homo sapiens
ugaaauaccaaccugaagacacc

SEQ ID NO: 1465304 - RNA, 13 nt, Homo sapiens
ugaaaucuuuuaa

SEQ ID NO: 1465305 - RNA, 13 nt, Homo sapiens
ugaaaugaccucu

SEQ ID NO: 1465306 - RNA, 18 nt, Homo sapiens
ugaaaugcuguuaguaaa

SEQ ID NO: 1465307 - RNA, 17 nt, Homo sapiens
ugaaauguuugcauaaa

SEQ ID NO: 1465308 - RNA, 16 nt, Homo sapiens
ugaaauuauacagaua

SEQ ID NO: 1465309 - RNA, 19 nt, Homo sapiens
ugaaauuauuugucauuca

SEQ ID NO: 1465310 - RNA, 22 nt, Homo sapiens
ugaacaaaaauugagacauuua

SEQ ID NO: 1465311 - RNA, 12 nt, Homo sapiens
ugaacaaacaau

SEQ ID NO: 1465312 - RNA, 15 nt, Homo sapiens
ugaacaaacuaaagg

SEQ ID NO: 1465313 - RNA, 11 nt, Homo sapiens
ugaacacuccc

SEQ ID NO: 1465314 - RNA, 12 nt, Homo sapiens
ugaacacucccc

SEQ ID NO: 1465315 - RNA, 20 nt, Homo sapiens
ugaacacucuuuugcuuuau

SEQ ID NO: 1465316 - RNA, 21 nt, Homo sapiens
ugaacaucccuuuuucaauga

SEQ ID NO: 1465317 - RNA, 15 nt, Homo sapiens
ugaaccaugaaguca

SEQ ID NO: 1465318 - RNA, 16 nt, Homo sapiens
ugaacccaagagcaag

SEQ ID NO: 1465319 - RNA, 16 nt, Homo sapiens
ugaaccuucugcaaca

SEQ ID NO: 1465320 - RNA, 15 nt, Homo sapiens
ugaacuaacugacag

SEQ ID NO: 1465321 - RNA, 18 nt, Homo sapiens
ugaacucuucaaucucuu

SEQ ID NO: 1465322 - RNA, 21 nt, Homo sapiens
ugaacugcuucuccaaggaca

SEQ ID NO: 1465323 - RNA, 14 nt, Homo sapiens
ugaacuguauuuau

SEQ ID NO: 1465324 - RNA, 14 nt, Homo sapiens
ugaacugugcauag

SEQ ID NO: 1465325 - RNA, 13 nt, Homo sapiens
ugaacuugccuua

SEQ ID NO: 1465326 - RNA, 17 nt, Homo sapiens
ugaagaaaaaaucagaa

SEQ ID NO: 1465327 - RNA, 13 nt, Homo sapiens
ugaagacaggaug

SEQ ID NO: 1465328 - RNA, 14 nt, Homo sapiens
ugaagagcuucauu

SEQ ID NO: 1465329 - RNA, 13 nt, Homo sapiens
ugaagaucugaga

SEQ ID NO: 1465330 - RNA, 13 nt, Homo sapiens
ugaagcagugauu

SEQ ID NO: 1465331 - RNA, 13 nt, Homo sapiens
ugaagccaaagaa

SEQ ID NO: 1465332 - RNA, 14 nt, Homo sapiens
ugaagccaauucag

SEQ ID NO: 1465333 - RNA, 21 nt, Homo sapiens
ugaagccaauucagacaggca

SEQ ID NO: 1465334 - RNA, 16 nt, Homo sapiens
ugaagcgaaacacaga

SEQ ID NO: 1465335 - RNA, 18 nt, Homo sapiens
ugaagcuuggaggucaca

SEQ ID NO: 1465336 - RNA, 19 nt, Homo sapiens
ugaagcuuggaggucacag

SEQ ID NO: 1465337 - RNA, 16 nt, Homo sapiens
ugaaggaaaaacacaa

SEQ ID NO: 1465338 - RNA, 16 nt, Homo sapiens
ugaaggagcagcauug

SEQ ID NO: 1465339 - RNA, 23 nt, Homo sapiens
ugaaggaggugagggaugugaau

SEQ ID NO: 1465340 - RNA, 17 nt, Homo sapiens
ugaaggcuuacuucaga

SEQ ID NO: 1465341 - RNA, 12 nt, Homo sapiens
ugaaggugaccu

SEQ ID NO: 1465342 - RNA, 19 nt, Homo sapiens
ugaagguggaacaagcaca

SEQ ID NO: 1465343 - RNA, 14 nt, Homo sapiens
ugaagucagcucag

SEQ ID NO: 1465344 - RNA, 14 nt, Homo sapiens
ugaagucaguucuc

SEQ ID NO: 1465345 - RNA, 19 nt, Homo sapiens
ugaagugcuuaguguacuu

SEQ ID NO: 1465346 - RNA, 15 nt, Homo sapiens
ugaaguuacaugcau

SEQ ID NO: 1465347 - RNA, 18 nt, Homo sapiens
ugaaguuggaagccauuu

SEQ ID NO: 1465348 - RNA, 15 nt, Homo sapiens
ugaaguuuacauuuu

SEQ ID NO: 1465349 - RNA, 22 nt, Homo sapiens
ugaauaacauuugugugguggg

SEQ ID NO: 1465350 - RNA, 16 nt, Homo sapiens
ugaauaaccacuuaaa

SEQ ID NO: 1465351 - RNA, 13 nt, Homo sapiens
ugaauacauuucc

SEQ ID NO: 1465352 - RNA, 17 nt, Homo sapiens
ugaauacugggaaucaa

SEQ ID NO: 1465353 - RNA, 18 nt, Homo sapiens
ugaaucgagugagacaaa

SEQ ID NO: 1465354 - RNA, 11 nt, Homo sapiens
ugaaucuacaa

SEQ ID NO: 1465355 - RNA, 15 nt, Homo sapiens
ugaaucuauuucacu

SEQ ID NO: 1465356 - RNA, 16 nt, Homo sapiens
ugaaugagagguuccu

SEQ ID NO: 1465357 - RNA, 15 nt, Homo sapiens
ugaaugcagggaaug

SEQ ID NO: 1465358 - RNA, 20 nt, Homo sapiens
ugaaugccuaaauauaauua

SEQ ID NO: 1465359 - RNA, 14 nt, Homo sapiens
ugaaugcugccaca

SEQ ID NO: 1465360 - RNA, 17 nt, Homo sapiens
ugaaugugguuacuucc

SEQ ID NO: 1465361 - RNA, 22 nt, Homo sapiens
ugaauucugcccuuuucucuca

SEQ ID NO: 1465362 - RNA, 17 nt, Homo sapiens
ugaauuguuaauucaca

SEQ ID NO: 1465363 - RNA, 13 nt, Homo sapiens
ugaauuucacugu

SEQ ID NO: 1465364 - RNA, 15 nt, Homo sapiens
ugaauuucuaaaaaa

SEQ ID NO: 1465365 - RNA, 17 nt, Homo sapiens
ugaauuuucaaguaauu

SEQ ID NO: 1465366 - RNA, 16 nt, Homo sapiens
ugacaacaaccuaugc

SEQ ID NO: 1465367 - RNA, 12 nt, Homo sapiens
ugacaaccucuu

SEQ ID NO: 1465368 - RNA, 17 nt, Homo sapiens
ugacaacugugacugua

SEQ ID NO: 1465369 - RNA, 14 nt, Homo sapiens
ugacaacuuccaga

SEQ ID NO: 1465370 - RNA, 14 nt, Homo sapiens
ugacaagcacugcu

SEQ ID NO: 1465371 - RNA, 18 nt, Homo sapiens
ugacaaucaacucuaaua

SEQ ID NO: 1465372 - RNA, 15 nt, Homo sapiens
ugacacaacugcacu

SEQ ID NO: 1465373 - RNA, 12 nt, Homo sapiens
ugacacacagca

SEQ ID NO: 1465374 - RNA, 13 nt, Homo sapiens
ugacacagucaau

SEQ ID NO: 1465375 - RNA, 15 nt, Homo sapiens
ugacaccugcugaga

SEQ ID NO: 1465376 - RNA, 12 nt, Homo sapiens
ugacacuauuca

SEQ ID NO: 1465377 - RNA, 23 nt, Homo sapiens
ugacagaaagcagauaccucacc

SEQ ID NO: 1465378 - RNA, 16 nt, Homo sapiens
uucuucuguauguuag

SEQ ID NO: 1465379 - RNA, 16 nt, Homo sapiens
uucuucuguccugaga

SEQ ID NO: 1465380 - RNA, 22 nt, Homo sapiens
uucuucuucagaagacacugca

SEQ ID NO: 1465381 - RNA, 19 nt, Homo sapiens
uuuaaaauauuuagucuaa

SEQ ID NO: 1465382 - RNA, 17 nt, Homo sapiens
uuuaaacaaaugugaua

SEQ ID NO: 1465383 - RNA, 14 nt, Homo sapiens
uuuaaacacaugcc

SEQ ID NO: 1465384 - RNA, 15 nt, Homo sapiens
uuuaaacucagggac

SEQ ID NO: 1465385 - RNA, 22 nt, Homo sapiens
uuuaaagcauauuggugcuaga

SEQ ID NO: 1465386 - RNA, 18 nt, Homo sapiens
uuuaaaguggcaaucuca

SEQ ID NO: 1465387 - RNA, 15 nt, Homo sapiens
uuuaaaguugcacau

SEQ ID NO: 1465388 - RNA, 16 nt, Homo sapiens
uuuaacaaacuaaaaa

SEQ ID NO: 1465389 - RNA, 14 nt, Homo sapiens
uuuaacagcugaau

SEQ ID NO: 1465390 - RNA, 14 nt, Homo sapiens
uuuaacguuuucau

SEQ ID NO: 1465391 - RNA, 17 nt, Homo sapiens
uuuaagauuuuucucaa

SEQ ID NO: 1465392 - RNA, 14 nt, Homo sapiens
uuuaagcuaccaau

SEQ ID NO: 1465393 - RNA, 12 nt, Homo sapiens
uuuaaggcuaaa

SEQ ID NO: 1465394 - RNA, 23 nt, Homo sapiens
uuuaagggcaugccuugugcugu

SEQ ID NO: 1465395 - RNA, 22 nt, Homo sapiens
uuuaauacaggguagauaaccu

SEQ ID NO: 1465396 - RNA, 16 nt, Homo sapiens
uuuaauauacuuuaaa

SEQ ID NO: 1465397 - RNA, 15 nt, Homo sapiens
uuuaauaugcuuaaa

SEQ ID NO: 1465398 - RNA, 23 nt, Homo sapiens
uuuaauccuguaccaaaucugac

SEQ ID NO: 1465399 - RNA, 16 nt, Homo sapiens
uuuaaugauaaguaaa

SEQ ID NO: 1465400 - RNA, 23 nt, Homo sapiens
uuuaauggcaauaggacauugug

SEQ ID NO: 1465401 - RNA, 15 nt, Homo sapiens
uuuaauucauaguaa

SEQ ID NO: 1465402 - RNA, 15 nt, Homo sapiens
uuuaauuuagugauc

SEQ ID NO: 1465403 - RNA, 23 nt, Homo sapiens
uuuaauuuagugaucuuagcaua

SEQ ID NO: 1465404 - RNA, 17 nt, Homo sapiens
uuuaauuuguuaucuca

SEQ ID NO: 1465405 - RNA, 21 nt, Homo sapiens
uuuacagcuaucgaacuucac

SEQ ID NO: 1465406 - RNA, 23 nt, Homo sapiens
uuuacauguauuuaaaguagcau

SEQ ID NO: 1465407 - RNA, 14 nt, Homo sapiens
uuuaccacagcagc

SEQ ID NO: 1465408 - RNA, 17 nt, Homo sapiens
uuuaccaguugccuuuu

SEQ ID NO: 1465409 - RNA, 24 nt, Homo sapiens
uuuacuuccauaggacauacugca

SEQ ID NO: 1465410 - RNA, 20 nt, Homo sapiens
uuuacuuuuaccacuauuua

SEQ ID NO: 1465411 - RNA, 19 nt, Homo sapiens
uuuagaaauagaacuacaa

SEQ ID NO: 1465412 - RNA, 22 nt, Homo sapiens
uuuagaacuuuaccuauggaag

SEQ ID NO: 1465413 - RNA, 21 nt, Homo sapiens
uuuagaagauagaugcacuua

SEQ ID NO: 1465414 - RNA, 21 nt, Homo sapiens
uuuagcauaguaccucugcua

SEQ ID NO: 1465415 - RNA, 22 nt, Homo sapiens
uuuagcauaguaccucugcuau

SEQ ID NO: 1465416 - RNA, 19 nt, Homo sapiens
uuuagcguagcuaagugaa

SEQ ID NO: 1465417 - RNA, 23 nt, Homo sapiens
uuuaguuguaaaccaagugauca

SEQ ID NO: 1465418 - RNA, 16 nt, Homo sapiens
uuuauaagagcuaaag

SEQ ID NO: 1465419 - RNA, 16 nt, Homo sapiens
uuuauaagagugccgu

SEQ ID NO: 1465420 - RNA, 13 nt, Homo sapiens
uuuauaagucauu

SEQ ID NO: 1465421 - RNA, 14 nt, Homo sapiens
uuuauaaucaauga

SEQ ID NO: 1465422 - RNA, 19 nt, Homo sapiens
uuuauacugauuaugucuu

SEQ ID NO: 1465423 - RNA, 15 nt, Homo sapiens
uuuauacuguuuacu

SEQ ID NO: 1465424 - RNA, 14 nt, Homo sapiens
uuuauagagugucu

SEQ ID NO: 1465425 - RNA, 17 nt, Homo sapiens
uuuauaucaugcaaaau

SEQ ID NO: 1465426 - RNA, 17 nt, Homo sapiens
uuuauauguacaugaga

SEQ ID NO: 1465427 - RNA, 15 nt, Homo sapiens
uuuaucaaagcauag

SEQ ID NO: 1465428 - RNA, 19 nt, Homo sapiens
uuuaucacacuucugugag

SEQ ID NO: 1465429 - RNA, 23 nt, Homo sapiens
uuuaucacuucauucacauucag

SEQ ID NO: 1465430 - RNA, 14 nt, Homo sapiens
uuuauccuagucau

SEQ ID NO: 1465431 - RNA, 13 nt, Homo sapiens
uuuaugaaaugac

SEQ ID NO: 1465432 - RNA, 18 nt, Homo sapiens
uuuaugugcucuccaaau

SEQ ID NO: 1465433 - RNA, 23 nt, Homo sapiens
uuuauuaauuugaaaccaggaca

SEQ ID NO: 1465434 - RNA, 11 nt, Homo sapiens
uuuauucacau

SEQ ID NO: 1465435 - RNA, 19 nt, Homo sapiens
uuuauucauuagcugugau

SEQ ID NO: 1465436 - RNA, 15 nt, Homo sapiens
uuuauuucugaucua

SEQ ID NO: 1465437 - RNA, 16 nt, Homo sapiens
uuuauuucugaucuau

SEQ ID NO: 1465438 - RNA, 22 nt, Homo sapiens
uuucaaaaaaucugaccaaaac

SEQ ID NO: 1465439 - RNA, 19 nt, Homo sapiens
uuucaaaauauacauucaa

SEQ ID NO: 1465440 - RNA, 20 nt, Homo sapiens
uuucaaauuuuuacugagaa

SEQ ID NO: 1465441 - RNA, 13 nt, Homo sapiens
uuucaaguucaau

SEQ ID NO: 1465442 - RNA, 18 nt, Homo sapiens
uuucaauaucuuaauacc

SEQ ID NO: 1465443 - RNA, 16 nt, Homo sapiens
uuucacaauaccucau

SEQ ID NO: 1465444 - RNA, 18 nt, Homo sapiens
uuucagauaaacaacaaa

SEQ ID NO: 1465445 - RNA, 12 nt, Homo sapiens
uuucagcuaaag

SEQ ID NO: 1465446 - RNA, 18 nt, Homo sapiens
uuucaguauaauuuaacu

SEQ ID NO: 1465447 - RNA, 22 nt, Homo sapiens
uuucaguauaauuuaacuucag

SEQ ID NO: 1465448 - RNA, 18 nt, Homo sapiens
uuucaguaucaucuccau

SEQ ID NO: 1465449 - RNA, 23 nt, Homo sapiens
uuucaguggcuaccuacauacaa

SEQ ID NO: 1465450 - RNA, 20 nt, Homo sapiens
uuucauaagaauucuguuga

SEQ ID NO: 1465451 - RNA, 15 nt, Homo sapiens
uuucaucacacuggg

SEQ ID NO: 1465452 - RNA, 21 nt, Homo sapiens
uuucaucacacuggguggugg

SEQ ID NO: 1465453 - RNA, 14 nt, Homo sapiens
uuucaucagucaau

SEQ ID NO: 1465454 - RNA, 17 nt, Homo sapiens
uuucaucauaacauaaa

SEQ ID NO: 1465455 - RNA, 15 nt, Homo sapiens
uuucaucuaauguga

SEQ ID NO: 1465456 - RNA, 19 nt, Homo sapiens
uuucauggucugcugagua

SEQ ID NO: 1465457 - RNA, 13 nt, Homo sapiens
uuucauguaaucc

SEQ ID NO: 1465458 - RNA, 21 nt, Homo sapiens
uuucauguggcuguagauccc

SEQ ID NO: 1465459 - RNA, 17 nt, Homo sapiens
uuuccacauuugucaca

SEQ ID NO: 1465460 - RNA, 12 nt, Homo sapiens
uuuccagggaua

SEQ ID NO: 1465461 - RNA, 17 nt, Homo sapiens
uuuccaggguugcuuga

SEQ ID NO: 1465462 - RNA, 22 nt, Homo sapiens
uuuccaguggaucauaagacaa

SEQ ID NO: 1465463 - RNA, 23 nt, Homo sapiens
uuuccaguuuauaagacuggaau

SEQ ID NO: 1465464 - RNA, 20 nt, Homo sapiens
uuucccacaucuuuccucaa

SEQ ID NO: 1465465 - RNA, 21 nt, Homo sapiens
uuucccagucccauuccucag

SEQ ID NO: 1465466 - RNA, 17 nt, Homo sapiens
uuuccccaaccacagag

SEQ ID NO: 1465467 - RNA, 13 nt, Homo sapiens
uuuccccuaucau

SEQ ID NO: 1465468 - RNA, 22 nt, Homo sapiens
uuucccuuccugggucuaccac

SEQ ID NO: 1465469 - RNA, 16 nt, Homo sapiens
uuuccgagccuccagu

SEQ ID NO: 1465470 - RNA, 19 nt, Homo sapiens
uuuccgagccuccagucca

SEQ ID NO: 1465471 - RNA, 18 nt, Homo sapiens
uuuccuaaaugcagugaa

SEQ ID NO: 1465472 - RNA, 17 nt, Homo sapiens
uuuccuagcuguguuau

SEQ ID NO: 1465473 - RNA, 15 nt, Homo sapiens
uuuccuccucaggca

SEQ ID NO: 1465474 - RNA, 12 nt, Homo sapiens
uuuccuccugag

SEQ ID NO: 1465475 - RNA, 16 nt, Homo sapiens
uuuccugauaacauua

SEQ ID NO: 1465476 - RNA, 16 nt, Homo sapiens
uuuccuuaaacugugu

SEQ ID NO: 1465477 - RNA, 11 nt, Homo sapiens
uuuccuuccau

SEQ ID NO: 1465478 - RNA, 17 nt, Homo sapiens
uuuccuuuaugugaauu

SEQ ID NO: 1465479 - RNA, 22 nt, Homo sapiens
ugcuucaaauaaaguccugaca

SEQ ID NO: 1465480 - RNA, 13 nt, Homo sapiens
ugcuucaguccac

SEQ ID NO: 1465481 - RNA, 16 nt, Homo sapiens
ugcuucaguugcauau

SEQ ID NO: 1465482 - RNA, 13 nt, Homo sapiens
ugcuucaucugcu

SEQ ID NO: 1465483 - RNA, 23 nt, Homo sapiens
ugcuuccgguagggaggcagccu

SEQ ID NO: 1465484 - RNA, 20 nt, Homo sapiens
ugcuucucaucccaaccucu

SEQ ID NO: 1465485 - RNA, 15 nt, Homo sapiens
ugcuucuuuaccaag

SEQ ID NO: 1465486 - RNA, 14 nt, Homo sapiens
ugcuugaacccaag

SEQ ID NO: 1465487 - RNA, 14 nt, Homo sapiens
ugcuugaccaaaga

SEQ ID NO: 1465488 - RNA, 13 nt, Homo sapiens
ugcuugauuccag

SEQ ID NO: 1465489 - RNA, 22 nt, Homo sapiens
ugcuugggacauugcaauuugc

SEQ ID NO: 1465490 - RNA, 12 nt, Homo sapiens
ugcuugugccac

SEQ ID NO: 1465491 - RNA, 19 nt, Homo sapiens
ugcuugugccacacccucc

SEQ ID NO: 1465492 - RNA, 20 nt, Homo sapiens
ugcacauuggucauugugaa

SEQ ID NO: 1465493 - RNA, 21 nt, Homo sapiens
ugcacauuucuuugcauucca

SEQ ID NO: 1465494 - RNA, 18 nt, Homo sapiens
ugcaccaacgagcuguac

SEQ ID NO: 1465495 - RNA, 14 nt, Homo sapiens
ugcaccacugcucu

SEQ ID NO: 1465496 - RNA, 17 nt, Homo sapiens
ugcaccacuucaaguga

SEQ ID NO: 1465497 - RNA, 15 nt, Homo sapiens
ugcaccaggcacugc

SEQ ID NO: 1465498 - RNA, 19 nt, Homo sapiens
ugcaccagguagaacgcca

SEQ ID NO: 1465499 - RNA, 15 nt, Homo sapiens
ugcacccacccagga

SEQ ID NO: 1465500 - RNA, 19 nt, Homo sapiens
ugcaccccucugcccucau

SEQ ID NO: 1465501 - RNA, 16 nt, Homo sapiens
ugcaccccugagccag

SEQ ID NO: 1465502 - RNA, 21 nt, Homo sapiens
ugcaccuguccccacccucca

SEQ ID NO: 1465503 - RNA, 19 nt, Homo sapiens
ugcacgggagaauauacaa

SEQ ID NO: 1465504 - RNA, 13 nt, Homo sapiens
ugcacuacugaca

SEQ ID NO: 1465505 - RNA, 20 nt, Homo sapiens
ugcacuauguauauacauau

SEQ ID NO: 1465506 - RNA, 20 nt, Homo sapiens
ugcacuccagcuugggcaac

SEQ ID NO: 1465507 - RNA, 16 nt, Homo sapiens
ugcacucuaaacugca

SEQ ID NO: 1465508 - RNA, 16 nt, Homo sapiens
ugcacugaucacccaa

SEQ ID NO: 1465509 - RNA, 16 nt, Homo sapiens
ugcacugucacuuugc

SEQ ID NO: 1465510 - RNA, 15 nt, Homo sapiens
ugcacuguccugacc

SEQ ID NO: 1465511 - RNA, 23 nt, Homo sapiens
ugcacugucugagaauuuccaaa

SEQ ID NO: 1465512 - RNA, 23 nt, Homo sapiens
ugcacuuguggcaacagauaagu

SEQ ID NO: 1465513 - RNA, 20 nt, Homo sapiens
ugcacuuuuuuauaagagcu

SEQ ID NO: 1465514 - RNA, 13 nt, Homo sapiens
ugcagagagccau

SEQ ID NO: 1465515 - RNA, 19 nt, Homo sapiens
ugcagaggauaaggaggca

SEQ ID NO: 1465516 - RNA, 16 nt, Homo sapiens
ugcagaguaggcagcu

SEQ ID NO: 1465517 - RNA, 14 nt, Homo sapiens
ugcagauuugauau

SEQ ID NO: 1465518 - RNA, 22 nt, Homo sapiens
ugcagcagugagucucuucaga

SEQ ID NO: 1465519 - RNA, 19 nt, Homo sapiens
ugcagcccagaauagcuuu

SEQ ID NO: 1465520 - RNA, 14 nt, Homo sapiens
ugcagcccaugccc

SEQ ID NO: 1465521 - RNA, 20 nt, Homo sapiens
ugcagcuagaggcaucuucu

SEQ ID NO: 1465522 - RNA, 16 nt, Homo sapiens
ugcagcuuuauguuca

SEQ ID NO: 1465523 - RNA, 22 nt, Homo sapiens
ugcaggacuugagaagaccuca

SEQ ID NO: 1465524 - RNA, 22 nt, Homo sapiens
ugcaggcccuuugaagccucag

SEQ ID NO: 1465525 - RNA, 22 nt, Homo sapiens
ugcaggccgugugucugucagc

SEQ ID NO: 1465526 - RNA, 13 nt, Homo sapiens
ugcagggacucca

SEQ ID NO: 1465527 - RNA, 16 nt, Homo sapiens
ugcagggccacuggaa

SEQ ID NO: 1465528 - RNA, 18 nt, Homo sapiens
ugcagggcuggucagggu

SEQ ID NO: 1465529 - RNA, 22 nt, Homo sapiens
ugcaggggguggacaaacugga

SEQ ID NO: 1465530 - RNA, 18 nt, Homo sapiens
ugcagguuuguuacauag

SEQ ID NO: 1465531 - RNA, 11 nt, Homo sapiens
ugcaguagcac

SEQ ID NO: 1465532 - RNA, 20 nt, Homo sapiens
ugcaguaggggcuacuguga

SEQ ID NO: 1465533 - RNA, 21 nt, Homo sapiens
ugcaguaggggcuacugugac

SEQ ID NO: 1465534 - RNA, 22 nt, Homo sapiens
ugcaguaggggcuacugugacc

SEQ ID NO: 1465535 - RNA, 22 nt, Homo sapiens
ugcagucggugguaccugagau

SEQ ID NO: 1465536 - RNA, 14 nt, Homo sapiens
ugcagugaauucau

SEQ ID NO: 1465537 - RNA, 16 nt, Homo sapiens
ugcagugagcccagau

SEQ ID NO: 1465538 - RNA, 18 nt, Homo sapiens
ugcaguggcgugaucucg

SEQ ID NO: 1465539 - RNA, 18 nt, Homo sapiens
ugcaguucagcaccaccc

SEQ ID NO: 1465540 - RNA, 21 nt, Homo sapiens
ugcaguuguaggcauguagcu

SEQ ID NO: 1465541 - RNA, 15 nt, Homo sapiens
ugcaguuuccaaucc

SEQ ID NO: 1465542 - RNA, 13 nt, Homo sapiens
ugcauagcucuau

SEQ ID NO: 1465543 - RNA, 15 nt, Homo sapiens
ugcauaggcucuuaa

SEQ ID NO: 1465544 - RNA, 13 nt, Homo sapiens
ugcauaugaaauc

SEQ ID NO: 1465545 - RNA, 17 nt, Homo sapiens
ugcauaugucacuagaa

SEQ ID NO: 1465546 - RNA, 19 nt, Homo sapiens
ugcauccccuuggcuguga

SEQ ID NO: 1465547 - RNA, 21 nt, Homo sapiens
ugcaugacaaacacacaucca

SEQ ID NO: 1465548 - RNA, 17 nt, Homo sapiens
ugcauggaggcccuccu

SEQ ID NO: 1465549 - RNA, 14 nt, Homo sapiens
ugcauggcuccaga

SEQ ID NO: 1465550 - RNA, 21 nt, Homo sapiens
ugcauguaccauuugcauggc

SEQ ID NO: 1465551 - RNA, 14 nt, Homo sapiens
ugcauguacuguau

SEQ ID NO: 1465552 - RNA, 24 nt, Homo sapiens
ugcauguagucacuuuauaaguca

SEQ ID NO: 1465553 - RNA, 22 nt, Homo sapiens
ugcauguccggcugaaggcuga

SEQ ID NO: 1465554 - RNA, 16 nt, Homo sapiens
ugcauucccagugguc

SEQ ID NO: 1465555 - RNA, 14 nt, Homo sapiens
ugcauuuagcuucu

SEQ ID NO: 1465556 - RNA, 15 nt, Homo sapiens
ugcauuuagcuucuu

SEQ ID NO: 1465557 - RNA, 16 nt, Homo sapiens
ugcauuuccuuucuac

SEQ ID NO: 1465558 - RNA, 13 nt, Homo sapiens
ugcauuuguucag

SEQ ID NO: 1465559 - RNA, 21 nt, Homo sapiens
ugcauuuucccagauacuucc

SEQ ID NO: 1465560 - RNA, 18 nt, Homo sapiens
ugccaaaggaugugauau

SEQ ID NO: 1465561 - RNA, 18 nt, Homo sapiens
ugccaaagggaaauauca

SEQ ID NO: 1465562 - RNA, 16 nt, Homo sapiens
ugccaaauauguccug

SEQ ID NO: 1465563 - RNA, 21 nt, Homo sapiens
ugccaaccggucacccaggag

SEQ ID NO: 1465564 - RNA, 22 nt, Homo sapiens
ugccaaggcaaaaaacucuuaa

SEQ ID NO: 1465565 - RNA, 17 nt, Homo sapiens
ugccaaugaccaaacag

SEQ ID NO: 1465566 - RNA, 22 nt, Homo sapiens
ugccacaaugcaguucugagca

SEQ ID NO: 1465567 - RNA, 15 nt, Homo sapiens
ugccacauacaggug

SEQ ID NO: 1465568 - RNA, 22 nt, Homo sapiens
ugccacauuucugaucagaggu

SEQ ID NO: 1465569 - RNA, 19 nt, Homo sapiens
ugccaccaggcacugccug

SEQ ID NO: 1465570 - RNA, 20 nt, Homo sapiens
ugccaccauggccagccaac

SEQ ID NO: 1465571 - RNA, 20 nt, Homo sapiens
ugccacccaggcuggagugc

SEQ ID NO: 1465572 - RNA, 23 nt, Homo sapiens
ugccacccaggcuggagugcagu

SEQ ID NO: 1465573 - RNA, 18 nt, Homo sapiens
ugccacucagagacuuca

SEQ ID NO: 1465574 - RNA, 17 nt, Homo sapiens
ugccagaugcaauacaa

SEQ ID NO: 1465575 - RNA, 11 nt, Homo sapiens
ugccagcagcc

SEQ ID NO: 1465576 - RNA, 16 nt, Homo sapiens
ugccaggcaacuuuua

SEQ ID NO: 1465577 - RNA, 18 nt, Homo sapiens
ugccagggacugacaaaa

SEQ ID NO: 1465578 - RNA, 19 nt, Homo sapiens
ugccagggcccaccccagc

SEQ ID NO: 1465579 - RNA, 15 nt, Homo sapiens
ugccagugacagaca

SEQ ID NO: 1465580 - RNA, 15 nt, Homo sapiens
ugccagugucauccg

SEQ ID NO: 1465581 - RNA, 21 nt, Homo sapiens
ugccauaaugacucagaauau

SEQ ID NO: 1465582 - RNA, 23 nt, Homo sapiens
ugccaucaccauacacaguggca

SEQ ID NO: 1465583 - RNA, 18 nt, Homo sapiens
ugccaucauuuacuuuua

SEQ ID NO: 1465584 - RNA, 23 nt, Homo sapiens
ugccauccucccaaggggcccaa

SEQ ID NO: 1465585 - RNA, 16 nt, Homo sapiens
ugccaucgaccuggag

SEQ ID NO: 1465586 - RNA, 22 nt, Homo sapiens
ugccaucuguacauauuacugu

SEQ ID NO: 1465587 - RNA, 15 nt, Homo sapiens
ugccaugcucagaaa

SEQ ID NO: 1465588 - RNA, 18 nt, Homo sapiens
ugccaugucugcagugug

SEQ ID NO: 1465589 - RNA, 11 nt, Homo sapiens
ugccauuccac

SEQ ID NO: 1465590 - RNA, 15 nt, Homo sapiens
ugcccaaaucuuuag

SEQ ID NO: 1465591 - RNA, 13 nt, Homo sapiens
ugcccacaggccg

SEQ ID NO: 1465592 - RNA, 14 nt, Homo sapiens
ugcccaggagacag

SEQ ID NO: 1465593 - RNA, 15 nt, Homo sapiens
ugagguguugugcau

SEQ ID NO: 1465594 - RNA, 16 nt, Homo sapiens
ugagguucuugggaua

SEQ ID NO: 1465595 - RNA, 22 nt, Homo sapiens
ugagguugggguguacuaguua

SEQ ID NO: 1465596 - RNA, 19 nt, Homo sapiens
ugagguuucccccugucuc

SEQ ID NO: 1465597 - RNA, 18 nt, Homo sapiens
ugaguaauacaucaaaga

SEQ ID NO: 1465598 - RNA, 19 nt, Homo sapiens
ugaguaaugguguagaaca

SEQ ID NO: 1465599 - RNA, 17 nt, Homo sapiens
ugagucaaugugcagug

SEQ ID NO: 1465600 - RNA, 18 nt, Homo sapiens
ugaguccaucuaacauca

SEQ ID NO: 1465601 - RNA, 15 nt, Homo sapiens
ugagucuccugugcc

SEQ ID NO: 1465602 - RNA, 15 nt, Homo sapiens
ugagugagccacaga

SEQ ID NO: 1465603 - RNA, 20 nt, Homo sapiens
ugaguggccagccagugcca

SEQ ID NO: 1465604 - RNA, 22 nt, Homo sapiens
ugaguggccagccagugccauu

SEQ ID NO: 1465605 - RNA, 15 nt, Homo sapiens
ugaguguaaguguga

SEQ ID NO: 1465606 - RNA, 22 nt, Homo sapiens
ugaguuacuuccuaucaagcca

SEQ ID NO: 1465607 - RNA, 19 nt, Homo sapiens
ugaguugcccaucuuguuu

SEQ ID NO: 1465608 - RNA, 21 nt, Homo sapiens
ugaguuuuugauagcuuuauu

SEQ ID NO: 1465609 - RNA, 15 nt, Homo sapiens
ugauaaagcacagcu

SEQ ID NO: 1465610 - RNA, 16 nt, Homo sapiens
ucuuagaaauacuugu

SEQ ID NO: 1465611 - RNA, 21 nt, Homo sapiens
ucuuagauguauauauuuccu

SEQ ID NO: 1465612 - RNA, 15 nt, Homo sapiens
ucuuagauucuuaau

SEQ ID NO: 1465613 - RNA, 21 nt, Homo sapiens
ucuuagcagcuuccagauuga

SEQ ID NO: 1465614 - RNA, 18 nt, Homo sapiens
ucuuagggugaaccacuu

SEQ ID NO: 1465615 - RNA, 21 nt, Homo sapiens
ucuuaguguuguggacacugc

SEQ ID NO: 1465616 - RNA, 14 nt, Homo sapiens
ucuuaguuguucag

SEQ ID NO: 1465617 - RNA, 23 nt, Homo sapiens
ucuuauaguguuuggacagcuga

SEQ ID NO: 1465618 - RNA, 21 nt, Homo sapiens
ucuuauccaacaucaacaucu

SEQ ID NO: 1465619 - RNA, 16 nt, Homo sapiens
ucuuaucucagucaug

SEQ ID NO: 1465620 - RNA, 17 nt, Homo sapiens
ucuuaugcaaucuaugu

SEQ ID NO: 1465621 - RNA, 16 nt, Homo sapiens
ucuuaugugugccuuu

SEQ ID NO: 1465622 - RNA, 16 nt, Homo sapiens
ucuuauuuaaugaaag

SEQ ID NO: 1465623 - RNA, 14 nt, Homo sapiens
ucuuauuuccucaa

SEQ ID NO: 1465624 - RNA, 14 nt, Homo sapiens
ucuucaaacuguga

SEQ ID NO: 1465625 - RNA, 13 nt, Homo sapiens
ucuucaccaggug

SEQ ID NO: 1465626 - RNA, 15 nt, Homo sapiens
ucuucacucucugaa

SEQ ID NO: 1465627 - RNA, 21 nt, Homo sapiens
ucuucacuguggucauccugc

SEQ ID NO: 1465628 - RNA, 18 nt, Homo sapiens
ucuucagaacuugucagg

SEQ ID NO: 1465629 - RNA, 18 nt, Homo sapiens
ucuucagauacaaacugc

SEQ ID NO: 1465630 - RNA, 14 nt, Homo sapiens
ucuucauacuuaaa

SEQ ID NO: 1465631 - RNA, 18 nt, Homo sapiens
ucuucaugaccuacuuca

SEQ ID NO: 1465632 - RNA, 11 nt, Homo sapiens
ucuucauggcc

SEQ ID NO: 1465633 - RNA, 15 nt, Homo sapiens
ucuucauuucaggaa

SEQ ID NO: 1465634 - RNA, 13 nt, Homo sapiens
ucuucauuuuggu

SEQ ID NO: 1465635 - RNA, 19 nt, Homo sapiens
ucuuccacaaaaaauacuu

SEQ ID NO: 1465636 - RNA, 13 nt, Homo sapiens
ucuuccaugaccc

SEQ ID NO: 1465637 - RNA, 13 nt, Homo sapiens
ucuucccuaccuc

SEQ ID NO: 1465638 - RNA, 15 nt, Homo sapiens
ucuucccuaccucag

SEQ ID NO: 1465639 - RNA, 18 nt, Homo sapiens
ucuucccuaccucaggca

SEQ ID NO: 1465640 - RNA, 22 nt, Homo sapiens
ucuucccucuccccauucggug

SEQ ID NO: 1465641 - RNA, 15 nt, Homo sapiens
ucuucccucucugca

SEQ ID NO: 1465642 - RNA, 22 nt, Homo sapiens
ucuucccucucugcagacuucc

SEQ ID NO: 1465643 - RNA, 17 nt, Homo sapiens
ucuuccucacuaugaca

SEQ ID NO: 1465644 - RNA, 22 nt, Homo sapiens
ucuuccuggcuccaacacugcu

SEQ ID NO: 1465645 - RNA, 15 nt, Homo sapiens
ucuuccuguguccug

SEQ ID NO: 1465646 - RNA, 15 nt, Homo sapiens
ucuuccuuagacuua

SEQ ID NO: 1465647 - RNA, 15 nt, Homo sapiens
ucuucuacaaccaga

SEQ ID NO: 1465648 - RNA, 14 nt, Homo sapiens
ucuucucaagaucc

SEQ ID NO: 1465649 - RNA, 13 nt, Homo sapiens
ucuucuccacugg

SEQ ID NO: 1465650 - RNA, 18 nt, Homo sapiens
ucuucugauuugucccua

SEQ ID NO: 1465651 - RNA, 21 nt, Homo sapiens
ucuucugcaagccucaugcca

SEQ ID NO: 1465652 - RNA, 15 nt, Homo sapiens
ucuucuucauucuau

SEQ ID NO: 1465653 - RNA, 14 nt, Homo sapiens
ucuucuuugcugca

SEQ ID NO: 1465654 - RNA, 23 nt, Homo sapiens
ucuugaaaaaugcccauuugccu

SEQ ID NO: 1465655 - RNA, 13 nt, Homo sapiens
ucuugaaagcugu

SEQ ID NO: 1465656 - RNA, 20 nt, Homo sapiens
ucuugaaauuaagaaggcaa

SEQ ID NO: 1465657 - RNA, 17 nt, Homo sapiens
ucuugaauagacuucca

SEQ ID NO: 1465658 - RNA, 15 nt, Homo sapiens
ucuugaauguggucu

SEQ ID NO: 1465659 - RNA, 22 nt, Homo sapiens
ucuugaauuagcauuuuucaaa

SEQ ID NO: 1465660 - RNA, 17 nt, Homo sapiens
ucuugcagucaucagaa

SEQ ID NO: 1465661 - RNA, 14 nt, Homo sapiens
ucuugcauucauuu

SEQ ID NO: 1465662 - RNA, 21 nt, Homo sapiens
ucuugcggcugaagugucaca

SEQ ID NO: 1465663 - RNA, 17 nt, Homo sapiens
ucuuggaaaaggaacuc

SEQ ID NO: 1465664 - RNA, 13 nt, Homo sapiens
ucuuggggaauau

SEQ ID NO: 1465665 - RNA, 16 nt, Homo sapiens
ucuugguauuacccuc

SEQ ID NO: 1465666 - RNA, 22 nt, Homo sapiens
ucuuggugccuuuugugugaug

SEQ ID NO: 1465667 - RNA, 23 nt, Homo sapiens
ucuuggugccuuuugugugaugc

SEQ ID NO: 1465668 - RNA, 14 nt, Homo sapiens
ucuuguauacacau

SEQ ID NO: 1465669 - RNA, 20 nt, Homo sapiens
ucuuguauacacauauauac

SEQ ID NO: 1465670 - RNA, 23 nt, Homo sapiens
ucuuguuucaucguaaacauacu

SEQ ID NO: 1465671 - RNA, 17 nt, Homo sapiens
ucuuguuuuaagcaaau

SEQ ID NO: 1465672 - RNA, 17 nt, Homo sapiens
ucuuguuuuauauaccu

SEQ ID NO: 1465673 - RNA, 13 nt, Homo sapiens
ucuuuaacacagc

SEQ ID NO: 1465674 - RNA, 21 nt, Homo sapiens
ucuuuacaaaacuacaugaga

SEQ ID NO: 1465675 - RNA, 17 nt, Homo sapiens
ucuuuacaaagaaaaaa

SEQ ID NO: 1465676 - RNA, 17 nt, Homo sapiens
ucuuuauaaucuacucc

SEQ ID NO: 1465677 - RNA, 13 nt, Homo sapiens
ucuuuauaauucu

SEQ ID NO: 1465678 - RNA, 16 nt, Homo sapiens
ucuuuauacagcugua

SEQ ID NO: 1465679 - RNA, 16 nt, Homo sapiens
ucuuuaucauugcuaa

SEQ ID NO: 1465680 - RNA, 18 nt, Homo sapiens
ucuuucaggacucuaccu

SEQ ID NO: 1465681 - RNA, 20 nt, Homo sapiens
ucuuucaugggcaccaaccu

SEQ ID NO: 1465682 - RNA, 16 nt, Homo sapiens
ucuuuccugaaccaug

SEQ ID NO: 1465683 - RNA, 20 nt, Homo sapiens
ucuuuccugaaccaugugga

SEQ ID NO: 1465684 - RNA, 14 nt, Homo sapiens
ucuuuccuggcacu

SEQ ID NO: 1465685 - RNA, 23 nt, Homo sapiens
ucuuuccuggcacuaacguugag

SEQ ID NO: 1465686 - RNA, 21 nt, Homo sapiens
ucuuucuaaugcugauaugau

SEQ ID NO: 1465687 - RNA, 21 nt, Homo sapiens
ucuuucuagaggugcuacaua

SEQ ID NO: 1465688 - RNA, 12 nt, Homo sapiens
ucuuucucucag

SEQ ID NO: 1465689 - RNA, 20 nt, Homo sapiens
ucuuucucugccagugacag

SEQ ID NO: 1465690 - RNA, 13 nt, Homo sapiens
ucuuucuuucugc

SEQ ID NO: 1465691 - RNA, 14 nt, Homo sapiens
ucuuugacaacuaa

SEQ ID NO: 1465692 - RNA, 11 nt, Homo sapiens
ucuuugccucu

SEQ ID NO: 1465693 - RNA, 24 nt, Homo sapiens
ucuuugcucaacagaacauauguu

SEQ ID NO: 1465694 - RNA, 15 nt, Homo sapiens
ucuuuggcgaccucc

SEQ ID NO: 1465695 - RNA, 13 nt, Homo sapiens
ucuuugugugaca

SEQ ID NO: 1465696 - RNA, 15 nt, Homo sapiens
ucuuugugugacaug

SEQ ID NO: 1465697 - RNA, 14 nt, Homo sapiens
ucuuuucauucuca

SEQ ID NO: 1465698 - RNA, 18 nt, Homo sapiens
ucuuuucugaucugcagu

SEQ ID NO: 1465699 - RNA, 22 nt, Homo sapiens
ucuuuuuuuuuaaguucuuaug

SEQ ID NO: 1465700 - RNA, 18 nt, Homo sapiens
ugaaaaaaaaaacuauca

SEQ ID NO: 1465701 - RNA, 18 nt, Homo sapiens
ugaaaaaacaccuagcuu

SEQ ID NO: 1465702 - RNA, 17 nt, Homo sapiens
ugaaaaacagaaagcau

SEQ ID NO: 1465703 - RNA, 19 nt, Homo sapiens
ugaaaaacagaaagcaucc

SEQ ID NO: 1465704 - RNA, 22 nt, Homo sapiens
ugaaaaacagaaagcauccuaa

SEQ ID NO: 1465705 - RNA, 14 nt, Homo sapiens
ugaaaaaucuaagu

SEQ ID NO: 1465706 - RNA, 18 nt, Homo sapiens
ugaaaaaucuaagugaua

SEQ ID NO: 1465707 - RNA, 17 nt, Homo sapiens
ugaaaaauggcaaagaa

SEQ ID NO: 1465708 - RNA, 16 nt, Homo sapiens
ugaaaaauuacagcuu

SEQ ID NO: 1465709 - RNA, 22 nt, Homo sapiens
ugaaaacaaacaagaggacugu

SEQ ID NO: 1465710 - RNA, 21 nt, Homo sapiens
ugaaaacauagcaucucagga

SEQ ID NO: 1465711 - RNA, 22 nt, Homo sapiens
ugaaaacucacagaacuaugua

SEQ ID NO: 1465712 - RNA, 17 nt, Homo sapiens
uauagcagauuguguaa

SEQ ID NO: 1465713 - RNA, 21 nt, Homo sapiens
uauagcgauugaaagggcaau

SEQ ID NO: 1465714 - RNA, 15 nt, Homo sapiens
uauaggaacaauucu

SEQ ID NO: 1465715 - RNA, 21 nt, Homo sapiens
uauaguuauugcacaaguuca

SEQ ID NO: 1465716 - RNA, 23 nt, Homo sapiens
uauaguuucaagccaacugugga

SEQ ID NO: 1465717 - RNA, 23 nt, Homo sapiens
uauaguuuguuuuuaaacuaaua

SEQ ID NO: 1465718 - RNA, 13 nt, Homo sapiens
uauauaaguuuac

SEQ ID NO: 1465719 - RNA, 20 nt, Homo sapiens
uauauaauaaagcuacugau

SEQ ID NO: 1465720 - RNA, 17 nt, Homo sapiens
uauauacccacauguac

SEQ ID NO: 1465721 - RNA, 22 nt, Homo sapiens
uauauaccuggcuuuuacuuua

SEQ ID NO: 1465722 - RNA, 13 nt, Homo sapiens
uauauacuuugaa

SEQ ID NO: 1465723 - RNA, 12 nt, Homo sapiens
uauauauugaau

SEQ ID NO: 1465724 - RNA, 13 nt, Homo sapiens
uauauauuuacau

SEQ ID NO: 1465725 - RNA, 15 nt, Homo sapiens
uauaucccauugaaa

SEQ ID NO: 1465726 - RNA, 14 nt, Homo sapiens
uauauccugugacu

SEQ ID NO: 1465727 - RNA, 14 nt, Homo sapiens
uauaucuaugcaaa

SEQ ID NO: 1465728 - RNA, 17 nt, Homo sapiens
uauaucuguggucuuca

SEQ ID NO: 1465729 - RNA, 14 nt, Homo sapiens
uauauguugcuaua

SEQ ID NO: 1465730 - RNA, 17 nt, Homo sapiens
uauauuauaaucuucca

SEQ ID NO: 1465731 - RNA, 16 nt, Homo sapiens
uauauuuauugugcuu

SEQ ID NO: 1465732 - RNA, 21 nt, Homo sapiens
uauauuucagguuauauccaa

SEQ ID NO: 1465733 - RNA, 13 nt, Homo sapiens
uauauuuccuuau

SEQ ID NO: 1465734 - RNA, 18 nt, Homo sapiens
uauauuugggccugcucc

SEQ ID NO: 1465735 - RNA, 20 nt, Homo sapiens
uauauuugugauagcacuuu

SEQ ID NO: 1465736 - RNA, 19 nt, Homo sapiens
uauauuuuugguugucaau

SEQ ID NO: 1465737 - RNA, 23 nt, Homo sapiens
uauauuuuuuguaacauaaugca

SEQ ID NO: 1465738 - RNA, 18 nt, Homo sapiens
uaucaaagaaagaugaaa

SEQ ID NO: 1465739 - RNA, 11 nt, Homo sapiens
uaucaaagugu

SEQ ID NO: 1465740 - RNA, 21 nt, Homo sapiens
uaucaaagugugauauacaaa

SEQ ID NO: 1465741 - RNA, 12 nt, Homo sapiens
ucugaaccuguc

SEQ ID NO: 1465742 - RNA, 19 nt, Homo sapiens
ucugaacuugcauugugau

SEQ ID NO: 1465743 - RNA, 15 nt, Homo sapiens
ucugaagucacugca

SEQ ID NO: 1465744 - RNA, 20 nt, Homo sapiens
ucugaaugcugccacaacca

SEQ ID NO: 1465745 - RNA, 12 nt, Homo sapiens
ucugacacugaa

SEQ ID NO: 1465746 - RNA, 22 nt, Homo sapiens
ucugacagaaagcagauaccuc

SEQ ID NO: 1465747 - RNA, 12 nt, Homo sapiens
ucugaccuguac

SEQ ID NO: 1465748 - RNA, 19 nt, Homo sapiens
ucugacuuaagcaaaagaa

SEQ ID NO: 1465749 - RNA, 14 nt, Homo sapiens
ucugagacucacag

SEQ ID NO: 1465750 - RNA, 20 nt, Homo sapiens
ucugagaggcucuccgugca

SEQ ID NO: 1465751 - RNA, 22 nt, Homo sapiens
ucugagagugaaaccaugacug

SEQ ID NO: 1465752 - RNA, 23 nt, Homo sapiens
ucugagagugaaaccaugacugu

SEQ ID NO: 1465753 - RNA, 20 nt, Homo sapiens
ucugaggcccugcccaauga

SEQ ID NO: 1465754 - RNA, 14 nt, Homo sapiens
ucugaggucccugu

SEQ ID NO: 1465755 - RNA, 13 nt, Homo sapiens
ucugauaccucaa

SEQ ID NO: 1465756 - RNA, 22 nt, Homo sapiens
ucugcaacauuugacaaaacua

SEQ ID NO: 1465757 - RNA, 21 nt, Homo sapiens
ucugcaagcacaucugcauuu

SEQ ID NO: 1465758 - RNA, 20 nt, Homo sapiens
ucugcaaugggcacugggau

SEQ ID NO: 1465759 - RNA, 13 nt, Homo sapiens
ucugcacacucca

SEQ ID NO: 1465760 - RNA, 20 nt, Homo sapiens
ucugcagcacucuuaucuac

SEQ ID NO: 1465761 - RNA, 19 nt, Homo sapiens
ucugcaucccagcaccugc

SEQ ID NO: 1465762 - RNA, 19 nt, Homo sapiens
ucugcauguuacauaagau

SEQ ID NO: 1465763 - RNA, 20 nt, Homo sapiens
ucugccaaaggaugugauau

SEQ ID NO: 1465764 - RNA, 13 nt, Homo sapiens
ucugccacccacu

SEQ ID NO: 1465765 - RNA, 17 nt, Homo sapiens
ucugcccgcuccaugga

SEQ ID NO: 1465766 - RNA, 23 nt, Homo sapiens
ucugcccgggaaggucaccagca

SEQ ID NO: 1465767 - RNA, 14 nt, Homo sapiens
ucugcccucauaga

SEQ ID NO: 1465768 - RNA, 21 nt, Homo sapiens
ucugccggcccccaggacaag

SEQ ID NO: 1465769 - RNA, 22 nt, Homo sapiens
ucugccugcaccccugcaguuu

SEQ ID NO: 1465770 - RNA, 15 nt, Homo sapiens
ucugccuuuucacug

SEQ ID NO: 1465771 - RNA, 18 nt, Homo sapiens
ucugcuaugcuauugaag

SEQ ID NO: 1465772 - RNA, 21 nt, Homo sapiens
ucugcucugguuagaaaaagg

SEQ ID NO: 1465773 - RNA, 18 nt, Homo sapiens
ucugcugaaugcagggaa

SEQ ID NO: 1465774 - RNA, 12 nt, Homo sapiens
ucugcugaggag

SEQ ID NO: 1465775 - RNA, 18 nt, Homo sapiens
ucugcugcauagcucuau

SEQ ID NO: 1465776 - RNA, 19 nt, Homo sapiens
ucugcuggccuggaucucc

SEQ ID NO: 1465777 - RNA, 23 nt, Homo sapiens
ucugcuggggauggccacuguga

SEQ ID NO: 1465778 - RNA, 13 nt, Homo sapiens
ucugcuugucaaa

SEQ ID NO: 1465779 - RNA, 14 nt, Homo sapiens
ucuggaaaagcaaa

SEQ ID NO: 1465780 - RNA, 14 nt, Homo sapiens
ucuggaaacuacca

SEQ ID NO: 1465781 - RNA, 16 nt, Homo sapiens
ucuggaaagaggcucu

SEQ ID NO: 1465782 - RNA, 21 nt, Homo sapiens
ucuggaagucaucucauucca

SEQ ID NO: 1465783 - RNA, 18 nt, Homo sapiens
ucuggaaucuggagacca

SEQ ID NO: 1465784 - RNA, 11 nt, Homo sapiens
ucuggacaaag

SEQ ID NO: 1465785 - RNA, 15 nt, Homo sapiens
ucuggacacugagag

SEQ ID NO: 1465786 - RNA, 14 nt, Homo sapiens
ucuggaccccaaag

SEQ ID NO: 1465787 - RNA, 15 nt, Homo sapiens
ucuggauucugaauc

SEQ ID NO: 1465788 - RNA, 23 nt, Homo sapiens
ucuggcaacagagcaagacucca

SEQ ID NO: 1465789 - RNA, 16 nt, Homo sapiens
ucuggcccuucuugcc

SEQ ID NO: 1465790 - RNA, 15 nt, Homo sapiens
ucugggagucacaca

SEQ ID NO: 1465791 - RNA, 19 nt, Homo sapiens
ucugggauauggcugccca

SEQ ID NO: 1465792 - RNA, 18 nt, Homo sapiens
ucugggauucccaccaag

SEQ ID NO: 1465793 - RNA, 19 nt, Homo sapiens
ucugggcacaguggacuca

SEQ ID NO: 1465794 - RNA, 20 nt, Homo sapiens
ucugggcuuggggcuuccua

SEQ ID NO: 1465795 - RNA, 21 nt, Homo sapiens
ucuggggaccccaaccucaga

SEQ ID NO: 1465796 - RNA, 15 nt, Homo sapiens
ucuggggcagauccc

SEQ ID NO: 1465797 - RNA, 18 nt, Homo sapiens
ucugggucaucucucaca

SEQ ID NO: 1465798 - RNA, 19 nt, Homo sapiens
ucugggugaccucacuuua

SEQ ID NO: 1465799 - RNA, 17 nt, Homo sapiens
ucuggugcuuucuguca

SEQ ID NO: 1465800 - RNA, 20 nt, Homo sapiens
ucugguuagaaaaaggacuc

SEQ ID NO: 1465801 - RNA, 19 nt, Homo sapiens
ucuguaaaaacacugaaaa

SEQ ID NO: 1465802 - RNA, 15 nt, Homo sapiens
ucuguaaaacuaaga

SEQ ID NO: 1465803 - RNA, 18 nt, Homo sapiens
ucuguaaguaacuucaca

SEQ ID NO: 1465804 - RNA, 16 nt, Homo sapiens
ucuguaaugguacuga

SEQ ID NO: 1465805 - RNA, 19 nt, Homo sapiens
ucuguacauauuacuguug

SEQ ID NO: 1465806 - RNA, 13 nt, Homo sapiens
ucugucaacauca

SEQ ID NO: 1465807 - RNA, 21 nt, Homo sapiens
ucugucaccagcuaucuguca

SEQ ID NO: 1465808 - RNA, 17 nt, Homo sapiens
ucugucagucacagcca

SEQ ID NO: 1465809 - RNA, 14 nt, Homo sapiens
ucugugaagaaaga

SEQ ID NO: 1465810 - RNA, 16 nt, Homo sapiens
ucugugcagucacugg

SEQ ID NO: 1465811 - RNA, 16 nt, Homo sapiens
ucugugccccaugccu

SEQ ID NO: 1465812 - RNA, 23 nt, Homo sapiens
ucugugggccccucaacagccaa

SEQ ID NO: 1465813 - RNA, 14 nt, Homo sapiens
ucuguguuaggggu

SEQ ID NO: 1465814 - RNA, 20 nt, Homo sapiens
ucuguuaauagucaucacau

SEQ ID NO: 1465815 - RNA, 14 nt, Homo sapiens
ucuguuuugcacag

SEQ ID NO: 1465816 - RNA, 16 nt, Homo sapiens
ucuguuuugccuucac

SEQ ID NO: 1465817 - RNA, 15 nt, Homo sapiens
ucuuacauuagcagu

SEQ ID NO: 1465818 - RNA, 16 nt, Homo sapiens
ucuuacccuguacaua

SEQ ID NO: 1465819 - RNA, 21 nt, Homo sapiens
ucuuacguucuuucacuucaa

SEQ ID NO: 1465820 - RNA, 15 nt, Homo sapiens
ucuuacuggugcuau

SEQ ID NO: 1465821 - RNA, 13 nt, Homo sapiens
uaagaugcacuga

SEQ ID NO: 1465822 - RNA, 18 nt, Homo sapiens
uaagauuuuacaaaagag

SEQ ID NO: 1465823 - RNA, 16 nt, Homo sapiens
uaagcagaaauccugc

SEQ ID NO: 1465824 - RNA, 23 nt, Homo sapiens
uaagcagaaauccugcaaugaaa

SEQ ID NO: 1465825 - RNA, 22 nt, Homo sapiens
uaagcaucaaauauuugugcaa

SEQ ID NO: 1465826 - RNA, 18 nt, Homo sapiens
uaagcaugugucccagga

SEQ ID NO: 1465827 - RNA, 20 nt, Homo sapiens
uaagccacucuuccaaaggc

SEQ ID NO: 1465828 - RNA, 14 nt, Homo sapiens
uaagcccacuguua

SEQ ID NO: 1465829 - RNA, 20 nt, Homo sapiens
uaagcucuacugaggugcua

SEQ ID NO: 1465830 - RNA, 12 nt, Homo sapiens
uaagcucuggcu

SEQ ID NO: 1465831 - RNA, 14 nt, Homo sapiens
uaaggaggcacugc

SEQ ID NO: 1465832 - RNA, 14 nt, Homo sapiens
uaaggaucucucag

SEQ ID NO: 1465833 - RNA, 15 nt, Homo sapiens
uaaggauugugauau

SEQ ID NO: 1465834 - RNA, 12 nt, Homo sapiens
uaaggccugaau

SEQ ID NO: 1465835 - RNA, 15 nt, Homo sapiens
uaaguacacaauaag

SEQ ID NO: 1465836 - RNA, 13 nt, Homo sapiens
uaaguacuaugua

SEQ ID NO: 1465837 - RNA, 16 nt, Homo sapiens
uaagucacaaagaguu

SEQ ID NO: 1465838 - RNA, 18 nt, Homo sapiens
uaagugaagugauacuau

SEQ ID NO: 1465839 - RNA, 12 nt, Homo sapiens
uaagugcugcua

SEQ ID NO: 1465840 - RNA, 13 nt, Homo sapiens
uaagugcugcuau

SEQ ID NO: 1465841 - RNA, 20 nt, Homo sapiens
uaaguuauuuacuuuuacca

SEQ ID NO: 1465842 - RNA, 22 nt, Homo sapiens
uaaguugucuaaacaaugcuga

SEQ ID NO: 1465843 - RNA, 15 nt, Homo sapiens
uaaguuugauuucau

SEQ ID NO: 1465844 - RNA, 13 nt, Homo sapiens
uaauaaaacuauu

SEQ ID NO: 1465845 - RNA, 15 nt, Homo sapiens
uaauaaacuacucuu

SEQ ID NO: 1465846 - RNA, 21 nt, Homo sapiens
uaauaaaggcccccacuucuc

SEQ ID NO: 1465847 - RNA, 18 nt, Homo sapiens
uaauaaauauuuuugcca

SEQ ID NO: 1465848 - RNA, 13 nt, Homo sapiens
uaauaaaucacac

SEQ ID NO: 1465849 - RNA, 19 nt, Homo sapiens
uaauaagcaaucaagguua

SEQ ID NO: 1465850 - RNA, 15 nt, Homo sapiens
uaauaauguuuaaua

SEQ ID NO: 1465851 - RNA, 15 nt, Homo sapiens
uaauagacugaguca

SEQ ID NO: 1465852 - RNA, 13 nt, Homo sapiens
uaauagugaacau

SEQ ID NO: 1465853 - RNA, 13 nt, Homo sapiens
uacuguacuuaau

SEQ ID NO: 1465854 - RNA, 19 nt, Homo sapiens
uacuguauggaaacacuga

SEQ ID NO: 1465855 - RNA, 17 nt, Homo sapiens
uacugugaaacuggcac

SEQ ID NO: 1465856 - RNA, 19 nt, Homo sapiens
uacugugaaacuggcacug

SEQ ID NO: 1465857 - RNA, 15 nt, Homo sapiens
uacugugaccaugga

SEQ ID NO: 1465858 - RNA, 20 nt, Homo sapiens
uacuuaaaaauagucuucca

SEQ ID NO: 1465859 - RNA, 19 nt, Homo sapiens
uacuuaacuauucaggaga

SEQ ID NO: 1465860 - RNA, 16 nt, Homo sapiens
uacuuaauaaacugug

SEQ ID NO: 1465861 - RNA, 15 nt, Homo sapiens
uacuuaugccauaga

SEQ ID NO: 1465862 - RNA, 14 nt, Homo sapiens
uacuucuccacugu

SEQ ID NO: 1465863 - RNA, 20 nt, Homo sapiens
uacuucucuuguuagguaau

SEQ ID NO: 1465864 - RNA, 15 nt, Homo sapiens
uacuugcuucucuag

SEQ ID NO: 1465865 - RNA, 18 nt, Homo sapiens
uacuugugaaacacagcu

SEQ ID NO: 1465866 - RNA, 20 nt, Homo sapiens
uacuugugaaacacagcugu

SEQ ID NO: 1465867 - RNA, 17 nt, Homo sapiens
uacuuuaaaaugccaau

SEQ ID NO: 1465868 - RNA, 20 nt, Homo sapiens
uacuuuauuucugaucuaua

SEQ ID NO: 1465869 - RNA, 24 nt, Homo sapiens
uacuuugggacgcccacguggcag

SEQ ID NO: 1465870 - RNA, 18 nt, Homo sapiens
uacuuuugugcuaucaau

SEQ ID NO: 1465871 - RNA, 19 nt, Homo sapiens
uagaaaaaggacucugcuu

SEQ ID NO: 1465872 - RNA, 22 nt, Homo sapiens
uagaaaaggccuucuucccaau

SEQ ID NO: 1465873 - RNA, 22 nt, Homo sapiens
uagaaaaguguggcuugggcau

SEQ ID NO: 1465874 - RNA, 19 nt, Homo sapiens
uagaaaauuagacugugau

SEQ ID NO: 1465875 - RNA, 19 nt, Homo sapiens
uagaaagcugaguguuuca

SEQ ID NO: 1465876 - RNA, 22 nt, Homo sapiens
uagaaaggaagccuugcucauu

SEQ ID NO: 1465877 - RNA, 14 nt, Homo sapiens
uagaaagggccuug

SEQ ID NO: 1465878 - RNA, 16 nt, Homo sapiens
uagaaauaauaugcau

SEQ ID NO: 1465879 - RNA, 13 nt, Homo sapiens
uagaaauggauuu

SEQ ID NO: 1465880 - RNA, 17 nt, Homo sapiens
uagaacaacgccuguca

SEQ ID NO: 1465881 - RNA, 18 nt, Homo sapiens
uagaacuccaauacucac

SEQ ID NO: 1465882 - RNA, 18 nt, Homo sapiens
uagaacucuccaucuuau

SEQ ID NO: 1465883 - RNA, 12 nt, Homo sapiens
uagaacugagaa

SEQ ID NO: 1465884 - RNA, 16 nt, Homo sapiens
uagaacugucugugaa

SEQ ID NO: 1465885 - RNA, 18 nt, Homo sapiens
uagaacugucugugaaca

SEQ ID NO: 1465886 - RNA, 19 nt, Homo sapiens
uagaacuuuaccuauggaa

SEQ ID NO: 1465887 - RNA, 15 nt, Homo sapiens
uagaacuuucugcuu

SEQ ID NO: 1465888 - RNA, 21 nt, Homo sapiens
uagaagaggguuuuagguaga

SEQ ID NO: 1465889 - RNA, 14 nt, Homo sapiens
uagaagccaaggga

SEQ ID NO: 1465890 - RNA, 21 nt, Homo sapiens
uagaagcuguaacagaauaca

SEQ ID NO: 1465891 - RNA, 21 nt, Homo sapiens
uagaaggcuucuuagcgcagu

SEQ ID NO: 1465892 - RNA, 22 nt, Homo sapiens
uagaagggccaguccugccugg

SEQ ID NO: 1465893 - RNA, 14 nt, Homo sapiens
uagaagucauaugu

SEQ ID NO: 1465894 - RNA, 23 nt, Homo sapiens
uagaaguuaaugauuuuacuuaa

SEQ ID NO: 1465895 - RNA, 20 nt, Homo sapiens
uagaauguugaaaaguaauu

SEQ ID NO: 1465896 - RNA, 13 nt, Homo sapiens
uagaauuuauuca

SEQ ID NO: 1465897 - RNA, 20 nt, Homo sapiens
uagaauuugggggaaaauuu

SEQ ID NO: 1465898 - RNA, 13 nt, Homo sapiens
uagacaauuugca

SEQ ID NO: 1465899 - RNA, 15 nt, Homo sapiens
uagacugugccagag

SEQ ID NO: 1465900 - RNA, 15 nt, Homo sapiens
uagacuuauugccaa

SEQ ID NO: 1465901 - RNA, 19 nt, Homo sapiens
uagagaaguuacacagaaa

SEQ ID NO: 1465902 - RNA, 16 nt, Homo sapiens
uagagagagaacuuuu

SEQ ID NO: 1465903 - RNA, 18 nt, Homo sapiens
uagagaggggacuggggg

SEQ ID NO: 1465904 - RNA, 14 nt, Homo sapiens
uagagaugcaguuu

SEQ ID NO: 1465905 - RNA, 22 nt, Homo sapiens
uagagauggggucucacagugu

SEQ ID NO: 1465906 - RNA, 19 nt, Homo sapiens
uagagaugugucuauggcu

SEQ ID NO: 1465907 - RNA, 21 nt, Homo sapiens
uagagcagccacaaccaaaaa

SEQ ID NO: 1465908 - RNA, 14 nt, Homo sapiens
uagaguauaugcac

SEQ ID NO: 1465909 - RNA, 14 nt, Homo sapiens
uagagucaucucca

SEQ ID NO: 1465910 - RNA, 14 nt, Homo sapiens
uagaguggugcugc

SEQ ID NO: 1465911 - RNA, 20 nt, Homo sapiens
uagagugugguuaugaacuu

SEQ ID NO: 1465912 - RNA, 13 nt, Homo sapiens
uagaguguuauca

SEQ ID NO: 1465913 - RNA, 15 nt, Homo sapiens
uagauauaugcucug

SEQ ID NO: 1465914 - RNA, 15 nt, Homo sapiens
uagaucaaagucaaa

SEQ ID NO: 1465915 - RNA, 19 nt, Homo sapiens
uagaucagaagacuacaaa

SEQ ID NO: 1465916 - RNA, 23 nt, Homo sapiens
uagaugauaaagagacagugaua

SEQ ID NO: 1465917 - RNA, 18 nt, Homo sapiens
uagaugcacuuaugcagu

SEQ ID NO: 1465918 - RNA, 21 nt, Homo sapiens
uagauggggagccucgggaaa

SEQ ID NO: 1465919 - RNA, 16 nt, Homo sapiens
uagaugguuugagccu

SEQ ID NO: 1465920 - RNA, 12 nt, Homo sapiens
uagaugugauua

SEQ ID NO: 1465921 - RNA, 22 nt, Homo sapiens
uagcaaaaacauguaugugcau

SEQ ID NO: 1465922 - RNA, 20 nt, Homo sapiens
uagcaaauggcagaaccaaa

SEQ ID NO: 1465923 - RNA, 14 nt, Homo sapiens
uagcacuauuuaca

SEQ ID NO: 1465924 - RNA, 17 nt, Homo sapiens
uagcacuauuuacauac

SEQ ID NO: 1465925 - RNA, 13 nt, Homo sapiens
gucuagagucuca

SEQ ID NO: 1465926 - RNA, 14 nt, Homo sapiens
gucucauucuucca

SEQ ID NO: 1465927 - RNA, 19 nt, Homo sapiens
gucuccacuaaaugagcuc

SEQ ID NO: 1465928 - RNA, 23 nt, Homo sapiens
gucuccuuauucggcagccuuau

SEQ ID NO: 1465929 - RNA, 19 nt, Homo sapiens
gucucuacuaaaaguacaa

SEQ ID NO: 1465930 - RNA, 18 nt, Homo sapiens
gucucucuuuggcuggaa

SEQ ID NO: 1465931 - RNA, 20 nt, Homo sapiens
gucugauaaugauuugcucu

SEQ ID NO: 1465932 - RNA, 16 nt, Homo sapiens
gucugcuagccaggau

SEQ ID NO: 1465933 - RNA, 16 nt, Homo sapiens
gucugggauauggcug

SEQ ID NO: 1465934 - RNA, 22 nt, Homo sapiens
gucuggugggaggacggugcaa

SEQ ID NO: 1465935 - RNA, 22 nt, Homo sapiens
gucugugcauuucugguugcac

SEQ ID NO: 1465936 - RNA, 13 nt, Homo sapiens
gucuguuaacuua

SEQ ID NO: 1465937 - RNA, 14 nt, Homo sapiens
gucuguugcuugua

SEQ ID NO: 1465938 - RNA, 16 nt, Homo sapiens
gucuguuuugccuuca

SEQ ID NO: 1465939 - RNA, 22 nt, Homo sapiens
gucuuaaaugagaaguacuugg

SEQ ID NO: 1465940 - RNA, 20 nt, Homo sapiens
gucuuaagccuuuugcucac

SEQ ID NO: 1465941 - RNA, 20 nt, Homo sapiens
gucuucaacauccugccagc

SEQ ID NO: 1465942 - RNA, 13 nt, Homo sapiens
gucuucacuugca

SEQ ID NO: 1465943 - RNA, 17 nt, Homo sapiens
gucuucagggaagguca

SEQ ID NO: 1465944 - RNA, 23 nt, Homo sapiens
gucuuccacaaaaaauacuuuau

SEQ ID NO: 1465945 - RNA, 12 nt, Homo sapiens
gucuuccauaau

SEQ ID NO: 1465946 - RNA, 21 nt, Homo sapiens
gucuuccugaguggugccaaa

SEQ ID NO: 1465947 - RNA, 18 nt, Homo sapiens
gucuuggaacauuggaau

SEQ ID NO: 1465948 - RNA, 17 nt, Homo sapiens
gucuugggggucagggg

SEQ ID NO: 1465949 - RNA, 20 nt, Homo sapiens
gucuuucacagcuccuccca

SEQ ID NO: 1465950 - RNA, 12 nt, Homo sapiens
gucuuuuacccg

SEQ ID NO: 1465951 - RNA, 15 nt, Homo sapiens
gucuuuuagaagaua

SEQ ID NO: 1465952 - RNA, 20 nt, Homo sapiens
gugaaaauuuuuacauucau

SEQ ID NO: 1465953 - RNA, 22 nt, Homo sapiens
guaucagaucuaucuugucaau

SEQ ID NO: 1465954 - RNA, 14 nt, Homo sapiens
guaucaguguuuua

SEQ ID NO: 1465955 - RNA, 16 nt, Homo sapiens
guaucccugcucugcu

SEQ ID NO: 1465956 - RNA, 23 nt, Homo sapiens
guauccugcgaccuugcaaccuc

SEQ ID NO: 1465957 - RNA, 19 nt, Homo sapiens
guaucuuuugaacuggcaa

SEQ ID NO: 1465958 - RNA, 18 nt, Homo sapiens
guaugaaggaaucauucc

SEQ ID NO: 1465959 - RNA, 15 nt, Homo sapiens
guaugagucaaugug

SEQ ID NO: 1465960 - RNA, 13 nt, Homo sapiens
guaugcuggccag

SEQ ID NO: 1465961 - RNA, 13 nt, Homo sapiens
guauggcucugca

SEQ ID NO: 1465962 - RNA, 19 nt, Homo sapiens
guauguaaaagaaaaucca

SEQ ID NO: 1465963 - RNA, 17 nt, Homo sapiens
guaugugacaccaaagc

SEQ ID NO: 1465964 - RNA, 19 nt, Homo sapiens
guaugugacaccaaagcca

SEQ ID NO: 1465965 - RNA, 16 nt, Homo sapiens
guaugugcacugucac

SEQ ID NO: 1465966 - RNA, 12 nt, Homo sapiens
guaugugcucuu

SEQ ID NO: 1465967 - RNA, 16 nt, Homo sapiens
guauguuaugaacaug

SEQ ID NO: 1465968 - RNA, 18 nt, Homo sapiens
guauuauauaaacuuaac

SEQ ID NO: 1465969 - RNA, 17 nt, Homo sapiens
guauuauauaauucaag

SEQ ID NO: 1465970 - RNA, 18 nt, Homo sapiens
guauucaaacaauuugaa

SEQ ID NO: 1465971 - RNA, 18 nt, Homo sapiens
guauuccgauacaaagug

SEQ ID NO: 1465972 - RNA, 13 nt, Homo sapiens
guauucucagagc

SEQ ID NO: 1465973 - RNA, 20 nt, Homo sapiens
guauucugacccaugggaga

SEQ ID NO: 1465974 - RNA, 16 nt, Homo sapiens
guauucuucaaccagu

SEQ ID NO: 1465975 - RNA, 17 nt, Homo sapiens
guauucuucaaccagug

SEQ ID NO: 1465976 - RNA, 12 nt, Homo sapiens
guauugacugua

SEQ ID NO: 1465977 - RNA, 19 nt, Homo sapiens
guauugacuguaccacaga

SEQ ID NO: 1465978 - RNA, 17 nt, Homo sapiens
guauuuaccacagcagc

SEQ ID NO: 1465979 - RNA, 13 nt, Homo sapiens
guauuucucagga

SEQ ID NO: 1465980 - RNA, 12 nt, Homo sapiens
ggcagaacuccc

SEQ ID NO: 1465981 - RNA, 17 nt, Homo sapiens
ggcagacuacacaggau

SEQ ID NO: 1465982 - RNA, 18 nt, Homo sapiens
ggcagacuacacaggaug

SEQ ID NO: 1465983 - RNA, 22 nt, Homo sapiens
ggcagagccaccugacucuugc

SEQ ID NO: 1465984 - RNA, 12 nt, Homo sapiens
ggcagauccagg

SEQ ID NO: 1465985 - RNA, 15 nt, Homo sapiens
ggcagauggggcacu

SEQ ID NO: 1465986 - RNA, 12 nt, Homo sapiens
ggcagcaauuua

SEQ ID NO: 1465987 - RNA, 23 nt, Homo sapiens
ggcagcagcucccgcagggcuga

SEQ ID NO: 1465988 - RNA, 20 nt, Homo sapiens
ggcaggaaaauuguuugaac

SEQ ID NO: 1465989 - RNA, 20 nt, Homo sapiens
ggcaggagaaucgcuugaac

SEQ ID NO: 1465990 - RNA, 20 nt, Homo sapiens
ggcaggagaaucucuugaac

SEQ ID NO: 1465991 - RNA, 20 nt, Homo sapiens
ggcaggagaauugcuugaac

SEQ ID NO: 1465992 - RNA, 18 nt, Homo sapiens
ggcaggcccauucagagc

SEQ ID NO: 1465993 - RNA, 17 nt, Homo sapiens
ggcaggcgguccccauc

SEQ ID NO: 1465994 - RNA, 16 nt, Homo sapiens
ggcaggcuccaggccu

SEQ ID NO: 1465995 - RNA, 15 nt, Homo sapiens
ggcaggcugggccau

SEQ ID NO: 1465996 - RNA, 17 nt, Homo sapiens
ggcagggcccagugaca

SEQ ID NO: 1465997 - RNA, 13 nt, Homo sapiens
ggcagggugcagu

SEQ ID NO: 1465998 - RNA, 14 nt, Homo sapiens
ggcagggugcagua

SEQ ID NO: 1465999 - RNA, 15 nt, Homo sapiens
ggcagguccacagag

SEQ ID NO: 1466000 - RNA, 18 nt, Homo sapiens
ggcagucugggcacuuuu

SEQ ID NO: 1466001 - RNA, 13 nt, Homo sapiens
ggcaucaauauac

SEQ ID NO: 1466002 - RNA, 20 nt, Homo sapiens
ggcaucucuuccccagagag

SEQ ID NO: 1466003 - RNA, 16 nt, Homo sapiens
gggggccaaaccuggg

SEQ ID NO: 1466004 - RNA, 23 nt, Homo sapiens
gggguaccuuaagagacacucca

SEQ ID NO: 1466005 - RNA, 18 nt, Homo sapiens
gggguauaaaacuuuccu

SEQ ID NO: 1466006 - RNA, 11 nt, Homo sapiens
ggggugcugcc

SEQ ID NO: 1466007 - RNA, 11 nt, Homo sapiens
gggguggagca

SEQ ID NO: 1466008 - RNA, 15 nt, Homo sapiens
gggguggaggggugu

SEQ ID NO: 1466009 - RNA, 18 nt, Homo sapiens
gggguuuuguaaugacag

SEQ ID NO: 1466010 - RNA, 24 nt, Homo sapiens
ggguaccucuggcacccaucugca

SEQ ID NO: 1466011 - RNA, 13 nt, Homo sapiens
ggguagaucucaa

SEQ ID NO: 1466012 - RNA, 15 nt, Homo sapiens
gggucaaagugcggc

SEQ ID NO: 1466013 - RNA, 12 nt, Homo sapiens
ggguccaccagg

SEQ ID NO: 1466014 - RNA, 15 nt, Homo sapiens
ggguccuugguguga

SEQ ID NO: 1466015 - RNA, 19 nt, Homo sapiens
gggucucacaguguugccc

SEQ ID NO: 1466016 - RNA, 21 nt, Homo sapiens
gggucucgcugucacuggcug

SEQ ID NO: 1466017 - RNA, 19 nt, Homo sapiens
gggucucgcuuuguugccc

SEQ ID NO: 1466018 - RNA, 20 nt, Homo sapiens
gggucucgcuuuguugccca

SEQ ID NO: 1466019 - RNA, 19 nt, Homo sapiens
gggucucguuuuguugcca

SEQ ID NO: 1466020 - RNA, 16 nt, Homo sapiens
gggugacggcccucau

SEQ ID NO: 1466021 - RNA, 11 nt, Homo sapiens
gggugagccag

SEQ ID NO: 1466022 - RNA, 16 nt, Homo sapiens
gggugauuucagagag

SEQ ID NO: 1466023 - RNA, 11 nt, Homo sapiens
gggugcuccug

SEQ ID NO: 1466024 - RNA, 14 nt, Homo sapiens
ggguggcauccagg

SEQ ID NO: 1466025 - RNA, 21 nt, Homo sapiens
ggguggcccuugcaguucagc

SEQ ID NO: 1466026 - RNA, 17 nt, Homo sapiens
gggugugaacauguucu

SEQ ID NO: 1466027 - RNA, 16 nt, Homo sapiens
ggguuacaaacugcaa

SEQ ID NO: 1466028 - RNA, 22 nt, Homo sapiens
cccaucccacacccuggaggau

SEQ ID NO: 1466029 - RNA, 21 nt, Homo sapiens
cccauccuucuccaccaaaga

SEQ ID NO: 1466030 - RNA, 19 nt, Homo sapiens
cccaucgguaggcaaagga

SEQ ID NO: 1466031 - RNA, 12 nt, Homo sapiens
cccaucuaugag

SEQ ID NO: 1466032 - RNA, 16 nt, Homo sapiens
cccaucuuuacaaaga

SEQ ID NO: 1466033 - RNA, 14 nt, Homo sapiens
cccaugcacuguga

SEQ ID NO: 1466034 - RNA, 17 nt, Homo sapiens
cccaugggagauuugga

SEQ ID NO: 1466035 - RNA, 23 nt, Homo sapiens
cccauguauuuaucucuauuuaa

SEQ ID NO: 1466036 - RNA, 14 nt, Homo sapiens
cccauuccugaaga

SEQ ID NO: 1466037 - RNA, 22 nt, Homo sapiens
cccauugaaacaaaacauugau

SEQ ID NO: 1466038 - RNA, 9 nt, Homo sapiens
cccauuucu

SEQ ID NO: 1466039 - RNA, 21 nt, Homo sapiens
cccauuucuauacaacaggca

SEQ ID NO: 1466040 - RNA, 21 nt, Homo sapiens
cccauuuucaacugcuuugaa

SEQ ID NO: 1466041 - RNA, 17 nt, Homo sapiens
ccccaaauuuggcuaaa

SEQ ID NO: 1466042 - RNA, 13 nt, Homo sapiens
ccccaaccacaga

SEQ ID NO: 1466043 - RNA, 12 nt, Homo sapiens
ccccaaccugcu

SEQ ID NO: 1466044 - RNA, 17 nt, Homo sapiens
ccccaacuaguagcuaa

SEQ ID NO: 1466045 - RNA, 15 nt, Homo sapiens
ccccaacuccaggaa

SEQ ID NO: 1466046 - RNA, 12 nt, Homo sapiens
ccccaaguccua

SEQ ID NO: 1466047 - RNA, 16 nt, Homo sapiens
ccccaccaccacuuac

SEQ ID NO: 1466048 - RNA, 21 nt, Homo sapiens
ccccaccugggacccuugaga

SEQ ID NO: 1466049 - RNA, 13 nt, Homo sapiens
ccccaccuucaau

SEQ ID NO: 1466050 - RNA, 18 nt, Homo sapiens
ccccacuaggcacugugg

SEQ ID NO: 1466051 - RNA, 14 nt, Homo sapiens
ccccagagcuguuu

SEQ ID NO: 1466052 - RNA, 17 nt, Homo sapiens
ccccagcccuaaucuca

SEQ ID NO: 1466053 - RNA, 15 nt, Homo sapiens
ccccaggagcucagg

SEQ ID NO: 1466054 - RNA, 14 nt, Homo sapiens
ccccaguccaugcu

SEQ ID NO: 1466055 - RNA, 16 nt, Homo sapiens
ccccaguggauucuca

SEQ ID NO: 1466056 - RNA, 21 nt, Homo sapiens
ccccauagguggcugagcauc

SEQ ID NO: 1466057 - RNA, 21 nt, Homo sapiens
ccccauccuucuccaccaaag

SEQ ID NO: 1466058 - RNA, 15 nt, Homo sapiens
ccccaucucccugcc

SEQ ID NO: 1466059 - RNA, 16 nt, Homo sapiens
cccccacccaccucca

SEQ ID NO: 1466060 - RNA, 18 nt, Homo sapiens
cccccacgugacagugcc

SEQ ID NO: 1466061 - RNA, 16 nt, Homo sapiens
cccccacugaccagaa

SEQ ID NO: 1466062 - RNA, 14 nt, Homo sapiens
cccccagcuaagaa

SEQ ID NO: 1466063 - RNA, 20 nt, Homo sapiens
cccccaggcuggagugcagu

SEQ ID NO: 1466064 - RNA, 12 nt, Homo sapiens
cccccaguguaa

SEQ ID NO: 1466065 - RNA, 14 nt, Homo sapiens
cccccaguguaaua

SEQ ID NO: 1466066 - RNA, 16 nt, Homo sapiens
cccccaucccucggga

SEQ ID NO: 1466067 - RNA, 14 nt, Homo sapiens
cccccgccaccuca

SEQ ID NO: 1466068 - RNA, 22 nt, Homo sapiens
ccccgauugaaagaaccagaga

SEQ ID NO: 1466069 - RNA, 16 nt, Homo sapiens
ccccgcccagugcagu

SEQ ID NO: 1466070 - RNA, 12 nt, Homo sapiens
ccccguagcucc

SEQ ID NO: 1466071 - RNA, 16 nt, Homo sapiens
ccccuacugcugugaa

SEQ ID NO: 1466072 - RNA, 15 nt, Homo sapiens
ccccuccacugucac

SEQ ID NO: 1466073 - RNA, 14 nt, Homo sapiens
ccccucucaccaaa

SEQ ID NO: 1466074 - RNA, 18 nt, Homo sapiens
ccccugaccucacuguga

SEQ ID NO: 1466075 - RNA, 20 nt, Homo sapiens
ccccugcggucaggcugggc

SEQ ID NO: 1466076 - RNA, 18 nt, Homo sapiens
ccccuggaucuaccagca

SEQ ID NO: 1466077 - RNA, 15 nt, Homo sapiens
ccccuggccacagua

SEQ ID NO: 1466078 - RNA, 16 nt, Homo sapiens
ccccuggcugugcucu

SEQ ID NO: 1466079 - RNA, 15 nt, Homo sapiens
ccccuggcuuugccu

SEQ ID NO: 1466080 - RNA, 17 nt, Homo sapiens
ccccuggucucuggucc

SEQ ID NO: 1466081 - RNA, 16 nt, Homo sapiens
ccccugguguguagcu

SEQ ID NO: 1466082 - RNA, 23 nt, Homo sapiens
ccccuuauccaggacucugucaa

SEQ ID NO: 1466083 - RNA, 14 nt, Homo sapiens
ccccuuguccuuuc

SEQ ID NO: 1466084 - RNA, 12 nt, Homo sapiens
ccccuuugcccu

SEQ ID NO: 1466085 - RNA, 13 nt, Homo sapiens
cccgaaaccagag

SEQ ID NO: 1466086 - RNA, 22 nt, Homo sapiens
cccggacauacucucugccugg

SEQ ID NO: 1466087 - RNA, 19 nt, Homo sapiens
cccggagguugggugggcc

SEQ ID NO: 1466088 - RNA, 16 nt, Homo sapiens
cccggggugaguccau

SEQ ID NO: 1466089 - RNA, 19 nt, Homo sapiens
cccggguggggcugcagaa

SEQ ID NO: 1466090 - RNA, 14 nt, Homo sapiens
cccgucauguuccu

SEQ ID NO: 1466091 - RNA, 16 nt, Homo sapiens
cccgucauguuccuca

SEQ ID NO: 1466092 - RNA, 20 nt, Homo sapiens
cccgucauguuccucaaaag

SEQ ID NO: 1466093 - RNA, 13 nt, Homo sapiens
cccgugccaaaaa

SEQ ID NO: 1466094 - RNA, 19 nt, Homo sapiens
cccguuccugacaucacag

SEQ ID NO: 1466095 - RNA, 14 nt, Homo sapiens
cccuacccaccgau

SEQ ID NO: 1466096 - RNA, 13 nt, Homo sapiens
cccuacugggaga

SEQ ID NO: 1466097 - RNA, 13 nt, Homo sapiens
cccucaacaggcc

SEQ ID NO: 1466098 - RNA, 14 nt, Homo sapiens
cccucagacauccc

SEQ ID NO: 1466099 - RNA, 11 nt, Homo sapiens
cccucauuccc

SEQ ID NO: 1466100 - RNA, 16 nt, Homo sapiens
cccuccaaaccuccag

SEQ ID NO: 1466101 - RNA, 13 nt, Homo sapiens
cccuccaauccca

SEQ ID NO: 1466102 - RNA, 19 nt, Homo sapiens
cccuccugugcugggggaa

SEQ ID NO: 1466103 - RNA, 20 nt, Homo sapiens
cccuccuugggucauugacc

SEQ ID NO: 1466104 - RNA, 19 nt, Homo sapiens
cccucuagaaauuuuucag

SEQ ID NO: 1466105 - RNA, 17 nt, Homo sapiens
cccucucccgccagacu

SEQ ID NO: 1466106 - RNA, 21 nt, Homo sapiens
cccucuguaacaacucuaguc

SEQ ID NO: 1466107 - RNA, 15 nt, Homo sapiens
cccucugucuuguga

SEQ ID NO: 1466108 - RNA, 14 nt, Homo sapiens
cccucuucauggau

SEQ ID NO: 1466109 - RNA, 14 nt, Homo sapiens
cccucuuugcugca

SEQ ID NO: 1466110 - RNA, 23 nt, Homo sapiens
cccucuuuucugaucugcaguuu

SEQ ID NO: 1466111 - RNA, 16 nt, Homo sapiens
cccugacucaucauuu

SEQ ID NO: 1466112 - RNA, 19 nt, Homo sapiens
cccugagauucagauguca

SEQ ID NO: 1466113 - RNA, 11 nt, Homo sapiens
aaaaaaagaga

SEQ ID NO: 1466114 - RNA, 14 nt, Homo sapiens
aaaaaacucuugau

SEQ ID NO: 1466115 - RNA, 12 nt, Homo sapiens
aaaaaaugcaca

SEQ ID NO: 1466116 - RNA, 17 nt, Homo sapiens
aaaaaauuaauacugaa

SEQ ID NO: 1466117 - RNA, 14 nt, Homo sapiens
aaaaaauuaugaca

SEQ ID NO: 1466118 - RNA, 15 nt, Homo sapiens
aaaaacaggucuuca

SEQ ID NO: 1466119 - RNA, 11 nt, Homo sapiens
aaaaacuacuu

SEQ ID NO: 1466120 - RNA, 19 nt, Homo sapiens
aaaaagagaauauacauga

SEQ ID NO: 1466121 - RNA, 18 nt, Homo sapiens
aaaaagcaucuaucucau

SEQ ID NO: 1466122 - RNA, 16 nt, Homo sapiens
aaaaagccacaaugaa

SEQ ID NO: 1466123 - RNA, 17 nt, Homo sapiens
aaaaagccaguuugggu

SEQ ID NO: 1466124 - RNA, 12 nt, Homo sapiens
aaaaagcuucca

SEQ ID NO: 1466125 - RNA, 13 nt, Homo sapiens
aaaaaggacucug

SEQ ID NO: 1466126 - RNA, 21 nt, Homo sapiens
aaaaagggauccguacauuca

SEQ ID NO: 1466127 - RNA, 13 nt, Homo sapiens
aaaaagucacaaa

SEQ ID NO: 1466128 - RNA, 17 nt, Homo sapiens
aaaaauaaugcauuugu

SEQ ID NO: 1466129 - RNA, 13 nt, Homo sapiens
aaaaauaaugugc

SEQ ID NO: 1466130 - RNA, 12 nt, Homo sapiens
aaaaauacaugu

SEQ ID NO: 1466131 - RNA, 15 nt, Homo sapiens
aaaaauagacacucc

SEQ ID NO: 1466132 - RNA, 19 nt, Homo sapiens
aaaaauauauuuaaugaua

SEQ ID NO: 1466133 - RNA, 15 nt, Homo sapiens
aaaaauauugcugaa

SEQ ID NO: 1466134 - RNA, 19 nt, Homo sapiens
aaaaauauuguuucugcau

SEQ ID NO: 1466135 - RNA, 13 nt, Homo sapiens
aaaaaugagcucg

SEQ ID NO: 1466136 - RNA, 17 nt, Homo sapiens
aaaaaugaugcgcauca

SEQ ID NO: 1466137 - RNA, 20 nt, Homo sapiens
aaaaaugugccuaguuuuau

SEQ ID NO: 1466138 - RNA, 18 nt, Homo sapiens
aaaaauuuaagcauuguu

SEQ ID NO: 1466139 - RNA, 20 nt, Homo sapiens
aaaacaaagaaauaaugguc

SEQ ID NO: 1466140 - RNA, 18 nt, Homo sapiens
aaaacacaaaguguauaa

SEQ ID NO: 1466141 - RNA, 22 nt, Homo sapiens
aaaacaccacuaauuguguaca

SEQ ID NO: 1466142 - RNA, 15 nt, Homo sapiens
aaaacaggcaaauuc

SEQ ID NO: 1466143 - RNA, 12 nt, Homo sapiens
aaaacauguaug

SEQ ID NO: 1466144 - RNA, 19 nt, Homo sapiens
aaaacauugauuauaagca

SEQ ID NO: 1466145 - RNA, 22 nt, Homo sapiens
aaaaccaaaagaacaagaauuu

SEQ ID NO: 1466146 - RNA, 22 nt, Homo sapiens
aaaaccacugggaggagucuau

SEQ ID NO: 1466147 - RNA, 20 nt, Homo sapiens
aaaaccccaucuuuacuaaa

SEQ ID NO: 1466148 - RNA, 16 nt, Homo sapiens
aaaaccucuaugcaau

SEQ ID NO: 1466149 - RNA, 22 nt, Homo sapiens
aaaaccugaagacugaggacaa

SEQ ID NO: 1466150 - RNA, 13 nt, Homo sapiens
aaaacuaagcaca

SEQ ID NO: 1466151 - RNA, 14 nt, Homo sapiens
aaaacuacaaauca

SEQ ID NO: 1466152 - RNA, 20 nt, Homo sapiens
aaaacuauauucauuuccac

SEQ ID NO: 1466153 - RNA, 16 nt, Homo sapiens
aaaacuauuauaugua

SEQ ID NO: 1466154 - RNA, 16 nt, Homo sapiens
aaaacuauuugggaua

SEQ ID NO: 1466155 - RNA, 12 nt, Homo sapiens
aaaacucagaga

SEQ ID NO: 1466156 - RNA, 18 nt, Homo sapiens
aaaacuggcuacugcucu

SEQ ID NO: 1466157 - RNA, 16 nt, Homo sapiens
aaaacuuagugacaaa

SEQ ID NO: 1466158 - RNA, 16 nt, Homo sapiens
aaaacuucaguaagua

SEQ ID NO: 1466159 - RNA, 19 nt, Homo sapiens
aaaacuucaguaaguacgu

SEQ ID NO: 1466160 - RNA, 17 nt, Homo sapiens
aaaacuuuaaugaacua

SEQ ID NO: 1466161 - RNA, 17 nt, Homo sapiens
aaaagaacaacugccaa

SEQ ID NO: 1466162 - RNA, 15 nt, Homo sapiens
aaaagaagacucuga

SEQ ID NO: 1466163 - RNA, 18 nt, Homo sapiens
aaaagacaacauaacuca

SEQ ID NO: 1466164 - RNA, 16 nt, Homo sapiens
aaaagacauucuucca

SEQ ID NO: 1466165 - RNA, 15 nt, Homo sapiens
aaaagacugaaucua

SEQ ID NO: 1466166 - RNA, 20 nt, Homo sapiens
aaaagacugaaucuaccugc

SEQ ID NO: 1466167 - RNA, 12 nt, Homo sapiens
aaaagaugaagu

SEQ ID NO: 1466168 - RNA, 20 nt, Homo sapiens
aaauacuucaugagcauuca

SEQ ID NO: 1466169 - RNA, 23 nt, Homo sapiens
aaauagagcuuuuaaaaaugucc

SEQ ID NO: 1466170 - RNA, 19 nt, Homo sapiens
aaauaggagccgauggauc

SEQ ID NO: 1466171 - RNA, 19 nt, Homo sapiens
aaauaguaaucuguaagca

SEQ ID NO: 1466172 - RNA, 14 nt, Homo sapiens
aaauagucuucuca

SEQ ID NO: 1466173 - RNA, 16 nt, Homo sapiens
aaauauaagacauuug

SEQ ID NO: 1466174 - RNA, 22 nt, Homo sapiens
aaauauagauuagaaaaauucc

SEQ ID NO: 1466175 - RNA, 20 nt, Homo sapiens
aaauauauacccccccaugc

SEQ ID NO: 1466176 - RNA, 22 nt, Homo sapiens
aaauauauacccccccaugcag

SEQ ID NO: 1466177 - RNA, 15 nt, Homo sapiens
aaauaucugucauau

SEQ ID NO: 1466178 - RNA, 17 nt, Homo sapiens
aaauaucuugcuuucaa

SEQ ID NO: 1466179 - RNA, 17 nt, Homo sapiens
aaauaugaagacauaaa

SEQ ID NO: 1466180 - RNA, 20 nt, Homo sapiens
aaauaugauuuuauuugaca

SEQ ID NO: 1466181 - RNA, 19 nt, Homo sapiens
aaauauuagaagccugcag

SEQ ID NO: 1466182 - RNA, 12 nt, Homo sapiens
aaauauugucau

SEQ ID NO: 1466183 - RNA, 20 nt, Homo sapiens
aaauauugucauaggauuaa

SEQ ID NO: 1466184 - RNA, 20 nt, Homo sapiens
aaauauuuauugucuguaaa

SEQ ID NO: 1466185 - RNA, 16 nt, Homo sapiens
aaauauuuccuuaaac

SEQ ID NO: 1466186 - RNA, 19 nt, Homo sapiens
aaauauuucucaacugagg

SEQ ID NO: 1466187 - RNA, 14 nt, Homo sapiens
aaauauuuuugcca

SEQ ID NO: 1466188 - RNA, 15 nt, Homo sapiens
aaaucaaugucacuu

SEQ ID NO: 1466189 - RNA, 16 nt, Homo sapiens
aaaucaaugucacuua

SEQ ID NO: 1466190 - RNA, 13 nt, Homo sapiens
aaaucacucucag

SEQ ID NO: 1466191 - RNA, 23 nt, Homo sapiens
aaaucaggacagguggugcaaau

SEQ ID NO: 1466192 - RNA, 13 nt, Homo sapiens
aaaucaguauuug

SEQ ID NO: 1466193 - RNA, 21 nt, Homo sapiens
aaaucauaguuuaaacugcau

SEQ ID NO: 1466194 - RNA, 20 nt, Homo sapiens
aaaucauccaagacaguuau

SEQ ID NO: 1466195 - RNA, 19 nt, Homo sapiens
aaaucauuaauacucuucu

SEQ ID NO: 1466196 - RNA, 21 nt, Homo sapiens
aaaucauuucaguaucaucuc

SEQ ID NO: 1466197 - RNA, 16 nt, Homo sapiens
aaauccucaggugauu

SEQ ID NO: 1466198 - RNA, 18 nt, Homo sapiens
aaauccucauguuacuca

SEQ ID NO: 1466199 - RNA, 22 nt, Homo sapiens
aaauccucauguuacucagugu

SEQ ID NO: 1466200 - RNA, 13 nt, Homo sapiens
aaauccuuccuaa

SEQ ID NO: 1466201 - RNA, 21 nt, Homo sapiens
aaauccuuccuaaacccaaug

SEQ ID NO: 1466202 - RNA, 21 nt, Homo sapiens
aaaucguccucccaggccagg

SEQ ID NO: 1466203 - RNA, 22 nt, Homo sapiens
aaaucuauucuguguugcauua

SEQ ID NO: 1466204 - RNA, 13 nt, Homo sapiens
aaaucucacaaau

SEQ ID NO: 1466205 - RNA, 12 nt, Homo sapiens
aaaucugaggga

SEQ ID NO: 1466206 - RNA, 15 nt, Homo sapiens
aaaucugaguauaua

SEQ ID NO: 1466207 - RNA, 19 nt, Homo sapiens
aaaucuggguaucuuucca

SEQ ID NO: 1466208 - RNA, 22 nt, Homo sapiens
aaaucuuaaaagcccuaaguga

SEQ ID NO: 1466209 - RNA, 19 nt, Homo sapiens
aaaucuuuuaaaaauucaa

SEQ ID NO: 1466210 - RNA, 17 nt, Homo sapiens
aaaucuuuuaaaucuuu

SEQ ID NO: 1466211 - RNA, 14 nt, Homo sapiens
aaaugaaaagccaa

SEQ ID NO: 1466212 - RNA, 15 nt, Homo sapiens
aaaugaaaagccaaa

SEQ ID NO: 1466213 - RNA, 15 nt, Homo sapiens
aaaugaaaauguuuc

SEQ ID NO: 1466214 - RNA, 15 nt, Homo sapiens
aaaugaaaauuccau

SEQ ID NO: 1466215 - RNA, 15 nt, Homo sapiens
aaaugaaagcaugug

SEQ ID NO: 1466216 - RNA, 15 nt, Homo sapiens
aaaugaacaaaagau

SEQ ID NO: 1466217 - RNA, 14 nt, Homo sapiens
aaaugacaaaaagc

SEQ ID NO: 1466218 - RNA, 13 nt, Homo sapiens
aaaugacauuaaa

SEQ ID NO: 1466219 - RNA, 20 nt, Homo sapiens
aaaugacucuggggagguga

SEQ ID NO: 1466220 - RNA, 19 nt, Homo sapiens
aaaugagacuuacugggug

SEQ ID NO: 1466221 - RNA, 21 nt, Homo sapiens
aaagacuguagaagaaagagc

SEQ ID NO: 1466222 - RNA, 14 nt, Homo sapiens
aaagagacagugau

SEQ ID NO: 1466223 - RNA, 17 nt, Homo sapiens
aaagagacuccgucuca

SEQ ID NO: 1466224 - RNA, 19 nt, Homo sapiens
aaagagagucgcaucucag

SEQ ID NO: 1466225 - RNA, 14 nt, Homo sapiens
aaagagcagcauuu

SEQ ID NO: 1466226 - RNA, 18 nt, Homo sapiens
aaagagcuuugugauaua

SEQ ID NO: 1466227 - RNA, 21 nt, Homo sapiens
aaagaggcugaggcuggcaca

SEQ ID NO: 1466228 - RNA, 15 nt, Homo sapiens
aaagaggcugccccu

SEQ ID NO: 1466229 - RNA, 20 nt, Homo sapiens
aaagaggcugccccucucac

SEQ ID NO: 1466230 - RNA, 18 nt, Homo sapiens
aaagauaauuuauuucaa

SEQ ID NO: 1466231 - RNA, 22 nt, Homo sapiens
aaagauccaagaaggccuucau

SEQ ID NO: 1466232 - RNA, 21 nt, Homo sapiens
aaagaucuuucaggacucuac

SEQ ID NO: 1466233 - RNA, 20 nt, Homo sapiens
aaagaugaucuacucagaaa

SEQ ID NO: 1466234 - RNA, 16 nt, Homo sapiens
aaagauguuugucaga

SEQ ID NO: 1466235 - RNA, 19 nt, Homo sapiens
aaagauguuugucagauau

SEQ ID NO: 1466236 - RNA, 21 nt, Homo sapiens
aaagauuauagaaguagcaaa

SEQ ID NO: 1466237 - RNA, 23 nt, Homo sapiens
aaagauuggacaccccugcuaua

SEQ ID NO: 1466238 - RNA, 15 nt, Homo sapiens
aaagauuuucagaaa

SEQ ID NO: 1466239 - RNA, 20 nt, Homo sapiens
aaagcaagacuguugcucaa

SEQ ID NO: 1466240 - RNA, 21 nt, Homo sapiens
aaagcacccuguaucacagac

SEQ ID NO: 1466241 - RNA, 16 nt, Homo sapiens
aaagcagacagucaca

SEQ ID NO: 1466242 - RNA, 18 nt, Homo sapiens
aaagcagacccaccuccc

SEQ ID NO: 1466243 - RNA, 15 nt, Homo sapiens
aaagcagauaccuca

SEQ ID NO: 1466244 - RNA, 16 nt, Homo sapiens
aaagcagauaccucac

SEQ ID NO: 1466245 - RNA, 22 nt, Homo sapiens
aaagcagccacgaggugcaaca

SEQ ID NO: 1466246 - RNA, 20 nt, Homo sapiens
aaagcagccauuggcacugu

SEQ ID NO: 1466247 - RNA, 20 nt, Homo sapiens
aaagcaguaaauuugcuagc

SEQ ID NO: 1466248 - RNA, 22 nt, Homo sapiens
aaagcaguuacuaauaugccua

SEQ ID NO: 1466249 - RNA, 15 nt, Homo sapiens
aaagcauccaugugu

SEQ ID NO: 1466250 - RNA, 12 nt, Homo sapiens
aaagcaugauau

SEQ ID NO: 1466251 - RNA, 15 nt, Homo sapiens
aaagccaacagucaa

SEQ ID NO: 1466252 - RNA, 14 nt, Homo sapiens
aaagccacaaggcu

SEQ ID NO: 1466253 - RNA, 18 nt, Homo sapiens
aaagccagugaaauguga

SEQ ID NO: 1466254 - RNA, 13 nt, Homo sapiens
aaagccuccucau

SEQ ID NO: 1466255 - RNA, 21 nt, Homo sapiens
aaagccucgggccacaugggu

SEQ ID NO: 1466256 - RNA, 13 nt, Homo sapiens
aaagccuuaggga

SEQ ID NO: 1466257 - RNA, 22 nt, Homo sapiens
aaagcucaugcauuucaagcag

SEQ ID NO: 1466258 - RNA, 20 nt, Homo sapiens
aaagcugagaacuccugacu

SEQ ID NO: 1466259 - RNA, 17 nt, Homo sapiens
aaagcugauuacuguca

SEQ ID NO: 1466260 - RNA, 22 nt, Homo sapiens
aaagcugauuacugucaauaaa

SEQ ID NO: 1466261 - RNA, 11 nt, Homo sapiens
aaagcugccau

SEQ ID NO: 1466262 - RNA, 13 nt, Homo sapiens
aaagcugccauuu

SEQ ID NO: 1466263 - RNA, 13 nt, Homo sapiens
aaagcuuccccaa

SEQ ID NO: 1466264 - RNA, 22 nt, Homo sapiens
aaagcuuuauuaccaguggcgu

SEQ ID NO: 1466265 - RNA, 21 nt, Homo sapiens
aaagcuuuuuacucaaagagu

SEQ ID NO: 1466266 - RNA, 20 nt, Homo sapiens
aaagcuuuuuccuccuggaa

SEQ ID NO: 1466267 - RNA, 19 nt, Homo sapiens
aaaggaaaauaguaauguu

SEQ ID NO: 1466268 - RNA, 13 nt, Homo sapiens
aaaggaacaaaua

SEQ ID NO: 1466269 - RNA, 14 nt, Homo sapiens
aaaggaagacuaga

SEQ ID NO: 1466270 - RNA, 21 nt, Homo sapiens
aaaggaagcuccacugucacc

SEQ ID NO: 1466271 - RNA, 21 nt, Homo sapiens
aaaggacaccuuuuaacucac

SEQ ID NO: 1466272 - RNA, 13 nt, Homo sapiens
aaaggacucugcu

SEQ ID NO: 1466273 - RNA, 19 nt, Homo sapiens
aaaggacucugcuucaguc

SEQ ID NO: 1466274 - RNA, 22 nt, Homo sapiens
aaaggcauaagacccuaagccu

SEQ ID NO: 1466275 - RNA, 21 nt, Homo sapiens
aacaggcaguggaagcaguuu

SEQ ID NO: 1466276 - RNA, 18 nt, Homo sapiens
aacaggcucaauauuccu

SEQ ID NO: 1466277 - RNA, 15 nt, Homo sapiens
aacagguauauacuu

SEQ ID NO: 1466278 - RNA, 23 nt, Homo sapiens
aacagugggcguugggagccuag

SEQ ID NO: 1466279 - RNA, 12 nt, Homo sapiens
aacaguugcauu

SEQ ID NO: 1466280 - RNA, 15 nt, Homo sapiens
aacaguuuuccauga

SEQ ID NO: 1466281 - RNA, 22 nt, Homo sapiens
aacaguuuuuuaugcuaaucag

SEQ ID NO: 1466282 - RNA, 21 nt, Homo sapiens
aacauaaauuucuuuaaucau

SEQ ID NO: 1466283 - RNA, 22 nt, Homo sapiens
aacauaaguguugguagcacuu

SEQ ID NO: 1466284 - RNA, 17 nt, Homo sapiens
aacauaaguugcauuua

SEQ ID NO: 1466285 - RNA, 23 nt, Homo sapiens
aacauaauaaaucacacauucag

SEQ ID NO: 1466286 - RNA, 20 nt, Homo sapiens
aacauacuggccuggacugu

SEQ ID NO: 1466287 - RNA, 12 nt, Homo sapiens
aacauacuucua

SEQ ID NO: 1466288 - RNA, 17 nt, Homo sapiens
aacauagcaucucagga

SEQ ID NO: 1466289 - RNA, 20 nt, Homo sapiens
aacauaggccugcucagccu

SEQ ID NO: 1466290 - RNA, 22 nt, Homo sapiens
aacauagugaaaccccaucucu

SEQ ID NO: 1466291 - RNA, 10 nt, Homo sapiens
aacaucaaag

SEQ ID NO: 1466292 - RNA, 12 nt, Homo sapiens
aacaucaaagag

SEQ ID NO: 1466293 - RNA, 13 nt, Homo sapiens
aacaucaguuucu

SEQ ID NO: 1466294 - RNA, 22 nt, Homo sapiens
aacaucgugaaaccccaucucu

SEQ ID NO: 1466295 - RNA, 19 nt, Homo sapiens
aacaucuaauaaguauaua

SEQ ID NO: 1466296 - RNA, 19 nt, Homo sapiens
aacaucuuaagauccacaa

SEQ ID NO: 1466297 - RNA, 21 nt, Homo sapiens
aacaucuuuuuaaccugcaaa

SEQ ID NO: 1466298 - RNA, 16 nt, Homo sapiens
aacaugccauaucuca

SEQ ID NO: 1466299 - RNA, 13 nt, Homo sapiens
aacaugcuuuaga

SEQ ID NO: 1466300 - RNA, 15 nt, Homo sapiens
aacauggagcuguca

SEQ ID NO: 1466301 - RNA, 22 nt, Homo sapiens
aacauggugaaaccccgucucu

SEQ ID NO: 1466302 - RNA, 13 nt, Homo sapiens
aacauguaugugc

SEQ ID NO: 1466303 - RNA, 16 nt, Homo sapiens
aacauguaugugcauu

SEQ ID NO: 1466304 - RNA, 18 nt, Homo sapiens
aacauuaaggaauuugau

SEQ ID NO: 1466305 - RNA, 22 nt, Homo sapiens
aacauuauguggcccucuggau

SEQ ID NO: 1466306 - RNA, 18 nt, Homo sapiens
aacauugauuauaagcau

SEQ ID NO: 1466307 - RNA, 21 nt, Homo sapiens
aacauuuggauuggugaaugg

SEQ ID NO: 1466308 - RNA, 21 nt, Homo sapiens
aacauuuuauuuuuaaaauau

SEQ ID NO: 1466309 - RNA, 19 nt, Homo sapiens
aaccaaagagggcuuccuc

SEQ ID NO: 1466310 - RNA, 15 nt, Homo sapiens
aaccaaggacugagc

SEQ ID NO: 1466311 - RNA, 15 nt, Homo sapiens
aaccaauagcuuuaa

SEQ ID NO: 1466312 - RNA, 17 nt, Homo sapiens
aaccacacaaagacauu

SEQ ID NO: 1466313 - RNA, 12 nt, Homo sapiens
aaccacagagaa

SEQ ID NO: 1466314 - RNA, 12 nt, Homo sapiens
aaccaccaaucc

SEQ ID NO: 1466315 - RNA, 13 nt, Homo sapiens
aaccacucaaauu

SEQ ID NO: 1466316 - RNA, 21 nt, Homo sapiens
aaccacuuaaaaaauguccau

SEQ ID NO: 1466317 - RNA, 14 nt, Homo sapiens
aaccagccaggcag

SEQ ID NO: 1466318 - RNA, 14 nt, Homo sapiens
aaccaguuuaucca

SEQ ID NO: 1466319 - RNA, 16 nt, Homo sapiens
aaccauccagugacaa

SEQ ID NO: 1466320 - RNA, 17 nt, Homo sapiens
aaccauccagugacaaa

SEQ ID NO: 1466321 - RNA, 19 nt, Homo sapiens
aacccaccccgcuuucgua

SEQ ID NO: 1466322 - RNA, 12 nt, Homo sapiens
aacccagacuca

SEQ ID NO: 1466323 - RNA, 18 nt, Homo sapiens
aacccaucgguaggcaaa

SEQ ID NO: 1466324 - RNA, 11 nt, Homo sapiens
aaccccagugg

SEQ ID NO: 1466325 - RNA, 12 nt, Homo sapiens
aaccccagugga

SEQ ID NO: 1466326 - RNA, 17 nt, Homo sapiens
aauggucauccaaacuc

SEQ ID NO: 1466327 - RNA, 22 nt, Homo sapiens
aauggugcaaauccuacugaau

SEQ ID NO: 1466328 - RNA, 13 nt, Homo sapiens
aauggugcugcag

SEQ ID NO: 1466329 - RNA, 15 nt, Homo sapiens
aauguaaagaacuua

SEQ ID NO: 1466330 - RNA, 14 nt, Homo sapiens
aauguaauacugga

SEQ ID NO: 1466331 - RNA, 16 nt, Homo sapiens
aauguaauacuggaau

SEQ ID NO: 1466332 - RNA, 15 nt, Homo sapiens
aauguaaucauuccu

SEQ ID NO: 1466333 - RNA, 13 nt, Homo sapiens
aauguaugugcac

SEQ ID NO: 1466334 - RNA, 23 nt, Homo sapiens
aauguaugugcacugucacuuug

SEQ ID NO: 1466335 - RNA, 21 nt, Homo sapiens
aauguaugugcucuuagcaaa

SEQ ID NO: 1466336 - RNA, 18 nt, Homo sapiens
aauguauucaaauaccaa

SEQ ID NO: 1466337 - RNA, 21 nt, Homo sapiens
aauguauuuguuugcaauuuu

SEQ ID NO: 1466338 - RNA, 17 nt, Homo sapiens
aaugucaggaacagaag

SEQ ID NO: 1466339 - RNA, 14 nt, Homo sapiens
aaugucauguugcu

SEQ ID NO: 1466340 - RNA, 22 nt, Homo sapiens
aaugucccuuucagagacagcu

SEQ ID NO: 1466341 - RNA, 12 nt, Homo sapiens
aaugucuaucaa

SEQ ID NO: 1466342 - RNA, 16 nt, Homo sapiens
aaugucuguuaacuua

SEQ ID NO: 1466343 - RNA, 16 nt, Homo sapiens
aaugugaccaggggug

SEQ ID NO: 1466344 - RNA, 23 nt, Homo sapiens
aaugugauuacugcucuauucca

SEQ ID NO: 1466345 - RNA, 21 nt, Homo sapiens
aaugugcagcucccauuuggc

SEQ ID NO: 1466346 - RNA, 17 nt, Homo sapiens
aauguggauucuuccca

SEQ ID NO: 1466347 - RNA, 16 nt, Homo sapiens
aaugugguuacuuccu

SEQ ID NO: 1466348 - RNA, 18 nt, Homo sapiens
aaugugguuacuuccuac

SEQ ID NO: 1466349 - RNA, 23 nt, Homo sapiens
aaugugucaggugacccugauga

SEQ ID NO: 1466350 - RNA, 23 nt, Homo sapiens
aauguguccuaucuaucuuccaa

SEQ ID NO: 1466351 - RNA, 17 nt, Homo sapiens
aauguguuaagugcagg

SEQ ID NO: 1466352 - RNA, 13 nt, Homo sapiens
aauguuaagcaga

SEQ ID NO: 1466353 - RNA, 15 nt, Homo sapiens
aauguuacauuauua

SEQ ID NO: 1466354 - RNA, 20 nt, Homo sapiens
aauguucacauagugaaaua

SEQ ID NO: 1466355 - RNA, 22 nt, Homo sapiens
aauguuuuacugugaaacuggc

SEQ ID NO: 1466356 - RNA, 21 nt, Homo sapiens
aauguuuuucccuccccagaa

SEQ ID NO: 1466357 - RNA, 21 nt, Homo sapiens
aauuaaaaaguuaaucuucau

SEQ ID NO: 1466358 - RNA, 17 nt, Homo sapiens
aauuaaaaauacagugu

SEQ ID NO: 1466359 - RNA, 16 nt, Homo sapiens
aauuaaaaccaauuua

SEQ ID NO: 1466360 - RNA, 16 nt, Homo sapiens
aauuaaaacuucuuaa

SEQ ID NO: 1466361 - RNA, 17 nt, Homo sapiens
aauuaaaggaacagagu

SEQ ID NO: 1466362 - RNA, 21 nt, Homo sapiens
aauuaauaucccuacauguau

SEQ ID NO: 1466363 - RNA, 16 nt, Homo sapiens
aauuagaaaguagcca

SEQ ID NO: 1466364 - RNA, 14 nt, Homo sapiens
aauuagaugaacuc

SEQ ID NO: 1466365 - RNA, 16 nt, Homo sapiens
aauuaggcagugcuaa

SEQ ID NO: 1466366 - RNA, 22 nt, Homo sapiens
aauuauacagauagaguuccau

SEQ ID NO: 1466367 - RNA, 20 nt, Homo sapiens
aauuaucggaagcagugccu

SEQ ID NO: 1466368 - RNA, 18 nt, Homo sapiens
aauuaucgggaacagugu

SEQ ID NO: 1466369 - RNA, 19 nt, Homo sapiens
aauuaugucuuaguuauaa

SEQ ID NO: 1466370 - RNA, 16 nt, Homo sapiens
aauuauuucacuuuag

SEQ ID NO: 1466371 - RNA, 13 nt, Homo sapiens
aauuauuugcuaa

SEQ ID NO: 1466372 - RNA, 16 nt, Homo sapiens
aauuauuuugguacuu

SEQ ID NO: 1466373 - RNA, 15 nt, Homo sapiens
aauucaaaagauuaa

SEQ ID NO: 1466374 - RNA, 12 nt, Homo sapiens
aauucaaccacu

SEQ ID NO: 1466375 - RNA, 14 nt, Homo sapiens
aauucagaguccuu

SEQ ID NO: 1466376 - RNA, 15 nt, Homo sapiens
aauucagaugcuguu

SEQ ID NO: 1466377 - RNA, 19 nt, Homo sapiens
acagaaagcagauaccuca

SEQ ID NO: 1466378 - RNA, 20 nt, Homo sapiens
acagaaagccugggugacau

SEQ ID NO: 1466379 - RNA, 21 nt, Homo sapiens
acagaaagccugggugacauu

SEQ ID NO: 1466380 - RNA, 17 nt, Homo sapiens
acagaacauauguugca

SEQ ID NO: 1466381 - RNA, 12 nt, Homo sapiens
acagaacuacuu

SEQ ID NO: 1466382 - RNA, 15 nt, Homo sapiens
acagaacugcaguca

SEQ ID NO: 1466383 - RNA, 12 nt, Homo sapiens
acagaacuugaa

SEQ ID NO: 1466384 - RNA, 19 nt, Homo sapiens
acagaaggaaucugugcag

SEQ ID NO: 1466385 - RNA, 14 nt, Homo sapiens
acagaauagcacaa

SEQ ID NO: 1466386 - RNA, 18 nt, Homo sapiens
acagaaugguggagugua

SEQ ID NO: 1466387 - RNA, 14 nt, Homo sapiens
acagaauuuccacu

SEQ ID NO: 1466388 - RNA, 20 nt, Homo sapiens
acagaauuuccacuguaauu

SEQ ID NO: 1466389 - RNA, 14 nt, Homo sapiens
acagacacuuacau

SEQ ID NO: 1466390 - RNA, 14 nt, Homo sapiens
acagacaggcucuu

SEQ ID NO: 1466391 - RNA, 15 nt, Homo sapiens
acagacauacauuua

SEQ ID NO: 1466392 - RNA, 20 nt, Homo sapiens
acagacauacauuuaugcac

SEQ ID NO: 1466393 - RNA, 13 nt, Homo sapiens
acagaccacagag

SEQ ID NO: 1466394 - RNA, 18 nt, Homo sapiens
acagaccggagaggacag

SEQ ID NO: 1466395 - RNA, 16 nt, Homo sapiens
acagaccucaguuuua

SEQ ID NO: 1466396 - RNA, 20 nt, Homo sapiens
acagagagacagacuugaga

SEQ ID NO: 1466397 - RNA, 15 nt, Homo sapiens
acagagaugugauaa

SEQ ID NO: 1466398 - RNA, 21 nt, Homo sapiens
acagagcaagacuccaucuca

SEQ ID NO: 1466399 - RNA, 21 nt, Homo sapiens
acagagcgagacuccgucuca

SEQ ID NO: 1466400 - RNA, 22 nt, Homo sapiens
acagaggaauuuauaccucaaa

SEQ ID NO: 1466401 - RNA, 15 nt, Homo sapiens
acagaggagugcagc

SEQ ID NO: 1466402 - RNA, 18 nt, Homo sapiens
acagagggcucaccucuu

SEQ ID NO: 1466403 - RNA, 19 nt, Homo sapiens
acagaguagaaacucaaaa

SEQ ID NO: 1466404 - RNA, 15 nt, Homo sapiens
acagaguaucagauc

SEQ ID NO: 1466405 - RNA, 21 nt, Homo sapiens
acagagucccuggcuccucua

SEQ ID NO: 1466406 - RNA, 13 nt, Homo sapiens
acagagugcaacc

SEQ ID NO: 1466407 - RNA, 17 nt, Homo sapiens
acagagugcaacccagu

SEQ ID NO: 1466408 - RNA, 20 nt, Homo sapiens
acagauccuuuuuccaucau

SEQ ID NO: 1466409 - RNA, 18 nt, Homo sapiens
acagaucuggaaccucag

SEQ ID NO: 1466410 - RNA, 14 nt, Homo sapiens
acagaugcuaauaa

SEQ ID NO: 1466411 - RNA, 15 nt, Homo sapiens
acagaugcuaauaaa

SEQ ID NO: 1466412 - RNA, 13 nt, Homo sapiens
acagaugucucug

SEQ ID NO: 1466413 - RNA, 13 nt, Homo sapiens
acagcaacaauga

SEQ ID NO: 1466414 - RNA, 22 nt, Homo sapiens
acagcaaccucuucaugagcuu

SEQ ID NO: 1466415 - RNA, 14 nt, Homo sapiens
acagcacagccaac

SEQ ID NO: 1466416 - RNA, 19 nt, Homo sapiens
acagcaccaccuugcgauu

SEQ ID NO: 1466417 - RNA, 16 nt, Homo sapiens
acagcacuacugggug

SEQ ID NO: 1466418 - RNA, 13 nt, Homo sapiens
acagcagauuuca

SEQ ID NO: 1466419 - RNA, 17 nt, Homo sapiens
acagcagcaguuacaaa

SEQ ID NO: 1466420 - RNA, 18 nt, Homo sapiens
acagcagugaucucaggg

SEQ ID NO: 1466421 - RNA, 20 nt, Homo sapiens
acagcaguguucucacagug

SEQ ID NO: 1466422 - RNA, 18 nt, Homo sapiens
acagcaugagguguugug

SEQ ID NO: 1466423 - RNA, 21 nt, Homo sapiens
acagcaugagguguugugcau

SEQ ID NO: 1466424 - RNA, 18 nt, Homo sapiens
acagcaugccuucaaauc

SEQ ID NO: 1466425 - RNA, 16 nt, Homo sapiens
acagcaugugccuuaa

SEQ ID NO: 1466426 - RNA, 22 nt, Homo sapiens
acagcccauggugaauguaugu

SEQ ID NO: 1466427 - RNA, 23 nt, Homo sapiens
acagccccacccuggugggccaa

SEQ ID NO: 1466428 - RNA, 18 nt, Homo sapiens
acccagguggagggcaca

SEQ ID NO: 1466429 - RNA, 17 nt, Homo sapiens
acccagugacugacauu

SEQ ID NO: 1466430 - RNA, 17 nt, Homo sapiens
acccaguggacucuucc

SEQ ID NO: 1466431 - RNA, 14 nt, Homo sapiens
acccauauuacaga

SEQ ID NO: 1466432 - RNA, 19 nt, Homo sapiens
acccaucccaccccuccau

SEQ ID NO: 1466433 - RNA, 19 nt, Homo sapiens
acccaucuaguacuugaaa

SEQ ID NO: 1466434 - RNA, 17 nt, Homo sapiens
acccaugggcucugaca

SEQ ID NO: 1466435 - RNA, 16 nt, Homo sapiens
acccauucacuacagg

SEQ ID NO: 1466436 - RNA, 13 nt, Homo sapiens
accccaaacccca

SEQ ID NO: 1466437 - RNA, 15 nt, Homo sapiens
accccaagcaggaac

SEQ ID NO: 1466438 - RNA, 14 nt, Homo sapiens
accccaagcugccu

SEQ ID NO: 1466439 - RNA, 20 nt, Homo sapiens
accccacaccccagcccacc

SEQ ID NO: 1466440 - RNA, 22 nt, Homo sapiens
accccaccuugccaagcuuucu

SEQ ID NO: 1466441 - RNA, 13 nt, Homo sapiens
accccagccugaa

SEQ ID NO: 1466442 - RNA, 19 nt, Homo sapiens
accccaucuuuacuaaaaa

SEQ ID NO: 1466443 - RNA, 20 nt, Homo sapiens
acccccacccccagcucaau

SEQ ID NO: 1466444 - RNA, 13 nt, Homo sapiens
acccccagcucaa

SEQ ID NO: 1466445 - RNA, 14 nt, Homo sapiens
acccccagcucaau

SEQ ID NO: 1466446 - RNA, 15 nt, Homo sapiens
acccccagcucaaug

SEQ ID NO: 1466447 - RNA, 15 nt, Homo sapiens
acccccaguguaaua

SEQ ID NO: 1466448 - RNA, 13 nt, Homo sapiens
acccccaucuuua

SEQ ID NO: 1466449 - RNA, 14 nt, Homo sapiens
accccgggcucucu

SEQ ID NO: 1466450 - RNA, 21 nt, Homo sapiens
accccggggugcccacaggcc

SEQ ID NO: 1466451 - RNA, 14 nt, Homo sapiens
accccguagcucca

SEQ ID NO: 1466452 - RNA, 18 nt, Homo sapiens
accccuacacacacccag

SEQ ID NO: 1466453 - RNA, 16 nt, Homo sapiens
accccuaggaacucag

SEQ ID NO: 1466454 - RNA, 15 nt, Homo sapiens
accccucuaccuccu

SEQ ID NO: 1466455 - RNA, 14 nt, Homo sapiens
accccugacucauc

SEQ ID NO: 1466456 - RNA, 19 nt, Homo sapiens
accccuggaagagcccagu

SEQ ID NO: 1466457 - RNA, 23 nt, Homo sapiens
accccugucccaaccccagugga

SEQ ID NO: 1466458 - RNA, 15 nt, Homo sapiens
accccuuagccuccc

SEQ ID NO: 1466459 - RNA, 22 nt, Homo sapiens
accccuuucugucccacuacau

SEQ ID NO: 1466460 - RNA, 14 nt, Homo sapiens
accccuuugcccuu

SEQ ID NO: 1466461 - RNA, 23 nt, Homo sapiens
acccggagcucuacgugcuccuc

SEQ ID NO: 1466462 - RNA, 21 nt, Homo sapiens
acccgggaggcagagguugca

SEQ ID NO: 1466463 - RNA, 22 nt, Homo sapiens
acccuaacacaguauaucccaa

SEQ ID NO: 1466464 - RNA, 16 nt, Homo sapiens
acccuacacccagacc

SEQ ID NO: 1466465 - RNA, 13 nt, Homo sapiens
acccuagucccuu

SEQ ID NO: 1466466 - RNA, 20 nt, Homo sapiens
acccuaguucuaccucaggc

SEQ ID NO: 1466467 - RNA, 20 nt, Homo sapiens
acccuauuuagaaauggauu

SEQ ID NO: 1466468 - RNA, 19 nt, Homo sapiens
acccucauucuacugaaaa

SEQ ID NO: 1466469 - RNA, 17 nt, Homo sapiens
acccucauuucucaucu

SEQ ID NO: 1466470 - RNA, 15 nt, Homo sapiens
acccuccacucagcu

SEQ ID NO: 1466471 - RNA, 20 nt, Homo sapiens
acccuccccacccugaacaa

SEQ ID NO: 1466472 - RNA, 19 nt, Homo sapiens
acccucccccgccacuccu

SEQ ID NO: 1466473 - RNA, 21 nt, Homo sapiens
acccucccuggaguguggcug

SEQ ID NO: 1466474 - RNA, 19 nt, Homo sapiens
acccuccuaauagucauac

SEQ ID NO: 1466475 - RNA, 23 nt, Homo sapiens
acccuccuccccacacagacucc

SEQ ID NO: 1466476 - RNA, 13 nt, Homo sapiens
acccucucagcuc

SEQ ID NO: 1466477 - RNA, 15 nt, Homo sapiens
acccucuuugcugca

SEQ ID NO: 1466478 - RNA, 24 nt, Homo sapiens
acccugcaaaauuugaugccagga

SEQ ID NO: 1466479 - RNA, 22 nt, Homo sapiens
acccugccccaccccaccucca

SEQ ID NO: 1466480 - RNA, 19 nt, Homo sapiens
acccugccuuaucuugcac

SEQ ID NO: 1466481 - RNA, 15 nt, Homo sapiens
acccugcgccuccag

SEQ ID NO: 1466482 - RNA, 16 nt, Homo sapiens
acccugcugaccuccc

SEQ ID NO: 1466483 - RNA, 19 nt, Homo sapiens
acccuggauggggcuucca

SEQ ID NO: 1466484 - RNA, 20 nt, Homo sapiens
acccuguaccucaucccaug

SEQ ID NO: 1466485 - RNA, 18 nt, Homo sapiens
acccuguuuucagcuaaa

SEQ ID NO: 1466486 - RNA, 17 nt, Homo sapiens
acccuucagaccccagu

SEQ ID NO: 1466487 - RNA, 13 nt, Homo sapiens
acccuucccucac

SEQ ID NO: 1466488 - RNA, 17 nt, Homo sapiens
acccuucuuuugaagga

SEQ ID NO: 1466489 - RNA, 13 nt, Homo sapiens
acccuugaaccaa

SEQ ID NO: 1466490 - RNA, 17 nt, Homo sapiens
acccuuggacaagacaa

SEQ ID NO: 1466491 - RNA, 19 nt, Homo sapiens
acccuuggagccaauggag

SEQ ID NO: 1466492 - RNA, 18 nt, Homo sapiens
acccuugguggcuuaugg

SEQ ID NO: 1466493 - RNA, 23 nt, Homo sapiens
acccuuuaagauauccaucuuuu

SEQ ID NO: 1466494 - RNA, 19 nt, Homo sapiens
acccuuucaaacuauuuau

SEQ ID NO: 1466495 - RNA, 22 nt, Homo sapiens
acccuuuucccccuucccauuu

SEQ ID NO: 1466496 - RNA, 11 nt, Homo sapiens
accgcacucca

SEQ ID NO: 1466497 - RNA, 17 nt, Homo sapiens
accgcccaucaggguuc

SEQ ID NO: 1466498 - RNA, 14 nt, Homo sapiens
accgcgacguugca

SEQ ID NO: 1466499 - RNA, 18 nt, Homo sapiens
accgcuucucagccacaa

SEQ ID NO: 1466500 - RNA, 23 nt, Homo sapiens
accgcuucugccuuuucacugug

SEQ ID NO: 1466501 - RNA, 19 nt, Homo sapiens
accggagaaccccaggacg

SEQ ID NO: 1466502 - RNA, 22 nt, Homo sapiens
accgggagccucccccucagau

SEQ ID NO: 1466503 - RNA, 23 nt, Homo sapiens
accggggccuacuagagucugaa

SEQ ID NO: 1466504 - RNA, 15 nt, Homo sapiens
accguaaauguccau

SEQ ID NO: 1466505 - RNA, 16 nt, Homo sapiens
accguacaucugcaau

SEQ ID NO: 1466506 - RNA, 15 nt, Homo sapiens
accgugaccaggaac

SEQ ID NO: 1466507 - RNA, 22 nt, Homo sapiens
accguggaggaggaaggcaaga

SEQ ID NO: 1466508 - RNA, 21 nt, Homo sapiens
accguuuugaagcuacugugu

SEQ ID NO: 1466509 - RNA, 21 nt, Homo sapiens
accuaauguuuaugagccaga

SEQ ID NO: 1466510 - RNA, 19 nt, Homo sapiens
accuaauucgaugaaggcu

SEQ ID NO: 1466511 - RNA, 16 nt, Homo sapiens
accuacauuaucucac

SEQ ID NO: 1466512 - RNA, 20 nt, Homo sapiens
accuacuuugguaguggaau

SEQ ID NO: 1466513 - RNA, 19 nt, Homo sapiens
accuagaaguauuuuuguc

SEQ ID NO: 1466514 - RNA, 17 nt, Homo sapiens
accuagaccuaaacggc

SEQ ID NO: 1466515 - RNA, 14 nt, Homo sapiens
accuagacuguaaa

SEQ ID NO: 1466516 - RNA, 11 nt, Homo sapiens
accuagcuuua

SEQ ID NO: 1466517 - RNA, 23 nt, Homo sapiens
accuaguacugccccccaugagg

SEQ ID NO: 1466518 - RNA, 19 nt, Homo sapiens
accuauuuccagaaauaca

SEQ ID NO: 1466519 - RNA, 13 nt, Homo sapiens
accucacugugac

SEQ ID NO: 1466520 - RNA, 16 nt, Homo sapiens
accucagaaagucacc

SEQ ID NO: 1466521 - RNA, 16 nt, Homo sapiens
accucagacuuaccag

SEQ ID NO: 1466522 - RNA, 19 nt, Homo sapiens
accucagccuggccagaca

SEQ ID NO: 1466523 - RNA, 20 nt, Homo sapiens
accucagccuggccagacac

SEQ ID NO: 1466524 - RNA, 22 nt, Homo sapiens
accucagugucauuuaugaaaa

SEQ ID NO: 1466525 - RNA, 20 nt, Homo sapiens
accuccaccacaucugccag

SEQ ID NO: 1466526 - RNA, 20 nt, Homo sapiens
accuccgagacaguccagug

SEQ ID NO: 1466527 - RNA, 17 nt, Homo sapiens
accuccgccucccgggu

SEQ ID NO: 1466528 - RNA, 20 nt, Homo sapiens
accuccuccucuggacaaag

SEQ ID NO: 1466529 - RNA, 14 nt, Homo sapiens
agauauuucacauu

SEQ ID NO: 1466530 - RNA, 18 nt, Homo sapiens
agaucacgucacugcacu

SEQ ID NO: 1466531 - RNA, 11 nt, Homo sapiens
agaucaugaca

SEQ ID NO: 1466532 - RNA, 17 nt, Homo sapiens
agauccgagucuaccca

SEQ ID NO: 1466533 - RNA, 20 nt, Homo sapiens
agauccuucgggugcuggaa

SEQ ID NO: 1466534 - RNA, 15 nt, Homo sapiens
agaucgcaccacugc

SEQ ID NO: 1466535 - RNA, 19 nt, Homo sapiens
agaucugcacucaccucac

SEQ ID NO: 1466536 - RNA, 18 nt, Homo sapiens
agaucuggucccuugcag

SEQ ID NO: 1466537 - RNA, 22 nt, Homo sapiens
agaucuguaaguaacuucacau

SEQ ID NO: 1466538 - RNA, 15 nt, Homo sapiens
agaugacagggaaaa

SEQ ID NO: 1466539 - RNA, 22 nt, Homo sapiens
agaugacagggaaaacugcaaa

SEQ ID NO: 1466540 - RNA, 22 nt, Homo sapiens
agaugagguucugagaccagug

SEQ ID NO: 1466541 - RNA, 22 nt, Homo sapiens
agaugauacauccaaagcagac

SEQ ID NO: 1466542 - RNA, 19 nt, Homo sapiens
agaugauggcucauuuaca

SEQ ID NO: 1466543 - RNA, 18 nt, Homo sapiens
agaugcagggcagucauu

SEQ ID NO: 1466544 - RNA, 18 nt, Homo sapiens
agaugccuacaaccaucc

SEQ ID NO: 1466545 - RNA, 15 nt, Homo sapiens
agauggaaaaacuga

SEQ ID NO: 1466546 - RNA, 16 nt, Homo sapiens
agauggaaaagaaauu

SEQ ID NO: 1466547 - RNA, 20 nt, Homo sapiens
agauggaaaagaaauugcau

SEQ ID NO: 1466548 - RNA, 16 nt, Homo sapiens
agauggacagcgauga

SEQ ID NO: 1466549 - RNA, 21 nt, Homo sapiens
agaugggcaaaagacgggaag

SEQ ID NO: 1466550 - RNA, 22 nt, Homo sapiens
agaugggcaaauuaaggcauaa

SEQ ID NO: 1466551 - RNA, 21 nt, Homo sapiens
agaugguaccgugcaucgcac

SEQ ID NO: 1466552 - RNA, 14 nt, Homo sapiens
agaugguccauuug

SEQ ID NO: 1466553 - RNA, 17 nt, Homo sapiens
agaugucucuggggcag

SEQ ID NO: 1466554 - RNA, 22 nt, Homo sapiens
agaugugaauuauugacacuga

SEQ ID NO: 1466555 - RNA, 20 nt, Homo sapiens
agaugugagccaccgugccu

SEQ ID NO: 1466556 - RNA, 19 nt, Homo sapiens
agauguuucaacugugcuc

SEQ ID NO: 1466557 - RNA, 19 nt, Homo sapiens
agauguuuuggggacucau

SEQ ID NO: 1466558 - RNA, 16 nt, Homo sapiens
agauuaaacaaacaaa

SEQ ID NO: 1466559 - RNA, 16 nt, Homo sapiens
agauuagguagacuuu

SEQ ID NO: 1466560 - RNA, 17 nt, Homo sapiens
agauuccccugugucau

SEQ ID NO: 1466561 - RNA, 22 nt, Homo sapiens
agauuccugguuaaauuugaau

SEQ ID NO: 1466562 - RNA, 20 nt, Homo sapiens
agauucucaaaauuccuaca

SEQ ID NO: 1466563 - RNA, 16 nt, Homo sapiens
agauucuccugugcua

SEQ ID NO: 1466564 - RNA, 13 nt, Homo sapiens
agauugauacuuu

SEQ ID NO: 1466565 - RNA, 14 nt, Homo sapiens
agauugcuuucuuc

SEQ ID NO: 1466566 - RNA, 17 nt, Homo sapiens
agauugugaauauuucc

SEQ ID NO: 1466567 - RNA, 22 nt, Homo sapiens
agauugugccacuucacuccag

SEQ ID NO: 1466568 - RNA, 12 nt, Homo sapiens
agauugugcucc

SEQ ID NO: 1466569 - RNA, 20 nt, Homo sapiens
agauuguuaggagugguucu

SEQ ID NO: 1466570 - RNA, 16 nt, Homo sapiens
agauuucaugccuggu

SEQ ID NO: 1466571 - RNA, 16 nt, Homo sapiens
agauuuggagcugucu

SEQ ID NO: 1466572 - RNA, 18 nt, Homo sapiens
agauuuggcuugacaaag

SEQ ID NO: 1466573 - RNA, 18 nt, Homo sapiens
agauuugucuaauugcau

SEQ ID NO: 1466574 - RNA, 14 nt, Homo sapiens
agauuuuaaagaca

SEQ ID NO: 1466575 - RNA, 15 nt, Homo sapiens
agauuuuacaaaaga

SEQ ID NO: 1466576 - RNA, 19 nt, Homo sapiens
agauuuucauguucuugca

SEQ ID NO: 1466577 - RNA, 19 nt, Homo sapiens
agauuuucugguucuacuu

SEQ ID NO: 1466578 - RNA, 17 nt, Homo sapiens
agccaaguggggugcug

SEQ ID NO: 1466579 - RNA, 15 nt, Homo sapiens
agccaauguguggcu

SEQ ID NO: 1466580 - RNA, 21 nt, Homo sapiens
agccaauguuuuccacccaua

SEQ ID NO: 1466581 - RNA, 16 nt, Homo sapiens
agccacaaccaaaaaa

SEQ ID NO: 1466582 - RNA, 17 nt, Homo sapiens
agccacgaggugcaaca

SEQ ID NO: 1466583 - RNA, 19 nt, Homo sapiens
agccacgggggacugacgc

SEQ ID NO: 1466584 - RNA, 17 nt, Homo sapiens
agccacuggcuuggaac

SEQ ID NO: 1466585 - RNA, 22 nt, Homo sapiens
agccagaugugaaaacaucuca

SEQ ID NO: 1466586 - RNA, 21 nt, Homo sapiens
agccagccaucaaauagugaa

SEQ ID NO: 1466587 - RNA, 18 nt, Homo sapiens
agccagccugaccuuccu

SEQ ID NO: 1466588 - RNA, 16 nt, Homo sapiens
agccagcucugcauua

SEQ ID NO: 1466589 - RNA, 19 nt, Homo sapiens
agccagcuggcuuugcacu

SEQ ID NO: 1466590 - RNA, 22 nt, Homo sapiens
agccagcuuacuagcacuuuga

SEQ ID NO: 1466591 - RNA, 15 nt, Homo sapiens
agccaggacaucucu

SEQ ID NO: 1466592 - RNA, 18 nt, Homo sapiens
agccaggccccaagccca

SEQ ID NO: 1466593 - RNA, 19 nt, Homo sapiens
agccaggcugcuaaccugg

SEQ ID NO: 1466594 - RNA, 21 nt, Homo sapiens
agccaggguggucuugaucuc

SEQ ID NO: 1466595 - RNA, 16 nt, Homo sapiens
agccagguaaugugaa

SEQ ID NO: 1466596 - RNA, 13 nt, Homo sapiens
agccagugccauu

SEQ ID NO: 1466597 - RNA, 16 nt, Homo sapiens
agccaguggugcuaaa

SEQ ID NO: 1466598 - RNA, 13 nt, Homo sapiens
agccauaaauugc

SEQ ID NO: 1466599 - RNA, 16 nt, Homo sapiens
agccaugccugagguc

SEQ ID NO: 1466600 - RNA, 23 nt, Homo sapiens
agccauggcugggcgugcuagag

SEQ ID NO: 1466601 - RNA, 16 nt, Homo sapiens
agccauuggcacugug

SEQ ID NO: 1466602 - RNA, 15 nt, Homo sapiens
agccauuuugugaau

SEQ ID NO: 1466603 - RNA, 18 nt, Homo sapiens
agcccaagcuucccucca

SEQ ID NO: 1466604 - RNA, 14 nt, Homo sapiens
agcccacacuugag

SEQ ID NO: 1466605 - RNA, 16 nt, Homo sapiens
agcccacuguuaauau

SEQ ID NO: 1466606 - RNA, 20 nt, Homo sapiens
agcccacuguuaauauucua

SEQ ID NO: 1466607 - RNA, 16 nt, Homo sapiens
agcccagacgcagcug

SEQ ID NO: 1466608 - RNA, 20 nt, Homo sapiens
agcccagagacauacuugaa

SEQ ID NO: 1466609 - RNA, 15 nt, Homo sapiens
agcccagauggaaag

SEQ ID NO: 1466610 - RNA, 15 nt, Homo sapiens
agcccagcacuguga

SEQ ID NO: 1466611 - RNA, 20 nt, Homo sapiens
agcccagcccuccucuguca

SEQ ID NO: 1466612 - RNA, 17 nt, Homo sapiens
agcccagcuugccaaug

SEQ ID NO: 1466613 - RNA, 18 nt, Homo sapiens
agcccagcuugccaaugg

SEQ ID NO: 1466614 - RNA, 15 nt, Homo sapiens
agcccaggacucuaa

SEQ ID NO: 1466615 - RNA, 17 nt, Homo sapiens
agcccauaucacuaaga

SEQ ID NO: 1466616 - RNA, 22 nt, Homo sapiens
agcccauccaaacacugaggca

SEQ ID NO: 1466617 - RNA, 16 nt, Homo sapiens
agcccauccagucucc

SEQ ID NO: 1466618 - RNA, 19 nt, Homo sapiens
agcccaugcucaaccacug

SEQ ID NO: 1466619 - RNA, 22 nt, Homo sapiens
agcccaugcucaaccacugugg

SEQ ID NO: 1466620 - RNA, 19 nt, Homo sapiens
agcccaugugcaccugccc

SEQ ID NO: 1466621 - RNA, 20 nt, Homo sapiens
agcccauuucuccauacgca

SEQ ID NO: 1466622 - RNA, 16 nt, Homo sapiens
agccccauccaacacu

SEQ ID NO: 1466623 - RNA, 22 nt, Homo sapiens
agcccccagcuaagaaccugga

SEQ ID NO: 1466624 - RNA, 17 nt, Homo sapiens
agccccucacauuccua

SEQ ID NO: 1466625 - RNA, 16 nt, Homo sapiens
agcccuccucugucaa

SEQ ID NO: 1466626 - RNA, 18 nt, Homo sapiens
agcccugaccccagugua

SEQ ID NO: 1466627 - RNA, 15 nt, Homo sapiens
agcccugaggugaaa

SEQ ID NO: 1466628 - RNA, 17 nt, Homo sapiens
agcccugugucuguaua

SEQ ID NO: 1466629 - RNA, 14 nt, Homo sapiens
agcccuuuacuuga

SEQ ID NO: 1466630 - RNA, 14 nt, Homo sapiens
agacugggacaccu

SEQ ID NO: 1466631 - RNA, 20 nt, Homo sapiens
agacuguggcuagugacaaa

SEQ ID NO: 1466632 - RNA, 19 nt, Homo sapiens
agacuguugaguuaugaua

SEQ ID NO: 1466633 - RNA, 17 nt, Homo sapiens
agacuguugccacuuaa

SEQ ID NO: 1466634 - RNA, 19 nt, Homo sapiens
agacuguugugaucuugca

SEQ ID NO: 1466635 - RNA, 23 nt, Homo sapiens
agacuguugugaucuugcauuca

SEQ ID NO: 1466636 - RNA, 17 nt, Homo sapiens
agacuuauguauuagcu

SEQ ID NO: 1466637 - RNA, 14 nt, Homo sapiens
agacuuuacaugga

SEQ ID NO: 1466638 - RNA, 15 nt, Homo sapiens
agacuuucucugugu

SEQ ID NO: 1466639 - RNA, 16 nt, Homo sapiens
agagaaacuuuauaca

SEQ ID NO: 1466640 - RNA, 17 nt, Homo sapiens
agagaaauuucucauca

SEQ ID NO: 1466641 - RNA, 17 nt, Homo sapiens
agagaaccgagcaaaga

SEQ ID NO: 1466642 - RNA, 20 nt, Homo sapiens
agagaagcggauuuccaggg

SEQ ID NO: 1466643 - RNA, 14 nt, Homo sapiens
agagaaugaugaua

SEQ ID NO: 1466644 - RNA, 22 nt, Homo sapiens
agagaauuguaucauuugaaca

SEQ ID NO: 1466645 - RNA, 13 nt, Homo sapiens
agagacacuccaa

SEQ ID NO: 1466646 - RNA, 21 nt, Homo sapiens
agagacagaggcgcccugggu

SEQ ID NO: 1466647 - RNA, 19 nt, Homo sapiens
agagacagauaacucuccu

SEQ ID NO: 1466648 - RNA, 14 nt, Homo sapiens
agagacuccgucuc

SEQ ID NO: 1466649 - RNA, 12 nt, Homo sapiens
agagagaacuuu

SEQ ID NO: 1466650 - RNA, 14 nt, Homo sapiens
agagagagaacuuu

SEQ ID NO: 1466651 - RNA, 16 nt, Homo sapiens
agagagauauaucuga

SEQ ID NO: 1466652 - RNA, 17 nt, Homo sapiens
agagagauauaucugaa

SEQ ID NO: 1466653 - RNA, 13 nt, Homo sapiens
agagagccuggug

SEQ ID NO: 1466654 - RNA, 19 nt, Homo sapiens
agagagccuggugcugcug

SEQ ID NO: 1466655 - RNA, 16 nt, Homo sapiens
agagagucgcaucuca

SEQ ID NO: 1466656 - RNA, 15 nt, Homo sapiens
agagauauaucugaa

SEQ ID NO: 1466657 - RNA, 15 nt, Homo sapiens
agagaugacagggaa

SEQ ID NO: 1466658 - RNA, 17 nt, Homo sapiens
agagaugggacuaggac

SEQ ID NO: 1466659 - RNA, 19 nt, Homo sapiens
agagauuacuuugcugccu

SEQ ID NO: 1466660 - RNA, 14 nt, Homo sapiens
agagauucauuauu

SEQ ID NO: 1466661 - RNA, 14 nt, Homo sapiens
agagcaaccucuca

SEQ ID NO: 1466662 - RNA, 21 nt, Homo sapiens
agagcaacucugagaucuaag

SEQ ID NO: 1466663 - RNA, 19 nt, Homo sapiens
agagcaagacuccaucuca

SEQ ID NO: 1466664 - RNA, 20 nt, Homo sapiens
agagcaagacuccaucucaa

SEQ ID NO: 1466665 - RNA, 19 nt, Homo sapiens
agagcaagacucugucuca

SEQ ID NO: 1466666 - RNA, 16 nt, Homo sapiens
agagcacaccuaucuu

SEQ ID NO: 1466667 - RNA, 15 nt, Homo sapiens
agagcagagguggaa

SEQ ID NO: 1466668 - RNA, 17 nt, Homo sapiens
agagcaggaagcauuca

SEQ ID NO: 1466669 - RNA, 13 nt, Homo sapiens
agagcagggauua

SEQ ID NO: 1466670 - RNA, 22 nt, Homo sapiens
agagcauuuccaacaccacaga

SEQ ID NO: 1466671 - RNA, 21 nt, Homo sapiens
agagccaauguuuuccaccca

SEQ ID NO: 1466672 - RNA, 14 nt, Homo sapiens
agagcccaugcuca

SEQ ID NO: 1466673 - RNA, 15 nt, Homo sapiens
agagcccccuugaca

SEQ ID NO: 1466674 - RNA, 18 nt, Homo sapiens
agagccccuacagcauug

SEQ ID NO: 1466675 - RNA, 21 nt, Homo sapiens
agagcccggcgccccugccac

SEQ ID NO: 1466676 - RNA, 21 nt, Homo sapiens
agagccuucugaugucucuaa

SEQ ID NO: 1466677 - RNA, 19 nt, Homo sapiens
agagcgagacuccgucuca

SEQ ID NO: 1466678 - RNA, 20 nt, Homo sapiens
agagcgagacuccgucucaa

SEQ ID NO: 1466679 - RNA, 20 nt, Homo sapiens
agagcuauugccaaccaguu

SEQ ID NO: 1466680 - RNA, 17 nt, Homo sapiens
agcuucuucacaggcac

SEQ ID NO: 1466681 - RNA, 17 nt, Homo sapiens
agcuucuuccuaggucc

SEQ ID NO: 1466682 - RNA, 22 nt, Homo sapiens
agcuugacucccaaguuuccau

SEQ ID NO: 1466683 - RNA, 13 nt, Homo sapiens
agcuugcagugag

SEQ ID NO: 1466684 - RNA, 14 nt, Homo sapiens
agcuuggagggaug

SEQ ID NO: 1466685 - RNA, 15 nt, Homo sapiens
agcuuggagggaugg

SEQ ID NO: 1466686 - RNA, 15 nt, Homo sapiens
agcuugucacuggaa

SEQ ID NO: 1466687 - RNA, 17 nt, Homo sapiens
agcuuuaaacucaggga

SEQ ID NO: 1466688 - RNA, 21 nt, Homo sapiens
agcuuuaaacucagggacaga

SEQ ID NO: 1466689 - RNA, 14 nt, Homo sapiens
agcuuuauucuuca

SEQ ID NO: 1466690 - RNA, 19 nt, Homo sapiens
agcuuucuucuacaaccag

SEQ ID NO: 1466691 - RNA, 21 nt, Homo sapiens
agcuuucuucuacaaccagag

SEQ ID NO: 1466692 - RNA, 18 nt, Homo sapiens
agcuuuuuacucaaagag

SEQ ID NO: 1466693 - RNA, 18 nt, Homo sapiens
aggaaaaaaagcaaaaag

SEQ ID NO: 1466694 - RNA, 17 nt, Homo sapiens
aggaaaauaaacugaca

SEQ ID NO: 1466695 - RNA, 19 nt, Homo sapiens
aggaaacccccaguguaau

SEQ ID NO: 1466696 - RNA, 16 nt, Homo sapiens
aggaaacgcuaccucu

SEQ ID NO: 1466697 - RNA, 21 nt, Homo sapiens
aggaaacuccacaucugccuu

SEQ ID NO: 1466698 - RNA, 16 nt, Homo sapiens
aggaaacuucaguuga

SEQ ID NO: 1466699 - RNA, 22 nt, Homo sapiens
aggaaagagcuccaaauugaau

SEQ ID NO: 1466700 - RNA, 15 nt, Homo sapiens
aggaaagauuuuguu

SEQ ID NO: 1466701 - RNA, 14 nt, Homo sapiens
aggaaagcccuccc

SEQ ID NO: 1466702 - RNA, 21 nt, Homo sapiens
aggaaagccucacugauauau

SEQ ID NO: 1466703 - RNA, 18 nt, Homo sapiens
aggaacaaauaaacucau

SEQ ID NO: 1466704 - RNA, 12 nt, Homo sapiens
aggaacacugca

SEQ ID NO: 1466705 - RNA, 14 nt, Homo sapiens
aggaacauggagcu

SEQ ID NO: 1466706 - RNA, 13 nt, Homo sapiens
aggaacauuccuu

SEQ ID NO: 1466707 - RNA, 18 nt, Homo sapiens
aggaaccagagugcugaa

SEQ ID NO: 1466708 - RNA, 18 nt, Homo sapiens
aggaagaaaagcugccau

SEQ ID NO: 1466709 - RNA, 16 nt, Homo sapiens
aggaagagcaggacuc

SEQ ID NO: 1466710 - RNA, 14 nt, Homo sapiens
aggaagcacugaaa

SEQ ID NO: 1466711 - RNA, 22 nt, Homo sapiens
aggaagcuccacugucacccuc

SEQ ID NO: 1466712 - RNA, 14 nt, Homo sapiens
aggaagcuugucac

SEQ ID NO: 1466713 - RNA, 17 nt, Homo sapiens
aggaaggcuucuguguc

SEQ ID NO: 1466714 - RNA, 21 nt, Homo sapiens
aggaaggcuucugugucaaug

SEQ ID NO: 1466715 - RNA, 20 nt, Homo sapiens
aggaagguagcccagcacug

SEQ ID NO: 1466716 - RNA, 22 nt, Homo sapiens
aggaagucauccagucuauuca

SEQ ID NO: 1466717 - RNA, 13 nt, Homo sapiens
aggaaucauguca

SEQ ID NO: 1466718 - RNA, 21 nt, Homo sapiens
aggaaucauuccagugcuaga

SEQ ID NO: 1466719 - RNA, 15 nt, Homo sapiens
aggaaucugugcaga

SEQ ID NO: 1466720 - RNA, 21 nt, Homo sapiens
aggaauucguaaucaucccca

SEQ ID NO: 1466721 - RNA, 13 nt, Homo sapiens
aggaauucugcaa

SEQ ID NO: 1466722 - RNA, 17 nt, Homo sapiens
aggaauuugcauuuagu

SEQ ID NO: 1466723 - RNA, 22 nt, Homo sapiens
aggacaccuuuuaacucaccuc

SEQ ID NO: 1466724 - RNA, 21 nt, Homo sapiens
aggacacuagaagauuuugaa

SEQ ID NO: 1466725 - RNA, 15 nt, Homo sapiens
aggacauacugcaug

SEQ ID NO: 1466726 - RNA, 19 nt, Homo sapiens
aggaccaagggcaccugga

SEQ ID NO: 1466727 - RNA, 21 nt, Homo sapiens
aggacccugaaggggccauga

SEQ ID NO: 1466728 - RNA, 21 nt, Homo sapiens
aggaccucccucccccuggca

SEQ ID NO: 1466729 - RNA, 19 nt, Homo sapiens
auagugaauggucucucuu

SEQ ID NO: 1466730 - RNA, 19 nt, Homo sapiens
auaguuauauaauucacuc

SEQ ID NO: 1466731 - RNA, 18 nt, Homo sapiens
auaguuaugugauuuucc

SEQ ID NO: 1466732 - RNA, 18 nt, Homo sapiens
auaguuggucaucuagca

SEQ ID NO: 1466733 - RNA, 18 nt, Homo sapiens
auauaaaguacaucucua

SEQ ID NO: 1466734 - RNA, 13 nt, Homo sapiens
auauaaaugggaa

SEQ ID NO: 1466735 - RNA, 16 nt, Homo sapiens
auauaagcugccauau

SEQ ID NO: 1466736 - RNA, 17 nt, Homo sapiens
auauacauaauacauga

SEQ ID NO: 1466737 - RNA, 12 nt, Homo sapiens
auauaccaucuc

SEQ ID NO: 1466738 - RNA, 21 nt, Homo sapiens
auauaccuggcuuuuacuuua

SEQ ID NO: 1466739 - RNA, 19 nt, Homo sapiens
auauaccuuuuugugucaa

SEQ ID NO: 1466740 - RNA, 22 nt, Homo sapiens
auauagagggcuuaugauucag

SEQ ID NO: 1466741 - RNA, 19 nt, Homo sapiens
auauagggaucaaccagcu

SEQ ID NO: 1466742 - RNA, 16 nt, Homo sapiens
auauaguuauugcaca

SEQ ID NO: 1466743 - RNA, 15 nt, Homo sapiens
auauauacuaaacaa

SEQ ID NO: 1466744 - RNA, 16 nt, Homo sapiens
auauaugcacuaugua

SEQ ID NO: 1466745 - RNA, 17 nt, Homo sapiens
auauaugcacuauguau

SEQ ID NO: 1466746 - RNA, 19 nt, Homo sapiens
auauauuccgcacucaagg

SEQ ID NO: 1466747 - RNA, 13 nt, Homo sapiens
auauauuuauuga

SEQ ID NO: 1466748 - RNA, 22 nt, Homo sapiens
auauauuuauuuaagcuuaugu

SEQ ID NO: 1466749 - RNA, 13 nt, Homo sapiens
auauauuucacuu

SEQ ID NO: 1466750 - RNA, 13 nt, Homo sapiens
auauauuuuuaga

SEQ ID NO: 1466751 - RNA, 23 nt, Homo sapiens
auauauuuuugguugucaauauu

SEQ ID NO: 1466752 - RNA, 14 nt, Homo sapiens
auaucaaucaagcc

SEQ ID NO: 1466753 - RNA, 19 nt, Homo sapiens
auaucacauuggagucacu

SEQ ID NO: 1466754 - RNA, 14 nt, Homo sapiens
auaucaugcaaaau

SEQ ID NO: 1466755 - RNA, 23 nt, Homo sapiens
auaucaugccccuguacuccagc

SEQ ID NO: 1466756 - RNA, 18 nt, Homo sapiens
auaucccaagugcacuuu

SEQ ID NO: 1466757 - RNA, 13 nt, Homo sapiens
auaucgaucucuu

SEQ ID NO: 1466758 - RNA, 14 nt, Homo sapiens
auaucgaucucuua

SEQ ID NO: 1466759 - RNA, 13 nt, Homo sapiens
auaucuaaaaacu

SEQ ID NO: 1466760 - RNA, 20 nt, Homo sapiens
auaucugaagagcuauuaua

SEQ ID NO: 1466761 - RNA, 21 nt, Homo sapiens
auaucugaauggaagaguguu

SEQ ID NO: 1466762 - RNA, 18 nt, Homo sapiens
auaucuggguuaaguguu

SEQ ID NO: 1466763 - RNA, 16 nt, Homo sapiens
auaucuugcuuucaaa

SEQ ID NO: 1466764 - RNA, 16 nt, Homo sapiens
auaucuuuauuaauca

SEQ ID NO: 1466765 - RNA, 19 nt, Homo sapiens
auaugaaauuccagcaaua

SEQ ID NO: 1466766 - RNA, 15 nt, Homo sapiens
auaugaaggauuacu

SEQ ID NO: 1466767 - RNA, 17 nt, Homo sapiens
auaugaagugaaaaaag

SEQ ID NO: 1466768 - RNA, 22 nt, Homo sapiens
auaugagcuuccuucugugaaa

SEQ ID NO: 1466769 - RNA, 18 nt, Homo sapiens
auaugaguaauacaucaa

SEQ ID NO: 1466770 - RNA, 16 nt, Homo sapiens
auaugauauguaaaca

SEQ ID NO: 1466771 - RNA, 22 nt, Homo sapiens
auaugcagcugugauacuugua

SEQ ID NO: 1466772 - RNA, 14 nt, Homo sapiens
auaugcugccaaau

SEQ ID NO: 1466773 - RNA, 19 nt, Homo sapiens
auaugcuggagauggacaa

SEQ ID NO: 1466774 - RNA, 20 nt, Homo sapiens
auaugcuuauacacuuacac

SEQ ID NO: 1466775 - RNA, 20 nt, Homo sapiens
auaugcuuggcuaacuauau

SEQ ID NO: 1466776 - RNA, 23 nt, Homo sapiens
auauggaugauucagaaauugga

SEQ ID NO: 1466777 - RNA, 13 nt, Homo sapiens
auauggcugccca

SEQ ID NO: 1466778 - RNA, 16 nt, Homo sapiens
auaugggaaagacaug

SEQ ID NO: 1466779 - RNA, 20 nt, Homo sapiens
auauggggaaaaaacugugc

SEQ ID NO: 1466780 - RNA, 21 nt, Homo sapiens
aucccauggccaggugguugu

SEQ ID NO: 1466781 - RNA, 23 nt, Homo sapiens
auccccacagcuggcucugacaa

SEQ ID NO: 1466782 - RNA, 14 nt, Homo sapiens
auccccacccaguc

SEQ ID NO: 1466783 - RNA, 16 nt, Homo sapiens
auccccauccuccaga

SEQ ID NO: 1466784 - RNA, 15 nt, Homo sapiens
aucccccagccucaa

SEQ ID NO: 1466785 - RNA, 19 nt, Homo sapiens
aucccccagccucaagucu

SEQ ID NO: 1466786 - RNA, 21 nt, Homo sapiens
aucccccgccuuuaguucucc

SEQ ID NO: 1466787 - RNA, 21 nt, Homo sapiens
auccccguuccugacaucaca

SEQ ID NO: 1466788 - RNA, 16 nt, Homo sapiens
auccccuggacuggga

SEQ ID NO: 1466789 - RNA, 22 nt, Homo sapiens
aucccgccucuucuucuucaga

SEQ ID NO: 1466790 - RNA, 14 nt, Homo sapiens
aucccuacauguau

SEQ ID NO: 1466791 - RNA, 20 nt, Homo sapiens
aucccuacauguauugcaca

SEQ ID NO: 1466792 - RNA, 15 nt, Homo sapiens
aucccucaccuguag

SEQ ID NO: 1466793 - RNA, 15 nt, Homo sapiens
aucccuggaaggaca

SEQ ID NO: 1466794 - RNA, 19 nt, Homo sapiens
aucccuguaauauuuagcu

SEQ ID NO: 1466795 - RNA, 17 nt, Homo sapiens
auccgcugccagccuug

SEQ ID NO: 1466796 - RNA, 13 nt, Homo sapiens
auccguacauuca

SEQ ID NO: 1466797 - RNA, 22 nt, Homo sapiens
auccuaaauaaaaaaagacaaa

SEQ ID NO: 1466798 - RNA, 19 nt, Homo sapiens
auccuauuaaaacacagcu

SEQ ID NO: 1466799 - RNA, 13 nt, Homo sapiens
auccucacugcug

SEQ ID NO: 1466800 - RNA, 16 nt, Homo sapiens
auccucccaccucagc

SEQ ID NO: 1466801 - RNA, 23 nt, Homo sapiens
auccugaauuccagcaaaagagc

SEQ ID NO: 1466802 - RNA, 16 nt, Homo sapiens
auccugccauccucaa

SEQ ID NO: 1466803 - RNA, 14 nt, Homo sapiens
auccugcccagugu

SEQ ID NO: 1466804 - RNA, 17 nt, Homo sapiens
auccuggaccaagcaca

SEQ ID NO: 1466805 - RNA, 22 nt, Homo sapiens
auccuggguacugaaagccuua

SEQ ID NO: 1466806 - RNA, 15 nt, Homo sapiens
auccuguuaagagau

SEQ ID NO: 1466807 - RNA, 19 nt, Homo sapiens
auccuuaacacauucaaua

SEQ ID NO: 1466808 - RNA, 20 nt, Homo sapiens
auccuuaacacauucaauag

SEQ ID NO: 1466809 - RNA, 14 nt, Homo sapiens
auccuuccaaagaa

SEQ ID NO: 1466810 - RNA, 13 nt, Homo sapiens
auccuuccaucca

SEQ ID NO: 1466811 - RNA, 22 nt, Homo sapiens
auccuucuccaccaaagacagu

SEQ ID NO: 1466812 - RNA, 19 nt, Homo sapiens
auccuucuggcuguagaua

SEQ ID NO: 1466813 - RNA, 20 nt, Homo sapiens
auccuuuagguaagaaguuu

SEQ ID NO: 1466814 - RNA, 19 nt, Homo sapiens
auccuuuagugcacccagu

SEQ ID NO: 1466815 - RNA, 21 nt, Homo sapiens
auccuuuagugcacccaguga

SEQ ID NO: 1466816 - RNA, 13 nt, Homo sapiens
aucgaacuucaca

SEQ ID NO: 1466817 - RNA, 12 nt, Homo sapiens
aucgaagcagau

SEQ ID NO: 1466818 - RNA, 21 nt, Homo sapiens
aucgcaccauugcacuccagc

SEQ ID NO: 1466819 - RNA, 18 nt, Homo sapiens
aucgcucauagaucagca

SEQ ID NO: 1466820 - RNA, 16 nt, Homo sapiens
aucggccuccaugacc

SEQ ID NO: 1466821 - RNA, 19 nt, Homo sapiens
aucggguaagaugcuccug

SEQ ID NO: 1466822 - RNA, 19 nt, Homo sapiens
aucgugaaaccccaucucu

SEQ ID NO: 1466823 - RNA, 12 nt, Homo sapiens
aucgugcuaaau

SEQ ID NO: 1466824 - RNA, 18 nt, Homo sapiens
aucgugggccgcacuggg

SEQ ID NO: 1466825 - RNA, 14 nt, Homo sapiens
aucguuuugcccga

SEQ ID NO: 1466826 - RNA, 16 nt, Homo sapiens
aucuaauauauaugaa

SEQ ID NO: 1466827 - RNA, 16 nt, Homo sapiens
aucuaaugugaaguag

SEQ ID NO: 1466828 - RNA, 21 nt, Homo sapiens
aucuacaagauccuccugcug

SEQ ID NO: 1466829 - RNA, 18 nt, Homo sapiens
aucuacacccaccagagu

SEQ ID NO: 1466830 - RNA, 13 nt, Homo sapiens
aucuacccugcug

SEQ ID NO: 1466831 - RNA, 14 nt, Homo sapiens
aucuucacuuuuau

SEQ ID NO: 1466832 - RNA, 17 nt, Homo sapiens
aucuuccaaaugcaauu

SEQ ID NO: 1466833 - RNA, 23 nt, Homo sapiens
aucuucccuuuauuacaagaagg

SEQ ID NO: 1466834 - RNA, 22 nt, Homo sapiens
aucuucuaaacccaauccaaau

SEQ ID NO: 1466835 - RNA, 18 nt, Homo sapiens
aucuucucuuugacaauu

SEQ ID NO: 1466836 - RNA, 22 nt, Homo sapiens
aucuucuuuauaauucuacuuu

SEQ ID NO: 1466837 - RNA, 19 nt, Homo sapiens
aucuugaucaaccaaaaac

SEQ ID NO: 1466838 - RNA, 14 nt, Homo sapiens
aucuugcaccccaa

SEQ ID NO: 1466839 - RNA, 11 nt, Homo sapiens
aucuugcugac

SEQ ID NO: 1466840 - RNA, 13 nt, Homo sapiens
aucuugcuggcua

SEQ ID NO: 1466841 - RNA, 15 nt, Homo sapiens
aucuuggaaguacau

SEQ ID NO: 1466842 - RNA, 19 nt, Homo sapiens
aucuuggacugacauuuag

SEQ ID NO: 1466843 - RNA, 18 nt, Homo sapiens
aucuuggagaaugugaga

SEQ ID NO: 1466844 - RNA, 18 nt, Homo sapiens
aucuuggagggaccaagg

SEQ ID NO: 1466845 - RNA, 17 nt, Homo sapiens
aucuugucuaacauucc

SEQ ID NO: 1466846 - RNA, 17 nt, Homo sapiens
aucuuuagagaaguaua

SEQ ID NO: 1466847 - RNA, 23 nt, Homo sapiens
aucuuucaaaagccuuaccuuga

SEQ ID NO: 1466848 - RNA, 21 nt, Homo sapiens
aucuuucaaagugucuugaau

SEQ ID NO: 1466849 - RNA, 19 nt, Homo sapiens
aucuuuuuaccuuucauac

SEQ ID NO: 1466850 - RNA, 22 nt, Homo sapiens
augaaaacauagcaucucagga

SEQ ID NO: 1466851 - RNA, 21 nt, Homo sapiens
augaaaauuuauuuuuaguga

SEQ ID NO: 1466852 - RNA, 17 nt, Homo sapiens
augaaacugcacauugg

SEQ ID NO: 1466853 - RNA, 20 nt, Homo sapiens
augaaacuguccaccaagau

SEQ ID NO: 1466854 - RNA, 14 nt, Homo sapiens
augaaagugacuuu

SEQ ID NO: 1466855 - RNA, 16 nt, Homo sapiens
augaaaguggacaagg

SEQ ID NO: 1466856 - RNA, 14 nt, Homo sapiens
augaaaguuuugca

SEQ ID NO: 1466857 - RNA, 19 nt, Homo sapiens
augaaaucugcuagaaagu

SEQ ID NO: 1466858 - RNA, 16 nt, Homo sapiens
augaaauuauuuguca

SEQ ID NO: 1466859 - RNA, 16 nt, Homo sapiens
augaaauugcugaaag

SEQ ID NO: 1466860 - RNA, 20 nt, Homo sapiens
augaacacuuauaagugaag

SEQ ID NO: 1466861 - RNA, 13 nt, Homo sapiens
augaacagcauua

SEQ ID NO: 1466862 - RNA, 16 nt, Homo sapiens
augaacaugcaguuca

SEQ ID NO: 1466863 - RNA, 22 nt, Homo sapiens
augaacuaacugacagcuucau

SEQ ID NO: 1466864 - RNA, 14 nt, Homo sapiens
augaagacauuucu

SEQ ID NO: 1466865 - RNA, 20 nt, Homo sapiens
augaagacauuucugcucuc

SEQ ID NO: 1466866 - RNA, 13 nt, Homo sapiens
augaaggaaucau

SEQ ID NO: 1466867 - RNA, 20 nt, Homo sapiens
augaaggauuacucuccaua

SEQ ID NO: 1466868 - RNA, 16 nt, Homo sapiens
augaaggcagagccau

SEQ ID NO: 1466869 - RNA, 21 nt, Homo sapiens
augaagguggaacaagcacag

SEQ ID NO: 1466870 - RNA, 17 nt, Homo sapiens
augaauaaacugaauau

SEQ ID NO: 1466871 - RNA, 13 nt, Homo sapiens
augaauacaaauu

SEQ ID NO: 1466872 - RNA, 21 nt, Homo sapiens
augaauauauuuaagcaacau

SEQ ID NO: 1466873 - RNA, 18 nt, Homo sapiens
augaaucucguucccaaa

SEQ ID NO: 1466874 - RNA, 21 nt, Homo sapiens
augaaucuucacaaaacacuu

SEQ ID NO: 1466875 - RNA, 19 nt, Homo sapiens
augaaugaggucccaggca

SEQ ID NO: 1466876 - RNA, 15 nt, Homo sapiens
augaaugugccuuga

SEQ ID NO: 1466877 - RNA, 19 nt, Homo sapiens
augaauugcauuuuacuuu

SEQ ID NO: 1466878 - RNA, 19 nt, Homo sapiens
augacaaccuccauucuau

SEQ ID NO: 1466879 - RNA, 12 nt, Homo sapiens
augacacugagc

SEQ ID NO: 1466880 - RNA, 21 nt, Homo sapiens
augacaguauuauacgcuggc

SEQ ID NO: 1466881 - RNA, 15 nt, Homo sapiens
augacauaagugcua

SEQ ID NO: 1466882 - RNA, 14 nt, Homo sapiens
ccuccaacacaagg

SEQ ID NO: 1466883 - RNA, 13 nt, Homo sapiens
ccuccaaccagga

SEQ ID NO: 1466884 - RNA, 17 nt, Homo sapiens
ccuccaccacaucugcc

SEQ ID NO: 1466885 - RNA, 13 nt, Homo sapiens
ccuccaccugaua

SEQ ID NO: 1466886 - RNA, 19 nt, Homo sapiens
ccuccacuccagcucugag

SEQ ID NO: 1466887 - RNA, 20 nt, Homo sapiens
ccuccacuccagcucugaga

SEQ ID NO: 1466888 - RNA, 18 nt, Homo sapiens
ccuccagagaaacccagg

SEQ ID NO: 1466889 - RNA, 15 nt, Homo sapiens
ccuccagaggaugac

SEQ ID NO: 1466890 - RNA, 21 nt, Homo sapiens
ccuccaggaagaagcaggggg

SEQ ID NO: 1466891 - RNA, 13 nt, Homo sapiens
ccuccccaguuca

SEQ ID NO: 1466892 - RNA, 18 nt, Homo sapiens
ccuccccgugccaaaaau

SEQ ID NO: 1466893 - RNA, 20 nt, Homo sapiens
ccucccggguucgcaccauu

SEQ ID NO: 1466894 - RNA, 17 nt, Homo sapiens
ccucccuuggguucuga

SEQ ID NO: 1466895 - RNA, 17 nt, Homo sapiens
ccuccuccccuagggaa

SEQ ID NO: 1466896 - RNA, 21 nt, Homo sapiens
ccuccucucaguguuuuggac

SEQ ID NO: 1466897 - RNA, 20 nt, Homo sapiens
ccuccucugccuacagccag

SEQ ID NO: 1466898 - RNA, 22 nt, Homo sapiens
ccuccuguaaaugguguacaua

SEQ ID NO: 1466899 - RNA, 19 nt, Homo sapiens
ccuccuuauauuuggccca

SEQ ID NO: 1466900 - RNA, 19 nt, Homo sapiens
ccucggccucccaaagugc

SEQ ID NO: 1466901 - RNA, 13 nt, Homo sapiens
ccucgggaagcag

SEQ ID NO: 1466902 - RNA, 13 nt, Homo sapiens
ccucgggacauca

SEQ ID NO: 1466903 - RNA, 19 nt, Homo sapiens
ccucgggccccauccucau

SEQ ID NO: 1466904 - RNA, 21 nt, Homo sapiens
ccucgggccgaggcccagcgg

SEQ ID NO: 1466905 - RNA, 14 nt, Homo sapiens
ccucggucacucca

SEQ ID NO: 1466906 - RNA, 13 nt, Homo sapiens
ccucuaagguugg

SEQ ID NO: 1466907 - RNA, 15 nt, Homo sapiens
ccucuagaagccaag

SEQ ID NO: 1466908 - RNA, 14 nt, Homo sapiens
ccucuagaggcaag

SEQ ID NO: 1466909 - RNA, 15 nt, Homo sapiens
ccucuaggaggagcu

SEQ ID NO: 1466910 - RNA, 16 nt, Homo sapiens
ccucuccaguuugcac

SEQ ID NO: 1466911 - RNA, 21 nt, Homo sapiens
ccucucucucccaggucccag

SEQ ID NO: 1466912 - RNA, 19 nt, Homo sapiens
ccucucucuucugcuccac

SEQ ID NO: 1466913 - RNA, 23 nt, Homo sapiens
ccucucugcagacuucccagcua

SEQ ID NO: 1466914 - RNA, 16 nt, Homo sapiens
ccucucuuaaaugcaa

SEQ ID NO: 1466915 - RNA, 14 nt, Homo sapiens
ccucugagcccagc

SEQ ID NO: 1466916 - RNA, 19 nt, Homo sapiens
ccucugauacccagagcau

SEQ ID NO: 1466917 - RNA, 20 nt, Homo sapiens
ccucugccuuguccugaugc

SEQ ID NO: 1466918 - RNA, 21 nt, Homo sapiens
ccucugcuacuccauccugaa

SEQ ID NO: 1466919 - RNA, 16 nt, Homo sapiens
ccucugcuauuugcug

SEQ ID NO: 1466920 - RNA, 13 nt, Homo sapiens
ccucuggacaaag

SEQ ID NO: 1466921 - RNA, 13 nt, Homo sapiens
ccucuggcucuca

SEQ ID NO: 1466922 - RNA, 19 nt, Homo sapiens
ccucugucaacaucaaaga

SEQ ID NO: 1466923 - RNA, 20 nt, Homo sapiens
ccucugucagucacagccac

SEQ ID NO: 1466924 - RNA, 21 nt, Homo sapiens
ccucugucggcuuuuugccau

SEQ ID NO: 1466925 - RNA, 22 nt, Homo sapiens
ccucuuccccagaaaggagacu

SEQ ID NO: 1466926 - RNA, 16 nt, Homo sapiens
ccucuuucacauugaa

SEQ ID NO: 1466927 - RNA, 17 nt, Homo sapiens
ccucuuuuuagggcuaa

SEQ ID NO: 1466928 - RNA, 18 nt, Homo sapiens
ccugaaacagccaugucc

SEQ ID NO: 1466929 - RNA, 13 nt, Homo sapiens
ccugaacuugccu

SEQ ID NO: 1466930 - RNA, 12 nt, Homo sapiens
ccugaagaacca

SEQ ID NO: 1466931 - RNA, 18 nt, Homo sapiens
ccugaaggaaaaugacuc

SEQ ID NO: 1466932 - RNA, 20 nt, Homo sapiens
ccugaagggggacacuccau

SEQ ID NO: 1466933 - RNA, 14 nt, Homo sapiens
ccugaauccauuaa

SEQ ID NO: 1466934 - RNA, 22 nt, Homo sapiens
ccugaauucuuuuucauuugag

SEQ ID NO: 1466935 - RNA, 18 nt, Homo sapiens
ccugacagaaggacucag

SEQ ID NO: 1466936 - RNA, 15 nt, Homo sapiens
ccugacagaugucag

SEQ ID NO: 1466937 - RNA, 12 nt, Homo sapiens
ccugaccccagu

SEQ ID NO: 1466938 - RNA, 18 nt, Homo sapiens
ccugaccccauuccugau

SEQ ID NO: 1466939 - RNA, 12 nt, Homo sapiens
ccugaccucacu

SEQ ID NO: 1466940 - RNA, 16 nt, Homo sapiens
ccugaccucacuguga

SEQ ID NO: 1466941 - RNA, 19 nt, Homo sapiens
ccugaccugucaccgugag

SEQ ID NO: 1466942 - RNA, 17 nt, Homo sapiens
ccugacgcugcaugaga

SEQ ID NO: 1466943 - RNA, 18 nt, Homo sapiens
ccugacuccuccaaggaa

SEQ ID NO: 1466944 - RNA, 19 nt, Homo sapiens
ccugagauucagaugucau

SEQ ID NO: 1466945 - RNA, 15 nt, Homo sapiens
ccugaggguccccac

SEQ ID NO: 1466946 - RNA, 16 nt, Homo sapiens
ccugaggucagggagu

SEQ ID NO: 1466947 - RNA, 20 nt, Homo sapiens
ccugaguucauccaggccca

SEQ ID NO: 1466948 - RNA, 19 nt, Homo sapiens
ccugauacaggcauggcag

SEQ ID NO: 1466949 - RNA, 21 nt, Homo sapiens
ccugauauucaggcuacucau

SEQ ID NO: 1466950 - RNA, 19 nt, Homo sapiens
ccugaucgccaaccuuucc

SEQ ID NO: 1466951 - RNA, 18 nt, Homo sapiens
ccugaugaaaacauagca

SEQ ID NO: 1466952 - RNA, 13 nt, Homo sapiens
ccugcacacucca

SEQ ID NO: 1466953 - RNA, 17 nt, Homo sapiens
ccugcaccccugcaguu

SEQ ID NO: 1466954 - RNA, 18 nt, Homo sapiens
ccugcaccccugcaguuu

SEQ ID NO: 1466955 - RNA, 16 nt, Homo sapiens
ccugcacuaaagccag

SEQ ID NO: 1466956 - RNA, 21 nt, Homo sapiens
ccugcacuguccugaccaucg

SEQ ID NO: 1466957 - RNA, 15 nt, Homo sapiens
ccugcagaagcagaa

SEQ ID NO: 1466958 - RNA, 19 nt, Homo sapiens
ccugcagaccucaagccau

SEQ ID NO: 1466959 - RNA, 11 nt, Homo sapiens
ccugcauguac

SEQ ID NO: 1466960 - RNA, 22 nt, Homo sapiens
ccugccccaaacaaauaugcaa

SEQ ID NO: 1466961 - RNA, 16 nt, Homo sapiens
ccugccccacacuccc

SEQ ID NO: 1466962 - RNA, 20 nt, Homo sapiens
ccugccccagacagacuuca

SEQ ID NO: 1466963 - RNA, 18 nt, Homo sapiens
ccugccccccucaucuca

SEQ ID NO: 1466964 - RNA, 19 nt, Homo sapiens
ccugcccccgcucccgcuc

SEQ ID NO: 1466965 - RNA, 17 nt, Homo sapiens
ccugccccucucccgcc

SEQ ID NO: 1466966 - RNA, 23 nt, Homo sapiens
ccugccuggcacuuacugguccu

SEQ ID NO: 1466967 - RNA, 20 nt, Homo sapiens
ccugccuguagcagugagaa

SEQ ID NO: 1466968 - RNA, 18 nt, Homo sapiens
ccugccuuuucauugccc

SEQ ID NO: 1466969 - RNA, 16 nt, Homo sapiens
ccugcgagacgcacac

SEQ ID NO: 1466970 - RNA, 22 nt, Homo sapiens
ccugcucacaaaaucacuuuaa

SEQ ID NO: 1466971 - RNA, 20 nt, Homo sapiens
ccugcuccuccaggaauucc

SEQ ID NO: 1466972 - RNA, 15 nt, Homo sapiens
ccugcuccugcagca

SEQ ID NO: 1466973 - RNA, 20 nt, Homo sapiens
ccugcugacaauuucccaca

SEQ ID NO: 1466974 - RNA, 18 nt, Homo sapiens
ccugcugcccaaucucca

SEQ ID NO: 1466975 - RNA, 19 nt, Homo sapiens
ccugcuggugagaggugca

SEQ ID NO: 1466976 - RNA, 21 nt, Homo sapiens
ccuggacacgcugguggugcu

SEQ ID NO: 1466977 - RNA, 18 nt, Homo sapiens
ccuggagaugcugccugg

SEQ ID NO: 1466978 - RNA, 17 nt, Homo sapiens
ccuggaggcggcaaagg

SEQ ID NO: 1466979 - RNA, 14 nt, Homo sapiens
ccuggagugcaguu

SEQ ID NO: 1466980 - RNA, 18 nt, Homo sapiens
ccuggaucccugcccuuc

SEQ ID NO: 1466981 - RNA, 16 nt, Homo sapiens
ccuggaucuaccagca

SEQ ID NO: 1466982 - RNA, 20 nt, Homo sapiens
ccuggcaaaaaugcaacaaa

SEQ ID NO: 1466983 - RNA, 18 nt, Homo sapiens
ccuggcaagugggugaaa

SEQ ID NO: 1466984 - RNA, 15 nt, Homo sapiens
ccuggcaggccagug

SEQ ID NO: 1466985 - RNA, 20 nt, Homo sapiens
ccuggccaacaugaugaaac

SEQ ID NO: 1466986 - RNA, 21 nt, Homo sapiens
ccuggccaccagccauccucc

SEQ ID NO: 1466987 - RNA, 13 nt, Homo sapiens
ccuggccagacac

SEQ ID NO: 1466988 - RNA, 18 nt, Homo sapiens
ccuggcccagaugauaua

SEQ ID NO: 1466989 - RNA, 18 nt, Homo sapiens
ccuggcccccaaccucag

SEQ ID NO: 1466990 - RNA, 16 nt, Homo sapiens
ccuggcugaugaucca

SEQ ID NO: 1466991 - RNA, 19 nt, Homo sapiens
ccuggcuggaagaggguga

SEQ ID NO: 1466992 - RNA, 14 nt, Homo sapiens
ccuggcuuugccuc

SEQ ID NO: 1466993 - RNA, 16 nt, Homo sapiens
ccuggcuuugccucuu

SEQ ID NO: 1466994 - RNA, 13 nt, Homo sapiens
ccugggagacaga

SEQ ID NO: 1466995 - RNA, 21 nt, Homo sapiens
ccugggagcccccaccacaaa

SEQ ID NO: 1466996 - RNA, 19 nt, Homo sapiens
ccugggaggcggagaguac

SEQ ID NO: 1466997 - RNA, 22 nt, Homo sapiens
ccugggccccucuuauuccucu

SEQ ID NO: 1466998 - RNA, 20 nt, Homo sapiens
ccugggcuuuuguuuugcuu

SEQ ID NO: 1466999 - RNA, 12 nt, Homo sapiens
ccuggggaccau

SEQ ID NO: 1467000 - RNA, 18 nt, Homo sapiens
ccuggggacuguuccaaa

SEQ ID NO: 1467001 - RNA, 21 nt, Homo sapiens
ccuggggccuggaccugccuc

SEQ ID NO: 1467002 - RNA, 20 nt, Homo sapiens
ccuggggcuagggggagccc

SEQ ID NO: 1467003 - RNA, 16 nt, Homo sapiens
ccuggggcugugcauu

SEQ ID NO: 1467004 - RNA, 15 nt, Homo sapiens
ccuggggguggcagg

SEQ ID NO: 1467005 - RNA, 18 nt, Homo sapiens
ccugggugacagagugag

SEQ ID NO: 1467006 - RNA, 14 nt, Homo sapiens
ccugguaccagagg

SEQ ID NO: 1467007 - RNA, 11 nt, Homo sapiens
ccuggucaguc

SEQ ID NO: 1467008 - RNA, 18 nt, Homo sapiens
ccuggucccuuggagaca

SEQ ID NO: 1467009 - RNA, 19 nt, Homo sapiens
ccuggucccuuggagacaa

SEQ ID NO: 1467010 - RNA, 12 nt, Homo sapiens
ccuggugcucuu

SEQ ID NO: 1467011 - RNA, 17 nt, Homo sapiens
ccugguggcaccagaug

SEQ ID NO: 1467012 - RNA, 22 nt, Homo sapiens
ccugguuuuagacgaggccaca

SEQ ID NO: 1467013 - RNA, 21 nt, Homo sapiens
ccuguaaggcaggcccauuca

SEQ ID NO: 1467014 - RNA, 20 nt, Homo sapiens
ccuguaauauuuagcuguaa

SEQ ID NO: 1467015 - RNA, 19 nt, Homo sapiens
ccuguaaucccaacacuuu

SEQ ID NO: 1467016 - RNA, 18 nt, Homo sapiens
ccuguaaucccagcacuu

SEQ ID NO: 1467017 - RNA, 17 nt, Homo sapiens
ccuguaaucucagcacu

SEQ ID NO: 1467018 - RNA, 21 nt, Homo sapiens
ccuguacucuggggugcugcc

SEQ ID NO: 1467019 - RNA, 14 nt, Homo sapiens
ccuguacucuugaa

SEQ ID NO: 1467020 - RNA, 17 nt, Homo sapiens
ccuguacuguauggaaa

SEQ ID NO: 1467021 - RNA, 17 nt, Homo sapiens
ccuguagcagccagucc

SEQ ID NO: 1467022 - RNA, 22 nt, Homo sapiens
ccuguagucccagcuacuugag

SEQ ID NO: 1467023 - RNA, 20 nt, Homo sapiens
ccuguauucuucaaccagug

SEQ ID NO: 1467024 - RNA, 20 nt, Homo sapiens
ccugucaaguuaacaaggaa

SEQ ID NO: 1467025 - RNA, 19 nt, Homo sapiens
ccugucacgccgggcucua

SEQ ID NO: 1467026 - RNA, 22 nt, Homo sapiens
ccugucauccucaugcugcuca

SEQ ID NO: 1467027 - RNA, 17 nt, Homo sapiens
ccugucccaaccccagu

SEQ ID NO: 1467028 - RNA, 14 nt, Homo sapiens
ccugucgugccagu

SEQ ID NO: 1467029 - RNA, 16 nt, Homo sapiens
ccugucgugccagucc

SEQ ID NO: 1467030 - RNA, 13 nt, Homo sapiens
ccugucuccuuau

SEQ ID NO: 1467031 - RNA, 21 nt, Homo sapiens
ccugucugcuaggcgcugggg

SEQ ID NO: 1467032 - RNA, 17 nt, Homo sapiens
ccugucuuaugguccag

SEQ ID NO: 1467033 - RNA, 20 nt, Homo sapiens
ccugucuuccaaggagacca

SEQ ID NO: 1467034 - RNA, 14 nt, Homo sapiens
ccugugaccagcac

SEQ ID NO: 1467035 - RNA, 17 nt, Homo sapiens
ccugugaccagcacugu

SEQ ID NO: 1467036 - RNA, 16 nt, Homo sapiens
ccugugacugucucac

SEQ ID NO: 1467037 - RNA, 21 nt, Homo sapiens
cgagcuguuuacagugaugcc

SEQ ID NO: 1467038 - RNA, 15 nt, Homo sapiens
cgagcuuccucggua

SEQ ID NO: 1467039 - RNA, 12 nt, Homo sapiens
cgaggccugaag

SEQ ID NO: 1467040 - RNA, 14 nt, Homo sapiens
cgaggucaggagau

SEQ ID NO: 1467041 - RNA, 22 nt, Homo sapiens
cgaguguccagccaagggcuga

SEQ ID NO: 1467042 - RNA, 13 nt, Homo sapiens
cgauacaaagugu

SEQ ID NO: 1467043 - RNA, 15 nt, Homo sapiens
cgauacaaaguguug

SEQ ID NO: 1467044 - RNA, 14 nt, Homo sapiens
cgauauacagauga

SEQ ID NO: 1467045 - RNA, 13 nt, Homo sapiens
cgaucuccugacc

SEQ ID NO: 1467046 - RNA, 23 nt, Homo sapiens
cgaugaggaccaagggcaccugg

SEQ ID NO: 1467047 - RNA, 12 nt, Homo sapiens
cgaugcucccuc

SEQ ID NO: 1467048 - RNA, 18 nt, Homo sapiens
cgauuaaaaucacucuca

SEQ ID NO: 1467049 - RNA, 16 nt, Homo sapiens
cgauugaaagaaccag

SEQ ID NO: 1467050 - RNA, 19 nt, Homo sapiens
cgauugaaagaaccagaga

SEQ ID NO: 1467051 - RNA, 14 nt, Homo sapiens
cgcaaaugaguauu

SEQ ID NO: 1467052 - RNA, 11 nt, Homo sapiens
cgcacacuggg

SEQ ID NO: 1467053 - RNA, 11 nt, Homo sapiens
cgcacagugug

SEQ ID NO: 1467054 - RNA, 12 nt, Homo sapiens
cgcaccacugca

SEQ ID NO: 1467055 - RNA, 16 nt, Homo sapiens
cgcaccacuguguauu

SEQ ID NO: 1467056 - RNA, 17 nt, Homo sapiens
cgcacuggggcuggcaa

SEQ ID NO: 1467057 - RNA, 19 nt, Homo sapiens
cgcagagguguaggggugg

SEQ ID NO: 1467058 - RNA, 16 nt, Homo sapiens
cgcagggguugcagug

SEQ ID NO: 1467059 - RNA, 16 nt, Homo sapiens
cgcaucaggccuggca

SEQ ID NO: 1467060 - RNA, 14 nt, Homo sapiens
cgcaugaaccugga

SEQ ID NO: 1467061 - RNA, 13 nt, Homo sapiens
cgccagacuguua

SEQ ID NO: 1467062 - RNA, 13 nt, Homo sapiens
cgccagcugggag

SEQ ID NO: 1467063 - RNA, 20 nt, Homo sapiens
cgcccaggcuggagugcagu

SEQ ID NO: 1467064 - RNA, 23 nt, Homo sapiens
cgcccagugcagucggugguacc

SEQ ID NO: 1467065 - RNA, 19 nt, Homo sapiens
cgcccugggcugucuguca

SEQ ID NO: 1467066 - RNA, 20 nt, Homo sapiens
cgccgucccaccagcuucac

SEQ ID NO: 1467067 - RNA, 14 nt, Homo sapiens
cgccucagggccag

SEQ ID NO: 1467068 - RNA, 13 nt, Homo sapiens
cgccugagcucac

SEQ ID NO: 1467069 - RNA, 13 nt, Homo sapiens
cgcgcaccuguag

SEQ ID NO: 1467070 - RNA, 22 nt, Homo sapiens
cgcuaccucccuccccgucuca

SEQ ID NO: 1467071 - RNA, 13 nt, Homo sapiens
cgcuaucuagcaa

SEQ ID NO: 1467072 - RNA, 12 nt, Homo sapiens
cgcuauuacaaa

SEQ ID NO: 1467073 - RNA, 16 nt, Homo sapiens
cgcucacccagucacc

SEQ ID NO: 1467074 - RNA, 18 nt, Homo sapiens
cgcucccagguuccccca

SEQ ID NO: 1467075 - RNA, 17 nt, Homo sapiens
cgcucucagcugaccau

SEQ ID NO: 1467076 - RNA, 16 nt, Homo sapiens
cgcugacugccaccca

SEQ ID NO: 1467077 - RNA, 22 nt, Homo sapiens
cgcugagcgucacggccaagug

SEQ ID NO: 1467078 - RNA, 22 nt, Homo sapiens
cgcugcagcuguguguccuucu

SEQ ID NO: 1467079 - RNA, 16 nt, Homo sapiens
cgcuuaaccuuuccag

SEQ ID NO: 1467080 - RNA, 16 nt, Homo sapiens
cgcuuaguuaucagcu

SEQ ID NO: 1467081 - RNA, 19 nt, Homo sapiens
cgcuucugccuuuucacug

SEQ ID NO: 1467082 - RNA, 20 nt, Homo sapiens
cgcuucugccuuuucacugu

SEQ ID NO: 1467083 - RNA, 14 nt, Homo sapiens
cggaacauguaaaa

SEQ ID NO: 1467084 - RNA, 17 nt, Homo sapiens
cggaaccugugagcugc

SEQ ID NO: 1467085 - RNA, 19 nt, Homo sapiens
cggaagaggcugcugagaa

SEQ ID NO: 1467086 - RNA, 18 nt, Homo sapiens
cggaagcugucgacuuca

SEQ ID NO: 1467087 - RNA, 19 nt, Homo sapiens
ccgaaauucuagcucugac

SEQ ID NO: 1467088 - RNA, 16 nt, Homo sapiens
ccgaaguaugagggaa

SEQ ID NO: 1467089 - RNA, 20 nt, Homo sapiens
ccgaagucuuuuguucgcau

SEQ ID NO: 1467090 - RNA, 14 nt, Homo sapiens
ccgaccacuuccag

SEQ ID NO: 1467091 - RNA, 22 nt, Homo sapiens
ccgacggugggcauuugugagg

SEQ ID NO: 1467092 - RNA, 21 nt, Homo sapiens
ccgacugcuagggaguggucu

SEQ ID NO: 1467093 - RNA, 19 nt, Homo sapiens
ccgacuuuccauugauuca

SEQ ID NO: 1467094 - RNA, 12 nt, Homo sapiens
ccgagaagaaca

SEQ ID NO: 1467095 - RNA, 18 nt, Homo sapiens
ccgagauccccagggcag

SEQ ID NO: 1467096 - RNA, 17 nt, Homo sapiens
ccgaggcccucaaucca

SEQ ID NO: 1467097 - RNA, 15 nt, Homo sapiens
ccgagguaggggugg

SEQ ID NO: 1467098 - RNA, 20 nt, Homo sapiens
ccgagucucuucuccacugg

SEQ ID NO: 1467099 - RNA, 19 nt, Homo sapiens
ccgauauacucuagaugaa

SEQ ID NO: 1467100 - RNA, 15 nt, Homo sapiens
ccgaugguacuauuu

SEQ ID NO: 1467101 - RNA, 18 nt, Homo sapiens
ccgauucccaacugagug

SEQ ID NO: 1467102 - RNA, 23 nt, Homo sapiens
ccgcaacaguuuuuuaugcuaau

SEQ ID NO: 1467103 - RNA, 13 nt, Homo sapiens
ccgcaucaccuca

SEQ ID NO: 1467104 - RNA, 14 nt, Homo sapiens
ccgcccacagccag

SEQ ID NO: 1467105 - RNA, 14 nt, Homo sapiens
ccgccuuugcuuuu

SEQ ID NO: 1467106 - RNA, 22 nt, Homo sapiens
ccgcuucuccaagucugcugau

SEQ ID NO: 1467107 - RNA, 20 nt, Homo sapiens
ccggccagcgggcacagggc

SEQ ID NO: 1467108 - RNA, 21 nt, Homo sapiens
ccggccucagggcgcucagac

SEQ ID NO: 1467109 - RNA, 18 nt, Homo sapiens
ccggcuuccacuccccac

SEQ ID NO: 1467110 - RNA, 17 nt, Homo sapiens
ccggggccagcaccacu

SEQ ID NO: 1467111 - RNA, 17 nt, Homo sapiens
ccggugcaugaugcugc

SEQ ID NO: 1467112 - RNA, 17 nt, Homo sapiens
ccguaacaacugugguc

SEQ ID NO: 1467113 - RNA, 14 nt, Homo sapiens
ccguaccaaucucu

SEQ ID NO: 1467114 - RNA, 21 nt, Homo sapiens
ccguaccucuucccaugacug

SEQ ID NO: 1467115 - RNA, 15 nt, Homo sapiens
ccgucuggaccuggg

SEQ ID NO: 1467116 - RNA, 11 nt, Homo sapiens
ccgucuucucc

SEQ ID NO: 1467117 - RNA, 16 nt, Homo sapiens
ccgugaacugugcaua

SEQ ID NO: 1467118 - RNA, 13 nt, Homo sapiens
ccgugaccaucuu

SEQ ID NO: 1467119 - RNA, 13 nt, Homo sapiens
ccgugacugcaau

SEQ ID NO: 1467120 - RNA, 15 nt, Homo sapiens
ccguggaaaauuuca

SEQ ID NO: 1467121 - RNA, 15 nt, Homo sapiens
ccguggagacugaga

SEQ ID NO: 1467122 - RNA, 15 nt, Homo sapiens
ccguuccugacauca

SEQ ID NO: 1467123 - RNA, 14 nt, Homo sapiens
ccuaaaaaaagaga

SEQ ID NO: 1467124 - RNA, 15 nt, Homo sapiens
ccuaaaacuggcaaa

SEQ ID NO: 1467125 - RNA, 21 nt, Homo sapiens
ccuaaaaguuacuuaccacag

SEQ ID NO: 1467126 - RNA, 18 nt, Homo sapiens
ccuaaaauauauuccuga

SEQ ID NO: 1467127 - RNA, 12 nt, Homo sapiens
ccuaaacccaau

SEQ ID NO: 1467128 - RNA, 19 nt, Homo sapiens
ccuaaauaauguuaucugu

SEQ ID NO: 1467129 - RNA, 16 nt, Homo sapiens
ccuaaaucuccagugg

SEQ ID NO: 1467130 - RNA, 12 nt, Homo sapiens
ccuaacaaaaga

SEQ ID NO: 1467131 - RNA, 15 nt, Homo sapiens
ccuaaccucauuccc

SEQ ID NO: 1467132 - RNA, 23 nt, Homo sapiens
ccuaaccucuuuucugcaucauc

SEQ ID NO: 1467133 - RNA, 17 nt, Homo sapiens
ccuaagacuuauguauu

SEQ ID NO: 1467134 - RNA, 12 nt, Homo sapiens
ccuaagcacuuu

SEQ ID NO: 1467135 - RNA, 17 nt, Homo sapiens
ccuaagcuggucucaaa

SEQ ID NO: 1467136 - RNA, 18 nt, Homo sapiens
ccuaaggacacacuaauc

SEQ ID NO: 1467137 - RNA, 18 nt, Homo sapiens
ccuaaggaucucucagga

SEQ ID NO: 1467138 - RNA, 16 nt, Homo sapiens
ccuaaggucacagcua

SEQ ID NO: 1467139 - RNA, 14 nt, Homo sapiens
ccuaauaaacaauu

SEQ ID NO: 1467140 - RNA, 13 nt, Homo sapiens
cuagaagacuguc

SEQ ID NO: 1467141 - RNA, 21 nt, Homo sapiens
cuagaauguggauuugauuca

SEQ ID NO: 1467142 - RNA, 22 nt, Homo sapiens
cuagaauguggauuugauucau

SEQ ID NO: 1467143 - RNA, 12 nt, Homo sapiens
cuagaauuauuc

SEQ ID NO: 1467144 - RNA, 19 nt, Homo sapiens
cuagaauuuucucccuuua

SEQ ID NO: 1467145 - RNA, 19 nt, Homo sapiens
cuagacuucccaacagccu

SEQ ID NO: 1467146 - RNA, 17 nt, Homo sapiens
cuagaguccucacuccc

SEQ ID NO: 1467147 - RNA, 18 nt, Homo sapiens
cuagaugcaucacugggu

SEQ ID NO: 1467148 - RNA, 19 nt, Homo sapiens
cuagauuuucuacuuuauu

SEQ ID NO: 1467149 - RNA, 23 nt, Homo sapiens
cuagcaaauggcagaaccaaagc

SEQ ID NO: 1467150 - RNA, 14 nt, Homo sapiens
cuagcagaaaucua

SEQ ID NO: 1467151 - RNA, 18 nt, Homo sapiens
cuagcccagacucugagc

SEQ ID NO: 1467152 - RNA, 19 nt, Homo sapiens
cuagccuauuuaccugcag

SEQ ID NO: 1467153 - RNA, 13 nt, Homo sapiens
cuagccugugcac

SEQ ID NO: 1467154 - RNA, 14 nt, Homo sapiens
cuagccuugcuugu

SEQ ID NO: 1467155 - RNA, 22 nt, Homo sapiens
cuagccuuggccucuuuccuca

SEQ ID NO: 1467156 - RNA, 17 nt, Homo sapiens
cuagcuagaaauaugau

SEQ ID NO: 1467157 - RNA, 19 nt, Homo sapiens
cuagcuagaaauaugauuu

SEQ ID NO: 1467158 - RNA, 18 nt, Homo sapiens
cuaggaaauccauucaca

SEQ ID NO: 1467159 - RNA, 13 nt, Homo sapiens
cuaggagaccaag

SEQ ID NO: 1467160 - RNA, 15 nt, Homo sapiens
cuaggagaccaaggc

SEQ ID NO: 1467161 - RNA, 20 nt, Homo sapiens
cuaggcuaccucaagacuca

SEQ ID NO: 1467162 - RNA, 17 nt, Homo sapiens
cuagggaggaccuuauc

SEQ ID NO: 1467163 - RNA, 19 nt, Homo sapiens
cuagggauucaggcugcuu

SEQ ID NO: 1467164 - RNA, 13 nt, Homo sapiens
cuagguucaggaa

SEQ ID NO: 1467165 - RNA, 18 nt, Homo sapiens
cuaguaagaugcacugaa

SEQ ID NO: 1467166 - RNA, 20 nt, Homo sapiens
cuaguaagaugcacugaaaa

SEQ ID NO: 1467167 - RNA, 19 nt, Homo sapiens
cuaguacugccccccauga

SEQ ID NO: 1467168 - RNA, 16 nt, Homo sapiens
cuagucauucuucccu

SEQ ID NO: 1467169 - RNA, 19 nt, Homo sapiens
cuagucuccuuugcacuga

SEQ ID NO: 1467170 - RNA, 16 nt, Homo sapiens
cuaguggucuuuguaa

SEQ ID NO: 1467171 - RNA, 16 nt, Homo sapiens
cuagugucuuuugccu

SEQ ID NO: 1467172 - RNA, 17 nt, Homo sapiens
cuaguuaggagcccacc

SEQ ID NO: 1467173 - RNA, 14 nt, Homo sapiens
cuaguucagagcca

SEQ ID NO: 1467174 - RNA, 12 nt, Homo sapiens
cuaguuccagaa

SEQ ID NO: 1467175 - RNA, 21 nt, Homo sapiens
cuaguuugcuuugcugaccaa

SEQ ID NO: 1467176 - RNA, 20 nt, Homo sapiens
cuaguuuugucaaacuguag

SEQ ID NO: 1467177 - RNA, 20 nt, Homo sapiens
cuauaaagaagaacuugcau

SEQ ID NO: 1467178 - RNA, 18 nt, Homo sapiens
cuauagcacugagcucac

SEQ ID NO: 1467179 - RNA, 17 nt, Homo sapiens
cuauaggaacauaugaa

SEQ ID NO: 1467180 - RNA, 18 nt, Homo sapiens
cuauagggugugaugaag

SEQ ID NO: 1467181 - RNA, 21 nt, Homo sapiens
cuauagggugugaugaaguca

SEQ ID NO: 1467182 - RNA, 14 nt, Homo sapiens
cuauauaagacaag

SEQ ID NO: 1467183 - RNA, 19 nt, Homo sapiens
cuauauaauaaagcuacug

SEQ ID NO: 1467184 - RNA, 18 nt, Homo sapiens
cuauauguaguauaaaga

SEQ ID NO: 1467185 - RNA, 16 nt, Homo sapiens
cuauauuaucauaaga

SEQ ID NO: 1467186 - RNA, 14 nt, Homo sapiens
cuauauugcacugu

SEQ ID NO: 1467187 - RNA, 21 nt, Homo sapiens
cuauauuugcuuuuugcuaac

SEQ ID NO: 1467188 - RNA, 15 nt, Homo sapiens
cuaucacacaguggg

SEQ ID NO: 1467189 - RNA, 14 nt, Homo sapiens
cucagaagcacaga

SEQ ID NO: 1467190 - RNA, 23 nt, Homo sapiens
cucagaauauugcuuuggucaua

SEQ ID NO: 1467191 - RNA, 20 nt, Homo sapiens
cucagaauugaucauuuucc

SEQ ID NO: 1467192 - RNA, 22 nt, Homo sapiens
cucagaggcgcacugugacccc

SEQ ID NO: 1467193 - RNA, 20 nt, Homo sapiens
cucagccacacccaggcacu

SEQ ID NO: 1467194 - RNA, 18 nt, Homo sapiens
cucagccuguuccaugaa

SEQ ID NO: 1467195 - RNA, 21 nt, Homo sapiens
cucagccuugccagagaucca

SEQ ID NO: 1467196 - RNA, 21 nt, Homo sapiens
cucagcuaaugaaguguuuag

SEQ ID NO: 1467197 - RNA, 23 nt, Homo sapiens
cucagcuaugcccggaccuccau

SEQ ID NO: 1467198 - RNA, 14 nt, Homo sapiens
cucagcuccacaac

SEQ ID NO: 1467199 - RNA, 17 nt, Homo sapiens
cucagggacagagccau

SEQ ID NO: 1467200 - RNA, 22 nt, Homo sapiens
cucagggagcagggaaggccug

SEQ ID NO: 1467201 - RNA, 22 nt, Homo sapiens
cucagggccuggcaggccagug

SEQ ID NO: 1467202 - RNA, 23 nt, Homo sapiens
cucagggccuggcaggccagugu

SEQ ID NO: 1467203 - RNA, 20 nt, Homo sapiens
cucaggggccaacuaggcag

SEQ ID NO: 1467204 - RNA, 18 nt, Homo sapiens
cucagggucaaagacaga

SEQ ID NO: 1467205 - RNA, 22 nt, Homo sapiens
cucaggugaaaauccaucucau

SEQ ID NO: 1467206 - RNA, 17 nt, Homo sapiens
cucagguguugccaaau

SEQ ID NO: 1467207 - RNA, 13 nt, Homo sapiens
cucaguccuguac

SEQ ID NO: 1467208 - RNA, 20 nt, Homo sapiens
cucagugggggcagagccac

SEQ ID NO: 1467209 - RNA, 17 nt, Homo sapiens
cucaguucccucuugcu

SEQ ID NO: 1467210 - RNA, 21 nt, Homo sapiens
cucaguugaaauaacaacaga

SEQ ID NO: 1467211 - RNA, 15 nt, Homo sapiens
cucaguuuccucauc

SEQ ID NO: 1467212 - RNA, 21 nt, Homo sapiens
cucaguuugucagacuuuaaa

SEQ ID NO: 1467213 - RNA, 15 nt, Homo sapiens
cucauaaaaagcaaa

SEQ ID NO: 1467214 - RNA, 16 nt, Homo sapiens
cucauaaaguagauua

SEQ ID NO: 1467215 - RNA, 13 nt, Homo sapiens
cucauaagcaaua

SEQ ID NO: 1467216 - RNA, 14 nt, Homo sapiens
cucauaauuuugca

SEQ ID NO: 1467217 - RNA, 14 nt, Homo sapiens
cucauagcauuaac

SEQ ID NO: 1467218 - RNA, 19 nt, Homo sapiens
cucauaugcauguagucac

SEQ ID NO: 1467219 - RNA, 13 nt, Homo sapiens
cucaucacuggau

SEQ ID NO: 1467220 - RNA, 22 nt, Homo sapiens
cucaucaguguccucuugcuca

SEQ ID NO: 1467221 - RNA, 18 nt, Homo sapiens
cucauccuccuggaaccu

SEQ ID NO: 1467222 - RNA, 12 nt, Homo sapiens
cucaucugcaaa

SEQ ID NO: 1467223 - RNA, 15 nt, Homo sapiens
cucaugaccuugaaa

SEQ ID NO: 1467224 - RNA, 20 nt, Homo sapiens
cucaugccuguaaucccaac

SEQ ID NO: 1467225 - RNA, 13 nt, Homo sapiens
cucaugugcagua

SEQ ID NO: 1467226 - RNA, 20 nt, Homo sapiens
cucauucuugaggagcauua

SEQ ID NO: 1467227 - RNA, 22 nt, Homo sapiens
cucauuguuuauuaacaaauua

SEQ ID NO: 1467228 - RNA, 20 nt, Homo sapiens
cucauuuacacucagcugcu

SEQ ID NO: 1467229 - RNA, 21 nt, Homo sapiens
cucauuuagaacuugcagcug

SEQ ID NO: 1467230 - RNA, 16 nt, Homo sapiens
cucauuuuacacaaag

SEQ ID NO: 1467231 - RNA, 17 nt, Homo sapiens
cuccaaaccuccagccu

SEQ ID NO: 1467232 - RNA, 22 nt, Homo sapiens
cuccaacacaaggcuccaagac

SEQ ID NO: 1467233 - RNA, 13 nt, Homo sapiens
cuccaacaccaag

SEQ ID NO: 1467234 - RNA, 12 nt, Homo sapiens
cuccaagacaga

SEQ ID NO: 1467235 - RNA, 22 nt, Homo sapiens
cuccaagggacccuuugccuuu

SEQ ID NO: 1467236 - RNA, 23 nt, Homo sapiens
cuccacaauagcagacaguguuu

SEQ ID NO: 1467237 - RNA, 13 nt, Homo sapiens
cuuaugauucaga

SEQ ID NO: 1467238 - RNA, 21 nt, Homo sapiens
cuuaugcaaucuauguuugca

SEQ ID NO: 1467239 - RNA, 18 nt, Homo sapiens
cuuaugcuuaaauucaag

SEQ ID NO: 1467240 - RNA, 14 nt, Homo sapiens
cuuauguugcacaa

SEQ ID NO: 1467241 - RNA, 21 nt, Homo sapiens
cuuauuacaauuuguucaucc

SEQ ID NO: 1467242 - RNA, 22 nt, Homo sapiens
cuuauuagggagaaaauucaau

SEQ ID NO: 1467243 - RNA, 18 nt, Homo sapiens
cuuauucuuugaguaaug

SEQ ID NO: 1467244 - RNA, 17 nt, Homo sapiens
cuuauuguuccaagaca

SEQ ID NO: 1467245 - RNA, 23 nt, Homo sapiens
cuuauuuaaaauuccauuaucuu

SEQ ID NO: 1467246 - RNA, 17 nt, Homo sapiens
cuuauuuugcauuccag

SEQ ID NO: 1467247 - RNA, 15 nt, Homo sapiens
cuucaaauauuuccc

SEQ ID NO: 1467248 - RNA, 13 nt, Homo sapiens
cuucaaaucaauc

SEQ ID NO: 1467249 - RNA, 18 nt, Homo sapiens
cuucaaaucaaucuguaa

SEQ ID NO: 1467250 - RNA, 13 nt, Homo sapiens
cuucaaccaguga

SEQ ID NO: 1467251 - RNA, 17 nt, Homo sapiens
cuucaaccucauugaca

SEQ ID NO: 1467252 - RNA, 17 nt, Homo sapiens
cuucaagaaauuacugg

SEQ ID NO: 1467253 - RNA, 22 nt, Homo sapiens
cuucaagugccuuuugcugcgc

SEQ ID NO: 1467254 - RNA, 18 nt, Homo sapiens
cuucaaugggcucuucca

SEQ ID NO: 1467255 - RNA, 17 nt, Homo sapiens
cuucacagucuggugcu

SEQ ID NO: 1467256 - RNA, 10 nt, Homo sapiens
cuucacugac

SEQ ID NO: 1467257 - RNA, 16 nt, Homo sapiens
cuucagaagacacugc

SEQ ID NO: 1467258 - RNA, 23 nt, Homo sapiens
cuucagagacuucguaauuaaag

SEQ ID NO: 1467259 - RNA, 20 nt, Homo sapiens
cuucagaggauaaauaucaa

SEQ ID NO: 1467260 - RNA, 14 nt, Homo sapiens
cuucagagugaaga

SEQ ID NO: 1467261 - RNA, 13 nt, Homo sapiens
cuucagcagucaa

SEQ ID NO: 1467262 - RNA, 14 nt, Homo sapiens
cuucagcagucaau

SEQ ID NO: 1467263 - RNA, 21 nt, Homo sapiens
cuucagcugggucacauccau

SEQ ID NO: 1467264 - RNA, 17 nt, Homo sapiens
cuucaggaaaauaaaua

SEQ ID NO: 1467265 - RNA, 18 nt, Homo sapiens
cuucagggcugaguucug

SEQ ID NO: 1467266 - RNA, 22 nt, Homo sapiens
cuucagguucuuagugucacuu

SEQ ID NO: 1467267 - RNA, 20 nt, Homo sapiens
cuucaguguuuuucauuucu

SEQ ID NO: 1467268 - RNA, 23 nt, Homo sapiens
cuucauacuggcaggagggugag

SEQ ID NO: 1467269 - RNA, 23 nt, Homo sapiens
cuucauauguuggguaagaaaca

SEQ ID NO: 1467270 - RNA, 23 nt, Homo sapiens
cuucaucauucccucucaucuca

SEQ ID NO: 1467271 - RNA, 15 nt, Homo sapiens
cuucauccaacuucc

SEQ ID NO: 1467272 - RNA, 17 nt, Homo sapiens
cuucaucucaccauccu

SEQ ID NO: 1467273 - RNA, 18 nt, Homo sapiens
cuucaucuucacugcaau

SEQ ID NO: 1467274 - RNA, 15 nt, Homo sapiens
cuucauggacuucca

SEQ ID NO: 1467275 - RNA, 15 nt, Homo sapiens
cuucauuccaaucua

SEQ ID NO: 1467276 - RNA, 23 nt, Homo sapiens
cuucauuccaaucuauugcuuca

SEQ ID NO: 1467277 - RNA, 12 nt, Homo sapiens
cuucauuucagg

SEQ ID NO: 1467278 - RNA, 22 nt, Homo sapiens
cuucauuucaggaagacugaca

SEQ ID NO: 1467279 - RNA, 18 nt, Homo sapiens
cuucauuugaugcuaaau

SEQ ID NO: 1467280 - RNA, 19 nt, Homo sapiens
cuucauuuuauuaauauuu

SEQ ID NO: 1467281 - RNA, 19 nt, Homo sapiens
cuuccaaggguacuaagga

SEQ ID NO: 1467282 - RNA, 22 nt, Homo sapiens
cuuccacaacagaaguauuucu

SEQ ID NO: 1467283 - RNA, 12 nt, Homo sapiens
cuuccacuuugc

SEQ ID NO: 1467284 - RNA, 18 nt, Homo sapiens
cuuccaggggaaccugcc

SEQ ID NO: 1467285 - RNA, 19 nt, Homo sapiens
cuuccagguaucuccagga

SEQ ID NO: 1467286 - RNA, 14 nt, Homo sapiens
cuuccagugcucag

SEQ ID NO: 1467287 - RNA, 15 nt, Homo sapiens
cuuccagugcucaga

SEQ ID NO: 1467288 - RNA, 16 nt, Homo sapiens
cuuccauaauguauaa

SEQ ID NO: 1467289 - RNA, 21 nt, Homo sapiens
cuuccauaggacauacugcau

SEQ ID NO: 1467290 - RNA, 23 nt, Homo sapiens
cuuccauaggacauacugcaugu

SEQ ID NO: 1467291 - RNA, 23 nt, Homo sapiens
cuuccaugacauaagugcuauug

SEQ ID NO: 1467292 - RNA, 13 nt, Homo sapiens
cuugaaaguuuuc

SEQ ID NO: 1467293 - RNA, 14 nt, Homo sapiens
cuugaaaugcauua

SEQ ID NO: 1467294 - RNA, 20 nt, Homo sapiens
cuugaaauuaagaaggcaaa

SEQ ID NO: 1467295 - RNA, 16 nt, Homo sapiens
cuugaaauuacugugu

SEQ ID NO: 1467296 - RNA, 22 nt, Homo sapiens
cuugaacaagaugugggccuug

SEQ ID NO: 1467297 - RNA, 22 nt, Homo sapiens
cuugaagaaccucucacuucac

SEQ ID NO: 1467298 - RNA, 11 nt, Homo sapiens
cuugaagccaa

SEQ ID NO: 1467299 - RNA, 12 nt, Homo sapiens
cuugaagccaaa

SEQ ID NO: 1467300 - RNA, 15 nt, Homo sapiens
cuugaagggcccaga

SEQ ID NO: 1467301 - RNA, 13 nt, Homo sapiens
cuugaaguacuua

SEQ ID NO: 1467302 - RNA, 16 nt, Homo sapiens
cuugaaguacuuaaca

SEQ ID NO: 1467303 - RNA, 17 nt, Homo sapiens
cuugaaucaaagcaguu

SEQ ID NO: 1467304 - RNA, 14 nt, Homo sapiens
cuugaaucaggacu

SEQ ID NO: 1467305 - RNA, 15 nt, Homo sapiens
cuugaaugcugccag

SEQ ID NO: 1467306 - RNA, 17 nt, Homo sapiens
cuugaaugcugccagug

SEQ ID NO: 1467307 - RNA, 20 nt, Homo sapiens
cuugaccuaagggacuccca

SEQ ID NO: 1467308 - RNA, 14 nt, Homo sapiens
cuugacucauggca

SEQ ID NO: 1467309 - RNA, 14 nt, Homo sapiens
cuugacuuccugcc

SEQ ID NO: 1467310 - RNA, 21 nt, Homo sapiens
cuugagaggaugaauguaugu

SEQ ID NO: 1467311 - RNA, 23 nt, Homo sapiens
cuugaggggcccacagacagauc

SEQ ID NO: 1467312 - RNA, 20 nt, Homo sapiens
cuugagggugcuuguucccu

SEQ ID NO: 1467313 - RNA, 20 nt, Homo sapiens
cuugaguguaauguuuguua

SEQ ID NO: 1467314 - RNA, 15 nt, Homo sapiens
cuugauaugaccugu

SEQ ID NO: 1467315 - RNA, 20 nt, Homo sapiens
cuugaucauuauaucauugg

SEQ ID NO: 1467316 - RNA, 17 nt, Homo sapiens
cuugauucugcaguaaa

SEQ ID NO: 1467317 - RNA, 21 nt, Homo sapiens
cuugauuuuuuuaaacauaag

SEQ ID NO: 1467318 - RNA, 14 nt, Homo sapiens
cuugcagggccguu

SEQ ID NO: 1467319 - RNA, 10 nt, Homo sapiens
cuugcauaau

SEQ ID NO: 1467320 - RNA, 24 nt, Homo sapiens
cuugcauaggcucuuaagcagcau

SEQ ID NO: 1467321 - RNA, 19 nt, Homo sapiens
cuugcccagacuacagggc

SEQ ID NO: 1467322 - RNA, 21 nt, Homo sapiens
cuugcgauucugcagccacaa

SEQ ID NO: 1467323 - RNA, 12 nt, Homo sapiens
cuugcucagugg

SEQ ID NO: 1467324 - RNA, 18 nt, Homo sapiens
cuugcucucagcugccaa

SEQ ID NO: 1467325 - RNA, 22 nt, Homo sapiens
cuugcugauggugacauugcac

SEQ ID NO: 1467326 - RNA, 16 nt, Homo sapiens
cuugcugcugcugcac

SEQ ID NO: 1467327 - RNA, 20 nt, Homo sapiens
cuugcuggaaaacccaaagu

SEQ ID NO: 1467328 - RNA, 17 nt, Homo sapiens
cuugcugugugaccuca

SEQ ID NO: 1467329 - RNA, 23 nt, Homo sapiens
cuugcuuuccugggccuuugcaa

SEQ ID NO: 1467330 - RNA, 21 nt, Homo sapiens
cuuggaaauagaaagaagcca

SEQ ID NO: 1467331 - RNA, 16 nt, Homo sapiens
cuuggaacauuggaau

SEQ ID NO: 1467332 - RNA, 22 nt, Homo sapiens
cuuggacaggagucagugucug

SEQ ID NO: 1467333 - RNA, 16 nt, Homo sapiens
cuuggaccaugccaga

SEQ ID NO: 1467334 - RNA, 14 nt, Homo sapiens
cuuggcaaaagccu

SEQ ID NO: 1467335 - RNA, 20 nt, Homo sapiens
cuuggcaccagacacccagg

SEQ ID NO: 1467336 - RNA, 21 nt, Homo sapiens
cuuggcaccagacacccagga

SEQ ID NO: 1467337 - RNA, 13 nt, Homo sapiens
cuuggccaagaga

SEQ ID NO: 1467338 - RNA, 19 nt, Homo sapiens
cuuggccggauguccucag

SEQ ID NO: 1467339 - RNA, 14 nt, Homo sapiens
cuuggcucugccag

SEQ ID NO: 1467340 - RNA, 20 nt, Homo sapiens
cuugggaaacuauucaugaa

SEQ ID NO: 1467341 - RNA, 18 nt, Homo sapiens
cuugggagaccuguaauc

SEQ ID NO: 1467342 - RNA, 13 nt, Homo sapiens
cuugggcucugcu

SEQ ID NO: 1467343 - RNA, 17 nt, Homo sapiens
cuuggggaacccaugag

SEQ ID NO: 1467344 - RNA, 17 nt, Homo sapiens
cuuggguucacagugca

SEQ ID NO: 1467345 - RNA, 15 nt, Homo sapiens
cuugguauuacccuc

SEQ ID NO: 1467346 - RNA, 17 nt, Homo sapiens
cuuggucuuuguaucuu

SEQ ID NO: 1467347 - RNA, 14 nt, Homo sapiens
cuuggugaugcugg

SEQ ID NO: 1467348 - RNA, 21 nt, Homo sapiens
cuugguggcgcgcaccuguag

SEQ ID NO: 1467349 - RNA, 21 nt, Homo sapiens
cuuuccugguuuucaucagga

SEQ ID NO: 1467350 - RNA, 15 nt, Homo sapiens
cuuucuaauguuucu

SEQ ID NO: 1467351 - RNA, 13 nt, Homo sapiens
cuuucuaugcugu

SEQ ID NO: 1467352 - RNA, 18 nt, Homo sapiens
cuuucuccaggaccaaua

SEQ ID NO: 1467353 - RNA, 19 nt, Homo sapiens
cuuucuccaggaccaauaa

SEQ ID NO: 1467354 - RNA, 11 nt, Homo sapiens
cuuucucucag

SEQ ID NO: 1467355 - RNA, 22 nt, Homo sapiens
cuuucucugccagugacagaca

SEQ ID NO: 1467356 - RNA, 20 nt, Homo sapiens
cuuucugccgaccccuaguu

SEQ ID NO: 1467357 - RNA, 15 nt, Homo sapiens
cuuucuggaaaagag

SEQ ID NO: 1467358 - RNA, 21 nt, Homo sapiens
cuuucuuccuuggccaagaga

SEQ ID NO: 1467359 - RNA, 14 nt, Homo sapiens
cuuucuucugaaua

SEQ ID NO: 1467360 - RNA, 17 nt, Homo sapiens
cuuugagacugggucuc

SEQ ID NO: 1467361 - RNA, 18 nt, Homo sapiens
cuuugaguuuuguauuca

SEQ ID NO: 1467362 - RNA, 19 nt, Homo sapiens
cuuugcaguuggacucuca

SEQ ID NO: 1467363 - RNA, 19 nt, Homo sapiens
cuuugccagaaagcauaaa

SEQ ID NO: 1467364 - RNA, 21 nt, Homo sapiens
cuuugcugccagccacuucau

SEQ ID NO: 1467365 - RNA, 20 nt, Homo sapiens
cuuugcugcuggugcuaaaa

SEQ ID NO: 1467366 - RNA, 14 nt, Homo sapiens
cuuuggaaagccau

SEQ ID NO: 1467367 - RNA, 23 nt, Homo sapiens
cuuuggggagcaggaggccaaua

SEQ ID NO: 1467368 - RNA, 18 nt, Homo sapiens
cuuuggucauaugagcuu

SEQ ID NO: 1467369 - RNA, 18 nt, Homo sapiens
cuuuguaagaguguagaa

SEQ ID NO: 1467370 - RNA, 23 nt, Homo sapiens
cuuugucccggggcuccacugaa

SEQ ID NO: 1467371 - RNA, 15 nt, Homo sapiens
cuuugugauucccuc

SEQ ID NO: 1467372 - RNA, 15 nt, Homo sapiens
cuuugugcuugucau

SEQ ID NO: 1467373 - RNA, 18 nt, Homo sapiens
cuuugugcuugucauucc

SEQ ID NO: 1467374 - RNA, 20 nt, Homo sapiens
cuuuguguagaaagccaaau

SEQ ID NO: 1467375 - RNA, 19 nt, Homo sapiens
cuuuguguuugguuuacau

SEQ ID NO: 1467376 - RNA, 11 nt, Homo sapiens
cuuuguugccc

SEQ ID NO: 1467377 - RNA, 22 nt, Homo sapiens
cuuuuaaaaacuagagcacaga

SEQ ID NO: 1467378 - RNA, 15 nt, Homo sapiens
cuuuuaaaaaugucc

SEQ ID NO: 1467379 - RNA, 15 nt, Homo sapiens
cuuuuaaacuuugau

SEQ ID NO: 1467380 - RNA, 16 nt, Homo sapiens
cuuuuaagcagucuca

SEQ ID NO: 1467381 - RNA, 13 nt, Homo sapiens
cuuuuaaguugcu

SEQ ID NO: 1467382 - RNA, 23 nt, Homo sapiens
cuuuuaaguugcugaugaacucu

SEQ ID NO: 1467383 - RNA, 17 nt, Homo sapiens
cuuuuaaucaacuguag

SEQ ID NO: 1467384 - RNA, 14 nt, Homo sapiens
cuuuuaaucaguga

SEQ ID NO: 1467385 - RNA, 13 nt, Homo sapiens
cuuuuaaugaugc

SEQ ID NO: 1467386 - RNA, 22 nt, Homo sapiens
cuuuuaauguauuuguuugcaa

SEQ ID NO: 1467387 - RNA, 22 nt, Homo sapiens
cuuuuaaugucauuuguuaaaa

SEQ ID NO: 1467388 - RNA, 13 nt, Homo sapiens
cuuuuaauucaaa

SEQ ID NO: 1467389 - RNA, 13 nt, Homo sapiens
cuuuuacauucug

SEQ ID NO: 1467390 - RNA, 13 nt, Homo sapiens
cuuuuaugcagau

SEQ ID NO: 1467391 - RNA, 14 nt, Homo sapiens
cuuuuaugccuuca

SEQ ID NO: 1467392 - RNA, 14 nt, Homo sapiens
cuuuuauguagcac

SEQ ID NO: 1467393 - RNA, 19 nt, Homo sapiens
cuuuuauguagcacauaaa

SEQ ID NO: 1467394 - RNA, 20 nt, Homo sapiens
cuuuuauucauuagcuguga

SEQ ID NO: 1467395 - RNA, 13 nt, Homo sapiens
cuuuucaggguuu

SEQ ID NO: 1467396 - RNA, 22 nt, Homo sapiens
cuuuuccaugcacccucauaca

SEQ ID NO: 1467397 - RNA, 15 nt, Homo sapiens
cuuuuccccaaccac

SEQ ID NO: 1467398 - RNA, 16 nt, Homo sapiens
cuuuuccccaguccca

SEQ ID NO: 1467399 - RNA, 16 nt, Homo sapiens
cuuuucuaacucuccc

SEQ ID NO: 1467400 - RNA, 13 nt, Homo sapiens
cuuuugaggggcu

SEQ ID NO: 1467401 - RNA, 20 nt, Homo sapiens
cuuuugagugugugugugca

SEQ ID NO: 1467402 - RNA, 11 nt, Homo sapiens
cuuuugcacau

SEQ ID NO: 1467403 - RNA, 22 nt, Homo sapiens
cuuuugccaguauuaugcauau

SEQ ID NO: 1467404 - RNA, 23 nt, Homo sapiens
cuuuugcuagagcugacagcuuu

SEQ ID NO: 1467405 - RNA, 23 nt, Homo sapiens
cuuuugcugcgcaccaaugccca

SEQ ID NO: 1467406 - RNA, 12 nt, Homo sapiens
cuuuuguacuga

SEQ ID NO: 1467407 - RNA, 13 nt, Homo sapiens
cuuuuguguacag

SEQ ID NO: 1467408 - RNA, 18 nt, Homo sapiens
cuuuuuaaagaaugcucu

SEQ ID NO: 1467409 - RNA, 18 nt, Homo sapiens
cuuuuuaaccugcaaaau

SEQ ID NO: 1467410 - RNA, 15 nt, Homo sapiens
cuuuuuccaucauuu

SEQ ID NO: 1467411 - RNA, 15 nt, Homo sapiens
cuuuuugugucucca

SEQ ID NO: 1467412 - RNA, 17 nt, Homo sapiens
cuuuuuucaaaagaaag

SEQ ID NO: 1467413 - RNA, 22 nt, Homo sapiens
cuuuuuuuauaucagaaugagg

SEQ ID NO: 1467414 - RNA, 18 nt, Homo sapiens
cuuuuuuucuuguaugca

SEQ ID NO: 1467415 - RNA, 18 nt, Homo sapiens
gaaaaaaaaaacuaucaa

SEQ ID NO: 1467416 - RNA, 17 nt, Homo sapiens
gaaaaaaaaagaauuac

SEQ ID NO: 1467417 - RNA, 18 nt, Homo sapiens
gaaaaaaaccacacaaag

SEQ ID NO: 1467418 - RNA, 13 nt, Homo sapiens
gaaaaaauggaug

SEQ ID NO: 1467419 - RNA, 16 nt, Homo sapiens
gaaaaacaaaugccau

SEQ ID NO: 1467420 - RNA, 19 nt, Homo sapiens
gaaaaacaccgcuucugcc

SEQ ID NO: 1467421 - RNA, 15 nt, Homo sapiens
gaaaaacagacaaaa

SEQ ID NO: 1467422 - RNA, 13 nt, Homo sapiens
gaaaaauaaaucu

SEQ ID NO: 1467423 - RNA, 12 nt, Homo sapiens
gaaaaauaauca

SEQ ID NO: 1467424 - RNA, 19 nt, Homo sapiens
gaaaaaucuaagugauaua

SEQ ID NO: 1467425 - RNA, 18 nt, Homo sapiens
gaaaacaucucaauaaca

SEQ ID NO: 1467426 - RNA, 22 nt, Homo sapiens
gaaaacuagauugcuaguuuau

SEQ ID NO: 1467427 - RNA, 16 nt, Homo sapiens
gaaaacuguuaccuaa

SEQ ID NO: 1467428 - RNA, 19 nt, Homo sapiens
gaaaacuguuaccuaaagu

SEQ ID NO: 1467429 - RNA, 13 nt, Homo sapiens
gaaaacuugacau

SEQ ID NO: 1467430 - RNA, 17 nt, Homo sapiens
gaaaagaaaguguuuua

SEQ ID NO: 1467431 - RNA, 14 nt, Homo sapiens
gaaaagaagacucu

SEQ ID NO: 1467432 - RNA, 17 nt, Homo sapiens
gaaaagauuuaagcaca

SEQ ID NO: 1467433 - RNA, 20 nt, Homo sapiens
gaaaagcaaaugacuaguaa

SEQ ID NO: 1467434 - RNA, 11 nt, Homo sapiens
gaaaagccaaa

SEQ ID NO: 1467435 - RNA, 15 nt, Homo sapiens
gaaaagguugccuga

SEQ ID NO: 1467436 - RNA, 20 nt, Homo sapiens
gaaaaguggagaaauggcaa

SEQ ID NO: 1467437 - RNA, 23 nt, Homo sapiens
gaaaaguguccuucuugcucccc

SEQ ID NO: 1467438 - RNA, 15 nt, Homo sapiens
gaaaaguguggcuug

SEQ ID NO: 1467439 - RNA, 14 nt, Homo sapiens
gaaaauaaacauca

SEQ ID NO: 1467440 - RNA, 21 nt, Homo sapiens
gaaaauaggggaugguccagg

SEQ ID NO: 1467441 - RNA, 18 nt, Homo sapiens
gaaaaucgaguuggcaaa

SEQ ID NO: 1467442 - RNA, 12 nt, Homo sapiens
gaaaaucuuaca

SEQ ID NO: 1467443 - RNA, 12 nt, Homo sapiens
gaaaaugccuca

SEQ ID NO: 1467444 - RNA, 13 nt, Homo sapiens
gaaaaugccucaa

SEQ ID NO: 1467445 - RNA, 20 nt, Homo sapiens
gaaaaugucagaaaccaguu

SEQ ID NO: 1467446 - RNA, 21 nt, Homo sapiens
gaaaauguugagaaucccaaa

SEQ ID NO: 1467447 - RNA, 17 nt, Homo sapiens
gaaacaaaaauguacaa

SEQ ID NO: 1467448 - RNA, 15 nt, Homo sapiens
gaaacaaacaucuaa

SEQ ID NO: 1467449 - RNA, 15 nt, Homo sapiens
gaaacaauggcuaag

SEQ ID NO: 1467450 - RNA, 20 nt, Homo sapiens
gaaacaauguggagucuccc

SEQ ID NO: 1467451 - RNA, 13 nt, Homo sapiens
gaaggucaccagc

SEQ ID NO: 1467452 - RNA, 14 nt, Homo sapiens
gaaggucaccagca

SEQ ID NO: 1467453 - RNA, 16 nt, Homo sapiens
gaaggucccucagaca

SEQ ID NO: 1467454 - RNA, 18 nt, Homo sapiens
gaaggugcaggugacaga

SEQ ID NO: 1467455 - RNA, 19 nt, Homo sapiens
gaagguucuucaugaucca

SEQ ID NO: 1467456 - RNA, 20 nt, Homo sapiens
gaagguuggugaauuucaca

SEQ ID NO: 1467457 - RNA, 19 nt, Homo sapiens
gaagguuuguauauuguca

SEQ ID NO: 1467458 - RNA, 12 nt, Homo sapiens
gaaguaaagccu

SEQ ID NO: 1467459 - RNA, 15 nt, Homo sapiens
gaaguaugagggaaa

SEQ ID NO: 1467460 - RNA, 13 nt, Homo sapiens
gaagucacaucac

SEQ ID NO: 1467461 - RNA, 18 nt, Homo sapiens
gaaguccccucuacuuua

SEQ ID NO: 1467462 - RNA, 14 nt, Homo sapiens
gaagugagcagugu

SEQ ID NO: 1467463 - RNA, 10 nt, Homo sapiens
gaagugcucu

SEQ ID NO: 1467464 - RNA, 16 nt, Homo sapiens
gaaguuccaguguucu

SEQ ID NO: 1467465 - RNA, 17 nt, Homo sapiens
gaaguugacuuauagua

SEQ ID NO: 1467466 - RNA, 15 nt, Homo sapiens
gaaguuuacaaucaa

SEQ ID NO: 1467467 - RNA, 15 nt, Homo sapiens
gaaguuucccuuccu

SEQ ID NO: 1467468 - RNA, 16 nt, Homo sapiens
gaauaaaguccaaagu

SEQ ID NO: 1467469 - RNA, 15 nt, Homo sapiens
gaauaaccacuuaaa

SEQ ID NO: 1467470 - RNA, 20 nt, Homo sapiens
gaauaacuguguuuccuacc

SEQ ID NO: 1467471 - RNA, 15 nt, Homo sapiens
gaauaagcacuugaa

SEQ ID NO: 1467472 - RNA, 15 nt, Homo sapiens
gaauagccuggccac

SEQ ID NO: 1467473 - RNA, 19 nt, Homo sapiens
gaauauaaaugggaaauca

SEQ ID NO: 1467474 - RNA, 13 nt, Homo sapiens
gaauauagagggu

SEQ ID NO: 1467475 - RNA, 16 nt, Homo sapiens
gaauauauuuccuuau

SEQ ID NO: 1467476 - RNA, 19 nt, Homo sapiens
gaauaucuguaaugguacu

SEQ ID NO: 1467477 - RNA, 21 nt, Homo sapiens
gaauauugcuuuggucauaug

SEQ ID NO: 1467478 - RNA, 18 nt, Homo sapiens
gaauauugucugccuuaa

SEQ ID NO: 1467479 - RNA, 18 nt, Homo sapiens
gaauauuuaagaaaagca

SEQ ID NO: 1467480 - RNA, 22 nt, Homo sapiens
gaaucaaagcaguuaacuuuaa

SEQ ID NO: 1467481 - RNA, 18 nt, Homo sapiens
gaaucacuagguaacuua

SEQ ID NO: 1467482 - RNA, 13 nt, Homo sapiens
gaaucacuggaac

SEQ ID NO: 1467483 - RNA, 22 nt, Homo sapiens
gaaucagcauuuagucuugcca

SEQ ID NO: 1467484 - RNA, 16 nt, Homo sapiens
gaaucccccuugccac

SEQ ID NO: 1467485 - RNA, 21 nt, Homo sapiens
gaauccuggaccaagcacaaa

SEQ ID NO: 1467486 - RNA, 23 nt, Homo sapiens
gaauccuuuggugccaacuggug

SEQ ID NO: 1467487 - RNA, 16 nt, Homo sapiens
gaaucucguucccaaa

SEQ ID NO: 1467488 - RNA, 14 nt, Homo sapiens
gaaucuggagacca

SEQ ID NO: 1467489 - RNA, 22 nt, Homo sapiens
gaaucuggcaggaaucuaucca

SEQ ID NO: 1467490 - RNA, 19 nt, Homo sapiens
gaaucugugggucugggag

SEQ ID NO: 1467491 - RNA, 21 nt, Homo sapiens
gaaucugugugaaacuuucau

SEQ ID NO: 1467492 - RNA, 20 nt, Homo sapiens
gcggcucaaaaggaaaccaa

SEQ ID NO: 1467493 - RNA, 17 nt, Homo sapiens
gcggcuucaccugcgug

SEQ ID NO: 1467494 - RNA, 13 nt, Homo sapiens
gcgggaggcggug

SEQ ID NO: 1467495 - RNA, 14 nt, Homo sapiens
gcgggcuaacggga

SEQ ID NO: 1467496 - RNA, 21 nt, Homo sapiens
gcgguagccagcacacagggc

SEQ ID NO: 1467497 - RNA, 15 nt, Homo sapiens
gcggucaauuugccu

SEQ ID NO: 1467498 - RNA, 23 nt, Homo sapiens
gcgguuccucaucugagaggcuc

SEQ ID NO: 1467499 - RNA, 14 nt, Homo sapiens
gcguacagaucucu

SEQ ID NO: 1467500 - RNA, 20 nt, Homo sapiens
gcgucaucucugacacggcc

SEQ ID NO: 1467501 - RNA, 23 nt, Homo sapiens
gcgucucccucgcagagcccuuc

SEQ ID NO: 1467502 - RNA, 21 nt, Homo sapiens
gcgugcucccgaugcugcuau

SEQ ID NO: 1467503 - RNA, 15 nt, Homo sapiens
gcguggcggagcugc

SEQ ID NO: 1467504 - RNA, 23 nt, Homo sapiens
gcguggcggagcugcugcugcuc

SEQ ID NO: 1467505 - RNA, 12 nt, Homo sapiens
gcguuacugcuu

SEQ ID NO: 1467506 - RNA, 21 nt, Homo sapiens
gcuaaagagcuuugugauaua

SEQ ID NO: 1467507 - RNA, 23 nt, Homo sapiens
gcuaaauaaauggguguauauaa

SEQ ID NO: 1467508 - RNA, 22 nt, Homo sapiens
gcuaaauccucauguuacucag

SEQ ID NO: 1467509 - RNA, 16 nt, Homo sapiens
gcuaaauucuauguua

SEQ ID NO: 1467510 - RNA, 13 nt, Homo sapiens
gcuaagaaccugg

SEQ ID NO: 1467511 - RNA, 17 nt, Homo sapiens
gcuaaggacauuuccca

SEQ ID NO: 1467512 - RNA, 21 nt, Homo sapiens
gcuaauugcuggcuggcugcc

SEQ ID NO: 1467513 - RNA, 17 nt, Homo sapiens
gcuacaguuauuaaucu

SEQ ID NO: 1467514 - RNA, 17 nt, Homo sapiens
gcuacccaugacuuuau

SEQ ID NO: 1467515 - RNA, 17 nt, Homo sapiens
gcuaccuacauacaauu

SEQ ID NO: 1467516 - RNA, 12 nt, Homo sapiens
gcuaccugaugg

SEQ ID NO: 1467517 - RNA, 16 nt, Homo sapiens
gcuacuccauccugaa

SEQ ID NO: 1467518 - RNA, 23 nt, Homo sapiens
gcuagaaggcaaagugcacauga

SEQ ID NO: 1467519 - RNA, 14 nt, Homo sapiens
gcuagggagugguc

SEQ ID NO: 1467520 - RNA, 19 nt, Homo sapiens
gcuaggguggcccuugcag

SEQ ID NO: 1467521 - RNA, 12 nt, Homo sapiens
gcuagugccuuu

SEQ ID NO: 1467522 - RNA, 15 nt, Homo sapiens
gcuauauccauguac

SEQ ID NO: 1467523 - RNA, 17 nt, Homo sapiens
gcuauauccauguacug

SEQ ID NO: 1467524 - RNA, 16 nt, Homo sapiens
gcuaucacacaguggg

SEQ ID NO: 1467525 - RNA, 19 nt, Homo sapiens
gcuaucacuguacuuguag

SEQ ID NO: 1467526 - RNA, 15 nt, Homo sapiens
gcuauccaaauaacu

SEQ ID NO: 1467527 - RNA, 21 nt, Homo sapiens
gcuauggaggguccuccucca

SEQ ID NO: 1467528 - RNA, 11 nt, Homo sapiens
gcuauggugcu

SEQ ID NO: 1467529 - RNA, 17 nt, Homo sapiens
gcuauguaaauauacaa

SEQ ID NO: 1467530 - RNA, 15 nt, Homo sapiens
gcuauuuccauucca

SEQ ID NO: 1467531 - RNA, 20 nt, Homo sapiens
gcuauuucuucuacugcuau

SEQ ID NO: 1467532 - RNA, 11 nt, Homo sapiens
gcuauuugccu

SEQ ID NO: 1467533 - RNA, 17 nt, Homo sapiens
gcuauuuggacucaggu

SEQ ID NO: 1467534 - RNA, 21 nt, Homo sapiens
gcucaagcgauccucccaccu

SEQ ID NO: 1467535 - RNA, 19 nt, Homo sapiens
gcucaauauuccugaauga

SEQ ID NO: 1467536 - RNA, 13 nt, Homo sapiens
gcucaauuccuuc

SEQ ID NO: 1467537 - RNA, 13 nt, Homo sapiens
gcucacaguacag

SEQ ID NO: 1467538 - RNA, 12 nt, Homo sapiens
gcucacaguccu

SEQ ID NO: 1467539 - RNA, 16 nt, Homo sapiens
gcucacccagucaccu

SEQ ID NO: 1467540 - RNA, 20 nt, Homo sapiens
gcucacgccuguaauucuag

SEQ ID NO: 1467541 - RNA, 16 nt, Homo sapiens
gcucacggcacgcuug

SEQ ID NO: 1467542 - RNA, 15 nt, Homo sapiens
gcucagaaaggaaau

SEQ ID NO: 1467543 - RNA, 14 nt, Homo sapiens
gcucagaacccauc

SEQ ID NO: 1467544 - RNA, 21 nt, Homo sapiens
gcucagagacugcaagcugcu

SEQ ID NO: 1467545 - RNA, 23 nt, Homo sapiens
gcucagaggcccaggaaucggag

SEQ ID NO: 1467546 - RNA, 18 nt, Homo sapiens
gcucaggagccaccagca

SEQ ID NO: 1467547 - RNA, 14 nt, Homo sapiens
gcucauaagcaaua

SEQ ID NO: 1467548 - RNA, 20 nt, Homo sapiens
gcucauaagcaauaccagca

SEQ ID NO: 1467549 - RNA, 17 nt, Homo sapiens
gcucauagaucagcaaa

SEQ ID NO: 1467550 - RNA, 21 nt, Homo sapiens
gcucauaugcauguagucacu

SEQ ID NO: 1467551 - RNA, 19 nt, Homo sapiens
gcucauuuacacucagcug

SEQ ID NO: 1467552 - RNA, 11 nt, Homo sapiens
gcuccacugaa

SEQ ID NO: 1467553 - RNA, 16 nt, Homo sapiens
gcuccagaugcagggc

SEQ ID NO: 1467554 - RNA, 19 nt, Homo sapiens
gcuccagaugcagggcagu

SEQ ID NO: 1467555 - RNA, 19 nt, Homo sapiens
gcuccaucccaaccaggca

SEQ ID NO: 1467556 - RNA, 22 nt, Homo sapiens
gcuccaucccaaccaggcaccu

SEQ ID NO: 1467557 - RNA, 16 nt, Homo sapiens
gcuccauuaauccagg

SEQ ID NO: 1467558 - RNA, 13 nt, Homo sapiens
gcuccccaaaagg

SEQ ID NO: 1467559 - RNA, 16 nt, Homo sapiens
gcuccccccaguggga

SEQ ID NO: 1467560 - RNA, 20 nt, Homo sapiens
gcucccuaccccagggcccu

SEQ ID NO: 1467561 - RNA, 21 nt, Homo sapiens
gcucccucuauuuauguuugc

SEQ ID NO: 1467562 - RNA, 16 nt, Homo sapiens
gcuccgcugcuccuug

SEQ ID NO: 1467563 - RNA, 21 nt, Homo sapiens
gcuccucuccccagcccagag

SEQ ID NO: 1467564 - RNA, 15 nt, Homo sapiens
gcuccuggggcaaug

SEQ ID NO: 1467565 - RNA, 16 nt, Homo sapiens
gcuccuuuacaaaaga

SEQ ID NO: 1467566 - RNA, 21 nt, Homo sapiens
gcuccuuucuccagccagcaa

SEQ ID NO: 1467567 - RNA, 22 nt, Homo sapiens
gcucgccccagcaggugcugac

SEQ ID NO: 1467568 - RNA, 15 nt, Homo sapiens
gcucgcccuccuuuc

SEQ ID NO: 1467569 - RNA, 23 nt, Homo sapiens
gcucuauaagagcuggaugcaca

SEQ ID NO: 1467570 - RNA, 21 nt, Homo sapiens
gcucuauauaugaagugaaaa

SEQ ID NO: 1467571 - RNA, 13 nt, Homo sapiens
gcucuauuuacuu

SEQ ID NO: 1467572 - RNA, 12 nt, Homo sapiens
gcucucagcuca

SEQ ID NO: 1467573 - RNA, 15 nt, Homo sapiens
gcucuccaucuucca

SEQ ID NO: 1467574 - RNA, 21 nt, Homo sapiens
gcucuccccaaacuugcuuua

SEQ ID NO: 1467575 - RNA, 23 nt, Homo sapiens
gcucuccccaaacuugcuuuaug

SEQ ID NO: 1467576 - RNA, 13 nt, Homo sapiens
gcucucgacagua

SEQ ID NO: 1467577 - RNA, 19 nt, Homo sapiens
gcucugagaaaccucggga

SEQ ID NO: 1467578 - RNA, 20 nt, Homo sapiens
gcucuguaggucauuggcca

SEQ ID NO: 1467579 - RNA, 14 nt, Homo sapiens
gcucuguuacccag

SEQ ID NO: 1467580 - RNA, 14 nt, Homo sapiens
gcucuuaaauguag

SEQ ID NO: 1467581 - RNA, 16 nt, Homo sapiens
gcucuuagcagcuucc

SEQ ID NO: 1467582 - RNA, 15 nt, Homo sapiens
gcucuucacuguggu

SEQ ID NO: 1467583 - RNA, 11 nt, Homo sapiens
gcucuugcagu

SEQ ID NO: 1467584 - RNA, 12 nt, Homo sapiens
gcucuuguuauu

SEQ ID NO: 1467585 - RNA, 15 nt, Homo sapiens
gcucuuuggggucag

SEQ ID NO: 1467586 - RNA, 17 nt, Homo sapiens
gcugaaaaaucauccaa

SEQ ID NO: 1467587 - RNA, 19 nt, Homo sapiens
gcugaaaaaucauccaaga

SEQ ID NO: 1467588 - RNA, 12 nt, Homo sapiens
gcugaacacugg

SEQ ID NO: 1467589 - RNA, 14 nt, Homo sapiens
gcugaagaccuaaa

SEQ ID NO: 1467590 - RNA, 18 nt, Homo sapiens
gcugaaggcuuacuucag

SEQ ID NO: 1467591 - RNA, 15 nt, Homo sapiens
gcugaagugucacag

SEQ ID NO: 1467592 - RNA, 20 nt, Homo sapiens
gcugaccacagcacagccaa

SEQ ID NO: 1467593 - RNA, 16 nt, Homo sapiens
gcugaccucccaguga

SEQ ID NO: 1467594 - RNA, 16 nt, Homo sapiens
gauuaugaaagcaaca

SEQ ID NO: 1467595 - RNA, 22 nt, Homo sapiens
gauuaugaagugacucucacaa

SEQ ID NO: 1467596 - RNA, 22 nt, Homo sapiens
gauucaaaguguuguguuccug

SEQ ID NO: 1467597 - RNA, 15 nt, Homo sapiens
gauucaggggucuga

SEQ ID NO: 1467598 - RNA, 23 nt, Homo sapiens
gauucauuauuuuuccacuuugu

SEQ ID NO: 1467599 - RNA, 21 nt, Homo sapiens
gauucauucucauaauuccua

SEQ ID NO: 1467600 - RNA, 22 nt, Homo sapiens
gauucauuuuccuguucaguga

SEQ ID NO: 1467601 - RNA, 12 nt, Homo sapiens
gauuccagagag

SEQ ID NO: 1467602 - RNA, 20 nt, Homo sapiens
gauuccagcccacauuggau

SEQ ID NO: 1467603 - RNA, 21 nt, Homo sapiens
gauuccguauugguauacuuu

SEQ ID NO: 1467604 - RNA, 13 nt, Homo sapiens
gauuccucagggu

SEQ ID NO: 1467605 - RNA, 15 nt, Homo sapiens
gauucugaaucucaa

SEQ ID NO: 1467606 - RNA, 12 nt, Homo sapiens
gauucugagcag

SEQ ID NO: 1467607 - RNA, 20 nt, Homo sapiens
gauucugagcagugccucuu

SEQ ID NO: 1467608 - RNA, 18 nt, Homo sapiens
gauucugagccauucaca

SEQ ID NO: 1467609 - RNA, 19 nt, Homo sapiens
gauucugcaguaaaucuuu

SEQ ID NO: 1467610 - RNA, 18 nt, Homo sapiens
gauucuuuccauuaugau

SEQ ID NO: 1467611 - RNA, 16 nt, Homo sapiens
gauugaaagaaccaga

SEQ ID NO: 1467612 - RNA, 12 nt, Homo sapiens
gauugaacucca

SEQ ID NO: 1467613 - RNA, 17 nt, Homo sapiens
gauugaaggugaccucu

SEQ ID NO: 1467614 - RNA, 16 nt, Homo sapiens
gauugaauuucacugu

SEQ ID NO: 1467615 - RNA, 17 nt, Homo sapiens
gauugacacacagcacu

SEQ ID NO: 1467616 - RNA, 18 nt, Homo sapiens
gauugacacacagcacuc

SEQ ID NO: 1467617 - RNA, 20 nt, Homo sapiens
gauuggauuauucauuuaaa

SEQ ID NO: 1467618 - RNA, 17 nt, Homo sapiens
gauuggcucacccaagc

SEQ ID NO: 1467619 - RNA, 20 nt, Homo sapiens
gauuguuuauacuccagugu

SEQ ID NO: 1467620 - RNA, 22 nt, Homo sapiens
gauuuaauuuccaggguugcuu

SEQ ID NO: 1467621 - RNA, 22 nt, Homo sapiens
gauuuacuaaaucaaucugcag

SEQ ID NO: 1467622 - RNA, 15 nt, Homo sapiens
gauuucaugauuuca

SEQ ID NO: 1467623 - RNA, 14 nt, Homo sapiens
gauuucaugccugg

SEQ ID NO: 1467624 - RNA, 17 nt, Homo sapiens
gauuucugguuguuaug

SEQ ID NO: 1467625 - RNA, 21 nt, Homo sapiens
gauuugaacccccgccauccu

SEQ ID NO: 1467626 - RNA, 19 nt, Homo sapiens
gauuugaagaacaugugag

SEQ ID NO: 1467627 - RNA, 20 nt, Homo sapiens
gauuugcaggugaacagccu

SEQ ID NO: 1467628 - RNA, 20 nt, Homo sapiens
gauuugccguaccaaucucu

SEQ ID NO: 1467629 - RNA, 14 nt, Homo sapiens
gauuuguagcacug

SEQ ID NO: 1467630 - RNA, 19 nt, Homo sapiens
gauuuuaaaaagucuucac

SEQ ID NO: 1467631 - RNA, 15 nt, Homo sapiens
gauuuuaacaauaac

SEQ ID NO: 1467632 - RNA, 14 nt, Homo sapiens
gauuuuagccaugc

SEQ ID NO: 1467633 - RNA, 23 nt, Homo sapiens
gauuuuucuaaccuugaaugcug

SEQ ID NO: 1467634 - RNA, 19 nt, Homo sapiens
gauuuuugacucuggcaaa

SEQ ID NO: 1467635 - RNA, 15 nt, Homo sapiens
gcaaaaaaugaaugu

SEQ ID NO: 1467636 - RNA, 19 nt, Homo sapiens
gcaaaaauggauauuauua

SEQ ID NO: 1467637 - RNA, 14 nt, Homo sapiens
gcaaaaggcagcuc

SEQ ID NO: 1467638 - RNA, 19 nt, Homo sapiens
gcaaaaucucuacugcuuu

SEQ ID NO: 1467639 - RNA, 23 nt, Homo sapiens
gcaaaauguuagcauguaugaca

SEQ ID NO: 1467640 - RNA, 18 nt, Homo sapiens
gcaaaauugauguguuua

SEQ ID NO: 1467641 - RNA, 14 nt, Homo sapiens
gcaaaccauuuuua

SEQ ID NO: 1467642 - RNA, 21 nt, Homo sapiens
gcaaacugccaucauuuacuu

SEQ ID NO: 1467643 - RNA, 22 nt, Homo sapiens
gcaaagaccgauugcauaggaa

SEQ ID NO: 1467644 - RNA, 17 nt, Homo sapiens
gcaaagaucuguccuca

SEQ ID NO: 1467645 - RNA, 21 nt, Homo sapiens
gcaaagcaccagcuucuccag

SEQ ID NO: 1467646 - RNA, 19 nt, Homo sapiens
gcaaagggcugaaagccau

SEQ ID NO: 1467647 - RNA, 18 nt, Homo sapiens
gcaaagguggcucuccag

SEQ ID NO: 1467648 - RNA, 23 nt, Homo sapiens
gcaaauaguaaucuguaagcaua

SEQ ID NO: 1467649 - RNA, 19 nt, Homo sapiens
gcaaaucuacagauccuuu

SEQ ID NO: 1467650 - RNA, 14 nt, Homo sapiens
gcaaaugaguauuu

SEQ ID NO: 1467651 - RNA, 16 nt, Homo sapiens
gcaacagacuguugag

SEQ ID NO: 1467652 - RNA, 21 nt, Homo sapiens
gcaacagauaaguuugcaguu

SEQ ID NO: 1467653 - RNA, 22 nt, Homo sapiens
gcaacaguacuucaaacagaac

SEQ ID NO: 1467654 - RNA, 16 nt, Homo sapiens
gcaacauuguccuuaa

SEQ ID NO: 1467655 - RNA, 16 nt, Homo sapiens
gcaaccucuuugcuca

SEQ ID NO: 1467656 - RNA, 22 nt, Homo sapiens
gcaaccucuuugcucaacagaa

SEQ ID NO: 1467657 - RNA, 13 nt, Homo sapiens
gcaacucacacau

SEQ ID NO: 1467658 - RNA, 17 nt, Homo sapiens
gcaagaauauugucccu

SEQ ID NO: 1467659 - RNA, 15 nt, Homo sapiens
gcaagaccagucacu

SEQ ID NO: 1467660 - RNA, 13 nt, Homo sapiens
gcaagacugucuc

SEQ ID NO: 1467661 - RNA, 17 nt, Homo sapiens
gcugaccuggagaugcu

SEQ ID NO: 1467662 - RNA, 18 nt, Homo sapiens
gcugacuagaagggccag

SEQ ID NO: 1467663 - RNA, 16 nt, Homo sapiens
gcugagaauguggaau

SEQ ID NO: 1467664 - RNA, 20 nt, Homo sapiens
gcugagaccacugaguacca

SEQ ID NO: 1467665 - RNA, 14 nt, Homo sapiens
gcugagagaccuga

SEQ ID NO: 1467666 - RNA, 14 nt, Homo sapiens
gcugagauuccugg

SEQ ID NO: 1467667 - RNA, 16 nt, Homo sapiens
gcugaggccacacuca

SEQ ID NO: 1467668 - RNA, 18 nt, Homo sapiens
gcugagugaaugaacaaa

SEQ ID NO: 1467669 - RNA, 16 nt, Homo sapiens
gcugagugcaccacuu

SEQ ID NO: 1467670 - RNA, 18 nt, Homo sapiens
gcugaguggccagccagu

SEQ ID NO: 1467671 - RNA, 13 nt, Homo sapiens
gcugauggcagcu

SEQ ID NO: 1467672 - RNA, 19 nt, Homo sapiens
gcugauggugacauugcac

SEQ ID NO: 1467673 - RNA, 14 nt, Homo sapiens
gcugauugaagaca

SEQ ID NO: 1467674 - RNA, 15 nt, Homo sapiens
gcugauuuuaacaau

SEQ ID NO: 1467675 - RNA, 16 nt, Homo sapiens
gcugcacccacccagg

SEQ ID NO: 1467676 - RNA, 13 nt, Homo sapiens
gcugcaccugguc

SEQ ID NO: 1467677 - RNA, 18 nt, Homo sapiens
gcugcacugaucacccaa

SEQ ID NO: 1467678 - RNA, 21 nt, Homo sapiens
gcugcagccugccccuagaca

SEQ ID NO: 1467679 - RNA, 12 nt, Homo sapiens
gcugcagcugug

SEQ ID NO: 1467680 - RNA, 18 nt, Homo sapiens
gcugcagggccacuggaa

SEQ ID NO: 1467681 - RNA, 22 nt, Homo sapiens
gcugcagguuccuuaucuguca

SEQ ID NO: 1467682 - RNA, 20 nt, Homo sapiens
gcugccagaugauuguucaa

SEQ ID NO: 1467683 - RNA, 19 nt, Homo sapiens
gcugccccugcaguuggca

SEQ ID NO: 1467684 - RNA, 23 nt, Homo sapiens
gcugccuucccuagcuuuagacc

SEQ ID NO: 1467685 - RNA, 15 nt, Homo sapiens
gcugcuaaaggacag

SEQ ID NO: 1467686 - RNA, 18 nt, Homo sapiens
gcugcuacuacuccugua

SEQ ID NO: 1467687 - RNA, 13 nt, Homo sapiens
gcugcuccgcccg

SEQ ID NO: 1467688 - RNA, 17 nt, Homo sapiens
gcugcugggucaggcca

SEQ ID NO: 1467689 - RNA, 14 nt, Homo sapiens
gcugcuucugcaaa

SEQ ID NO: 1467690 - RNA, 23 nt, Homo sapiens
gcuggaaaaccuccuuuaccaga

SEQ ID NO: 1467691 - RNA, 19 nt, Homo sapiens
gcuggaauuacaaaacuca

SEQ ID NO: 1467692 - RNA, 12 nt, Homo sapiens
gcuggaauucua

SEQ ID NO: 1467693 - RNA, 18 nt, Homo sapiens
gcuggacggggacugggg

SEQ ID NO: 1467694 - RNA, 17 nt, Homo sapiens
gcuggacuucuaccugc

SEQ ID NO: 1467695 - RNA, 20 nt, Homo sapiens
gcuggagugcaguagcacga

SEQ ID NO: 1467696 - RNA, 18 nt, Homo sapiens
gcuggcaaccacuaagaa

SEQ ID NO: 1467697 - RNA, 16 nt, Homo sapiens
gcuggcaagucuucca

SEQ ID NO: 1467698 - RNA, 22 nt, Homo sapiens
gcuggcaagucuuccaugaccc

SEQ ID NO: 1467699 - RNA, 15 nt, Homo sapiens
gcuggcaucaagagg

SEQ ID NO: 1467700 - RNA, 15 nt, Homo sapiens
gcuggcccagccaaa

SEQ ID NO: 1467701 - RNA, 17 nt, Homo sapiens
gcuggccccuucugggg

SEQ ID NO: 1467702 - RNA, 21 nt, Homo sapiens
gcuggccuccuaugccucauc

SEQ ID NO: 1467703 - RNA, 18 nt, Homo sapiens
gcuggcucugcacuaaga

SEQ ID NO: 1467704 - RNA, 13 nt, Homo sapiens
gcuggcuugcagu

SEQ ID NO: 1467705 - RNA, 22 nt, Homo sapiens
gcuggcuuugcacuugaccuca

SEQ ID NO: 1467706 - RNA, 23 nt, Homo sapiens
gcugggacguggcucagccagca

SEQ ID NO: 1467707 - RNA, 16 nt, Homo sapiens
gcugggauuacaggug

SEQ ID NO: 1467708 - RNA, 16 nt, Homo sapiens
gcugggcagaccccuc

SEQ ID NO: 1467709 - RNA, 13 nt, Homo sapiens
gcugggccauguc

SEQ ID NO: 1467710 - RNA, 17 nt, Homo sapiens
gcugggccauguccaaa

SEQ ID NO: 1467711 - RNA, 18 nt, Homo sapiens
gcugggccauguccaaag

SEQ ID NO: 1467712 - RNA, 17 nt, Homo sapiens
gcugggcugagugacac

SEQ ID NO: 1467713 - RNA, 17 nt, Homo sapiens
gcugggcugggcaguau

SEQ ID NO: 1467714 - RNA, 14 nt, Homo sapiens
gcuggggugucaau

SEQ ID NO: 1467715 - RNA, 15 nt, Homo sapiens
gcuggggugucaaua

SEQ ID NO: 1467716 - RNA, 18 nt, Homo sapiens
gcugguaacaguggcugc

SEQ ID NO: 1467717 - RNA, 14 nt, Homo sapiens
gcugguggcaauaa

SEQ ID NO: 1467718 - RNA, 19 nt, Homo sapiens
gcuggugggacagugguga

SEQ ID NO: 1467719 - RNA, 19 nt, Homo sapiens
gcugguugaaaaauggcaa

SEQ ID NO: 1467720 - RNA, 20 nt, Homo sapiens
gcugguuuuccuaaaugcag

SEQ ID NO: 1467721 - RNA, 20 nt, Homo sapiens
gcuguaacguggcacuggua

SEQ ID NO: 1467722 - RNA, 16 nt, Homo sapiens
gcugucaagcaccugc

SEQ ID NO: 1467723 - RNA, 22 nt, Homo sapiens
gcugucagcccaugugcaccug

SEQ ID NO: 1467724 - RNA, 20 nt, Homo sapiens
gcugucaguaugacauuuca

SEQ ID NO: 1467725 - RNA, 18 nt, Homo sapiens
gcugucaucugugcacug

SEQ ID NO: 1467726 - RNA, 17 nt, Homo sapiens
gcuguccugaucuguga

SEQ ID NO: 1467727 - RNA, 19 nt, Homo sapiens
gcugugaggccccuggaca

SEQ ID NO: 1467728 - RNA, 14 nt, Homo sapiens
gcuguggaugcuuc

SEQ ID NO: 1467729 - RNA, 18 nt, Homo sapiens
gcuguguuuccaucucaa

SEQ ID NO: 1467730 - RNA, 23 nt, Homo sapiens
gcuguguuugcagccugcucuag

SEQ ID NO: 1467731 - RNA, 20 nt, Homo sapiens
gcuguuauuuuaucugcuau

SEQ ID NO: 1467732 - RNA, 14 nt, Homo sapiens
gcuguuccugagaa

SEQ ID NO: 1467733 - RNA, 17 nt, Homo sapiens
gcuguucucuucuucau

SEQ ID NO: 1467734 - RNA, 21 nt, Homo sapiens
gcuguucuucuguucugcaga

SEQ ID NO: 1467735 - RNA, 22 nt, Homo sapiens
gcuguugcgcucccaccucagc

SEQ ID NO: 1467736 - RNA, 22 nt, Homo sapiens
gcuugaagcuguggagggccac

SEQ ID NO: 1467737 - RNA, 15 nt, Homo sapiens
gcuugacaacaaccu

SEQ ID NO: 1467738 - RNA, 13 nt, Homo sapiens
gcuugaccaaaga

SEQ ID NO: 1467739 - RNA, 14 nt, Homo sapiens
gcuugcaugccaaa

SEQ ID NO: 1467740 - RNA, 19 nt, Homo sapiens
gcuuggcccuuuccuucca

SEQ ID NO: 1467741 - RNA, 23 nt, Homo sapiens
gcuuggccuacagucaucugcca

SEQ ID NO: 1467742 - RNA, 21 nt, Homo sapiens
gcuugggaaaaaaacuuggca

SEQ ID NO: 1467743 - RNA, 17 nt, Homo sapiens
gcuugggcccugcacag

SEQ ID NO: 1467744 - RNA, 19 nt, Homo sapiens
gcuugggcccugcacagau

SEQ ID NO: 1467745 - RNA, 16 nt, Homo sapiens
gcuuguaucaacacug

SEQ ID NO: 1467746 - RNA, 21 nt, Homo sapiens
gcuuuaauaagcgagaccuaa

SEQ ID NO: 1467747 - RNA, 22 nt, Homo sapiens
gcuuuagaugaggaaaugaucc

SEQ ID NO: 1467748 - RNA, 20 nt, Homo sapiens
gcuuuauuccagaaugcugu

SEQ ID NO: 1467749 - RNA, 20 nt, Homo sapiens
gcuuuauuuuuuaaguauuu

SEQ ID NO: 1467750 - RNA, 18 nt, Homo sapiens
gcuuucuaaaguuaccug

SEQ ID NO: 1467751 - RNA, 17 nt, Homo sapiens
gcuuugaguuaacucac

SEQ ID NO: 1467752 - RNA, 15 nt, Homo sapiens
gcuuugcaaacauca

SEQ ID NO: 1467753 - RNA, 21 nt, Homo sapiens
gcuuugcaaacaucaaccugg

SEQ ID NO: 1467754 - RNA, 23 nt, Homo sapiens
gcuuugcugaccaaaugccuggu

SEQ ID NO: 1467755 - RNA, 16 nt, Homo sapiens
gcuuuggauuugacau

SEQ ID NO: 1467756 - RNA, 20 nt, Homo sapiens
gcuuuguguuugguuuacau

SEQ ID NO: 1467757 - RNA, 22 nt, Homo sapiens
gcuuuugccaguauuaugcaua

SEQ ID NO: 1467758 - RNA, 18 nt, Homo sapiens
ggaaaaacaaaugccaua

SEQ ID NO: 1467759 - RNA, 22 nt, Homo sapiens
ggaaaagaagaaacuuugccuc

SEQ ID NO: 1467760 - RNA, 13 nt, Homo sapiens
ggaaaagcaaaac

SEQ ID NO: 1467761 - RNA, 12 nt, Homo sapiens
ggaaaaugacuc

SEQ ID NO: 1467762 - RNA, 12 nt, Homo sapiens
ggaaaaugugac

SEQ ID NO: 1467763 - RNA, 21 nt, Homo sapiens
ggaaaccaguuuggugauaua

SEQ ID NO: 1467764 - RNA, 14 nt, Homo sapiens
ggaaacccccagug

SEQ ID NO: 1467765 - RNA, 16 nt, Homo sapiens
ggaaaccgccuaguuu

SEQ ID NO: 1467766 - RNA, 17 nt, Homo sapiens
ggaaacucacacucccc

SEQ ID NO: 1467767 - RNA, 14 nt, Homo sapiens
ggaaacugcuaaau

SEQ ID NO: 1467768 - RNA, 15 nt, Homo sapiens
ggaaacugcucccau

SEQ ID NO: 1467769 - RNA, 21 nt, Homo sapiens
ggaaacugcucccaucauucc

SEQ ID NO: 1467770 - RNA, 17 nt, Homo sapiens
ggaaaguaaauauuuca

SEQ ID NO: 1467771 - RNA, 12 nt, Homo sapiens
ggaaagugcaua

SEQ ID NO: 1467772 - RNA, 23 nt, Homo sapiens
ggaaauaguaccuucaauacuua

SEQ ID NO: 1467773 - RNA, 21 nt, Homo sapiens
ggaaauauuaagaaagacuau

SEQ ID NO: 1467774 - RNA, 20 nt, Homo sapiens
ggaaauauuuuaauguuucu

SEQ ID NO: 1467775 - RNA, 14 nt, Homo sapiens
ggaaauccuaccuu

SEQ ID NO: 1467776 - RNA, 15 nt, Homo sapiens
ggaaaugauguuuca

SEQ ID NO: 1467777 - RNA, 15 nt, Homo sapiens
ggaaaugcugacuuu

SEQ ID NO: 1467778 - RNA, 21 nt, Homo sapiens
ggaaauguauuuugacacugg

SEQ ID NO: 1467779 - RNA, 22 nt, Homo sapiens
ggaacacccgacuccucaaaag

SEQ ID NO: 1467780 - RNA, 13 nt, Homo sapiens
ggaacacuggugg

SEQ ID NO: 1467781 - RNA, 18 nt, Homo sapiens
ggaacagaagacagcugc

SEQ ID NO: 1467782 - RNA, 14 nt, Homo sapiens
ggaacagaccagug

SEQ ID NO: 1467783 - RNA, 18 nt, Homo sapiens
ggaacccagacucagaca

SEQ ID NO: 1467784 - RNA, 20 nt, Homo sapiens
ggaacccugcuugcacuuug

SEQ ID NO: 1467785 - RNA, 15 nt, Homo sapiens
ggaaccuccccucau

SEQ ID NO: 1467786 - RNA, 14 nt, Homo sapiens
ggaacucagaucca

SEQ ID NO: 1467787 - RNA, 16 nt, Homo sapiens
ggaacuccuggccuuu

SEQ ID NO: 1467788 - RNA, 20 nt, Homo sapiens
ggaacucuggcuuccaggua

SEQ ID NO: 1467789 - RNA, 20 nt, Homo sapiens
ggaacugcguggugcucuuu

SEQ ID NO: 1467790 - RNA, 17 nt, Homo sapiens
ggaagaauccaguauua

SEQ ID NO: 1467791 - RNA, 16 nt, Homo sapiens
ggaagacaagcauuuu

SEQ ID NO: 1467792 - RNA, 19 nt, Homo sapiens
ggaagacuagaggcuugca

SEQ ID NO: 1467793 - RNA, 16 nt, Homo sapiens
ggaagacuauggugcu

SEQ ID NO: 1467794 - RNA, 16 nt, Homo sapiens
ggaagcacauguuuau

SEQ ID NO: 1467795 - RNA, 14 nt, Homo sapiens
ggaagccaaagagu

SEQ ID NO: 1467796 - RNA, 17 nt, Homo sapiens
ggaagcuccacugucac

SEQ ID NO: 1467797 - RNA, 16 nt, Homo sapiens
ggaagcugucccucac

SEQ ID NO: 1467798 - RNA, 23 nt, Homo sapiens
ggaagucaucucauuccacuguu

SEQ ID NO: 1467799 - RNA, 13 nt, Homo sapiens
ggaaguccaucug

SEQ ID NO: 1467800 - RNA, 11 nt, Homo sapiens
ggaagucucca

SEQ ID NO: 1467801 - RNA, 17 nt, Homo sapiens
ggaauaaaaacauuucu

SEQ ID NO: 1467802 - RNA, 20 nt, Homo sapiens
ggaauaaccuuccauacauu

SEQ ID NO: 1467803 - RNA, 15 nt, Homo sapiens
ggaauaaggccuuaa

SEQ ID NO: 1467804 - RNA, 15 nt, Homo sapiens
ggaauacugugcaua

SEQ ID NO: 1467805 - RNA, 21 nt, Homo sapiens
ggaauauaaggaaagcaauaa

SEQ ID NO: 1467806 - RNA, 13 nt, Homo sapiens
ggaauauuuccau

SEQ ID NO: 1467807 - RNA, 14 nt, Homo sapiens
ggaaucgacuguau

SEQ ID NO: 1467808 - RNA, 24 nt, Homo sapiens
ggaaucgguggucuccaccuguca

SEQ ID NO: 1467809 - RNA, 12 nt, Homo sapiens
ggaaugccuugg

SEQ ID NO: 1467810 - RNA, 14 nt, Homo sapiens
ggacaaacagggaa

SEQ ID NO: 1467811 - RNA, 14 nt, Homo sapiens
ggacaagaccccca

SEQ ID NO: 1467812 - RNA, 20 nt, Homo sapiens
ggacaccacgauucucccaa

SEQ ID NO: 1467813 - RNA, 21 nt, Homo sapiens
guagguaggaagcacugaaaa

SEQ ID NO: 1467814 - RNA, 15 nt, Homo sapiens
guagucucauuacuu

SEQ ID NO: 1467815 - RNA, 21 nt, Homo sapiens
guagucucuccccuggccaca

SEQ ID NO: 1467816 - RNA, 20 nt, Homo sapiens
guagugaaauuauacagaua

SEQ ID NO: 1467817 - RNA, 16 nt, Homo sapiens
guaguuagccaucuaa

SEQ ID NO: 1467818 - RNA, 14 nt, Homo sapiens
guaguuagcuuaag

SEQ ID NO: 1467819 - RNA, 20 nt, Homo sapiens
guaguuuuguuuaugcauuu

SEQ ID NO: 1467820 - RNA, 13 nt, Homo sapiens
guauaaacacucu

SEQ ID NO: 1467821 - RNA, 19 nt, Homo sapiens
guauaaguggaggcacuuu

SEQ ID NO: 1467822 - RNA, 21 nt, Homo sapiens
guauaaguuauuuuuguacau

SEQ ID NO: 1467823 - RNA, 20 nt, Homo sapiens
guauaauugaccuacuuugg

SEQ ID NO: 1467824 - RNA, 20 nt, Homo sapiens
guauacauaaguuuaggaua

SEQ ID NO: 1467825 - RNA, 21 nt, Homo sapiens
guauaggggcaacuguaugaa

SEQ ID NO: 1467826 - RNA, 19 nt, Homo sapiens
guauauauuuacaugucuu

SEQ ID NO: 1467827 - RNA, 23 nt, Homo sapiens
guauauuugugauagcacuuucu

SEQ ID NO: 1467828 - RNA, 16 nt, Homo sapiens
guaucaacacuguuac

SEQ ID NO: 1467829 - RNA, 14 nt, Homo sapiens
guaucacucuaaaa

SEQ ID NO: 1467830 - RNA, 21 nt, Homo sapiens
guaucagaucuaucuugucaa

SEQ ID NO: 1467831 - RNA, 12 nt, Homo sapiens
guaucauucaac

SEQ ID NO: 1467832 - RNA, 18 nt, Homo sapiens
guccccgagacacaggca

SEQ ID NO: 1467833 - RNA, 18 nt, Homo sapiens
guccccucacucugucag

SEQ ID NO: 1467834 - RNA, 16 nt, Homo sapiens
guccccuccacuguca

SEQ ID NO: 1467835 - RNA, 12 nt, Homo sapiens
gucccuaccugc

SEQ ID NO: 1467836 - RNA, 21 nt, Homo sapiens
gucccuucagcaccugacccu

SEQ ID NO: 1467837 - RNA, 13 nt, Homo sapiens
gucccuugccucu

SEQ ID NO: 1467838 - RNA, 22 nt, Homo sapiens
gucccuuugagcagaaauuuau

SEQ ID NO: 1467839 - RNA, 15 nt, Homo sapiens
guccgaucuuugacu

SEQ ID NO: 1467840 - RNA, 14 nt, Homo sapiens
guccuaagcacuuu

SEQ ID NO: 1467841 - RNA, 15 nt, Homo sapiens
guccuacuccuugca

SEQ ID NO: 1467842 - RNA, 18 nt, Homo sapiens
guccuccagaccaccagc

SEQ ID NO: 1467843 - RNA, 16 nt, Homo sapiens
guccugacacuauuca

SEQ ID NO: 1467844 - RNA, 21 nt, Homo sapiens
guccugacacuauucauuuga

SEQ ID NO: 1467845 - RNA, 21 nt, Homo sapiens
guccugagcaccacacccagu

SEQ ID NO: 1467846 - RNA, 18 nt, Homo sapiens
guccugaugcugugcuca

SEQ ID NO: 1467847 - RNA, 20 nt, Homo sapiens
guccugaugcuuuugucuaa

SEQ ID NO: 1467848 - RNA, 20 nt, Homo sapiens
guccugcagcaaacacucca

SEQ ID NO: 1467849 - RNA, 18 nt, Homo sapiens
guccugggagaaugcaga

SEQ ID NO: 1467850 - RNA, 14 nt, Homo sapiens
guccuggggaccau

SEQ ID NO: 1467851 - RNA, 15 nt, Homo sapiens
guccuguacauugug

SEQ ID NO: 1467852 - RNA, 23 nt, Homo sapiens
guccuuaaaaaucacacuguaaa

SEQ ID NO: 1467853 - RNA, 14 nt, Homo sapiens
guccuuucuugcag

SEQ ID NO: 1467854 - RNA, 16 nt, Homo sapiens
guccuuugggacucau

SEQ ID NO: 1467855 - RNA, 18 nt, Homo sapiens
gucgaugcguucacucca

SEQ ID NO: 1467856 - RNA, 18 nt, Homo sapiens
gucgcaucucagugcagg

SEQ ID NO: 1467857 - RNA, 14 nt, Homo sapiens
gucuaaaauuacau

SEQ ID NO: 1467858 - RNA, 18 nt, Homo sapiens
gucuaaacaaaauugcaa

SEQ ID NO: 1467859 - RNA, 21 nt, Homo sapiens
gucuacauacuuucauccuga

SEQ ID NO: 1467860 - RNA, 19 nt, Homo sapiens
gucucaaacuccugaccuc

SEQ ID NO: 1467861 - RNA, 19 nt, Homo sapiens
gucucaagagggcacuggu

SEQ ID NO: 1467862 - RNA, 23 nt, Homo sapiens
gucucacgggcaugggcacuccc

SEQ ID NO: 1467863 - RNA, 23 nt, Homo sapiens
gucucagaaacugcgaggccagu

SEQ ID NO: 1467864 - RNA, 17 nt, Homo sapiens
gucucaguggcuucauc

SEQ ID NO: 1467865 - RNA, 20 nt, Homo sapiens
gucucaguggcuucaucugu

SEQ ID NO: 1467866 - RNA, 15 nt, Homo sapiens
gucucaguuucacuu

SEQ ID NO: 1467867 - RNA, 13 nt, Homo sapiens
gucucauuuagaa

SEQ ID NO: 1467868 - RNA, 16 nt, Homo sapiens
gucucauuuagaacuu

SEQ ID NO: 1467869 - RNA, 23 nt, Homo sapiens
gucucccuuccuaugcuguucac

SEQ ID NO: 1467870 - RNA, 18 nt, Homo sapiens
gucuccuuugcacugagg

SEQ ID NO: 1467871 - RNA, 13 nt, Homo sapiens
gucucgcuuuguu

SEQ ID NO: 1467872 - RNA, 13 nt, Homo sapiens
gucucucccucag

SEQ ID NO: 1467873 - RNA, 18 nt, Homo sapiens
gucugagacucacaggaa

SEQ ID NO: 1467874 - RNA, 15 nt, Homo sapiens
gucugauaaacugac

SEQ ID NO: 1467875 - RNA, 12 nt, Homo sapiens
gucugaugacac

SEQ ID NO: 1467876 - RNA, 19 nt, Homo sapiens
gucugauuggcucacccaa

SEQ ID NO: 1467877 - RNA, 14 nt, Homo sapiens
gucugcuugucaaa

SEQ ID NO: 1467878 - RNA, 18 nt, Homo sapiens
gucugggagucacacagu

SEQ ID NO: 1467879 - RNA, 19 nt, Homo sapiens
gucuggggagaauguaauc

SEQ ID NO: 1467880 - RNA, 20 nt, Homo sapiens
gucuguagcuccucaacuca

SEQ ID NO: 1467881 - RNA, 18 nt, Homo sapiens
gucuguuuggacugcaga

SEQ ID NO: 1467882 - RNA, 19 nt, Homo sapiens
gucuguuuggacugcagaa

SEQ ID NO: 1467883 - RNA, 13 nt, Homo sapiens
gucuucacuuccc

SEQ ID NO: 1467884 - RNA, 13 nt, Homo sapiens
gucuucuaaacuu

SEQ ID NO: 1467885 - RNA, 19 nt, Homo sapiens
gucuugacucauggcagcu

SEQ ID NO: 1467886 - RNA, 16 nt, Homo sapiens
gucuugcucuguuacc

SEQ ID NO: 1467887 - RNA, 22 nt, Homo sapiens
gucuuuagggguugggcuggau

SEQ ID NO: 1467888 - RNA, 21 nt, Homo sapiens
gucuuuucaaaauauuacuca

SEQ ID NO: 1467889 - RNA, 22 nt, Homo sapiens
gucuuuuuuucccuaccauuca

SEQ ID NO: 1467890 - RNA, 14 nt, Homo sapiens
gugaaaaacuuaag

SEQ ID NO: 1467891 - RNA, 21 nt, Homo sapiens
gugaaaaaguuaaacauugaa

SEQ ID NO: 1467892 - RNA, 16 nt, Homo sapiens
gugaaaccccaucucu

SEQ ID NO: 1467893 - RNA, 13 nt, Homo sapiens
gugaaacuggcac

SEQ ID NO: 1467894 - RNA, 20 nt, Homo sapiens
gugaaaugcuggcauuugca

SEQ ID NO: 1467895 - RNA, 17 nt, Homo sapiens
gugaaaugugaaggaaa

SEQ ID NO: 1467896 - RNA, 14 nt, Homo sapiens
gugaacaaagcagc

SEQ ID NO: 1467897 - RNA, 19 nt, Homo sapiens
gugaacaaagcagccacga

SEQ ID NO: 1467898 - RNA, 16 nt, Homo sapiens
gugaaccacuucauuc

SEQ ID NO: 1467899 - RNA, 19 nt, Homo sapiens
gugaacuagggaagcucag

SEQ ID NO: 1467900 - RNA, 14 nt, Homo sapiens
gugaagagucuaca

SEQ ID NO: 1467901 - RNA, 12 nt, Homo sapiens
gugaagcauuua

SEQ ID NO: 1467902 - RNA, 14 nt, Homo sapiens
gugaagccucugag

SEQ ID NO: 1467903 - RNA, 19 nt, Homo sapiens
gugaaguuuaauugucuca

SEQ ID NO: 1467904 - RNA, 16 nt, Homo sapiens
gugaauaaccacuuaa

SEQ ID NO: 1467905 - RNA, 13 nt, Homo sapiens
gugaaucuugucu

SEQ ID NO: 1467906 - RNA, 18 nt, Homo sapiens
gugaauggccuuccuucc

SEQ ID NO: 1467907 - RNA, 19 nt, Homo sapiens
gugaauuauugacacugaa

SEQ ID NO: 1467908 - RNA, 12 nt, Homo sapiens
gugacaccucac

SEQ ID NO: 1467909 - RNA, 18 nt, Homo sapiens
gugacauuuauauauuga

SEQ ID NO: 1467910 - RNA, 21 nt, Homo sapiens
gugacauuugggagacaugug

SEQ ID NO: 1467911 - RNA, 16 nt, Homo sapiens
gugaccacugaagcac

SEQ ID NO: 1467912 - RNA, 17 nt, Homo sapiens
gugaccuaaccacuuag

SEQ ID NO: 1467913 - RNA, 12 nt, Homo sapiens
gugacugcaaua

SEQ ID NO: 1467914 - RNA, 19 nt, Homo sapiens
gugacuucuccaggucuca

SEQ ID NO: 1467915 - RNA, 20 nt, Homo sapiens
gugacuuucaagcuacucac

SEQ ID NO: 1467916 - RNA, 23 nt, Homo sapiens
gugagacuguguuguacagcuag

SEQ ID NO: 1467917 - RNA, 14 nt, Homo sapiens
gugagaucaugcca

SEQ ID NO: 1467918 - RNA, 17 nt, Homo sapiens
gugagcaccugagcaug

SEQ ID NO: 1467919 - RNA, 13 nt, Homo sapiens
gugagcacgcuga

SEQ ID NO: 1467920 - RNA, 18 nt, Homo sapiens
gugagccaagauugcacc

SEQ ID NO: 1467921 - RNA, 14 nt, Homo sapiens
gugagccacagacc

SEQ ID NO: 1467922 - RNA, 19 nt, Homo sapiens
gugaggcuguccuguacau

SEQ ID NO: 1467923 - RNA, 20 nt, Homo sapiens
gugaggugugucacaaugag

SEQ ID NO: 1467924 - RNA, 19 nt, Homo sapiens
gugaguuuaccuuguauac

SEQ ID NO: 1467925 - RNA, 12 nt, Homo sapiens
gugauacauuua

SEQ ID NO: 1467926 - RNA, 16 nt, Homo sapiens
gugauccgccuaccuc

SEQ ID NO: 1467927 - RNA, 20 nt, Homo sapiens
gugaucucccaagcuaucua

SEQ ID NO: 1467928 - RNA, 17 nt, Homo sapiens
gugaugaugcugugaca

SEQ ID NO: 1467929 - RNA, 13 nt, Homo sapiens
gugauggggcaag

SEQ ID NO: 1467930 - RNA, 14 nt, Homo sapiens
gugauguuugcucu

SEQ ID NO: 1467931 - RNA, 16 nt, Homo sapiens
gugauuaacaucuaca

SEQ ID NO: 1467932 - RNA, 22 nt, Homo sapiens
gugauucuguuuauucuuccag

SEQ ID NO: 1467933 - RNA, 16 nt, Homo sapiens
gugauugacacacagc

SEQ ID NO: 1467934 - RNA, 13 nt, Homo sapiens
gugauuucagaga

SEQ ID NO: 1467935 - RNA, 17 nt, Homo sapiens
guuaauguuauaucaua

SEQ ID NO: 1467936 - RNA, 21 nt, Homo sapiens
guuacagugaugcugugcuau

SEQ ID NO: 1467937 - RNA, 14 nt, Homo sapiens
guuacauaagauaa

SEQ ID NO: 1467938 - RNA, 17 nt, Homo sapiens
guuaccagagauuuacc

SEQ ID NO: 1467939 - RNA, 15 nt, Homo sapiens
guuacugaaggugau

SEQ ID NO: 1467940 - RNA, 19 nt, Homo sapiens
guuacugcuugaccaaaga

SEQ ID NO: 1467941 - RNA, 24 nt, Homo sapiens
guuacuggcuucucuugagucaca

SEQ ID NO: 1467942 - RNA, 17 nt, Homo sapiens
guuacuuaccacagacu

SEQ ID NO: 1467943 - RNA, 12 nt, Homo sapiens
guuacuuuguaa

SEQ ID NO: 1467944 - RNA, 19 nt, Homo sapiens
guuagaaaaaggacucugc

SEQ ID NO: 1467945 - RNA, 21 nt, Homo sapiens
guuagaaaauggacacugugc

SEQ ID NO: 1467946 - RNA, 18 nt, Homo sapiens
guuagacuuaaacagcag

SEQ ID NO: 1467947 - RNA, 18 nt, Homo sapiens
guuagagaauuuccuuac

SEQ ID NO: 1467948 - RNA, 21 nt, Homo sapiens
guuagagagggaccauguguc

SEQ ID NO: 1467949 - RNA, 13 nt, Homo sapiens
guuaggcauuaau

SEQ ID NO: 1467950 - RNA, 15 nt, Homo sapiens
guuaguuaaaagccc

SEQ ID NO: 1467951 - RNA, 23 nt, Homo sapiens
guuaguugugaaagaaagcugag

SEQ ID NO: 1467952 - RNA, 19 nt, Homo sapiens
guuauaaaucaaugucacu

SEQ ID NO: 1467953 - RNA, 20 nt, Homo sapiens
guuauaaaucaaugucacuu

SEQ ID NO: 1467954 - RNA, 22 nt, Homo sapiens
guuauaaaucaaugucacuuaa

SEQ ID NO: 1467955 - RNA, 18 nt, Homo sapiens
guuauaucauauguauau

SEQ ID NO: 1467956 - RNA, 16 nt, Homo sapiens
guuauauccaauagua

SEQ ID NO: 1467957 - RNA, 15 nt, Homo sapiens
guuauaucuaugcaa

SEQ ID NO: 1467958 - RNA, 19 nt, Homo sapiens
guuaucuguguagcaagcu

SEQ ID NO: 1467959 - RNA, 15 nt, Homo sapiens
guuaugacuauguaa

SEQ ID NO: 1467960 - RNA, 16 nt, Homo sapiens
guuaugugauuuuccu

SEQ ID NO: 1467961 - RNA, 19 nt, Homo sapiens
guuauuguuguugccaaag

SEQ ID NO: 1467962 - RNA, 20 nt, Homo sapiens
guuauuugcacacugcacug

SEQ ID NO: 1467963 - RNA, 20 nt, Homo sapiens
guucaaaugcccuuccagug

SEQ ID NO: 1467964 - RNA, 22 nt, Homo sapiens
guucaagugauucuccugccuc

SEQ ID NO: 1467965 - RNA, 15 nt, Homo sapiens
guucaauaaagcacu

SEQ ID NO: 1467966 - RNA, 20 nt, Homo sapiens
guucaaucucccgcugcugc

SEQ ID NO: 1467967 - RNA, 14 nt, Homo sapiens
guucacagugcaua

SEQ ID NO: 1467968 - RNA, 17 nt, Homo sapiens
guucacucuacuuagca

SEQ ID NO: 1467969 - RNA, 19 nt, Homo sapiens
guucagagccaagccuuaa

SEQ ID NO: 1467970 - RNA, 24 nt, Homo sapiens
guucagcacugucccuugccucaa

SEQ ID NO: 1467971 - RNA, 16 nt, Homo sapiens
guucauguuugcuuca

SEQ ID NO: 1467972 - RNA, 16 nt, Homo sapiens
guucauugcacuuuga

SEQ ID NO: 1467973 - RNA, 13 nt, Homo sapiens
guuccaguggcuu

SEQ ID NO: 1467974 - RNA, 20 nt, Homo sapiens
guuccccacugacagccucc

SEQ ID NO: 1467975 - RNA, 16 nt, Homo sapiens
guucccucuugcucag

SEQ ID NO: 1467976 - RNA, 14 nt, Homo sapiens
guucccugugucau

SEQ ID NO: 1467977 - RNA, 22 nt, Homo sapiens
guucccuuggccucagaauuca

SEQ ID NO: 1467978 - RNA, 18 nt, Homo sapiens
guuccgcacuuuccacuu

SEQ ID NO: 1467979 - RNA, 12 nt, Homo sapiens
guuccucaaaag

SEQ ID NO: 1467980 - RNA, 20 nt, Homo sapiens
guuccucaucugagaggcuc

SEQ ID NO: 1467981 - RNA, 15 nt, Homo sapiens
guuccuuucuuuucc

SEQ ID NO: 1467982 - RNA, 12 nt, Homo sapiens
guucuaaccacu

SEQ ID NO: 1467983 - RNA, 21 nt, Homo sapiens
guucuaccucaggcagcucaa

SEQ ID NO: 1467984 - RNA, 12 nt, Homo sapiens
guucuaugagaa

SEQ ID NO: 1467985 - RNA, 15 nt, Homo sapiens
guucuauuuguauau

SEQ ID NO: 1467986 - RNA, 17 nt, Homo sapiens
guucuauuuguauauau

SEQ ID NO: 1467987 - RNA, 20 nt, Homo sapiens
guucucauuuggucugccag

SEQ ID NO: 1467988 - RNA, 15 nt, Homo sapiens
guucucuucuucauu

SEQ ID NO: 1467989 - RNA, 15 nt, Homo sapiens
guucugagaccagug

SEQ ID NO: 1467990 - RNA, 18 nt, Homo sapiens
guucugggacuacaggca

SEQ ID NO: 1467991 - RNA, 16 nt, Homo sapiens
guucuuacugcuuaau

SEQ ID NO: 1467992 - RNA, 13 nt, Homo sapiens
guucuuaguguca

SEQ ID NO: 1467993 - RNA, 19 nt, Homo sapiens
guucuucuguucugcagac

SEQ ID NO: 1467994 - RNA, 15 nt, Homo sapiens
guucuuggugaugcu

SEQ ID NO: 1467995 - RNA, 12 nt, Homo sapiens
guucuuuccucc

SEQ ID NO: 1467996 - RNA, 23 nt, Homo sapiens
guucuuuggaaaguacacucugc

SEQ ID NO: 1467997 - RNA, 14 nt, Homo sapiens
guucuuugggccag

SEQ ID NO: 1467998 - RNA, 18 nt, Homo sapiens
guugaacuuugccaaaaa

SEQ ID NO: 1467999 - RNA, 14 nt, Homo sapiens
guugaagacuuugu

SEQ ID NO: 1468000 - RNA, 23 nt, Homo sapiens
guugaauuucccacauacccucc

SEQ ID NO: 1468001 - RNA, 15 nt, Homo sapiens
guugacaacugugac

SEQ ID NO: 1468002 - RNA, 21 nt, Homo sapiens
guugaguuaugauaacaccag

SEQ ID NO: 1468003 - RNA, 16 nt, Homo sapiens
guugcaagaugugaau

SEQ ID NO: 1468004 - RNA, 12 nt, Homo sapiens
guugcauugcuu

SEQ ID NO: 1468005 - RNA, 21 nt, Homo sapiens
guugcccgaaacuaagccagg

SEQ ID NO: 1468006 - RNA, 11 nt, Homo sapiens
guugcucugac

SEQ ID NO: 1468007 - RNA, 14 nt, Homo sapiens
guugcuguuucaca

SEQ ID NO: 1468008 - RNA, 13 nt, Homo sapiens
guuggaacauccu

SEQ ID NO: 1468009 - RNA, 10 nt, Homo sapiens
guuggaagag

SEQ ID NO: 1468010 - RNA, 16 nt, Homo sapiens
guuggagcuacugcaa

SEQ ID NO: 1468011 - RNA, 18 nt, Homo sapiens
guuggaugggagugggca

SEQ ID NO: 1468012 - RNA, 14 nt, Homo sapiens
guuggcagcccacu

SEQ ID NO: 1468013 - RNA, 19 nt, Homo sapiens
guuggggaaaccuucaucu

SEQ ID NO: 1468014 - RNA, 15 nt, Homo sapiens
guuggugacaccuca

SEQ ID NO: 1468015 - RNA, 20 nt, Homo sapiens
guuguaaaccaagugaucaa

SEQ ID NO: 1468016 - RNA, 18 nt, Homo sapiens
guuguaggguuacagaga

SEQ ID NO: 1468017 - RNA, 19 nt, Homo sapiens
guuguaucaaagugugaua

SEQ ID NO: 1468018 - RNA, 18 nt, Homo sapiens
guugugaugaaucaauga

SEQ ID NO: 1468019 - RNA, 21 nt, Homo sapiens
guugugcauuuguucagcucc

SEQ ID NO: 1468020 - RNA, 16 nt, Homo sapiens
guuguguuagccucuu

SEQ ID NO: 1468021 - RNA, 19 nt, Homo sapiens
guuguucaguugccaagga

SEQ ID NO: 1468022 - RNA, 11 nt, Homo sapiens
guuguuugcaa

SEQ ID NO: 1468023 - RNA, 19 nt, Homo sapiens
guuuaaaguggcaaucuca

SEQ ID NO: 1468024 - RNA, 16 nt, Homo sapiens
guuuaaaguugcacau

SEQ ID NO: 1468025 - RNA, 23 nt, Homo sapiens
guuuacauuguaaauaguauuug

SEQ ID NO: 1468026 - RNA, 18 nt, Homo sapiens
guuuaccaguugccuuuu

SEQ ID NO: 1468027 - RNA, 19 nt, Homo sapiens
guuuaccuuguauacugua

SEQ ID NO: 1468028 - RNA, 21 nt, Homo sapiens
guuuacuucaaauuaacucua

SEQ ID NO: 1468029 - RNA, 21 nt, Homo sapiens
guuuagacaguaugagucaau

SEQ ID NO: 1468030 - RNA, 18 nt, Homo sapiens
guuuagccaaaggauaag

SEQ ID NO: 1468031 - RNA, 19 nt, Homo sapiens
guuuaugauauuucuugcu

SEQ ID NO: 1468032 - RNA, 13 nt, Homo sapiens
guuuauucuucca

SEQ ID NO: 1468033 - RNA, 18 nt, Homo sapiens
guuuauuucaacuauuua

SEQ ID NO: 1468034 - RNA, 22 nt, Homo sapiens
guuuauuuuagaggaacucuca

SEQ ID NO: 1468035 - RNA, 23 nt, Homo sapiens
guuucaaaaaaucugaccaaaac

SEQ ID NO: 1468036 - RNA, 14 nt, Homo sapiens
guuucaacugugcu

SEQ ID NO: 1468037 - RNA, 19 nt, Homo sapiens
guuucacuguguuagccag

SEQ ID NO: 1468038 - RNA, 19 nt, Homo sapiens
guuucaucguaaacauacu

SEQ ID NO: 1468039 - RNA, 17 nt, Homo sapiens
guuucccauaauuuucu

SEQ ID NO: 1468040 - RNA, 16 nt, Homo sapiens
guuucccuuucacugg

SEQ ID NO: 1468041 - RNA, 21 nt, Homo sapiens
guuucuaaaaacacacacaaa

SEQ ID NO: 1468042 - RNA, 20 nt, Homo sapiens
guuucugauaccacugcacu

SEQ ID NO: 1468043 - RNA, 14 nt, Homo sapiens
guuucugucuguaa

SEQ ID NO: 1468044 - RNA, 22 nt, Homo sapiens
guuugaagaugccgcauuugga

SEQ ID NO: 1468045 - RNA, 18 nt, Homo sapiens
guuugacacgaagccuua

SEQ ID NO: 1468046 - RNA, 23 nt, Homo sapiens
guuugauugaggagcugcacuga

SEQ ID NO: 1468047 - RNA, 20 nt, Homo sapiens
guuugcaguuggcuaagaga

SEQ ID NO: 1468048 - RNA, 23 nt, Homo sapiens
guuugcucuuuuaagcagucuca

SEQ ID NO: 1468049 - RNA, 17 nt, Homo sapiens
guuuggaaaaguggcgu

SEQ ID NO: 1468050 - RNA, 17 nt, Homo sapiens
guuuggacagcugauaa

SEQ ID NO: 1468051 - RNA, 16 nt, Homo sapiens
guuugguuuacauuua

SEQ ID NO: 1468052 - RNA, 18 nt, Homo sapiens
guuugucuguuuguuuca

SEQ ID NO: 1468053 - RNA, 20 nt, Homo sapiens
guuuguggccucagaauuga

SEQ ID NO: 1468054 - RNA, 20 nt, Homo sapiens
guuuguuccuacagccccuu

SEQ ID NO: 1468055 - RNA, 23 nt, Homo sapiens
guuuguucuguucugggggacag

SEQ ID NO: 1468056 - RNA, 17 nt, Homo sapiens
guuuguuucauauauac

SEQ ID NO: 1468057 - RNA, 12 nt, Homo sapiens
guuuuaacugua

SEQ ID NO: 1468058 - RNA, 17 nt, Homo sapiens
guuuuaaguacuacaca

SEQ ID NO: 1468059 - RNA, 15 nt, Homo sapiens
guuuuauauguugcu

SEQ ID NO: 1468060 - RNA, 16 nt, Homo sapiens
guuuuauauguugcua

SEQ ID NO: 1468061 - RNA, 15 nt, Homo sapiens
guuuuaucacuucau

SEQ ID NO: 1468062 - RNA, 11 nt, Homo sapiens
guuuucagugu

SEQ ID NO: 1468063 - RNA, 17 nt, Homo sapiens
guuuuccaguucaucga

SEQ ID NO: 1468064 - RNA, 20 nt, Homo sapiens
guuuucgcuggggauggaau

SEQ ID NO: 1468065 - RNA, 15 nt, Homo sapiens
guuuucuagaauuua

SEQ ID NO: 1468066 - RNA, 15 nt, Homo sapiens
guuuucugacacagu

SEQ ID NO: 1468067 - RNA, 17 nt, Homo sapiens
guuuucugacacaguca

SEQ ID NO: 1468068 - RNA, 23 nt, Homo sapiens
guuuugaaggcaaaauugcaaau

SEQ ID NO: 1468069 - RNA, 17 nt, Homo sapiens
guuuuggaagcucugaa

SEQ ID NO: 1468070 - RNA, 19 nt, Homo sapiens
guuuuggggaaauguggag

SEQ ID NO: 1468071 - RNA, 23 nt, Homo sapiens
guuuuguugagcaugacagccug

SEQ ID NO: 1468072 - RNA, 13 nt, Homo sapiens
guuuuuacuguga

SEQ ID NO: 1468073 - RNA, 20 nt, Homo sapiens
guuuuuagauuaaacaaaca

SEQ ID NO: 1468074 - RNA, 20 nt, Homo sapiens
guuuuuauauuaauguacuu

SEQ ID NO: 1468075 - RNA, 14 nt, Homo sapiens
guuuuucagcaccc

SEQ ID NO: 1468076 - RNA, 13 nt, Homo sapiens
guuuuuccuccau

SEQ ID NO: 1468077 - RNA, 17 nt, Homo sapiens
guuuuucugaagacagu

SEQ ID NO: 1468078 - RNA, 17 nt, Homo sapiens
guuuuugcuuguuauau

SEQ ID NO: 1468079 - RNA, 20 nt, Homo sapiens
guuuuuucaucauaacauaa

SEQ ID NO: 1468080 - RNA, 12 nt, Homo sapiens
uaaaaaagccug

SEQ ID NO: 1468081 - RNA, 19 nt, Homo sapiens
uaaaaaauuaugacaaugu

SEQ ID NO: 1468082 - RNA, 20 nt, Homo sapiens
uaaaaacaccaaaaagggau

SEQ ID NO: 1468083 - RNA, 21 nt, Homo sapiens
uaaaaagacacgguugcucua

SEQ ID NO: 1468084 - RNA, 20 nt, Homo sapiens
uaaaaagccugcaauuucau

SEQ ID NO: 1468085 - RNA, 15 nt, Homo sapiens
uaaaaagucuucacu

SEQ ID NO: 1468086 - RNA, 13 nt, Homo sapiens
uaaaaagugacac

SEQ ID NO: 1468087 - RNA, 20 nt, Homo sapiens
uaaaaagugacacagcagcu

SEQ ID NO: 1468088 - RNA, 17 nt, Homo sapiens
uaaaaaguuaaucuuca

SEQ ID NO: 1468089 - RNA, 12 nt, Homo sapiens
uaaaaaguucag

SEQ ID NO: 1468090 - RNA, 18 nt, Homo sapiens
uaaaaauaaaucccaugg

SEQ ID NO: 1468091 - RNA, 17 nt, Homo sapiens
uaaaaauagucuuccac

SEQ ID NO: 1468092 - RNA, 19 nt, Homo sapiens
uaaaaauggcaaaugcacu

SEQ ID NO: 1468093 - RNA, 12 nt, Homo sapiens
uaaaacaauucu

SEQ ID NO: 1468094 - RNA, 17 nt, Homo sapiens
uaaaacacagcuuuaca

SEQ ID NO: 1468095 - RNA, 22 nt, Homo sapiens
uaaaacagccaaaacuccacag

SEQ ID NO: 1468096 - RNA, 14 nt, Homo sapiens
uaaaacuaagcaca

SEQ ID NO: 1468097 - RNA, 15 nt, Homo sapiens
uaaaacugaaucuca

SEQ ID NO: 1468098 - RNA, 17 nt, Homo sapiens
uaaaacuuaacauucau

SEQ ID NO: 1468099 - RNA, 21 nt, Homo sapiens
uaaaagggucguuaccagaga

SEQ ID NO: 1468100 - RNA, 17 nt, Homo sapiens
uaaaauaaaaauucuga

SEQ ID NO: 1468101 - RNA, 23 nt, Homo sapiens
uaaaauaaaguauauauagaauc

SEQ ID NO: 1468102 - RNA, 14 nt, Homo sapiens
uaaaauaaauuccu

SEQ ID NO: 1468103 - RNA, 16 nt, Homo sapiens
uaaaauaaugaacacu

SEQ ID NO: 1468104 - RNA, 18 nt, Homo sapiens
uaaaauaauuuuaucucu

SEQ ID NO: 1468105 - RNA, 17 nt, Homo sapiens
uaaaauaccuagaccua

SEQ ID NO: 1468106 - RNA, 20 nt, Homo sapiens
uaaaauacuuuuacucugcc

SEQ ID NO: 1468107 - RNA, 12 nt, Homo sapiens
uaaaauagagua

SEQ ID NO: 1468108 - RNA, 22 nt, Homo sapiens
uaaaauaggaaccuaugaaacu

SEQ ID NO: 1468109 - RNA, 22 nt, Homo sapiens
uaaaaugguuuuugccuaaaau

SEQ ID NO: 1468110 - RNA, 17 nt, Homo sapiens
uaaaauguacucagcua

SEQ ID NO: 1468111 - RNA, 23 nt, Homo sapiens
uaaaaugugaggaagaacuacag

SEQ ID NO: 1468112 - RNA, 18 nt, Homo sapiens
uaaaauuagaugaacuca

SEQ ID NO: 1468113 - RNA, 20 nt, Homo sapiens
uaaaauuccucuuacuguaa

SEQ ID NO: 1468114 - RNA, 16 nt, Homo sapiens
uaaaauugcugugcuu

SEQ ID NO: 1468115 - RNA, 23 nt, Homo sapiens
uaaaauugcuucuuuaccaagga

SEQ ID NO: 1468116 - RNA, 18 nt, Homo sapiens
uaaacaaaauugcaauuu

SEQ ID NO: 1468117 - RNA, 14 nt, Homo sapiens
uaaacaaacaaaca

SEQ ID NO: 1468118 - RNA, 20 nt, Homo sapiens
uaaacagauggcacuuugaa

SEQ ID NO: 1468119 - RNA, 17 nt, Homo sapiens
uaaacagcuucaugccu

SEQ ID NO: 1468120 - RNA, 19 nt, Homo sapiens
uaaacauaaguugcauuua

SEQ ID NO: 1468121 - RNA, 16 nt, Homo sapiens
uaaacauaugauuuca

SEQ ID NO: 1468122 - RNA, 14 nt, Homo sapiens
uaaacauccuucaa

SEQ ID NO: 1468123 - RNA, 21 nt, Homo sapiens
uaaacauccuucaagaacucu

SEQ ID NO: 1468124 - RNA, 22 nt, Homo sapiens
uaaacauugguaagaaugagcu

SEQ ID NO: 1468125 - RNA, 16 nt, Homo sapiens
uaaacauugugaucau

SEQ ID NO: 1468126 - RNA, 21 nt, Homo sapiens
uaaacauuugagagcuaacua

SEQ ID NO: 1468127 - RNA, 19 nt, Homo sapiens
uaaacauuuugacacaaaa

SEQ ID NO: 1468128 - RNA, 23 nt, Homo sapiens
uaaaccuggaaucuacaagccaa

SEQ ID NO: 1468129 - RNA, 20 nt, Homo sapiens
uaaacgacaagaauaauuca

SEQ ID NO: 1468130 - RNA, 14 nt, Homo sapiens
uaaacuacucuuug

SEQ ID NO: 1468131 - RNA, 23 nt, Homo sapiens
uaaacuauacacuuaaugauaca

SEQ ID NO: 1468132 - RNA, 20 nt, Homo sapiens
uaaacucauuuaacuaaagu

SEQ ID NO: 1468133 - RNA, 22 nt, Homo sapiens
uaaacucuguugcaagugcaau

SEQ ID NO: 1468134 - RNA, 21 nt, Homo sapiens
uaaacuuaccugggcauucuu

SEQ ID NO: 1468135 - RNA, 22 nt, Homo sapiens
uaaacuucaccuacauuaucuc

SEQ ID NO: 1468136 - RNA, 23 nt, Homo sapiens
uaaacuucaccuacauuaucuca

SEQ ID NO: 1468137 - RNA, 22 nt, Homo sapiens
uaaacuuggauucucuaaccuu

SEQ ID NO: 1468138 - RNA, 17 nt, Homo sapiens
uaaacuuguuuacaaag

SEQ ID NO: 1468139 - RNA, 16 nt, Homo sapiens
uaaagaaaagaugaaa

SEQ ID NO: 1468140 - RNA, 22 nt, Homo sapiens
uaaagaagguuggugaauuuca

SEQ ID NO: 1468141 - RNA, 19 nt, Homo sapiens
uaaagacgucucuuuuugg

SEQ ID NO: 1468142 - RNA, 21 nt, Homo sapiens
uaaagacugguuuucugccaa

SEQ ID NO: 1468143 - RNA, 19 nt, Homo sapiens
uaaagagagaauguagaua

SEQ ID NO: 1468144 - RNA, 23 nt, Homo sapiens
uaaagagucuggccuggacccug

SEQ ID NO: 1468145 - RNA, 15 nt, Homo sapiens
uaaagauacaguguc

SEQ ID NO: 1468146 - RNA, 16 nt, Homo sapiens
uaaagaugaucuacuc

SEQ ID NO: 1468147 - RNA, 17 nt, Homo sapiens
uaaagcagacagucaca

SEQ ID NO: 1468148 - RNA, 19 nt, Homo sapiens
uaaagcauauuggugcuag

SEQ ID NO: 1468149 - RNA, 21 nt, Homo sapiens
uaaagccaacacccugucuaa

SEQ ID NO: 1468150 - RNA, 16 nt, Homo sapiens
uaaagggaaaacccuc

SEQ ID NO: 1468151 - RNA, 17 nt, Homo sapiens
uaaaggugagcccucau

SEQ ID NO: 1468152 - RNA, 21 nt, Homo sapiens
uaaaguauuauuuauuugaau

SEQ ID NO: 1468153 - RNA, 17 nt, Homo sapiens
uaaagucaacauaugca

SEQ ID NO: 1468154 - RNA, 15 nt, Homo sapiens
uaaagucacagaauu

SEQ ID NO: 1468155 - RNA, 15 nt, Homo sapiens
uaaaguguuugccuc

SEQ ID NO: 1468156 - RNA, 17 nt, Homo sapiens
uaaaguuacuugaauuu

SEQ ID NO: 1468157 - RNA, 14 nt, Homo sapiens
uaaaguugccuuua

SEQ ID NO: 1468158 - RNA, 16 nt, Homo sapiens
uaaauaaaaaaagaca

SEQ ID NO: 1468159 - RNA, 14 nt, Homo sapiens
uaaauaaaacugaa

SEQ ID NO: 1468160 - RNA, 15 nt, Homo sapiens
uaaauaaaacugaau

SEQ ID NO: 1468161 - RNA, 21 nt, Homo sapiens
uaaauaaaauucauuucuaca

SEQ ID NO: 1468162 - RNA, 19 nt, Homo sapiens
uaaauaaaccucaaaaugu

SEQ ID NO: 1468163 - RNA, 21 nt, Homo sapiens
uaaauaaauguaucuuauuca

SEQ ID NO: 1468164 - RNA, 14 nt, Homo sapiens
uaaauaacaggcau

SEQ ID NO: 1468165 - RNA, 20 nt, Homo sapiens
uaaauaaugaauaaacugaa

SEQ ID NO: 1468166 - RNA, 19 nt, Homo sapiens
uaaauaauguuaucugugu

SEQ ID NO: 1468167 - RNA, 20 nt, Homo sapiens
uaaauaauuucuacucuguc

SEQ ID NO: 1468168 - RNA, 19 nt, Homo sapiens
uaaauagaacuaucugcau

SEQ ID NO: 1468169 - RNA, 19 nt, Homo sapiens
uaaauaucaacccacuuaa

SEQ ID NO: 1468170 - RNA, 21 nt, Homo sapiens
uaaauaucacaguauuaucug

SEQ ID NO: 1468171 - RNA, 17 nt, Homo sapiens
uaaauaugcagugauau

SEQ ID NO: 1468172 - RNA, 21 nt, Homo sapiens
uaaauauuagaagccugcaga

SEQ ID NO: 1468173 - RNA, 16 nt, Homo sapiens
uaaaucacacauucag

SEQ ID NO: 1468174 - RNA, 17 nt, Homo sapiens
uaaaucauauuaguauu

SEQ ID NO: 1468175 - RNA, 13 nt, Homo sapiens
uaaauccugccau

SEQ ID NO: 1468176 - RNA, 14 nt, Homo sapiens
uaaaucguccuccc

SEQ ID NO: 1468177 - RNA, 20 nt, Homo sapiens
uaaaucuguuauuuugcuau

SEQ ID NO: 1468178 - RNA, 20 nt, Homo sapiens
uaaaugauagacaauugagg

SEQ ID NO: 1468179 - RNA, 13 nt, Homo sapiens
uaaaugccuaaua

SEQ ID NO: 1468180 - RNA, 22 nt, Homo sapiens
uaaaugggaaaucaguguuuua

SEQ ID NO: 1468181 - RNA, 20 nt, Homo sapiens
uaaaugggagggcauuccau

SEQ ID NO: 1468182 - RNA, 18 nt, Homo sapiens
uaaauguauacuauagua

SEQ ID NO: 1468183 - RNA, 20 nt, Homo sapiens
uaaauguaucuuauucacau

SEQ ID NO: 1468184 - RNA, 22 nt, Homo sapiens
uaaaugucuuguuucccagauu

SEQ ID NO: 1468185 - RNA, 12 nt, Homo sapiens
uaaaugugauau

SEQ ID NO: 1468186 - RNA, 16 nt, Homo sapiens
uaaauguuaugacuau

SEQ ID NO: 1468187 - RNA, 19 nt, Homo sapiens
uaaauguuaugacuaugua

SEQ ID NO: 1468188 - RNA, 14 nt, Homo sapiens
uaaauuauugcugu

SEQ ID NO: 1468189 - RNA, 14 nt, Homo sapiens
uaaauucaaguuua

SEQ ID NO: 1468190 - RNA, 20 nt, Homo sapiens
uaaauucccaacuucucuug

SEQ ID NO: 1468191 - RNA, 17 nt, Homo sapiens
uaaauucuaagccauau

SEQ ID NO: 1468192 - RNA, 16 nt, Homo sapiens
uaaauugguacaguau

SEQ ID NO: 1468193 - RNA, 20 nt, Homo sapiens
uaaauuguuucauaucuggu

SEQ ID NO: 1468194 - RNA, 14 nt, Homo sapiens
uaaauuugcuagca

SEQ ID NO: 1468195 - RNA, 17 nt, Homo sapiens
uaaauuugguucuaggc

SEQ ID NO: 1468196 - RNA, 23 nt, Homo sapiens
uaaauuuguuauuguguauuaug

SEQ ID NO: 1468197 - RNA, 17 nt, Homo sapiens
uaaauuuugaguucuac

SEQ ID NO: 1468198 - RNA, 18 nt, Homo sapiens
uaacaaauaugcuaauuu

SEQ ID NO: 1468199 - RNA, 16 nt, Homo sapiens
uaacaaguaccaaagu

SEQ ID NO: 1468200 - RNA, 20 nt, Homo sapiens
uaacaaguagcacccuggau

SEQ ID NO: 1468201 - RNA, 11 nt, Homo sapiens
uaacaaugaag

SEQ ID NO: 1468202 - RNA, 14 nt, Homo sapiens
uaacaauguuaagg

SEQ ID NO: 1468203 - RNA, 23 nt, Homo sapiens
uaacacagaccccuagggauuua

SEQ ID NO: 1468204 - RNA, 21 nt, Homo sapiens
uaacacagccguguguucaaa

SEQ ID NO: 1468205 - RNA, 15 nt, Homo sapiens
uaacagaacagucac

SEQ ID NO: 1468206 - RNA, 15 nt, Homo sapiens
uaacagaccacugua

SEQ ID NO: 1468207 - RNA, 17 nt, Homo sapiens
uaacagaguaucagauc

SEQ ID NO: 1468208 - RNA, 21 nt, Homo sapiens
uaacagcggcaggguguccca

SEQ ID NO: 1468209 - RNA, 18 nt, Homo sapiens
uaacaggauauuuaauga

SEQ ID NO: 1468210 - RNA, 14 nt, Homo sapiens
uaacaggcauuugu

SEQ ID NO: 1468211 - RNA, 16 nt, Homo sapiens
uaacaggugccuuccc

SEQ ID NO: 1468212 - RNA, 14 nt, Homo sapiens
uaacaguucacuuu

SEQ ID NO: 1468213 - RNA, 21 nt, Homo sapiens
uaacaguucauguuugcuuca

SEQ ID NO: 1468214 - RNA, 14 nt, Homo sapiens
uaacauucaguucc

SEQ ID NO: 1468215 - RNA, 19 nt, Homo sapiens
uaacccaacugacuuguau

SEQ ID NO: 1468216 - RNA, 16 nt, Homo sapiens
uaaccucuucaccuua

SEQ ID NO: 1468217 - RNA, 12 nt, Homo sapiens
uaacuagaauuu

SEQ ID NO: 1468218 - RNA, 20 nt, Homo sapiens
uaacuaguggcucucaguua

SEQ ID NO: 1468219 - RNA, 14 nt, Homo sapiens
uaacuaugacagau

SEQ ID NO: 1468220 - RNA, 14 nt, Homo sapiens
uaacucacucaguu

SEQ ID NO: 1468221 - RNA, 15 nt, Homo sapiens
uaacucacugagggu

SEQ ID NO: 1468222 - RNA, 15 nt, Homo sapiens
uaacucggauuccag

SEQ ID NO: 1468223 - RNA, 19 nt, Homo sapiens
uaacugcaccaacgagcug

SEQ ID NO: 1468224 - RNA, 18 nt, Homo sapiens
uaacugugccaguucuuu

SEQ ID NO: 1468225 - RNA, 14 nt, Homo sapiens
uaacuuauauugaa

SEQ ID NO: 1468226 - RNA, 19 nt, Homo sapiens
uaacuuauauugaagacaa

SEQ ID NO: 1468227 - RNA, 13 nt, Homo sapiens
uaacuuauuuucc

SEQ ID NO: 1468228 - RNA, 18 nt, Homo sapiens
uaacuuucagaggcaaua

SEQ ID NO: 1468229 - RNA, 20 nt, Homo sapiens
uaacuuuuuuuucucucuuu

SEQ ID NO: 1468230 - RNA, 22 nt, Homo sapiens
uaagaaaacaaaaucuaaaaca

SEQ ID NO: 1468231 - RNA, 13 nt, Homo sapiens
uaagaaagacuau

SEQ ID NO: 1468232 - RNA, 16 nt, Homo sapiens
uaagaaagaucaaaga

SEQ ID NO: 1468233 - RNA, 17 nt, Homo sapiens
uaagaaaugaacaaaag

SEQ ID NO: 1468234 - RNA, 14 nt, Homo sapiens
uaagaaugcugguu

SEQ ID NO: 1468235 - RNA, 18 nt, Homo sapiens
uaagaauuuagggagaaa

SEQ ID NO: 1468236 - RNA, 13 nt, Homo sapiens
uaagaauuucaca

SEQ ID NO: 1468237 - RNA, 15 nt, Homo sapiens
uaagacacucaaaua

SEQ ID NO: 1468238 - RNA, 18 nt, Homo sapiens
uaagacaugauuuccuug

SEQ ID NO: 1468239 - RNA, 12 nt, Homo sapiens
uaagacauguga

SEQ ID NO: 1468240 - RNA, 19 nt, Homo sapiens
uaagacugugacaacuguc

SEQ ID NO: 1468241 - RNA, 23 nt, Homo sapiens
uaagacuguuuuuaaguaacuua

SEQ ID NO: 1468242 - RNA, 23 nt, Homo sapiens
uaagacuuccccucaacaugcug

SEQ ID NO: 1468243 - RNA, 13 nt, Homo sapiens
uaaggaacaacgu

SEQ ID NO: 1468244 - RNA, 14 nt, Homo sapiens
uaaggacauuuccc

SEQ ID NO: 1468245 - RNA, 16 nt, Homo sapiens
uaaggacuucugcagc

SEQ ID NO: 1468246 - RNA, 16 nt, Homo sapiens
uaaggaggcacugcug

SEQ ID NO: 1468247 - RNA, 13 nt, Homo sapiens
uaaggaugaaggu

SEQ ID NO: 1468248 - RNA, 20 nt, Homo sapiens
uaagggaaggaacucuggcu

SEQ ID NO: 1468249 - RNA, 18 nt, Homo sapiens
uaagggacucccacaaca

SEQ ID NO: 1468250 - RNA, 22 nt, Homo sapiens
uaaggggggcagggagugauga

SEQ ID NO: 1468251 - RNA, 17 nt, Homo sapiens
uaagggugggugcucag

SEQ ID NO: 1468252 - RNA, 13 nt, Homo sapiens
uaagguacuuaaa

SEQ ID NO: 1468253 - RNA, 19 nt, Homo sapiens
uaaggugcaguucccccaa

SEQ ID NO: 1468254 - RNA, 19 nt, Homo sapiens
uaaguacacaauaagcaaa

SEQ ID NO: 1468255 - RNA, 20 nt, Homo sapiens
uaaguacuauguaucaauga

SEQ ID NO: 1468256 - RNA, 16 nt, Homo sapiens
uaaguccaguguuucu

SEQ ID NO: 1468257 - RNA, 24 nt, Homo sapiens
uaagugaaaaucuuacaacaggcu

SEQ ID NO: 1468258 - RNA, 20 nt, Homo sapiens
uaagugauauaaaucagauu

SEQ ID NO: 1468259 - RNA, 19 nt, Homo sapiens
uaagugcuuuguaauggga

SEQ ID NO: 1468260 - RNA, 20 nt, Homo sapiens
uaagugggguugcaaccacu

SEQ ID NO: 1468261 - RNA, 14 nt, Homo sapiens
uaaguuuaucuuuc

SEQ ID NO: 1468262 - RNA, 14 nt, Homo sapiens
uaaguuucugggac

SEQ ID NO: 1468263 - RNA, 18 nt, Homo sapiens
uaauaaaaaucauggcaa

SEQ ID NO: 1468264 - RNA, 19 nt, Homo sapiens
uaauaaaacuaaacuuuca

SEQ ID NO: 1468265 - RNA, 17 nt, Homo sapiens
uaauaaacauccuucaa

SEQ ID NO: 1468266 - RNA, 15 nt, Homo sapiens
uaauaaaccuccuuc

SEQ ID NO: 1468267 - RNA, 12 nt, Homo sapiens
uaauaacaaacg

SEQ ID NO: 1468268 - RNA, 13 nt, Homo sapiens
uaauaacugugaa

SEQ ID NO: 1468269 - RNA, 15 nt, Homo sapiens
uaauaagcuaaagag

SEQ ID NO: 1468270 - RNA, 13 nt, Homo sapiens
uaauaauugauca

SEQ ID NO: 1468271 - RNA, 15 nt, Homo sapiens
uaauacaucaaagag

SEQ ID NO: 1468272 - RNA, 19 nt, Homo sapiens
uaauacauugaucaggcca

SEQ ID NO: 1468273 - RNA, 14 nt, Homo sapiens
uaauacguacaugu

SEQ ID NO: 1468274 - RNA, 18 nt, Homo sapiens
uaauacguagcucucuua

SEQ ID NO: 1468275 - RNA, 23 nt, Homo sapiens
uaauacugguauuuuuacuuaau

SEQ ID NO: 1468276 - RNA, 19 nt, Homo sapiens
uaauagucaauuucuacuu

SEQ ID NO: 1468277 - RNA, 18 nt, Homo sapiens
uaauaguuuugauccuaa

SEQ ID NO: 1468278 - RNA, 14 nt, Homo sapiens
uaauauaguagauu

SEQ ID NO: 1468279 - RNA, 20 nt, Homo sapiens
uaauauaguuauugcacaag

SEQ ID NO: 1468280 - RNA, 19 nt, Homo sapiens
uaauaucaugugcacuuca

SEQ ID NO: 1468281 - RNA, 15 nt, Homo sapiens
uaauaugacaaaaca

SEQ ID NO: 1468282 - RNA, 15 nt, Homo sapiens
uaauauugugcaaac

SEQ ID NO: 1468283 - RNA, 21 nt, Homo sapiens
uaaucaagaaaaacaucuuug

SEQ ID NO: 1468284 - RNA, 18 nt, Homo sapiens
uaauccaguaaaauaaua

SEQ ID NO: 1468285 - RNA, 13 nt, Homo sapiens
uaaucccagcacu

SEQ ID NO: 1468286 - RNA, 14 nt, Homo sapiens
uaaucccagcacuu

SEQ ID NO: 1468287 - RNA, 16 nt, Homo sapiens
uaaucucucugcagcu

SEQ ID NO: 1468288 - RNA, 19 nt, Homo sapiens
uaaucucucugcagcugcc

SEQ ID NO: 1468289 - RNA, 19 nt, Homo sapiens
uaaucuggaauaugcaaca

SEQ ID NO: 1468290 - RNA, 15 nt, Homo sapiens
uaaucuucauggcca

SEQ ID NO: 1468291 - RNA, 22 nt, Homo sapiens
uaaugaaauaauguacaucugg

SEQ ID NO: 1468292 - RNA, 14 nt, Homo sapiens
uaaugaaauacauc

SEQ ID NO: 1468293 - RNA, 16 nt, Homo sapiens
uaaugaaauacaucau

SEQ ID NO: 1468294 - RNA, 19 nt, Homo sapiens
uaaugaaguguuuagcaua

SEQ ID NO: 1468295 - RNA, 17 nt, Homo sapiens
uaaugaauacauuucca

SEQ ID NO: 1468296 - RNA, 18 nt, Homo sapiens
uaaugaauacauuuccaa

SEQ ID NO: 1468297 - RNA, 12 nt, Homo sapiens
uaaugacacucc

SEQ ID NO: 1468298 - RNA, 15 nt, Homo sapiens
uaaugagacaugaau

SEQ ID NO: 1468299 - RNA, 16 nt, Homo sapiens
uaaugagccaucacua

SEQ ID NO: 1468300 - RNA, 17 nt, Homo sapiens
uaauggcaauaggacau

SEQ ID NO: 1468301 - RNA, 21 nt, Homo sapiens
uaauggcaucaauauacauaa

SEQ ID NO: 1468302 - RNA, 19 nt, Homo sapiens
uaaugguguagaacacuaa

SEQ ID NO: 1468303 - RNA, 14 nt, Homo sapiens
uaaugguguuuuaa

SEQ ID NO: 1468304 - RNA, 14 nt, Homo sapiens
uaauguaagcucua

SEQ ID NO: 1468305 - RNA, 20 nt, Homo sapiens
uaauguacacauugcauuuu

SEQ ID NO: 1468306 - RNA, 17 nt, Homo sapiens
uaauguagcguguuuac

SEQ ID NO: 1468307 - RNA, 13 nt, Homo sapiens
uaauguccagcua

SEQ ID NO: 1468308 - RNA, 21 nt, Homo sapiens
uaaugucuucauaaaguacuu

SEQ ID NO: 1468309 - RNA, 18 nt, Homo sapiens
uaauguguuaagugcagg

SEQ ID NO: 1468310 - RNA, 14 nt, Homo sapiens
uaauguuacugauc

SEQ ID NO: 1468311 - RNA, 20 nt, Homo sapiens
uaauguuauaucauauguau

SEQ ID NO: 1468312 - RNA, 21 nt, Homo sapiens
uaauguucacauagugaaaua

SEQ ID NO: 1468313 - RNA, 23 nt, Homo sapiens
uaauguuuuuugccacagcuuuu

SEQ ID NO: 1468314 - RNA, 18 nt, Homo sapiens
uaauuaggguacauuuau

SEQ ID NO: 1468315 - RNA, 20 nt, Homo sapiens
uaauuaucgggaacaguguu

SEQ ID NO: 1468316 - RNA, 17 nt, Homo sapiens
uaauuauuucacuuuag

SEQ ID NO: 1468317 - RNA, 19 nt, Homo sapiens
uaauucaagaaaacaacuu

SEQ ID NO: 1468318 - RNA, 13 nt, Homo sapiens
uaauucaauguga

SEQ ID NO: 1468319 - RNA, 21 nt, Homo sapiens
uaauucacagaauagcacaaa

SEQ ID NO: 1468320 - RNA, 19 nt, Homo sapiens
uaauucacucaagcacuga

SEQ ID NO: 1468321 - RNA, 21 nt, Homo sapiens
uaauucacucaagcacugaua

SEQ ID NO: 1468322 - RNA, 14 nt, Homo sapiens
uaauucagcacuga

SEQ ID NO: 1468323 - RNA, 13 nt, Homo sapiens
uaauucagcacuu

SEQ ID NO: 1468324 - RNA, 20 nt, Homo sapiens
uaauucauaaaucacaaaua

SEQ ID NO: 1468325 - RNA, 19 nt, Homo sapiens
uaauucauaaucacucuaa

SEQ ID NO: 1468326 - RNA, 15 nt, Homo sapiens
uaauucauaguaauu

SEQ ID NO: 1468327 - RNA, 15 nt, Homo sapiens
uaauucuaaguuauu

SEQ ID NO: 1468328 - RNA, 14 nt, Homo sapiens
uaauucuggagaua

SEQ ID NO: 1468329 - RNA, 17 nt, Homo sapiens
uaauucuuaaaagggaa

SEQ ID NO: 1468330 - RNA, 16 nt, Homo sapiens
uaauugcuuacauuuu

SEQ ID NO: 1468331 - RNA, 15 nt, Homo sapiens
uaauuguaaucugaa

SEQ ID NO: 1468332 - RNA, 14 nt, Homo sapiens
uaauuuaaagcuua

SEQ ID NO: 1468333 - RNA, 21 nt, Homo sapiens
uaauuuauuuaauauacuuua

SEQ ID NO: 1468334 - RNA, 18 nt, Homo sapiens
agcagccgccagcuggga

SEQ ID NO: 1468335 - RNA, 21 nt, Homo sapiens
agcagcuccccaggagcucag

SEQ ID NO: 1468336 - RNA, 13 nt, Homo sapiens
agcaggacuccag

SEQ ID NO: 1468337 - RNA, 15 nt, Homo sapiens
agcaggaggccaaua

SEQ ID NO: 1468338 - RNA, 15 nt, Homo sapiens
agcaggaguggugca

SEQ ID NO: 1468339 - RNA, 21 nt, Homo sapiens
agcaggcagcgccaagugcgu

SEQ ID NO: 1468340 - RNA, 21 nt, Homo sapiens
agcaggccggaaccacagggc

SEQ ID NO: 1468341 - RNA, 17 nt, Homo sapiens
agcaggugcugacuuca

SEQ ID NO: 1468342 - RNA, 16 nt, Homo sapiens
agcaguaaauuugcua

SEQ ID NO: 1468343 - RNA, 19 nt, Homo sapiens
agcaguaccccccuaccac

SEQ ID NO: 1468344 - RNA, 10 nt, Homo sapiens
agcagucaau

SEQ ID NO: 1468345 - RNA, 20 nt, Homo sapiens
agcagucagaguccagugcu

SEQ ID NO: 1468346 - RNA, 21 nt, Homo sapiens
agcagucccaguauucucaga

SEQ ID NO: 1468347 - RNA, 13 nt, Homo sapiens
agcagucuugcuc

SEQ ID NO: 1468348 - RNA, 23 nt, Homo sapiens
cagaaggacacuagccugugcac

SEQ ID NO: 1468349 - RNA, 20 nt, Homo sapiens
cagaaggauuaccugaggca

SEQ ID NO: 1468350 - RNA, 23 nt, Homo sapiens
cagaaggcagagguugcagugag

SEQ ID NO: 1468351 - RNA, 23 nt, Homo sapiens
cagaauagcuuugaauguggccc

SEQ ID NO: 1468352 - RNA, 19 nt, Homo sapiens
cagaauauugcuuugguca

SEQ ID NO: 1468353 - RNA, 17 nt, Homo sapiens
cagaauauugugcccca

SEQ ID NO: 1468354 - RNA, 18 nt, Homo sapiens
cagaauauugugccccau

SEQ ID NO: 1468355 - RNA, 21 nt, Homo sapiens
cagaaucaagcuuuugcuuga

SEQ ID NO: 1468356 - RNA, 17 nt, Homo sapiens
cagaaucucaaauaacu

SEQ ID NO: 1468357 - RNA, 15 nt, Homo sapiens
cagaauguacggaaa

SEQ ID NO: 1468358 - RNA, 15 nt, Homo sapiens
cagacaaagugacau

SEQ ID NO: 1468359 - RNA, 16 nt, Homo sapiens
cagacaacagaaguca

SEQ ID NO: 1468360 - RNA, 18 nt, Homo sapiens
cagacacacccacagaag

SEQ ID NO: 1468361 - RNA, 18 nt, Homo sapiens
cagacagaagucuccuca

SEQ ID NO: 1468362 - RNA, 19 nt, Homo sapiens
cagacagccguuuguucua

SEQ ID NO: 1468363 - RNA, 14 nt, Homo sapiens
cagaccacuugcca

SEQ ID NO: 1468364 - RNA, 17 nt, Homo sapiens
cagaccagugaccccag

SEQ ID NO: 1468365 - RNA, 17 nt, Homo sapiens
cagaccaugaaguaaau

SEQ ID NO: 1468366 - RNA, 12 nt, Homo sapiens
cagacccagugg

SEQ ID NO: 1468367 - RNA, 22 nt, Homo sapiens
cagacccaguggacucuuccac

SEQ ID NO: 1468368 - RNA, 20 nt, Homo sapiens
cagaccgugaccaucuuugu

SEQ ID NO: 1468369 - RNA, 18 nt, Homo sapiens
cagaccugcauugaacag

SEQ ID NO: 1468370 - RNA, 18 nt, Homo sapiens
cagacggcggccaggcac

SEQ ID NO: 1468371 - RNA, 20 nt, Homo sapiens
cagacuaaaggauccagaga

SEQ ID NO: 1468372 - RNA, 20 nt, Homo sapiens
cagacuacacaggaugaggu

SEQ ID NO: 1468373 - RNA, 16 nt, Homo sapiens
cagacucaguuuguca

SEQ ID NO: 1468374 - RNA, 20 nt, Homo sapiens
cagacuucaucauugugcua

SEQ ID NO: 1468375 - RNA, 16 nt, Homo sapiens
cagagaaauacuuuca

SEQ ID NO: 1468376 - RNA, 14 nt, Homo sapiens
cagagaagcuggac

SEQ ID NO: 1468377 - RNA, 13 nt, Homo sapiens
cagagaagguaag

SEQ ID NO: 1468378 - RNA, 17 nt, Homo sapiens
uauuauacgcuggcaac

SEQ ID NO: 1468379 - RNA, 15 nt, Homo sapiens
uauuauacuaagaaa

SEQ ID NO: 1468380 - RNA, 14 nt, Homo sapiens
uauuauuaucacau

SEQ ID NO: 1468381 - RNA, 18 nt, Homo sapiens
uauuauucuucauaacaa

SEQ ID NO: 1468382 - RNA, 14 nt, Homo sapiens
uauucaagcacuua

SEQ ID NO: 1468383 - RNA, 18 nt, Homo sapiens
uauucauuagcugugauu

SEQ ID NO: 1468384 - RNA, 11 nt, Homo sapiens
uauuccaucaa

SEQ ID NO: 1468385 - RNA, 21 nt, Homo sapiens
uauucgugcauuuuuggauca

SEQ ID NO: 1468386 - RNA, 15 nt, Homo sapiens
uauucuaaaaccauu

SEQ ID NO: 1468387 - RNA, 20 nt, Homo sapiens
uauucuaagcccuuugccau

SEQ ID NO: 1468388 - RNA, 23 nt, Homo sapiens
uauucuaguuuugucaaacugua

SEQ ID NO: 1468389 - RNA, 19 nt, Homo sapiens
uauucucuaaaagcuuuaa

SEQ ID NO: 1468390 - RNA, 15 nt, Homo sapiens
uauucucugcaauuu

SEQ ID NO: 1468391 - RNA, 16 nt, Homo sapiens
uauucucugcaauuug

SEQ ID NO: 1468392 - RNA, 16 nt, Homo sapiens
uauucuguuuugcaca

SEQ ID NO: 1468393 - RNA, 13 nt, Homo sapiens
uauugacacugaa

SEQ ID NO: 1468394 - RNA, 18 nt, Homo sapiens
uauugcaggauucuguaa

SEQ ID NO: 1468395 - RNA, 18 nt, Homo sapiens
uauugcauuuauauguac

SEQ ID NO: 1468396 - RNA, 17 nt, Homo sapiens
uauuggaagcauacaaa

SEQ ID NO: 1468397 - RNA, 21 nt, Homo sapiens
uauuggcugcuuugccucuac

SEQ ID NO: 1468398 - RNA, 14 nt, Homo sapiens
uauuguacauaaaa

SEQ ID NO: 1468399 - RNA, 23 nt, Homo sapiens
uauuuaaacaugguuacaaucau

SEQ ID NO: 1468400 - RNA, 18 nt, Homo sapiens
uauuuaaagccuccucau

SEQ ID NO: 1468401 - RNA, 22 nt, Homo sapiens
uauuuaaagccuccucaucccg

SEQ ID NO: 1468402 - RNA, 22 nt, Homo sapiens
uauuuaauauaguaacacacuu

SEQ ID NO: 1468403 - RNA, 23 nt, Homo sapiens
uauuuaaucaaacaguaaucuag

SEQ ID NO: 1468404 - RNA, 19 nt, Homo sapiens
uauuuacuuuuaccacuau

SEQ ID NO: 1468405 - RNA, 19 nt, Homo sapiens
uauuuagaaauagaacuac

SEQ ID NO: 1468406 - RNA, 21 nt, Homo sapiens
uauuuagaaauagaacuacaa

SEQ ID NO: 1468407 - RNA, 18 nt, Homo sapiens
uauuuagauauaacacua

SEQ ID NO: 1468408 - RNA, 20 nt, Homo sapiens
uauuuagauauaacacuaug

SEQ ID NO: 1468409 - RNA, 16 nt, Homo sapiens
uauuuauguguucaca

SEQ ID NO: 1468410 - RNA, 15 nt, Homo sapiens
uauuucacuugauga

SEQ ID NO: 1468411 - RNA, 16 nt, Homo sapiens
uauuucauccaguuug

SEQ ID NO: 1468412 - RNA, 23 nt, Homo sapiens
uauuuccaagaaauauuccuuaa

SEQ ID NO: 1468413 - RNA, 19 nt, Homo sapiens
uauuuccauucaacaagag

SEQ ID NO: 1468414 - RNA, 18 nt, Homo sapiens
uauuucccucaccuuucc

SEQ ID NO: 1468415 - RNA, 22 nt, Homo sapiens
uauuucuucuacugcuaucuac

SEQ ID NO: 1468416 - RNA, 23 nt, Homo sapiens
uauuugaaauacuaaaagcaaau

SEQ ID NO: 1468417 - RNA, 16 nt, Homo sapiens
uauuugaaucuacaaa

SEQ ID NO: 1468418 - RNA, 16 nt, Homo sapiens
uauuugcuaagcauau

SEQ ID NO: 1468419 - RNA, 16 nt, Homo sapiens
uauuugcuuuuugcua

SEQ ID NO: 1468420 - RNA, 24 nt, Homo sapiens
uauuugcuuuuugcuaacaaugcu

SEQ ID NO: 1468421 - RNA, 14 nt, Homo sapiens
uauuuggaaccuug

SEQ ID NO: 1468422 - RNA, 21 nt, Homo sapiens
uauuugggagggaaaagggaa

SEQ ID NO: 1468423 - RNA, 22 nt, Homo sapiens
uauuugggauauguauggguag

SEQ ID NO: 1468424 - RNA, 11 nt, Homo sapiens
uauuugucauu

SEQ ID NO: 1468425 - RNA, 20 nt, Homo sapiens
uauuuuaaaguaaaagucua

SEQ ID NO: 1468426 - RNA, 17 nt, Homo sapiens
uauuuuaagaauuucac

SEQ ID NO: 1468427 - RNA, 22 nt, Homo sapiens
uauuuuaagaauuucacaagcu

SEQ ID NO: 1468428 - RNA, 22 nt, Homo sapiens
uauuuuacaaucaacaaaaugg

SEQ ID NO: 1468429 - RNA, 17 nt, Homo sapiens
uauuuuauuuagacaag

SEQ ID NO: 1468430 - RNA, 21 nt, Homo sapiens
uauuuucagccuacaguuaug

SEQ ID NO: 1468431 - RNA, 22 nt, Homo sapiens
uauuuucuuacccaauuuccca

SEQ ID NO: 1468432 - RNA, 14 nt, Homo sapiens
uauuuugaaguuua

SEQ ID NO: 1468433 - RNA, 22 nt, Homo sapiens
uauuuugcauaguaccaaucau

SEQ ID NO: 1468434 - RNA, 12 nt, Homo sapiens
uauuuugcccag

SEQ ID NO: 1468435 - RNA, 13 nt, Homo sapiens
uauuuugguucuu

SEQ ID NO: 1468436 - RNA, 17 nt, Homo sapiens
uauuuuguaaugcugca

SEQ ID NO: 1468437 - RNA, 21 nt, Homo sapiens
uauuuuguaaugcugcacaga

SEQ ID NO: 1468438 - RNA, 16 nt, Homo sapiens
uauuuuguugccuuca

SEQ ID NO: 1468439 - RNA, 14 nt, Homo sapiens
uauuuuuaccuaaa

SEQ ID NO: 1468440 - RNA, 20 nt, Homo sapiens
uauuuuuauaauaaacauaa

SEQ ID NO: 1468441 - RNA, 22 nt, Homo sapiens
uauuuuuguuucuuccaaagca

SEQ ID NO: 1468442 - RNA, 23 nt, Homo sapiens
ucaaaaaagaaaaaagaaaagaa

SEQ ID NO: 1468443 - RNA, 17 nt, Homo sapiens
ucaaaaaaucugaccaa

SEQ ID NO: 1468444 - RNA, 14 nt, Homo sapiens
ucaaaaacagcaga

SEQ ID NO: 1468445 - RNA, 15 nt, Homo sapiens
ucaaaaagagagauu

SEQ ID NO: 1468446 - RNA, 19 nt, Homo sapiens
ucaaaacagagaugugaua

SEQ ID NO: 1468447 - RNA, 13 nt, Homo sapiens
ucaaaagaaauaa

SEQ ID NO: 1468448 - RNA, 17 nt, Homo sapiens
ucaaaagauuaaugugu

SEQ ID NO: 1468449 - RNA, 17 nt, Homo sapiens
ucaaaagccagauguga

SEQ ID NO: 1468450 - RNA, 16 nt, Homo sapiens
ucaaaaggaaaccaag

SEQ ID NO: 1468451 - RNA, 21 nt, Homo sapiens
ucaaaaguugguguugacaua

SEQ ID NO: 1468452 - RNA, 14 nt, Homo sapiens
ucaaaaucaauuaa

SEQ ID NO: 1468453 - RNA, 14 nt, Homo sapiens
ucaaacagugccaa

SEQ ID NO: 1468454 - RNA, 22 nt, Homo sapiens
ucaaaccccuacugaccuggcu

SEQ ID NO: 1468455 - RNA, 16 nt, Homo sapiens
ucaaacgacagaggag

SEQ ID NO: 1468456 - RNA, 17 nt, Homo sapiens
ucaaacuccugaccuca

SEQ ID NO: 1468457 - RNA, 12 nt, Homo sapiens
ucaaagaaagaa

SEQ ID NO: 1468458 - RNA, 14 nt, Homo sapiens
ucaaagaacaaaca

SEQ ID NO: 1468459 - RNA, 20 nt, Homo sapiens
ucaaagaagucauucuuuaa

SEQ ID NO: 1468460 - RNA, 17 nt, Homo sapiens
ucaaagaggaaccagga

SEQ ID NO: 1468461 - RNA, 14 nt, Homo sapiens
ucaaagauucacac

SEQ ID NO: 1468462 - RNA, 16 nt, Homo sapiens
ucaaagccuugguuua

SEQ ID NO: 1468463 - RNA, 22 nt, Homo sapiens
ucaaaguucugggacuacaggc

SEQ ID NO: 1468464 - RNA, 21 nt, Homo sapiens
ucaaaguuuggauuguaucaa

SEQ ID NO: 1468465 - RNA, 22 nt, Homo sapiens
ucaaaguuuugaaaagcuauua

SEQ ID NO: 1468466 - RNA, 13 nt, Homo sapiens
ucaaauagcauaa

SEQ ID NO: 1468467 - RNA, 14 nt, Homo sapiens
ucaaauagcauaag

SEQ ID NO: 1468468 - RNA, 14 nt, Homo sapiens
ucaaauauuucaac

SEQ ID NO: 1468469 - RNA, 15 nt, Homo sapiens
ucaaaucaaucugua

SEQ ID NO: 1468470 - RNA, 21 nt, Homo sapiens
ucaaaucacauggcuuuccac

SEQ ID NO: 1468471 - RNA, 15 nt, Homo sapiens
ucaaaucguccagcg

SEQ ID NO: 1468472 - RNA, 14 nt, Homo sapiens
ucaaaugcauuuug

SEQ ID NO: 1468473 - RNA, 17 nt, Homo sapiens
ucaacaagaguugucuu

SEQ ID NO: 1468474 - RNA, 13 nt, Homo sapiens
ucaacacuguuac

SEQ ID NO: 1468475 - RNA, 19 nt, Homo sapiens
aaucaaucauuucuauuaa

SEQ ID NO: 1468476 - RNA, 20 nt, Homo sapiens
aaucaauccugggcaaucag

SEQ ID NO: 1468477 - RNA, 12 nt, Homo sapiens
aaucaaucugca

SEQ ID NO: 1468478 - RNA, 14 nt, Homo sapiens
aaucaaucuguaaa

SEQ ID NO: 1468479 - RNA, 17 nt, Homo sapiens
aaucagaacuaaccagu

SEQ ID NO: 1468480 - RNA, 18 nt, Homo sapiens
aaucagcaaccugacuca

SEQ ID NO: 1468481 - RNA, 17 nt, Homo sapiens
aaucagcauucucacuc

SEQ ID NO: 1468482 - RNA, 15 nt, Homo sapiens
aaucagccacauucu

SEQ ID NO: 1468483 - RNA, 15 nt, Homo sapiens
aaucagccuggccau

SEQ ID NO: 1468484 - RNA, 22 nt, Homo sapiens
aaucaggcugaggugucuuaag

SEQ ID NO: 1468485 - RNA, 15 nt, Homo sapiens
aaucagucagccgcu

SEQ ID NO: 1468486 - RNA, 21 nt, Homo sapiens
aaucagugaagaugcaaucag

SEQ ID NO: 1468487 - RNA, 23 nt, Homo sapiens
aaucagugugucuaaauuugaau

SEQ ID NO: 1468488 - RNA, 19 nt, Homo sapiens
aaucauaaaacuugaugug

SEQ ID NO: 1468489 - RNA, 24 nt, Homo sapiens
aaucaucuauaaagaagaacuugc

SEQ ID NO: 1468490 - RNA, 16 nt, Homo sapiens
aaucauuaauacucuu

SEQ ID NO: 1468491 - RNA, 23 nt, Homo sapiens
aaucauugauugucagcuacuaa

SEQ ID NO: 1468492 - RNA, 22 nt, Homo sapiens
aaucauuucaguaucaucucca

SEQ ID NO: 1468493 - RNA, 15 nt, Homo sapiens
aaucauuucuauuaa

SEQ ID NO: 1468494 - RNA, 20 nt, Homo sapiens
aauccaaauggcgucuggaa

SEQ ID NO: 1468495 - RNA, 17 nt, Homo sapiens
aauccagacucuuucga

SEQ ID NO: 1468496 - RNA, 22 nt, Homo sapiens
aauccaguccagauauuucaca

SEQ ID NO: 1468497 - RNA, 19 nt, Homo sapiens
aauccaugcuucucaucug

SEQ ID NO: 1468498 - RNA, 18 nt, Homo sapiens
aaucccuguaauauuuag

SEQ ID NO: 1468499 - RNA, 12 nt, Homo sapiens
aauccuggacca

SEQ ID NO: 1468500 - RNA, 22 nt, Homo sapiens
aauccuguaccaaaucugacau

SEQ ID NO: 1468501 - RNA, 20 nt, Homo sapiens
aauccuuaacacauucaaua

SEQ ID NO: 1468502 - RNA, 21 nt, Homo sapiens
aauccuucccugcucuugcag

SEQ ID NO: 1468503 - RNA, 13 nt, Homo sapiens
aauccuucucauu

SEQ ID NO: 1468504 - RNA, 14 nt, Homo sapiens
aauccuugacugga

SEQ ID NO: 1468505 - RNA, 17 nt, Homo sapiens
aauccuugccacagugu

SEQ ID NO: 1468506 - RNA, 19 nt, Homo sapiens
aauccuuuacuguuaguca

SEQ ID NO: 1468507 - RNA, 15 nt, Homo sapiens
aauccuuuuccuuau

SEQ ID NO: 1468508 - RNA, 19 nt, Homo sapiens
aaucgauucugcagcaccg

SEQ ID NO: 1468509 - RNA, 20 nt, Homo sapiens
aaucuaaaccuuacaugugu

SEQ ID NO: 1468510 - RNA, 15 nt, Homo sapiens
aaucuaacaucgugg

SEQ ID NO: 1468511 - RNA, 20 nt, Homo sapiens
aaucuaccugcccuaaggga

SEQ ID NO: 1468512 - RNA, 16 nt, Homo sapiens
aaucuacuaauuccac

SEQ ID NO: 1468513 - RNA, 21 nt, Homo sapiens
aaucuauccauugaacuaaaa

SEQ ID NO: 1468514 - RNA, 18 nt, Homo sapiens
aaucucaccccaucccac

SEQ ID NO: 1468515 - RNA, 20 nt, Homo sapiens
aaucucacccucuccuccag

SEQ ID NO: 1468516 - RNA, 13 nt, Homo sapiens
aaucuccagugga

SEQ ID NO: 1468517 - RNA, 22 nt, Homo sapiens
aaucucuacgacuaaucaccua

SEQ ID NO: 1468518 - RNA, 14 nt, Homo sapiens
aaucugaacucuca

SEQ ID NO: 1468519 - RNA, 13 nt, Homo sapiens
aaucugagccagu

SEQ ID NO: 1468520 - RNA, 22 nt, Homo sapiens
aaucuggcuccuuuacaaaaga

SEQ ID NO: 1468521 - RNA, 18 nt, Homo sapiens
aaucuguccgugaccuau

SEQ ID NO: 1468522 - RNA, 16 nt, Homo sapiens
aaucugugccugcacu

SEQ ID NO: 1468523 - RNA, 20 nt, Homo sapiens
aaucugugccugcacugaga

SEQ ID NO: 1468524 - RNA, 21 nt, Homo sapiens
aaucuuccgauggaugaaucu

SEQ ID NO: 1468525 - RNA, 19 nt, Homo sapiens
aaucuucuccuaugcauuu

SEQ ID NO: 1468526 - RNA, 19 nt, Homo sapiens
aaucuucucuuugacaauu

SEQ ID NO: 1468527 - RNA, 15 nt, Homo sapiens
aaucuuuaccuguau

SEQ ID NO: 1468528 - RNA, 16 nt, Homo sapiens
aaucuuucacuugaaa

SEQ ID NO: 1468529 - RNA, 17 nt, Homo sapiens
aaucuuucugugucuuc

SEQ ID NO: 1468530 - RNA, 19 nt, Homo sapiens
aaucuuuggguaacuucaa

SEQ ID NO: 1468531 - RNA, 18 nt, Homo sapiens
aaucuuuuacaacugccu

SEQ ID NO: 1468532 - RNA, 15 nt, Homo sapiens
aaugaaaagccaaau

SEQ ID NO: 1468533 - RNA, 14 nt, Homo sapiens
aaugaaaauuguau

SEQ ID NO: 1468534 - RNA, 13 nt, Homo sapiens
aaugaaacuuuaa

SEQ ID NO: 1468535 - RNA, 22 nt, Homo sapiens
aaugaaagcccucaugugcagu

SEQ ID NO: 1468536 - RNA, 14 nt, Homo sapiens
aaugaaauuugcaa

SEQ ID NO: 1468537 - RNA, 13 nt, Homo sapiens
aaugaacacuccc

SEQ ID NO: 1468538 - RNA, 14 nt, Homo sapiens
aaugaaccacaaaa

SEQ ID NO: 1468539 - RNA, 16 nt, Homo sapiens
aaugaaccuucugcaa

SEQ ID NO: 1468540 - RNA, 16 nt, Homo sapiens
aaugaauaaacugaau

SEQ ID NO: 1468541 - RNA, 16 nt, Homo sapiens
aaugaauacugggaau

SEQ ID NO: 1468542 - RNA, 12 nt, Homo sapiens
aaugaaucuuca

SEQ ID NO: 1468543 - RNA, 15 nt, Homo sapiens
aaugaaucuucacaa

SEQ ID NO: 1468544 - RNA, 21 nt, Homo sapiens
aaugacacgccuaaggucaca

SEQ ID NO: 1468545 - RNA, 14 nt, Homo sapiens
aaugacaucuucaa

SEQ ID NO: 1468546 - RNA, 23 nt, Homo sapiens
aaugacaucuucaaagcuugaag

SEQ ID NO: 1468547 - RNA, 16 nt, Homo sapiens
aaugaccaauauuaua

SEQ ID NO: 1468548 - RNA, 18 nt, Homo sapiens
aaugacugacuugucuaa

SEQ ID NO: 1468549 - RNA, 13 nt, Homo sapiens
aaugaucacucca

SEQ ID NO: 1468550 - RNA, 15 nt, Homo sapiens
aaugaugggacaaua

SEQ ID NO: 1468551 - RNA, 17 nt, Homo sapiens
aaugauuaaacuauuaa

SEQ ID NO: 1468552 - RNA, 23 nt, Homo sapiens
aaugcaacaaaugaauuuuccac

SEQ ID NO: 1468553 - RNA, 16 nt, Homo sapiens
aaugcaauccuucccu

SEQ ID NO: 1468554 - RNA, 15 nt, Homo sapiens
aaugcacaguugcca

SEQ ID NO: 1468555 - RNA, 12 nt, Homo sapiens
aaugcauucccu

SEQ ID NO: 1468556 - RNA, 16 nt, Homo sapiens
aaugcauugcuaaaau

SEQ ID NO: 1468557 - RNA, 18 nt, Homo sapiens
aaugcauuugauggccac

SEQ ID NO: 1468558 - RNA, 19 nt, Homo sapiens
aaugcauuuuauucuuuaa

SEQ ID NO: 1468559 - RNA, 14 nt, Homo sapiens
aaugccccaaggac

SEQ ID NO: 1468560 - RNA, 14 nt, Homo sapiens
aaugcccugugcau

SEQ ID NO: 1468561 - RNA, 16 nt, Homo sapiens
aaugccucaaugugac

SEQ ID NO: 1468562 - RNA, 17 nt, Homo sapiens
aaugcuacauacuccaa

SEQ ID NO: 1468563 - RNA, 22 nt, Homo sapiens
aaugcuccauuaauccagggaa

SEQ ID NO: 1468564 - RNA, 16 nt, Homo sapiens
aaugcucuuuacuuca

SEQ ID NO: 1468565 - RNA, 14 nt, Homo sapiens
aaugcuggacugga

SEQ ID NO: 1468566 - RNA, 17 nt, Homo sapiens
aaugcuggcauuugcac

SEQ ID NO: 1468567 - RNA, 16 nt, Homo sapiens
aaugcuguguugggua

SEQ ID NO: 1468568 - RNA, 17 nt, Homo sapiens
aaugcuuuccaucucca

SEQ ID NO: 1468569 - RNA, 17 nt, Homo sapiens
aauggaaaguaacucau

SEQ ID NO: 1468570 - RNA, 13 nt, Homo sapiens
aauggaaguccau

SEQ ID NO: 1468571 - RNA, 15 nt, Homo sapiens
aauggaauacugaaa

SEQ ID NO: 1468572 - RNA, 20 nt, Homo sapiens
aauggagggaauaauaccua

SEQ ID NO: 1468573 - RNA, 19 nt, Homo sapiens
aauggaucuuaaagcauuc

SEQ ID NO: 1468574 - RNA, 18 nt, Homo sapiens
aauggcagcauacacaga

SEQ ID NO: 1468575 - RNA, 23 nt, Homo sapiens
aauggcaucaaccaccauggauu

SEQ ID NO: 1468576 - RNA, 15 nt, Homo sapiens
aauggcaugcugaaa

SEQ ID NO: 1468577 - RNA, 15 nt, Homo sapiens
aaugggaaaaccaga

SEQ ID NO: 1468578 - RNA, 18 nt, Homo sapiens
acaggguaacugugcuga

SEQ ID NO: 1468579 - RNA, 19 nt, Homo sapiens
acagggucugcucuuucuc

SEQ ID NO: 1468580 - RNA, 20 nt, Homo sapiens
acagggucuuuuuucauuuc

SEQ ID NO: 1468581 - RNA, 14 nt, Homo sapiens
acagguaccaucuu

SEQ ID NO: 1468582 - RNA, 16 nt, Homo sapiens
acaggugucugagaug

SEQ ID NO: 1468583 - RNA, 13 nt, Homo sapiens
acaguaaaucuca

SEQ ID NO: 1468584 - RNA, 22 nt, Homo sapiens
acaguaacaaauaaagugcagu

SEQ ID NO: 1468585 - RNA, 17 nt, Homo sapiens
acaguaaguccaguaaa

SEQ ID NO: 1468586 - RNA, 20 nt, Homo sapiens
acaguagaacugucugugaa

SEQ ID NO: 1468587 - RNA, 14 nt, Homo sapiens
acaguagcauuaug

SEQ ID NO: 1468588 - RNA, 14 nt, Homo sapiens
acaguauccacaau

SEQ ID NO: 1468589 - RNA, 18 nt, Homo sapiens
acaguaugagucaaugug

SEQ ID NO: 1468590 - RNA, 21 nt, Homo sapiens
acaguaugagucaaugugcag

SEQ ID NO: 1468591 - RNA, 23 nt, Homo sapiens
acaguaugagucaaugugcagug

SEQ ID NO: 1468592 - RNA, 16 nt, Homo sapiens
acagucaauucugauu

SEQ ID NO: 1468593 - RNA, 15 nt, Homo sapiens
acagucaucugccac

SEQ ID NO: 1468594 - RNA, 14 nt, Homo sapiens
acaguccacccacc

SEQ ID NO: 1468595 - RNA, 20 nt, Homo sapiens
acagucucccuuccuaugcu

SEQ ID NO: 1468596 - RNA, 17 nt, Homo sapiens
acagugacuggugccag

SEQ ID NO: 1468597 - RNA, 14 nt, Homo sapiens
acagugaggcugca

SEQ ID NO: 1468598 - RNA, 21 nt, Homo sapiens
acagugaugcugugcuaugaa

SEQ ID NO: 1468599 - RNA, 15 nt, Homo sapiens
acagugccaacuccu

SEQ ID NO: 1468600 - RNA, 17 nt, Homo sapiens
acagugccgacagcucu

SEQ ID NO: 1468601 - RNA, 20 nt, Homo sapiens
acagugccgacagcucucca

SEQ ID NO: 1468602 - RNA, 18 nt, Homo sapiens
acaguggacucagcagug

SEQ ID NO: 1468603 - RNA, 15 nt, Homo sapiens
acaguggaugcugcu

SEQ ID NO: 1468604 - RNA, 12 nt, Homo sapiens
acaguggcugcu

SEQ ID NO: 1468605 - RNA, 15 nt, Homo sapiens
acaguguacaaugcc

SEQ ID NO: 1468606 - RNA, 16 nt, Homo sapiens
acaguguacaaugccu

SEQ ID NO: 1468607 - RNA, 16 nt, Homo sapiens
acaguuaacuuucaga

SEQ ID NO: 1468608 - RNA, 13 nt, Homo sapiens
acaguuaaugcca

SEQ ID NO: 1468609 - RNA, 18 nt, Homo sapiens
acaguuagguagcuuuag

SEQ ID NO: 1468610 - RNA, 17 nt, Homo sapiens
acaguucuuggugacug

SEQ ID NO: 1468611 - RNA, 20 nt, Homo sapiens
acaguugcauuuagcuucuu

SEQ ID NO: 1468612 - RNA, 20 nt, Homo sapiens
acaguugggacccaaaacac

SEQ ID NO: 1468613 - RNA, 19 nt, Homo sapiens
acaguuguguuagccucuu

SEQ ID NO: 1468614 - RNA, 21 nt, Homo sapiens
acauaaaauaagagauccuuu

SEQ ID NO: 1468615 - RNA, 12 nt, Homo sapiens
acauaaacugac

SEQ ID NO: 1468616 - RNA, 20 nt, Homo sapiens
acauaaaggcuaacuaugag

SEQ ID NO: 1468617 - RNA, 20 nt, Homo sapiens
acauaacguuuuuccuuuaa

SEQ ID NO: 1468618 - RNA, 13 nt, Homo sapiens
acauaacugccuu

SEQ ID NO: 1468619 - RNA, 20 nt, Homo sapiens
acauacaauuccaaacacau

SEQ ID NO: 1468620 - RNA, 15 nt, Homo sapiens
acauacaggauuuga

SEQ ID NO: 1468621 - RNA, 22 nt, Homo sapiens
acauacaggccauacuuuacaa

SEQ ID NO: 1468622 - RNA, 13 nt, Homo sapiens
acauacauucccu

SEQ ID NO: 1468623 - RNA, 21 nt, Homo sapiens
acauacucugcuuagaauuug

SEQ ID NO: 1468624 - RNA, 19 nt, Homo sapiens
acauacuugaagggccaga

SEQ ID NO: 1468625 - RNA, 13 nt, Homo sapiens
acauagcaucuca

SEQ ID NO: 1468626 - RNA, 23 nt, Homo sapiens
acauagugaaaccccaucucuac

SEQ ID NO: 1468627 - RNA, 19 nt, Homo sapiens
acauagugaaauaaauucu

SEQ ID NO: 1468628 - RNA, 16 nt, Homo sapiens
acauauaaaugaaucu

SEQ ID NO: 1468629 - RNA, 12 nt, Homo sapiens
acauaugugcug

SEQ ID NO: 1468630 - RNA, 14 nt, Homo sapiens
acauauuacuguug

SEQ ID NO: 1468631 - RNA, 14 nt, Homo sapiens
acauauuaucucau

SEQ ID NO: 1468632 - RNA, 17 nt, Homo sapiens
acaucaaagagcacauu

SEQ ID NO: 1468633 - RNA, 12 nt, Homo sapiens
acaucaauguuc

SEQ ID NO: 1468634 - RNA, 13 nt, Homo sapiens
acaucaauguuca

SEQ ID NO: 1468635 - RNA, 13 nt, Homo sapiens
acaucacagcagc

SEQ ID NO: 1468636 - RNA, 16 nt, Homo sapiens
acaucacagcagccuc

SEQ ID NO: 1468637 - RNA, 18 nt, Homo sapiens
acaucagaccugucuucc

SEQ ID NO: 1468638 - RNA, 19 nt, Homo sapiens
acaucagcaaacaggauca

SEQ ID NO: 1468639 - RNA, 15 nt, Homo sapiens
acaucauaacccaug

SEQ ID NO: 1468640 - RNA, 15 nt, Homo sapiens
acauccaucccucca

SEQ ID NO: 1468641 - RNA, 20 nt, Homo sapiens
acauccccuuuguguagaaa

SEQ ID NO: 1468642 - RNA, 17 nt, Homo sapiens
acauccuuaagucaaaa

SEQ ID NO: 1468643 - RNA, 23 nt, Homo sapiens
acauccuuucuuuuaaugaugcc

SEQ ID NO: 1468644 - RNA, 15 nt, Homo sapiens
acaucgcacacuggg

SEQ ID NO: 1468645 - RNA, 14 nt, Homo sapiens
acaucggccuccau

SEQ ID NO: 1468646 - RNA, 17 nt, Homo sapiens
acaucggccuccaugac

SEQ ID NO: 1468647 - RNA, 19 nt, Homo sapiens
acaucuacaaucaguugac

SEQ ID NO: 1468648 - RNA, 20 nt, Homo sapiens
acaucucgggaguccucuag

SEQ ID NO: 1468649 - RNA, 13 nt, Homo sapiens
acaucugcaauau

SEQ ID NO: 1468650 - RNA, 20 nt, Homo sapiens
acaucugcaauaugaauuca

SEQ ID NO: 1468651 - RNA, 23 nt, Homo sapiens
acaucugccuuaaaaccaaagag

SEQ ID NO: 1468652 - RNA, 12 nt, Homo sapiens
acaucugucacg

SEQ ID NO: 1468653 - RNA, 23 nt, Homo sapiens
acaugaauugcauuuuacuuuaa

SEQ ID NO: 1468654 - RNA, 10 nt, Homo sapiens
acaugacugg

SEQ ID NO: 1468655 - RNA, 18 nt, Homo sapiens
acaugaucuucuuuauaa

SEQ ID NO: 1468656 - RNA, 20 nt, Homo sapiens
acaugauuguauaagcaugc

SEQ ID NO: 1468657 - RNA, 22 nt, Homo sapiens
acaugcaaaaagaaaugacuaa

SEQ ID NO: 1468658 - RNA, 21 nt, Homo sapiens
acaugcacacacacacaucuc

SEQ ID NO: 1468659 - RNA, 14 nt, Homo sapiens
acaugccacaagga

SEQ ID NO: 1468660 - RNA, 20 nt, Homo sapiens
acaugccucugccaaaggau

SEQ ID NO: 1468661 - RNA, 17 nt, Homo sapiens
acauggacugcuucauc

SEQ ID NO: 1468662 - RNA, 24 nt, Homo sapiens
acauggcuaaauacaauggguauc

SEQ ID NO: 1468663 - RNA, 15 nt, Homo sapiens
acauggcuagccuuu

SEQ ID NO: 1468664 - RNA, 13 nt, Homo sapiens
acauguaugugca

SEQ ID NO: 1468665 - RNA, 18 nt, Homo sapiens
acauguaugugcauuuca

SEQ ID NO: 1468666 - RNA, 19 nt, Homo sapiens
acauguaugugcauuucaa

SEQ ID NO: 1468667 - RNA, 12 nt, Homo sapiens
acaugugacauu

SEQ ID NO: 1468668 - RNA, 17 nt, Homo sapiens
acauguggggccagguc

SEQ ID NO: 1468669 - RNA, 12 nt, Homo sapiens
acauguguaaac

SEQ ID NO: 1468670 - RNA, 19 nt, Homo sapiens
acauguguuuauucaucca

SEQ ID NO: 1468671 - RNA, 16 nt, Homo sapiens
acauguuacugcuuca

SEQ ID NO: 1468672 - RNA, 17 nt, Homo sapiens
acauguuacugcuucau

SEQ ID NO: 1468673 - RNA, 15 nt, Homo sapiens
acauguuaucaaauc

SEQ ID NO: 1468674 - RNA, 16 nt, Homo sapiens
acauuaaggaauuuga

SEQ ID NO: 1468675 - RNA, 20 nt, Homo sapiens
acauuauaaaaauugacaau

SEQ ID NO: 1468676 - RNA, 19 nt, Homo sapiens
acauuauuucuaguccaaa

SEQ ID NO: 1468677 - RNA, 14 nt, Homo sapiens
acauucaguuccca

SEQ ID NO: 1468678 - RNA, 22 nt, Homo sapiens
acauucccucuaauuugaacug

SEQ ID NO: 1468679 - RNA, 18 nt, Homo sapiens
acauucuuuaucuugaca

SEQ ID NO: 1468680 - RNA, 22 nt, Homo sapiens
acauuggcaccuaauccaggca

SEQ ID NO: 1468681 - RNA, 14 nt, Homo sapiens
acuauauuugcuag

SEQ ID NO: 1468682 - RNA, 15 nt, Homo sapiens
acuaucacugaacaa

SEQ ID NO: 1468683 - RNA, 16 nt, Homo sapiens
acuauccaguuacugc

SEQ ID NO: 1468684 - RNA, 14 nt, Homo sapiens
acuaucugcauuau

SEQ ID NO: 1468685 - RNA, 19 nt, Homo sapiens
acuaugaaguaagcaacaa

SEQ ID NO: 1468686 - RNA, 13 nt, Homo sapiens
acuaugacacuga

SEQ ID NO: 1468687 - RNA, 22 nt, Homo sapiens
acuaugcauggugccccaggac

SEQ ID NO: 1468688 - RNA, 17 nt, Homo sapiens
acuaugugccaguuccu

SEQ ID NO: 1468689 - RNA, 14 nt, Homo sapiens
acuauuaaagcaca

SEQ ID NO: 1468690 - RNA, 15 nt, Homo sapiens
acuauuaccaugaga

SEQ ID NO: 1468691 - RNA, 20 nt, Homo sapiens
acuauugaaaucaagcuuau

SEQ ID NO: 1468692 - RNA, 22 nt, Homo sapiens
acuauuguuacauuauguggaa

SEQ ID NO: 1468693 - RNA, 18 nt, Homo sapiens
acuauuuaaagccuccuc

SEQ ID NO: 1468694 - RNA, 18 nt, Homo sapiens
acuauuuagauauaacac

SEQ ID NO: 1468695 - RNA, 22 nt, Homo sapiens
acuauuucugggucuuuugcua

SEQ ID NO: 1468696 - RNA, 15 nt, Homo sapiens
acuauuuugugcucc

SEQ ID NO: 1468697 - RNA, 14 nt, Homo sapiens
acuauuuuuccaaa

SEQ ID NO: 1468698 - RNA, 17 nt, Homo sapiens
acucaaauggggccaga

SEQ ID NO: 1468699 - RNA, 21 nt, Homo sapiens
acucaaauggggccagaucca

SEQ ID NO: 1468700 - RNA, 16 nt, Homo sapiens
acucacauccucacuu

SEQ ID NO: 1468701 - RNA, 23 nt, Homo sapiens
acucaccaguguccccuccacug

SEQ ID NO: 1468702 - RNA, 21 nt, Homo sapiens
acucacugacucuucuaugca

SEQ ID NO: 1468703 - RNA, 19 nt, Homo sapiens
acucagccggcagccagau

SEQ ID NO: 1468704 - RNA, 16 nt, Homo sapiens
acucagcuaucagcuc

SEQ ID NO: 1468705 - RNA, 18 nt, Homo sapiens
acucagggacagagccau

SEQ ID NO: 1468706 - RNA, 17 nt, Homo sapiens
acucagggagcauuuaa

SEQ ID NO: 1468707 - RNA, 13 nt, Homo sapiens
acucagugcaaac

SEQ ID NO: 1468708 - RNA, 22 nt, Homo sapiens
acucaguuugucagacuuuaaa

SEQ ID NO: 1468709 - RNA, 17 nt, Homo sapiens
acucaucuuagugccug

SEQ ID NO: 1468710 - RNA, 18 nt, Homo sapiens
acucaucuuagugccuga

SEQ ID NO: 1468711 - RNA, 19 nt, Homo sapiens
acucaucuugaucaaccaa

SEQ ID NO: 1468712 - RNA, 12 nt, Homo sapiens
acuccaacugaa

SEQ ID NO: 1468713 - RNA, 21 nt, Homo sapiens
acuccacaaaugauguuuuca

SEQ ID NO: 1468714 - RNA, 17 nt, Homo sapiens
acuccacagucaauauu

SEQ ID NO: 1468715 - RNA, 23 nt, Homo sapiens
acuccaccgaccaacugcccuaa

SEQ ID NO: 1468716 - RNA, 16 nt, Homo sapiens
acuccagcucugagac

SEQ ID NO: 1468717 - RNA, 13 nt, Homo sapiens
acuccaguaaaaa

SEQ ID NO: 1468718 - RNA, 13 nt, Homo sapiens
acuccagugguga

SEQ ID NO: 1468719 - RNA, 19 nt, Homo sapiens
acucccggagccugugcag

SEQ ID NO: 1468720 - RNA, 15 nt, Homo sapiens
acucccuaucuccuu

SEQ ID NO: 1468721 - RNA, 18 nt, Homo sapiens
acuccuaagacuuaugua

SEQ ID NO: 1468722 - RNA, 14 nt, Homo sapiens
acuccuccaaggca

SEQ ID NO: 1468723 - RNA, 16 nt, Homo sapiens
acuccuccaaggcaca

SEQ ID NO: 1468724 - RNA, 17 nt, Homo sapiens
acuccuccucacuaaaa

SEQ ID NO: 1468725 - RNA, 18 nt, Homo sapiens
acuccugacuccuaccug

SEQ ID NO: 1468726 - RNA, 13 nt, Homo sapiens
acuccugcaaaau

SEQ ID NO: 1468727 - RNA, 12 nt, Homo sapiens
acuccuguuacu

SEQ ID NO: 1468728 - RNA, 19 nt, Homo sapiens
acuccuuguaaagacugua

SEQ ID NO: 1468729 - RNA, 12 nt, Homo sapiens
acucgacccaga

SEQ ID NO: 1468730 - RNA, 16 nt, Homo sapiens
acucuaagcucagugc

SEQ ID NO: 1468731 - RNA, 16 nt, Homo sapiens
acucuaauagugcuua

SEQ ID NO: 1468732 - RNA, 13 nt, Homo sapiens
acucuaccaaaua

SEQ ID NO: 1468733 - RNA, 18 nt, Homo sapiens
acucuaggguccagugga

SEQ ID NO: 1468734 - RNA, 23 nt, Homo sapiens
acucucacaagauggaaaucaca

SEQ ID NO: 1468735 - RNA, 19 nt, Homo sapiens
acucucuucccuuucccca

SEQ ID NO: 1468736 - RNA, 19 nt, Homo sapiens
acucugaaacacacugaaa

SEQ ID NO: 1468737 - RNA, 14 nt, Homo sapiens
acucugagcccaua

SEQ ID NO: 1468738 - RNA, 18 nt, Homo sapiens
acucuggcaaagcuuuua

SEQ ID NO: 1468739 - RNA, 15 nt, Homo sapiens
acucugggaagccaa

SEQ ID NO: 1468740 - RNA, 20 nt, Homo sapiens
acucugggaauacaggggug

SEQ ID NO: 1468741 - RNA, 19 nt, Homo sapiens
acucugggcugccauguga

SEQ ID NO: 1468742 - RNA, 23 nt, Homo sapiens
acucugggcuguaacguggcacu

SEQ ID NO: 1468743 - RNA, 18 nt, Homo sapiens
acucugguaaaugaucac

SEQ ID NO: 1468744 - RNA, 19 nt, Homo sapiens
acucuguaaaaacacugaa

SEQ ID NO: 1468745 - RNA, 22 nt, Homo sapiens
acucuugaaguacuuaacauac

SEQ ID NO: 1468746 - RNA, 14 nt, Homo sapiens
acucuugaucucuc

SEQ ID NO: 1468747 - RNA, 12 nt, Homo sapiens
acucuugcaggg

SEQ ID NO: 1468748 - RNA, 23 nt, Homo sapiens
acucuuguggucaucauggccag

SEQ ID NO: 1468749 - RNA, 18 nt, Homo sapiens
acugaaaacuuagccaga

SEQ ID NO: 1468750 - RNA, 16 nt, Homo sapiens
acugaaagaugaucau

SEQ ID NO: 1468751 - RNA, 20 nt, Homo sapiens
acugaacuuaauaacugugu

SEQ ID NO: 1468752 - RNA, 16 nt, Homo sapiens
acugaaggacacagca

SEQ ID NO: 1468753 - RNA, 19 nt, Homo sapiens
acugaagucuuuucuguca

SEQ ID NO: 1468754 - RNA, 17 nt, Homo sapiens
acugaaguuucacauga

SEQ ID NO: 1468755 - RNA, 16 nt, Homo sapiens
acugaaucuaccugcc

SEQ ID NO: 1468756 - RNA, 14 nt, Homo sapiens
acugacaacauuau

SEQ ID NO: 1468757 - RNA, 19 nt, Homo sapiens
acugacacuuugccagaaa

SEQ ID NO: 1468758 - RNA, 20 nt, Homo sapiens
acugacuuguuugucuucca

SEQ ID NO: 1468759 - RNA, 21 nt, Homo sapiens
acugacuuguuugucuuccau

SEQ ID NO: 1468760 - RNA, 18 nt, Homo sapiens
acugagcagccgccagcu

SEQ ID NO: 1468761 - RNA, 20 nt, Homo sapiens
acugagcuccccagaucucc

SEQ ID NO: 1468762 - RNA, 14 nt, Homo sapiens
acugauauccuccu

SEQ ID NO: 1468763 - RNA, 16 nt, Homo sapiens
acugaugaaaucugcu

SEQ ID NO: 1468764 - RNA, 19 nt, Homo sapiens
acugaugaaggcaugccua

SEQ ID NO: 1468765 - RNA, 12 nt, Homo sapiens
acugaugcugcc

SEQ ID NO: 1468766 - RNA, 15 nt, Homo sapiens
acugaugcuguucuc

SEQ ID NO: 1468767 - RNA, 17 nt, Homo sapiens
acugauggccaggcaag

SEQ ID NO: 1468768 - RNA, 15 nt, Homo sapiens
acugauuaugucuuu

SEQ ID NO: 1468769 - RNA, 19 nt, Homo sapiens
acugcaaagcucggugcuc

SEQ ID NO: 1468770 - RNA, 15 nt, Homo sapiens
acugcaaccucugcc

SEQ ID NO: 1468771 - RNA, 16 nt, Homo sapiens
acugcaaccucugccu

SEQ ID NO: 1468772 - RNA, 20 nt, Homo sapiens
acugcacuccagccugggca

SEQ ID NO: 1468773 - RNA, 20 nt, Homo sapiens
acugcacuccagccugggug

SEQ ID NO: 1468774 - RNA, 15 nt, Homo sapiens
acugcaggagcaguu

SEQ ID NO: 1468775 - RNA, 22 nt, Homo sapiens
acugcagucagcaugaauccag

SEQ ID NO: 1468776 - RNA, 21 nt, Homo sapiens
acugcauaugaaaggacacua

SEQ ID NO: 1468777 - RNA, 19 nt, Homo sapiens
acugcccauggacaggcug

SEQ ID NO: 1468778 - RNA, 21 nt, Homo sapiens
acugccccacggagacagagg

SEQ ID NO: 1468779 - RNA, 23 nt, Homo sapiens
acugccccccugccuugcucccc

SEQ ID NO: 1468780 - RNA, 19 nt, Homo sapiens
acugccucgaaacacagaa

SEQ ID NO: 1468781 - RNA, 13 nt, Homo sapiens
acugccucuggaa

SEQ ID NO: 1468782 - RNA, 23 nt, Homo sapiens
acugccuggagggcagggagugg

SEQ ID NO: 1468783 - RNA, 20 nt, Homo sapiens
agacuugggaaacuauucau

SEQ ID NO: 1468784 - RNA, 14 nt, Homo sapiens
agacuugguuucaa

SEQ ID NO: 1468785 - RNA, 20 nt, Homo sapiens
agacuuuacauggaugccaa

SEQ ID NO: 1468786 - RNA, 18 nt, Homo sapiens
agacuuucuuaucacuua

SEQ ID NO: 1468787 - RNA, 23 nt, Homo sapiens
agagaaaccgggagaaggcauga

SEQ ID NO: 1468788 - RNA, 13 nt, Homo sapiens
agagaaaguguga

SEQ ID NO: 1468789 - RNA, 14 nt, Homo sapiens
agagaaauacuuuc

SEQ ID NO: 1468790 - RNA, 14 nt, Homo sapiens
agagaacaacuacu

SEQ ID NO: 1468791 - RNA, 14 nt, Homo sapiens
agagaagaggcugg

SEQ ID NO: 1468792 - RNA, 14 nt, Homo sapiens
agagaauauacaug

SEQ ID NO: 1468793 - RNA, 13 nt, Homo sapiens
agagaauuuccuu

SEQ ID NO: 1468794 - RNA, 21 nt, Homo sapiens
agagacuuggggaaauugcuu

SEQ ID NO: 1468795 - RNA, 18 nt, Homo sapiens
agagagaacaggugggcu

SEQ ID NO: 1468796 - RNA, 19 nt, Homo sapiens
agagagcaacucugagauc

SEQ ID NO: 1468797 - RNA, 21 nt, Homo sapiens
agagagcagcuuuaaacucag

SEQ ID NO: 1468798 - RNA, 16 nt, Homo sapiens
agagagguuuuucuga

SEQ ID NO: 1468799 - RNA, 20 nt, Homo sapiens
agagauagauauuguccuaa

SEQ ID NO: 1468800 - RNA, 22 nt, Homo sapiens
agagauccuuuagugcacccag

SEQ ID NO: 1468801 - RNA, 12 nt, Homo sapiens
agagauucugug

SEQ ID NO: 1468802 - RNA, 22 nt, Homo sapiens
agagcaacaauccaucucucaa

SEQ ID NO: 1468803 - RNA, 18 nt, Homo sapiens
agagcaagacugucucaa

SEQ ID NO: 1468804 - RNA, 11 nt, Homo sapiens
agagcacauuu

SEQ ID NO: 1468805 - RNA, 12 nt, Homo sapiens
agagcagcagca

SEQ ID NO: 1468806 - RNA, 21 nt, Homo sapiens
agagcaguaccagcgcucuaa

SEQ ID NO: 1468807 - RNA, 12 nt, Homo sapiens
agagcaucucuu

SEQ ID NO: 1468808 - RNA, 22 nt, Homo sapiens
agagcaugaaaaucacacuguc

SEQ ID NO: 1468809 - RNA, 21 nt, Homo sapiens
agagccaaccucggcuugugg

SEQ ID NO: 1468810 - RNA, 16 nt, Homo sapiens
agagccagggcugaug

SEQ ID NO: 1468811 - RNA, 20 nt, Homo sapiens
agagccagucucaccuucaa

SEQ ID NO: 1468812 - RNA, 23 nt, Homo sapiens
agagcccccaccuugaucccaau

SEQ ID NO: 1468813 - RNA, 14 nt, Homo sapiens
agagccuggagaag

SEQ ID NO: 1468814 - RNA, 23 nt, Homo sapiens
agagcuaagggugggugcucaga

SEQ ID NO: 1468815 - RNA, 10 nt, Homo sapiens
agagcucuau

SEQ ID NO: 1468816 - RNA, 17 nt, Homo sapiens
agagcuuugugcuuguc

SEQ ID NO: 1468817 - RNA, 18 nt, Homo sapiens
agaggaacccagaugcuc

SEQ ID NO: 1468818 - RNA, 14 nt, Homo sapiens
agaggaacugucca

SEQ ID NO: 1468819 - RNA, 19 nt, Homo sapiens
agaggaauuuauaccucaa

SEQ ID NO: 1468820 - RNA, 13 nt, Homo sapiens
agaggacuguguu

SEQ ID NO: 1468821 - RNA, 13 nt, Homo sapiens
agaggagguuugg

SEQ ID NO: 1468822 - RNA, 19 nt, Homo sapiens
agaggauaagccacugggc

SEQ ID NO: 1468823 - RNA, 14 nt, Homo sapiens
agaggaugaaugua

SEQ ID NO: 1468824 - RNA, 13 nt, Homo sapiens
agaggaugucaca

SEQ ID NO: 1468825 - RNA, 17 nt, Homo sapiens
agaggaugucacaaaga

SEQ ID NO: 1468826 - RNA, 13 nt, Homo sapiens
agaggcagcuuca

SEQ ID NO: 1468827 - RNA, 16 nt, Homo sapiens
agaggcucuggacagc

SEQ ID NO: 1468828 - RNA, 20 nt, Homo sapiens
agaggcugaggcuggcacag

SEQ ID NO: 1468829 - RNA, 22 nt, Homo sapiens
agagggacagaugaaugccgug

SEQ ID NO: 1468830 - RNA, 24 nt, Homo sapiens
agagggaccaugugucacuugugc

SEQ ID NO: 1468831 - RNA, 15 nt, Homo sapiens
agagggcccagccca

SEQ ID NO: 1468832 - RNA, 17 nt, Homo sapiens
agagggggucucagaaa

SEQ ID NO: 1468833 - RNA, 20 nt, Homo sapiens
agaggucaaggcugcaguga

SEQ ID NO: 1468834 - RNA, 22 nt, Homo sapiens
agagguccuaaagaugcugacu

SEQ ID NO: 1468835 - RNA, 22 nt, Homo sapiens
agagguguacacuaacauuucc

SEQ ID NO: 1468836 - RNA, 18 nt, Homo sapiens
agaguagaauugcauuga

SEQ ID NO: 1468837 - RNA, 21 nt, Homo sapiens
agagucagcucucugcccugu

SEQ ID NO: 1468838 - RNA, 17 nt, Homo sapiens
agagugaaaccaugacu

SEQ ID NO: 1468839 - RNA, 19 nt, Homo sapiens
agagugcaacccagucaca

SEQ ID NO: 1468840 - RNA, 22 nt, Homo sapiens
agagugccguaacaacuguggu

SEQ ID NO: 1468841 - RNA, 21 nt, Homo sapiens
agaguggccuggccaggagcu

SEQ ID NO: 1468842 - RNA, 19 nt, Homo sapiens
agaguggugcugcuuuaau

SEQ ID NO: 1468843 - RNA, 17 nt, Homo sapiens
agaguguagacuguggc

SEQ ID NO: 1468844 - RNA, 15 nt, Homo sapiens
agagugugguuauga

SEQ ID NO: 1468845 - RNA, 19 nt, Homo sapiens
agaguguuaucagucauaa

SEQ ID NO: 1468846 - RNA, 15 nt, Homo sapiens
agaguguucccugac

SEQ ID NO: 1468847 - RNA, 16 nt, Homo sapiens
agaguguuucuuccac

SEQ ID NO: 1468848 - RNA, 18 nt, Homo sapiens
agaguucuggaaaagaac

SEQ ID NO: 1468849 - RNA, 19 nt, Homo sapiens
agaguuggacuucuagacu

SEQ ID NO: 1468850 - RNA, 13 nt, Homo sapiens
agaguuuccugaa

SEQ ID NO: 1468851 - RNA, 15 nt, Homo sapiens
agauaaacuauacac

SEQ ID NO: 1468852 - RNA, 13 nt, Homo sapiens
agauaaaugugcu

SEQ ID NO: 1468853 - RNA, 13 nt, Homo sapiens
agauaacugagaa

SEQ ID NO: 1468854 - RNA, 15 nt, Homo sapiens
agauaauaucuguga

SEQ ID NO: 1468855 - RNA, 17 nt, Homo sapiens
agauaauaucugugagg

SEQ ID NO: 1468856 - RNA, 19 nt, Homo sapiens
agauaaucagugugucuaa

SEQ ID NO: 1468857 - RNA, 17 nt, Homo sapiens
agauaauuauaauauac

SEQ ID NO: 1468858 - RNA, 13 nt, Homo sapiens
agauaauuggcaa

SEQ ID NO: 1468859 - RNA, 14 nt, Homo sapiens
agauaauuggcaac

SEQ ID NO: 1468860 - RNA, 13 nt, Homo sapiens
agauacaaacugc

SEQ ID NO: 1468861 - RNA, 15 nt, Homo sapiens
agauacaaaugucua

SEQ ID NO: 1468862 - RNA, 21 nt, Homo sapiens
agauacaugguugugaccuga

SEQ ID NO: 1468863 - RNA, 21 nt, Homo sapiens
agauacccuacgcuguccaga

SEQ ID NO: 1468864 - RNA, 14 nt, Homo sapiens
agauagacaaucac

SEQ ID NO: 1468865 - RNA, 16 nt, Homo sapiens
agauagauauaugcuc

SEQ ID NO: 1468866 - RNA, 19 nt, Homo sapiens
agauagaugcacuuaugca

SEQ ID NO: 1468867 - RNA, 13 nt, Homo sapiens
agauauaugcucu

SEQ ID NO: 1468868 - RNA, 19 nt, Homo sapiens
agauauucuggcccaggga

SEQ ID NO: 1468869 - RNA, 13 nt, Homo sapiens
agauauuguucaa

SEQ ID NO: 1468870 - RNA, 14 nt, Homo sapiens
agaucaaauacuuu

SEQ ID NO: 1468871 - RNA, 20 nt, Homo sapiens
agaucaaggaguacaaugcc

SEQ ID NO: 1468872 - RNA, 17 nt, Homo sapiens
agaucacugacucugac

SEQ ID NO: 1468873 - RNA, 19 nt, Homo sapiens
agaucaugacauaugacuu

SEQ ID NO: 1468874 - RNA, 17 nt, Homo sapiens
agaucauuuucuuaucu

SEQ ID NO: 1468875 - RNA, 17 nt, Homo sapiens
agauccaagaggcccug

SEQ ID NO: 1468876 - RNA, 14 nt, Homo sapiens
agaucccagaggau

SEQ ID NO: 1468877 - RNA, 23 nt, Homo sapiens
agaucccauccaucagcucccuu

SEQ ID NO: 1468878 - RNA, 22 nt, Homo sapiens
agauccugcagaaguacuccua

SEQ ID NO: 1468879 - RNA, 15 nt, Homo sapiens
agauccuuaaaaccu

SEQ ID NO: 1468880 - RNA, 17 nt, Homo sapiens
agaucgcaccacugcac

SEQ ID NO: 1468881 - RNA, 16 nt, Homo sapiens
agaucgcaguuugccu

SEQ ID NO: 1468882 - RNA, 19 nt, Homo sapiens
agaucgcgccacugcacuc

SEQ ID NO: 1468883 - RNA, 20 nt, Homo sapiens
agaucuaagccuuuccauaa

SEQ ID NO: 1468884 - RNA, 17 nt, Homo sapiens
agaucuaaggaugucac

SEQ ID NO: 1468885 - RNA, 18 nt, Homo sapiens
agaucuaaggaugucaca

SEQ ID NO: 1468886 - RNA, 12 nt, Homo sapiens
aucacugaacaa

SEQ ID NO: 1468887 - RNA, 18 nt, Homo sapiens
aucacugaacaaacuaaa

SEQ ID NO: 1468888 - RNA, 18 nt, Homo sapiens
aucacugacucugacuca

SEQ ID NO: 1468889 - RNA, 19 nt, Homo sapiens
aucacugcauuauucucuu

SEQ ID NO: 1468890 - RNA, 16 nt, Homo sapiens
aucacuguacuuguag

SEQ ID NO: 1468891 - RNA, 19 nt, Homo sapiens
aucacuucauucacauuca

SEQ ID NO: 1468892 - RNA, 16 nt, Homo sapiens
aucagaaacuugugaa

SEQ ID NO: 1468893 - RNA, 17 nt, Homo sapiens
aucagaacugugccaca

SEQ ID NO: 1468894 - RNA, 17 nt, Homo sapiens
aucagaaggacauggug

SEQ ID NO: 1468895 - RNA, 17 nt, Homo sapiens
aucagaaucauugaagu

SEQ ID NO: 1468896 - RNA, 13 nt, Homo sapiens
aucagaccugguu

SEQ ID NO: 1468897 - RNA, 22 nt, Homo sapiens
aucagcaucacccgggaacuuu

SEQ ID NO: 1468898 - RNA, 15 nt, Homo sapiens
aucagccacauucua

SEQ ID NO: 1468899 - RNA, 14 nt, Homo sapiens
aucagcugcuacua

SEQ ID NO: 1468900 - RNA, 21 nt, Homo sapiens
aucaggacagguggugcaaau

SEQ ID NO: 1468901 - RNA, 20 nt, Homo sapiens
aucaggccuggcacgguggc

SEQ ID NO: 1468902 - RNA, 17 nt, Homo sapiens
aucagggaggucauuuu

SEQ ID NO: 1468903 - RNA, 15 nt, Homo sapiens
aucagucaaugagga

SEQ ID NO: 1468904 - RNA, 16 nt, Homo sapiens
aucagucauaacuaaa

SEQ ID NO: 1468905 - RNA, 23 nt, Homo sapiens
aucagugacagaguucacuauaa

SEQ ID NO: 1468906 - RNA, 14 nt, Homo sapiens
aucaguuaacuauu

SEQ ID NO: 1468907 - RNA, 17 nt, Homo sapiens
aucauaauucagcacuu

SEQ ID NO: 1468908 - RNA, 18 nt, Homo sapiens
aucauaauucagcacuua

SEQ ID NO: 1468909 - RNA, 20 nt, Homo sapiens
aucauacuaaacuucaccua

SEQ ID NO: 1468910 - RNA, 13 nt, Homo sapiens
aucauauuaguau

SEQ ID NO: 1468911 - RNA, 13 nt, Homo sapiens
aucauccaagaca

SEQ ID NO: 1468912 - RNA, 22 nt, Homo sapiens
aucauccugcagacagacaaua

SEQ ID NO: 1468913 - RNA, 20 nt, Homo sapiens
aucaugaaaaugucuauuca

SEQ ID NO: 1468914 - RNA, 16 nt, Homo sapiens
aucaugggcuggacau

SEQ ID NO: 1468915 - RNA, 16 nt, Homo sapiens
aucauguccauacacu

SEQ ID NO: 1468916 - RNA, 15 nt, Homo sapiens
aucauucaacucucc

SEQ ID NO: 1468917 - RNA, 16 nt, Homo sapiens
aucauucaacucucca

SEQ ID NO: 1468918 - RNA, 20 nt, Homo sapiens
aucauuggaacaacugauac

SEQ ID NO: 1468919 - RNA, 23 nt, Homo sapiens
aucauuuacuuuuaaacuuugau

SEQ ID NO: 1468920 - RNA, 15 nt, Homo sapiens
aucauuucaguauca

SEQ ID NO: 1468921 - RNA, 20 nt, Homo sapiens
auccaaaauauuuuuugcaa

SEQ ID NO: 1468922 - RNA, 17 nt, Homo sapiens
auccaaaggugcucaga

SEQ ID NO: 1468923 - RNA, 13 nt, Homo sapiens
auccaacacugga

SEQ ID NO: 1468924 - RNA, 13 nt, Homo sapiens
auccaacccgggg

SEQ ID NO: 1468925 - RNA, 18 nt, Homo sapiens
auccaagaaucagugaag

SEQ ID NO: 1468926 - RNA, 18 nt, Homo sapiens
auccaauccucacugggu

SEQ ID NO: 1468927 - RNA, 16 nt, Homo sapiens
auccacaauagcugac

SEQ ID NO: 1468928 - RNA, 21 nt, Homo sapiens
auccacaccguacaucugcaa

SEQ ID NO: 1468929 - RNA, 18 nt, Homo sapiens
auccaccaagaacauaag

SEQ ID NO: 1468930 - RNA, 18 nt, Homo sapiens
auccacccaccuuggccu

SEQ ID NO: 1468931 - RNA, 15 nt, Homo sapiens
auccaccccauccaa

SEQ ID NO: 1468932 - RNA, 12 nt, Homo sapiens
auccaccugccu

SEQ ID NO: 1468933 - RNA, 15 nt, Homo sapiens
auccacuuacauaua

SEQ ID NO: 1468934 - RNA, 16 nt, Homo sapiens
auccacuuacauauau

SEQ ID NO: 1468935 - RNA, 16 nt, Homo sapiens
auccagagucaucuca

SEQ ID NO: 1468936 - RNA, 16 nt, Homo sapiens
auccagcaauuccuga

SEQ ID NO: 1468937 - RNA, 23 nt, Homo sapiens
auccagcacuggugaacugagcu

SEQ ID NO: 1468938 - RNA, 18 nt, Homo sapiens
auccagcaguguugcuca

SEQ ID NO: 1468939 - RNA, 15 nt, Homo sapiens
auccagcccaggacu

SEQ ID NO: 1468940 - RNA, 14 nt, Homo sapiens
auccagcuaugaau

SEQ ID NO: 1468941 - RNA, 15 nt, Homo sapiens
auccaggcagaucca

SEQ ID NO: 1468942 - RNA, 19 nt, Homo sapiens
auccaggcccaacugugag

SEQ ID NO: 1468943 - RNA, 16 nt, Homo sapiens
auccaggcuuuguaca

SEQ ID NO: 1468944 - RNA, 20 nt, Homo sapiens
auccauccucacugcuguca

SEQ ID NO: 1468945 - RNA, 15 nt, Homo sapiens
auccaucgaagcaga

SEQ ID NO: 1468946 - RNA, 12 nt, Homo sapiens
auccaucucuca

SEQ ID NO: 1468947 - RNA, 18 nt, Homo sapiens
auccaucuuuccauccau

SEQ ID NO: 1468948 - RNA, 18 nt, Homo sapiens
auccauguguggacucaa

SEQ ID NO: 1468949 - RNA, 15 nt, Homo sapiens
auccauuaccuccau

SEQ ID NO: 1468950 - RNA, 21 nt, Homo sapiens
aucccaaaucugucagcaucu

SEQ ID NO: 1468951 - RNA, 12 nt, Homo sapiens
aucccaagagaa

SEQ ID NO: 1468952 - RNA, 13 nt, Homo sapiens
aucccacuguaug

SEQ ID NO: 1468953 - RNA, 16 nt, Homo sapiens
aucccagcaccugccu

SEQ ID NO: 1468954 - RNA, 12 nt, Homo sapiens
aucccagcacuu

SEQ ID NO: 1468955 - RNA, 13 nt, Homo sapiens
aucccauggaaua

SEQ ID NO: 1468956 - RNA, 16 nt, Homo sapiens
aucccauuuuauccca

SEQ ID NO: 1468957 - RNA, 17 nt, Homo sapiens
auccccacccagucuca

SEQ ID NO: 1468958 - RNA, 18 nt, Homo sapiens
auccccacccagucucau

SEQ ID NO: 1468959 - RNA, 19 nt, Homo sapiens
auccccuggacugggaggu

SEQ ID NO: 1468960 - RNA, 17 nt, Homo sapiens
auccccuggcuccagag

SEQ ID NO: 1468961 - RNA, 17 nt, Homo sapiens
auccccuuggcugugag

SEQ ID NO: 1468962 - RNA, 19 nt, Homo sapiens
auccccuuuggcuaccuga

SEQ ID NO: 1468963 - RNA, 17 nt, Homo sapiens
auccccuuuguguagaa

SEQ ID NO: 1468964 - RNA, 14 nt, Homo sapiens
aucccuacaaaaaa

SEQ ID NO: 1468965 - RNA, 12 nt, Homo sapiens
aucccuaccccc

SEQ ID NO: 1468966 - RNA, 14 nt, Homo sapiens
aucccucaccugua

SEQ ID NO: 1468967 - RNA, 18 nt, Homo sapiens
aucccucgggugugcuau

SEQ ID NO: 1468968 - RNA, 18 nt, Homo sapiens
aucccuggggcugugcau

SEQ ID NO: 1468969 - RNA, 15 nt, Homo sapiens
auccgccuaccucag

SEQ ID NO: 1468970 - RNA, 20 nt, Homo sapiens
auccgguggccuauuccagg

SEQ ID NO: 1468971 - RNA, 20 nt, Homo sapiens
auccguacauucaauguuua

SEQ ID NO: 1468972 - RNA, 16 nt, Homo sapiens
auccuaaauaauguua

SEQ ID NO: 1468973 - RNA, 15 nt, Homo sapiens
auccuaacacauuau

SEQ ID NO: 1468974 - RNA, 20 nt, Homo sapiens
auccuaagaaauaugugaga

SEQ ID NO: 1468975 - RNA, 21 nt, Homo sapiens
auccuccagagaaacccaggg

SEQ ID NO: 1468976 - RNA, 21 nt, Homo sapiens
auccucucccauggagacaag

SEQ ID NO: 1468977 - RNA, 22 nt, Homo sapiens
auccucugagugugaccaggca

SEQ ID NO: 1468978 - RNA, 13 nt, Homo sapiens
auccugaauucca

SEQ ID NO: 1468979 - RNA, 21 nt, Homo sapiens
auccugccagccccacacagc

SEQ ID NO: 1468980 - RNA, 21 nt, Homo sapiens
auccuggccaacauggugaaa

SEQ ID NO: 1468981 - RNA, 22 nt, Homo sapiens
auccugggggacccaauguagg

SEQ ID NO: 1468982 - RNA, 21 nt, Homo sapiens
auccuggguacugaaagccuu

SEQ ID NO: 1468983 - RNA, 16 nt, Homo sapiens
auccugugacauguaa

SEQ ID NO: 1468984 - RNA, 17 nt, Homo sapiens
auccugugacugucuca

SEQ ID NO: 1468985 - RNA, 18 nt, Homo sapiens
auccuuaacacauucaau

SEQ ID NO: 1468986 - RNA, 15 nt, Homo sapiens
auccuucaccagagc

SEQ ID NO: 1468987 - RNA, 14 nt, Homo sapiens
auccuuccaaaaau

SEQ ID NO: 1468988 - RNA, 18 nt, Homo sapiens
auccuuccuaaacccaau

SEQ ID NO: 1468989 - RNA, 16 nt, Homo sapiens
auucagagagcagcuu

SEQ ID NO: 1468990 - RNA, 23 nt, Homo sapiens
auucagugagggucuucuuacau

SEQ ID NO: 1468991 - RNA, 18 nt, Homo sapiens
auucauaaaucacaaaua

SEQ ID NO: 1468992 - RNA, 21 nt, Homo sapiens
auucaugugguuucuaugcaa

SEQ ID NO: 1468993 - RNA, 18 nt, Homo sapiens
auucauuagcugugauuu

SEQ ID NO: 1468994 - RNA, 13 nt, Homo sapiens
auucauuuaguga

SEQ ID NO: 1468995 - RNA, 17 nt, Homo sapiens
auucauuuucaucacug

SEQ ID NO: 1468996 - RNA, 19 nt, Homo sapiens
auuccaaggaguuccauga

SEQ ID NO: 1468997 - RNA, 14 nt, Homo sapiens
auuccacacuacca

SEQ ID NO: 1468998 - RNA, 14 nt, Homo sapiens
auuccacacugcac

SEQ ID NO: 1468999 - RNA, 12 nt, Homo sapiens
auuccacuccac

SEQ ID NO: 1469000 - RNA, 16 nt, Homo sapiens
auuccacuccacucag

SEQ ID NO: 1469001 - RNA, 17 nt, Homo sapiens
auuccacuccacucagg

SEQ ID NO: 1469002 - RNA, 17 nt, Homo sapiens
auuccagaaugcuguac

SEQ ID NO: 1469003 - RNA, 13 nt, Homo sapiens
auuccagcaauaa

SEQ ID NO: 1469004 - RNA, 15 nt, Homo sapiens
auuccaggagcugcg

SEQ ID NO: 1469005 - RNA, 17 nt, Homo sapiens
auuccagugcuagaaaa

SEQ ID NO: 1469006 - RNA, 20 nt, Homo sapiens
auucccaagguuacuggaua

SEQ ID NO: 1469007 - RNA, 20 nt, Homo sapiens
auucccaccauucuaccuga

SEQ ID NO: 1469008 - RNA, 17 nt, Homo sapiens
auucccauuuugcaaaa

SEQ ID NO: 1469009 - RNA, 20 nt, Homo sapiens
auuccuacagcacuacuggg

SEQ ID NO: 1469010 - RNA, 19 nt, Homo sapiens
auuccuauuggaaacagag

SEQ ID NO: 1469011 - RNA, 13 nt, Homo sapiens
auuccucaggguu

SEQ ID NO: 1469012 - RNA, 21 nt, Homo sapiens
auuccugccccagauggcuuu

SEQ ID NO: 1469013 - RNA, 21 nt, Homo sapiens
auuccugguuugacucaguuc

SEQ ID NO: 1469014 - RNA, 23 nt, Homo sapiens
auuccuuugucuucaaacuguga

SEQ ID NO: 1469015 - RNA, 15 nt, Homo sapiens
auucgcccaccucag

SEQ ID NO: 1469016 - RNA, 13 nt, Homo sapiens
auucgcuguuacc

SEQ ID NO: 1469017 - RNA, 13 nt, Homo sapiens
auucuaagugaaa

SEQ ID NO: 1469018 - RNA, 18 nt, Homo sapiens
auucuaaguuauuuacuu

SEQ ID NO: 1469019 - RNA, 15 nt, Homo sapiens
auucuaguucagagc

SEQ ID NO: 1469020 - RNA, 12 nt, Homo sapiens
auucucaccagg

SEQ ID NO: 1469021 - RNA, 14 nt, Homo sapiens
auucucaccaggaa

SEQ ID NO: 1469022 - RNA, 17 nt, Homo sapiens
auucucauuuguucuca

SEQ ID NO: 1469023 - RNA, 19 nt, Homo sapiens
auucucauuuguucucaca

SEQ ID NO: 1469024 - RNA, 12 nt, Homo sapiens
auucuccacagc

SEQ ID NO: 1469025 - RNA, 15 nt, Homo sapiens
auucucugcaauuug

SEQ ID NO: 1469026 - RNA, 22 nt, Homo sapiens
auucucugugguauccaagaau

SEQ ID NO: 1469027 - RNA, 18 nt, Homo sapiens
auucugaagcaacauuuu

SEQ ID NO: 1469028 - RNA, 16 nt, Homo sapiens
auucugaaucucaaga

SEQ ID NO: 1469029 - RNA, 15 nt, Homo sapiens
auucugcagccacaa

SEQ ID NO: 1469030 - RNA, 15 nt, Homo sapiens
auucugcauugcuag

SEQ ID NO: 1469031 - RNA, 15 nt, Homo sapiens
auucuggauaucuca

SEQ ID NO: 1469032 - RNA, 22 nt, Homo sapiens
auucuggcaucuuagaccucca

SEQ ID NO: 1469033 - RNA, 19 nt, Homo sapiens
auucuguaucauugauuca

SEQ ID NO: 1469034 - RNA, 15 nt, Homo sapiens
auucuuagugacuuu

SEQ ID NO: 1469035 - RNA, 14 nt, Homo sapiens
auucuucaaccagu

SEQ ID NO: 1469036 - RNA, 19 nt, Homo sapiens
auucuucaaccucauugac

SEQ ID NO: 1469037 - RNA, 21 nt, Homo sapiens
auucuucagauacaaacugca

SEQ ID NO: 1469038 - RNA, 22 nt, Homo sapiens
auucuucagauacaaacugcag

SEQ ID NO: 1469039 - RNA, 16 nt, Homo sapiens
auucuuggaccaugcc

SEQ ID NO: 1469040 - RNA, 11 nt, Homo sapiens
auucuuggccc

SEQ ID NO: 1469041 - RNA, 15 nt, Homo sapiens
auucuugucacaaua

SEQ ID NO: 1469042 - RNA, 23 nt, Homo sapiens
auucuuuaaaauuacaacuaagu

SEQ ID NO: 1469043 - RNA, 17 nt, Homo sapiens
auucuuuggaguuguca

SEQ ID NO: 1469044 - RNA, 18 nt, Homo sapiens
auucuuuuguuuccaugg

SEQ ID NO: 1469045 - RNA, 12 nt, Homo sapiens
auugaaaacacu

SEQ ID NO: 1469046 - RNA, 17 nt, Homo sapiens
auugaaagaaccagaga

SEQ ID NO: 1469047 - RNA, 18 nt, Homo sapiens
auugaaauguuugcauaa

SEQ ID NO: 1469048 - RNA, 21 nt, Homo sapiens
auugaacuuuuguacugaauu

SEQ ID NO: 1469049 - RNA, 18 nt, Homo sapiens
auugaaguuuuggcaauu

SEQ ID NO: 1469050 - RNA, 14 nt, Homo sapiens
auugacaacacagc

SEQ ID NO: 1469051 - RNA, 14 nt, Homo sapiens
auugacacacagca

SEQ ID NO: 1469052 - RNA, 22 nt, Homo sapiens
auugacacagaaaauguugaga

SEQ ID NO: 1469053 - RNA, 24 nt, Homo sapiens
auugacaugugccagggcaaugau

SEQ ID NO: 1469054 - RNA, 22 nt, Homo sapiens
auugaccaagaacugcauggac

SEQ ID NO: 1469055 - RNA, 15 nt, Homo sapiens
auugaccuacuuugg

SEQ ID NO: 1469056 - RNA, 14 nt, Homo sapiens
auugacgacuucac

SEQ ID NO: 1469057 - RNA, 20 nt, Homo sapiens
auugagaaaaauauauacua

SEQ ID NO: 1469058 - RNA, 19 nt, Homo sapiens
auugagaaagaaacuaaua

SEQ ID NO: 1469059 - RNA, 21 nt, Homo sapiens
auugagauaauaucugugagg

SEQ ID NO: 1469060 - RNA, 20 nt, Homo sapiens
auugagcagaagaucaagga

SEQ ID NO: 1469061 - RNA, 21 nt, Homo sapiens
auugagcagaagaucaaggag

SEQ ID NO: 1469062 - RNA, 17 nt, Homo sapiens
auugagccaguggugcu

SEQ ID NO: 1469063 - RNA, 18 nt, Homo sapiens
auugagccaguggugcua

SEQ ID NO: 1469064 - RNA, 14 nt, Homo sapiens
auugaggcuuugug

SEQ ID NO: 1469065 - RNA, 23 nt, Homo sapiens
auugauauacacggaugacuuaa

SEQ ID NO: 1469066 - RNA, 17 nt, Homo sapiens
auugauaugcuuauaca

SEQ ID NO: 1469067 - RNA, 19 nt, Homo sapiens
auugaucaaauauuucaac

SEQ ID NO: 1469068 - RNA, 17 nt, Homo sapiens
auugaugauaacacuua

SEQ ID NO: 1469069 - RNA, 19 nt, Homo sapiens
auugauuauaagcauguau

SEQ ID NO: 1469070 - RNA, 22 nt, Homo sapiens
auugcagcuagaggcaucuucu

SEQ ID NO: 1469071 - RNA, 21 nt, Homo sapiens
auugcagguggaacucaguca

SEQ ID NO: 1469072 - RNA, 20 nt, Homo sapiens
auugccaccaggagaaccac

SEQ ID NO: 1469073 - RNA, 21 nt, Homo sapiens
auugccccuggcuuugccucu

SEQ ID NO: 1469074 - RNA, 17 nt, Homo sapiens
auugcccgaaaccagag

SEQ ID NO: 1469075 - RNA, 16 nt, Homo sapiens
auugcgcucucaagac

SEQ ID NO: 1469076 - RNA, 18 nt, Homo sapiens
auugcuaaucaccaaagg

SEQ ID NO: 1469077 - RNA, 14 nt, Homo sapiens
auugcuaugaauga

SEQ ID NO: 1469078 - RNA, 17 nt, Homo sapiens
auugcuaugaaugauac

SEQ ID NO: 1469079 - RNA, 20 nt, Homo sapiens
auugcuuacaagccuaagaa

SEQ ID NO: 1469080 - RNA, 16 nt, Homo sapiens
auuggaaaguacuccc

SEQ ID NO: 1469081 - RNA, 19 nt, Homo sapiens
auuggaacagaauguuuua

SEQ ID NO: 1469082 - RNA, 21 nt, Homo sapiens
auuggaauaaaauugauucau

SEQ ID NO: 1469083 - RNA, 19 nt, Homo sapiens
auuggagaguaaaaacuga

SEQ ID NO: 1469084 - RNA, 19 nt, Homo sapiens
auuggucauaacucagccc

SEQ ID NO: 1469085 - RNA, 14 nt, Homo sapiens
auuggucauuguga

SEQ ID NO: 1469086 - RNA, 17 nt, Homo sapiens
auuggugcauagcagau

SEQ ID NO: 1469087 - RNA, 18 nt, Homo sapiens
auuguacaugguacgaau

SEQ ID NO: 1469088 - RNA, 14 nt, Homo sapiens
auuguaccaugaaa

SEQ ID NO: 1469089 - RNA, 13 nt, Homo sapiens
auuguaggugcaa

SEQ ID NO: 1469090 - RNA, 14 nt, Homo sapiens
auuguauuuaguua

SEQ ID NO: 1469091 - RNA, 22 nt, Homo sapiens
auugucauaggauuaagcaguu

SEQ ID NO: 1469092 - RNA, 13 nt, Homo sapiens
auuuuauuauaau

SEQ ID NO: 1469093 - RNA, 13 nt, Homo sapiens
auuuucaucacug

SEQ ID NO: 1469094 - RNA, 16 nt, Homo sapiens
auuuucauguauaugu

SEQ ID NO: 1469095 - RNA, 22 nt, Homo sapiens
auuuucauguucuugcagucau

SEQ ID NO: 1469096 - RNA, 18 nt, Homo sapiens
auuuuccaaugcacaguu

SEQ ID NO: 1469097 - RNA, 22 nt, Homo sapiens
auuuucccccacuacugcagca

SEQ ID NO: 1469098 - RNA, 18 nt, Homo sapiens
auuuuccccuagcuuucc

SEQ ID NO: 1469099 - RNA, 16 nt, Homo sapiens
auuuuccuccaggcaa

SEQ ID NO: 1469100 - RNA, 17 nt, Homo sapiens
auuuuccuccaggcaaa

SEQ ID NO: 1469101 - RNA, 21 nt, Homo sapiens
auuuucuagauuuucuacuuu

SEQ ID NO: 1469102 - RNA, 20 nt, Homo sapiens
auuuucuuuacaauuucacu

SEQ ID NO: 1469103 - RNA, 14 nt, Homo sapiens
auuuugaaguuuac

SEQ ID NO: 1469104 - RNA, 13 nt, Homo sapiens
auuuugacacugg

SEQ ID NO: 1469105 - RNA, 21 nt, Homo sapiens
auuuugauugcuuaccuacau

SEQ ID NO: 1469106 - RNA, 12 nt, Homo sapiens
auuuugcaaaua

SEQ ID NO: 1469107 - RNA, 16 nt, Homo sapiens
auuuugcaccuguaaa

SEQ ID NO: 1469108 - RNA, 17 nt, Homo sapiens
auuuugcauaguaccaa

SEQ ID NO: 1469109 - RNA, 20 nt, Homo sapiens
auuuugccauaaagucaaau

SEQ ID NO: 1469110 - RNA, 20 nt, Homo sapiens
auuuugcccaggcaacagua

SEQ ID NO: 1469111 - RNA, 12 nt, Homo sapiens
auuuuggagcuu

SEQ ID NO: 1469112 - RNA, 19 nt, Homo sapiens
auuuuggcgcuauuacaaa

SEQ ID NO: 1469113 - RNA, 17 nt, Homo sapiens
auuuugggaaguugcau

SEQ ID NO: 1469114 - RNA, 21 nt, Homo sapiens
auuuuguagaauaaggaacaa

SEQ ID NO: 1469115 - RNA, 17 nt, Homo sapiens
auuuuguagaugugauu

SEQ ID NO: 1469116 - RNA, 13 nt, Homo sapiens
auuuugugcaaaa

SEQ ID NO: 1469117 - RNA, 17 nt, Homo sapiens
auuuuuaagcugcaaau

SEQ ID NO: 1469118 - RNA, 13 nt, Homo sapiens
auuuuuacauuca

SEQ ID NO: 1469119 - RNA, 20 nt, Homo sapiens
auuuuuauaauaaacauaau

SEQ ID NO: 1469120 - RNA, 16 nt, Homo sapiens
auuuuuauacuuucag

SEQ ID NO: 1469121 - RNA, 15 nt, Homo sapiens
auuuuugaaaacugg

SEQ ID NO: 1469122 - RNA, 15 nt, Homo sapiens
auuuuugauacaguu

SEQ ID NO: 1469123 - RNA, 17 nt, Homo sapiens
auuuuugccaaggcaaa

SEQ ID NO: 1469124 - RNA, 21 nt, Homo sapiens
auuuuuggggaaaaaagcaca

SEQ ID NO: 1469125 - RNA, 16 nt, Homo sapiens
auuuuuguacauguuc

SEQ ID NO: 1469126 - RNA, 20 nt, Homo sapiens
auuuuuguuucuuccaaagc

SEQ ID NO: 1469127 - RNA, 20 nt, Homo sapiens
auuuuuuaagguaacaaaua

SEQ ID NO: 1469128 - RNA, 20 nt, Homo sapiens
auuuuuuaguauaaguacau

SEQ ID NO: 1469129 - RNA, 19 nt, Homo sapiens
auuuuuucgugcacucugc

SEQ ID NO: 1469130 - RNA, 13 nt, Homo sapiens
auuuuuugacuuu

SEQ ID NO: 1469131 - RNA, 16 nt, Homo sapiens
auuuuuuuaauagugc

SEQ ID NO: 1469132 - RNA, 20 nt, Homo sapiens
auuuuuuuuaacauuccaau

SEQ ID NO: 1469133 - RNA, 13 nt, Homo sapiens
auuuuuuuuacau

SEQ ID NO: 1469134 - RNA, 21 nt, Homo sapiens
caaaaaaaccucuaugcaauc

SEQ ID NO: 1469135 - RNA, 14 nt, Homo sapiens
caaaaaaucugacc

SEQ ID NO: 1469136 - RNA, 23 nt, Homo sapiens
caaaaacauguaugugcauuuca

SEQ ID NO: 1469137 - RNA, 15 nt, Homo sapiens
caaaaaccuucccca

SEQ ID NO: 1469138 - RNA, 18 nt, Homo sapiens
caaaaagccacaaugaac

SEQ ID NO: 1469139 - RNA, 21 nt, Homo sapiens
caaaaagccuuuuccagaaga

SEQ ID NO: 1469140 - RNA, 17 nt, Homo sapiens
caaaaauaaacgaacuc

SEQ ID NO: 1469141 - RNA, 20 nt, Homo sapiens
caaaaauagcccugcaaaaa

SEQ ID NO: 1469142 - RNA, 22 nt, Homo sapiens
caaaaaucuguguaacuguaaa

SEQ ID NO: 1469143 - RNA, 22 nt, Homo sapiens
caaaaaugaacugaaguuucac

SEQ ID NO: 1469144 - RNA, 19 nt, Homo sapiens
caaaaauggauauuauuag

SEQ ID NO: 1469145 - RNA, 22 nt, Homo sapiens
caaaaauugaagagagauauau

SEQ ID NO: 1469146 - RNA, 17 nt, Homo sapiens
caaaacagaaaaugaag

SEQ ID NO: 1469147 - RNA, 16 nt, Homo sapiens
caaaacagagauguga

SEQ ID NO: 1469148 - RNA, 16 nt, Homo sapiens
caaaacagaucugaau

SEQ ID NO: 1469149 - RNA, 18 nt, Homo sapiens
caaaaccacuagaacucu

SEQ ID NO: 1469150 - RNA, 12 nt, Homo sapiens
caaaacccaggg

SEQ ID NO: 1469151 - RNA, 23 nt, Homo sapiens
caaaaccuugcuaauuuucucaa

SEQ ID NO: 1469152 - RNA, 14 nt, Homo sapiens
caaaacuacaaauc

SEQ ID NO: 1469153 - RNA, 14 nt, Homo sapiens
caaaacuacaugag

SEQ ID NO: 1469154 - RNA, 15 nt, Homo sapiens
caaaacuacaugaga

SEQ ID NO: 1469155 - RNA, 17 nt, Homo sapiens
caaaacugacaguaaau

SEQ ID NO: 1469156 - RNA, 14 nt, Homo sapiens
caaaagcaguaaau

SEQ ID NO: 1469157 - RNA, 19 nt, Homo sapiens
caaaagccuuaccuugaaa

SEQ ID NO: 1469158 - RNA, 18 nt, Homo sapiens
caaaaggccucuuguaaa

SEQ ID NO: 1469159 - RNA, 18 nt, Homo sapiens
caaaaguuucuuacucaa

SEQ ID NO: 1469160 - RNA, 20 nt, Homo sapiens
caaaauaaaaagugacacag

SEQ ID NO: 1469161 - RNA, 19 nt, Homo sapiens
caaaauagagaaucccacu

SEQ ID NO: 1469162 - RNA, 16 nt, Homo sapiens
caaaauauguuuaaaa

SEQ ID NO: 1469163 - RNA, 16 nt, Homo sapiens
caaaauauuuuuugca

SEQ ID NO: 1469164 - RNA, 15 nt, Homo sapiens
caaaaucacuuagca

SEQ ID NO: 1469165 - RNA, 13 nt, Homo sapiens
caaaaugugaugc

SEQ ID NO: 1469166 - RNA, 12 nt, Homo sapiens
caaaauguguaa

SEQ ID NO: 1469167 - RNA, 18 nt, Homo sapiens
caaaauuacacaguuaau

SEQ ID NO: 1469168 - RNA, 15 nt, Homo sapiens
caaaauuuccaguac

SEQ ID NO: 1469169 - RNA, 20 nt, Homo sapiens
caaacaagggagaagagugu

SEQ ID NO: 1469170 - RNA, 14 nt, Homo sapiens
caaacaaugugcug

SEQ ID NO: 1469171 - RNA, 18 nt, Homo sapiens
caaacacaggauuuguaa

SEQ ID NO: 1469172 - RNA, 23 nt, Homo sapiens
caaacacugcagaacagcaucau

SEQ ID NO: 1469173 - RNA, 18 nt, Homo sapiens
caaacagggcaaaguguu

SEQ ID NO: 1469174 - RNA, 21 nt, Homo sapiens
caaacaggguuugauagcacu

SEQ ID NO: 1469175 - RNA, 19 nt, Homo sapiens
caaacguuuugaacuaaua

SEQ ID NO: 1469176 - RNA, 13 nt, Homo sapiens
caaacuaaaagac

SEQ ID NO: 1469177 - RNA, 21 nt, Homo sapiens
caaacucacugcucaagaaga

SEQ ID NO: 1469178 - RNA, 16 nt, Homo sapiens
caaacugcaaaccaug

SEQ ID NO: 1469179 - RNA, 17 nt, Homo sapiens
caaacuuuguuugucac

SEQ ID NO: 1469180 - RNA, 20 nt, Homo sapiens
caaacuuuuuuauaucuuuu

SEQ ID NO: 1469181 - RNA, 20 nt, Homo sapiens
caaagaaauuccccaagcac

SEQ ID NO: 1469182 - RNA, 16 nt, Homo sapiens
caaagaccgauugcau

SEQ ID NO: 1469183 - RNA, 18 nt, Homo sapiens
caaagagguacaaaaaag

SEQ ID NO: 1469184 - RNA, 15 nt, Homo sapiens
caaagagguguacag

SEQ ID NO: 1469185 - RNA, 16 nt, Homo sapiens
caaagauaacaugcuu

SEQ ID NO: 1469186 - RNA, 22 nt, Homo sapiens
caaagauuuuggaggagaagga

SEQ ID NO: 1469187 - RNA, 21 nt, Homo sapiens
caaagcaaguuucaucaguca

SEQ ID NO: 1469188 - RNA, 14 nt, Homo sapiens
caaagcacauuggg

SEQ ID NO: 1469189 - RNA, 13 nt, Homo sapiens
caaagcaccagcu

SEQ ID NO: 1469190 - RNA, 16 nt, Homo sapiens
caaagccggcuugauu

SEQ ID NO: 1469191 - RNA, 15 nt, Homo sapiens
caaagcuuuccugcc

SEQ ID NO: 1469192 - RNA, 20 nt, Homo sapiens
caaaggaaguccaaccugag

SEQ ID NO: 1469193 - RNA, 14 nt, Homo sapiens
caaaggugcuaaau

SEQ ID NO: 1469194 - RNA, 17 nt, Homo sapiens
caaaggugugcccugua

SEQ ID NO: 1469195 - RNA, 23 nt, Homo sapiens
caauugagaaaaauauauacuaa

SEQ ID NO: 1469196 - RNA, 15 nt, Homo sapiens
caauugugcugccau

SEQ ID NO: 1469197 - RNA, 20 nt, Homo sapiens
caauugugcugccauuugau

SEQ ID NO: 1469198 - RNA, 17 nt, Homo sapiens
caauuuaacauguguau

SEQ ID NO: 1469199 - RNA, 22 nt, Homo sapiens
caauuucaccaccaaaugccaa

SEQ ID NO: 1469200 - RNA, 19 nt, Homo sapiens
caauuucacuuagucugua

SEQ ID NO: 1469201 - RNA, 23 nt, Homo sapiens
caauuucuugcucuaucucucaa

SEQ ID NO: 1469202 - RNA, 16 nt, Homo sapiens
caauuugaauauaaau

SEQ ID NO: 1469203 - RNA, 23 nt, Homo sapiens
caauuuucuuuuuuauacucaau

SEQ ID NO: 1469204 - RNA, 19 nt, Homo sapiens
cacaaaaagugucucugcc

SEQ ID NO: 1469205 - RNA, 12 nt, Homo sapiens
cacaaaacagaa

SEQ ID NO: 1469206 - RNA, 16 nt, Homo sapiens
cacaaaaucuguccaa

SEQ ID NO: 1469207 - RNA, 13 nt, Homo sapiens
cacaaaguguaua

SEQ ID NO: 1469208 - RNA, 17 nt, Homo sapiens
cacaacauuuacuuaac

SEQ ID NO: 1469209 - RNA, 22 nt, Homo sapiens
cacaagcgaaucucugccuuuc

SEQ ID NO: 1469210 - RNA, 14 nt, Homo sapiens
cacaaggaaggcau

SEQ ID NO: 1469211 - RNA, 23 nt, Homo sapiens
cacaaggggaaggguacugaaaa

SEQ ID NO: 1469212 - RNA, 15 nt, Homo sapiens
cacaagguccacucc

SEQ ID NO: 1469213 - RNA, 16 nt, Homo sapiens
cacaagguccacuccc

SEQ ID NO: 1469214 - RNA, 17 nt, Homo sapiens
cacaaggugcaaaucaa

SEQ ID NO: 1469215 - RNA, 14 nt, Homo sapiens
cacaauaaauguau

SEQ ID NO: 1469216 - RNA, 13 nt, Homo sapiens
cacaauaugaaua

SEQ ID NO: 1469217 - RNA, 23 nt, Homo sapiens
cacaaucccuggggcugugcauu

SEQ ID NO: 1469218 - RNA, 14 nt, Homo sapiens
cacaaugcugaaua

SEQ ID NO: 1469219 - RNA, 15 nt, Homo sapiens
cacacaaggugcaaa

SEQ ID NO: 1469220 - RNA, 12 nt, Homo sapiens
cacacacacaaa

SEQ ID NO: 1469221 - RNA, 14 nt, Homo sapiens
cacacacacaugcu

SEQ ID NO: 1469222 - RNA, 15 nt, Homo sapiens
cacacacaugcuagg

SEQ ID NO: 1469223 - RNA, 13 nt, Homo sapiens
cacacacucccug

SEQ ID NO: 1469224 - RNA, 16 nt, Homo sapiens
cacacagcacucucua

SEQ ID NO: 1469225 - RNA, 13 nt, Homo sapiens
cacacagcugccc

SEQ ID NO: 1469226 - RNA, 20 nt, Homo sapiens
cacacaguuauuuaaucaaa

SEQ ID NO: 1469227 - RNA, 14 nt, Homo sapiens
cacacaucucauuu

SEQ ID NO: 1469228 - RNA, 12 nt, Homo sapiens
cacacaugcuag

SEQ ID NO: 1469229 - RNA, 20 nt, Homo sapiens
cacaccauucauucugguca

SEQ ID NO: 1469230 - RNA, 12 nt, Homo sapiens
cacacccggcua

SEQ ID NO: 1469231 - RNA, 16 nt, Homo sapiens
cacacccgugagaaau

SEQ ID NO: 1469232 - RNA, 20 nt, Homo sapiens
cacacccuggaggauuucau

SEQ ID NO: 1469233 - RNA, 13 nt, Homo sapiens
cacacggaucuga

SEQ ID NO: 1469234 - RNA, 16 nt, Homo sapiens
cacacguuugugagcu

SEQ ID NO: 1469235 - RNA, 17 nt, Homo sapiens
cacacguuugugagcuc

SEQ ID NO: 1469236 - RNA, 14 nt, Homo sapiens
cacacucagcacaa

SEQ ID NO: 1469237 - RNA, 20 nt, Homo sapiens
cacacuccuccaaggcacaa

SEQ ID NO: 1469238 - RNA, 14 nt, Homo sapiens
cacacugcuagcaa

SEQ ID NO: 1469239 - RNA, 15 nt, Homo sapiens
cacacuggugacugc

SEQ ID NO: 1469240 - RNA, 20 nt, Homo sapiens
cacagaacacagcaauuccu

SEQ ID NO: 1469241 - RNA, 15 nt, Homo sapiens
cacagaagacccgcu

SEQ ID NO: 1469242 - RNA, 14 nt, Homo sapiens
cacagaaggaauaa

SEQ ID NO: 1469243 - RNA, 19 nt, Homo sapiens
cacagaaggaauaagguca

SEQ ID NO: 1469244 - RNA, 23 nt, Homo sapiens
cacagagugcauugugaggguua

SEQ ID NO: 1469245 - RNA, 20 nt, Homo sapiens
cacagcaagacuccgucuca

SEQ ID NO: 1469246 - RNA, 15 nt, Homo sapiens
cacagcagcaguuac

SEQ ID NO: 1469247 - RNA, 15 nt, Homo sapiens
cacagcagcugaaca

SEQ ID NO: 1469248 - RNA, 20 nt, Homo sapiens
cacagcagcugaacagccaa

SEQ ID NO: 1469249 - RNA, 15 nt, Homo sapiens
cacagcucuucacac

SEQ ID NO: 1469250 - RNA, 16 nt, Homo sapiens
cacagcugaacuauuu

SEQ ID NO: 1469251 - RNA, 12 nt, Homo sapiens
cacagcugccau

SEQ ID NO: 1469252 - RNA, 16 nt, Homo sapiens
cacagcuggcucugac

SEQ ID NO: 1469253 - RNA, 17 nt, Homo sapiens
cacagcuggcucugaca

SEQ ID NO: 1469254 - RNA, 20 nt, Homo sapiens
cacagcugggcaaagccaca

SEQ ID NO: 1469255 - RNA, 19 nt, Homo sapiens
cacaggaagccugcagucc

SEQ ID NO: 1469256 - RNA, 14 nt, Homo sapiens
cacaggaguguccu

SEQ ID NO: 1469257 - RNA, 23 nt, Homo sapiens
cacaggcuggcgcucggcuccac

SEQ ID NO: 1469258 - RNA, 22 nt, Homo sapiens
cacagggcgagacuccgucuca

SEQ ID NO: 1469259 - RNA, 21 nt, Homo sapiens
cacaguagaacugucugugaa

SEQ ID NO: 1469260 - RNA, 16 nt, Homo sapiens
cacaguagucuugaug

SEQ ID NO: 1469261 - RNA, 14 nt, Homo sapiens
cacaguauuaucug

SEQ ID NO: 1469262 - RNA, 12 nt, Homo sapiens
cacaguccucau

SEQ ID NO: 1469263 - RNA, 12 nt, Homo sapiens
cacaguggcacc

SEQ ID NO: 1469264 - RNA, 13 nt, Homo sapiens
cacaguguuuuaa

SEQ ID NO: 1469265 - RNA, 18 nt, Homo sapiens
cacaguuagguagcuuua

SEQ ID NO: 1469266 - RNA, 17 nt, Homo sapiens
cacauacaggugcucaa

SEQ ID NO: 1469267 - RNA, 17 nt, Homo sapiens
cacauauaucaaaguga

SEQ ID NO: 1469268 - RNA, 22 nt, Homo sapiens
cacauauaucaaagugagaaaa

SEQ ID NO: 1469269 - RNA, 16 nt, Homo sapiens
cacaucgcacacuggg

SEQ ID NO: 1469270 - RNA, 17 nt, Homo sapiens
cacaucucugccuggaa

SEQ ID NO: 1469271 - RNA, 18 nt, Homo sapiens
cacaucugccagaccuua

SEQ ID NO: 1469272 - RNA, 22 nt, Homo sapiens
cacaugaaugcagucaugcaaa

SEQ ID NO: 1469273 - RNA, 19 nt, Homo sapiens
cacaugaccugaucacuag

SEQ ID NO: 1469274 - RNA, 17 nt, Homo sapiens
cacaugaggccaucuca

SEQ ID NO: 1469275 - RNA, 15 nt, Homo sapiens
cacaugcacacacac

SEQ ID NO: 1469276 - RNA, 12 nt, Homo sapiens
cacaugccuuaa

SEQ ID NO: 1469277 - RNA, 9 nt, Homo sapiens
cacaugcua

SEQ ID NO: 1469278 - RNA, 22 nt, Homo sapiens
cacauuaucaguugacagugua

SEQ ID NO: 1469279 - RNA, 20 nt, Homo sapiens
cacauuaucgggagcagugu

SEQ ID NO: 1469280 - RNA, 19 nt, Homo sapiens
cacauucaugugggcauuu

SEQ ID NO: 1469281 - RNA, 15 nt, Homo sapiens
cacauucgacauacc

SEQ ID NO: 1469282 - RNA, 18 nt, Homo sapiens
cacauuggaaugccuugg

SEQ ID NO: 1469283 - RNA, 22 nt, Homo sapiens
cacauuggucauugugaauauu

SEQ ID NO: 1469284 - RNA, 15 nt, Homo sapiens
cacauuuaccaguau

SEQ ID NO: 1469285 - RNA, 21 nt, Homo sapiens
cacauuuagauccugguuuca

SEQ ID NO: 1469286 - RNA, 15 nt, Homo sapiens
caccaaaaagggauc

SEQ ID NO: 1469287 - RNA, 14 nt, Homo sapiens
caccaaaagugcuc

SEQ ID NO: 1469288 - RNA, 21 nt, Homo sapiens
caccaacgagcuguacaugau

SEQ ID NO: 1469289 - RNA, 22 nt, Homo sapiens
caccaaggaaacgcuaccucuc

SEQ ID NO: 1469290 - RNA, 14 nt, Homo sapiens
caccacagacacac

SEQ ID NO: 1469291 - RNA, 14 nt, Homo sapiens
caccacagagccuc

SEQ ID NO: 1469292 - RNA, 13 nt, Homo sapiens
caccaccacuuac

SEQ ID NO: 1469293 - RNA, 23 nt, Homo sapiens
caccaccuggggagagccugcuu

SEQ ID NO: 1469294 - RNA, 15 nt, Homo sapiens
caccacgacuggcca

SEQ ID NO: 1469295 - RNA, 18 nt, Homo sapiens
caccacgguagugccuga

SEQ ID NO: 1469296 - RNA, 12 nt, Homo sapiens
caccacuguaua

SEQ ID NO: 1469297 - RNA, 13 nt, Homo sapiens
caccagacaucac

SEQ ID NO: 1469298 - RNA, 19 nt, Homo sapiens
cagccugggcaacagagca

SEQ ID NO: 1469299 - RNA, 19 nt, Homo sapiens
cagccugggugacagagca

SEQ ID NO: 1469300 - RNA, 23 nt, Homo sapiens
cagccugggugacagugcaagac

SEQ ID NO: 1469301 - RNA, 16 nt, Homo sapiens
cagccuguccaacaga

SEQ ID NO: 1469302 - RNA, 18 nt, Homo sapiens
cagccugucccauggaca

SEQ ID NO: 1469303 - RNA, 20 nt, Homo sapiens
cagccugugguuacagugca

SEQ ID NO: 1469304 - RNA, 24 nt, Homo sapiens
cagccuuaugauuaaacuuccuuc

SEQ ID NO: 1469305 - RNA, 19 nt, Homo sapiens
cagcgaccuuccucaucca

SEQ ID NO: 1469306 - RNA, 21 nt, Homo sapiens
cagcgcagcuggacucugcau

SEQ ID NO: 1469307 - RNA, 19 nt, Homo sapiens
cagcggaggagaccagcuc

SEQ ID NO: 1469308 - RNA, 16 nt, Homo sapiens
cagcgucccagucucu

SEQ ID NO: 1469309 - RNA, 19 nt, Homo sapiens
cagcuaagggaagacauuu

SEQ ID NO: 1469310 - RNA, 15 nt, Homo sapiens
cagcuagugccuuua

SEQ ID NO: 1469311 - RNA, 18 nt, Homo sapiens
cagcuauaccugcacguu

SEQ ID NO: 1469312 - RNA, 20 nt, Homo sapiens
cagcuaucugucaucucucu

SEQ ID NO: 1469313 - RNA, 19 nt, Homo sapiens
cagcuauuuucaacauaac

SEQ ID NO: 1469314 - RNA, 15 nt, Homo sapiens
cagcucagaggccca

SEQ ID NO: 1469315 - RNA, 14 nt, Homo sapiens
cagcucugggccau

SEQ ID NO: 1469316 - RNA, 15 nt, Homo sapiens
cagcugaacagccaa

SEQ ID NO: 1469317 - RNA, 17 nt, Homo sapiens
cagcugagccugagcca

SEQ ID NO: 1469318 - RNA, 14 nt, Homo sapiens
cagcugccaaggaa

SEQ ID NO: 1469319 - RNA, 16 nt, Homo sapiens
cagcugcgcuugcuuu

SEQ ID NO: 1469320 - RNA, 21 nt, Homo sapiens
cagcuggaagggucaacaucu

SEQ ID NO: 1469321 - RNA, 22 nt, Homo sapiens
cagcuguaacccucacccacag

SEQ ID NO: 1469322 - RNA, 21 nt, Homo sapiens
cagcuguauugucugaacuug

SEQ ID NO: 1469323 - RNA, 14 nt, Homo sapiens
cagcugugcacuuu

SEQ ID NO: 1469324 - RNA, 22 nt, Homo sapiens
cagcuuagaauuauuugcacua

SEQ ID NO: 1469325 - RNA, 19 nt, Homo sapiens
cagcuucaccagagcauuu

SEQ ID NO: 1469326 - RNA, 12 nt, Homo sapiens
cagcuucaugaa

SEQ ID NO: 1469327 - RNA, 13 nt, Homo sapiens
cagcuuguaugca

SEQ ID NO: 1469328 - RNA, 14 nt, Homo sapiens
caggaaacuagcuu

SEQ ID NO: 1469329 - RNA, 21 nt, Homo sapiens
caggaaacuccacaucugccu

SEQ ID NO: 1469330 - RNA, 14 nt, Homo sapiens
caggaaaguguuau

SEQ ID NO: 1469331 - RNA, 19 nt, Homo sapiens
caggaaauaaauuguaaaa

SEQ ID NO: 1469332 - RNA, 17 nt, Homo sapiens
caggaagggagaacuug

SEQ ID NO: 1469333 - RNA, 21 nt, Homo sapiens
caggaagguagcccagcacug

SEQ ID NO: 1469334 - RNA, 19 nt, Homo sapiens
caggacaccaguccaggua

SEQ ID NO: 1469335 - RNA, 19 nt, Homo sapiens
caggacagaugccacacaa

SEQ ID NO: 1469336 - RNA, 15 nt, Homo sapiens
caggaccaagccaca

SEQ ID NO: 1469337 - RNA, 15 nt, Homo sapiens
caggaccuacuagga

SEQ ID NO: 1469338 - RNA, 20 nt, Homo sapiens
caggacucaaucuacaggcc

SEQ ID NO: 1469339 - RNA, 20 nt, Homo sapiens
caggacuuccauuugcuuug

SEQ ID NO: 1469340 - RNA, 19 nt, Homo sapiens
caggacuuguuuacaaaga

SEQ ID NO: 1469341 - RNA, 17 nt, Homo sapiens
caggagaaccacuacau

SEQ ID NO: 1469342 - RNA, 18 nt, Homo sapiens
caggagaacuacuugaac

SEQ ID NO: 1469343 - RNA, 13 nt, Homo sapiens
caggagaaucgcu

SEQ ID NO: 1469344 - RNA, 18 nt, Homo sapiens
caggagacagaccacuug

SEQ ID NO: 1469345 - RNA, 14 nt, Homo sapiens
caggagacauuggu

SEQ ID NO: 1469346 - RNA, 17 nt, Homo sapiens
caggagaccuggcacug

SEQ ID NO: 1469347 - RNA, 19 nt, Homo sapiens
caggagauggguccagggg

SEQ ID NO: 1469348 - RNA, 15 nt, Homo sapiens
caggagccaccagca

SEQ ID NO: 1469349 - RNA, 21 nt, Homo sapiens
caggagcugcggccacucuac

SEQ ID NO: 1469350 - RNA, 14 nt, Homo sapiens
caggaggaggccaa

SEQ ID NO: 1469351 - RNA, 15 nt, Homo sapiens
caggaggcugaggca

SEQ ID NO: 1469352 - RNA, 22 nt, Homo sapiens
caggaggcugggacgcucugcu

SEQ ID NO: 1469353 - RNA, 16 nt, Homo sapiens
caggagggcccuaccu

SEQ ID NO: 1469354 - RNA, 15 nt, Homo sapiens
caggaggggucucau

SEQ ID NO: 1469355 - RNA, 17 nt, Homo sapiens
caggaggugcuaucgca

SEQ ID NO: 1469356 - RNA, 17 nt, Homo sapiens
caggagucagugucugg

SEQ ID NO: 1469357 - RNA, 23 nt, Homo sapiens
caggaguguuaagcguucaguga

SEQ ID NO: 1469358 - RNA, 17 nt, Homo sapiens
caggaguucaagaccag

SEQ ID NO: 1469359 - RNA, 17 nt, Homo sapiens
caggauauccuuaucag

SEQ ID NO: 1469360 - RNA, 15 nt, Homo sapiens
caggaucauggugua

SEQ ID NO: 1469361 - RNA, 22 nt, Homo sapiens
caggauccuauucucaccagga

SEQ ID NO: 1469362 - RNA, 17 nt, Homo sapiens
caggaugagguggugga

SEQ ID NO: 1469363 - RNA, 13 nt, Homo sapiens
caggaugaguuac

SEQ ID NO: 1469364 - RNA, 19 nt, Homo sapiens
caggaugaguuacuugaaa

SEQ ID NO: 1469365 - RNA, 19 nt, Homo sapiens
caggaugguggacuacaaa

SEQ ID NO: 1469366 - RNA, 19 nt, Homo sapiens
caggauuauugucaaagaa

SEQ ID NO: 1469367 - RNA, 15 nt, Homo sapiens
caggcaacgcacaaa

SEQ ID NO: 1469368 - RNA, 22 nt, Homo sapiens
caggcaauuucaccaccaaaug

SEQ ID NO: 1469369 - RNA, 13 nt, Homo sapiens
caggcaccugcca

SEQ ID NO: 1469370 - RNA, 14 nt, Homo sapiens
caggcacugcugca

SEQ ID NO: 1469371 - RNA, 22 nt, Homo sapiens
caggcagacuacacaggaugag

SEQ ID NO: 1469372 - RNA, 16 nt, Homo sapiens
caggcagaucugugcc

SEQ ID NO: 1469373 - RNA, 14 nt, Homo sapiens
caggcagauuugag

SEQ ID NO: 1469374 - RNA, 15 nt, Homo sapiens
caggcagggugagcu

SEQ ID NO: 1469375 - RNA, 15 nt, Homo sapiens
caggcagggugcagu

SEQ ID NO: 1469376 - RNA, 18 nt, Homo sapiens
caggcaguggaagcaguu

SEQ ID NO: 1469377 - RNA, 16 nt, Homo sapiens
caggcaugcaagugag

SEQ ID NO: 1469378 - RNA, 15 nt, Homo sapiens
caggcauuugacuga

SEQ ID NO: 1469379 - RNA, 18 nt, Homo sapiens
caggcauuugacugaaga

SEQ ID NO: 1469380 - RNA, 16 nt, Homo sapiens
caggccagagggcagu

SEQ ID NO: 1469381 - RNA, 14 nt, Homo sapiens
caggccaggccacc

SEQ ID NO: 1469382 - RNA, 15 nt, Homo sapiens
caggccagugucugg

SEQ ID NO: 1469383 - RNA, 22 nt, Homo sapiens
caggcccuguccuaagcacuuu

SEQ ID NO: 1469384 - RNA, 17 nt, Homo sapiens
caggccgggguggagca

SEQ ID NO: 1469385 - RNA, 18 nt, Homo sapiens
caggccucccugccagua

SEQ ID NO: 1469386 - RNA, 13 nt, Homo sapiens
caggccuggacuu

SEQ ID NO: 1469387 - RNA, 22 nt, Homo sapiens
caggccuggacuuccagugcuc

SEQ ID NO: 1469388 - RNA, 17 nt, Homo sapiens
caggccugugcgugcca

SEQ ID NO: 1469389 - RNA, 21 nt, Homo sapiens
caggccuuaauuuucaguaua

SEQ ID NO: 1469390 - RNA, 20 nt, Homo sapiens
caggcgugagccaccgcgcc

SEQ ID NO: 1469391 - RNA, 16 nt, Homo sapiens
caggcucaagcugucc

SEQ ID NO: 1469392 - RNA, 17 nt, Homo sapiens
caggcuggagugcagug

SEQ ID NO: 1469393 - RNA, 14 nt, Homo sapiens
caggcugggccaug

SEQ ID NO: 1469394 - RNA, 13 nt, Homo sapiens
caggcuggucuca

SEQ ID NO: 1469395 - RNA, 14 nt, Homo sapiens
caggcugugggccu

SEQ ID NO: 1469396 - RNA, 23 nt, Homo sapiens
caggcuguggguagaugugcaau

SEQ ID NO: 1469397 - RNA, 13 nt, Homo sapiens
caggcuguucucc

SEQ ID NO: 1469398 - RNA, 13 nt, Homo sapiens
caggcuucaucaa

SEQ ID NO: 1469399 - RNA, 13 nt, Homo sapiens
cagggaagccaaa

SEQ ID NO: 1469400 - RNA, 16 nt, Homo sapiens
cagggaagucacuuca

SEQ ID NO: 1469401 - RNA, 21 nt, Homo sapiens
ccuuauuguaccucucuuaua

SEQ ID NO: 1469402 - RNA, 23 nt, Homo sapiens
ccuuauuuugugugcuuucccag

SEQ ID NO: 1469403 - RNA, 22 nt, Homo sapiens
ccuucaccccaguggccacuca

SEQ ID NO: 1469404 - RNA, 19 nt, Homo sapiens
ccuucaucuucacugcaau

SEQ ID NO: 1469405 - RNA, 23 nt, Homo sapiens
ccuuccccagcgucccagucucu

SEQ ID NO: 1469406 - RNA, 18 nt, Homo sapiens
ccuucccucucaugacuu

SEQ ID NO: 1469407 - RNA, 17 nt, Homo sapiens
ccuuccuaauaugcuuu

SEQ ID NO: 1469408 - RNA, 18 nt, Homo sapiens
ccuuccuaauaugcuuua

SEQ ID NO: 1469409 - RNA, 18 nt, Homo sapiens
ccuuccuaugcuguucac

SEQ ID NO: 1469410 - RNA, 14 nt, Homo sapiens
ccuuccucacuucc

SEQ ID NO: 1469411 - RNA, 16 nt, Homo sapiens
ccuuccucucaggcuc

SEQ ID NO: 1469412 - RNA, 14 nt, Homo sapiens
ccuuccuggccuga

SEQ ID NO: 1469413 - RNA, 13 nt, Homo sapiens
ccuucggcagcua

SEQ ID NO: 1469414 - RNA, 17 nt, Homo sapiens
ccuucggcagcuacuca

SEQ ID NO: 1469415 - RNA, 22 nt, Homo sapiens
ccuucuaggucacuucucacaa

SEQ ID NO: 1469416 - RNA, 15 nt, Homo sapiens
ccuucucaagacuuu

SEQ ID NO: 1469417 - RNA, 22 nt, Homo sapiens
ccuucucacacacaacugucca

SEQ ID NO: 1469418 - RNA, 22 nt, Homo sapiens
ccuucucagaccugcgcacucc

SEQ ID NO: 1469419 - RNA, 15 nt, Homo sapiens
ccuucuccaccaaag

SEQ ID NO: 1469420 - RNA, 14 nt, Homo sapiens
ccuugaguaaaaag

SEQ ID NO: 1469421 - RNA, 22 nt, Homo sapiens
ccuugauggagauauuuacaug

SEQ ID NO: 1469422 - RNA, 21 nt, Homo sapiens
ccuugcaaucuucuacuuuaa

SEQ ID NO: 1469423 - RNA, 13 nt, Homo sapiens
ccuugcagccaca

SEQ ID NO: 1469424 - RNA, 19 nt, Homo sapiens
ccuugccucaaugccagua

SEQ ID NO: 1469425 - RNA, 21 nt, Homo sapiens
ccuugcgauucugcagccaca

SEQ ID NO: 1469426 - RNA, 14 nt, Homo sapiens
ccuugcuagcugac

SEQ ID NO: 1469427 - RNA, 22 nt, Homo sapiens
ccuugcugauggugacauugca

SEQ ID NO: 1469428 - RNA, 23 nt, Homo sapiens
ccuugcuggacggggacugggga

SEQ ID NO: 1469429 - RNA, 17 nt, Homo sapiens
ccuuggcaccagacacc

SEQ ID NO: 1469430 - RNA, 15 nt, Homo sapiens
ccuugggaugaucuu

SEQ ID NO: 1469431 - RNA, 17 nt, Homo sapiens
ccuugggccuugcugcu

SEQ ID NO: 1469432 - RNA, 16 nt, Homo sapiens
ccuugggcugcuccuc

SEQ ID NO: 1469433 - RNA, 20 nt, Homo sapiens
ccuuggggaaccccgagcug

SEQ ID NO: 1469434 - RNA, 14 nt, Homo sapiens
ccuuggugugaccc

SEQ ID NO: 1469435 - RNA, 16 nt, Homo sapiens
ccuuguaaagacugua

SEQ ID NO: 1469436 - RNA, 19 nt, Homo sapiens
ccuuguaauucuaaaugaa

SEQ ID NO: 1469437 - RNA, 13 nt, Homo sapiens
ccuuguccaccca

SEQ ID NO: 1469438 - RNA, 24 nt, Homo sapiens
ccuuguccacccaccuaugugcca

SEQ ID NO: 1469439 - RNA, 22 nt, Homo sapiens
ccuuguccugaugcugugcuca

SEQ ID NO: 1469440 - RNA, 19 nt, Homo sapiens
ccuuguuccaauuugacaa

SEQ ID NO: 1469441 - RNA, 16 nt, Homo sapiens
ccuuuagaaccuuaaa

SEQ ID NO: 1469442 - RNA, 16 nt, Homo sapiens
ccuuuccauaaggaau

SEQ ID NO: 1469443 - RNA, 19 nt, Homo sapiens
ccuuuccuuccaucccuac

SEQ ID NO: 1469444 - RNA, 20 nt, Homo sapiens
ccuuucuccaggaccaauaa

SEQ ID NO: 1469445 - RNA, 24 nt, Homo sapiens
ccuuucugucccacuacaucuggg

SEQ ID NO: 1469446 - RNA, 15 nt, Homo sapiens
ccuuucuuacauuag

SEQ ID NO: 1469447 - RNA, 18 nt, Homo sapiens
ccuuucuuauuaauuuca

SEQ ID NO: 1469448 - RNA, 19 nt, Homo sapiens
ccuuucuugcagauucuau

SEQ ID NO: 1469449 - RNA, 23 nt, Homo sapiens
ccuuucuuuuaaugaugccaugg

SEQ ID NO: 1469450 - RNA, 18 nt, Homo sapiens
ccuuugacauuuaauuua

SEQ ID NO: 1469451 - RNA, 22 nt, Homo sapiens
ccuuugaguuuuguauucaaua

SEQ ID NO: 1469452 - RNA, 23 nt, Homo sapiens
ccuuugcuaaaauauaauuuuca

SEQ ID NO: 1469453 - RNA, 14 nt, Homo sapiens
ccuuuggaaagcca

SEQ ID NO: 1469454 - RNA, 23 nt, Homo sapiens
ccuuuggagcuuuuuucuuuaag

SEQ ID NO: 1469455 - RNA, 22 nt, Homo sapiens
ccuuugggccucugcuucucuc

SEQ ID NO: 1469456 - RNA, 19 nt, Homo sapiens
ccuuuguguagaaagccaa

SEQ ID NO: 1469457 - RNA, 18 nt, Homo sapiens
ccuuuguguauucaucuu

SEQ ID NO: 1469458 - RNA, 13 nt, Homo sapiens
ccuuuguugcaca

SEQ ID NO: 1469459 - RNA, 15 nt, Homo sapiens
ccuuuuaacucaccu

SEQ ID NO: 1469460 - RNA, 17 nt, Homo sapiens
ccuuuuccuauccuuau

SEQ ID NO: 1469461 - RNA, 18 nt, Homo sapiens
ccuuuucucucacccauc

SEQ ID NO: 1469462 - RNA, 17 nt, Homo sapiens
ccuuuuuuauuccauaa

SEQ ID NO: 1469463 - RNA, 21 nt, Homo sapiens
cgaaaccugggauucaggaau

SEQ ID NO: 1469464 - RNA, 18 nt, Homo sapiens
cgaaauaacaauguuaag

SEQ ID NO: 1469465 - RNA, 16 nt, Homo sapiens
cgaacccaaucugcac

SEQ ID NO: 1469466 - RNA, 14 nt, Homo sapiens
cgaagaguggacaa

SEQ ID NO: 1469467 - RNA, 16 nt, Homo sapiens
cgaagccuuaagccau

SEQ ID NO: 1469468 - RNA, 15 nt, Homo sapiens
cgaaggauauuguca

SEQ ID NO: 1469469 - RNA, 18 nt, Homo sapiens
cgaccgcccccuccucua

SEQ ID NO: 1469470 - RNA, 11 nt, Homo sapiens
cgacuguaaau

SEQ ID NO: 1469471 - RNA, 18 nt, Homo sapiens
cgagacacaggcacgggu

SEQ ID NO: 1469472 - RNA, 21 nt, Homo sapiens
cgagaucacgucacugcacuc

SEQ ID NO: 1469473 - RNA, 19 nt, Homo sapiens
cgagaucgcgccacugcac

SEQ ID NO: 1469474 - RNA, 20 nt, Homo sapiens
cgagaucgcgccacugcacu

SEQ ID NO: 1469475 - RNA, 19 nt, Homo sapiens
cgagcaccuccagccugaa

SEQ ID NO: 1469476 - RNA, 19 nt, Homo sapiens
cgagcaccuguaaucccag

SEQ ID NO: 1469477 - RNA, 14 nt, Homo sapiens
cgagccugcacugg

SEQ ID NO: 1469478 - RNA, 18 nt, Homo sapiens
cgagcuccagagcaacga

SEQ ID NO: 1469479 - RNA, 22 nt, Homo sapiens
cgaggacuacaaccaauuuaca

SEQ ID NO: 1469480 - RNA, 14 nt, Homo sapiens
cgaggcgaugccac

SEQ ID NO: 1469481 - RNA, 15 nt, Homo sapiens
cgaggcgaugccacg

SEQ ID NO: 1469482 - RNA, 23 nt, Homo sapiens
cgagggcugauggaggaaaaagg

SEQ ID NO: 1469483 - RNA, 20 nt, Homo sapiens
cgaguggauuguaggugcaa

SEQ ID NO: 1469484 - RNA, 16 nt, Homo sapiens
cgaugcugcuauggaa

SEQ ID NO: 1469485 - RNA, 12 nt, Homo sapiens
cgauggagacac

SEQ ID NO: 1469486 - RNA, 20 nt, Homo sapiens
cgcaaagggcugaaagccau

SEQ ID NO: 1469487 - RNA, 14 nt, Homo sapiens
cgcaccauucuccu

SEQ ID NO: 1469488 - RNA, 21 nt, Homo sapiens
cgcaccgacuagacacacaaa

SEQ ID NO: 1469489 - RNA, 13 nt, Homo sapiens
cgcaccugccuca

SEQ ID NO: 1469490 - RNA, 17 nt, Homo sapiens
cgcaggagccauugcuc

SEQ ID NO: 1469491 - RNA, 23 nt, Homo sapiens
cgcaucguggccuugaccuccaa

SEQ ID NO: 1469492 - RNA, 16 nt, Homo sapiens
cgcaucucagugcagg

SEQ ID NO: 1469493 - RNA, 16 nt, Homo sapiens
cgcaugugugcugcag

SEQ ID NO: 1469494 - RNA, 19 nt, Homo sapiens
cgcauugagccaguggugc

SEQ ID NO: 1469495 - RNA, 20 nt, Homo sapiens
cgccagagggcuugugaaca

SEQ ID NO: 1469496 - RNA, 15 nt, Homo sapiens
cgccaggaagccaga

SEQ ID NO: 1469497 - RNA, 21 nt, Homo sapiens
cgcccacguggcagaccguga

SEQ ID NO: 1469498 - RNA, 21 nt, Homo sapiens
cgcccagguccccgcuuucuu

SEQ ID NO: 1469499 - RNA, 13 nt, Homo sapiens
cgcccuccacaaa

SEQ ID NO: 1469500 - RNA, 15 nt, Homo sapiens
cgccgcugacugcca

SEQ ID NO: 1469501 - RNA, 18 nt, Homo sapiens
cgccucacugaaacaugg

SEQ ID NO: 1469502 - RNA, 11 nt, Homo sapiens
cgccucagggc

SEQ ID NO: 1469503 - RNA, 22 nt, Homo sapiens
cucagaaacugcgaggccaguu

SEQ ID NO: 1469504 - RNA, 21 nt, Homo sapiens
cucagaagugaaaaucuugga

SEQ ID NO: 1469505 - RNA, 22 nt, Homo sapiens
cucagaauauugucugccuuaa

SEQ ID NO: 1469506 - RNA, 12 nt, Homo sapiens
cucagaccugaa

SEQ ID NO: 1469507 - RNA, 13 nt, Homo sapiens
cucagagauauac

SEQ ID NO: 1469508 - RNA, 14 nt, Homo sapiens
cucagagaugugca

SEQ ID NO: 1469509 - RNA, 16 nt, Homo sapiens
cucagaggcgcacugu

SEQ ID NO: 1469510 - RNA, 18 nt, Homo sapiens
cucagaucaguguaccau

SEQ ID NO: 1469511 - RNA, 13 nt, Homo sapiens
cucagaugaucuc

SEQ ID NO: 1469512 - RNA, 13 nt, Homo sapiens
cucagcaacaagg

SEQ ID NO: 1469513 - RNA, 23 nt, Homo sapiens
cucagcauuucuuuucuggccaa

SEQ ID NO: 1469514 - RNA, 23 nt, Homo sapiens
cucagccacacccaggcacuuaa

SEQ ID NO: 1469515 - RNA, 15 nt, Homo sapiens
cucagcuguccugca

SEQ ID NO: 1469516 - RNA, 18 nt, Homo sapiens
cucagcuguccugcagca

SEQ ID NO: 1469517 - RNA, 19 nt, Homo sapiens
cucagcuguccugcagcaa

SEQ ID NO: 1469518 - RNA, 13 nt, Homo sapiens
cucagcuuaucuc

SEQ ID NO: 1469519 - RNA, 21 nt, Homo sapiens
cucagcuuuccuuaaggauau

SEQ ID NO: 1469520 - RNA, 13 nt, Homo sapiens
cucaggacagaug

SEQ ID NO: 1469521 - RNA, 17 nt, Homo sapiens
cucaggacugcaacagg

SEQ ID NO: 1469522 - RNA, 14 nt, Homo sapiens
cucaggcacacagc

SEQ ID NO: 1469523 - RNA, 19 nt, Homo sapiens
cucaggcacacagcuacuc

SEQ ID NO: 1469524 - RNA, 21 nt, Homo sapiens
cucaggccugaggugugugcc

SEQ ID NO: 1469525 - RNA, 15 nt, Homo sapiens
cucaggcuugaaaug

SEQ ID NO: 1469526 - RNA, 16 nt, Homo sapiens
cucaggggacuugaau

SEQ ID NO: 1469527 - RNA, 14 nt, Homo sapiens
cucagggugcagag

SEQ ID NO: 1469528 - RNA, 22 nt, Homo sapiens
cucagguagaagguugacacag

SEQ ID NO: 1469529 - RNA, 16 nt, Homo sapiens
cucagguguugccaaa

SEQ ID NO: 1469530 - RNA, 15 nt, Homo sapiens
cucaguaaaaguaaa

SEQ ID NO: 1469531 - RNA, 15 nt, Homo sapiens
cucagucaugcauaa

SEQ ID NO: 1469532 - RNA, 19 nt, Homo sapiens
cucaguccuguacucuggg

SEQ ID NO: 1469533 - RNA, 15 nt, Homo sapiens
cucagugucauuuau

SEQ ID NO: 1469534 - RNA, 17 nt, Homo sapiens
cucaguuucacuuucac

SEQ ID NO: 1469535 - RNA, 13 nt, Homo sapiens
cucauacacagaa

SEQ ID NO: 1469536 - RNA, 21 nt, Homo sapiens
cucauauuuaaagacagggaa

SEQ ID NO: 1469537 - RNA, 14 nt, Homo sapiens
cucaucaacaaaga

SEQ ID NO: 1469538 - RNA, 13 nt, Homo sapiens
cucaucaaucaaa

SEQ ID NO: 1469539 - RNA, 22 nt, Homo sapiens
cucaucauaaaauaaaguauau

SEQ ID NO: 1469540 - RNA, 20 nt, Homo sapiens
cucauccaggcuaccauccg

SEQ ID NO: 1469541 - RNA, 21 nt, Homo sapiens
cucaucccccagccacagugg

SEQ ID NO: 1469542 - RNA, 17 nt, Homo sapiens
cucauccuuaccgcaca

SEQ ID NO: 1469543 - RNA, 12 nt, Homo sapiens
cucaugccugua

SEQ ID NO: 1469544 - RNA, 18 nt, Homo sapiens
cucaugccuguaauccca

SEQ ID NO: 1469545 - RNA, 24 nt, Homo sapiens
cucaugggaagcauguggaugaca

SEQ ID NO: 1469546 - RNA, 17 nt, Homo sapiens
cucaugguccuuggagg

SEQ ID NO: 1469547 - RNA, 18 nt, Homo sapiens
cucauuccccaaccacuu

SEQ ID NO: 1469548 - RNA, 17 nt, Homo sapiens
cucauuuagaacuugca

SEQ ID NO: 1469549 - RNA, 14 nt, Homo sapiens
cuccaaacauuacu

SEQ ID NO: 1469550 - RNA, 16 nt, Homo sapiens
cuccaaaccugaaguu

SEQ ID NO: 1469551 - RNA, 13 nt, Homo sapiens
cuccaaaugagau

SEQ ID NO: 1469552 - RNA, 18 nt, Homo sapiens
cuccaagccugccuccca

SEQ ID NO: 1469553 - RNA, 15 nt, Homo sapiens
cuccaaggacaucua

SEQ ID NO: 1469554 - RNA, 17 nt, Homo sapiens
cuccaaugucugcugag

SEQ ID NO: 1469555 - RNA, 20 nt, Homo sapiens
cuccacaaaugggaaaacca

SEQ ID NO: 1469556 - RNA, 22 nt, Homo sapiens
cuccacaucugccuuaaaacca

SEQ ID NO: 1469557 - RNA, 14 nt, Homo sapiens
cuccaccacauccu

SEQ ID NO: 1469558 - RNA, 12 nt, Homo sapiens
cuccacccuaua

SEQ ID NO: 1469559 - RNA, 19 nt, Homo sapiens
cuccacccuauauguagua

SEQ ID NO: 1469560 - RNA, 12 nt, Homo sapiens
cuccacugccuc

SEQ ID NO: 1469561 - RNA, 12 nt, Homo sapiens
cuccacugucac

SEQ ID NO: 1469562 - RNA, 13 nt, Homo sapiens
cuccacugucacc

SEQ ID NO: 1469563 - RNA, 19 nt, Homo sapiens
cuccagaagaugccagcuu

SEQ ID NO: 1469564 - RNA, 12 nt, Homo sapiens
cuccagaccacc

SEQ ID NO: 1469565 - RNA, 17 nt, Homo sapiens
cuccagaccugauccug

SEQ ID NO: 1469566 - RNA, 20 nt, Homo sapiens
cuccagagaaacccagggag

SEQ ID NO: 1469567 - RNA, 17 nt, Homo sapiens
cuccagaggaugacugg

SEQ ID NO: 1469568 - RNA, 18 nt, Homo sapiens
cuccagaugcagggcagu

SEQ ID NO: 1469569 - RNA, 13 nt, Homo sapiens
cuccagcaccaua

SEQ ID NO: 1469570 - RNA, 15 nt, Homo sapiens
cuccagcaccauaga

SEQ ID NO: 1469571 - RNA, 22 nt, Homo sapiens
cuccagccagcaaugaugucca

SEQ ID NO: 1469572 - RNA, 20 nt, Homo sapiens
cuccagcccagacccagugg

SEQ ID NO: 1469573 - RNA, 22 nt, Homo sapiens
cuccaggaugaguuacuugaaa

SEQ ID NO: 1469574 - RNA, 14 nt, Homo sapiens
cuccaggauuuccu

SEQ ID NO: 1469575 - RNA, 13 nt, Homo sapiens
cuccaggcaaaau

SEQ ID NO: 1469576 - RNA, 19 nt, Homo sapiens
cuccaggccaugauggccu

SEQ ID NO: 1469577 - RNA, 14 nt, Homo sapiens
cuccaggcucuuug

SEQ ID NO: 1469578 - RNA, 16 nt, Homo sapiens
cuccagggacaaagag

SEQ ID NO: 1469579 - RNA, 22 nt, Homo sapiens
cuccagguggcucugaggugcc

SEQ ID NO: 1469580 - RNA, 12 nt, Homo sapiens
cuccagugcagg

SEQ ID NO: 1469581 - RNA, 21 nt, Homo sapiens
cuccaguggcagacaaacaga

SEQ ID NO: 1469582 - RNA, 23 nt, Homo sapiens
cuccauauuggacauccccagaa

SEQ ID NO: 1469583 - RNA, 19 nt, Homo sapiens
cuccaucccaacagccaug

SEQ ID NO: 1469584 - RNA, 12 nt, Homo sapiens
cuccaucuguca

SEQ ID NO: 1469585 - RNA, 20 nt, Homo sapiens
cuccaucuuucuacagagau

SEQ ID NO: 1469586 - RNA, 16 nt, Homo sapiens
cuccaugagacacauc

SEQ ID NO: 1469587 - RNA, 14 nt, Homo sapiens
cuccauguuugaug

SEQ ID NO: 1469588 - RNA, 19 nt, Homo sapiens
cucccaaauugcugggauu

SEQ ID NO: 1469589 - RNA, 18 nt, Homo sapiens
cucccacuucacugcgaa

SEQ ID NO: 1469590 - RNA, 12 nt, Homo sapiens
cucccagcauag

SEQ ID NO: 1469591 - RNA, 16 nt, Homo sapiens
cucccagguaccagcu

SEQ ID NO: 1469592 - RNA, 20 nt, Homo sapiens
cucccagguucccccagcaa

SEQ ID NO: 1469593 - RNA, 22 nt, Homo sapiens
cucccaguccaaauguccucca

SEQ ID NO: 1469594 - RNA, 21 nt, Homo sapiens
cucccauccccuggacuggga

SEQ ID NO: 1469595 - RNA, 11 nt, Homo sapiens
cucccauuuca

SEQ ID NO: 1469596 - RNA, 13 nt, Homo sapiens
cuccccacucuag

SEQ ID NO: 1469597 - RNA, 20 nt, Homo sapiens
cuccccagacuccaccguca

SEQ ID NO: 1469598 - RNA, 18 nt, Homo sapiens
cuccccaggagcucaggu

SEQ ID NO: 1469599 - RNA, 17 nt, Homo sapiens
cuccccaggcuaugcca

SEQ ID NO: 1469600 - RNA, 20 nt, Homo sapiens
cuccccaugccacguuccac

SEQ ID NO: 1469601 - RNA, 19 nt, Homo sapiens
cucccccuccuccagggaa

SEQ ID NO: 1469602 - RNA, 20 nt, Homo sapiens
cuccccuagggggagaagaa

SEQ ID NO: 1469603 - RNA, 17 nt, Homo sapiens
cuccccugcccuggucc

SEQ ID NO: 1469604 - RNA, 19 nt, Homo sapiens
cucccggguucaagugauu

SEQ ID NO: 1469605 - RNA, 21 nt, Homo sapiens
cucccucuggaggcaggcuug

SEQ ID NO: 1469606 - RNA, 12 nt, Homo sapiens
cuggauggggcu

SEQ ID NO: 1469607 - RNA, 19 nt, Homo sapiens
cuggaugucugggugaccu

SEQ ID NO: 1469608 - RNA, 13 nt, Homo sapiens
cuggauucauucu

SEQ ID NO: 1469609 - RNA, 18 nt, Homo sapiens
cuggauuccacacugcac

SEQ ID NO: 1469610 - RNA, 22 nt, Homo sapiens
cuggcaaaaaugcaacaaauga

SEQ ID NO: 1469611 - RNA, 21 nt, Homo sapiens
cuggcaaugaaaaauucucag

SEQ ID NO: 1469612 - RNA, 22 nt, Homo sapiens
cuggcacugaauuaaucaucua

SEQ ID NO: 1469613 - RNA, 21 nt, Homo sapiens
cuggcacuuaguagguccuca

SEQ ID NO: 1469614 - RNA, 18 nt, Homo sapiens
cuggcaggccagugucug

SEQ ID NO: 1469615 - RNA, 12 nt, Homo sapiens
cuggccaaaagc

SEQ ID NO: 1469616 - RNA, 16 nt, Homo sapiens
cuggccauauuuacua

SEQ ID NO: 1469617 - RNA, 19 nt, Homo sapiens
cuggccgcuccucccucag

SEQ ID NO: 1469618 - RNA, 17 nt, Homo sapiens
cuggccugaacugagga

SEQ ID NO: 1469619 - RNA, 23 nt, Homo sapiens
cuggccuggaucuccccacucua

SEQ ID NO: 1469620 - RNA, 17 nt, Homo sapiens
cuggcgcauauuaagca

SEQ ID NO: 1469621 - RNA, 16 nt, Homo sapiens
cuggcucacaguacag

SEQ ID NO: 1469622 - RNA, 15 nt, Homo sapiens
cuggcucuaccuucc

SEQ ID NO: 1469623 - RNA, 19 nt, Homo sapiens
cuggcugaccccaaagagc

SEQ ID NO: 1469624 - RNA, 13 nt, Homo sapiens
cuggcugagcuga

SEQ ID NO: 1469625 - RNA, 17 nt, Homo sapiens
cuggcugcuuuguucaa

SEQ ID NO: 1469626 - RNA, 22 nt, Homo sapiens
cuggcugcuuuguucaaugcua

SEQ ID NO: 1469627 - RNA, 20 nt, Homo sapiens
cuggcugucaguaugacauu

SEQ ID NO: 1469628 - RNA, 22 nt, Homo sapiens
cuggcuguuuagcagaacucau

SEQ ID NO: 1469629 - RNA, 14 nt, Homo sapiens
cuggcuuggaacac

SEQ ID NO: 1469630 - RNA, 16 nt, Homo sapiens
cugggaaucaagacaa

SEQ ID NO: 1469631 - RNA, 15 nt, Homo sapiens
cugggaccuccuuag

SEQ ID NO: 1469632 - RNA, 18 nt, Homo sapiens
cugggagucacacagugu

SEQ ID NO: 1469633 - RNA, 19 nt, Homo sapiens
cugggauucccaccaaggu

SEQ ID NO: 1469634 - RNA, 13 nt, Homo sapiens
cugggcacacgca

SEQ ID NO: 1469635 - RNA, 16 nt, Homo sapiens
cugggcacagagguca

SEQ ID NO: 1469636 - RNA, 15 nt, Homo sapiens
cugggcacaguggac

SEQ ID NO: 1469637 - RNA, 15 nt, Homo sapiens
cugggccacugggga

SEQ ID NO: 1469638 - RNA, 13 nt, Homo sapiens
cugggccaugucc

SEQ ID NO: 1469639 - RNA, 18 nt, Homo sapiens
cugggccauguccaaaga

SEQ ID NO: 1469640 - RNA, 16 nt, Homo sapiens
cugggcccaagacaga

SEQ ID NO: 1469641 - RNA, 22 nt, Homo sapiens
cugggcccggaagggcuuuggu

SEQ ID NO: 1469642 - RNA, 20 nt, Homo sapiens
cugggcccucucuucucacc

SEQ ID NO: 1469643 - RNA, 21 nt, Homo sapiens
cugggccguuacaucugugca

SEQ ID NO: 1469644 - RNA, 15 nt, Homo sapiens
cugggccucaguuca

SEQ ID NO: 1469645 - RNA, 15 nt, Homo sapiens
cugggccuucucacc

SEQ ID NO: 1469646 - RNA, 17 nt, Homo sapiens
cugggcugccaccagcc

SEQ ID NO: 1469647 - RNA, 23 nt, Homo sapiens
cugggcuguaacguggcacuggu

SEQ ID NO: 1469648 - RNA, 16 nt, Homo sapiens
cugggcugucugucac

SEQ ID NO: 1469649 - RNA, 21 nt, Homo sapiens
cugggcugucugucaccagcu

SEQ ID NO: 1469650 - RNA, 14 nt, Homo sapiens
cugggcuugggcac

SEQ ID NO: 1469651 - RNA, 18 nt, Homo sapiens
cuggggacagcuuccuca

SEQ ID NO: 1469652 - RNA, 11 nt, Homo sapiens
cuggggaccau

SEQ ID NO: 1469653 - RNA, 15 nt, Homo sapiens
cuggggacucaggga

SEQ ID NO: 1469654 - RNA, 19 nt, Homo sapiens
cuggggagugguuaggcag

SEQ ID NO: 1469655 - RNA, 14 nt, Homo sapiens
cuggggcaauggga

SEQ ID NO: 1469656 - RNA, 21 nt, Homo sapiens
cuggggcaggaagcuugucac

SEQ ID NO: 1469657 - RNA, 15 nt, Homo sapiens
cuggggcaggucacu

SEQ ID NO: 1469658 - RNA, 11 nt, Homo sapiens
cuggggccacc

SEQ ID NO: 1469659 - RNA, 20 nt, Homo sapiens
cuggggccuacagcuuugau

SEQ ID NO: 1469660 - RNA, 15 nt, Homo sapiens
cuggggcggggccca

SEQ ID NO: 1469661 - RNA, 14 nt, Homo sapiens
cuggggcugugcau

SEQ ID NO: 1469662 - RNA, 20 nt, Homo sapiens
cugggucuaccacucagaga

SEQ ID NO: 1469663 - RNA, 20 nt, Homo sapiens
cugggugcggugacucaugc

SEQ ID NO: 1469664 - RNA, 20 nt, Homo sapiens
cugguaauuuaagauuccag

SEQ ID NO: 1469665 - RNA, 13 nt, Homo sapiens
cugguagcacuug

SEQ ID NO: 1469666 - RNA, 19 nt, Homo sapiens
cugguccagggcuagugac

SEQ ID NO: 1469667 - RNA, 22 nt, Homo sapiens
cuggucccggggccagcacuuc

SEQ ID NO: 1469668 - RNA, 17 nt, Homo sapiens
cugguccucccauuucu

SEQ ID NO: 1469669 - RNA, 15 nt, Homo sapiens
cugguccuuaccaga

SEQ ID NO: 1469670 - RNA, 15 nt, Homo sapiens
cuggucucaaacucc

SEQ ID NO: 1469671 - RNA, 18 nt, Homo sapiens
cuggugcagucauuauga

SEQ ID NO: 1469672 - RNA, 22 nt, Homo sapiens
cuggugccagggugggugucca

SEQ ID NO: 1469673 - RNA, 14 nt, Homo sapiens
cuggugcuccaguu

SEQ ID NO: 1469674 - RNA, 13 nt, Homo sapiens
cugguggugcugc

SEQ ID NO: 1469675 - RNA, 17 nt, Homo sapiens
cugguguugacuggacu

SEQ ID NO: 1469676 - RNA, 15 nt, Homo sapiens
cugguguuggggaaa

SEQ ID NO: 1469677 - RNA, 17 nt, Homo sapiens
cugguuagguagaggga

SEQ ID NO: 1469678 - RNA, 14 nt, Homo sapiens
cugguucuugcaaa

SEQ ID NO: 1469679 - RNA, 22 nt, Homo sapiens
cugguugaaaaauggcaaagaa

SEQ ID NO: 1469680 - RNA, 21 nt, Homo sapiens
cugguugauuuguaacacagu

SEQ ID NO: 1469681 - RNA, 15 nt, Homo sapiens
cugguuuaauuacau

SEQ ID NO: 1469682 - RNA, 13 nt, Homo sapiens
cugguuucuacca

SEQ ID NO: 1469683 - RNA, 17 nt, Homo sapiens
cugguuucuaccagcuc

SEQ ID NO: 1469684 - RNA, 21 nt, Homo sapiens
cugguuuugacaucagcauua

SEQ ID NO: 1469685 - RNA, 14 nt, Homo sapiens
cuguaaagacuuuu

SEQ ID NO: 1469686 - RNA, 15 nt, Homo sapiens
cuguaaauaaccuau

SEQ ID NO: 1469687 - RNA, 18 nt, Homo sapiens
cuguaaaugcauuggaau

SEQ ID NO: 1469688 - RNA, 20 nt, Homo sapiens
cuguaaggcaggcccauuca

SEQ ID NO: 1469689 - RNA, 15 nt, Homo sapiens
cuguaaucccaacac

SEQ ID NO: 1469690 - RNA, 18 nt, Homo sapiens
cuguaaucccagcacuuu

SEQ ID NO: 1469691 - RNA, 20 nt, Homo sapiens
cuguaaucccagcacuuuag

SEQ ID NO: 1469692 - RNA, 20 nt, Homo sapiens
cuguaaucccagcacuuugg

SEQ ID NO: 1469693 - RNA, 21 nt, Homo sapiens
cuguacagaaaguaucacaaa

SEQ ID NO: 1469694 - RNA, 15 nt, Homo sapiens
cuguacauugugaac

SEQ ID NO: 1469695 - RNA, 16 nt, Homo sapiens
cuguacugacuugagg

SEQ ID NO: 1469696 - RNA, 16 nt, Homo sapiens
cuguaggggcaaaaau

SEQ ID NO: 1469697 - RNA, 19 nt, Homo sapiens
cuguagucccagcuacuca

SEQ ID NO: 1469698 - RNA, 21 nt, Homo sapiens
cuguagucccagcuacuuggg

SEQ ID NO: 1469699 - RNA, 16 nt, Homo sapiens
cuguaugauuccuuga

SEQ ID NO: 1469700 - RNA, 15 nt, Homo sapiens
cuguaugcucacaac

SEQ ID NO: 1469701 - RNA, 21 nt, Homo sapiens
cuguauuccgauacaaagugu

SEQ ID NO: 1469702 - RNA, 23 nt, Homo sapiens
cugucaagcaccugcaugugcug

SEQ ID NO: 1469703 - RNA, 19 nt, Homo sapiens
cugucacccagacuggagu

SEQ ID NO: 1469704 - RNA, 16 nt, Homo sapiens
cugucacucugugccu

SEQ ID NO: 1469705 - RNA, 18 nt, Homo sapiens
cugucagcuuccaaacau

SEQ ID NO: 1469706 - RNA, 20 nt, Homo sapiens
cugucaugcuucaucauucc

SEQ ID NO: 1469707 - RNA, 20 nt, Homo sapiens
cugucauuucagauauucca

SEQ ID NO: 1469708 - RNA, 12 nt, Homo sapiens
cuguccagauua

SEQ ID NO: 1469709 - RNA, 15 nt, Homo sapiens
cuuuaaagauguaau

SEQ ID NO: 1469710 - RNA, 22 nt, Homo sapiens
cuuuaaccccaaauuuggcuaa

SEQ ID NO: 1469711 - RNA, 21 nt, Homo sapiens
cuuuaacuuucagaggcaaua

SEQ ID NO: 1469712 - RNA, 19 nt, Homo sapiens
cuuuaagcagcgccaguga

SEQ ID NO: 1469713 - RNA, 21 nt, Homo sapiens
cuuuaagcagcgccagugaca

SEQ ID NO: 1469714 - RNA, 21 nt, Homo sapiens
cuuuaagggcaugccuugugc

SEQ ID NO: 1469715 - RNA, 15 nt, Homo sapiens
cuuuaaugcuuuuau

SEQ ID NO: 1469716 - RNA, 13 nt, Homo sapiens
cuuuaauucugua

SEQ ID NO: 1469717 - RNA, 19 nt, Homo sapiens
cuuuaauucuguaucugua

SEQ ID NO: 1469718 - RNA, 22 nt, Homo sapiens
cuuuacaaaagaaauaccuuga

SEQ ID NO: 1469719 - RNA, 15 nt, Homo sapiens
cuuuacaaauauguc

SEQ ID NO: 1469720 - RNA, 19 nt, Homo sapiens
cuuuacuguuagucauuug

SEQ ID NO: 1469721 - RNA, 11 nt, Homo sapiens
cuuuacuugac

SEQ ID NO: 1469722 - RNA, 19 nt, Homo sapiens
cuuuagagaaguauacaua

SEQ ID NO: 1469723 - RNA, 19 nt, Homo sapiens
cuuuagucucccacuaaaa

SEQ ID NO: 1469724 - RNA, 19 nt, Homo sapiens
cuuuauacacaguggauug

SEQ ID NO: 1469725 - RNA, 14 nt, Homo sapiens
cuuuaucuaaagaa

SEQ ID NO: 1469726 - RNA, 13 nt, Homo sapiens
cuuuaugcacauu

SEQ ID NO: 1469727 - RNA, 17 nt, Homo sapiens
cuuuaugguuucuccag

SEQ ID NO: 1469728 - RNA, 14 nt, Homo sapiens
cuuuauguaucucu

SEQ ID NO: 1469729 - RNA, 16 nt, Homo sapiens
cuuuauuucugaucua

SEQ ID NO: 1469730 - RNA, 22 nt, Homo sapiens
cuuucaagaagugccaguugau

SEQ ID NO: 1469731 - RNA, 13 nt, Homo sapiens
cuuuccaccaagc

SEQ ID NO: 1469732 - RNA, 15 nt, Homo sapiens
cuuucccagucccau

SEQ ID NO: 1469733 - RNA, 21 nt, Homo sapiens
cuuucccagucccauuccuca

SEQ ID NO: 1469734 - RNA, 16 nt, Homo sapiens
cuuuccccuaagcaga

SEQ ID NO: 1469735 - RNA, 14 nt, Homo sapiens
cuuuccuacucuca

SEQ ID NO: 1469736 - RNA, 11 nt, Homo sapiens
cuuuccuccac

SEQ ID NO: 1469737 - RNA, 20 nt, Homo sapiens
cuuuccucgccugacaacca

SEQ ID NO: 1469738 - RNA, 15 nt, Homo sapiens
cuuuccugcaacuca

SEQ ID NO: 1469739 - RNA, 22 nt, Homo sapiens
cuuuccugguuuucaucaggaa

SEQ ID NO: 1469740 - RNA, 13 nt, Homo sapiens
cuuucuaacaaaa

SEQ ID NO: 1469741 - RNA, 20 nt, Homo sapiens
cuuucuaaugcugauaugau

SEQ ID NO: 1469742 - RNA, 17 nt, Homo sapiens
cuuucuccaggaccaau

SEQ ID NO: 1469743 - RNA, 18 nt, Homo sapiens
cuuucucugccagugaca

SEQ ID NO: 1469744 - RNA, 20 nt, Homo sapiens
cuuucucugccagugacaga

SEQ ID NO: 1469745 - RNA, 16 nt, Homo sapiens
cuuucuguugucauug

SEQ ID NO: 1469746 - RNA, 19 nt, Homo sapiens
cuuucuucauuaagauuuu

SEQ ID NO: 1469747 - RNA, 11 nt, Homo sapiens
cuuucuugcag

SEQ ID NO: 1469748 - RNA, 14 nt, Homo sapiens
cuuugaauuuacug

SEQ ID NO: 1469749 - RNA, 13 nt, Homo sapiens
cuuugacugaugc

SEQ ID NO: 1469750 - RNA, 14 nt, Homo sapiens
cuuugaucaguaua

SEQ ID NO: 1469751 - RNA, 13 nt, Homo sapiens
cuuugcacugagg

SEQ ID NO: 1469752 - RNA, 21 nt, Homo sapiens
cuuugccagaggcugauguca

SEQ ID NO: 1469753 - RNA, 15 nt, Homo sapiens
cuuugccuuuaucuc

SEQ ID NO: 1469754 - RNA, 23 nt, Homo sapiens
cuuugcucuuacuacacugagga

SEQ ID NO: 1469755 - RNA, 15 nt, Homo sapiens
cuuugcugauuuccc

SEQ ID NO: 1469756 - RNA, 18 nt, Homo sapiens
cuuugcugcacuauuugc

SEQ ID NO: 1469757 - RNA, 17 nt, Homo sapiens
cuuugcugcagucaucu

SEQ ID NO: 1469758 - RNA, 12 nt, Homo sapiens
cuuugcugccag

SEQ ID NO: 1469759 - RNA, 14 nt, Homo sapiens
cuuugcugccugag

SEQ ID NO: 1469760 - RNA, 18 nt, Homo sapiens
cuuugcugcuggugcuaa

SEQ ID NO: 1469761 - RNA, 23 nt, Homo sapiens
cuuugcugugaggcuguccugua

SEQ ID NO: 1469762 - RNA, 20 nt, Homo sapiens
cuuuggauccugggucaaaa

SEQ ID NO: 1469763 - RNA, 19 nt, Homo sapiens
cuuugggccagacaugcca

SEQ ID NO: 1469764 - RNA, 20 nt, Homo sapiens
cuuugggccagacaugccac

SEQ ID NO: 1469765 - RNA, 15 nt, Homo sapiens
cuuuguaugcacuuu

SEQ ID NO: 1469766 - RNA, 17 nt, Homo sapiens
cuuugucccggggcucc

SEQ ID NO: 1469767 - RNA, 19 nt, Homo sapiens
cuuuguguagaaagccaaa

SEQ ID NO: 1469768 - RNA, 22 nt, Homo sapiens
cuuuguguuugcuuggugcugg

SEQ ID NO: 1469769 - RNA, 17 nt, Homo sapiens
cuuuguuacuuccuuau

SEQ ID NO: 1469770 - RNA, 20 nt, Homo sapiens
cuuuguugcaagaugugaau

SEQ ID NO: 1469771 - RNA, 14 nt, Homo sapiens
cuuuguuugucaca

SEQ ID NO: 1469772 - RNA, 17 nt, Homo sapiens
cuuuuaaggaaaggcaa

SEQ ID NO: 1469773 - RNA, 17 nt, Homo sapiens
cuuuuaaugcuucauuc

SEQ ID NO: 1469774 - RNA, 18 nt, Homo sapiens
cuuuuacaacugccucga

SEQ ID NO: 1469775 - RNA, 12 nt, Homo sapiens
cuuuuacauucu

SEQ ID NO: 1469776 - RNA, 21 nt, Homo sapiens
cuuuuacccggcacauucccc

SEQ ID NO: 1469777 - RNA, 21 nt, Homo sapiens
cuuuuaccuagccacuuaaua

SEQ ID NO: 1469778 - RNA, 17 nt, Homo sapiens
cuuuuacucugccuaca

SEQ ID NO: 1469779 - RNA, 23 nt, Homo sapiens
cuuuuauaggugagaaaaaaaca

SEQ ID NO: 1469780 - RNA, 14 nt, Homo sapiens
cuuuuaucugcaga

SEQ ID NO: 1469781 - RNA, 21 nt, Homo sapiens
cuuuuaugauauauauaugcu

SEQ ID NO: 1469782 - RNA, 13 nt, Homo sapiens
cuuuuauguagca

SEQ ID NO: 1469783 - RNA, 21 nt, Homo sapiens
cuuuuauguaguaauugacau

SEQ ID NO: 1469784 - RNA, 16 nt, Homo sapiens
cuuuuauuugcaacau

SEQ ID NO: 1469785 - RNA, 23 nt, Homo sapiens
cuuuuauuuuuuaagguaacaaa

SEQ ID NO: 1469786 - RNA, 14 nt, Homo sapiens
cuuuucaagcugcu

SEQ ID NO: 1469787 - RNA, 18 nt, Homo sapiens
cuuuucagaagcaagcca

SEQ ID NO: 1469788 - RNA, 17 nt, Homo sapiens
cuuuucaucuaauguga

SEQ ID NO: 1469789 - RNA, 15 nt, Homo sapiens
cuuuuccuuucugcc

SEQ ID NO: 1469790 - RNA, 13 nt, Homo sapiens
cuuuucucaggac

SEQ ID NO: 1469791 - RNA, 21 nt, Homo sapiens
cuuuucuggcaaaaaggagcc

SEQ ID NO: 1469792 - RNA, 23 nt, Homo sapiens
cuuuucuggccaaaagcaguaaa

SEQ ID NO: 1469793 - RNA, 17 nt, Homo sapiens
cuuuugagaaccaagua

SEQ ID NO: 1469794 - RNA, 21 nt, Homo sapiens
cuuuugaggggcugacuucaa

SEQ ID NO: 1469795 - RNA, 16 nt, Homo sapiens
cuuuugccaguauuau

SEQ ID NO: 1469796 - RNA, 18 nt, Homo sapiens
cuuuugcuugauccagaa

SEQ ID NO: 1469797 - RNA, 20 nt, Homo sapiens
cuuuugguagagaaggagca

SEQ ID NO: 1469798 - RNA, 18 nt, Homo sapiens
cuuuuggucccauccucu

SEQ ID NO: 1469799 - RNA, 13 nt, Homo sapiens
cuuuuguacugaa

SEQ ID NO: 1469800 - RNA, 14 nt, Homo sapiens
cuuuugucuaauua

SEQ ID NO: 1469801 - RNA, 17 nt, Homo sapiens
cuuuugugcaaagccaa

SEQ ID NO: 1469802 - RNA, 22 nt, Homo sapiens
cuuuugugcaaagccaaaaccu

SEQ ID NO: 1469803 - RNA, 16 nt, Homo sapiens
cuuuuuacaauuaaaa

SEQ ID NO: 1469804 - RNA, 16 nt, Homo sapiens
cuuuuuauuagagcuc

SEQ ID NO: 1469805 - RNA, 13 nt, Homo sapiens
cuuuuuccacaag

SEQ ID NO: 1469806 - RNA, 16 nt, Homo sapiens
cuuuuuccuccuggaa

SEQ ID NO: 1469807 - RNA, 18 nt, Homo sapiens
cuuuuuccuccuggaaca

SEQ ID NO: 1469808 - RNA, 22 nt, Homo sapiens
cuuuuucguguggaucuugcca

SEQ ID NO: 1469809 - RNA, 23 nt, Homo sapiens
cuuuuucguguggaucuugccac

SEQ ID NO: 1469810 - RNA, 14 nt, Homo sapiens
cuuuuugacacuga

SEQ ID NO: 1469811 - RNA, 13 nt, Homo sapiens
cuuuuuucauuuc

SEQ ID NO: 1469812 - RNA, 19 nt, Homo sapiens
gccucuucuuugugccuuu

SEQ ID NO: 1469813 - RNA, 20 nt, Homo sapiens
gccucuugucugagggacau

SEQ ID NO: 1469814 - RNA, 20 nt, Homo sapiens
gccucuuuuccccaugaacu

SEQ ID NO: 1469815 - RNA, 23 nt, Homo sapiens
gccugaaguuugugggggccaaa

SEQ ID NO: 1469816 - RNA, 18 nt, Homo sapiens
gccugagcgaguguccag

SEQ ID NO: 1469817 - RNA, 16 nt, Homo sapiens
gccugaggugugugcc

SEQ ID NO: 1469818 - RNA, 16 nt, Homo sapiens
gccugcacuaauuuga

SEQ ID NO: 1469819 - RNA, 21 nt, Homo sapiens
gccugcagcaggaguggugca

SEQ ID NO: 1469820 - RNA, 21 nt, Homo sapiens
gccugcaggagagagcagcac

SEQ ID NO: 1469821 - RNA, 15 nt, Homo sapiens
gccugcaucugugaa

SEQ ID NO: 1469822 - RNA, 22 nt, Homo sapiens
gccuggacuguuuucucucggc

SEQ ID NO: 1469823 - RNA, 15 nt, Homo sapiens
gccuggacuuuccug

SEQ ID NO: 1469824 - RNA, 19 nt, Homo sapiens
gccuggaucccugcccuuc

SEQ ID NO: 1469825 - RNA, 12 nt, Homo sapiens
gccuggcacuua

SEQ ID NO: 1469826 - RNA, 18 nt, Homo sapiens
gccuggcaggccaguguc

SEQ ID NO: 1469827 - RNA, 20 nt, Homo sapiens
gccuggccaggagcucuuca

SEQ ID NO: 1469828 - RNA, 15 nt, Homo sapiens
gccuggccucugccu

SEQ ID NO: 1469829 - RNA, 19 nt, Homo sapiens
gccuguaaucccagcacuu

SEQ ID NO: 1469830 - RNA, 19 nt, Homo sapiens
gccuguaaucccagcuacu

SEQ ID NO: 1469831 - RNA, 20 nt, Homo sapiens
gccuguaaucucagcacuuu

SEQ ID NO: 1469832 - RNA, 19 nt, Homo sapiens
gccugucccauggacacuc

SEQ ID NO: 1469833 - RNA, 22 nt, Homo sapiens
gccugugcgugccauccagagu

SEQ ID NO: 1469834 - RNA, 23 nt, Homo sapiens
gccuguggguuugguccuugaac

SEQ ID NO: 1469835 - RNA, 19 nt, Homo sapiens
gccugugguuaacaucuca

SEQ ID NO: 1469836 - RNA, 20 nt, Homo sapiens
gccugugguuacagugcaga

SEQ ID NO: 1469837 - RNA, 14 nt, Homo sapiens
gccuguugaaucug

SEQ ID NO: 1469838 - RNA, 22 nt, Homo sapiens
gccuguuugcuuagcauuccua

SEQ ID NO: 1469839 - RNA, 17 nt, Homo sapiens
gccuuaaacacucaccu

SEQ ID NO: 1469840 - RNA, 12 nt, Homo sapiens
gccuucacccau

SEQ ID NO: 1469841 - RNA, 21 nt, Homo sapiens
gccuucagaguacguccugcc

SEQ ID NO: 1469842 - RNA, 14 nt, Homo sapiens
gccuucaucuucac

SEQ ID NO: 1469843 - RNA, 21 nt, Homo sapiens
gccuucaucuucacugcaauu

SEQ ID NO: 1469844 - RNA, 23 nt, Homo sapiens
gccuucauggaacucagcugucu

SEQ ID NO: 1469845 - RNA, 19 nt, Homo sapiens
gccuuccagccacaucgcc

SEQ ID NO: 1469846 - RNA, 12 nt, Homo sapiens
gccuucucacca

SEQ ID NO: 1469847 - RNA, 15 nt, Homo sapiens
gccuucuucacccag

SEQ ID NO: 1469848 - RNA, 22 nt, Homo sapiens
gccuugacaucaguuccuuugu

SEQ ID NO: 1469849 - RNA, 16 nt, Homo sapiens
gccuugagcccuggcu

SEQ ID NO: 1469850 - RNA, 18 nt, Homo sapiens
gccuugccagagauccaa

SEQ ID NO: 1469851 - RNA, 21 nt, Homo sapiens
gccuugcuagcugaccuggag

SEQ ID NO: 1469852 - RNA, 19 nt, Homo sapiens
gccuuuaguucuccacugg

SEQ ID NO: 1469853 - RNA, 15 nt, Homo sapiens
gccuuuaucucugag

SEQ ID NO: 1469854 - RNA, 15 nt, Homo sapiens
gccuuuauggcugcu

SEQ ID NO: 1469855 - RNA, 19 nt, Homo sapiens
gccuuuccccccagagggc

SEQ ID NO: 1469856 - RNA, 12 nt, Homo sapiens
gccuuucuuugc

SEQ ID NO: 1469857 - RNA, 22 nt, Homo sapiens
gccuuuugcucacaaaaccugg

SEQ ID NO: 1469858 - RNA, 15 nt, Homo sapiens
gccuuuugugugaug

SEQ ID NO: 1469859 - RNA, 17 nt, Homo sapiens
gcgacccauucagagac

SEQ ID NO: 1469860 - RNA, 17 nt, Homo sapiens
gcgaccuccuuucauca

SEQ ID NO: 1469861 - RNA, 20 nt, Homo sapiens
gcgagagguggagugucaca

SEQ ID NO: 1469862 - RNA, 17 nt, Homo sapiens
gcgagucuuacuuugag

SEQ ID NO: 1469863 - RNA, 12 nt, Homo sapiens
gcgaugcucccu

SEQ ID NO: 1469864 - RNA, 14 nt, Homo sapiens
gcgcaucaggccug

SEQ ID NO: 1469865 - RNA, 16 nt, Homo sapiens
gcgcaugaaccuggac

SEQ ID NO: 1469866 - RNA, 16 nt, Homo sapiens
gcgccaggaagccaga

SEQ ID NO: 1469867 - RNA, 21 nt, Homo sapiens
gcgccaggauggaacacggcc

SEQ ID NO: 1469868 - RNA, 20 nt, Homo sapiens
gcgccaggcugaccacagca

SEQ ID NO: 1469869 - RNA, 14 nt, Homo sapiens
gcgccagugacagu

SEQ ID NO: 1469870 - RNA, 23 nt, Homo sapiens
gcgccccugccaccucccugacc

SEQ ID NO: 1469871 - RNA, 13 nt, Homo sapiens
gcgcuauuacaaa

SEQ ID NO: 1469872 - RNA, 15 nt, Homo sapiens
gcgcucccuugccuu

SEQ ID NO: 1469873 - RNA, 20 nt, Homo sapiens
gcgcugguggaccacaggca

SEQ ID NO: 1469874 - RNA, 13 nt, Homo sapiens
gcggccucuugcu

SEQ ID NO: 1469875 - RNA, 17 nt, Homo sapiens
gcggcggaaagccugua

SEQ ID NO: 1469876 - RNA, 13 nt, Homo sapiens
gcgggccaugagg

SEQ ID NO: 1469877 - RNA, 13 nt, Homo sapiens
gcgggcuugacug

SEQ ID NO: 1469878 - RNA, 17 nt, Homo sapiens
gcguaaacgacacucuc

SEQ ID NO: 1469879 - RNA, 22 nt, Homo sapiens
gcguaagaugauggauuugauu

SEQ ID NO: 1469880 - RNA, 21 nt, Homo sapiens
gcgugguauaaucuccauuuc

SEQ ID NO: 1469881 - RNA, 23 nt, Homo sapiens
gcguggugcucuuugcugcacua

SEQ ID NO: 1469882 - RNA, 22 nt, Homo sapiens
gcguucacuccaaugucugcug

SEQ ID NO: 1469883 - RNA, 13 nt, Homo sapiens
gcuaaaacugcuc

SEQ ID NO: 1469884 - RNA, 16 nt, Homo sapiens
gcuaaaggaagugaau

SEQ ID NO: 1469885 - RNA, 18 nt, Homo sapiens
gcuaaaggaagugaaucu

SEQ ID NO: 1469886 - RNA, 17 nt, Homo sapiens
gcuaaaggacaguggau

SEQ ID NO: 1469887 - RNA, 12 nt, Homo sapiens
gcuaaauuccac

SEQ ID NO: 1469888 - RNA, 20 nt, Homo sapiens
gcuaacuauauuugcuuuuu

SEQ ID NO: 1469889 - RNA, 20 nt, Homo sapiens
gcuaacugcuugaacccaga

SEQ ID NO: 1469890 - RNA, 21 nt, Homo sapiens
gcuaagauuuagagaugaauu

SEQ ID NO: 1469891 - RNA, 14 nt, Homo sapiens
gcuaauguaauaac

SEQ ID NO: 1469892 - RNA, 17 nt, Homo sapiens
gcuacagcuuucuugcu

SEQ ID NO: 1469893 - RNA, 19 nt, Homo sapiens
gcuacccugaguucaucca

SEQ ID NO: 1469894 - RNA, 21 nt, Homo sapiens
gcuacugaugaaaucugcuag

SEQ ID NO: 1469895 - RNA, 18 nt, Homo sapiens
gcuacuguaauuuuauau

SEQ ID NO: 1469896 - RNA, 19 nt, Homo sapiens
gcuagaacacuacagggga

SEQ ID NO: 1469897 - RNA, 20 nt, Homo sapiens
gcuagaaggcaaagugcaca

SEQ ID NO: 1469898 - RNA, 18 nt, Homo sapiens
gcuagcaguaaaagauga

SEQ ID NO: 1469899 - RNA, 15 nt, Homo sapiens
gcuagggaguggucu

SEQ ID NO: 1469900 - RNA, 20 nt, Homo sapiens
gcuaggguggcccuugcagu

SEQ ID NO: 1469901 - RNA, 16 nt, Homo sapiens
gcuagguaucauucaa

SEQ ID NO: 1469902 - RNA, 19 nt, Homo sapiens
gcuaguguaccuccucuca

SEQ ID NO: 1469903 - RNA, 13 nt, Homo sapiens
gcuauagcacaca

SEQ ID NO: 1469904 - RNA, 13 nt, Homo sapiens
gcuauauugcacu

SEQ ID NO: 1469905 - RNA, 17 nt, Homo sapiens
gcuaucgcaccacugug

SEQ ID NO: 1469906 - RNA, 11 nt, Homo sapiens
gcuaugaauga

SEQ ID NO: 1469907 - RNA, 20 nt, Homo sapiens
gcuaugcccggaccuccauc

SEQ ID NO: 1469908 - RNA, 16 nt, Homo sapiens
gcuauugccaaccagu

SEQ ID NO: 1469909 - RNA, 13 nt, Homo sapiens
gcuauugcugcug

SEQ ID NO: 1469910 - RNA, 14 nt, Homo sapiens
gcuauuuaugcaag

SEQ ID NO: 1469911 - RNA, 19 nt, Homo sapiens
gcuauuuauuaaguauuuu

SEQ ID NO: 1469912 - RNA, 22 nt, Homo sapiens
gcuauuugaaauacuaaaagca

SEQ ID NO: 1469913 - RNA, 22 nt, Homo sapiens
gcuauuuuuuauuuuacuuuua

SEQ ID NO: 1469914 - RNA, 22 nt, Homo sapiens
ggaaacugcucccaucauuccu

SEQ ID NO: 1469915 - RNA, 16 nt, Homo sapiens
ggaaacuucaguugau

SEQ ID NO: 1469916 - RNA, 21 nt, Homo sapiens
ggaaagacaugcagcuuucau

SEQ ID NO: 1469917 - RNA, 22 nt, Homo sapiens
ggaaagacguuuuugugcugug

SEQ ID NO: 1469918 - RNA, 16 nt, Homo sapiens
ggaaagaugaucagcu

SEQ ID NO: 1469919 - RNA, 18 nt, Homo sapiens
ggaaaguaaauauuucag

SEQ ID NO: 1469920 - RNA, 23 nt, Homo sapiens
ggaaaguaaauauuucaggcaua

SEQ ID NO: 1469921 - RNA, 14 nt, Homo sapiens
ggaaauacacuguu

SEQ ID NO: 1469922 - RNA, 18 nt, Homo sapiens
ggaaauccccuuaugacu

SEQ ID NO: 1469923 - RNA, 12 nt, Homo sapiens
ggaacaauccau

SEQ ID NO: 1469924 - RNA, 13 nt, Homo sapiens
ggaacacacuugg

SEQ ID NO: 1469925 - RNA, 14 nt, Homo sapiens
ggaacacggccaca

SEQ ID NO: 1469926 - RNA, 23 nt, Homo sapiens
ggaacacggccacaucaaagagg

SEQ ID NO: 1469927 - RNA, 18 nt, Homo sapiens
ggaacacugcacucuuaa

SEQ ID NO: 1469928 - RNA, 18 nt, Homo sapiens
ggaacagaaggaugaaug

SEQ ID NO: 1469929 - RNA, 13 nt, Homo sapiens
ggaacagaauguu

SEQ ID NO: 1469930 - RNA, 18 nt, Homo sapiens
ggaacagacaacagaagu

SEQ ID NO: 1469931 - RNA, 23 nt, Homo sapiens
ggaacagcacuggggagucuuug

SEQ ID NO: 1469932 - RNA, 20 nt, Homo sapiens
ggaacauauagaaugcagag

SEQ ID NO: 1469933 - RNA, 22 nt, Homo sapiens
ggaacauguaaaacaguuacaa

SEQ ID NO: 1469934 - RNA, 12 nt, Homo sapiens
ggaacauuucag

SEQ ID NO: 1469935 - RNA, 13 nt, Homo sapiens
ggaaccaugaaga

SEQ ID NO: 1469936 - RNA, 20 nt, Homo sapiens
ggaaccucagccuggccaga

SEQ ID NO: 1469937 - RNA, 17 nt, Homo sapiens
ggaaccuguccuaagga

SEQ ID NO: 1469938 - RNA, 15 nt, Homo sapiens
ggaacuaaagcaaau

SEQ ID NO: 1469939 - RNA, 13 nt, Homo sapiens
ggaacucucucca

SEQ ID NO: 1469940 - RNA, 17 nt, Homo sapiens
ggaacugcccuacuggg

SEQ ID NO: 1469941 - RNA, 19 nt, Homo sapiens
ggaagaaaagcugccauuu

SEQ ID NO: 1469942 - RNA, 21 nt, Homo sapiens
ggaagaacuacagcucuuaaa

SEQ ID NO: 1469943 - RNA, 17 nt, Homo sapiens
ggaagaagauagaucca

SEQ ID NO: 1469944 - RNA, 18 nt, Homo sapiens
ggaagaagauagauccaa

SEQ ID NO: 1469945 - RNA, 15 nt, Homo sapiens
ggaagagcauuagcu

SEQ ID NO: 1469946 - RNA, 20 nt, Homo sapiens
ggaagagcuaggcagggugu

SEQ ID NO: 1469947 - RNA, 15 nt, Homo sapiens
ggaagaugaaagagg

SEQ ID NO: 1469948 - RNA, 11 nt, Homo sapiens
ggaagccagag

SEQ ID NO: 1469949 - RNA, 15 nt, Homo sapiens
ggaagccaggugagc

SEQ ID NO: 1469950 - RNA, 22 nt, Homo sapiens
ggaagccccauccaacacugga

SEQ ID NO: 1469951 - RNA, 22 nt, Homo sapiens
ggaaggaaaugacaccaaauau

SEQ ID NO: 1469952 - RNA, 17 nt, Homo sapiens
ggaaggacauccauguu

SEQ ID NO: 1469953 - RNA, 14 nt, Homo sapiens
ggaaggagugagau

SEQ ID NO: 1469954 - RNA, 17 nt, Homo sapiens
ggaaggcuucuguguca

SEQ ID NO: 1469955 - RNA, 11 nt, Homo sapiens
ggaagggucaa

SEQ ID NO: 1469956 - RNA, 22 nt, Homo sapiens
ggaagguagcccagcacuguga

SEQ ID NO: 1469957 - RNA, 15 nt, Homo sapiens
ggaagucuccaugaa

SEQ ID NO: 1469958 - RNA, 15 nt, Homo sapiens
ggaaguguaacagcu

SEQ ID NO: 1469959 - RNA, 12 nt, Homo sapiens
ggaaguuuucag

SEQ ID NO: 1469960 - RNA, 16 nt, Homo sapiens
ggaaguuuuccuacac

SEQ ID NO: 1469961 - RNA, 14 nt, Homo sapiens
ggaauaaccuucca

SEQ ID NO: 1469962 - RNA, 16 nt, Homo sapiens
ggaauagugaauacuu

SEQ ID NO: 1469963 - RNA, 23 nt, Homo sapiens
ggaaucagaacucaaauggggcc

SEQ ID NO: 1469964 - RNA, 15 nt, Homo sapiens
ggaaucccacuguau

SEQ ID NO: 1469965 - RNA, 19 nt, Homo sapiens
ggaaugcuuuccaucucca

SEQ ID NO: 1469966 - RNA, 21 nt, Homo sapiens
ggaauuacaaaacucagagaa

SEQ ID NO: 1469967 - RNA, 13 nt, Homo sapiens
ggaauugcucaga

SEQ ID NO: 1469968 - RNA, 19 nt, Homo sapiens
ggacaaagaaauuccccaa

SEQ ID NO: 1469969 - RNA, 15 nt, Homo sapiens
ggacaaaugaugcca

SEQ ID NO: 1469970 - RNA, 17 nt, Homo sapiens
ggacaaaugaugccaug

SEQ ID NO: 1469971 - RNA, 20 nt, Homo sapiens
ggacaaaugaugccauggca

SEQ ID NO: 1469972 - RNA, 17 nt, Homo sapiens
ggacaagacaaaccaag

SEQ ID NO: 1469973 - RNA, 18 nt, Homo sapiens
ggacaagagguacagggu

SEQ ID NO: 1469974 - RNA, 18 nt, Homo sapiens
ggacaauuaucuguguca

SEQ ID NO: 1469975 - RNA, 23 nt, Homo sapiens
ggacagaaagagacuccgucuca

SEQ ID NO: 1469976 - RNA, 15 nt, Homo sapiens
ggacagaccacagag

SEQ ID NO: 1469977 - RNA, 18 nt, Homo sapiens
ggacaguggauuguuuau

SEQ ID NO: 1469978 - RNA, 13 nt, Homo sapiens
ggacauaucagug

SEQ ID NO: 1469979 - RNA, 17 nt, Homo sapiens
ggacauuuaaaauucaa

SEQ ID NO: 1469980 - RNA, 17 nt, Homo sapiens
ggacauuugaacauguu

SEQ ID NO: 1469981 - RNA, 14 nt, Homo sapiens
ggaccacaguaaca

SEQ ID NO: 1469982 - RNA, 22 nt, Homo sapiens
ggaccagagccagaugcaggac

SEQ ID NO: 1469983 - RNA, 22 nt, Homo sapiens
ggaccaggacuauagcccaggu

SEQ ID NO: 1469984 - RNA, 12 nt, Homo sapiens
ggaccagggaug

SEQ ID NO: 1469985 - RNA, 14 nt, Homo sapiens
ggacccggauguga

SEQ ID NO: 1469986 - RNA, 18 nt, Homo sapiens
ggacccugagaagccagu

SEQ ID NO: 1469987 - RNA, 23 nt, Homo sapiens
ggaccgcugauaagcauugacuu

SEQ ID NO: 1469988 - RNA, 14 nt, Homo sapiens
ggaccucaguuuua

SEQ ID NO: 1469989 - RNA, 21 nt, Homo sapiens
ggaccugccccccacucugca

SEQ ID NO: 1469990 - RNA, 22 nt, Homo sapiens
ggaccugccccccacucugcac

SEQ ID NO: 1469991 - RNA, 19 nt, Homo sapiens
ggacgagacccuacaggag

SEQ ID NO: 1469992 - RNA, 21 nt, Homo sapiens
ggacgaggaguaauggcauuu

SEQ ID NO: 1469993 - RNA, 22 nt, Homo sapiens
ggacgauagcuuggagggaugg

SEQ ID NO: 1469994 - RNA, 15 nt, Homo sapiens
ggacggcaggcucac

SEQ ID NO: 1469995 - RNA, 13 nt, Homo sapiens
ggacuacaaccaa

SEQ ID NO: 1469996 - RNA, 19 nt, Homo sapiens
ggacuacaccaggguccug

SEQ ID NO: 1469997 - RNA, 14 nt, Homo sapiens
ggacuaccaagcug

SEQ ID NO: 1469998 - RNA, 23 nt, Homo sapiens
ggacuaucaacaccacuaggaau

SEQ ID NO: 1469999 - RNA, 17 nt, Homo sapiens
ggacucaaucuacaggc

SEQ ID NO: 1470000 - RNA, 23 nt, Homo sapiens
ggacucagguugucugaagucac

SEQ ID NO: 1470001 - RNA, 17 nt, Homo sapiens
ggacucaucaaagccuu

SEQ ID NO: 1470002 - RNA, 22 nt, Homo sapiens
ggacuccaucucucauccucca

SEQ ID NO: 1470003 - RNA, 23 nt, Homo sapiens
ggacuccaucucucauccuccag

SEQ ID NO: 1470004 - RNA, 16 nt, Homo sapiens
ggacucucagggauuc

SEQ ID NO: 1470005 - RNA, 16 nt, Homo sapiens
ggacucugcaucccag

SEQ ID NO: 1470006 - RNA, 20 nt, Homo sapiens
ggacuggaaggggaagggac

SEQ ID NO: 1470007 - RNA, 14 nt, Homo sapiens
ggacuggggggcca

SEQ ID NO: 1470008 - RNA, 15 nt, Homo sapiens
ggacuguaagggauu

SEQ ID NO: 1470009 - RNA, 17 nt, Homo sapiens
ggacuguugaugccuuu

SEQ ID NO: 1470010 - RNA, 16 nt, Homo sapiens
ggacuuuccugcaacu

SEQ ID NO: 1470011 - RNA, 17 nt, Homo sapiens
ggacuuuugaaaagcuu

SEQ ID NO: 1470012 - RNA, 16 nt, Homo sapiens
ggagaaaauucaauug

SEQ ID NO: 1470013 - RNA, 12 nt, Homo sapiens
ggagaacuacuu

SEQ ID NO: 1470014 - RNA, 13 nt, Homo sapiens
ggagaacuagaga

SEQ ID NO: 1470015 - RNA, 19 nt, Homo sapiens
ggagaaugaauacugggaa

SEQ ID NO: 1470016 - RNA, 19 nt, Homo sapiens
ggagacacuggccccucaa

SEQ ID NO: 1470017 - RNA, 12 nt, Homo sapiens
ggggccaccauc

SEQ ID NO: 1470018 - RNA, 20 nt, Homo sapiens
ggggccaccaucccugaugg

SEQ ID NO: 1470019 - RNA, 15 nt, Homo sapiens
ggggccagauccagc

SEQ ID NO: 1470020 - RNA, 22 nt, Homo sapiens
ggggcccaaauucuuucagugg

SEQ ID NO: 1470021 - RNA, 18 nt, Homo sapiens
ggggcgagcacugugagc

SEQ ID NO: 1470022 - RNA, 16 nt, Homo sapiens
ggggcucucagcucag

SEQ ID NO: 1470023 - RNA, 22 nt, Homo sapiens
ggggcuggccucuggcucucau

SEQ ID NO: 1470024 - RNA, 14 nt, Homo sapiens
ggggucugagcaug

SEQ ID NO: 1470025 - RNA, 17 nt, Homo sapiens
ggggugaaucuugucua

SEQ ID NO: 1470026 - RNA, 15 nt, Homo sapiens
gggguggggagcaug

SEQ ID NO: 1470027 - RNA, 19 nt, Homo sapiens
ggguauuuaccacagcagc

SEQ ID NO: 1470028 - RNA, 22 nt, Homo sapiens
gggucaaguacaccagccaccu

SEQ ID NO: 1470029 - RNA, 21 nt, Homo sapiens
gggucucgcuuuguugcccag

SEQ ID NO: 1470030 - RNA, 22 nt, Homo sapiens
gggugagcuccagcugcugcgc

SEQ ID NO: 1470031 - RNA, 13 nt, Homo sapiens
gggugggggugga

SEQ ID NO: 1470032 - RNA, 14 nt, Homo sapiens
gggugguacccucu

SEQ ID NO: 1470033 - RNA, 17 nt, Homo sapiens
gggugguggaaggcagc

SEQ ID NO: 1470034 - RNA, 14 nt, Homo sapiens
ggguuaagucuccu

SEQ ID NO: 1470035 - RNA, 12 nt, Homo sapiens
ggguuuugcucu

SEQ ID NO: 1470036 - RNA, 23 nt, Homo sapiens
ggguuuuuguucuggaagccaua

SEQ ID NO: 1470037 - RNA, 18 nt, Homo sapiens
gguaaauuuuuaggcaaa

SEQ ID NO: 1470038 - RNA, 21 nt, Homo sapiens
gguaauauugacuuguauauu

SEQ ID NO: 1470039 - RNA, 14 nt, Homo sapiens
gguacuuaaagcuu

SEQ ID NO: 1470040 - RNA, 16 nt, Homo sapiens
gguagagaaggagcag

SEQ ID NO: 1470041 - RNA, 19 nt, Homo sapiens
gguaguacuccugcaaaau

SEQ ID NO: 1470042 - RNA, 19 nt, Homo sapiens
gguagugaccuaaccacuu

SEQ ID NO: 1470043 - RNA, 14 nt, Homo sapiens
gguauuauucuguu

SEQ ID NO: 1470044 - RNA, 15 nt, Homo sapiens
ggucaaaggcucaaa

SEQ ID NO: 1470045 - RNA, 15 nt, Homo sapiens
ggucaagaaacagcc

SEQ ID NO: 1470046 - RNA, 22 nt, Homo sapiens
ggucaggaacaguggcugggug

SEQ ID NO: 1470047 - RNA, 15 nt, Homo sapiens
ggucaggcagggugc

SEQ ID NO: 1470048 - RNA, 22 nt, Homo sapiens
ggucaggcggggugcuguggug

SEQ ID NO: 1470049 - RNA, 13 nt, Homo sapiens
ggucauacaugca

SEQ ID NO: 1470050 - RNA, 15 nt, Homo sapiens
ggucauacaugcaua

SEQ ID NO: 1470051 - RNA, 13 nt, Homo sapiens
ggucauugugaau

SEQ ID NO: 1470052 - RNA, 11 nt, Homo sapiens
gguccacagag

SEQ ID NO: 1470053 - RNA, 18 nt, Homo sapiens
gguccacccagcaaagag

SEQ ID NO: 1470054 - RNA, 20 nt, Homo sapiens
ggucccauuucucacugaga

SEQ ID NO: 1470055 - RNA, 21 nt, Homo sapiens
ggucccugaggaugggucaga

SEQ ID NO: 1470056 - RNA, 18 nt, Homo sapiens
gguccuggacaaaggagu

SEQ ID NO: 1470057 - RNA, 15 nt, Homo sapiens
gguccuggcuccuga

SEQ ID NO: 1470058 - RNA, 20 nt, Homo sapiens
gguccuucccucucaugacu

SEQ ID NO: 1470059 - RNA, 22 nt, Homo sapiens
gguccuugcaccccucacucug

SEQ ID NO: 1470060 - RNA, 16 nt, Homo sapiens
ggucucauguccugcu

SEQ ID NO: 1470061 - RNA, 17 nt, Homo sapiens
ggucucccgauucccaa

SEQ ID NO: 1470062 - RNA, 18 nt, Homo sapiens
ggucugauauuaaucaaa

SEQ ID NO: 1470063 - RNA, 16 nt, Homo sapiens
ggucuggccacugucc

SEQ ID NO: 1470064 - RNA, 23 nt, Homo sapiens
ggucuguuguaggguugccagau

SEQ ID NO: 1470065 - RNA, 15 nt, Homo sapiens
ggucuucccuaccuc

SEQ ID NO: 1470066 - RNA, 20 nt, Homo sapiens
ggucuuugcaagaaucauua

SEQ ID NO: 1470067 - RNA, 22 nt, Homo sapiens
ggugaaacuaacagauaagcaa

SEQ ID NO: 1470068 - RNA, 14 nt, Homo sapiens
ggugaaagugcagu

SEQ ID NO: 1470069 - RNA, 20 nt, Homo sapiens
ggugaaccuuaguaccuaaa

SEQ ID NO: 1470070 - RNA, 16 nt, Homo sapiens
ggugaggguuggcgcu

SEQ ID NO: 1470071 - RNA, 15 nt, Homo sapiens
ggugauagguaaauu

SEQ ID NO: 1470072 - RNA, 19 nt, Homo sapiens
ggugaucaauuaaauguag

SEQ ID NO: 1470073 - RNA, 14 nt, Homo sapiens
ggugcaaaucaaug

SEQ ID NO: 1470074 - RNA, 17 nt, Homo sapiens
ggugcaguaucaugccc

SEQ ID NO: 1470075 - RNA, 18 nt, Homo sapiens
ggugcaguugacagcagg

SEQ ID NO: 1470076 - RNA, 21 nt, Homo sapiens
ggugcaugauaagagcaucuc

SEQ ID NO: 1470077 - RNA, 15 nt, Homo sapiens
ggugcaugaugcugc

SEQ ID NO: 1470078 - RNA, 13 nt, Homo sapiens
ggugcccacaggc

SEQ ID NO: 1470079 - RNA, 19 nt, Homo sapiens
ggugcgcccugucucugug

SEQ ID NO: 1470080 - RNA, 16 nt, Homo sapiens
ggugcucuuugcugca

SEQ ID NO: 1470081 - RNA, 18 nt, Homo sapiens
ggugcucuuugcugcacu

SEQ ID NO: 1470082 - RNA, 15 nt, Homo sapiens
gguggaacaagcaca

SEQ ID NO: 1470083 - RNA, 16 nt, Homo sapiens
gguggaagaccuggac

SEQ ID NO: 1470084 - RNA, 12 nt, Homo sapiens
gguggcaauaaa

SEQ ID NO: 1470085 - RNA, 19 nt, Homo sapiens
gguggcacucaacucugag

SEQ ID NO: 1470086 - RNA, 16 nt, Homo sapiens
gguggcaggugccuug

SEQ ID NO: 1470087 - RNA, 17 nt, Homo sapiens
gguggcccuugcaguuc

SEQ ID NO: 1470088 - RNA, 14 nt, Homo sapiens
gguggcucaugccu

SEQ ID NO: 1470089 - RNA, 16 nt, Homo sapiens
gguggcucuccaguua

SEQ ID NO: 1470090 - RNA, 21 nt, Homo sapiens
gguggggggugcaggugggca

SEQ ID NO: 1470091 - RNA, 15 nt, Homo sapiens
ggugguaugugacac

SEQ ID NO: 1470092 - RNA, 15 nt, Homo sapiens
gguggucugaauguu

SEQ ID NO: 1470093 - RNA, 16 nt, Homo sapiens
ggugguuuuugcucuc

SEQ ID NO: 1470094 - RNA, 19 nt, Homo sapiens
gguguacacuaacauuucc

SEQ ID NO: 1470095 - RNA, 23 nt, Homo sapiens
gguguacuuauauccacacugca

SEQ ID NO: 1470096 - RNA, 20 nt, Homo sapiens
gguguagccagguauggcuc

SEQ ID NO: 1470097 - RNA, 11 nt, Homo sapiens
ggugucauauu

SEQ ID NO: 1470098 - RNA, 13 nt, Homo sapiens
gguguggccucag

SEQ ID NO: 1470099 - RNA, 20 nt, Homo sapiens
gguuaaacccacagccaaac

SEQ ID NO: 1470100 - RNA, 14 nt, Homo sapiens
gguuaaauuugaau

SEQ ID NO: 1470101 - RNA, 18 nt, Homo sapiens
gguuacaaucauugcuga

SEQ ID NO: 1470102 - RNA, 21 nt, Homo sapiens
gguucaauuucagaaguaaug

SEQ ID NO: 1470103 - RNA, 20 nt, Homo sapiens
gguucagacaccuguucaca

SEQ ID NO: 1470104 - RNA, 15 nt, Homo sapiens
gguucagcugaagcu

SEQ ID NO: 1470105 - RNA, 13 nt, Homo sapiens
gguucugcugagg

SEQ ID NO: 1470106 - RNA, 16 nt, Homo sapiens
gguucuucagggccag

SEQ ID NO: 1470107 - RNA, 23 nt, Homo sapiens
gguugaaaaaauagauccaauca

SEQ ID NO: 1470108 - RNA, 20 nt, Homo sapiens
gguugaacucugguggcaca

SEQ ID NO: 1470109 - RNA, 19 nt, Homo sapiens
gguuggacuguaagggauu

SEQ ID NO: 1470110 - RNA, 19 nt, Homo sapiens
gguuggaugggagugggca

SEQ ID NO: 1470111 - RNA, 21 nt, Homo sapiens
gguuggcaccugcacacucca

SEQ ID NO: 1470112 - RNA, 16 nt, Homo sapiens
gguugugcacauuucu

SEQ ID NO: 1470113 - RNA, 15 nt, Homo sapiens
gguuguuucuguucc

SEQ ID NO: 1470114 - RNA, 19 nt, Homo sapiens
gguuucacuauguugccua

SEQ ID NO: 1470115 - RNA, 23 nt, Homo sapiens
gguuuccgaaggguuuugcuaca

SEQ ID NO: 1470116 - RNA, 17 nt, Homo sapiens
gguuucucucccuccuu

SEQ ID NO: 1470117 - RNA, 18 nt, Homo sapiens
gguuuguugcagccaaag

SEQ ID NO: 1470118 - RNA, 20 nt, Homo sapiens
gguuuuaaccgcacaugcac

SEQ ID NO: 1470119 - RNA, 18 nt, Homo sapiens
gguuuuauaaaagccuug

SEQ ID NO: 1470120 - RNA, 18 nt, Homo sapiens
guucauuauuuugugguu

SEQ ID NO: 1470121 - RNA, 16 nt, Homo sapiens
guuccaagacauuguc

SEQ ID NO: 1470122 - RNA, 17 nt, Homo sapiens
guuccaaugucaaugug

SEQ ID NO: 1470123 - RNA, 19 nt, Homo sapiens
guuccaaugucaaugugaa

SEQ ID NO: 1470124 - RNA, 13 nt, Homo sapiens
guuccaggccuga

SEQ ID NO: 1470125 - RNA, 17 nt, Homo sapiens
guuccaugaagaccaca

SEQ ID NO: 1470126 - RNA, 14 nt, Homo sapiens
guuccccacugaca

SEQ ID NO: 1470127 - RNA, 15 nt, Homo sapiens
guucccuguucuucc

SEQ ID NO: 1470128 - RNA, 18 nt, Homo sapiens
guucccuuacuguuucac

SEQ ID NO: 1470129 - RNA, 15 nt, Homo sapiens
guuccgagaagaaca

SEQ ID NO: 1470130 - RNA, 21 nt, Homo sapiens
guuccuauuuggggcuugcau

SEQ ID NO: 1470131 - RNA, 14 nt, Homo sapiens
guuccuccuacuua

SEQ ID NO: 1470132 - RNA, 18 nt, Homo sapiens
guuccucuuggugucaua

SEQ ID NO: 1470133 - RNA, 16 nt, Homo sapiens
guucuaacauguaauu

SEQ ID NO: 1470134 - RNA, 16 nt, Homo sapiens
guucuaaccacuucag

SEQ ID NO: 1470135 - RNA, 23 nt, Homo sapiens
guucuacuauggcugaguucugg

SEQ ID NO: 1470136 - RNA, 21 nt, Homo sapiens
guucuaucaggggugcauucu

SEQ ID NO: 1470137 - RNA, 23 nt, Homo sapiens
guucucaaaguuaauucaccuau

SEQ ID NO: 1470138 - RNA, 23 nt, Homo sapiens
guucucacaccaacagugugaag

SEQ ID NO: 1470139 - RNA, 19 nt, Homo sapiens
guucucagguguugccaaa

SEQ ID NO: 1470140 - RNA, 20 nt, Homo sapiens
guucucagguguugccaaau

SEQ ID NO: 1470141 - RNA, 21 nt, Homo sapiens
guucucauuuuuaucccauug

SEQ ID NO: 1470142 - RNA, 22 nt, Homo sapiens
guucucauuuuuaucccauuga

SEQ ID NO: 1470143 - RNA, 17 nt, Homo sapiens
guucugagaccagugua

SEQ ID NO: 1470144 - RNA, 14 nt, Homo sapiens
guucugaguguuuu

SEQ ID NO: 1470145 - RNA, 18 nt, Homo sapiens
guucuucaccuccugcca

SEQ ID NO: 1470146 - RNA, 15 nt, Homo sapiens
guucuucagggccag

SEQ ID NO: 1470147 - RNA, 19 nt, Homo sapiens
guucuucagggccaguccu

SEQ ID NO: 1470148 - RNA, 13 nt, Homo sapiens
guucuugggauac

SEQ ID NO: 1470149 - RNA, 22 nt, Homo sapiens
guugaaaccaccgugaaccaga

SEQ ID NO: 1470150 - RNA, 14 nt, Homo sapiens
guugaauaaaugaa

SEQ ID NO: 1470151 - RNA, 19 nt, Homo sapiens
guugacuuauaguacauga

SEQ ID NO: 1470152 - RNA, 22 nt, Homo sapiens
guugagcuucauauaccagcaa

SEQ ID NO: 1470153 - RNA, 22 nt, Homo sapiens
guugaucuggaacccagacuca

SEQ ID NO: 1470154 - RNA, 11 nt, Homo sapiens
guugauuuucu

SEQ ID NO: 1470155 - RNA, 20 nt, Homo sapiens
guugccacaguagaacuguc

SEQ ID NO: 1470156 - RNA, 20 nt, Homo sapiens
guugccaccauguauucauc

SEQ ID NO: 1470157 - RNA, 16 nt, Homo sapiens
guugcgcgccugcucc

SEQ ID NO: 1470158 - RNA, 12 nt, Homo sapiens
guugcuauaaua

SEQ ID NO: 1470159 - RNA, 14 nt, Homo sapiens
guuggaacauuuca

SEQ ID NO: 1470160 - RNA, 23 nt, Homo sapiens
guuggaaccguguccagcacaga

SEQ ID NO: 1470161 - RNA, 16 nt, Homo sapiens
guuggaugaugagcag

SEQ ID NO: 1470162 - RNA, 14 nt, Homo sapiens
guuggggugacagu

SEQ ID NO: 1470163 - RNA, 16 nt, Homo sapiens
guuggugaauuucaca

SEQ ID NO: 1470164 - RNA, 20 nt, Homo sapiens
guuggugaauuucacaagcu

SEQ ID NO: 1470165 - RNA, 16 nt, Homo sapiens
guuggugacaccucac

SEQ ID NO: 1470166 - RNA, 21 nt, Homo sapiens
guugguuguuuuuuccuuugc

SEQ ID NO: 1470167 - RNA, 18 nt, Homo sapiens
guuguaaccugcugugau

SEQ ID NO: 1470168 - RNA, 21 nt, Homo sapiens
guuguaguuaccuacugagua

SEQ ID NO: 1470169 - RNA, 13 nt, Homo sapiens
guuuaacugaaag

SEQ ID NO: 1470170 - RNA, 19 nt, Homo sapiens
guuuaauggguaugcucag

SEQ ID NO: 1470171 - RNA, 15 nt, Homo sapiens
guuuacagugaugcc

SEQ ID NO: 1470172 - RNA, 15 nt, Homo sapiens
guuuagcagaacuca

SEQ ID NO: 1470173 - RNA, 23 nt, Homo sapiens
guuuagccaaaggauaagugucc

SEQ ID NO: 1470174 - RNA, 14 nt, Homo sapiens
guuuaugagccaga

SEQ ID NO: 1470175 - RNA, 19 nt, Homo sapiens
guuuauggccacauuuaau

SEQ ID NO: 1470176 - RNA, 18 nt, Homo sapiens
guuuauuauaaacuguau

SEQ ID NO: 1470177 - RNA, 19 nt, Homo sapiens
guuuauuuuuauacuuuca

SEQ ID NO: 1470178 - RNA, 17 nt, Homo sapiens
guuucaaaaaaucugac

SEQ ID NO: 1470179 - RNA, 17 nt, Homo sapiens
guuucaacugugcucuu

SEQ ID NO: 1470180 - RNA, 17 nt, Homo sapiens
guuucacacuagucaca

SEQ ID NO: 1470181 - RNA, 18 nt, Homo sapiens
guuucacacuagucacau

SEQ ID NO: 1470182 - RNA, 18 nt, Homo sapiens
guuucauaucuggucaag

SEQ ID NO: 1470183 - RNA, 14 nt, Homo sapiens
guuucaugaaauga

SEQ ID NO: 1470184 - RNA, 20 nt, Homo sapiens
guuucauuuagucaugugac

SEQ ID NO: 1470185 - RNA, 21 nt, Homo sapiens
guuucauuuagucaugugacc

SEQ ID NO: 1470186 - RNA, 16 nt, Homo sapiens
guuuccagccugcuag

SEQ ID NO: 1470187 - RNA, 21 nt, Homo sapiens
guuucccaucagacugucaag

SEQ ID NO: 1470188 - RNA, 23 nt, Homo sapiens
guuuccgaaggguuuugcuacau

SEQ ID NO: 1470189 - RNA, 16 nt, Homo sapiens
guuuccucauuccuga

SEQ ID NO: 1470190 - RNA, 17 nt, Homo sapiens
guuucuccaaguacuuu

SEQ ID NO: 1470191 - RNA, 17 nt, Homo sapiens
guuucugauaccacugc

SEQ ID NO: 1470192 - RNA, 15 nt, Homo sapiens
guuucuuccacaaca

SEQ ID NO: 1470193 - RNA, 23 nt, Homo sapiens
guuucuuucuaguggucuuugua

SEQ ID NO: 1470194 - RNA, 21 nt, Homo sapiens
guuugaaaauauuuuguugcc

SEQ ID NO: 1470195 - RNA, 15 nt, Homo sapiens
guuugaacucuguaa

SEQ ID NO: 1470196 - RNA, 20 nt, Homo sapiens
guuugaaggaggugagggau

SEQ ID NO: 1470197 - RNA, 20 nt, Homo sapiens
guuugaguuuuuccucccag

SEQ ID NO: 1470198 - RNA, 18 nt, Homo sapiens
guuugauaccugcacugu

SEQ ID NO: 1470199 - RNA, 22 nt, Homo sapiens
guuugauaccugcacuguccug

SEQ ID NO: 1470200 - RNA, 16 nt, Homo sapiens
guuugcuuagcauucc

SEQ ID NO: 1470201 - RNA, 23 nt, Homo sapiens
guuuggccgggugcgguggcuca

SEQ ID NO: 1470202 - RNA, 13 nt, Homo sapiens
guuuggggagcag

SEQ ID NO: 1470203 - RNA, 21 nt, Homo sapiens
guuugguaguuagccaucuaa

SEQ ID NO: 1470204 - RNA, 14 nt, Homo sapiens
guuuguaaauaaga

SEQ ID NO: 1470205 - RNA, 11 nt, Homo sapiens
guuuguuaaaa

SEQ ID NO: 1470206 - RNA, 11 nt, Homo sapiens
guuuguuguuu

SEQ ID NO: 1470207 - RNA, 21 nt, Homo sapiens
guuuguuucaagaaccuggaa

SEQ ID NO: 1470208 - RNA, 14 nt, Homo sapiens
guuuuaaauugaua

SEQ ID NO: 1470209 - RNA, 17 nt, Homo sapiens
guuuuaacaguucacuu

SEQ ID NO: 1470210 - RNA, 18 nt, Homo sapiens
guuuuacaaugucauaua

SEQ ID NO: 1470211 - RNA, 20 nt, Homo sapiens
guuuuacauuguugagcuau

SEQ ID NO: 1470212 - RNA, 17 nt, Homo sapiens
guuuuauaaaagccuug

SEQ ID NO: 1470213 - RNA, 14 nt, Homo sapiens
guuuucaagucaaa

SEQ ID NO: 1470214 - RNA, 13 nt, Homo sapiens
guuuucugacuaa

SEQ ID NO: 1470215 - RNA, 16 nt, Homo sapiens
guuuugucaaacugua

SEQ ID NO: 1470216 - RNA, 15 nt, Homo sapiens
guuuuuaagcuguuu

SEQ ID NO: 1470217 - RNA, 22 nt, Homo sapiens
guuuuucuucaacaucaauguu

SEQ ID NO: 1470218 - RNA, 22 nt, Homo sapiens
guuuuuguauuuauuaauuuga

SEQ ID NO: 1470219 - RNA, 21 nt, Homo sapiens
guuuuuugaaauuaugugaca

SEQ ID NO: 1470220 - RNA, 23 nt, Homo sapiens
guuuuuuuuuuccacuuagaaau

SEQ ID NO: 1470221 - RNA, 19 nt, Homo sapiens
uaaaaaaauacaugcaucu

SEQ ID NO: 1470222 - RNA, 19 nt, Homo sapiens
uccagcuugggcaacagag

SEQ ID NO: 1470223 - RNA, 23 nt, Homo sapiens
uccaggcaaaauugauauacuuu

SEQ ID NO: 1470224 - RNA, 18 nt, Homo sapiens
uccaggcccaacugugag

SEQ ID NO: 1470225 - RNA, 19 nt, Homo sapiens
uccagggaauggagcucag

SEQ ID NO: 1470226 - RNA, 15 nt, Homo sapiens
uccagggacaaagag

SEQ ID NO: 1470227 - RNA, 19 nt, Homo sapiens
uccagggcccccaucucau

SEQ ID NO: 1470228 - RNA, 21 nt, Homo sapiens
uccagguggagacccugagaa

SEQ ID NO: 1470229 - RNA, 15 nt, Homo sapiens
uccagugcaggagac

SEQ ID NO: 1470230 - RNA, 14 nt, Homo sapiens
uccagugggacccc

SEQ ID NO: 1470231 - RNA, 16 nt, Homo sapiens
uccaguuugcaccugu

SEQ ID NO: 1470232 - RNA, 12 nt, Homo sapiens
uccauaccagcu

SEQ ID NO: 1470233 - RNA, 23 nt, Homo sapiens
uccauaucccuuccucucaggcu

SEQ ID NO: 1470234 - RNA, 22 nt, Homo sapiens
uccauauccuucuggcuguaga

SEQ ID NO: 1470235 - RNA, 16 nt, Homo sapiens
uccauauuuacauucu

SEQ ID NO: 1470236 - RNA, 21 nt, Homo sapiens
uccaucagagaaggugcaggu

SEQ ID NO: 1470237 - RNA, 22 nt, Homo sapiens
uccauccauaaauccaguucua

SEQ ID NO: 1470238 - RNA, 17 nt, Homo sapiens
uccauccauuaccucca

SEQ ID NO: 1470239 - RNA, 16 nt, Homo sapiens
uccaucccuccauuca

SEQ ID NO: 1470240 - RNA, 14 nt, Homo sapiens
uccauccucacugc

SEQ ID NO: 1470241 - RNA, 17 nt, Homo sapiens
uccauccucacugcugu

SEQ ID NO: 1470242 - RNA, 13 nt, Homo sapiens
uccauccuuccaa

SEQ ID NO: 1470243 - RNA, 15 nt, Homo sapiens
uccaucucaaaaaag

SEQ ID NO: 1470244 - RNA, 17 nt, Homo sapiens
uccaucuuucuacagag

SEQ ID NO: 1470245 - RNA, 14 nt, Homo sapiens
uccaugaagaccac

SEQ ID NO: 1470246 - RNA, 16 nt, Homo sapiens
uccaugagacacaucu

SEQ ID NO: 1470247 - RNA, 22 nt, Homo sapiens
uccaugcaacuggaguuccuua

SEQ ID NO: 1470248 - RNA, 13 nt, Homo sapiens
uccaugcugccag

SEQ ID NO: 1470249 - RNA, 23 nt, Homo sapiens
uccauguaggaaaguaaaaugga

SEQ ID NO: 1470250 - RNA, 18 nt, Homo sapiens
uccauuaccuccauccau

SEQ ID NO: 1470251 - RNA, 16 nt, Homo sapiens
uccauucaacugaaaa

SEQ ID NO: 1470252 - RNA, 17 nt, Homo sapiens
uccauuggcucccaagu

SEQ ID NO: 1470253 - RNA, 18 nt, Homo sapiens
uccauuuauaaccccagc

SEQ ID NO: 1470254 - RNA, 15 nt, Homo sapiens
uccauuuauauauga

SEQ ID NO: 1470255 - RNA, 20 nt, Homo sapiens
uccauuucccacaucuuucc

SEQ ID NO: 1470256 - RNA, 15 nt, Homo sapiens
uccauuugcuuuguc

SEQ ID NO: 1470257 - RNA, 13 nt, Homo sapiens
uccauuuucaagc

SEQ ID NO: 1470258 - RNA, 13 nt, Homo sapiens
ucccaaagugcug

SEQ ID NO: 1470259 - RNA, 19 nt, Homo sapiens
ucccaaaugagccaugaga

SEQ ID NO: 1470260 - RNA, 16 nt, Homo sapiens
ucccaacacuuugaga

SEQ ID NO: 1470261 - RNA, 14 nt, Homo sapiens
ucccaacagccuua

SEQ ID NO: 1470262 - RNA, 13 nt, Homo sapiens
ucccaacccauuc

SEQ ID NO: 1470263 - RNA, 21 nt, Homo sapiens
ucccaacccauucacuacagg

SEQ ID NO: 1470264 - RNA, 16 nt, Homo sapiens
ucccaaccccagugga

SEQ ID NO: 1470265 - RNA, 14 nt, Homo sapiens
ucccaacguuuuac

SEQ ID NO: 1470266 - RNA, 14 nt, Homo sapiens
ucccaacugagugu

SEQ ID NO: 1470267 - RNA, 22 nt, Homo sapiens
ucccaacugaguguuauuugca

SEQ ID NO: 1470268 - RNA, 15 nt, Homo sapiens
ucccaagaguauccu

SEQ ID NO: 1470269 - RNA, 16 nt, Homo sapiens
ucccaagguccucuca

SEQ ID NO: 1470270 - RNA, 18 nt, Homo sapiens
ucccacaacaacaaaagc

SEQ ID NO: 1470271 - RNA, 17 nt, Homo sapiens
ucccacccacacagcug

SEQ ID NO: 1470272 - RNA, 23 nt, Homo sapiens
ucccacccccacccccagcucaa

SEQ ID NO: 1470273 - RNA, 14 nt, Homo sapiens
ucccaccccuccau

SEQ ID NO: 1470274 - RNA, 20 nt, Homo sapiens
ucccaccucagcuucucaaa

SEQ ID NO: 1470275 - RNA, 15 nt, Homo sapiens
ucccacuacaucugg

SEQ ID NO: 1470276 - RNA, 13 nt, Homo sapiens
ucccacuguauga

SEQ ID NO: 1470277 - RNA, 13 nt, Homo sapiens
ucccacuuucauc

SEQ ID NO: 1470278 - RNA, 19 nt, Homo sapiens
ucccacuuuucggagacag

SEQ ID NO: 1470279 - RNA, 14 nt, Homo sapiens
ucccagacauucau

SEQ ID NO: 1470280 - RNA, 18 nt, Homo sapiens
ucccagaggaugucacaa

SEQ ID NO: 1470281 - RNA, 16 nt, Homo sapiens
ucccagagucaucuga

SEQ ID NO: 1470282 - RNA, 18 nt, Homo sapiens
ucccagauguuggaccaa

SEQ ID NO: 1470283 - RNA, 13 nt, Homo sapiens
ucccagcacuuug

SEQ ID NO: 1470284 - RNA, 23 nt, Homo sapiens
ucccagcagcccuaaggaucucu

SEQ ID NO: 1470285 - RNA, 19 nt, Homo sapiens
ucccagcauaggauucauu

SEQ ID NO: 1470286 - RNA, 23 nt, Homo sapiens
ucccaggaaguggccaaaagcua

SEQ ID NO: 1470287 - RNA, 18 nt, Homo sapiens
ucccaggacccugaaggg

SEQ ID NO: 1470288 - RNA, 19 nt, Homo sapiens
ucccaguaguuauaaaguc

SEQ ID NO: 1470289 - RNA, 20 nt, Homo sapiens
ucccaguaguuauaaagucc

SEQ ID NO: 1470290 - RNA, 15 nt, Homo sapiens
ucccagucucuggca

SEQ ID NO: 1470291 - RNA, 13 nt, Homo sapiens
ucccagucuguga

SEQ ID NO: 1470292 - RNA, 13 nt, Homo sapiens
ucccauccuugau

SEQ ID NO: 1470293 - RNA, 15 nt, Homo sapiens
ucccaucuuuacucc

SEQ ID NO: 1470294 - RNA, 12 nt, Homo sapiens
ucccauggaaua

SEQ ID NO: 1470295 - RNA, 22 nt, Homo sapiens
ucccauggguuguguguuuauu

SEQ ID NO: 1470296 - RNA, 14 nt, Homo sapiens
ucccauguauuuau

SEQ ID NO: 1470297 - RNA, 16 nt, Homo sapiens
ucccauuccugaagaa

SEQ ID NO: 1470298 - RNA, 13 nt, Homo sapiens
uccccaagcaccu

SEQ ID NO: 1470299 - RNA, 17 nt, Homo sapiens
uccccaagcaccuuccc

SEQ ID NO: 1470300 - RNA, 16 nt, Homo sapiens
uccccaagcacggugu

SEQ ID NO: 1470301 - RNA, 14 nt, Homo sapiens
uccccaaggacucu

SEQ ID NO: 1470302 - RNA, 19 nt, Homo sapiens
uccccaaggacucuuccac

SEQ ID NO: 1470303 - RNA, 23 nt, Homo sapiens
uccccagcccuggcucugcaaug

SEQ ID NO: 1470304 - RNA, 23 nt, Homo sapiens
uccccagccuccccgugccaaaa

SEQ ID NO: 1470305 - RNA, 20 nt, Homo sapiens
uccccauucgguguggugca

SEQ ID NO: 1470306 - RNA, 17 nt, Homo sapiens
ucccccaaaaugcauuu

SEQ ID NO: 1470307 - RNA, 17 nt, Homo sapiens
ucccccagccucaaguc

SEQ ID NO: 1470308 - RNA, 18 nt, Homo sapiens
ucccccaggcuguucucc

SEQ ID NO: 1470309 - RNA, 12 nt, Homo sapiens
ucccccauaggu

SEQ ID NO: 1470310 - RNA, 22 nt, Homo sapiens
ucccccgagcucuuggccuuug

SEQ ID NO: 1470311 - RNA, 22 nt, Homo sapiens
ucccccuguagacuagugccgu

SEQ ID NO: 1470312 - RNA, 18 nt, Homo sapiens
ucccccuuugugcacauu

SEQ ID NO: 1470313 - RNA, 15 nt, Homo sapiens
uccccuacagaauuu

SEQ ID NO: 1470314 - RNA, 17 nt, Homo sapiens
uccccucaacaugcugc

SEQ ID NO: 1470315 - RNA, 15 nt, Homo sapiens
uccccuccagccuuu

SEQ ID NO: 1470316 - RNA, 15 nt, Homo sapiens
uccccugaccuguga

SEQ ID NO: 1470317 - RNA, 15 nt, Homo sapiens
uccccuggacuggga

SEQ ID NO: 1470318 - RNA, 18 nt, Homo sapiens
uccccuuuguguagaaag

SEQ ID NO: 1470319 - RNA, 21 nt, Homo sapiens
uccccuuuguguagaaagcca

SEQ ID NO: 1470320 - RNA, 22 nt, Homo sapiens
ucccgaagaaugaacccaagag

SEQ ID NO: 1470321 - RNA, 14 nt, Homo sapiens
ucccgaauccacag

SEQ ID NO: 1470322 - RNA, 14 nt, Homo sapiens
ucccgcagggcuga

SEQ ID NO: 1470323 - RNA, 14 nt, Homo sapiens
ucccgccaugcuca

SEQ ID NO: 1470324 - RNA, 18 nt, Homo sapiens
ucccggagagggagucag

SEQ ID NO: 1470325 - RNA, 21 nt, Homo sapiens
ucucuuucuagaggugcuaca

SEQ ID NO: 1470326 - RNA, 21 nt, Homo sapiens
ucucuuuggcuggaauuacaa

SEQ ID NO: 1470327 - RNA, 19 nt, Homo sapiens
ucugaaaauauaaccagcc

SEQ ID NO: 1470328 - RNA, 19 nt, Homo sapiens
ucugaaaucuccuuuagcc

SEQ ID NO: 1470329 - RNA, 16 nt, Homo sapiens
ucugaacccugagcag

SEQ ID NO: 1470330 - RNA, 20 nt, Homo sapiens
ucugaauaaaguguaacaau

SEQ ID NO: 1470331 - RNA, 21 nt, Homo sapiens
ucugaauaaaguguaacaauu

SEQ ID NO: 1470332 - RNA, 16 nt, Homo sapiens
ucugaauaacauuugu

SEQ ID NO: 1470333 - RNA, 20 nt, Homo sapiens
ucugaaucgagugagacaaa

SEQ ID NO: 1470334 - RNA, 18 nt, Homo sapiens
ucugacaaugcugagguu

SEQ ID NO: 1470335 - RNA, 12 nt, Homo sapiens
ucugacccagug

SEQ ID NO: 1470336 - RNA, 17 nt, Homo sapiens
ucugagaauuccaagga

SEQ ID NO: 1470337 - RNA, 19 nt, Homo sapiens
ucugagacccuuuucucag

SEQ ID NO: 1470338 - RNA, 19 nt, Homo sapiens
ucugagagaugacagggaa

SEQ ID NO: 1470339 - RNA, 11 nt, Homo sapiens
ucugagcagug

SEQ ID NO: 1470340 - RNA, 21 nt, Homo sapiens
ucugagcucuggcuuugccuu

SEQ ID NO: 1470341 - RNA, 17 nt, Homo sapiens
ucugaggauucaggggc

SEQ ID NO: 1470342 - RNA, 16 nt, Homo sapiens
ucugaggccugaguga

SEQ ID NO: 1470343 - RNA, 19 nt, Homo sapiens
ucugaggccugagugagug

SEQ ID NO: 1470344 - RNA, 20 nt, Homo sapiens
ucugaguaagaaacagaauc

SEQ ID NO: 1470345 - RNA, 20 nt, Homo sapiens
ucugauacccagagcauuac

SEQ ID NO: 1470346 - RNA, 17 nt, Homo sapiens
ucugauaggaaugugaa

SEQ ID NO: 1470347 - RNA, 22 nt, Homo sapiens
ucugaucugcaguuuuugccug

SEQ ID NO: 1470348 - RNA, 20 nt, Homo sapiens
ucugcaaaaggccucuugua

SEQ ID NO: 1470349 - RNA, 23 nt, Homo sapiens
ucugcaagugaggugugucacaa

SEQ ID NO: 1470350 - RNA, 15 nt, Homo sapiens
ucugcacacuccagg

SEQ ID NO: 1470351 - RNA, 23 nt, Homo sapiens
ucugcacagccuagacauccagg

SEQ ID NO: 1470352 - RNA, 23 nt, Homo sapiens
ucugcacuuauaagaaagaucaa

SEQ ID NO: 1470353 - RNA, 19 nt, Homo sapiens
ucugcagcacucuuaucua

SEQ ID NO: 1470354 - RNA, 16 nt, Homo sapiens
ucugcagcuaacuuau

SEQ ID NO: 1470355 - RNA, 14 nt, Homo sapiens
ucugcaguuuaaca

SEQ ID NO: 1470356 - RNA, 21 nt, Homo sapiens
ucugcauuaucugaggucaca

SEQ ID NO: 1470357 - RNA, 13 nt, Homo sapiens
ucugcauuuugcu

SEQ ID NO: 1470358 - RNA, 15 nt, Homo sapiens
ucugcauuuugcuau

SEQ ID NO: 1470359 - RNA, 18 nt, Homo sapiens
ucugcauuuugcuauugu

SEQ ID NO: 1470360 - RNA, 19 nt, Homo sapiens
ucugccaaaggaugugaua

SEQ ID NO: 1470361 - RNA, 21 nt, Homo sapiens
ucugccacccacucaggauug

SEQ ID NO: 1470362 - RNA, 12 nt, Homo sapiens
ucugccaggcaa

SEQ ID NO: 1470363 - RNA, 16 nt, Homo sapiens
ucugccccagcccaga

SEQ ID NO: 1470364 - RNA, 15 nt, Homo sapiens
ucugcccucauuacu

SEQ ID NO: 1470365 - RNA, 15 nt, Homo sapiens
ucugccuucuuuaug

SEQ ID NO: 1470366 - RNA, 13 nt, Homo sapiens
ucugcgugacaau

SEQ ID NO: 1470367 - RNA, 18 nt, Homo sapiens
ucugcuauuugcuguuau

SEQ ID NO: 1470368 - RNA, 13 nt, Homo sapiens
ucugcuccugcuu

SEQ ID NO: 1470369 - RNA, 23 nt, Homo sapiens
ucugcucuuucucugccagugac

SEQ ID NO: 1470370 - RNA, 12 nt, Homo sapiens
ucugcuuaccuu

SEQ ID NO: 1470371 - RNA, 23 nt, Homo sapiens
ucugcuuguugcauuuccagcug

SEQ ID NO: 1470372 - RNA, 13 nt, Homo sapiens
ucuggaaccucag

SEQ ID NO: 1470373 - RNA, 13 nt, Homo sapiens
ucuggaagaccug

SEQ ID NO: 1470374 - RNA, 16 nt, Homo sapiens
ucuggaagucaucuca

SEQ ID NO: 1470375 - RNA, 19 nt, Homo sapiens
ucuggaauuucaaaccauu

SEQ ID NO: 1470376 - RNA, 21 nt, Homo sapiens
ucuggacacucaaacacauca

SEQ ID NO: 1470377 - RNA, 23 nt, Homo sapiens
ucuggagggguguggcuccuucc

SEQ ID NO: 1470378 - RNA, 16 nt, Homo sapiens
ucuggaugcugugaag

SEQ ID NO: 1470379 - RNA, 21 nt, Homo sapiens
ucuggauggauuugaagcaaa

SEQ ID NO: 1470380 - RNA, 17 nt, Homo sapiens
ucuggauucugaaucuc

SEQ ID NO: 1470381 - RNA, 12 nt, Homo sapiens
ucuggcaaaaag

SEQ ID NO: 1470382 - RNA, 19 nt, Homo sapiens
ucuggcaggaaucuaucca

SEQ ID NO: 1470383 - RNA, 14 nt, Homo sapiens
ucuggccacugucc

SEQ ID NO: 1470384 - RNA, 18 nt, Homo sapiens
ucuggccccugucauccu

SEQ ID NO: 1470385 - RNA, 12 nt, Homo sapiens
ucuggccucaga

SEQ ID NO: 1470386 - RNA, 12 nt, Homo sapiens
ucuggcucucau

SEQ ID NO: 1470387 - RNA, 23 nt, Homo sapiens
ucuggcugccccaaccugcugaa

SEQ ID NO: 1470388 - RNA, 17 nt, Homo sapiens
ucugggagucacacagu

SEQ ID NO: 1470389 - RNA, 21 nt, Homo sapiens
ucugggccucugacucugagu

SEQ ID NO: 1470390 - RNA, 9 nt, Homo sapiens
ucugggcuu

SEQ ID NO: 1470391 - RNA, 23 nt, Homo sapiens
ucuggggaugagguugcuuacua

SEQ ID NO: 1470392 - RNA, 16 nt, Homo sapiens
ucugggggacagagaa

SEQ ID NO: 1470393 - RNA, 18 nt, Homo sapiens
ucuggggugcugccugaa

SEQ ID NO: 1470394 - RNA, 18 nt, Homo sapiens
ucuggguacuucuugaag

SEQ ID NO: 1470395 - RNA, 22 nt, Homo sapiens
ucuguaaaagcagacccaccuc

SEQ ID NO: 1470396 - RNA, 16 nt, Homo sapiens
ucuguaaggacgccuu

SEQ ID NO: 1470397 - RNA, 16 nt, Homo sapiens
ucuguaggaaccgugg

SEQ ID NO: 1470398 - RNA, 20 nt, Homo sapiens
ucuguauugggguacaggaa

SEQ ID NO: 1470399 - RNA, 20 nt, Homo sapiens
ucugucacccuuguccuuga

SEQ ID NO: 1470400 - RNA, 19 nt, Homo sapiens
ucugucauuuguugugaug

SEQ ID NO: 1470401 - RNA, 18 nt, Homo sapiens
ucuguccauuuauccaca

SEQ ID NO: 1470402 - RNA, 13 nt, Homo sapiens
ucuguccuaccuu

SEQ ID NO: 1470403 - RNA, 21 nt, Homo sapiens
ucugugagacccccacaccuc

SEQ ID NO: 1470404 - RNA, 15 nt, Homo sapiens
ucugugaggugcuga

SEQ ID NO: 1470405 - RNA, 17 nt, Homo sapiens
ucugugaugacauuccc

SEQ ID NO: 1470406 - RNA, 15 nt, Homo sapiens
ucugugcacugccca

SEQ ID NO: 1470407 - RNA, 14 nt, Homo sapiens
ucugugccccaugc

SEQ ID NO: 1470408 - RNA, 14 nt, Homo sapiens
ucugugcuguggaa

SEQ ID NO: 1470409 - RNA, 18 nt, Homo sapiens
ucuguguucccagaggca

SEQ ID NO: 1470410 - RNA, 13 nt, Homo sapiens
ucuguguuuacag

SEQ ID NO: 1470411 - RNA, 15 nt, Homo sapiens
ucuguuaaucaugua

SEQ ID NO: 1470412 - RNA, 14 nt, Homo sapiens
ucuguuauguacua

SEQ ID NO: 1470413 - RNA, 15 nt, Homo sapiens
ucuguucacccugca

SEQ ID NO: 1470414 - RNA, 17 nt, Homo sapiens
ucuguuccccauggcca

SEQ ID NO: 1470415 - RNA, 17 nt, Homo sapiens
ucuguugucauugcugu

SEQ ID NO: 1470416 - RNA, 20 nt, Homo sapiens
ucuguuuauggccacauuua

SEQ ID NO: 1470417 - RNA, 19 nt, Homo sapiens
ucuguuuauucuuccagaa

SEQ ID NO: 1470418 - RNA, 14 nt, Homo sapiens
ucuguuugagauuu

SEQ ID NO: 1470419 - RNA, 22 nt, Homo sapiens
ucuguuugcuguggaacuacau

SEQ ID NO: 1470420 - RNA, 17 nt, Homo sapiens
ucuguuuugaaggcaaa

SEQ ID NO: 1470421 - RNA, 18 nt, Homo sapiens
ucuuaaaacacuuuucaa

SEQ ID NO: 1470422 - RNA, 23 nt, Homo sapiens
ucuuaaaaucacucagcacucca

SEQ ID NO: 1470423 - RNA, 21 nt, Homo sapiens
ucuuaaacauaauaaaucaca

SEQ ID NO: 1470424 - RNA, 20 nt, Homo sapiens
ucuuaaauauguauaugaca

SEQ ID NO: 1470425 - RNA, 19 nt, Homo sapiens
ucuuaaauuugauuuacau

SEQ ID NO: 1470426 - RNA, 22 nt, Homo sapiens
ucuuaagauccacaaaugaagg

SEQ ID NO: 1470427 - RNA, 18 nt, Homo sapiens
ugagcuauugcuguucuc

SEQ ID NO: 1470428 - RNA, 21 nt, Homo sapiens
ugagcucgguggcucaugccu

SEQ ID NO: 1470429 - RNA, 15 nt, Homo sapiens
ugagcucuucccuua

SEQ ID NO: 1470430 - RNA, 17 nt, Homo sapiens
ugagcugagaccacuga

SEQ ID NO: 1470431 - RNA, 19 nt, Homo sapiens
ugagcugccuguaacuuga

SEQ ID NO: 1470432 - RNA, 14 nt, Homo sapiens
ugagcuggggaccu

SEQ ID NO: 1470433 - RNA, 14 nt, Homo sapiens
ugagcuggggacuc

SEQ ID NO: 1470434 - RNA, 16 nt, Homo sapiens
ugaggaagugaacauu

SEQ ID NO: 1470435 - RNA, 18 nt, Homo sapiens
ugaggacagaccacagag

SEQ ID NO: 1470436 - RNA, 16 nt, Homo sapiens
ugaggaggaugucccu

SEQ ID NO: 1470437 - RNA, 17 nt, Homo sapiens
ugaggcccucauuccca

SEQ ID NO: 1470438 - RNA, 18 nt, Homo sapiens
ugaggccuggacuuuccu

SEQ ID NO: 1470439 - RNA, 14 nt, Homo sapiens
ugaggcugucacag

SEQ ID NO: 1470440 - RNA, 17 nt, Homo sapiens
ugaggcuucuccuucuc

SEQ ID NO: 1470441 - RNA, 13 nt, Homo sapiens
ugagggacucuga

SEQ ID NO: 1470442 - RNA, 20 nt, Homo sapiens
ugagggacuggaaccaggga

SEQ ID NO: 1470443 - RNA, 21 nt, Homo sapiens
ugagggaggauuccucagggu

SEQ ID NO: 1470444 - RNA, 18 nt, Homo sapiens
ugaggggcugacuucaau

SEQ ID NO: 1470445 - RNA, 22 nt, Homo sapiens
ugaggggguaauaaaccuccuu

SEQ ID NO: 1470446 - RNA, 15 nt, Homo sapiens
ugagggguugaggga

SEQ ID NO: 1470447 - RNA, 19 nt, Homo sapiens
ugaggguaucugacaaugc

SEQ ID NO: 1470448 - RNA, 14 nt, Homo sapiens
ugaggucacagucc

SEQ ID NO: 1470449 - RNA, 12 nt, Homo sapiens
ugaggucaggga

SEQ ID NO: 1470450 - RNA, 19 nt, Homo sapiens
ugagguguugugcauuugu

SEQ ID NO: 1470451 - RNA, 18 nt, Homo sapiens
ugaguaacaggugccuuc

SEQ ID NO: 1470452 - RNA, 17 nt, Homo sapiens
ugaguaauacaucaaag

SEQ ID NO: 1470453 - RNA, 17 nt, Homo sapiens
ugaguagaguugaucaa

SEQ ID NO: 1470454 - RNA, 23 nt, Homo sapiens
ugagucauuuaaauguguacaau

SEQ ID NO: 1470455 - RNA, 21 nt, Homo sapiens
ugaguccgacccagacaucca

SEQ ID NO: 1470456 - RNA, 23 nt, Homo sapiens
ugagucgaagaguggacaaacag

SEQ ID NO: 1470457 - RNA, 17 nt, Homo sapiens
ugagugaaccuguauaa

SEQ ID NO: 1470458 - RNA, 22 nt, Homo sapiens
ugagugggagaaggcagugauu

SEQ ID NO: 1470459 - RNA, 22 nt, Homo sapiens
ugagugguguguguuaucagau

SEQ ID NO: 1470460 - RNA, 17 nt, Homo sapiens
ugagugucuuagcauau

SEQ ID NO: 1470461 - RNA, 16 nt, Homo sapiens
ugaguguuauuugcac

SEQ ID NO: 1470462 - RNA, 17 nt, Homo sapiens
ugaguuaauuuuaccaa

SEQ ID NO: 1470463 - RNA, 20 nt, Homo sapiens
ugaguuaugauguaaucucu

SEQ ID NO: 1470464 - RNA, 14 nt, Homo sapiens
ugaguucuacauaa

SEQ ID NO: 1470465 - RNA, 17 nt, Homo sapiens
ugaguucuauaauauaa

SEQ ID NO: 1470466 - RNA, 17 nt, Homo sapiens
ugaguugaugggggcca

SEQ ID NO: 1470467 - RNA, 14 nt, Homo sapiens
ugaguugugaugaa

SEQ ID NO: 1470468 - RNA, 15 nt, Homo sapiens
ugaguuuuguauuca

SEQ ID NO: 1470469 - RNA, 21 nt, Homo sapiens
ugauaaagcuuaacacuugac

SEQ ID NO: 1470470 - RNA, 18 nt, Homo sapiens
ugauaaaugauagacaau

SEQ ID NO: 1470471 - RNA, 14 nt, Homo sapiens
ugauaagacuguuu

SEQ ID NO: 1470472 - RNA, 17 nt, Homo sapiens
ugauaaguuucauacuc

SEQ ID NO: 1470473 - RNA, 15 nt, Homo sapiens
ugauaauagcacuaa

SEQ ID NO: 1470474 - RNA, 20 nt, Homo sapiens
ugauaauagcacuaaugcuu

SEQ ID NO: 1470475 - RNA, 16 nt, Homo sapiens
ugauaaugcagacuuc

SEQ ID NO: 1470476 - RNA, 14 nt, Homo sapiens
ugauacaacauuaa

SEQ ID NO: 1470477 - RNA, 16 nt, Homo sapiens
ugauagaguguuauca

SEQ ID NO: 1470478 - RNA, 14 nt, Homo sapiens
ugauauauauaugc

SEQ ID NO: 1470479 - RNA, 14 nt, Homo sapiens
ugauauauuuucca

SEQ ID NO: 1470480 - RNA, 17 nt, Homo sapiens
ugauaucuggccuaaaa

SEQ ID NO: 1470481 - RNA, 14 nt, Homo sapiens
ugauauuggcuuaa

SEQ ID NO: 1470482 - RNA, 16 nt, Homo sapiens
ugaucaaauauuucaa

SEQ ID NO: 1470483 - RNA, 17 nt, Homo sapiens
ugaucaaauauuucaac

SEQ ID NO: 1470484 - RNA, 17 nt, Homo sapiens
ugaucaauaaaauguga

SEQ ID NO: 1470485 - RNA, 14 nt, Homo sapiens
ugaucaaugaauaa

SEQ ID NO: 1470486 - RNA, 15 nt, Homo sapiens
ugaucacacucuggg

SEQ ID NO: 1470487 - RNA, 18 nt, Homo sapiens
ugaucagcaucugugaug

SEQ ID NO: 1470488 - RNA, 17 nt, Homo sapiens
ugauccggggguccagg

SEQ ID NO: 1470489 - RNA, 20 nt, Homo sapiens
ugauccuggaggcccaguuc

SEQ ID NO: 1470490 - RNA, 20 nt, Homo sapiens
ugaucucccaagcuaucuaa

SEQ ID NO: 1470491 - RNA, 19 nt, Homo sapiens
ugaucuuaauauauuugaa

SEQ ID NO: 1470492 - RNA, 15 nt, Homo sapiens
ugaugacccucugac

SEQ ID NO: 1470493 - RNA, 17 nt, Homo sapiens
ugaugaugaugaugacu

SEQ ID NO: 1470494 - RNA, 17 nt, Homo sapiens
ugaugauuaauucaccu

SEQ ID NO: 1470495 - RNA, 16 nt, Homo sapiens
ugaugcaagccagcuu

SEQ ID NO: 1470496 - RNA, 15 nt, Homo sapiens
ugaugccauucuucc

SEQ ID NO: 1470497 - RNA, 23 nt, Homo sapiens
ugaugcucccuccccugcccugg

SEQ ID NO: 1470498 - RNA, 19 nt, Homo sapiens
ugaugcuuagauguuccag

SEQ ID NO: 1470499 - RNA, 21 nt, Homo sapiens
ugauggaaaauaaacaucagu

SEQ ID NO: 1470500 - RNA, 15 nt, Homo sapiens
ugauggcaccacugc

SEQ ID NO: 1470501 - RNA, 22 nt, Homo sapiens
ugauggcccuaaguuaagcaaa

SEQ ID NO: 1470502 - RNA, 16 nt, Homo sapiens
ugauggcucauuuaca

SEQ ID NO: 1470503 - RNA, 21 nt, Homo sapiens
ugauggcucauuuacacucag

SEQ ID NO: 1470504 - RNA, 17 nt, Homo sapiens
ugauggcuugacaugug

SEQ ID NO: 1470505 - RNA, 17 nt, Homo sapiens
ugaugggggccaggaca

SEQ ID NO: 1470506 - RNA, 16 nt, Homo sapiens
ugauguguccucaggg

SEQ ID NO: 1470507 - RNA, 18 nt, Homo sapiens
ugauguguccucagggag

SEQ ID NO: 1470508 - RNA, 13 nt, Homo sapiens
ugauuaacuuauu

SEQ ID NO: 1470509 - RNA, 12 nt, Homo sapiens
ugauuagcuuug

SEQ ID NO: 1470510 - RNA, 21 nt, Homo sapiens
ugauuauccauauugagucaa

SEQ ID NO: 1470511 - RNA, 23 nt, Homo sapiens
ugauuauccauauugagucaaau

SEQ ID NO: 1470512 - RNA, 15 nt, Homo sapiens
ugauuauuaaagucc

SEQ ID NO: 1470513 - RNA, 15 nt, Homo sapiens
ugauugagacucaaa

SEQ ID NO: 1470514 - RNA, 20 nt, Homo sapiens
ugauugaggagcugcacuga

SEQ ID NO: 1470515 - RNA, 14 nt, Homo sapiens
ugauugcagcuuua

SEQ ID NO: 1470516 - RNA, 13 nt, Homo sapiens
ugauuggcucacc

SEQ ID NO: 1470517 - RNA, 15 nt, Homo sapiens
ugauuggugauucaa

SEQ ID NO: 1470518 - RNA, 17 nt, Homo sapiens
ugauuguggaauggaga

SEQ ID NO: 1470519 - RNA, 20 nt, Homo sapiens
ugauugugggauacuauuua

SEQ ID NO: 1470520 - RNA, 12 nt, Homo sapiens
ugauuuacauaa

SEQ ID NO: 1470521 - RNA, 13 nt, Homo sapiens
ugauuucaggaua

SEQ ID NO: 1470522 - RNA, 15 nt, Homo sapiens
ugauuuguagcacug

SEQ ID NO: 1470523 - RNA, 16 nt, Homo sapiens
ugauuuguagcacuga

SEQ ID NO: 1470524 - RNA, 19 nt, Homo sapiens
ugauuuuauaugcuauuua

SEQ ID NO: 1470525 - RNA, 15 nt, Homo sapiens
ugauuuugcuuucca

SEQ ID NO: 1470526 - RNA, 16 nt, Homo sapiens
ugauuuugcuuuccaa

SEQ ID NO: 1470527 - RNA, 14 nt, Homo sapiens
ugauuuuuacuuca

SEQ ID NO: 1470528 - RNA, 17 nt, Homo sapiens
ugcaaacaucaaccugg

SEQ ID NO: 1470529 - RNA, 19 nt, Homo sapiens
ugcaaacucacugcucaag

SEQ ID NO: 1470530 - RNA, 19 nt, Homo sapiens
ugccagaugauuguucaaa

SEQ ID NO: 1470531 - RNA, 18 nt, Homo sapiens
ugccagcaaugacaucuc

SEQ ID NO: 1470532 - RNA, 19 nt, Homo sapiens
ugccagccccacacagcua

SEQ ID NO: 1470533 - RNA, 17 nt, Homo sapiens
ugccagccgugaugcuc

SEQ ID NO: 1470534 - RNA, 15 nt, Homo sapiens
ugccaggccuggcaa

SEQ ID NO: 1470535 - RNA, 11 nt, Homo sapiens
ugccagugaaa

SEQ ID NO: 1470536 - RNA, 16 nt, Homo sapiens
ugccagugccucucac

SEQ ID NO: 1470537 - RNA, 20 nt, Homo sapiens
ugccaugccaggaaccuguc

SEQ ID NO: 1470538 - RNA, 11 nt, Homo sapiens
ugccaugucug

SEQ ID NO: 1470539 - RNA, 14 nt, Homo sapiens
ugccauuacauugc

SEQ ID NO: 1470540 - RNA, 16 nt, Homo sapiens
ugccauuccacuccac

SEQ ID NO: 1470541 - RNA, 17 nt, Homo sapiens
ugccauuccacuccacu

SEQ ID NO: 1470542 - RNA, 19 nt, Homo sapiens
ugcccacccugggagacag

SEQ ID NO: 1470543 - RNA, 13 nt, Homo sapiens
ugcccacucccua

SEQ ID NO: 1470544 - RNA, 15 nt, Homo sapiens
ugcccagaacuuccc

SEQ ID NO: 1470545 - RNA, 17 nt, Homo sapiens
ugcccagacuacagggc

SEQ ID NO: 1470546 - RNA, 22 nt, Homo sapiens
ugcccagaucagccagaagcca

SEQ ID NO: 1470547 - RNA, 19 nt, Homo sapiens
ugcccaggagaaaagaaga

SEQ ID NO: 1470548 - RNA, 20 nt, Homo sapiens
ugcccaggcuggaguggagu

SEQ ID NO: 1470549 - RNA, 18 nt, Homo sapiens
ugcccauccugacugaaa

SEQ ID NO: 1470550 - RNA, 15 nt, Homo sapiens
ugccccagagcuguu

SEQ ID NO: 1470551 - RNA, 22 nt, Homo sapiens
ugccccagauuuacuaaaucaa

SEQ ID NO: 1470552 - RNA, 19 nt, Homo sapiens
ugccccccagccucuggca

SEQ ID NO: 1470553 - RNA, 14 nt, Homo sapiens
ugccccccaugagg

SEQ ID NO: 1470554 - RNA, 17 nt, Homo sapiens
ugccccccaugaggaag

SEQ ID NO: 1470555 - RNA, 16 nt, Homo sapiens
ugccccucccaaccca

SEQ ID NO: 1470556 - RNA, 19 nt, Homo sapiens
ugccccugcaguuggcaga

SEQ ID NO: 1470557 - RNA, 19 nt, Homo sapiens
ugccccuggaccugggaac

SEQ ID NO: 1470558 - RNA, 15 nt, Homo sapiens
ugcccgaaaccagag

SEQ ID NO: 1470559 - RNA, 13 nt, Homo sapiens
ugcccucauggcc

SEQ ID NO: 1470560 - RNA, 15 nt, Homo sapiens
ugcccucucugccag

SEQ ID NO: 1470561 - RNA, 23 nt, Homo sapiens
ugcccuguuguguauagaugcaa

SEQ ID NO: 1470562 - RNA, 14 nt, Homo sapiens
ugccgaaugugcag

SEQ ID NO: 1470563 - RNA, 19 nt, Homo sapiens
ugccgccuccuugugcaca

SEQ ID NO: 1470564 - RNA, 18 nt, Homo sapiens
ugccggcccccaggacaa

SEQ ID NO: 1470565 - RNA, 20 nt, Homo sapiens
ugccggccgggugugguggc

SEQ ID NO: 1470566 - RNA, 16 nt, Homo sapiens
ugccgucuucacuucc

SEQ ID NO: 1470567 - RNA, 13 nt, Homo sapiens
ugccuaaauauaa

SEQ ID NO: 1470568 - RNA, 20 nt, Homo sapiens
ugccuaaguccaguguuucu

SEQ ID NO: 1470569 - RNA, 23 nt, Homo sapiens
ugccucaccuaauaggcugggag

SEQ ID NO: 1470570 - RNA, 21 nt, Homo sapiens
ugccucagacguugccugaga

SEQ ID NO: 1470571 - RNA, 17 nt, Homo sapiens
ugccucagacuccgccc

SEQ ID NO: 1470572 - RNA, 14 nt, Homo sapiens
ugccucagccuccc

SEQ ID NO: 1470573 - RNA, 16 nt, Homo sapiens
ugccucagccuuccaa

SEQ ID NO: 1470574 - RNA, 20 nt, Homo sapiens
ugccuccucagaggacaguu

SEQ ID NO: 1470575 - RNA, 21 nt, Homo sapiens
ugccuccucguuccuuucucc

SEQ ID NO: 1470576 - RNA, 16 nt, Homo sapiens
ugccucuaccaguugg

SEQ ID NO: 1470577 - RNA, 13 nt, Homo sapiens
ugccucuggaugc

SEQ ID NO: 1470578 - RNA, 15 nt, Homo sapiens
ugccucuguauuuaa

SEQ ID NO: 1470579 - RNA, 20 nt, Homo sapiens
ugccucuucuuugugccuuu

SEQ ID NO: 1470580 - RNA, 21 nt, Homo sapiens
ugccugaaaugcuucuguuuu

SEQ ID NO: 1470581 - RNA, 20 nt, Homo sapiens
ugccuggccucugccuccac

SEQ ID NO: 1470582 - RNA, 23 nt, Homo sapiens
ugccuggccuggggaccaggugc

SEQ ID NO: 1470583 - RNA, 18 nt, Homo sapiens
ugccuuaaaaccaaagag

SEQ ID NO: 1470584 - RNA, 15 nt, Homo sapiens
ugccuuaaacacuca

SEQ ID NO: 1470585 - RNA, 15 nt, Homo sapiens
ugccuuagucucagu

SEQ ID NO: 1470586 - RNA, 14 nt, Homo sapiens
ugccuuaucuugca

SEQ ID NO: 1470587 - RNA, 22 nt, Homo sapiens
ugccuucucuguucccuugcag

SEQ ID NO: 1470588 - RNA, 20 nt, Homo sapiens
ugccuucuuauugcuuuuau

SEQ ID NO: 1470589 - RNA, 21 nt, Homo sapiens
ugccuugaaggggcagcugug

SEQ ID NO: 1470590 - RNA, 16 nt, Homo sapiens
ugccuugcuucuguau

SEQ ID NO: 1470591 - RNA, 16 nt, Homo sapiens
ugccuugugcuguuaa

SEQ ID NO: 1470592 - RNA, 15 nt, Homo sapiens
ugccuuuauuugcug

SEQ ID NO: 1470593 - RNA, 19 nt, Homo sapiens
ugccuuucuacaacugauu

SEQ ID NO: 1470594 - RNA, 17 nt, Homo sapiens
ugccuuuguaaguuauu

SEQ ID NO: 1470595 - RNA, 20 nt, Homo sapiens
ugccuuuucaucuaauguga

SEQ ID NO: 1470596 - RNA, 21 nt, Homo sapiens
ugcgaaugacaguagcauuau

SEQ ID NO: 1470597 - RNA, 13 nt, Homo sapiens
ugcgacugaugaa

SEQ ID NO: 1470598 - RNA, 18 nt, Homo sapiens
ugcgacugcgaacacuga

SEQ ID NO: 1470599 - RNA, 22 nt, Homo sapiens
ugcgccaaucccgccaugcuca

SEQ ID NO: 1470600 - RNA, 20 nt, Homo sapiens
ugcgcggaagugaccacaga

SEQ ID NO: 1470601 - RNA, 20 nt, Homo sapiens
ugcgugcucccgaugcugcu

SEQ ID NO: 1470602 - RNA, 17 nt, Homo sapiens
ugcgugguauaaucucc

SEQ ID NO: 1470603 - RNA, 13 nt, Homo sapiens
ugcguuacuaauu

SEQ ID NO: 1470604 - RNA, 14 nt, Homo sapiens
ugcguucacuccaa

SEQ ID NO: 1470605 - RNA, 22 nt, Homo sapiens
ugcuaaauggucgcccaggaga

SEQ ID NO: 1470606 - RNA, 18 nt, Homo sapiens
ugcuaacaaagacaaaag

SEQ ID NO: 1470607 - RNA, 14 nt, Homo sapiens
ugcuaaccuggaaa

SEQ ID NO: 1470608 - RNA, 22 nt, Homo sapiens
ugcuaagaagcgagcacugacc

SEQ ID NO: 1470609 - RNA, 17 nt, Homo sapiens
ugcuaaggcuccuccuu

SEQ ID NO: 1470610 - RNA, 18 nt, Homo sapiens
ugcuacauucuaaugcau

SEQ ID NO: 1470611 - RNA, 19 nt, Homo sapiens
ugcuaccccuacaucaucu

SEQ ID NO: 1470612 - RNA, 12 nt, Homo sapiens
ugcuacugcacu

SEQ ID NO: 1470613 - RNA, 23 nt, Homo sapiens
ugcuagaacaacgccugucacag

SEQ ID NO: 1470614 - RNA, 15 nt, Homo sapiens
ugcuagaagcuguaa

SEQ ID NO: 1470615 - RNA, 20 nt, Homo sapiens
ugcuaggcgcuggggagacu

SEQ ID NO: 1470616 - RNA, 23 nt, Homo sapiens
ugcuagugggcccucucucuggg

SEQ ID NO: 1470617 - RNA, 18 nt, Homo sapiens
ugcuauauugcacuguga

SEQ ID NO: 1470618 - RNA, 16 nt, Homo sapiens
ugcuauccccaucucc

SEQ ID NO: 1470619 - RNA, 15 nt, Homo sapiens
ugcuaucgcaccacu

SEQ ID NO: 1470620 - RNA, 16 nt, Homo sapiens
ugcuaugaaugauacc

SEQ ID NO: 1470621 - RNA, 12 nt, Homo sapiens
ugcuauuugccu

SEQ ID NO: 1470622 - RNA, 16 nt, Homo sapiens
ugcucaaccacugugg

SEQ ID NO: 1470623 - RNA, 12 nt, Homo sapiens
ugcucacagucc

SEQ ID NO: 1470624 - RNA, 18 nt, Homo sapiens
ugcucaggagccaccagc

SEQ ID NO: 1470625 - RNA, 17 nt, Homo sapiens
ugcucauugaacuuuaa

SEQ ID NO: 1470626 - RNA, 13 nt, Homo sapiens
ugcuccaccagca

SEQ ID NO: 1470627 - RNA, 17 nt, Homo sapiens
ugcucccaacccauuca

SEQ ID NO: 1470628 - RNA, 17 nt, Homo sapiens
ugcucccgaugcugcua

SEQ ID NO: 1470629 - RNA, 19 nt, Homo sapiens
ugcucccgaugcugcuaug

SEQ ID NO: 1470630 - RNA, 15 nt, Homo sapiens
ugcuccugcaucuca

SEQ ID NO: 1470631 - RNA, 18 nt, Homo sapiens
ugcucguuuucgcugggg

SEQ ID NO: 1470632 - RNA, 16 nt, Homo sapiens
ugcucuacccaugagc

SEQ ID NO: 1470633 - RNA, 23 nt, Homo sapiens
uuggcagaaaggauguuuugucc

SEQ ID NO: 1470634 - RNA, 22 nt, Homo sapiens
uuggccaaacaucagaccuguc

SEQ ID NO: 1470635 - RNA, 20 nt, Homo sapiens
uuggcccaggauuauuguca

SEQ ID NO: 1470636 - RNA, 15 nt, Homo sapiens
uuggccugcugugau

SEQ ID NO: 1470637 - RNA, 20 nt, Homo sapiens
uuggccuguagaguugcuga

SEQ ID NO: 1470638 - RNA, 23 nt, Homo sapiens
uuggcgugguccaugcugaugau

SEQ ID NO: 1470639 - RNA, 14 nt, Homo sapiens
uuggcuuaaauaau

SEQ ID NO: 1470640 - RNA, 13 nt, Homo sapiens
uuggcuuugccag

SEQ ID NO: 1470641 - RNA, 19 nt, Homo sapiens
uuggcuuuuucagagucau

SEQ ID NO: 1470642 - RNA, 18 nt, Homo sapiens
uugggaaaaaaacuuggc

SEQ ID NO: 1470643 - RNA, 21 nt, Homo sapiens
uugggaacggacugguaugua

SEQ ID NO: 1470644 - RNA, 13 nt, Homo sapiens
uugggcacagucc

SEQ ID NO: 1470645 - RNA, 15 nt, Homo sapiens
uugggcaccagcuca

SEQ ID NO: 1470646 - RNA, 14 nt, Homo sapiens
uugggcccaggacu

SEQ ID NO: 1470647 - RNA, 16 nt, Homo sapiens
uugggccuugcugcug

SEQ ID NO: 1470648 - RNA, 16 nt, Homo sapiens
uugggcugcuccucau

SEQ ID NO: 1470649 - RNA, 22 nt, Homo sapiens
uuggggaaaccuucaucugaaa

SEQ ID NO: 1470650 - RNA, 19 nt, Homo sapiens
uuggggagcaggaggccaa

SEQ ID NO: 1470651 - RNA, 21 nt, Homo sapiens
uuggggaggggccucccugug

SEQ ID NO: 1470652 - RNA, 23 nt, Homo sapiens
uuggguuaagcauuaccacucag

SEQ ID NO: 1470653 - RNA, 19 nt, Homo sapiens
uugguaaaaugcaucaaaa

SEQ ID NO: 1470654 - RNA, 16 nt, Homo sapiens
uugguauaauguuuaa

SEQ ID NO: 1470655 - RNA, 20 nt, Homo sapiens
uugguauacuuuugcuucag

SEQ ID NO: 1470656 - RNA, 15 nt, Homo sapiens
uuggugaauuucaca

SEQ ID NO: 1470657 - RNA, 16 nt, Homo sapiens
uuggugaauuucacaa

SEQ ID NO: 1470658 - RNA, 19 nt, Homo sapiens
uuggugacaccucaccuca

SEQ ID NO: 1470659 - RNA, 22 nt, Homo sapiens
uuggugccaccaaaagugcucc

SEQ ID NO: 1470660 - RNA, 15 nt, Homo sapiens
uugguguugacauac

SEQ ID NO: 1470661 - RNA, 12 nt, Homo sapiens
uugguugugaau

SEQ ID NO: 1470662 - RNA, 18 nt, Homo sapiens
uuguaaccauuucucacu

SEQ ID NO: 1470663 - RNA, 18 nt, Homo sapiens
uuguaaccugcugugaua

SEQ ID NO: 1470664 - RNA, 21 nt, Homo sapiens
uuguaacgacuucuccaucuc

SEQ ID NO: 1470665 - RNA, 22 nt, Homo sapiens
uuguaacgacuucuccaucucc

SEQ ID NO: 1470666 - RNA, 21 nt, Homo sapiens
uuguaagaaaaugagacaaaa

SEQ ID NO: 1470667 - RNA, 14 nt, Homo sapiens
uuguaauaaauacu

SEQ ID NO: 1470668 - RNA, 19 nt, Homo sapiens
uuguaaugacagugcuaaa

SEQ ID NO: 1470669 - RNA, 14 nt, Homo sapiens
uuguacaauguaga

SEQ ID NO: 1470670 - RNA, 15 nt, Homo sapiens
uuguacacugcugua

SEQ ID NO: 1470671 - RNA, 18 nt, Homo sapiens
uuguacagugucugugcc

SEQ ID NO: 1470672 - RNA, 19 nt, Homo sapiens
uuguacccccagguggaag

SEQ ID NO: 1470673 - RNA, 19 nt, Homo sapiens
uuguagagauggggucuca

SEQ ID NO: 1470674 - RNA, 21 nt, Homo sapiens
uuguagagauggggucucaca

SEQ ID NO: 1470675 - RNA, 22 nt, Homo sapiens
uuguagagauggggucucacag

SEQ ID NO: 1470676 - RNA, 19 nt, Homo sapiens
uuguagaguggugcugcuu

SEQ ID NO: 1470677 - RNA, 22 nt, Homo sapiens
uuguagcacugaggguggcacu

SEQ ID NO: 1470678 - RNA, 20 nt, Homo sapiens
uuguaguuuuggcuaguccu

SEQ ID NO: 1470679 - RNA, 14 nt, Homo sapiens
uuguauauuacaca

SEQ ID NO: 1470680 - RNA, 15 nt, Homo sapiens
uuguaucaacacugu

SEQ ID NO: 1470681 - RNA, 18 nt, Homo sapiens
uuguauuguucauaauau

SEQ ID NO: 1470682 - RNA, 21 nt, Homo sapiens
uugucaaaaggaagucucuag

SEQ ID NO: 1470683 - RNA, 13 nt, Homo sapiens
uugucaaacugua

SEQ ID NO: 1470684 - RNA, 16 nt, Homo sapiens
uugucagaaaccugca

SEQ ID NO: 1470685 - RNA, 12 nt, Homo sapiens
uugucaguucuu

SEQ ID NO: 1470686 - RNA, 15 nt, Homo sapiens
uugucccucugcuac

SEQ ID NO: 1470687 - RNA, 20 nt, Homo sapiens
uugugacaggaaagcccucc

SEQ ID NO: 1470688 - RNA, 20 nt, Homo sapiens
uugugaguuuaccuuguaua

SEQ ID NO: 1470689 - RNA, 15 nt, Homo sapiens
uugugauagcacuuu

SEQ ID NO: 1470690 - RNA, 10 nt, Homo sapiens
uugugcaaac

SEQ ID NO: 1470691 - RNA, 13 nt, Homo sapiens
uuguggggcuccc

SEQ ID NO: 1470692 - RNA, 17 nt, Homo sapiens
uuguggguccaugcuaa

SEQ ID NO: 1470693 - RNA, 21 nt, Homo sapiens
uuguguaaugaaaaugaauau

SEQ ID NO: 1470694 - RNA, 17 nt, Homo sapiens
uuguguagaaagccaaa

SEQ ID NO: 1470695 - RNA, 20 nt, Homo sapiens
uuguguuccuggcugaugau

SEQ ID NO: 1470696 - RNA, 18 nt, Homo sapiens
uuguuaccuuuaugguuu

SEQ ID NO: 1470697 - RNA, 12 nt, Homo sapiens
uuguuauaccau

SEQ ID NO: 1470698 - RNA, 17 nt, Homo sapiens
uuguuauuugaaaacau

SEQ ID NO: 1470699 - RNA, 23 nt, Homo sapiens
uuguuccagcaguuuucaaguca

SEQ ID NO: 1470700 - RNA, 16 nt, Homo sapiens
uuguuccagcccuauu

SEQ ID NO: 1470701 - RNA, 21 nt, Homo sapiens
uuguucuuuaaagucaggucc

SEQ ID NO: 1470702 - RNA, 18 nt, Homo sapiens
uuguugccuucaucuuca

SEQ ID NO: 1470703 - RNA, 20 nt, Homo sapiens
uuguuguaaccugcugugau

SEQ ID NO: 1470704 - RNA, 13 nt, Homo sapiens
uuguugugugugc

SEQ ID NO: 1470705 - RNA, 20 nt, Homo sapiens
uuguuuagauaugacauuua

SEQ ID NO: 1470706 - RNA, 22 nt, Homo sapiens
uuguuuauacuccaguguacau

SEQ ID NO: 1470707 - RNA, 19 nt, Homo sapiens
uuguuucaaccaagucaug

SEQ ID NO: 1470708 - RNA, 21 nt, Homo sapiens
uuguuucccagauuucaggaa

SEQ ID NO: 1470709 - RNA, 19 nt, Homo sapiens
uuguuuuacccuauacauc

SEQ ID NO: 1470710 - RNA, 19 nt, Homo sapiens
uuguuuugacggaugauug

SEQ ID NO: 1470711 - RNA, 20 nt, Homo sapiens
uuuaaaaccugugugccauu

SEQ ID NO: 1470712 - RNA, 14 nt, Homo sapiens
uuuaaaagauaaaa

SEQ ID NO: 1470713 - RNA, 16 nt, Homo sapiens
uuuaaacacaugccuu

SEQ ID NO: 1470714 - RNA, 18 nt, Homo sapiens
uuuaaacacaugccuuaa

SEQ ID NO: 1470715 - RNA, 19 nt, Homo sapiens
uuuaaaccuuuuucuugau

SEQ ID NO: 1470716 - RNA, 20 nt, Homo sapiens
uuuaaacuaucuugugugau

SEQ ID NO: 1470717 - RNA, 22 nt, Homo sapiens
uuuaaacucagggacagagcca

SEQ ID NO: 1470718 - RNA, 12 nt, Homo sapiens
uuuaaacugcau

SEQ ID NO: 1470719 - RNA, 12 nt, Homo sapiens
uuuaaacuuuga

SEQ ID NO: 1470720 - RNA, 19 nt, Homo sapiens
uuuaaagaugaacucugaa

SEQ ID NO: 1470721 - RNA, 14 nt, Homo sapiens
uuuaaagccuccuc

SEQ ID NO: 1470722 - RNA, 16 nt, Homo sapiens
uuuaaagcucaugcau

SEQ ID NO: 1470723 - RNA, 18 nt, Homo sapiens
uuuaaauguguacaaugu

SEQ ID NO: 1470724 - RNA, 16 nt, Homo sapiens
uuuaacaacauggcuu

SEQ ID NO: 1470725 - RNA, 13 nt, Homo sapiens
uuuaacaauaacu

SEQ ID NO: 1470726 - RNA, 23 nt, Homo sapiens
uuuaacacccuuuagaaccuuaa

SEQ ID NO: 1470727 - RNA, 21 nt, Homo sapiens
uuuaacuagaauuuauucaau

SEQ ID NO: 1470728 - RNA, 16 nt, Homo sapiens
uuuaacuagacacaga

SEQ ID NO: 1470729 - RNA, 20 nt, Homo sapiens
uuuaacuuuaaggauuugaa

SEQ ID NO: 1470730 - RNA, 23 nt, Homo sapiens
uuuaagaaauaaauuuauuucaa

SEQ ID NO: 1470731 - RNA, 13 nt, Homo sapiens
uuuaagaaaucaa

SEQ ID NO: 1470732 - RNA, 11 nt, Homo sapiens
uuuaagccaua

SEQ ID NO: 1470733 - RNA, 14 nt, Homo sapiens
uuuaagguaacaaa

SEQ ID NO: 1470734 - RNA, 19 nt, Homo sapiens
uuuaagguuuuuacuguga

SEQ ID NO: 1470735 - RNA, 20 nt, Homo sapiens
uuuucuaaaaaaagaaaaaa

SEQ ID NO: 1470736 - RNA, 14 nt, Homo sapiens
uuuucuaucaaaua

SEQ ID NO: 1470737 - RNA, 12 nt, Homo sapiens
uuuucucaggac

SEQ ID NO: 1470738 - RNA, 15 nt, Homo sapiens
uuuucucugugcuuc

SEQ ID NO: 1470739 - RNA, 11 nt, Homo sapiens
uuuucugcuaa

SEQ ID NO: 1470740 - RNA, 19 nt, Homo sapiens
uuuucuuauuuaacuuaac

SEQ ID NO: 1470741 - RNA, 13 nt, Homo sapiens
uuuugaagaauau

SEQ ID NO: 1470742 - RNA, 13 nt, Homo sapiens
uuuugaaggcaaa

SEQ ID NO: 1470743 - RNA, 22 nt, Homo sapiens
uuuugauaacaaugacacuaga

SEQ ID NO: 1470744 - RNA, 18 nt, Homo sapiens
uuuugccaaggcaaaaaa

SEQ ID NO: 1470745 - RNA, 17 nt, Homo sapiens
uuuugccauaaugacuc

SEQ ID NO: 1470746 - RNA, 18 nt, Homo sapiens
uuuugccucaccuaauag

SEQ ID NO: 1470747 - RNA, 13 nt, Homo sapiens
uuuugcuauugua

SEQ ID NO: 1470748 - RNA, 20 nt, Homo sapiens
uuuuggggaaaaaagcacau

SEQ ID NO: 1470749 - RNA, 20 nt, Homo sapiens
uuuugguagaugcaugacuu

SEQ ID NO: 1470750 - RNA, 19 nt, Homo sapiens
uuuuguaaaguugccuuua

SEQ ID NO: 1470751 - RNA, 11 nt, Homo sapiens
uuuuguacuuu

SEQ ID NO: 1470752 - RNA, 12 nt, Homo sapiens
uuuuguguccuc

SEQ ID NO: 1470753 - RNA, 13 nt, Homo sapiens
uuuuguuaccuuu

SEQ ID NO: 1470754 - RNA, 22 nt, Homo sapiens
uuuuuacuaaacucagaggcag

SEQ ID NO: 1470755 - RNA, 12 nt, Homo sapiens
uuuuuacuauua

SEQ ID NO: 1470756 - RNA, 21 nt, Homo sapiens
uuuuuaugaagugcgugaaug

SEQ ID NO: 1470757 - RNA, 16 nt, Homo sapiens
uuuuucaaaugaucuu

SEQ ID NO: 1470758 - RNA, 23 nt, Homo sapiens
uuuuucguguggaucuugccaca

SEQ ID NO: 1470759 - RNA, 16 nt, Homo sapiens
uuuuucuaagguucuc

SEQ ID NO: 1470760 - RNA, 11 nt, Homo sapiens
uuuuugcucuc

SEQ ID NO: 1470761 - RNA, 20 nt, Homo sapiens
uuuuuggaacuaaagcaaau

SEQ ID NO: 1470762 - RNA, 21 nt, Homo sapiens
uuuuuggggaaaaaagcacau

SEQ ID NO: 1470763 - RNA, 13 nt, Homo sapiens
uuuuuuaacauuc

SEQ ID NO: 1470764 - RNA, 16 nt, Homo sapiens
uuguucugugguuauc

SEQ ID NO: 1470765 - RNA, 11 nt, Homo sapiens
uuguugccaug

SEQ ID NO: 1470766 - RNA, 14 nt, Homo sapiens
uuguuggucagagg

SEQ ID NO: 1470767 - RNA, 14 nt, Homo sapiens
uuguuguugccaaa

SEQ ID NO: 1470768 - RNA, 22 nt, Homo sapiens
uuguuuaccucuuugucccaga

SEQ ID NO: 1470769 - RNA, 22 nt, Homo sapiens
uuguuuccucuuccaaaguaaa

SEQ ID NO: 1470770 - RNA, 14 nt, Homo sapiens
uuguuugucuucca

SEQ ID NO: 1470771 - RNA, 20 nt, Homo sapiens
uuuaaaaaaaaaaguuacag

SEQ ID NO: 1470772 - RNA, 15 nt, Homo sapiens
uuuaaaaaaucucaa

SEQ ID NO: 1470773 - RNA, 15 nt, Homo sapiens
uuuaaaagcaucuca

SEQ ID NO: 1470774 - RNA, 14 nt, Homo sapiens
uuuaaacucaggga

SEQ ID NO: 1470775 - RNA, 16 nt, Homo sapiens
uuuaaagacucaaggu

SEQ ID NO: 1470776 - RNA, 10 nt, Homo sapiens
uuuaaagggu

SEQ ID NO: 1470777 - RNA, 18 nt, Homo sapiens
uuuaaaguaaaggcaaac

SEQ ID NO: 1470778 - RNA, 14 nt, Homo sapiens
uuuaaaguggcaau

SEQ ID NO: 1470779 - RNA, 18 nt, Homo sapiens
uuuaaaguggguuauucu

SEQ ID NO: 1470780 - RNA, 20 nt, Homo sapiens
uuuaaauaaaguuacuugaa

SEQ ID NO: 1470781 - RNA, 17 nt, Homo sapiens
uuuaaauguauuuuaca

SEQ ID NO: 1470782 - RNA, 17 nt, Homo sapiens
uuuaaaugucugcaugc

SEQ ID NO: 1470783 - RNA, 17 nt, Homo sapiens
uuuaacuuaacauucug

SEQ ID NO: 1470784 - RNA, 14 nt, Homo sapiens
uuuaagaauuucac

SEQ ID NO: 1470785 - RNA, 15 nt, Homo sapiens
uuuaagaauuucaca

SEQ ID NO: 1470786 - RNA, 15 nt, Homo sapiens
uuuaagcagucucac

SEQ ID NO: 1470787 - RNA, 15 nt, Homo sapiens
uuuaaggauguugcc

SEQ ID NO: 1470788 - RNA, 22 nt, Homo sapiens
uuuaagggcaugccuugugcug

SEQ ID NO: 1470789 - RNA, 13 nt, Homo sapiens
uuuaaguaacuua

SEQ ID NO: 1470790 - RNA, 15 nt, Homo sapiens
uuuaaguacuacaca

SEQ ID NO: 1470791 - RNA, 20 nt, Homo sapiens
uuuaauaaaugguuuauucu

SEQ ID NO: 1470792 - RNA, 12 nt, Homo sapiens
uuuaauccuuaa

SEQ ID NO: 1470793 - RNA, 21 nt, Homo sapiens
uuuaauccuuaacacauucaa

SEQ ID NO: 1470794 - RNA, 19 nt, Homo sapiens
uuuaaugccgauauacucu

SEQ ID NO: 1470795 - RNA, 17 nt, Homo sapiens
uuuaauggcaugucaga

SEQ ID NO: 1470796 - RNA, 19 nt, Homo sapiens
uuuaauguuuuuugccaca

SEQ ID NO: 1470797 - RNA, 20 nt, Homo sapiens
uuuacaaaacuacaugagaa

SEQ ID NO: 1470798 - RNA, 12 nt, Homo sapiens
uuuacaaaguau

SEQ ID NO: 1470799 - RNA, 17 nt, Homo sapiens
uuuacaaaguauuugcu

SEQ ID NO: 1470800 - RNA, 21 nt, Homo sapiens
uuuacaagaaguuuauucuca

SEQ ID NO: 1470801 - RNA, 17 nt, Homo sapiens
uuuacagcaaguagaua

SEQ ID NO: 1470802 - RNA, 21 nt, Homo sapiens
uuuacauaucaccucauggcc

SEQ ID NO: 1470803 - RNA, 17 nt, Homo sapiens
uuuacauuauuaagaaa

SEQ ID NO: 1470804 - RNA, 15 nt, Homo sapiens
uuuacauucaucuca

SEQ ID NO: 1470805 - RNA, 16 nt, Homo sapiens
uuuaccauuuguaaua

SEQ ID NO: 1470806 - RNA, 14 nt, Homo sapiens
uuuacccucaggca

SEQ ID NO: 1470807 - RNA, 12 nt, Homo sapiens
uuuagaaaucaa

SEQ ID NO: 1470808 - RNA, 18 nt, Homo sapiens
uuuagaacuugcagcuga

SEQ ID NO: 1470809 - RNA, 14 nt, Homo sapiens
uuuagagaaguaua

SEQ ID NO: 1470810 - RNA, 15 nt, Homo sapiens
uuuagauauacauau

SEQ ID NO: 1470811 - RNA, 19 nt, Homo sapiens
uuuagauuaaacaaacaaa

SEQ ID NO: 1470812 - RNA, 20 nt, Homo sapiens
uuuagcaauuuauacaauau

SEQ ID NO: 1470813 - RNA, 15 nt, Homo sapiens
uuuagucaugugacc

SEQ ID NO: 1470814 - RNA, 12 nt, Homo sapiens
uuuaguccugua

SEQ ID NO: 1470815 - RNA, 11 nt, Homo sapiens
uuuaguucucc

SEQ ID NO: 1470816 - RNA, 15 nt, Homo sapiens
uuuauaaaggccaaa

SEQ ID NO: 1470817 - RNA, 13 nt, Homo sapiens
uuuauaauaaaca

SEQ ID NO: 1470818 - RNA, 19 nt, Homo sapiens
uuuauacuccaguguacau

SEQ ID NO: 1470819 - RNA, 23 nt, Homo sapiens
uuuauaguacuaguuuugcuuua

SEQ ID NO: 1470820 - RNA, 13 nt, Homo sapiens
uuuauaugcuauu

SEQ ID NO: 1470821 - RNA, 17 nt, Homo sapiens
uuuaucaaaauguagcu

SEQ ID NO: 1470822 - RNA, 18 nt, Homo sapiens
uuuaucacuucauucaca

SEQ ID NO: 1470823 - RNA, 18 nt, Homo sapiens
uuuaucugcuaugcuauu

SEQ ID NO: 1470824 - RNA, 15 nt, Homo sapiens
uuuauugaaugcuua

SEQ ID NO: 1470825 - RNA, 20 nt, Homo sapiens
uuuauugaguaccuacugug

SEQ ID NO: 1470826 - RNA, 18 nt, Homo sapiens
uuuauuuaagcaucaaau

SEQ ID NO: 1470827 - RNA, 13 nt, Homo sapiens
uuuauuucucggg

SEQ ID NO: 1470828 - RNA, 17 nt, Homo sapiens
uuucaacuaauauaucu

SEQ ID NO: 1470829 - RNA, 19 nt, Homo sapiens
uuucaaguguaacuuauua

SEQ ID NO: 1470830 - RNA, 23 nt, Homo sapiens
uuucaauaaaaguaaagacugua

SEQ ID NO: 1470831 - RNA, 15 nt, Homo sapiens
uuucaauuacaaagc

SEQ ID NO: 1470832 - RNA, 20 nt, Homo sapiens
uuucaauuucuagaggaacu

SEQ ID NO: 1470833 - RNA, 16 nt, Homo sapiens
uuucacaacauuugca

SEQ ID NO: 1470834 - RNA, 11 nt, Homo sapiens
uuucacaagcu

SEQ ID NO: 1470835 - RNA, 14 nt, Homo sapiens
uuucacucucugca

SEQ ID NO: 1470836 - RNA, 20 nt, Homo sapiens
uuucagagaaauacuuucag

SEQ ID NO: 1470837 - RNA, 17 nt, Homo sapiens
uuucaggauacaugugc

SEQ ID NO: 1470838 - RNA, 16 nt, Homo sapiens
uuucaggugucaugga

SEQ ID NO: 1470839 - RNA, 15 nt, Homo sapiens
uuucaugcagccuaa

SEQ ID NO: 1470840 - RNA, 22 nt, Homo sapiens
uuucauguggcuguagauccca

SEQ ID NO: 1470841 - RNA, 19 nt, Homo sapiens
uuucauguuuuugaucaaa

SEQ ID NO: 1470842 - RNA, 20 nt, Homo sapiens
uggcacuuaguagguccuca

SEQ ID NO: 1470843 - RNA, 11 nt, Homo sapiens
uggcacuuuga

SEQ ID NO: 1470844 - RNA, 19 nt, Homo sapiens
uggcacuuugaaggggccu

SEQ ID NO: 1470845 - RNA, 15 nt, Homo sapiens
uggcagaaccaaagc

SEQ ID NO: 1470846 - RNA, 15 nt, Homo sapiens
uggcagauuuuacaa

SEQ ID NO: 1470847 - RNA, 16 nt, Homo sapiens
uggcagcauacacaga

SEQ ID NO: 1470848 - RNA, 17 nt, Homo sapiens
uggcagccgugccuuca

SEQ ID NO: 1470849 - RNA, 14 nt, Homo sapiens
uggcaggccagugu

SEQ ID NO: 1470850 - RNA, 19 nt, Homo sapiens
uggcauacgccuguagucc

SEQ ID NO: 1470851 - RNA, 16 nt, Homo sapiens
uggcauagccccggcc

SEQ ID NO: 1470852 - RNA, 17 nt, Homo sapiens
uggccaaauagcaaaga

SEQ ID NO: 1470853 - RNA, 21 nt, Homo sapiens
uggccaccaguaugacaguau

SEQ ID NO: 1470854 - RNA, 22 nt, Homo sapiens
uggccacgugggcaaacaggca

SEQ ID NO: 1470855 - RNA, 21 nt, Homo sapiens
uggccacugucuccacucaca

SEQ ID NO: 1470856 - RNA, 17 nt, Homo sapiens
uggccagacuucagcug

SEQ ID NO: 1470857 - RNA, 17 nt, Homo sapiens
uggccaggugguugucu

SEQ ID NO: 1470858 - RNA, 17 nt, Homo sapiens
uggccccaguccaugcu

SEQ ID NO: 1470859 - RNA, 19 nt, Homo sapiens
uggccccaguccaugcuuc

SEQ ID NO: 1470860 - RNA, 18 nt, Homo sapiens
uggcccggaugcugcuuc

SEQ ID NO: 1470861 - RNA, 16 nt, Homo sapiens
uggcccucgacacuca

SEQ ID NO: 1470862 - RNA, 22 nt, Homo sapiens
uggccgcuccucccucagaaaa

SEQ ID NO: 1470863 - RNA, 20 nt, Homo sapiens
uggccuaggcuaccucaaga

SEQ ID NO: 1470864 - RNA, 18 nt, Homo sapiens
uggccuggccauuuccaa

SEQ ID NO: 1470865 - RNA, 23 nt, Homo sapiens
uggccuggggcaggucacuuuac

SEQ ID NO: 1470866 - RNA, 22 nt, Homo sapiens
uggccuggucccuguuuuccca

SEQ ID NO: 1470867 - RNA, 15 nt, Homo sapiens
uggccuuacacugaa

SEQ ID NO: 1470868 - RNA, 18 nt, Homo sapiens
uggcgcauauuaagcacu

SEQ ID NO: 1470869 - RNA, 13 nt, Homo sapiens
uggcgcccagugg

SEQ ID NO: 1470870 - RNA, 22 nt, Homo sapiens
uggcguuacugcuugaccaaag

SEQ ID NO: 1470871 - RNA, 21 nt, Homo sapiens
uggcuaaagagcuuugugaua

SEQ ID NO: 1470872 - RNA, 15 nt, Homo sapiens
uggcuaagauaccaa

SEQ ID NO: 1470873 - RNA, 17 nt, Homo sapiens
uggcuacacacaaacca

SEQ ID NO: 1470874 - RNA, 18 nt, Homo sapiens
uggcuacacacaaaccag

SEQ ID NO: 1470875 - RNA, 15 nt, Homo sapiens
uggcuagacuugcca

SEQ ID NO: 1470876 - RNA, 12 nt, Homo sapiens
uggcuagccuuu

SEQ ID NO: 1470877 - RNA, 15 nt, Homo sapiens
uggcuauaaauauau

SEQ ID NO: 1470878 - RNA, 12 nt, Homo sapiens
uggcucacuggc

SEQ ID NO: 1470879 - RNA, 22 nt, Homo sapiens
uggcucaugccuguaaucucag

SEQ ID NO: 1470880 - RNA, 17 nt, Homo sapiens
uggcucaugucuauaau

SEQ ID NO: 1470881 - RNA, 16 nt, Homo sapiens
uggcuccucuacuguu

SEQ ID NO: 1470882 - RNA, 13 nt, Homo sapiens
uggcucucauggg

SEQ ID NO: 1470883 - RNA, 15 nt, Homo sapiens
uggcugaccccaaag

SEQ ID NO: 1470884 - RNA, 17 nt, Homo sapiens
uggcugagguuccucug

SEQ ID NO: 1470885 - RNA, 11 nt, Homo sapiens
uggcugaugau

SEQ ID NO: 1470886 - RNA, 13 nt, Homo sapiens
uggcugcccagga

SEQ ID NO: 1470887 - RNA, 16 nt, Homo sapiens
uggcugcuuuguucaa

SEQ ID NO: 1470888 - RNA, 17 nt, Homo sapiens
uggcugcuuuguucaau

SEQ ID NO: 1470889 - RNA, 17 nt, Homo sapiens
uggcuggaucagggaau

SEQ ID NO: 1470890 - RNA, 18 nt, Homo sapiens
uggcuggcucuaccuucc

SEQ ID NO: 1470891 - RNA, 24 nt, Homo sapiens
uggcugggaacaacuucaguccaa

SEQ ID NO: 1470892 - RNA, 22 nt, Homo sapiens
uggcugggaagacuauggugcu

SEQ ID NO: 1470893 - RNA, 17 nt, Homo sapiens
uggcuuaaauaaucucu

SEQ ID NO: 1470894 - RNA, 16 nt, Homo sapiens
uggcuuucuggcugcu

SEQ ID NO: 1470895 - RNA, 23 nt, Homo sapiens
ugggaaaaaaacuuggcacuuuu

SEQ ID NO: 1470896 - RNA, 20 nt, Homo sapiens
ugggaagagaagagggccca

SEQ ID NO: 1470897 - RNA, 19 nt, Homo sapiens
ugggaaugaaauuaacaca

SEQ ID NO: 1470898 - RNA, 16 nt, Homo sapiens
ugggacaaaggacauu

SEQ ID NO: 1470899 - RNA, 22 nt, Homo sapiens
ugggaccaacuuccuguugaug

SEQ ID NO: 1470900 - RNA, 14 nt, Homo sapiens
ugggacccuugaga

SEQ ID NO: 1470901 - RNA, 15 nt, Homo sapiens
ugggacuauucauug

SEQ ID NO: 1470902 - RNA, 15 nt, Homo sapiens
ugggacucaggauau

SEQ ID NO: 1470903 - RNA, 20 nt, Homo sapiens
ugggacuggagucagaugag

SEQ ID NO: 1470904 - RNA, 14 nt, Homo sapiens
ugggagaaggcagu

SEQ ID NO: 1470905 - RNA, 20 nt, Homo sapiens
ugggagacugaagacucagc

SEQ ID NO: 1470906 - RNA, 18 nt, Homo sapiens
ugggagcaggaacaauga

SEQ ID NO: 1470907 - RNA, 20 nt, Homo sapiens
ugggagcccugaccuuggcu

SEQ ID NO: 1470908 - RNA, 15 nt, Homo sapiens
ugggagcuuauugcu

SEQ ID NO: 1470909 - RNA, 13 nt, Homo sapiens
ugggaggcaagaa

SEQ ID NO: 1470910 - RNA, 16 nt, Homo sapiens
ugggaggccaaggugg

SEQ ID NO: 1470911 - RNA, 18 nt, Homo sapiens
ucccggggcuccacugaa

SEQ ID NO: 1470912 - RNA, 23 nt, Homo sapiens
ucccguaccucuucccaugacug

SEQ ID NO: 1470913 - RNA, 15 nt, Homo sapiens
ucccuaggaaacuca

SEQ ID NO: 1470914 - RNA, 23 nt, Homo sapiens
ucccucaccuuggcaccagacac

SEQ ID NO: 1470915 - RNA, 20 nt, Homo sapiens
ucccucagaaaaaggcagug

SEQ ID NO: 1470916 - RNA, 13 nt, Homo sapiens
ucccuccaccuca

SEQ ID NO: 1470917 - RNA, 20 nt, Homo sapiens
ucccuccccaguucauugca

SEQ ID NO: 1470918 - RNA, 17 nt, Homo sapiens
ucccucccccccaugca

SEQ ID NO: 1470919 - RNA, 14 nt, Homo sapiens
ucccuccggccaua

SEQ ID NO: 1470920 - RNA, 21 nt, Homo sapiens
ucccucucaugacuugcaggg

SEQ ID NO: 1470921 - RNA, 13 nt, Homo sapiens
ucccugaucccau

SEQ ID NO: 1470922 - RNA, 15 nt, Homo sapiens
ucccugccacauaca

SEQ ID NO: 1470923 - RNA, 21 nt, Homo sapiens
ucccuggcucccaugaccaua

SEQ ID NO: 1470924 - RNA, 18 nt, Homo sapiens
ucccuggggcugugcauu

SEQ ID NO: 1470925 - RNA, 18 nt, Homo sapiens
ucccuguaauauuuagcu

SEQ ID NO: 1470926 - RNA, 16 nt, Homo sapiens
ucccugugucauuuca

SEQ ID NO: 1470927 - RNA, 17 nt, Homo sapiens
ucccuguuuuaauucaa

SEQ ID NO: 1470928 - RNA, 15 nt, Homo sapiens
ucccuuccagcaaua

SEQ ID NO: 1470929 - RNA, 19 nt, Homo sapiens
ucccuuccugggucuacca

SEQ ID NO: 1470930 - RNA, 18 nt, Homo sapiens
ucccuucuggacacugag

SEQ ID NO: 1470931 - RNA, 18 nt, Homo sapiens
ucccuucuuggugcuuac

SEQ ID NO: 1470932 - RNA, 15 nt, Homo sapiens
ucccuugcagggguc

SEQ ID NO: 1470933 - RNA, 14 nt, Homo sapiens
ucccuugcuguaug

SEQ ID NO: 1470934 - RNA, 18 nt, Homo sapiens
ucccuuuggagaugcuga

SEQ ID NO: 1470935 - RNA, 21 nt, Homo sapiens
uccgaacuguucaaguguccc

SEQ ID NO: 1470936 - RNA, 16 nt, Homo sapiens
uccgagcggcuacaaa

SEQ ID NO: 1470937 - RNA, 16 nt, Homo sapiens
uccgcacuuuccacuu

SEQ ID NO: 1470938 - RNA, 19 nt, Homo sapiens
uccgcaggcagacuacaca

SEQ ID NO: 1470939 - RNA, 20 nt, Homo sapiens
uccgcaguuccugucccuuc

SEQ ID NO: 1470940 - RNA, 22 nt, Homo sapiens
uccgccaaucuggcccuuacac

SEQ ID NO: 1470941 - RNA, 22 nt, Homo sapiens
uccggcugaaggcugagugucc

SEQ ID NO: 1470942 - RNA, 23 nt, Homo sapiens
uccggcugaaggcugaguguccg

SEQ ID NO: 1470943 - RNA, 22 nt, Homo sapiens
uccgggagcggcuguugggcug

SEQ ID NO: 1470944 - RNA, 17 nt, Homo sapiens
uccgguuuagucaucca

SEQ ID NO: 1470945 - RNA, 12 nt, Homo sapiens
uccguacauuca

SEQ ID NO: 1470946 - RNA, 19 nt, Homo sapiens
uccguuaugccaccuggag

SEQ ID NO: 1470947 - RNA, 22 nt, Homo sapiens
uccuaaacccaaugacuucccu

SEQ ID NO: 1470948 - RNA, 23 nt, Homo sapiens
uccuaacaggaugaaaguucccc

SEQ ID NO: 1470949 - RNA, 19 nt, Homo sapiens
ugccuaguaacacauaugu

SEQ ID NO: 1470950 - RNA, 13 nt, Homo sapiens
ugccucaagacua

SEQ ID NO: 1470951 - RNA, 18 nt, Homo sapiens
ugccucagccucccgagu

SEQ ID NO: 1470952 - RNA, 22 nt, Homo sapiens
ugccucccaagguccucucagu

SEQ ID NO: 1470953 - RNA, 16 nt, Homo sapiens
ugccucccacuucacu

SEQ ID NO: 1470954 - RNA, 20 nt, Homo sapiens
ugccucccauccuucccuca

SEQ ID NO: 1470955 - RNA, 23 nt, Homo sapiens
ugccuccucccugggcagaaagu

SEQ ID NO: 1470956 - RNA, 15 nt, Homo sapiens
ugccucuucuuugug

SEQ ID NO: 1470957 - RNA, 20 nt, Homo sapiens
ugccugccccccucaucuca

SEQ ID NO: 1470958 - RNA, 23 nt, Homo sapiens
ugccuggagacagauacguaguu

SEQ ID NO: 1470959 - RNA, 20 nt, Homo sapiens
ugccuggggucugagcauga

SEQ ID NO: 1470960 - RNA, 16 nt, Homo sapiens
ugccugguaccagagg

SEQ ID NO: 1470961 - RNA, 16 nt, Homo sapiens
ugccuguaacuugaga

SEQ ID NO: 1470962 - RNA, 18 nt, Homo sapiens
ugccuguaaucccaacac

SEQ ID NO: 1470963 - RNA, 20 nt, Homo sapiens
ugccugugguuaacaucuca

SEQ ID NO: 1470964 - RNA, 15 nt, Homo sapiens
ugccuuaaaauggaa

SEQ ID NO: 1470965 - RNA, 16 nt, Homo sapiens
ugccuuaggccuaccu

SEQ ID NO: 1470966 - RNA, 21 nt, Homo sapiens
ugccuucaaacaaaggcaguu

SEQ ID NO: 1470967 - RNA, 14 nt, Homo sapiens
ugccuucaaaucaa

SEQ ID NO: 1470968 - RNA, 13 nt, Homo sapiens
ugccuucacccau

SEQ ID NO: 1470969 - RNA, 19 nt, Homo sapiens
ugccuucagcuguugcaga

SEQ ID NO: 1470970 - RNA, 21 nt, Homo sapiens
ugccuucuuauugcuuuuaug

SEQ ID NO: 1470971 - RNA, 16 nt, Homo sapiens
ugccuuggcuuugcca

SEQ ID NO: 1470972 - RNA, 17 nt, Homo sapiens
ugccuuuuuaaugaaca

SEQ ID NO: 1470973 - RNA, 17 nt, Homo sapiens
ugcgcuuuauugcccau

SEQ ID NO: 1470974 - RNA, 16 nt, Homo sapiens
ugcggauggauggaag

SEQ ID NO: 1470975 - RNA, 13 nt, Homo sapiens
ugcggcaucagau

SEQ ID NO: 1470976 - RNA, 21 nt, Homo sapiens
ugcggcugccauuggagccaa

SEQ ID NO: 1470977 - RNA, 13 nt, Homo sapiens
ugcgugggggcca

SEQ ID NO: 1470978 - RNA, 21 nt, Homo sapiens
ugcuaaaugcuacauacucca

SEQ ID NO: 1470979 - RNA, 23 nt, Homo sapiens
ugcuaaauggucgcccaggagac

SEQ ID NO: 1470980 - RNA, 23 nt, Homo sapiens
ugcuaaucaugugggugagccag

SEQ ID NO: 1470981 - RNA, 24 nt, Homo sapiens
ugcuaauuaaaaaguuaaucuuca

SEQ ID NO: 1470982 - RNA, 17 nt, Homo sapiens
uggaacuccuggccuuu

SEQ ID NO: 1470983 - RNA, 22 nt, Homo sapiens
uggaagaaaaaaaccacacaaa

SEQ ID NO: 1470984 - RNA, 18 nt, Homo sapiens
uggaagaagugagcagug

SEQ ID NO: 1470985 - RNA, 16 nt, Homo sapiens
uggaagaggaacagca

SEQ ID NO: 1470986 - RNA, 19 nt, Homo sapiens
uggaagaggcugagacauu

SEQ ID NO: 1470987 - RNA, 14 nt, Homo sapiens
uggaagaguaguaa

SEQ ID NO: 1470988 - RNA, 17 nt, Homo sapiens
uggaagaguaguaauag

SEQ ID NO: 1470989 - RNA, 14 nt, Homo sapiens
uggaagcacauguu

SEQ ID NO: 1470990 - RNA, 18 nt, Homo sapiens
uggaagcuaauuugcauu

SEQ ID NO: 1470991 - RNA, 15 nt, Homo sapiens
uggaaggcagacagc

SEQ ID NO: 1470992 - RNA, 16 nt, Homo sapiens
uggaaggcuuccacua

SEQ ID NO: 1470993 - RNA, 14 nt, Homo sapiens
uggaaggugcuacu

SEQ ID NO: 1470994 - RNA, 14 nt, Homo sapiens
uggaagucaucuca

SEQ ID NO: 1470995 - RNA, 15 nt, Homo sapiens
uggaagucaucucau

SEQ ID NO: 1470996 - RNA, 20 nt, Homo sapiens
uggaagucaucucauuccac

SEQ ID NO: 1470997 - RNA, 21 nt, Homo sapiens
uggaaguguauuuauuuuaca

SEQ ID NO: 1470998 - RNA, 20 nt, Homo sapiens
uggaaguuauuaacuuuaau

SEQ ID NO: 1470999 - RNA, 15 nt, Homo sapiens
uggaauaacucugug

SEQ ID NO: 1471000 - RNA, 13 nt, Homo sapiens
uggaauauuacaa

SEQ ID NO: 1471001 - RNA, 15 nt, Homo sapiens
uggaaucccacugua

SEQ ID NO: 1471002 - RNA, 16 nt, Homo sapiens
uggaaugcuguguuaa

SEQ ID NO: 1471003 - RNA, 13 nt, Homo sapiens
uggaauguaauca

SEQ ID NO: 1471004 - RNA, 14 nt, Homo sapiens
uggaauugcucaag

SEQ ID NO: 1471005 - RNA, 17 nt, Homo sapiens
uggaauuuggacaagug

SEQ ID NO: 1471006 - RNA, 23 nt, Homo sapiens
uggaauuuucucacgcaggagcc

SEQ ID NO: 1471007 - RNA, 17 nt, Homo sapiens
uggacaaaugaugccau

SEQ ID NO: 1471008 - RNA, 17 nt, Homo sapiens
uggacaaggagugugac

SEQ ID NO: 1471009 - RNA, 22 nt, Homo sapiens
uggacacuucacgcccuuggcc

SEQ ID NO: 1471010 - RNA, 17 nt, Homo sapiens
uggacagcuuuucccaa

SEQ ID NO: 1471011 - RNA, 22 nt, Homo sapiens
uggacaggaggcccccaucuau

SEQ ID NO: 1471012 - RNA, 17 nt, Homo sapiens
uggacaggagucagugu

SEQ ID NO: 1471013 - RNA, 22 nt, Homo sapiens
uggacagugaggucacagucca

SEQ ID NO: 1471014 - RNA, 15 nt, Homo sapiens
uggacauccccagaa

SEQ ID NO: 1471015 - RNA, 21 nt, Homo sapiens
uggacauccuguauaagcacu

SEQ ID NO: 1471016 - RNA, 15 nt, Homo sapiens
uggaccaguacuccc

SEQ ID NO: 1471017 - RNA, 19 nt, Homo sapiens
uggacgcuguccugagaug

SEQ ID NO: 1471018 - RNA, 22 nt, Homo sapiens
uggacuccaucucucauccucc

SEQ ID NO: 1471019 - RNA, 14 nt, Homo sapiens
uggacucucaggga

SEQ ID NO: 1471020 - RNA, 13 nt, Homo sapiens
uggacugcaauga

SEQ ID NO: 1471021 - RNA, 14 nt, Homo sapiens
uggacuguugccac

SEQ ID NO: 1471022 - RNA, 15 nt, Homo sapiens
uggacuguugccacc

SEQ ID NO: 1471023 - RNA, 21 nt, Homo sapiens
uggacuuuucguuaacauuga

SEQ ID NO: 1471024 - RNA, 17 nt, Homo sapiens
uggagaaucugcugcau

SEQ ID NO: 1471025 - RNA, 23 nt, Homo sapiens
uggagacaccaaccgacaggccc

SEQ ID NO: 1471026 - RNA, 19 nt, Homo sapiens
uggagacugacaaccucau

SEQ ID NO: 1471027 - RNA, 19 nt, Homo sapiens
uggagacugagaucacuga

SEQ ID NO: 1471028 - RNA, 15 nt, Homo sapiens
uggagagaagggcau

SEQ ID NO: 1471029 - RNA, 22 nt, Homo sapiens
uggagagcacaccuaucuuagu

SEQ ID NO: 1471030 - RNA, 23 nt, Homo sapiens
uggagagucagaucuuucuccuu

SEQ ID NO: 1471031 - RNA, 22 nt, Homo sapiens
uggagauggacaacucaaugaa

SEQ ID NO: 1471032 - RNA, 19 nt, Homo sapiens
uggagauuggcaugccauu

SEQ ID NO: 1471033 - RNA, 19 nt, Homo sapiens
uggagcaucauaauggacu

SEQ ID NO: 1471034 - RNA, 12 nt, Homo sapiens
uggagccuuuga

SEQ ID NO: 1471035 - RNA, 16 nt, Homo sapiens
uggagcucagguccca

SEQ ID NO: 1471036 - RNA, 13 nt, Homo sapiens
uggagcugucauc

SEQ ID NO: 1471037 - RNA, 19 nt, Homo sapiens
uggaggaggaaggcaagag

SEQ ID NO: 1471038 - RNA, 21 nt, Homo sapiens
uggaggcacugaagugcuuag

SEQ ID NO: 1471039 - RNA, 13 nt, Homo sapiens
uggaggcacuuua

SEQ ID NO: 1471040 - RNA, 16 nt, Homo sapiens
uggaggcagcagcucc

SEQ ID NO: 1471041 - RNA, 17 nt, Homo sapiens
uggaggccugugccuug

SEQ ID NO: 1471042 - RNA, 15 nt, Homo sapiens
uggaggcugcaguga

SEQ ID NO: 1471043 - RNA, 11 nt, Homo sapiens
uggaggggugu

SEQ ID NO: 1471044 - RNA, 16 nt, Homo sapiens
uggagguugaagccaa

SEQ ID NO: 1471045 - RNA, 19 nt, Homo sapiens
uggaguagagguacuagaa

SEQ ID NO: 1471046 - RNA, 22 nt, Homo sapiens
uggaguagcaucccccuggggc

SEQ ID NO: 1471047 - RNA, 16 nt, Homo sapiens
uggaguauuggggucu

SEQ ID NO: 1471048 - RNA, 13 nt, Homo sapiens
uggagugucacau

SEQ ID NO: 1471049 - RNA, 16 nt, Homo sapiens
uggagugucacaucuc

SEQ ID NO: 1471050 - RNA, 24 nt, Homo sapiens
uggaguuucauguacaagaugaag

SEQ ID NO: 1471051 - RNA, 20 nt, Homo sapiens
ucacuuuacaaauucaagcc

SEQ ID NO: 1471052 - RNA, 16 nt, Homo sapiens
ucacuuuauuaucccu

SEQ ID NO: 1471053 - RNA, 20 nt, Homo sapiens
ucacuuuuguucccagguac

SEQ ID NO: 1471054 - RNA, 14 nt, Homo sapiens
ucagaaaacucugg

SEQ ID NO: 1471055 - RNA, 19 nt, Homo sapiens
ucagaaacuagaaauguga

SEQ ID NO: 1471056 - RNA, 15 nt, Homo sapiens
ucagaaauauaugca

SEQ ID NO: 1471057 - RNA, 22 nt, Homo sapiens
ucagaagaaagaaucuuuccau

SEQ ID NO: 1471058 - RNA, 20 nt, Homo sapiens
ucagaauaaauuauugcugu

SEQ ID NO: 1471059 - RNA, 15 nt, Homo sapiens
ucagaauaaggcagg

SEQ ID NO: 1471060 - RNA, 21 nt, Homo sapiens
ucagaauaaggcaggcauuga

SEQ ID NO: 1471061 - RNA, 17 nt, Homo sapiens
ucagaauggauuuauca

SEQ ID NO: 1471062 - RNA, 22 nt, Homo sapiens
ucagaauuuaguguauccauaa

SEQ ID NO: 1471063 - RNA, 20 nt, Homo sapiens
ucagacacccucuccuuaaa

SEQ ID NO: 1471064 - RNA, 15 nt, Homo sapiens
ucagacagaacuuga

SEQ ID NO: 1471065 - RNA, 13 nt, Homo sapiens
ucagacaggcaaa

SEQ ID NO: 1471066 - RNA, 21 nt, Homo sapiens
ucagaccaacucucuccugua

SEQ ID NO: 1471067 - RNA, 14 nt, Homo sapiens
ucagaccugcauug

SEQ ID NO: 1471068 - RNA, 16 nt, Homo sapiens
ucagaccuggcugcuu

SEQ ID NO: 1471069 - RNA, 15 nt, Homo sapiens
ucagagccaccccua

SEQ ID NO: 1471070 - RNA, 20 nt, Homo sapiens
ucagagguguacacuaacau

SEQ ID NO: 1471071 - RNA, 22 nt, Homo sapiens
ucagaguggucgagugacacac

SEQ ID NO: 1471072 - RNA, 13 nt, Homo sapiens
ucagauaugauau

SEQ ID NO: 1471073 - RNA, 20 nt, Homo sapiens
ucagauauuuuuucagaaau

SEQ ID NO: 1471074 - RNA, 21 nt, Homo sapiens
ucagauauuuuuucagaaaua

SEQ ID NO: 1471075 - RNA, 17 nt, Homo sapiens
ucagaucauauuucaca

SEQ ID NO: 1471076 - RNA, 15 nt, Homo sapiens
ucagauccagggaca

SEQ ID NO: 1471077 - RNA, 14 nt, Homo sapiens
ucagaucugucuga

SEQ ID NO: 1471078 - RNA, 16 nt, Homo sapiens
ucagaugaucucucca

SEQ ID NO: 1471079 - RNA, 19 nt, Homo sapiens
ucagauggagguucucaga

SEQ ID NO: 1471080 - RNA, 21 nt, Homo sapiens
ucagauuuuaaaaagucuuca

SEQ ID NO: 1471081 - RNA, 23 nt, Homo sapiens
ucagauuuuaaaaagucuucacu

SEQ ID NO: 1471082 - RNA, 17 nt, Homo sapiens
ucagcaaugccauuuca

SEQ ID NO: 1471083 - RNA, 19 nt, Homo sapiens
ucagcacugucccuugccu

SEQ ID NO: 1471084 - RNA, 21 nt, Homo sapiens
ucagcacugucccuugccuca

SEQ ID NO: 1471085 - RNA, 16 nt, Homo sapiens
ucagcaucugugaugg

SEQ ID NO: 1471086 - RNA, 18 nt, Homo sapiens
ucagcauucucacuccua

SEQ ID NO: 1471087 - RNA, 21 nt, Homo sapiens
ucagcauuuagucuugccagg

SEQ ID NO: 1471088 - RNA, 11 nt, Homo sapiens
ucagcauuucc

SEQ ID NO: 1471089 - RNA, 22 nt, Homo sapiens
ucagcauuucuuuucuggccaa

SEQ ID NO: 1471090 - RNA, 22 nt, Homo sapiens
ucagccaagaucuugccacugu

SEQ ID NO: 1471091 - RNA, 14 nt, Homo sapiens
guuacaaagacaug

SEQ ID NO: 1471092 - RNA, 21 nt, Homo sapiens
guuacaaaguaauuucuuuga

SEQ ID NO: 1471093 - RNA, 14 nt, Homo sapiens
guuacagaccucag

SEQ ID NO: 1471094 - RNA, 21 nt, Homo sapiens
guuacagcgagaggcagagaa

SEQ ID NO: 1471095 - RNA, 22 nt, Homo sapiens
guuacauuucuaucaguacuuu

SEQ ID NO: 1471096 - RNA, 22 nt, Homo sapiens
guuacuauuuucuacaauuaau

SEQ ID NO: 1471097 - RNA, 19 nt, Homo sapiens
guuacuguggccaguauuu

SEQ ID NO: 1471098 - RNA, 20 nt, Homo sapiens
guuacuguggccaguauuuu

SEQ ID NO: 1471099 - RNA, 21 nt, Homo sapiens
guuacuguguuuaucuugaua

SEQ ID NO: 1471100 - RNA, 13 nt, Homo sapiens
guuagaccacuuu

SEQ ID NO: 1471101 - RNA, 12 nt, Homo sapiens
guuagccucuug

SEQ ID NO: 1471102 - RNA, 13 nt, Homo sapiens
guuagccucuugc

SEQ ID NO: 1471103 - RNA, 14 nt, Homo sapiens
guuauaaaguccuu

SEQ ID NO: 1471104 - RNA, 17 nt, Homo sapiens
guuauaaaucaauguca

SEQ ID NO: 1471105 - RNA, 23 nt, Homo sapiens
guuauaaaucaaugucacuuaaa

SEQ ID NO: 1471106 - RNA, 11 nt, Homo sapiens
guuaucuguga

SEQ ID NO: 1471107 - RNA, 14 nt, Homo sapiens
guuaugacuaugua

SEQ ID NO: 1471108 - RNA, 13 nt, Homo sapiens
guucaaucauuga

SEQ ID NO: 1471109 - RNA, 14 nt, Homo sapiens
guucaauccagaga

SEQ ID NO: 1471110 - RNA, 18 nt, Homo sapiens
guucaaugcuagaacaac

SEQ ID NO: 1471111 - RNA, 16 nt, Homo sapiens
guucacauagugaaau

SEQ ID NO: 1471112 - RNA, 15 nt, Homo sapiens
guucacgcucaccca

SEQ ID NO: 1471113 - RNA, 11 nt, Homo sapiens
guucacuccca

SEQ ID NO: 1471114 - RNA, 20 nt, Homo sapiens
guucaggagucccaaggaaa

SEQ ID NO: 1471115 - RNA, 17 nt, Homo sapiens
guucauccaggcccaac

SEQ ID NO: 1471116 - RNA, 17 nt, Homo sapiens
guuccaaagccagugaa

SEQ ID NO: 1471117 - RNA, 20 nt, Homo sapiens
guuccaaauucaguuucaua

SEQ ID NO: 1471118 - RNA, 21 nt, Homo sapiens
guuccagaaggauccaagaca

SEQ ID NO: 1471119 - RNA, 15 nt, Homo sapiens
guuccagauguggau

SEQ ID NO: 1471120 - RNA, 21 nt, Homo sapiens
guuccaguaccgcccucgggg

SEQ ID NO: 1471121 - RNA, 13 nt, Homo sapiens
guuccccacugac

SEQ ID NO: 1471122 - RNA, 14 nt, Homo sapiens
guucccccaaccuc

SEQ ID NO: 1471123 - RNA, 13 nt, Homo sapiens
guuccccucugcu

SEQ ID NO: 1471124 - RNA, 16 nt, Homo sapiens
guucccuguucuuccu

SEQ ID NO: 1471125 - RNA, 17 nt, Homo sapiens
guucccuuacuguuuca

SEQ ID NO: 1471126 - RNA, 19 nt, Homo sapiens
guucccuugcagggguccc

SEQ ID NO: 1471127 - RNA, 16 nt, Homo sapiens
guucccuuggccucag

SEQ ID NO: 1471128 - RNA, 19 nt, Homo sapiens
guuccgcacuuuccacuuc

SEQ ID NO: 1471129 - RNA, 19 nt, Homo sapiens
guuccuguagaacugagaa

SEQ ID NO: 1471130 - RNA, 16 nt, Homo sapiens
guuccuuaucugucac

SEQ ID NO: 1471131 - RNA, 13 nt, Homo sapiens
guucgaagcuccg

SEQ ID NO: 1471132 - RNA, 20 nt, Homo sapiens
guucgcauggucacacacug

SEQ ID NO: 1471133 - RNA, 18 nt, Homo sapiens
guucuacauaaguaauuc

SEQ ID NO: 1471134 - RNA, 18 nt, Homo sapiens
guucuaugaagaguauua

SEQ ID NO: 1471135 - RNA, 19 nt, Homo sapiens
guucucaaaguuaauucac

SEQ ID NO: 1471136 - RNA, 19 nt, Homo sapiens
guucucccaccaccucacc

SEQ ID NO: 1471137 - RNA, 19 nt, Homo sapiens
guucucuucuucauucuau

SEQ ID NO: 1471138 - RNA, 23 nt, Homo sapiens
guucugacauuaacaguuuucca

SEQ ID NO: 1471139 - RNA, 16 nt, Homo sapiens
guucugagaccagugu

SEQ ID NO: 1471140 - RNA, 12 nt, Homo sapiens
guucugucauau

SEQ ID NO: 1471141 - RNA, 14 nt, Homo sapiens
guucugugaccacu

SEQ ID NO: 1471142 - RNA, 21 nt, Homo sapiens
guucuuacacaggcuucauca

SEQ ID NO: 1471143 - RNA, 12 nt, Homo sapiens
guucuucagggc

SEQ ID NO: 1471144 - RNA, 17 nt, Homo sapiens
guucuucagggccaguc

SEQ ID NO: 1471145 - RNA, 22 nt, Homo sapiens
guucuuguuuuauauaccuggc

SEQ ID NO: 1471146 - RNA, 18 nt, Homo sapiens
guucuuuaaaggcaucua

SEQ ID NO: 1471147 - RNA, 15 nt, Homo sapiens
guucuuugggccaga

SEQ ID NO: 1471148 - RNA, 16 nt, Homo sapiens
guucuuugggccagac

SEQ ID NO: 1471149 - RNA, 14 nt, Homo sapiens
guucuuuuugccag

SEQ ID NO: 1471150 - RNA, 21 nt, Homo sapiens
guugaaaauguguuugcugcc

SEQ ID NO: 1471151 - RNA, 16 nt, Homo sapiens
guugaaaccaccguga

SEQ ID NO: 1471152 - RNA, 15 nt, Homo sapiens
guugaaagaucaaaa

SEQ ID NO: 1471153 - RNA, 17 nt, Homo sapiens
guugaaaggccucaaga

SEQ ID NO: 1471154 - RNA, 19 nt, Homo sapiens
guugagaguugcuggugua

SEQ ID NO: 1471155 - RNA, 22 nt, Homo sapiens
guugagauuuuuaagaacuuca

SEQ ID NO: 1471156 - RNA, 16 nt, Homo sapiens
guugagcuauugcugu

SEQ ID NO: 1471157 - RNA, 16 nt, Homo sapiens
guugaggcugucacag

SEQ ID NO: 1471158 - RNA, 22 nt, Homo sapiens
guugauggaaauacacuguuau

SEQ ID NO: 1471159 - RNA, 19 nt, Homo sapiens
guugaugggggccaggaca

SEQ ID NO: 1471160 - RNA, 18 nt, Homo sapiens
guugauuuuaaugaaugc

SEQ ID NO: 1471161 - RNA, 19 nt, Homo sapiens
guugcaccaggcacugcug

SEQ ID NO: 1471162 - RNA, 14 nt, Homo sapiens
guugccacauuuag

SEQ ID NO: 1471163 - RNA, 18 nt, Homo sapiens
guugcucaaaucuauuca

SEQ ID NO: 1471164 - RNA, 22 nt, Homo sapiens
guugcucaaaucuauucagaca

SEQ ID NO: 1471165 - RNA, 21 nt, Homo sapiens
guugcucagcuccuaccucug

SEQ ID NO: 1471166 - RNA, 18 nt, Homo sapiens
guugcuuuugugaacuuu

SEQ ID NO: 1471167 - RNA, 22 nt, Homo sapiens
guuggaaccguguccagcacag

SEQ ID NO: 1471168 - RNA, 21 nt, Homo sapiens
guuggacuguaagggauugaa

SEQ ID NO: 1471169 - RNA, 21 nt, Homo sapiens
guuggccgugguccagcucuu

SEQ ID NO: 1471170 - RNA, 18 nt, Homo sapiens
guuggccugcacuggugu

SEQ ID NO: 1471171 - RNA, 15 nt, Homo sapiens
guugggagcacugga

SEQ ID NO: 1471172 - RNA, 14 nt, Homo sapiens
guugguucaucccu

SEQ ID NO: 1471173 - RNA, 19 nt, Homo sapiens
guugguucuuagaccucaa

SEQ ID NO: 1471174 - RNA, 19 nt, Homo sapiens
guuguaacuaggcucagag

SEQ ID NO: 1471175 - RNA, 19 nt, Homo sapiens
guugucucuagagcaggga

SEQ ID NO: 1471176 - RNA, 21 nt, Homo sapiens
guugucugaagucacugcaca

SEQ ID NO: 1471177 - RNA, 19 nt, Homo sapiens
guuguuaaugaaaauguca

SEQ ID NO: 1471178 - RNA, 20 nt, Homo sapiens
guuguuaaugaaaaugucag

SEQ ID NO: 1471179 - RNA, 18 nt, Homo sapiens
guuguugaggcugucaca

SEQ ID NO: 1471180 - RNA, 18 nt, Homo sapiens
guuguuuuauauguugcu

SEQ ID NO: 1471181 - RNA, 18 nt, Homo sapiens
guuuaagaaaaguauuuu

SEQ ID NO: 1471182 - RNA, 18 nt, Homo sapiens
guuuaauggguaugcuca

SEQ ID NO: 1471183 - RNA, 15 nt, Homo sapiens
guuuaccacuaacuc

SEQ ID NO: 1471184 - RNA, 23 nt, Homo sapiens
guuuagcauaguaccucugcuau

SEQ ID NO: 1471185 - RNA, 13 nt, Homo sapiens
guuuaucacacag

SEQ ID NO: 1471186 - RNA, 18 nt, Homo sapiens
guuuauccuuagcucaca

SEQ ID NO: 1471187 - RNA, 19 nt, Homo sapiens
guuuauuuaucagugacag

SEQ ID NO: 1471188 - RNA, 19 nt, Homo sapiens
guuucaccguguuagccag

SEQ ID NO: 1471189 - RNA, 16 nt, Homo sapiens
guuuccacagccugca

SEQ ID NO: 1471190 - RNA, 18 nt, Homo sapiens
guuuccaugguuaccuga

SEQ ID NO: 1471191 - RNA, 14 nt, Homo sapiens
guuucugcagcccu

SEQ ID NO: 1471192 - RNA, 15 nt, Homo sapiens
guuucuugugggcua

SEQ ID NO: 1471193 - RNA, 15 nt, Homo sapiens
agcccaaaacccagg

SEQ ID NO: 1471194 - RNA, 15 nt, Homo sapiens
agcccacacuugaga

SEQ ID NO: 1471195 - RNA, 23 nt, Homo sapiens
agcccacauuggauucaucagca

SEQ ID NO: 1471196 - RNA, 16 nt, Homo sapiens
agcccaccagacguca

SEQ ID NO: 1471197 - RNA, 18 nt, Homo sapiens
agcccagacucugagcug

SEQ ID NO: 1471198 - RNA, 14 nt, Homo sapiens
agcccagccuggga

SEQ ID NO: 1471199 - RNA, 19 nt, Homo sapiens
agcccagcugggucaggca

SEQ ID NO: 1471200 - RNA, 22 nt, Homo sapiens
agcccagcuuggcccuuuccuu

SEQ ID NO: 1471201 - RNA, 23 nt, Homo sapiens
agcccaguaacugcaccaacgag

SEQ ID NO: 1471202 - RNA, 16 nt, Homo sapiens
agcccauagccagcug

SEQ ID NO: 1471203 - RNA, 18 nt, Homo sapiens
agcccauccagucuccca

SEQ ID NO: 1471204 - RNA, 14 nt, Homo sapiens
agcccaugugcacc

SEQ ID NO: 1471205 - RNA, 19 nt, Homo sapiens
agccccagagggucagggu

SEQ ID NO: 1471206 - RNA, 18 nt, Homo sapiens
agccccagcagcccucaa

SEQ ID NO: 1471207 - RNA, 19 nt, Homo sapiens
agccccaggccucuguguc

SEQ ID NO: 1471208 - RNA, 16 nt, Homo sapiens
agccccggcaagccac

SEQ ID NO: 1471209 - RNA, 17 nt, Homo sapiens
agccccugggguggcca

SEQ ID NO: 1471210 - RNA, 13 nt, Homo sapiens
agcccgucucagu

SEQ ID NO: 1471211 - RNA, 23 nt, Homo sapiens
agcccuacauugugcugcaccug

SEQ ID NO: 1471212 - RNA, 18 nt, Homo sapiens
agcccugauguguccuca

SEQ ID NO: 1471213 - RNA, 15 nt, Homo sapiens
agcccugucugcuag

SEQ ID NO: 1471214 - RNA, 14 nt, Homo sapiens
agcccuguguccug

SEQ ID NO: 1471215 - RNA, 15 nt, Homo sapiens
agcccuugggcaguu

SEQ ID NO: 1471216 - RNA, 15 nt, Homo sapiens
agccgaaaagcuuuu

SEQ ID NO: 1471217 - RNA, 13 nt, Homo sapiens
agccgacucuggc

SEQ ID NO: 1471218 - RNA, 15 nt, Homo sapiens
agccgccauugccac

SEQ ID NO: 1471219 - RNA, 16 nt, Homo sapiens
agccgcugcacaucac

SEQ ID NO: 1471220 - RNA, 16 nt, Homo sapiens
agccggcuugauuucc

SEQ ID NO: 1471221 - RNA, 12 nt, Homo sapiens
agccuaacacgg

SEQ ID NO: 1471222 - RNA, 24 nt, Homo sapiens
agccuacaguuauguucagucaca

SEQ ID NO: 1471223 - RNA, 16 nt, Homo sapiens
agccuagcggagccca

SEQ ID NO: 1471224 - RNA, 19 nt, Homo sapiens
agccuauaggccaaugcau

SEQ ID NO: 1471225 - RNA, 14 nt, Homo sapiens
agccuauuuaccug

SEQ ID NO: 1471226 - RNA, 15 nt, Homo sapiens
agccuauuuaccugc

SEQ ID NO: 1471227 - RNA, 18 nt, Homo sapiens
agccucagaggagcucua

SEQ ID NO: 1471228 - RNA, 12 nt, Homo sapiens
agccuccaacac

SEQ ID NO: 1471229 - RNA, 14 nt, Homo sapiens
agccuccaccugau

SEQ ID NO: 1471230 - RNA, 16 nt, Homo sapiens
agccuccagguuuccu

SEQ ID NO: 1471231 - RNA, 18 nt, Homo sapiens
agccucccuucugccuug

SEQ ID NO: 1471232 - RNA, 23 nt, Homo sapiens
agccucucaccuggacuccagua

SEQ ID NO: 1471233 - RNA, 14 nt, Homo sapiens
agccucuccaggaa

SEQ ID NO: 1471234 - RNA, 14 nt, Homo sapiens
agccucuccuccau

SEQ ID NO: 1471235 - RNA, 17 nt, Homo sapiens
agccugagcagagacau

SEQ ID NO: 1471236 - RNA, 20 nt, Homo sapiens
agccugaggcagccacuucg

SEQ ID NO: 1471237 - RNA, 20 nt, Homo sapiens
agccugaugcugacauucac

SEQ ID NO: 1471238 - RNA, 23 nt, Homo sapiens
agccugcaaacucacugcucaag

SEQ ID NO: 1471239 - RNA, 16 nt, Homo sapiens
agccugccucccaagg

SEQ ID NO: 1471240 - RNA, 20 nt, Homo sapiens
agccugcucuagugggacag

SEQ ID NO: 1471241 - RNA, 14 nt, Homo sapiens
agccugcugcaugg

SEQ ID NO: 1471242 - RNA, 13 nt, Homo sapiens
agccugcuuucac

SEQ ID NO: 1471243 - RNA, 20 nt, Homo sapiens
agccugcuuugcuuuacugc

SEQ ID NO: 1471244 - RNA, 14 nt, Homo sapiens
agccuggccagaca

SEQ ID NO: 1471245 - RNA, 22 nt, Homo sapiens
agccuggccccaggccccagac

SEQ ID NO: 1471246 - RNA, 14 nt, Homo sapiens
agccugggggacag

SEQ ID NO: 1471247 - RNA, 16 nt, Homo sapiens
agccuggugcugcugc

SEQ ID NO: 1471248 - RNA, 13 nt, Homo sapiens
agccugguuuuuc

SEQ ID NO: 1471249 - RNA, 23 nt, Homo sapiens
agccugucccauggacacuccag

SEQ ID NO: 1471250 - RNA, 11 nt, Homo sapiens
agccuguguca

SEQ ID NO: 1471251 - RNA, 13 nt, Homo sapiens
agccuuaagccau

SEQ ID NO: 1471252 - RNA, 20 nt, Homo sapiens
agccuuauaaaccaaucuua

SEQ ID NO: 1471253 - RNA, 15 nt, Homo sapiens
agccuuccacaguga

SEQ ID NO: 1471254 - RNA, 20 nt, Homo sapiens
agccuuccacagugaaugug

SEQ ID NO: 1471255 - RNA, 16 nt, Homo sapiens
agccuucggacagaca

SEQ ID NO: 1471256 - RNA, 17 nt, Homo sapiens
agccuucugaugucucu

SEQ ID NO: 1471257 - RNA, 12 nt, Homo sapiens
agccuugcuugu

SEQ ID NO: 1471258 - RNA, 14 nt, Homo sapiens
agccuuugccuccc

SEQ ID NO: 1471259 - RNA, 14 nt, Homo sapiens
agccuuuugcucuc

SEQ ID NO: 1471260 - RNA, 22 nt, Homo sapiens
agcgaccgcccccuccucuagc

SEQ ID NO: 1471261 - RNA, 19 nt, Homo sapiens
agcgauccucccaccucag

SEQ ID NO: 1471262 - RNA, 16 nt, Homo sapiens
agcgcaugcuggugca

SEQ ID NO: 1471263 - RNA, 20 nt, Homo sapiens
agcgcauugagccaguggug

SEQ ID NO: 1471264 - RNA, 18 nt, Homo sapiens
agcgccaggcugaccaca

SEQ ID NO: 1471265 - RNA, 23 nt, Homo sapiens
agcggagaucgcaucauugcacu

SEQ ID NO: 1471266 - RNA, 17 nt, Homo sapiens
agcgggaggcagaguuu

SEQ ID NO: 1471267 - RNA, 15 nt, Homo sapiens
agcgggcacagggca

SEQ ID NO: 1471268 - RNA, 23 nt, Homo sapiens
agcggggccaccgcgacguugca

SEQ ID NO: 1471269 - RNA, 19 nt, Homo sapiens
agcguguuuacauguguag

SEQ ID NO: 1471270 - RNA, 20 nt, Homo sapiens
agcguuucuuuacuucucac

SEQ ID NO: 1471271 - RNA, 21 nt, Homo sapiens
agcuaaaccaaggacugagca

SEQ ID NO: 1471272 - RNA, 15 nt, Homo sapiens
agcuaaagaggcuga

SEQ ID NO: 1471273 - RNA, 19 nt, Homo sapiens
agcuaagugaaaaggucau

SEQ ID NO: 1471274 - RNA, 22 nt, Homo sapiens
agcuaauggcgaucaucuuugc

SEQ ID NO: 1471275 - RNA, 15 nt, Homo sapiens
agcuaauguaauaac

SEQ ID NO: 1471276 - RNA, 13 nt, Homo sapiens
agcuacagcuuuc

SEQ ID NO: 1471277 - RNA, 18 nt, Homo sapiens
agcuacagcuuucuugcu

SEQ ID NO: 1471278 - RNA, 21 nt, Homo sapiens
agcuacagucuaaaauugcuu

SEQ ID NO: 1471279 - RNA, 13 nt, Homo sapiens
agcuaccaggugu

SEQ ID NO: 1471280 - RNA, 14 nt, Homo sapiens
agcuacucucccca

SEQ ID NO: 1471281 - RNA, 13 nt, Homo sapiens
agcuacugaugaa

SEQ ID NO: 1471282 - RNA, 23 nt, Homo sapiens
agcuagcaaauaguaaucuguaa

SEQ ID NO: 1471283 - RNA, 19 nt, Homo sapiens
agcuaucugucaucucucu

SEQ ID NO: 1471284 - RNA, 20 nt, Homo sapiens
agcuaugaagaaaacacaaa

SEQ ID NO: 1471285 - RNA, 21 nt, Homo sapiens
agcuauggcccagaaacaaca

SEQ ID NO: 1471286 - RNA, 16 nt, Homo sapiens
acacaccuccgagaca

SEQ ID NO: 1471287 - RNA, 20 nt, Homo sapiens
acacagcaagacuccgucuc

SEQ ID NO: 1471288 - RNA, 17 nt, Homo sapiens
acacagcuacagcuuuc

SEQ ID NO: 1471289 - RNA, 13 nt, Homo sapiens
acacagcuguucu

SEQ ID NO: 1471290 - RNA, 14 nt, Homo sapiens
acacaggcacgggu

SEQ ID NO: 1471291 - RNA, 19 nt, Homo sapiens
acacaguuguaggguuaca

SEQ ID NO: 1471292 - RNA, 22 nt, Homo sapiens
acacauucccccaccagcugca

SEQ ID NO: 1471293 - RNA, 20 nt, Homo sapiens
acacauuccugcauucaugu

SEQ ID NO: 1471294 - RNA, 17 nt, Homo sapiens
acacauuggaaugccuu

SEQ ID NO: 1471295 - RNA, 16 nt, Homo sapiens
acaccaaaaaugaugc

SEQ ID NO: 1471296 - RNA, 18 nt, Homo sapiens
acaccaaauuuuucuauc

SEQ ID NO: 1471297 - RNA, 16 nt, Homo sapiens
acaccacaccaucagg

SEQ ID NO: 1471298 - RNA, 17 nt, Homo sapiens
acaccacgguagugccu

SEQ ID NO: 1471299 - RNA, 21 nt, Homo sapiens
acaccacgguagugccugaaa

SEQ ID NO: 1471300 - RNA, 22 nt, Homo sapiens
acaccagagcagaugcagagag

SEQ ID NO: 1471301 - RNA, 23 nt, Homo sapiens
acaccagccauacuuaucucucu

SEQ ID NO: 1471302 - RNA, 23 nt, Homo sapiens
acacccaaguugaagacuuuguu

SEQ ID NO: 1471303 - RNA, 19 nt, Homo sapiens
acacccagucuguucccca

SEQ ID NO: 1471304 - RNA, 21 nt, Homo sapiens
acacccagugggaagagugug

SEQ ID NO: 1471305 - RNA, 23 nt, Homo sapiens
acaccccugcucuacccaugagc

SEQ ID NO: 1471306 - RNA, 17 nt, Homo sapiens
acacccgacuccucaaa

SEQ ID NO: 1471307 - RNA, 16 nt, Homo sapiens
acaccgcugcacucaa

SEQ ID NO: 1471308 - RNA, 15 nt, Homo sapiens
acaccuacucuauca

SEQ ID NO: 1471309 - RNA, 23 nt, Homo sapiens
acaccucaguucccuuggccuca

SEQ ID NO: 1471310 - RNA, 19 nt, Homo sapiens
acaccuccgagacagucca

SEQ ID NO: 1471311 - RNA, 16 nt, Homo sapiens
acaccugacacaucuu

SEQ ID NO: 1471312 - RNA, 14 nt, Homo sapiens
acaccugcugagaa

SEQ ID NO: 1471313 - RNA, 18 nt, Homo sapiens
acaccuuuuauugacaca

SEQ ID NO: 1471314 - RNA, 15 nt, Homo sapiens
acaccuuuuccccaa

SEQ ID NO: 1471315 - RNA, 18 nt, Homo sapiens
acacgcacuggugccaaa

SEQ ID NO: 1471316 - RNA, 13 nt, Homo sapiens
acacggcacauuu

SEQ ID NO: 1471317 - RNA, 20 nt, Homo sapiens
acacggccucccucugcuac

SEQ ID NO: 1471318 - RNA, 15 nt, Homo sapiens
acacuaacauauaau

SEQ ID NO: 1471319 - RNA, 19 nt, Homo sapiens
acacuaaugcagccacgau

SEQ ID NO: 1471320 - RNA, 18 nt, Homo sapiens
acacuagaaaacuugacu

SEQ ID NO: 1471321 - RNA, 17 nt, Homo sapiens
acacuagccugugcacg

SEQ ID NO: 1471322 - RNA, 19 nt, Homo sapiens
acacucaucuuagugccug

SEQ ID NO: 1471323 - RNA, 12 nt, Homo sapiens
acacuccaugag

SEQ ID NO: 1471324 - RNA, 12 nt, Homo sapiens
acacucucugga

SEQ ID NO: 1471325 - RNA, 20 nt, Homo sapiens
acacucucuggaagcccugg

SEQ ID NO: 1471326 - RNA, 21 nt, Homo sapiens
acacugaaaaaucuaagugau

SEQ ID NO: 1471327 - RNA, 17 nt, Homo sapiens
acacugagauauucagc

SEQ ID NO: 1471328 - RNA, 18 nt, Homo sapiens
acacugagauauucagcc

SEQ ID NO: 1471329 - RNA, 21 nt, Homo sapiens
acacugaggagagauucccgc

SEQ ID NO: 1471330 - RNA, 16 nt, Homo sapiens
acacugaugcuuagau

SEQ ID NO: 1471331 - RNA, 21 nt, Homo sapiens
acacugcacagggaaaauugc

SEQ ID NO: 1471332 - RNA, 13 nt, Homo sapiens
acacugcacuguu

SEQ ID NO: 1471333 - RNA, 12 nt, Homo sapiens
acacugcugcuc

SEQ ID NO: 1471334 - RNA, 22 nt, Homo sapiens
acacugcugcuccagugcagga

SEQ ID NO: 1471335 - RNA, 21 nt, Homo sapiens
acacuggcguuacugcuugac

SEQ ID NO: 1471336 - RNA, 19 nt, Homo sapiens
acacugucacuagucucac

SEQ ID NO: 1471337 - RNA, 17 nt, Homo sapiens
acacuucugacuucacu

SEQ ID NO: 1471338 - RNA, 24 nt, Homo sapiens
acacuugcucccaacccauucacu

SEQ ID NO: 1471339 - RNA, 22 nt, Homo sapiens
acagaaauggggaauucucuaa

SEQ ID NO: 1471340 - RNA, 21 nt, Homo sapiens
acagaacuucagaaagacuug

SEQ ID NO: 1471341 - RNA, 21 nt, Homo sapiens
acagaagccugaugcugacau

SEQ ID NO: 1471342 - RNA, 20 nt, Homo sapiens
acagaagccuggacucugcc

SEQ ID NO: 1471343 - RNA, 20 nt, Homo sapiens
acagaaggaaucugugcaga

SEQ ID NO: 1471344 - RNA, 20 nt, Homo sapiens
acagaauguuuuacugugaa

SEQ ID NO: 1471345 - RNA, 14 nt, Homo sapiens
acagaauuugucag

SEQ ID NO: 1471346 - RNA, 16 nt, Homo sapiens
acagacacaauaugua

SEQ ID NO: 1471347 - RNA, 18 nt, Homo sapiens
acagaccacaucuuuauc

SEQ ID NO: 1471348 - RNA, 15 nt, Homo sapiens
acagaccaccugcuu

SEQ ID NO: 1471349 - RNA, 20 nt, Homo sapiens
acagaccuaggauuucauga

SEQ ID NO: 1471350 - RNA, 12 nt, Homo sapiens
acagacgugugc

SEQ ID NO: 1471351 - RNA, 16 nt, Homo sapiens
acagacugauguguau

SEQ ID NO: 1471352 - RNA, 19 nt, Homo sapiens
acagacuucaucauugugc

SEQ ID NO: 1471353 - RNA, 17 nt, Homo sapiens
acagacuucuccagacc

SEQ ID NO: 1471354 - RNA, 23 nt, Homo sapiens
acagagaagcggauuuccaggga

SEQ ID NO: 1471355 - RNA, 22 nt, Homo sapiens
acagagauuggagagaagggca

SEQ ID NO: 1471356 - RNA, 20 nt, Homo sapiens
acagagcaagacuccaucuc

SEQ ID NO: 1471357 - RNA, 20 nt, Homo sapiens
acagagcaagacucugucuc

SEQ ID NO: 1471358 - RNA, 20 nt, Homo sapiens
acagagcgagacuccgucuc

SEQ ID NO: 1471359 - RNA, 20 nt, Homo sapiens
acagagcgagauuccgucuu

SEQ ID NO: 1471360 - RNA, 20 nt, Homo sapiens
acagaggagcuuuucuggaa

SEQ ID NO: 1471361 - RNA, 15 nt, Homo sapiens
acagaggcgaaggca

SEQ ID NO: 1471362 - RNA, 16 nt, Homo sapiens
acagaguagaaacuca

SEQ ID NO: 1471363 - RNA, 17 nt, Homo sapiens
acagagugcauugugag

SEQ ID NO: 1471364 - RNA, 16 nt, Homo sapiens
acagauggauuugccu

SEQ ID NO: 1471365 - RNA, 18 nt, Homo sapiens
acagcaaccccaggcuga

SEQ ID NO: 1471366 - RNA, 15 nt, Homo sapiens
acagcagaacuucug

SEQ ID NO: 1471367 - RNA, 18 nt, Homo sapiens
acagcagauuucagauca

SEQ ID NO: 1471368 - RNA, 15 nt, Homo sapiens
acagcagccuggggc

SEQ ID NO: 1471369 - RNA, 18 nt, Homo sapiens
acagcagcugaacagcca

SEQ ID NO: 1471370 - RNA, 15 nt, Homo sapiens
acagcagucagggac

SEQ ID NO: 1471371 - RNA, 18 nt, Homo sapiens
acagcagucccaguauuc

SEQ ID NO: 1471372 - RNA, 21 nt, Homo sapiens
acagcagucccaguauucuca

SEQ ID NO: 1471373 - RNA, 17 nt, Homo sapiens
acagcaguguucucaca

SEQ ID NO: 1471374 - RNA, 17 nt, Homo sapiens
agaccuuuggagcaaag

SEQ ID NO: 1471375 - RNA, 22 nt, Homo sapiens
agacggcggccaggcacagggc

SEQ ID NO: 1471376 - RNA, 24 nt, Homo sapiens
agacuacaguuguguuagccucuu

SEQ ID NO: 1471377 - RNA, 23 nt, Homo sapiens
agacuagaaaauuagacugugau

SEQ ID NO: 1471378 - RNA, 15 nt, Homo sapiens
agacuagauugccuu

SEQ ID NO: 1471379 - RNA, 21 nt, Homo sapiens
agacuauggugcugccuugcu

SEQ ID NO: 1471380 - RNA, 22 nt, Homo sapiens
agacucaccucauccuuaccgc

SEQ ID NO: 1471381 - RNA, 16 nt, Homo sapiens
agacucagccaagaca

SEQ ID NO: 1471382 - RNA, 13 nt, Homo sapiens
agacucugagaug

SEQ ID NO: 1471383 - RNA, 15 nt, Homo sapiens
agacugacaaccuca

SEQ ID NO: 1471384 - RNA, 17 nt, Homo sapiens
agacugacaaccucauc

SEQ ID NO: 1471385 - RNA, 20 nt, Homo sapiens
agacugcaguggacaguccc

SEQ ID NO: 1471386 - RNA, 18 nt, Homo sapiens
agacugcuaaguaggggc

SEQ ID NO: 1471387 - RNA, 14 nt, Homo sapiens
agcacgcugaaggc

SEQ ID NO: 1471388 - RNA, 15 nt, Homo sapiens
agcacggacucuuac

SEQ ID NO: 1471389 - RNA, 15 nt, Homo sapiens
agcacgugucucaga

SEQ ID NO: 1471390 - RNA, 17 nt, Homo sapiens
agcacuacaccuugccu

SEQ ID NO: 1471391 - RNA, 19 nt, Homo sapiens
agcacuauguggagcucag

SEQ ID NO: 1471392 - RNA, 21 nt, Homo sapiens
agcacugaggguggcacucaa

SEQ ID NO: 1471393 - RNA, 11 nt, Homo sapiens
agcacugugag

SEQ ID NO: 1471394 - RNA, 22 nt, Homo sapiens
agcacuuacagcucuggccaca

SEQ ID NO: 1471395 - RNA, 15 nt, Homo sapiens
agcagaaacuuuaca

SEQ ID NO: 1471396 - RNA, 17 nt, Homo sapiens
agcagacacacaugggc

SEQ ID NO: 1471397 - RNA, 14 nt, Homo sapiens
agcagacucuggag

SEQ ID NO: 1471398 - RNA, 22 nt, Homo sapiens
agcagaggaggggaaaguccag

SEQ ID NO: 1471399 - RNA, 16 nt, Homo sapiens
agcagauaacaaugca

SEQ ID NO: 1471400 - RNA, 20 nt, Homo sapiens
agcagcaccaaccacagcau

SEQ ID NO: 1471401 - RNA, 21 nt, Homo sapiens
agcagcaccguucugugcaca

SEQ ID NO: 1471402 - RNA, 18 nt, Homo sapiens
agcagcagaccuccuagc

SEQ ID NO: 1471403 - RNA, 13 nt, Homo sapiens
agcagccacgagg

SEQ ID NO: 1471404 - RNA, 14 nt, Homo sapiens
agcagccccgggag

SEQ ID NO: 1471405 - RNA, 14 nt, Homo sapiens
agcagcccugucac

SEQ ID NO: 1471406 - RNA, 23 nt, Homo sapiens
agcagccucuggacagccaguga

SEQ ID NO: 1471407 - RNA, 23 nt, Homo sapiens
agcagccuuucucucuuuauaca

SEQ ID NO: 1471408 - RNA, 15 nt, Homo sapiens
agcagcgccagugac

SEQ ID NO: 1471409 - RNA, 14 nt, Homo sapiens
agcaggcacccacu

SEQ ID NO: 1471410 - RNA, 18 nt, Homo sapiens
agcaggccuaagacaugu

SEQ ID NO: 1471411 - RNA, 24 nt, Homo sapiens
agcaggcuuucaagaagugccagu

SEQ ID NO: 1471412 - RNA, 18 nt, Homo sapiens
agcagggauuaaccucug

SEQ ID NO: 1471413 - RNA, 16 nt, Homo sapiens
agcaggguacccuuug

SEQ ID NO: 1471414 - RNA, 22 nt, Homo sapiens
agcaggugcugacuucaucucc

SEQ ID NO: 1471415 - RNA, 20 nt, Homo sapiens
agcagguucccaagcucaga

SEQ ID NO: 1471416 - RNA, 13 nt, Homo sapiens
agcagugaugaaa

SEQ ID NO: 1471417 - RNA, 17 nt, Homo sapiens
agcagugucuuccauaa

SEQ ID NO: 1471418 - RNA, 22 nt, Homo sapiens
agcagugucuuccauaauguau

SEQ ID NO: 1471419 - RNA, 21 nt, Homo sapiens
agcaguguucucacagugugg

SEQ ID NO: 1471420 - RNA, 19 nt, Homo sapiens
agcaguguugcucagcucc

SEQ ID NO: 1471421 - RNA, 23 nt, Homo sapiens
agcaguuacaaaaaccuucccca

SEQ ID NO: 1471422 - RNA, 21 nt, Homo sapiens
agcaguugaaacaagaagcca

SEQ ID NO: 1471423 - RNA, 21 nt, Homo sapiens
agcaguuuaugagacagcuga

SEQ ID NO: 1471424 - RNA, 22 nt, Homo sapiens
agcaguuugcuuuguaugcacu

SEQ ID NO: 1471425 - RNA, 19 nt, Homo sapiens
agcauaaauaaaacugaau

SEQ ID NO: 1471426 - RNA, 17 nt, Homo sapiens
agcauaagcuuaugcuu

SEQ ID NO: 1471427 - RNA, 18 nt, Homo sapiens
agcauaaguuucugggac

SEQ ID NO: 1471428 - RNA, 20 nt, Homo sapiens
agcauaguaccucugcuauu

SEQ ID NO: 1471429 - RNA, 17 nt, Homo sapiens
agcauauacugaagucu

SEQ ID NO: 1471430 - RNA, 19 nt, Homo sapiens
agcauauuuuaaugcaguu

SEQ ID NO: 1471431 - RNA, 13 nt, Homo sapiens
agcauccaugugu

SEQ ID NO: 1471432 - RNA, 21 nt, Homo sapiens
agcauccuggccaacauggug

SEQ ID NO: 1471433 - RNA, 19 nt, Homo sapiens
agcaucgggagcacccaga

SEQ ID NO: 1471434 - RNA, 15 nt, Homo sapiens
agcaucucaggagau

SEQ ID NO: 1471435 - RNA, 16 nt, Homo sapiens
agcaugauauuuacug

SEQ ID NO: 1471436 - RNA, 15 nt, Homo sapiens
agcaugaugagaguu

SEQ ID NO: 1471437 - RNA, 19 nt, Homo sapiens
agcaugaugggaauaggga

SEQ ID NO: 1471438 - RNA, 23 nt, Homo sapiens
agcaugcuucccagagggagcag

SEQ ID NO: 1471439 - RNA, 13 nt, Homo sapiens
agcaugugucaga

SEQ ID NO: 1471440 - RNA, 20 nt, Homo sapiens
agcauuagcuggcgcauauu

SEQ ID NO: 1471441 - RNA, 22 nt, Homo sapiens
agcauuagcuggcgcauauuaa

SEQ ID NO: 1471442 - RNA, 17 nt, Homo sapiens
agcauuagucacuuuga

SEQ ID NO: 1471443 - RNA, 14 nt, Homo sapiens
agcauugagcauaa

SEQ ID NO: 1471444 - RNA, 18 nt, Homo sapiens
agcauuuccaacaccaca

SEQ ID NO: 1471445 - RNA, 16 nt, Homo sapiens
agcauuucuagcagug

SEQ ID NO: 1471446 - RNA, 22 nt, Homo sapiens
agcauuucuagcagugaugaaa

SEQ ID NO: 1471447 - RNA, 13 nt, Homo sapiens
agcauuugcaaca

SEQ ID NO: 1471448 - RNA, 18 nt, Homo sapiens
agcauuuuuaauuuucac

SEQ ID NO: 1471449 - RNA, 23 nt, Homo sapiens
agcauuuuuaauuuucacaaaau

SEQ ID NO: 1471450 - RNA, 16 nt, Homo sapiens
agccaaauaaaaucua

SEQ ID NO: 1471451 - RNA, 20 nt, Homo sapiens
agccaacacccugucuaaaa

SEQ ID NO: 1471452 - RNA, 12 nt, Homo sapiens
agccaaccucau

SEQ ID NO: 1471453 - RNA, 16 nt, Homo sapiens
agccaagaacgcaggg

SEQ ID NO: 1471454 - RNA, 20 nt, Homo sapiens
agccaagaucgcgccacugc

SEQ ID NO: 1471455 - RNA, 20 nt, Homo sapiens
agccaagaugacacaacugc

SEQ ID NO: 1471456 - RNA, 19 nt, Homo sapiens
agccaagccuuaaacugua

SEQ ID NO: 1471457 - RNA, 22 nt, Homo sapiens
agccaaggcaggcagaucacuu

SEQ ID NO: 1471458 - RNA, 15 nt, Homo sapiens
agccacaaccaaaaa

SEQ ID NO: 1471459 - RNA, 16 nt, Homo sapiens
agccacagaccaccug

SEQ ID NO: 1471460 - RNA, 19 nt, Homo sapiens
agccacagcagguccucca

SEQ ID NO: 1471461 - RNA, 19 nt, Homo sapiens
agccacaucccuuugaaac

SEQ ID NO: 1471462 - RNA, 20 nt, Homo sapiens
agccacauggccccauccca

SEQ ID NO: 1471463 - RNA, 14 nt, Homo sapiens
agccaccgcugcca

SEQ ID NO: 1471464 - RNA, 14 nt, Homo sapiens
agccacuucggcca

SEQ ID NO: 1471465 - RNA, 16 nt, Homo sapiens
agccagaggcaucuga

SEQ ID NO: 1471466 - RNA, 16 nt, Homo sapiens
agccagcaaugauguc

SEQ ID NO: 1471467 - RNA, 14 nt, Homo sapiens
agccaggacaucuc

SEQ ID NO: 1471468 - RNA, 18 nt, Homo sapiens
agccaggccaacagcacc

SEQ ID NO: 1471469 - RNA, 22 nt, Homo sapiens
agccaggccugggggcagccuc

SEQ ID NO: 1471470 - RNA, 18 nt, Homo sapiens
agccaggcugagugagcc

SEQ ID NO: 1471471 - RNA, 22 nt, Homo sapiens
agccagggggaugccacuccuc

SEQ ID NO: 1471472 - RNA, 22 nt, Homo sapiens
agccaggguggucuugaucucc

SEQ ID NO: 1471473 - RNA, 15 nt, Homo sapiens
agccagguaauguga

SEQ ID NO: 1471474 - RNA, 15 nt, Homo sapiens
agccaggugagcucu

SEQ ID NO: 1471475 - RNA, 18 nt, Homo sapiens
agccaggugagcucugac

SEQ ID NO: 1471476 - RNA, 12 nt, Homo sapiens
agccagugccau

SEQ ID NO: 1471477 - RNA, 16 nt, Homo sapiens
agccagugccauucca

SEQ ID NO: 1471478 - RNA, 15 nt, Homo sapiens
agaucaugucucacu

SEQ ID NO: 1471479 - RNA, 20 nt, Homo sapiens
agaucaugucucacuucaca

SEQ ID NO: 1471480 - RNA, 16 nt, Homo sapiens
agauccuggguacuga

SEQ ID NO: 1471481 - RNA, 14 nt, Homo sapiens
agaucgcaccacug

SEQ ID NO: 1471482 - RNA, 16 nt, Homo sapiens
agaucgcaccacugca

SEQ ID NO: 1471483 - RNA, 19 nt, Homo sapiens
agaucgcaccacugcacuc

SEQ ID NO: 1471484 - RNA, 19 nt, Homo sapiens
agaucgcaccauugcacuc

SEQ ID NO: 1471485 - RNA, 13 nt, Homo sapiens
agaucgcaucauu

SEQ ID NO: 1471486 - RNA, 20 nt, Homo sapiens
agaucgcgccacugcacucc

SEQ ID NO: 1471487 - RNA, 18 nt, Homo sapiens
agaucgugcuacugcacu

SEQ ID NO: 1471488 - RNA, 19 nt, Homo sapiens
agaucuggaaccucagccu

SEQ ID NO: 1471489 - RNA, 16 nt, Homo sapiens
agaucuucacucuggg

SEQ ID NO: 1471490 - RNA, 23 nt, Homo sapiens
agaucuuucaggacucuaccuca

SEQ ID NO: 1471491 - RNA, 20 nt, Homo sapiens
agaugaaggagaggcaacau

SEQ ID NO: 1471492 - RNA, 19 nt, Homo sapiens
agaugaaucauugauugaa

SEQ ID NO: 1471493 - RNA, 14 nt, Homo sapiens
agaugacaaccucc

SEQ ID NO: 1471494 - RNA, 20 nt, Homo sapiens
agaugacaaccuccauucua

SEQ ID NO: 1471495 - RNA, 19 nt, Homo sapiens
agaugacacaacugcacuc

SEQ ID NO: 1471496 - RNA, 19 nt, Homo sapiens
agaugacagggaaaacugc

SEQ ID NO: 1471497 - RNA, 14 nt, Homo sapiens
agaugagguucuga

SEQ ID NO: 1471498 - RNA, 15 nt, Homo sapiens
agaugaucauuugcc

SEQ ID NO: 1471499 - RNA, 17 nt, Homo sapiens
agaugauggaugccaau

SEQ ID NO: 1471500 - RNA, 18 nt, Homo sapiens
agaugauggcucauuuac

SEQ ID NO: 1471501 - RNA, 14 nt, Homo sapiens
agaugauuguucaa

SEQ ID NO: 1471502 - RNA, 15 nt, Homo sapiens
agaugauuguucaaa

SEQ ID NO: 1471503 - RNA, 15 nt, Homo sapiens
agaugcaaccucacu

SEQ ID NO: 1471504 - RNA, 19 nt, Homo sapiens
agaugcaaggaccaggacu

SEQ ID NO: 1471505 - RNA, 12 nt, Homo sapiens
agaugcacugaa

SEQ ID NO: 1471506 - RNA, 18 nt, Homo sapiens
agaugcacuuaugcagua

SEQ ID NO: 1471507 - RNA, 14 nt, Homo sapiens
agaugcagggcagu

SEQ ID NO: 1471508 - RNA, 14 nt, Homo sapiens
agaugcaucacugg

SEQ ID NO: 1471509 - RNA, 16 nt, Homo sapiens
agaugcaucacugggu

SEQ ID NO: 1471510 - RNA, 16 nt, Homo sapiens
agaugccagcuucucu

SEQ ID NO: 1471511 - RNA, 16 nt, Homo sapiens
agaugcccuuuggaaa

SEQ ID NO: 1471512 - RNA, 17 nt, Homo sapiens
agaugcuggacuugccu

SEQ ID NO: 1471513 - RNA, 15 nt, Homo sapiens
agaugcuugguugug

SEQ ID NO: 1471514 - RNA, 22 nt, Homo sapiens
agauggaaaaacugaggcuuag

SEQ ID NO: 1471515 - RNA, 19 nt, Homo sapiens
agauggaaaagaaauugca

SEQ ID NO: 1471516 - RNA, 19 nt, Homo sapiens
agauggaaugcuguguuaa

SEQ ID NO: 1471517 - RNA, 14 nt, Homo sapiens
agauggcacuuuga

SEQ ID NO: 1471518 - RNA, 13 nt, Homo sapiens
agauggggaggag

SEQ ID NO: 1471519 - RNA, 14 nt, Homo sapiens
agauggggcacuga

SEQ ID NO: 1471520 - RNA, 16 nt, Homo sapiens
agauggggcacugacc

SEQ ID NO: 1471521 - RNA, 21 nt, Homo sapiens
agauggggucucacaguguug

SEQ ID NO: 1471522 - RNA, 23 nt, Homo sapiens
agaugguggagauuggcaugcca

SEQ ID NO: 1471523 - RNA, 22 nt, Homo sapiens
agaugguguggguguccugccu

SEQ ID NO: 1471524 - RNA, 22 nt, Homo sapiens
agauguaagaaauguucuugca

SEQ ID NO: 1471525 - RNA, 18 nt, Homo sapiens
agaugucuuggaacauug

SEQ ID NO: 1471526 - RNA, 19 nt, Homo sapiens
agaugugaaaacaucucaa

SEQ ID NO: 1471527 - RNA, 14 nt, Homo sapiens
agauguuggaccaa

SEQ ID NO: 1471528 - RNA, 12 nt, Homo sapiens
agauuacccaaa

SEQ ID NO: 1471529 - RNA, 20 nt, Homo sapiens
agauuagaagacaacaggca

SEQ ID NO: 1471530 - RNA, 17 nt, Homo sapiens
agauuagguagacuuug

SEQ ID NO: 1471531 - RNA, 21 nt, Homo sapiens
agauuauauuggugguucuca

SEQ ID NO: 1471532 - RNA, 22 nt, Homo sapiens
agauucauuauuuuuccacuuu

SEQ ID NO: 1471533 - RNA, 21 nt, Homo sapiens
agauucuucaggcuuccugca

SEQ ID NO: 1471534 - RNA, 14 nt, Homo sapiens
agauugacuuugaa

SEQ ID NO: 1471535 - RNA, 20 nt, Homo sapiens
agauuggaccagacccugaa

SEQ ID NO: 1471536 - RNA, 16 nt, Homo sapiens
agauuuacuaaaucaa

SEQ ID NO: 1471537 - RNA, 17 nt, Homo sapiens
agauuuaugaugcacuu

SEQ ID NO: 1471538 - RNA, 18 nt, Homo sapiens
agauuuccuccuggccuu

SEQ ID NO: 1471539 - RNA, 16 nt, Homo sapiens
agauuugauauuugca

SEQ ID NO: 1471540 - RNA, 17 nt, Homo sapiens
agauuuuacaaaagagg

SEQ ID NO: 1471541 - RNA, 18 nt, Homo sapiens
agauuuuauuuauggaau

SEQ ID NO: 1471542 - RNA, 20 nt, Homo sapiens
agauuuucauguucuugcag

SEQ ID NO: 1471543 - RNA, 17 nt, Homo sapiens
agauuuuuaagaacuuc

SEQ ID NO: 1471544 - RNA, 18 nt, Homo sapiens
agauuuuuuuguguaugu

SEQ ID NO: 1471545 - RNA, 19 nt, Homo sapiens
agcaaaaacauguaugugc

SEQ ID NO: 1471546 - RNA, 21 nt, Homo sapiens
agcaaaaacauguaugugcau

SEQ ID NO: 1471547 - RNA, 13 nt, Homo sapiens
agcaaaaggcagc

SEQ ID NO: 1471548 - RNA, 12 nt, Homo sapiens
agcaaaaggcau

SEQ ID NO: 1471549 - RNA, 19 nt, Homo sapiens
agcaaaauugauguguuua

SEQ ID NO: 1471550 - RNA, 13 nt, Homo sapiens
agcaaacuuggaa

SEQ ID NO: 1471551 - RNA, 14 nt, Homo sapiens
agcaaagaagggaa

SEQ ID NO: 1471552 - RNA, 23 nt, Homo sapiens
agcaaaggggagucucagcuuuc

SEQ ID NO: 1471553 - RNA, 17 nt, Homo sapiens
agcaaauaaauaucauc

SEQ ID NO: 1471554 - RNA, 18 nt, Homo sapiens
agcaaauaguaaucugua

SEQ ID NO: 1471555 - RNA, 12 nt, Homo sapiens
agcaaaugacaa

SEQ ID NO: 1471556 - RNA, 15 nt, Homo sapiens
agcaacaagaccacc

SEQ ID NO: 1471557 - RNA, 14 nt, Homo sapiens
agcaaccacacgga

SEQ ID NO: 1471558 - RNA, 14 nt, Homo sapiens
agcaagacacaucc

SEQ ID NO: 1471559 - RNA, 17 nt, Homo sapiens
agcaaggcccugcugcc

SEQ ID NO: 1471560 - RNA, 21 nt, Homo sapiens
agcaagggcuugauggugaca

SEQ ID NO: 1471561 - RNA, 13 nt, Homo sapiens
agcaauaccaguu

SEQ ID NO: 1471562 - RNA, 22 nt, Homo sapiens
agcaauauaucugaagagcuau

SEQ ID NO: 1471563 - RNA, 19 nt, Homo sapiens
agcaaucaagguuauaauu

SEQ ID NO: 1471564 - RNA, 19 nt, Homo sapiens
agcaaugacaucucagggg

SEQ ID NO: 1471565 - RNA, 20 nt, Homo sapiens
agcaaugcaagcagccuagc

SEQ ID NO: 1471566 - RNA, 15 nt, Homo sapiens
agcaauggaguggcu

SEQ ID NO: 1471567 - RNA, 18 nt, Homo sapiens
agcaaugggacuggaguc

SEQ ID NO: 1471568 - RNA, 16 nt, Homo sapiens
agcaauucuccugccu

SEQ ID NO: 1471569 - RNA, 14 nt, Homo sapiens
agcacaccuaucuu

SEQ ID NO: 1471570 - RNA, 13 nt, Homo sapiens
agcacagaauuug

SEQ ID NO: 1471571 - RNA, 19 nt, Homo sapiens
agcacagaauuugucagaa

SEQ ID NO: 1471572 - RNA, 23 nt, Homo sapiens
agcacaggccauggugcacaaaa

SEQ ID NO: 1471573 - RNA, 18 nt, Homo sapiens
agcacauacuguguucca

SEQ ID NO: 1471574 - RNA, 14 nt, Homo sapiens
agcaccccaugcca

SEQ ID NO: 1471575 - RNA, 17 nt, Homo sapiens
agcaccguucugugcac

SEQ ID NO: 1471576 - RNA, 18 nt, Homo sapiens
agcaccguucugugcaca

SEQ ID NO: 1471577 - RNA, 21 nt, Homo sapiens
agcaccguucugugcacaaaa

SEQ ID NO: 1471578 - RNA, 18 nt, Homo sapiens
agcaccuccagccugaac

SEQ ID NO: 1471579 - RNA, 20 nt, Homo sapiens
agcaccuccccgcugggaag

SEQ ID NO: 1471580 - RNA, 20 nt, Homo sapiens
agacuggggacccuggacau

SEQ ID NO: 1471581 - RNA, 20 nt, Homo sapiens
agacugggucucgcuuuguu

SEQ ID NO: 1471582 - RNA, 21 nt, Homo sapiens
agacugggucucgcuuuguug

SEQ ID NO: 1471583 - RNA, 17 nt, Homo sapiens
agacugucagcuuccaa

SEQ ID NO: 1471584 - RNA, 19 nt, Homo sapiens
agacugucccugaaaccua

SEQ ID NO: 1471585 - RNA, 19 nt, Homo sapiens
agacugucucaagagggca

SEQ ID NO: 1471586 - RNA, 19 nt, Homo sapiens
agacuguggcuagugacaa

SEQ ID NO: 1471587 - RNA, 14 nt, Homo sapiens
agacuguugcucaa

SEQ ID NO: 1471588 - RNA, 18 nt, Homo sapiens
agagaaauccuuccuaaa

SEQ ID NO: 1471589 - RNA, 13 nt, Homo sapiens
agagaaauguguc

SEQ ID NO: 1471590 - RNA, 16 nt, Homo sapiens
agagaaaugugucauc

SEQ ID NO: 1471591 - RNA, 13 nt, Homo sapiens
agagaaauucugu

SEQ ID NO: 1471592 - RNA, 18 nt, Homo sapiens
agagaagcaaguaaaaag

SEQ ID NO: 1471593 - RNA, 13 nt, Homo sapiens
agagaagccaugg

SEQ ID NO: 1471594 - RNA, 12 nt, Homo sapiens
agagaagcugcu

SEQ ID NO: 1471595 - RNA, 12 nt, Homo sapiens
agagaaggcagg

SEQ ID NO: 1471596 - RNA, 23 nt, Homo sapiens
agagaauguguguguguggcagg

SEQ ID NO: 1471597 - RNA, 20 nt, Homo sapiens
agagaauucucuuauccaac

SEQ ID NO: 1471598 - RNA, 15 nt, Homo sapiens
agagaauuggcucaa

SEQ ID NO: 1471599 - RNA, 21 nt, Homo sapiens
agagacaggguuucacugugu

SEQ ID NO: 1471600 - RNA, 14 nt, Homo sapiens
agagaccuauguaa

SEQ ID NO: 1471601 - RNA, 22 nt, Homo sapiens
agagaccugagucugcaugugc

SEQ ID NO: 1471602 - RNA, 15 nt, Homo sapiens
agagacuccgucuca

SEQ ID NO: 1471603 - RNA, 12 nt, Homo sapiens
agagacuguaga

SEQ ID NO: 1471604 - RNA, 11 nt, Homo sapiens
agagacuucac

SEQ ID NO: 1471605 - RNA, 15 nt, Homo sapiens
agagagaaauucugu

SEQ ID NO: 1471606 - RNA, 18 nt, Homo sapiens
agagagacagacuugaga

SEQ ID NO: 1471607 - RNA, 20 nt, Homo sapiens
agagagcuuaaauugucauu

SEQ ID NO: 1471608 - RNA, 15 nt, Homo sapiens
agagaggcucugaga

SEQ ID NO: 1471609 - RNA, 18 nt, Homo sapiens
agagagggaccauguguc

SEQ ID NO: 1471610 - RNA, 22 nt, Homo sapiens
agagagucgcaucucagugcag

SEQ ID NO: 1471611 - RNA, 13 nt, Homo sapiens
agagaguggcucc

SEQ ID NO: 1471612 - RNA, 20 nt, Homo sapiens
agagaugacaaggagcacaa

SEQ ID NO: 1471613 - RNA, 16 nt, Homo sapiens
agagaugggacuagga

SEQ ID NO: 1471614 - RNA, 13 nt, Homo sapiens
agagcaagggcuu

SEQ ID NO: 1471615 - RNA, 17 nt, Homo sapiens
agagcacuuugcaacuc

SEQ ID NO: 1471616 - RNA, 14 nt, Homo sapiens
agagcagaugcaga

SEQ ID NO: 1471617 - RNA, 21 nt, Homo sapiens
agagcagcuccccaggagcuc

SEQ ID NO: 1471618 - RNA, 15 nt, Homo sapiens
agagccaagccuuaa

SEQ ID NO: 1471619 - RNA, 23 nt, Homo sapiens
agagccaggggggugaggagcug

SEQ ID NO: 1471620 - RNA, 20 nt, Homo sapiens
agagcccggcgccccugcca

SEQ ID NO: 1471621 - RNA, 17 nt, Homo sapiens
agagcccugugucugua

SEQ ID NO: 1471622 - RNA, 13 nt, Homo sapiens
agagcccuugccu

SEQ ID NO: 1471623 - RNA, 14 nt, Homo sapiens
agagcccuugccuc

SEQ ID NO: 1471624 - RNA, 19 nt, Homo sapiens
agagcccuugccuccccau

SEQ ID NO: 1471625 - RNA, 17 nt, Homo sapiens
agagccuggugcugcug

SEQ ID NO: 1471626 - RNA, 17 nt, Homo sapiens
agagccuuuugugcaaa

SEQ ID NO: 1471627 - RNA, 22 nt, Homo sapiens
agagcgaucucggcucacugca

SEQ ID NO: 1471628 - RNA, 13 nt, Homo sapiens
agagcugccagug

SEQ ID NO: 1471629 - RNA, 15 nt, Homo sapiens
agagcuuaaauuguc

SEQ ID NO: 1471630 - RNA, 20 nt, Homo sapiens
agagcuuuuaaaaauguccu

SEQ ID NO: 1471631 - RNA, 22 nt, Homo sapiens
agaggaauaacaucaccacugu

SEQ ID NO: 1471632 - RNA, 22 nt, Homo sapiens
agaggagugauugaaccagcuc

SEQ ID NO: 1471633 - RNA, 14 nt, Homo sapiens
agaggagugugaag

SEQ ID NO: 1471634 - RNA, 17 nt, Homo sapiens
agaggauaagccacugg

SEQ ID NO: 1471635 - RNA, 21 nt, Homo sapiens
agaggaugaauguaugugcac

SEQ ID NO: 1471636 - RNA, 20 nt, Homo sapiens
agaggcagcuucaagugccu

SEQ ID NO: 1471637 - RNA, 20 nt, Homo sapiens
agaggcgcccuggguggugg

SEQ ID NO: 1471638 - RNA, 17 nt, Homo sapiens
agaggcugccccucuca

SEQ ID NO: 1471639 - RNA, 14 nt, Homo sapiens
agaggcugugucag

SEQ ID NO: 1471640 - RNA, 16 nt, Homo sapiens
agagggagagcagaga

SEQ ID NO: 1471641 - RNA, 13 nt, Homo sapiens
agagggaugcuug

SEQ ID NO: 1471642 - RNA, 17 nt, Homo sapiens
agagggcccagcccaga

SEQ ID NO: 1471643 - RNA, 16 nt, Homo sapiens
agagggccucaaucuc

SEQ ID NO: 1471644 - RNA, 23 nt, Homo sapiens
agagggguggaguuuuaacugua

SEQ ID NO: 1471645 - RNA, 18 nt, Homo sapiens
agagggucucgcugucac

SEQ ID NO: 1471646 - RNA, 21 nt, Homo sapiens
agagguaaaagugugagcagu

SEQ ID NO: 1471647 - RNA, 18 nt, Homo sapiens
agagguuaaggugcaaua

SEQ ID NO: 1471648 - RNA, 20 nt, Homo sapiens
agaguaaaccuugaagggcu

SEQ ID NO: 1471649 - RNA, 17 nt, Homo sapiens
agaguagaacagauaau

SEQ ID NO: 1471650 - RNA, 16 nt, Homo sapiens
agaguauaugcacuuu

SEQ ID NO: 1471651 - RNA, 21 nt, Homo sapiens
agagucauauugcccaguggu

SEQ ID NO: 1471652 - RNA, 18 nt, Homo sapiens
agagugaaaccaugacug

SEQ ID NO: 1471653 - RNA, 20 nt, Homo sapiens
agagugagaccccaucucua

SEQ ID NO: 1471654 - RNA, 20 nt, Homo sapiens
agagugagagacaucaucaa

SEQ ID NO: 1471655 - RNA, 19 nt, Homo sapiens
agagugauugcagcuuuau

SEQ ID NO: 1471656 - RNA, 23 nt, Homo sapiens
agagugccguaacaacugugguc

SEQ ID NO: 1471657 - RNA, 20 nt, Homo sapiens
agaguggcugcaccacuucc

SEQ ID NO: 1471658 - RNA, 17 nt, Homo sapiens
agagugugaaacuuccu

SEQ ID NO: 1471659 - RNA, 19 nt, Homo sapiens
agaguuagguugucuccag

SEQ ID NO: 1471660 - RNA, 23 nt, Homo sapiens
agauaaaagaaccgagcaauuuu

SEQ ID NO: 1471661 - RNA, 15 nt, Homo sapiens
agauaaaauguguaa

SEQ ID NO: 1471662 - RNA, 13 nt, Homo sapiens
agauaaagaccuu

SEQ ID NO: 1471663 - RNA, 22 nt, Homo sapiens
agauaaauagaacuaucugcau

SEQ ID NO: 1471664 - RNA, 22 nt, Homo sapiens
agauaaguuugcaguuggcuaa

SEQ ID NO: 1471665 - RNA, 16 nt, Homo sapiens
agauaauaucugugag

SEQ ID NO: 1471666 - RNA, 12 nt, Homo sapiens
agauaaucagug

SEQ ID NO: 1471667 - RNA, 18 nt, Homo sapiens
agauaaucagugugucua

SEQ ID NO: 1471668 - RNA, 21 nt, Homo sapiens
agauaauuuauuaaagguggu

SEQ ID NO: 1471669 - RNA, 23 nt, Homo sapiens
agauagcaucagaccugcauuga

SEQ ID NO: 1471670 - RNA, 23 nt, Homo sapiens
agauaggaaacugaagcauaaag

SEQ ID NO: 1471671 - RNA, 15 nt, Homo sapiens
agauagguaaauacc

SEQ ID NO: 1471672 - RNA, 18 nt, Homo sapiens
agauagguggugccagug

SEQ ID NO: 1471673 - RNA, 14 nt, Homo sapiens
agauauacauauca

SEQ ID NO: 1471674 - RNA, 23 nt, Homo sapiens
agauauaucccggaugaggcuga

SEQ ID NO: 1471675 - RNA, 18 nt, Homo sapiens
agauauuaaaugauguuu

SEQ ID NO: 1471676 - RNA, 16 nt, Homo sapiens
agaucacgagaucaag

SEQ ID NO: 1471677 - RNA, 15 nt, Homo sapiens
agaucauauuucaca

SEQ ID NO: 1471678 - RNA, 14 nt, Homo sapiens
agaucaucagucac

SEQ ID NO: 1471679 - RNA, 15 nt, Homo sapiens
agaucaucagucacc

SEQ ID NO: 1471680 - RNA, 18 nt, Homo sapiens
agaucaugaaaguccagc

SEQ ID NO: 1471681 - RNA, 17 nt, Homo sapiens
aauguaacugugccagu

SEQ ID NO: 1471682 - RNA, 13 nt, Homo sapiens
aauguacaauuaa

SEQ ID NO: 1471683 - RNA, 15 nt, Homo sapiens
aauguaugauuacau

SEQ ID NO: 1471684 - RNA, 20 nt, Homo sapiens
aauguauuguaaucuuucau

SEQ ID NO: 1471685 - RNA, 20 nt, Homo sapiens
aauguauuuguuugcaauuu

SEQ ID NO: 1471686 - RNA, 19 nt, Homo sapiens
aaugucaaacagugccaaa

SEQ ID NO: 1471687 - RNA, 17 nt, Homo sapiens
aaugucagaacagagug

SEQ ID NO: 1471688 - RNA, 14 nt, Homo sapiens
aaugucauagguaa

SEQ ID NO: 1471689 - RNA, 13 nt, Homo sapiens
aaugucuaagaua

SEQ ID NO: 1471690 - RNA, 19 nt, Homo sapiens
aaugucuaucaacuuuaau

SEQ ID NO: 1471691 - RNA, 15 nt, Homo sapiens
aaugucucacuguuc

SEQ ID NO: 1471692 - RNA, 23 nt, Homo sapiens
aaugucucacuguucugcaaagg

SEQ ID NO: 1471693 - RNA, 14 nt, Homo sapiens
aaugugaacacugg

SEQ ID NO: 1471694 - RNA, 16 nt, Homo sapiens
aaugugaacacuggca

SEQ ID NO: 1471695 - RNA, 16 nt, Homo sapiens
aaugugaaggcccaag

SEQ ID NO: 1471696 - RNA, 19 nt, Homo sapiens
aaugugacccccaaguccu

SEQ ID NO: 1471697 - RNA, 14 nt, Homo sapiens
aauguggauuugau

SEQ ID NO: 1471698 - RNA, 23 nt, Homo sapiens
aaugugguuacuuccuacuguag

SEQ ID NO: 1471699 - RNA, 12 nt, Homo sapiens
aaugugucacua

SEQ ID NO: 1471700 - RNA, 22 nt, Homo sapiens
aauguguuuuaucacuucauuc

SEQ ID NO: 1471701 - RNA, 18 nt, Homo sapiens
aauguuacauuauuauca

SEQ ID NO: 1471702 - RNA, 19 nt, Homo sapiens
aauguuacugaucaugcau

SEQ ID NO: 1471703 - RNA, 23 nt, Homo sapiens
aauguuaguauuuuaauccugua

SEQ ID NO: 1471704 - RNA, 18 nt, Homo sapiens
aauguuaugacuauguaa

SEQ ID NO: 1471705 - RNA, 16 nt, Homo sapiens
aauguucacauaguga

SEQ ID NO: 1471706 - RNA, 13 nt, Homo sapiens
aauguucugacau

SEQ ID NO: 1471707 - RNA, 12 nt, Homo sapiens
aauguugccagc

SEQ ID NO: 1471708 - RNA, 20 nt, Homo sapiens
aauguuuaaagaucaugaca

SEQ ID NO: 1471709 - RNA, 23 nt, Homo sapiens
aauguuuaaguauuaacuuacaa

SEQ ID NO: 1471710 - RNA, 14 nt, Homo sapiens
aauguuuacacucu

SEQ ID NO: 1471711 - RNA, 16 nt, Homo sapiens
aauuaaaauuuaucuu

SEQ ID NO: 1471712 - RNA, 21 nt, Homo sapiens
aauuaacagagauugaacucc

SEQ ID NO: 1471713 - RNA, 17 nt, Homo sapiens
aauuaaccuggugcugg

SEQ ID NO: 1471714 - RNA, 18 nt, Homo sapiens
aauuaauauucauauuau

SEQ ID NO: 1471715 - RNA, 13 nt, Homo sapiens
aauuaaucacaaa

SEQ ID NO: 1471716 - RNA, 12 nt, Homo sapiens
aauuacuggaau

SEQ ID NO: 1471717 - RNA, 15 nt, Homo sapiens
aauuacuguguaaau

SEQ ID NO: 1471718 - RNA, 21 nt, Homo sapiens
aauuagcugugugaaauacca

SEQ ID NO: 1471719 - RNA, 14 nt, Homo sapiens
aauuagggcccaau

SEQ ID NO: 1471720 - RNA, 14 nt, Homo sapiens
aauuauaguuucaa

SEQ ID NO: 1471721 - RNA, 14 nt, Homo sapiens
aauuauggcauuuu

SEQ ID NO: 1471722 - RNA, 21 nt, Homo sapiens
aauuauuauuaucacauuuac

SEQ ID NO: 1471723 - RNA, 21 nt, Homo sapiens
aauuauuauuuauauauguau

SEQ ID NO: 1471724 - RNA, 22 nt, Homo sapiens
aauuauuuaugugaaagucaaa

SEQ ID NO: 1471725 - RNA, 13 nt, Homo sapiens
aauucaaacuggg

SEQ ID NO: 1471726 - RNA, 21 nt, Homo sapiens
aauucaacccagccaugcaau

SEQ ID NO: 1471727 - RNA, 16 nt, Homo sapiens
aauucaauccuacuuu

SEQ ID NO: 1471728 - RNA, 21 nt, Homo sapiens
aauucacaaguuacacugcca

SEQ ID NO: 1471729 - RNA, 20 nt, Homo sapiens
aauucacagaauagcacaaa

SEQ ID NO: 1471730 - RNA, 20 nt, Homo sapiens
aauucacccccuuuccugga

SEQ ID NO: 1471731 - RNA, 22 nt, Homo sapiens
aauucacucaagcacugauauc

SEQ ID NO: 1471732 - RNA, 22 nt, Homo sapiens
aauucagaagaccccugacuca

SEQ ID NO: 1471733 - RNA, 17 nt, Homo sapiens
aauucagacaagcugca

SEQ ID NO: 1471734 - RNA, 13 nt, Homo sapiens
aauucagugaaga

SEQ ID NO: 1471735 - RNA, 19 nt, Homo sapiens
aauucauaaaaacugcuua

SEQ ID NO: 1471736 - RNA, 15 nt, Homo sapiens
aauucaugccuuuca

SEQ ID NO: 1471737 - RNA, 18 nt, Homo sapiens
aauuccaaacacauacag

SEQ ID NO: 1471738 - RNA, 22 nt, Homo sapiens
aauuccacaccuuuuauugaca

SEQ ID NO: 1471739 - RNA, 13 nt, Homo sapiens
aauuccucuggga

SEQ ID NO: 1471740 - RNA, 14 nt, Homo sapiens
aauucgcuguuacc

SEQ ID NO: 1471741 - RNA, 18 nt, Homo sapiens
aauucggauguaugaucu

SEQ ID NO: 1471742 - RNA, 22 nt, Homo sapiens
aauucuaccaaggucuucuuaa

SEQ ID NO: 1471743 - RNA, 12 nt, Homo sapiens
aauucuauuaca

SEQ ID NO: 1471744 - RNA, 15 nt, Homo sapiens
aauucucacaucccu

SEQ ID NO: 1471745 - RNA, 15 nt, Homo sapiens
aauucucuagauuua

SEQ ID NO: 1471746 - RNA, 21 nt, Homo sapiens
aauucucuuauccaacaucaa

SEQ ID NO: 1471747 - RNA, 20 nt, Homo sapiens
aauucugagacaugugucaa

SEQ ID NO: 1471748 - RNA, 21 nt, Homo sapiens
aauucugcccgcuccauggaa

SEQ ID NO: 1471749 - RNA, 22 nt, Homo sapiens
aauucugugacauacauauuau

SEQ ID NO: 1471750 - RNA, 19 nt, Homo sapiens
aauucuuccuaaugucaga

SEQ ID NO: 1471751 - RNA, 22 nt, Homo sapiens
aauucuucuguccugagaagca

SEQ ID NO: 1471752 - RNA, 14 nt, Homo sapiens
aauugaacuaacaa

SEQ ID NO: 1471753 - RNA, 17 nt, Homo sapiens
aauugacaaugauuuau

SEQ ID NO: 1471754 - RNA, 20 nt, Homo sapiens
aauugauuuuccuuugugca

SEQ ID NO: 1471755 - RNA, 19 nt, Homo sapiens
aauugcauacuacucucaa

SEQ ID NO: 1471756 - RNA, 14 nt, Homo sapiens
aauugcucagagaa

SEQ ID NO: 1471757 - RNA, 12 nt, Homo sapiens
aauugcugaaag

SEQ ID NO: 1471758 - RNA, 16 nt, Homo sapiens
aauugcuucaagcauu

SEQ ID NO: 1471759 - RNA, 17 nt, Homo sapiens
aauuggccgcugucacu

SEQ ID NO: 1471760 - RNA, 23 nt, Homo sapiens
aauuuaaaaauaagaaaauacau

SEQ ID NO: 1471761 - RNA, 18 nt, Homo sapiens
aauuuaaagggaaaaccc

SEQ ID NO: 1471762 - RNA, 18 nt, Homo sapiens
aauuuaaaggguguacuu

SEQ ID NO: 1471763 - RNA, 19 nt, Homo sapiens
aauuuaaaggguguacuua

SEQ ID NO: 1471764 - RNA, 12 nt, Homo sapiens
aauuuaacaaac

SEQ ID NO: 1471765 - RNA, 17 nt, Homo sapiens
aauuuaaucacuuucau

SEQ ID NO: 1471766 - RNA, 15 nt, Homo sapiens
aauuuacacugccau

SEQ ID NO: 1471767 - RNA, 21 nt, Homo sapiens
aauuuagagauaggaaacuga

SEQ ID NO: 1471768 - RNA, 21 nt, Homo sapiens
aauuuauaccucaaacuaucu

SEQ ID NO: 1471769 - RNA, 20 nt, Homo sapiens
aauuuaucaaacccuagccu

SEQ ID NO: 1471770 - RNA, 22 nt, Homo sapiens
aaucaaaccgagcagggcugug

SEQ ID NO: 1471771 - RNA, 14 nt, Homo sapiens
aaucaaagccaggg

SEQ ID NO: 1471772 - RNA, 20 nt, Homo sapiens
aaucaagaaaaacaucuuug

SEQ ID NO: 1471773 - RNA, 18 nt, Homo sapiens
aaucaagcuuuugcuuga

SEQ ID NO: 1471774 - RNA, 18 nt, Homo sapiens
aaucaaggccagugcuaa

SEQ ID NO: 1471775 - RNA, 22 nt, Homo sapiens
aaucaaguauuugggaagugaa

SEQ ID NO: 1471776 - RNA, 14 nt, Homo sapiens
aaucaaugaauauu

SEQ ID NO: 1471777 - RNA, 12 nt, Homo sapiens
aaucaauguuca

SEQ ID NO: 1471778 - RNA, 17 nt, Homo sapiens
aaucaauguucacgcaa

SEQ ID NO: 1471779 - RNA, 17 nt, Homo sapiens
aaucaccuggcugagca

SEQ ID NO: 1471780 - RNA, 14 nt, Homo sapiens
aaucacggcucacu

SEQ ID NO: 1471781 - RNA, 23 nt, Homo sapiens
aaucacuggcuguuaaucuuuca

SEQ ID NO: 1471782 - RNA, 18 nt, Homo sapiens
aaucacuuuaagaucuuu

SEQ ID NO: 1471783 - RNA, 16 nt, Homo sapiens
aaucagcaaccugacu

SEQ ID NO: 1471784 - RNA, 16 nt, Homo sapiens
aaucagccacauucua

SEQ ID NO: 1471785 - RNA, 11 nt, Homo sapiens
aaucauuuccc

SEQ ID NO: 1471786 - RNA, 17 nt, Homo sapiens
aaucauuuuaauuauua

SEQ ID NO: 1471787 - RNA, 13 nt, Homo sapiens
aauccaacaucca

SEQ ID NO: 1471788 - RNA, 14 nt, Homo sapiens
aauccaacauccag

SEQ ID NO: 1471789 - RNA, 16 nt, Homo sapiens
aauccaccugccuugg

SEQ ID NO: 1471790 - RNA, 22 nt, Homo sapiens
aauccagcucccuagacugcau

SEQ ID NO: 1471791 - RNA, 16 nt, Homo sapiens
aauccaggcagaucca

SEQ ID NO: 1471792 - RNA, 16 nt, Homo sapiens
aauccauuaucgagca

SEQ ID NO: 1471793 - RNA, 17 nt, Homo sapiens
aaucccaacacuuugag

SEQ ID NO: 1471794 - RNA, 22 nt, Homo sapiens
aaucccaacguuuuacauaaaa

SEQ ID NO: 1471795 - RNA, 14 nt, Homo sapiens
aaucccagcacuuu

SEQ ID NO: 1471796 - RNA, 20 nt, Homo sapiens
aaucccuccccgugacugca

SEQ ID NO: 1471797 - RNA, 15 nt, Homo sapiens
aauccgcauugaugg

SEQ ID NO: 1471798 - RNA, 18 nt, Homo sapiens
aauccucauguuacucag

SEQ ID NO: 1471799 - RNA, 15 nt, Homo sapiens
aauccugcaaugaaa

SEQ ID NO: 1471800 - RNA, 20 nt, Homo sapiens
aauccuggaccaagcacaaa

SEQ ID NO: 1471801 - RNA, 21 nt, Homo sapiens
aauccuggaccaagcacaaaa

SEQ ID NO: 1471802 - RNA, 22 nt, Homo sapiens
aauccuucccugcucuugcagu

SEQ ID NO: 1471803 - RNA, 19 nt, Homo sapiens
aauccuuuuccuguucaua

SEQ ID NO: 1471804 - RNA, 23 nt, Homo sapiens
aaucgauucugcagcaccggccu

SEQ ID NO: 1471805 - RNA, 21 nt, Homo sapiens
aaucgcugcccucucugccag

SEQ ID NO: 1471806 - RNA, 12 nt, Homo sapiens
aaucuaagugau

SEQ ID NO: 1471807 - RNA, 14 nt, Homo sapiens
aaucuacuaauucc

SEQ ID NO: 1471808 - RNA, 15 nt, Homo sapiens
aaucuacuaauucca

SEQ ID NO: 1471809 - RNA, 17 nt, Homo sapiens
aaucuagacaauauaca

SEQ ID NO: 1471810 - RNA, 15 nt, Homo sapiens
aaucuauccauugaa

SEQ ID NO: 1471811 - RNA, 13 nt, Homo sapiens
aaucuauucugug

SEQ ID NO: 1471812 - RNA, 13 nt, Homo sapiens
aaucucagcacuu

SEQ ID NO: 1471813 - RNA, 14 nt, Homo sapiens
aaucucagcacuuu

SEQ ID NO: 1471814 - RNA, 17 nt, Homo sapiens
aaucucagcgugggcca

SEQ ID NO: 1471815 - RNA, 22 nt, Homo sapiens
aaucuccucucucuuuccucca

SEQ ID NO: 1471816 - RNA, 19 nt, Homo sapiens
aaucucuacugcuuuggau

SEQ ID NO: 1471817 - RNA, 16 nt, Homo sapiens
aaucucucuccuguau

SEQ ID NO: 1471818 - RNA, 14 nt, Homo sapiens
aaucucuugcacuc

SEQ ID NO: 1471819 - RNA, 15 nt, Homo sapiens
aaucugaacucucaa

SEQ ID NO: 1471820 - RNA, 13 nt, Homo sapiens
aaucugaccaaaa

SEQ ID NO: 1471821 - RNA, 14 nt, Homo sapiens
aaucugaccaaaac

SEQ ID NO: 1471822 - RNA, 16 nt, Homo sapiens
aaucugagcugcaggu

SEQ ID NO: 1471823 - RNA, 21 nt, Homo sapiens
aaucuggcaggaaucuaucca

SEQ ID NO: 1471824 - RNA, 19 nt, Homo sapiens
aaucuggcccuuacacacu

SEQ ID NO: 1471825 - RNA, 23 nt, Homo sapiens
aaucugucccugagagugucucu

SEQ ID NO: 1471826 - RNA, 15 nt, Homo sapiens
aaucuucuacuuuaa

SEQ ID NO: 1471827 - RNA, 23 nt, Homo sapiens
aaucuucucuuugacaauuccua

SEQ ID NO: 1471828 - RNA, 20 nt, Homo sapiens
aaucuuucaaagugucuuga

SEQ ID NO: 1471829 - RNA, 19 nt, Homo sapiens
aaucuuucuuuaccugaga

SEQ ID NO: 1471830 - RNA, 19 nt, Homo sapiens
aaucuuugccuuuaucucu

SEQ ID NO: 1471831 - RNA, 19 nt, Homo sapiens
aaucuuuuaaaaauucaaa

SEQ ID NO: 1471832 - RNA, 17 nt, Homo sapiens
aaucuuuuaaaucuuug

SEQ ID NO: 1471833 - RNA, 14 nt, Homo sapiens
aaugaaaaugcagu

SEQ ID NO: 1471834 - RNA, 24 nt, Homo sapiens
aaugaaagcauguggcauguucau

SEQ ID NO: 1471835 - RNA, 17 nt, Homo sapiens
aaugaaauguaugugcu

SEQ ID NO: 1471836 - RNA, 15 nt, Homo sapiens
aaugaaauuugcaaa

SEQ ID NO: 1471837 - RNA, 22 nt, Homo sapiens
aaugaaccuucugcaacaucuu

SEQ ID NO: 1471838 - RNA, 11 nt, Homo sapiens
aaugaacuaau

SEQ ID NO: 1471839 - RNA, 14 nt, Homo sapiens
aaugaaucuucaca

SEQ ID NO: 1471840 - RNA, 12 nt, Homo sapiens
aaugaaugccua

SEQ ID NO: 1471841 - RNA, 14 nt, Homo sapiens
aaugaauguuuaca

SEQ ID NO: 1471842 - RNA, 22 nt, Homo sapiens
aaugaauuuucuucauacuuaa

SEQ ID NO: 1471843 - RNA, 14 nt, Homo sapiens
aaugaccaauauua

SEQ ID NO: 1471844 - RNA, 15 nt, Homo sapiens
aaugacuacuuagca

SEQ ID NO: 1471845 - RNA, 16 nt, Homo sapiens
aaugacuuaaccauau

SEQ ID NO: 1471846 - RNA, 23 nt, Homo sapiens
aaugagaagccaagcucuucaag

SEQ ID NO: 1471847 - RNA, 15 nt, Homo sapiens
aaugagcaccuccau

SEQ ID NO: 1471848 - RNA, 22 nt, Homo sapiens
aaugaggauuauugauaguacu

SEQ ID NO: 1471849 - RNA, 20 nt, Homo sapiens
aaugaggcagauagcacugg

SEQ ID NO: 1471850 - RNA, 16 nt, Homo sapiens
aaugagggccaagaaa

SEQ ID NO: 1471851 - RNA, 11 nt, Homo sapiens
aaugagugugc

SEQ ID NO: 1471852 - RNA, 16 nt, Homo sapiens
aaugauagacaauuga

SEQ ID NO: 1471853 - RNA, 18 nt, Homo sapiens
aaugaucugccucuaaaa

SEQ ID NO: 1471854 - RNA, 21 nt, Homo sapiens
aaugaugaguauuaguucccu

SEQ ID NO: 1471855 - RNA, 15 nt, Homo sapiens
aaugauuaaucaaag

SEQ ID NO: 1471856 - RNA, 17 nt, Homo sapiens
aaugauuuacauaaaag

SEQ ID NO: 1471857 - RNA, 18 nt, Homo sapiens
aaugauuugcucuuugac

SEQ ID NO: 1471858 - RNA, 14 nt, Homo sapiens
aaugauuuuaucug

SEQ ID NO: 1471859 - RNA, 18 nt, Homo sapiens
aaugcacauagcuaucaa

SEQ ID NO: 1471860 - RNA, 14 nt, Homo sapiens
aaugcaccaagaaa

SEQ ID NO: 1471861 - RNA, 14 nt, Homo sapiens
aaugcauggugcag

SEQ ID NO: 1471862 - RNA, 16 nt, Homo sapiens
aaugcauucccugaau

SEQ ID NO: 1471863 - RNA, 14 nt, Homo sapiens
aaugcauugcuaaa

SEQ ID NO: 1471864 - RNA, 20 nt, Homo sapiens
aaugccaaucuucaguauuu

SEQ ID NO: 1471865 - RNA, 13 nt, Homo sapiens
aaugcccagugag

SEQ ID NO: 1471866 - RNA, 23 nt, Homo sapiens
aaugcccuuccagugggacccca

SEQ ID NO: 1471867 - RNA, 21 nt, Homo sapiens
aaugcucauuuucugguuugg

SEQ ID NO: 1471868 - RNA, 12 nt, Homo sapiens
aaugcugagaag

SEQ ID NO: 1471869 - RNA, 17 nt, Homo sapiens
aaugcugauaugaucuu

SEQ ID NO: 1471870 - RNA, 16 nt, Homo sapiens
aaugcuggcauuugca

SEQ ID NO: 1471871 - RNA, 18 nt, Homo sapiens
aaugcugugguugauauu

SEQ ID NO: 1471872 - RNA, 22 nt, Homo sapiens
aucuauagcuaaguacacaaua

SEQ ID NO: 1471873 - RNA, 16 nt, Homo sapiens
uugcaaauacauggau

SEQ ID NO: 1471874 - RNA, 23 nt, Homo sapiens
uugcaauuaggauuuugauguga

SEQ ID NO: 1471875 - RNA, 12 nt, Homo sapiens
uugcaccacugc

SEQ ID NO: 1471876 - RNA, 22 nt, Homo sapiens
uugcaccccaaagcuuuccugc

SEQ ID NO: 1471877 - RNA, 16 nt, Homo sapiens
uugcacuugaccucau

SEQ ID NO: 1471878 - RNA, 17 nt, Homo sapiens
uugcagauaacuuugac

SEQ ID NO: 1471879 - RNA, 18 nt, Homo sapiens
uugcagcuuuauguucau

SEQ ID NO: 1471880 - RNA, 18 nt, Homo sapiens
uugcaggugaacagccuc

SEQ ID NO: 1471881 - RNA, 22 nt, Homo sapiens
uugcaggugacauuugcucuga

SEQ ID NO: 1471882 - RNA, 17 nt, Homo sapiens
uugcauacccaaaccag

SEQ ID NO: 1471883 - RNA, 21 nt, Homo sapiens
uugcauaucuuaaaacuaaau

SEQ ID NO: 1471884 - RNA, 14 nt, Homo sapiens
uugccaaaaacaaa

SEQ ID NO: 1471885 - RNA, 18 nt, Homo sapiens
uugccaagaaaaugaagg

SEQ ID NO: 1471886 - RNA, 22 nt, Homo sapiens
uugccaccauguauucauccag

SEQ ID NO: 1471887 - RNA, 22 nt, Homo sapiens
uugccagcgauuuuaguucaau

SEQ ID NO: 1471888 - RNA, 17 nt, Homo sapiens
uugccaguauuaugcau

SEQ ID NO: 1471889 - RNA, 21 nt, Homo sapiens
uugcccaggcuggagugcagu

SEQ ID NO: 1471890 - RNA, 13 nt, Homo sapiens
uugccccaagaua

SEQ ID NO: 1471891 - RNA, 13 nt, Homo sapiens
uugccucaagacu

SEQ ID NO: 1471892 - RNA, 17 nt, Homo sapiens
uugccuuccuuucucca

SEQ ID NO: 1471893 - RNA, 15 nt, Homo sapiens
uugccuugggcugcu

SEQ ID NO: 1471894 - RNA, 23 nt, Homo sapiens
uugcuaaaagauuauagaaguag

SEQ ID NO: 1471895 - RNA, 15 nt, Homo sapiens
uugcuaccucaaggg

SEQ ID NO: 1471896 - RNA, 23 nt, Homo sapiens
uugcucaggggaaccauggggcu

SEQ ID NO: 1471897 - RNA, 12 nt, Homo sapiens
uugcucugccac

SEQ ID NO: 1471898 - RNA, 19 nt, Homo sapiens
uucucuauuucuggaugaa

SEQ ID NO: 1471899 - RNA, 22 nt, Homo sapiens
uucucucccuuccucucuccuu

SEQ ID NO: 1471900 - RNA, 15 nt, Homo sapiens
uucucucguaacugg

SEQ ID NO: 1471901 - RNA, 18 nt, Homo sapiens
uucucucuuauuccacuu

SEQ ID NO: 1471902 - RNA, 15 nt, Homo sapiens
uucucugccagugac

SEQ ID NO: 1471903 - RNA, 22 nt, Homo sapiens
uucucugggccuucucaccaca

SEQ ID NO: 1471904 - RNA, 14 nt, Homo sapiens
uucugaaugcugcu

SEQ ID NO: 1471905 - RNA, 11 nt, Homo sapiens
uucugacccac

SEQ ID NO: 1471906 - RNA, 17 nt, Homo sapiens
uucugaugaaucucaaa

SEQ ID NO: 1471907 - RNA, 22 nt, Homo sapiens
uucugcaacaucuuaagaucca

SEQ ID NO: 1471908 - RNA, 18 nt, Homo sapiens
uucugcaucaucuguaga

SEQ ID NO: 1471909 - RNA, 20 nt, Homo sapiens
uucugccugccuuccagcca

SEQ ID NO: 1471910 - RNA, 13 nt, Homo sapiens
uucugcucuggaa

SEQ ID NO: 1471911 - RNA, 16 nt, Homo sapiens
uucugcuuugcacagg

SEQ ID NO: 1471912 - RNA, 17 nt, Homo sapiens
uucuggaagucaucuca

SEQ ID NO: 1471913 - RNA, 22 nt, Homo sapiens
uucuggaugaaugcccagugag

SEQ ID NO: 1471914 - RNA, 18 nt, Homo sapiens
uucuggauuugcagguga

SEQ ID NO: 1471915 - RNA, 15 nt, Homo sapiens
uucugguuacugugg

SEQ ID NO: 1471916 - RNA, 14 nt, Homo sapiens
uucuguaucauuga

SEQ ID NO: 1471917 - RNA, 15 nt, Homo sapiens
uucugucaccaaauu

SEQ ID NO: 1471918 - RNA, 16 nt, Homo sapiens
uucugucccacuacau

SEQ ID NO: 1471919 - RNA, 23 nt, Homo sapiens
uucuguccugagaagcauguaau

SEQ ID NO: 1471920 - RNA, 13 nt, Homo sapiens
uucugucuuccua

SEQ ID NO: 1471921 - RNA, 24 nt, Homo sapiens
uucugugaucuuuuaaaguguuac

SEQ ID NO: 1471922 - RNA, 12 nt, Homo sapiens
uucuguggcuca

SEQ ID NO: 1471923 - RNA, 13 nt, Homo sapiens
uucuguucugcug

SEQ ID NO: 1471924 - RNA, 17 nt, Homo sapiens
uucuuaaagaguucuua

SEQ ID NO: 1471925 - RNA, 21 nt, Homo sapiens
uucauggguuuaccacuaacu

SEQ ID NO: 1471926 - RNA, 19 nt, Homo sapiens
uucauguaauagcaaugca

SEQ ID NO: 1471927 - RNA, 23 nt, Homo sapiens
uucauuacuugauuaagauuuua

SEQ ID NO: 1471928 - RNA, 20 nt, Homo sapiens
uucauuauuggaauuaaccu

SEQ ID NO: 1471929 - RNA, 21 nt, Homo sapiens
uucauucaggcaacgcacaaa

SEQ ID NO: 1471930 - RNA, 13 nt, Homo sapiens
uucauucugcauu

SEQ ID NO: 1471931 - RNA, 22 nt, Homo sapiens
uucauucugcauugcuagauaa

SEQ ID NO: 1471932 - RNA, 18 nt, Homo sapiens
uucauuuaaaaugauuag

SEQ ID NO: 1471933 - RNA, 19 nt, Homo sapiens
uucauuucagauaaacaac

SEQ ID NO: 1471934 - RNA, 23 nt, Homo sapiens
uucauuucagauaaacaacaaau

SEQ ID NO: 1471935 - RNA, 17 nt, Homo sapiens
uucauuuucaucacugg

SEQ ID NO: 1471936 - RNA, 17 nt, Homo sapiens
uuccacaaguuaaauaa

SEQ ID NO: 1471937 - RNA, 21 nt, Homo sapiens
uuccacaguugccaccaccuc

SEQ ID NO: 1471938 - RNA, 20 nt, Homo sapiens
uuccaccuccaccacaucug

SEQ ID NO: 1471939 - RNA, 18 nt, Homo sapiens
uuccacucccuuugccag

SEQ ID NO: 1471940 - RNA, 13 nt, Homo sapiens
uuccacuguaauu

SEQ ID NO: 1471941 - RNA, 22 nt, Homo sapiens
uuccagaagaagagaagcugcu

SEQ ID NO: 1471942 - RNA, 15 nt, Homo sapiens
uuccagagaagccau

SEQ ID NO: 1471943 - RNA, 18 nt, Homo sapiens
uuccagauccuucaaaga

SEQ ID NO: 1471944 - RNA, 16 nt, Homo sapiens
uuccagcuccuguaac

SEQ ID NO: 1471945 - RNA, 11 nt, Homo sapiens
uuccagcugcu

SEQ ID NO: 1471946 - RNA, 20 nt, Homo sapiens
uuccaggaccagaagcauuu

SEQ ID NO: 1471947 - RNA, 22 nt, Homo sapiens
uuccaguguccuuagaacauuu

SEQ ID NO: 1471948 - RNA, 12 nt, Homo sapiens
uuccaguguuug

SEQ ID NO: 1471949 - RNA, 16 nt, Homo sapiens
uuccaguuucuguaag

SEQ ID NO: 1471950 - RNA, 16 nt, Homo sapiens
uuccauaagaagucgu

SEQ ID NO: 1471951 - RNA, 18 nt, Homo sapiens
uuccauaggacauacugc

SEQ ID NO: 1471952 - RNA, 22 nt, Homo sapiens
uuaugaaaugaccucuguccuc

SEQ ID NO: 1471953 - RNA, 22 nt, Homo sapiens
uuaugaccaugguauauuccua

SEQ ID NO: 1471954 - RNA, 21 nt, Homo sapiens
uuaugccuucacuuuacaaau

SEQ ID NO: 1471955 - RNA, 16 nt, Homo sapiens
uuauggaaaacugugu

SEQ ID NO: 1471956 - RNA, 20 nt, Homo sapiens
uuauguauguauguauuuau

SEQ ID NO: 1471957 - RNA, 20 nt, Homo sapiens
uuauguuuuaaacacaugcc

SEQ ID NO: 1471958 - RNA, 22 nt, Homo sapiens
uuauuaaagcauuuccuaccag

SEQ ID NO: 1471959 - RNA, 18 nt, Homo sapiens
uuauuaauauuauuauga

SEQ ID NO: 1471960 - RNA, 17 nt, Homo sapiens
uuauuacauggggucua

SEQ ID NO: 1471961 - RNA, 21 nt, Homo sapiens
uuauuagguacguaacuauuu

SEQ ID NO: 1471962 - RNA, 19 nt, Homo sapiens
uuauuauuuuggggucucu

SEQ ID NO: 1471963 - RNA, 21 nt, Homo sapiens
uuauucaguaaacaacuugua

SEQ ID NO: 1471964 - RNA, 17 nt, Homo sapiens
uuauuccugguuuaauu

SEQ ID NO: 1471965 - RNA, 17 nt, Homo sapiens
uuauuccuugaucauuu

SEQ ID NO: 1471966 - RNA, 23 nt, Homo sapiens
uuauugccuggagugugaacugu

SEQ ID NO: 1471967 - RNA, 15 nt, Homo sapiens
uuauugcgcugcuac

SEQ ID NO: 1471968 - RNA, 12 nt, Homo sapiens
uuauuggcugcu

SEQ ID NO: 1471969 - RNA, 14 nt, Homo sapiens
uuauuguaccucuc

SEQ ID NO: 1471970 - RNA, 15 nt, Homo sapiens
uuauugucuguaaau

SEQ ID NO: 1471971 - RNA, 14 nt, Homo sapiens
uuauuuauguaugu

SEQ ID NO: 1471972 - RNA, 14 nt, Homo sapiens
uuauuucugaucua

SEQ ID NO: 1471973 - RNA, 21 nt, Homo sapiens
uuauuucugguaacucacuca

SEQ ID NO: 1471974 - RNA, 16 nt, Homo sapiens
uuauuuugaaaauaau

SEQ ID NO: 1471975 - RNA, 18 nt, Homo sapiens
uuauuuuuaaaaagaaau

SEQ ID NO: 1471976 - RNA, 13 nt, Homo sapiens
uucaaaaacaccc

SEQ ID NO: 1471977 - RNA, 18 nt, Homo sapiens
uucaaaauauacauucaa

SEQ ID NO: 1471978 - RNA, 21 nt, Homo sapiens
uucaaacaauaucauaucauc

SEQ ID NO: 1471979 - RNA, 12 nt, Homo sapiens
uucaaacagaac

SEQ ID NO: 1471980 - RNA, 13 nt, Homo sapiens
ugguuuacuucaa

SEQ ID NO: 1471981 - RNA, 17 nt, Homo sapiens
ugguuuccauuuacuaa

SEQ ID NO: 1471982 - RNA, 13 nt, Homo sapiens
ugguuugacucag

SEQ ID NO: 1471983 - RNA, 19 nt, Homo sapiens
ugguuuuguacacugcugu

SEQ ID NO: 1471984 - RNA, 20 nt, Homo sapiens
uguaaaaugugaagugaaug

SEQ ID NO: 1471985 - RNA, 19 nt, Homo sapiens
uguaaacauaauucuugua

SEQ ID NO: 1471986 - RNA, 22 nt, Homo sapiens
uguaaacugaauauaaagcuua

SEQ ID NO: 1471987 - RNA, 20 nt, Homo sapiens
uguaaauaugaaucugcuca

SEQ ID NO: 1471988 - RNA, 17 nt, Homo sapiens
uguaacccagauuuugc

SEQ ID NO: 1471989 - RNA, 14 nt, Homo sapiens
uguaacccgcucau

SEQ ID NO: 1471990 - RNA, 17 nt, Homo sapiens
uguaacccucacccaca

SEQ ID NO: 1471991 - RNA, 23 nt, Homo sapiens
uguaacguuuucuuucacacaca

SEQ ID NO: 1471992 - RNA, 16 nt, Homo sapiens
uguaacuuauauugaa

SEQ ID NO: 1471993 - RNA, 15 nt, Homo sapiens
uguaacuuccugcug

SEQ ID NO: 1471994 - RNA, 22 nt, Homo sapiens
uguaagcucuacugaggugcua

SEQ ID NO: 1471995 - RNA, 14 nt, Homo sapiens
uguaaggacgccuu

SEQ ID NO: 1471996 - RNA, 13 nt, Homo sapiens
uguaagucaucua

SEQ ID NO: 1471997 - RNA, 17 nt, Homo sapiens
uguaaguuucaggugac

SEQ ID NO: 1471998 - RNA, 19 nt, Homo sapiens
uguaauagugaacauaugg

SEQ ID NO: 1471999 - RNA, 22 nt, Homo sapiens
uguaaucaaggccagugcuaaa

SEQ ID NO: 1472000 - RNA, 16 nt, Homo sapiens
uguaaugacagugcua

SEQ ID NO: 1472001 - RNA, 22 nt, Homo sapiens
uguaaugguaucuuaaagugug

SEQ ID NO: 1472002 - RNA, 23 nt, Homo sapiens
uguaauuuuaaauaaaagugauc

SEQ ID NO: 1472003 - RNA, 13 nt, Homo sapiens
uguacaacugcac

SEQ ID NO: 1472004 - RNA, 14 nt, Homo sapiens
uguacacagucagc

SEQ ID NO: 1472005 - RNA, 15 nt, Homo sapiens
uguacagaauuucca

SEQ ID NO: 1472006 - RNA, 15 nt, Homo sapiens
uguacagagugcuuu

SEQ ID NO: 1472007 - RNA, 13 nt, Homo sapiens
uguaccauguaca

SEQ ID NO: 1472008 - RNA, 14 nt, Homo sapiens
uguaccauuugccu

SEQ ID NO: 1472009 - RNA, 18 nt, Homo sapiens
uguacugcauguuaccau

SEQ ID NO: 1472010 - RNA, 22 nt, Homo sapiens
uguacuuauauccacacugcac

SEQ ID NO: 1472011 - RNA, 17 nt, Homo sapiens
ugcagaaacaguucacc

SEQ ID NO: 1472012 - RNA, 21 nt, Homo sapiens
ugcagacagaagucuccucaa

SEQ ID NO: 1472013 - RNA, 22 nt, Homo sapiens
ugcagagaaacuuaagcaaagg

SEQ ID NO: 1472014 - RNA, 16 nt, Homo sapiens
ugcagaguccauuucc

SEQ ID NO: 1472015 - RNA, 23 nt, Homo sapiens
ugcagaugagcagucacacuguu

SEQ ID NO: 1472016 - RNA, 16 nt, Homo sapiens
ugcagcaaacacucca

SEQ ID NO: 1472017 - RNA, 21 nt, Homo sapiens
ugcagcaaacacuccacccuc

SEQ ID NO: 1472018 - RNA, 19 nt, Homo sapiens
ugcagcaccggccucggga

SEQ ID NO: 1472019 - RNA, 14 nt, Homo sapiens
ugcagcaccuccag

SEQ ID NO: 1472020 - RNA, 14 nt, Homo sapiens
ugcagcacucuuau

SEQ ID NO: 1472021 - RNA, 15 nt, Homo sapiens
ugcagcacucuuauc

SEQ ID NO: 1472022 - RNA, 13 nt, Homo sapiens
ugcagccacuggc

SEQ ID NO: 1472023 - RNA, 22 nt, Homo sapiens
ugcagccacuggcuuggaacac

SEQ ID NO: 1472024 - RNA, 17 nt, Homo sapiens
ugcagcccuugggcagu

SEQ ID NO: 1472025 - RNA, 20 nt, Homo sapiens
ugcaggacuugagaagaccu

SEQ ID NO: 1472026 - RNA, 17 nt, Homo sapiens
ugcaggagagacaguga

SEQ ID NO: 1472027 - RNA, 16 nt, Homo sapiens
ugcaggcuuuuccucc

SEQ ID NO: 1472028 - RNA, 15 nt, Homo sapiens
ugcagggccacugga

SEQ ID NO: 1472029 - RNA, 17 nt, Homo sapiens
ugcagggccacuggaag

SEQ ID NO: 1472030 - RNA, 12 nt, Homo sapiens
ugcagggguccc

SEQ ID NO: 1472031 - RNA, 21 nt, Homo sapiens
ugcaggggugacggcccucau

SEQ ID NO: 1472032 - RNA, 16 nt, Homo sapiens
ugcaggugacauuugc

SEQ ID NO: 1472033 - RNA, 17 nt, Homo sapiens
ugcaggugacauuugcu

SEQ ID NO: 1472034 - RNA, 22 nt, Homo sapiens
ugcaguaaauuaucuugggaua

SEQ ID NO: 1472035 - RNA, 22 nt, Homo sapiens
ugcaguagagucaucuccauca

SEQ ID NO: 1472036 - RNA, 12 nt, Homo sapiens
ugcagucacugg

SEQ ID NO: 1472037 - RNA, 22 nt, Homo sapiens
ugcagucauuaugagaggcaau

SEQ ID NO: 1472038 - RNA, 21 nt, Homo sapiens
ugcaguggcgugaucuuggcu

SEQ ID NO: 1472039 - RNA, 19 nt, Homo sapiens
ugcaguggcugugccacca

SEQ ID NO: 1472040 - RNA, 17 nt, Homo sapiens
ugcaguggugugaucuc

SEQ ID NO: 1472041 - RNA, 18 nt, Homo sapiens
ugcaguggugugaucucg

SEQ ID NO: 1472042 - RNA, 15 nt, Homo sapiens
ugcaguucugagcac

SEQ ID NO: 1472043 - RNA, 18 nt, Homo sapiens
ugcaguuggacucucagg

SEQ ID NO: 1472044 - RNA, 15 nt, Homo sapiens
ugagucugcaugugc

SEQ ID NO: 1472045 - RNA, 22 nt, Homo sapiens
ugagugaaaauuuuuacauuca

SEQ ID NO: 1472046 - RNA, 18 nt, Homo sapiens
ugaguggaucuccaagga

SEQ ID NO: 1472047 - RNA, 15 nt, Homo sapiens
ugaguggccugcuaa

SEQ ID NO: 1472048 - RNA, 15 nt, Homo sapiens
ugaguggugccaaac

SEQ ID NO: 1472049 - RNA, 21 nt, Homo sapiens
ugaguuaacucacugagggua

SEQ ID NO: 1472050 - RNA, 12 nt, Homo sapiens
ugaguuacuuga

SEQ ID NO: 1472051 - RNA, 16 nt, Homo sapiens
ugaguucgaggacuac

SEQ ID NO: 1472052 - RNA, 13 nt, Homo sapiens
ugaguuuuuagug

SEQ ID NO: 1472053 - RNA, 15 nt, Homo sapiens
ugauaaaacacugcc

SEQ ID NO: 1472054 - RNA, 17 nt, Homo sapiens
ugauaaaugauagacaa

SEQ ID NO: 1472055 - RNA, 14 nt, Homo sapiens
ugauaacaccagug

SEQ ID NO: 1472056 - RNA, 12 nt, Homo sapiens
ugauaaguaaau

SEQ ID NO: 1472057 - RNA, 21 nt, Homo sapiens
ugauaaugccccaaggacaag

SEQ ID NO: 1472058 - RNA, 19 nt, Homo sapiens
ugauacaagaaagcaaugc

SEQ ID NO: 1472059 - RNA, 22 nt, Homo sapiens
ugauacauccaaagcagacagc

SEQ ID NO: 1472060 - RNA, 12 nt, Homo sapiens
ugauaccacugc

SEQ ID NO: 1472061 - RNA, 14 nt, Homo sapiens
ugauaccacugcac

SEQ ID NO: 1472062 - RNA, 23 nt, Homo sapiens
ugauagcacuuucuacaauguga

SEQ ID NO: 1472063 - RNA, 15 nt, Homo sapiens
ugauagggaacuggg

SEQ ID NO: 1472064 - RNA, 14 nt, Homo sapiens
ugauauacaaagug

SEQ ID NO: 1472065 - RNA, 14 nt, Homo sapiens
ugauauauugcugu

SEQ ID NO: 1472066 - RNA, 17 nt, Homo sapiens
ugauaucugcagggaca

SEQ ID NO: 1472067 - RNA, 18 nt, Homo sapiens
ugauaucuggccuaaaau

SEQ ID NO: 1472068 - RNA, 17 nt, Homo sapiens
ugauaugugaaugcuca

SEQ ID NO: 1472069 - RNA, 15 nt, Homo sapiens
ugauauuucuugcuu

SEQ ID NO: 1472070 - RNA, 17 nt, Homo sapiens
ugauauuuuuacuugca

SEQ ID NO: 1472071 - RNA, 13 nt, Homo sapiens
ugaucauuugccc

SEQ ID NO: 1472072 - RNA, 15 nt, Homo sapiens
ugaucccaauccuua

SEQ ID NO: 1472073 - RNA, 17 nt, Homo sapiens
ugauccccaagugguga

SEQ ID NO: 1472074 - RNA, 21 nt, Homo sapiens
ugaucccccauagguggcuga

SEQ ID NO: 1472075 - RNA, 13 nt, Homo sapiens
ugauccgccuacc

SEQ ID NO: 1472076 - RNA, 13 nt, Homo sapiens
ugaucucagggca

SEQ ID NO: 1472077 - RNA, 12 nt, Homo sapiens
ugaucugugaua

SEQ ID NO: 1472078 - RNA, 14 nt, Homo sapiens
ugaacuaacugaca

SEQ ID NO: 1472079 - RNA, 17 nt, Homo sapiens
ugaacuaaucugauguu

SEQ ID NO: 1472080 - RNA, 19 nt, Homo sapiens
ugaacuacauaacuuccua

SEQ ID NO: 1472081 - RNA, 20 nt, Homo sapiens
ugaacuacuaaaguuuuaca

SEQ ID NO: 1472082 - RNA, 17 nt, Homo sapiens
ugaacuccaccgaccaa

SEQ ID NO: 1472083 - RNA, 21 nt, Homo sapiens
ugaacucugguggcacaggag

SEQ ID NO: 1472084 - RNA, 22 nt, Homo sapiens
ugaacucuuucuggccugccuu

SEQ ID NO: 1472085 - RNA, 18 nt, Homo sapiens
ugaacugaaguuucacau

SEQ ID NO: 1472086 - RNA, 17 nt, Homo sapiens
ugaacuguaguacaugg

SEQ ID NO: 1472087 - RNA, 13 nt, Homo sapiens
ugaacugugcaua

SEQ ID NO: 1472088 - RNA, 17 nt, Homo sapiens
ugaacuugcauugugau

SEQ ID NO: 1472089 - RNA, 16 nt, Homo sapiens
ugaacuuuuguacuga

SEQ ID NO: 1472090 - RNA, 15 nt, Homo sapiens
ugaagaaaacuccuu

SEQ ID NO: 1472091 - RNA, 23 nt, Homo sapiens
ugaagaacaacaacucucagugg

SEQ ID NO: 1472092 - RNA, 15 nt, Homo sapiens
ugaagacacacucag

SEQ ID NO: 1472093 - RNA, 15 nt, Homo sapiens
ugaagaccacaucca

SEQ ID NO: 1472094 - RNA, 20 nt, Homo sapiens
ugaagagaaccgagcaaaga

SEQ ID NO: 1472095 - RNA, 18 nt, Homo sapiens
ugaagagaccaagacucu

SEQ ID NO: 1472096 - RNA, 22 nt, Homo sapiens
ugaagaggaagggcaaaaccac

SEQ ID NO: 1472097 - RNA, 18 nt, Homo sapiens
ugaagaggguugguauaa

SEQ ID NO: 1472098 - RNA, 13 nt, Homo sapiens
ugaagaguauuaa

SEQ ID NO: 1472099 - RNA, 13 nt, Homo sapiens
ugaagaugaucau

SEQ ID NO: 1472100 - RNA, 19 nt, Homo sapiens
ugaagauucuccugugcua

SEQ ID NO: 1472101 - RNA, 19 nt, Homo sapiens
ugaagauuuaugaugcacu

SEQ ID NO: 1472102 - RNA, 16 nt, Homo sapiens
ugaagcaaaucagaaa

SEQ ID NO: 1472103 - RNA, 23 nt, Homo sapiens
ugaagcaaaucagaaacuuguga

SEQ ID NO: 1472104 - RNA, 17 nt, Homo sapiens
ugaagcagucuugcucu

SEQ ID NO: 1472105 - RNA, 17 nt, Homo sapiens
ugaagccucagcuaccc

SEQ ID NO: 1472106 - RNA, 22 nt, Homo sapiens
ugaagcuuggaggucacagcug

SEQ ID NO: 1472107 - RNA, 16 nt, Homo sapiens
ugaaggaacauuccuu

SEQ ID NO: 1472108 - RNA, 18 nt, Homo sapiens
ugaaggaacauuccuuag

SEQ ID NO: 1472109 - RNA, 17 nt, Homo sapiens
ugaaggaggugagggau

SEQ ID NO: 1472110 - RNA, 22 nt, Homo sapiens
ugaaggaggugagggaugugaa

SEQ ID NO: 1472111 - RNA, 20 nt, Homo sapiens
ugaaggcauccccaggcccu

SEQ ID NO: 1472112 - RNA, 14 nt, Homo sapiens
ugaaggcaugccua

SEQ ID NO: 1472113 - RNA, 22 nt, Homo sapiens
ucuuucacacggcacauuugga

SEQ ID NO: 1472114 - RNA, 15 nt, Homo sapiens
ucuuuccaggcuucc

SEQ ID NO: 1472115 - RNA, 17 nt, Homo sapiens
ucuuuccauuaugauuc

SEQ ID NO: 1472116 - RNA, 15 nt, Homo sapiens
ucuuucuacaugacu

SEQ ID NO: 1472117 - RNA, 22 nt, Homo sapiens
ucuuucucugccagugacagac

SEQ ID NO: 1472118 - RNA, 14 nt, Homo sapiens
ucuuucugauaaca

SEQ ID NO: 1472119 - RNA, 15 nt, Homo sapiens
ucuuucugccaacuu

SEQ ID NO: 1472120 - RNA, 14 nt, Homo sapiens
ucuuucuuguuuca

SEQ ID NO: 1472121 - RNA, 17 nt, Homo sapiens
ucuuucuuuaccugaga

SEQ ID NO: 1472122 - RNA, 14 nt, Homo sapiens
ucuuugcauuccag

SEQ ID NO: 1472123 - RNA, 17 nt, Homo sapiens
ucuuugccuuuaucucu

SEQ ID NO: 1472124 - RNA, 15 nt, Homo sapiens
ucuuugcucaacaga

SEQ ID NO: 1472125 - RNA, 16 nt, Homo sapiens
ucuuuguaucuuccau

SEQ ID NO: 1472126 - RNA, 17 nt, Homo sapiens
ucuuugucuuaucuggc

SEQ ID NO: 1472127 - RNA, 18 nt, Homo sapiens
ucuuuguuacuuccuuau

SEQ ID NO: 1472128 - RNA, 16 nt, Homo sapiens
ucuuuuaagcuaucca

SEQ ID NO: 1472129 - RNA, 14 nt, Homo sapiens
ucuuuuccccauga

SEQ ID NO: 1472130 - RNA, 23 nt, Homo sapiens
ucuuuucugcaucaucuguagau

SEQ ID NO: 1472131 - RNA, 13 nt, Homo sapiens
ucuuuucuuucaa

SEQ ID NO: 1472132 - RNA, 19 nt, Homo sapiens
ucuuuuuacauaacugccu

SEQ ID NO: 1472133 - RNA, 16 nt, Homo sapiens
ugaaaaacaaaauggg

SEQ ID NO: 1472134 - RNA, 13 nt, Homo sapiens
ugaaaaacuuaag

SEQ ID NO: 1472135 - RNA, 23 nt, Homo sapiens
ugaaaaaguagauugaguauaaa

SEQ ID NO: 1472136 - RNA, 13 nt, Homo sapiens
ugaaaagccaaau

SEQ ID NO: 1472137 - RNA, 20 nt, Homo sapiens
ugaaaaguaucacucuaaaa

SEQ ID NO: 1472138 - RNA, 13 nt, Homo sapiens
ugaaaaguuuccu

SEQ ID NO: 1472139 - RNA, 11 nt, Homo sapiens
ugaaaauaacu

SEQ ID NO: 1472140 - RNA, 16 nt, Homo sapiens
ugaaaauccaucucau

SEQ ID NO: 1472141 - RNA, 20 nt, Homo sapiens
ugaaacaagauaacugagaa

SEQ ID NO: 1472142 - RNA, 14 nt, Homo sapiens
ugaaacacaccagg

SEQ ID NO: 1472143 - RNA, 21 nt, Homo sapiens
ugaaacacucaguuguucaau

SEQ ID NO: 1472144 - RNA, 16 nt, Homo sapiens
ugaaacauggcugugu

SEQ ID NO: 1472145 - RNA, 17 nt, Homo sapiens
ugaaaccaggacauuaa

SEQ ID NO: 1472146 - RNA, 20 nt, Homo sapiens
ugaaaccccaucucuacuaa

SEQ ID NO: 1472147 - RNA, 20 nt, Homo sapiens
ugaaaccccaucucuacuga

SEQ ID NO: 1472148 - RNA, 17 nt, Homo sapiens
ugaaacgucauguguuu

SEQ ID NO: 1472149 - RNA, 17 nt, Homo sapiens
ugaaacuaggguuugaa

SEQ ID NO: 1472150 - RNA, 14 nt, Homo sapiens
ugaaacugcacauu

SEQ ID NO: 1472151 - RNA, 18 nt, Homo sapiens
ugaaacuguccaccaaga

SEQ ID NO: 1472152 - RNA, 21 nt, Homo sapiens
ugaaagaacauggacuuguau

SEQ ID NO: 1472153 - RNA, 19 nt, Homo sapiens
ugaaagaagacagcuuaau

SEQ ID NO: 1472154 - RNA, 16 nt, Homo sapiens
ugaaagaugaucauuu

SEQ ID NO: 1472155 - RNA, 22 nt, Homo sapiens
ugaaaggaagcuccacugucac

SEQ ID NO: 1472156 - RNA, 20 nt, Homo sapiens
ugaaaggggggaaccaguga

SEQ ID NO: 1472157 - RNA, 19 nt, Homo sapiens
ugaaaguccagcacuggaa

SEQ ID NO: 1472158 - RNA, 13 nt, Homo sapiens
ugaaaguggacaa

SEQ ID NO: 1472159 - RNA, 14 nt, Homo sapiens
ugaaaguuuaacua

SEQ ID NO: 1472160 - RNA, 13 nt, Homo sapiens
ugaaauacuaaaa

SEQ ID NO: 1472161 - RNA, 12 nt, Homo sapiens
ugaaauaugcau

SEQ ID NO: 1472162 - RNA, 19 nt, Homo sapiens
ugaaaucugcuagaaaguu

SEQ ID NO: 1472163 - RNA, 12 nt, Homo sapiens
ugaaaugaccuc

SEQ ID NO: 1472164 - RNA, 16 nt, Homo sapiens
ugaaaugcaucagguc

SEQ ID NO: 1472165 - RNA, 17 nt, Homo sapiens
ugaaauuaagaaggcaa

SEQ ID NO: 1472166 - RNA, 20 nt, Homo sapiens
ugaaauuauguauguuuaca

SEQ ID NO: 1472167 - RNA, 22 nt, Homo sapiens
ugaaauuaugugacauuuuaca

SEQ ID NO: 1472168 - RNA, 21 nt, Homo sapiens
ugaaauucacccccuuuccug

SEQ ID NO: 1472169 - RNA, 16 nt, Homo sapiens
ugaaauuuauucacau

SEQ ID NO: 1472170 - RNA, 13 nt, Homo sapiens
ugaaauuuuaccg

SEQ ID NO: 1472171 - RNA, 17 nt, Homo sapiens
ugaacaaagcagccacg

SEQ ID NO: 1472172 - RNA, 24 nt, Homo sapiens
ugaacaaccugcucacaguccuca

SEQ ID NO: 1472173 - RNA, 15 nt, Homo sapiens
ugaacacacacacac

SEQ ID NO: 1472174 - RNA, 17 nt, Homo sapiens
ugaacacaggcagcuuu

SEQ ID NO: 1472175 - RNA, 15 nt, Homo sapiens
ugaacagcauuagaa

SEQ ID NO: 1472176 - RNA, 22 nt, Homo sapiens
ugaacaucccuuuuucaaugaa

SEQ ID NO: 1472177 - RNA, 19 nt, Homo sapiens
ugaaccagaggguguggcu

SEQ ID NO: 1472178 - RNA, 15 nt, Homo sapiens
ugaacccagaaggca

SEQ ID NO: 1472179 - RNA, 16 nt, Homo sapiens
ucuguaaguaacuuca

SEQ ID NO: 1472180 - RNA, 19 nt, Homo sapiens
ucuguaauagugaacauau

SEQ ID NO: 1472181 - RNA, 13 nt, Homo sapiens
ucuguagggauuu

SEQ ID NO: 1472182 - RNA, 15 nt, Homo sapiens
ucuguagucauuuac

SEQ ID NO: 1472183 - RNA, 21 nt, Homo sapiens
ucuguaucauugauucaucaa

SEQ ID NO: 1472184 - RNA, 18 nt, Homo sapiens
ucugucacaccagccaua

SEQ ID NO: 1472185 - RNA, 18 nt, Homo sapiens
ucugucaccaacugaagu

SEQ ID NO: 1472186 - RNA, 14 nt, Homo sapiens
ucugucaccagcua

SEQ ID NO: 1472187 - RNA, 16 nt, Homo sapiens
ucuguccauuuaucca

SEQ ID NO: 1472188 - RNA, 22 nt, Homo sapiens
ucugugaaaagggaucugcucc

SEQ ID NO: 1472189 - RNA, 19 nt, Homo sapiens
ucugugaagaaagagguua

SEQ ID NO: 1472190 - RNA, 15 nt, Homo sapiens
ucugugacauacaua

SEQ ID NO: 1472191 - RNA, 23 nt, Homo sapiens
ucugugacauacauauuaucuca

SEQ ID NO: 1472192 - RNA, 18 nt, Homo sapiens
ucugugcagucacuggag

SEQ ID NO: 1472193 - RNA, 18 nt, Homo sapiens
ucugugcccuacucauug

SEQ ID NO: 1472194 - RNA, 16 nt, Homo sapiens
ucuguggagggcauuu

SEQ ID NO: 1472195 - RNA, 21 nt, Homo sapiens
ucuguguagcaagcuauucaa

SEQ ID NO: 1472196 - RNA, 15 nt, Homo sapiens
ucuguguuaggggua

SEQ ID NO: 1472197 - RNA, 20 nt, Homo sapiens
ucuguguuuuugaaauauua

SEQ ID NO: 1472198 - RNA, 14 nt, Homo sapiens
ucuguuuaacauuu

SEQ ID NO: 1472199 - RNA, 23 nt, Homo sapiens
ucuuaaauguagcaauggcacug

SEQ ID NO: 1472200 - RNA, 23 nt, Homo sapiens
ucuuaaauuugauuuacauauau

SEQ ID NO: 1472201 - RNA, 22 nt, Homo sapiens
ucuuaacaaaccaacaucuuug

SEQ ID NO: 1472202 - RNA, 19 nt, Homo sapiens
ucuuaacccccuagaaaga

SEQ ID NO: 1472203 - RNA, 16 nt, Homo sapiens
ucuuaaccuauuuauu

SEQ ID NO: 1472204 - RNA, 15 nt, Homo sapiens
ucuuaaguucuauga

SEQ ID NO: 1472205 - RNA, 18 nt, Homo sapiens
ucuuaauguacacauugc

SEQ ID NO: 1472206 - RNA, 23 nt, Homo sapiens
ucuuacaacaggcuuaugaauau

SEQ ID NO: 1472207 - RNA, 20 nt, Homo sapiens
ucuuacacaggcuucaucaa

SEQ ID NO: 1472208 - RNA, 18 nt, Homo sapiens
ucuuacugcuuaauucaa

SEQ ID NO: 1472209 - RNA, 22 nt, Homo sapiens
ucuuacuuugaguuagugccau

SEQ ID NO: 1472210 - RNA, 18 nt, Homo sapiens
ucuuagaaauacuuguga

SEQ ID NO: 1472211 - RNA, 20 nt, Homo sapiens
ucuuagaagcacuacaccuu

SEQ ID NO: 1472212 - RNA, 14 nt, Homo sapiens
ucuuaggugccagu

SEQ ID NO: 1472213 - RNA, 12 nt, Homo sapiens
ucuuaguuauug

SEQ ID NO: 1472214 - RNA, 16 nt, Homo sapiens
ucuuaguucucacugu

SEQ ID NO: 1472215 - RNA, 22 nt, Homo sapiens
ucuuaugauuacuaucauggca

SEQ ID NO: 1472216 - RNA, 23 nt, Homo sapiens
ucuuauuuaaugaaagacuguac

SEQ ID NO: 1472217 - RNA, 15 nt, Homo sapiens
ucuuauuuugcauuc

SEQ ID NO: 1472218 - RNA, 12 nt, Homo sapiens
ucuucaacaucc

SEQ ID NO: 1472219 - RNA, 18 nt, Homo sapiens
ucuucaacgccaucucca

SEQ ID NO: 1472220 - RNA, 17 nt, Homo sapiens
ucuucacaaaacacuuc

SEQ ID NO: 1472221 - RNA, 15 nt, Homo sapiens
ucuucacaccauuca

SEQ ID NO: 1472222 - RNA, 20 nt, Homo sapiens
ucuucaccaggugcaugcau

SEQ ID NO: 1472223 - RNA, 15 nt, Homo sapiens
ucuucacugugguca

SEQ ID NO: 1472224 - RNA, 21 nt, Homo sapiens
ucuucacuucuaaaugcauau

SEQ ID NO: 1472225 - RNA, 16 nt, Homo sapiens
ucuucagaagacacug

SEQ ID NO: 1472226 - RNA, 12 nt, Homo sapiens
ucuucagaauua

SEQ ID NO: 1472227 - RNA, 17 nt, Homo sapiens
ucuucagaggagaaaga

SEQ ID NO: 1472228 - RNA, 16 nt, Homo sapiens
ucuucaggccucccuc

SEQ ID NO: 1472229 - RNA, 16 nt, Homo sapiens
ucuucagggccagucc

SEQ ID NO: 1472230 - RNA, 18 nt, Homo sapiens
ucuuccaaagcacauuga

SEQ ID NO: 1472231 - RNA, 13 nt, Homo sapiens
ucuuccagcccau

SEQ ID NO: 1472232 - RNA, 22 nt, Homo sapiens
ucuuccagcccaucuccgggga

SEQ ID NO: 1472233 - RNA, 12 nt, Homo sapiens
ucuuccaugacc

SEQ ID NO: 1472234 - RNA, 13 nt, Homo sapiens
ucuucccaugacu

SEQ ID NO: 1472235 - RNA, 14 nt, Homo sapiens
ucuucccaugacug

SEQ ID NO: 1472236 - RNA, 13 nt, Homo sapiens
ucuuccccagaga

SEQ ID NO: 1472237 - RNA, 11 nt, Homo sapiens
ucuucccuacc

SEQ ID NO: 1472238 - RNA, 19 nt, Homo sapiens
ucuucccucagaaacuaga

SEQ ID NO: 1472239 - RNA, 23 nt, Homo sapiens
ucuucccugggcugccaccagcc

SEQ ID NO: 1472240 - RNA, 23 nt, Homo sapiens
ucuucccuguaugauuccuugau

SEQ ID NO: 1472241 - RNA, 19 nt, Homo sapiens
ucuuccuccucgcugccag

SEQ ID NO: 1472242 - RNA, 23 nt, Homo sapiens
ucuuccuccucgcugccagauga

SEQ ID NO: 1472243 - RNA, 19 nt, Homo sapiens
ucuuccugaguggugccaa

SEQ ID NO: 1472244 - RNA, 18 nt, Homo sapiens
ucuccccagcccagagac

SEQ ID NO: 1472245 - RNA, 16 nt, Homo sapiens
ucuccguaauuagcau

SEQ ID NO: 1472246 - RNA, 13 nt, Homo sapiens
ucuccuccagugu

SEQ ID NO: 1472247 - RNA, 18 nt, Homo sapiens
ucuccugggccguuacau

SEQ ID NO: 1472248 - RNA, 16 nt, Homo sapiens
ucuccuguauaaucuc

SEQ ID NO: 1472249 - RNA, 17 nt, Homo sapiens
ucuccuuacagucacua

SEQ ID NO: 1472250 - RNA, 16 nt, Homo sapiens
ucuccuucccauuucu

SEQ ID NO: 1472251 - RNA, 14 nt, Homo sapiens
ucuccuuugcugag

SEQ ID NO: 1472252 - RNA, 15 nt, Homo sapiens
ucucgaucuccugac

SEQ ID NO: 1472253 - RNA, 18 nt, Homo sapiens
ucucgccacugcacucca

SEQ ID NO: 1472254 - RNA, 12 nt, Homo sapiens
ucucgcuuuguu

SEQ ID NO: 1472255 - RNA, 20 nt, Homo sapiens
ucucggcucaggcucugcug

SEQ ID NO: 1472256 - RNA, 16 nt, Homo sapiens
ucucgggugcauuuga

SEQ ID NO: 1472257 - RNA, 15 nt, Homo sapiens
ucucuaaaagcuuua

SEQ ID NO: 1472258 - RNA, 18 nt, Homo sapiens
ucucuauucucugcaauu

SEQ ID NO: 1472259 - RNA, 23 nt, Homo sapiens
ucucuccgucuguuuuugcaacu

SEQ ID NO: 1472260 - RNA, 20 nt, Homo sapiens
ucucuccugauagucuuuca

SEQ ID NO: 1472261 - RNA, 11 nt, Homo sapiens
ucucucugauc

SEQ ID NO: 1472262 - RNA, 14 nt, Homo sapiens
ucucucuucccuca

SEQ ID NO: 1472263 - RNA, 17 nt, Homo sapiens
ucucugcagacuuccca

SEQ ID NO: 1472264 - RNA, 12 nt, Homo sapiens
ucucugcauuga

SEQ ID NO: 1472265 - RNA, 13 nt, Homo sapiens
ucucugguaauau

SEQ ID NO: 1472266 - RNA, 16 nt, Homo sapiens
ucucugguuuacuuca

SEQ ID NO: 1472267 - RNA, 19 nt, Homo sapiens
ucucugucccuugcuguau

SEQ ID NO: 1472268 - RNA, 16 nt, Homo sapiens
ucucuuagcaacucag

SEQ ID NO: 1472269 - RNA, 16 nt, Homo sapiens
ucucuuauagaauauu

SEQ ID NO: 1472270 - RNA, 20 nt, Homo sapiens
ucucuugaaaaguucaggga

SEQ ID NO: 1472271 - RNA, 24 nt, Homo sapiens
ucucuugggcccaggacuguugau

SEQ ID NO: 1472272 - RNA, 19 nt, Homo sapiens
ucucuuuaaaaccauauca

SEQ ID NO: 1472273 - RNA, 21 nt, Homo sapiens
ucucuuuaguauaauugaccu

SEQ ID NO: 1472274 - RNA, 21 nt, Homo sapiens
ucugaaacccacagaugucuc

SEQ ID NO: 1472275 - RNA, 23 nt, Homo sapiens
ucugaaaggauguggaagagcau

SEQ ID NO: 1472276 - RNA, 15 nt, Homo sapiens
ucugaagacagucuu

SEQ ID NO: 1472277 - RNA, 13 nt, Homo sapiens
ucugaagucacau

SEQ ID NO: 1472278 - RNA, 17 nt, Homo sapiens
ucugaagucacugcaca

SEQ ID NO: 1472279 - RNA, 23 nt, Homo sapiens
ucugacagaaagcagauaccuca

SEQ ID NO: 1472280 - RNA, 15 nt, Homo sapiens
ucugacaugcauugu

SEQ ID NO: 1472281 - RNA, 13 nt, Homo sapiens
ucugaccaaaaca

SEQ ID NO: 1472282 - RNA, 12 nt, Homo sapiens
ucugacucucca

SEQ ID NO: 1472283 - RNA, 11 nt, Homo sapiens
ucugacugcug

SEQ ID NO: 1472284 - RNA, 14 nt, Homo sapiens
ucugagaauuucca

SEQ ID NO: 1472285 - RNA, 22 nt, Homo sapiens
ucugagacccuuuucucaggac

SEQ ID NO: 1472286 - RNA, 13 nt, Homo sapiens
ucugagacucaca

SEQ ID NO: 1472287 - RNA, 21 nt, Homo sapiens
ucugagagugaaaccaugacu

SEQ ID NO: 1472288 - RNA, 20 nt, Homo sapiens
ucugagcaagagcuggcaaa

SEQ ID NO: 1472289 - RNA, 11 nt, Homo sapiens
ucugagcccag

SEQ ID NO: 1472290 - RNA, 17 nt, Homo sapiens
ucugagcccagcugccu

SEQ ID NO: 1472291 - RNA, 16 nt, Homo sapiens
ucugaggauucagggg

SEQ ID NO: 1472292 - RNA, 13 nt, Homo sapiens
ucugaggucauua

SEQ ID NO: 1472293 - RNA, 20 nt, Homo sapiens
ucugagugaaccuguauaag

SEQ ID NO: 1472294 - RNA, 15 nt, Homo sapiens
ucugauaacagaauu

SEQ ID NO: 1472295 - RNA, 19 nt, Homo sapiens
ucugauaccacugcacugu

SEQ ID NO: 1472296 - RNA, 14 nt, Homo sapiens
ucugauguuaacca

SEQ ID NO: 1472297 - RNA, 18 nt, Homo sapiens
ucugauuaaaaugcuucc

SEQ ID NO: 1472298 - RNA, 14 nt, Homo sapiens
ucugauuggcucac

SEQ ID NO: 1472299 - RNA, 16 nt, Homo sapiens
ucugauuggugauuca

SEQ ID NO: 1472300 - RNA, 20 nt, Homo sapiens
ucugcaaaaauggauauuau

SEQ ID NO: 1472301 - RNA, 23 nt, Homo sapiens
ucugcaauaugaauucaagaaag

SEQ ID NO: 1472302 - RNA, 19 nt, Homo sapiens
ucugcacccacgugcauuc

SEQ ID NO: 1472303 - RNA, 12 nt, Homo sapiens
ucugcacccagg

SEQ ID NO: 1472304 - RNA, 11 nt, Homo sapiens
ucugcacggga

SEQ ID NO: 1472305 - RNA, 18 nt, Homo sapiens
ucugcacucuaaacugca

SEQ ID NO: 1472306 - RNA, 12 nt, Homo sapiens
ucugcaucccag

SEQ ID NO: 1472307 - RNA, 17 nt, Homo sapiens
ucugcauuaucuaugca

SEQ ID NO: 1472308 - RNA, 18 nt, Homo sapiens
ucugccaaaguacucuua

SEQ ID NO: 1472309 - RNA, 21 nt, Homo sapiens
uccuaacugaaagaugaucau

SEQ ID NO: 1472310 - RNA, 12 nt, Homo sapiens
uccuaagcacuu

SEQ ID NO: 1472311 - RNA, 13 nt, Homo sapiens
uccuaauucaauc

SEQ ID NO: 1472312 - RNA, 19 nt, Homo sapiens
uccuacagcacuacugggu

SEQ ID NO: 1472313 - RNA, 17 nt, Homo sapiens
uccuacaucuucuuccc

SEQ ID NO: 1472314 - RNA, 15 nt, Homo sapiens
uccuacguauccugc

SEQ ID NO: 1472315 - RNA, 16 nt, Homo sapiens
uccuacguauccugca

SEQ ID NO: 1472316 - RNA, 18 nt, Homo sapiens
uccuacuaucacugaaca

SEQ ID NO: 1472317 - RNA, 19 nt, Homo sapiens
uccuaggagagccaaccuc

SEQ ID NO: 1472318 - RNA, 16 nt, Homo sapiens
uccuaggaugucaugu

SEQ ID NO: 1472319 - RNA, 23 nt, Homo sapiens
uccuaggggaacagaccagugac

SEQ ID NO: 1472320 - RNA, 14 nt, Homo sapiens
uccuauauccugug

SEQ ID NO: 1472321 - RNA, 16 nt, Homo sapiens
uccuauccacugggca

SEQ ID NO: 1472322 - RNA, 17 nt, Homo sapiens
uccuaugcuguucacug

SEQ ID NO: 1472323 - RNA, 19 nt, Homo sapiens
uccuauuaaaacacagcuu

SEQ ID NO: 1472324 - RNA, 13 nt, Homo sapiens
uccuauugucauu

SEQ ID NO: 1472325 - RNA, 16 nt, Homo sapiens
uccuauugucauuaaa

SEQ ID NO: 1472326 - RNA, 15 nt, Homo sapiens
uccucaagaacacag

SEQ ID NO: 1472327 - RNA, 22 nt, Homo sapiens
uccucacacacccugaggucag

SEQ ID NO: 1472328 - RNA, 15 nt, Homo sapiens
uccucagcuuaucuc

SEQ ID NO: 1472329 - RNA, 13 nt, Homo sapiens
uccucauguacau

SEQ ID NO: 1472330 - RNA, 21 nt, Homo sapiens
uccuccagcccagacccagug

SEQ ID NO: 1472331 - RNA, 22 nt, Homo sapiens
uccuccauaaauuauggcauuu

SEQ ID NO: 1472332 - RNA, 15 nt, Homo sapiens
uccucccaccucagc

SEQ ID NO: 1472333 - RNA, 14 nt, Homo sapiens
uccucccagugaga

SEQ ID NO: 1472334 - RNA, 10 nt, Homo sapiens
uccuccucag

SEQ ID NO: 1472335 - RNA, 19 nt, Homo sapiens
uccuccuggaacagaagac

SEQ ID NO: 1472336 - RNA, 17 nt, Homo sapiens
uccucuauuuugugaug

SEQ ID NO: 1472337 - RNA, 16 nt, Homo sapiens
uccucuccacugccuu

SEQ ID NO: 1472338 - RNA, 14 nt, Homo sapiens
uccucuccuacuuu

SEQ ID NO: 1472339 - RNA, 14 nt, Homo sapiens
uccucuucagagga

SEQ ID NO: 1472340 - RNA, 15 nt, Homo sapiens
uccucuugaaccaca

SEQ ID NO: 1472341 - RNA, 14 nt, Homo sapiens
uccucuugauuccu

SEQ ID NO: 1472342 - RNA, 16 nt, Homo sapiens
uccucuuggugucaua

SEQ ID NO: 1472343 - RNA, 19 nt, Homo sapiens
uccugacagaaggacucag

SEQ ID NO: 1472344 - RNA, 13 nt, Homo sapiens
uccugaccucagg

SEQ ID NO: 1472345 - RNA, 17 nt, Homo sapiens
uccugacuccuaccugc

SEQ ID NO: 1472346 - RNA, 13 nt, Homo sapiens
uccugacugaaag

SEQ ID NO: 1472347 - RNA, 19 nt, Homo sapiens
uccugaggggcaucugccc

SEQ ID NO: 1472348 - RNA, 13 nt, Homo sapiens
uccugcaacucaa

SEQ ID NO: 1472349 - RNA, 14 nt, Homo sapiens
uccugccacaugga

SEQ ID NO: 1472350 - RNA, 19 nt, Homo sapiens
uccugccauggaucucuug

SEQ ID NO: 1472351 - RNA, 18 nt, Homo sapiens
uccugcccagcacaggaa

SEQ ID NO: 1472352 - RNA, 18 nt, Homo sapiens
uccugccuguagcaguga

SEQ ID NO: 1472353 - RNA, 16 nt, Homo sapiens
uccugccuucauggaa

SEQ ID NO: 1472354 - RNA, 17 nt, Homo sapiens
uccugcugcuucugcaa

SEQ ID NO: 1472355 - RNA, 20 nt, Homo sapiens
uccuggaacagaagacagcu

SEQ ID NO: 1472356 - RNA, 13 nt, Homo sapiens
uccuggaaccaau

SEQ ID NO: 1472357 - RNA, 19 nt, Homo sapiens
uccuggcuaacauggugaa

SEQ ID NO: 1472358 - RNA, 21 nt, Homo sapiens
uccugggagcccccaccacaa

SEQ ID NO: 1472359 - RNA, 16 nt, Homo sapiens
uccuggguacugaaag

SEQ ID NO: 1472360 - RNA, 14 nt, Homo sapiens
uccugggucuacca

SEQ ID NO: 1472361 - RNA, 19 nt, Homo sapiens
uccuguacauugugggaug

SEQ ID NO: 1472362 - RNA, 19 nt, Homo sapiens
uccuguacucuggggugcu

SEQ ID NO: 1472363 - RNA, 20 nt, Homo sapiens
uccuguauaagcacugaaaa

SEQ ID NO: 1472364 - RNA, 23 nt, Homo sapiens
uccuguccagcuccaaccugcaa

SEQ ID NO: 1472365 - RNA, 21 nt, Homo sapiens
uccuguccccaaaaugugaug

SEQ ID NO: 1472366 - RNA, 18 nt, Homo sapiens
uccugugacauguaacag

SEQ ID NO: 1472367 - RNA, 18 nt, Homo sapiens
uccugugggagaucuuca

SEQ ID NO: 1472368 - RNA, 15 nt, Homo sapiens
uccuuaacacauuca

SEQ ID NO: 1472369 - RNA, 16 nt, Homo sapiens
uccuuaacacauucaa

SEQ ID NO: 1472370 - RNA, 20 nt, Homo sapiens
uccuuacgcuuugucacaca

SEQ ID NO: 1472371 - RNA, 16 nt, Homo sapiens
uccuuauucagaauuu

SEQ ID NO: 1472372 - RNA, 18 nt, Homo sapiens
uccuuauuguuaaaaaca

SEQ ID NO: 1472373 - RNA, 23 nt, Homo sapiens
guaucccccgccuuuaguucucc

SEQ ID NO: 1472374 - RNA, 13 nt, Homo sapiens
guauccugugaca

SEQ ID NO: 1472375 - RNA, 17 nt, Homo sapiens
guaucuucaaacuuuca

SEQ ID NO: 1472376 - RNA, 23 nt, Homo sapiens
guaucuuuugaacuggcaauugu

SEQ ID NO: 1472377 - RNA, 17 nt, Homo sapiens
guaugaucucucuagcu

SEQ ID NO: 1472378 - RNA, 12 nt, Homo sapiens
guaugccaagug

SEQ ID NO: 1472379 - RNA, 20 nt, Homo sapiens
guauggaaaaaccauuugaa

SEQ ID NO: 1472380 - RNA, 17 nt, Homo sapiens
guauggcaaacugccau

SEQ ID NO: 1472381 - RNA, 17 nt, Homo sapiens
guauguaauuuaugcaa

SEQ ID NO: 1472382 - RNA, 15 nt, Homo sapiens
guauguauauauaca

SEQ ID NO: 1472383 - RNA, 20 nt, Homo sapiens
guauguauuuucaguuacaa

SEQ ID NO: 1472384 - RNA, 10 nt, Homo sapiens
guaugugcac

SEQ ID NO: 1472385 - RNA, 21 nt, Homo sapiens
guauguucccucuugucccuu

SEQ ID NO: 1472386 - RNA, 13 nt, Homo sapiens
guauuaaagacag

SEQ ID NO: 1472387 - RNA, 24 nt, Homo sapiens
guauuacccuccuaauagucauac

SEQ ID NO: 1472388 - RNA, 17 nt, Homo sapiens
guauuagccaagcuggu

SEQ ID NO: 1472389 - RNA, 19 nt, Homo sapiens
guauuaggugucauuucca

SEQ ID NO: 1472390 - RNA, 18 nt, Homo sapiens
guauuauucuguuuugca

SEQ ID NO: 1472391 - RNA, 21 nt, Homo sapiens
guauuauucuguuuugcacag

SEQ ID NO: 1472392 - RNA, 17 nt, Homo sapiens
guauuauuuuacaauca

SEQ ID NO: 1472393 - RNA, 22 nt, Homo sapiens
guauuauuuuacaaucaacaaa

SEQ ID NO: 1472394 - RNA, 19 nt, Homo sapiens
guauuccgauacaaagugu

SEQ ID NO: 1472395 - RNA, 15 nt, Homo sapiens
guauucuucaaccuc

SEQ ID NO: 1472396 - RNA, 19 nt, Homo sapiens
guauuugaaaacucacaga

SEQ ID NO: 1472397 - RNA, 13 nt, Homo sapiens
gucaaaaaucugu

SEQ ID NO: 1472398 - RNA, 17 nt, Homo sapiens
gucaaaacaagacuccu

SEQ ID NO: 1472399 - RNA, 16 nt, Homo sapiens
gucaacagcgugcagg

SEQ ID NO: 1472400 - RNA, 14 nt, Homo sapiens
gucaacauaugcaa

SEQ ID NO: 1472401 - RNA, 14 nt, Homo sapiens
gucaacuaugauau

SEQ ID NO: 1472402 - RNA, 23 nt, Homo sapiens
gucaacuucuggcuccucaaaca

SEQ ID NO: 1472403 - RNA, 23 nt, Homo sapiens
gucaagaagaaaaagguuugcau

SEQ ID NO: 1472404 - RNA, 21 nt, Homo sapiens
gucaagcaccugcaugugcug

SEQ ID NO: 1472405 - RNA, 21 nt, Homo sapiens
gucaauauuaaauacagacac

SEQ ID NO: 1472406 - RNA, 22 nt, Homo sapiens
gucacaacaacaacaacaaaaa

SEQ ID NO: 1472407 - RNA, 11 nt, Homo sapiens
gucacacuggu

SEQ ID NO: 1472408 - RNA, 15 nt, Homo sapiens
gucacagaagcagcu

SEQ ID NO: 1472409 - RNA, 13 nt, Homo sapiens
gucacagccaccc

SEQ ID NO: 1472410 - RNA, 13 nt, Homo sapiens
gucacaugaccca

SEQ ID NO: 1472411 - RNA, 21 nt, Homo sapiens
gucaccagaauauuucuuuca

SEQ ID NO: 1472412 - RNA, 20 nt, Homo sapiens
gucacccuuggacaagacaa

SEQ ID NO: 1472413 - RNA, 19 nt, Homo sapiens
gucaccggccgauggagac

SEQ ID NO: 1472414 - RNA, 23 nt, Homo sapiens
gucacgcuggggcucucugagac

SEQ ID NO: 1472415 - RNA, 22 nt, Homo sapiens
gucacugaacaccuauugcacu

SEQ ID NO: 1472416 - RNA, 18 nt, Homo sapiens
gucacuuauccucuugga

SEQ ID NO: 1472417 - RNA, 13 nt, Homo sapiens
gucacuucaccau

SEQ ID NO: 1472418 - RNA, 20 nt, Homo sapiens
gucagauuugaacucuucaa

SEQ ID NO: 1472419 - RNA, 20 nt, Homo sapiens
gucagcccaugugcaccugc

SEQ ID NO: 1472420 - RNA, 16 nt, Homo sapiens
gucagguaguugcaau

SEQ ID NO: 1472421 - RNA, 20 nt, Homo sapiens
gucaguccaggaugcuaaca

SEQ ID NO: 1472422 - RNA, 17 nt, Homo sapiens
uaaaaaucacacuguaa

SEQ ID NO: 1472423 - RNA, 13 nt, Homo sapiens
uaaaaauguccug

SEQ ID NO: 1472424 - RNA, 17 nt, Homo sapiens
uaaaaauguccugccuu

SEQ ID NO: 1472425 - RNA, 15 nt, Homo sapiens
uaaaacaauacucaa

SEQ ID NO: 1472426 - RNA, 17 nt, Homo sapiens
uaaaacggugcugugag

SEQ ID NO: 1472427 - RNA, 16 nt, Homo sapiens
uaaaacucacugugau

SEQ ID NO: 1472428 - RNA, 19 nt, Homo sapiens
uaaaacuuuucugcugaua

SEQ ID NO: 1472429 - RNA, 18 nt, Homo sapiens
uaaaagaaaauccauuau

SEQ ID NO: 1472430 - RNA, 19 nt, Homo sapiens
uaaaagaaccgagcaauuu

SEQ ID NO: 1472431 - RNA, 15 nt, Homo sapiens
uaaaagaaggaugaa

SEQ ID NO: 1472432 - RNA, 16 nt, Homo sapiens
uaaaaguggauuuaga

SEQ ID NO: 1472433 - RNA, 20 nt, Homo sapiens
uaaaaguuacuuaccacaga

SEQ ID NO: 1472434 - RNA, 20 nt, Homo sapiens
uaaaaguuuacaacuugauu

SEQ ID NO: 1472435 - RNA, 17 nt, Homo sapiens
uaaaauaaaaugcagac

SEQ ID NO: 1472436 - RNA, 16 nt, Homo sapiens
uaaaauaagagauccu

SEQ ID NO: 1472437 - RNA, 19 nt, Homo sapiens
uaaaauacuauugccucau

SEQ ID NO: 1472438 - RNA, 14 nt, Homo sapiens
uaaaauacugaaua

SEQ ID NO: 1472439 - RNA, 21 nt, Homo sapiens
uaaaauauaauuuucaaaaag

SEQ ID NO: 1472440 - RNA, 14 nt, Homo sapiens
uaaaauauaucauc

SEQ ID NO: 1472441 - RNA, 18 nt, Homo sapiens
uaaaauauauuucagaua

SEQ ID NO: 1472442 - RNA, 14 nt, Homo sapiens
uaaaauauuacaca

SEQ ID NO: 1472443 - RNA, 20 nt, Homo sapiens
uaaaaugugaggaagaacua

SEQ ID NO: 1472444 - RNA, 23 nt, Homo sapiens
uaaaauuaaucacaaauuucacu

SEQ ID NO: 1472445 - RNA, 15 nt, Homo sapiens
uaaaauuaccagaca

SEQ ID NO: 1472446 - RNA, 18 nt, Homo sapiens
uaaaauuaggacuguaua

SEQ ID NO: 1472447 - RNA, 18 nt, Homo sapiens
uaaaauuaucaauaucua

SEQ ID NO: 1472448 - RNA, 19 nt, Homo sapiens
uaaaauucagaugcuguua

SEQ ID NO: 1472449 - RNA, 17 nt, Homo sapiens
uaaaauugaaaguaaua

SEQ ID NO: 1472450 - RNA, 20 nt, Homo sapiens
uaaaauuuaacuuuugagca

SEQ ID NO: 1472451 - RNA, 17 nt, Homo sapiens
uaaacagauggcacuuu

SEQ ID NO: 1472452 - RNA, 17 nt, Homo sapiens
uaaacaguggaauauaa

SEQ ID NO: 1472453 - RNA, 18 nt, Homo sapiens
uaaacauuggacagugag

SEQ ID NO: 1472454 - RNA, 17 nt, Homo sapiens
uaaacauuucauuuccc

SEQ ID NO: 1472455 - RNA, 14 nt, Homo sapiens
uaaaccaaggacug

SEQ ID NO: 1472456 - RNA, 16 nt, Homo sapiens
uaaaccuccuucggga

SEQ ID NO: 1472457 - RNA, 15 nt, Homo sapiens
uaaaccuuacaugug

SEQ ID NO: 1472458 - RNA, 22 nt, Homo sapiens
uaaacggcucagacaggcagau

SEQ ID NO: 1472459 - RNA, 17 nt, Homo sapiens
uaaacuauuuguggcaa

SEQ ID NO: 1472460 - RNA, 23 nt, Homo sapiens
uaaacuccuuccuggccugagag

SEQ ID NO: 1472461 - RNA, 15 nt, Homo sapiens
uaaacucuguugcaa

SEQ ID NO: 1472462 - RNA, 21 nt, Homo sapiens
uaaacugcaggagcaguuugc

SEQ ID NO: 1472463 - RNA, 21 nt, Homo sapiens
uaaacuguacagaauuuccac

SEQ ID NO: 1472464 - RNA, 17 nt, Homo sapiens
uaaacuguaugcucaca

SEQ ID NO: 1472465 - RNA, 15 nt, Homo sapiens
uaaacuuaacuuuaa

SEQ ID NO: 1472466 - RNA, 14 nt, Homo sapiens
uaaacuuguuuaca

SEQ ID NO: 1472467 - RNA, 22 nt, Homo sapiens
uaaagaaccaucagcaucaccc

SEQ ID NO: 1472468 - RNA, 19 nt, Homo sapiens
uaaagaaggguguuuaaua

SEQ ID NO: 1472469 - RNA, 14 nt, Homo sapiens
uaaagacucaaggu

SEQ ID NO: 1472470 - RNA, 12 nt, Homo sapiens
uaaagacuguag

SEQ ID NO: 1472471 - RNA, 20 nt, Homo sapiens
uaaagagagaauguagauau

SEQ ID NO: 1472472 - RNA, 18 nt, Homo sapiens
uaaagagcacuuacugua

SEQ ID NO: 1472473 - RNA, 17 nt, Homo sapiens
uaaagaucaugacauau

SEQ ID NO: 1472474 - RNA, 17 nt, Homo sapiens
uaaagaugaucuacuca

SEQ ID NO: 1472475 - RNA, 18 nt, Homo sapiens
uaaagaugaucuacucag

SEQ ID NO: 1472476 - RNA, 15 nt, Homo sapiens
uaaagauggcacuuu

SEQ ID NO: 1472477 - RNA, 23 nt, Homo sapiens
uaaagcaaucugauucagcauca

SEQ ID NO: 1472478 - RNA, 15 nt, Homo sapiens
gguugggcuauagca

SEQ ID NO: 1472479 - RNA, 20 nt, Homo sapiens
gguuggggccgggcacauug

SEQ ID NO: 1472480 - RNA, 18 nt, Homo sapiens
gguuggggugacagucau

SEQ ID NO: 1472481 - RNA, 19 nt, Homo sapiens
gguuucaccguguuagcca

SEQ ID NO: 1472482 - RNA, 20 nt, Homo sapiens
gguuucauguucacugugag

SEQ ID NO: 1472483 - RNA, 22 nt, Homo sapiens
gguuugagaauguuuuuagcug

SEQ ID NO: 1472484 - RNA, 17 nt, Homo sapiens
gguuuggucaguuacaa

SEQ ID NO: 1472485 - RNA, 23 nt, Homo sapiens
gguuugucgggcaccagccagcg

SEQ ID NO: 1472486 - RNA, 16 nt, Homo sapiens
guaaaagugugagcag

SEQ ID NO: 1472487 - RNA, 21 nt, Homo sapiens
guaaaaguucuuuuugcucua

SEQ ID NO: 1472488 - RNA, 11 nt, Homo sapiens
guaaacauacu

SEQ ID NO: 1472489 - RNA, 15 nt, Homo sapiens
guaaagaaguuugau

SEQ ID NO: 1472490 - RNA, 12 nt, Homo sapiens
guaaagacugua

SEQ ID NO: 1472491 - RNA, 14 nt, Homo sapiens
guaaauaacaggca

SEQ ID NO: 1472492 - RNA, 21 nt, Homo sapiens
guaaauacacauagcauguaa

SEQ ID NO: 1472493 - RNA, 13 nt, Homo sapiens
guaaauacaggua

SEQ ID NO: 1472494 - RNA, 20 nt, Homo sapiens
guaaauacuguaaaugcauu

SEQ ID NO: 1472495 - RNA, 18 nt, Homo sapiens
guaaaucaggacaggugg

SEQ ID NO: 1472496 - RNA, 11 nt, Homo sapiens
guaaaucucac

SEQ ID NO: 1472497 - RNA, 22 nt, Homo sapiens
guaaaugaucacuccaggauau

SEQ ID NO: 1472498 - RNA, 15 nt, Homo sapiens
guaaauuuuuaggca

SEQ ID NO: 1472499 - RNA, 19 nt, Homo sapiens
guaacaaauaaagugcagu

SEQ ID NO: 1472500 - RNA, 14 nt, Homo sapiens
guaacaacuguggu

SEQ ID NO: 1472501 - RNA, 18 nt, Homo sapiens
guaacaacuguggucaau

SEQ ID NO: 1472502 - RNA, 20 nt, Homo sapiens
guaacaauuguguagccuuu

SEQ ID NO: 1472503 - RNA, 16 nt, Homo sapiens
guaacaguucauguuu

SEQ ID NO: 1472504 - RNA, 16 nt, Homo sapiens
guaacauauucuguau

SEQ ID NO: 1472505 - RNA, 14 nt, Homo sapiens
guaacaucuguuau

SEQ ID NO: 1472506 - RNA, 18 nt, Homo sapiens
guaaccuuauauuuacaa

SEQ ID NO: 1472507 - RNA, 19 nt, Homo sapiens
guaacugugccaguucuuu

SEQ ID NO: 1472508 - RNA, 18 nt, Homo sapiens
guaacuuugaaagguaua

SEQ ID NO: 1472509 - RNA, 13 nt, Homo sapiens
guaagaagagcca

SEQ ID NO: 1472510 - RNA, 14 nt, Homo sapiens
guaagaaggcaaua

SEQ ID NO: 1472511 - RNA, 14 nt, Homo sapiens
guaagaugcacuga

SEQ ID NO: 1472512 - RNA, 17 nt, Homo sapiens
guaaggugcaucuguuu

SEQ ID NO: 1472513 - RNA, 12 nt, Homo sapiens
guaagugcugcu

SEQ ID NO: 1472514 - RNA, 19 nt, Homo sapiens
guaaguuucaggugacaug

SEQ ID NO: 1472515 - RNA, 13 nt, Homo sapiens
guaauaacaaacg

SEQ ID NO: 1472516 - RNA, 17 nt, Homo sapiens
guaauaagcaaucaagg

SEQ ID NO: 1472517 - RNA, 13 nt, Homo sapiens
guaauacuggaau

SEQ ID NO: 1472518 - RNA, 21 nt, Homo sapiens
guaauacuggaauaauuugua

SEQ ID NO: 1472519 - RNA, 16 nt, Homo sapiens
guaaucccaacacuuu

SEQ ID NO: 1472520 - RNA, 16 nt, Homo sapiens
guaaucccagcacuuu

SEQ ID NO: 1472521 - RNA, 18 nt, Homo sapiens
guaaucccagcuacucag

SEQ ID NO: 1472522 - RNA, 16 nt, Homo sapiens
guaaucccagcuacuu

SEQ ID NO: 1472523 - RNA, 20 nt, Homo sapiens
guaaucccagcuacuuggga

SEQ ID NO: 1472524 - RNA, 18 nt, Homo sapiens
guaaucucucugcagcug

SEQ ID NO: 1472525 - RNA, 18 nt, Homo sapiens
guaauuaaaggaacagag

SEQ ID NO: 1472526 - RNA, 20 nt, Homo sapiens
guaauuaaguacuauguauc

SEQ ID NO: 1472527 - RNA, 20 nt, Homo sapiens
guaauugcagauaacuuuga

SEQ ID NO: 1472528 - RNA, 20 nt, Homo sapiens
guacaauuaaguaaagucaa

SEQ ID NO: 1472529 - RNA, 16 nt, Homo sapiens
guacaggaaugaaccu

SEQ ID NO: 1472530 - RNA, 16 nt, Homo sapiens
guacaguauuucugga

SEQ ID NO: 1472531 - RNA, 14 nt, Homo sapiens
guacagugagccaa

SEQ ID NO: 1472532 - RNA, 21 nt, Homo sapiens
guacaguucugggguacaugu

SEQ ID NO: 1472533 - RNA, 15 nt, Homo sapiens
guacaucugcaauau

SEQ ID NO: 1472534 - RNA, 12 nt, Homo sapiens
guacaucuggcc

SEQ ID NO: 1472535 - RNA, 11 nt, Homo sapiens
guacaugagaa

SEQ ID NO: 1472536 - RNA, 23 nt, Homo sapiens
guacaugauaaaugauagacaau

SEQ ID NO: 1472537 - RNA, 21 nt, Homo sapiens
guacauggaauaacauguaau

SEQ ID NO: 1472538 - RNA, 22 nt, Homo sapiens
guacauggaauaacauguaauu

SEQ ID NO: 1472539 - RNA, 22 nt, Homo sapiens
guacauucaauguuuaugcaag

SEQ ID NO: 1472540 - RNA, 21 nt, Homo sapiens
guacauuggcugguaacaguu

SEQ ID NO: 1472541 - RNA, 16 nt, Homo sapiens
guaccaaaucugacau

SEQ ID NO: 1472542 - RNA, 18 nt, Homo sapiens
guacccuuuggggagcag

SEQ ID NO: 1472543 - RNA, 14 nt, Homo sapiens
guaccgucuucucc

SEQ ID NO: 1472544 - RNA, 13 nt, Homo sapiens
guaccucuaagua

SEQ ID NO: 1472545 - RNA, 18 nt, Homo sapiens
guaccucuucccaugacu

SEQ ID NO: 1472546 - RNA, 23 nt, Homo sapiens
guacuauccaaucugugaugaca

SEQ ID NO: 1472547 - RNA, 16 nt, Homo sapiens
guacuauguaucaaug

SEQ ID NO: 1472548 - RNA, 20 nt, Homo sapiens
guacuccagccugggugaca

SEQ ID NO: 1472549 - RNA, 14 nt, Homo sapiens
guacuuauguugca

SEQ ID NO: 1472550 - RNA, 20 nt, Homo sapiens
guacuuauguugcacaauga

SEQ ID NO: 1472551 - RNA, 12 nt, Homo sapiens
guacuucuugaa

SEQ ID NO: 1472552 - RNA, 22 nt, Homo sapiens
guagagggaguugucaagucuc

SEQ ID NO: 1472553 - RNA, 12 nt, Homo sapiens
guagaugggagg

SEQ ID NO: 1472554 - RNA, 12 nt, Homo sapiens
guagaugugauu

SEQ ID NO: 1472555 - RNA, 15 nt, Homo sapiens
guagaugugauuaac

SEQ ID NO: 1472556 - RNA, 16 nt, Homo sapiens
guagcucuccugacuu

SEQ ID NO: 1472557 - RNA, 19 nt, Homo sapiens
guagcugggauuacaggug

SEQ ID NO: 1472558 - RNA, 20 nt, Homo sapiens
guaggaagaugauggcucau

SEQ ID NO: 1472559 - RNA, 15 nt, Homo sapiens
guaggagcugccuug

SEQ ID NO: 1472560 - RNA, 21 nt, Homo sapiens
guaggagcugccuuggcucag

SEQ ID NO: 1472561 - RNA, 17 nt, Homo sapiens
guaggggcccacuucac

SEQ ID NO: 1472562 - RNA, 16 nt, Homo sapiens
guaggggcuacuguga

SEQ ID NO: 1472563 - RNA, 13 nt, Homo sapiens
guaguucuugucu

SEQ ID NO: 1472564 - RNA, 14 nt, Homo sapiens
guauaagcacugaa

SEQ ID NO: 1472565 - RNA, 10 nt, Homo sapiens
guauaaucuc

SEQ ID NO: 1472566 - RNA, 14 nt, Homo sapiens
guauaauugaccua

SEQ ID NO: 1472567 - RNA, 16 nt, Homo sapiens
guauaauuuaacuuca

SEQ ID NO: 1472568 - RNA, 11 nt, Homo sapiens
guauacaguau

SEQ ID NO: 1472569 - RNA, 17 nt, Homo sapiens
guauacuaagugauaca

SEQ ID NO: 1472570 - RNA, 11 nt, Homo sapiens
guauacuauag

SEQ ID NO: 1472571 - RNA, 14 nt, Homo sapiens
guauacuauaguac

SEQ ID NO: 1472572 - RNA, 15 nt, Homo sapiens
guauagaccaaagca

SEQ ID NO: 1472573 - RNA, 19 nt, Homo sapiens
guauauauguguaugcaca

SEQ ID NO: 1472574 - RNA, 14 nt, Homo sapiens
guaucaacacuguu

SEQ ID NO: 1472575 - RNA, 15 nt, Homo sapiens
guaucaacacuguua

SEQ ID NO: 1472576 - RNA, 23 nt, Homo sapiens
guaucaaguggcaugugcuguga

SEQ ID NO: 1472577 - RNA, 24 nt, Homo sapiens
guaucacagacuggcaacaagaag

SEQ ID NO: 1472578 - RNA, 18 nt, Homo sapiens
guaucaugcccugugcaa

SEQ ID NO: 1472579 - RNA, 20 nt, Homo sapiens
guaucaugcccugugcaacc

SEQ ID NO: 1472580 - RNA, 12 nt, Homo sapiens
gggggaaggugg

SEQ ID NO: 1472581 - RNA, 13 nt, Homo sapiens
gggguggagcaug

SEQ ID NO: 1472582 - RNA, 12 nt, Homo sapiens
ggggugggccac

SEQ ID NO: 1472583 - RNA, 12 nt, Homo sapiens
gggguuccucaa

SEQ ID NO: 1472584 - RNA, 13 nt, Homo sapiens
gggguuucaccug

SEQ ID NO: 1472585 - RNA, 21 nt, Homo sapiens
ggguaagaugcuccugguggc

SEQ ID NO: 1472586 - RNA, 22 nt, Homo sapiens
ggguacuucuugaaggugcuga

SEQ ID NO: 1472587 - RNA, 20 nt, Homo sapiens
ggguagaaugauuaaucaaa

SEQ ID NO: 1472588 - RNA, 23 nt, Homo sapiens
gggucaaggaguacuccaagaca

SEQ ID NO: 1472589 - RNA, 19 nt, Homo sapiens
gggucauugaccucucagg

SEQ ID NO: 1472590 - RNA, 20 nt, Homo sapiens
ggguccacccagcaaagagu

SEQ ID NO: 1472591 - RNA, 15 nt, Homo sapiens
ggguccccaccuggg

SEQ ID NO: 1472592 - RNA, 13 nt, Homo sapiens
gggucgucugccc

SEQ ID NO: 1472593 - RNA, 18 nt, Homo sapiens
gggugacccugaagugag

SEQ ID NO: 1472594 - RNA, 22 nt, Homo sapiens
gggugauuuuaugaucaguguu

SEQ ID NO: 1472595 - RNA, 17 nt, Homo sapiens
ggguggagcaugggccu

SEQ ID NO: 1472596 - RNA, 20 nt, Homo sapiens
ggguggcacucaacucugag

SEQ ID NO: 1472597 - RNA, 21 nt, Homo sapiens
gggugucaauaaagcugugcu

SEQ ID NO: 1472598 - RNA, 11 nt, Homo sapiens
gggugugcuau

SEQ ID NO: 1472599 - RNA, 22 nt, Homo sapiens
ggguuaaagcagacagucacac

SEQ ID NO: 1472600 - RNA, 21 nt, Homo sapiens
ggguucuuauuuugcauucca

SEQ ID NO: 1472601 - RNA, 21 nt, Homo sapiens
ggguucuuggugaugcuggca

SEQ ID NO: 1472602 - RNA, 20 nt, Homo sapiens
ggguuucaccaucuuggcca

SEQ ID NO: 1472603 - RNA, 14 nt, Homo sapiens
ggguuuugcuacau

SEQ ID NO: 1472604 - RNA, 15 nt, Homo sapiens
gguaaaggucugugg

SEQ ID NO: 1472605 - RNA, 16 nt, Homo sapiens
gguaacaguggcugcu

SEQ ID NO: 1472606 - RNA, 23 nt, Homo sapiens
gguaacuuuuuuuuaaagcucau

SEQ ID NO: 1472607 - RNA, 21 nt, Homo sapiens
gguaaggugugaaccuaccug

SEQ ID NO: 1472608 - RNA, 20 nt, Homo sapiens
gguagggugggagugguuua

SEQ ID NO: 1472609 - RNA, 18 nt, Homo sapiens
gguaguuagccaucuaau

SEQ ID NO: 1472610 - RNA, 13 nt, Homo sapiens
gguaugaccagug

SEQ ID NO: 1472611 - RNA, 12 nt, Homo sapiens
gguaugagcuga

SEQ ID NO: 1472612 - RNA, 21 nt, Homo sapiens
gguaugucugccauguugccc

SEQ ID NO: 1472613 - RNA, 19 nt, Homo sapiens
gguauuauucuguuuugca

SEQ ID NO: 1472614 - RNA, 19 nt, Homo sapiens
ggucaaacuaauucucaca

SEQ ID NO: 1472615 - RNA, 16 nt, Homo sapiens
ggucaaguaagaagac

SEQ ID NO: 1472616 - RNA, 13 nt, Homo sapiens
ggucacacucuca

SEQ ID NO: 1472617 - RNA, 12 nt, Homo sapiens
ggucacaugaug

SEQ ID NO: 1472618 - RNA, 15 nt, Homo sapiens
ggucacauucaggaa

SEQ ID NO: 1472619 - RNA, 17 nt, Homo sapiens
ggucacauugugccuuu

SEQ ID NO: 1472620 - RNA, 20 nt, Homo sapiens
ggucagcuuuuguuguuuau

SEQ ID NO: 1472621 - RNA, 14 nt, Homo sapiens
ggucauacaugcau

SEQ ID NO: 1472622 - RNA, 15 nt, Homo sapiens
ggucauccaaacuca

SEQ ID NO: 1472623 - RNA, 17 nt, Homo sapiens
ggucauccaaacucaaa

SEQ ID NO: 1472624 - RNA, 19 nt, Homo sapiens
ggucaucucggcuguuccu

SEQ ID NO: 1472625 - RNA, 21 nt, Homo sapiens
ggucaucucucacacauucca

SEQ ID NO: 1472626 - RNA, 20 nt, Homo sapiens
gguccacucccugcuccacg

SEQ ID NO: 1472627 - RNA, 19 nt, Homo sapiens
ggucccaggcagagaauca

SEQ ID NO: 1472628 - RNA, 15 nt, Homo sapiens
gguccccauccccac

SEQ ID NO: 1472629 - RNA, 20 nt, Homo sapiens
ggucccggggccagcacuuc

SEQ ID NO: 1472630 - RNA, 17 nt, Homo sapiens
gguccuaaagaugcuga

SEQ ID NO: 1472631 - RNA, 15 nt, Homo sapiens
gguccucccauuucu

SEQ ID NO: 1472632 - RNA, 15 nt, Homo sapiens
gguccuuuucagagu

SEQ ID NO: 1472633 - RNA, 15 nt, Homo sapiens
ggucguccaagcaaa

SEQ ID NO: 1472634 - RNA, 16 nt, Homo sapiens
ggucuaacacuggcau

SEQ ID NO: 1472635 - RNA, 23 nt, Homo sapiens
ggucuaugccaggcccauuuccu

SEQ ID NO: 1472636 - RNA, 15 nt, Homo sapiens
ggucuguagggauuu

SEQ ID NO: 1472637 - RNA, 13 nt, Homo sapiens
ggucuugacucau

SEQ ID NO: 1472638 - RNA, 16 nt, Homo sapiens
ggugaaagauggaacu

SEQ ID NO: 1472639 - RNA, 23 nt, Homo sapiens
ggugaaggaugcggcaggugcuc

SEQ ID NO: 1472640 - RNA, 19 nt, Homo sapiens
ggugaagggagagccagcu

SEQ ID NO: 1472641 - RNA, 15 nt, Homo sapiens
ggugaauuucacaag

SEQ ID NO: 1472642 - RNA, 20 nt, Homo sapiens
ggugacagcugcaagccagg

SEQ ID NO: 1472643 - RNA, 21 nt, Homo sapiens
ggugacagugccuucucuauu

SEQ ID NO: 1472644 - RNA, 19 nt, Homo sapiens
ggugagcagaaguggagcu

SEQ ID NO: 1472645 - RNA, 15 nt, Homo sapiens
ggugagcuccagcug

SEQ ID NO: 1472646 - RNA, 15 nt, Homo sapiens
ggugaggucuguucc

SEQ ID NO: 1472647 - RNA, 18 nt, Homo sapiens
ggugcaaauccuacugaa

SEQ ID NO: 1472648 - RNA, 16 nt, Homo sapiens
ggugcaugaugcugcc

SEQ ID NO: 1472649 - RNA, 17 nt, Homo sapiens
ggugcaugaugcugccc

SEQ ID NO: 1472650 - RNA, 15 nt, Homo sapiens
ggugccaaguuccac

SEQ ID NO: 1472651 - RNA, 20 nt, Homo sapiens
ggugccucagacuccgcccu

SEQ ID NO: 1472652 - RNA, 20 nt, Homo sapiens
ggugccuuuugugugaugcg

SEQ ID NO: 1472653 - RNA, 17 nt, Homo sapiens
ggugcucuuugcugcac

SEQ ID NO: 1472654 - RNA, 20 nt, Homo sapiens
ggugcuggaagucuccauga

SEQ ID NO: 1472655 - RNA, 18 nt, Homo sapiens
ggugcugugguggggaga

SEQ ID NO: 1472656 - RNA, 19 nt, Homo sapiens
gguggagggcacagcccuc

SEQ ID NO: 1472657 - RNA, 20 nt, Homo sapiens
gguggaggguggggggcgcu

SEQ ID NO: 1472658 - RNA, 14 nt, Homo sapiens
gguggagugucaca

SEQ ID NO: 1472659 - RNA, 21 nt, Homo sapiens
gguggaucacgaggucaggag

SEQ ID NO: 1472660 - RNA, 21 nt, Homo sapiens
gguggaugaggagacagaaua

SEQ ID NO: 1472661 - RNA, 15 nt, Homo sapiens
gguggcgcgcaccug

SEQ ID NO: 1472662 - RNA, 20 nt, Homo sapiens
gguggcugagcaucggagug

SEQ ID NO: 1472663 - RNA, 20 nt, Homo sapiens
gguggggguaaggugcaucu

SEQ ID NO: 1472664 - RNA, 16 nt, Homo sapiens
ggugguaagcaccagg

SEQ ID NO: 1472665 - RNA, 13 nt, Homo sapiens
ggugguaccugag

SEQ ID NO: 1472666 - RNA, 17 nt, Homo sapiens
gguggugggaaccauga

SEQ ID NO: 1472667 - RNA, 18 nt, Homo sapiens
gguguacacggaggucuc

SEQ ID NO: 1472668 - RNA, 12 nt, Homo sapiens
ggugucaugcca

SEQ ID NO: 1472669 - RNA, 13 nt, Homo sapiens
ggugucugcccug

SEQ ID NO: 1472670 - RNA, 17 nt, Homo sapiens
ggugugcccuguacaca

SEQ ID NO: 1472671 - RNA, 20 nt, Homo sapiens
ggugugugccacucagagac

SEQ ID NO: 1472672 - RNA, 20 nt, Homo sapiens
gguuagaaaaaggacucugc

SEQ ID NO: 1472673 - RNA, 20 nt, Homo sapiens
gguuaggauuuaacagucau

SEQ ID NO: 1472674 - RNA, 11 nt, Homo sapiens
gguucacugag

SEQ ID NO: 1472675 - RNA, 13 nt, Homo sapiens
gguucacugagcu

SEQ ID NO: 1472676 - RNA, 22 nt, Homo sapiens
gguucccaagaguauccuaccc

SEQ ID NO: 1472677 - RNA, 20 nt, Homo sapiens
gguucuugguagagauucau

SEQ ID NO: 1472678 - RNA, 21 nt, Homo sapiens
gguugaacucugguggcacag

SEQ ID NO: 1472679 - RNA, 18 nt, Homo sapiens
gguugaucacacucuggg

SEQ ID NO: 1472680 - RNA, 16 nt, Homo sapiens
gguugaucaguuaaaa

SEQ ID NO: 1472681 - RNA, 21 nt, Homo sapiens
gguuggauggauggguggaug

SEQ ID NO: 1472682 - RNA, 14 nt, Homo sapiens
ggcuggagugcagu

SEQ ID NO: 1472683 - RNA, 19 nt, Homo sapiens
ggcuggaugugguggcaua

SEQ ID NO: 1472684 - RNA, 22 nt, Homo sapiens
ggcugggaacaacuucagucca

SEQ ID NO: 1472685 - RNA, 19 nt, Homo sapiens
ggcugggagacagagucag

SEQ ID NO: 1472686 - RNA, 18 nt, Homo sapiens
ggcuggggccaccauccc

SEQ ID NO: 1472687 - RNA, 22 nt, Homo sapiens
ggcuggggccaccaucccugau

SEQ ID NO: 1472688 - RNA, 17 nt, Homo sapiens
ggcugguaacaguucau

SEQ ID NO: 1472689 - RNA, 22 nt, Homo sapiens
ggcugguccagggcuagugacu

SEQ ID NO: 1472690 - RNA, 18 nt, Homo sapiens
ggcuggucuuggugaaca

SEQ ID NO: 1472691 - RNA, 10 nt, Homo sapiens
ggcugugagg

SEQ ID NO: 1472692 - RNA, 16 nt, Homo sapiens
ggcuguguuuccaucu

SEQ ID NO: 1472693 - RNA, 11 nt, Homo sapiens
ggcuguucucc

SEQ ID NO: 1472694 - RNA, 21 nt, Homo sapiens
ggcuuagacuucgacucagga

SEQ ID NO: 1472695 - RNA, 19 nt, Homo sapiens
ggcuuaguauuucucagga

SEQ ID NO: 1472696 - RNA, 19 nt, Homo sapiens
ggcuuaugaauauauuuaa

SEQ ID NO: 1472697 - RNA, 19 nt, Homo sapiens
ggcuuccagguaucuccag

SEQ ID NO: 1472698 - RNA, 14 nt, Homo sapiens
ggcuucccaugucu

SEQ ID NO: 1472699 - RNA, 17 nt, Homo sapiens
ggcuugaagccaaagaa

SEQ ID NO: 1472700 - RNA, 14 nt, Homo sapiens
ggcuugcagugcgc

SEQ ID NO: 1472701 - RNA, 20 nt, Homo sapiens
ggcuuuacaguguaaacugu

SEQ ID NO: 1472702 - RNA, 14 nt, Homo sapiens
ggcuuucuugacau

SEQ ID NO: 1472703 - RNA, 23 nt, Homo sapiens
ggcuuugugauucccuccaguga

SEQ ID NO: 1472704 - RNA, 12 nt, Homo sapiens
gggaaauugcuu

SEQ ID NO: 1472705 - RNA, 17 nt, Homo sapiens
gggaacucagauccagg

SEQ ID NO: 1472706 - RNA, 12 nt, Homo sapiens
gggaagccaaaa

SEQ ID NO: 1472707 - RNA, 18 nt, Homo sapiens
gggaaggaggguacagcu

SEQ ID NO: 1472708 - RNA, 16 nt, Homo sapiens
gggaaggucaccagca

SEQ ID NO: 1472709 - RNA, 23 nt, Homo sapiens
gggaauacugugcauaagccauu

SEQ ID NO: 1472710 - RNA, 14 nt, Homo sapiens
gggaaugcaauccu

SEQ ID NO: 1472711 - RNA, 20 nt, Homo sapiens
gggacaacagugcuuuguaa

SEQ ID NO: 1472712 - RNA, 21 nt, Homo sapiens
gggacagagccaugcugggaa

SEQ ID NO: 1472713 - RNA, 11 nt, Homo sapiens
gggacaggaug

SEQ ID NO: 1472714 - RNA, 15 nt, Homo sapiens
gggacuaggaccuga

SEQ ID NO: 1472715 - RNA, 19 nt, Homo sapiens
gggacuaucuuugcugcag

SEQ ID NO: 1472716 - RNA, 15 nt, Homo sapiens
gggacuugggucuca

SEQ ID NO: 1472717 - RNA, 15 nt, Homo sapiens
gggagaagagcccug

SEQ ID NO: 1472718 - RNA, 19 nt, Homo sapiens
gggagaagcuccucucccc

SEQ ID NO: 1472719 - RNA, 15 nt, Homo sapiens
gggagacaugugaca

SEQ ID NO: 1472720 - RNA, 14 nt, Homo sapiens
gggagacugggaca

SEQ ID NO: 1472721 - RNA, 19 nt, Homo sapiens
gggagaguaaaccuugaag

SEQ ID NO: 1472722 - RNA, 11 nt, Homo sapiens
gggagcacugc

SEQ ID NO: 1472723 - RNA, 22 nt, Homo sapiens
gggagcacugcguuuuccuagc

SEQ ID NO: 1472724 - RNA, 14 nt, Homo sapiens
gggagcauguucau

SEQ ID NO: 1472725 - RNA, 12 nt, Homo sapiens
gggagcccagug

SEQ ID NO: 1472726 - RNA, 17 nt, Homo sapiens
gggagcccccaccacaa

SEQ ID NO: 1472727 - RNA, 16 nt, Homo sapiens
gggagcuaucacugua

SEQ ID NO: 1472728 - RNA, 20 nt, Homo sapiens
gggaggcagaguuugccuuc

SEQ ID NO: 1472729 - RNA, 20 nt, Homo sapiens
gggaguaggacauaccagcu

SEQ ID NO: 1472730 - RNA, 18 nt, Homo sapiens
gggagugcucaccgccuc

SEQ ID NO: 1472731 - RNA, 12 nt, Homo sapiens
gggauacaggcc

SEQ ID NO: 1472732 - RNA, 17 nt, Homo sapiens
gggauagaggggcugca

SEQ ID NO: 1472733 - RNA, 19 nt, Homo sapiens
gggaucugucacaccagcc

SEQ ID NO: 1472734 - RNA, 16 nt, Homo sapiens
gggaucuugcauuccc

SEQ ID NO: 1472735 - RNA, 21 nt, Homo sapiens
gggauggccagagaugcugga

SEQ ID NO: 1472736 - RNA, 10 nt, Homo sapiens
gggauguuuu

SEQ ID NO: 1472737 - RNA, 12 nt, Homo sapiens
gggcaacagagc

SEQ ID NO: 1472738 - RNA, 17 nt, Homo sapiens
gggcaacagagcaagau

SEQ ID NO: 1472739 - RNA, 22 nt, Homo sapiens
gggcaccacccgcuuucuugcu

SEQ ID NO: 1472740 - RNA, 13 nt, Homo sapiens
gggcaccagcuca

SEQ ID NO: 1472741 - RNA, 22 nt, Homo sapiens
gggcagagccuuccacagugaa

SEQ ID NO: 1472742 - RNA, 16 nt, Homo sapiens
gggcagaugggcggac

SEQ ID NO: 1472743 - RNA, 20 nt, Homo sapiens
gggcaggagggcccuaccug

SEQ ID NO: 1472744 - RNA, 16 nt, Homo sapiens
gggcaggcugggccau

SEQ ID NO: 1472745 - RNA, 17 nt, Homo sapiens
gggcauccauaccagcu

SEQ ID NO: 1472746 - RNA, 18 nt, Homo sapiens
gggcaucugccccucccc

SEQ ID NO: 1472747 - RNA, 12 nt, Homo sapiens
gggcaugccacc

SEQ ID NO: 1472748 - RNA, 17 nt, Homo sapiens
gggcaugccacccucac

SEQ ID NO: 1472749 - RNA, 16 nt, Homo sapiens
gggcauguguaugugu

SEQ ID NO: 1472750 - RNA, 16 nt, Homo sapiens
gggccacaugggucca

SEQ ID NO: 1472751 - RNA, 12 nt, Homo sapiens
gggccagagcca

SEQ ID NO: 1472752 - RNA, 18 nt, Homo sapiens
gggccagagggagcugga

SEQ ID NO: 1472753 - RNA, 23 nt, Homo sapiens
gggccagcuuuuccucaccagga

SEQ ID NO: 1472754 - RNA, 18 nt, Homo sapiens
gggccagggucuguguga

SEQ ID NO: 1472755 - RNA, 21 nt, Homo sapiens
gggccaugagggacagggucu

SEQ ID NO: 1472756 - RNA, 14 nt, Homo sapiens
gggccauguccaaa

SEQ ID NO: 1472757 - RNA, 21 nt, Homo sapiens
gggcccaaauucuuucagugg

SEQ ID NO: 1472758 - RNA, 16 nt, Homo sapiens
gggcccacccauguca

SEQ ID NO: 1472759 - RNA, 14 nt, Homo sapiens
gggcccagagccca

SEQ ID NO: 1472760 - RNA, 15 nt, Homo sapiens
gggcccagcccagag

SEQ ID NO: 1472761 - RNA, 22 nt, Homo sapiens
gggccccgccagggcuggggac

SEQ ID NO: 1472762 - RNA, 21 nt, Homo sapiens
gggccccucaacagccaagug

SEQ ID NO: 1472763 - RNA, 22 nt, Homo sapiens
gggccccucaacagccaagugu

SEQ ID NO: 1472764 - RNA, 20 nt, Homo sapiens
gggccuagaccuggugcuga

SEQ ID NO: 1472765 - RNA, 19 nt, Homo sapiens
gggccuccagggcccaggu

SEQ ID NO: 1472766 - RNA, 14 nt, Homo sapiens
gggccuggaccugc

SEQ ID NO: 1472767 - RNA, 18 nt, Homo sapiens
gggccuggccaccucucu

SEQ ID NO: 1472768 - RNA, 16 nt, Homo sapiens
gggccugucgugccag

SEQ ID NO: 1472769 - RNA, 22 nt, Homo sapiens
gggccuuaucgggcuccagcca

SEQ ID NO: 1472770 - RNA, 21 nt, Homo sapiens
gggcgugccuggcgcccagug

SEQ ID NO: 1472771 - RNA, 17 nt, Homo sapiens
gggcuacugugaccaug

SEQ ID NO: 1472772 - RNA, 17 nt, Homo sapiens
gggcuccuccagggugu

SEQ ID NO: 1472773 - RNA, 18 nt, Homo sapiens
gggcucugugaccaggaa

SEQ ID NO: 1472774 - RNA, 20 nt, Homo sapiens
gggcugacugggccagggga

SEQ ID NO: 1472775 - RNA, 15 nt, Homo sapiens
gggcugccaccagcc

SEQ ID NO: 1472776 - RNA, 15 nt, Homo sapiens
gggcugcccuggugc

SEQ ID NO: 1472777 - RNA, 23 nt, Homo sapiens
gggcuggaggcccaggcugggaa

SEQ ID NO: 1472778 - RNA, 15 nt, Homo sapiens
gggcuuaccagguga

SEQ ID NO: 1472779 - RNA, 15 nt, Homo sapiens
gggcuugaagccaaa

SEQ ID NO: 1472780 - RNA, 22 nt, Homo sapiens
ggggacagcuuccucacacccc

SEQ ID NO: 1472781 - RNA, 18 nt, Homo sapiens
ggggccuugggugagugg

SEQ ID NO: 1472782 - RNA, 21 nt, Homo sapiens
ggggcugacuucaauccaugu

SEQ ID NO: 1472783 - RNA, 15 nt, Homo sapiens
ggggcugaggggcaa

SEQ ID NO: 1472784 - RNA, 16 nt, Homo sapiens
ggcauaggccugggug

SEQ ID NO: 1472785 - RNA, 20 nt, Homo sapiens
ggcauagguaagcugugccu

SEQ ID NO: 1472786 - RNA, 17 nt, Homo sapiens
ggcauauccaccaccuc

SEQ ID NO: 1472787 - RNA, 22 nt, Homo sapiens
ggcaucaaaaaagauagaucua

SEQ ID NO: 1472788 - RNA, 16 nt, Homo sapiens
ggcauccauaccagcu

SEQ ID NO: 1472789 - RNA, 21 nt, Homo sapiens
ggcaucuccugugcaugggug

SEQ ID NO: 1472790 - RNA, 18 nt, Homo sapiens
ggcauuaggaguguuuca

SEQ ID NO: 1472791 - RNA, 17 nt, Homo sapiens
ggcauuuaacuccucau

SEQ ID NO: 1472792 - RNA, 20 nt, Homo sapiens
ggcauuugcaccuaccucac

SEQ ID NO: 1472793 - RNA, 14 nt, Homo sapiens
ggccaacagcaccu

SEQ ID NO: 1472794 - RNA, 14 nt, Homo sapiens
ggccaacuaggcag

SEQ ID NO: 1472795 - RNA, 21 nt, Homo sapiens
ggccaagaaagagucaggccu

SEQ ID NO: 1472796 - RNA, 12 nt, Homo sapiens
ggccaaguguac

SEQ ID NO: 1472797 - RNA, 15 nt, Homo sapiens
ggccacucuaccuga

SEQ ID NO: 1472798 - RNA, 16 nt, Homo sapiens
ggccacucuaccugaa

SEQ ID NO: 1472799 - RNA, 15 nt, Homo sapiens
ggccagaagaucuac

SEQ ID NO: 1472800 - RNA, 14 nt, Homo sapiens
ggccagagggcagu

SEQ ID NO: 1472801 - RNA, 17 nt, Homo sapiens
ggccagaugcacauccc

SEQ ID NO: 1472802 - RNA, 16 nt, Homo sapiens
ggccagccagugccau

SEQ ID NO: 1472803 - RNA, 23 nt, Homo sapiens
ggccagcccugcagcccaaaacc

SEQ ID NO: 1472804 - RNA, 20 nt, Homo sapiens
ggccaggaguuugagaccag

SEQ ID NO: 1472805 - RNA, 21 nt, Homo sapiens
ggccaggcccgcaccccggcc

SEQ ID NO: 1472806 - RNA, 13 nt, Homo sapiens
ggccagguggcca

SEQ ID NO: 1472807 - RNA, 18 nt, Homo sapiens
ggccagugccagcaccug

SEQ ID NO: 1472808 - RNA, 20 nt, Homo sapiens
ggccaguuugaagccugugc

SEQ ID NO: 1472809 - RNA, 18 nt, Homo sapiens
ggccauaaagaucaaaca

SEQ ID NO: 1472810 - RNA, 14 nt, Homo sapiens
ggccauggugcaca

SEQ ID NO: 1472811 - RNA, 14 nt, Homo sapiens
ggccauguccaaag

SEQ ID NO: 1472812 - RNA, 15 nt, Homo sapiens
ggccauguccaaaga

SEQ ID NO: 1472813 - RNA, 19 nt, Homo sapiens
ggcccaaacucaucuugau

SEQ ID NO: 1472814 - RNA, 17 nt, Homo sapiens
ggcccacuucaccguac

SEQ ID NO: 1472815 - RNA, 17 nt, Homo sapiens
ggccccaguccaugcuu

SEQ ID NO: 1472816 - RNA, 13 nt, Homo sapiens
ggccccaucccag

SEQ ID NO: 1472817 - RNA, 14 nt, Homo sapiens
ggccccauccucau

SEQ ID NO: 1472818 - RNA, 15 nt, Homo sapiens
ggcccccaggacaag

SEQ ID NO: 1472819 - RNA, 14 nt, Homo sapiens
ggcccccaguggga

SEQ ID NO: 1472820 - RNA, 15 nt, Homo sapiens
ggccccugcaucccc

SEQ ID NO: 1472821 - RNA, 14 nt, Homo sapiens
ggcccggccggccu

SEQ ID NO: 1472822 - RNA, 23 nt, Homo sapiens
ggcccuccucucccauccuugau

SEQ ID NO: 1472823 - RNA, 19 nt, Homo sapiens
ggcccuguccuaagcacuu

SEQ ID NO: 1472824 - RNA, 23 nt, Homo sapiens
ggcccuuccucuccacugccuuc

SEQ ID NO: 1472825 - RNA, 15 nt, Homo sapiens
ggcccuuugaagccu

SEQ ID NO: 1472826 - RNA, 17 nt, Homo sapiens
ggccggaaccacagggc

SEQ ID NO: 1472827 - RNA, 17 nt, Homo sapiens
ggccgggcacggucaca

SEQ ID NO: 1472828 - RNA, 14 nt, Homo sapiens
ggccuacagcuuug

SEQ ID NO: 1472829 - RNA, 15 nt, Homo sapiens
ggccuagcgaucucu

SEQ ID NO: 1472830 - RNA, 13 nt, Homo sapiens
ggccucaagaaca

SEQ ID NO: 1472831 - RNA, 22 nt, Homo sapiens
ggccucacccaccccugcacag

SEQ ID NO: 1472832 - RNA, 19 nt, Homo sapiens
ggccucagcugaaugccuc

SEQ ID NO: 1472833 - RNA, 18 nt, Homo sapiens
ggccucagggcgcucaga

SEQ ID NO: 1472834 - RNA, 13 nt, Homo sapiens
ggccuccaugacc

SEQ ID NO: 1472835 - RNA, 14 nt, Homo sapiens
ggccuccaugaccu

SEQ ID NO: 1472836 - RNA, 18 nt, Homo sapiens
ggccucuccaguuugcac

SEQ ID NO: 1472837 - RNA, 20 nt, Homo sapiens
ggccucugacucugagucca

SEQ ID NO: 1472838 - RNA, 15 nt, Homo sapiens
ggccugaccaaacag

SEQ ID NO: 1472839 - RNA, 14 nt, Homo sapiens
ggaggucucuguaa

SEQ ID NO: 1472840 - RNA, 20 nt, Homo sapiens
ggagguggaggcugcaguga

SEQ ID NO: 1472841 - RNA, 15 nt, Homo sapiens
ggagguucucagagc

SEQ ID NO: 1472842 - RNA, 21 nt, Homo sapiens
ggaguacaaugcccagaucaa

SEQ ID NO: 1472843 - RNA, 13 nt, Homo sapiens
ggaguacugauga

SEQ ID NO: 1472844 - RNA, 16 nt, Homo sapiens
ggaguaggacauacca

SEQ ID NO: 1472845 - RNA, 16 nt, Homo sapiens
ggagucagcuguuucu

SEQ ID NO: 1472846 - RNA, 14 nt, Homo sapiens
ggagucagugucug

SEQ ID NO: 1472847 - RNA, 21 nt, Homo sapiens
ggagucugccuccaugcugca

SEQ ID NO: 1472848 - RNA, 20 nt, Homo sapiens
ggagugacggucccacacug

SEQ ID NO: 1472849 - RNA, 18 nt, Homo sapiens
ggagugagaucauuuucu

SEQ ID NO: 1472850 - RNA, 22 nt, Homo sapiens
ggagugcaguggcgugaucucg

SEQ ID NO: 1472851 - RNA, 22 nt, Homo sapiens
ggagugcucaccgccucacuca

SEQ ID NO: 1472852 - RNA, 15 nt, Homo sapiens
ggaguggcucuguaa

SEQ ID NO: 1472853 - RNA, 14 nt, Homo sapiens
ggaguggcugccau

SEQ ID NO: 1472854 - RNA, 16 nt, Homo sapiens
ggagugugugacauuc

SEQ ID NO: 1472855 - RNA, 20 nt, Homo sapiens
ggaguucgaggcugcaguca

SEQ ID NO: 1472856 - RNA, 20 nt, Homo sapiens
ggaguucuagaaccacuucc

SEQ ID NO: 1472857 - RNA, 21 nt, Homo sapiens
ggaguuggaauguuguaguua

SEQ ID NO: 1472858 - RNA, 18 nt, Homo sapiens
ggauaacccuacacccag

SEQ ID NO: 1472859 - RNA, 13 nt, Homo sapiens
ggauaagccacug

SEQ ID NO: 1472860 - RNA, 15 nt, Homo sapiens
ggauaaggaggcacu

SEQ ID NO: 1472861 - RNA, 15 nt, Homo sapiens
ggauacuauuuaauu

SEQ ID NO: 1472862 - RNA, 14 nt, Homo sapiens
ggauagaagccaac

SEQ ID NO: 1472863 - RNA, 18 nt, Homo sapiens
ggauaucacuuccaugac

SEQ ID NO: 1472864 - RNA, 19 nt, Homo sapiens
ggauaucacuuccaugaca

SEQ ID NO: 1472865 - RNA, 16 nt, Homo sapiens
ggauccagagagcagc

SEQ ID NO: 1472866 - RNA, 12 nt, Homo sapiens
ggauccagcacu

SEQ ID NO: 1472867 - RNA, 17 nt, Homo sapiens
ggauccuuugcugcuga

SEQ ID NO: 1472868 - RNA, 24 nt, Homo sapiens
ggaucuugcaaaagaugucugauc

SEQ ID NO: 1472869 - RNA, 18 nt, Homo sapiens
ggaucuuggagaauguga

SEQ ID NO: 1472870 - RNA, 15 nt, Homo sapiens
ggaugaacaauuaua

SEQ ID NO: 1472871 - RNA, 16 nt, Homo sapiens
ggaugacccacugucc

SEQ ID NO: 1472872 - RNA, 19 nt, Homo sapiens
ggaugaucuugauuguggg

SEQ ID NO: 1472873 - RNA, 15 nt, Homo sapiens
ggaugaugcugucau

SEQ ID NO: 1472874 - RNA, 21 nt, Homo sapiens
ggaugccaaccggucacccag

SEQ ID NO: 1472875 - RNA, 19 nt, Homo sapiens
ggaugccacagcccagcuu

SEQ ID NO: 1472876 - RNA, 21 nt, Homo sapiens
ggauggaaagacaaacugcac

SEQ ID NO: 1472877 - RNA, 22 nt, Homo sapiens
ggauggaaagacaaacugcaca

SEQ ID NO: 1472878 - RNA, 14 nt, Homo sapiens
ggauguaagccugg

SEQ ID NO: 1472879 - RNA, 22 nt, Homo sapiens
ggaugucaugucugcuugucaa

SEQ ID NO: 1472880 - RNA, 23 nt, Homo sapiens
ggauuaaagugcccagcacaaag

SEQ ID NO: 1472881 - RNA, 15 nt, Homo sapiens
ggauuaaauuuaauu

SEQ ID NO: 1472882 - RNA, 23 nt, Homo sapiens
ggauuacaggugugggccacugc

SEQ ID NO: 1472883 - RNA, 21 nt, Homo sapiens
ggauuacaggugugugccacc

SEQ ID NO: 1472884 - RNA, 15 nt, Homo sapiens
ggauucugagcagug

SEQ ID NO: 1472885 - RNA, 16 nt, Homo sapiens
ggauuguuacagcuuc

SEQ ID NO: 1472886 - RNA, 18 nt, Homo sapiens
ggauuuaacagucauuua

SEQ ID NO: 1472887 - RNA, 14 nt, Homo sapiens
ggauuuaauuucca

SEQ ID NO: 1472888 - RNA, 20 nt, Homo sapiens
ggauuuaauuuccaggguug

SEQ ID NO: 1472889 - RNA, 17 nt, Homo sapiens
ggauuugccugugccac

SEQ ID NO: 1472890 - RNA, 22 nt, Homo sapiens
ggauuuuuuuccuccccaccuu

SEQ ID NO: 1472891 - RNA, 20 nt, Homo sapiens
ggcaaaaccacuagaacucu

SEQ ID NO: 1472892 - RNA, 20 nt, Homo sapiens
ggcaacagagcaagacucca

SEQ ID NO: 1472893 - RNA, 22 nt, Homo sapiens
ggcaaccuugucucuaugccag

SEQ ID NO: 1472894 - RNA, 19 nt, Homo sapiens
ggaaagagcacccucgaga

SEQ ID NO: 1472895 - RNA, 15 nt, Homo sapiens
ggaaagccucacuga

SEQ ID NO: 1472896 - RNA, 22 nt, Homo sapiens
ggaaaguaaauauuucaggcau

SEQ ID NO: 1472897 - RNA, 16 nt, Homo sapiens
ggaaagugcauaugaa

SEQ ID NO: 1472898 - RNA, 20 nt, Homo sapiens
ggaaauagaaagaagccaua

SEQ ID NO: 1472899 - RNA, 17 nt, Homo sapiens
ggaaauccccuuaugac

SEQ ID NO: 1472900 - RNA, 13 nt, Homo sapiens
ggaacacugcacu

SEQ ID NO: 1472901 - RNA, 14 nt, Homo sapiens
ggaacacugcacuc

SEQ ID NO: 1472902 - RNA, 14 nt, Homo sapiens
ggaacagaugcuaa

SEQ ID NO: 1472903 - RNA, 16 nt, Homo sapiens
ggaacagcagauaaca

SEQ ID NO: 1472904 - RNA, 21 nt, Homo sapiens
ggaaccacagggccagaggga

SEQ ID NO: 1472905 - RNA, 14 nt, Homo sapiens
ggaacccagacuca

SEQ ID NO: 1472906 - RNA, 16 nt, Homo sapiens
ggaacccagacucaga

SEQ ID NO: 1472907 - RNA, 21 nt, Homo sapiens
ggaaccucagccuggccagac

SEQ ID NO: 1472908 - RNA, 19 nt, Homo sapiens
ggaaccuugcuguccugau

SEQ ID NO: 1472909 - RNA, 13 nt, Homo sapiens
ggaacuccugacu

SEQ ID NO: 1472910 - RNA, 19 nt, Homo sapiens
ggaacucuggcuuccaggu

SEQ ID NO: 1472911 - RNA, 21 nt, Homo sapiens
ggaagacgugcgcgaugugac

SEQ ID NO: 1472912 - RNA, 21 nt, Homo sapiens
ggaagaggaacagcacugggg

SEQ ID NO: 1472913 - RNA, 23 nt, Homo sapiens
ggaagauauaacauucaguuccc

SEQ ID NO: 1472914 - RNA, 19 nt, Homo sapiens
ggaagaucagcacccuaag

SEQ ID NO: 1472915 - RNA, 21 nt, Homo sapiens
ggaagcaacaggaaucaagag

SEQ ID NO: 1472916 - RNA, 15 nt, Homo sapiens
ggaagcaagauguga

SEQ ID NO: 1472917 - RNA, 21 nt, Homo sapiens
ggaagccuugcucauucuuga

SEQ ID NO: 1472918 - RNA, 15 nt, Homo sapiens
ggaagcuccacuguc

SEQ ID NO: 1472919 - RNA, 16 nt, Homo sapiens
ggaagcuccacuguca

SEQ ID NO: 1472920 - RNA, 19 nt, Homo sapiens
ggaagcucugaagucacau

SEQ ID NO: 1472921 - RNA, 23 nt, Homo sapiens
ggaagcuucuaaauggugcugca

SEQ ID NO: 1472922 - RNA, 19 nt, Homo sapiens
ggaagcuuggggaacccau

SEQ ID NO: 1472923 - RNA, 19 nt, Homo sapiens
ggaagggccuacagcccau

SEQ ID NO: 1472924 - RNA, 14 nt, Homo sapiens
ggaagucacuucac

SEQ ID NO: 1472925 - RNA, 13 nt, Homo sapiens
ggaagucaucuca

SEQ ID NO: 1472926 - RNA, 14 nt, Homo sapiens
ggaaguugacuuau

SEQ ID NO: 1472927 - RNA, 21 nt, Homo sapiens
ggaauaaccuuccauacauuu

SEQ ID NO: 1472928 - RNA, 16 nt, Homo sapiens
ggaauaagaagcaaau

SEQ ID NO: 1472929 - RNA, 21 nt, Homo sapiens
ggaauacugugcauaagccau

SEQ ID NO: 1472930 - RNA, 17 nt, Homo sapiens
ggaaugcaauccuuccc

SEQ ID NO: 1472931 - RNA, 15 nt, Homo sapiens
ggaauggugaaugaa

SEQ ID NO: 1472932 - RNA, 17 nt, Homo sapiens
ggaauuauuguaccauu

SEQ ID NO: 1472933 - RNA, 21 nt, Homo sapiens
ggaauucauuuucaucacugg

SEQ ID NO: 1472934 - RNA, 21 nt, Homo sapiens
ggaauugcuggaggaaccaga

SEQ ID NO: 1472935 - RNA, 14 nt, Homo sapiens
ggaauuuggaguga

SEQ ID NO: 1472936 - RNA, 15 nt, Homo sapiens
ggacaacauccuuaa

SEQ ID NO: 1472937 - RNA, 21 nt, Homo sapiens
ggacaagacccccagcacuug

SEQ ID NO: 1472938 - RNA, 21 nt, Homo sapiens
ggacaagugguaugaccagug

SEQ ID NO: 1472939 - RNA, 22 nt, Homo sapiens
ggacaagugguaugaccaguga

SEQ ID NO: 1472940 - RNA, 13 nt, Homo sapiens
ggacacagaccca

SEQ ID NO: 1472941 - RNA, 14 nt, Homo sapiens
ggacacuccagugc

SEQ ID NO: 1472942 - RNA, 23 nt, Homo sapiens
ggacacuuaauacuaccuugaaa

SEQ ID NO: 1472943 - RNA, 17 nt, Homo sapiens
ggacagcagaagccucc

SEQ ID NO: 1472944 - RNA, 15 nt, Homo sapiens
ggacaggaugaccug

SEQ ID NO: 1472945 - RNA, 14 nt, Homo sapiens
ggacaguggugaca

SEQ ID NO: 1472946 - RNA, 14 nt, Homo sapiens
ggaccacauuuuau

SEQ ID NO: 1472947 - RNA, 15 nt, Homo sapiens
ggaccagcucaggac

SEQ ID NO: 1472948 - RNA, 18 nt, Homo sapiens
ggacccccacgauuggcc

SEQ ID NO: 1472949 - RNA, 15 nt, Homo sapiens
ggacccccacuaaga

SEQ ID NO: 1472950 - RNA, 13 nt, Homo sapiens
ggaccguccaggg

SEQ ID NO: 1472951 - RNA, 16 nt, Homo sapiens
gcuuccgccgucucaa

SEQ ID NO: 1472952 - RNA, 12 nt, Homo sapiens
gcuuccuaacug

SEQ ID NO: 1472953 - RNA, 10 nt, Homo sapiens
gcuuccucua

SEQ ID NO: 1472954 - RNA, 19 nt, Homo sapiens
gcuuccucuagaagccaag

SEQ ID NO: 1472955 - RNA, 14 nt, Homo sapiens
gcuucugcacacaa

SEQ ID NO: 1472956 - RNA, 17 nt, Homo sapiens
gcuucuggaaacuacca

SEQ ID NO: 1472957 - RNA, 23 nt, Homo sapiens
gcuucuggaauuuguucaaguuu

SEQ ID NO: 1472958 - RNA, 14 nt, Homo sapiens
gcuugaagccaaag

SEQ ID NO: 1472959 - RNA, 15 nt, Homo sapiens
gcuugaagccaaaga

SEQ ID NO: 1472960 - RNA, 21 nt, Homo sapiens
gcuugagaauccucuccuuuc

SEQ ID NO: 1472961 - RNA, 14 nt, Homo sapiens
gcuugcucauuaau

SEQ ID NO: 1472962 - RNA, 14 nt, Homo sapiens
gcuugggcauugaa

SEQ ID NO: 1472963 - RNA, 19 nt, Homo sapiens
gcuuggguucacagugcau

SEQ ID NO: 1472964 - RNA, 23 nt, Homo sapiens
gcuuguaauaaauacugcagcuu

SEQ ID NO: 1472965 - RNA, 16 nt, Homo sapiens
gcuugucauuccagag

SEQ ID NO: 1472966 - RNA, 14 nt, Homo sapiens
gcuuuagcacagga

SEQ ID NO: 1472967 - RNA, 12 nt, Homo sapiens
gcuuuagcuuca

SEQ ID NO: 1472968 - RNA, 21 nt, Homo sapiens
gcuuuauuuuuuaaguauuua

SEQ ID NO: 1472969 - RNA, 23 nt, Homo sapiens
gcuuucuaugcuguuuguaguga

SEQ ID NO: 1472970 - RNA, 22 nt, Homo sapiens
gcuuucugccaucuagccagcc

SEQ ID NO: 1472971 - RNA, 20 nt, Homo sapiens
gcuuucuucuacaaccagag

SEQ ID NO: 1472972 - RNA, 20 nt, Homo sapiens
gcuuugaaaagucacuuacu

SEQ ID NO: 1472973 - RNA, 18 nt, Homo sapiens
gcuuugaaacuugccugg

SEQ ID NO: 1472974 - RNA, 13 nt, Homo sapiens
gcuuugccucuac

SEQ ID NO: 1472975 - RNA, 12 nt, Homo sapiens
gcuuugucauag

SEQ ID NO: 1472976 - RNA, 14 nt, Homo sapiens
gcuuugugcuuguc

SEQ ID NO: 1472977 - RNA, 14 nt, Homo sapiens
gcuuuguugcccag

SEQ ID NO: 1472978 - RNA, 15 nt, Homo sapiens
gcuuuuaauucucau

SEQ ID NO: 1472979 - RNA, 14 nt, Homo sapiens
gcuuuucacaucca

SEQ ID NO: 1472980 - RNA, 12 nt, Homo sapiens
gcuuuucagggu

SEQ ID NO: 1472981 - RNA, 20 nt, Homo sapiens
gcuuuucauugcugugacag

SEQ ID NO: 1472982 - RNA, 13 nt, Homo sapiens
gcuuuuccucacc

SEQ ID NO: 1472983 - RNA, 13 nt, Homo sapiens
gcuuuucuguauu

SEQ ID NO: 1472984 - RNA, 18 nt, Homo sapiens
gcuuuugagaaccaagua

SEQ ID NO: 1472985 - RNA, 18 nt, Homo sapiens
gcuuuuugccaucuguga

SEQ ID NO: 1472986 - RNA, 21 nt, Homo sapiens
ggaaaaaaauaguaaagccaa

SEQ ID NO: 1472987 - RNA, 21 nt, Homo sapiens
ggaaaagaaauugcaugcagu

SEQ ID NO: 1472988 - RNA, 21 nt, Homo sapiens
ggaaaagcauuuuucaauaua

SEQ ID NO: 1472989 - RNA, 21 nt, Homo sapiens
ggaaaaggaaaaaaagcaaaa

SEQ ID NO: 1472990 - RNA, 17 nt, Homo sapiens
ggaaaauaaacaucagu

SEQ ID NO: 1472991 - RNA, 14 nt, Homo sapiens
ggaaaaugacucug

SEQ ID NO: 1472992 - RNA, 15 nt, Homo sapiens
ggaaaaugucuuaaa

SEQ ID NO: 1472993 - RNA, 17 nt, Homo sapiens
ggaaaaugugacccaga

SEQ ID NO: 1472994 - RNA, 20 nt, Homo sapiens
ggaaacacugauuuuguaaa

SEQ ID NO: 1472995 - RNA, 23 nt, Homo sapiens
gacaaccugaaauuuauucacau

SEQ ID NO: 1472996 - RNA, 16 nt, Homo sapiens
gacaacugugacugua

SEQ ID NO: 1472997 - RNA, 17 nt, Homo sapiens
gacaagaauaauucaau

SEQ ID NO: 1472998 - RNA, 22 nt, Homo sapiens
gacaagagaugggaaugaggug

SEQ ID NO: 1472999 - RNA, 22 nt, Homo sapiens
gacaagccaacuuguaaauaca

SEQ ID NO: 1473000 - RNA, 13 nt, Homo sapiens
gacaaggcccuga

SEQ ID NO: 1473001 - RNA, 12 nt, Homo sapiens
gacaagggauuu

SEQ ID NO: 1473002 - RNA, 15 nt, Homo sapiens
gacaaguauggcucc

SEQ ID NO: 1473003 - RNA, 20 nt, Homo sapiens
gacaaugauauugacacugu

SEQ ID NO: 1473004 - RNA, 14 nt, Homo sapiens
gacaaugauccagu

SEQ ID NO: 1473005 - RNA, 19 nt, Homo sapiens
gacaauuaucugugucaaa

SEQ ID NO: 1473006 - RNA, 21 nt, Homo sapiens
gacaauuccuagauaaaaaga

SEQ ID NO: 1473007 - RNA, 21 nt, Homo sapiens
gacacaacuauuuuuccaaaa

SEQ ID NO: 1473008 - RNA, 11 nt, Homo sapiens
gacaccaaagc

SEQ ID NO: 1473009 - RNA, 21 nt, Homo sapiens
gacaccagagcagaugcagag

SEQ ID NO: 1473010 - RNA, 18 nt, Homo sapiens
gacaccccugcucuaccc

SEQ ID NO: 1473011 - RNA, 10 nt, Homo sapiens
gacaccucac

SEQ ID NO: 1473012 - RNA, 15 nt, Homo sapiens
gacacuagccugugc

SEQ ID NO: 1473013 - RNA, 21 nt, Homo sapiens
gacacuagccugugcacgcgc

SEQ ID NO: 1473014 - RNA, 17 nt, Homo sapiens
gacacugccacucuccc

SEQ ID NO: 1473015 - RNA, 14 nt, Homo sapiens
gacacuuaauacua

SEQ ID NO: 1473016 - RNA, 18 nt, Homo sapiens
gacagaacacccaauuca

SEQ ID NO: 1473017 - RNA, 22 nt, Homo sapiens
gacagagucccuggcuccucua

SEQ ID NO: 1473018 - RNA, 13 nt, Homo sapiens
gacagagugagug

SEQ ID NO: 1473019 - RNA, 22 nt, Homo sapiens
gacagaucccauccaucagcuc

SEQ ID NO: 1473020 - RNA, 13 nt, Homo sapiens
gacagcucuccaa

SEQ ID NO: 1473021 - RNA, 20 nt, Homo sapiens
gacaggcucugcuucuccaa

SEQ ID NO: 1473022 - RNA, 17 nt, Homo sapiens
gacaggugaggucuguu

SEQ ID NO: 1473023 - RNA, 15 nt, Homo sapiens
gacaguccaguguca

SEQ ID NO: 1473024 - RNA, 18 nt, Homo sapiens
gacauacucucugccugg

SEQ ID NO: 1473025 - RNA, 16 nt, Homo sapiens
gacauaucagugaccu

SEQ ID NO: 1473026 - RNA, 22 nt, Homo sapiens
gacauauuaugccugaaugacu

SEQ ID NO: 1473027 - RNA, 16 nt, Homo sapiens
gacaugauuuccuuga

SEQ ID NO: 1473028 - RNA, 22 nt, Homo sapiens
gacauguagguaggaagcacug

SEQ ID NO: 1473029 - RNA, 16 nt, Homo sapiens
gacaugugaaaccuuu

SEQ ID NO: 1473030 - RNA, 14 nt, Homo sapiens
cagugcacagggaa

SEQ ID NO: 1473031 - RNA, 15 nt, Homo sapiens
cagugccauuccacu

SEQ ID NO: 1473032 - RNA, 23 nt, Homo sapiens
cagugccccagggaguccagggu

SEQ ID NO: 1473033 - RNA, 14 nt, Homo sapiens
cagugcccucacag

SEQ ID NO: 1473034 - RNA, 15 nt, Homo sapiens
cagugcuaaagccug

SEQ ID NO: 1473035 - RNA, 22 nt, Homo sapiens
cagugcuaaagccuguggguuu

SEQ ID NO: 1473036 - RNA, 15 nt, Homo sapiens
cagugcucaccagcc

SEQ ID NO: 1473037 - RNA, 18 nt, Homo sapiens
cagugcuucuuacuauua

SEQ ID NO: 1473038 - RNA, 14 nt, Homo sapiens
caguggacucuucc

SEQ ID NO: 1473039 - RNA, 13 nt, Homo sapiens
caguggauucuca

SEQ ID NO: 1473040 - RNA, 14 nt, Homo sapiens
caguggauucucau

SEQ ID NO: 1473041 - RNA, 16 nt, Homo sapiens
caguggauuguuuaua

SEQ ID NO: 1473042 - RNA, 18 nt, Homo sapiens
cagugggaguaccaaaga

SEQ ID NO: 1473043 - RNA, 17 nt, Homo sapiens
cagugggggcagagcca

SEQ ID NO: 1473044 - RNA, 19 nt, Homo sapiens
caguguagcccacacuuga

SEQ ID NO: 1473045 - RNA, 12 nt, Homo sapiens
cagugucauuua

SEQ ID NO: 1473046 - RNA, 20 nt, Homo sapiens
caguguccccuccacuguca

SEQ ID NO: 1473047 - RNA, 19 nt, Homo sapiens
caguguccucuugcucaaa

SEQ ID NO: 1473048 - RNA, 22 nt, Homo sapiens
caguguggcccagggaagccaa

SEQ ID NO: 1473049 - RNA, 12 nt, Homo sapiens
caguguuuacaa

SEQ ID NO: 1473050 - RNA, 19 nt, Homo sapiens
caguguuugcaaugguguu

SEQ ID NO: 1473051 - RNA, 23 nt, Homo sapiens
caguguuuuagagagagaacuuu

SEQ ID NO: 1473052 - RNA, 22 nt, Homo sapiens
caguuaacuuuaagacugagca

SEQ ID NO: 1473053 - RNA, 23 nt, Homo sapiens
caguuacaagauuguaaguaaau

SEQ ID NO: 1473054 - RNA, 18 nt, Homo sapiens
caguucccaccaucugau

SEQ ID NO: 1473055 - RNA, 15 nt, Homo sapiens
caguucccucuugcu

SEQ ID NO: 1473056 - RNA, 19 nt, Homo sapiens
caguucugucauauguuaa

SEQ ID NO: 1473057 - RNA, 14 nt, Homo sapiens
caguugacagcagg

SEQ ID NO: 1473058 - RNA, 14 nt, Homo sapiens
caguugacuuuaag

SEQ ID NO: 1473059 - RNA, 16 nt, Homo sapiens
caguugcauuuagcuu

SEQ ID NO: 1473060 - RNA, 20 nt, Homo sapiens
caguugccacauuuaguccu

SEQ ID NO: 1473061 - RNA, 21 nt, Homo sapiens
caguugcccuagcccagacuc

SEQ ID NO: 1473062 - RNA, 13 nt, Homo sapiens
caguugcucugac

SEQ ID NO: 1473063 - RNA, 19 nt, Homo sapiens
caguuggacucucagggau

SEQ ID NO: 1473064 - RNA, 17 nt, Homo sapiens
caguuggcagaaaggau

SEQ ID NO: 1473065 - RNA, 16 nt, Homo sapiens
caguugggagcacugg

SEQ ID NO: 1473066 - RNA, 19 nt, Homo sapiens
caguuguuuguuuuugcuu

SEQ ID NO: 1473067 - RNA, 17 nt, Homo sapiens
caguuucuggaaaaagu

SEQ ID NO: 1473068 - RNA, 19 nt, Homo sapiens
caguuugauaccugcacug

SEQ ID NO: 1473069 - RNA, 15 nt, Homo sapiens
caguuugcaccuguc

SEQ ID NO: 1473070 - RNA, 20 nt, Homo sapiens
caguuugcuuuguaugcacu

SEQ ID NO: 1473071 - RNA, 18 nt, Homo sapiens
caguuuuauuuuugccaa

SEQ ID NO: 1473072 - RNA, 20 nt, Homo sapiens
caguuuuauuuuugccaagg

SEQ ID NO: 1473073 - RNA, 23 nt, Homo sapiens
caguuuucaggaugauacacuau

SEQ ID NO: 1473074 - RNA, 15 nt, Homo sapiens
caguuuucguagguu

SEQ ID NO: 1473075 - RNA, 12 nt, Homo sapiens
caguuuuugccu

SEQ ID NO: 1473076 - RNA, 17 nt, Homo sapiens
cauaaaaagcagaauuu

SEQ ID NO: 1473077 - RNA, 21 nt, Homo sapiens
cauaaaaagccugcaauuuca

SEQ ID NO: 1473078 - RNA, 14 nt, Homo sapiens
cauaaacaauucau

SEQ ID NO: 1473079 - RNA, 18 nt, Homo sapiens
cauaaagaaaagaugaaa

SEQ ID NO: 1473080 - RNA, 14 nt, Homo sapiens
cauaaaucacuuca

SEQ ID NO: 1473081 - RNA, 19 nt, Homo sapiens
cauaaaugaagcagcuuua

SEQ ID NO: 1473082 - RNA, 17 nt, Homo sapiens
cauaaaugaaucaucaa

SEQ ID NO: 1473083 - RNA, 16 nt, Homo sapiens
cauaagugaaaaucuu

SEQ ID NO: 1473084 - RNA, 18 nt, Homo sapiens
cauaaguuaacuuccaau

SEQ ID NO: 1473085 - RNA, 21 nt, Homo sapiens
cauaauaaaaaauuaugacaa

SEQ ID NO: 1473086 - RNA, 14 nt, Homo sapiens
cauaauaaagcaau

SEQ ID NO: 1473087 - RNA, 22 nt, Homo sapiens
cauaauaaauaauuaaccacca

SEQ ID NO: 1473088 - RNA, 18 nt, Homo sapiens
cauaauaaauaucuguac

SEQ ID NO: 1473089 - RNA, 17 nt, Homo sapiens
cauaauaagcuaaagag

SEQ ID NO: 1473090 - RNA, 15 nt, Homo sapiens
cauaaugcacuuuag

SEQ ID NO: 1473091 - RNA, 21 nt, Homo sapiens
cauaauguuacauuauuauca

SEQ ID NO: 1473092 - RNA, 21 nt, Homo sapiens
cauaauuauuauuuccagugu

SEQ ID NO: 1473093 - RNA, 20 nt, Homo sapiens
cauaauucagcacuuaacua

SEQ ID NO: 1473094 - RNA, 16 nt, Homo sapiens
cauaauuguucuuagu

SEQ ID NO: 1473095 - RNA, 18 nt, Homo sapiens
cauacaaagagguguaca

SEQ ID NO: 1473096 - RNA, 14 nt, Homo sapiens
cauacaaagcaguu

SEQ ID NO: 1473097 - RNA, 23 nt, Homo sapiens
cauacaaagcaguuuauuuuaga

SEQ ID NO: 1473098 - RNA, 13 nt, Homo sapiens
cauacaauuccaa

SEQ ID NO: 1473099 - RNA, 18 nt, Homo sapiens
cauacaauuccaaacaca

SEQ ID NO: 1473100 - RNA, 20 nt, Homo sapiens
cauacacaguggcaccuuca

SEQ ID NO: 1473101 - RNA, 13 nt, Homo sapiens
cauacacuuuguu

SEQ ID NO: 1473102 - RNA, 12 nt, Homo sapiens
cauacagacugg

SEQ ID NO: 1473103 - RNA, 12 nt, Homo sapiens
cauacaggccau

SEQ ID NO: 1473104 - RNA, 16 nt, Homo sapiens
cauacauauuaucuca

SEQ ID NO: 1473105 - RNA, 17 nt, Homo sapiens
cauacauuuaugcacau

SEQ ID NO: 1473106 - RNA, 18 nt, Homo sapiens
cauacauuuaugcacauu

SEQ ID NO: 1473107 - RNA, 19 nt, Homo sapiens
cauacgagagcagaggucu

SEQ ID NO: 1473108 - RNA, 17 nt, Homo sapiens
cauacuaugguuuucau

SEQ ID NO: 1473109 - RNA, 18 nt, Homo sapiens
cauagaaaauuaaacaca

SEQ ID NO: 1473110 - RNA, 20 nt, Homo sapiens
cauagagauagcuacagugu

SEQ ID NO: 1473111 - RNA, 21 nt, Homo sapiens
cauagccauggaacccugcca

SEQ ID NO: 1473112 - RNA, 14 nt, Homo sapiens
cauaggccauuugg

SEQ ID NO: 1473113 - RNA, 19 nt, Homo sapiens
cauaguaccucugcuauuu

SEQ ID NO: 1473114 - RNA, 18 nt, Homo sapiens
cauaguauuggagcacau

SEQ ID NO: 1473115 - RNA, 13 nt, Homo sapiens
cauagucaauauu

SEQ ID NO: 1473116 - RNA, 22 nt, Homo sapiens
cauaguggguggauuuguugcc

SEQ ID NO: 1473117 - RNA, 13 nt, Homo sapiens
cauauaauguugu

SEQ ID NO: 1473118 - RNA, 19 nt, Homo sapiens
cauauaauguuguuauuua

SEQ ID NO: 1473119 - RNA, 23 nt, Homo sapiens
cauauacauuuuuagccuguguc

SEQ ID NO: 1473120 - RNA, 19 nt, Homo sapiens
cauauauaaauucuaagcc

SEQ ID NO: 1473121 - RNA, 16 nt, Homo sapiens
cauauauacaggcaua

SEQ ID NO: 1473122 - RNA, 15 nt, Homo sapiens
caugcucaaccacug

SEQ ID NO: 1473123 - RNA, 19 nt, Homo sapiens
caugcucaaccacuguggc

SEQ ID NO: 1473124 - RNA, 21 nt, Homo sapiens
caugcugugugcuggagacac

SEQ ID NO: 1473125 - RNA, 23 nt, Homo sapiens
caugcuuuagauuauauauuccg

SEQ ID NO: 1473126 - RNA, 18 nt, Homo sapiens
cauggaaacgcaaaugag

SEQ ID NO: 1473127 - RNA, 13 nt, Homo sapiens
cauggacacucca

SEQ ID NO: 1473128 - RNA, 18 nt, Homo sapiens
cauggacuacaccagggu

SEQ ID NO: 1473129 - RNA, 16 nt, Homo sapiens
cauggaggucauacau

SEQ ID NO: 1473130 - RNA, 11 nt, Homo sapiens
cauggaucucu

SEQ ID NO: 1473131 - RNA, 12 nt, Homo sapiens
cauggaugccaa

SEQ ID NO: 1473132 - RNA, 21 nt, Homo sapiens
cauggcaacauaauucacuuu

SEQ ID NO: 1473133 - RNA, 21 nt, Homo sapiens
cauggcccccaggggcaggac

SEQ ID NO: 1473134 - RNA, 22 nt, Homo sapiens
gaaaugauccccaaguggugaa

SEQ ID NO: 1473135 - RNA, 17 nt, Homo sapiens
gaaauguaugugcucuu

SEQ ID NO: 1473136 - RNA, 22 nt, Homo sapiens
gaaauguuaaagguucacaggg

SEQ ID NO: 1473137 - RNA, 18 nt, Homo sapiens
gaaauguucuguucaccc

SEQ ID NO: 1473138 - RNA, 17 nt, Homo sapiens
gaaauuaugugacauuu

SEQ ID NO: 1473139 - RNA, 23 nt, Homo sapiens
gaaauuuucaauuugagauucua

SEQ ID NO: 1473140 - RNA, 21 nt, Homo sapiens
gaaauuuuguaagaaggcaau

SEQ ID NO: 1473141 - RNA, 18 nt, Homo sapiens
gaacaaaaauugagacau

SEQ ID NO: 1473142 - RNA, 14 nt, Homo sapiens
gaacaaaugaauaa

SEQ ID NO: 1473143 - RNA, 21 nt, Homo sapiens
gaacaaugaauuauccagcau

SEQ ID NO: 1473144 - RNA, 15 nt, Homo sapiens
gaacaauugaaguaa

SEQ ID NO: 1473145 - RNA, 12 nt, Homo sapiens
gaacacacuugg

SEQ ID NO: 1473146 - RNA, 17 nt, Homo sapiens
gaacacaggagauucca

SEQ ID NO: 1473147 - RNA, 17 nt, Homo sapiens
gaacacaggcagcuuuc

SEQ ID NO: 1473148 - RNA, 21 nt, Homo sapiens
gaacacccgacuccucaaaag

SEQ ID NO: 1473149 - RNA, 17 nt, Homo sapiens
gaacacccuugguggcu

SEQ ID NO: 1473150 - RNA, 16 nt, Homo sapiens
gaacaccuauugcacu

SEQ ID NO: 1473151 - RNA, 20 nt, Homo sapiens
gaacacucuuuugcuuuauu

SEQ ID NO: 1473152 - RNA, 13 nt, Homo sapiens
gaacagaaggaug

SEQ ID NO: 1473153 - RNA, 15 nt, Homo sapiens
gaacagaccagugac

SEQ ID NO: 1473154 - RNA, 20 nt, Homo sapiens
gaacagaccggagaggacag

SEQ ID NO: 1473155 - RNA, 12 nt, Homo sapiens
gaacagagcaag

SEQ ID NO: 1473156 - RNA, 22 nt, Homo sapiens
gaacagauaaucagugugucua

SEQ ID NO: 1473157 - RNA, 15 nt, Homo sapiens
gaacagcaguguucu

SEQ ID NO: 1473158 - RNA, 18 nt, Homo sapiens
gaacagcaguguucucac

SEQ ID NO: 1473159 - RNA, 22 nt, Homo sapiens
gaacagcgggagaccugugcua

SEQ ID NO: 1473160 - RNA, 21 nt, Homo sapiens
gaacaguugcauuuagcuucu

SEQ ID NO: 1473161 - RNA, 19 nt, Homo sapiens
gaacaucauaacccaugaa

SEQ ID NO: 1473162 - RNA, 17 nt, Homo sapiens
gaacauccaaccuuccc

SEQ ID NO: 1473163 - RNA, 20 nt, Homo sapiens
gaacaugcagcaaggggaca

SEQ ID NO: 1473164 - RNA, 13 nt, Homo sapiens
gaacaugcaguuc

SEQ ID NO: 1473165 - RNA, 15 nt, Homo sapiens
gaacauuauuuaaua

SEQ ID NO: 1473166 - RNA, 16 nt, Homo sapiens
gaaccaagcaggagac

SEQ ID NO: 1473167 - RNA, 12 nt, Homo sapiens
gaaccagcccca

SEQ ID NO: 1473168 - RNA, 14 nt, Homo sapiens
cugaucccuuccac

SEQ ID NO: 1473169 - RNA, 19 nt, Homo sapiens
cugaucccuuccaccugcu

SEQ ID NO: 1473170 - RNA, 11 nt, Homo sapiens
cugaucugcag

SEQ ID NO: 1473171 - RNA, 20 nt, Homo sapiens
cugaucugcaguuuuugccu

SEQ ID NO: 1473172 - RNA, 18 nt, Homo sapiens
cugaugaaggcaugccua

SEQ ID NO: 1473173 - RNA, 15 nt, Homo sapiens
cugaugauacaugca

SEQ ID NO: 1473174 - RNA, 15 nt, Homo sapiens
cugaugcugggcaau

SEQ ID NO: 1473175 - RNA, 14 nt, Homo sapiens
cugauggaccagga

SEQ ID NO: 1473176 - RNA, 16 nt, Homo sapiens
cugauggccaggcaag

SEQ ID NO: 1473177 - RNA, 16 nt, Homo sapiens
cugauguuaaccaaug

SEQ ID NO: 1473178 - RNA, 19 nt, Homo sapiens
cugauuagaaaugaccaau

SEQ ID NO: 1473179 - RNA, 13 nt, Homo sapiens
cugauucauaaua

SEQ ID NO: 1473180 - RNA, 18 nt, Homo sapiens
cugauuucuucagaauua

SEQ ID NO: 1473181 - RNA, 18 nt, Homo sapiens
cugauuuguauucuguga

SEQ ID NO: 1473182 - RNA, 19 nt, Homo sapiens
cugcaaaggcgcagugcuu

SEQ ID NO: 1473183 - RNA, 14 nt, Homo sapiens
cugcaacucaagga

SEQ ID NO: 1473184 - RNA, 16 nt, Homo sapiens
cugcaagcacaucugc

SEQ ID NO: 1473185 - RNA, 12 nt, Homo sapiens
cugcacacucca

SEQ ID NO: 1473186 - RNA, 13 nt, Homo sapiens
cugcacacugccu

SEQ ID NO: 1473187 - RNA, 17 nt, Homo sapiens
cugcacagugcaucuca

SEQ ID NO: 1473188 - RNA, 17 nt, Homo sapiens
cugcacccaacuacuga

SEQ ID NO: 1473189 - RNA, 19 nt, Homo sapiens
cugcaccccucugcccuca

SEQ ID NO: 1473190 - RNA, 20 nt, Homo sapiens
cugcaccccucugcccucau

SEQ ID NO: 1473191 - RNA, 20 nt, Homo sapiens
cugcaccugauuaguugaaa

SEQ ID NO: 1473192 - RNA, 20 nt, Homo sapiens
cugcacuaauuugauguuua

SEQ ID NO: 1473193 - RNA, 23 nt, Homo sapiens
cugcacuaauuugauguuuacag

SEQ ID NO: 1473194 - RNA, 15 nt, Homo sapiens
cugcacugaugcugc

SEQ ID NO: 1473195 - RNA, 20 nt, Homo sapiens
cugcagaguaggcagcugcc

SEQ ID NO: 1473196 - RNA, 18 nt, Homo sapiens
cugcagcccaaaacccag

SEQ ID NO: 1473197 - RNA, 17 nt, Homo sapiens
cugcagcucccauuuca

SEQ ID NO: 1473198 - RNA, 15 nt, Homo sapiens
cugcaggaaucaaaa

SEQ ID NO: 1473199 - RNA, 15 nt, Homo sapiens
cugcaggcugcaguc

SEQ ID NO: 1473200 - RNA, 18 nt, Homo sapiens
cugcagggacuccaugcu

SEQ ID NO: 1473201 - RNA, 20 nt, Homo sapiens
cugcagggacuccaugcugc

SEQ ID NO: 1473202 - RNA, 20 nt, Homo sapiens
cugcagguacuuccucaguc

SEQ ID NO: 1473203 - RNA, 19 nt, Homo sapiens
cugcaguggacagucccca

SEQ ID NO: 1473204 - RNA, 16 nt, Homo sapiens
cugcaucauccuugca

SEQ ID NO: 1473205 - RNA, 19 nt, Homo sapiens
cugcauggaccuaacauuc

SEQ ID NO: 1473206 - RNA, 20 nt, Homo sapiens
cugcauguaccauuugcaug

SEQ ID NO: 1473207 - RNA, 16 nt, Homo sapiens
cugcauguacuguaua

SEQ ID NO: 1473208 - RNA, 12 nt, Homo sapiens
cugcauguuaca

SEQ ID NO: 1473209 - RNA, 13 nt, Homo sapiens
cugcauugcuaga

SEQ ID NO: 1473210 - RNA, 17 nt, Homo sapiens
cugccaagacagugaag

SEQ ID NO: 1473211 - RNA, 20 nt, Homo sapiens
cugccacauacaggugcuca

SEQ ID NO: 1473212 - RNA, 20 nt, Homo sapiens
cugccaccaggcacugccug

SEQ ID NO: 1473213 - RNA, 16 nt, Homo sapiens
cugccaccucccugac

SEQ ID NO: 1473214 - RNA, 19 nt, Homo sapiens
cugccagaagauccccuca

SEQ ID NO: 1473215 - RNA, 15 nt, Homo sapiens
cugccaucaugccug

SEQ ID NO: 1473216 - RNA, 20 nt, Homo sapiens
cugccaucauuuacuuuuaa

SEQ ID NO: 1473217 - RNA, 17 nt, Homo sapiens
cugccaugacagaggcu

SEQ ID NO: 1473218 - RNA, 20 nt, Homo sapiens
cugcccaacccuucccucac

SEQ ID NO: 1473219 - RNA, 16 nt, Homo sapiens
cugcccaaucuccauc

SEQ ID NO: 1473220 - RNA, 13 nt, Homo sapiens
cugcccaaugaga

SEQ ID NO: 1473221 - RNA, 22 nt, Homo sapiens
cugcccauggacaggcuggcuc

SEQ ID NO: 1473222 - RNA, 21 nt, Homo sapiens
cugccccaaacaaauaugcaa

SEQ ID NO: 1473223 - RNA, 15 nt, Homo sapiens
cugccccccaugagg

SEQ ID NO: 1473224 - RNA, 21 nt, Homo sapiens
cugcccgggaaggucaccagc

SEQ ID NO: 1473225 - RNA, 21 nt, Homo sapiens
cugcccuccuuugccuuccac

SEQ ID NO: 1473226 - RNA, 19 nt, Homo sapiens
cugccuagcugccuagcaa

SEQ ID NO: 1473227 - RNA, 21 nt, Homo sapiens
cugccucggccucccaaagug

SEQ ID NO: 1473228 - RNA, 15 nt, Homo sapiens
cugccugaguuucca

SEQ ID NO: 1473229 - RNA, 20 nt, Homo sapiens
cugccuggagugcugugcug

SEQ ID NO: 1473230 - RNA, 16 nt, Homo sapiens
cugccuuaaaaccaaa

SEQ ID NO: 1473231 - RNA, 19 nt, Homo sapiens
cugccuuaaaaccaaagag

SEQ ID NO: 1473232 - RNA, 17 nt, Homo sapiens
cugccuuuucaucuaau

SEQ ID NO: 1473233 - RNA, 13 nt, Homo sapiens
cugcgacugauga

SEQ ID NO: 1473234 - RNA, 19 nt, Homo sapiens
cugcggggggcaccagagg

SEQ ID NO: 1473235 - RNA, 19 nt, Homo sapiens
cugcuaaaggacaguggau

SEQ ID NO: 1473236 - RNA, 15 nt, Homo sapiens
cugcuacaacuucag

SEQ ID NO: 1473237 - RNA, 17 nt, Homo sapiens
cugcuauaucuauccau

SEQ ID NO: 1473238 - RNA, 18 nt, Homo sapiens
cugcucacaaaaucacuu

SEQ ID NO: 1473239 - RNA, 13 nt, Homo sapiens
cugcucacuuuaa

SEQ ID NO: 1473240 - RNA, 14 nt, Homo sapiens
cugcuccaccagca

SEQ ID NO: 1473241 - RNA, 13 nt, Homo sapiens
cugcuccacccuu

SEQ ID NO: 1473242 - RNA, 20 nt, Homo sapiens
cugguacugcaggaccucca

SEQ ID NO: 1473243 - RNA, 22 nt, Homo sapiens
cugguacugcaggaccuccagc

SEQ ID NO: 1473244 - RNA, 15 nt, Homo sapiens
cugguauguguggau

SEQ ID NO: 1473245 - RNA, 16 nt, Homo sapiens
cuggucagaugauaua

SEQ ID NO: 1473246 - RNA, 21 nt, Homo sapiens
cuggucccggggccagcacuu

SEQ ID NO: 1473247 - RNA, 23 nt, Homo sapiens
cuggucucaaacuccugggcuca

SEQ ID NO: 1473248 - RNA, 16 nt, Homo sapiens
cuggucuuggugaaca

SEQ ID NO: 1473249 - RNA, 15 nt, Homo sapiens
cuggugagaggugca

SEQ ID NO: 1473250 - RNA, 12 nt, Homo sapiens
cuggugccccac

SEQ ID NO: 1473251 - RNA, 15 nt, Homo sapiens
cugguggcacaggag

SEQ ID NO: 1473252 - RNA, 16 nt, Homo sapiens
cugguggcaccagaug

SEQ ID NO: 1473253 - RNA, 15 nt, Homo sapiens
cuggugggacagugg

SEQ ID NO: 1473254 - RNA, 19 nt, Homo sapiens
cugguggggaucagacaga

SEQ ID NO: 1473255 - RNA, 13 nt, Homo sapiens
cugguuugacuca

SEQ ID NO: 1473256 - RNA, 16 nt, Homo sapiens
cugguuuucugccaau

SEQ ID NO: 1473257 - RNA, 17 nt, Homo sapiens
cuguaaaaacacugaaa

SEQ ID NO: 1473258 - RNA, 16 nt, Homo sapiens
cuguaaaacuaagaaa

SEQ ID NO: 1473259 - RNA, 21 nt, Homo sapiens
cuguaaagacuuuuucaaaga

SEQ ID NO: 1473260 - RNA, 17 nt, Homo sapiens
cuguaacauauucugua

SEQ ID NO: 1473261 - RNA, 18 nt, Homo sapiens
cuguaacccucacccaca

SEQ ID NO: 1473262 - RNA, 18 nt, Homo sapiens
cuguaauauuuagcugua

SEQ ID NO: 1473263 - RNA, 23 nt, Homo sapiens
cuguaaucccagcacuuugggag

SEQ ID NO: 1473264 - RNA, 21 nt, Homo sapiens
cuguaaucccagcuacucggg

SEQ ID NO: 1473265 - RNA, 18 nt, Homo sapiens
cuguaaucccagcuacuu

SEQ ID NO: 1473266 - RNA, 20 nt, Homo sapiens
cuguacaaaauaacucucca

SEQ ID NO: 1473267 - RNA, 17 nt, Homo sapiens
cuguacaaaguagaagu

SEQ ID NO: 1473268 - RNA, 13 nt, Homo sapiens
cuguacacaggcg

SEQ ID NO: 1473269 - RNA, 11 nt, Homo sapiens
cuguaccucau

SEQ ID NO: 1473270 - RNA, 20 nt, Homo sapiens
cuguacuguucugugucuuu

SEQ ID NO: 1473271 - RNA, 22 nt, Homo sapiens
cuccucuucagaggagaaagaa

SEQ ID NO: 1473272 - RNA, 16 nt, Homo sapiens
cuccugaccucaggug

SEQ ID NO: 1473273 - RNA, 14 nt, Homo sapiens
cuccugacuguaac

SEQ ID NO: 1473274 - RNA, 13 nt, Homo sapiens
cuccugacuuuua

SEQ ID NO: 1473275 - RNA, 12 nt, Homo sapiens
cuccugcaaaau

SEQ ID NO: 1473276 - RNA, 17 nt, Homo sapiens
cuccugccccacacucc

SEQ ID NO: 1473277 - RNA, 12 nt, Homo sapiens
cuccugccccuu

SEQ ID NO: 1473278 - RNA, 15 nt, Homo sapiens
cuccuggaaccuugc

SEQ ID NO: 1473279 - RNA, 22 nt, Homo sapiens
cuccugggaagaugagguucug

SEQ ID NO: 1473280 - RNA, 16 nt, Homo sapiens
cuccuggucuugagau

SEQ ID NO: 1473281 - RNA, 19 nt, Homo sapiens
cuccugucccuugaccuua

SEQ ID NO: 1473282 - RNA, 15 nt, Homo sapiens
cuccugucuccagca

SEQ ID NO: 1473283 - RNA, 18 nt, Homo sapiens
cuccugugggagaucuuc

SEQ ID NO: 1473284 - RNA, 20 nt, Homo sapiens
cuccugugggagaucuucac

SEQ ID NO: 1473285 - RNA, 15 nt, Homo sapiens
cuccuucagacaccc

SEQ ID NO: 1473286 - RNA, 22 nt, Homo sapiens
cuccuucccauuucucuacacu

SEQ ID NO: 1473287 - RNA, 16 nt, Homo sapiens
cuccuugggucauuga

SEQ ID NO: 1473288 - RNA, 19 nt, Homo sapiens
cuccuuguaaagacuguag

SEQ ID NO: 1473289 - RNA, 11 nt, Homo sapiens
cuccuuuacaa

SEQ ID NO: 1473290 - RNA, 15 nt, Homo sapiens
cuccuuuacaaaaga

SEQ ID NO: 1473291 - RNA, 16 nt, Homo sapiens
cuccuuuacaaaagaa

SEQ ID NO: 1473292 - RNA, 14 nt, Homo sapiens
cuccuuucucuuau

SEQ ID NO: 1473293 - RNA, 19 nt, Homo sapiens
cuccuuuugcuugaaacca

SEQ ID NO: 1473294 - RNA, 23 nt, Homo sapiens
cuccuuuugcuugaaaccaaaga

SEQ ID NO: 1473295 - RNA, 21 nt, Homo sapiens
cucgaagucauggccaccucc

SEQ ID NO: 1473296 - RNA, 14 nt, Homo sapiens
cucgagauguaucc

SEQ ID NO: 1473297 - RNA, 23 nt, Homo sapiens
cucgagcaucagagcuuccagca

SEQ ID NO: 1473298 - RNA, 23 nt, Homo sapiens
cucgagcuguuuacagugaugcc

SEQ ID NO: 1473299 - RNA, 18 nt, Homo sapiens
cucgaggcccuagcauuu

SEQ ID NO: 1473300 - RNA, 13 nt, Homo sapiens
cucgcacucuggu

SEQ ID NO: 1473301 - RNA, 14 nt, Homo sapiens
cucgcacucuggug

SEQ ID NO: 1473302 - RNA, 22 nt, Homo sapiens
cucgcaggccucccugccagua

SEQ ID NO: 1473303 - RNA, 15 nt, Homo sapiens
cucgcccaacuccac

SEQ ID NO: 1473304 - RNA, 12 nt, Homo sapiens
cucggaugacac

SEQ ID NO: 1473305 - RNA, 11 nt, Homo sapiens
cucgugccaug

SEQ ID NO: 1473306 - RNA, 13 nt, Homo sapiens
cucuaacauuucc

SEQ ID NO: 1473307 - RNA, 12 nt, Homo sapiens
cucuaacuucaa

SEQ ID NO: 1473308 - RNA, 19 nt, Homo sapiens
cucuaagccacucuuccaa

SEQ ID NO: 1473309 - RNA, 19 nt, Homo sapiens
cucuaaugcuugauuuagg

SEQ ID NO: 1473310 - RNA, 14 nt, Homo sapiens
cucuacagugccaa

SEQ ID NO: 1473311 - RNA, 22 nt, Homo sapiens
cucuacccuauacaacuggaca

SEQ ID NO: 1473312 - RNA, 17 nt, Homo sapiens
cucuacgucccagggag

SEQ ID NO: 1473313 - RNA, 14 nt, Homo sapiens
cucuacgugcuccu

SEQ ID NO: 1473314 - RNA, 17 nt, Homo sapiens
cucuacuaaaaauacaa

SEQ ID NO: 1473315 - RNA, 13 nt, Homo sapiens
cucuagaagccaa

SEQ ID NO: 1473316 - RNA, 19 nt, Homo sapiens
cucuagacaacuaccccuu

SEQ ID NO: 1473317 - RNA, 12 nt, Homo sapiens
cucuagcucucu

SEQ ID NO: 1473318 - RNA, 20 nt, Homo sapiens
cucuagcuuugucauaguua

SEQ ID NO: 1473319 - RNA, 23 nt, Homo sapiens
cucuaggccucuccaguuugcac

SEQ ID NO: 1473320 - RNA, 19 nt, Homo sapiens
cucuaguaagaugcacuga

SEQ ID NO: 1473321 - RNA, 18 nt, Homo sapiens
cucuagugucuuuugccu

SEQ ID NO: 1473322 - RNA, 21 nt, Homo sapiens
cucuauagacucuaggacaua

SEQ ID NO: 1473323 - RNA, 20 nt, Homo sapiens
cucuaugaaaauuauaucuc

SEQ ID NO: 1473324 - RNA, 15 nt, Homo sapiens
cucuauuccaaaaag

SEQ ID NO: 1473325 - RNA, 14 nt, Homo sapiens
cucuauuuacuucu

SEQ ID NO: 1473326 - RNA, 22 nt, Homo sapiens
cucucaauuaaagucuauucaa

SEQ ID NO: 1473327 - RNA, 16 nt, Homo sapiens
cucucagcugaccauc

SEQ ID NO: 1473328 - RNA, 23 nt, Homo sapiens
cucucaggaucaagaaaguguug

SEQ ID NO: 1473329 - RNA, 15 nt, Homo sapiens
cucucaguucucgau

SEQ ID NO: 1473330 - RNA, 16 nt, Homo sapiens
cucuccaucagcuccu

SEQ ID NO: 1473331 - RNA, 16 nt, Homo sapiens
cucuccaucucuagga

SEQ ID NO: 1473332 - RNA, 21 nt, Homo sapiens
cucuccccagccuccccgugc

SEQ ID NO: 1473333 - RNA, 22 nt, Homo sapiens
cucuccccauccccacccaguc

SEQ ID NO: 1473334 - RNA, 18 nt, Homo sapiens
cucucccgccagacuguu

SEQ ID NO: 1473335 - RNA, 15 nt, Homo sapiens
cucucuacagugcca

SEQ ID NO: 1473336 - RNA, 13 nt, Homo sapiens
cucucucagcaca

SEQ ID NO: 1473337 - RNA, 13 nt, Homo sapiens
cucucugaucucc

SEQ ID NO: 1473338 - RNA, 17 nt, Homo sapiens
cucugaacuugccuuaa

SEQ ID NO: 1473339 - RNA, 15 nt, Homo sapiens
cucugaccugcacug

SEQ ID NO: 1473340 - RNA, 17 nt, Homo sapiens
cucugaggcuauggagg

SEQ ID NO: 1473341 - RNA, 15 nt, Homo sapiens
cucugauacccagag

SEQ ID NO: 1473342 - RNA, 18 nt, Homo sapiens
cucugcaugacaaacaca

SEQ ID NO: 1473343 - RNA, 15 nt, Homo sapiens
cucugcauucuagua

SEQ ID NO: 1473344 - RNA, 16 nt, Homo sapiens
cucuggaccauauacc

SEQ ID NO: 1473345 - RNA, 15 nt, Homo sapiens
cucuggcacagugua

SEQ ID NO: 1473346 - RNA, 23 nt, Homo sapiens
cucuggccaggauggaggggugg

SEQ ID NO: 1473347 - RNA, 13 nt, Homo sapiens
cuaaaaauccaga

SEQ ID NO: 1473348 - RNA, 14 nt, Homo sapiens
cuaaaacacugaaa

SEQ ID NO: 1473349 - RNA, 18 nt, Homo sapiens
cuaaaacuaugguuccca

SEQ ID NO: 1473350 - RNA, 21 nt, Homo sapiens
cuaaaagcguuggauguagca

SEQ ID NO: 1473351 - RNA, 17 nt, Homo sapiens
cuaaaaggaaaucucac

SEQ ID NO: 1473352 - RNA, 18 nt, Homo sapiens
cuaaaagugggcuugauu

SEQ ID NO: 1473353 - RNA, 18 nt, Homo sapiens
cuaaaauauauuccugag

SEQ ID NO: 1473354 - RNA, 23 nt, Homo sapiens
cuaaaaugauuuuaucugugaau

SEQ ID NO: 1473355 - RNA, 17 nt, Homo sapiens
cuaaaauuuuaggcacu

SEQ ID NO: 1473356 - RNA, 17 nt, Homo sapiens
cuaaacaaaauugcaau

SEQ ID NO: 1473357 - RNA, 16 nt, Homo sapiens
cuaaacaaugcugauu

SEQ ID NO: 1473358 - RNA, 20 nt, Homo sapiens
cuaaaccaaggacugagcac

SEQ ID NO: 1473359 - RNA, 15 nt, Homo sapiens
cuaaaccuuacaugu

SEQ ID NO: 1473360 - RNA, 16 nt, Homo sapiens
cuaaacucagaggcag

SEQ ID NO: 1473361 - RNA, 14 nt, Homo sapiens
cuaaacugguguuu

SEQ ID NO: 1473362 - RNA, 20 nt, Homo sapiens
cuaaaggauccagagagcag

SEQ ID NO: 1473363 - RNA, 14 nt, Homo sapiens
cuaaaggugcacug

SEQ ID NO: 1473364 - RNA, 21 nt, Homo sapiens
cuaaauaaugaauaaacugaa

SEQ ID NO: 1473365 - RNA, 14 nt, Homo sapiens
cuaaauaggagaua

SEQ ID NO: 1473366 - RNA, 18 nt, Homo sapiens
cuaaauccuuuacuguua

SEQ ID NO: 1473367 - RNA, 16 nt, Homo sapiens
cuaaaugcagugaauu

SEQ ID NO: 1473368 - RNA, 23 nt, Homo sapiens
cuaaauggugcugcagauuugau

SEQ ID NO: 1473369 - RNA, 11 nt, Homo sapiens
cuaacaaaaga

SEQ ID NO: 1473370 - RNA, 14 nt, Homo sapiens
cuaacacggugcuc

SEQ ID NO: 1473371 - RNA, 16 nt, Homo sapiens
cuaacauguaauugca

SEQ ID NO: 1473372 - RNA, 20 nt, Homo sapiens
cuaacauguaauugcagaua

SEQ ID NO: 1473373 - RNA, 11 nt, Homo sapiens
cuaacauuucc

SEQ ID NO: 1473374 - RNA, 13 nt, Homo sapiens
cuaaccacuucag

SEQ ID NO: 1473375 - RNA, 16 nt, Homo sapiens
cuaaccuugaaugcug

SEQ ID NO: 1473376 - RNA, 17 nt, Homo sapiens
cuaacgacuucagggca

SEQ ID NO: 1473377 - RNA, 15 nt, Homo sapiens
cuaacuauauuugcu

SEQ ID NO: 1473378 - RNA, 20 nt, Homo sapiens
cuaacuggcaggggagacag

SEQ ID NO: 1473379 - RNA, 17 nt, Homo sapiens
cuaacuucaaggcccau

SEQ ID NO: 1473380 - RNA, 17 nt, Homo sapiens
cuaacuuuucuuaaggu

SEQ ID NO: 1473381 - RNA, 19 nt, Homo sapiens
cuaacuuuucuuaagguuu

SEQ ID NO: 1473382 - RNA, 19 nt, Homo sapiens
cuaagaaauaugcacaaua

SEQ ID NO: 1473383 - RNA, 15 nt, Homo sapiens
cuaagaaauauucca

SEQ ID NO: 1473384 - RNA, 18 nt, Homo sapiens
cuaagaauucaaacuggg

SEQ ID NO: 1473385 - RNA, 13 nt, Homo sapiens
cuaagauuaccuu

SEQ ID NO: 1473386 - RNA, 14 nt, Homo sapiens
cuaagcaugugucc

SEQ ID NO: 1473387 - RNA, 11 nt, Homo sapiens
cuaagccuuuc

SEQ ID NO: 1473388 - RNA, 17 nt, Homo sapiens
cuaagccuuuccauaag

SEQ ID NO: 1473389 - RNA, 16 nt, Homo sapiens
cuaagcuauucaguaa

SEQ ID NO: 1473390 - RNA, 18 nt, Homo sapiens
cuaagggugggugcucag

SEQ ID NO: 1473391 - RNA, 13 nt, Homo sapiens
cuaauaaacaauu

SEQ ID NO: 1473392 - RNA, 17 nt, Homo sapiens
cuaauaaacauccuuca

SEQ ID NO: 1473393 - RNA, 22 nt, Homo sapiens
cuaauagagugguacagcacug

SEQ ID NO: 1473394 - RNA, 18 nt, Homo sapiens
cuaauaugccuagcacaa

SEQ ID NO: 1473395 - RNA, 20 nt, Homo sapiens
cuaaucaccauguaagcacu

SEQ ID NO: 1473396 - RNA, 16 nt, Homo sapiens
cuaaucgaaugaacaa

SEQ ID NO: 1473397 - RNA, 18 nt, Homo sapiens
cuaaugagggugugagaa

SEQ ID NO: 1473398 - RNA, 19 nt, Homo sapiens
cuaauggggacacagauca

SEQ ID NO: 1473399 - RNA, 19 nt, Homo sapiens
cuaauuuguaggaaaaagc

SEQ ID NO: 1473400 - RNA, 16 nt, Homo sapiens
cuaauuuuuaagaauu

SEQ ID NO: 1473401 - RNA, 19 nt, Homo sapiens
cuacaaguauaugugaaaa

SEQ ID NO: 1473402 - RNA, 16 nt, Homo sapiens
cuacacccaccagagu

SEQ ID NO: 1473403 - RNA, 21 nt, Homo sapiens
cuacacucuugacuagugcaa

SEQ ID NO: 1473404 - RNA, 22 nt, Homo sapiens
cuacagagcagcuccccaggag

SEQ ID NO: 1473405 - RNA, 17 nt, Homo sapiens
cuacagcacuacugggu

SEQ ID NO: 1473406 - RNA, 19 nt, Homo sapiens
cuacagggccacaacugcc

SEQ ID NO: 1473407 - RNA, 17 nt, Homo sapiens
cuacagggcuuaggacu

SEQ ID NO: 1473408 - RNA, 20 nt, Homo sapiens
cuacagugaauuuaaucaaa

SEQ ID NO: 1473409 - RNA, 14 nt, Homo sapiens
cuacauaaguaauu

SEQ ID NO: 1473410 - RNA, 21 nt, Homo sapiens
cuaccagguguucuacacuca

SEQ ID NO: 1473411 - RNA, 13 nt, Homo sapiens
cuaccaguuggca

SEQ ID NO: 1473412 - RNA, 13 nt, Homo sapiens
cuaccaucaggga

SEQ ID NO: 1473413 - RNA, 15 nt, Homo sapiens
cuaccaucagggaca

SEQ ID NO: 1473414 - RNA, 16 nt, Homo sapiens
cuacccuggcacuaua

SEQ ID NO: 1473415 - RNA, 23 nt, Homo sapiens
cuaccgagucucuucuccacugg

SEQ ID NO: 1473416 - RNA, 16 nt, Homo sapiens
cuaccucaagacucac

SEQ ID NO: 1473417 - RNA, 22 nt, Homo sapiens
cuaccucaagacucaccucauc

SEQ ID NO: 1473418 - RNA, 12 nt, Homo sapiens
cuaccucaaggg

SEQ ID NO: 1473419 - RNA, 18 nt, Homo sapiens
cuaccucaggcagcucaa

SEQ ID NO: 1473420 - RNA, 15 nt, Homo sapiens
cuaccucugugccag

SEQ ID NO: 1473421 - RNA, 17 nt, Homo sapiens
cuacgaauauagagggu

SEQ ID NO: 1473422 - RNA, 14 nt, Homo sapiens
cuacgaaucuuccg

SEQ ID NO: 1473423 - RNA, 15 nt, Homo sapiens
cuacuaaaaaugcaa

SEQ ID NO: 1473424 - RNA, 20 nt, Homo sapiens
cuacuaaguucacauuagaa

SEQ ID NO: 1473425 - RNA, 20 nt, Homo sapiens
cuacuccuuguaaagacugu

SEQ ID NO: 1473426 - RNA, 16 nt, Homo sapiens
cuacucuucagggucu

SEQ ID NO: 1473427 - RNA, 22 nt, Homo sapiens
cuacugagcugagaccacugag

SEQ ID NO: 1473428 - RNA, 16 nt, Homo sapiens
cuacugauuguuucau

SEQ ID NO: 1473429 - RNA, 18 nt, Homo sapiens
cuacugcuaaauccucau

SEQ ID NO: 1473430 - RNA, 14 nt, Homo sapiens
cuacugcucugugu

SEQ ID NO: 1473431 - RNA, 13 nt, Homo sapiens
cuacugugugcca

SEQ ID NO: 1473432 - RNA, 15 nt, Homo sapiens
cuacuucauagcucc

SEQ ID NO: 1473433 - RNA, 12 nt, Homo sapiens
cuacuugaguua

SEQ ID NO: 1473434 - RNA, 14 nt, Homo sapiens
cuacuugggagcac

SEQ ID NO: 1473435 - RNA, 15 nt, Homo sapiens
cuacuuuaagcacua

SEQ ID NO: 1473436 - RNA, 21 nt, Homo sapiens
cuacuuugguuucugucugua

SEQ ID NO: 1473437 - RNA, 13 nt, Homo sapiens
cuacuuuuaguug

SEQ ID NO: 1473438 - RNA, 19 nt, Homo sapiens
cuacuuuuaguugacucac

SEQ ID NO: 1473439 - RNA, 20 nt, Homo sapiens
cuagaagcacauguguauuu

SEQ ID NO: 1473440 - RNA, 10 nt, Homo sapiens
cuagaaggca

SEQ ID NO: 1473441 - RNA, 22 nt, Homo sapiens
cuagaaugcaaguauccugcga

SEQ ID NO: 1473442 - RNA, 19 nt, Homo sapiens
cuagaauguggauuugauu

SEQ ID NO: 1473443 - RNA, 14 nt, Homo sapiens
cuagacuggcugaa

SEQ ID NO: 1473444 - RNA, 21 nt, Homo sapiens
cuagacuggcugaaaaaccua

SEQ ID NO: 1473445 - RNA, 23 nt, Homo sapiens
cuagagaagaggcuggugcugug

SEQ ID NO: 1473446 - RNA, 15 nt, Homo sapiens
cuagagacaggcaaa

SEQ ID NO: 1473447 - RNA, 14 nt, Homo sapiens
cuagaguccucacu

SEQ ID NO: 1473448 - RNA, 19 nt, Homo sapiens
cuagaugauggaugccaau

SEQ ID NO: 1473449 - RNA, 22 nt, Homo sapiens
cauuuggugggcuuuggagcug

SEQ ID NO: 1473450 - RNA, 19 nt, Homo sapiens
cauuugguguggauuuucu

SEQ ID NO: 1473451 - RNA, 12 nt, Homo sapiens
cauuuguucuca

SEQ ID NO: 1473452 - RNA, 15 nt, Homo sapiens
cauuuuaagaguuac

SEQ ID NO: 1473453 - RNA, 22 nt, Homo sapiens
cauuuuacccuuggcucaaucc

SEQ ID NO: 1473454 - RNA, 20 nt, Homo sapiens
cauuuuagucaugcaaagau

SEQ ID NO: 1473455 - RNA, 14 nt, Homo sapiens
cauuuucaccccac

SEQ ID NO: 1473456 - RNA, 16 nt, Homo sapiens
cauuuucaucacuggg

SEQ ID NO: 1473457 - RNA, 18 nt, Homo sapiens
cauuuucugacaugcauu

SEQ ID NO: 1473458 - RNA, 14 nt, Homo sapiens
cauuuugcauucaa

SEQ ID NO: 1473459 - RNA, 22 nt, Homo sapiens
cauuuuggaaguuuucaggacu

SEQ ID NO: 1473460 - RNA, 21 nt, Homo sapiens
cauuuuguugcuuuugugaac

SEQ ID NO: 1473461 - RNA, 22 nt, Homo sapiens
cauuuuuuucacuggaguuaca

SEQ ID NO: 1473462 - RNA, 15 nt, Homo sapiens
ccaaaagcaguaaau

SEQ ID NO: 1473463 - RNA, 22 nt, Homo sapiens
ccaaaagggccauguuucaaga

SEQ ID NO: 1473464 - RNA, 19 nt, Homo sapiens
ccaaaauaguuaagacaug

SEQ ID NO: 1473465 - RNA, 18 nt, Homo sapiens
ccaaaaucggaucugggg

SEQ ID NO: 1473466 - RNA, 17 nt, Homo sapiens
ccaaaauuaccaaaaau

SEQ ID NO: 1473467 - RNA, 21 nt, Homo sapiens
ccaaaauuaguuuguguuacu

SEQ ID NO: 1473468 - RNA, 22 nt, Homo sapiens
ccaaacccaugaggcaauguca

SEQ ID NO: 1473469 - RNA, 19 nt, Homo sapiens
ccaaagagggcuuccucua

SEQ ID NO: 1473470 - RNA, 22 nt, Homo sapiens
ccaaagaguagaauugcauuga

SEQ ID NO: 1473471 - RNA, 19 nt, Homo sapiens
ccaaagcagacagcuccac

SEQ ID NO: 1473472 - RNA, 12 nt, Homo sapiens
ccaaagcugcag

SEQ ID NO: 1473473 - RNA, 23 nt, Homo sapiens
ccaaaggauagugcgauguuuca

SEQ ID NO: 1473474 - RNA, 21 nt, Homo sapiens
ccaaagggugaagcuauuuau

SEQ ID NO: 1473475 - RNA, 14 nt, Homo sapiens
ccaaaguuauccag

SEQ ID NO: 1473476 - RNA, 16 nt, Homo sapiens
ccaaaucccagggaag

SEQ ID NO: 1473477 - RNA, 22 nt, Homo sapiens
ccaaaugcagggaggggaggca

SEQ ID NO: 1473478 - RNA, 19 nt, Homo sapiens
ccaaaugcauggugcaguu

SEQ ID NO: 1473479 - RNA, 14 nt, Homo sapiens
ccaaauugcagcuu

SEQ ID NO: 1473480 - RNA, 15 nt, Homo sapiens
ccaacacccugucua

SEQ ID NO: 1473481 - RNA, 21 nt, Homo sapiens
ccaacacugcugcuccagugc

SEQ ID NO: 1473482 - RNA, 14 nt, Homo sapiens
ccaaccacagagaa

SEQ ID NO: 1473483 - RNA, 13 nt, Homo sapiens
ccaaccccagugg

SEQ ID NO: 1473484 - RNA, 16 nt, Homo sapiens
ccaaccugaagacacc

SEQ ID NO: 1473485 - RNA, 24 nt, Homo sapiens
ccaacguaugugguuaucugugaa

SEQ ID NO: 1473486 - RNA, 13 nt, Homo sapiens
ccaacucugggaa

SEQ ID NO: 1473487 - RNA, 19 nt, Homo sapiens
ccaacuucauuugaugcua

SEQ ID NO: 1473488 - RNA, 21 nt, Homo sapiens
ccaacuugagggcccagagca

SEQ ID NO: 1473489 - RNA, 19 nt, Homo sapiens
ccaagaaagcucacuguag

SEQ ID NO: 1473490 - RNA, 19 nt, Homo sapiens
ccaagaacugcauggaccu

SEQ ID NO: 1473491 - RNA, 15 nt, Homo sapiens
ccaagacagugaagu

SEQ ID NO: 1473492 - RNA, 21 nt, Homo sapiens
ccaagaugacacaacugcacu

SEQ ID NO: 1473493 - RNA, 19 nt, Homo sapiens
ccaagaugucaaaacaaga

SEQ ID NO: 1473494 - RNA, 21 nt, Homo sapiens
ccaagcaaaccaauggugauc

SEQ ID NO: 1473495 - RNA, 13 nt, Homo sapiens
ccaagccugacca

SEQ ID NO: 1473496 - RNA, 23 nt, Homo sapiens
ccaaggaaacccccaguguaaua

SEQ ID NO: 1473497 - RNA, 15 nt, Homo sapiens
ccaaggaugcuguca

SEQ ID NO: 1473498 - RNA, 15 nt, Homo sapiens
ccaagggaaaggggu

SEQ ID NO: 1473499 - RNA, 20 nt, Homo sapiens
ccaagggacccuuugccuuu

SEQ ID NO: 1473500 - RNA, 15 nt, Homo sapiens
ccaaggggaaucaga

SEQ ID NO: 1473501 - RNA, 14 nt, Homo sapiens
ccaagguaggcaga

SEQ ID NO: 1473502 - RNA, 17 nt, Homo sapiens
ccaagguucugggugca

SEQ ID NO: 1473503 - RNA, 13 nt, Homo sapiens
ccaagucauggag

SEQ ID NO: 1473504 - RNA, 15 nt, Homo sapiens
ccaagucaugugcau

SEQ ID NO: 1473505 - RNA, 18 nt, Homo sapiens
ccaaguccucccucucua

SEQ ID NO: 1473506 - RNA, 18 nt, Homo sapiens
ccaaguugaagacuuugu

SEQ ID NO: 1473507 - RNA, 15 nt, Homo sapiens
ccaauaaaaaguuca

SEQ ID NO: 1473508 - RNA, 20 nt, Homo sapiens
ccaauaaaaaguucagaguu

SEQ ID NO: 1473509 - RNA, 14 nt, Homo sapiens
ccaauaaaauuucu

SEQ ID NO: 1473510 - RNA, 17 nt, Homo sapiens
ccaauagcaaggcugug

SEQ ID NO: 1473511 - RNA, 14 nt, Homo sapiens
ccaaucauuuuaau

SEQ ID NO: 1473512 - RNA, 19 nt, Homo sapiens
ccaaucccaccaacccuca

SEQ ID NO: 1473513 - RNA, 23 nt, Homo sapiens
ccaaucccuuuauuacccccucc

SEQ ID NO: 1473514 - RNA, 23 nt, Homo sapiens
ccaaucuugcuuuguguaucuca

SEQ ID NO: 1473515 - RNA, 23 nt, Homo sapiens
ccaauguucuauuaaucaccucu

SEQ ID NO: 1473516 - RNA, 14 nt, Homo sapiens
ccaauuuacauacu

SEQ ID NO: 1473517 - RNA, 16 nt, Homo sapiens
ccaauuugacaaaacc

SEQ ID NO: 1473518 - RNA, 20 nt, Homo sapiens
ccacaaccuuccagcuccau

SEQ ID NO: 1473519 - RNA, 21 nt, Homo sapiens
ccacaauagcagacaguguuu

SEQ ID NO: 1473520 - RNA, 11 nt, Homo sapiens
ccacacaagcg

SEQ ID NO: 1473521 - RNA, 15 nt, Homo sapiens
ccacacagacuccac

SEQ ID NO: 1473522 - RNA, 18 nt, Homo sapiens
ccacacagcuacagcuuu

SEQ ID NO: 1473523 - RNA, 16 nt, Homo sapiens
ccacacauuaguacuu

SEQ ID NO: 1473524 - RNA, 19 nt, Homo sapiens
ccacacauuaguacuuaug

SEQ ID NO: 1473525 - RNA, 11 nt, Homo sapiens
ccacaccucag

SEQ ID NO: 1473526 - RNA, 18 nt, Homo sapiens
ccacacgcacuggugcca

SEQ ID NO: 1473527 - RNA, 14 nt, Homo sapiens
ccacacucagcaca

SEQ ID NO: 1473528 - RNA, 21 nt, Homo sapiens
ccacacuuguuccagcucuuu

SEQ ID NO: 1473529 - RNA, 23 nt, Homo sapiens
ccacagaacacagcaauuccuca

SEQ ID NO: 1473530 - RNA, 20 nt, Homo sapiens
ccacagccaaacuaggacac

SEQ ID NO: 1473531 - RNA, 18 nt, Homo sapiens
ccacagccaggccgagag

SEQ ID NO: 1473532 - RNA, 12 nt, Homo sapiens
ccacagccaugg

SEQ ID NO: 1473533 - RNA, 17 nt, Homo sapiens
ccacagcuggcucugac

SEQ ID NO: 1473534 - RNA, 18 nt, Homo sapiens
ccacauacaggugcucaa

SEQ ID NO: 1473535 - RNA, 23 nt, Homo sapiens
ccacauuaucaguugacagugua

SEQ ID NO: 1473536 - RNA, 18 nt, Homo sapiens
ccaggaguuugagaccag

SEQ ID NO: 1473537 - RNA, 18 nt, Homo sapiens
ccaggauaaggagacuga

SEQ ID NO: 1473538 - RNA, 15 nt, Homo sapiens
ccaggaucauggugu

SEQ ID NO: 1473539 - RNA, 20 nt, Homo sapiens
ccaggaucaugguguaauaa

SEQ ID NO: 1473540 - RNA, 14 nt, Homo sapiens
ccaggauucagcua

SEQ ID NO: 1473541 - RNA, 19 nt, Homo sapiens
ccaggcaagugggaccagg

SEQ ID NO: 1473542 - RNA, 16 nt, Homo sapiens
ccaggcacugccugga

SEQ ID NO: 1473543 - RNA, 16 nt, Homo sapiens
ccaggcacugcugcac

SEQ ID NO: 1473544 - RNA, 13 nt, Homo sapiens
ccaggcagaucca

SEQ ID NO: 1473545 - RNA, 17 nt, Homo sapiens
ccaggccagagggcagu

SEQ ID NO: 1473546 - RNA, 16 nt, Homo sapiens
ccaggcccaugccaag

SEQ ID NO: 1473547 - RNA, 18 nt, Homo sapiens
ccaggccgggguggagca

SEQ ID NO: 1473548 - RNA, 14 nt, Homo sapiens
ccaggccugccaag

SEQ ID NO: 1473549 - RNA, 18 nt, Homo sapiens
ccaggccuguugcuauag

SEQ ID NO: 1473550 - RNA, 13 nt, Homo sapiens
ccaggcuaccauc

SEQ ID NO: 1473551 - RNA, 15 nt, Homo sapiens
cacccacgugcauuc

SEQ ID NO: 1473552 - RNA, 14 nt, Homo sapiens
cacccagaccccag

SEQ ID NO: 1473553 - RNA, 18 nt, Homo sapiens
cacccagaccccaggcug

SEQ ID NO: 1473554 - RNA, 19 nt, Homo sapiens
cacccagacuggagugcag

SEQ ID NO: 1473555 - RNA, 22 nt, Homo sapiens
cacccaggcccgcaccgcuggg

SEQ ID NO: 1473556 - RNA, 20 nt, Homo sapiens
cacccaggcuggacugcaau

SEQ ID NO: 1473557 - RNA, 13 nt, Homo sapiens
cacccagucucau

SEQ ID NO: 1473558 - RNA, 16 nt, Homo sapiens
cacccauaauccuuuc

SEQ ID NO: 1473559 - RNA, 21 nt, Homo sapiens
cacccccugcuccaccagcag

SEQ ID NO: 1473560 - RNA, 20 nt, Homo sapiens
cacccccuucucugcuccac

SEQ ID NO: 1473561 - RNA, 18 nt, Homo sapiens
caccccgccugcccucau

SEQ ID NO: 1473562 - RNA, 15 nt, Homo sapiens
caccccuacacacac

SEQ ID NO: 1473563 - RNA, 16 nt, Homo sapiens
caccccuuauccagga

SEQ ID NO: 1473564 - RNA, 21 nt, Homo sapiens
cacccgaccuggcugccccuc

SEQ ID NO: 1473565 - RNA, 20 nt, Homo sapiens
cacccuccaugcuccucacc

SEQ ID NO: 1473566 - RNA, 22 nt, Homo sapiens
cacccucccccgccacuccuga

SEQ ID NO: 1473567 - RNA, 17 nt, Homo sapiens
cacccuccuugcaggau

SEQ ID NO: 1473568 - RNA, 14 nt, Homo sapiens
cacccugcacuuuc

SEQ ID NO: 1473569 - RNA, 22 nt, Homo sapiens
cacccugcuacacauacaggau

SEQ ID NO: 1473570 - RNA, 16 nt, Homo sapiens
cacccuggacaaagaa

SEQ ID NO: 1473571 - RNA, 21 nt, Homo sapiens
cacccugugccaucaccauaa

SEQ ID NO: 1473572 - RNA, 14 nt, Homo sapiens
caccgacuagccag

SEQ ID NO: 1473573 - RNA, 20 nt, Homo sapiens
caccgagaauguuguauuca

SEQ ID NO: 1473574 - RNA, 17 nt, Homo sapiens
caccguacaucugcaau

SEQ ID NO: 1473575 - RNA, 18 nt, Homo sapiens
caccguacaucugcaaua

SEQ ID NO: 1473576 - RNA, 21 nt, Homo sapiens
caccuaauguuuaugagccag

SEQ ID NO: 1473577 - RNA, 22 nt, Homo sapiens
caccuaauguuuaugagccaga

SEQ ID NO: 1473578 - RNA, 16 nt, Homo sapiens
caccuacuaugugcug

SEQ ID NO: 1473579 - RNA, 15 nt, Homo sapiens
caccuagacuguaaa

SEQ ID NO: 1473580 - RNA, 12 nt, Homo sapiens
caccuaugugcc

SEQ ID NO: 1473581 - RNA, 12 nt, Homo sapiens
caccuauuucca

SEQ ID NO: 1473582 - RNA, 18 nt, Homo sapiens
caccucaagacccccauu

SEQ ID NO: 1473583 - RNA, 14 nt, Homo sapiens
caccucacccggcc

SEQ ID NO: 1473584 - RNA, 20 nt, Homo sapiens
caccuccucauguacauacc

SEQ ID NO: 1473585 - RNA, 18 nt, Homo sapiens
caccucucuguaguuuau

SEQ ID NO: 1473586 - RNA, 17 nt, Homo sapiens
caccucuuccuugaugu

SEQ ID NO: 1473587 - RNA, 12 nt, Homo sapiens
caccugcaucug

SEQ ID NO: 1473588 - RNA, 16 nt, Homo sapiens
caccugccgucuucac

SEQ ID NO: 1473589 - RNA, 21 nt, Homo sapiens
caccugccuccucguuccuuu

SEQ ID NO: 1473590 - RNA, 14 nt, Homo sapiens
caccugcuccagaa

SEQ ID NO: 1473591 - RNA, 18 nt, Homo sapiens
caccugcuucugaacuca

SEQ ID NO: 1473592 - RNA, 19 nt, Homo sapiens
caccuggauguacuaucca

SEQ ID NO: 1473593 - RNA, 20 nt, Homo sapiens
caccuggguccaucagagaa

SEQ ID NO: 1473594 - RNA, 18 nt, Homo sapiens
caccugucaucauggagg

SEQ ID NO: 1473595 - RNA, 17 nt, Homo sapiens
caccuuaagauuuugca

SEQ ID NO: 1473596 - RNA, 16 nt, Homo sapiens
caccuucaagcagcug

SEQ ID NO: 1473597 - RNA, 14 nt, Homo sapiens
caccuuccaaagga

SEQ ID NO: 1473598 - RNA, 21 nt, Homo sapiens
caccuuccagcuccuguaaca

SEQ ID NO: 1473599 - RNA, 15 nt, Homo sapiens
caccuugccaagcuu

SEQ ID NO: 1473600 - RNA, 17 nt, Homo sapiens
caccuugccuugcuguu

SEQ ID NO: 1473601 - RNA, 16 nt, Homo sapiens
caccuuggcaccagac

SEQ ID NO: 1473602 - RNA, 20 nt, Homo sapiens
caccuuuaacacagaccccu

SEQ ID NO: 1473603 - RNA, 13 nt, Homo sapiens
caccuuuuacucu

SEQ ID NO: 1473604 - RNA, 18 nt, Homo sapiens
caccuuuugcacauaaca

SEQ ID NO: 1473605 - RNA, 16 nt, Homo sapiens
cacgaccauuugauag

SEQ ID NO: 1473606 - RNA, 23 nt, Homo sapiens
cacgccgcucuucacugugguca

SEQ ID NO: 1473607 - RNA, 13 nt, Homo sapiens
cacgccuguaauu

SEQ ID NO: 1473608 - RNA, 21 nt, Homo sapiens
cacgcugaaggcuuacuucag

SEQ ID NO: 1473609 - RNA, 19 nt, Homo sapiens
cacgcuguuuguuucauau

SEQ ID NO: 1473610 - RNA, 16 nt, Homo sapiens
cacgcuuugcugcuac

SEQ ID NO: 1473611 - RNA, 14 nt, Homo sapiens
cacggcauuacccc

SEQ ID NO: 1473612 - RNA, 20 nt, Homo sapiens
cacggccacaucaaagaggc

SEQ ID NO: 1473613 - RNA, 20 nt, Homo sapiens
cacgucacugcacuccagcu

SEQ ID NO: 1473614 - RNA, 19 nt, Homo sapiens
cacgugucuuccacuuugc

SEQ ID NO: 1473615 - RNA, 22 nt, Homo sapiens
cacgugucuuccacuuugcaua

SEQ ID NO: 1473616 - RNA, 16 nt, Homo sapiens
cacguugggacaggga

SEQ ID NO: 1473617 - RNA, 17 nt, Homo sapiens
cacuaaagccagccuga

SEQ ID NO: 1473618 - RNA, 13 nt, Homo sapiens
cacuaacauuucc

SEQ ID NO: 1473619 - RNA, 13 nt, Homo sapiens
cacuaaucugaaa

SEQ ID NO: 1473620 - RNA, 15 nt, Homo sapiens
cacuaaugcuuuaag

SEQ ID NO: 1473621 - RNA, 22 nt, Homo sapiens
cacuaauuugauguuuacaggu

SEQ ID NO: 1473622 - RNA, 18 nt, Homo sapiens
cacuacaccuugccuugc

SEQ ID NO: 1473623 - RNA, 15 nt, Homo sapiens
cacuacauucauuua

SEQ ID NO: 1473624 - RNA, 13 nt, Homo sapiens
cacuaccacauua

SEQ ID NO: 1473625 - RNA, 19 nt, Homo sapiens
cacuacugggugucauuuc

SEQ ID NO: 1473626 - RNA, 16 nt, Homo sapiens
cacuagaaugcaagua

SEQ ID NO: 1473627 - RNA, 18 nt, Homo sapiens
cacuaggguccaccagga

SEQ ID NO: 1473628 - RNA, 17 nt, Homo sapiens
cacuagucucaccagcc

SEQ ID NO: 1473629 - RNA, 19 nt, Homo sapiens
cacuauaauguaagcucua

SEQ ID NO: 1473630 - RNA, 20 nt, Homo sapiens
cacuauaguuuaaaacacau

SEQ ID NO: 1473631 - RNA, 17 nt, Homo sapiens
cacuauguggagcucag

SEQ ID NO: 1473632 - RNA, 21 nt, Homo sapiens
cacuauguuuauuuacuaauu

SEQ ID NO: 1473633 - RNA, 16 nt, Homo sapiens
cacuauucuugaauua

SEQ ID NO: 1473634 - RNA, 21 nt, Homo sapiens
cacuauuguuccagcaguuuu

SEQ ID NO: 1473635 - RNA, 14 nt, Homo sapiens
cacucaagcacuga

SEQ ID NO: 1473636 - RNA, 16 nt, Homo sapiens
cacucaagcacugaua

SEQ ID NO: 1473637 - RNA, 13 nt, Homo sapiens
cacucagcugucc

SEQ ID NO: 1473638 - RNA, 17 nt, Homo sapiens
cacucagggagcauuua

SEQ ID NO: 1473639 - RNA, 15 nt, Homo sapiens
cacucagguucuuca

SEQ ID NO: 1473640 - RNA, 22 nt, Homo sapiens
cacucagguucuucagggccag

SEQ ID NO: 1473641 - RNA, 17 nt, Homo sapiens
cacucaguuuaugcugu

SEQ ID NO: 1473642 - RNA, 15 nt, Homo sapiens
cacuccacagaguga

SEQ ID NO: 1473643 - RNA, 14 nt, Homo sapiens
cacuccagugccag

SEQ ID NO: 1473644 - RNA, 14 nt, Homo sapiens
cacucccaguccaa

SEQ ID NO: 1473645 - RNA, 13 nt, Homo sapiens
cacuccccuaggg

SEQ ID NO: 1473646 - RNA, 15 nt, Homo sapiens
cacucccgccucagg

SEQ ID NO: 1473647 - RNA, 15 nt, Homo sapiens
caaaugcuuuggacu

SEQ ID NO: 1473648 - RNA, 20 nt, Homo sapiens
caaaugcuuuggacuuuuga

SEQ ID NO: 1473649 - RNA, 16 nt, Homo sapiens
caaauggcagaaccaa

SEQ ID NO: 1473650 - RNA, 23 nt, Homo sapiens
caaauggcagaaccaaagcucaa

SEQ ID NO: 1473651 - RNA, 13 nt, Homo sapiens
caaauggggccag

SEQ ID NO: 1473652 - RNA, 17 nt, Homo sapiens
caaauggggccagaucc

SEQ ID NO: 1473653 - RNA, 20 nt, Homo sapiens
caaaugguaggcauuuccua

SEQ ID NO: 1473654 - RNA, 19 nt, Homo sapiens
caaauguacagugguccuu

SEQ ID NO: 1473655 - RNA, 19 nt, Homo sapiens
caaaugucuaucaacuuua

SEQ ID NO: 1473656 - RNA, 21 nt, Homo sapiens
caaauuugauugauuugaaga

SEQ ID NO: 1473657 - RNA, 16 nt, Homo sapiens
caaauuuuucuaucaa

SEQ ID NO: 1473658 - RNA, 11 nt, Homo sapiens
caacaaaccau

SEQ ID NO: 1473659 - RNA, 19 nt, Homo sapiens
caacaaaccauccagugac

SEQ ID NO: 1473660 - RNA, 19 nt, Homo sapiens
caacaacacaauaacacua

SEQ ID NO: 1473661 - RNA, 16 nt, Homo sapiens
caacaaccuaugcacc

SEQ ID NO: 1473662 - RNA, 17 nt, Homo sapiens
caacaauccaucucuca

SEQ ID NO: 1473663 - RNA, 23 nt, Homo sapiens
caacacugcugcuccagugcagg

SEQ ID NO: 1473664 - RNA, 17 nt, Homo sapiens
caacacuguacacauaa

SEQ ID NO: 1473665 - RNA, 19 nt, Homo sapiens
caacacuguuacuuucgua

SEQ ID NO: 1473666 - RNA, 11 nt, Homo sapiens
caacacuuaag

SEQ ID NO: 1473667 - RNA, 20 nt, Homo sapiens
caacagaacauauguugcaa

SEQ ID NO: 1473668 - RNA, 21 nt, Homo sapiens
caacagaaguauuucugugga

SEQ ID NO: 1473669 - RNA, 13 nt, Homo sapiens
caacagagcaaga

SEQ ID NO: 1473670 - RNA, 23 nt, Homo sapiens
caacagcaccuccccgcugggaa

SEQ ID NO: 1473671 - RNA, 13 nt, Homo sapiens
caacagcagugau

SEQ ID NO: 1473672 - RNA, 22 nt, Homo sapiens
caacagccaugcccgcauuagc

SEQ ID NO: 1473673 - RNA, 19 nt, Homo sapiens
caacagcuacagucuaaaa

SEQ ID NO: 1473674 - RNA, 11 nt, Homo sapiens
caacaggaaau

SEQ ID NO: 1473675 - RNA, 14 nt, Homo sapiens
caacaggaaggaac

SEQ ID NO: 1473676 - RNA, 14 nt, Homo sapiens
caacaggacagagu

SEQ ID NO: 1473677 - RNA, 22 nt, Homo sapiens
caacaggcaguggaagcaguuu

SEQ ID NO: 1473678 - RNA, 16 nt, Homo sapiens
caacaggcccagggag

SEQ ID NO: 1473679 - RNA, 20 nt, Homo sapiens
caacauaacugaaggcauau

SEQ ID NO: 1473680 - RNA, 11 nt, Homo sapiens
caacauaugca

SEQ ID NO: 1473681 - RNA, 16 nt, Homo sapiens
caacaucaauccuuua

SEQ ID NO: 1473682 - RNA, 14 nt, Homo sapiens
caacauccaaaaua

SEQ ID NO: 1473683 - RNA, 13 nt, Homo sapiens
caacauccugcca

SEQ ID NO: 1473684 - RNA, 20 nt, Homo sapiens
caacauccugccagccccac

SEQ ID NO: 1473685 - RNA, 12 nt, Homo sapiens
caacaugcugcc

SEQ ID NO: 1473686 - RNA, 15 nt, Homo sapiens
caacauggcuuucuu

SEQ ID NO: 1473687 - RNA, 18 nt, Homo sapiens
caacauugcuugugccac

SEQ ID NO: 1473688 - RNA, 16 nt, Homo sapiens
caaccaggaguaccug

SEQ ID NO: 1473689 - RNA, 14 nt, Homo sapiens
caacccggcacugc

SEQ ID NO: 1473690 - RNA, 14 nt, Homo sapiens
caaccgccucaaaa

SEQ ID NO: 1473691 - RNA, 12 nt, Homo sapiens
caaccucaucca

SEQ ID NO: 1473692 - RNA, 13 nt, Homo sapiens
caaccucauccag

SEQ ID NO: 1473693 - RNA, 16 nt, Homo sapiens
caaccucauccaggcu

SEQ ID NO: 1473694 - RNA, 17 nt, Homo sapiens
caaccucauugcagcua

SEQ ID NO: 1473695 - RNA, 14 nt, Homo sapiens
caaccucugccucc

SEQ ID NO: 1473696 - RNA, 18 nt, Homo sapiens
caaccuucacaucuguca

SEQ ID NO: 1473697 - RNA, 16 nt, Homo sapiens
caacgauaaaauuaca

SEQ ID NO: 1473698 - RNA, 13 nt, Homo sapiens
caacgaugaauuu

SEQ ID NO: 1473699 - RNA, 16 nt, Homo sapiens
caacggcuuagacuuc

SEQ ID NO: 1473700 - RNA, 20 nt, Homo sapiens
caacucaaugaaaauuuaaa

SEQ ID NO: 1473701 - RNA, 20 nt, Homo sapiens
caacucuaccccugcuccca

SEQ ID NO: 1473702 - RNA, 12 nt, Homo sapiens
caacucuugauu

SEQ ID NO: 1473703 - RNA, 17 nt, Homo sapiens
caacugauacuucacua

SEQ ID NO: 1473704 - RNA, 21 nt, Homo sapiens
caacugcccccgccacaaccc

SEQ ID NO: 1473705 - RNA, 18 nt, Homo sapiens
caacugucuaacuuuaga

SEQ ID NO: 1473706 - RNA, 19 nt, Homo sapiens
caacuuccagagaagccau

SEQ ID NO: 1473707 - RNA, 19 nt, Homo sapiens
caacuugaaauuauaucug

SEQ ID NO: 1473708 - RNA, 22 nt, Homo sapiens
caacuugaaauuauaucugugg

SEQ ID NO: 1473709 - RNA, 20 nt, Homo sapiens
caacuuguauuaaagacaga

SEQ ID NO: 1473710 - RNA, 14 nt, Homo sapiens
caagaaagcucacu

SEQ ID NO: 1473711 - RNA, 15 nt, Homo sapiens
caagaagugguccau

SEQ ID NO: 1473712 - RNA, 18 nt, Homo sapiens
caagaaguuuauucucau

SEQ ID NO: 1473713 - RNA, 13 nt, Homo sapiens
caagaaugaaaca

SEQ ID NO: 1473714 - RNA, 20 nt, Homo sapiens
caagacaagacuauaccuua

SEQ ID NO: 1473715 - RNA, 16 nt, Homo sapiens
caagacaaugagagua

SEQ ID NO: 1473716 - RNA, 13 nt, Homo sapiens
caagacagugaag

SEQ ID NO: 1473717 - RNA, 12 nt, Homo sapiens
caagacuccuca

SEQ ID NO: 1473718 - RNA, 15 nt, Homo sapiens
caagacuuuagcuuu

SEQ ID NO: 1473719 - RNA, 23 nt, Homo sapiens
caagagcugcccuccuuguccac

SEQ ID NO: 1473720 - RNA, 17 nt, Homo sapiens
caagagcuggcaaaggu

SEQ ID NO: 1473721 - RNA, 21 nt, Homo sapiens
caagauacugcuacuguaauu

SEQ ID NO: 1473722 - RNA, 16 nt, Homo sapiens
caagaucuuucaggaa

SEQ ID NO: 1473723 - RNA, 17 nt, Homo sapiens
caagaucuuucaggaaa

SEQ ID NO: 1473724 - RNA, 20 nt, Homo sapiens
caagaugacacaacugcacu

SEQ ID NO: 1473725 - RNA, 12 nt, Homo sapiens
caagauggucca

SEQ ID NO: 1473726 - RNA, 21 nt, Homo sapiens
caagaugugaauuauugacac

SEQ ID NO: 1473727 - RNA, 20 nt, Homo sapiens
caagauugcaccacugcucu

SEQ ID NO: 1473728 - RNA, 22 nt, Homo sapiens
caagauuguaaguaaauugccu

SEQ ID NO: 1473729 - RNA, 23 nt, Homo sapiens
caagcaaaccaauggugauccuc

SEQ ID NO: 1473730 - RNA, 14 nt, Homo sapiens
caagcacaaaaacu

SEQ ID NO: 1473731 - RNA, 20 nt, Homo sapiens
caagcaggaaccccaggaga

SEQ ID NO: 1473732 - RNA, 17 nt, Homo sapiens
caagcagucaguuugca

SEQ ID NO: 1473733 - RNA, 14 nt, Homo sapiens
caagcgacgacaga

SEQ ID NO: 1473734 - RNA, 20 nt, Homo sapiens
caagcgacgacagaugcuaa

SEQ ID NO: 1473735 - RNA, 12 nt, Homo sapiens
caagcuauucaa

SEQ ID NO: 1473736 - RNA, 23 nt, Homo sapiens
caagcugacucgacaccguguca

SEQ ID NO: 1473737 - RNA, 21 nt, Homo sapiens
caagcuguccagagaaaagag

SEQ ID NO: 1473738 - RNA, 20 nt, Homo sapiens
caagcugugacuucuccagg

SEQ ID NO: 1473739 - RNA, 21 nt, Homo sapiens
caagcugugacuucuccaggu

SEQ ID NO: 1473740 - RNA, 21 nt, Homo sapiens
caagcuuuugcuugauccaga

SEQ ID NO: 1473741 - RNA, 13 nt, Homo sapiens
caaggacauugcc

SEQ ID NO: 1473742 - RNA, 16 nt, Homo sapiens
caaggacauugcccca

SEQ ID NO: 1473743 - RNA, 15 nt, Homo sapiens
caaggacucuuccac

SEQ ID NO: 1473744 - RNA, 13 nt, Homo sapiens
caaggacugagca

SEQ ID NO: 1473745 - RNA, 14 nt, Homo sapiens
caaggacuuugcag

SEQ ID NO: 1473746 - RNA, 19 nt, Homo sapiens
caaggaguacaaugcccag

SEQ ID NO: 1473747 - RNA, 17 nt, Homo sapiens
caaggaguacuccaaga

SEQ ID NO: 1473748 - RNA, 19 nt, Homo sapiens
caaggauccucuccacucc

SEQ ID NO: 1473749 - RNA, 13 nt, Homo sapiens
auuguuguugcca

SEQ ID NO: 1473750 - RNA, 18 nt, Homo sapiens
auuguuguugccaaagag

SEQ ID NO: 1473751 - RNA, 21 nt, Homo sapiens
auuguuuugaaacucaguaug

SEQ ID NO: 1473752 - RNA, 14 nt, Homo sapiens
auuuaaaacuugcc

SEQ ID NO: 1473753 - RNA, 15 nt, Homo sapiens
auuuaaaauucaauu

SEQ ID NO: 1473754 - RNA, 19 nt, Homo sapiens
auuuaaagggaaaacccuc

SEQ ID NO: 1473755 - RNA, 15 nt, Homo sapiens
auuuaaauguaacuu

SEQ ID NO: 1473756 - RNA, 22 nt, Homo sapiens
auuuaacacccuuuagaaccuu

SEQ ID NO: 1473757 - RNA, 16 nt, Homo sapiens
auuuaagguacuuaaa

SEQ ID NO: 1473758 - RNA, 18 nt, Homo sapiens
auuuaaguuaucaacuuu

SEQ ID NO: 1473759 - RNA, 16 nt, Homo sapiens
auuuaauuauuuccua

SEQ ID NO: 1473760 - RNA, 22 nt, Homo sapiens
auuuaauuuagugaucuuagca

SEQ ID NO: 1473761 - RNA, 16 nt, Homo sapiens
auuuaauuuccagggu

SEQ ID NO: 1473762 - RNA, 21 nt, Homo sapiens
auuuacagaaaagacucugac

SEQ ID NO: 1473763 - RNA, 20 nt, Homo sapiens
auuuacauacucugcuuaga

SEQ ID NO: 1473764 - RNA, 14 nt, Homo sapiens
auuuacccuuuucc

SEQ ID NO: 1473765 - RNA, 14 nt, Homo sapiens
auuuacuaaaucaa

SEQ ID NO: 1473766 - RNA, 11 nt, Homo sapiens
auuuacuuaac

SEQ ID NO: 1473767 - RNA, 22 nt, Homo sapiens
auuuagaaaauagagcuuuuaa

SEQ ID NO: 1473768 - RNA, 21 nt, Homo sapiens
auuuagcuaaacggauuccaa

SEQ ID NO: 1473769 - RNA, 18 nt, Homo sapiens
auuuagguuuuuauuagu

SEQ ID NO: 1473770 - RNA, 19 nt, Homo sapiens
auuuauaacagcauucuug

SEQ ID NO: 1473771 - RNA, 15 nt, Homo sapiens
auuuauaacucauca

SEQ ID NO: 1473772 - RNA, 13 nt, Homo sapiens
auuuauaauugca

SEQ ID NO: 1473773 - RNA, 16 nt, Homo sapiens
auuuaucauuuaguua

SEQ ID NO: 1473774 - RNA, 23 nt, Homo sapiens
auuuauccaaaauguguauuucu

SEQ ID NO: 1473775 - RNA, 15 nt, Homo sapiens
auuuauuaacaggau

SEQ ID NO: 1473776 - RNA, 19 nt, Homo sapiens
auuuauucacauauaucaa

SEQ ID NO: 1473777 - RNA, 13 nt, Homo sapiens
auuuauugccugg

SEQ ID NO: 1473778 - RNA, 21 nt, Homo sapiens
auuuauugugcuucgagugac

SEQ ID NO: 1473779 - RNA, 13 nt, Homo sapiens
auuucaagaccuc

SEQ ID NO: 1473780 - RNA, 14 nt, Homo sapiens
auuucacaagcuau

SEQ ID NO: 1473781 - RNA, 16 nt, Homo sapiens
auuucacaagcuauuu

SEQ ID NO: 1473782 - RNA, 16 nt, Homo sapiens
auuucaccaccaaaug

SEQ ID NO: 1473783 - RNA, 21 nt, Homo sapiens
auuucaccccacagacacuua

SEQ ID NO: 1473784 - RNA, 12 nt, Homo sapiens
auuucagacucc

SEQ ID NO: 1473785 - RNA, 22 nt, Homo sapiens
auuucagauaaacaacaaauaa

SEQ ID NO: 1473786 - RNA, 12 nt, Homo sapiens
auuucagauauc

SEQ ID NO: 1473787 - RNA, 18 nt, Homo sapiens
auuucagauauuccaggu

SEQ ID NO: 1473788 - RNA, 15 nt, Homo sapiens
auuucagcagggaug

SEQ ID NO: 1473789 - RNA, 14 nt, Homo sapiens
auuucauaccucag

SEQ ID NO: 1473790 - RNA, 12 nt, Homo sapiens
auuucaucucuu

SEQ ID NO: 1473791 - RNA, 20 nt, Homo sapiens
auuucaugauuucauuucaa

SEQ ID NO: 1473792 - RNA, 21 nt, Homo sapiens
auuucaugggacuaaaugaac

SEQ ID NO: 1473793 - RNA, 22 nt, Homo sapiens
auuucaugggacuaaaugaacu

SEQ ID NO: 1473794 - RNA, 21 nt, Homo sapiens
auuuccaaaacuuuaaugaac

SEQ ID NO: 1473795 - RNA, 22 nt, Homo sapiens
auuuccaagaaauauuccuuaa

SEQ ID NO: 1473796 - RNA, 18 nt, Homo sapiens
auuuccaaguaagaguac

SEQ ID NO: 1473797 - RNA, 12 nt, Homo sapiens
auuucccaggac

SEQ ID NO: 1473798 - RNA, 19 nt, Homo sapiens
auuucccaggacccugaag

SEQ ID NO: 1473799 - RNA, 20 nt, Homo sapiens
auuuccuguguguguugccc

SEQ ID NO: 1473800 - RNA, 23 nt, Homo sapiens
auuuccuuaaacuguguggacug

SEQ ID NO: 1473801 - RNA, 21 nt, Homo sapiens
auuuccuuacagaacuacuuc

SEQ ID NO: 1473802 - RNA, 19 nt, Homo sapiens
auuuccuucaaugugcaua

SEQ ID NO: 1473803 - RNA, 23 nt, Homo sapiens
auuuccuuucuacaauuucaauu

SEQ ID NO: 1473804 - RNA, 18 nt, Homo sapiens
auuuccuuuuugacacug

SEQ ID NO: 1473805 - RNA, 19 nt, Homo sapiens
auuuccuuuuugacacuga

SEQ ID NO: 1473806 - RNA, 23 nt, Homo sapiens
auuucuacuucuggaagucaucu

SEQ ID NO: 1473807 - RNA, 16 nt, Homo sapiens
auuucuagaagcacau

SEQ ID NO: 1473808 - RNA, 17 nt, Homo sapiens
auuucuagaagcacaug

SEQ ID NO: 1473809 - RNA, 15 nt, Homo sapiens
auuucuaguccaaaa

SEQ ID NO: 1473810 - RNA, 15 nt, Homo sapiens
auuucuauacaacag

SEQ ID NO: 1473811 - RNA, 19 nt, Homo sapiens
auuucuccucccuuccuuu

SEQ ID NO: 1473812 - RNA, 16 nt, Homo sapiens
auuucucugauuugca

SEQ ID NO: 1473813 - RNA, 17 nt, Homo sapiens
auuucuuaugugacauu

SEQ ID NO: 1473814 - RNA, 15 nt, Homo sapiens
auuucuugcauucau

SEQ ID NO: 1473815 - RNA, 16 nt, Homo sapiens
auuucuuguugcucaa

SEQ ID NO: 1473816 - RNA, 20 nt, Homo sapiens
auuucuuugaucuggacaga

SEQ ID NO: 1473817 - RNA, 11 nt, Homo sapiens
auuucuuugca

SEQ ID NO: 1473818 - RNA, 17 nt, Homo sapiens
auuucuuuucuggccaa

SEQ ID NO: 1473819 - RNA, 23 nt, Homo sapiens
auuugaaaaaaacuucauucucg

SEQ ID NO: 1473820 - RNA, 21 nt, Homo sapiens
auuugaaugugguuacuuccu

SEQ ID NO: 1473821 - RNA, 22 nt, Homo sapiens
auuugaaugugguuacuuccua

SEQ ID NO: 1473822 - RNA, 18 nt, Homo sapiens
auuugacaaaacuaaccu

SEQ ID NO: 1473823 - RNA, 21 nt, Homo sapiens
auuugacugaagaugcagcuc

SEQ ID NO: 1473824 - RNA, 14 nt, Homo sapiens
auuugcaguauuca

SEQ ID NO: 1473825 - RNA, 21 nt, Homo sapiens
auuugcauugaggaaauauua

SEQ ID NO: 1473826 - RNA, 23 nt, Homo sapiens
auuugcauugaggaaauauuaau

SEQ ID NO: 1473827 - RNA, 19 nt, Homo sapiens
auuugcccuuaaggacaaa

SEQ ID NO: 1473828 - RNA, 22 nt, Homo sapiens
auuugcuaaucaaagccagggu

SEQ ID NO: 1473829 - RNA, 15 nt, Homo sapiens
auuugcuagcaguaa

SEQ ID NO: 1473830 - RNA, 15 nt, Homo sapiens
auuugcucuuugaca

SEQ ID NO: 1473831 - RNA, 19 nt, Homo sapiens
auuugcugagcauguacug

SEQ ID NO: 1473832 - RNA, 15 nt, Homo sapiens
auuugcuuuuugcua

SEQ ID NO: 1473833 - RNA, 13 nt, Homo sapiens
auuuggaaauuca

SEQ ID NO: 1473834 - RNA, 15 nt, Homo sapiens
auuuggacucugccu

SEQ ID NO: 1473835 - RNA, 18 nt, Homo sapiens
auuugggagacaugugac

SEQ ID NO: 1473836 - RNA, 15 nt, Homo sapiens
auuuguaaaucugcc

SEQ ID NO: 1473837 - RNA, 21 nt, Homo sapiens
auuuguaauuccuuacuguaa

SEQ ID NO: 1473838 - RNA, 17 nt, Homo sapiens
auuuguaauugaacuua

SEQ ID NO: 1473839 - RNA, 20 nt, Homo sapiens
auuuguaugcucauugaacu

SEQ ID NO: 1473840 - RNA, 20 nt, Homo sapiens
auuugucccuaugcauauca

SEQ ID NO: 1473841 - RNA, 17 nt, Homo sapiens
auuuguuccuggaguuu

SEQ ID NO: 1473842 - RNA, 16 nt, Homo sapiens
auuuguuuaaagaaua

SEQ ID NO: 1473843 - RNA, 18 nt, Homo sapiens
auuuuaaaucauuaggaa

SEQ ID NO: 1473844 - RNA, 14 nt, Homo sapiens
auuuuaaggacugc

SEQ ID NO: 1473845 - RNA, 16 nt, Homo sapiens
auuuuaauacauugau

SEQ ID NO: 1473846 - RNA, 16 nt, Homo sapiens
auuuuagccaugccug

SEQ ID NO: 1473847 - RNA, 15 nt, Homo sapiens
auuuuauaugaagau

SEQ ID NO: 1473848 - RNA, 13 nt, Homo sapiens
auuuuaucauuaa

SEQ ID NO: 1473849 - RNA, 15 nt, Homo sapiens
auuuuaucugugaau

SEQ ID NO: 1473850 - RNA, 23 nt, Homo sapiens
auuuuauuguauaaaaaguuuca

SEQ ID NO: 1473851 - RNA, 20 nt, Homo sapiens
acaccagcagcccugucacg

SEQ ID NO: 1473852 - RNA, 16 nt, Homo sapiens
acacccaauucaaauu

SEQ ID NO: 1473853 - RNA, 16 nt, Homo sapiens
acacccgacuccucaa

SEQ ID NO: 1473854 - RNA, 23 nt, Homo sapiens
acacccuauauuuugcauaguac

SEQ ID NO: 1473855 - RNA, 22 nt, Homo sapiens
acacccuggccugaacugagga

SEQ ID NO: 1473856 - RNA, 13 nt, Homo sapiens
acacccuguacug

SEQ ID NO: 1473857 - RNA, 19 nt, Homo sapiens
acaccguguaaaccaaagc

SEQ ID NO: 1473858 - RNA, 20 nt, Homo sapiens
acaccguguaaaccaaagcc

SEQ ID NO: 1473859 - RNA, 23 nt, Homo sapiens
acaccguguaaaccaaagcccua

SEQ ID NO: 1473860 - RNA, 20 nt, Homo sapiens
acaccuggcccuugcaaucu

SEQ ID NO: 1473861 - RNA, 11 nt, Homo sapiens
acaccuuccag

SEQ ID NO: 1473862 - RNA, 16 nt, Homo sapiens
acacgaccggggccag

SEQ ID NO: 1473863 - RNA, 19 nt, Homo sapiens
acacgcaccugccucagga

SEQ ID NO: 1473864 - RNA, 15 nt, Homo sapiens
acacgcacuggugcc

SEQ ID NO: 1473865 - RNA, 16 nt, Homo sapiens
acacgcugguggugcu

SEQ ID NO: 1473866 - RNA, 22 nt, Homo sapiens
acacggacucccgggccacgcc

SEQ ID NO: 1473867 - RNA, 14 nt, Homo sapiens
acacguuggcucag

SEQ ID NO: 1473868 - RNA, 13 nt, Homo sapiens
uguaauaagcaau

SEQ ID NO: 1473869 - RNA, 16 nt, Homo sapiens
uguaauagugaacaua

SEQ ID NO: 1473870 - RNA, 16 nt, Homo sapiens
uguaaucauuccuucc

SEQ ID NO: 1473871 - RNA, 20 nt, Homo sapiens
uguaaucccaacauuuuggg

SEQ ID NO: 1473872 - RNA, 19 nt, Homo sapiens
uguaaucccagcacuuugg

SEQ ID NO: 1473873 - RNA, 21 nt, Homo sapiens
uguaaucgcccuacuauucag

SEQ ID NO: 1473874 - RNA, 12 nt, Homo sapiens
uguaaucucagc

SEQ ID NO: 1473875 - RNA, 17 nt, Homo sapiens
uguaaucucagcacuuu

SEQ ID NO: 1473876 - RNA, 18 nt, Homo sapiens
uguaaugaaaaugaauau

SEQ ID NO: 1473877 - RNA, 20 nt, Homo sapiens
uguaaugugugguggccuca

SEQ ID NO: 1473878 - RNA, 19 nt, Homo sapiens
uguacagaaaguaucacaa

SEQ ID NO: 1473879 - RNA, 16 nt, Homo sapiens
uguacagaauuuccac

SEQ ID NO: 1473880 - RNA, 15 nt, Homo sapiens
uguacagacauacau

SEQ ID NO: 1473881 - RNA, 11 nt, Homo sapiens
uguacagguac

SEQ ID NO: 1473882 - RNA, 15 nt, Homo sapiens
uguacauugugggau

SEQ ID NO: 1473883 - RNA, 14 nt, Homo sapiens
uguaccauaugauc

SEQ ID NO: 1473884 - RNA, 13 nt, Homo sapiens
uguaccuguguac

SEQ ID NO: 1473885 - RNA, 20 nt, Homo sapiens
uguacuauccaaucugugau

SEQ ID NO: 1473886 - RNA, 19 nt, Homo sapiens
uguacuuuaaaaagaugua

SEQ ID NO: 1473887 - RNA, 15 nt, Homo sapiens
uguagagaaaagcac

SEQ ID NO: 1473888 - RNA, 20 nt, Homo sapiens
uguagagauggggucucaca

SEQ ID NO: 1473889 - RNA, 15 nt, Homo sapiens
uguagauacuagcua

SEQ ID NO: 1473890 - RNA, 20 nt, Homo sapiens
uguagaugggggaacuguga

SEQ ID NO: 1473891 - RNA, 16 nt, Homo sapiens
uguagcaauggcacug

SEQ ID NO: 1473892 - RNA, 13 nt, Homo sapiens
uguagcagugaga

SEQ ID NO: 1473893 - RNA, 10 nt, Homo sapiens
uguagccaug

SEQ ID NO: 1473894 - RNA, 15 nt, Homo sapiens
uguagcguguuuaca

SEQ ID NO: 1473895 - RNA, 14 nt, Homo sapiens
uguagcuaguaaga

SEQ ID NO: 1473896 - RNA, 18 nt, Homo sapiens
uguagcuucuucugaaag

SEQ ID NO: 1473897 - RNA, 21 nt, Homo sapiens
uguaguuuuucuucaacauca

SEQ ID NO: 1473898 - RNA, 19 nt, Homo sapiens
uguauaaaugugauaugau

SEQ ID NO: 1473899 - RNA, 22 nt, Homo sapiens
uguauaagcacugaaaaacaac

SEQ ID NO: 1473900 - RNA, 16 nt, Homo sapiens
uguauacacauauaua

SEQ ID NO: 1473901 - RNA, 16 nt, Homo sapiens
uguauacuguaggcac

SEQ ID NO: 1473902 - RNA, 13 nt, Homo sapiens
uguauauaagcaa

SEQ ID NO: 1473903 - RNA, 15 nt, Homo sapiens
uguauauacauauau

SEQ ID NO: 1473904 - RNA, 17 nt, Homo sapiens
uguauauuuucucuaua

SEQ ID NO: 1473905 - RNA, 18 nt, Homo sapiens
uguaucaaaaucacuauc

SEQ ID NO: 1473906 - RNA, 17 nt, Homo sapiens
uguaucaagucauggca

SEQ ID NO: 1473907 - RNA, 17 nt, Homo sapiens
uguaucggagacaguga

SEQ ID NO: 1473908 - RNA, 19 nt, Homo sapiens
uguaucguaaccagccaga

SEQ ID NO: 1473909 - RNA, 14 nt, Homo sapiens
uguaucuugccuaa

SEQ ID NO: 1473910 - RNA, 16 nt, Homo sapiens
uguaucuuuuuuauaa

SEQ ID NO: 1473911 - RNA, 17 nt, Homo sapiens
uguaugaaaaguaacug

SEQ ID NO: 1473912 - RNA, 12 nt, Homo sapiens
uguaugcacuuu

SEQ ID NO: 1473913 - RNA, 22 nt, Homo sapiens
uguauggaaucccacuguauga

SEQ ID NO: 1473914 - RNA, 18 nt, Homo sapiens
uguauguuccucuaugaa

SEQ ID NO: 1473915 - RNA, 22 nt, Homo sapiens
uguauguuuacauaucaccuca

SEQ ID NO: 1473916 - RNA, 22 nt, Homo sapiens
uguauuauuauuauugcugcca

SEQ ID NO: 1473917 - RNA, 23 nt, Homo sapiens
uguauucacgccauugguuggaa

SEQ ID NO: 1473918 - RNA, 16 nt, Homo sapiens
uguauuguauugccca

SEQ ID NO: 1473919 - RNA, 17 nt, Homo sapiens
uguauuuccagugcaau

SEQ ID NO: 1473920 - RNA, 20 nt, Homo sapiens
uguauuuccagugcaauugu

SEQ ID NO: 1473921 - RNA, 17 nt, Homo sapiens
ugucaaaagccagaugu

SEQ ID NO: 1473922 - RNA, 16 nt, Homo sapiens
ugucaaacagugccaa

SEQ ID NO: 1473923 - RNA, 21 nt, Homo sapiens
ugucaacaccccuguguggau

SEQ ID NO: 1473924 - RNA, 22 nt, Homo sapiens
ugucaacaucaaagagcacauu

SEQ ID NO: 1473925 - RNA, 20 nt, Homo sapiens
ugucaagcugaaaacaaaca

SEQ ID NO: 1473926 - RNA, 18 nt, Homo sapiens
ugucaaugccugucuuag

SEQ ID NO: 1473927 - RNA, 13 nt, Homo sapiens
ugucaaugugaac

SEQ ID NO: 1473928 - RNA, 20 nt, Homo sapiens
ugucaaugugaacguccaca

SEQ ID NO: 1473929 - RNA, 18 nt, Homo sapiens
ugucacaaccucucugau

SEQ ID NO: 1473930 - RNA, 12 nt, Homo sapiens
ugucacacaaaa

SEQ ID NO: 1473931 - RNA, 20 nt, Homo sapiens
ugucacaccagccauacuua

SEQ ID NO: 1473932 - RNA, 17 nt, Homo sapiens
ugucagauuaccaguua

SEQ ID NO: 1473933 - RNA, 16 nt, Homo sapiens
ugucagucacagccac

SEQ ID NO: 1473934 - RNA, 20 nt, Homo sapiens
ugucaguuuuaucuucagaa

SEQ ID NO: 1473935 - RNA, 20 nt, Homo sapiens
ugucauauaguaaacacuca

SEQ ID NO: 1473936 - RNA, 13 nt, Homo sapiens
ugucaucacucaa

SEQ ID NO: 1473937 - RNA, 16 nt, Homo sapiens
ugucauccuuggucuu

SEQ ID NO: 1473938 - RNA, 19 nt, Homo sapiens
ugucaucuuucuuguuuca

SEQ ID NO: 1473939 - RNA, 19 nt, Homo sapiens
ugucauggacuguugccac

SEQ ID NO: 1473940 - RNA, 11 nt, Homo sapiens
uguccaaagag

SEQ ID NO: 1473941 - RNA, 12 nt, Homo sapiens
uguccaaagagg

SEQ ID NO: 1473942 - RNA, 14 nt, Homo sapiens
uguccaacugagaa

SEQ ID NO: 1473943 - RNA, 21 nt, Homo sapiens
uguccacccaccuaugugcca

SEQ ID NO: 1473944 - RNA, 15 nt, Homo sapiens
uguccagcacaccug

SEQ ID NO: 1473945 - RNA, 22 nt, Homo sapiens
uguccagccaagggcugagugu

SEQ ID NO: 1473946 - RNA, 16 nt, Homo sapiens
uguccauuuauaucau

SEQ ID NO: 1473947 - RNA, 15 nt, Homo sapiens
uguccauuugcaaau

SEQ ID NO: 1473948 - RNA, 22 nt, Homo sapiens
ugucccaccccuagccaccagu

SEQ ID NO: 1473949 - RNA, 21 nt, Homo sapiens
uguccccaaaaugugaugcuu

SEQ ID NO: 1473950 - RNA, 15 nt, Homo sapiens
ugucccccuacccac

SEQ ID NO: 1473951 - RNA, 18 nt, Homo sapiens
uguccccuccacugucac

SEQ ID NO: 1473952 - RNA, 19 nt, Homo sapiens
uguccccuccacugucaca

SEQ ID NO: 1473953 - RNA, 20 nt, Homo sapiens
ugucccggggcuccacugaa

SEQ ID NO: 1473954 - RNA, 22 nt, Homo sapiens
ugucccugugggugaaacagaa

SEQ ID NO: 1473955 - RNA, 22 nt, Homo sapiens
ugucccuugccucaaugccagu

SEQ ID NO: 1473956 - RNA, 18 nt, Homo sapiens
uguccucaaaaggaauaa

SEQ ID NO: 1473957 - RNA, 13 nt, Homo sapiens
uguccucagcauu

SEQ ID NO: 1473958 - RNA, 17 nt, Homo sapiens
uguccugagcaccacac

SEQ ID NO: 1473959 - RNA, 16 nt, Homo sapiens
uguccugaucugugau

SEQ ID NO: 1473960 - RNA, 20 nt, Homo sapiens
uguccugaugcuuuugucua

SEQ ID NO: 1473961 - RNA, 17 nt, Homo sapiens
ucauuucagauauucca

SEQ ID NO: 1473962 - RNA, 14 nt, Homo sapiens
ucauuucauuccau

SEQ ID NO: 1473963 - RNA, 15 nt, Homo sapiens
ucauuucuacuguga

SEQ ID NO: 1473964 - RNA, 12 nt, Homo sapiens
ucauuugaacaa

SEQ ID NO: 1473965 - RNA, 21 nt, Homo sapiens
ucauuuguaccucgaguuuua

SEQ ID NO: 1473966 - RNA, 16 nt, Homo sapiens
ucauuuugcauucaaa

SEQ ID NO: 1473967 - RNA, 23 nt, Homo sapiens
ucauuuuuuucacuggaguuaca

SEQ ID NO: 1473968 - RNA, 23 nt, Homo sapiens
uccaaaacuuuaaugaacuaacu

SEQ ID NO: 1473969 - RNA, 19 nt, Homo sapiens
uccaaacucaaacuugaga

SEQ ID NO: 1473970 - RNA, 15 nt, Homo sapiens
uccaaagaacuugau

SEQ ID NO: 1473971 - RNA, 15 nt, Homo sapiens
uccaaagaggcugcc

SEQ ID NO: 1473972 - RNA, 22 nt, Homo sapiens
uccaaagaggcugccccucuca

SEQ ID NO: 1473973 - RNA, 14 nt, Homo sapiens
uccaaagcuuuauu

SEQ ID NO: 1473974 - RNA, 21 nt, Homo sapiens
uccaacaccaagcacagcagc

SEQ ID NO: 1473975 - RNA, 16 nt, Homo sapiens
uccaacacugcugcuc

SEQ ID NO: 1473976 - RNA, 17 nt, Homo sapiens
uccaaccaggagcugau

SEQ ID NO: 1473977 - RNA, 20 nt, Homo sapiens
uccaacccauuuaaucacca

SEQ ID NO: 1473978 - RNA, 22 nt, Homo sapiens
uccaaccugagaaauggccaaa

SEQ ID NO: 1473979 - RNA, 14 nt, Homo sapiens
uccaacucccuuaa

SEQ ID NO: 1473980 - RNA, 15 nt, Homo sapiens
uccaagacagagaca

SEQ ID NO: 1473981 - RNA, 20 nt, Homo sapiens
uccaagcaaaaacaaauggg

SEQ ID NO: 1473982 - RNA, 23 nt, Homo sapiens
uccaagccugaccacgcuuucua

SEQ ID NO: 1473983 - RNA, 19 nt, Homo sapiens
uccaaggauggaccacaca

SEQ ID NO: 1473984 - RNA, 14 nt, Homo sapiens
uccaagggacccuu

SEQ ID NO: 1473985 - RNA, 19 nt, Homo sapiens
uccaagguguaacucuaau

SEQ ID NO: 1473986 - RNA, 17 nt, Homo sapiens
gugcuuacacaucucag

SEQ ID NO: 1473987 - RNA, 19 nt, Homo sapiens
gugcuuggucuguuugacu

SEQ ID NO: 1473988 - RNA, 23 nt, Homo sapiens
guggaauauaaggaaagcaauaa

SEQ ID NO: 1473989 - RNA, 17 nt, Homo sapiens
guggacucagcagugac

SEQ ID NO: 1473990 - RNA, 12 nt, Homo sapiens
guggacugugau

SEQ ID NO: 1473991 - RNA, 20 nt, Homo sapiens
guggagaacugggauuugaa

SEQ ID NO: 1473992 - RNA, 17 nt, Homo sapiens
guggagacugauggcca

SEQ ID NO: 1473993 - RNA, 13 nt, Homo sapiens
guggaggcacuuu

SEQ ID NO: 1473994 - RNA, 21 nt, Homo sapiens
guggauauuaaaaaucuguaa

SEQ ID NO: 1473995 - RNA, 19 nt, Homo sapiens
guggaucuugccacauuuc

SEQ ID NO: 1473996 - RNA, 20 nt, Homo sapiens
guggauuaaagugcccagca

SEQ ID NO: 1473997 - RNA, 21 nt, Homo sapiens
guggauucuucccacacagaa

SEQ ID NO: 1473998 - RNA, 13 nt, Homo sapiens
guggcacaggagu

SEQ ID NO: 1473999 - RNA, 16 nt, Homo sapiens
guggcagacaucggcc

SEQ ID NO: 1474000 - RNA, 20 nt, Homo sapiens
guggcaugaucauagcucac

SEQ ID NO: 1474001 - RNA, 18 nt, Homo sapiens
guggcccaagggugguga

SEQ ID NO: 1474002 - RNA, 19 nt, Homo sapiens
guggcccagggaagccaaa

SEQ ID NO: 1474003 - RNA, 20 nt, Homo sapiens
guggccccaccgagcuggag

SEQ ID NO: 1474004 - RNA, 14 nt, Homo sapiens
guggcccucuggau

SEQ ID NO: 1474005 - RNA, 19 nt, Homo sapiens
guggccuaggcuaccucaa

SEQ ID NO: 1474006 - RNA, 19 nt, Homo sapiens
guggccucagcccucagaa

SEQ ID NO: 1474007 - RNA, 20 nt, Homo sapiens
guggccugccuucaccccac

SEQ ID NO: 1474008 - RNA, 22 nt, Homo sapiens
guggcgagaaauaaaguuugcu

SEQ ID NO: 1474009 - RNA, 22 nt, Homo sapiens
guggcguuguugcauguuugaa

SEQ ID NO: 1474010 - RNA, 20 nt, Homo sapiens
guggcugccccggccuccuc

SEQ ID NO: 1474011 - RNA, 14 nt, Homo sapiens
guggcugugccacc

SEQ ID NO: 1474012 - RNA, 15 nt, Homo sapiens
gugggagaaggacua

SEQ ID NO: 1474013 - RNA, 15 nt, Homo sapiens
gugggagaucuucac

SEQ ID NO: 1474014 - RNA, 15 nt, Homo sapiens
guucugagcaccgug

SEQ ID NO: 1474015 - RNA, 18 nt, Homo sapiens
guucuggaccugggcaug

SEQ ID NO: 1474016 - RNA, 20 nt, Homo sapiens
guucugggcucuuuccucug

SEQ ID NO: 1474017 - RNA, 12 nt, Homo sapiens
guucugugcaca

SEQ ID NO: 1474018 - RNA, 14 nt, Homo sapiens
guucugugcacaaa

SEQ ID NO: 1474019 - RNA, 21 nt, Homo sapiens
guucuguucacccugcauuac

SEQ ID NO: 1474020 - RNA, 16 nt, Homo sapiens
guucuuagugucacuu

SEQ ID NO: 1474021 - RNA, 17 nt, Homo sapiens
guucuuaguuugcaguu

SEQ ID NO: 1474022 - RNA, 22 nt, Homo sapiens
guucuucuuucucuguauuccg

SEQ ID NO: 1474023 - RNA, 12 nt, Homo sapiens
guucuugggaua

SEQ ID NO: 1474024 - RNA, 22 nt, Homo sapiens
guucuuggugaugcuggcagcc

SEQ ID NO: 1474025 - RNA, 13 nt, Homo sapiens
guugaacuuugcc

SEQ ID NO: 1474026 - RNA, 16 nt, Homo sapiens
guugaauuucccacau

SEQ ID NO: 1474027 - RNA, 15 nt, Homo sapiens
guugaggcugucaca

SEQ ID NO: 1474028 - RNA, 19 nt, Homo sapiens
guugaucuggaacccagac

SEQ ID NO: 1474029 - RNA, 22 nt, Homo sapiens
guugauggaaaauaaacaucag

SEQ ID NO: 1474030 - RNA, 20 nt, Homo sapiens
guugcaaauacauggauaac

SEQ ID NO: 1474031 - RNA, 18 nt, Homo sapiens
guugcagugaauucauau

SEQ ID NO: 1474032 - RNA, 11 nt, Homo sapiens
guugcagugag

SEQ ID NO: 1474033 - RNA, 15 nt, Homo sapiens
guugcauuccuuugu

SEQ ID NO: 1474034 - RNA, 17 nt, Homo sapiens
guugcauuuagcuucuu

SEQ ID NO: 1474035 - RNA, 21 nt, Homo sapiens
guugccaaagagaaacaaaaa

SEQ ID NO: 1474036 - RNA, 20 nt, Homo sapiens
guugccccacucaucugccg

SEQ ID NO: 1474037 - RNA, 22 nt, Homo sapiens
guugcccuagcccagacucuga

SEQ ID NO: 1474038 - RNA, 16 nt, Homo sapiens
guugcuauaauaaaga

SEQ ID NO: 1474039 - RNA, 19 nt, Homo sapiens
guuggaaccguguccagca

SEQ ID NO: 1474040 - RNA, 14 nt, Homo sapiens
guuggcacaugccu

SEQ ID NO: 1474041 - RNA, 23 nt, Homo sapiens
guugggggcaguguuguggcccu

SEQ ID NO: 1474042 - RNA, 18 nt, Homo sapiens
guuguagaaauuaacaaa

SEQ ID NO: 1474043 - RNA, 14 nt, Homo sapiens
guuguagaagacaa

SEQ ID NO: 1474044 - RNA, 22 nt, Homo sapiens
guuguauaauuucgagauuugu

SEQ ID NO: 1474045 - RNA, 14 nt, Homo sapiens
guugucauugcugu

SEQ ID NO: 1474046 - RNA, 21 nt, Homo sapiens
guuguuuauauacaguacaca

SEQ ID NO: 1474047 - RNA, 16 nt, Homo sapiens
guuuaaaaauacaugu

SEQ ID NO: 1474048 - RNA, 15 nt, Homo sapiens
guuuaaaacagaagc

SEQ ID NO: 1474049 - RNA, 17 nt, Homo sapiens
guuuaaaacaguauuua

SEQ ID NO: 1474050 - RNA, 17 nt, Homo sapiens
guuuaacauuuccucag

SEQ ID NO: 1474051 - RNA, 14 nt, Homo sapiens
guuuacaacuugau

SEQ ID NO: 1474052 - RNA, 22 nt, Homo sapiens
guuuacaggcccugcuccugca

SEQ ID NO: 1474053 - RNA, 14 nt, Homo sapiens
guuuaccacuaacu

SEQ ID NO: 1474054 - RNA, 21 nt, Homo sapiens
guuuacuucucaccauuugag

SEQ ID NO: 1474055 - RNA, 17 nt, Homo sapiens
guuuaggaauccuuugg

SEQ ID NO: 1474056 - RNA, 17 nt, Homo sapiens
guuuaguugcagacuca

SEQ ID NO: 1474057 - RNA, 14 nt, Homo sapiens
guuuaucacacagu

SEQ ID NO: 1474058 - RNA, 16 nt, Homo sapiens
guuuaugcugugcuaa

SEQ ID NO: 1474059 - RNA, 20 nt, Homo sapiens
guuuauguaagagcaccuuc

SEQ ID NO: 1474060 - RNA, 20 nt, Homo sapiens
guuuauuuuuauacuuucag

SEQ ID NO: 1474061 - RNA, 17 nt, Homo sapiens
guuucaccguguuagcc

SEQ ID NO: 1474062 - RNA, 15 nt, Homo sapiens
guuucccuuccucca

SEQ ID NO: 1474063 - RNA, 12 nt, Homo sapiens
guuuccugaaac

SEQ ID NO: 1474064 - RNA, 20 nt, Homo sapiens
guuucuagcuagaaauauga

SEQ ID NO: 1474065 - RNA, 16 nt, Homo sapiens
guuucuccaaguacuu

SEQ ID NO: 1474066 - RNA, 19 nt, Homo sapiens
guuucuccuuaguuggcug

SEQ ID NO: 1474067 - RNA, 16 nt, Homo sapiens
guuucuuagcuuuuua

SEQ ID NO: 1474068 - RNA, 11 nt, Homo sapiens
guuucuuccaa

SEQ ID NO: 1474069 - RNA, 18 nt, Homo sapiens
guuugaaaauaugccugc

SEQ ID NO: 1474070 - RNA, 23 nt, Homo sapiens
guuugaucccuguuacccagaga

SEQ ID NO: 1474071 - RNA, 21 nt, Homo sapiens
guuugcuauugacaagucauu

SEQ ID NO: 1474072 - RNA, 17 nt, Homo sapiens
guuugcuuauuguucca

SEQ ID NO: 1474073 - RNA, 22 nt, Homo sapiens
guuugggaauauccauguacuu

SEQ ID NO: 1474074 - RNA, 23 nt, Homo sapiens
guuuguucccugugucauuucaa

SEQ ID NO: 1474075 - RNA, 16 nt, Homo sapiens
guuuguuucauauaua

SEQ ID NO: 1474076 - RNA, 17 nt, Homo sapiens
guuuuaaaaaaucucaa

SEQ ID NO: 1474077 - RNA, 22 nt, Homo sapiens
guuuuaauccuuaacacauuca

SEQ ID NO: 1474078 - RNA, 23 nt, Homo sapiens
guuuuaauccuuaacacauucaa

SEQ ID NO: 1474079 - RNA, 21 nt, Homo sapiens
guuuuagcggucaauuugccu

SEQ ID NO: 1474080 - RNA, 17 nt, Homo sapiens
guuuuaggguacaguuu

SEQ ID NO: 1474081 - RNA, 18 nt, Homo sapiens
guuuuauaaguucacaaa

SEQ ID NO: 1474082 - RNA, 19 nt, Homo sapiens
guuuuauuuucaaaucugg

SEQ ID NO: 1474083 - RNA, 19 nt, Homo sapiens
guuuucaagucaaauuaau

SEQ ID NO: 1474084 - RNA, 21 nt, Homo sapiens
guuuucccugaccucccucua

SEQ ID NO: 1474085 - RNA, 17 nt, Homo sapiens
guuuuccuaaaugcagu

SEQ ID NO: 1474086 - RNA, 20 nt, Homo sapiens
guuuugaaggcaaaauugca

SEQ ID NO: 1474087 - RNA, 19 nt, Homo sapiens
uuuuauauucuaagccagu

SEQ ID NO: 1474088 - RNA, 18 nt, Homo sapiens
uuuuauauuuauugugcu

SEQ ID NO: 1474089 - RNA, 20 nt, Homo sapiens
uuuuauccuagucauucuuc

SEQ ID NO: 1474090 - RNA, 23 nt, Homo sapiens
uuuuauguguggcccaagacaau

SEQ ID NO: 1474091 - RNA, 18 nt, Homo sapiens
uuuuauuaauuuauaugu

SEQ ID NO: 1474092 - RNA, 23 nt, Homo sapiens
uuuucauugcccgaaaccagagc

SEQ ID NO: 1474093 - RNA, 12 nt, Homo sapiens
uuuucauuugag

SEQ ID NO: 1474094 - RNA, 14 nt, Homo sapiens
uuuucuaagcaauu

SEQ ID NO: 1474095 - RNA, 12 nt, Homo sapiens
uuuucuacugua

SEQ ID NO: 1474096 - RNA, 16 nt, Homo sapiens
uuuucuauuauggaaa

SEQ ID NO: 1474097 - RNA, 22 nt, Homo sapiens
uuuucucuggaaugguacaugu

SEQ ID NO: 1474098 - RNA, 16 nt, Homo sapiens
uuuucucugugcuuca

SEQ ID NO: 1474099 - RNA, 22 nt, Homo sapiens
uuuucugcuaaaaaguccuuga

SEQ ID NO: 1474100 - RNA, 21 nt, Homo sapiens
uuuucuggccaaaagcaguaa

SEQ ID NO: 1474101 - RNA, 22 nt, Homo sapiens
uuuucuuacuagaccuguaacu

SEQ ID NO: 1474102 - RNA, 18 nt, Homo sapiens
uuuucuuauuuaacuuaa

SEQ ID NO: 1474103 - RNA, 15 nt, Homo sapiens
uuuucuugccaauga

SEQ ID NO: 1474104 - RNA, 22 nt, Homo sapiens
uuuucuuuuaagcuauccacag

SEQ ID NO: 1474105 - RNA, 14 nt, Homo sapiens
uuuugaaggcaaaa

SEQ ID NO: 1474106 - RNA, 22 nt, Homo sapiens
uuuugcacauaacaugcuuuag

SEQ ID NO: 1474107 - RNA, 21 nt, Homo sapiens
uuuugccaguauuaugcauau

SEQ ID NO: 1474108 - RNA, 18 nt, Homo sapiens
uuuugggaagaauccagu

SEQ ID NO: 1474109 - RNA, 16 nt, Homo sapiens
uuuuguaaauguaucu

SEQ ID NO: 1474110 - RNA, 17 nt, Homo sapiens
uuuuguaagaaggcaau

SEQ ID NO: 1474111 - RNA, 20 nt, Homo sapiens
uuuuguauuguuuucugaca

SEQ ID NO: 1474112 - RNA, 22 nt, Homo sapiens
uuuuguccuaaaacaccuggua

SEQ ID NO: 1474113 - RNA, 18 nt, Homo sapiens
uuuugucuagaccuauua

SEQ ID NO: 1474114 - RNA, 21 nt, Homo sapiens
uuuugucugcuuaguaucuca

SEQ ID NO: 1474115 - RNA, 22 nt, Homo sapiens
uuuugucugcuuaguaucucau

SEQ ID NO: 1474116 - RNA, 17 nt, Homo sapiens
uuuuuaauuuaguguga

SEQ ID NO: 1474117 - RNA, 19 nt, Homo sapiens
uuuuuaguagagauggggu

SEQ ID NO: 1474118 - RNA, 20 nt, Homo sapiens
uuuuuauaucaugcaaaaua

SEQ ID NO: 1474119 - RNA, 11 nt, Homo sapiens
uuuuucaauuu

SEQ ID NO: 1474120 - RNA, 15 nt, Homo sapiens
uuuuucuuuuuccac

SEQ ID NO: 1474121 - RNA, 21 nt, Homo sapiens
uuuuugaaaaaaguacauauu

SEQ ID NO: 1474122 - RNA, 21 nt, Homo sapiens
uuuuuggcuacacacaaacca

SEQ ID NO: 1474123 - RNA, 12 nt, Homo sapiens
uuuuugugucaa

SEQ ID NO: 1474124 - RNA, 21 nt, Homo sapiens
uuuuuguuucuuccaaagcac

SEQ ID NO: 1474125 - RNA, 19 nt, Homo sapiens
uuuuuuaaauaaaagcagc

SEQ ID NO: 1474126 - RNA, 21 nt, Homo sapiens
uuuuuuguauagaccaaagca

SEQ ID NO: 1474127 - RNA, 15 nt, Homo sapiens
ucccaacacuuugag

SEQ ID NO: 1474128 - RNA, 14 nt, Homo sapiens
ucccaacccauuca

SEQ ID NO: 1474129 - RNA, 22 nt, Homo sapiens
ucccaacccauucacuacaggu

SEQ ID NO: 1474130 - RNA, 15 nt, Homo sapiens
ucccaaccccaggaa

SEQ ID NO: 1474131 - RNA, 22 nt, Homo sapiens
ucccaaccccaguggauucuca

SEQ ID NO: 1474132 - RNA, 20 nt, Homo sapiens
ucccaagguccucucaguuc

SEQ ID NO: 1474133 - RNA, 23 nt, Homo sapiens
ucccaagguucugggugcaggag

SEQ ID NO: 1474134 - RNA, 20 nt, Homo sapiens
ucccaaguaacugggauuac

SEQ ID NO: 1474135 - RNA, 20 nt, Homo sapiens
ucccaaguagcugagacuac

SEQ ID NO: 1474136 - RNA, 20 nt, Homo sapiens
ucccaaguagcugggauuac

SEQ ID NO: 1474137 - RNA, 22 nt, Homo sapiens
ucccaauuucagacucccauuc

SEQ ID NO: 1474138 - RNA, 16 nt, Homo sapiens
ucccacaggcccuucc

SEQ ID NO: 1474139 - RNA, 17 nt, Homo sapiens
ucccacccccaucucuc

SEQ ID NO: 1474140 - RNA, 14 nt, Homo sapiens
ucccaccccuacac

SEQ ID NO: 1474141 - RNA, 14 nt, Homo sapiens
ucccacgaggaauc

SEQ ID NO: 1474142 - RNA, 16 nt, Homo sapiens
ucccacgugucuucca

SEQ ID NO: 1474143 - RNA, 11 nt, Homo sapiens
ucccacuccag

SEQ ID NO: 1474144 - RNA, 15 nt, Homo sapiens
ucccagaaguggcua

SEQ ID NO: 1474145 - RNA, 15 nt, Homo sapiens
ucccagaucagucag

SEQ ID NO: 1474146 - RNA, 16 nt, Homo sapiens
ucccagaugggccacg

SEQ ID NO: 1474147 - RNA, 21 nt, Homo sapiens
ucccagauguuggaccaacac

SEQ ID NO: 1474148 - RNA, 15 nt, Homo sapiens
ucccagcuacucggg

SEQ ID NO: 1474149 - RNA, 23 nt, Homo sapiens
ucccagggcuggcucugcacuaa

SEQ ID NO: 1474150 - RNA, 12 nt, Homo sapiens
ucccagucccau

SEQ ID NO: 1474151 - RNA, 16 nt, Homo sapiens
ucccagucugugaagu

SEQ ID NO: 1474152 - RNA, 15 nt, Homo sapiens
uggauucucauugcc

SEQ ID NO: 1474153 - RNA, 12 nt, Homo sapiens
uggauugagggu

SEQ ID NO: 1474154 - RNA, 15 nt, Homo sapiens
uggauugcacguggc

SEQ ID NO: 1474155 - RNA, 17 nt, Homo sapiens
uggauuguuacagcuuc

SEQ ID NO: 1474156 - RNA, 15 nt, Homo sapiens
uggauuuaguuucag

SEQ ID NO: 1474157 - RNA, 17 nt, Homo sapiens
uggauuugccugugcca

SEQ ID NO: 1474158 - RNA, 18 nt, Homo sapiens
uggcaaaaaggagccuuu

SEQ ID NO: 1474159 - RNA, 23 nt, Homo sapiens
uggcaacagaucuggaaccucag

SEQ ID NO: 1474160 - RNA, 13 nt, Homo sapiens
uggcaacaggaca

SEQ ID NO: 1474161 - RNA, 20 nt, Homo sapiens
uggcaagucuuccaugaccc

SEQ ID NO: 1474162 - RNA, 11 nt, Homo sapiens
uggcaccugca

SEQ ID NO: 1474163 - RNA, 16 nt, Homo sapiens
uggcacugacugggca

SEQ ID NO: 1474164 - RNA, 17 nt, Homo sapiens
uggcacuggaugcagaa

SEQ ID NO: 1474165 - RNA, 12 nt, Homo sapiens
uggcacuuugaa

SEQ ID NO: 1474166 - RNA, 23 nt, Homo sapiens
uggcagacaucggccuccaugac

SEQ ID NO: 1474167 - RNA, 20 nt, Homo sapiens
uggcagaccgugaccaucuu

SEQ ID NO: 1474168 - RNA, 12 nt, Homo sapiens
uggcagagccag

SEQ ID NO: 1474169 - RNA, 23 nt, Homo sapiens
uggcagaugcaguagacugcagu

SEQ ID NO: 1474170 - RNA, 16 nt, Homo sapiens
uggcagccgugccuuc

SEQ ID NO: 1474171 - RNA, 16 nt, Homo sapiens
uggcagcggguggcau

SEQ ID NO: 1474172 - RNA, 20 nt, Homo sapiens
uggcagcuguuucucaugaa

SEQ ID NO: 1474173 - RNA, 14 nt, Homo sapiens
uggcaggaccagga

SEQ ID NO: 1474174 - RNA, 12 nt, Homo sapiens
uggcaguugcau

SEQ ID NO: 1474175 - RNA, 23 nt, Homo sapiens
uggcaucaaacagggcaaagugu

SEQ ID NO: 1474176 - RNA, 14 nt, Homo sapiens
uggccaaaagcuag

SEQ ID NO: 1474177 - RNA, 20 nt, Homo sapiens
uggccacaguaauuggucau

SEQ ID NO: 1474178 - RNA, 21 nt, Homo sapiens
uggccacccgcccacagccag

SEQ ID NO: 1474179 - RNA, 15 nt, Homo sapiens
uggccagcacucuga

SEQ ID NO: 1474180 - RNA, 17 nt, Homo sapiens
uggccagccagugccau

SEQ ID NO: 1474181 - RNA, 18 nt, Homo sapiens
uggccaggcuggucucaa

SEQ ID NO: 1474182 - RNA, 19 nt, Homo sapiens
uggccaggcuggucucaaa

SEQ ID NO: 1474183 - RNA, 13 nt, Homo sapiens
uggccaguucauu

SEQ ID NO: 1474184 - RNA, 17 nt, Homo sapiens
uggccaugggucccauu

SEQ ID NO: 1474185 - RNA, 13 nt, Homo sapiens
uggcccuaaagga

SEQ ID NO: 1474186 - RNA, 14 nt, Homo sapiens
uggcccuucuugcc

SEQ ID NO: 1474187 - RNA, 22 nt, Homo sapiens
uggcccuuuccuuccagauccu

SEQ ID NO: 1474188 - RNA, 13 nt, Homo sapiens
uggccuacaguca

SEQ ID NO: 1474189 - RNA, 16 nt, Homo sapiens
uggccuauccgcugcc

SEQ ID NO: 1474190 - RNA, 23 nt, Homo sapiens
uggccucacccaccccugcacag

SEQ ID NO: 1474191 - RNA, 15 nt, Homo sapiens
uggccuccuaugccu

SEQ ID NO: 1474192 - RNA, 14 nt, Homo sapiens
uggccucugcugaa

SEQ ID NO: 1474193 - RNA, 23 nt, Homo sapiens
uggccucugcugaaugcagggaa

SEQ ID NO: 1474194 - RNA, 16 nt, Homo sapiens
uggccucuggcucuca

SEQ ID NO: 1474195 - RNA, 15 nt, Homo sapiens
uggccugcccgugcc

SEQ ID NO: 1474196 - RNA, 19 nt, Homo sapiens
uggccugcugugauuccac

SEQ ID NO: 1474197 - RNA, 21 nt, Homo sapiens
uggccugcugugauuccacua

SEQ ID NO: 1474198 - RNA, 21 nt, Homo sapiens
uggcgcuuagagaggacaaua

SEQ ID NO: 1474199 - RNA, 22 nt, Homo sapiens
uggcuaacuauauuugcuuuuu

SEQ ID NO: 1474200 - RNA, 21 nt, Homo sapiens
uggcuacacacaaaccaguau

SEQ ID NO: 1474201 - RNA, 17 nt, Homo sapiens
uggcuacugacuacccu

SEQ ID NO: 1474202 - RNA, 13 nt, Homo sapiens
uggcuaugcaaca

SEQ ID NO: 1474203 - RNA, 23 nt, Homo sapiens
uggcucacugcaagcucugccuc

SEQ ID NO: 1474204 - RNA, 21 nt, Homo sapiens
uggcucaugccuguaaucuca

SEQ ID NO: 1474205 - RNA, 15 nt, Homo sapiens
uggcuccaacacugc

SEQ ID NO: 1474206 - RNA, 20 nt, Homo sapiens
uggcuccaacacugcugcuc

SEQ ID NO: 1474207 - RNA, 12 nt, Homo sapiens
uggcucccaagu

SEQ ID NO: 1474208 - RNA, 15 nt, Homo sapiens
uggcucucagaaggu

SEQ ID NO: 1474209 - RNA, 21 nt, Homo sapiens
uggcugcuuugccucuaccag

SEQ ID NO: 1474210 - RNA, 17 nt, Homo sapiens
uggcuguguuugcagcc

SEQ ID NO: 1474211 - RNA, 19 nt, Homo sapiens
uggcuuauaaacacauuga

SEQ ID NO: 1474212 - RNA, 16 nt, Homo sapiens
uggcuugacaugugca

SEQ ID NO: 1474213 - RNA, 16 nt, Homo sapiens
uggcuuggguucacag

SEQ ID NO: 1474214 - RNA, 20 nt, Homo sapiens
uggcuuggguucacagugca

SEQ ID NO: 1474215 - RNA, 14 nt, Homo sapiens
uggcuuucccagga

SEQ ID NO: 1474216 - RNA, 18 nt, Homo sapiens
ugggaaaaaaacuuggca

SEQ ID NO: 1474217 - RNA, 15 nt, Homo sapiens
ugggaaaaccagacu

SEQ ID NO: 1474218 - RNA, 15 nt, Homo sapiens
ugggaagacuauggu

SEQ ID NO: 1474219 - RNA, 21 nt, Homo sapiens
ugggaagauaggcucugcaca

SEQ ID NO: 1474220 - RNA, 16 nt, Homo sapiens
ugggaagccgugcucg

SEQ ID NO: 1474221 - RNA, 23 nt, Homo sapiens
ugggaauacaggggugaaagggg

SEQ ID NO: 1474222 - RNA, 21 nt, Homo sapiens
ugggaauagggagacagggua

SEQ ID NO: 1474223 - RNA, 20 nt, Homo sapiens
ugggaauguauuauucugca

SEQ ID NO: 1474224 - RNA, 19 nt, Homo sapiens
ugggaauuuggagugacca

SEQ ID NO: 1474225 - RNA, 13 nt, Homo sapiens
ugggaccaggaua

SEQ ID NO: 1474226 - RNA, 15 nt, Homo sapiens
ugggacguggcucag

SEQ ID NO: 1474227 - RNA, 18 nt, Homo sapiens
ugggagaaggacuaucaa

SEQ ID NO: 1474228 - RNA, 15 nt, Homo sapiens
ugggagaaggcagug

SEQ ID NO: 1474229 - RNA, 18 nt, Homo sapiens
ugggagacugaagacuca

SEQ ID NO: 1474230 - RNA, 15 nt, Homo sapiens
ugggagacuggaaaa

SEQ ID NO: 1474231 - RNA, 20 nt, Homo sapiens
ugggagauucaagggaccca

SEQ ID NO: 1474232 - RNA, 22 nt, Homo sapiens
ugggagccaguccuccacucga

SEQ ID NO: 1474233 - RNA, 20 nt, Homo sapiens
ugggagcccccaccacaaac

SEQ ID NO: 1474234 - RNA, 18 nt, Homo sapiens
ugggaggagggagaggga

SEQ ID NO: 1474235 - RNA, 17 nt, Homo sapiens
ugggaggcuguggagcc

SEQ ID NO: 1474236 - RNA, 15 nt, Homo sapiens
ugggaggucuugcua

SEQ ID NO: 1474237 - RNA, 16 nt, Homo sapiens
ugggaggucuugcuag

SEQ ID NO: 1474238 - RNA, 16 nt, Homo sapiens
ugggagguggaagaag

SEQ ID NO: 1474239 - RNA, 23 nt, Homo sapiens
ugggaguccauggugucaugcca

SEQ ID NO: 1474240 - RNA, 18 nt, Homo sapiens
ugggagucugaggccuga

SEQ ID NO: 1474241 - RNA, 12 nt, Homo sapiens
ugggaguguccu

SEQ ID NO: 1474242 - RNA, 15 nt, Homo sapiens
ugggcagagcugcau

SEQ ID NO: 1474243 - RNA, 18 nt, Homo sapiens
ugggcagagcugcaucau

SEQ ID NO: 1474244 - RNA, 18 nt, Homo sapiens
ugggcagcauagcaagac

SEQ ID NO: 1474245 - RNA, 18 nt, Homo sapiens
ugggcagggugacccuga

SEQ ID NO: 1474246 - RNA, 13 nt, Homo sapiens
ugggcaugccacc

SEQ ID NO: 1474247 - RNA, 12 nt, Homo sapiens
ugggcaugugau

SEQ ID NO: 1474248 - RNA, 17 nt, Homo sapiens
ugggccauguccaaaga

SEQ ID NO: 1474249 - RNA, 18 nt, Homo sapiens
ugggccccucaacagcca

SEQ ID NO: 1474250 - RNA, 16 nt, Homo sapiens
ugggccgcacuggggc

SEQ ID NO: 1474251 - RNA, 15 nt, Homo sapiens
ugggcugggcaguau

SEQ ID NO: 1474252 - RNA, 15 nt, Homo sapiens
ugggcugucugucac

SEQ ID NO: 1474253 - RNA, 16 nt, Homo sapiens
ugggcuugaaacauua

SEQ ID NO: 1474254 - RNA, 14 nt, Homo sapiens
ugggcuugauucug

SEQ ID NO: 1474255 - RNA, 15 nt, Homo sapiens
ugggcuuuggagcug

SEQ ID NO: 1474256 - RNA, 20 nt, Homo sapiens
uggggaaacagaugccucag

SEQ ID NO: 1474257 - RNA, 18 nt, Homo sapiens
uggggaacagagcaagac

SEQ ID NO: 1474258 - RNA, 16 nt, Homo sapiens
uggggaaggguuugaa

SEQ ID NO: 1474259 - RNA, 19 nt, Homo sapiens
uggggaccccaaccucaga

SEQ ID NO: 1474260 - RNA, 16 nt, Homo sapiens
uggggaggagggggcc

SEQ ID NO: 1474261 - RNA, 14 nt, Homo sapiens
uggggagguggagu

SEQ ID NO: 1474262 - RNA, 19 nt, Homo sapiens
uggggaguaggacauacca

SEQ ID NO: 1474263 - RNA, 17 nt, Homo sapiens
uggggaugguccacugu

SEQ ID NO: 1474264 - RNA, 18 nt, Homo sapiens
uggggccuccagaacuca

SEQ ID NO: 1474265 - RNA, 22 nt, Homo sapiens
uggggcuggccucccaaaugag

SEQ ID NO: 1474266 - RNA, 15 nt, Homo sapiens
uggggcuggccugca

SEQ ID NO: 1474267 - RNA, 18 nt, Homo sapiens
ugggggacgugggcauuu

SEQ ID NO: 1474268 - RNA, 19 nt, Homo sapiens
ugggggagguccaagcaga

SEQ ID NO: 1474269 - RNA, 18 nt, Homo sapiens
ugggggccaggacaccag

SEQ ID NO: 1474270 - RNA, 13 nt, Homo sapiens
ugggggucagggg

SEQ ID NO: 1474271 - RNA, 15 nt, Homo sapiens
ugggguaacaucugu

SEQ ID NO: 1474272 - RNA, 21 nt, Homo sapiens
ugggguauuuaccacagcagc

SEQ ID NO: 1474273 - RNA, 13 nt, Homo sapiens
uggggucaggaac

SEQ ID NO: 1474274 - RNA, 21 nt, Homo sapiens
uggguacugaaagccuuaggg

SEQ ID NO: 1474275 - RNA, 16 nt, Homo sapiens
uggguagaugugcaau

SEQ ID NO: 1474276 - RNA, 22 nt, Homo sapiens
ugggucaaagugcggcugccau

SEQ ID NO: 1474277 - RNA, 16 nt, Homo sapiens
ugggucacauccaucc

SEQ ID NO: 1474278 - RNA, 23 nt, Homo sapiens
ugggucucauuuagaacuugcag

SEQ ID NO: 1474279 - RNA, 13 nt, Homo sapiens
ugggugacauuug

SEQ ID NO: 1474280 - RNA, 10 nt, Homo sapiens
ugggugcugc

SEQ ID NO: 1474281 - RNA, 20 nt, Homo sapiens
uggguuuugggucuuugaac

SEQ ID NO: 1474282 - RNA, 15 nt, Homo sapiens
ugguaaauuaguauu

SEQ ID NO: 1474283 - RNA, 17 nt, Homo sapiens
ugguaaauuaguauuua

SEQ ID NO: 1474284 - RNA, 22 nt, Homo sapiens
ugguaacugcuuucuguuccaa

SEQ ID NO: 1474285 - RNA, 21 nt, Homo sapiens
ugguaauauaguuauugcaca

SEQ ID NO: 1474286 - RNA, 18 nt, Homo sapiens
ugguaauauugacuugua

SEQ ID NO: 1474287 - RNA, 20 nt, Homo sapiens
ugguaaucauaugugucuuu

SEQ ID NO: 1474288 - RNA, 18 nt, Homo sapiens
ugguacuuuuaugaugua

SEQ ID NO: 1474289 - RNA, 22 nt, Homo sapiens
ugguagaacguaaccacggaaa

SEQ ID NO: 1474290 - RNA, 20 nt, Homo sapiens
ugguauauucagucucugug

SEQ ID NO: 1474291 - RNA, 21 nt, Homo sapiens
ugguaucacugaacuacuaaa

SEQ ID NO: 1474292 - RNA, 19 nt, Homo sapiens
ugguauccugugacaugua

SEQ ID NO: 1474293 - RNA, 15 nt, Homo sapiens
ugguaugaccaguga

SEQ ID NO: 1474294 - RNA, 18 nt, Homo sapiens
ugguauuauauaauucaa

SEQ ID NO: 1474295 - RNA, 23 nt, Homo sapiens
uggucacaugaugugcauagaga

SEQ ID NO: 1474296 - RNA, 16 nt, Homo sapiens
uggucagaugcagguu

SEQ ID NO: 1474297 - RNA, 19 nt, Homo sapiens
uggucagguuauacuccuc

SEQ ID NO: 1474298 - RNA, 13 nt, Homo sapiens
ugguccagcucuu

SEQ ID NO: 1474299 - RNA, 14 nt, Homo sapiens
ugguccaugcccac

SEQ ID NO: 1474300 - RNA, 22 nt, Homo sapiens
uggucccugccuuaggccuacc

SEQ ID NO: 1474301 - RNA, 14 nt, Homo sapiens
ugguccgaucuuug

SEQ ID NO: 1474302 - RNA, 19 nt, Homo sapiens
ugguccuggggaccauuca

SEQ ID NO: 1474303 - RNA, 18 nt, Homo sapiens
uggucucauguaacacau

SEQ ID NO: 1474304 - RNA, 18 nt, Homo sapiens
uggucuugagaugucuuc

SEQ ID NO: 1474305 - RNA, 17 nt, Homo sapiens
uggucuugaucuccuga

SEQ ID NO: 1474306 - RNA, 22 nt, Homo sapiens
uggucuuuguaagaguguagaa

SEQ ID NO: 1474307 - RNA, 14 nt, Homo sapiens
uggugaauuucaca

SEQ ID NO: 1474308 - RNA, 18 nt, Homo sapiens
uggugacaccucaccuca

SEQ ID NO: 1474309 - RNA, 13 nt, Homo sapiens
uggugacugagau

SEQ ID NO: 1474310 - RNA, 12 nt, Homo sapiens
uggugacugucc

SEQ ID NO: 1474311 - RNA, 23 nt, Homo sapiens
uggugagacccugucucuacuaa

SEQ ID NO: 1474312 - RNA, 14 nt, Homo sapiens
uggugaggcaauaa

SEQ ID NO: 1474313 - RNA, 17 nt, Homo sapiens
uggugccaaacaaaaag

SEQ ID NO: 1474314 - RNA, 20 nt, Homo sapiens
uggugcgcccugucucugug

SEQ ID NO: 1474315 - RNA, 23 nt, Homo sapiens
ugguggaguggagugagagcaau

SEQ ID NO: 1474316 - RNA, 16 nt, Homo sapiens
ugguggaucuguccaa

SEQ ID NO: 1474317 - RNA, 19 nt, Homo sapiens
ugguggcagauuuuacaaa

SEQ ID NO: 1474318 - RNA, 22 nt, Homo sapiens
ugguguaaagccaacacccugu

SEQ ID NO: 1474319 - RNA, 21 nt, Homo sapiens
uggugucccgguaccuuccau

SEQ ID NO: 1474320 - RNA, 13 nt, Homo sapiens
uggugugaccuga

SEQ ID NO: 1474321 - RNA, 16 nt, Homo sapiens
ugguguggguguccug

SEQ ID NO: 1474322 - RNA, 15 nt, Homo sapiens
ugguuaacaucucag

SEQ ID NO: 1474323 - RNA, 19 nt, Homo sapiens
ugguuaacgccuucauuua

SEQ ID NO: 1474324 - RNA, 14 nt, Homo sapiens
ugguuauauaguca

SEQ ID NO: 1474325 - RNA, 22 nt, Homo sapiens
ugguucaauuucagaaguaaug

SEQ ID NO: 1474326 - RNA, 12 nt, Homo sapiens
ugguucucucca

SEQ ID NO: 1474327 - RNA, 14 nt, Homo sapiens
ugguugacauugua

SEQ ID NO: 1474328 - RNA, 22 nt, Homo sapiens
ugguuggccgugguccagcucu

SEQ ID NO: 1474329 - RNA, 16 nt, Homo sapiens
ugguuguaauaugcga

SEQ ID NO: 1474330 - RNA, 22 nt, Homo sapiens
uguaaaaaaaaaugccuuugag

SEQ ID NO: 1474331 - RNA, 23 nt, Homo sapiens
uguaaaaugucuguuaacuuaau

SEQ ID NO: 1474332 - RNA, 14 nt, Homo sapiens
uguaaauaugaauc

SEQ ID NO: 1474333 - RNA, 11 nt, Homo sapiens
uaaaugugcag

SEQ ID NO: 1474334 - RNA, 14 nt, Homo sapiens
uaaaugugcuuaug

SEQ ID NO: 1474335 - RNA, 16 nt, Homo sapiens
uaaauuauggcauuuu

SEQ ID NO: 1474336 - RNA, 11 nt, Homo sapiens
uaaauucauuu

SEQ ID NO: 1474337 - RNA, 22 nt, Homo sapiens
uaaauuccacacuaccacauua

SEQ ID NO: 1474338 - RNA, 23 nt, Homo sapiens
uaaauucuauaggaacauaugaa

SEQ ID NO: 1474339 - RNA, 11 nt, Homo sapiens
uaaauucugug

SEQ ID NO: 1474340 - RNA, 13 nt, Homo sapiens
uaaauugcucugu

SEQ ID NO: 1474341 - RNA, 14 nt, Homo sapiens
uaaauuguguuucc

SEQ ID NO: 1474342 - RNA, 13 nt, Homo sapiens
uaaauuuauuuca

SEQ ID NO: 1474343 - RNA, 18 nt, Homo sapiens
uaaauuucuuaugugaca

SEQ ID NO: 1474344 - RNA, 15 nt, Homo sapiens
uaacaaaauccucag

SEQ ID NO: 1474345 - RNA, 18 nt, Homo sapiens
uaacaaauaaagugcagu

SEQ ID NO: 1474346 - RNA, 19 nt, Homo sapiens
uaacaacaauaacacuguc

SEQ ID NO: 1474347 - RNA, 14 nt, Homo sapiens
uaacaacucuaguc

SEQ ID NO: 1474348 - RNA, 21 nt, Homo sapiens
uaacaauaacuacuguguucc

SEQ ID NO: 1474349 - RNA, 13 nt, Homo sapiens
uaacaauugugua

SEQ ID NO: 1474350 - RNA, 18 nt, Homo sapiens
uaacaauuguguagccuu

SEQ ID NO: 1474351 - RNA, 19 nt, Homo sapiens
uaacacagagagacagacu

SEQ ID NO: 1474352 - RNA, 16 nt, Homo sapiens
uaacacagcugaacua

SEQ ID NO: 1474353 - RNA, 12 nt, Homo sapiens
uaacacauucaa

SEQ ID NO: 1474354 - RNA, 14 nt, Homo sapiens
uaacacauucaaua

SEQ ID NO: 1474355 - RNA, 14 nt, Homo sapiens
uaacacggugcuca

SEQ ID NO: 1474356 - RNA, 20 nt, Homo sapiens
uaacacuggcuucaggcaaa

SEQ ID NO: 1474357 - RNA, 10 nt, Homo sapiens
uaacagaauu

SEQ ID NO: 1474358 - RNA, 23 nt, Homo sapiens
uaacagaccacuguauguuuacu

SEQ ID NO: 1474359 - RNA, 20 nt, Homo sapiens
uaacagaugcaaugugcuac

SEQ ID NO: 1474360 - RNA, 22 nt, Homo sapiens
uaacagauggaaaaacugaggc

SEQ ID NO: 1474361 - RNA, 20 nt, Homo sapiens
uaacaggugcgguuccucau

SEQ ID NO: 1474362 - RNA, 15 nt, Homo sapiens
uaacagucauuuaaa

SEQ ID NO: 1474363 - RNA, 12 nt, Homo sapiens
uaacaugcuuua

SEQ ID NO: 1474364 - RNA, 13 nt, Homo sapiens
uaacauguuauca

SEQ ID NO: 1474365 - RNA, 13 nt, Homo sapiens
uaacauuaccuua

SEQ ID NO: 1474366 - RNA, 22 nt, Homo sapiens
uaacauuaccuuacuguggagg

SEQ ID NO: 1474367 - RNA, 15 nt, Homo sapiens
uaacauucaguuccc

SEQ ID NO: 1474368 - RNA, 17 nt, Homo sapiens
uaacauuuccuuacaga

SEQ ID NO: 1474369 - RNA, 21 nt, Homo sapiens
uaaccaaguuuauucaguaaa

SEQ ID NO: 1474370 - RNA, 23 nt, Homo sapiens
uaacccaugaaggauaaaagccc

SEQ ID NO: 1474371 - RNA, 15 nt, Homo sapiens
uaaccccaccuugcc

SEQ ID NO: 1474372 - RNA, 16 nt, Homo sapiens
uaaccgcacaugcaca

SEQ ID NO: 1474373 - RNA, 16 nt, Homo sapiens
uaaccuagaaguauuu

SEQ ID NO: 1474374 - RNA, 14 nt, Homo sapiens
uaacgacuucaggg

SEQ ID NO: 1474375 - RNA, 21 nt, Homo sapiens
uaacuaaaagguaugcaauca

SEQ ID NO: 1474376 - RNA, 12 nt, Homo sapiens
uaacuacugugu

SEQ ID NO: 1474377 - RNA, 14 nt, Homo sapiens
uaacuauauuugcu

SEQ ID NO: 1474378 - RNA, 15 nt, Homo sapiens
uaacuaugacagaua

SEQ ID NO: 1474379 - RNA, 20 nt, Homo sapiens
uaacuguaugggagcuuaac

SEQ ID NO: 1474380 - RNA, 14 nt, Homo sapiens
uaacugugaaguuu

SEQ ID NO: 1474381 - RNA, 20 nt, Homo sapiens
uaacuguuaacuaugacaga

SEQ ID NO: 1474382 - RNA, 16 nt, Homo sapiens
uaacuuagguggcaag

SEQ ID NO: 1474383 - RNA, 21 nt, Homo sapiens
uaacuuauauugaagacaauu

SEQ ID NO: 1474384 - RNA, 18 nt, Homo sapiens
uaacuuauuuuauuucca

SEQ ID NO: 1474385 - RNA, 19 nt, Homo sapiens
uaacuuuggaaacaaaaau

SEQ ID NO: 1474386 - RNA, 14 nt, Homo sapiens
uaagaaaacuaaga

SEQ ID NO: 1474387 - RNA, 20 nt, Homo sapiens
uaagaaauaaauuuauuuca

SEQ ID NO: 1474388 - RNA, 20 nt, Homo sapiens
uaagaagcaaauaaauauca

SEQ ID NO: 1474389 - RNA, 14 nt, Homo sapiens
uaagaauagaaaua

SEQ ID NO: 1474390 - RNA, 22 nt, Homo sapiens
uaagaaucuuuagagaaguaua

SEQ ID NO: 1474391 - RNA, 17 nt, Homo sapiens
uaagaauuucacaagcu

SEQ ID NO: 1474392 - RNA, 21 nt, Homo sapiens
uaagacauacuccuuccauca

SEQ ID NO: 1474393 - RNA, 16 nt, Homo sapiens
uaagacauaucucuaa

SEQ ID NO: 1474394 - RNA, 17 nt, Homo sapiens
uaagaccauaacagcca

SEQ ID NO: 1474395 - RNA, 18 nt, Homo sapiens
uaagaccauaacagccaa

SEQ ID NO: 1474396 - RNA, 13 nt, Homo sapiens
uaagaccuggcag

SEQ ID NO: 1474397 - RNA, 14 nt, Homo sapiens
uaagagacacucca

SEQ ID NO: 1474398 - RNA, 15 nt, Homo sapiens
uaagagacacuccaa

SEQ ID NO: 1474399 - RNA, 17 nt, Homo sapiens
uaagaguaaaauuccuc

SEQ ID NO: 1474400 - RNA, 17 nt, Homo sapiens
uaagagucauccagcuc

SEQ ID NO: 1474401 - RNA, 22 nt, Homo sapiens
uaagagugccguaacaacugug

SEQ ID NO: 1474402 - RNA, 13 nt, Homo sapiens
uaagaguuacuua

SEQ ID NO: 1474403 - RNA, 19 nt, Homo sapiens
uaagauauuaacugagaag

SEQ ID NO: 1474404 - RNA, 19 nt, Homo sapiens
uaagauauucagaaguaua

SEQ ID NO: 1474405 - RNA, 13 nt, Homo sapiens
gcugaguggcgca

SEQ ID NO: 1474406 - RNA, 22 nt, Homo sapiens
gcugaguguuucacaccuuauc

SEQ ID NO: 1474407 - RNA, 14 nt, Homo sapiens
gcugauccaugaga

SEQ ID NO: 1474408 - RNA, 15 nt, Homo sapiens
gcugcaccacuucca

SEQ ID NO: 1474409 - RNA, 19 nt, Homo sapiens
gcugcaccacuuccagggu

SEQ ID NO: 1474410 - RNA, 17 nt, Homo sapiens
gcugcagagcaccuuug

SEQ ID NO: 1474411 - RNA, 14 nt, Homo sapiens
gcugcagucaucua

SEQ ID NO: 1474412 - RNA, 13 nt, Homo sapiens
gcugccaaggaaa

SEQ ID NO: 1474413 - RNA, 16 nt, Homo sapiens
gcugccagccacuuca

SEQ ID NO: 1474414 - RNA, 24 nt, Homo sapiens
gcugccauuucccuucuggacacu

SEQ ID NO: 1474415 - RNA, 15 nt, Homo sapiens
gcugccucacuuccu

SEQ ID NO: 1474416 - RNA, 17 nt, Homo sapiens
gcugccuuggcucagac

SEQ ID NO: 1474417 - RNA, 16 nt, Homo sapiens
gcugcuccagugcagg

SEQ ID NO: 1474418 - RNA, 14 nt, Homo sapiens
gcugcugcugcacc

SEQ ID NO: 1474419 - RNA, 18 nt, Homo sapiens
gcugcugcugcacccaac

SEQ ID NO: 1474420 - RNA, 15 nt, Homo sapiens
gcugcugcugcucca

SEQ ID NO: 1474421 - RNA, 19 nt, Homo sapiens
gcugcuuucuguugucauu

SEQ ID NO: 1474422 - RNA, 18 nt, Homo sapiens
gcuggaagucuccaugaa

SEQ ID NO: 1474423 - RNA, 23 nt, Homo sapiens
gcuggaauuacaaaacucagaga

SEQ ID NO: 1474424 - RNA, 16 nt, Homo sapiens
gaacugugcauagugc

SEQ ID NO: 1474425 - RNA, 23 nt, Homo sapiens
gaacugugcauagugcugggaug

SEQ ID NO: 1474426 - RNA, 12 nt, Homo sapiens
gaacugugccac

SEQ ID NO: 1474427 - RNA, 23 nt, Homo sapiens
gaacuguuuuguaagugcugcua

SEQ ID NO: 1474428 - RNA, 17 nt, Homo sapiens
gaacuuaauaacugugu

SEQ ID NO: 1474429 - RNA, 22 nt, Homo sapiens
gaacuugcgaguccaaggccag

SEQ ID NO: 1474430 - RNA, 20 nt, Homo sapiens
gaacuugcugcugagugcac

SEQ ID NO: 1474431 - RNA, 20 nt, Homo sapiens
gaacuuuggagagugagcua

SEQ ID NO: 1474432 - RNA, 21 nt, Homo sapiens
gaacuuuguggucgacaucaa

SEQ ID NO: 1474433 - RNA, 21 nt, Homo sapiens
gaacuuuuuuagaaaugcaaa

SEQ ID NO: 1474434 - RNA, 22 nt, Homo sapiens
gaagaacagauaaucccuguau

SEQ ID NO: 1474435 - RNA, 13 nt, Homo sapiens
gaagaacuacagc

SEQ ID NO: 1474436 - RNA, 19 nt, Homo sapiens
gaagaagaucaacgccuca

SEQ ID NO: 1474437 - RNA, 23 nt, Homo sapiens
gaagaaugaucagcaucugugau

SEQ ID NO: 1474438 - RNA, 23 nt, Homo sapiens
gaagaauugaccuugaccauuaa

SEQ ID NO: 1474439 - RNA, 22 nt, Homo sapiens
gaagacacacucagcaaccaca

SEQ ID NO: 1474440 - RNA, 17 nt, Homo sapiens
gaagacccgcucuccau

SEQ ID NO: 1474441 - RNA, 13 nt, Homo sapiens
gaagaccuggacc

SEQ ID NO: 1474442 - RNA, 21 nt, Homo sapiens
gaagacuauggugcugccuug

SEQ ID NO: 1474443 - RNA, 14 nt, Homo sapiens
gaagagcuauggcc

SEQ ID NO: 1474444 - RNA, 13 nt, Homo sapiens
gaagagcuugugu

SEQ ID NO: 1474445 - RNA, 15 nt, Homo sapiens
gaagaggcugcugag

SEQ ID NO: 1474446 - RNA, 13 nt, Homo sapiens
gaagauagaucca

SEQ ID NO: 1474447 - RNA, 21 nt, Homo sapiens
gaagauagaugcacuuaugca

SEQ ID NO: 1474448 - RNA, 13 nt, Homo sapiens
gaagaugugaagg

SEQ ID NO: 1474449 - RNA, 16 nt, Homo sapiens
gaagauuagaaacuac

SEQ ID NO: 1474450 - RNA, 17 nt, Homo sapiens
gaagcaaauaaauauca

SEQ ID NO: 1474451 - RNA, 23 nt, Homo sapiens
gaagcaaaucagaaacuugugaa

SEQ ID NO: 1474452 - RNA, 18 nt, Homo sapiens
gaagcaaguuuucuucca

SEQ ID NO: 1474453 - RNA, 19 nt, Homo sapiens
gaagcagagagguggagaa

SEQ ID NO: 1474454 - RNA, 16 nt, Homo sapiens
gaagcagcagaccucc

SEQ ID NO: 1474455 - RNA, 16 nt, Homo sapiens
gaagcagccucagagu

SEQ ID NO: 1474456 - RNA, 17 nt, Homo sapiens
gaagcagucuugcucug

SEQ ID NO: 1474457 - RNA, 16 nt, Homo sapiens
gaagcaguuucagaga

SEQ ID NO: 1474458 - RNA, 14 nt, Homo sapiens
gaagcauacaaagc

SEQ ID NO: 1474459 - RNA, 19 nt, Homo sapiens
gaagcauacaaagcaguuu

SEQ ID NO: 1474460 - RNA, 21 nt, Homo sapiens
gaagcaucacauaaaaaugau

SEQ ID NO: 1474461 - RNA, 15 nt, Homo sapiens
gaagccagagcccca

SEQ ID NO: 1474462 - RNA, 18 nt, Homo sapiens
gaagcccccagcccuaau

SEQ ID NO: 1474463 - RNA, 16 nt, Homo sapiens
gaagccucuggcuaga

SEQ ID NO: 1474464 - RNA, 17 nt, Homo sapiens
gaagccugaugcugaca

SEQ ID NO: 1474465 - RNA, 22 nt, Homo sapiens
gaagcuccugggggaugcucua

SEQ ID NO: 1474466 - RNA, 16 nt, Homo sapiens
gaagcuguucucagga

SEQ ID NO: 1474467 - RNA, 13 nt, Homo sapiens
gaaggaaaugaca

SEQ ID NO: 1474468 - RNA, 23 nt, Homo sapiens
gaaggaacauggagcugucauca

SEQ ID NO: 1474469 - RNA, 20 nt, Homo sapiens
gaaggaacucuggcuuccag

SEQ ID NO: 1474470 - RNA, 17 nt, Homo sapiens
gaaggacacuagccugu

SEQ ID NO: 1474471 - RNA, 21 nt, Homo sapiens
gaaggacacuagccugugcac

SEQ ID NO: 1474472 - RNA, 12 nt, Homo sapiens
gaaggacuauca

SEQ ID NO: 1474473 - RNA, 15 nt, Homo sapiens
gaaggauaaaagccc

SEQ ID NO: 1474474 - RNA, 13 nt, Homo sapiens
gaaggaugaauga

SEQ ID NO: 1474475 - RNA, 12 nt, Homo sapiens
gaaggcaaaauu

SEQ ID NO: 1474476 - RNA, 19 nt, Homo sapiens
gaaggcaagagggggugga

SEQ ID NO: 1474477 - RNA, 13 nt, Homo sapiens
gaaggcagccgcc

SEQ ID NO: 1474478 - RNA, 17 nt, Homo sapiens
gaaggccgaggucccau

SEQ ID NO: 1474479 - RNA, 18 nt, Homo sapiens
gaaggccgggcgcagugg

SEQ ID NO: 1474480 - RNA, 14 nt, Homo sapiens
gaaggcuucugugu

SEQ ID NO: 1474481 - RNA, 19 nt, Homo sapiens
gaaggcuucugugucaaug

SEQ ID NO: 1474482 - RNA, 21 nt, Homo sapiens
gaaggguuuugcuacauucua

SEQ ID NO: 1474483 - RNA, 22 nt, Homo sapiens
gaagguagcccagcacugugaa

SEQ ID NO: 1474484 - RNA, 23 nt, Homo sapiens
gaagguagcccagcacugugaag

SEQ ID NO: 1474485 - RNA, 15 nt, Homo sapiens
gaaggucccucagac

SEQ ID NO: 1474486 - RNA, 23 nt, Homo sapiens
gaagguuggcccccacgugggga

SEQ ID NO: 1474487 - RNA, 20 nt, Homo sapiens
gaaguaaaagcaaguacucu

SEQ ID NO: 1474488 - RNA, 20 nt, Homo sapiens
gaaguauuuuccuccaggca

SEQ ID NO: 1474489 - RNA, 21 nt, Homo sapiens
gaaguauuuuccuccaggcaa

SEQ ID NO: 1474490 - RNA, 18 nt, Homo sapiens
gaaguauuuucuaguucu

SEQ ID NO: 1474491 - RNA, 22 nt, Homo sapiens
gaagucaccccuuucuguccca

SEQ ID NO: 1474492 - RNA, 16 nt, Homo sapiens
gaagucaucucauucc

SEQ ID NO: 1474493 - RNA, 20 nt, Homo sapiens
gaagucaucucauuccacug

SEQ ID NO: 1474494 - RNA, 22 nt, Homo sapiens
gaagucgggcaugguggcucau

SEQ ID NO: 1474495 - RNA, 15 nt, Homo sapiens
gaagucuccaugaag

SEQ ID NO: 1474496 - RNA, 22 nt, Homo sapiens
gaagucuuuucugucaccaaau

SEQ ID NO: 1474497 - RNA, 17 nt, Homo sapiens
gaagugcauccaaaggu

SEQ ID NO: 1474498 - RNA, 15 nt, Homo sapiens
gaagugcgugaaugu

SEQ ID NO: 1474499 - RNA, 22 nt, Homo sapiens
gaagugcgugguauaaucucca

SEQ ID NO: 1474500 - RNA, 16 nt, Homo sapiens
gaagugguccaucucc

SEQ ID NO: 1474501 - RNA, 16 nt, Homo sapiens
gaagugguucuauguc

SEQ ID NO: 1474502 - RNA, 15 nt, Homo sapiens
gaaguuacuuuguaa

SEQ ID NO: 1474503 - RNA, 19 nt, Homo sapiens
gaaguuccaguguucucuc

SEQ ID NO: 1474504 - RNA, 20 nt, Homo sapiens
gaaguugcagugagcugaua

SEQ ID NO: 1474505 - RNA, 21 nt, Homo sapiens
gaaguuuaaaacaguauuuau

SEQ ID NO: 1474506 - RNA, 21 nt, Homo sapiens
gaaguuuacauuuuuauuuau

SEQ ID NO: 1474507 - RNA, 19 nt, Homo sapiens
gaaguuuauucucauuugg

SEQ ID NO: 1474508 - RNA, 22 nt, Homo sapiens
gaauaaaacuuuucugcugaua

SEQ ID NO: 1474509 - RNA, 19 nt, Homo sapiens
gaauaaacuagacucugaa

SEQ ID NO: 1474510 - RNA, 12 nt, Homo sapiens
gcgcaccuguag

SEQ ID NO: 1474511 - RNA, 21 nt, Homo sapiens
gcgccugccaucaugccugac

SEQ ID NO: 1474512 - RNA, 20 nt, Homo sapiens
gcgccugcugccugcugaga

SEQ ID NO: 1474513 - RNA, 18 nt, Homo sapiens
gcgccuugcugauggcuu

SEQ ID NO: 1474514 - RNA, 14 nt, Homo sapiens
gcgcgcgugcacac

SEQ ID NO: 1474515 - RNA, 19 nt, Homo sapiens
gcggaaggucccucagaca

SEQ ID NO: 1474516 - RNA, 15 nt, Homo sapiens
gcggagaguacagug

SEQ ID NO: 1474517 - RNA, 21 nt, Homo sapiens
gcggccucgugccaugaucug

SEQ ID NO: 1474518 - RNA, 17 nt, Homo sapiens
gcggcuggaaucaguca

SEQ ID NO: 1474519 - RNA, 13 nt, Homo sapiens
gcgggacugcugg

SEQ ID NO: 1474520 - RNA, 15 nt, Homo sapiens
gcgggugauggccag

SEQ ID NO: 1474521 - RNA, 16 nt, Homo sapiens
gcgucacggccaagug

SEQ ID NO: 1474522 - RNA, 15 nt, Homo sapiens
gcguccucugacccc

SEQ ID NO: 1474523 - RNA, 14 nt, Homo sapiens
gcgucuaugcugcu

SEQ ID NO: 1474524 - RNA, 19 nt, Homo sapiens
gcgugcucccgaugcugcu

SEQ ID NO: 1474525 - RNA, 19 nt, Homo sapiens
gcguguguagaguuaagaa

SEQ ID NO: 1474526 - RNA, 20 nt, Homo sapiens
gcuaaaauuagaugaacuca

SEQ ID NO: 1474527 - RNA, 20 nt, Homo sapiens
gcuaaauuuggguacugggu

SEQ ID NO: 1474528 - RNA, 13 nt, Homo sapiens
acauugagguucc

SEQ ID NO: 1474529 - RNA, 17 nt, Homo sapiens
acauuggaaugccuugg

SEQ ID NO: 1474530 - RNA, 19 nt, Homo sapiens
acauuuaaagcauugcugu

SEQ ID NO: 1474531 - RNA, 22 nt, Homo sapiens
acauuuaauacagcagugucau

SEQ ID NO: 1474532 - RNA, 17 nt, Homo sapiens
acauuuaugcacauuca

SEQ ID NO: 1474533 - RNA, 18 nt, Homo sapiens
acauuucucauaccuucc

SEQ ID NO: 1474534 - RNA, 22 nt, Homo sapiens
acauuucucauaccuuccccac

SEQ ID NO: 1474535 - RNA, 13 nt, Homo sapiens
acauuugggagac

SEQ ID NO: 1474536 - RNA, 19 nt, Homo sapiens
acauuugggagacauguga

SEQ ID NO: 1474537 - RNA, 20 nt, Homo sapiens
acauuugggagacaugugac

SEQ ID NO: 1474538 - RNA, 23 nt, Homo sapiens
acauuuuggaaacaacauauuac

SEQ ID NO: 1474539 - RNA, 16 nt, Homo sapiens
accaaaaccacagugc

SEQ ID NO: 1474540 - RNA, 16 nt, Homo sapiens
accaaagagggcuucc

SEQ ID NO: 1474541 - RNA, 17 nt, Homo sapiens
accaaaucagcugcuac

SEQ ID NO: 1474542 - RNA, 17 nt, Homo sapiens
accaaaucugacauauu

SEQ ID NO: 1474543 - RNA, 12 nt, Homo sapiens
accaaccacagc

SEQ ID NO: 1474544 - RNA, 22 nt, Homo sapiens
cuuugaucccugacaucuggaa

SEQ ID NO: 1474545 - RNA, 18 nt, Homo sapiens
cuuugauuuuauaugcua

SEQ ID NO: 1474546 - RNA, 11 nt, Homo sapiens
cuuugcacuga

SEQ ID NO: 1474547 - RNA, 12 nt, Homo sapiens
cuuugccucaag

SEQ ID NO: 1474548 - RNA, 19 nt, Homo sapiens
cuuugccucuucuuugugc

SEQ ID NO: 1474549 - RNA, 12 nt, Homo sapiens
cuuugcuaaaau

SEQ ID NO: 1474550 - RNA, 16 nt, Homo sapiens
cuuuggaaauacacag

SEQ ID NO: 1474551 - RNA, 15 nt, Homo sapiens
cuuuggcgaccuccu

SEQ ID NO: 1474552 - RNA, 19 nt, Homo sapiens
cuuuggcuggaauuacaaa

SEQ ID NO: 1474553 - RNA, 18 nt, Homo sapiens
cuuugggauucuuuccau

SEQ ID NO: 1474554 - RNA, 21 nt, Homo sapiens
cuuugggauugcuaugaauga

SEQ ID NO: 1474555 - RNA, 21 nt, Homo sapiens
cuuugggccagacaugccaca

SEQ ID NO: 1474556 - RNA, 22 nt, Homo sapiens
cuuuggggagcaggaggccaau

SEQ ID NO: 1474557 - RNA, 11 nt, Homo sapiens
cuuuggugggg

SEQ ID NO: 1474558 - RNA, 20 nt, Homo sapiens
cuuuguaauaucuaaaaacu

SEQ ID NO: 1474559 - RNA, 14 nt, Homo sapiens
cuuuguagcuacuu

SEQ ID NO: 1474560 - RNA, 11 nt, Homo sapiens
cuuugucacaa

SEQ ID NO: 1474561 - RNA, 13 nt, Homo sapiens
cuuugugcugcgc

SEQ ID NO: 1474562 - RNA, 15 nt, Homo sapiens
cuuugugguagcuua

SEQ ID NO: 1474563 - RNA, 18 nt, Homo sapiens
cuuuguggucgacaucaa

SEQ ID NO: 1474564 - RNA, 21 nt, Homo sapiens
cuuuguguagaaagccaaaua

SEQ ID NO: 1474565 - RNA, 14 nt, Homo sapiens
cuuuguguuugcuu

SEQ ID NO: 1474566 - RNA, 20 nt, Homo sapiens
cuuuguuuggauguaauuua

SEQ ID NO: 1474567 - RNA, 22 nt, Homo sapiens
cuuuuaaaaauucaaaugauuu

SEQ ID NO: 1474568 - RNA, 16 nt, Homo sapiens
cuuuuaacugccaaga

SEQ ID NO: 1474569 - RNA, 15 nt, Homo sapiens
cuuuuaaggcuaaaa

SEQ ID NO: 1474570 - RNA, 23 nt, Homo sapiens
cuuuuacaaaaaaguaaccugaa

SEQ ID NO: 1474571 - RNA, 19 nt, Homo sapiens
cuuuuaucuuggacugaca

SEQ ID NO: 1474572 - RNA, 12 nt, Homo sapiens
cuuuuauuacau

SEQ ID NO: 1474573 - RNA, 17 nt, Homo sapiens
cuuuuauugacacagaa

SEQ ID NO: 1474574 - RNA, 19 nt, Homo sapiens
cuuuucaaaauauuacuca

SEQ ID NO: 1474575 - RNA, 23 nt, Homo sapiens
cuuuucacugcuggcugccuuag

SEQ ID NO: 1474576 - RNA, 20 nt, Homo sapiens
cuuuucagaagcaagccaga

SEQ ID NO: 1474577 - RNA, 22 nt, Homo sapiens
cuuuucaggguuuucugaggga

SEQ ID NO: 1474578 - RNA, 12 nt, Homo sapiens
cuuuucauuuaa

SEQ ID NO: 1474579 - RNA, 16 nt, Homo sapiens
cuuuuccucaccagga

SEQ ID NO: 1474580 - RNA, 19 nt, Homo sapiens
cuuuuccugauaaagcaca

SEQ ID NO: 1474581 - RNA, 16 nt, Homo sapiens
cuuuuccuuucugcca

SEQ ID NO: 1474582 - RNA, 15 nt, Homo sapiens
cuuuucuagccuauu

SEQ ID NO: 1474583 - RNA, 24 nt, Homo sapiens
cuuuucuagccuauuuaccugcag

SEQ ID NO: 1474584 - RNA, 14 nt, Homo sapiens
cuuuucucaggacc

SEQ ID NO: 1474585 - RNA, 16 nt, Homo sapiens
cuuuucugaucugcag

SEQ ID NO: 1474586 - RNA, 19 nt, Homo sapiens
cuuuucuggaauguaauca

SEQ ID NO: 1474587 - RNA, 14 nt, Homo sapiens
cuuuucuuggcaaa

SEQ ID NO: 1474588 - RNA, 16 nt, Homo sapiens
cuuuugaaaagcuuuu

SEQ ID NO: 1474589 - RNA, 16 nt, Homo sapiens
cuuuugaaguaauccc

SEQ ID NO: 1474590 - RNA, 12 nt, Homo sapiens
cuuuugaagucc

SEQ ID NO: 1474591 - RNA, 13 nt, Homo sapiens
cuuuugagcauau

SEQ ID NO: 1474592 - RNA, 20 nt, Homo sapiens
cuuuugaggggcugacuuca

SEQ ID NO: 1474593 - RNA, 16 nt, Homo sapiens
cuuuugauuuuagcca

SEQ ID NO: 1474594 - RNA, 19 nt, Homo sapiens
cuuuugauuuuagccaugc

SEQ ID NO: 1474595 - RNA, 17 nt, Homo sapiens
cuuuugcaacuuaauac

SEQ ID NO: 1474596 - RNA, 19 nt, Homo sapiens
cuuuugccaguauuaugca

SEQ ID NO: 1474597 - RNA, 20 nt, Homo sapiens
cuuuugcuugaaaccaaaga

SEQ ID NO: 1474598 - RNA, 21 nt, Homo sapiens
cuuuugguuuaaaaaguuuca

SEQ ID NO: 1474599 - RNA, 20 nt, Homo sapiens
cuuuuguaaaaaugucccca

SEQ ID NO: 1474600 - RNA, 21 nt, Homo sapiens
cuuuugucuaauuaaaacacu

SEQ ID NO: 1474601 - RNA, 18 nt, Homo sapiens
cuuuugugcuaucaauga

SEQ ID NO: 1474602 - RNA, 16 nt, Homo sapiens
cuuuugugugaugcgc

SEQ ID NO: 1474603 - RNA, 17 nt, Homo sapiens
cuuuuuaaccugcaaaa

SEQ ID NO: 1474604 - RNA, 20 nt, Homo sapiens
cuuuuuaauauugauaugcu

SEQ ID NO: 1474605 - RNA, 21 nt, Homo sapiens
cuuuuuacauaacugccuuga

SEQ ID NO: 1474606 - RNA, 13 nt, Homo sapiens
cuuuuuaugcauu

SEQ ID NO: 1474607 - RNA, 12 nt, Homo sapiens
cuuuuuccucug

SEQ ID NO: 1474608 - RNA, 19 nt, Homo sapiens
cuuuuucuuuacaaacaaa

SEQ ID NO: 1474609 - RNA, 13 nt, Homo sapiens
cuuuuucuuugaa

SEQ ID NO: 1474610 - RNA, 15 nt, Homo sapiens
cuuuuugacacugaa

SEQ ID NO: 1474611 - RNA, 16 nt, Homo sapiens
cuuuuugcaugcuuau

SEQ ID NO: 1474612 - RNA, 15 nt, Homo sapiens
cuuuuugccuuacaa

SEQ ID NO: 1474613 - RNA, 21 nt, Homo sapiens
cuuuuuggcugacuucaucug

SEQ ID NO: 1474614 - RNA, 20 nt, Homo sapiens
cuuuuuuagaaaugcaaaau

SEQ ID NO: 1474615 - RNA, 14 nt, Homo sapiens
cuuuuuuuguaugu

SEQ ID NO: 1474616 - RNA, 22 nt, Homo sapiens
gaaaaaaaaaaaaaagaacaac

SEQ ID NO: 1474617 - RNA, 18 nt, Homo sapiens
gaaaaaaacuucauucuc

SEQ ID NO: 1474618 - RNA, 14 nt, Homo sapiens
gaaaaaaauuacua

SEQ ID NO: 1474619 - RNA, 22 nt, Homo sapiens
gaaaaaacugugccuuguuuca

SEQ ID NO: 1474620 - RNA, 14 nt, Homo sapiens
gaaaaaacuuugac

SEQ ID NO: 1474621 - RNA, 19 nt, Homo sapiens
gaaaaaaguuccuuccuaa

SEQ ID NO: 1474622 - RNA, 20 nt, Homo sapiens
gaaaaagguuugcauucuca

SEQ ID NO: 1474623 - RNA, 19 nt, Homo sapiens
gaaaacacuguuucuggua

SEQ ID NO: 1474624 - RNA, 13 nt, Homo sapiens
gaaaacaggcaaa

SEQ ID NO: 1474625 - RNA, 16 nt, Homo sapiens
gaaaacaucucaauaa

SEQ ID NO: 1474626 - RNA, 18 nt, Homo sapiens
gaaaacuucagaagcaaa

SEQ ID NO: 1474627 - RNA, 11 nt, Homo sapiens
gaaaagacucu

SEQ ID NO: 1474628 - RNA, 21 nt, Homo sapiens
gaaaagccaaauaaaaaucuu

SEQ ID NO: 1474629 - RNA, 20 nt, Homo sapiens
gaaaagcuagguguuuaaua

SEQ ID NO: 1474630 - RNA, 21 nt, Homo sapiens
aaguguccccuauggggaugg

SEQ ID NO: 1474631 - RNA, 19 nt, Homo sapiens
aaguguuguguuccuggcu

SEQ ID NO: 1474632 - RNA, 22 nt, Homo sapiens
aaguguuuuuuauugaaugcuu

SEQ ID NO: 1474633 - RNA, 20 nt, Homo sapiens
aaguuacuagguaacuucau

SEQ ID NO: 1474634 - RNA, 15 nt, Homo sapiens
aaguuacucugccuu

SEQ ID NO: 1474635 - RNA, 14 nt, Homo sapiens
aaguuacuugaauu

SEQ ID NO: 1474636 - RNA, 23 nt, Homo sapiens
aaguuauuuacuuuuaccacuau

SEQ ID NO: 1474637 - RNA, 14 nt, Homo sapiens
aaguucauaggguc

SEQ ID NO: 1474638 - RNA, 20 nt, Homo sapiens
aaguucuaugaagaguauua

SEQ ID NO: 1474639 - RNA, 20 nt, Homo sapiens
aaguuguuuaccucuuuguc

SEQ ID NO: 1474640 - RNA, 21 nt, Homo sapiens
aaguuuaaaguugcacaugau

SEQ ID NO: 1474641 - RNA, 18 nt, Homo sapiens
aaguuucaggauacaugu

SEQ ID NO: 1474642 - RNA, 15 nt, Homo sapiens
aaguuucauacucaa

SEQ ID NO: 1474643 - RNA, 22 nt, Homo sapiens
aaguuucaucagucaaugagga

SEQ ID NO: 1474644 - RNA, 18 nt, Homo sapiens
aaguuucugcagcagaug

SEQ ID NO: 1474645 - RNA, 23 nt, Homo sapiens
aaguuugggccagugaacagggu

SEQ ID NO: 1474646 - RNA, 14 nt, Homo sapiens
aaguuuuacauugu

SEQ ID NO: 1474647 - RNA, 18 nt, Homo sapiens
aauaaaaaagcucuuuua

SEQ ID NO: 1474648 - RNA, 20 nt, Homo sapiens
aauaaaaagugacacagcag

SEQ ID NO: 1474649 - RNA, 15 nt, Homo sapiens
aauaaaaaguucaga

SEQ ID NO: 1474650 - RNA, 14 nt, Homo sapiens
aauaaaaaugcacg

SEQ ID NO: 1474651 - RNA, 13 nt, Homo sapiens
aauaaaauaauuc

SEQ ID NO: 1474652 - RNA, 19 nt, Homo sapiens
aauaaacagcuucaugccu

SEQ ID NO: 1474653 - RNA, 22 nt, Homo sapiens
aauaaacaguugugaaccaaga

SEQ ID NO: 1474654 - RNA, 18 nt, Homo sapiens
aauaaacugaaaauggac

SEQ ID NO: 1474655 - RNA, 14 nt, Homo sapiens
aauaaacugugcaa

SEQ ID NO: 1474656 - RNA, 15 nt, Homo sapiens
aauaaauaaucugua

SEQ ID NO: 1474657 - RNA, 13 nt, Homo sapiens
aauaaauaauuaa

SEQ ID NO: 1474658 - RNA, 23 nt, Homo sapiens
aauaaaucguccucccaggccag

SEQ ID NO: 1474659 - RNA, 16 nt, Homo sapiens
aauaaauguacauuaa

SEQ ID NO: 1474660 - RNA, 13 nt, Homo sapiens
aauaaauuccuaa

SEQ ID NO: 1474661 - RNA, 15 nt, Homo sapiens
aauaaauuccuacaa

SEQ ID NO: 1474662 - RNA, 14 nt, Homo sapiens
aauaacacagagag

SEQ ID NO: 1474663 - RNA, 12 nt, Homo sapiens
aauaacacuguc

SEQ ID NO: 1474664 - RNA, 15 nt, Homo sapiens
aauaacaggcauuug

SEQ ID NO: 1474665 - RNA, 14 nt, Homo sapiens
aauaaccacuuaaa

SEQ ID NO: 1474666 - RNA, 18 nt, Homo sapiens
aauaacucuccaguaaca

SEQ ID NO: 1474667 - RNA, 19 nt, Homo sapiens
aauaauaaaucguccuccc

SEQ ID NO: 1474668 - RNA, 16 nt, Homo sapiens
aauaauagaauugcuc

SEQ ID NO: 1474669 - RNA, 15 nt, Homo sapiens
aauaauauacaugca

SEQ ID NO: 1474670 - RNA, 18 nt, Homo sapiens
aauaauaugcugccaaau

SEQ ID NO: 1474671 - RNA, 19 nt, Homo sapiens
aauaaucucuuuauucuaa

SEQ ID NO: 1474672 - RNA, 14 nt, Homo sapiens
aauacaaaucugua

SEQ ID NO: 1474673 - RNA, 22 nt, Homo sapiens
aauacaagaguggagagaagcu

SEQ ID NO: 1474674 - RNA, 20 nt, Homo sapiens
aauacaauggguaucgcuga

SEQ ID NO: 1474675 - RNA, 15 nt, Homo sapiens
aauacaggggugaaa

SEQ ID NO: 1474676 - RNA, 15 nt, Homo sapiens
aauacauaagaccau

SEQ ID NO: 1474677 - RNA, 21 nt, Homo sapiens
aauacgaacccaaucugcaca

SEQ ID NO: 1474678 - RNA, 22 nt, Homo sapiens
aauacugaaggacacagcagug

SEQ ID NO: 1474679 - RNA, 23 nt, Homo sapiens
aauacugaaggacacagcagugg

SEQ ID NO: 1474680 - RNA, 17 nt, Homo sapiens
aauacugcuacagcaau

SEQ ID NO: 1474681 - RNA, 23 nt, Homo sapiens
acuccacagcggaggagaccagc

SEQ ID NO: 1474682 - RNA, 23 nt, Homo sapiens
acuccacccuccaccuuccauuu

SEQ ID NO: 1474683 - RNA, 21 nt, Homo sapiens
acuccagucuggcaacagagc

SEQ ID NO: 1474684 - RNA, 19 nt, Homo sapiens
acuccaucuccugcucacc

SEQ ID NO: 1474685 - RNA, 15 nt, Homo sapiens
acuccaugagugucu

SEQ ID NO: 1474686 - RNA, 15 nt, Homo sapiens
acucccaacccuggc

SEQ ID NO: 1474687 - RNA, 13 nt, Homo sapiens
acucccacuuuuc

SEQ ID NO: 1474688 - RNA, 12 nt, Homo sapiens
acucccagacau

SEQ ID NO: 1474689 - RNA, 23 nt, Homo sapiens
acuccccauuaacagauggaaaa

SEQ ID NO: 1474690 - RNA, 16 nt, Homo sapiens
acucccccagcuuucc

SEQ ID NO: 1474691 - RNA, 20 nt, Homo sapiens
acucccuccucaccucugga

SEQ ID NO: 1474692 - RNA, 20 nt, Homo sapiens
acucccuguuuuaauucaac

SEQ ID NO: 1474693 - RNA, 17 nt, Homo sapiens
acucccuuugccagugc

SEQ ID NO: 1474694 - RNA, 23 nt, Homo sapiens
acuccugacgucugaagcuugac

SEQ ID NO: 1474695 - RNA, 14 nt, Homo sapiens
acuccugacuguaa

SEQ ID NO: 1474696 - RNA, 14 nt, Homo sapiens
acuccugcucugcu

SEQ ID NO: 1474697 - RNA, 19 nt, Homo sapiens
acuccuguaggaagguuaa

SEQ ID NO: 1474698 - RNA, 19 nt, Homo sapiens
acucuaccaaauaauuuca

SEQ ID NO: 1474699 - RNA, 13 nt, Homo sapiens
acucuacccuaua

SEQ ID NO: 1474700 - RNA, 17 nt, Homo sapiens
acucuaccucauaucag

SEQ ID NO: 1474701 - RNA, 20 nt, Homo sapiens
acucuaggggucaggcucca

SEQ ID NO: 1474702 - RNA, 21 nt, Homo sapiens
acucuaggggucaggcuccau

SEQ ID NO: 1474703 - RNA, 16 nt, Homo sapiens
acucuaggguccagug

SEQ ID NO: 1474704 - RNA, 20 nt, Homo sapiens
acucuaggguccaguggaug

SEQ ID NO: 1474705 - RNA, 14 nt, Homo sapiens
acucucacccauaa

SEQ ID NO: 1474706 - RNA, 22 nt, Homo sapiens
acucucacccauaaacaguaau

SEQ ID NO: 1474707 - RNA, 13 nt, Homo sapiens
acucucauguggc

SEQ ID NO: 1474708 - RNA, 20 nt, Homo sapiens
acucuccaauguucuauuaa

SEQ ID NO: 1474709 - RNA, 18 nt, Homo sapiens
acucuccccauuggcacc

SEQ ID NO: 1474710 - RNA, 14 nt, Homo sapiens
acucuccuagucaa

SEQ ID NO: 1474711 - RNA, 14 nt, Homo sapiens
acucucugaagaug

SEQ ID NO: 1474712 - RNA, 21 nt, Homo sapiens
acucucugcauugacuuauga

SEQ ID NO: 1474713 - RNA, 14 nt, Homo sapiens
acucugaccuguac

SEQ ID NO: 1474714 - RNA, 15 nt, Homo sapiens
acucugagaucuaag

SEQ ID NO: 1474715 - RNA, 16 nt, Homo sapiens
acucugcacagccuag

SEQ ID NO: 1474716 - RNA, 17 nt, Homo sapiens
acucugcuucaguccac

SEQ ID NO: 1474717 - RNA, 22 nt, Homo sapiens
acucuggguuuauuacauggca

SEQ ID NO: 1474718 - RNA, 12 nt, Homo sapiens
acucugguggca

SEQ ID NO: 1474719 - RNA, 14 nt, Homo sapiens
acucugguggcaca

SEQ ID NO: 1474720 - RNA, 12 nt, Homo sapiens
acucugucuugu

SEQ ID NO: 1474721 - RNA, 20 nt, Homo sapiens
acucuuagcuaaaucccucc

SEQ ID NO: 1474722 - RNA, 16 nt, Homo sapiens
acucuuaucuacauaa

SEQ ID NO: 1474723 - RNA, 16 nt, Homo sapiens
acucuuccaaaggcau

SEQ ID NO: 1474724 - RNA, 14 nt, Homo sapiens
acucuuccaccucc

SEQ ID NO: 1474725 - RNA, 17 nt, Homo sapiens
acucuucucucugcucu

SEQ ID NO: 1474726 - RNA, 16 nt, Homo sapiens
acucuugaucucucuu

SEQ ID NO: 1474727 - RNA, 18 nt, Homo sapiens
acucuuguugaguucugu

SEQ ID NO: 1474728 - RNA, 19 nt, Homo sapiens
acucuuucuggccugccuu

SEQ ID NO: 1474729 - RNA, 20 nt, Homo sapiens
acugaaaaugucacauucua

SEQ ID NO: 1474730 - RNA, 15 nt, Homo sapiens
acugaacucacuuuc

SEQ ID NO: 1474731 - RNA, 15 nt, Homo sapiens
acugaagaugcagcu

SEQ ID NO: 1474732 - RNA, 21 nt, Homo sapiens
acugaagccugcguuggucca

SEQ ID NO: 1474733 - RNA, 20 nt, Homo sapiens
acugggccuuagugggccag

SEQ ID NO: 1474734 - RNA, 18 nt, Homo sapiens
acugggcuggguuugcug

SEQ ID NO: 1474735 - RNA, 18 nt, Homo sapiens
acuggggagucuuugugg

SEQ ID NO: 1474736 - RNA, 22 nt, Homo sapiens
acugguagaacguaaccacgga

SEQ ID NO: 1474737 - RNA, 23 nt, Homo sapiens
acugguauguguggaugaugcug

SEQ ID NO: 1474738 - RNA, 16 nt, Homo sapiens
acugguucacauccua

SEQ ID NO: 1474739 - RNA, 20 nt, Homo sapiens
acugguuuggucaguuacaa

SEQ ID NO: 1474740 - RNA, 15 nt, Homo sapiens
acugguuuucugcca

SEQ ID NO: 1474741 - RNA, 21 nt, Homo sapiens
acuguaaauacgaacccaauc

SEQ ID NO: 1474742 - RNA, 14 nt, Homo sapiens
acuguaaaugcauu

SEQ ID NO: 1474743 - RNA, 18 nt, Homo sapiens
acuguaacugacugccuu

SEQ ID NO: 1474744 - RNA, 13 nt, Homo sapiens
acuguaagggauu

SEQ ID NO: 1474745 - RNA, 23 nt, Homo sapiens
acuguagaaaugaugauguggaa

SEQ ID NO: 1474746 - RNA, 23 nt, Homo sapiens
acuguagccacagcugcuguucu

SEQ ID NO: 1474747 - RNA, 14 nt, Homo sapiens
acuguagcuuuuag

SEQ ID NO: 1474748 - RNA, 19 nt, Homo sapiens
acuguaggcacacuuugca

SEQ ID NO: 1474749 - RNA, 22 nt, Homo sapiens
acuguaguguagucaggugcuc

SEQ ID NO: 1474750 - RNA, 15 nt, Homo sapiens
acuguaucaagucau

SEQ ID NO: 1474751 - RNA, 17 nt, Homo sapiens
acuguaucaagucaugg

SEQ ID NO: 1474752 - RNA, 23 nt, Homo sapiens
acugucaagaagaggaaagggag

SEQ ID NO: 1474753 - RNA, 20 nt, Homo sapiens
acugucaaggcugcuuagaa

SEQ ID NO: 1474754 - RNA, 13 nt, Homo sapiens
acugucacuuugc

SEQ ID NO: 1474755 - RNA, 19 nt, Homo sapiens
acuguccuguccugcucau

SEQ ID NO: 1474756 - RNA, 14 nt, Homo sapiens
acugucucacuuaa

SEQ ID NO: 1474757 - RNA, 21 nt, Homo sapiens
acugucugugaacagagagac

SEQ ID NO: 1474758 - RNA, 16 nt, Homo sapiens
acugucuuccucaaaa

SEQ ID NO: 1474759 - RNA, 15 nt, Homo sapiens
acugugaagcauuua

SEQ ID NO: 1474760 - RNA, 14 nt, Homo sapiens
acugugagcaagga

SEQ ID NO: 1474761 - RNA, 14 nt, Homo sapiens
acuguggagcucag

SEQ ID NO: 1474762 - RNA, 16 nt, Homo sapiens
acuguguggacuguga

SEQ ID NO: 1474763 - RNA, 19 nt, Homo sapiens
acuguguggacugugaugc

SEQ ID NO: 1474764 - RNA, 18 nt, Homo sapiens
acuguguuuuuccuccau

SEQ ID NO: 1474765 - RNA, 16 nt, Homo sapiens
acuguuaacuaugaca

SEQ ID NO: 1474766 - RNA, 20 nt, Homo sapiens
acuguuaggaacagcagugu

SEQ ID NO: 1474767 - RNA, 14 nt, Homo sapiens
acuguuccaaagcc

SEQ ID NO: 1474768 - RNA, 15 nt, Homo sapiens
acuguuccaaagcca

SEQ ID NO: 1474769 - RNA, 17 nt, Homo sapiens
acuguuguucugugguu

SEQ ID NO: 1474770 - RNA, 20 nt, Homo sapiens
acuuaaaaaauguccaugau

SEQ ID NO: 1474771 - RNA, 13 nt, Homo sapiens
acuuaacauucug

SEQ ID NO: 1474772 - RNA, 13 nt, Homo sapiens
acuuaacuaugag

SEQ ID NO: 1474773 - RNA, 15 nt, Homo sapiens
acuuaagcacaagca

SEQ ID NO: 1474774 - RNA, 16 nt, Homo sapiens
acuuaaguggcauuaa

SEQ ID NO: 1474775 - RNA, 18 nt, Homo sapiens
acuuaauguucuuaugca

SEQ ID NO: 1474776 - RNA, 14 nt, Homo sapiens
acuuacaacccagg

SEQ ID NO: 1474777 - RNA, 17 nt, Homo sapiens
acuuagaucaucaguca

SEQ ID NO: 1474778 - RNA, 14 nt, Homo sapiens
acuuagcauccuaa

SEQ ID NO: 1474779 - RNA, 21 nt, Homo sapiens
acuuauaaaucauauugauga

SEQ ID NO: 1474780 - RNA, 21 nt, Homo sapiens
acuuauaagaaagaucaaaga

SEQ ID NO: 1474781 - RNA, 17 nt, Homo sapiens
acuuaugagauaauuaa

SEQ ID NO: 1474782 - RNA, 18 nt, Homo sapiens
acuucaaugggcucuucc

SEQ ID NO: 1474783 - RNA, 19 nt, Homo sapiens
acuucaaugggcucuucca

SEQ ID NO: 1474784 - RNA, 20 nt, Homo sapiens
acuucaaugggcucuuccaa

SEQ ID NO: 1474785 - RNA, 18 nt, Homo sapiens
acuucaccuaacuagaga

SEQ ID NO: 1474786 - RNA, 15 nt, Homo sapiens
aguacaucucuacua

SEQ ID NO: 1474787 - RNA, 19 nt, Homo sapiens
aguacaugauaaaugauag

SEQ ID NO: 1474788 - RNA, 22 nt, Homo sapiens
aguacaugauaaaugauagaca

SEQ ID NO: 1474789 - RNA, 15 nt, Homo sapiens
aguaccuacugugug

SEQ ID NO: 1474790 - RNA, 14 nt, Homo sapiens
aguaccucugcuau

SEQ ID NO: 1474791 - RNA, 11 nt, Homo sapiens
aguaccugcug

SEQ ID NO: 1474792 - RNA, 22 nt, Homo sapiens
aguaccuuuuccuacacagcgg

SEQ ID NO: 1474793 - RNA, 20 nt, Homo sapiens
aguacuccaagacagagaca

SEQ ID NO: 1474794 - RNA, 15 nt, Homo sapiens
aguacuccugcaaaa

SEQ ID NO: 1474795 - RNA, 15 nt, Homo sapiens
aguacugaccacugg

SEQ ID NO: 1474796 - RNA, 13 nt, Homo sapiens
aguacugaugaaa

SEQ ID NO: 1474797 - RNA, 15 nt, Homo sapiens
aguacuuaacauaca

SEQ ID NO: 1474798 - RNA, 11 nt, Homo sapiens
aguacuugaaa

SEQ ID NO: 1474799 - RNA, 21 nt, Homo sapiens
aguacuugugaaacacagcug

SEQ ID NO: 1474800 - RNA, 19 nt, Homo sapiens
aguagaaauaaaagugaau

SEQ ID NO: 1474801 - RNA, 16 nt, Homo sapiens
aguagaaauuuuacaa

SEQ ID NO: 1474802 - RNA, 16 nt, Homo sapiens
aguagaagauuugaug

SEQ ID NO: 1474803 - RNA, 14 nt, Homo sapiens
aguagaauccuaaa

SEQ ID NO: 1474804 - RNA, 14 nt, Homo sapiens
aguagacugcagug

SEQ ID NO: 1474805 - RNA, 17 nt, Homo sapiens
aguagaugauuuccuua

SEQ ID NO: 1474806 - RNA, 14 nt, Homo sapiens
aguagcuuugcacu

SEQ ID NO: 1474807 - RNA, 13 nt, Homo sapiens
aguaguagcugaa

SEQ ID NO: 1474808 - RNA, 17 nt, Homo sapiens
aguaguccuuggcauag

SEQ ID NO: 1474809 - RNA, 15 nt, Homo sapiens
aguagugcugugauu

SEQ ID NO: 1474810 - RNA, 14 nt, Homo sapiens
aguauaauuuaacu

SEQ ID NO: 1474811 - RNA, 14 nt, Homo sapiens
aguauauauagaau

SEQ ID NO: 1474812 - RNA, 12 nt, Homo sapiens
aguauccacaau

SEQ ID NO: 1474813 - RNA, 18 nt, Homo sapiens
aguauuauuuuacaauca

SEQ ID NO: 1474814 - RNA, 18 nt, Homo sapiens
aguauucuuaguuguuca

SEQ ID NO: 1474815 - RNA, 16 nt, Homo sapiens
aguauugguguaugua

SEQ ID NO: 1474816 - RNA, 15 nt, Homo sapiens
aguauuguggcugca

SEQ ID NO: 1474817 - RNA, 21 nt, Homo sapiens
aguauuuuccuccaggcaaaa

SEQ ID NO: 1474818 - RNA, 17 nt, Homo sapiens
agucaaaacuacaaauc

SEQ ID NO: 1474819 - RNA, 13 nt, Homo sapiens
agucaaugugcag

SEQ ID NO: 1474820 - RNA, 13 nt, Homo sapiens
agucaauucugau

SEQ ID NO: 1474821 - RNA, 12 nt, Homo sapiens
agucacagugau

SEQ ID NO: 1474822 - RNA, 12 nt, Homo sapiens
agucacaugacc

SEQ ID NO: 1474823 - RNA, 12 nt, Homo sapiens
agucacgcuggg

SEQ ID NO: 1474824 - RNA, 17 nt, Homo sapiens
agucacuugaugugcca

SEQ ID NO: 1474825 - RNA, 16 nt, Homo sapiens
agucaggcaggguuaa

SEQ ID NO: 1474826 - RNA, 23 nt, Homo sapiens
agucaggccuuaauuuucaguau

SEQ ID NO: 1474827 - RNA, 16 nt, Homo sapiens
agucaguaauugccaa

SEQ ID NO: 1474828 - RNA, 14 nt, Homo sapiens
agucaguccaggau

SEQ ID NO: 1474829 - RNA, 13 nt, Homo sapiens
agucagugucugg

SEQ ID NO: 1474830 - RNA, 15 nt, Homo sapiens
agucagugucuggcu

SEQ ID NO: 1474831 - RNA, 15 nt, Homo sapiens
agucauauaccuaua

SEQ ID NO: 1474832 - RNA, 17 nt, Homo sapiens
agucaucaucagggccu

SEQ ID NO: 1474833 - RNA, 13 nt, Homo sapiens
agucaucucagcc

SEQ ID NO: 1474834 - RNA, 14 nt, Homo sapiens
agucaucucagccc

SEQ ID NO: 1474835 - RNA, 22 nt, Homo sapiens
agucauggagaaucugcugcau

SEQ ID NO: 1474836 - RNA, 17 nt, Homo sapiens
agucauggcuaauuuaa

SEQ ID NO: 1474837 - RNA, 12 nt, Homo sapiens
agucaugguguu

SEQ ID NO: 1474838 - RNA, 13 nt, Homo sapiens
agucauucuagga

SEQ ID NO: 1474839 - RNA, 15 nt, Homo sapiens
agugugaaugaucaa

SEQ ID NO: 1474840 - RNA, 14 nt, Homo sapiens
agugugacuucccu

SEQ ID NO: 1474841 - RNA, 16 nt, Homo sapiens
aguguggaaagaaaga

SEQ ID NO: 1474842 - RNA, 23 nt, Homo sapiens
aguguggcccagggaagccaaaa

SEQ ID NO: 1474843 - RNA, 18 nt, Homo sapiens
agugugugugugcaugug

SEQ ID NO: 1474844 - RNA, 20 nt, Homo sapiens
aguguuaagcguucagugau

SEQ ID NO: 1474845 - RNA, 14 nt, Homo sapiens
aguguuaguuauaa

SEQ ID NO: 1474846 - RNA, 23 nt, Homo sapiens
aguguuauuugcacacugcacug

SEQ ID NO: 1474847 - RNA, 16 nt, Homo sapiens
aguguugagaugggga

SEQ ID NO: 1474848 - RNA, 23 nt, Homo sapiens
aguuaaagugaauaaccacuuaa

SEQ ID NO: 1474849 - RNA, 21 nt, Homo sapiens
aguuaaauagaguauaugcac

SEQ ID NO: 1474850 - RNA, 18 nt, Homo sapiens
aguuaacucacugagggu

SEQ ID NO: 1474851 - RNA, 13 nt, Homo sapiens
aguuacacuugac

SEQ ID NO: 1474852 - RNA, 16 nt, Homo sapiens
aguuacuaccugucaa

SEQ ID NO: 1474853 - RNA, 12 nt, Homo sapiens
aguuacuugaaa

SEQ ID NO: 1474854 - RNA, 16 nt, Homo sapiens
aguuagguagcuuuag

SEQ ID NO: 1474855 - RNA, 15 nt, Homo sapiens
aguuauaaaguccuu

SEQ ID NO: 1474856 - RNA, 16 nt, Homo sapiens
aguuauggugaaccca

SEQ ID NO: 1474857 - RNA, 18 nt, Homo sapiens
aguuauuauuuaauugca

SEQ ID NO: 1474858 - RNA, 20 nt, Homo sapiens
aguuauuuacuuuuaccacu

SEQ ID NO: 1474859 - RNA, 22 nt, Homo sapiens
aguucacuuuuuacagugcuau

SEQ ID NO: 1474860 - RNA, 16 nt, Homo sapiens
aguucauauguaccau

SEQ ID NO: 1474861 - RNA, 18 nt, Homo sapiens
aguucauauguaccaugu

SEQ ID NO: 1474862 - RNA, 19 nt, Homo sapiens
aguuccaugaagaccacau

SEQ ID NO: 1474863 - RNA, 19 nt, Homo sapiens
aguucccccaguaccucca

SEQ ID NO: 1474864 - RNA, 13 nt, Homo sapiens
aguucccuuggcc

SEQ ID NO: 1474865 - RNA, 17 nt, Homo sapiens
aguuccuguaacaggug

SEQ ID NO: 1474866 - RNA, 20 nt, Homo sapiens
aguuccuguagaacugagaa

SEQ ID NO: 1474867 - RNA, 14 nt, Homo sapiens
aguucuaggcauag

SEQ ID NO: 1474868 - RNA, 19 nt, Homo sapiens
aguucugagcaccguguca

SEQ ID NO: 1474869 - RNA, 23 nt, Homo sapiens
aguucuuaaaguuuaaaguugca

SEQ ID NO: 1474870 - RNA, 20 nt, Homo sapiens
aguucuuacugcuuaauuca

SEQ ID NO: 1474871 - RNA, 16 nt, Homo sapiens
aguucuuugggccaga

SEQ ID NO: 1474872 - RNA, 19 nt, Homo sapiens
aguucuuugggccagacau

SEQ ID NO: 1474873 - RNA, 12 nt, Homo sapiens
aguugaacaugg

SEQ ID NO: 1474874 - RNA, 20 nt, Homo sapiens
aguugaucuacaaaggccau

SEQ ID NO: 1474875 - RNA, 19 nt, Homo sapiens
aguugaucuggaacccaga

SEQ ID NO: 1474876 - RNA, 23 nt, Homo sapiens
aguugccacauuuaguccuguac

SEQ ID NO: 1474877 - RNA, 12 nt, Homo sapiens
aguugccuuuau

SEQ ID NO: 1474878 - RNA, 21 nt, Homo sapiens
aguuggaaaaacaaaugccau

SEQ ID NO: 1474879 - RNA, 20 nt, Homo sapiens
aguuggaaccguguccagca

SEQ ID NO: 1474880 - RNA, 14 nt, Homo sapiens
aguuggaguacuau

SEQ ID NO: 1474881 - RNA, 21 nt, Homo sapiens
aguuggugcuuuugagaacca

SEQ ID NO: 1474882 - RNA, 20 nt, Homo sapiens
aguugguuuguaucuugccu

SEQ ID NO: 1474883 - RNA, 17 nt, Homo sapiens
aguugucuuuccuggca

SEQ ID NO: 1474884 - RNA, 23 nt, Homo sapiens
aguuguuggcaagguagcaauac

SEQ ID NO: 1474885 - RNA, 21 nt, Homo sapiens
aguuuaauuuuugaaaacugg

SEQ ID NO: 1474886 - RNA, 17 nt, Homo sapiens
aguuuacccaugaagau

SEQ ID NO: 1474887 - RNA, 14 nt, Homo sapiens
aguuuaugauggaa

SEQ ID NO: 1474888 - RNA, 23 nt, Homo sapiens
aguuuauuccagagcugccagug

SEQ ID NO: 1474889 - RNA, 20 nt, Homo sapiens
ccagcuucaggcaccagcau

SEQ ID NO: 1474890 - RNA, 20 nt, Homo sapiens
ccagcuucucucuccagggu

SEQ ID NO: 1474891 - RNA, 20 nt, Homo sapiens
ccaggaaagguuuuccuuau

SEQ ID NO: 1474892 - RNA, 13 nt, Homo sapiens
ccaggaaugccuc

SEQ ID NO: 1474893 - RNA, 20 nt, Homo sapiens
ccaggacuguugaugccuuu

SEQ ID NO: 1474894 - RNA, 23 nt, Homo sapiens
ccaggagcaggaccuacuaggag

SEQ ID NO: 1474895 - RNA, 11 nt, Homo sapiens
ccaggagcuca

SEQ ID NO: 1474896 - RNA, 13 nt, Homo sapiens
ccaggagcucuuc

SEQ ID NO: 1474897 - RNA, 17 nt, Homo sapiens
ccaggagcugauggcag

SEQ ID NO: 1474898 - RNA, 19 nt, Homo sapiens
ccaggagggaccacccucc

SEQ ID NO: 1474899 - RNA, 23 nt, Homo sapiens
ccaggaggggaugugugugugca

SEQ ID NO: 1474900 - RNA, 22 nt, Homo sapiens
ccaggaguaccuggaccugucc

SEQ ID NO: 1474901 - RNA, 22 nt, Homo sapiens
ccaggaguucgaggcugcaguc

SEQ ID NO: 1474902 - RNA, 19 nt, Homo sapiens
ccaggaucaugguguaaua

SEQ ID NO: 1474903 - RNA, 20 nt, Homo sapiens
ccaggauuauugucaaagaa

SEQ ID NO: 1474904 - RNA, 16 nt, Homo sapiens
ccaggcacugcccuuu

SEQ ID NO: 1474905 - RNA, 14 nt, Homo sapiens
ccaggcaggggugg

SEQ ID NO: 1474906 - RNA, 21 nt, Homo sapiens
ccaggcccugcucuuccucag

SEQ ID NO: 1474907 - RNA, 19 nt, Homo sapiens
ccaggcugaccacagcaca

SEQ ID NO: 1474908 - RNA, 20 nt, Homo sapiens
ccaggcuggacugcaaugac

SEQ ID NO: 1474909 - RNA, 15 nt, Homo sapiens
ccaggcugggaacuc

SEQ ID NO: 1474910 - RNA, 16 nt, Homo sapiens
ccaggcuggucucaaa

SEQ ID NO: 1474911 - RNA, 15 nt, Homo sapiens
ccaggcugugcagcg

SEQ ID NO: 1474912 - RNA, 21 nt, Homo sapiens
ccaggcuucacccugaauggu

SEQ ID NO: 1474913 - RNA, 14 nt, Homo sapiens
ccaggcuuuguaca

SEQ ID NO: 1474914 - RNA, 13 nt, Homo sapiens
ccagggaaggugg

SEQ ID NO: 1474915 - RNA, 17 nt, Homo sapiens
ccagggagaagcuccuc

SEQ ID NO: 1474916 - RNA, 18 nt, Homo sapiens
ccagggagggaaguguga

SEQ ID NO: 1474917 - RNA, 15 nt, Homo sapiens
ccagggcauguguau

SEQ ID NO: 1474918 - RNA, 16 nt, Homo sapiens
ccagggcucccggaga

SEQ ID NO: 1474919 - RNA, 21 nt, Homo sapiens
ccagggugauuuuaugaucag

SEQ ID NO: 1474920 - RNA, 20 nt, Homo sapiens
ccaggucguccaagcaaaaa

SEQ ID NO: 1474921 - RNA, 15 nt, Homo sapiens
ccaggugaacuggaa

SEQ ID NO: 1474922 - RNA, 14 nt, Homo sapiens
ccagguguucuaca

SEQ ID NO: 1474923 - RNA, 19 nt, Homo sapiens
ccagguugggggcaguguu

SEQ ID NO: 1474924 - RNA, 15 nt, Homo sapiens
ccagguuuugcacuc

SEQ ID NO: 1474925 - RNA, 14 nt, Homo sapiens
ccaguaacuuuucu

SEQ ID NO: 1474926 - RNA, 14 nt, Homo sapiens
ccaguauuaugcau

SEQ ID NO: 1474927 - RNA, 22 nt, Homo sapiens
ccaguauuuuuauuucuuuaau

SEQ ID NO: 1474928 - RNA, 17 nt, Homo sapiens
ccagucacuuugccaga

SEQ ID NO: 1474929 - RNA, 22 nt, Homo sapiens
ccagucaggcucucugggcuga

SEQ ID NO: 1474930 - RNA, 18 nt, Homo sapiens
ccagucggccccaucucu

SEQ ID NO: 1474931 - RNA, 14 nt, Homo sapiens
ccagucucuggcag

SEQ ID NO: 1474932 - RNA, 20 nt, Homo sapiens
ccagugaccccugaccucac

SEQ ID NO: 1474933 - RNA, 14 nt, Homo sapiens
ccagugagacugug

SEQ ID NO: 1474934 - RNA, 15 nt, Homo sapiens
ccagugccagcaccu

SEQ ID NO: 1474935 - RNA, 11 nt, Homo sapiens
ccagugccauu

SEQ ID NO: 1474936 - RNA, 15 nt, Homo sapiens
ccagugcuccaggca

SEQ ID NO: 1474937 - RNA, 23 nt, Homo sapiens
ccagugcuccaggcacccagcuu

SEQ ID NO: 1474938 - RNA, 22 nt, Homo sapiens
ccaguggaacagcgggagaccu

SEQ ID NO: 1474939 - RNA, 18 nt, Homo sapiens
ccaguggaucauaagaca

SEQ ID NO: 1474940 - RNA, 21 nt, Homo sapiens
ccaguguaucaggucagggac

SEQ ID NO: 1474941 - RNA, 16 nt, Homo sapiens
ccauuccaaagcuuua

SEQ ID NO: 1474942 - RNA, 23 nt, Homo sapiens
ccauucgguguggugcaguguga

SEQ ID NO: 1474943 - RNA, 13 nt, Homo sapiens
ccauugcacucca

SEQ ID NO: 1474944 - RNA, 12 nt, Homo sapiens
ccauuguucacc

SEQ ID NO: 1474945 - RNA, 22 nt, Homo sapiens
ccauuuauaauguuaguagaaa

SEQ ID NO: 1474946 - RNA, 19 nt, Homo sapiens
ccauuucugccucgcucac

SEQ ID NO: 1474947 - RNA, 13 nt, Homo sapiens
ccauuuguuccug

SEQ ID NO: 1474948 - RNA, 23 nt, Homo sapiens
ccauuuucuuauugcgcugcuac

SEQ ID NO: 1474949 - RNA, 15 nt, Homo sapiens
cccaaaaugugaugc

SEQ ID NO: 1474950 - RNA, 12 nt, Homo sapiens
cccaaagagccu

SEQ ID NO: 1474951 - RNA, 13 nt, Homo sapiens
cccaaagugcuga

SEQ ID NO: 1474952 - RNA, 16 nt, Homo sapiens
cccaaaguuguuguaa

SEQ ID NO: 1474953 - RNA, 16 nt, Homo sapiens
cccaacaaaccaucca

SEQ ID NO: 1474954 - RNA, 18 nt, Homo sapiens
cccaacaagauugcuuaa

SEQ ID NO: 1474955 - RNA, 15 nt, Homo sapiens
cccaacacuuugaga

SEQ ID NO: 1474956 - RNA, 16 nt, Homo sapiens
cccaaccccaguggau

SEQ ID NO: 1474957 - RNA, 15 nt, Homo sapiens
cccaacugacuugua

SEQ ID NO: 1474958 - RNA, 23 nt, Homo sapiens
cccaagaggucaaggcugcagug

SEQ ID NO: 1474959 - RNA, 16 nt, Homo sapiens
cccaaggaugcuguca

SEQ ID NO: 1474960 - RNA, 18 nt, Homo sapiens
cccaaggcucaugguccu

SEQ ID NO: 1474961 - RNA, 22 nt, Homo sapiens
cccaaguggugaaugacacgcc

SEQ ID NO: 1474962 - RNA, 17 nt, Homo sapiens
cccaauaaaagugacuc

SEQ ID NO: 1474963 - RNA, 19 nt, Homo sapiens
cccaaucuccaucugucaa

SEQ ID NO: 1474964 - RNA, 13 nt, Homo sapiens
cccacaacuuuaa

SEQ ID NO: 1474965 - RNA, 16 nt, Homo sapiens
cccacacacacuauaa

SEQ ID NO: 1474966 - RNA, 18 nt, Homo sapiens
cccacacagcuacagcuu

SEQ ID NO: 1474967 - RNA, 20 nt, Homo sapiens
cccacacagcuacagcuuuc

SEQ ID NO: 1474968 - RNA, 15 nt, Homo sapiens
cccacaccguguaaa

SEQ ID NO: 1474969 - RNA, 19 nt, Homo sapiens
cccacagcuggcucugaca

SEQ ID NO: 1474970 - RNA, 18 nt, Homo sapiens
cccaccagagugaugugu

SEQ ID NO: 1474971 - RNA, 22 nt, Homo sapiens
cccaccagcuaaggacauuucc

SEQ ID NO: 1474972 - RNA, 15 nt, Homo sapiens
cccacccugcacuuu

SEQ ID NO: 1474973 - RNA, 18 nt, Homo sapiens
cccacuaaaacugcauuu

SEQ ID NO: 1474974 - RNA, 22 nt, Homo sapiens
cccacucccuggcucucagaag

SEQ ID NO: 1474975 - RNA, 13 nt, Homo sapiens
cccacugagauuu

SEQ ID NO: 1474976 - RNA, 16 nt, Homo sapiens
cccacuguucuuguau

SEQ ID NO: 1474977 - RNA, 15 nt, Homo sapiens
cccagacuacuauuu

SEQ ID NO: 1474978 - RNA, 12 nt, Homo sapiens
cccagagcagga

SEQ ID NO: 1474979 - RNA, 18 nt, Homo sapiens
cccagaggauaagccacu

SEQ ID NO: 1474980 - RNA, 21 nt, Homo sapiens
cccagaggauaagccacuggg

SEQ ID NO: 1474981 - RNA, 21 nt, Homo sapiens
cccagaggaugucacaaagau

SEQ ID NO: 1474982 - RNA, 16 nt, Homo sapiens
cccagagggucagggu

SEQ ID NO: 1474983 - RNA, 18 nt, Homo sapiens
cccagagguaacagaaca

SEQ ID NO: 1474984 - RNA, 14 nt, Homo sapiens
cccagauaacuuuc

SEQ ID NO: 1474985 - RNA, 15 nt, Homo sapiens
cccagauagguggug

SEQ ID NO: 1474986 - RNA, 19 nt, Homo sapiens
cccagaugggccacggcug

SEQ ID NO: 1474987 - RNA, 12 nt, Homo sapiens
cccagcacuuug

SEQ ID NO: 1474988 - RNA, 19 nt, Homo sapiens
cccagcaucccuggagcag

SEQ ID NO: 1474989 - RNA, 19 nt, Homo sapiens
cccagccaugcaaugccaa

SEQ ID NO: 1474990 - RNA, 15 nt, Homo sapiens
cccagcccagagcca

SEQ ID NO: 1474991 - RNA, 22 nt, Homo sapiens
cccagccggcaggccuggacuu

SEQ ID NO: 1474992 - RNA, 20 nt, Homo sapiens
cccagccuccccgugccaaa

SEQ ID NO: 1474993 - RNA, 15 nt, Homo sapiens
cccagccuucacuga

SEQ ID NO: 1474994 - RNA, 22 nt, Homo sapiens
cuccacagagugagccagugag

SEQ ID NO: 1474995 - RNA, 17 nt, Homo sapiens
cuccacaucugccuuaa

SEQ ID NO: 1474996 - RNA, 15 nt, Homo sapiens
cuccaccugcuggug

SEQ ID NO: 1474997 - RNA, 16 nt, Homo sapiens
cuccaccuuccaaagg

SEQ ID NO: 1474998 - RNA, 15 nt, Homo sapiens
cuccacucagguucu

SEQ ID NO: 1474999 - RNA, 19 nt, Homo sapiens
cuccagaauggaacucaag

SEQ ID NO: 1475000 - RNA, 16 nt, Homo sapiens
cuccagagaaacccag

SEQ ID NO: 1475001 - RNA, 16 nt, Homo sapiens
cuccagccagcaauga

SEQ ID NO: 1475002 - RNA, 14 nt, Homo sapiens
cuccagccaucuca

SEQ ID NO: 1475003 - RNA, 22 nt, Homo sapiens
cuccagcccagacccaguggac

SEQ ID NO: 1475004 - RNA, 20 nt, Homo sapiens
cuccagcugggcucugcaau

SEQ ID NO: 1475005 - RNA, 22 nt, Homo sapiens
cuccagcuugggcaacagggcg

SEQ ID NO: 1475006 - RNA, 14 nt, Homo sapiens
cuccaggaaugccu

SEQ ID NO: 1475007 - RNA, 16 nt, Homo sapiens
cuccaggaucuauuga

SEQ ID NO: 1475008 - RNA, 18 nt, Homo sapiens
cuccaggcccaaggcucc

SEQ ID NO: 1475009 - RNA, 21 nt, Homo sapiens
cuccagggcuuugcuccagaa

SEQ ID NO: 1475010 - RNA, 14 nt, Homo sapiens
cuccaggugcucau

SEQ ID NO: 1475011 - RNA, 19 nt, Homo sapiens
cuccaguaccuugcuucuu

SEQ ID NO: 1475012 - RNA, 18 nt, Homo sapiens
cuccagugccagcaauga

SEQ ID NO: 1475013 - RNA, 19 nt, Homo sapiens
cuccaguuuuuuguuauau

SEQ ID NO: 1475014 - RNA, 20 nt, Homo sapiens
cuccauaaacagacuguuaa

SEQ ID NO: 1475015 - RNA, 22 nt, Homo sapiens
cuccauaucccuuccucucagg

SEQ ID NO: 1475016 - RNA, 17 nt, Homo sapiens
cuccauaucuccauggc

SEQ ID NO: 1475017 - RNA, 18 nt, Homo sapiens
cuccaucccaacagccau

SEQ ID NO: 1475018 - RNA, 15 nt, Homo sapiens
cuccaucucaaaaag

SEQ ID NO: 1475019 - RNA, 14 nt, Homo sapiens
cuccaucucaugua

SEQ ID NO: 1475020 - RNA, 17 nt, Homo sapiens
cuccaucucauguauca

SEQ ID NO: 1475021 - RNA, 21 nt, Homo sapiens
cuccaugcuccucaccugucu

SEQ ID NO: 1475022 - RNA, 14 nt, Homo sapiens
cuccaugcugccag

SEQ ID NO: 1475023 - RNA, 16 nt, Homo sapiens
cuccauguuugaugua

SEQ ID NO: 1475024 - RNA, 21 nt, Homo sapiens
cucccaaaaaacuacuucuuu

SEQ ID NO: 1475025 - RNA, 12 nt, Homo sapiens
cucccaaagugc

SEQ ID NO: 1475026 - RNA, 19 nt, Homo sapiens
cucccaaagugcugggauu

SEQ ID NO: 1475027 - RNA, 20 nt, Homo sapiens
cucccaaaugagccaugaga

SEQ ID NO: 1475028 - RNA, 23 nt, Homo sapiens
cucccaagguccucucaguucuc

SEQ ID NO: 1475029 - RNA, 19 nt, Homo sapiens
cucccaaguagcugggauu

SEQ ID NO: 1475030 - RNA, 12 nt, Homo sapiens
cucccacagaac

SEQ ID NO: 1475031 - RNA, 19 nt, Homo sapiens
cucccagugaacuccugcc

SEQ ID NO: 1475032 - RNA, 19 nt, Homo sapiens
cuccccacacagacuccac

SEQ ID NO: 1475033 - RNA, 17 nt, Homo sapiens
cuccccagcccagagac

SEQ ID NO: 1475034 - RNA, 13 nt, Homo sapiens
cuccccaggggag

SEQ ID NO: 1475035 - RNA, 12 nt, Homo sapiens
cuccccauggag

SEQ ID NO: 1475036 - RNA, 18 nt, Homo sapiens
cuccccugcccuggucca

SEQ ID NO: 1475037 - RNA, 15 nt, Homo sapiens
cucccgaugcugcua

SEQ ID NO: 1475038 - RNA, 16 nt, Homo sapiens
cucccuaggagaccaa

SEQ ID NO: 1475039 - RNA, 20 nt, Homo sapiens
cucccuaucuccuucccacc

SEQ ID NO: 1475040 - RNA, 22 nt, Homo sapiens
cucccucucucuucugcuccac

SEQ ID NO: 1475041 - RNA, 14 nt, Homo sapiens
cucccugaugacac

SEQ ID NO: 1475042 - RNA, 15 nt, Homo sapiens
cucccugccaccagg

SEQ ID NO: 1475043 - RNA, 14 nt, Homo sapiens
cuccgcaucaccuc

SEQ ID NO: 1475044 - RNA, 16 nt, Homo sapiens
cuccggccugaugaca

SEQ ID NO: 1475045 - RNA, 20 nt, Homo sapiens
cuccuacaggugcuguucag

SEQ ID NO: 1475046 - RNA, 19 nt, Homo sapiens
cuccucaggcacacagcua

SEQ ID NO: 1475047 - RNA, 12 nt, Homo sapiens
cuccucuaguaa

SEQ ID NO: 1475048 - RNA, 18 nt, Homo sapiens
cucuccaagucucagugg

SEQ ID NO: 1475049 - RNA, 13 nt, Homo sapiens
cucuccauauccc

SEQ ID NO: 1475050 - RNA, 21 nt, Homo sapiens
cucucccaaaaaacuacuucu

SEQ ID NO: 1475051 - RNA, 15 nt, Homo sapiens
cucuccccuccagcc

SEQ ID NO: 1475052 - RNA, 17 nt, Homo sapiens
cucuccccuccagccuu

SEQ ID NO: 1475053 - RNA, 19 nt, Homo sapiens
cucuccccuccagccuuug

SEQ ID NO: 1475054 - RNA, 21 nt, Homo sapiens
cucucuaaaucuuccuuguga

SEQ ID NO: 1475055 - RNA, 23 nt, Homo sapiens
cucucugggccucaguuuuccca

SEQ ID NO: 1475056 - RNA, 18 nt, Homo sapiens
cucucugguuuacuucaa

SEQ ID NO: 1475057 - RNA, 23 nt, Homo sapiens
cucucuuucuagaggugcuacau

SEQ ID NO: 1475058 - RNA, 16 nt, Homo sapiens
cucugaacuugccuua

SEQ ID NO: 1475059 - RNA, 11 nt, Homo sapiens
cucugaaguca

SEQ ID NO: 1475060 - RNA, 12 nt, Homo sapiens
cucugaagucac

SEQ ID NO: 1475061 - RNA, 19 nt, Homo sapiens
cucugaagucacaucacag

SEQ ID NO: 1475062 - RNA, 23 nt, Homo sapiens
cucugaagucacaucacaggaca

SEQ ID NO: 1475063 - RNA, 13 nt, Homo sapiens
cucugaccuguac

SEQ ID NO: 1475064 - RNA, 14 nt, Homo sapiens
cucugagaucuaag

SEQ ID NO: 1475065 - RNA, 15 nt, Homo sapiens
cucugaggcuaugga

SEQ ID NO: 1475066 - RNA, 21 nt, Homo sapiens
cucugcaaugggcacugggau

SEQ ID NO: 1475067 - RNA, 16 nt, Homo sapiens
cucugcagacuuccca

SEQ ID NO: 1475068 - RNA, 20 nt, Homo sapiens
cucugcagacuucccagcua

SEQ ID NO: 1475069 - RNA, 14 nt, Homo sapiens
cucugcauguuaca

SEQ ID NO: 1475070 - RNA, 20 nt, Homo sapiens
cucugccaaaggaugugaua

SEQ ID NO: 1475071 - RNA, 21 nt, Homo sapiens
cucugccaaaggaugugauau

SEQ ID NO: 1475072 - RNA, 13 nt, Homo sapiens
cucugccagugac

SEQ ID NO: 1475073 - RNA, 20 nt, Homo sapiens
cucugccuacagaacuucag

SEQ ID NO: 1475074 - RNA, 16 nt, Homo sapiens
cucugccuacagccag

SEQ ID NO: 1475075 - RNA, 18 nt, Homo sapiens
cucugccuuugacauuua

SEQ ID NO: 1475076 - RNA, 19 nt, Homo sapiens
cucugccuuugacauuuaa

SEQ ID NO: 1475077 - RNA, 20 nt, Homo sapiens
cucugcuacuccauccugaa

SEQ ID NO: 1475078 - RNA, 19 nt, Homo sapiens
cucugcuauuugcuguuau

SEQ ID NO: 1475079 - RNA, 20 nt, Homo sapiens
cucugcuucaguccacagua

SEQ ID NO: 1475080 - RNA, 14 nt, Homo sapiens
cucugcuucuccaa

SEQ ID NO: 1475081 - RNA, 18 nt, Homo sapiens
cucugcuucuccaaggaa

SEQ ID NO: 1475082 - RNA, 18 nt, Homo sapiens
cucuggaaaaugugaccc

SEQ ID NO: 1475083 - RNA, 14 nt, Homo sapiens
cucuggaagaccug

SEQ ID NO: 1475084 - RNA, 18 nt, Homo sapiens
cucuggacagccagugac

SEQ ID NO: 1475085 - RNA, 15 nt, Homo sapiens
cucuggaggccugug

SEQ ID NO: 1475086 - RNA, 17 nt, Homo sapiens
cucuggcacccaucugc

SEQ ID NO: 1475087 - RNA, 22 nt, Homo sapiens
cucuggcuuugccuuggcuuug

SEQ ID NO: 1475088 - RNA, 21 nt, Homo sapiens
cucugggaauuuggagugacc

SEQ ID NO: 1475089 - RNA, 22 nt, Homo sapiens
cucugggaauuuggagugacca

SEQ ID NO: 1475090 - RNA, 18 nt, Homo sapiens
cucugggcuugggcacca

SEQ ID NO: 1475091 - RNA, 21 nt, Homo sapiens
cucuggggucuuuuuaugcau

SEQ ID NO: 1475092 - RNA, 22 nt, Homo sapiens
cucugguaaaugaucacuccag

SEQ ID NO: 1475093 - RNA, 11 nt, Homo sapiens
cucuguaaaac

SEQ ID NO: 1475094 - RNA, 12 nt, Homo sapiens
cucugucagcca

SEQ ID NO: 1475095 - RNA, 18 nt, Homo sapiens
cucuguucccaguaguua

SEQ ID NO: 1475096 - RNA, 22 nt, Homo sapiens
cucuuaagcuuccgccgucuca

SEQ ID NO: 1475097 - RNA, 15 nt, Homo sapiens
cucuuagauucuuaa

SEQ ID NO: 1475098 - RNA, 18 nt, Homo sapiens
cucuuaugugugccuuug

SEQ ID NO: 1475099 - RNA, 16 nt, Homo sapiens
cucuucaaucucuugc

SEQ ID NO: 1475100 - RNA, 23 nt, Homo sapiens
cucuucaccaggugcaugcaugc

SEQ ID NO: 1475101 - RNA, 20 nt, Homo sapiens
cucuuccaaaggcauaagac

SEQ ID NO: 1475102 - RNA, 18 nt, Homo sapiens
cugaccuggagaugcugc

SEQ ID NO: 1475103 - RNA, 21 nt, Homo sapiens
cugaccuugcugauggugaca

SEQ ID NO: 1475104 - RNA, 17 nt, Homo sapiens
cugaccuugugauccac

SEQ ID NO: 1475105 - RNA, 23 nt, Homo sapiens
cugacucaacauguuacugacca

SEQ ID NO: 1475106 - RNA, 17 nt, Homo sapiens
cugacuucaucuggggu

SEQ ID NO: 1475107 - RNA, 20 nt, Homo sapiens
cugacuuguuugucuuccau

SEQ ID NO: 1475108 - RNA, 15 nt, Homo sapiens
cugacuuuuaaccca

SEQ ID NO: 1475109 - RNA, 13 nt, Homo sapiens
cugagaaaccucg

SEQ ID NO: 1475110 - RNA, 21 nt, Homo sapiens
cugagaaauguuaaagguuca

SEQ ID NO: 1475111 - RNA, 15 nt, Homo sapiens
cugagaaauguucag

SEQ ID NO: 1475112 - RNA, 15 nt, Homo sapiens
cugagaauguggaau

SEQ ID NO: 1475113 - RNA, 15 nt, Homo sapiens
cugagacucacagga

SEQ ID NO: 1475114 - RNA, 17 nt, Homo sapiens
cugagaugcucacuuua

SEQ ID NO: 1475115 - RNA, 18 nt, Homo sapiens
cugagauugcagauguga

SEQ ID NO: 1475116 - RNA, 16 nt, Homo sapiens
cugagcagccucugga

SEQ ID NO: 1475117 - RNA, 20 nt, Homo sapiens
cugagcugaacccauuuuga

SEQ ID NO: 1475118 - RNA, 20 nt, Homo sapiens
cugagcugccuguaacuuga

SEQ ID NO: 1475119 - RNA, 19 nt, Homo sapiens
cugagcuggccuccuaugc

SEQ ID NO: 1475120 - RNA, 17 nt, Homo sapiens
cugaggacaaaguggag

SEQ ID NO: 1475121 - RNA, 14 nt, Homo sapiens
cugaggcaagagaa

SEQ ID NO: 1475122 - RNA, 18 nt, Homo sapiens
cugaggcaggaggauugc

SEQ ID NO: 1475123 - RNA, 15 nt, Homo sapiens
cugaggccacacuca

SEQ ID NO: 1475124 - RNA, 22 nt, Homo sapiens
cugaggccacacucagcacaag

SEQ ID NO: 1475125 - RNA, 15 nt, Homo sapiens
cugaggccagaguca

SEQ ID NO: 1475126 - RNA, 22 nt, Homo sapiens
cugaggccuccagcuucaggca

SEQ ID NO: 1475127 - RNA, 19 nt, Homo sapiens
cugaggccuggacuuuccu

SEQ ID NO: 1475128 - RNA, 22 nt, Homo sapiens
cugaggcgcugcuuugucaaaa

SEQ ID NO: 1475129 - RNA, 20 nt, Homo sapiens
cugaggcgggagaaucaugu

SEQ ID NO: 1475130 - RNA, 16 nt, Homo sapiens
cugagggaaagugcau

SEQ ID NO: 1475131 - RNA, 17 nt, Homo sapiens
cugagggaaagugcaua

SEQ ID NO: 1475132 - RNA, 20 nt, Homo sapiens
cugagggacauaucagugac

SEQ ID NO: 1475133 - RNA, 22 nt, Homo sapiens
cugaggguccccaccugggacc

SEQ ID NO: 1475134 - RNA, 17 nt, Homo sapiens
cugaggguguuucuucc

SEQ ID NO: 1475135 - RNA, 15 nt, Homo sapiens
cugagucaucuguua

SEQ ID NO: 1475136 - RNA, 19 nt, Homo sapiens
cugagugggagaaggcagu

SEQ ID NO: 1475137 - RNA, 21 nt, Homo sapiens
cugaguguccagcacaccugc

SEQ ID NO: 1475138 - RNA, 17 nt, Homo sapiens
cugaguguuauuugcac

SEQ ID NO: 1475139 - RNA, 19 nt, Homo sapiens
cugaguguuauuugcacac

SEQ ID NO: 1475140 - RNA, 23 nt, Homo sapiens
cugaguguuauuugcacacugca

SEQ ID NO: 1475141 - RNA, 14 nt, Homo sapiens
cugauaagcauuga

SEQ ID NO: 1475142 - RNA, 15 nt, Homo sapiens
cugauaaguuucaua

SEQ ID NO: 1475143 - RNA, 15 nt, Homo sapiens
cugauaauaauugau

SEQ ID NO: 1475144 - RNA, 17 nt, Homo sapiens
cugauaauaauugauca

SEQ ID NO: 1475145 - RNA, 13 nt, Homo sapiens
cugauaccacugc

SEQ ID NO: 1475146 - RNA, 14 nt, Homo sapiens
cugauaccacugca

SEQ ID NO: 1475147 - RNA, 14 nt, Homo sapiens
cugauaguauuccu

SEQ ID NO: 1475148 - RNA, 16 nt, Homo sapiens
cugaucacuagccugu

SEQ ID NO: 1475149 - RNA, 18 nt, Homo sapiens
cugaucagagguguacac

SEQ ID NO: 1475150 - RNA, 23 nt, Homo sapiens
cugaucccccauagguggcugag

SEQ ID NO: 1475151 - RNA, 19 nt, Homo sapiens
cugaucuuauucuguggug

SEQ ID NO: 1475152 - RNA, 14 nt, Homo sapiens
cugaugacaacuuc

SEQ ID NO: 1475153 - RNA, 12 nt, Homo sapiens
cugaugcugaca

SEQ ID NO: 1475154 - RNA, 15 nt, Homo sapiens
cugaugcugccccuc

SEQ ID NO: 1475155 - RNA, 16 nt, Homo sapiens
cugaugcuuuggugug

SEQ ID NO: 1475156 - RNA, 20 nt, Homo sapiens
cugauggaaguaaagccuca

SEQ ID NO: 1475157 - RNA, 16 nt, Homo sapiens
gacuguuuggcuuaua

SEQ ID NO: 1475158 - RNA, 20 nt, Homo sapiens
gacuuaaacagcagauuuca

SEQ ID NO: 1475159 - RNA, 22 nt, Homo sapiens
gacuuauacuugccuucugaua

SEQ ID NO: 1475160 - RNA, 21 nt, Homo sapiens
gacuucaccuaacuagagaca

SEQ ID NO: 1475161 - RNA, 11 nt, Homo sapiens
gacuucaucug

SEQ ID NO: 1475162 - RNA, 22 nt, Homo sapiens
gacuucaugacaagcauuuugu

SEQ ID NO: 1475163 - RNA, 15 nt, Homo sapiens
gacuuccagugcuca

SEQ ID NO: 1475164 - RNA, 19 nt, Homo sapiens
gacuuccauuugcuuuguc

SEQ ID NO: 1475165 - RNA, 20 nt, Homo sapiens
gacuucugugggccccucaa

SEQ ID NO: 1475166 - RNA, 14 nt, Homo sapiens
gacuugauagcaaa

SEQ ID NO: 1475167 - RNA, 21 nt, Homo sapiens
gacuuggacaggagucagugu

SEQ ID NO: 1475168 - RNA, 17 nt, Homo sapiens
gacuuguccagugcucc

SEQ ID NO: 1475169 - RNA, 19 nt, Homo sapiens
gacuuucaugcagccuaaa

SEQ ID NO: 1475170 - RNA, 14 nt, Homo sapiens
gacuuuuaaucagu

SEQ ID NO: 1475171 - RNA, 16 nt, Homo sapiens
gagaaaauguuguaua

SEQ ID NO: 1475172 - RNA, 15 nt, Homo sapiens
gagaaacaauggcua

SEQ ID NO: 1475173 - RNA, 14 nt, Homo sapiens
gagaaauggccaaa

SEQ ID NO: 1475174 - RNA, 23 nt, Homo sapiens
gagaaauuccuuagucauggugu

SEQ ID NO: 1475175 - RNA, 19 nt, Homo sapiens
gagaacaucauaacccaug

SEQ ID NO: 1475176 - RNA, 19 nt, Homo sapiens
gagaagaaguggcugccac

SEQ ID NO: 1475177 - RNA, 15 nt, Homo sapiens
gagaagauucuugua

SEQ ID NO: 1475178 - RNA, 18 nt, Homo sapiens
gagaaggaaaagacugaa

SEQ ID NO: 1475179 - RNA, 11 nt, Homo sapiens
gagaagugccu

SEQ ID NO: 1475180 - RNA, 17 nt, Homo sapiens
gagaauacuuugcuuca

SEQ ID NO: 1475181 - RNA, 14 nt, Homo sapiens
gagaaucacuggaa

SEQ ID NO: 1475182 - RNA, 15 nt, Homo sapiens
gagaaucugcugcau

SEQ ID NO: 1475183 - RNA, 16 nt, Homo sapiens
gagaauguuguauuca

SEQ ID NO: 1475184 - RNA, 19 nt, Homo sapiens
gagacaagggcaucaucua

SEQ ID NO: 1475185 - RNA, 12 nt, Homo sapiens
gagacagaauag

SEQ ID NO: 1475186 - RNA, 15 nt, Homo sapiens
gagacaggagccuag

SEQ ID NO: 1475187 - RNA, 15 nt, Homo sapiens
gagacaggcaaacug

SEQ ID NO: 1475188 - RNA, 17 nt, Homo sapiens
gagacaggguuucaccg

SEQ ID NO: 1475189 - RNA, 22 nt, Homo sapiens
gagaccaagacucugaaaucuc

SEQ ID NO: 1475190 - RNA, 16 nt, Homo sapiens
gagaccacggggagca

SEQ ID NO: 1475191 - RNA, 16 nt, Homo sapiens
gagacccaacagcagu

SEQ ID NO: 1475192 - RNA, 20 nt, Homo sapiens
gagacccaacagcagugauc

SEQ ID NO: 1475193 - RNA, 23 nt, Homo sapiens
gagacccccacaccucaguuccc

SEQ ID NO: 1475194 - RNA, 14 nt, Homo sapiens
gagacgcaggaaug

SEQ ID NO: 1475195 - RNA, 17 nt, Homo sapiens
gagacguggaaccucug

SEQ ID NO: 1475196 - RNA, 21 nt, Homo sapiens
gagcccagaucgcaccacugc

SEQ ID NO: 1475197 - RNA, 12 nt, Homo sapiens
gagcccagugaa

SEQ ID NO: 1475198 - RNA, 15 nt, Homo sapiens
gagcccauccagucu

SEQ ID NO: 1475199 - RNA, 18 nt, Homo sapiens
gagccccagggugcccag

SEQ ID NO: 1475200 - RNA, 15 nt, Homo sapiens
gagcccccaccacaa

SEQ ID NO: 1475201 - RNA, 17 nt, Homo sapiens
gagccccccacaaugau

SEQ ID NO: 1475202 - RNA, 18 nt, Homo sapiens
gagccccuacagcauugu

SEQ ID NO: 1475203 - RNA, 20 nt, Homo sapiens
gagcccuaaaaauccagacu

SEQ ID NO: 1475204 - RNA, 13 nt, Homo sapiens
gagcccuugccca

SEQ ID NO: 1475205 - RNA, 12 nt, Homo sapiens
gagccgcuguga

SEQ ID NO: 1475206 - RNA, 21 nt, Homo sapiens
gagccggcugccuaccagggg

SEQ ID NO: 1475207 - RNA, 17 nt, Homo sapiens
gagccuagcuccugcca

SEQ ID NO: 1475208 - RNA, 16 nt, Homo sapiens
gagccuccacugccuc

SEQ ID NO: 1475209 - RNA, 17 nt, Homo sapiens
gagccuccacugccucu

SEQ ID NO: 1475210 - RNA, 17 nt, Homo sapiens
gagccucgggacaucaa

SEQ ID NO: 1475211 - RNA, 16 nt, Homo sapiens
gagccugcugcauggg

SEQ ID NO: 1475212 - RNA, 14 nt, Homo sapiens
gagcuacugaugaa

SEQ ID NO: 1475213 - RNA, 12 nt, Homo sapiens
gagcucuuggcc

SEQ ID NO: 1475214 - RNA, 22 nt, Homo sapiens
gagcugaacccauuuugaguga

SEQ ID NO: 1475215 - RNA, 20 nt, Homo sapiens
gagcugaugaaacucacaaa

SEQ ID NO: 1475216 - RNA, 22 nt, Homo sapiens
gagcugcacugaucacccaaug

SEQ ID NO: 1475217 - RNA, 16 nt, Homo sapiens
gagcugcucaccggag

SEQ ID NO: 1475218 - RNA, 17 nt, Homo sapiens
gagcugcucucucauga

SEQ ID NO: 1475219 - RNA, 21 nt, Homo sapiens
gagcugggaccaguaccuggg

SEQ ID NO: 1475220 - RNA, 16 nt, Homo sapiens
gagcugucugaacuca

SEQ ID NO: 1475221 - RNA, 20 nt, Homo sapiens
gagcuguuuucccugaccuc

SEQ ID NO: 1475222 - RNA, 18 nt, Homo sapiens
gagcuucauauaccagca

SEQ ID NO: 1475223 - RNA, 21 nt, Homo sapiens
gaggaaaaguaaggugcaguu

SEQ ID NO: 1475224 - RNA, 22 nt, Homo sapiens
gaggaaaaguaaggugcaguuc

SEQ ID NO: 1475225 - RNA, 14 nt, Homo sapiens
gaggaaauccauug

SEQ ID NO: 1475226 - RNA, 22 nt, Homo sapiens
gaggaagaacuacagcucuuaa

SEQ ID NO: 1475227 - RNA, 19 nt, Homo sapiens
gaggaaggaacagcaaugg

SEQ ID NO: 1475228 - RNA, 23 nt, Homo sapiens
gaggaagggcaaaaccacuagaa

SEQ ID NO: 1475229 - RNA, 20 nt, Homo sapiens
gaggaaugcuggacuggagg

SEQ ID NO: 1475230 - RNA, 15 nt, Homo sapiens
gaggaauuggccgcu

SEQ ID NO: 1475231 - RNA, 22 nt, Homo sapiens
gaggacauucuggaaaagcaaa

SEQ ID NO: 1475232 - RNA, 14 nt, Homo sapiens
gaggaguaauggca

SEQ ID NO: 1475233 - RNA, 14 nt, Homo sapiens
gaggcaaugggagc

SEQ ID NO: 1475234 - RNA, 20 nt, Homo sapiens
gaggcagagcuugcagugag

SEQ ID NO: 1475235 - RNA, 20 nt, Homo sapiens
gaggcagaggcugcauugag

SEQ ID NO: 1475236 - RNA, 17 nt, Homo sapiens
gaggcagauagcacugg

SEQ ID NO: 1475237 - RNA, 14 nt, Homo sapiens
gaggcagaucuuug

SEQ ID NO: 1475238 - RNA, 12 nt, Homo sapiens
gaggcaggugag

SEQ ID NO: 1475239 - RNA, 17 nt, Homo sapiens
gaggcauacacacagca

SEQ ID NO: 1475240 - RNA, 20 nt, Homo sapiens
gaggcaucaguugcuauaua

SEQ ID NO: 1475241 - RNA, 11 nt, Homo sapiens
gaggcaucuga

SEQ ID NO: 1475242 - RNA, 13 nt, Homo sapiens
gaggcauuauuug

SEQ ID NO: 1475243 - RNA, 16 nt, Homo sapiens
gaggccaagccacuca

SEQ ID NO: 1475244 - RNA, 16 nt, Homo sapiens
gaggccacacucagca

SEQ ID NO: 1475245 - RNA, 13 nt, Homo sapiens
gaggccacagcug

SEQ ID NO: 1475246 - RNA, 12 nt, Homo sapiens
gaggccaucuca

SEQ ID NO: 1475247 - RNA, 21 nt, Homo sapiens
gaggcccccuggugugucuga

SEQ ID NO: 1475248 - RNA, 19 nt, Homo sapiens
gaggccccuggagccagau

SEQ ID NO: 1475249 - RNA, 19 nt, Homo sapiens
gaggcccugagacagggau

SEQ ID NO: 1475250 - RNA, 18 nt, Homo sapiens
gaggcccugcccaaugag

SEQ ID NO: 1475251 - RNA, 21 nt, Homo sapiens
gaggccucaggugcuguccau

SEQ ID NO: 1475252 - RNA, 17 nt, Homo sapiens
gaggccugugcuugugu

SEQ ID NO: 1475253 - RNA, 20 nt, Homo sapiens
gaggcggagguugcaaugag

SEQ ID NO: 1475254 - RNA, 21 nt, Homo sapiens
gaggcugagccuacagaugaa

SEQ ID NO: 1475255 - RNA, 18 nt, Homo sapiens
gaggcugaggcgggugga

SEQ ID NO: 1475256 - RNA, 21 nt, Homo sapiens
gaggcuucuccgccagccucc

SEQ ID NO: 1475257 - RNA, 15 nt, Homo sapiens
gaggcuuuacagugu

SEQ ID NO: 1475258 - RNA, 14 nt, Homo sapiens
gagggaaagugcau

SEQ ID NO: 1475259 - RNA, 23 nt, Homo sapiens
gagggaagaaugaacacucccca

SEQ ID NO: 1475260 - RNA, 14 nt, Homo sapiens
gagggagggcggug

SEQ ID NO: 1475261 - RNA, 16 nt, Homo sapiens
gagggagggcggugga

SEQ ID NO: 1475262 - RNA, 16 nt, Homo sapiens
gagggagguaacgggu

SEQ ID NO: 1475263 - RNA, 20 nt, Homo sapiens
gagggaguggguuaaacaca

SEQ ID NO: 1475264 - RNA, 16 nt, Homo sapiens
gagggcagacuggggc

SEQ ID NO: 1475265 - RNA, 14 nt, Homo sapiens
gagggcagggacca

SEQ ID NO: 1475266 - RNA, 13 nt, Homo sapiens
gagggcauuccau

SEQ ID NO: 1475267 - RNA, 15 nt, Homo sapiens
gagggccucaaucuc

SEQ ID NO: 1475268 - RNA, 15 nt, Homo sapiens
gaggggaagggccag

SEQ ID NO: 1475269 - RNA, 17 nt, Homo sapiens
gagggggaguagccaag

SEQ ID NO: 1475270 - RNA, 19 nt, Homo sapiens
gagggggcuugaagccaaa

SEQ ID NO: 1475271 - RNA, 16 nt, Homo sapiens
gagggugaaaggcagg

SEQ ID NO: 1475272 - RNA, 18 nt, Homo sapiens
gagggugggguaaccaaa

SEQ ID NO: 1475273 - RNA, 23 nt, Homo sapiens
gaggguuggguucaucugagcaa

SEQ ID NO: 1475274 - RNA, 15 nt, Homo sapiens
gaggucucccaaacg

SEQ ID NO: 1475275 - RNA, 16 nt, Homo sapiens
gaggugcaacaagguc

SEQ ID NO: 1475276 - RNA, 15 nt, Homo sapiens
gaggugggaggugga

SEQ ID NO: 1475277 - RNA, 21 nt, Homo sapiens
gagguguacacuaacauuucc

SEQ ID NO: 1475278 - RNA, 14 nt, Homo sapiens
gagguugaagccaa

SEQ ID NO: 1475279 - RNA, 15 nt, Homo sapiens
gagguugaagccaag

SEQ ID NO: 1475280 - RNA, 15 nt, Homo sapiens
gaguaaaccuugaag

SEQ ID NO: 1475281 - RNA, 18 nt, Homo sapiens
gaguaauacaucaaagag

SEQ ID NO: 1475282 - RNA, 16 nt, Homo sapiens
gaguacagugagccaa

SEQ ID NO: 1475283 - RNA, 15 nt, Homo sapiens
gaguaccauaauucu

SEQ ID NO: 1475284 - RNA, 12 nt, Homo sapiens
gaguaccuggac

SEQ ID NO: 1475285 - RNA, 15 nt, Homo sapiens
gagucacugccaagu

SEQ ID NO: 1475286 - RNA, 16 nt, Homo sapiens
gagucagaucuuucuc

SEQ ID NO: 1475287 - RNA, 22 nt, Homo sapiens
gagucaggcaggguuaaacugc

SEQ ID NO: 1475288 - RNA, 13 nt, Homo sapiens
gagucagucuuca

SEQ ID NO: 1475289 - RNA, 22 nt, Homo sapiens
gagucaucuauucaagcacuua

SEQ ID NO: 1475290 - RNA, 19 nt, Homo sapiens
gagucauuuaugagcagaa

SEQ ID NO: 1475291 - RNA, 20 nt, Homo sapiens
gaguccauggugucaugcca

SEQ ID NO: 1475292 - RNA, 21 nt, Homo sapiens
gaguccauggugucaugccaa

SEQ ID NO: 1475293 - RNA, 14 nt, Homo sapiens
gagucuacagagaa

SEQ ID NO: 1475294 - RNA, 18 nt, Homo sapiens
gagucuccucucugagac

SEQ ID NO: 1475295 - RNA, 17 nt, Homo sapiens
gagucucuucuccacug

SEQ ID NO: 1475296 - RNA, 18 nt, Homo sapiens
gagucugaacagcuguaa

SEQ ID NO: 1475297 - RNA, 22 nt, Homo sapiens
gagugacggucccacacuggug

SEQ ID NO: 1475298 - RNA, 16 nt, Homo sapiens
gagugacuaguacaaa

SEQ ID NO: 1475299 - RNA, 15 nt, Homo sapiens
gagugagcacucacg

SEQ ID NO: 1475300 - RNA, 22 nt, Homo sapiens
gagugcaacccagucacacugu

SEQ ID NO: 1475301 - RNA, 20 nt, Homo sapiens
gagugcaccacuucaaguga

SEQ ID NO: 1475302 - RNA, 19 nt, Homo sapiens
gagugcaguggcgugaucu

SEQ ID NO: 1475303 - RNA, 19 nt, Homo sapiens
gagugcaguggugugaucu

SEQ ID NO: 1475304 - RNA, 21 nt, Homo sapiens
gagugccguaacaacuguggu

SEQ ID NO: 1475305 - RNA, 14 nt, Homo sapiens
gagugcuggcacuu

SEQ ID NO: 1475306 - RNA, 14 nt, Homo sapiens
gaguggaucuccaa

SEQ ID NO: 1475307 - RNA, 15 nt, Homo sapiens
gagugucacaucucu

SEQ ID NO: 1475308 - RNA, 21 nt, Homo sapiens
gaguguccggcugaggccuga

SEQ ID NO: 1475309 - RNA, 18 nt, Homo sapiens
gagugugacagggccagu

SEQ ID NO: 1475310 - RNA, 19 nt, Homo sapiens
gaguguuucuuccacaaca

SEQ ID NO: 1475311 - RNA, 17 nt, Homo sapiens
gaguuacuuccuaucaa

SEQ ID NO: 1475312 - RNA, 21 nt, Homo sapiens
gaguuccuuaucccucucuuc

SEQ ID NO: 1475313 - RNA, 22 nt, Homo sapiens
gaguugagucuccucucugaga

SEQ ID NO: 1475314 - RNA, 17 nt, Homo sapiens
gaguugucaagucucug

SEQ ID NO: 1475315 - RNA, 17 nt, Homo sapiens
gaguuuuguauucaaua

SEQ ID NO: 1475316 - RNA, 20 nt, Homo sapiens
gaguuuuuccucccagugag

SEQ ID NO: 1475317 - RNA, 10 nt, Homo sapiens
gauaaacuag

SEQ ID NO: 1475318 - RNA, 17 nt, Homo sapiens
gauaaagagacagugau

SEQ ID NO: 1475319 - RNA, 14 nt, Homo sapiens
gauaacacuggcuu

SEQ ID NO: 1475320 - RNA, 18 nt, Homo sapiens
gauaacaguuacuccagu

SEQ ID NO: 1475321 - RNA, 17 nt, Homo sapiens
gauaacuugagcaccgu

SEQ ID NO: 1475322 - RNA, 14 nt, Homo sapiens
gauaauaucuuugu

SEQ ID NO: 1475323 - RNA, 12 nt, Homo sapiens
gauacaaacugc

SEQ ID NO: 1475324 - RNA, 14 nt, Homo sapiens
gauacaaacugcag

SEQ ID NO: 1475325 - RNA, 20 nt, Homo sapiens
gauacagccuuccguaucca

SEQ ID NO: 1475326 - RNA, 21 nt, Homo sapiens
gauacaucacugcuugaugaa

SEQ ID NO: 1475327 - RNA, 13 nt, Homo sapiens
gauaccacugcac

SEQ ID NO: 1475328 - RNA, 17 nt, Homo sapiens
gauacccagagcauuac

SEQ ID NO: 1475329 - RNA, 21 nt, Homo sapiens
gauaccucaacccccauuucu

SEQ ID NO: 1475330 - RNA, 15 nt, Homo sapiens
gauacuucacuacuu

SEQ ID NO: 1475331 - RNA, 22 nt, Homo sapiens
gauagacuuauugccaaaaaca

SEQ ID NO: 1475332 - RNA, 20 nt, Homo sapiens
gauauaacacuauguuuauu

SEQ ID NO: 1475333 - RNA, 22 nt, Homo sapiens
gauauaacauucaguucccacc

SEQ ID NO: 1475334 - RNA, 23 nt, Homo sapiens
gauauaauuuaacuguguuuuag

SEQ ID NO: 1475335 - RNA, 16 nt, Homo sapiens
uacuaaggaaucuuuc

SEQ ID NO: 1475336 - RNA, 20 nt, Homo sapiens
uacuaauaugccuagcacaa

SEQ ID NO: 1475337 - RNA, 14 nt, Homo sapiens
uacuaccuguguau

SEQ ID NO: 1475338 - RNA, 13 nt, Homo sapiens
uacuaccuugaaa

SEQ ID NO: 1475339 - RNA, 22 nt, Homo sapiens
uacuaguuuuaguuuucucuua

SEQ ID NO: 1475340 - RNA, 14 nt, Homo sapiens
uacuaguuuucaau

SEQ ID NO: 1475341 - RNA, 15 nt, Homo sapiens
uacuaucauaauuca

SEQ ID NO: 1475342 - RNA, 16 nt, Homo sapiens
uacuaucauggcauau

SEQ ID NO: 1475343 - RNA, 22 nt, Homo sapiens
uacuccaguauaugcugaugga

SEQ ID NO: 1475344 - RNA, 16 nt, Homo sapiens
uacuccuuccaucaaa

SEQ ID NO: 1475345 - RNA, 14 nt, Homo sapiens
ggcaccugggucca

SEQ ID NO: 1475346 - RNA, 22 nt, Homo sapiens
ggcaccuuaagauuuugcaccu

SEQ ID NO: 1475347 - RNA, 14 nt, Homo sapiens
ggcaccuucaccug

SEQ ID NO: 1475348 - RNA, 20 nt, Homo sapiens
ggcacuccuggagauaugaa

SEQ ID NO: 1475349 - RNA, 21 nt, Homo sapiens
ggcacuugcugaggccaagcc

SEQ ID NO: 1475350 - RNA, 15 nt, Homo sapiens
ggcagaaccaaagcu

SEQ ID NO: 1475351 - RNA, 21 nt, Homo sapiens
ggcagaaggaagcagguguga

SEQ ID NO: 1475352 - RNA, 13 nt, Homo sapiens
ggcagagccuuug

SEQ ID NO: 1475353 - RNA, 17 nt, Homo sapiens
ggcagauggggcacuga

SEQ ID NO: 1475354 - RNA, 15 nt, Homo sapiens
ggcagcacagugugu

SEQ ID NO: 1475355 - RNA, 23 nt, Homo sapiens
ggcagcccagcccuccucuguca

SEQ ID NO: 1475356 - RNA, 14 nt, Homo sapiens
ggcagcgccaagug

SEQ ID NO: 1475357 - RNA, 15 nt, Homo sapiens
ggcagcggguggcau

SEQ ID NO: 1475358 - RNA, 16 nt, Homo sapiens
ggcagcuagugccuuu

SEQ ID NO: 1475359 - RNA, 20 nt, Homo sapiens
ggcaggagaauggcgugaac

SEQ ID NO: 1475360 - RNA, 21 nt, Homo sapiens
ggcaggccuggacuuccagug

SEQ ID NO: 1475361 - RNA, 15 nt, Homo sapiens
ggcaggucacuuuac

SEQ ID NO: 1475362 - RNA, 20 nt, Homo sapiens
ggcaguggaagcaguuucag

SEQ ID NO: 1475363 - RNA, 17 nt, Homo sapiens
ggcaguggaugggugcu

SEQ ID NO: 1475364 - RNA, 22 nt, Homo sapiens
ggcaguggcccuccaccuuguu

SEQ ID NO: 1475365 - RNA, 16 nt, Homo sapiens
ggcauaauagucaauu

SEQ ID NO: 1475366 - RNA, 13 nt, Homo sapiens
ggcaucaaacagg

SEQ ID NO: 1475367 - RNA, 22 nt, Homo sapiens
ggcaucaaacagggcaaagugu

SEQ ID NO: 1475368 - RNA, 22 nt, Homo sapiens
ggccaagcauuucuagcaguga

SEQ ID NO: 1475369 - RNA, 13 nt, Homo sapiens
ggccaagccacuc

SEQ ID NO: 1475370 - RNA, 23 nt, Homo sapiens
ggccaagguggguggaucacuug

SEQ ID NO: 1475371 - RNA, 19 nt, Homo sapiens
ggccaaugggagagcucuu

SEQ ID NO: 1475372 - RNA, 19 nt, Homo sapiens
ggccacaacagggcauuuu

SEQ ID NO: 1475373 - RNA, 15 nt, Homo sapiens
ggccacccagccagg

SEQ ID NO: 1475374 - RNA, 22 nt, Homo sapiens
ggccacccccuauccucugagu

SEQ ID NO: 1475375 - RNA, 21 nt, Homo sapiens
ggccaccccuaggaacucagu

SEQ ID NO: 1475376 - RNA, 20 nt, Homo sapiens
ggccacccgcccacagccag

SEQ ID NO: 1475377 - RNA, 15 nt, Homo sapiens
ggccacccugugcag

SEQ ID NO: 1475378 - RNA, 21 nt, Homo sapiens
ggccaccuguagccaucugca

SEQ ID NO: 1475379 - RNA, 20 nt, Homo sapiens
ggccagagggcaguggcccu

SEQ ID NO: 1475380 - RNA, 13 nt, Homo sapiens
ggccagauccagc

SEQ ID NO: 1475381 - RNA, 13 nt, Homo sapiens
ggccagccagugc

SEQ ID NO: 1475382 - RNA, 23 nt, Homo sapiens
ggccagucaggcugcagaggcac

SEQ ID NO: 1475383 - RNA, 16 nt, Homo sapiens
ggccagugaacagggu

SEQ ID NO: 1475384 - RNA, 15 nt, Homo sapiens
ggccagugggcgggc

SEQ ID NO: 1475385 - RNA, 15 nt, Homo sapiens
ggccauaaagaucaa

SEQ ID NO: 1475386 - RNA, 14 nt, Homo sapiens
ggccauacugccuu

SEQ ID NO: 1475387 - RNA, 18 nt, Homo sapiens
ggccaugagggacagggu

SEQ ID NO: 1475388 - RNA, 14 nt, Homo sapiens
ggcccaagagcaga

SEQ ID NO: 1475389 - RNA, 12 nt, Homo sapiens
ggcccagaaaca

SEQ ID NO: 1475390 - RNA, 17 nt, Homo sapiens
ggcccagagcaggaagc

SEQ ID NO: 1475391 - RNA, 20 nt, Homo sapiens
ggcccaggagaccacgggga

SEQ ID NO: 1475392 - RNA, 15 nt, Homo sapiens
ggcccauacugguug

SEQ ID NO: 1475393 - RNA, 14 nt, Homo sapiens
ggccccuccaucca

SEQ ID NO: 1475394 - RNA, 22 nt, Homo sapiens
ggccccucccgccccuucccac

SEQ ID NO: 1475395 - RNA, 19 nt, Homo sapiens
ggcccgacagccuggcaca

SEQ ID NO: 1475396 - RNA, 15 nt, Homo sapiens
ggcccgcaccgcugg

SEQ ID NO: 1475397 - RNA, 22 nt, Homo sapiens
ggcccgcagugcugggaccaga

SEQ ID NO: 1475398 - RNA, 23 nt, Homo sapiens
ggcccggccagcgggcacagggc

SEQ ID NO: 1475399 - RNA, 22 nt, Homo sapiens
ggcccucccaucuccccgcuga

SEQ ID NO: 1475400 - RNA, 15 nt, Homo sapiens
ggcccugcugaguca

SEQ ID NO: 1475401 - RNA, 19 nt, Homo sapiens
ggcccugcugcccaaucuc

SEQ ID NO: 1475402 - RNA, 17 nt, Homo sapiens
ggccgcccugcggguga

SEQ ID NO: 1475403 - RNA, 22 nt, Homo sapiens
ggccggggcccugcaccugugc

SEQ ID NO: 1475404 - RNA, 16 nt, Homo sapiens
ggccuacggagucagc

SEQ ID NO: 1475405 - RNA, 24 nt, Homo sapiens
ggccuaggcuaccucaagacucac

SEQ ID NO: 1475406 - RNA, 14 nt, Homo sapiens
ggccuauuccagga

SEQ ID NO: 1475407 - RNA, 12 nt, Homo sapiens
ggccucccucag

SEQ ID NO: 1475408 - RNA, 16 nt, Homo sapiens
ggccucccugccagua

SEQ ID NO: 1475409 - RNA, 22 nt, Homo sapiens
ggccuccuguggccugccaguc

SEQ ID NO: 1475410 - RNA, 16 nt, Homo sapiens
ggccucuggcucucau

SEQ ID NO: 1475411 - RNA, 15 nt, Homo sapiens
ggccugcacuggugu

SEQ ID NO: 1475412 - RNA, 17 nt, Homo sapiens
ggccugcccucagggau

SEQ ID NO: 1475413 - RNA, 14 nt, Homo sapiens
ggccugcuccagac

SEQ ID NO: 1475414 - RNA, 19 nt, Homo sapiens
ggccugcugccagugcagc

SEQ ID NO: 1475415 - RNA, 15 nt, Homo sapiens
ggccuggcugcagcu

SEQ ID NO: 1475416 - RNA, 16 nt, Homo sapiens
ggccuggggccugaga

SEQ ID NO: 1475417 - RNA, 21 nt, Homo sapiens
ggccuggggcgagcacuguga

SEQ ID NO: 1475418 - RNA, 14 nt, Homo sapiens
ggccuguccuccaa

SEQ ID NO: 1475419 - RNA, 18 nt, Homo sapiens
ggccugugcgugccaucc

SEQ ID NO: 1475420 - RNA, 14 nt, Homo sapiens
ggccugugugugaa

SEQ ID NO: 1475421 - RNA, 11 nt, Homo sapiens
ggccuucucac

SEQ ID NO: 1475422 - RNA, 13 nt, Homo sapiens
ggccuugcugagu

SEQ ID NO: 1475423 - RNA, 15 nt, Homo sapiens
ggccuuugcauuuau

SEQ ID NO: 1475424 - RNA, 18 nt, Homo sapiens
gguggcauacagacuggg

SEQ ID NO: 1475425 - RNA, 22 nt, Homo sapiens
gguggcccuaaaggacucucca

SEQ ID NO: 1475426 - RNA, 17 nt, Homo sapiens
gguggcucacgccugua

SEQ ID NO: 1475427 - RNA, 11 nt, Homo sapiens
ggugggguccu

SEQ ID NO: 1475428 - RNA, 20 nt, Homo sapiens
ggugguauguaauuuaugca

SEQ ID NO: 1475429 - RNA, 24 nt, Homo sapiens
gguguacuuauauccacacugcac

SEQ ID NO: 1475430 - RNA, 24 nt, Homo sapiens
gguguagaugggggaacugugaau

SEQ ID NO: 1475431 - RNA, 16 nt, Homo sapiens
gguguauguaugagua

SEQ ID NO: 1475432 - RNA, 9 nt, Homo sapiens
ggugucaau

SEQ ID NO: 1475433 - RNA, 15 nt, Homo sapiens
ggugugagcuucaga

SEQ ID NO: 1475434 - RNA, 19 nt, Homo sapiens
ggugugcugagguguuaga

SEQ ID NO: 1475435 - RNA, 18 nt, Homo sapiens
gguguuuuaagacugaau

SEQ ID NO: 1475436 - RNA, 22 nt, Homo sapiens
gguucccaauaaaagugacucu

SEQ ID NO: 1475437 - RNA, 19 nt, Homo sapiens
gguucucagguguugccaa

SEQ ID NO: 1475438 - RNA, 15 nt, Homo sapiens
gguuggcaccugcac

SEQ ID NO: 1475439 - RNA, 18 nt, Homo sapiens
gguuggcccccacguggg

SEQ ID NO: 1475440 - RNA, 19 nt, Homo sapiens
gguugucuuauugcaccau

SEQ ID NO: 1475441 - RNA, 17 nt, Homo sapiens
gguuuaauucagcagag

SEQ ID NO: 1475442 - RNA, 16 nt, Homo sapiens
gguuugagaugcugua

SEQ ID NO: 1475443 - RNA, 17 nt, Homo sapiens
gguuuguugcagccaaa

SEQ ID NO: 1475444 - RNA, 13 nt, Homo sapiens
gauauacauauca

SEQ ID NO: 1475445 - RNA, 13 nt, Homo sapiens
gauauacuggccc

SEQ ID NO: 1475446 - RNA, 22 nt, Homo sapiens
gauauauauaugcuuggcuaac

SEQ ID NO: 1475447 - RNA, 17 nt, Homo sapiens
gauauauuuaagccuua

SEQ ID NO: 1475448 - RNA, 13 nt, Homo sapiens
gauaucacuucca

SEQ ID NO: 1475449 - RNA, 14 nt, Homo sapiens
gauaucaugcaaau

SEQ ID NO: 1475450 - RNA, 13 nt, Homo sapiens
gauauuaaaggag

SEQ ID NO: 1475451 - RNA, 18 nt, Homo sapiens
gauauucaggcuacucau

SEQ ID NO: 1475452 - RNA, 14 nt, Homo sapiens
gauauuggcuuaaa

SEQ ID NO: 1475453 - RNA, 15 nt, Homo sapiens
gauauuuccauuucu

SEQ ID NO: 1475454 - RNA, 22 nt, Homo sapiens
gaucaaaauaaaaagugacaca

SEQ ID NO: 1475455 - RNA, 14 nt, Homo sapiens
gaucaaaaucaauu

SEQ ID NO: 1475456 - RNA, 15 nt, Homo sapiens
gaucaaauacuuuaa

SEQ ID NO: 1475457 - RNA, 15 nt, Homo sapiens
gaucaaauauuucaa

SEQ ID NO: 1475458 - RNA, 18 nt, Homo sapiens
gaucaacgccucacugaa

SEQ ID NO: 1475459 - RNA, 17 nt, Homo sapiens
gaucaaggaguacaaug

SEQ ID NO: 1475460 - RNA, 18 nt, Homo sapiens
gaucaauucccucucuca

SEQ ID NO: 1475461 - RNA, 16 nt, Homo sapiens
gaucagcaucugugau

SEQ ID NO: 1475462 - RNA, 13 nt, Homo sapiens
gaucauauuucac

SEQ ID NO: 1475463 - RNA, 16 nt, Homo sapiens
gaucaucagugauacu

SEQ ID NO: 1475464 - RNA, 17 nt, Homo sapiens
gaucaugucucacuuca

SEQ ID NO: 1475465 - RNA, 23 nt, Homo sapiens
gaucauuugcccuuaaggacaaa

SEQ ID NO: 1475466 - RNA, 21 nt, Homo sapiens
gaucauuuuuaacugauucuu

SEQ ID NO: 1475467 - RNA, 17 nt, Homo sapiens
gauccacuaugccuuaa

SEQ ID NO: 1475468 - RNA, 17 nt, Homo sapiens
gauccagaacugcacuc

SEQ ID NO: 1475469 - RNA, 15 nt, Homo sapiens
gauccaggugccaag

SEQ ID NO: 1475470 - RNA, 23 nt, Homo sapiens
gauccccaaguggugaaugacac

SEQ ID NO: 1475471 - RNA, 14 nt, Homo sapiens
gauccgagucuacc

SEQ ID NO: 1475472 - RNA, 16 nt, Homo sapiens
gauccuuuuuccauca

SEQ ID NO: 1475473 - RNA, 20 nt, Homo sapiens
gaucgcaccacugcacucca

SEQ ID NO: 1475474 - RNA, 20 nt, Homo sapiens
gaucgcaccauugcacucca

SEQ ID NO: 1475475 - RNA, 20 nt, Homo sapiens
gaucggagccuccucucuca

SEQ ID NO: 1475476 - RNA, 20 nt, Homo sapiens
gaucgugcuacugcacucca

SEQ ID NO: 1475477 - RNA, 22 nt, Homo sapiens
gaucguuuuuucccagggcaag

SEQ ID NO: 1475478 - RNA, 21 nt, Homo sapiens
gaucuaaggaugucacagggc

SEQ ID NO: 1475479 - RNA, 13 nt, Homo sapiens
gaucuaccagcau

SEQ ID NO: 1475480 - RNA, 21 nt, Homo sapiens
gaucucaauuugcaguauuca

SEQ ID NO: 1475481 - RNA, 14 nt, Homo sapiens
gaucucagggcaga

SEQ ID NO: 1475482 - RNA, 19 nt, Homo sapiens
gaucuccaaggaccagguu

SEQ ID NO: 1475483 - RNA, 17 nt, Homo sapiens
gaucuccauauguuaca

SEQ ID NO: 1475484 - RNA, 15 nt, Homo sapiens
gaucucccacugcgg

SEQ ID NO: 1475485 - RNA, 15 nt, Homo sapiens
gaucuccccacucua

SEQ ID NO: 1475486 - RNA, 18 nt, Homo sapiens
gaucugcaguuuuugccu

SEQ ID NO: 1475487 - RNA, 21 nt, Homo sapiens
gaucuggucuaguuaaccuag

SEQ ID NO: 1475488 - RNA, 13 nt, Homo sapiens
gaucugugauagu

SEQ ID NO: 1475489 - RNA, 11 nt, Homo sapiens
gaucugugguc

SEQ ID NO: 1475490 - RNA, 19 nt, Homo sapiens
gaucuguuuugaaggcaaa

SEQ ID NO: 1475491 - RNA, 18 nt, Homo sapiens
gaucuuaaagcauucccc

SEQ ID NO: 1475492 - RNA, 23 nt, Homo sapiens
gaucuucuucauccaacuuccaa

SEQ ID NO: 1475493 - RNA, 16 nt, Homo sapiens
gaucuugcauucccag

SEQ ID NO: 1475494 - RNA, 17 nt, Homo sapiens
gaucuugccacauuucu

SEQ ID NO: 1475495 - RNA, 19 nt, Homo sapiens
gaugaaaaugaaucuucac

SEQ ID NO: 1475496 - RNA, 20 nt, Homo sapiens
gaugaaaaugaaucuucaca

SEQ ID NO: 1475497 - RNA, 17 nt, Homo sapiens
gaugaaauuauuuguca

SEQ ID NO: 1475498 - RNA, 14 nt, Homo sapiens
gaugaacaucuaac

SEQ ID NO: 1475499 - RNA, 21 nt, Homo sapiens
gaugaaguuuuacauuguuga

SEQ ID NO: 1475500 - RNA, 13 nt, Homo sapiens
gaugacaaccucc

SEQ ID NO: 1475501 - RNA, 14 nt, Homo sapiens
gaugacacaauccc

SEQ ID NO: 1475502 - RNA, 24 nt, Homo sapiens
gaugacacccacccugugccauca

SEQ ID NO: 1475503 - RNA, 14 nt, Homo sapiens
gaugaggcccucau

SEQ ID NO: 1475504 - RNA, 14 nt, Homo sapiens
gaugauacauccaa

SEQ ID NO: 1475505 - RNA, 17 nt, Homo sapiens
gaugauauaauuuaacu

SEQ ID NO: 1475506 - RNA, 13 nt, Homo sapiens
gaugaucuacuca

SEQ ID NO: 1475507 - RNA, 21 nt, Homo sapiens
gaugaucuggauccaccaaga

SEQ ID NO: 1475508 - RNA, 10 nt, Homo sapiens
gaugaugcug

SEQ ID NO: 1475509 - RNA, 16 nt, Homo sapiens
gaugauggcucauuua

SEQ ID NO: 1475510 - RNA, 21 nt, Homo sapiens
gaugauggcucauuuacacuc

SEQ ID NO: 1475511 - RNA, 18 nt, Homo sapiens
gaugauuuaauauggauu

SEQ ID NO: 1475512 - RNA, 16 nt, Homo sapiens
gaugcacuuaugcagu

SEQ ID NO: 1475513 - RNA, 17 nt, Homo sapiens
gaugcacuuauucaaua

SEQ ID NO: 1475514 - RNA, 15 nt, Homo sapiens
gaugcguucacucca

SEQ ID NO: 1475515 - RNA, 13 nt, Homo sapiens
gaugcucccucag

SEQ ID NO: 1475516 - RNA, 20 nt, Homo sapiens
gaugcucugaacccugagca

SEQ ID NO: 1475517 - RNA, 11 nt, Homo sapiens
gaugcugcuau

SEQ ID NO: 1475518 - RNA, 21 nt, Homo sapiens
gauggaauuauuguaccauuu

SEQ ID NO: 1475519 - RNA, 19 nt, Homo sapiens
gauggaccagugguuucca

SEQ ID NO: 1475520 - RNA, 21 nt, Homo sapiens
gauggaccuccuucgcuggaa

SEQ ID NO: 1475521 - RNA, 17 nt, Homo sapiens
gauggaggggugguccu

SEQ ID NO: 1475522 - RNA, 22 nt, Homo sapiens
gauggaugaaucucccacucca

SEQ ID NO: 1475523 - RNA, 23 nt, Homo sapiens
gauggccacccgcccacagccag

SEQ ID NO: 1475524 - RNA, 22 nt, Homo sapiens
gauggccacugugaauaacugu

SEQ ID NO: 1475525 - RNA, 17 nt, Homo sapiens
gauggccuuacacugaa

SEQ ID NO: 1475526 - RNA, 17 nt, Homo sapiens
gauggcucgugggaugu

SEQ ID NO: 1475527 - RNA, 20 nt, Homo sapiens
gaugggcggacggcugugga

SEQ ID NO: 1475528 - RNA, 20 nt, Homo sapiens
gauguaucccugccccgugg

SEQ ID NO: 1475529 - RNA, 13 nt, Homo sapiens
gauguaugaucuc

SEQ ID NO: 1475530 - RNA, 18 nt, Homo sapiens
gaugucauauuccauuuu

SEQ ID NO: 1475531 - RNA, 13 nt, Homo sapiens
gaugugaagccaa

SEQ ID NO: 1475532 - RNA, 22 nt, Homo sapiens
gaugugaauuauugacacugaa

SEQ ID NO: 1475533 - RNA, 17 nt, Homo sapiens
gaugugagccaccgugc

SEQ ID NO: 1475534 - RNA, 19 nt, Homo sapiens
gauguggagcuacugauga

SEQ ID NO: 1475535 - RNA, 17 nt, Homo sapiens
gauguuacaucacagug

SEQ ID NO: 1475536 - RNA, 18 nt, Homo sapiens
gauguuuccagacuuccu

SEQ ID NO: 1475537 - RNA, 22 nt, Homo sapiens
gauguuuuaaguuuaucuuuca

SEQ ID NO: 1475538 - RNA, 17 nt, Homo sapiens
gauuaagauuuuacaaa

SEQ ID NO: 1475539 - RNA, 21 nt, Homo sapiens
gauuacaggcaugagccaccg

SEQ ID NO: 1475540 - RNA, 19 nt, Homo sapiens
gauuacaggcgugagccac

SEQ ID NO: 1475541 - RNA, 14 nt, Homo sapiens
gauuacugucaaua

SEQ ID NO: 1475542 - RNA, 21 nt, Homo sapiens
gauuagguagacuuugcuuag

SEQ ID NO: 1475543 - RNA, 23 nt, Homo sapiens
gauuagguagacuuugcuuagua

SEQ ID NO: 1475544 - RNA, 21 nt, Homo sapiens
gauuaguugaaaggccucaag

SEQ ID NO: 1475545 - RNA, 14 nt, Homo sapiens
gauuauaaacugac

SEQ ID NO: 1475546 - RNA, 21 nt, Homo sapiens
ggagacccucgcccaacucca

SEQ ID NO: 1475547 - RNA, 15 nt, Homo sapiens
ggagaccuggcacug

SEQ ID NO: 1475548 - RNA, 17 nt, Homo sapiens
ggagaccuggcacugga

SEQ ID NO: 1475549 - RNA, 15 nt, Homo sapiens
ggagaccugugcuag

SEQ ID NO: 1475550 - RNA, 18 nt, Homo sapiens
ggagacguggaaccucug

SEQ ID NO: 1475551 - RNA, 18 nt, Homo sapiens
ggagacugaagacucagc

SEQ ID NO: 1475552 - RNA, 20 nt, Homo sapiens
ggagacuuucaugcagccua

SEQ ID NO: 1475553 - RNA, 14 nt, Homo sapiens
ggagagaaguuucu

SEQ ID NO: 1475554 - RNA, 22 nt, Homo sapiens
ggagaggcggccucgugccaug

SEQ ID NO: 1475555 - RNA, 14 nt, Homo sapiens
ggagaggggggcca

SEQ ID NO: 1475556 - RNA, 16 nt, Homo sapiens
ggagaguacagugagc

SEQ ID NO: 1475557 - RNA, 20 nt, Homo sapiens
ggagaguacagugagccaag

SEQ ID NO: 1475558 - RNA, 21 nt, Homo sapiens
ggagaguacagugagccaaga

SEQ ID NO: 1475559 - RNA, 19 nt, Homo sapiens
ggagcauuggggauguuuu

SEQ ID NO: 1475560 - RNA, 13 nt, Homo sapiens
ggagccaccagca

SEQ ID NO: 1475561 - RNA, 13 nt, Homo sapiens
ggagcccagugaa

SEQ ID NO: 1475562 - RNA, 22 nt, Homo sapiens
ggagccccaggggacaagggau

SEQ ID NO: 1475563 - RNA, 18 nt, Homo sapiens
ggagccccgccacagccu

SEQ ID NO: 1475564 - RNA, 22 nt, Homo sapiens
ggagcccggcuuccacucccca

SEQ ID NO: 1475565 - RNA, 18 nt, Homo sapiens
ggagccucccccucagau

SEQ ID NO: 1475566 - RNA, 17 nt, Homo sapiens
ggagcucacacuccagu

SEQ ID NO: 1475567 - RNA, 18 nt, Homo sapiens
ggagcucaucugcaaaag

SEQ ID NO: 1475568 - RNA, 19 nt, Homo sapiens
ggagcucuggggacagcuu

SEQ ID NO: 1475569 - RNA, 23 nt, Homo sapiens
ggagcucuucaggccucccucuc

SEQ ID NO: 1475570 - RNA, 15 nt, Homo sapiens
ggagcugaggccaca

SEQ ID NO: 1475571 - RNA, 21 nt, Homo sapiens
ggagcugccuuggcucagaca

SEQ ID NO: 1475572 - RNA, 18 nt, Homo sapiens
ggagcugcucucucauga

SEQ ID NO: 1475573 - RNA, 18 nt, Homo sapiens
ggagcugucccaccugca

SEQ ID NO: 1475574 - RNA, 19 nt, Homo sapiens
ggaggaauccuggaccaag

SEQ ID NO: 1475575 - RNA, 14 nt, Homo sapiens
ggaggagcagcagc

SEQ ID NO: 1475576 - RNA, 23 nt, Homo sapiens
ggaggauugcagguggaacucag

SEQ ID NO: 1475577 - RNA, 12 nt, Homo sapiens
ggaggcacuuua

SEQ ID NO: 1475578 - RNA, 14 nt, Homo sapiens
ggaggccaauaaaa

SEQ ID NO: 1475579 - RNA, 20 nt, Homo sapiens
ggaggccagugccagcaccu

SEQ ID NO: 1475580 - RNA, 16 nt, Homo sapiens
ggaggccuauuccugc

SEQ ID NO: 1475581 - RNA, 18 nt, Homo sapiens
ggaggccuuccagcugcu

SEQ ID NO: 1475582 - RNA, 15 nt, Homo sapiens
ggaggcugaggcaag

SEQ ID NO: 1475583 - RNA, 17 nt, Homo sapiens
ggaggcugcgugccagu

SEQ ID NO: 1475584 - RNA, 16 nt, Homo sapiens
ggaggcugugugccug

SEQ ID NO: 1475585 - RNA, 16 nt, Homo sapiens
ggagggcgguggacaa

SEQ ID NO: 1475586 - RNA, 13 nt, Homo sapiens
ggagguaacgggu

SEQ ID NO: 1475587 - RNA, 20 nt, Homo sapiens
ggagguggagauugcaguga

SEQ ID NO: 1475588 - RNA, 15 nt, Homo sapiens
ggagguugaagccaa

SEQ ID NO: 1475589 - RNA, 22 nt, Homo sapiens
ggaguaacaauacaaauggauu

SEQ ID NO: 1475590 - RNA, 14 nt, Homo sapiens
ggagucacacagug

SEQ ID NO: 1475591 - RNA, 14 nt, Homo sapiens
ggagucucugccac

SEQ ID NO: 1475592 - RNA, 15 nt, Homo sapiens
ggagugaggaccugu

SEQ ID NO: 1475593 - RNA, 20 nt, Homo sapiens
ggagugccugcuguggaccc

SEQ ID NO: 1475594 - RNA, 16 nt, Homo sapiens
ggagugggcaccucag

SEQ ID NO: 1475595 - RNA, 13 nt, Homo sapiens
ggagugugccccu

SEQ ID NO: 1475596 - RNA, 22 nt, Homo sapiens
ggaguguugggcaugugaucac

SEQ ID NO: 1475597 - RNA, 18 nt, Homo sapiens
ggaguucucccaccaccu

SEQ ID NO: 1475598 - RNA, 19 nt, Homo sapiens
ggaguuguggugaggccac

SEQ ID NO: 1475599 - RNA, 16 nt, Homo sapiens
ggauaagccacugggc

SEQ ID NO: 1475600 - RNA, 21 nt, Homo sapiens
ggauaaguuucuauucuguca

SEQ ID NO: 1475601 - RNA, 23 nt, Homo sapiens
ggauaauauccagccucccacaa

SEQ ID NO: 1475602 - RNA, 20 nt, Homo sapiens
ggaucacaaggucacuagau

SEQ ID NO: 1475603 - RNA, 19 nt, Homo sapiens
ggaucaguuaacuauugca

SEQ ID NO: 1475604 - RNA, 22 nt, Homo sapiens
ggaucaguuaacuauugcauuu

SEQ ID NO: 1475605 - RNA, 17 nt, Homo sapiens
ggauccagaacugcacu

SEQ ID NO: 1475606 - RNA, 14 nt, Homo sapiens
ggauccucccucau

SEQ ID NO: 1475607 - RNA, 14 nt, Homo sapiens
ggauccuuugcugc

SEQ ID NO: 1475608 - RNA, 16 nt, Homo sapiens
ggaucuguccaaggaa

SEQ ID NO: 1475609 - RNA, 15 nt, Homo sapiens
ggaucuugaaugugg

SEQ ID NO: 1475610 - RNA, 22 nt, Homo sapiens
ggaucuugaauguggucucagg

SEQ ID NO: 1475611 - RNA, 13 nt, Homo sapiens
ggaucuugccaca

SEQ ID NO: 1475612 - RNA, 19 nt, Homo sapiens
ggaucuuguaauccagugc

SEQ ID NO: 1475613 - RNA, 23 nt, Homo sapiens
ggaugccaaccggucacccagga

SEQ ID NO: 1475614 - RNA, 15 nt, Homo sapiens
ggaugccuguggaag

SEQ ID NO: 1475615 - RNA, 23 nt, Homo sapiens
ggauggaacacggccacaucaaa

SEQ ID NO: 1475616 - RNA, 21 nt, Homo sapiens
ggauggcaucaaacagggcaa

SEQ ID NO: 1475617 - RNA, 15 nt, Homo sapiens
ggauggguccucacg

SEQ ID NO: 1475618 - RNA, 23 nt, Homo sapiens
ggaugucagcagacacacauggg

SEQ ID NO: 1475619 - RNA, 19 nt, Homo sapiens
ggauguccuacuaucacug

SEQ ID NO: 1475620 - RNA, 17 nt, Homo sapiens
ggauuaaccucugcacu

SEQ ID NO: 1475621 - RNA, 21 nt, Homo sapiens
ggauuaugaagugacucucac

SEQ ID NO: 1475622 - RNA, 13 nt, Homo sapiens
ggauuauuaacua

SEQ ID NO: 1475623 - RNA, 17 nt, Homo sapiens
ggauucaucagcauuug

SEQ ID NO: 1475624 - RNA, 16 nt, Homo sapiens
ggauucugaaucucaa

SEQ ID NO: 1475625 - RNA, 16 nt, Homo sapiens
ggauugcuaugaauga

SEQ ID NO: 1475626 - RNA, 17 nt, Homo sapiens
ggauugcuaugaaugau

SEQ ID NO: 1475627 - RNA, 15 nt, Homo sapiens
ggauuuccagggaua

SEQ ID NO: 1475628 - RNA, 13 nt, Homo sapiens
ggauuuguugcca

SEQ ID NO: 1475629 - RNA, 23 nt, Homo sapiens
ggauuuuaaguuugggccaguga

SEQ ID NO: 1475630 - RNA, 18 nt, Homo sapiens
ggcaaaaacuuccaucac

SEQ ID NO: 1475631 - RNA, 12 nt, Homo sapiens
ggcaaacaggca

SEQ ID NO: 1475632 - RNA, 14 nt, Homo sapiens
ggcaaacaggcagu

SEQ ID NO: 1475633 - RNA, 17 nt, Homo sapiens
ggcaaagaccgauugca

SEQ ID NO: 1475634 - RNA, 15 nt, Homo sapiens
ggcaaauggggugca

SEQ ID NO: 1475635 - RNA, 14 nt, Homo sapiens
ggcaacuguaugaa

SEQ ID NO: 1475636 - RNA, 18 nt, Homo sapiens
ggcaagucuagagucuca

SEQ ID NO: 1475637 - RNA, 20 nt, Homo sapiens
ggcaagucuagagucucaga

SEQ ID NO: 1475638 - RNA, 13 nt, Homo sapiens
ggcaagucuucca

SEQ ID NO: 1475639 - RNA, 23 nt, Homo sapiens
ggcaauaaauauuagaagccugc

SEQ ID NO: 1475640 - RNA, 17 nt, Homo sapiens
ggcaaucuuugccuuua

SEQ ID NO: 1475641 - RNA, 19 nt, Homo sapiens
ggcaaucuuugccuuuauc

SEQ ID NO: 1475642 - RNA, 18 nt, Homo sapiens
ggcaauuucaccaccaaa

SEQ ID NO: 1475643 - RNA, 20 nt, Homo sapiens
ggcacagggucugcucuuuc

SEQ ID NO: 1475644 - RNA, 13 nt, Homo sapiens
ggcacaguggacu

SEQ ID NO: 1475645 - RNA, 17 nt, Homo sapiens
ggcaccaaccugcauuu

SEQ ID NO: 1475646 - RNA, 12 nt, Homo sapiens
ggcaccagacac

SEQ ID NO: 1475647 - RNA, 18 nt, Homo sapiens
ggcaccagacacccagga

SEQ ID NO: 1475648 - RNA, 15 nt, Homo sapiens
uagcuccacuggaga

SEQ ID NO: 1475649 - RNA, 14 nt, Homo sapiens
uagcucugacuuug

SEQ ID NO: 1475650 - RNA, 18 nt, Homo sapiens
uagcugggauuacaggug

SEQ ID NO: 1475651 - RNA, 19 nt, Homo sapiens
uagcugggauuacaggugu

SEQ ID NO: 1475652 - RNA, 18 nt, Homo sapiens
uagcuuagcugucucaga

SEQ ID NO: 1475653 - RNA, 19 nt, Homo sapiens
uagcuuccugccccagaca

SEQ ID NO: 1475654 - RNA, 12 nt, Homo sapiens
uagcuugcuccc

SEQ ID NO: 1475655 - RNA, 14 nt, Homo sapiens
uaggaaaaccagag

SEQ ID NO: 1475656 - RNA, 17 nt, Homo sapiens
uaggaaauuccuucaua

SEQ ID NO: 1475657 - RNA, 15 nt, Homo sapiens
uaggaaccuaugaaa

SEQ ID NO: 1475658 - RNA, 16 nt, Homo sapiens
uaggaagcacugaaaa

SEQ ID NO: 1475659 - RNA, 19 nt, Homo sapiens
uaggaagguuaauguucau

SEQ ID NO: 1475660 - RNA, 13 nt, Homo sapiens
uaggaaucccaga

SEQ ID NO: 1475661 - RNA, 16 nt, Homo sapiens
uaggacauugugucag

SEQ ID NO: 1475662 - RNA, 23 nt, Homo sapiens
uaggagccugcuggucacagccu

SEQ ID NO: 1475663 - RNA, 12 nt, Homo sapiens
uaggcagaucac

SEQ ID NO: 1475664 - RNA, 17 nt, Homo sapiens
uaggcauguagcuacag

SEQ ID NO: 1475665 - RNA, 21 nt, Homo sapiens
uaggcauguagcuacaggaca

SEQ ID NO: 1475666 - RNA, 16 nt, Homo sapiens
uaggcauuaacacaaa

SEQ ID NO: 1475667 - RNA, 17 nt, Homo sapiens
uaggcuaccucaagacu

SEQ ID NO: 1475668 - RNA, 19 nt, Homo sapiens
uaggcucagagaugugcac

SEQ ID NO: 1475669 - RNA, 12 nt, Homo sapiens
uaggcuggccag

SEQ ID NO: 1475670 - RNA, 14 nt, Homo sapiens
uagggaagcucagg

SEQ ID NO: 1475671 - RNA, 15 nt, Homo sapiens
uagggaugugugaga

SEQ ID NO: 1475672 - RNA, 24 nt, Homo sapiens
uagggauuuuuggcuacacacaaa

SEQ ID NO: 1475673 - RNA, 20 nt, Homo sapiens
uaggggaacagaccagugac

SEQ ID NO: 1475674 - RNA, 22 nt, Homo sapiens
uaggguuacagagaccuaugua

SEQ ID NO: 1475675 - RNA, 14 nt, Homo sapiens
uagguaucauucaa

SEQ ID NO: 1475676 - RNA, 16 nt, Homo sapiens
uaggucagauggaggu

SEQ ID NO: 1475677 - RNA, 16 nt, Homo sapiens
uaggucuccucagggu

SEQ ID NO: 1475678 - RNA, 17 nt, Homo sapiens
uaggucuccucagggug

SEQ ID NO: 1475679 - RNA, 12 nt, Homo sapiens
uaggugagacag

SEQ ID NO: 1475680 - RNA, 15 nt, Homo sapiens
uagguggcugagcau

SEQ ID NO: 1475681 - RNA, 14 nt, Homo sapiens
uaguaaacaugugg

SEQ ID NO: 1475682 - RNA, 23 nt, Homo sapiens
uaguaaguacuuaauaaacugug

SEQ ID NO: 1475683 - RNA, 13 nt, Homo sapiens
uaguaaucuguaa

SEQ ID NO: 1475684 - RNA, 16 nt, Homo sapiens
uaguaccucugcuauu

SEQ ID NO: 1475685 - RNA, 11 nt, Homo sapiens
uaguacuccuu

SEQ ID NO: 1475686 - RNA, 15 nt, Homo sapiens
uaguauaauugaccu

SEQ ID NO: 1475687 - RNA, 15 nt, Homo sapiens
uaguauuucucagga

SEQ ID NO: 1475688 - RNA, 18 nt, Homo sapiens
uagucacucauccauccc

SEQ ID NO: 1475689 - RNA, 20 nt, Homo sapiens
uagucauacucccuggugua

SEQ ID NO: 1475690 - RNA, 13 nt, Homo sapiens
uagucaugugacc

SEQ ID NO: 1475691 - RNA, 15 nt, Homo sapiens
uaguccuguacugua

SEQ ID NO: 1475692 - RNA, 19 nt, Homo sapiens
uagucgggaugucagcaga

SEQ ID NO: 1475693 - RNA, 16 nt, Homo sapiens
uagucuguacuucauc

SEQ ID NO: 1475694 - RNA, 17 nt, Homo sapiens
uagugaccuaaccacuu

SEQ ID NO: 1475695 - RNA, 23 nt, Homo sapiens
uagugggccagggcugcccugag

SEQ ID NO: 1475696 - RNA, 20 nt, Homo sapiens
uaguguaccuccucucagug

SEQ ID NO: 1475697 - RNA, 18 nt, Homo sapiens
uaguguauccauaaugca

SEQ ID NO: 1475698 - RNA, 13 nt, Homo sapiens
uaguguauucucu

SEQ ID NO: 1475699 - RNA, 16 nt, Homo sapiens
uaguuaccuacugagu

SEQ ID NO: 1475700 - RNA, 15 nt, Homo sapiens
uaguuagccaucuaa

SEQ ID NO: 1475701 - RNA, 18 nt, Homo sapiens
uaguuauuuuauaaucaa

SEQ ID NO: 1475702 - RNA, 15 nt, Homo sapiens
uaguucauccaaucc

SEQ ID NO: 1475703 - RNA, 12 nt, Homo sapiens
uaguugccuuaa

SEQ ID NO: 1475704 - RNA, 13 nt, Homo sapiens
uaguuuauuucaa

SEQ ID NO: 1475705 - RNA, 21 nt, Homo sapiens
uaguuucuucauuucaggaag

SEQ ID NO: 1475706 - RNA, 22 nt, Homo sapiens
uaguuuguaugccaagugagaa

SEQ ID NO: 1475707 - RNA, 23 nt, Homo sapiens
uaguuuuaaacucauuuuugcca

SEQ ID NO: 1475708 - RNA, 21 nt, Homo sapiens
uaguuuucuccuuuuacuuca

SEQ ID NO: 1475709 - RNA, 11 nt, Homo sapiens
uaguuuugcuu

SEQ ID NO: 1475710 - RNA, 21 nt, Homo sapiens
uauaaaaaccaugcugguaua

SEQ ID NO: 1475711 - RNA, 14 nt, Homo sapiens
uauaaaaaguggag

SEQ ID NO: 1475712 - RNA, 20 nt, Homo sapiens
uauaaacagacaauauguga

SEQ ID NO: 1475713 - RNA, 15 nt, Homo sapiens
uauaaaccaaucuua

SEQ ID NO: 1475714 - RNA, 20 nt, Homo sapiens
uauaaaccguggucucaugu

SEQ ID NO: 1475715 - RNA, 12 nt, Homo sapiens
uauaaccccagc

SEQ ID NO: 1475716 - RNA, 23 nt, Homo sapiens
uauaacccuaggaauuuagacaa

SEQ ID NO: 1475717 - RNA, 22 nt, Homo sapiens
uauaagaaaugcauaugucacu

SEQ ID NO: 1475718 - RNA, 18 nt, Homo sapiens
uauaagcauguauauucu

SEQ ID NO: 1475719 - RNA, 15 nt, Homo sapiens
uauaagcugccauau

SEQ ID NO: 1475720 - RNA, 21 nt, Homo sapiens
uauaaggcugagggcugccag

SEQ ID NO: 1475721 - RNA, 19 nt, Homo sapiens
uauaauaaagaaguguucu

SEQ ID NO: 1475722 - RNA, 13 nt, Homo sapiens
uauaaucauauca

SEQ ID NO: 1475723 - RNA, 17 nt, Homo sapiens
uauaaucccagcacuuu

SEQ ID NO: 1475724 - RNA, 17 nt, Homo sapiens
uauaauguaagcucuac

SEQ ID NO: 1475725 - RNA, 15 nt, Homo sapiens
uauaauguugccagc

SEQ ID NO: 1475726 - RNA, 16 nt, Homo sapiens
uauaauuagauuguga

SEQ ID NO: 1475727 - RNA, 20 nt, Homo sapiens
uauaauucacucaagcacug

SEQ ID NO: 1475728 - RNA, 14 nt, Homo sapiens
uauacaguacacag

SEQ ID NO: 1475729 - RNA, 12 nt, Homo sapiens
uauacauuugau

SEQ ID NO: 1475730 - RNA, 14 nt, Homo sapiens
uauaccugcacguu

SEQ ID NO: 1475731 - RNA, 20 nt, Homo sapiens
uauacugccaaagaauguga

SEQ ID NO: 1475732 - RNA, 18 nt, Homo sapiens
uauacugugaaguuacau

SEQ ID NO: 1475733 - RNA, 11 nt, Homo sapiens
uauacuuucag

SEQ ID NO: 1475734 - RNA, 22 nt, Homo sapiens
uauagaaaaggaacaguugcau

SEQ ID NO: 1475735 - RNA, 14 nt, Homo sapiens
uauagacucuagga

SEQ ID NO: 1475736 - RNA, 21 nt, Homo sapiens
uauagagggcuuaugauucag

SEQ ID NO: 1475737 - RNA, 14 nt, Homo sapiens
uauagaugaggcag

SEQ ID NO: 1475738 - RNA, 14 nt, Homo sapiens
uauaguacaugaua

SEQ ID NO: 1475739 - RNA, 14 nt, Homo sapiens
uauagucacaagag

SEQ ID NO: 1475740 - RNA, 20 nt, Homo sapiens
uauaguccagacacuuaacu

SEQ ID NO: 1475741 - RNA, 18 nt, Homo sapiens
uauauaaguuuacaccuu

SEQ ID NO: 1475742 - RNA, 17 nt, Homo sapiens
uauauaauguugccagc

SEQ ID NO: 1475743 - RNA, 19 nt, Homo sapiens
uauauaauuuauuuccacu

SEQ ID NO: 1475744 - RNA, 19 nt, Homo sapiens
uucacagaauagcacaaac

SEQ ID NO: 1475745 - RNA, 19 nt, Homo sapiens
uucacagcccugcagugcc

SEQ ID NO: 1475746 - RNA, 17 nt, Homo sapiens
uucacagucuggugcuu

SEQ ID NO: 1475747 - RNA, 19 nt, Homo sapiens
uucacauaguuuauuucaa

SEQ ID NO: 1475748 - RNA, 14 nt, Homo sapiens
uucacaucugucac

SEQ ID NO: 1475749 - RNA, 15 nt, Homo sapiens
uucacaucugucacg

SEQ ID NO: 1475750 - RNA, 16 nt, Homo sapiens
uucacaugagcuauuu

SEQ ID NO: 1475751 - RNA, 14 nt, Homo sapiens
uucaccagagcauu

SEQ ID NO: 1475752 - RNA, 19 nt, Homo sapiens
uucaccauauuggccaguc

SEQ ID NO: 1475753 - RNA, 20 nt, Homo sapiens
uucaccccacucagcucacc

SEQ ID NO: 1475754 - RNA, 14 nt, Homo sapiens
uucacccugcauua

SEQ ID NO: 1475755 - RNA, 16 nt, Homo sapiens
uucaccuacauuaucu

SEQ ID NO: 1475756 - RNA, 20 nt, Homo sapiens
uucaccuuccagugucucgg

SEQ ID NO: 1475757 - RNA, 13 nt, Homo sapiens
uucacgccauucu

SEQ ID NO: 1475758 - RNA, 12 nt, Homo sapiens
uucacuacaggu

SEQ ID NO: 1475759 - RNA, 16 nt, Homo sapiens
uucacucccaaccuga

SEQ ID NO: 1475760 - RNA, 17 nt, Homo sapiens
uucacucucugcauuga

SEQ ID NO: 1475761 - RNA, 23 nt, Homo sapiens
uucacugaggggagacaaaggga

SEQ ID NO: 1475762 - RNA, 12 nt, Homo sapiens
uucagagauuua

SEQ ID NO: 1475763 - RNA, 16 nt, Homo sapiens
uucagaggauaaauau

SEQ ID NO: 1475764 - RNA, 21 nt, Homo sapiens
uucagaggguaacuuaacaga

SEQ ID NO: 1475765 - RNA, 19 nt, Homo sapiens
uucagaucauauuucacaa

SEQ ID NO: 1475766 - RNA, 18 nt, Homo sapiens
uucccuaggaaacucaca

SEQ ID NO: 1475767 - RNA, 23 nt, Homo sapiens
uucccucuuggugugauugcaca

SEQ ID NO: 1475768 - RNA, 17 nt, Homo sapiens
uucccugacuugcuuua

SEQ ID NO: 1475769 - RNA, 22 nt, Homo sapiens
uucccugcucuugcaguugcuc

SEQ ID NO: 1475770 - RNA, 20 nt, Homo sapiens
uucccugggcugccaccagc

SEQ ID NO: 1475771 - RNA, 17 nt, Homo sapiens
uucccugugucauuuca

SEQ ID NO: 1475772 - RNA, 18 nt, Homo sapiens
uucccuucaacaugaaaa

SEQ ID NO: 1475773 - RNA, 17 nt, Homo sapiens
uucccuuucacuggcau

SEQ ID NO: 1475774 - RNA, 15 nt, Homo sapiens
uucccuuugugcaca

SEQ ID NO: 1475775 - RNA, 20 nt, Homo sapiens
uuccuacagcacuacugggu

SEQ ID NO: 1475776 - RNA, 22 nt, Homo sapiens
uuccuacccacaccucugccag

SEQ ID NO: 1475777 - RNA, 20 nt, Homo sapiens
uuccuauuuggggcuugcau

SEQ ID NO: 1475778 - RNA, 21 nt, Homo sapiens
uuccucaccaggagcccggcu

SEQ ID NO: 1475779 - RNA, 13 nt, Homo sapiens
uuccucacucaga

SEQ ID NO: 1475780 - RNA, 13 nt, Homo sapiens
uuccuccauaaau

SEQ ID NO: 1475781 - RNA, 14 nt, Homo sapiens
uuccucccagugag

SEQ ID NO: 1475782 - RNA, 18 nt, Homo sapiens
uuccuccucgcugccaga

SEQ ID NO: 1475783 - RNA, 18 nt, Homo sapiens
uuccucgccugacaacca

SEQ ID NO: 1475784 - RNA, 12 nt, Homo sapiens
uuccucucuuaa

SEQ ID NO: 1475785 - RNA, 14 nt, Homo sapiens
uuccugacugcuag

SEQ ID NO: 1475786 - RNA, 22 nt, Homo sapiens
uuccugcuggccccuucugggg

SEQ ID NO: 1475787 - RNA, 21 nt, Homo sapiens
uuccuggccugagagucagcu

SEQ ID NO: 1475788 - RNA, 20 nt, Homo sapiens
uuccuggcuccaacacugcu

SEQ ID NO: 1475789 - RNA, 17 nt, Homo sapiens
uucuuacaugcauuuga

SEQ ID NO: 1475790 - RNA, 13 nt, Homo sapiens
uucuucaaccuca

SEQ ID NO: 1475791 - RNA, 11 nt, Homo sapiens
uucuucagggc

SEQ ID NO: 1475792 - RNA, 18 nt, Homo sapiens
uucuucauccaacuucca

SEQ ID NO: 1475793 - RNA, 18 nt, Homo sapiens
uucuuccccuuacucuca

SEQ ID NO: 1475794 - RNA, 21 nt, Homo sapiens
uucuucucaaaaaauaauuag

SEQ ID NO: 1475795 - RNA, 12 nt, Homo sapiens
uucuucugcaac

SEQ ID NO: 1475796 - RNA, 15 nt, Homo sapiens
uucuucuguccugag

SEQ ID NO: 1475797 - RNA, 14 nt, Homo sapiens
uucuucuuuuacuu

SEQ ID NO: 1475798 - RNA, 17 nt, Homo sapiens
uucuugcagucaucaga

SEQ ID NO: 1475799 - RNA, 15 nt, Homo sapiens
uucuuggcccaggau

SEQ ID NO: 1475800 - RNA, 19 nt, Homo sapiens
uucuugggguacucuugau

SEQ ID NO: 1475801 - RNA, 13 nt, Homo sapiens
uucuugguauuau

SEQ ID NO: 1475802 - RNA, 13 nt, Homo sapiens
uucuuguauugua

SEQ ID NO: 1475803 - RNA, 16 nt, Homo sapiens
uucuugugguguaaag

SEQ ID NO: 1475804 - RNA, 22 nt, Homo sapiens
uucuuuaaaaaacaacuaugga

SEQ ID NO: 1475805 - RNA, 15 nt, Homo sapiens
uucuuuaaaggcauc

SEQ ID NO: 1475806 - RNA, 17 nt, Homo sapiens
uucuuuaccaaggauau

SEQ ID NO: 1475807 - RNA, 14 nt, Homo sapiens
uucuuuccauaaua

SEQ ID NO: 1475808 - RNA, 14 nt, Homo sapiens
uucuuugucuuauc

SEQ ID NO: 1475809 - RNA, 17 nt, Homo sapiens
uucuuuuaaugaugcca

SEQ ID NO: 1475810 - RNA, 14 nt, Homo sapiens
uucuuuucuugauu

SEQ ID NO: 1475811 - RNA, 13 nt, Homo sapiens
uucuuuuuccaca

SEQ ID NO: 1475812 - RNA, 20 nt, Homo sapiens
uucuuuuuccacaaggaaua

SEQ ID NO: 1475813 - RNA, 14 nt, Homo sapiens
uucuuuuugcucua

SEQ ID NO: 1475814 - RNA, 17 nt, Homo sapiens
cugcccagaugcccuuu

SEQ ID NO: 1475815 - RNA, 14 nt, Homo sapiens
cugccccacacucc

SEQ ID NO: 1475816 - RNA, 15 nt, Homo sapiens
cugccccacacuccc

SEQ ID NO: 1475817 - RNA, 14 nt, Homo sapiens
cugccccagacaga

SEQ ID NO: 1475818 - RNA, 19 nt, Homo sapiens
cugccccaggccugaaaga

SEQ ID NO: 1475819 - RNA, 21 nt, Homo sapiens
cugcccccuugggugaccucu

SEQ ID NO: 1475820 - RNA, 23 nt, Homo sapiens
cugcccgaggagcccugccugcc

SEQ ID NO: 1475821 - RNA, 18 nt, Homo sapiens
cugcccgggagggcuucc

SEQ ID NO: 1475822 - RNA, 14 nt, Homo sapiens
cugcccuacuggga

SEQ ID NO: 1475823 - RNA, 17 nt, Homo sapiens
cugcccuccuuguccac

SEQ ID NO: 1475824 - RNA, 17 nt, Homo sapiens
cugccgaaccaaaagaa

SEQ ID NO: 1475825 - RNA, 19 nt, Homo sapiens
cugccgggcugagggccug

SEQ ID NO: 1475826 - RNA, 21 nt, Homo sapiens
cugccggucgggcagccagca

SEQ ID NO: 1475827 - RNA, 14 nt, Homo sapiens
cugccgucuucacu

SEQ ID NO: 1475828 - RNA, 17 nt, Homo sapiens
cugccucagccucccaa

SEQ ID NO: 1475829 - RNA, 19 nt, Homo sapiens
cugccucuuuuccccauga

SEQ ID NO: 1475830 - RNA, 23 nt, Homo sapiens
cugccugaaacagccauguccaa

SEQ ID NO: 1475831 - RNA, 15 nt, Homo sapiens
cugccugacacugag

SEQ ID NO: 1475832 - RNA, 18 nt, Homo sapiens
cugccuggagagggucuc

SEQ ID NO: 1475833 - RNA, 12 nt, Homo sapiens
cugccuguaacu

SEQ ID NO: 1475834 - RNA, 22 nt, Homo sapiens
cugccuguucugaggauucagg

SEQ ID NO: 1475835 - RNA, 15 nt, Homo sapiens
cugcguuuuccuagc

SEQ ID NO: 1475836 - RNA, 23 nt, Homo sapiens
cugcuaauaccucuuacuuugcu

SEQ ID NO: 1475837 - RNA, 15 nt, Homo sapiens
cugcuacuuaauucc

SEQ ID NO: 1475838 - RNA, 17 nt, Homo sapiens
cugcuacuuaauuccuu

SEQ ID NO: 1475839 - RNA, 22 nt, Homo sapiens
cugcuaugcuauugaaguuuug

SEQ ID NO: 1475840 - RNA, 20 nt, Homo sapiens
cugcucacaaaaucacuuua

SEQ ID NO: 1475841 - RNA, 13 nt, Homo sapiens
cugcuccaacccc

SEQ ID NO: 1475842 - RNA, 16 nt, Homo sapiens
cugcuccacguucucu

SEQ ID NO: 1475843 - RNA, 13 nt, Homo sapiens
cugcucccauucc

SEQ ID NO: 1475844 - RNA, 13 nt, Homo sapiens
cugcucccuggca

SEQ ID NO: 1475845 - RNA, 16 nt, Homo sapiens
cugcucugcaagcaga

SEQ ID NO: 1475846 - RNA, 21 nt, Homo sapiens
cugcucugcuccugaagcccu

SEQ ID NO: 1475847 - RNA, 20 nt, Homo sapiens
cugcucugguuagaaaaagg

SEQ ID NO: 1475848 - RNA, 22 nt, Homo sapiens
cugcugaccaauugugcugcca

SEQ ID NO: 1475849 - RNA, 23 nt, Homo sapiens
cugcugaccaauugugcugccau

SEQ ID NO: 1475850 - RNA, 21 nt, Homo sapiens
cugcugccucuuucccuagga

SEQ ID NO: 1475851 - RNA, 16 nt, Homo sapiens
cugcugccugcugaga

SEQ ID NO: 1475852 - RNA, 16 nt, Homo sapiens
cugcugcuccacggcg

SEQ ID NO: 1475853 - RNA, 16 nt, Homo sapiens
cugcuggaaaugcuga

SEQ ID NO: 1475854 - RNA, 20 nt, Homo sapiens
cugcuggcuuccagcuucag

SEQ ID NO: 1475855 - RNA, 22 nt, Homo sapiens
cugcuggugccagggugggugu

SEQ ID NO: 1475856 - RNA, 21 nt, Homo sapiens
cugcuguggcgugagggugag

SEQ ID NO: 1475857 - RNA, 13 nt, Homo sapiens
cugcuucagucca

SEQ ID NO: 1475858 - RNA, 14 nt, Homo sapiens
cugcuugaacccag

SEQ ID NO: 1475859 - RNA, 15 nt, Homo sapiens
cugcuugaccaaaga

SEQ ID NO: 1475860 - RNA, 16 nt, Homo sapiens
cugcuugaccaaagag

SEQ ID NO: 1475861 - RNA, 13 nt, Homo sapiens
cugcuuguguuaa

SEQ ID NO: 1475862 - RNA, 16 nt, Homo sapiens
cuggaaaaauuccaga

SEQ ID NO: 1475863 - RNA, 18 nt, Homo sapiens
cuggaaaaauuccagaag

SEQ ID NO: 1475864 - RNA, 16 nt, Homo sapiens
cuggaaaacccaaagu

SEQ ID NO: 1475865 - RNA, 14 nt, Homo sapiens
cuggaaaaugugac

SEQ ID NO: 1475866 - RNA, 15 nt, Homo sapiens
cuggaaaaugugacc

SEQ ID NO: 1475867 - RNA, 14 nt, Homo sapiens
cuggaaaugcugac

SEQ ID NO: 1475868 - RNA, 12 nt, Homo sapiens
cuggaacccaga

SEQ ID NO: 1475869 - RNA, 22 nt, Homo sapiens
gagacggagucuugcucuguca

SEQ ID NO: 1475870 - RNA, 15 nt, Homo sapiens
gagacgggcaucgca

SEQ ID NO: 1475871 - RNA, 14 nt, Homo sapiens
gagacuccgucuca

SEQ ID NO: 1475872 - RNA, 19 nt, Homo sapiens
gagacuccgucucaaaaaa

SEQ ID NO: 1475873 - RNA, 12 nt, Homo sapiens
gagacucuaggg

SEQ ID NO: 1475874 - RNA, 14 nt, Homo sapiens
gagacugggagcca

SEQ ID NO: 1475875 - RNA, 20 nt, Homo sapiens
gagacugggagccacuucuc

SEQ ID NO: 1475876 - RNA, 20 nt, Homo sapiens
gagacuguaaguuacaugaa

SEQ ID NO: 1475877 - RNA, 21 nt, Homo sapiens
gagagaacaacuacugugauc

SEQ ID NO: 1475878 - RNA, 16 nt, Homo sapiens
gagagaggagccagac

SEQ ID NO: 1475879 - RNA, 23 nt, Homo sapiens
gagagcuuucuguccuuuuggca

SEQ ID NO: 1475880 - RNA, 13 nt, Homo sapiens
gagaggaacccag

SEQ ID NO: 1475881 - RNA, 17 nt, Homo sapiens
gagaggacaguggauug

SEQ ID NO: 1475882 - RNA, 21 nt, Homo sapiens
gagaggauguggaaagcacuu

SEQ ID NO: 1475883 - RNA, 22 nt, Homo sapiens
gagaggcagcuaucugcacucu

SEQ ID NO: 1475884 - RNA, 14 nt, Homo sapiens
gagaggcuguguca

SEQ ID NO: 1475885 - RNA, 19 nt, Homo sapiens
gagagggaccaugugucac

SEQ ID NO: 1475886 - RNA, 21 nt, Homo sapiens
gagagugguuagaaggcuucu

SEQ ID NO: 1475887 - RNA, 20 nt, Homo sapiens
gagaucacgccacugcacuc

SEQ ID NO: 1475888 - RNA, 18 nt, Homo sapiens
gagauccaaaguccugug

SEQ ID NO: 1475889 - RNA, 18 nt, Homo sapiens
gagauccugagucaugug

SEQ ID NO: 1475890 - RNA, 21 nt, Homo sapiens
gagaucgcgccacugcacucc

SEQ ID NO: 1475891 - RNA, 19 nt, Homo sapiens
gagaucgugcuacugcacu

SEQ ID NO: 1475892 - RNA, 19 nt, Homo sapiens
gagaucuaaggaugucaca

SEQ ID NO: 1475893 - RNA, 11 nt, Homo sapiens
gagaucucuau

SEQ ID NO: 1475894 - RNA, 16 nt, Homo sapiens
gagaugauacauccaa

SEQ ID NO: 1475895 - RNA, 19 nt, Homo sapiens
gagaugcuggacuugccua

SEQ ID NO: 1475896 - RNA, 18 nt, Homo sapiens
gagauggacaacucaaug

SEQ ID NO: 1475897 - RNA, 16 nt, Homo sapiens
gagauucugugaucuu

SEQ ID NO: 1475898 - RNA, 16 nt, Homo sapiens
gagauuucaugccugg

SEQ ID NO: 1475899 - RNA, 13 nt, Homo sapiens
gagcaagacucca

SEQ ID NO: 1475900 - RNA, 22 nt, Homo sapiens
gagcaagacuccaucucaaaaa

SEQ ID NO: 1475901 - RNA, 15 nt, Homo sapiens
gagcaagacugucuc

SEQ ID NO: 1475902 - RNA, 16 nt, Homo sapiens
gagcaagacugucuca

SEQ ID NO: 1475903 - RNA, 16 nt, Homo sapiens
gagcacagaaggaaua

SEQ ID NO: 1475904 - RNA, 20 nt, Homo sapiens
gagcacauuuaccaguauag

SEQ ID NO: 1475905 - RNA, 15 nt, Homo sapiens
gagcagaaacagcca

SEQ ID NO: 1475906 - RNA, 13 nt, Homo sapiens
gagcagccugaac

SEQ ID NO: 1475907 - RNA, 12 nt, Homo sapiens
gagcagccugug

SEQ ID NO: 1475908 - RNA, 22 nt, Homo sapiens
gagcagcuccccaggagcucag

SEQ ID NO: 1475909 - RNA, 24 nt, Homo sapiens
gagcaggccggaaccacagggcca

SEQ ID NO: 1475910 - RNA, 14 nt, Homo sapiens
gagcagugucuucc

SEQ ID NO: 1475911 - RNA, 14 nt, Homo sapiens
gagcaguuugccac

SEQ ID NO: 1475912 - RNA, 14 nt, Homo sapiens
gagcaucugcagua

SEQ ID NO: 1475913 - RNA, 18 nt, Homo sapiens
gagcaugggccuggccac

SEQ ID NO: 1475914 - RNA, 19 nt, Homo sapiens
gagcauuacgugagccagg

SEQ ID NO: 1475915 - RNA, 12 nt, Homo sapiens
gagcauuuccaa

SEQ ID NO: 1475916 - RNA, 12 nt, Homo sapiens
gagccaaccucg

SEQ ID NO: 1475917 - RNA, 15 nt, Homo sapiens
gagccagcucccucu

SEQ ID NO: 1475918 - RNA, 16 nt, Homo sapiens
gagccaggacccagga

SEQ ID NO: 1475919 - RNA, 13 nt, Homo sapiens
gagccagucucac

SEQ ID NO: 1475920 - RNA, 17 nt, Homo sapiens
gagcccauccagucucc

SEQ ID NO: 1475921 - RNA, 21 nt, Homo sapiens
gagcccaugcucaaccacugu

SEQ ID NO: 1475922 - RNA, 17 nt, Homo sapiens
gagccgauggaucugug

SEQ ID NO: 1475923 - RNA, 14 nt, Homo sapiens
gagccgcugugagc

SEQ ID NO: 1475924 - RNA, 12 nt, Homo sapiens
gagccugugcag

SEQ ID NO: 1475925 - RNA, 13 nt, Homo sapiens
gagccuucagagu

SEQ ID NO: 1475926 - RNA, 14 nt, Homo sapiens
gagcgagacucugu

SEQ ID NO: 1475927 - RNA, 14 nt, Homo sapiens
gagcgagacuuggu

SEQ ID NO: 1475928 - RNA, 18 nt, Homo sapiens
gagcggggcccacccggu

SEQ ID NO: 1475929 - RNA, 16 nt, Homo sapiens
gagcuaaacuccuucc

SEQ ID NO: 1475930 - RNA, 17 nt, Homo sapiens
gagcuccccagaucucc

SEQ ID NO: 1475931 - RNA, 19 nt, Homo sapiens
gagcuccugcugcggagga

SEQ ID NO: 1475932 - RNA, 19 nt, Homo sapiens
gagcucuacccugcucccu

SEQ ID NO: 1475933 - RNA, 21 nt, Homo sapiens
gagcugaauuaccuuucacuu

SEQ ID NO: 1475934 - RNA, 14 nt, Homo sapiens
gagcugagaucacg

SEQ ID NO: 1475935 - RNA, 21 nt, Homo sapiens
gagcugaguggccagccagug

SEQ ID NO: 1475936 - RNA, 15 nt, Homo sapiens
gagcugcacugauca

SEQ ID NO: 1475937 - RNA, 12 nt, Homo sapiens
gagcugcagcug

SEQ ID NO: 1475938 - RNA, 17 nt, Homo sapiens
gagcuggccuccuaugc

SEQ ID NO: 1475939 - RNA, 16 nt, Homo sapiens
gagcuggggaucccuc

SEQ ID NO: 1475940 - RNA, 22 nt, Homo sapiens
gagcuguccccguguugcauga

SEQ ID NO: 1475941 - RNA, 14 nt, Homo sapiens
gaggaaaccuagca

SEQ ID NO: 1475942 - RNA, 12 nt, Homo sapiens
gaggaaagggag

SEQ ID NO: 1475943 - RNA, 21 nt, Homo sapiens
gaggaauaacaucaccacugu

SEQ ID NO: 1475944 - RNA, 17 nt, Homo sapiens
gaggacaauacuggggu

SEQ ID NO: 1475945 - RNA, 14 nt, Homo sapiens
gaggagauggccau

SEQ ID NO: 1475946 - RNA, 23 nt, Homo sapiens
gaggagcaagguuuaaauuuguu

SEQ ID NO: 1475947 - RNA, 20 nt, Homo sapiens
gaggagccggugcucuggaa

SEQ ID NO: 1475948 - RNA, 14 nt, Homo sapiens
gaggaggccuccau

SEQ ID NO: 1475949 - RNA, 17 nt, Homo sapiens
gaggagguucacugagc

SEQ ID NO: 1475950 - RNA, 22 nt, Homo sapiens
gaggaugaauguaugugcacug

SEQ ID NO: 1475951 - RNA, 18 nt, Homo sapiens
gaggauugcuaucuggag

SEQ ID NO: 1475952 - RNA, 16 nt, Homo sapiens
gaggauuucaucucuu

SEQ ID NO: 1475953 - RNA, 13 nt, Homo sapiens
gaggcacugcuga

SEQ ID NO: 1475954 - RNA, 20 nt, Homo sapiens
gaggcaggagaaucgcuuga

SEQ ID NO: 1475955 - RNA, 20 nt, Homo sapiens
gaggcaggagaauggcguga

SEQ ID NO: 1475956 - RNA, 20 nt, Homo sapiens
gaggcaggagaauugcuuga

SEQ ID NO: 1475957 - RNA, 13 nt, Homo sapiens
gaggcagugacag

SEQ ID NO: 1475958 - RNA, 23 nt, Homo sapiens
gaggccaauaaaaaguucagagu

SEQ ID NO: 1475959 - RNA, 11 nt, Homo sapiens
gaggcccucaa

SEQ ID NO: 1475960 - RNA, 15 nt, Homo sapiens
gaggcgcacagugug

SEQ ID NO: 1475961 - RNA, 12 nt, Homo sapiens
gaggcuggccaa

SEQ ID NO: 1475962 - RNA, 20 nt, Homo sapiens
gaggcugggccccugggaug

SEQ ID NO: 1475963 - RNA, 12 nt, Homo sapiens
gaggcugucaca

SEQ ID NO: 1475964 - RNA, 17 nt, Homo sapiens
gaggcugucacaguccu

SEQ ID NO: 1475965 - RNA, 14 nt, Homo sapiens
gagggaaaaugagu

SEQ ID NO: 1475966 - RNA, 20 nt, Homo sapiens
gagggaaaguaaauauuuca

SEQ ID NO: 1475967 - RNA, 22 nt, Homo sapiens
gagggacgacaccucugguuuu

SEQ ID NO: 1475968 - RNA, 17 nt, Homo sapiens
gagggaggcucaggucc

SEQ ID NO: 1475969 - RNA, 20 nt, Homo sapiens
gagggcaaucuuugccuuua

SEQ ID NO: 1475970 - RNA, 18 nt, Homo sapiens
gagggccccgcccagugc

SEQ ID NO: 1475971 - RNA, 14 nt, Homo sapiens
gagggcggcacagg

SEQ ID NO: 1475972 - RNA, 14 nt, Homo sapiens
gaucaugcauuguu

SEQ ID NO: 1475973 - RNA, 22 nt, Homo sapiens
gauccaaaagaagcccccagcu

SEQ ID NO: 1475974 - RNA, 15 nt, Homo sapiens
gauccaaaguccugu

SEQ ID NO: 1475975 - RNA, 23 nt, Homo sapiens
gauccaagaaggccuucauggcc

SEQ ID NO: 1475976 - RNA, 15 nt, Homo sapiens
gauccagccaugccu

SEQ ID NO: 1475977 - RNA, 15 nt, Homo sapiens
gauccaguugcacua

SEQ ID NO: 1475978 - RNA, 15 nt, Homo sapiens
gauccccaaguggug

SEQ ID NO: 1475979 - RNA, 22 nt, Homo sapiens
gauccccguuccugacaucaca

SEQ ID NO: 1475980 - RNA, 18 nt, Homo sapiens
gaucgccaaccuuucccc

SEQ ID NO: 1475981 - RNA, 17 nt, Homo sapiens
gaucuacacccaccaga

SEQ ID NO: 1475982 - RNA, 19 nt, Homo sapiens
gaucuacacccaccagagu

SEQ ID NO: 1475983 - RNA, 20 nt, Homo sapiens
gaucucaauuugcaguauuc

SEQ ID NO: 1475984 - RNA, 11 nt, Homo sapiens
gaucucucuug

SEQ ID NO: 1475985 - RNA, 14 nt, Homo sapiens
gaucugaaaucauu

SEQ ID NO: 1475986 - RNA, 14 nt, Homo sapiens
gaucugcaguuuuu

SEQ ID NO: 1475987 - RNA, 23 nt, Homo sapiens
gaucuggaacccagacucagaca

SEQ ID NO: 1475988 - RNA, 11 nt, Homo sapiens
gaucugugaua

SEQ ID NO: 1475989 - RNA, 18 nt, Homo sapiens
gaucuguuuugaaggcaa

SEQ ID NO: 1475990 - RNA, 20 nt, Homo sapiens
gaucuuaaagcauuccccaa

SEQ ID NO: 1475991 - RNA, 12 nt, Homo sapiens
gaucuucagagc

SEQ ID NO: 1475992 - RNA, 20 nt, Homo sapiens
gaucuugcauucccaguggu

SEQ ID NO: 1475993 - RNA, 21 nt, Homo sapiens
gaucuugccugucuggcucag

SEQ ID NO: 1475994 - RNA, 18 nt, Homo sapiens
gaugaaaaugaaucuuca

SEQ ID NO: 1475995 - RNA, 23 nt, Homo sapiens
gaugaaauaacuccuucuuguag

SEQ ID NO: 1475996 - RNA, 22 nt, Homo sapiens
gaugaaaucugcuagaaaguua

SEQ ID NO: 1475997 - RNA, 17 nt, Homo sapiens
gaugaauguaugugcac

SEQ ID NO: 1475998 - RNA, 20 nt, Homo sapiens
gaugacacaacugcacucca

SEQ ID NO: 1475999 - RNA, 14 nt, Homo sapiens
gaugacuguugaug

SEQ ID NO: 1476000 - RNA, 18 nt, Homo sapiens
gaugagcagucacacugu

SEQ ID NO: 1476001 - RNA, 13 nt, Homo sapiens
gaugagguugcuu

SEQ ID NO: 1476002 - RNA, 16 nt, Homo sapiens
gaugauacacuaugaa

SEQ ID NO: 1476003 - RNA, 15 nt, Homo sapiens
gaugauauucucacc

SEQ ID NO: 1476004 - RNA, 15 nt, Homo sapiens
gaugcaaugugcuac

SEQ ID NO: 1476005 - RNA, 23 nt, Homo sapiens
gaugcagguuggaaggggccuug

SEQ ID NO: 1476006 - RNA, 15 nt, Homo sapiens
gaugcagugcuucca

SEQ ID NO: 1476007 - RNA, 20 nt, Homo sapiens
gaugccacgcuuugcugcua

SEQ ID NO: 1476008 - RNA, 17 nt, Homo sapiens
gaugcggccucagagag

SEQ ID NO: 1476009 - RNA, 16 nt, Homo sapiens
gaugcuauuuaugcaa

SEQ ID NO: 1476010 - RNA, 17 nt, Homo sapiens
gaugcuccugguggcug

SEQ ID NO: 1476011 - RNA, 22 nt, Homo sapiens
gaugcugaggguguuucuuccu

SEQ ID NO: 1476012 - RNA, 20 nt, Homo sapiens
gaugcugccccucaucucuc

SEQ ID NO: 1476013 - RNA, 15 nt, Homo sapiens
gaugcugcuccgccc

SEQ ID NO: 1476014 - RNA, 16 nt, Homo sapiens
gaugcuggacuugccu

SEQ ID NO: 1476015 - RNA, 20 nt, Homo sapiens
gaugcuggcagccauggcca

SEQ ID NO: 1476016 - RNA, 13 nt, Homo sapiens
gaugcugugaaga

SEQ ID NO: 1476017 - RNA, 20 nt, Homo sapiens
gauggaacacggccacauca

SEQ ID NO: 1476018 - RNA, 23 nt, Homo sapiens
gauggaaugaccagccuguccaa

SEQ ID NO: 1476019 - RNA, 19 nt, Homo sapiens
gauggagauauuuacauga

SEQ ID NO: 1476020 - RNA, 18 nt, Homo sapiens
gauggagccagcucugca

SEQ ID NO: 1476021 - RNA, 19 nt, Homo sapiens
gauggaggggugguccuga

SEQ ID NO: 1476022 - RNA, 23 nt, Homo sapiens
gauggaggggugguccugacuca

SEQ ID NO: 1476023 - RNA, 16 nt, Homo sapiens
gauggccagagaugcu

SEQ ID NO: 1476024 - RNA, 14 nt, Homo sapiens
gauggcucguggga

SEQ ID NO: 1476025 - RNA, 17 nt, Homo sapiens
gaugggaccagggaugg

SEQ ID NO: 1476026 - RNA, 19 nt, Homo sapiens
gaugggauggguuccagag

SEQ ID NO: 1476027 - RNA, 16 nt, Homo sapiens
gauggggacauuugaa

SEQ ID NO: 1476028 - RNA, 13 nt, Homo sapiens
gauggggcacuga

SEQ ID NO: 1476029 - RNA, 22 nt, Homo sapiens
gaugggguuucaccaucuuggc

SEQ ID NO: 1476030 - RNA, 22 nt, Homo sapiens
gauguaaaaaugaaaagccaaa

SEQ ID NO: 1476031 - RNA, 23 nt, Homo sapiens
gauguaaaaaugaaaagccaaau

SEQ ID NO: 1476032 - RNA, 22 nt, Homo sapiens
gaugucaaaacaagacuccuca

SEQ ID NO: 1476033 - RNA, 17 nt, Homo sapiens
gaugucagcagacacac

SEQ ID NO: 1476034 - RNA, 17 nt, Homo sapiens
gaugucaugucugcuug

SEQ ID NO: 1476035 - RNA, 12 nt, Homo sapiens
gauguccuacua

SEQ ID NO: 1476036 - RNA, 19 nt, Homo sapiens
gaugugaauuauugacacu

SEQ ID NO: 1476037 - RNA, 16 nt, Homo sapiens
gaugugacagcccuga

SEQ ID NO: 1476038 - RNA, 22 nt, Homo sapiens
gaugugcagccccuuccuggug

SEQ ID NO: 1476039 - RNA, 18 nt, Homo sapiens
gaugugccaauaaccaag

SEQ ID NO: 1476040 - RNA, 22 nt, Homo sapiens
gauguggaucacgcagugcuuu

SEQ ID NO: 1476041 - RNA, 15 nt, Homo sapiens
gauguuucauaagaa

SEQ ID NO: 1476042 - RNA, 20 nt, Homo sapiens
gauuaaacaaacaaacaauu

SEQ ID NO: 1476043 - RNA, 14 nt, Homo sapiens
gauuaaagugccca

SEQ ID NO: 1476044 - RNA, 14 nt, Homo sapiens
gauuaaccucugca

SEQ ID NO: 1476045 - RNA, 23 nt, Homo sapiens
gauuaaccucugcacuacugaca

SEQ ID NO: 1476046 - RNA, 16 nt, Homo sapiens
gauuacaggcaccugc

SEQ ID NO: 1476047 - RNA, 19 nt, Homo sapiens
gauuacuuugcugccuuaa

SEQ ID NO: 1476048 - RNA, 13 nt, Homo sapiens
gauuagcuuugug

SEQ ID NO: 1476049 - RNA, 16 nt, Homo sapiens
gauuagguagacuuug

SEQ ID NO: 1476050 - RNA, 22 nt, Homo sapiens
gauuagugccuucugcccuccc

SEQ ID NO: 1476051 - RNA, 16 nt, Homo sapiens
gauuaugaagugacuc

SEQ ID NO: 1476052 - RNA, 20 nt, Homo sapiens
gauuaugaagugacucucac

SEQ ID NO: 1476053 - RNA, 21 nt, Homo sapiens
gauuauuggaaauuuguuaua

SEQ ID NO: 1476054 - RNA, 22 nt, Homo sapiens
gauucagaaauuggaacagaau

SEQ ID NO: 1476055 - RNA, 17 nt, Homo sapiens
gauucagaugucauuua

SEQ ID NO: 1476056 - RNA, 22 nt, Homo sapiens
gauucagccggagggaagggac

SEQ ID NO: 1476057 - RNA, 17 nt, Homo sapiens
gauuccagucuacuuga

SEQ ID NO: 1476058 - RNA, 16 nt, Homo sapiens
gauucgcccaccucag

SEQ ID NO: 1476059 - RNA, 21 nt, Homo sapiens
gauucugagcagugccucuug

SEQ ID NO: 1476060 - RNA, 15 nt, Homo sapiens
gauucugcagcaccg

SEQ ID NO: 1476061 - RNA, 14 nt, Homo sapiens
gauucuucccacac

SEQ ID NO: 1476062 - RNA, 14 nt, Homo sapiens
gauucuuuguuaca

SEQ ID NO: 1476063 - RNA, 19 nt, Homo sapiens
gauugauagaguguuauca

SEQ ID NO: 1476064 - RNA, 22 nt, Homo sapiens
gauugcagguggaacucaguca

SEQ ID NO: 1476065 - RNA, 22 nt, Homo sapiens
gauugccccuggcuuugccucu

SEQ ID NO: 1476066 - RNA, 14 nt, Homo sapiens
gauuggcucaccca

SEQ ID NO: 1476067 - RNA, 22 nt, Homo sapiens
gauuggguuggaaugcuuucca

SEQ ID NO: 1476068 - RNA, 18 nt, Homo sapiens
gauuguuuccucuuccaa

SEQ ID NO: 1476069 - RNA, 12 nt, Homo sapiens
gauuuacauaua

SEQ ID NO: 1476070 - RNA, 20 nt, Homo sapiens
gauuuauauuuagcaaaaug

SEQ ID NO: 1476071 - RNA, 16 nt, Homo sapiens
gauuuaugaugcacuu

SEQ ID NO: 1476072 - RNA, 23 nt, Homo sapiens
gauuucaccccacagacacuuac

SEQ ID NO: 1476073 - RNA, 13 nt, Homo sapiens
gauuucaggauac

SEQ ID NO: 1476074 - RNA, 22 nt, Homo sapiens
uaaaaacagaaggaaauugaga

SEQ ID NO: 1476075 - RNA, 16 nt, Homo sapiens
uaaaaaggaacaaaua

SEQ ID NO: 1476076 - RNA, 18 nt, Homo sapiens
uaaaaaggcuaaauggaa

SEQ ID NO: 1476077 - RNA, 19 nt, Homo sapiens
uaaaaagugacacagcagc

SEQ ID NO: 1476078 - RNA, 14 nt, Homo sapiens
uaaaaauacaagca

SEQ ID NO: 1476079 - RNA, 15 nt, Homo sapiens
uaaaaaucacacugu

SEQ ID NO: 1476080 - RNA, 18 nt, Homo sapiens
uaaaaaucauaguacucu

SEQ ID NO: 1476081 - RNA, 19 nt, Homo sapiens
uaaaaaucauugauuguca

SEQ ID NO: 1476082 - RNA, 11 nt, Homo sapiens
uaaaaauggaa

SEQ ID NO: 1476083 - RNA, 16 nt, Homo sapiens
uaaaaauguccugccu

SEQ ID NO: 1476084 - RNA, 16 nt, Homo sapiens
uaaaaauugacaauga

SEQ ID NO: 1476085 - RNA, 11 nt, Homo sapiens
uaaaacaaaca

SEQ ID NO: 1476086 - RNA, 16 nt, Homo sapiens
uaaaacaauaauaaua

SEQ ID NO: 1476087 - RNA, 12 nt, Homo sapiens
uaaaacacagcu

SEQ ID NO: 1476088 - RNA, 16 nt, Homo sapiens
uaaaacacauuaugua

SEQ ID NO: 1476089 - RNA, 14 nt, Homo sapiens
uaaaacagaagccu

SEQ ID NO: 1476090 - RNA, 20 nt, Homo sapiens
uaaaacagaagccugaugcu

SEQ ID NO: 1476091 - RNA, 23 nt, Homo sapiens
uaaaacauuauagauuuucaugu

SEQ ID NO: 1476092 - RNA, 12 nt, Homo sapiens
uaaaaccaaaga

SEQ ID NO: 1476093 - RNA, 13 nt, Homo sapiens
uaaaaccaaagag

SEQ ID NO: 1476094 - RNA, 17 nt, Homo sapiens
uaaaaccugugugccau

SEQ ID NO: 1476095 - RNA, 19 nt, Homo sapiens
uaaaacuaugguucccaau

SEQ ID NO: 1476096 - RNA, 18 nt, Homo sapiens
uaaaacucacugugauca

SEQ ID NO: 1476097 - RNA, 20 nt, Homo sapiens
uaaaagaacuuacugauuau

SEQ ID NO: 1476098 - RNA, 15 nt, Homo sapiens
uaaaagaaugacuau

SEQ ID NO: 1476099 - RNA, 19 nt, Homo sapiens
uaaaagcagcaucugcuaa

SEQ ID NO: 1476100 - RNA, 17 nt, Homo sapiens
uaaaagccaauuagcuc

SEQ ID NO: 1476101 - RNA, 22 nt, Homo sapiens
uaaaagccccaaauggugguaa

SEQ ID NO: 1476102 - RNA, 24 nt, Homo sapiens
uaaaagcggaaaguuagugcuugu

SEQ ID NO: 1476103 - RNA, 18 nt, Homo sapiens
uaaaagggaaagaaggcc

SEQ ID NO: 1476104 - RNA, 16 nt, Homo sapiens
uaaaagguaugcaauc

SEQ ID NO: 1476105 - RNA, 14 nt, Homo sapiens
uaaaaguaaauuca

SEQ ID NO: 1476106 - RNA, 19 nt, Homo sapiens
uaaaaguaaauucauguaa

SEQ ID NO: 1476107 - RNA, 13 nt, Homo sapiens
uaaaagucuacca

SEQ ID NO: 1476108 - RNA, 21 nt, Homo sapiens
uaaaagugaaugaaagauuaa

SEQ ID NO: 1476109 - RNA, 15 nt, Homo sapiens
uaaaagugacucuca

SEQ ID NO: 1476110 - RNA, 17 nt, Homo sapiens
uaaaagugggcuugauu

SEQ ID NO: 1476111 - RNA, 12 nt, Homo sapiens
uaaaaguucuuu

SEQ ID NO: 1476112 - RNA, 19 nt, Homo sapiens
uaaaauaauuuucauucau

SEQ ID NO: 1476113 - RNA, 24 nt, Homo sapiens
uaaaauacuuuuacucugccuaca

SEQ ID NO: 1476114 - RNA, 13 nt, Homo sapiens
uaaaauagaaaca

SEQ ID NO: 1476115 - RNA, 20 nt, Homo sapiens
uaaaauauuuagucuaagau

SEQ ID NO: 1476116 - RNA, 22 nt, Homo sapiens
uaaaauauuuaucugauuaagu

SEQ ID NO: 1476117 - RNA, 22 nt, Homo sapiens
uaaaauauuuuguaaugcugca

SEQ ID NO: 1476118 - RNA, 12 nt, Homo sapiens
uaaaaucucaaa

SEQ ID NO: 1476119 - RNA, 19 nt, Homo sapiens
uaaaaucuuggcacagaaa

SEQ ID NO: 1476120 - RNA, 21 nt, Homo sapiens
uaaaaugauuuuaucugugaa

SEQ ID NO: 1476121 - RNA, 20 nt, Homo sapiens
uaaaauuacauugagguucc

SEQ ID NO: 1476122 - RNA, 20 nt, Homo sapiens
uaaaauuaucaauaucuaau

SEQ ID NO: 1476123 - RNA, 12 nt, Homo sapiens
uaaaauucauuu

SEQ ID NO: 1476124 - RNA, 17 nt, Homo sapiens
uaaaauuccauuaucuu

SEQ ID NO: 1476125 - RNA, 22 nt, Homo sapiens
uaaaauuuaucuuaaguucuau

SEQ ID NO: 1476126 - RNA, 17 nt, Homo sapiens
uaaaauuuccacaagca

SEQ ID NO: 1476127 - RNA, 22 nt, Homo sapiens
uaaacaaaugugauacauuuaa

SEQ ID NO: 1476128 - RNA, 18 nt, Homo sapiens
uaaacaagggucaauuca

SEQ ID NO: 1476129 - RNA, 20 nt, Homo sapiens
uaaacaagggucaauucaaa

SEQ ID NO: 1476130 - RNA, 22 nt, Homo sapiens
uaaacacaaauagaacauucca

SEQ ID NO: 1476131 - RNA, 16 nt, Homo sapiens
uaaacacaugccuuaa

SEQ ID NO: 1476132 - RNA, 15 nt, Homo sapiens
uaaacaccuccucau

SEQ ID NO: 1476133 - RNA, 20 nt, Homo sapiens
uaaacagcuucaugccuuug

SEQ ID NO: 1476134 - RNA, 15 nt, Homo sapiens
uaaacauuucauuuc

SEQ ID NO: 1476135 - RNA, 13 nt, Homo sapiens
uaaaccaaccuuu

SEQ ID NO: 1476136 - RNA, 18 nt, Homo sapiens
uaaacccaguugccaucu

SEQ ID NO: 1476137 - RNA, 18 nt, Homo sapiens
uaaaccguggucucaugu

SEQ ID NO: 1476138 - RNA, 19 nt, Homo sapiens
uaaaccuagaguuuuauca

SEQ ID NO: 1476139 - RNA, 20 nt, Homo sapiens
uaaaccuagaguuuuaucaa

SEQ ID NO: 1476140 - RNA, 16 nt, Homo sapiens
uaaaccucaaaauguc

SEQ ID NO: 1476141 - RNA, 13 nt, Homo sapiens
uaaacucagggac

SEQ ID NO: 1476142 - RNA, 21 nt, Homo sapiens
uaaacucagggacagagccau

SEQ ID NO: 1476143 - RNA, 13 nt, Homo sapiens
uaaagaaaaccuu

SEQ ID NO: 1476144 - RNA, 21 nt, Homo sapiens
uaaagaaaaguagguuuacau

SEQ ID NO: 1476145 - RNA, 15 nt, Homo sapiens
uaaagaagaacuugc

SEQ ID NO: 1476146 - RNA, 14 nt, Homo sapiens
uaaagaaguuugau

SEQ ID NO: 1476147 - RNA, 21 nt, Homo sapiens
uaaagacagggaagagcagaa

SEQ ID NO: 1476148 - RNA, 20 nt, Homo sapiens
uaaagacugguuuucugcca

SEQ ID NO: 1476149 - RNA, 18 nt, Homo sapiens
uaaagagcuuugugauau

SEQ ID NO: 1476150 - RNA, 18 nt, Homo sapiens
uaaagauaauugcuauuu

SEQ ID NO: 1476151 - RNA, 16 nt, Homo sapiens
uaaagauauuguucaa

SEQ ID NO: 1476152 - RNA, 18 nt, Homo sapiens
uaaagaugaacucugaac

SEQ ID NO: 1476153 - RNA, 15 nt, Homo sapiens
uaaagcauauuggug

SEQ ID NO: 1476154 - RNA, 11 nt, Homo sapiens
uaaagccucaa

SEQ ID NO: 1476155 - RNA, 18 nt, Homo sapiens
uaaagcucaucagcuauc

SEQ ID NO: 1476156 - RNA, 22 nt, Homo sapiens
uaaagcugccggcacagaacuu

SEQ ID NO: 1476157 - RNA, 17 nt, Homo sapiens
uaaagcuuaacacuuga

SEQ ID NO: 1476158 - RNA, 16 nt, Homo sapiens
uaaaggaauuccccaa

SEQ ID NO: 1476159 - RNA, 18 nt, Homo sapiens
uaaaggcccccacuucuc

SEQ ID NO: 1476160 - RNA, 16 nt, Homo sapiens
uaaaggugguccuucc

SEQ ID NO: 1476161 - RNA, 23 nt, Homo sapiens
uaaaggugguccuuccuaccucu

SEQ ID NO: 1476162 - RNA, 22 nt, Homo sapiens
uaaagguuuuuaaauuguuuca

SEQ ID NO: 1476163 - RNA, 15 nt, Homo sapiens
uaaaguacaucucua

SEQ ID NO: 1476164 - RNA, 16 nt, Homo sapiens
uaaagugcccagcaca

SEQ ID NO: 1476165 - RNA, 18 nt, Homo sapiens
uaaagugccuuacagggu

SEQ ID NO: 1476166 - RNA, 19 nt, Homo sapiens
uaaagugcuugcuuuuugc

SEQ ID NO: 1476167 - RNA, 22 nt, Homo sapiens
uaaaguuacuauucuguaucau

SEQ ID NO: 1476168 - RNA, 21 nt, Homo sapiens
uaaaguuuuaggguacaguuu

SEQ ID NO: 1476169 - RNA, 16 nt, Homo sapiens
uaaauaaaccacugug

SEQ ID NO: 1476170 - RNA, 18 nt, Homo sapiens
uaaauaaaccacugugcg

SEQ ID NO: 1476171 - RNA, 15 nt, Homo sapiens
uaaauaaaucauuaa

SEQ ID NO: 1476172 - RNA, 23 nt, Homo sapiens
uaaauacacaacacacacacucu

SEQ ID NO: 1476173 - RNA, 12 nt, Homo sapiens
uaaauacagaca

SEQ ID NO: 1476174 - RNA, 17 nt, Homo sapiens
uaaauaccagacacgua

SEQ ID NO: 1476175 - RNA, 21 nt, Homo sapiens
uaaauagaguauaugcacuuu

SEQ ID NO: 1476176 - RNA, 18 nt, Homo sapiens
uacacacuuuuuaagaaa

SEQ ID NO: 1476177 - RNA, 14 nt, Homo sapiens
uacacauugcauuu

SEQ ID NO: 1476178 - RNA, 18 nt, Homo sapiens
uacaccauuaucuuggaa

SEQ ID NO: 1476179 - RNA, 14 nt, Homo sapiens
uacacccaccagag

SEQ ID NO: 1476180 - RNA, 21 nt, Homo sapiens
uacacggaggucucuguaaaa

SEQ ID NO: 1476181 - RNA, 18 nt, Homo sapiens
uacacugcuguacccaga

SEQ ID NO: 1476182 - RNA, 17 nt, Homo sapiens
uacagaaaagacucuga

SEQ ID NO: 1476183 - RNA, 20 nt, Homo sapiens
uacagaaaagacucugacca

SEQ ID NO: 1476184 - RNA, 22 nt, Homo sapiens
uacagaaguccccucuacuuua

SEQ ID NO: 1476185 - RNA, 22 nt, Homo sapiens
uacagacaagguucugcccuua

SEQ ID NO: 1476186 - RNA, 13 nt, Homo sapiens
uacagacauacau

SEQ ID NO: 1476187 - RNA, 23 nt, Homo sapiens
uacagacauacauuuaugcacau

SEQ ID NO: 1476188 - RNA, 20 nt, Homo sapiens
uacagauagauauaugcucu

SEQ ID NO: 1476189 - RNA, 17 nt, Homo sapiens
uacagauauuugucaug

SEQ ID NO: 1476190 - RNA, 23 nt, Homo sapiens
uacagcaugugccuuaaugcuuc

SEQ ID NO: 1476191 - RNA, 14 nt, Homo sapiens
uacagccuggacca

SEQ ID NO: 1476192 - RNA, 22 nt, Homo sapiens
uacagcuaaucagcauucucac

SEQ ID NO: 1476193 - RNA, 22 nt, Homo sapiens
uacaggaggggucucauguccu

SEQ ID NO: 1476194 - RNA, 14 nt, Homo sapiens
uacaggcgugagcc

SEQ ID NO: 1476195 - RNA, 19 nt, Homo sapiens
uacaggugaaggcucucac

SEQ ID NO: 1476196 - RNA, 15 nt, Homo sapiens
uacaguacacagaua

SEQ ID NO: 1476197 - RNA, 19 nt, Homo sapiens
uacaguauguuuuacaugu

SEQ ID NO: 1476198 - RNA, 22 nt, Homo sapiens
uacaguauuguggcugcacuug

SEQ ID NO: 1476199 - RNA, 21 nt, Homo sapiens
uacagucuaaaauugcuucuu

SEQ ID NO: 1476200 - RNA, 17 nt, Homo sapiens
uacagugcagagccuuc

SEQ ID NO: 1476201 - RNA, 20 nt, Homo sapiens
uacaguuaggcaccagaaga

SEQ ID NO: 1476202 - RNA, 16 nt, Homo sapiens
uacaguucugucauau

SEQ ID NO: 1476203 - RNA, 23 nt, Homo sapiens
uacauaauaaaaaauuaugacaa

SEQ ID NO: 1476204 - RNA, 15 nt, Homo sapiens
uacauaauguauugu

SEQ ID NO: 1476205 - RNA, 20 nt, Homo sapiens
uacauacaggccauacuuua

SEQ ID NO: 1476206 - RNA, 16 nt, Homo sapiens
uacauaucuuuauuaa

SEQ ID NO: 1476207 - RNA, 18 nt, Homo sapiens
uacauauguaaacauaag

SEQ ID NO: 1476208 - RNA, 14 nt, Homo sapiens
uacauauguagaua

SEQ ID NO: 1476209 - RNA, 13 nt, Homo sapiens
uacauaugugcug

SEQ ID NO: 1476210 - RNA, 15 nt, Homo sapiens
uacauauuacuguug

SEQ ID NO: 1476211 - RNA, 13 nt, Homo sapiens
uacauauuaucuc

SEQ ID NO: 1476212 - RNA, 14 nt, Homo sapiens
uacauauuaucuca

SEQ ID NO: 1476213 - RNA, 22 nt, Homo sapiens
uacauccaaagcagacagcucc

SEQ ID NO: 1476214 - RNA, 17 nt, Homo sapiens
uacaucucuacuaaaaa

SEQ ID NO: 1476215 - RNA, 21 nt, Homo sapiens
uacaucugcaauaugaauuca

SEQ ID NO: 1476216 - RNA, 21 nt, Homo sapiens
uacaucugggacugacuuucc

SEQ ID NO: 1476217 - RNA, 13 nt, Homo sapiens
uacaugaagaaua

SEQ ID NO: 1476218 - RNA, 10 nt, Homo sapiens
uacaugacug

SEQ ID NO: 1476219 - RNA, 11 nt, Homo sapiens
uacaugacugg

SEQ ID NO: 1476220 - RNA, 11 nt, Homo sapiens
uacauggaaua

SEQ ID NO: 1476221 - RNA, 20 nt, Homo sapiens
uacauggaauaacauguaau

SEQ ID NO: 1476222 - RNA, 14 nt, Homo sapiens
uacauguauugcac

SEQ ID NO: 1476223 - RNA, 13 nt, Homo sapiens
uacauuaucucac

SEQ ID NO: 1476224 - RNA, 16 nt, Homo sapiens
uacauuaucucacuua

SEQ ID NO: 1476225 - RNA, 20 nt, Homo sapiens
uacauucuuuaucuugacau

SEQ ID NO: 1476226 - RNA, 15 nt, Homo sapiens
uacauuuaauacagc

SEQ ID NO: 1476227 - RNA, 13 nt, Homo sapiens
uacauuuaugcac

SEQ ID NO: 1476228 - RNA, 17 nt, Homo sapiens
uacauuuaugcacauuc

SEQ ID NO: 1476229 - RNA, 15 nt, Homo sapiens
uacauuucuaucagu

SEQ ID NO: 1476230 - RNA, 21 nt, Homo sapiens
uacauuuuuugggcagcaauu

SEQ ID NO: 1476231 - RNA, 23 nt, Homo sapiens
uacauuuuuugggcagcaauuua

SEQ ID NO: 1476232 - RNA, 24 nt, Homo sapiens
uacauuuuuugggcagcaauuuaa

SEQ ID NO: 1476233 - RNA, 14 nt, Homo sapiens
uaccaaucauuuua

SEQ ID NO: 1476234 - RNA, 16 nt, Homo sapiens
uaccacuaacuccuga

SEQ ID NO: 1476235 - RNA, 18 nt, Homo sapiens
uaccacuaacuccugaga

SEQ ID NO: 1476236 - RNA, 16 nt, Homo sapiens
uaccacucuaccaaau

SEQ ID NO: 1476237 - RNA, 14 nt, Homo sapiens
uaccacuuguauua

SEQ ID NO: 1476238 - RNA, 14 nt, Homo sapiens
uaccagagauuuac

SEQ ID NO: 1476239 - RNA, 18 nt, Homo sapiens
uaccaguauagcuugcau

SEQ ID NO: 1476240 - RNA, 23 nt, Homo sapiens
uaccauuaaaguucucaaugcaa

SEQ ID NO: 1476241 - RNA, 14 nt, Homo sapiens
uaccauuuccucag

SEQ ID NO: 1476242 - RNA, 14 nt, Homo sapiens
uacccaauuuccca

SEQ ID NO: 1476243 - RNA, 13 nt, Homo sapiens
uacccacauguac

SEQ ID NO: 1476244 - RNA, 20 nt, Homo sapiens
uaccccagggcccuggccag

SEQ ID NO: 1476245 - RNA, 19 nt, Homo sapiens
uaccccugcucccauuccu

SEQ ID NO: 1476246 - RNA, 14 nt, Homo sapiens
uacccuauacaucc

SEQ ID NO: 1476247 - RNA, 11 nt, Homo sapiens
uacccucucag

SEQ ID NO: 1476248 - RNA, 23 nt, Homo sapiens
uacccuugugagagcccauuccc

SEQ ID NO: 1476249 - RNA, 15 nt, Homo sapiens
uaccgcccucggggc

SEQ ID NO: 1476250 - RNA, 15 nt, Homo sapiens
uaccucgaguuuuaa

SEQ ID NO: 1476251 - RNA, 23 nt, Homo sapiens
uaccucuaaguacauauguagau

SEQ ID NO: 1476252 - RNA, 11 nt, Homo sapiens
uaccucuggca

SEQ ID NO: 1476253 - RNA, 15 nt, Homo sapiens
uaccugagauggagg

SEQ ID NO: 1476254 - RNA, 15 nt, Homo sapiens
uaccugaggccagga

SEQ ID NO: 1476255 - RNA, 21 nt, Homo sapiens
uaccugggcauucuuguuuca

SEQ ID NO: 1476256 - RNA, 16 nt, Homo sapiens
uaccuuaucacugcau

SEQ ID NO: 1476257 - RNA, 16 nt, Homo sapiens
uaccuucuuguugaua

SEQ ID NO: 1476258 - RNA, 20 nt, Homo sapiens
uaccuugaacucuuagugau

SEQ ID NO: 1476259 - RNA, 12 nt, Homo sapiens
uacggacacugu

SEQ ID NO: 1476260 - RNA, 20 nt, Homo sapiens
uacguuuccugagaaguguc

SEQ ID NO: 1476261 - RNA, 17 nt, Homo sapiens
uacuaaggaaucuuucu

SEQ ID NO: 1476262 - RNA, 16 nt, Homo sapiens
uacuaaggugcuagga

SEQ ID NO: 1476263 - RNA, 20 nt, Homo sapiens
uacuagagcgacugaggcag

SEQ ID NO: 1476264 - RNA, 19 nt, Homo sapiens
uacuaggagaggggggcca

SEQ ID NO: 1476265 - RNA, 16 nt, Homo sapiens
uacuauaguaccagua

SEQ ID NO: 1476266 - RNA, 15 nt, Homo sapiens
uacuauccaaucugu

SEQ ID NO: 1476267 - RNA, 18 nt, Homo sapiens
uacuaugugccaguuccu

SEQ ID NO: 1476268 - RNA, 23 nt, Homo sapiens
uacucaaggaauuugcauuuagu

SEQ ID NO: 1476269 - RNA, 21 nt, Homo sapiens
uacucaggguucaucugucca

SEQ ID NO: 1476270 - RNA, 21 nt, Homo sapiens
uacucagguuaaugcugaaaa

SEQ ID NO: 1476271 - RNA, 23 nt, Homo sapiens
uacucgggaggcugagacaggag

SEQ ID NO: 1476272 - RNA, 20 nt, Homo sapiens
uacucgggaggcugaggcag

SEQ ID NO: 1476273 - RNA, 16 nt, Homo sapiens
uacucuggggugcugc

SEQ ID NO: 1476274 - RNA, 20 nt, Homo sapiens
uacucuuucuaaugcugaua

SEQ ID NO: 1476275 - RNA, 21 nt, Homo sapiens
uacugaaaaggaggggucugg

SEQ ID NO: 1476276 - RNA, 13 nt, Homo sapiens
uacugaccagcaa

SEQ ID NO: 1476277 - RNA, 16 nt, Homo sapiens
uacugcagcaccucca

SEQ ID NO: 1476278 - RNA, 13 nt, Homo sapiens
uacugccauguac

SEQ ID NO: 1476279 - RNA, 17 nt, Homo sapiens
uagcuggaugugguggu

SEQ ID NO: 1476280 - RNA, 18 nt, Homo sapiens
uagcugggacuacagggg

SEQ ID NO: 1476281 - RNA, 17 nt, Homo sapiens
uagcuguaaacugaaua

SEQ ID NO: 1476282 - RNA, 14 nt, Homo sapiens
uagcuuaacuaauu

SEQ ID NO: 1476283 - RNA, 22 nt, Homo sapiens
uagcuucuuucccuuagugacu

SEQ ID NO: 1476284 - RNA, 23 nt, Homo sapiens
uagcuuuaaaaccugugugccau

SEQ ID NO: 1476285 - RNA, 22 nt, Homo sapiens
uagcuuuagggcaauauugcca

SEQ ID NO: 1476286 - RNA, 22 nt, Homo sapiens
uagcuuuccacauuugucacag

SEQ ID NO: 1476287 - RNA, 21 nt, Homo sapiens
uaggaaaaauaaaacuucaca

SEQ ID NO: 1476288 - RNA, 17 nt, Homo sapiens
uaggaaaaguacauuua

SEQ ID NO: 1476289 - RNA, 18 nt, Homo sapiens
uaggaaacucacacuccc

SEQ ID NO: 1476290 - RNA, 18 nt, Homo sapiens
uaggaaagaggaagcaaa

SEQ ID NO: 1476291 - RNA, 19 nt, Homo sapiens
uaggaaaucuagaaguagu

SEQ ID NO: 1476292 - RNA, 20 nt, Homo sapiens
uaggaacagcaguguucuca

SEQ ID NO: 1476293 - RNA, 18 nt, Homo sapiens
uaggaaccuaugaaacua

SEQ ID NO: 1476294 - RNA, 13 nt, Homo sapiens
uaggaagcacuga

SEQ ID NO: 1476295 - RNA, 22 nt, Homo sapiens
uaggaaggucucauucuuccaa

SEQ ID NO: 1476296 - RNA, 16 nt, Homo sapiens
uaggaauaaauaaaaa

SEQ ID NO: 1476297 - RNA, 16 nt, Homo sapiens
uaggaggcugaggcag

SEQ ID NO: 1476298 - RNA, 17 nt, Homo sapiens
uaggagggagacacugg

SEQ ID NO: 1476299 - RNA, 20 nt, Homo sapiens
uaggagggcuggcaacuuag

SEQ ID NO: 1476300 - RNA, 22 nt, Homo sapiens
uaggcaaagauaauuuauuuca

SEQ ID NO: 1476301 - RNA, 20 nt, Homo sapiens
uaggcaagcaggaccuggca

SEQ ID NO: 1476302 - RNA, 19 nt, Homo sapiens
uaggcagcaagcuuugguu

SEQ ID NO: 1476303 - RNA, 15 nt, Homo sapiens
uaggcagugcuaaag

SEQ ID NO: 1476304 - RNA, 19 nt, Homo sapiens
uaggccagggcauguguau

SEQ ID NO: 1476305 - RNA, 12 nt, Homo sapiens
uaggcucugcac

SEQ ID NO: 1476306 - RNA, 23 nt, Homo sapiens
uagggaguuagaggcuguacaag

SEQ ID NO: 1476307 - RNA, 19 nt, Homo sapiens
uagggcaauauugccaugg

SEQ ID NO: 1476308 - RNA, 18 nt, Homo sapiens
uaggggaacagaccagug

SEQ ID NO: 1476309 - RNA, 21 nt, Homo sapiens
uaggggaagggcuuugagggu

SEQ ID NO: 1476310 - RNA, 13 nt, Homo sapiens
uaggggcaaaaau

SEQ ID NO: 1476311 - RNA, 16 nt, Homo sapiens
uaggguggcccuugca

SEQ ID NO: 1476312 - RNA, 17 nt, Homo sapiens
uagguauauauaugcca

SEQ ID NO: 1476313 - RNA, 17 nt, Homo sapiens
uagguaucauucaacuc

SEQ ID NO: 1476314 - RNA, 16 nt, Homo sapiens
uaggucauuggccacu

SEQ ID NO: 1476315 - RNA, 15 nt, Homo sapiens
uagguguggcuguga

SEQ ID NO: 1476316 - RNA, 19 nt, Homo sapiens
uagguucaggaagaccaca

SEQ ID NO: 1476317 - RNA, 20 nt, Homo sapiens
uagguuuacauucaucucau

SEQ ID NO: 1476318 - RNA, 20 nt, Homo sapiens
uaguacuuauguugcacaau

SEQ ID NO: 1476319 - RNA, 12 nt, Homo sapiens
uaguacuugaaa

SEQ ID NO: 1476320 - RNA, 23 nt, Homo sapiens
uaguacuugggagaccuguaauc

SEQ ID NO: 1476321 - RNA, 13 nt, Homo sapiens
uaguauacuuugu

SEQ ID NO: 1476322 - RNA, 13 nt, Homo sapiens
uaguauuggagca

SEQ ID NO: 1476323 - RNA, 13 nt, Homo sapiens
uaguauuuaugaa

SEQ ID NO: 1476324 - RNA, 22 nt, Homo sapiens
uagucaacaugccauaucucau

SEQ ID NO: 1476325 - RNA, 12 nt, Homo sapiens
uagucauacucc

SEQ ID NO: 1476326 - RNA, 17 nt, Homo sapiens
uagucccagcuacuccg

SEQ ID NO: 1476327 - RNA, 19 nt, Homo sapiens
uagucccagcuacuccgga

SEQ ID NO: 1476328 - RNA, 15 nt, Homo sapiens
uagucucauucuguc

SEQ ID NO: 1476329 - RNA, 20 nt, Homo sapiens
uagugcacccagugacugac

SEQ ID NO: 1476330 - RNA, 16 nt, Homo sapiens
uaguggaagcuucuaa

SEQ ID NO: 1476331 - RNA, 14 nt, Homo sapiens
uaguguacuuggag

SEQ ID NO: 1476332 - RNA, 20 nt, Homo sapiens
uaguguauaaaaaccaugcu

SEQ ID NO: 1476333 - RNA, 14 nt, Homo sapiens
uaguuaaaguaaug

SEQ ID NO: 1476334 - RNA, 20 nt, Homo sapiens
uaguucacccccugagaucc

SEQ ID NO: 1476335 - RNA, 23 nt, Homo sapiens
uaguugaucuacaaaggccaugg

SEQ ID NO: 1476336 - RNA, 19 nt, Homo sapiens
uaguuucuccaaguacuuu

SEQ ID NO: 1476337 - RNA, 16 nt, Homo sapiens
uaguuuuaguugcaga

SEQ ID NO: 1476338 - RNA, 20 nt, Homo sapiens
uaguuuugucaaacuguaga

SEQ ID NO: 1476339 - RNA, 15 nt, Homo sapiens
uauaaaaagcuucca

SEQ ID NO: 1476340 - RNA, 15 nt, Homo sapiens
uauaaaauuaaucac

SEQ ID NO: 1476341 - RNA, 17 nt, Homo sapiens
uauaaacuguaugcuca

SEQ ID NO: 1476342 - RNA, 16 nt, Homo sapiens
uauaaagaagaacuug

SEQ ID NO: 1476343 - RNA, 22 nt, Homo sapiens
uauaaagaagaacuugcaugga

SEQ ID NO: 1476344 - RNA, 20 nt, Homo sapiens
uauaaauacaaaucuguaua

SEQ ID NO: 1476345 - RNA, 15 nt, Homo sapiens
uauaaauagccuuca

SEQ ID NO: 1476346 - RNA, 14 nt, Homo sapiens
uauaaaugcuauuu

SEQ ID NO: 1476347 - RNA, 21 nt, Homo sapiens
uauaaauguuaguucuagcuc

SEQ ID NO: 1476348 - RNA, 21 nt, Homo sapiens
uauaacagaauuaaaguagau

SEQ ID NO: 1476349 - RNA, 22 nt, Homo sapiens
uauaacccuaggaauuuagaca

SEQ ID NO: 1476350 - RNA, 16 nt, Homo sapiens
uauaagaaagaucaaa

SEQ ID NO: 1476351 - RNA, 13 nt, Homo sapiens
uauaagacuacua

SEQ ID NO: 1476352 - RNA, 20 nt, Homo sapiens
uauaagcagauuuaacaauu

SEQ ID NO: 1476353 - RNA, 15 nt, Homo sapiens
uauaagucacaaaga

SEQ ID NO: 1476354 - RNA, 23 nt, Homo sapiens
uauaagugaagugauacuaucca

SEQ ID NO: 1476355 - RNA, 23 nt, Homo sapiens
uauaauaaagaaaaccuuucuac

SEQ ID NO: 1476356 - RNA, 18 nt, Homo sapiens
uauaauuggugcauagca

SEQ ID NO: 1476357 - RNA, 17 nt, Homo sapiens
uauaauuguaccaaccu

SEQ ID NO: 1476358 - RNA, 22 nt, Homo sapiens
uauaauuucaaaccacacauua

SEQ ID NO: 1476359 - RNA, 23 nt, Homo sapiens
uauaauuucaaaccacacauuag

SEQ ID NO: 1476360 - RNA, 13 nt, Homo sapiens
uauacagcuguau

SEQ ID NO: 1476361 - RNA, 15 nt, Homo sapiens
uauacaggcauaaaa

SEQ ID NO: 1476362 - RNA, 11 nt, Homo sapiens
uauacaucucu

SEQ ID NO: 1476363 - RNA, 21 nt, Homo sapiens
uauacauucuuuaucuugaca

SEQ ID NO: 1476364 - RNA, 17 nt, Homo sapiens
uauaccaucuccagcua

SEQ ID NO: 1476365 - RNA, 15 nt, Homo sapiens
uauaccucaaugucc

SEQ ID NO: 1476366 - RNA, 19 nt, Homo sapiens
uauacgcuggcaacacaga

SEQ ID NO: 1476367 - RNA, 17 nt, Homo sapiens
uauagagccuaccugua

SEQ ID NO: 1476368 - RNA, 16 nt, Homo sapiens
uauagaguagaagauu

SEQ ID NO: 1476369 - RNA, 13 nt, Homo sapiens
uauagcuaaguac

SEQ ID NO: 1476370 - RNA, 20 nt, Homo sapiens
uauaggugauguuugcucuu

SEQ ID NO: 1476371 - RNA, 18 nt, Homo sapiens
uauagguuuugguuccac

SEQ ID NO: 1476372 - RNA, 19 nt, Homo sapiens
uauaguaacacacuuccag

SEQ ID NO: 1476373 - RNA, 14 nt, Homo sapiens
uauauaaacuuaac

SEQ ID NO: 1476374 - RNA, 15 nt, Homo sapiens
uauauaaguguacau

SEQ ID NO: 1476375 - RNA, 13 nt, Homo sapiens
uauauacaaggug

SEQ ID NO: 1476376 - RNA, 13 nt, Homo sapiens
uauauacauucuu

SEQ ID NO: 1476377 - RNA, 21 nt, Homo sapiens
uauauacccccccaugcaguc

SEQ ID NO: 1476378 - RNA, 21 nt, Homo sapiens
uauauagggaucaaccagcua

SEQ ID NO: 1476379 - RNA, 22 nt, Homo sapiens
uauauaugcuuggcuaacuaua

SEQ ID NO: 1476380 - RNA, 16 nt, Homo sapiens
uauauaugugugugua

SEQ ID NO: 1476381 - RNA, 13 nt, Homo sapiens
uauuaguauuaau

SEQ ID NO: 1476382 - RNA, 13 nt, Homo sapiens
uauuauaagcauu

SEQ ID NO: 1476383 - RNA, 22 nt, Homo sapiens
uauuaucuacaaacacugcaga

SEQ ID NO: 1476384 - RNA, 14 nt, Homo sapiens
uauuaugcauauau

SEQ ID NO: 1476385 - RNA, 18 nt, Homo sapiens
uauuaugccugaaugacu

SEQ ID NO: 1476386 - RNA, 17 nt, Homo sapiens
uauuauucuucauaaca

SEQ ID NO: 1476387 - RNA, 15 nt, Homo sapiens
uauuauugcugccaa

SEQ ID NO: 1476388 - RNA, 14 nt, Homo sapiens
uauucagacaagca

SEQ ID NO: 1476389 - RNA, 13 nt, Homo sapiens
uauucagcccacu

SEQ ID NO: 1476390 - RNA, 14 nt, Homo sapiens
uauucaggagagua

SEQ ID NO: 1476391 - RNA, 18 nt, Homo sapiens
uauucaguaauaacucua

SEQ ID NO: 1476392 - RNA, 20 nt, Homo sapiens
uauuccgauacaaaguguug

SEQ ID NO: 1476393 - RNA, 11 nt, Homo sapiens
uauuccugcug

SEQ ID NO: 1476394 - RNA, 16 nt, Homo sapiens
uauucuaaaaccauuc

SEQ ID NO: 1476395 - RNA, 18 nt, Homo sapiens
uauucuaagccaguuuuc

SEQ ID NO: 1476396 - RNA, 15 nt, Homo sapiens
uauucuucauaacaa

SEQ ID NO: 1476397 - RNA, 21 nt, Homo sapiens
uauugaacuuuuguacugaau

SEQ ID NO: 1476398 - RNA, 13 nt, Homo sapiens
uauugaagacaau

SEQ ID NO: 1476399 - RNA, 16 nt, Homo sapiens
uauugcaagaguuuaa

SEQ ID NO: 1476400 - RNA, 17 nt, Homo sapiens
uauugcuucaccauggc

SEQ ID NO: 1476401 - RNA, 22 nt, Homo sapiens
uauuggacauccccagaaaaga

SEQ ID NO: 1476402 - RNA, 23 nt, Homo sapiens
uauuggcccuaaauagcagaaag

SEQ ID NO: 1476403 - RNA, 23 nt, Homo sapiens
uauugucauaggauuaagcaguu

SEQ ID NO: 1476404 - RNA, 15 nt, Homo sapiens
uauuguuguugccaa

SEQ ID NO: 1476405 - RNA, 14 nt, Homo sapiens
uauuguuucugcau

SEQ ID NO: 1476406 - RNA, 20 nt, Homo sapiens
uauuuaaaaacaaaaggcaa

SEQ ID NO: 1476407 - RNA, 14 nt, Homo sapiens
uauuuaacauuaac

SEQ ID NO: 1476408 - RNA, 17 nt, Homo sapiens
uauuuaagaaaagcacu

SEQ ID NO: 1476409 - RNA, 16 nt, Homo sapiens
uauuuaagcaacaucu

SEQ ID NO: 1476410 - RNA, 14 nt, Homo sapiens
uauuuaaguucaca

SEQ ID NO: 1476411 - RNA, 22 nt, Homo sapiens
uauuuaaucaaacaguaaucua

SEQ ID NO: 1476412 - RNA, 21 nt, Homo sapiens
uauuuacugagcuucucugug

SEQ ID NO: 1476413 - RNA, 13 nt, Homo sapiens
uauuuauaacuca

SEQ ID NO: 1476414 - RNA, 15 nt, Homo sapiens
uauuuauagucacaa

SEQ ID NO: 1476415 - RNA, 19 nt, Homo sapiens
uauuuaucagugacagagu

SEQ ID NO: 1476416 - RNA, 20 nt, Homo sapiens
uauuuauccaaaauguguau

SEQ ID NO: 1476417 - RNA, 15 nt, Homo sapiens
uauuuaugaaguuua

SEQ ID NO: 1476418 - RNA, 21 nt, Homo sapiens
uauuuaugcacugugggaugu

SEQ ID NO: 1476419 - RNA, 15 nt, Homo sapiens
uauuuaugugugagg

SEQ ID NO: 1476420 - RNA, 19 nt, Homo sapiens
uauuuauugaguaccuacu

SEQ ID NO: 1476421 - RNA, 20 nt, Homo sapiens
uauuucaaaauauacauuca

SEQ ID NO: 1476422 - RNA, 16 nt, Homo sapiens
uauuucacuaucuucu

SEQ ID NO: 1476423 - RNA, 15 nt, Homo sapiens
uauuucucuuugcac

SEQ ID NO: 1476424 - RNA, 15 nt, Homo sapiens
uauuucuugcauuca

SEQ ID NO: 1476425 - RNA, 21 nt, Homo sapiens
uauuugaagcaucacauaaaa

SEQ ID NO: 1476426 - RNA, 16 nt, Homo sapiens
uauuugauaacaguua

SEQ ID NO: 1476427 - RNA, 21 nt, Homo sapiens
uauuugauaacaguuacucca

SEQ ID NO: 1476428 - RNA, 19 nt, Homo sapiens
uauuugcacacugcacugu

SEQ ID NO: 1476429 - RNA, 19 nt, Homo sapiens
uauuugcauguuaccuccu

SEQ ID NO: 1476430 - RNA, 22 nt, Homo sapiens
uauuuuagcugcacggcauuac

SEQ ID NO: 1476431 - RNA, 17 nt, Homo sapiens
uauuuucuacagugguu

SEQ ID NO: 1476432 - RNA, 18 nt, Homo sapiens
uauuuugcauaguaccaa

SEQ ID NO: 1476433 - RNA, 14 nt, Homo sapiens
uauuuuguguccuc

SEQ ID NO: 1476434 - RNA, 19 nt, Homo sapiens
uauuuuuacaagaaguuua

SEQ ID NO: 1476435 - RNA, 19 nt, Homo sapiens
uauuuuuauaucaugcaaa

SEQ ID NO: 1476436 - RNA, 17 nt, Homo sapiens
uauuuuuuaaguauuua

SEQ ID NO: 1476437 - RNA, 22 nt, Homo sapiens
uauuuuuucgugcacucugcua

SEQ ID NO: 1476438 - RNA, 16 nt, Homo sapiens
uauuuuuuuuuugcca

SEQ ID NO: 1476439 - RNA, 17 nt, Homo sapiens
uauuuuuuuuuugccaa

SEQ ID NO: 1476440 - RNA, 18 nt, Homo sapiens
ucaaaaaagauagaucua

SEQ ID NO: 1476441 - RNA, 15 nt, Homo sapiens
ucaaaaaucuguccg

SEQ ID NO: 1476442 - RNA, 23 nt, Homo sapiens
ucaaaaauuaucuauagcuaagu

SEQ ID NO: 1476443 - RNA, 12 nt, Homo sapiens
ucaaaagaucaa

SEQ ID NO: 1476444 - RNA, 18 nt, Homo sapiens
ucaaaagccuuaccuuga

SEQ ID NO: 1476445 - RNA, 15 nt, Homo sapiens
ucaaaaggaaaccaa

SEQ ID NO: 1476446 - RNA, 22 nt, Homo sapiens
ucaaaagguuaauaaaguaauu

SEQ ID NO: 1476447 - RNA, 22 nt, Homo sapiens
ucaaaauaaaaagugacacagc

SEQ ID NO: 1476448 - RNA, 17 nt, Homo sapiens
ucaaaauaaaaaugagg

SEQ ID NO: 1476449 - RNA, 22 nt, Homo sapiens
ucaaaauaaaaaugagguacuc

SEQ ID NO: 1476450 - RNA, 17 nt, Homo sapiens
ucaaaauauacauucaa

SEQ ID NO: 1476451 - RNA, 21 nt, Homo sapiens
ucaaaauccuuccaaagaauu

SEQ ID NO: 1476452 - RNA, 14 nt, Homo sapiens
ucaaaaugcuuuuu

SEQ ID NO: 1476453 - RNA, 21 nt, Homo sapiens
ucaaacauauucuaaugccug

SEQ ID NO: 1476454 - RNA, 14 nt, Homo sapiens
ucaaacauuucaaa

SEQ ID NO: 1476455 - RNA, 17 nt, Homo sapiens
ucaaaccugaccacaga

SEQ ID NO: 1476456 - RNA, 14 nt, Homo sapiens
ucaaauaacuaaaa

SEQ ID NO: 1476457 - RNA, 18 nt, Homo sapiens
ucaaauacuuuaaaggaa

SEQ ID NO: 1476458 - RNA, 20 nt, Homo sapiens
ucaaauagaaccacuaugaa

SEQ ID NO: 1476459 - RNA, 19 nt, Homo sapiens
ucaaauaucaguuacccac

SEQ ID NO: 1476460 - RNA, 15 nt, Homo sapiens
ucaaaucugagggag

SEQ ID NO: 1476461 - RNA, 16 nt, Homo sapiens
ucaaauguauucagau

SEQ ID NO: 1476462 - RNA, 17 nt, Homo sapiens
ucaaauuggacuuucaa

SEQ ID NO: 1476463 - RNA, 18 nt, Homo sapiens
ucaaauuuuuacugagaa

SEQ ID NO: 1476464 - RNA, 12 nt, Homo sapiens
ucaacagaauug

SEQ ID NO: 1476465 - RNA, 15 nt, Homo sapiens
ucaacagccaagugu

SEQ ID NO: 1476466 - RNA, 17 nt, Homo sapiens
ucaacaggcccagggag

SEQ ID NO: 1476467 - RNA, 12 nt, Homo sapiens
ucaacauaugca

SEQ ID NO: 1476468 - RNA, 13 nt, Homo sapiens
ucaacauaugcaa

SEQ ID NO: 1476469 - RNA, 21 nt, Homo sapiens
ucaacauccugccagccccac

SEQ ID NO: 1476470 - RNA, 12 nt, Homo sapiens
ucaacauugcau

SEQ ID NO: 1476471 - RNA, 13 nt, Homo sapiens
ucaacuaugauau

SEQ ID NO: 1476472 - RNA, 22 nt, Homo sapiens
ucaacugaaaagacucaguguu

SEQ ID NO: 1476473 - RNA, 22 nt, Homo sapiens
ucaacugagguucuugggauac

SEQ ID NO: 1476474 - RNA, 22 nt, Homo sapiens
ucaacugcuuugaaacuugccu

SEQ ID NO: 1476475 - RNA, 15 nt, Homo sapiens
ucaacugguuguaua

SEQ ID NO: 1476476 - RNA, 19 nt, Homo sapiens
ucaacuucuggcuccucaa

SEQ ID NO: 1476477 - RNA, 22 nt, Homo sapiens
ucaacuuuagcuaguaucuuca

SEQ ID NO: 1476478 - RNA, 12 nt, Homo sapiens
ucaacuuugaca

SEQ ID NO: 1476479 - RNA, 16 nt, Homo sapiens
ucaagaaaacaacuuc

SEQ ID NO: 1476480 - RNA, 16 nt, Homo sapiens
ucaagaacucugggcu

SEQ ID NO: 1476481 - RNA, 20 nt, Homo sapiens
ucaagaccagccugggcaac

SEQ ID NO: 1476482 - RNA, 15 nt, Homo sapiens
ucaagaccauaguga

SEQ ID NO: 1476483 - RNA, 19 nt, Homo sapiens
ucaagauacugcuacugua

SEQ ID NO: 1476484 - RNA, 22 nt, Homo sapiens
uggugcucuuugcugcacuauu

SEQ ID NO: 1476485 - RNA, 13 nt, Homo sapiens
uggugcuggauau

SEQ ID NO: 1476486 - RNA, 20 nt, Homo sapiens
uggugcuguggccaggguga

SEQ ID NO: 1476487 - RNA, 15 nt, Homo sapiens
ugguggagaaccaca

SEQ ID NO: 1476488 - RNA, 15 nt, Homo sapiens
ugguggaucugucca

SEQ ID NO: 1476489 - RNA, 24 nt, Homo sapiens
ugguggcacaggaguguccucuuc

SEQ ID NO: 1476490 - RNA, 19 nt, Homo sapiens
ugguggcccacgccuguaa

SEQ ID NO: 1476491 - RNA, 19 nt, Homo sapiens
ugguggcgggcgccuguag

SEQ ID NO: 1476492 - RNA, 16 nt, Homo sapiens
uggugggcgccuguaa

SEQ ID NO: 1476493 - RNA, 17 nt, Homo sapiens
uggugggucuauguucc

SEQ ID NO: 1476494 - RNA, 13 nt, Homo sapiens
ugguguagacugu

SEQ ID NO: 1476495 - RNA, 15 nt, Homo sapiens
ugguguauguaugag

SEQ ID NO: 1476496 - RNA, 23 nt, Homo sapiens
uggugugaucucggcucacugca

SEQ ID NO: 1476497 - RNA, 19 nt, Homo sapiens
ugguuaguuaaaagcccau

SEQ ID NO: 1476498 - RNA, 14 nt, Homo sapiens
ugguucaucccuuu

SEQ ID NO: 1476499 - RNA, 17 nt, Homo sapiens
ugguucauuaauucuau

SEQ ID NO: 1476500 - RNA, 19 nt, Homo sapiens
ugguuccaugccugagggu

SEQ ID NO: 1476501 - RNA, 17 nt, Homo sapiens
ugguucuuaguucucac

SEQ ID NO: 1476502 - RNA, 21 nt, Homo sapiens
ugguuucauuucuacugugac

SEQ ID NO: 1476503 - RNA, 15 nt, Homo sapiens
ugguuuccacauuua

SEQ ID NO: 1476504 - RNA, 20 nt, Homo sapiens
ugguuuguuauaucagggaa

SEQ ID NO: 1476505 - RNA, 18 nt, Homo sapiens
uguaaaagagucaucugg

SEQ ID NO: 1476506 - RNA, 21 nt, Homo sapiens
uguaaaccuagaguuuuauca

SEQ ID NO: 1476507 - RNA, 22 nt, Homo sapiens
uguaaacgacaagaauaauuca

SEQ ID NO: 1476508 - RNA, 15 nt, Homo sapiens
uguaaagaaugucua

SEQ ID NO: 1476509 - RNA, 13 nt, Homo sapiens
uguaaagugccuu

SEQ ID NO: 1476510 - RNA, 22 nt, Homo sapiens
uguaaaguugccuuuauuugcu

SEQ ID NO: 1476511 - RNA, 17 nt, Homo sapiens
uguaaauacacauagca

SEQ ID NO: 1476512 - RNA, 19 nt, Homo sapiens
uguaaauacuguaaaugca

SEQ ID NO: 1476513 - RNA, 15 nt, Homo sapiens
uguaaaucugccaca

SEQ ID NO: 1476514 - RNA, 21 nt, Homo sapiens
uguaacaauuguguagccuuu

SEQ ID NO: 1476515 - RNA, 13 nt, Homo sapiens
uguaaccauuucu

SEQ ID NO: 1476516 - RNA, 16 nt, Homo sapiens
uguaaccugcugugau

SEQ ID NO: 1476517 - RNA, 15 nt, Homo sapiens
uguaagaagagccau

SEQ ID NO: 1476518 - RNA, 22 nt, Homo sapiens
uguaagcaggagagaaauuucu

SEQ ID NO: 1476519 - RNA, 14 nt, Homo sapiens
uguaaggugcuaca

SEQ ID NO: 1476520 - RNA, 13 nt, Homo sapiens
uguaagugcugcu

SEQ ID NO: 1476521 - RNA, 14 nt, Homo sapiens
uguaagugcugcua

SEQ ID NO: 1476522 - RNA, 18 nt, Homo sapiens
uguaauaaaaguuuacaa

SEQ ID NO: 1476523 - RNA, 15 nt, Homo sapiens
uguaauaagcaauca

SEQ ID NO: 1476524 - RNA, 11 nt, Homo sapiens
uguaauacugg

SEQ ID NO: 1476525 - RNA, 18 nt, Homo sapiens
uguaauagugaacauaug

SEQ ID NO: 1476526 - RNA, 15 nt, Homo sapiens
uguaauauuuagcug

SEQ ID NO: 1476527 - RNA, 14 nt, Homo sapiens
uguaaucauauaau

SEQ ID NO: 1476528 - RNA, 21 nt, Homo sapiens
uguaaugaaaaugaauaucua

SEQ ID NO: 1476529 - RNA, 14 nt, Homo sapiens
uguaaugcugcaca

SEQ ID NO: 1476530 - RNA, 15 nt, Homo sapiens
uguaauggaucuuaa

SEQ ID NO: 1476531 - RNA, 13 nt, Homo sapiens
uguaauuccagcu

SEQ ID NO: 1476532 - RNA, 15 nt, Homo sapiens
uguaauuuaugcaag

SEQ ID NO: 1476533 - RNA, 21 nt, Homo sapiens
uguaauuuauuaacuaaucaa

SEQ ID NO: 1476534 - RNA, 13 nt, Homo sapiens
uguacaccaaggu

SEQ ID NO: 1476535 - RNA, 19 nt, Homo sapiens
uguacaguguguaaagugu

SEQ ID NO: 1476536 - RNA, 23 nt, Homo sapiens
uguacauaccuccuugcacaaau

SEQ ID NO: 1476537 - RNA, 16 nt, Homo sapiens
uguacauaguguaaug

SEQ ID NO: 1476538 - RNA, 22 nt, Homo sapiens
uguacccuccuccccacacaga

SEQ ID NO: 1476539 - RNA, 18 nt, Homo sapiens
uguacucugaaaguuuug

SEQ ID NO: 1476540 - RNA, 19 nt, Homo sapiens
uguacucuggggugcugcc

SEQ ID NO: 1476541 - RNA, 13 nt, Homo sapiens
uguacuuguuuca

SEQ ID NO: 1476542 - RNA, 17 nt, Homo sapiens
uguagaacacuaauuca

SEQ ID NO: 1476543 - RNA, 15 nt, Homo sapiens
uguagacugugccag

SEQ ID NO: 1476544 - RNA, 12 nt, Homo sapiens
uguagacugugu

SEQ ID NO: 1476545 - RNA, 17 nt, Homo sapiens
uguagagagaacaggug

SEQ ID NO: 1476546 - RNA, 22 nt, Homo sapiens
uguagaugggggaacugugaau

SEQ ID NO: 1476547 - RNA, 16 nt, Homo sapiens
uguagcauuggaucaa

SEQ ID NO: 1476548 - RNA, 13 nt, Homo sapiens
uguaguagucuca

SEQ ID NO: 1476549 - RNA, 14 nt, Homo sapiens
uguaguagucucau

SEQ ID NO: 1476550 - RNA, 17 nt, Homo sapiens
uguagucucgaccuccc

SEQ ID NO: 1476551 - RNA, 15 nt, Homo sapiens
uguaguuaaugaugg

SEQ ID NO: 1476552 - RNA, 23 nt, Homo sapiens
uguauaaccccaccuugccaagc

SEQ ID NO: 1476553 - RNA, 19 nt, Homo sapiens
uguauacuauaguaccagu

SEQ ID NO: 1476554 - RNA, 15 nt, Homo sapiens
uguauauuuguacaa

SEQ ID NO: 1476555 - RNA, 17 nt, Homo sapiens
uguauauuuguacaaaa

SEQ ID NO: 1476556 - RNA, 19 nt, Homo sapiens
uguaucccaacuccuauaa

SEQ ID NO: 1476557 - RNA, 20 nt, Homo sapiens
uguaucuuuuauccugggag

SEQ ID NO: 1476558 - RNA, 14 nt, Homo sapiens
uguaugacuaaaga

SEQ ID NO: 1476559 - RNA, 22 nt, Homo sapiens
uguaugcaaaucaaacauauuc

SEQ ID NO: 1476560 - RNA, 20 nt, Homo sapiens
uguauggaaucccacuguau

SEQ ID NO: 1476561 - RNA, 17 nt, Homo sapiens
uguauguuccucuauga

SEQ ID NO: 1476562 - RNA, 18 nt, Homo sapiens
uguauuaaacucuucaca

SEQ ID NO: 1476563 - RNA, 18 nt, Homo sapiens
uguauuaaagacagaggc

SEQ ID NO: 1476564 - RNA, 15 nt, Homo sapiens
uguauucaccaccaa

SEQ ID NO: 1476565 - RNA, 22 nt, Homo sapiens
uguauugacuguaccacagaca

SEQ ID NO: 1476566 - RNA, 19 nt, Homo sapiens
uguauuguucccagugaca

SEQ ID NO: 1476567 - RNA, 15 nt, Homo sapiens
uguauuuaacugccu

SEQ ID NO: 1476568 - RNA, 16 nt, Homo sapiens
uguauuucaagaccuc

SEQ ID NO: 1476569 - RNA, 16 nt, Homo sapiens
uguauuuuaagugaau

SEQ ID NO: 1476570 - RNA, 19 nt, Homo sapiens
uguauuuuuuuauucgcca

SEQ ID NO: 1476571 - RNA, 15 nt, Homo sapiens
ugucaaacagugcca

SEQ ID NO: 1476572 - RNA, 13 nt, Homo sapiens
ugucaaagugaua

SEQ ID NO: 1476573 - RNA, 13 nt, Homo sapiens
ugucaacaucaaa

SEQ ID NO: 1476574 - RNA, 22 nt, Homo sapiens
ugucaagcugcucugagccaca

SEQ ID NO: 1476575 - RNA, 21 nt, Homo sapiens
ugucacaaccucucugaucuu

SEQ ID NO: 1476576 - RNA, 15 nt, Homo sapiens
ugucacacaaaaagu

SEQ ID NO: 1476577 - RNA, 15 nt, Homo sapiens
ugucacagggccaac

SEQ ID NO: 1476578 - RNA, 22 nt, Homo sapiens
ugucaccagcuaucugucaucu

SEQ ID NO: 1476579 - RNA, 22 nt, Homo sapiens
ugucagaaaccugcagggacuc

SEQ ID NO: 1476580 - RNA, 19 nt, Homo sapiens
ugucagaaacugaagcugu

SEQ ID NO: 1476581 - RNA, 13 nt, Homo sapiens
ugucaguauuuca

SEQ ID NO: 1476582 - RNA, 22 nt, Homo sapiens
ugucauaaacgauucugagcca

SEQ ID NO: 1476583 - RNA, 23 nt, Homo sapiens
ugucauaggauuaagcaguuuaa

SEQ ID NO: 1476584 - RNA, 17 nt, Homo sapiens
ugucauauaagauucau

SEQ ID NO: 1476585 - RNA, 23 nt, Homo sapiens
ugucaucccauauaacuaagaca

SEQ ID NO: 1476586 - RNA, 12 nt, Homo sapiens
ugucauuccaga

SEQ ID NO: 1476587 - RNA, 19 nt, Homo sapiens
uguuagagaauuuccuuac

SEQ ID NO: 1476588 - RNA, 15 nt, Homo sapiens
uguuagcuuccuuaa

SEQ ID NO: 1476589 - RNA, 19 nt, Homo sapiens
uguuaggaacagcaguguu

SEQ ID NO: 1476590 - RNA, 21 nt, Homo sapiens
uguuaguuauaaauagccuuc

SEQ ID NO: 1476591 - RNA, 14 nt, Homo sapiens
uguuauaucaggga

SEQ ID NO: 1476592 - RNA, 18 nt, Homo sapiens
uguuaucuaucaacuaua

SEQ ID NO: 1476593 - RNA, 15 nt, Homo sapiens
uguuaucuucacuuu

SEQ ID NO: 1476594 - RNA, 20 nt, Homo sapiens
uguuauuguugaacauacuu

SEQ ID NO: 1476595 - RNA, 19 nt, Homo sapiens
uguuauuugcacacugcac

SEQ ID NO: 1476596 - RNA, 17 nt, Homo sapiens
uguuauuuuucaaggaa

SEQ ID NO: 1476597 - RNA, 14 nt, Homo sapiens
uguucaauccagag

SEQ ID NO: 1476598 - RNA, 21 nt, Homo sapiens
uguucacgcucacccagucac

SEQ ID NO: 1476599 - RNA, 21 nt, Homo sapiens
uguucauaauaucaugugcac

SEQ ID NO: 1476600 - RNA, 18 nt, Homo sapiens
uguuccaaagccagugaa

SEQ ID NO: 1476601 - RNA, 17 nt, Homo sapiens
uguuccaauuugacaaa

SEQ ID NO: 1476602 - RNA, 22 nt, Homo sapiens
uguuccaauuugacaaaaccca

SEQ ID NO: 1476603 - RNA, 17 nt, Homo sapiens
uguuccagugucuauaa

SEQ ID NO: 1476604 - RNA, 18 nt, Homo sapiens
uguucccagguaccucau

SEQ ID NO: 1476605 - RNA, 13 nt, Homo sapiens
uguuccccagaga

SEQ ID NO: 1476606 - RNA, 22 nt, Homo sapiens
uguucuaaagguggugaggcaa

SEQ ID NO: 1476607 - RNA, 17 nt, Homo sapiens
uguucucgcaaaaacgu

SEQ ID NO: 1476608 - RNA, 16 nt, Homo sapiens
uguucuggaagccaua

SEQ ID NO: 1476609 - RNA, 15 nt, Homo sapiens
uguucugggggacag

SEQ ID NO: 1476610 - RNA, 13 nt, Homo sapiens
uguucuguucugg

SEQ ID NO: 1476611 - RNA, 20 nt, Homo sapiens
uguucuuaugcaaaauggaa

SEQ ID NO: 1476612 - RNA, 19 nt, Homo sapiens
uguucuucuucauauucua

SEQ ID NO: 1476613 - RNA, 17 nt, Homo sapiens
uguugaaucuauuucac

SEQ ID NO: 1476614 - RNA, 16 nt, Homo sapiens
uguugauaaaugacac

SEQ ID NO: 1476615 - RNA, 18 nt, Homo sapiens
uguugaugaaguauacuu

SEQ ID NO: 1476616 - RNA, 13 nt, Homo sapiens
uguugcaaacuca

SEQ ID NO: 1476617 - RNA, 17 nt, Homo sapiens
uguugcauuuccagcug

SEQ ID NO: 1476618 - RNA, 17 nt, Homo sapiens
uguugccuucaucuuca

SEQ ID NO: 1476619 - RNA, 14 nt, Homo sapiens
uguugcucagcucc

SEQ ID NO: 1476620 - RNA, 17 nt, Homo sapiens
uguuguuccguuaaccu

SEQ ID NO: 1476621 - RNA, 13 nt, Homo sapiens
uguuguugccaaa

SEQ ID NO: 1476622 - RNA, 23 nt, Homo sapiens
uguuuacauaucaccucauggcc

SEQ ID NO: 1476623 - RNA, 22 nt, Homo sapiens
uguuuauacuccaguguacaua

SEQ ID NO: 1476624 - RNA, 17 nt, Homo sapiens
uguuuauauacuggguu

SEQ ID NO: 1476625 - RNA, 19 nt, Homo sapiens
uguuuauccuuagcucaca

SEQ ID NO: 1476626 - RNA, 18 nt, Homo sapiens
uguuucaaaaaaucugac

SEQ ID NO: 1476627 - RNA, 18 nt, Homo sapiens
uguuucacaauaccucau

SEQ ID NO: 1476628 - RNA, 17 nt, Homo sapiens
uguuucaguucagauaa

SEQ ID NO: 1476629 - RNA, 19 nt, Homo sapiens
uguuucuaaaacuaugguu

SEQ ID NO: 1476630 - RNA, 23 nt, Homo sapiens
uguuucuccuuaguuggcuggaa

SEQ ID NO: 1476631 - RNA, 14 nt, Homo sapiens
uguuucuguuccaa

SEQ ID NO: 1476632 - RNA, 15 nt, Homo sapiens
uguuucuuaugccag

SEQ ID NO: 1476633 - RNA, 18 nt, Homo sapiens
uguuuggguauccugccc

SEQ ID NO: 1476634 - RNA, 23 nt, Homo sapiens
uguuugucauagggcaguuggaa

SEQ ID NO: 1476635 - RNA, 16 nt, Homo sapiens
uguuuuauauguugcu

SEQ ID NO: 1476636 - RNA, 12 nt, Homo sapiens
uguuuucugaca

SEQ ID NO: 1476637 - RNA, 20 nt, Homo sapiens
uguuuucuugccaaugaggu

SEQ ID NO: 1476638 - RNA, 16 nt, Homo sapiens
uguuuuuaaacuaaua

SEQ ID NO: 1476639 - RNA, 14 nt, Homo sapiens
uguuuuugaucaaa

SEQ ID NO: 1476640 - RNA, 22 nt, Homo sapiens
uguuuuuugccacagcuuuugc

SEQ ID NO: 1476641 - RNA, 19 nt, Homo sapiens
uguuuuuuuuuuccacuua

SEQ ID NO: 1476642 - RNA, 22 nt, Homo sapiens
uuaaaaaaaaaaagaacacagg

SEQ ID NO: 1476643 - RNA, 15 nt, Homo sapiens
uuaaaaagaaugacg

SEQ ID NO: 1476644 - RNA, 14 nt, Homo sapiens
uuaaaaaguuucac

SEQ ID NO: 1476645 - RNA, 18 nt, Homo sapiens
uuaaaacaauucugugac

SEQ ID NO: 1476646 - RNA, 19 nt, Homo sapiens
uuaaaacacagcuuuacaa

SEQ ID NO: 1476647 - RNA, 14 nt, Homo sapiens
uuaaaacacuuuca

SEQ ID NO: 1476648 - RNA, 14 nt, Homo sapiens
uuaaaaccaaagag

SEQ ID NO: 1476649 - RNA, 19 nt, Homo sapiens
uuaaaaccauaucagagau

SEQ ID NO: 1476650 - RNA, 17 nt, Homo sapiens
uuaaaacuugaaguagg

SEQ ID NO: 1476651 - RNA, 17 nt, Homo sapiens
uuaaaagaauguaaaau

SEQ ID NO: 1476652 - RNA, 19 nt, Homo sapiens
uuaaaaggaaagucaagaa

SEQ ID NO: 1476653 - RNA, 16 nt, Homo sapiens
uuaaaauaaugaacac

SEQ ID NO: 1476654 - RNA, 22 nt, Homo sapiens
uuaaaauaaugaacacuacaga

SEQ ID NO: 1476655 - RNA, 18 nt, Homo sapiens
uuaaaauauuugaaugaa

SEQ ID NO: 1476656 - RNA, 19 nt, Homo sapiens
uuaaaauuaucaauaucua

SEQ ID NO: 1476657 - RNA, 13 nt, Homo sapiens
uuaaaauucaauu

SEQ ID NO: 1476658 - RNA, 15 nt, Homo sapiens
uuaaaauucaauuag

SEQ ID NO: 1476659 - RNA, 15 nt, Homo sapiens
uuaaacaaaaacuag

SEQ ID NO: 1476660 - RNA, 14 nt, Homo sapiens
uuaaacacaaagug

SEQ ID NO: 1476661 - RNA, 14 nt, Homo sapiens
uuaaacaccuccuc

SEQ ID NO: 1476662 - RNA, 21 nt, Homo sapiens
uuaaacagaugaugagaauuu

SEQ ID NO: 1476663 - RNA, 14 nt, Homo sapiens
uuaaacccacagcc

SEQ ID NO: 1476664 - RNA, 13 nt, Homo sapiens
uuaaacucaggga

SEQ ID NO: 1476665 - RNA, 21 nt, Homo sapiens
uuaaacucagggacagagcca

SEQ ID NO: 1476666 - RNA, 20 nt, Homo sapiens
uuaaacuguguggacuguga

SEQ ID NO: 1476667 - RNA, 23 nt, Homo sapiens
uuaaacuuucaauugucacuuuu

SEQ ID NO: 1476668 - RNA, 15 nt, Homo sapiens
uuaaagcagacaguc

SEQ ID NO: 1476669 - RNA, 13 nt, Homo sapiens
uuaaagccuccuc

SEQ ID NO: 1476670 - RNA, 17 nt, Homo sapiens
uuaaagccuuuaguauc

SEQ ID NO: 1476671 - RNA, 15 nt, Homo sapiens
uuaaagguucacagg

SEQ ID NO: 1476672 - RNA, 17 nt, Homo sapiens
uuaaaguggcaaucuca

SEQ ID NO: 1476673 - RNA, 15 nt, Homo sapiens
uuaaauaaaccucaa

SEQ ID NO: 1476674 - RNA, 23 nt, Homo sapiens
uuaaauaaaucauaaaacuugau

SEQ ID NO: 1476675 - RNA, 13 nt, Homo sapiens
uuaaauaaucucu

SEQ ID NO: 1476676 - RNA, 17 nt, Homo sapiens
uuaaauaauuucuacuc

SEQ ID NO: 1476677 - RNA, 17 nt, Homo sapiens
uuaaauauauaauguug

SEQ ID NO: 1476678 - RNA, 19 nt, Homo sapiens
uuaaaucuuuggauuugau

SEQ ID NO: 1476679 - RNA, 22 nt, Homo sapiens
uuaaauguagcaauggcacugu

SEQ ID NO: 1476680 - RNA, 15 nt, Homo sapiens
uuaaauucaaguuua

SEQ ID NO: 1476681 - RNA, 21 nt, Homo sapiens
uuaacagauggaaaaacugag

SEQ ID NO: 1476682 - RNA, 18 nt, Homo sapiens
uuaacauggacaugaucu

SEQ ID NO: 1476683 - RNA, 18 nt, Homo sapiens
uuaaccccauguccucag

SEQ ID NO: 1476684 - RNA, 18 nt, Homo sapiens
uuaaccgcacaugcacac

SEQ ID NO: 1476685 - RNA, 13 nt, Homo sapiens
uuaaccuuaucag

SEQ ID NO: 1476686 - RNA, 15 nt, Homo sapiens
uuaacuaugacagau

SEQ ID NO: 1476687 - RNA, 19 nt, Homo sapiens
uuaacucaccucucaaggu

SEQ ID NO: 1476688 - RNA, 15 nt, Homo sapiens
uuaacugccaagaaa

SEQ ID NO: 1476689 - RNA, 21 nt, Homo sapiens
uuaacuuccaauuuacauacu

SEQ ID NO: 1476690 - RNA, 13 nt, Homo sapiens
uuaguccaaauaa

SEQ ID NO: 1476691 - RNA, 11 nt, Homo sapiens
uuagugcuugu

SEQ ID NO: 1476692 - RNA, 16 nt, Homo sapiens
uuaguguuuugccuca

SEQ ID NO: 1476693 - RNA, 15 nt, Homo sapiens
uuaguuuuucugucc

SEQ ID NO: 1476694 - RNA, 16 nt, Homo sapiens
uuauaaaccaaucuua

SEQ ID NO: 1476695 - RNA, 15 nt, Homo sapiens
uuauaaauagccuuc

SEQ ID NO: 1476696 - RNA, 16 nt, Homo sapiens
uuauaaauagccuuca

SEQ ID NO: 1476697 - RNA, 15 nt, Homo sapiens
uuauaaaugcuauuu

SEQ ID NO: 1476698 - RNA, 20 nt, Homo sapiens
uuauaagaaagaucaaagac

SEQ ID NO: 1476699 - RNA, 16 nt, Homo sapiens
uuauaagguaguacug

SEQ ID NO: 1476700 - RNA, 13 nt, Homo sapiens
uuauaaucaauga

SEQ ID NO: 1476701 - RNA, 18 nt, Homo sapiens
uuauaauuccuauauccu

SEQ ID NO: 1476702 - RNA, 18 nt, Homo sapiens
uuauaauuggugcauagc

SEQ ID NO: 1476703 - RNA, 20 nt, Homo sapiens
uuauacagauagaguuccau

SEQ ID NO: 1476704 - RNA, 23 nt, Homo sapiens
uuauacagauagaguuccauaua

SEQ ID NO: 1476705 - RNA, 23 nt, Homo sapiens
uuauacccccaggaaacuagcuu

SEQ ID NO: 1476706 - RNA, 21 nt, Homo sapiens
uuauacugauuaugucuuuua

SEQ ID NO: 1476707 - RNA, 22 nt, Homo sapiens
uuauagaauaaaagcuguggaa

SEQ ID NO: 1476708 - RNA, 18 nt, Homo sapiens
uuauaggacgaaugccaa

SEQ ID NO: 1476709 - RNA, 13 nt, Homo sapiens
uuauauaaucaau

SEQ ID NO: 1476710 - RNA, 12 nt, Homo sapiens
uuauauaauuca

SEQ ID NO: 1476711 - RNA, 18 nt, Homo sapiens
uuauaucuguggucuuca

SEQ ID NO: 1476712 - RNA, 17 nt, Homo sapiens
uuaucacuucauucaca

SEQ ID NO: 1476713 - RNA, 18 nt, Homo sapiens
uuaucacuucauucacau

SEQ ID NO: 1476714 - RNA, 12 nt, Homo sapiens
uuaucagcuuuc

SEQ ID NO: 1476715 - RNA, 14 nt, Homo sapiens
uuaucagcuuucag

SEQ ID NO: 1476716 - RNA, 14 nt, Homo sapiens
uuauccaagaccug

SEQ ID NO: 1476717 - RNA, 18 nt, Homo sapiens
uuauccuagucauucuuc

SEQ ID NO: 1476718 - RNA, 18 nt, Homo sapiens
uuaucgggagcagugucu

SEQ ID NO: 1476719 - RNA, 20 nt, Homo sapiens
uuaucugcuaugcuauugaa

SEQ ID NO: 1476720 - RNA, 23 nt, Homo sapiens
uuaucugugcgugaaacacacca

SEQ ID NO: 1476721 - RNA, 14 nt, Homo sapiens
uuaugacuugcuac

SEQ ID NO: 1476722 - RNA, 11 nt, Homo sapiens
uuaugagacag

SEQ ID NO: 1476723 - RNA, 13 nt, Homo sapiens
uuaugauguaauc

SEQ ID NO: 1476724 - RNA, 21 nt, Homo sapiens
uuaugcagaauccaaaguaaa

SEQ ID NO: 1476725 - RNA, 23 nt, Homo sapiens
uuauggcagaagggaauugcuca

SEQ ID NO: 1476726 - RNA, 19 nt, Homo sapiens
uuaugggaagacaaaacaa

SEQ ID NO: 1476727 - RNA, 16 nt, Homo sapiens
uuauguauaaacauaa

SEQ ID NO: 1476728 - RNA, 17 nt, Homo sapiens
uuaugucaccagaauau

SEQ ID NO: 1476729 - RNA, 21 nt, Homo sapiens
uuaugucuauuuaagccucau

SEQ ID NO: 1476730 - RNA, 19 nt, Homo sapiens
uuaugugugaggagcugcu

SEQ ID NO: 1476731 - RNA, 13 nt, Homo sapiens
uuauuaauuugaa

SEQ ID NO: 1476732 - RNA, 18 nt, Homo sapiens
uuauuaccccacacaucc

SEQ ID NO: 1476733 - RNA, 12 nt, Homo sapiens
uuauuaccucug

SEQ ID NO: 1476734 - RNA, 21 nt, Homo sapiens
uuauuaccucugauaccucaa

SEQ ID NO: 1476735 - RNA, 21 nt, Homo sapiens
uuauucuguuuugcacaguua

SEQ ID NO: 1476736 - RNA, 21 nt, Homo sapiens
uuauugaguucgaggacuaca

SEQ ID NO: 1476737 - RNA, 21 nt, Homo sapiens
uuauuuccccaggugugugcu

SEQ ID NO: 1476738 - RNA, 20 nt, Homo sapiens
uuauuucugaucuauacaaa

SEQ ID NO: 1476739 - RNA, 13 nt, Homo sapiens
uuauuucugcucu

SEQ ID NO: 1476740 - RNA, 17 nt, Homo sapiens
uuauuugcacacugcac

SEQ ID NO: 1476741 - RNA, 21 nt, Homo sapiens
uuauuugcuaaucaaagccag

SEQ ID NO: 1476742 - RNA, 13 nt, Homo sapiens
uuauuuuaauaca

SEQ ID NO: 1476743 - RNA, 14 nt, Homo sapiens
uuauuuuucuuguc

SEQ ID NO: 1476744 - RNA, 14 nt, Homo sapiens
uuauuuuugucaaa

SEQ ID NO: 1476745 - RNA, 21 nt, Homo sapiens
uuauuuuuucgugcacucugc

SEQ ID NO: 1476746 - RNA, 16 nt, Homo sapiens
uucaaacaauaucaua

SEQ ID NO: 1476747 - RNA, 24 nt, Homo sapiens
uucaaacagaacugcagucagcau

SEQ ID NO: 1476748 - RNA, 22 nt, Homo sapiens
uucaaagagucauauugcccag

SEQ ID NO: 1476749 - RNA, 18 nt, Homo sapiens
uucaaaguuaaaagcaaa

SEQ ID NO: 1476750 - RNA, 12 nt, Homo sapiens
uucaaaugaauu

SEQ ID NO: 1476751 - RNA, 15 nt, Homo sapiens
uucaaccacuguaaa

SEQ ID NO: 1476752 - RNA, 23 nt, Homo sapiens
uucaaggcauuucuaucacauau

SEQ ID NO: 1476753 - RNA, 20 nt, Homo sapiens
uucaauaaagcacugagcaa

SEQ ID NO: 1476754 - RNA, 15 nt, Homo sapiens
uucaauaaagcauuu

SEQ ID NO: 1476755 - RNA, 18 nt, Homo sapiens
uucaauagcuaagcaucu

SEQ ID NO: 1476756 - RNA, 19 nt, Homo sapiens
uucaauccagagagcuuaa

SEQ ID NO: 1476757 - RNA, 17 nt, Homo sapiens
uucaaugaaccacaaaa

SEQ ID NO: 1476758 - RNA, 18 nt, Homo sapiens
uucaaugggcucuuccaa

SEQ ID NO: 1476759 - RNA, 22 nt, Homo sapiens
uucaauguccuaaaaagacacg

SEQ ID NO: 1476760 - RNA, 21 nt, Homo sapiens
uucaaugugcauaaugauaaa

SEQ ID NO: 1476761 - RNA, 18 nt, Homo sapiens
uucaauuguaaauugaau

SEQ ID NO: 1476762 - RNA, 10 nt, Homo sapiens
uucacaagcu

SEQ ID NO: 1476763 - RNA, 18 nt, Homo sapiens
uucacacaguaaagcagg

SEQ ID NO: 1476764 - RNA, 18 nt, Homo sapiens
uucacaggaggccagugg

SEQ ID NO: 1476765 - RNA, 19 nt, Homo sapiens
uucacauauaucaaaguga

SEQ ID NO: 1476766 - RNA, 19 nt, Homo sapiens
uucacaugagcuauuucca

SEQ ID NO: 1476767 - RNA, 16 nt, Homo sapiens
uucacauugaaaccca

SEQ ID NO: 1476768 - RNA, 16 nt, Homo sapiens
uucacauuuguauuaa

SEQ ID NO: 1476769 - RNA, 11 nt, Homo sapiens
uucaccaaaau

SEQ ID NO: 1476770 - RNA, 17 nt, Homo sapiens
uucaccagagcauuucc

SEQ ID NO: 1476771 - RNA, 17 nt, Homo sapiens
uucacccaucuuaucaa

SEQ ID NO: 1476772 - RNA, 19 nt, Homo sapiens
uucacgcuguuuguuucau

SEQ ID NO: 1476773 - RNA, 16 nt, Homo sapiens
uucacguguaccugug

SEQ ID NO: 1476774 - RNA, 17 nt, Homo sapiens
uucacucaagcacugau

SEQ ID NO: 1476775 - RNA, 15 nt, Homo sapiens
uucacugaaggugau

SEQ ID NO: 1476776 - RNA, 10 nt, Homo sapiens
uucacugagc

SEQ ID NO: 1476777 - RNA, 16 nt, Homo sapiens
uucacuggacacuuca

SEQ ID NO: 1476778 - RNA, 17 nt, Homo sapiens
uucacugugagugaaaa

SEQ ID NO: 1476779 - RNA, 13 nt, Homo sapiens
uucacuuuacaaa

SEQ ID NO: 1476780 - RNA, 16 nt, Homo sapiens
uucagaaauauaugca

SEQ ID NO: 1476781 - RNA, 14 nt, Homo sapiens
uucagaagacacug

SEQ ID NO: 1476782 - RNA, 17 nt, Homo sapiens
uucagaagagaugggcu

SEQ ID NO: 1476783 - RNA, 18 nt, Homo sapiens
uucagaagccuaauucca

SEQ ID NO: 1476784 - RNA, 19 nt, Homo sapiens
uucagaagccuaauuccag

SEQ ID NO: 1476785 - RNA, 24 nt, Homo sapiens
uucagaaguaauuugaauagccug

SEQ ID NO: 1476786 - RNA, 15 nt, Homo sapiens
uucagacaagcugca

SEQ ID NO: 1476787 - RNA, 14 nt, Homo sapiens
uucagacaccuguu

SEQ ID NO: 1476788 - RNA, 22 nt, Homo sapiens
uucagagacagcugauacuuca

SEQ ID NO: 1476789 - RNA, 15 nt, Homo sapiens
uucagagagcuggua

SEQ ID NO: 1476790 - RNA, 19 nt, Homo sapiens
uucagaggagcaacccuau

SEQ ID NO: 1476791 - RNA, 17 nt, Homo sapiens
uucagauacaaacugca

SEQ ID NO: 1476792 - RNA, 17 nt, Homo sapiens
uucagaucauauuucac

SEQ ID NO: 1476793 - RNA, 18 nt, Homo sapiens
uuccuuuguguguacuca

SEQ ID NO: 1476794 - RNA, 15 nt, Homo sapiens
uuccuuuucauuuaa

SEQ ID NO: 1476795 - RNA, 21 nt, Homo sapiens
uucgcaccuaccaucagggac

SEQ ID NO: 1476796 - RNA, 15 nt, Homo sapiens
uucgcccaccucagc

SEQ ID NO: 1476797 - RNA, 19 nt, Homo sapiens
uucggaagggguuccucaa

SEQ ID NO: 1476798 - RNA, 22 nt, Homo sapiens
uucggauguaugaucucucuag

SEQ ID NO: 1476799 - RNA, 17 nt, Homo sapiens
uucgucuguugugcgaa

SEQ ID NO: 1476800 - RNA, 17 nt, Homo sapiens
uucuaaaaacacacaca

SEQ ID NO: 1476801 - RNA, 15 nt, Homo sapiens
uucuaaagagcacuu

SEQ ID NO: 1476802 - RNA, 14 nt, Homo sapiens
uucuaaaugcauau

SEQ ID NO: 1476803 - RNA, 19 nt, Homo sapiens
uucuaauccuuuuccuuau

SEQ ID NO: 1476804 - RNA, 17 nt, Homo sapiens
uucuaauuuuuaagcaa

SEQ ID NO: 1476805 - RNA, 20 nt, Homo sapiens
uucuacaacugauugcaaca

SEQ ID NO: 1476806 - RNA, 22 nt, Homo sapiens
uucuacaauuucaauuucuccc

SEQ ID NO: 1476807 - RNA, 13 nt, Homo sapiens
uucuaccagcuca

SEQ ID NO: 1476808 - RNA, 13 nt, Homo sapiens
uucuaccugcccu

SEQ ID NO: 1476809 - RNA, 15 nt, Homo sapiens
uucuacucugucuua

SEQ ID NO: 1476810 - RNA, 15 nt, Homo sapiens
uucuacugugacuga

SEQ ID NO: 1476811 - RNA, 21 nt, Homo sapiens
uucuagccuauuuaccugcag

SEQ ID NO: 1476812 - RNA, 17 nt, Homo sapiens
uucuaggccaagcauuu

SEQ ID NO: 1476813 - RNA, 15 nt, Homo sapiens
uucuauaaggccaua

SEQ ID NO: 1476814 - RNA, 22 nt, Homo sapiens
uucuaugguuaugaaagaauau

SEQ ID NO: 1476815 - RNA, 16 nt, Homo sapiens
uucuauguccauucuc

SEQ ID NO: 1476816 - RNA, 15 nt, Homo sapiens
uucuauuauggaaaa

SEQ ID NO: 1476817 - RNA, 14 nt, Homo sapiens
uucuauugccuucu

SEQ ID NO: 1476818 - RNA, 21 nt, Homo sapiens
uucuauuuauauguacaugag

SEQ ID NO: 1476819 - RNA, 19 nt, Homo sapiens
uucucacaaugucccuuca

SEQ ID NO: 1476820 - RNA, 22 nt, Homo sapiens
uucucacacacaacuguccaua

SEQ ID NO: 1476821 - RNA, 13 nt, Homo sapiens
uucucacagugug

SEQ ID NO: 1476822 - RNA, 15 nt, Homo sapiens
uucucaccacagagc

SEQ ID NO: 1476823 - RNA, 20 nt, Homo sapiens
uucucacuccuaccugguaa

SEQ ID NO: 1476824 - RNA, 17 nt, Homo sapiens
uucucagguguugccaa

SEQ ID NO: 1476825 - RNA, 18 nt, Homo sapiens
uucucauaccuuccccac

SEQ ID NO: 1476826 - RNA, 16 nt, Homo sapiens
uucucaucccaaccuc

SEQ ID NO: 1476827 - RNA, 21 nt, Homo sapiens
uucucaucccccagccacagu

SEQ ID NO: 1476828 - RNA, 19 nt, Homo sapiens
uucucaucuuuuuacuaaa

SEQ ID NO: 1476829 - RNA, 14 nt, Homo sapiens
uucuccaaaugaga

SEQ ID NO: 1476830 - RNA, 21 nt, Homo sapiens
uucuccaccuagacuguaaac

SEQ ID NO: 1476831 - RNA, 22 nt, Homo sapiens
uucuccaggcuucacagucugg

SEQ ID NO: 1476832 - RNA, 23 nt, Homo sapiens
uucucccuguacaguguuaccau

SEQ ID NO: 1476833 - RNA, 23 nt, Homo sapiens
uucucucugugguggagaaccac

SEQ ID NO: 1476834 - RNA, 19 nt, Homo sapiens
uucucugccuuugacauuu

SEQ ID NO: 1476835 - RNA, 14 nt, Homo sapiens
uucucugguaauau

SEQ ID NO: 1476836 - RNA, 21 nt, Homo sapiens
uucucuguauuccgauacaaa

SEQ ID NO: 1476837 - RNA, 20 nt, Homo sapiens
uucucuuaguuauugcugaa

SEQ ID NO: 1476838 - RNA, 15 nt, Homo sapiens
uucugaaacugcaua

SEQ ID NO: 1476839 - RNA, 15 nt, Homo sapiens
uucugagaaggugag

SEQ ID NO: 1476840 - RNA, 17 nt, Homo sapiens
uucugagacauguguca

SEQ ID NO: 1476841 - RNA, 18 nt, Homo sapiens
uucugagcagugccucuu

SEQ ID NO: 1476842 - RNA, 21 nt, Homo sapiens
uucugagcaucugcaguacag

SEQ ID NO: 1476843 - RNA, 17 nt, Homo sapiens
uucugauuggugauuca

SEQ ID NO: 1476844 - RNA, 22 nt, Homo sapiens
uucugauuugucccuaugcaua

SEQ ID NO: 1476845 - RNA, 19 nt, Homo sapiens
uucugccaaugaccaaaca

SEQ ID NO: 1476846 - RNA, 23 nt, Homo sapiens
uucugcccgggaaggucaccagc

SEQ ID NO: 1476847 - RNA, 15 nt, Homo sapiens
uucugcuaaagaaga

SEQ ID NO: 1476848 - RNA, 10 nt, Homo sapiens
uucugcugag

SEQ ID NO: 1476849 - RNA, 18 nt, Homo sapiens
uucuggaaacuaccaggu

SEQ ID NO: 1476850 - RNA, 16 nt, Homo sapiens
uucuggauaucucagg

SEQ ID NO: 1476851 - RNA, 21 nt, Homo sapiens
uucuggcccagggaauccagc

SEQ ID NO: 1476852 - RNA, 19 nt, Homo sapiens
uucugggguugcuccgggg

SEQ ID NO: 1476853 - RNA, 15 nt, Homo sapiens
uucugguucuacuuu

SEQ ID NO: 1476854 - RNA, 14 nt, Homo sapiens
uucuguaguacucc

SEQ ID NO: 1476855 - RNA, 20 nt, Homo sapiens
uucugucccacuacaucugg

SEQ ID NO: 1476856 - RNA, 16 nt, Homo sapiens
uucuguugaaguuuac

SEQ ID NO: 1476857 - RNA, 19 nt, Homo sapiens
uucuuacccuguacauaug

SEQ ID NO: 1476858 - RNA, 14 nt, Homo sapiens
uucuuagugucacu

SEQ ID NO: 1476859 - RNA, 14 nt, Homo sapiens
uucuuauaauauua

SEQ ID NO: 1476860 - RNA, 22 nt, Homo sapiens
uucuuauaccacguuccacgga

SEQ ID NO: 1476861 - RNA, 15 nt, Homo sapiens
uucuuauuaauuuca

SEQ ID NO: 1476862 - RNA, 17 nt, Homo sapiens
uucuuauuuugcauucc

SEQ ID NO: 1476863 - RNA, 18 nt, Homo sapiens
uucuucaacaugcuccaa

SEQ ID NO: 1476864 - RNA, 19 nt, Homo sapiens
uucuucacauguuuaacuu

SEQ ID NO: 1476865 - RNA, 14 nt, Homo sapiens
uucuucagagugaa

SEQ ID NO: 1476866 - RNA, 21 nt, Homo sapiens
uucuucagauacaaacugcag

SEQ ID NO: 1476867 - RNA, 16 nt, Homo sapiens
uucuucagggccaguc

SEQ ID NO: 1476868 - RNA, 17 nt, Homo sapiens
uucuucagggccagucc

SEQ ID NO: 1476869 - RNA, 21 nt, Homo sapiens
uucuuccuaaugucagaacag

SEQ ID NO: 1476870 - RNA, 15 nt, Homo sapiens
uucuucuacugcuau

SEQ ID NO: 1476871 - RNA, 16 nt, Homo sapiens
uucuucuuuuacuuga

SEQ ID NO: 1476872 - RNA, 20 nt, Homo sapiens
uucuuguauauuauggaaga

SEQ ID NO: 1476873 - RNA, 23 nt, Homo sapiens
uucuuuaagcagcgccagugaca

SEQ ID NO: 1476874 - RNA, 13 nt, Homo sapiens
uucuuugaaguuu

SEQ ID NO: 1476875 - RNA, 14 nt, Homo sapiens
uucuuugcauucca

SEQ ID NO: 1476876 - RNA, 12 nt, Homo sapiens
uucuuugccucu

SEQ ID NO: 1476877 - RNA, 18 nt, Homo sapiens
uucuuuuucguuggugua

SEQ ID NO: 1476878 - RNA, 15 nt, Homo sapiens
uucuuuuugcucuaa

SEQ ID NO: 1476879 - RNA, 19 nt, Homo sapiens
uugaaaauauuuuguugcc

SEQ ID NO: 1476880 - RNA, 16 nt, Homo sapiens
uugaaagaaccagaga

SEQ ID NO: 1476881 - RNA, 11 nt, Homo sapiens
uugaaagaaga

SEQ ID NO: 1476882 - RNA, 14 nt, Homo sapiens
uugaaauaguugau

SEQ ID NO: 1476883 - RNA, 22 nt, Homo sapiens
uugaaaucaaugcaagagugau

SEQ ID NO: 1476884 - RNA, 20 nt, Homo sapiens
uugaaauuaagaaggcaaaa

SEQ ID NO: 1476885 - RNA, 15 nt, Homo sapiens
uugaacauacuucaa

SEQ ID NO: 1476886 - RNA, 21 nt, Homo sapiens
uugaagaaaaagacacagaca

SEQ ID NO: 1476887 - RNA, 22 nt, Homo sapiens
uugaagacaauuugauacauaa

SEQ ID NO: 1476888 - RNA, 22 nt, Homo sapiens
uugaagauuuaugaugcacuua

SEQ ID NO: 1476889 - RNA, 13 nt, Homo sapiens
uugaagccaaaga

SEQ ID NO: 1476890 - RNA, 14 nt, Homo sapiens
uugaagccaaagaa

SEQ ID NO: 1476891 - RNA, 19 nt, Homo sapiens
uugaaggcccugcugaguc

SEQ ID NO: 1476892 - RNA, 13 nt, Homo sapiens
uugaagggccaga

SEQ ID NO: 1476893 - RNA, 13 nt, Homo sapiens
uugaagggcuuua

SEQ ID NO: 1476894 - RNA, 16 nt, Homo sapiens
uugaaguacuuaacau

SEQ ID NO: 1476895 - RNA, 22 nt, Homo sapiens
agccagugccauuccacuccac

SEQ ID NO: 1476896 - RNA, 13 nt, Homo sapiens
agccaguggugcu

SEQ ID NO: 1476897 - RNA, 14 nt, Homo sapiens
agccaguggugcua

SEQ ID NO: 1476898 - RNA, 10 nt, Homo sapiens
agccauaaau

SEQ ID NO: 1476899 - RNA, 18 nt, Homo sapiens
agccauaggcccaggaua

SEQ ID NO: 1476900 - RNA, 18 nt, Homo sapiens
agccaucugcacacaccu

SEQ ID NO: 1476901 - RNA, 11 nt, Homo sapiens
agccaugccug

SEQ ID NO: 1476902 - RNA, 17 nt, Homo sapiens
agccauggaacccugcc

SEQ ID NO: 1476903 - RNA, 21 nt, Homo sapiens
agccauugcggccccaggagg

SEQ ID NO: 1476904 - RNA, 15 nt, Homo sapiens
agccauuggcacugu

SEQ ID NO: 1476905 - RNA, 17 nt, Homo sapiens
ccguguccagcacagaa

SEQ ID NO: 1476906 - RNA, 15 nt, Homo sapiens
ccguguugcaugaag

SEQ ID NO: 1476907 - RNA, 23 nt, Homo sapiens
ccguguugcaugaaggagcagca

SEQ ID NO: 1476908 - RNA, 13 nt, Homo sapiens
ccguugaccagau

SEQ ID NO: 1476909 - RNA, 23 nt, Homo sapiens
ccguuucauuuagucaugugacc

SEQ ID NO: 1476910 - RNA, 18 nt, Homo sapiens
ccuaaaaggaaaucucac

SEQ ID NO: 1476911 - RNA, 14 nt, Homo sapiens
ccuaaauauaauua

SEQ ID NO: 1476912 - RNA, 20 nt, Homo sapiens
ccuaaauauaauuauccaaa

SEQ ID NO: 1476913 - RNA, 20 nt, Homo sapiens
ccuaacuuuucuacguauaa

SEQ ID NO: 1476914 - RNA, 14 nt, Homo sapiens
ccuaagcacuuuau

SEQ ID NO: 1476915 - RNA, 22 nt, Homo sapiens
ccuaagcacuuuauaaauauca

SEQ ID NO: 1476916 - RNA, 17 nt, Homo sapiens
ccuaagcauguguccca

SEQ ID NO: 1476917 - RNA, 20 nt, Homo sapiens
ccuaaguauaaaugguuguc

SEQ ID NO: 1476918 - RNA, 22 nt, Homo sapiens
ccuaauaaacauccuucaagaa

SEQ ID NO: 1476919 - RNA, 19 nt, Homo sapiens
ccuaauagucauacuagua

SEQ ID NO: 1476920 - RNA, 16 nt, Homo sapiens
ccuaauaugcuuuaca

SEQ ID NO: 1476921 - RNA, 19 nt, Homo sapiens
ccuaauccaggcagaucca

SEQ ID NO: 1476922 - RNA, 20 nt, Homo sapiens
ccuaauccaggcagauccag

SEQ ID NO: 1476923 - RNA, 18 nt, Homo sapiens
ccuaaucuuccacuugag

SEQ ID NO: 1476924 - RNA, 11 nt, Homo sapiens
ccuacaacuua

SEQ ID NO: 1476925 - RNA, 17 nt, Homo sapiens
ccuacacacacacuccc

SEQ ID NO: 1476926 - RNA, 18 nt, Homo sapiens
ccuacagcacuacugggu

SEQ ID NO: 1476927 - RNA, 12 nt, Homo sapiens
ccuacauguauu

SEQ ID NO: 1476928 - RNA, 15 nt, Homo sapiens
ccuacauuaucucac

SEQ ID NO: 1476929 - RNA, 15 nt, Homo sapiens
ccuaccaucagggac

SEQ ID NO: 1476930 - RNA, 19 nt, Homo sapiens
ccuacccaccgauggagcc

SEQ ID NO: 1476931 - RNA, 15 nt, Homo sapiens
ccuacccuucccgcc

SEQ ID NO: 1476932 - RNA, 15 nt, Homo sapiens
ccuaccuucauuuca

SEQ ID NO: 1476933 - RNA, 14 nt, Homo sapiens
ccuacggagucagc

SEQ ID NO: 1476934 - RNA, 15 nt, Homo sapiens
ccuacucacacuuca

SEQ ID NO: 1476935 - RNA, 13 nt, Homo sapiens
ccuacuccugacu

SEQ ID NO: 1476936 - RNA, 16 nt, Homo sapiens
ccuacucuucaggguc

SEQ ID NO: 1476937 - RNA, 12 nt, Homo sapiens
ccuagaacuucc

SEQ ID NO: 1476938 - RNA, 16 nt, Homo sapiens
ccuagacauggacgca

SEQ ID NO: 1476939 - RNA, 17 nt, Homo sapiens
ccuagaccuggugcuga

SEQ ID NO: 1476940 - RNA, 15 nt, Homo sapiens
ccuaggcuaccucaa

SEQ ID NO: 1476941 - RNA, 18 nt, Homo sapiens
ccuaguucccucugcuca

SEQ ID NO: 1476942 - RNA, 18 nt, Homo sapiens
ccuauagcacugagcuca

SEQ ID NO: 1476943 - RNA, 19 nt, Homo sapiens
ccuauagcacugagcucac

SEQ ID NO: 1476944 - RNA, 18 nt, Homo sapiens
ccuauauugcauuaauuu

SEQ ID NO: 1476945 - RNA, 19 nt, Homo sapiens
ccuauauuguuuucagugu

SEQ ID NO: 1476946 - RNA, 22 nt, Homo sapiens
ccuaugcaccagguauuuaaca

SEQ ID NO: 1476947 - RNA, 17 nt, Homo sapiens
ccuauguugugguccau

SEQ ID NO: 1476948 - RNA, 16 nt, Homo sapiens
ccuauuaaaacacagc

SEQ ID NO: 1476949 - RNA, 18 nt, Homo sapiens
ccuauuccaggaauuccu

SEQ ID NO: 1476950 - RNA, 20 nt, Homo sapiens
ccuauuuggggcuugcaugc

SEQ ID NO: 1476951 - RNA, 13 nt, Homo sapiens
ccucaaacaacac

SEQ ID NO: 1476952 - RNA, 21 nt, Homo sapiens
ccucaaacuuccagucaggua

SEQ ID NO: 1476953 - RNA, 17 nt, Homo sapiens
ccucaagccccauuucc

SEQ ID NO: 1476954 - RNA, 20 nt, Homo sapiens
ccucaagccccauuuccuca

SEQ ID NO: 1476955 - RNA, 21 nt, Homo sapiens
ccucaagccccauuuccucac

SEQ ID NO: 1476956 - RNA, 17 nt, Homo sapiens
ccucacauucucuaugu

SEQ ID NO: 1476957 - RNA, 22 nt, Homo sapiens
ccucacuccuguuacuuaccua

SEQ ID NO: 1476958 - RNA, 15 nt, Homo sapiens
ccucacugauauauu

SEQ ID NO: 1476959 - RNA, 12 nt, Homo sapiens
ccucacugggug

SEQ ID NO: 1476960 - RNA, 12 nt, Homo sapiens
ccucagacaucc

SEQ ID NO: 1476961 - RNA, 13 nt, Homo sapiens
ccucagacauccc

SEQ ID NO: 1476962 - RNA, 17 nt, Homo sapiens
ccucagacguugccuga

SEQ ID NO: 1476963 - RNA, 20 nt, Homo sapiens
ccucagacuucaagaccauc

SEQ ID NO: 1476964 - RNA, 16 nt, Homo sapiens
ccucagaggacaguuu

SEQ ID NO: 1476965 - RNA, 11 nt, Homo sapiens
ccucagaugau

SEQ ID NO: 1476966 - RNA, 14 nt, Homo sapiens
ccucagaugaucuc

SEQ ID NO: 1476967 - RNA, 19 nt, Homo sapiens
ccucagccuggccagacac

SEQ ID NO: 1476968 - RNA, 18 nt, Homo sapiens
ccucagcucucugggacc

SEQ ID NO: 1476969 - RNA, 15 nt, Homo sapiens
ccucagcuucucaaa

SEQ ID NO: 1476970 - RNA, 14 nt, Homo sapiens
ccucaggcagcuca

SEQ ID NO: 1476971 - RNA, 22 nt, Homo sapiens
ccucagggaucuugcauuccca

SEQ ID NO: 1476972 - RNA, 21 nt, Homo sapiens
ccucagggcuggcagaugcag

SEQ ID NO: 1476973 - RNA, 21 nt, Homo sapiens
ccucaggguggggggugacag

SEQ ID NO: 1476974 - RNA, 17 nt, Homo sapiens
ccucaggguucccuuga

SEQ ID NO: 1476975 - RNA, 20 nt, Homo sapiens
ccucauugcagcuagaggca

SEQ ID NO: 1476976 - RNA, 18 nt, Homo sapiens
ccuccaccacaucugcca

SEQ ID NO: 1476977 - RNA, 12 nt, Homo sapiens
ccuccacccucc

SEQ ID NO: 1476978 - RNA, 13 nt, Homo sapiens
ccuccagaacuca

SEQ ID NO: 1476979 - RNA, 22 nt, Homo sapiens
ccuccagcuucaggcaggccaa

SEQ ID NO: 1476980 - RNA, 18 nt, Homo sapiens
ccuccagggugauuuuau

SEQ ID NO: 1476981 - RNA, 16 nt, Homo sapiens
ccuccauacucaggac

SEQ ID NO: 1476982 - RNA, 22 nt, Homo sapiens
ccucccaggcucaagcuguccu

SEQ ID NO: 1476983 - RNA, 16 nt, Homo sapiens
ccucccccccaugcac

SEQ ID NO: 1476984 - RNA, 14 nt, Homo sapiens
ccucccgggcucaa

SEQ ID NO: 1476985 - RNA, 15 nt, Homo sapiens
ccucccgggucacuu

SEQ ID NO: 1476986 - RNA, 15 nt, Homo sapiens
ccucccucaccaaca

SEQ ID NO: 1476987 - RNA, 17 nt, Homo sapiens
caggcuggagugcagua

SEQ ID NO: 1476988 - RNA, 20 nt, Homo sapiens
caggcuggagugcaguggca

SEQ ID NO: 1476989 - RNA, 17 nt, Homo sapiens
caggcugggccaugucc

SEQ ID NO: 1476990 - RNA, 23 nt, Homo sapiens
caggcugggccauguccaaagag

SEQ ID NO: 1476991 - RNA, 19 nt, Homo sapiens
caggcuggucucaaacucc

SEQ ID NO: 1476992 - RNA, 14 nt, Homo sapiens
caggcugugcagcg

SEQ ID NO: 1476993 - RNA, 15 nt, Homo sapiens
caggcuugugcaaca

SEQ ID NO: 1476994 - RNA, 20 nt, Homo sapiens
caggcuuucaagaagugcca

SEQ ID NO: 1476995 - RNA, 13 nt, Homo sapiens
cagggaaaacugc

SEQ ID NO: 1476996 - RNA, 19 nt, Homo sapiens
cagggaagcugucccucac

SEQ ID NO: 1476997 - RNA, 14 nt, Homo sapiens
cagggaagguaauu

SEQ ID NO: 1476998 - RNA, 14 nt, Homo sapiens
cagggaauggagcu

SEQ ID NO: 1476999 - RNA, 15 nt, Homo sapiens
cagggacagagccau

SEQ ID NO: 1477000 - RNA, 12 nt, Homo sapiens
cagggagcauuu

SEQ ID NO: 1477001 - RNA, 23 nt, Homo sapiens
cagggagggagggcgguggacaa

SEQ ID NO: 1477002 - RNA, 18 nt, Homo sapiens
cagggagugaugauuugg

SEQ ID NO: 1477003 - RNA, 18 nt, Homo sapiens
cagggauuaaccucugca

SEQ ID NO: 1477004 - RNA, 22 nt, Homo sapiens
cagggcagucauuggcugucuc

SEQ ID NO: 1477005 - RNA, 14 nt, Homo sapiens
cagggcauuuuaca

SEQ ID NO: 1477006 - RNA, 21 nt, Homo sapiens
cagggccagcuuuuccucacc

SEQ ID NO: 1477007 - RNA, 14 nt, Homo sapiens
cagggccucaaagu

SEQ ID NO: 1477008 - RNA, 18 nt, Homo sapiens
cagggccuggagccccau

SEQ ID NO: 1477009 - RNA, 15 nt, Homo sapiens
cagggcugugcuuga

SEQ ID NO: 1477010 - RNA, 18 nt, Homo sapiens
caggggaaaaugaagguu

SEQ ID NO: 1477011 - RNA, 23 nt, Homo sapiens
caggggaaggcccugaggcggag

SEQ ID NO: 1477012 - RNA, 14 nt, Homo sapiens
caggggacaaggga

SEQ ID NO: 1477013 - RNA, 22 nt, Homo sapiens
caggggacuugaaucuuuccaa

SEQ ID NO: 1477014 - RNA, 14 nt, Homo sapiens
cagggggaaggugg

SEQ ID NO: 1477015 - RNA, 11 nt, Homo sapiens
caggggugacg

SEQ ID NO: 1477016 - RNA, 13 nt, Homo sapiens
caggggugggggg

SEQ ID NO: 1477017 - RNA, 17 nt, Homo sapiens
cagggguggggggugca

SEQ ID NO: 1477018 - RNA, 21 nt, Homo sapiens
caggguacccuuuggggagca

SEQ ID NO: 1477019 - RNA, 20 nt, Homo sapiens
caggguccucuucugggccu

SEQ ID NO: 1477020 - RNA, 17 nt, Homo sapiens
cagggucuaaaauuaca

SEQ ID NO: 1477021 - RNA, 16 nt, Homo sapiens
cagggucucucccuca

SEQ ID NO: 1477022 - RNA, 15 nt, Homo sapiens
cagggucuugcucug

SEQ ID NO: 1477023 - RNA, 15 nt, Homo sapiens
cagggugcaguauca

SEQ ID NO: 1477024 - RNA, 22 nt, Homo sapiens
caggguggggggugacagugcc

SEQ ID NO: 1477025 - RNA, 19 nt, Homo sapiens
caggguggucuugaucucc

SEQ ID NO: 1477026 - RNA, 22 nt, Homo sapiens
caggguucccuugaaagcuuua

SEQ ID NO: 1477027 - RNA, 23 nt, Homo sapiens
caggguuuacccagugggacaga

SEQ ID NO: 1477028 - RNA, 17 nt, Homo sapiens
caggguuugauagcacu

SEQ ID NO: 1477029 - RNA, 20 nt, Homo sapiens
cagguaccaucuuguauaca

SEQ ID NO: 1477030 - RNA, 19 nt, Homo sapiens
cagguacuuccucagucug

SEQ ID NO: 1477031 - RNA, 14 nt, Homo sapiens
caggucacacgacc

SEQ ID NO: 1477032 - RNA, 13 nt, Homo sapiens
caggucacuuuac

SEQ ID NO: 1477033 - RNA, 12 nt, Homo sapiens
caggucagggac

SEQ ID NO: 1477034 - RNA, 19 nt, Homo sapiens
cagguccucuacuuaauga

SEQ ID NO: 1477035 - RNA, 14 nt, Homo sapiens
cagguccuuuccac

SEQ ID NO: 1477036 - RNA, 14 nt, Homo sapiens
caggugaacagccu

SEQ ID NO: 1477037 - RNA, 15 nt, Homo sapiens
caggugaacagccuc

SEQ ID NO: 1477038 - RNA, 17 nt, Homo sapiens
caggugauccaccugcc

SEQ ID NO: 1477039 - RNA, 18 nt, Homo sapiens
caggugauccgccuaccu

SEQ ID NO: 1477040 - RNA, 20 nt, Homo sapiens
caggugauucgcccaccuca

SEQ ID NO: 1477041 - RNA, 17 nt, Homo sapiens
caggugcgcacuaccac

SEQ ID NO: 1477042 - RNA, 21 nt, Homo sapiens
caggugcucaauaaacacuug

SEQ ID NO: 1477043 - RNA, 17 nt, Homo sapiens
cagguggccccaguuca

SEQ ID NO: 1477044 - RNA, 11 nt, Homo sapiens
caggugggcac

SEQ ID NO: 1477045 - RNA, 14 nt, Homo sapiens
cagguggugcaaau

SEQ ID NO: 1477046 - RNA, 17 nt, Homo sapiens
cagguguucugggcucc

SEQ ID NO: 1477047 - RNA, 15 nt, Homo sapiens
cagguuaaugcugaa

SEQ ID NO: 1477048 - RNA, 13 nt, Homo sapiens
cagguucuucagg

SEQ ID NO: 1477049 - RNA, 16 nt, Homo sapiens
cagguucuucagggcc

SEQ ID NO: 1477050 - RNA, 18 nt, Homo sapiens
caguaaaaacuguucucu

SEQ ID NO: 1477051 - RNA, 15 nt, Homo sapiens
caguaaaauaauaau

SEQ ID NO: 1477052 - RNA, 19 nt, Homo sapiens
caguaaauaacaggcauuu

SEQ ID NO: 1477053 - RNA, 16 nt, Homo sapiens
caguaaaucucacaaa

SEQ ID NO: 1477054 - RNA, 13 nt, Homo sapiens
caguaaguuuccc

SEQ ID NO: 1477055 - RNA, 18 nt, Homo sapiens
caguacccucucagcucc

SEQ ID NO: 1477056 - RNA, 16 nt, Homo sapiens
caguacuugugaaaca

SEQ ID NO: 1477057 - RNA, 19 nt, Homo sapiens
caguagaaauaauaugcau

SEQ ID NO: 1477058 - RNA, 15 nt, Homo sapiens
caguagacugcagug

SEQ ID NO: 1477059 - RNA, 16 nt, Homo sapiens
caguagagucaucucc

SEQ ID NO: 1477060 - RNA, 23 nt, Homo sapiens
caguagauugcagaaaauucugu

SEQ ID NO: 1477061 - RNA, 17 nt, Homo sapiens
caguagggaggucagug

SEQ ID NO: 1477062 - RNA, 16 nt, Homo sapiens
caguagguuggcagua

SEQ ID NO: 1477063 - RNA, 19 nt, Homo sapiens
caguaguuauaaaguccuu

SEQ ID NO: 1477064 - RNA, 15 nt, Homo sapiens
caguaugagucaaug

SEQ ID NO: 1477065 - RNA, 20 nt, Homo sapiens
caguaugagucaaugugcag

SEQ ID NO: 1477066 - RNA, 21 nt, Homo sapiens
caguaugagucaaugugcagu

SEQ ID NO: 1477067 - RNA, 12 nt, Homo sapiens
caguauuaugca

SEQ ID NO: 1477068 - RNA, 13 nt, Homo sapiens
caguauuaugcau

SEQ ID NO: 1477069 - RNA, 16 nt, Homo sapiens
cagucaaguucagagu

SEQ ID NO: 1477070 - RNA, 14 nt, Homo sapiens
cagucacacuguua

SEQ ID NO: 1477071 - RNA, 12 nt, Homo sapiens
cagucacagcca

SEQ ID NO: 1477072 - RNA, 22 nt, Homo sapiens
cagucacaugaccugaucacua

SEQ ID NO: 1477073 - RNA, 19 nt, Homo sapiens
cagucaccgacaacaugcu

SEQ ID NO: 1477074 - RNA, 19 nt, Homo sapiens
caguccaugcuucuagccu

SEQ ID NO: 1477075 - RNA, 15 nt, Homo sapiens
cagucccaucagaga

SEQ ID NO: 1477076 - RNA, 13 nt, Homo sapiens
cagucucacuuug

SEQ ID NO: 1477077 - RNA, 20 nt, Homo sapiens
cagugaaugugucuggaccu

SEQ ID NO: 1477078 - RNA, 17 nt, Homo sapiens
cagugacaaggcccuga

SEQ ID NO: 1477079 - RNA, 12 nt, Homo sapiens
cagugacaguau

SEQ ID NO: 1477080 - RNA, 15 nt, Homo sapiens
cagugaccccugacc

SEQ ID NO: 1477081 - RNA, 13 nt, Homo sapiens
ccggaggucauga

SEQ ID NO: 1477082 - RNA, 21 nt, Homo sapiens
ccggaucuacacccaccagag

SEQ ID NO: 1477083 - RNA, 24 nt, Homo sapiens
ccggccgauggagacaccaaccga

SEQ ID NO: 1477084 - RNA, 17 nt, Homo sapiens
ccggcggcuacucugga

SEQ ID NO: 1477085 - RNA, 16 nt, Homo sapiens
ccggcugaaggcugag

SEQ ID NO: 1477086 - RNA, 14 nt, Homo sapiens
ccgggacgcagggg

SEQ ID NO: 1477087 - RNA, 23 nt, Homo sapiens
ccgggaggcagagguugcagugu

SEQ ID NO: 1477088 - RNA, 15 nt, Homo sapiens
ccggggaagcugcca

SEQ ID NO: 1477089 - RNA, 15 nt, Homo sapiens
ccggggccagcacuu

SEQ ID NO: 1477090 - RNA, 16 nt, Homo sapiens
ccggggcuccacugaa

SEQ ID NO: 1477091 - RNA, 13 nt, Homo sapiens
ccggggguccagg

SEQ ID NO: 1477092 - RNA, 17 nt, Homo sapiens
ccgguucuuaaauccau

SEQ ID NO: 1477093 - RNA, 12 nt, Homo sapiens
ccguaacaacug

SEQ ID NO: 1477094 - RNA, 18 nt, Homo sapiens
ccguaacaacugugguca

SEQ ID NO: 1477095 - RNA, 16 nt, Homo sapiens
ccgucacccaacauca

SEQ ID NO: 1477096 - RNA, 23 nt, Homo sapiens
ccgucagccaaauguaauugaau

SEQ ID NO: 1477097 - RNA, 17 nt, Homo sapiens
ccgucgaggggcucuca

SEQ ID NO: 1477098 - RNA, 13 nt, Homo sapiens
ccgugccaaaaau

SEQ ID NO: 1477099 - RNA, 14 nt, Homo sapiens
ccgugucaagcugc

SEQ ID NO: 1477100 - RNA, 20 nt, Homo sapiens
caggcccugcuccugcagca

SEQ ID NO: 1477101 - RNA, 18 nt, Homo sapiens
caggcccuuccucuccac

SEQ ID NO: 1477102 - RNA, 21 nt, Homo sapiens
caggcccuuccucuccacugc

SEQ ID NO: 1477103 - RNA, 20 nt, Homo sapiens
caggcgauccaccugucuca

SEQ ID NO: 1477104 - RNA, 11 nt, Homo sapiens
caggcucugcu

SEQ ID NO: 1477105 - RNA, 17 nt, Homo sapiens
caggcugaagucagcuc

SEQ ID NO: 1477106 - RNA, 15 nt, Homo sapiens
caggcuggacaugcu

SEQ ID NO: 1477107 - RNA, 16 nt, Homo sapiens
caggcuggagugcagu

SEQ ID NO: 1477108 - RNA, 13 nt, Homo sapiens
augacucacauga

SEQ ID NO: 1477109 - RNA, 21 nt, Homo sapiens
augagaaggcagccaccagcg

SEQ ID NO: 1477110 - RNA, 16 nt, Homo sapiens
augagaccacuguuau

SEQ ID NO: 1477111 - RNA, 18 nt, Homo sapiens
augagaugauacauccaa

SEQ ID NO: 1477112 - RNA, 18 nt, Homo sapiens
augagcacccauuccaaa

SEQ ID NO: 1477113 - RNA, 20 nt, Homo sapiens
augagcacguuuuuguaaaa

SEQ ID NO: 1477114 - RNA, 11 nt, Homo sapiens
augagccauga

SEQ ID NO: 1477115 - RNA, 19 nt, Homo sapiens
augagccgugaacugugca

SEQ ID NO: 1477116 - RNA, 16 nt, Homo sapiens
augagcugacaucuca

SEQ ID NO: 1477117 - RNA, 13 nt, Homo sapiens
augagggaaaaug

SEQ ID NO: 1477118 - RNA, 23 nt, Homo sapiens
augaggucuguuuaaaguggcaa

SEQ ID NO: 1477119 - RNA, 22 nt, Homo sapiens
augagguucuggccccugucau

SEQ ID NO: 1477120 - RNA, 21 nt, Homo sapiens
augaguaacauuugcuguuuu

SEQ ID NO: 1477121 - RNA, 15 nt, Homo sapiens
augagucaaugugca

SEQ ID NO: 1477122 - RNA, 18 nt, Homo sapiens
augagucaaugugcagug

SEQ ID NO: 1477123 - RNA, 14 nt, Homo sapiens
augaguuacuugaa

SEQ ID NO: 1477124 - RNA, 22 nt, Homo sapiens
augaguuuuugauagcuuuauu

SEQ ID NO: 1477125 - RNA, 20 nt, Homo sapiens
augauaaauuaagcaugaaa

SEQ ID NO: 1477126 - RNA, 15 nt, Homo sapiens
augauacacuaugaa

SEQ ID NO: 1477127 - RNA, 13 nt, Homo sapiens
augauacauccaa

SEQ ID NO: 1477128 - RNA, 16 nt, Homo sapiens
augauauaacccuaac

SEQ ID NO: 1477129 - RNA, 17 nt, Homo sapiens
augaucuggauccacca

SEQ ID NO: 1477130 - RNA, 19 nt, Homo sapiens
augaugagaguuucuguua

SEQ ID NO: 1477131 - RNA, 12 nt, Homo sapiens
augaugaucugg

SEQ ID NO: 1477132 - RNA, 13 nt, Homo sapiens
augaugcacuuau

SEQ ID NO: 1477133 - RNA, 11 nt, Homo sapiens
augaugccaug

SEQ ID NO: 1477134 - RNA, 18 nt, Homo sapiens
augaugcgggacugcugg

SEQ ID NO: 1477135 - RNA, 14 nt, Homo sapiens
augauggaugccaa

SEQ ID NO: 1477136 - RNA, 20 nt, Homo sapiens
augauggccuuacacugaaa

SEQ ID NO: 1477137 - RNA, 21 nt, Homo sapiens
augauggccuuacacugaaaa

SEQ ID NO: 1477138 - RNA, 22 nt, Homo sapiens
augauggcucauuuacacucag

SEQ ID NO: 1477139 - RNA, 20 nt, Homo sapiens
augaugguuuuaaacuuuca

SEQ ID NO: 1477140 - RNA, 17 nt, Homo sapiens
augaugugaguauuuag

SEQ ID NO: 1477141 - RNA, 11 nt, Homo sapiens
augauguuuca

SEQ ID NO: 1477142 - RNA, 17 nt, Homo sapiens
augauuguuauguguau

SEQ ID NO: 1477143 - RNA, 13 nt, Homo sapiens
augauuguucaaa

SEQ ID NO: 1477144 - RNA, 15 nt, Homo sapiens
augcaaauuucauga

SEQ ID NO: 1477145 - RNA, 22 nt, Homo sapiens
augcaacaaaugaauuuuccac

SEQ ID NO: 1477146 - RNA, 19 nt, Homo sapiens
augcaagguauuucuccag

SEQ ID NO: 1477147 - RNA, 14 nt, Homo sapiens
augcaaucagacaa

SEQ ID NO: 1477148 - RNA, 15 nt, Homo sapiens
augcaaucagacaag

SEQ ID NO: 1477149 - RNA, 18 nt, Homo sapiens
augcaauggcucaucaga

SEQ ID NO: 1477150 - RNA, 16 nt, Homo sapiens
augcacaguugccaca

SEQ ID NO: 1477151 - RNA, 16 nt, Homo sapiens
augcacuuauucaaua

SEQ ID NO: 1477152 - RNA, 18 nt, Homo sapiens
augcagccagccaucaaa

SEQ ID NO: 1477153 - RNA, 23 nt, Homo sapiens
augcaggcccuuugaagccucag

SEQ ID NO: 1477154 - RNA, 14 nt, Homo sapiens
augcagugcccuca

SEQ ID NO: 1477155 - RNA, 18 nt, Homo sapiens
augcaguuuuaagaauug

SEQ ID NO: 1477156 - RNA, 22 nt, Homo sapiens
augcauggugccccaggaccag

SEQ ID NO: 1477157 - RNA, 23 nt, Homo sapiens
augcauggugccccaggaccagc

SEQ ID NO: 1477158 - RNA, 15 nt, Homo sapiens
augcauugcuaaaau

SEQ ID NO: 1477159 - RNA, 18 nt, Homo sapiens
augcauuucaagcagcug

SEQ ID NO: 1477160 - RNA, 18 nt, Homo sapiens
augccaaccggucaccca

SEQ ID NO: 1477161 - RNA, 21 nt, Homo sapiens
augccaauaauaaaugcccuc

SEQ ID NO: 1477162 - RNA, 23 nt, Homo sapiens
augccacaaggacuuccugucca

SEQ ID NO: 1477163 - RNA, 17 nt, Homo sapiens
augccacccuguuuuca

SEQ ID NO: 1477164 - RNA, 22 nt, Homo sapiens
augccacguggucacugugcac

SEQ ID NO: 1477165 - RNA, 12 nt, Homo sapiens
augccacuccuc

SEQ ID NO: 1477166 - RNA, 23 nt, Homo sapiens
augccacuuccuuuuaacugcca

SEQ ID NO: 1477167 - RNA, 16 nt, Homo sapiens
augccccaaggacaag

SEQ ID NO: 1477168 - RNA, 14 nt, Homo sapiens
augcccuugccuau

SEQ ID NO: 1477169 - RNA, 19 nt, Homo sapiens
augccgagguaaaaguucu

SEQ ID NO: 1477170 - RNA, 15 nt, Homo sapiens
augccuagaguuuac

SEQ ID NO: 1477171 - RNA, 16 nt, Homo sapiens
augccucuguauuuaa

SEQ ID NO: 1477172 - RNA, 14 nt, Homo sapiens
augccugcaaucug

SEQ ID NO: 1477173 - RNA, 23 nt, Homo sapiens
augccuguaaucucagcacuuug

SEQ ID NO: 1477174 - RNA, 17 nt, Homo sapiens
augccuucacuuuacaa

SEQ ID NO: 1477175 - RNA, 15 nt, Homo sapiens
augcgcagugccuug

SEQ ID NO: 1477176 - RNA, 20 nt, Homo sapiens
augcgguagccagcacacag

SEQ ID NO: 1477177 - RNA, 15 nt, Homo sapiens
augcguucacuccaa

SEQ ID NO: 1477178 - RNA, 17 nt, Homo sapiens
augcuaauuuggggaaa

SEQ ID NO: 1477179 - RNA, 21 nt, Homo sapiens
augcuaccacugguacuuccu

SEQ ID NO: 1477180 - RNA, 22 nt, Homo sapiens
augcuaccacugguacuuccuu

SEQ ID NO: 1477181 - RNA, 20 nt, Homo sapiens
augcucaggagccaccagca

SEQ ID NO: 1477182 - RNA, 17 nt, Homo sapiens
augcucugcauguuaca

SEQ ID NO: 1477183 - RNA, 23 nt, Homo sapiens
augcugacacuuuuucagggcug

SEQ ID NO: 1477184 - RNA, 14 nt, Homo sapiens
augcugacauucac

SEQ ID NO: 1477185 - RNA, 22 nt, Homo sapiens
augcugagguuaugaacaaagu

SEQ ID NO: 1477186 - RNA, 15 nt, Homo sapiens
augcugcacagaaau

SEQ ID NO: 1477187 - RNA, 13 nt, Homo sapiens
augcugccagccu

SEQ ID NO: 1477188 - RNA, 20 nt, Homo sapiens
augcuggcagccauggccau

SEQ ID NO: 1477189 - RNA, 14 nt, Homo sapiens
augcuguaacuuaa

SEQ ID NO: 1477190 - RNA, 22 nt, Homo sapiens
augcugucauuaguauuucaca

SEQ ID NO: 1477191 - RNA, 15 nt, Homo sapiens
augcugugcuaugaa

SEQ ID NO: 1477192 - RNA, 23 nt, Homo sapiens
augcuguucucuucuucauucua

SEQ ID NO: 1477193 - RNA, 18 nt, Homo sapiens
augcuucaguacuuguga

SEQ ID NO: 1477194 - RNA, 15 nt, Homo sapiens
augcuuccugacaau

SEQ ID NO: 1477195 - RNA, 12 nt, Homo sapiens
augcuucuagcc

SEQ ID NO: 1477196 - RNA, 15 nt, Homo sapiens
augcuucugcacaca

SEQ ID NO: 1477197 - RNA, 14 nt, Homo sapiens
augcuugauuccag

SEQ ID NO: 1477198 - RNA, 15 nt, Homo sapiens
augcuugauuccagu

SEQ ID NO: 1477199 - RNA, 17 nt, Homo sapiens
auggaaaaacugaggcu

SEQ ID NO: 1477200 - RNA, 15 nt, Homo sapiens
auggaaaacuguguu

SEQ ID NO: 1477201 - RNA, 20 nt, Homo sapiens
auggaaagacaaacugcaca

SEQ ID NO: 1477202 - RNA, 15 nt, Homo sapiens
auggaaccacuaaaa

SEQ ID NO: 1477203 - RNA, 16 nt, Homo sapiens
auggaagggcaaguuu

SEQ ID NO: 1477204 - RNA, 14 nt, Homo sapiens
auggaaggugcuac

SEQ ID NO: 1477205 - RNA, 20 nt, Homo sapiens
auggaauauuccccuaucuc

SEQ ID NO: 1477206 - RNA, 22 nt, Homo sapiens
auggaaugaccagccuguccaa

SEQ ID NO: 1477207 - RNA, 23 nt, Homo sapiens
auggacaccccuuauccaggacu

SEQ ID NO: 1477208 - RNA, 18 nt, Homo sapiens
auggacacuccagugcca

SEQ ID NO: 1477209 - RNA, 13 nt, Homo sapiens
aucuauuuauuaa

SEQ ID NO: 1477210 - RNA, 16 nt, Homo sapiens
aucucaaagaaggcau

SEQ ID NO: 1477211 - RNA, 16 nt, Homo sapiens
aucucaccccauccca

SEQ ID NO: 1477212 - RNA, 23 nt, Homo sapiens
aucucagaggcucagagacugca

SEQ ID NO: 1477213 - RNA, 12 nt, Homo sapiens
aucucagugcag

SEQ ID NO: 1477214 - RNA, 18 nt, Homo sapiens
aucucauuuuacacaaag

SEQ ID NO: 1477215 - RNA, 21 nt, Homo sapiens
aucucccacccuguaccucau

SEQ ID NO: 1477216 - RNA, 21 nt, Homo sapiens
aucuccugcucaccaccugcc

SEQ ID NO: 1477217 - RNA, 22 nt, Homo sapiens
aucuccuuacagucacuaauau

SEQ ID NO: 1477218 - RNA, 20 nt, Homo sapiens
aucucggcucacugcaagcu

SEQ ID NO: 1477219 - RNA, 15 nt, Homo sapiens
aucucuacuaaaaau

SEQ ID NO: 1477220 - RNA, 16 nt, Homo sapiens
aucucuacuaccacaa

SEQ ID NO: 1477221 - RNA, 18 nt, Homo sapiens
aucucucugcagcugccg

SEQ ID NO: 1477222 - RNA, 13 nt, Homo sapiens
aucucugacuuaa

SEQ ID NO: 1477223 - RNA, 17 nt, Homo sapiens
aucucuuauuuuacaau

SEQ ID NO: 1477224 - RNA, 22 nt, Homo sapiens
aucucuucuuugcugcagucau

SEQ ID NO: 1477225 - RNA, 19 nt, Homo sapiens
aucucuugcacucaaagcu

SEQ ID NO: 1477226 - RNA, 14 nt, Homo sapiens
aucugaaaauguau

SEQ ID NO: 1477227 - RNA, 13 nt, Homo sapiens
aucugaacucuca

SEQ ID NO: 1477228 - RNA, 19 nt, Homo sapiens
aucugaauaaaguguaaca

SEQ ID NO: 1477229 - RNA, 21 nt, Homo sapiens
aucugacagacaaugauccag

SEQ ID NO: 1477230 - RNA, 19 nt, Homo sapiens
aucugagagaugacaggga

SEQ ID NO: 1477231 - RNA, 14 nt, Homo sapiens
aucugagaggcucu

SEQ ID NO: 1477232 - RNA, 17 nt, Homo sapiens
aucugauccccaugccu

SEQ ID NO: 1477233 - RNA, 23 nt, Homo sapiens
aucugaucgggggcguagcauca

SEQ ID NO: 1477234 - RNA, 13 nt, Homo sapiens
aucugauguuaac

SEQ ID NO: 1477235 - RNA, 20 nt, Homo sapiens
aucugccggcccccaggaca

SEQ ID NO: 1477236 - RNA, 21 nt, Homo sapiens
aucugccggcccccaggacaa

SEQ ID NO: 1477237 - RNA, 19 nt, Homo sapiens
aucugccuguucugaggau

SEQ ID NO: 1477238 - RNA, 17 nt, Homo sapiens
aucugccuuaaaaccaa

SEQ ID NO: 1477239 - RNA, 14 nt, Homo sapiens
aucugcuaugcuau

SEQ ID NO: 1477240 - RNA, 20 nt, Homo sapiens
aucuggaagaagaugggcug

SEQ ID NO: 1477241 - RNA, 18 nt, Homo sapiens
aucuggcccucgacacuc

SEQ ID NO: 1477242 - RNA, 20 nt, Homo sapiens
aucuggcccuuacacacuca

SEQ ID NO: 1477243 - RNA, 18 nt, Homo sapiens
aucuggccuaauguucca

SEQ ID NO: 1477244 - RNA, 10 nt, Homo sapiens
aucugugcac

SEQ ID NO: 1477245 - RNA, 21 nt, Homo sapiens
aucugugggucugggagucac

SEQ ID NO: 1477246 - RNA, 15 nt, Homo sapiens
aucuuaaacauaaua

SEQ ID NO: 1477247 - RNA, 22 nt, Homo sapiens
aucuuaaacauaauaaaucaca

SEQ ID NO: 1477248 - RNA, 13 nt, Homo sapiens
aucuuacuugagc

SEQ ID NO: 1477249 - RNA, 19 nt, Homo sapiens
aucuuagaagcacuacacc

SEQ ID NO: 1477250 - RNA, 17 nt, Homo sapiens
aucuuagggugaaccac

SEQ ID NO: 1477251 - RNA, 15 nt, Homo sapiens
aucuuauuuaggaag

SEQ ID NO: 1477252 - RNA, 19 nt, Homo sapiens
aucuucaaacuuucacuuu

SEQ ID NO: 1477253 - RNA, 21 nt, Homo sapiens
aucuucaaacuuucacuuuga

SEQ ID NO: 1477254 - RNA, 24 nt, Homo sapiens
aucuucagcucuuuuuguggauau

SEQ ID NO: 1477255 - RNA, 18 nt, Homo sapiens
aucuuccaaggguacuaa

SEQ ID NO: 1477256 - RNA, 21 nt, Homo sapiens
aucuuccaaggguacuaagga

SEQ ID NO: 1477257 - RNA, 15 nt, Homo sapiens
aucuucccauaauaa

SEQ ID NO: 1477258 - RNA, 18 nt, Homo sapiens
aucuucccuuuauuacaa

SEQ ID NO: 1477259 - RNA, 22 nt, Homo sapiens
aucuucccuuuauuacaagaag

SEQ ID NO: 1477260 - RNA, 13 nt, Homo sapiens
aucuucugaauuu

SEQ ID NO: 1477261 - RNA, 15 nt, Homo sapiens
aucuucugccuuagu

SEQ ID NO: 1477262 - RNA, 24 nt, Homo sapiens
aucuugccugucuggcucaggguc

SEQ ID NO: 1477263 - RNA, 14 nt, Homo sapiens
aucuuggacugaca

SEQ ID NO: 1477264 - RNA, 18 nt, Homo sapiens
aucuugggauaguuccca

SEQ ID NO: 1477265 - RNA, 15 nt, Homo sapiens
aucuuuaacacagcc

SEQ ID NO: 1477266 - RNA, 20 nt, Homo sapiens
aucuuuacaaaacuacauga

SEQ ID NO: 1477267 - RNA, 15 nt, Homo sapiens
aucuuuaucuguucu

SEQ ID NO: 1477268 - RNA, 21 nt, Homo sapiens
aucuuucaggacucuaccuca

SEQ ID NO: 1477269 - RNA, 10 nt, Homo sapiens
aucuuucuac

SEQ ID NO: 1477270 - RNA, 13 nt, Homo sapiens
aucuuucuaggag

SEQ ID NO: 1477271 - RNA, 18 nt, Homo sapiens
aucuuugaccacgucauc

SEQ ID NO: 1477272 - RNA, 16 nt, Homo sapiens
aucuuuuuuagcauaa

SEQ ID NO: 1477273 - RNA, 12 nt, Homo sapiens
augaaaagccaa

SEQ ID NO: 1477274 - RNA, 17 nt, Homo sapiens
augaaaaugaaucuuca

SEQ ID NO: 1477275 - RNA, 13 nt, Homo sapiens
augaaaaugucag

SEQ ID NO: 1477276 - RNA, 16 nt, Homo sapiens
augaaacauuuuguca

SEQ ID NO: 1477277 - RNA, 16 nt, Homo sapiens
augaaacgucaugugu

SEQ ID NO: 1477278 - RNA, 19 nt, Homo sapiens
augaaacuauuuuaccuga

SEQ ID NO: 1477279 - RNA, 14 nt, Homo sapiens
augaaaguggacaa

SEQ ID NO: 1477280 - RNA, 15 nt, Homo sapiens
augaaaugauuggaa

SEQ ID NO: 1477281 - RNA, 16 nt, Homo sapiens
augaacaugguguuca

SEQ ID NO: 1477282 - RNA, 17 nt, Homo sapiens
augaacccaagagcaag

SEQ ID NO: 1477283 - RNA, 20 nt, Homo sapiens
augaaccugcccugcuccca

SEQ ID NO: 1477284 - RNA, 23 nt, Homo sapiens
augaaccugcccugcucccacag

SEQ ID NO: 1477285 - RNA, 12 nt, Homo sapiens
augaaccuggac

SEQ ID NO: 1477286 - RNA, 20 nt, Homo sapiens
augaacuaacugacagcuuc

SEQ ID NO: 1477287 - RNA, 22 nt, Homo sapiens
augaagacauuucugcucucag

SEQ ID NO: 1477288 - RNA, 20 nt, Homo sapiens
augaagacccuggaguucaa

SEQ ID NO: 1477289 - RNA, 18 nt, Homo sapiens
augaagguggaacaagca

SEQ ID NO: 1477290 - RNA, 16 nt, Homo sapiens
augaauaaaguguaag

SEQ ID NO: 1477291 - RNA, 20 nt, Homo sapiens
augaaucucguucccaaaga

SEQ ID NO: 1477292 - RNA, 13 nt, Homo sapiens
augaaucugcuca

SEQ ID NO: 1477293 - RNA, 15 nt, Homo sapiens
augaauguaugugca

SEQ ID NO: 1477294 - RNA, 16 nt, Homo sapiens
augaauguaugugcac

SEQ ID NO: 1477295 - RNA, 18 nt, Homo sapiens
augaauucaagaaaggaa

SEQ ID NO: 1477296 - RNA, 12 nt, Homo sapiens
augacaaaaagc

SEQ ID NO: 1477297 - RNA, 18 nt, Homo sapiens
augacaaacacacaucca

SEQ ID NO: 1477298 - RNA, 18 nt, Homo sapiens
augacacccacccugugc

SEQ ID NO: 1477299 - RNA, 19 nt, Homo sapiens
augacacccacccugugcc

SEQ ID NO: 1477300 - RNA, 12 nt, Homo sapiens
augacagugcua

SEQ ID NO: 1477301 - RNA, 13 nt, Homo sapiens
augacagugcuaa

SEQ ID NO: 1477302 - RNA, 14 nt, Homo sapiens
augacaucucaggg

SEQ ID NO: 1477303 - RNA, 19 nt, Homo sapiens
augacauucccugcuaaua

SEQ ID NO: 1477304 - RNA, 23 nt, Homo sapiens
augacauuuuuuuuaacuacuau

SEQ ID NO: 1477305 - RNA, 19 nt, Homo sapiens
augacccaggccuggccag

SEQ ID NO: 1477306 - RNA, 23 nt, Homo sapiens
augacccccgcaaguuugcacuc

SEQ ID NO: 1477307 - RNA, 23 nt, Homo sapiens
augaccuguuauuaccauuagca

SEQ ID NO: 1477308 - RNA, 22 nt, Homo sapiens
augaccuuggacaaucaugaaa

SEQ ID NO: 1477309 - RNA, 19 nt, Homo sapiens
augaccuugggguacaauu

SEQ ID NO: 1477310 - RNA, 18 nt, Homo sapiens
aucacuucccuacaugga

SEQ ID NO: 1477311 - RNA, 14 nt, Homo sapiens
aucacuugagguca

SEQ ID NO: 1477312 - RNA, 17 nt, Homo sapiens
uccagccucauaaagua

SEQ ID NO: 1477313 - RNA, 20 nt, Homo sapiens
uccagccugggcaacagagc

SEQ ID NO: 1477314 - RNA, 20 nt, Homo sapiens
uccagccuggggaacagagc

SEQ ID NO: 1477315 - RNA, 14 nt, Homo sapiens
uccagcucuaauaa

SEQ ID NO: 1477316 - RNA, 14 nt, Homo sapiens
uccagcucugagac

SEQ ID NO: 1477317 - RNA, 14 nt, Homo sapiens
uccagcuucaggca

SEQ ID NO: 1477318 - RNA, 20 nt, Homo sapiens
uccagcuugggcaacagagc

SEQ ID NO: 1477319 - RNA, 20 nt, Homo sapiens
uccagcuugggcaacagggc

SEQ ID NO: 1477320 - RNA, 17 nt, Homo sapiens
uccaggaucuccacuga

SEQ ID NO: 1477321 - RNA, 13 nt, Homo sapiens
uccaggcacagcu

SEQ ID NO: 1477322 - RNA, 15 nt, Homo sapiens
uccaggcagauccag

SEQ ID NO: 1477323 - RNA, 23 nt, Homo sapiens
uccaggccaugauggccuuacac

SEQ ID NO: 1477324 - RNA, 16 nt, Homo sapiens
uccaggcuucacaguc

SEQ ID NO: 1477325 - RNA, 21 nt, Homo sapiens
uccagggcuauagggugugau

SEQ ID NO: 1477326 - RNA, 22 nt, Homo sapiens
uccagguaguguugagacccag

SEQ ID NO: 1477327 - RNA, 17 nt, Homo sapiens
uccaguaguuagcuuuc

SEQ ID NO: 1477328 - RNA, 15 nt, Homo sapiens
uccagucuacuugag

SEQ ID NO: 1477329 - RNA, 13 nt, Homo sapiens
uccagucucaaaa

SEQ ID NO: 1477330 - RNA, 14 nt, Homo sapiens
uccagugcaauugu

SEQ ID NO: 1477331 - RNA, 11 nt, Homo sapiens
uccagugcagg

SEQ ID NO: 1477332 - RNA, 15 nt, Homo sapiens
uccagugccuggauc

SEQ ID NO: 1477333 - RNA, 21 nt, Homo sapiens
uccaguguacauaguguaaug

SEQ ID NO: 1477334 - RNA, 13 nt, Homo sapiens
uccaguguuuaca

SEQ ID NO: 1477335 - RNA, 21 nt, Homo sapiens
uccaguuacuuuccaauucuc

SEQ ID NO: 1477336 - RNA, 22 nt, Homo sapiens
uccaguuuuauaaaaaguggag

SEQ ID NO: 1477337 - RNA, 22 nt, Homo sapiens
uccauaggcgcaggugcacagg

SEQ ID NO: 1477338 - RNA, 21 nt, Homo sapiens
uccauaguucugaggucccug

SEQ ID NO: 1477339 - RNA, 23 nt, Homo sapiens
uccauauguuauaucaacagaua

SEQ ID NO: 1477340 - RNA, 23 nt, Homo sapiens
uccauauuggacauccccagaaa

SEQ ID NO: 1477341 - RNA, 19 nt, Homo sapiens
uccaucagagccagucuca

SEQ ID NO: 1477342 - RNA, 20 nt, Homo sapiens
uccauccaucuuuccaucca

SEQ ID NO: 1477343 - RNA, 17 nt, Homo sapiens
uccaucccuccauucau

SEQ ID NO: 1477344 - RNA, 21 nt, Homo sapiens
uccaucucucauccuccagua

SEQ ID NO: 1477345 - RNA, 16 nt, Homo sapiens
uccaucucugacuuaa

SEQ ID NO: 1477346 - RNA, 20 nt, Homo sapiens
uccaucuuuacaaaacuaca

SEQ ID NO: 1477347 - RNA, 14 nt, Homo sapiens
uccaugaauguauc

SEQ ID NO: 1477348 - RNA, 22 nt, Homo sapiens
uccaugauuuuaaauugugauc

SEQ ID NO: 1477349 - RNA, 22 nt, Homo sapiens
uccaugcuccucaccugucuag

SEQ ID NO: 1477350 - RNA, 21 nt, Homo sapiens
ugcauaaauaugcagugauau

SEQ ID NO: 1477351 - RNA, 17 nt, Homo sapiens
ugcauagugcugggaug

SEQ ID NO: 1477352 - RNA, 22 nt, Homo sapiens
ugcaucacguaccccacugggc

SEQ ID NO: 1477353 - RNA, 21 nt, Homo sapiens
ugcaucuuuguuacuuccuua

SEQ ID NO: 1477354 - RNA, 17 nt, Homo sapiens
ugcaugagacauugaca

SEQ ID NO: 1477355 - RNA, 16 nt, Homo sapiens
ugcaugauaagagcau

SEQ ID NO: 1477356 - RNA, 11 nt, Homo sapiens
ugcaugccaaa

SEQ ID NO: 1477357 - RNA, 21 nt, Homo sapiens
ugcauguuacauaagauaaau

SEQ ID NO: 1477358 - RNA, 15 nt, Homo sapiens
ugcauucuauugccu

SEQ ID NO: 1477359 - RNA, 16 nt, Homo sapiens
ugcauucuauugccuu

SEQ ID NO: 1477360 - RNA, 18 nt, Homo sapiens
ugcauugcuaaaauauua

SEQ ID NO: 1477361 - RNA, 22 nt, Homo sapiens
ugcauuuauggucaacacuuaa

SEQ ID NO: 1477362 - RNA, 19 nt, Homo sapiens
ugcauuuucccagauacuu

SEQ ID NO: 1477363 - RNA, 21 nt, Homo sapiens
ugcauuuuuauuaaagcauuu

SEQ ID NO: 1477364 - RNA, 20 nt, Homo sapiens
ugcauuuuucacuuugcucu

SEQ ID NO: 1477365 - RNA, 15 nt, Homo sapiens
ugccaaaaaucuuuu

SEQ ID NO: 1477366 - RNA, 19 nt, Homo sapiens
ugccaaaggaugugauaua

SEQ ID NO: 1477367 - RNA, 16 nt, Homo sapiens
ugccaaccaguuugaa

SEQ ID NO: 1477368 - RNA, 15 nt, Homo sapiens
ugccaaccggucacc

SEQ ID NO: 1477369 - RNA, 14 nt, Homo sapiens
ugccaacuccucac

SEQ ID NO: 1477370 - RNA, 18 nt, Homo sapiens
ugccaagaauaaagaagu

SEQ ID NO: 1477371 - RNA, 23 nt, Homo sapiens
ugccaauuauuguuacacauuaa

SEQ ID NO: 1477372 - RNA, 12 nt, Homo sapiens
ugccacaaccag

SEQ ID NO: 1477373 - RNA, 21 nt, Homo sapiens
ugccacaccagucacaugacc

SEQ ID NO: 1477374 - RNA, 23 nt, Homo sapiens
ugccacaccagucacaugaccug

SEQ ID NO: 1477375 - RNA, 23 nt, Homo sapiens
ugccacagcuuuugcaacuuaau

SEQ ID NO: 1477376 - RNA, 21 nt, Homo sapiens
ugccacguggucacugugcac

SEQ ID NO: 1477377 - RNA, 22 nt, Homo sapiens
ugccacuuccuuuuaacugcca

SEQ ID NO: 1477378 - RNA, 18 nt, Homo sapiens
ugccagaugauuguucaa

SEQ ID NO: 1477379 - RNA, 22 nt, Homo sapiens
ugccagcauauacugaagucuu

SEQ ID NO: 1477380 - RNA, 19 nt, Homo sapiens
ugccaggccagagggcagu

SEQ ID NO: 1477381 - RNA, 13 nt, Homo sapiens
ugccaguggcuua

SEQ ID NO: 1477382 - RNA, 13 nt, Homo sapiens
ugccaucaugccu

SEQ ID NO: 1477383 - RNA, 20 nt, Homo sapiens
ugccaucugugauaugccau

SEQ ID NO: 1477384 - RNA, 12 nt, Homo sapiens
ugccaugaucug

SEQ ID NO: 1477385 - RNA, 12 nt, Homo sapiens
ugccauggauuu

SEQ ID NO: 1477386 - RNA, 17 nt, Homo sapiens
ugccauugaaacuaaga

SEQ ID NO: 1477387 - RNA, 21 nt, Homo sapiens
ugcccacccugggagacagac

SEQ ID NO: 1477388 - RNA, 15 nt, Homo sapiens
ugcccagacuacagg

SEQ ID NO: 1477389 - RNA, 12 nt, Homo sapiens
ugcccagaucaa

SEQ ID NO: 1477390 - RNA, 16 nt, Homo sapiens
ugcccagcacaggaau

SEQ ID NO: 1477391 - RNA, 15 nt, Homo sapiens
ugcccagcaggggag

SEQ ID NO: 1477392 - RNA, 20 nt, Homo sapiens
ugcccaggcuggagugcagu

SEQ ID NO: 1477393 - RNA, 20 nt, Homo sapiens
ugccccaaacaaauaugcaa

SEQ ID NO: 1477394 - RNA, 15 nt, Homo sapiens
ugccccaaggacaag

SEQ ID NO: 1477395 - RNA, 20 nt, Homo sapiens
ugccccaccaucuugcugac

SEQ ID NO: 1477396 - RNA, 19 nt, Homo sapiens
ugccccagauagguggugc

SEQ ID NO: 1477397 - RNA, 18 nt, Homo sapiens
ugccccaggccugaaaga

SEQ ID NO: 1477398 - RNA, 20 nt, Homo sapiens
ugccccagggaguccagggu

SEQ ID NO: 1477399 - RNA, 17 nt, Homo sapiens
ugcccccaccccgggga

SEQ ID NO: 1477400 - RNA, 15 nt, Homo sapiens
ugcccgccagugcac

SEQ ID NO: 1477401 - RNA, 19 nt, Homo sapiens
ugcccguguaguccccaac

SEQ ID NO: 1477402 - RNA, 20 nt, Homo sapiens
ugcccuagcccagacucuga

SEQ ID NO: 1477403 - RNA, 16 nt, Homo sapiens
ugcccucaggggacuu

SEQ ID NO: 1477404 - RNA, 17 nt, Homo sapiens
ugcccucucccaaaaaa

SEQ ID NO: 1477405 - RNA, 20 nt, Homo sapiens
ugcccucuuguggugcauug

SEQ ID NO: 1477406 - RNA, 21 nt, Homo sapiens
ugcccuguucaugugccucug

SEQ ID NO: 1477407 - RNA, 18 nt, Homo sapiens
ugcccuucucaagacuuu

SEQ ID NO: 1477408 - RNA, 17 nt, Homo sapiens
ugcccuuuaacuuucag

SEQ ID NO: 1477409 - RNA, 12 nt, Homo sapiens
ugccgcauuugg

SEQ ID NO: 1477410 - RNA, 20 nt, Homo sapiens
ugccgccuccuugugcacaa

SEQ ID NO: 1477411 - RNA, 14 nt, Homo sapiens
ugccgcuaccuccc

SEQ ID NO: 1477412 - RNA, 19 nt, Homo sapiens
ugccggguucuagucuccu

SEQ ID NO: 1477413 - RNA, 18 nt, Homo sapiens
ugccguaggaaaaauaaa

SEQ ID NO: 1477414 - RNA, 16 nt, Homo sapiens
ugccuaaauauaauua

SEQ ID NO: 1477415 - RNA, 15 nt, Homo sapiens
ugccuacaaccaucc

SEQ ID NO: 1477416 - RNA, 13 nt, Homo sapiens
ugccuacagccag

SEQ ID NO: 1477417 - RNA, 15 nt, Homo sapiens
ugccuacagccaggu

SEQ ID NO: 1477418 - RNA, 15 nt, Homo sapiens
ucauagggucucuuc

SEQ ID NO: 1477419 - RNA, 14 nt, Homo sapiens
ucauauaccagcaa

SEQ ID NO: 1477420 - RNA, 20 nt, Homo sapiens
ucauaucaucacauugagcu

SEQ ID NO: 1477421 - RNA, 17 nt, Homo sapiens
ucaucaaaaacuuugga

SEQ ID NO: 1477422 - RNA, 20 nt, Homo sapiens
ucaucacagggauuuagacu

SEQ ID NO: 1477423 - RNA, 20 nt, Homo sapiens
ucaucacauuucuaugccaa

SEQ ID NO: 1477424 - RNA, 19 nt, Homo sapiens
ucaucacuggaugaagauu

SEQ ID NO: 1477425 - RNA, 19 nt, Homo sapiens
ucaucagcauuuggaccaa

SEQ ID NO: 1477426 - RNA, 21 nt, Homo sapiens
ucaucaggaaggaaaugacac

SEQ ID NO: 1477427 - RNA, 23 nt, Homo sapiens
ucaucaguguccucuugcucaaa

SEQ ID NO: 1477428 - RNA, 21 nt, Homo sapiens
ucaucauaaaauaaaguauau

SEQ ID NO: 1477429 - RNA, 13 nt, Homo sapiens
ucaucaugauaag

SEQ ID NO: 1477430 - RNA, 19 nt, Homo sapiens
ucaucauggaggucauaca

SEQ ID NO: 1477431 - RNA, 17 nt, Homo sapiens
ucaucauugugcuagcu

SEQ ID NO: 1477432 - RNA, 19 nt, Homo sapiens
ucauccccaggggucccag

SEQ ID NO: 1477433 - RNA, 23 nt, Homo sapiens
ucauccuuaaaacaauucuguga

SEQ ID NO: 1477434 - RNA, 16 nt, Homo sapiens
ucaucuacccugcuga

SEQ ID NO: 1477435 - RNA, 20 nt, Homo sapiens
ucaucuauaaagaagaacuu

SEQ ID NO: 1477436 - RNA, 20 nt, Homo sapiens
ucaucuauucaagcacuuac

SEQ ID NO: 1477437 - RNA, 14 nt, Homo sapiens
ucaucucauuccaa

SEQ ID NO: 1477438 - RNA, 16 nt, Homo sapiens
ucaucucggaguucca

SEQ ID NO: 1477439 - RNA, 12 nt, Homo sapiens
ucaucugguugu

SEQ ID NO: 1477440 - RNA, 14 nt, Homo sapiens
ucaucugguuguga

SEQ ID NO: 1477441 - RNA, 13 nt, Homo sapiens
ucaucugugcacu

SEQ ID NO: 1477442 - RNA, 15 nt, Homo sapiens
ucaucuucacugcaa

SEQ ID NO: 1477443 - RNA, 21 nt, Homo sapiens
ucaucuuccuguguccugaaa

SEQ ID NO: 1477444 - RNA, 14 nt, Homo sapiens
ucaugaaacugucc

SEQ ID NO: 1477445 - RNA, 13 nt, Homo sapiens
ucaugaaaucagc

SEQ ID NO: 1477446 - RNA, 11 nt, Homo sapiens
ucaugaaggag

SEQ ID NO: 1477447 - RNA, 19 nt, Homo sapiens
ucaugccaagacaguauca

SEQ ID NO: 1477448 - RNA, 18 nt, Homo sapiens
ucaugcccgccagugcac

SEQ ID NO: 1477449 - RNA, 20 nt, Homo sapiens
ucaugcccgccagugcacag

SEQ ID NO: 1477450 - RNA, 20 nt, Homo sapiens
ucauggagaaucugcugcau

SEQ ID NO: 1477451 - RNA, 19 nt, Homo sapiens
ucaugggagggggcuugaa

SEQ ID NO: 1477452 - RNA, 22 nt, Homo sapiens
ucauguauauguguucauuaaa

SEQ ID NO: 1477453 - RNA, 13 nt, Homo sapiens
ucaugugcacuuc

SEQ ID NO: 1477454 - RNA, 19 nt, Homo sapiens
ucaugugcugccugcaagc

SEQ ID NO: 1477455 - RNA, 19 nt, Homo sapiens
ucauguuugcuucauaaau

SEQ ID NO: 1477456 - RNA, 22 nt, Homo sapiens
ucauucaauauugacauuugua

SEQ ID NO: 1477457 - RNA, 22 nt, Homo sapiens
gugguauccugugacauguaac

SEQ ID NO: 1477458 - RNA, 16 nt, Homo sapiens
gugguaugucugccau

SEQ ID NO: 1477459 - RNA, 13 nt, Homo sapiens
gugguaugugaca

SEQ ID NO: 1477460 - RNA, 12 nt, Homo sapiens
gugguccagcuc

SEQ ID NO: 1477461 - RNA, 15 nt, Homo sapiens
guggucuugaucucc

SEQ ID NO: 1477462 - RNA, 16 nt, Homo sapiens
gugguuaacaucucag

SEQ ID NO: 1477463 - RNA, 19 nt, Homo sapiens
gugguuacuuccuacugua

SEQ ID NO: 1477464 - RNA, 18 nt, Homo sapiens
gugguugucuuauugcac

SEQ ID NO: 1477465 - RNA, 22 nt, Homo sapiens
gugguuuuauacugaaggaaaa

SEQ ID NO: 1477466 - RNA, 19 nt, Homo sapiens
guguaaauauaugucugau

SEQ ID NO: 1477467 - RNA, 21 nt, Homo sapiens
guguaauguagcguguuuaca

SEQ ID NO: 1477468 - RNA, 22 nt, Homo sapiens
guguacacggaggucucuguaa

SEQ ID NO: 1477469 - RNA, 22 nt, Homo sapiens
guguauaaaaaccaugcuggua

SEQ ID NO: 1477470 - RNA, 19 nt, Homo sapiens
gugucaccuacgugccacu

SEQ ID NO: 1477471 - RNA, 21 nt, Homo sapiens
gugucacuacucacagucucu

SEQ ID NO: 1477472 - RNA, 17 nt, Homo sapiens
gugucaugccaagacag

SEQ ID NO: 1477473 - RNA, 22 nt, Homo sapiens
guguccuucgggggcgugcgug

SEQ ID NO: 1477474 - RNA, 23 nt, Homo sapiens
gugucugcacccaggggugggga

SEQ ID NO: 1477475 - RNA, 15 nt, Homo sapiens
gugucuuaauuauua

SEQ ID NO: 1477476 - RNA, 20 nt, Homo sapiens
gugucuuccacuuugcauau

SEQ ID NO: 1477477 - RNA, 16 nt, Homo sapiens
gugucuuuggugggga

SEQ ID NO: 1477478 - RNA, 21 nt, Homo sapiens
gugugaucuuaauauauuuga

SEQ ID NO: 1477479 - RNA, 16 nt, Homo sapiens
gugugccacucagaga

SEQ ID NO: 1477480 - RNA, 14 nt, Homo sapiens
guguggcuuuccag

SEQ ID NO: 1477481 - RNA, 19 nt, Homo sapiens
gugugggcugugaguguaa

SEQ ID NO: 1477482 - RNA, 14 nt, Homo sapiens
gugugggggguccu

SEQ ID NO: 1477483 - RNA, 22 nt, Homo sapiens
gugugguccagguccuuuccac

SEQ ID NO: 1477484 - RNA, 19 nt, Homo sapiens
guguggugagaucaugcca

SEQ ID NO: 1477485 - RNA, 17 nt, Homo sapiens
gugugugguccaugccc

SEQ ID NO: 1477486 - RNA, 13 nt, Homo sapiens
guguuaccauccc

SEQ ID NO: 1477487 - RNA, 21 nt, Homo sapiens
guguuacgcacacguacuuaa

SEQ ID NO: 1477488 - RNA, 23 nt, Homo sapiens
guguuaguuauaaauagccuuca

SEQ ID NO: 1477489 - RNA, 21 nt, Homo sapiens
guguuaucagucauaacuaaa

SEQ ID NO: 1477490 - RNA, 21 nt, Homo sapiens
guguuauuguauuagguguca

SEQ ID NO: 1477491 - RNA, 15 nt, Homo sapiens
guguuauuugcacac

SEQ ID NO: 1477492 - RNA, 17 nt, Homo sapiens
guguuauuugcacacug

SEQ ID NO: 1477493 - RNA, 24 nt, Homo sapiens
guguuggggaaaccuucaucugaa

SEQ ID NO: 1477494 - RNA, 22 nt, Homo sapiens
guguuguguuccuggcugauga

SEQ ID NO: 1477495 - RNA, 13 nt, Homo sapiens
guguuuaauuuga

SEQ ID NO: 1477496 - RNA, 19 nt, Homo sapiens
guguuucagcuaagggaag

SEQ ID NO: 1477497 - RNA, 21 nt, Homo sapiens
guguuuggaaauaaacugugc

SEQ ID NO: 1477498 - RNA, 17 nt, Homo sapiens
guguuugggaugaccag

SEQ ID NO: 1477499 - RNA, 15 nt, Homo sapiens
guguuugguuuacau

SEQ ID NO: 1477500 - RNA, 21 nt, Homo sapiens
guguuuuucuuuuuccacaag

SEQ ID NO: 1477501 - RNA, 21 nt, Homo sapiens
guuaaaaugguuuuugccuaa

SEQ ID NO: 1477502 - RNA, 14 nt, Homo sapiens
guuaaagugaauaa

SEQ ID NO: 1477503 - RNA, 20 nt, Homo sapiens
guuaacuuuucuaacagaaa

SEQ ID NO: 1477504 - RNA, 23 nt, Homo sapiens
guuaagcaaaaugcuucugcaca

SEQ ID NO: 1477505 - RNA, 21 nt, Homo sapiens
guuaagcagauggaaugcugu

SEQ ID NO: 1477506 - RNA, 23 nt, Homo sapiens
guuaagcauuaccacucaggcau

SEQ ID NO: 1477507 - RNA, 16 nt, Homo sapiens
guuaauucagcacuga

SEQ ID NO: 1477508 - RNA, 11 nt, Homo sapiens
guuacaaagac

SEQ ID NO: 1477509 - RNA, 14 nt, Homo sapiens
gugaacugugcaua

SEQ ID NO: 1477510 - RNA, 23 nt, Homo sapiens
gugaagcauucuccccaguguau

SEQ ID NO: 1477511 - RNA, 18 nt, Homo sapiens
gugaagggagagccagcu

SEQ ID NO: 1477512 - RNA, 17 nt, Homo sapiens
gugaaugggacuauuca

SEQ ID NO: 1477513 - RNA, 13 nt, Homo sapiens
gugaaugugggca

SEQ ID NO: 1477514 - RNA, 18 nt, Homo sapiens
gugaauugccugcagaga

SEQ ID NO: 1477515 - RNA, 13 nt, Homo sapiens
gugacaacaugcg

SEQ ID NO: 1477516 - RNA, 19 nt, Homo sapiens
gugacagcugcaagccagg

SEQ ID NO: 1477517 - RNA, 16 nt, Homo sapiens
gugacauuugggagac

SEQ ID NO: 1477518 - RNA, 19 nt, Homo sapiens
gugacucuaagcucagugc

SEQ ID NO: 1477519 - RNA, 17 nt, Homo sapiens
gugagaaaaugccucaa

SEQ ID NO: 1477520 - RNA, 23 nt, Homo sapiens
gugagaauaaacuagacucugaa

SEQ ID NO: 1477521 - RNA, 16 nt, Homo sapiens
gugagcggagaucgca

SEQ ID NO: 1477522 - RNA, 16 nt, Homo sapiens
gugaggucacagucca

SEQ ID NO: 1477523 - RNA, 18 nt, Homo sapiens
gugaggugcugaugagug

SEQ ID NO: 1477524 - RNA, 15 nt, Homo sapiens
gugagguucugcuga

SEQ ID NO: 1477525 - RNA, 18 nt, Homo sapiens
gugaguaagagcuggugu

SEQ ID NO: 1477526 - RNA, 22 nt, Homo sapiens
gugaguuuaccuuguauacugu

SEQ ID NO: 1477527 - RNA, 14 nt, Homo sapiens
gugaguuugagcug

SEQ ID NO: 1477528 - RNA, 21 nt, Homo sapiens
gugauacuaagguggaugcca

SEQ ID NO: 1477529 - RNA, 13 nt, Homo sapiens
gugauagcacuuu

SEQ ID NO: 1477530 - RNA, 22 nt, Homo sapiens
gugaucagaccauaauguuaca

SEQ ID NO: 1477531 - RNA, 18 nt, Homo sapiens
gugauccgccuaccucag

SEQ ID NO: 1477532 - RNA, 12 nt, Homo sapiens
gugaucucaggg

SEQ ID NO: 1477533 - RNA, 14 nt, Homo sapiens
gugaugacauuccc

SEQ ID NO: 1477534 - RNA, 18 nt, Homo sapiens
gugaugaugcugugacaa

SEQ ID NO: 1477535 - RNA, 13 nt, Homo sapiens
gugauucaaugaa

SEQ ID NO: 1477536 - RNA, 21 nt, Homo sapiens
gugauucuguuuauucuucca

SEQ ID NO: 1477537 - RNA, 21 nt, Homo sapiens
gugauugacacacagcacucu

SEQ ID NO: 1477538 - RNA, 14 nt, Homo sapiens
gugauugcugccau

SEQ ID NO: 1477539 - RNA, 19 nt, Homo sapiens
gugcacagggggaggccau

SEQ ID NO: 1477540 - RNA, 23 nt, Homo sapiens
gugcacauuucuuugcauuccag

SEQ ID NO: 1477541 - RNA, 18 nt, Homo sapiens
gugcaccacuucaaguga

SEQ ID NO: 1477542 - RNA, 17 nt, Homo sapiens
gugcacugucacuuugc

SEQ ID NO: 1477543 - RNA, 20 nt, Homo sapiens
gugcaguuguaggcauguag

SEQ ID NO: 1477544 - RNA, 15 nt, Homo sapiens
gugcauggaggcccu

SEQ ID NO: 1477545 - RNA, 14 nt, Homo sapiens
gugcauucuggcca

SEQ ID NO: 1477546 - RNA, 15 nt, Homo sapiens
gugcauuucuaggac

SEQ ID NO: 1477547 - RNA, 19 nt, Homo sapiens
gugccaaaaaucuuuucau

SEQ ID NO: 1477548 - RNA, 16 nt, Homo sapiens
gugccaaguuccacuu

SEQ ID NO: 1477549 - RNA, 19 nt, Homo sapiens
gugccagaggccagaccca

SEQ ID NO: 1477550 - RNA, 22 nt, Homo sapiens
gugccagugucauccgggccua

SEQ ID NO: 1477551 - RNA, 20 nt, Homo sapiens
gugcccauccugccauccuc

SEQ ID NO: 1477552 - RNA, 22 nt, Homo sapiens
gugccccacagcuaccugagac

SEQ ID NO: 1477553 - RNA, 19 nt, Homo sapiens
gugcccuacaaaggcuaga

SEQ ID NO: 1477554 - RNA, 16 nt, Homo sapiens
gugcccuagacuggcu

SEQ ID NO: 1477555 - RNA, 18 nt, Homo sapiens
gugccgugugagugugac

SEQ ID NO: 1477556 - RNA, 21 nt, Homo sapiens
gugccugaaauuucaccauug

SEQ ID NO: 1477557 - RNA, 18 nt, Homo sapiens
gugccugccaccuucaag

SEQ ID NO: 1477558 - RNA, 23 nt, Homo sapiens
gugccugggggaguuuuccucua

SEQ ID NO: 1477559 - RNA, 14 nt, Homo sapiens
gugccuuccauaau

SEQ ID NO: 1477560 - RNA, 17 nt, Homo sapiens
gugccuucccagacacu

SEQ ID NO: 1477561 - RNA, 18 nt, Homo sapiens
gucaguuugguugggcua

SEQ ID NO: 1477562 - RNA, 20 nt, Homo sapiens
gucauaaugguuuuuaacac

SEQ ID NO: 1477563 - RNA, 23 nt, Homo sapiens
gucaucgggaggagcagccugaa

SEQ ID NO: 1477564 - RNA, 13 nt, Homo sapiens
gucaucugugcac

SEQ ID NO: 1477565 - RNA, 20 nt, Homo sapiens
gucaugcauaaauaugcagu

SEQ ID NO: 1477566 - RNA, 11 nt, Homo sapiens
gucauugcugu

SEQ ID NO: 1477567 - RNA, 17 nt, Homo sapiens
guccaacaagaaugcau

SEQ ID NO: 1477568 - RNA, 21 nt, Homo sapiens
guccaagccccccacaccuuu

SEQ ID NO: 1477569 - RNA, 13 nt, Homo sapiens
guccaagucuucu

SEQ ID NO: 1477570 - RNA, 20 nt, Homo sapiens
guccacccacccucucucug

SEQ ID NO: 1477571 - RNA, 18 nt, Homo sapiens
guccacccaccuaugugc

SEQ ID NO: 1477572 - RNA, 14 nt, Homo sapiens
guccagcacuggaa

SEQ ID NO: 1477573 - RNA, 16 nt, Homo sapiens
guccagcucguucucu

SEQ ID NO: 1477574 - RNA, 17 nt, Homo sapiens
guccagggcuagugacu

SEQ ID NO: 1477575 - RNA, 23 nt, Homo sapiens
guccaggggucugucugcuuugg

SEQ ID NO: 1477576 - RNA, 22 nt, Homo sapiens
guccauacacuuuguugcaaga

SEQ ID NO: 1477577 - RNA, 14 nt, Homo sapiens
guccauauuuacau

SEQ ID NO: 1477578 - RNA, 14 nt, Homo sapiens
guccaugcuucuag

SEQ ID NO: 1477579 - RNA, 18 nt, Homo sapiens
guccauggugucaugcca

SEQ ID NO: 1477580 - RNA, 19 nt, Homo sapiens
guccauuuugcccuuccau

SEQ ID NO: 1477581 - RNA, 16 nt, Homo sapiens
gucccaaccccagugg

SEQ ID NO: 1477582 - RNA, 14 nt, Homo sapiens
gucccaccugcaca

SEQ ID NO: 1477583 - RNA, 21 nt, Homo sapiens
gucccaugaccuugggguaca

SEQ ID NO: 1477584 - RNA, 17 nt, Homo sapiens
gucccauggacacucca

SEQ ID NO: 1477585 - RNA, 17 nt, Homo sapiens
guccccacccuccacuc

SEQ ID NO: 1477586 - RNA, 17 nt, Homo sapiens
guccccucaccuccucu

SEQ ID NO: 1477587 - RNA, 14 nt, Homo sapiens
guccccuccaggaa

SEQ ID NO: 1477588 - RNA, 18 nt, Homo sapiens
guccccuccccucucagc

SEQ ID NO: 1477589 - RNA, 16 nt, Homo sapiens
guccccucuugaccca

SEQ ID NO: 1477590 - RNA, 20 nt, Homo sapiens
gucccggggccagcacuucc

SEQ ID NO: 1477591 - RNA, 20 nt, Homo sapiens
gucccggggcuccacugaac

SEQ ID NO: 1477592 - RNA, 15 nt, Homo sapiens
gucccgguaccuucc

SEQ ID NO: 1477593 - RNA, 11 nt, Homo sapiens
gucccuaccuc

SEQ ID NO: 1477594 - RNA, 18 nt, Homo sapiens
gucccuccaccccacaga

SEQ ID NO: 1477595 - RNA, 15 nt, Homo sapiens
gucccucccugccug

SEQ ID NO: 1477596 - RNA, 22 nt, Homo sapiens
gucccugaaaccuaguacugcc

SEQ ID NO: 1477597 - RNA, 22 nt, Homo sapiens
gucccuguuuucccacgaggaa

SEQ ID NO: 1477598 - RNA, 19 nt, Homo sapiens
gucccuugcuguaugcuga

SEQ ID NO: 1477599 - RNA, 16 nt, Homo sapiens
guccuaaagaugcuga

SEQ ID NO: 1477600 - RNA, 18 nt, Homo sapiens
guccuaaagaugcugacu

SEQ ID NO: 1477601 - RNA, 18 nt, Homo sapiens
guccucacgcagacacac

SEQ ID NO: 1477602 - RNA, 19 nt, Homo sapiens
guccucagccuugccagag

SEQ ID NO: 1477603 - RNA, 20 nt, Homo sapiens
guccuccaacaccaagcaca

SEQ ID NO: 1477604 - RNA, 13 nt, Homo sapiens
guccuccaagcuc

SEQ ID NO: 1477605 - RNA, 15 nt, Homo sapiens
guccucccaggccag

SEQ ID NO: 1477606 - RNA, 21 nt, Homo sapiens
guccucuccccuccagccuuu

SEQ ID NO: 1477607 - RNA, 15 nt, Homo sapiens
guccugaucugugau

SEQ ID NO: 1477608 - RNA, 16 nt, Homo sapiens
guccugaucugugaua

SEQ ID NO: 1477609 - RNA, 22 nt, Homo sapiens
guccugcagaagcagaagugca

SEQ ID NO: 1477610 - RNA, 23 nt, Homo sapiens
guccugggguauaaaacuuuccu

SEQ ID NO: 1477611 - RNA, 16 nt, Homo sapiens
guccuguccugcucau

SEQ ID NO: 1477612 - RNA, 18 nt, Homo sapiens
guccuuucuaaguauuuu

SEQ ID NO: 1477613 - RNA, 21 nt, Homo sapiens
ccucugacauuuauccaagac

SEQ ID NO: 1477614 - RNA, 17 nt, Homo sapiens
ccucugaccugcacugg

SEQ ID NO: 1477615 - RNA, 20 nt, Homo sapiens
ccucugagaauuccaaggag

SEQ ID NO: 1477616 - RNA, 16 nt, Homo sapiens
ccucugcuacuagcca

SEQ ID NO: 1477617 - RNA, 18 nt, Homo sapiens
ccucugucucauccuccu

SEQ ID NO: 1477618 - RNA, 13 nt, Homo sapiens
ccucuucccauga

SEQ ID NO: 1477619 - RNA, 13 nt, Homo sapiens
ccucuugcucaaa

SEQ ID NO: 1477620 - RNA, 22 nt, Homo sapiens
ccucuuggccugaucagaccac

SEQ ID NO: 1477621 - RNA, 23 nt, Homo sapiens
ccucuuguaagucaucuacuuaa

SEQ ID NO: 1477622 - RNA, 16 nt, Homo sapiens
ccugaacuuacacaaa

SEQ ID NO: 1477623 - RNA, 15 nt, Homo sapiens
ccugaagaaccaguc

SEQ ID NO: 1477624 - RNA, 20 nt, Homo sapiens
ccugaaggaaaauaaacuga

SEQ ID NO: 1477625 - RNA, 13 nt, Homo sapiens
ccugaaucauucu

SEQ ID NO: 1477626 - RNA, 22 nt, Homo sapiens
ccugaaucugugccugcacuga

SEQ ID NO: 1477627 - RNA, 13 nt, Homo sapiens
ccugaaugaaaua

SEQ ID NO: 1477628 - RNA, 18 nt, Homo sapiens
ccugacaucacagcagcc

SEQ ID NO: 1477629 - RNA, 16 nt, Homo sapiens
ccugaccaucgcacac

SEQ ID NO: 1477630 - RNA, 15 nt, Homo sapiens
ccugaccuccgcccc

SEQ ID NO: 1477631 - RNA, 13 nt, Homo sapiens
ccugacucaggcc

SEQ ID NO: 1477632 - RNA, 20 nt, Homo sapiens
ccugaggguggagacuaagc

SEQ ID NO: 1477633 - RNA, 21 nt, Homo sapiens
ccugaggugaaagggagcuau

SEQ ID NO: 1477634 - RNA, 17 nt, Homo sapiens
ccugaguggugccaaac

SEQ ID NO: 1477635 - RNA, 23 nt, Homo sapiens
ccugaguggugccaaacaaaaag

SEQ ID NO: 1477636 - RNA, 14 nt, Homo sapiens
ccugaucugugaua

SEQ ID NO: 1477637 - RNA, 17 nt, Homo sapiens
ccugaugacacccaccc

SEQ ID NO: 1477638 - RNA, 21 nt, Homo sapiens
ccugaugacagagcgagauuc

SEQ ID NO: 1477639 - RNA, 16 nt, Homo sapiens
ccugaugcuaugguca

SEQ ID NO: 1477640 - RNA, 20 nt, Homo sapiens
ccugauggaaguaaagccuc

SEQ ID NO: 1477641 - RNA, 12 nt, Homo sapiens
ccugauguuaaa

SEQ ID NO: 1477642 - RNA, 19 nt, Homo sapiens
ccugauuuaggagaagcca

SEQ ID NO: 1477643 - RNA, 20 nt, Homo sapiens
ccugauuuguuuucauuaua

SEQ ID NO: 1477644 - RNA, 21 nt, Homo sapiens
ccugcaaacucacugcucaag

SEQ ID NO: 1477645 - RNA, 15 nt, Homo sapiens
ccugcaagucagucc

SEQ ID NO: 1477646 - RNA, 19 nt, Homo sapiens
ccugcaauucuacaguuuc

SEQ ID NO: 1477647 - RNA, 19 nt, Homo sapiens
ccugcacuguccugaccau

SEQ ID NO: 1477648 - RNA, 18 nt, Homo sapiens
ccugcaggcugagccacu

SEQ ID NO: 1477649 - RNA, 19 nt, Homo sapiens
ccugcagggacuccaugcu

SEQ ID NO: 1477650 - RNA, 20 nt, Homo sapiens
ccugcagggacuccaugcug

SEQ ID NO: 1477651 - RNA, 13 nt, Homo sapiens
ccugccaccuuca

SEQ ID NO: 1477652 - RNA, 13 nt, Homo sapiens
ccugccacucuca

SEQ ID NO: 1477653 - RNA, 13 nt, Homo sapiens
ccugccaggcaca

SEQ ID NO: 1477654 - RNA, 15 nt, Homo sapiens
ccugccaggcacaca

SEQ ID NO: 1477655 - RNA, 23 nt, Homo sapiens
ccugccauaauccuuuggaaaag

SEQ ID NO: 1477656 - RNA, 14 nt, Homo sapiens
ccugcccaaugaga

SEQ ID NO: 1477657 - RNA, 15 nt, Homo sapiens
ccugcccaugugucc

SEQ ID NO: 1477658 - RNA, 19 nt, Homo sapiens
ccugccccagauuuacuaa

SEQ ID NO: 1477659 - RNA, 16 nt, Homo sapiens
ccugccccugccccau

SEQ ID NO: 1477660 - RNA, 17 nt, Homo sapiens
ccugcccuucucaagac

SEQ ID NO: 1477661 - RNA, 23 nt, Homo sapiens
ccugccucccacuucacugcgaa

SEQ ID NO: 1477662 - RNA, 10 nt, Homo sapiens
ccugccugua

SEQ ID NO: 1477663 - RNA, 17 nt, Homo sapiens
ccugccuuuucauugcc

SEQ ID NO: 1477664 - RNA, 18 nt, Homo sapiens
ccugcgugggggccaguc

SEQ ID NO: 1477665 - RNA, 16 nt, Homo sapiens
ccugcucacaaaauca

SEQ ID NO: 1477666 - RNA, 20 nt, Homo sapiens
ccugcucacaguccucauuu

SEQ ID NO: 1477667 - RNA, 13 nt, Homo sapiens
ccugcucuugcag

SEQ ID NO: 1477668 - RNA, 22 nt, Homo sapiens
ccugcugaccucccagugaccc

SEQ ID NO: 1477669 - RNA, 16 nt, Homo sapiens
ccugcugccccagcug

SEQ ID NO: 1477670 - RNA, 18 nt, Homo sapiens
ccugcugccugcugagau

SEQ ID NO: 1477671 - RNA, 12 nt, Homo sapiens
ccugcugugauu

SEQ ID NO: 1477672 - RNA, 23 nt, Homo sapiens
ccugcuuagcugccuugagcuaa

SEQ ID NO: 1477673 - RNA, 23 nt, Homo sapiens
ccuggaaaagaagaaacuuugcc

SEQ ID NO: 1477674 - RNA, 13 nt, Homo sapiens
ccuggacugggag

SEQ ID NO: 1477675 - RNA, 20 nt, Homo sapiens
ccuggacugggagguagaua

SEQ ID NO: 1477676 - RNA, 20 nt, Homo sapiens
ccuggagaugcugccuggug

SEQ ID NO: 1477677 - RNA, 17 nt, Homo sapiens
ccuggagccuccacugc

SEQ ID NO: 1477678 - RNA, 18 nt, Homo sapiens
ccuggaggccgcagccaa

SEQ ID NO: 1477679 - RNA, 17 nt, Homo sapiens
ccuggagugcugugcug

SEQ ID NO: 1477680 - RNA, 14 nt, Homo sapiens
ccuggauccagcac

SEQ ID NO: 1477681 - RNA, 19 nt, Homo sapiens
ccuggaugucugggugacc

SEQ ID NO: 1477682 - RNA, 18 nt, Homo sapiens
ccuggauuccucacuuug

SEQ ID NO: 1477683 - RNA, 19 nt, Homo sapiens
ccuggauuccucacuuuga

SEQ ID NO: 1477684 - RNA, 18 nt, Homo sapiens
ccuggcaaaaaugcaaca

SEQ ID NO: 1477685 - RNA, 18 nt, Homo sapiens
ccuggcacuaacguugag

SEQ ID NO: 1477686 - RNA, 15 nt, Homo sapiens
ccuggcagcucugga

SEQ ID NO: 1477687 - RNA, 19 nt, Homo sapiens
ccuggcaggccagugucug

SEQ ID NO: 1477688 - RNA, 17 nt, Homo sapiens
ccuggcagggcccagug

SEQ ID NO: 1477689 - RNA, 20 nt, Homo sapiens
ccuggccaauacggcaaaac

SEQ ID NO: 1477690 - RNA, 17 nt, Homo sapiens
ccuggcccagaugauau

SEQ ID NO: 1477691 - RNA, 15 nt, Homo sapiens
ccuggccgaguccaa

SEQ ID NO: 1477692 - RNA, 15 nt, Homo sapiens
ccuggccgaugguac

SEQ ID NO: 1477693 - RNA, 21 nt, Homo sapiens
ccuggcuccaacacugcugcu

SEQ ID NO: 1477694 - RNA, 23 nt, Homo sapiens
cacucuuguggucaucauggcca

SEQ ID NO: 1477695 - RNA, 14 nt, Homo sapiens
cacugaaaauguca

SEQ ID NO: 1477696 - RNA, 19 nt, Homo sapiens
cacugaacuagugcagggu

SEQ ID NO: 1477697 - RNA, 13 nt, Homo sapiens
cacugaagcacca

SEQ ID NO: 1477698 - RNA, 23 nt, Homo sapiens
cacugaaugccucaaugugacca

SEQ ID NO: 1477699 - RNA, 20 nt, Homo sapiens
cacugcacagugcaucucag

SEQ ID NO: 1477700 - RNA, 13 nt, Homo sapiens
cacugcacccucc

SEQ ID NO: 1477701 - RNA, 23 nt, Homo sapiens
cacugcccucuuguggugcauug

SEQ ID NO: 1477702 - RNA, 14 nt, Homo sapiens
cacugcucaagaag

SEQ ID NO: 1477703 - RNA, 11 nt, Homo sapiens
cacugcuguac

SEQ ID NO: 1477704 - RNA, 18 nt, Homo sapiens
cacuggcacacugcucuu

SEQ ID NO: 1477705 - RNA, 22 nt, Homo sapiens
cacuggccccucaaaucgucca

SEQ ID NO: 1477706 - RNA, 22 nt, Homo sapiens
cacugggugguggccugguccc

SEQ ID NO: 1477707 - RNA, 13 nt, Homo sapiens
cacuggucuguag

SEQ ID NO: 1477708 - RNA, 23 nt, Homo sapiens
cacuguaaauaugaaucugcuca

SEQ ID NO: 1477709 - RNA, 13 nt, Homo sapiens
cacuguacuugua

SEQ ID NO: 1477710 - RNA, 15 nt, Homo sapiens
cacuguagucucgac

SEQ ID NO: 1477711 - RNA, 14 nt, Homo sapiens
cacugucacuuugc

SEQ ID NO: 1477712 - RNA, 14 nt, Homo sapiens
cacuguccugacca

SEQ ID NO: 1477713 - RNA, 15 nt, Homo sapiens
cacuguccugaccau

SEQ ID NO: 1477714 - RNA, 13 nt, Homo sapiens
cacugugcacugc

SEQ ID NO: 1477715 - RNA, 19 nt, Homo sapiens
cacuguguacaccucugga

SEQ ID NO: 1477716 - RNA, 19 nt, Homo sapiens
cacuguuaauauucuauua

SEQ ID NO: 1477717 - RNA, 18 nt, Homo sapiens
cacuguuaucuucacuuu

SEQ ID NO: 1477718 - RNA, 20 nt, Homo sapiens
cacuuaaaaaauguccauga

SEQ ID NO: 1477719 - RNA, 15 nt, Homo sapiens
cacuuaaccauucca

SEQ ID NO: 1477720 - RNA, 13 nt, Homo sapiens
cacuuacagaauu

SEQ ID NO: 1477721 - RNA, 20 nt, Homo sapiens
cacuuacagcucuggccaca

SEQ ID NO: 1477722 - RNA, 12 nt, Homo sapiens
cacuuacuauug

SEQ ID NO: 1477723 - RNA, 22 nt, Homo sapiens
cacuuacugguccuuaccagag

SEQ ID NO: 1477724 - RNA, 23 nt, Homo sapiens
cacuuauaagaaagaucaaagac

SEQ ID NO: 1477725 - RNA, 13 nt, Homo sapiens
cacuucauucaca

SEQ ID NO: 1477726 - RNA, 12 nt, Homo sapiens
cacuuccagggg

SEQ ID NO: 1477727 - RNA, 12 nt, Homo sapiens
cacuuccagugu

SEQ ID NO: 1477728 - RNA, 20 nt, Homo sapiens
cacuuccguagacuguuuag

SEQ ID NO: 1477729 - RNA, 13 nt, Homo sapiens
cacuugaccucau

SEQ ID NO: 1477730 - RNA, 15 nt, Homo sapiens
cacuugaugugccau

SEQ ID NO: 1477731 - RNA, 20 nt, Homo sapiens
cacuugcucccaacccauuc

SEQ ID NO: 1477732 - RNA, 16 nt, Homo sapiens
cacuugcugaggccaa

SEQ ID NO: 1477733 - RNA, 19 nt, Homo sapiens
cacuugggucuucccugua

SEQ ID NO: 1477734 - RNA, 20 nt, Homo sapiens
cacuugugugugggcuguga

SEQ ID NO: 1477735 - RNA, 22 nt, Homo sapiens
cacuuguucuguacuuguaaaa

SEQ ID NO: 1477736 - RNA, 18 nt, Homo sapiens
cacuuuaccucuguggac

SEQ ID NO: 1477737 - RNA, 17 nt, Homo sapiens
cacuuugagaagcugag

SEQ ID NO: 1477738 - RNA, 12 nt, Homo sapiens
cacuuugcucuc

SEQ ID NO: 1477739 - RNA, 21 nt, Homo sapiens
cacuuugcugccccaccaucu

SEQ ID NO: 1477740 - RNA, 16 nt, Homo sapiens
cagaaaaacucuggga

SEQ ID NO: 1477741 - RNA, 20 nt, Homo sapiens
cagaaaaacucugggaaaua

SEQ ID NO: 1477742 - RNA, 13 nt, Homo sapiens
cagaaaagcauac

SEQ ID NO: 1477743 - RNA, 15 nt, Homo sapiens
cagaaaagugccuga

SEQ ID NO: 1477744 - RNA, 23 nt, Homo sapiens
cagaaaauguugagaaucccaaa

SEQ ID NO: 1477745 - RNA, 20 nt, Homo sapiens
cagaaaccaguuaugugaau

SEQ ID NO: 1477746 - RNA, 17 nt, Homo sapiens
cagaaagcauccuaaau

SEQ ID NO: 1477747 - RNA, 20 nt, Homo sapiens
cagaaagccugggugacauu

SEQ ID NO: 1477748 - RNA, 15 nt, Homo sapiens
cagaaauauaugcag

SEQ ID NO: 1477749 - RNA, 21 nt, Homo sapiens
cagaaaucuagaagacuguca

SEQ ID NO: 1477750 - RNA, 22 nt, Homo sapiens
cagaaauuuaucuuucaaagag

SEQ ID NO: 1477751 - RNA, 15 nt, Homo sapiens
cagaacaacacuucc

SEQ ID NO: 1477752 - RNA, 18 nt, Homo sapiens
cagaacacccaauucaaa

SEQ ID NO: 1477753 - RNA, 16 nt, Homo sapiens
cagaacauauguugca

SEQ ID NO: 1477754 - RNA, 23 nt, Homo sapiens
cagaacucugccugcccuuuguc

SEQ ID NO: 1477755 - RNA, 15 nt, Homo sapiens
cagaacuugaagggu

SEQ ID NO: 1477756 - RNA, 14 nt, Homo sapiens
cagaacuugaaugu

SEQ ID NO: 1477757 - RNA, 15 nt, Homo sapiens
cagaagaaaagcaaa

SEQ ID NO: 1477758 - RNA, 14 nt, Homo sapiens
cagaagaacugugu

SEQ ID NO: 1477759 - RNA, 14 nt, Homo sapiens
cagaagacacugca

SEQ ID NO: 1477760 - RNA, 22 nt, Homo sapiens
cagaagauaacuugagcaccgu

SEQ ID NO: 1477761 - RNA, 14 nt, Homo sapiens
cagaagaucugaaa

SEQ ID NO: 1477762 - RNA, 19 nt, Homo sapiens
cagaagaugccagcuucuc

SEQ ID NO: 1477763 - RNA, 18 nt, Homo sapiens
cagaagccugaugcugac

SEQ ID NO: 1477764 - RNA, 14 nt, Homo sapiens
cagaagguauuccu

SEQ ID NO: 1477765 - RNA, 15 nt, Homo sapiens
cagaaguaauuugaa

SEQ ID NO: 1477766 - RNA, 19 nt, Homo sapiens
cagaaguccccucuacuuu

SEQ ID NO: 1477767 - RNA, 21 nt, Homo sapiens
cagaaguuugcaaauaggcag

SEQ ID NO: 1477768 - RNA, 21 nt, Homo sapiens
cagaauaauggaaacauuaca

SEQ ID NO: 1477769 - RNA, 14 nt, Homo sapiens
cagaauagcacaaa

SEQ ID NO: 1477770 - RNA, 17 nt, Homo sapiens
cagaauauaauucccaa

SEQ ID NO: 1477771 - RNA, 14 nt, Homo sapiens
cagaaucagaauca

SEQ ID NO: 1477772 - RNA, 20 nt, Homo sapiens
cagaauucucagaaucucaa

SEQ ID NO: 1477773 - RNA, 12 nt, Homo sapiens
cagacaacagaa

SEQ ID NO: 1477774 - RNA, 13 nt, Homo sapiens
cagacaauuccau

SEQ ID NO: 1477775 - RNA, 14 nt, Homo sapiens
cagacacccaggac

SEQ ID NO: 1477776 - RNA, 21 nt, Homo sapiens
cagacacuggcguuacugcuu

SEQ ID NO: 1477777 - RNA, 19 nt, Homo sapiens
cagacagaagucuccucaa

SEQ ID NO: 1477778 - RNA, 22 nt, Homo sapiens
cagacaggaggaaucaugucag

SEQ ID NO: 1477779 - RNA, 13 nt, Homo sapiens
cagacagucacac

SEQ ID NO: 1477780 - RNA, 22 nt, Homo sapiens
cagacauacauuuaugcacauu

SEQ ID NO: 1477781 - RNA, 21 nt, Homo sapiens
cagacaucggccuccaugacc

SEQ ID NO: 1477782 - RNA, 13 nt, Homo sapiens
cagacaugccaca

SEQ ID NO: 1477783 - RNA, 16 nt, Homo sapiens
cagaccacggcucgau

SEQ ID NO: 1477784 - RNA, 22 nt, Homo sapiens
cagaccaguuucagagaaauac

SEQ ID NO: 1477785 - RNA, 23 nt, Homo sapiens
cagacccccccauuucccgcaca

SEQ ID NO: 1477786 - RNA, 17 nt, Homo sapiens
cagaccccuagggauuu

SEQ ID NO: 1477787 - RNA, 13 nt, Homo sapiens
cagacguugccug

SEQ ID NO: 1477788 - RNA, 19 nt, Homo sapiens
cagacuaagaaauauucca

SEQ ID NO: 1477789 - RNA, 13 nt, Homo sapiens
cagcccugcugca

SEQ ID NO: 1477790 - RNA, 18 nt, Homo sapiens
cagcccugucacgccggg

SEQ ID NO: 1477791 - RNA, 23 nt, Homo sapiens
cagccgccagcugggagcacugg

SEQ ID NO: 1477792 - RNA, 18 nt, Homo sapiens
cagccgccuuaagcugau

SEQ ID NO: 1477793 - RNA, 23 nt, Homo sapiens
cagccucacuugaaugugucacu

SEQ ID NO: 1477794 - RNA, 19 nt, Homo sapiens
cagccucccaaguagcuga

SEQ ID NO: 1477795 - RNA, 19 nt, Homo sapiens
cagccuccccgugccaaaa

SEQ ID NO: 1477796 - RNA, 14 nt, Homo sapiens
cagccucccugaag

SEQ ID NO: 1477797 - RNA, 19 nt, Homo sapiens
gccaaccggucacccagga

SEQ ID NO: 1477798 - RNA, 15 nt, Homo sapiens
gccaacuuguaaaua

SEQ ID NO: 1477799 - RNA, 17 nt, Homo sapiens
gccaagaauacuugaag

SEQ ID NO: 1477800 - RNA, 17 nt, Homo sapiens
gccaagcugguccuggg

SEQ ID NO: 1477801 - RNA, 20 nt, Homo sapiens
gccaaggaaacccccagugu

SEQ ID NO: 1477802 - RNA, 14 nt, Homo sapiens
gccaagguccugcu

SEQ ID NO: 1477803 - RNA, 18 nt, Homo sapiens
gccaaguaagaaagugaa

SEQ ID NO: 1477804 - RNA, 15 nt, Homo sapiens
gccaagucauagcca

SEQ ID NO: 1477805 - RNA, 17 nt, Homo sapiens
gccaagugugaccccac

SEQ ID NO: 1477806 - RNA, 18 nt, Homo sapiens
gccaauaauaaaugcccu

SEQ ID NO: 1477807 - RNA, 11 nt, Homo sapiens
gccaaucucaa

SEQ ID NO: 1477808 - RNA, 21 nt, Homo sapiens
gccaaucuggcccuuacacac

SEQ ID NO: 1477809 - RNA, 18 nt, Homo sapiens
gccaauggagacugucuc

SEQ ID NO: 1477810 - RNA, 14 nt, Homo sapiens
gccacaacccuguu

SEQ ID NO: 1477811 - RNA, 22 nt, Homo sapiens
gccacacucagcacaaggccau

SEQ ID NO: 1477812 - RNA, 18 nt, Homo sapiens
gccacaguccuucuuuga

SEQ ID NO: 1477813 - RNA, 16 nt, Homo sapiens
gccacaucccuuugaa

SEQ ID NO: 1477814 - RNA, 19 nt, Homo sapiens
gccacauggccccauccca

SEQ ID NO: 1477815 - RNA, 20 nt, Homo sapiens
gccacauggccccaucccag

SEQ ID NO: 1477816 - RNA, 12 nt, Homo sapiens
gccaccaguguc

SEQ ID NO: 1477817 - RNA, 14 nt, Homo sapiens
gccaccaguguccu

SEQ ID NO: 1477818 - RNA, 20 nt, Homo sapiens
gccacccaggaacuccugac

SEQ ID NO: 1477819 - RNA, 22 nt, Homo sapiens
gccacccaggcuggagugcagu

SEQ ID NO: 1477820 - RNA, 14 nt, Homo sapiens
gccaccgcacucca

SEQ ID NO: 1477821 - RNA, 24 nt, Homo sapiens
gccaccgggacagaccuggacacu

SEQ ID NO: 1477822 - RNA, 13 nt, Homo sapiens
gccaccucagggc

SEQ ID NO: 1477823 - RNA, 19 nt, Homo sapiens
gccaccucucccucaacaa

SEQ ID NO: 1477824 - RNA, 23 nt, Homo sapiens
gccacgcacugggccacggagga

SEQ ID NO: 1477825 - RNA, 24 nt, Homo sapiens
gccacguaugguggcucaugucua

SEQ ID NO: 1477826 - RNA, 21 nt, Homo sapiens
gccacucaggaggcugaggca

SEQ ID NO: 1477827 - RNA, 14 nt, Homo sapiens
gccacucuccccau

SEQ ID NO: 1477828 - RNA, 22 nt, Homo sapiens
gccacugagaagugcacuuuaa

SEQ ID NO: 1477829 - RNA, 22 nt, Homo sapiens
gccagaaagcauaaaauucuua

SEQ ID NO: 1477830 - RNA, 15 nt, Homo sapiens
gccagacaugccaca

SEQ ID NO: 1477831 - RNA, 14 nt, Homo sapiens
gccagcaaugacau

SEQ ID NO: 1477832 - RNA, 16 nt, Homo sapiens
gccagccagugccauu

SEQ ID NO: 1477833 - RNA, 14 nt, Homo sapiens
gccagccccacaca

SEQ ID NO: 1477834 - RNA, 17 nt, Homo sapiens
gccagccgugaugcuca

SEQ ID NO: 1477835 - RNA, 15 nt, Homo sapiens
gccagcugcacugau

SEQ ID NO: 1477836 - RNA, 16 nt, Homo sapiens
gccagcugugcacuuu

SEQ ID NO: 1477837 - RNA, 14 nt, Homo sapiens
uggauaacuuuaca

SEQ ID NO: 1477838 - RNA, 21 nt, Homo sapiens
uggaucagggaauccagcucc

SEQ ID NO: 1477839 - RNA, 20 nt, Homo sapiens
uggaucaguccuuugaucag

SEQ ID NO: 1477840 - RNA, 19 nt, Homo sapiens
uggauccagccaugccuga

SEQ ID NO: 1477841 - RNA, 23 nt, Homo sapiens
uggauccugggucaaaaaaaaga

SEQ ID NO: 1477842 - RNA, 13 nt, Homo sapiens
uggaucuugccac

SEQ ID NO: 1477843 - RNA, 22 nt, Homo sapiens
uggaucuuggagaaugugagaa

SEQ ID NO: 1477844 - RNA, 15 nt, Homo sapiens
uggaugaggagacag

SEQ ID NO: 1477845 - RNA, 13 nt, Homo sapiens
uggaugauucaga

SEQ ID NO: 1477846 - RNA, 17 nt, Homo sapiens
uggaugcgcagugccuu

SEQ ID NO: 1477847 - RNA, 20 nt, Homo sapiens
uggaugcugugaagagucua

SEQ ID NO: 1477848 - RNA, 21 nt, Homo sapiens
uggaugggagugggcaccuca

SEQ ID NO: 1477849 - RNA, 17 nt, Homo sapiens
uggauggggcuuccagc

SEQ ID NO: 1477850 - RNA, 14 nt, Homo sapiens
uggauuauucauuu

SEQ ID NO: 1477851 - RNA, 18 nt, Homo sapiens
uggauucaucagcauuug

SEQ ID NO: 1477852 - RNA, 16 nt, Homo sapiens
uggauuccacacugca

SEQ ID NO: 1477853 - RNA, 20 nt, Homo sapiens
uggauucuucccacacagaa

SEQ ID NO: 1477854 - RNA, 17 nt, Homo sapiens
uggauuguuuauacucc

SEQ ID NO: 1477855 - RNA, 14 nt, Homo sapiens
uggauuugauucau

SEQ ID NO: 1477856 - RNA, 23 nt, Homo sapiens
uggauuugcaggugaacagccuc

SEQ ID NO: 1477857 - RNA, 24 nt, Homo sapiens
uggauuugcaggugaacagccucc

SEQ ID NO: 1477858 - RNA, 22 nt, Homo sapiens
uggcaaaaaggagccuuuugcu

SEQ ID NO: 1477859 - RNA, 17 nt, Homo sapiens
uggcaaacauuuuucca

SEQ ID NO: 1477860 - RNA, 21 nt, Homo sapiens
uggcaacagagcaagacucca

SEQ ID NO: 1477861 - RNA, 16 nt, Homo sapiens
uggcaagucacaugcg

SEQ ID NO: 1477862 - RNA, 19 nt, Homo sapiens
uggcaagucuagagucuca

SEQ ID NO: 1477863 - RNA, 20 nt, Homo sapiens
uggcaauuuaacauguguau

SEQ ID NO: 1477864 - RNA, 15 nt, Homo sapiens
uggcaccacugcacu

SEQ ID NO: 1477865 - RNA, 15 nt, Homo sapiens
uggcaccagaugcaa

SEQ ID NO: 1477866 - RNA, 17 nt, Homo sapiens
uggcaccugcacacucc

SEQ ID NO: 1477867 - RNA, 21 nt, Homo sapiens
uggcaccuguagucccagcua

SEQ ID NO: 1477868 - RNA, 21 nt, Homo sapiens
uggcacuaaagaauacauuua

SEQ ID NO: 1477869 - RNA, 17 nt, Homo sapiens
ugggagggaaaagggaa

SEQ ID NO: 1477870 - RNA, 19 nt, Homo sapiens
ugggagggagguaacgggu

SEQ ID NO: 1477871 - RNA, 21 nt, Homo sapiens
ugggagggggcuugaagccaa

SEQ ID NO: 1477872 - RNA, 15 nt, Homo sapiens
ugggagucacacagu

SEQ ID NO: 1477873 - RNA, 17 nt, Homo sapiens
ugggagucacacagugu

SEQ ID NO: 1477874 - RNA, 23 nt, Homo sapiens
ugggauaucacuuccaugacaua

SEQ ID NO: 1477875 - RNA, 14 nt, Homo sapiens
ugggauauucccaa

SEQ ID NO: 1477876 - RNA, 15 nt, Homo sapiens
ugggaucaaauaacu

SEQ ID NO: 1477877 - RNA, 13 nt, Homo sapiens
ugggaugagaaaa

SEQ ID NO: 1477878 - RNA, 14 nt, Homo sapiens
ugggauggggacau

SEQ ID NO: 1477879 - RNA, 17 nt, Homo sapiens
ugggauguucagcacug

SEQ ID NO: 1477880 - RNA, 20 nt, Homo sapiens
ugggauuaugccaaggccgu

SEQ ID NO: 1477881 - RNA, 12 nt, Homo sapiens
ugggauucccac

SEQ ID NO: 1477882 - RNA, 16 nt, Homo sapiens
ugggauuuaauuucca

SEQ ID NO: 1477883 - RNA, 16 nt, Homo sapiens
ugggcaaacaggcagu

SEQ ID NO: 1477884 - RNA, 19 nt, Homo sapiens
ugggcaacaagagcaaaac

SEQ ID NO: 1477885 - RNA, 13 nt, Homo sapiens
ugggcacuggccc

SEQ ID NO: 1477886 - RNA, 14 nt, Homo sapiens
ugggccacagccau

SEQ ID NO: 1477887 - RNA, 20 nt, Homo sapiens
ugggccagugaacaggguaa

SEQ ID NO: 1477888 - RNA, 15 nt, Homo sapiens
ugggccauguccaaa

SEQ ID NO: 1477889 - RNA, 18 nt, Homo sapiens
ugggccauguccaaagag

SEQ ID NO: 1477890 - RNA, 14 nt, Homo sapiens
ugggccugcuccag

SEQ ID NO: 1477891 - RNA, 15 nt, Homo sapiens
ugggccugugaauca

SEQ ID NO: 1477892 - RNA, 23 nt, Homo sapiens
ugggcuauugcugcugccccuua

SEQ ID NO: 1477893 - RNA, 12 nt, Homo sapiens
ugggcucaggga

SEQ ID NO: 1477894 - RNA, 18 nt, Homo sapiens
ugggcuccuccagggugu

SEQ ID NO: 1477895 - RNA, 13 nt, Homo sapiens
ugggcucuuccaa

SEQ ID NO: 1477896 - RNA, 23 nt, Homo sapiens
ugggcuguaacguggcacuggua

SEQ ID NO: 1477897 - RNA, 19 nt, Homo sapiens
uggggaacugcguggugcu

SEQ ID NO: 1477898 - RNA, 23 nt, Homo sapiens
uggggaacugcguggugcucuuu

SEQ ID NO: 1477899 - RNA, 17 nt, Homo sapiens
uggggagcccgucucag

SEQ ID NO: 1477900 - RNA, 16 nt, Homo sapiens
uggggcacuugcugag

SEQ ID NO: 1477901 - RNA, 17 nt, Homo sapiens
ucacaaauaaaagccaa

SEQ ID NO: 1477902 - RNA, 23 nt, Homo sapiens
ucacaaaugaucgcuaucuagca

SEQ ID NO: 1477903 - RNA, 13 nt, Homo sapiens
ucacaaauggaau

SEQ ID NO: 1477904 - RNA, 20 nt, Homo sapiens
ucacaacauuuacuuaacag

SEQ ID NO: 1477905 - RNA, 20 nt, Homo sapiens
ucacaauaccucaugcuuca

SEQ ID NO: 1477906 - RNA, 19 nt, Homo sapiens
ucacacaugccuauauuau

SEQ ID NO: 1477907 - RNA, 12 nt, Homo sapiens
ucacacauucag

SEQ ID NO: 1477908 - RNA, 24 nt, Homo sapiens
ucacacugguuuggucaguuacaa

SEQ ID NO: 1477909 - RNA, 17 nt, Homo sapiens
ucacagaguagaaacuc

SEQ ID NO: 1477910 - RNA, 15 nt, Homo sapiens
ucacagagugcauug

SEQ ID NO: 1477911 - RNA, 12 nt, Homo sapiens
ucacagggccaa

SEQ ID NO: 1477912 - RNA, 18 nt, Homo sapiens
ucacaguacagcaugugc

SEQ ID NO: 1477913 - RNA, 11 nt, Homo sapiens
ucacagugcau

SEQ ID NO: 1477914 - RNA, 19 nt, Homo sapiens
ucacaguuagguagcuuua

SEQ ID NO: 1477915 - RNA, 23 nt, Homo sapiens
ucacaguucuuugggccagacau

SEQ ID NO: 1477916 - RNA, 13 nt, Homo sapiens
ucacaucugucac

SEQ ID NO: 1477917 - RNA, 18 nt, Homo sapiens
ucacaugagcuauuucca

SEQ ID NO: 1477918 - RNA, 16 nt, Homo sapiens
ucacauugcauucuau

SEQ ID NO: 1477919 - RNA, 14 nt, Homo sapiens
ucacauugugccuu

SEQ ID NO: 1477920 - RNA, 19 nt, Homo sapiens
ucacauuguuugcugcuau

SEQ ID NO: 1477921 - RNA, 19 nt, Homo sapiens
ucacauuuaccauaauuua

SEQ ID NO: 1477922 - RNA, 10 nt, Homo sapiens
ucaccacugu

SEQ ID NO: 1477923 - RNA, 21 nt, Homo sapiens
ucaccaggagcccggcuucca

SEQ ID NO: 1477924 - RNA, 12 nt, Homo sapiens
ucaccagugucc

SEQ ID NO: 1477925 - RNA, 15 nt, Homo sapiens
ucaccaucaacauuc

SEQ ID NO: 1477926 - RNA, 13 nt, Homo sapiens
ucaccauguugcc

SEQ ID NO: 1477927 - RNA, 21 nt, Homo sapiens
ucacccagcuaaucuguaggg

SEQ ID NO: 1477928 - RNA, 16 nt, Homo sapiens
ucaccgcauggacaag

SEQ ID NO: 1477929 - RNA, 14 nt, Homo sapiens
ucaccuaacuagag

SEQ ID NO: 1477930 - RNA, 16 nt, Homo sapiens
ucaccuacauuaucuc

SEQ ID NO: 1477931 - RNA, 18 nt, Homo sapiens
ucaccuacauuaucucac

SEQ ID NO: 1477932 - RNA, 14 nt, Homo sapiens
ucaccucuccaggu

SEQ ID NO: 1477933 - RNA, 14 nt, Homo sapiens
ucaccucuugccuu

SEQ ID NO: 1477934 - RNA, 18 nt, Homo sapiens
ucaccuuggcaccagaca

SEQ ID NO: 1477935 - RNA, 15 nt, Homo sapiens
ucacgcagugcuuuc

SEQ ID NO: 1477936 - RNA, 17 nt, Homo sapiens
ucacguuuccuuuucau

SEQ ID NO: 1477937 - RNA, 17 nt, Homo sapiens
ucacuacccuauucucu

SEQ ID NO: 1477938 - RNA, 15 nt, Homo sapiens
ucacuaugacacuga

SEQ ID NO: 1477939 - RNA, 17 nt, Homo sapiens
ucacuaugacacugagc

SEQ ID NO: 1477940 - RNA, 15 nt, Homo sapiens
ucacuaugguaugcu

SEQ ID NO: 1477941 - RNA, 15 nt, Homo sapiens
ucacucauccauccc

SEQ ID NO: 1477942 - RNA, 16 nt, Homo sapiens
ucacucccaccugcau

SEQ ID NO: 1477943 - RNA, 14 nt, Homo sapiens
ucacucccagucca

SEQ ID NO: 1477944 - RNA, 13 nt, Homo sapiens
ucacugaacucca

SEQ ID NO: 1477945 - RNA, 22 nt, Homo sapiens
ucacugacucaagacacugaga

SEQ ID NO: 1477946 - RNA, 14 nt, Homo sapiens
ucacugagaagauu

SEQ ID NO: 1477947 - RNA, 18 nt, Homo sapiens
ucacugagaagauuguga

SEQ ID NO: 1477948 - RNA, 22 nt, Homo sapiens
ucacugagaagauugugaauau

SEQ ID NO: 1477949 - RNA, 18 nt, Homo sapiens
ucacugauauauuuucca

SEQ ID NO: 1477950 - RNA, 12 nt, Homo sapiens
ucacugcaauuu

SEQ ID NO: 1477951 - RNA, 13 nt, Homo sapiens
ucacugcugucaa

SEQ ID NO: 1477952 - RNA, 14 nt, Homo sapiens
ucacuguacuugua

SEQ ID NO: 1477953 - RNA, 15 nt, Homo sapiens
ucacuguauaaacuu

SEQ ID NO: 1477954 - RNA, 22 nt, Homo sapiens
ucacugucuuuaauucuguauc

SEQ ID NO: 1477955 - RNA, 16 nt, Homo sapiens
ucacuguuucucugcu

SEQ ID NO: 1477956 - RNA, 15 nt, Homo sapiens
ucacuucaccaucaa

SEQ ID NO: 1477957 - RNA, 15 nt, Homo sapiens
ucacuuccccacagg

SEQ ID NO: 1477958 - RNA, 18 nt, Homo sapiens
ucacuucccuacauggag

SEQ ID NO: 1477959 - RNA, 13 nt, Homo sapiens
ucacuuccuacaa

SEQ ID NO: 1477960 - RNA, 18 nt, Homo sapiens
ucacuucgggcuguguaa

SEQ ID NO: 1477961 - RNA, 17 nt, Homo sapiens
ucacuucugacucuucc

SEQ ID NO: 1477962 - RNA, 23 nt, Homo sapiens
aggccaagcauuucuagcaguga

SEQ ID NO: 1477963 - RNA, 16 nt, Homo sapiens
aggccaccaggcugaa

SEQ ID NO: 1477964 - RNA, 17 nt, Homo sapiens
aggccaguaugauuuau

SEQ ID NO: 1477965 - RNA, 14 nt, Homo sapiens
aggccagugccagc

SEQ ID NO: 1477966 - RNA, 13 nt, Homo sapiens
aggccagugucug

SEQ ID NO: 1477967 - RNA, 22 nt, Homo sapiens
aggccagugugccgaccucucu

SEQ ID NO: 1477968 - RNA, 14 nt, Homo sapiens
aggccagugugucu

SEQ ID NO: 1477969 - RNA, 21 nt, Homo sapiens
aggccauugggauauucugaa

SEQ ID NO: 1477970 - RNA, 20 nt, Homo sapiens
aggcccaagagcagagucug

SEQ ID NO: 1477971 - RNA, 15 nt, Homo sapiens
aggcccacuguaaua

SEQ ID NO: 1477972 - RNA, 22 nt, Homo sapiens
aggcccagggagggaaguguga

SEQ ID NO: 1477973 - RNA, 15 nt, Homo sapiens
aggcccccaguggga

SEQ ID NO: 1477974 - RNA, 14 nt, Homo sapiens
aggcccgcaccgcu

SEQ ID NO: 1477975 - RNA, 16 nt, Homo sapiens
aggcccgcaccgcugg

SEQ ID NO: 1477976 - RNA, 15 nt, Homo sapiens
aggcccgcucuacau

SEQ ID NO: 1477977 - RNA, 10 nt, Homo sapiens
aggcccuccc

SEQ ID NO: 1477978 - RNA, 17 nt, Homo sapiens
aggcccugcccaaugag

SEQ ID NO: 1477979 - RNA, 19 nt, Homo sapiens
aggcccugcuccugcagca

SEQ ID NO: 1477980 - RNA, 20 nt, Homo sapiens
aggcccugcugcccaaucuc

SEQ ID NO: 1477981 - RNA, 23 nt, Homo sapiens
aggcccuuccucuccacugccuu

SEQ ID NO: 1477982 - RNA, 21 nt, Homo sapiens
aggccgagagcagacaccagc

SEQ ID NO: 1477983 - RNA, 20 nt, Homo sapiens
aggccggaugcgguggcuca

SEQ ID NO: 1477984 - RNA, 15 nt, Homo sapiens
aggccgugugucugu

SEQ ID NO: 1477985 - RNA, 18 nt, Homo sapiens
aggccgugugucugucag

SEQ ID NO: 1477986 - RNA, 16 nt, Homo sapiens
aggccucaagaacaaa

SEQ ID NO: 1477987 - RNA, 22 nt, Homo sapiens
aggccucaagaacaaacacugc

SEQ ID NO: 1477988 - RNA, 19 nt, Homo sapiens
aggccucuccaguuugcac

SEQ ID NO: 1477989 - RNA, 22 nt, Homo sapiens
aggccucuccaguuugcaccug

SEQ ID NO: 1477990 - RNA, 19 nt, Homo sapiens
aggcgagagaggagccaga

SEQ ID NO: 1477991 - RNA, 22 nt, Homo sapiens
aggcgauccaccugucucagcc

SEQ ID NO: 1477992 - RNA, 16 nt, Homo sapiens
aggcgcacagugugag

SEQ ID NO: 1477993 - RNA, 20 nt, Homo sapiens
aggcggguggaucacuugag

SEQ ID NO: 1477994 - RNA, 13 nt, Homo sapiens
aggcuaaaugcac

SEQ ID NO: 1477995 - RNA, 15 nt, Homo sapiens
aggcuaaggcaggaa

SEQ ID NO: 1477996 - RNA, 13 nt, Homo sapiens
aggcuaccucaag

SEQ ID NO: 1477997 - RNA, 16 nt, Homo sapiens
aggcucagagacugca

SEQ ID NO: 1477998 - RNA, 15 nt, Homo sapiens
aggcuccugccugag

SEQ ID NO: 1477999 - RNA, 12 nt, Homo sapiens
aggcucuucucc

SEQ ID NO: 1478000 - RNA, 17 nt, Homo sapiens
aggcugaggcaggagaa

SEQ ID NO: 1478001 - RNA, 22 nt, Homo sapiens
aggcugaggccuggacuuuccu

SEQ ID NO: 1478002 - RNA, 19 nt, Homo sapiens
aggcugagugagccacaga

SEQ ID NO: 1478003 - RNA, 15 nt, Homo sapiens
aggcugcacagcuca

SEQ ID NO: 1478004 - RNA, 20 nt, Homo sapiens
aggcugcauugagcuaugau

SEQ ID NO: 1478005 - RNA, 19 nt, Homo sapiens
aggcugccccucucaccaa

SEQ ID NO: 1478006 - RNA, 19 nt, Homo sapiens
aggcugcgacugaugaagg

SEQ ID NO: 1478007 - RNA, 20 nt, Homo sapiens
aggcugcgacugaugaaggc

SEQ ID NO: 1478008 - RNA, 15 nt, Homo sapiens
aggcuggagugcagu

SEQ ID NO: 1478009 - RNA, 20 nt, Homo sapiens
aggcuggagugcaguggcau

SEQ ID NO: 1478010 - RNA, 20 nt, Homo sapiens
aggcuggagugcaguggugu

SEQ ID NO: 1478011 - RNA, 18 nt, Homo sapiens
aggcuggcuccagaugca

SEQ ID NO: 1478012 - RNA, 20 nt, Homo sapiens
aggcuggcuccagaugcagg

SEQ ID NO: 1478013 - RNA, 12 nt, Homo sapiens
aggcugggagac

SEQ ID NO: 1478014 - RNA, 16 nt, Homo sapiens
aggcugggccaugucc

SEQ ID NO: 1478015 - RNA, 17 nt, Homo sapiens
aggcugggccaugucca

SEQ ID NO: 1478016 - RNA, 15 nt, Homo sapiens
aggcugucacagucc

SEQ ID NO: 1478017 - RNA, 16 nt, Homo sapiens
aggcuguccuguacau

SEQ ID NO: 1478018 - RNA, 10 nt, Homo sapiens
aggcuuccug

SEQ ID NO: 1478019 - RNA, 22 nt, Homo sapiens
aggcuuucaagaagugccaguu

SEQ ID NO: 1478020 - RNA, 20 nt, Homo sapiens
aggcuuuguacagagugcuu

SEQ ID NO: 1478021 - RNA, 22 nt, Homo sapiens
agggaaagugcauaugaaaucc

SEQ ID NO: 1478022 - RNA, 21 nt, Homo sapiens
agggaacccugcuugcacuuu

SEQ ID NO: 1478023 - RNA, 17 nt, Homo sapiens
agggaacgguccaugaa

SEQ ID NO: 1478024 - RNA, 20 nt, Homo sapiens
agggaagaaugaacacuccc

SEQ ID NO: 1478025 - RNA, 20 nt, Homo sapiens
agggaagagugcauuuuccc

SEQ ID NO: 1478026 - RNA, 13 nt, Homo sapiens
agggaagccaaaa

SEQ ID NO: 1478027 - RNA, 22 nt, Homo sapiens
agggaagcugucccucacuguu

SEQ ID NO: 1478028 - RNA, 20 nt, Homo sapiens
agggaaguaguccuuggcau

SEQ ID NO: 1478029 - RNA, 23 nt, Homo sapiens
agggaagugugagcgccuuggua

SEQ ID NO: 1478030 - RNA, 16 nt, Homo sapiens
agggaauccagccaug

SEQ ID NO: 1478031 - RNA, 17 nt, Homo sapiens
agggaauccagccauga

SEQ ID NO: 1478032 - RNA, 14 nt, Homo sapiens
agggacuccaugcu

SEQ ID NO: 1478033 - RNA, 12 nt, Homo sapiens
agggacucccac

SEQ ID NO: 1478034 - RNA, 15 nt, Homo sapiens
agggagaacuugaaa

SEQ ID NO: 1478035 - RNA, 15 nt, Homo sapiens
agggagaagcaugaa

SEQ ID NO: 1478036 - RNA, 12 nt, Homo sapiens
agggaggcucag

SEQ ID NO: 1478037 - RNA, 16 nt, Homo sapiens
agggagguaacgggug

SEQ ID NO: 1478038 - RNA, 16 nt, Homo sapiens
agggaggucacuggaa

SEQ ID NO: 1478039 - RNA, 17 nt, Homo sapiens
agggauccguacauuca

SEQ ID NO: 1478040 - RNA, 15 nt, Homo sapiens
agggcaagaucucag

SEQ ID NO: 1478041 - RNA, 15 nt, Homo sapiens
agggcauguguaugu

SEQ ID NO: 1478042 - RNA, 21 nt, Homo sapiens
agggcauucgggccacagggc

SEQ ID NO: 1478043 - RNA, 21 nt, Homo sapiens
agggccagagggagcuggaac

SEQ ID NO: 1478044 - RNA, 16 nt, Homo sapiens
agggcccccaucucau

SEQ ID NO: 1478045 - RNA, 17 nt, Homo sapiens
agggcccuccgaccacu

SEQ ID NO: 1478046 - RNA, 19 nt, Homo sapiens
agggcgccuacucuucagg

SEQ ID NO: 1478047 - RNA, 14 nt, Homo sapiens
agggcgcucagacg

SEQ ID NO: 1478048 - RNA, 18 nt, Homo sapiens
agggcgggcagagggcug

SEQ ID NO: 1478049 - RNA, 13 nt, Homo sapiens
acccccaacuccu

SEQ ID NO: 1478050 - RNA, 17 nt, Homo sapiens
acccccaccauccaggu

SEQ ID NO: 1478051 - RNA, 16 nt, Homo sapiens
acccccagcacagggg

SEQ ID NO: 1478052 - RNA, 14 nt, Homo sapiens
acccccagcacuug

SEQ ID NO: 1478053 - RNA, 15 nt, Homo sapiens
accccccuaccacac

SEQ ID NO: 1478054 - RNA, 13 nt, Homo sapiens
acccccugcccug

SEQ ID NO: 1478055 - RNA, 21 nt, Homo sapiens
acccccugcuccaccagcagc

SEQ ID NO: 1478056 - RNA, 18 nt, Homo sapiens
accccgagaagugcucuu

SEQ ID NO: 1478057 - RNA, 20 nt, Homo sapiens
accccggggacccugugaca

SEQ ID NO: 1478058 - RNA, 21 nt, Homo sapiens
accccgucgaggggcucucag

SEQ ID NO: 1478059 - RNA, 13 nt, Homo sapiens
accccuacacaca

SEQ ID NO: 1478060 - RNA, 18 nt, Homo sapiens
accccuacacacacacuc

SEQ ID NO: 1478061 - RNA, 18 nt, Homo sapiens
accccuagccaccagugu

SEQ ID NO: 1478062 - RNA, 14 nt, Homo sapiens
accccugcacaguu

SEQ ID NO: 1478063 - RNA, 19 nt, Homo sapiens
accccugccuuuucauugc

SEQ ID NO: 1478064 - RNA, 17 nt, Homo sapiens
accccugcucuacccau

SEQ ID NO: 1478065 - RNA, 16 nt, Homo sapiens
agcuuugcugccugag

SEQ ID NO: 1478066 - RNA, 23 nt, Homo sapiens
agcuuugugcuugucauuccaga

SEQ ID NO: 1478067 - RNA, 18 nt, Homo sapiens
agcuuuuaaaaauguccu

SEQ ID NO: 1478068 - RNA, 20 nt, Homo sapiens
agcuuuuagaaauacugcaa

SEQ ID NO: 1478069 - RNA, 15 nt, Homo sapiens
aggaaaaaaaugacu

SEQ ID NO: 1478070 - RNA, 20 nt, Homo sapiens
aggaaaaaacuaguauuccc

SEQ ID NO: 1478071 - RNA, 18 nt, Homo sapiens
aggaaaagcaaauugaug

SEQ ID NO: 1478072 - RNA, 13 nt, Homo sapiens
aggaaaaugccuc

SEQ ID NO: 1478073 - RNA, 18 nt, Homo sapiens
aggaaacccccaguguaa

SEQ ID NO: 1478074 - RNA, 22 nt, Homo sapiens
aggaaacccccaguguaauaau

SEQ ID NO: 1478075 - RNA, 13 nt, Homo sapiens
aggaaagcaauaa

SEQ ID NO: 1478076 - RNA, 23 nt, Homo sapiens
aggaaauccauucacaguucuuu

SEQ ID NO: 1478077 - RNA, 17 nt, Homo sapiens
aggaacaaauaaacuca

SEQ ID NO: 1478078 - RNA, 14 nt, Homo sapiens
aggaacacugcacu

SEQ ID NO: 1478079 - RNA, 16 nt, Homo sapiens
aggaacacugcacucu

SEQ ID NO: 1478080 - RNA, 15 nt, Homo sapiens
aggaacagcacuggg

SEQ ID NO: 1478081 - RNA, 19 nt, Homo sapiens
aggaacucgcaccugugcu

SEQ ID NO: 1478082 - RNA, 12 nt, Homo sapiens
aggaacucuggc

SEQ ID NO: 1478083 - RNA, 18 nt, Homo sapiens
aggaagaagauagaucca

SEQ ID NO: 1478084 - RNA, 14 nt, Homo sapiens
aggaagauauacau

SEQ ID NO: 1478085 - RNA, 14 nt, Homo sapiens
aggaagcauucaga

SEQ ID NO: 1478086 - RNA, 17 nt, Homo sapiens
aggaagcuccacuguca

SEQ ID NO: 1478087 - RNA, 12 nt, Homo sapiens
aggaagcucucu

SEQ ID NO: 1478088 - RNA, 21 nt, Homo sapiens
aggaaggaaagaaagaaggaa

SEQ ID NO: 1478089 - RNA, 15 nt, Homo sapiens
aggaagggagaacuu

SEQ ID NO: 1478090 - RNA, 21 nt, Homo sapiens
aggaagguagaaauaucugaa

SEQ ID NO: 1478091 - RNA, 22 nt, Homo sapiens
aggaaguugacuuauaguacau

SEQ ID NO: 1478092 - RNA, 18 nt, Homo sapiens
aggaauauaugugugccu

SEQ ID NO: 1478093 - RNA, 17 nt, Homo sapiens
aggaauuucugcucugg

SEQ ID NO: 1478094 - RNA, 15 nt, Homo sapiens
aggacaguauuccug

SEQ ID NO: 1478095 - RNA, 17 nt, Homo sapiens
aggacaguggaugcugc

SEQ ID NO: 1478096 - RNA, 14 nt, Homo sapiens
aggacaucagcaaa

SEQ ID NO: 1478097 - RNA, 23 nt, Homo sapiens
aggacaugcgguagccagcacac

SEQ ID NO: 1478098 - RNA, 22 nt, Homo sapiens
aggacauucuggaaaagcaaaa

SEQ ID NO: 1478099 - RNA, 14 nt, Homo sapiens
aggaccaagccaca

SEQ ID NO: 1478100 - RNA, 13 nt, Homo sapiens
aggaccagagcua

SEQ ID NO: 1478101 - RNA, 19 nt, Homo sapiens
aggacccaggaggugugau

SEQ ID NO: 1478102 - RNA, 19 nt, Homo sapiens
aggaccccauccuguucuc

SEQ ID NO: 1478103 - RNA, 11 nt, Homo sapiens
aggacccugaa

SEQ ID NO: 1478104 - RNA, 21 nt, Homo sapiens
aggacuacaaccaauuuacac

SEQ ID NO: 1478105 - RNA, 21 nt, Homo sapiens
aggacuuccauuugcuuuguc

SEQ ID NO: 1478106 - RNA, 12 nt, Homo sapiens
aggagaaacugc

SEQ ID NO: 1478107 - RNA, 21 nt, Homo sapiens
aggagaaccacuacaugcagc

SEQ ID NO: 1478108 - RNA, 15 nt, Homo sapiens
aggagaauaugauaa

SEQ ID NO: 1478109 - RNA, 16 nt, Homo sapiens
aggagaccagcucaga

SEQ ID NO: 1478110 - RNA, 20 nt, Homo sapiens
aggagaccuggcacuggaug

SEQ ID NO: 1478111 - RNA, 19 nt, Homo sapiens
aggagaggggaagggccag

SEQ ID NO: 1478112 - RNA, 23 nt, Homo sapiens
aggagccgaccgggaauaaccuu

SEQ ID NO: 1478113 - RNA, 22 nt, Homo sapiens
aggagccggugcucuggaagac

SEQ ID NO: 1478114 - RNA, 18 nt, Homo sapiens
aggagcucuacccugcuc

SEQ ID NO: 1478115 - RNA, 21 nt, Homo sapiens
aggagcugcuggcuugcagug

SEQ ID NO: 1478116 - RNA, 18 nt, Homo sapiens
aggagcuuccagcucuaa

SEQ ID NO: 1478117 - RNA, 13 nt, Homo sapiens
aggaggccagugg

SEQ ID NO: 1478118 - RNA, 17 nt, Homo sapiens
aggaggcuggcagguau

SEQ ID NO: 1478119 - RNA, 21 nt, Homo sapiens
aggaggggaggaacacugcac

SEQ ID NO: 1478120 - RNA, 16 nt, Homo sapiens
aggaggguugugcuac

SEQ ID NO: 1478121 - RNA, 19 nt, Homo sapiens
aggagguucacugagcucc

SEQ ID NO: 1478122 - RNA, 23 nt, Homo sapiens
aggagucugccuccaugcugcag

SEQ ID NO: 1478123 - RNA, 14 nt, Homo sapiens
aggagugguucuca

SEQ ID NO: 1478124 - RNA, 19 nt, Homo sapiens
aggaguguccucuucccuc

SEQ ID NO: 1478125 - RNA, 23 nt, Homo sapiens
aggagugugugacauuccagggg

SEQ ID NO: 1478126 - RNA, 22 nt, Homo sapiens
aggaguuguuucugacccacug

SEQ ID NO: 1478127 - RNA, 19 nt, Homo sapiens
aggauaaggaggcacugcu

SEQ ID NO: 1478128 - RNA, 14 nt, Homo sapiens
aggauagaugcugg

SEQ ID NO: 1478129 - RNA, 16 nt, Homo sapiens
aggauagucacaguga

SEQ ID NO: 1478130 - RNA, 13 nt, Homo sapiens
aggauauuaacaa

SEQ ID NO: 1478131 - RNA, 19 nt, Homo sapiens
aggauccucuccacuccau

SEQ ID NO: 1478132 - RNA, 19 nt, Homo sapiens
aggaugaauguaugugcac

SEQ ID NO: 1478133 - RNA, 20 nt, Homo sapiens
aggaugaauguaugugcacu

SEQ ID NO: 1478134 - RNA, 13 nt, Homo sapiens
aggaugcugucaa

SEQ ID NO: 1478135 - RNA, 19 nt, Homo sapiens
aggaugcugucaagcaccu

SEQ ID NO: 1478136 - RNA, 14 nt, Homo sapiens
aggauguaagccug

SEQ ID NO: 1478137 - RNA, 15 nt, Homo sapiens
aggauguaagccugg

SEQ ID NO: 1478138 - RNA, 21 nt, Homo sapiens
aggauguagagagaacaggug

SEQ ID NO: 1478139 - RNA, 11 nt, Homo sapiens
aggaugugaua

SEQ ID NO: 1478140 - RNA, 13 nt, Homo sapiens
aggauguggagcu

SEQ ID NO: 1478141 - RNA, 15 nt, Homo sapiens
aggauuccucagggu

SEQ ID NO: 1478142 - RNA, 19 nt, Homo sapiens
aggcaaggcuaugugauua

SEQ ID NO: 1478143 - RNA, 18 nt, Homo sapiens
aggcaagugcaauaaucc

SEQ ID NO: 1478144 - RNA, 13 nt, Homo sapiens
aggcaaugggagc

SEQ ID NO: 1478145 - RNA, 21 nt, Homo sapiens
aggcaauuucaccaccaaaug

SEQ ID NO: 1478146 - RNA, 14 nt, Homo sapiens
aggcacugcccuuu

SEQ ID NO: 1478147 - RNA, 20 nt, Homo sapiens
aggcacugcccuuuucagga

SEQ ID NO: 1478148 - RNA, 12 nt, Homo sapiens
aggcacugcuga

SEQ ID NO: 1478149 - RNA, 18 nt, Homo sapiens
aggcacuguggcucugca

SEQ ID NO: 1478150 - RNA, 22 nt, Homo sapiens
aggcagauggggcacugaccca

SEQ ID NO: 1478151 - RNA, 16 nt, Homo sapiens
aggcagauguuugccu

SEQ ID NO: 1478152 - RNA, 19 nt, Homo sapiens
aggcagcacagugugugaa

SEQ ID NO: 1478153 - RNA, 20 nt, Homo sapiens
aggcagcagugagcuaugau

SEQ ID NO: 1478154 - RNA, 12 nt, Homo sapiens
aucuucuacuuu

SEQ ID NO: 1478155 - RNA, 21 nt, Homo sapiens
aucuucugggagcaggaacaa

SEQ ID NO: 1478156 - RNA, 21 nt, Homo sapiens
aucuucuucauccaacuucca

SEQ ID NO: 1478157 - RNA, 17 nt, Homo sapiens
aucuucuuuggggcccu

SEQ ID NO: 1478158 - RNA, 19 nt, Homo sapiens
aucuuggagaaugugagaa

SEQ ID NO: 1478159 - RNA, 23 nt, Homo sapiens
aucuuggccaggcuggucuugaa

SEQ ID NO: 1478160 - RNA, 20 nt, Homo sapiens
aucuuucugugucuucacau

SEQ ID NO: 1478161 - RNA, 15 nt, Homo sapiens
aucuuucuuguuuca

SEQ ID NO: 1478162 - RNA, 18 nt, Homo sapiens
aucuuugccuuuaucucu

SEQ ID NO: 1478163 - RNA, 14 nt, Homo sapiens
aucuuugugacagg

SEQ ID NO: 1478164 - RNA, 13 nt, Homo sapiens
aucuuuucauuaa

SEQ ID NO: 1478165 - RNA, 19 nt, Homo sapiens
augaaaaaaaaaacuauca

SEQ ID NO: 1478166 - RNA, 12 nt, Homo sapiens
augaaaaauugg

SEQ ID NO: 1478167 - RNA, 14 nt, Homo sapiens
augaaaaugaauau

SEQ ID NO: 1478168 - RNA, 14 nt, Homo sapiens
augaaaaugaaucu

SEQ ID NO: 1478169 - RNA, 13 nt, Homo sapiens
augaaaaugcagu

SEQ ID NO: 1478170 - RNA, 17 nt, Homo sapiens
augaaaaugucaauacu

SEQ ID NO: 1478171 - RNA, 13 nt, Homo sapiens
augaaauaaucag

SEQ ID NO: 1478172 - RNA, 16 nt, Homo sapiens
augaaaucagcaagag

SEQ ID NO: 1478173 - RNA, 17 nt, Homo sapiens
augaaauuccagcaaua

SEQ ID NO: 1478174 - RNA, 16 nt, Homo sapiens
augaaauuucacuuca

SEQ ID NO: 1478175 - RNA, 16 nt, Homo sapiens
augaacacuacagaua

SEQ ID NO: 1478176 - RNA, 13 nt, Homo sapiens
augaacacuuuuu

SEQ ID NO: 1478177 - RNA, 15 nt, Homo sapiens
augaacucuuaauca

SEQ ID NO: 1478178 - RNA, 20 nt, Homo sapiens
augaagaaguuucuaaaaac

SEQ ID NO: 1478179 - RNA, 22 nt, Homo sapiens
augaagacaucuuauccauccu

SEQ ID NO: 1478180 - RNA, 23 nt, Homo sapiens
augaagcagcuuuaaacaaauuc

SEQ ID NO: 1478181 - RNA, 13 nt, Homo sapiens
augaagcaugcua

SEQ ID NO: 1478182 - RNA, 20 nt, Homo sapiens
augaagcgaaacacagagaa

SEQ ID NO: 1478183 - RNA, 18 nt, Homo sapiens
augaauauuuuguaacua

SEQ ID NO: 1478184 - RNA, 20 nt, Homo sapiens
augaauauuuuguaacuauu

SEQ ID NO: 1478185 - RNA, 15 nt, Homo sapiens
augaaucaucaaagc

SEQ ID NO: 1478186 - RNA, 18 nt, Homo sapiens
augaaucauugauugaau

SEQ ID NO: 1478187 - RNA, 20 nt, Homo sapiens
augaaugccuaaauauaauu

SEQ ID NO: 1478188 - RNA, 16 nt, Homo sapiens
augacaaaaagccuuu

SEQ ID NO: 1478189 - RNA, 16 nt, Homo sapiens
augacacaacugcacu

SEQ ID NO: 1478190 - RNA, 18 nt, Homo sapiens
augacaccaaauaugucc

SEQ ID NO: 1478191 - RNA, 16 nt, Homo sapiens
augacaguagcauuau

SEQ ID NO: 1478192 - RNA, 18 nt, Homo sapiens
augacauaugacuugauc

SEQ ID NO: 1478193 - RNA, 15 nt, Homo sapiens
augacaucucagggg

SEQ ID NO: 1478194 - RNA, 15 nt, Homo sapiens
augacauuuauucaa

SEQ ID NO: 1478195 - RNA, 20 nt, Homo sapiens
augaccagaagccuuggaac

SEQ ID NO: 1478196 - RNA, 23 nt, Homo sapiens
augaccaguaaaggcugcugcua

SEQ ID NO: 1478197 - RNA, 14 nt, Homo sapiens
augacccacugucc

SEQ ID NO: 1478198 - RNA, 17 nt, Homo sapiens
augacccuuugccuguu

SEQ ID NO: 1478199 - RNA, 15 nt, Homo sapiens
augacgucaucauca

SEQ ID NO: 1478200 - RNA, 23 nt, Homo sapiens
augacuaaagagagaauguagau

SEQ ID NO: 1478201 - RNA, 14 nt, Homo sapiens
augacuacuuuuuc

SEQ ID NO: 1478202 - RNA, 16 nt, Homo sapiens
augacugacuugucua

SEQ ID NO: 1478203 - RNA, 15 nt, Homo sapiens
augacuuaaccauau

SEQ ID NO: 1478204 - RNA, 18 nt, Homo sapiens
augacuucccugcuccaa

SEQ ID NO: 1478205 - RNA, 13 nt, Homo sapiens
augacuugcuacu

SEQ ID NO: 1478206 - RNA, 17 nt, Homo sapiens
augagaaaagaaauuag

SEQ ID NO: 1478207 - RNA, 15 nt, Homo sapiens
augagaaaugaugaa

SEQ ID NO: 1478208 - RNA, 17 nt, Homo sapiens
augagaccacuguuauc

SEQ ID NO: 1478209 - RNA, 19 nt, Homo sapiens
augagacccuggugccugg

SEQ ID NO: 1478210 - RNA, 23 nt, Homo sapiens
augagaguuucuguuaaucaugu

SEQ ID NO: 1478211 - RNA, 17 nt, Homo sapiens
augagccaucacuagaa

SEQ ID NO: 1478212 - RNA, 13 nt, Homo sapiens
augagccaugaga

SEQ ID NO: 1478213 - RNA, 18 nt, Homo sapiens
augagcugacaucucagu

SEQ ID NO: 1478214 - RNA, 15 nt, Homo sapiens
augaggaaaugaucc

SEQ ID NO: 1478215 - RNA, 14 nt, Homo sapiens
augaggccaucuca

SEQ ID NO: 1478216 - RNA, 15 nt, Homo sapiens
augaggccaucucag

SEQ ID NO: 1478217 - RNA, 18 nt, Homo sapiens
augaggcccucauuccca

SEQ ID NO: 1478218 - RNA, 14 nt, Homo sapiens
augaggggugcugg

SEQ ID NO: 1478219 - RNA, 15 nt, Homo sapiens
augagguacucuccu

SEQ ID NO: 1478220 - RNA, 15 nt, Homo sapiens
augaggucuguuuaa

SEQ ID NO: 1478221 - RNA, 21 nt, Homo sapiens
augagguucugagaccagugu

SEQ ID NO: 1478222 - RNA, 21 nt, Homo sapiens
augaguaauacaucaaagagu

SEQ ID NO: 1478223 - RNA, 16 nt, Homo sapiens
augaguaguguggaau

SEQ ID NO: 1478224 - RNA, 13 nt, Homo sapiens
augauacaaugaa

SEQ ID NO: 1478225 - RNA, 19 nt, Homo sapiens
augauccccaaguggugaa

SEQ ID NO: 1478226 - RNA, 15 nt, Homo sapiens
augaucgcuaucuag

SEQ ID NO: 1478227 - RNA, 16 nt, Homo sapiens
augauggcaacagauc

SEQ ID NO: 1478228 - RNA, 20 nt, Homo sapiens
augauggcagccauagugca

SEQ ID NO: 1478229 - RNA, 21 nt, Homo sapiens
augauuggauuauucauuuaa

SEQ ID NO: 1478230 - RNA, 14 nt, Homo sapiens
augauuuacauaaa

SEQ ID NO: 1478231 - RNA, 14 nt, Homo sapiens
augauuuuauuuga

SEQ ID NO: 1478232 - RNA, 9 nt, Homo sapiens
augcaaaac

SEQ ID NO: 1478233 - RNA, 15 nt, Homo sapiens
augcaaaguagcaau

SEQ ID NO: 1478234 - RNA, 21 nt, Homo sapiens
augcaaaguucuucauaucau

SEQ ID NO: 1478235 - RNA, 17 nt, Homo sapiens
augccugguaccagagg

SEQ ID NO: 1478236 - RNA, 15 nt, Homo sapiens
augccuguaauccca

SEQ ID NO: 1478237 - RNA, 14 nt, Homo sapiens
augccuguaaucuc

SEQ ID NO: 1478238 - RNA, 15 nt, Homo sapiens
augccuguaaucuca

SEQ ID NO: 1478239 - RNA, 22 nt, Homo sapiens
augccuuaaaccuaccucccac

SEQ ID NO: 1478240 - RNA, 18 nt, Homo sapiens
augcguaaacgacacucu

SEQ ID NO: 1478241 - RNA, 23 nt, Homo sapiens
augcuagaacaacgccugucaca

SEQ ID NO: 1478242 - RNA, 12 nt, Homo sapiens
augcucacuuua

SEQ ID NO: 1478243 - RNA, 14 nt, Homo sapiens
augcucacuuuauu

SEQ ID NO: 1478244 - RNA, 21 nt, Homo sapiens
augcuccaucccaaccaggca

SEQ ID NO: 1478245 - RNA, 16 nt, Homo sapiens
augcucugcauguuac

SEQ ID NO: 1478246 - RNA, 22 nt, Homo sapiens
augcugaaaaaucauccaagac

SEQ ID NO: 1478247 - RNA, 15 nt, Homo sapiens
augcugcuauggaag

SEQ ID NO: 1478248 - RNA, 21 nt, Homo sapiens
augcugcuauggaaggugcua

SEQ ID NO: 1478249 - RNA, 21 nt, Homo sapiens
augcugcuuuaggaauucugc

SEQ ID NO: 1478250 - RNA, 15 nt, Homo sapiens
augcuggacuugccu

SEQ ID NO: 1478251 - RNA, 20 nt, Homo sapiens
augcugucaagcaccugcau

SEQ ID NO: 1478252 - RNA, 13 nt, Homo sapiens
augcugugcucaa

SEQ ID NO: 1478253 - RNA, 20 nt, Homo sapiens
augcugugcucaaucagccu

SEQ ID NO: 1478254 - RNA, 23 nt, Homo sapiens
augcuguucacuggacacuucac

SEQ ID NO: 1478255 - RNA, 19 nt, Homo sapiens
augcuguuuguagugaaau

SEQ ID NO: 1478256 - RNA, 17 nt, Homo sapiens
augcuuaaacuaaauaa

SEQ ID NO: 1478257 - RNA, 15 nt, Homo sapiens
augcuucaugugcug

SEQ ID NO: 1478258 - RNA, 17 nt, Homo sapiens
augcuuggcuaacuaua

SEQ ID NO: 1478259 - RNA, 11 nt, Homo sapiens
augcuuuacaa

SEQ ID NO: 1478260 - RNA, 19 nt, Homo sapiens
auggaaaauaaacaucagu

SEQ ID NO: 1478261 - RNA, 14 nt, Homo sapiens
auggaacacggcca

SEQ ID NO: 1478262 - RNA, 16 nt, Homo sapiens
auggaacacggccaca

SEQ ID NO: 1478263 - RNA, 23 nt, Homo sapiens
auggaacgcuaaugaaacacagc

SEQ ID NO: 1478264 - RNA, 16 nt, Homo sapiens
auggaacucucuccac

SEQ ID NO: 1478265 - RNA, 15 nt, Homo sapiens
auggaauuacaugua

SEQ ID NO: 1478266 - RNA, 14 nt, Homo sapiens
auggacaacucaau

SEQ ID NO: 1478267 - RNA, 17 nt, Homo sapiens
auggacaacucaaugaa

SEQ ID NO: 1478268 - RNA, 21 nt, Homo sapiens
auggacacuccagugccagca

SEQ ID NO: 1478269 - RNA, 13 nt, Homo sapiens
auggacagugggc

SEQ ID NO: 1478270 - RNA, 19 nt, Homo sapiens
auggaccaggaagcccuga

SEQ ID NO: 1478271 - RNA, 22 nt, Homo sapiens
auggacuggagcucaucugcaa

SEQ ID NO: 1478272 - RNA, 18 nt, Homo sapiens
auggaggaaagugauauc

SEQ ID NO: 1478273 - RNA, 14 nt, Homo sapiens
auggaggucauaca

SEQ ID NO: 1478274 - RNA, 15 nt, Homo sapiens
auggauauuauuaga

SEQ ID NO: 1478275 - RNA, 11 nt, Homo sapiens
auggaucacaa

SEQ ID NO: 1478276 - RNA, 18 nt, Homo sapiens
auggaugggggaacucag

SEQ ID NO: 1478277 - RNA, 21 nt, Homo sapiens
auggaugggggaacucagauc

SEQ ID NO: 1478278 - RNA, 23 nt, Homo sapiens
auggcaaaaccccaucuuuacua

SEQ ID NO: 1478279 - RNA, 17 nt, Homo sapiens
auggcaaagaauucaaa

SEQ ID NO: 1478280 - RNA, 23 nt, Homo sapiens
auggcaacagaucuggaaccuca

SEQ ID NO: 1478281 - RNA, 15 nt, Homo sapiens
auggcaccuuuugca

SEQ ID NO: 1478282 - RNA, 16 nt, Homo sapiens
auggcaccuuuugcac

SEQ ID NO: 1478283 - RNA, 20 nt, Homo sapiens
auggcagcuguuucucauga

SEQ ID NO: 1478284 - RNA, 21 nt, Homo sapiens
auggccagagaugcuggacuu

SEQ ID NO: 1478285 - RNA, 13 nt, Homo sapiens
auggccagccaac

SEQ ID NO: 1478286 - RNA, 22 nt, Homo sapiens
auggccauagcuuuuauucauu

SEQ ID NO: 1478287 - RNA, 16 nt, Homo sapiens
auggcuaccaaaaaga

SEQ ID NO: 1478288 - RNA, 21 nt, Homo sapiens
auggcuacuuugguuucuguc

SEQ ID NO: 1478289 - RNA, 19 nt, Homo sapiens
auggcuagccuuucuugua

SEQ ID NO: 1478290 - RNA, 17 nt, Homo sapiens
auggcuccuccauaucu

SEQ ID NO: 1478291 - RNA, 22 nt, Homo sapiens
auggcuggaagggguccagccu

SEQ ID NO: 1478292 - RNA, 18 nt, Homo sapiens
augggacuaaaugaacua

SEQ ID NO: 1478293 - RNA, 19 nt, Homo sapiens
augggagugggcaccucag

SEQ ID NO: 1478294 - RNA, 14 nt, Homo sapiens
augggccuggccac

SEQ ID NO: 1478295 - RNA, 14 nt, Homo sapiens
augggcucuuccaa

SEQ ID NO: 1478296 - RNA, 13 nt, Homo sapiens
auggggacacaga

SEQ ID NO: 1478297 - RNA, 15 nt, Homo sapiens
auggggugcaugaua

SEQ ID NO: 1478298 - RNA, 18 nt, Homo sapiens
auggggugggguagggcu

SEQ ID NO: 1478299 - RNA, 14 nt, Homo sapiens
auggguacaaugaa

SEQ ID NO: 1478300 - RNA, 18 nt, Homo sapiens
augggucccccucagcaa

SEQ ID NO: 1478301 - RNA, 15 nt, Homo sapiens
auggguugcauuugg

SEQ ID NO: 1478302 - RNA, 20 nt, Homo sapiens
auggucaacacuuaaggguu

SEQ ID NO: 1478303 - RNA, 20 nt, Homo sapiens
augguccugcagaagcagaa

SEQ ID NO: 1478304 - RNA, 20 nt, Homo sapiens
auggugaaaccccaucucua

SEQ ID NO: 1478305 - RNA, 13 nt, Homo sapiens
auggugacagcug

SEQ ID NO: 1478306 - RNA, 18 nt, Homo sapiens
augguguaauaagacaua

SEQ ID NO: 1478307 - RNA, 23 nt, Homo sapiens
augguguagaacacuaauucaua

SEQ ID NO: 1478308 - RNA, 14 nt, Homo sapiens
auggugucaugcca

SEQ ID NO: 1478309 - RNA, 17 nt, Homo sapiens
augguguggguguccug

SEQ ID NO: 1478310 - RNA, 16 nt, Homo sapiens
augguuacucuuguca

SEQ ID NO: 1478311 - RNA, 20 nt, Homo sapiens
augguuacuucuucucuuag

SEQ ID NO: 1478312 - RNA, 13 nt, Homo sapiens
augguuucuccag

SEQ ID NO: 1478313 - RNA, 21 nt, Homo sapiens
auguaaaaaugaaaagccaaa

SEQ ID NO: 1478314 - RNA, 14 nt, Homo sapiens
auguaaaacugaac

SEQ ID NO: 1478315 - RNA, 13 nt, Homo sapiens
acaggcacggguc

SEQ ID NO: 1478316 - RNA, 21 nt, Homo sapiens
acaggcaguggaagcaguuuc

SEQ ID NO: 1478317 - RNA, 15 nt, Homo sapiens
acaggccauacuuua

SEQ ID NO: 1478318 - RNA, 15 nt, Homo sapiens
acaggccauggugca

SEQ ID NO: 1478319 - RNA, 21 nt, Homo sapiens
acaggcccccuugaguggggu

SEQ ID NO: 1478320 - RNA, 21 nt, Homo sapiens
acaggcccuuccucuccacug

SEQ ID NO: 1478321 - RNA, 22 nt, Homo sapiens
acaggcccuuccucuccacugc

SEQ ID NO: 1478322 - RNA, 20 nt, Homo sapiens
acaggcgccugccaucaugc

SEQ ID NO: 1478323 - RNA, 22 nt, Homo sapiens
acagggagaagggauaacccua

SEQ ID NO: 1478324 - RNA, 24 nt, Homo sapiens
acagggucugcucuuucucugcca

SEQ ID NO: 1478325 - RNA, 18 nt, Homo sapiens
acaggguuugauagcacu

SEQ ID NO: 1478326 - RNA, 18 nt, Homo sapiens
acaggugcgguuccucau

SEQ ID NO: 1478327 - RNA, 15 nt, Homo sapiens
acagguggugcaaau

SEQ ID NO: 1478328 - RNA, 18 nt, Homo sapiens
acagguguauauaagcaa

SEQ ID NO: 1478329 - RNA, 19 nt, Homo sapiens
acaguacacagauaccuug

SEQ ID NO: 1478330 - RNA, 15 nt, Homo sapiens
acaguagaacugucu

SEQ ID NO: 1478331 - RNA, 15 nt, Homo sapiens
accaaccucauagag

SEQ ID NO: 1478332 - RNA, 15 nt, Homo sapiens
accaaccugcucugu

SEQ ID NO: 1478333 - RNA, 14 nt, Homo sapiens
accaagaacugcau

SEQ ID NO: 1478334 - RNA, 19 nt, Homo sapiens
accaagucggaacagcaga

SEQ ID NO: 1478335 - RNA, 13 nt, Homo sapiens
accaaguuuauuc

SEQ ID NO: 1478336 - RNA, 16 nt, Homo sapiens
accaauccaacaucca

SEQ ID NO: 1478337 - RNA, 15 nt, Homo sapiens
accaauugugcugcc

SEQ ID NO: 1478338 - RNA, 20 nt, Homo sapiens
accacaaaaaagaaacuugc

SEQ ID NO: 1478339 - RNA, 17 nt, Homo sapiens
accacacccagugggaa

SEQ ID NO: 1478340 - RNA, 20 nt, Homo sapiens
accacaccuggcccuugcaa

SEQ ID NO: 1478341 - RNA, 15 nt, Homo sapiens
accacacggaucuga

SEQ ID NO: 1478342 - RNA, 12 nt, Homo sapiens
accacagacugu

SEQ ID NO: 1478343 - RNA, 20 nt, Homo sapiens
accacagagcugucacuuuu

SEQ ID NO: 1478344 - RNA, 11 nt, Homo sapiens
accacagcagc

SEQ ID NO: 1478345 - RNA, 13 nt, Homo sapiens
accacagggccag

SEQ ID NO: 1478346 - RNA, 15 nt, Homo sapiens
accacagugucugua

SEQ ID NO: 1478347 - RNA, 14 nt, Homo sapiens
accacaucugccag

SEQ ID NO: 1478348 - RNA, 21 nt, Homo sapiens
accaccccaacaaaccaucca

SEQ ID NO: 1478349 - RNA, 16 nt, Homo sapiens
accacccuagucccuu

SEQ ID NO: 1478350 - RNA, 15 nt, Homo sapiens
accaccucaccaguu

SEQ ID NO: 1478351 - RNA, 15 nt, Homo sapiens
accaccugcuucuga

SEQ ID NO: 1478352 - RNA, 18 nt, Homo sapiens
accacuacaugcagccca

SEQ ID NO: 1478353 - RNA, 21 nt, Homo sapiens
accacucaggcauuugacuga

SEQ ID NO: 1478354 - RNA, 20 nt, Homo sapiens
accacucuucuuuaagccau

SEQ ID NO: 1478355 - RNA, 16 nt, Homo sapiens
accacugcacugucug

SEQ ID NO: 1478356 - RNA, 18 nt, Homo sapiens
accacugguacuuccuuu

SEQ ID NO: 1478357 - RNA, 22 nt, Homo sapiens
accacuucagaaauauaugcag

SEQ ID NO: 1478358 - RNA, 17 nt, Homo sapiens
accacuucgaaaccugg

SEQ ID NO: 1478359 - RNA, 17 nt, Homo sapiens
accagagccagaugcag

SEQ ID NO: 1478360 - RNA, 11 nt, Homo sapiens
accagaggcag

SEQ ID NO: 1478361 - RNA, 18 nt, Homo sapiens
accagcagcccugucacg

SEQ ID NO: 1478362 - RNA, 14 nt, Homo sapiens
accagcucaugcca

SEQ ID NO: 1478363 - RNA, 16 nt, Homo sapiens
accaggacuauagccc

SEQ ID NO: 1478364 - RNA, 20 nt, Homo sapiens
accaggacucccuccucacc

SEQ ID NO: 1478365 - RNA, 14 nt, Homo sapiens
accaggccgugccu

SEQ ID NO: 1478366 - RNA, 19 nt, Homo sapiens
accaggcugugggccucaa

SEQ ID NO: 1478367 - RNA, 14 nt, Homo sapiens
accaggcuuggccu

SEQ ID NO: 1478368 - RNA, 22 nt, Homo sapiens
accaguacucccccagcuuucc

SEQ ID NO: 1478369 - RNA, 15 nt, Homo sapiens
accaguguagcauug

SEQ ID NO: 1478370 - RNA, 21 nt, Homo sapiens
accaguguaucaggucaggga

SEQ ID NO: 1478371 - RNA, 17 nt, Homo sapiens
accagugugacaucuac

SEQ ID NO: 1478372 - RNA, 16 nt, Homo sapiens
accaguuucagagaaa

SEQ ID NO: 1478373 - RNA, 22 nt, Homo sapiens
accaguuuuuggauaaagaaua

SEQ ID NO: 1478374 - RNA, 16 nt, Homo sapiens
accaucccugccacau

SEQ ID NO: 1478375 - RNA, 21 nt, Homo sapiens
accaucuccagcuauuuacac

SEQ ID NO: 1478376 - RNA, 16 nt, Homo sapiens
accaugaagacaggau

SEQ ID NO: 1478377 - RNA, 11 nt, Homo sapiens
accaugaaguc

SEQ ID NO: 1478378 - RNA, 11 nt, Homo sapiens
accaugacugu

SEQ ID NO: 1478379 - RNA, 19 nt, Homo sapiens
accaugagaccacuguuau

SEQ ID NO: 1478380 - RNA, 21 nt, Homo sapiens
accaugagaccacuguuauca

SEQ ID NO: 1478381 - RNA, 13 nt, Homo sapiens
accauguacauga

SEQ ID NO: 1478382 - RNA, 14 nt, Homo sapiens
accaugucacugug

SEQ ID NO: 1478383 - RNA, 22 nt, Homo sapiens
accauuccauuuccaagcacuu

SEQ ID NO: 1478384 - RNA, 18 nt, Homo sapiens
accauucuccugccucag

SEQ ID NO: 1478385 - RNA, 12 nt, Homo sapiens
accauuucucac

SEQ ID NO: 1478386 - RNA, 23 nt, Homo sapiens
accauuuguaauaaaguauauaa

SEQ ID NO: 1478387 - RNA, 13 nt, Homo sapiens
acccaacagcagu

SEQ ID NO: 1478388 - RNA, 18 nt, Homo sapiens
acccaacuacugagcuga

SEQ ID NO: 1478389 - RNA, 13 nt, Homo sapiens
acccacacaagcg

SEQ ID NO: 1478390 - RNA, 16 nt, Homo sapiens
acccaccccugcacag

SEQ ID NO: 1478391 - RNA, 18 nt, Homo sapiens
acccaccuucaagcagcu

SEQ ID NO: 1478392 - RNA, 23 nt, Homo sapiens
acccacuguccgcgguggacucu

SEQ ID NO: 1478393 - RNA, 14 nt, Homo sapiens
acccacuuugucca

SEQ ID NO: 1478394 - RNA, 14 nt, Homo sapiens
acccagaugcucuc

SEQ ID NO: 1478395 - RNA, 13 nt, Homo sapiens
acccagcaaagag

SEQ ID NO: 1478396 - RNA, 20 nt, Homo sapiens
acccagcuugugccuguggu

SEQ ID NO: 1478397 - RNA, 16 nt, Homo sapiens
acccaggaccaagcca

SEQ ID NO: 1478398 - RNA, 17 nt, Homo sapiens
acccaggaguguggcca

SEQ ID NO: 1478399 - RNA, 20 nt, Homo sapiens
acccaggcuggagugcagug

SEQ ID NO: 1478400 - RNA, 20 nt, Homo sapiens
acccagggaggaagacugua

SEQ ID NO: 1478401 - RNA, 23 nt, Homo sapiens
acccaguuugauaccugcacugu

SEQ ID NO: 1478402 - RNA, 15 nt, Homo sapiens
acccauaaacaguaa

SEQ ID NO: 1478403 - RNA, 18 nt, Homo sapiens
acccaugagauucauuca

SEQ ID NO: 1478404 - RNA, 15 nt, Homo sapiens
acccaugaggcaaug

SEQ ID NO: 1478405 - RNA, 18 nt, Homo sapiens
accccaaacuguugauua

SEQ ID NO: 1478406 - RNA, 15 nt, Homo sapiens
accccaaagcuuucc

SEQ ID NO: 1478407 - RNA, 14 nt, Homo sapiens
accccaaccucaga

SEQ ID NO: 1478408 - RNA, 17 nt, Homo sapiens
accccacagacacuuac

SEQ ID NO: 1478409 - RNA, 14 nt, Homo sapiens
accccacauuuuuc

SEQ ID NO: 1478410 - RNA, 19 nt, Homo sapiens
accccagggccagcuuuuc

SEQ ID NO: 1478411 - RNA, 19 nt, Homo sapiens
accccagggcccuggccag

SEQ ID NO: 1478412 - RNA, 18 nt, Homo sapiens
accccaguggauucucau

SEQ ID NO: 1478413 - RNA, 22 nt, Homo sapiens
accccagugguauccugugaca

SEQ ID NO: 1478414 - RNA, 23 nt, Homo sapiens
accccagugguauccugugacau

SEQ ID NO: 1478415 - RNA, 17 nt, Homo sapiens
accccaucuuuacuaaa

SEQ ID NO: 1478416 - RNA, 14 nt, Homo sapiens
accccauuccugau

SEQ ID NO: 1478417 - RNA, 19 nt, Homo sapiens
aacaaaagcgacccauuca

SEQ ID NO: 1478418 - RNA, 22 nt, Homo sapiens
aacaaaagcuugaagcugugga

SEQ ID NO: 1478419 - RNA, 15 nt, Homo sapiens
aacaaacaaacaauu

SEQ ID NO: 1478420 - RNA, 14 nt, Homo sapiens
aacaaagaaugggc

SEQ ID NO: 1478421 - RNA, 22 nt, Homo sapiens
aacaaagugacuguuuggcuua

SEQ ID NO: 1478422 - RNA, 13 nt, Homo sapiens
aacaaauaugcaa

SEQ ID NO: 1478423 - RNA, 14 nt, Homo sapiens
aacaaauaugcaaa

SEQ ID NO: 1478424 - RNA, 15 nt, Homo sapiens
aacaaauugaugcaa

SEQ ID NO: 1478425 - RNA, 20 nt, Homo sapiens
aacaacacuggugugaccug

SEQ ID NO: 1478426 - RNA, 16 nt, Homo sapiens
aacaaccuaugcacca

SEQ ID NO: 1478427 - RNA, 22 nt, Homo sapiens
aacaacuaggcuucagcauauu

SEQ ID NO: 1478428 - RNA, 21 nt, Homo sapiens
aacaacuauccugacuucuaa

SEQ ID NO: 1478429 - RNA, 12 nt, Homo sapiens
aacaacuguggu

SEQ ID NO: 1478430 - RNA, 23 nt, Homo sapiens
aacaagcccguuagccccaggga

SEQ ID NO: 1478431 - RNA, 23 nt, Homo sapiens
aacaagguccucugucagucaca

SEQ ID NO: 1478432 - RNA, 20 nt, Homo sapiens
aacaauccccaucagguagc

SEQ ID NO: 1478433 - RNA, 18 nt, Homo sapiens
aacaauugaaguaaacuu

SEQ ID NO: 1478434 - RNA, 22 nt, Homo sapiens
aacacaagagacuuaaaggaca

SEQ ID NO: 1478435 - RNA, 19 nt, Homo sapiens
aacacacacuguucugaaa

SEQ ID NO: 1478436 - RNA, 21 nt, Homo sapiens
aacacagcauguguauuucca

SEQ ID NO: 1478437 - RNA, 14 nt, Homo sapiens
aacacaggaaguca

SEQ ID NO: 1478438 - RNA, 14 nt, Homo sapiens
aacacaugccuuaa

SEQ ID NO: 1478439 - RNA, 17 nt, Homo sapiens
aacacauucuuauuaau

SEQ ID NO: 1478440 - RNA, 22 nt, Homo sapiens
augugaauaaauucuauaggaa

SEQ ID NO: 1478441 - RNA, 21 nt, Homo sapiens
augugaauuauugacacugaa

SEQ ID NO: 1478442 - RNA, 13 nt, Homo sapiens
augugaggauuuu

SEQ ID NO: 1478443 - RNA, 18 nt, Homo sapiens
augugagugccuuuugca

SEQ ID NO: 1478444 - RNA, 22 nt, Homo sapiens
augugccaauaaccaaguuuau

SEQ ID NO: 1478445 - RNA, 21 nt, Homo sapiens
augugccccagcaggcaugga

SEQ ID NO: 1478446 - RNA, 22 nt, Homo sapiens
augugcugaaugguuuucaaaa

SEQ ID NO: 1478447 - RNA, 21 nt, Homo sapiens
auguggacuaaauaucuguca

SEQ ID NO: 1478448 - RNA, 22 nt, Homo sapiens
auguggcaaggaaaaacagguc

SEQ ID NO: 1478449 - RNA, 17 nt, Homo sapiens
auguggccugcauguac

SEQ ID NO: 1478450 - RNA, 18 nt, Homo sapiens
augugggagggagcagac

SEQ ID NO: 1478451 - RNA, 13 nt, Homo sapiens
auguggucucagg

SEQ ID NO: 1478452 - RNA, 16 nt, Homo sapiens
augugguuaucuguga

SEQ ID NO: 1478453 - RNA, 15 nt, Homo sapiens
augugucacuugugc

SEQ ID NO: 1478454 - RNA, 22 nt, Homo sapiens
augugucaggugacccugauga

SEQ ID NO: 1478455 - RNA, 18 nt, Homo sapiens
auguguccccucacucug

SEQ ID NO: 1478456 - RNA, 19 nt, Homo sapiens
augugugaaaaagaugcca

SEQ ID NO: 1478457 - RNA, 15 nt, Homo sapiens
augugugaggagcug

SEQ ID NO: 1478458 - RNA, 23 nt, Homo sapiens
auguguggaaguuauuaacuuua

SEQ ID NO: 1478459 - RNA, 15 nt, Homo sapiens
auguguugcuauccu

SEQ ID NO: 1478460 - RNA, 20 nt, Homo sapiens
auguguuuauucauccagca

SEQ ID NO: 1478461 - RNA, 22 nt, Homo sapiens
auguguuuuaucacuucauuca

SEQ ID NO: 1478462 - RNA, 19 nt, Homo sapiens
auguuaauauugugcaaac

SEQ ID NO: 1478463 - RNA, 22 nt, Homo sapiens
auguuaguauuuuaauccugua

SEQ ID NO: 1478464 - RNA, 15 nt, Homo sapiens
auguuaugacuaugu

SEQ ID NO: 1478465 - RNA, 19 nt, Homo sapiens
auguucacauagugaaaua

SEQ ID NO: 1478466 - RNA, 13 nt, Homo sapiens
auguucacuguga

SEQ ID NO: 1478467 - RNA, 15 nt, Homo sapiens
auguucacugugagu

SEQ ID NO: 1478468 - RNA, 12 nt, Homo sapiens
auguucagucac

SEQ ID NO: 1478469 - RNA, 14 nt, Homo sapiens
auguucauuuguac

SEQ ID NO: 1478470 - RNA, 22 nt, Homo sapiens
auguuccccaggauucagcuau

SEQ ID NO: 1478471 - RNA, 14 nt, Homo sapiens
auguuccucaaaag

SEQ ID NO: 1478472 - RNA, 15 nt, Homo sapiens
auguucuauuguggg

SEQ ID NO: 1478473 - RNA, 17 nt, Homo sapiens
auguugaaagaucaaaa

SEQ ID NO: 1478474 - RNA, 14 nt, Homo sapiens
auguugcacaauga

SEQ ID NO: 1478475 - RNA, 16 nt, Homo sapiens
auguuugcacuuguga

SEQ ID NO: 1478476 - RNA, 22 nt, Homo sapiens
auguuugccgcuuaagcuuuca

SEQ ID NO: 1478477 - RNA, 17 nt, Homo sapiens
auguuugcuauugacaa

SEQ ID NO: 1478478 - RNA, 13 nt, Homo sapiens
auguuugucagau

SEQ ID NO: 1478479 - RNA, 16 nt, Homo sapiens
auguuuguccugaaca

SEQ ID NO: 1478480 - RNA, 12 nt, Homo sapiens
auguuuuccacc

SEQ ID NO: 1478481 - RNA, 18 nt, Homo sapiens
auguuuuuugccacagcu

SEQ ID NO: 1478482 - RNA, 17 nt, Homo sapiens
auuaaaacacagcuuua

SEQ ID NO: 1478483 - RNA, 13 nt, Homo sapiens
auuaaaaccaauu

SEQ ID NO: 1478484 - RNA, 19 nt, Homo sapiens
auuaaaacuaagcacaaag

SEQ ID NO: 1478485 - RNA, 19 nt, Homo sapiens
auuaaagaauguuuuggaa

SEQ ID NO: 1478486 - RNA, 19 nt, Homo sapiens
auuaaagcauuuccuacca

SEQ ID NO: 1478487 - RNA, 15 nt, Homo sapiens
auuaaauaaaucauu

SEQ ID NO: 1478488 - RNA, 15 nt, Homo sapiens
auuaaauauauacug

SEQ ID NO: 1478489 - RNA, 14 nt, Homo sapiens
auuaaauucacaaa

SEQ ID NO: 1478490 - RNA, 19 nt, Homo sapiens
auuaacaacaauaacacug

SEQ ID NO: 1478491 - RNA, 18 nt, Homo sapiens
auuaagaaagacuaucua

SEQ ID NO: 1478492 - RNA, 13 nt, Homo sapiens
auuaaguuaucuu

SEQ ID NO: 1478493 - RNA, 18 nt, Homo sapiens
auuaauaaucuuauuagg

SEQ ID NO: 1478494 - RNA, 22 nt, Homo sapiens
auuaaugauaaaaauaaugcau

SEQ ID NO: 1478495 - RNA, 20 nt, Homo sapiens
auuaaugauuaaacuauuaa

SEQ ID NO: 1478496 - RNA, 20 nt, Homo sapiens
auuaauucuauaaggccaua

SEQ ID NO: 1478497 - RNA, 19 nt, Homo sapiens
auuaauuuuccaaugcaca

SEQ ID NO: 1478498 - RNA, 15 nt, Homo sapiens
auuacaaaacucaga

SEQ ID NO: 1478499 - RNA, 14 nt, Homo sapiens
auuacaauugugag

SEQ ID NO: 1478500 - RNA, 20 nt, Homo sapiens
auuacacauuuguacagaau

SEQ ID NO: 1478501 - RNA, 15 nt, Homo sapiens
auuacaggcaccugc

SEQ ID NO: 1478502 - RNA, 21 nt, Homo sapiens
auuacaggcgugauccaccac

SEQ ID NO: 1478503 - RNA, 23 nt, Homo sapiens
auuacaggugugugccaccacac

SEQ ID NO: 1478504 - RNA, 16 nt, Homo sapiens
auuacauggcaguguu

SEQ ID NO: 1478505 - RNA, 23 nt, Homo sapiens
auuacauguguuuauucauccag

SEQ ID NO: 1478506 - RNA, 12 nt, Homo sapiens
auuacauuuuaa

SEQ ID NO: 1478507 - RNA, 21 nt, Homo sapiens
auuacccacccgaccuggcug

SEQ ID NO: 1478508 - RNA, 23 nt, Homo sapiens
auuaccuccauccauccuuccaa

SEQ ID NO: 1478509 - RNA, 15 nt, Homo sapiens
auuacuaucauggca

SEQ ID NO: 1478510 - RNA, 20 nt, Homo sapiens
auuacuguugcauuuacuuu

SEQ ID NO: 1478511 - RNA, 14 nt, Homo sapiens
auuagaaaguuaac

SEQ ID NO: 1478512 - RNA, 24 nt, Homo sapiens
auuagaagacaacaggcauagcaa

SEQ ID NO: 1478513 - RNA, 16 nt, Homo sapiens
auuagaguauuuucca

SEQ ID NO: 1478514 - RNA, 16 nt, Homo sapiens
auuagaugaacucaac

SEQ ID NO: 1478515 - RNA, 17 nt, Homo sapiens
auuagcaaggucauuuc

SEQ ID NO: 1478516 - RNA, 18 nt, Homo sapiens
auuagccgggcauggugg

SEQ ID NO: 1478517 - RNA, 13 nt, Homo sapiens
auuagcugugauu

SEQ ID NO: 1478518 - RNA, 15 nt, Homo sapiens
ucuaaccuugaaugc

SEQ ID NO: 1478519 - RNA, 16 nt, Homo sapiens
ucuaagaugauucaaa

SEQ ID NO: 1478520 - RNA, 23 nt, Homo sapiens
ucuaagaugauucaaaguaguuu

SEQ ID NO: 1478521 - RNA, 18 nt, Homo sapiens
ucuaagaugccagcauau

SEQ ID NO: 1478522 - RNA, 20 nt, Homo sapiens
ucuaaguuauuuacuuuuac

SEQ ID NO: 1478523 - RNA, 14 nt, Homo sapiens
ucuaauuucugaaa

SEQ ID NO: 1478524 - RNA, 22 nt, Homo sapiens
ucuaauuuuggauggaguccag

SEQ ID NO: 1478525 - RNA, 16 nt, Homo sapiens
ucuaauuuuuaagaau

SEQ ID NO: 1478526 - RNA, 22 nt, Homo sapiens
ucuacaaauggugaaauuuaau

SEQ ID NO: 1478527 - RNA, 17 nt, Homo sapiens
ucuacaaucaguugacu

SEQ ID NO: 1478528 - RNA, 21 nt, Homo sapiens
ucuacaaucaguugacuuuaa

SEQ ID NO: 1478529 - RNA, 18 nt, Homo sapiens
ucuacaggccagcaccuu

SEQ ID NO: 1478530 - RNA, 15 nt, Homo sapiens
ucuacauuugagggc

SEQ ID NO: 1478531 - RNA, 23 nt, Homo sapiens
ucuaccaaauaauuucauauuca

SEQ ID NO: 1478532 - RNA, 16 nt, Homo sapiens
ucuaccaggcaaauuc

SEQ ID NO: 1478533 - RNA, 16 nt, Homo sapiens
ucuaccccugcuccca

SEQ ID NO: 1478534 - RNA, 21 nt, Homo sapiens
ucuacuacaaacuucaaagag

SEQ ID NO: 1478535 - RNA, 16 nt, Homo sapiens
ucuacugaggugcuau

SEQ ID NO: 1478536 - RNA, 22 nt, Homo sapiens
ucuacugugacugauguuacau

SEQ ID NO: 1478537 - RNA, 13 nt, Homo sapiens
ucuagaacuugac

SEQ ID NO: 1478538 - RNA, 15 nt, Homo sapiens
ucuagaagacuguca

SEQ ID NO: 1478539 - RNA, 12 nt, Homo sapiens
ucuagacaacua

SEQ ID NO: 1478540 - RNA, 23 nt, Homo sapiens
ucuagacaagauauuguacauaa

SEQ ID NO: 1478541 - RNA, 22 nt, Homo sapiens
uguccugggccugccccugugu

SEQ ID NO: 1478542 - RNA, 14 nt, Homo sapiens
uguccuuucuugca

SEQ ID NO: 1478543 - RNA, 17 nt, Homo sapiens
ugucgaauuccuacuga

SEQ ID NO: 1478544 - RNA, 21 nt, Homo sapiens
ugucuaauaaaauauaaucua

SEQ ID NO: 1478545 - RNA, 22 nt, Homo sapiens
ugucuaauuaaaacacuuucaa

SEQ ID NO: 1478546 - RNA, 22 nt, Homo sapiens
ugucuauuauuaugaagaauug

SEQ ID NO: 1478547 - RNA, 20 nt, Homo sapiens
ugucuauuuuuuucaguuua

SEQ ID NO: 1478548 - RNA, 20 nt, Homo sapiens
uuucuaaaaacacacacaaa

SEQ ID NO: 1478549 - RNA, 19 nt, Homo sapiens
uuucuaacgccagcacacu

SEQ ID NO: 1478550 - RNA, 15 nt, Homo sapiens
uuucuaagacucacu

SEQ ID NO: 1478551 - RNA, 21 nt, Homo sapiens
uuucuacaacugauugcaaca

SEQ ID NO: 1478552 - RNA, 22 nt, Homo sapiens
uuucuagaaguuucccuuccuc

SEQ ID NO: 1478553 - RNA, 20 nt, Homo sapiens
uuucuaggguaaugccguag

SEQ ID NO: 1478554 - RNA, 12 nt, Homo sapiens
uuucuaugcaaa

SEQ ID NO: 1478555 - RNA, 14 nt, Homo sapiens
uuucuaugugacaa

SEQ ID NO: 1478556 - RNA, 12 nt, Homo sapiens
uuucucacugag

SEQ ID NO: 1478557 - RNA, 16 nt, Homo sapiens
uuucuccaggaccaau

SEQ ID NO: 1478558 - RNA, 20 nt, Homo sapiens
uuucuccuuuuguguuccaa

SEQ ID NO: 1478559 - RNA, 15 nt, Homo sapiens
uuucucgggugcauu

SEQ ID NO: 1478560 - RNA, 18 nt, Homo sapiens
uuucucgggugcauuuga

SEQ ID NO: 1478561 - RNA, 14 nt, Homo sapiens
uuucucuuaugcuu

SEQ ID NO: 1478562 - RNA, 12 nt, Homo sapiens
uuucugacacag

SEQ ID NO: 1478563 - RNA, 20 nt, Homo sapiens
uuucugacacagucaauucu

SEQ ID NO: 1478564 - RNA, 19 nt, Homo sapiens
uuucugcuaaaaaguccuu

SEQ ID NO: 1478565 - RNA, 18 nt, Homo sapiens
uuucuggaggucucugaa

SEQ ID NO: 1478566 - RNA, 23 nt, Homo sapiens
uuucuggaugaaugcccagugag

SEQ ID NO: 1478567 - RNA, 14 nt, Homo sapiens
uuucuggccaaaag

SEQ ID NO: 1478568 - RNA, 17 nt, Homo sapiens
uuucuggccugccuucg

SEQ ID NO: 1478569 - RNA, 18 nt, Homo sapiens
uuucuuagguaaccuuau

SEQ ID NO: 1478570 - RNA, 14 nt, Homo sapiens
uuucuuaguuacuu

SEQ ID NO: 1478571 - RNA, 14 nt, Homo sapiens
uuucuucauuaaga

SEQ ID NO: 1478572 - RNA, 13 nt, Homo sapiens
uuucuuccaugau

SEQ ID NO: 1478573 - RNA, 22 nt, Homo sapiens
uuucuucuugugauugcugcca

SEQ ID NO: 1478574 - RNA, 22 nt, Homo sapiens
uuucuuggcaaaagccuugugu

SEQ ID NO: 1478575 - RNA, 12 nt, Homo sapiens
uuucuuugccuc

SEQ ID NO: 1478576 - RNA, 19 nt, Homo sapiens
uuugaaaccaggacauuaa

SEQ ID NO: 1478577 - RNA, 22 nt, Homo sapiens
uuugaaccauccacuuacauau

SEQ ID NO: 1478578 - RNA, 19 nt, Homo sapiens
uuugaacccuugcuugcaa

SEQ ID NO: 1478579 - RNA, 18 nt, Homo sapiens
uuugaagaacaugugaga

SEQ ID NO: 1478580 - RNA, 16 nt, Homo sapiens
uuugaagagugugagg

SEQ ID NO: 1478581 - RNA, 18 nt, Homo sapiens
uuugaaucuuucuguguc

SEQ ID NO: 1478582 - RNA, 20 nt, Homo sapiens
uuugacuugcaugaagagaa

SEQ ID NO: 1478583 - RNA, 14 nt, Homo sapiens
uuugagacaggaga

SEQ ID NO: 1478584 - RNA, 13 nt, Homo sapiens
uuugagugauccu

SEQ ID NO: 1478585 - RNA, 17 nt, Homo sapiens
uuugauaccugcacugu

SEQ ID NO: 1478586 - RNA, 20 nt, Homo sapiens
uuugauaguugguguucaaa

SEQ ID NO: 1478587 - RNA, 13 nt, Homo sapiens
uuugauauuugca

SEQ ID NO: 1478588 - RNA, 21 nt, Homo sapiens
uuugauuaacaaauaugcuaa

SEQ ID NO: 1478589 - RNA, 23 nt, Homo sapiens
uuugauuuuucuaaccuugaaug

SEQ ID NO: 1478590 - RNA, 18 nt, Homo sapiens
uuugcacacuugugugug

SEQ ID NO: 1478591 - RNA, 20 nt, Homo sapiens
uuugcacaggaaagagucac

SEQ ID NO: 1478592 - RNA, 12 nt, Homo sapiens
uuugcacugagg

SEQ ID NO: 1478593 - RNA, 19 nt, Homo sapiens
uuugcagcagugagucucu

SEQ ID NO: 1478594 - RNA, 22 nt, Homo sapiens
uuugccaaggcuaauccaauua

SEQ ID NO: 1478595 - RNA, 14 nt, Homo sapiens
uuugccaguauuau

SEQ ID NO: 1478596 - RNA, 13 nt, Homo sapiens
uuugccagugccu

SEQ ID NO: 1478597 - RNA, 15 nt, Homo sapiens
uuugccuucacccau

SEQ ID NO: 1478598 - RNA, 10 nt, Homo sapiens
uuugccuucc

SEQ ID NO: 1478599 - RNA, 18 nt, Homo sapiens
uuugccuuucuucugccc

SEQ ID NO: 1478600 - RNA, 19 nt, Homo sapiens
uuugcuagacucuagacaa

SEQ ID NO: 1478601 - RNA, 17 nt, Homo sapiens
uuugcuagcaguaaaag

SEQ ID NO: 1478602 - RNA, 17 nt, Homo sapiens
uuugcugcagucaucua

SEQ ID NO: 1478603 - RNA, 17 nt, Homo sapiens
uuugcuguuaacuguua

SEQ ID NO: 1478604 - RNA, 19 nt, Homo sapiens
uuuggagacacaacuauuu

SEQ ID NO: 1478605 - RNA, 19 nt, Homo sapiens
uuuggaguccccucaccuc

SEQ ID NO: 1478606 - RNA, 21 nt, Homo sapiens
uuuggcccaaacucaucuuga

SEQ ID NO: 1478607 - RNA, 23 nt, Homo sapiens
uuuggcgaccuccuuucaucaca

SEQ ID NO: 1478608 - RNA, 13 nt, Homo sapiens
uuugggaugacca

SEQ ID NO: 1478609 - RNA, 13 nt, Homo sapiens
uuugggccagaca

SEQ ID NO: 1478610 - RNA, 15 nt, Homo sapiens
uuuggguaacuucaa

SEQ ID NO: 1478611 - RNA, 14 nt, Homo sapiens
uuuggucacacucu

SEQ ID NO: 1478612 - RNA, 16 nt, Homo sapiens
uuuggucaguuacaaa

SEQ ID NO: 1478613 - RNA, 19 nt, Homo sapiens
uuugguucucuccaggaag

SEQ ID NO: 1478614 - RNA, 19 nt, Homo sapiens
uuuguaaaaauguccccac

SEQ ID NO: 1478615 - RNA, 17 nt, Homo sapiens
uuuguaaaucugccaca

SEQ ID NO: 1478616 - RNA, 18 nt, Homo sapiens
uuuguaaaucugccacaa

SEQ ID NO: 1478617 - RNA, 13 nt, Homo sapiens
uuuguaaugcugc

SEQ ID NO: 1478618 - RNA, 15 nt, Homo sapiens
uuuguacacugcugu

SEQ ID NO: 1478619 - RNA, 16 nt, Homo sapiens
uuuguacacugcugua

SEQ ID NO: 1478620 - RNA, 19 nt, Homo sapiens
uuuguauaaaauagacaaa

SEQ ID NO: 1478621 - RNA, 19 nt, Homo sapiens
uuugugauagcacuuucua

SEQ ID NO: 1478622 - RNA, 19 nt, Homo sapiens
uuugugcuugucauuccag

SEQ ID NO: 1478623 - RNA, 13 nt, Homo sapiens
uuuguggccucag

SEQ ID NO: 1478624 - RNA, 16 nt, Homo sapiens
uuuguuacuuccuuau

SEQ ID NO: 1478625 - RNA, 12 nt, Homo sapiens
uuuguuguaaaa

SEQ ID NO: 1478626 - RNA, 16 nt, Homo sapiens
uuuguuuaagcugacu

SEQ ID NO: 1478627 - RNA, 13 nt, Homo sapiens
uuuguuucaauga

SEQ ID NO: 1478628 - RNA, 21 nt, Homo sapiens
uuuguuuuaauaaacaguaua

SEQ ID NO: 1478629 - RNA, 22 nt, Homo sapiens
uuuguuuugauguuuguggccu

SEQ ID NO: 1478630 - RNA, 18 nt, Homo sapiens
uuuguuuuuuaagggagg

SEQ ID NO: 1478631 - RNA, 23 nt, Homo sapiens
uuuuaaaaacuccuuuugguuua

SEQ ID NO: 1478632 - RNA, 17 nt, Homo sapiens
uuuuaaacaaaugugau

SEQ ID NO: 1478633 - RNA, 13 nt, Homo sapiens
uuuuaaagacaaa

SEQ ID NO: 1478634 - RNA, 16 nt, Homo sapiens
uuuuaaaguguuucag

SEQ ID NO: 1478635 - RNA, 14 nt, Homo sapiens
uuuuaaaugacuug

SEQ ID NO: 1478636 - RNA, 17 nt, Homo sapiens
uuuuaacucaccucuca

SEQ ID NO: 1478637 - RNA, 17 nt, Homo sapiens
uuuuaagaagacauacu

SEQ ID NO: 1478638 - RNA, 15 nt, Homo sapiens
uuuuaaggauguugc

SEQ ID NO: 1478639 - RNA, 20 nt, Homo sapiens
uuuuaaggcuaaaacuuaac

SEQ ID NO: 1478640 - RNA, 15 nt, Homo sapiens
uuuuaagugccuuua

SEQ ID NO: 1478641 - RNA, 20 nt, Homo sapiens
uuuuaauccuuaacacauuc

SEQ ID NO: 1478642 - RNA, 15 nt, Homo sapiens
uuuuaauuugaugaa

SEQ ID NO: 1478643 - RNA, 18 nt, Homo sapiens
uuuuaccugcccaaggau

SEQ ID NO: 1478644 - RNA, 12 nt, Homo sapiens
uuuuaggcaaag

SEQ ID NO: 1478645 - RNA, 23 nt, Homo sapiens
uuuuagguagaaaaacauauucu

SEQ ID NO: 1478646 - RNA, 16 nt, Homo sapiens
uuuuaguugacucaca

SEQ ID NO: 1478647 - RNA, 23 nt, Homo sapiens
uguaaaucugccacaaaaacagg

SEQ ID NO: 1478648 - RNA, 23 nt, Homo sapiens
uguaacagcggcaggguguccca

SEQ ID NO: 1478649 - RNA, 20 nt, Homo sapiens
uguaaccuguugcuguguuu

SEQ ID NO: 1478650 - RNA, 16 nt, Homo sapiens
uguaacguggcacugg

SEQ ID NO: 1478651 - RNA, 21 nt, Homo sapiens
uguaacugacugccuugcuaa

SEQ ID NO: 1478652 - RNA, 19 nt, Homo sapiens
uguaacuguaaaacauuga

SEQ ID NO: 1478653 - RNA, 18 nt, Homo sapiens
uguaagaaggcaauauua

SEQ ID NO: 1478654 - RNA, 15 nt, Homo sapiens
uguaagugcugcuau

SEQ ID NO: 1478655 - RNA, 16 nt, Homo sapiens
uguaagugcugcuaua

SEQ ID NO: 1478656 - RNA, 13 nt, Homo sapiens
ugggauacagauc

SEQ ID NO: 1478657 - RNA, 17 nt, Homo sapiens
ugggauaguguucugcu

SEQ ID NO: 1478658 - RNA, 14 nt, Homo sapiens
ugggauuacaggca

SEQ ID NO: 1478659 - RNA, 21 nt, Homo sapiens
ugggcaacagagcaagacucc

SEQ ID NO: 1478660 - RNA, 19 nt, Homo sapiens
ugggcacacgcacaaacac

SEQ ID NO: 1478661 - RNA, 15 nt, Homo sapiens
ugggcaccagcucau

SEQ ID NO: 1478662 - RNA, 19 nt, Homo sapiens
ugggcaccagcucaugcca

SEQ ID NO: 1478663 - RNA, 16 nt, Homo sapiens
ugggcaccucagaaag

SEQ ID NO: 1478664 - RNA, 21 nt, Homo sapiens
ugggcaccuuccuaauaugcu

SEQ ID NO: 1478665 - RNA, 23 nt, Homo sapiens
ugggcacuggagcaugcagagga

SEQ ID NO: 1478666 - RNA, 16 nt, Homo sapiens
ugggcacuucaucuga

SEQ ID NO: 1478667 - RNA, 17 nt, Homo sapiens
uccuagucauucuuccc

SEQ ID NO: 1478668 - RNA, 18 nt, Homo sapiens
uccucaauaaacauuuca

SEQ ID NO: 1478669 - RNA, 21 nt, Homo sapiens
uccucacacacccugagguca

SEQ ID NO: 1478670 - RNA, 13 nt, Homo sapiens
uccucacuuccau

SEQ ID NO: 1478671 - RNA, 13 nt, Homo sapiens
uccucacuuugaa

SEQ ID NO: 1478672 - RNA, 16 nt, Homo sapiens
uccucagaggacaguu

SEQ ID NO: 1478673 - RNA, 11 nt, Homo sapiens
uccucagggag

SEQ ID NO: 1478674 - RNA, 21 nt, Homo sapiens
uccucaggguggggggugaca

SEQ ID NO: 1478675 - RNA, 21 nt, Homo sapiens
uccucaggugauuuguaugcu

SEQ ID NO: 1478676 - RNA, 13 nt, Homo sapiens
uccucauuccuga

SEQ ID NO: 1478677 - RNA, 16 nt, Homo sapiens
uccucauuuacuggau

SEQ ID NO: 1478678 - RNA, 14 nt, Homo sapiens
uccuccaagcuauu

SEQ ID NO: 1478679 - RNA, 17 nt, Homo sapiens
uccuccacaauagcaga

SEQ ID NO: 1478680 - RNA, 16 nt, Homo sapiens
uccuccagcaccauag

SEQ ID NO: 1478681 - RNA, 13 nt, Homo sapiens
uccucccauuucu

SEQ ID NO: 1478682 - RNA, 11 nt, Homo sapiens
uccuccccaaa

SEQ ID NO: 1478683 - RNA, 20 nt, Homo sapiens
uccucccuuccuuuucccug

SEQ ID NO: 1478684 - RNA, 16 nt, Homo sapiens
uccuccguccauauca

SEQ ID NO: 1478685 - RNA, 20 nt, Homo sapiens
uccuccuggaacagaagaca

SEQ ID NO: 1478686 - RNA, 14 nt, Homo sapiens
uccuccuugcccag

SEQ ID NO: 1478687 - RNA, 17 nt, Homo sapiens
uccucguuccuuucucc

SEQ ID NO: 1478688 - RNA, 22 nt, Homo sapiens
uccucuaguaagaugcacugaa

SEQ ID NO: 1478689 - RNA, 22 nt, Homo sapiens
uccucucccccuccuccaggga

SEQ ID NO: 1478690 - RNA, 16 nt, Homo sapiens
uccucuucaccaggug

SEQ ID NO: 1478691 - RNA, 13 nt, Homo sapiens
uaaagucugaauc

SEQ ID NO: 1478692 - RNA, 15 nt, Homo sapiens
uaaagugacuuucua

SEQ ID NO: 1478693 - RNA, 14 nt, Homo sapiens
uaaagugcuugcuu

SEQ ID NO: 1478694 - RNA, 14 nt, Homo sapiens
uaaaguuacuugaa

SEQ ID NO: 1478695 - RNA, 14 nt, Homo sapiens
uaaaguuggaauuu

SEQ ID NO: 1478696 - RNA, 18 nt, Homo sapiens
uaaaguuuaaaguugcac

SEQ ID NO: 1478697 - RNA, 18 nt, Homo sapiens
uaaauaaaguuacuugaa

SEQ ID NO: 1478698 - RNA, 11 nt, Homo sapiens
uaaauacaggu

SEQ ID NO: 1478699 - RNA, 16 nt, Homo sapiens
uaaauacugcuugacc

SEQ ID NO: 1478700 - RNA, 22 nt, Homo sapiens
uaaauacuguaaaugcauugga

SEQ ID NO: 1478701 - RNA, 15 nt, Homo sapiens
uaaauagaacuaucu

SEQ ID NO: 1478702 - RNA, 12 nt, Homo sapiens
uaaauagccuuc

SEQ ID NO: 1478703 - RNA, 18 nt, Homo sapiens
uaaauagccuucaaaaag

SEQ ID NO: 1478704 - RNA, 22 nt, Homo sapiens
uaaauaguauuugagaguucua

SEQ ID NO: 1478705 - RNA, 16 nt, Homo sapiens
uaaauauagagaugug

SEQ ID NO: 1478706 - RNA, 24 nt, Homo sapiens
uaaauaucacaguauuaucugugu

SEQ ID NO: 1478707 - RNA, 15 nt, Homo sapiens
uaaauaucugucaua

SEQ ID NO: 1478708 - RNA, 18 nt, Homo sapiens
uaaauauuuauguagaug

SEQ ID NO: 1478709 - RNA, 17 nt, Homo sapiens
uaaauauuucaggcaua

SEQ ID NO: 1478710 - RNA, 19 nt, Homo sapiens
uaaauauuucucaacugag

SEQ ID NO: 1478711 - RNA, 15 nt, Homo sapiens
uaaaucacacauuca

SEQ ID NO: 1478712 - RNA, 20 nt, Homo sapiens
uaaaucagagagcaaggcau

SEQ ID NO: 1478713 - RNA, 13 nt, Homo sapiens
uaaaucauauuag

SEQ ID NO: 1478714 - RNA, 18 nt, Homo sapiens
uaaaucauauuaguauua

SEQ ID NO: 1478715 - RNA, 15 nt, Homo sapiens
uaaaugaagcagcuu

SEQ ID NO: 1478716 - RNA, 18 nt, Homo sapiens
uaaaugauagacaauuga

SEQ ID NO: 1478717 - RNA, 18 nt, Homo sapiens
uaaaugcuacauacucca

SEQ ID NO: 1478718 - RNA, 14 nt, Homo sapiens
uaaauguacauuaa

SEQ ID NO: 1478719 - RNA, 14 nt, Homo sapiens
uaaauguauacuau

SEQ ID NO: 1478720 - RNA, 17 nt, Homo sapiens
uaaauguauacuauagu

SEQ ID NO: 1478721 - RNA, 14 nt, Homo sapiens
uaaauguaucuuau

SEQ ID NO: 1478722 - RNA, 22 nt, Homo sapiens
ucccagugaccccugaccucac

SEQ ID NO: 1478723 - RNA, 16 nt, Homo sapiens
ucccauagccaggaaa

SEQ ID NO: 1478724 - RNA, 15 nt, Homo sapiens
ucccaucacuucccu

SEQ ID NO: 1478725 - RNA, 14 nt, Homo sapiens
ucccauccaucagc

SEQ ID NO: 1478726 - RNA, 15 nt, Homo sapiens
ucccauggaaccacu

SEQ ID NO: 1478727 - RNA, 16 nt, Homo sapiens
ucccauggacacucca

SEQ ID NO: 1478728 - RNA, 17 nt, Homo sapiens
ucccauggacacuccag

SEQ ID NO: 1478729 - RNA, 12 nt, Homo sapiens
ucccauucuugg

SEQ ID NO: 1478730 - RNA, 17 nt, Homo sapiens
ucccauuucaucagcaa

SEQ ID NO: 1478731 - RNA, 16 nt, Homo sapiens
uccccaaccacuucau

SEQ ID NO: 1478732 - RNA, 19 nt, Homo sapiens
uccccacccagucucaugu

SEQ ID NO: 1478733 - RNA, 16 nt, Homo sapiens
uccccagcccagagac

SEQ ID NO: 1478734 - RNA, 21 nt, Homo sapiens
uccccagcccagagacauacu

SEQ ID NO: 1478735 - RNA, 19 nt, Homo sapiens
uccccaucuggguccuugc

SEQ ID NO: 1478736 - RNA, 14 nt, Homo sapiens
ucccccaaccucag

SEQ ID NO: 1478737 - RNA, 13 nt, Homo sapiens
uccccccaguggg

SEQ ID NO: 1478738 - RNA, 14 nt, Homo sapiens
uccccccaguggga

SEQ ID NO: 1478739 - RNA, 12 nt, Homo sapiens
ucccccccaugc

SEQ ID NO: 1478740 - RNA, 17 nt, Homo sapiens
ucccccucucugcccug

SEQ ID NO: 1478741 - RNA, 19 nt, Homo sapiens
ucccccuuugugcacauuu

SEQ ID NO: 1478742 - RNA, 13 nt, Homo sapiens
uccccgugccaaa

SEQ ID NO: 1478743 - RNA, 14 nt, Homo sapiens
uccccucacucugu

SEQ ID NO: 1478744 - RNA, 16 nt, Homo sapiens
uccccuccacauccca

SEQ ID NO: 1478745 - RNA, 13 nt, Homo sapiens
uccccucccagau

SEQ ID NO: 1478746 - RNA, 22 nt, Homo sapiens
uccccucccuggcucccaugac

SEQ ID NO: 1478747 - RNA, 16 nt, Homo sapiens
uccccugaccugugag

SEQ ID NO: 1478748 - RNA, 12 nt, Homo sapiens
uccccuguguca

SEQ ID NO: 1478749 - RNA, 19 nt, Homo sapiens
uccccuugccuaaauacaa

SEQ ID NO: 1478750 - RNA, 15 nt, Homo sapiens
uccccuuggcuguga

SEQ ID NO: 1478751 - RNA, 19 nt, Homo sapiens
uccccuuuugccaaucuca

SEQ ID NO: 1478752 - RNA, 20 nt, Homo sapiens
ucccgaguagcugggauuac

SEQ ID NO: 1478753 - RNA, 15 nt, Homo sapiens
ucccgaugcugcuau

SEQ ID NO: 1478754 - RNA, 19 nt, Homo sapiens
ucccgauucccaacugagu

SEQ ID NO: 1478755 - RNA, 14 nt, Homo sapiens
ucccgccucagggc

SEQ ID NO: 1478756 - RNA, 16 nt, Homo sapiens
ucccggguguguacac

SEQ ID NO: 1478757 - RNA, 20 nt, Homo sapiens
ucccuacauggaguauaugu

SEQ ID NO: 1478758 - RNA, 14 nt, Homo sapiens
ucccucagcucucu

SEQ ID NO: 1478759 - RNA, 22 nt, Homo sapiens
ucccucccccccaugcacugug

SEQ ID NO: 1478760 - RNA, 17 nt, Homo sapiens
ucccucgggugugcuau

SEQ ID NO: 1478761 - RNA, 14 nt, Homo sapiens
ucccucucaugacu

SEQ ID NO: 1478762 - RNA, 23 nt, Homo sapiens
ucccugcacuaaagccagccuga

SEQ ID NO: 1478763 - RNA, 14 nt, Homo sapiens
ucccugcagaccuc

SEQ ID NO: 1478764 - RNA, 12 nt, Homo sapiens
ucccugccacau

SEQ ID NO: 1478765 - RNA, 17 nt, Homo sapiens
ucccugccaccaggcac

SEQ ID NO: 1478766 - RNA, 22 nt, Homo sapiens
ucccugcccaccuccuggagaa

SEQ ID NO: 1478767 - RNA, 21 nt, Homo sapiens
ucccugccugugacuuucaag

SEQ ID NO: 1478768 - RNA, 19 nt, Homo sapiens
ucccugcgccugugaugcu

SEQ ID NO: 1478769 - RNA, 15 nt, Homo sapiens
ucccugcugugccau

SEQ ID NO: 1478770 - RNA, 21 nt, Homo sapiens
ucccuggaucacgacgcugca

SEQ ID NO: 1478771 - RNA, 18 nt, Homo sapiens
ucccugugucauuucaaa

SEQ ID NO: 1478772 - RNA, 19 nt, Homo sapiens
ucccuugccucaaugccag

SEQ ID NO: 1478773 - RNA, 16 nt, Homo sapiens
ucccuuggccucagaa

SEQ ID NO: 1478774 - RNA, 15 nt, Homo sapiens
ucccuugguggcaag

SEQ ID NO: 1478775 - RNA, 18 nt, Homo sapiens
ucccuuuccccagcauca

SEQ ID NO: 1478776 - RNA, 18 nt, Homo sapiens
ucccuuuccuacucucag

SEQ ID NO: 1478777 - RNA, 19 nt, Homo sapiens
ucccuuuguugcacacuca

SEQ ID NO: 1478778 - RNA, 21 nt, Homo sapiens
ucccuuuguugcacacucacu

SEQ ID NO: 1478779 - RNA, 14 nt, Homo sapiens
ucccuuuucccuua

SEQ ID NO: 1478780 - RNA, 22 nt, Homo sapiens
ucccuuuugcuagagcugacag

SEQ ID NO: 1478781 - RNA, 17 nt, Homo sapiens
ucccuuuuuauauccca

SEQ ID NO: 1478782 - RNA, 19 nt, Homo sapiens
ucccuuuuucaaugaauuu

SEQ ID NO: 1478783 - RNA, 16 nt, Homo sapiens
uccgacugcuagggag

SEQ ID NO: 1478784 - RNA, 23 nt, Homo sapiens
uccgcagaagcccugaugugucc

SEQ ID NO: 1478785 - RNA, 17 nt, Homo sapiens
uccgcgcaggugccaac

SEQ ID NO: 1478786 - RNA, 21 nt, Homo sapiens
uccggaagcugucgacuucau

SEQ ID NO: 1478787 - RNA, 20 nt, Homo sapiens
uccggagugagcaauggagu

SEQ ID NO: 1478788 - RNA, 15 nt, Homo sapiens
uccguagacuguuua

SEQ ID NO: 1478789 - RNA, 20 nt, Homo sapiens
uccgucaguccaagucuucu

SEQ ID NO: 1478790 - RNA, 15 nt, Homo sapiens
uccuaaacccaauga

SEQ ID NO: 1478791 - RNA, 14 nt, Homo sapiens
uccuaacaaaagau

SEQ ID NO: 1478792 - RNA, 16 nt, Homo sapiens
uccuaagcuauucagu

SEQ ID NO: 1478793 - RNA, 18 nt, Homo sapiens
uccuaaugucagaacaga

SEQ ID NO: 1478794 - RNA, 14 nt, Homo sapiens
uccuaccagcaaag

SEQ ID NO: 1478795 - RNA, 20 nt, Homo sapiens
uccuaccuguuuugugguca

SEQ ID NO: 1478796 - RNA, 16 nt, Homo sapiens
uccuacucacacuuca

SEQ ID NO: 1478797 - RNA, 23 nt, Homo sapiens
uccuaggaugucaugucugcuug

SEQ ID NO: 1478798 - RNA, 13 nt, Homo sapiens
uccuagucauucu

SEQ ID NO: 1478799 - RNA, 20 nt, Homo sapiens
guuuugauuuguagcacuga

SEQ ID NO: 1478800 - RNA, 15 nt, Homo sapiens
guuuugcuacauucu

SEQ ID NO: 1478801 - RNA, 16 nt, Homo sapiens
guuuugcuacauucua

SEQ ID NO: 1478802 - RNA, 23 nt, Homo sapiens
guuuuggaagcucugaagucaca

SEQ ID NO: 1478803 - RNA, 22 nt, Homo sapiens
guuuuuaaaaaggucauauauu

SEQ ID NO: 1478804 - RNA, 14 nt, Homo sapiens
guuuuuagcuggug

SEQ ID NO: 1478805 - RNA, 22 nt, Homo sapiens
uaaaaaagccugguuuuucuca

SEQ ID NO: 1478806 - RNA, 15 nt, Homo sapiens
uaaaaaagccuuccu

SEQ ID NO: 1478807 - RNA, 19 nt, Homo sapiens
uaaaaaccccaaacuguug

SEQ ID NO: 1478808 - RNA, 14 nt, Homo sapiens
uaaaaagcuuccau

SEQ ID NO: 1478809 - RNA, 21 nt, Homo sapiens
uaaaaaggaaacuucaguuga

SEQ ID NO: 1478810 - RNA, 22 nt, Homo sapiens
uaaaaagggcagggcaucuccu

SEQ ID NO: 1478811 - RNA, 16 nt, Homo sapiens
uaaaaauaaugcauuu

SEQ ID NO: 1478812 - RNA, 13 nt, Homo sapiens
uaaaaauagacac

SEQ ID NO: 1478813 - RNA, 22 nt, Homo sapiens
uaaaaauauauagcgacauccu

SEQ ID NO: 1478814 - RNA, 16 nt, Homo sapiens
uaaaaaucacacugua

SEQ ID NO: 1478815 - RNA, 18 nt, Homo sapiens
uaaaaauggauacuggug

SEQ ID NO: 1478816 - RNA, 20 nt, Homo sapiens
uaaaaauuccaaauggacua

SEQ ID NO: 1478817 - RNA, 15 nt, Homo sapiens
uaaaaauugugauca

SEQ ID NO: 1478818 - RNA, 23 nt, Homo sapiens
uaaaaauugugaucagaccauaa

SEQ ID NO: 1478819 - RNA, 23 nt, Homo sapiens
uaaaacaaaaucugaacucucaa

SEQ ID NO: 1478820 - RNA, 19 nt, Homo sapiens
uaaaacauugaaugaaacu

SEQ ID NO: 1478821 - RNA, 18 nt, Homo sapiens
uaaaaccugugugccauu

SEQ ID NO: 1478822 - RNA, 20 nt, Homo sapiens
uaaaacuaaauguaauuuau

SEQ ID NO: 1478823 - RNA, 15 nt, Homo sapiens
uaaaacuaagcacaa

SEQ ID NO: 1478824 - RNA, 16 nt, Homo sapiens
uaaaacuaagcacaaa

SEQ ID NO: 1478825 - RNA, 16 nt, Homo sapiens
uaaaacuacaugguca

SEQ ID NO: 1478826 - RNA, 19 nt, Homo sapiens
uaaaacuacauggucaaca

SEQ ID NO: 1478827 - RNA, 20 nt, Homo sapiens
uaaaacuagugacagcuugu

SEQ ID NO: 1478828 - RNA, 16 nt, Homo sapiens
gugggagggacuuugc

SEQ ID NO: 1478829 - RNA, 20 nt, Homo sapiens
gugggaucugucacaccagc

SEQ ID NO: 1478830 - RNA, 17 nt, Homo sapiens
gugggcaaacaggcagu

SEQ ID NO: 1478831 - RNA, 23 nt, Homo sapiens
gugggccagggcugcccugagaa

SEQ ID NO: 1478832 - RNA, 21 nt, Homo sapiens
guggggguaaggugcaucugu

SEQ ID NO: 1478833 - RNA, 19 nt, Homo sapiens
gugggugaaacagaacaau

SEQ ID NO: 1478834 - RNA, 11 nt, Homo sapiens
guggguggugg

SEQ ID NO: 1478835 - RNA, 12 nt, Homo sapiens
guggguggugga

SEQ ID NO: 1478836 - RNA, 14 nt, Homo sapiens
gugguacagcacug

SEQ ID NO: 1478837 - RNA, 20 nt, Homo sapiens
gugguauguaauuuaugcaa

SEQ ID NO: 1478838 - RNA, 15 nt, Homo sapiens
guggucaucauggcc

SEQ ID NO: 1478839 - RNA, 14 nt, Homo sapiens
guggucccugagga

SEQ ID NO: 1478840 - RNA, 17 nt, Homo sapiens
guggucuccaccuguca

SEQ ID NO: 1478841 - RNA, 18 nt, Homo sapiens
gugguggagaaccacagc

SEQ ID NO: 1478842 - RNA, 15 nt, Homo sapiens
guggugggcagguga

SEQ ID NO: 1478843 - RNA, 17 nt, Homo sapiens
gugguguuuauugcaau

SEQ ID NO: 1478844 - RNA, 21 nt, Homo sapiens
gugguugauuuuaaugaaugc

SEQ ID NO: 1478845 - RNA, 21 nt, Homo sapiens
gugguugucuuauugcaccau

SEQ ID NO: 1478846 - RNA, 18 nt, Homo sapiens
guguaaaauacguuugaa

SEQ ID NO: 1478847 - RNA, 19 nt, Homo sapiens
guguaaggaaggugcucac

SEQ ID NO: 1478848 - RNA, 15 nt, Homo sapiens
guguaccuccucuca

SEQ ID NO: 1478849 - RNA, 20 nt, Homo sapiens
guguaccuccucucaguguu

SEQ ID NO: 1478850 - RNA, 23 nt, Homo sapiens
guguaugugagagauucugugau

SEQ ID NO: 1478851 - RNA, 14 nt, Homo sapiens
gugucaaaagccag

SEQ ID NO: 1478852 - RNA, 20 nt, Homo sapiens
gugucaacuaaaugagauua

SEQ ID NO: 1478853 - RNA, 15 nt, Homo sapiens
gugucacuugugcuu

SEQ ID NO: 1478854 - RNA, 22 nt, Homo sapiens
guguccaugugcacccggccug

SEQ ID NO: 1478855 - RNA, 16 nt, Homo sapiens
guguccccuccacugu

SEQ ID NO: 1478856 - RNA, 14 nt, Homo sapiens
guguccucagggag

SEQ ID NO: 1478857 - RNA, 23 nt, Homo sapiens
gugucucagggugcagaggucag

SEQ ID NO: 1478858 - RNA, 18 nt, Homo sapiens
gugucucugaggacguca

SEQ ID NO: 1478859 - RNA, 12 nt, Homo sapiens
gugucugucagc

SEQ ID NO: 1478860 - RNA, 16 nt, Homo sapiens
gugucuguugcuugua

SEQ ID NO: 1478861 - RNA, 15 nt, Homo sapiens
gugucuuaggguaga

SEQ ID NO: 1478862 - RNA, 15 nt, Homo sapiens
gugugaaugugggca

SEQ ID NO: 1478863 - RNA, 17 nt, Homo sapiens
gugugaccccacugcca

SEQ ID NO: 1478864 - RNA, 22 nt, Homo sapiens
gugugaucuuaauauauuugaa

SEQ ID NO: 1478865 - RNA, 14 nt, Homo sapiens
gugugccauuuuaa

SEQ ID NO: 1478866 - RNA, 14 nt, Homo sapiens
guguggagcuguau

SEQ ID NO: 1478867 - RNA, 23 nt, Homo sapiens
guguggauuuucuacuguaagaa

SEQ ID NO: 1478868 - RNA, 22 nt, Homo sapiens
guguggcccagggaagccaaaa

SEQ ID NO: 1478869 - RNA, 15 nt, Homo sapiens
guguggccugccuuc

SEQ ID NO: 1478870 - RNA, 20 nt, Homo sapiens
gugugggggaggcgcacagu

SEQ ID NO: 1478871 - RNA, 18 nt, Homo sapiens
guguggguggaagggcug

SEQ ID NO: 1478872 - RNA, 11 nt, Homo sapiens
gugugguggcu

SEQ ID NO: 1478873 - RNA, 18 nt, Homo sapiens
gugugucgcgcacacagc

SEQ ID NO: 1478874 - RNA, 22 nt, Homo sapiens
guguucaauccagagagcuuaa

SEQ ID NO: 1478875 - RNA, 19 nt, Homo sapiens
guguucuacacucaucuua

SEQ ID NO: 1478876 - RNA, 14 nt, Homo sapiens
guguugaccacaga

SEQ ID NO: 1478877 - RNA, 23 nt, Homo sapiens
guguuucuuccccuuacucucac

SEQ ID NO: 1478878 - RNA, 12 nt, Homo sapiens
guuaacaucuca

SEQ ID NO: 1478879 - RNA, 18 nt, Homo sapiens
guuaaccccauguccuca

SEQ ID NO: 1478880 - RNA, 16 nt, Homo sapiens
guuaaccucaguguca

SEQ ID NO: 1478881 - RNA, 23 nt, Homo sapiens
guuaaccuuuuuguaaauacugc

SEQ ID NO: 1478882 - RNA, 18 nt, Homo sapiens
guuaaggguuaguuuaca

SEQ ID NO: 1478883 - RNA, 16 nt, Homo sapiens
guuaauaccagcuuaa

SEQ ID NO: 1478884 - RNA, 17 nt, Homo sapiens
guuaauauugugcaaac

SEQ ID NO: 1478885 - RNA, 24 nt, Homo sapiens
guuaauauuuauuaagugacuaua

SEQ ID NO: 1478886 - RNA, 20 nt, Homo sapiens
guuaauucaccuauguuauu

SEQ ID NO: 1478887 - RNA, 22 nt, Homo sapiens
guuaauuuuuccuauauugcau

SEQ ID NO: 1478888 - RNA, 22 nt, Homo sapiens
guuacauaagauaaaugugcug

SEQ ID NO: 1478889 - RNA, 21 nt, Homo sapiens
guuacaucacaguguuugcaa

SEQ ID NO: 1478890 - RNA, 15 nt, Homo sapiens
guuacaucugugcag

SEQ ID NO: 1478891 - RNA, 21 nt, Homo sapiens
guuacauuucuaucaguacuu

SEQ ID NO: 1478892 - RNA, 15 nt, Homo sapiens
guuaccaacuaccua

SEQ ID NO: 1478893 - RNA, 15 nt, Homo sapiens
guuacugaccagcaa

SEQ ID NO: 1478894 - RNA, 18 nt, Homo sapiens
guuacugaucuuacucac

SEQ ID NO: 1478895 - RNA, 16 nt, Homo sapiens
guuagccucacccggu

SEQ ID NO: 1478896 - RNA, 21 nt, Homo sapiens
guuaguugugaaagaaagcug

SEQ ID NO: 1478897 - RNA, 16 nt, Homo sapiens
guuaguuuacaauauu

SEQ ID NO: 1478898 - RNA, 18 nt, Homo sapiens
guuauaaaucaaugucac

SEQ ID NO: 1478899 - RNA, 23 nt, Homo sapiens
guuaugauauuguuuaaaauuca

SEQ ID NO: 1478900 - RNA, 17 nt, Homo sapiens
guuaugauguaaucucu

SEQ ID NO: 1478901 - RNA, 17 nt, Homo sapiens
gccacaguagaacuguc

SEQ ID NO: 1478902 - RNA, 13 nt, Homo sapiens
gccacaguggcca

SEQ ID NO: 1478903 - RNA, 18 nt, Homo sapiens
gccacauuucugaucaga

SEQ ID NO: 1478904 - RNA, 22 nt, Homo sapiens
gccaccaguguccuccaagugc

SEQ ID NO: 1478905 - RNA, 16 nt, Homo sapiens
gccacgaggugcaaca

SEQ ID NO: 1478906 - RNA, 22 nt, Homo sapiens
gccacgugggcaaacaggcagu

SEQ ID NO: 1478907 - RNA, 16 nt, Homo sapiens
gccacucuuagcuaaa

SEQ ID NO: 1478908 - RNA, 21 nt, Homo sapiens
gccacucuuagcuaaaucccu

SEQ ID NO: 1478909 - RNA, 15 nt, Homo sapiens
gccacuucggccagg

SEQ ID NO: 1478910 - RNA, 13 nt, Homo sapiens
gccagaauacugg

SEQ ID NO: 1478911 - RNA, 17 nt, Homo sapiens
gccagagauccaaaaga

SEQ ID NO: 1478912 - RNA, 17 nt, Homo sapiens
gccagaggaacugucca

SEQ ID NO: 1478913 - RNA, 13 nt, Homo sapiens
gccagaggcagcu

SEQ ID NO: 1478914 - RNA, 16 nt, Homo sapiens
gccagaggugcuucac

SEQ ID NO: 1478915 - RNA, 19 nt, Homo sapiens
gccagaguggccuggccag

SEQ ID NO: 1478916 - RNA, 16 nt, Homo sapiens
gccagcaaggcagguu

SEQ ID NO: 1478917 - RNA, 14 nt, Homo sapiens
gccagcaccacuuc

SEQ ID NO: 1478918 - RNA, 19 nt, Homo sapiens
gccagcaccugcccagugg

SEQ ID NO: 1478919 - RNA, 19 nt, Homo sapiens
gccagcagggcaucuugga

SEQ ID NO: 1478920 - RNA, 16 nt, Homo sapiens
gccagcucagucccau

SEQ ID NO: 1478921 - RNA, 17 nt, Homo sapiens
gccagcugugcacuuuc

SEQ ID NO: 1478922 - RNA, 14 nt, Homo sapiens
gccaggaagccaga

SEQ ID NO: 1478923 - RNA, 11 nt, Homo sapiens
gccaggagcuc

SEQ ID NO: 1478924 - RNA, 20 nt, Homo sapiens
gccaggcaggugccuggaca

SEQ ID NO: 1478925 - RNA, 19 nt, Homo sapiens
gccaggccagagggcagug

SEQ ID NO: 1478926 - RNA, 20 nt, Homo sapiens
gccaggcugccaaggccaga

SEQ ID NO: 1478927 - RNA, 21 nt, Homo sapiens
gccaggcuggucucaaacucc

SEQ ID NO: 1478928 - RNA, 16 nt, Homo sapiens
gccagggcugcccuga

SEQ ID NO: 1478929 - RNA, 21 nt, Homo sapiens
gccagggggaugccacuccuc

SEQ ID NO: 1478930 - RNA, 23 nt, Homo sapiens
gccaggucacccuuugcugugag

SEQ ID NO: 1478931 - RNA, 18 nt, Homo sapiens
gccagguugggggcagug

SEQ ID NO: 1478932 - RNA, 15 nt, Homo sapiens
gccaguauuaugcau

SEQ ID NO: 1478933 - RNA, 19 nt, Homo sapiens
gccaguccugccuggccag

SEQ ID NO: 1478934 - RNA, 11 nt, Homo sapiens
gccagugacag

SEQ ID NO: 1478935 - RNA, 21 nt, Homo sapiens
gccaguggugcuaaaugcuac

SEQ ID NO: 1478936 - RNA, 13 nt, Homo sapiens
gccauaauguugc

SEQ ID NO: 1478937 - RNA, 13 nt, Homo sapiens
gccauacugccuu

SEQ ID NO: 1478938 - RNA, 18 nt, Homo sapiens
gccaucaaaaugcuuuuu

SEQ ID NO: 1478939 - RNA, 14 nt, Homo sapiens
gccaucacuagaag

SEQ ID NO: 1478940 - RNA, 17 nt, Homo sapiens
gccauccucccaagggg

SEQ ID NO: 1478941 - RNA, 20 nt, Homo sapiens
gccaucggugaaacuaacag

SEQ ID NO: 1478942 - RNA, 22 nt, Homo sapiens
gccaugauggccuuacacugaa

SEQ ID NO: 1478943 - RNA, 13 nt, Homo sapiens
gccaugccaggaa

SEQ ID NO: 1478944 - RNA, 15 nt, Homo sapiens
gccaugcugggccac

SEQ ID NO: 1478945 - RNA, 12 nt, Homo sapiens
gccauggcagcg

SEQ ID NO: 1478946 - RNA, 19 nt, Homo sapiens
gccauuccacuccacucag

SEQ ID NO: 1478947 - RNA, 22 nt, Homo sapiens
gccauuccacuccacucagguu

SEQ ID NO: 1478948 - RNA, 17 nt, Homo sapiens
gcccaacuccaccagau

SEQ ID NO: 1478949 - RNA, 22 nt, Homo sapiens
gcccacagcugagaauguggaa

SEQ ID NO: 1478950 - RNA, 14 nt, Homo sapiens
gcccaccaccuguc

SEQ ID NO: 1478951 - RNA, 14 nt, Homo sapiens
gcccaccagguguc

SEQ ID NO: 1478952 - RNA, 22 nt, Homo sapiens
gcccacuucaccguacuaacca

SEQ ID NO: 1478953 - RNA, 22 nt, Homo sapiens
gcccagauucuaccacacagca

SEQ ID NO: 1478954 - RNA, 23 nt, Homo sapiens
gcccagccccuacugcugugaac

SEQ ID NO: 1478955 - RNA, 23 nt, Homo sapiens
gcccagccuuguaaauaaccaca

SEQ ID NO: 1478956 - RNA, 23 nt, Homo sapiens
gcccagcuccaaggggaaucaga

SEQ ID NO: 1478957 - RNA, 21 nt, Homo sapiens
gcccaggaucguuuuuuccca

SEQ ID NO: 1478958 - RNA, 20 nt, Homo sapiens
gcccaggcuggagugcagua

SEQ ID NO: 1478959 - RNA, 20 nt, Homo sapiens
gcccaggggcccacagggaa

SEQ ID NO: 1478960 - RNA, 14 nt, Homo sapiens
gcccaggugccagc

SEQ ID NO: 1478961 - RNA, 21 nt, Homo sapiens
gcccaguguuguuuguaaaua

SEQ ID NO: 1478962 - RNA, 14 nt, Homo sapiens
gcccaucacuguau

SEQ ID NO: 1478963 - RNA, 17 nt, Homo sapiens
gcccaugugcaccugcc

SEQ ID NO: 1478964 - RNA, 16 nt, Homo sapiens
gccccaacucuuuauc

SEQ ID NO: 1478965 - RNA, 14 nt, Homo sapiens
gccccacaacuuua

SEQ ID NO: 1478966 - RNA, 13 nt, Homo sapiens
gccccacacuccc

SEQ ID NO: 1478967 - RNA, 14 nt, Homo sapiens
gccccacacucccc

SEQ ID NO: 1478968 - RNA, 20 nt, Homo sapiens
gccccaccaucuugcugaca

SEQ ID NO: 1478969 - RNA, 18 nt, Homo sapiens
gccccagaagggggcauu

SEQ ID NO: 1478970 - RNA, 23 nt, Homo sapiens
gccccagagcuguuuauggccuc

SEQ ID NO: 1478971 - RNA, 15 nt, Homo sapiens
gccccaggaccagcu

SEQ ID NO: 1478972 - RNA, 18 nt, Homo sapiens
gccccagggaucacuggc

SEQ ID NO: 1478973 - RNA, 16 nt, Homo sapiens
gccccaguccaugcuu

SEQ ID NO: 1478974 - RNA, 20 nt, Homo sapiens
gccccagugcgguuccucau

SEQ ID NO: 1478975 - RNA, 19 nt, Homo sapiens
gcccccagggccuccaggg

SEQ ID NO: 1478976 - RNA, 18 nt, Homo sapiens
gcccccaggggcaggacu

SEQ ID NO: 1478977 - RNA, 15 nt, Homo sapiens
gcccccgccccagag

SEQ ID NO: 1478978 - RNA, 15 nt, Homo sapiens
gcccccucaccucuc

SEQ ID NO: 1478979 - RNA, 16 nt, Homo sapiens
gcccccuccucuagcu

SEQ ID NO: 1478980 - RNA, 22 nt, Homo sapiens
gccccuccuagacccaggugga

SEQ ID NO: 1478981 - RNA, 22 nt, Homo sapiens
gccccugggguggccaccagua

SEQ ID NO: 1478982 - RNA, 22 nt, Homo sapiens
gccccuucuggggguggugggc

SEQ ID NO: 1478983 - RNA, 18 nt, Homo sapiens
gcccgacagccuggcaca

SEQ ID NO: 1478984 - RNA, 22 nt, Homo sapiens
gcccgcagugcugggaccagag

SEQ ID NO: 1478985 - RNA, 18 nt, Homo sapiens
cggcugaggccugagcga

SEQ ID NO: 1478986 - RNA, 16 nt, Homo sapiens
cgggagaccugugcua

SEQ ID NO: 1478987 - RNA, 13 nt, Homo sapiens
cgggagcacagcu

SEQ ID NO: 1478988 - RNA, 14 nt, Homo sapiens
cgggagccauguca

SEQ ID NO: 1478989 - RNA, 15 nt, Homo sapiens
cgggagggcggcaca

SEQ ID NO: 1478990 - RNA, 13 nt, Homo sapiens
cgggcaccuguag

SEQ ID NO: 1478991 - RNA, 16 nt, Homo sapiens
cgggccacagggcggu

SEQ ID NO: 1478992 - RNA, 16 nt, Homo sapiens
cgggcuuaccagguga

SEQ ID NO: 1478993 - RNA, 23 nt, Homo sapiens
cggggacugcuucguguucugua

SEQ ID NO: 1478994 - RNA, 15 nt, Homo sapiens
cggggagcaaaccag

SEQ ID NO: 1478995 - RNA, 20 nt, Homo sapiens
cggggaggcuccugccugag

SEQ ID NO: 1478996 - RNA, 15 nt, Homo sapiens
cggggcuccacugaa

SEQ ID NO: 1478997 - RNA, 15 nt, Homo sapiens
cggggugcuguggug

SEQ ID NO: 1478998 - RNA, 12 nt, Homo sapiens
cgggugugcuau

SEQ ID NO: 1478999 - RNA, 13 nt, Homo sapiens
cggguguguacac

SEQ ID NO: 1479000 - RNA, 14 nt, Homo sapiens
cggucccacacugg

SEQ ID NO: 1479001 - RNA, 16 nt, Homo sapiens
cggugcaugaugcugc

SEQ ID NO: 1479002 - RNA, 22 nt, Homo sapiens
cggugcucuggaagaccugaaa

SEQ ID NO: 1479003 - RNA, 22 nt, Homo sapiens
cgguggacucucauguggccaa

SEQ ID NO: 1479004 - RNA, 15 nt, Homo sapiens
cgguggcucaugccu

SEQ ID NO: 1479005 - RNA, 22 nt, Homo sapiens
cgguuuacagcuaucgaacuuc

SEQ ID NO: 1479006 - RNA, 19 nt, Homo sapiens
cgguuuuauaaaagccuug

SEQ ID NO: 1479007 - RNA, 13 nt, Homo sapiens
cguaaagauuugg

SEQ ID NO: 1479008 - RNA, 14 nt, Homo sapiens
cguaacaacugugg

SEQ ID NO: 1479009 - RNA, 16 nt, Homo sapiens
cguacaucugcaauau

SEQ ID NO: 1479010 - RNA, 13 nt, Homo sapiens
cguauagguugau

SEQ ID NO: 1479011 - RNA, 15 nt, Homo sapiens
cgucacccaacauca

SEQ ID NO: 1479012 - RNA, 17 nt, Homo sapiens
cgucaucaucacauuca

SEQ ID NO: 1479013 - RNA, 17 nt, Homo sapiens
cgucauguguuuugcca

SEQ ID NO: 1479014 - RNA, 18 nt, Homo sapiens
cguccuccguccauauca

SEQ ID NO: 1479015 - RNA, 16 nt, Homo sapiens
cguccuucuaaugaag

SEQ ID NO: 1479016 - RNA, 15 nt, Homo sapiens
cgucuccucccucag

SEQ ID NO: 1479017 - RNA, 22 nt, Homo sapiens
cgucuguugugcgaaugacuga

SEQ ID NO: 1479018 - RNA, 22 nt, Homo sapiens
cgucuucacuuccccacaggcu

SEQ ID NO: 1479019 - RNA, 16 nt, Homo sapiens
cgugaacugugcauag

SEQ ID NO: 1479020 - RNA, 15 nt, Homo sapiens
cgugccaaaaaucuu

SEQ ID NO: 1479021 - RNA, 17 nt, Homo sapiens
cgugcucccgaugcugc

SEQ ID NO: 1479022 - RNA, 20 nt, Homo sapiens
cgugcucccgaugcugcuau

SEQ ID NO: 1479023 - RNA, 21 nt, Homo sapiens
cguggagacugagaucacuga

SEQ ID NO: 1479024 - RNA, 15 nt, Homo sapiens
cgugguauaaucucc

SEQ ID NO: 1479025 - RNA, 13 nt, Homo sapiens
cguggucccugag

SEQ ID NO: 1479026 - RNA, 20 nt, Homo sapiens
cguguccagcacagaaggaa

SEQ ID NO: 1479027 - RNA, 16 nt, Homo sapiens
cguguggaucuugcca

SEQ ID NO: 1479028 - RNA, 15 nt, Homo sapiens
cguucugugcacaaa

SEQ ID NO: 1479029 - RNA, 22 nt, Homo sapiens
cguugacaaguuuuguggggcu

SEQ ID NO: 1479030 - RNA, 17 nt, Homo sapiens
cguugggagccuagcuc

SEQ ID NO: 1479031 - RNA, 23 nt, Homo sapiens
cguuuccugagaagugucuaaaa

SEQ ID NO: 1479032 - RNA, 22 nt, Homo sapiens
cguuucuccaccuagacuguaa

SEQ ID NO: 1479033 - RNA, 13 nt, Homo sapiens
cguuuuauuccag

SEQ ID NO: 1479034 - RNA, 18 nt, Homo sapiens
cuaaaaaacagaggccau

SEQ ID NO: 1479035 - RNA, 15 nt, Homo sapiens
cuaaaaagauuagca

SEQ ID NO: 1479036 - RNA, 12 nt, Homo sapiens
cuaaaacugcuc

SEQ ID NO: 1479037 - RNA, 14 nt, Homo sapiens
cuaaaacuggcaaa

SEQ ID NO: 1479038 - RNA, 14 nt, Homo sapiens
cuaaaacuuaacau

SEQ ID NO: 1479039 - RNA, 18 nt, Homo sapiens
cuaaaacuuaacauucau

SEQ ID NO: 1479040 - RNA, 18 nt, Homo sapiens
cuaaaagaaaaaggaacu

SEQ ID NO: 1479041 - RNA, 14 nt, Homo sapiens
cuaaaagcuuuaaa

SEQ ID NO: 1479042 - RNA, 19 nt, Homo sapiens
cuaaaauuagaugaacuca

SEQ ID NO: 1479043 - RNA, 14 nt, Homo sapiens
cuaaacagauauaa

SEQ ID NO: 1479044 - RNA, 18 nt, Homo sapiens
cuaaaccaaggacugagc

SEQ ID NO: 1479045 - RNA, 16 nt, Homo sapiens
cuaaacccaauccaaa

SEQ ID NO: 1479046 - RNA, 17 nt, Homo sapiens
cuaaaccgauaaugcau

SEQ ID NO: 1479047 - RNA, 16 nt, Homo sapiens
cuaaacggauuccaaa

SEQ ID NO: 1479048 - RNA, 21 nt, Homo sapiens
cuaaagcagaggcaacacugg

SEQ ID NO: 1479049 - RNA, 18 nt, Homo sapiens
cuaaaggacucuccagcc

SEQ ID NO: 1479050 - RNA, 16 nt, Homo sapiens
cuaaaggugcacugcu

SEQ ID NO: 1479051 - RNA, 21 nt, Homo sapiens
cuaaaguacagccuggaccac

SEQ ID NO: 1479052 - RNA, 13 nt, Homo sapiens
cuaaauaaauggg

SEQ ID NO: 1479053 - RNA, 14 nt, Homo sapiens
cuaaaugaacuaau

SEQ ID NO: 1479054 - RNA, 18 nt, Homo sapiens
cuaaaugaauguuuacac

SEQ ID NO: 1479055 - RNA, 20 nt, Homo sapiens
cuaaauuuucugaaacugca

SEQ ID NO: 1479056 - RNA, 22 nt, Homo sapiens
cuaacaaguagcacccuggauu

SEQ ID NO: 1479057 - RNA, 13 nt, Homo sapiens
cuaacacuggcau

SEQ ID NO: 1479058 - RNA, 18 nt, Homo sapiens
cuaaccaaaucucucaaa

SEQ ID NO: 1479059 - RNA, 23 nt, Homo sapiens
cuaaccacuuagcaugugugauu

SEQ ID NO: 1479060 - RNA, 17 nt, Homo sapiens
cuaaccagccuggucaa

SEQ ID NO: 1479061 - RNA, 18 nt, Homo sapiens
cuaaccuugaaugcugcc

SEQ ID NO: 1479062 - RNA, 19 nt, Homo sapiens
cuaacuauauuugcuuuuu

SEQ ID NO: 1479063 - RNA, 16 nt, Homo sapiens
cuaacugcagaccaug

SEQ ID NO: 1479064 - RNA, 20 nt, Homo sapiens
cuaagaagcgagcacugacc

SEQ ID NO: 1479065 - RNA, 15 nt, Homo sapiens
cuaagauaguaacaa

SEQ ID NO: 1479066 - RNA, 12 nt, Homo sapiens
cuaagcacaaag

SEQ ID NO: 1479067 - RNA, 21 nt, Homo sapiens
cuaagcacuuuauaaauauca

SEQ ID NO: 1479068 - RNA, 13 nt, Homo sapiens
cuaagccacucuu

SEQ ID NO: 1479069 - RNA, 14 nt, Homo sapiens
cuugaguuggagua

SEQ ID NO: 1479070 - RNA, 14 nt, Homo sapiens
cuugauaaacuagg

SEQ ID NO: 1479071 - RNA, 17 nt, Homo sapiens
cuugaucucucuugucc

SEQ ID NO: 1479072 - RNA, 13 nt, Homo sapiens
cuugaugauacaa

SEQ ID NO: 1479073 - RNA, 13 nt, Homo sapiens
cuugauggugaca

SEQ ID NO: 1479074 - RNA, 20 nt, Homo sapiens
cuugauggugacagcugcaa

SEQ ID NO: 1479075 - RNA, 20 nt, Homo sapiens
cuugauuuagcacuauuuac

SEQ ID NO: 1479076 - RNA, 18 nt, Homo sapiens
cuugcaggugacauuugc

SEQ ID NO: 1479077 - RNA, 14 nt, Homo sapiens
cuugccacauuucu

SEQ ID NO: 1479078 - RNA, 23 nt, Homo sapiens
cuugccaccccacccucccugga

SEQ ID NO: 1479079 - RNA, 21 nt, Homo sapiens
cuugcuaaaagauuauagaag

SEQ ID NO: 1479080 - RNA, 16 nt, Homo sapiens
cuugcugauggcuuga

SEQ ID NO: 1479081 - RNA, 21 nt, Homo sapiens
cuugcuuccccuuuugccaau

SEQ ID NO: 1479082 - RNA, 19 nt, Homo sapiens
cuugcuuuuugcccguuga

SEQ ID NO: 1479083 - RNA, 23 nt, Homo sapiens
cuuggaaauagaaagaagccaua

SEQ ID NO: 1479084 - RNA, 19 nt, Homo sapiens
cuuggacaggagucagugu

SEQ ID NO: 1479085 - RNA, 21 nt, Homo sapiens
cuuggagaaugugagaagcca

SEQ ID NO: 1479086 - RNA, 13 nt, Homo sapiens
cuuggaggccacc

SEQ ID NO: 1479087 - RNA, 21 nt, Homo sapiens
cuuggauuuuccugaaagugu

SEQ ID NO: 1479088 - RNA, 22 nt, Homo sapiens
cuuggcaaaagccuuguguaua

SEQ ID NO: 1479089 - RNA, 23 nt, Homo sapiens
cuuggcacacagcaggcuuucaa

SEQ ID NO: 1479090 - RNA, 16 nt, Homo sapiens
cuuggcaccagacacc

SEQ ID NO: 1479091 - RNA, 23 nt, Homo sapiens
cuuggcccaggauuauugucaaa

SEQ ID NO: 1479092 - RNA, 22 nt, Homo sapiens
cuuggccggauguccucagggc

SEQ ID NO: 1479093 - RNA, 23 nt, Homo sapiens
cuuggccucccaaagugcugaga

SEQ ID NO: 1479094 - RNA, 16 nt, Homo sapiens
cuuggcucgaugcugu

SEQ ID NO: 1479095 - RNA, 22 nt, Homo sapiens
cuuggcuuacugcagccuuugc

SEQ ID NO: 1479096 - RNA, 21 nt, Homo sapiens
cuugggaaaaaaacuuggcac

SEQ ID NO: 1479097 - RNA, 21 nt, Homo sapiens
cuugggaaacuauucaugaau

SEQ ID NO: 1479098 - RNA, 20 nt, Homo sapiens
cuugggggaacgaugugucu

SEQ ID NO: 1479099 - RNA, 15 nt, Homo sapiens
cuugggggucagggg

SEQ ID NO: 1479100 - RNA, 13 nt, Homo sapiens
cuuggugcucugu

SEQ ID NO: 1479101 - RNA, 14 nt, Homo sapiens
cuuggugcugguuu

SEQ ID NO: 1479102 - RNA, 14 nt, Homo sapiens
cuuggugguggaug

SEQ ID NO: 1479103 - RNA, 15 nt, Homo sapiens
cuugguguaauuuga

SEQ ID NO: 1479104 - RNA, 17 nt, Homo sapiens
cuugguuaaaauggcua

SEQ ID NO: 1479105 - RNA, 16 nt, Homo sapiens
cuugguuccuucugcc

SEQ ID NO: 1479106 - RNA, 15 nt, Homo sapiens
cuuguaaagacugua

SEQ ID NO: 1479107 - RNA, 17 nt, Homo sapiens
cuuguaaucaagccuuu

SEQ ID NO: 1479108 - RNA, 20 nt, Homo sapiens
cuuguacccccagguggaag

SEQ ID NO: 1479109 - RNA, 17 nt, Homo sapiens
cuuguagaguggugcug

SEQ ID NO: 1479110 - RNA, 13 nt, Homo sapiens
cuugucauuccag

SEQ ID NO: 1479111 - RNA, 22 nt, Homo sapiens
cuuguccacccaccuaugugcc

SEQ ID NO: 1479112 - RNA, 13 nt, Homo sapiens
cuuguccugaugc

SEQ ID NO: 1479113 - RNA, 15 nt, Homo sapiens
cuuguggcacuccaa

SEQ ID NO: 1479114 - RNA, 22 nt, Homo sapiens
cuuguggcuucucucucuagca

SEQ ID NO: 1479115 - RNA, 14 nt, Homo sapiens
cuugugguguaaag

SEQ ID NO: 1479116 - RNA, 19 nt, Homo sapiens
cuugugguguaaagcuggc

SEQ ID NO: 1479117 - RNA, 19 nt, Homo sapiens
cuugugugugggcugugag

SEQ ID NO: 1479118 - RNA, 15 nt, Homo sapiens
cuuguguuugcugcu

SEQ ID NO: 1479119 - RNA, 13 nt, Homo sapiens
cuuguuagauuca

SEQ ID NO: 1479120 - RNA, 23 nt, Homo sapiens
cuuguuccccacugacagccucc

SEQ ID NO: 1479121 - RNA, 18 nt, Homo sapiens
cuuguuuuacccuauaca

SEQ ID NO: 1479122 - RNA, 16 nt, Homo sapiens
cuuguuuuaugcucag

SEQ ID NO: 1479123 - RNA, 23 nt, Homo sapiens
cuuguuuugagguagaaaugcaa

SEQ ID NO: 1479124 - RNA, 20 nt, Homo sapiens
cuuuaaaaccauaucagaga

SEQ ID NO: 1479125 - RNA, 20 nt, Homo sapiens
cuuuaaaauuacaacuaagu

SEQ ID NO: 1479126 - RNA, 16 nt, Homo sapiens
cuuuaaacaaauucau

SEQ ID NO: 1479127 - RNA, 14 nt, Homo sapiens
cuuuaaacauugac

SEQ ID NO: 1479128 - RNA, 14 nt, Homo sapiens
cuuuaacugacuua

SEQ ID NO: 1479129 - RNA, 22 nt, Homo sapiens
cuuuaagaagcaguguuuuaga

SEQ ID NO: 1479130 - RNA, 19 nt, Homo sapiens
cuuuaagggcaugccuugu

SEQ ID NO: 1479131 - RNA, 16 nt, Homo sapiens
cuuuaauccaguguua

SEQ ID NO: 1479132 - RNA, 19 nt, Homo sapiens
cuuuaaucuucaguuuuau

SEQ ID NO: 1479133 - RNA, 11 nt, Homo sapiens
cuuuaauuuca

SEQ ID NO: 1479134 - RNA, 16 nt, Homo sapiens
cuuuacaauuucacuu

SEQ ID NO: 1479135 - RNA, 16 nt, Homo sapiens
cuuuacauggaugcca

SEQ ID NO: 1479136 - RNA, 18 nt, Homo sapiens
cuuuacuguuagucauuu

SEQ ID NO: 1479137 - RNA, 13 nt, Homo sapiens
cuuuacuucucac

SEQ ID NO: 1479138 - RNA, 15 nt, Homo sapiens
cuuuagaaaaggcau

SEQ ID NO: 1479139 - RNA, 18 nt, Homo sapiens
cuuuagcaagugugcacu

SEQ ID NO: 1479140 - RNA, 13 nt, Homo sapiens
cuuuagcaugcua

SEQ ID NO: 1479141 - RNA, 19 nt, Homo sapiens
cuuuaguaucaguguuuua

SEQ ID NO: 1479142 - RNA, 12 nt, Homo sapiens
cuuuaucacaac

SEQ ID NO: 1479143 - RNA, 17 nt, Homo sapiens
cuuuaucuugacauuca

SEQ ID NO: 1479144 - RNA, 13 nt, Homo sapiens
cuuuauguaucuc

SEQ ID NO: 1479145 - RNA, 14 nt, Homo sapiens
cuuucacacacaca

SEQ ID NO: 1479146 - RNA, 14 nt, Homo sapiens
cuuucaggacucua

SEQ ID NO: 1479147 - RNA, 18 nt, Homo sapiens
cuuucauuauagcagaga

SEQ ID NO: 1479148 - RNA, 20 nt, Homo sapiens
cuuuccauccauuaccucca

SEQ ID NO: 1479149 - RNA, 21 nt, Homo sapiens
cuuuccauccauuaccuccau

SEQ ID NO: 1479150 - RNA, 22 nt, Homo sapiens
cuuucccagucccauuccucag

SEQ ID NO: 1479151 - RNA, 13 nt, Homo sapiens
cuuucccuuccag

SEQ ID NO: 1479152 - RNA, 13 nt, Homo sapiens
cuuuccuccugag

SEQ ID NO: 1479153 - RNA, 16 nt, Homo sapiens
cuuuccucgccugaca

SEQ ID NO: 1479154 - RNA, 14 nt, Homo sapiens
cuuuccugcucugg

SEQ ID NO: 1479155 - RNA, 20 nt, Homo sapiens
cuuuccugguuuucaucagg

SEQ ID NO: 1479156 - RNA, 13 nt, Homo sapiens
cuuucgaggccug

SEQ ID NO: 1479157 - RNA, 17 nt, Homo sapiens
cuuucggggugcuccug

SEQ ID NO: 1479158 - RNA, 14 nt, Homo sapiens
cuuucuaaugcuga

SEQ ID NO: 1479159 - RNA, 22 nt, Homo sapiens
cuuucuacaacugauugcaaca

SEQ ID NO: 1479160 - RNA, 22 nt, Homo sapiens
cuuucuaggagggagacacugg

SEQ ID NO: 1479161 - RNA, 23 nt, Homo sapiens
cuuucuaggagggagacacuggc

SEQ ID NO: 1479162 - RNA, 18 nt, Homo sapiens
cuuucugaaauuagggcc

SEQ ID NO: 1479163 - RNA, 16 nt, Homo sapiens
cuuucugacaaaaagu

SEQ ID NO: 1479164 - RNA, 20 nt, Homo sapiens
cuuucugcaggaaauaguca

SEQ ID NO: 1479165 - RNA, 18 nt, Homo sapiens
cuuucugccaacuuuguu

SEQ ID NO: 1479166 - RNA, 15 nt, Homo sapiens
cuuucugcuuugcac

SEQ ID NO: 1479167 - RNA, 14 nt, Homo sapiens
cuuucugggagcag

SEQ ID NO: 1479168 - RNA, 20 nt, Homo sapiens
cuuucuugaauuagcauuuu

SEQ ID NO: 1479169 - RNA, 12 nt, Homo sapiens
cuuucuugcucc

SEQ ID NO: 1479170 - RNA, 15 nt, Homo sapiens
cuuugaagaaaaaga

SEQ ID NO: 1479171 - RNA, 17 nt, Homo sapiens
cuuugaguuuuguauuc

SEQ ID NO: 1479172 - RNA, 21 nt, Homo sapiens
gaaaauauuuuguugccuuca

SEQ ID NO: 1479173 - RNA, 15 nt, Homo sapiens
gaaaauccaucucau

SEQ ID NO: 1479174 - RNA, 17 nt, Homo sapiens
gaaaaugaaucuucaca

SEQ ID NO: 1479175 - RNA, 15 nt, Homo sapiens
gaaaaugacucuggg

SEQ ID NO: 1479176 - RNA, 14 nt, Homo sapiens
gaaaauguacaaua

SEQ ID NO: 1479177 - RNA, 17 nt, Homo sapiens
gaaaaugucacauucua

SEQ ID NO: 1479178 - RNA, 15 nt, Homo sapiens
gaaaaugugacccag

SEQ ID NO: 1479179 - RNA, 22 nt, Homo sapiens
gaaaauguguaauucaaaagau

SEQ ID NO: 1479180 - RNA, 18 nt, Homo sapiens
gaaacacagcaacaauga

SEQ ID NO: 1479181 - RNA, 16 nt, Homo sapiens
gaaacacugugcaaag

SEQ ID NO: 1479182 - RNA, 22 nt, Homo sapiens
gaaacagcaggacuuguuuaca

SEQ ID NO: 1479183 - RNA, 17 nt, Homo sapiens
gaaacagccauguccaa

SEQ ID NO: 1479184 - RNA, 12 nt, Homo sapiens
gaaacaggaaac

SEQ ID NO: 1479185 - RNA, 15 nt, Homo sapiens
gaaaccauuuuccca

SEQ ID NO: 1479186 - RNA, 14 nt, Homo sapiens
gaaacccccagugu

SEQ ID NO: 1479187 - RNA, 17 nt, Homo sapiens
gaaacuaagagcucuca

SEQ ID NO: 1479188 - RNA, 17 nt, Homo sapiens
gaaacuagcuuuugcca

SEQ ID NO: 1479189 - RNA, 15 nt, Homo sapiens
gaaacuauacauuua

SEQ ID NO: 1479190 - RNA, 15 nt, Homo sapiens
gaaacuauucaugaa

SEQ ID NO: 1479191 - RNA, 14 nt, Homo sapiens
gaaacucacacucc

SEQ ID NO: 1479192 - RNA, 21 nt, Homo sapiens
gaaacucaguaugcugccccu

SEQ ID NO: 1479193 - RNA, 21 nt, Homo sapiens
gaaacucuuaucucagucaug

SEQ ID NO: 1479194 - RNA, 16 nt, Homo sapiens
gaaagaaaaagcaaua

SEQ ID NO: 1479195 - RNA, 18 nt, Homo sapiens
gaaagacaagacauugug

SEQ ID NO: 1479196 - RNA, 13 nt, Homo sapiens
gaaagaucaaaga

SEQ ID NO: 1479197 - RNA, 14 nt, Homo sapiens
gaaagaucaaagac

SEQ ID NO: 1479198 - RNA, 18 nt, Homo sapiens
gaaagaugggcaaaagac

SEQ ID NO: 1479199 - RNA, 23 nt, Homo sapiens
gaaagcaggauguaguucugcca

SEQ ID NO: 1479200 - RNA, 22 nt, Homo sapiens
gaaagcuguggccagcuuguua

SEQ ID NO: 1479201 - RNA, 11 nt, Homo sapiens
gaaagcuuugu

SEQ ID NO: 1479202 - RNA, 18 nt, Homo sapiens
gaaaggaagccuugcuca

SEQ ID NO: 1479203 - RNA, 21 nt, Homo sapiens
gaaagguacuauauuugcuag

SEQ ID NO: 1479204 - RNA, 16 nt, Homo sapiens
gaaagguuauguuagc

SEQ ID NO: 1479205 - RNA, 20 nt, Homo sapiens
gaaaguaaaaaguugcuucu

SEQ ID NO: 1479206 - RNA, 19 nt, Homo sapiens
gaaaguacacucugcuguu

SEQ ID NO: 1479207 - RNA, 12 nt, Homo sapiens
gaaagugauauc

SEQ ID NO: 1479208 - RNA, 22 nt, Homo sapiens
gaaaguucccccaucaguuccc

SEQ ID NO: 1479209 - RNA, 13 nt, Homo sapiens
gaaauaaaacuac

SEQ ID NO: 1479210 - RNA, 18 nt, Homo sapiens
gaaauaaaaggaagccaa

SEQ ID NO: 1479211 - RNA, 15 nt, Homo sapiens
gaaauaaauguaccu

SEQ ID NO: 1479212 - RNA, 15 nt, Homo sapiens
gaaauaacaauguua

SEQ ID NO: 1479213 - RNA, 18 nt, Homo sapiens
gaaauaauaaaacuauua

SEQ ID NO: 1479214 - RNA, 23 nt, Homo sapiens
gaaauacacagugcugaccagac

SEQ ID NO: 1479215 - RNA, 14 nt, Homo sapiens
gaaauagaacuaca

SEQ ID NO: 1479216 - RNA, 16 nt, Homo sapiens
gaaauaguaccuucaa

SEQ ID NO: 1479217 - RNA, 22 nt, Homo sapiens
gaaauauauauguguguguaug

SEQ ID NO: 1479218 - RNA, 20 nt, Homo sapiens
gaaauaugugguuuccacga

SEQ ID NO: 1479219 - RNA, 22 nt, Homo sapiens
gaaaucuuguuggcaaaucaga

SEQ ID NO: 1479220 - RNA, 9 nt, Homo sapiens
gaaaugcaa

SEQ ID NO: 1479221 - RNA, 11 nt, Homo sapiens
gaaaugcaaaa

SEQ ID NO: 1479222 - RNA, 12 nt, Homo sapiens
gaaaugcaaaau

SEQ ID NO: 1479223 - RNA, 16 nt, Homo sapiens
gaaaugccacgugguc

SEQ ID NO: 1479224 - RNA, 18 nt, Homo sapiens
gaaauguaauacuggaau

SEQ ID NO: 1479225 - RNA, 14 nt, Homo sapiens
gaaauguaugugcu

SEQ ID NO: 1479226 - RNA, 11 nt, Homo sapiens
gaaauuaacac

SEQ ID NO: 1479227 - RNA, 21 nt, Homo sapiens
gaaauuacuggaaggcuucca

SEQ ID NO: 1479228 - RNA, 20 nt, Homo sapiens
gaaauucuaaagagcacuua

SEQ ID NO: 1479229 - RNA, 19 nt, Homo sapiens
gaaauugcauuuccugaca

SEQ ID NO: 1479230 - RNA, 13 nt, Homo sapiens
gaaauuucacuuc

SEQ ID NO: 1479231 - RNA, 19 nt, Homo sapiens
gaacaaaguccacaguuua

SEQ ID NO: 1479232 - RNA, 12 nt, Homo sapiens
gaacaacacuuc

SEQ ID NO: 1479233 - RNA, 15 nt, Homo sapiens
gaacacacauuauua

SEQ ID NO: 1479234 - RNA, 18 nt, Homo sapiens
gaacacgagacagcuugg

SEQ ID NO: 1479235 - RNA, 20 nt, Homo sapiens
gaacacguuggcucaguccu

SEQ ID NO: 1479236 - RNA, 23 nt, Homo sapiens
gaacacuaacuaugcauggugcc

SEQ ID NO: 1479237 - RNA, 18 nt, Homo sapiens
gaacacucuuuugcuuua

SEQ ID NO: 1479238 - RNA, 21 nt, Homo sapiens
gaacacuggcaacaacaaagc

SEQ ID NO: 1479239 - RNA, 23 nt, Homo sapiens
gaacagaauguuuuacugugaaa

SEQ ID NO: 1479240 - RNA, 20 nt, Homo sapiens
gaacagacaacagaagucau

SEQ ID NO: 1479241 - RNA, 13 nt, Homo sapiens
gaacagaccagug

SEQ ID NO: 1479242 - RNA, 13 nt, Homo sapiens
gaacagagugcaa

SEQ ID NO: 1479243 - RNA, 15 nt, Homo sapiens
gaacagagugcaacc

SEQ ID NO: 1479244 - RNA, 22 nt, Homo sapiens
gaacagcacuggggagucuuug

SEQ ID NO: 1479245 - RNA, 17 nt, Homo sapiens
gaacagcaguguucuca

SEQ ID NO: 1479246 - RNA, 15 nt, Homo sapiens
gaacagcuucagguu

SEQ ID NO: 1479247 - RNA, 20 nt, Homo sapiens
gaacagggucauguuugcag

SEQ ID NO: 1479248 - RNA, 13 nt, Homo sapiens
gaacagguucuua

SEQ ID NO: 1479249 - RNA, 13 nt, Homo sapiens
gaacaguguuucc

SEQ ID NO: 1479250 - RNA, 22 nt, Homo sapiens
gaacaguugcauuuagcuucuu

SEQ ID NO: 1479251 - RNA, 16 nt, Homo sapiens
gaacauagaacucugg

SEQ ID NO: 1479252 - RNA, 17 nt, Homo sapiens
gaacauguuuaaugggu

SEQ ID NO: 1479253 - RNA, 13 nt, Homo sapiens
gaaccacuaugaa

SEQ ID NO: 1479254 - RNA, 21 nt, Homo sapiens
gaaccccagcuucccuccagc

SEQ ID NO: 1479255 - RNA, 17 nt, Homo sapiens
gaacccucugucccacc

SEQ ID NO: 1479256 - RNA, 13 nt, Homo sapiens
gaaccguuuugaa

SEQ ID NO: 1479257 - RNA, 15 nt, Homo sapiens
gaaccucacugaaaa

SEQ ID NO: 1479258 - RNA, 12 nt, Homo sapiens
gaaccucuccau

SEQ ID NO: 1479259 - RNA, 20 nt, Homo sapiens
ccuuggcuuaccugaccucu

SEQ ID NO: 1479260 - RNA, 20 nt, Homo sapiens
ccuugggcuauuuggacuca

SEQ ID NO: 1479261 - RNA, 14 nt, Homo sapiens
ccuugggcucugcu

SEQ ID NO: 1479262 - RNA, 14 nt, Homo sapiens
ccuugguguucaaa

SEQ ID NO: 1479263 - RNA, 17 nt, Homo sapiens
ccuuguccucagggcua

SEQ ID NO: 1479264 - RNA, 21 nt, Homo sapiens
ccuuguguacaguuauuuaug

SEQ ID NO: 1479265 - RNA, 21 nt, Homo sapiens
ccuuuaaagaugaacucugaa

SEQ ID NO: 1479266 - RNA, 22 nt, Homo sapiens
ccuuuaacuuucagaggcaaua

SEQ ID NO: 1479267 - RNA, 16 nt, Homo sapiens
ccuuuacuugucuuuc

SEQ ID NO: 1479268 - RNA, 18 nt, Homo sapiens
ccuuuauagagugucuca

SEQ ID NO: 1479269 - RNA, 13 nt, Homo sapiens
ccuuuaugugaau

SEQ ID NO: 1479270 - RNA, 22 nt, Homo sapiens
ccuuucaaauuuuuacugagaa

SEQ ID NO: 1479271 - RNA, 19 nt, Homo sapiens
ccuuucauggucugcugag

SEQ ID NO: 1479272 - RNA, 22 nt, Homo sapiens
ccuuuccaagcuccucgugaua

SEQ ID NO: 1479273 - RNA, 11 nt, Homo sapiens
ccuuuccauaa

SEQ ID NO: 1479274 - RNA, 13 nt, Homo sapiens
ccuuuccuuccag

SEQ ID NO: 1479275 - RNA, 17 nt, Homo sapiens
ccuuucgagcucugcag

SEQ ID NO: 1479276 - RNA, 14 nt, Homo sapiens
ccuuucucauccca

SEQ ID NO: 1479277 - RNA, 16 nt, Homo sapiens
ccuuucuugaauuagc

SEQ ID NO: 1479278 - RNA, 21 nt, Homo sapiens
ccuuucuugaauuagcauuuu

SEQ ID NO: 1479279 - RNA, 17 nt, Homo sapiens
ccuuugaagccucagcu

SEQ ID NO: 1479280 - RNA, 15 nt, Homo sapiens
ccuuugagacaguuu

SEQ ID NO: 1479281 - RNA, 16 nt, Homo sapiens
ccuuugaucaguauaa

SEQ ID NO: 1479282 - RNA, 21 nt, Homo sapiens
ccuuugcaguuggacucucag

SEQ ID NO: 1479283 - RNA, 21 nt, Homo sapiens
ccuuugccuuagcagggguga

SEQ ID NO: 1479284 - RNA, 13 nt, Homo sapiens
ccuuugcuucaaa

SEQ ID NO: 1479285 - RNA, 16 nt, Homo sapiens
ccuuugcuucaaauaa

SEQ ID NO: 1479286 - RNA, 14 nt, Homo sapiens
ccuuuggggagcag

SEQ ID NO: 1479287 - RNA, 16 nt, Homo sapiens
ccuuugugcacauuua

SEQ ID NO: 1479288 - RNA, 13 nt, Homo sapiens
ccuuuuauacuga

SEQ ID NO: 1479289 - RNA, 13 nt, Homo sapiens
ccuuuucauuuaa

SEQ ID NO: 1479290 - RNA, 22 nt, Homo sapiens
ccuuuuccccaaccacagagaa

SEQ ID NO: 1479291 - RNA, 13 nt, Homo sapiens
ccuuuucuguucu

SEQ ID NO: 1479292 - RNA, 16 nt, Homo sapiens
ccuuuugcugcgcacc

SEQ ID NO: 1479293 - RNA, 14 nt, Homo sapiens
ccuuuugugugaug

SEQ ID NO: 1479294 - RNA, 13 nt, Homo sapiens
ccuuuuucaauga

SEQ ID NO: 1479295 - RNA, 22 nt, Homo sapiens
ccuuuuuuaagauuuuucucaa

SEQ ID NO: 1479296 - RNA, 19 nt, Homo sapiens
ccuuuuuuauacaggaaaa

SEQ ID NO: 1479297 - RNA, 20 nt, Homo sapiens
cgaaauaacaauguuaagga

SEQ ID NO: 1479298 - RNA, 14 nt, Homo sapiens
cgaaaucaaaccac

SEQ ID NO: 1479299 - RNA, 17 nt, Homo sapiens
cgaaauuggauuaugca

SEQ ID NO: 1479300 - RNA, 19 nt, Homo sapiens
cgaagccuuauuucuagaa

SEQ ID NO: 1479301 - RNA, 19 nt, Homo sapiens
cgaagucgccacguggccu

SEQ ID NO: 1479302 - RNA, 17 nt, Homo sapiens
cgaagugcugagauuac

SEQ ID NO: 1479303 - RNA, 17 nt, Homo sapiens
cgagagcagacaccagc

SEQ ID NO: 1479304 - RNA, 21 nt, Homo sapiens
cgagaucgcgccacugcacuc

SEQ ID NO: 1479305 - RNA, 21 nt, Homo sapiens
cgagcaccuccagccugaaca

SEQ ID NO: 1479306 - RNA, 15 nt, Homo sapiens
cgagcacugugagca

SEQ ID NO: 1479307 - RNA, 18 nt, Homo sapiens
cgaggaguaacaauacaa

SEQ ID NO: 1479308 - RNA, 22 nt, Homo sapiens
cgaggcaggccgacuguacuaa

SEQ ID NO: 1479309 - RNA, 18 nt, Homo sapiens
cgaggggcucucagcuca

SEQ ID NO: 1479310 - RNA, 14 nt, Homo sapiens
cgagucucuucucc

SEQ ID NO: 1479311 - RNA, 17 nt, Homo sapiens
cgaugcagugcuuccaa

SEQ ID NO: 1479312 - RNA, 12 nt, Homo sapiens
cgaugcugcuau

SEQ ID NO: 1479313 - RNA, 17 nt, Homo sapiens
cgauggaucuguggucc

SEQ ID NO: 1479314 - RNA, 15 nt, Homo sapiens
cgauucacuguauaa

SEQ ID NO: 1479315 - RNA, 20 nt, Homo sapiens
cgauucaucuacccugcuga

SEQ ID NO: 1479316 - RNA, 13 nt, Homo sapiens
cgcaacaguuuuu

SEQ ID NO: 1479317 - RNA, 23 nt, Homo sapiens
cgcacaccggcuuaacacuauca

SEQ ID NO: 1479318 - RNA, 13 nt, Homo sapiens
cgcacagugugag

SEQ ID NO: 1479319 - RNA, 13 nt, Homo sapiens
cgcacaugcacac

SEQ ID NO: 1479320 - RNA, 20 nt, Homo sapiens
cgcaccauucuccugccuca

SEQ ID NO: 1479321 - RNA, 22 nt, Homo sapiens
cgcacccaguuugauaccugca

SEQ ID NO: 1479322 - RNA, 18 nt, Homo sapiens
cgcaccuaccaucaggga

SEQ ID NO: 1479323 - RNA, 13 nt, Homo sapiens
cgcacgcacacac

SEQ ID NO: 1479324 - RNA, 20 nt, Homo sapiens
cgcagacacacccacagaag

SEQ ID NO: 1479325 - RNA, 14 nt, Homo sapiens
cgcagacgggcaca

SEQ ID NO: 1479326 - RNA, 19 nt, Homo sapiens
cgcagggaugucgcugggg

SEQ ID NO: 1479327 - RNA, 17 nt, Homo sapiens
cgccaggcugaccacag

SEQ ID NO: 1479328 - RNA, 20 nt, Homo sapiens
cgcccaccucggccucccaa

SEQ ID NO: 1479329 - RNA, 23 nt, Homo sapiens
cgccccagcaggugcugacuuca

SEQ ID NO: 1479330 - RNA, 19 nt, Homo sapiens
cgcccucacugcaggcucc

SEQ ID NO: 1479331 - RNA, 17 nt, Homo sapiens
cgcccuccucccuguca

SEQ ID NO: 1479332 - RNA, 19 nt, Homo sapiens
cgcccuccucccugucaua

SEQ ID NO: 1479333 - RNA, 20 nt, Homo sapiens
cgccgcagguguuuggcacc

SEQ ID NO: 1479334 - RNA, 11 nt, Homo sapiens
cgccuguaauu

SEQ ID NO: 1479335 - RNA, 15 nt, Homo sapiens
cgccuucucccacau

SEQ ID NO: 1479336 - RNA, 13 nt, Homo sapiens
cgccuuucccacc

SEQ ID NO: 1479337 - RNA, 14 nt, Homo sapiens
cgcguacagaucuc

SEQ ID NO: 1479338 - RNA, 15 nt, Homo sapiens
cgcucgccacagucc

SEQ ID NO: 1479339 - RNA, 13 nt, Homo sapiens
cgcugacucuggg

SEQ ID NO: 1479340 - RNA, 21 nt, Homo sapiens
cgcugagugggagaaggcagu

SEQ ID NO: 1479341 - RNA, 14 nt, Homo sapiens
cgcugucacuggcu

SEQ ID NO: 1479342 - RNA, 15 nt, Homo sapiens
ccugcaguuggcaga

SEQ ID NO: 1479343 - RNA, 15 nt, Homo sapiens
ccugcaucugugaaa

SEQ ID NO: 1479344 - RNA, 18 nt, Homo sapiens
ccugccacagccagagga

SEQ ID NO: 1479345 - RNA, 15 nt, Homo sapiens
ccugccaggcugcua

SEQ ID NO: 1479346 - RNA, 15 nt, Homo sapiens
ccugccauggaucuc

SEQ ID NO: 1479347 - RNA, 13 nt, Homo sapiens
ccugccgucuuca

SEQ ID NO: 1479348 - RNA, 22 nt, Homo sapiens
ccugccgucuucacuuccccac

SEQ ID NO: 1479349 - RNA, 20 nt, Homo sapiens
ccugccucagccucccaauu

SEQ ID NO: 1479350 - RNA, 22 nt, Homo sapiens
ccugccucccaagguccucuca

SEQ ID NO: 1479351 - RNA, 22 nt, Homo sapiens
ccugccuuuuaacguagauaua

SEQ ID NO: 1479352 - RNA, 20 nt, Homo sapiens
ccugcgccuccagagguccu

SEQ ID NO: 1479353 - RNA, 19 nt, Homo sapiens
ccugcgcgucaucucugac

SEQ ID NO: 1479354 - RNA, 21 nt, Homo sapiens
ccugcguguccccgugcagua

SEQ ID NO: 1479355 - RNA, 18 nt, Homo sapiens
ccugcucacaaaaucacu

SEQ ID NO: 1479356 - RNA, 23 nt, Homo sapiens
ccugcuccaagggacccuuugcc

SEQ ID NO: 1479357 - RNA, 14 nt, Homo sapiens
ccugcucccacaga

SEQ ID NO: 1479358 - RNA, 19 nt, Homo sapiens
ccugcucccagcagcccua

SEQ ID NO: 1479359 - RNA, 17 nt, Homo sapiens
ccugcuccgcugcuccu

SEQ ID NO: 1479360 - RNA, 11 nt, Homo sapiens
ccugcucugcu

SEQ ID NO: 1479361 - RNA, 21 nt, Homo sapiens
ccugcugcuguguuuuugcua

SEQ ID NO: 1479362 - RNA, 17 nt, Homo sapiens
ccugcugcuucugcaaa

SEQ ID NO: 1479363 - RNA, 10 nt, Homo sapiens
ccugcuggag

SEQ ID NO: 1479364 - RNA, 20 nt, Homo sapiens
ccugcuggccccuucugggg

SEQ ID NO: 1479365 - RNA, 16 nt, Homo sapiens
ccugcuugcacuuugu

SEQ ID NO: 1479366 - RNA, 16 nt, Homo sapiens
ccugcuuugggaagcc

SEQ ID NO: 1479367 - RNA, 18 nt, Homo sapiens
ccuggaaucuacaagcca

SEQ ID NO: 1479368 - RNA, 21 nt, Homo sapiens
ccuggagacguggaaccucug

SEQ ID NO: 1479369 - RNA, 19 nt, Homo sapiens
ccuggagcccauccagucu

SEQ ID NO: 1479370 - RNA, 14 nt, Homo sapiens
ccuggagccuuuga

SEQ ID NO: 1479371 - RNA, 17 nt, Homo sapiens
ccuggaucuaccagcau

SEQ ID NO: 1479372 - RNA, 20 nt, Homo sapiens
ccuggauggggcuuccagcu

SEQ ID NO: 1479373 - RNA, 17 nt, Homo sapiens
ccuggauguacuaucca

SEQ ID NO: 1479374 - RNA, 14 nt, Homo sapiens
ccuggccaggagcu

SEQ ID NO: 1479375 - RNA, 17 nt, Homo sapiens
ccuggccaggagcucuu

SEQ ID NO: 1479376 - RNA, 16 nt, Homo sapiens
ccuggcuggugacaga

SEQ ID NO: 1479377 - RNA, 14 nt, Homo sapiens
ccugggacuuccau

SEQ ID NO: 1479378 - RNA, 21 nt, Homo sapiens
ccugggaggaaauuugaaugg

SEQ ID NO: 1479379 - RNA, 17 nt, Homo sapiens
ccugggcugucugucac

SEQ ID NO: 1479380 - RNA, 14 nt, Homo sapiens
ccuggggaugugaa

SEQ ID NO: 1479381 - RNA, 14 nt, Homo sapiens
ccuggggugcaucu

SEQ ID NO: 1479382 - RNA, 16 nt, Homo sapiens
ccugggugacagagug

SEQ ID NO: 1479383 - RNA, 19 nt, Homo sapiens
ccuggucaacauggugaaa

SEQ ID NO: 1479384 - RNA, 14 nt, Homo sapiens
ccuggucaggguga

SEQ ID NO: 1479385 - RNA, 14 nt, Homo sapiens
ccugguccuggaca

SEQ ID NO: 1479386 - RNA, 15 nt, Homo sapiens
ccuggugcugcugcu

SEQ ID NO: 1479387 - RNA, 23 nt, Homo sapiens
ccugguguaguuucuucauuuca

SEQ ID NO: 1479388 - RNA, 22 nt, Homo sapiens
ccuggugucugcccugcuggga

SEQ ID NO: 1479389 - RNA, 17 nt, Homo sapiens
ccugguuggccgugguc

SEQ ID NO: 1479390 - RNA, 15 nt, Homo sapiens
ccugguuugacucag

SEQ ID NO: 1479391 - RNA, 20 nt, Homo sapiens
ccuguaaucccagcuacucg

SEQ ID NO: 1479392 - RNA, 14 nt, Homo sapiens
ccuguacacaggcg

SEQ ID NO: 1479393 - RNA, 12 nt, Homo sapiens
ccuguaccucau

SEQ ID NO: 1479394 - RNA, 13 nt, Homo sapiens
ccuguagucccag

SEQ ID NO: 1479395 - RNA, 20 nt, Homo sapiens
ccugucaagguuuguguuac

SEQ ID NO: 1479396 - RNA, 15 nt, Homo sapiens
ccuguccagcuccaa

SEQ ID NO: 1479397 - RNA, 21 nt, Homo sapiens
ccugucccacccacacagcug

SEQ ID NO: 1479398 - RNA, 13 nt, Homo sapiens
ccugucccaugca

SEQ ID NO: 1479399 - RNA, 16 nt, Homo sapiens
ccuguccccacccucc

SEQ ID NO: 1479400 - RNA, 15 nt, Homo sapiens
ccugucccuugccuc

SEQ ID NO: 1479401 - RNA, 19 nt, Homo sapiens
ccuguccuaagcacuuuau

SEQ ID NO: 1479402 - RNA, 22 nt, Homo sapiens
ccugucuaggucuccucagggu

SEQ ID NO: 1479403 - RNA, 14 nt, Homo sapiens
ccugucuccagcug

SEQ ID NO: 1479404 - RNA, 14 nt, Homo sapiens
ccugugaaauacca

SEQ ID NO: 1479405 - RNA, 20 nt, Homo sapiens
ccugugacauguaacagcca

SEQ ID NO: 1479406 - RNA, 22 nt, Homo sapiens
ccugugcacgcgcgcgugcaca

SEQ ID NO: 1479407 - RNA, 19 nt, Homo sapiens
ccugugguuacagugcaga

SEQ ID NO: 1479408 - RNA, 15 nt, Homo sapiens
ccuguguacauauaa

SEQ ID NO: 1479409 - RNA, 14 nt, Homo sapiens
ccuguguguaggcu

SEQ ID NO: 1479410 - RNA, 22 nt, Homo sapiens
ccuguuccccaaggacucuucc

SEQ ID NO: 1479411 - RNA, 19 nt, Homo sapiens
ccuguuccuuuaaccccaa

SEQ ID NO: 1479412 - RNA, 23 nt, Homo sapiens
ccuguucuuccuccagcugcacc

SEQ ID NO: 1479413 - RNA, 17 nt, Homo sapiens
ccuuaaacuguacagaa

SEQ ID NO: 1479414 - RNA, 18 nt, Homo sapiens
ccuuaagauuuugcaccu

SEQ ID NO: 1479415 - RNA, 20 nt, Homo sapiens
ccuuaaggauaucaguaaau

SEQ ID NO: 1479416 - RNA, 15 nt, Homo sapiens
ccuuaauauguuaac

SEQ ID NO: 1479417 - RNA, 13 nt, Homo sapiens
ccuuacacagggc

SEQ ID NO: 1479418 - RNA, 16 nt, Homo sapiens
ccuuacagucacuaau

SEQ ID NO: 1479419 - RNA, 18 nt, Homo sapiens
ccuuagcccugucugcua

SEQ ID NO: 1479420 - RNA, 12 nt, Homo sapiens
ccuuauggagcu

SEQ ID NO: 1479421 - RNA, 14 nt, Homo sapiens
ccuuauuguaccuc

SEQ ID NO: 1479422 - RNA, 15 nt, Homo sapiens
ccuucaauacuuaaa

SEQ ID NO: 1479423 - RNA, 17 nt, Homo sapiens
ccuucaccagagcccau

SEQ ID NO: 1479424 - RNA, 12 nt, Homo sapiens
ccuucacuuuac

SEQ ID NO: 1479425 - RNA, 23 nt, Homo sapiens
aacuuugacaaccaugagaccac

SEQ ID NO: 1479426 - RNA, 20 nt, Homo sapiens
aacuuuggaguccccucacc

SEQ ID NO: 1479427 - RNA, 13 nt, Homo sapiens
aacuuuggcuuau

SEQ ID NO: 1479428 - RNA, 13 nt, Homo sapiens
aacuuuguauuaa

SEQ ID NO: 1479429 - RNA, 19 nt, Homo sapiens
aacuuuuuuugucuguuga

SEQ ID NO: 1479430 - RNA, 18 nt, Homo sapiens
aagaaaaacaucuuuggc

SEQ ID NO: 1479431 - RNA, 13 nt, Homo sapiens
aagaaaaggacaa
